United States Patent 12,644,137 (MATERIALS AND METHODS FOR TREATMENT OF HEMOGLOBINOPATHIES) - sequence listing, part 6

SEQ ID NO: 110973 - DNA, 22 bp, Artificial Sequence
  Synthetic oligonucleotide; CTA chr11 5390088 5390109 5390105 5390110 +
tggactcatcctgcacacagta

SEQ ID NO: 110974 - DNA, 22 bp, Artificial Sequence
  Synthetic oligonucleotide; CTC chr11 5390095 5390116 5390112 5390117 +
atcctgcacacagtagcaggcc

SEQ ID NO: 110975 - DNA, 22 bp, Artificial Sequence
  Synthetic oligonucleotide; CTG chr11 5390101 5390122 5390118 5390123 +
cacacagtagcaggcctggcct

SEQ ID NO: 110976 - DNA, 22 bp, Artificial Sequence
  Synthetic oligonucleotide; CTG chr11 5390119 5390140 5390136 5390141 +
gcctcccaagaggagcagcgcc

SEQ ID NO: 110977 - DNA, 22 bp, Artificial Sequence
  Synthetic oligonucleotide; CTC chr11 5390124 5390145 5390141 5390146 +
ccaagaggagcagcgccgtgcc

SEQ ID NO: 110978 - DNA, 22 bp, Artificial Sequence
  Synthetic oligonucleotide; CTT chr11 5390148 5390169 5390165 5390170 +
tcagacatgcaccgctcctctc

SEQ ID NO: 110979 - DNA, 22 bp, Artificial Sequence
  Synthetic oligonucleotide; TTT chr11 5390149 5390170 5390166 5390171 +
cagacatgcaccgctcctctct

SEQ ID NO: 110980 - DNA, 22 bp, Artificial Sequence
  Synthetic oligonucleotide; TTC chr11 5390150 5390171 5390167 5390172 +
agacatgcaccgctcctctctg

SEQ ID NO: 110981 - DNA, 22 bp, Artificial Sequence
  Synthetic oligonucleotide; CTC chr11 5390165 5390186 5390182 5390187 +
ctctctgtgctgtgctagtatt

SEQ ID NO: 110982 - DNA, 22 bp, Artificial Sequence
  Synthetic oligonucleotide; CTC chr11 5390168 5390189 5390185 5390190 +
tctgtgctgtgctagtattctt

SEQ ID NO: 110983 - DNA, 22 bp, Artificial Sequence
  Synthetic oligonucleotide; CTC chr11 5390170 5390191 5390187 5390192 +
tgtgctgtgctagtattctttg

SEQ ID NO: 110984 - DNA, 22 bp, Artificial Sequence
  Synthetic oligonucleotide; CTG chr11 5390172 5390193 5390189 5390194 +
tgctgtgctagtattctttgtg

SEQ ID NO: 110985 - DNA, 22 bp, Artificial Sequence
  Synthetic oligonucleotide; CTG chr11 5390177 5390198 5390194 5390199 +
tgctagtattctttgtgcccat

SEQ ID NO: 110986 - DNA, 22 bp, Artificial Sequence
  Synthetic oligonucleotide; CTA chr11 5390182 5390203 5390199 5390204 +
gtattctttgtgcccatgatgg

SEQ ID NO: 110987 - DNA, 22 bp, Artificial Sequence
  Synthetic oligonucleotide; TTC chr11 5390188 5390209 5390205 5390210 +
tttgtgcccatgatggggctgt

SEQ ID NO: 110988 - DNA, 22 bp, Artificial Sequence
  Synthetic oligonucleotide; CTT chr11 5390190 5390211 5390207 5390212 +
tgtgcccatgatggggctgtcc

SEQ ID NO: 110989 - DNA, 22 bp, Artificial Sequence
  Synthetic oligonucleotide; TTT chr11 5390191 5390212 5390208 5390213 +
gtgcccatgatggggctgtccc

SEQ ID NO: 110990 - DNA, 22 bp, Artificial Sequence
  Synthetic oligonucleotide; TTG chr11 5390192 5390213 5390209 5390214 +
tgcccatgatggggctgtccct

SEQ ID NO: 110991 - DNA, 22 bp, Artificial Sequence
  Synthetic oligonucleotide; CTG chr11 5390209 5390230 5390226 5390231 +
tccctggtgcaccgttttggga

SEQ ID NO: 110992 - DNA, 22 bp, Artificial Sequence
  Synthetic oligonucleotide; CTG chr11 5390215 5390236 5390232 5390237 +
gtgcaccgttttgggaagcatg

SEQ ID NO: 110993 - DNA, 22 bp, Artificial Sequence
  Synthetic oligonucleotide; TTT chr11 5390226 5390247 5390243 5390248 +
tgggaagcatgccccacctgct

SEQ ID NO: 110994 - DNA, 22 bp, Artificial Sequence
  Synthetic oligonucleotide; TTT chr11 5390227 5390248 5390244 5390249 +
gggaagcatgccccacctgcta

SEQ ID NO: 110995 - DNA, 22 bp, Artificial Sequence
  Synthetic oligonucleotide; TTG chr11 5390228 5390249 5390245 5390250 +
ggaagcatgccccacctgctat

SEQ ID NO: 110996 - DNA, 22 bp, Artificial Sequence
  Synthetic oligonucleotide; CTG chr11 5390246 5390267 5390263 5390268 +
ctattcatcttcttatggccaa

SEQ ID NO: 110997 - DNA, 22 bp, Artificial Sequence
  Synthetic oligonucleotide; CTA chr11 5390249 5390270 5390266 5390271 +
ttcatcttcttatggccaatgt

SEQ ID NO: 110998 - DNA, 22 bp, Artificial Sequence
  Synthetic oligonucleotide; TTC chr11 5390252 5390273 5390269 5390274 +
atcttcttatggccaatgtcta

SEQ ID NO: 110999 - DNA, 22 bp, Artificial Sequence
  Synthetic oligonucleotide; CTT chr11 5390257 5390278 5390274 5390279 +
cttatggccaatgtctaccttt

SEQ ID NO: 111000 - DNA, 22 bp, Artificial Sequence
  Synthetic oligonucleotide; TTC chr11 5390258 5390279 5390275 5390280 +
ttatggccaatgtctacctttt

SEQ ID NO: 111001 - DNA, 22 bp, Artificial Sequence
  Synthetic oligonucleotide; CTT chr11 5390260 5390281 5390277 5390282 +
atggccaatgtctacctttttg

SEQ ID NO: 111002 - DNA, 22 bp, Artificial Sequence
  Synthetic oligonucleotide; TTA chr11 5390261 5390282 5390278 5390283 +
tggccaatgtctacctttttgt

SEQ ID NO: 111003 - DNA, 22 bp, Artificial Sequence
  Synthetic oligonucleotide; CTA chr11 5390274 5390295 5390291 5390296 +
cctttttgtgcctcccatgctt

SEQ ID NO: 111004 - DNA, 22 bp, Artificial Sequence
  Synthetic oligonucleotide; CTT chr11 5390278 5390299 5390295 5390300 +
tttgtgcctcccatgcttaacc

SEQ ID NO: 111005 - DNA, 22 bp, Artificial Sequence
  Synthetic oligonucleotide; TTT chr11 5390279 5390300 5390296 5390301 +
ttgtgcctcccatgcttaaccc

SEQ ID NO: 111006 - DNA, 22 bp, Artificial Sequence
  Synthetic oligonucleotide; TTT chr11 5390280 5390301 5390297 5390302 +
tgtgcctcccatgcttaaccca

SEQ ID NO: 111007 - DNA, 22 bp, Artificial Sequence
  Synthetic oligonucleotide; TTT chr11 5390281 5390302 5390298 5390303 +
gtgcctcccatgcttaacccaa

SEQ ID NO: 111008 - DNA, 22 bp, Artificial Sequence
  Synthetic oligonucleotide; TTG chr11 5390282 5390303 5390299 5390304 +
tgcctcccatgcttaacccaat

SEQ ID NO: 111009 - DNA, 22 bp, Artificial Sequence
  Synthetic oligonucleotide; CTC chr11 5390288 5390309 5390305 5390310 +
ccatgcttaacccaatcatata

SEQ ID NO: 111010 - DNA, 22 bp, Artificial Sequence
  Synthetic oligonucleotide; CTT chr11 5390296 5390317 5390313 5390318 +
aacccaatcatatacagcatta

SEQ ID NO: 111011 - DNA, 22 bp, Artificial Sequence
  Synthetic oligonucleotide; TTA chr11 5390297 5390318 5390314 5390319 +
acccaatcatatacagcattaa

SEQ ID NO: 111012 - DNA, 22 bp, Artificial Sequence
  Synthetic oligonucleotide; TTA chr11 5390318 5390339 5390335 5390340 +
agaccaaggagatccaccgtgc

SEQ ID NO: 111013 - DNA, 22 bp, Artificial Sequence
  Synthetic oligonucleotide; TTA chr11 5390345 5390366 5390362 5390367 +
tcaagttcctaggtcttaaaaa

SEQ ID NO: 111014 - DNA, 22 bp, Artificial Sequence
  Synthetic oligonucleotide; TTC chr11 5390353 5390374 5390370 5390375 +
ctaggtcttaaaaaggccagta

SEQ ID NO: 111015 - DNA, 22 bp, Artificial Sequence
  Synthetic oligonucleotide; CTA chr11 5390356 5390377 5390373 5390378 +
ggtcttaaaaaggccagtaaat

SEQ ID NO: 111016 - DNA, 22 bp, Artificial Sequence
  Synthetic oligonucleotide; CTT chr11 5390362 5390383 5390379 5390384 +
aaaaaggccagtaaatgagtcc

SEQ ID NO: 111017 - DNA, 22 bp, Artificial Sequence
  Synthetic oligonucleotide; TTA chr11 5390363 5390384 5390380 5390385 +
aaaaggccagtaaatgagtcct

SEQ ID NO: 111018 - DNA, 22 bp, Artificial Sequence
  Synthetic oligonucleotide; CTG chr11 5390386 5390407 5390403 5390408 +
gggctaaaactccccctagagg

SEQ ID NO: 111019 - DNA, 22 bp, Artificial Sequence
  Synthetic oligonucleotide; CTA chr11 5390392 5390413 5390409 5390414 +
aaactccccctagaggcctata

SEQ ID NO: 111020 - DNA, 22 bp, Artificial Sequence
  Synthetic oligonucleotide; CTC chr11 5390398 5390419 5390415 5390420 +
cccctagaggcctataagaagg

SEQ ID NO: 111021 - DNA, 22 bp, Artificial Sequence
  Synthetic oligonucleotide; CTA chr11 5390404 5390425 5390421 5390426 +
gaggcctataagaaggccccaa

SEQ ID NO: 111022 - DNA, 22 bp, Artificial Sequence
  Synthetic oligonucleotide; CTA chr11 5390412 5390433 5390429 5390434 +
taagaaggccccaaattggact

SEQ ID NO: 111023 - DNA, 22 bp, Artificial Sequence
  Synthetic oligonucleotide; TTG chr11 5390430 5390451 5390447 5390452 +
gactgaaaatttggagtattga

SEQ ID NO: 111024 - DNA, 22 bp, Artificial Sequence
  Synthetic oligonucleotide; CTG chr11 5390435 5390456 5390452 5390457 +
aaaatttggagtattgagtata

SEQ ID NO: 111025 - DNA, 22 bp, Artificial Sequence
  Synthetic oligonucleotide; TTT chr11 5390442 5390463 5390459 5390464 +
ggagtattgagtatatagcatg

SEQ ID NO: 111026 - DNA, 22 bp, Artificial Sequence
  Synthetic oligonucleotide; TTG chr11 5390443 5390464 5390460 5390465 +
gagtattgagtatatagcatgc

SEQ ID NO: 111027 - DNA, 22 bp, Artificial Sequence
  Synthetic oligonucleotide; TTG chr11 5390451 5390472 5390468 5390473 +
agtatatagcatgctcttaaag

SEQ ID NO: 111028 - DNA, 22 bp, Artificial Sequence
  Synthetic oligonucleotide; CTC chr11 5390467 5390488 5390484 5390489 +
ttaaagattttttgcccctgtc

SEQ ID NO: 111029 - DNA, 22 bp, Artificial Sequence
  Synthetic oligonucleotide; CTT chr11 5390469 5390490 5390486 5390491 +
aaagattttttgcccctgtcct

SEQ ID NO: 111030 - DNA, 22 bp, Artificial Sequence
  Synthetic oligonucleotide; TTA chr11 5390470 5390491 5390487 5390492 +
aagattttttgcccctgtccta

SEQ ID NO: 111031 - DNA, 22 bp, Artificial Sequence
  Synthetic oligonucleotide; TTT chr11 5390477 5390498 5390494 5390499 +
tttgcccctgtcctaaataaaa

SEQ ID NO: 111032 - DNA, 22 bp, Artificial Sequence
  Synthetic oligonucleotide; TTT chr11 5390478 5390499 5390495 5390500 +
ttgcccctgtcctaaataaaat

SEQ ID NO: 111033 - DNA, 22 bp, Artificial Sequence
  Synthetic oligonucleotide; TTT chr11 5390479 5390500 5390496 5390501 +
tgcccctgtcctaaataaaata

SEQ ID NO: 111034 - DNA, 22 bp, Artificial Sequence
  Synthetic oligonucleotide; TTT chr11 5390480 5390501 5390497 5390502 +
gcccctgtcctaaataaaatat

SEQ ID NO: 111035 - DNA, 22 bp, Artificial Sequence
  Synthetic oligonucleotide; TTG chr11 5390481 5390502 5390498 5390503 +
cccctgtcctaaataaaatatg

SEQ ID NO: 111036 - DNA, 22 bp, Artificial Sequence
  Synthetic oligonucleotide; CTG chr11 5390487 5390508 5390504 5390509 +
tcctaaataaaatatgggcaaa

SEQ ID NO: 111037 - DNA, 22 bp, Artificial Sequence
  Synthetic oligonucleotide; CTA chr11 5390492 5390513 5390509 5390514 +
aataaaatatgggcaaatttat

SEQ ID NO: 111038 - DNA, 22 bp, Artificial Sequence
  Synthetic oligonucleotide; TTT chr11 5390512 5390533 5390529 5390534 +
atgtctggagttgtggctttaa

SEQ ID NO: 111039 - DNA, 22 bp, Artificial Sequence
  Synthetic oligonucleotide; TTA chr11 5390513 5390534 5390530 5390535 +
tgtctggagttgtggctttaaa

SEQ ID NO: 111040 - DNA, 22 bp, Artificial Sequence
  Synthetic oligonucleotide; CTG chr11 5390519 5390540 5390536 5390541 +
gagttgtggctttaaaaaactg

SEQ ID NO: 111041 - DNA, 22 bp, Artificial Sequence
  Synthetic oligonucleotide; TTG chr11 5390525 5390546 5390542 5390547 +
tggctttaaaaaactgaacttc

SEQ ID NO: 111042 - DNA, 22 bp, Artificial Sequence
  Synthetic oligonucleotide; CTT chr11 5390531 5390552 5390548 5390553 +
taaaaaactgaacttctcttgc

SEQ ID NO: 111043 - DNA, 22 bp, Artificial Sequence
  Synthetic oligonucleotide; TTT chr11 5390532 5390553 5390549 5390554 +
aaaaaactgaacttctcttgct

SEQ ID NO: 111044 - DNA, 22 bp, Artificial Sequence
  Synthetic oligonucleotide; TTA chr11 5390533 5390554 5390550 5390555 +
aaaaactgaacttctcttgctt

SEQ ID NO: 111045 - DNA, 22 bp, Artificial Sequence
  Synthetic oligonucleotide; CTG chr11 5390541 5390562 5390558 5390563 +
aacttctcttgcttagatttta

SEQ ID NO: 111046 - DNA, 22 bp, Artificial Sequence
  Synthetic oligonucleotide; CTT chr11 5390546 5390567 5390563 5390568 +
ctcttgcttagattttaatggc

SEQ ID NO: 111047 - DNA, 22 bp, Artificial Sequence
  Synthetic oligonucleotide; TTC chr11 5390547 5390568 5390564 5390569 +
tcttgcttagattttaatggct

SEQ ID NO: 111048 - DNA, 22 bp, Artificial Sequence
  Synthetic oligonucleotide; CTC chr11 5390549 5390570 5390566 5390571 +
ttgcttagattttaatggctcc

SEQ ID NO: 111049 - DNA, 22 bp, Artificial Sequence
  Synthetic oligonucleotide; CTT chr11 5390551 5390572 5390568 5390573 +
gcttagattttaatggctcctc

SEQ ID NO: 111050 - DNA, 22 bp, Artificial Sequence
  Synthetic oligonucleotide; TTG chr11 5390552 5390573 5390569 5390574 +
cttagattttaatggctcctcc

SEQ ID NO: 111051 - DNA, 22 bp, Artificial Sequence
  Synthetic oligonucleotide; CTT chr11 5390555 5390576 5390572 5390577 +
agattttaatggctcctcctac

SEQ ID NO: 111052 - DNA, 22 bp, Artificial Sequence
  Synthetic oligonucleotide; TTA chr11 5390556 5390577 5390573 5390578 +
gattttaatggctcctcctaca

SEQ ID NO: 111053 - DNA, 22 bp, Artificial Sequence
  Synthetic oligonucleotide; TTT chr11 5390561 5390582 5390578 5390583 +
taatggctcctcctacagctga

SEQ ID NO: 111054 - DNA, 22 bp, Artificial Sequence
  Synthetic oligonucleotide; TTT chr11 5390562 5390583 5390579 5390584 +
aatggctcctcctacagctgag

SEQ ID NO: 111055 - DNA, 22 bp, Artificial Sequence
  Synthetic oligonucleotide; TTA chr11 5390563 5390584 5390580 5390585 +
atggctcctcctacagctgaga

SEQ ID NO: 111056 - DNA, 22 bp, Artificial Sequence
  Synthetic oligonucleotide; CTC chr11 5390570 5390591 5390587 5390592 +
ctcctacagctgagaactggca

SEQ ID NO: 111057 - DNA, 22 bp, Artificial Sequence
  Synthetic oligonucleotide; CTC chr11 5390573 5390594 5390590 5390595 +
ctacagctgagaactggcattt

SEQ ID NO: 111058 - DNA, 22 bp, Artificial Sequence
  Synthetic oligonucleotide; CTA chr11 5390576 5390597 5390593 5390598 +
cagctgagaactggcatttttg

SEQ ID NO: 111059 - DNA, 22 bp, Artificial Sequence
  Synthetic oligonucleotide; CTG chr11 5390582 5390603 5390599 5390604 +
agaactggcatttttggtagca

SEQ ID NO: 111060 - DNA, 22 bp, Artificial Sequence
  Synthetic oligonucleotide; CTG chr11 5390589 5390610 5390606 5390611 +
gcatttttggtagcatcaaagc

SEQ ID NO: 111061 - DNA, 22 bp, Artificial Sequence
  Synthetic oligonucleotide; TTT chr11 5390595 5390616 5390612 5390617 +
ttggtagcatcaaagctatcca

SEQ ID NO: 111062 - DNA, 22 bp, Artificial Sequence
  Synthetic oligonucleotide; TTT chr11 5390596 5390617 5390613 5390618 +
tggtagcatcaaagctatccag

SEQ ID NO: 111063 - DNA, 22 bp, Artificial Sequence
  Synthetic oligonucleotide; TTT chr11 5390597 5390618 5390614 5390619 +
ggtagcatcaaagctatccaga

SEQ ID NO: 111064 - DNA, 22 bp, Artificial Sequence
  Synthetic oligonucleotide; TTG chr11 5390598 5390619 5390615 5390620 +
gtagcatcaaagctatccagaa

SEQ ID NO: 111065 - DNA, 22 bp, Artificial Sequence
  Synthetic oligonucleotide; CTA chr11 5390613 5390634 5390630 5390635 +
tccagaaggcaactttattgaa

SEQ ID NO: 111066 - DNA, 22 bp, Artificial Sequence
  Synthetic oligonucleotide; CTT chr11 5390628 5390649 5390645 5390650 +
tattgaaggtcatcatcaatgt

SEQ ID NO: 111067 - DNA, 22 bp, Artificial Sequence
  Synthetic oligonucleotide; TTT chr11 5390629 5390650 5390646 5390651 +
attgaaggtcatcatcaatgta

SEQ ID NO: 111068 - DNA, 22 bp, Artificial Sequence
  Synthetic oligonucleotide; TTA chr11 5390630 5390651 5390647 5390652 +
ttgaaggtcatcatcaatgtaa

SEQ ID NO: 111069 - DNA, 22 bp, Artificial Sequence
  Synthetic oligonucleotide; TTG chr11 5390633 5390654 5390650 5390655 +
aaggtcatcatcaatgtaacta

SEQ ID NO: 111070 - DNA, 22 bp, Artificial Sequence
  Synthetic oligonucleotide; CTA chr11 5390655 5390676 5390672 5390677 +
aaactaaaatgaaactaaataa

SEQ ID NO: 111071 - DNA, 22 bp, Artificial Sequence
  Synthetic oligonucleotide; CTA chr11 5390661 5390682 5390678 5390683 +
aaatgaaactaaataaaaacta

SEQ ID NO: 111072 - DNA, 22 bp, Artificial Sequence
  Synthetic oligonucleotide; CTA chr11 5390672 5390693 5390689 5390694 +
aataaaaactaaaaagaacaat

SEQ ID NO: 111073 - DNA, 22 bp, Artificial Sequence
  Synthetic oligonucleotide; CTA chr11 5390683 5390704 5390700 5390705 +
aaaagaacaataaataccagag

SEQ ID NO: 111074 - DNA, 22 bp, Artificial Sequence
  Synthetic oligonucleotide; CTG chr11 5390723 5390744 5390740 5390745 +
gcagagaccaggtaaatgccat

SEQ ID NO: 111075 - DNA, 22 bp, Artificial Sequence
  Synthetic oligonucleotide; TTT chr11 5390747 5390768 5390764 5390769 +
gctctaactcacctccggaaat

SEQ ID NO: 111076 - DNA, 22 bp, Artificial Sequence
  Synthetic oligonucleotide; TTG chr11 5390748 5390769 5390765 5390770 +
ctctaactcacctccggaaata

SEQ ID NO: 111077 - DNA, 22 bp, Artificial Sequence
  Synthetic oligonucleotide; CTC chr11 5390751 5390772 5390768 5390773 +
taactcacctccggaaatacac

SEQ ID NO: 111078 - DNA, 22 bp, Artificial Sequence
  Synthetic oligonucleotide; CTA chr11 5390753 5390774 5390770 5390775 +
actcacctccggaaatacacct

SEQ ID NO: 111079 - DNA, 22 bp, Artificial Sequence
  Synthetic oligonucleotide; CTC chr11 5390757 5390778 5390774 5390779 +
acctccggaaatacacctcctt

SEQ ID NO: 111080 - DNA, 22 bp, Artificial Sequence
  Synthetic oligonucleotide; CTC chr11 5390762 5390783 5390779 5390784 +
cggaaatacacctccttccatg

SEQ ID NO: 111081 - DNA, 22 bp, Artificial Sequence
  Synthetic oligonucleotide; CTC chr11 5390776 5390797 5390793 5390798 +
cttccatggttccttgggactg

SEQ ID NO: 111082 - DNA, 22 bp, Artificial Sequence
  Synthetic oligonucleotide; CTT chr11 5390779 5390800 5390796 5390801 +
ccatggttccttgggactgctt

SEQ ID NO: 111083 - DNA, 22 bp, Artificial Sequence
  Synthetic oligonucleotide; TTC chr11 5390780 5390801 5390797 5390802 +
catggttccttgggactgcttc

SEQ ID NO: 111084 - DNA, 22 bp, Artificial Sequence
  Synthetic oligonucleotide; TTC chr11 5390788 5390809 5390805 5390810 +
cttgggactgcttccatcttat

SEQ ID NO: 111085 - DNA, 22 bp, Artificial Sequence
  Synthetic oligonucleotide; CTT chr11 5390791 5390812 5390808 5390813 +
gggactgcttccatcttatcta

SEQ ID NO: 111086 - DNA, 22 bp, Artificial Sequence
  Synthetic oligonucleotide; TTG chr11 5390792 5390813 5390809 5390814 +
ggactgcttccatcttatctac

SEQ ID NO: 111087 - DNA, 22 bp, Artificial Sequence
  Synthetic oligonucleotide; CTG chr11 5390798 5390819 5390815 5390820 +
cttccatcttatctacctggcc

SEQ ID NO: 111088 - DNA, 22 bp, Artificial Sequence
  Synthetic oligonucleotide; CTT chr11 5390801 5390822 5390818 5390823 +
ccatcttatctacctggccaag

SEQ ID NO: 111089 - DNA, 22 bp, Artificial Sequence
  Synthetic oligonucleotide; TTC chr11 5390802 5390823 5390819 5390824 +
catcttatctacctggccaagt

SEQ ID NO: 111090 - DNA, 22 bp, Artificial Sequence
  Synthetic oligonucleotide; CTT chr11 5390808 5390829 5390825 5390830 +
atctacctggccaagtttcttc

SEQ ID NO: 111091 - DNA, 22 bp, Artificial Sequence
  Synthetic oligonucleotide; TTA chr11 5390809 5390830 5390826 5390831 +
tctacctggccaagtttcttct

SEQ ID NO: 111092 - DNA, 22 bp, Artificial Sequence
  Synthetic oligonucleotide; CTA chr11 5390813 5390834 5390830 5390835 +
cctggccaagtttcttctcatc

SEQ ID NO: 111093 - DNA, 22 bp, Artificial Sequence
  Synthetic oligonucleotide; CTG chr11 5390817 5390838 5390834 5390839 +
gccaagtttcttctcatctttt

SEQ ID NO: 111094 - DNA, 22 bp, Artificial Sequence
  Synthetic oligonucleotide; TTT chr11 5390826 5390847 5390843 5390848 +
cttctcatctttttctatcctg

SEQ ID NO: 111095 - DNA, 22 bp, Artificial Sequence
  Synthetic oligonucleotide; TTC chr11 5390827 5390848 5390844 5390849 +
ttctcatctttttctatcctgg

SEQ ID NO: 111096 - DNA, 22 bp, Artificial Sequence
  Synthetic oligonucleotide; CTT chr11 5390829 5390850 5390846 5390851 +
ctcatctttttctatcctggtc

SEQ ID NO: 111097 - DNA, 22 bp, Artificial Sequence
  Synthetic oligonucleotide; TTC chr11 5390830 5390851 5390847 5390852 +
tcatctttttctatcctggtca

SEQ ID NO: 111098 - DNA, 22 bp, Artificial Sequence
  Synthetic oligonucleotide; CTC chr11 5390832 5390853 5390849 5390854 +
atctttttctatcctggtcagc

SEQ ID NO: 111099 - DNA, 22 bp, Artificial Sequence
  Synthetic oligonucleotide; CTT chr11 5390837 5390858 5390854 5390859 +
tttctatcctggtcagcagtaa

SEQ ID NO: 111100 - DNA, 22 bp, Artificial Sequence
  Synthetic oligonucleotide; TTT chr11 5390838 5390859 5390855 5390860 +
ttctatcctggtcagcagtaac

SEQ ID NO: 111101 - DNA, 22 bp, Artificial Sequence
  Synthetic oligonucleotide; TTT chr11 5390839 5390860 5390856 5390861 +
tctatcctggtcagcagtaact

SEQ ID NO: 111102 - DNA, 22 bp, Artificial Sequence
  Synthetic oligonucleotide; TTT chr11 5390840 5390861 5390857 5390862 +
ctatcctggtcagcagtaactt

SEQ ID NO: 111103 - DNA, 22 bp, Artificial Sequence
  Synthetic oligonucleotide; TTC chr11 5390841 5390862 5390858 5390863 +
tatcctggtcagcagtaacttt

SEQ ID NO: 111104 - DNA, 22 bp, Artificial Sequence
  Synthetic oligonucleotide; CTA chr11 5390843 5390864 5390860 5390865 +
tcctggtcagcagtaactttca

SEQ ID NO: 111105 - DNA, 22 bp, Artificial Sequence
  Synthetic oligonucleotide; CTG chr11 5390848 5390869 5390865 5390870 +
gtcagcagtaactttcagaccc

SEQ ID NO: 111106 - DNA, 22 bp, Artificial Sequence
  Synthetic oligonucleotide; CTT chr11 5390862 5390883 5390879 5390884 +
tcagacccccaagtcacatcag

SEQ ID NO: 111107 - DNA, 22 bp, Artificial Sequence
  Synthetic oligonucleotide; TTT chr11 5390863 5390884 5390880 5390885 +
cagacccccaagtcacatcaga

SEQ ID NO: 111108 - DNA, 22 bp, Artificial Sequence
  Synthetic oligonucleotide; TTC chr11 5390864 5390885 5390881 5390886 +
agacccccaagtcacatcagaa

SEQ ID NO: 111109 - DNA, 22 bp, Artificial Sequence
  Synthetic oligonucleotide; CTC chr11 5390891 5390912 5390908 5390913 +
agaactcctgcattcttcctca

SEQ ID NO: 111110 - DNA, 22 bp, Artificial Sequence
  Synthetic oligonucleotide; CTC chr11 5390898 5390919 5390915 5390920 +
ctgcattcttcctcaacacctg

SEQ ID NO: 111111 - DNA, 22 bp, Artificial Sequence
  Synthetic oligonucleotide; CTG chr11 5390901 5390922 5390918 5390923 +
cattcttcctcaacacctgttt

SEQ ID NO: 111112 - DNA, 22 bp, Artificial Sequence
  Synthetic oligonucleotide; TTC chr11 5390906 5390927 5390923 5390928 +
ttcctcaacacctgtttcaagc

SEQ ID NO: 111113 - DNA, 22 bp, Artificial Sequence
  Synthetic oligonucleotide; CTT chr11 5390908 5390929 5390925 5390930 +
cctcaacacctgtttcaagcaa

SEQ ID NO: 111114 - DNA, 22 bp, Artificial Sequence
  Synthetic oligonucleotide; TTC chr11 5390909 5390930 5390926 5390931 +
ctcaacacctgtttcaagcaac

SEQ ID NO: 111115 - DNA, 22 bp, Artificial Sequence
  Synthetic oligonucleotide; CTC chr11 5390912 5390933 5390929 5390934 +
aacacctgtttcaagcaacacc

SEQ ID NO: 111116 - DNA, 22 bp, Artificial Sequence
  Synthetic oligonucleotide; CTG chr11 5390920 5390941 5390937 5390942 +
tttcaagcaacacccccccaaa

SEQ ID NO: 111117 - DNA, 22 bp, Artificial Sequence
  Synthetic oligonucleotide; TTT chr11 5390923 5390944 5390940 5390945 +
caagcaacacccccccaaattt

SEQ ID NO: 111118 - DNA, 22 bp, Artificial Sequence
  Synthetic oligonucleotide; TTC chr11 5390924 5390945 5390941 5390946 +
aagcaacacccccccaaatttc

SEQ ID NO: 111119 - DNA, 22 bp, Artificial Sequence
  Synthetic oligonucleotide; TTT chr11 5390945 5390966 5390962 5390967 +
ctaaggttgtgctctctcctga

SEQ ID NO: 111120 - DNA, 22 bp, Artificial Sequence
  Synthetic oligonucleotide; TTC chr11 5390946 5390967 5390963 5390968 +
taaggttgtgctctctcctgac

SEQ ID NO: 111121 - DNA, 22 bp, Artificial Sequence
  Synthetic oligonucleotide; CTA chr11 5390948 5390969 5390965 5390970 +
aggttgtgctctctcctgacca

SEQ ID NO: 111122 - DNA, 22 bp, Artificial Sequence
  Synthetic oligonucleotide; TTG chr11 5390954 5390975 5390971 5390976 +
tgctctctcctgaccatattcc

SEQ ID NO: 111123 - DNA, 22 bp, Artificial Sequence
  Synthetic oligonucleotide; CTC chr11 5390959 5390980 5390976 5390981 +
tctcctgaccatattcctctag

SEQ ID NO: 111124 - DNA, 22 bp, Artificial Sequence
  Synthetic oligonucleotide; CTC chr11 5390961 5390982 5390978 5390983 +
tcctgaccatattcctctagaa

SEQ ID NO: 111125 - DNA, 22 bp, Artificial Sequence
  Synthetic oligonucleotide; CTC chr11 5390963 5390984 5390980 5390985 +
ctgaccatattcctctagaaga

SEQ ID NO: 111126 - DNA, 22 bp, Artificial Sequence
  Synthetic oligonucleotide; CTG chr11 5390966 5390987 5390983 5390988 +
accatattcctctagaagaaga

SEQ ID NO: 111127 - DNA, 22 bp, Artificial Sequence
  Synthetic oligonucleotide; TTC chr11 5390975 5390996 5390992 5390997 +
ctctagaagaagagactttgat

SEQ ID NO: 111128 - DNA, 22 bp, Artificial Sequence
  Synthetic oligonucleotide; CTC chr11 5390978 5390999 5390995 5391000 +
tagaagaagagactttgatcct

SEQ ID NO: 111129 - DNA, 22 bp, Artificial Sequence
  Synthetic oligonucleotide; CTA chr11 5390980 5391001 5390997 5391002 +
gaagaagagactttgatcctat

SEQ ID NO: 111130 - DNA, 22 bp, Artificial Sequence
  Synthetic oligonucleotide; CTT chr11 5390993 5391014 5391010 5391015 +
tgatcctatccttgactcctct

SEQ ID NO: 111131 - DNA, 22 bp, Artificial Sequence
  Synthetic oligonucleotide; TTT chr11 5390994 5391015 5391011 5391016 +
gatcctatccttgactcctctc

SEQ ID NO: 111132 - DNA, 22 bp, Artificial Sequence
  Synthetic oligonucleotide; TTG chr11 5390995 5391016 5391012 5391017 +
atcctatccttgactcctctca

SEQ ID NO: 111133 - DNA, 22 bp, Artificial Sequence
  Synthetic oligonucleotide; CTA chr11 5391001 5391022 5391018 5391023 +
tccttgactcctctcatctctg

SEQ ID NO: 111134 - DNA, 22 bp, Artificial Sequence
  Synthetic oligonucleotide; CTT chr11 5391006 5391027 5391023 5391028 +
gactcctctcatctctgatttt

SEQ ID NO: 111135 - DNA, 22 bp, Artificial Sequence
  Synthetic oligonucleotide; TTG chr11 5391007 5391028 5391024 5391029 +
actcctctcatctctgatttta

SEQ ID NO: 111136 - DNA, 22 bp, Artificial Sequence
  Synthetic oligonucleotide; CTC chr11 5391011 5391032 5391028 5391033 +
ctctcatctctgattttacctt

SEQ ID NO: 111137 - DNA, 22 bp, Artificial Sequence
  Synthetic oligonucleotide; CTC chr11 5391014 5391035 5391031 5391036 +
tcatctctgattttaccttaca

SEQ ID NO: 111138 - DNA, 22 bp, Artificial Sequence
  Synthetic oligonucleotide; CTC chr11 5391016 5391037 5391033 5391038 +
atctctgattttaccttacaac

SEQ ID NO: 111139 - DNA, 22 bp, Artificial Sequence
  Synthetic oligonucleotide; CTC chr11 5391021 5391042 5391038 5391043 +
tgattttaccttacaacctcaa

SEQ ID NO: 111140 - DNA, 22 bp, Artificial Sequence
  Synthetic oligonucleotide; CTG chr11 5391023 5391044 5391040 5391045 +
attttaccttacaacctcaagt

SEQ ID NO: 111141 - DNA, 22 bp, Artificial Sequence
  Synthetic oligonucleotide; TTT chr11 5391027 5391048 5391044 5391049 +
taccttacaacctcaagtctga

SEQ ID NO: 111142 - DNA, 22 bp, Artificial Sequence
  Synthetic oligonucleotide; TTT chr11 5391028 5391049 5391045 5391050 +
accttacaacctcaagtctgac

SEQ ID NO: 111143 - DNA, 22 bp, Artificial Sequence
  Synthetic oligonucleotide; TTA chr11 5391029 5391050 5391046 5391051 +
ccttacaacctcaagtctgaca

SEQ ID NO: 111144 - DNA, 22 bp, Artificial Sequence
  Synthetic oligonucleotide; CTT chr11 5391033 5391054 5391050 5391055 +
acaacctcaagtctgacattaa

SEQ ID NO: 111145 - DNA, 22 bp, Artificial Sequence
  Synthetic oligonucleotide; TTA chr11 5391034 5391055 5391051 5391056 +
caacctcaagtctgacattaag

SEQ ID NO: 111146 - DNA, 22 bp, Artificial Sequence
  Synthetic oligonucleotide; CTC chr11 5391041 5391062 5391058 5391063 +
aagtctgacattaagctacagt

SEQ ID NO: 111147 - DNA, 22 bp, Artificial Sequence
  Synthetic oligonucleotide; CTG chr11 5391048 5391069 5391065 5391070 +
acattaagctacagtcagtatt

SEQ ID NO: 111148 - DNA, 22 bp, Artificial Sequence
  Synthetic oligonucleotide; TTA chr11 5391054 5391075 5391071 5391076 +
agctacagtcagtatttacttg

SEQ ID NO: 111149 - DNA, 22 bp, Artificial Sequence
  Synthetic oligonucleotide; CTA chr11 5391059 5391080 5391076 5391081 +
cagtcagtatttacttgtaggt

SEQ ID NO: 111150 - DNA, 22 bp, Artificial Sequence
  Synthetic oligonucleotide; TTT chr11 5391071 5391092 5391088 5391093 +
acttgtaggtgttttagttgtg

SEQ ID NO: 111151 - DNA, 22 bp, Artificial Sequence
  Synthetic oligonucleotide; TTA chr11 5391072 5391093 5391089 5391094 +
cttgtaggtgttttagttgtgt

SEQ ID NO: 111152 - DNA, 22 bp, Artificial Sequence
  Synthetic oligonucleotide; CTT chr11 5391075 5391096 5391092 5391097 +
gtaggtgttttagttgtgtgat

SEQ ID NO: 111153 - DNA, 22 bp, Artificial Sequence
  Synthetic oligonucleotide; TTG chr11 5391076 5391097 5391093 5391098 +
taggtgttttagttgtgtgata

SEQ ID NO: 111154 - DNA, 22 bp, Artificial Sequence
  Synthetic oligonucleotide; TTT chr11 5391085 5391106 5391102 5391107 +
tagttgtgtgatattgaacaat

SEQ ID NO: 111155 - DNA, 22 bp, Artificial Sequence
  Synthetic oligonucleotide; TTT chr11 5391086 5391107 5391103 5391108 +
agttgtgtgatattgaacaatg

SEQ ID NO: 111156 - DNA, 22 bp, Artificial Sequence
  Synthetic oligonucleotide; TTA chr11 5391087 5391108 5391104 5391109 +
gttgtgtgatattgaacaatga

SEQ ID NO: 111157 - DNA, 22 bp, Artificial Sequence
  Synthetic oligonucleotide; TTG chr11 5391091 5391112 5391108 5391113 +
tgtgatattgaacaatgacatg

SEQ ID NO: 111158 - DNA, 22 bp, Artificial Sequence
  Synthetic oligonucleotide; TTG chr11 5391101 5391122 5391118 5391123 +
aacaatgacatgtaacgtgaga

SEQ ID NO: 111159 - DNA, 22 bp, Artificial Sequence
  Synthetic oligonucleotide; CTT chr11 5391129 5391150 5391146 5391151 +
cagccaaggaaactcacacaaa

SEQ ID NO: 111160 - DNA, 22 bp, Artificial Sequence
  Synthetic oligonucleotide; TTC chr11 5391130 5391151 5391147 5391152 +
agccaaggaaactcacacaaac

SEQ ID NO: 111161 - DNA, 22 bp, Artificial Sequence
  Synthetic oligonucleotide; CTC chr11 5391144 5391165 5391161 5391166 +
acacaaacatattgaagtcaca

SEQ ID NO: 111162 - DNA, 22 bp, Artificial Sequence
  Synthetic oligonucleotide; TTG chr11 5391158 5391179 5391175 5391180 +
aagtcacaatcccattgctcag

SEQ ID NO: 111163 - DNA, 22 bp, Artificial Sequence
  Synthetic oligonucleotide; TTG chr11 5391175 5391196 5391192 5391197 +
ctcaggaggaaataaactttac

SEQ ID NO: 111164 - DNA, 22 bp, Artificial Sequence
  Synthetic oligonucleotide; CTC chr11 5391178 5391199 5391195 5391200 +
aggaggaaataaactttacatt

SEQ ID NO: 111165 - DNA, 22 bp, Artificial Sequence
  Synthetic oligonucleotide; CTT chr11 5391194 5391215 5391211 5391216 +
tacattggctgatcagcctgtc

SEQ ID NO: 111166 - DNA, 22 bp, Artificial Sequence
  Synthetic oligonucleotide; TTT chr11 5391195 5391216 5391212 5391217 +
acattggctgatcagcctgtcc

SEQ ID NO: 111167 - DNA, 22 bp, Artificial Sequence
  Synthetic oligonucleotide; TTA chr11 5391196 5391217 5391213 5391218 +
cattggctgatcagcctgtccc

SEQ ID NO: 111168 - DNA, 22 bp, Artificial Sequence
  Synthetic oligonucleotide; TTG chr11 5391201 5391222 5391218 5391223 +
gctgatcagcctgtccctacga

SEQ ID NO: 111169 - DNA, 22 bp, Artificial Sequence
  Synthetic oligonucleotide; CTG chr11 5391205 5391226 5391222 5391227 +
atcagcctgtccctacgagtga

SEQ ID NO: 111170 - DNA, 22 bp, Artificial Sequence
  Synthetic oligonucleotide; CTG chr11 5391214 5391235 5391231 5391236 +
tccctacgagtgactaaatgca

SEQ ID NO: 111171 - DNA, 22 bp, Artificial Sequence
  Synthetic oligonucleotide; CTA chr11 5391220 5391241 5391237 5391242 +
cgagtgactaaatgcaatcctt

SEQ ID NO: 111172 - DNA, 22 bp, Artificial Sequence
  Synthetic oligonucleotide; CTA chr11 5391230 5391251 5391247 5391252 +
aatgcaatccttgcaggggtct

SEQ ID NO: 111173 - DNA, 22 bp, Artificial Sequence
  Synthetic oligonucleotide; CTT chr11 5391242 5391263 5391259 5391264 +
gcaggggtctcagctttgaaat

SEQ ID NO: 111174 - DNA, 22 bp, Artificial Sequence
  Synthetic oligonucleotide; TTG chr11 5391243 5391264 5391260 5391265 +
caggggtctcagctttgaaatt

SEQ ID NO: 111175 - DNA, 22 bp, Artificial Sequence
  Synthetic oligonucleotide; CTC chr11 5391253 5391274 5391270 5391275 +
agctttgaaattgcttcctcaa

SEQ ID NO: 111176 - DNA, 22 bp, Artificial Sequence
  Synthetic oligonucleotide; CTT chr11 5391258 5391279 5391275 5391280 +
tgaaattgcttcctcaaggaca

SEQ ID NO: 111177 - DNA, 22 bp, Artificial Sequence
  Synthetic oligonucleotide; TTT chr11 5391259 5391280 5391276 5391281 +
gaaattgcttcctcaaggacat

SEQ ID NO: 111178 - DNA, 22 bp, Artificial Sequence
  Synthetic oligonucleotide; TTG chr11 5391260 5391281 5391277 5391282 +
aaattgcttcctcaaggacatt

SEQ ID NO: 111179 - DNA, 22 bp, Artificial Sequence
  Synthetic oligonucleotide; TTG chr11 5391266 5391287 5391283 5391288 +
cttcctcaaggacattttcaca

SEQ ID NO: 111180 - DNA, 22 bp, Artificial Sequence
  Synthetic oligonucleotide; CTT chr11 5391269 5391290 5391286 5391291 +
cctcaaggacattttcacagat

SEQ ID NO: 111181 - DNA, 22 bp, Artificial Sequence
  Synthetic oligonucleotide; TTC chr11 5391270 5391291 5391287 5391292 +
ctcaaggacattttcacagata

SEQ ID NO: 111182 - DNA, 22 bp, Artificial Sequence
  Synthetic oligonucleotide; CTC chr11 5391273 5391294 5391290 5391295 +
aaggacattttcacagatagct

SEQ ID NO: 111183 - DNA, 22 bp, Artificial Sequence
  Synthetic oligonucleotide; TTT chr11 5391283 5391304 5391300 5391305 +
tcacagatagctcctccctttc

SEQ ID NO: 111184 - DNA, 22 bp, Artificial Sequence
  Synthetic oligonucleotide; TTT chr11 5391284 5391305 5391301 5391306 +
cacagatagctcctccctttcc

SEQ ID NO: 111185 - DNA, 22 bp, Artificial Sequence
  Synthetic oligonucleotide; TTC chr11 5391285 5391306 5391302 5391307 +
acagatagctcctccctttcca

SEQ ID NO: 111186 - DNA, 22 bp, Artificial Sequence
  Synthetic oligonucleotide; CTC chr11 5391296 5391317 5391313 5391318 +
ctccctttccaatggtaaagca

SEQ ID NO: 111187 - DNA, 22 bp, Artificial Sequence
  Synthetic oligonucleotide; CTC chr11 5391299 5391320 5391316 5391321 +
cctttccaatggtaaagcacca

SEQ ID NO: 111188 - DNA, 22 bp, Artificial Sequence
  Synthetic oligonucleotide; CTT chr11 5391303 5391324 5391320 5391325 +
tccaatggtaaagcaccaaatg

SEQ ID NO: 111189 - DNA, 22 bp, Artificial Sequence
  Synthetic oligonucleotide; TTT chr11 5391304 5391325 5391321 5391326 +
ccaatggtaaagcaccaaatgc

SEQ ID NO: 111190 - DNA, 22 bp, Artificial Sequence
  Synthetic oligonucleotide; TTC chr11 5391305 5391326 5391322 5391327 +
caatggtaaagcaccaaatgct

SEQ ID NO: 111191 - DNA, 22 bp, Artificial Sequence
  Synthetic oligonucleotide; CTC chr11 5391328 5391349 5391345 5391350 +
catcggtttccttccacagtgc

SEQ ID NO: 111192 - DNA, 22 bp, Artificial Sequence
  Synthetic oligonucleotide; TTT chr11 5391337 5391358 5391354 5391359 +
ccttccacagtgccctgcattt

SEQ ID NO: 111193 - DNA, 22 bp, Artificial Sequence
  Synthetic oligonucleotide; TTC chr11 5391338 5391359 5391355 5391360 +
cttccacagtgccctgcatttc

SEQ ID NO: 111194 - DNA, 22 bp, Artificial Sequence
  Synthetic oligonucleotide; CTT chr11 5391341 5391362 5391358 5391363 +
ccacagtgccctgcatttcccg

SEQ ID NO: 111195 - DNA, 22 bp, Artificial Sequence
  Synthetic oligonucleotide; TTC chr11 5391342 5391363 5391359 5391364 +
cacagtgccctgcatttcccgt

SEQ ID NO: 111196 - DNA, 22 bp, Artificial Sequence
  Synthetic oligonucleotide; CTG chr11 5391354 5391375 5391371 5391376 +
catttcccgttgtaacatttgt

SEQ ID NO: 111197 - DNA, 22 bp, Artificial Sequence
  Synthetic oligonucleotide; TTT chr11 5391359 5391380 5391376 5391381 +
cccgttgtaacatttgtcacac

SEQ ID NO: 111198 - DNA, 22 bp, Artificial Sequence
  Synthetic oligonucleotide; TTC chr11 5391360 5391381 5391377 5391382 +
ccgttgtaacatttgtcacaca

SEQ ID NO: 111199 - DNA, 22 bp, Artificial Sequence
  Synthetic oligonucleotide; TTG chr11 5391366 5391387 5391383 5391388 +
taacatttgtcacacagtaatg

SEQ ID NO: 111200 - DNA, 22 bp, Artificial Sequence
  Synthetic oligonucleotide; TTT chr11 5391374 5391395 5391391 5391396 +
gtcacacagtaatgtcctgttt

SEQ ID NO: 111201 - DNA, 22 bp, Artificial Sequence
  Synthetic oligonucleotide; TTG chr11 5391375 5391396 5391392 5391397 +
tcacacagtaatgtcctgttta

SEQ ID NO: 111202 - DNA, 22 bp, Artificial Sequence
  Synthetic oligonucleotide; CTG chr11 5391393 5391414 5391410 5391415 +
tttatgaaggtgtgtgcatgtg

SEQ ID NO: 111203 - DNA, 22 bp, Artificial Sequence
  Synthetic oligonucleotide; TTT chr11 5391396 5391417 5391413 5391418 +
atgaaggtgtgtgcatgtgtcc

SEQ ID NO: 111204 - DNA, 22 bp, Artificial Sequence
  Synthetic oligonucleotide; TTA chr11 5391397 5391418 5391414 5391419 +
tgaaggtgtgtgcatgtgtcca

SEQ ID NO: 111205 - DNA, 22 bp, Artificial Sequence
  Synthetic oligonucleotide; TTA chr11 5391422 5391443 5391439 5391444 +
gaatgactaaatcaagatccct

SEQ ID NO: 111206 - DNA, 22 bp, Artificial Sequence
  Synthetic oligonucleotide; CTA chr11 5391431 5391452 5391448 5391453 +
aatcaagatccctggaggaatt

SEQ ID NO: 111207 - DNA, 22 bp, Artificial Sequence
  Synthetic oligonucleotide; CTG chr11 5391445 5391466 5391462 5391467 +
gaggaattaggcatgtcttgct

SEQ ID NO: 111208 - DNA, 22 bp, Artificial Sequence
  Synthetic oligonucleotide; TTA chr11 5391454 5391475 5391471 5391476 +
ggcatgtcttgctcgccagtaa

SEQ ID NO: 111209 - DNA, 22 bp, Artificial Sequence
  Synthetic oligonucleotide; CTT chr11 5391464 5391485 5391481 5391486 +
gctcgccagtaaatgtatataa

SEQ ID NO: 111210 - DNA, 22 bp, Artificial Sequence
  Synthetic oligonucleotide; TTG chr11 5391465 5391486 5391482 5391487 +
ctcgccagtaaatgtatataaa

SEQ ID NO: 111211 - DNA, 22 bp, Artificial Sequence
  Synthetic oligonucleotide; CTC chr11 5391468 5391489 5391485 5391490 +
gccagtaaatgtatataaatac

SEQ ID NO: 111212 - DNA, 22 bp, Artificial Sequence
  Synthetic oligonucleotide; CTA chr11 5391498 5391519 5391515 5391520 +
gcacatgccatatactcaataa

SEQ ID NO: 111213 - DNA, 22 bp, Artificial Sequence
  Synthetic oligonucleotide; CTC chr11 5391515 5391536 5391532 5391537 +
aataaatattaaatgtatgcgt

SEQ ID NO: 111214 - DNA, 22 bp, Artificial Sequence
  Synthetic oligonucleotide; TTA chr11 5391526 5391547 5391543 5391548 +
aatgtatgcgtggacatataga

SEQ ID NO: 111215 - DNA, 22 bp, Artificial Sequence
  Synthetic oligonucleotide; CTA chr11 5391572 5391593 5391589 5391594 +
acagaagttctcttcttgtctc

SEQ ID NO: 111216 - DNA, 22 bp, Artificial Sequence
  Synthetic oligonucleotide; TTC chr11 5391582 5391603 5391599 5391604 +
tcttcttgtctcgaggaactcc

SEQ ID NO: 111217 - DNA, 22 bp, Artificial Sequence
  Synthetic oligonucleotide; CTC chr11 5391584 5391605 5391601 5391606 +
ttcttgtctcgaggaactcctc

SEQ ID NO: 111218 - DNA, 22 bp, Artificial Sequence
  Synthetic oligonucleotide; CTT chr11 5391586 5391607 5391603 5391608 +
cttgtctcgaggaactcctcct

SEQ ID NO: 111219 - DNA, 22 bp, Artificial Sequence
  Synthetic oligonucleotide; TTC chr11 5391587 5391608 5391604 5391609 +
ttgtctcgaggaactcctcctc

SEQ ID NO: 111220 - DNA, 22 bp, Artificial Sequence
  Synthetic oligonucleotide; CTT chr11 5391589 5391610 5391606 5391611 +
gtctcgaggaactcctcctctt

SEQ ID NO: 111221 - DNA, 22 bp, Artificial Sequence
  Synthetic oligonucleotide; TTG chr11 5391590 5391611 5391607 5391612 +
tctcgaggaactcctcctcttc

SEQ ID NO: 111222 - DNA, 22 bp, Artificial Sequence
  Synthetic oligonucleotide; CTC chr11 5391594 5391615 5391611 5391616 +
gaggaactcctcctcttcacat

SEQ ID NO: 111223 - DNA, 22 bp, Artificial Sequence
  Synthetic oligonucleotide; CTC chr11 5391603 5391624 5391620 5391625 +
ctcctcttcacattcagaagcc

SEQ ID NO: 111224 - DNA, 22 bp, Artificial Sequence
  Synthetic oligonucleotide; CTC chr11 5391606 5391627 5391623 5391628 +
ctcttcacattcagaagcccaa

SEQ ID NO: 111225 - DNA, 22 bp, Artificial Sequence
  Synthetic oligonucleotide; CTC chr11 5391609 5391630 5391626 5391631 +
ttcacattcagaagcccaagaa

SEQ ID NO: 111226 - DNA, 22 bp, Artificial Sequence
  Synthetic oligonucleotide; CTT chr11 5391611 5391632 5391628 5391633 +
cacattcagaagcccaagaaga

SEQ ID NO: 111227 - DNA, 22 bp, Artificial Sequence
  Synthetic oligonucleotide; TTC chr11 5391612 5391633 5391629 5391634 +
acattcagaagcccaagaagac

SEQ ID NO: 111228 - DNA, 22 bp, Artificial Sequence
  Synthetic oligonucleotide; TTC chr11 5391618 5391639 5391635 5391640 +
agaagcccaagaagacaccttt

SEQ ID NO: 111229 - DNA, 22 bp, Artificial Sequence
  Synthetic oligonucleotide; CTT chr11 5391639 5391660 5391656 5391661 +
tctgctggcatccatcaaggtg

SEQ ID NO: 111230 - DNA, 22 bp, Artificial Sequence
  Synthetic oligonucleotide; TTT chr11 5391640 5391661 5391657 5391662 +
ctgctggcatccatcaaggtgg

SEQ ID NO: 111231 - DNA, 22 bp, Artificial Sequence
  Synthetic oligonucleotide; TTC chr11 5391641 5391662 5391658 5391663 +
tgctggcatccatcaaggtggt

SEQ ID NO: 111232 - DNA, 22 bp, Artificial Sequence
  Synthetic oligonucleotide; CTG chr11 5391643 5391664 5391660 5391665 +
ctggcatccatcaaggtggtat

SEQ ID NO: 111233 - DNA, 22 bp, Artificial Sequence
  Synthetic oligonucleotide; CTG chr11 5391646 5391667 5391663 5391668 +
gcatccatcaaggtggtatatc

SEQ ID NO: 111234 - DNA, 22 bp, Artificial Sequence
  Synthetic oligonucleotide; CTT chr11 5391670 5391691 5391687 5391692 +
cattgtcccagttctactttac

SEQ ID NO: 111235 - DNA, 22 bp, Artificial Sequence
  Synthetic oligonucleotide; TTC chr11 5391671 5391692 5391688 5391693 +
attgtcccagttctactttact

SEQ ID NO: 111236 - DNA, 22 bp, Artificial Sequence
  Synthetic oligonucleotide; TTG chr11 5391675 5391696 5391692 5391697 +
tcccagttctactttactcagg

SEQ ID NO: 111237 - DNA, 22 bp, Artificial Sequence
  Synthetic oligonucleotide; TTC chr11 5391684 5391705 5391701 5391706 +
tactttactcaggccctctgga

SEQ ID NO: 111238 - DNA, 22 bp, Artificial Sequence
  Synthetic oligonucleotide; CTA chr11 5391686 5391707 5391703 5391708 +
ctttactcaggccctctggatc

SEQ ID NO: 111239 - DNA, 22 bp, Artificial Sequence
  Synthetic oligonucleotide; CTT chr11 5391689 5391710 5391706 5391711 +
tactcaggccctctggatcctc

SEQ ID NO: 111240 - DNA, 22 bp, Artificial Sequence
  Synthetic oligonucleotide; TTT chr11 5391690 5391711 5391707 5391712 +
actcaggccctctggatcctcc

SEQ ID NO: 111241 - DNA, 22 bp, Artificial Sequence
  Synthetic oligonucleotide; TTA chr11 5391691 5391712 5391708 5391713 +
ctcaggccctctggatcctccc

SEQ ID NO: 111242 - DNA, 22 bp, Artificial Sequence
  Synthetic oligonucleotide; CTC chr11 5391694 5391715 5391711 5391716 +
aggccctctggatcctcccacc

SEQ ID NO: 111243 - DNA, 22 bp, Artificial Sequence
  Synthetic oligonucleotide; CTC chr11 5391702 5391723 5391719 5391724 +
tggatcctcccacccattctcc

SEQ ID NO: 111244 - DNA, 22 bp, Artificial Sequence
  Synthetic oligonucleotide; CTG chr11 5391704 5391725 5391721 5391726 +
gatcctcccacccattctccta

SEQ ID NO: 111245 - DNA, 22 bp, Artificial Sequence
  Synthetic oligonucleotide; CTC chr11 5391711 5391732 5391728 5391733 +
ccacccattctcctacaggtta

SEQ ID NO: 111246 - DNA, 22 bp, Artificial Sequence
  Synthetic oligonucleotide; TTC chr11 5391721 5391742 5391738 5391743 +
tcctacaggttaaaattaccat

SEQ ID NO: 111247 - DNA, 22 bp, Artificial Sequence
  Synthetic oligonucleotide; CTC chr11 5391723 5391744 5391740 5391745 +
ctacaggttaaaattaccatga

SEQ ID NO: 111248 - DNA, 22 bp, Artificial Sequence
  Synthetic oligonucleotide; CTA chr11 5391726 5391747 5391743 5391748 +
caggttaaaattaccatgaggc

SEQ ID NO: 111249 - DNA, 22 bp, Artificial Sequence
  Synthetic oligonucleotide; TTA chr11 5391733 5391754 5391750 5391755 +
aaattaccatgaggccaggcac

SEQ ID NO: 111250 - DNA, 22 bp, Artificial Sequence
  Synthetic oligonucleotide; TTA chr11 5391739 5391760 5391756 5391761 +
ccatgaggccaggcacggtggc

SEQ ID NO: 111251 - DNA, 22 bp, Artificial Sequence
  Synthetic oligonucleotide; CTT chr11 5391763 5391784 5391780 5391785 +
atgctataatcccagcactttg

SEQ ID NO: 111252 - DNA, 22 bp, Artificial Sequence
  Synthetic oligonucleotide; TTA chr11 5391764 5391785 5391781 5391786 +
tgctataatcccagcactttgg

SEQ ID NO: 111253 - DNA, 22 bp, Artificial Sequence
  Synthetic oligonucleotide; CTA chr11 5391769 5391790 5391786 5391791 +
taatcccagcactttgggagac

SEQ ID NO: 111254 - DNA, 22 bp, Artificial Sequence
  Synthetic oligonucleotide; CTT chr11 5391783 5391804 5391800 5391805 +
tgggagaccaaggtgggaggat

SEQ ID NO: 111255 - DNA, 22 bp, Artificial Sequence
  Synthetic oligonucleotide; TTT chr11 5391784 5391805 5391801 5391806 +
gggagaccaaggtgggaggatt

SEQ ID NO: 111256 - DNA, 22 bp, Artificial Sequence
  Synthetic oligonucleotide; TTG chr11 5391785 5391806 5391802 5391807 +
ggagaccaaggtgggaggattg

SEQ ID NO: 111257 - DNA, 22 bp, Artificial Sequence
  Synthetic oligonucleotide; TTG chr11 5391807 5391828 5391824 5391829 +
ctgaaggccaggagtttgagac

SEQ ID NO: 111258 - DNA, 22 bp, Artificial Sequence
  Synthetic oligonucleotide; CTG chr11 5391810 5391831 5391827 5391832 +
aaggccaggagtttgagaccaa

SEQ ID NO: 111259 - DNA, 22 bp, Artificial Sequence
  Synthetic oligonucleotide; TTT chr11 5391824 5391845 5391841 5391846 +
gagaccaacttcaggcaagaag

SEQ ID NO: 111260 - DNA, 22 bp, Artificial Sequence
  Synthetic oligonucleotide; TTG chr11 5391825 5391846 5391842 5391847 +
agaccaacttcaggcaagaaga

SEQ ID NO: 111261 - DNA, 22 bp, Artificial Sequence
  Synthetic oligonucleotide; CTT chr11 5391835 5391856 5391852 5391857 +
caggcaagaagattacttgagt

SEQ ID NO: 111262 - DNA, 22 bp, Artificial Sequence
  Synthetic oligonucleotide; TTC chr11 5391836 5391857 5391853 5391858 +
aggcaagaagattacttgagtc

SEQ ID NO: 111263 - DNA, 22 bp, Artificial Sequence
  Synthetic oligonucleotide; TTA chr11 5391850 5391871 5391867 5391872 +
cttgagtccaggagtttgagac

SEQ ID NO: 111264 - DNA, 22 bp, Artificial Sequence
  Synthetic oligonucleotide; CTT chr11 5391853 5391874 5391870 5391875 +
gagtccaggagtttgagaccag

SEQ ID NO: 111265 - DNA, 22 bp, Artificial Sequence
  Synthetic oligonucleotide; TTG chr11 5391854 5391875 5391871 5391876 +
agtccaggagtttgagaccagc

SEQ ID NO: 111266 - DNA, 22 bp, Artificial Sequence
  Synthetic oligonucleotide; TTT chr11 5391867 5391888 5391884 5391889 +
gagaccagcctgaacaatacag

SEQ ID NO: 111267 - DNA, 22 bp, Artificial Sequence
  Synthetic oligonucleotide; TTG chr11 5391868 5391889 5391885 5391890 +
agaccagcctgaacaatacagc

SEQ ID NO: 111268 - DNA, 22 bp, Artificial Sequence
  Synthetic oligonucleotide; CTG chr11 5391879 5391900 5391896 5391901 +
aacaatacagcaagaccctatc

SEQ ID NO: 111269 - DNA, 22 bp, Artificial Sequence
  Synthetic oligonucleotide; CTA chr11 5391899 5391920 5391916 5391921 +
tctctacaaaaaaaattaaaat

SEQ ID NO: 111270 - DNA, 22 bp, Artificial Sequence
  Synthetic oligonucleotide; CTC chr11 5391903 5391924 5391920 5391925 +
tacaaaaaaaattaaaattagc

SEQ ID NO: 111271 - DNA, 22 bp, Artificial Sequence
  Synthetic oligonucleotide; CTA chr11 5391905 5391926 5391922 5391927 +
caaaaaaaattaaaattagcca

SEQ ID NO: 111272 - DNA, 22 bp, Artificial Sequence
  Synthetic oligonucleotide; TTA chr11 5391917 5391938 5391934 5391939 +
aaattagccatgtgtggcggtg

SEQ ID NO: 111273 - DNA, 22 bp, Artificial Sequence
  Synthetic oligonucleotide; TTA chr11 5391923 5391944 5391940 5391945 +
gccatgtgtggcggtgcacgtc

SEQ ID NO: 111274 - DNA, 22 bp, Artificial Sequence
  Synthetic oligonucleotide; CTG chr11 5391947 5391968 5391964 5391969 +
tagtctcagctacctgggaggc

SEQ ID NO: 111275 - DNA, 22 bp, Artificial Sequence
  Synthetic oligonucleotide; CTC chr11 5391954 5391975 5391971 5391976 +
agctacctgggaggctgaggtg

SEQ ID NO: 111276 - DNA, 22 bp, Artificial Sequence
  Synthetic oligonucleotide; CTA chr11 5391959 5391980 5391976 5391981 +
cctgggaggctgaggtgggaag

SEQ ID NO: 111277 - DNA, 22 bp, Artificial Sequence
  Synthetic oligonucleotide; CTG chr11 5391963 5391984 5391980 5391985 +
ggaggctgaggtgggaagaatg

SEQ ID NO: 111278 - DNA, 22 bp, Artificial Sequence
  Synthetic oligonucleotide; CTG chr11 5391971 5391992 5391988 5391993 +
aggtgggaagaatgcttgagcc

SEQ ID NO: 111279 - DNA, 22 bp, Artificial Sequence
  Synthetic oligonucleotide; CTT chr11 5391988 5392009 5392005 5392010 +
gagcccaggaggttgaggctgc

SEQ ID NO: 111280 - DNA, 22 bp, Artificial Sequence
  Synthetic oligonucleotide; TTG chr11 5391989 5392010 5392006 5392011 +
agcccaggaggttgaggctgca

SEQ ID NO: 111281 - DNA, 22 bp, Artificial Sequence
  Synthetic oligonucleotide; TTG chr11 5392003 5392024 5392020 5392025 +
aggctgcagtgagccataatca

SEQ ID NO: 111282 - DNA, 22 bp, Artificial Sequence
  Synthetic oligonucleotide; CTG chr11 5392009 5392030 5392026 5392031 +
cagtgagccataatcacactac

SEQ ID NO: 111283 - DNA, 22 bp, Artificial Sequence
  Synthetic oligonucleotide; CTA chr11 5392030 5392051 5392047 5392052 +
ctgcctgggtgaccaagtgaga

SEQ ID NO: 111284 - DNA, 22 bp, Artificial Sequence
  Synthetic oligonucleotide; CTG chr11 5392033 5392054 5392050 5392055 +
cctgggtgaccaagtgagaccc

SEQ ID NO: 111285 - DNA, 22 bp, Artificial Sequence
  Synthetic oligonucleotide; CTG chr11 5392037 5392058 5392054 5392059 +
ggtgaccaagtgagaccccgat

SEQ ID NO: 111286 - DNA, 22 bp, Artificial Sequence
  Synthetic oligonucleotide; TTC chr11 5392061 5392082 5392078 5392083 +
aaaaataaaaaggaaaacaaac

SEQ ID NO: 111287 - DNA, 22 bp, Artificial Sequence
  Synthetic oligonucleotide; TTA chr11 5392090 5392111 5392107 5392112 +
caaagcgaaatttaaaaaagaa

SEQ ID NO: 111288 - DNA, 22 bp, Artificial Sequence
  Synthetic oligonucleotide; TTT chr11 5392103 5392124 5392120 5392125 +
aaaaaagaaccaaactctaaaa

SEQ ID NO: 111289 - DNA, 22 bp, Artificial Sequence
  Synthetic oligonucleotide; TTA chr11 5392104 5392125 5392121 5392126 +
aaaaagaaccaaactctaaaaa

SEQ ID NO: 111290 - DNA, 22 bp, Artificial Sequence
  Synthetic oligonucleotide; CTC chr11 5392120 5392141 5392137 5392142 +
taaaaatatgtatgtatgtttg

SEQ ID NO: 111291 - DNA, 22 bp, Artificial Sequence
  Synthetic oligonucleotide; CTA chr11 5392122 5392143 5392139 5392144 +
aaaatatgtatgtatgtttgtg

SEQ ID NO: 111292 - DNA, 22 bp, Artificial Sequence
  Synthetic oligonucleotide; TTT chr11 5392141 5392162 5392158 5392163 +
gtgcggtttcttgtgtatgttt

SEQ ID NO: 111293 - DNA, 22 bp, Artificial Sequence
  Synthetic oligonucleotide; TTG chr11 5392142 5392163 5392159 5392164 +
tgcggtttcttgtgtatgtttg

SEQ ID NO: 111294 - DNA, 22 bp, Artificial Sequence
  Synthetic oligonucleotide; TTT chr11 5392150 5392171 5392167 5392172 +
cttgtgtatgtttgtgtggtat

SEQ ID NO: 111295 - DNA, 22 bp, Artificial Sequence
  Synthetic oligonucleotide; TTC chr11 5392151 5392172 5392168 5392173 +
ttgtgtatgtttgtgtggtatc

SEQ ID NO: 111296 - DNA, 22 bp, Artificial Sequence
  Synthetic oligonucleotide; CTT chr11 5392153 5392174 5392170 5392175 +
gtgtatgtttgtgtggtatctc

SEQ ID NO: 111297 - DNA, 22 bp, Artificial Sequence
  Synthetic oligonucleotide; TTG chr11 5392154 5392175 5392171 5392176 +
tgtatgtttgtgtggtatctca

SEQ ID NO: 111298 - DNA, 22 bp, Artificial Sequence
  Synthetic oligonucleotide; TTT chr11 5392163 5392184 5392180 5392185 +
gtgtggtatctcatgtttgtat

SEQ ID NO: 111299 - DNA, 22 bp, Artificial Sequence
  Synthetic oligonucleotide; TTG chr11 5392164 5392185 5392181 5392186 +
tgtggtatctcatgtttgtatg

SEQ ID NO: 111300 - DNA, 22 bp, Artificial Sequence
  Synthetic oligonucleotide; CTC chr11 5392175 5392196 5392192 5392197 +
atgtttgtatgtgtgggtgtta

SEQ ID NO: 111301 - DNA, 22 bp, Artificial Sequence
  Synthetic oligonucleotide; TTT chr11 5392181 5392202 5392198 5392203 +
gtatgtgtgggtgttatcagac

SEQ ID NO: 111302 - DNA, 22 bp, Artificial Sequence
  Synthetic oligonucleotide; TTG chr11 5392182 5392203 5392199 5392204 +
tatgtgtgggtgttatcagact

SEQ ID NO: 111303 - DNA, 22 bp, Artificial Sequence
  Synthetic oligonucleotide; TTA chr11 5392197 5392218 5392214 5392219 +
tcagactctcaggcttgggagc

SEQ ID NO: 111304 - DNA, 22 bp, Artificial Sequence
  Synthetic oligonucleotide; CTC chr11 5392205 5392226 5392222 5392227 +
tcaggcttgggagcccctctgg

SEQ ID NO: 111305 - DNA, 22 bp, Artificial Sequence
  Synthetic oligonucleotide; CTC chr11 5392207 5392228 5392224 5392229 +
aggcttgggagcccctctggaa

SEQ ID NO: 111306 - DNA, 22 bp, Artificial Sequence
  Synthetic oligonucleotide; CTT chr11 5392213 5392234 5392230 5392235 +
gggagcccctctggaacccagc

SEQ ID NO: 111307 - DNA, 22 bp, Artificial Sequence
  Synthetic oligonucleotide; TTG chr11 5392214 5392235 5392231 5392236 +
ggagcccctctggaacccagca

SEQ ID NO: 111308 - DNA, 22 bp, Artificial Sequence
  Synthetic oligonucleotide; CTC chr11 5392224 5392245 5392241 5392246 +
tggaacccagcagtttctgcag

SEQ ID NO: 111309 - DNA, 22 bp, Artificial Sequence
  Synthetic oligonucleotide; CTG chr11 5392226 5392247 5392243 5392248 +
gaacccagcagtttctgcagcc

SEQ ID NO: 111310 - DNA, 22 bp, Artificial Sequence
  Synthetic oligonucleotide; TTT chr11 5392240 5392261 5392257 5392262 +
ctgcagccttacaggctggcac

SEQ ID NO: 111311 - DNA, 22 bp, Artificial Sequence
  Synthetic oligonucleotide; TTC chr11 5392241 5392262 5392258 5392263 +
tgcagccttacaggctggcact

SEQ ID NO: 111312 - DNA, 22 bp, Artificial Sequence
  Synthetic oligonucleotide; CTG chr11 5392243 5392264 5392260 5392265 +
cagccttacaggctggcactcc

SEQ ID NO: 111313 - DNA, 22 bp, Artificial Sequence
  Synthetic oligonucleotide; CTT chr11 5392250 5392271 5392267 5392272 +
acaggctggcactccttaaaca

SEQ ID NO: 111314 - DNA, 22 bp, Artificial Sequence
  Synthetic oligonucleotide; TTA chr11 5392251 5392272 5392268 5392273 +
caggctggcactccttaaacat

SEQ ID NO: 111315 - DNA, 22 bp, Artificial Sequence
  Synthetic oligonucleotide; CTG chr11 5392258 5392279 5392275 5392280 +
gcactccttaaacataggttcc

SEQ ID NO: 111316 - DNA, 22 bp, Artificial Sequence
  Synthetic oligonucleotide; CTC chr11 5392264 5392285 5392281 5392286 +
cttaaacataggttccattcta

SEQ ID NO: 111317 - DNA, 22 bp, Artificial Sequence
  Synthetic oligonucleotide; CTT chr11 5392267 5392288 5392284 5392289 +
aaacataggttccattctaaac

SEQ ID NO: 111318 - DNA, 22 bp, Artificial Sequence
  Synthetic oligonucleotide; TTA chr11 5392268 5392289 5392285 5392290 +
aacataggttccattctaaact

SEQ ID NO: 111319 - DNA, 22 bp, Artificial Sequence
  Synthetic oligonucleotide; TTC chr11 5392279 5392300 5392296 5392301 +
cattctaaactttaatttacat

SEQ ID NO: 111320 - DNA, 22 bp, Artificial Sequence
  Synthetic oligonucleotide; TTC chr11 5392284 5392305 5392301 5392306 +
taaactttaatttacatccaca

SEQ ID NO: 111321 - DNA, 22 bp, Artificial Sequence
  Synthetic oligonucleotide; CTA chr11 5392286 5392307 5392303 5392308 +
aactttaatttacatccacata

SEQ ID NO: 111322 - DNA, 22 bp, Artificial Sequence
  Synthetic oligonucleotide; CTT chr11 5392291 5392312 5392308 5392313 +
taatttacatccacatagtagg

SEQ ID NO: 111323 - DNA, 22 bp, Artificial Sequence
  Synthetic oligonucleotide; TTT chr11 5392292 5392313 5392309 5392314 +
aatttacatccacatagtaggc

SEQ ID NO: 111324 - DNA, 22 bp, Artificial Sequence
  Synthetic oligonucleotide; TTA chr11 5392293 5392314 5392310 5392315 +
atttacatccacatagtaggcc

SEQ ID NO: 111325 - DNA, 22 bp, Artificial Sequence
  Synthetic oligonucleotide; TTT chr11 5392297 5392318 5392314 5392319 +
acatccacatagtaggccacat

SEQ ID NO: 111326 - DNA, 22 bp, Artificial Sequence
  Synthetic oligonucleotide; TTA chr11 5392298 5392319 5392315 5392320 +
catccacatagtaggccacatt

SEQ ID NO: 111327 - DNA, 22 bp, Artificial Sequence
  Synthetic oligonucleotide; TTA chr11 5392321 5392342 5392338 5392343 +
ctcaatagcagttccgagactt

SEQ ID NO: 111328 - DNA, 22 bp, Artificial Sequence
  Synthetic oligonucleotide; CTC chr11 5392324 5392345 5392341 5392346 +
aatagcagttccgagacttaga

SEQ ID NO: 111329 - DNA, 22 bp, Artificial Sequence
  Synthetic oligonucleotide; TTC chr11 5392335 5392356 5392352 5392357 +
cgagacttagaatattcttctc

SEQ ID NO: 111330 - DNA, 22 bp, Artificial Sequence
  Synthetic oligonucleotide; CTT chr11 5392343 5392364 5392360 5392365 +
agaatattcttctccatgttga

SEQ ID NO: 111331 - DNA, 22 bp, Artificial Sequence
  Synthetic oligonucleotide; TTA chr11 5392344 5392365 5392361 5392366 +
gaatattcttctccatgttgag

SEQ ID NO: 111332 - DNA, 22 bp, Artificial Sequence
  Synthetic oligonucleotide; TTC chr11 5392352 5392373 5392369 5392374 +
ttctccatgttgagaggaaatt

SEQ ID NO: 111333 - DNA, 22 bp, Artificial Sequence
  Synthetic oligonucleotide; CTT chr11 5392354 5392375 5392371 5392376 +
ctccatgttgagaggaaattcc

SEQ ID NO: 111334 - DNA, 22 bp, Artificial Sequence
  Synthetic oligonucleotide; TTC chr11 5392355 5392376 5392372 5392377 +
tccatgttgagaggaaattcct

SEQ ID NO: 111335 - DNA, 22 bp, Artificial Sequence
  Synthetic oligonucleotide; CTC chr11 5392357 5392378 5392374 5392379 +
catgttgagaggaaattcctat

SEQ ID NO: 111336 - DNA, 22 bp, Artificial Sequence
  Synthetic oligonucleotide; TTG chr11 5392364 5392385 5392381 5392386 +
agaggaaattcctattctatag

SEQ ID NO: 111337 - DNA, 22 bp, Artificial Sequence
  Synthetic oligonucleotide; TTC chr11 5392375 5392396 5392392 5392397 +
ctattctatagatctcatttgg

SEQ ID NO: 111338 - DNA, 22 bp, Artificial Sequence
  Synthetic oligonucleotide; CTA chr11 5392378 5392399 5392395 5392400 +
ttctatagatctcatttggtag

SEQ ID NO: 111339 - DNA, 22 bp, Artificial Sequence
  Synthetic oligonucleotide; TTC chr11 5392381 5392402 5392398 5392403 +
tatagatctcatttggtagaat

SEQ ID NO: 111340 - DNA, 22 bp, Artificial Sequence
  Synthetic oligonucleotide; CTA chr11 5392383 5392404 5392400 5392405 +
tagatctcatttggtagaatgg

SEQ ID NO: 111341 - DNA, 22 bp, Artificial Sequence
  Synthetic oligonucleotide; CTC chr11 5392391 5392412 5392408 5392413 +
atttggtagaatggggtacaaa

SEQ ID NO: 111342 - DNA, 22 bp, Artificial Sequence
  Synthetic oligonucleotide; TTT chr11 5392395 5392416 5392412 5392417 +
ggtagaatggggtacaaaaaat

SEQ ID NO: 111343 - DNA, 22 bp, Artificial Sequence
  Synthetic oligonucleotide; TTG chr11 5392396 5392417 5392413 5392418 +
gtagaatggggtacaaaaaatt

SEQ ID NO: 111344 - DNA, 22 bp, Artificial Sequence
  Synthetic oligonucleotide; TTT chr11 5392419 5392440 5392436 5392441 +
aggatttggatttagattagca

SEQ ID NO: 111345 - DNA, 22 bp, Artificial Sequence
  Synthetic oligonucleotide; TTA chr11 5392420 5392441 5392437 5392442 +
ggatttggatttagattagcac

SEQ ID NO: 111346 - DNA, 22 bp, Artificial Sequence
  Synthetic oligonucleotide; TTT chr11 5392426 5392447 5392443 5392448 +
ggatttagattagcactgaagt

SEQ ID NO: 111347 - DNA, 22 bp, Artificial Sequence
  Synthetic oligonucleotide; TTG chr11 5392427 5392448 5392444 5392449 +
gatttagattagcactgaagtc

SEQ ID NO: 111348 - DNA, 22 bp, Artificial Sequence
  Synthetic oligonucleotide; TTT chr11 5392432 5392453 5392449 5392454 +
agattagcactgaagtcccatt

SEQ ID NO: 111349 - DNA, 22 bp, Artificial Sequence
  Synthetic oligonucleotide; TTA chr11 5392433 5392454 5392450 5392455 +
gattagcactgaagtcccattt

SEQ ID NO: 111350 - DNA, 22 bp, Artificial Sequence
  Synthetic oligonucleotide; TTA chr11 5392438 5392459 5392455 5392460 +
gcactgaagtcccattttgcct

SEQ ID NO: 111351 - DNA, 22 bp, Artificial Sequence
  Synthetic oligonucleotide; CTG chr11 5392444 5392465 5392461 5392466 +
aagtcccattttgcctcttatt

SEQ ID NO: 111352 - DNA, 22 bp, Artificial Sequence
  Synthetic oligonucleotide; TTT chr11 5392455 5392476 5392472 5392477 +
tgcctcttattaacaaatagac

SEQ ID NO: 111353 - DNA, 22 bp, Artificial Sequence
  Synthetic oligonucleotide; TTT chr11 5392456 5392477 5392473 5392478 +
gcctcttattaacaaatagacc

SEQ ID NO: 111354 - DNA, 22 bp, Artificial Sequence
  Synthetic oligonucleotide; TTG chr11 5392457 5392478 5392474 5392479 +
cctcttattaacaaatagacca

SEQ ID NO: 111355 - DNA, 22 bp, Artificial Sequence
  Synthetic oligonucleotide; CTC chr11 5392461 5392482 5392478 5392483 +
ttattaacaaatagaccactga

SEQ ID NO: 111356 - DNA, 22 bp, Artificial Sequence
  Synthetic oligonucleotide; CTT chr11 5392463 5392484 5392480 5392485 +
attaacaaatagaccactgaca

SEQ ID NO: 111357 - DNA, 22 bp, Artificial Sequence
  Synthetic oligonucleotide; TTA chr11 5392464 5392485 5392481 5392486 +
ttaacaaatagaccactgacat

SEQ ID NO: 111358 - DNA, 22 bp, Artificial Sequence
  Synthetic oligonucleotide; TTA chr11 5392467 5392488 5392484 5392489 +
acaaatagaccactgacatcta

SEQ ID NO: 111359 - DNA, 22 bp, Artificial Sequence
  Synthetic oligonucleotide; CTG chr11 5392482 5392503 5392499 5392504 +
acatctaaatttcattttcaaa

SEQ ID NO: 111360 - DNA, 22 bp, Artificial Sequence
  Synthetic oligonucleotide; CTA chr11 5392489 5392510 5392506 5392511 +
aatttcattttcaaattaggaa

SEQ ID NO: 111361 - DNA, 22 bp, Artificial Sequence
  Synthetic oligonucleotide; TTT chr11 5392494 5392515 5392511 5392516 +
cattttcaaattaggaaatacg

SEQ ID NO: 111362 - DNA, 22 bp, Artificial Sequence
  Synthetic oligonucleotide; TTC chr11 5392495 5392516 5392512 5392517 +
attttcaaattaggaaatacgt

SEQ ID NO: 111363 - DNA, 22 bp, Artificial Sequence
  Synthetic oligonucleotide; TTT chr11 5392499 5392520 5392516 5392521 +
tcaaattaggaaatacgtacag

SEQ ID NO: 111364 - DNA, 22 bp, Artificial Sequence
  Synthetic oligonucleotide; TTT chr11 5392500 5392521 5392517 5392522 +
caaattaggaaatacgtacagg

SEQ ID NO: 111365 - DNA, 22 bp, Artificial Sequence
  Synthetic oligonucleotide; TTC chr11 5392501 5392522 5392518 5392523 +
aaattaggaaatacgtacaggt

SEQ ID NO: 111366 - DNA, 22 bp, Artificial Sequence
  Synthetic oligonucleotide; TTA chr11 5392507 5392528 5392524 5392529 +
ggaaatacgtacaggtaataac

SEQ ID NO: 111367 - DNA, 22 bp, Artificial Sequence
  Synthetic oligonucleotide; TTT chr11 5392535 5392556 5392552 5392557 +
gaaaacttctaccttactcaaa

SEQ ID NO: 111368 - DNA, 22 bp, Artificial Sequence
  Synthetic oligonucleotide; TTG chr11 5392536 5392557 5392553 5392558 +
aaaacttctaccttactcaaat

SEQ ID NO: 111369 - DNA, 22 bp, Artificial Sequence
  Synthetic oligonucleotide; CTT chr11 5392543 5392564 5392560 5392565 +
ctaccttactcaaatttaaaat

SEQ ID NO: 111370 - DNA, 22 bp, Artificial Sequence
  Synthetic oligonucleotide; TTC chr11 5392544 5392565 5392561 5392566 +
taccttactcaaatttaaaatg

SEQ ID NO: 111371 - DNA, 22 bp, Artificial Sequence
  Synthetic oligonucleotide; CTA chr11 5392546 5392567 5392563 5392568 +
ccttactcaaatttaaaatgca

SEQ ID NO: 111372 - DNA, 22 bp, Artificial Sequence
  Synthetic oligonucleotide; CTT chr11 5392550 5392571 5392567 5392572 +
actcaaatttaaaatgcaaatt

SEQ ID NO: 111373 - DNA, 22 bp, Artificial Sequence
  Synthetic oligonucleotide; TTA chr11 5392551 5392572 5392568 5392573 +
ctcaaatttaaaatgcaaatta

SEQ ID NO: 111374 - DNA, 22 bp, Artificial Sequence
  Synthetic oligonucleotide; CTC chr11 5392554 5392575 5392571 5392576 +
aaatttaaaatgcaaattaaca

SEQ ID NO: 111375 - DNA, 22 bp, Artificial Sequence
  Synthetic oligonucleotide; TTT chr11 5392560 5392581 5392577 5392582 +
aaaatgcaaattaacatatctt

SEQ ID NO: 111376 - DNA, 22 bp, Artificial Sequence
  Synthetic oligonucleotide; TTA chr11 5392561 5392582 5392578 5392583 +
aaatgcaaattaacatatctta

SEQ ID NO: 111377 - DNA, 22 bp, Artificial Sequence
  Synthetic oligonucleotide; TTA chr11 5392573 5392594 5392590 5392595 +
acatatcttaatttgttactaa

SEQ ID NO: 111378 - DNA, 22 bp, Artificial Sequence
  Synthetic oligonucleotide; CTT chr11 5392582 5392603 5392599 5392604 +
aatttgttactaaacgaatatt

SEQ ID NO: 111379 - DNA, 22 bp, Artificial Sequence
  Synthetic oligonucleotide; TTA chr11 5392583 5392604 5392600 5392605 +
atttgttactaaacgaatattg

SEQ ID NO: 111380 - DNA, 22 bp, Artificial Sequence
  Synthetic oligonucleotide; TTT chr11 5392587 5392608 5392604 5392609 +
gttactaaacgaatattgaaga

SEQ ID NO: 111381 - DNA, 22 bp, Artificial Sequence
  Synthetic oligonucleotide; TTG chr11 5392588 5392609 5392605 5392610 +
ttactaaacgaatattgaagaa

SEQ ID NO: 111382 - DNA, 22 bp, Artificial Sequence
  Synthetic oligonucleotide; TTA chr11 5392591 5392612 5392608 5392613 +
ctaaacgaatattgaagaatag

SEQ ID NO: 111383 - DNA, 22 bp, Artificial Sequence
  Synthetic oligonucleotide; CTA chr11 5392594 5392615 5392611 5392616 +
aacgaatattgaagaatagagt

SEQ ID NO: 111384 - DNA, 22 bp, Artificial Sequence
  Synthetic oligonucleotide; TTG chr11 5392605 5392626 5392622 5392627 +
aagaatagagttaacaatcaat

SEQ ID NO: 111385 - DNA, 22 bp, Artificial Sequence
  Synthetic oligonucleotide; TTA chr11 5392618 5392639 5392635 5392640 +
acaatcaatatctggctgggcg

SEQ ID NO: 111386 - DNA, 22 bp, Artificial Sequence
  Synthetic oligonucleotide; CTG chr11 5392632 5392653 5392649 5392654 +
gctgggcgcggtggctcacgcc

SEQ ID NO: 111387 - DNA, 22 bp, Artificial Sequence
  Synthetic oligonucleotide; CTG chr11 5392636 5392657 5392653 5392658 +
ggcgcggtggctcacgcctgta

SEQ ID NO: 111388 - DNA, 22 bp, Artificial Sequence
  Synthetic oligonucleotide; CTC chr11 5392649 5392670 5392666 5392671 +
acgcctgtaatcccagcactct

SEQ ID NO: 111389 - DNA, 22 bp, Artificial Sequence
  Synthetic oligonucleotide; CTG chr11 5392656 5392677 5392673 5392678 +
taatcccagcactctgggaggc

SEQ ID NO: 111390 - DNA, 22 bp, Artificial Sequence
  Synthetic oligonucleotide; CTC chr11 5392670 5392691 5392687 5392692 +
tgggaggccgaggcgggtggat

SEQ ID NO: 111391 - DNA, 22 bp, Artificial Sequence
  Synthetic oligonucleotide; CTG chr11 5392672 5392693 5392689 5392694 +
ggaggccgaggcgggtggatca

SEQ ID NO: 111392 - DNA, 22 bp, Artificial Sequence
  Synthetic oligonucleotide; CTG chr11 5392721 5392742 5392738 5392743 +
gctaacacggtggaacccagtc

SEQ ID NO: 111393 - DNA, 22 bp, Artificial Sequence
  Synthetic oligonucleotide; CTA chr11 5392725 5392746 5392742 5392747 +
acacggtggaacccagtctcta

SEQ ID NO: 111394 - DNA, 22 bp, Artificial Sequence
  Synthetic oligonucleotide; CTC chr11 5392745 5392766 5392762 5392767 +
tactaaaaatacaaaaagttag

SEQ ID NO: 111395 - DNA, 22 bp, Artificial Sequence
  Synthetic oligonucleotide; CTA chr11 5392747 5392768 5392764 5392769 +
ctaaaaatacaaaaagttagcc

SEQ ID NO: 111396 - DNA, 22 bp, Artificial Sequence
  Synthetic oligonucleotide; CTA chr11 5392750 5392771 5392767 5392772 +
aaaatacaaaaagttagccggg

SEQ ID NO: 111397 - DNA, 22 bp, Artificial Sequence
  Synthetic oligonucleotide; TTA chr11 5392766 5392787 5392783 5392788 +
gccgggcatggtggtgggcacc

SEQ ID NO: 111398 - DNA, 22 bp, Artificial Sequence
  Synthetic oligonucleotide; CTG chr11 5392790 5392811 5392807 5392812 +
tagtcccagctactcaggaggc

SEQ ID NO: 111399 - DNA, 22 bp, Artificial Sequence
  Synthetic oligonucleotide; CTA chr11 5392802 5392823 5392819 5392824 +
ctcaggaggctggggcagcaga

SEQ ID NO: 111400 - DNA, 22 bp, Artificial Sequence
  Synthetic oligonucleotide; CTC chr11 5392805 5392826 5392822 5392827 +
aggaggctggggcagcagaatg

SEQ ID NO: 111401 - DNA, 22 bp, Artificial Sequence
  Synthetic oligonucleotide; CTG chr11 5392814 5392835 5392831 5392836 +
gggcagcagaatggcgtgaacc

SEQ ID NO: 111402 - DNA, 22 bp, Artificial Sequence
  Synthetic oligonucleotide; CTT chr11 5392851 5392872 5392868 5392873 +
gcagtgagccgagatcgtgcca

SEQ ID NO: 111403 - DNA, 22 bp, Artificial Sequence
  Synthetic oligonucleotide; TTG chr11 5392852 5392873 5392869 5392874 +
cagtgagccgagatcgtgccac

SEQ ID NO: 111404 - DNA, 22 bp, Artificial Sequence
  Synthetic oligonucleotide; CTG chr11 5392876 5392897 5392893 5392898 +
cactccagcctgggcaacagag

SEQ ID NO: 111405 - DNA, 22 bp, Artificial Sequence
  Synthetic oligonucleotide; CTC chr11 5392881 5392902 5392898 5392903 +
cagcctgggcaacagagcaaga

SEQ ID NO: 111406 - DNA, 22 bp, Artificial Sequence
  Synthetic oligonucleotide; CTG chr11 5392888 5392909 5392905 5392910 +
ggcaacagagcaagactccttc

SEQ ID NO: 111407 - DNA, 22 bp, Artificial Sequence
  Synthetic oligonucleotide; CTC chr11 5392906 5392927 5392923 5392928 +
cttctcaaaaacaaaaaaaaag

SEQ ID NO: 111408 - DNA, 22 bp, Artificial Sequence
  Synthetic oligonucleotide; CTT chr11 5392909 5392930 5392926 5392931 +
ctcaaaaacaaaaaaaaagaaa

SEQ ID NO: 111409 - DNA, 22 bp, Artificial Sequence
  Synthetic oligonucleotide; TTC chr11 5392910 5392931 5392927 5392932 +
tcaaaaacaaaaaaaaagaaaa

SEQ ID NO: 111410 - DNA, 22 bp, Artificial Sequence
  Synthetic oligonucleotide; CTC chr11 5392912 5392933 5392929 5392934 +
aaaaacaaaaaaaaagaaaaat

SEQ ID NO: 111411 - DNA, 22 bp, Artificial Sequence
  Synthetic oligonucleotide; CTG chr11 5392947 5392968 5392964 5392969 +
tgctgttaagtatgtggtaaaa

SEQ ID NO: 111412 - DNA, 22 bp, Artificial Sequence
  Synthetic oligonucleotide; CTG chr11 5392952 5392973 5392969 5392974 +
ttaagtatgtggtaaaagaggt

SEQ ID NO: 111413 - DNA, 22 bp, Artificial Sequence
  Synthetic oligonucleotide; TTA chr11 5392955 5392976 5392972 5392977 +
agtatgtggtaaaagaggtatt

SEQ ID NO: 111414 - DNA, 22 bp, Artificial Sequence
  Synthetic oligonucleotide; TTT chr11 5392978 5392999 5392995 5393000 +
tcacataccagaatgaaaacat

SEQ ID NO: 111415 - DNA, 22 bp, Artificial Sequence
  Synthetic oligonucleotide; TTT chr11 5392979 5393000 5392996 5393001 +
cacataccagaatgaaaacata

SEQ ID NO: 111416 - DNA, 22 bp, Artificial Sequence
  Synthetic oligonucleotide; TTC chr11 5392980 5393001 5392997 5393002 +
acataccagaatgaaaacataa

SEQ ID NO: 111417 - DNA, 22 bp, Artificial Sequence
  Synthetic oligonucleotide; TTT chr11 5393005 5393026 5393022 5393027 +
aatttgccttttataaaaaaca

SEQ ID NO: 111418 - DNA, 22 bp, Artificial Sequence
  Synthetic oligonucleotide; TTA chr11 5393006 5393027 5393023 5393028 +
atttgccttttataaaaaacaa

SEQ ID NO: 111419 - DNA, 22 bp, Artificial Sequence
  Synthetic oligonucleotide; TTT chr11 5393010 5393031 5393027 5393032 +
gccttttataaaaaacaaaata

SEQ ID NO: 111420 - DNA, 22 bp, Artificial Sequence
  Synthetic oligonucleotide; TTG chr11 5393011 5393032 5393028 5393033 +
ccttttataaaaaacaaaatac

SEQ ID NO: 111421 - DNA, 22 bp, Artificial Sequence
  Synthetic oligonucleotide; CTT chr11 5393015 5393036 5393032 5393037 +
ttataaaaaacaaaatacatca

SEQ ID NO: 111422 - DNA, 22 bp, Artificial Sequence
  Synthetic oligonucleotide; TTT chr11 5393016 5393037 5393033 5393038 +
tataaaaaacaaaatacatcaa

SEQ ID NO: 111423 - DNA, 22 bp, Artificial Sequence
  Synthetic oligonucleotide; TTT chr11 5393017 5393038 5393034 5393039 +
ataaaaaacaaaatacatcaaa

SEQ ID NO: 111424 - DNA, 22 bp, Artificial Sequence
  Synthetic oligonucleotide; TTA chr11 5393018 5393039 5393035 5393040 +
taaaaaacaaaatacatcaaaa

SEQ ID NO: 111425 - DNA, 22 bp, Artificial Sequence
  Synthetic oligonucleotide; CTT chr11 5393045 5393066 5393062 5393067 +
gaaaatattcatgctctgtgtc

SEQ ID NO: 111426 - DNA, 22 bp, Artificial Sequence
  Synthetic oligonucleotide; TTG chr11 5393046 5393067 5393063 5393068 +
aaaatattcatgctctgtgtct

SEQ ID NO: 111427 - DNA, 22 bp, Artificial Sequence
  Synthetic oligonucleotide; TTC chr11 5393055 5393076 5393072 5393077 +
atgctctgtgtctcagaaatgc

SEQ ID NO: 111428 - DNA, 22 bp, Artificial Sequence
  Synthetic oligonucleotide; CTC chr11 5393061 5393082 5393078 5393083 +
tgtgtctcagaaatgccacttc

SEQ ID NO: 111429 - DNA, 22 bp, Artificial Sequence
  Synthetic oligonucleotide; CTG chr11 5393063 5393084 5393080 5393085 +
tgtctcagaaatgccacttcta

SEQ ID NO: 111430 - DNA, 22 bp, Artificial Sequence
  Synthetic oligonucleotide; CTC chr11 5393069 5393090 5393086 5393091 +
agaaatgccacttctaaaaatc

SEQ ID NO: 111431 - DNA, 22 bp, Artificial Sequence
  Synthetic oligonucleotide; CTT chr11 5393082 5393103 5393099 5393104 +
ctaaaaatctgtcctaaataaa

SEQ ID NO: 111432 - DNA, 22 bp, Artificial Sequence
  Synthetic oligonucleotide; TTC chr11 5393083 5393104 5393100 5393105 +
taaaaatctgtcctaaataaat

SEQ ID NO: 111433 - DNA, 22 bp, Artificial Sequence
  Synthetic oligonucleotide; CTA chr11 5393085 5393106 5393102 5393107 +
aaaatctgtcctaaataaatga

SEQ ID NO: 111434 - DNA, 22 bp, Artificial Sequence
  Synthetic oligonucleotide; CTG chr11 5393093 5393114 5393110 5393115 +
tcctaaataaatgataaattaa

SEQ ID NO: 111435 - DNA, 22 bp, Artificial Sequence
  Synthetic oligonucleotide; CTA chr11 5393098 5393119 5393115 5393120 +
aataaatgataaattaaaaatt

SEQ ID NO: 111436 - DNA, 22 bp, Artificial Sequence
  Synthetic oligonucleotide; TTA chr11 5393114 5393135 5393131 5393136 +
aaaatttaggatgtaagctgtt

SEQ ID NO: 111437 - DNA, 22 bp, Artificial Sequence
  Synthetic oligonucleotide; TTT chr11 5393121 5393142 5393138 5393143 +
aggatgtaagctgtttgtggca

SEQ ID NO: 111438 - DNA, 22 bp, Artificial Sequence
  Synthetic oligonucleotide; TTA chr11 5393122 5393143 5393139 5393144 +
ggatgtaagctgtttgtggcaa

SEQ ID NO: 111439 - DNA, 22 bp, Artificial Sequence
  Synthetic oligonucleotide; CTG chr11 5393134 5393155 5393151 5393156 +
tttgtggcaaaatttttttcct

SEQ ID NO: 111440 - DNA, 22 bp, Artificial Sequence
  Synthetic oligonucleotide; TTT chr11 5393137 5393158 5393154 5393159 +
gtggcaaaatttttttcctgtt

SEQ ID NO: 111441 - DNA, 22 bp, Artificial Sequence
  Synthetic oligonucleotide; TTG chr11 5393138 5393159 5393155 5393160 +
tggcaaaatttttttcctgttt

SEQ ID NO: 111442 - DNA, 22 bp, Artificial Sequence
  Synthetic oligonucleotide; TTT chr11 5393149 5393170 5393166 5393171 +
ttttcctgtttgctcacagttc

SEQ ID NO: 111443 - DNA, 22 bp, Artificial Sequence
  Synthetic oligonucleotide; TTT chr11 5393150 5393171 5393167 5393172 +
tttcctgtttgctcacagttct

SEQ ID NO: 111444 - DNA, 22 bp, Artificial Sequence
  Synthetic oligonucleotide; TTT chr11 5393151 5393172 5393168 5393173 +
ttcctgtttgctcacagttcta

SEQ ID NO: 111445 - DNA, 22 bp, Artificial Sequence
  Synthetic oligonucleotide; TTT chr11 5393152 5393173 5393169 5393174 +
tcctgtttgctcacagttctaa

SEQ ID NO: 111446 - DNA, 22 bp, Artificial Sequence
  Synthetic oligonucleotide; TTT chr11 5393153 5393174 5393170 5393175 +
cctgtttgctcacagttctaaa

SEQ ID NO: 111447 - DNA, 22 bp, Artificial Sequence
  Synthetic oligonucleotide; TTC chr11 5393154 5393175 5393171 5393176 +
ctgtttgctcacagttctaaat

SEQ ID NO: 111448 - DNA, 22 bp, Artificial Sequence
  Synthetic oligonucleotide; CTG chr11 5393157 5393178 5393174 5393179 +
tttgctcacagttctaaatcca

SEQ ID NO: 111449 - DNA, 22 bp, Artificial Sequence
  Synthetic oligonucleotide; TTT chr11 5393160 5393181 5393177 5393182 +
gctcacagttctaaatccatct

SEQ ID NO: 111450 - DNA, 22 bp, Artificial Sequence
  Synthetic oligonucleotide; TTG chr11 5393161 5393182 5393178 5393183 +
ctcacagttctaaatccatctc

SEQ ID NO: 111451 - DNA, 22 bp, Artificial Sequence
  Synthetic oligonucleotide; CTC chr11 5393164 5393185 5393181 5393186 +
acagttctaaatccatctccta

SEQ ID NO: 111452 - DNA, 22 bp, Artificial Sequence
  Synthetic oligonucleotide; TTC chr11 5393171 5393192 5393188 5393193 +
taaatccatctcctaggtcagt

SEQ ID NO: 111453 - DNA, 22 bp, Artificial Sequence
  Synthetic oligonucleotide; CTA chr11 5393173 5393194 5393190 5393195 +
aatccatctcctaggtcagtga

SEQ ID NO: 111454 - DNA, 22 bp, Artificial Sequence
  Synthetic oligonucleotide; CTC chr11 5393183 5393204 5393200 5393205 +
ctaggtcagtgatcaataaata

SEQ ID NO: 111455 - DNA, 22 bp, Artificial Sequence
  Synthetic oligonucleotide; CTA chr11 5393186 5393207 5393203 5393208 +
ggtcagtgatcaataaatatgt

SEQ ID NO: 111456 - DNA, 22 bp, Artificial Sequence
  Synthetic oligonucleotide; TTG chr11 5393212 5393233 5393229 5393234 +
aactatttaataagtgaatatt

SEQ ID NO: 111457 - DNA, 22 bp, Artificial Sequence
  Synthetic oligonucleotide; CTA chr11 5393217 5393238 5393234 5393239 +
tttaataagtgaatattataat

SEQ ID NO: 111458 - DNA, 22 bp, Artificial Sequence
  Synthetic oligonucleotide; TTT chr11 5393220 5393241 5393237 5393242 +
aataagtgaatattataatttg

SEQ ID NO: 111459 - DNA, 22 bp, Artificial Sequence
  Synthetic oligonucleotide; TTA chr11 5393221 5393242 5393238 5393243 +
ataagtgaatattataatttgt

SEQ ID NO: 111460 - DNA, 22 bp, Artificial Sequence
  Synthetic oligonucleotide; TTA chr11 5393235 5393256 5393252 5393257 +
taatttgtgttattgttcataa

SEQ ID NO: 111461 - DNA, 22 bp, Artificial Sequence
  Synthetic oligonucleotide; TTT chr11 5393241 5393262 5393258 5393263 +
gtgttattgttcataattttaa

SEQ ID NO: 111462 - DNA, 22 bp, Artificial Sequence
  Synthetic oligonucleotide; TTG chr11 5393242 5393263 5393259 5393264 +
tgttattgttcataattttaag

SEQ ID NO: 111463 - DNA, 22 bp, Artificial Sequence
  Synthetic oligonucleotide; TTA chr11 5393247 5393268 5393264 5393269 +
ttgttcataattttaagaatgt

SEQ ID NO: 111464 - DNA, 22 bp, Artificial Sequence
  Synthetic oligonucleotide; TTG chr11 5393250 5393271 5393267 5393272 +
ttcataattttaagaatgtaag

SEQ ID NO: 111465 - DNA, 22 bp, Artificial Sequence
  Synthetic oligonucleotide; TTC chr11 5393253 5393274 5393270 5393275 +
ataattttaagaatgtaagcat

SEQ ID NO: 111466 - DNA, 22 bp, Artificial Sequence
  Synthetic oligonucleotide; TTT chr11 5393260 5393281 5393277 5393282 +
taagaatgtaagcatacaaaat

SEQ ID NO: 111467 - DNA, 22 bp, Artificial Sequence
  Synthetic oligonucleotide; TTT chr11 5393261 5393282 5393278 5393283 +
aagaatgtaagcatacaaaatg

SEQ ID NO: 111468 - DNA, 22 bp, Artificial Sequence
  Synthetic oligonucleotide; TTA chr11 5393262 5393283 5393279 5393284 +
agaatgtaagcatacaaaatgt

SEQ ID NO: 111469 - DNA, 22 bp, Artificial Sequence
  Synthetic oligonucleotide; CTA chr11 5393287 5393308 5393304 5393309 +
gaataaaaatattacataaatc

SEQ ID NO: 111470 - DNA, 22 bp, Artificial Sequence
  Synthetic oligonucleotide; TTA chr11 5393301 5393322 5393318 5393323 +
cataaatcaaagcatattcatt

SEQ ID NO: 111471 - DNA, 22 bp, Artificial Sequence
  Synthetic oligonucleotide; TTC chr11 5393320 5393341 5393337 5393342 +
atttgatacactattattaaaa

SEQ ID NO: 111472 - DNA, 22 bp, Artificial Sequence
  Synthetic oligonucleotide; TTT chr11 5393324 5393345 5393341 5393346 +
gatacactattattaaaatgac

SEQ ID NO: 111473 - DNA, 22 bp, Artificial Sequence
  Synthetic oligonucleotide; TTG chr11 5393325 5393346 5393342 5393347 +
atacactattattaaaatgaca

SEQ ID NO: 111474 - DNA, 22 bp, Artificial Sequence
  Synthetic oligonucleotide; CTA chr11 5393333 5393354 5393350 5393355 +
ttattaaaatgacatttaaatg

SEQ ID NO: 111475 - DNA, 22 bp, Artificial Sequence
  Synthetic oligonucleotide; TTA chr11 5393336 5393357 5393353 5393358 +
ttaaaatgacatttaaatgctt

SEQ ID NO: 111476 - DNA, 22 bp, Artificial Sequence
  Synthetic oligonucleotide; TTA chr11 5393339 5393360 5393356 5393361 +
aaatgacatttaaatgcttagg

SEQ ID NO: 111477 - DNA, 22 bp, Artificial Sequence
  Synthetic oligonucleotide; TTT chr11 5393350 5393371 5393367 5393372 +
aaatgcttaggaaactgttggc

SEQ ID NO: 111478 - DNA, 22 bp, Artificial Sequence
  Synthetic oligonucleotide; TTA chr11 5393351 5393372 5393368 5393373 +
aatgcttaggaaactgttggca

SEQ ID NO: 111479 - DNA, 22 bp, Artificial Sequence
  Synthetic oligonucleotide; CTT chr11 5393358 5393379 5393375 5393380 +
aggaaactgttggcaaaatatt

SEQ ID NO: 111480 - DNA, 22 bp, Artificial Sequence
  Synthetic oligonucleotide; TTA chr11 5393359 5393380 5393376 5393381 +
ggaaactgttggcaaaatatta

SEQ ID NO: 111481 - DNA, 22 bp, Artificial Sequence
  Synthetic oligonucleotide; CTG chr11 5393367 5393388 5393384 5393389 +
ttggcaaaatattaaataaaaa

SEQ ID NO: 111482 - DNA, 22 bp, Artificial Sequence
  Synthetic oligonucleotide; TTG chr11 5393370 5393391 5393387 5393392 +
gcaaaatattaaataaaaataa

SEQ ID NO: 111483 - DNA, 22 bp, Artificial Sequence
  Synthetic oligonucleotide; TTA chr11 5393381 5393402 5393398 5393403 +
aataaaaataagcaaaattagg

SEQ ID NO: 111484 - DNA, 22 bp, Artificial Sequence
  Synthetic oligonucleotide; TTA chr11 5393401 5393422 5393418 5393423 +
ggtacagaacaatcactatgta

SEQ ID NO: 111485 - DNA, 22 bp, Artificial Sequence
  Synthetic oligonucleotide; CTA chr11 5393419 5393440 5393436 5393441 +
tgtaaaaggctataaatatttg

SEQ ID NO: 111486 - DNA, 22 bp, Artificial Sequence
  Synthetic oligonucleotide; CTA chr11 5393431 5393452 5393448 5393453 +
taaatatttgtatcaaaagaaa

SEQ ID NO: 111487 - DNA, 22 bp, Artificial Sequence
  Synthetic oligonucleotide; TTT chr11 5393440 5393461 5393457 5393462 +
gtatcaaaagaaaaacagctgt

SEQ ID NO: 111488 - DNA, 22 bp, Artificial Sequence
  Synthetic oligonucleotide; TTG chr11 5393441 5393462 5393458 5393463 +
tatcaaaagaaaaacagctgtt

SEQ ID NO: 111489 - DNA, 22 bp, Artificial Sequence
  Synthetic oligonucleotide; CTG chr11 5393461 5393482 5393478 5393483 +
ttatatataatcttattttcta

SEQ ID NO: 111490 - DNA, 22 bp, Artificial Sequence
  Synthetic oligonucleotide; TTA chr11 5393464 5393485 5393481 5393486 +
tatataatcttattttctatat

SEQ ID NO: 111491 - DNA, 22 bp, Artificial Sequence
  Synthetic oligonucleotide; CTT chr11 5393475 5393496 5393492 5393497 +
attttctatatagatttctcta

SEQ ID NO: 111492 - DNA, 22 bp, Artificial Sequence
  Synthetic oligonucleotide; TTA chr11 5393476 5393497 5393493 5393498 +
ttttctatatagatttctctat

SEQ ID NO: 111493 - DNA, 22 bp, Artificial Sequence
  Synthetic oligonucleotide; TTT chr11 5393479 5393500 5393496 5393501 +
tctatatagatttctctatctt

SEQ ID NO: 111494 - DNA, 22 bp, Artificial Sequence
  Synthetic oligonucleotide; TTT chr11 5393480 5393501 5393497 5393502 +
ctatatagatttctctatcttt

SEQ ID NO: 111495 - DNA, 22 bp, Artificial Sequence
  Synthetic oligonucleotide; TTC chr11 5393481 5393502 5393498 5393503 +
tatatagatttctctatctttg

SEQ ID NO: 111496 - DNA, 22 bp, Artificial Sequence
  Synthetic oligonucleotide; CTA chr11 5393483 5393504 5393500 5393505 +
tatagatttctctatctttgcc

SEQ ID NO: 111497 - DNA, 22 bp, Artificial Sequence
  Synthetic oligonucleotide; TTT chr11 5393492 5393513 5393509 5393514 +
ctctatctttgccgtatacaaa

SEQ ID NO: 111498 - DNA, 22 bp, Artificial Sequence
  Synthetic oligonucleotide; TTC chr11 5393493 5393514 5393510 5393515 +
tctatctttgccgtatacaaat

SEQ ID NO: 111499 - DNA, 22 bp, Artificial Sequence
  Synthetic oligonucleotide; CTC chr11 5393495 5393516 5393512 5393517 +
tatctttgccgtatacaaattt

SEQ ID NO: 111500 - DNA, 22 bp, Artificial Sequence
  Synthetic oligonucleotide; CTA chr11 5393497 5393518 5393514 5393519 +
tctttgccgtatacaaattttc

SEQ ID NO: 111501 - DNA, 22 bp, Artificial Sequence
  Synthetic oligonucleotide; CTT chr11 5393501 5393522 5393518 5393523 +
tgccgtatacaaattttctgaa

SEQ ID NO: 111502 - DNA, 22 bp, Artificial Sequence
  Synthetic oligonucleotide; TTT chr11 5393502 5393523 5393519 5393524 +
gccgtatacaaattttctgaag

SEQ ID NO: 111503 - DNA, 22 bp, Artificial Sequence
  Synthetic oligonucleotide; TTG chr11 5393503 5393524 5393520 5393525 +
ccgtatacaaattttctgaaga

SEQ ID NO: 111504 - DNA, 22 bp, Artificial Sequence
  Synthetic oligonucleotide; TTT chr11 5393517 5393538 5393534 5393539 +
tctgaagaagacatttcggttt

SEQ ID NO: 111505 - DNA, 22 bp, Artificial Sequence
  Synthetic oligonucleotide; TTT chr11 5393518 5393539 5393535 5393540 +
ctgaagaagacatttcggtttt

SEQ ID NO: 111506 - DNA, 22 bp, Artificial Sequence
  Synthetic oligonucleotide; TTC chr11 5393519 5393540 5393536 5393541 +
tgaagaagacatttcggtttta

SEQ ID NO: 111507 - DNA, 22 bp, Artificial Sequence
  Synthetic oligonucleotide; CTG chr11 5393521 5393542 5393538 5393543 +
aagaagacatttcggttttata

SEQ ID NO: 111508 - DNA, 22 bp, Artificial Sequence
  Synthetic oligonucleotide; TTT chr11 5393533 5393554 5393550 5393555 +
cggttttataatctaaaaagag

SEQ ID NO: 111509 - DNA, 22 bp, Artificial Sequence
  Synthetic oligonucleotide; TTC chr11 5393534 5393555 5393551 5393556 +
ggttttataatctaaaaagagc

SEQ ID NO: 111510 - DNA, 22 bp, Artificial Sequence
  Synthetic oligonucleotide; TTT chr11 5393539 5393560 5393556 5393561 +
tataatctaaaaagagcatttt

SEQ ID NO: 111511 - DNA, 22 bp, Artificial Sequence
  Synthetic oligonucleotide; TTT chr11 5393540 5393561 5393557 5393562 +
ataatctaaaaagagcatttta

SEQ ID NO: 111512 - DNA, 22 bp, Artificial Sequence
  Synthetic oligonucleotide; TTA chr11 5393541 5393562 5393558 5393563 +
taatctaaaaagagcattttac

SEQ ID NO: 111513 - DNA, 22 bp, Artificial Sequence
  Synthetic oligonucleotide; CTA chr11 5393548 5393569 5393565 5393570 +
aaaagagcattttacaatgact

SEQ ID NO: 111514 - DNA, 22 bp, Artificial Sequence
  Synthetic oligonucleotide; TTT chr11 5393560 5393581 5393577 5393582 +
tacaatgactataaaaagttat

SEQ ID NO: 111515 - DNA, 22 bp, Artificial Sequence
  Synthetic oligonucleotide; TTT chr11 5393561 5393582 5393578 5393583 +
acaatgactataaaaagttata

SEQ ID NO: 111516 - DNA, 22 bp, Artificial Sequence
  Synthetic oligonucleotide; TTA chr11 5393562 5393583 5393579 5393584 +
caatgactataaaaagttatat

SEQ ID NO: 111517 - DNA, 22 bp, Artificial Sequence
  Synthetic oligonucleotide; CTA chr11 5393571 5393592 5393588 5393593 +
taaaaagttatatacgattatg

SEQ ID NO: 111518 - DNA, 22 bp, Artificial Sequence
  Synthetic oligonucleotide; TTA chr11 5393581 5393602 5393598 5393603 +
tatacgattatgctgaagatga

SEQ ID NO: 111519 - DNA, 22 bp, Artificial Sequence
  Synthetic oligonucleotide; TTA chr11 5393591 5393612 5393608 5393613 +
tgctgaagatgacaatgaagat

SEQ ID NO: 111520 - DNA, 22 bp, Artificial Sequence
  Synthetic oligonucleotide; CTG chr11 5393596 5393617 5393613 5393618 +
aagatgacaatgaagatgataa

SEQ ID NO: 111521 - DNA, 22 bp, Artificial Sequence
  Synthetic oligonucleotide; TTA chr11 5393621 5393642 5393638 5393643 +
tgatcatgataaatgctaatgt

SEQ ID NO: 111522 - DNA, 22 bp, Artificial Sequence
  Synthetic oligonucleotide; CTA chr11 5393639 5393660 5393656 5393661 +
atgtttattaagcatttaactc

SEQ ID NO: 111523 - DNA, 22 bp, Artificial Sequence
  Synthetic oligonucleotide; TTT chr11 5393645 5393666 5393662 5393667 +
attaagcatttaactcacggta

SEQ ID NO: 111524 - DNA, 22 bp, Artificial Sequence
  Synthetic oligonucleotide; TTA chr11 5393646 5393667 5393663 5393668 +
ttaagcatttaactcacggtag

SEQ ID NO: 111525 - DNA, 22 bp, Artificial Sequence
  Synthetic oligonucleotide; TTA chr11 5393649 5393670 5393666 5393671 +
agcatttaactcacggtagaga

SEQ ID NO: 111526 - DNA, 22 bp, Artificial Sequence
  Synthetic oligonucleotide; TTT chr11 5393656 5393677 5393673 5393678 +
aactcacggtagagagggctga

SEQ ID NO: 111527 - DNA, 22 bp, Artificial Sequence
  Synthetic oligonucleotide; TTA chr11 5393657 5393678 5393674 5393679 +
actcacggtagagagggctgag

SEQ ID NO: 111528 - DNA, 22 bp, Artificial Sequence
  Synthetic oligonucleotide; CTC chr11 5393661 5393682 5393678 5393683 +
acggtagagagggctgagtact

SEQ ID NO: 111529 - DNA, 22 bp, Artificial Sequence
  Synthetic oligonucleotide; CTG chr11 5393677 5393698 5393694 5393699 +
agtactttttattttcattatt

SEQ ID NO: 111530 - DNA, 22 bp, Artificial Sequence
  Synthetic oligonucleotide; CTT chr11 5393684 5393705 5393701 5393706 +
tttattttcattattttacatt

SEQ ID NO: 111531 - DNA, 22 bp, Artificial Sequence
  Synthetic oligonucleotide; TTT chr11 5393685 5393706 5393702 5393707 +
ttattttcattattttacatta

SEQ ID NO: 111532 - DNA, 22 bp, Artificial Sequence
  Synthetic oligonucleotide; TTT chr11 5393686 5393707 5393703 5393708 +
tattttcattattttacattat

SEQ ID NO: 111533 - DNA, 22 bp, Artificial Sequence
  Synthetic oligonucleotide; TTT chr11 5393687 5393708 5393704 5393709 +
attttcattattttacattatt

SEQ ID NO: 111534 - DNA, 22 bp, Artificial Sequence
  Synthetic oligonucleotide; TTA chr11 5393688 5393709 5393705 5393710 +
ttttcattattttacattattt

SEQ ID NO: 111535 - DNA, 22 bp, Artificial Sequence
  Synthetic oligonucleotide; TTT chr11 5393691 5393712 5393708 5393713 +
tcattattttacattatttcat

SEQ ID NO: 111536 - DNA, 22 bp, Artificial Sequence
  Synthetic oligonucleotide; TTT chr11 5393692 5393713 5393709 5393714 +
cattattttacattatttcatt

SEQ ID NO: 111537 - DNA, 22 bp, Artificial Sequence
  Synthetic oligonucleotide; TTC chr11 5393693 5393714 5393710 5393715 +
attattttacattatttcattt

SEQ ID NO: 111538 - DNA, 22 bp, Artificial Sequence
  Synthetic oligonucleotide; TTA chr11 5393697 5393718 5393714 5393719 +
ttttacattatttcatttaatt

SEQ ID NO: 111539 - DNA, 22 bp, Artificial Sequence
  Synthetic oligonucleotide; TTT chr11 5393700 5393721 5393717 5393722 +
tacattatttcatttaattttc

SEQ ID NO: 111540 - DNA, 22 bp, Artificial Sequence
  Synthetic oligonucleotide; TTT chr11 5393701 5393722 5393718 5393723 +
acattatttcatttaattttct

SEQ ID NO: 111541 - DNA, 22 bp, Artificial Sequence
  Synthetic oligonucleotide; TTA chr11 5393702 5393723 5393719 5393724 +
cattatttcatttaattttctc

SEQ ID NO: 111542 - DNA, 22 bp, Artificial Sequence
  Synthetic oligonucleotide; TTA chr11 5393707 5393728 5393724 5393729 +
tttcatttaattttctcaccaa

SEQ ID NO: 111543 - DNA, 22 bp, Artificial Sequence
  Synthetic oligonucleotide; TTT chr11 5393710 5393731 5393727 5393732 +
catttaattttctcaccaaacc

SEQ ID NO: 111544 - DNA, 22 bp, Artificial Sequence
  Synthetic oligonucleotide; TTC chr11 5393711 5393732 5393728 5393733 +
atttaattttctcaccaaacct

SEQ ID NO: 111545 - DNA, 22 bp, Artificial Sequence
  Synthetic oligonucleotide; TTT chr11 5393715 5393736 5393732 5393737 +
aattttctcaccaaacctgtga

SEQ ID NO: 111546 - DNA, 22 bp, Artificial Sequence
  Synthetic oligonucleotide; TTA chr11 5393716 5393737 5393733 5393738 +
attttctcaccaaacctgtgaa

SEQ ID NO: 111547 - DNA, 22 bp, Artificial Sequence
  Synthetic oligonucleotide; TTT chr11 5393720 5393741 5393737 5393742 +
tctcaccaaacctgtgaagtag

SEQ ID NO: 111548 - DNA, 22 bp, Artificial Sequence
  Synthetic oligonucleotide; TTT chr11 5393721 5393742 5393738 5393743 +
ctcaccaaacctgtgaagtagg

SEQ ID NO: 111549 - DNA, 22 bp, Artificial Sequence
  Synthetic oligonucleotide; TTC chr11 5393722 5393743 5393739 5393744 +
tcaccaaacctgtgaagtaggg

SEQ ID NO: 111550 - DNA, 22 bp, Artificial Sequence
  Synthetic oligonucleotide; CTC chr11 5393724 5393745 5393741 5393746 +
accaaacctgtgaagtagggag

SEQ ID NO: 111551 - DNA, 22 bp, Artificial Sequence
  Synthetic oligonucleotide; CTG chr11 5393734 5393755 5393751 5393756 +
tgaagtagggaggtattattat

SEQ ID NO: 111552 - DNA, 22 bp, Artificial Sequence
  Synthetic oligonucleotide; TTA chr11 5393752 5393773 5393769 5393774 +
ttattttcaatgttttaaaatt

SEQ ID NO: 111553 - DNA, 22 bp, Artificial Sequence
  Synthetic oligonucleotide; TTA chr11 5393755 5393776 5393772 5393777 +
ttttcaatgttttaaaattagg

SEQ ID NO: 111554 - DNA, 22 bp, Artificial Sequence
  Synthetic oligonucleotide; TTT chr11 5393758 5393779 5393775 5393780 +
tcaatgttttaaaattaggaaa

SEQ ID NO: 111555 - DNA, 22 bp, Artificial Sequence
  Synthetic oligonucleotide; TTT chr11 5393759 5393780 5393776 5393781 +
caatgttttaaaattaggaaac

SEQ ID NO: 111556 - DNA, 22 bp, Artificial Sequence
  Synthetic oligonucleotide; TTC chr11 5393760 5393781 5393777 5393782 +
aatgttttaaaattaggaaact

SEQ ID NO: 111557 - DNA, 22 bp, Artificial Sequence
  Synthetic oligonucleotide; TTT chr11 5393767 5393788 5393784 5393789 +
taaaattaggaaactgaggctc

SEQ ID NO: 111558 - DNA, 22 bp, Artificial Sequence
  Synthetic oligonucleotide; TTT chr11 5393768 5393789 5393785 5393790 +
aaaattaggaaactgaggctca

SEQ ID NO: 111559 - DNA, 22 bp, Artificial Sequence
  Synthetic oligonucleotide; TTA chr11 5393769 5393790 5393786 5393791 +
aaattaggaaactgaggctcac

SEQ ID NO: 111560 - DNA, 22 bp, Artificial Sequence
  Synthetic oligonucleotide; TTA chr11 5393775 5393796 5393792 5393797 +
ggaaactgaggctcacagagga

SEQ ID NO: 111561 - DNA, 22 bp, Artificial Sequence
  Synthetic oligonucleotide; CTG chr11 5393783 5393804 5393800 5393805 +
aggctcacagaggaaagcaact

SEQ ID NO: 111562 - DNA, 22 bp, Artificial Sequence
  Synthetic oligonucleotide; CTC chr11 5393789 5393810 5393806 5393811 +
acagaggaaagcaactttcctt

SEQ ID NO: 111563 - DNA, 22 bp, Artificial Sequence
  Synthetic oligonucleotide; CTT chr11 5393806 5393827 5393823 5393828 +
tccttagttaaatcattaatgt

SEQ ID NO: 111564 - DNA, 22 bp, Artificial Sequence
  Synthetic oligonucleotide; TTT chr11 5393807 5393828 5393824 5393829 +
ccttagttaaatcattaatgta

SEQ ID NO: 111565 - DNA, 22 bp, Artificial Sequence
  Synthetic oligonucleotide; TTC chr11 5393808 5393829 5393825 5393830 +
cttagttaaatcattaatgtaa

SEQ ID NO: 111566 - DNA, 22 bp, Artificial Sequence
  Synthetic oligonucleotide; CTT chr11 5393811 5393832 5393828 5393833 +
agttaaatcattaatgtaagtc

SEQ ID NO: 111567 - DNA, 22 bp, Artificial Sequence
  Synthetic oligonucleotide; TTA chr11 5393812 5393833 5393829 5393834 +
gttaaatcattaatgtaagtca

SEQ ID NO: 111568 - DNA, 22 bp, Artificial Sequence
  Synthetic oligonucleotide; TTA chr11 5393816 5393837 5393833 5393838 +
aatcattaatgtaagtcagaac

SEQ ID NO: 111569 - DNA, 22 bp, Artificial Sequence
  Synthetic oligonucleotide; TTA chr11 5393824 5393845 5393841 5393846 +
atgtaagtcagaactgaaattc

SEQ ID NO: 111570 - DNA, 22 bp, Artificial Sequence
  Synthetic oligonucleotide; CTG chr11 5393840 5393861 5393857 5393862 +
aaattcaatatcaagcgcatct

SEQ ID NO: 111571 - DNA, 22 bp, Artificial Sequence
  Synthetic oligonucleotide; TTC chr11 5393846 5393867 5393863 5393868 +
aatatcaagcgcatctgatttt

SEQ ID NO: 111572 - DNA, 22 bp, Artificial Sequence
  Synthetic oligonucleotide; CTG chr11 5393863 5393884 5393880 5393885 +
attttcttaaaccattatgctg

SEQ ID NO: 111573 - DNA, 22 bp, Artificial Sequence
  Synthetic oligonucleotide; TTT chr11 5393867 5393888 5393884 5393889 +
tcttaaaccattatgctggact

SEQ ID NO: 111574 - DNA, 22 bp, Artificial Sequence
  Synthetic oligonucleotide; TTT chr11 5393868 5393889 5393885 5393890 +
cttaaaccattatgctggactc

SEQ ID NO: 111575 - DNA, 22 bp, Artificial Sequence
  Synthetic oligonucleotide; TTC chr11 5393869 5393890 5393886 5393891 +
ttaaaccattatgctggactcc

SEQ ID NO: 111576 - DNA, 22 bp, Artificial Sequence
  Synthetic oligonucleotide; CTT chr11 5393871 5393892 5393888 5393893 +
aaaccattatgctggactcctc

SEQ ID NO: 111577 - DNA, 22 bp, Artificial Sequence
  Synthetic oligonucleotide; TTA chr11 5393872 5393893 5393889 5393894 +
aaccattatgctggactcctct

SEQ ID NO: 111578 - DNA, 22 bp, Artificial Sequence
  Synthetic oligonucleotide; TTA chr11 5393880 5393901 5393897 5393902 +
tgctggactcctctccaaacag

SEQ ID NO: 111579 - DNA, 22 bp, Artificial Sequence
  Synthetic oligonucleotide; CTG chr11 5393885 5393906 5393902 5393907 +
gactcctctccaaacaggacca

SEQ ID NO: 111580 - DNA, 22 bp, Artificial Sequence
  Synthetic oligonucleotide; CTC chr11 5393890 5393911 5393907 5393912 +
ctctccaaacaggaccactcgt

SEQ ID NO: 111581 - DNA, 22 bp, Artificial Sequence
  Synthetic oligonucleotide; CTC chr11 5393893 5393914 5393910 5393915 +
tccaaacaggaccactcgtttc

SEQ ID NO: 111582 - DNA, 22 bp, Artificial Sequence
  Synthetic oligonucleotide; CTC chr11 5393895 5393916 5393912 5393917 +
caaacaggaccactcgtttcag

SEQ ID NO: 111583 - DNA, 22 bp, Artificial Sequence
  Synthetic oligonucleotide; CTC chr11 5393910 5393931 5393927 5393932 +
gtttcagggccatgttttccat

SEQ ID NO: 111584 - DNA, 22 bp, Artificial Sequence
  Synthetic oligonucleotide; TTT chr11 5393914 5393935 5393931 5393936 +
cagggccatgttttccatgtta

SEQ ID NO: 111585 - DNA, 22 bp, Artificial Sequence
  Synthetic oligonucleotide; TTC chr11 5393915 5393936 5393932 5393937 +
agggccatgttttccatgttat

SEQ ID NO: 111586 - DNA, 22 bp, Artificial Sequence
  Synthetic oligonucleotide; TTT chr11 5393927 5393948 5393944 5393949 +
tccatgttatactgaaggaagt

SEQ ID NO: 111587 - DNA, 22 bp, Artificial Sequence
  Synthetic oligonucleotide; TTT chr11 5393928 5393949 5393945 5393950 +
ccatgttatactgaaggaagtc

SEQ ID NO: 111588 - DNA, 22 bp, Artificial Sequence
  Synthetic oligonucleotide; TTC chr11 5393929 5393950 5393946 5393951 +
catgttatactgaaggaagtcc

SEQ ID NO: 111589 - DNA, 22 bp, Artificial Sequence
  Synthetic oligonucleotide; TTA chr11 5393936 5393957 5393953 5393958 +
tactgaaggaagtcccatcatt

SEQ ID NO: 111590 - DNA, 22 bp, Artificial Sequence
  Synthetic oligonucleotide; CTG chr11 5393941 5393962 5393958 5393963 +
aaggaagtcccatcattggctt

SEQ ID NO: 111591 - DNA, 22 bp, Artificial Sequence
  Synthetic oligonucleotide; TTG chr11 5393959 5393980 5393976 5393981 +
gcttctccctaactttttgttc

SEQ ID NO: 111592 - DNA, 22 bp, Artificial Sequence
  Synthetic oligonucleotide; CTT chr11 5393963 5393984 5393980 5393985 +
ctccctaactttttgttccctt

SEQ ID NO: 111593 - DNA, 22 bp, Artificial Sequence
  Synthetic oligonucleotide; TTC chr11 5393964 5393985 5393981 5393986 +
tccctaactttttgttcccttt

SEQ ID NO: 111594 - DNA, 22 bp, Artificial Sequence
  Synthetic oligonucleotide; CTC chr11 5393966 5393987 5393983 5393988 +
cctaactttttgttccctttcc

SEQ ID NO: 111595 - DNA, 22 bp, Artificial Sequence
  Synthetic oligonucleotide; CTA chr11 5393970 5393991 5393987 5393992 +
actttttgttccctttcctaga

SEQ ID NO: 111596 - DNA, 22 bp, Artificial Sequence
  Synthetic oligonucleotide; CTT chr11 5393974 5393995 5393991 5393996 +
tttgttccctttcctagaatat

SEQ ID NO: 111597 - DNA, 22 bp, Artificial Sequence
  Synthetic oligonucleotide; TTT chr11 5393975 5393996 5393992 5393997 +
ttgttccctttcctagaatatg

SEQ ID NO: 111598 - DNA, 22 bp, Artificial Sequence
  Synthetic oligonucleotide; TTT chr11 5393976 5393997 5393993 5393998 +
tgttccctttcctagaatatgt

SEQ ID NO: 111599 - DNA, 22 bp, Artificial Sequence
  Synthetic oligonucleotide; TTT chr11 5393977 5393998 5393994 5393999 +
gttccctttcctagaatatgtt

SEQ ID NO: 111600 - DNA, 22 bp, Artificial Sequence
  Synthetic oligonucleotide; TTG chr11 5393978 5393999 5393995 5394000 +
ttccctttcctagaatatgtta

SEQ ID NO: 111601 - DNA, 22 bp, Artificial Sequence
  Synthetic oligonucleotide; TTC chr11 5393981 5394002 5393998 5394003 +
cctttcctagaatatgttatct

SEQ ID NO: 111602 - DNA, 22 bp, Artificial Sequence
  Synthetic oligonucleotide; CTT chr11 5393985 5394006 5394002 5394007 +
tcctagaatatgttatctattt

SEQ ID NO: 111603 - DNA, 22 bp, Artificial Sequence
  Synthetic oligonucleotide; TTT chr11 5393986 5394007 5394003 5394008 +
cctagaatatgttatctatttt

SEQ ID NO: 111604 - DNA, 22 bp, Artificial Sequence
  Synthetic oligonucleotide; TTC chr11 5393987 5394008 5394004 5394009 +
ctagaatatgttatctattttt

SEQ ID NO: 111605 - DNA, 22 bp, Artificial Sequence
  Synthetic oligonucleotide; CTA chr11 5393990 5394011 5394007 5394012 +
gaatatgttatctatttttcca

SEQ ID NO: 111606 - DNA, 22 bp, Artificial Sequence
  Synthetic oligonucleotide; TTA chr11 5394000 5394021 5394017 5394022 +
tctatttttccatttagtatca

SEQ ID NO: 111607 - DNA, 22 bp, Artificial Sequence
  Synthetic oligonucleotide; CTA chr11 5394004 5394025 5394021 5394026 +
tttttccatttagtatcaggaa

SEQ ID NO: 111608 - DNA, 22 bp, Artificial Sequence
  Synthetic oligonucleotide; TTT chr11 5394007 5394028 5394024 5394029 +
ttccatttagtatcaggaaaag

SEQ ID NO: 111609 - DNA, 22 bp, Artificial Sequence
  Synthetic oligonucleotide; TTT chr11 5394008 5394029 5394025 5394030 +
tccatttagtatcaggaaaaga

SEQ ID NO: 111610 - DNA, 22 bp, Artificial Sequence
  Synthetic oligonucleotide; TTT chr11 5394009 5394030 5394026 5394031 +
ccatttagtatcaggaaaagat

SEQ ID NO: 111611 - DNA, 22 bp, Artificial Sequence
  Synthetic oligonucleotide; TTC chr11 5394010 5394031 5394027 5394032 +
catttagtatcaggaaaagata

SEQ ID NO: 111612 - DNA, 22 bp, Artificial Sequence
  Synthetic oligonucleotide; TTT chr11 5394015 5394036 5394032 5394037 +
agtatcaggaaaagatagcaac

SEQ ID NO: 111613 - DNA, 22 bp, Artificial Sequence
  Synthetic oligonucleotide; TTA chr11 5394016 5394037 5394033 5394038 +
gtatcaggaaaagatagcaaca

SEQ ID NO: 111614 - DNA, 22 bp, Artificial Sequence
  Synthetic oligonucleotide; TTA chr11 5394059 5394080 5394076 5394081 +
ttgtattaaatactttttaata

SEQ ID NO: 111615 - DNA, 22 bp, Artificial Sequence
  Synthetic oligonucleotide; TTG chr11 5394062 5394083 5394079 5394084 +
tattaaatactttttaatagac

SEQ ID NO: 111616 - DNA, 22 bp, Artificial Sequence
  Synthetic oligonucleotide; TTA chr11 5394067 5394088 5394084 5394089 +
aatactttttaatagacttgat

SEQ ID NO: 111617 - DNA, 22 bp, Artificial Sequence
  Synthetic oligonucleotide; CTT chr11 5394074 5394095 5394091 5394096 +
tttaatagacttgattttaaga

SEQ ID NO: 111618 - DNA, 22 bp, Artificial Sequence
  Synthetic oligonucleotide; TTT chr11 5394075 5394096 5394092 5394097 +
ttaatagacttgattttaagag

SEQ ID NO: 111619 - DNA, 22 bp, Artificial Sequence
  Synthetic oligonucleotide; TTT chr11 5394076 5394097 5394093 5394098 +
taatagacttgattttaagagt

SEQ ID NO: 111620 - DNA, 22 bp, Artificial Sequence
  Synthetic oligonucleotide; TTT chr11 5394077 5394098 5394094 5394099 +
aatagacttgattttaagagtt

SEQ ID NO: 111621 - DNA, 22 bp, Artificial Sequence
  Synthetic oligonucleotide; TTA chr11 5394078 5394099 5394095 5394100 +
atagacttgattttaagagtta

SEQ ID NO: 111622 - DNA, 22 bp, Artificial Sequence
  Synthetic oligonucleotide; CTT chr11 5394086 5394107 5394103 5394108 +
gattttaagagttatagattca

SEQ ID NO: 111623 - DNA, 22 bp, Artificial Sequence
  Synthetic oligonucleotide; TTG chr11 5394087 5394108 5394104 5394109 +
attttaagagttatagattcac

SEQ ID NO: 111624 - DNA, 22 bp, Artificial Sequence
  Synthetic oligonucleotide; TTT chr11 5394091 5394112 5394108 5394113 +
taagagttatagattcacagaa

SEQ ID NO: 111625 - DNA, 22 bp, Artificial Sequence
  Synthetic oligonucleotide; TTT chr11 5394092 5394113 5394109 5394114 +
aagagttatagattcacagaaa

SEQ ID NO: 111626 - DNA, 22 bp, Artificial Sequence
  Synthetic oligonucleotide; TTA chr11 5394093 5394114 5394110 5394115 +
agagttatagattcacagaaaa

SEQ ID NO: 111627 - DNA, 22 bp, Artificial Sequence
  Synthetic oligonucleotide; TTA chr11 5394100 5394121 5394117 5394122 +
tagattcacagaaaaactcagt

SEQ ID NO: 111628 - DNA, 22 bp, Artificial Sequence
  Synthetic oligonucleotide; TTC chr11 5394107 5394128 5394124 5394129 +
acagaaaaactcagtagaaggt

SEQ ID NO: 111629 - DNA, 22 bp, Artificial Sequence
  Synthetic oligonucleotide; CTC chr11 5394119 5394140 5394136 5394141 +
agtagaaggtactgagtacctt

SEQ ID NO: 111630 - DNA, 22 bp, Artificial Sequence
  Synthetic oligonucleotide; CTG chr11 5394133 5394154 5394150 5394155 +
agtaccttctattttgcatatc

SEQ ID NO: 111631 - DNA, 22 bp, Artificial Sequence
  Synthetic oligonucleotide; CTT chr11 5394141 5394162 5394158 5394163 +
ctattttgcatatcatggtttt

SEQ ID NO: 111632 - DNA, 22 bp, Artificial Sequence
  Synthetic oligonucleotide; TTC chr11 5394142 5394163 5394159 5394164 +
tattttgcatatcatggttttt

SEQ ID NO: 111633 - DNA, 22 bp, Artificial Sequence
  Synthetic oligonucleotide; CTA chr11 5394144 5394165 5394161 5394166 +
ttttgcatatcatggtttttta

SEQ ID NO: 111634 - DNA, 22 bp, Artificial Sequence
  Synthetic oligonucleotide; TTT chr11 5394147 5394168 5394164 5394169 +
tgcatatcatggttttttaagc

SEQ ID NO: 111635 - DNA, 22 bp, Artificial Sequence
  Synthetic oligonucleotide; TTT chr11 5394148 5394169 5394165 5394170 +
gcatatcatggttttttaagca

SEQ ID NO: 111636 - DNA, 22 bp, Artificial Sequence
  Synthetic oligonucleotide; TTG chr11 5394149 5394170 5394166 5394171 +
catatcatggttttttaagcac

SEQ ID NO: 111637 - DNA, 22 bp, Artificial Sequence
  Synthetic oligonucleotide; TTT chr11 5394162 5394183 5394179 5394184 +
tttaagcacatattataaccta

SEQ ID NO: 111638 - DNA, 22 bp, Artificial Sequence
  Synthetic oligonucleotide; TTT chr11 5394163 5394184 5394180 5394185 +
ttaagcacatattataacctag

SEQ ID NO: 111639 - DNA, 22 bp, Artificial Sequence
  Synthetic oligonucleotide; TTT chr11 5394164 5394185 5394181 5394186 +
taagcacatattataacctagg

SEQ ID NO: 111640 - DNA, 22 bp, Artificial Sequence
  Synthetic oligonucleotide; TTT chr11 5394165 5394186 5394182 5394187 +
aagcacatattataacctaggt

SEQ ID NO: 111641 - DNA, 22 bp, Artificial Sequence
  Synthetic oligonucleotide; TTA chr11 5394166 5394187 5394183 5394188 +
agcacatattataacctaggta

SEQ ID NO: 111642 - DNA, 22 bp, Artificial Sequence
  Synthetic oligonucleotide; TTA chr11 5394177 5394198 5394194 5394199 +
taacctaggtattattctaagg

SEQ ID NO: 111643 - DNA, 22 bp, Artificial Sequence
  Synthetic oligonucleotide; CTA chr11 5394184 5394205 5394201 5394206 +
ggtattattctaagggcataat

SEQ ID NO: 111644 - DNA, 22 bp, Artificial Sequence
  Synthetic oligonucleotide; TTA chr11 5394191 5394212 5394208 5394213 +
ttctaagggcataatacactat

SEQ ID NO: 111645 - DNA, 22 bp, Artificial Sequence
  Synthetic oligonucleotide; TTC chr11 5394194 5394215 5394211 5394216 +
taagggcataatacactataag

SEQ ID NO: 111646 - DNA, 22 bp, Artificial Sequence
  Synthetic oligonucleotide; CTA chr11 5394196 5394217 5394213 5394218 +
agggcataatacactataagtc

SEQ ID NO: 111647 - DNA, 22 bp, Artificial Sequence
  Synthetic oligonucleotide; CTA chr11 5394212 5394233 5394229 5394234 +
taagtcactttatcttgacaat

SEQ ID NO: 111648 - DNA, 22 bp, Artificial Sequence
  Synthetic oligonucleotide; CTT chr11 5394222 5394243 5394239 5394244 +
tatcttgacaataaccttatga

SEQ ID NO: 111649 - DNA, 22 bp, Artificial Sequence
  Synthetic oligonucleotide; TTT chr11 5394223 5394244 5394240 5394245 +
atcttgacaataaccttatgag

SEQ ID NO: 111650 - DNA, 22 bp, Artificial Sequence
  Synthetic oligonucleotide; TTA chr11 5394224 5394245 5394241 5394246 +
tcttgacaataaccttatgaga

SEQ ID NO: 111651 - DNA, 22 bp, Artificial Sequence
  Synthetic oligonucleotide; CTT chr11 5394228 5394249 5394245 5394250 +
gacaataaccttatgagatgga

SEQ ID NO: 111652 - DNA, 22 bp, Artificial Sequence
  Synthetic oligonucleotide; TTG chr11 5394229 5394250 5394246 5394251 +
acaataaccttatgagatggat

SEQ ID NO: 111653 - DNA, 22 bp, Artificial Sequence
  Synthetic oligonucleotide; CTT chr11 5394240 5394261 5394257 5394262 +
atgagatggatactactagatt

SEQ ID NO: 111654 - DNA, 22 bp, Artificial Sequence
  Synthetic oligonucleotide; TTA chr11 5394241 5394262 5394258 5394263 +
tgagatggatactactagatta

SEQ ID NO: 111655 - DNA, 22 bp, Artificial Sequence
  Synthetic oligonucleotide; CTA chr11 5394255 5394276 5394272 5394277 +
ctagattacccattttacagat

SEQ ID NO: 111656 - DNA, 22 bp, Artificial Sequence
  Synthetic oligonucleotide; CTA chr11 5394258 5394279 5394275 5394280 +
gattacccattttacagataag

SEQ ID NO: 111657 - DNA, 22 bp, Artificial Sequence
  Synthetic oligonucleotide; TTA chr11 5394263 5394284 5394280 5394285 +
cccattttacagataagtacac

SEQ ID NO: 111658 - DNA, 22 bp, Artificial Sequence
  Synthetic oligonucleotide; TTT chr11 5394270 5394291 5394287 5394292 +
tacagataagtacactgaggct

SEQ ID NO: 111659 - DNA, 22 bp, Artificial Sequence
  Synthetic oligonucleotide; TTT chr11 5394271 5394292 5394288 5394293 +
acagataagtacactgaggctc

SEQ ID NO: 111660 - DNA, 22 bp, Artificial Sequence
  Synthetic oligonucleotide; TTA chr11 5394272 5394293 5394289 5394294 +
cagataagtacactgaggctca

SEQ ID NO: 111661 - DNA, 22 bp, Artificial Sequence
  Synthetic oligonucleotide; CTG chr11 5394287 5394308 5394304 5394309 +
aggctcagagacaaaatatctt

SEQ ID NO: 111662 - DNA, 22 bp, Artificial Sequence
  Synthetic oligonucleotide; CTC chr11 5394293 5394314 5394310 5394315 +
agagacaaaatatcttgcccaa

SEQ ID NO: 111663 - DNA, 22 bp, Artificial Sequence
  Synthetic oligonucleotide; CTT chr11 5394309 5394330 5394326 5394331 +
gcccaatattataccaagtttg

SEQ ID NO: 111664 - DNA, 22 bp, Artificial Sequence
  Synthetic oligonucleotide; TTG chr11 5394310 5394331 5394327 5394332 +
cccaatattataccaagtttga

SEQ ID NO: 111665 - DNA, 22 bp, Artificial Sequence
  Synthetic oligonucleotide; TTA chr11 5394320 5394341 5394337 5394342 +
taccaagtttgacagttctgac

SEQ ID NO: 111666 - DNA, 22 bp, Artificial Sequence
  Synthetic oligonucleotide; TTT chr11 5394330 5394351 5394347 5394352 +
gacagttctgactgtggtgctt

SEQ ID NO: 111667 - DNA, 22 bp, Artificial Sequence
  Synthetic oligonucleotide; TTG chr11 5394331 5394352 5394348 5394353 +
acagttctgactgtggtgcttg

SEQ ID NO: 111668 - DNA, 22 bp, Artificial Sequence
  Synthetic oligonucleotide; TTC chr11 5394338 5394359 5394355 5394360 +
tgactgtggtgcttgtagtttt

SEQ ID NO: 111669 - DNA, 22 bp, Artificial Sequence
  Synthetic oligonucleotide; CTG chr11 5394340 5394361 5394357 5394362 +
actgtggtgcttgtagttttaa

SEQ ID NO: 111670 - DNA, 22 bp, Artificial Sequence
  Synthetic oligonucleotide; CTG chr11 5394344 5394365 5394361 5394366 +
tggtgcttgtagttttaactat

SEQ ID NO: 111671 - DNA, 22 bp, Artificial Sequence
  Synthetic oligonucleotide; CTT chr11 5394352 5394373 5394369 5394374 +
gtagttttaactatgctccact

SEQ ID NO: 111672 - DNA, 22 bp, Artificial Sequence
  Synthetic oligonucleotide; TTG chr11 5394353 5394374 5394370 5394375 +
tagttttaactatgctccactg

SEQ ID NO: 111673 - DNA, 22 bp, Artificial Sequence
  Synthetic oligonucleotide; TTT chr11 5394359 5394380 5394376 5394381 +
taactatgctccactgattcaa

SEQ ID NO: 111674 - DNA, 22 bp, Artificial Sequence
  Synthetic oligonucleotide; TTT chr11 5394360 5394381 5394377 5394382 +
aactatgctccactgattcaac

SEQ ID NO: 111675 - DNA, 22 bp, Artificial Sequence
  Synthetic oligonucleotide; TTA chr11 5394361 5394382 5394378 5394383 +
actatgctccactgattcaaca

SEQ ID NO: 111676 - DNA, 22 bp, Artificial Sequence
  Synthetic oligonucleotide; CTA chr11 5394365 5394386 5394382 5394387 +
tgctccactgattcaacaacaa

SEQ ID NO: 111677 - DNA, 22 bp, Artificial Sequence
  Synthetic oligonucleotide; CTC chr11 5394370 5394391 5394387 5394392 +
cactgattcaacaacaacaaca

SEQ ID NO: 111678 - DNA, 22 bp, Artificial Sequence
  Synthetic oligonucleotide; CTG chr11 5394375 5394396 5394392 5394397 +
attcaacaacaacaacaaacca

SEQ ID NO: 111679 - DNA, 22 bp, Artificial Sequence
  Synthetic oligonucleotide; TTC chr11 5394379 5394400 5394396 5394401 +
aacaacaacaacaaaccaaaaa

SEQ ID NO: 111680 - DNA, 22 bp, Artificial Sequence
  Synthetic oligonucleotide; CTG chr11 5394424 5394445 5394441 5394446 +
tacatattcctgctaatgacag

SEQ ID NO: 111681 - DNA, 22 bp, Artificial Sequence
  Synthetic oligonucleotide; TTC chr11 5394433 5394454 5394450 5394455 +
ctgctaatgacagtatctgctt

SEQ ID NO: 111682 - DNA, 22 bp, Artificial Sequence
  Synthetic oligonucleotide; CTG chr11 5394436 5394457 5394453 5394458 +
ctaatgacagtatctgctttaa

SEQ ID NO: 111683 - DNA, 22 bp, Artificial Sequence
  Synthetic oligonucleotide; CTA chr11 5394439 5394460 5394456 5394461 +
atgacagtatctgctttaaatc

SEQ ID NO: 111684 - DNA, 22 bp, Artificial Sequence
  Synthetic oligonucleotide; CTG chr11 5394452 5394473 5394469 5394474 +
ctttaaatcatctggcccattc

SEQ ID NO: 111685 - DNA, 22 bp, Artificial Sequence
  Synthetic oligonucleotide; CTT chr11 5394455 5394476 5394472 5394477 +
taaatcatctggcccattcctc

SEQ ID NO: 111686 - DNA, 22 bp, Artificial Sequence
  Synthetic oligonucleotide; TTT chr11 5394456 5394477 5394473 5394478 +
aaatcatctggcccattcctca

SEQ ID NO: 111687 - DNA, 22 bp, Artificial Sequence
  Synthetic oligonucleotide; TTA chr11 5394457 5394478 5394474 5394479 +
aatcatctggcccattcctcag

SEQ ID NO: 111688 - DNA, 22 bp, Artificial Sequence
  Synthetic oligonucleotide; CTG chr11 5394466 5394487 5394483 5394488 +
gcccattcctcagcacaagcct

SEQ ID NO: 111689 - DNA, 22 bp, Artificial Sequence
  Synthetic oligonucleotide; TTC chr11 5394474 5394495 5394491 5394496 +
ctcagcacaagcctatattcct

SEQ ID NO: 111690 - DNA, 22 bp, Artificial Sequence
  Synthetic oligonucleotide; CTC chr11 5394477 5394498 5394494 5394499 +
agcacaagcctatattcctgca

SEQ ID NO: 111691 - DNA, 22 bp, Artificial Sequence
  Synthetic oligonucleotide; CTA chr11 5394489 5394510 5394506 5394511 +
tattcctgcaggcaaaaatctt

SEQ ID NO: 111692 - DNA, 22 bp, Artificial Sequence
  Synthetic oligonucleotide; TTC chr11 5394494 5394515 5394511 5394516 +
ctgcaggcaaaaatctttacaa

SEQ ID NO: 111693 - DNA, 22 bp, Artificial Sequence
  Synthetic oligonucleotide; CTG chr11 5394497 5394518 5394514 5394519 +
caggcaaaaatctttacaacta

SEQ ID NO: 111694 - DNA, 22 bp, Artificial Sequence
  Synthetic oligonucleotide; CTT chr11 5394511 5394532 5394528 5394533 +
tacaactatcccgttatttaat

SEQ ID NO: 111695 - DNA, 22 bp, Artificial Sequence
  Synthetic oligonucleotide; TTT chr11 5394512 5394533 5394529 5394534 +
acaactatcccgttatttaata

SEQ ID NO: 111696 - DNA, 22 bp, Artificial Sequence
  Synthetic oligonucleotide; TTA chr11 5394513 5394534 5394530 5394535 +
caactatcccgttatttaatat

SEQ ID NO: 111697 - DNA, 22 bp, Artificial Sequence
  Synthetic oligonucleotide; CTA chr11 5394519 5394540 5394536 5394541 +
tcccgttatttaatatccacaa

SEQ ID NO: 111698 - DNA, 22 bp, Artificial Sequence
  Synthetic oligonucleotide; TTA chr11 5394527 5394548 5394544 5394549 +
tttaatatccacaagcctctct

SEQ ID NO: 111699 - DNA, 22 bp, Artificial Sequence
  Synthetic oligonucleotide; TTT chr11 5394530 5394551 5394547 5394552 +
aatatccacaagcctctctaag

SEQ ID NO: 111700 - DNA, 22 bp, Artificial Sequence
  Synthetic oligonucleotide; TTA chr11 5394531 5394552 5394548 5394553 +
atatccacaagcctctctaagc

SEQ ID NO: 111701 - DNA, 22 bp, Artificial Sequence
  Synthetic oligonucleotide; CTC chr11 5394546 5394567 5394563 5394568 +
tctaagcctttgaaattgatac

SEQ ID NO: 111702 - DNA, 22 bp, Artificial Sequence
  Synthetic oligonucleotide; CTC chr11 5394548 5394569 5394565 5394570 +
taagcctttgaaattgatactg

SEQ ID NO: 111703 - DNA, 22 bp, Artificial Sequence
  Synthetic oligonucleotide; CTA chr11 5394550 5394571 5394567 5394572 +
agcctttgaaattgatactgta

SEQ ID NO: 111704 - DNA, 22 bp, Artificial Sequence
  Synthetic oligonucleotide; CTT chr11 5394556 5394577 5394573 5394578 +
tgaaattgatactgtatttgta

SEQ ID NO: 111705 - DNA, 22 bp, Artificial Sequence
  Synthetic oligonucleotide; TTT chr11 5394557 5394578 5394574 5394579 +
gaaattgatactgtatttgtaa

SEQ ID NO: 111706 - DNA, 22 bp, Artificial Sequence
  Synthetic oligonucleotide; TTG chr11 5394558 5394579 5394575 5394580 +
aaattgatactgtatttgtaaa

SEQ ID NO: 111707 - DNA, 22 bp, Artificial Sequence
  Synthetic oligonucleotide; TTG chr11 5394564 5394585 5394581 5394586 +
atactgtatttgtaaaacacag

SEQ ID NO: 111708 - DNA, 22 bp, Artificial Sequence
  Synthetic oligonucleotide; CTG chr11 5394570 5394591 5394587 5394592 +
tatttgtaaaacacagatggct

SEQ ID NO: 111709 - DNA, 22 bp, Artificial Sequence
  Synthetic oligonucleotide; TTT chr11 5394575 5394596 5394592 5394597 +
gtaaaacacagatggctcatgt

SEQ ID NO: 111710 - DNA, 22 bp, Artificial Sequence
  Synthetic oligonucleotide; TTG chr11 5394576 5394597 5394593 5394598 +
taaaacacagatggctcatgta

SEQ ID NO: 111711 - DNA, 22 bp, Artificial Sequence
  Synthetic oligonucleotide; CTC chr11 5394593 5394614 5394610 5394615 +
atgtaattgaagttcacagaat

SEQ ID NO: 111712 - DNA, 22 bp, Artificial Sequence
  Synthetic oligonucleotide; TTG chr11 5394602 5394623 5394619 5394624 +
aagttcacagaattttatgttt

SEQ ID NO: 111713 - DNA, 22 bp, Artificial Sequence
  Synthetic oligonucleotide; TTC chr11 5394608 5394629 5394625 5394630 +
acagaattttatgttttgcttt

SEQ ID NO: 111714 - DNA, 22 bp, Artificial Sequence
  Synthetic oligonucleotide; TTT chr11 5394617 5394638 5394634 5394639 +
tatgttttgctttgtgacaact

SEQ ID NO: 111715 - DNA, 22 bp, Artificial Sequence
  Synthetic oligonucleotide; TTT chr11 5394618 5394639 5394635 5394640 +
atgttttgctttgtgacaactc

SEQ ID NO: 111716 - DNA, 22 bp, Artificial Sequence
  Synthetic oligonucleotide; TTA chr11 5394619 5394640 5394636 5394641 +
tgttttgctttgtgacaactct

SEQ ID NO: 111717 - DNA, 22 bp, Artificial Sequence
  Synthetic oligonucleotide; TTT chr11 5394624 5394645 5394641 5394646 +
tgctttgtgacaactctgagcc

SEQ ID NO: 111718 - DNA, 22 bp, Artificial Sequence
  Synthetic oligonucleotide; TTT chr11 5394625 5394646 5394642 5394647 +
gctttgtgacaactctgagcct

SEQ ID NO: 111719 - DNA, 22 bp, Artificial Sequence
  Synthetic oligonucleotide; TTG chr11 5394626 5394647 5394643 5394648 +
ctttgtgacaactctgagcctt

SEQ ID NO: 111720 - DNA, 22 bp, Artificial Sequence
  Synthetic oligonucleotide; CTT chr11 5394629 5394650 5394646 5394651 +
tgtgacaactctgagcctttgt

SEQ ID NO: 111721 - DNA, 22 bp, Artificial Sequence
  Synthetic oligonucleotide; TTT chr11 5394630 5394651 5394647 5394652 +
gtgacaactctgagcctttgta

SEQ ID NO: 111722 - DNA, 22 bp, Artificial Sequence
  Synthetic oligonucleotide; TTG chr11 5394631 5394652 5394648 5394653 +
tgacaactctgagcctttgtac

SEQ ID NO: 111723 - DNA, 22 bp, Artificial Sequence
  Synthetic oligonucleotide; CTC chr11 5394640 5394661 5394657 5394662 +
tgagcctttgtacatgttttcc

SEQ ID NO: 111724 - DNA, 22 bp, Artificial Sequence
  Synthetic oligonucleotide; CTG chr11 5394642 5394663 5394659 5394664 +
agcctttgtacatgttttcccc

SEQ ID NO: 111725 - DNA, 22 bp, Artificial Sequence
  Synthetic oligonucleotide; CTT chr11 5394648 5394669 5394665 5394670 +
tgtacatgttttcccctctatc

SEQ ID NO: 111726 - DNA, 22 bp, Artificial Sequence
  Synthetic oligonucleotide; TTT chr11 5394649 5394670 5394666 5394671 +
gtacatgttttcccctctatct

SEQ ID NO: 111727 - DNA, 22 bp, Artificial Sequence
  Synthetic oligonucleotide; TTG chr11 5394650 5394671 5394667 5394672 +
tacatgttttcccctctatcta

SEQ ID NO: 111728 - DNA, 22 bp, Artificial Sequence
  Synthetic oligonucleotide; TTT chr11 5394659 5394680 5394676 5394681 +
tcccctctatctaaaatgttac

SEQ ID NO: 111729 - DNA, 22 bp, Artificial Sequence
  Synthetic oligonucleotide; TTT chr11 5394660 5394681 5394677 5394682 +
cccctctatctaaaatgttacc

SEQ ID NO: 111730 - DNA, 22 bp, Artificial Sequence
  Synthetic oligonucleotide; TTC chr11 5394661 5394682 5394678 5394683 +
ccctctatctaaaatgttacct

SEQ ID NO: 111731 - DNA, 22 bp, Artificial Sequence
  Synthetic oligonucleotide; CTC chr11 5394666 5394687 5394683 5394688 +
tatctaaaatgttacctatttt

SEQ ID NO: 111732 - DNA, 22 bp, Artificial Sequence
  Synthetic oligonucleotide; CTA chr11 5394668 5394689 5394685 5394690 +
tctaaaatgttacctattttga

SEQ ID NO: 111733 - DNA, 22 bp, Artificial Sequence
  Synthetic oligonucleotide; CTA chr11 5394672 5394693 5394689 5394694 +
aaatgttacctattttgaatga

SEQ ID NO: 111734 - DNA, 22 bp, Artificial Sequence
  Synthetic oligonucleotide; TTA chr11 5394680 5394701 5394697 5394702 +
cctattttgaatgatagtgcag

SEQ ID NO: 111735 - DNA, 22 bp, Artificial Sequence
  Synthetic oligonucleotide; CTA chr11 5394684 5394705 5394701 5394706 +
ttttgaatgatagtgcagacat

SEQ ID NO: 111736 - DNA, 22 bp, Artificial Sequence
  Synthetic oligonucleotide; TTT chr11 5394687 5394708 5394704 5394709 +
tgaatgatagtgcagacattag

SEQ ID NO: 111737 - DNA, 22 bp, Artificial Sequence
  Synthetic oligonucleotide; TTT chr11 5394688 5394709 5394705 5394710 +
gaatgatagtgcagacattagt

SEQ ID NO: 111738 - DNA, 22 bp, Artificial Sequence
  Synthetic oligonucleotide; TTG chr11 5394689 5394710 5394706 5394711 +
aatgatagtgcagacattagta

SEQ ID NO: 111739 - DNA, 22 bp, Artificial Sequence
  Synthetic oligonucleotide; TTA chr11 5394708 5394729 5394725 5394730 +
gtaaggaaagcttgctaaatat

SEQ ID NO: 111740 - DNA, 22 bp, Artificial Sequence
  Synthetic oligonucleotide; CTT chr11 5394721 5394742 5394738 5394743 +
gctaaatatttgtatcacctgg

SEQ ID NO: 111741 - DNA, 22 bp, Artificial Sequence
  Synthetic oligonucleotide; TTG chr11 5394722 5394743 5394739 5394744 +
ctaaatatttgtatcacctggg

SEQ ID NO: 111742 - DNA, 22 bp, Artificial Sequence
  Synthetic oligonucleotide; CTA chr11 5394725 5394746 5394742 5394747 +
aatatttgtatcacctgggaag

SEQ ID NO: 111743 - DNA, 22 bp, Artificial Sequence
  Synthetic oligonucleotide; TTT chr11 5394732 5394753 5394749 5394754 +
gtatcacctgggaagcctgttt

SEQ ID NO: 111744 - DNA, 22 bp, Artificial Sequence
  Synthetic oligonucleotide; TTG chr11 5394733 5394754 5394750 5394755 +
tatcacctgggaagcctgtttt

SEQ ID NO: 111745 - DNA, 22 bp, Artificial Sequence
  Synthetic oligonucleotide; CTG chr11 5394742 5394763 5394759 5394764 +
ggaagcctgtttttgcttcatc

SEQ ID NO: 111746 - DNA, 22 bp, Artificial Sequence
  Synthetic oligonucleotide; CTG chr11 5394751 5394772 5394768 5394773 +
tttttgcttcatcaggggacgt

SEQ ID NO: 111747 - DNA, 22 bp, Artificial Sequence
  Synthetic oligonucleotide; TTT chr11 5394754 5394775 5394771 5394776 +
ttgcttcatcaggggacgttag

SEQ ID NO: 111748 - DNA, 22 bp, Artificial Sequence
  Synthetic oligonucleotide; TTT chr11 5394755 5394776 5394772 5394777 +
tgcttcatcaggggacgttagt

SEQ ID NO: 111749 - DNA, 22 bp, Artificial Sequence
  Synthetic oligonucleotide; TTT chr11 5394756 5394777 5394773 5394778 +
gcttcatcaggggacgttagtt

SEQ ID NO: 111750 - DNA, 22 bp, Artificial Sequence
  Synthetic oligonucleotide; TTG chr11 5394757 5394778 5394774 5394779 +
cttcatcaggggacgttagttt

SEQ ID NO: 111751 - DNA, 22 bp, Artificial Sequence
  Synthetic oligonucleotide; CTT chr11 5394760 5394781 5394777 5394782 +
catcaggggacgttagtttttt

SEQ ID NO: 111752 - DNA, 22 bp, Artificial Sequence
  Synthetic oligonucleotide; TTC chr11 5394761 5394782 5394778 5394783 +
atcaggggacgttagttttttt

SEQ ID NO: 111753 - DNA, 22 bp, Artificial Sequence
  Synthetic oligonucleotide; TTA chr11 5394775 5394796 5394792 5394797 +
gtttttttcacatcaacctcct

SEQ ID NO: 111754 - DNA, 22 bp, Artificial Sequence
  Synthetic oligonucleotide; TTT chr11 5394779 5394800 5394796 5394801 +
ttttcacatcaacctcctgcag

SEQ ID NO: 111755 - DNA, 22 bp, Artificial Sequence
  Synthetic oligonucleotide; TTT chr11 5394780 5394801 5394797 5394802 +
tttcacatcaacctcctgcaga

SEQ ID NO: 111756 - DNA, 22 bp, Artificial Sequence
  Synthetic oligonucleotide; TTT chr11 5394781 5394802 5394798 5394803 +
ttcacatcaacctcctgcagaa

SEQ ID NO: 111757 - DNA, 22 bp, Artificial Sequence
  Synthetic oligonucleotide; TTT chr11 5394782 5394803 5394799 5394804 +
tcacatcaacctcctgcagaag

SEQ ID NO: 111758 - DNA, 22 bp, Artificial Sequence
  Synthetic oligonucleotide; TTT chr11 5394783 5394804 5394800 5394805 +
cacatcaacctcctgcagaaga

SEQ ID NO: 111759 - DNA, 22 bp, Artificial Sequence
  Synthetic oligonucleotide; TTC chr11 5394784 5394805 5394801 5394806 +
acatcaacctcctgcagaagac

SEQ ID NO: 111760 - DNA, 22 bp, Artificial Sequence
  Synthetic oligonucleotide; CTC chr11 5394795 5394816 5394812 5394817 +
ctgcagaagacaatgctttctg

SEQ ID NO: 111761 - DNA, 22 bp, Artificial Sequence
  Synthetic oligonucleotide; CTG chr11 5394798 5394819 5394815 5394820 +
cagaagacaatgctttctgaaa

SEQ ID NO: 111762 - DNA, 22 bp, Artificial Sequence
  Synthetic oligonucleotide; CTT chr11 5394813 5394834 5394830 5394835 +
tctgaaagacagagtttgtgtc

SEQ ID NO: 111763 - DNA, 22 bp, Artificial Sequence
  Synthetic oligonucleotide; TTT chr11 5394814 5394835 5394831 5394836 +
ctgaaagacagagtttgtgtct

SEQ ID NO: 111764 - DNA, 22 bp, Artificial Sequence
  Synthetic oligonucleotide; TTC chr11 5394815 5394836 5394832 5394837 +
tgaaagacagagtttgtgtctt

SEQ ID NO: 111765 - DNA, 22 bp, Artificial Sequence
  Synthetic oligonucleotide; CTG chr11 5394817 5394838 5394834 5394839 +
aaagacagagtttgtgtcttat

SEQ ID NO: 111766 - DNA, 22 bp, Artificial Sequence
  Synthetic oligonucleotide; TTT chr11 5394830 5394851 5394847 5394852 +
gtgtcttattaatgcttgcatt

SEQ ID NO: 111767 - DNA, 22 bp, Artificial Sequence
  Synthetic oligonucleotide; TTG chr11 5394831 5394852 5394848 5394853 +
tgtcttattaatgcttgcattc

SEQ ID NO: 111768 - DNA, 22 bp, Artificial Sequence
  Synthetic oligonucleotide; CTT chr11 5394837 5394858 5394854 5394859 +
attaatgcttgcattcaaatat

SEQ ID NO: 111769 - DNA, 22 bp, Artificial Sequence
  Synthetic oligonucleotide; TTA chr11 5394838 5394859 5394855 5394860 +
ttaatgcttgcattcaaatatc

SEQ ID NO: 111770 - DNA, 22 bp, Artificial Sequence
  Synthetic oligonucleotide; TTA chr11 5394841 5394862 5394858 5394863 +
atgcttgcattcaaatatctga

SEQ ID NO: 111771 - DNA, 22 bp, Artificial Sequence
  Synthetic oligonucleotide; CTT chr11 5394847 5394868 5394864 5394869 +
gcattcaaatatctgacccaaa

SEQ ID NO: 111772 - DNA, 22 bp, Artificial Sequence
  Synthetic oligonucleotide; TTG chr11 5394848 5394869 5394865 5394870 +
cattcaaatatctgacccaaag

SEQ ID NO: 111773 - DNA, 22 bp, Artificial Sequence
  Synthetic oligonucleotide; TTC chr11 5394853 5394874 5394870 5394875 +
aaatatctgacccaaagcttgt

SEQ ID NO: 111774 - DNA, 22 bp, Artificial Sequence
  Synthetic oligonucleotide; CTG chr11 5394862 5394883 5394879 5394884 +
acccaaagcttgtgatctttac

SEQ ID NO: 111775 - DNA, 22 bp, Artificial Sequence
  Synthetic oligonucleotide; CTT chr11 5394873 5394894 5394890 5394895 +
gtgatctttacatacttgctca

SEQ ID NO: 111776 - DNA, 22 bp, Artificial Sequence
  Synthetic oligonucleotide; TTG chr11 5394874 5394895 5394891 5394896 +
tgatctttacatacttgctcag

SEQ ID NO: 111777 - DNA, 22 bp, Artificial Sequence
  Synthetic oligonucleotide; CTT chr11 5394881 5394902 5394898 5394903 +
tacatacttgctcagtgaatga

SEQ ID NO: 111778 - DNA, 22 bp, Artificial Sequence
  Synthetic oligonucleotide; TTT chr11 5394882 5394903 5394899 5394904 +
acatacttgctcagtgaatgac

SEQ ID NO: 111779 - DNA, 22 bp, Artificial Sequence
  Synthetic oligonucleotide; TTA chr11 5394883 5394904 5394900 5394905 +
catacttgctcagtgaatgaca

SEQ ID NO: 111780 - DNA, 22 bp, Artificial Sequence
  Synthetic oligonucleotide; CTT chr11 5394890 5394911 5394907 5394912 +
gctcagtgaatgacagtgaata

SEQ ID NO: 111781 - DNA, 22 bp, Artificial Sequence
  Synthetic oligonucleotide; TTG chr11 5394891 5394912 5394908 5394913 +
ctcagtgaatgacagtgaataa

SEQ ID NO: 111782 - DNA, 22 bp, Artificial Sequence
  Synthetic oligonucleotide; CTC chr11 5394894 5394915 5394911 5394916 +
agtgaatgacagtgaataacta

SEQ ID NO: 111783 - DNA, 22 bp, Artificial Sequence
  Synthetic oligonucleotide; CTA chr11 5394916 5394937 5394933 5394938 +
cctggttgtaaagactgtctca

SEQ ID NO: 111784 - DNA, 22 bp, Artificial Sequence
  Synthetic oligonucleotide; CTG chr11 5394920 5394941 5394937 5394942 +
gttgtaaagactgtctcaaggg

SEQ ID NO: 111785 - DNA, 22 bp, Artificial Sequence
  Synthetic oligonucleotide; TTG chr11 5394924 5394945 5394941 5394946 +
taaagactgtctcaaggggact

SEQ ID NO: 111786 - DNA, 22 bp, Artificial Sequence
  Synthetic oligonucleotide; CTG chr11 5394933 5394954 5394950 5394955 +
tctcaaggggacttttgtctgg

SEQ ID NO: 111787 - DNA, 22 bp, Artificial Sequence
  Synthetic oligonucleotide; CTC chr11 5394937 5394958 5394954 5394959 +
aaggggacttttgtctgggaaa

SEQ ID NO: 111788 - DNA, 22 bp, Artificial Sequence
  Synthetic oligonucleotide; CTT chr11 5394947 5394968 5394964 5394969 +
ttgtctgggaaaagaaaagaaa

SEQ ID NO: 111789 - DNA, 22 bp, Artificial Sequence
  Synthetic oligonucleotide; TTT chr11 5394948 5394969 5394965 5394970 +
tgtctgggaaaagaaaagaaag

SEQ ID NO: 111790 - DNA, 22 bp, Artificial Sequence
  Synthetic oligonucleotide; TTT chr11 5394949 5394970 5394966 5394971 +
gtctgggaaaagaaaagaaaga

SEQ ID NO: 111791 - DNA, 22 bp, Artificial Sequence
  Synthetic oligonucleotide; TTG chr11 5394950 5394971 5394967 5394972 +
tctgggaaaagaaaagaaagac

SEQ ID NO: 111792 - DNA, 22 bp, Artificial Sequence
  Synthetic oligonucleotide; CTG chr11 5394954 5394975 5394971 5394976 +
ggaaaagaaaagaaagacaaaa

SEQ ID NO: 111793 - DNA, 22 bp, Artificial Sequence
  Synthetic oligonucleotide; TTG chr11 5394986 5395007 5395003 5395008 +
agaagcacccaataaattttct

SEQ ID NO: 111794 - DNA, 22 bp, Artificial Sequence
  Synthetic oligonucleotide; TTT chr11 5395005 5395026 5395022 5395027 +
tcttatgaagttggcagctggg

SEQ ID NO: 111795 - DNA, 22 bp, Artificial Sequence
  Synthetic oligonucleotide; TTT chr11 5395006 5395027 5395023 5395028 +
cttatgaagttggcagctgggg

SEQ ID NO: 111796 - DNA, 22 bp, Artificial Sequence
  Synthetic oligonucleotide; TTC chr11 5395007 5395028 5395024 5395029 +
ttatgaagttggcagctgggga

SEQ ID NO: 111797 - DNA, 22 bp, Artificial Sequence
  Synthetic oligonucleotide; CTT chr11 5395009 5395030 5395026 5395031 +
atgaagttggcagctggggaga

SEQ ID NO: 111798 - DNA, 22 bp, Artificial Sequence
  Synthetic oligonucleotide; TTA chr11 5395010 5395031 5395027 5395032 +
tgaagttggcagctggggagag

SEQ ID NO: 111799 - DNA, 22 bp, Artificial Sequence
  Synthetic oligonucleotide; TTG chr11 5395018 5395039 5395035 5395040 +
gcagctggggagagaagacagt

SEQ ID NO: 111800 - DNA, 22 bp, Artificial Sequence
  Synthetic oligonucleotide; CTG chr11 5395025 5395046 5395042 5395047 +
gggagagaagacagtcaaggat

SEQ ID NO: 111801 - DNA, 22 bp, Artificial Sequence
  Synthetic oligonucleotide; CTC chr11 5395051 5395072 5395068 5395073 +
tggctcactgaaatacctccta

SEQ ID NO: 111802 - DNA, 22 bp, Artificial Sequence
  Synthetic oligonucleotide; CTG chr11 5395053 5395074 5395070 5395075 +
gctcactgaaatacctcctaga

SEQ ID NO: 111803 - DNA, 22 bp, Artificial Sequence
  Synthetic oligonucleotide; CTC chr11 5395057 5395078 5395074 5395079 +
actgaaatacctcctagaggta

SEQ ID NO: 111804 - DNA, 22 bp, Artificial Sequence
  Synthetic oligonucleotide; CTG chr11 5395061 5395082 5395078 5395083 +
aaatacctcctagaggtactca

SEQ ID NO: 111805 - DNA, 22 bp, Artificial Sequence
  Synthetic oligonucleotide; CTC chr11 5395070 5395091 5395087 5395092 +
ctagaggtactcatggttcact

SEQ ID NO: 111806 - DNA, 22 bp, Artificial Sequence
  Synthetic oligonucleotide; CTA chr11 5395073 5395094 5395090 5395095 +
gaggtactcatggttcactaaa

SEQ ID NO: 111807 - DNA, 22 bp, Artificial Sequence
  Synthetic oligonucleotide; CTC chr11 5395082 5395103 5395099 5395104 +
atggttcactaaatttccattt

SEQ ID NO: 111808 - DNA, 22 bp, Artificial Sequence
  Synthetic oligonucleotide; TTC chr11 5395089 5395110 5395106 5395111 +
actaaatttccatttaagataa

SEQ ID NO: 111809 - DNA, 22 bp, Artificial Sequence
  Synthetic oligonucleotide; CTA chr11 5395093 5395114 5395110 5395115 +
aatttccatttaagataactgg

SEQ ID NO: 111810 - DNA, 22 bp, Artificial Sequence
  Synthetic oligonucleotide; TTT chr11 5395098 5395119 5395115 5395120 +
ccatttaagataactgggcatc

SEQ ID NO: 111811 - DNA, 22 bp, Artificial Sequence
  Synthetic oligonucleotide; TTC chr11 5395099 5395120 5395116 5395121 +
catttaagataactgggcatct

SEQ ID NO: 111812 - DNA, 22 bp, Artificial Sequence
  Synthetic oligonucleotide; TTT chr11 5395104 5395125 5395121 5395126 +
aagataactgggcatctcaaat

SEQ ID NO: 111813 - DNA, 22 bp, Artificial Sequence
  Synthetic oligonucleotide; TTA chr11 5395105 5395126 5395122 5395127 +
agataactgggcatctcaaatg

SEQ ID NO: 111814 - DNA, 22 bp, Artificial Sequence
  Synthetic oligonucleotide; CTG chr11 5395114 5395135 5395131 5395136 +
ggcatctcaaatgctttggtct

SEQ ID NO: 111815 - DNA, 22 bp, Artificial Sequence
  Synthetic oligonucleotide; CTC chr11 5395122 5395143 5395139 5395144 +
aaatgctttggtctaggaggat

SEQ ID NO: 111816 - DNA, 22 bp, Artificial Sequence
  Synthetic oligonucleotide; CTT chr11 5395130 5395151 5395147 5395152 +
tggtctaggaggatgctaatcc

SEQ ID NO: 111817 - DNA, 22 bp, Artificial Sequence
  Synthetic oligonucleotide; TTT chr11 5395131 5395152 5395148 5395153 +
ggtctaggaggatgctaatccc

SEQ ID NO: 111818 - DNA, 22 bp, Artificial Sequence
  Synthetic oligonucleotide; TTG chr11 5395132 5395153 5395149 5395154 +
gtctaggaggatgctaatccct

SEQ ID NO: 111819 - DNA, 22 bp, Artificial Sequence
  Synthetic oligonucleotide; CTA chr11 5395137 5395158 5395154 5395159 +
ggaggatgctaatccctctttg

SEQ ID NO: 111820 - DNA, 22 bp, Artificial Sequence
  Synthetic oligonucleotide; CTA chr11 5395148 5395169 5395165 5395170 +
atccctctttgacattcatcaa

SEQ ID NO: 111821 - DNA, 22 bp, Artificial Sequence
  Synthetic oligonucleotide; CTC chr11 5395155 5395176 5395172 5395177 +
tttgacattcatcaagtctgcg

SEQ ID NO: 111822 - DNA, 22 bp, Artificial Sequence
  Synthetic oligonucleotide; CTT chr11 5395157 5395178 5395174 5395179 +
tgacattcatcaagtctgcgtc

SEQ ID NO: 111823 - DNA, 22 bp, Artificial Sequence
  Synthetic oligonucleotide; TTT chr11 5395158 5395179 5395175 5395180 +
gacattcatcaagtctgcgtcc

SEQ ID NO: 111824 - DNA, 22 bp, Artificial Sequence
  Synthetic oligonucleotide; TTG chr11 5395159 5395180 5395176 5395181 +
acattcatcaagtctgcgtcca

SEQ ID NO: 111825 - DNA, 22 bp, Artificial Sequence
  Synthetic oligonucleotide; TTC chr11 5395165 5395186 5395182 5395187 +
atcaagtctgcgtccatctagg

SEQ ID NO: 111826 - DNA, 22 bp, Artificial Sequence
  Synthetic oligonucleotide; CTG chr11 5395175 5395196 5395192 5395197 +
cgtccatctagggagattcctt

SEQ ID NO: 111827 - DNA, 22 bp, Artificial Sequence
  Synthetic oligonucleotide; CTA chr11 5395185 5395206 5395202 5395207 +
gggagattcctttgagggccaa

SEQ ID NO: 111828 - DNA, 22 bp, Artificial Sequence
  Synthetic oligonucleotide; TTC chr11 5395194 5395215 5395211 5395216 +
ctttgagggccaaagacccaag

SEQ ID NO: 111829 - DNA, 22 bp, Artificial Sequence
  Synthetic oligonucleotide; CTT chr11 5395197 5395218 5395214 5395219 +
tgagggccaaagacccaaggaa

SEQ ID NO: 111830 - DNA, 22 bp, Artificial Sequence
  Synthetic oligonucleotide; TTT chr11 5395198 5395219 5395215 5395220 +
gagggccaaagacccaaggaag

SEQ ID NO: 111831 - DNA, 22 bp, Artificial Sequence
  Synthetic oligonucleotide; TTG chr11 5395199 5395220 5395216 5395221 +
agggccaaagacccaaggaaga

SEQ ID NO: 111832 - DNA, 22 bp, Artificial Sequence
  Synthetic oligonucleotide; CTT chr11 5395231 5395252 5395248 5395253 +
tataagtgccagtgcagcccac

SEQ ID NO: 111833 - DNA, 22 bp, Artificial Sequence
  Synthetic oligonucleotide; TTT chr11 5395232 5395253 5395249 5395254 +
ataagtgccagtgcagcccacg

SEQ ID NO: 111834 - DNA, 22 bp, Artificial Sequence
  Synthetic oligonucleotide; TTA chr11 5395233 5395254 5395250 5395255 +
taagtgccagtgcagcccacgt

SEQ ID NO: 111835 - DNA, 22 bp, Artificial Sequence
  Synthetic oligonucleotide; CTG chr11 5395269 5395290 5395286 5395291 +
agtcaaatggaagatgctggca

SEQ ID NO: 111836 - DNA, 22 bp, Artificial Sequence
  Synthetic oligonucleotide; CTG chr11 5395288 5395309 5395305 5395310 +
gcatggagtggaagggctgcat

SEQ ID NO: 111837 - DNA, 22 bp, Artificial Sequence
  Synthetic oligonucleotide; CTG chr11 5395307 5395328 5395324 5395329 +
catgagaaagaagctacagaga

SEQ ID NO: 111838 - DNA, 22 bp, Artificial Sequence
  Synthetic oligonucleotide; CTA chr11 5395323 5395344 5395340 5395345 +
cagagaagaaaggaccagtaag

SEQ ID NO: 111839 - DNA, 22 bp, Artificial Sequence
  Synthetic oligonucleotide; TTG chr11 5395348 5395369 5395365 5395370 +
ctgaaggtcctttgttttgtgg

SEQ ID NO: 111840 - DNA, 22 bp, Artificial Sequence
  Synthetic oligonucleotide; CTG chr11 5395351 5395372 5395368 5395373 +
aaggtcctttgttttgtggata

SEQ ID NO: 111841 - DNA, 22 bp, Artificial Sequence
  Synthetic oligonucleotide; CTT chr11 5395360 5395381 5395377 5395382 +
tgttttgtggataaaggaagtc

SEQ ID NO: 111842 - DNA, 22 bp, Artificial Sequence
  Synthetic oligonucleotide; TTT chr11 5395361 5395382 5395378 5395383 +
gttttgtggataaaggaagtca

SEQ ID NO: 111843 - DNA, 22 bp, Artificial Sequence
  Synthetic oligonucleotide; TTG chr11 5395362 5395383 5395379 5395384 +
ttttgtggataaaggaagtcat

SEQ ID NO: 111844 - DNA, 22 bp, Artificial Sequence
  Synthetic oligonucleotide; TTT chr11 5395365 5395386 5395382 5395387 +
tgtggataaaggaagtcattgg

SEQ ID NO: 111845 - DNA, 22 bp, Artificial Sequence
  Synthetic oligonucleotide; TTT chr11 5395366 5395387 5395383 5395388 +
gtggataaaggaagtcattgga

SEQ ID NO: 111846 - DNA, 22 bp, Artificial Sequence
  Synthetic oligonucleotide; TTG chr11 5395367 5395388 5395384 5395389 +
tggataaaggaagtcattggag

SEQ ID NO: 111847 - DNA, 22 bp, Artificial Sequence
  Synthetic oligonucleotide; TTG chr11 5395386 5395407 5395403 5395408 +
gagtgacctctctaatatccct

SEQ ID NO: 111848 - DNA, 22 bp, Artificial Sequence
  Synthetic oligonucleotide; CTC chr11 5395396 5395417 5395413 5395418 +
tctaatatcccttatctagcat

SEQ ID NO: 111849 - DNA, 22 bp, Artificial Sequence
  Synthetic oligonucleotide; CTC chr11 5395398 5395419 5395415 5395420 +
taatatcccttatctagcatga

SEQ ID NO: 111850 - DNA, 22 bp, Artificial Sequence
  Synthetic oligonucleotide; CTA chr11 5395400 5395421 5395417 5395422 +
atatcccttatctagcatgact

SEQ ID NO: 111851 - DNA, 22 bp, Artificial Sequence
  Synthetic oligonucleotide; CTT chr11 5395409 5395430 5395426 5395431 +
atctagcatgactatatgcagg

SEQ ID NO: 111852 - DNA, 22 bp, Artificial Sequence
  Synthetic oligonucleotide; TTA chr11 5395410 5395431 5395427 5395432 +
tctagcatgactatatgcaggg

SEQ ID NO: 111853 - DNA, 22 bp, Artificial Sequence
  Synthetic oligonucleotide; CTA chr11 5395414 5395435 5395431 5395436 +
gcatgactatatgcagggttat

SEQ ID NO: 111854 - DNA, 22 bp, Artificial Sequence
  Synthetic oligonucleotide; CTA chr11 5395423 5395444 5395440 5395445 +
tatgcagggttatggaataggg

SEQ ID NO: 111855 - DNA, 22 bp, Artificial Sequence
  Synthetic oligonucleotide; TTA chr11 5395435 5395456 5395452 5395457 +
tggaatagggcagcttccagga

SEQ ID NO: 111856 - DNA, 22 bp, Artificial Sequence
  Synthetic oligonucleotide; CTT chr11 5395451 5395472 5395468 5395473 +
ccaggaagatggccaatctgtt

SEQ ID NO: 111857 - DNA, 22 bp, Artificial Sequence
  Synthetic oligonucleotide; TTC chr11 5395452 5395473 5395469 5395474 +
caggaagatggccaatctgttg

SEQ ID NO: 111858 - DNA, 22 bp, Artificial Sequence
  Synthetic oligonucleotide; CTG chr11 5395471 5395492 5395488 5395493 +
ttgttagggctgctgttctatc

SEQ ID NO: 111859 - DNA, 22 bp, Artificial Sequence
  Synthetic oligonucleotide; TTG chr11 5395474 5395495 5395491 5395496 +
ttagggctgctgttctatcata

SEQ ID NO: 111860 - DNA, 22 bp, Artificial Sequence
  Synthetic oligonucleotide; TTA chr11 5395477 5395498 5395494 5395499 +
gggctgctgttctatcatatct

SEQ ID NO: 111861 - DNA, 22 bp, Artificial Sequence
  Synthetic oligonucleotide; CTG chr11 5395483 5395504 5395500 5395505 +
ctgttctatcatatctcccgtg

SEQ ID NO: 111862 - DNA, 22 bp, Artificial Sequence
  Synthetic oligonucleotide; CTG chr11 5395486 5395507 5395503 5395508 +
ttctatcatatctcccgtgatg

SEQ ID NO: 111863 - DNA, 22 bp, Artificial Sequence
  Synthetic oligonucleotide; TTC chr11 5395489 5395510 5395506 5395511 +
tatcatatctcccgtgatgttt

SEQ ID NO: 111864 - DNA, 22 bp, Artificial Sequence
  Synthetic oligonucleotide; CTA chr11 5395491 5395512 5395508 5395513 +
tcatatctcccgtgatgttttt

SEQ ID NO: 111865 - DNA, 22 bp, Artificial Sequence
  Synthetic oligonucleotide; CTC chr11 5395500 5395521 5395517 5395522 +
ccgtgatgtttttgatggggaa

SEQ ID NO: 111866 - DNA, 22 bp, Artificial Sequence
  Synthetic oligonucleotide; TTT chr11 5395511 5395532 5395528 5395533 +
ttgatggggaagacagatctgg

SEQ ID NO: 111867 - DNA, 22 bp, Artificial Sequence
  Synthetic oligonucleotide; TTT chr11 5395512 5395533 5395529 5395534 +
tgatggggaagacagatctgga

SEQ ID NO: 111868 - DNA, 22 bp, Artificial Sequence
  Synthetic oligonucleotide; TTT chr11 5395513 5395534 5395530 5395535 +
gatggggaagacagatctggac

SEQ ID NO: 111869 - DNA, 22 bp, Artificial Sequence
  Synthetic oligonucleotide; TTG chr11 5395514 5395535 5395531 5395536 +
atggggaagacagatctggact

SEQ ID NO: 111870 - DNA, 22 bp, Artificial Sequence
  Synthetic oligonucleotide; CTG chr11 5395532 5395553 5395549 5395554 +
gacttgttactgggctatgcct

SEQ ID NO: 111871 - DNA, 22 bp, Artificial Sequence
  Synthetic oligonucleotide; CTT chr11 5395537 5395558 5395554 5395559 +
gttactgggctatgccttgtag

SEQ ID NO: 111872 - DNA, 22 bp, Artificial Sequence
  Synthetic oligonucleotide; TTG chr11 5395538 5395559 5395555 5395560 +
ttactgggctatgccttgtaga

SEQ ID NO: 111873 - DNA, 22 bp, Artificial Sequence
  Synthetic oligonucleotide; TTA chr11 5395541 5395562 5395558 5395563 +
ctgggctatgccttgtagagaa

SEQ ID NO: 111874 - DNA, 22 bp, Artificial Sequence
  Synthetic oligonucleotide; CTG chr11 5395544 5395565 5395561 5395566 +
ggctatgccttgtagagaatga

SEQ ID NO: 111875 - DNA, 22 bp, Artificial Sequence
  Synthetic oligonucleotide; CTA chr11 5395549 5395570 5395566 5395571 +
tgccttgtagagaatgatacag

SEQ ID NO: 111876 - DNA, 22 bp, Artificial Sequence
  Synthetic oligonucleotide; CTT chr11 5395555 5395576 5395572 5395577 +
gtagagaatgatacagggttgt

SEQ ID NO: 111877 - DNA, 22 bp, Artificial Sequence
  Synthetic oligonucleotide; TTG chr11 5395556 5395577 5395573 5395578 +
tagagaatgatacagggttgtg

SEQ ID NO: 111878 - DNA, 22 bp, Artificial Sequence
  Synthetic oligonucleotide; TTG chr11 5395576 5395597 5395593 5395598 +
tggcaggcaaggaaacataatc

SEQ ID NO: 111879 - DNA, 22 bp, Artificial Sequence
  Synthetic oligonucleotide; CTC chr11 5395600 5395621 5395617 5395622 +
agcaattgctccaattgatgaa

SEQ ID NO: 111880 - DNA, 22 bp, Artificial Sequence
  Synthetic oligonucleotide; TTG chr11 5395608 5395629 5395625 5395630 +
ctccaattgatgaagcttctaa

SEQ ID NO: 111881 - DNA, 22 bp, Artificial Sequence
  Synthetic oligonucleotide; CTC chr11 5395611 5395632 5395628 5395633 +
caattgatgaagcttctaacat

SEQ ID NO: 111882 - DNA, 22 bp, Artificial Sequence
  Synthetic oligonucleotide; TTG chr11 5395617 5395638 5395634 5395639 +
atgaagcttctaacatttcaga

SEQ ID NO: 111883 - DNA, 22 bp, Artificial Sequence
  Synthetic oligonucleotide; CTT chr11 5395626 5395647 5395643 5395648 +
ctaacatttcagagtgctttcc

SEQ ID NO: 111884 - DNA, 22 bp, Artificial Sequence
  Synthetic oligonucleotide; TTC chr11 5395627 5395648 5395644 5395649 +
taacatttcagagtgctttcct

SEQ ID NO: 111885 - DNA, 22 bp, Artificial Sequence
  Synthetic oligonucleotide; CTA chr11 5395629 5395650 5395646 5395651 +
acatttcagagtgctttcctcc

SEQ ID NO: 111886 - DNA, 22 bp, Artificial Sequence
  Synthetic oligonucleotide; TTT chr11 5395635 5395656 5395652 5395657 +
cagagtgctttcctccacagcc

SEQ ID NO: 111887 - DNA, 22 bp, Artificial Sequence
  Synthetic oligonucleotide; TTC chr11 5395636 5395657 5395653 5395658 +
agagtgctttcctccacagccc

SEQ ID NO: 111888 - DNA, 22 bp, Artificial Sequence
  Synthetic oligonucleotide; CTT chr11 5395645 5395666 5395662 5395667 +
tcctccacagccccattaaacc

SEQ ID NO: 111889 - DNA, 22 bp, Artificial Sequence
  Synthetic oligonucleotide; TTT chr11 5395646 5395667 5395663 5395668 +
cctccacagccccattaaacct

SEQ ID NO: 111890 - DNA, 22 bp, Artificial Sequence
  Synthetic oligonucleotide; TTC chr11 5395647 5395668 5395664 5395669 +
ctccacagccccattaaaccta

SEQ ID NO: 111891 - DNA, 22 bp, Artificial Sequence
  Synthetic oligonucleotide; CTC chr11 5395650 5395671 5395667 5395672 +
cacagccccattaaacctaatc

SEQ ID NO: 111892 - DNA, 22 bp, Artificial Sequence
  Synthetic oligonucleotide; TTA chr11 5395663 5395684 5395680 5395685 +
aacctaatcatttctctcgaaa

SEQ ID NO: 111893 - DNA, 22 bp, Artificial Sequence
  Synthetic oligonucleotide; CTA chr11 5395669 5395690 5395686 5395691 +
atcatttctctcgaaaagaggc

SEQ ID NO: 111894 - DNA, 22 bp, Artificial Sequence
  Synthetic oligonucleotide; TTT chr11 5395676 5395697 5395693 5395698 +
ctctcgaaaagaggcagggccc

SEQ ID NO: 111895 - DNA, 22 bp, Artificial Sequence
  Synthetic oligonucleotide; TTC chr11 5395677 5395698 5395694 5395699 +
tctcgaaaagaggcagggccca

SEQ ID NO: 111896 - DNA, 22 bp, Artificial Sequence
  Synthetic oligonucleotide; CTC chr11 5395679 5395700 5395696 5395701 +
tcgaaaagaggcagggcccatg

SEQ ID NO: 111897 - DNA, 22 bp, Artificial Sequence
  Synthetic oligonucleotide; CTC chr11 5395681 5395702 5395698 5395703 +
gaaaagaggcagggcccatgtg

SEQ ID NO: 111898 - DNA, 22 bp, Artificial Sequence
  Synthetic oligonucleotide; CTT chr11 5395711 5395732 5395728 5395733 +
tcaacatagtaaaaaagctaag

SEQ ID NO: 111899 - DNA, 22 bp, Artificial Sequence
  Synthetic oligonucleotide; TTT chr11 5395712 5395733 5395729 5395734 +
caacatagtaaaaaagctaagg

SEQ ID NO: 111900 - DNA, 22 bp, Artificial Sequence
  Synthetic oligonucleotide; TTC chr11 5395713 5395734 5395730 5395735 +
aacatagtaaaaaagctaaggt

SEQ ID NO: 111901 - DNA, 22 bp, Artificial Sequence
  Synthetic oligonucleotide; CTA chr11 5395731 5395752 5395748 5395753 +
aggtttagaaagattcagtaac

SEQ ID NO: 111902 - DNA, 22 bp, Artificial Sequence
  Synthetic oligonucleotide; TTT chr11 5395737 5395758 5395754 5395759 +
agaaagattcagtaactttgcc

SEQ ID NO: 111903 - DNA, 22 bp, Artificial Sequence
  Synthetic oligonucleotide; TTA chr11 5395738 5395759 5395755 5395760 +
gaaagattcagtaactttgcca

SEQ ID NO: 111904 - DNA, 22 bp, Artificial Sequence
  Synthetic oligonucleotide; TTC chr11 5395747 5395768 5395764 5395769 +
agtaactttgccaaagccatat

SEQ ID NO: 111905 - DNA, 22 bp, Artificial Sequence
  Synthetic oligonucleotide; CTT chr11 5395755 5395776 5395772 5395777 +
tgccaaagccatatggaaggat

SEQ ID NO: 111906 - DNA, 22 bp, Artificial Sequence
  Synthetic oligonucleotide; TTT chr11 5395756 5395777 5395773 5395778 +
gccaaagccatatggaaggatt

SEQ ID NO: 111907 - DNA, 22 bp, Artificial Sequence
  Synthetic oligonucleotide; TTG chr11 5395757 5395778 5395774 5395779 +
ccaaagccatatggaaggattg

SEQ ID NO: 111908 - DNA, 22 bp, Artificial Sequence
  Synthetic oligonucleotide; TTG chr11 5395779 5395800 5395796 5395801 +
tccaaaaacctgtgcaagagct

SEQ ID NO: 111909 - DNA, 22 bp, Artificial Sequence
  Synthetic oligonucleotide; CTG chr11 5395791 5395812 5395808 5395813 +
tgcaagagctcatggcttccca

SEQ ID NO: 111910 - DNA, 22 bp, Artificial Sequence
  Synthetic oligonucleotide; CTC chr11 5395802 5395823 5395819 5395824 +
atggcttcccactccaaatacc

SEQ ID NO: 111911 - DNA, 22 bp, Artificial Sequence
  Synthetic oligonucleotide; CTT chr11 5395809 5395830 5395826 5395831 +
cccactccaaataccttacgct

SEQ ID NO: 111912 - DNA, 22 bp, Artificial Sequence
  Synthetic oligonucleotide; TTC chr11 5395810 5395831 5395827 5395832 +
ccactccaaataccttacgctt

SEQ ID NO: 111913 - DNA, 22 bp, Artificial Sequence
  Synthetic oligonucleotide; CTC chr11 5395816 5395837 5395833 5395838 +
caaataccttacgcttcattgt

SEQ ID NO: 111914 - DNA, 22 bp, Artificial Sequence
  Synthetic oligonucleotide; CTT chr11 5395826 5395847 5395843 5395848 +
acgcttcattgttgtcagatta

SEQ ID NO: 111915 - DNA, 22 bp, Artificial Sequence
  Synthetic oligonucleotide; TTA chr11 5395827 5395848 5395844 5395849 +
cgcttcattgttgtcagattat

SEQ ID NO: 111916 - DNA, 22 bp, Artificial Sequence
  Synthetic oligonucleotide; CTT chr11 5395832 5395853 5395849 5395854 +
cattgttgtcagattatttttc

SEQ ID NO: 111917 - DNA, 22 bp, Artificial Sequence
  Synthetic oligonucleotide; TTC chr11 5395833 5395854 5395850 5395855 +
attgttgtcagattatttttca

SEQ ID NO: 111918 - DNA, 22 bp, Artificial Sequence
  Synthetic oligonucleotide; TTG chr11 5395837 5395858 5395854 5395859 +
ttgtcagattatttttcaatct

SEQ ID NO: 111919 - DNA, 22 bp, Artificial Sequence
  Synthetic oligonucleotide; TTG chr11 5395840 5395861 5395857 5395862 +
tcagattatttttcaatctttt

SEQ ID NO: 111920 - DNA, 22 bp, Artificial Sequence
  Synthetic oligonucleotide; TTA chr11 5395848 5395869 5395865 5395870 +
tttttcaatcttttcttagagc

SEQ ID NO: 111921 - DNA, 22 bp, Artificial Sequence
  Synthetic oligonucleotide; TTT chr11 5395851 5395872 5395868 5395873 +
ttcaatcttttcttagagctca

SEQ ID NO: 111922 - DNA, 22 bp, Artificial Sequence
  Synthetic oligonucleotide; TTT chr11 5395852 5395873 5395869 5395874 +
tcaatcttttcttagagctcac

SEQ ID NO: 111923 - DNA, 22 bp, Artificial Sequence
  Synthetic oligonucleotide; TTT chr11 5395853 5395874 5395870 5395875 +
caatcttttcttagagctcact

SEQ ID NO: 111924 - DNA, 22 bp, Artificial Sequence
  Synthetic oligonucleotide; TTC chr11 5395854 5395875 5395871 5395876 +
aatcttttcttagagctcactg

SEQ ID NO: 111925 - DNA, 22 bp, Artificial Sequence
  Synthetic oligonucleotide; CTT chr11 5395860 5395881 5395877 5395882 +
ttcttagagctcactgcaacat

SEQ ID NO: 111926 - DNA, 22 bp, Artificial Sequence
  Synthetic oligonucleotide; TTT chr11 5395861 5395882 5395878 5395883 +
tcttagagctcactgcaacatt

SEQ ID NO: 111927 - DNA, 22 bp, Artificial Sequence
  Synthetic oligonucleotide; TTT chr11 5395862 5395883 5395879 5395884 +
cttagagctcactgcaacattg

SEQ ID NO: 111928 - DNA, 22 bp, Artificial Sequence
  Synthetic oligonucleotide; TTC chr11 5395863 5395884 5395880 5395885 +
ttagagctcactgcaacattgc

SEQ ID NO: 111929 - DNA, 22 bp, Artificial Sequence
  Synthetic oligonucleotide; CTT chr11 5395865 5395886 5395882 5395887 +
agagctcactgcaacattgctc

SEQ ID NO: 111930 - DNA, 22 bp, Artificial Sequence
  Synthetic oligonucleotide; TTA chr11 5395866 5395887 5395883 5395888 +
gagctcactgcaacattgctca

SEQ ID NO: 111931 - DNA, 22 bp, Artificial Sequence
  Synthetic oligonucleotide; CTC chr11 5395872 5395893 5395889 5395894 +
actgcaacattgctcactggaa

SEQ ID NO: 111932 - DNA, 22 bp, Artificial Sequence
  Synthetic oligonucleotide; CTG chr11 5395876 5395897 5395893 5395898 +
caacattgctcactggaatgct

SEQ ID NO: 111933 - DNA, 22 bp, Artificial Sequence
  Synthetic oligonucleotide; TTG chr11 5395884 5395905 5395901 5395906 +
ctcactggaatgctggaaagta

SEQ ID NO: 111934 - DNA, 22 bp, Artificial Sequence
  Synthetic oligonucleotide; CTC chr11 5395887 5395908 5395904 5395909 +
actggaatgctggaaagtacaa

SEQ ID NO: 111935 - DNA, 22 bp, Artificial Sequence
  Synthetic oligonucleotide; CTG chr11 5395891 5395912 5395908 5395913 +
gaatgctggaaagtacaactaa

SEQ ID NO: 111936 - DNA, 22 bp, Artificial Sequence
  Synthetic oligonucleotide; CTG chr11 5395899 5395920 5395916 5395921 +
gaaagtacaactaataaaatgt

SEQ ID NO: 111937 - DNA, 22 bp, Artificial Sequence
  Synthetic oligonucleotide; CTA chr11 5395912 5395933 5395929 5395934 +
ataaaatgtgtctattgagtat

SEQ ID NO: 111938 - DNA, 22 bp, Artificial Sequence
  Synthetic oligonucleotide; CTA chr11 5395926 5395947 5395943 5395948 +
ttgagtatttgcttctaactgt

SEQ ID NO: 111939 - DNA, 22 bp, Artificial Sequence
  Synthetic oligonucleotide; TTG chr11 5395929 5395950 5395946 5395951 +
agtatttgcttctaactgtact

SEQ ID NO: 111940 - DNA, 22 bp, Artificial Sequence
  Synthetic oligonucleotide; TTT chr11 5395936 5395957 5395953 5395958 +
gcttctaactgtactccattta

SEQ ID NO: 111941 - DNA, 22 bp, Artificial Sequence
  Synthetic oligonucleotide; TTG chr11 5395937 5395958 5395954 5395959 +
cttctaactgtactccatttaa

SEQ ID NO: 111942 - DNA, 22 bp, Artificial Sequence
  Synthetic oligonucleotide; CTT chr11 5395940 5395961 5395957 5395962 +
ctaactgtactccatttaaaat

SEQ ID NO: 111943 - DNA, 22 bp, Artificial Sequence
  Synthetic oligonucleotide; TTC chr11 5395941 5395962 5395958 5395963 +
taactgtactccatttaaaatt

SEQ ID NO: 111944 - DNA, 22 bp, Artificial Sequence
  Synthetic oligonucleotide; CTA chr11 5395943 5395964 5395960 5395965 +
actgtactccatttaaaattgc

SEQ ID NO: 111945 - DNA, 22 bp, Artificial Sequence
  Synthetic oligonucleotide; CTG chr11 5395947 5395968 5395964 5395969 +
tactccatttaaaattgcatat

SEQ ID NO: 111946 - DNA, 22 bp, Artificial Sequence
  Synthetic oligonucleotide; CTC chr11 5395952 5395973 5395969 5395974 +
catttaaaattgcatatgaatg

SEQ ID NO: 111947 - DNA, 22 bp, Artificial Sequence
  Synthetic oligonucleotide; TTT chr11 5395957 5395978 5395974 5395979 +
aaaattgcatatgaatggctct

SEQ ID NO: 111948 - DNA, 22 bp, Artificial Sequence
  Synthetic oligonucleotide; TTA chr11 5395958 5395979 5395975 5395980 +
aaattgcatatgaatggctctc

SEQ ID NO: 111949 - DNA, 22 bp, Artificial Sequence
  Synthetic oligonucleotide; TTG chr11 5395964 5395985 5395981 5395986 +
catatgaatggctctctaatct

SEQ ID NO: 111950 - DNA, 22 bp, Artificial Sequence
  Synthetic oligonucleotide; CTC chr11 5395978 5395999 5395995 5396000 +
tctaatctatggagtaggtaga

SEQ ID NO: 111951 - DNA, 22 bp, Artificial Sequence
  Synthetic oligonucleotide; CTC chr11 5395980 5396001 5395997 5396002 +
taatctatggagtaggtagaat

SEQ ID NO: 111952 - DNA, 22 bp, Artificial Sequence
  Synthetic oligonucleotide; CTA chr11 5395982 5396003 5395999 5396004 +
atctatggagtaggtagaattg

SEQ ID NO: 111953 - DNA, 22 bp, Artificial Sequence
  Synthetic oligonucleotide; CTA chr11 5395987 5396008 5396004 5396009 +
tggagtaggtagaattgtctca

SEQ ID NO: 111954 - DNA, 22 bp, Artificial Sequence
  Synthetic oligonucleotide; TTG chr11 5396004 5396025 5396021 5396026 +
tctcaatttttcagatgaagaa

SEQ ID NO: 111955 - DNA, 22 bp, Artificial Sequence
  Synthetic oligonucleotide; CTC chr11 5396008 5396029 5396025 5396030 +
aatttttcagatgaagaaacta

SEQ ID NO: 111956 - DNA, 22 bp, Artificial Sequence
  Synthetic oligonucleotide; TTT chr11 5396013 5396034 5396030 5396035 +
ttcagatgaagaaactaagatt

SEQ ID NO: 111957 - DNA, 22 bp, Artificial Sequence
  Synthetic oligonucleotide; TTT chr11 5396014 5396035 5396031 5396036 +
tcagatgaagaaactaagatta

SEQ ID NO: 111958 - DNA, 22 bp, Artificial Sequence
  Synthetic oligonucleotide; TTT chr11 5396015 5396036 5396032 5396037 +
cagatgaagaaactaagattaa

SEQ ID NO: 111959 - DNA, 22 bp, Artificial Sequence
  Synthetic oligonucleotide; TTC chr11 5396016 5396037 5396033 5396038 +
agatgaagaaactaagattaat

SEQ ID NO: 111960 - DNA, 22 bp, Artificial Sequence
  Synthetic oligonucleotide; CTA chr11 5396030 5396051 5396047 5396052 +
agattaatcagatactttgcac

SEQ ID NO: 111961 - DNA, 22 bp, Artificial Sequence
  Synthetic oligonucleotide; TTA chr11 5396036 5396057 5396053 5396058 +
atcagatactttgcacaatcat

SEQ ID NO: 111962 - DNA, 22 bp, Artificial Sequence
  Synthetic oligonucleotide; CTT chr11 5396047 5396068 5396064 5396069 +
tgcacaatcatagagtgaagag

SEQ ID NO: 111963 - DNA, 22 bp, Artificial Sequence
  Synthetic oligonucleotide; TTT chr11 5396048 5396069 5396065 5396070 +
gcacaatcatagagtgaagagc

SEQ ID NO: 111964 - DNA, 22 bp, Artificial Sequence
  Synthetic oligonucleotide; TTG chr11 5396049 5396070 5396066 5396071 +
cacaatcatagagtgaagagct

SEQ ID NO: 111965 - DNA, 22 bp, Artificial Sequence
  Synthetic oligonucleotide; CTA chr11 5396072 5396093 5396089 5396094 +
ttgaagttatgattgtaataca

SEQ ID NO: 111966 - DNA, 22 bp, Artificial Sequence
  Synthetic oligonucleotide; TTG chr11 5396075 5396096 5396092 5396097 +
aagttatgattgtaatacagat

SEQ ID NO: 111967 - DNA, 22 bp, Artificial Sequence
  Synthetic oligonucleotide; TTA chr11 5396081 5396102 5396098 5396103 +
tgattgtaatacagatctggtc

SEQ ID NO: 111968 - DNA, 22 bp, Artificial Sequence
  Synthetic oligonucleotide; TTG chr11 5396087 5396108 5396104 5396109 +
taatacagatctggtcccagag

SEQ ID NO: 111969 - DNA, 22 bp, Artificial Sequence
  Synthetic oligonucleotide; CTG chr11 5396100 5396121 5396117 5396122 +
gtcccagagacactgctcttaa

SEQ ID NO: 111970 - DNA, 22 bp, Artificial Sequence
  Synthetic oligonucleotide; CTG chr11 5396115 5396136 5396132 5396137 +
ctcttaaccacactgcactgcc

SEQ ID NO: 111971 - DNA, 22 bp, Artificial Sequence
  Synthetic oligonucleotide; CTC chr11 5396118 5396139 5396135 5396140 +
ttaaccacactgcactgcctaa

SEQ ID NO: 111972 - DNA, 22 bp, Artificial Sequence
  Synthetic oligonucleotide; CTT chr11 5396120 5396141 5396137 5396142 +
aaccacactgcactgcctaatg

SEQ ID NO: 111973 - DNA, 22 bp, Artificial Sequence
  Synthetic oligonucleotide; TTA chr11 5396121 5396142 5396138 5396143 +
accacactgcactgcctaatga

SEQ ID NO: 111974 - DNA, 22 bp, Artificial Sequence
  Synthetic oligonucleotide; CTG chr11 5396130 5396151 5396147 5396152 +
cactgcctaatgaaaatgtgcc

SEQ ID NO: 111975 - DNA, 22 bp, Artificial Sequence
  Synthetic oligonucleotide; CTG chr11 5396135 5396156 5396152 5396157 +
cctaatgaaaatgtgcctaggc

SEQ ID NO: 111976 - DNA, 22 bp, Artificial Sequence
  Synthetic oligonucleotide; CTA chr11 5396139 5396160 5396156 5396161 +
atgaaaatgtgcctaggctgca

SEQ ID NO: 111977 - DNA, 22 bp, Artificial Sequence
  Synthetic oligonucleotide; CTA chr11 5396154 5396175 5396171 5396176 +
ggctgcaagacagggatgccct

SEQ ID NO: 111978 - DNA, 22 bp, Artificial Sequence
  Synthetic oligonucleotide; CTG chr11 5396159 5396180 5396176 5396181 +
caagacagggatgccctctctc

SEQ ID NO: 111979 - DNA, 22 bp, Artificial Sequence
  Synthetic oligonucleotide; CTC chr11 5396177 5396198 5396194 5396199 +
tctcaccactcctattcaacat

SEQ ID NO: 111980 - DNA, 22 bp, Artificial Sequence
  Synthetic oligonucleotide; CTC chr11 5396179 5396200 5396196 5396201 +
tcaccactcctattcaacatag

SEQ ID NO: 111981 - DNA, 22 bp, Artificial Sequence
  Synthetic oligonucleotide; CTC chr11 5396181 5396202 5396198 5396203 +
accactcctattcaacatagtg

SEQ ID NO: 111982 - DNA, 22 bp, Artificial Sequence
  Synthetic oligonucleotide; CTC chr11 5396188 5396209 5396205 5396210 +
ctattcaacatagtgttggaag

SEQ ID NO: 111983 - DNA, 22 bp, Artificial Sequence
  Synthetic oligonucleotide; CTA chr11 5396191 5396212 5396208 5396213 +
ttcaacatagtgttggaagttc

SEQ ID NO: 111984 - DNA, 22 bp, Artificial Sequence
  Synthetic oligonucleotide; TTC chr11 5396194 5396215 5396211 5396216 +
aacatagtgttggaagttctgg

SEQ ID NO: 111985 - DNA, 22 bp, Artificial Sequence
  Synthetic oligonucleotide; TTG chr11 5396206 5396227 5396223 5396228 +
gaagttctggcccgggcaatcg

SEQ ID NO: 111986 - DNA, 22 bp, Artificial Sequence
  Synthetic oligonucleotide; TTC chr11 5396213 5396234 5396230 5396235 +
tggcccgggcaatcgggcagga

SEQ ID NO: 111987 - DNA, 22 bp, Artificial Sequence
  Synthetic oligonucleotide; CTG chr11 5396215 5396236 5396232 5396237 +
gcccgggcaatcgggcaggaga

SEQ ID NO: 111988 - DNA, 22 bp, Artificial Sequence
  Synthetic oligonucleotide; TTC chr11 5396255 5396276 5396272 5396277 +
aattatgtaaagagaaagtcaa

SEQ ID NO: 111989 - DNA, 22 bp, Artificial Sequence
  Synthetic oligonucleotide; TTA chr11 5396260 5396281 5396277 5396282 +
tgtaaagagaaagtcaaattgt

SEQ ID NO: 111990 - DNA, 22 bp, Artificial Sequence
  Synthetic oligonucleotide; TTG chr11 5396281 5396302 5396298 5396303 +
tccctgtttgcagatgacgtga

SEQ ID NO: 111991 - DNA, 22 bp, Artificial Sequence
  Synthetic oligonucleotide; CTG chr11 5396287 5396308 5396304 5396309 +
tttgcagatgacgtgattgcat

SEQ ID NO: 111992 - DNA, 22 bp, Artificial Sequence
  Synthetic oligonucleotide; TTT chr11 5396290 5396311 5396307 5396312 +
gcagatgacgtgattgcatatc

SEQ ID NO: 111993 - DNA, 22 bp, Artificial Sequence
  Synthetic oligonucleotide; TTG chr11 5396291 5396312 5396308 5396313 +
cagatgacgtgattgcatatct

SEQ ID NO: 111994 - DNA, 22 bp, Artificial Sequence
  Synthetic oligonucleotide; TTG chr11 5396306 5396327 5396323 5396328 +
catatctagaaaaccccattgt

SEQ ID NO: 111995 - DNA, 22 bp, Artificial Sequence
  Synthetic oligonucleotide; CTA chr11 5396314 5396335 5396331 5396336 +
gaaaaccccattgtctcagccc

SEQ ID NO: 111996 - DNA, 22 bp, Artificial Sequence
  Synthetic oligonucleotide; TTG chr11 5396327 5396348 5396344 5396349 +
tctcagcccaaaatccccttaa

SEQ ID NO: 111997 - DNA, 22 bp, Artificial Sequence
  Synthetic oligonucleotide; CTC chr11 5396331 5396352 5396348 5396353 +
agcccaaaatccccttaagctg

SEQ ID NO: 111998 - DNA, 22 bp, Artificial Sequence
  Synthetic oligonucleotide; CTT chr11 5396347 5396368 5396364 5396369 +
aagctgataagcaacttcagca

SEQ ID NO: 111999 - DNA, 22 bp, Artificial Sequence
  Synthetic oligonucleotide; TTA chr11 5396348 5396369 5396365 5396370 +
agctgataagcaacttcagcaa

SEQ ID NO: 112000 - DNA, 22 bp, Artificial Sequence
  Synthetic oligonucleotide; CTG chr11 5396353 5396374 5396370 5396375 +
ataagcaacttcagcaaagtct

SEQ ID NO: 112001 - DNA, 22 bp, Artificial Sequence
  Synthetic oligonucleotide; CTT chr11 5396364 5396385 5396381 5396386 +
cagcaaagtctcaggatacaaa

SEQ ID NO: 112002 - DNA, 22 bp, Artificial Sequence
  Synthetic oligonucleotide; TTC chr11 5396365 5396386 5396382 5396387 +
agcaaagtctcaggatacaaaa

SEQ ID NO: 112003 - DNA, 22 bp, Artificial Sequence
  Synthetic oligonucleotide; CTC chr11 5396376 5396397 5396393 5396398 +
aggatacaaaatcaatgtgcaa

SEQ ID NO: 112004 - DNA, 22 bp, Artificial Sequence
  Synthetic oligonucleotide; TTC chr11 5396413 5396434 5396430 5396435 +
ttatacaccaataacagacaaa

SEQ ID NO: 112005 - DNA, 22 bp, Artificial Sequence
  Synthetic oligonucleotide; CTT chr11 5396415 5396436 5396432 5396437 +
atacaccaataacagacaaaca

SEQ ID NO: 112006 - DNA, 22 bp, Artificial Sequence
  Synthetic oligonucleotide; TTA chr11 5396416 5396437 5396433 5396438 +
tacaccaataacagacaaacag

SEQ ID NO: 112007 - DNA, 22 bp, Artificial Sequence
  Synthetic oligonucleotide; CTC chr11 5396449 5396470 5396466 5396471 +
ccattcacaattgcttcagaga

SEQ ID NO: 112008 - DNA, 22 bp, Artificial Sequence
  Synthetic oligonucleotide; TTC chr11 5396455 5396476 5396472 5396477 +
acaattgcttcagagagaatat

SEQ ID NO: 112009 - DNA, 22 bp, Artificial Sequence
  Synthetic oligonucleotide; TTG chr11 5396462 5396483 5396479 5396484 +
cttcagagagaatataatacct

SEQ ID NO: 112010 - DNA, 22 bp, Artificial Sequence
  Synthetic oligonucleotide; CTT chr11 5396465 5396486 5396482 5396487 +
cagagagaatataatacctagg

SEQ ID NO: 112011 - DNA, 22 bp, Artificial Sequence
  Synthetic oligonucleotide; TTC chr11 5396466 5396487 5396483 5396488 +
agagagaatataatacctagga

SEQ ID NO: 112012 - DNA, 22 bp, Artificial Sequence
  Synthetic oligonucleotide; CTA chr11 5396485 5396506 5396502 5396507 +
ggaatccaacttacaagggatg

SEQ ID NO: 112013 - DNA, 22 bp, Artificial Sequence
  Synthetic oligonucleotide; CTT chr11 5396497 5396518 5396514 5396519 +
acaagggatgtgaaggacctct

SEQ ID NO: 112014 - DNA, 22 bp, Artificial Sequence
  Synthetic oligonucleotide; TTA chr11 5396498 5396519 5396515 5396520 +
caagggatgtgaaggacctctt

SEQ ID NO: 112015 - DNA, 22 bp, Artificial Sequence
  Synthetic oligonucleotide; CTC chr11 5396518 5396539 5396535 5396540 +
ttcaaggagaactacaaaccac

SEQ ID NO: 112016 - DNA, 22 bp, Artificial Sequence
  Synthetic oligonucleotide; CTT chr11 5396520 5396541 5396537 5396542 +
caaggagaactacaaaccactg

SEQ ID NO: 112017 - DNA, 22 bp, Artificial Sequence
  Synthetic oligonucleotide; TTC chr11 5396521 5396542 5396538 5396543 +
aaggagaactacaaaccactgc

SEQ ID NO: 112018 - DNA, 22 bp, Artificial Sequence
  Synthetic oligonucleotide; CTA chr11 5396532 5396553 5396549 5396554 +
caaaccactgctcaaggaaata

SEQ ID NO: 112019 - DNA, 22 bp, Artificial Sequence
  Synthetic oligonucleotide; CTG chr11 5396542 5396563 5396559 5396564 +
ctcaaggaaataagatacaaac

SEQ ID NO: 112020 - DNA, 22 bp, Artificial Sequence
  Synthetic oligonucleotide; CTC chr11 5396545 5396566 5396562 5396567 +
aaggaaataagatacaaacaaa

SEQ ID NO: 112021 - DNA, 22 bp, Artificial Sequence
  Synthetic oligonucleotide; TTC chr11 5396580 5396601 5396597 5396602 +
catgctcatggataggaagaaa

SEQ ID NO: 112022 - DNA, 22 bp, Artificial Sequence
  Synthetic oligonucleotide; CTC chr11 5396587 5396608 5396604 5396609 +
atggataggaagaaacaatatc

SEQ ID NO: 112023 - DNA, 22 bp, Artificial Sequence
  Synthetic oligonucleotide; CTG chr11 5396627 5396648 5396644 5396649 +
cccaaggtaatttatagattca

SEQ ID NO: 112024 - DNA, 22 bp, Artificial Sequence
  Synthetic oligonucleotide; TTT chr11 5396640 5396661 5396657 5396662 +
atagattcaatgccatccccat

SEQ ID NO: 112025 - DNA, 22 bp, Artificial Sequence
  Synthetic oligonucleotide; TTA chr11 5396641 5396662 5396658 5396663 +
tagattcaatgccatccccatc

SEQ ID NO: 112026 - DNA, 22 bp, Artificial Sequence
  Synthetic oligonucleotide; TTC chr11 5396648 5396669 5396665 5396670 +
aatgccatccccatcaagctac

SEQ ID NO: 112027 - DNA, 22 bp, Artificial Sequence
  Synthetic oligonucleotide; CTA chr11 5396669 5396690 5396686 5396691 +
ccaatgactttcttcacagaat

SEQ ID NO: 112028 - DNA, 22 bp, Artificial Sequence
  Synthetic oligonucleotide; CTT chr11 5396679 5396700 5396696 5396701 +
tcttcacagaattggaaaaaac

SEQ ID NO: 112029 - DNA, 22 bp, Artificial Sequence
  Synthetic oligonucleotide; TTT chr11 5396680 5396701 5396697 5396702 +
cttcacagaattggaaaaaact

SEQ ID NO: 112030 - DNA, 22 bp, Artificial Sequence
  Synthetic oligonucleotide; TTC chr11 5396681 5396702 5396698 5396703 +
ttcacagaattggaaaaaacta

SEQ ID NO: 112031 - DNA, 22 bp, Artificial Sequence
  Synthetic oligonucleotide; CTT chr11 5396683 5396704 5396700 5396705 +
cacagaattggaaaaaactact

SEQ ID NO: 112032 - DNA, 22 bp, Artificial Sequence
  Synthetic oligonucleotide; TTC chr11 5396684 5396705 5396701 5396706 +
acagaattggaaaaaactactt

SEQ ID NO: 112033 - DNA, 22 bp, Artificial Sequence
  Synthetic oligonucleotide; TTG chr11 5396693 5396714 5396710 5396715 +
gaaaaaactactttaaagttca

SEQ ID NO: 112034 - DNA, 22 bp, Artificial Sequence
  Synthetic oligonucleotide; CTA chr11 5396703 5396724 5396720 5396725 +
ctttaaagttcatatggaacca

SEQ ID NO: 112035 - DNA, 22 bp, Artificial Sequence
  Synthetic oligonucleotide; CTT chr11 5396706 5396727 5396723 5396728 +
taaagttcatatggaaccaaaa

SEQ ID NO: 112036 - DNA, 22 bp, Artificial Sequence
  Synthetic oligonucleotide; TTT chr11 5396707 5396728 5396724 5396729 +
aaagttcatatggaaccaaaaa

SEQ ID NO: 112037 - DNA, 22 bp, Artificial Sequence
  Synthetic oligonucleotide; TTA chr11 5396708 5396729 5396725 5396730 +
aagttcatatggaaccaaaaaa

SEQ ID NO: 112038 - DNA, 22 bp, Artificial Sequence
  Synthetic oligonucleotide; TTC chr11 5396714 5396735 5396731 5396736 +
atatggaaccaaaaaagagccc

SEQ ID NO: 112039 - DNA, 22 bp, Artificial Sequence
  Synthetic oligonucleotide; CTA chr11 5396756 5396777 5396773 5396778 +
agccaaaagaacaaagctggag

SEQ ID NO: 112040 - DNA, 22 bp, Artificial Sequence
  Synthetic oligonucleotide; CTG chr11 5396775 5396796 5396792 5396797 +
gaggcatcacactacctgattt

SEQ ID NO: 112041 - DNA, 22 bp, Artificial Sequence
  Synthetic oligonucleotide; CTA chr11 5396789 5396810 5396806 5396811 +
cctgatttcaaactatactaca

SEQ ID NO: 112042 - DNA, 22 bp, Artificial Sequence
  Synthetic oligonucleotide; CTG chr11 5396793 5396814 5396810 5396815 +
atttcaaactatactacaaggc

SEQ ID NO: 112043 - DNA, 22 bp, Artificial Sequence
  Synthetic oligonucleotide; TTT chr11 5396797 5396818 5396814 5396819 +
caaactatactacaaggctaca

SEQ ID NO: 112044 - DNA, 22 bp, Artificial Sequence
  Synthetic oligonucleotide; TTC chr11 5396798 5396819 5396815 5396820 +
aaactatactacaaggctacag

SEQ ID NO: 112045 - DNA, 22 bp, Artificial Sequence
  Synthetic oligonucleotide; CTA chr11 5396804 5396825 5396821 5396826 +
tactacaaggctacagtaacca

SEQ ID NO: 112046 - DNA, 22 bp, Artificial Sequence
  Synthetic oligonucleotide; CTA chr11 5396809 5396830 5396826 5396831 +
caaggctacagtaaccaaaaca

SEQ ID NO: 112047 - DNA, 22 bp, Artificial Sequence
  Synthetic oligonucleotide; CTA chr11 5396817 5396838 5396834 5396839 +
cagtaaccaaaacagcatagta

SEQ ID NO: 112048 - DNA, 22 bp, Artificial Sequence
  Synthetic oligonucleotide; CTG chr11 5396842 5396863 5396859 5396864 +
gtaccaaaacagagatatagac

SEQ ID NO: 112049 - DNA, 22 bp, Artificial Sequence
  Synthetic oligonucleotide; CTC chr11 5396887 5396908 5396904 5396909 +
agaaataatgctgtctatctac

SEQ ID NO: 112050 - DNA, 22 bp, Artificial Sequence
  Synthetic oligonucleotide; CTG chr11 5396900 5396921 5396917 5396922 +
tctatctacaactatctgatct

SEQ ID NO: 112051 - DNA, 22 bp, Artificial Sequence
  Synthetic oligonucleotide; CTA chr11 5396904 5396925 5396921 5396926 +
tctacaactatctgatctttga

SEQ ID NO: 112052 - DNA, 22 bp, Artificial Sequence
  Synthetic oligonucleotide; CTA chr11 5396908 5396929 5396925 5396930 +
caactatctgatctttgacaaa

SEQ ID NO: 112053 - DNA, 22 bp, Artificial Sequence
  Synthetic oligonucleotide; CTA chr11 5396914 5396935 5396931 5396936 +
tctgatctttgacaaacctgag

SEQ ID NO: 112054 - DNA, 22 bp, Artificial Sequence
  Synthetic oligonucleotide; CTG chr11 5396918 5396939 5396935 5396940 +
atctttgacaaacctgagaaaa

SEQ ID NO: 112055 - DNA, 22 bp, Artificial Sequence
  Synthetic oligonucleotide; CTT chr11 5396923 5396944 5396940 5396945 +
tgacaaacctgagaaaaacaag

SEQ ID NO: 112056 - DNA, 22 bp, Artificial Sequence
  Synthetic oligonucleotide; TTT chr11 5396924 5396945 5396941 5396946 +
gacaaacctgagaaaaacaaga

SEQ ID NO: 112057 - DNA, 22 bp, Artificial Sequence
  Synthetic oligonucleotide; TTG chr11 5396925 5396946 5396942 5396947 +
acaaacctgagaaaaacaagaa

SEQ ID NO: 112058 - DNA, 22 bp, Artificial Sequence
  Synthetic oligonucleotide; CTG chr11 5396934 5396955 5396951 5396956 +
agaaaaacaagaaatggggaaa

SEQ ID NO: 112059 - DNA, 22 bp, Artificial Sequence
  Synthetic oligonucleotide; TTC chr11 5396962 5396983 5396979 5396984 +
cctgtttaataaatggtgctgg

SEQ ID NO: 112060 - DNA, 22 bp, Artificial Sequence
  Synthetic oligonucleotide; CTG chr11 5396966 5396987 5396983 5396988 +
tttaataaatggtgctgggaaa

SEQ ID NO: 112061 - DNA, 22 bp, Artificial Sequence
  Synthetic oligonucleotide; TTT chr11 5396969 5396990 5396986 5396991 +
aataaatggtgctgggaaaact

SEQ ID NO: 112062 - DNA, 22 bp, Artificial Sequence
  Synthetic oligonucleotide; TTA chr11 5396970 5396991 5396987 5396992 +
ataaatggtgctgggaaaactg

SEQ ID NO: 112063 - DNA, 22 bp, Artificial Sequence
  Synthetic oligonucleotide; CTG chr11 5396983 5397004 5397000 5397005 +
ggaaaactggctagccaaatgt

SEQ ID NO: 112064 - DNA, 22 bp, Artificial Sequence
  Synthetic oligonucleotide; CTG chr11 5396992 5397013 5397009 5397014 +
gctagccaaatgtaggaagctg

SEQ ID NO: 112065 - DNA, 22 bp, Artificial Sequence
  Synthetic oligonucleotide; CTA chr11 5396996 5397017 5397013 5397018 +
gccaaatgtaggaagctgaaac

SEQ ID NO: 112066 - DNA, 22 bp, Artificial Sequence
  Synthetic oligonucleotide; CTG chr11 5397014 5397035 5397031 5397036 +
aaactggatcccttccttacac

SEQ ID NO: 112067 - DNA, 22 bp, Artificial Sequence
  Synthetic oligonucleotide; CTG chr11 5397020 5397041 5397037 5397042 +
gatcccttccttacaccttata

SEQ ID NO: 112068 - DNA, 22 bp, Artificial Sequence
  Synthetic oligonucleotide; CTT chr11 5397028 5397049 5397045 5397050 +
ccttacaccttatacaaaaatt

SEQ ID NO: 112069 - DNA, 22 bp, Artificial Sequence
  Synthetic oligonucleotide; TTC chr11 5397029 5397050 5397046 5397051 +
cttacaccttatacaaaaatta

SEQ ID NO: 112070 - DNA, 22 bp, Artificial Sequence
  Synthetic oligonucleotide; CTT chr11 5397032 5397053 5397049 5397054 +
acaccttatacaaaaattaact

SEQ ID NO: 112071 - DNA, 22 bp, Artificial Sequence
  Synthetic oligonucleotide; TTA chr11 5397033 5397054 5397050 5397055 +
caccttatacaaaaattaactc

SEQ ID NO: 112072 - DNA, 22 bp, Artificial Sequence
  Synthetic oligonucleotide; CTT chr11 5397039 5397060 5397056 5397061 +
atacaaaaattaactcaagatg

SEQ ID NO: 112073 - DNA, 22 bp, Artificial Sequence
  Synthetic oligonucleotide; TTA chr11 5397040 5397061 5397057 5397062 +
tacaaaaattaactcaagatgg

SEQ ID NO: 112074 - DNA, 22 bp, Artificial Sequence
  Synthetic oligonucleotide; TTA chr11 5397051 5397072 5397068 5397073 +
actcaagatggattaaagactt

SEQ ID NO: 112075 - DNA, 22 bp, Artificial Sequence
  Synthetic oligonucleotide; CTC chr11 5397055 5397076 5397072 5397077 +
aagatggattaaagacttaaat

SEQ ID NO: 112076 - DNA, 22 bp, Artificial Sequence
  Synthetic oligonucleotide; TTA chr11 5397066 5397087 5397083 5397088 +
aagacttaaatgttagacctaa

SEQ ID NO: 112077 - DNA, 22 bp, Artificial Sequence
  Synthetic oligonucleotide; CTT chr11 5397073 5397094 5397090 5397095 +
aaatgttagacctaaaaccata

SEQ ID NO: 112078 - DNA, 22 bp, Artificial Sequence
  Synthetic oligonucleotide; TTA chr11 5397074 5397095 5397091 5397096 +
aatgttagacctaaaaccataa

SEQ ID NO: 112079 - DNA, 22 bp, Artificial Sequence
  Synthetic oligonucleotide; TTA chr11 5397081 5397102 5397098 5397103 +
gacctaaaaccataaaaactct

SEQ ID NO: 112080 - DNA, 22 bp, Artificial Sequence
  Synthetic oligonucleotide; CTA chr11 5397087 5397108 5397104 5397109 +
aaaccataaaaactctagaaga

SEQ ID NO: 112081 - DNA, 22 bp, Artificial Sequence
  Synthetic oligonucleotide; CTC chr11 5397102 5397123 5397119 5397124 +
tagaagaaaacctaagcaatac

SEQ ID NO: 112082 - DNA, 22 bp, Artificial Sequence
  Synthetic oligonucleotide; CTA chr11 5397104 5397125 5397121 5397126 +
gaagaaaacctaagcaatacca

SEQ ID NO: 112083 - DNA, 22 bp, Artificial Sequence
  Synthetic oligonucleotide; CTA chr11 5397116 5397137 5397133 5397138 +
agcaataccattcaggacatag

SEQ ID NO: 112084 - DNA, 22 bp, Artificial Sequence
  Synthetic oligonucleotide; TTC chr11 5397129 5397150 5397146 5397151 +
aggacataggcatgggcatgga

SEQ ID NO: 112085 - DNA, 22 bp, Artificial Sequence
  Synthetic oligonucleotide; CTT chr11 5397154 5397175 5397171 5397176 +
catgtctaaaacaccaaaagca

SEQ ID NO: 112086 - DNA, 22 bp, Artificial Sequence
  Synthetic oligonucleotide; TTC chr11 5397155 5397176 5397172 5397177 +
atgtctaaaacaccaaaagcaa

SEQ ID NO: 112087 - DNA, 22 bp, Artificial Sequence
  Synthetic oligonucleotide; CTA chr11 5397162 5397183 5397179 5397184 +
aaacaccaaaagcaatggcaac

SEQ ID NO: 112088 - DNA, 22 bp, Artificial Sequence
  Synthetic oligonucleotide; TTC chr11 5397198 5397219 5397215 5397220 +
actaatgggatctaattaaact

SEQ ID NO: 112089 - DNA, 22 bp, Artificial Sequence
  Synthetic oligonucleotide; CTA chr11 5397202 5397223 5397219 5397224 +
atgggatctaattaaactaaag

SEQ ID NO: 112090 - DNA, 22 bp, Artificial Sequence
  Synthetic oligonucleotide; CTA chr11 5397212 5397233 5397229 5397234 +
attaaactaaagatcttctgca

SEQ ID NO: 112091 - DNA, 22 bp, Artificial Sequence
  Synthetic oligonucleotide; TTA chr11 5397216 5397237 5397233 5397238 +
aactaaagatcttctgcacagc

SEQ ID NO: 112092 - DNA, 22 bp, Artificial Sequence
  Synthetic oligonucleotide; CTA chr11 5397221 5397242 5397238 5397243 +
aagatcttctgcacagcaaaag

SEQ ID NO: 112093 - DNA, 22 bp, Artificial Sequence
  Synthetic oligonucleotide; CTT chr11 5397229 5397250 5397246 5397251 +
ctgcacagcaaaagaaactacc

SEQ ID NO: 112094 - DNA, 22 bp, Artificial Sequence
  Synthetic oligonucleotide; TTC chr11 5397230 5397251 5397247 5397252 +
tgcacagcaaaagaaactacca

SEQ ID NO: 112095 - DNA, 22 bp, Artificial Sequence
  Synthetic oligonucleotide; CTG chr11 5397232 5397253 5397249 5397254 +
cacagcaaaagaaactaccatc

SEQ ID NO: 112096 - DNA, 22 bp, Artificial Sequence
  Synthetic oligonucleotide; CTA chr11 5397249 5397270 5397266 5397271 +
ccatcagagtgaacaggcaacc

SEQ ID NO: 112097 - DNA, 22 bp, Artificial Sequence
  Synthetic oligonucleotide; CTA chr11 5397273 5397294 5397290 5397295 +
cacaatgggagaaaatttttgc

SEQ ID NO: 112098 - DNA, 22 bp, Artificial Sequence
  Synthetic oligonucleotide; TTT chr11 5397291 5397312 5397308 5397313 +
ttgcaatctactcatctgacaa

SEQ ID NO: 112099 - DNA, 22 bp, Artificial Sequence
  Synthetic oligonucleotide; TTT chr11 5397292 5397313 5397309 5397314 +
tgcaatctactcatctgacaaa

SEQ ID NO: 112100 - DNA, 22 bp, Artificial Sequence
  Synthetic oligonucleotide; TTT chr11 5397293 5397314 5397310 5397315 +
gcaatctactcatctgacaaag

SEQ ID NO: 112101 - DNA, 22 bp, Artificial Sequence
  Synthetic oligonucleotide; TTG chr11 5397294 5397315 5397311 5397316 +
caatctactcatctgacaaagg

SEQ ID NO: 112102 - DNA, 22 bp, Artificial Sequence
  Synthetic oligonucleotide; CTA chr11 5397301 5397322 5397318 5397323 +
ctcatctgacaaagggctaata

SEQ ID NO: 112103 - DNA, 22 bp, Artificial Sequence
  Synthetic oligonucleotide; CTC chr11 5397304 5397325 5397321 5397326 +
atctgacaaagggctaatatcc

SEQ ID NO: 112104 - DNA, 22 bp, Artificial Sequence
  Synthetic oligonucleotide; CTG chr11 5397309 5397330 5397326 5397331 +
acaaagggctaatatccagaat

SEQ ID NO: 112105 - DNA, 22 bp, Artificial Sequence
  Synthetic oligonucleotide; CTA chr11 5397320 5397341 5397337 5397342 +
atatccagaatctacaatgaac

SEQ ID NO: 112106 - DNA, 22 bp, Artificial Sequence
  Synthetic oligonucleotide; CTA chr11 5397334 5397355 5397351 5397356 +
caatgaactcaaacaaatttac

SEQ ID NO: 112107 - DNA, 22 bp, Artificial Sequence
  Synthetic oligonucleotide; CTC chr11 5397344 5397365 5397361 5397366 +
aaacaaatttacaagagaaaaa

SEQ ID NO: 112108 - DNA, 22 bp, Artificial Sequence
  Synthetic oligonucleotide; TTT chr11 5397354 5397375 5397371 5397376 +
acaagagaaaaaaaaccccatc

SEQ ID NO: 112109 - DNA, 22 bp, Artificial Sequence
  Synthetic oligonucleotide; TTA chr11 5397355 5397376 5397372 5397377 +
caagagaaaaaaaaccccatca

SEQ ID NO: 112110 - DNA, 22 bp, Artificial Sequence
  Synthetic oligonucleotide; CTT chr11 5397408 5397429 5397425 5397430 +
ctcaaaagaagacatttatgca

SEQ ID NO: 112111 - DNA, 22 bp, Artificial Sequence
  Synthetic oligonucleotide; TTC chr11 5397409 5397430 5397426 5397431 +
tcaaaagaagacatttatgcag

SEQ ID NO: 112112 - DNA, 22 bp, Artificial Sequence
  Synthetic oligonucleotide; CTC chr11 5397411 5397432 5397428 5397433 +
aaaagaagacatttatgcagcc

SEQ ID NO: 112113 - DNA, 22 bp, Artificial Sequence
  Synthetic oligonucleotide; TTT chr11 5397425 5397446 5397442 5397447 +
atgcagccaaaagacacatgaa

SEQ ID NO: 112114 - DNA, 22 bp, Artificial Sequence
  Synthetic oligonucleotide; TTA chr11 5397426 5397447 5397443 5397448 +
tgcagccaaaagacacatgaaa

SEQ ID NO: 112115 - DNA, 22 bp, Artificial Sequence
  Synthetic oligonucleotide; CTC chr11 5397456 5397477 5397473 5397478 +
atcatcactggccatcagagaa

SEQ ID NO: 112116 - DNA, 22 bp, Artificial Sequence
  Synthetic oligonucleotide; CTG chr11 5397466 5397487 5397483 5397488 +
gccatcagagaaatgcaaatca

SEQ ID NO: 112117 - DNA, 22 bp, Artificial Sequence
  Synthetic oligonucleotide; CTC chr11 5397511 5397532 5397528 5397533 +
acaccagttagaatggcaatca

SEQ ID NO: 112118 - DNA, 22 bp, Artificial Sequence
  Synthetic oligonucleotide; TTA chr11 5397521 5397542 5397538 5397543 +
gaatggcaatcattaaaaagtc

SEQ ID NO: 112119 - DNA, 22 bp, Artificial Sequence
  Synthetic oligonucleotide; TTA chr11 5397536 5397557 5397553 5397558 +
aaaagtcaggaaacaacaggtg

SEQ ID NO: 112120 - DNA, 22 bp, Artificial Sequence
  Synthetic oligonucleotide; CTG chr11 5397561 5397582 5397578 5397583 +
gagaggatgtggagaaatagga

SEQ ID NO: 112121 - DNA, 22 bp, Artificial Sequence
  Synthetic oligonucleotide; CTT chr11 5397589 5397610 5397606 5397611 +
ttacactgttggtgggactgta

SEQ ID NO: 112122 - DNA, 22 bp, Artificial Sequence
  Synthetic oligonucleotide; TTT chr11 5397590 5397611 5397607 5397612 +
tacactgttggtgggactgtaa

SEQ ID NO: 112123 - DNA, 22 bp, Artificial Sequence
  Synthetic oligonucleotide; TTT chr11 5397591 5397612 5397608 5397613 +
acactgttggtgggactgtaaa

SEQ ID NO: 112124 - DNA, 22 bp, Artificial Sequence
  Synthetic oligonucleotide; TTA chr11 5397592 5397613 5397609 5397614 +
cactgttggtgggactgtaaac

SEQ ID NO: 112125 - DNA, 22 bp, Artificial Sequence
  Synthetic oligonucleotide; CTG chr11 5397597 5397618 5397614 5397619 +
ttggtgggactgtaaactagtt

SEQ ID NO: 112126 - DNA, 22 bp, Artificial Sequence
  Synthetic oligonucleotide; TTG chr11 5397600 5397621 5397617 5397622 +
gtgggactgtaaactagttcaa

SEQ ID NO: 112127 - DNA, 22 bp, Artificial Sequence
  Synthetic oligonucleotide; CTG chr11 5397609 5397630 5397626 5397631 +
taaactagttcaaacattgtgg

SEQ ID NO: 112128 - DNA, 22 bp, Artificial Sequence
  Synthetic oligonucleotide; CTA chr11 5397616 5397637 5397633 5397638 +
gttcaaacattgtggaagtcag

SEQ ID NO: 112129 - DNA, 22 bp, Artificial Sequence
  Synthetic oligonucleotide; TTC chr11 5397620 5397641 5397637 5397642 +
aaacattgtggaagtcagtgtg

SEQ ID NO: 112130 - DNA, 22 bp, Artificial Sequence
  Synthetic oligonucleotide; TTG chr11 5397628 5397649 5397645 5397650 +
tggaagtcagtgtggtgattcc

SEQ ID NO: 112131 - DNA, 22 bp, Artificial Sequence
  Synthetic oligonucleotide; TTC chr11 5397649 5397670 5397666 5397671 +
ctcagggatctagaactagaaa

SEQ ID NO: 112132 - DNA, 22 bp, Artificial Sequence
  Synthetic oligonucleotide; CTC chr11 5397652 5397673 5397669 5397674 +
agggatctagaactagaaatac

SEQ ID NO: 112133 - DNA, 22 bp, Artificial Sequence
  Synthetic oligonucleotide; CTA chr11 5397661 5397682 5397678 5397683 +
gaactagaaataccatttgacc

SEQ ID NO: 112134 - DNA, 22 bp, Artificial Sequence
  Synthetic oligonucleotide; CTA chr11 5397667 5397688 5397684 5397689 +
gaaataccatttgacccagcca

SEQ ID NO: 112135 - DNA, 22 bp, Artificial Sequence
  Synthetic oligonucleotide; TTT chr11 5397679 5397700 5397696 5397701 +
gacccagccatcccattactgg

SEQ ID NO: 112136 - DNA, 22 bp, Artificial Sequence
  Synthetic oligonucleotide; TTG chr11 5397680 5397701 5397697 5397702 +
acccagccatcccattactggg

SEQ ID NO: 112137 - DNA, 22 bp, Artificial Sequence
  Synthetic oligonucleotide; TTA chr11 5397697 5397718 5397714 5397719 +
ctgggtatacacccaaaggatt

SEQ ID NO: 112138 - DNA, 22 bp, Artificial Sequence
  Synthetic oligonucleotide; CTG chr11 5397700 5397721 5397717 5397722 +
ggtatacacccaaaggattata

SEQ ID NO: 112139 - DNA, 22 bp, Artificial Sequence
  Synthetic oligonucleotide; TTA chr11 5397720 5397741 5397737 5397742 +
taaatcatgctgctataaagac

SEQ ID NO: 112140 - DNA, 22 bp, Artificial Sequence
  Synthetic oligonucleotide; CTG chr11 5397732 5397753 5397749 5397754 +
ctataaagacacatgcacacgt

SEQ ID NO: 112141 - DNA, 22 bp, Artificial Sequence
  Synthetic oligonucleotide; CTA chr11 5397735 5397756 5397752 5397757 +
taaagacacatgcacacgtatg

SEQ ID NO: 112142 - DNA, 22 bp, Artificial Sequence
  Synthetic oligonucleotide; TTT chr11 5397760 5397781 5397777 5397782 +
attgcggcactattcacaatag

SEQ ID NO: 112143 - DNA, 22 bp, Artificial Sequence
  Synthetic oligonucleotide; TTA chr11 5397761 5397782 5397778 5397783 +
ttgcggcactattcacaatagc

SEQ ID NO: 112144 - DNA, 22 bp, Artificial Sequence
  Synthetic oligonucleotide; TTG chr11 5397764 5397785 5397781 5397786 +
cggcactattcacaatagcaaa

SEQ ID NO: 112145 - DNA, 22 bp, Artificial Sequence
  Synthetic oligonucleotide; CTA chr11 5397772 5397793 5397789 5397794 +
ttcacaatagcaaagacttgga

SEQ ID NO: 112146 - DNA, 22 bp, Artificial Sequence
  Synthetic oligonucleotide; TTC chr11 5397775 5397796 5397792 5397797 +
acaatagcaaagacttggaacc

SEQ ID NO: 112147 - DNA, 22 bp, Artificial Sequence
  Synthetic oligonucleotide; CTT chr11 5397791 5397812 5397808 5397813 +
ggaaccaacccaaatgtccaac

SEQ ID NO: 112148 - DNA, 22 bp, Artificial Sequence
  Synthetic oligonucleotide; TTG chr11 5397792 5397813 5397809 5397814 +
gaaccaacccaaatgtccaaca

SEQ ID NO: 112149 - DNA, 22 bp, Artificial Sequence
  Synthetic oligonucleotide; CTG chr11 5397825 5397846 5397842 5397847 +
gattaagaaaatgtggcacata

SEQ ID NO: 112150 - DNA, 22 bp, Artificial Sequence
  Synthetic oligonucleotide; TTA chr11 5397830 5397851 5397847 5397852 +
agaaaatgtggcacatatacac

SEQ ID NO: 112151 - DNA, 22 bp, Artificial Sequence
  Synthetic oligonucleotide; CTA chr11 5397864 5397885 5397881 5397886 +
tgcagccataaaaaatgatgag

SEQ ID NO: 112152 - DNA, 22 bp, Artificial Sequence
  Synthetic oligonucleotide; TTC chr11 5397889 5397910 5397906 5397911 +
atgtcctttgtagggacatgga

SEQ ID NO: 112153 - DNA, 22 bp, Artificial Sequence
  Synthetic oligonucleotide; CTT chr11 5397897 5397918 5397914 5397919 +
tgtagggacatggatgaagctg

SEQ ID NO: 112154 - DNA, 22 bp, Artificial Sequence
  Synthetic oligonucleotide; TTT chr11 5397898 5397919 5397915 5397920 +
gtagggacatggatgaagctgg

SEQ ID NO: 112155 - DNA, 22 bp, Artificial Sequence
  Synthetic oligonucleotide; TTG chr11 5397899 5397920 5397916 5397921 +
tagggacatggatgaagctgga

SEQ ID NO: 112156 - DNA, 22 bp, Artificial Sequence
  Synthetic oligonucleotide; CTG chr11 5397919 5397940 5397936 5397941 +
gaaaccatcattctcagcaaac

SEQ ID NO: 112157 - DNA, 22 bp, Artificial Sequence
  Synthetic oligonucleotide; TTC chr11 5397932 5397953 5397949 5397954 +
tcagcaaactatcacaaggaca

SEQ ID NO: 112158 - DNA, 22 bp, Artificial Sequence
  Synthetic oligonucleotide; CTC chr11 5397934 5397955 5397951 5397956 +
agcaaactatcacaaggacaaa

SEQ ID NO: 112159 - DNA, 22 bp, Artificial Sequence
  Synthetic oligonucleotide; CTA chr11 5397943 5397964 5397960 5397965 +
tcacaaggacaaaaagccaaac

SEQ ID NO: 112160 - DNA, 22 bp, Artificial Sequence
  Synthetic oligonucleotide; TTC chr11 5397976 5397997 5397993 5397998 +
tcactcataggtgggaactgaa

SEQ ID NO: 112161 - DNA, 22 bp, Artificial Sequence
  Synthetic oligonucleotide; CTC chr11 5397978 5397999 5397995 5398000 +
actcataggtgggaactgaaca

SEQ ID NO: 112162 - DNA, 22 bp, Artificial Sequence
  Synthetic oligonucleotide; CTC chr11 5397982 5398003 5397999 5398004 +
ataggtgggaactgaacaatga

SEQ ID NO: 112163 - DNA, 22 bp, Artificial Sequence
  Synthetic oligonucleotide; CTG chr11 5397996 5398017 5398013 5398018 +
aacaatgagaacacatggacac

SEQ ID NO: 112164 - DNA, 22 bp, Artificial Sequence
  Synthetic oligonucleotide; CTG chr11 5398048 5398069 5398065 5398070 +
ttgtggggtgggaggagggggc

SEQ ID NO: 112165 - DNA, 22 bp, Artificial Sequence
  Synthetic oligonucleotide; TTG chr11 5398051 5398072 5398068 5398073 +
tggggtgggaggagggggcagg

SEQ ID NO: 112166 - DNA, 22 bp, Artificial Sequence
  Synthetic oligonucleotide; TTA chr11 5398083 5398104 5398100 5398105 +
ggagatatacctaatgttaaat

SEQ ID NO: 112167 - DNA, 22 bp, Artificial Sequence
  Synthetic oligonucleotide; CTA chr11 5398096 5398117 5398113 5398118 +
atgttaaatggtgagttaatgg

SEQ ID NO: 112168 - DNA, 22 bp, Artificial Sequence
  Synthetic oligonucleotide; TTA chr11 5398102 5398123 5398119 5398124 +
aatggtgagttaatgggtgcag

SEQ ID NO: 112169 - DNA, 22 bp, Artificial Sequence
  Synthetic oligonucleotide; TTA chr11 5398114 5398135 5398131 5398136 +
atgggtgcagcacaccaacatg

SEQ ID NO: 112170 - DNA, 22 bp, Artificial Sequence
  Synthetic oligonucleotide; CTA chr11 5398159 5398180 5398176 5398181 +
acctgcaccttgtgcacatgta

SEQ ID NO: 112171 - DNA, 22 bp, Artificial Sequence
  Synthetic oligonucleotide; CTG chr11 5398164 5398185 5398181 5398186 +
caccttgtgcacatgtacccta

SEQ ID NO: 112172 - DNA, 22 bp, Artificial Sequence
  Synthetic oligonucleotide; CTT chr11 5398170 5398191 5398187 5398192 +
gtgcacatgtaccctaaaactt

SEQ ID NO: 112173 - DNA, 22 bp, Artificial Sequence
  Synthetic oligonucleotide; TTG chr11 5398171 5398192 5398188 5398193 +
tgcacatgtaccctaaaactta

SEQ ID NO: 112174 - DNA, 22 bp, Artificial Sequence
  Synthetic oligonucleotide; CTA chr11 5398186 5398207 5398203 5398208 +
aaacttaaaagtataacaaaaa

SEQ ID NO: 112175 - DNA, 22 bp, Artificial Sequence
  Synthetic oligonucleotide; CTT chr11 5398192 5398213 5398209 5398214 +
aaaagtataacaaaaaataagt

SEQ ID NO: 112176 - DNA, 22 bp, Artificial Sequence
  Synthetic oligonucleotide; TTA chr11 5398193 5398214 5398210 5398215 +
aaagtataacaaaaaataagtt

SEQ ID NO: 112177 - DNA, 22 bp, Artificial Sequence
  Synthetic oligonucleotide; TTA chr11 5398216 5398237 5398233 5398238 +
gaaaaaagaaatttacatatat

SEQ ID NO: 112178 - DNA, 22 bp, Artificial Sequence
  Synthetic oligonucleotide; TTT chr11 5398230 5398251 5398247 5398252 +
acatatattagttatttaaata

SEQ ID NO: 112179 - DNA, 22 bp, Artificial Sequence
  Synthetic oligonucleotide; TTA chr11 5398231 5398252 5398248 5398253 +
catatattagttatttaaatat

SEQ ID NO: 112180 - DNA, 22 bp, Artificial Sequence
  Synthetic oligonucleotide; TTA chr11 5398240 5398261 5398257 5398262 +
gttatttaaatatgctggataa

SEQ ID NO: 112181 - DNA, 22 bp, Artificial Sequence
  Synthetic oligonucleotide; TTA chr11 5398244 5398265 5398261 5398266 +
tttaaatatgctggataaatac

SEQ ID NO: 112182 - DNA, 22 bp, Artificial Sequence
  Synthetic oligonucleotide; TTT chr11 5398247 5398268 5398264 5398269 +
aaatatgctggataaatactat

SEQ ID NO: 112183 - DNA, 22 bp, Artificial Sequence
  Synthetic oligonucleotide; TTA chr11 5398248 5398269 5398265 5398270 +
aatatgctggataaatactatt

SEQ ID NO: 112184 - DNA, 22 bp, Artificial Sequence
  Synthetic oligonucleotide; CTG chr11 5398257 5398278 5398274 5398279 +
gataaatactattacactcatt

SEQ ID NO: 112185 - DNA, 22 bp, Artificial Sequence
  Synthetic oligonucleotide; CTA chr11 5398268 5398289 5398285 5398290 +
ttacactcatttcacaaagata

SEQ ID NO: 112186 - DNA, 22 bp, Artificial Sequence
  Synthetic oligonucleotide; TTA chr11 5398271 5398292 5398288 5398293 +
cactcatttcacaaagatactg

SEQ ID NO: 112187 - DNA, 22 bp, Artificial Sequence
  Synthetic oligonucleotide; CTC chr11 5398276 5398297 5398293 5398298 +
atttcacaaagatactgactct

SEQ ID NO: 112188 - DNA, 22 bp, Artificial Sequence
  Synthetic oligonucleotide; TTT chr11 5398280 5398301 5398297 5398302 +
cacaaagatactgactctatat

SEQ ID NO: 112189 - DNA, 22 bp, Artificial Sequence
  Synthetic oligonucleotide; TTC chr11 5398281 5398302 5398298 5398303 +
acaaagatactgactctatatc

SEQ ID NO: 112190 - DNA, 22 bp, Artificial Sequence
  Synthetic oligonucleotide; CTG chr11 5398293 5398314 5398310 5398315 +
actctatatctttgcttgtttc

SEQ ID NO: 112191 - DNA, 22 bp, Artificial Sequence
  Synthetic oligonucleotide; CTC chr11 5398297 5398318 5398314 5398319 +
tatatctttgcttgtttccctt

SEQ ID NO: 112192 - DNA, 22 bp, Artificial Sequence
  Synthetic oligonucleotide; CTA chr11 5398299 5398320 5398316 5398321 +
tatctttgcttgtttcccttag

SEQ ID NO: 112193 - DNA, 22 bp, Artificial Sequence
  Synthetic oligonucleotide; CTT chr11 5398305 5398326 5398322 5398327 +
tgcttgtttcccttaggttctc

SEQ ID NO: 112194 - DNA, 22 bp, Artificial Sequence
  Synthetic oligonucleotide; TTT chr11 5398306 5398327 5398323 5398328 +
gcttgtttcccttaggttctct

SEQ ID NO: 112195 - DNA, 22 bp, Artificial Sequence
  Synthetic oligonucleotide; TTG chr11 5398307 5398328 5398324 5398329 +
cttgtttcccttaggttctctg

SEQ ID NO: 112196 - DNA, 22 bp, Artificial Sequence
  Synthetic oligonucleotide; CTT chr11 5398310 5398331 5398327 5398332 +
gtttcccttaggttctctggat

SEQ ID NO: 112197 - DNA, 22 bp, Artificial Sequence
  Synthetic oligonucleotide; TTG chr11 5398311 5398332 5398328 5398333 +
tttcccttaggttctctggata

SEQ ID NO: 112198 - DNA, 22 bp, Artificial Sequence
  Synthetic oligonucleotide; TTT chr11 5398314 5398335 5398331 5398336 +
cccttaggttctctggatattg

SEQ ID NO: 112199 - DNA, 22 bp, Artificial Sequence
  Synthetic oligonucleotide; TTC chr11 5398315 5398336 5398332 5398337 +
ccttaggttctctggatattga

SEQ ID NO: 112200 - DNA, 22 bp, Artificial Sequence
  Synthetic oligonucleotide; CTT chr11 5398319 5398340 5398336 5398341 +
aggttctctggatattgagaga

SEQ ID NO: 112201 - DNA, 22 bp, Artificial Sequence
  Synthetic oligonucleotide; TTA chr11 5398320 5398341 5398337 5398342 +
ggttctctggatattgagagag

SEQ ID NO: 112202 - DNA, 22 bp, Artificial Sequence
  Synthetic oligonucleotide; TTC chr11 5398325 5398346 5398342 5398347 +
tctggatattgagagaggctaa

SEQ ID NO: 112203 - DNA, 22 bp, Artificial Sequence
  Synthetic oligonucleotide; CTC chr11 5398327 5398348 5398344 5398349 +
tggatattgagagaggctaatg

SEQ ID NO: 112204 - DNA, 22 bp, Artificial Sequence
  Synthetic oligonucleotide; CTG chr11 5398329 5398350 5398346 5398351 +
gatattgagagaggctaatgta

SEQ ID NO: 112205 - DNA, 22 bp, Artificial Sequence
  Synthetic oligonucleotide; TTG chr11 5398336 5398357 5398353 5398358 +
agagaggctaatgtaattacct

SEQ ID NO: 112206 - DNA, 22 bp, Artificial Sequence
  Synthetic oligonucleotide; CTA chr11 5398346 5398367 5398363 5398368 +
atgtaattacctgggtaattgc

SEQ ID NO: 112207 - DNA, 22 bp, Artificial Sequence
  Synthetic oligonucleotide; TTA chr11 5398355 5398376 5398372 5398377 +
cctgggtaattgctcctcaggg

SEQ ID NO: 112208 - DNA, 22 bp, Artificial Sequence
  Synthetic oligonucleotide; CTG chr11 5398359 5398380 5398376 5398381 +
ggtaattgctcctcagggaacc

SEQ ID NO: 112209 - DNA, 22 bp, Artificial Sequence
  Synthetic oligonucleotide; TTG chr11 5398367 5398388 5398384 5398389 +
ctcctcagggaacctaactttc

SEQ ID NO: 112210 - DNA, 22 bp, Artificial Sequence
  Synthetic oligonucleotide; CTC chr11 5398370 5398391 5398387 5398392 +
ctcagggaacctaactttctcc

SEQ ID NO: 112211 - DNA, 22 bp, Artificial Sequence
  Synthetic oligonucleotide; CTC chr11 5398373 5398394 5398390 5398395 +
agggaacctaactttctcccca

SEQ ID NO: 112212 - DNA, 22 bp, Artificial Sequence
  Synthetic oligonucleotide; CTA chr11 5398383 5398404 5398400 5398405 +
actttctccccattactctact

SEQ ID NO: 112213 - DNA, 22 bp, Artificial Sequence
  Synthetic oligonucleotide; CTT chr11 5398387 5398408 5398404 5398409 +
tctccccattactctactccta

SEQ ID NO: 112214 - DNA, 22 bp, Artificial Sequence
  Synthetic oligonucleotide; TTT chr11 5398388 5398409 5398405 5398410 +
ctccccattactctactcctag

SEQ ID NO: 112215 - DNA, 22 bp, Artificial Sequence
  Synthetic oligonucleotide; TTC chr11 5398389 5398410 5398406 5398411 +
tccccattactctactcctaga

SEQ ID NO: 112216 - DNA, 22 bp, Artificial Sequence
  Synthetic oligonucleotide; CTC chr11 5398391 5398412 5398408 5398413 +
cccattactctactcctagaga

SEQ ID NO: 112217 - DNA, 22 bp, Artificial Sequence
  Synthetic oligonucleotide; TTA chr11 5398398 5398419 5398415 5398420 +
ctctactcctagagactctgat

SEQ ID NO: 112218 - DNA, 22 bp, Artificial Sequence
  Synthetic oligonucleotide; CTC chr11 5398401 5398422 5398418 5398423 +
tactcctagagactctgatcag

SEQ ID NO: 112219 - DNA, 22 bp, Artificial Sequence
  Synthetic oligonucleotide; CTA chr11 5398403 5398424 5398420 5398425 +
ctcctagagactctgatcagct

SEQ ID NO: 112220 - DNA, 22 bp, Artificial Sequence
  Synthetic oligonucleotide; CTC chr11 5398406 5398427 5398423 5398428 +
ctagagactctgatcagctttt

SEQ ID NO: 112221 - DNA, 22 bp, Artificial Sequence
  Synthetic oligonucleotide; CTA chr11 5398409 5398430 5398426 5398431 +
gagactctgatcagctttttca

SEQ ID NO: 112222 - DNA, 22 bp, Artificial Sequence
  Synthetic oligonucleotide; CTC chr11 5398416 5398437 5398433 5398438 +
tgatcagctttttcaaaaaatg

SEQ ID NO: 112223 - DNA, 22 bp, Artificial Sequence
  Synthetic oligonucleotide; CTG chr11 5398418 5398439 5398435 5398440 +
atcagctttttcaaaaaatggg

SEQ ID NO: 112224 - DNA, 22 bp, Artificial Sequence
  Synthetic oligonucleotide; CTT chr11 5398426 5398447 5398443 5398448 +
tttcaaaaaatgggcagcattc

SEQ ID NO: 112225 - DNA, 22 bp, Artificial Sequence
  Synthetic oligonucleotide; TTT chr11 5398427 5398448 5398444 5398449 +
ttcaaaaaatgggcagcattcc

SEQ ID NO: 112226 - DNA, 22 bp, Artificial Sequence
  Synthetic oligonucleotide; TTT chr11 5398428 5398449 5398445 5398450 +
tcaaaaaatgggcagcattcca

SEQ ID NO: 112227 - DNA, 22 bp, Artificial Sequence
  Synthetic oligonucleotide; TTT chr11 5398429 5398450 5398446 5398451 +
caaaaaatgggcagcattccag

SEQ ID NO: 112228 - DNA, 22 bp, Artificial Sequence
  Synthetic oligonucleotide; TTC chr11 5398430 5398451 5398447 5398452 +
aaaaaatgggcagcattccagc

SEQ ID NO: 112229 - DNA, 22 bp, Artificial Sequence
  Synthetic oligonucleotide; TTC chr11 5398448 5398469 5398465 5398470 +
cagccccaggactaagaagata

SEQ ID NO: 112230 - DNA, 22 bp, Artificial Sequence
  Synthetic oligonucleotide; CTA chr11 5398462 5398483 5398479 5398484 +
agaagatatgaatgccacagtg

SEQ ID NO: 112231 - DNA, 22 bp, Artificial Sequence
  Synthetic oligonucleotide; CTT chr11 5398494 5398515 5398511 5398516 +
gctgaagtgagcttccccatcc

SEQ ID NO: 112232 - DNA, 22 bp, Artificial Sequence
  Synthetic oligonucleotide; TTG chr11 5398495 5398516 5398512 5398517 +
ctgaagtgagcttccccatccc

SEQ ID NO: 112233 - DNA, 22 bp, Artificial Sequence
  Synthetic oligonucleotide; CTG chr11 5398498 5398519 5398515 5398520 +
aagtgagcttccccatcccacc

SEQ ID NO: 112234 - DNA, 22 bp, Artificial Sequence
  Synthetic oligonucleotide; CTT chr11 5398508 5398529 5398525 5398530 +
ccccatcccacctgaggctcag

SEQ ID NO: 112235 - DNA, 22 bp, Artificial Sequence
  Synthetic oligonucleotide; TTC chr11 5398509 5398530 5398526 5398531 +
cccatcccacctgaggctcaga

SEQ ID NO: 112236 - DNA, 22 bp, Artificial Sequence
  Synthetic oligonucleotide; CTG chr11 5398522 5398543 5398539 5398544 +
aggctcagaggccagtttcact

SEQ ID NO: 112237 - DNA, 22 bp, Artificial Sequence
  Synthetic oligonucleotide; CTC chr11 5398528 5398549 5398545 5398550 +
agaggccagtttcacttgtggt

SEQ ID NO: 112238 - DNA, 22 bp, Artificial Sequence
  Synthetic oligonucleotide; TTT chr11 5398540 5398561 5398557 5398562 +
cacttgtggtgagtgcacaagc

SEQ ID NO: 112239 - DNA, 22 bp, Artificial Sequence
  Synthetic oligonucleotide; TTC chr11 5398541 5398562 5398558 5398563 +
acttgtggtgagtgcacaagcc

SEQ ID NO: 112240 - DNA, 22 bp, Artificial Sequence
  Synthetic oligonucleotide; CTT chr11 5398545 5398566 5398562 5398567 +
gtggtgagtgcacaagcccatg

SEQ ID NO: 112241 - DNA, 22 bp, Artificial Sequence
  Synthetic oligonucleotide; TTG chr11 5398546 5398567 5398563 5398568 +
tggtgagtgcacaagcccatga

SEQ ID NO: 112242 - DNA, 22 bp, Artificial Sequence
  Synthetic oligonucleotide; CTG chr11 5398574 5398595 5398591 5398596 +
atatggcttggctctgtgtctc

SEQ ID NO: 112243 - DNA, 22 bp, Artificial Sequence
  Synthetic oligonucleotide; CTT chr11 5398583 5398604 5398600 5398605 +
ggctctgtgtctccacccaaat

SEQ ID NO: 112244 - DNA, 22 bp, Artificial Sequence
  Synthetic oligonucleotide; TTG chr11 5398584 5398605 5398601 5398606 +
gctctgtgtctccacccaaatt

SEQ ID NO: 112245 - DNA, 22 bp, Artificial Sequence
  Synthetic oligonucleotide; CTC chr11 5398588 5398609 5398605 5398610 +
tgtgtctccacccaaatttcat

SEQ ID NO: 112246 - DNA, 22 bp, Artificial Sequence
  Synthetic oligonucleotide; CTG chr11 5398590 5398611 5398607 5398612 +
tgtctccacccaaatttcatat

SEQ ID NO: 112247 - DNA, 22 bp, Artificial Sequence
  Synthetic oligonucleotide; CTC chr11 5398596 5398617 5398613 5398618 +
cacccaaatttcatattgaatt

SEQ ID NO: 112248 - DNA, 22 bp, Artificial Sequence
  Synthetic oligonucleotide; TTT chr11 5398607 5398628 5398624 5398629 +
catattgaattgtaatccccat

SEQ ID NO: 112249 - DNA, 22 bp, Artificial Sequence
  Synthetic oligonucleotide; TTC chr11 5398608 5398629 5398625 5398630 +
atattgaattgtaatccccata

SEQ ID NO: 112250 - DNA, 22 bp, Artificial Sequence
  Synthetic oligonucleotide; TTG chr11 5398614 5398635 5398631 5398636 +
aattgtaatccccataatccct

SEQ ID NO: 112251 - DNA, 22 bp, Artificial Sequence
  Synthetic oligonucleotide; TTG chr11 5398619 5398640 5398636 5398641 +
taatccccataatccctatatg

SEQ ID NO: 112252 - DNA, 22 bp, Artificial Sequence
  Synthetic oligonucleotide; CTA chr11 5398637 5398658 5398654 5398659 +
tatgtcgggggagggaccaggt

SEQ ID NO: 112253 - DNA, 22 bp, Artificial Sequence
  Synthetic oligonucleotide; TTA chr11 5398668 5398689 5398685 5398690 +
ttggatcatgggagcagtttcc

SEQ ID NO: 112254 - DNA, 22 bp, Artificial Sequence
  Synthetic oligonucleotide; TTG chr11 5398671 5398692 5398688 5398693 +
gatcatgggagcagtttccccc

SEQ ID NO: 112255 - DNA, 22 bp, Artificial Sequence
  Synthetic oligonucleotide; TTT chr11 5398688 5398709 5398705 5398710 +
cccccatgcagttctcgtgata

SEQ ID NO: 112256 - DNA, 22 bp, Artificial Sequence
  Synthetic oligonucleotide; TTC chr11 5398689 5398710 5398706 5398711 +
ccccatgcagttctcgtgatac

SEQ ID NO: 112257 - DNA, 22 bp, Artificial Sequence
  Synthetic oligonucleotide; TTC chr11 5398702 5398723 5398719 5398724 +
tcgtgatactgagtgagttttc

SEQ ID NO: 112258 - DNA, 22 bp, Artificial Sequence
  Synthetic oligonucleotide; CTC chr11 5398704 5398725 5398721 5398726 +
gtgatactgagtgagttttcat

SEQ ID NO: 112259 - DNA, 22 bp, Artificial Sequence
  Synthetic oligonucleotide; CTG chr11 5398713 5398734 5398730 5398735 +
agtgagttttcatgagatctga

SEQ ID NO: 112260 - DNA, 22 bp, Artificial Sequence
  Synthetic oligonucleotide; TTT chr11 5398722 5398743 5398739 5398744 +
tcatgagatctgatggttttat

SEQ ID NO: 112261 - DNA, 22 bp, Artificial Sequence
  Synthetic oligonucleotide; TTT chr11 5398723 5398744 5398740 5398745 +
catgagatctgatggttttata

SEQ ID NO: 112262 - DNA, 22 bp, Artificial Sequence
  Synthetic oligonucleotide; TTC chr11 5398724 5398745 5398741 5398746 +
atgagatctgatggttttataa

SEQ ID NO: 112263 - DNA, 22 bp, Artificial Sequence
  Synthetic oligonucleotide; CTG chr11 5398734 5398755 5398751 5398756 +
atggttttataaggcagttttc

SEQ ID NO: 112264 - DNA, 22 bp, Artificial Sequence
  Synthetic oligonucleotide; TTT chr11 5398741 5398762 5398758 5398763 +
tataaggcagttttccctcttc

SEQ ID NO: 112265 - DNA, 22 bp, Artificial Sequence
  Synthetic oligonucleotide; TTT chr11 5398742 5398763 5398759 5398764 +
ataaggcagttttccctcttct

SEQ ID NO: 112266 - DNA, 22 bp, Artificial Sequence
  Synthetic oligonucleotide; TTA chr11 5398743 5398764 5398760 5398765 +
taaggcagttttccctcttctt

SEQ ID NO: 112267 - DNA, 22 bp, Artificial Sequence
  Synthetic oligonucleotide; TTT chr11 5398754 5398775 5398771 5398776 +
tccctcttcttgctcactctct

SEQ ID NO: 112268 - DNA, 22 bp, Artificial Sequence
  Synthetic oligonucleotide; TTT chr11 5398755 5398776 5398772 5398777 +
ccctcttcttgctcactctctc

SEQ ID NO: 112269 - DNA, 22 bp, Artificial Sequence
  Synthetic oligonucleotide; TTC chr11 5398756 5398777 5398773 5398778 +
cctcttcttgctcactctctct

SEQ ID NO: 112270 - DNA, 22 bp, Artificial Sequence
  Synthetic oligonucleotide; CTC chr11 5398760 5398781 5398777 5398782 +
ttcttgctcactctctcttgcc

SEQ ID NO: 112271 - DNA, 22 bp, Artificial Sequence
  Synthetic oligonucleotide; CTT chr11 5398762 5398783 5398779 5398784 +
cttgctcactctctcttgcctg

SEQ ID NO: 112272 - DNA, 22 bp, Artificial Sequence
  Synthetic oligonucleotide; TTC chr11 5398763 5398784 5398780 5398785 +
ttgctcactctctcttgcctgc

SEQ ID NO: 112273 - DNA, 22 bp, Artificial Sequence
  Synthetic oligonucleotide; CTT chr11 5398765 5398786 5398782 5398787 +
gctcactctctcttgcctgcca

SEQ ID NO: 112274 - DNA, 22 bp, Artificial Sequence
  Synthetic oligonucleotide; TTG chr11 5398766 5398787 5398783 5398788 +
ctcactctctcttgcctgccac

SEQ ID NO: 112275 - DNA, 22 bp, Artificial Sequence
  Synthetic oligonucleotide; CTC chr11 5398769 5398790 5398786 5398791 +
actctctcttgcctgccaccaa

SEQ ID NO: 112276 - DNA, 22 bp, Artificial Sequence
  Synthetic oligonucleotide; CTC chr11 5398773 5398794 5398790 5398795 +
tctcttgcctgccaccaagtaa

SEQ ID NO: 112277 - DNA, 22 bp, Artificial Sequence
  Synthetic oligonucleotide; CTC chr11 5398775 5398796 5398792 5398797 +
tcttgcctgccaccaagtaaga

SEQ ID NO: 112278 - DNA, 22 bp, Artificial Sequence
  Synthetic oligonucleotide; CTC chr11 5398777 5398798 5398794 5398799 +
ttgcctgccaccaagtaagatg

SEQ ID NO: 112279 - DNA, 22 bp, Artificial Sequence
  Synthetic oligonucleotide; CTT chr11 5398779 5398800 5398796 5398801 +
gcctgccaccaagtaagatgtg

SEQ ID NO: 112280 - DNA, 22 bp, Artificial Sequence
  Synthetic oligonucleotide; TTG chr11 5398780 5398801 5398797 5398802 +
cctgccaccaagtaagatgtgc

SEQ ID NO: 112281 - DNA, 22 bp, Artificial Sequence
  Synthetic oligonucleotide; CTG chr11 5398784 5398805 5398801 5398806 +
ccaccaagtaagatgtgcctgc

SEQ ID NO: 112282 - DNA, 22 bp, Artificial Sequence
  Synthetic oligonucleotide; CTG chr11 5398805 5398826 5398822 5398827 +
cttctccttctgccataattgt

SEQ ID NO: 112283 - DNA, 22 bp, Artificial Sequence
  Synthetic oligonucleotide; CTT chr11 5398808 5398829 5398825 5398830 +
ctccttctgccataattgtaag

SEQ ID NO: 112284 - DNA, 22 bp, Artificial Sequence
  Synthetic oligonucleotide; TTC chr11 5398809 5398830 5398826 5398831 +
tccttctgccataattgtaagt

SEQ ID NO: 112285 - DNA, 22 bp, Artificial Sequence
  Synthetic oligonucleotide; CTC chr11 5398811 5398832 5398828 5398833 +
cttctgccataattgtaagttt

SEQ ID NO: 112286 - DNA, 22 bp, Artificial Sequence
  Synthetic oligonucleotide; CTT chr11 5398814 5398835 5398831 5398836 +
ctgccataattgtaagtttcct

SEQ ID NO: 112287 - DNA, 22 bp, Artificial Sequence
  Synthetic oligonucleotide; TTC chr11 5398815 5398836 5398832 5398837 +
tgccataattgtaagtttcctg

SEQ ID NO: 112288 - DNA, 22 bp, Artificial Sequence
  Synthetic oligonucleotide; CTG chr11 5398817 5398838 5398834 5398839 +
ccataattgtaagtttcctgag

SEQ ID NO: 112289 - DNA, 22 bp, Artificial Sequence
  Synthetic oligonucleotide; TTG chr11 5398826 5398847 5398843 5398848 +
taagtttcctgaggcctcccca

SEQ ID NO: 112290 - DNA, 22 bp, Artificial Sequence
  Synthetic oligonucleotide; TTT chr11 5398833 5398854 5398850 5398855 +
cctgaggcctccccagctatgt

SEQ ID NO: 112291 - DNA, 22 bp, Artificial Sequence
  Synthetic oligonucleotide; TTC chr11 5398834 5398855 5398851 5398856 +
ctgaggcctccccagctatgtg

SEQ ID NO: 112292 - DNA, 22 bp, Artificial Sequence
  Synthetic oligonucleotide; CTG chr11 5398837 5398858 5398854 5398859 +
aggcctccccagctatgtggaa

SEQ ID NO: 112293 - DNA, 22 bp, Artificial Sequence
  Synthetic oligonucleotide; CTC chr11 5398844 5398865 5398861 5398866 +
cccagctatgtggaaatgtgag

SEQ ID NO: 112294 - DNA, 22 bp, Artificial Sequence
  Synthetic oligonucleotide; CTA chr11 5398852 5398873 5398869 5398874 +
tgtggaaatgtgagtcaattaa

SEQ ID NO: 112295 - DNA, 22 bp, Artificial Sequence
  Synthetic oligonucleotide; TTA chr11 5398873 5398894 5398890 5398895 +
aacctcctttgttaataaatta

SEQ ID NO: 112296 - DNA, 22 bp, Artificial Sequence
  Synthetic oligonucleotide; CTC chr11 5398879 5398900 5398896 5398901 +
ctttgttaataaattacccagt

SEQ ID NO: 112297 - DNA, 22 bp, Artificial Sequence
  Synthetic oligonucleotide; CTT chr11 5398882 5398903 5398899 5398904 +
tgttaataaattacccagtctc

SEQ ID NO: 112298 - DNA, 22 bp, Artificial Sequence
  Synthetic oligonucleotide; TTT chr11 5398883 5398904 5398900 5398905 +
gttaataaattacccagtctca

SEQ ID NO: 112299 - DNA, 22 bp, Artificial Sequence
  Synthetic oligonucleotide; TTG chr11 5398884 5398905 5398901 5398906 +
ttaataaattacccagtctcag

SEQ ID NO: 112300 - DNA, 22 bp, Artificial Sequence
  Synthetic oligonucleotide; TTA chr11 5398887 5398908 5398904 5398909 +
ataaattacccagtctcaggta

SEQ ID NO: 112301 - DNA, 22 bp, Artificial Sequence
  Synthetic oligonucleotide; TTA chr11 5398895 5398916 5398912 5398917 +
cccagtctcaggtagtatcttt

SEQ ID NO: 112302 - DNA, 22 bp, Artificial Sequence
  Synthetic oligonucleotide; CTC chr11 5398904 5398925 5398921 5398926 +
aggtagtatctttagagcagtg

SEQ ID NO: 112303 - DNA, 22 bp, Artificial Sequence
  Synthetic oligonucleotide; CTT chr11 5398916 5398937 5398933 5398938 +
tagagcagtgtgagaatgaact

SEQ ID NO: 112304 - DNA, 22 bp, Artificial Sequence
  Synthetic oligonucleotide; TTT chr11 5398917 5398938 5398934 5398939 +
agagcagtgtgagaatgaacta

SEQ ID NO: 112305 - DNA, 22 bp, Artificial Sequence
  Synthetic oligonucleotide; TTA chr11 5398918 5398939 5398935 5398940 +
gagcagtgtgagaatgaactaa

SEQ ID NO: 112306 - DNA, 22 bp, Artificial Sequence
  Synthetic oligonucleotide; CTA chr11 5398939 5398960 5398956 5398961 +
atacaatccccaagccctgcct

SEQ ID NO: 112307 - DNA, 22 bp, Artificial Sequence
  Synthetic oligonucleotide; CTG chr11 5398958 5398979 5398975 5398980 +
ccttctgaagcagcattcagga

SEQ ID NO: 112308 - DNA, 22 bp, Artificial Sequence
  Synthetic oligonucleotide; CTT chr11 5398962 5398983 5398979 5398984 +
ctgaagcagcattcaggactcc

SEQ ID NO: 112309 - DNA, 22 bp, Artificial Sequence
  Synthetic oligonucleotide; TTC chr11 5398963 5398984 5398980 5398985 +
tgaagcagcattcaggactccc

SEQ ID NO: 112310 - DNA, 22 bp, Artificial Sequence
  Synthetic oligonucleotide; CTG chr11 5398965 5398986 5398982 5398987 +
aagcagcattcaggactcccaa

SEQ ID NO: 112311 - DNA, 22 bp, Artificial Sequence
  Synthetic oligonucleotide; TTC chr11 5398976 5398997 5398993 5398998 +
aggactcccaaccccatgtcac

SEQ ID NO: 112312 - DNA, 22 bp, Artificial Sequence
  Synthetic oligonucleotide; CTC chr11 5398983 5399004 5399000 5399005 +
ccaaccccatgtcacagtgtga

SEQ ID NO: 112313 - DNA, 22 bp, Artificial Sequence
  Synthetic oligonucleotide; CTT chr11 5399012 5399033 5399029 5399034 +
agcatttttcctaagacagtag

SEQ ID NO: 112314 - DNA, 22 bp, Artificial Sequence
  Synthetic oligonucleotide; TTA chr11 5399013 5399034 5399030 5399035 +
gcatttttcctaagacagtagt

SEQ ID NO: 112315 - DNA, 22 bp, Artificial Sequence
  Synthetic oligonucleotide; TTT chr11 5399019 5399040 5399036 5399041 +
ttcctaagacagtagtcacctc

SEQ ID NO: 112316 - DNA, 22 bp, Artificial Sequence
  Synthetic oligonucleotide; TTT chr11 5399020 5399041 5399037 5399042 +
tcctaagacagtagtcacctcc

SEQ ID NO: 112317 - DNA, 22 bp, Artificial Sequence
  Synthetic oligonucleotide; TTT chr11 5399021 5399042 5399038 5399043 +
cctaagacagtagtcacctccc

SEQ ID NO: 112318 - DNA, 22 bp, Artificial Sequence
  Synthetic oligonucleotide; TTC chr11 5399022 5399043 5399039 5399044 +
ctaagacagtagtcacctccct

SEQ ID NO: 112319 - DNA, 22 bp, Artificial Sequence
  Synthetic oligonucleotide; CTA chr11 5399025 5399046 5399042 5399047 +
agacagtagtcacctccctagc

SEQ ID NO: 112320 - DNA, 22 bp, Artificial Sequence
  Synthetic oligonucleotide; CTC chr11 5399041 5399062 5399058 5399063 +
cctagcttcttgaacctgtctg

SEQ ID NO: 112321 - DNA, 22 bp, Artificial Sequence
  Synthetic oligonucleotide; CTA chr11 5399045 5399066 5399062 5399067 +
gcttcttgaacctgtctggcag

SEQ ID NO: 112322 - DNA, 22 bp, Artificial Sequence
  Synthetic oligonucleotide; CTT chr11 5399049 5399070 5399066 5399071 +
cttgaacctgtctggcagaagg

SEQ ID NO: 112323 - DNA, 22 bp, Artificial Sequence
  Synthetic oligonucleotide; TTC chr11 5399050 5399071 5399067 5399072 +
ttgaacctgtctggcagaagga

SEQ ID NO: 112324 - DNA, 22 bp, Artificial Sequence
  Synthetic oligonucleotide; CTT chr11 5399052 5399073 5399069 5399074 +
gaacctgtctggcagaaggaga

SEQ ID NO: 112325 - DNA, 22 bp, Artificial Sequence
  Synthetic oligonucleotide; TTG chr11 5399053 5399074 5399070 5399075 +
aacctgtctggcagaaggagag

SEQ ID NO: 112326 - DNA, 22 bp, Artificial Sequence
  Synthetic oligonucleotide; CTG chr11 5399059 5399080 5399076 5399081 +
tctggcagaaggagaggaatca

SEQ ID NO: 112327 - DNA, 22 bp, Artificial Sequence
  Synthetic oligonucleotide; CTG chr11 5399063 5399084 5399080 5399085 +
gcagaaggagaggaatcacatc

SEQ ID NO: 112328 - DNA, 22 bp, Artificial Sequence
  Synthetic oligonucleotide; CTA chr11 5399088 5399109 5399105 5399110 +
aattggtggcagatggaaaaca

SEQ ID NO: 112329 - DNA, 22 bp, Artificial Sequence
  Synthetic oligonucleotide; TTG chr11 5399093 5399114 5399110 5399115 +
gtggcagatggaaaacaaaaca

SEQ ID NO: 112330 - DNA, 22 bp, Artificial Sequence
  Synthetic oligonucleotide; TTC chr11 5399141 5399162 5399158 5399163 +
ttgaaatagttttgccatcata

SEQ ID NO: 112331 - DNA, 22 bp, Artificial Sequence
  Synthetic oligonucleotide; CTT chr11 5399143 5399164 5399160 5399165 +
gaaatagttttgccatcatatt

SEQ ID NO: 112332 - DNA, 22 bp, Artificial Sequence
  Synthetic oligonucleotide; TTG chr11 5399144 5399165 5399161 5399166 +
aaatagttttgccatcatatta

SEQ ID NO: 112333 - DNA, 22 bp, Artificial Sequence
  Synthetic oligonucleotide; TTT chr11 5399153 5399174 5399170 5399175 +
tgccatcatattatcttgggtt

SEQ ID NO: 112334 - DNA, 22 bp, Artificial Sequence
  Synthetic oligonucleotide; TTT chr11 5399154 5399175 5399171 5399176 +
gccatcatattatcttgggtta

SEQ ID NO: 112335 - DNA, 22 bp, Artificial Sequence
  Synthetic oligonucleotide; TTG chr11 5399155 5399176 5399172 5399177 +
ccatcatattatcttgggttac

SEQ ID NO: 112336 - DNA, 22 bp, Artificial Sequence
  Synthetic oligonucleotide; TTA chr11 5399166 5399187 5399183 5399188 +
tcttgggttactcacaaaatgc

SEQ ID NO: 112337 - DNA, 22 bp, Artificial Sequence
  Synthetic oligonucleotide; CTT chr11 5399170 5399191 5399187 5399192 +
gggttactcacaaaatgcttat

SEQ ID NO: 112338 - DNA, 22 bp, Artificial Sequence
  Synthetic oligonucleotide; TTG chr11 5399171 5399192 5399188 5399193 +
ggttactcacaaaatgcttatg

SEQ ID NO: 112339 - DNA, 22 bp, Artificial Sequence
  Synthetic oligonucleotide; TTA chr11 5399176 5399197 5399193 5399198 +
ctcacaaaatgcttatgtctgg

SEQ ID NO: 112340 - DNA, 22 bp, Artificial Sequence
  Synthetic oligonucleotide; CTC chr11 5399179 5399200 5399196 5399201 +
acaaaatgcttatgtctggttt

SEQ ID NO: 112341 - DNA, 22 bp, Artificial Sequence
  Synthetic oligonucleotide; CTT chr11 5399190 5399211 5399207 5399212 +
atgtctggtttatatgctcatc

SEQ ID NO: 112342 - DNA, 22 bp, Artificial Sequence
  Synthetic oligonucleotide; TTA chr11 5399191 5399212 5399208 5399213 +
tgtctggtttatatgctcatct

SEQ ID NO: 112343 - DNA, 22 bp, Artificial Sequence
  Synthetic oligonucleotide; CTG chr11 5399197 5399218 5399214 5399219 +
gtttatatgctcatctattaag

SEQ ID NO: 112344 - DNA, 22 bp, Artificial Sequence
  Synthetic oligonucleotide; TTT chr11 5399201 5399222 5399218 5399223 +
atatgctcatctattaagtggg

SEQ ID NO: 112345 - DNA, 22 bp, Artificial Sequence
  Synthetic oligonucleotide; TTA chr11 5399202 5399223 5399219 5399224 +
tatgctcatctattaagtggga

SEQ ID NO: 112346 - DNA, 22 bp, Artificial Sequence
  Synthetic oligonucleotide; CTC chr11 5399209 5399230 5399226 5399231 +
atctattaagtgggaaattctt

SEQ ID NO: 112347 - DNA, 22 bp, Artificial Sequence
  Synthetic oligonucleotide; CTA chr11 5399214 5399235 5399231 5399236 +
ttaagtgggaaattcttgtctc

SEQ ID NO: 112348 - DNA, 22 bp, Artificial Sequence
  Synthetic oligonucleotide; TTA chr11 5399217 5399238 5399234 5399239 +
agtgggaaattcttgtctcctt

SEQ ID NO: 112349 - DNA, 22 bp, Artificial Sequence
  Synthetic oligonucleotide; TTC chr11 5399229 5399250 5399246 5399251 +
ttgtctccttgtttacctcaca

SEQ ID NO: 112350 - DNA, 22 bp, Artificial Sequence
  Synthetic oligonucleotide; CTT chr11 5399231 5399252 5399248 5399253 +
gtctccttgtttacctcacaga

SEQ ID NO: 112351 - DNA, 22 bp, Artificial Sequence
  Synthetic oligonucleotide; TTG chr11 5399232 5399253 5399249 5399254 +
tctccttgtttacctcacagat

SEQ ID NO: 112352 - DNA, 22 bp, Artificial Sequence
  Synthetic oligonucleotide; CTC chr11 5399236 5399257 5399253 5399258 +
cttgtttacctcacagatgtgg

SEQ ID NO: 112353 - DNA, 22 bp, Artificial Sequence
  Synthetic oligonucleotide; CTT chr11 5399239 5399260 5399256 5399261 +
gtttacctcacagatgtggtct

SEQ ID NO: 112354 - DNA, 22 bp, Artificial Sequence
  Synthetic oligonucleotide; TTG chr11 5399240 5399261 5399257 5399262 +
tttacctcacagatgtggtctg

SEQ ID NO: 112355 - DNA, 22 bp, Artificial Sequence
  Synthetic oligonucleotide; TTT chr11 5399243 5399264 5399260 5399265 +
acctcacagatgtggtctgagt

SEQ ID NO: 112356 - DNA, 22 bp, Artificial Sequence
  Synthetic oligonucleotide; TTA chr11 5399244 5399265 5399261 5399266 +
cctcacagatgtggtctgagta

SEQ ID NO: 112357 - DNA, 22 bp, Artificial Sequence
  Synthetic oligonucleotide; CTC chr11 5399248 5399269 5399265 5399270 +
acagatgtggtctgagtatcag

SEQ ID NO: 112358 - DNA, 22 bp, Artificial Sequence
  Synthetic oligonucleotide; CTG chr11 5399262 5399283 5399279 5399284 +
agtatcagtgagccaataacaa

SEQ ID NO: 112359 - DNA, 22 bp, Artificial Sequence
  Synthetic oligonucleotide; TTA chr11 5399297 5399318 5399314 5399319 +
ttaataaaaagttggaaataag

SEQ ID NO: 112360 - DNA, 22 bp, Artificial Sequence
  Synthetic oligonucleotide; TTA chr11 5399300 5399321 5399317 5399322 +
ataaaaagttggaaataagctg

SEQ ID NO: 112361 - DNA, 22 bp, Artificial Sequence
  Synthetic oligonucleotide; TTG chr11 5399311 5399332 5399328 5399333 +
gaaataagctgactgtgattga

SEQ ID NO: 112362 - DNA, 22 bp, Artificial Sequence
  Synthetic oligonucleotide; CTG chr11 5399322 5399343 5399339 5399344 +
actgtgattgactcctgagaat

SEQ ID NO: 112363 - DNA, 22 bp, Artificial Sequence
  Synthetic oligonucleotide; CTG chr11 5399326 5399347 5399343 5399348 +
tgattgactcctgagaattcct

SEQ ID NO: 112364 - DNA, 22 bp, Artificial Sequence
  Synthetic oligonucleotide; TTG chr11 5399332 5399353 5399349 5399354 +
actcctgagaattcctgaaaga

SEQ ID NO: 112365 - DNA, 22 bp, Artificial Sequence
  Synthetic oligonucleotide; CTC chr11 5399336 5399357 5399353 5399358 +
ctgagaattcctgaaagagata

SEQ ID NO: 112366 - DNA, 22 bp, Artificial Sequence
  Synthetic oligonucleotide; CTG chr11 5399339 5399360 5399356 5399361 +
agaattcctgaaagagatatag

SEQ ID NO: 112367 - DNA, 22 bp, Artificial Sequence
  Synthetic oligonucleotide; TTC chr11 5399346 5399367 5399363 5399368 +
ctgaaagagatatagagtggag

SEQ ID NO: 112368 - DNA, 22 bp, Artificial Sequence
  Synthetic oligonucleotide; CTG chr11 5399349 5399370 5399366 5399371 +
aaagagatatagagtggagaga

SEQ ID NO: 112369 - DNA, 22 bp, Artificial Sequence
  Synthetic oligonucleotide; TTA chr11 5399377 5399398 5399394 5399399 +
acattcactggttgctaaaggc

SEQ ID NO: 112370 - DNA, 22 bp, Artificial Sequence
  Synthetic oligonucleotide; TTC chr11 5399383 5399404 5399400 5399405 +
actggttgctaaaggctcacat

SEQ ID NO: 112371 - DNA, 22 bp, Artificial Sequence
  Synthetic oligonucleotide; CTG chr11 5399387 5399408 5399404 5399409 +
gttgctaaaggctcacattaaa

SEQ ID NO: 112372 - DNA, 22 bp, Artificial Sequence
  Synthetic oligonucleotide; TTG chr11 5399391 5399412 5399408 5399413 +
ctaaaggctcacattaaatatt

SEQ ID NO: 112373 - DNA, 22 bp, Artificial Sequence
  Synthetic oligonucleotide; CTA chr11 5399394 5399415 5399411 5399416 +
aaggctcacattaaatatttag

SEQ ID NO: 112374 - DNA, 22 bp, Artificial Sequence
  Synthetic oligonucleotide; CTC chr11 5399401 5399422 5399418 5399423 +
acattaaatatttagagccagt

SEQ ID NO: 112375 - DNA, 22 bp, Artificial Sequence
  Synthetic oligonucleotide; TTA chr11 5399407 5399428 5399424 5399429 +
aatatttagagccagtccctga

SEQ ID NO: 112376 - DNA, 22 bp, Artificial Sequence
  Synthetic oligonucleotide; TTT chr11 5399414 5399435 5399431 5399436 +
agagccagtccctgaggtaagt

SEQ ID NO: 112377 - DNA, 22 bp, Artificial Sequence
  Synthetic oligonucleotide; TTA chr11 5399415 5399436 5399432 5399437 +
gagccagtccctgaggtaagta

SEQ ID NO: 112378 - DNA, 22 bp, Artificial Sequence
  Synthetic oligonucleotide; CTG chr11 5399428 5399449 5399445 5399450 +
aggtaagtattaacatctttat

SEQ ID NO: 112379 - DNA, 22 bp, Artificial Sequence
  Synthetic oligonucleotide; TTA chr11 5399440 5399461 5399457 5399462 +
acatctttatctttaaaaacaa

SEQ ID NO: 112380 - DNA, 22 bp, Artificial Sequence
  Synthetic oligonucleotide; CTT chr11 5399447 5399468 5399464 5399469 +
tatctttaaaaacaaagatact

SEQ ID NO: 112381 - DNA, 22 bp, Artificial Sequence
  Synthetic oligonucleotide; TTT chr11 5399448 5399469 5399465 5399470 +
atctttaaaaacaaagatacta

SEQ ID NO: 112382 - DNA, 22 bp, Artificial Sequence
  Synthetic oligonucleotide; TTA chr11 5399449 5399470 5399466 5399471 +
tctttaaaaacaaagatactaa

SEQ ID NO: 112383 - DNA, 22 bp, Artificial Sequence
  Synthetic oligonucleotide; CTT chr11 5399453 5399474 5399470 5399475 +
taaaaacaaagatactaatgtg

SEQ ID NO: 112384 - DNA, 22 bp, Artificial Sequence
  Synthetic oligonucleotide; TTT chr11 5399454 5399475 5399471 5399476 +
aaaaacaaagatactaatgtgc

SEQ ID NO: 112385 - DNA, 22 bp, Artificial Sequence
  Synthetic oligonucleotide; TTA chr11 5399455 5399476 5399472 5399477 +
aaaacaaagatactaatgtgca

SEQ ID NO: 112386 - DNA, 22 bp, Artificial Sequence
  Synthetic oligonucleotide; CTA chr11 5399470 5399491 5399487 5399492 +
atgtgcacaaaggtaaagtacg

SEQ ID NO: 112387 - DNA, 22 bp, Artificial Sequence
  Synthetic oligonucleotide; TTA chr11 5399500 5399521 5399517 5399522 +
taccgaacataagattcacctc

SEQ ID NO: 112388 - DNA, 22 bp, Artificial Sequence
  Synthetic oligonucleotide; TTC chr11 5399517 5399538 5399534 5399539 +
acctccaattctgtccagctcc

SEQ ID NO: 112389 - DNA, 22 bp, Artificial Sequence
  Synthetic oligonucleotide; CTC chr11 5399522 5399543 5399539 5399544 +
caattctgtccagctccagggg

SEQ ID NO: 112390 - DNA, 22 bp, Artificial Sequence
  Synthetic oligonucleotide; TTC chr11 5399528 5399549 5399545 5399550 +
tgtccagctccaggggtacagt

SEQ ID NO: 112391 - DNA, 22 bp, Artificial Sequence
  Synthetic oligonucleotide; CTG chr11 5399530 5399551 5399547 5399552 +
tccagctccaggggtacagtca

SEQ ID NO: 112392 - DNA, 22 bp, Artificial Sequence
  Synthetic oligonucleotide; CTC chr11 5399538 5399559 5399555 5399560 +
caggggtacagtcatcactgtc

SEQ ID NO: 112393 - DNA, 22 bp, Artificial Sequence
  Synthetic oligonucleotide; CTG chr11 5399558 5399579 5399575 5399580 +
tcccacattctactttttttct

SEQ ID NO: 112394 - DNA, 22 bp, Artificial Sequence
  Synthetic oligonucleotide; TTC chr11 5399568 5399589 5399585 5399590 +
tactttttttctgatttgttgt

SEQ ID NO: 112395 - DNA, 22 bp, Artificial Sequence
  Synthetic oligonucleotide; CTA chr11 5399570 5399591 5399587 5399592 +
ctttttttctgatttgttgtgt

SEQ ID NO: 112396 - DNA, 22 bp, Artificial Sequence
  Synthetic oligonucleotide; CTT chr11 5399573 5399594 5399590 5399595 +
tttttctgatttgttgtgtcct

SEQ ID NO: 112397 - DNA, 22 bp, Artificial Sequence
  Synthetic oligonucleotide; TTT chr11 5399574 5399595 5399591 5399596 +
ttttctgatttgttgtgtccta

SEQ ID NO: 112398 - DNA, 22 bp, Artificial Sequence
  Synthetic oligonucleotide; TTT chr11 5399575 5399596 5399592 5399597 +
tttctgatttgttgtgtcctat

SEQ ID NO: 112399 - DNA, 22 bp, Artificial Sequence
  Synthetic oligonucleotide; TTT chr11 5399576 5399597 5399593 5399598 +
ttctgatttgttgtgtcctatt

SEQ ID NO: 112400 - DNA, 22 bp, Artificial Sequence
  Synthetic oligonucleotide; TTT chr11 5399577 5399598 5399594 5399599 +
tctgatttgttgtgtcctatta

SEQ ID NO: 112401 - DNA, 22 bp, Artificial Sequence
  Synthetic oligonucleotide; TTT chr11 5399578 5399599 5399595 5399600 +
ctgatttgttgtgtcctattat

SEQ ID NO: 112402 - DNA, 22 bp, Artificial Sequence
  Synthetic oligonucleotide; TTC chr11 5399579 5399600 5399596 5399601 +
tgatttgttgtgtcctattata

SEQ ID NO: 112403 - DNA, 22 bp, Artificial Sequence
  Synthetic oligonucleotide; CTG chr11 5399581 5399602 5399598 5399603 +
atttgttgtgtcctattatact

SEQ ID NO: 112404 - DNA, 22 bp, Artificial Sequence
  Synthetic oligonucleotide; TTT chr11 5399585 5399606 5399602 5399607 +
gttgtgtcctattatactgggc

SEQ ID NO: 112405 - DNA, 22 bp, Artificial Sequence
  Synthetic oligonucleotide; TTG chr11 5399586 5399607 5399603 5399608 +
ttgtgtcctattatactgggct

SEQ ID NO: 112406 - DNA, 22 bp, Artificial Sequence
  Synthetic oligonucleotide; TTG chr11 5399589 5399610 5399606 5399611 +
tgtcctattatactgggctata

SEQ ID NO: 112407 - DNA, 22 bp, Artificial Sequence
  Synthetic oligonucleotide; CTA chr11 5399596 5399617 5399613 5399618 +
ttatactgggctatagactaca

SEQ ID NO: 112408 - DNA, 22 bp, Artificial Sequence
  Synthetic oligonucleotide; TTA chr11 5399599 5399620 5399616 5399621 +
tactgggctatagactacatga

SEQ ID NO: 112409 - DNA, 22 bp, Artificial Sequence
  Synthetic oligonucleotide; CTG chr11 5399604 5399625 5399621 5399626 +
ggctatagactacatgatccct

SEQ ID NO: 112410 - DNA, 22 bp, Artificial Sequence
  Synthetic oligonucleotide; CTA chr11 5399609 5399630 5399626 5399631 +
tagactacatgatcccttttgt

SEQ ID NO: 112411 - DNA, 22 bp, Artificial Sequence
  Synthetic oligonucleotide; CTA chr11 5399616 5399637 5399633 5399638 +
catgatcccttttgtaaccttt

SEQ ID NO: 112412 - DNA, 22 bp, Artificial Sequence
  Synthetic oligonucleotide; CTT chr11 5399627 5399648 5399644 5399649 +
ttgtaacctttcaagctaaaat

SEQ ID NO: 112413 - DNA, 22 bp, Artificial Sequence
  Synthetic oligonucleotide; TTT chr11 5399628 5399649 5399645 5399650 +
tgtaacctttcaagctaaaatg

SEQ ID NO: 112414 - DNA, 22 bp, Artificial Sequence
  Synthetic oligonucleotide; TTT chr11 5399629 5399650 5399646 5399651 +
gtaacctttcaagctaaaatgc

SEQ ID NO: 112415 - DNA, 22 bp, Artificial Sequence
  Synthetic oligonucleotide; TTG chr11 5399630 5399651 5399647 5399652 +
taacctttcaagctaaaatgct

SEQ ID NO: 112416 - DNA, 22 bp, Artificial Sequence
  Synthetic oligonucleotide; CTT chr11 5399637 5399658 5399654 5399659 +
tcaagctaaaatgctcttgtca

SEQ ID NO: 112417 - DNA, 22 bp, Artificial Sequence
  Synthetic oligonucleotide; TTT chr11 5399638 5399659 5399655 5399660 +
caagctaaaatgctcttgtcaa

SEQ ID NO: 112418 - DNA, 22 bp, Artificial Sequence
  Synthetic oligonucleotide; TTC chr11 5399639 5399660 5399656 5399661 +
aagctaaaatgctcttgtcaaa

SEQ ID NO: 112419 - DNA, 22 bp, Artificial Sequence
  Synthetic oligonucleotide; CTA chr11 5399645 5399666 5399662 5399667 +
aaatgctcttgtcaaacaaatc

SEQ ID NO: 112420 - DNA, 22 bp, Artificial Sequence
  Synthetic oligonucleotide; CTC chr11 5399653 5399674 5399670 5399675 +
ttgtcaaacaaatcctaaactc

SEQ ID NO: 112421 - DNA, 22 bp, Artificial Sequence
  Synthetic oligonucleotide; CTT chr11 5399655 5399676 5399672 5399677 +
gtcaaacaaatcctaaactcag

SEQ ID NO: 112422 - DNA, 22 bp, Artificial Sequence
  Synthetic oligonucleotide; TTG chr11 5399656 5399677 5399673 5399678 +
tcaaacaaatcctaaactcagg

SEQ ID NO: 112423 - DNA, 22 bp, Artificial Sequence
  Synthetic oligonucleotide; CTA chr11 5399670 5399691 5399687 5399692 +
aactcaggagaatgattgtgtt

SEQ ID NO: 112424 - DNA, 22 bp, Artificial Sequence
  Synthetic oligonucleotide; CTC chr11 5399675 5399696 5399692 5399697 +
aggagaatgattgtgttttaag

SEQ ID NO: 112425 - DNA, 22 bp, Artificial Sequence
  Synthetic oligonucleotide; TTG chr11 5399688 5399709 5399705 5399710 +
tgttttaagatctctttcaagg

SEQ ID NO: 112426 - DNA, 22 bp, Artificial Sequence
  Synthetic oligonucleotide; TTT chr11 5399693 5399714 5399710 5399715 +
taagatctctttcaaggagatc

SEQ ID NO: 112427 - DNA, 22 bp, Artificial Sequence
  Synthetic oligonucleotide; TTT chr11 5399694 5399715 5399711 5399716 +
aagatctctttcaaggagatct

SEQ ID NO: 112428 - DNA, 22 bp, Artificial Sequence
  Synthetic oligonucleotide; TTA chr11 5399695 5399716 5399712 5399717 +
agatctctttcaaggagatctg

SEQ ID NO: 112429 - DNA, 22 bp, Artificial Sequence
  Synthetic oligonucleotide; CTC chr11 5399702 5399723 5399719 5399724 +
tttcaaggagatctgaccctta

SEQ ID NO: 112430 - DNA, 22 bp, Artificial Sequence
  Synthetic oligonucleotide; CTT chr11 5399704 5399725 5399721 5399726 +
tcaaggagatctgacccttatc

SEQ ID NO: 112431 - DNA, 22 bp, Artificial Sequence
  Synthetic oligonucleotide; TTT chr11 5399705 5399726 5399722 5399727 +
caaggagatctgacccttatct

SEQ ID NO: 112432 - DNA, 22 bp, Artificial Sequence
  Synthetic oligonucleotide; TTC chr11 5399706 5399727 5399723 5399728 +
aaggagatctgacccttatctg

SEQ ID NO: 112433 - DNA, 22 bp, Artificial Sequence
  Synthetic oligonucleotide; CTG chr11 5399717 5399738 5399734 5399739 +
acccttatctggcggtagagac

SEQ ID NO: 112434 - DNA, 22 bp, Artificial Sequence
  Synthetic oligonucleotide; CTT chr11 5399723 5399744 5399740 5399745 +
atctggcggtagagactctgga

SEQ ID NO: 112435 - DNA, 22 bp, Artificial Sequence
  Synthetic oligonucleotide; TTA chr11 5399724 5399745 5399741 5399746 +
tctggcggtagagactctggag

SEQ ID NO: 112436 - DNA, 22 bp, Artificial Sequence
  Synthetic oligonucleotide; CTG chr11 5399728 5399749 5399745 5399750 +
gcggtagagactctggagatgg

SEQ ID NO: 112437 - DNA, 22 bp, Artificial Sequence
  Synthetic oligonucleotide; CTC chr11 5399741 5399762 5399758 5399763 +
tggagatggaaactgagaagga

SEQ ID NO: 112438 - DNA, 22 bp, Artificial Sequence
  Synthetic oligonucleotide; CTG chr11 5399743 5399764 5399760 5399765 +
gagatggaaactgagaaggatg

SEQ ID NO: 112439 - DNA, 22 bp, Artificial Sequence
  Synthetic oligonucleotide; CTG chr11 5399756 5399777 5399773 5399778 +
agaaggatgcaaaaaaaaaaaa

SEQ ID NO: 112440 - DNA, 22 bp, Artificial Sequence
  Synthetic oligonucleotide; CTC chr11 5399853 5399874 5399870 5399875 +
tagtttcaagtatcagtcaaga

SEQ ID NO: 112441 - DNA, 22 bp, Artificial Sequence
  Synthetic oligonucleotide; CTA chr11 5399855 5399876 5399872 5399877 +
gtttcaagtatcagtcaagatt

SEQ ID NO: 112442 - DNA, 22 bp, Artificial Sequence
  Synthetic oligonucleotide; TTT chr11 5399859 5399880 5399876 5399881 +
caagtatcagtcaagatttgtt

SEQ ID NO: 112443 - DNA, 22 bp, Artificial Sequence
  Synthetic oligonucleotide; TTC chr11 5399860 5399881 5399877 5399882 +
aagtatcagtcaagatttgttt

SEQ ID NO: 112444 - DNA, 22 bp, Artificial Sequence
  Synthetic oligonucleotide; TTT chr11 5399878 5399899 5399895 5399900 +
gtttcttccaatatccggttat

SEQ ID NO: 112445 - DNA, 22 bp, Artificial Sequence
  Synthetic oligonucleotide; TTG chr11 5399879 5399900 5399896 5399901 +
tttcttccaatatccggttatt

SEQ ID NO: 112446 - DNA, 22 bp, Artificial Sequence
  Synthetic oligonucleotide; TTT chr11 5399882 5399903 5399899 5399904 +
cttccaatatccggttatttga

SEQ ID NO: 112447 - DNA, 22 bp, Artificial Sequence
  Synthetic oligonucleotide; TTC chr11 5399883 5399904 5399900 5399905 +
ttccaatatccggttatttgag

SEQ ID NO: 112448 - DNA, 22 bp, Artificial Sequence
  Synthetic oligonucleotide; CTT chr11 5399885 5399906 5399902 5399907 +
ccaatatccggttatttgaggt

SEQ ID NO: 112449 - DNA, 22 bp, Artificial Sequence
  Synthetic oligonucleotide; TTC chr11 5399886 5399907 5399903 5399908 +
caatatccggttatttgaggtg

SEQ ID NO: 112450 - DNA, 22 bp, Artificial Sequence
  Synthetic oligonucleotide; TTA chr11 5399899 5399920 5399916 5399921 +
tttgaggtgtggcaggcaagat

SEQ ID NO: 112451 - DNA, 22 bp, Artificial Sequence
  Synthetic oligonucleotide; TTT chr11 5399902 5399923 5399919 5399924 +
gaggtgtggcaggcaagataca

SEQ ID NO: 112452 - DNA, 22 bp, Artificial Sequence
  Synthetic oligonucleotide; TTG chr11 5399903 5399924 5399920 5399925 +
aggtgtggcaggcaagatacag

SEQ ID NO: 112453 - DNA, 22 bp, Artificial Sequence
  Synthetic oligonucleotide; TTC chr11 5399947 5399968 5399964 5399969 +
agtaaggcagcacacgggaaga

SEQ ID NO: 112454 - DNA, 22 bp, Artificial Sequence
  Synthetic oligonucleotide; CTG chr11 5399976 5399997 5399993 5399998 +
ctcaatccagaggcagatcaat

SEQ ID NO: 112455 - DNA, 22 bp, Artificial Sequence
  Synthetic oligonucleotide; CTC chr11 5399979 5400000 5399996 5400001 +
aatccagaggcagatcaatatt

SEQ ID NO: 112456 - DNA, 22 bp, Artificial Sequence
  Synthetic oligonucleotide; TTG chr11 5399972 5399993 5399977 5399972 -
atctgcctctggattgagcagc

SEQ ID NO: 112457 - DNA, 22 bp, Artificial Sequence
  Synthetic oligonucleotide; CTG chr11 5399967 5399988 5399972 5399967 -
cctctggattgagcagctgttc

SEQ ID NO: 112458 - DNA, 22 bp, Artificial Sequence
  Synthetic oligonucleotide; CTC chr11 5399963 5399984 5399968 5399963 -
tggattgagcagctgttcttcc

SEQ ID NO: 112459 - DNA, 22 bp, Artificial Sequence
  Synthetic oligonucleotide; CTG chr11 5399961 5399982 5399966 5399961 -
gattgagcagctgttcttcccg

SEQ ID NO: 112460 - DNA, 22 bp, Artificial Sequence
  Synthetic oligonucleotide; TTG chr11 5399956 5399977 5399961 5399956 -
agcagctgttcttcccgtgtgc

SEQ ID NO: 112461 - DNA, 22 bp, Artificial Sequence
  Synthetic oligonucleotide; CTG chr11 5399948 5399969 5399953 5399948 -
ttcttcccgtgtgctgccttac

SEQ ID NO: 112462 - DNA, 22 bp, Artificial Sequence
  Synthetic oligonucleotide; TTC chr11 5399945 5399966 5399950 5399945 -
ttcccgtgtgctgccttactga

SEQ ID NO: 112463 - DNA, 22 bp, Artificial Sequence
  Synthetic oligonucleotide; CTT chr11 5399943 5399964 5399948 5399943 -
cccgtgtgctgccttactgaat

SEQ ID NO: 112464 - DNA, 22 bp, Artificial Sequence
  Synthetic oligonucleotide; TTC chr11 5399942 5399963 5399947 5399942 -
ccgtgtgctgccttactgaatc

SEQ ID NO: 112465 - DNA, 22 bp, Artificial Sequence
  Synthetic oligonucleotide; CTG chr11 5399932 5399953 5399937 5399932 -
ccttactgaatccttgatccca

SEQ ID NO: 112466 - DNA, 22 bp, Artificial Sequence
  Synthetic oligonucleotide; CTT chr11 5399928 5399949 5399933 5399928 -
actgaatccttgatcccactgc

SEQ ID NO: 112467 - DNA, 22 bp, Artificial Sequence
  Synthetic oligonucleotide; TTA chr11 5399927 5399948 5399932 5399927 -
ctgaatccttgatcccactgca

SEQ ID NO: 112468 - DNA, 22 bp, Artificial Sequence
  Synthetic oligonucleotide; CTG chr11 5399924 5399945 5399929 5399924 -
aatccttgatcccactgcaccc

SEQ ID NO: 112469 - DNA, 22 bp, Artificial Sequence
  Synthetic oligonucleotide; CTT chr11 5399917 5399938 5399922 5399917 -
gatcccactgcaccctgtatct

SEQ ID NO: 112470 - DNA, 22 bp, Artificial Sequence
  Synthetic oligonucleotide; TTG chr11 5399916 5399937 5399921 5399916 -
atcccactgcaccctgtatctt

SEQ ID NO: 112471 - DNA, 22 bp, Artificial Sequence
  Synthetic oligonucleotide; CTG chr11 5399907 5399928 5399912 5399907 -
caccctgtatcttgcctgccac

SEQ ID NO: 112472 - DNA, 22 bp, Artificial Sequence
  Synthetic oligonucleotide; CTG chr11 5399900 5399921 5399905 5399900 -
tatcttgcctgccacacctcaa

SEQ ID NO: 112473 - DNA, 22 bp, Artificial Sequence
  Synthetic oligonucleotide; CTT chr11 5399894 5399915 5399899 5399894 -
gcctgccacacctcaaataacc

SEQ ID NO: 112474 - DNA, 22 bp, Artificial Sequence
  Synthetic oligonucleotide; TTG chr11 5399893 5399914 5399898 5399893 -
cctgccacacctcaaataaccg

SEQ ID NO: 112475 - DNA, 22 bp, Artificial Sequence
  Synthetic oligonucleotide; CTG chr11 5399889 5399910 5399894 5399889 -
ccacacctcaaataaccggata

SEQ ID NO: 112476 - DNA, 22 bp, Artificial Sequence
  Synthetic oligonucleotide; CTC chr11 5399880 5399901 5399885 5399880 -
aaataaccggatattggaagaa

SEQ ID NO: 112477 - DNA, 22 bp, Artificial Sequence
  Synthetic oligonucleotide; TTG chr11 5399864 5399885 5399869 5399864 -
gaagaaacaaatcttgactgat

SEQ ID NO: 112478 - DNA, 22 bp, Artificial Sequence
  Synthetic oligonucleotide; CTT chr11 5399849 5399870 5399854 5399849 -
gactgatacttgaaactagagt

SEQ ID NO: 112479 - DNA, 22 bp, Artificial Sequence
  Synthetic oligonucleotide; TTG chr11 5399848 5399869 5399853 5399848 -
actgatacttgaaactagagtc

SEQ ID NO: 112480 - DNA, 22 bp, Artificial Sequence
  Synthetic oligonucleotide; CTG chr11 5399844 5399865 5399849 5399844 -
atacttgaaactagagtctctc

SEQ ID NO: 112481 - DNA, 22 bp, Artificial Sequence
  Synthetic oligonucleotide; CTT chr11 5399838 5399859 5399843 5399838 -
gaaactagagtctctcctcctc

SEQ ID NO: 112482 - DNA, 22 bp, Artificial Sequence
  Synthetic oligonucleotide; TTG chr11 5399837 5399858 5399842 5399837 -
aaactagagtctctcctcctct

SEQ ID NO: 112483 - DNA, 22 bp, Artificial Sequence
  Synthetic oligonucleotide; CTA chr11 5399831 5399852 5399836 5399831 -
gagtctctcctcctctgccttc

SEQ ID NO: 112484 - DNA, 22 bp, Artificial Sequence
  Synthetic oligonucleotide; CTC chr11 5399824 5399845 5399829 5399824 -
tcctcctctgccttctctgcct

SEQ ID NO: 112485 - DNA, 22 bp, Artificial Sequence
  Synthetic oligonucleotide; CTC chr11 5399822 5399843 5399827 5399822 -
ctcctctgccttctctgcctgt

SEQ ID NO: 112486 - DNA, 22 bp, Artificial Sequence
  Synthetic oligonucleotide; CTC chr11 5399819 5399840 5399824 5399819 -
ctctgccttctctgcctgtctg

SEQ ID NO: 112487 - DNA, 22 bp, Artificial Sequence
  Synthetic oligonucleotide; CTC chr11 5399816 5399837 5399821 5399816 -
tgccttctctgcctgtctgtgg

SEQ ID NO: 112488 - DNA, 22 bp, Artificial Sequence
  Synthetic oligonucleotide; CTG chr11 5399814 5399835 5399819 5399814 -
ccttctctgcctgtctgtggtc

SEQ ID NO: 112489 - DNA, 22 bp, Artificial Sequence
  Synthetic oligonucleotide; CTT chr11 5399810 5399831 5399815 5399810 -
ctctgcctgtctgtggtctctt

SEQ ID NO: 112490 - DNA, 22 bp, Artificial Sequence
  Synthetic oligonucleotide; TTC chr11 5399809 5399830 5399814 5399809 -
tctgcctgtctgtggtctcttt

SEQ ID NO: 112491 - DNA, 22 bp, Artificial Sequence
  Synthetic oligonucleotide; CTC chr11 5399807 5399828 5399812 5399807 -
tgcctgtctgtggtctcttttg

SEQ ID NO: 112492 - DNA, 22 bp, Artificial Sequence
  Synthetic oligonucleotide; CTG chr11 5399805 5399826 5399810 5399805 -
cctgtctgtggtctcttttgtt

SEQ ID NO: 112493 - DNA, 22 bp, Artificial Sequence
  Synthetic oligonucleotide; CTG chr11 5399801 5399822 5399806 5399801 -
tctgtggtctcttttgttttct

SEQ ID NO: 112494 - DNA, 22 bp, Artificial Sequence
  Synthetic oligonucleotide; CTG chr11 5399797 5399818 5399802 5399797 -
tggtctcttttgttttcttcct

SEQ ID NO: 112495 - DNA, 22 bp, Artificial Sequence
  Synthetic oligonucleotide; CTC chr11 5399790 5399811 5399795 5399790 -
ttttgttttcttcctttttttt

SEQ ID NO: 112496 - DNA, 22 bp, Artificial Sequence
  Synthetic oligonucleotide; CTT chr11 5399788 5399809 5399793 5399788 -
ttgttttcttcctttttttttc

SEQ ID NO: 112497 - DNA, 22 bp, Artificial Sequence
  Synthetic oligonucleotide; TTT chr11 5399787 5399808 5399792 5399787 -
tgttttcttcctttttttttct

SEQ ID NO: 112498 - DNA, 22 bp, Artificial Sequence
  Synthetic oligonucleotide; TTT chr11 5399786 5399807 5399791 5399786 -
gttttcttcctttttttttctt

SEQ ID NO: 112499 - DNA, 22 bp, Artificial Sequence
  Synthetic oligonucleotide; TTG chr11 5399785 5399806 5399790 5399785 -
ttttcttcctttttttttcttt

SEQ ID NO: 112500 - DNA, 22 bp, Artificial Sequence
  Synthetic oligonucleotide; TTT chr11 5399782 5399803 5399787 5399782 -
tcttcctttttttttctttctt

SEQ ID NO: 112501 - DNA, 22 bp, Artificial Sequence
  Synthetic oligonucleotide; TTT chr11 5399781 5399802 5399786 5399781 -
cttcctttttttttctttcttg

SEQ ID NO: 112502 - DNA, 22 bp, Artificial Sequence
  Synthetic oligonucleotide; TTC chr11 5399780 5399801 5399785 5399780 -
ttcctttttttttctttcttgc

SEQ ID NO: 112503 - DNA, 22 bp, Artificial Sequence
  Synthetic oligonucleotide; CTT chr11 5399778 5399799 5399783 5399778 -
cctttttttttctttcttgcat

SEQ ID NO: 112504 - DNA, 22 bp, Artificial Sequence
  Synthetic oligonucleotide; TTC chr11 5399777 5399798 5399782 5399777 -
ctttttttttctttcttgcatt

SEQ ID NO: 112505 - DNA, 22 bp, Artificial Sequence
  Synthetic oligonucleotide; CTT chr11 5399774 5399795 5399779 5399774 -
tttttttctttcttgcattttt

SEQ ID NO: 112506 - DNA, 22 bp, Artificial Sequence
  Synthetic oligonucleotide; TTT chr11 5399773 5399794 5399778 5399773 -
ttttttctttcttgcatttttt

SEQ ID NO: 112507 - DNA, 22 bp, Artificial Sequence
  Synthetic oligonucleotide; TTT chr11 5399772 5399793 5399777 5399772 -
tttttctttcttgcattttttt

SEQ ID NO: 112508 - DNA, 22 bp, Artificial Sequence
  Synthetic oligonucleotide; TTT chr11 5399771 5399792 5399776 5399771 -
ttttctttcttgcatttttttt

SEQ ID NO: 112509 - DNA, 22 bp, Artificial Sequence
  Synthetic oligonucleotide; TTT chr11 5399770 5399791 5399775 5399770 -
tttctttcttgcattttttttt

SEQ ID NO: 112510 - DNA, 22 bp, Artificial Sequence
  Synthetic oligonucleotide; TTT chr11 5399769 5399790 5399774 5399769 -
ttctttcttgcatttttttttt

SEQ ID NO: 112511 - DNA, 22 bp, Artificial Sequence
  Synthetic oligonucleotide; TTT chr11 5399768 5399789 5399773 5399768 -
tctttcttgcattttttttttt

SEQ ID NO: 112512 - DNA, 22 bp, Artificial Sequence
  Synthetic oligonucleotide; TTT chr11 5399767 5399788 5399772 5399767 -
ctttcttgcatttttttttttt

SEQ ID NO: 112513 - DNA, 22 bp, Artificial Sequence
  Synthetic oligonucleotide; TTC chr11 5399766 5399787 5399771 5399766 -
tttcttgcattttttttttttt

SEQ ID NO: 112514 - DNA, 22 bp, Artificial Sequence
  Synthetic oligonucleotide; CTT chr11 5399764 5399785 5399769 5399764 -
tcttgcatttttttttttttgc

SEQ ID NO: 112515 - DNA, 22 bp, Artificial Sequence
  Synthetic oligonucleotide; TTT chr11 5399763 5399784 5399768 5399763 -
cttgcatttttttttttttgca

SEQ ID NO: 112516 - DNA, 22 bp, Artificial Sequence
  Synthetic oligonucleotide; TTC chr11 5399762 5399783 5399767 5399762 -
ttgcatttttttttttttgcat

SEQ ID NO: 112517 - DNA, 22 bp, Artificial Sequence
  Synthetic oligonucleotide; CTT chr11 5399760 5399781 5399765 5399760 -
gcatttttttttttttgcatcc

SEQ ID NO: 112518 - DNA, 22 bp, Artificial Sequence
  Synthetic oligonucleotide; TTG chr11 5399759 5399780 5399764 5399759 -
catttttttttttttgcatcct

SEQ ID NO: 112519 - DNA, 22 bp, Artificial Sequence
  Synthetic oligonucleotide; TTT chr11 5399754 5399775 5399759 5399754 -
ttttttttttgcatccttctca

SEQ ID NO: 112520 - DNA, 22 bp, Artificial Sequence
  Synthetic oligonucleotide; TTT chr11 5399753 5399774 5399758 5399753 -
tttttttttgcatccttctcag

SEQ ID NO: 112521 - DNA, 22 bp, Artificial Sequence
  Synthetic oligonucleotide; TTT chr11 5399752 5399773 5399757 5399752 -
ttttttttgcatccttctcagt

SEQ ID NO: 112522 - DNA, 22 bp, Artificial Sequence
  Synthetic oligonucleotide; TTT chr11 5399751 5399772 5399756 5399751 -
tttttttgcatccttctcagtt

SEQ ID NO: 112523 - DNA, 22 bp, Artificial Sequence
  Synthetic oligonucleotide; TTT chr11 5399750 5399771 5399755 5399750 -
ttttttgcatccttctcagttt

SEQ ID NO: 112524 - DNA, 22 bp, Artificial Sequence
  Synthetic oligonucleotide; TTT chr11 5399749 5399770 5399754 5399749 -
tttttgcatccttctcagtttc

SEQ ID NO: 112525 - DNA, 22 bp, Artificial Sequence
  Synthetic oligonucleotide; TTT chr11 5399748 5399769 5399753 5399748 -
ttttgcatccttctcagtttcc

SEQ ID NO: 112526 - DNA, 22 bp, Artificial Sequence
  Synthetic oligonucleotide; TTT chr11 5399747 5399768 5399752 5399747 -
tttgcatccttctcagtttcca

SEQ ID NO: 112527 - DNA, 22 bp, Artificial Sequence
  Synthetic oligonucleotide; TTT chr11 5399746 5399767 5399751 5399746 -
ttgcatccttctcagtttccat

SEQ ID NO: 112528 - DNA, 22 bp, Artificial Sequence
  Synthetic oligonucleotide; TTT chr11 5399745 5399766 5399750 5399745 -
tgcatccttctcagtttccatc

SEQ ID NO: 112529 - DNA, 22 bp, Artificial Sequence
  Synthetic oligonucleotide; TTT chr11 5399744 5399765 5399749 5399744 -
gcatccttctcagtttccatct

SEQ ID NO: 112530 - DNA, 22 bp, Artificial Sequence
  Synthetic oligonucleotide; TTG chr11 5399743 5399764 5399748 5399743 -
catccttctcagtttccatctc

SEQ ID NO: 112531 - DNA, 22 bp, Artificial Sequence
  Synthetic oligonucleotide; CTT chr11 5399736 5399757 5399741 5399736 -
ctcagtttccatctccagagtc

SEQ ID NO: 112532 - DNA, 22 bp, Artificial Sequence
  Synthetic oligonucleotide; TTC chr11 5399735 5399756 5399740 5399735 -
tcagtttccatctccagagtct

SEQ ID NO: 112533 - DNA, 22 bp, Artificial Sequence
  Synthetic oligonucleotide; CTC chr11 5399733 5399754 5399738 5399733 -
agtttccatctccagagtctct

SEQ ID NO: 112534 - DNA, 22 bp, Artificial Sequence
  Synthetic oligonucleotide; TTT chr11 5399728 5399749 5399733 5399728 -
ccatctccagagtctctaccgc

SEQ ID NO: 112535 - DNA, 22 bp, Artificial Sequence
  Synthetic oligonucleotide; TTC chr11 5399727 5399748 5399732 5399727 -
catctccagagtctctaccgcc

SEQ ID NO: 112536 - DNA, 22 bp, Artificial Sequence
  Synthetic oligonucleotide; CTC chr11 5399721 5399742 5399726 5399721 -
cagagtctctaccgccagataa

SEQ ID NO: 112537 - DNA, 22 bp, Artificial Sequence
  Synthetic oligonucleotide; CTC chr11 5399712 5399733 5399717 5399712 -
taccgccagataagggtcagat

SEQ ID NO: 112538 - DNA, 22 bp, Artificial Sequence
  Synthetic oligonucleotide; CTA chr11 5399710 5399731 5399715 5399710 -
ccgccagataagggtcagatct

SEQ ID NO: 112539 - DNA, 22 bp, Artificial Sequence
  Synthetic oligonucleotide; CTC chr11 5399687 5399708 5399692 5399687 -
cttgaaagagatcttaaaacac

SEQ ID NO: 112540 - DNA, 22 bp, Artificial Sequence
  Synthetic oligonucleotide; CTT chr11 5399684 5399705 5399689 5399684 -
gaaagagatcttaaaacacaat

SEQ ID NO: 112541 - DNA, 22 bp, Artificial Sequence
  Synthetic oligonucleotide; TTG chr11 5399683 5399704 5399688 5399683 -
aaagagatcttaaaacacaatc

SEQ ID NO: 112542 - DNA, 22 bp, Artificial Sequence
  Synthetic oligonucleotide; CTT chr11 5399672 5399693 5399677 5399672 -
aaaacacaatcattctcctgag

SEQ ID NO: 112543 - DNA, 22 bp, Artificial Sequence
  Synthetic oligonucleotide; TTA chr11 5399671 5399692 5399676 5399671 -
aaacacaatcattctcctgagt

SEQ ID NO: 112544 - DNA, 22 bp, Artificial Sequence
  Synthetic oligonucleotide; TTC chr11 5399657 5399678 5399662 5399657 -
tcctgagtttaggatttgtttg

SEQ ID NO: 112545 - DNA, 22 bp, Artificial Sequence
  Synthetic oligonucleotide; CTC chr11 5399655 5399676 5399660 5399655 -
ctgagtttaggatttgtttgac

SEQ ID NO: 112546 - DNA, 22 bp, Artificial Sequence
  Synthetic oligonucleotide; CTG chr11 5399652 5399673 5399657 5399652 -
agtttaggatttgtttgacaag

SEQ ID NO: 112547 - DNA, 22 bp, Artificial Sequence
  Synthetic oligonucleotide; TTT chr11 5399647 5399668 5399652 5399647 -
aggatttgtttgacaagagcat

SEQ ID NO: 112548 - DNA, 22 bp, Artificial Sequence
  Synthetic oligonucleotide; TTA chr11 5399646 5399667 5399651 5399646 -
ggatttgtttgacaagagcatt

SEQ ID NO: 112549 - DNA, 22 bp, Artificial Sequence
  Synthetic oligonucleotide; TTT chr11 5399640 5399661 5399645 5399640 -
gtttgacaagagcattttagct

SEQ ID NO: 112550 - DNA, 22 bp, Artificial Sequence
  Synthetic oligonucleotide; TTG chr11 5399639 5399660 5399644 5399639 -
tttgacaagagcattttagctt

SEQ ID NO: 112551 - DNA, 22 bp, Artificial Sequence
  Synthetic oligonucleotide; TTT chr11 5399636 5399657 5399641 5399636 -
gacaagagcattttagcttgaa

SEQ ID NO: 112552 - DNA, 22 bp, Artificial Sequence
  Synthetic oligonucleotide; TTG chr11 5399635 5399656 5399640 5399635 -
acaagagcattttagcttgaaa

SEQ ID NO: 112553 - DNA, 22 bp, Artificial Sequence
  Synthetic oligonucleotide; TTT chr11 5399623 5399644 5399628 5399623 -
tagcttgaaaggttacaaaagg

SEQ ID NO: 112554 - DNA, 22 bp, Artificial Sequence
  Synthetic oligonucleotide; TTT chr11 5399622 5399643 5399627 5399622 -
agcttgaaaggttacaaaaggg

SEQ ID NO: 112555 - DNA, 22 bp, Artificial Sequence
  Synthetic oligonucleotide; TTA chr11 5399621 5399642 5399626 5399621 -
gcttgaaaggttacaaaaggga

SEQ ID NO: 112556 - DNA, 22 bp, Artificial Sequence
  Synthetic oligonucleotide; CTT chr11 5399617 5399638 5399622 5399617 -
gaaaggttacaaaagggatcat

SEQ ID NO: 112557 - DNA, 22 bp, Artificial Sequence
  Synthetic oligonucleotide; TTG chr11 5399616 5399637 5399621 5399616 -
aaaggttacaaaagggatcatg

SEQ ID NO: 112558 - DNA, 22 bp, Artificial Sequence
  Synthetic oligonucleotide; TTA chr11 5399608 5399629 5399613 5399608 -
caaaagggatcatgtagtctat

SEQ ID NO: 112559 - DNA, 22 bp, Artificial Sequence
  Synthetic oligonucleotide; CTA chr11 5399587 5399608 5399592 5399587 -
tagcccagtataataggacaca

SEQ ID NO: 112560 - DNA, 22 bp, Artificial Sequence
  Synthetic oligonucleotide; CTG chr11 5399524 5399545 5399529 5399524 -
tacccctggagctggacagaat

SEQ ID NO: 112561 - DNA, 22 bp, Artificial Sequence
  Synthetic oligonucleotide; CTG chr11 5399516 5399537 5399521 5399516 -
gagctggacagaattggaggtg

SEQ ID NO: 112562 - DNA, 22 bp, Artificial Sequence
  Synthetic oligonucleotide; CTG chr11 5399510 5399531 5399515 5399510 -
gacagaattggaggtgaatctt

SEQ ID NO: 112563 - DNA, 22 bp, Artificial Sequence
  Synthetic oligonucleotide; TTG chr11 5399500 5399521 5399505 5399500 -
gaggtgaatcttatgttcggta

SEQ ID NO: 112564 - DNA, 22 bp, Artificial Sequence
  Synthetic oligonucleotide; CTT chr11 5399488 5399509 5399493 5399488 -
atgttcggtataactttacgta

SEQ ID NO: 112565 - DNA, 22 bp, Artificial Sequence
  Synthetic oligonucleotide; TTA chr11 5399487 5399508 5399492 5399487 -
tgttcggtataactttacgtac

SEQ ID NO: 112566 - DNA, 22 bp, Artificial Sequence
  Synthetic oligonucleotide; TTC chr11 5399482 5399503 5399487 5399482 -
ggtataactttacgtactttac

SEQ ID NO: 112567 - DNA, 22 bp, Artificial Sequence
  Synthetic oligonucleotide; CTT chr11 5399472 5399493 5399477 5399472 -
tacgtactttacctttgtgcac

SEQ ID NO: 112568 - DNA, 22 bp, Artificial Sequence
  Synthetic oligonucleotide; TTT chr11 5399471 5399492 5399476 5399471 -
acgtactttacctttgtgcaca

SEQ ID NO: 112569 - DNA, 22 bp, Artificial Sequence
  Synthetic oligonucleotide; TTA chr11 5399470 5399491 5399475 5399470 -
cgtactttacctttgtgcacat

SEQ ID NO: 112570 - DNA, 22 bp, Artificial Sequence
  Synthetic oligonucleotide; CTT chr11 5399463 5399484 5399468 5399463 -
tacctttgtgcacattagtatc

SEQ ID NO: 112571 - DNA, 22 bp, Artificial Sequence
  Synthetic oligonucleotide; TTT chr11 5399462 5399483 5399467 5399462 -
acctttgtgcacattagtatct

SEQ ID NO: 112572 - DNA, 22 bp, Artificial Sequence
  Synthetic oligonucleotide; TTA chr11 5399461 5399482 5399466 5399461 -
cctttgtgcacattagtatctt

SEQ ID NO: 112573 - DNA, 22 bp, Artificial Sequence
  Synthetic oligonucleotide; CTT chr11 5399457 5399478 5399462 5399457 -
tgtgcacattagtatctttgtt

SEQ ID NO: 112574 - DNA, 22 bp, Artificial Sequence
  Synthetic oligonucleotide; TTT chr11 5399456 5399477 5399461 5399456 -
gtgcacattagtatctttgttt

SEQ ID NO: 112575 - DNA, 22 bp, Artificial Sequence
  Synthetic oligonucleotide; TTG chr11 5399455 5399476 5399460 5399455 -
tgcacattagtatctttgtttt

SEQ ID NO: 112576 - DNA, 22 bp, Artificial Sequence
  Synthetic oligonucleotide; TTA chr11 5399446 5399467 5399451 5399446 -
gtatctttgtttttaaagataa

SEQ ID NO: 112577 - DNA, 22 bp, Artificial Sequence
  Synthetic oligonucleotide; CTT chr11 5399439 5399460 5399444 5399439 -
tgtttttaaagataaagatgtt

SEQ ID NO: 112578 - DNA, 22 bp, Artificial Sequence
  Synthetic oligonucleotide; TTT chr11 5399438 5399459 5399443 5399438 -
gtttttaaagataaagatgtta

SEQ ID NO: 112579 - DNA, 22 bp, Artificial Sequence
  Synthetic oligonucleotide; TTG chr11 5399437 5399458 5399442 5399437 -
tttttaaagataaagatgttaa

SEQ ID NO: 112580 - DNA, 22 bp, Artificial Sequence
  Synthetic oligonucleotide; TTT chr11 5399434 5399455 5399439 5399434 -
ttaaagataaagatgttaatac

SEQ ID NO: 112581 - DNA, 22 bp, Artificial Sequence
  Synthetic oligonucleotide; TTT chr11 5399433 5399454 5399438 5399433 -
taaagataaagatgttaatact

SEQ ID NO: 112582 - DNA, 22 bp, Artificial Sequence
  Synthetic oligonucleotide; TTT chr11 5399432 5399453 5399437 5399432 -
aaagataaagatgttaatactt

SEQ ID NO: 112583 - DNA, 22 bp, Artificial Sequence
  Synthetic oligonucleotide; TTA chr11 5399431 5399452 5399436 5399431 -
aagataaagatgttaatactta

SEQ ID NO: 112584 - DNA, 22 bp, Artificial Sequence
  Synthetic oligonucleotide; TTA chr11 5399416 5399437 5399421 5399416 -
atacttacctcagggactggct

SEQ ID NO: 112585 - DNA, 22 bp, Artificial Sequence
  Synthetic oligonucleotide; CTT chr11 5399410 5399431 5399415 5399410 -
acctcagggactggctctaaat

SEQ ID NO: 112586 - DNA, 22 bp, Artificial Sequence
  Synthetic oligonucleotide; TTA chr11 5399409 5399430 5399414 5399409 -
cctcagggactggctctaaata

SEQ ID NO: 112587 - DNA, 22 bp, Artificial Sequence
  Synthetic oligonucleotide; CTC chr11 5399405 5399426 5399410 5399405 -
agggactggctctaaatattta

SEQ ID NO: 112588 - DNA, 22 bp, Artificial Sequence
  Synthetic oligonucleotide; CTG chr11 5399397 5399418 5399402 5399397 -
gctctaaatatttaatgtgagc

SEQ ID NO: 112589 - DNA, 22 bp, Artificial Sequence
  Synthetic oligonucleotide; CTC chr11 5399393 5399414 5399398 5399393 -
taaatatttaatgtgagccttt

SEQ ID NO: 112590 - DNA, 22 bp, Artificial Sequence
  Synthetic oligonucleotide; CTA chr11 5399391 5399412 5399396 5399391 -
aatatttaatgtgagcctttag

SEQ ID NO: 112591 - DNA, 22 bp, Artificial Sequence
  Synthetic oligonucleotide; TTT chr11 5399384 5399405 5399389 5399384 -
aatgtgagcctttagcaaccag

SEQ ID NO: 112592 - DNA, 22 bp, Artificial Sequence
  Synthetic oligonucleotide; TTA chr11 5399383 5399404 5399388 5399383 -
atgtgagcctttagcaaccagt

SEQ ID NO: 112593 - DNA, 22 bp, Artificial Sequence
  Synthetic oligonucleotide; CTT chr11 5399372 5399393 5399377 5399372 -
tagcaaccagtgaatgttaata

SEQ ID NO: 112594 - DNA, 22 bp, Artificial Sequence
  Synthetic oligonucleotide; TTT chr11 5399371 5399392 5399376 5399371 -
agcaaccagtgaatgttaatat

SEQ ID NO: 112595 - DNA, 22 bp, Artificial Sequence
  Synthetic oligonucleotide; TTA chr11 5399370 5399391 5399375 5399370 -
gcaaccagtgaatgttaatatt

SEQ ID NO: 112596 - DNA, 22 bp, Artificial Sequence
  Synthetic oligonucleotide; TTA chr11 5399353 5399374 5399358 5399353 -
atattctctccactctatatct

SEQ ID NO: 112597 - DNA, 22 bp, Artificial Sequence
  Synthetic oligonucleotide; TTC chr11 5399347 5399368 5399352 5399347 -
tctccactctatatctctttca

SEQ ID NO: 112598 - DNA, 22 bp, Artificial Sequence
  Synthetic oligonucleotide; CTC chr11 5399345 5399366 5399350 5399345 -
tccactctatatctctttcagg

SEQ ID NO: 112599 - DNA, 22 bp, Artificial Sequence
  Synthetic oligonucleotide; CTC chr11 5399343 5399364 5399348 5399343 -
cactctatatctctttcaggaa

SEQ ID NO: 112600 - DNA, 22 bp, Artificial Sequence
  Synthetic oligonucleotide; CTC chr11 5399338 5399359 5399343 5399338 -
tatatctctttcaggaattctc

SEQ ID NO: 112601 - DNA, 22 bp, Artificial Sequence
  Synthetic oligonucleotide; CTA chr11 5399336 5399357 5399341 5399336 -
tatctctttcaggaattctcag

SEQ ID NO: 112602 - DNA, 22 bp, Artificial Sequence
  Synthetic oligonucleotide; CTC chr11 5399330 5399351 5399335 5399330 -
tttcaggaattctcaggagtca

SEQ ID NO: 112603 - DNA, 22 bp, Artificial Sequence
  Synthetic oligonucleotide; CTT chr11 5399328 5399349 5399333 5399328 -
tcaggaattctcaggagtcaat

SEQ ID NO: 112604 - DNA, 22 bp, Artificial Sequence
  Synthetic oligonucleotide; TTT chr11 5399327 5399348 5399332 5399327 -
caggaattctcaggagtcaatc

SEQ ID NO: 112605 - DNA, 22 bp, Artificial Sequence
  Synthetic oligonucleotide; TTC chr11 5399326 5399347 5399331 5399326 -
aggaattctcaggagtcaatca

SEQ ID NO: 112606 - DNA, 22 bp, Artificial Sequence
  Synthetic oligonucleotide; TTC chr11 5399318 5399339 5399323 5399318 -
tcaggagtcaatcacagtcagc

SEQ ID NO: 112607 - DNA, 22 bp, Artificial Sequence
  Synthetic oligonucleotide; CTC chr11 5399316 5399337 5399321 5399316 -
aggagtcaatcacagtcagctt

SEQ ID NO: 112608 - DNA, 22 bp, Artificial Sequence
  Synthetic oligonucleotide; CTT chr11 5399294 5399315 5399299 5399294 -
atttccaactttttattaataa

SEQ ID NO: 112609 - DNA, 22 bp, Artificial Sequence
  Synthetic oligonucleotide; TTA chr11 5399293 5399314 5399298 5399293 -
tttccaactttttattaataat

SEQ ID NO: 112610 - DNA, 22 bp, Artificial Sequence
  Synthetic oligonucleotide; TTT chr11 5399290 5399311 5399295 5399290 -
ccaactttttattaataattgt

SEQ ID NO: 112611 - DNA, 22 bp, Artificial Sequence
  Synthetic oligonucleotide; TTC chr11 5399289 5399310 5399294 5399289 -
caactttttattaataattgtc

SEQ ID NO: 112612 - DNA, 22 bp, Artificial Sequence
  Synthetic oligonucleotide; CTT chr11 5399283 5399304 5399288 5399283 -
tttattaataattgtctttcct

SEQ ID NO: 112613 - DNA, 22 bp, Artificial Sequence
  Synthetic oligonucleotide; TTT chr11 5399282 5399303 5399287 5399282 -
ttattaataattgtctttcctt

SEQ ID NO: 112614 - DNA, 22 bp, Artificial Sequence
  Synthetic oligonucleotide; TTT chr11 5399281 5399302 5399286 5399281 -
tattaataattgtctttccttg

SEQ ID NO: 112615 - DNA, 22 bp, Artificial Sequence
  Synthetic oligonucleotide; TTT chr11 5399280 5399301 5399285 5399280 -
attaataattgtctttccttgt

SEQ ID NO: 112616 - DNA, 22 bp, Artificial Sequence
  Synthetic oligonucleotide; TTA chr11 5399279 5399300 5399284 5399279 -
ttaataattgtctttccttgtt

SEQ ID NO: 112617 - DNA, 22 bp, Artificial Sequence
  Synthetic oligonucleotide; TTA chr11 5399276 5399297 5399281 5399276 -
ataattgtctttccttgttatt

SEQ ID NO: 112618 - DNA, 22 bp, Artificial Sequence
  Synthetic oligonucleotide; TTG chr11 5399269 5399290 5399274 5399269 -
tctttccttgttattggctcac

SEQ ID NO: 112619 - DNA, 22 bp, Artificial Sequence
  Synthetic oligonucleotide; CTT chr11 5399265 5399286 5399270 5399265 -
tccttgttattggctcactgat

SEQ ID NO: 112620 - DNA, 22 bp, Artificial Sequence
  Synthetic oligonucleotide; TTT chr11 5399264 5399285 5399269 5399264 -
ccttgttattggctcactgata

SEQ ID NO: 112621 - DNA, 22 bp, Artificial Sequence
  Synthetic oligonucleotide; TTC chr11 5399263 5399284 5399268 5399263 -
cttgttattggctcactgatac

SEQ ID NO: 112622 - DNA, 22 bp, Artificial Sequence
  Synthetic oligonucleotide; CTT chr11 5399260 5399281 5399265 5399260 -
gttattggctcactgatactca

SEQ ID NO: 112623 - DNA, 22 bp, Artificial Sequence
  Synthetic oligonucleotide; TTG chr11 5399259 5399280 5399264 5399259 -
ttattggctcactgatactcag

SEQ ID NO: 112624 - DNA, 22 bp, Artificial Sequence
  Synthetic oligonucleotide; TTA chr11 5399256 5399277 5399261 5399256 -
ttggctcactgatactcagacc

SEQ ID NO: 112625 - DNA, 22 bp, Artificial Sequence
  Synthetic oligonucleotide; TTG chr11 5399253 5399274 5399258 5399253 -
gctcactgatactcagaccaca

SEQ ID NO: 112626 - DNA, 22 bp, Artificial Sequence
  Synthetic oligonucleotide; CTC chr11 5399249 5399270 5399254 5399249 -
actgatactcagaccacatctg

SEQ ID NO: 112627 - DNA, 22 bp, Artificial Sequence
  Synthetic oligonucleotide; CTG chr11 5399245 5399266 5399250 5399245 -
atactcagaccacatctgtgag

SEQ ID NO: 112628 - DNA, 22 bp, Artificial Sequence
  Synthetic oligonucleotide; CTC chr11 5399239 5399260 5399244 5399239 -
agaccacatctgtgaggtaaac

SEQ ID NO: 112629 - DNA, 22 bp, Artificial Sequence
  Synthetic oligonucleotide; CTG chr11 5399227 5399248 5399232 5399227 -
tgaggtaaacaaggagacaaga

SEQ ID NO: 112630 - DNA, 22 bp, Artificial Sequence
  Synthetic oligonucleotide; TTT chr11 5399201 5399222 5399206 5399201 -
cccacttaatagatgagcatat

SEQ ID NO: 112631 - DNA, 22 bp, Artificial Sequence
  Synthetic oligonucleotide; TTC chr11 5399200 5399221 5399205 5399200 -
ccacttaatagatgagcatata

SEQ ID NO: 112632 - DNA, 22 bp, Artificial Sequence
  Synthetic oligonucleotide; CTT chr11 5399194 5399215 5399199 5399194 -
aatagatgagcatataaaccag

SEQ ID NO: 112633 - DNA, 22 bp, Artificial Sequence
  Synthetic oligonucleotide; TTA chr11 5399193 5399214 5399198 5399193 -
atagatgagcatataaaccaga

SEQ ID NO: 112634 - DNA, 22 bp, Artificial Sequence
  Synthetic oligonucleotide; TTT chr11 5399160 5399181 5399165 5399160 -
tgtgagtaacccaagataatat

SEQ ID NO: 112635 - DNA, 22 bp, Artificial Sequence
  Synthetic oligonucleotide; TTT chr11 5399159 5399180 5399164 5399159 -
gtgagtaacccaagataatatg

SEQ ID NO: 112636 - DNA, 22 bp, Artificial Sequence
  Synthetic oligonucleotide; TTG chr11 5399158 5399179 5399163 5399158 -
tgagtaacccaagataatatga

SEQ ID NO: 112637 - DNA, 22 bp, Artificial Sequence
  Synthetic oligonucleotide; CTA chr11 5399125 5399146 5399130 5399125 -
tttcaagaattcatgatgtgct

SEQ ID NO: 112638 - DNA, 22 bp, Artificial Sequence
  Synthetic oligonucleotide; TTT chr11 5399122 5399143 5399127 5399122 -
caagaattcatgatgtgctctg

SEQ ID NO: 112639 - DNA, 22 bp, Artificial Sequence
  Synthetic oligonucleotide; TTC chr11 5399121 5399142 5399126 5399121 -
aagaattcatgatgtgctctgg

SEQ ID NO: 112640 - DNA, 22 bp, Artificial Sequence
  Synthetic oligonucleotide; TTC chr11 5399113 5399134 5399118 5399113 -
atgatgtgctctggtgtttttg

SEQ ID NO: 112641 - DNA, 22 bp, Artificial Sequence
  Synthetic oligonucleotide; CTC chr11 5399102 5399123 5399107 5399102 -
tggtgtttttgttttgttttcc

SEQ ID NO: 112642 - DNA, 22 bp, Artificial Sequence
  Synthetic oligonucleotide; CTG chr11 5399100 5399121 5399105 5399100 -
gtgtttttgttttgttttccat

SEQ ID NO: 112643 - DNA, 22 bp, Artificial Sequence
  Synthetic oligonucleotide; TTT chr11 5399094 5399115 5399099 5399094 -
ttgttttgttttccatctgcca

SEQ ID NO: 112644 - DNA, 22 bp, Artificial Sequence
  Synthetic oligonucleotide; TTT chr11 5399093 5399114 5399098 5399093 -
tgttttgttttccatctgccac

SEQ ID NO: 112645 - DNA, 22 bp, Artificial Sequence
  Synthetic oligonucleotide; TTT chr11 5399092 5399113 5399097 5399092 -
gttttgttttccatctgccacc

SEQ ID NO: 112646 - DNA, 22 bp, Artificial Sequence
  Synthetic oligonucleotide; TTG chr11 5399091 5399112 5399096 5399091 -
ttttgttttccatctgccacca

SEQ ID NO: 112647 - DNA, 22 bp, Artificial Sequence
  Synthetic oligonucleotide; TTT chr11 5399088 5399109 5399093 5399088 -
tgttttccatctgccaccaatt

SEQ ID NO: 112648 - DNA, 22 bp, Artificial Sequence
  Synthetic oligonucleotide; TTT chr11 5399087 5399108 5399092 5399087 -
gttttccatctgccaccaattt

SEQ ID NO: 112649 - DNA, 22 bp, Artificial Sequence
  Synthetic oligonucleotide; TTG chr11 5399086 5399107 5399091 5399086 -
ttttccatctgccaccaattta

SEQ ID NO: 112650 - DNA, 22 bp, Artificial Sequence
  Synthetic oligonucleotide; TTT chr11 5399083 5399104 5399088 5399083 -
tccatctgccaccaatttagga

SEQ ID NO: 112651 - DNA, 22 bp, Artificial Sequence
  Synthetic oligonucleotide; TTT chr11 5399082 5399103 5399087 5399082 -
ccatctgccaccaatttaggat

SEQ ID NO: 112652 - DNA, 22 bp, Artificial Sequence
  Synthetic oligonucleotide; TTC chr11 5399081 5399102 5399086 5399081 -
catctgccaccaatttaggatg

SEQ ID NO: 112653 - DNA, 22 bp, Artificial Sequence
  Synthetic oligonucleotide; CTG chr11 5399075 5399096 5399080 5399075 -
ccaccaatttaggatgtgattc

SEQ ID NO: 112654 - DNA, 22 bp, Artificial Sequence
  Synthetic oligonucleotide; TTT chr11 5399065 5399086 5399070 5399065 -
aggatgtgattcctctccttct

SEQ ID NO: 112655 - DNA, 22 bp, Artificial Sequence
  Synthetic oligonucleotide; TTA chr11 5399064 5399085 5399069 5399064 -
ggatgtgattcctctccttctg

SEQ ID NO: 112656 - DNA, 22 bp, Artificial Sequence
  Synthetic oligonucleotide; TTC chr11 5399053 5399074 5399058 5399053 -
ctctccttctgccagacaggtt

SEQ ID NO: 112657 - DNA, 22 bp, Artificial Sequence
  Synthetic oligonucleotide; CTC chr11 5399050 5399071 5399055 5399050 -
tccttctgccagacaggttcaa

SEQ ID NO: 112658 - DNA, 22 bp, Artificial Sequence
  Synthetic oligonucleotide; CTC chr11 5399048 5399069 5399053 5399048 -
cttctgccagacaggttcaaga

SEQ ID NO: 112659 - DNA, 22 bp, Artificial Sequence
  Synthetic oligonucleotide; CTT chr11 5399045 5399066 5399050 5399045 -
ctgccagacaggttcaagaagc

SEQ ID NO: 112660 - DNA, 22 bp, Artificial Sequence
  Synthetic oligonucleotide; TTC chr11 5399044 5399065 5399049 5399044 -
tgccagacaggttcaagaagct

SEQ ID NO: 112661 - DNA, 22 bp, Artificial Sequence
  Synthetic oligonucleotide; CTG chr11 5399042 5399063 5399047 5399042 -
ccagacaggttcaagaagctag

SEQ ID NO: 112662 - DNA, 22 bp, Artificial Sequence
  Synthetic oligonucleotide; TTC chr11 5399030 5399051 5399035 5399030 -
aagaagctagggaggtgactac

SEQ ID NO: 112663 - DNA, 22 bp, Artificial Sequence
  Synthetic oligonucleotide; CTA chr11 5399021 5399042 5399026 5399021 -
gggaggtgactactgtcttagg

SEQ ID NO: 112664 - DNA, 22 bp, Artificial Sequence
  Synthetic oligonucleotide; CTA chr11 5399009 5399030 5399014 5399009 -
ctgtcttaggaaaaatgctaag

SEQ ID NO: 112665 - DNA, 22 bp, Artificial Sequence
  Synthetic oligonucleotide; CTG chr11 5399006 5399027 5399011 5399006 -
tcttaggaaaaatgctaagggc

SEQ ID NO: 112666 - DNA, 22 bp, Artificial Sequence
  Synthetic oligonucleotide; CTT chr11 5399002 5399023 5399007 5399002 -
aggaaaaatgctaagggcttca

SEQ ID NO: 112667 - DNA, 22 bp, Artificial Sequence
  Synthetic oligonucleotide; TTA chr11 5399001 5399022 5399006 5399001 -
ggaaaaatgctaagggcttcac

SEQ ID NO: 112668 - DNA, 22 bp, Artificial Sequence
  Synthetic oligonucleotide; CTA chr11 5398989 5399010 5398994 5398989 -
agggcttcacactgtgacatgg

SEQ ID NO: 112669 - DNA, 22 bp, Artificial Sequence
  Synthetic oligonucleotide; CTT chr11 5398982 5399003 5398987 5398982 -
cacactgtgacatggggttggg

SEQ ID NO: 112670 - DNA, 22 bp, Artificial Sequence
  Synthetic oligonucleotide; TTC chr11 5398981 5399002 5398986 5398981 -
acactgtgacatggggttggga

SEQ ID NO: 112671 - DNA, 22 bp, Artificial Sequence
  Synthetic oligonucleotide; CTG chr11 5398975 5398996 5398980 5398975 -
tgacatggggttgggagtcctg

SEQ ID NO: 112672 - DNA, 22 bp, Artificial Sequence
  Synthetic oligonucleotide; TTG chr11 5398962 5398983 5398967 5398962 -
ggagtcctgaatgctgcttcag

SEQ ID NO: 112673 - DNA, 22 bp, Artificial Sequence
  Synthetic oligonucleotide; CTG chr11 5398953 5398974 5398958 5398953 -
aatgctgcttcagaaggcaggg

SEQ ID NO: 112674 - DNA, 22 bp, Artificial Sequence
  Synthetic oligonucleotide; CTG chr11 5398946 5398967 5398951 5398946 -
cttcagaaggcagggcttgggg

SEQ ID NO: 112675 - DNA, 22 bp, Artificial Sequence
  Synthetic oligonucleotide; CTT chr11 5398943 5398964 5398948 5398943 -
cagaaggcagggcttggggatt

SEQ ID NO: 112676 - DNA, 22 bp, Artificial Sequence
  Synthetic oligonucleotide; TTC chr11 5398942 5398963 5398947 5398942 -
agaaggcagggcttggggattg

SEQ ID NO: 112677 - DNA, 22 bp, Artificial Sequence
  Synthetic oligonucleotide; CTT chr11 5398928 5398949 5398933 5398928 -
ggggattgtattagttcattct

SEQ ID NO: 112678 - DNA, 22 bp, Artificial Sequence
  Synthetic oligonucleotide; TTG chr11 5398927 5398948 5398932 5398927 -
gggattgtattagttcattctc

SEQ ID NO: 112679 - DNA, 22 bp, Artificial Sequence
  Synthetic oligonucleotide; TTG chr11 5398920 5398941 5398925 5398920 -
tattagttcattctcacactgc

SEQ ID NO: 112680 - DNA, 22 bp, Artificial Sequence
  Synthetic oligonucleotide; TTA chr11 5398915 5398936 5398920 5398915 -
gttcattctcacactgctctaa

SEQ ID NO: 112681 - DNA, 22 bp, Artificial Sequence
  Synthetic oligonucleotide; TTC chr11 5398911 5398932 5398916 5398911 -
attctcacactgctctaaagat

SEQ ID NO: 112682 - DNA, 22 bp, Artificial Sequence
  Synthetic oligonucleotide; TTC chr11 5398907 5398928 5398912 5398907 -
tcacactgctctaaagatacta

SEQ ID NO: 112683 - DNA, 22 bp, Artificial Sequence
  Synthetic oligonucleotide; CTC chr11 5398905 5398926 5398910 5398905 -
acactgctctaaagatactacc

SEQ ID NO: 112684 - DNA, 22 bp, Artificial Sequence
  Synthetic oligonucleotide; CTG chr11 5398899 5398920 5398904 5398899 -
ctctaaagatactacctgagac

SEQ ID NO: 112685 - DNA, 22 bp, Artificial Sequence
  Synthetic oligonucleotide; CTC chr11 5398896 5398917 5398901 5398896 -
taaagatactacctgagactgg

SEQ ID NO: 112686 - DNA, 22 bp, Artificial Sequence
  Synthetic oligonucleotide; CTA chr11 5398894 5398915 5398899 5398894 -
aagatactacctgagactgggt

SEQ ID NO: 112687 - DNA, 22 bp, Artificial Sequence
  Synthetic oligonucleotide; CTA chr11 5398885 5398906 5398890 5398885 -
cctgagactgggtaatttatta

SEQ ID NO: 112688 - DNA, 22 bp, Artificial Sequence
  Synthetic oligonucleotide; CTG chr11 5398881 5398902 5398886 5398881 -
agactgggtaatttattaacaa

SEQ ID NO: 112689 - DNA, 22 bp, Artificial Sequence
  Synthetic oligonucleotide; CTG chr11 5398875 5398896 5398880 5398875 -
ggtaatttattaacaaaggagg

SEQ ID NO: 112690 - DNA, 22 bp, Artificial Sequence
  Synthetic oligonucleotide; TTT chr11 5398867 5398888 5398872 5398867 -
attaacaaaggaggtttaattg

SEQ ID NO: 112691 - DNA, 22 bp, Artificial Sequence
  Synthetic oligonucleotide; TTA chr11 5398866 5398887 5398871 5398866 -
ttaacaaaggaggtttaattga

SEQ ID NO: 112692 - DNA, 22 bp, Artificial Sequence
  Synthetic oligonucleotide; TTA chr11 5398863 5398884 5398868 5398863 -
acaaaggaggtttaattgactc

SEQ ID NO: 112693 - DNA, 22 bp, Artificial Sequence
  Synthetic oligonucleotide; TTT chr11 5398850 5398871 5398855 5398850 -
aattgactcacatttccacata

SEQ ID NO: 112694 - DNA, 22 bp, Artificial Sequence
  Synthetic oligonucleotide; TTA chr11 5398849 5398870 5398854 5398849 -
attgactcacatttccacatag

SEQ ID NO: 112695 - DNA, 22 bp, Artificial Sequence
  Synthetic oligonucleotide; TTG chr11 5398845 5398866 5398850 5398845 -
actcacatttccacatagctgg

SEQ ID NO: 112696 - DNA, 22 bp, Artificial Sequence
  Synthetic oligonucleotide; CTC chr11 5398841 5398862 5398846 5398841 -
acatttccacatagctggggag

SEQ ID NO: 112697 - DNA, 22 bp, Artificial Sequence
  Synthetic oligonucleotide; TTT chr11 5398835 5398856 5398840 5398835 -
ccacatagctggggaggcctca

SEQ ID NO: 112698 - DNA, 22 bp, Artificial Sequence
  Synthetic oligonucleotide; TTC chr11 5398834 5398855 5398839 5398834 -
cacatagctggggaggcctcag

SEQ ID NO: 112699 - DNA, 22 bp, Artificial Sequence
  Synthetic oligonucleotide; CTG chr11 5398824 5398845 5398829 5398824 -
gggaggcctcaggaaacttaca

SEQ ID NO: 112700 - DNA, 22 bp, Artificial Sequence
  Synthetic oligonucleotide; CTC chr11 5398814 5398835 5398819 5398814 -
aggaaacttacaattatggcag

SEQ ID NO: 112701 - DNA, 22 bp, Artificial Sequence
  Synthetic oligonucleotide; CTT chr11 5398805 5398826 5398810 5398805 -
acaattatggcagaaggagaag

SEQ ID NO: 112702 - DNA, 22 bp, Artificial Sequence
  Synthetic oligonucleotide; TTA chr11 5398804 5398825 5398809 5398804 -
caattatggcagaaggagaagc

SEQ ID NO: 112703 - DNA, 22 bp, Artificial Sequence
  Synthetic oligonucleotide; TTA chr11 5398798 5398819 5398803 5398798 -
tggcagaaggagaagcaggcac

SEQ ID NO: 112704 - DNA, 22 bp, Artificial Sequence
  Synthetic oligonucleotide; CTT chr11 5398771 5398792 5398776 5398771 -
acttggtggcaggcaagagaga

SEQ ID NO: 112705 - DNA, 22 bp, Artificial Sequence
  Synthetic oligonucleotide; TTA chr11 5398770 5398791 5398775 5398770 -
cttggtggcaggcaagagagag

SEQ ID NO: 112706 - DNA, 22 bp, Artificial Sequence
  Synthetic oligonucleotide; CTT chr11 5398767 5398788 5398772 5398767 -
ggtggcaggcaagagagagtga

SEQ ID NO: 112707 - DNA, 22 bp, Artificial Sequence
  Synthetic oligonucleotide; TTG chr11 5398766 5398787 5398771 5398766 -
gtggcaggcaagagagagtgag

SEQ ID NO: 112708 - DNA, 22 bp, Artificial Sequence
  Synthetic oligonucleotide; CTG chr11 5398726 5398747 5398731 5398726 -
ccttataaaaccatcagatctc

SEQ ID NO: 112709 - DNA, 22 bp, Artificial Sequence
  Synthetic oligonucleotide; CTT chr11 5398722 5398743 5398727 5398722 -
ataaaaccatcagatctcatga

SEQ ID NO: 112710 - DNA, 22 bp, Artificial Sequence
  Synthetic oligonucleotide; TTA chr11 5398721 5398742 5398726 5398721 -
taaaaccatcagatctcatgaa

SEQ ID NO: 112711 - DNA, 22 bp, Artificial Sequence
  Synthetic oligonucleotide; CTC chr11 5398704 5398725 5398709 5398704 -
atgaaaactcactcagtatcac

SEQ ID NO: 112712 - DNA, 22 bp, Artificial Sequence
  Synthetic oligonucleotide; CTC chr11 5398694 5398715 5398699 5398694 -
actcagtatcacgagaactgca

SEQ ID NO: 112713 - DNA, 22 bp, Artificial Sequence
  Synthetic oligonucleotide; CTC chr11 5398690 5398711 5398695 5398690 -
agtatcacgagaactgcatggg

SEQ ID NO: 112714 - DNA, 22 bp, Artificial Sequence
  Synthetic oligonucleotide; CTG chr11 5398674 5398695 5398679 5398674 -
catgggggaaactgctcccatg

SEQ ID NO: 112715 - DNA, 22 bp, Artificial Sequence
  Synthetic oligonucleotide; CTG chr11 5398660 5398681 5398665 5398660 -
ctcccatgatccaataatctcc

SEQ ID NO: 112716 - DNA, 22 bp, Artificial Sequence
  Synthetic oligonucleotide; CTC chr11 5398657 5398678 5398662 5398657 -
ccatgatccaataatctcccac

SEQ ID NO: 112717 - DNA, 22 bp, Artificial Sequence
  Synthetic oligonucleotide; CTC chr11 5398639 5398660 5398644 5398639 -
ccacctggtccctcccccgaca

SEQ ID NO: 112718 - DNA, 22 bp, Artificial Sequence
  Synthetic oligonucleotide; CTG chr11 5398632 5398653 5398637 5398632 -
gtccctcccccgacatataggg

SEQ ID NO: 112719 - DNA, 22 bp, Artificial Sequence
  Synthetic oligonucleotide; CTC chr11 5398625 5398646 5398630 5398625 -
ccccgacatatagggattatgg

SEQ ID NO: 112720 - DNA, 22 bp, Artificial Sequence
  Synthetic oligonucleotide; TTA chr11 5398606 5398627 5398611 5398606 -
tggggattacaattcaatatga

SEQ ID NO: 112721 - DNA, 22 bp, Artificial Sequence
  Synthetic oligonucleotide; TTA chr11 5398597 5398618 5398602 5398597 -
caattcaatatgaaatttgggt

SEQ ID NO: 112722 - DNA, 22 bp, Artificial Sequence
  Synthetic oligonucleotide; TTC chr11 5398591 5398612 5398596 5398591 -
aatatgaaatttgggtggagac

SEQ ID NO: 112723 - DNA, 22 bp, Artificial Sequence
  Synthetic oligonucleotide; TTT chr11 5398579 5398600 5398584 5398579 -
gggtggagacacagagccaagc

SEQ ID NO: 112724 - DNA, 22 bp, Artificial Sequence
  Synthetic oligonucleotide; TTG chr11 5398578 5398599 5398583 5398578 -
ggtggagacacagagccaagcc

SEQ ID NO: 112725 - DNA, 22 bp, Artificial Sequence
  Synthetic oligonucleotide; CTT chr11 5398536 5398557 5398541 5398536 -
gtgcactcaccacaagtgaaac

SEQ ID NO: 112726 - DNA, 22 bp, Artificial Sequence
  Synthetic oligonucleotide; TTG chr11 5398535 5398556 5398540 5398535 -
tgcactcaccacaagtgaaact

SEQ ID NO: 112727 - DNA, 22 bp, Artificial Sequence
  Synthetic oligonucleotide; CTC chr11 5398528 5398549 5398533 5398528 -
accacaagtgaaactggcctct

SEQ ID NO: 112728 - DNA, 22 bp, Artificial Sequence
  Synthetic oligonucleotide; CTG chr11 5398512 5398533 5398517 5398512 -
gcctctgagcctcaggtgggat

SEQ ID NO: 112729 - DNA, 22 bp, Artificial Sequence
  Synthetic oligonucleotide; CTC chr11 5398507 5398528 5398512 5398507 -
tgagcctcaggtgggatgggga

SEQ ID NO: 112730 - DNA, 22 bp, Artificial Sequence
  Synthetic oligonucleotide; CTG chr11 5398505 5398526 5398510 5398505 -
agcctcaggtgggatggggaag

SEQ ID NO: 112731 - DNA, 22 bp, Artificial Sequence
  Synthetic oligonucleotide; CTC chr11 5398499 5398520 5398504 5398499 -
aggtgggatggggaagctcact

SEQ ID NO: 112732 - DNA, 22 bp, Artificial Sequence
  Synthetic oligonucleotide; CTC chr11 5398480 5398501 5398485 5398480 -
acttcagcaagtccctgccact

SEQ ID NO: 112733 - DNA, 22 bp, Artificial Sequence
  Synthetic oligonucleotide; CTT chr11 5398476 5398497 5398481 5398476 -
cagcaagtccctgccactgtgg

SEQ ID NO: 112734 - DNA, 22 bp, Artificial Sequence
  Synthetic oligonucleotide; TTC chr11 5398475 5398496 5398480 5398475 -
agcaagtccctgccactgtggc

SEQ ID NO: 112735 - DNA, 22 bp, Artificial Sequence
  Synthetic oligonucleotide; CTG chr11 5398463 5398484 5398468 5398463 -
ccactgtggcattcatatcttc

SEQ ID NO: 112736 - DNA, 22 bp, Artificial Sequence
  Synthetic oligonucleotide; CTG chr11 5398457 5398478 5398462 5398457 -
tggcattcatatcttcttagtc

SEQ ID NO: 112737 - DNA, 22 bp, Artificial Sequence
  Synthetic oligonucleotide; TTC chr11 5398449 5398470 5398454 5398449 -
atatcttcttagtcctggggct

SEQ ID NO: 112738 - DNA, 22 bp, Artificial Sequence
  Synthetic oligonucleotide; CTT chr11 5398442 5398463 5398447 5398442 -
cttagtcctggggctggaatgc

SEQ ID NO: 112739 - DNA, 22 bp, Artificial Sequence
  Synthetic oligonucleotide; TTC chr11 5398441 5398462 5398446 5398441 -
ttagtcctggggctggaatgct

SEQ ID NO: 112740 - DNA, 22 bp, Artificial Sequence
  Synthetic oligonucleotide; CTT chr11 5398439 5398460 5398444 5398439 -
agtcctggggctggaatgctgc

SEQ ID NO: 112741 - DNA, 22 bp, Artificial Sequence
  Synthetic oligonucleotide; TTA chr11 5398438 5398459 5398443 5398438 -
gtcctggggctggaatgctgcc

SEQ ID NO: 112742 - DNA, 22 bp, Artificial Sequence
  Synthetic oligonucleotide; CTG chr11 5398432 5398453 5398437 5398432 -
gggctggaatgctgcccatttt

SEQ ID NO: 112743 - DNA, 22 bp, Artificial Sequence
  Synthetic oligonucleotide; CTG chr11 5398426 5398447 5398431 5398426 -
gaatgctgcccattttttgaaa

SEQ ID NO: 112744 - DNA, 22 bp, Artificial Sequence
  Synthetic oligonucleotide; CTG chr11 5398418 5398439 5398423 5398418 -
cccattttttgaaaaagctgat

SEQ ID NO: 112745 - DNA, 22 bp, Artificial Sequence
  Synthetic oligonucleotide; TTT chr11 5398411 5398432 5398416 5398411 -
tttgaaaaagctgatcagagtc

SEQ ID NO: 112746 - DNA, 22 bp, Artificial Sequence
  Synthetic oligonucleotide; TTT chr11 5398410 5398431 5398415 5398410 -
ttgaaaaagctgatcagagtct

SEQ ID NO: 112747 - DNA, 22 bp, Artificial Sequence
  Synthetic oligonucleotide; TTT chr11 5398409 5398430 5398414 5398409 -
tgaaaaagctgatcagagtctc

SEQ ID NO: 112748 - DNA, 22 bp, Artificial Sequence
  Synthetic oligonucleotide; TTT chr11 5398408 5398429 5398413 5398408 -
gaaaaagctgatcagagtctct

SEQ ID NO: 112749 - DNA, 22 bp, Artificial Sequence
  Synthetic oligonucleotide; TTG chr11 5398407 5398428 5398412 5398407 -
aaaaagctgatcagagtctcta

SEQ ID NO: 112750 - DNA, 22 bp, Artificial Sequence
  Synthetic oligonucleotide; CTG chr11 5398398 5398419 5398403 5398398 -
atcagagtctctaggagtagag

SEQ ID NO: 112751 - DNA, 22 bp, Artificial Sequence
  Synthetic oligonucleotide; CTC chr11 5398387 5398408 5398392 5398387 -
taggagtagagtaatggggaga

SEQ ID NO: 112752 - DNA, 22 bp, Artificial Sequence
  Synthetic oligonucleotide; CTA chr11 5398385 5398406 5398390 5398385 -
ggagtagagtaatggggagaaa

SEQ ID NO: 112753 - DNA, 22 bp, Artificial Sequence
  Synthetic oligonucleotide; TTA chr11 5398359 5398380 5398364 5398359 -
ggttccctgaggagcaattacc

SEQ ID NO: 112754 - DNA, 22 bp, Artificial Sequence
  Synthetic oligonucleotide; TTC chr11 5398354 5398375 5398359 5398354 -
cctgaggagcaattacccaggt

SEQ ID NO: 112755 - DNA, 22 bp, Artificial Sequence
  Synthetic oligonucleotide; CTG chr11 5398350 5398371 5398355 5398350 -
aggagcaattacccaggtaatt

SEQ ID NO: 112756 - DNA, 22 bp, Artificial Sequence
  Synthetic oligonucleotide; TTA chr11 5398339 5398360 5398344 5398339 -
cccaggtaattacattagcctc

SEQ ID NO: 112757 - DNA, 22 bp, Artificial Sequence
  Synthetic oligonucleotide; TTA chr11 5398327 5398348 5398332 5398327 -
cattagcctctctcaatatcca

SEQ ID NO: 112758 - DNA, 22 bp, Artificial Sequence
  Synthetic oligonucleotide; TTA chr11 5398322 5398343 5398327 5398322 -
gcctctctcaatatccagagaa

SEQ ID NO: 112759 - DNA, 22 bp, Artificial Sequence
  Synthetic oligonucleotide; CTC chr11 5398317 5398338 5398322 5398317 -
tctcaatatccagagaacctaa

SEQ ID NO: 112760 - DNA, 22 bp, Artificial Sequence
  Synthetic oligonucleotide; CTC chr11 5398315 5398336 5398320 5398315 -
tcaatatccagagaacctaagg

SEQ ID NO: 112761 - DNA, 22 bp, Artificial Sequence
  Synthetic oligonucleotide; CTC chr11 5398313 5398334 5398318 5398313 -
aatatccagagaacctaaggga

SEQ ID NO: 112762 - DNA, 22 bp, Artificial Sequence
  Synthetic oligonucleotide; CTA chr11 5398296 5398317 5398301 5398296 -
agggaaacaagcaaagatatag

SEQ ID NO: 112763 - DNA, 22 bp, Artificial Sequence
  Synthetic oligonucleotide; CTT chr11 5398262 5398283 5398267 5398262 -
tgtgaaatgagtgtaatagtat

SEQ ID NO: 112764 - DNA, 22 bp, Artificial Sequence
  Synthetic oligonucleotide; TTT chr11 5398261 5398282 5398266 5398261 -
gtgaaatgagtgtaatagtatt

SEQ ID NO: 112765 - DNA, 22 bp, Artificial Sequence
  Synthetic oligonucleotide; TTG chr11 5398260 5398281 5398265 5398260 -
tgaaatgagtgtaatagtattt

SEQ ID NO: 112766 - DNA, 22 bp, Artificial Sequence
  Synthetic oligonucleotide; TTT chr11 5398238 5398259 5398243 5398238 -
atccagcatatttaaataacta

SEQ ID NO: 112767 - DNA, 22 bp, Artificial Sequence
  Synthetic oligonucleotide; TTA chr11 5398237 5398258 5398242 5398237 -
tccagcatatttaaataactaa

SEQ ID NO: 112768 - DNA, 22 bp, Artificial Sequence
  Synthetic oligonucleotide; TTT chr11 5398225 5398246 5398230 5398225 -
aaataactaatatatgtaaatt

SEQ ID NO: 112769 - DNA, 22 bp, Artificial Sequence
  Synthetic oligonucleotide; TTA chr11 5398224 5398245 5398229 5398224 -
aataactaatatatgtaaattt

SEQ ID NO: 112770 - DNA, 22 bp, Artificial Sequence
  Synthetic oligonucleotide; CTA chr11 5398216 5398237 5398221 5398216 -
atatatgtaaatttcttttttc

SEQ ID NO: 112771 - DNA, 22 bp, Artificial Sequence
  Synthetic oligonucleotide; TTT chr11 5398202 5398223 5398207 5398202 -
cttttttctaacttattttttg

SEQ ID NO: 112772 - DNA, 22 bp, Artificial Sequence
  Synthetic oligonucleotide; TTC chr11 5398201 5398222 5398206 5398201 -
ttttttctaacttattttttgt

SEQ ID NO: 112773 - DNA, 22 bp, Artificial Sequence
  Synthetic oligonucleotide; CTT chr11 5398199 5398220 5398204 5398199 -
ttttctaacttattttttgtta

SEQ ID NO: 112774 - DNA, 22 bp, Artificial Sequence
  Synthetic oligonucleotide; TTT chr11 5398198 5398219 5398203 5398198 -
tttctaacttattttttgttat

SEQ ID NO: 112775 - DNA, 22 bp, Artificial Sequence
  Synthetic oligonucleotide; TTT chr11 5398197 5398218 5398202 5398197 -
ttctaacttattttttgttata

SEQ ID NO: 112776 - DNA, 22 bp, Artificial Sequence
  Synthetic oligonucleotide; TTT chr11 5398196 5398217 5398201 5398196 -
tctaacttattttttgttatac

SEQ ID NO: 112777 - DNA, 22 bp, Artificial Sequence
  Synthetic oligonucleotide; TTT chr11 5398195 5398216 5398200 5398195 -
ctaacttattttttgttatact

SEQ ID NO: 112778 - DNA, 22 bp, Artificial Sequence
  Synthetic oligonucleotide; TTC chr11 5398194 5398215 5398199 5398194 -
taacttattttttgttatactt

SEQ ID NO: 112779 - DNA, 22 bp, Artificial Sequence
  Synthetic oligonucleotide; CTA chr11 5398192 5398213 5398197 5398192 -
acttattttttgttatactttt

SEQ ID NO: 112780 - DNA, 22 bp, Artificial Sequence
  Synthetic oligonucleotide; CTT chr11 5398188 5398209 5398193 5398188 -
attttttgttatacttttaagt

SEQ ID NO: 112781 - DNA, 22 bp, Artificial Sequence
  Synthetic oligonucleotide; TTA chr11 5398187 5398208 5398192 5398187 -
ttttttgttatacttttaagtt

SEQ ID NO: 112782 - DNA, 22 bp, Artificial Sequence
  Synthetic oligonucleotide; TTT chr11 5398184 5398205 5398189 5398184 -
tttgttatacttttaagtttta

SEQ ID NO: 112783 - DNA, 22 bp, Artificial Sequence
  Synthetic oligonucleotide; TTT chr11 5398183 5398204 5398188 5398183 -
ttgttatacttttaagttttag

SEQ ID NO: 112784 - DNA, 22 bp, Artificial Sequence
  Synthetic oligonucleotide; TTT chr11 5398182 5398203 5398187 5398182 -
tgttatacttttaagttttagg

SEQ ID NO: 112785 - DNA, 22 bp, Artificial Sequence
  Synthetic oligonucleotide; TTT chr11 5398181 5398202 5398186 5398181 -
gttatacttttaagttttaggg

SEQ ID NO: 112786 - DNA, 22 bp, Artificial Sequence
  Synthetic oligonucleotide; TTG chr11 5398180 5398201 5398185 5398180 -
ttatacttttaagttttagggt

SEQ ID NO: 112787 - DNA, 22 bp, Artificial Sequence
  Synthetic oligonucleotide; TTA chr11 5398177 5398198 5398182 5398177 -
tacttttaagttttagggtaca

SEQ ID NO: 112788 - DNA, 22 bp, Artificial Sequence
  Synthetic oligonucleotide; CTT chr11 5398172 5398193 5398177 5398172 -
ttaagttttagggtacatgtgc

SEQ ID NO: 112789 - DNA, 22 bp, Artificial Sequence
  Synthetic oligonucleotide; TTT chr11 5398171 5398192 5398176 5398171 -
taagttttagggtacatgtgca

SEQ ID NO: 112790 - DNA, 22 bp, Artificial Sequence
  Synthetic oligonucleotide; TTT chr11 5398170 5398191 5398175 5398170 -
aagttttagggtacatgtgcac

SEQ ID NO: 112791 - DNA, 22 bp, Artificial Sequence
  Synthetic oligonucleotide; TTA chr11 5398169 5398190 5398174 5398169 -
agttttagggtacatgtgcaca

SEQ ID NO: 112792 - DNA, 22 bp, Artificial Sequence
  Synthetic oligonucleotide; TTT chr11 5398164 5398185 5398169 5398164 -
tagggtacatgtgcacaaggtg

SEQ ID NO: 112793 - DNA, 22 bp, Artificial Sequence
  Synthetic oligonucleotide; TTT chr11 5398163 5398184 5398168 5398163 -
agggtacatgtgcacaaggtgc

SEQ ID NO: 112794 - DNA, 22 bp, Artificial Sequence
  Synthetic oligonucleotide; TTA chr11 5398162 5398183 5398167 5398162 -
gggtacatgtgcacaaggtgca

SEQ ID NO: 112795 - DNA, 22 bp, Artificial Sequence
  Synthetic oligonucleotide; TTA chr11 5398135 5398156 5398140 5398135 -
gttacatatgtatacatgtgcc

SEQ ID NO: 112796 - DNA, 22 bp, Artificial Sequence
  Synthetic oligonucleotide; TTA chr11 5398131 5398152 5398136 5398131 -
catatgtatacatgtgccatgt

SEQ ID NO: 112797 - DNA, 22 bp, Artificial Sequence
  Synthetic oligonucleotide; TTG chr11 5398107 5398128 5398112 5398107 -
gtgtgctgcacccattaactca

SEQ ID NO: 112798 - DNA, 22 bp, Artificial Sequence
  Synthetic oligonucleotide; CTG chr11 5398099 5398120 5398104 5398099 -
cacccattaactcaccatttaa

SEQ ID NO: 112799 - DNA, 22 bp, Artificial Sequence
  Synthetic oligonucleotide; TTA chr11 5398090 5398111 5398095 5398090 -
actcaccatttaacattaggta

SEQ ID NO: 112800 - DNA, 22 bp, Artificial Sequence
  Synthetic oligonucleotide; CTC chr11 5398086 5398107 5398091 5398086 -
accatttaacattaggtatatc

SEQ ID NO: 112801 - DNA, 22 bp, Artificial Sequence
  Synthetic oligonucleotide; TTT chr11 5398079 5398100 5398084 5398079 -
aacattaggtatatctcctaat

SEQ ID NO: 112802 - DNA, 22 bp, Artificial Sequence
  Synthetic oligonucleotide; TTA chr11 5398078 5398099 5398083 5398078 -
acattaggtatatctcctaatg

SEQ ID NO: 112803 - DNA, 22 bp, Artificial Sequence
  Synthetic oligonucleotide; TTA chr11 5398072 5398093 5398077 5398072 -
ggtatatctcctaatgctatcc

SEQ ID NO: 112804 - DNA, 22 bp, Artificial Sequence
  Synthetic oligonucleotide; CTC chr11 5398062 5398083 5398067 5398062 -
ctaatgctatccctgccccctc

SEQ ID NO: 112805 - DNA, 22 bp, Artificial Sequence
  Synthetic oligonucleotide; CTA chr11 5398059 5398080 5398064 5398059 -
atgctatccctgccccctcctc

SEQ ID NO: 112806 - DNA, 22 bp, Artificial Sequence
  Synthetic oligonucleotide; CTA chr11 5398053 5398074 5398058 5398053 -
tccctgccccctcctcccaccc

SEQ ID NO: 112807 - DNA, 22 bp, Artificial Sequence
  Synthetic oligonucleotide; CTG chr11 5398047 5398068 5398052 5398047 -
ccccctcctcccaccccacaac

SEQ ID NO: 112808 - DNA, 22 bp, Artificial Sequence
  Synthetic oligonucleotide; CTC chr11 5398040 5398061 5398045 5398040 -
ctcccaccccacaacaggcccc

SEQ ID NO: 112809 - DNA, 22 bp, Artificial Sequence
  Synthetic oligonucleotide; CTC chr11 5398037 5398058 5398042 5398037 -
ccaccccacaacaggccccggt

SEQ ID NO: 112810 - DNA, 22 bp, Artificial Sequence
  Synthetic oligonucleotide; TTC chr11 5398004 5398025 5398009 5398004 -
cccttcctgtgtccatgtgttc

SEQ ID NO: 112811 - DNA, 22 bp, Artificial Sequence
  Synthetic oligonucleotide; CTT chr11 5397999 5398020 5398004 5397999 -
cctgtgtccatgtgttctcatt

SEQ ID NO: 112812 - DNA, 22 bp, Artificial Sequence
  Synthetic oligonucleotide; TTC chr11 5397998 5398019 5398003 5397998 -
ctgtgtccatgtgttctcattg

SEQ ID NO: 112813 - DNA, 22 bp, Artificial Sequence
  Synthetic oligonucleotide; CTG chr11 5397995 5398016 5398000 5397995 -
tgtccatgtgttctcattgttc

SEQ ID NO: 112814 - DNA, 22 bp, Artificial Sequence
  Synthetic oligonucleotide; TTC chr11 5397982 5398003 5397987 5397982 -
tcattgttcagttcccacctat

SEQ ID NO: 112815 - DNA, 22 bp, Artificial Sequence
  Synthetic oligonucleotide; CTC chr11 5397980 5398001 5397985 5397980 -
attgttcagttcccacctatga

SEQ ID NO: 112816 - DNA, 22 bp, Artificial Sequence
  Synthetic oligonucleotide; TTG chr11 5397976 5397997 5397981 5397976 -
ttcagttcccacctatgagtga

SEQ ID NO: 112817 - DNA, 22 bp, Artificial Sequence
  Synthetic oligonucleotide; TTC chr11 5397973 5397994 5397978 5397973 -
agttcccacctatgagtgagaa

SEQ ID NO: 112818 - DNA, 22 bp, Artificial Sequence
  Synthetic oligonucleotide; TTC chr11 5397968 5397989 5397973 5397968 -
ccacctatgagtgagaacatgt

SEQ ID NO: 112819 - DNA, 22 bp, Artificial Sequence
  Synthetic oligonucleotide; CTA chr11 5397961 5397982 5397966 5397961 -
tgagtgagaacatgtggtgttt

SEQ ID NO: 112820 - DNA, 22 bp, Artificial Sequence
  Synthetic oligonucleotide; TTT chr11 5397939 5397960 5397944 5397939 -
ggctttttgtccttgtgatagt

SEQ ID NO: 112821 - DNA, 22 bp, Artificial Sequence
  Synthetic oligonucleotide; TTG chr11 5397938 5397959 5397943 5397938 -
gctttttgtccttgtgatagtt

SEQ ID NO: 112822 - DNA, 22 bp, Artificial Sequence
  Synthetic oligonucleotide; CTT chr11 5397934 5397955 5397939 5397934 -
tttgtccttgtgatagtttgct

SEQ ID NO: 112823 - DNA, 22 bp, Artificial Sequence
  Synthetic oligonucleotide; TTT chr11 5397933 5397954 5397938 5397933 -
ttgtccttgtgatagtttgctg

SEQ ID NO: 112824 - DNA, 22 bp, Artificial Sequence
  Synthetic oligonucleotide; TTT chr11 5397932 5397953 5397937 5397932 -
tgtccttgtgatagtttgctga

SEQ ID NO: 112825 - DNA, 22 bp, Artificial Sequence
  Synthetic oligonucleotide; TTT chr11 5397931 5397952 5397936 5397931 -
gtccttgtgatagtttgctgag

SEQ ID NO: 112826 - DNA, 22 bp, Artificial Sequence
  Synthetic oligonucleotide; TTG chr11 5397930 5397951 5397935 5397930 -
tccttgtgatagtttgctgaga

SEQ ID NO: 112827 - DNA, 22 bp, Artificial Sequence
  Synthetic oligonucleotide; CTT chr11 5397925 5397946 5397930 5397925 -
gtgatagtttgctgagaatgat

SEQ ID NO: 112828 - DNA, 22 bp, Artificial Sequence
  Synthetic oligonucleotide; TTG chr11 5397924 5397945 5397929 5397924 -
tgatagtttgctgagaatgatg

SEQ ID NO: 112829 - DNA, 22 bp, Artificial Sequence
  Synthetic oligonucleotide; TTT chr11 5397915 5397936 5397920 5397915 -
gctgagaatgatggtttccagc

SEQ ID NO: 112830 - DNA, 22 bp, Artificial Sequence
  Synthetic oligonucleotide; TTG chr11 5397914 5397935 5397919 5397914 -
ctgagaatgatggtttccagct

SEQ ID NO: 112831 - DNA, 22 bp, Artificial Sequence
  Synthetic oligonucleotide; CTG chr11 5397911 5397932 5397916 5397911 -
agaatgatggtttccagcttca

SEQ ID NO: 112832 - DNA, 22 bp, Artificial Sequence
  Synthetic oligonucleotide; TTT chr11 5397898 5397919 5397903 5397898 -
ccagcttcatccatgtccctac

SEQ ID NO: 112833 - DNA, 22 bp, Artificial Sequence
  Synthetic oligonucleotide; TTC chr11 5397897 5397918 5397902 5397897 -
cagcttcatccatgtccctaca

SEQ ID NO: 112834 - DNA, 22 bp, Artificial Sequence
  Synthetic oligonucleotide; CTT chr11 5397891 5397912 5397896 5397891 -
catccatgtccctacaaaggac

SEQ ID NO: 112835 - DNA, 22 bp, Artificial Sequence
  Synthetic oligonucleotide; TTC chr11 5397890 5397911 5397895 5397890 -
atccatgtccctacaaaggaca

SEQ ID NO: 112836 - DNA, 22 bp, Artificial Sequence
  Synthetic oligonucleotide; CTA chr11 5397877 5397898 5397882 5397877 -
caaaggacatgaactcatcatt

SEQ ID NO: 112837 - DNA, 22 bp, Artificial Sequence
  Synthetic oligonucleotide; CTC chr11 5397861 5397882 5397866 5397861 -
atcattttttatggctgcatag

SEQ ID NO: 112838 - DNA, 22 bp, Artificial Sequence
  Synthetic oligonucleotide; TTT chr11 5397854 5397875 5397859 5397854 -
tttatggctgcatagtattcca

SEQ ID NO: 112839 - DNA, 22 bp, Artificial Sequence
  Synthetic oligonucleotide; TTT chr11 5397853 5397874 5397858 5397853 -
ttatggctgcatagtattccat

SEQ ID NO: 112840 - DNA, 22 bp, Artificial Sequence
  Synthetic oligonucleotide; TTT chr11 5397852 5397873 5397857 5397852 -
tatggctgcatagtattccatg

SEQ ID NO: 112841 - DNA, 22 bp, Artificial Sequence
  Synthetic oligonucleotide; TTT chr11 5397851 5397872 5397856 5397851 -
atggctgcatagtattccatgg

SEQ ID NO: 112842 - DNA, 22 bp, Artificial Sequence
  Synthetic oligonucleotide; TTA chr11 5397850 5397871 5397855 5397850 -
tggctgcatagtattccatggt

SEQ ID NO: 112843 - DNA, 22 bp, Artificial Sequence
  Synthetic oligonucleotide; CTG chr11 5397844 5397865 5397849 5397844 -
catagtattccatggtgtatat

SEQ ID NO: 112844 - DNA, 22 bp, Artificial Sequence
  Synthetic oligonucleotide; TTC chr11 5397834 5397855 5397839 5397834 -
catggtgtatatgtgccacatt

SEQ ID NO: 112845 - DNA, 22 bp, Artificial Sequence
  Synthetic oligonucleotide; TTT chr11 5397811 5397832 5397816 5397811 -
tcttaatccagtctatcattgt

SEQ ID NO: 112846 - DNA, 22 bp, Artificial Sequence
  Synthetic oligonucleotide; TTT chr11 5397810 5397831 5397815 5397810 -
cttaatccagtctatcattgtt

SEQ ID NO: 112847 - DNA, 22 bp, Artificial Sequence
  Synthetic oligonucleotide; TTC chr11 5397809 5397830 5397814 5397809 -
ttaatccagtctatcattgttg

SEQ ID NO: 112848 - DNA, 22 bp, Artificial Sequence
  Synthetic oligonucleotide; CTT chr11 5397807 5397828 5397812 5397807 -
aatccagtctatcattgttgga

SEQ ID NO: 112849 - DNA, 22 bp, Artificial Sequence
  Synthetic oligonucleotide; TTA chr11 5397806 5397827 5397811 5397806 -
atccagtctatcattgttggac

SEQ ID NO: 112850 - DNA, 22 bp, Artificial Sequence
  Synthetic oligonucleotide; CTA chr11 5397796 5397817 5397801 5397796 -
tcattgttggacatttgggttg

SEQ ID NO: 112851 - DNA, 22 bp, Artificial Sequence
  Synthetic oligonucleotide; TTG chr11 5397790 5397811 5397795 5397790 -
ttggacatttgggttggttcca

SEQ ID NO: 112852 - DNA, 22 bp, Artificial Sequence
  Synthetic oligonucleotide; TTG chr11 5397787 5397808 5397792 5397787 -
gacatttgggttggttccaagt

SEQ ID NO: 112853 - DNA, 22 bp, Artificial Sequence
  Synthetic oligonucleotide; TTT chr11 5397780 5397801 5397785 5397780 -
gggttggttccaagtctttgct

SEQ ID NO: 112854 - DNA, 22 bp, Artificial Sequence
  Synthetic oligonucleotide; TTG chr11 5397779 5397800 5397784 5397779 -
ggttggttccaagtctttgcta

SEQ ID NO: 112855 - DNA, 22 bp, Artificial Sequence
  Synthetic oligonucleotide; TTG chr11 5397774 5397795 5397779 5397774 -
gttccaagtctttgctattgtg

SEQ ID NO: 112856 - DNA, 22 bp, Artificial Sequence
  Synthetic oligonucleotide; TTC chr11 5397770 5397791 5397775 5397770 -
caagtctttgctattgtgaata

SEQ ID NO: 112857 - DNA, 22 bp, Artificial Sequence
  Synthetic oligonucleotide; CTT chr11 5397762 5397783 5397767 5397762 -
tgctattgtgaatagtgccgca

SEQ ID NO: 112858 - DNA, 22 bp, Artificial Sequence
  Synthetic oligonucleotide; TTT chr11 5397761 5397782 5397766 5397761 -
gctattgtgaatagtgccgcaa

SEQ ID NO: 112859 - DNA, 22 bp, Artificial Sequence
  Synthetic oligonucleotide; TTG chr11 5397760 5397781 5397765 5397760 -
ctattgtgaatagtgccgcaat

SEQ ID NO: 112860 - DNA, 22 bp, Artificial Sequence
  Synthetic oligonucleotide; CTA chr11 5397757 5397778 5397762 5397757 -
ttgtgaatagtgccgcaataaa

SEQ ID NO: 112861 - DNA, 22 bp, Artificial Sequence
  Synthetic oligonucleotide; TTG chr11 5397754 5397775 5397759 5397754 -
tgaatagtgccgcaataaacat

SEQ ID NO: 112862 - DNA, 22 bp, Artificial Sequence
  Synthetic oligonucleotide; CTT chr11 5397715 5397736 5397720 5397715 -
tatagcagcatgatttataatc

SEQ ID NO: 112863 - DNA, 22 bp, Artificial Sequence
  Synthetic oligonucleotide; TTT chr11 5397714 5397735 5397719 5397714 -
atagcagcatgatttataatcc

SEQ ID NO: 112864 - DNA, 22 bp, Artificial Sequence
  Synthetic oligonucleotide; TTA chr11 5397713 5397734 5397718 5397713 -
tagcagcatgatttataatcct

SEQ ID NO: 112865 - DNA, 22 bp, Artificial Sequence
  Synthetic oligonucleotide; TTT chr11 5397699 5397720 5397704 5397699 -
ataatcctttgggtgtataccc

SEQ ID NO: 112866 - DNA, 22 bp, Artificial Sequence
  Synthetic oligonucleotide; TTA chr11 5397698 5397719 5397703 5397698 -
taatcctttgggtgtataccca

SEQ ID NO: 112867 - DNA, 22 bp, Artificial Sequence
  Synthetic oligonucleotide; CTT chr11 5397690 5397711 5397695 5397690 -
tgggtgtatacccagtaatggg

SEQ ID NO: 112868 - DNA, 22 bp, Artificial Sequence
  Synthetic oligonucleotide; TTT chr11 5397689 5397710 5397694 5397689 -
gggtgtatacccagtaatggga

SEQ ID NO: 112869 - DNA, 22 bp, Artificial Sequence
  Synthetic oligonucleotide; TTG chr11 5397688 5397709 5397693 5397688 -
ggtgtatacccagtaatgggat

SEQ ID NO: 112870 - DNA, 22 bp, Artificial Sequence
  Synthetic oligonucleotide; CTG chr11 5397661 5397682 5397666 5397661 -
ggtcaaatggtatttctagttc

SEQ ID NO: 112871 - DNA, 22 bp, Artificial Sequence
  Synthetic oligonucleotide; TTT chr11 5397646 5397667 5397651 5397646 -
ctagttctagatccctgaggaa

SEQ ID NO: 112872 - DNA, 22 bp, Artificial Sequence
  Synthetic oligonucleotide; TTC chr11 5397645 5397666 5397650 5397645 -
tagttctagatccctgaggaat

SEQ ID NO: 112873 - DNA, 22 bp, Artificial Sequence
  Synthetic oligonucleotide; CTA chr11 5397643 5397664 5397648 5397643 -
gttctagatccctgaggaatca

SEQ ID NO: 112874 - DNA, 22 bp, Artificial Sequence
  Synthetic oligonucleotide; TTC chr11 5397639 5397660 5397644 5397639 -
tagatccctgaggaatcaccac

SEQ ID NO: 112875 - DNA, 22 bp, Artificial Sequence
  Synthetic oligonucleotide; CTA chr11 5397637 5397658 5397642 5397637 -
gatccctgaggaatcaccacac

SEQ ID NO: 112876 - DNA, 22 bp, Artificial Sequence
  Synthetic oligonucleotide; CTG chr11 5397629 5397650 5397634 5397629 -
aggaatcaccacactgacttcc

SEQ ID NO: 112877 - DNA, 22 bp, Artificial Sequence
  Synthetic oligonucleotide; CTG chr11 5397613 5397634 5397618 5397613 -
acttccacaatgtttgaactag

SEQ ID NO: 112878 - DNA, 22 bp, Artificial Sequence
  Synthetic oligonucleotide; CTT chr11 5397609 5397630 5397614 5397609 -
ccacaatgtttgaactagttta

SEQ ID NO: 112879 - DNA, 22 bp, Artificial Sequence
  Synthetic oligonucleotide; TTC chr11 5397608 5397629 5397613 5397608 -
cacaatgtttgaactagtttac

SEQ ID NO: 112880 - DNA, 22 bp, Artificial Sequence
  Synthetic oligonucleotide; TTT chr11 5397598 5397619 5397603 5397598 -
gaactagtttacagtcccacca

SEQ ID NO: 112881 - DNA, 22 bp, Artificial Sequence
  Synthetic oligonucleotide; TTG chr11 5397597 5397618 5397602 5397597 -
aactagtttacagtcccaccaa

SEQ ID NO: 112882 - DNA, 22 bp, Artificial Sequence
  Synthetic oligonucleotide; CTA chr11 5397592 5397613 5397597 5397592 -
gtttacagtcccaccaacagtg

SEQ ID NO: 112883 - DNA, 22 bp, Artificial Sequence
  Synthetic oligonucleotide; TTT chr11 5397588 5397609 5397593 5397588 -
acagtcccaccaacagtgtaaa

SEQ ID NO: 112884 - DNA, 22 bp, Artificial Sequence
  Synthetic oligonucleotide; TTA chr11 5397587 5397608 5397592 5397587 -
cagtcccaccaacagtgtaaaa

SEQ ID NO: 112885 - DNA, 22 bp, Artificial Sequence
  Synthetic oligonucleotide; TTC chr11 5397559 5397580 5397564 5397559 -
ctatttctccacatcctctcca

SEQ ID NO: 112886 - DNA, 22 bp, Artificial Sequence
  Synthetic oligonucleotide; CTA chr11 5397556 5397577 5397561 5397556 -
tttctccacatcctctccagca

SEQ ID NO: 112887 - DNA, 22 bp, Artificial Sequence
  Synthetic oligonucleotide; TTT chr11 5397553 5397574 5397558 5397553 -
ctccacatcctctccagcacct

SEQ ID NO: 112888 - DNA, 22 bp, Artificial Sequence
  Synthetic oligonucleotide; TTC chr11 5397552 5397573 5397557 5397552 -
tccacatcctctccagcacctg

SEQ ID NO: 112889 - DNA, 22 bp, Artificial Sequence
  Synthetic oligonucleotide; CTC chr11 5397550 5397571 5397555 5397550 -
cacatcctctccagcacctgtt

SEQ ID NO: 112890 - DNA, 22 bp, Artificial Sequence
  Synthetic oligonucleotide; CTC chr11 5397541 5397562 5397546 5397541 -
tccagcacctgttgtttcctga

SEQ ID NO: 112891 - DNA, 22 bp, Artificial Sequence
  Synthetic oligonucleotide; CTC chr11 5397539 5397560 5397544 5397539 -
cagcacctgttgtttcctgact

SEQ ID NO: 112892 - DNA, 22 bp, Artificial Sequence
  Synthetic oligonucleotide; CTG chr11 5397530 5397551 5397535 5397530 -
ttgtttcctgactttttaatga

SEQ ID NO: 112893 - DNA, 22 bp, Artificial Sequence
  Synthetic oligonucleotide; TTG chr11 5397527 5397548 5397532 5397527 -
tttcctgactttttaatgattg

SEQ ID NO: 112894 - DNA, 22 bp, Artificial Sequence
  Synthetic oligonucleotide; TTT chr11 5397524 5397545 5397529 5397524 -
cctgactttttaatgattgcca

SEQ ID NO: 112895 - DNA, 22 bp, Artificial Sequence
  Synthetic oligonucleotide; TTC chr11 5397523 5397544 5397528 5397523 -
ctgactttttaatgattgccat

SEQ ID NO: 112896 - DNA, 22 bp, Artificial Sequence
  Synthetic oligonucleotide; CTG chr11 5397520 5397541 5397525 5397520 -
actttttaatgattgccattct

SEQ ID NO: 112897 - DNA, 22 bp, Artificial Sequence
  Synthetic oligonucleotide; CTT chr11 5397516 5397537 5397521 5397516 -
tttaatgattgccattctaact

SEQ ID NO: 112898 - DNA, 22 bp, Artificial Sequence
  Synthetic oligonucleotide; TTT chr11 5397515 5397536 5397520 5397515 -
ttaatgattgccattctaactg

SEQ ID NO: 112899 - DNA, 22 bp, Artificial Sequence
  Synthetic oligonucleotide; TTT chr11 5397514 5397535 5397519 5397514 -
taatgattgccattctaactgg

SEQ ID NO: 112900 - DNA, 22 bp, Artificial Sequence
  Synthetic oligonucleotide; TTT chr11 5397513 5397534 5397518 5397513 -
aatgattgccattctaactggt

SEQ ID NO: 112901 - DNA, 22 bp, Artificial Sequence
  Synthetic oligonucleotide; TTA chr11 5397512 5397533 5397517 5397512 -
atgattgccattctaactggtg

SEQ ID NO: 112902 - DNA, 22 bp, Artificial Sequence
  Synthetic oligonucleotide; TTG chr11 5397505 5397526 5397510 5397505 -
ccattctaactggtgtgagatg

SEQ ID NO: 112903 - DNA, 22 bp, Artificial Sequence
  Synthetic oligonucleotide; TTC chr11 5397499 5397520 5397504 5397499 -
taactggtgtgagatggtatct

SEQ ID NO: 112904 - DNA, 22 bp, Artificial Sequence
  Synthetic oligonucleotide; CTA chr11 5397497 5397518 5397502 5397497 -
actggtgtgagatggtatctca

SEQ ID NO: 112905 - DNA, 22 bp, Artificial Sequence
  Synthetic oligonucleotide; CTG chr11 5397493 5397514 5397498 5397493 -
gtgtgagatggtatctcattgt

SEQ ID NO: 112906 - DNA, 22 bp, Artificial Sequence
  Synthetic oligonucleotide; CTC chr11 5397476 5397497 5397481 5397476 -
attgtggttttgatttgcattt

SEQ ID NO: 112907 - DNA, 22 bp, Artificial Sequence
  Synthetic oligonucleotide; TTG chr11 5397472 5397493 5397477 5397472 -
tggttttgatttgcatttctct

SEQ ID NO: 112908 - DNA, 22 bp, Artificial Sequence
  Synthetic oligonucleotide; TTT chr11 5397466 5397487 5397471 5397466 -
tgatttgcatttctctgatggc

SEQ ID NO: 112909 - DNA, 22 bp, Artificial Sequence
  Synthetic oligonucleotide; TTT chr11 5397465 5397486 5397470 5397465 -
gatttgcatttctctgatggcc

SEQ ID NO: 112910 - DNA, 22 bp, Artificial Sequence
  Synthetic oligonucleotide; TTG chr11 5397464 5397485 5397469 5397464 -
atttgcatttctctgatggcca

SEQ ID NO: 112911 - DNA, 22 bp, Artificial Sequence
  Synthetic oligonucleotide; TTT chr11 5397460 5397481 5397465 5397460 -
gcatttctctgatggccagtga

SEQ ID NO: 112912 - DNA, 22 bp, Artificial Sequence
  Synthetic oligonucleotide; TTG chr11 5397459 5397480 5397464 5397459 -
catttctctgatggccagtgat

SEQ ID NO: 112913 - DNA, 22 bp, Artificial Sequence
  Synthetic oligonucleotide; TTT chr11 5397454 5397475 5397459 5397454 -
ctctgatggccagtgatgatga

SEQ ID NO: 112914 - DNA, 22 bp, Artificial Sequence
  Synthetic oligonucleotide; TTC chr11 5397453 5397474 5397458 5397453 -
tctgatggccagtgatgatgag

SEQ ID NO: 112915 - DNA, 22 bp, Artificial Sequence
  Synthetic oligonucleotide; CTC chr11 5397451 5397472 5397456 5397451 -
tgatggccagtgatgatgagca

SEQ ID NO: 112916 - DNA, 22 bp, Artificial Sequence
  Synthetic oligonucleotide; CTG chr11 5397449 5397470 5397454 5397449 -
atggccagtgatgatgagcatt

SEQ ID NO: 112917 - DNA, 22 bp, Artificial Sequence
  Synthetic oligonucleotide; TTT chr11 5397426 5397447 5397431 5397426 -
tttcatgtgtcttttggctgca

SEQ ID NO: 112918 - DNA, 22 bp, Artificial Sequence
  Synthetic oligonucleotide; TTT chr11 5397425 5397446 5397430 5397425 -
ttcatgtgtcttttggctgcat

SEQ ID NO: 112919 - DNA, 22 bp, Artificial Sequence
  Synthetic oligonucleotide; TTT chr11 5397424 5397445 5397429 5397424 -
tcatgtgtcttttggctgcata

SEQ ID NO: 112920 - DNA, 22 bp, Artificial Sequence
  Synthetic oligonucleotide; TTT chr11 5397423 5397444 5397428 5397423 -
catgtgtcttttggctgcataa

SEQ ID NO: 112921 - DNA, 22 bp, Artificial Sequence
  Synthetic oligonucleotide; TTC chr11 5397422 5397443 5397427 5397422 -
atgtgtcttttggctgcataaa

SEQ ID NO: 112922 - DNA, 22 bp, Artificial Sequence
  Synthetic oligonucleotide; CTT chr11 5397413 5397434 5397418 5397413 -
ttggctgcataaatgtcttctt

SEQ ID NO: 112923 - DNA, 22 bp, Artificial Sequence
  Synthetic oligonucleotide; TTT chr11 5397412 5397433 5397417 5397412 -
tggctgcataaatgtcttcttt

SEQ ID NO: 112924 - DNA, 22 bp, Artificial Sequence
  Synthetic oligonucleotide; TTT chr11 5397411 5397432 5397416 5397411 -
ggctgcataaatgtcttctttt

SEQ ID NO: 112925 - DNA, 22 bp, Artificial Sequence
  Synthetic oligonucleotide; TTG chr11 5397410 5397431 5397415 5397410 -
gctgcataaatgtcttcttttg

SEQ ID NO: 112926 - DNA, 22 bp, Artificial Sequence
  Synthetic oligonucleotide; CTG chr11 5397406 5397427 5397411 5397406 -
cataaatgtcttcttttgagaa

SEQ ID NO: 112927 - DNA, 22 bp, Artificial Sequence
  Synthetic oligonucleotide; CTT chr11 5397394 5397415 5397399 5397394 -
cttttgagaagtgtctgttcat

SEQ ID NO: 112928 - DNA, 22 bp, Artificial Sequence
  Synthetic oligonucleotide; TTC chr11 5397393 5397414 5397398 5397393 -
ttttgagaagtgtctgttcata

SEQ ID NO: 112929 - DNA, 22 bp, Artificial Sequence
  Synthetic oligonucleotide; CTT chr11 5397391 5397412 5397396 5397391 -
ttgagaagtgtctgttcatatc

SEQ ID NO: 112930 - DNA, 22 bp, Artificial Sequence
  Synthetic oligonucleotide; TTT chr11 5397390 5397411 5397395 5397390 -
tgagaagtgtctgttcatatcc

SEQ ID NO: 112931 - DNA, 22 bp, Artificial Sequence
  Synthetic oligonucleotide; TTT chr11 5397389 5397410 5397394 5397389 -
gagaagtgtctgttcatatcct

SEQ ID NO: 112932 - DNA, 22 bp, Artificial Sequence
  Synthetic oligonucleotide; TTG chr11 5397388 5397409 5397393 5397388 -
agaagtgtctgttcatatcctt

SEQ ID NO: 112933 - DNA, 22 bp, Artificial Sequence
  Synthetic oligonucleotide; CTG chr11 5397377 5397398 5397382 5397377 -
ttcatatcctttgcccactttt

SEQ ID NO: 112934 - DNA, 22 bp, Artificial Sequence
  Synthetic oligonucleotide; TTC chr11 5397374 5397395 5397379 5397374 -
atatcctttgcccactttttga

SEQ ID NO: 112935 - DNA, 22 bp, Artificial Sequence
  Synthetic oligonucleotide; CTT chr11 5397366 5397387 5397371 5397366 -
tgcccactttttgatggggttt

SEQ ID NO: 112936 - DNA, 22 bp, Artificial Sequence
  Synthetic oligonucleotide; TTT chr11 5397365 5397386 5397370 5397365 -
gcccactttttgatggggtttt

SEQ ID NO: 112937 - DNA, 22 bp, Artificial Sequence
  Synthetic oligonucleotide; TTG chr11 5397364 5397385 5397369 5397364 -
cccactttttgatggggttttt

SEQ ID NO: 112938 - DNA, 22 bp, Artificial Sequence
  Synthetic oligonucleotide; CTT chr11 5397357 5397378 5397362 5397357 -
tttgatggggttttttttctct

SEQ ID NO: 112939 - DNA, 22 bp, Artificial Sequence
  Synthetic oligonucleotide; TTT chr11 5397356 5397377 5397361 5397356 -
ttgatggggttttttttctctt

SEQ ID NO: 112940 - DNA, 22 bp, Artificial Sequence
  Synthetic oligonucleotide; TTT chr11 5397355 5397376 5397360 5397355 -
tgatggggttttttttctcttg

SEQ ID NO: 112941 - DNA, 22 bp, Artificial Sequence
  Synthetic oligonucleotide; TTT chr11 5397354 5397375 5397359 5397354 -
gatggggttttttttctcttgt

SEQ ID NO: 112942 - DNA, 22 bp, Artificial Sequence
  Synthetic oligonucleotide; TTG chr11 5397353 5397374 5397358 5397353 -
atggggttttttttctcttgta

SEQ ID NO: 112943 - DNA, 22 bp, Artificial Sequence
  Synthetic oligonucleotide; TTT chr11 5397344 5397365 5397349 5397344 -
tttttctcttgtaaatttgttt

SEQ ID NO: 112944 - DNA, 22 bp, Artificial Sequence
  Synthetic oligonucleotide; TTT chr11 5397343 5397364 5397348 5397343 -
ttttctcttgtaaatttgtttg

SEQ ID NO: 112945 - DNA, 22 bp, Artificial Sequence
  Synthetic oligonucleotide; TTT chr11 5397342 5397363 5397347 5397342 -
tttctcttgtaaatttgtttga

SEQ ID NO: 112946 - DNA, 22 bp, Artificial Sequence
  Synthetic oligonucleotide; TTT chr11 5397341 5397362 5397346 5397341 -
ttctcttgtaaatttgtttgag

SEQ ID NO: 112947 - DNA, 22 bp, Artificial Sequence
  Synthetic oligonucleotide; TTT chr11 5397340 5397361 5397345 5397340 -
tctcttgtaaatttgtttgagt

SEQ ID NO: 112948 - DNA, 22 bp, Artificial Sequence
  Synthetic oligonucleotide; TTT chr11 5397339 5397360 5397344 5397339 -
ctcttgtaaatttgtttgagtt

SEQ ID NO: 112949 - DNA, 22 bp, Artificial Sequence
  Synthetic oligonucleotide; TTC chr11 5397338 5397359 5397343 5397338 -
tcttgtaaatttgtttgagttc

SEQ ID NO: 112950 - DNA, 22 bp, Artificial Sequence
  Synthetic oligonucleotide; CTC chr11 5397336 5397357 5397341 5397336 -
ttgtaaatttgtttgagttcat

SEQ ID NO: 112951 - DNA, 22 bp, Artificial Sequence
  Synthetic oligonucleotide; CTT chr11 5397334 5397355 5397339 5397334 -
gtaaatttgtttgagttcattg

SEQ ID NO: 112952 - DNA, 22 bp, Artificial Sequence
  Synthetic oligonucleotide; TTG chr11 5397333 5397354 5397338 5397333 -
taaatttgtttgagttcattgt

SEQ ID NO: 112953 - DNA, 22 bp, Artificial Sequence
  Synthetic oligonucleotide; TTT chr11 5397326 5397347 5397331 5397326 -
gtttgagttcattgtagattct

SEQ ID NO: 112954 - DNA, 22 bp, Artificial Sequence
  Synthetic oligonucleotide; TTG chr11 5397325 5397346 5397330 5397325 -
tttgagttcattgtagattctg

SEQ ID NO: 112955 - DNA, 22 bp, Artificial Sequence
  Synthetic oligonucleotide; TTT chr11 5397322 5397343 5397327 5397322 -
gagttcattgtagattctggat

SEQ ID NO: 112956 - DNA, 22 bp, Artificial Sequence
  Synthetic oligonucleotide; TTG chr11 5397321 5397342 5397326 5397321 -
agttcattgtagattctggata

SEQ ID NO: 112957 - DNA, 22 bp, Artificial Sequence
  Synthetic oligonucleotide; TTC chr11 5397316 5397337 5397321 5397316 -
attgtagattctggatattagc

SEQ ID NO: 112958 - DNA, 22 bp, Artificial Sequence
  Synthetic oligonucleotide; TTG chr11 5397312 5397333 5397317 5397312 -
tagattctggatattagccctt

SEQ ID NO: 112959 - DNA, 22 bp, Artificial Sequence
  Synthetic oligonucleotide; TTC chr11 5397305 5397326 5397310 5397305 -
tggatattagccctttgtcaga

SEQ ID NO: 112960 - DNA, 22 bp, Artificial Sequence
  Synthetic oligonucleotide; CTG chr11 5397303 5397324 5397308 5397303 -
gatattagccctttgtcagatg

SEQ ID NO: 112961 - DNA, 22 bp, Artificial Sequence
  Synthetic oligonucleotide; TTA chr11 5397296 5397317 5397301 5397296 -
gccctttgtcagatgagtagat

SEQ ID NO: 112962 - DNA, 22 bp, Artificial Sequence
  Synthetic oligonucleotide; CTT chr11 5397290 5397311 5397295 5397290 -
tgtcagatgagtagattgcaaa

SEQ ID NO: 112963 - DNA, 22 bp, Artificial Sequence
  Synthetic oligonucleotide; TTT chr11 5397289 5397310 5397294 5397289 -
gtcagatgagtagattgcaaaa

SEQ ID NO: 112964 - DNA, 22 bp, Artificial Sequence
  Synthetic oligonucleotide; TTG chr11 5397288 5397309 5397293 5397288 -
tcagatgagtagattgcaaaaa

SEQ ID NO: 112965 - DNA, 22 bp, Artificial Sequence
  Synthetic oligonucleotide; TTG chr11 5397272 5397293 5397277 5397272 -
caaaaattttctcccattgtgt

SEQ ID NO: 112966 - DNA, 22 bp, Artificial Sequence
  Synthetic oligonucleotide; TTT chr11 5397263 5397284 5397268 5397263 -
tctcccattgtgtaggttgcct

SEQ ID NO: 112967 - DNA, 22 bp, Artificial Sequence
  Synthetic oligonucleotide; TTT chr11 5397262 5397283 5397267 5397262 -
ctcccattgtgtaggttgcctg

SEQ ID NO: 112968 - DNA, 22 bp, Artificial Sequence
  Synthetic oligonucleotide; TTC chr11 5397261 5397282 5397266 5397261 -
tcccattgtgtaggttgcctgt

SEQ ID NO: 112969 - DNA, 22 bp, Artificial Sequence
  Synthetic oligonucleotide; CTC chr11 5397259 5397280 5397264 5397259 -
ccattgtgtaggttgcctgttc

SEQ ID NO: 112970 - DNA, 22 bp, Artificial Sequence
  Synthetic oligonucleotide; TTG chr11 5397253 5397274 5397258 5397253 -
tgtaggttgcctgttcactctg

SEQ ID NO: 112971 - DNA, 22 bp, Artificial Sequence
  Synthetic oligonucleotide; TTG chr11 5397244 5397265 5397249 5397244 -
cctgttcactctgatggtagtt

SEQ ID NO: 112972 - DNA, 22 bp, Artificial Sequence
  Synthetic oligonucleotide; CTG chr11 5397240 5397261 5397245 5397240 -
ttcactctgatggtagtttctt

SEQ ID NO: 112973 - DNA, 22 bp, Artificial Sequence
  Synthetic oligonucleotide; TTC chr11 5397237 5397258 5397242 5397237 -
actctgatggtagtttcttttg

SEQ ID NO: 112974 - DNA, 22 bp, Artificial Sequence
  Synthetic oligonucleotide; CTC chr11 5397233 5397254 5397238 5397233 -
tgatggtagtttcttttgctgt

SEQ ID NO: 112975 - DNA, 22 bp, Artificial Sequence
  Synthetic oligonucleotide; CTG chr11 5397231 5397252 5397236 5397231 -
atggtagtttcttttgctgtgc

SEQ ID NO: 112976 - DNA, 22 bp, Artificial Sequence
  Synthetic oligonucleotide; TTT chr11 5397221 5397242 5397226 5397221 -
cttttgctgtgcagaagatctt

SEQ ID NO: 112977 - DNA, 22 bp, Artificial Sequence
  Synthetic oligonucleotide; TTC chr11 5397220 5397241 5397225 5397220 -
ttttgctgtgcagaagatcttt

SEQ ID NO: 112978 - DNA, 22 bp, Artificial Sequence
  Synthetic oligonucleotide; CTT chr11 5397218 5397239 5397223 5397218 -
ttgctgtgcagaagatctttag

SEQ ID NO: 112979 - DNA, 22 bp, Artificial Sequence
  Synthetic oligonucleotide; TTT chr11 5397217 5397238 5397222 5397217 -
tgctgtgcagaagatctttagt

SEQ ID NO: 112980 - DNA, 22 bp, Artificial Sequence
  Synthetic oligonucleotide; TTT chr11 5397216 5397237 5397221 5397216 -
gctgtgcagaagatctttagtt

SEQ ID NO: 112981 - DNA, 22 bp, Artificial Sequence
  Synthetic oligonucleotide; TTG chr11 5397215 5397236 5397220 5397215 -
ctgtgcagaagatctttagttt

SEQ ID NO: 112982 - DNA, 22 bp, Artificial Sequence
  Synthetic oligonucleotide; CTG chr11 5397212 5397233 5397217 5397212 -
tgcagaagatctttagtttaat

SEQ ID NO: 112983 - DNA, 22 bp, Artificial Sequence
  Synthetic oligonucleotide; CTT chr11 5397199 5397220 5397204 5397199 -
tagtttaattagatcccattag

SEQ ID NO: 112984 - DNA, 22 bp, Artificial Sequence
  Synthetic oligonucleotide; TTT chr11 5397198 5397219 5397203 5397198 -
agtttaattagatcccattagt

SEQ ID NO: 112985 - DNA, 22 bp, Artificial Sequence
  Synthetic oligonucleotide; TTA chr11 5397197 5397218 5397202 5397197 -
gtttaattagatcccattagtg

SEQ ID NO: 112986 - DNA, 22 bp, Artificial Sequence
  Synthetic oligonucleotide; TTT chr11 5397193 5397214 5397198 5397193 -
aattagatcccattagtgaatt

SEQ ID NO: 112987 - DNA, 22 bp, Artificial Sequence
  Synthetic oligonucleotide; TTA chr11 5397192 5397213 5397197 5397192 -
attagatcccattagtgaattt

SEQ ID NO: 112988 - DNA, 22 bp, Artificial Sequence
  Synthetic oligonucleotide; TTA chr11 5397188 5397209 5397193 5397188 -
gatcccattagtgaattttggc

SEQ ID NO: 112989 - DNA, 22 bp, Artificial Sequence
  Synthetic oligonucleotide; TTA chr11 5397178 5397199 5397183 5397178 -
gtgaattttggcttttgttgcc

SEQ ID NO: 112990 - DNA, 22 bp, Artificial Sequence
  Synthetic oligonucleotide; TTT chr11 5397170 5397191 5397175 5397170 -
tggcttttgttgccattgcttt

SEQ ID NO: 112991 - DNA, 22 bp, Artificial Sequence
  Synthetic oligonucleotide; TTT chr11 5397169 5397190 5397174 5397169 -
ggcttttgttgccattgctttt

SEQ ID NO: 112992 - DNA, 22 bp, Artificial Sequence
  Synthetic oligonucleotide; TTG chr11 5397168 5397189 5397173 5397168 -
gcttttgttgccattgcttttg

SEQ ID NO: 112993 - DNA, 22 bp, Artificial Sequence
  Synthetic oligonucleotide; CTT chr11 5397164 5397185 5397169 5397164 -
ttgttgccattgcttttggtgt

SEQ ID NO: 112994 - DNA, 22 bp, Artificial Sequence
  Synthetic oligonucleotide; TTT chr11 5397163 5397184 5397168 5397163 -
tgttgccattgcttttggtgtt

SEQ ID NO: 112995 - DNA, 22 bp, Artificial Sequence
  Synthetic oligonucleotide; TTT chr11 5397162 5397183 5397167 5397162 -
gttgccattgcttttggtgttt

SEQ ID NO: 112996 - DNA, 22 bp, Artificial Sequence
  Synthetic oligonucleotide; TTG chr11 5397161 5397182 5397166 5397161 -
ttgccattgcttttggtgtttt

SEQ ID NO: 112997 - DNA, 22 bp, Artificial Sequence
  Synthetic oligonucleotide; TTG chr11 5397158 5397179 5397163 5397158 -
ccattgcttttggtgttttaga

SEQ ID NO: 112998 - DNA, 22 bp, Artificial Sequence
  Synthetic oligonucleotide; TTG chr11 5397152 5397173 5397157 5397152 -
cttttggtgttttagacatgaa

SEQ ID NO: 112999 - DNA, 22 bp, Artificial Sequence
  Synthetic oligonucleotide; CTT chr11 5397149 5397170 5397154 5397149 -
ttggtgttttagacatgaagtc

SEQ ID NO: 113000 - DNA, 22 bp, Artificial Sequence
  Synthetic oligonucleotide; TTT chr11 5397148 5397169 5397153 5397148 -
tggtgttttagacatgaagtcc

SEQ ID NO: 113001 - DNA, 22 bp, Artificial Sequence
  Synthetic oligonucleotide; TTT chr11 5397147 5397168 5397152 5397147 -
ggtgttttagacatgaagtcca

SEQ ID NO: 113002 - DNA, 22 bp, Artificial Sequence
  Synthetic oligonucleotide; TTG chr11 5397146 5397167 5397151 5397146 -
gtgttttagacatgaagtccat

SEQ ID NO: 113003 - DNA, 22 bp, Artificial Sequence
  Synthetic oligonucleotide; TTT chr11 5397140 5397161 5397145 5397140 -
tagacatgaagtccatgcccat

SEQ ID NO: 113004 - DNA, 22 bp, Artificial Sequence
  Synthetic oligonucleotide; TTT chr11 5397139 5397160 5397144 5397139 -
agacatgaagtccatgcccatg

SEQ ID NO: 113005 - DNA, 22 bp, Artificial Sequence
  Synthetic oligonucleotide; TTA chr11 5397138 5397159 5397143 5397138 -
gacatgaagtccatgcccatgc

SEQ ID NO: 113006 - DNA, 22 bp, Artificial Sequence
  Synthetic oligonucleotide; CTA chr11 5397113 5397134 5397118 5397113 -
tgtcctgaatggtattgcttag

SEQ ID NO: 113007 - DNA, 22 bp, Artificial Sequence
  Synthetic oligonucleotide; CTG chr11 5397106 5397127 5397111 5397106 -
aatggtattgcttaggttttct

SEQ ID NO: 113008 - DNA, 22 bp, Artificial Sequence
  Synthetic oligonucleotide; TTG chr11 5397096 5397117 5397101 5397096 -
cttaggttttcttctagagttt

SEQ ID NO: 113009 - DNA, 22 bp, Artificial Sequence
  Synthetic oligonucleotide; CTT chr11 5397093 5397114 5397098 5397093 -
aggttttcttctagagttttta

SEQ ID NO: 113010 - DNA, 22 bp, Artificial Sequence
  Synthetic oligonucleotide; TTA chr11 5397092 5397113 5397097 5397092 -
ggttttcttctagagtttttat

SEQ ID NO: 113011 - DNA, 22 bp, Artificial Sequence
  Synthetic oligonucleotide; TTT chr11 5397087 5397108 5397092 5397087 -
tcttctagagtttttatggttt

SEQ ID NO: 113012 - DNA, 22 bp, Artificial Sequence
  Synthetic oligonucleotide; TTT chr11 5397086 5397107 5397091 5397086 -
cttctagagtttttatggtttt

SEQ ID NO: 113013 - DNA, 22 bp, Artificial Sequence
  Synthetic oligonucleotide; TTC chr11 5397085 5397106 5397090 5397085 -
ttctagagtttttatggtttta

SEQ ID NO: 113014 - DNA, 22 bp, Artificial Sequence
  Synthetic oligonucleotide; CTT chr11 5397083 5397104 5397088 5397083 -
ctagagtttttatggttttagg

SEQ ID NO: 113015 - DNA, 22 bp, Artificial Sequence
  Synthetic oligonucleotide; TTC chr11 5397082 5397103 5397087 5397082 -
tagagtttttatggttttaggt

SEQ ID NO: 113016 - DNA, 22 bp, Artificial Sequence
  Synthetic oligonucleotide; CTA chr11 5397080 5397101 5397085 5397080 -
gagtttttatggttttaggtct

SEQ ID NO: 113017 - DNA, 22 bp, Artificial Sequence
  Synthetic oligonucleotide; TTT chr11 5397074 5397095 5397079 5397074 -
ttatggttttaggtctaacatt

SEQ ID NO: 113018 - DNA, 22 bp, Artificial Sequence
  Synthetic oligonucleotide; TTT chr11 5397073 5397094 5397078 5397073 -
tatggttttaggtctaacattt

SEQ ID NO: 113019 - DNA, 22 bp, Artificial Sequence
  Synthetic oligonucleotide; TTT chr11 5397072 5397093 5397077 5397072 -
atggttttaggtctaacattta

SEQ ID NO: 113020 - DNA, 22 bp, Artificial Sequence
  Synthetic oligonucleotide; TTA chr11 5397071 5397092 5397076 5397071 -
tggttttaggtctaacatttaa

SEQ ID NO: 113021 - DNA, 22 bp, Artificial Sequence
  Synthetic oligonucleotide; TTT chr11 5397065 5397086 5397070 5397065 -
taggtctaacatttaagtcttt

SEQ ID NO: 113022 - DNA, 22 bp, Artificial Sequence
  Synthetic oligonucleotide; TTT chr11 5397064 5397085 5397069 5397064 -
aggtctaacatttaagtcttta

SEQ ID NO: 113023 - DNA, 22 bp, Artificial Sequence
  Synthetic oligonucleotide; TTA chr11 5397063 5397084 5397068 5397063 -
ggtctaacatttaagtctttaa

SEQ ID NO: 113024 - DNA, 22 bp, Artificial Sequence
  Synthetic oligonucleotide; CTA chr11 5397057 5397078 5397062 5397057 -
acatttaagtctttaatccatc

SEQ ID NO: 113025 - DNA, 22 bp, Artificial Sequence
  Synthetic oligonucleotide; TTT chr11 5397051 5397072 5397056 5397051 -
aagtctttaatccatcttgagt

SEQ ID NO: 113026 - DNA, 22 bp, Artificial Sequence
  Synthetic oligonucleotide; TTA chr11 5397050 5397071 5397055 5397050 -
agtctttaatccatcttgagtt

SEQ ID NO: 113027 - DNA, 22 bp, Artificial Sequence
  Synthetic oligonucleotide; CTT chr11 5397044 5397065 5397049 5397044 -
taatccatcttgagttaatttt

SEQ ID NO: 113028 - DNA, 22 bp, Artificial Sequence
  Synthetic oligonucleotide; TTT chr11 5397043 5397064 5397048 5397043 -
aatccatcttgagttaattttt

SEQ ID NO: 113029 - DNA, 22 bp, Artificial Sequence
  Synthetic oligonucleotide; TTA chr11 5397042 5397063 5397047 5397042 -
atccatcttgagttaatttttg

SEQ ID NO: 113030 - DNA, 22 bp, Artificial Sequence
  Synthetic oligonucleotide; CTT chr11 5397033 5397054 5397038 5397033 -
gagttaatttttgtataaggtg

SEQ ID NO: 113031 - DNA, 22 bp, Artificial Sequence
  Synthetic oligonucleotide; TTG chr11 5397032 5397053 5397037 5397032 -
agttaatttttgtataaggtgt

SEQ ID NO: 113032 - DNA, 22 bp, Artificial Sequence
  Synthetic oligonucleotide; TTA chr11 5397027 5397048 5397032 5397027 -
atttttgtataaggtgtaagga

SEQ ID NO: 113033 - DNA, 22 bp, Artificial Sequence
  Synthetic oligonucleotide; TTT chr11 5397023 5397044 5397028 5397023 -
ttgtataaggtgtaaggaaggg

SEQ ID NO: 113034 - DNA, 22 bp, Artificial Sequence
  Synthetic oligonucleotide; TTT chr11 5397022 5397043 5397027 5397022 -
tgtataaggtgtaaggaaggga

SEQ ID NO: 113035 - DNA, 22 bp, Artificial Sequence
  Synthetic oligonucleotide; TTT chr11 5397021 5397042 5397026 5397021 -
gtataaggtgtaaggaagggat

SEQ ID NO: 113036 - DNA, 22 bp, Artificial Sequence
  Synthetic oligonucleotide; TTG chr11 5397020 5397041 5397025 5397020 -
tataaggtgtaaggaagggatc

SEQ ID NO: 113037 - DNA, 22 bp, Artificial Sequence
  Synthetic oligonucleotide; TTT chr11 5396992 5397013 5396997 5396992 -
cagcttcctacatttggctagc

SEQ ID NO: 113038 - DNA, 22 bp, Artificial Sequence
  Synthetic oligonucleotide; TTC chr11 5396991 5397012 5396996 5396991 -
agcttcctacatttggctagcc

SEQ ID NO: 113039 - DNA, 22 bp, Artificial Sequence
  Synthetic oligonucleotide; CTT chr11 5396986 5397007 5396991 5396986 -
cctacatttggctagccagttt

SEQ ID NO: 113040 - DNA, 22 bp, Artificial Sequence
  Synthetic oligonucleotide; TTC chr11 5396985 5397006 5396990 5396985 -
ctacatttggctagccagtttt

SEQ ID NO: 113041 - DNA, 22 bp, Artificial Sequence
  Synthetic oligonucleotide; CTA chr11 5396982 5397003 5396987 5396982 -
catttggctagccagttttccc

SEQ ID NO: 113042 - DNA, 22 bp, Artificial Sequence
  Synthetic oligonucleotide; TTT chr11 5396977 5396998 5396982 5396977 -
ggctagccagttttcccagcac

SEQ ID NO: 113043 - DNA, 22 bp, Artificial Sequence
  Synthetic oligonucleotide; TTG chr11 5396976 5396997 5396981 5396976 -
gctagccagttttcccagcacc

SEQ ID NO: 113044 - DNA, 22 bp, Artificial Sequence
  Synthetic oligonucleotide; CTA chr11 5396972 5396993 5396977 5396972 -
gccagttttcccagcaccattt

SEQ ID NO: 113045 - DNA, 22 bp, Artificial Sequence
  Synthetic oligonucleotide; TTT chr11 5396964 5396985 5396969 5396964 -
tcccagcaccatttattaaaca

SEQ ID NO: 113046 - DNA, 22 bp, Artificial Sequence
  Synthetic oligonucleotide; TTT chr11 5396963 5396984 5396968 5396963 -
cccagcaccatttattaaacag

SEQ ID NO: 113047 - DNA, 22 bp, Artificial Sequence
  Synthetic oligonucleotide; TTC chr11 5396962 5396983 5396967 5396962 -
ccagcaccatttattaaacagg

SEQ ID NO: 113048 - DNA, 22 bp, Artificial Sequence
  Synthetic oligonucleotide; TTT chr11 5396950 5396971 5396955 5396950 -
attaaacagggaatcctttccc

SEQ ID NO: 113049 - DNA, 22 bp, Artificial Sequence
  Synthetic oligonucleotide; TTA chr11 5396949 5396970 5396954 5396949 -
ttaaacagggaatcctttcccc

SEQ ID NO: 113050 - DNA, 22 bp, Artificial Sequence
  Synthetic oligonucleotide; TTA chr11 5396946 5396967 5396951 5396946 -
aacagggaatcctttccccatt

SEQ ID NO: 113051 - DNA, 22 bp, Artificial Sequence
  Synthetic oligonucleotide; CTT chr11 5396932 5396953 5396937 5396932 -
tccccatttcttgtttttctca

SEQ ID NO: 113052 - DNA, 22 bp, Artificial Sequence
  Synthetic oligonucleotide; TTT chr11 5396931 5396952 5396936 5396931 -
ccccatttcttgtttttctcag

SEQ ID NO: 113053 - DNA, 22 bp, Artificial Sequence
  Synthetic oligonucleotide; TTC chr11 5396930 5396951 5396935 5396930 -
cccatttcttgtttttctcagg

SEQ ID NO: 113054 - DNA, 22 bp, Artificial Sequence
  Synthetic oligonucleotide; TTT chr11 5396923 5396944 5396928 5396923 -
cttgtttttctcaggtttgtca

SEQ ID NO: 113055 - DNA, 22 bp, Artificial Sequence
  Synthetic oligonucleotide; TTC chr11 5396922 5396943 5396927 5396922 -
ttgtttttctcaggtttgtcaa

SEQ ID NO: 113056 - DNA, 22 bp, Artificial Sequence
  Synthetic oligonucleotide; CTT chr11 5396920 5396941 5396925 5396920 -
gtttttctcaggtttgtcaaag

SEQ ID NO: 113057 - DNA, 22 bp, Artificial Sequence
  Synthetic oligonucleotide; TTG chr11 5396919 5396940 5396924 5396919 -
tttttctcaggtttgtcaaaga

SEQ ID NO: 113058 - DNA, 22 bp, Artificial Sequence
  Synthetic oligonucleotide; TTT chr11 5396916 5396937 5396921 5396916 -
ttctcaggtttgtcaaagatca

SEQ ID NO: 113059 - DNA, 22 bp, Artificial Sequence
  Synthetic oligonucleotide; TTT chr11 5396915 5396936 5396920 5396915 -
tctcaggtttgtcaaagatcag

SEQ ID NO: 113060 - DNA, 22 bp, Artificial Sequence
  Synthetic oligonucleotide; TTT chr11 5396914 5396935 5396919 5396914 -
ctcaggtttgtcaaagatcaga

SEQ ID NO: 113061 - DNA, 22 bp, Artificial Sequence
  Synthetic oligonucleotide; TTC chr11 5396913 5396934 5396918 5396913 -
tcaggtttgtcaaagatcagat

SEQ ID NO: 113062 - DNA, 22 bp, Artificial Sequence
  Synthetic oligonucleotide; CTC chr11 5396911 5396932 5396916 5396911 -
aggtttgtcaaagatcagatag

SEQ ID NO: 113063 - DNA, 22 bp, Artificial Sequence
  Synthetic oligonucleotide; TTT chr11 5396905 5396926 5396910 5396905 -
gtcaaagatcagatagttgtag

SEQ ID NO: 113064 - DNA, 22 bp, Artificial Sequence
  Synthetic oligonucleotide; TTG chr11 5396904 5396925 5396909 5396904 -
tcaaagatcagatagttgtaga

SEQ ID NO: 113065 - DNA, 22 bp, Artificial Sequence
  Synthetic oligonucleotide; TTG chr11 5396886 5396907 5396891 5396886 -
tagatagacagcattatttctg

SEQ ID NO: 113066 - DNA, 22 bp, Artificial Sequence
  Synthetic oligonucleotide; TTA chr11 5396870 5396891 5396875 5396870 -
tttctgagggctctgttttgtt

SEQ ID NO: 113067 - DNA, 22 bp, Artificial Sequence
  Synthetic oligonucleotide; TTT chr11 5396867 5396888 5396872 5396867 -
ctgagggctctgttttgttcca

SEQ ID NO: 113068 - DNA, 22 bp, Artificial Sequence
  Synthetic oligonucleotide; TTC chr11 5396866 5396887 5396871 5396866 -
tgagggctctgttttgttccat

SEQ ID NO: 113069 - DNA, 22 bp, Artificial Sequence
  Synthetic oligonucleotide; CTG chr11 5396864 5396885 5396869 5396864 -
agggctctgttttgttccattg

SEQ ID NO: 113070 - DNA, 22 bp, Artificial Sequence
  Synthetic oligonucleotide; CTC chr11 5396857 5396878 5396862 5396857 -
tgttttgttccattggtctata

SEQ ID NO: 113071 - DNA, 22 bp, Artificial Sequence
  Synthetic oligonucleotide; CTG chr11 5396855 5396876 5396860 5396855 -
ttttgttccattggtctatatc

SEQ ID NO: 113072 - DNA, 22 bp, Artificial Sequence
  Synthetic oligonucleotide; TTT chr11 5396852 5396873 5396857 5396852 -
tgttccattggtctatatctct

SEQ ID NO: 113073 - DNA, 22 bp, Artificial Sequence
  Synthetic oligonucleotide; TTT chr11 5396851 5396872 5396856 5396851 -
gttccattggtctatatctctg

SEQ ID NO: 113074 - DNA, 22 bp, Artificial Sequence
  Synthetic oligonucleotide; TTG chr11 5396850 5396871 5396855 5396850 -
ttccattggtctatatctctgt

SEQ ID NO: 113075 - DNA, 22 bp, Artificial Sequence
  Synthetic oligonucleotide; TTC chr11 5396847 5396868 5396852 5396847 -
cattggtctatatctctgtttt

SEQ ID NO: 113076 - DNA, 22 bp, Artificial Sequence
  Synthetic oligonucleotide; TTG chr11 5396842 5396863 5396847 5396842 -
gtctatatctctgttttggtac

SEQ ID NO: 113077 - DNA, 22 bp, Artificial Sequence
  Synthetic oligonucleotide; CTA chr11 5396837 5396858 5396842 5396837 -
tatctctgttttggtaccagta

SEQ ID NO: 113078 - DNA, 22 bp, Artificial Sequence
  Synthetic oligonucleotide; CTC chr11 5396831 5396852 5396836 5396831 -
tgttttggtaccagtactatgc

SEQ ID NO: 113079 - DNA, 22 bp, Artificial Sequence
  Synthetic oligonucleotide; CTG chr11 5396829 5396850 5396834 5396829 -
ttttggtaccagtactatgctg

SEQ ID NO: 113080 - DNA, 22 bp, Artificial Sequence
  Synthetic oligonucleotide; TTT chr11 5396826 5396847 5396831 5396826 -
tggtaccagtactatgctgttt

SEQ ID NO: 113081 - DNA, 22 bp, Artificial Sequence
  Synthetic oligonucleotide; TTT chr11 5396825 5396846 5396830 5396825 -
ggtaccagtactatgctgtttt

SEQ ID NO: 113082 - DNA, 22 bp, Artificial Sequence
  Synthetic oligonucleotide; TTG chr11 5396824 5396845 5396829 5396824 -
gtaccagtactatgctgttttg

SEQ ID NO: 113083 - DNA, 22 bp, Artificial Sequence
  Synthetic oligonucleotide; CTA chr11 5396812 5396833 5396817 5396812 -
tgctgttttggttactgtagcc

SEQ ID NO: 113084 - DNA, 22 bp, Artificial Sequence
  Synthetic oligonucleotide; CTG chr11 5396807 5396828 5396812 5396807 -
ttttggttactgtagccttgta

SEQ ID NO: 113085 - DNA, 22 bp, Artificial Sequence
  Synthetic oligonucleotide; TTT chr11 5396804 5396825 5396809 5396804 -
tggttactgtagccttgtagta

SEQ ID NO: 113086 - DNA, 22 bp, Artificial Sequence
  Synthetic oligonucleotide; TTT chr11 5396803 5396824 5396808 5396803 -
ggttactgtagccttgtagtat

SEQ ID NO: 113087 - DNA, 22 bp, Artificial Sequence
  Synthetic oligonucleotide; TTG chr11 5396802 5396823 5396807 5396802 -
gttactgtagccttgtagtata

SEQ ID NO: 113088 - DNA, 22 bp, Artificial Sequence
  Synthetic oligonucleotide; TTA chr11 5396798 5396819 5396803 5396798 -
ctgtagccttgtagtatagttt

SEQ ID NO: 113089 - DNA, 22 bp, Artificial Sequence
  Synthetic oligonucleotide; CTG chr11 5396795 5396816 5396800 5396795 -
tagccttgtagtatagtttgaa

SEQ ID NO: 113090 - DNA, 22 bp, Artificial Sequence
  Synthetic oligonucleotide; CTT chr11 5396788 5396809 5396793 5396788 -
gtagtatagtttgaaatcaggt

SEQ ID NO: 113091 - DNA, 22 bp, Artificial Sequence
  Synthetic oligonucleotide; TTG chr11 5396787 5396808 5396792 5396787 -
tagtatagtttgaaatcaggta

SEQ ID NO: 113092 - DNA, 22 bp, Artificial Sequence
  Synthetic oligonucleotide; TTT chr11 5396776 5396797 5396781 5396776 -
gaaatcaggtagtgtgatgcct

SEQ ID NO: 113093 - DNA, 22 bp, Artificial Sequence
  Synthetic oligonucleotide; TTG chr11 5396775 5396796 5396780 5396775 -
aaatcaggtagtgtgatgcctc

SEQ ID NO: 113094 - DNA, 22 bp, Artificial Sequence
  Synthetic oligonucleotide; CTC chr11 5396753 5396774 5396758 5396753 -
cagctttgttcttttggcttag

SEQ ID NO: 113095 - DNA, 22 bp, Artificial Sequence
  Synthetic oligonucleotide; CTT chr11 5396747 5396768 5396752 5396747 -
tgttcttttggcttaggattga

SEQ ID NO: 113096 - DNA, 22 bp, Artificial Sequence
  Synthetic oligonucleotide; TTT chr11 5396746 5396767 5396751 5396746 -
gttcttttggcttaggattgac

SEQ ID NO: 113097 - DNA, 22 bp, Artificial Sequence
  Synthetic oligonucleotide; TTG chr11 5396745 5396766 5396750 5396745 -
ttcttttggcttaggattgact

SEQ ID NO: 113098 - DNA, 22 bp, Artificial Sequence
  Synthetic oligonucleotide; TTC chr11 5396742 5396763 5396747 5396742 -
ttttggcttaggattgacttgg

SEQ ID NO: 113099 - DNA, 22 bp, Artificial Sequence
  Synthetic oligonucleotide; CTT chr11 5396740 5396761 5396745 5396740 -
ttggcttaggattgacttggcg

SEQ ID NO: 113100 - DNA, 22 bp, Artificial Sequence
  Synthetic oligonucleotide; TTT chr11 5396739 5396760 5396744 5396739 -
tggcttaggattgacttggcga

SEQ ID NO: 113101 - DNA, 22 bp, Artificial Sequence
  Synthetic oligonucleotide; TTT chr11 5396738 5396759 5396743 5396738 -
ggcttaggattgacttggcgat

SEQ ID NO: 113102 - DNA, 22 bp, Artificial Sequence
  Synthetic oligonucleotide; TTG chr11 5396737 5396758 5396742 5396737 -
gcttaggattgacttggcgatg

SEQ ID NO: 113103 - DNA, 22 bp, Artificial Sequence
  Synthetic oligonucleotide; CTT chr11 5396733 5396754 5396738 5396733 -
aggattgacttggcgatgcggg

SEQ ID NO: 113104 - DNA, 22 bp, Artificial Sequence
  Synthetic oligonucleotide; TTA chr11 5396732 5396753 5396737 5396732 -
ggattgacttggcgatgcgggc

SEQ ID NO: 113105 - DNA, 22 bp, Artificial Sequence
  Synthetic oligonucleotide; TTG chr11 5396726 5396747 5396731 5396726 -
acttggcgatgcgggctctttt

SEQ ID NO: 113106 - DNA, 22 bp, Artificial Sequence
  Synthetic oligonucleotide; CTT chr11 5396722 5396743 5396727 5396722 -
ggcgatgcgggctcttttttgg

SEQ ID NO: 113107 - DNA, 22 bp, Artificial Sequence
  Synthetic oligonucleotide; TTG chr11 5396721 5396742 5396726 5396721 -
gcgatgcgggctcttttttggt

SEQ ID NO: 113108 - DNA, 22 bp, Artificial Sequence
  Synthetic oligonucleotide; CTC chr11 5396708 5396729 5396713 5396708 -
ttttttggttccatatgaactt

SEQ ID NO: 113109 - DNA, 22 bp, Artificial Sequence
  Synthetic oligonucleotide; CTT chr11 5396706 5396727 5396711 5396706 -
ttttggttccatatgaacttta

SEQ ID NO: 113110 - DNA, 22 bp, Artificial Sequence
  Synthetic oligonucleotide; TTT chr11 5396705 5396726 5396710 5396705 -
tttggttccatatgaactttaa

SEQ ID NO: 113111 - DNA, 22 bp, Artificial Sequence
  Synthetic oligonucleotide; TTT chr11 5396704 5396725 5396709 5396704 -
ttggttccatatgaactttaaa

SEQ ID NO: 113112 - DNA, 22 bp, Artificial Sequence
  Synthetic oligonucleotide; TTT chr11 5396703 5396724 5396708 5396703 -
tggttccatatgaactttaaag

SEQ ID NO: 113113 - DNA, 22 bp, Artificial Sequence
  Synthetic oligonucleotide; TTT chr11 5396702 5396723 5396707 5396702 -
ggttccatatgaactttaaagt

SEQ ID NO: 113114 - DNA, 22 bp, Artificial Sequence
  Synthetic oligonucleotide; TTG chr11 5396701 5396722 5396706 5396701 -
gttccatatgaactttaaagta

SEQ ID NO: 113115 - DNA, 22 bp, Artificial Sequence
  Synthetic oligonucleotide; TTC chr11 5396697 5396718 5396702 5396697 -
catatgaactttaaagtagttt

SEQ ID NO: 113116 - DNA, 22 bp, Artificial Sequence
  Synthetic oligonucleotide; CTT chr11 5396686 5396707 5396691 5396686 -
taaagtagttttttccaattct

SEQ ID NO: 113117 - DNA, 22 bp, Artificial Sequence
  Synthetic oligonucleotide; TTT chr11 5396685 5396706 5396690 5396685 -
aaagtagttttttccaattctg

SEQ ID NO: 113118 - DNA, 22 bp, Artificial Sequence
  Synthetic oligonucleotide; TTA chr11 5396684 5396705 5396689 5396684 -
aagtagttttttccaattctgt

SEQ ID NO: 113119 - DNA, 22 bp, Artificial Sequence
  Synthetic oligonucleotide; TTT chr11 5396675 5396696 5396680 5396675 -
tttccaattctgtgaagaaagt

SEQ ID NO: 113120 - DNA, 22 bp, Artificial Sequence
  Synthetic oligonucleotide; TTT chr11 5396674 5396695 5396679 5396674 -
ttccaattctgtgaagaaagtc

SEQ ID NO: 113121 - DNA, 22 bp, Artificial Sequence
  Synthetic oligonucleotide; TTT chr11 5396673 5396694 5396678 5396673 -
tccaattctgtgaagaaagtca

SEQ ID NO: 113122 - DNA, 22 bp, Artificial Sequence
  Synthetic oligonucleotide; TTT chr11 5396672 5396693 5396677 5396672 -
ccaattctgtgaagaaagtcat

SEQ ID NO: 113123 - DNA, 22 bp, Artificial Sequence
  Synthetic oligonucleotide; TTC chr11 5396671 5396692 5396676 5396671 -
caattctgtgaagaaagtcatt

SEQ ID NO: 113124 - DNA, 22 bp, Artificial Sequence
  Synthetic oligonucleotide; TTC chr11 5396665 5396686 5396670 5396665 -
tgtgaagaaagtcattggtagc

SEQ ID NO: 113125 - DNA, 22 bp, Artificial Sequence
  Synthetic oligonucleotide; CTG chr11 5396663 5396684 5396668 5396663 -
tgaagaaagtcattggtagctt

SEQ ID NO: 113126 - DNA, 22 bp, Artificial Sequence
  Synthetic oligonucleotide; TTG chr11 5396648 5396669 5396653 5396648 -
gtagcttgatggggatggcatt

SEQ ID NO: 113127 - DNA, 22 bp, Artificial Sequence
  Synthetic oligonucleotide; CTT chr11 5396641 5396662 5396646 5396641 -
gatggggatggcattgaatcta

SEQ ID NO: 113128 - DNA, 22 bp, Artificial Sequence
  Synthetic oligonucleotide; TTG chr11 5396640 5396661 5396645 5396640 -
atggggatggcattgaatctat

SEQ ID NO: 113129 - DNA, 22 bp, Artificial Sequence
  Synthetic oligonucleotide; TTG chr11 5396625 5396646 5396630 5396625 -
aatctataaattaccttgggca

SEQ ID NO: 113130 - DNA, 22 bp, Artificial Sequence
  Synthetic oligonucleotide; CTA chr11 5396619 5396640 5396624 5396619 -
taaattaccttgggcagtatgg

SEQ ID NO: 113131 - DNA, 22 bp, Artificial Sequence
  Synthetic oligonucleotide; TTA chr11 5396612 5396633 5396617 5396612 -
ccttgggcagtatggccatttt

SEQ ID NO: 113132 - DNA, 22 bp, Artificial Sequence
  Synthetic oligonucleotide; CTT chr11 5396608 5396629 5396613 5396608 -
gggcagtatggccattttcacg

SEQ ID NO: 113133 - DNA, 22 bp, Artificial Sequence
  Synthetic oligonucleotide; TTG chr11 5396607 5396628 5396612 5396607 -
ggcagtatggccattttcacga

SEQ ID NO: 113134 - DNA, 22 bp, Artificial Sequence
  Synthetic oligonucleotide; TTT chr11 5396591 5396612 5396596 5396591 -
tcacgatattgtttcttcctat

SEQ ID NO: 113135 - DNA, 22 bp, Artificial Sequence
  Synthetic oligonucleotide; TTT chr11 5396590 5396611 5396595 5396590 -
cacgatattgtttcttcctatc

SEQ ID NO: 113136 - DNA, 22 bp, Artificial Sequence
  Synthetic oligonucleotide; TTC chr11 5396589 5396610 5396594 5396589 -
acgatattgtttcttcctatcc

SEQ ID NO: 113137 - DNA, 22 bp, Artificial Sequence
  Synthetic oligonucleotide; TTG chr11 5396580 5396601 5396585 5396580 -
tttcttcctatccatgagcatg

SEQ ID NO: 113138 - DNA, 22 bp, Artificial Sequence
  Synthetic oligonucleotide; TTT chr11 5396577 5396598 5396582 5396577 -
cttcctatccatgagcatggaa

SEQ ID NO: 113139 - DNA, 22 bp, Artificial Sequence
  Synthetic oligonucleotide; TTC chr11 5396576 5396597 5396581 5396576 -
ttcctatccatgagcatggaat

SEQ ID NO: 113140 - DNA, 22 bp, Artificial Sequence
  Synthetic oligonucleotide; CTT chr11 5396574 5396595 5396579 5396574 -
cctatccatgagcatggaatgt

SEQ ID NO: 113141 - DNA, 22 bp, Artificial Sequence
  Synthetic oligonucleotide; TTC chr11 5396573 5396594 5396578 5396573 -
ctatccatgagcatggaatgtt

SEQ ID NO: 113142 - DNA, 22 bp, Artificial Sequence
  Synthetic oligonucleotide; CTA chr11 5396570 5396591 5396575 5396570 -
tccatgagcatggaatgttctt

SEQ ID NO: 113143 - DNA, 22 bp, Artificial Sequence
  Synthetic oligonucleotide; TTC chr11 5396550 5396571 5396555 5396550 -
ttccatttgtttgtatcttatt

SEQ ID NO: 113144 - DNA, 22 bp, Artificial Sequence
  Synthetic oligonucleotide; CTT chr11 5396548 5396569 5396553 5396548 -
ccatttgtttgtatcttatttc

SEQ ID NO: 113145 - DNA, 22 bp, Artificial Sequence
  Synthetic oligonucleotide; TTC chr11 5396547 5396568 5396552 5396547 -
catttgtttgtatcttatttcc

SEQ ID NO: 113146 - DNA, 22 bp, Artificial Sequence
  Synthetic oligonucleotide; TTT chr11 5396542 5396563 5396547 5396542 -
gtttgtatcttatttccttgag

SEQ ID NO: 113147 - DNA, 22 bp, Artificial Sequence
  Synthetic oligonucleotide; TTG chr11 5396541 5396562 5396546 5396541 -
tttgtatcttatttccttgagc

SEQ ID NO: 113148 - DNA, 22 bp, Artificial Sequence
  Synthetic oligonucleotide; TTT chr11 5396538 5396559 5396543 5396538 -
gtatcttatttccttgagcagt

SEQ ID NO: 113149 - DNA, 22 bp, Artificial Sequence
  Synthetic oligonucleotide; TTG chr11 5396537 5396558 5396542 5396537 -
tatcttatttccttgagcagtg

SEQ ID NO: 113150 - DNA, 22 bp, Artificial Sequence
  Synthetic oligonucleotide; CTT chr11 5396531 5396552 5396536 5396531 -
atttccttgagcagtggtttgt

SEQ ID NO: 113151 - DNA, 22 bp, Artificial Sequence
  Synthetic oligonucleotide; TTA chr11 5396530 5396551 5396535 5396530 -
tttccttgagcagtggtttgta

SEQ ID NO: 113152 - DNA, 22 bp, Artificial Sequence
  Synthetic oligonucleotide; TTT chr11 5396527 5396548 5396532 5396527 -
ccttgagcagtggtttgtagtt

SEQ ID NO: 113153 - DNA, 22 bp, Artificial Sequence
  Synthetic oligonucleotide; TTC chr11 5396526 5396547 5396531 5396526 -
cttgagcagtggtttgtagttc

SEQ ID NO: 113154 - DNA, 22 bp, Artificial Sequence
  Synthetic oligonucleotide; CTT chr11 5396523 5396544 5396528 5396523 -
gagcagtggtttgtagttctcc

SEQ ID NO: 113155 - DNA, 22 bp, Artificial Sequence
  Synthetic oligonucleotide; TTG chr11 5396522 5396543 5396527 5396522 -
agcagtggtttgtagttctcct

SEQ ID NO: 113156 - DNA, 22 bp, Artificial Sequence
  Synthetic oligonucleotide; TTT chr11 5396511 5396532 5396516 5396511 -
gtagttctccttgaagaggtcc

SEQ ID NO: 113157 - DNA, 22 bp, Artificial Sequence
  Synthetic oligonucleotide; TTG chr11 5396510 5396531 5396515 5396510 -
tagttctccttgaagaggtcct

SEQ ID NO: 113158 - DNA, 22 bp, Artificial Sequence
  Synthetic oligonucleotide; TTC chr11 5396504 5396525 5396509 5396504 -
tccttgaagaggtccttcacat

SEQ ID NO: 113159 - DNA, 22 bp, Artificial Sequence
  Synthetic oligonucleotide; CTC chr11 5396502 5396523 5396507 5396502 -
cttgaagaggtccttcacatcc

SEQ ID NO: 113160 - DNA, 22 bp, Artificial Sequence
  Synthetic oligonucleotide; CTT chr11 5396499 5396520 5396504 5396499 -
gaagaggtccttcacatccctt

SEQ ID NO: 113161 - DNA, 22 bp, Artificial Sequence
  Synthetic oligonucleotide; TTG chr11 5396498 5396519 5396503 5396498 -
aagaggtccttcacatcccttg

SEQ ID NO: 113162 - DNA, 22 bp, Artificial Sequence
  Synthetic oligonucleotide; CTT chr11 5396487 5396508 5396492 5396487 -
cacatcccttgtaagttggatt

SEQ ID NO: 113163 - DNA, 22 bp, Artificial Sequence
  Synthetic oligonucleotide; TTC chr11 5396486 5396507 5396491 5396486 -
acatcccttgtaagttggattc

SEQ ID NO: 113164 - DNA, 22 bp, Artificial Sequence
  Synthetic oligonucleotide; CTT chr11 5396477 5396498 5396482 5396477 -
gtaagttggattcctaggtatt

SEQ ID NO: 113165 - DNA, 22 bp, Artificial Sequence
  Synthetic oligonucleotide; TTG chr11 5396476 5396497 5396481 5396476 -
taagttggattcctaggtatta

SEQ ID NO: 113166 - DNA, 22 bp, Artificial Sequence
  Synthetic oligonucleotide; TTG chr11 5396469 5396490 5396474 5396469 -
gattcctaggtattatattctc

SEQ ID NO: 113167 - DNA, 22 bp, Artificial Sequence
  Synthetic oligonucleotide; TTC chr11 5396464 5396485 5396469 5396464 -
ctaggtattatattctctctga

SEQ ID NO: 113168 - DNA, 22 bp, Artificial Sequence
  Synthetic oligonucleotide; CTA chr11 5396461 5396482 5396466 5396461 -
ggtattatattctctctgaagc

SEQ ID NO: 113169 - DNA, 22 bp, Artificial Sequence
  Synthetic oligonucleotide; TTA chr11 5396454 5396475 5396459 5396454 -
tattctctctgaagcaattgtg

SEQ ID NO: 113170 - DNA, 22 bp, Artificial Sequence
  Synthetic oligonucleotide; TTC chr11 5396449 5396470 5396454 5396449 -
tctctgaagcaattgtgaatgg

SEQ ID NO: 113171 - DNA, 22 bp, Artificial Sequence
  Synthetic oligonucleotide; CTC chr11 5396447 5396468 5396452 5396447 -
tctgaagcaattgtgaatggga

SEQ ID NO: 113172 - DNA, 22 bp, Artificial Sequence
  Synthetic oligonucleotide; CTC chr11 5396445 5396466 5396450 5396445 -
tgaagcaattgtgaatgggagt

SEQ ID NO: 113173 - DNA, 22 bp, Artificial Sequence
  Synthetic oligonucleotide; CTG chr11 5396443 5396464 5396448 5396443 -
aagcaattgtgaatgggagttc

SEQ ID NO: 113174 - DNA, 22 bp, Artificial Sequence
  Synthetic oligonucleotide; TTG chr11 5396434 5396455 5396439 5396434 -
tgaatgggagttcactcactgt

SEQ ID NO: 113175 - DNA, 22 bp, Artificial Sequence
  Synthetic oligonucleotide; TTC chr11 5396421 5396442 5396426 5396421 -
actcactgtttgtctgttattg

SEQ ID NO: 113176 - DNA, 22 bp, Artificial Sequence
  Synthetic oligonucleotide; CTC chr11 5396417 5396438 5396422 5396417 -
actgtttgtctgttattggtgt

SEQ ID NO: 113177 - DNA, 22 bp, Artificial Sequence
  Synthetic oligonucleotide; CTG chr11 5396413 5396434 5396418 5396413 -
tttgtctgttattggtgtataa

SEQ ID NO: 113178 - DNA, 22 bp, Artificial Sequence
  Synthetic oligonucleotide; TTT chr11 5396410 5396431 5396415 5396410 -
gtctgttattggtgtataagaa

SEQ ID NO: 113179 - DNA, 22 bp, Artificial Sequence
  Synthetic oligonucleotide; TTG chr11 5396409 5396430 5396414 5396409 -
tctgttattggtgtataagaat

SEQ ID NO: 113180 - DNA, 22 bp, Artificial Sequence
  Synthetic oligonucleotide; CTG chr11 5396405 5396426 5396410 5396405 -
ttattggtgtataagaatgctt

SEQ ID NO: 113181 - DNA, 22 bp, Artificial Sequence
  Synthetic oligonucleotide; TTA chr11 5396402 5396423 5396407 5396402 -
ttggtgtataagaatgcttgtg

SEQ ID NO: 113182 - DNA, 22 bp, Artificial Sequence
  Synthetic oligonucleotide; TTG chr11 5396399 5396420 5396404 5396399 -
gtgtataagaatgcttgtgatt

SEQ ID NO: 113183 - DNA, 22 bp, Artificial Sequence
  Synthetic oligonucleotide; CTT chr11 5396383 5396404 5396388 5396383 -
gtgatttttgcacattgatttt

SEQ ID NO: 113184 - DNA, 22 bp, Artificial Sequence
  Synthetic oligonucleotide; TTG chr11 5396382 5396403 5396387 5396382 -
tgatttttgcacattgattttg

SEQ ID NO: 113185 - DNA, 22 bp, Artificial Sequence
  Synthetic oligonucleotide; TTT chr11 5396376 5396397 5396381 5396376 -
ttgcacattgattttgtatcct

SEQ ID NO: 113186 - DNA, 22 bp, Artificial Sequence
  Synthetic oligonucleotide; TTT chr11 5396375 5396396 5396380 5396375 -
tgcacattgattttgtatcctg

SEQ ID NO: 113187 - DNA, 22 bp, Artificial Sequence
  Synthetic oligonucleotide; TTT chr11 5396374 5396395 5396379 5396374 -
gcacattgattttgtatcctga

SEQ ID NO: 113188 - DNA, 22 bp, Artificial Sequence
  Synthetic oligonucleotide; TTG chr11 5396373 5396394 5396378 5396373 -
cacattgattttgtatcctgag

SEQ ID NO: 113189 - DNA, 22 bp, Artificial Sequence
  Synthetic oligonucleotide; TTG chr11 5396366 5396387 5396371 5396366 -
attttgtatcctgagactttgc

SEQ ID NO: 113190 - DNA, 22 bp, Artificial Sequence
  Synthetic oligonucleotide; TTT chr11 5396362 5396383 5396367 5396362 -
tgtatcctgagactttgctgaa

SEQ ID NO: 113191 - DNA, 22 bp, Artificial Sequence
  Synthetic oligonucleotide; TTT chr11 5396361 5396382 5396366 5396361 -
gtatcctgagactttgctgaag

SEQ ID NO: 113192 - DNA, 22 bp, Artificial Sequence
  Synthetic oligonucleotide; TTG chr11 5396360 5396381 5396365 5396360 -
tatcctgagactttgctgaagt

SEQ ID NO: 113193 - DNA, 22 bp, Artificial Sequence
  Synthetic oligonucleotide; CTG chr11 5396353 5396374 5396358 5396353 -
agactttgctgaagttgcttat

SEQ ID NO: 113194 - DNA, 22 bp, Artificial Sequence
  Synthetic oligonucleotide; CTT chr11 5396347 5396368 5396352 5396347 -
tgctgaagttgcttatcagctt

SEQ ID NO: 113195 - DNA, 22 bp, Artificial Sequence
  Synthetic oligonucleotide; TTT chr11 5396346 5396367 5396351 5396346 -
gctgaagttgcttatcagctta

SEQ ID NO: 113196 - DNA, 22 bp, Artificial Sequence
  Synthetic oligonucleotide; TTG chr11 5396345 5396366 5396350 5396345 -
ctgaagttgcttatcagcttaa

SEQ ID NO: 113197 - DNA, 22 bp, Artificial Sequence
  Synthetic oligonucleotide; CTG chr11 5396342 5396363 5396347 5396342 -
aagttgcttatcagcttaaggg

SEQ ID NO: 113198 - DNA, 22 bp, Artificial Sequence
  Synthetic oligonucleotide; TTG chr11 5396336 5396357 5396341 5396336 -
cttatcagcttaaggggatttt

SEQ ID NO: 113199 - DNA, 22 bp, Artificial Sequence
  Synthetic oligonucleotide; CTT chr11 5396333 5396354 5396338 5396333 -
atcagcttaaggggattttggg

SEQ ID NO: 113200 - DNA, 22 bp, Artificial Sequence
  Synthetic oligonucleotide; TTA chr11 5396332 5396353 5396337 5396332 -
tcagcttaaggggattttgggc

SEQ ID NO: 113201 - DNA, 22 bp, Artificial Sequence
  Synthetic oligonucleotide; CTT chr11 5396325 5396346 5396330 5396325 -
aaggggattttgggctgagaca

SEQ ID NO: 113202 - DNA, 22 bp, Artificial Sequence
  Synthetic oligonucleotide; TTA chr11 5396324 5396345 5396329 5396324 -
aggggattttgggctgagacaa

SEQ ID NO: 113203 - DNA, 22 bp, Artificial Sequence
  Synthetic oligonucleotide; TTT chr11 5396315 5396336 5396320 5396315 -
tgggctgagacaatggggtttt

SEQ ID NO: 113204 - DNA, 22 bp, Artificial Sequence
  Synthetic oligonucleotide; TTT chr11 5396314 5396335 5396319 5396314 -
gggctgagacaatggggttttc

SEQ ID NO: 113205 - DNA, 22 bp, Artificial Sequence
  Synthetic oligonucleotide; TTG chr11 5396313 5396334 5396318 5396313 -
ggctgagacaatggggttttct

SEQ ID NO: 113206 - DNA, 22 bp, Artificial Sequence
  Synthetic oligonucleotide; CTG chr11 5396308 5396329 5396313 5396308 -
agacaatggggttttctagata

SEQ ID NO: 113207 - DNA, 22 bp, Artificial Sequence
  Synthetic oligonucleotide; TTT chr11 5396294 5396315 5396299 5396294 -
tctagatatgcaatcacgtcat

SEQ ID NO: 113208 - DNA, 22 bp, Artificial Sequence
  Synthetic oligonucleotide; TTT chr11 5396293 5396314 5396298 5396293 -
ctagatatgcaatcacgtcatc

SEQ ID NO: 113209 - DNA, 22 bp, Artificial Sequence
  Synthetic oligonucleotide; TTC chr11 5396292 5396313 5396297 5396292 -
tagatatgcaatcacgtcatct

SEQ ID NO: 113210 - DNA, 22 bp, Artificial Sequence
  Synthetic oligonucleotide; CTA chr11 5396290 5396311 5396295 5396290 -
gatatgcaatcacgtcatctgc

SEQ ID NO: 113211 - DNA, 22 bp, Artificial Sequence
  Synthetic oligonucleotide; CTG chr11 5396269 5396290 5396274 5396269 -
caaacagggacaatttgacttt

SEQ ID NO: 113212 - DNA, 22 bp, Artificial Sequence
  Synthetic oligonucleotide; TTT chr11 5396253 5396274 5396258 5396253 -
gactttctctttacataattga

SEQ ID NO: 113213 - DNA, 22 bp, Artificial Sequence
  Synthetic oligonucleotide; TTG chr11 5396252 5396273 5396257 5396252 -
actttctctttacataattgaa

SEQ ID NO: 113214 - DNA, 22 bp, Artificial Sequence
  Synthetic oligonucleotide; CTT chr11 5396248 5396269 5396253 5396248 -
tctctttacataattgaatgcc

SEQ ID NO: 113215 - DNA, 22 bp, Artificial Sequence
  Synthetic oligonucleotide; TTT chr11 5396247 5396268 5396252 5396247 -
ctctttacataattgaatgcct

SEQ ID NO: 113216 - DNA, 22 bp, Artificial Sequence
  Synthetic oligonucleotide; TTC chr11 5396246 5396267 5396251 5396246 -
tctttacataattgaatgcctt

SEQ ID NO: 113217 - DNA, 22 bp, Artificial Sequence
  Synthetic oligonucleotide; CTC chr11 5396244 5396265 5396249 5396244 -
tttacataattgaatgcctttt

SEQ ID NO: 113218 - DNA, 22 bp, Artificial Sequence
  Synthetic oligonucleotide; CTT chr11 5396242 5396263 5396247 5396242 -
tacataattgaatgccttttat

SEQ ID NO: 113219 - DNA, 22 bp, Artificial Sequence
  Synthetic oligonucleotide; TTT chr11 5396241 5396262 5396246 5396241 -
acataattgaatgccttttatt

SEQ ID NO: 113220 - DNA, 22 bp, Artificial Sequence
  Synthetic oligonucleotide; TTA chr11 5396240 5396261 5396245 5396240 -
cataattgaatgccttttattt

SEQ ID NO: 113221 - DNA, 22 bp, Artificial Sequence
  Synthetic oligonucleotide; TTG chr11 5396232 5396253 5396237 5396232 -
aatgccttttatttccttctcc

SEQ ID NO: 113222 - DNA, 22 bp, Artificial Sequence
  Synthetic oligonucleotide; CTT chr11 5396224 5396245 5396229 5396224 -
ttatttccttctcctgcccgat

SEQ ID NO: 113223 - DNA, 22 bp, Artificial Sequence
  Synthetic oligonucleotide; TTT chr11 5396223 5396244 5396228 5396223 -
tatttccttctcctgcccgatt

SEQ ID NO: 113224 - DNA, 22 bp, Artificial Sequence
  Synthetic oligonucleotide; TTT chr11 5396222 5396243 5396227 5396222 -
atttccttctcctgcccgattg

SEQ ID NO: 113225 - DNA, 22 bp, Artificial Sequence
  Synthetic oligonucleotide; TTA chr11 5396221 5396242 5396226 5396221 -
tttccttctcctgcccgattgc

SEQ ID NO: 113226 - DNA, 22 bp, Artificial Sequence
  Synthetic oligonucleotide; TTT chr11 5396218 5396239 5396223 5396218 -
ccttctcctgcccgattgcccg

SEQ ID NO: 113227 - DNA, 22 bp, Artificial Sequence
  Synthetic oligonucleotide; TTC chr11 5396217 5396238 5396222 5396217 -
cttctcctgcccgattgcccgg

SEQ ID NO: 113228 - DNA, 22 bp, Artificial Sequence
  Synthetic oligonucleotide; CTT chr11 5396214 5396235 5396219 5396214 -
ctcctgcccgattgcccgggcc

SEQ ID NO: 113229 - DNA, 22 bp, Artificial Sequence
  Synthetic oligonucleotide; TTC chr11 5396213 5396234 5396218 5396213 -
tcctgcccgattgcccgggcca

SEQ ID NO: 113230 - DNA, 22 bp, Artificial Sequence
  Synthetic oligonucleotide; CTC chr11 5396211 5396232 5396216 5396211 -
ctgcccgattgcccgggccaga

SEQ ID NO: 113231 - DNA, 22 bp, Artificial Sequence
  Synthetic oligonucleotide; CTG chr11 5396208 5396229 5396213 5396208 -
cccgattgcccgggccagaact

SEQ ID NO: 113232 - DNA, 22 bp, Artificial Sequence
  Synthetic oligonucleotide; TTG chr11 5396200 5396221 5396205 5396200 -
cccgggccagaacttccaacac

SEQ ID NO: 113233 - DNA, 22 bp, Artificial Sequence
  Synthetic oligonucleotide; CTT chr11 5396185 5396206 5396190 5396185 -
ccaacactatgttgaataggag

SEQ ID NO: 113234 - DNA, 22 bp, Artificial Sequence
  Synthetic oligonucleotide; TTC chr11 5396184 5396205 5396189 5396184 -
caacactatgttgaataggagt

SEQ ID NO: 113235 - DNA, 22 bp, Artificial Sequence
  Synthetic oligonucleotide; CTA chr11 5396176 5396197 5396181 5396176 -
tgttgaataggagtggtgagag

SEQ ID NO: 113236 - DNA, 22 bp, Artificial Sequence
  Synthetic oligonucleotide; TTG chr11 5396171 5396192 5396176 5396171 -
aataggagtggtgagagagggc

SEQ ID NO: 113237 - DNA, 22 bp, Artificial Sequence
  Synthetic oligonucleotide; CTG chr11 5396142 5396163 5396147 5396142 -
tcttgcagcctaggcacatttt

SEQ ID NO: 113238 - DNA, 22 bp, Artificial Sequence
  Synthetic oligonucleotide; CTT chr11 5396138 5396159 5396143 5396138 -
gcagcctaggcacattttcatt

SEQ ID NO: 113239 - DNA, 22 bp, Artificial Sequence
  Synthetic oligonucleotide; TTG chr11 5396137 5396158 5396142 5396137 -
cagcctaggcacattttcatta

SEQ ID NO: 113240 - DNA, 22 bp, Artificial Sequence
  Synthetic oligonucleotide; CTA chr11 5396130 5396151 5396135 5396130 -
ggcacattttcattaggcagtg

SEQ ID NO: 113241 - DNA, 22 bp, Artificial Sequence
  Synthetic oligonucleotide; TTT chr11 5396121 5396142 5396126 5396121 -
tcattaggcagtgcagtgtggt

SEQ ID NO: 113242 - DNA, 22 bp, Artificial Sequence
  Synthetic oligonucleotide; TTT chr11 5396120 5396141 5396125 5396120 -
cattaggcagtgcagtgtggtt

SEQ ID NO: 113243 - DNA, 22 bp, Artificial Sequence
  Synthetic oligonucleotide; TTC chr11 5396119 5396140 5396124 5396119 -
attaggcagtgcagtgtggtta

SEQ ID NO: 113244 - DNA, 22 bp, Artificial Sequence
  Synthetic oligonucleotide; TTA chr11 5396115 5396136 5396120 5396115 -
ggcagtgcagtgtggttaagag

SEQ ID NO: 113245 - DNA, 22 bp, Artificial Sequence
  Synthetic oligonucleotide; TTA chr11 5396097 5396118 5396102 5396097 -
agagcagtgtctctgggaccag

SEQ ID NO: 113246 - DNA, 22 bp, Artificial Sequence
  Synthetic oligonucleotide; CTC chr11 5396084 5396105 5396089 5396084 -
tgggaccagatctgtattacaa

SEQ ID NO: 113247 - DNA, 22 bp, Artificial Sequence
  Synthetic oligonucleotide; CTG chr11 5396082 5396103 5396087 5396082 -
ggaccagatctgtattacaatc

SEQ ID NO: 113248 - DNA, 22 bp, Artificial Sequence
  Synthetic oligonucleotide; CTG chr11 5396070 5396091 5396075 5396070 -
tattacaatcataacttcaata

SEQ ID NO: 113249 - DNA, 22 bp, Artificial Sequence
  Synthetic oligonucleotide; TTA chr11 5396065 5396086 5396070 5396065 -
caatcataacttcaatagctct

SEQ ID NO: 113250 - DNA, 22 bp, Artificial Sequence
  Synthetic oligonucleotide; CTT chr11 5396053 5396074 5396058 5396053 -
caatagctcttcactctatgat

SEQ ID NO: 113251 - DNA, 22 bp, Artificial Sequence
  Synthetic oligonucleotide; TTC chr11 5396052 5396073 5396057 5396052 -
aatagctcttcactctatgatt

SEQ ID NO: 113252 - DNA, 22 bp, Artificial Sequence
  Synthetic oligonucleotide; CTC chr11 5396044 5396065 5396049 5396044 -
ttcactctatgattgtgcaaag

SEQ ID NO: 113253 - DNA, 22 bp, Artificial Sequence
  Synthetic oligonucleotide; CTT chr11 5396042 5396063 5396047 5396042 -
cactctatgattgtgcaaagta

SEQ ID NO: 113254 - DNA, 22 bp, Artificial Sequence
  Synthetic oligonucleotide; TTC chr11 5396041 5396062 5396046 5396041 -
actctatgattgtgcaaagtat

SEQ ID NO: 113255 - DNA, 22 bp, Artificial Sequence
  Synthetic oligonucleotide; CTC chr11 5396037 5396058 5396042 5396037 -
tatgattgtgcaaagtatctga

SEQ ID NO: 113256 - DNA, 22 bp, Artificial Sequence
  Synthetic oligonucleotide; CTA chr11 5396035 5396056 5396040 5396035 -
tgattgtgcaaagtatctgatt

SEQ ID NO: 113257 - DNA, 22 bp, Artificial Sequence
  Synthetic oligonucleotide; TTG chr11 5396029 5396050 5396034 5396029 -
tgcaaagtatctgattaatctt

SEQ ID NO: 113258 - DNA, 22 bp, Artificial Sequence
  Synthetic oligonucleotide; CTG chr11 5396016 5396037 5396021 5396016 -
attaatcttagtttcttcatct

SEQ ID NO: 113259 - DNA, 22 bp, Artificial Sequence
  Synthetic oligonucleotide; TTA chr11 5396012 5396033 5396017 5396012 -
atcttagtttcttcatctgaaa

SEQ ID NO: 113260 - DNA, 22 bp, Artificial Sequence
  Synthetic oligonucleotide; CTT chr11 5396007 5396028 5396012 5396007 -
agtttcttcatctgaaaaattg

SEQ ID NO: 113261 - DNA, 22 bp, Artificial Sequence
  Synthetic oligonucleotide; TTA chr11 5396006 5396027 5396011 5396006 -
gtttcttcatctgaaaaattga

SEQ ID NO: 113262 - DNA, 22 bp, Artificial Sequence
  Synthetic oligonucleotide; TTT chr11 5396002 5396023 5396007 5396002 -
cttcatctgaaaaattgagaca

SEQ ID NO: 113263 - DNA, 22 bp, Artificial Sequence
  Synthetic oligonucleotide; TTC chr11 5396001 5396022 5396006 5396001 -
ttcatctgaaaaattgagacaa

SEQ ID NO: 113264 - DNA, 22 bp, Artificial Sequence
  Synthetic oligonucleotide; CTT chr11 5395999 5396020 5396004 5395999 -
catctgaaaaattgagacaatt

SEQ ID NO: 113265 - DNA, 22 bp, Artificial Sequence
  Synthetic oligonucleotide; TTC chr11 5395998 5396019 5396003 5395998 -
atctgaaaaattgagacaattc

SEQ ID NO: 113266 - DNA, 22 bp, Artificial Sequence
  Synthetic oligonucleotide; CTG chr11 5395993 5396014 5395998 5395993 -
aaaaattgagacaattctacct

SEQ ID NO: 113267 - DNA, 22 bp, Artificial Sequence
  Synthetic oligonucleotide; TTG chr11 5395985 5396006 5395990 5395985 -
agacaattctacctactccata

SEQ ID NO: 113268 - DNA, 22 bp, Artificial Sequence
  Synthetic oligonucleotide; TTC chr11 5395976 5395997 5395981 5395976 -
tacctactccatagattagaga

SEQ ID NO: 113269 - DNA, 22 bp, Artificial Sequence
  Synthetic oligonucleotide; CTA chr11 5395974 5395995 5395979 5395974 -
cctactccatagattagagagc

SEQ ID NO: 113270 - DNA, 22 bp, Artificial Sequence
  Synthetic oligonucleotide; CTA chr11 5395970 5395991 5395975 5395970 -
ctccatagattagagagccatt

SEQ ID NO: 113271 - DNA, 22 bp, Artificial Sequence
  Synthetic oligonucleotide; CTC chr11 5395967 5395988 5395972 5395967 -
catagattagagagccattcat

SEQ ID NO: 113272 - DNA, 22 bp, Artificial Sequence
  Synthetic oligonucleotide; TTA chr11 5395958 5395979 5395963 5395958 -
gagagccattcatatgcaattt

SEQ ID NO: 113273 - DNA, 22 bp, Artificial Sequence
  Synthetic oligonucleotide; TTC chr11 5395947 5395968 5395952 5395947 -
atatgcaattttaaatggagta

SEQ ID NO: 113274 - DNA, 22 bp, Artificial Sequence
  Synthetic oligonucleotide; TTT chr11 5395936 5395957 5395941 5395936 -
taaatggagtacagttagaagc

SEQ ID NO: 113275 - DNA, 22 bp, Artificial Sequence
  Synthetic oligonucleotide; TTT chr11 5395935 5395956 5395940 5395935 -
aaatggagtacagttagaagca

SEQ ID NO: 113276 - DNA, 22 bp, Artificial Sequence
  Synthetic oligonucleotide; TTA chr11 5395934 5395955 5395939 5395934 -
aatggagtacagttagaagcaa

SEQ ID NO: 113277 - DNA, 22 bp, Artificial Sequence
  Synthetic oligonucleotide; TTA chr11 5395919 5395940 5395924 5395919 -
gaagcaaatactcaatagacac

SEQ ID NO: 113278 - DNA, 22 bp, Artificial Sequence
  Synthetic oligonucleotide; CTC chr11 5395906 5395927 5395911 5395906 -
aatagacacattttattagttg

SEQ ID NO: 113279 - DNA, 22 bp, Artificial Sequence
  Synthetic oligonucleotide; TTT chr11 5395893 5395914 5395898 5395893 -
tattagttgtactttccagcat

SEQ ID NO: 113280 - DNA, 22 bp, Artificial Sequence
  Synthetic oligonucleotide; TTT chr11 5395892 5395913 5395897 5395892 -
attagttgtactttccagcatt

SEQ ID NO: 113281 - DNA, 22 bp, Artificial Sequence
  Synthetic oligonucleotide; TTA chr11 5395891 5395912 5395896 5395891 -
ttagttgtactttccagcattc

SEQ ID NO: 113282 - DNA, 22 bp, Artificial Sequence
  Synthetic oligonucleotide; TTA chr11 5395888 5395909 5395893 5395888 -
gttgtactttccagcattccag

SEQ ID NO: 113283 - DNA, 22 bp, Artificial Sequence
  Synthetic oligonucleotide; TTG chr11 5395884 5395905 5395889 5395884 -
tactttccagcattccagtgag

SEQ ID NO: 113284 - DNA, 22 bp, Artificial Sequence
  Synthetic oligonucleotide; CTT chr11 5395879 5395900 5395884 5395879 -
tccagcattccagtgagcaatg

SEQ ID NO: 113285 - DNA, 22 bp, Artificial Sequence
  Synthetic oligonucleotide; TTT chr11 5395878 5395899 5395883 5395878 -
ccagcattccagtgagcaatgt

SEQ ID NO: 113286 - DNA, 22 bp, Artificial Sequence
  Synthetic oligonucleotide; TTC chr11 5395877 5395898 5395882 5395877 -
cagcattccagtgagcaatgtt

SEQ ID NO: 113287 - DNA, 22 bp, Artificial Sequence
  Synthetic oligonucleotide; TTC chr11 5395869 5395890 5395874 5395869 -
cagtgagcaatgttgcagtgag

SEQ ID NO: 113288 - DNA, 22 bp, Artificial Sequence
  Synthetic oligonucleotide; TTG chr11 5395854 5395875 5395859 5395854 -
cagtgagctctaagaaaagatt

SEQ ID NO: 113289 - DNA, 22 bp, Artificial Sequence
  Synthetic oligonucleotide; CTC chr11 5395844 5395865 5395849 5395844 -
taagaaaagattgaaaaataat

SEQ ID NO: 113290 - DNA, 22 bp, Artificial Sequence
  Synthetic oligonucleotide; CTA chr11 5395842 5395863 5395847 5395842 -
agaaaagattgaaaaataatct

SEQ ID NO: 113291 - DNA, 22 bp, Artificial Sequence
  Synthetic oligonucleotide; TTG chr11 5395831 5395852 5395836 5395831 -
aaaaataatctgacaacaatga

SEQ ID NO: 113292 - DNA, 22 bp, Artificial Sequence
  Synthetic oligonucleotide; CTG chr11 5395819 5395840 5395824 5395819 -
acaacaatgaagcgtaaggtat

SEQ ID NO: 113293 - DNA, 22 bp, Artificial Sequence
  Synthetic oligonucleotide; TTT chr11 5395795 5395816 5395800 5395795 -
ggagtgggaagccatgagctct

SEQ ID NO: 113294 - DNA, 22 bp, Artificial Sequence
  Synthetic oligonucleotide; TTG chr11 5395794 5395815 5395799 5395794 -
gagtgggaagccatgagctctt

SEQ ID NO: 113295 - DNA, 22 bp, Artificial Sequence
  Synthetic oligonucleotide; CTC chr11 5395774 5395795 5395779 5395774 -
ttgcacaggtttttggacaatc

SEQ ID NO: 113296 - DNA, 22 bp, Artificial Sequence
  Synthetic oligonucleotide; CTT chr11 5395772 5395793 5395777 5395772 -
gcacaggtttttggacaatcct

SEQ ID NO: 113297 - DNA, 22 bp, Artificial Sequence
  Synthetic oligonucleotide; TTG chr11 5395771 5395792 5395776 5395771 -
cacaggtttttggacaatcctt

SEQ ID NO: 113298 - DNA, 22 bp, Artificial Sequence
  Synthetic oligonucleotide; TTT chr11 5395762 5395783 5395767 5395762 -
ttggacaatccttccatatggc

SEQ ID NO: 113299 - DNA, 22 bp, Artificial Sequence
  Synthetic oligonucleotide; TTT chr11 5395761 5395782 5395766 5395761 -
tggacaatccttccatatggct

SEQ ID NO: 113300 - DNA, 22 bp, Artificial Sequence
  Synthetic oligonucleotide; TTT chr11 5395760 5395781 5395765 5395760 -
ggacaatccttccatatggctt

SEQ ID NO: 113301 - DNA, 22 bp, Artificial Sequence
  Synthetic oligonucleotide; TTG chr11 5395759 5395780 5395764 5395759 -
gacaatccttccatatggcttt

SEQ ID NO: 113302 - DNA, 22 bp, Artificial Sequence
  Synthetic oligonucleotide; CTT chr11 5395749 5395770 5395754 5395749 -
ccatatggctttggcaaagtta

SEQ ID NO: 113303 - DNA, 22 bp, Artificial Sequence
  Synthetic oligonucleotide; TTC chr11 5395748 5395769 5395753 5395748 -
catatggctttggcaaagttac

SEQ ID NO: 113304 - DNA, 22 bp, Artificial Sequence
  Synthetic oligonucleotide; CTT chr11 5395738 5395759 5395743 5395738 -
tggcaaagttactgaatctttc

SEQ ID NO: 113305 - DNA, 22 bp, Artificial Sequence
  Synthetic oligonucleotide; TTT chr11 5395737 5395758 5395742 5395737 -
ggcaaagttactgaatctttct

SEQ ID NO: 113306 - DNA, 22 bp, Artificial Sequence
  Synthetic oligonucleotide; TTG chr11 5395736 5395757 5395741 5395736 -
gcaaagttactgaatctttcta

SEQ ID NO: 113307 - DNA, 22 bp, Artificial Sequence
  Synthetic oligonucleotide; TTA chr11 5395727 5395748 5395732 5395727 -
ctgaatctttctaaaccttagc

SEQ ID NO: 113308 - DNA, 22 bp, Artificial Sequence
  Synthetic oligonucleotide; CTG chr11 5395724 5395745 5395729 5395724 -
aatctttctaaaccttagcttt

SEQ ID NO: 113309 - DNA, 22 bp, Artificial Sequence
  Synthetic oligonucleotide; CTT chr11 5395718 5395739 5395723 5395718 -
tctaaaccttagcttttttact

SEQ ID NO: 113310 - DNA, 22 bp, Artificial Sequence
  Synthetic oligonucleotide; TTT chr11 5395717 5395738 5395722 5395717 -
ctaaaccttagcttttttacta

SEQ ID NO: 113311 - DNA, 22 bp, Artificial Sequence
  Synthetic oligonucleotide; TTC chr11 5395716 5395737 5395721 5395716 -
taaaccttagcttttttactat

SEQ ID NO: 113312 - DNA, 22 bp, Artificial Sequence
  Synthetic oligonucleotide; CTA chr11 5395714 5395735 5395719 5395714 -
aaccttagcttttttactatgt

SEQ ID NO: 113313 - DNA, 22 bp, Artificial Sequence
  Synthetic oligonucleotide; CTT chr11 5395708 5395729 5395713 5395708 -
agcttttttactatgttgaaag

SEQ ID NO: 113314 - DNA, 22 bp, Artificial Sequence
  Synthetic oligonucleotide; TTA chr11 5395707 5395728 5395712 5395707 -
gcttttttactatgttgaaaga

SEQ ID NO: 113315 - DNA, 22 bp, Artificial Sequence
  Synthetic oligonucleotide; CTT chr11 5395703 5395724 5395708 5395703 -
ttttactatgttgaaagatttc

SEQ ID NO: 113316 - DNA, 22 bp, Artificial Sequence
  Synthetic oligonucleotide; TTT chr11 5395702 5395723 5395707 5395702 -
tttactatgttgaaagatttcc

SEQ ID NO: 113317 - DNA, 22 bp, Artificial Sequence
  Synthetic oligonucleotide; TTT chr11 5395701 5395722 5395706 5395701 -
ttactatgttgaaagatttcca

SEQ ID NO: 113318 - DNA, 22 bp, Artificial Sequence
  Synthetic oligonucleotide; TTT chr11 5395700 5395721 5395705 5395700 -
tactatgttgaaagatttccac

SEQ ID NO: 113319 - DNA, 22 bp, Artificial Sequence
  Synthetic oligonucleotide; TTT chr11 5395699 5395720 5395704 5395699 -
actatgttgaaagatttccaca

SEQ ID NO: 113320 - DNA, 22 bp, Artificial Sequence
  Synthetic oligonucleotide; TTA chr11 5395698 5395719 5395703 5395698 -
ctatgttgaaagatttccacat

SEQ ID NO: 113321 - DNA, 22 bp, Artificial Sequence
  Synthetic oligonucleotide; CTA chr11 5395695 5395716 5395700 5395695 -
tgttgaaagatttccacatggg

SEQ ID NO: 113322 - DNA, 22 bp, Artificial Sequence
  Synthetic oligonucleotide; TTG chr11 5395690 5395711 5395695 5395690 -
aaagatttccacatgggccctg

SEQ ID NO: 113323 - DNA, 22 bp, Artificial Sequence
  Synthetic oligonucleotide; TTT chr11 5395682 5395703 5395687 5395682 -
ccacatgggccctgcctctttt

SEQ ID NO: 113324 - DNA, 22 bp, Artificial Sequence
  Synthetic oligonucleotide; TTC chr11 5395681 5395702 5395686 5395681 -
cacatgggccctgcctcttttc

SEQ ID NO: 113325 - DNA, 22 bp, Artificial Sequence
  Synthetic oligonucleotide; CTG chr11 5395668 5395689 5395673 5395668 -
cctcttttcgagagaaatgatt

SEQ ID NO: 113326 - DNA, 22 bp, Artificial Sequence
  Synthetic oligonucleotide; CTC chr11 5395664 5395685 5395669 5395664 -
ttttcgagagaaatgattaggt

SEQ ID NO: 113327 - DNA, 22 bp, Artificial Sequence
  Synthetic oligonucleotide; CTT chr11 5395662 5395683 5395667 5395662 -
ttcgagagaaatgattaggttt

SEQ ID NO: 113328 - DNA, 22 bp, Artificial Sequence
  Synthetic oligonucleotide; TTT chr11 5395661 5395682 5395666 5395661 -
tcgagagaaatgattaggttta

SEQ ID NO: 113329 - DNA, 22 bp, Artificial Sequence
  Synthetic oligonucleotide; TTT chr11 5395660 5395681 5395665 5395660 -
cgagagaaatgattaggtttaa

SEQ ID NO: 113330 - DNA, 22 bp, Artificial Sequence
  Synthetic oligonucleotide; TTC chr11 5395659 5395680 5395664 5395659 -
gagagaaatgattaggtttaat

SEQ ID NO: 113331 - DNA, 22 bp, Artificial Sequence
  Synthetic oligonucleotide; TTA chr11 5395645 5395666 5395650 5395645 -
ggtttaatggggctgtggagga

SEQ ID NO: 113332 - DNA, 22 bp, Artificial Sequence
  Synthetic oligonucleotide; TTT chr11 5395640 5395661 5395645 5395640 -
aatggggctgtggaggaaagca

SEQ ID NO: 113333 - DNA, 22 bp, Artificial Sequence
  Synthetic oligonucleotide; TTA chr11 5395639 5395660 5395644 5395639 -
atggggctgtggaggaaagcac

SEQ ID NO: 113334 - DNA, 22 bp, Artificial Sequence
  Synthetic oligonucleotide; CTG chr11 5395630 5395651 5395635 5395630 -
tggaggaaagcactctgaaatg

SEQ ID NO: 113335 - DNA, 22 bp, Artificial Sequence
  Synthetic oligonucleotide; CTC chr11 5395615 5395636 5395620 5395615 -
tgaaatgttagaagcttcatca

SEQ ID NO: 113336 - DNA, 22 bp, Artificial Sequence
  Synthetic oligonucleotide; CTG chr11 5395613 5395634 5395618 5395613 -
aaatgttagaagcttcatcaat

SEQ ID NO: 113337 - DNA, 22 bp, Artificial Sequence
  Synthetic oligonucleotide; TTA chr11 5395605 5395626 5395610 5395605 -
gaagcttcatcaattggagcaa

SEQ ID NO: 113338 - DNA, 22 bp, Artificial Sequence
  Synthetic oligonucleotide; CTT chr11 5395598 5395619 5395603 5395598 -
catcaattggagcaattgctga

SEQ ID NO: 113339 - DNA, 22 bp, Artificial Sequence
  Synthetic oligonucleotide; TTC chr11 5395597 5395618 5395602 5395597 -
atcaattggagcaattgctgag

SEQ ID NO: 113340 - DNA, 22 bp, Artificial Sequence
  Synthetic oligonucleotide; TTG chr11 5395589 5395610 5395594 5395589 -
gagcaattgctgagattatgtt

SEQ ID NO: 113341 - DNA, 22 bp, Artificial Sequence
  Synthetic oligonucleotide; TTG chr11 5395580 5395601 5395585 5395580 -
ctgagattatgtttccttgcct

SEQ ID NO: 113342 - DNA, 22 bp, Artificial Sequence
  Synthetic oligonucleotide; CTG chr11 5395577 5395598 5395582 5395577 -
agattatgtttccttgcctgcc

SEQ ID NO: 113343 - DNA, 22 bp, Artificial Sequence
  Synthetic oligonucleotide; TTA chr11 5395571 5395592 5395576 5395571 -
tgtttccttgcctgccacaacc

SEQ ID NO: 113344 - DNA, 22 bp, Artificial Sequence
  Synthetic oligonucleotide; TTT chr11 5395566 5395587 5395571 5395566 -
ccttgcctgccacaaccctgta

SEQ ID NO: 113345 - DNA, 22 bp, Artificial Sequence
  Synthetic oligonucleotide; TTC chr11 5395565 5395586 5395570 5395565 -
cttgcctgccacaaccctgtat

SEQ ID NO: 113346 - DNA, 22 bp, Artificial Sequence
  Synthetic oligonucleotide; CTT chr11 5395562 5395583 5395567 5395562 -
gcctgccacaaccctgtatcat

SEQ ID NO: 113347 - DNA, 22 bp, Artificial Sequence
  Synthetic oligonucleotide; TTG chr11 5395561 5395582 5395566 5395561 -
cctgccacaaccctgtatcatt

SEQ ID NO: 113348 - DNA, 22 bp, Artificial Sequence
  Synthetic oligonucleotide; CTG chr11 5395557 5395578 5395562 5395557 -
ccacaaccctgtatcattctct

SEQ ID NO: 113349 - DNA, 22 bp, Artificial Sequence
  Synthetic oligonucleotide; CTG chr11 5395546 5395567 5395551 5395546 -
tatcattctctacaaggcatag

SEQ ID NO: 113350 - DNA, 22 bp, Artificial Sequence
  Synthetic oligonucleotide; TTC chr11 5395538 5395559 5395543 5395538 -
tctacaaggcatagcccagtaa

SEQ ID NO: 113351 - DNA, 22 bp, Artificial Sequence
  Synthetic oligonucleotide; CTC chr11 5395536 5395557 5395541 5395536 -
tacaaggcatagcccagtaaca

SEQ ID NO: 113352 - DNA, 22 bp, Artificial Sequence
  Synthetic oligonucleotide; CTA chr11 5395534 5395555 5395539 5395534 -
caaggcatagcccagtaacaag

SEQ ID NO: 113353 - DNA, 22 bp, Artificial Sequence
  Synthetic oligonucleotide; CTG chr11 5395502 5395523 5395507 5395502 -
tcttccccatcaaaaacatcac

SEQ ID NO: 113354 - DNA, 22 bp, Artificial Sequence
  Synthetic oligonucleotide; CTT chr11 5395498 5395519 5395503 5395498 -
ccccatcaaaaacatcacggga

SEQ ID NO: 113355 - DNA, 22 bp, Artificial Sequence
  Synthetic oligonucleotide; TTC chr11 5395497 5395518 5395502 5395497 -
cccatcaaaaacatcacgggag

SEQ ID NO: 113356 - DNA, 22 bp, Artificial Sequence
  Synthetic oligonucleotide; CTA chr11 5395453 5395474 5395458 5395453 -
acaacagattggccatcttcct

SEQ ID NO: 113357 - DNA, 22 bp, Artificial Sequence
  Synthetic oligonucleotide; TTG chr11 5395442 5395463 5395447 5395442 -
gccatcttcctggaagctgccc

SEQ ID NO: 113358 - DNA, 22 bp, Artificial Sequence
  Synthetic oligonucleotide; CTT chr11 5395434 5395455 5395439 5395434 -
cctggaagctgccctattccat

SEQ ID NO: 113359 - DNA, 22 bp, Artificial Sequence
  Synthetic oligonucleotide; TTC chr11 5395433 5395454 5395438 5395433 -
ctggaagctgccctattccata

SEQ ID NO: 113360 - DNA, 22 bp, Artificial Sequence
  Synthetic oligonucleotide; CTG chr11 5395430 5395451 5395435 5395430 -
gaagctgccctattccataacc

SEQ ID NO: 113361 - DNA, 22 bp, Artificial Sequence
  Synthetic oligonucleotide; CTG chr11 5395423 5395444 5395428 5395423 -
ccctattccataaccctgcata

SEQ ID NO: 113362 - DNA, 22 bp, Artificial Sequence
  Synthetic oligonucleotide; CTA chr11 5395418 5395439 5395423 5395418 -
ttccataaccctgcatatagtc

SEQ ID NO: 113363 - DNA, 22 bp, Artificial Sequence
  Synthetic oligonucleotide; TTC chr11 5395415 5395436 5395420 5395415 -
cataaccctgcatatagtcatg

SEQ ID NO: 113364 - DNA, 22 bp, Artificial Sequence
  Synthetic oligonucleotide; CTG chr11 5395405 5395426 5395410 5395405 -
catatagtcatgctagataagg

SEQ ID NO: 113365 - DNA, 22 bp, Artificial Sequence
  Synthetic oligonucleotide; CTA chr11 5395390 5395411 5395395 5395390 -
gataagggatattagagaggtc

SEQ ID NO: 113366 - DNA, 22 bp, Artificial Sequence
  Synthetic oligonucleotide; TTA chr11 5395376 5395397 5395381 5395376 -
gagaggtcactccaatgacttc

SEQ ID NO: 113367 - DNA, 22 bp, Artificial Sequence
  Synthetic oligonucleotide; CTC chr11 5395364 5395385 5395369 5395364 -
caatgacttcctttatccacaa

SEQ ID NO: 113368 - DNA, 22 bp, Artificial Sequence
  Synthetic oligonucleotide; CTT chr11 5395355 5395376 5395360 5395355 -
cctttatccacaaaacaaagga

SEQ ID NO: 113369 - DNA, 22 bp, Artificial Sequence
  Synthetic oligonucleotide; TTC chr11 5395354 5395375 5395359 5395354 -
ctttatccacaaaacaaaggac

SEQ ID NO: 113370 - DNA, 22 bp, Artificial Sequence
  Synthetic oligonucleotide; CTT chr11 5395351 5395372 5395356 5395351 -
tatccacaaaacaaaggacctt

SEQ ID NO: 113371 - DNA, 22 bp, Artificial Sequence
  Synthetic oligonucleotide; TTT chr11 5395350 5395371 5395355 5395350 -
atccacaaaacaaaggaccttc

SEQ ID NO: 113372 - DNA, 22 bp, Artificial Sequence
  Synthetic oligonucleotide; TTA chr11 5395349 5395370 5395354 5395349 -
tccacaaaacaaaggaccttca

SEQ ID NO: 113373 - DNA, 22 bp, Artificial Sequence
  Synthetic oligonucleotide; CTT chr11 5395329 5395350 5395334 5395329 -
cagcaacttactggtcctttct

SEQ ID NO: 113374 - DNA, 22 bp, Artificial Sequence
  Synthetic oligonucleotide; TTC chr11 5395328 5395349 5395333 5395328 -
agcaacttactggtcctttctt

SEQ ID NO: 113375 - DNA, 22 bp, Artificial Sequence
  Synthetic oligonucleotide; CTT chr11 5395320 5395341 5395325 5395320 -
actggtcctttcttctctgtag

SEQ ID NO: 113376 - DNA, 22 bp, Artificial Sequence
  Synthetic oligonucleotide; TTA chr11 5395319 5395340 5395324 5395319 -
ctggtcctttcttctctgtagc

SEQ ID NO: 113377 - DNA, 22 bp, Artificial Sequence
  Synthetic oligonucleotide; CTG chr11 5395316 5395337 5395321 5395316 -
gtcctttcttctctgtagcttc

SEQ ID NO: 113378 - DNA, 22 bp, Artificial Sequence
  Synthetic oligonucleotide; CTT chr11 5395310 5395331 5395315 5395310 -
tcttctctgtagcttctttctc

SEQ ID NO: 113379 - DNA, 22 bp, Artificial Sequence
  Synthetic oligonucleotide; TTT chr11 5395309 5395330 5395314 5395309 -
cttctctgtagcttctttctca

SEQ ID NO: 113380 - DNA, 22 bp, Artificial Sequence
  Synthetic oligonucleotide; TTC chr11 5395308 5395329 5395313 5395308 -
ttctctgtagcttctttctcat

SEQ ID NO: 113381 - DNA, 22 bp, Artificial Sequence
  Synthetic oligonucleotide; CTT chr11 5395306 5395327 5395311 5395306 -
ctctgtagcttctttctcatgc

SEQ ID NO: 113382 - DNA, 22 bp, Artificial Sequence
  Synthetic oligonucleotide; TTC chr11 5395305 5395326 5395310 5395305 -
tctgtagcttctttctcatgca

SEQ ID NO: 113383 - DNA, 22 bp, Artificial Sequence
  Synthetic oligonucleotide; CTC chr11 5395303 5395324 5395308 5395303 -
tgtagcttctttctcatgcagc

SEQ ID NO: 113384 - DNA, 22 bp, Artificial Sequence
  Synthetic oligonucleotide; CTG chr11 5395301 5395322 5395306 5395301 -
tagcttctttctcatgcagccc

SEQ ID NO: 113385 - DNA, 22 bp, Artificial Sequence
  Synthetic oligonucleotide; CTT chr11 5395295 5395316 5395300 5395295 -
ctttctcatgcagcccttccac

SEQ ID NO: 113386 - DNA, 22 bp, Artificial Sequence
  Synthetic oligonucleotide; TTC chr11 5395294 5395315 5395299 5395294 -
tttctcatgcagcccttccact

SEQ ID NO: 113387 - DNA, 22 bp, Artificial Sequence
  Synthetic oligonucleotide; CTT chr11 5395292 5395313 5395297 5395292 -
tctcatgcagcccttccactcc

SEQ ID NO: 113388 - DNA, 22 bp, Artificial Sequence
  Synthetic oligonucleotide; TTT chr11 5395291 5395312 5395296 5395291 -
ctcatgcagcccttccactcca

SEQ ID NO: 113389 - DNA, 22 bp, Artificial Sequence
  Synthetic oligonucleotide; TTC chr11 5395290 5395311 5395295 5395290 -
tcatgcagcccttccactccat

SEQ ID NO: 113390 - DNA, 22 bp, Artificial Sequence
  Synthetic oligonucleotide; CTC chr11 5395288 5395309 5395293 5395288 -
atgcagcccttccactccatgc

SEQ ID NO: 113391 - DNA, 22 bp, Artificial Sequence
  Synthetic oligonucleotide; CTT chr11 5395277 5395298 5395282 5395277 -
ccactccatgccagcatcttcc

SEQ ID NO: 113392 - DNA, 22 bp, Artificial Sequence
  Synthetic oligonucleotide; TTC chr11 5395276 5395297 5395281 5395276 -
cactccatgccagcatcttcca

SEQ ID NO: 113393 - DNA, 22 bp, Artificial Sequence
  Synthetic oligonucleotide; CTC chr11 5395271 5395292 5395276 5395271 -
catgccagcatcttccatttga

SEQ ID NO: 113394 - DNA, 22 bp, Artificial Sequence
  Synthetic oligonucleotide; CTT chr11 5395257 5395278 5395262 5395257 -
ccatttgactcaggatgctgtt

SEQ ID NO: 113395 - DNA, 22 bp, Artificial Sequence
  Synthetic oligonucleotide; TTC chr11 5395256 5395277 5395261 5395256 -
catttgactcaggatgctgttc

SEQ ID NO: 113396 - DNA, 22 bp, Artificial Sequence
  Synthetic oligonucleotide; TTT chr11 5395251 5395272 5395256 5395251 -
gactcaggatgctgttctacgt

SEQ ID NO: 113397 - DNA, 22 bp, Artificial Sequence
  Synthetic oligonucleotide; TTG chr11 5395250 5395271 5395255 5395250 -
actcaggatgctgttctacgtg

SEQ ID NO: 113398 - DNA, 22 bp, Artificial Sequence
  Synthetic oligonucleotide; CTC chr11 5395246 5395267 5395251 5395246 -
aggatgctgttctacgtgggct

SEQ ID NO: 113399 - DNA, 22 bp, Artificial Sequence
  Synthetic oligonucleotide; CTG chr11 5395237 5395258 5395242 5395237 -
ttctacgtgggctgcactggca

SEQ ID NO: 113400 - DNA, 22 bp, Artificial Sequence
  Synthetic oligonucleotide; TTC chr11 5395234 5395255 5395239 5395234 -
tacgtgggctgcactggcactt

SEQ ID NO: 113401 - DNA, 22 bp, Artificial Sequence
  Synthetic oligonucleotide; CTA chr11 5395232 5395253 5395237 5395232 -
cgtgggctgcactggcacttat

SEQ ID NO: 113402 - DNA, 22 bp, Artificial Sequence
  Synthetic oligonucleotide; CTG chr11 5395223 5395244 5395228 5395223 -
cactggcacttataaagctgtc

SEQ ID NO: 113403 - DNA, 22 bp, Artificial Sequence
  Synthetic oligonucleotide; CTG chr11 5395218 5395239 5395223 5395218 -
gcacttataaagctgtctctct

SEQ ID NO: 113404 - DNA, 22 bp, Artificial Sequence
  Synthetic oligonucleotide; CTT chr11 5395212 5395233 5395217 5395212 -
ataaagctgtctctcttccttg

SEQ ID NO: 113405 - DNA, 22 bp, Artificial Sequence
  Synthetic oligonucleotide; TTA chr11 5395211 5395232 5395216 5395211 -
taaagctgtctctcttccttgg

SEQ ID NO: 113406 - DNA, 22 bp, Artificial Sequence
  Synthetic oligonucleotide; CTG chr11 5395203 5395224 5395208 5395203 -
tctctcttccttgggtctttgg

SEQ ID NO: 113407 - DNA, 22 bp, Artificial Sequence
  Synthetic oligonucleotide; CTC chr11 5395199 5395220 5395204 5395199 -
tcttccttgggtctttggccct

SEQ ID NO: 113408 - DNA, 22 bp, Artificial Sequence
  Synthetic oligonucleotide; CTC chr11 5395197 5395218 5395202 5395197 -
ttccttgggtctttggccctca

SEQ ID NO: 113409 - DNA, 22 bp, Artificial Sequence
  Synthetic oligonucleotide; CTT chr11 5395195 5395216 5395200 5395195 -
ccttgggtctttggccctcaaa

SEQ ID NO: 113410 - DNA, 22 bp, Artificial Sequence
  Synthetic oligonucleotide; TTC chr11 5395194 5395215 5395199 5395194 -
cttgggtctttggccctcaaag

SEQ ID NO: 113411 - DNA, 22 bp, Artificial Sequence
  Synthetic oligonucleotide; CTT chr11 5395191 5395212 5395196 5395191 -
gggtctttggccctcaaaggaa

SEQ ID NO: 113412 - DNA, 22 bp, Artificial Sequence
  Synthetic oligonucleotide; TTG chr11 5395190 5395211 5395195 5395190 -
ggtctttggccctcaaaggaat

SEQ ID NO: 113413 - DNA, 22 bp, Artificial Sequence
  Synthetic oligonucleotide; CTT chr11 5395184 5395205 5395189 5395184 -
tggccctcaaaggaatctccct

SEQ ID NO: 113414 - DNA, 22 bp, Artificial Sequence
  Synthetic oligonucleotide; TTT chr11 5395183 5395204 5395188 5395183 -
ggccctcaaaggaatctcccta

SEQ ID NO: 113415 - DNA, 22 bp, Artificial Sequence
  Synthetic oligonucleotide; TTG chr11 5395182 5395203 5395187 5395182 -
gccctcaaaggaatctccctag

SEQ ID NO: 113416 - DNA, 22 bp, Artificial Sequence
  Synthetic oligonucleotide; CTC chr11 5395176 5395197 5395181 5395176 -
aaaggaatctccctagatggac

SEQ ID NO: 113417 - DNA, 22 bp, Artificial Sequence
  Synthetic oligonucleotide; CTC chr11 5395165 5395186 5395170 5395165 -
cctagatggacgcagacttgat

SEQ ID NO: 113418 - DNA, 22 bp, Artificial Sequence
  Synthetic oligonucleotide; CTA chr11 5395161 5395182 5395166 5395161 -
gatggacgcagacttgatgaat

SEQ ID NO: 113419 - DNA, 22 bp, Artificial Sequence
  Synthetic oligonucleotide; CTT chr11 5395146 5395167 5395151 5395146 -
gatgaatgtcaaagagggatta

SEQ ID NO: 113420 - DNA, 22 bp, Artificial Sequence
  Synthetic oligonucleotide; TTG chr11 5395145 5395166 5395150 5395145 -
atgaatgtcaaagagggattag

SEQ ID NO: 113421 - DNA, 22 bp, Artificial Sequence
  Synthetic oligonucleotide; TTA chr11 5395124 5395145 5395129 5395124 -
gcatcctcctagaccaaagcat

SEQ ID NO: 113422 - DNA, 22 bp, Artificial Sequence
  Synthetic oligonucleotide; CTC chr11 5395116 5395137 5395121 5395116 -
ctagaccaaagcatttgagatg

SEQ ID NO: 113423 - DNA, 22 bp, Artificial Sequence
  Synthetic oligonucleotide; CTA chr11 5395113 5395134 5395118 5395113 -
gaccaaagcatttgagatgccc

SEQ ID NO: 113424 - DNA, 22 bp, Artificial Sequence
  Synthetic oligonucleotide; TTT chr11 5395100 5395121 5395105 5395100 -
gagatgcccagttatcttaaat

SEQ ID NO: 113425 - DNA, 22 bp, Artificial Sequence
  Synthetic oligonucleotide; TTG chr11 5395099 5395120 5395104 5395099 -
agatgcccagttatcttaaatg

SEQ ID NO: 113426 - DNA, 22 bp, Artificial Sequence
  Synthetic oligonucleotide; TTA chr11 5395086 5395107 5395091 5395086 -
tcttaaatggaaatttagtgaa

SEQ ID NO: 113427 - DNA, 22 bp, Artificial Sequence
  Synthetic oligonucleotide; CTT chr11 5395082 5395103 5395087 5395082 -
aaatggaaatttagtgaaccat

SEQ ID NO: 113428 - DNA, 22 bp, Artificial Sequence
  Synthetic oligonucleotide; TTA chr11 5395081 5395102 5395086 5395081 -
aatggaaatttagtgaaccatg

SEQ ID NO: 113429 - DNA, 22 bp, Artificial Sequence
  Synthetic oligonucleotide; TTT chr11 5395070 5395091 5395075 5395070 -
agtgaaccatgagtacctctag

SEQ ID NO: 113430 - DNA, 22 bp, Artificial Sequence
  Synthetic oligonucleotide; TTA chr11 5395069 5395090 5395074 5395069 -
gtgaaccatgagtacctctagg

SEQ ID NO: 113431 - DNA, 22 bp, Artificial Sequence
  Synthetic oligonucleotide; CTC chr11 5395051 5395072 5395056 5395051 -
taggaggtatttcagtgagcca

SEQ ID NO: 113432 - DNA, 22 bp, Artificial Sequence
  Synthetic oligonucleotide; CTA chr11 5395049 5395070 5395054 5395049 -
ggaggtatttcagtgagccaga

SEQ ID NO: 113433 - DNA, 22 bp, Artificial Sequence
  Synthetic oligonucleotide; TTT chr11 5395039 5395060 5395044 5395039 -
cagtgagccagaggatccttga

SEQ ID NO: 113434 - DNA, 22 bp, Artificial Sequence
  Synthetic oligonucleotide; TTC chr11 5395038 5395059 5395043 5395038 -
agtgagccagaggatccttgac

SEQ ID NO: 113435 - DNA, 22 bp, Artificial Sequence
  Synthetic oligonucleotide; CTT chr11 5395019 5395040 5395024 5395019 -
gactgtcttctctccccagctg

SEQ ID NO: 113436 - DNA, 22 bp, Artificial Sequence
  Synthetic oligonucleotide; TTG chr11 5395018 5395039 5395023 5395018 -
actgtcttctctccccagctgc

SEQ ID NO: 113437 - DNA, 22 bp, Artificial Sequence
  Synthetic oligonucleotide; CTG chr11 5395014 5395035 5395019 5395014 -
tcttctctccccagctgccaac

SEQ ID NO: 113438 - DNA, 22 bp, Artificial Sequence
  Synthetic oligonucleotide; CTT chr11 5395010 5395031 5395015 5395010 -
ctctccccagctgccaacttca

SEQ ID NO: 113439 - DNA, 22 bp, Artificial Sequence
  Synthetic oligonucleotide; TTC chr11 5395009 5395030 5395014 5395009 -
tctccccagctgccaacttcat

SEQ ID NO: 113440 - DNA, 22 bp, Artificial Sequence
  Synthetic oligonucleotide; CTC chr11 5395007 5395028 5395012 5395007 -
tccccagctgccaacttcataa

SEQ ID NO: 113441 - DNA, 22 bp, Artificial Sequence
  Synthetic oligonucleotide; CTC chr11 5395005 5395026 5395010 5395005 -
cccagctgccaacttcataaga

SEQ ID NO: 113442 - DNA, 22 bp, Artificial Sequence
  Synthetic oligonucleotide; CTG chr11 5394997 5395018 5395002 5394997 -
ccaacttcataagaaaatttat

SEQ ID NO: 113443 - DNA, 22 bp, Artificial Sequence
  Synthetic oligonucleotide; CTT chr11 5394990 5395011 5394995 5394990 -
cataagaaaatttattgggtgc

SEQ ID NO: 113444 - DNA, 22 bp, Artificial Sequence
  Synthetic oligonucleotide; TTC chr11 5394989 5395010 5394994 5394989 -
ataagaaaatttattgggtgct

SEQ ID NO: 113445 - DNA, 22 bp, Artificial Sequence
  Synthetic oligonucleotide; TTT chr11 5394977 5394998 5394982 5394977 -
attgggtgcttctcaatcctct

SEQ ID NO: 113446 - DNA, 22 bp, Artificial Sequence
  Synthetic oligonucleotide; TTA chr11 5394976 5394997 5394981 5394976 -
ttgggtgcttctcaatcctctt

SEQ ID NO: 113447 - DNA, 22 bp, Artificial Sequence
  Synthetic oligonucleotide; TTG chr11 5394973 5394994 5394978 5394973 -
ggtgcttctcaatcctcttttt

SEQ ID NO: 113448 - DNA, 22 bp, Artificial Sequence
  Synthetic oligonucleotide; CTT chr11 5394966 5394987 5394971 5394966 -
ctcaatcctcttttttgtcttt

SEQ ID NO: 113449 - DNA, 22 bp, Artificial Sequence
  Synthetic oligonucleotide; TTC chr11 5394965 5394986 5394970 5394965 -
tcaatcctcttttttgtctttc

SEQ ID NO: 113450 - DNA, 22 bp, Artificial Sequence
  Synthetic oligonucleotide; CTC chr11 5394963 5394984 5394968 5394963 -
aatcctcttttttgtctttctt

SEQ ID NO: 113451 - DNA, 22 bp, Artificial Sequence
  Synthetic oligonucleotide; CTC chr11 5394956 5394977 5394961 5394956 -
ttttttgtctttcttttctttt

SEQ ID NO: 113452 - DNA, 22 bp, Artificial Sequence
  Synthetic oligonucleotide; CTT chr11 5394954 5394975 5394959 5394954 -
ttttgtctttcttttcttttcc

SEQ ID NO: 113453 - DNA, 22 bp, Artificial Sequence
  Synthetic oligonucleotide; TTT chr11 5394953 5394974 5394958 5394953 -
tttgtctttcttttcttttccc

SEQ ID NO: 113454 - DNA, 22 bp, Artificial Sequence
  Synthetic oligonucleotide; TTT chr11 5394952 5394973 5394957 5394952 -
ttgtctttcttttcttttccca

SEQ ID NO: 113455 - DNA, 22 bp, Artificial Sequence
  Synthetic oligonucleotide; TTT chr11 5394951 5394972 5394956 5394951 -
tgtctttcttttcttttcccag

SEQ ID NO: 113456 - DNA, 22 bp, Artificial Sequence
  Synthetic oligonucleotide; TTT chr11 5394950 5394971 5394955 5394950 -
gtctttcttttcttttcccaga

SEQ ID NO: 113457 - DNA, 22 bp, Artificial Sequence
  Synthetic oligonucleotide; TTG chr11 5394949 5394970 5394954 5394949 -
tctttcttttcttttcccagac

SEQ ID NO: 113458 - DNA, 22 bp, Artificial Sequence
  Synthetic oligonucleotide; CTT chr11 5394945 5394966 5394950 5394945 -
tcttttcttttcccagacaaaa

SEQ ID NO: 113459 - DNA, 22 bp, Artificial Sequence
  Synthetic oligonucleotide; TTT chr11 5394944 5394965 5394949 5394944 -
cttttcttttcccagacaaaag

SEQ ID NO: 113460 - DNA, 22 bp, Artificial Sequence
  Synthetic oligonucleotide; TTC chr11 5394943 5394964 5394948 5394943 -
ttttcttttcccagacaaaagt

SEQ ID NO: 113461 - DNA, 22 bp, Artificial Sequence
  Synthetic oligonucleotide; CTT chr11 5394941 5394962 5394946 5394941 -
ttcttttcccagacaaaagtcc

SEQ ID NO: 113462 - DNA, 22 bp, Artificial Sequence
  Synthetic oligonucleotide; TTT chr11 5394940 5394961 5394945 5394940 -
tcttttcccagacaaaagtccc

SEQ ID NO: 113463 - DNA, 22 bp, Artificial Sequence
  Synthetic oligonucleotide; TTT chr11 5394939 5394960 5394944 5394939 -
cttttcccagacaaaagtcccc

SEQ ID NO: 113464 - DNA, 22 bp, Artificial Sequence
  Synthetic oligonucleotide; TTC chr11 5394938 5394959 5394943 5394938 -
ttttcccagacaaaagtcccct

SEQ ID NO: 113465 - DNA, 22 bp, Artificial Sequence
  Synthetic oligonucleotide; CTT chr11 5394936 5394957 5394941 5394936 -
ttcccagacaaaagtccccttg

SEQ ID NO: 113466 - DNA, 22 bp, Artificial Sequence
  Synthetic oligonucleotide; TTT chr11 5394935 5394956 5394940 5394935 -
tcccagacaaaagtccccttga

SEQ ID NO: 113467 - DNA, 22 bp, Artificial Sequence
  Synthetic oligonucleotide; TTT chr11 5394934 5394955 5394939 5394934 -
cccagacaaaagtccccttgag

SEQ ID NO: 113468 - DNA, 22 bp, Artificial Sequence
  Synthetic oligonucleotide; TTC chr11 5394933 5394954 5394938 5394933 -
ccagacaaaagtccccttgaga

SEQ ID NO: 113469 - DNA, 22 bp, Artificial Sequence
  Synthetic oligonucleotide; CTT chr11 5394915 5394936 5394920 5394915 -
gagacagtctttacaaccaggt

SEQ ID NO: 113470 - DNA, 22 bp, Artificial Sequence
  Synthetic oligonucleotide; TTG chr11 5394914 5394935 5394919 5394914 -
agacagtctttacaaccaggta

SEQ ID NO: 113471 - DNA, 22 bp, Artificial Sequence
  Synthetic oligonucleotide; CTT chr11 5394904 5394925 5394909 5394904 -
tacaaccaggtagttattcact

SEQ ID NO: 113472 - DNA, 22 bp, Artificial Sequence
  Synthetic oligonucleotide; TTT chr11 5394903 5394924 5394908 5394903 -
acaaccaggtagttattcactg

SEQ ID NO: 113473 - DNA, 22 bp, Artificial Sequence
  Synthetic oligonucleotide; TTA chr11 5394902 5394923 5394907 5394902 -
caaccaggtagttattcactgt

SEQ ID NO: 113474 - DNA, 22 bp, Artificial Sequence
  Synthetic oligonucleotide; TTA chr11 5394888 5394909 5394893 5394888 -
ttcactgtcattcactgagcaa

SEQ ID NO: 113475 - DNA, 22 bp, Artificial Sequence
  Synthetic oligonucleotide; TTC chr11 5394885 5394906 5394890 5394885 -
actgtcattcactgagcaagta

SEQ ID NO: 113476 - DNA, 22 bp, Artificial Sequence
  Synthetic oligonucleotide; CTG chr11 5394881 5394902 5394886 5394881 -
tcattcactgagcaagtatgta

SEQ ID NO: 113477 - DNA, 22 bp, Artificial Sequence
  Synthetic oligonucleotide; TTC chr11 5394875 5394896 5394880 5394875 -
actgagcaagtatgtaaagatc

SEQ ID NO: 113478 - DNA, 22 bp, Artificial Sequence
  Synthetic oligonucleotide; CTG chr11 5394871 5394892 5394876 5394871 -
agcaagtatgtaaagatcacaa

SEQ ID NO: 113479 - DNA, 22 bp, Artificial Sequence
  Synthetic oligonucleotide; CTT chr11 5394845 5394866 5394850 5394845 -
tgggtcagatatttgaatgcaa

SEQ ID NO: 113480 - DNA, 22 bp, Artificial Sequence
  Synthetic oligonucleotide; TTT chr11 5394844 5394865 5394849 5394844 -
gggtcagatatttgaatgcaag

SEQ ID NO: 113481 - DNA, 22 bp, Artificial Sequence
  Synthetic oligonucleotide; TTG chr11 5394843 5394864 5394848 5394843 -
ggtcagatatttgaatgcaagc

SEQ ID NO: 113482 - DNA, 22 bp, Artificial Sequence
  Synthetic oligonucleotide; TTT chr11 5394831 5394852 5394836 5394831 -
gaatgcaagcattaataagaca

SEQ ID NO: 113483 - DNA, 22 bp, Artificial Sequence
  Synthetic oligonucleotide; TTG chr11 5394830 5394851 5394835 5394830 -
aatgcaagcattaataagacac

SEQ ID NO: 113484 - DNA, 22 bp, Artificial Sequence
  Synthetic oligonucleotide; TTA chr11 5394817 5394838 5394822 5394817 -
ataagacacaaactctgtcttt

SEQ ID NO: 113485 - DNA, 22 bp, Artificial Sequence
  Synthetic oligonucleotide; CTC chr11 5394802 5394823 5394807 5394802 -
tgtctttcagaaagcattgtct

SEQ ID NO: 113486 - DNA, 22 bp, Artificial Sequence
  Synthetic oligonucleotide; CTG chr11 5394800 5394821 5394805 5394800 -
tctttcagaaagcattgtcttc

SEQ ID NO: 113487 - DNA, 22 bp, Artificial Sequence
  Synthetic oligonucleotide; CTT chr11 5394796 5394817 5394801 5394796 -
tcagaaagcattgtcttctgca

SEQ ID NO: 113488 - DNA, 22 bp, Artificial Sequence
  Synthetic oligonucleotide; TTT chr11 5394795 5394816 5394800 5394795 -
cagaaagcattgtcttctgcag

SEQ ID NO: 113489 - DNA, 22 bp, Artificial Sequence
  Synthetic oligonucleotide; TTC chr11 5394794 5394815 5394799 5394794 -
agaaagcattgtcttctgcagg

SEQ ID NO: 113490 - DNA, 22 bp, Artificial Sequence
  Synthetic oligonucleotide; TTG chr11 5394783 5394804 5394788 5394783 -
tcttctgcaggaggttgatgtg

SEQ ID NO: 113491 - DNA, 22 bp, Artificial Sequence
  Synthetic oligonucleotide; CTT chr11 5394779 5394800 5394784 5394779 -
ctgcaggaggttgatgtgaaaa

SEQ ID NO: 113492 - DNA, 22 bp, Artificial Sequence
  Synthetic oligonucleotide; TTC chr11 5394778 5394799 5394783 5394778 -
tgcaggaggttgatgtgaaaaa

SEQ ID NO: 113493 - DNA, 22 bp, Artificial Sequence
  Synthetic oligonucleotide; CTG chr11 5394776 5394797 5394781 5394776 -
caggaggttgatgtgaaaaaaa

SEQ ID NO: 113494 - DNA, 22 bp, Artificial Sequence
  Synthetic oligonucleotide; TTG chr11 5394766 5394787 5394771 5394766 -
atgtgaaaaaaactaacgtccc

SEQ ID NO: 113495 - DNA, 22 bp, Artificial Sequence
  Synthetic oligonucleotide; CTA chr11 5394751 5394772 5394756 5394751 -
acgtcccctgatgaagcaaaaa

SEQ ID NO: 113496 - DNA, 22 bp, Artificial Sequence
  Synthetic oligonucleotide; CTG chr11 5394741 5394762 5394746 5394741 -
atgaagcaaaaacaggcttccc

SEQ ID NO: 113497 - DNA, 22 bp, Artificial Sequence
  Synthetic oligonucleotide; CTT chr11 5394722 5394743 5394727 5394722 -
cccaggtgatacaaatatttag

SEQ ID NO: 113498 - DNA, 22 bp, Artificial Sequence
  Synthetic oligonucleotide; TTC chr11 5394721 5394742 5394726 5394721 -
ccaggtgatacaaatatttagc

SEQ ID NO: 113499 - DNA, 22 bp, Artificial Sequence
  Synthetic oligonucleotide; TTT chr11 5394702 5394723 5394707 5394702 -
agcaagctttccttactaatgt

SEQ ID NO: 113500 - DNA, 22 bp, Artificial Sequence
  Synthetic oligonucleotide; TTA chr11 5394701 5394722 5394706 5394701 -
gcaagctttccttactaatgtc

SEQ ID NO: 113501 - DNA, 22 bp, Artificial Sequence
  Synthetic oligonucleotide; CTT chr11 5394693 5394714 5394698 5394693 -
tccttactaatgtctgcactat

SEQ ID NO: 113502 - DNA, 22 bp, Artificial Sequence
  Synthetic oligonucleotide; TTT chr11 5394692 5394713 5394697 5394692 -
ccttactaatgtctgcactatc

SEQ ID NO: 113503 - DNA, 22 bp, Artificial Sequence
  Synthetic oligonucleotide; TTC chr11 5394691 5394712 5394696 5394691 -
cttactaatgtctgcactatca

SEQ ID NO: 113504 - DNA, 22 bp, Artificial Sequence
  Synthetic oligonucleotide; CTT chr11 5394688 5394709 5394693 5394688 -
actaatgtctgcactatcattc

SEQ ID NO: 113505 - DNA, 22 bp, Artificial Sequence
  Synthetic oligonucleotide; TTA chr11 5394687 5394708 5394692 5394687 -
ctaatgtctgcactatcattca

SEQ ID NO: 113506 - DNA, 22 bp, Artificial Sequence
  Synthetic oligonucleotide; CTA chr11 5394684 5394705 5394689 5394684 -
atgtctgcactatcattcaaaa

SEQ ID NO: 113507 - DNA, 22 bp, Artificial Sequence
  Synthetic oligonucleotide; CTG chr11 5394677 5394698 5394682 5394677 -
cactatcattcaaaataggtaa

SEQ ID NO: 113508 - DNA, 22 bp, Artificial Sequence
  Synthetic oligonucleotide; CTA chr11 5394672 5394693 5394677 5394672 -
tcattcaaaataggtaacattt

SEQ ID NO: 113509 - DNA, 22 bp, Artificial Sequence
  Synthetic oligonucleotide; TTC chr11 5394666 5394687 5394671 5394666 -
aaaataggtaacattttagata

SEQ ID NO: 113510 - DNA, 22 bp, Artificial Sequence
  Synthetic oligonucleotide; TTT chr11 5394650 5394671 5394655 5394650 -
tagatagaggggaaaacatgta

SEQ ID NO: 113511 - DNA, 22 bp, Artificial Sequence
  Synthetic oligonucleotide; TTT chr11 5394649 5394670 5394654 5394649 -
agatagaggggaaaacatgtac

SEQ ID NO: 113512 - DNA, 22 bp, Artificial Sequence
  Synthetic oligonucleotide; TTA chr11 5394648 5394669 5394653 5394648 -
gatagaggggaaaacatgtaca

SEQ ID NO: 113513 - DNA, 22 bp, Artificial Sequence
  Synthetic oligonucleotide; CTC chr11 5394619 5394640 5394624 5394619 -
agagttgtcacaaagcaaaaca

SEQ ID NO: 113514 - DNA, 22 bp, Artificial Sequence
  Synthetic oligonucleotide; TTG chr11 5394612 5394633 5394617 5394612 -
tcacaaagcaaaacataaaatt

SEQ ID NO: 113515 - DNA, 22 bp, Artificial Sequence
  Synthetic oligonucleotide; TTC chr11 5394589 5394610 5394594 5394589 -
tgtgaacttcaattacatgagc

SEQ ID NO: 113516 - DNA, 22 bp, Artificial Sequence
  Synthetic oligonucleotide; CTG chr11 5394587 5394608 5394592 5394587 -
tgaacttcaattacatgagcca

SEQ ID NO: 113517 - DNA, 22 bp, Artificial Sequence
  Synthetic oligonucleotide; CTT chr11 5394580 5394601 5394585 5394580 -
caattacatgagccatctgtgt

SEQ ID NO: 113518 - DNA, 22 bp, Artificial Sequence
  Synthetic oligonucleotide; TTC chr11 5394579 5394600 5394584 5394579 -
aattacatgagccatctgtgtt

SEQ ID NO: 113519 - DNA, 22 bp, Artificial Sequence
  Synthetic oligonucleotide; TTA chr11 5394574 5394595 5394579 5394574 -
catgagccatctgtgttttaca

SEQ ID NO: 113520 - DNA, 22 bp, Artificial Sequence
  Synthetic oligonucleotide; CTG chr11 5394561 5394582 5394566 5394561 -
tgttttacaaatacagtatcaa

SEQ ID NO: 113521 - DNA, 22 bp, Artificial Sequence
  Synthetic oligonucleotide; TTT chr11 5394556 5394577 5394561 5394556 -
tacaaatacagtatcaatttca

SEQ ID NO: 113522 - DNA, 22 bp, Artificial Sequence
  Synthetic oligonucleotide; TTT chr11 5394555 5394576 5394560 5394555 -
acaaatacagtatcaatttcaa

SEQ ID NO: 113523 - DNA, 22 bp, Artificial Sequence
  Synthetic oligonucleotide; TTA chr11 5394554 5394575 5394559 5394554 -
caaatacagtatcaatttcaaa

SEQ ID NO: 113524 - DNA, 22 bp, Artificial Sequence
  Synthetic oligonucleotide; TTT chr11 5394536 5394557 5394541 5394536 -
caaaggcttagagaggcttgtg

SEQ ID NO: 113525 - DNA, 22 bp, Artificial Sequence
  Synthetic oligonucleotide; TTC chr11 5394535 5394556 5394540 5394535 -
aaaggcttagagaggcttgtgg

SEQ ID NO: 113526 - DNA, 22 bp, Artificial Sequence
  Synthetic oligonucleotide; CTT chr11 5394527 5394548 5394532 5394527 -
agagaggcttgtggatattaaa

SEQ ID NO: 113527 - DNA, 22 bp, Artificial Sequence
  Synthetic oligonucleotide; TTA chr11 5394526 5394547 5394531 5394526 -
gagaggcttgtggatattaaat

SEQ ID NO: 113528 - DNA, 22 bp, Artificial Sequence
  Synthetic oligonucleotide; CTT chr11 5394517 5394538 5394522 5394517 -
gtggatattaaataacgggata

SEQ ID NO: 113529 - DNA, 22 bp, Artificial Sequence
  Synthetic oligonucleotide; TTG chr11 5394516 5394537 5394521 5394516 -
tggatattaaataacgggatag

SEQ ID NO: 113530 - DNA, 22 bp, Artificial Sequence
  Synthetic oligonucleotide; TTA chr11 5394507 5394528 5394512 5394507 -
aataacgggatagttgtaaaga

SEQ ID NO: 113531 - DNA, 22 bp, Artificial Sequence
  Synthetic oligonucleotide; TTG chr11 5394491 5394512 5394496 5394491 -
taaagatttttgcctgcaggaa

SEQ ID NO: 113532 - DNA, 22 bp, Artificial Sequence
  Synthetic oligonucleotide; TTT chr11 5394482 5394503 5394487 5394482 -
ttgcctgcaggaatataggctt

SEQ ID NO: 113533 - DNA, 22 bp, Artificial Sequence
  Synthetic oligonucleotide; TTT chr11 5394481 5394502 5394486 5394481 -
tgcctgcaggaatataggcttg

SEQ ID NO: 113534 - DNA, 22 bp, Artificial Sequence
  Synthetic oligonucleotide; TTT chr11 5394480 5394501 5394485 5394480 -
gcctgcaggaatataggcttgt

SEQ ID NO: 113535 - DNA, 22 bp, Artificial Sequence
  Synthetic oligonucleotide; TTG chr11 5394479 5394500 5394484 5394479 -
cctgcaggaatataggcttgtg

SEQ ID NO: 113536 - DNA, 22 bp, Artificial Sequence
  Synthetic oligonucleotide; CTG chr11 5394475 5394496 5394480 5394475 -
caggaatataggcttgtgctga

SEQ ID NO: 113537 - DNA, 22 bp, Artificial Sequence
  Synthetic oligonucleotide; CTT chr11 5394460 5394481 5394465 5394460 -
gtgctgaggaatgggccagatg

SEQ ID NO: 113538 - DNA, 22 bp, Artificial Sequence
  Synthetic oligonucleotide; TTG chr11 5394459 5394480 5394464 5394459 -
tgctgaggaatgggccagatga

SEQ ID NO: 113539 - DNA, 22 bp, Artificial Sequence
  Synthetic oligonucleotide; CTG chr11 5394454 5394475 5394459 5394454 -
aggaatgggccagatgatttaa

SEQ ID NO: 113540 - DNA, 22 bp, Artificial Sequence
  Synthetic oligonucleotide; TTT chr11 5394434 5394455 5394439 5394434 -
aaagcagatactgtcattagca

SEQ ID NO: 113541 - DNA, 22 bp, Artificial Sequence
  Synthetic oligonucleotide; TTA chr11 5394433 5394454 5394438 5394433 -
aagcagatactgtcattagcag

SEQ ID NO: 113542 - DNA, 22 bp, Artificial Sequence
  Synthetic oligonucleotide; CTG chr11 5394421 5394442 5394426 5394421 -
tcattagcaggaatatgtacag

SEQ ID NO: 113543 - DNA, 22 bp, Artificial Sequence
  Synthetic oligonucleotide; TTA chr11 5394415 5394436 5394420 5394415 -
gcaggaatatgtacagctttgg

SEQ ID NO: 113544 - DNA, 22 bp, Artificial Sequence
  Synthetic oligonucleotide; CTT chr11 5394396 5394417 5394401 5394396 -
tggctgattttatgtttttttt

SEQ ID NO: 113545 - DNA, 22 bp, Artificial Sequence
  Synthetic oligonucleotide; TTT chr11 5394395 5394416 5394400 5394395 -
ggctgattttatgttttttttg

SEQ ID NO: 113546 - DNA, 22 bp, Artificial Sequence
  Synthetic oligonucleotide; TTG chr11 5394394 5394415 5394399 5394394 -
gctgattttatgttttttttgg

SEQ ID NO: 113547 - DNA, 22 bp, Artificial Sequence
  Synthetic oligonucleotide; CTG chr11 5394390 5394411 5394395 5394390 -
attttatgttttttttggtttg

SEQ ID NO: 113548 - DNA, 22 bp, Artificial Sequence
  Synthetic oligonucleotide; TTT chr11 5394386 5394407 5394391 5394386 -
tatgttttttttggtttgttgt

SEQ ID NO: 113549 - DNA, 22 bp, Artificial Sequence
  Synthetic oligonucleotide; TTT chr11 5394385 5394406 5394390 5394385 -
atgttttttttggtttgttgtt

SEQ ID NO: 113550 - DNA, 22 bp, Artificial Sequence
  Synthetic oligonucleotide; TTA chr11 5394384 5394405 5394389 5394384 -
tgttttttttggtttgttgttg

SEQ ID NO: 113551 - DNA, 22 bp, Artificial Sequence
  Synthetic oligonucleotide; TTT chr11 5394379 5394400 5394384 5394379 -
tttttggtttgttgttgttgtt

SEQ ID NO: 113552 - DNA, 22 bp, Artificial Sequence
  Synthetic oligonucleotide; TTT chr11 5394378 5394399 5394383 5394378 -
ttttggtttgttgttgttgttg

SEQ ID NO: 113553 - DNA, 22 bp, Artificial Sequence
  Synthetic oligonucleotide; TTT chr11 5394377 5394398 5394382 5394377 -
tttggtttgttgttgttgttga

SEQ ID NO: 113554 - DNA, 22 bp, Artificial Sequence
  Synthetic oligonucleotide; TTT chr11 5394376 5394397 5394381 5394376 -
ttggtttgttgttgttgttgaa

SEQ ID NO: 113555 - DNA, 22 bp, Artificial Sequence
  Synthetic oligonucleotide; TTT chr11 5394375 5394396 5394380 5394375 -
tggtttgttgttgttgttgaat

SEQ ID NO: 113556 - DNA, 22 bp, Artificial Sequence
  Synthetic oligonucleotide; TTT chr11 5394374 5394395 5394379 5394374 -
ggtttgttgttgttgttgaatc

SEQ ID NO: 113557 - DNA, 22 bp, Artificial Sequence
  Synthetic oligonucleotide; TTG chr11 5394373 5394394 5394378 5394373 -
gtttgttgttgttgttgaatca

SEQ ID NO: 113558 - DNA, 22 bp, Artificial Sequence
  Synthetic oligonucleotide; TTT chr11 5394369 5394390 5394374 5394369 -
gttgttgttgttgaatcagtgg

SEQ ID NO: 113559 - DNA, 22 bp, Artificial Sequence
  Synthetic oligonucleotide; TTG chr11 5394368 5394389 5394373 5394368 -
ttgttgttgttgaatcagtgga

SEQ ID NO: 113560 - DNA, 22 bp, Artificial Sequence
  Synthetic oligonucleotide; TTG chr11 5394365 5394386 5394370 5394365 -
ttgttgttgaatcagtggagca

SEQ ID NO: 113561 - DNA, 22 bp, Artificial Sequence
  Synthetic oligonucleotide; TTG chr11 5394362 5394383 5394367 5394362 -
ttgttgaatcagtggagcatag

SEQ ID NO: 113562 - DNA, 22 bp, Artificial Sequence
  Synthetic oligonucleotide; TTG chr11 5394359 5394380 5394364 5394359 -
ttgaatcagtggagcatagtta

SEQ ID NO: 113563 - DNA, 22 bp, Artificial Sequence
  Synthetic oligonucleotide; TTG chr11 5394356 5394377 5394361 5394356 -
aatcagtggagcatagttaaaa

SEQ ID NO: 113564 - DNA, 22 bp, Artificial Sequence
  Synthetic oligonucleotide; TTA chr11 5394337 5394358 5394342 5394337 -
aaactacaagcaccacagtcag

SEQ ID NO: 113565 - DNA, 22 bp, Artificial Sequence
  Synthetic oligonucleotide; CTA chr11 5394331 5394352 5394336 5394331 -
caagcaccacagtcagaactgt

SEQ ID NO: 113566 - DNA, 22 bp, Artificial Sequence
  Synthetic oligonucleotide; CTG chr11 5394310 5394331 5394315 5394310 -
tcaaacttggtataatattggg

SEQ ID NO: 113567 - DNA, 22 bp, Artificial Sequence
  Synthetic oligonucleotide; CTT chr11 5394302 5394323 5394307 5394302 -
ggtataatattgggcaagatat

SEQ ID NO: 113568 - DNA, 22 bp, Artificial Sequence
  Synthetic oligonucleotide; TTG chr11 5394301 5394322 5394306 5394301 -
gtataatattgggcaagatatt

SEQ ID NO: 113569 - DNA, 22 bp, Artificial Sequence
  Synthetic oligonucleotide; TTG chr11 5394290 5394311 5394295 5394290 -
ggcaagatattttgtctctgag

SEQ ID NO: 113570 - DNA, 22 bp, Artificial Sequence
  Synthetic oligonucleotide; TTT chr11 5394278 5394299 5394283 5394278 -
tgtctctgagcctcagtgtact

SEQ ID NO: 113571 - DNA, 22 bp, Artificial Sequence
  Synthetic oligonucleotide; TTT chr11 5394277 5394298 5394282 5394277 -
gtctctgagcctcagtgtactt

SEQ ID NO: 113572 - DNA, 22 bp, Artificial Sequence
  Synthetic oligonucleotide; TTG chr11 5394276 5394297 5394281 5394276 -
tctctgagcctcagtgtactta

SEQ ID NO: 113573 - DNA, 22 bp, Artificial Sequence
  Synthetic oligonucleotide; CTC chr11 5394272 5394293 5394277 5394272 -
tgagcctcagtgtacttatctg

SEQ ID NO: 113574 - DNA, 22 bp, Artificial Sequence
  Synthetic oligonucleotide; CTG chr11 5394270 5394291 5394275 5394270 -
agcctcagtgtacttatctgta

SEQ ID NO: 113575 - DNA, 22 bp, Artificial Sequence
  Synthetic oligonucleotide; CTC chr11 5394264 5394285 5394269 5394264 -
agtgtacttatctgtaaaatgg

SEQ ID NO: 113576 - DNA, 22 bp, Artificial Sequence
  Synthetic oligonucleotide; CTT chr11 5394255 5394276 5394260 5394255 -
atctgtaaaatgggtaatctag

SEQ ID NO: 113577 - DNA, 22 bp, Artificial Sequence
  Synthetic oligonucleotide; TTA chr11 5394254 5394275 5394259 5394254 -
tctgtaaaatgggtaatctagt

SEQ ID NO: 113578 - DNA, 22 bp, Artificial Sequence
  Synthetic oligonucleotide; CTG chr11 5394250 5394271 5394255 5394250 -
taaaatgggtaatctagtagta

SEQ ID NO: 113579 - DNA, 22 bp, Artificial Sequence
  Synthetic oligonucleotide; CTA chr11 5394234 5394255 5394239 5394234 -
gtagtatccatctcataaggtt

SEQ ID NO: 113580 - DNA, 22 bp, Artificial Sequence
  Synthetic oligonucleotide; CTC chr11 5394220 5394241 5394225 5394220 -
ataaggttattgtcaagataaa

SEQ ID NO: 113581 - DNA, 22 bp, Artificial Sequence
  Synthetic oligonucleotide; TTA chr11 5394211 5394232 5394216 5394211 -
ttgtcaagataaagtgacttat

SEQ ID NO: 113582 - DNA, 22 bp, Artificial Sequence
  Synthetic oligonucleotide; TTG chr11 5394208 5394229 5394213 5394208 -
tcaagataaagtgacttatagt

SEQ ID NO: 113583 - DNA, 22 bp, Artificial Sequence
  Synthetic oligonucleotide; CTT chr11 5394191 5394212 5394196 5394191 -
atagtgtattatgcccttagaa

SEQ ID NO: 113584 - DNA, 22 bp, Artificial Sequence
  Synthetic oligonucleotide; TTA chr11 5394190 5394211 5394195 5394190 -
tagtgtattatgcccttagaat

SEQ ID NO: 113585 - DNA, 22 bp, Artificial Sequence
  Synthetic oligonucleotide; TTA chr11 5394180 5394201 5394185 5394180 -
tgcccttagaataatacctagg

SEQ ID NO: 113586 - DNA, 22 bp, Artificial Sequence
  Synthetic oligonucleotide; CTT chr11 5394173 5394194 5394178 5394173 -
agaataatacctaggttataat

SEQ ID NO: 113587 - DNA, 22 bp, Artificial Sequence
  Synthetic oligonucleotide; TTA chr11 5394172 5394193 5394177 5394172 -
gaataatacctaggttataata

SEQ ID NO: 113588 - DNA, 22 bp, Artificial Sequence
  Synthetic oligonucleotide; CTA chr11 5394160 5394181 5394165 5394160 -
ggttataatatgtgcttaaaaa

SEQ ID NO: 113589 - DNA, 22 bp, Artificial Sequence
  Synthetic oligonucleotide; TTA chr11 5394155 5394176 5394160 5394155 -
taatatgtgcttaaaaaaccat

SEQ ID NO: 113590 - DNA, 22 bp, Artificial Sequence
  Synthetic oligonucleotide; CTT chr11 5394143 5394164 5394148 5394143 -
aaaaaaccatgatatgcaaaat

SEQ ID NO: 113591 - DNA, 22 bp, Artificial Sequence
  Synthetic oligonucleotide; TTA chr11 5394142 5394163 5394147 5394142 -
aaaaaccatgatatgcaaaata

SEQ ID NO: 113592 - DNA, 22 bp, Artificial Sequence
  Synthetic oligonucleotide; CTC chr11 5394110 5394131 5394115 5394110 -
agtaccttctactgagtttttc

SEQ ID NO: 113593 - DNA, 22 bp, Artificial Sequence
  Synthetic oligonucleotide; CTT chr11 5394102 5394123 5394107 5394102 -
ctactgagtttttctgtgaatc

SEQ ID NO: 113594 - DNA, 22 bp, Artificial Sequence
  Synthetic oligonucleotide; TTC chr11 5394101 5394122 5394106 5394101 -
tactgagtttttctgtgaatct

SEQ ID NO: 113595 - DNA, 22 bp, Artificial Sequence
  Synthetic oligonucleotide; CTA chr11 5394099 5394120 5394104 5394099 -
ctgagtttttctgtgaatctat

SEQ ID NO: 113596 - DNA, 22 bp, Artificial Sequence
  Synthetic oligonucleotide; CTG chr11 5394096 5394117 5394101 5394096 -
agtttttctgtgaatctataac

SEQ ID NO: 113597 - DNA, 22 bp, Artificial Sequence
  Synthetic oligonucleotide; TTT chr11 5394091 5394112 5394096 5394091 -
ttctgtgaatctataactctta

SEQ ID NO: 113598 - DNA, 22 bp, Artificial Sequence
  Synthetic oligonucleotide; TTT chr11 5394090 5394111 5394095 5394090 -
tctgtgaatctataactcttaa

SEQ ID NO: 113599 - DNA, 22 bp, Artificial Sequence
  Synthetic oligonucleotide; TTT chr11 5394089 5394110 5394094 5394089 -
ctgtgaatctataactcttaaa

SEQ ID NO: 113600 - DNA, 22 bp, Artificial Sequence
  Synthetic oligonucleotide; TTC chr11 5394088 5394109 5394093 5394088 -
tgtgaatctataactcttaaaa

SEQ ID NO: 113601 - DNA, 22 bp, Artificial Sequence
  Synthetic oligonucleotide; CTG chr11 5394086 5394107 5394091 5394086 -
tgaatctataactcttaaaatc

SEQ ID NO: 113602 - DNA, 22 bp, Artificial Sequence
  Synthetic oligonucleotide; CTA chr11 5394078 5394099 5394083 5394078 -
taactcttaaaatcaagtctat

SEQ ID NO: 113603 - DNA, 22 bp, Artificial Sequence
  Synthetic oligonucleotide; CTC chr11 5394072 5394093 5394077 5394072 -
ttaaaatcaagtctattaaaaa

SEQ ID NO: 113604 - DNA, 22 bp, Artificial Sequence
  Synthetic oligonucleotide; CTT chr11 5394070 5394091 5394075 5394070 -
aaaatcaagtctattaaaaagt

SEQ ID NO: 113605 - DNA, 22 bp, Artificial Sequence
  Synthetic oligonucleotide; TTA chr11 5394069 5394090 5394074 5394069 -
aaatcaagtctattaaaaagta

SEQ ID NO: 113606 - DNA, 22 bp, Artificial Sequence
  Synthetic oligonucleotide; CTA chr11 5394057 5394078 5394062 5394057 -
ttaaaaagtatttaatacaata

SEQ ID NO: 113607 - DNA, 22 bp, Artificial Sequence
  Synthetic oligonucleotide; TTA chr11 5394054 5394075 5394059 5394054 -
aaaagtatttaatacaataatt

SEQ ID NO: 113608 - DNA, 22 bp, Artificial Sequence
  Synthetic oligonucleotide; TTT chr11 5394044 5394065 5394049 5394044 -
aatacaataattttatgttact

SEQ ID NO: 113609 - DNA, 22 bp, Artificial Sequence
  Synthetic oligonucleotide; TTA chr11 5394043 5394064 5394048 5394043 -
atacaataattttatgttactg

SEQ ID NO: 113610 - DNA, 22 bp, Artificial Sequence
  Synthetic oligonucleotide; TTT chr11 5394031 5394052 5394036 5394031 -
tatgttactgttttctgttgct

SEQ ID NO: 113611 - DNA, 22 bp, Artificial Sequence
  Synthetic oligonucleotide; TTT chr11 5394030 5394051 5394035 5394030 -
atgttactgttttctgttgcta

SEQ ID NO: 113612 - DNA, 22 bp, Artificial Sequence
  Synthetic oligonucleotide; TTA chr11 5394029 5394050 5394034 5394029 -
tgttactgttttctgttgctat

SEQ ID NO: 113613 - DNA, 22 bp, Artificial Sequence
  Synthetic oligonucleotide; TTA chr11 5394024 5394045 5394029 5394024 -
ctgttttctgttgctatctttt

SEQ ID NO: 113614 - DNA, 22 bp, Artificial Sequence
  Synthetic oligonucleotide; CTG chr11 5394021 5394042 5394026 5394021 -
ttttctgttgctatcttttcct

SEQ ID NO: 113615 - DNA, 22 bp, Artificial Sequence
  Synthetic oligonucleotide; TTT chr11 5394018 5394039 5394023 5394018 -
tctgttgctatcttttcctgat

SEQ ID NO: 113616 - DNA, 22 bp, Artificial Sequence
  Synthetic oligonucleotide; TTT chr11 5394017 5394038 5394022 5394017 -
ctgttgctatcttttcctgata

SEQ ID NO: 113617 - DNA, 22 bp, Artificial Sequence
  Synthetic oligonucleotide; TTC chr11 5394016 5394037 5394021 5394016 -
tgttgctatcttttcctgatac

SEQ ID NO: 113618 - DNA, 22 bp, Artificial Sequence
  Synthetic oligonucleotide; CTG chr11 5394014 5394035 5394019 5394014 -
ttgctatcttttcctgatacta

SEQ ID NO: 113619 - DNA, 22 bp, Artificial Sequence
  Synthetic oligonucleotide; TTG chr11 5394011 5394032 5394016 5394011 -
ctatcttttcctgatactaaat

SEQ ID NO: 113620 - DNA, 22 bp, Artificial Sequence
  Synthetic oligonucleotide; CTA chr11 5394008 5394029 5394013 5394008 -
tcttttcctgatactaaatgga

SEQ ID NO: 113621 - DNA, 22 bp, Artificial Sequence
  Synthetic oligonucleotide; CTT chr11 5394004 5394025 5394009 5394004 -
ttcctgatactaaatggaaaaa

SEQ ID NO: 113622 - DNA, 22 bp, Artificial Sequence
  Synthetic oligonucleotide; TTT chr11 5394003 5394024 5394008 5394003 -
tcctgatactaaatggaaaaat

SEQ ID NO: 113623 - DNA, 22 bp, Artificial Sequence
  Synthetic oligonucleotide; TTT chr11 5394002 5394023 5394007 5394002 -
cctgatactaaatggaaaaata

SEQ ID NO: 113624 - DNA, 22 bp, Artificial Sequence
  Synthetic oligonucleotide; TTC chr11 5394001 5394022 5394006 5394001 -
ctgatactaaatggaaaaatag

SEQ ID NO: 113625 - DNA, 22 bp, Artificial Sequence
  Synthetic oligonucleotide; CTG chr11 5393998 5394019 5394003 5393998 -
atactaaatggaaaaatagata

SEQ ID NO: 113626 - DNA, 22 bp, Artificial Sequence
  Synthetic oligonucleotide; CTA chr11 5393992 5394013 5393997 5393992 -
aatggaaaaatagataacatat

SEQ ID NO: 113627 - DNA, 22 bp, Artificial Sequence
  Synthetic oligonucleotide; TTC chr11 5393968 5393989 5393973 5393968 -
taggaaagggaacaaaaagtta

SEQ ID NO: 113628 - DNA, 22 bp, Artificial Sequence
  Synthetic oligonucleotide; CTA chr11 5393966 5393987 5393971 5393966 -
ggaaagggaacaaaaagttagg

SEQ ID NO: 113629 - DNA, 22 bp, Artificial Sequence
  Synthetic oligonucleotide; TTA chr11 5393946 5393967 5393951 5393946 -
gggagaagccaatgatgggact

SEQ ID NO: 113630 - DNA, 22 bp, Artificial Sequence
  Synthetic oligonucleotide; CTT chr11 5393923 5393944 5393928 5393923 -
ccttcagtataacatggaaaac

SEQ ID NO: 113631 - DNA, 22 bp, Artificial Sequence
  Synthetic oligonucleotide; TTC chr11 5393922 5393943 5393927 5393922 -
cttcagtataacatggaaaaca

SEQ ID NO: 113632 - DNA, 22 bp, Artificial Sequence
  Synthetic oligonucleotide; CTT chr11 5393919 5393940 5393924 5393919 -
cagtataacatggaaaacatgg

SEQ ID NO: 113633 - DNA, 22 bp, Artificial Sequence
  Synthetic oligonucleotide; TTC chr11 5393918 5393939 5393923 5393918 -
agtataacatggaaaacatggc

SEQ ID NO: 113634 - DNA, 22 bp, Artificial Sequence
  Synthetic oligonucleotide; CTG chr11 5393892 5393913 5393897 5393892 -
aaacgagtggtcctgtttggag

SEQ ID NO: 113635 - DNA, 22 bp, Artificial Sequence
  Synthetic oligonucleotide; CTG chr11 5393877 5393898 5393882 5393877 -
tttggagaggagtccagcataa

SEQ ID NO: 113636 - DNA, 22 bp, Artificial Sequence
  Synthetic oligonucleotide; TTT chr11 5393874 5393895 5393879 5393874 -
ggagaggagtccagcataatgg

SEQ ID NO: 113637 - DNA, 22 bp, Artificial Sequence
  Synthetic oligonucleotide; TTG chr11 5393873 5393894 5393878 5393873 -
gagaggagtccagcataatggt

SEQ ID NO: 113638 - DNA, 22 bp, Artificial Sequence
  Synthetic oligonucleotide; TTT chr11 5393849 5393870 5393854 5393849 -
aagaaaatcagatgcgcttgat

SEQ ID NO: 113639 - DNA, 22 bp, Artificial Sequence
  Synthetic oligonucleotide; TTA chr11 5393848 5393869 5393853 5393848 -
agaaaatcagatgcgcttgata

SEQ ID NO: 113640 - DNA, 22 bp, Artificial Sequence
  Synthetic oligonucleotide; CTT chr11 5393830 5393851 5393835 5393830 -
gatattgaatttcagttctgac

SEQ ID NO: 113641 - DNA, 22 bp, Artificial Sequence
  Synthetic oligonucleotide; TTG chr11 5393829 5393850 5393834 5393829 -
atattgaatttcagttctgact

SEQ ID NO: 113642 - DNA, 22 bp, Artificial Sequence
  Synthetic oligonucleotide; TTG chr11 5393823 5393844 5393828 5393823 -
aatttcagttctgacttacatt

SEQ ID NO: 113643 - DNA, 22 bp, Artificial Sequence
  Synthetic oligonucleotide; TTT chr11 5393818 5393839 5393823 5393818 -
cagttctgacttacattaatga

SEQ ID NO: 113644 - DNA, 22 bp, Artificial Sequence
  Synthetic oligonucleotide; TTC chr11 5393817 5393838 5393822 5393817 -
agttctgacttacattaatgat

SEQ ID NO: 113645 - DNA, 22 bp, Artificial Sequence
  Synthetic oligonucleotide; TTC chr11 5393812 5393833 5393817 5393812 -
tgacttacattaatgatttaac

SEQ ID NO: 113646 - DNA, 22 bp, Artificial Sequence
  Synthetic oligonucleotide; CTG chr11 5393810 5393831 5393815 5393810 -
acttacattaatgatttaacta

SEQ ID NO: 113647 - DNA, 22 bp, Artificial Sequence
  Synthetic oligonucleotide; CTT chr11 5393806 5393827 5393811 5393806 -
acattaatgatttaactaagga

SEQ ID NO: 113648 - DNA, 22 bp, Artificial Sequence
  Synthetic oligonucleotide; TTA chr11 5393805 5393826 5393810 5393805 -
cattaatgatttaactaaggaa

SEQ ID NO: 113649 - DNA, 22 bp, Artificial Sequence
  Synthetic oligonucleotide; TTA chr11 5393800 5393821 5393805 5393800 -
atgatttaactaaggaaagttg

SEQ ID NO: 113650 - DNA, 22 bp, Artificial Sequence
  Synthetic oligonucleotide; TTT chr11 5393793 5393814 5393798 5393793 -
aactaaggaaagttgctttcct

SEQ ID NO: 113651 - DNA, 22 bp, Artificial Sequence
  Synthetic oligonucleotide; TTA chr11 5393792 5393813 5393797 5393792 -
actaaggaaagttgctttcctc

SEQ ID NO: 113652 - DNA, 22 bp, Artificial Sequence
  Synthetic oligonucleotide; CTA chr11 5393788 5393809 5393793 5393788 -
aggaaagttgctttcctctgtg

SEQ ID NO: 113653 - DNA, 22 bp, Artificial Sequence
  Synthetic oligonucleotide; TTG chr11 5393778 5393799 5393783 5393778 -
ctttcctctgtgagcctcagtt

SEQ ID NO: 113654 - DNA, 22 bp, Artificial Sequence
  Synthetic oligonucleotide; CTT chr11 5393775 5393796 5393780 5393775 -
tcctctgtgagcctcagtttcc

SEQ ID NO: 113655 - DNA, 22 bp, Artificial Sequence
  Synthetic oligonucleotide; TTT chr11 5393774 5393795 5393779 5393774 -
cctctgtgagcctcagtttcct

SEQ ID NO: 113656 - DNA, 22 bp, Artificial Sequence
  Synthetic oligonucleotide; TTC chr11 5393773 5393794 5393778 5393773 -
ctctgtgagcctcagtttccta

SEQ ID NO: 113657 - DNA, 22 bp, Artificial Sequence
  Synthetic oligonucleotide; CTC chr11 5393770 5393791 5393775 5393770 -
tgtgagcctcagtttcctaatt

SEQ ID NO: 113658 - DNA, 22 bp, Artificial Sequence
  Synthetic oligonucleotide; CTG chr11 5393768 5393789 5393773 5393768 -
tgagcctcagtttcctaatttt

SEQ ID NO: 113659 - DNA, 22 bp, Artificial Sequence
  Synthetic oligonucleotide; CTC chr11 5393760 5393781 5393765 5393760 -
agtttcctaattttaaaacatt

SEQ ID NO: 113660 - DNA, 22 bp, Artificial Sequence
  Synthetic oligonucleotide; TTT chr11 5393755 5393776 5393760 5393755 -
cctaattttaaaacattgaaaa

SEQ ID NO: 113661 - DNA, 22 bp, Artificial Sequence
  Synthetic oligonucleotide; TTC chr11 5393754 5393775 5393759 5393754 -
ctaattttaaaacattgaaaat

SEQ ID NO: 113662 - DNA, 22 bp, Artificial Sequence
  Synthetic oligonucleotide; CTA chr11 5393751 5393772 5393756 5393751 -
attttaaaacattgaaaataat

SEQ ID NO: 113663 - DNA, 22 bp, Artificial Sequence
  Synthetic oligonucleotide; TTT chr11 5393747 5393768 5393752 5393747 -
taaaacattgaaaataataata

SEQ ID NO: 113664 - DNA, 22 bp, Artificial Sequence
  Synthetic oligonucleotide; TTT chr11 5393746 5393767 5393751 5393746 -
aaaacattgaaaataataatac

SEQ ID NO: 113665 - DNA, 22 bp, Artificial Sequence
  Synthetic oligonucleotide; TTA chr11 5393745 5393766 5393750 5393745 -
aaacattgaaaataataatacc

SEQ ID NO: 113666 - DNA, 22 bp, Artificial Sequence
  Synthetic oligonucleotide; TTG chr11 5393737 5393758 5393742 5393737 -
aaaataataatacctccctact

SEQ ID NO: 113667 - DNA, 22 bp, Artificial Sequence
  Synthetic oligonucleotide; CTC chr11 5393721 5393742 5393726 5393721 -
cctacttcacaggtttggtgag

SEQ ID NO: 113668 - DNA, 22 bp, Artificial Sequence
  Synthetic oligonucleotide; CTA chr11 5393717 5393738 5393722 5393717 -
cttcacaggtttggtgagaaaa

SEQ ID NO: 113669 - DNA, 22 bp, Artificial Sequence
  Synthetic oligonucleotide; CTT chr11 5393714 5393735 5393719 5393714 -
cacaggtttggtgagaaaatta

SEQ ID NO: 113670 - DNA, 22 bp, Artificial Sequence
  Synthetic oligonucleotide; TTC chr11 5393713 5393734 5393718 5393713 -
acaggtttggtgagaaaattaa

SEQ ID NO: 113671 - DNA, 22 bp, Artificial Sequence
  Synthetic oligonucleotide; TTT chr11 5393705 5393726 5393710 5393705 -
ggtgagaaaattaaatgaaata

SEQ ID NO: 113672 - DNA, 22 bp, Artificial Sequence
  Synthetic oligonucleotide; TTG chr11 5393704 5393725 5393709 5393704 -
gtgagaaaattaaatgaaataa

SEQ ID NO: 113673 - DNA, 22 bp, Artificial Sequence
  Synthetic oligonucleotide; TTA chr11 5393692 5393713 5393697 5393692 -
aatgaaataatgtaaaataatg

SEQ ID NO: 113674 - DNA, 22 bp, Artificial Sequence
  Synthetic oligonucleotide; CTC chr11 5393654 5393675 5393659 5393654 -
agccctctctaccgtgagttaa

SEQ ID NO: 113675 - DNA, 22 bp, Artificial Sequence
  Synthetic oligonucleotide; CTC chr11 5393647 5393668 5393652 5393647 -
tctaccgtgagttaaatgctta

SEQ ID NO: 113676 - DNA, 22 bp, Artificial Sequence
  Synthetic oligonucleotide; CTC chr11 5393645 5393666 5393650 5393645 -
taccgtgagttaaatgcttaat

SEQ ID NO: 113677 - DNA, 22 bp, Artificial Sequence
  Synthetic oligonucleotide; CTA chr11 5393643 5393664 5393648 5393643 -
ccgtgagttaaatgcttaataa

SEQ ID NO: 113678 - DNA, 22 bp, Artificial Sequence
  Synthetic oligonucleotide; TTA chr11 5393633 5393654 5393638 5393633 -
aatgcttaataaacattagcat

SEQ ID NO: 113679 - DNA, 22 bp, Artificial Sequence
  Synthetic oligonucleotide; CTT chr11 5393626 5393647 5393631 5393626 -
aataaacattagcatttatcat

SEQ ID NO: 113680 - DNA, 22 bp, Artificial Sequence
  Synthetic oligonucleotide; TTA chr11 5393625 5393646 5393630 5393625 -
ataaacattagcatttatcatg

SEQ ID NO: 113681 - DNA, 22 bp, Artificial Sequence
  Synthetic oligonucleotide; TTA chr11 5393615 5393636 5393620 5393615 -
gcatttatcatgatcataatta

SEQ ID NO: 113682 - DNA, 22 bp, Artificial Sequence
  Synthetic oligonucleotide; TTT chr11 5393609 5393630 5393614 5393609 -
atcatgatcataattatcatct

SEQ ID NO: 113683 - DNA, 22 bp, Artificial Sequence
  Synthetic oligonucleotide; TTA chr11 5393608 5393629 5393613 5393608 -
tcatgatcataattatcatctt

SEQ ID NO: 113684 - DNA, 22 bp, Artificial Sequence
  Synthetic oligonucleotide; TTA chr11 5393593 5393614 5393598 5393593 -
tcatcttcattgtcatcttcag

SEQ ID NO: 113685 - DNA, 22 bp, Artificial Sequence
  Synthetic oligonucleotide; CTT chr11 5393586 5393607 5393591 5393586 -
cattgtcatcttcagcataatc

SEQ ID NO: 113686 - DNA, 22 bp, Artificial Sequence
  Synthetic oligonucleotide; TTC chr11 5393585 5393606 5393590 5393585 -
attgtcatcttcagcataatcg

SEQ ID NO: 113687 - DNA, 22 bp, Artificial Sequence
  Synthetic oligonucleotide; TTG chr11 5393581 5393602 5393586 5393581 -
tcatcttcagcataatcgtata

SEQ ID NO: 113688 - DNA, 22 bp, Artificial Sequence
  Synthetic oligonucleotide; CTT chr11 5393574 5393595 5393579 5393574 -
cagcataatcgtatataacttt

SEQ ID NO: 113689 - DNA, 22 bp, Artificial Sequence
  Synthetic oligonucleotide; TTC chr11 5393573 5393594 5393578 5393573 -
agcataatcgtatataactttt

SEQ ID NO: 113690 - DNA, 22 bp, Artificial Sequence
  Synthetic oligonucleotide; CTT chr11 5393553 5393574 5393558 5393553 -
tttatagtcattgtaaaatgct

SEQ ID NO: 113691 - DNA, 22 bp, Artificial Sequence
  Synthetic oligonucleotide; TTT chr11 5393552 5393573 5393557 5393552 -
ttatagtcattgtaaaatgctc

SEQ ID NO: 113692 - DNA, 22 bp, Artificial Sequence
  Synthetic oligonucleotide; TTT chr11 5393551 5393572 5393556 5393551 -
tatagtcattgtaaaatgctct

SEQ ID NO: 113693 - DNA, 22 bp, Artificial Sequence
  Synthetic oligonucleotide; TTT chr11 5393550 5393571 5393555 5393550 -
atagtcattgtaaaatgctctt

SEQ ID NO: 113694 - DNA, 22 bp, Artificial Sequence
  Synthetic oligonucleotide; TTA chr11 5393549 5393570 5393554 5393549 -
tagtcattgtaaaatgctcttt

SEQ ID NO: 113695 - DNA, 22 bp, Artificial Sequence
  Synthetic oligonucleotide; TTG chr11 5393540 5393561 5393545 5393540 -
taaaatgctctttttagattat

SEQ ID NO: 113696 - DNA, 22 bp, Artificial Sequence
  Synthetic oligonucleotide; CTC chr11 5393530 5393551 5393535 5393530 -
tttttagattataaaaccgaaa

SEQ ID NO: 113697 - DNA, 22 bp, Artificial Sequence
  Synthetic oligonucleotide; CTT chr11 5393528 5393549 5393533 5393528 -
tttagattataaaaccgaaatg

SEQ ID NO: 113698 - DNA, 22 bp, Artificial Sequence
  Synthetic oligonucleotide; TTT chr11 5393527 5393548 5393532 5393527 -
ttagattataaaaccgaaatgt

SEQ ID NO: 113699 - DNA, 22 bp, Artificial Sequence
  Synthetic oligonucleotide; TTT chr11 5393526 5393547 5393531 5393526 -
tagattataaaaccgaaatgtc

SEQ ID NO: 113700 - DNA, 22 bp, Artificial Sequence
  Synthetic oligonucleotide; TTT chr11 5393525 5393546 5393530 5393525 -
agattataaaaccgaaatgtct

SEQ ID NO: 113701 - DNA, 22 bp, Artificial Sequence
  Synthetic oligonucleotide; TTA chr11 5393524 5393545 5393529 5393524 -
gattataaaaccgaaatgtctt

SEQ ID NO: 113702 - DNA, 22 bp, Artificial Sequence
  Synthetic oligonucleotide; TTA chr11 5393519 5393540 5393524 5393519 -
taaaaccgaaatgtcttcttca

SEQ ID NO: 113703 - DNA, 22 bp, Artificial Sequence
  Synthetic oligonucleotide; CTT chr11 5393502 5393523 5393507 5393502 -
cttcagaaaatttgtatacggc

SEQ ID NO: 113704 - DNA, 22 bp, Artificial Sequence
  Synthetic oligonucleotide; TTC chr11 5393501 5393522 5393506 5393501 -
ttcagaaaatttgtatacggca

SEQ ID NO: 113705 - DNA, 22 bp, Artificial Sequence
  Synthetic oligonucleotide; CTT chr11 5393499 5393520 5393504 5393499 -
cagaaaatttgtatacggcaaa

SEQ ID NO: 113706 - DNA, 22 bp, Artificial Sequence
  Synthetic oligonucleotide; TTC chr11 5393498 5393519 5393503 5393498 -
agaaaatttgtatacggcaaag

SEQ ID NO: 113707 - DNA, 22 bp, Artificial Sequence
  Synthetic oligonucleotide; TTT chr11 5393489 5393510 5393494 5393489 -
gtatacggcaaagatagagaaa

SEQ ID NO: 113708 - DNA, 22 bp, Artificial Sequence
  Synthetic oligonucleotide; TTG chr11 5393488 5393509 5393493 5393488 -
tatacggcaaagatagagaaat

SEQ ID NO: 113709 - DNA, 22 bp, Artificial Sequence
  Synthetic oligonucleotide; CTA chr11 5393463 5393484 5393468 5393463 -
tatagaaaataagattatatat

SEQ ID NO: 113710 - DNA, 22 bp, Artificial Sequence
  Synthetic oligonucleotide; TTA chr11 5393446 5393467 5393451 5393446 -
tatataacagctgtttttcttt

SEQ ID NO: 113711 - DNA, 22 bp, Artificial Sequence
  Synthetic oligonucleotide; CTG chr11 5393433 5393454 5393438 5393433 -
tttttcttttgatacaaatatt

SEQ ID NO: 113712 - DNA, 22 bp, Artificial Sequence
  Synthetic oligonucleotide; TTT chr11 5393430 5393451 5393435 5393430 -
ttcttttgatacaaatatttat

SEQ ID NO: 113713 - DNA, 22 bp, Artificial Sequence
  Synthetic oligonucleotide; TTT chr11 5393429 5393450 5393434 5393429 -
tcttttgatacaaatatttata

SEQ ID NO: 113714 - DNA, 22 bp, Artificial Sequence
  Synthetic oligonucleotide; TTT chr11 5393428 5393449 5393433 5393428 -
cttttgatacaaatatttatag

SEQ ID NO: 113715 - DNA, 22 bp, Artificial Sequence
  Synthetic oligonucleotide; TTC chr11 5393427 5393448 5393432 5393427 -
ttttgatacaaatatttatagc

SEQ ID NO: 113716 - DNA, 22 bp, Artificial Sequence
  Synthetic oligonucleotide; CTT chr11 5393425 5393446 5393430 5393425 -
ttgatacaaatatttatagcct

SEQ ID NO: 113717 - DNA, 22 bp, Artificial Sequence
  Synthetic oligonucleotide; TTT chr11 5393424 5393445 5393429 5393424 -
tgatacaaatatttatagcctt

SEQ ID NO: 113718 - DNA, 22 bp, Artificial Sequence
  Synthetic oligonucleotide; TTT chr11 5393423 5393444 5393428 5393423 -
gatacaaatatttatagccttt

SEQ ID NO: 113719 - DNA, 22 bp, Artificial Sequence
  Synthetic oligonucleotide; TTG chr11 5393422 5393443 5393427 5393422 -
atacaaatatttatagcctttt

SEQ ID NO: 113720 - DNA, 22 bp, Artificial Sequence
  Synthetic oligonucleotide; TTT chr11 5393410 5393431 5393415 5393410 -
atagccttttacatagtgattg

SEQ ID NO: 113721 - DNA, 22 bp, Artificial Sequence
  Synthetic oligonucleotide; TTA chr11 5393409 5393430 5393414 5393409 -
tagccttttacatagtgattgt

SEQ ID NO: 113722 - DNA, 22 bp, Artificial Sequence
  Synthetic oligonucleotide; CTT chr11 5393402 5393423 5393407 5393402 -
ttacatagtgattgttctgtac

SEQ ID NO: 113723 - DNA, 22 bp, Artificial Sequence
  Synthetic oligonucleotide; TTT chr11 5393401 5393422 5393406 5393401 -
tacatagtgattgttctgtacc

SEQ ID NO: 113724 - DNA, 22 bp, Artificial Sequence
  Synthetic oligonucleotide; TTT chr11 5393400 5393421 5393405 5393400 -
acatagtgattgttctgtacct

SEQ ID NO: 113725 - DNA, 22 bp, Artificial Sequence
  Synthetic oligonucleotide; TTA chr11 5393399 5393420 5393404 5393399 -
catagtgattgttctgtaccta

SEQ ID NO: 113726 - DNA, 22 bp, Artificial Sequence
  Synthetic oligonucleotide; TTG chr11 5393388 5393409 5393393 5393388 -
ttctgtacctaattttgcttat

SEQ ID NO: 113727 - DNA, 22 bp, Artificial Sequence
  Synthetic oligonucleotide; TTC chr11 5393385 5393406 5393390 5393385 -
tgtacctaattttgcttatttt

SEQ ID NO: 113728 - DNA, 22 bp, Artificial Sequence
  Synthetic oligonucleotide; CTG chr11 5393383 5393404 5393388 5393383 -
tacctaattttgcttattttta

SEQ ID NO: 113729 - DNA, 22 bp, Artificial Sequence
  Synthetic oligonucleotide; CTA chr11 5393377 5393398 5393382 5393377 -
attttgcttatttttatttaat

SEQ ID NO: 113730 - DNA, 22 bp, Artificial Sequence
  Synthetic oligonucleotide; TTT chr11 5393373 5393394 5393378 5393373 -
tgcttatttttatttaatattt

SEQ ID NO: 113731 - DNA, 22 bp, Artificial Sequence
  Synthetic oligonucleotide; TTT chr11 5393372 5393393 5393377 5393372 -
gcttatttttatttaatatttt

SEQ ID NO: 113732 - DNA, 22 bp, Artificial Sequence
  Synthetic oligonucleotide; TTG chr11 5393371 5393392 5393376 5393371 -
cttatttttatttaatattttg

SEQ ID NO: 113733 - DNA, 22 bp, Artificial Sequence
  Synthetic oligonucleotide; CTT chr11 5393368 5393389 5393373 5393368 -
atttttatttaatattttgcca

SEQ ID NO: 113734 - DNA, 22 bp, Artificial Sequence
  Synthetic oligonucleotide; TTA chr11 5393367 5393388 5393372 5393367 -
tttttatttaatattttgccaa

SEQ ID NO: 113735 - DNA, 22 bp, Artificial Sequence
  Synthetic oligonucleotide; TTT chr11 5393364 5393385 5393369 5393364 -
ttatttaatattttgccaacag

SEQ ID NO: 113736 - DNA, 22 bp, Artificial Sequence
  Synthetic oligonucleotide; TTT chr11 5393363 5393384 5393368 5393363 -
tatttaatattttgccaacagt

SEQ ID NO: 113737 - DNA, 22 bp, Artificial Sequence
  Synthetic oligonucleotide; TTT chr11 5393362 5393383 5393367 5393362 -
atttaatattttgccaacagtt

SEQ ID NO: 113738 - DNA, 22 bp, Artificial Sequence
  Synthetic oligonucleotide; TTA chr11 5393361 5393382 5393366 5393361 -
tttaatattttgccaacagttt

SEQ ID NO: 113739 - DNA, 22 bp, Artificial Sequence
  Synthetic oligonucleotide; TTT chr11 5393358 5393379 5393363 5393358 -
aatattttgccaacagtttcct

SEQ ID NO: 113740 - DNA, 22 bp, Artificial Sequence
  Synthetic oligonucleotide; TTA chr11 5393357 5393378 5393362 5393357 -
atattttgccaacagtttccta

SEQ ID NO: 113741 - DNA, 22 bp, Artificial Sequence
  Synthetic oligonucleotide; TTT chr11 5393351 5393372 5393356 5393351 -
tgccaacagtttcctaagcatt

SEQ ID NO: 113742 - DNA, 22 bp, Artificial Sequence
  Synthetic oligonucleotide; TTT chr11 5393350 5393371 5393355 5393350 -
gccaacagtttcctaagcattt

SEQ ID NO: 113743 - DNA, 22 bp, Artificial Sequence
  Synthetic oligonucleotide; TTG chr11 5393349 5393370 5393354 5393349 -
ccaacagtttcctaagcattta

SEQ ID NO: 113744 - DNA, 22 bp, Artificial Sequence
  Synthetic oligonucleotide; TTT chr11 5393339 5393360 5393344 5393339 -
cctaagcatttaaatgtcattt

SEQ ID NO: 113745 - DNA, 22 bp, Artificial Sequence
  Synthetic oligonucleotide; TTC chr11 5393338 5393359 5393343 5393338 -
ctaagcatttaaatgtcatttt

SEQ ID NO: 113746 - DNA, 22 bp, Artificial Sequence
  Synthetic oligonucleotide; CTA chr11 5393335 5393356 5393340 5393335 -
agcatttaaatgtcattttaat

SEQ ID NO: 113747 - DNA, 22 bp, Artificial Sequence
  Synthetic oligonucleotide; TTT chr11 5393328 5393349 5393333 5393328 -
aaatgtcattttaataatagtg

SEQ ID NO: 113748 - DNA, 22 bp, Artificial Sequence
  Synthetic oligonucleotide; TTA chr11 5393327 5393348 5393332 5393327 -
aatgtcattttaataatagtgt

SEQ ID NO: 113749 - DNA, 22 bp, Artificial Sequence
  Synthetic oligonucleotide; TTT chr11 5393317 5393338 5393322 5393317 -
taataatagtgtatcaaatgaa

SEQ ID NO: 113750 - DNA, 22 bp, Artificial Sequence
  Synthetic oligonucleotide; TTT chr11 5393316 5393337 5393321 5393316 -
aataatagtgtatcaaatgaat

SEQ ID NO: 113751 - DNA, 22 bp, Artificial Sequence
  Synthetic oligonucleotide; TTA chr11 5393315 5393336 5393320 5393315 -
ataatagtgtatcaaatgaata

SEQ ID NO: 113752 - DNA, 22 bp, Artificial Sequence
  Synthetic oligonucleotide; CTT chr11 5393288 5393309 5393293 5393288 -
tgatttatgtaatatttttatt

SEQ ID NO: 113753 - DNA, 22 bp, Artificial Sequence
  Synthetic oligonucleotide; TTT chr11 5393287 5393308 5393292 5393287 -
gatttatgtaatatttttattc

SEQ ID NO: 113754 - DNA, 22 bp, Artificial Sequence
  Synthetic oligonucleotide; TTG chr11 5393286 5393307 5393291 5393286 -
atttatgtaatatttttattct

SEQ ID NO: 113755 - DNA, 22 bp, Artificial Sequence
  Synthetic oligonucleotide; TTT chr11 5393282 5393303 5393287 5393282 -
atgtaatatttttattctagac

SEQ ID NO: 113756 - DNA, 22 bp, Artificial Sequence
  Synthetic oligonucleotide; TTA chr11 5393281 5393302 5393286 5393281 -
tgtaatatttttattctagaca

SEQ ID NO: 113757 - DNA, 22 bp, Artificial Sequence
  Synthetic oligonucleotide; TTT chr11 5393271 5393292 5393276 5393271 -
ttattctagacattttgtatgc

SEQ ID NO: 113758 - DNA, 22 bp, Artificial Sequence
  Synthetic oligonucleotide; TTT chr11 5393270 5393291 5393275 5393270 -
tattctagacattttgtatgct

SEQ ID NO: 113759 - DNA, 22 bp, Artificial Sequence
  Synthetic oligonucleotide; TTT chr11 5393269 5393290 5393274 5393269 -
attctagacattttgtatgctt

SEQ ID NO: 113760 - DNA, 22 bp, Artificial Sequence
  Synthetic oligonucleotide; TTA chr11 5393268 5393289 5393273 5393268 -
ttctagacattttgtatgctta

SEQ ID NO: 113761 - DNA, 22 bp, Artificial Sequence
  Synthetic oligonucleotide; TTC chr11 5393265 5393286 5393270 5393265 -
tagacattttgtatgcttacat

SEQ ID NO: 113762 - DNA, 22 bp, Artificial Sequence
  Synthetic oligonucleotide; CTA chr11 5393263 5393284 5393268 5393263 -
gacattttgtatgcttacattc

SEQ ID NO: 113763 - DNA, 22 bp, Artificial Sequence
  Synthetic oligonucleotide; TTT chr11 5393256 5393277 5393261 5393256 -
tgtatgcttacattcttaaaat

SEQ ID NO: 113764 - DNA, 22 bp, Artificial Sequence
  Synthetic oligonucleotide; TTT chr11 5393255 5393276 5393260 5393255 -
gtatgcttacattcttaaaatt

SEQ ID NO: 113765 - DNA, 22 bp, Artificial Sequence
  Synthetic oligonucleotide; TTG chr11 5393254 5393275 5393259 5393254 -
tatgcttacattcttaaaatta

SEQ ID NO: 113766 - DNA, 22 bp, Artificial Sequence
  Synthetic oligonucleotide; CTT chr11 5393247 5393268 5393252 5393247 -
acattcttaaaattatgaacaa

SEQ ID NO: 113767 - DNA, 22 bp, Artificial Sequence
  Synthetic oligonucleotide; TTA chr11 5393246 5393267 5393251 5393246 -
cattcttaaaattatgaacaat

SEQ ID NO: 113768 - DNA, 22 bp, Artificial Sequence
  Synthetic oligonucleotide; TTC chr11 5393241 5393262 5393246 5393241 -
ttaaaattatgaacaataacac

SEQ ID NO: 113769 - DNA, 22 bp, Artificial Sequence
  Synthetic oligonucleotide; CTT chr11 5393239 5393260 5393244 5393239 -
aaaattatgaacaataacacaa

SEQ ID NO: 113770 - DNA, 22 bp, Artificial Sequence
  Synthetic oligonucleotide; TTA chr11 5393238 5393259 5393243 5393238 -
aaattatgaacaataacacaaa

SEQ ID NO: 113771 - DNA, 22 bp, Artificial Sequence
  Synthetic oligonucleotide; TTA chr11 5393232 5393253 5393237 5393232 -
tgaacaataacacaaattataa

SEQ ID NO: 113772 - DNA, 22 bp, Artificial Sequence
  Synthetic oligonucleotide; TTA chr11 5393213 5393234 5393218 5393213 -
taatattcacttattaaatagt

SEQ ID NO: 113773 - DNA, 22 bp, Artificial Sequence
  Synthetic oligonucleotide; TTC chr11 5393205 5393226 5393210 5393205 -
acttattaaatagttcaacaca

SEQ ID NO: 113774 - DNA, 22 bp, Artificial Sequence
  Synthetic oligonucleotide; CTT chr11 5393201 5393222 5393206 5393201 -
attaaatagttcaacacatatt

SEQ ID NO: 113775 - DNA, 22 bp, Artificial Sequence
  Synthetic oligonucleotide; TTA chr11 5393200 5393221 5393205 5393200 -
ttaaatagttcaacacatattt

SEQ ID NO: 113776 - DNA, 22 bp, Artificial Sequence
  Synthetic oligonucleotide; TTA chr11 5393197 5393218 5393202 5393197 -
aatagttcaacacatatttatt

SEQ ID NO: 113777 - DNA, 22 bp, Artificial Sequence
  Synthetic oligonucleotide; TTC chr11 5393189 5393210 5393194 5393189 -
aacacatatttattgatcactg

SEQ ID NO: 113778 - DNA, 22 bp, Artificial Sequence
  Synthetic oligonucleotide; TTT chr11 5393178 5393199 5393183 5393178 -
attgatcactgacctaggagat

SEQ ID NO: 113779 - DNA, 22 bp, Artificial Sequence
  Synthetic oligonucleotide; TTA chr11 5393177 5393198 5393182 5393177 -
ttgatcactgacctaggagatg

SEQ ID NO: 113780 - DNA, 22 bp, Artificial Sequence
  Synthetic oligonucleotide; TTG chr11 5393174 5393195 5393179 5393174 -
atcactgacctaggagatggat

SEQ ID NO: 113781 - DNA, 22 bp, Artificial Sequence
  Synthetic oligonucleotide; CTG chr11 5393167 5393188 5393172 5393167 -
acctaggagatggatttagaac

SEQ ID NO: 113782 - DNA, 22 bp, Artificial Sequence
  Synthetic oligonucleotide; CTA chr11 5393162 5393183 5393167 5393162 -
ggagatggatttagaactgtga

SEQ ID NO: 113783 - DNA, 22 bp, Artificial Sequence
  Synthetic oligonucleotide; TTT chr11 5393150 5393171 5393155 5393150 -
agaactgtgagcaaacaggaaa

SEQ ID NO: 113784 - DNA, 22 bp, Artificial Sequence
  Synthetic oligonucleotide; TTA chr11 5393149 5393170 5393154 5393149 -
gaactgtgagcaaacaggaaaa

SEQ ID NO: 113785 - DNA, 22 bp, Artificial Sequence
  Synthetic oligonucleotide; CTG chr11 5393143 5393164 5393148 5393143 -
tgagcaaacaggaaaaaaattt

SEQ ID NO: 113786 - DNA, 22 bp, Artificial Sequence
  Synthetic oligonucleotide; TTT chr11 5393121 5393142 5393126 5393121 -
tgccacaaacagcttacatcct

SEQ ID NO: 113787 - DNA, 22 bp, Artificial Sequence
  Synthetic oligonucleotide; TTT chr11 5393120 5393141 5393125 5393120 -
gccacaaacagcttacatccta

SEQ ID NO: 113788 - DNA, 22 bp, Artificial Sequence
  Synthetic oligonucleotide; TTG chr11 5393119 5393140 5393124 5393119 -
ccacaaacagcttacatcctaa

SEQ ID NO: 113789 - DNA, 22 bp, Artificial Sequence
  Synthetic oligonucleotide; CTT chr11 5393106 5393127 5393111 5393106 -
acatcctaaatttttaatttat

SEQ ID NO: 113790 - DNA, 22 bp, Artificial Sequence
  Synthetic oligonucleotide; TTA chr11 5393105 5393126 5393110 5393105 -
catcctaaatttttaatttatc

SEQ ID NO: 113791 - DNA, 22 bp, Artificial Sequence
  Synthetic oligonucleotide; CTA chr11 5393098 5393119 5393103 5393098 -
aatttttaatttatcatttatt

SEQ ID NO: 113792 - DNA, 22 bp, Artificial Sequence
  Synthetic oligonucleotide; TTT chr11 5393093 5393114 5393098 5393093 -
ttaatttatcatttatttagga

SEQ ID NO: 113793 - DNA, 22 bp, Artificial Sequence
  Synthetic oligonucleotide; TTT chr11 5393092 5393113 5393097 5393092 -
taatttatcatttatttaggac

SEQ ID NO: 113794 - DNA, 22 bp, Artificial Sequence
  Synthetic oligonucleotide; TTT chr11 5393091 5393112 5393096 5393091 -
aatttatcatttatttaggaca

SEQ ID NO: 113795 - DNA, 22 bp, Artificial Sequence
  Synthetic oligonucleotide; TTA chr11 5393090 5393111 5393095 5393090 -
atttatcatttatttaggacag

SEQ ID NO: 113796 - DNA, 22 bp, Artificial Sequence
  Synthetic oligonucleotide; TTT chr11 5393086 5393107 5393091 5393086 -
atcatttatttaggacagattt

SEQ ID NO: 113797 - DNA, 22 bp, Artificial Sequence
  Synthetic oligonucleotide; TTA chr11 5393085 5393106 5393090 5393085 -
tcatttatttaggacagatttt

SEQ ID NO: 113798 - DNA, 22 bp, Artificial Sequence
  Synthetic oligonucleotide; TTT chr11 5393079 5393100 5393084 5393079 -
atttaggacagatttttagaag

SEQ ID NO: 113799 - DNA, 22 bp, Artificial Sequence
  Synthetic oligonucleotide; TTA chr11 5393078 5393099 5393083 5393078 -
tttaggacagatttttagaagt

SEQ ID NO: 113800 - DNA, 22 bp, Artificial Sequence
  Synthetic oligonucleotide; TTT chr11 5393075 5393096 5393080 5393075 -
aggacagatttttagaagtggc

SEQ ID NO: 113801 - DNA, 22 bp, Artificial Sequence
  Synthetic oligonucleotide; TTA chr11 5393074 5393095 5393079 5393074 -
ggacagatttttagaagtggca

SEQ ID NO: 113802 - DNA, 22 bp, Artificial Sequence
  Synthetic oligonucleotide; TTT chr11 5393064 5393085 5393069 5393064 -
ttagaagtggcatttctgagac

SEQ ID NO: 113803 - DNA, 22 bp, Artificial Sequence
  Synthetic oligonucleotide; TTT chr11 5393063 5393084 5393068 5393063 -
tagaagtggcatttctgagaca

SEQ ID NO: 113804 - DNA, 22 bp, Artificial Sequence
  Synthetic oligonucleotide; TTT chr11 5393062 5393083 5393067 5393062 -
agaagtggcatttctgagacac

SEQ ID NO: 113805 - DNA, 22 bp, Artificial Sequence
  Synthetic oligonucleotide; TTA chr11 5393061 5393082 5393066 5393061 -
gaagtggcatttctgagacaca

SEQ ID NO: 113806 - DNA, 22 bp, Artificial Sequence
  Synthetic oligonucleotide; TTT chr11 5393049 5393070 5393054 5393049 -
ctgagacacagagcatgaatat

SEQ ID NO: 113807 - DNA, 22 bp, Artificial Sequence
  Synthetic oligonucleotide; TTC chr11 5393048 5393069 5393053 5393048 -
tgagacacagagcatgaatatt

SEQ ID NO: 113808 - DNA, 22 bp, Artificial Sequence
  Synthetic oligonucleotide; CTG chr11 5393046 5393067 5393051 5393046 -
agacacagagcatgaatatttt

SEQ ID NO: 113809 - DNA, 22 bp, Artificial Sequence
  Synthetic oligonucleotide; TTT chr11 5393025 5393046 5393030 5393025 -
tcaagtcttttgatgtattttg

SEQ ID NO: 113810 - DNA, 22 bp, Artificial Sequence
  Synthetic oligonucleotide; TTT chr11 5393024 5393045 5393029 5393024 -
caagtcttttgatgtattttgt

SEQ ID NO: 113811 - DNA, 22 bp, Artificial Sequence
  Synthetic oligonucleotide; TTC chr11 5393023 5393044 5393028 5393023 -
aagtcttttgatgtattttgtt

SEQ ID NO: 113812 - DNA, 22 bp, Artificial Sequence
  Synthetic oligonucleotide; CTT chr11 5393016 5393037 5393021 5393016 -
ttgatgtattttgttttttata

SEQ ID NO: 113813 - DNA, 22 bp, Artificial Sequence
  Synthetic oligonucleotide; TTT chr11 5393015 5393036 5393020 5393015 -
tgatgtattttgttttttataa

SEQ ID NO: 113814 - DNA, 22 bp, Artificial Sequence
  Synthetic oligonucleotide; TTT chr11 5393014 5393035 5393019 5393014 -
gatgtattttgttttttataaa

SEQ ID NO: 113815 - DNA, 22 bp, Artificial Sequence
  Synthetic oligonucleotide; TTG chr11 5393013 5393034 5393018 5393013 -
atgtattttgttttttataaaa

SEQ ID NO: 113816 - DNA, 22 bp, Artificial Sequence
  Synthetic oligonucleotide; TTT chr11 5393005 5393026 5393010 5393005 -
tgttttttataaaaggcaaatt

SEQ ID NO: 113817 - DNA, 22 bp, Artificial Sequence
  Synthetic oligonucleotide; TTT chr11 5393004 5393025 5393009 5393004 -
gttttttataaaaggcaaatta

SEQ ID NO: 113818 - DNA, 22 bp, Artificial Sequence
  Synthetic oligonucleotide; TTG chr11 5393003 5393024 5393008 5393003 -
ttttttataaaaggcaaattaa

SEQ ID NO: 113819 - DNA, 22 bp, Artificial Sequence
  Synthetic oligonucleotide; TTT chr11 5393000 5393021 5393005 5393000 -
tttataaaaggcaaattaaatt

SEQ ID NO: 113820 - DNA, 22 bp, Artificial Sequence
  Synthetic oligonucleotide; TTT chr11 5392999 5393020 5393004 5392999 -
ttataaaaggcaaattaaatta

SEQ ID NO: 113821 - DNA, 22 bp, Artificial Sequence
  Synthetic oligonucleotide; TTT chr11 5392998 5393019 5393003 5392998 -
tataaaaggcaaattaaattat

SEQ ID NO: 113822 - DNA, 22 bp, Artificial Sequence
  Synthetic oligonucleotide; TTT chr11 5392997 5393018 5393002 5392997 -
ataaaaggcaaattaaattatg

SEQ ID NO: 113823 - DNA, 22 bp, Artificial Sequence
  Synthetic oligonucleotide; TTA chr11 5392996 5393017 5393001 5392996 -
taaaaggcaaattaaattatgt

SEQ ID NO: 113824 - DNA, 22 bp, Artificial Sequence
  Synthetic oligonucleotide; TTA chr11 5392982 5393003 5392987 5392982 -
aattatgttttcattctggtat

SEQ ID NO: 113825 - DNA, 22 bp, Artificial Sequence
  Synthetic oligonucleotide; TTA chr11 5392977 5392998 5392982 5392977 -
tgttttcattctggtatgtgaa

SEQ ID NO: 113826 - DNA, 22 bp, Artificial Sequence
  Synthetic oligonucleotide; TTT chr11 5392972 5392993 5392977 5392972 -
tcattctggtatgtgaaaatac

SEQ ID NO: 113827 - DNA, 22 bp, Artificial Sequence
  Synthetic oligonucleotide; TTT chr11 5392971 5392992 5392976 5392971 -
cattctggtatgtgaaaatacc

SEQ ID NO: 113828 - DNA, 22 bp, Artificial Sequence
  Synthetic oligonucleotide; TTC chr11 5392970 5392991 5392975 5392970 -
attctggtatgtgaaaatacct

SEQ ID NO: 113829 - DNA, 22 bp, Artificial Sequence
  Synthetic oligonucleotide; TTC chr11 5392966 5392987 5392971 5392966 -
tggtatgtgaaaatacctcttt

SEQ ID NO: 113830 - DNA, 22 bp, Artificial Sequence
  Synthetic oligonucleotide; CTG chr11 5392964 5392985 5392969 5392964 -
gtatgtgaaaatacctctttta

SEQ ID NO: 113831 - DNA, 22 bp, Artificial Sequence
  Synthetic oligonucleotide; CTC chr11 5392947 5392968 5392952 5392947 -
ttttaccacatacttaacagca

SEQ ID NO: 113832 - DNA, 22 bp, Artificial Sequence
  Synthetic oligonucleotide; CTT chr11 5392945 5392966 5392950 5392945 -
ttaccacatacttaacagcaca

SEQ ID NO: 113833 - DNA, 22 bp, Artificial Sequence
  Synthetic oligonucleotide; TTT chr11 5392944 5392965 5392949 5392944 -
taccacatacttaacagcacag

SEQ ID NO: 113834 - DNA, 22 bp, Artificial Sequence
  Synthetic oligonucleotide; TTT chr11 5392943 5392964 5392948 5392943 -
accacatacttaacagcacaga

SEQ ID NO: 113835 - DNA, 22 bp, Artificial Sequence
  Synthetic oligonucleotide; TTA chr11 5392942 5392963 5392947 5392942 -
ccacatacttaacagcacagat

SEQ ID NO: 113836 - DNA, 22 bp, Artificial Sequence
  Synthetic oligonucleotide; CTT chr11 5392932 5392953 5392937 5392932 -
aacagcacagatatttatttat

SEQ ID NO: 113837 - DNA, 22 bp, Artificial Sequence
  Synthetic oligonucleotide; TTA chr11 5392931 5392952 5392936 5392931 -
acagcacagatatttatttatt

SEQ ID NO: 113838 - DNA, 22 bp, Artificial Sequence
  Synthetic oligonucleotide; TTT chr11 5392916 5392937 5392921 5392916 -
atttatttttctttttttttgt

SEQ ID NO: 113839 - DNA, 22 bp, Artificial Sequence
  Synthetic oligonucleotide; TTA chr11 5392915 5392936 5392920 5392915 -
tttatttttctttttttttgtt

SEQ ID NO: 113840 - DNA, 22 bp, Artificial Sequence
  Synthetic oligonucleotide; TTT chr11 5392912 5392933 5392917 5392912 -
atttttctttttttttgttttt

SEQ ID NO: 113841 - DNA, 22 bp, Artificial Sequence
  Synthetic oligonucleotide; TTA chr11 5392911 5392932 5392916 5392911 -
tttttctttttttttgtttttg

SEQ ID NO: 113842 - DNA, 22 bp, Artificial Sequence
  Synthetic oligonucleotide; TTT chr11 5392908 5392929 5392913 5392908 -
ttctttttttttgtttttgaga

SEQ ID NO: 113843 - DNA, 22 bp, Artificial Sequence
  Synthetic oligonucleotide; TTT chr11 5392907 5392928 5392912 5392907 -
tctttttttttgtttttgagaa

SEQ ID NO: 113844 - DNA, 22 bp, Artificial Sequence
  Synthetic oligonucleotide; TTT chr11 5392906 5392927 5392911 5392906 -
ctttttttttgtttttgagaag

SEQ ID NO: 113845 - DNA, 22 bp, Artificial Sequence
  Synthetic oligonucleotide; TTC chr11 5392905 5392926 5392910 5392905 -
tttttttttgtttttgagaagg

SEQ ID NO: 113846 - DNA, 22 bp, Artificial Sequence
  Synthetic oligonucleotide; CTT chr11 5392903 5392924 5392908 5392903 -
tttttttgtttttgagaaggag

SEQ ID NO: 113847 - DNA, 22 bp, Artificial Sequence
  Synthetic oligonucleotide; TTT chr11 5392902 5392923 5392907 5392902 -
ttttttgtttttgagaaggagt

SEQ ID NO: 113848 - DNA, 22 bp, Artificial Sequence
  Synthetic oligonucleotide; TTT chr11 5392901 5392922 5392906 5392901 -
tttttgtttttgagaaggagtc

SEQ ID NO: 113849 - DNA, 22 bp, Artificial Sequence
  Synthetic oligonucleotide; TTT chr11 5392900 5392921 5392905 5392900 -
ttttgtttttgagaaggagtct

SEQ ID NO: 113850 - DNA, 22 bp, Artificial Sequence
  Synthetic oligonucleotide; TTT chr11 5392899 5392920 5392904 5392899 -
tttgtttttgagaaggagtctt

SEQ ID NO: 113851 - DNA, 22 bp, Artificial Sequence
  Synthetic oligonucleotide; TTT chr11 5392898 5392919 5392903 5392898 -
ttgtttttgagaaggagtcttg

SEQ ID NO: 113852 - DNA, 22 bp, Artificial Sequence
  Synthetic oligonucleotide; TTT chr11 5392897 5392918 5392902 5392897 -
tgtttttgagaaggagtcttgc

SEQ ID NO: 113853 - DNA, 22 bp, Artificial Sequence
  Synthetic oligonucleotide; TTT chr11 5392896 5392917 5392901 5392896 -
gtttttgagaaggagtcttgct

SEQ ID NO: 113854 - DNA, 22 bp, Artificial Sequence
  Synthetic oligonucleotide; TTG chr11 5392895 5392916 5392900 5392895 -
tttttgagaaggagtcttgctc

SEQ ID NO: 113855 - DNA, 22 bp, Artificial Sequence
  Synthetic oligonucleotide; TTT chr11 5392892 5392913 5392897 5392892 -
ttgagaaggagtcttgctctgt

SEQ ID NO: 113856 - DNA, 22 bp, Artificial Sequence
  Synthetic oligonucleotide; TTT chr11 5392891 5392912 5392896 5392891 -
tgagaaggagtcttgctctgtt

SEQ ID NO: 113857 - DNA, 22 bp, Artificial Sequence
  Synthetic oligonucleotide; TTT chr11 5392890 5392911 5392895 5392890 -
gagaaggagtcttgctctgttg

SEQ ID NO: 113858 - DNA, 22 bp, Artificial Sequence
  Synthetic oligonucleotide; TTG chr11 5392889 5392910 5392894 5392889 -
agaaggagtcttgctctgttgc

SEQ ID NO: 113859 - DNA, 22 bp, Artificial Sequence
  Synthetic oligonucleotide; CTT chr11 5392877 5392898 5392882 5392877 -
gctctgttgcccaggctggagt

SEQ ID NO: 113860 - DNA, 22 bp, Artificial Sequence
  Synthetic oligonucleotide; TTG chr11 5392876 5392897 5392881 5392876 -
ctctgttgcccaggctggagtg

SEQ ID NO: 113861 - DNA, 22 bp, Artificial Sequence
  Synthetic oligonucleotide; CTC chr11 5392873 5392894 5392878 5392873 -
tgttgcccaggctggagtgcag

SEQ ID NO: 113862 - DNA, 22 bp, Artificial Sequence
  Synthetic oligonucleotide; CTG chr11 5392871 5392892 5392876 5392871 -
ttgcccaggctggagtgcagtg

SEQ ID NO: 113863 - DNA, 22 bp, Artificial Sequence
  Synthetic oligonucleotide; TTG chr11 5392868 5392889 5392873 5392868 -
cccaggctggagtgcagtggca

SEQ ID NO: 113864 - DNA, 22 bp, Artificial Sequence
  Synthetic oligonucleotide; CTG chr11 5392859 5392880 5392864 5392859 -
gagtgcagtggcacgatctcgg

SEQ ID NO: 113865 - DNA, 22 bp, Artificial Sequence
  Synthetic oligonucleotide; CTC chr11 5392839 5392860 5392844 5392839 -
ggctcactgcaagctccacctc

SEQ ID NO: 113866 - DNA, 22 bp, Artificial Sequence
  Synthetic oligonucleotide; CTC chr11 5392834 5392855 5392839 5392834 -
actgcaagctccacctcctggg

SEQ ID NO: 113867 - DNA, 22 bp, Artificial Sequence
  Synthetic oligonucleotide; CTG chr11 5392830 5392851 5392835 5392830 -
caagctccacctcctgggttca

SEQ ID NO: 113868 - DNA, 22 bp, Artificial Sequence
  Synthetic oligonucleotide; CTC chr11 5392823 5392844 5392828 5392823 -
cacctcctgggttcacgccatt

SEQ ID NO: 113869 - DNA, 22 bp, Artificial Sequence
  Synthetic oligonucleotide; CTC chr11 5392817 5392838 5392822 5392817 -
ctgggttcacgccattctgctg

SEQ ID NO: 113870 - DNA, 22 bp, Artificial Sequence
  Synthetic oligonucleotide; CTG chr11 5392814 5392835 5392819 5392814 -
ggttcacgccattctgctgccc

SEQ ID NO: 113871 - DNA, 22 bp, Artificial Sequence
  Synthetic oligonucleotide; TTC chr11 5392809 5392830 5392814 5392809 -
acgccattctgctgccccagcc

SEQ ID NO: 113872 - DNA, 22 bp, Artificial Sequence
  Synthetic oligonucleotide; TTC chr11 5392800 5392821 5392805 5392800 -
tgctgccccagcctcctgagta

SEQ ID NO: 113873 - DNA, 22 bp, Artificial Sequence
  Synthetic oligonucleotide; CTG chr11 5392798 5392819 5392803 5392798 -
ctgccccagcctcctgagtagc

SEQ ID NO: 113874 - DNA, 22 bp, Artificial Sequence
  Synthetic oligonucleotide; CTG chr11 5392795 5392816 5392800 5392795 -
ccccagcctcctgagtagctgg

SEQ ID NO: 113875 - DNA, 22 bp, Artificial Sequence
  Synthetic oligonucleotide; CTC chr11 5392785 5392806 5392790 5392785 -
ctgagtagctgggactacaggt

SEQ ID NO: 113876 - DNA, 22 bp, Artificial Sequence
  Synthetic oligonucleotide; CTG chr11 5392782 5392803 5392787 5392782 -
agtagctgggactacaggtgcc

SEQ ID NO: 113877 - DNA, 22 bp, Artificial Sequence
  Synthetic oligonucleotide; CTG chr11 5392774 5392795 5392779 5392774 -
ggactacaggtgcccaccacca

SEQ ID NO: 113878 - DNA, 22 bp, Artificial Sequence
  Synthetic oligonucleotide; CTA chr11 5392768 5392789 5392773 5392768 -
caggtgcccaccaccatgcccg

SEQ ID NO: 113879 - DNA, 22 bp, Artificial Sequence
  Synthetic oligonucleotide; CTA chr11 5392742 5392763 5392747 5392742 -
actttttgtatttttagtagag

SEQ ID NO: 113880 - DNA, 22 bp, Artificial Sequence
  Synthetic oligonucleotide; CTT chr11 5392738 5392759 5392743 5392738 -
tttgtatttttagtagagactg

SEQ ID NO: 113881 - DNA, 22 bp, Artificial Sequence
  Synthetic oligonucleotide; TTT chr11 5392737 5392758 5392742 5392737 -
ttgtatttttagtagagactgg

SEQ ID NO: 113882 - DNA, 22 bp, Artificial Sequence
  Synthetic oligonucleotide; TTT chr11 5392736 5392757 5392741 5392736 -
tgtatttttagtagagactggg

SEQ ID NO: 113883 - DNA, 22 bp, Artificial Sequence
  Synthetic oligonucleotide; TTT chr11 5392735 5392756 5392740 5392735 -
gtatttttagtagagactgggt

SEQ ID NO: 113884 - DNA, 22 bp, Artificial Sequence
  Synthetic oligonucleotide; TTG chr11 5392734 5392755 5392739 5392734 -
tatttttagtagagactgggtt

SEQ ID NO: 113885 - DNA, 22 bp, Artificial Sequence
  Synthetic oligonucleotide; TTT chr11 5392729 5392750 5392734 5392729 -
ttagtagagactgggttccacc

SEQ ID NO: 113886 - DNA, 22 bp, Artificial Sequence
  Synthetic oligonucleotide; TTT chr11 5392728 5392749 5392733 5392728 -
tagtagagactgggttccaccg

SEQ ID NO: 113887 - DNA, 22 bp, Artificial Sequence
  Synthetic oligonucleotide; TTT chr11 5392727 5392748 5392732 5392727 -
agtagagactgggttccaccgt

SEQ ID NO: 113888 - DNA, 22 bp, Artificial Sequence
  Synthetic oligonucleotide; TTA chr11 5392726 5392747 5392731 5392726 -
gtagagactgggttccaccgtg

SEQ ID NO: 113889 - DNA, 22 bp, Artificial Sequence
  Synthetic oligonucleotide; CTG chr11 5392716 5392737 5392721 5392716 -
ggttccaccgtgttagccagga

SEQ ID NO: 113890 - DNA, 22 bp, Artificial Sequence
  Synthetic oligonucleotide; TTC chr11 5392711 5392732 5392716 5392711 -
caccgtgttagccaggatggtc

SEQ ID NO: 113891 - DNA, 22 bp, Artificial Sequence
  Synthetic oligonucleotide; TTA chr11 5392701 5392722 5392706 5392701 -
gccaggatggtctcgatctcct

SEQ ID NO: 113892 - DNA, 22 bp, Artificial Sequence
  Synthetic oligonucleotide; CTC chr11 5392687 5392708 5392692 5392687 -
gatctcctgacctcgtgatcca

SEQ ID NO: 113893 - DNA, 22 bp, Artificial Sequence
  Synthetic oligonucleotide; CTC chr11 5392681 5392702 5392686 5392681 -
ctgacctcgtgatccacccgcc

SEQ ID NO: 113894 - DNA, 22 bp, Artificial Sequence
  Synthetic oligonucleotide; CTG chr11 5392678 5392699 5392683 5392678 -
acctcgtgatccacccgcctcg

SEQ ID NO: 113895 - DNA, 22 bp, Artificial Sequence
  Synthetic oligonucleotide; CTC chr11 5392673 5392694 5392678 5392673 -
gtgatccacccgcctcggcctc

SEQ ID NO: 113896 - DNA, 22 bp, Artificial Sequence
  Synthetic oligonucleotide; CTC chr11 5392657 5392678 5392662 5392657 -
ggcctcccagagtgctgggatt

SEQ ID NO: 113897 - DNA, 22 bp, Artificial Sequence
  Synthetic oligonucleotide; CTC chr11 5392651 5392672 5392656 5392651 -
ccagagtgctgggattacaggc

SEQ ID NO: 113898 - DNA, 22 bp, Artificial Sequence
  Synthetic oligonucleotide; CTG chr11 5392640 5392661 5392645 5392640 -
ggattacaggcgtgagccaccg

SEQ ID NO: 113899 - DNA, 22 bp, Artificial Sequence
  Synthetic oligonucleotide; TTA chr11 5392634 5392655 5392639 5392634 -
caggcgtgagccaccgcgccca

SEQ ID NO: 113900 - DNA, 22 bp, Artificial Sequence
  Synthetic oligonucleotide; TTG chr11 5392601 5392622 5392606 5392601 -
attgttaactctattcttcaat

SEQ ID NO: 113901 - DNA, 22 bp, Artificial Sequence
  Synthetic oligonucleotide; TTG chr11 5392597 5392618 5392602 5392597 -
ttaactctattcttcaatattc

SEQ ID NO: 113902 - DNA, 22 bp, Artificial Sequence
  Synthetic oligonucleotide; TTA chr11 5392594 5392615 5392599 5392594 -
actctattcttcaatattcgtt

SEQ ID NO: 113903 - DNA, 22 bp, Artificial Sequence
  Synthetic oligonucleotide; CTC chr11 5392590 5392611 5392595 5392590 -
tattcttcaatattcgtttagt

SEQ ID NO: 113904 - DNA, 22 bp, Artificial Sequence
  Synthetic oligonucleotide; CTA chr11 5392588 5392609 5392593 5392588 -
ttcttcaatattcgtttagtaa

SEQ ID NO: 113905 - DNA, 22 bp, Artificial Sequence
  Synthetic oligonucleotide; TTC chr11 5392585 5392606 5392590 5392585 -
ttcaatattcgtttagtaacaa

SEQ ID NO: 113906 - DNA, 22 bp, Artificial Sequence
  Synthetic oligonucleotide; CTT chr11 5392583 5392604 5392588 5392583 -
caatattcgtttagtaacaaat

SEQ ID NO: 113907 - DNA, 22 bp, Artificial Sequence
  Synthetic oligonucleotide; TTC chr11 5392582 5392603 5392587 5392582 -
aatattcgtttagtaacaaatt

SEQ ID NO: 113908 - DNA, 22 bp, Artificial Sequence
  Synthetic oligonucleotide; TTC chr11 5392575 5392596 5392580 5392575 -
gtttagtaacaaattaagatat

SEQ ID NO: 113909 - DNA, 22 bp, Artificial Sequence
  Synthetic oligonucleotide; TTT chr11 5392571 5392592 5392576 5392571 -
agtaacaaattaagatatgtta

SEQ ID NO: 113910 - DNA, 22 bp, Artificial Sequence
  Synthetic oligonucleotide; TTA chr11 5392570 5392591 5392575 5392570 -
gtaacaaattaagatatgttaa

SEQ ID NO: 113911 - DNA, 22 bp, Artificial Sequence
  Synthetic oligonucleotide; TTA chr11 5392559 5392580 5392564 5392559 -
agatatgttaatttgcatttta

SEQ ID NO: 113912 - DNA, 22 bp, Artificial Sequence
  Synthetic oligonucleotide; TTA chr11 5392549 5392570 5392554 5392549 -
atttgcattttaaatttgagta

SEQ ID NO: 113913 - DNA, 22 bp, Artificial Sequence
  Synthetic oligonucleotide; TTT chr11 5392545 5392566 5392550 5392545 -
gcattttaaatttgagtaaggt

SEQ ID NO: 113914 - DNA, 22 bp, Artificial Sequence
  Synthetic oligonucleotide; TTG chr11 5392544 5392565 5392549 5392544 -
cattttaaatttgagtaaggta

SEQ ID NO: 113915 - DNA, 22 bp, Artificial Sequence
  Synthetic oligonucleotide; TTT chr11 5392539 5392560 5392544 5392539 -
taaatttgagtaaggtagaagt

SEQ ID NO: 113916 - DNA, 22 bp, Artificial Sequence
  Synthetic oligonucleotide; TTT chr11 5392538 5392559 5392543 5392538 -
aaatttgagtaaggtagaagtt

SEQ ID NO: 113917 - DNA, 22 bp, Artificial Sequence
  Synthetic oligonucleotide; TTA chr11 5392537 5392558 5392542 5392537 -
aatttgagtaaggtagaagttt

SEQ ID NO: 113918 - DNA, 22 bp, Artificial Sequence
  Synthetic oligonucleotide; TTT chr11 5392532 5392553 5392537 5392532 -
gagtaaggtagaagttttcaaa

SEQ ID NO: 113919 - DNA, 22 bp, Artificial Sequence
  Synthetic oligonucleotide; TTG chr11 5392531 5392552 5392536 5392531 -
agtaaggtagaagttttcaaat

SEQ ID NO: 113920 - DNA, 22 bp, Artificial Sequence
  Synthetic oligonucleotide; TTT chr11 5392515 5392536 5392520 5392515 -
tcaaatatgttattacctgtac

SEQ ID NO: 113921 - DNA, 22 bp, Artificial Sequence
  Synthetic oligonucleotide; TTT chr11 5392514 5392535 5392519 5392514 -
caaatatgttattacctgtacg

SEQ ID NO: 113922 - DNA, 22 bp, Artificial Sequence
  Synthetic oligonucleotide; TTC chr11 5392513 5392534 5392518 5392513 -
aaatatgttattacctgtacgt

SEQ ID NO: 113923 - DNA, 22 bp, Artificial Sequence
  Synthetic oligonucleotide; TTA chr11 5392503 5392524 5392508 5392503 -
ttacctgtacgtatttcctaat

SEQ ID NO: 113924 - DNA, 22 bp, Artificial Sequence
  Synthetic oligonucleotide; TTA chr11 5392500 5392521 5392505 5392500 -
cctgtacgtatttcctaatttg

SEQ ID NO: 113925 - DNA, 22 bp, Artificial Sequence
  Synthetic oligonucleotide; CTG chr11 5392496 5392517 5392501 5392496 -
tacgtatttcctaatttgaaaa

SEQ ID NO: 113926 - DNA, 22 bp, Artificial Sequence
  Synthetic oligonucleotide; TTT chr11 5392487 5392508 5392492 5392487 -
cctaatttgaaaatgaaattta

SEQ ID NO: 113927 - DNA, 22 bp, Artificial Sequence
  Synthetic oligonucleotide; TTC chr11 5392486 5392507 5392491 5392486 -
ctaatttgaaaatgaaatttag

SEQ ID NO: 113928 - DNA, 22 bp, Artificial Sequence
  Synthetic oligonucleotide; CTA chr11 5392483 5392504 5392488 5392483 -
atttgaaaatgaaatttagatg

SEQ ID NO: 113929 - DNA, 22 bp, Artificial Sequence
  Synthetic oligonucleotide; TTT chr11 5392479 5392500 5392484 5392479 -
gaaaatgaaatttagatgtcag

SEQ ID NO: 113930 - DNA, 22 bp, Artificial Sequence
  Synthetic oligonucleotide; TTG chr11 5392478 5392499 5392483 5392478 -
aaaatgaaatttagatgtcagt

SEQ ID NO: 113931 - DNA, 22 bp, Artificial Sequence
  Synthetic oligonucleotide; TTT chr11 5392466 5392487 5392471 5392466 -
agatgtcagtggtctatttgtt

SEQ ID NO: 113932 - DNA, 22 bp, Artificial Sequence
  Synthetic oligonucleotide; TTA chr11 5392465 5392486 5392470 5392465 -
gatgtcagtggtctatttgtta

SEQ ID NO: 113933 - DNA, 22 bp, Artificial Sequence
  Synthetic oligonucleotide; CTA chr11 5392450 5392471 5392455 5392450 -
tttgttaataagaggcaaaatg

SEQ ID NO: 113934 - DNA, 22 bp, Artificial Sequence
  Synthetic oligonucleotide; TTT chr11 5392447 5392468 5392452 5392447 -
gttaataagaggcaaaatggga

SEQ ID NO: 113935 - DNA, 22 bp, Artificial Sequence
  Synthetic oligonucleotide; TTG chr11 5392446 5392467 5392451 5392446 -
ttaataagaggcaaaatgggac

SEQ ID NO: 113936 - DNA, 22 bp, Artificial Sequence
  Synthetic oligonucleotide; TTA chr11 5392443 5392464 5392448 5392443 -
ataagaggcaaaatgggacttc

SEQ ID NO: 113937 - DNA, 22 bp, Artificial Sequence
  Synthetic oligonucleotide; CTT chr11 5392422 5392443 5392427 5392422 -
cagtgctaatctaaatccaaat

SEQ ID NO: 113938 - DNA, 22 bp, Artificial Sequence
  Synthetic oligonucleotide; TTC chr11 5392421 5392442 5392426 5392421 -
agtgctaatctaaatccaaatc

SEQ ID NO: 113939 - DNA, 22 bp, Artificial Sequence
  Synthetic oligonucleotide; CTA chr11 5392414 5392435 5392419 5392414 -
atctaaatccaaatcctaaatt

SEQ ID NO: 113940 - DNA, 22 bp, Artificial Sequence
  Synthetic oligonucleotide; CTA chr11 5392409 5392430 5392414 5392409 -
aatccaaatcctaaattttttg

SEQ ID NO: 113941 - DNA, 22 bp, Artificial Sequence
  Synthetic oligonucleotide; CTA chr11 5392396 5392417 5392401 5392396 -
aattttttgtaccccattctac

SEQ ID NO: 113942 - DNA, 22 bp, Artificial Sequence
  Synthetic oligonucleotide; TTT chr11 5392391 5392412 5392396 5392391 -
tttgtaccccattctaccaaat

SEQ ID NO: 113943 - DNA, 22 bp, Artificial Sequence
  Synthetic oligonucleotide; TTT chr11 5392390 5392411 5392395 5392390 -
ttgtaccccattctaccaaatg

SEQ ID NO: 113944 - DNA, 22 bp, Artificial Sequence
  Synthetic oligonucleotide; TTT chr11 5392389 5392410 5392394 5392389 -
tgtaccccattctaccaaatga

SEQ ID NO: 113945 - DNA, 22 bp, Artificial Sequence
  Synthetic oligonucleotide; TTT chr11 5392388 5392409 5392393 5392388 -
gtaccccattctaccaaatgag

SEQ ID NO: 113946 - DNA, 22 bp, Artificial Sequence
  Synthetic oligonucleotide; TTG chr11 5392387 5392408 5392392 5392387 -
taccccattctaccaaatgaga

SEQ ID NO: 113947 - DNA, 22 bp, Artificial Sequence
  Synthetic oligonucleotide; TTC chr11 5392377 5392398 5392382 5392377 -
taccaaatgagatctatagaat

SEQ ID NO: 113948 - DNA, 22 bp, Artificial Sequence
  Synthetic oligonucleotide; CTA chr11 5392375 5392396 5392380 5392375 -
ccaaatgagatctatagaatag

SEQ ID NO: 113949 - DNA, 22 bp, Artificial Sequence
  Synthetic oligonucleotide; CTA chr11 5392361 5392382 5392366 5392361 -
tagaataggaatttcctctcaa

SEQ ID NO: 113950 - DNA, 22 bp, Artificial Sequence
  Synthetic oligonucleotide; TTT chr11 5392347 5392368 5392352 5392347 -
cctctcaacatggagaagaata

SEQ ID NO: 113951 - DNA, 22 bp, Artificial Sequence
  Synthetic oligonucleotide; TTC chr11 5392346 5392367 5392351 5392346 -
ctctcaacatggagaagaatat

SEQ ID NO: 113952 - DNA, 22 bp, Artificial Sequence
  Synthetic oligonucleotide; CTC chr11 5392343 5392364 5392348 5392343 -
tcaacatggagaagaatattct

SEQ ID NO: 113953 - DNA, 22 bp, Artificial Sequence
  Synthetic oligonucleotide; CTC chr11 5392341 5392362 5392346 5392341 -
aacatggagaagaatattctaa

SEQ ID NO: 113954 - DNA, 22 bp, Artificial Sequence
  Synthetic oligonucleotide; TTC chr11 5392322 5392343 5392327 5392322 -
taagtctcggaactgctattga

SEQ ID NO: 113955 - DNA, 22 bp, Artificial Sequence
  Synthetic oligonucleotide; CTA chr11 5392320 5392341 5392325 5392320 -
agtctcggaactgctattgagt

SEQ ID NO: 113956 - DNA, 22 bp, Artificial Sequence
  Synthetic oligonucleotide; CTC chr11 5392314 5392335 5392319 5392314 -
ggaactgctattgagtaatgtg

SEQ ID NO: 113957 - DNA, 22 bp, Artificial Sequence
  Synthetic oligonucleotide; CTG chr11 5392307 5392328 5392312 5392307 -
ctattgagtaatgtggcctact

SEQ ID NO: 113958 - DNA, 22 bp, Artificial Sequence
  Synthetic oligonucleotide; CTA chr11 5392304 5392325 5392309 5392304 -
ttgagtaatgtggcctactatg

SEQ ID NO: 113959 - DNA, 22 bp, Artificial Sequence
  Synthetic oligonucleotide; TTG chr11 5392301 5392322 5392306 5392301 -
agtaatgtggcctactatgtgg

SEQ ID NO: 113960 - DNA, 22 bp, Artificial Sequence
  Synthetic oligonucleotide; CTA chr11 5392287 5392308 5392292 5392287 -
ctatgtggatgtaaattaaagt

SEQ ID NO: 113961 - DNA, 22 bp, Artificial Sequence
  Synthetic oligonucleotide; CTA chr11 5392284 5392305 5392289 5392284 -
tgtggatgtaaattaaagttta

SEQ ID NO: 113962 - DNA, 22 bp, Artificial Sequence
  Synthetic oligonucleotide; TTA chr11 5392269 5392290 5392274 5392269 -
aagtttagaatggaacctatgt

SEQ ID NO: 113963 - DNA, 22 bp, Artificial Sequence
  Synthetic oligonucleotide; TTT chr11 5392263 5392284 5392268 5392263 -
agaatggaacctatgtttaagg

SEQ ID NO: 113964 - DNA, 22 bp, Artificial Sequence
  Synthetic oligonucleotide; TTA chr11 5392262 5392283 5392267 5392262 -
gaatggaacctatgtttaagga

SEQ ID NO: 113965 - DNA, 22 bp, Artificial Sequence
  Synthetic oligonucleotide; CTA chr11 5392250 5392271 5392255 5392250 -
tgtttaaggagtgccagcctgt

SEQ ID NO: 113966 - DNA, 22 bp, Artificial Sequence
  Synthetic oligonucleotide; TTT chr11 5392245 5392266 5392250 5392245 -
aaggagtgccagcctgtaaggc

SEQ ID NO: 113967 - DNA, 22 bp, Artificial Sequence
  Synthetic oligonucleotide; TTA chr11 5392244 5392265 5392249 5392244 -
aggagtgccagcctgtaaggct

SEQ ID NO: 113968 - DNA, 22 bp, Artificial Sequence
  Synthetic oligonucleotide; CTG chr11 5392229 5392250 5392234 5392229 -
taaggctgcagaaactgctggg

SEQ ID NO: 113969 - DNA, 22 bp, Artificial Sequence
  Synthetic oligonucleotide; CTG chr11 5392221 5392242 5392226 5392221 -
cagaaactgctgggttccagag

SEQ ID NO: 113970 - DNA, 22 bp, Artificial Sequence
  Synthetic oligonucleotide; CTG chr11 5392212 5392233 5392217 5392212 -
ctgggttccagaggggctccca

SEQ ID NO: 113971 - DNA, 22 bp, Artificial Sequence
  Synthetic oligonucleotide; CTG chr11 5392209 5392230 5392214 5392209 -
ggttccagaggggctcccaagc

SEQ ID NO: 113972 - DNA, 22 bp, Artificial Sequence
  Synthetic oligonucleotide; TTC chr11 5392204 5392225 5392209 5392204 -
cagaggggctcccaagcctgag

SEQ ID NO: 113973 - DNA, 22 bp, Artificial Sequence
  Synthetic oligonucleotide; CTC chr11 5392193 5392214 5392198 5392193 -
ccaagcctgagagtctgataac

SEQ ID NO: 113974 - DNA, 22 bp, Artificial Sequence
  Synthetic oligonucleotide; CTG chr11 5392184 5392205 5392189 5392184 -
agagtctgataacacccacaca

SEQ ID NO: 113975 - DNA, 22 bp, Artificial Sequence
  Synthetic oligonucleotide; CTG chr11 5392176 5392197 5392181 5392176 -
ataacacccacacatacaaaca

SEQ ID NO: 113976 - DNA, 22 bp, Artificial Sequence
  Synthetic oligonucleotide; TTT chr11 5392101 5392122 5392106 5392101 -
ttagagtttggttcttttttaa

SEQ ID NO: 113977 - DNA, 22 bp, Artificial Sequence
  Synthetic oligonucleotide; TTT chr11 5392100 5392121 5392105 5392100 -
tagagtttggttcttttttaaa

SEQ ID NO: 113978 - DNA, 22 bp, Artificial Sequence
  Synthetic oligonucleotide; TTT chr11 5392099 5392120 5392104 5392099 -
agagtttggttcttttttaaat

SEQ ID NO: 113979 - DNA, 22 bp, Artificial Sequence
  Synthetic oligonucleotide; TTA chr11 5392098 5392119 5392103 5392098 -
gagtttggttcttttttaaatt

SEQ ID NO: 113980 - DNA, 22 bp, Artificial Sequence
  Synthetic oligonucleotide; TTT chr11 5392092 5392113 5392097 5392092 -
ggttcttttttaaatttcgctt

SEQ ID NO: 113981 - DNA, 22 bp, Artificial Sequence
  Synthetic oligonucleotide; TTG chr11 5392091 5392112 5392096 5392091 -
gttcttttttaaatttcgcttt

SEQ ID NO: 113982 - DNA, 22 bp, Artificial Sequence
  Synthetic oligonucleotide; TTC chr11 5392087 5392108 5392092 5392087 -
ttttttaaatttcgctttgtaa

SEQ ID NO: 113983 - DNA, 22 bp, Artificial Sequence
  Synthetic oligonucleotide; CTT chr11 5392085 5392106 5392090 5392085 -
ttttaaatttcgctttgtaatt

SEQ ID NO: 113984 - DNA, 22 bp, Artificial Sequence
  Synthetic oligonucleotide; TTT chr11 5392084 5392105 5392089 5392084 -
tttaaatttcgctttgtaattt

SEQ ID NO: 113985 - DNA, 22 bp, Artificial Sequence
  Synthetic oligonucleotide; TTT chr11 5392083 5392104 5392088 5392083 -
ttaaatttcgctttgtaatttt

SEQ ID NO: 113986 - DNA, 22 bp, Artificial Sequence
  Synthetic oligonucleotide; TTT chr11 5392082 5392103 5392087 5392082 -
taaatttcgctttgtaattttg

SEQ ID NO: 113987 - DNA, 22 bp, Artificial Sequence
  Synthetic oligonucleotide; TTT chr11 5392081 5392102 5392086 5392081 -
aaatttcgctttgtaattttgt

SEQ ID NO: 113988 - DNA, 22 bp, Artificial Sequence
  Synthetic oligonucleotide; TTA chr11 5392080 5392101 5392085 5392080 -
aatttcgctttgtaattttgtt

SEQ ID NO: 113989 - DNA, 22 bp, Artificial Sequence
  Synthetic oligonucleotide; TTT chr11 5392075 5392096 5392080 5392075 -
cgctttgtaattttgtttgttt

SEQ ID NO: 113990 - DNA, 22 bp, Artificial Sequence
  Synthetic oligonucleotide; TTC chr11 5392074 5392095 5392079 5392074 -
gctttgtaattttgtttgtttt

SEQ ID NO: 113991 - DNA, 22 bp, Artificial Sequence
  Synthetic oligonucleotide; CTT chr11 5392070 5392091 5392075 5392070 -
tgtaattttgtttgttttcctt

SEQ ID NO: 113992 - DNA, 22 bp, Artificial Sequence
  Synthetic oligonucleotide; TTT chr11 5392069 5392090 5392074 5392069 -
gtaattttgtttgttttccttt

SEQ ID NO: 113993 - DNA, 22 bp, Artificial Sequence
  Synthetic oligonucleotide; TTG chr11 5392068 5392089 5392073 5392068 -
taattttgtttgttttcctttt

SEQ ID NO: 113994 - DNA, 22 bp, Artificial Sequence
  Synthetic oligonucleotide; TTT chr11 5392062 5392083 5392067 5392062 -
tgtttgttttcctttttatttt

SEQ ID NO: 113995 - DNA, 22 bp, Artificial Sequence
  Synthetic oligonucleotide; TTT chr11 5392061 5392082 5392066 5392061 -
gtttgttttcctttttattttt

SEQ ID NO: 113996 - DNA, 22 bp, Artificial Sequence
  Synthetic oligonucleotide; TTG chr11 5392060 5392081 5392065 5392060 -
tttgttttcctttttatttttg

SEQ ID NO: 113997 - DNA, 22 bp, Artificial Sequence
  Synthetic oligonucleotide; TTT chr11 5392057 5392078 5392062 5392057 -
gttttcctttttatttttgaat

SEQ ID NO: 113998 - DNA, 22 bp, Artificial Sequence
  Synthetic oligonucleotide; TTG chr11 5392056 5392077 5392061 5392056 -
ttttcctttttatttttgaatc

SEQ ID NO: 113999 - DNA, 22 bp, Artificial Sequence
  Synthetic oligonucleotide; TTT chr11 5392053 5392074 5392058 5392053 -
tcctttttatttttgaatcggg

SEQ ID NO: 114000 - DNA, 22 bp, Artificial Sequence
  Synthetic oligonucleotide; TTT chr11 5392052 5392073 5392057 5392052 -
cctttttatttttgaatcgggg

SEQ ID NO: 114001 - DNA, 22 bp, Artificial Sequence
  Synthetic oligonucleotide; TTC chr11 5392051 5392072 5392056 5392051 -
ctttttatttttgaatcggggt

SEQ ID NO: 114002 - DNA, 22 bp, Artificial Sequence
  Synthetic oligonucleotide; CTT chr11 5392048 5392069 5392053 5392048 -
tttatttttgaatcggggtctc

SEQ ID NO: 114003 - DNA, 22 bp, Artificial Sequence
  Synthetic oligonucleotide; TTT chr11 5392047 5392068 5392052 5392047 -
ttatttttgaatcggggtctca

SEQ ID NO: 114004 - DNA, 22 bp, Artificial Sequence
  Synthetic oligonucleotide; TTT chr11 5392046 5392067 5392051 5392046 -
tatttttgaatcggggtctcac

SEQ ID NO: 114005 - DNA, 22 bp, Artificial Sequence
  Synthetic oligonucleotide; TTT chr11 5392045 5392066 5392050 5392045 -
atttttgaatcggggtctcact

SEQ ID NO: 114006 - DNA, 22 bp, Artificial Sequence
  Synthetic oligonucleotide; TTA chr11 5392044 5392065 5392049 5392044 -
tttttgaatcggggtctcactt

SEQ ID NO: 114007 - DNA, 22 bp, Artificial Sequence
  Synthetic oligonucleotide; TTT chr11 5392041 5392062 5392046 5392041 -
ttgaatcggggtctcacttggt

SEQ ID NO: 114008 - DNA, 22 bp, Artificial Sequence
  Synthetic oligonucleotide; TTT chr11 5392040 5392061 5392045 5392040 -
tgaatcggggtctcacttggtc

SEQ ID NO: 114009 - DNA, 22 bp, Artificial Sequence
  Synthetic oligonucleotide; TTT chr11 5392039 5392060 5392044 5392039 -
gaatcggggtctcacttggtca

SEQ ID NO: 114010 - DNA, 22 bp, Artificial Sequence
  Synthetic oligonucleotide; TTG chr11 5392038 5392059 5392043 5392038 -
aatcggggtctcacttggtcac

SEQ ID NO: 114011 - DNA, 22 bp, Artificial Sequence
  Synthetic oligonucleotide; CTC chr11 5392026 5392047 5392031 5392026 -
acttggtcacccaggcagtagt

SEQ ID NO: 114012 - DNA, 22 bp, Artificial Sequence
  Synthetic oligonucleotide; CTT chr11 5392022 5392043 5392027 5392022 -
ggtcacccaggcagtagtgtga

SEQ ID NO: 114013 - DNA, 22 bp, Artificial Sequence
  Synthetic oligonucleotide; TTG chr11 5392021 5392042 5392026 5392021 -
gtcacccaggcagtagtgtgat

SEQ ID NO: 114014 - DNA, 22 bp, Artificial Sequence
  Synthetic oligonucleotide; TTA chr11 5391997 5392018 5392002 5391997 -
tggctcactgcagcctcaacct

SEQ ID NO: 114015 - DNA, 22 bp, Artificial Sequence
  Synthetic oligonucleotide; CTC chr11 5391991 5392012 5391996 5391991 -
actgcagcctcaacctcctggg

SEQ ID NO: 114016 - DNA, 22 bp, Artificial Sequence
  Synthetic oligonucleotide; CTG chr11 5391987 5392008 5391992 5391987 -
cagcctcaacctcctgggctca

SEQ ID NO: 114017 - DNA, 22 bp, Artificial Sequence
  Synthetic oligonucleotide; CTC chr11 5391980 5392001 5391985 5391980 -
aacctcctgggctcaagcattc

SEQ ID NO: 114018 - DNA, 22 bp, Artificial Sequence
  Synthetic oligonucleotide; CTC chr11 5391974 5391995 5391979 5391974 -
ctgggctcaagcattcttccca

SEQ ID NO: 114019 - DNA, 22 bp, Artificial Sequence
  Synthetic oligonucleotide; CTG chr11 5391971 5391992 5391976 5391971 -
ggctcaagcattcttcccacct

SEQ ID NO: 114020 - DNA, 22 bp, Artificial Sequence
  Synthetic oligonucleotide; CTC chr11 5391966 5391987 5391971 5391966 -
aagcattcttcccacctcagcc

SEQ ID NO: 114021 - DNA, 22 bp, Artificial Sequence
  Synthetic oligonucleotide; TTC chr11 5391958 5391979 5391963 5391958 -
ttcccacctcagcctcccaggt

SEQ ID NO: 114022 - DNA, 22 bp, Artificial Sequence
  Synthetic oligonucleotide; CTT chr11 5391956 5391977 5391961 5391956 -
cccacctcagcctcccaggtag

SEQ ID NO: 114023 - DNA, 22 bp, Artificial Sequence
  Synthetic oligonucleotide; TTC chr11 5391955 5391976 5391960 5391955 -
ccacctcagcctcccaggtagc

SEQ ID NO: 114024 - DNA, 22 bp, Artificial Sequence
  Synthetic oligonucleotide; CTC chr11 5391948 5391969 5391953 5391948 -
agcctcccaggtagctgagact

SEQ ID NO: 114025 - DNA, 22 bp, Artificial Sequence
  Synthetic oligonucleotide; CTC chr11 5391942 5391963 5391947 5391942 -
ccaggtagctgagactacagac

SEQ ID NO: 114026 - DNA, 22 bp, Artificial Sequence
  Synthetic oligonucleotide; CTG chr11 5391931 5391952 5391936 5391931 -
agactacagacgtgcaccgcca

SEQ ID NO: 114027 - DNA, 22 bp, Artificial Sequence
  Synthetic oligonucleotide; CTA chr11 5391925 5391946 5391930 5391925 -
cagacgtgcaccgccacacatg

SEQ ID NO: 114028 - DNA, 22 bp, Artificial Sequence
  Synthetic oligonucleotide; CTA chr11 5391899 5391920 5391904 5391899 -
attttaattttttttgtagaga

SEQ ID NO: 114029 - DNA, 22 bp, Artificial Sequence
  Synthetic oligonucleotide; TTT chr11 5391895 5391916 5391900 5391895 -
taattttttttgtagagatagg

SEQ ID NO: 114030 - DNA, 22 bp, Artificial Sequence
  Synthetic oligonucleotide; TTT chr11 5391894 5391915 5391899 5391894 -
aattttttttgtagagataggg

SEQ ID NO: 114031 - DNA, 22 bp, Artificial Sequence
  Synthetic oligonucleotide; TTA chr11 5391893 5391914 5391898 5391893 -
attttttttgtagagatagggt

SEQ ID NO: 114032 - DNA, 22 bp, Artificial Sequence
  Synthetic oligonucleotide; TTT chr11 5391889 5391910 5391894 5391889 -
tttttgtagagatagggtcttg

SEQ ID NO: 114033 - DNA, 22 bp, Artificial Sequence
  Synthetic oligonucleotide; TTT chr11 5391888 5391909 5391893 5391888 -
ttttgtagagatagggtcttgc

SEQ ID NO: 114034 - DNA, 22 bp, Artificial Sequence
  Synthetic oligonucleotide; TTT chr11 5391887 5391908 5391892 5391887 -
tttgtagagatagggtcttgct

SEQ ID NO: 114035 - DNA, 22 bp, Artificial Sequence
  Synthetic oligonucleotide; TTT chr11 5391886 5391907 5391891 5391886 -
ttgtagagatagggtcttgctg

SEQ ID NO: 114036 - DNA, 22 bp, Artificial Sequence
  Synthetic oligonucleotide; TTT chr11 5391885 5391906 5391890 5391885 -
tgtagagatagggtcttgctgt

SEQ ID NO: 114037 - DNA, 22 bp, Artificial Sequence
  Synthetic oligonucleotide; TTT chr11 5391884 5391905 5391889 5391884 -
gtagagatagggtcttgctgta

SEQ ID NO: 114038 - DNA, 22 bp, Artificial Sequence
  Synthetic oligonucleotide; TTG chr11 5391883 5391904 5391888 5391883 -
tagagatagggtcttgctgtat

SEQ ID NO: 114039 - DNA, 22 bp, Artificial Sequence
  Synthetic oligonucleotide; CTT chr11 5391868 5391889 5391873 5391868 -
gctgtattgttcaggctggtct

SEQ ID NO: 114040 - DNA, 22 bp, Artificial Sequence
  Synthetic oligonucleotide; TTG chr11 5391867 5391888 5391872 5391867 -
ctgtattgttcaggctggtctc

SEQ ID NO: 114041 - DNA, 22 bp, Artificial Sequence
  Synthetic oligonucleotide; CTG chr11 5391864 5391885 5391869 5391864 -
tattgttcaggctggtctcaaa

SEQ ID NO: 114042 - DNA, 22 bp, Artificial Sequence
  Synthetic oligonucleotide; TTG chr11 5391859 5391880 5391864 5391859 -
ttcaggctggtctcaaactcct

SEQ ID NO: 114043 - DNA, 22 bp, Artificial Sequence
  Synthetic oligonucleotide; TTC chr11 5391856 5391877 5391861 5391856 -
aggctggtctcaaactcctgga

SEQ ID NO: 114044 - DNA, 22 bp, Artificial Sequence
  Synthetic oligonucleotide; CTG chr11 5391850 5391871 5391855 5391850 -
gtctcaaactcctggactcaag

SEQ ID NO: 114045 - DNA, 22 bp, Artificial Sequence
  Synthetic oligonucleotide; CTC chr11 5391845 5391866 5391850 5391845 -
aaactcctggactcaagtaatc

SEQ ID NO: 114046 - DNA, 22 bp, Artificial Sequence
  Synthetic oligonucleotide; CTC chr11 5391839 5391860 5391844 5391839 -
ctggactcaagtaatcttcttg

SEQ ID NO: 114047 - DNA, 22 bp, Artificial Sequence
  Synthetic oligonucleotide; CTG chr11 5391836 5391857 5391841 5391836 -
gactcaagtaatcttcttgcct

SEQ ID NO: 114048 - DNA, 22 bp, Artificial Sequence
  Synthetic oligonucleotide; CTC chr11 5391831 5391852 5391836 5391831 -
aagtaatcttcttgcctgaagt

SEQ ID NO: 114049 - DNA, 22 bp, Artificial Sequence
  Synthetic oligonucleotide; CTT chr11 5391821 5391842 5391826 5391821 -
cttgcctgaagttggtctcaaa

SEQ ID NO: 114050 - DNA, 22 bp, Artificial Sequence
  Synthetic oligonucleotide; TTC chr11 5391820 5391841 5391825 5391820 -
ttgcctgaagttggtctcaaac

SEQ ID NO: 114051 - DNA, 22 bp, Artificial Sequence
  Synthetic oligonucleotide; CTT chr11 5391818 5391839 5391823 5391818 -
gcctgaagttggtctcaaactc

SEQ ID NO: 114052 - DNA, 22 bp, Artificial Sequence
  Synthetic oligonucleotide; TTG chr11 5391817 5391838 5391822 5391817 -
cctgaagttggtctcaaactcc

SEQ ID NO: 114053 - DNA, 22 bp, Artificial Sequence
  Synthetic oligonucleotide; CTG chr11 5391813 5391834 5391818 5391813 -
aagttggtctcaaactcctggc

SEQ ID NO: 114054 - DNA, 22 bp, Artificial Sequence
  Synthetic oligonucleotide; TTG chr11 5391807 5391828 5391812 5391807 -
gtctcaaactcctggccttcag

SEQ ID NO: 114055 - DNA, 22 bp, Artificial Sequence
  Synthetic oligonucleotide; CTC chr11 5391802 5391823 5391807 5391802 -
aaactcctggccttcagcaatc

SEQ ID NO: 114056 - DNA, 22 bp, Artificial Sequence
  Synthetic oligonucleotide; CTC chr11 5391796 5391817 5391801 5391796 -
ctggccttcagcaatcctccca

SEQ ID NO: 114057 - DNA, 22 bp, Artificial Sequence
  Synthetic oligonucleotide; CTG chr11 5391793 5391814 5391798 5391793 -
gccttcagcaatcctcccacct

SEQ ID NO: 114058 - DNA, 22 bp, Artificial Sequence
  Synthetic oligonucleotide; CTT chr11 5391788 5391809 5391793 5391788 -
cagcaatcctcccaccttggtc

SEQ ID NO: 114059 - DNA, 22 bp, Artificial Sequence
  Synthetic oligonucleotide; TTC chr11 5391787 5391808 5391792 5391787 -
agcaatcctcccaccttggtct

SEQ ID NO: 114060 - DNA, 22 bp, Artificial Sequence
  Synthetic oligonucleotide; CTC chr11 5391777 5391798 5391782 5391777 -
ccaccttggtctcccaaagtgc

SEQ ID NO: 114061 - DNA, 22 bp, Artificial Sequence
  Synthetic oligonucleotide; CTT chr11 5391770 5391791 5391775 5391770 -
ggtctcccaaagtgctgggatt

SEQ ID NO: 114062 - DNA, 22 bp, Artificial Sequence
  Synthetic oligonucleotide; TTG chr11 5391769 5391790 5391774 5391769 -
gtctcccaaagtgctgggatta

SEQ ID NO: 114063 - DNA, 22 bp, Artificial Sequence
  Synthetic oligonucleotide; CTC chr11 5391764 5391785 5391769 5391764 -
ccaaagtgctgggattatagca

SEQ ID NO: 114064 - DNA, 22 bp, Artificial Sequence
  Synthetic oligonucleotide; CTG chr11 5391753 5391774 5391758 5391753 -
ggattatagcataagccaccgt

SEQ ID NO: 114065 - DNA, 22 bp, Artificial Sequence
  Synthetic oligonucleotide; TTA chr11 5391747 5391768 5391752 5391747 -
tagcataagccaccgtgcctgg

SEQ ID NO: 114066 - DNA, 22 bp, Artificial Sequence
  Synthetic oligonucleotide; CTG chr11 5391726 5391747 5391731 5391726 -
gcctcatggtaattttaacctg

SEQ ID NO: 114067 - DNA, 22 bp, Artificial Sequence
  Synthetic oligonucleotide; CTC chr11 5391721 5391742 5391726 5391721 -
atggtaattttaacctgtagga

SEQ ID NO: 114068 - DNA, 22 bp, Artificial Sequence
  Synthetic oligonucleotide; TTT chr11 5391711 5391732 5391716 5391711 -
taacctgtaggagaatgggtgg

SEQ ID NO: 114069 - DNA, 22 bp, Artificial Sequence
  Synthetic oligonucleotide; TTT chr11 5391710 5391731 5391715 5391710 -
aacctgtaggagaatgggtggg

SEQ ID NO: 114070 - DNA, 22 bp, Artificial Sequence
  Synthetic oligonucleotide; TTA chr11 5391709 5391730 5391714 5391709 -
acctgtaggagaatgggtggga

SEQ ID NO: 114071 - DNA, 22 bp, Artificial Sequence
  Synthetic oligonucleotide; CTG chr11 5391704 5391725 5391709 5391704 -
taggagaatgggtgggaggatc

SEQ ID NO: 114072 - DNA, 22 bp, Artificial Sequence
  Synthetic oligonucleotide; CTG chr11 5391671 5391692 5391676 5391671 -
agtaaagtagaactgggacaat

SEQ ID NO: 114073 - DNA, 22 bp, Artificial Sequence
  Synthetic oligonucleotide; CTG chr11 5391656 5391677 5391661 5391656 -
ggacaatgaagatataccacct

SEQ ID NO: 114074 - DNA, 22 bp, Artificial Sequence
  Synthetic oligonucleotide; CTT chr11 5391633 5391654 5391638 5391633 -
gatggatgccagcagaaaggtg

SEQ ID NO: 114075 - DNA, 22 bp, Artificial Sequence
  Synthetic oligonucleotide; TTG chr11 5391632 5391653 5391637 5391632 -
atggatgccagcagaaaggtgt

SEQ ID NO: 114076 - DNA, 22 bp, Artificial Sequence
  Synthetic oligonucleotide; CTT chr11 5391607 5391628 5391612 5391607 -
cttgggcttctgaatgtgaaga

SEQ ID NO: 114077 - DNA, 22 bp, Artificial Sequence
  Synthetic oligonucleotide; TTC chr11 5391606 5391627 5391611 5391606 -
ttgggcttctgaatgtgaagag

SEQ ID NO: 114078 - DNA, 22 bp, Artificial Sequence
  Synthetic oligonucleotide; CTT chr11 5391604 5391625 5391609 5391604 -
gggcttctgaatgtgaagagga

SEQ ID NO: 114079 - DNA, 22 bp, Artificial Sequence
  Synthetic oligonucleotide; TTG chr11 5391603 5391624 5391608 5391603 -
ggcttctgaatgtgaagaggag

SEQ ID NO: 114080 - DNA, 22 bp, Artificial Sequence
  Synthetic oligonucleotide; CTT chr11 5391598 5391619 5391603 5391598 -
ctgaatgtgaagaggaggagtt

SEQ ID NO: 114081 - DNA, 22 bp, Artificial Sequence
  Synthetic oligonucleotide; TTC chr11 5391597 5391618 5391602 5391597 -
tgaatgtgaagaggaggagttc

SEQ ID NO: 114082 - DNA, 22 bp, Artificial Sequence
  Synthetic oligonucleotide; CTG chr11 5391595 5391616 5391600 5391595 -
aatgtgaagaggaggagttcct

SEQ ID NO: 114083 - DNA, 22 bp, Artificial Sequence
  Synthetic oligonucleotide; TTC chr11 5391575 5391596 5391580 5391575 -
ctcgagacaagaagagaacttc

SEQ ID NO: 114084 - DNA, 22 bp, Artificial Sequence
  Synthetic oligonucleotide; CTC chr11 5391572 5391593 5391577 5391572 -
gagacaagaagagaacttctgt

SEQ ID NO: 114085 - DNA, 22 bp, Artificial Sequence
  Synthetic oligonucleotide; CTT chr11 5391554 5391575 5391559 5391554 -
ctgttagctctggatccctctt

SEQ ID NO: 114086 - DNA, 22 bp, Artificial Sequence
  Synthetic oligonucleotide; TTC chr11 5391553 5391574 5391558 5391553 -
tgttagctctggatccctcttt

SEQ ID NO: 114087 - DNA, 22 bp, Artificial Sequence
  Synthetic oligonucleotide; CTG chr11 5391551 5391572 5391556 5391551 -
ttagctctggatccctctttat

SEQ ID NO: 114088 - DNA, 22 bp, Artificial Sequence
  Synthetic oligonucleotide; TTA chr11 5391548 5391569 5391553 5391548 -
gctctggatccctctttatgta

SEQ ID NO: 114089 - DNA, 22 bp, Artificial Sequence
  Synthetic oligonucleotide; CTC chr11 5391544 5391565 5391549 5391544 -
tggatccctctttatgtatcta

SEQ ID NO: 114090 - DNA, 22 bp, Artificial Sequence
  Synthetic oligonucleotide; CTG chr11 5391542 5391563 5391547 5391542 -
gatccctctttatgtatctata

SEQ ID NO: 114091 - DNA, 22 bp, Artificial Sequence
  Synthetic oligonucleotide; CTC chr11 5391534 5391555 5391539 5391534 -
tttatgtatctatatgtccacg

SEQ ID NO: 114092 - DNA, 22 bp, Artificial Sequence
  Synthetic oligonucleotide; CTT chr11 5391532 5391553 5391537 5391532 -
tatgtatctatatgtccacgca

SEQ ID NO: 114093 - DNA, 22 bp, Artificial Sequence
  Synthetic oligonucleotide; TTT chr11 5391531 5391552 5391536 5391531 -
atgtatctatatgtccacgcat

SEQ ID NO: 114094 - DNA, 22 bp, Artificial Sequence
  Synthetic oligonucleotide; TTA chr11 5391530 5391551 5391535 5391530 -
tgtatctatatgtccacgcata

SEQ ID NO: 114095 - DNA, 22 bp, Artificial Sequence
  Synthetic oligonucleotide; CTA chr11 5391522 5391543 5391527 5391522 -
tatgtccacgcatacatttaat

SEQ ID NO: 114096 - DNA, 22 bp, Artificial Sequence
  Synthetic oligonucleotide; TTT chr11 5391503 5391524 5391508 5391503 -
aatatttattgagtatatggca

SEQ ID NO: 114097 - DNA, 22 bp, Artificial Sequence
  Synthetic oligonucleotide; TTA chr11 5391502 5391523 5391507 5391502 -
atatttattgagtatatggcat

SEQ ID NO: 114098 - DNA, 22 bp, Artificial Sequence
  Synthetic oligonucleotide; TTT chr11 5391496 5391517 5391501 5391496 -
attgagtatatggcatgtgcta

SEQ ID NO: 114099 - DNA, 22 bp, Artificial Sequence
  Synthetic oligonucleotide; TTA chr11 5391495 5391516 5391500 5391495 -
ttgagtatatggcatgtgctag

SEQ ID NO: 114100 - DNA, 22 bp, Artificial Sequence
  Synthetic oligonucleotide; TTG chr11 5391492 5391513 5391497 5391492 -
agtatatggcatgtgctaggca

SEQ ID NO: 114101 - DNA, 22 bp, Artificial Sequence
  Synthetic oligonucleotide; CTA chr11 5391474 5391495 5391479 5391474 -
ggcattgtatttatatacattt

SEQ ID NO: 114102 - DNA, 22 bp, Artificial Sequence
  Synthetic oligonucleotide; TTG chr11 5391467 5391488 5391472 5391467 -
tatttatatacatttactggcg

SEQ ID NO: 114103 - DNA, 22 bp, Artificial Sequence
  Synthetic oligonucleotide; TTT chr11 5391462 5391483 5391467 5391462 -
atatacatttactggcgagcaa

SEQ ID NO: 114104 - DNA, 22 bp, Artificial Sequence
  Synthetic oligonucleotide; TTA chr11 5391461 5391482 5391466 5391461 -
tatacatttactggcgagcaag

SEQ ID NO: 114105 - DNA, 22 bp, Artificial Sequence
  Synthetic oligonucleotide; TTT chr11 5391452 5391473 5391457 5391452 -
actggcgagcaagacatgccta

SEQ ID NO: 114106 - DNA, 22 bp, Artificial Sequence
  Synthetic oligonucleotide; TTA chr11 5391451 5391472 5391456 5391451 -
ctggcgagcaagacatgcctaa

SEQ ID NO: 114107 - DNA, 22 bp, Artificial Sequence
  Synthetic oligonucleotide; CTG chr11 5391448 5391469 5391453 5391448 -
gcgagcaagacatgcctaattc

SEQ ID NO: 114108 - DNA, 22 bp, Artificial Sequence
  Synthetic oligonucleotide; CTA chr11 5391430 5391451 5391435 5391430 -
attcctccagggatcttgattt

SEQ ID NO: 114109 - DNA, 22 bp, Artificial Sequence
  Synthetic oligonucleotide; TTC chr11 5391426 5391447 5391431 5391426 -
ctccagggatcttgatttagtc

SEQ ID NO: 114110 - DNA, 22 bp, Artificial Sequence
  Synthetic oligonucleotide; CTC chr11 5391423 5391444 5391428 5391423 -
cagggatcttgatttagtcatt

SEQ ID NO: 114111 - DNA, 22 bp, Artificial Sequence
  Synthetic oligonucleotide; CTT chr11 5391413 5391434 5391418 5391413 -
gatttagtcattctaatggaca

SEQ ID NO: 114112 - DNA, 22 bp, Artificial Sequence
  Synthetic oligonucleotide; TTG chr11 5391412 5391433 5391417 5391412 -
atttagtcattctaatggacac

SEQ ID NO: 114113 - DNA, 22 bp, Artificial Sequence
  Synthetic oligonucleotide; TTT chr11 5391408 5391429 5391413 5391408 -
agtcattctaatggacacatgc

SEQ ID NO: 114114 - DNA, 22 bp, Artificial Sequence
  Synthetic oligonucleotide; TTA chr11 5391407 5391428 5391412 5391407 -
gtcattctaatggacacatgca

SEQ ID NO: 114115 - DNA, 22 bp, Artificial Sequence
  Synthetic oligonucleotide; TTC chr11 5391400 5391421 5391405 5391400 -
taatggacacatgcacacacct

SEQ ID NO: 114116 - DNA, 22 bp, Artificial Sequence
  Synthetic oligonucleotide; CTA chr11 5391398 5391419 5391403 5391398 -
atggacacatgcacacaccttc

SEQ ID NO: 114117 - DNA, 22 bp, Artificial Sequence
  Synthetic oligonucleotide; CTT chr11 5391377 5391398 5391382 5391377 -
cataaacaggacattactgtgt

SEQ ID NO: 114118 - DNA, 22 bp, Artificial Sequence
  Synthetic oligonucleotide; TTC chr11 5391376 5391397 5391381 5391376 -
ataaacaggacattactgtgtg

SEQ ID NO: 114119 - DNA, 22 bp, Artificial Sequence
  Synthetic oligonucleotide; TTA chr11 5391361 5391382 5391366 5391361 -
ctgtgtgacaaatgttacaacg

SEQ ID NO: 114120 - DNA, 22 bp, Artificial Sequence
  Synthetic oligonucleotide; CTG chr11 5391358 5391379 5391363 5391358 -
tgtgacaaatgttacaacggga

SEQ ID NO: 114121 - DNA, 22 bp, Artificial Sequence
  Synthetic oligonucleotide; TTA chr11 5391344 5391365 5391349 5391344 -
caacgggaaatgcagggcactg

SEQ ID NO: 114122 - DNA, 22 bp, Artificial Sequence
  Synthetic oligonucleotide; CTG chr11 5391322 5391343 5391327 5391322 -
tggaaggaaaccgatggagcat

SEQ ID NO: 114123 - DNA, 22 bp, Artificial Sequence
  Synthetic oligonucleotide; TTT chr11 5391298 5391319 5391303 5391298 -
ggtgctttaccattggaaaggg

SEQ ID NO: 114124 - DNA, 22 bp, Artificial Sequence
  Synthetic oligonucleotide; TTG chr11 5391297 5391318 5391302 5391297 -
gtgctttaccattggaaaggga

SEQ ID NO: 114125 - DNA, 22 bp, Artificial Sequence
  Synthetic oligonucleotide; CTT chr11 5391291 5391312 5391296 5391291 -
taccattggaaagggaggagct

SEQ ID NO: 114126 - DNA, 22 bp, Artificial Sequence
  Synthetic oligonucleotide; TTT chr11 5391290 5391311 5391295 5391290 -
accattggaaagggaggagcta

SEQ ID NO: 114127 - DNA, 22 bp, Artificial Sequence
  Synthetic oligonucleotide; TTA chr11 5391289 5391310 5391294 5391289 -
ccattggaaagggaggagctat

SEQ ID NO: 114128 - DNA, 22 bp, Artificial Sequence
  Synthetic oligonucleotide; TTG chr11 5391283 5391304 5391288 5391283 -
gaaagggaggagctatctgtga

SEQ ID NO: 114129 - DNA, 22 bp, Artificial Sequence
  Synthetic oligonucleotide; CTA chr11 5391268 5391289 5391273 5391268 -
tctgtgaaaatgtccttgagga

SEQ ID NO: 114130 - DNA, 22 bp, Artificial Sequence
  Synthetic oligonucleotide; CTG chr11 5391264 5391285 5391269 5391264 -
tgaaaatgtccttgaggaagca

SEQ ID NO: 114131 - DNA, 22 bp, Artificial Sequence
  Synthetic oligonucleotide; CTT chr11 5391251 5391272 5391256 5391251 -
gaggaagcaatttcaaagctga

SEQ ID NO: 114132 - DNA, 22 bp, Artificial Sequence
  Synthetic oligonucleotide; TTG chr11 5391250 5391271 5391255 5391250 -
aggaagcaatttcaaagctgag

SEQ ID NO: 114133 - DNA, 22 bp, Artificial Sequence
  Synthetic oligonucleotide; TTT chr11 5391238 5391259 5391243 5391238 -
caaagctgagacccctgcaagg

SEQ ID NO: 114134 - DNA, 22 bp, Artificial Sequence
  Synthetic oligonucleotide; TTC chr11 5391237 5391258 5391242 5391237 -
aaagctgagacccctgcaagga

SEQ ID NO: 114135 - DNA, 22 bp, Artificial Sequence
  Synthetic oligonucleotide; CTG chr11 5391230 5391251 5391235 5391230 -
agacccctgcaaggattgcatt

SEQ ID NO: 114136 - DNA, 22 bp, Artificial Sequence
  Synthetic oligonucleotide; CTG chr11 5391221 5391242 5391226 5391221 -
caaggattgcatttagtcactc

SEQ ID NO: 114137 - DNA, 22 bp, Artificial Sequence
  Synthetic oligonucleotide; TTG chr11 5391212 5391233 5391217 5391212 -
catttagtcactcgtagggaca

SEQ ID NO: 114138 - DNA, 22 bp, Artificial Sequence
  Synthetic oligonucleotide; TTT chr11 5391207 5391228 5391212 5391207 -
agtcactcgtagggacaggctg

SEQ ID NO: 114139 - DNA, 22 bp, Artificial Sequence
  Synthetic oligonucleotide; TTA chr11 5391206 5391227 5391211 5391206 -
gtcactcgtagggacaggctga

SEQ ID NO: 114140 - DNA, 22 bp, Artificial Sequence
  Synthetic oligonucleotide; CTC chr11 5391199 5391220 5391204 5391199 -
gtagggacaggctgatcagcca

SEQ ID NO: 114141 - DNA, 22 bp, Artificial Sequence
  Synthetic oligonucleotide; CTG chr11 5391185 5391206 5391190 5391185 -
atcagccaatgtaaagtttatt

SEQ ID NO: 114142 - DNA, 22 bp, Artificial Sequence
  Synthetic oligonucleotide; TTT chr11 5391166 5391187 5391171 5391166 -
atttcctcctgagcaatgggat

SEQ ID NO: 114143 - DNA, 22 bp, Artificial Sequence
  Synthetic oligonucleotide; TTA chr11 5391165 5391186 5391170 5391165 -
tttcctcctgagcaatgggatt

SEQ ID NO: 114144 - DNA, 22 bp, Artificial Sequence
  Synthetic oligonucleotide; TTT chr11 5391162 5391183 5391167 5391162 -
cctcctgagcaatgggattgtg

SEQ ID NO: 114145 - DNA, 22 bp, Artificial Sequence
  Synthetic oligonucleotide; TTC chr11 5391161 5391182 5391166 5391161 -
ctcctgagcaatgggattgtga

SEQ ID NO: 114146 - DNA, 22 bp, Artificial Sequence
  Synthetic oligonucleotide; CTC chr11 5391158 5391179 5391163 5391158 -
ctgagcaatgggattgtgactt

SEQ ID NO: 114147 - DNA, 22 bp, Artificial Sequence
  Synthetic oligonucleotide; CTG chr11 5391155 5391176 5391160 5391155 -
agcaatgggattgtgacttcaa

SEQ ID NO: 114148 - DNA, 22 bp, Artificial Sequence
  Synthetic oligonucleotide; TTG chr11 5391142 5391163 5391147 5391142 -
tgacttcaatatgtttgtgtga

SEQ ID NO: 114149 - DNA, 22 bp, Artificial Sequence
  Synthetic oligonucleotide; CTT chr11 5391136 5391157 5391141 5391136 -
caatatgtttgtgtgagtttcc

SEQ ID NO: 114150 - DNA, 22 bp, Artificial Sequence
  Synthetic oligonucleotide; TTC chr11 5391135 5391156 5391140 5391135 -
aatatgtttgtgtgagtttcct

SEQ ID NO: 114151 - DNA, 22 bp, Artificial Sequence
  Synthetic oligonucleotide; TTT chr11 5391126 5391147 5391131 5391126 -
gtgtgagtttccttggctgaag

SEQ ID NO: 114152 - DNA, 22 bp, Artificial Sequence
  Synthetic oligonucleotide; TTG chr11 5391125 5391146 5391130 5391125 -
tgtgagtttccttggctgaagc

SEQ ID NO: 114153 - DNA, 22 bp, Artificial Sequence
  Synthetic oligonucleotide; TTT chr11 5391116 5391137 5391121 5391116 -
ccttggctgaagctttctcacg

SEQ ID NO: 114154 - DNA, 22 bp, Artificial Sequence
  Synthetic oligonucleotide; TTC chr11 5391115 5391136 5391120 5391115 -
cttggctgaagctttctcacgt

SEQ ID NO: 114155 - DNA, 22 bp, Artificial Sequence
  Synthetic oligonucleotide; CTT chr11 5391112 5391133 5391117 5391112 -
ggctgaagctttctcacgttac

SEQ ID NO: 114156 - DNA, 22 bp, Artificial Sequence
  Synthetic oligonucleotide; TTG chr11 5391111 5391132 5391116 5391111 -
gctgaagctttctcacgttaca

SEQ ID NO: 114157 - DNA, 22 bp, Artificial Sequence
  Synthetic oligonucleotide; CTG chr11 5391107 5391128 5391112 5391107 -
aagctttctcacgttacatgtc

SEQ ID NO: 114158 - DNA, 22 bp, Artificial Sequence
  Synthetic oligonucleotide; CTT chr11 5391101 5391122 5391106 5391101 -
tctcacgttacatgtcattgtt

SEQ ID NO: 114159 - DNA, 22 bp, Artificial Sequence
  Synthetic oligonucleotide; TTT chr11 5391100 5391121 5391105 5391100 -
ctcacgttacatgtcattgttc

SEQ ID NO: 114160 - DNA, 22 bp, Artificial Sequence
  Synthetic oligonucleotide; TTC chr11 5391099 5391120 5391104 5391099 -
tcacgttacatgtcattgttca

SEQ ID NO: 114161 - DNA, 22 bp, Artificial Sequence
  Synthetic oligonucleotide; CTC chr11 5391097 5391118 5391102 5391097 -
acgttacatgtcattgttcaat

SEQ ID NO: 114162 - DNA, 22 bp, Artificial Sequence
  Synthetic oligonucleotide; TTA chr11 5391091 5391112 5391096 5391091 -
catgtcattgttcaatatcaca

SEQ ID NO: 114163 - DNA, 22 bp, Artificial Sequence
  Synthetic oligonucleotide; TTG chr11 5391081 5391102 5391086 5391081 -
ttcaatatcacacaactaaaac

SEQ ID NO: 114164 - DNA, 22 bp, Artificial Sequence
  Synthetic oligonucleotide; TTC chr11 5391078 5391099 5391083 5391078 -
aatatcacacaactaaaacacc

SEQ ID NO: 114165 - DNA, 22 bp, Artificial Sequence
  Synthetic oligonucleotide; CTA chr11 5391063 5391084 5391068 5391063 -
aaacacctacaagtaaatactg

SEQ ID NO: 114166 - DNA, 22 bp, Artificial Sequence
  Synthetic oligonucleotide; CTA chr11 5391054 5391075 5391059 5391054 -
caagtaaatactgactgtagct

SEQ ID NO: 114167 - DNA, 22 bp, Artificial Sequence
  Synthetic oligonucleotide; CTG chr11 5391041 5391062 5391046 5391041 -
actgtagcttaatgtcagactt

SEQ ID NO: 114168 - DNA, 22 bp, Artificial Sequence
  Synthetic oligonucleotide; CTG chr11 5391037 5391058 5391042 5391037 -
tagcttaatgtcagacttgagg

SEQ ID NO: 114169 - DNA, 22 bp, Artificial Sequence
  Synthetic oligonucleotide; CTT chr11 5391031 5391052 5391036 5391031 -
aatgtcagacttgaggttgtaa

SEQ ID NO: 114170 - DNA, 22 bp, Artificial Sequence
  Synthetic oligonucleotide; TTA chr11 5391030 5391051 5391035 5391030 -
atgtcagacttgaggttgtaag

SEQ ID NO: 114171 - DNA, 22 bp, Artificial Sequence
  Synthetic oligonucleotide; CTT chr11 5391019 5391040 5391024 5391019 -
gaggttgtaaggtaaaatcaga

SEQ ID NO: 114172 - DNA, 22 bp, Artificial Sequence
  Synthetic oligonucleotide; TTG chr11 5391018 5391039 5391023 5391018 -
aggttgtaaggtaaaatcagag

SEQ ID NO: 114173 - DNA, 22 bp, Artificial Sequence
  Synthetic oligonucleotide; TTG chr11 5391012 5391033 5391017 5391012 -
taaggtaaaatcagagatgaga

SEQ ID NO: 114174 - DNA, 22 bp, Artificial Sequence
  Synthetic oligonucleotide; CTC chr11 5390964 5390985 5390969 5390964 -
ttcttctagaggaatatggtca

SEQ ID NO: 114175 - DNA, 22 bp, Artificial Sequence
  Synthetic oligonucleotide; CTT chr11 5390962 5390983 5390967 5390962 -
cttctagaggaatatggtcagg

SEQ ID NO: 114176 - DNA, 22 bp, Artificial Sequence
  Synthetic oligonucleotide; TTC chr11 5390961 5390982 5390966 5390961 -
ttctagaggaatatggtcagga

SEQ ID NO: 114177 - DNA, 22 bp, Artificial Sequence
  Synthetic oligonucleotide; CTT chr11 5390959 5390980 5390964 5390959 -
ctagaggaatatggtcaggaga

SEQ ID NO: 114178 - DNA, 22 bp, Artificial Sequence
  Synthetic oligonucleotide; TTC chr11 5390958 5390979 5390963 5390958 -
tagaggaatatggtcaggagag

SEQ ID NO: 114179 - DNA, 22 bp, Artificial Sequence
  Synthetic oligonucleotide; CTA chr11 5390956 5390977 5390961 5390956 -
gaggaatatggtcaggagagag

SEQ ID NO: 114180 - DNA, 22 bp, Artificial Sequence
  Synthetic oligonucleotide; CTT chr11 5390925 5390946 5390930 5390925 -
agaaatttgggggggtgttgct

SEQ ID NO: 114181 - DNA, 22 bp, Artificial Sequence
  Synthetic oligonucleotide; TTA chr11 5390924 5390945 5390929 5390924 -
gaaatttgggggggtgttgctt

SEQ ID NO: 114182 - DNA, 22 bp, Artificial Sequence
  Synthetic oligonucleotide; TTT chr11 5390917 5390938 5390922 5390917 -
gggggggtgttgcttgaaacag

SEQ ID NO: 114183 - DNA, 22 bp, Artificial Sequence
  Synthetic oligonucleotide; TTG chr11 5390916 5390937 5390921 5390916 -
ggggggtgttgcttgaaacagg

SEQ ID NO: 114184 - DNA, 22 bp, Artificial Sequence
  Synthetic oligonucleotide; TTG chr11 5390905 5390926 5390910 5390905 -
cttgaaacaggtgttgaggaag

SEQ ID NO: 114185 - DNA, 22 bp, Artificial Sequence
  Synthetic oligonucleotide; CTT chr11 5390902 5390923 5390907 5390902 -
gaaacaggtgttgaggaagaat

SEQ ID NO: 114186 - DNA, 22 bp, Artificial Sequence
  Synthetic oligonucleotide; TTG chr11 5390901 5390922 5390906 5390901 -
aaacaggtgttgaggaagaatg

SEQ ID NO: 114187 - DNA, 22 bp, Artificial Sequence
  Synthetic oligonucleotide; TTG chr11 5390889 5390910 5390894 5390889 -
aggaagaatgcaggagttctga

SEQ ID NO: 114188 - DNA, 22 bp, Artificial Sequence
  Synthetic oligonucleotide; TTC chr11 5390870 5390891 5390875 5390870 -
tgaggtttctgatgtgacttgg

SEQ ID NO: 114189 - DNA, 22 bp, Artificial Sequence
  Synthetic oligonucleotide; CTG chr11 5390868 5390889 5390873 5390868 -
aggtttctgatgtgacttgggg

SEQ ID NO: 114190 - DNA, 22 bp, Artificial Sequence
  Synthetic oligonucleotide; TTT chr11 5390862 5390883 5390867 5390862 -
ctgatgtgacttgggggtctga

SEQ ID NO: 114191 - DNA, 22 bp, Artificial Sequence
  Synthetic oligonucleotide; TTC chr11 5390861 5390882 5390866 5390861 -
tgatgtgacttgggggtctgaa

SEQ ID NO: 114192 - DNA, 22 bp, Artificial Sequence
  Synthetic oligonucleotide; CTG chr11 5390859 5390880 5390864 5390859 -
atgtgacttgggggtctgaaag

SEQ ID NO: 114193 - DNA, 22 bp, Artificial Sequence
  Synthetic oligonucleotide; CTT chr11 5390850 5390871 5390855 5390850 -
gggggtctgaaagttactgctg

SEQ ID NO: 114194 - DNA, 22 bp, Artificial Sequence
  Synthetic oligonucleotide; TTG chr11 5390849 5390870 5390854 5390849 -
ggggtctgaaagttactgctga

SEQ ID NO: 114195 - DNA, 22 bp, Artificial Sequence
  Synthetic oligonucleotide; CTG chr11 5390841 5390862 5390846 5390841 -
aaagttactgctgaccaggata

SEQ ID NO: 114196 - DNA, 22 bp, Artificial Sequence
  Synthetic oligonucleotide; TTA chr11 5390834 5390855 5390839 5390834 -
ctgctgaccaggatagaaaaag

SEQ ID NO: 114197 - DNA, 22 bp, Artificial Sequence
  Synthetic oligonucleotide; CTG chr11 5390831 5390852 5390836 5390831 -
ctgaccaggatagaaaaagatg

SEQ ID NO: 114198 - DNA, 22 bp, Artificial Sequence
  Synthetic oligonucleotide; CTG chr11 5390828 5390849 5390833 5390828 -
accaggatagaaaaagatgaga

SEQ ID NO: 114199 - DNA, 22 bp, Artificial Sequence
  Synthetic oligonucleotide; CTT chr11 5390798 5390819 5390803 5390798 -
ggccaggtagataagatggaag

SEQ ID NO: 114200 - DNA, 22 bp, Artificial Sequence
  Synthetic oligonucleotide; TTG chr11 5390797 5390818 5390802 5390797 -
gccaggtagataagatggaagc

SEQ ID NO: 114201 - DNA, 22 bp, Artificial Sequence
  Synthetic oligonucleotide; TTT chr11 5390743 5390764 5390748 5390743 -
ccggaggtgagttagagcaaat

SEQ ID NO: 114202 - DNA, 22 bp, Artificial Sequence
  Synthetic oligonucleotide; TTC chr11 5390742 5390763 5390747 5390742 -
cggaggtgagttagagcaaatg

SEQ ID NO: 114203 - DNA, 22 bp, Artificial Sequence
  Synthetic oligonucleotide; TTA chr11 5390729 5390750 5390734 5390729 -
gagcaaatggcatttacctggt

SEQ ID NO: 114204 - DNA, 22 bp, Artificial Sequence
  Synthetic oligonucleotide; TTT chr11 5390714 5390735 5390719 5390714 -
acctggtctctgccaggctctc

SEQ ID NO: 114205 - DNA, 22 bp, Artificial Sequence
  Synthetic oligonucleotide; TTA chr11 5390713 5390734 5390718 5390713 -
cctggtctctgccaggctctcc

SEQ ID NO: 114206 - DNA, 22 bp, Artificial Sequence
  Synthetic oligonucleotide; CTG chr11 5390709 5390730 5390714 5390709 -
gtctctgccaggctctcctctg

SEQ ID NO: 114207 - DNA, 22 bp, Artificial Sequence
  Synthetic oligonucleotide; CTC chr11 5390704 5390725 5390709 5390704 -
tgccaggctctcctctgggtgc

SEQ ID NO: 114208 - DNA, 22 bp, Artificial Sequence
  Synthetic oligonucleotide; CTG chr11 5390702 5390723 5390707 5390702 -
ccaggctctcctctgggtgctc

SEQ ID NO: 114209 - DNA, 22 bp, Artificial Sequence
  Synthetic oligonucleotide; CTC chr11 5390694 5390715 5390699 5390694 -
tcctctgggtgctctggtattt

SEQ ID NO: 114210 - DNA, 22 bp, Artificial Sequence
  Synthetic oligonucleotide; CTC chr11 5390692 5390713 5390697 5390692 -
ctctgggtgctctggtatttat

SEQ ID NO: 114211 - DNA, 22 bp, Artificial Sequence
  Synthetic oligonucleotide; CTC chr11 5390689 5390710 5390694 5390689 -
tgggtgctctggtatttattgt

SEQ ID NO: 114212 - DNA, 22 bp, Artificial Sequence
  Synthetic oligonucleotide; CTG chr11 5390687 5390708 5390692 5390687 -
ggtgctctggtatttattgttc

SEQ ID NO: 114213 - DNA, 22 bp, Artificial Sequence
  Synthetic oligonucleotide; CTC chr11 5390680 5390701 5390685 5390680 -
tggtatttattgttctttttag

SEQ ID NO: 114214 - DNA, 22 bp, Artificial Sequence
  Synthetic oligonucleotide; CTG chr11 5390678 5390699 5390683 5390678 -
gtatttattgttctttttagtt

SEQ ID NO: 114215 - DNA, 22 bp, Artificial Sequence
  Synthetic oligonucleotide; TTT chr11 5390672 5390693 5390677 5390672 -
attgttctttttagtttttatt

SEQ ID NO: 114216 - DNA, 22 bp, Artificial Sequence
  Synthetic oligonucleotide; TTA chr11 5390671 5390692 5390676 5390671 -
ttgttctttttagtttttattt

SEQ ID NO: 114217 - DNA, 22 bp, Artificial Sequence
  Synthetic oligonucleotide; TTG chr11 5390668 5390689 5390673 5390668 -
ttctttttagtttttatttagt

SEQ ID NO: 114218 - DNA, 22 bp, Artificial Sequence
  Synthetic oligonucleotide; TTC chr11 5390665 5390686 5390670 5390665 -
tttttagtttttatttagtttc

SEQ ID NO: 114219 - DNA, 22 bp, Artificial Sequence
  Synthetic oligonucleotide; CTT chr11 5390663 5390684 5390668 5390663 -
tttagtttttatttagtttcat

SEQ ID NO: 114220 - DNA, 22 bp, Artificial Sequence
  Synthetic oligonucleotide; TTT chr11 5390662 5390683 5390667 5390662 -
ttagtttttatttagtttcatt

SEQ ID NO: 114221 - DNA, 22 bp, Artificial Sequence
  Synthetic oligonucleotide; TTT chr11 5390661 5390682 5390666 5390661 -
tagtttttatttagtttcattt

SEQ ID NO: 114222 - DNA, 22 bp, Artificial Sequence
  Synthetic oligonucleotide; TTT chr11 5390660 5390681 5390665 5390660 -
agtttttatttagtttcatttt

SEQ ID NO: 114223 - DNA, 22 bp, Artificial Sequence
  Synthetic oligonucleotide; TTA chr11 5390659 5390680 5390664 5390659 -
gtttttatttagtttcatttta

SEQ ID NO: 114224 - DNA, 22 bp, Artificial Sequence
  Synthetic oligonucleotide; TTT chr11 5390655 5390676 5390660 5390655 -
ttatttagtttcattttagttt

SEQ ID NO: 114225 - DNA, 22 bp, Artificial Sequence
  Synthetic oligonucleotide; TTT chr11 5390654 5390675 5390659 5390654 -
tatttagtttcattttagtttt

SEQ ID NO: 114226 - DNA, 22 bp, Artificial Sequence
  Synthetic oligonucleotide; TTT chr11 5390653 5390674 5390658 5390653 -
atttagtttcattttagtttta

SEQ ID NO: 114227 - DNA, 22 bp, Artificial Sequence
  Synthetic oligonucleotide; TTA chr11 5390652 5390673 5390657 5390652 -
tttagtttcattttagttttag

SEQ ID NO: 114228 - DNA, 22 bp, Artificial Sequence
  Synthetic oligonucleotide; TTT chr11 5390649 5390670 5390654 5390649 -
agtttcattttagttttagtta

SEQ ID NO: 114229 - DNA, 22 bp, Artificial Sequence
  Synthetic oligonucleotide; TTA chr11 5390648 5390669 5390653 5390648 -
gtttcattttagttttagttac

SEQ ID NO: 114230 - DNA, 22 bp, Artificial Sequence
  Synthetic oligonucleotide; TTT chr11 5390644 5390665 5390649 5390644 -
cattttagttttagttacattg

SEQ ID NO: 114231 - DNA, 22 bp, Artificial Sequence
  Synthetic oligonucleotide; TTC chr11 5390643 5390664 5390648 5390643 -
attttagttttagttacattga

SEQ ID NO: 114232 - DNA, 22 bp, Artificial Sequence
  Synthetic oligonucleotide; TTT chr11 5390639 5390660 5390644 5390639 -
tagttttagttacattgatgat

SEQ ID NO: 114233 - DNA, 22 bp, Artificial Sequence
  Synthetic oligonucleotide; TTT chr11 5390638 5390659 5390643 5390638 -
agttttagttacattgatgatg

SEQ ID NO: 114234 - DNA, 22 bp, Artificial Sequence
  Synthetic oligonucleotide; TTA chr11 5390637 5390658 5390642 5390637 -
gttttagttacattgatgatga

SEQ ID NO: 114235 - DNA, 22 bp, Artificial Sequence
  Synthetic oligonucleotide; TTT chr11 5390633 5390654 5390638 5390633 -
tagttacattgatgatgacctt

SEQ ID NO: 114236 - DNA, 22 bp, Artificial Sequence
  Synthetic oligonucleotide; TTT chr11 5390632 5390653 5390637 5390632 -
agttacattgatgatgaccttc

SEQ ID NO: 114237 - DNA, 22 bp, Artificial Sequence
  Synthetic oligonucleotide; TTA chr11 5390631 5390652 5390636 5390631 -
gttacattgatgatgaccttca

SEQ ID NO: 114238 - DNA, 22 bp, Artificial Sequence
  Synthetic oligonucleotide; TTA chr11 5390627 5390648 5390632 5390627 -
cattgatgatgaccttcaataa

SEQ ID NO: 114239 - DNA, 22 bp, Artificial Sequence
  Synthetic oligonucleotide; TTG chr11 5390622 5390643 5390627 5390622 -
atgatgaccttcaataaagttg

SEQ ID NO: 114240 - DNA, 22 bp, Artificial Sequence
  Synthetic oligonucleotide; CTT chr11 5390611 5390632 5390616 5390611 -
caataaagttgccttctggata

SEQ ID NO: 114241 - DNA, 22 bp, Artificial Sequence
  Synthetic oligonucleotide; TTC chr11 5390610 5390631 5390615 5390610 -
aataaagttgccttctggatag

SEQ ID NO: 114242 - DNA, 22 bp, Artificial Sequence
  Synthetic oligonucleotide; TTG chr11 5390600 5390621 5390605 5390600 -
ccttctggatagctttgatgct

SEQ ID NO: 114243 - DNA, 22 bp, Artificial Sequence
  Synthetic oligonucleotide; CTT chr11 5390596 5390617 5390601 5390596 -
ctggatagctttgatgctacca

SEQ ID NO: 114244 - DNA, 22 bp, Artificial Sequence
  Synthetic oligonucleotide; TTC chr11 5390595 5390616 5390600 5390595 -
tggatagctttgatgctaccaa

SEQ ID NO: 114245 - DNA, 22 bp, Artificial Sequence
  Synthetic oligonucleotide; CTG chr11 5390593 5390614 5390598 5390593 -
gatagctttgatgctaccaaaa

SEQ ID NO: 114246 - DNA, 22 bp, Artificial Sequence
  Synthetic oligonucleotide; CTT chr11 5390585 5390606 5390590 5390585 -
tgatgctaccaaaaatgccagt

SEQ ID NO: 114247 - DNA, 22 bp, Artificial Sequence
  Synthetic oligonucleotide; TTT chr11 5390584 5390605 5390589 5390584 -
gatgctaccaaaaatgccagtt

SEQ ID NO: 114248 - DNA, 22 bp, Artificial Sequence
  Synthetic oligonucleotide; TTG chr11 5390583 5390604 5390588 5390583 -
atgctaccaaaaatgccagttc

SEQ ID NO: 114249 - DNA, 22 bp, Artificial Sequence
  Synthetic oligonucleotide; CTA chr11 5390577 5390598 5390582 5390577 -
ccaaaaatgccagttctcagct

SEQ ID NO: 114250 - DNA, 22 bp, Artificial Sequence
  Synthetic oligonucleotide; TTC chr11 5390561 5390582 5390566 5390561 -
tcagctgtaggaggagccatta

SEQ ID NO: 114251 - DNA, 22 bp, Artificial Sequence
  Synthetic oligonucleotide; CTC chr11 5390559 5390580 5390564 5390559 -
agctgtaggaggagccattaaa

SEQ ID NO: 114252 - DNA, 22 bp, Artificial Sequence
  Synthetic oligonucleotide; CTG chr11 5390554 5390575 5390559 5390554 -
taggaggagccattaaaatcta

SEQ ID NO: 114253 - DNA, 22 bp, Artificial Sequence
  Synthetic oligonucleotide; TTA chr11 5390539 5390560 5390544 5390539 -
aaatctaagcaagagaagttca

SEQ ID NO: 114254 - DNA, 22 bp, Artificial Sequence
  Synthetic oligonucleotide; CTA chr11 5390532 5390553 5390537 5390532 -
agcaagagaagttcagtttttt

SEQ ID NO: 114255 - DNA, 22 bp, Artificial Sequence
  Synthetic oligonucleotide; TTC chr11 5390518 5390539 5390523 5390518 -
agttttttaaagccacaactcc

SEQ ID NO: 114256 - DNA, 22 bp, Artificial Sequence
  Synthetic oligonucleotide; TTT chr11 5390513 5390534 5390518 5390513 -
tttaaagccacaactccagaca

SEQ ID NO: 114257 - DNA, 22 bp, Artificial Sequence
  Synthetic oligonucleotide; TTT chr11 5390512 5390533 5390517 5390512 -
ttaaagccacaactccagacat

SEQ ID NO: 114258 - DNA, 22 bp, Artificial Sequence
  Synthetic oligonucleotide; TTT chr11 5390511 5390532 5390516 5390511 -
taaagccacaactccagacata

SEQ ID NO: 114259 - DNA, 22 bp, Artificial Sequence
  Synthetic oligonucleotide; TTT chr11 5390510 5390531 5390515 5390510 -
aaagccacaactccagacataa

SEQ ID NO: 114260 - DNA, 22 bp, Artificial Sequence
  Synthetic oligonucleotide; TTA chr11 5390509 5390530 5390514 5390509 -
aagccacaactccagacataaa

SEQ ID NO: 114261 - DNA, 22 bp, Artificial Sequence
  Synthetic oligonucleotide; CTC chr11 5390497 5390518 5390502 5390497 -
cagacataaatttgcccatatt

SEQ ID NO: 114262 - DNA, 22 bp, Artificial Sequence
  Synthetic oligonucleotide; TTT chr11 5390484 5390505 5390489 5390484 -
gcccatattttatttaggacag

SEQ ID NO: 114263 - DNA, 22 bp, Artificial Sequence
  Synthetic oligonucleotide; TTG chr11 5390483 5390504 5390488 5390483 -
cccatattttatttaggacagg

SEQ ID NO: 114264 - DNA, 22 bp, Artificial Sequence
  Synthetic oligonucleotide; TTT chr11 5390474 5390495 5390479 5390474 -
tatttaggacaggggcaaaaaa

SEQ ID NO: 114265 - DNA, 22 bp, Artificial Sequence
  Synthetic oligonucleotide; TTT chr11 5390473 5390494 5390478 5390473 -
atttaggacaggggcaaaaaat

SEQ ID NO: 114266 - DNA, 22 bp, Artificial Sequence
  Synthetic oligonucleotide; TTA chr11 5390472 5390493 5390477 5390472 -
tttaggacaggggcaaaaaatc

SEQ ID NO: 114267 - DNA, 22 bp, Artificial Sequence
  Synthetic oligonucleotide; TTT chr11 5390469 5390490 5390474 5390469 -
aggacaggggcaaaaaatcttt

SEQ ID NO: 114268 - DNA, 22 bp, Artificial Sequence
  Synthetic oligonucleotide; TTA chr11 5390468 5390489 5390473 5390468 -
ggacaggggcaaaaaatcttta

SEQ ID NO: 114269 - DNA, 22 bp, Artificial Sequence
  Synthetic oligonucleotide; CTT chr11 5390448 5390469 5390453 5390448 -
taagagcatgctatatactcaa

SEQ ID NO: 114270 - DNA, 22 bp, Artificial Sequence
  Synthetic oligonucleotide; TTT chr11 5390447 5390468 5390452 5390447 -
aagagcatgctatatactcaat

SEQ ID NO: 114271 - DNA, 22 bp, Artificial Sequence
  Synthetic oligonucleotide; TTA chr11 5390446 5390467 5390451 5390446 -
agagcatgctatatactcaata

SEQ ID NO: 114272 - DNA, 22 bp, Artificial Sequence
  Synthetic oligonucleotide; CTA chr11 5390435 5390456 5390440 5390435 -
tatactcaatactccaaatttt

SEQ ID NO: 114273 - DNA, 22 bp, Artificial Sequence
  Synthetic oligonucleotide; CTC chr11 5390428 5390449 5390433 5390428 -
aatactccaaattttcagtcca

SEQ ID NO: 114274 - DNA, 22 bp, Artificial Sequence
  Synthetic oligonucleotide; CTC chr11 5390421 5390442 5390426 5390421 -
caaattttcagtccaatttggg

SEQ ID NO: 114275 - DNA, 22 bp, Artificial Sequence
  Synthetic oligonucleotide; TTT chr11 5390414 5390435 5390419 5390414 -
tcagtccaatttggggccttct

SEQ ID NO: 114276 - DNA, 22 bp, Artificial Sequence
  Synthetic oligonucleotide; TTT chr11 5390413 5390434 5390418 5390413 -
cagtccaatttggggccttctt

SEQ ID NO: 114277 - DNA, 22 bp, Artificial Sequence
  Synthetic oligonucleotide; TTC chr11 5390412 5390433 5390417 5390412 -
agtccaatttggggccttctta

SEQ ID NO: 114278 - DNA, 22 bp, Artificial Sequence
  Synthetic oligonucleotide; TTT chr11 5390402 5390423 5390407 5390402 -
ggggccttcttataggcctcta

SEQ ID NO: 114279 - DNA, 22 bp, Artificial Sequence
  Synthetic oligonucleotide; TTG chr11 5390401 5390422 5390406 5390401 -
gggccttcttataggcctctag

SEQ ID NO: 114280 - DNA, 22 bp, Artificial Sequence
  Synthetic oligonucleotide; CTT chr11 5390394 5390415 5390399 5390394 -
cttataggcctctagggggagt

SEQ ID NO: 114281 - DNA, 22 bp, Artificial Sequence
  Synthetic oligonucleotide; TTC chr11 5390393 5390414 5390398 5390393 -
ttataggcctctagggggagtt

SEQ ID NO: 114282 - DNA, 22 bp, Artificial Sequence
  Synthetic oligonucleotide; CTT chr11 5390391 5390412 5390396 5390391 -
ataggcctctagggggagtttt

SEQ ID NO: 114283 - DNA, 22 bp, Artificial Sequence
  Synthetic oligonucleotide; TTA chr11 5390390 5390411 5390395 5390390 -
taggcctctagggggagtttta

SEQ ID NO: 114284 - DNA, 22 bp, Artificial Sequence
  Synthetic oligonucleotide; CTC chr11 5390382 5390403 5390387 5390382 -
tagggggagttttagccccagg

SEQ ID NO: 114285 - DNA, 22 bp, Artificial Sequence
  Synthetic oligonucleotide; CTA chr11 5390380 5390401 5390385 5390380 -
gggggagttttagccccaggac

SEQ ID NO: 114286 - DNA, 22 bp, Artificial Sequence
  Synthetic oligonucleotide; TTT chr11 5390370 5390391 5390375 5390370 -
tagccccaggactcatttactg

SEQ ID NO: 114287 - DNA, 22 bp, Artificial Sequence
  Synthetic oligonucleotide; TTT chr11 5390369 5390390 5390374 5390369 -
agccccaggactcatttactgg

SEQ ID NO: 114288 - DNA, 22 bp, Artificial Sequence
  Synthetic oligonucleotide; TTA chr11 5390368 5390389 5390373 5390368 -
gccccaggactcatttactggc

SEQ ID NO: 114289 - DNA, 22 bp, Artificial Sequence
  Synthetic oligonucleotide; CTC chr11 5390356 5390377 5390361 5390356 -
atttactggcctttttaagacc

SEQ ID NO: 114290 - DNA, 22 bp, Artificial Sequence
  Synthetic oligonucleotide; TTT chr11 5390352 5390373 5390357 5390352 -
actggcctttttaagacctagg

SEQ ID NO: 114291 - DNA, 22 bp, Artificial Sequence
  Synthetic oligonucleotide; TTA chr11 5390351 5390372 5390356 5390351 -
ctggcctttttaagacctagga

SEQ ID NO: 114292 - DNA, 22 bp, Artificial Sequence
  Synthetic oligonucleotide; CTG chr11 5390348 5390369 5390353 5390348 -
gcctttttaagacctaggaact

SEQ ID NO: 114293 - DNA, 22 bp, Artificial Sequence
  Synthetic oligonucleotide; CTT chr11 5390343 5390364 5390348 5390343 -
tttaagacctaggaacttgata

SEQ ID NO: 114294 - DNA, 22 bp, Artificial Sequence
  Synthetic oligonucleotide; TTT chr11 5390342 5390363 5390347 5390342 -
ttaagacctaggaacttgataa

SEQ ID NO: 114295 - DNA, 22 bp, Artificial Sequence
  Synthetic oligonucleotide; TTT chr11 5390341 5390362 5390346 5390341 -
taagacctaggaacttgataat

SEQ ID NO: 114296 - DNA, 22 bp, Artificial Sequence
  Synthetic oligonucleotide; TTT chr11 5390340 5390361 5390345 5390340 -
aagacctaggaacttgataatg

SEQ ID NO: 114297 - DNA, 22 bp, Artificial Sequence
  Synthetic oligonucleotide; TTA chr11 5390339 5390360 5390344 5390339 -
agacctaggaacttgataatgg

SEQ ID NO: 114298 - DNA, 22 bp, Artificial Sequence
  Synthetic oligonucleotide; CTA chr11 5390332 5390353 5390337 5390332 -
ggaacttgataatggcacggtg

SEQ ID NO: 114299 - DNA, 22 bp, Artificial Sequence
  Synthetic oligonucleotide; CTT chr11 5390325 5390346 5390330 5390325 -
gataatggcacggtggatctcc

SEQ ID NO: 114300 - DNA, 22 bp, Artificial Sequence
  Synthetic oligonucleotide; TTG chr11 5390324 5390345 5390329 5390324 -
ataatggcacggtggatctcct

SEQ ID NO: 114301 - DNA, 22 bp, Artificial Sequence
  Synthetic oligonucleotide; CTC chr11 5390304 5390325 5390309 5390304 -
cttggtcttaatgctgtatatg

SEQ ID NO: 114302 - DNA, 22 bp, Artificial Sequence
  Synthetic oligonucleotide; CTT chr11 5390301 5390322 5390306 5390301 -
ggtcttaatgctgtatatgatt

SEQ ID NO: 114303 - DNA, 22 bp, Artificial Sequence
  Synthetic oligonucleotide; TTG chr11 5390300 5390321 5390305 5390300 -
gtcttaatgctgtatatgattg

SEQ ID NO: 114304 - DNA, 22 bp, Artificial Sequence
  Synthetic oligonucleotide; CTT chr11 5390295 5390316 5390300 5390295 -
aatgctgtatatgattgggtta

SEQ ID NO: 114305 - DNA, 22 bp, Artificial Sequence
  Synthetic oligonucleotide; TTA chr11 5390294 5390315 5390299 5390294 -
atgctgtatatgattgggttaa

SEQ ID NO: 114306 - DNA, 22 bp, Artificial Sequence
  Synthetic oligonucleotide; CTG chr11 5390288 5390309 5390293 5390288 -
tatatgattgggttaagcatgg

SEQ ID NO: 114307 - DNA, 22 bp, Artificial Sequence
  Synthetic oligonucleotide; TTG chr11 5390278 5390299 5390283 5390278 -
ggttaagcatgggaggcacaaa

SEQ ID NO: 114308 - DNA, 22 bp, Artificial Sequence
  Synthetic oligonucleotide; TTA chr11 5390273 5390294 5390278 5390273 -
agcatgggaggcacaaaaaggt

SEQ ID NO: 114309 - DNA, 22 bp, Artificial Sequence
  Synthetic oligonucleotide; TTG chr11 5390243 5390264 5390248 5390243 -
gccataagaagatgaatagcag

SEQ ID NO: 114310 - DNA, 22 bp, Artificial Sequence
  Synthetic oligonucleotide; CTT chr11 5390208 5390229 5390213 5390208 -
cccaaaacggtgcaccagggac

SEQ ID NO: 114311 - DNA, 22 bp, Artificial Sequence
  Synthetic oligonucleotide; TTC chr11 5390207 5390228 5390212 5390207 -
ccaaaacggtgcaccagggaca

SEQ ID NO: 114312 - DNA, 22 bp, Artificial Sequence
  Synthetic oligonucleotide; CTA chr11 5390158 5390179 5390163 5390158 -
gcacagcacagagaggagcggt

SEQ ID NO: 114313 - DNA, 22 bp, Artificial Sequence
  Synthetic oligonucleotide; CTG chr11 5390127 5390148 5390132 5390127 -
aaaggcacggcgctgctcctct

SEQ ID NO: 114314 - DNA, 22 bp, Artificial Sequence
  Synthetic oligonucleotide; CTG chr11 5390112 5390133 5390117 5390112 -
ctcctcttgggaggccaggcct

SEQ ID NO: 114315 - DNA, 22 bp, Artificial Sequence
  Synthetic oligonucleotide; CTC chr11 5390109 5390130 5390114 5390109 -
ctcttgggaggccaggcctgct

SEQ ID NO: 114316 - DNA, 22 bp, Artificial Sequence
  Synthetic oligonucleotide; CTC chr11 5390106 5390127 5390111 5390106 -
ttgggaggccaggcctgctact

SEQ ID NO: 114317 - DNA, 22 bp, Artificial Sequence
  Synthetic oligonucleotide; CTT chr11 5390104 5390125 5390109 5390104 -
gggaggccaggcctgctactgt

SEQ ID NO: 114318 - DNA, 22 bp, Artificial Sequence
  Synthetic oligonucleotide; TTG chr11 5390103 5390124 5390108 5390103 -
ggaggccaggcctgctactgtg

SEQ ID NO: 114319 - DNA, 22 bp, Artificial Sequence
  Synthetic oligonucleotide; CTG chr11 5390089 5390110 5390094 5390089 -
ctactgtgtgcaggatgagtcc

SEQ ID NO: 114320 - DNA, 22 bp, Artificial Sequence
  Synthetic oligonucleotide; CTA chr11 5390086 5390107 5390091 5390086 -
ctgtgtgcaggatgagtccata

SEQ ID NO: 114321 - DNA, 22 bp, Artificial Sequence
  Synthetic oligonucleotide; CTG chr11 5390083 5390104 5390088 5390083 -
tgtgcaggatgagtccatagga

SEQ ID NO: 114322 - DNA, 22 bp, Artificial Sequence
  Synthetic oligonucleotide; CTA chr11 5390020 5390041 5390025 5390020 -
ccaccatcagtccatacagatt

SEQ ID NO: 114323 - DNA, 22 bp, Artificial Sequence
  Synthetic oligonucleotide; TTA chr11 5389997 5390018 5390002 5389997 -
ttgaaggtgatatctgtgcagg

SEQ ID NO: 114324 - DNA, 22 bp, Artificial Sequence
  Synthetic oligonucleotide; TTG chr11 5389994 5390015 5389999 5389994 -
aaggtgatatctgtgcaggcca

SEQ ID NO: 114325 - DNA, 22 bp, Artificial Sequence
  Synthetic oligonucleotide; CTG chr11 5389981 5390002 5389986 5389981 -
tgcaggccagctgtatcacttc

SEQ ID NO: 114326 - DNA, 22 bp, Artificial Sequence
  Synthetic oligonucleotide; CTG chr11 5389968 5389989 5389973 5389968 -
tatcacttcctggtgcaggcaa

SEQ ID NO: 114327 - DNA, 22 bp, Artificial Sequence
  Synthetic oligonucleotide; CTT chr11 5389960 5389981 5389965 5389960 -
cctggtgcaggcaaaatgagtg

SEQ ID NO: 114328 - DNA, 22 bp, Artificial Sequence
  Synthetic oligonucleotide; TTC chr11 5389959 5389980 5389964 5389959 -
ctggtgcaggcaaaatgagtgg

SEQ ID NO: 114329 - DNA, 22 bp, Artificial Sequence
  Synthetic oligonucleotide; CTG chr11 5389956 5389977 5389961 5389956 -
gtgcaggcaaaatgagtgggag

SEQ ID NO: 114330 - DNA, 22 bp, Artificial Sequence
  Synthetic oligonucleotide; CTT chr11 5389902 5389923 5389907 5389902 -
caggaggaggacaatagggata

SEQ ID NO: 114331 - DNA, 22 bp, Artificial Sequence
  Synthetic oligonucleotide; TTC chr11 5389901 5389922 5389906 5389901 -
aggaggaggacaatagggatag

SEQ ID NO: 114332 - DNA, 22 bp, Artificial Sequence
  Synthetic oligonucleotide; TTA chr11 5389849 5389870 5389854 5389849 -
ggcctgctctgaccacttgctg

SEQ ID NO: 114333 - DNA, 22 bp, Artificial Sequence
  Synthetic oligonucleotide; CTG chr11 5389843 5389864 5389848 5389843 -
ctctgaccacttgctggccagt

SEQ ID NO: 114334 - DNA, 22 bp, Artificial Sequence
  Synthetic oligonucleotide; CTC chr11 5389840 5389861 5389845 5389840 -
tgaccacttgctggccagtgat

SEQ ID NO: 114335 - DNA, 22 bp, Artificial Sequence
  Synthetic oligonucleotide; CTG chr11 5389838 5389859 5389843 5389838 -
accacttgctggccagtgataa

SEQ ID NO: 114336 - DNA, 22 bp, Artificial Sequence
  Synthetic oligonucleotide; CTT chr11 5389831 5389852 5389836 5389831 -
gctggccagtgataatgaccga

SEQ ID NO: 114337 - DNA, 22 bp, Artificial Sequence
  Synthetic oligonucleotide; TTG chr11 5389830 5389851 5389835 5389830 -
ctggccagtgataatgaccgaa

SEQ ID NO: 114338 - DNA, 22 bp, Artificial Sequence
  Synthetic oligonucleotide; CTG chr11 5389827 5389848 5389832 5389827 -
gccagtgataatgaccgaatac

SEQ ID NO: 114339 - DNA, 22 bp, Artificial Sequence
  Synthetic oligonucleotide; CTC chr11 5389802 5389823 5389807 5389802 -
agagggtggcagatggccacaa

SEQ ID NO: 114340 - DNA, 22 bp, Artificial Sequence
  Synthetic oligonucleotide; CTG chr11 5389750 5389771 5389755 5389750 -
aggactccatgaaggaaaaaga

SEQ ID NO: 114341 - DNA, 22 bp, Artificial Sequence
  Synthetic oligonucleotide; CTC chr11 5389743 5389764 5389748 5389743 -
catgaaggaaaaagagtggatg

SEQ ID NO: 114342 - DNA, 22 bp, Artificial Sequence
  Synthetic oligonucleotide; CTG chr11 5389710 5389731 5389715 5389710 -
gatttgacacgctccaaagtag

SEQ ID NO: 114343 - DNA, 22 bp, Artificial Sequence
  Synthetic oligonucleotide; TTT chr11 5389705 5389726 5389710 5389705 -
gacacgctccaaagtagatact

SEQ ID NO: 114344 - DNA, 22 bp, Artificial Sequence
  Synthetic oligonucleotide; TTG chr11 5389704 5389725 5389709 5389704 -
acacgctccaaagtagatacta

SEQ ID NO: 114345 - DNA, 22 bp, Artificial Sequence
  Synthetic oligonucleotide; CTC chr11 5389696 5389717 5389701 5389696 -
caaagtagatactatgggagtt

SEQ ID NO: 114346 - DNA, 22 bp, Artificial Sequence
  Synthetic oligonucleotide; CTA chr11 5389682 5389703 5389687 5389682 -
tgggagttaaaccagaagatcc

SEQ ID NO: 114347 - DNA, 22 bp, Artificial Sequence
  Synthetic oligonucleotide; TTA chr11 5389673 5389694 5389678 5389673 -
aaccagaagatccccatagtgg

SEQ ID NO: 114348 - DNA, 22 bp, Artificial Sequence
  Synthetic oligonucleotide; TTG chr11 5389565 5389586 5389570 5389565 -
gtcttaataatgatcagaatga

SEQ ID NO: 114349 - DNA, 22 bp, Artificial Sequence
  Synthetic oligonucleotide; CTT chr11 5389560 5389581 5389565 5389560 -
aataatgatcagaatgaaacaa

SEQ ID NO: 114350 - DNA, 22 bp, Artificial Sequence
  Synthetic oligonucleotide; TTA chr11 5389559 5389580 5389564 5389559 -
ataatgatcagaatgaaacaat

SEQ ID NO: 114351 - DNA, 22 bp, Artificial Sequence
  Synthetic oligonucleotide; TTG chr11 5389535 5389556 5389540 5389535 -
cctgagatggcaaccatgtaca

SEQ ID NO: 114352 - DNA, 22 bp, Artificial Sequence
  Synthetic oligonucleotide; CTG chr11 5389531 5389552 5389536 5389531 -
agatggcaaccatgtacataaa

SEQ ID NO: 114353 - DNA, 22 bp, Artificial Sequence
  Synthetic oligonucleotide; TTT chr11 5389482 5389503 5389487 5389482 -
gatgccttccaatccaggaaag

SEQ ID NO: 114354 - DNA, 22 bp, Artificial Sequence
  Synthetic oligonucleotide; TTG chr11 5389481 5389502 5389486 5389481 -
atgccttccaatccaggaaagc

SEQ ID NO: 114355 - DNA, 22 bp, Artificial Sequence
  Synthetic oligonucleotide; CTT chr11 5389474 5389495 5389479 5389474 -
ccaatccaggaaagctggtgag

SEQ ID NO: 114356 - DNA, 22 bp, Artificial Sequence
  Synthetic oligonucleotide; TTC chr11 5389473 5389494 5389478 5389473 -
caatccaggaaagctggtgaga

SEQ ID NO: 114357 - DNA, 22 bp, Artificial Sequence
  Synthetic oligonucleotide; CTG chr11 5389457 5389478 5389462 5389457 -
gtgagatagaatatggggctaa

SEQ ID NO: 114358 - DNA, 22 bp, Artificial Sequence
  Synthetic oligonucleotide; CTA chr11 5389436 5389457 5389441 5389436 -
aactgagtaatgttggatagca

SEQ ID NO: 114359 - DNA, 22 bp, Artificial Sequence
  Synthetic oligonucleotide; CTG chr11 5389431 5389452 5389436 5389431 -
agtaatgttggatagcagcatg

SEQ ID NO: 114360 - DNA, 22 bp, Artificial Sequence
  Synthetic oligonucleotide; TTG chr11 5389421 5389442 5389426 5389421 -
gatagcagcatgaattgaggac

SEQ ID NO: 114361 - DNA, 22 bp, Artificial Sequence
  Synthetic oligonucleotide; TTG chr11 5389404 5389425 5389409 5389404 -
aggactgagcgaatattggact

SEQ ID NO: 114362 - DNA, 22 bp, Artificial Sequence
  Synthetic oligonucleotide; CTG chr11 5389397 5389418 5389402 5389397 -
agcgaatattggactgacattc

SEQ ID NO: 114363 - DNA, 22 bp, Artificial Sequence
  Synthetic oligonucleotide; TTG chr11 5389386 5389407 5389391 5389386 -
gactgacattcctcggggattg

SEQ ID NO: 114364 - DNA, 22 bp, Artificial Sequence
  Synthetic oligonucleotide; CTG chr11 5389381 5389402 5389386 5389381 -
acattcctcggggattgagctg

SEQ ID NO: 114365 - DNA, 22 bp, Artificial Sequence
  Synthetic oligonucleotide; TTC chr11 5389375 5389396 5389380 5389375 -
ctcggggattgagctgaaaata

SEQ ID NO: 114366 - DNA, 22 bp, Artificial Sequence
  Synthetic oligonucleotide; CTC chr11 5389372 5389393 5389377 5389372 -
ggggattgagctgaaaataaat

SEQ ID NO: 114367 - DNA, 22 bp, Artificial Sequence
  Synthetic oligonucleotide; TTG chr11 5389364 5389385 5389369 5389364 -
agctgaaaataaatggatattt

SEQ ID NO: 114368 - DNA, 22 bp, Artificial Sequence
  Synthetic oligonucleotide; CTG chr11 5389359 5389380 5389364 5389359 -
aaaataaatggatatttctggt

SEQ ID NO: 114369 - DNA, 22 bp, Artificial Sequence
  Synthetic oligonucleotide; TTT chr11 5389342 5389363 5389347 5389342 -
ctggttattaattcttcagctt

SEQ ID NO: 114370 - DNA, 22 bp, Artificial Sequence
  Synthetic oligonucleotide; TTC chr11 5389341 5389362 5389346 5389341 -
tggttattaattcttcagcttc

SEQ ID NO: 114371 - DNA, 22 bp, Artificial Sequence
  Synthetic oligonucleotide; CTG chr11 5389339 5389360 5389344 5389339 -
gttattaattcttcagcttcac

SEQ ID NO: 114372 - DNA, 22 bp, Artificial Sequence
  Synthetic oligonucleotide; TTA chr11 5389335 5389356 5389340 5389335 -
ttaattcttcagcttcactaac

SEQ ID NO: 114373 - DNA, 22 bp, Artificial Sequence
  Synthetic oligonucleotide; TTA chr11 5389332 5389353 5389337 5389332 -
attcttcagcttcactaacatt

SEQ ID NO: 114374 - DNA, 22 bp, Artificial Sequence
  Synthetic oligonucleotide; TTC chr11 5389328 5389349 5389333 5389328 -
ttcagcttcactaacattcaca

SEQ ID NO: 114375 - DNA, 22 bp, Artificial Sequence
  Synthetic oligonucleotide; CTT chr11 5389326 5389347 5389331 5389326 -
cagcttcactaacattcacaac

SEQ ID NO: 114376 - DNA, 22 bp, Artificial Sequence
  Synthetic oligonucleotide; TTC chr11 5389325 5389346 5389330 5389325 -
agcttcactaacattcacaaca

SEQ ID NO: 114377 - DNA, 22 bp, Artificial Sequence
  Synthetic oligonucleotide; CTT chr11 5389320 5389341 5389325 5389320 -
cactaacattcacaacatcaca

SEQ ID NO: 114378 - DNA, 22 bp, Artificial Sequence
  Synthetic oligonucleotide; TTC chr11 5389319 5389340 5389324 5389319 -
actaacattcacaacatcacaa

SEQ ID NO: 114379 - DNA, 22 bp, Artificial Sequence
  Synthetic oligonucleotide; CTA chr11 5389315 5389336 5389320 5389315 -
acattcacaacatcacaagcag

SEQ ID NO: 114380 - DNA, 22 bp, Artificial Sequence
  Synthetic oligonucleotide; TTC chr11 5389309 5389330 5389314 5389309 -
acaacatcacaagcagtaccat

SEQ ID NO: 114381 - DNA, 22 bp, Artificial Sequence
  Synthetic oligonucleotide; CTT chr11 5389272 5389293 5389277 5389272 -
tagtattatctactccaccctt

SEQ ID NO: 114382 - DNA, 22 bp, Artificial Sequence
  Synthetic oligonucleotide; TTT chr11 5389271 5389292 5389276 5389271 -
agtattatctactccaccctta

SEQ ID NO: 114383 - DNA, 22 bp, Artificial Sequence
  Synthetic oligonucleotide; TTA chr11 5389270 5389291 5389275 5389270 -
gtattatctactccacccttat

SEQ ID NO: 114384 - DNA, 22 bp, Artificial Sequence
  Synthetic oligonucleotide; TTA chr11 5389264 5389285 5389269 5389264 -
tctactccacccttatgaattc

SEQ ID NO: 114385 - DNA, 22 bp, Artificial Sequence
  Synthetic oligonucleotide; CTA chr11 5389260 5389281 5389265 5389260 -
ctccacccttatgaattctgcc

SEQ ID NO: 114386 - DNA, 22 bp, Artificial Sequence
  Synthetic oligonucleotide; CTC chr11 5389257 5389278 5389262 5389257 -
cacccttatgaattctgccaat

SEQ ID NO: 114387 - DNA, 22 bp, Artificial Sequence
  Synthetic oligonucleotide; CTT chr11 5389250 5389271 5389255 5389250 -
atgaattctgccaatctcacta

SEQ ID NO: 114388 - DNA, 22 bp, Artificial Sequence
  Synthetic oligonucleotide; TTA chr11 5389249 5389270 5389254 5389249 -
tgaattctgccaatctcactac

SEQ ID NO: 114389 - DNA, 22 bp, Artificial Sequence
  Synthetic oligonucleotide; TTC chr11 5389242 5389263 5389247 5389242 -
tgccaatctcactactttattg

SEQ ID NO: 114390 - DNA, 22 bp, Artificial Sequence
  Synthetic oligonucleotide; CTG chr11 5389240 5389261 5389245 5389240 -
ccaatctcactactttattgaa

SEQ ID NO: 114391 - DNA, 22 bp, Artificial Sequence
  Synthetic oligonucleotide; CTC chr11 5389232 5389253 5389237 5389232 -
actactttattgaactttcttt

SEQ ID NO: 114392 - DNA, 22 bp, Artificial Sequence
  Synthetic oligonucleotide; CTA chr11 5389228 5389249 5389233 5389228 -
ctttattgaactttctttgata

SEQ ID NO: 114393 - DNA, 22 bp, Artificial Sequence
  Synthetic oligonucleotide; CTT chr11 5389225 5389246 5389230 5389225 -
tattgaactttctttgataacc

SEQ ID NO: 114394 - DNA, 22 bp, Artificial Sequence
  Synthetic oligonucleotide; TTT chr11 5389224 5389245 5389229 5389224 -
attgaactttctttgataacct

SEQ ID NO: 114395 - DNA, 22 bp, Artificial Sequence
  Synthetic oligonucleotide; TTA chr11 5389223 5389244 5389228 5389223 -
ttgaactttctttgataacctc

SEQ ID NO: 114396 - DNA, 22 bp, Artificial Sequence
  Synthetic oligonucleotide; TTG chr11 5389220 5389241 5389225 5389220 -
aactttctttgataacctcgcc

SEQ ID NO: 114397 - DNA, 22 bp, Artificial Sequence
  Synthetic oligonucleotide; CTT chr11 5389215 5389236 5389220 5389215 -
tctttgataacctcgccctcac

SEQ ID NO: 114398 - DNA, 22 bp, Artificial Sequence
  Synthetic oligonucleotide; TTT chr11 5389214 5389235 5389219 5389214 -
ctttgataacctcgccctcacc

SEQ ID NO: 114399 - DNA, 22 bp, Artificial Sequence
  Synthetic oligonucleotide; TTC chr11 5389213 5389234 5389218 5389213 -
tttgataacctcgccctcacca

SEQ ID NO: 114400 - DNA, 22 bp, Artificial Sequence
  Synthetic oligonucleotide; CTT chr11 5389211 5389232 5389216 5389211 -
tgataacctcgccctcaccagt

SEQ ID NO: 114401 - DNA, 22 bp, Artificial Sequence
  Synthetic oligonucleotide; TTT chr11 5389210 5389231 5389215 5389210 -
gataacctcgccctcaccagtt

SEQ ID NO: 114402 - DNA, 22 bp, Artificial Sequence
  Synthetic oligonucleotide; TTG chr11 5389209 5389230 5389214 5389209 -
ataacctcgccctcaccagttt

SEQ ID NO: 114403 - DNA, 22 bp, Artificial Sequence
  Synthetic oligonucleotide; CTC chr11 5389201 5389222 5389206 5389201 -
gccctcaccagttttcctctgt

SEQ ID NO: 114404 - DNA, 22 bp, Artificial Sequence
  Synthetic oligonucleotide; CTC chr11 5389195 5389216 5389200 5389195 -
accagttttcctctgtatttca

SEQ ID NO: 114405 - DNA, 22 bp, Artificial Sequence
  Synthetic oligonucleotide; TTT chr11 5389187 5389208 5389192 5389187 -
tcctctgtatttcaattatttc

SEQ ID NO: 114406 - DNA, 22 bp, Artificial Sequence
  Synthetic oligonucleotide; TTT chr11 5389186 5389207 5389191 5389186 -
cctctgtatttcaattatttca

SEQ ID NO: 114407 - DNA, 22 bp, Artificial Sequence
  Synthetic oligonucleotide; TTC chr11 5389185 5389206 5389190 5389185 -
ctctgtatttcaattatttcag

SEQ ID NO: 114408 - DNA, 22 bp, Artificial Sequence
  Synthetic oligonucleotide; CTC chr11 5389182 5389203 5389187 5389182 -
tgtatttcaattatttcagttc

SEQ ID NO: 114409 - DNA, 22 bp, Artificial Sequence
  Synthetic oligonucleotide; CTG chr11 5389180 5389201 5389185 5389180 -
tatttcaattatttcagttcct

SEQ ID NO: 114410 - DNA, 22 bp, Artificial Sequence
  Synthetic oligonucleotide; TTT chr11 5389175 5389196 5389180 5389175 -
caattatttcagttcctctctg

SEQ ID NO: 114411 - DNA, 22 bp, Artificial Sequence
  Synthetic oligonucleotide; TTC chr11 5389174 5389195 5389179 5389174 -
aattatttcagttcctctctgc

SEQ ID NO: 114412 - DNA, 22 bp, Artificial Sequence
  Synthetic oligonucleotide; TTA chr11 5389169 5389190 5389174 5389169 -
tttcagttcctctctgcctctt

SEQ ID NO: 114413 - DNA, 22 bp, Artificial Sequence
  Synthetic oligonucleotide; TTT chr11 5389166 5389187 5389171 5389166 -
cagttcctctctgcctctttgc

SEQ ID NO: 114414 - DNA, 22 bp, Artificial Sequence
  Synthetic oligonucleotide; TTC chr11 5389165 5389186 5389170 5389165 -
agttcctctctgcctctttgct

SEQ ID NO: 114415 - DNA, 22 bp, Artificial Sequence
  Synthetic oligonucleotide; TTC chr11 5389160 5389181 5389165 5389160 -
ctctctgcctctttgctggtgt

SEQ ID NO: 114416 - DNA, 22 bp, Artificial Sequence
  Synthetic oligonucleotide; CTC chr11 5389157 5389178 5389162 5389157 -
tctgcctctttgctggtgtgcc

SEQ ID NO: 114417 - DNA, 22 bp, Artificial Sequence
  Synthetic oligonucleotide; CTC chr11 5389155 5389176 5389160 5389155 -
tgcctctttgctggtgtgcctt

SEQ ID NO: 114418 - DNA, 22 bp, Artificial Sequence
  Synthetic oligonucleotide; CTG chr11 5389153 5389174 5389158 5389153 -
cctctttgctggtgtgccttta

SEQ ID NO: 114419 - DNA, 22 bp, Artificial Sequence
  Synthetic oligonucleotide; CTC chr11 5389149 5389170 5389154 5389149 -
tttgctggtgtgcctttattgc

SEQ ID NO: 114420 - DNA, 22 bp, Artificial Sequence
  Synthetic oligonucleotide; CTT chr11 5389147 5389168 5389152 5389147 -
tgctggtgtgcctttattgctc

SEQ ID NO: 114421 - DNA, 22 bp, Artificial Sequence
  Synthetic oligonucleotide; TTT chr11 5389146 5389167 5389151 5389146 -
gctggtgtgcctttattgctca

SEQ ID NO: 114422 - DNA, 22 bp, Artificial Sequence
  Synthetic oligonucleotide; TTG chr11 5389145 5389166 5389150 5389145 -
ctggtgtgcctttattgctcaa

SEQ ID NO: 114423 - DNA, 22 bp, Artificial Sequence
  Synthetic oligonucleotide; CTG chr11 5389142 5389163 5389147 5389142 -
gtgtgcctttattgctcaaccc

SEQ ID NO: 114424 - DNA, 22 bp, Artificial Sequence
  Synthetic oligonucleotide; CTT chr11 5389133 5389154 5389138 5389133 -
tattgctcaacccttaagtata

SEQ ID NO: 114425 - DNA, 22 bp, Artificial Sequence
  Synthetic oligonucleotide; TTT chr11 5389132 5389153 5389137 5389132 -
attgctcaacccttaagtatag

SEQ ID NO: 114426 - DNA, 22 bp, Artificial Sequence
  Synthetic oligonucleotide; TTA chr11 5389131 5389152 5389136 5389131 -
ttgctcaacccttaagtatagt

SEQ ID NO: 114427 - DNA, 22 bp, Artificial Sequence
  Synthetic oligonucleotide; TTG chr11 5389128 5389149 5389133 5389128 -
ctcaacccttaagtatagttct

SEQ ID NO: 114428 - DNA, 22 bp, Artificial Sequence
  Synthetic oligonucleotide; CTC chr11 5389125 5389146 5389130 5389125 -
aacccttaagtatagttcttcc

SEQ ID NO: 114429 - DNA, 22 bp, Artificial Sequence
  Synthetic oligonucleotide; CTT chr11 5389118 5389139 5389123 5389118 -
aagtatagttcttcccatcctt

SEQ ID NO: 114430 - DNA, 22 bp, Artificial Sequence
  Synthetic oligonucleotide; TTA chr11 5389117 5389138 5389122 5389117 -
agtatagttcttcccatccttg

SEQ ID NO: 114431 - DNA, 22 bp, Artificial Sequence
  Synthetic oligonucleotide; TTC chr11 5389107 5389128 5389112 5389107 -
ttcccatccttggcaatttcct

SEQ ID NO: 114432 - DNA, 22 bp, Artificial Sequence
  Synthetic oligonucleotide; CTT chr11 5389105 5389126 5389110 5389105 -
cccatccttggcaatttcctgg

SEQ ID NO: 114433 - DNA, 22 bp, Artificial Sequence
  Synthetic oligonucleotide; TTC chr11 5389104 5389125 5389109 5389104 -
ccatccttggcaatttcctggc

SEQ ID NO: 114434 - DNA, 22 bp, Artificial Sequence
  Synthetic oligonucleotide; CTT chr11 5389096 5389117 5389101 5389096 -
ggcaatttcctggccatattct

SEQ ID NO: 114435 - DNA, 22 bp, Artificial Sequence
  Synthetic oligonucleotide; TTG chr11 5389095 5389116 5389100 5389095 -
gcaatttcctggccatattcta

SEQ ID NO: 114436 - DNA, 22 bp, Artificial Sequence
  Synthetic oligonucleotide; TTT chr11 5389088 5389109 5389093 5389088 -
cctggccatattctattatttc

SEQ ID NO: 114437 - DNA, 22 bp, Artificial Sequence
  Synthetic oligonucleotide; TTC chr11 5389087 5389108 5389092 5389087 -
ctggccatattctattatttct

SEQ ID NO: 114438 - DNA, 22 bp, Artificial Sequence
  Synthetic oligonucleotide; CTG chr11 5389084 5389105 5389089 5389084 -
gccatattctattatttcttct

SEQ ID NO: 114439 - DNA, 22 bp, Artificial Sequence
  Synthetic oligonucleotide; TTC chr11 5389075 5389096 5389080 5389075 -
tattatttcttcttaatgtcat

SEQ ID NO: 114440 - DNA, 22 bp, Artificial Sequence
  Synthetic oligonucleotide; CTA chr11 5389073 5389094 5389078 5389073 -
ttatttcttcttaatgtcatcc

SEQ ID NO: 114441 - DNA, 22 bp, Artificial Sequence
  Synthetic oligonucleotide; TTA chr11 5389070 5389091 5389075 5389070 -
tttcttcttaatgtcatccact

SEQ ID NO: 114442 - DNA, 22 bp, Artificial Sequence
  Synthetic oligonucleotide; TTT chr11 5389067 5389088 5389072 5389067 -
cttcttaatgtcatccactacc

SEQ ID NO: 114443 - DNA, 22 bp, Artificial Sequence
  Synthetic oligonucleotide; TTC chr11 5389066 5389087 5389071 5389066 -
ttcttaatgtcatccactacca

SEQ ID NO: 114444 - DNA, 22 bp, Artificial Sequence
  Synthetic oligonucleotide; CTT chr11 5389064 5389085 5389069 5389064 -
cttaatgtcatccactaccatg

SEQ ID NO: 114445 - DNA, 22 bp, Artificial Sequence
  Synthetic oligonucleotide; TTC chr11 5389063 5389084 5389068 5389063 -
ttaatgtcatccactaccatga

SEQ ID NO: 114446 - DNA, 22 bp, Artificial Sequence
  Synthetic oligonucleotide; CTT chr11 5389061 5389082 5389066 5389061 -
aatgtcatccactaccatgatt

SEQ ID NO: 114447 - DNA, 22 bp, Artificial Sequence
  Synthetic oligonucleotide; TTA chr11 5389060 5389081 5389065 5389060 -
atgtcatccactaccatgattt

SEQ ID NO: 114448 - DNA, 22 bp, Artificial Sequence
  Synthetic oligonucleotide; CTA chr11 5389047 5389068 5389052 5389047 -
ccatgatttcatttaccatcca

SEQ ID NO: 114449 - DNA, 22 bp, Artificial Sequence
  Synthetic oligonucleotide; TTT chr11 5389038 5389059 5389043 5389038 -
catttaccatccatatattgat

SEQ ID NO: 114450 - DNA, 22 bp, Artificial Sequence
  Synthetic oligonucleotide; TTC chr11 5389037 5389058 5389042 5389037 -
atttaccatccatatattgata

SEQ ID NO: 114451 - DNA, 22 bp, Artificial Sequence
  Synthetic oligonucleotide; TTT chr11 5389033 5389054 5389038 5389033 -
accatccatatattgataaata

SEQ ID NO: 114452 - DNA, 22 bp, Artificial Sequence
  Synthetic oligonucleotide; TTA chr11 5389032 5389053 5389037 5389032 -
ccatccatatattgataaataa

SEQ ID NO: 114453 - DNA, 22 bp, Artificial Sequence
  Synthetic oligonucleotide; TTG chr11 5389018 5389039 5389023 5389018 -
ataaataacaaatatataattc

SEQ ID NO: 114454 - DNA, 22 bp, Artificial Sequence
  Synthetic oligonucleotide; TTC chr11 5388996 5389017 5389001 5388996 -
cagaacttgtctttctctcttt

SEQ ID NO: 114455 - DNA, 22 bp, Artificial Sequence
  Synthetic oligonucleotide; CTT chr11 5388988 5389009 5388993 5388988 -
gtctttctctcttttgatttcc

SEQ ID NO: 114456 - DNA, 22 bp, Artificial Sequence
  Synthetic oligonucleotide; TTG chr11 5388987 5389008 5388992 5388987 -
tctttctctcttttgatttcca

SEQ ID NO: 114457 - DNA, 22 bp, Artificial Sequence
  Synthetic oligonucleotide; CTT chr11 5388983 5389004 5388988 5388983 -
tctctcttttgatttccagact

SEQ ID NO: 114458 - DNA, 22 bp, Artificial Sequence
  Synthetic oligonucleotide; TTT chr11 5388982 5389003 5388987 5388982 -
ctctcttttgatttccagactc

SEQ ID NO: 114459 - DNA, 22 bp, Artificial Sequence
  Synthetic oligonucleotide; TTC chr11 5388981 5389002 5388986 5388981 -
tctcttttgatttccagactct

SEQ ID NO: 114460 - DNA, 22 bp, Artificial Sequence
  Synthetic oligonucleotide; CTC chr11 5388979 5389000 5388984 5388979 -
tcttttgatttccagactctag

SEQ ID NO: 114461 - DNA, 22 bp, Artificial Sequence
  Synthetic oligonucleotide; CTC chr11 5388977 5388998 5388982 5388977 -
ttttgatttccagactctagca

SEQ ID NO: 114462 - DNA, 22 bp, Artificial Sequence
  Synthetic oligonucleotide; CTT chr11 5388975 5388996 5388980 5388975 -
ttgatttccagactctagcaac

SEQ ID NO: 114463 - DNA, 22 bp, Artificial Sequence
  Synthetic oligonucleotide; TTT chr11 5388974 5388995 5388979 5388974 -
tgatttccagactctagcaaca

SEQ ID NO: 114464 - DNA, 22 bp, Artificial Sequence
  Synthetic oligonucleotide; TTT chr11 5388973 5388994 5388978 5388973 -
gatttccagactctagcaacat

SEQ ID NO: 114465 - DNA, 22 bp, Artificial Sequence
  Synthetic oligonucleotide; TTG chr11 5388972 5388993 5388977 5388972 -
atttccagactctagcaacatc

SEQ ID NO: 114466 - DNA, 22 bp, Artificial Sequence
  Synthetic oligonucleotide; TTT chr11 5388968 5388989 5388973 5388968 -
ccagactctagcaacatctgta

SEQ ID NO: 114467 - DNA, 22 bp, Artificial Sequence
  Synthetic oligonucleotide; TTC chr11 5388967 5388988 5388972 5388967 -
cagactctagcaacatctgtac

SEQ ID NO: 114468 - DNA, 22 bp, Artificial Sequence
  Synthetic oligonucleotide; CTC chr11 5388960 5388981 5388965 5388960 -
tagcaacatctgtacttttcat

SEQ ID NO: 114469 - DNA, 22 bp, Artificial Sequence
  Synthetic oligonucleotide; CTA chr11 5388958 5388979 5388963 5388958 -
gcaacatctgtacttttcatta

SEQ ID NO: 114470 - DNA, 22 bp, Artificial Sequence
  Synthetic oligonucleotide; CTG chr11 5388948 5388969 5388953 5388948 -
tacttttcattatctcagtggc

SEQ ID NO: 114471 - DNA, 22 bp, Artificial Sequence
  Synthetic oligonucleotide; CTT chr11 5388943 5388964 5388948 5388943 -
ttcattatctcagtggctcaag

SEQ ID NO: 114472 - DNA, 22 bp, Artificial Sequence
  Synthetic oligonucleotide; TTT chr11 5388942 5388963 5388947 5388942 -
tcattatctcagtggctcaagt

SEQ ID NO: 114473 - DNA, 22 bp, Artificial Sequence
  Synthetic oligonucleotide; TTT chr11 5388941 5388962 5388946 5388941 -
cattatctcagtggctcaagtc

SEQ ID NO: 114474 - DNA, 22 bp, Artificial Sequence
  Synthetic oligonucleotide; TTC chr11 5388940 5388961 5388945 5388940 -
attatctcagtggctcaagtca

SEQ ID NO: 114475 - DNA, 22 bp, Artificial Sequence
  Synthetic oligonucleotide; TTA chr11 5388936 5388957 5388941 5388936 -
tctcagtggctcaagtcaaatg

SEQ ID NO: 114476 - DNA, 22 bp, Artificial Sequence
  Synthetic oligonucleotide; CTC chr11 5388932 5388953 5388937 5388932 -
agtggctcaagtcaaatgtcat

SEQ ID NO: 114477 - DNA, 22 bp, Artificial Sequence
  Synthetic oligonucleotide; CTC chr11 5388924 5388945 5388929 5388924 -
aagtcaaatgtcatgttttatg

SEQ ID NO: 114478 - DNA, 22 bp, Artificial Sequence
  Synthetic oligonucleotide; TTT chr11 5388906 5388927 5388911 5388906 -
tatgttagacttctccatatca

SEQ ID NO: 114479 - DNA, 22 bp, Artificial Sequence
  Synthetic oligonucleotide; TTT chr11 5388905 5388926 5388910 5388905 -
atgttagacttctccatatcac

SEQ ID NO: 114480 - DNA, 22 bp, Artificial Sequence
  Synthetic oligonucleotide; TTA chr11 5388904 5388925 5388909 5388904 -
tgttagacttctccatatcaca

SEQ ID NO: 114481 - DNA, 22 bp, Artificial Sequence
  Synthetic oligonucleotide; TTA chr11 5388899 5388920 5388904 5388899 -
gacttctccatatcacatctct

SEQ ID NO: 114482 - DNA, 22 bp, Artificial Sequence
  Synthetic oligonucleotide; CTT chr11 5388894 5388915 5388899 5388894 -
ctccatatcacatctctccata

SEQ ID NO: 114483 - DNA, 22 bp, Artificial Sequence
  Synthetic oligonucleotide; TTC chr11 5388893 5388914 5388898 5388893 -
tccatatcacatctctccatag

SEQ ID NO: 114484 - DNA, 22 bp, Artificial Sequence
  Synthetic oligonucleotide; CTC chr11 5388891 5388912 5388896 5388891 -
catatcacatctctccatagta

SEQ ID NO: 114485 - DNA, 22 bp, Artificial Sequence
  Synthetic oligonucleotide; CTC chr11 5388878 5388899 5388883 5388878 -
tccatagtatctaatcaaccaa

SEQ ID NO: 114486 - DNA, 22 bp, Artificial Sequence
  Synthetic oligonucleotide; CTC chr11 5388876 5388897 5388881 5388876 -
catagtatctaatcaaccaatc

SEQ ID NO: 114487 - DNA, 22 bp, Artificial Sequence
  Synthetic oligonucleotide; CTA chr11 5388865 5388886 5388870 5388865 -
atcaaccaatcaccaagtccta

SEQ ID NO: 114488 - DNA, 22 bp, Artificial Sequence
  Synthetic oligonucleotide; CTA chr11 5388843 5388864 5388848 5388843 -
gggtttctgtttactgaatacc

SEQ ID NO: 114489 - DNA, 22 bp, Artificial Sequence
  Synthetic oligonucleotide; TTT chr11 5388837 5388858 5388842 5388837 -
ctgtttactgaatacctcaagt

SEQ ID NO: 114490 - DNA, 22 bp, Artificial Sequence
  Synthetic oligonucleotide; TTC chr11 5388836 5388857 5388841 5388836 -
tgtttactgaatacctcaagtc

SEQ ID NO: 114491 - DNA, 22 bp, Artificial Sequence
  Synthetic oligonucleotide; CTG chr11 5388834 5388855 5388839 5388834 -
tttactgaatacctcaagtctg

SEQ ID NO: 114492 - DNA, 22 bp, Artificial Sequence
  Synthetic oligonucleotide; TTT chr11 5388831 5388852 5388836 5388831 -
actgaatacctcaagtctgttt

SEQ ID NO: 114493 - DNA, 22 bp, Artificial Sequence
  Synthetic oligonucleotide; TTA chr11 5388830 5388851 5388835 5388830 -
ctgaatacctcaagtctgttta

SEQ ID NO: 114494 - DNA, 22 bp, Artificial Sequence
  Synthetic oligonucleotide; CTG chr11 5388827 5388848 5388832 5388827 -
aatacctcaagtctgtttactc

SEQ ID NO: 114495 - DNA, 22 bp, Artificial Sequence
  Synthetic oligonucleotide; CTC chr11 5388819 5388840 5388824 5388819 -
aagtctgtttactcaccgtcac

SEQ ID NO: 114496 - DNA, 22 bp, Artificial Sequence
  Synthetic oligonucleotide; CTG chr11 5388812 5388833 5388817 5388812 -
tttactcaccgtcaccttcatt

SEQ ID NO: 114497 - DNA, 22 bp, Artificial Sequence
  Synthetic oligonucleotide; TTT chr11 5388809 5388830 5388814 5388809 -
actcaccgtcaccttcattgat

SEQ ID NO: 114498 - DNA, 22 bp, Artificial Sequence
  Synthetic oligonucleotide; TTA chr11 5388808 5388829 5388813 5388808 -
ctcaccgtcaccttcattgatg

SEQ ID NO: 114499 - DNA, 22 bp, Artificial Sequence
  Synthetic oligonucleotide; CTC chr11 5388805 5388826 5388810 5388805 -
accgtcaccttcattgatgcta

SEQ ID NO: 114500 - DNA, 22 bp, Artificial Sequence
  Synthetic oligonucleotide; CTT chr11 5388794 5388815 5388799 5388794 -
cattgatgctattctaattcag

SEQ ID NO: 114501 - DNA, 22 bp, Artificial Sequence
  Synthetic oligonucleotide; TTC chr11 5388793 5388814 5388798 5388793 -
attgatgctattctaattcaga

SEQ ID NO: 114502 - DNA, 22 bp, Artificial Sequence
  Synthetic oligonucleotide; TTG chr11 5388789 5388810 5388794 5388789 -
atgctattctaattcagatcac

SEQ ID NO: 114503 - DNA, 22 bp, Artificial Sequence
  Synthetic oligonucleotide; CTA chr11 5388783 5388804 5388788 5388783 -
ttctaattcagatcactctttc

SEQ ID NO: 114504 - DNA, 22 bp, Artificial Sequence
  Synthetic oligonucleotide; TTC chr11 5388780 5388801 5388785 5388780 -
taattcagatcactctttcagg

SEQ ID NO: 114505 - DNA, 22 bp, Artificial Sequence
  Synthetic oligonucleotide; CTA chr11 5388778 5388799 5388783 5388778 -
attcagatcactctttcaggac

SEQ ID NO: 114506 - DNA, 22 bp, Artificial Sequence
  Synthetic oligonucleotide; TTC chr11 5388774 5388795 5388779 5388774 -
agatcactctttcaggactatt

SEQ ID NO: 114507 - DNA, 22 bp, Artificial Sequence
  Synthetic oligonucleotide; CTC chr11 5388765 5388786 5388770 5388765 -
tttcaggactattccagtgact

SEQ ID NO: 114508 - DNA, 22 bp, Artificial Sequence
  Synthetic oligonucleotide; CTT chr11 5388763 5388784 5388768 5388763 -
tcaggactattccagtgactca

SEQ ID NO: 114509 - DNA, 22 bp, Artificial Sequence
  Synthetic oligonucleotide; TTT chr11 5388762 5388783 5388767 5388762 -
caggactattccagtgactcat

SEQ ID NO: 114510 - DNA, 22 bp, Artificial Sequence
  Synthetic oligonucleotide; TTC chr11 5388761 5388782 5388766 5388761 -
aggactattccagtgactcatc

SEQ ID NO: 114511 - DNA, 22 bp, Artificial Sequence
  Synthetic oligonucleotide; CTA chr11 5388754 5388775 5388759 5388754 -
ttccagtgactcatcttttgta

SEQ ID NO: 114512 - DNA, 22 bp, Artificial Sequence
  Synthetic oligonucleotide; TTC chr11 5388751 5388772 5388756 5388751 -
cagtgactcatcttttgtacta

SEQ ID NO: 114513 - DNA, 22 bp, Artificial Sequence
  Synthetic oligonucleotide; CTC chr11 5388742 5388763 5388747 5388742 -
atcttttgtactactgtattca

SEQ ID NO: 114514 - DNA, 22 bp, Artificial Sequence
  Synthetic oligonucleotide; CTT chr11 5388737 5388758 5388742 5388737 -
ttgtactactgtattcagttga

SEQ ID NO: 114515 - DNA, 22 bp, Artificial Sequence
  Synthetic oligonucleotide; TTT chr11 5388736 5388757 5388741 5388736 -
tgtactactgtattcagttgac

SEQ ID NO: 114516 - DNA, 22 bp, Artificial Sequence
  Synthetic oligonucleotide; TTT chr11 5388735 5388756 5388740 5388735 -
gtactactgtattcagttgact

SEQ ID NO: 114517 - DNA, 22 bp, Artificial Sequence
  Synthetic oligonucleotide; TTG chr11 5388734 5388755 5388739 5388734 -
tactactgtattcagttgacta

SEQ ID NO: 114518 - DNA, 22 bp, Artificial Sequence
  Synthetic oligonucleotide; CTA chr11 5388729 5388750 5388734 5388729 -
ctgtattcagttgactactata

SEQ ID NO: 114519 - DNA, 22 bp, Artificial Sequence
  Synthetic oligonucleotide; CTG chr11 5388726 5388747 5388731 5388726 -
tattcagttgactactatatag

SEQ ID NO: 114520 - DNA, 22 bp, Artificial Sequence
  Synthetic oligonucleotide; TTC chr11 5388721 5388742 5388726 5388721 -
agttgactactatatagcaaga

SEQ ID NO: 114521 - DNA, 22 bp, Artificial Sequence
  Synthetic oligonucleotide; TTG chr11 5388716 5388737 5388721 5388716 -
actactatatagcaagagagac

SEQ ID NO: 114522 - DNA, 22 bp, Artificial Sequence
  Synthetic oligonucleotide; CTA chr11 5388712 5388733 5388717 5388712 -
ctatatagcaagagagacgtat

SEQ ID NO: 114523 - DNA, 22 bp, Artificial Sequence
  Synthetic oligonucleotide; CTA chr11 5388709 5388730 5388714 5388709 -
tatagcaagagagacgtataca

SEQ ID NO: 114524 - DNA, 22 bp, Artificial Sequence
  Synthetic oligonucleotide; TTT chr11 5388676 5388697 5388681 5388676 -
ttaatgaagtaaaaaaggttta

SEQ ID NO: 114525 - DNA, 22 bp, Artificial Sequence
  Synthetic oligonucleotide; TTT chr11 5388675 5388696 5388680 5388675 -
taatgaagtaaaaaaggtttaa

SEQ ID NO: 114526 - DNA, 22 bp, Artificial Sequence
  Synthetic oligonucleotide; TTT chr11 5388674 5388695 5388679 5388674 -
aatgaagtaaaaaaggtttaaa

SEQ ID NO: 114527 - DNA, 22 bp, Artificial Sequence
  Synthetic oligonucleotide; TTA chr11 5388673 5388694 5388678 5388673 -
atgaagtaaaaaaggtttaaaa

SEQ ID NO: 114528 - DNA, 22 bp, Artificial Sequence
  Synthetic oligonucleotide; TTT chr11 5388655 5388676 5388660 5388655 -
aaaatgacattcaagaccctac

SEQ ID NO: 114529 - DNA, 22 bp, Artificial Sequence
  Synthetic oligonucleotide; TTA chr11 5388654 5388675 5388659 5388654 -
aaatgacattcaagaccctacc

SEQ ID NO: 114530 - DNA, 22 bp, Artificial Sequence
  Synthetic oligonucleotide; TTC chr11 5388643 5388664 5388648 5388643 -
aagaccctaccttattttctct

SEQ ID NO: 114531 - DNA, 22 bp, Artificial Sequence
  Synthetic oligonucleotide; CTA chr11 5388634 5388655 5388639 5388634 -
ccttattttctctccgtgtata

SEQ ID NO: 114532 - DNA, 22 bp, Artificial Sequence
  Synthetic oligonucleotide; CTT chr11 5388630 5388651 5388635 5388630 -
attttctctccgtgtatatcct

SEQ ID NO: 114533 - DNA, 22 bp, Artificial Sequence
  Synthetic oligonucleotide; TTA chr11 5388629 5388650 5388634 5388629 -
ttttctctccgtgtatatccta

SEQ ID NO: 114534 - DNA, 22 bp, Artificial Sequence
  Synthetic oligonucleotide; TTT chr11 5388626 5388647 5388631 5388626 -
tctctccgtgtatatcctattt

SEQ ID NO: 114535 - DNA, 22 bp, Artificial Sequence
  Synthetic oligonucleotide; TTT chr11 5388625 5388646 5388630 5388625 -
ctctccgtgtatatcctatttt

SEQ ID NO: 114536 - DNA, 22 bp, Artificial Sequence
  Synthetic oligonucleotide; TTC chr11 5388624 5388645 5388629 5388624 -
tctccgtgtatatcctattttc

SEQ ID NO: 114537 - DNA, 22 bp, Artificial Sequence
  Synthetic oligonucleotide; CTC chr11 5388622 5388643 5388627 5388622 -
tccgtgtatatcctattttctt

SEQ ID NO: 114538 - DNA, 22 bp, Artificial Sequence
  Synthetic oligonucleotide; CTC chr11 5388620 5388641 5388625 5388620 -
cgtgtatatcctattttcttat

SEQ ID NO: 114539 - DNA, 22 bp, Artificial Sequence
  Synthetic oligonucleotide; CTA chr11 5388607 5388628 5388612 5388607 -
ttttcttatctatcctaatttc

SEQ ID NO: 114540 - DNA, 22 bp, Artificial Sequence
  Synthetic oligonucleotide; TTT chr11 5388604 5388625 5388609 5388604 -
tcttatctatcctaatttcctc

SEQ ID NO: 114541 - DNA, 22 bp, Artificial Sequence
  Synthetic oligonucleotide; TTT chr11 5388603 5388624 5388608 5388603 -
cttatctatcctaatttcctct

SEQ ID NO: 114542 - DNA, 22 bp, Artificial Sequence
  Synthetic oligonucleotide; TTC chr11 5388602 5388623 5388607 5388602 -
ttatctatcctaatttcctctg

SEQ ID NO: 114543 - DNA, 22 bp, Artificial Sequence
  Synthetic oligonucleotide; CTT chr11 5388600 5388621 5388605 5388600 -
atctatcctaatttcctctgta

SEQ ID NO: 114544 - DNA, 22 bp, Artificial Sequence
  Synthetic oligonucleotide; TTA chr11 5388599 5388620 5388604 5388599 -
tctatcctaatttcctctgtat

SEQ ID NO: 114545 - DNA, 22 bp, Artificial Sequence
  Synthetic oligonucleotide; CTA chr11 5388595 5388616 5388600 5388595 -
tcctaatttcctctgtatattc

SEQ ID NO: 114546 - DNA, 22 bp, Artificial Sequence
  Synthetic oligonucleotide; CTA chr11 5388590 5388611 5388595 5388590 -
atttcctctgtatattcacggt

SEQ ID NO: 114547 - DNA, 22 bp, Artificial Sequence
  Synthetic oligonucleotide; TTT chr11 5388586 5388607 5388591 5388586 -
cctctgtatattcacggtgtta

SEQ ID NO: 114548 - DNA, 22 bp, Artificial Sequence
  Synthetic oligonucleotide; TTC chr11 5388585 5388606 5388590 5388585 -
ctctgtatattcacggtgttaa

SEQ ID NO: 114549 - DNA, 22 bp, Artificial Sequence
  Synthetic oligonucleotide; CTC chr11 5388582 5388603 5388587 5388582 -
tgtatattcacggtgttaatga

SEQ ID NO: 114550 - DNA, 22 bp, Artificial Sequence
  Synthetic oligonucleotide; CTG chr11 5388580 5388601 5388585 5388580 -
tatattcacggtgttaatgaca

SEQ ID NO: 114551 - DNA, 22 bp, Artificial Sequence
  Synthetic oligonucleotide; TTC chr11 5388573 5388594 5388578 5388573 -
acggtgttaatgacactaaaca

SEQ ID NO: 114552 - DNA, 22 bp, Artificial Sequence
  Synthetic oligonucleotide; TTA chr11 5388564 5388585 5388569 5388564 -
atgacactaaacaattcttcca

SEQ ID NO: 114553 - DNA, 22 bp, Artificial Sequence
  Synthetic oligonucleotide; CTA chr11 5388555 5388576 5388560 5388555 -
aacaattcttccagtttatcta

SEQ ID NO: 114554 - DNA, 22 bp, Artificial Sequence
  Synthetic oligonucleotide; TTC chr11 5388547 5388568 5388552 5388547 -
ttccagtttatctagtatgctt

SEQ ID NO: 114555 - DNA, 22 bp, Artificial Sequence
  Synthetic oligonucleotide; CTT chr11 5388545 5388566 5388550 5388545 -
ccagtttatctagtatgcttgc

SEQ ID NO: 114556 - DNA, 22 bp, Artificial Sequence
  Synthetic oligonucleotide; TTC chr11 5388544 5388565 5388549 5388544 -
cagtttatctagtatgcttgct

SEQ ID NO: 114557 - DNA, 22 bp, Artificial Sequence
  Synthetic oligonucleotide; TTT chr11 5388538 5388559 5388543 5388538 -
atctagtatgcttgctcatagg

SEQ ID NO: 114558 - DNA, 22 bp, Artificial Sequence
  Synthetic oligonucleotide; TTA chr11 5388537 5388558 5388542 5388537 -
tctagtatgcttgctcataggt

SEQ ID NO: 114559 - DNA, 22 bp, Artificial Sequence
  Synthetic oligonucleotide; CTA chr11 5388533 5388554 5388538 5388533 -
gtatgcttgctcataggtaaac

SEQ ID NO: 114560 - DNA, 22 bp, Artificial Sequence
  Synthetic oligonucleotide; CTT chr11 5388525 5388546 5388530 5388525 -
gctcataggtaaacatttgtat

SEQ ID NO: 114561 - DNA, 22 bp, Artificial Sequence
  Synthetic oligonucleotide; TTG chr11 5388524 5388545 5388529 5388524 -
ctcataggtaaacatttgtatt

SEQ ID NO: 114562 - DNA, 22 bp, Artificial Sequence
  Synthetic oligonucleotide; CTC chr11 5388521 5388542 5388526 5388521 -
ataggtaaacatttgtattttc

SEQ ID NO: 114563 - DNA, 22 bp, Artificial Sequence
  Synthetic oligonucleotide; TTT chr11 5388507 5388528 5388512 5388507 -
gtattttcattcttcctggaat

SEQ ID NO: 114564 - DNA, 22 bp, Artificial Sequence
  Synthetic oligonucleotide; TTG chr11 5388506 5388527 5388511 5388506 -
tattttcattcttcctggaata

SEQ ID NO: 114565 - DNA, 22 bp, Artificial Sequence
  Synthetic oligonucleotide; TTT chr11 5388501 5388522 5388506 5388501 -
tcattcttcctggaataaaaac

SEQ ID NO: 114566 - DNA, 22 bp, Artificial Sequence
  Synthetic oligonucleotide; TTT chr11 5388500 5388521 5388505 5388500 -
cattcttcctggaataaaaaca

SEQ ID NO: 114567 - DNA, 22 bp, Artificial Sequence
  Synthetic oligonucleotide; TTC chr11 5388499 5388520 5388504 5388499 -
attcttcctggaataaaaacat

SEQ ID NO: 114568 - DNA, 22 bp, Artificial Sequence
  Synthetic oligonucleotide; TTC chr11 5388495 5388516 5388500 5388495 -
ttcctggaataaaaacattttt

SEQ ID NO: 114569 - DNA, 22 bp, Artificial Sequence
  Synthetic oligonucleotide; CTT chr11 5388493 5388514 5388498 5388493 -
cctggaataaaaacattttttc

SEQ ID NO: 114570 - DNA, 22 bp, Artificial Sequence
  Synthetic oligonucleotide; TTC chr11 5388492 5388513 5388497 5388492 -
ctggaataaaaacattttttcc

SEQ ID NO: 114571 - DNA, 22 bp, Artificial Sequence
  Synthetic oligonucleotide; CTG chr11 5388489 5388510 5388494 5388489 -
gaataaaaacattttttcctga

SEQ ID NO: 114572 - DNA, 22 bp, Artificial Sequence
  Synthetic oligonucleotide; TTT chr11 5388475 5388496 5388480 5388475 -
tttcctgaaatagctttccctt

SEQ ID NO: 114573 - DNA, 22 bp, Artificial Sequence
  Synthetic oligonucleotide; TTT chr11 5388474 5388495 5388479 5388474 -
ttcctgaaatagctttccctta

SEQ ID NO: 114574 - DNA, 22 bp, Artificial Sequence
  Synthetic oligonucleotide; TTT chr11 5388473 5388494 5388478 5388473 -
tcctgaaatagctttcccttaa

SEQ ID NO: 114575 - DNA, 22 bp, Artificial Sequence
  Synthetic oligonucleotide; TTT chr11 5388472 5388493 5388477 5388472 -
cctgaaatagctttcccttaat

SEQ ID NO: 114576 - DNA, 22 bp, Artificial Sequence
  Synthetic oligonucleotide; TTC chr11 5388471 5388492 5388476 5388471 -
ctgaaatagctttcccttaatc

SEQ ID NO: 114577 - DNA, 22 bp, Artificial Sequence
  Synthetic oligonucleotide; CTG chr11 5388468 5388489 5388473 5388468 -
aaatagctttcccttaatcttt

SEQ ID NO: 114578 - DNA, 22 bp, Artificial Sequence
  Synthetic oligonucleotide; CTT chr11 5388459 5388480 5388464 5388459 -
tcccttaatctttgtctagtta

SEQ ID NO: 114579 - DNA, 22 bp, Artificial Sequence
  Synthetic oligonucleotide; TTT chr11 5388458 5388479 5388463 5388458 -
cccttaatctttgtctagttaa

SEQ ID NO: 114580 - DNA, 22 bp, Artificial Sequence
  Synthetic oligonucleotide; TTC chr11 5388457 5388478 5388462 5388457 -
ccttaatctttgtctagttaac

SEQ ID NO: 114581 - DNA, 22 bp, Artificial Sequence
  Synthetic oligonucleotide; CTT chr11 5388453 5388474 5388458 5388453 -
aatctttgtctagttaacttct

SEQ ID NO: 114582 - DNA, 22 bp, Artificial Sequence
  Synthetic oligonucleotide; TTA chr11 5388452 5388473 5388457 5388452 -
atctttgtctagttaacttcta

SEQ ID NO: 114583 - DNA, 22 bp, Artificial Sequence
  Synthetic oligonucleotide; CTT chr11 5388447 5388468 5388452 5388447 -
tgtctagttaacttctactaat

SEQ ID NO: 114584 - DNA, 22 bp, Artificial Sequence
  Synthetic oligonucleotide; TTT chr11 5388446 5388467 5388451 5388446 -
gtctagttaacttctactaata

SEQ ID NO: 114585 - DNA, 22 bp, Artificial Sequence
  Synthetic oligonucleotide; TTG chr11 5388445 5388466 5388450 5388445 -
tctagttaacttctactaatat

SEQ ID NO: 114586 - DNA, 22 bp, Artificial Sequence
  Synthetic oligonucleotide; CTA chr11 5388441 5388462 5388446 5388441 -
gttaacttctactaatataacc

SEQ ID NO: 114587 - DNA, 22 bp, Artificial Sequence
  Synthetic oligonucleotide; TTA chr11 5388437 5388458 5388442 5388437 -
acttctactaatataacccacc

SEQ ID NO: 114588 - DNA, 22 bp, Artificial Sequence
  Synthetic oligonucleotide; CTT chr11 5388433 5388454 5388438 5388433 -
ctactaatataacccaccttag

SEQ ID NO: 114589 - DNA, 22 bp, Artificial Sequence
  Synthetic oligonucleotide; TTC chr11 5388432 5388453 5388437 5388432 -
tactaatataacccaccttagc

SEQ ID NO: 114590 - DNA, 22 bp, Artificial Sequence
  Synthetic oligonucleotide; CTA chr11 5388430 5388451 5388435 5388430 -
ctaatataacccaccttagctt

SEQ ID NO: 114591 - DNA, 22 bp, Artificial Sequence
  Synthetic oligonucleotide; CTA chr11 5388427 5388448 5388432 5388427 -
atataacccaccttagcttaga

SEQ ID NO: 114592 - DNA, 22 bp, Artificial Sequence
  Synthetic oligonucleotide; CTT chr11 5388413 5388434 5388418 5388413 -
agcttagatatgatgtccttca

SEQ ID NO: 114593 - DNA, 22 bp, Artificial Sequence
  Synthetic oligonucleotide; TTA chr11 5388412 5388433 5388417 5388412 -
gcttagatatgatgtccttcag

SEQ ID NO: 114594 - DNA, 22 bp, Artificial Sequence
  Synthetic oligonucleotide; CTT chr11 5388408 5388429 5388413 5388408 -
agatatgatgtccttcagaagg

SEQ ID NO: 114595 - DNA, 22 bp, Artificial Sequence
  Synthetic oligonucleotide; TTA chr11 5388407 5388428 5388412 5388407 -
gatatgatgtccttcagaaggc

SEQ ID NO: 114596 - DNA, 22 bp, Artificial Sequence
  Synthetic oligonucleotide; CTT chr11 5388393 5388414 5388398 5388393 -
cagaaggccttcttaaattccc

SEQ ID NO: 114597 - DNA, 22 bp, Artificial Sequence
  Synthetic oligonucleotide; TTC chr11 5388392 5388413 5388397 5388392 -
agaaggccttcttaaattcccc

SEQ ID NO: 114598 - DNA, 22 bp, Artificial Sequence
  Synthetic oligonucleotide; CTT chr11 5388382 5388403 5388387 5388382 -
cttaaattccccaagtttagtt

SEQ ID NO: 114599 - DNA, 22 bp, Artificial Sequence
  Synthetic oligonucleotide; TTC chr11 5388381 5388402 5388386 5388381 -
ttaaattccccaagtttagttt

SEQ ID NO: 114600 - DNA, 22 bp, Artificial Sequence
  Synthetic oligonucleotide; CTT chr11 5388379 5388400 5388384 5388379 -
aaattccccaagtttagtttga

SEQ ID NO: 114601 - DNA, 22 bp, Artificial Sequence
  Synthetic oligonucleotide; TTA chr11 5388378 5388399 5388383 5388378 -
aattccccaagtttagtttgaa

SEQ ID NO: 114602 - DNA, 22 bp, Artificial Sequence
  Synthetic oligonucleotide; TTC chr11 5388373 5388394 5388378 5388373 -
cccaagtttagtttgaataccc

SEQ ID NO: 114603 - DNA, 22 bp, Artificial Sequence
  Synthetic oligonucleotide; TTT chr11 5388364 5388385 5388369 5388364 -
agtttgaataccctctcctatg

SEQ ID NO: 114604 - DNA, 22 bp, Artificial Sequence
  Synthetic oligonucleotide; TTA chr11 5388363 5388384 5388368 5388363 -
gtttgaataccctctcctatgt

SEQ ID NO: 114605 - DNA, 22 bp, Artificial Sequence
  Synthetic oligonucleotide; TTT chr11 5388359 5388380 5388364 5388359 -
gaataccctctcctatgtgttc

SEQ ID NO: 114606 - DNA, 22 bp, Artificial Sequence
  Synthetic oligonucleotide; TTG chr11 5388358 5388379 5388363 5388358 -
aataccctctcctatgtgttcc

SEQ ID NO: 114607 - DNA, 22 bp, Artificial Sequence
  Synthetic oligonucleotide; CTC chr11 5388349 5388370 5388354 5388349 -
tcctatgtgttcctgtagttca

SEQ ID NO: 114608 - DNA, 22 bp, Artificial Sequence
  Synthetic oligonucleotide; CTC chr11 5388347 5388368 5388352 5388347 -
ctatgtgttcctgtagttcact

SEQ ID NO: 114609 - DNA, 22 bp, Artificial Sequence
  Synthetic oligonucleotide; CTA chr11 5388344 5388365 5388349 5388344 -
tgtgttcctgtagttcactatg

SEQ ID NO: 114610 - DNA, 22 bp, Artificial Sequence
  Synthetic oligonucleotide; TTC chr11 5388337 5388358 5388342 5388337 -
ctgtagttcactatgcactaat

SEQ ID NO: 114611 - DNA, 22 bp, Artificial Sequence
  Synthetic oligonucleotide; CTG chr11 5388334 5388355 5388339 5388334 -
tagttcactatgcactaattac

SEQ ID NO: 114612 - DNA, 22 bp, Artificial Sequence
  Synthetic oligonucleotide; TTC chr11 5388328 5388349 5388333 5388328 -
actatgcactaattaccatgat

SEQ ID NO: 114613 - DNA, 22 bp, Artificial Sequence
  Synthetic oligonucleotide; CTA chr11 5388324 5388345 5388329 5388324 -
tgcactaattaccatgatattt

SEQ ID NO: 114614 - DNA, 22 bp, Artificial Sequence
  Synthetic oligonucleotide; CTA chr11 5388317 5388338 5388322 5388317 -
attaccatgatattttccctgc

SEQ ID NO: 114615 - DNA, 22 bp, Artificial Sequence
  Synthetic oligonucleotide; TTA chr11 5388313 5388334 5388318 5388313 -
ccatgatattttccctgcagca

SEQ ID NO: 114616 - DNA, 22 bp, Artificial Sequence
  Synthetic oligonucleotide; TTT chr11 5388302 5388323 5388307 5388302 -
tccctgcagcattgtcaatttc

SEQ ID NO: 114617 - DNA, 22 bp, Artificial Sequence
  Synthetic oligonucleotide; TTT chr11 5388301 5388322 5388306 5388301 -
ccctgcagcattgtcaatttct

SEQ ID NO: 114618 - DNA, 22 bp, Artificial Sequence
  Synthetic oligonucleotide; TTC chr11 5388300 5388321 5388305 5388300 -
cctgcagcattgtcaatttctg

SEQ ID NO: 114619 - DNA, 22 bp, Artificial Sequence
  Synthetic oligonucleotide; CTG chr11 5388296 5388317 5388301 5388296 -
cagcattgtcaatttctgtatt

SEQ ID NO: 114620 - DNA, 22 bp, Artificial Sequence
  Synthetic oligonucleotide; TTG chr11 5388288 5388309 5388293 5388288 -
tcaatttctgtattgcttctat

SEQ ID NO: 114621 - DNA, 22 bp, Artificial Sequence
  Synthetic oligonucleotide; TTT chr11 5388281 5388302 5388286 5388281 -
ctgtattgcttctataatgtga

SEQ ID NO: 114622 - DNA, 22 bp, Artificial Sequence
  Synthetic oligonucleotide; TTC chr11 5388280 5388301 5388285 5388280 -
tgtattgcttctataatgtgaa

SEQ ID NO: 114623 - DNA, 22 bp, Artificial Sequence
  Synthetic oligonucleotide; CTG chr11 5388278 5388299 5388283 5388278 -
tattgcttctataatgtgaatt

SEQ ID NO: 114624 - DNA, 22 bp, Artificial Sequence
  Synthetic oligonucleotide; TTG chr11 5388273 5388294 5388278 5388273 -
cttctataatgtgaattccttg

SEQ ID NO: 114625 - DNA, 22 bp, Artificial Sequence
  Synthetic oligonucleotide; CTT chr11 5388270 5388291 5388275 5388270 -
ctataatgtgaattccttgtgg

SEQ ID NO: 114626 - DNA, 22 bp, Artificial Sequence
  Synthetic oligonucleotide; TTC chr11 5388269 5388290 5388274 5388269 -
tataatgtgaattccttgtgga

SEQ ID NO: 114627 - DNA, 22 bp, Artificial Sequence
  Synthetic oligonucleotide; CTA chr11 5388267 5388288 5388272 5388267 -
taatgtgaattccttgtggaca

SEQ ID NO: 114628 - DNA, 22 bp, Artificial Sequence
  Synthetic oligonucleotide; TTC chr11 5388255 5388276 5388260 5388255 -
cttgtggacataaaccatgact

SEQ ID NO: 114629 - DNA, 22 bp, Artificial Sequence
  Synthetic oligonucleotide; CTT chr11 5388252 5388273 5388257 5388252 -
gtggacataaaccatgactgtc

SEQ ID NO: 114630 - DNA, 22 bp, Artificial Sequence
  Synthetic oligonucleotide; TTG chr11 5388251 5388272 5388256 5388251 -
tggacataaaccatgactgtct

SEQ ID NO: 114631 - DNA, 22 bp, Artificial Sequence
  Synthetic oligonucleotide; CTG chr11 5388232 5388253 5388237 5388232 -
tctcttttttaattttaatatt

SEQ ID NO: 114632 - DNA, 22 bp, Artificial Sequence
  Synthetic oligonucleotide; CTC chr11 5388228 5388249 5388233 5388228 -
ttttttaattttaatattagct

SEQ ID NO: 114633 - DNA, 22 bp, Artificial Sequence
  Synthetic oligonucleotide; CTT chr11 5388226 5388247 5388231 5388226 -
ttttaattttaatattagctct

SEQ ID NO: 114634 - DNA, 22 bp, Artificial Sequence
  Synthetic oligonucleotide; TTT chr11 5388225 5388246 5388230 5388225 -
tttaattttaatattagctcta

SEQ ID NO: 114635 - DNA, 22 bp, Artificial Sequence
  Synthetic oligonucleotide; TTT chr11 5388224 5388245 5388229 5388224 -
ttaattttaatattagctctag

SEQ ID NO: 114636 - DNA, 22 bp, Artificial Sequence
  Synthetic oligonucleotide; TTT chr11 5388223 5388244 5388228 5388223 -
taattttaatattagctctagg

SEQ ID NO: 114637 - DNA, 22 bp, Artificial Sequence
  Synthetic oligonucleotide; TTT chr11 5388222 5388243 5388227 5388222 -
aattttaatattagctctaggg

SEQ ID NO: 114638 - DNA, 22 bp, Artificial Sequence
  Synthetic oligonucleotide; TTA chr11 5388221 5388242 5388226 5388221 -
attttaatattagctctaggga

SEQ ID NO: 114639 - DNA, 22 bp, Artificial Sequence
  Synthetic oligonucleotide; TTT chr11 5388217 5388238 5388222 5388217 -
taatattagctctagggattga

SEQ ID NO: 114640 - DNA, 22 bp, Artificial Sequence
  Synthetic oligonucleotide; TTT chr11 5388216 5388237 5388221 5388216 -
aatattagctctagggattgac

SEQ ID NO: 114641 - DNA, 22 bp, Artificial Sequence
  Synthetic oligonucleotide; TTA chr11 5388215 5388236 5388220 5388215 -
atattagctctagggattgact

SEQ ID NO: 114642 - DNA, 22 bp, Artificial Sequence
  Synthetic oligonucleotide; TTA chr11 5388209 5388230 5388214 5388209 -
gctctagggattgactttttta

SEQ ID NO: 114643 - DNA, 22 bp, Artificial Sequence
  Synthetic oligonucleotide; CTC chr11 5388205 5388226 5388210 5388205 -
tagggattgacttttttagcca

SEQ ID NO: 114644 - DNA, 22 bp, Artificial Sequence
  Synthetic oligonucleotide; CTA chr11 5388203 5388224 5388208 5388203 -
gggattgacttttttagccacc

SEQ ID NO: 114645 - DNA, 22 bp, Artificial Sequence
  Synthetic oligonucleotide; TTG chr11 5388196 5388217 5388201 5388196 -
acttttttagccaccatatcat

SEQ ID NO: 114646 - DNA, 22 bp, Artificial Sequence
  Synthetic oligonucleotide; CTT chr11 5388192 5388213 5388197 5388192 -
ttttagccaccatatcattgga

SEQ ID NO: 114647 - DNA, 22 bp, Artificial Sequence
  Synthetic oligonucleotide; TTT chr11 5388191 5388212 5388196 5388191 -
tttagccaccatatcattggaa

SEQ ID NO: 114648 - DNA, 22 bp, Artificial Sequence
  Synthetic oligonucleotide; TTT chr11 5388190 5388211 5388195 5388190 -
ttagccaccatatcattggaat

SEQ ID NO: 114649 - DNA, 22 bp, Artificial Sequence
  Synthetic oligonucleotide; TTT chr11 5388189 5388210 5388194 5388189 -
tagccaccatatcattggaatc

SEQ ID NO: 114650 - DNA, 22 bp, Artificial Sequence
  Synthetic oligonucleotide; TTT chr11 5388188 5388209 5388193 5388188 -
agccaccatatcattggaatcc

SEQ ID NO: 114651 - DNA, 22 bp, Artificial Sequence
  Synthetic oligonucleotide; TTA chr11 5388187 5388208 5388192 5388187 -
gccaccatatcattggaatcct

SEQ ID NO: 114652 - DNA, 22 bp, Artificial Sequence
  Synthetic oligonucleotide; TTG chr11 5388172 5388193 5388177 5388172 -
gaatcctttaaatattatttga

SEQ ID NO: 114653 - DNA, 22 bp, Artificial Sequence
  Synthetic oligonucleotide; CTT chr11 5388164 5388185 5388169 5388164 -
taaatattatttgaataaatta

SEQ ID NO: 114654 - DNA, 22 bp, Artificial Sequence
  Synthetic oligonucleotide; TTT chr11 5388163 5388184 5388168 5388163 -
aaatattatttgaataaattat

SEQ ID NO: 114655 - DNA, 22 bp, Artificial Sequence
  Synthetic oligonucleotide; TTA chr11 5388162 5388183 5388167 5388162 -
aatattatttgaataaattatt

SEQ ID NO: 114656 - DNA, 22 bp, Artificial Sequence
  Synthetic oligonucleotide; TTA chr11 5388155 5388176 5388160 5388155 -
tttgaataaattattaaatatg

SEQ ID NO: 114657 - DNA, 22 bp, Artificial Sequence
  Synthetic oligonucleotide; TTT chr11 5388152 5388173 5388157 5388152 -
gaataaattattaaatatgtat

SEQ ID NO: 114658 - DNA, 22 bp, Artificial Sequence
  Synthetic oligonucleotide; TTG chr11 5388151 5388172 5388156 5388151 -
aataaattattaaatatgtatc

SEQ ID NO: 114659 - DNA, 22 bp, Artificial Sequence
  Synthetic oligonucleotide; TTA chr11 5388142 5388163 5388147 5388142 -
ttaaatatgtatcattaccatt

SEQ ID NO: 114660 - DNA, 22 bp, Artificial Sequence
  Synthetic oligonucleotide; TTA chr11 5388139 5388160 5388144 5388139 -
aatatgtatcattaccattaat

SEQ ID NO: 114661 - DNA, 22 bp, Artificial Sequence
  Synthetic oligonucleotide; TTA chr11 5388125 5388146 5388130 5388125 -
ccattaatcttatttcaataat

SEQ ID NO: 114662 - DNA, 22 bp, Artificial Sequence
  Synthetic oligonucleotide; TTA chr11 5388119 5388140 5388124 5388119 -
atcttatttcaataattatttc

SEQ ID NO: 114663 - DNA, 22 bp, Artificial Sequence
  Synthetic oligonucleotide; CTT chr11 5388114 5388135 5388119 5388114 -
atttcaataattatttcaatat

SEQ ID NO: 114664 - DNA, 22 bp, Artificial Sequence
  Synthetic oligonucleotide; TTA chr11 5388113 5388134 5388118 5388113 -
tttcaataattatttcaatatt

SEQ ID NO: 114665 - DNA, 22 bp, Artificial Sequence
  Synthetic oligonucleotide; TTT chr11 5388110 5388131 5388115 5388110 -
caataattatttcaatattcaa

SEQ ID NO: 114666 - DNA, 22 bp, Artificial Sequence
  Synthetic oligonucleotide; TTC chr11 5388109 5388130 5388114 5388109 -
aataattatttcaatattcaat

SEQ ID NO: 114667 - DNA, 22 bp, Artificial Sequence
  Synthetic oligonucleotide; TTA chr11 5388101 5388122 5388106 5388101 -
tttcaatattcaattatttcaa

SEQ ID NO: 114668 - DNA, 22 bp, Artificial Sequence
  Synthetic oligonucleotide; TTT chr11 5388098 5388119 5388103 5388098 -
caatattcaattatttcaataa

SEQ ID NO: 114669 - DNA, 22 bp, Artificial Sequence
  Synthetic oligonucleotide; TTC chr11 5388097 5388118 5388102 5388097 -
aatattcaattatttcaataat

SEQ ID NO: 114670 - DNA, 22 bp, Artificial Sequence
  Synthetic oligonucleotide; TTC chr11 5388090 5388111 5388095 5388090 -
aattatttcaataattattcat

SEQ ID NO: 114671 - DNA, 22 bp, Artificial Sequence
  Synthetic oligonucleotide; TTA chr11 5388085 5388106 5388090 5388085 -
tttcaataattattcattaatt

SEQ ID NO: 114672 - DNA, 22 bp, Artificial Sequence
  Synthetic oligonucleotide; TTT chr11 5388082 5388103 5388087 5388082 -
caataattattcattaattgat

SEQ ID NO: 114673 - DNA, 22 bp, Artificial Sequence
  Synthetic oligonucleotide; TTC chr11 5388081 5388102 5388086 5388081 -
aataattattcattaattgatt

SEQ ID NO: 114674 - DNA, 22 bp, Artificial Sequence
  Synthetic oligonucleotide; TTA chr11 5388073 5388094 5388078 5388073 -
ttcattaattgattcaataaat

SEQ ID NO: 114675 - DNA, 22 bp, Artificial Sequence
  Synthetic oligonucleotide; TTC chr11 5388070 5388091 5388075 5388070 -
attaattgattcaataaataca

SEQ ID NO: 114676 - DNA, 22 bp, Artificial Sequence
  Synthetic oligonucleotide; TTA chr11 5388066 5388087 5388071 5388066 -
attgattcaataaatacatatt

SEQ ID NO: 114677 - DNA, 22 bp, Artificial Sequence
  Synthetic oligonucleotide; TTG chr11 5388062 5388083 5388067 5388062 -
attcaataaatacatattgaaa

SEQ ID NO: 114678 - DNA, 22 bp, Artificial Sequence
  Synthetic oligonucleotide; TTC chr11 5388058 5388079 5388063 5388058 -
aataaatacatattgaaattgt

SEQ ID NO: 114679 - DNA, 22 bp, Artificial Sequence
  Synthetic oligonucleotide; TTG chr11 5388043 5388064 5388048 5388043 -
aaattgtattacatggcagaca

SEQ ID NO: 114680 - DNA, 22 bp, Artificial Sequence
  Synthetic oligonucleotide; TTG chr11 5388037 5388058 5388042 5388037 -
tattacatggcagacataattc

SEQ ID NO: 114681 - DNA, 22 bp, Artificial Sequence
  Synthetic oligonucleotide; TTA chr11 5388032 5388053 5388037 5388032 -
catggcagacataattctatta

SEQ ID NO: 114682 - DNA, 22 bp, Artificial Sequence
  Synthetic oligonucleotide; TTC chr11 5388015 5388036 5388020 5388015 -
tattaggttggtgcaaaagtaa

SEQ ID NO: 114683 - DNA, 22 bp, Artificial Sequence
  Synthetic oligonucleotide; CTA chr11 5388013 5388034 5388018 5388013 -
ttaggttggtgcaaaagtaatt

SEQ ID NO: 114684 - DNA, 22 bp, Artificial Sequence
  Synthetic oligonucleotide; TTA chr11 5388010 5388031 5388015 5388010 -
ggttggtgcaaaagtaattgtg

SEQ ID NO: 114685 - DNA, 22 bp, Artificial Sequence
  Synthetic oligonucleotide; TTG chr11 5388005 5388026 5388010 5388005 -
gtgcaaaagtaattgtggtttt

SEQ ID NO: 114686 - DNA, 22 bp, Artificial Sequence
  Synthetic oligonucleotide; TTG chr11 5387990 5388011 5387995 5387990 -
tggtttttaccattactttcaa

SEQ ID NO: 114687 - DNA, 22 bp, Artificial Sequence
  Synthetic oligonucleotide; TTT chr11 5387984 5388005 5387989 5387984 -
ttaccattactttcaatggcaa

SEQ ID NO: 114688 - DNA, 22 bp, Artificial Sequence
  Synthetic oligonucleotide; TTT chr11 5387983 5388004 5387988 5387983 -
taccattactttcaatggcaag

SEQ ID NO: 114689 - DNA, 22 bp, Artificial Sequence
  Synthetic oligonucleotide; TTT chr11 5387982 5388003 5387987 5387982 -
accattactttcaatggcaaga

SEQ ID NO: 114690 - DNA, 22 bp, Artificial Sequence
  Synthetic oligonucleotide; TTA chr11 5387981 5388002 5387986 5387981 -
ccattactttcaatggcaagaa

SEQ ID NO: 114691 - DNA, 22 bp, Artificial Sequence
  Synthetic oligonucleotide; TTA chr11 5387975 5387996 5387980 5387975 -
ctttcaatggcaagaactgcaa

SEQ ID NO: 114692 - DNA, 22 bp, Artificial Sequence
  Synthetic oligonucleotide; CTT chr11 5387972 5387993 5387977 5387972 -
tcaatggcaagaactgcaatta

SEQ ID NO: 114693 - DNA, 22 bp, Artificial Sequence
  Synthetic oligonucleotide; TTT chr11 5387971 5387992 5387976 5387971 -
caatggcaagaactgcaattac

SEQ ID NO: 114694 - DNA, 22 bp, Artificial Sequence
  Synthetic oligonucleotide; TTC chr11 5387970 5387991 5387975 5387970 -
aatggcaagaactgcaattact

SEQ ID NO: 114695 - DNA, 22 bp, Artificial Sequence
  Synthetic oligonucleotide; CTG chr11 5387956 5387977 5387961 5387956 -
caattacttttacacctaggta

SEQ ID NO: 114696 - DNA, 22 bp, Artificial Sequence
  Synthetic oligonucleotide; TTA chr11 5387950 5387971 5387955 5387950 -
cttttacacctaggtactgaaa

SEQ ID NO: 114697 - DNA, 22 bp, Artificial Sequence
  Synthetic oligonucleotide; CTT chr11 5387947 5387968 5387952 5387947 -
ttacacctaggtactgaaaata

SEQ ID NO: 114698 - DNA, 22 bp, Artificial Sequence
  Synthetic oligonucleotide; TTT chr11 5387946 5387967 5387951 5387946 -
tacacctaggtactgaaaatac

SEQ ID NO: 114699 - DNA, 22 bp, Artificial Sequence
  Synthetic oligonucleotide; TTT chr11 5387945 5387966 5387950 5387945 -
acacctaggtactgaaaataca

SEQ ID NO: 114700 - DNA, 22 bp, Artificial Sequence
  Synthetic oligonucleotide; TTA chr11 5387944 5387965 5387949 5387944 -
cacctaggtactgaaaatacaa

SEQ ID NO: 114701 - DNA, 22 bp, Artificial Sequence
  Synthetic oligonucleotide; CTA chr11 5387938 5387959 5387943 5387938 -
ggtactgaaaatacaatgaaca

SEQ ID NO: 114702 - DNA, 22 bp, Artificial Sequence
  Synthetic oligonucleotide; CTG chr11 5387931 5387952 5387936 5387931 -
aaaatacaatgaacagaaacag

SEQ ID NO: 114703 - DNA, 22 bp, Artificial Sequence
  Synthetic oligonucleotide; CTG chr11 5387874 5387895 5387879 5387874 -
caatgcaaggtaatgtaatgca

SEQ ID NO: 114704 - DNA, 22 bp, Artificial Sequence
  Synthetic oligonucleotide; TTT chr11 5387807 5387828 5387812 5387807 -
tatatagggtagtcagagaaga

SEQ ID NO: 114705 - DNA, 22 bp, Artificial Sequence
  Synthetic oligonucleotide; TTT chr11 5387806 5387827 5387811 5387806 -
atatagggtagtcagagaagac

SEQ ID NO: 114706 - DNA, 22 bp, Artificial Sequence
  Synthetic oligonucleotide; TTA chr11 5387805 5387826 5387810 5387805 -
tatagggtagtcagagaagacc

SEQ ID NO: 114707 - DNA, 22 bp, Artificial Sequence
  Synthetic oligonucleotide; CTC chr11 5387781 5387802 5387786 5387781 -
tctgagtaggtaattttagaga

SEQ ID NO: 114708 - DNA, 22 bp, Artificial Sequence
  Synthetic oligonucleotide; CTC chr11 5387779 5387800 5387784 5387779 -
tgagtaggtaattttagagaag

SEQ ID NO: 114709 - DNA, 22 bp, Artificial Sequence
  Synthetic oligonucleotide; CTG chr11 5387777 5387798 5387782 5387777 -
agtaggtaattttagagaagaa

SEQ ID NO: 114710 - DNA, 22 bp, Artificial Sequence
  Synthetic oligonucleotide; TTT chr11 5387765 5387786 5387770 5387765 -
tagagaagaaatcaaaatcaga

SEQ ID NO: 114711 - DNA, 22 bp, Artificial Sequence
  Synthetic oligonucleotide; TTT chr11 5387764 5387785 5387769 5387764 -
agagaagaaatcaaaatcagag

SEQ ID NO: 114712 - DNA, 22 bp, Artificial Sequence
  Synthetic oligonucleotide; TTA chr11 5387763 5387784 5387768 5387763 -
gagaagaaatcaaaatcagagg

SEQ ID NO: 114713 - DNA, 22 bp, Artificial Sequence
  Synthetic oligonucleotide; CTA chr11 5387726 5387747 5387731 5387726 -
tcttagggaaaaacattcaagg

SEQ ID NO: 114714 - DNA, 22 bp, Artificial Sequence
  Synthetic oligonucleotide; CTT chr11 5387722 5387743 5387727 5387722 -
agggaaaaacattcaaggaagg

SEQ ID NO: 114715 - DNA, 22 bp, Artificial Sequence
  Synthetic oligonucleotide; TTA chr11 5387721 5387742 5387726 5387721 -
gggaaaaacattcaaggaagga

SEQ ID NO: 114716 - DNA, 22 bp, Artificial Sequence
  Synthetic oligonucleotide; TTC chr11 5387708 5387729 5387713 5387708 -
aaggaaggaggaagaacaagtg

SEQ ID NO: 114717 - DNA, 22 bp, Artificial Sequence
  Synthetic oligonucleotide; TTC chr11 5387679 5387700 5387684 5387679 -
ctgaagcagagagcagcttgac

SEQ ID NO: 114718 - DNA, 22 bp, Artificial Sequence
  Synthetic oligonucleotide; CTG chr11 5387676 5387697 5387681 5387676 -
aagcagagagcagcttgacaag

SEQ ID NO: 114719 - DNA, 22 bp, Artificial Sequence
  Synthetic oligonucleotide; CTT chr11 5387660 5387681 5387665 5387660 -
gacaagtttaaaagacaaaaga

SEQ ID NO: 114720 - DNA, 22 bp, Artificial Sequence
  Synthetic oligonucleotide; TTG chr11 5387659 5387680 5387664 5387659 -
acaagtttaaaagacaaaagaa

SEQ ID NO: 114721 - DNA, 22 bp, Artificial Sequence
  Synthetic oligonucleotide; TTT chr11 5387651 5387672 5387656 5387651 -
aaaagacaaaagaaggccaatg

SEQ ID NO: 114722 - DNA, 22 bp, Artificial Sequence
  Synthetic oligonucleotide; TTA chr11 5387650 5387671 5387655 5387650 -
aaagacaaaagaaggccaatgt

SEQ ID NO: 114723 - DNA, 22 bp, Artificial Sequence
  Synthetic oligonucleotide; TTC chr11 5387622 5387643 5387627 5387622 -
aatggaggaagcaaggtgggga

SEQ ID NO: 114724 - DNA, 22 bp, Artificial Sequence
  Synthetic oligonucleotide; CTT chr11 5387582 5387603 5387587 5387582 -
gaagtagcagctaaatgctacg

SEQ ID NO: 114725 - DNA, 22 bp, Artificial Sequence
  Synthetic oligonucleotide; TTG chr11 5387581 5387602 5387586 5387581 -
aagtagcagctaaatgctacgt

SEQ ID NO: 114726 - DNA, 22 bp, Artificial Sequence
  Synthetic oligonucleotide; CTA chr11 5387569 5387590 5387574 5387569 -
aatgctacgtcatgtatgatct

SEQ ID NO: 114727 - DNA, 22 bp, Artificial Sequence
  Synthetic oligonucleotide; CTA chr11 5387562 5387583 5387567 5387562 -
cgtcatgtatgatcttgcaggt

SEQ ID NO: 114728 - DNA, 22 bp, Artificial Sequence
  Synthetic oligonucleotide; CTT chr11 5387546 5387567 5387551 5387546 -
gcaggtcacgcaagctactttg

SEQ ID NO: 114729 - DNA, 22 bp, Artificial Sequence
  Synthetic oligonucleotide; TTG chr11 5387545 5387566 5387550 5387545 -
caggtcacgcaagctactttga

SEQ ID NO: 114730 - DNA, 22 bp, Artificial Sequence
  Synthetic oligonucleotide; CTA chr11 5387529 5387550 5387534 5387529 -
ctttgaattttattatacttgt

SEQ ID NO: 114731 - DNA, 22 bp, Artificial Sequence
  Synthetic oligonucleotide; CTT chr11 5387526 5387547 5387531 5387526 -
tgaattttattatacttgtgag

SEQ ID NO: 114732 - DNA, 22 bp, Artificial Sequence
  Synthetic oligonucleotide; TTT chr11 5387525 5387546 5387530 5387525 -
gaattttattatacttgtgagc

SEQ ID NO: 114733 - DNA, 22 bp, Artificial Sequence
  Synthetic oligonucleotide; TTG chr11 5387524 5387545 5387529 5387524 -
aattttattatacttgtgagct

SEQ ID NO: 114734 - DNA, 22 bp, Artificial Sequence
  Synthetic oligonucleotide; TTT chr11 5387519 5387540 5387524 5387519 -
tattatacttgtgagcttcgag

SEQ ID NO: 114735 - DNA, 22 bp, Artificial Sequence
  Synthetic oligonucleotide; TTT chr11 5387518 5387539 5387523 5387518 -
attatacttgtgagcttcgagt

SEQ ID NO: 114736 - DNA, 22 bp, Artificial Sequence
  Synthetic oligonucleotide; TTA chr11 5387517 5387538 5387522 5387517 -
ttatacttgtgagcttcgagtt

SEQ ID NO: 114737 - DNA, 22 bp, Artificial Sequence
  Synthetic oligonucleotide; TTA chr11 5387514 5387535 5387519 5387514 -
tacttgtgagcttcgagttgag

SEQ ID NO: 114738 - DNA, 22 bp, Artificial Sequence
  Synthetic oligonucleotide; CTT chr11 5387509 5387530 5387514 5387509 -
gtgagcttcgagttgagagcag

SEQ ID NO: 114739 - DNA, 22 bp, Artificial Sequence
  Synthetic oligonucleotide; TTG chr11 5387508 5387529 5387513 5387508 -
tgagcttcgagttgagagcaga

SEQ ID NO: 114740 - DNA, 22 bp, Artificial Sequence
  Synthetic oligonucleotide; CTT chr11 5387501 5387522 5387506 5387501 -
cgagttgagagcagaggtgctg

SEQ ID NO: 114741 - DNA, 22 bp, Artificial Sequence
  Synthetic oligonucleotide; TTC chr11 5387500 5387521 5387505 5387500 -
gagttgagagcagaggtgctgc

SEQ ID NO: 114742 - DNA, 22 bp, Artificial Sequence
  Synthetic oligonucleotide; TTG chr11 5387494 5387515 5387499 5387494 -
agagcagaggtgctgcatggat

SEQ ID NO: 114743 - DNA, 22 bp, Artificial Sequence
  Synthetic oligonucleotide; CTG chr11 5387479 5387500 5387484 5387479 -
catggatataaggcttacatca

SEQ ID NO: 114744 - DNA, 22 bp, Artificial Sequence
  Synthetic oligonucleotide; CTT chr11 5387463 5387484 5387468 5387463 -
acatcactttggcaaggggtaa

SEQ ID NO: 114745 - DNA, 22 bp, Artificial Sequence
  Synthetic oligonucleotide; TTA chr11 5387462 5387483 5387467 5387462 -
catcactttggcaaggggtaaa

SEQ ID NO: 114746 - DNA, 22 bp, Artificial Sequence
  Synthetic oligonucleotide; CTT chr11 5387454 5387475 5387459 5387454 -
tggcaaggggtaaaaaatagtc

SEQ ID NO: 114747 - DNA, 22 bp, Artificial Sequence
  Synthetic oligonucleotide; TTT chr11 5387453 5387474 5387458 5387453 -
ggcaaggggtaaaaaatagtcc

SEQ ID NO: 114748 - DNA, 22 bp, Artificial Sequence
  Synthetic oligonucleotide; TTG chr11 5387452 5387473 5387457 5387452 -
gcaaggggtaaaaaatagtcca

SEQ ID NO: 114749 - DNA, 22 bp, Artificial Sequence
  Synthetic oligonucleotide; TTT chr11 5387425 5387446 5387430 5387425 -
atcttttccatttctttacttc

SEQ ID NO: 114750 - DNA, 22 bp, Artificial Sequence
  Synthetic oligonucleotide; TTA chr11 5387424 5387445 5387429 5387424 -
tcttttccatttctttacttct

SEQ ID NO: 114751 - DNA, 22 bp, Artificial Sequence
  Synthetic oligonucleotide; CTT chr11 5387420 5387441 5387425 5387420 -
ttccatttctttacttctcagt

SEQ ID NO: 114752 - DNA, 22 bp, Artificial Sequence
  Synthetic oligonucleotide; TTT chr11 5387419 5387440 5387424 5387419 -
tccatttctttacttctcagtt

SEQ ID NO: 114753 - DNA, 22 bp, Artificial Sequence
  Synthetic oligonucleotide; TTT chr11 5387418 5387439 5387423 5387418 -
ccatttctttacttctcagttt

SEQ ID NO: 114754 - DNA, 22 bp, Artificial Sequence
  Synthetic oligonucleotide; TTC chr11 5387417 5387438 5387422 5387417 -
catttctttacttctcagttta

SEQ ID NO: 114755 - DNA, 22 bp, Artificial Sequence
  Synthetic oligonucleotide; TTT chr11 5387412 5387433 5387417 5387412 -
ctttacttctcagtttactact

SEQ ID NO: 114756 - DNA, 22 bp, Artificial Sequence
  Synthetic oligonucleotide; TTC chr11 5387411 5387432 5387416 5387411 -
tttacttctcagtttactactc

SEQ ID NO: 114757 - DNA, 22 bp, Artificial Sequence
  Synthetic oligonucleotide; CTT chr11 5387409 5387430 5387414 5387409 -
tacttctcagtttactactcaa

SEQ ID NO: 114758 - DNA, 22 bp, Artificial Sequence
  Synthetic oligonucleotide; TTT chr11 5387408 5387429 5387413 5387408 -
acttctcagtttactactcaac

SEQ ID NO: 114759 - DNA, 22 bp, Artificial Sequence
  Synthetic oligonucleotide; TTA chr11 5387407 5387428 5387412 5387407 -
cttctcagtttactactcaacc

SEQ ID NO: 114760 - DNA, 22 bp, Artificial Sequence
  Synthetic oligonucleotide; CTT chr11 5387404 5387425 5387409 5387404 -
ctcagtttactactcaaccaac

SEQ ID NO: 114761 - DNA, 22 bp, Artificial Sequence
  Synthetic oligonucleotide; TTC chr11 5387403 5387424 5387408 5387403 -
tcagtttactactcaaccaacc

SEQ ID NO: 114762 - DNA, 22 bp, Artificial Sequence
  Synthetic oligonucleotide; CTC chr11 5387401 5387422 5387406 5387401 -
agtttactactcaaccaaccac

SEQ ID NO: 114763 - DNA, 22 bp, Artificial Sequence
  Synthetic oligonucleotide; TTT chr11 5387396 5387417 5387401 5387396 -
actactcaaccaaccaccctat

SEQ ID NO: 114764 - DNA, 22 bp, Artificial Sequence
  Synthetic oligonucleotide; TTA chr11 5387395 5387416 5387400 5387395 -
ctactcaaccaaccaccctata

SEQ ID NO: 114765 - DNA, 22 bp, Artificial Sequence
  Synthetic oligonucleotide; CTA chr11 5387392 5387413 5387397 5387392 -
ctcaaccaaccaccctataatg

SEQ ID NO: 114766 - DNA, 22 bp, Artificial Sequence
  Synthetic oligonucleotide; CTC chr11 5387389 5387410 5387394 5387389 -
aaccaaccaccctataatgttt

SEQ ID NO: 114767 - DNA, 22 bp, Artificial Sequence
  Synthetic oligonucleotide; CTA chr11 5387375 5387396 5387380 5387375 -
taatgttttttttaaaacccac

SEQ ID NO: 114768 - DNA, 22 bp, Artificial Sequence
  Synthetic oligonucleotide; TTT chr11 5387367 5387388 5387372 5387367 -
tttttaaaacccacttagctaa

SEQ ID NO: 114769 - DNA, 22 bp, Artificial Sequence
  Synthetic oligonucleotide; TTT chr11 5387366 5387387 5387371 5387366 -
ttttaaaacccacttagctaaa

SEQ ID NO: 114770 - DNA, 22 bp, Artificial Sequence
  Synthetic oligonucleotide; TTT chr11 5387365 5387386 5387370 5387365 -
tttaaaacccacttagctaaag

SEQ ID NO: 114771 - DNA, 22 bp, Artificial Sequence
  Synthetic oligonucleotide; TTT chr11 5387364 5387385 5387369 5387364 -
ttaaaacccacttagctaaagc

SEQ ID NO: 114772 - DNA, 22 bp, Artificial Sequence
  Synthetic oligonucleotide; TTT chr11 5387363 5387384 5387368 5387363 -
taaaacccacttagctaaagca

SEQ ID NO: 114773 - DNA, 22 bp, Artificial Sequence
  Synthetic oligonucleotide; TTT chr11 5387362 5387383 5387367 5387362 -
aaaacccacttagctaaagcaa

SEQ ID NO: 114774 - DNA, 22 bp, Artificial Sequence
  Synthetic oligonucleotide; TTA chr11 5387361 5387382 5387366 5387361 -
aaacccacttagctaaagcaat

SEQ ID NO: 114775 - DNA, 22 bp, Artificial Sequence
  Synthetic oligonucleotide; CTT chr11 5387351 5387372 5387356 5387351 -
agctaaagcaatgctccttaaa

SEQ ID NO: 114776 - DNA, 22 bp, Artificial Sequence
  Synthetic oligonucleotide; TTA chr11 5387350 5387371 5387355 5387350 -
gctaaagcaatgctccttaaat

SEQ ID NO: 114777 - DNA, 22 bp, Artificial Sequence
  Synthetic oligonucleotide; CTA chr11 5387346 5387367 5387351 5387346 -
aagcaatgctccttaaattcac

SEQ ID NO: 114778 - DNA, 22 bp, Artificial Sequence
  Synthetic oligonucleotide; CTC chr11 5387335 5387356 5387340 5387335 -
cttaaattcaccagtgacttct

SEQ ID NO: 114779 - DNA, 22 bp, Artificial Sequence
  Synthetic oligonucleotide; CTT chr11 5387332 5387353 5387337 5387332 -
aaattcaccagtgacttctagg

SEQ ID NO: 114780 - DNA, 22 bp, Artificial Sequence
  Synthetic oligonucleotide; TTA chr11 5387331 5387352 5387336 5387331 -
aattcaccagtgacttctaggg

SEQ ID NO: 114781 - DNA, 22 bp, Artificial Sequence
  Synthetic oligonucleotide; TTC chr11 5387326 5387347 5387331 5387326 -
accagtgacttctaggggccaa

SEQ ID NO: 114782 - DNA, 22 bp, Artificial Sequence
  Synthetic oligonucleotide; CTT chr11 5387315 5387336 5387320 5387315 -
ctaggggccaaatgcaatggag

SEQ ID NO: 114783 - DNA, 22 bp, Artificial Sequence
  Synthetic oligonucleotide; TTC chr11 5387314 5387335 5387319 5387314 -
taggggccaaatgcaatggaga

SEQ ID NO: 114784 - DNA, 22 bp, Artificial Sequence
  Synthetic oligonucleotide; CTA chr11 5387312 5387333 5387317 5387312 -
ggggccaaatgcaatggagagt

SEQ ID NO: 114785 - DNA, 22 bp, Artificial Sequence
  Synthetic oligonucleotide; CTT chr11 5387287 5387308 5387292 5387287 -
aatcatacctgcttttattgat

SEQ ID NO: 114786 - DNA, 22 bp, Artificial Sequence
  Synthetic oligonucleotide; TTA chr11 5387286 5387307 5387291 5387286 -
atcatacctgcttttattgatt

SEQ ID NO: 114787 - DNA, 22 bp, Artificial Sequence
  Synthetic oligonucleotide; CTG chr11 5387276 5387297 5387281 5387276 -
cttttattgatttttttgtgca

SEQ ID NO: 114788 - DNA, 22 bp, Artificial Sequence
  Synthetic oligonucleotide; CTT chr11 5387273 5387294 5387278 5387273 -
ttattgatttttttgtgcaata

SEQ ID NO: 114789 - DNA, 22 bp, Artificial Sequence
  Synthetic oligonucleotide; TTT chr11 5387272 5387293 5387277 5387272 -
tattgatttttttgtgcaatag

SEQ ID NO: 114790 - DNA, 22 bp, Artificial Sequence
  Synthetic oligonucleotide; TTT chr11 5387271 5387292 5387276 5387271 -
attgatttttttgtgcaatagt

SEQ ID NO: 114791 - DNA, 22 bp, Artificial Sequence
  Synthetic oligonucleotide; TTA chr11 5387270 5387291 5387275 5387270 -
ttgatttttttgtgcaatagtt

SEQ ID NO: 114792 - DNA, 22 bp, Artificial Sequence
  Synthetic oligonucleotide; TTG chr11 5387267 5387288 5387272 5387267 -
atttttttgtgcaatagttgtg

SEQ ID NO: 114793 - DNA, 22 bp, Artificial Sequence
  Synthetic oligonucleotide; TTT chr11 5387263 5387284 5387268 5387263 -
ttttgtgcaatagttgtgtgct

SEQ ID NO: 114794 - DNA, 22 bp, Artificial Sequence
  Synthetic oligonucleotide; TTT chr11 5387262 5387283 5387267 5387262 -
tttgtgcaatagttgtgtgctc

SEQ ID NO: 114795 - DNA, 22 bp, Artificial Sequence
  Synthetic oligonucleotide; TTT chr11 5387261 5387282 5387266 5387261 -
ttgtgcaatagttgtgtgctct

SEQ ID NO: 114796 - DNA, 22 bp, Artificial Sequence
  Synthetic oligonucleotide; TTT chr11 5387260 5387281 5387265 5387260 -
tgtgcaatagttgtgtgctctg

SEQ ID NO: 114797 - DNA, 22 bp, Artificial Sequence
  Synthetic oligonucleotide; TTT chr11 5387259 5387280 5387264 5387259 -
gtgcaatagttgtgtgctctgg

SEQ ID NO: 114798 - DNA, 22 bp, Artificial Sequence
  Synthetic oligonucleotide; TTG chr11 5387258 5387279 5387263 5387258 -
tgcaatagttgtgtgctctggc

SEQ ID NO: 114799 - DNA, 22 bp, Artificial Sequence
  Synthetic oligonucleotide; TTG chr11 5387247 5387268 5387252 5387247 -
tgtgctctggccatgccttcct

SEQ ID NO: 114800 - DNA, 22 bp, Artificial Sequence
  Synthetic oligonucleotide; CTC chr11 5387240 5387261 5387245 5387240 -
tggccatgccttcctttttaga

SEQ ID NO: 114801 - DNA, 22 bp, Artificial Sequence
  Synthetic oligonucleotide; CTG chr11 5387238 5387259 5387243 5387238 -
gccatgccttcctttttagagc

SEQ ID NO: 114802 - DNA, 22 bp, Artificial Sequence
  Synthetic oligonucleotide; CTT chr11 5387228 5387249 5387233 5387228 -
cctttttagagctctctctaga

SEQ ID NO: 114803 - DNA, 22 bp, Artificial Sequence
  Synthetic oligonucleotide; TTC chr11 5387227 5387248 5387232 5387227 -
ctttttagagctctctctagaa

SEQ ID NO: 114804 - DNA, 22 bp, Artificial Sequence
  Synthetic oligonucleotide; CTT chr11 5387224 5387245 5387229 5387224 -
tttagagctctctctagaaatt

SEQ ID NO: 114805 - DNA, 22 bp, Artificial Sequence
  Synthetic oligonucleotide; TTT chr11 5387223 5387244 5387228 5387223 -
ttagagctctctctagaaattc

SEQ ID NO: 114806 - DNA, 22 bp, Artificial Sequence
  Synthetic oligonucleotide; TTT chr11 5387222 5387243 5387227 5387222 -
tagagctctctctagaaattct

SEQ ID NO: 114807 - DNA, 22 bp, Artificial Sequence
  Synthetic oligonucleotide; TTT chr11 5387221 5387242 5387226 5387221 -
agagctctctctagaaattctt

SEQ ID NO: 114808 - DNA, 22 bp, Artificial Sequence
  Synthetic oligonucleotide; TTA chr11 5387220 5387241 5387225 5387220 -
gagctctctctagaaattctta

SEQ ID NO: 114809 - DNA, 22 bp, Artificial Sequence
  Synthetic oligonucleotide; CTC chr11 5387214 5387235 5387219 5387214 -
tctctagaaattcttaatgcca

SEQ ID NO: 114810 - DNA, 22 bp, Artificial Sequence
  Synthetic oligonucleotide; CTC chr11 5387212 5387233 5387217 5387212 -
tctagaaattcttaatgccaag

SEQ ID NO: 114811 - DNA, 22 bp, Artificial Sequence
  Synthetic oligonucleotide; CTC chr11 5387210 5387231 5387215 5387210 -
tagaaattcttaatgccaagat

SEQ ID NO: 114812 - DNA, 22 bp, Artificial Sequence
  Synthetic oligonucleotide; CTA chr11 5387208 5387229 5387213 5387208 -
gaaattcttaatgccaagatct

SEQ ID NO: 114813 - DNA, 22 bp, Artificial Sequence
  Synthetic oligonucleotide; TTC chr11 5387201 5387222 5387206 5387201 -
ttaatgccaagatctgctggtt

SEQ ID NO: 114814 - DNA, 22 bp, Artificial Sequence
  Synthetic oligonucleotide; CTT chr11 5387199 5387220 5387204 5387199 -
aatgccaagatctgctggttct

SEQ ID NO: 114815 - DNA, 22 bp, Artificial Sequence
  Synthetic oligonucleotide; TTA chr11 5387198 5387219 5387203 5387198 -
atgccaagatctgctggttctc

SEQ ID NO: 114816 - DNA, 22 bp, Artificial Sequence
  Synthetic oligonucleotide; CTG chr11 5387185 5387206 5387190 5387185 -
ctggttctcttctgatttttgt

SEQ ID NO: 114817 - DNA, 22 bp, Artificial Sequence
  Synthetic oligonucleotide; CTG chr11 5387182 5387203 5387187 5387182 -
gttctcttctgatttttgtgat

SEQ ID NO: 114818 - DNA, 22 bp, Artificial Sequence
  Synthetic oligonucleotide; TTC chr11 5387178 5387199 5387183 5387178 -
tcttctgatttttgtgatagct

SEQ ID NO: 114819 - DNA, 22 bp, Artificial Sequence
  Synthetic oligonucleotide; CTC chr11 5387176 5387197 5387181 5387176 -
ttctgatttttgtgatagcttc

SEQ ID NO: 114820 - DNA, 22 bp, Artificial Sequence
  Synthetic oligonucleotide; CTT chr11 5387174 5387195 5387179 5387174 -
ctgatttttgtgatagcttcta

SEQ ID NO: 114821 - DNA, 22 bp, Artificial Sequence
  Synthetic oligonucleotide; TTC chr11 5387173 5387194 5387178 5387173 -
tgatttttgtgatagcttctat

SEQ ID NO: 114822 - DNA, 22 bp, Artificial Sequence
  Synthetic oligonucleotide; CTG chr11 5387171 5387192 5387176 5387171 -
atttttgtgatagcttctatgc

SEQ ID NO: 114823 - DNA, 22 bp, Artificial Sequence
  Synthetic oligonucleotide; TTT chr11 5387167 5387188 5387172 5387167 -
ttgtgatagcttctatgcactc

SEQ ID NO: 114824 - DNA, 22 bp, Artificial Sequence
  Synthetic oligonucleotide; TTT chr11 5387166 5387187 5387171 5387166 -
tgtgatagcttctatgcactct

SEQ ID NO: 114825 - DNA, 22 bp, Artificial Sequence
  Synthetic oligonucleotide; TTT chr11 5387165 5387186 5387170 5387165 -
gtgatagcttctatgcactctc

SEQ ID NO: 114826 - DNA, 22 bp, Artificial Sequence
  Synthetic oligonucleotide; TTG chr11 5387164 5387185 5387169 5387164 -
tgatagcttctatgcactctct

SEQ ID NO: 114827 - DNA, 22 bp, Artificial Sequence
  Synthetic oligonucleotide; CTT chr11 5387155 5387176 5387160 5387155 -
ctatgcactctcttatttccat

SEQ ID NO: 114828 - DNA, 22 bp, Artificial Sequence
  Synthetic oligonucleotide; TTC chr11 5387154 5387175 5387159 5387154 -
tatgcactctcttatttccatt

SEQ ID NO: 114829 - DNA, 22 bp, Artificial Sequence
  Synthetic oligonucleotide; CTA chr11 5387152 5387173 5387157 5387152 -
tgcactctcttatttccattgc

SEQ ID NO: 114830 - DNA, 22 bp, Artificial Sequence
  Synthetic oligonucleotide; CTC chr11 5387145 5387166 5387150 5387145 -
tcttatttccattgctcaaata

SEQ ID NO: 114831 - DNA, 22 bp, Artificial Sequence
  Synthetic oligonucleotide; CTC chr11 5387143 5387164 5387148 5387143 -
ttatttccattgctcaaatatt

SEQ ID NO: 114832 - DNA, 22 bp, Artificial Sequence
  Synthetic oligonucleotide; CTT chr11 5387141 5387162 5387146 5387141 -
atttccattgctcaaatattta

SEQ ID NO: 114833 - DNA, 22 bp, Artificial Sequence
  Synthetic oligonucleotide; TTA chr11 5387140 5387161 5387145 5387140 -
tttccattgctcaaatatttat

SEQ ID NO: 114834 - DNA, 22 bp, Artificial Sequence
  Synthetic oligonucleotide; TTT chr11 5387137 5387158 5387142 5387137 -
ccattgctcaaatatttatgtt

SEQ ID NO: 114835 - DNA, 22 bp, Artificial Sequence
  Synthetic oligonucleotide; TTC chr11 5387136 5387157 5387141 5387136 -
cattgctcaaatatttatgtta

SEQ ID NO: 114836 - DNA, 22 bp, Artificial Sequence
  Synthetic oligonucleotide; TTG chr11 5387131 5387152 5387136 5387131 -
ctcaaatatttatgttattcag

SEQ ID NO: 114837 - DNA, 22 bp, Artificial Sequence
  Synthetic oligonucleotide; CTC chr11 5387128 5387149 5387133 5387128 -
aaatatttatgttattcagttt

SEQ ID NO: 114838 - DNA, 22 bp, Artificial Sequence
  Synthetic oligonucleotide; TTT chr11 5387120 5387141 5387125 5387120 -
atgttattcagtttactgtcct

SEQ ID NO: 114839 - DNA, 22 bp, Artificial Sequence
  Synthetic oligonucleotide; TTA chr11 5387119 5387140 5387124 5387119 -
tgttattcagtttactgtcctt

SEQ ID NO: 114840 - DNA, 22 bp, Artificial Sequence
  Synthetic oligonucleotide; TTA chr11 5387114 5387135 5387119 5387114 -
ttcagtttactgtccttgaaca

SEQ ID NO: 114841 - DNA, 22 bp, Artificial Sequence
  Synthetic oligonucleotide; TTC chr11 5387111 5387132 5387116 5387111 -
agtttactgtccttgaacacct

SEQ ID NO: 114842 - DNA, 22 bp, Artificial Sequence
  Synthetic oligonucleotide; TTT chr11 5387106 5387127 5387111 5387106 -
actgtccttgaacaccttaact

SEQ ID NO: 114843 - DNA, 22 bp, Artificial Sequence
  Synthetic oligonucleotide; TTA chr11 5387105 5387126 5387110 5387105 -
ctgtccttgaacaccttaactt

SEQ ID NO: 114844 - DNA, 22 bp, Artificial Sequence
  Synthetic oligonucleotide; CTG chr11 5387102 5387123 5387107 5387102 -
tccttgaacaccttaacttctc

SEQ ID NO: 114845 - DNA, 22 bp, Artificial Sequence
  Synthetic oligonucleotide; CTT chr11 5387097 5387118 5387102 5387097 -
gaacaccttaacttctcattca

SEQ ID NO: 114846 - DNA, 22 bp, Artificial Sequence
  Synthetic oligonucleotide; TTG chr11 5387096 5387117 5387101 5387096 -
aacaccttaacttctcattcat

SEQ ID NO: 114847 - DNA, 22 bp, Artificial Sequence
  Synthetic oligonucleotide; CTT chr11 5387088 5387109 5387093 5387088 -
aacttctcattcattatattat

SEQ ID NO: 114848 - DNA, 22 bp, Artificial Sequence
  Synthetic oligonucleotide; TTA chr11 5387087 5387108 5387092 5387087 -
acttctcattcattatattatc

SEQ ID NO: 114849 - DNA, 22 bp, Artificial Sequence
  Synthetic oligonucleotide; CTT chr11 5387083 5387104 5387088 5387083 -
ctcattcattatattatctatt

SEQ ID NO: 114850 - DNA, 22 bp, Artificial Sequence
  Synthetic oligonucleotide; TTC chr11 5387082 5387103 5387087 5387082 -
tcattcattatattatctatta

SEQ ID NO: 114851 - DNA, 22 bp, Artificial Sequence
  Synthetic oligonucleotide; CTC chr11 5387080 5387101 5387085 5387080 -
attcattatattatctattatt

SEQ ID NO: 114852 - DNA, 22 bp, Artificial Sequence
  Synthetic oligonucleotide; TTC chr11 5387076 5387097 5387081 5387076 -
attatattatctattattatta

SEQ ID NO: 114853 - DNA, 22 bp, Artificial Sequence
  Synthetic oligonucleotide; TTA chr11 5387072 5387093 5387077 5387072 -
tattatctattattattattac

SEQ ID NO: 114854 - DNA, 22 bp, Artificial Sequence
  Synthetic oligonucleotide; TTA chr11 5387067 5387088 5387072 5387067 -
tctattattattattacttata

SEQ ID NO: 114855 - DNA, 22 bp, Artificial Sequence
  Synthetic oligonucleotide; CTA chr11 5387063 5387084 5387068 5387063 -
ttattattattacttatacagt

SEQ ID NO: 114856 - DNA, 22 bp, Artificial Sequence
  Synthetic oligonucleotide; TTA chr11 5387060 5387081 5387065 5387060 -
ttattattacttatacagtggt

SEQ ID NO: 114857 - DNA, 22 bp, Artificial Sequence
  Synthetic oligonucleotide; TTA chr11 5387057 5387078 5387062 5387057 -
ttattacttatacagtggtggc

SEQ ID NO: 114858 - DNA, 22 bp, Artificial Sequence
  Synthetic oligonucleotide; TTA chr11 5387054 5387075 5387059 5387054 -
ttacttatacagtggtggctct

SEQ ID NO: 114859 - DNA, 22 bp, Artificial Sequence
  Synthetic oligonucleotide; TTA chr11 5387051 5387072 5387056 5387051 -
cttatacagtggtggctcttag

SEQ ID NO: 114860 - DNA, 22 bp, Artificial Sequence
  Synthetic oligonucleotide; CTT chr11 5387048 5387069 5387053 5387048 -
atacagtggtggctcttagaca

SEQ ID NO: 114861 - DNA, 22 bp, Artificial Sequence
  Synthetic oligonucleotide; TTA chr11 5387047 5387068 5387052 5387047 -
tacagtggtggctcttagacat

SEQ ID NO: 114862 - DNA, 22 bp, Artificial Sequence
  Synthetic oligonucleotide; CTC chr11 5387033 5387054 5387038 5387033 -
ttagacattaatctctagtcca

SEQ ID NO: 114863 - DNA, 22 bp, Artificial Sequence
  Synthetic oligonucleotide; CTT chr11 5387031 5387052 5387036 5387031 -
agacattaatctctagtccaga

SEQ ID NO: 114864 - DNA, 22 bp, Artificial Sequence
  Synthetic oligonucleotide; TTA chr11 5387030 5387051 5387035 5387030 -
gacattaatctctagtccagat

SEQ ID NO: 114865 - DNA, 22 bp, Artificial Sequence
  Synthetic oligonucleotide; TTA chr11 5387023 5387044 5387028 5387023 -
atctctagtccagataactccg

SEQ ID NO: 114866 - DNA, 22 bp, Artificial Sequence
  Synthetic oligonucleotide; CTC chr11 5387018 5387039 5387023 5387018 -
tagtccagataactccgttaca

SEQ ID NO: 114867 - DNA, 22 bp, Artificial Sequence
  Synthetic oligonucleotide; CTA chr11 5387016 5387037 5387021 5387016 -
gtccagataactccgttacata

SEQ ID NO: 114868 - DNA, 22 bp, Artificial Sequence
  Synthetic oligonucleotide; CTC chr11 5387003 5387024 5387008 5387003 -
cgttacatatcaggcctgagtt

SEQ ID NO: 114869 - DNA, 22 bp, Artificial Sequence
  Synthetic oligonucleotide; TTA chr11 5386998 5387019 5387003 5386998 -
catatcaggcctgagtttctgc

SEQ ID NO: 114870 - DNA, 22 bp, Artificial Sequence
  Synthetic oligonucleotide; CTG chr11 5386985 5387006 5386990 5386985 -
agtttctgccttctcactaggt

SEQ ID NO: 114871 - DNA, 22 bp, Artificial Sequence
  Synthetic oligonucleotide; TTT chr11 5386980 5387001 5386985 5386980 -
ctgccttctcactaggtgtttc

SEQ ID NO: 114872 - DNA, 22 bp, Artificial Sequence
  Synthetic oligonucleotide; TTC chr11 5386979 5387000 5386984 5386979 -
tgccttctcactaggtgtttcc

SEQ ID NO: 114873 - DNA, 22 bp, Artificial Sequence
  Synthetic oligonucleotide; CTG chr11 5386977 5386998 5386982 5386977 -
ccttctcactaggtgtttccaa

SEQ ID NO: 114874 - DNA, 22 bp, Artificial Sequence
  Synthetic oligonucleotide; CTT chr11 5386973 5386994 5386978 5386973 -
ctcactaggtgtttccaaaagg

SEQ ID NO: 114875 - DNA, 22 bp, Artificial Sequence
  Synthetic oligonucleotide; TTC chr11 5386972 5386993 5386977 5386972 -
tcactaggtgtttccaaaagga

SEQ ID NO: 114876 - DNA, 22 bp, Artificial Sequence
  Synthetic oligonucleotide; CTC chr11 5386970 5386991 5386975 5386970 -
actaggtgtttccaaaaggata

SEQ ID NO: 114877 - DNA, 22 bp, Artificial Sequence
  Synthetic oligonucleotide; CTA chr11 5386966 5386987 5386971 5386966 -
ggtgtttccaaaaggatactga

SEQ ID NO: 114878 - DNA, 22 bp, Artificial Sequence
  Synthetic oligonucleotide; TTT chr11 5386959 5386980 5386964 5386959 -
ccaaaaggatactgatgaaact

SEQ ID NO: 114879 - DNA, 22 bp, Artificial Sequence
  Synthetic oligonucleotide; TTC chr11 5386958 5386979 5386963 5386958 -
caaaaggatactgatgaaactc

SEQ ID NO: 114880 - DNA, 22 bp, Artificial Sequence
  Synthetic oligonucleotide; CTG chr11 5386945 5386966 5386950 5386945 -
atgaaactcaacacgtctaata

SEQ ID NO: 114881 - DNA, 22 bp, Artificial Sequence
  Synthetic oligonucleotide; CTC chr11 5386936 5386957 5386941 5386936 -
aacacgtctaatattgagccca

SEQ ID NO: 114882 - DNA, 22 bp, Artificial Sequence
  Synthetic oligonucleotide; CTA chr11 5386926 5386947 5386931 5386926 -
atattgagcccagcatccatct

SEQ ID NO: 114883 - DNA, 22 bp, Artificial Sequence
  Synthetic oligonucleotide; TTG chr11 5386920 5386941 5386925 5386920 -
agcccagcatccatcttttcac

SEQ ID NO: 114884 - DNA, 22 bp, Artificial Sequence
  Synthetic oligonucleotide; CTT chr11 5386903 5386924 5386908 5386903 -
ttcacacctgattcttctcata

SEQ ID NO: 114885 - DNA, 22 bp, Artificial Sequence
  Synthetic oligonucleotide; TTT chr11 5386902 5386923 5386907 5386902 -
tcacacctgattcttctcatat

SEQ ID NO: 114886 - DNA, 22 bp, Artificial Sequence
  Synthetic oligonucleotide; TTT chr11 5386901 5386922 5386906 5386901 -
cacacctgattcttctcatatt

SEQ ID NO: 114887 - DNA, 22 bp, Artificial Sequence
  Synthetic oligonucleotide; TTC chr11 5386900 5386921 5386905 5386900 -
acacctgattcttctcatattt

SEQ ID NO: 114888 - DNA, 22 bp, Artificial Sequence
  Synthetic oligonucleotide; CTG chr11 5386893 5386914 5386898 5386893 -
attcttctcatatttatgcatt

SEQ ID NO: 114889 - DNA, 22 bp, Artificial Sequence
  Synthetic oligonucleotide; TTC chr11 5386889 5386910 5386894 5386889 -
ttctcatatttatgcatttttt

SEQ ID NO: 114890 - DNA, 22 bp, Artificial Sequence
  Synthetic oligonucleotide; CTT chr11 5386887 5386908 5386892 5386887 -
ctcatatttatgcattttttat

SEQ ID NO: 114891 - DNA, 22 bp, Artificial Sequence
  Synthetic oligonucleotide; TTC chr11 5386886 5386907 5386891 5386886 -
tcatatttatgcattttttata

SEQ ID NO: 114892 - DNA, 22 bp, Artificial Sequence
  Synthetic oligonucleotide; CTC chr11 5386884 5386905 5386889 5386884 -
atatttatgcattttttataat

SEQ ID NO: 114893 - DNA, 22 bp, Artificial Sequence
  Synthetic oligonucleotide; TTT chr11 5386878 5386899 5386883 5386878 -
atgcattttttataatattatt

SEQ ID NO: 114894 - DNA, 22 bp, Artificial Sequence
  Synthetic oligonucleotide; TTA chr11 5386877 5386898 5386882 5386877 -
tgcattttttataatattattc

SEQ ID NO: 114895 - DNA, 22 bp, Artificial Sequence
  Synthetic oligonucleotide; TTT chr11 5386870 5386891 5386875 5386870 -
tttataatattattcaccattt

SEQ ID NO: 114896 - DNA, 22 bp, Artificial Sequence
  Synthetic oligonucleotide; TTT chr11 5386869 5386890 5386874 5386869 -
ttataatattattcaccatttc

SEQ ID NO: 114897 - DNA, 22 bp, Artificial Sequence
  Synthetic oligonucleotide; TTT chr11 5386868 5386889 5386873 5386868 -
tataatattattcaccatttcc

SEQ ID NO: 114898 - DNA, 22 bp, Artificial Sequence
  Synthetic oligonucleotide; TTT chr11 5386867 5386888 5386872 5386867 -
ataatattattcaccatttcct

SEQ ID NO: 114899 - DNA, 22 bp, Artificial Sequence
  Synthetic oligonucleotide; TTA chr11 5386866 5386887 5386871 5386866 -
taatattattcaccatttcctg

SEQ ID NO: 114900 - DNA, 22 bp, Artificial Sequence
  Synthetic oligonucleotide; TTA chr11 5386858 5386879 5386863 5386858 -
ttcaccatttcctgccattcaa

SEQ ID NO: 114901 - DNA, 22 bp, Artificial Sequence
  Synthetic oligonucleotide; TTC chr11 5386855 5386876 5386860 5386855 -
accatttcctgccattcaagac

SEQ ID NO: 114902 - DNA, 22 bp, Artificial Sequence
  Synthetic oligonucleotide; TTT chr11 5386848 5386869 5386853 5386848 -
cctgccattcaagacaacattt

SEQ ID NO: 114903 - DNA, 22 bp, Artificial Sequence
  Synthetic oligonucleotide; TTC chr11 5386847 5386868 5386852 5386847 -
ctgccattcaagacaacatttt

SEQ ID NO: 114904 - DNA, 22 bp, Artificial Sequence
  Synthetic oligonucleotide; CTG chr11 5386844 5386865 5386849 5386844 -
ccattcaagacaacatttttga

SEQ ID NO: 114905 - DNA, 22 bp, Artificial Sequence
  Synthetic oligonucleotide; TTC chr11 5386838 5386859 5386843 5386838 -
aagacaacatttttgagctgat

SEQ ID NO: 114906 - DNA, 22 bp, Artificial Sequence
  Synthetic oligonucleotide; TTT chr11 5386826 5386847 5386831 5386826 -
ttgagctgatgctctactcaac

SEQ ID NO: 114907 - DNA, 22 bp, Artificial Sequence
  Synthetic oligonucleotide; TTT chr11 5386825 5386846 5386830 5386825 -
tgagctgatgctctactcaacc

SEQ ID NO: 114908 - DNA, 22 bp, Artificial Sequence
  Synthetic oligonucleotide; TTT chr11 5386824 5386845 5386829 5386824 -
gagctgatgctctactcaaccc

SEQ ID NO: 114909 - DNA, 22 bp, Artificial Sequence
  Synthetic oligonucleotide; TTG chr11 5386823 5386844 5386828 5386823 -
agctgatgctctactcaaccct

SEQ ID NO: 114910 - DNA, 22 bp, Artificial Sequence
  Synthetic oligonucleotide; CTG chr11 5386818 5386839 5386823 5386818 -
atgctctactcaaccctctccc

SEQ ID NO: 114911 - DNA, 22 bp, Artificial Sequence
  Synthetic oligonucleotide; CTC chr11 5386812 5386833 5386817 5386812 -
tactcaaccctctccctctttc

SEQ ID NO: 114912 - DNA, 22 bp, Artificial Sequence
  Synthetic oligonucleotide; CTA chr11 5386810 5386831 5386815 5386810 -
ctcaaccctctccctctttctg

SEQ ID NO: 114913 - DNA, 22 bp, Artificial Sequence
  Synthetic oligonucleotide; CTC chr11 5386807 5386828 5386812 5386807 -
aaccctctccctctttctgtat

SEQ ID NO: 114914 - DNA, 22 bp, Artificial Sequence
  Synthetic oligonucleotide; CTC chr11 5386800 5386821 5386805 5386800 -
tccctctttctgtatctaattt

SEQ ID NO: 114915 - DNA, 22 bp, Artificial Sequence
  Synthetic oligonucleotide; CTC chr11 5386798 5386819 5386803 5386798 -
cctctttctgtatctaattttt

SEQ ID NO: 114916 - DNA, 22 bp, Artificial Sequence
  Synthetic oligonucleotide; CTC chr11 5386794 5386815 5386799 5386794 -
tttctgtatctaatttttaact

SEQ ID NO: 114917 - DNA, 22 bp, Artificial Sequence
  Synthetic oligonucleotide; CTT chr11 5386792 5386813 5386797 5386792 -
tctgtatctaatttttaactaa

SEQ ID NO: 114918 - DNA, 22 bp, Artificial Sequence
  Synthetic oligonucleotide; TTT chr11 5386791 5386812 5386796 5386791 -
ctgtatctaatttttaactaag

SEQ ID NO: 114919 - DNA, 22 bp, Artificial Sequence
  Synthetic oligonucleotide; TTC chr11 5386790 5386811 5386795 5386790 -
tgtatctaatttttaactaagt

SEQ ID NO: 114920 - DNA, 22 bp, Artificial Sequence
  Synthetic oligonucleotide; CTG chr11 5386788 5386809 5386793 5386788 -
tatctaatttttaactaagttc

SEQ ID NO: 114921 - DNA, 22 bp, Artificial Sequence
  Synthetic oligonucleotide; CTA chr11 5386782 5386803 5386787 5386782 -
atttttaactaagttcttttaa

SEQ ID NO: 114922 - DNA, 22 bp, Artificial Sequence
  Synthetic oligonucleotide; TTT chr11 5386778 5386799 5386783 5386778 -
ttaactaagttcttttaatcta

SEQ ID NO: 114923 - DNA, 22 bp, Artificial Sequence
  Synthetic oligonucleotide; TTT chr11 5386777 5386798 5386782 5386777 -
taactaagttcttttaatctat

SEQ ID NO: 114924 - DNA, 22 bp, Artificial Sequence
  Synthetic oligonucleotide; TTT chr11 5386776 5386797 5386781 5386776 -
aactaagttcttttaatctatc

SEQ ID NO: 114925 - DNA, 22 bp, Artificial Sequence
  Synthetic oligonucleotide; TTA chr11 5386775 5386796 5386780 5386775 -
actaagttcttttaatctatcc

SEQ ID NO: 114926 - DNA, 22 bp, Artificial Sequence
  Synthetic oligonucleotide; CTA chr11 5386771 5386792 5386776 5386771 -
agttcttttaatctatccctgt

SEQ ID NO: 114927 - DNA, 22 bp, Artificial Sequence
  Synthetic oligonucleotide; TTC chr11 5386766 5386787 5386771 5386766 -
ttttaatctatccctgtaatct

SEQ ID NO: 114928 - DNA, 22 bp, Artificial Sequence
  Synthetic oligonucleotide; CTT chr11 5386764 5386785 5386769 5386764 -
ttaatctatccctgtaatctat

SEQ ID NO: 114929 - DNA, 22 bp, Artificial Sequence
  Synthetic oligonucleotide; TTT chr11 5386763 5386784 5386768 5386763 -
taatctatccctgtaatctatt

SEQ ID NO: 114930 - DNA, 22 bp, Artificial Sequence
  Synthetic oligonucleotide; TTT chr11 5386762 5386783 5386767 5386762 -
aatctatccctgtaatctattc

SEQ ID NO: 114931 - DNA, 22 bp, Artificial Sequence
  Synthetic oligonucleotide; TTA chr11 5386761 5386782 5386766 5386761 -
atctatccctgtaatctattca

SEQ ID NO: 114932 - DNA, 22 bp, Artificial Sequence
  Synthetic oligonucleotide; CTA chr11 5386756 5386777 5386761 5386756 -
tccctgtaatctattcatcttc

SEQ ID NO: 114933 - DNA, 22 bp, Artificial Sequence
  Synthetic oligonucleotide; CTG chr11 5386750 5386771 5386755 5386750 -
taatctattcatcttcatctct

SEQ ID NO: 114934 - DNA, 22 bp, Artificial Sequence
  Synthetic oligonucleotide; CTA chr11 5386743 5386764 5386748 5386743 -
ttcatcttcatctctgtagcca

SEQ ID NO: 114935 - DNA, 22 bp, Artificial Sequence
  Synthetic oligonucleotide; TTC chr11 5386740 5386761 5386745 5386740 -
atcttcatctctgtagccaatg

SEQ ID NO: 114936 - DNA, 22 bp, Artificial Sequence
  Synthetic oligonucleotide; CTT chr11 5386735 5386756 5386740 5386735 -
catctctgtagccaatgtcctt

SEQ ID NO: 114937 - DNA, 22 bp, Artificial Sequence
  Synthetic oligonucleotide; TTC chr11 5386734 5386755 5386739 5386734 -
atctctgtagccaatgtccttg

SEQ ID NO: 114938 - DNA, 22 bp, Artificial Sequence
  Synthetic oligonucleotide; CTC chr11 5386729 5386750 5386734 5386729 -
tgtagccaatgtccttgttctt

SEQ ID NO: 114939 - DNA, 22 bp, Artificial Sequence
  Synthetic oligonucleotide; CTG chr11 5386727 5386748 5386732 5386727 -
tagccaatgtccttgttcttag

SEQ ID NO: 114940 - DNA, 22 bp, Artificial Sequence
  Synthetic oligonucleotide; CTT chr11 5386713 5386734 5386718 5386713 -
gttcttagcttttccacacctg

SEQ ID NO: 114941 - DNA, 22 bp, Artificial Sequence
  Synthetic oligonucleotide; TTG chr11 5386712 5386733 5386717 5386712 -
ttcttagcttttccacacctgc

SEQ ID NO: 114942 - DNA, 22 bp, Artificial Sequence
  Synthetic oligonucleotide; TTC chr11 5386709 5386730 5386714 5386709 -
ttagcttttccacacctgcttg

SEQ ID NO: 114943 - DNA, 22 bp, Artificial Sequence
  Synthetic oligonucleotide; CTT chr11 5386707 5386728 5386712 5386707 -
agcttttccacacctgcttgcc

SEQ ID NO: 114944 - DNA, 22 bp, Artificial Sequence
  Synthetic oligonucleotide; TTA chr11 5386706 5386727 5386711 5386706 -
gcttttccacacctgcttgcct

SEQ ID NO: 114945 - DNA, 22 bp, Artificial Sequence
  Synthetic oligonucleotide; CTT chr11 5386702 5386723 5386707 5386702 -
ttccacacctgcttgcctgacc

SEQ ID NO: 114946 - DNA, 22 bp, Artificial Sequence
  Synthetic oligonucleotide; TTT chr11 5386701 5386722 5386706 5386701 -
tccacacctgcttgcctgacct

SEQ ID NO: 114947 - DNA, 22 bp, Artificial Sequence
  Synthetic oligonucleotide; TTT chr11 5386700 5386721 5386705 5386700 -
ccacacctgcttgcctgacctg

SEQ ID NO: 114948 - DNA, 22 bp, Artificial Sequence
  Synthetic oligonucleotide; TTC chr11 5386699 5386720 5386704 5386699 -
cacacctgcttgcctgacctgt

SEQ ID NO: 114949 - DNA, 22 bp, Artificial Sequence
  Synthetic oligonucleotide; CTG chr11 5386691 5386712 5386696 5386691 -
cttgcctgacctgtcattcaac

SEQ ID NO: 114950 - DNA, 22 bp, Artificial Sequence
  Synthetic oligonucleotide; CTT chr11 5386688 5386709 5386693 5386688 -
gcctgacctgtcattcaacatg

SEQ ID NO: 114951 - DNA, 22 bp, Artificial Sequence
  Synthetic oligonucleotide; TTG chr11 5386687 5386708 5386692 5386687 -
cctgacctgtcattcaacatgc

SEQ ID NO: 114952 - DNA, 22 bp, Artificial Sequence
  Synthetic oligonucleotide; CTG chr11 5386683 5386704 5386688 5386683 -
acctgtcattcaacatgcaaag

SEQ ID NO: 114953 - DNA, 22 bp, Artificial Sequence
  Synthetic oligonucleotide; CTG chr11 5386678 5386699 5386683 5386678 -
tcattcaacatgcaaagccagg

SEQ ID NO: 114954 - DNA, 22 bp, Artificial Sequence
  Synthetic oligonucleotide; TTC chr11 5386672 5386693 5386677 5386672 -
aacatgcaaagccaggctcctc

SEQ ID NO: 114955 - DNA, 22 bp, Artificial Sequence
  Synthetic oligonucleotide; CTC chr11 5386653 5386674 5386658 5386653 -
ctccttcccttggtccatcctc

SEQ ID NO: 114956 - DNA, 22 bp, Artificial Sequence
  Synthetic oligonucleotide; CTC chr11 5386650 5386671 5386655 5386650 -
cttcccttggtccatcctctac

SEQ ID NO: 114957 - DNA, 22 bp, Artificial Sequence
  Synthetic oligonucleotide; CTT chr11 5386647 5386668 5386652 5386647 -
cccttggtccatcctctactgc

SEQ ID NO: 114958 - DNA, 22 bp, Artificial Sequence
  Synthetic oligonucleotide; TTC chr11 5386646 5386667 5386651 5386646 -
ccttggtccatcctctactgca

SEQ ID NO: 114959 - DNA, 22 bp, Artificial Sequence
  Synthetic oligonucleotide; CTT chr11 5386642 5386663 5386647 5386642 -
ggtccatcctctactgcagcca

SEQ ID NO: 114960 - DNA, 22 bp, Artificial Sequence
  Synthetic oligonucleotide; TTG chr11 5386641 5386662 5386646 5386641 -
gtccatcctctactgcagccac

SEQ ID NO: 114961 - DNA, 22 bp, Artificial Sequence
  Synthetic oligonucleotide; CTC chr11 5386631 5386652 5386636 5386631 -
tactgcagccaccgagattatg

SEQ ID NO: 114962 - DNA, 22 bp, Artificial Sequence
  Synthetic oligonucleotide; CTA chr11 5386629 5386650 5386634 5386629 -
ctgcagccaccgagattatgca

SEQ ID NO: 114963 - DNA, 22 bp, Artificial Sequence
  Synthetic oligonucleotide; CTG chr11 5386626 5386647 5386631 5386626 -
cagccaccgagattatgcagaa

SEQ ID NO: 114964 - DNA, 22 bp, Artificial Sequence
  Synthetic oligonucleotide; TTA chr11 5386611 5386632 5386616 5386611 -
tgcagaaagtactaactctatg

SEQ ID NO: 114965 - DNA, 22 bp, Artificial Sequence
  Synthetic oligonucleotide; CTA chr11 5386597 5386618 5386602 5386597 -
actctatgaatcactgcactgt

SEQ ID NO: 114966 - DNA, 22 bp, Artificial Sequence
  Synthetic oligonucleotide; CTC chr11 5386593 5386614 5386598 5386593 -
tatgaatcactgcactgttttc

SEQ ID NO: 114967 - DNA, 22 bp, Artificial Sequence
  Synthetic oligonucleotide; CTA chr11 5386591 5386612 5386596 5386591 -
tgaatcactgcactgttttcag

SEQ ID NO: 114968 - DNA, 22 bp, Artificial Sequence
  Synthetic oligonucleotide; CTG chr11 5386581 5386602 5386586 5386581 -
cactgttttcagtacttcagta

SEQ ID NO: 114969 - DNA, 22 bp, Artificial Sequence
  Synthetic oligonucleotide; CTG chr11 5386576 5386597 5386581 5386576 -
ttttcagtacttcagtagctcc

SEQ ID NO: 114970 - DNA, 22 bp, Artificial Sequence
  Synthetic oligonucleotide; TTT chr11 5386573 5386594 5386578 5386573 -
tcagtacttcagtagctcctat

SEQ ID NO: 114971 - DNA, 22 bp, Artificial Sequence
  Synthetic oligonucleotide; TTT chr11 5386572 5386593 5386577 5386572 -
cagtacttcagtagctcctatc

SEQ ID NO: 114972 - DNA, 22 bp, Artificial Sequence
  Synthetic oligonucleotide; TTC chr11 5386571 5386592 5386576 5386571 -
agtacttcagtagctcctatca

SEQ ID NO: 114973 - DNA, 22 bp, Artificial Sequence
  Synthetic oligonucleotide; CTT chr11 5386564 5386585 5386569 5386564 -
cagtagctcctatcattagaat

SEQ ID NO: 114974 - DNA, 22 bp, Artificial Sequence
  Synthetic oligonucleotide; TTC chr11 5386563 5386584 5386568 5386563 -
agtagctcctatcattagaata

SEQ ID NO: 114975 - DNA, 22 bp, Artificial Sequence
  Synthetic oligonucleotide; CTC chr11 5386555 5386576 5386560 5386555 -
ctatcattagaataaagttcaa

SEQ ID NO: 114976 - DNA, 22 bp, Artificial Sequence
  Synthetic oligonucleotide; CTA chr11 5386552 5386573 5386557 5386552 -
tcattagaataaagttcaaact

SEQ ID NO: 114977 - DNA, 22 bp, Artificial Sequence
  Synthetic oligonucleotide; TTA chr11 5386546 5386567 5386551 5386546 -
gaataaagttcaaacttgtaaa

SEQ ID NO: 114978 - DNA, 22 bp, Artificial Sequence
  Synthetic oligonucleotide; TTC chr11 5386535 5386556 5386540 5386535 -
aaacttgtaaaagatctgtggt

SEQ ID NO: 114979 - DNA, 22 bp, Artificial Sequence
  Synthetic oligonucleotide; CTT chr11 5386529 5386550 5386534 5386529 -
gtaaaagatctgtggtgatagt

SEQ ID NO: 114980 - DNA, 22 bp, Artificial Sequence
  Synthetic oligonucleotide; TTG chr11 5386528 5386549 5386533 5386528 -
taaaagatctgtggtgatagtc

SEQ ID NO: 114981 - DNA, 22 bp, Artificial Sequence
  Synthetic oligonucleotide; CTG chr11 5386517 5386538 5386522 5386517 -
tggtgatagtccaatttattga

SEQ ID NO: 114982 - DNA, 22 bp, Artificial Sequence
  Synthetic oligonucleotide; TTT chr11 5386500 5386521 5386505 5386500 -
attgaggccatacatgatttag

SEQ ID NO: 114983 - DNA, 22 bp, Artificial Sequence
  Synthetic oligonucleotide; TTA chr11 5386499 5386520 5386504 5386499 -
ttgaggccatacatgatttaga

SEQ ID NO: 114984 - DNA, 22 bp, Artificial Sequence
  Synthetic oligonucleotide; TTG chr11 5386496 5386517 5386501 5386496 -
aggccatacatgatttagatgc

SEQ ID NO: 114985 - DNA, 22 bp, Artificial Sequence
  Synthetic oligonucleotide; TTT chr11 5386480 5386501 5386485 5386480 -
agatgctgtgaaaagcttgaca

SEQ ID NO: 114986 - DNA, 22 bp, Artificial Sequence
  Synthetic oligonucleotide; TTA chr11 5386479 5386500 5386484 5386479 -
gatgctgtgaaaagcttgacat

SEQ ID NO: 114987 - DNA, 22 bp, Artificial Sequence
  Synthetic oligonucleotide; CTG chr11 5386472 5386493 5386477 5386472 -
tgaaaagcttgacataatcatg

SEQ ID NO: 114988 - DNA, 22 bp, Artificial Sequence
  Synthetic oligonucleotide; CTT chr11 5386462 5386483 5386467 5386462 -
gacataatcatgaatatttcat

SEQ ID NO: 114989 - DNA, 22 bp, Artificial Sequence
  Synthetic oligonucleotide; TTG chr11 5386461 5386482 5386466 5386461 -
acataatcatgaatatttcatg

SEQ ID NO: 114990 - DNA, 22 bp, Artificial Sequence
  Synthetic oligonucleotide; TTT chr11 5386443 5386464 5386448 5386443 -
catgtaactatgaaacatttta

SEQ ID NO: 114991 - DNA, 22 bp, Artificial Sequence
  Synthetic oligonucleotide; TTC chr11 5386442 5386463 5386447 5386442 -
atgtaactatgaaacattttat

SEQ ID NO: 114992 - DNA, 22 bp, Artificial Sequence
  Synthetic oligonucleotide; CTA chr11 5386433 5386454 5386438 5386433 -
tgaaacattttattactacttc

SEQ ID NO: 114993 - DNA, 22 bp, Artificial Sequence
  Synthetic oligonucleotide; TTT chr11 5386423 5386444 5386428 5386423 -
tattactacttcacaaggagaa

SEQ ID NO: 114994 - DNA, 22 bp, Artificial Sequence
  Synthetic oligonucleotide; TTT chr11 5386422 5386443 5386427 5386422 -
attactacttcacaaggagaaa

SEQ ID NO: 114995 - DNA, 22 bp, Artificial Sequence
  Synthetic oligonucleotide; TTA chr11 5386421 5386442 5386426 5386421 -
ttactacttcacaaggagaaaa

SEQ ID NO: 114996 - DNA, 22 bp, Artificial Sequence
  Synthetic oligonucleotide; TTA chr11 5386418 5386439 5386423 5386418 -
ctacttcacaaggagaaaacta

SEQ ID NO: 114997 - DNA, 22 bp, Artificial Sequence
  Synthetic oligonucleotide; CTA chr11 5386415 5386436 5386420 5386415 -
cttcacaaggagaaaactacaa

SEQ ID NO: 114998 - DNA, 22 bp, Artificial Sequence
  Synthetic oligonucleotide; CTT chr11 5386412 5386433 5386417 5386412 -
cacaaggagaaaactacaaaaa

SEQ ID NO: 114999 - DNA, 22 bp, Artificial Sequence
  Synthetic oligonucleotide; TTC chr11 5386411 5386432 5386416 5386411 -
acaaggagaaaactacaaaaag

SEQ ID NO: 115000 - DNA, 22 bp, Artificial Sequence
  Synthetic oligonucleotide; CTA chr11 5386396 5386417 5386401 5386396 -
caaaaaggtaaacaatcatccc

SEQ ID NO: 115001 - DNA, 22 bp, Artificial Sequence
  Synthetic oligonucleotide; CTG chr11 5386366 5386387 5386371 5386366 -
gtagtgagcgaaaatcaggata

SEQ ID NO: 115002 - DNA, 22 bp, Artificial Sequence
  Synthetic oligonucleotide; CTT chr11 5386331 5386352 5386336 5386331 -
tgtctctctatgcatggccctg

SEQ ID NO: 115003 - DNA, 22 bp, Artificial Sequence
  Synthetic oligonucleotide; TTT chr11 5386330 5386351 5386335 5386330 -
gtctctctatgcatggccctgg

SEQ ID NO: 115004 - DNA, 22 bp, Artificial Sequence
  Synthetic oligonucleotide; TTG chr11 5386329 5386350 5386334 5386329 -
tctctctatgcatggccctggt

SEQ ID NO: 115005 - DNA, 22 bp, Artificial Sequence
  Synthetic oligonucleotide; CTC chr11 5386325 5386346 5386330 5386325 -
tctatgcatggccctggtagcc

SEQ ID NO: 115006 - DNA, 22 bp, Artificial Sequence
  Synthetic oligonucleotide; CTC chr11 5386323 5386344 5386328 5386323 -
tatgcatggccctggtagcctc

SEQ ID NO: 115007 - DNA, 22 bp, Artificial Sequence
  Synthetic oligonucleotide; CTA chr11 5386321 5386342 5386326 5386321 -
tgcatggccctggtagcctcaa

SEQ ID NO: 115008 - DNA, 22 bp, Artificial Sequence
  Synthetic oligonucleotide; CTG chr11 5386309 5386330 5386314 5386309 -
gtagcctcaaacaccctgtaac

SEQ ID NO: 115009 - DNA, 22 bp, Artificial Sequence
  Synthetic oligonucleotide; CTC chr11 5386301 5386322 5386306 5386301 -
aaacaccctgtaacaccatctt

SEQ ID NO: 115010 - DNA, 22 bp, Artificial Sequence
  Synthetic oligonucleotide; CTG chr11 5386291 5386312 5386296 5386291 -
taacaccatctttagcccggtc

SEQ ID NO: 115011 - DNA, 22 bp, Artificial Sequence
  Synthetic oligonucleotide; CTT chr11 5386279 5386300 5386284 5386279 -
tagcccggtccttcttgttttg

SEQ ID NO: 115012 - DNA, 22 bp, Artificial Sequence
  Synthetic oligonucleotide; TTT chr11 5386278 5386299 5386283 5386278 -
agcccggtccttcttgttttgg

SEQ ID NO: 115013 - DNA, 22 bp, Artificial Sequence
  Synthetic oligonucleotide; TTA chr11 5386277 5386298 5386282 5386277 -
gcccggtccttcttgttttggc

SEQ ID NO: 115014 - DNA, 22 bp, Artificial Sequence
  Synthetic oligonucleotide; CTT chr11 5386266 5386287 5386271 5386266 -
cttgttttggcacctttccaaa

SEQ ID NO: 115015 - DNA, 22 bp, Artificial Sequence
  Synthetic oligonucleotide; TTC chr11 5386265 5386286 5386270 5386265 -
ttgttttggcacctttccaaac

SEQ ID NO: 115016 - DNA, 22 bp, Artificial Sequence
  Synthetic oligonucleotide; CTT chr11 5386263 5386284 5386268 5386263 -
gttttggcacctttccaaaccc

SEQ ID NO: 115017 - DNA, 22 bp, Artificial Sequence
  Synthetic oligonucleotide; TTG chr11 5386262 5386283 5386267 5386262 -
ttttggcacctttccaaaccca

SEQ ID NO: 115018 - DNA, 22 bp, Artificial Sequence
  Synthetic oligonucleotide; TTT chr11 5386259 5386280 5386264 5386259 -
tggcacctttccaaacccatct

SEQ ID NO: 115019 - DNA, 22 bp, Artificial Sequence
  Synthetic oligonucleotide; TTT chr11 5386258 5386279 5386263 5386258 -
ggcacctttccaaacccatctt

SEQ ID NO: 115020 - DNA, 22 bp, Artificial Sequence
  Synthetic oligonucleotide; TTG chr11 5386257 5386278 5386262 5386257 -
gcacctttccaaacccatcttt

SEQ ID NO: 115021 - DNA, 22 bp, Artificial Sequence
  Synthetic oligonucleotide; CTT chr11 5386250 5386271 5386255 5386250 -
tccaaacccatcttttcccagt

SEQ ID NO: 115022 - DNA, 22 bp, Artificial Sequence
  Synthetic oligonucleotide; TTT chr11 5386249 5386270 5386254 5386249 -
ccaaacccatcttttcccagtc

SEQ ID NO: 115023 - DNA, 22 bp, Artificial Sequence
  Synthetic oligonucleotide; TTC chr11 5386248 5386269 5386253 5386248 -
caaacccatcttttcccagtca

SEQ ID NO: 115024 - DNA, 22 bp, Artificial Sequence
  Synthetic oligonucleotide; CTT chr11 5386236 5386257 5386241 5386236 -
ttcccagtcaacacacccatat

SEQ ID NO: 115025 - DNA, 22 bp, Artificial Sequence
  Synthetic oligonucleotide; TTT chr11 5386235 5386256 5386240 5386235 -
tcccagtcaacacacccatatc

SEQ ID NO: 115026 - DNA, 22 bp, Artificial Sequence
  Synthetic oligonucleotide; TTT chr11 5386234 5386255 5386239 5386234 -
cccagtcaacacacccatatca

SEQ ID NO: 115027 - DNA, 22 bp, Artificial Sequence
  Synthetic oligonucleotide; TTC chr11 5386233 5386254 5386238 5386233 -
ccagtcaacacacccatatcat

SEQ ID NO: 115028 - DNA, 22 bp, Artificial Sequence
  Synthetic oligonucleotide; TTT chr11 5386209 5386230 5386214 5386209 -
ttttcttcaattccctacacat

SEQ ID NO: 115029 - DNA, 22 bp, Artificial Sequence
  Synthetic oligonucleotide; TTT chr11 5386208 5386229 5386213 5386208 -
tttcttcaattccctacacata

SEQ ID NO: 115030 - DNA, 22 bp, Artificial Sequence
  Synthetic oligonucleotide; TTT chr11 5386207 5386228 5386212 5386207 -
ttcttcaattccctacacatac

SEQ ID NO: 115031 - DNA, 22 bp, Artificial Sequence
  Synthetic oligonucleotide; TTT chr11 5386206 5386227 5386211 5386206 -
tcttcaattccctacacatact

SEQ ID NO: 115032 - DNA, 22 bp, Artificial Sequence
  Synthetic oligonucleotide; TTT chr11 5386205 5386226 5386210 5386205 -
cttcaattccctacacatactt

SEQ ID NO: 115033 - DNA, 22 bp, Artificial Sequence
  Synthetic oligonucleotide; TTC chr11 5386204 5386225 5386209 5386204 -
ttcaattccctacacatacttt

SEQ ID NO: 115034 - DNA, 22 bp, Artificial Sequence
  Synthetic oligonucleotide; CTT chr11 5386202 5386223 5386207 5386202 -
caattccctacacatacttttc

SEQ ID NO: 115035 - DNA, 22 bp, Artificial Sequence
  Synthetic oligonucleotide; TTC chr11 5386201 5386222 5386206 5386201 -
aattccctacacatacttttct

SEQ ID NO: 115036 - DNA, 22 bp, Artificial Sequence
  Synthetic oligonucleotide; TTC chr11 5386196 5386217 5386201 5386196 -
cctacacatacttttcttgttt

SEQ ID NO: 115037 - DNA, 22 bp, Artificial Sequence
  Synthetic oligonucleotide; CTA chr11 5386192 5386213 5386197 5386192 -
cacatacttttcttgtttttat

SEQ ID NO: 115038 - DNA, 22 bp, Artificial Sequence
  Synthetic oligonucleotide; CTT chr11 5386183 5386204 5386188 5386183 -
ttcttgtttttattcttctata

SEQ ID NO: 115039 - DNA, 22 bp, Artificial Sequence
  Synthetic oligonucleotide; TTT chr11 5386182 5386203 5386187 5386182 -
tcttgtttttattcttctatat

SEQ ID NO: 115040 - DNA, 22 bp, Artificial Sequence
  Synthetic oligonucleotide; TTT chr11 5386181 5386202 5386186 5386181 -
cttgtttttattcttctatatt

SEQ ID NO: 115041 - DNA, 22 bp, Artificial Sequence
  Synthetic oligonucleotide; TTC chr11 5386180 5386201 5386185 5386180 -
ttgtttttattcttctatattt

SEQ ID NO: 115042 - DNA, 22 bp, Artificial Sequence
  Synthetic oligonucleotide; CTT chr11 5386178 5386199 5386183 5386178 -
gtttttattcttctatatttat

SEQ ID NO: 115043 - DNA, 22 bp, Artificial Sequence
  Synthetic oligonucleotide; TTG chr11 5386177 5386198 5386182 5386177 -
tttttattcttctatatttatt

SEQ ID NO: 115044 - DNA, 22 bp, Artificial Sequence
  Synthetic oligonucleotide; TTT chr11 5386174 5386195 5386179 5386174 -
ttattcttctatatttattgct

SEQ ID NO: 115045 - DNA, 22 bp, Artificial Sequence
  Synthetic oligonucleotide; TTT chr11 5386173 5386194 5386178 5386173 -
tattcttctatatttattgctt

SEQ ID NO: 115046 - DNA, 22 bp, Artificial Sequence
  Synthetic oligonucleotide; TTT chr11 5386172 5386193 5386177 5386172 -
attcttctatatttattgcttt

SEQ ID NO: 115047 - DNA, 22 bp, Artificial Sequence
  Synthetic oligonucleotide; TTA chr11 5386171 5386192 5386176 5386171 -
ttcttctatatttattgctttc

SEQ ID NO: 115048 - DNA, 22 bp, Artificial Sequence
  Synthetic oligonucleotide; TTC chr11 5386168 5386189 5386173 5386168 -
ttctatatttattgctttcttg

SEQ ID NO: 115049 - DNA, 22 bp, Artificial Sequence
  Synthetic oligonucleotide; CTT chr11 5386166 5386187 5386171 5386166 -
ctatatttattgctttcttggc

SEQ ID NO: 115050 - DNA, 22 bp, Artificial Sequence
  Synthetic oligonucleotide; TTC chr11 5386165 5386186 5386170 5386165 -
tatatttattgctttcttggca

SEQ ID NO: 115051 - DNA, 22 bp, Artificial Sequence
  Synthetic oligonucleotide; CTA chr11 5386163 5386184 5386168 5386163 -
tatttattgctttcttggcaaa

SEQ ID NO: 115052 - DNA, 22 bp, Artificial Sequence
  Synthetic oligonucleotide; TTT chr11 5386158 5386179 5386163 5386158 -
attgctttcttggcaaaaacca

SEQ ID NO: 115053 - DNA, 22 bp, Artificial Sequence
  Synthetic oligonucleotide; TTA chr11 5386157 5386178 5386162 5386157 -
ttgctttcttggcaaaaaccac

SEQ ID NO: 115054 - DNA, 22 bp, Artificial Sequence
  Synthetic oligonucleotide; TTG chr11 5386154 5386175 5386159 5386154 -
ctttcttggcaaaaaccacccc

SEQ ID NO: 115055 - DNA, 22 bp, Artificial Sequence
  Synthetic oligonucleotide; CTT chr11 5386151 5386172 5386156 5386151 -
tcttggcaaaaaccacccctgt

SEQ ID NO: 115056 - DNA, 22 bp, Artificial Sequence
  Synthetic oligonucleotide; TTT chr11 5386150 5386171 5386155 5386150 -
cttggcaaaaaccacccctgtt

SEQ ID NO: 115057 - DNA, 22 bp, Artificial Sequence
  Synthetic oligonucleotide; TTC chr11 5386149 5386170 5386154 5386149 -
ttggcaaaaaccacccctgttt

SEQ ID NO: 115058 - DNA, 22 bp, Artificial Sequence
  Synthetic oligonucleotide; CTT chr11 5386147 5386168 5386152 5386147 -
ggcaaaaaccacccctgttttt

SEQ ID NO: 115059 - DNA, 22 bp, Artificial Sequence
  Synthetic oligonucleotide; TTG chr11 5386146 5386167 5386151 5386146 -
gcaaaaaccacccctgtttttc

SEQ ID NO: 115060 - DNA, 22 bp, Artificial Sequence
  Synthetic oligonucleotide; CTG chr11 5386130 5386151 5386135 5386130 -
tttttccaaccagtaaacactt

SEQ ID NO: 115061 - DNA, 22 bp, Artificial Sequence
  Synthetic oligonucleotide; TTT chr11 5386127 5386148 5386132 5386127 -
ttccaaccagtaaacacttgcg

SEQ ID NO: 115062 - DNA, 22 bp, Artificial Sequence
  Synthetic oligonucleotide; TTT chr11 5386126 5386147 5386131 5386126 -
tccaaccagtaaacacttgcgg

SEQ ID NO: 115063 - DNA, 22 bp, Artificial Sequence
  Synthetic oligonucleotide; TTT chr11 5386125 5386146 5386130 5386125 -
ccaaccagtaaacacttgcgga

SEQ ID NO: 115064 - DNA, 22 bp, Artificial Sequence
  Synthetic oligonucleotide; TTC chr11 5386124 5386145 5386129 5386124 -
caaccagtaaacacttgcggat

SEQ ID NO: 115065 - DNA, 22 bp, Artificial Sequence
  Synthetic oligonucleotide; CTT chr11 5386108 5386129 5386113 5386108 -
gcggatcctttaagacttagta

SEQ ID NO: 115066 - DNA, 22 bp, Artificial Sequence
  Synthetic oligonucleotide; TTG chr11 5386107 5386128 5386112 5386107 -
cggatcctttaagacttagtac

SEQ ID NO: 115067 - DNA, 22 bp, Artificial Sequence
  Synthetic oligonucleotide; CTT chr11 5386098 5386119 5386103 5386098 -
taagacttagtacaaatatcac

SEQ ID NO: 115068 - DNA, 22 bp, Artificial Sequence
  Synthetic oligonucleotide; TTT chr11 5386097 5386118 5386102 5386097 -
aagacttagtacaaatatcact

SEQ ID NO: 115069 - DNA, 22 bp, Artificial Sequence
  Synthetic oligonucleotide; TTA chr11 5386096 5386117 5386101 5386096 -
agacttagtacaaatatcactt

SEQ ID NO: 115070 - DNA, 22 bp, Artificial Sequence
  Synthetic oligonucleotide; CTT chr11 5386090 5386111 5386095 5386090 -
agtacaaatatcacttcttctg

SEQ ID NO: 115071 - DNA, 22 bp, Artificial Sequence
  Synthetic oligonucleotide; TTA chr11 5386089 5386110 5386094 5386089 -
gtacaaatatcacttcttctgt

SEQ ID NO: 115072 - DNA, 22 bp, Artificial Sequence
  Synthetic oligonucleotide; CTT chr11 5386074 5386095 5386079 5386074 -
cttctgtcaaatctctcctgac

SEQ ID NO: 115073 - DNA, 22 bp, Artificial Sequence
  Synthetic oligonucleotide; TTC chr11 5386073 5386094 5386078 5386073 -
ttctgtcaaatctctcctgact

SEQ ID NO: 115074 - DNA, 22 bp, Artificial Sequence
  Synthetic oligonucleotide; CTT chr11 5386071 5386092 5386076 5386071 -
ctgtcaaatctctcctgacttc

SEQ ID NO: 115075 - DNA, 22 bp, Artificial Sequence
  Synthetic oligonucleotide; TTC chr11 5386070 5386091 5386075 5386070 -
tgtcaaatctctcctgacttcc

SEQ ID NO: 115076 - DNA, 22 bp, Artificial Sequence
  Synthetic oligonucleotide; CTG chr11 5386068 5386089 5386073 5386068 -
tcaaatctctcctgacttcctt

SEQ ID NO: 115077 - DNA, 22 bp, Artificial Sequence
  Synthetic oligonucleotide; CTC chr11 5386059 5386080 5386064 5386059 -
tcctgacttccttctgtagcat

SEQ ID NO: 115078 - DNA, 22 bp, Artificial Sequence
  Synthetic oligonucleotide; CTC chr11 5386057 5386078 5386062 5386057 -
ctgacttccttctgtagcatta

SEQ ID NO: 115079 - DNA, 22 bp, Artificial Sequence
  Synthetic oligonucleotide; CTG chr11 5386054 5386075 5386059 5386054 -
acttccttctgtagcattaggt

SEQ ID NO: 115080 - DNA, 22 bp, Artificial Sequence
  Synthetic oligonucleotide; CTT chr11 5386050 5386071 5386055 5386050 -
ccttctgtagcattaggtacat

SEQ ID NO: 115081 - DNA, 22 bp, Artificial Sequence
  Synthetic oligonucleotide; TTC chr11 5386049 5386070 5386054 5386049 -
cttctgtagcattaggtacatc

SEQ ID NO: 115082 - DNA, 22 bp, Artificial Sequence
  Synthetic oligonucleotide; CTT chr11 5386046 5386067 5386051 5386046 -
ctgtagcattaggtacatcttt

SEQ ID NO: 115083 - DNA, 22 bp, Artificial Sequence
  Synthetic oligonucleotide; TTC chr11 5386045 5386066 5386050 5386045 -
tgtagcattaggtacatctttc

SEQ ID NO: 115084 - DNA, 22 bp, Artificial Sequence
  Synthetic oligonucleotide; CTG chr11 5386043 5386064 5386048 5386043 -
tagcattaggtacatctttctc

SEQ ID NO: 115085 - DNA, 22 bp, Artificial Sequence
  Synthetic oligonucleotide; TTA chr11 5386035 5386056 5386040 5386035 -
ggtacatctttctctgttctca

SEQ ID NO: 115086 - DNA, 22 bp, Artificial Sequence
  Synthetic oligonucleotide; CTT chr11 5386025 5386046 5386030 5386025 -
tctctgttctcacgtagtacct

SEQ ID NO: 115087 - DNA, 22 bp, Artificial Sequence
  Synthetic oligonucleotide; TTT chr11 5386024 5386045 5386029 5386024 -
ctctgttctcacgtagtacctg

SEQ ID NO: 115088 - DNA, 22 bp, Artificial Sequence
  Synthetic oligonucleotide; TTC chr11 5386023 5386044 5386028 5386023 -
tctgttctcacgtagtacctgt

SEQ ID NO: 115089 - DNA, 22 bp, Artificial Sequence
  Synthetic oligonucleotide; CTC chr11 5386021 5386042 5386026 5386021 -
tgttctcacgtagtacctgtaa

SEQ ID NO: 115090 - DNA, 22 bp, Artificial Sequence
  Synthetic oligonucleotide; CTG chr11 5386019 5386040 5386024 5386019 -
ttctcacgtagtacctgtaatg

SEQ ID NO: 115091 - DNA, 22 bp, Artificial Sequence
  Synthetic oligonucleotide; TTC chr11 5386016 5386037 5386021 5386016 -
tcacgtagtacctgtaatgtac

SEQ ID NO: 115092 - DNA, 22 bp, Artificial Sequence
  Synthetic oligonucleotide; CTC chr11 5386014 5386035 5386019 5386014 -
acgtagtacctgtaatgtacta

SEQ ID NO: 115093 - DNA, 22 bp, Artificial Sequence
  Synthetic oligonucleotide; CTG chr11 5386002 5386023 5386007 5386002 -
taatgtactattaaggtgtaaa

SEQ ID NO: 115094 - DNA, 22 bp, Artificial Sequence
  Synthetic oligonucleotide; CTA chr11 5385992 5386013 5385997 5385992 -
ttaaggtgtaaatacacacaca

SEQ ID NO: 115095 - DNA, 22 bp, Artificial Sequence
  Synthetic oligonucleotide; TTA chr11 5385989 5386010 5385994 5385989 -
aggtgtaaatacacacacacat

SEQ ID NO: 115096 - DNA, 22 bp, Artificial Sequence
  Synthetic oligonucleotide; TTC chr11 5385965 5385986 5385970 5385965 -
tttatatttttatatttatata

SEQ ID NO: 115097 - DNA, 22 bp, Artificial Sequence
  Synthetic oligonucleotide; CTT chr11 5385963 5385984 5385968 5385963 -
tatatttttatatttatatata

SEQ ID NO: 115098 - DNA, 22 bp, Artificial Sequence
  Synthetic oligonucleotide; TTT chr11 5385962 5385983 5385967 5385962 -
atatttttatatttatatatac

SEQ ID NO: 115099 - DNA, 22 bp, Artificial Sequence
  Synthetic oligonucleotide; TTA chr11 5385961 5385982 5385966 5385961 -
tatttttatatttatatatact

SEQ ID NO: 115100 - DNA, 22 bp, Artificial Sequence
  Synthetic oligonucleotide; TTT chr11 5385956 5385977 5385961 5385956 -
ttatatttatatatacttattg

SEQ ID NO: 115101 - DNA, 22 bp, Artificial Sequence
  Synthetic oligonucleotide; TTT chr11 5385955 5385976 5385960 5385955 -
tatatttatatatacttattga

SEQ ID NO: 115102 - DNA, 22 bp, Artificial Sequence
  Synthetic oligonucleotide; TTT chr11 5385954 5385975 5385959 5385954 -
atatttatatatacttattgat

SEQ ID NO: 115103 - DNA, 22 bp, Artificial Sequence
  Synthetic oligonucleotide; TTA chr11 5385953 5385974 5385958 5385953 -
tatttatatatacttattgata

SEQ ID NO: 115104 - DNA, 22 bp, Artificial Sequence
  Synthetic oligonucleotide; TTT chr11 5385948 5385969 5385953 5385948 -
atatatacttattgatatatat

SEQ ID NO: 115105 - DNA, 22 bp, Artificial Sequence
  Synthetic oligonucleotide; TTA chr11 5385947 5385968 5385952 5385947 -
tatatacttattgatatatata

SEQ ID NO: 115106 - DNA, 22 bp, Artificial Sequence
  Synthetic oligonucleotide; CTT chr11 5385938 5385959 5385943 5385938 -
attgatatatatatagaacata

SEQ ID NO: 115107 - DNA, 22 bp, Artificial Sequence
  Synthetic oligonucleotide; TTA chr11 5385937 5385958 5385942 5385937 -
ttgatatatatatagaacatac

SEQ ID NO: 115108 - DNA, 22 bp, Artificial Sequence
  Synthetic oligonucleotide; TTG chr11 5385934 5385955 5385939 5385934 -
atatatatatagaacatactta

SEQ ID NO: 115109 - DNA, 22 bp, Artificial Sequence
  Synthetic oligonucleotide; CTT chr11 5385913 5385934 5385918 5385913 -
atacatccatataagtacacat

SEQ ID NO: 115110 - DNA, 22 bp, Artificial Sequence
  Synthetic oligonucleotide; TTA chr11 5385912 5385933 5385917 5385912 -
tacatccatataagtacacata

SEQ ID NO: 115111 - DNA, 22 bp, Artificial Sequence
  Synthetic oligonucleotide; TTT chr11 5385879 5385900 5385884 5385879 -
aaataacatataagtgtataga

SEQ ID NO: 115112 - DNA, 22 bp, Artificial Sequence
  Synthetic oligonucleotide; TTA chr11 5385878 5385899 5385883 5385878 -
aataacatataagtgtatagat

SEQ ID NO: 115113 - DNA, 22 bp, Artificial Sequence
  Synthetic oligonucleotide; TTT chr11 5385854 5385875 5385859 5385854 -
actcataaatactttatagaat

SEQ ID NO: 115114 - DNA, 22 bp, Artificial Sequence
  Synthetic oligonucleotide; TTA chr11 5385853 5385874 5385858 5385853 -
ctcataaatactttatagaata

SEQ ID NO: 115115 - DNA, 22 bp, Artificial Sequence
  Synthetic oligonucleotide; CTC chr11 5385850 5385871 5385855 5385850 -
ataaatactttatagaatatac

SEQ ID NO: 115116 - DNA, 22 bp, Artificial Sequence
  Synthetic oligonucleotide; CTT chr11 5385840 5385861 5385845 5385840 -
tatagaatatacattttagtat

SEQ ID NO: 115117 - DNA, 22 bp, Artificial Sequence
  Synthetic oligonucleotide; TTT chr11 5385839 5385860 5385844 5385839 -
atagaatatacattttagtata

SEQ ID NO: 115118 - DNA, 22 bp, Artificial Sequence
  Synthetic oligonucleotide; TTA chr11 5385838 5385859 5385843 5385838 -
tagaatatacattttagtatat

SEQ ID NO: 115119 - DNA, 22 bp, Artificial Sequence
  Synthetic oligonucleotide; TTT chr11 5385824 5385845 5385829 5385824 -
tagtatatacattatatattct

SEQ ID NO: 115120 - DNA, 22 bp, Artificial Sequence
  Synthetic oligonucleotide; TTT chr11 5385823 5385844 5385828 5385823 -
agtatatacattatatattctt

SEQ ID NO: 115121 - DNA, 22 bp, Artificial Sequence
  Synthetic oligonucleotide; TTA chr11 5385822 5385843 5385827 5385822 -
gtatatacattatatattcttt

SEQ ID NO: 115122 - DNA, 22 bp, Artificial Sequence
  Synthetic oligonucleotide; TTA chr11 5385810 5385831 5385815 5385810 -
tatattctttatatactttata

SEQ ID NO: 115123 - DNA, 22 bp, Artificial Sequence
  Synthetic oligonucleotide; TTC chr11 5385803 5385824 5385808 5385803 -
tttatatactttatagattttt

SEQ ID NO: 115124 - DNA, 22 bp, Artificial Sequence
  Synthetic oligonucleotide; CTT chr11 5385801 5385822 5385806 5385801 -
tatatactttatagatttttta

SEQ ID NO: 115125 - DNA, 22 bp, Artificial Sequence
  Synthetic oligonucleotide; TTT chr11 5385800 5385821 5385805 5385800 -
atatactttatagattttttat

SEQ ID NO: 115126 - DNA, 22 bp, Artificial Sequence
  Synthetic oligonucleotide; TTA chr11 5385799 5385820 5385804 5385799 -
tatactttatagattttttata

SEQ ID NO: 115127 - DNA, 22 bp, Artificial Sequence
  Synthetic oligonucleotide; CTT chr11 5385792 5385813 5385797 5385792 -
tatagattttttatatataagt

SEQ ID NO: 115128 - DNA, 22 bp, Artificial Sequence
  Synthetic oligonucleotide; TTT chr11 5385791 5385812 5385796 5385791 -
atagattttttatatataagta

SEQ ID NO: 115129 - DNA, 22 bp, Artificial Sequence
  Synthetic oligonucleotide; TTA chr11 5385790 5385811 5385795 5385790 -
tagattttttatatataagtat

SEQ ID NO: 115130 - DNA, 22 bp, Artificial Sequence
  Synthetic oligonucleotide; TTT chr11 5385783 5385804 5385788 5385783 -
tttatatataagtatagggtat

SEQ ID NO: 115131 - DNA, 22 bp, Artificial Sequence
  Synthetic oligonucleotide; TTT chr11 5385782 5385803 5385787 5385782 -
ttatatataagtatagggtata

SEQ ID NO: 115132 - DNA, 22 bp, Artificial Sequence
  Synthetic oligonucleotide; TTT chr11 5385781 5385802 5385786 5385781 -
tatatataagtatagggtatac

SEQ ID NO: 115133 - DNA, 22 bp, Artificial Sequence
  Synthetic oligonucleotide; TTT chr11 5385780 5385801 5385785 5385780 -
atatataagtatagggtataca

SEQ ID NO: 115134 - DNA, 22 bp, Artificial Sequence
  Synthetic oligonucleotide; TTA chr11 5385779 5385800 5385784 5385779 -
tatataagtatagggtatacat

SEQ ID NO: 115135 - DNA, 22 bp, Artificial Sequence
  Synthetic oligonucleotide; CTG chr11 5385746 5385767 5385751 5385746 -
tatatttatatatgtaaacaaa

SEQ ID NO: 115136 - DNA, 22 bp, Artificial Sequence
  Synthetic oligonucleotide; TTT chr11 5385739 5385760 5385744 5385739 -
atatatgtaaacaaatatacaa

SEQ ID NO: 115137 - DNA, 22 bp, Artificial Sequence
  Synthetic oligonucleotide; TTA chr11 5385738 5385759 5385743 5385738 -
tatatgtaaacaaatatacaaa

SEQ ID NO: 115138 - DNA, 22 bp, Artificial Sequence
  Synthetic oligonucleotide; TTA chr11 5385709 5385730 5385714 5385709 -
gatatttgtacacatatatata

SEQ ID NO: 115139 - DNA, 22 bp, Artificial Sequence
  Synthetic oligonucleotide; TTT chr11 5385702 5385723 5385707 5385702 -
gtacacatatatatactttgta

SEQ ID NO: 115140 - DNA, 22 bp, Artificial Sequence
  Synthetic oligonucleotide; TTG chr11 5385701 5385722 5385706 5385701 -
tacacatatatatactttgtac

SEQ ID NO: 115141 - DNA, 22 bp, Artificial Sequence
  Synthetic oligonucleotide; CTT chr11 5385684 5385705 5385689 5385684 -
tgtacaacatatatattatagg

SEQ ID NO: 115142 - DNA, 22 bp, Artificial Sequence
  Synthetic oligonucleotide; TTT chr11 5385683 5385704 5385688 5385683 -
gtacaacatatatattataggt

SEQ ID NO: 115143 - DNA, 22 bp, Artificial Sequence
  Synthetic oligonucleotide; TTG chr11 5385682 5385703 5385687 5385682 -
tacaacatatatattataggta

SEQ ID NO: 115144 - DNA, 22 bp, Artificial Sequence
  Synthetic oligonucleotide; TTA chr11 5385666 5385687 5385671 5385666 -
taggtagtatttatacgtattc

SEQ ID NO: 115145 - DNA, 22 bp, Artificial Sequence
  Synthetic oligonucleotide; TTT chr11 5385654 5385675 5385659 5385654 -
atacgtattctttattatacat

SEQ ID NO: 115146 - DNA, 22 bp, Artificial Sequence
  Synthetic oligonucleotide; TTA chr11 5385653 5385674 5385658 5385653 -
tacgtattctttattatacatg

SEQ ID NO: 115147 - DNA, 22 bp, Artificial Sequence
  Synthetic oligonucleotide; TTC chr11 5385644 5385665 5385649 5385644 -
tttattatacatgtttagaaca

SEQ ID NO: 115148 - DNA, 22 bp, Artificial Sequence
  Synthetic oligonucleotide; CTT chr11 5385642 5385663 5385647 5385642 -
tattatacatgtttagaacata

SEQ ID NO: 115149 - DNA, 22 bp, Artificial Sequence
  Synthetic oligonucleotide; TTT chr11 5385641 5385662 5385646 5385641 -
attatacatgtttagaacataa

SEQ ID NO: 115150 - DNA, 22 bp, Artificial Sequence
  Synthetic oligonucleotide; TTA chr11 5385640 5385661 5385645 5385640 -
ttatacatgtttagaacataaa

SEQ ID NO: 115151 - DNA, 22 bp, Artificial Sequence
  Synthetic oligonucleotide; TTA chr11 5385637 5385658 5385642 5385637 -
tacatgtttagaacataaattt

SEQ ID NO: 115152 - DNA, 22 bp, Artificial Sequence
  Synthetic oligonucleotide; TTT chr11 5385628 5385649 5385633 5385628 -
agaacataaatttatattggca

SEQ ID NO: 115153 - DNA, 22 bp, Artificial Sequence
  Synthetic oligonucleotide; TTA chr11 5385627 5385648 5385632 5385627 -
gaacataaatttatattggcaa

SEQ ID NO: 115154 - DNA, 22 bp, Artificial Sequence
  Synthetic oligonucleotide; TTT chr11 5385615 5385636 5385620 5385615 -
atattggcaaaaactgccatta

SEQ ID NO: 115155 - DNA, 22 bp, Artificial Sequence
  Synthetic oligonucleotide; TTA chr11 5385614 5385635 5385619 5385614 -
tattggcaaaaactgccattaa

SEQ ID NO: 115156 - DNA, 22 bp, Artificial Sequence
  Synthetic oligonucleotide; TTG chr11 5385609 5385630 5385614 5385609 -
gcaaaaactgccattaattttt

SEQ ID NO: 115157 - DNA, 22 bp, Artificial Sequence
  Synthetic oligonucleotide; CTG chr11 5385599 5385620 5385604 5385599 -
ccattaatttttcaccaaccta

SEQ ID NO: 115158 - DNA, 22 bp, Artificial Sequence
  Synthetic oligonucleotide; TTA chr11 5385593 5385614 5385598 5385593 -
atttttcaccaacctaataatt

SEQ ID NO: 115159 - DNA, 22 bp, Artificial Sequence
  Synthetic oligonucleotide; TTT chr11 5385589 5385610 5385594 5385589 -
ttcaccaacctaataattcatt

SEQ ID NO: 115160 - DNA, 22 bp, Artificial Sequence
  Synthetic oligonucleotide; TTT chr11 5385588 5385609 5385593 5385588 -
tcaccaacctaataattcattt

SEQ ID NO: 115161 - DNA, 22 bp, Artificial Sequence
  Synthetic oligonucleotide; TTT chr11 5385587 5385608 5385592 5385587 -
caccaacctaataattcatttt

SEQ ID NO: 115162 - DNA, 22 bp, Artificial Sequence
  Synthetic oligonucleotide; TTC chr11 5385586 5385607 5385591 5385586 -
accaacctaataattcattttt

SEQ ID NO: 115163 - DNA, 22 bp, Artificial Sequence
  Synthetic oligonucleotide; CTA chr11 5385577 5385598 5385582 5385577 -
ataattcattttttaagttgat

SEQ ID NO: 115164 - DNA, 22 bp, Artificial Sequence
  Synthetic oligonucleotide; TTC chr11 5385570 5385591 5385575 5385570 -
attttttaagttgattagactg

SEQ ID NO: 115165 - DNA, 22 bp, Artificial Sequence
  Synthetic oligonucleotide; TTT chr11 5385566 5385587 5385571 5385566 -
tttaagttgattagactggaat

SEQ ID NO: 115166 - DNA, 22 bp, Artificial Sequence
  Synthetic oligonucleotide; TTT chr11 5385565 5385586 5385570 5385565 -
ttaagttgattagactggaatt

SEQ ID NO: 115167 - DNA, 22 bp, Artificial Sequence
  Synthetic oligonucleotide; TTT chr11 5385564 5385585 5385569 5385564 -
taagttgattagactggaattc

SEQ ID NO: 115168 - DNA, 22 bp, Artificial Sequence
  Synthetic oligonucleotide; TTT chr11 5385563 5385584 5385568 5385563 -
aagttgattagactggaattct

SEQ ID NO: 115169 - DNA, 22 bp, Artificial Sequence
  Synthetic oligonucleotide; TTA chr11 5385562 5385583 5385567 5385562 -
agttgattagactggaattctc

SEQ ID NO: 115170 - DNA, 22 bp, Artificial Sequence
  Synthetic oligonucleotide; TTG chr11 5385557 5385578 5385562 5385557 -
attagactggaattctctaaag

SEQ ID NO: 115171 - DNA, 22 bp, Artificial Sequence
  Synthetic oligonucleotide; TTA chr11 5385553 5385574 5385558 5385553 -
gactggaattctctaaaggccc

SEQ ID NO: 115172 - DNA, 22 bp, Artificial Sequence
  Synthetic oligonucleotide; CTG chr11 5385548 5385569 5385553 5385548 -
gaattctctaaaggcccctgga

SEQ ID NO: 115173 - DNA, 22 bp, Artificial Sequence
  Synthetic oligonucleotide; TTC chr11 5385542 5385563 5385547 5385542 -
tctaaaggcccctggagcctga

SEQ ID NO: 115174 - DNA, 22 bp, Artificial Sequence
  Synthetic oligonucleotide; CTC chr11 5385540 5385561 5385545 5385540 -
taaaggcccctggagcctgaca

SEQ ID NO: 115175 - DNA, 22 bp, Artificial Sequence
  Synthetic oligonucleotide; CTA chr11 5385538 5385559 5385543 5385538 -
aaggcccctggagcctgacagt

SEQ ID NO: 115176 - DNA, 22 bp, Artificial Sequence
  Synthetic oligonucleotide; CTG chr11 5385528 5385549 5385533 5385528 -
gagcctgacagtgtctaagatg

SEQ ID NO: 115177 - DNA, 22 bp, Artificial Sequence
  Synthetic oligonucleotide; CTG chr11 5385521 5385542 5385526 5385521 -
acagtgtctaagatgtggtagg

SEQ ID NO: 115178 - DNA, 22 bp, Artificial Sequence
  Synthetic oligonucleotide; CTA chr11 5385511 5385532 5385516 5385511 -
agatgtggtaggtaccactata

SEQ ID NO: 115179 - DNA, 22 bp, Artificial Sequence
  Synthetic oligonucleotide; CTA chr11 5385491 5385512 5385496 5385491 -
tatatatatttttttgcatgaa

SEQ ID NO: 115180 - DNA, 22 bp, Artificial Sequence
  Synthetic oligonucleotide; TTT chr11 5385480 5385501 5385485 5385480 -
ttttgcatgaaaaactaaatgg

SEQ ID NO: 115181 - DNA, 22 bp, Artificial Sequence
  Synthetic oligonucleotide; TTT chr11 5385479 5385500 5385484 5385479 -
tttgcatgaaaaactaaatggg

SEQ ID NO: 115182 - DNA, 22 bp, Artificial Sequence
  Synthetic oligonucleotide; TTT chr11 5385478 5385499 5385483 5385478 -
ttgcatgaaaaactaaatgggt

SEQ ID NO: 115183 - DNA, 22 bp, Artificial Sequence
  Synthetic oligonucleotide; TTT chr11 5385477 5385498 5385482 5385477 -
tgcatgaaaaactaaatgggtg

SEQ ID NO: 115184 - DNA, 22 bp, Artificial Sequence
  Synthetic oligonucleotide; TTT chr11 5385476 5385497 5385481 5385476 -
gcatgaaaaactaaatgggtga

SEQ ID NO: 115185 - DNA, 22 bp, Artificial Sequence
  Synthetic oligonucleotide; TTG chr11 5385475 5385496 5385480 5385475 -
catgaaaaactaaatgggtgaa

SEQ ID NO: 115186 - DNA, 22 bp, Artificial Sequence
  Synthetic oligonucleotide; CTA chr11 5385463 5385484 5385468 5385463 -
aatgggtgaataaataaagtac

SEQ ID NO: 115187 - DNA, 22 bp, Artificial Sequence
  Synthetic oligonucleotide; CTC chr11 5385439 5385460 5385444 5385439 -
acctcttatcctgattctttgt

SEQ ID NO: 115188 - DNA, 22 bp, Artificial Sequence
  Synthetic oligonucleotide; CTC chr11 5385434 5385455 5385439 5385434 -
ttatcctgattctttgtgcctg

SEQ ID NO: 115189 - DNA, 22 bp, Artificial Sequence
  Synthetic oligonucleotide; CTT chr11 5385432 5385453 5385437 5385432 -
atcctgattctttgtgcctggg

SEQ ID NO: 115190 - DNA, 22 bp, Artificial Sequence
  Synthetic oligonucleotide; TTA chr11 5385431 5385452 5385436 5385431 -
tcctgattctttgtgcctgggg

SEQ ID NO: 115191 - DNA, 22 bp, Artificial Sequence
  Synthetic oligonucleotide; CTG chr11 5385426 5385447 5385431 5385426 -
attctttgtgcctggggttctg

SEQ ID NO: 115192 - DNA, 22 bp, Artificial Sequence
  Synthetic oligonucleotide; TTC chr11 5385422 5385443 5385427 5385422 -
tttgtgcctggggttctgttgt

SEQ ID NO: 115193 - DNA, 22 bp, Artificial Sequence
  Synthetic oligonucleotide; CTT chr11 5385420 5385441 5385425 5385420 -
tgtgcctggggttctgttgtca

SEQ ID NO: 115194 - DNA, 22 bp, Artificial Sequence
  Synthetic oligonucleotide; TTT chr11 5385419 5385440 5385424 5385419 -
gtgcctggggttctgttgtcag

SEQ ID NO: 115195 - DNA, 22 bp, Artificial Sequence
  Synthetic oligonucleotide; TTG chr11 5385418 5385439 5385423 5385418 -
tgcctggggttctgttgtcagc

SEQ ID NO: 115196 - DNA, 22 bp, Artificial Sequence
  Synthetic oligonucleotide; CTG chr11 5385412 5385433 5385417 5385412 -
gggttctgttgtcagctctgtg

SEQ ID NO: 115197 - DNA, 22 bp, Artificial Sequence
  Synthetic oligonucleotide; TTC chr11 5385406 5385427 5385411 5385406 -
tgttgtcagctctgtgttcacc

SEQ ID NO: 115198 - DNA, 22 bp, Artificial Sequence
  Synthetic oligonucleotide; CTG chr11 5385404 5385425 5385409 5385404 -
ttgtcagctctgtgttcaccaa

SEQ ID NO: 115199 - DNA, 22 bp, Artificial Sequence
  Synthetic oligonucleotide; TTG chr11 5385401 5385422 5385406 5385401 -
tcagctctgtgttcaccaactt

SEQ ID NO: 115200 - DNA, 22 bp, Artificial Sequence
  Synthetic oligonucleotide; CTC chr11 5385394 5385415 5385399 5385394 -
tgtgttcaccaacttcagagtg

SEQ ID NO: 115201 - DNA, 22 bp, Artificial Sequence
  Synthetic oligonucleotide; CTG chr11 5385392 5385413 5385397 5385392 -
tgttcaccaacttcagagtgat

SEQ ID NO: 115202 - DNA, 22 bp, Artificial Sequence
  Synthetic oligonucleotide; TTC chr11 5385387 5385408 5385392 5385387 -
accaacttcagagtgatgagat

SEQ ID NO: 115203 - DNA, 22 bp, Artificial Sequence
  Synthetic oligonucleotide; CTT chr11 5385379 5385400 5385384 5385379 -
cagagtgatgagatggacaggg

SEQ ID NO: 115204 - DNA, 22 bp, Artificial Sequence
  Synthetic oligonucleotide; TTC chr11 5385378 5385399 5385383 5385378 -
agagtgatgagatggacaggga

SEQ ID NO: 115205 - DNA, 22 bp, Artificial Sequence
  Synthetic oligonucleotide; CTG chr11 5385346 5385367 5385351 5385346 -
gtagaaacaagatgtctataca

SEQ ID NO: 115206 - DNA, 22 bp, Artificial Sequence
  Synthetic oligonucleotide; CTA chr11 5385328 5385349 5385333 5385328 -
tacagagacaatgacagggctg

SEQ ID NO: 115207 - DNA, 22 bp, Artificial Sequence
  Synthetic oligonucleotide; CTG chr11 5385306 5385327 5385311 5385306 -
ggattatttctcttggaaagta

SEQ ID NO: 115208 - DNA, 22 bp, Artificial Sequence
  Synthetic oligonucleotide; TTA chr11 5385300 5385321 5385305 5385300 -
tttctcttggaaagtatacttc

SEQ ID NO: 115209 - DNA, 22 bp, Artificial Sequence
  Synthetic oligonucleotide; TTT chr11 5385297 5385318 5385302 5385297 -
ctcttggaaagtatacttcctc

SEQ ID NO: 115210 - DNA, 22 bp, Artificial Sequence
  Synthetic oligonucleotide; TTC chr11 5385296 5385317 5385301 5385296 -
tcttggaaagtatacttcctct

SEQ ID NO: 115211 - DNA, 22 bp, Artificial Sequence
  Synthetic oligonucleotide; CTC chr11 5385294 5385315 5385299 5385294 -
ttggaaagtatacttcctcttg

SEQ ID NO: 115212 - DNA, 22 bp, Artificial Sequence
  Synthetic oligonucleotide; CTT chr11 5385292 5385313 5385297 5385292 -
ggaaagtatacttcctcttggg

SEQ ID NO: 115213 - DNA, 22 bp, Artificial Sequence
  Synthetic oligonucleotide; TTG chr11 5385291 5385312 5385296 5385291 -
gaaagtatacttcctcttggga

SEQ ID NO: 115214 - DNA, 22 bp, Artificial Sequence
  Synthetic oligonucleotide; CTT chr11 5385279 5385300 5385284 5385279 -
cctcttgggaagaaagctttag

SEQ ID NO: 115215 - DNA, 22 bp, Artificial Sequence
  Synthetic oligonucleotide; TTC chr11 5385278 5385299 5385283 5385278 -
ctcttgggaagaaagctttagg

SEQ ID NO: 115216 - DNA, 22 bp, Artificial Sequence
  Synthetic oligonucleotide; CTC chr11 5385275 5385296 5385280 5385275 -
ttgggaagaaagctttagggga

SEQ ID NO: 115217 - DNA, 22 bp, Artificial Sequence
  Synthetic oligonucleotide; CTT chr11 5385273 5385294 5385278 5385273 -
gggaagaaagctttaggggatt

SEQ ID NO: 115218 - DNA, 22 bp, Artificial Sequence
  Synthetic oligonucleotide; TTG chr11 5385272 5385293 5385277 5385272 -
ggaagaaagctttaggggattt

SEQ ID NO: 115219 - DNA, 22 bp, Artificial Sequence
  Synthetic oligonucleotide; CTT chr11 5385260 5385281 5385265 5385260 -
taggggatttctcctagcaaga

SEQ ID NO: 115220 - DNA, 22 bp, Artificial Sequence
  Synthetic oligonucleotide; TTT chr11 5385259 5385280 5385264 5385259 -
aggggatttctcctagcaagag

SEQ ID NO: 115221 - DNA, 22 bp, Artificial Sequence
  Synthetic oligonucleotide; TTA chr11 5385258 5385279 5385263 5385258 -
ggggatttctcctagcaagaga

SEQ ID NO: 115222 - DNA, 22 bp, Artificial Sequence
  Synthetic oligonucleotide; TTT chr11 5385250 5385271 5385255 5385250 -
ctcctagcaagagagataatta

SEQ ID NO: 115223 - DNA, 22 bp, Artificial Sequence
  Synthetic oligonucleotide; TTC chr11 5385249 5385270 5385254 5385249 -
tcctagcaagagagataattat

SEQ ID NO: 115224 - DNA, 22 bp, Artificial Sequence
  Synthetic oligonucleotide; CTC chr11 5385247 5385268 5385252 5385247 -
ctagcaagagagataattatcc

SEQ ID NO: 115225 - DNA, 22 bp, Artificial Sequence
  Synthetic oligonucleotide; CTA chr11 5385244 5385265 5385249 5385244 -
gcaagagagataattatccatg

SEQ ID NO: 115226 - DNA, 22 bp, Artificial Sequence
  Synthetic oligonucleotide; TTA chr11 5385228 5385249 5385233 5385228 -
tccatgataggagagcaacagt

SEQ ID NO: 115227 - DNA, 22 bp, Artificial Sequence
  Synthetic oligonucleotide; TTT chr11 5385201 5385222 5385206 5385201 -
tttcatgtctactaagcaatgg

SEQ ID NO: 115228 - DNA, 22 bp, Artificial Sequence
  Synthetic oligonucleotide; TTT chr11 5385200 5385221 5385205 5385200 -
ttcatgtctactaagcaatgga

SEQ ID NO: 115229 - DNA, 22 bp, Artificial Sequence
  Synthetic oligonucleotide; TTT chr11 5385199 5385220 5385204 5385199 -
tcatgtctactaagcaatggag

SEQ ID NO: 115230 - DNA, 22 bp, Artificial Sequence
  Synthetic oligonucleotide; TTT chr11 5385198 5385219 5385203 5385198 -
catgtctactaagcaatggagg

SEQ ID NO: 115231 - DNA, 22 bp, Artificial Sequence
  Synthetic oligonucleotide; TTC chr11 5385197 5385218 5385202 5385197 -
atgtctactaagcaatggagga

SEQ ID NO: 115232 - DNA, 22 bp, Artificial Sequence
  Synthetic oligonucleotide; CTA chr11 5385190 5385211 5385195 5385190 -
ctaagcaatggaggagtccact

SEQ ID NO: 115233 - DNA, 22 bp, Artificial Sequence
  Synthetic oligonucleotide; CTA chr11 5385187 5385208 5385192 5385187 -
agcaatggaggagtccactcag

SEQ ID NO: 115234 - DNA, 22 bp, Artificial Sequence
  Synthetic oligonucleotide; CTC chr11 5385167 5385188 5385172 5385167 -
agagcagtcagttacatctaat

SEQ ID NO: 115235 - DNA, 22 bp, Artificial Sequence
  Synthetic oligonucleotide; TTA chr11 5385153 5385174 5385158 5385153 -
catctaattacaacataattaa

SEQ ID NO: 115236 - DNA, 22 bp, Artificial Sequence
  Synthetic oligonucleotide; CTA chr11 5385147 5385168 5385152 5385147 -
attacaacataattaaaatatt

SEQ ID NO: 115237 - DNA, 22 bp, Artificial Sequence
  Synthetic oligonucleotide; TTA chr11 5385143 5385164 5385148 5385143 -
caacataattaaaatattcaag

SEQ ID NO: 115238 - DNA, 22 bp, Artificial Sequence
  Synthetic oligonucleotide; TTA chr11 5385132 5385153 5385137 5385132 -
aaatattcaaggcagagtagat

SEQ ID NO: 115239 - DNA, 22 bp, Artificial Sequence
  Synthetic oligonucleotide; TTC chr11 5385124 5385145 5385129 5385124 -
aaggcagagtagattcatctta

SEQ ID NO: 115240 - DNA, 22 bp, Artificial Sequence
  Synthetic oligonucleotide; TTC chr11 5385108 5385129 5385113 5385108 -
atcttagatcacaggagaaaat

SEQ ID NO: 115241 - DNA, 22 bp, Artificial Sequence
  Synthetic oligonucleotide; CTT chr11 5385103 5385124 5385108 5385103 -
agatcacaggagaaaattcctg

SEQ ID NO: 115242 - DNA, 22 bp, Artificial Sequence
  Synthetic oligonucleotide; TTA chr11 5385102 5385123 5385107 5385102 -
gatcacaggagaaaattcctga

SEQ ID NO: 115243 - DNA, 22 bp, Artificial Sequence
  Synthetic oligonucleotide; TTC chr11 5385084 5385105 5385089 5385084 -
ctgaaaagagattttcagtata

SEQ ID NO: 115244 - DNA, 22 bp, Artificial Sequence
  Synthetic oligonucleotide; CTG chr11 5385081 5385102 5385086 5385081 -
aaaagagattttcagtatacaa

SEQ ID NO: 115245 - DNA, 22 bp, Artificial Sequence
  Synthetic oligonucleotide; TTT chr11 5385070 5385091 5385075 5385070 -
tcagtatacaatgagtaattgg

SEQ ID NO: 115246 - DNA, 22 bp, Artificial Sequence
  Synthetic oligonucleotide; TTT chr11 5385069 5385090 5385074 5385069 -
cagtatacaatgagtaattggc

SEQ ID NO: 115247 - DNA, 22 bp, Artificial Sequence
  Synthetic oligonucleotide; TTC chr11 5385068 5385089 5385073 5385068 -
agtatacaatgagtaattggct

SEQ ID NO: 115248 - DNA, 22 bp, Artificial Sequence
  Synthetic oligonucleotide; TTG chr11 5385049 5385070 5385054 5385049 -
gctctctacctcacctgtgtct

SEQ ID NO: 115249 - DNA, 22 bp, Artificial Sequence
  Synthetic oligonucleotide; CTC chr11 5385045 5385066 5385050 5385045 -
tctacctcacctgtgtctaaat

SEQ ID NO: 115250 - DNA, 22 bp, Artificial Sequence
  Synthetic oligonucleotide; CTC chr11 5385043 5385064 5385048 5385043 -
tacctcacctgtgtctaaatat

SEQ ID NO: 115251 - DNA, 22 bp, Artificial Sequence
  Synthetic oligonucleotide; CTA chr11 5385041 5385062 5385046 5385041 -
cctcacctgtgtctaaatattc

SEQ ID NO: 115252 - DNA, 22 bp, Artificial Sequence
  Synthetic oligonucleotide; CTC chr11 5385037 5385058 5385042 5385037 -
acctgtgtctaaatattctttt

SEQ ID NO: 115253 - DNA, 22 bp, Artificial Sequence
  Synthetic oligonucleotide; CTG chr11 5385032 5385053 5385037 5385032 -
tgtctaaatattcttttgtttg

SEQ ID NO: 115254 - DNA, 22 bp, Artificial Sequence
  Synthetic oligonucleotide; CTA chr11 5385026 5385047 5385031 5385026 -
aatattcttttgtttgaattta

SEQ ID NO: 115255 - DNA, 22 bp, Artificial Sequence
  Synthetic oligonucleotide; TTC chr11 5385019 5385040 5385024 5385019 -
ttttgtttgaatttaatattag

SEQ ID NO: 115256 - DNA, 22 bp, Artificial Sequence
  Synthetic oligonucleotide; CTT chr11 5385017 5385038 5385022 5385017 -
ttgtttgaatttaatattagtt

SEQ ID NO: 115257 - DNA, 22 bp, Artificial Sequence
  Synthetic oligonucleotide; TTT chr11 5385016 5385037 5385021 5385016 -
tgtttgaatttaatattagtta

SEQ ID NO: 115258 - DNA, 22 bp, Artificial Sequence
  Synthetic oligonucleotide; TTT chr11 5385015 5385036 5385020 5385015 -
gtttgaatttaatattagttat

SEQ ID NO: 115259 - DNA, 22 bp, Artificial Sequence
  Synthetic oligonucleotide; TTG chr11 5385014 5385035 5385019 5385014 -
tttgaatttaatattagttatt

SEQ ID NO: 115260 - DNA, 22 bp, Artificial Sequence
  Synthetic oligonucleotide; TTT chr11 5385011 5385032 5385016 5385011 -
gaatttaatattagttattttt

SEQ ID NO: 115261 - DNA, 22 bp, Artificial Sequence
  Synthetic oligonucleotide; TTG chr11 5385010 5385031 5385015 5385010 -
aatttaatattagttatttttt

SEQ ID NO: 115262 - DNA, 22 bp, Artificial Sequence
  Synthetic oligonucleotide; TTT chr11 5385005 5385026 5385010 5385005 -
aatattagttattttttaatga

SEQ ID NO: 115263 - DNA, 22 bp, Artificial Sequence
  Synthetic oligonucleotide; TTA chr11 5385004 5385025 5385009 5385004 -
atattagttattttttaatgaa

SEQ ID NO: 115264 - DNA, 22 bp, Artificial Sequence
  Synthetic oligonucleotide; TTA chr11 5384998 5385019 5385003 5384998 -
gttattttttaatgaactacat

SEQ ID NO: 115265 - DNA, 22 bp, Artificial Sequence
  Synthetic oligonucleotide; TTA chr11 5384994 5385015 5384999 5384994 -
ttttttaatgaactacattggt

SEQ ID NO: 115266 - DNA, 22 bp, Artificial Sequence
  Synthetic oligonucleotide; TTT chr11 5384991 5385012 5384996 5384991 -
tttaatgaactacattggtgga

SEQ ID NO: 115267 - DNA, 22 bp, Artificial Sequence
  Synthetic oligonucleotide; TTT chr11 5384990 5385011 5384995 5384990 -
ttaatgaactacattggtggag

SEQ ID NO: 115268 - DNA, 22 bp, Artificial Sequence
  Synthetic oligonucleotide; TTT chr11 5384989 5385010 5384994 5384989 -
taatgaactacattggtggagg

SEQ ID NO: 115269 - DNA, 22 bp, Artificial Sequence
  Synthetic oligonucleotide; TTT chr11 5384988 5385009 5384993 5384988 -
aatgaactacattggtggagga

SEQ ID NO: 115270 - DNA, 22 bp, Artificial Sequence
  Synthetic oligonucleotide; TTA chr11 5384987 5385008 5384992 5384987 -
atgaactacattggtggaggat

SEQ ID NO: 115271 - DNA, 22 bp, Artificial Sequence
  Synthetic oligonucleotide; CTA chr11 5384979 5385000 5384984 5384979 -
cattggtggaggatactgtttc

SEQ ID NO: 115272 - DNA, 22 bp, Artificial Sequence
  Synthetic oligonucleotide; TTG chr11 5384974 5384995 5384979 5384974 -
gtggaggatactgtttcttgta

SEQ ID NO: 115273 - DNA, 22 bp, Artificial Sequence
  Synthetic oligonucleotide; CTG chr11 5384961 5384982 5384966 5384961 -
tttcttgtaaataggagaatat

SEQ ID NO: 115274 - DNA, 22 bp, Artificial Sequence
  Synthetic oligonucleotide; TTT chr11 5384958 5384979 5384963 5384958 -
cttgtaaataggagaatatgca

SEQ ID NO: 115275 - DNA, 22 bp, Artificial Sequence
  Synthetic oligonucleotide; TTC chr11 5384957 5384978 5384962 5384957 -
ttgtaaataggagaatatgcaa

SEQ ID NO: 115276 - DNA, 22 bp, Artificial Sequence
  Synthetic oligonucleotide; CTT chr11 5384955 5384976 5384960 5384955 -
gtaaataggagaatatgcaaaa

SEQ ID NO: 115277 - DNA, 22 bp, Artificial Sequence
  Synthetic oligonucleotide; TTG chr11 5384954 5384975 5384959 5384954 -
taaataggagaatatgcaaaag

SEQ ID NO: 115278 - DNA, 22 bp, Artificial Sequence
  Synthetic oligonucleotide; CTG chr11 5384926 5384947 5384931 5384926 -
cacctaaacacaaggacttgaa

SEQ ID NO: 115279 - DNA, 22 bp, Artificial Sequence
  Synthetic oligonucleotide; CTA chr11 5384920 5384941 5384925 5384920 -
aacacaaggacttgaaccagat

SEQ ID NO: 115280 - DNA, 22 bp, Artificial Sequence
  Synthetic oligonucleotide; CTT chr11 5384907 5384928 5384912 5384907 -
gaaccagattattcatttttga

SEQ ID NO: 115281 - DNA, 22 bp, Artificial Sequence
  Synthetic oligonucleotide; TTG chr11 5384906 5384927 5384911 5384906 -
aaccagattattcatttttgaa

SEQ ID NO: 115282 - DNA, 22 bp, Artificial Sequence
  Synthetic oligonucleotide; TTA chr11 5384896 5384917 5384901 5384896 -
ttcatttttgaacccctagaga

SEQ ID NO: 115283 - DNA, 22 bp, Artificial Sequence
  Synthetic oligonucleotide; TTC chr11 5384893 5384914 5384898 5384893 -
atttttgaacccctagagaaca

SEQ ID NO: 115284 - DNA, 22 bp, Artificial Sequence
  Synthetic oligonucleotide; TTT chr11 5384889 5384910 5384894 5384889 -
ttgaacccctagagaacatttc

SEQ ID NO: 115285 - DNA, 22 bp, Artificial Sequence
  Synthetic oligonucleotide; TTT chr11 5384888 5384909 5384893 5384888 -
tgaacccctagagaacatttcc

SEQ ID NO: 115286 - DNA, 22 bp, Artificial Sequence
  Synthetic oligonucleotide; TTT chr11 5384887 5384908 5384892 5384887 -
gaacccctagagaacatttcca

SEQ ID NO: 115287 - DNA, 22 bp, Artificial Sequence
  Synthetic oligonucleotide; TTG chr11 5384886 5384907 5384891 5384886 -
aacccctagagaacatttccac

SEQ ID NO: 115288 - DNA, 22 bp, Artificial Sequence
  Synthetic oligonucleotide; CTA chr11 5384878 5384899 5384883 5384878 -
gagaacatttccacagtggtca

SEQ ID NO: 115289 - DNA, 22 bp, Artificial Sequence
  Synthetic oligonucleotide; TTT chr11 5384868 5384889 5384873 5384868 -
ccacagtggtcaaactcatctg

SEQ ID NO: 115290 - DNA, 22 bp, Artificial Sequence
  Synthetic oligonucleotide; TTC chr11 5384867 5384888 5384872 5384867 -
cacagtggtcaaactcatctgt

SEQ ID NO: 115291 - DNA, 22 bp, Artificial Sequence
  Synthetic oligonucleotide; CTC chr11 5384851 5384872 5384856 5384851 -
atctgtaaacatgcctgttttt

SEQ ID NO: 115292 - DNA, 22 bp, Artificial Sequence
  Synthetic oligonucleotide; CTG chr11 5384846 5384867 5384851 5384846 -
taaacatgcctgtttttagtag

SEQ ID NO: 115293 - DNA, 22 bp, Artificial Sequence
  Synthetic oligonucleotide; CTG chr11 5384834 5384855 5384839 5384834 -
tttttagtaggatagaggagga

SEQ ID NO: 115294 - DNA, 22 bp, Artificial Sequence
  Synthetic oligonucleotide; TTT chr11 5384831 5384852 5384836 5384831 -
ttagtaggatagaggaggattt

SEQ ID NO: 115295 - DNA, 22 bp, Artificial Sequence
  Synthetic oligonucleotide; TTT chr11 5384830 5384851 5384835 5384830 -
tagtaggatagaggaggatttt

SEQ ID NO: 115296 - DNA, 22 bp, Artificial Sequence
  Synthetic oligonucleotide; TTT chr11 5384829 5384850 5384834 5384829 -
agtaggatagaggaggattttg

SEQ ID NO: 115297 - DNA, 22 bp, Artificial Sequence
  Synthetic oligonucleotide; TTA chr11 5384828 5384849 5384833 5384828 -
gtaggatagaggaggattttgg

SEQ ID NO: 115298 - DNA, 22 bp, Artificial Sequence
  Synthetic oligonucleotide; TTT chr11 5384809 5384830 5384814 5384809 -
tggaaggcgaaggccatatcct

SEQ ID NO: 115299 - DNA, 22 bp, Artificial Sequence
  Synthetic oligonucleotide; TTT chr11 5384808 5384829 5384813 5384808 -
ggaaggcgaaggccatatcctg

SEQ ID NO: 115300 - DNA, 22 bp, Artificial Sequence
  Synthetic oligonucleotide; TTG chr11 5384807 5384828 5384812 5384807 -
gaaggcgaaggccatatcctgg

SEQ ID NO: 115301 - DNA, 22 bp, Artificial Sequence
  Synthetic oligonucleotide; CTG chr11 5384786 5384807 5384791 5384786 -
gatactggggaagttacaaggt

SEQ ID NO: 115302 - DNA, 22 bp, Artificial Sequence
  Synthetic oligonucleotide; CTG chr11 5384779 5384800 5384784 5384779 -
gggaagttacaaggtgttgttt

SEQ ID NO: 115303 - DNA, 22 bp, Artificial Sequence
  Synthetic oligonucleotide; TTA chr11 5384770 5384791 5384775 5384770 -
caaggtgttgtttggattaaaa

SEQ ID NO: 115304 - DNA, 22 bp, Artificial Sequence
  Synthetic oligonucleotide; TTG chr11 5384760 5384781 5384765 5384760 -
tttggattaaaataagcagatt

SEQ ID NO: 115305 - DNA, 22 bp, Artificial Sequence
  Synthetic oligonucleotide; TTT chr11 5384757 5384778 5384762 5384757 -
ggattaaaataagcagattgag

SEQ ID NO: 115306 - DNA, 22 bp, Artificial Sequence
  Synthetic oligonucleotide; TTG chr11 5384756 5384777 5384761 5384756 -
gattaaaataagcagattgagg

SEQ ID NO: 115307 - DNA, 22 bp, Artificial Sequence
  Synthetic oligonucleotide; TTA chr11 5384751 5384772 5384756 5384751 -
aaataagcagattgaggatggg

SEQ ID NO: 115308 - DNA, 22 bp, Artificial Sequence
  Synthetic oligonucleotide; TTG chr11 5384737 5384758 5384742 5384737 -
aggatggggtcttttctatgtt

SEQ ID NO: 115309 - DNA, 22 bp, Artificial Sequence
  Synthetic oligonucleotide; CTT chr11 5384724 5384745 5384729 5384724 -
ttctatgttaactggaccagca

SEQ ID NO: 115310 - DNA, 22 bp, Artificial Sequence
  Synthetic oligonucleotide; TTT chr11 5384723 5384744 5384728 5384723 -
tctatgttaactggaccagcat

SEQ ID NO: 115311 - DNA, 22 bp, Artificial Sequence
  Synthetic oligonucleotide; TTT chr11 5384722 5384743 5384727 5384722 -
ctatgttaactggaccagcata

SEQ ID NO: 115312 - DNA, 22 bp, Artificial Sequence
  Synthetic oligonucleotide; TTC chr11 5384721 5384742 5384726 5384721 -
tatgttaactggaccagcatat

SEQ ID NO: 115313 - DNA, 22 bp, Artificial Sequence
  Synthetic oligonucleotide; CTA chr11 5384719 5384740 5384724 5384719 -
tgttaactggaccagcatataa

SEQ ID NO: 115314 - DNA, 22 bp, Artificial Sequence
  Synthetic oligonucleotide; TTA chr11 5384714 5384735 5384719 5384714 -
actggaccagcatataaaatgc

SEQ ID NO: 115315 - DNA, 22 bp, Artificial Sequence
  Synthetic oligonucleotide; CTG chr11 5384710 5384731 5384715 5384710 -
gaccagcatataaaatgcattt

SEQ ID NO: 115316 - DNA, 22 bp, Artificial Sequence
  Synthetic oligonucleotide; TTT chr11 5384688 5384709 5384693 5384688 -
aataatttgttgaataagtgaa

SEQ ID NO: 115317 - DNA, 22 bp, Artificial Sequence
  Synthetic oligonucleotide; TTA chr11 5384687 5384708 5384692 5384687 -
ataatttgttgaataagtgaat

SEQ ID NO: 115318 - DNA, 22 bp, Artificial Sequence
  Synthetic oligonucleotide; TTT chr11 5384680 5384701 5384685 5384680 -
gttgaataagtgaatgactgtt

SEQ ID NO: 115319 - DNA, 22 bp, Artificial Sequence
  Synthetic oligonucleotide; TTG chr11 5384679 5384700 5384684 5384679 -
ttgaataagtgaatgactgttt

SEQ ID NO: 115320 - DNA, 22 bp, Artificial Sequence
  Synthetic oligonucleotide; TTG chr11 5384676 5384697 5384681 5384676 -
aataagtgaatgactgtttttc

SEQ ID NO: 115321 - DNA, 22 bp, Artificial Sequence
  Synthetic oligonucleotide; CTG chr11 5384660 5384681 5384665 5384660 -
tttttctgatgagagtaaggag

SEQ ID NO: 115322 - DNA, 22 bp, Artificial Sequence
  Synthetic oligonucleotide; TTT chr11 5384657 5384678 5384662 5384657 -
ttctgatgagagtaaggagagg

SEQ ID NO: 115323 - DNA, 22 bp, Artificial Sequence
  Synthetic oligonucleotide; TTT chr11 5384656 5384677 5384661 5384656 -
tctgatgagagtaaggagaggg

SEQ ID NO: 115324 - DNA, 22 bp, Artificial Sequence
  Synthetic oligonucleotide; TTT chr11 5384655 5384676 5384660 5384655 -
ctgatgagagtaaggagagggt

SEQ ID NO: 115325 - DNA, 22 bp, Artificial Sequence
  Synthetic oligonucleotide; TTC chr11 5384654 5384675 5384659 5384654 -
tgatgagagtaaggagagggtg

SEQ ID NO: 115326 - DNA, 22 bp, Artificial Sequence
  Synthetic oligonucleotide; CTG chr11 5384652 5384673 5384657 5384652 -
atgagagtaaggagagggtgtg

SEQ ID NO: 115327 - DNA, 22 bp, Artificial Sequence
  Synthetic oligonucleotide; CTC chr11 5384615 5384636 5384620 5384615 -
ggcaggaaagagtatagagacc

SEQ ID NO: 115328 - DNA, 22 bp, Artificial Sequence
  Synthetic oligonucleotide; CTT chr11 5384584 5384605 5384589 5384584 -
ctgccatcctgacttctagaca

SEQ ID NO: 115329 - DNA, 22 bp, Artificial Sequence
  Synthetic oligonucleotide; TTC chr11 5384583 5384604 5384588 5384583 -
tgccatcctgacttctagacat

SEQ ID NO: 115330 - DNA, 22 bp, Artificial Sequence
  Synthetic oligonucleotide; CTG chr11 5384581 5384602 5384586 5384581 -
ccatcctgacttctagacatga

SEQ ID NO: 115331 - DNA, 22 bp, Artificial Sequence
  Synthetic oligonucleotide; CTG chr11 5384573 5384594 5384578 5384573 -
acttctagacatgatccaggga

SEQ ID NO: 115332 - DNA, 22 bp, Artificial Sequence
  Synthetic oligonucleotide; CTT chr11 5384569 5384590 5384574 5384569 -
ctagacatgatccagggagggg

SEQ ID NO: 115333 - DNA, 22 bp, Artificial Sequence
  Synthetic oligonucleotide; TTC chr11 5384568 5384589 5384573 5384568 -
tagacatgatccagggaggggc

SEQ ID NO: 115334 - DNA, 22 bp, Artificial Sequence
  Synthetic oligonucleotide; CTA chr11 5384566 5384587 5384571 5384566 -
gacatgatccagggaggggctg

SEQ ID NO: 115335 - DNA, 22 bp, Artificial Sequence
  Synthetic oligonucleotide; CTG chr11 5384544 5384565 5384549 5384544 -
gcctggccatgcaggcactcat

SEQ ID NO: 115336 - DNA, 22 bp, Artificial Sequence
  Synthetic oligonucleotide; CTG chr11 5384539 5384560 5384544 5384539 -
gccatgcaggcactcatcaggg

SEQ ID NO: 115337 - DNA, 22 bp, Artificial Sequence
  Synthetic oligonucleotide; CTC chr11 5384524 5384545 5384529 5384524 -
atcaggggagtgaggcagccct

SEQ ID NO: 115338 - DNA, 22 bp, Artificial Sequence
  Synthetic oligonucleotide; CTG chr11 5384501 5384522 5384506 5384501 -
cctcctggccttcctaacagaa

SEQ ID NO: 115339 - DNA, 22 bp, Artificial Sequence
  Synthetic oligonucleotide; CTC chr11 5384497 5384518 5384502 5384497 -
ctggccttcctaacagaatact

SEQ ID NO: 115340 - DNA, 22 bp, Artificial Sequence
  Synthetic oligonucleotide; CTG chr11 5384494 5384515 5384499 5384494 -
gccttcctaacagaatactgca

SEQ ID NO: 115341 - DNA, 22 bp, Artificial Sequence
  Synthetic oligonucleotide; CTT chr11 5384489 5384510 5384494 5384489 -
cctaacagaatactgcagatga

SEQ ID NO: 115342 - DNA, 22 bp, Artificial Sequence
  Synthetic oligonucleotide; TTC chr11 5384488 5384509 5384493 5384488 -
ctaacagaatactgcagatgag

SEQ ID NO: 115343 - DNA, 22 bp, Artificial Sequence
  Synthetic oligonucleotide; CTA chr11 5384485 5384506 5384490 5384485 -
acagaatactgcagatgagctc

SEQ ID NO: 115344 - DNA, 22 bp, Artificial Sequence
  Synthetic oligonucleotide; CTG chr11 5384474 5384495 5384479 5384474 -
cagatgagctcgcctcttttcc

SEQ ID NO: 115345 - DNA, 22 bp, Artificial Sequence
  Synthetic oligonucleotide; CTC chr11 5384463 5384484 5384468 5384463 -
gcctcttttccagcaagagaag

SEQ ID NO: 115346 - DNA, 22 bp, Artificial Sequence
  Synthetic oligonucleotide; CTC chr11 5384458 5384479 5384463 5384458 -
ttttccagcaagagaaggtcct

SEQ ID NO: 115347 - DNA, 22 bp, Artificial Sequence
  Synthetic oligonucleotide; CTT chr11 5384456 5384477 5384461 5384456 -
ttccagcaagagaaggtcctgt

SEQ ID NO: 115348 - DNA, 22 bp, Artificial Sequence
  Synthetic oligonucleotide; TTT chr11 5384455 5384476 5384460 5384455 -
tccagcaagagaaggtcctgtt

SEQ ID NO: 115349 - DNA, 22 bp, Artificial Sequence
  Synthetic oligonucleotide; TTT chr11 5384454 5384475 5384459 5384454 -
ccagcaagagaaggtcctgttt

SEQ ID NO: 115350 - DNA, 22 bp, Artificial Sequence
  Synthetic oligonucleotide; TTC chr11 5384453 5384474 5384458 5384453 -
cagcaagagaaggtcctgtttt

SEQ ID NO: 115351 - DNA, 22 bp, Artificial Sequence
  Synthetic oligonucleotide; CTG chr11 5384435 5384456 5384440 5384435 -
ttttctgttctttctctggctc

SEQ ID NO: 115352 - DNA, 22 bp, Artificial Sequence
  Synthetic oligonucleotide; TTT chr11 5384432 5384453 5384437 5384432 -
tctgttctttctctggctctgg

SEQ ID NO: 115353 - DNA, 22 bp, Artificial Sequence
  Synthetic oligonucleotide; TTT chr11 5384431 5384452 5384436 5384431 -
ctgttctttctctggctctggt

SEQ ID NO: 115354 - DNA, 22 bp, Artificial Sequence
  Synthetic oligonucleotide; TTC chr11 5384430 5384451 5384435 5384430 -
tgttctttctctggctctggtt

SEQ ID NO: 115355 - DNA, 22 bp, Artificial Sequence
  Synthetic oligonucleotide; CTG chr11 5384428 5384449 5384433 5384428 -
ttctttctctggctctggttct

SEQ ID NO: 115356 - DNA, 22 bp, Artificial Sequence
  Synthetic oligonucleotide; TTC chr11 5384425 5384446 5384430 5384425 -
tttctctggctctggttctgtg

SEQ ID NO: 115357 - DNA, 22 bp, Artificial Sequence
  Synthetic oligonucleotide; CTT chr11 5384423 5384444 5384428 5384423 -
tctctggctctggttctgtgca

SEQ ID NO: 115358 - DNA, 22 bp, Artificial Sequence
  Synthetic oligonucleotide; TTT chr11 5384422 5384443 5384427 5384422 -
ctctggctctggttctgtgcat

SEQ ID NO: 115359 - DNA, 22 bp, Artificial Sequence
  Synthetic oligonucleotide; TTC chr11 5384421 5384442 5384426 5384421 -
tctggctctggttctgtgcata

SEQ ID NO: 115360 - DNA, 22 bp, Artificial Sequence
  Synthetic oligonucleotide; CTC chr11 5384419 5384440 5384424 5384419 -
tggctctggttctgtgcataga

SEQ ID NO: 115361 - DNA, 22 bp, Artificial Sequence
  Synthetic oligonucleotide; CTG chr11 5384417 5384438 5384422 5384417 -
gctctggttctgtgcatagact

SEQ ID NO: 115362 - DNA, 22 bp, Artificial Sequence
  Synthetic oligonucleotide; CTC chr11 5384413 5384434 5384418 5384413 -
tggttctgtgcatagactctga

SEQ ID NO: 115363 - DNA, 22 bp, Artificial Sequence
  Synthetic oligonucleotide; CTG chr11 5384411 5384432 5384416 5384411 -
gttctgtgcatagactctgaga

SEQ ID NO: 115364 - DNA, 22 bp, Artificial Sequence
  Synthetic oligonucleotide; TTC chr11 5384407 5384428 5384412 5384407 -
tgtgcatagactctgagaatat

SEQ ID NO: 115365 - DNA, 22 bp, Artificial Sequence
  Synthetic oligonucleotide; CTG chr11 5384405 5384426 5384410 5384405 -
tgcatagactctgagaatatca

SEQ ID NO: 115366 - DNA, 22 bp, Artificial Sequence
  Synthetic oligonucleotide; CTC chr11 5384394 5384415 5384399 5384394 -
tgagaatatcagaagagattct

SEQ ID NO: 115367 - DNA, 22 bp, Artificial Sequence
  Synthetic oligonucleotide; CTG chr11 5384392 5384413 5384397 5384392 -
agaatatcagaagagattctgt

SEQ ID NO: 115368 - DNA, 22 bp, Artificial Sequence
  Synthetic oligonucleotide; TTC chr11 5384373 5384394 5384378 5384373 -
tgtgagaaccctggtttctaag

SEQ ID NO: 115369 - DNA, 22 bp, Artificial Sequence
  Synthetic oligonucleotide; CTG chr11 5384371 5384392 5384376 5384371 -
tgagaaccctggtttctaagac

SEQ ID NO: 115370 - DNA, 22 bp, Artificial Sequence
  Synthetic oligonucleotide; CTG chr11 5384360 5384381 5384365 5384360 -
gtttctaagacttcattttcca

SEQ ID NO: 115371 - DNA, 22 bp, Artificial Sequence
  Synthetic oligonucleotide; TTT chr11 5384356 5384377 5384361 5384356 -
ctaagacttcattttccaagtg

SEQ ID NO: 115372 - DNA, 22 bp, Artificial Sequence
  Synthetic oligonucleotide; TTC chr11 5384355 5384376 5384360 5384355 -
taagacttcattttccaagtga

SEQ ID NO: 115373 - DNA, 22 bp, Artificial Sequence
  Synthetic oligonucleotide; CTA chr11 5384353 5384374 5384358 5384353 -
agacttcattttccaagtgaaa

SEQ ID NO: 115374 - DNA, 22 bp, Artificial Sequence
  Synthetic oligonucleotide; CTT chr11 5384347 5384368 5384352 5384347 -
cattttccaagtgaaaaatcta

SEQ ID NO: 115375 - DNA, 22 bp, Artificial Sequence
  Synthetic oligonucleotide; TTC chr11 5384346 5384367 5384351 5384346 -
attttccaagtgaaaaatctaa

SEQ ID NO: 115376 - DNA, 22 bp, Artificial Sequence
  Synthetic oligonucleotide; TTT chr11 5384342 5384363 5384347 5384342 -
tccaagtgaaaaatctaaggcc

SEQ ID NO: 115377 - DNA, 22 bp, Artificial Sequence
  Synthetic oligonucleotide; TTT chr11 5384341 5384362 5384346 5384341 -
ccaagtgaaaaatctaaggccc

SEQ ID NO: 115378 - DNA, 22 bp, Artificial Sequence
  Synthetic oligonucleotide; TTC chr11 5384340 5384361 5384345 5384340 -
caagtgaaaaatctaaggccca

SEQ ID NO: 115379 - DNA, 22 bp, Artificial Sequence
  Synthetic oligonucleotide; CTA chr11 5384325 5384346 5384330 5384325 -
aggcccagactgctgtatatgg

SEQ ID NO: 115380 - DNA, 22 bp, Artificial Sequence
  Synthetic oligonucleotide; CTG chr11 5384313 5384334 5384318 5384313 -
ctgtatatggtggttcacactt

SEQ ID NO: 115381 - DNA, 22 bp, Artificial Sequence
  Synthetic oligonucleotide; CTG chr11 5384310 5384331 5384315 5384310 -
tatatggtggttcacacttata

SEQ ID NO: 115382 - DNA, 22 bp, Artificial Sequence
  Synthetic oligonucleotide; TTC chr11 5384297 5384318 5384302 5384297 -
acacttataatcctggcaactt

SEQ ID NO: 115383 - DNA, 22 bp, Artificial Sequence
  Synthetic oligonucleotide; CTT chr11 5384291 5384312 5384296 5384291 -
ataatcctggcaacttggaaga

SEQ ID NO: 115384 - DNA, 22 bp, Artificial Sequence
  Synthetic oligonucleotide; TTA chr11 5384290 5384311 5384295 5384290 -
taatcctggcaacttggaagaa

SEQ ID NO: 115385 - DNA, 22 bp, Artificial Sequence
  Synthetic oligonucleotide; CTG chr11 5384282 5384303 5384287 5384282 -
gcaacttggaagaataaggtgg

SEQ ID NO: 115386 - DNA, 22 bp, Artificial Sequence
  Synthetic oligonucleotide; CTT chr11 5384275 5384296 5384280 5384275 -
ggaagaataaggtgggaggatt

SEQ ID NO: 115387 - DNA, 22 bp, Artificial Sequence
  Synthetic oligonucleotide; TTG chr11 5384274 5384295 5384279 5384274 -
gaagaataaggtgggaggattg

SEQ ID NO: 115388 - DNA, 22 bp, Artificial Sequence
  Synthetic oligonucleotide; TTG chr11 5384252 5384273 5384257 5384252 -
cttgaatccggtttgagtttac

SEQ ID NO: 115389 - DNA, 22 bp, Artificial Sequence
  Synthetic oligonucleotide; CTT chr11 5384249 5384270 5384254 5384249 -
gaatccggtttgagtttacagt

SEQ ID NO: 115390 - DNA, 22 bp, Artificial Sequence
  Synthetic oligonucleotide; TTG chr11 5384248 5384269 5384253 5384248 -
aatccggtttgagtttacagtg

SEQ ID NO: 115391 - DNA, 22 bp, Artificial Sequence
  Synthetic oligonucleotide; TTT chr11 5384238 5384259 5384243 5384238 -
gagtttacagtgagctatgatt

SEQ ID NO: 115392 - DNA, 22 bp, Artificial Sequence
  Synthetic oligonucleotide; TTG chr11 5384237 5384258 5384242 5384237 -
agtttacagtgagctatgatta

SEQ ID NO: 115393 - DNA, 22 bp, Artificial Sequence
  Synthetic oligonucleotide; TTT chr11 5384232 5384253 5384237 5384232 -
acagtgagctatgattacacca

SEQ ID NO: 115394 - DNA, 22 bp, Artificial Sequence
  Synthetic oligonucleotide; TTA chr11 5384231 5384252 5384236 5384231 -
cagtgagctatgattacaccac

SEQ ID NO: 115395 - DNA, 22 bp, Artificial Sequence
  Synthetic oligonucleotide; CTA chr11 5384221 5384242 5384226 5384221 -
tgattacaccactgcactgtag

SEQ ID NO: 115396 - DNA, 22 bp, Artificial Sequence
  Synthetic oligonucleotide; TTA chr11 5384215 5384236 5384220 5384215 -
caccactgcactgtagcctggg

SEQ ID NO: 115397 - DNA, 22 bp, Artificial Sequence
  Synthetic oligonucleotide; CTG chr11 5384207 5384228 5384212 5384207 -
cactgtagcctgggtaacagag

SEQ ID NO: 115398 - DNA, 22 bp, Artificial Sequence
  Synthetic oligonucleotide; CTG chr11 5384202 5384223 5384207 5384202 -
tagcctgggtaacagagctaga

SEQ ID NO: 115399 - DNA, 22 bp, Artificial Sequence
  Synthetic oligonucleotide; CTG chr11 5384195 5384216 5384200 5384195 -
ggtaacagagctagacctcatt

SEQ ID NO: 115400 - DNA, 22 bp, Artificial Sequence
  Synthetic oligonucleotide; CTA chr11 5384182 5384203 5384187 5384182 -
gacctcatttctaaaaacaaca

SEQ ID NO: 115401 - DNA, 22 bp, Artificial Sequence
  Synthetic oligonucleotide; CTC chr11 5384176 5384197 5384181 5384176 -
atttctaaaaacaacaaacaaa

SEQ ID NO: 115402 - DNA, 22 bp, Artificial Sequence
  Synthetic oligonucleotide; TTT chr11 5384172 5384193 5384177 5384172 -
ctaaaaacaacaaacaaagaaa

SEQ ID NO: 115403 - DNA, 22 bp, Artificial Sequence
  Synthetic oligonucleotide; TTC chr11 5384171 5384192 5384176 5384171 -
taaaaacaacaaacaaagaaac

SEQ ID NO: 115404 - DNA, 22 bp, Artificial Sequence
  Synthetic oligonucleotide; CTA chr11 5384169 5384190 5384174 5384169 -
aaaacaacaaacaaagaaacaa

SEQ ID NO: 115405 - DNA, 22 bp, Artificial Sequence
  Synthetic oligonucleotide; TTA chr11 5384112 5384133 5384117 5384112 -
ggcttagtgcagggaatgtggg

SEQ ID NO: 115406 - DNA, 22 bp, Artificial Sequence
  Synthetic oligonucleotide; CTT chr11 5384107 5384128 5384112 5384107 -
agtgcagggaatgtggggaatc

SEQ ID NO: 115407 - DNA, 22 bp, Artificial Sequence
  Synthetic oligonucleotide; TTA chr11 5384106 5384127 5384111 5384106 -
gtgcagggaatgtggggaatcc

SEQ ID NO: 115408 - DNA, 22 bp, Artificial Sequence
  Synthetic oligonucleotide; TTT chr11 5384080 5384101 5384085 5384080 -
ggctaaggacattcaaacattt

SEQ ID NO: 115409 - DNA, 22 bp, Artificial Sequence
  Synthetic oligonucleotide; TTG chr11 5384079 5384100 5384084 5384079 -
gctaaggacattcaaacatttg

SEQ ID NO: 115410 - DNA, 22 bp, Artificial Sequence
  Synthetic oligonucleotide; CTA chr11 5384075 5384096 5384080 5384075 -
aggacattcaaacatttggggg

SEQ ID NO: 115411 - DNA, 22 bp, Artificial Sequence
  Synthetic oligonucleotide; TTC chr11 5384066 5384087 5384071 5384066 -
aaacatttgggggaaaagcctt

SEQ ID NO: 115412 - DNA, 22 bp, Artificial Sequence
  Synthetic oligonucleotide; TTT chr11 5384058 5384079 5384063 5384058 -
gggggaaaagccttaattgtaa

SEQ ID NO: 115413 - DNA, 22 bp, Artificial Sequence
  Synthetic oligonucleotide; TTG chr11 5384057 5384078 5384062 5384057 -
ggggaaaagccttaattgtaac

SEQ ID NO: 115414 - DNA, 22 bp, Artificial Sequence
  Synthetic oligonucleotide; CTT chr11 5384044 5384065 5384049 5384044 -
aattgtaactgagaccatgtct

SEQ ID NO: 115415 - DNA, 22 bp, Artificial Sequence
  Synthetic oligonucleotide; TTA chr11 5384043 5384064 5384048 5384043 -
attgtaactgagaccatgtctt

SEQ ID NO: 115416 - DNA, 22 bp, Artificial Sequence
  Synthetic oligonucleotide; TTG chr11 5384039 5384060 5384044 5384039 -
taactgagaccatgtctttttg

SEQ ID NO: 115417 - DNA, 22 bp, Artificial Sequence
  Synthetic oligonucleotide; CTG chr11 5384033 5384054 5384038 5384033 -
agaccatgtctttttgggctca

SEQ ID NO: 115418 - DNA, 22 bp, Artificial Sequence
  Synthetic oligonucleotide; CTT chr11 5384021 5384042 5384026 5384021 -
tttgggctcactgcttttgtga

SEQ ID NO: 115419 - DNA, 22 bp, Artificial Sequence
  Synthetic oligonucleotide; TTT chr11 5384020 5384041 5384025 5384020 -
ttgggctcactgcttttgtgat

SEQ ID NO: 115420 - DNA, 22 bp, Artificial Sequence
  Synthetic oligonucleotide; TTT chr11 5384019 5384040 5384024 5384019 -
tgggctcactgcttttgtgata

SEQ ID NO: 115421 - DNA, 22 bp, Artificial Sequence
  Synthetic oligonucleotide; TTT chr11 5384018 5384039 5384023 5384018 -
gggctcactgcttttgtgatac

SEQ ID NO: 115422 - DNA, 22 bp, Artificial Sequence
  Synthetic oligonucleotide; TTG chr11 5384017 5384038 5384022 5384017 -
ggctcactgcttttgtgatacc

SEQ ID NO: 115423 - DNA, 22 bp, Artificial Sequence
  Synthetic oligonucleotide; CTC chr11 5384012 5384033 5384017 5384012 -
actgcttttgtgatacctatgc

SEQ ID NO: 115424 - DNA, 22 bp, Artificial Sequence
  Synthetic oligonucleotide; CTG chr11 5384008 5384029 5384013 5384008 -
cttttgtgatacctatgcattc

SEQ ID NO: 115425 - DNA, 22 bp, Artificial Sequence
  Synthetic oligonucleotide; CTT chr11 5384005 5384026 5384010 5384005 -
ttgtgatacctatgcattccca

SEQ ID NO: 115426 - DNA, 22 bp, Artificial Sequence
  Synthetic oligonucleotide; TTT chr11 5384004 5384025 5384009 5384004 -
tgtgatacctatgcattcccat

SEQ ID NO: 115427 - DNA, 22 bp, Artificial Sequence
  Synthetic oligonucleotide; TTT chr11 5384003 5384024 5384008 5384003 -
gtgatacctatgcattcccatt

SEQ ID NO: 115428 - DNA, 22 bp, Artificial Sequence
  Synthetic oligonucleotide; TTG chr11 5384002 5384023 5384007 5384002 -
tgatacctatgcattcccattt

SEQ ID NO: 115429 - DNA, 22 bp, Artificial Sequence
  Synthetic oligonucleotide; CTA chr11 5383993 5384014 5383998 5383993 -
tgcattcccattttccctcatt

SEQ ID NO: 115430 - DNA, 22 bp, Artificial Sequence
  Synthetic oligonucleotide; TTC chr11 5383986 5384007 5383991 5383986 -
ccattttccctcattttctccc

SEQ ID NO: 115431 - DNA, 22 bp, Artificial Sequence
  Synthetic oligonucleotide; TTT chr11 5383980 5384001 5383985 5383980 -
tccctcattttctccctcctct

SEQ ID NO: 115432 - DNA, 22 bp, Artificial Sequence
  Synthetic oligonucleotide; TTT chr11 5383979 5384000 5383984 5383979 -
ccctcattttctccctcctctc

SEQ ID NO: 115433 - DNA, 22 bp, Artificial Sequence
  Synthetic oligonucleotide; TTC chr11 5383978 5383999 5383983 5383978 -
cctcattttctccctcctctct

SEQ ID NO: 115434 - DNA, 22 bp, Artificial Sequence
  Synthetic oligonucleotide; CTC chr11 5383974 5383995 5383979 5383974 -
attttctccctcctctctccca

SEQ ID NO: 115435 - DNA, 22 bp, Artificial Sequence
  Synthetic oligonucleotide; TTT chr11 5383970 5383991 5383975 5383970 -
tctccctcctctctcccatgtc

SEQ ID NO: 115436 - DNA, 22 bp, Artificial Sequence
  Synthetic oligonucleotide; TTT chr11 5383969 5383990 5383974 5383969 -
ctccctcctctctcccatgtcc

SEQ ID NO: 115437 - DNA, 22 bp, Artificial Sequence
  Synthetic oligonucleotide; TTC chr11 5383968 5383989 5383973 5383968 -
tccctcctctctcccatgtccc

SEQ ID NO: 115438 - DNA, 22 bp, Artificial Sequence
  Synthetic oligonucleotide; CTC chr11 5383966 5383987 5383971 5383966 -
cctcctctctcccatgtccccc

SEQ ID NO: 115439 - DNA, 22 bp, Artificial Sequence
  Synthetic oligonucleotide; CTC chr11 5383962 5383983 5383967 5383962 -
ctctctcccatgtccccctaat

SEQ ID NO: 115440 - DNA, 22 bp, Artificial Sequence
  Synthetic oligonucleotide; CTC chr11 5383959 5383980 5383964 5383959 -
tctcccatgtccccctaattac

SEQ ID NO: 115441 - DNA, 22 bp, Artificial Sequence
  Synthetic oligonucleotide; CTC chr11 5383957 5383978 5383962 5383957 -
tcccatgtccccctaattaccc

SEQ ID NO: 115442 - DNA, 22 bp, Artificial Sequence
  Synthetic oligonucleotide; CTC chr11 5383955 5383976 5383960 5383955 -
ccatgtccccctaattacccac

SEQ ID NO: 115443 - DNA, 22 bp, Artificial Sequence
  Synthetic oligonucleotide; CTA chr11 5383942 5383963 5383947 5383942 -
attacccactcctgaaaccccg

SEQ ID NO: 115444 - DNA, 22 bp, Artificial Sequence
  Synthetic oligonucleotide; TTA chr11 5383938 5383959 5383943 5383938 -
cccactcctgaaaccccggcac

SEQ ID NO: 115445 - DNA, 22 bp, Artificial Sequence
  Synthetic oligonucleotide; CTC chr11 5383931 5383952 5383936 5383931 -
ctgaaaccccggcacaagacag

SEQ ID NO: 115446 - DNA, 22 bp, Artificial Sequence
  Synthetic oligonucleotide; CTG chr11 5383928 5383949 5383933 5383928 -
aaaccccggcacaagacagtag

SEQ ID NO: 115447 - DNA, 22 bp, Artificial Sequence
  Synthetic oligonucleotide; CTC chr11 5383898 5383919 5383903 5383898 -
accagcaggtaataacaaaaat

SEQ ID NO: 115448 - DNA, 22 bp, Artificial Sequence
  Synthetic oligonucleotide; TTC chr11 5383855 5383876 5383860 5383855 -
caaaggaagaaagaagagtata

SEQ ID NO: 115449 - DNA, 22 bp, Artificial Sequence
  Synthetic oligonucleotide; CTG chr11 5383808 5383829 5383813 5383808 -
agaggcacaaggctgtggctgt

SEQ ID NO: 115450 - DNA, 22 bp, Artificial Sequence
  Synthetic oligonucleotide; CTG chr11 5383793 5383814 5383798 5383793 -
tggctgtcacagaaggatttat

SEQ ID NO: 115451 - DNA, 22 bp, Artificial Sequence
  Synthetic oligonucleotide; CTG chr11 5383787 5383808 5383792 5383787 -
tcacagaaggatttatcctcct

SEQ ID NO: 115452 - DNA, 22 bp, Artificial Sequence
  Synthetic oligonucleotide; TTT chr11 5383773 5383794 5383778 5383773 -
atcctcctaaagaccatggctc

SEQ ID NO: 115453 - DNA, 22 bp, Artificial Sequence
  Synthetic oligonucleotide; TTA chr11 5383772 5383793 5383777 5383772 -
tcctcctaaagaccatggctcc

SEQ ID NO: 115454 - DNA, 22 bp, Artificial Sequence
  Synthetic oligonucleotide; CTC chr11 5383767 5383788 5383772 5383767 -
ctaaagaccatggctccagctg

SEQ ID NO: 115455 - DNA, 22 bp, Artificial Sequence
  Synthetic oligonucleotide; CTA chr11 5383764 5383785 5383769 5383764 -
aagaccatggctccagctggga

SEQ ID NO: 115456 - DNA, 22 bp, Artificial Sequence
  Synthetic oligonucleotide; CTC chr11 5383751 5383772 5383756 5383751 -
cagctgggagaacttaatggta

SEQ ID NO: 115457 - DNA, 22 bp, Artificial Sequence
  Synthetic oligonucleotide; CTG chr11 5383745 5383766 5383750 5383745 -
ggagaacttaatggtaaacaaa

SEQ ID NO: 115458 - DNA, 22 bp, Artificial Sequence
  Synthetic oligonucleotide; CTT chr11 5383736 5383757 5383741 5383736 -
aatggtaaacaaagggtcccca

SEQ ID NO: 115459 - DNA, 22 bp, Artificial Sequence
  Synthetic oligonucleotide; TTA chr11 5383735 5383756 5383740 5383735 -
atggtaaacaaagggtccccag

SEQ ID NO: 115460 - DNA, 22 bp, Artificial Sequence
  Synthetic oligonucleotide; CTG chr11 5383708 5383729 5383713 5383708 -
ggaatcctatgggcaggaaact

SEQ ID NO: 115461 - DNA, 22 bp, Artificial Sequence
  Synthetic oligonucleotide; CTA chr11 5383699 5383720 5383704 5383699 -
tgggcaggaaactttctttatc

SEQ ID NO: 115462 - DNA, 22 bp, Artificial Sequence
  Synthetic oligonucleotide; CTT chr11 5383685 5383706 5383690 5383685 -
tctttatctccacccctgtctc

SEQ ID NO: 115463 - DNA, 22 bp, Artificial Sequence
  Synthetic oligonucleotide; TTT chr11 5383684 5383705 5383689 5383684 -
ctttatctccacccctgtctcc

SEQ ID NO: 115464 - DNA, 22 bp, Artificial Sequence
  Synthetic oligonucleotide; TTC chr11 5383683 5383704 5383688 5383683 -
tttatctccacccctgtctcct

SEQ ID NO: 115465 - DNA, 22 bp, Artificial Sequence
  Synthetic oligonucleotide; CTT chr11 5383681 5383702 5383686 5383681 -
tatctccacccctgtctcctga

SEQ ID NO: 115466 - DNA, 22 bp, Artificial Sequence
  Synthetic oligonucleotide; TTT chr11 5383680 5383701 5383685 5383680 -
atctccacccctgtctcctgaa

SEQ ID NO: 115467 - DNA, 22 bp, Artificial Sequence
  Synthetic oligonucleotide; TTA chr11 5383679 5383700 5383684 5383679 -
tctccacccctgtctcctgaag

SEQ ID NO: 115468 - DNA, 22 bp, Artificial Sequence
  Synthetic oligonucleotide; CTC chr11 5383675 5383696 5383680 5383675 -
cacccctgtctcctgaagctga

SEQ ID NO: 115469 - DNA, 22 bp, Artificial Sequence
  Synthetic oligonucleotide; CTG chr11 5383667 5383688 5383672 5383667 -
tctcctgaagctgaagagccct

SEQ ID NO: 115470 - DNA, 22 bp, Artificial Sequence
  Synthetic oligonucleotide; CTC chr11 5383663 5383684 5383668 5383663 -
ctgaagctgaagagccctaact

SEQ ID NO: 115471 - DNA, 22 bp, Artificial Sequence
  Synthetic oligonucleotide; CTG chr11 5383660 5383681 5383665 5383660 -
aagctgaagagccctaactttt

SEQ ID NO: 115472 - DNA, 22 bp, Artificial Sequence
  Synthetic oligonucleotide; CTG chr11 5383654 5383675 5383659 5383654 -
aagagccctaactttttagcat

SEQ ID NO: 115473 - DNA, 22 bp, Artificial Sequence
  Synthetic oligonucleotide; CTA chr11 5383644 5383665 5383649 5383644 -
actttttagcattcagtcccca

SEQ ID NO: 115474 - DNA, 22 bp, Artificial Sequence
  Synthetic oligonucleotide; CTT chr11 5383640 5383661 5383645 5383640 -
tttagcattcagtccccaggtt

SEQ ID NO: 115475 - DNA, 22 bp, Artificial Sequence
  Synthetic oligonucleotide; TTT chr11 5383639 5383660 5383644 5383639 -
ttagcattcagtccccaggttt

SEQ ID NO: 115476 - DNA, 22 bp, Artificial Sequence
  Synthetic oligonucleotide; TTT chr11 5383638 5383659 5383643 5383638 -
tagcattcagtccccaggtttt

SEQ ID NO: 115477 - DNA, 22 bp, Artificial Sequence
  Synthetic oligonucleotide; TTT chr11 5383637 5383658 5383642 5383637 -
agcattcagtccccaggttttg

SEQ ID NO: 115478 - DNA, 22 bp, Artificial Sequence
  Synthetic oligonucleotide; TTA chr11 5383636 5383657 5383641 5383636 -
gcattcagtccccaggttttgg

SEQ ID NO: 115479 - DNA, 22 bp, Artificial Sequence
  Synthetic oligonucleotide; TTC chr11 5383630 5383651 5383635 5383630 -
agtccccaggttttggctacac

SEQ ID NO: 115480 - DNA, 22 bp, Artificial Sequence
  Synthetic oligonucleotide; TTT chr11 5383617 5383638 5383622 5383617 -
tggctacacagacatctgctgc

SEQ ID NO: 115481 - DNA, 22 bp, Artificial Sequence
  Synthetic oligonucleotide; TTT chr11 5383616 5383637 5383621 5383616 -
ggctacacagacatctgctgca

SEQ ID NO: 115482 - DNA, 22 bp, Artificial Sequence
  Synthetic oligonucleotide; TTG chr11 5383615 5383636 5383620 5383615 -
gctacacagacatctgctgcaa

SEQ ID NO: 115483 - DNA, 22 bp, Artificial Sequence
  Synthetic oligonucleotide; CTA chr11 5383611 5383632 5383616 5383611 -
cacagacatctgctgcaacaaa

SEQ ID NO: 115484 - DNA, 22 bp, Artificial Sequence
  Synthetic oligonucleotide; CTG chr11 5383599 5383620 5383604 5383599 -
ctgcaacaaaagtactactgcc

SEQ ID NO: 115485 - DNA, 22 bp, Artificial Sequence
  Synthetic oligonucleotide; CTG chr11 5383596 5383617 5383601 5383596 -
caacaaaagtactactgcctta

SEQ ID NO: 115486 - DNA, 22 bp, Artificial Sequence
  Synthetic oligonucleotide; CTA chr11 5383582 5383603 5383587 5383582 -
ctgccttatctgtttattttta

SEQ ID NO: 115487 - DNA, 22 bp, Artificial Sequence
  Synthetic oligonucleotide; CTG chr11 5383579 5383600 5383584 5383579 -
ccttatctgtttatttttaatt

SEQ ID NO: 115488 - DNA, 22 bp, Artificial Sequence
  Synthetic oligonucleotide; CTT chr11 5383575 5383596 5383580 5383575 -
atctgtttatttttaatttcat

SEQ ID NO: 115489 - DNA, 22 bp, Artificial Sequence
  Synthetic oligonucleotide; TTA chr11 5383574 5383595 5383579 5383574 -
tctgtttatttttaatttcata

SEQ ID NO: 115490 - DNA, 22 bp, Artificial Sequence
  Synthetic oligonucleotide; CTG chr11 5383570 5383591 5383575 5383570 -
tttatttttaatttcataaaga

SEQ ID NO: 115491 - DNA, 22 bp, Artificial Sequence
  Synthetic oligonucleotide; TTT chr11 5383567 5383588 5383572 5383567 -
atttttaatttcataaagaagt

SEQ ID NO: 115492 - DNA, 22 bp, Artificial Sequence
  Synthetic oligonucleotide; TTA chr11 5383566 5383587 5383571 5383566 -
tttttaatttcataaagaagtc

SEQ ID NO: 115493 - DNA, 22 bp, Artificial Sequence
  Synthetic oligonucleotide; TTT chr11 5383563 5383584 5383568 5383563 -
ttaatttcataaagaagtcaat

SEQ ID NO: 115494 - DNA, 22 bp, Artificial Sequence
  Synthetic oligonucleotide; TTT chr11 5383562 5383583 5383567 5383562 -
taatttcataaagaagtcaatt

SEQ ID NO: 115495 - DNA, 22 bp, Artificial Sequence
  Synthetic oligonucleotide; TTT chr11 5383561 5383582 5383566 5383561 -
aatttcataaagaagtcaattc

SEQ ID NO: 115496 - DNA, 22 bp, Artificial Sequence
  Synthetic oligonucleotide; TTA chr11 5383560 5383581 5383565 5383560 -
atttcataaagaagtcaattca

SEQ ID NO: 115497 - DNA, 22 bp, Artificial Sequence
  Synthetic oligonucleotide; TTT chr11 5383556 5383577 5383561 5383556 -
cataaagaagtcaattcatatc

SEQ ID NO: 115498 - DNA, 22 bp, Artificial Sequence
  Synthetic oligonucleotide; TTC chr11 5383555 5383576 5383560 5383555 -
ataaagaagtcaattcatatca

SEQ ID NO: 115499 - DNA, 22 bp, Artificial Sequence
  Synthetic oligonucleotide; TTC chr11 5383539 5383560 5383544 5383539 -
atatcacttatcattttattta

SEQ ID NO: 115500 - DNA, 22 bp, Artificial Sequence
  Synthetic oligonucleotide; CTT chr11 5383530 5383551 5383535 5383530 -
atcattttatttactgtcttct

SEQ ID NO: 115501 - DNA, 22 bp, Artificial Sequence
  Synthetic oligonucleotide; TTA chr11 5383529 5383550 5383534 5383529 -
tcattttatttactgtcttctg

SEQ ID NO: 115502 - DNA, 22 bp, Artificial Sequence
  Synthetic oligonucleotide; TTT chr11 5383523 5383544 5383528 5383523 -
tatttactgtcttctgttatcc

SEQ ID NO: 115503 - DNA, 22 bp, Artificial Sequence
  Synthetic oligonucleotide; TTT chr11 5383522 5383543 5383527 5383522 -
atttactgtcttctgttatcca

SEQ ID NO: 115504 - DNA, 22 bp, Artificial Sequence
  Synthetic oligonucleotide; TTA chr11 5383521 5383542 5383526 5383521 -
tttactgtcttctgttatccac

SEQ ID NO: 115505 - DNA, 22 bp, Artificial Sequence
  Synthetic oligonucleotide; TTT chr11 5383518 5383539 5383523 5383518 -
actgtcttctgttatccactag

SEQ ID NO: 115506 - DNA, 22 bp, Artificial Sequence
  Synthetic oligonucleotide; TTA chr11 5383517 5383538 5383522 5383517 -
ctgtcttctgttatccactagt

SEQ ID NO: 115507 - DNA, 22 bp, Artificial Sequence
  Synthetic oligonucleotide; CTG chr11 5383514 5383535 5383519 5383514 -
tcttctgttatccactagtaat

SEQ ID NO: 115508 - DNA, 22 bp, Artificial Sequence
  Synthetic oligonucleotide; CTT chr11 5383510 5383531 5383515 5383510 -
ctgttatccactagtaatggac

SEQ ID NO: 115509 - DNA, 22 bp, Artificial Sequence
  Synthetic oligonucleotide; TTC chr11 5383509 5383530 5383514 5383509 -
tgttatccactagtaatggacc

SEQ ID NO: 115510 - DNA, 22 bp, Artificial Sequence
  Synthetic oligonucleotide; CTG chr11 5383507 5383528 5383512 5383507 -
ttatccactagtaatggacccg

SEQ ID NO: 115511 - DNA, 22 bp, Artificial Sequence
  Synthetic oligonucleotide; TTA chr11 5383504 5383525 5383509 5383504 -
tccactagtaatggacccgtcg

SEQ ID NO: 115512 - DNA, 22 bp, Artificial Sequence
  Synthetic oligonucleotide; CTA chr11 5383497 5383518 5383502 5383497 -
gtaatggacccgtcgttttcca

SEQ ID NO: 115513 - DNA, 22 bp, Artificial Sequence
  Synthetic oligonucleotide; TTT chr11 5383479 5383500 5383484 5383479 -
tccagagaggtcggatgtagta

SEQ ID NO: 115514 - DNA, 22 bp, Artificial Sequence
  Synthetic oligonucleotide; TTT chr11 5383478 5383499 5383483 5383478 -
ccagagaggtcggatgtagtat

SEQ ID NO: 115515 - DNA, 22 bp, Artificial Sequence
  Synthetic oligonucleotide; TTC chr11 5383477 5383498 5383482 5383477 -
cagagaggtcggatgtagtata

SEQ ID NO: 115516 - DNA, 22 bp, Artificial Sequence
  Synthetic oligonucleotide; TTA chr11 5383443 5383464 5383448 5383443 -
tccatgtgatgttcacagtggc

SEQ ID NO: 115517 - DNA, 22 bp, Artificial Sequence
  Synthetic oligonucleotide; TTC chr11 5383429 5383450 5383434 5383429 -
acagtggcttttaaattgcaca

SEQ ID NO: 115518 - DNA, 22 bp, Artificial Sequence
  Synthetic oligonucleotide; CTT chr11 5383419 5383440 5383424 5383419 -
ttaaattgcacatctgccttga

SEQ ID NO: 115519 - DNA, 22 bp, Artificial Sequence
  Synthetic oligonucleotide; TTT chr11 5383418 5383439 5383423 5383418 -
taaattgcacatctgccttgaa

SEQ ID NO: 115520 - DNA, 22 bp, Artificial Sequence
  Synthetic oligonucleotide; TTT chr11 5383417 5383438 5383422 5383417 -
aaattgcacatctgccttgaag

SEQ ID NO: 115521 - DNA, 22 bp, Artificial Sequence
  Synthetic oligonucleotide; TTA chr11 5383416 5383437 5383421 5383416 -
aattgcacatctgccttgaagc

SEQ ID NO: 115522 - DNA, 22 bp, Artificial Sequence
  Synthetic oligonucleotide; TTG chr11 5383411 5383432 5383416 5383411 -
cacatctgccttgaagcaccac

SEQ ID NO: 115523 - DNA, 22 bp, Artificial Sequence
  Synthetic oligonucleotide; CTG chr11 5383403 5383424 5383408 5383403 -
ccttgaagcaccacaatcacca

SEQ ID NO: 115524 - DNA, 22 bp, Artificial Sequence
  Synthetic oligonucleotide; CTT chr11 5383399 5383420 5383404 5383399 -
gaagcaccacaatcaccactac

SEQ ID NO: 115525 - DNA, 22 bp, Artificial Sequence
  Synthetic oligonucleotide; TTG chr11 5383398 5383419 5383403 5383398 -
aagcaccacaatcaccactact

SEQ ID NO: 115526 - DNA, 22 bp, Artificial Sequence
  Synthetic oligonucleotide; CTA chr11 5383378 5383399 5383383 5383378 -
cttcaagattctctcactcctg

SEQ ID NO: 115527 - DNA, 22 bp, Artificial Sequence
  Synthetic oligonucleotide; CTT chr11 5383375 5383396 5383380 5383375 -
caagattctctcactcctgcac

SEQ ID NO: 115528 - DNA, 22 bp, Artificial Sequence
  Synthetic oligonucleotide; TTC chr11 5383374 5383395 5383379 5383374 -
aagattctctcactcctgcact

SEQ ID NO: 115529 - DNA, 22 bp, Artificial Sequence
  Synthetic oligonucleotide; TTC chr11 5383367 5383388 5383372 5383367 -
tctcactcctgcactcattttc

SEQ ID NO: 115530 - DNA, 22 bp, Artificial Sequence
  Synthetic oligonucleotide; CTC chr11 5383365 5383386 5383370 5383365 -
tcactcctgcactcattttcct

SEQ ID NO: 115531 - DNA, 22 bp, Artificial Sequence
  Synthetic oligonucleotide; CTC chr11 5383363 5383384 5383368 5383363 -
actcctgcactcattttcctgt

SEQ ID NO: 115532 - DNA, 22 bp, Artificial Sequence
  Synthetic oligonucleotide; CTC chr11 5383359 5383380 5383364 5383359 -
ctgcactcattttcctgtctat

SEQ ID NO: 115533 - DNA, 22 bp, Artificial Sequence
  Synthetic oligonucleotide; CTG chr11 5383356 5383377 5383361 5383356 -
cactcattttcctgtctatttt

SEQ ID NO: 115534 - DNA, 22 bp, Artificial Sequence
  Synthetic oligonucleotide; CTC chr11 5383351 5383372 5383356 5383351 -
attttcctgtctatttttatat

SEQ ID NO: 115535 - DNA, 22 bp, Artificial Sequence
  Synthetic oligonucleotide; TTT chr11 5383347 5383368 5383352 5383347 -
tcctgtctatttttatatttcc

SEQ ID NO: 115536 - DNA, 22 bp, Artificial Sequence
  Synthetic oligonucleotide; TTT chr11 5383346 5383367 5383351 5383346 -
cctgtctatttttatatttcca

SEQ ID NO: 115537 - DNA, 22 bp, Artificial Sequence
  Synthetic oligonucleotide; TTC chr11 5383345 5383366 5383350 5383345 -
ctgtctatttttatatttccat

SEQ ID NO: 115538 - DNA, 22 bp, Artificial Sequence
  Synthetic oligonucleotide; CTG chr11 5383342 5383363 5383347 5383342 -
tctatttttatatttccattta

SEQ ID NO: 115539 - DNA, 22 bp, Artificial Sequence
  Synthetic oligonucleotide; CTA chr11 5383338 5383359 5383343 5383338 -
tttttatatttccatttactgc

SEQ ID NO: 115540 - DNA, 22 bp, Artificial Sequence
  Synthetic oligonucleotide; TTT chr11 5383335 5383356 5383340 5383335 -
ttatatttccatttactgcaga

SEQ ID NO: 115541 - DNA, 22 bp, Artificial Sequence
  Synthetic oligonucleotide; TTT chr11 5383334 5383355 5383339 5383334 -
tatatttccatttactgcagat

SEQ ID NO: 115542 - DNA, 22 bp, Artificial Sequence
  Synthetic oligonucleotide; TTT chr11 5383333 5383354 5383338 5383333 -
atatttccatttactgcagata

SEQ ID NO: 115543 - DNA, 22 bp, Artificial Sequence
  Synthetic oligonucleotide; TTA chr11 5383332 5383353 5383337 5383332 -
tatttccatttactgcagataa

SEQ ID NO: 115544 - DNA, 22 bp, Artificial Sequence
  Synthetic oligonucleotide; TTT chr11 5383327 5383348 5383332 5383327 -
ccatttactgcagataattaaa

SEQ ID NO: 115545 - DNA, 22 bp, Artificial Sequence
  Synthetic oligonucleotide; TTC chr11 5383326 5383347 5383331 5383326 -
catttactgcagataattaaat

SEQ ID NO: 115546 - DNA, 22 bp, Artificial Sequence
  Synthetic oligonucleotide; TTT chr11 5383321 5383342 5383326 5383321 -
actgcagataattaaattgccc

SEQ ID NO: 115547 - DNA, 22 bp, Artificial Sequence
  Synthetic oligonucleotide; TTA chr11 5383320 5383341 5383325 5383320 -
ctgcagataattaaattgccct

SEQ ID NO: 115548 - DNA, 22 bp, Artificial Sequence
  Synthetic oligonucleotide; CTG chr11 5383317 5383338 5383322 5383317 -
cagataattaaattgccctcca

SEQ ID NO: 115549 - DNA, 22 bp, Artificial Sequence
  Synthetic oligonucleotide; TTA chr11 5383307 5383328 5383312 5383307 -
aattgccctccatctctgccag

SEQ ID NO: 115550 - DNA, 22 bp, Artificial Sequence
  Synthetic oligonucleotide; TTG chr11 5383302 5383323 5383307 5383302 -
ccctccatctctgccagcctct

SEQ ID NO: 115551 - DNA, 22 bp, Artificial Sequence
  Synthetic oligonucleotide; CTC chr11 5383297 5383318 5383302 5383297 -
catctctgccagcctctatatc

SEQ ID NO: 115552 - DNA, 22 bp, Artificial Sequence
  Synthetic oligonucleotide; CTC chr11 5383291 5383312 5383296 5383291 -
tgccagcctctatatctttgga

SEQ ID NO: 115553 - DNA, 22 bp, Artificial Sequence
  Synthetic oligonucleotide; CTG chr11 5383289 5383310 5383294 5383289 -
ccagcctctatatctttggacc

SEQ ID NO: 115554 - DNA, 22 bp, Artificial Sequence
  Synthetic oligonucleotide; CTC chr11 5383281 5383302 5383286 5383281 -
tatatctttggacctagaagtc

SEQ ID NO: 115555 - DNA, 22 bp, Artificial Sequence
  Synthetic oligonucleotide; CTA chr11 5383279 5383300 5383284 5383279 -
tatctttggacctagaagtcaa

SEQ ID NO: 115556 - DNA, 22 bp, Artificial Sequence
  Synthetic oligonucleotide; CTT chr11 5383273 5383294 5383278 5383273 -
tggacctagaagtcaatcttgc

SEQ ID NO: 115557 - DNA, 22 bp, Artificial Sequence
  Synthetic oligonucleotide; TTT chr11 5383272 5383293 5383277 5383272 -
ggacctagaagtcaatcttgca

SEQ ID NO: 115558 - DNA, 22 bp, Artificial Sequence
  Synthetic oligonucleotide; TTG chr11 5383271 5383292 5383276 5383271 -
gacctagaagtcaatcttgcat

SEQ ID NO: 115559 - DNA, 22 bp, Artificial Sequence
  Synthetic oligonucleotide; CTA chr11 5383265 5383286 5383270 5383265 -
gaagtcaatcttgcatattcaa

SEQ ID NO: 115560 - DNA, 22 bp, Artificial Sequence
  Synthetic oligonucleotide; CTT chr11 5383253 5383274 5383258 5383253 -
gcatattcaatcctaccccaaa

SEQ ID NO: 115561 - DNA, 22 bp, Artificial Sequence
  Synthetic oligonucleotide; TTG chr11 5383252 5383273 5383257 5383252 -
catattcaatcctaccccaaac

SEQ ID NO: 115562 - DNA, 22 bp, Artificial Sequence
  Synthetic oligonucleotide; TTC chr11 5383245 5383266 5383250 5383245 -
aatcctaccccaaacaaatgtc

SEQ ID NO: 115563 - DNA, 22 bp, Artificial Sequence
  Synthetic oligonucleotide; CTA chr11 5383238 5383259 5383243 5383238 -
ccccaaacaaatgtccaggtca

SEQ ID NO: 115564 - DNA, 22 bp, Artificial Sequence
  Synthetic oligonucleotide; CTC chr11 5383209 5383230 5383214 5383209 -
aggctttcccaaagctctctac

SEQ ID NO: 115565 - DNA, 22 bp, Artificial Sequence
  Synthetic oligonucleotide; CTT chr11 5383203 5383224 5383208 5383203 -
tcccaaagctctctacttcatc

SEQ ID NO: 115566 - DNA, 22 bp, Artificial Sequence
  Synthetic oligonucleotide; TTT chr11 5383202 5383223 5383207 5383202 -
cccaaagctctctacttcatct

SEQ ID NO: 115567 - DNA, 22 bp, Artificial Sequence
  Synthetic oligonucleotide; TTC chr11 5383201 5383222 5383206 5383201 -
ccaaagctctctacttcatctt

SEQ ID NO: 115568 - DNA, 22 bp, Artificial Sequence
  Synthetic oligonucleotide; CTC chr11 5383192 5383213 5383197 5383192 -
tctacttcatctttgaatgcac

SEQ ID NO: 115569 - DNA, 22 bp, Artificial Sequence
  Synthetic oligonucleotide; CTC chr11 5383190 5383211 5383195 5383190 -
tacttcatctttgaatgcactg

SEQ ID NO: 115570 - DNA, 22 bp, Artificial Sequence
  Synthetic oligonucleotide; CTA chr11 5383188 5383209 5383193 5383188 -
cttcatctttgaatgcactgga

SEQ ID NO: 115571 - DNA, 22 bp, Artificial Sequence
  Synthetic oligonucleotide; CTT chr11 5383185 5383206 5383190 5383185 -
catctttgaatgcactggactt

SEQ ID NO: 115572 - DNA, 22 bp, Artificial Sequence
  Synthetic oligonucleotide; TTC chr11 5383184 5383205 5383189 5383184 -
atctttgaatgcactggacttt

SEQ ID NO: 115573 - DNA, 22 bp, Artificial Sequence
  Synthetic oligonucleotide; CTT chr11 5383179 5383200 5383184 5383179 -
tgaatgcactggactttccttc

SEQ ID NO: 115574 - DNA, 22 bp, Artificial Sequence
  Synthetic oligonucleotide; TTT chr11 5383178 5383199 5383183 5383178 -
gaatgcactggactttccttca

SEQ ID NO: 115575 - DNA, 22 bp, Artificial Sequence
  Synthetic oligonucleotide; TTG chr11 5383177 5383198 5383182 5383177 -
aatgcactggactttccttcaa

SEQ ID NO: 115576 - DNA, 22 bp, Artificial Sequence
  Synthetic oligonucleotide; CTG chr11 5383168 5383189 5383173 5383168 -
gactttccttcaatgagcccta

SEQ ID NO: 115577 - DNA, 22 bp, Artificial Sequence
  Synthetic oligonucleotide; CTT chr11 5383163 5383184 5383168 5383163 -
tccttcaatgagccctacaaca

SEQ ID NO: 115578 - DNA, 22 bp, Artificial Sequence
  Synthetic oligonucleotide; TTT chr11 5383162 5383183 5383167 5383162 -
ccttcaatgagccctacaacaa

SEQ ID NO: 115579 - DNA, 22 bp, Artificial Sequence
  Synthetic oligonucleotide; TTC chr11 5383161 5383182 5383166 5383161 -
cttcaatgagccctacaacaag

SEQ ID NO: 115580 - DNA, 22 bp, Artificial Sequence
  Synthetic oligonucleotide; CTT chr11 5383158 5383179 5383163 5383158 -
caatgagccctacaacaagtag

SEQ ID NO: 115581 - DNA, 22 bp, Artificial Sequence
  Synthetic oligonucleotide; TTC chr11 5383157 5383178 5383162 5383157 -
aatgagccctacaacaagtagc

SEQ ID NO: 115582 - DNA, 22 bp, Artificial Sequence
  Synthetic oligonucleotide; CTA chr11 5383146 5383167 5383151 5383146 -
caacaagtagcctttacaaaac

SEQ ID NO: 115583 - DNA, 22 bp, Artificial Sequence
  Synthetic oligonucleotide; CTT chr11 5383132 5383153 5383137 5383132 -
tacaaaacttttttccttcttt

SEQ ID NO: 115584 - DNA, 22 bp, Artificial Sequence
  Synthetic oligonucleotide; TTT chr11 5383131 5383152 5383136 5383131 -
acaaaacttttttccttctttt

SEQ ID NO: 115585 - DNA, 22 bp, Artificial Sequence
  Synthetic oligonucleotide; TTA chr11 5383130 5383151 5383135 5383130 -
caaaacttttttccttcttttc

SEQ ID NO: 115586 - DNA, 22 bp, Artificial Sequence
  Synthetic oligonucleotide; CTT chr11 5383122 5383143 5383127 5383122 -
ttttccttcttttctggtagca

SEQ ID NO: 115587 - DNA, 22 bp, Artificial Sequence
  Synthetic oligonucleotide; TTT chr11 5383121 5383142 5383126 5383121 -
tttccttcttttctggtagcaa

SEQ ID NO: 115588 - DNA, 22 bp, Artificial Sequence
  Synthetic oligonucleotide; TTT chr11 5383120 5383141 5383125 5383120 -
ttccttcttttctggtagcaaa

SEQ ID NO: 115589 - DNA, 22 bp, Artificial Sequence
  Synthetic oligonucleotide; TTT chr11 5383119 5383140 5383124 5383119 -
tccttcttttctggtagcaaat

SEQ ID NO: 115590 - DNA, 22 bp, Artificial Sequence
  Synthetic oligonucleotide; TTT chr11 5383118 5383139 5383123 5383118 -
ccttcttttctggtagcaaatg

SEQ ID NO: 115591 - DNA, 22 bp, Artificial Sequence
  Synthetic oligonucleotide; TTC chr11 5383117 5383138 5383122 5383117 -
cttcttttctggtagcaaatgc

SEQ ID NO: 115592 - DNA, 22 bp, Artificial Sequence
  Synthetic oligonucleotide; CTT chr11 5383114 5383135 5383119 5383114 -
cttttctggtagcaaatgccat

SEQ ID NO: 115593 - DNA, 22 bp, Artificial Sequence
  Synthetic oligonucleotide; TTC chr11 5383113 5383134 5383118 5383113 -
ttttctggtagcaaatgccatc

SEQ ID NO: 115594 - DNA, 22 bp, Artificial Sequence
  Synthetic oligonucleotide; CTT chr11 5383111 5383132 5383116 5383111 -
ttctggtagcaaatgccatcaa

SEQ ID NO: 115595 - DNA, 22 bp, Artificial Sequence
  Synthetic oligonucleotide; TTT chr11 5383110 5383131 5383115 5383110 -
tctggtagcaaatgccatcaac

SEQ ID NO: 115596 - DNA, 22 bp, Artificial Sequence
  Synthetic oligonucleotide; TTT chr11 5383109 5383130 5383114 5383109 -
ctggtagcaaatgccatcaaca

SEQ ID NO: 115597 - DNA, 22 bp, Artificial Sequence
  Synthetic oligonucleotide; TTC chr11 5383108 5383129 5383113 5383108 -
tggtagcaaatgccatcaacat

SEQ ID NO: 115598 - DNA, 22 bp, Artificial Sequence
  Synthetic oligonucleotide; CTG chr11 5383106 5383127 5383111 5383106 -
gtagcaaatgccatcaacattt

SEQ ID NO: 115599 - DNA, 22 bp, Artificial Sequence
  Synthetic oligonucleotide; TTT chr11 5383084 5383105 5383089 5383084 -
agaaaaaaaaaaatagtcttgt

SEQ ID NO: 115600 - DNA, 22 bp, Artificial Sequence
  Synthetic oligonucleotide; TTA chr11 5383083 5383104 5383088 5383083 -
gaaaaaaaaaaatagtcttgta

SEQ ID NO: 115601 - DNA, 22 bp, Artificial Sequence
  Synthetic oligonucleotide; CTT chr11 5383064 5383085 5383069 5383064 -
gtacttcttccccagactatgc

SEQ ID NO: 115602 - DNA, 22 bp, Artificial Sequence
  Synthetic oligonucleotide; TTG chr11 5383063 5383084 5383068 5383063 -
tacttcttccccagactatgct

SEQ ID NO: 115603 - DNA, 22 bp, Artificial Sequence
  Synthetic oligonucleotide; CTT chr11 5383058 5383079 5383063 5383058 -
cttccccagactatgctacaga

SEQ ID NO: 115604 - DNA, 22 bp, Artificial Sequence
  Synthetic oligonucleotide; TTC chr11 5383057 5383078 5383062 5383057 -
ttccccagactatgctacagaa

SEQ ID NO: 115605 - DNA, 22 bp, Artificial Sequence
  Synthetic oligonucleotide; CTT chr11 5383055 5383076 5383060 5383055 -
ccccagactatgctacagaacc

SEQ ID NO: 115606 - DNA, 22 bp, Artificial Sequence
  Synthetic oligonucleotide; TTC chr11 5383054 5383075 5383059 5383054 -
cccagactatgctacagaacct

SEQ ID NO: 115607 - DNA, 22 bp, Artificial Sequence
  Synthetic oligonucleotide; CTA chr11 5383045 5383066 5383050 5383045 -
tgctacagaacctgagttaatg

SEQ ID NO: 115608 - DNA, 22 bp, Artificial Sequence
  Synthetic oligonucleotide; CTA chr11 5383040 5383061 5383045 5383040 -
cagaacctgagttaatgtgatc

SEQ ID NO: 115609 - DNA, 22 bp, Artificial Sequence
  Synthetic oligonucleotide; CTG chr11 5383031 5383052 5383036 5383031 -
agttaatgtgatcaggtcatgt

SEQ ID NO: 115610 - DNA, 22 bp, Artificial Sequence
  Synthetic oligonucleotide; TTA chr11 5383026 5383047 5383031 5383026 -
atgtgatcaggtcatgtgtaca

SEQ ID NO: 115611 - DNA, 22 bp, Artificial Sequence
  Synthetic oligonucleotide; TTT chr11 5383001 5383022 5383006 5383001 -
ctcttttctttcaaaactcaca

SEQ ID NO: 115612 - DNA, 22 bp, Artificial Sequence
  Synthetic oligonucleotide; TTC chr11 5383000 5383021 5383005 5383000 -
tcttttctttcaaaactcacac

SEQ ID NO: 115613 - DNA, 22 bp, Artificial Sequence
  Synthetic oligonucleotide; CTC chr11 5382998 5383019 5383003 5382998 -
ttttctttcaaaactcacacac

SEQ ID NO: 115614 - DNA, 22 bp, Artificial Sequence
  Synthetic oligonucleotide; CTT chr11 5382996 5383017 5383001 5382996 -
ttctttcaaaactcacacacaa

SEQ ID NO: 115615 - DNA, 22 bp, Artificial Sequence
  Synthetic oligonucleotide; TTT chr11 5382995 5383016 5383000 5382995 -
tctttcaaaactcacacacaac

SEQ ID NO: 115616 - DNA, 22 bp, Artificial Sequence
  Synthetic oligonucleotide; TTT chr11 5382994 5383015 5382999 5382994 -
ctttcaaaactcacacacaacc

SEQ ID NO: 115617 - DNA, 22 bp, Artificial Sequence
  Synthetic oligonucleotide; TTC chr11 5382993 5383014 5382998 5382993 -
tttcaaaactcacacacaacct

SEQ ID NO: 115618 - DNA, 22 bp, Artificial Sequence
  Synthetic oligonucleotide; CTT chr11 5382991 5383012 5382996 5382991 -
tcaaaactcacacacaacctct

SEQ ID NO: 115619 - DNA, 22 bp, Artificial Sequence
  Synthetic oligonucleotide; TTT chr11 5382990 5383011 5382995 5382990 -
caaaactcacacacaacctctc

SEQ ID NO: 115620 - DNA, 22 bp, Artificial Sequence
  Synthetic oligonucleotide; TTC chr11 5382989 5383010 5382994 5382989 -
aaaactcacacacaacctctcc

SEQ ID NO: 115621 - DNA, 22 bp, Artificial Sequence
  Synthetic oligonucleotide; CTC chr11 5382982 5383003 5382987 5382982 -
acacacaacctctccaccacaa

SEQ ID NO: 115622 - DNA, 22 bp, Artificial Sequence
  Synthetic oligonucleotide; CTC chr11 5382970 5382991 5382975 5382970 -
tccaccacaaacacacacacac

SEQ ID NO: 115623 - DNA, 22 bp, Artificial Sequence
  Synthetic oligonucleotide; CTC chr11 5382968 5382989 5382973 5382968 -
caccacaaacacacacacactc

SEQ ID NO: 115624 - DNA, 22 bp, Artificial Sequence
  Synthetic oligonucleotide; CTC chr11 5382946 5382967 5382951 5382946 -
ttggagactggcatgaagcaag

SEQ ID NO: 115625 - DNA, 22 bp, Artificial Sequence
  Synthetic oligonucleotide; CTT chr11 5382944 5382965 5382949 5382944 -
ggagactggcatgaagcaaggt

SEQ ID NO: 115626 - DNA, 22 bp, Artificial Sequence
  Synthetic oligonucleotide; TTG chr11 5382943 5382964 5382948 5382943 -
gagactggcatgaagcaaggta

SEQ ID NO: 115627 - DNA, 22 bp, Artificial Sequence
  Synthetic oligonucleotide; CTG chr11 5382936 5382957 5382941 5382936 -
gcatgaagcaaggtattacatc

SEQ ID NO: 115628 - DNA, 22 bp, Artificial Sequence
  Synthetic oligonucleotide; TTA chr11 5382918 5382939 5382923 5382918 -
catcctttaaatagggcatggt

SEQ ID NO: 115629 - DNA, 22 bp, Artificial Sequence
  Synthetic oligonucleotide; CTT chr11 5382911 5382932 5382916 5382911 -
taaatagggcatggttgattag

SEQ ID NO: 115630 - DNA, 22 bp, Artificial Sequence
  Synthetic oligonucleotide; TTT chr11 5382910 5382931 5382915 5382910 -
aaatagggcatggttgattaga

SEQ ID NO: 115631 - DNA, 22 bp, Artificial Sequence
  Synthetic oligonucleotide; TTA chr11 5382909 5382930 5382914 5382909 -
aatagggcatggttgattagag

SEQ ID NO: 115632 - DNA, 22 bp, Artificial Sequence
  Synthetic oligonucleotide; TTG chr11 5382894 5382915 5382899 5382894 -
attagagttgtgtggggatgag

SEQ ID NO: 115633 - DNA, 22 bp, Artificial Sequence
  Synthetic oligonucleotide; TTA chr11 5382890 5382911 5382895 5382890 -
gagttgtgtggggatgagctcc

SEQ ID NO: 115634 - DNA, 22 bp, Artificial Sequence
  Synthetic oligonucleotide; TTG chr11 5382884 5382905 5382889 5382884 -
tgtggggatgagctccaaaacg

SEQ ID NO: 115635 - DNA, 22 bp, Artificial Sequence
  Synthetic oligonucleotide; CTC chr11 5382869 5382890 5382874 5382869 -
caaaacggggcatacagatcta

SEQ ID NO: 115636 - DNA, 22 bp, Artificial Sequence
  Synthetic oligonucleotide; CTA chr11 5382847 5382868 5382852 5382847 -
aaaccaggacagagacccatga

SEQ ID NO: 115637 - DNA, 22 bp, Artificial Sequence
  Synthetic oligonucleotide; TTT chr11 5382820 5382841 5382825 5382820 -
atgacatgccattgtgatcaga

SEQ ID NO: 115638 - DNA, 22 bp, Artificial Sequence
  Synthetic oligonucleotide; TTA chr11 5382819 5382840 5382824 5382819 -
tgacatgccattgtgatcagac

SEQ ID NO: 115639 - DNA, 22 bp, Artificial Sequence
  Synthetic oligonucleotide; TTG chr11 5382806 5382827 5382811 5382806 -
tgatcagaccacacccagacag

SEQ ID NO: 115640 - DNA, 22 bp, Artificial Sequence
  Synthetic oligonucleotide; CTT chr11 5382769 5382790 5382774 5382769 -
acaccgggtaagtaactggttg

SEQ ID NO: 115641 - DNA, 22 bp, Artificial Sequence
  Synthetic oligonucleotide; TTA chr11 5382768 5382789 5382773 5382768 -
caccgggtaagtaactggttgt

SEQ ID NO: 115642 - DNA, 22 bp, Artificial Sequence
  Synthetic oligonucleotide; CTG chr11 5382751 5382772 5382756 5382751 -
gttgttagggccagagtgtagg

SEQ ID NO: 115643 - DNA, 22 bp, Artificial Sequence
  Synthetic oligonucleotide; TTG chr11 5382747 5382768 5382752 5382747 -
ttagggccagagtgtaggagag

SEQ ID NO: 115644 - DNA, 22 bp, Artificial Sequence
  Synthetic oligonucleotide; TTA chr11 5382744 5382765 5382749 5382744 -
gggccagagtgtaggagagtca

SEQ ID NO: 115645 - DNA, 22 bp, Artificial Sequence
  Synthetic oligonucleotide; CTT chr11 5382686 5382707 5382691 5382686 -
attaaattgtagttatgaggaa

SEQ ID NO: 115646 - DNA, 22 bp, Artificial Sequence
  Synthetic oligonucleotide; TTA chr11 5382685 5382706 5382690 5382685 -
ttaaattgtagttatgaggaag

SEQ ID NO: 115647 - DNA, 22 bp, Artificial Sequence
  Synthetic oligonucleotide; TTA chr11 5382682 5382703 5382687 5382682 -
aattgtagttatgaggaaggtt

SEQ ID NO: 115648 - DNA, 22 bp, Artificial Sequence
  Synthetic oligonucleotide; TTG chr11 5382677 5382698 5382682 5382677 -
tagttatgaggaaggttctggc

SEQ ID NO: 115649 - DNA, 22 bp, Artificial Sequence
  Synthetic oligonucleotide; TTA chr11 5382671 5382692 5382676 5382671 -
tgaggaaggttctggcttcggt

SEQ ID NO: 115650 - DNA, 22 bp, Artificial Sequence
  Synthetic oligonucleotide; TTC chr11 5382659 5382680 5382664 5382659 -
tggcttcggtacaataggaagg

SEQ ID NO: 115651 - DNA, 22 bp, Artificial Sequence
  Synthetic oligonucleotide; CTG chr11 5382657 5382678 5382662 5382657 -
gcttcggtacaataggaaggag

SEQ ID NO: 115652 - DNA, 22 bp, Artificial Sequence
  Synthetic oligonucleotide; CTT chr11 5382653 5382674 5382658 5382653 -
cggtacaataggaaggagctga

SEQ ID NO: 115653 - DNA, 22 bp, Artificial Sequence
  Synthetic oligonucleotide; TTC chr11 5382652 5382673 5382657 5382652 -
ggtacaataggaaggagctgag

SEQ ID NO: 115654 - DNA, 22 bp, Artificial Sequence
  Synthetic oligonucleotide; CTG chr11 5382632 5382653 5382637 5382632 -
agcatcttcatttaggcttgta

SEQ ID NO: 115655 - DNA, 22 bp, Artificial Sequence
  Synthetic oligonucleotide; CTT chr11 5382624 5382645 5382629 5382624 -
catttaggcttgtaggagaggg

SEQ ID NO: 115656 - DNA, 22 bp, Artificial Sequence
  Synthetic oligonucleotide; TTC chr11 5382623 5382644 5382628 5382623 -
atttaggcttgtaggagagggc

SEQ ID NO: 115657 - DNA, 22 bp, Artificial Sequence
  Synthetic oligonucleotide; TTT chr11 5382619 5382640 5382624 5382619 -
aggcttgtaggagagggcacca

SEQ ID NO: 115658 - DNA, 22 bp, Artificial Sequence
  Synthetic oligonucleotide; TTA chr11 5382618 5382639 5382623 5382618 -
ggcttgtaggagagggcaccac

SEQ ID NO: 115659 - DNA, 22 bp, Artificial Sequence
  Synthetic oligonucleotide; CTT chr11 5382613 5382634 5382618 5382613 -
gtaggagagggcaccactacca

SEQ ID NO: 115660 - DNA, 22 bp, Artificial Sequence
  Synthetic oligonucleotide; TTG chr11 5382612 5382633 5382617 5382612 -
taggagagggcaccactaccag

SEQ ID NO: 115661 - DNA, 22 bp, Artificial Sequence
  Synthetic oligonucleotide; CTA chr11 5382594 5382615 5382599 5382594 -
ccagaaaaatttcagaaaatcc

SEQ ID NO: 115662 - DNA, 22 bp, Artificial Sequence
  Synthetic oligonucleotide; TTT chr11 5382582 5382603 5382587 5382582 -
cagaaaatcctgcatttattaa

SEQ ID NO: 115663 - DNA, 22 bp, Artificial Sequence
  Synthetic oligonucleotide; TTC chr11 5382581 5382602 5382586 5382581 -
agaaaatcctgcatttattaag

SEQ ID NO: 115664 - DNA, 22 bp, Artificial Sequence
  Synthetic oligonucleotide; CTG chr11 5382570 5382591 5382575 5382570 -
catttattaagaacatgatttt

SEQ ID NO: 115665 - DNA, 22 bp, Artificial Sequence
  Synthetic oligonucleotide; TTT chr11 5382565 5382586 5382570 5382565 -
attaagaacatgattttagcct

SEQ ID NO: 115666 - DNA, 22 bp, Artificial Sequence
  Synthetic oligonucleotide; TTA chr11 5382564 5382585 5382569 5382564 -
ttaagaacatgattttagccta

SEQ ID NO: 115667 - DNA, 22 bp, Artificial Sequence
  Synthetic oligonucleotide; TTA chr11 5382561 5382582 5382566 5382561 -
agaacatgattttagcctattt

SEQ ID NO: 115668 - DNA, 22 bp, Artificial Sequence
  Synthetic oligonucleotide; TTT chr11 5382549 5382570 5382554 5382549 -
tagcctatttcactgggatcct

SEQ ID NO: 115669 - DNA, 22 bp, Artificial Sequence
  Synthetic oligonucleotide; TTT chr11 5382548 5382569 5382553 5382548 -
agcctatttcactgggatccta

SEQ ID NO: 115670 - DNA, 22 bp, Artificial Sequence
  Synthetic oligonucleotide; TTA chr11 5382547 5382568 5382552 5382547 -
gcctatttcactgggatcctag

SEQ ID NO: 115671 - DNA, 22 bp, Artificial Sequence
  Synthetic oligonucleotide; CTA chr11 5382542 5382563 5382547 5382542 -
tttcactgggatcctagccaag

SEQ ID NO: 115672 - DNA, 22 bp, Artificial Sequence
  Synthetic oligonucleotide; TTT chr11 5382539 5382560 5382544 5382539 -
cactgggatcctagccaaggac

SEQ ID NO: 115673 - DNA, 22 bp, Artificial Sequence
  Synthetic oligonucleotide; TTC chr11 5382538 5382559 5382543 5382538 -
actgggatcctagccaaggaca

SEQ ID NO: 115674 - DNA, 22 bp, Artificial Sequence
  Synthetic oligonucleotide; CTG chr11 5382534 5382555 5382539 5382534 -
ggatcctagccaaggacagtat

SEQ ID NO: 115675 - DNA, 22 bp, Artificial Sequence
  Synthetic oligonucleotide; CTA chr11 5382526 5382547 5382531 5382526 -
gccaaggacagtataacagcaa

SEQ ID NO: 115676 - DNA, 22 bp, Artificial Sequence
  Synthetic oligonucleotide; CTG chr11 5382496 5382517 5382501 5382496 -
ctattattaccagcaacagcaa

SEQ ID NO: 115677 - DNA, 22 bp, Artificial Sequence
  Synthetic oligonucleotide; CTA chr11 5382493 5382514 5382498 5382493 -
ttattaccagcaacagcaaata

SEQ ID NO: 115678 - DNA, 22 bp, Artificial Sequence
  Synthetic oligonucleotide; TTA chr11 5382490 5382511 5382495 5382490 -
ttaccagcaacagcaaatattg

SEQ ID NO: 115679 - DNA, 22 bp, Artificial Sequence
  Synthetic oligonucleotide; TTA chr11 5382487 5382508 5382492 5382487 -
ccagcaacagcaaatattgcta

SEQ ID NO: 115680 - DNA, 22 bp, Artificial Sequence
  Synthetic oligonucleotide; TTG chr11 5382468 5382489 5382473 5382468 -
ctattattcaggggcatctatc

SEQ ID NO: 115681 - DNA, 22 bp, Artificial Sequence
  Synthetic oligonucleotide; CTA chr11 5382465 5382486 5382470 5382465 -
ttattcaggggcatctatcaca

SEQ ID NO: 115682 - DNA, 22 bp, Artificial Sequence
  Synthetic oligonucleotide; TTA chr11 5382462 5382483 5382467 5382462 -
ttcaggggcatctatcacacat

SEQ ID NO: 115683 - DNA, 22 bp, Artificial Sequence
  Synthetic oligonucleotide; TTC chr11 5382459 5382480 5382464 5382459 -
aggggcatctatcacacataag

SEQ ID NO: 115684 - DNA, 22 bp, Artificial Sequence
  Synthetic oligonucleotide; CTA chr11 5382448 5382469 5382453 5382448 -
tcacacataagataggaaaaca

SEQ ID NO: 115685 - DNA, 22 bp, Artificial Sequence
  Synthetic oligonucleotide; CTA chr11 5382422 5382443 5382427 5382422 -
tcttagcgcaatgtaagagatg

SEQ ID NO: 115686 - DNA, 22 bp, Artificial Sequence
  Synthetic oligonucleotide; CTT chr11 5382418 5382439 5382423 5382418 -
agcgcaatgtaagagatggaca

SEQ ID NO: 115687 - DNA, 22 bp, Artificial Sequence
  Synthetic oligonucleotide; TTA chr11 5382417 5382438 5382422 5382417 -
gcgcaatgtaagagatggacat

SEQ ID NO: 115688 - DNA, 22 bp, Artificial Sequence
  Synthetic oligonucleotide; TTA chr11 5382387 5382408 5382392 5382387 -
tattaatatttgtgggtagcac

SEQ ID NO: 115689 - DNA, 22 bp, Artificial Sequence
  Synthetic oligonucleotide; TTA chr11 5382382 5382403 5382387 5382382 -
atatttgtgggtagcacctggc

SEQ ID NO: 115690 - DNA, 22 bp, Artificial Sequence
  Synthetic oligonucleotide; TTT chr11 5382376 5382397 5382381 5382376 -
gtgggtagcacctggcccacag

SEQ ID NO: 115691 - DNA, 22 bp, Artificial Sequence
  Synthetic oligonucleotide; TTG chr11 5382375 5382396 5382380 5382375 -
tgggtagcacctggcccacagg

SEQ ID NO: 115692 - DNA, 22 bp, Artificial Sequence
  Synthetic oligonucleotide; CTG chr11 5382362 5382383 5382367 5382362 -
gcccacaggtgagggccaggga

SEQ ID NO: 115693 - DNA, 22 bp, Artificial Sequence
  Synthetic oligonucleotide; CTG chr11 5382327 5382348 5382332 5382327 -
agctatgaagactaattaagaa

SEQ ID NO: 115694 - DNA, 22 bp, Artificial Sequence
  Synthetic oligonucleotide; CTA chr11 5382322 5382343 5382327 5382322 -
tgaagactaattaagaatcaac

SEQ ID NO: 115695 - DNA, 22 bp, Artificial Sequence
  Synthetic oligonucleotide; CTA chr11 5382313 5382334 5382318 5382313 -
attaagaatcaaccacagatag

SEQ ID NO: 115696 - DNA, 22 bp, Artificial Sequence
  Synthetic oligonucleotide; TTA chr11 5382309 5382330 5382314 5382309 -
agaatcaaccacagatagggct

SEQ ID NO: 115697 - DNA, 22 bp, Artificial Sequence
  Synthetic oligonucleotide; CTT chr11 5382286 5382307 5382291 5382286 -
tatagaaaggtatttccaaaaa

SEQ ID NO: 115698 - DNA, 22 bp, Artificial Sequence
  Synthetic oligonucleotide; TTT chr11 5382285 5382306 5382290 5382285 -
atagaaaggtatttccaaaaag

SEQ ID NO: 115699 - DNA, 22 bp, Artificial Sequence
  Synthetic oligonucleotide; TTA chr11 5382284 5382305 5382289 5382284 -
tagaaaggtatttccaaaaagg

SEQ ID NO: 115700 - DNA, 22 bp, Artificial Sequence
  Synthetic oligonucleotide; TTT chr11 5382271 5382292 5382276 5382271 -
ccaaaaaggaggggtagtgtaa

SEQ ID NO: 115701 - DNA, 22 bp, Artificial Sequence
  Synthetic oligonucleotide; TTC chr11 5382270 5382291 5382275 5382270 -
caaaaaggaggggtagtgtaag

SEQ ID NO: 115702 - DNA, 22 bp, Artificial Sequence
  Synthetic oligonucleotide; TTG chr11 5382221 5382242 5382226 5382221 -
tttatgtgttttgagaactata

SEQ ID NO: 115703 - DNA, 22 bp, Artificial Sequence
  Synthetic oligonucleotide; TTT chr11 5382218 5382239 5382223 5382218 -
atgtgttttgagaactataaga

SEQ ID NO: 115704 - DNA, 22 bp, Artificial Sequence
  Synthetic oligonucleotide; TTA chr11 5382217 5382238 5382222 5382217 -
tgtgttttgagaactataagat

SEQ ID NO: 115705 - DNA, 22 bp, Artificial Sequence
  Synthetic oligonucleotide; TTT chr11 5382210 5382231 5382215 5382210 -
tgagaactataagattttccgg

SEQ ID NO: 115706 - DNA, 22 bp, Artificial Sequence
  Synthetic oligonucleotide; TTT chr11 5382209 5382230 5382214 5382209 -
gagaactataagattttccggt

SEQ ID NO: 115707 - DNA, 22 bp, Artificial Sequence
  Synthetic oligonucleotide; TTG chr11 5382208 5382229 5382213 5382208 -
agaactataagattttccggtg

SEQ ID NO: 115708 - DNA, 22 bp, Artificial Sequence
  Synthetic oligonucleotide; CTA chr11 5382201 5382222 5382206 5382201 -
taagattttccggtgatcaaat

SEQ ID NO: 115709 - DNA, 22 bp, Artificial Sequence
  Synthetic oligonucleotide; TTT chr11 5382193 5382214 5382198 5382193 -
tccggtgatcaaatataacatt

SEQ ID NO: 115710 - DNA, 22 bp, Artificial Sequence
  Synthetic oligonucleotide; TTT chr11 5382192 5382213 5382197 5382192 -
ccggtgatcaaatataacattt

SEQ ID NO: 115711 - DNA, 22 bp, Artificial Sequence
  Synthetic oligonucleotide; TTC chr11 5382191 5382212 5382196 5382191 -
cggtgatcaaatataacattta

SEQ ID NO: 115712 - DNA, 22 bp, Artificial Sequence
  Synthetic oligonucleotide; TTT chr11 5382170 5382191 5382175 5382170 -
aagagagttaataccttggaat

SEQ ID NO: 115713 - DNA, 22 bp, Artificial Sequence
  Synthetic oligonucleotide; TTA chr11 5382169 5382190 5382174 5382169 -
agagagttaataccttggaata

SEQ ID NO: 115714 - DNA, 22 bp, Artificial Sequence
  Synthetic oligonucleotide; TTA chr11 5382160 5382181 5382165 5382160 -
ataccttggaataaaacagtag

SEQ ID NO: 115715 - DNA, 22 bp, Artificial Sequence
  Synthetic oligonucleotide; CTT chr11 5382153 5382174 5382158 5382153 -
ggaataaaacagtagaggtagg

SEQ ID NO: 115716 - DNA, 22 bp, Artificial Sequence
  Synthetic oligonucleotide; TTG chr11 5382152 5382173 5382157 5382152 -
gaataaaacagtagaggtaggc

SEQ ID NO: 115717 - DNA, 22 bp, Artificial Sequence
  Synthetic oligonucleotide; CTG chr11 5382115 5382136 5382120 5382115 -
aatgagtttatatgacatgtca

SEQ ID NO: 115718 - DNA, 22 bp, Artificial Sequence
  Synthetic oligonucleotide; TTT chr11 5382106 5382127 5382111 5382106 -
atatgacatgtcaaacatggta

SEQ ID NO: 115719 - DNA, 22 bp, Artificial Sequence
  Synthetic oligonucleotide; TTA chr11 5382105 5382126 5382110 5382105 -
tatgacatgtcaaacatggtac

SEQ ID NO: 115720 - DNA, 22 bp, Artificial Sequence
  Synthetic oligonucleotide; TTT chr11 5382077 5382098 5382082 5382077 -
tgatggttgggtttaaaaaggc

SEQ ID NO: 115721 - DNA, 22 bp, Artificial Sequence
  Synthetic oligonucleotide; TTT chr11 5382076 5382097 5382081 5382076 -
gatggttgggtttaaaaaggca

SEQ ID NO: 115722 - DNA, 22 bp, Artificial Sequence
  Synthetic oligonucleotide; TTG chr11 5382075 5382096 5382080 5382075 -
atggttgggtttaaaaaggcag

SEQ ID NO: 115723 - DNA, 22 bp, Artificial Sequence
  Synthetic oligonucleotide; TTG chr11 5382068 5382089 5382073 5382068 -
ggtttaaaaaggcaggagataa

SEQ ID NO: 115724 - DNA, 22 bp, Artificial Sequence
  Synthetic oligonucleotide; TTT chr11 5382063 5382084 5382068 5382063 -
aaaaaggcaggagataacaatc

SEQ ID NO: 115725 - DNA, 22 bp, Artificial Sequence
  Synthetic oligonucleotide; TTA chr11 5382062 5382083 5382067 5382062 -
aaaaggcaggagataacaatca

SEQ ID NO: 115726 - DNA, 22 bp, Artificial Sequence
  Synthetic oligonucleotide; TTT chr11 5382035 5382056 5382040 5382035 -
tccagagtacattgttaacaat

SEQ ID NO: 115727 - DNA, 22 bp, Artificial Sequence
  Synthetic oligonucleotide; TTT chr11 5382034 5382055 5382039 5382034 -
ccagagtacattgttaacaata

SEQ ID NO: 115728 - DNA, 22 bp, Artificial Sequence
  Synthetic oligonucleotide; TTC chr11 5382033 5382054 5382038 5382033 -
cagagtacattgttaacaatat

SEQ ID NO: 115729 - DNA, 22 bp, Artificial Sequence
  Synthetic oligonucleotide; TTG chr11 5382021 5382042 5382026 5382021 -
ttaacaatatgcaggaaggatt

SEQ ID NO: 115730 - DNA, 22 bp, Artificial Sequence
  Synthetic oligonucleotide; TTA chr11 5382018 5382039 5382023 5382018 -
acaatatgcaggaaggatttaa

SEQ ID NO: 115731 - DNA, 22 bp, Artificial Sequence
  Synthetic oligonucleotide; TTT chr11 5381998 5382019 5382003 5381998 -
aaagtctgcactggaaacagat

SEQ ID NO: 115732 - DNA, 22 bp, Artificial Sequence
  Synthetic oligonucleotide; TTA chr11 5381997 5382018 5382002 5381997 -
aagtctgcactggaaacagatg

SEQ ID NO: 115733 - DNA, 22 bp, Artificial Sequence
  Synthetic oligonucleotide; CTG chr11 5381990 5382011 5381995 5381990 -
cactggaaacagatgttatttt

SEQ ID NO: 115734 - DNA, 22 bp, Artificial Sequence
  Synthetic oligonucleotide; CTG chr11 5381985 5382006 5381990 5381985 -
gaaacagatgttattttggtgt

SEQ ID NO: 115735 - DNA, 22 bp, Artificial Sequence
  Synthetic oligonucleotide; TTA chr11 5381972 5381993 5381977 5381972 -
ttttggtgtatggagctggatg

SEQ ID NO: 115736 - DNA, 22 bp, Artificial Sequence
  Synthetic oligonucleotide; TTT chr11 5381969 5381990 5381974 5381969 -
tggtgtatggagctggatgcag

SEQ ID NO: 115737 - DNA, 22 bp, Artificial Sequence
  Synthetic oligonucleotide; TTT chr11 5381968 5381989 5381973 5381968 -
ggtgtatggagctggatgcaga

SEQ ID NO: 115738 - DNA, 22 bp, Artificial Sequence
  Synthetic oligonucleotide; TTG chr11 5381967 5381988 5381972 5381967 -
gtgtatggagctggatgcagat

SEQ ID NO: 115739 - DNA, 22 bp, Artificial Sequence
  Synthetic oligonucleotide; CTG chr11 5381954 5381975 5381959 5381954 -
gatgcagatatgtaattgacag

SEQ ID NO: 115740 - DNA, 22 bp, Artificial Sequence
  Synthetic oligonucleotide; TTG chr11 5381936 5381957 5381941 5381936 -
acagctttttacgtagataaac

SEQ ID NO: 115741 - DNA, 22 bp, Artificial Sequence
  Synthetic oligonucleotide; CTT chr11 5381929 5381950 5381934 5381929 -
tttacgtagataaacaatactg

SEQ ID NO: 115742 - DNA, 22 bp, Artificial Sequence
  Synthetic oligonucleotide; TTT chr11 5381928 5381949 5381933 5381928 -
ttacgtagataaacaatactgt

SEQ ID NO: 115743 - DNA, 22 bp, Artificial Sequence
  Synthetic oligonucleotide; TTT chr11 5381927 5381948 5381932 5381927 -
tacgtagataaacaatactgtt

SEQ ID NO: 115744 - DNA, 22 bp, Artificial Sequence
  Synthetic oligonucleotide; TTT chr11 5381926 5381947 5381931 5381926 -
acgtagataaacaatactgttt

SEQ ID NO: 115745 - DNA, 22 bp, Artificial Sequence
  Synthetic oligonucleotide; TTA chr11 5381925 5381946 5381930 5381925 -
cgtagataaacaatactgttta

SEQ ID NO: 115746 - DNA, 22 bp, Artificial Sequence
  Synthetic oligonucleotide; CTG chr11 5381907 5381928 5381912 5381907 -
tttagtggataacctaccattt

SEQ ID NO: 115747 - DNA, 22 bp, Artificial Sequence
  Synthetic oligonucleotide; TTT chr11 5381904 5381925 5381909 5381904 -
agtggataacctaccatttaga

SEQ ID NO: 115748 - DNA, 22 bp, Artificial Sequence
  Synthetic oligonucleotide; TTA chr11 5381903 5381924 5381908 5381903 -
gtggataacctaccatttagag

SEQ ID NO: 115749 - DNA, 22 bp, Artificial Sequence
  Synthetic oligonucleotide; CTA chr11 5381891 5381912 5381896 5381891 -
ccatttagagatctctaatatt

SEQ ID NO: 115750 - DNA, 22 bp, Artificial Sequence
  Synthetic oligonucleotide; TTT chr11 5381885 5381906 5381890 5381885 -
agagatctctaatatttgctta

SEQ ID NO: 115751 - DNA, 22 bp, Artificial Sequence
  Synthetic oligonucleotide; TTA chr11 5381884 5381905 5381889 5381884 -
gagatctctaatatttgcttac

SEQ ID NO: 115752 - DNA, 22 bp, Artificial Sequence
  Synthetic oligonucleotide; CTC chr11 5381876 5381897 5381881 5381876 -
taatatttgcttacttttttaa

SEQ ID NO: 115753 - DNA, 22 bp, Artificial Sequence
  Synthetic oligonucleotide; CTA chr11 5381874 5381895 5381879 5381874 -
atatttgcttacttttttaaac

SEQ ID NO: 115754 - DNA, 22 bp, Artificial Sequence
  Synthetic oligonucleotide; TTT chr11 5381868 5381889 5381873 5381868 -
gcttacttttttaaactaacat

SEQ ID NO: 115755 - DNA, 22 bp, Artificial Sequence
  Synthetic oligonucleotide; TTG chr11 5381867 5381888 5381872 5381867 -
cttacttttttaaactaacatc

SEQ ID NO: 115756 - DNA, 22 bp, Artificial Sequence
  Synthetic oligonucleotide; CTT chr11 5381864 5381885 5381869 5381864 -
acttttttaaactaacatctgt

SEQ ID NO: 115757 - DNA, 22 bp, Artificial Sequence
  Synthetic oligonucleotide; TTA chr11 5381863 5381884 5381868 5381863 -
cttttttaaactaacatctgta

SEQ ID NO: 115758 - DNA, 22 bp, Artificial Sequence
  Synthetic oligonucleotide; CTT chr11 5381860 5381881 5381865 5381860 -
ttttaaactaacatctgtataa

SEQ ID NO: 115759 - DNA, 22 bp, Artificial Sequence
  Synthetic oligonucleotide; TTT chr11 5381859 5381880 5381864 5381859 -
tttaaactaacatctgtataat

SEQ ID NO: 115760 - DNA, 22 bp, Artificial Sequence
  Synthetic oligonucleotide; TTT chr11 5381858 5381879 5381863 5381858 -
ttaaactaacatctgtataata

SEQ ID NO: 115761 - DNA, 22 bp, Artificial Sequence
  Synthetic oligonucleotide; TTT chr11 5381857 5381878 5381862 5381857 -
taaactaacatctgtataatag

SEQ ID NO: 115762 - DNA, 22 bp, Artificial Sequence
  Synthetic oligonucleotide; TTT chr11 5381856 5381877 5381861 5381856 -
aaactaacatctgtataatagc

SEQ ID NO: 115763 - DNA, 22 bp, Artificial Sequence
  Synthetic oligonucleotide; TTA chr11 5381855 5381876 5381860 5381855 -
aactaacatctgtataatagct

SEQ ID NO: 115764 - DNA, 22 bp, Artificial Sequence
  Synthetic oligonucleotide; CTA chr11 5381850 5381871 5381855 5381850 -
acatctgtataatagctttata

SEQ ID NO: 115765 - DNA, 22 bp, Artificial Sequence
  Synthetic oligonucleotide; CTG chr11 5381843 5381864 5381848 5381843 -
tataatagctttatattctatt

SEQ ID NO: 115766 - DNA, 22 bp, Artificial Sequence
  Synthetic oligonucleotide; CTT chr11 5381832 5381853 5381837 5381832 -
tatattctatttctctgaatta

SEQ ID NO: 115767 - DNA, 22 bp, Artificial Sequence
  Synthetic oligonucleotide; TTT chr11 5381831 5381852 5381836 5381831 -
atattctatttctctgaattat

SEQ ID NO: 115768 - DNA, 22 bp, Artificial Sequence
  Synthetic oligonucleotide; TTA chr11 5381830 5381851 5381835 5381830 -
tattctatttctctgaattata

SEQ ID NO: 115769 - DNA, 22 bp, Artificial Sequence
  Synthetic oligonucleotide; TTC chr11 5381825 5381846 5381830 5381825 -
tatttctctgaattatataatt

SEQ ID NO: 115770 - DNA, 22 bp, Artificial Sequence
  Synthetic oligonucleotide; CTA chr11 5381823 5381844 5381828 5381823 -
tttctctgaattatataattga

SEQ ID NO: 115771 - DNA, 22 bp, Artificial Sequence
  Synthetic oligonucleotide; TTT chr11 5381820 5381841 5381825 5381820 -
ctctgaattatataattgaagg

SEQ ID NO: 115772 - DNA, 22 bp, Artificial Sequence
  Synthetic oligonucleotide; TTC chr11 5381819 5381840 5381824 5381819 -
tctgaattatataattgaagga

SEQ ID NO: 115773 - DNA, 22 bp, Artificial Sequence
  Synthetic oligonucleotide; CTC chr11 5381817 5381838 5381822 5381817 -
tgaattatataattgaaggacc

SEQ ID NO: 115774 - DNA, 22 bp, Artificial Sequence
  Synthetic oligonucleotide; CTG chr11 5381815 5381836 5381820 5381815 -
aattatataattgaaggaccag

SEQ ID NO: 115775 - DNA, 22 bp, Artificial Sequence
  Synthetic oligonucleotide; TTA chr11 5381810 5381831 5381815 5381810 -
tataattgaaggaccagtttcc

SEQ ID NO: 115776 - DNA, 22 bp, Artificial Sequence
  Synthetic oligonucleotide; TTG chr11 5381802 5381823 5381807 5381802 -
aaggaccagtttccaagcaata

SEQ ID NO: 115777 - DNA, 22 bp, Artificial Sequence
  Synthetic oligonucleotide; TTT chr11 5381790 5381811 5381795 5381790 -
ccaagcaatagatttatttgaa

SEQ ID NO: 115778 - DNA, 22 bp, Artificial Sequence
  Synthetic oligonucleotide; TTC chr11 5381789 5381810 5381794 5381789 -
caagcaatagatttatttgaaa

SEQ ID NO: 115779 - DNA, 22 bp, Artificial Sequence
  Synthetic oligonucleotide; TTT chr11 5381775 5381796 5381780 5381775 -
atttgaaaaccaaatgaaagaa

SEQ ID NO: 115780 - DNA, 22 bp, Artificial Sequence
  Synthetic oligonucleotide; TTA chr11 5381774 5381795 5381779 5381774 -
tttgaaaaccaaatgaaagaac

SEQ ID NO: 115781 - DNA, 22 bp, Artificial Sequence
  Synthetic oligonucleotide; TTT chr11 5381771 5381792 5381776 5381771 -
gaaaaccaaatgaaagaactca

SEQ ID NO: 115782 - DNA, 22 bp, Artificial Sequence
  Synthetic oligonucleotide; TTG chr11 5381770 5381791 5381775 5381770 -
aaaaccaaatgaaagaactcag

SEQ ID NO: 115783 - DNA, 22 bp, Artificial Sequence
  Synthetic oligonucleotide; CTC chr11 5381750 5381771 5381755 5381750 -
agcatttttgattctttattgc

SEQ ID NO: 115784 - DNA, 22 bp, Artificial Sequence
  Synthetic oligonucleotide; TTT chr11 5381743 5381764 5381748 5381743 -
ttgattctttattgctctaaat

SEQ ID NO: 115785 - DNA, 22 bp, Artificial Sequence
  Synthetic oligonucleotide; TTT chr11 5381742 5381763 5381747 5381742 -
tgattctttattgctctaaatg

SEQ ID NO: 115786 - DNA, 22 bp, Artificial Sequence
  Synthetic oligonucleotide; TTT chr11 5381741 5381762 5381746 5381741 -
gattctttattgctctaaatga

SEQ ID NO: 115787 - DNA, 22 bp, Artificial Sequence
  Synthetic oligonucleotide; TTG chr11 5381740 5381761 5381745 5381740 -
attctttattgctctaaatgac

SEQ ID NO: 115788 - DNA, 22 bp, Artificial Sequence
  Synthetic oligonucleotide; TTC chr11 5381736 5381757 5381741 5381736 -
tttattgctctaaatgaccttt

SEQ ID NO: 115789 - DNA, 22 bp, Artificial Sequence
  Synthetic oligonucleotide; CTT chr11 5381734 5381755 5381739 5381734 -
tattgctctaaatgacctttag

SEQ ID NO: 115790 - DNA, 22 bp, Artificial Sequence
  Synthetic oligonucleotide; TTT chr11 5381733 5381754 5381738 5381733 -
attgctctaaatgacctttaga

SEQ ID NO: 115791 - DNA, 22 bp, Artificial Sequence
  Synthetic oligonucleotide; TTA chr11 5381732 5381753 5381737 5381732 -
ttgctctaaatgacctttagat

SEQ ID NO: 115792 - DNA, 22 bp, Artificial Sequence
  Synthetic oligonucleotide; TTG chr11 5381729 5381750 5381734 5381729 -
ctctaaatgacctttagatttg

SEQ ID NO: 115793 - DNA, 22 bp, Artificial Sequence
  Synthetic oligonucleotide; CTC chr11 5381726 5381747 5381731 5381726 -
taaatgacctttagatttgttt

SEQ ID NO: 115794 - DNA, 22 bp, Artificial Sequence
  Synthetic oligonucleotide; CTA chr11 5381724 5381745 5381729 5381724 -
aatgacctttagatttgtttta

SEQ ID NO: 115795 - DNA, 22 bp, Artificial Sequence
  Synthetic oligonucleotide; CTT chr11 5381715 5381736 5381720 5381715 -
tagatttgttttatcatatcac

SEQ ID NO: 115796 - DNA, 22 bp, Artificial Sequence
  Synthetic oligonucleotide; TTT chr11 5381714 5381735 5381719 5381714 -
agatttgttttatcatatcaca

SEQ ID NO: 115797 - DNA, 22 bp, Artificial Sequence
  Synthetic oligonucleotide; TTA chr11 5381713 5381734 5381718 5381713 -
gatttgttttatcatatcacaa

SEQ ID NO: 115798 - DNA, 22 bp, Artificial Sequence
  Synthetic oligonucleotide; TTT chr11 5381708 5381729 5381713 5381708 -
gttttatcatatcacaaaatag

SEQ ID NO: 115799 - DNA, 22 bp, Artificial Sequence
  Synthetic oligonucleotide; TTG chr11 5381707 5381728 5381712 5381707 -
ttttatcatatcacaaaatagt

SEQ ID NO: 115800 - DNA, 22 bp, Artificial Sequence
  Synthetic oligonucleotide; TTT chr11 5381704 5381725 5381709 5381704 -
tatcatatcacaaaatagtcct

SEQ ID NO: 115801 - DNA, 22 bp, Artificial Sequence
  Synthetic oligonucleotide; TTT chr11 5381703 5381724 5381708 5381703 -
atcatatcacaaaatagtcctc

SEQ ID NO: 115802 - DNA, 22 bp, Artificial Sequence
  Synthetic oligonucleotide; TTA chr11 5381702 5381723 5381707 5381702 -
tcatatcacaaaatagtcctct

SEQ ID NO: 115803 - DNA, 22 bp, Artificial Sequence
  Synthetic oligonucleotide; CTC chr11 5381681 5381702 5381686 5381681 -
tttgaagtgtgactgaaattac

SEQ ID NO: 115804 - DNA, 22 bp, Artificial Sequence
  Synthetic oligonucleotide; CTT chr11 5381679 5381700 5381684 5381679 -
tgaagtgtgactgaaattacat

SEQ ID NO: 115805 - DNA, 22 bp, Artificial Sequence
  Synthetic oligonucleotide; TTT chr11 5381678 5381699 5381683 5381678 -
gaagtgtgactgaaattacatt

SEQ ID NO: 115806 - DNA, 22 bp, Artificial Sequence
  Synthetic oligonucleotide; TTG chr11 5381677 5381698 5381682 5381677 -
aagtgtgactgaaattacatta

SEQ ID NO: 115807 - DNA, 22 bp, Artificial Sequence
  Synthetic oligonucleotide; CTG chr11 5381666 5381687 5381671 5381666 -
aaattacattaaacattctcat

SEQ ID NO: 115808 - DNA, 22 bp, Artificial Sequence
  Synthetic oligonucleotide; TTA chr11 5381660 5381681 5381665 5381660 -
cattaaacattctcatcaattt

SEQ ID NO: 115809 - DNA, 22 bp, Artificial Sequence
  Synthetic oligonucleotide; TTA chr11 5381655 5381676 5381660 5381655 -
aacattctcatcaattttcatt

SEQ ID NO: 115810 - DNA, 22 bp, Artificial Sequence
  Synthetic oligonucleotide; TTC chr11 5381648 5381669 5381653 5381648 -
tcatcaattttcattgacgtgc

SEQ ID NO: 115811 - DNA, 22 bp, Artificial Sequence
  Synthetic oligonucleotide; CTC chr11 5381646 5381667 5381651 5381646 -
atcaattttcattgacgtgcat

SEQ ID NO: 115812 - DNA, 22 bp, Artificial Sequence
  Synthetic oligonucleotide; TTT chr11 5381638 5381659 5381643 5381638 -
tcattgacgtgcattaagtgcg

SEQ ID NO: 115813 - DNA, 22 bp, Artificial Sequence
  Synthetic oligonucleotide; TTT chr11 5381637 5381658 5381642 5381637 -
cattgacgtgcattaagtgcgt

SEQ ID NO: 115814 - DNA, 22 bp, Artificial Sequence
  Synthetic oligonucleotide; TTC chr11 5381636 5381657 5381641 5381636 -
attgacgtgcattaagtgcgtc

SEQ ID NO: 115815 - DNA, 22 bp, Artificial Sequence
  Synthetic oligonucleotide; TTG chr11 5381632 5381653 5381637 5381632 -
acgtgcattaagtgcgtcctgt

SEQ ID NO: 115816 - DNA, 22 bp, Artificial Sequence
  Synthetic oligonucleotide; TTA chr11 5381622 5381643 5381627 5381622 -
agtgcgtcctgtgagaaactct

SEQ ID NO: 115817 - DNA, 22 bp, Artificial Sequence
  Synthetic oligonucleotide; CTG chr11 5381611 5381632 5381616 5381611 -
tgagaaactctgatcaagaact

SEQ ID NO: 115818 - DNA, 22 bp, Artificial Sequence
  Synthetic oligonucleotide; CTC chr11 5381601 5381622 5381606 5381601 -
tgatcaagaacttgaagataga

SEQ ID NO: 115819 - DNA, 22 bp, Artificial Sequence
  Synthetic oligonucleotide; CTG chr11 5381599 5381620 5381604 5381599 -
atcaagaacttgaagatagaca

SEQ ID NO: 115820 - DNA, 22 bp, Artificial Sequence
  Synthetic oligonucleotide; CTT chr11 5381588 5381609 5381593 5381588 -
gaagatagacagattaacatgt

SEQ ID NO: 115821 - DNA, 22 bp, Artificial Sequence
  Synthetic oligonucleotide; TTG chr11 5381587 5381608 5381592 5381587 -
aagatagacagattaacatgtc

SEQ ID NO: 115822 - DNA, 22 bp, Artificial Sequence
  Synthetic oligonucleotide; TTA chr11 5381572 5381593 5381577 5381572 -
acatgtcatggtcttgccttta

SEQ ID NO: 115823 - DNA, 22 bp, Artificial Sequence
  Synthetic oligonucleotide; CTT chr11 5381557 5381578 5381562 5381557 -
gcctttatgaagctcacattga

SEQ ID NO: 115824 - DNA, 22 bp, Artificial Sequence
  Synthetic oligonucleotide; TTG chr11 5381556 5381577 5381561 5381556 -
cctttatgaagctcacattgag

SEQ ID NO: 115825 - DNA, 22 bp, Artificial Sequence
  Synthetic oligonucleotide; CTT chr11 5381552 5381573 5381557 5381552 -
tatgaagctcacattgagtaaa

SEQ ID NO: 115826 - DNA, 22 bp, Artificial Sequence
  Synthetic oligonucleotide; TTT chr11 5381551 5381572 5381556 5381551 -
atgaagctcacattgagtaaag

SEQ ID NO: 115827 - DNA, 22 bp, Artificial Sequence
  Synthetic oligonucleotide; TTA chr11 5381550 5381571 5381555 5381550 -
tgaagctcacattgagtaaaga

SEQ ID NO: 115828 - DNA, 22 bp, Artificial Sequence
  Synthetic oligonucleotide; CTC chr11 5381542 5381563 5381547 5381542 -
acattgagtaaagatgttagat

SEQ ID NO: 115829 - DNA, 22 bp, Artificial Sequence
  Synthetic oligonucleotide; TTG chr11 5381536 5381557 5381541 5381536 -
agtaaagatgttagattgttca

SEQ ID NO: 115830 - DNA, 22 bp, Artificial Sequence
  Synthetic oligonucleotide; TTA chr11 5381523 5381544 5381528 5381523 -
gattgttcaacgaagtttccaa

SEQ ID NO: 115831 - DNA, 22 bp, Artificial Sequence
  Synthetic oligonucleotide; TTG chr11 5381518 5381539 5381523 5381518 -
ttcaacgaagtttccaaaatag

SEQ ID NO: 115832 - DNA, 22 bp, Artificial Sequence
  Synthetic oligonucleotide; TTC chr11 5381515 5381536 5381520 5381515 -
aacgaagtttccaaaatagggt

SEQ ID NO: 115833 - DNA, 22 bp, Artificial Sequence
  Synthetic oligonucleotide; TTT chr11 5381505 5381526 5381510 5381505 -
ccaaaatagggtcactagccca

SEQ ID NO: 115834 - DNA, 22 bp, Artificial Sequence
  Synthetic oligonucleotide; TTC chr11 5381504 5381525 5381509 5381504 -
caaaatagggtcactagcccag

SEQ ID NO: 115835 - DNA, 22 bp, Artificial Sequence
  Synthetic oligonucleotide; CTA chr11 5381488 5381509 5381493 5381488 -
gcccaggctaggaaggcagagg

SEQ ID NO: 115836 - DNA, 22 bp, Artificial Sequence
  Synthetic oligonucleotide; CTA chr11 5381478 5381499 5381483 5381478 -
ggaaggcagaggtagtttctga

SEQ ID NO: 115837 - DNA, 22 bp, Artificial Sequence
  Synthetic oligonucleotide; TTT chr11 5381460 5381481 5381465 5381460 -
ctgaagcctggaggccaagagg

SEQ ID NO: 115838 - DNA, 22 bp, Artificial Sequence
  Synthetic oligonucleotide; TTC chr11 5381459 5381480 5381464 5381459 -
tgaagcctggaggccaagagga

SEQ ID NO: 115839 - DNA, 22 bp, Artificial Sequence
  Synthetic oligonucleotide; CTG chr11 5381457 5381478 5381462 5381457 -
aagcctggaggccaagaggagg

SEQ ID NO: 115840 - DNA, 22 bp, Artificial Sequence
  Synthetic oligonucleotide; CTG chr11 5381450 5381471 5381455 5381450 -
gaggccaagaggaggatgatgg

SEQ ID NO: 115841 - DNA, 22 bp, Artificial Sequence
  Synthetic oligonucleotide; CTC chr11 5381405 5381426 5381410 5381405 -
ggacctatctctatcactgtgg

SEQ ID NO: 115842 - DNA, 22 bp, Artificial Sequence
  Synthetic oligonucleotide; CTA chr11 5381398 5381419 5381403 5381398 -
tctctatcactgtgggtaatca

SEQ ID NO: 115843 - DNA, 22 bp, Artificial Sequence
  Synthetic oligonucleotide; CTC chr11 5381394 5381415 5381399 5381394 -
tatcactgtgggtaatcatgcg

SEQ ID NO: 115844 - DNA, 22 bp, Artificial Sequence
  Synthetic oligonucleotide; CTA chr11 5381392 5381413 5381397 5381392 -
tcactgtgggtaatcatgcgaa

SEQ ID NO: 115845 - DNA, 22 bp, Artificial Sequence
  Synthetic oligonucleotide; CTG chr11 5381386 5381407 5381391 5381386 -
tgggtaatcatgcgaatattag

SEQ ID NO: 115846 - DNA, 22 bp, Artificial Sequence
  Synthetic oligonucleotide; TTA chr11 5381365 5381386 5381370 5381365 -
ggtgaagtgaatgtgggtgcat

SEQ ID NO: 115847 - DNA, 22 bp, Artificial Sequence
  Synthetic oligonucleotide; TTG chr11 5381335 5381356 5381340 5381335 -
gggaaggtgaagtatcaacaca

SEQ ID NO: 115848 - DNA, 22 bp, Artificial Sequence
  Synthetic oligonucleotide; TTA chr11 5381310 5381331 5381315 5381310 -
gtgtgaggcattcaggccttaa

SEQ ID NO: 115849 - DNA, 22 bp, Artificial Sequence
  Synthetic oligonucleotide; TTC chr11 5381297 5381318 5381302 5381297 -
aggccttaacctttaaggtatt

SEQ ID NO: 115850 - DNA, 22 bp, Artificial Sequence
  Synthetic oligonucleotide; CTT chr11 5381290 5381311 5381295 5381290 -
aacctttaaggtattagaattc

SEQ ID NO: 115851 - DNA, 22 bp, Artificial Sequence
  Synthetic oligonucleotide; TTA chr11 5381289 5381310 5381294 5381289 -
acctttaaggtattagaattca

SEQ ID NO: 115852 - DNA, 22 bp, Artificial Sequence
  Synthetic oligonucleotide; CTT chr11 5381284 5381305 5381289 5381284 -
taaggtattagaattcattatt

SEQ ID NO: 115853 - DNA, 22 bp, Artificial Sequence
  Synthetic oligonucleotide; TTT chr11 5381283 5381304 5381288 5381283 -
aaggtattagaattcattatta

SEQ ID NO: 115854 - DNA, 22 bp, Artificial Sequence
  Synthetic oligonucleotide; TTA chr11 5381282 5381303 5381287 5381282 -
aggtattagaattcattattaa

SEQ ID NO: 115855 - DNA, 22 bp, Artificial Sequence
  Synthetic oligonucleotide; TTA chr11 5381274 5381295 5381279 5381274 -
gaattcattattaaagaatcta

SEQ ID NO: 115856 - DNA, 22 bp, Artificial Sequence
  Synthetic oligonucleotide; TTC chr11 5381268 5381289 5381273 5381268 -
attattaaagaatctaaatcca

SEQ ID NO: 115857 - DNA, 22 bp, Artificial Sequence
  Synthetic oligonucleotide; TTA chr11 5381264 5381285 5381269 5381264 -
ttaaagaatctaaatccattac

SEQ ID NO: 115858 - DNA, 22 bp, Artificial Sequence
  Synthetic oligonucleotide; TTA chr11 5381261 5381282 5381266 5381261 -
aagaatctaaatccattactaa

SEQ ID NO: 115859 - DNA, 22 bp, Artificial Sequence
  Synthetic oligonucleotide; CTA chr11 5381252 5381273 5381257 5381252 -
aatccattactaaaagtgaaaa

SEQ ID NO: 115860 - DNA, 22 bp, Artificial Sequence
  Synthetic oligonucleotide; TTA chr11 5381243 5381264 5381248 5381243 -
ctaaaagtgaaaagtgtcactg

SEQ ID NO: 115861 - DNA, 22 bp, Artificial Sequence
  Synthetic oligonucleotide; CTA chr11 5381240 5381261 5381245 5381240 -
aaagtgaaaagtgtcactgtaa

SEQ ID NO: 115862 - DNA, 22 bp, Artificial Sequence
  Synthetic oligonucleotide; CTG chr11 5381221 5381242 5381226 5381221 -
taacagtgtacctatttgttaa

SEQ ID NO: 115863 - DNA, 22 bp, Artificial Sequence
  Synthetic oligonucleotide; CTA chr11 5381207 5381228 5381212 5381207 -
tttgttaatgtgcaaatggttt

SEQ ID NO: 115864 - DNA, 22 bp, Artificial Sequence
  Synthetic oligonucleotide; TTT chr11 5381204 5381225 5381209 5381204 -
gttaatgtgcaaatggttttca

SEQ ID NO: 115865 - DNA, 22 bp, Artificial Sequence
  Synthetic oligonucleotide; TTG chr11 5381203 5381224 5381208 5381203 -
ttaatgtgcaaatggttttcat

SEQ ID NO: 115866 - DNA, 22 bp, Artificial Sequence
  Synthetic oligonucleotide; TTA chr11 5381200 5381221 5381205 5381200 -
atgtgcaaatggttttcattgc

SEQ ID NO: 115867 - DNA, 22 bp, Artificial Sequence
  Synthetic oligonucleotide; TTT chr11 5381185 5381206 5381190 5381185 -
tcattgcatgtaatattgtttg

SEQ ID NO: 115868 - DNA, 22 bp, Artificial Sequence
  Synthetic oligonucleotide; TTT chr11 5381184 5381205 5381189 5381184 -
cattgcatgtaatattgtttgt

SEQ ID NO: 115869 - DNA, 22 bp, Artificial Sequence
  Synthetic oligonucleotide; TTC chr11 5381183 5381204 5381188 5381183 -
attgcatgtaatattgtttgtg

SEQ ID NO: 115870 - DNA, 22 bp, Artificial Sequence
  Synthetic oligonucleotide; TTG chr11 5381179 5381200 5381184 5381179 -
catgtaatattgtttgtgtgtg

SEQ ID NO: 115871 - DNA, 22 bp, Artificial Sequence
  Synthetic oligonucleotide; TTG chr11 5381167 5381188 5381172 5381167 -
tttgtgtgtgtgtgagagagag

SEQ ID NO: 115872 - DNA, 22 bp, Artificial Sequence
  Synthetic oligonucleotide; TTT chr11 5381164 5381185 5381169 5381164 -
gtgtgtgtgtgagagagagaga

SEQ ID NO: 115873 - DNA, 22 bp, Artificial Sequence
  Synthetic oligonucleotide; TTG chr11 5381163 5381184 5381168 5381163 -
tgtgtgtgtgagagagagagag

SEQ ID NO: 115874 - DNA, 22 bp, Artificial Sequence
  Synthetic oligonucleotide; CTG chr11 5381076 5381097 5381081 5381076 -
gctttcaaggggccagtataag

SEQ ID NO: 115875 - DNA, 22 bp, Artificial Sequence
  Synthetic oligonucleotide; CTT chr11 5381072 5381093 5381077 5381072 -
tcaaggggccagtataagtttt

SEQ ID NO: 115876 - DNA, 22 bp, Artificial Sequence
  Synthetic oligonucleotide; TTT chr11 5381071 5381092 5381076 5381071 -
caaggggccagtataagtttta

SEQ ID NO: 115877 - DNA, 22 bp, Artificial Sequence
  Synthetic oligonucleotide; TTC chr11 5381070 5381091 5381075 5381070 -
aaggggccagtataagttttat

SEQ ID NO: 115878 - DNA, 22 bp, Artificial Sequence
  Synthetic oligonucleotide; TTT chr11 5381051 5381072 5381056 5381051 -
tatttaaggaacctctatccag

SEQ ID NO: 115879 - DNA, 22 bp, Artificial Sequence
  Synthetic oligonucleotide; TTT chr11 5381050 5381071 5381055 5381050 -
atttaaggaacctctatccaga

SEQ ID NO: 115880 - DNA, 22 bp, Artificial Sequence
  Synthetic oligonucleotide; TTA chr11 5381049 5381070 5381054 5381049 -
tttaaggaacctctatccagaa

SEQ ID NO: 115881 - DNA, 22 bp, Artificial Sequence
  Synthetic oligonucleotide; TTT chr11 5381046 5381067 5381051 5381046 -
aaggaacctctatccagaattg

SEQ ID NO: 115882 - DNA, 22 bp, Artificial Sequence
  Synthetic oligonucleotide; TTA chr11 5381045 5381066 5381050 5381045 -
aggaacctctatccagaattga

SEQ ID NO: 115883 - DNA, 22 bp, Artificial Sequence
  Synthetic oligonucleotide; CTC chr11 5381036 5381057 5381041 5381036 -
tatccagaattgatacctagcc

SEQ ID NO: 115884 - DNA, 22 bp, Artificial Sequence
  Synthetic oligonucleotide; CTA chr11 5381034 5381055 5381039 5381034 -
tccagaattgatacctagccag

SEQ ID NO: 115885 - DNA, 22 bp, Artificial Sequence
  Synthetic oligonucleotide; TTG chr11 5381024 5381045 5381029 5381024 -
atacctagccagcccactgagc

SEQ ID NO: 115886 - DNA, 22 bp, Artificial Sequence
  Synthetic oligonucleotide; CTA chr11 5381017 5381038 5381022 5381017 -
gccagcccactgagccaggctt

SEQ ID NO: 115887 - DNA, 22 bp, Artificial Sequence
  Synthetic oligonucleotide; CTG chr11 5381005 5381026 5381010 5381005 -
agccaggcttggtgaagtagga

SEQ ID NO: 115888 - DNA, 22 bp, Artificial Sequence
  Synthetic oligonucleotide; CTT chr11 5380995 5381016 5381000 5380995 -
ggtgaagtaggagattccttca

SEQ ID NO: 115889 - DNA, 22 bp, Artificial Sequence
  Synthetic oligonucleotide; TTG chr11 5380994 5381015 5380999 5380994 -
gtgaagtaggagattccttcag

SEQ ID NO: 115890 - DNA, 22 bp, Artificial Sequence
  Synthetic oligonucleotide; TTC chr11 5380978 5380999 5380983 5380978 -
cttcaggagaactgaatcccca

SEQ ID NO: 115891 - DNA, 22 bp, Artificial Sequence
  Synthetic oligonucleotide; CTT chr11 5380975 5380996 5380980 5380975 -
caggagaactgaatccccaagg

SEQ ID NO: 115892 - DNA, 22 bp, Artificial Sequence
  Synthetic oligonucleotide; TTC chr11 5380974 5380995 5380979 5380974 -
aggagaactgaatccccaaggt

SEQ ID NO: 115893 - DNA, 22 bp, Artificial Sequence
  Synthetic oligonucleotide; CTG chr11 5380964 5380985 5380969 5380964 -
aatccccaaggtctgtacacat

SEQ ID NO: 115894 - DNA, 22 bp, Artificial Sequence
  Synthetic oligonucleotide; CTG chr11 5380949 5380970 5380954 5380949 -
tacacatgctgtggttttccaa

SEQ ID NO: 115895 - DNA, 22 bp, Artificial Sequence
  Synthetic oligonucleotide; CTG chr11 5380938 5380959 5380943 5380938 -
tggttttccaatgtagccacca

SEQ ID NO: 115896 - DNA, 22 bp, Artificial Sequence
  Synthetic oligonucleotide; TTT chr11 5380932 5380953 5380937 5380932 -
tccaatgtagccaccaggggga

SEQ ID NO: 115897 - DNA, 22 bp, Artificial Sequence
  Synthetic oligonucleotide; TTT chr11 5380931 5380952 5380936 5380931 -
ccaatgtagccaccagggggag

SEQ ID NO: 115898 - DNA, 22 bp, Artificial Sequence
  Synthetic oligonucleotide; TTC chr11 5380930 5380951 5380935 5380930 -
caatgtagccaccagggggagc

SEQ ID NO: 115899 - DNA, 22 bp, Artificial Sequence
  Synthetic oligonucleotide; TTC chr11 5380904 5380925 5380909 5380904 -
agcccaaggataggcttaaatt

SEQ ID NO: 115900 - DNA, 22 bp, Artificial Sequence
  Synthetic oligonucleotide; CTT chr11 5380887 5380908 5380892 5380887 -
aaattctgaccagcaccaaggc

SEQ ID NO: 115901 - DNA, 22 bp, Artificial Sequence
  Synthetic oligonucleotide; TTA chr11 5380886 5380907 5380891 5380886 -
aattctgaccagcaccaaggcc

SEQ ID NO: 115902 - DNA, 22 bp, Artificial Sequence
  Synthetic oligonucleotide; TTC chr11 5380881 5380902 5380886 5380881 -
tgaccagcaccaaggccctact

SEQ ID NO: 115903 - DNA, 22 bp, Artificial Sequence
  Synthetic oligonucleotide; CTG chr11 5380879 5380900 5380884 5380879 -
accagcaccaaggccctactat

SEQ ID NO: 115904 - DNA, 22 bp, Artificial Sequence
  Synthetic oligonucleotide; CTA chr11 5380861 5380882 5380866 5380861 -
ctatccccagggcacaagaaaa

SEQ ID NO: 115905 - DNA, 22 bp, Artificial Sequence
  Synthetic oligonucleotide; CTA chr11 5380858 5380879 5380863 5380858 -
tccccagggcacaagaaaatgt

SEQ ID NO: 115906 - DNA, 22 bp, Artificial Sequence
  Synthetic oligonucleotide; CTT chr11 5380831 5380852 5380836 5380831 -
ttcttccagcaccaccttcccg

SEQ ID NO: 115907 - DNA, 22 bp, Artificial Sequence
  Synthetic oligonucleotide; TTT chr11 5380830 5380851 5380835 5380830 -
tcttccagcaccaccttcccgt

SEQ ID NO: 115908 - DNA, 22 bp, Artificial Sequence
  Synthetic oligonucleotide; TTT chr11 5380829 5380850 5380834 5380829 -
cttccagcaccaccttcccgtg

SEQ ID NO: 115909 - DNA, 22 bp, Artificial Sequence
  Synthetic oligonucleotide; TTC chr11 5380828 5380849 5380833 5380828 -
ttccagcaccaccttcccgtgt

SEQ ID NO: 115910 - DNA, 22 bp, Artificial Sequence
  Synthetic oligonucleotide; CTT chr11 5380826 5380847 5380831 5380826 -
ccagcaccaccttcccgtgtcc

SEQ ID NO: 115911 - DNA, 22 bp, Artificial Sequence
  Synthetic oligonucleotide; TTC chr11 5380825 5380846 5380830 5380825 -
cagcaccaccttcccgtgtcct

SEQ ID NO: 115912 - DNA, 22 bp, Artificial Sequence
  Synthetic oligonucleotide; CTT chr11 5380813 5380834 5380818 5380813 -
cccgtgtcctcaatacccacta

SEQ ID NO: 115913 - DNA, 22 bp, Artificial Sequence
  Synthetic oligonucleotide; TTC chr11 5380812 5380833 5380817 5380812 -
ccgtgtcctcaatacccactac

SEQ ID NO: 115914 - DNA, 22 bp, Artificial Sequence
  Synthetic oligonucleotide; CTC chr11 5380802 5380823 5380807 5380802 -
aatacccactacacagctgaaa

SEQ ID NO: 115915 - DNA, 22 bp, Artificial Sequence
  Synthetic oligonucleotide; CTA chr11 5380791 5380812 5380796 5380791 -
cacagctgaaagctgccaacca

SEQ ID NO: 115916 - DNA, 22 bp, Artificial Sequence
  Synthetic oligonucleotide; CTG chr11 5380783 5380804 5380788 5380783 -
aaagctgccaaccagttcattc

SEQ ID NO: 115917 - DNA, 22 bp, Artificial Sequence
  Synthetic oligonucleotide; CTG chr11 5380776 5380797 5380781 5380776 -
ccaaccagttcattcttccttt

SEQ ID NO: 115918 - DNA, 22 bp, Artificial Sequence
  Synthetic oligonucleotide; TTC chr11 5380765 5380786 5380770 5380765 -
attcttcctttgaggatgatct

SEQ ID NO: 115919 - DNA, 22 bp, Artificial Sequence
  Synthetic oligonucleotide; TTC chr11 5380761 5380782 5380766 5380761 -
ttcctttgaggatgatcttcct

SEQ ID NO: 115920 - DNA, 22 bp, Artificial Sequence
  Synthetic oligonucleotide; CTT chr11 5380759 5380780 5380764 5380759 -
cctttgaggatgatcttcctct

SEQ ID NO: 115921 - DNA, 22 bp, Artificial Sequence
  Synthetic oligonucleotide; TTC chr11 5380758 5380779 5380763 5380758 -
ctttgaggatgatcttcctctc

SEQ ID NO: 115922 - DNA, 22 bp, Artificial Sequence
  Synthetic oligonucleotide; CTT chr11 5380755 5380776 5380760 5380755 -
tgaggatgatcttcctctctct

SEQ ID NO: 115923 - DNA, 22 bp, Artificial Sequence
  Synthetic oligonucleotide; TTT chr11 5380754 5380775 5380759 5380754 -
gaggatgatcttcctctctctc

SEQ ID NO: 115924 - DNA, 22 bp, Artificial Sequence
  Synthetic oligonucleotide; TTG chr11 5380753 5380774 5380758 5380753 -
aggatgatcttcctctctctca

SEQ ID NO: 115925 - DNA, 22 bp, Artificial Sequence
  Synthetic oligonucleotide; CTT chr11 5380742 5380763 5380747 5380742 -
cctctctctcatgcacaaaata

SEQ ID NO: 115926 - DNA, 22 bp, Artificial Sequence
  Synthetic oligonucleotide; TTC chr11 5380741 5380762 5380746 5380741 -
ctctctctcatgcacaaaatag

SEQ ID NO: 115927 - DNA, 22 bp, Artificial Sequence
  Synthetic oligonucleotide; CTC chr11 5380738 5380759 5380743 5380738 -
tctctcatgcacaaaatagaca

SEQ ID NO: 115928 - DNA, 22 bp, Artificial Sequence
  Synthetic oligonucleotide; CTC chr11 5380736 5380757 5380741 5380736 -
tctcatgcacaaaatagacata

SEQ ID NO: 115929 - DNA, 22 bp, Artificial Sequence
  Synthetic oligonucleotide; CTC chr11 5380734 5380755 5380739 5380734 -
tcatgcacaaaatagacatatc

SEQ ID NO: 115930 - DNA, 22 bp, Artificial Sequence
  Synthetic oligonucleotide; CTC chr11 5380732 5380753 5380737 5380732 -
atgcacaaaatagacatatcta

SEQ ID NO: 115931 - DNA, 22 bp, Artificial Sequence
  Synthetic oligonucleotide; CTA chr11 5380710 5380731 5380715 5380710 -
catcttacaaacacataaaaac

SEQ ID NO: 115932 - DNA, 22 bp, Artificial Sequence
  Synthetic oligonucleotide; CTT chr11 5380704 5380725 5380709 5380704 -
acaaacacataaaaactaaaat

SEQ ID NO: 115933 - DNA, 22 bp, Artificial Sequence
  Synthetic oligonucleotide; TTA chr11 5380703 5380724 5380708 5380703 -
caaacacataaaaactaaaatt

SEQ ID NO: 115934 - DNA, 22 bp, Artificial Sequence
  Synthetic oligonucleotide; CTA chr11 5380686 5380707 5380691 5380686 -
aaattgatggagagagataggt

SEQ ID NO: 115935 - DNA, 22 bp, Artificial Sequence
  Synthetic oligonucleotide; TTG chr11 5380680 5380701 5380685 5380680 -
atggagagagataggttttctt

SEQ ID NO: 115936 - DNA, 22 bp, Artificial Sequence
  Synthetic oligonucleotide; TTT chr11 5380662 5380683 5380667 5380662 -
tcttagctttttcagattttta

SEQ ID NO: 115937 - DNA, 22 bp, Artificial Sequence
  Synthetic oligonucleotide; TTT chr11 5380661 5380682 5380666 5380661 -
cttagctttttcagatttttac

SEQ ID NO: 115938 - DNA, 22 bp, Artificial Sequence
  Synthetic oligonucleotide; TTC chr11 5380660 5380681 5380665 5380660 -
ttagctttttcagatttttaca

SEQ ID NO: 115939 - DNA, 22 bp, Artificial Sequence
  Synthetic oligonucleotide; CTT chr11 5380658 5380679 5380663 5380658 -
agctttttcagatttttacaga

SEQ ID NO: 115940 - DNA, 22 bp, Artificial Sequence
  Synthetic oligonucleotide; TTA chr11 5380657 5380678 5380662 5380657 -
gctttttcagatttttacagat

SEQ ID NO: 115941 - DNA, 22 bp, Artificial Sequence
  Synthetic oligonucleotide; CTT chr11 5380653 5380674 5380658 5380653 -
tttcagatttttacagatggta

SEQ ID NO: 115942 - DNA, 22 bp, Artificial Sequence
  Synthetic oligonucleotide; TTT chr11 5380652 5380673 5380657 5380652 -
ttcagatttttacagatggtaa

SEQ ID NO: 115943 - DNA, 22 bp, Artificial Sequence
  Synthetic oligonucleotide; TTT chr11 5380651 5380672 5380656 5380651 -
tcagatttttacagatggtaat

SEQ ID NO: 115944 - DNA, 22 bp, Artificial Sequence
  Synthetic oligonucleotide; TTT chr11 5380650 5380671 5380655 5380650 -
cagatttttacagatggtaatc

SEQ ID NO: 115945 - DNA, 22 bp, Artificial Sequence
  Synthetic oligonucleotide; TTC chr11 5380649 5380670 5380654 5380649 -
agatttttacagatggtaatct

SEQ ID NO: 115946 - DNA, 22 bp, Artificial Sequence
  Synthetic oligonucleotide; TTT chr11 5380643 5380664 5380648 5380643 -
ttacagatggtaatctcacaca

SEQ ID NO: 115947 - DNA, 22 bp, Artificial Sequence
  Synthetic oligonucleotide; TTT chr11 5380642 5380663 5380647 5380642 -
tacagatggtaatctcacacaa

SEQ ID NO: 115948 - DNA, 22 bp, Artificial Sequence
  Synthetic oligonucleotide; TTT chr11 5380641 5380662 5380646 5380641 -
acagatggtaatctcacacaaa

SEQ ID NO: 115949 - DNA, 22 bp, Artificial Sequence
  Synthetic oligonucleotide; TTA chr11 5380640 5380661 5380645 5380640 -
cagatggtaatctcacacaaat

SEQ ID NO: 115950 - DNA, 22 bp, Artificial Sequence
  Synthetic oligonucleotide; CTC chr11 5380626 5380647 5380631 5380626 -
acacaaatctatgtgtgtggcc

SEQ ID NO: 115951 - DNA, 22 bp, Artificial Sequence
  Synthetic oligonucleotide; CTA chr11 5380615 5380636 5380620 5380615 -
tgtgtgtggcctttagtcttaa

SEQ ID NO: 115952 - DNA, 22 bp, Artificial Sequence
  Synthetic oligonucleotide; CTT chr11 5380602 5380623 5380607 5380602 -
tagtcttaatcatattgaccaa

SEQ ID NO: 115953 - DNA, 22 bp, Artificial Sequence
  Synthetic oligonucleotide; TTT chr11 5380601 5380622 5380606 5380601 -
agtcttaatcatattgaccaag

SEQ ID NO: 115954 - DNA, 22 bp, Artificial Sequence
  Synthetic oligonucleotide; TTA chr11 5380600 5380621 5380605 5380600 -
gtcttaatcatattgaccaagc

SEQ ID NO: 115955 - DNA, 22 bp, Artificial Sequence
  Synthetic oligonucleotide; CTT chr11 5380595 5380616 5380600 5380595 -
aatcatattgaccaagccttaa

SEQ ID NO: 115956 - DNA, 22 bp, Artificial Sequence
  Synthetic oligonucleotide; TTA chr11 5380594 5380615 5380599 5380594 -
atcatattgaccaagccttaaa

SEQ ID NO: 115957 - DNA, 22 bp, Artificial Sequence
  Synthetic oligonucleotide; TTG chr11 5380585 5380606 5380590 5380585 -
accaagccttaaatccccactc

SEQ ID NO: 115958 - DNA, 22 bp, Artificial Sequence
  Synthetic oligonucleotide; CTT chr11 5380575 5380596 5380580 5380575 -
aaatccccactctgaccagaaa

SEQ ID NO: 115959 - DNA, 22 bp, Artificial Sequence
  Synthetic oligonucleotide; TTA chr11 5380574 5380595 5380579 5380574 -
aatccccactctgaccagaaac

SEQ ID NO: 115960 - DNA, 22 bp, Artificial Sequence
  Synthetic oligonucleotide; CTC chr11 5380563 5380584 5380568 5380563 -
tgaccagaaacagacctaaata

SEQ ID NO: 115961 - DNA, 22 bp, Artificial Sequence
  Synthetic oligonucleotide; CTG chr11 5380561 5380582 5380566 5380561 -
accagaaacagacctaaataaa

SEQ ID NO: 115962 - DNA, 22 bp, Artificial Sequence
  Synthetic oligonucleotide; CTA chr11 5380545 5380566 5380550 5380545 -
aataaaatccttactcacaggg

SEQ ID NO: 115963 - DNA, 22 bp, Artificial Sequence
  Synthetic oligonucleotide; CTT chr11 5380533 5380554 5380538 5380533 -
actcacagggttctcaatgtct

SEQ ID NO: 115964 - DNA, 22 bp, Artificial Sequence
  Synthetic oligonucleotide; TTA chr11 5380532 5380553 5380537 5380532 -
ctcacagggttctcaatgtctc

SEQ ID NO: 115965 - DNA, 22 bp, Artificial Sequence
  Synthetic oligonucleotide; CTC chr11 5380529 5380550 5380534 5380529 -
acagggttctcaatgtctccag

SEQ ID NO: 115966 - DNA, 22 bp, Artificial Sequence
  Synthetic oligonucleotide; TTC chr11 5380520 5380541 5380525 5380520 -
tcaatgtctccagactcacaac

SEQ ID NO: 115967 - DNA, 22 bp, Artificial Sequence
  Synthetic oligonucleotide; CTC chr11 5380518 5380539 5380523 5380518 -
aatgtctccagactcacaacag

SEQ ID NO: 115968 - DNA, 22 bp, Artificial Sequence
  Synthetic oligonucleotide; CTC chr11 5380510 5380531 5380515 5380510 -
cagactcacaacagactctttt

SEQ ID NO: 115969 - DNA, 22 bp, Artificial Sequence
  Synthetic oligonucleotide; CTC chr11 5380503 5380524 5380508 5380503 -
acaacagactctttttaggtgt

SEQ ID NO: 115970 - DNA, 22 bp, Artificial Sequence
  Synthetic oligonucleotide; CTC chr11 5380492 5380513 5380497 5380492 -
tttttaggtgtctctgtcacag

SEQ ID NO: 115971 - DNA, 22 bp, Artificial Sequence
  Synthetic oligonucleotide; CTT chr11 5380490 5380511 5380495 5380490 -
tttaggtgtctctgtcacagaa

SEQ ID NO: 115972 - DNA, 22 bp, Artificial Sequence
  Synthetic oligonucleotide; TTT chr11 5380489 5380510 5380494 5380489 -
ttaggtgtctctgtcacagaaa

SEQ ID NO: 115973 - DNA, 22 bp, Artificial Sequence
  Synthetic oligonucleotide; TTT chr11 5380488 5380509 5380493 5380488 -
taggtgtctctgtcacagaaaa

SEQ ID NO: 115974 - DNA, 22 bp, Artificial Sequence
  Synthetic oligonucleotide; TTT chr11 5380487 5380508 5380492 5380487 -
aggtgtctctgtcacagaaaat

SEQ ID NO: 115975 - DNA, 22 bp, Artificial Sequence
  Synthetic oligonucleotide; TTA chr11 5380486 5380507 5380491 5380486 -
ggtgtctctgtcacagaaaatg

SEQ ID NO: 115976 - DNA, 22 bp, Artificial Sequence
  Synthetic oligonucleotide; CTC chr11 5380478 5380499 5380483 5380478 -
tgtcacagaaaatggccacaag

SEQ ID NO: 115977 - DNA, 22 bp, Artificial Sequence
  Synthetic oligonucleotide; CTG chr11 5380476 5380497 5380481 5380476 -
tcacagaaaatggccacaaggt

SEQ ID NO: 115978 - DNA, 22 bp, Artificial Sequence
  Synthetic oligonucleotide; CTC chr11 5380448 5380469 5380453 5380448 -
actctcaggcctgttagaacaa

SEQ ID NO: 115979 - DNA, 22 bp, Artificial Sequence
  Synthetic oligonucleotide; CTC chr11 5380444 5380465 5380449 5380444 -
tcaggcctgttagaacaagtcc

SEQ ID NO: 115980 - DNA, 22 bp, Artificial Sequence
  Synthetic oligonucleotide; CTC chr11 5380442 5380463 5380447 5380442 -
aggcctgttagaacaagtcctt

SEQ ID NO: 115981 - DNA, 22 bp, Artificial Sequence
  Synthetic oligonucleotide; CTG chr11 5380435 5380456 5380440 5380435 -
ttagaacaagtccttcccagaa

SEQ ID NO: 115982 - DNA, 22 bp, Artificial Sequence
  Synthetic oligonucleotide; TTA chr11 5380432 5380453 5380437 5380432 -
gaacaagtccttcccagaagaa

SEQ ID NO: 115983 - DNA, 22 bp, Artificial Sequence
  Synthetic oligonucleotide; CTT chr11 5380420 5380441 5380425 5380420 -
cccagaagaactccattttgtg

SEQ ID NO: 115984 - DNA, 22 bp, Artificial Sequence
  Synthetic oligonucleotide; TTC chr11 5380419 5380440 5380424 5380419 -
ccagaagaactccattttgtgg

SEQ ID NO: 115985 - DNA, 22 bp, Artificial Sequence
  Synthetic oligonucleotide; CTC chr11 5380407 5380428 5380412 5380407 -
cattttgtggtgtgagatcgat

SEQ ID NO: 115986 - DNA, 22 bp, Artificial Sequence
  Synthetic oligonucleotide; TTT chr11 5380402 5380423 5380407 5380402 -
tgtggtgtgagatcgatgcggg

SEQ ID NO: 115987 - DNA, 22 bp, Artificial Sequence
  Synthetic oligonucleotide; TTT chr11 5380401 5380422 5380406 5380401 -
gtggtgtgagatcgatgcgggt

SEQ ID NO: 115988 - DNA, 22 bp, Artificial Sequence
  Synthetic oligonucleotide; TTG chr11 5380400 5380421 5380405 5380400 -
tggtgtgagatcgatgcgggtc

SEQ ID NO: 115989 - DNA, 22 bp, Artificial Sequence
  Synthetic oligonucleotide; CTT chr11 5380376 5380397 5380381 5380376 -
tcagactggagagacccacaga

SEQ ID NO: 115990 - DNA, 22 bp, Artificial Sequence
  Synthetic oligonucleotide; TTT chr11 5380375 5380396 5380380 5380375 -
cagactggagagacccacagaa

SEQ ID NO: 115991 - DNA, 22 bp, Artificial Sequence
  Synthetic oligonucleotide; TTC chr11 5380374 5380395 5380379 5380374 -
agactggagagacccacagaag

SEQ ID NO: 115992 - DNA, 22 bp, Artificial Sequence
  Synthetic oligonucleotide; CTG chr11 5380368 5380389 5380373 5380368 -
gagagacccacagaagttagga

SEQ ID NO: 115993 - DNA, 22 bp, Artificial Sequence
  Synthetic oligonucleotide; TTA chr11 5380349 5380370 5380354 5380349 -
ggattgccaaaagggtcttctg

SEQ ID NO: 115994 - DNA, 22 bp, Artificial Sequence
  Synthetic oligonucleotide; TTG chr11 5380343 5380364 5380348 5380343 -
ccaaaagggtcttctggactgg

SEQ ID NO: 115995 - DNA, 22 bp, Artificial Sequence
  Synthetic oligonucleotide; CTT chr11 5380330 5380351 5380335 5380330 -
ctggactggtccacagccccta

SEQ ID NO: 115996 - DNA, 22 bp, Artificial Sequence
  Synthetic oligonucleotide; TTC chr11 5380329 5380350 5380334 5380329 -
tggactggtccacagcccctaa

SEQ ID NO: 115997 - DNA, 22 bp, Artificial Sequence
  Synthetic oligonucleotide; CTG chr11 5380327 5380348 5380332 5380327 -
gactggtccacagcccctaaga

SEQ ID NO: 115998 - DNA, 22 bp, Artificial Sequence
  Synthetic oligonucleotide; CTG chr11 5380322 5380343 5380327 5380322 -
gtccacagcccctaagaaattt

SEQ ID NO: 115999 - DNA, 22 bp, Artificial Sequence
  Synthetic oligonucleotide; CTA chr11 5380308 5380329 5380313 5380308 -
agaaattttcatgttgcaattc

SEQ ID NO: 116000 - DNA, 22 bp, Artificial Sequence
  Synthetic oligonucleotide; TTT chr11 5380300 5380321 5380305 5380300 -
tcatgttgcaattcattttgtc

SEQ ID NO: 116001 - DNA, 22 bp, Artificial Sequence
  Synthetic oligonucleotide; TTT chr11 5380299 5380320 5380304 5380299 -
catgttgcaattcattttgtcc

SEQ ID NO: 116002 - DNA, 22 bp, Artificial Sequence
  Synthetic oligonucleotide; TTC chr11 5380298 5380319 5380303 5380298 -
atgttgcaattcattttgtcca

SEQ ID NO: 116003 - DNA, 22 bp, Artificial Sequence
  Synthetic oligonucleotide; TTG chr11 5380292 5380313 5380297 5380292 -
caattcattttgtccatccccc

SEQ ID NO: 116004 - DNA, 22 bp, Artificial Sequence
  Synthetic oligonucleotide; TTC chr11 5380286 5380307 5380291 5380286 -
attttgtccatccccctgcctc

SEQ ID NO: 116005 - DNA, 22 bp, Artificial Sequence
  Synthetic oligonucleotide; TTT chr11 5380282 5380303 5380287 5380282 -
tgtccatccccctgcctccctg

SEQ ID NO: 116006 - DNA, 22 bp, Artificial Sequence
  Synthetic oligonucleotide; TTT chr11 5380281 5380302 5380286 5380281 -
gtccatccccctgcctccctgg

SEQ ID NO: 116007 - DNA, 22 bp, Artificial Sequence
  Synthetic oligonucleotide; TTG chr11 5380280 5380301 5380285 5380280 -
tccatccccctgcctccctgga

SEQ ID NO: 116008 - DNA, 22 bp, Artificial Sequence
  Synthetic oligonucleotide; CTG chr11 5380268 5380289 5380273 5380268 -
cctccctggacacctgcatctg

SEQ ID NO: 116009 - DNA, 22 bp, Artificial Sequence
  Synthetic oligonucleotide; CTC chr11 5380264 5380285 5380269 5380264 -
cctggacacctgcatctgtgtg

SEQ ID NO: 116010 - DNA, 22 bp, Artificial Sequence
  Synthetic oligonucleotide; CTG chr11 5380260 5380281 5380265 5380260 -
gacacctgcatctgtgtgtgca

SEQ ID NO: 116011 - DNA, 22 bp, Artificial Sequence
  Synthetic oligonucleotide; CTG chr11 5380252 5380273 5380257 5380252 -
catctgtgtgtgcacagagagt

SEQ ID NO: 116012 - DNA, 22 bp, Artificial Sequence
  Synthetic oligonucleotide; CTG chr11 5380246 5380267 5380251 5380246 -
tgtgtgcacagagagtctggaa

SEQ ID NO: 116013 - DNA, 22 bp, Artificial Sequence
  Synthetic oligonucleotide; CTG chr11 5380227 5380248 5380232 5380227 -
gaaggtttacagagaagtctcc

SEQ ID NO: 116014 - DNA, 22 bp, Artificial Sequence
  Synthetic oligonucleotide; TTT chr11 5380219 5380240 5380224 5380219 -
acagagaagtctccacatcttc

SEQ ID NO: 116015 - DNA, 22 bp, Artificial Sequence
  Synthetic oligonucleotide; TTA chr11 5380218 5380239 5380223 5380218 -
cagagaagtctccacatcttcc

SEQ ID NO: 116016 - DNA, 22 bp, Artificial Sequence
  Synthetic oligonucleotide; CTC chr11 5380206 5380227 5380211 5380206 -
cacatcttcccacagcaactct

SEQ ID NO: 116017 - DNA, 22 bp, Artificial Sequence
  Synthetic oligonucleotide; CTT chr11 5380198 5380219 5380203 5380198 -
cccacagcaactctttcagaaa

SEQ ID NO: 116018 - DNA, 22 bp, Artificial Sequence
  Synthetic oligonucleotide; TTC chr11 5380197 5380218 5380202 5380197 -
ccacagcaactctttcagaaac

SEQ ID NO: 116019 - DNA, 22 bp, Artificial Sequence
  Synthetic oligonucleotide; CTC chr11 5380185 5380206 5380190 5380185 -
tttcagaaacgccttctttcgt

SEQ ID NO: 116020 - DNA, 22 bp, Artificial Sequence
  Synthetic oligonucleotide; CTT chr11 5380183 5380204 5380188 5380183 -
tcagaaacgccttctttcgtaa

SEQ ID NO: 116021 - DNA, 22 bp, Artificial Sequence
  Synthetic oligonucleotide; TTT chr11 5380182 5380203 5380187 5380182 -
cagaaacgccttctttcgtaac

SEQ ID NO: 116022 - DNA, 22 bp, Artificial Sequence
  Synthetic oligonucleotide; TTC chr11 5380181 5380202 5380186 5380181 -
agaaacgccttctttcgtaaca

SEQ ID NO: 116023 - DNA, 22 bp, Artificial Sequence
  Synthetic oligonucleotide; CTT chr11 5380170 5380191 5380175 5380170 -
ctttcgtaacatcctacctctc

SEQ ID NO: 116024 - DNA, 22 bp, Artificial Sequence
  Synthetic oligonucleotide; TTC chr11 5380169 5380190 5380174 5380169 -
tttcgtaacatcctacctctct

SEQ ID NO: 116025 - DNA, 22 bp, Artificial Sequence
  Synthetic oligonucleotide; CTT chr11 5380167 5380188 5380172 5380167 -
tcgtaacatcctacctctcttc

SEQ ID NO: 116026 - DNA, 22 bp, Artificial Sequence
  Synthetic oligonucleotide; TTT chr11 5380166 5380187 5380171 5380166 -
cgtaacatcctacctctcttca

SEQ ID NO: 116027 - DNA, 22 bp, Artificial Sequence
  Synthetic oligonucleotide; TTC chr11 5380165 5380186 5380170 5380165 -
gtaacatcctacctctcttcag

SEQ ID NO: 116028 - DNA, 22 bp, Artificial Sequence
  Synthetic oligonucleotide; CTA chr11 5380154 5380175 5380159 5380154 -
cctctcttcagtcattatgaaa

SEQ ID NO: 116029 - DNA, 22 bp, Artificial Sequence
  Synthetic oligonucleotide; CTC chr11 5380150 5380171 5380155 5380150 -
tcttcagtcattatgaaaggga

SEQ ID NO: 116030 - DNA, 22 bp, Artificial Sequence
  Synthetic oligonucleotide; CTC chr11 5380148 5380169 5380153 5380148 -
ttcagtcattatgaaagggaac

SEQ ID NO: 116031 - DNA, 22 bp, Artificial Sequence
  Synthetic oligonucleotide; CTT chr11 5380146 5380167 5380151 5380146 -
cagtcattatgaaagggaaccg

SEQ ID NO: 116032 - DNA, 22 bp, Artificial Sequence
  Synthetic oligonucleotide; TTC chr11 5380145 5380166 5380150 5380145 -
agtcattatgaaagggaaccga

SEQ ID NO: 116033 - DNA, 22 bp, Artificial Sequence
  Synthetic oligonucleotide; TTA chr11 5380137 5380158 5380142 5380137 -
tgaaagggaaccgattttcatt

SEQ ID NO: 116034 - DNA, 22 bp, Artificial Sequence
  Synthetic oligonucleotide; TTT chr11 5380120 5380141 5380125 5380120 -
tcattttcattgtgaaaacttt

SEQ ID NO: 116035 - DNA, 22 bp, Artificial Sequence
  Synthetic oligonucleotide; TTT chr11 5380119 5380140 5380124 5380119 -
cattttcattgtgaaaactttt

SEQ ID NO: 116036 - DNA, 22 bp, Artificial Sequence
  Synthetic oligonucleotide; TTC chr11 5380118 5380139 5380123 5380118 -
attttcattgtgaaaacttttc

SEQ ID NO: 116037 - DNA, 22 bp, Artificial Sequence
  Synthetic oligonucleotide; TTT chr11 5380114 5380135 5380119 5380114 -
tcattgtgaaaacttttcagag

SEQ ID NO: 116038 - DNA, 22 bp, Artificial Sequence
  Synthetic oligonucleotide; TTT chr11 5380113 5380134 5380118 5380113 -
cattgtgaaaacttttcagaga

SEQ ID NO: 116039 - DNA, 22 bp, Artificial Sequence
  Synthetic oligonucleotide; TTC chr11 5380112 5380133 5380117 5380112 -
attgtgaaaacttttcagagag

SEQ ID NO: 116040 - DNA, 22 bp, Artificial Sequence
  Synthetic oligonucleotide; TTG chr11 5380108 5380129 5380113 5380108 -
tgaaaacttttcagagagaccc

SEQ ID NO: 116041 - DNA, 22 bp, Artificial Sequence
  Synthetic oligonucleotide; CTT chr11 5380099 5380120 5380104 5380099 -
ttcagagagaccccttttggga

SEQ ID NO: 116042 - DNA, 22 bp, Artificial Sequence
  Synthetic oligonucleotide; TTT chr11 5380098 5380119 5380103 5380098 -
tcagagagaccccttttgggaa

SEQ ID NO: 116043 - DNA, 22 bp, Artificial Sequence
  Synthetic oligonucleotide; TTT chr11 5380097 5380118 5380102 5380097 -
cagagagaccccttttgggaaa

SEQ ID NO: 116044 - DNA, 22 bp, Artificial Sequence
  Synthetic oligonucleotide; TTC chr11 5380096 5380117 5380101 5380096 -
agagagaccccttttgggaaac

SEQ ID NO: 116045 - DNA, 22 bp, Artificial Sequence
  Synthetic oligonucleotide; CTT chr11 5380083 5380104 5380088 5380083 -
ttgggaaaccatctcttctccc

SEQ ID NO: 116046 - DNA, 22 bp, Artificial Sequence
  Synthetic oligonucleotide; TTT chr11 5380082 5380103 5380087 5380082 -
tgggaaaccatctcttctcccc

SEQ ID NO: 116047 - DNA, 22 bp, Artificial Sequence
  Synthetic oligonucleotide; TTT chr11 5380081 5380102 5380086 5380081 -
gggaaaccatctcttctcccca

SEQ ID NO: 116048 - DNA, 22 bp, Artificial Sequence
  Synthetic oligonucleotide; TTG chr11 5380080 5380101 5380085 5380080 -
ggaaaccatctcttctccccac

SEQ ID NO: 116049 - DNA, 22 bp, Artificial Sequence
  Synthetic oligonucleotide; CTC chr11 5380068 5380089 5380073 5380068 -
ttctccccactccaagttgggc

SEQ ID NO: 116050 - DNA, 22 bp, Artificial Sequence
  Synthetic oligonucleotide; CTT chr11 5380066 5380087 5380071 5380066 -
ctccccactccaagttgggcta

SEQ ID NO: 116051 - DNA, 22 bp, Artificial Sequence
  Synthetic oligonucleotide; TTC chr11 5380065 5380086 5380070 5380065 -
tccccactccaagttgggctaa

SEQ ID NO: 116052 - DNA, 22 bp, Artificial Sequence
  Synthetic oligonucleotide; CTC chr11 5380063 5380084 5380068 5380063 -
cccactccaagttgggctaaag

SEQ ID NO: 116053 - DNA, 22 bp, Artificial Sequence
  Synthetic oligonucleotide; CTC chr11 5380056 5380077 5380061 5380056 -
caagttgggctaaagttttagt

SEQ ID NO: 116054 - DNA, 22 bp, Artificial Sequence
  Synthetic oligonucleotide; TTG chr11 5380049 5380070 5380054 5380049 -
ggctaaagttttagtgtatttt

SEQ ID NO: 116055 - DNA, 22 bp, Artificial Sequence
  Synthetic oligonucleotide; CTA chr11 5380044 5380065 5380049 5380044 -
aagttttagtgtattttgcata

SEQ ID NO: 116056 - DNA, 22 bp, Artificial Sequence
  Synthetic oligonucleotide; TTT chr11 5380038 5380059 5380043 5380038 -
tagtgtattttgcatattttga

SEQ ID NO: 116057 - DNA, 22 bp, Artificial Sequence
  Synthetic oligonucleotide; TTT chr11 5380037 5380058 5380042 5380037 -
agtgtattttgcatattttgat

SEQ ID NO: 116058 - DNA, 22 bp, Artificial Sequence
  Synthetic oligonucleotide; TTA chr11 5380036 5380057 5380041 5380036 -
gtgtattttgcatattttgatt

SEQ ID NO: 116059 - DNA, 22 bp, Artificial Sequence
  Synthetic oligonucleotide; TTT chr11 5380028 5380049 5380033 5380028 -
tgcatattttgatttgctataa

SEQ ID NO: 116060 - DNA, 22 bp, Artificial Sequence
  Synthetic oligonucleotide; TTT chr11 5380027 5380048 5380032 5380027 -
gcatattttgatttgctataac

SEQ ID NO: 116061 - DNA, 22 bp, Artificial Sequence
  Synthetic oligonucleotide; TTG chr11 5380026 5380047 5380031 5380026 -
catattttgatttgctataaca

SEQ ID NO: 116062 - DNA, 22 bp, Artificial Sequence
  Synthetic oligonucleotide; TTT chr11 5380019 5380040 5380024 5380019 -
tgatttgctataacagagtacc

SEQ ID NO: 116063 - DNA, 22 bp, Artificial Sequence
  Synthetic oligonucleotide; TTT chr11 5380018 5380039 5380023 5380018 -
gatttgctataacagagtacct

SEQ ID NO: 116064 - DNA, 22 bp, Artificial Sequence
  Synthetic oligonucleotide; TTG chr11 5380017 5380038 5380022 5380017 -
atttgctataacagagtacctg

SEQ ID NO: 116065 - DNA, 22 bp, Artificial Sequence
  Synthetic oligonucleotide; TTT chr11 5380013 5380034 5380018 5380013 -
gctataacagagtacctgagtc

SEQ ID NO: 116066 - DNA, 22 bp, Artificial Sequence
  Synthetic oligonucleotide; TTG chr11 5380012 5380033 5380017 5380012 -
ctataacagagtacctgagtct

SEQ ID NO: 116067 - DNA, 22 bp, Artificial Sequence
  Synthetic oligonucleotide; CTA chr11 5380009 5380030 5380014 5380009 -
taacagagtacctgagtctggg

SEQ ID NO: 116068 - DNA, 22 bp, Artificial Sequence
  Synthetic oligonucleotide; CTG chr11 5379995 5380016 5380000 5379995 -
agtctgggtagcttattttttt

SEQ ID NO: 116069 - DNA, 22 bp, Artificial Sequence
  Synthetic oligonucleotide; CTG chr11 5379989 5380010 5379994 5379989 -
ggtagcttatttttttttttta

SEQ ID NO: 116070 - DNA, 22 bp, Artificial Sequence
  Synthetic oligonucleotide; CTT chr11 5379981 5380002 5379986 5379981 -
attttttttttttaaagttttg

SEQ ID NO: 116071 - DNA, 22 bp, Artificial Sequence
  Synthetic oligonucleotide; TTA chr11 5379980 5380001 5379985 5379980 -
ttttttttttttaaagttttgt

SEQ ID NO: 116072 - DNA, 22 bp, Artificial Sequence
  Synthetic oligonucleotide; TTT chr11 5379977 5379998 5379982 5379977 -
tttttttttaaagttttgtttg

SEQ ID NO: 116073 - DNA, 22 bp, Artificial Sequence
  Synthetic oligonucleotide; TTT chr11 5379976 5379997 5379981 5379976 -
ttttttttaaagttttgtttgg

SEQ ID NO: 116074 - DNA, 22 bp, Artificial Sequence
  Synthetic oligonucleotide; TTT chr11 5379975 5379996 5379980 5379975 -
tttttttaaagttttgtttggt

SEQ ID NO: 116075 - DNA, 22 bp, Artificial Sequence
  Synthetic oligonucleotide; TTT chr11 5379974 5379995 5379979 5379974 -
ttttttaaagttttgtttggtt

SEQ ID NO: 116076 - DNA, 22 bp, Artificial Sequence
  Synthetic oligonucleotide; TTT chr11 5379973 5379994 5379978 5379973 -
tttttaaagttttgtttggttc

SEQ ID NO: 116077 - DNA, 22 bp, Artificial Sequence
  Synthetic oligonucleotide; TTT chr11 5379972 5379993 5379977 5379972 -
ttttaaagttttgtttggttca

SEQ ID NO: 116078 - DNA, 22 bp, Artificial Sequence
  Synthetic oligonucleotide; TTT chr11 5379971 5379992 5379976 5379971 -
tttaaagttttgtttggttcat

SEQ ID NO: 116079 - DNA, 22 bp, Artificial Sequence
  Synthetic oligonucleotide; TTT chr11 5379970 5379991 5379975 5379970 -
ttaaagttttgtttggttcatg

SEQ ID NO: 116080 - DNA, 22 bp, Artificial Sequence
  Synthetic oligonucleotide; TTT chr11 5379969 5379990 5379974 5379969 -
taaagttttgtttggttcatga

SEQ ID NO: 116081 - DNA, 22 bp, Artificial Sequence
  Synthetic oligonucleotide; TTT chr11 5379968 5379989 5379973 5379968 -
aaagttttgtttggttcatgat

SEQ ID NO: 116082 - DNA, 22 bp, Artificial Sequence
  Synthetic oligonucleotide; TTA chr11 5379967 5379988 5379972 5379967 -
aagttttgtttggttcatgatt

SEQ ID NO: 116083 - DNA, 22 bp, Artificial Sequence
  Synthetic oligonucleotide; TTT chr11 5379961 5379982 5379966 5379961 -
tgtttggttcatgattctggtg

SEQ ID NO: 116084 - DNA, 22 bp, Artificial Sequence
  Synthetic oligonucleotide; TTT chr11 5379960 5379981 5379965 5379960 -
gtttggttcatgattctggtga

SEQ ID NO: 116085 - DNA, 22 bp, Artificial Sequence
  Synthetic oligonucleotide; TTG chr11 5379959 5379980 5379964 5379959 -
tttggttcatgattctggtgac

SEQ ID NO: 116086 - DNA, 22 bp, Artificial Sequence
  Synthetic oligonucleotide; TTT chr11 5379956 5379977 5379961 5379956 -
ggttcatgattctggtgactta

SEQ ID NO: 116087 - DNA, 22 bp, Artificial Sequence
  Synthetic oligonucleotide; TTG chr11 5379955 5379976 5379960 5379955 -
gttcatgattctggtgacttaa

SEQ ID NO: 116088 - DNA, 22 bp, Artificial Sequence
  Synthetic oligonucleotide; TTC chr11 5379951 5379972 5379956 5379951 -
atgattctggtgacttaaaagt

SEQ ID NO: 116089 - DNA, 22 bp, Artificial Sequence
  Synthetic oligonucleotide; TTC chr11 5379944 5379965 5379949 5379944 -
tggtgacttaaaagtccaagat

SEQ ID NO: 116090 - DNA, 22 bp, Artificial Sequence
  Synthetic oligonucleotide; CTG chr11 5379942 5379963 5379947 5379942 -
gtgacttaaaagtccaagatcg

SEQ ID NO: 116091 - DNA, 22 bp, Artificial Sequence
  Synthetic oligonucleotide; CTT chr11 5379935 5379956 5379940 5379935 -
aaaagtccaagatcgggcggtt

SEQ ID NO: 116092 - DNA, 22 bp, Artificial Sequence
  Synthetic oligonucleotide; TTA chr11 5379934 5379955 5379939 5379934 -
aaagtccaagatcgggcggttg

SEQ ID NO: 116093 - DNA, 22 bp, Artificial Sequence
  Synthetic oligonucleotide; TTG chr11 5379912 5379933 5379917 5379912 -
catctgataaaggtctcatgct

SEQ ID NO: 116094 - DNA, 22 bp, Artificial Sequence
  Synthetic oligonucleotide; CTG chr11 5379906 5379927 5379911 5379906 -
ataaaggtctcatgctggttcc

SEQ ID NO: 116095 - DNA, 22 bp, Artificial Sequence
  Synthetic oligonucleotide; CTC chr11 5379895 5379916 5379900 5379895 -
atgctggttccaaacatggcag

SEQ ID NO: 116096 - DNA, 22 bp, Artificial Sequence
  Synthetic oligonucleotide; CTG chr11 5379889 5379910 5379894 5379889 -
gttccaaacatggcagaaagca

SEQ ID NO: 116097 - DNA, 22 bp, Artificial Sequence
  Synthetic oligonucleotide; TTC chr11 5379885 5379906 5379890 5379885 -
caaacatggcagaaagcagaca

SEQ ID NO: 116098 - DNA, 22 bp, Artificial Sequence
  Synthetic oligonucleotide; CTC chr11 5379790 5379811 5379795 5379790 -
atgggaaagtatcaagctgtcc

SEQ ID NO: 116099 - DNA, 22 bp, Artificial Sequence
  Synthetic oligonucleotide; CTG chr11 5379771 5379792 5379776 5379771 -
tccaccatatgtgaaattagaa

SEQ ID NO: 116100 - DNA, 22 bp, Artificial Sequence
  Synthetic oligonucleotide; TTA chr11 5379752 5379773 5379757 5379752 -
gaattctaaaaggaaacaaaaa

SEQ ID NO: 116101 - DNA, 22 bp, Artificial Sequence
  Synthetic oligonucleotide; TTC chr11 5379746 5379767 5379751 5379746 -
taaaaggaaacaaaaaatggat

SEQ ID NO: 116102 - DNA, 22 bp, Artificial Sequence
  Synthetic oligonucleotide; CTA chr11 5379744 5379765 5379749 5379744 -
aaaggaaacaaaaaatggatta

SEQ ID NO: 116103 - DNA, 22 bp, Artificial Sequence
  Synthetic oligonucleotide; TTA chr11 5379722 5379743 5379727 5379722 -
aacgttttttgaggaattattg

SEQ ID NO: 116104 - DNA, 22 bp, Artificial Sequence
  Synthetic oligonucleotide; TTT chr11 5379715 5379736 5379720 5379715 -
tttgaggaattattgactgaat

SEQ ID NO: 116105 - DNA, 22 bp, Artificial Sequence
  Synthetic oligonucleotide; TTT chr11 5379714 5379735 5379719 5379714 -
ttgaggaattattgactgaatg

SEQ ID NO: 116106 - DNA, 22 bp, Artificial Sequence
  Synthetic oligonucleotide; TTT chr11 5379713 5379734 5379718 5379713 -
tgaggaattattgactgaatgt

SEQ ID NO: 116107 - DNA, 22 bp, Artificial Sequence
  Synthetic oligonucleotide; TTT chr11 5379712 5379733 5379717 5379712 -
gaggaattattgactgaatgtt

SEQ ID NO: 116108 - DNA, 22 bp, Artificial Sequence
  Synthetic oligonucleotide; TTG chr11 5379711 5379732 5379716 5379711 -
aggaattattgactgaatgttt

SEQ ID NO: 116109 - DNA, 22 bp, Artificial Sequence
  Synthetic oligonucleotide; TTA chr11 5379703 5379724 5379708 5379703 -
ttgactgaatgtttcaacatct

SEQ ID NO: 116110 - DNA, 22 bp, Artificial Sequence
  Synthetic oligonucleotide; TTG chr11 5379700 5379721 5379705 5379700 -
actgaatgtttcaacatctgga

SEQ ID NO: 116111 - DNA, 22 bp, Artificial Sequence
  Synthetic oligonucleotide; CTG chr11 5379696 5379717 5379701 5379696 -
aatgtttcaacatctggacata

SEQ ID NO: 116112 - DNA, 22 bp, Artificial Sequence
  Synthetic oligonucleotide; TTT chr11 5379689 5379710 5379694 5379689 -
caacatctggacataaaatcta

SEQ ID NO: 116113 - DNA, 22 bp, Artificial Sequence
  Synthetic oligonucleotide; TTC chr11 5379688 5379709 5379693 5379688 -
aacatctggacataaaatctat

SEQ ID NO: 116114 - DNA, 22 bp, Artificial Sequence
  Synthetic oligonucleotide; CTG chr11 5379680 5379701 5379685 5379680 -
gacataaaatctattaattcat

SEQ ID NO: 116115 - DNA, 22 bp, Artificial Sequence
  Synthetic oligonucleotide; CTA chr11 5379667 5379688 5379672 5379667 -
ttaattcatatctttagctaac

SEQ ID NO: 116116 - DNA, 22 bp, Artificial Sequence
  Synthetic oligonucleotide; TTA chr11 5379664 5379685 5379669 5379664 -
attcatatctttagctaacctt

SEQ ID NO: 116117 - DNA, 22 bp, Artificial Sequence
  Synthetic oligonucleotide; TTC chr11 5379660 5379681 5379665 5379660 -
atatctttagctaaccttgagc

SEQ ID NO: 116118 - DNA, 22 bp, Artificial Sequence
  Synthetic oligonucleotide; CTT chr11 5379653 5379674 5379658 5379653 -
tagctaaccttgagcaatgtca

SEQ ID NO: 116119 - DNA, 22 bp, Artificial Sequence
  Synthetic oligonucleotide; TTT chr11 5379652 5379673 5379657 5379652 -
agctaaccttgagcaatgtcaa

SEQ ID NO: 116120 - DNA, 22 bp, Artificial Sequence
  Synthetic oligonucleotide; TTA chr11 5379651 5379672 5379656 5379651 -
gctaaccttgagcaatgtcaat

SEQ ID NO: 116121 - DNA, 22 bp, Artificial Sequence
  Synthetic oligonucleotide; CTA chr11 5379647 5379668 5379652 5379647 -
accttgagcaatgtcaattaaa

SEQ ID NO: 116122 - DNA, 22 bp, Artificial Sequence
  Synthetic oligonucleotide; CTT chr11 5379642 5379663 5379647 5379642 -
gagcaatgtcaattaaaaaata

SEQ ID NO: 116123 - DNA, 22 bp, Artificial Sequence
  Synthetic oligonucleotide; TTG chr11 5379641 5379662 5379646 5379641 -
agcaatgtcaattaaaaaataa

SEQ ID NO: 116124 - DNA, 22 bp, Artificial Sequence
  Synthetic oligonucleotide; TTA chr11 5379627 5379648 5379632 5379627 -
aaaaataaaacacaactaaatg

SEQ ID NO: 116125 - DNA, 22 bp, Artificial Sequence
  Synthetic oligonucleotide; CTA chr11 5379609 5379630 5379614 5379609 -
aatgcatatcttacaaatggca

SEQ ID NO: 116126 - DNA, 22 bp, Artificial Sequence
  Synthetic oligonucleotide; CTT chr11 5379597 5379618 5379602 5379597 -
acaaatggcataaacaacaaat

SEQ ID NO: 116127 - DNA, 22 bp, Artificial Sequence
  Synthetic oligonucleotide; TTA chr11 5379596 5379617 5379601 5379596 -
caaatggcataaacaacaaatg

SEQ ID NO: 116128 - DNA, 22 bp, Artificial Sequence
  Synthetic oligonucleotide; CTT chr11 5379562 5379583 5379567 5379562 -
aaaagcagacatagaaaaagac

SEQ ID NO: 116129 - DNA, 22 bp, Artificial Sequence
  Synthetic oligonucleotide; TTA chr11 5379561 5379582 5379566 5379561 -
aaagcagacatagaaaaagaca

SEQ ID NO: 116130 - DNA, 22 bp, Artificial Sequence
  Synthetic oligonucleotide; TTG chr11 5379534 5379555 5379539 5379534 -
catacaagaaaattattagagg

SEQ ID NO: 116131 - DNA, 22 bp, Artificial Sequence
  Synthetic oligonucleotide; TTA chr11 5379519 5379540 5379524 5379519 -
ttagaggaaacaacggaaacct

SEQ ID NO: 116132 - DNA, 22 bp, Artificial Sequence
  Synthetic oligonucleotide; TTA chr11 5379516 5379537 5379521 5379516 -
gaggaaacaacggaaacctgaa

SEQ ID NO: 116133 - DNA, 22 bp, Artificial Sequence
  Synthetic oligonucleotide; CTG chr11 5379496 5379517 5379501 5379496 -
aaaaaataaactggaactttat

SEQ ID NO: 116134 - DNA, 22 bp, Artificial Sequence
  Synthetic oligonucleotide; CTG chr11 5379483 5379504 5379488 5379483 -
gaactttattttttattttttt

SEQ ID NO: 116135 - DNA, 22 bp, Artificial Sequence
  Synthetic oligonucleotide; CTT chr11 5379477 5379498 5379482 5379477 -
tattttttatttttttatttat

SEQ ID NO: 116136 - DNA, 22 bp, Artificial Sequence
  Synthetic oligonucleotide; TTT chr11 5379476 5379497 5379481 5379476 -
attttttatttttttatttatt

SEQ ID NO: 116137 - DNA, 22 bp, Artificial Sequence
  Synthetic oligonucleotide; TTA chr11 5379475 5379496 5379480 5379475 -
ttttttatttttttatttattt

SEQ ID NO: 116138 - DNA, 22 bp, Artificial Sequence
  Synthetic oligonucleotide; TTT chr11 5379472 5379493 5379477 5379472 -
tttatttttttatttattttat

SEQ ID NO: 116139 - DNA, 22 bp, Artificial Sequence
  Synthetic oligonucleotide; TTT chr11 5379471 5379492 5379476 5379471 -
ttatttttttatttattttatt

SEQ ID NO: 116140 - DNA, 22 bp, Artificial Sequence
  Synthetic oligonucleotide; TTT chr11 5379470 5379491 5379475 5379470 -
tatttttttatttattttattt

SEQ ID NO: 116141 - DNA, 22 bp, Artificial Sequence
  Synthetic oligonucleotide; TTT chr11 5379469 5379490 5379474 5379469 -
atttttttatttattttattta

SEQ ID NO: 116142 - DNA, 22 bp, Artificial Sequence
  Synthetic oligonucleotide; TTA chr11 5379468 5379489 5379473 5379468 -
tttttttatttattttatttat

SEQ ID NO: 116143 - DNA, 22 bp, Artificial Sequence
  Synthetic oligonucleotide; TTT chr11 5379465 5379486 5379470 5379465 -
ttttatttattttatttattat

SEQ ID NO: 116144 - DNA, 22 bp, Artificial Sequence
  Synthetic oligonucleotide; TTT chr11 5379464 5379485 5379469 5379464 -
tttatttattttatttattatt

SEQ ID NO: 116145 - DNA, 22 bp, Artificial Sequence
  Synthetic oligonucleotide; TTT chr11 5379463 5379484 5379468 5379463 -
ttatttattttatttattatta

SEQ ID NO: 116146 - DNA, 22 bp, Artificial Sequence
  Synthetic oligonucleotide; TTT chr11 5379462 5379483 5379467 5379462 -
tatttattttatttattattat

SEQ ID NO: 116147 - DNA, 22 bp, Artificial Sequence
  Synthetic oligonucleotide; TTT chr11 5379461 5379482 5379466 5379461 -
atttattttatttattattatt

SEQ ID NO: 116148 - DNA, 22 bp, Artificial Sequence
  Synthetic oligonucleotide; TTA chr11 5379460 5379481 5379465 5379460 -
tttattttatttattattatta

SEQ ID NO: 116149 - DNA, 22 bp, Artificial Sequence
  Synthetic oligonucleotide; TTT chr11 5379457 5379478 5379462 5379457 -
attttatttattattattatta

SEQ ID NO: 116150 - DNA, 22 bp, Artificial Sequence
  Synthetic oligonucleotide; TTA chr11 5379456 5379477 5379461 5379456 -
ttttatttattattattattat

SEQ ID NO: 116151 - DNA, 22 bp, Artificial Sequence
  Synthetic oligonucleotide; TTT chr11 5379453 5379474 5379458 5379453 -
tatttattattattattatact

SEQ ID NO: 116152 - DNA, 22 bp, Artificial Sequence
  Synthetic oligonucleotide; TTT chr11 5379452 5379473 5379457 5379452 -
atttattattattattatactt

SEQ ID NO: 116153 - DNA, 22 bp, Artificial Sequence
  Synthetic oligonucleotide; TTA chr11 5379451 5379472 5379456 5379451 -
tttattattattattatacttt

SEQ ID NO: 116154 - DNA, 22 bp, Artificial Sequence
  Synthetic oligonucleotide; TTT chr11 5379448 5379469 5379453 5379448 -
attattattattatactttaag

SEQ ID NO: 116155 - DNA, 22 bp, Artificial Sequence
  Synthetic oligonucleotide; TTA chr11 5379447 5379468 5379452 5379447 -
ttattattattatactttaaga

SEQ ID NO: 116156 - DNA, 22 bp, Artificial Sequence
  Synthetic oligonucleotide; TTA chr11 5379444 5379465 5379449 5379444 -
ttattattatactttaagattt

SEQ ID NO: 116157 - DNA, 22 bp, Artificial Sequence
  Synthetic oligonucleotide; TTA chr11 5379441 5379462 5379446 5379441 -
ttattatactttaagatttagg

SEQ ID NO: 116158 - DNA, 22 bp, Artificial Sequence
  Synthetic oligonucleotide; TTA chr11 5379438 5379459 5379443 5379438 -
ttatactttaagatttagggta

SEQ ID NO: 116159 - DNA, 22 bp, Artificial Sequence
  Synthetic oligonucleotide; TTA chr11 5379435 5379456 5379440 5379435 -
tactttaagatttagggtacat

SEQ ID NO: 116160 - DNA, 22 bp, Artificial Sequence
  Synthetic oligonucleotide; CTT chr11 5379430 5379451 5379435 5379430 -
taagatttagggtacatgtgca

SEQ ID NO: 116161 - DNA, 22 bp, Artificial Sequence
  Synthetic oligonucleotide; TTT chr11 5379429 5379450 5379434 5379429 -
aagatttagggtacatgtgcat

SEQ ID NO: 116162 - DNA, 22 bp, Artificial Sequence
  Synthetic oligonucleotide; TTA chr11 5379428 5379449 5379433 5379428 -
agatttagggtacatgtgcata

SEQ ID NO: 116163 - DNA, 22 bp, Artificial Sequence
  Synthetic oligonucleotide; TTT chr11 5379422 5379443 5379427 5379422 -
agggtacatgtgcataatgtgc

SEQ ID NO: 116164 - DNA, 22 bp, Artificial Sequence
  Synthetic oligonucleotide; TTA chr11 5379421 5379442 5379426 5379421 -
gggtacatgtgcataatgtgcc

SEQ ID NO: 116165 - DNA, 22 bp, Artificial Sequence
  Synthetic oligonucleotide; TTA chr11 5379394 5379415 5379399 5379394 -
gttacatatgtatacatgtgcc

SEQ ID NO: 116166 - DNA, 22 bp, Artificial Sequence
  Synthetic oligonucleotide; TTA chr11 5379390 5379411 5379395 5379390 -
catatgtatacatgtgccatgt

SEQ ID NO: 116167 - DNA, 22 bp, Artificial Sequence
  Synthetic oligonucleotide; TTG chr11 5379366 5379387 5379371 5379366 -
gtgtgctgcacccattaactcg

SEQ ID NO: 116168 - DNA, 22 bp, Artificial Sequence
  Synthetic oligonucleotide; CTG chr11 5379358 5379379 5379363 5379358 -
cacccattaactcgtaatttag

SEQ ID NO: 116169 - DNA, 22 bp, Artificial Sequence
  Synthetic oligonucleotide; TTA chr11 5379349 5379370 5379354 5379349 -
actcgtaatttagcattaggta

SEQ ID NO: 116170 - DNA, 22 bp, Artificial Sequence
  Synthetic oligonucleotide; CTC chr11 5379345 5379366 5379350 5379345 -
gtaatttagcattaggtatatc

SEQ ID NO: 116171 - DNA, 22 bp, Artificial Sequence
  Synthetic oligonucleotide; TTT chr11 5379338 5379359 5379343 5379338 -
agcattaggtatatctcctaat

SEQ ID NO: 116172 - DNA, 22 bp, Artificial Sequence
  Synthetic oligonucleotide; TTA chr11 5379337 5379358 5379342 5379337 -
gcattaggtatatctcctaatg

SEQ ID NO: 116173 - DNA, 22 bp, Artificial Sequence
  Synthetic oligonucleotide; TTA chr11 5379331 5379352 5379336 5379331 -
ggtatatctcctaatgccatcc

SEQ ID NO: 116174 - DNA, 22 bp, Artificial Sequence
  Synthetic oligonucleotide; CTC chr11 5379321 5379342 5379326 5379321 -
ctaatgccatccctccctgcac

SEQ ID NO: 116175 - DNA, 22 bp, Artificial Sequence
  Synthetic oligonucleotide; CTA chr11 5379318 5379339 5379323 5379318 -
atgccatccctccctgcacccc

SEQ ID NO: 116176 - DNA, 22 bp, Artificial Sequence
  Synthetic oligonucleotide; CTC chr11 5379306 5379327 5379311 5379306 -
cctgcacccccaccccacaaca

SEQ ID NO: 116177 - DNA, 22 bp, Artificial Sequence
  Synthetic oligonucleotide; CTG chr11 5379302 5379323 5379307 5379302 -
cacccccaccccacaacagtcc

SEQ ID NO: 116178 - DNA, 22 bp, Artificial Sequence
  Synthetic oligonucleotide; TTC chr11 5379264 5379285 5379269 5379264 -
cccttcctgtgtccatgtgttc

SEQ ID NO: 116179 - DNA, 22 bp, Artificial Sequence
  Synthetic oligonucleotide; CTT chr11 5379259 5379280 5379264 5379259 -
cctgtgtccatgtgttctcatt

SEQ ID NO: 116180 - DNA, 22 bp, Artificial Sequence
  Synthetic oligonucleotide; TTC chr11 5379258 5379279 5379263 5379258 -
ctgtgtccatgtgttctcattg

SEQ ID NO: 116181 - DNA, 22 bp, Artificial Sequence
  Synthetic oligonucleotide; CTG chr11 5379255 5379276 5379260 5379255 -
tgtccatgtgttctcattgttc

SEQ ID NO: 116182 - DNA, 22 bp, Artificial Sequence
  Synthetic oligonucleotide; TTC chr11 5379242 5379263 5379247 5379242 -
tcattgttcagttcccatctat

SEQ ID NO: 116183 - DNA, 22 bp, Artificial Sequence
  Synthetic oligonucleotide; CTC chr11 5379240 5379261 5379245 5379240 -
attgttcagttcccatctatga

SEQ ID NO: 116184 - DNA, 22 bp, Artificial Sequence
  Synthetic oligonucleotide; TTG chr11 5379236 5379257 5379241 5379236 -
ttcagttcccatctatgagtga

SEQ ID NO: 116185 - DNA, 22 bp, Artificial Sequence
  Synthetic oligonucleotide; TTC chr11 5379233 5379254 5379238 5379233 -
agttcccatctatgagtgagaa

SEQ ID NO: 116186 - DNA, 22 bp, Artificial Sequence
  Synthetic oligonucleotide; TTC chr11 5379228 5379249 5379233 5379228 -
ccatctatgagtgagaatatgt

SEQ ID NO: 116187 - DNA, 22 bp, Artificial Sequence
  Synthetic oligonucleotide; CTA chr11 5379221 5379242 5379226 5379221 -
tgagtgagaatatgtggtgttt

SEQ ID NO: 116188 - DNA, 22 bp, Artificial Sequence
  Synthetic oligonucleotide; TTT chr11 5379199 5379220 5379204 5379199 -
ggttttttgtccttgcgatagt

SEQ ID NO: 116189 - DNA, 22 bp, Artificial Sequence
  Synthetic oligonucleotide; TTG chr11 5379198 5379219 5379203 5379198 -
gttttttgtccttgcgatagtt

SEQ ID NO: 116190 - DNA, 22 bp, Artificial Sequence
  Synthetic oligonucleotide; TTT chr11 5379194 5379215 5379199 5379194 -
tttgtccttgcgatagtttact

SEQ ID NO: 116191 - DNA, 22 bp, Artificial Sequence
  Synthetic oligonucleotide; TTT chr11 5379193 5379214 5379198 5379193 -
ttgtccttgcgatagtttactg

SEQ ID NO: 116192 - DNA, 22 bp, Artificial Sequence
  Synthetic oligonucleotide; TTT chr11 5379192 5379213 5379197 5379192 -
tgtccttgcgatagtttactga

SEQ ID NO: 116193 - DNA, 22 bp, Artificial Sequence
  Synthetic oligonucleotide; TTT chr11 5379191 5379212 5379196 5379191 -
gtccttgcgatagtttactgag

SEQ ID NO: 116194 - DNA, 22 bp, Artificial Sequence
  Synthetic oligonucleotide; TTG chr11 5379190 5379211 5379195 5379190 -
tccttgcgatagtttactgaga

SEQ ID NO: 116195 - DNA, 22 bp, Artificial Sequence
  Synthetic oligonucleotide; CTT chr11 5379185 5379206 5379190 5379185 -
gcgatagtttactgagaatgat

SEQ ID NO: 116196 - DNA, 22 bp, Artificial Sequence
  Synthetic oligonucleotide; TTG chr11 5379184 5379205 5379189 5379184 -
cgatagtttactgagaatgatg

SEQ ID NO: 116197 - DNA, 22 bp, Artificial Sequence
  Synthetic oligonucleotide; TTT chr11 5379175 5379196 5379180 5379175 -
actgagaatgatgatttccaat

SEQ ID NO: 116198 - DNA, 22 bp, Artificial Sequence
  Synthetic oligonucleotide; TTA chr11 5379174 5379195 5379179 5379174 -
ctgagaatgatgatttccaatt

SEQ ID NO: 116199 - DNA, 22 bp, Artificial Sequence
  Synthetic oligonucleotide; CTG chr11 5379171 5379192 5379176 5379171 -
agaatgatgatttccaatttca

SEQ ID NO: 116200 - DNA, 22 bp, Artificial Sequence
  Synthetic oligonucleotide; TTT chr11 5379158 5379179 5379163 5379158 -
ccaatttcatccatgtccctac

SEQ ID NO: 116201 - DNA, 22 bp, Artificial Sequence
  Synthetic oligonucleotide; TTC chr11 5379157 5379178 5379162 5379157 -
caatttcatccatgtccctaca

SEQ ID NO: 116202 - DNA, 22 bp, Artificial Sequence
  Synthetic oligonucleotide; TTT chr11 5379151 5379172 5379156 5379151 -
catccatgtccctacaaaggac

SEQ ID NO: 116203 - DNA, 22 bp, Artificial Sequence
  Synthetic oligonucleotide; TTC chr11 5379150 5379171 5379155 5379150 -
atccatgtccctacaaaggaca

SEQ ID NO: 116204 - DNA, 22 bp, Artificial Sequence
  Synthetic oligonucleotide; CTA chr11 5379137 5379158 5379142 5379137 -
caaaggacatgaactcatcatt

SEQ ID NO: 116205 - DNA, 22 bp, Artificial Sequence
  Synthetic oligonucleotide; CTC chr11 5379121 5379142 5379126 5379121 -
atcatttttatggctgcatagt

SEQ ID NO: 116206 - DNA, 22 bp, Artificial Sequence
  Synthetic oligonucleotide; TTT chr11 5379114 5379135 5379119 5379114 -
ttatggctgcatagtattccat

SEQ ID NO: 116207 - DNA, 22 bp, Artificial Sequence
  Synthetic oligonucleotide; TTT chr11 5379113 5379134 5379118 5379113 -
tatggctgcatagtattccatg

SEQ ID NO: 116208 - DNA, 22 bp, Artificial Sequence
  Synthetic oligonucleotide; TTT chr11 5379112 5379133 5379117 5379112 -
atggctgcatagtattccatgg

SEQ ID NO: 116209 - DNA, 22 bp, Artificial Sequence
  Synthetic oligonucleotide; TTA chr11 5379111 5379132 5379116 5379111 -
tggctgcatagtattccatggt

SEQ ID NO: 116210 - DNA, 22 bp, Artificial Sequence
  Synthetic oligonucleotide; CTG chr11 5379105 5379126 5379110 5379105 -
catagtattccatggtgtatat

SEQ ID NO: 116211 - DNA, 22 bp, Artificial Sequence
  Synthetic oligonucleotide; TTC chr11 5379095 5379116 5379100 5379095 -
catggtgtatatgtgccacatt

SEQ ID NO: 116212 - DNA, 22 bp, Artificial Sequence
  Synthetic oligonucleotide; TTT chr11 5379072 5379093 5379077 5379072 -
tcttaatccagtctatcattgt

SEQ ID NO: 116213 - DNA, 22 bp, Artificial Sequence
  Synthetic oligonucleotide; TTT chr11 5379071 5379092 5379076 5379071 -
cttaatccagtctatcattgtt

SEQ ID NO: 116214 - DNA, 22 bp, Artificial Sequence
  Synthetic oligonucleotide; TTC chr11 5379070 5379091 5379075 5379070 -
ttaatccagtctatcattgttg

SEQ ID NO: 116215 - DNA, 22 bp, Artificial Sequence
  Synthetic oligonucleotide; CTT chr11 5379068 5379089 5379073 5379068 -
aatccagtctatcattgttgga

SEQ ID NO: 116216 - DNA, 22 bp, Artificial Sequence
  Synthetic oligonucleotide; TTA chr11 5379067 5379088 5379072 5379067 -
atccagtctatcattgttggac

SEQ ID NO: 116217 - DNA, 22 bp, Artificial Sequence
  Synthetic oligonucleotide; CTA chr11 5379057 5379078 5379062 5379057 -
tcattgttggacatttgggttg

SEQ ID NO: 116218 - DNA, 22 bp, Artificial Sequence
  Synthetic oligonucleotide; TTG chr11 5379051 5379072 5379056 5379051 -
ttggacatttgggttggttcca

SEQ ID NO: 116219 - DNA, 22 bp, Artificial Sequence
  Synthetic oligonucleotide; TTG chr11 5379048 5379069 5379053 5379048 -
gacatttgggttggttccaagt

SEQ ID NO: 116220 - DNA, 22 bp, Artificial Sequence
  Synthetic oligonucleotide; TTT chr11 5379041 5379062 5379046 5379041 -
gggttggttccaagtctttgct

SEQ ID NO: 116221 - DNA, 22 bp, Artificial Sequence
  Synthetic oligonucleotide; TTG chr11 5379040 5379061 5379045 5379040 -
ggttggttccaagtctttgcta

SEQ ID NO: 116222 - DNA, 22 bp, Artificial Sequence
  Synthetic oligonucleotide; TTG chr11 5379035 5379056 5379040 5379035 -
gttccaagtctttgctattgtg

SEQ ID NO: 116223 - DNA, 22 bp, Artificial Sequence
  Synthetic oligonucleotide; TTC chr11 5379031 5379052 5379036 5379031 -
caagtctttgctattgtgaata

SEQ ID NO: 116224 - DNA, 22 bp, Artificial Sequence
  Synthetic oligonucleotide; CTT chr11 5379023 5379044 5379028 5379023 -
tgctattgtgaatagtaccgca

SEQ ID NO: 116225 - DNA, 22 bp, Artificial Sequence
  Synthetic oligonucleotide; TTT chr11 5379022 5379043 5379027 5379022 -
gctattgtgaatagtaccgcaa

SEQ ID NO: 116226 - DNA, 22 bp, Artificial Sequence
  Synthetic oligonucleotide; TTG chr11 5379021 5379042 5379026 5379021 -
ctattgtgaatagtaccgcaat

SEQ ID NO: 116227 - DNA, 22 bp, Artificial Sequence
  Synthetic oligonucleotide; CTA chr11 5379018 5379039 5379023 5379018 -
ttgtgaatagtaccgcaataaa

SEQ ID NO: 116228 - DNA, 22 bp, Artificial Sequence
  Synthetic oligonucleotide; TTG chr11 5379015 5379036 5379020 5379015 -
tgaatagtaccgcaataaacat

SEQ ID NO: 116229 - DNA, 22 bp, Artificial Sequence
  Synthetic oligonucleotide; CTT chr11 5378976 5378997 5378981 5378976 -
tatagcagcatgatttatattc

SEQ ID NO: 116230 - DNA, 22 bp, Artificial Sequence
  Synthetic oligonucleotide; TTT chr11 5378975 5378996 5378980 5378975 -
atagcagcatgatttatattcc

SEQ ID NO: 116231 - DNA, 22 bp, Artificial Sequence
  Synthetic oligonucleotide; TTA chr11 5378974 5378995 5378979 5378974 -
tagcagcatgatttatattcct

SEQ ID NO: 116232 - DNA, 22 bp, Artificial Sequence
  Synthetic oligonucleotide; TTT chr11 5378960 5378981 5378965 5378960 -
atattcctttgggtatataccc

SEQ ID NO: 116233 - DNA, 22 bp, Artificial Sequence
  Synthetic oligonucleotide; TTA chr11 5378959 5378980 5378964 5378959 -
tattcctttgggtatataccca

SEQ ID NO: 116234 - DNA, 22 bp, Artificial Sequence
  Synthetic oligonucleotide; TTC chr11 5378954 5378975 5378959 5378954 -
ctttgggtatatacccagtaat

SEQ ID NO: 116235 - DNA, 22 bp, Artificial Sequence
  Synthetic oligonucleotide; CTT chr11 5378951 5378972 5378956 5378951 -
tgggtatatacccagtaatggg

SEQ ID NO: 116236 - DNA, 22 bp, Artificial Sequence
  Synthetic oligonucleotide; TTT chr11 5378950 5378971 5378955 5378950 -
gggtatatacccagtaatggga

SEQ ID NO: 116237 - DNA, 22 bp, Artificial Sequence
  Synthetic oligonucleotide; TTG chr11 5378949 5378970 5378954 5378949 -
ggtatatacccagtaatgggat

SEQ ID NO: 116238 - DNA, 22 bp, Artificial Sequence
  Synthetic oligonucleotide; CTG chr11 5378922 5378943 5378927 5378922 -
ggtcaaatggtatttctagttc

SEQ ID NO: 116239 - DNA, 22 bp, Artificial Sequence
  Synthetic oligonucleotide; TTT chr11 5378907 5378928 5378912 5378907 -
ctagttctagatccctgaggaa

SEQ ID NO: 116240 - DNA, 22 bp, Artificial Sequence
  Synthetic oligonucleotide; TTC chr11 5378906 5378927 5378911 5378906 -
tagttctagatccctgaggaat

SEQ ID NO: 116241 - DNA, 22 bp, Artificial Sequence
  Synthetic oligonucleotide; CTA chr11 5378904 5378925 5378909 5378904 -
gttctagatccctgaggaatcg

SEQ ID NO: 116242 - DNA, 22 bp, Artificial Sequence
  Synthetic oligonucleotide; TTC chr11 5378900 5378921 5378905 5378900 -
tagatccctgaggaatcgccac

SEQ ID NO: 116243 - DNA, 22 bp, Artificial Sequence
  Synthetic oligonucleotide; CTA chr11 5378898 5378919 5378903 5378898 -
gatccctgaggaatcgccacac

SEQ ID NO: 116244 - DNA, 22 bp, Artificial Sequence
  Synthetic oligonucleotide; CTG chr11 5378890 5378911 5378895 5378890 -
aggaatcgccacactgacttcc

SEQ ID NO: 116245 - DNA, 22 bp, Artificial Sequence
  Synthetic oligonucleotide; CTG chr11 5378874 5378895 5378879 5378874 -
acttccacaatggttgaactag

SEQ ID NO: 116246 - DNA, 22 bp, Artificial Sequence
  Synthetic oligonucleotide; CTT chr11 5378870 5378891 5378875 5378870 -
ccacaatggttgaactagttta

SEQ ID NO: 116247 - DNA, 22 bp, Artificial Sequence
  Synthetic oligonucleotide; TTC chr11 5378869 5378890 5378874 5378869 -
cacaatggttgaactagtttac

SEQ ID NO: 116248 - DNA, 22 bp, Artificial Sequence
  Synthetic oligonucleotide; TTG chr11 5378858 5378879 5378863 5378858 -
aactagtttacagtcccaccaa

SEQ ID NO: 116249 - DNA, 22 bp, Artificial Sequence
  Synthetic oligonucleotide; CTA chr11 5378853 5378874 5378858 5378853 -
gtttacagtcccaccaagagtg

SEQ ID NO: 116250 - DNA, 22 bp, Artificial Sequence
  Synthetic oligonucleotide; TTT chr11 5378849 5378870 5378854 5378849 -
acagtcccaccaagagtgtaaa

SEQ ID NO: 116251 - DNA, 22 bp, Artificial Sequence
  Synthetic oligonucleotide; TTA chr11 5378848 5378869 5378853 5378848 -
cagtcccaccaagagtgtaaaa

SEQ ID NO: 116252 - DNA, 22 bp, Artificial Sequence
  Synthetic oligonucleotide; TTC chr11 5378820 5378841 5378825 5378820 -
ctatttctccacatcctctcca

SEQ ID NO: 116253 - DNA, 22 bp, Artificial Sequence
  Synthetic oligonucleotide; CTA chr11 5378817 5378838 5378822 5378817 -
tttctccacatcctctccagca

SEQ ID NO: 116254 - DNA, 22 bp, Artificial Sequence
  Synthetic oligonucleotide; TTT chr11 5378814 5378835 5378819 5378814 -
ctccacatcctctccagcacct

SEQ ID NO: 116255 - DNA, 22 bp, Artificial Sequence
  Synthetic oligonucleotide; TTC chr11 5378813 5378834 5378818 5378813 -
tccacatcctctccagcacctg

SEQ ID NO: 116256 - DNA, 22 bp, Artificial Sequence
  Synthetic oligonucleotide; CTC chr11 5378811 5378832 5378816 5378811 -
cacatcctctccagcacctgtt

SEQ ID NO: 116257 - DNA, 22 bp, Artificial Sequence
  Synthetic oligonucleotide; CTC chr11 5378802 5378823 5378807 5378802 -
tccagcacctgttgtttcctga

SEQ ID NO: 116258 - DNA, 22 bp, Artificial Sequence
  Synthetic oligonucleotide; CTC chr11 5378800 5378821 5378805 5378800 -
cagcacctgttgtttcctgact

SEQ ID NO: 116259 - DNA, 22 bp, Artificial Sequence
  Synthetic oligonucleotide; CTG chr11 5378791 5378812 5378796 5378791 -
ttgtttcctgactttttaatga

SEQ ID NO: 116260 - DNA, 22 bp, Artificial Sequence
  Synthetic oligonucleotide; TTG chr11 5378788 5378809 5378793 5378788 -
tttcctgactttttaatgattg

SEQ ID NO: 116261 - DNA, 22 bp, Artificial Sequence
  Synthetic oligonucleotide; TTT chr11 5378785 5378806 5378790 5378785 -
cctgactttttaatgattgcca

SEQ ID NO: 116262 - DNA, 22 bp, Artificial Sequence
  Synthetic oligonucleotide; TTC chr11 5378784 5378805 5378789 5378784 -
ctgactttttaatgattgccat

SEQ ID NO: 116263 - DNA, 22 bp, Artificial Sequence
  Synthetic oligonucleotide; CTG chr11 5378781 5378802 5378786 5378781 -
actttttaatgattgccattct

SEQ ID NO: 116264 - DNA, 22 bp, Artificial Sequence
  Synthetic oligonucleotide; CTT chr11 5378777 5378798 5378782 5378777 -
tttaatgattgccattctaact

SEQ ID NO: 116265 - DNA, 22 bp, Artificial Sequence
  Synthetic oligonucleotide; TTT chr11 5378776 5378797 5378781 5378776 -
ttaatgattgccattctaactg

SEQ ID NO: 116266 - DNA, 22 bp, Artificial Sequence
  Synthetic oligonucleotide; TTT chr11 5378775 5378796 5378780 5378775 -
taatgattgccattctaactgg

SEQ ID NO: 116267 - DNA, 22 bp, Artificial Sequence
  Synthetic oligonucleotide; TTT chr11 5378774 5378795 5378779 5378774 -
aatgattgccattctaactggt

SEQ ID NO: 116268 - DNA, 22 bp, Artificial Sequence
  Synthetic oligonucleotide; TTA chr11 5378773 5378794 5378778 5378773 -
atgattgccattctaactggta

SEQ ID NO: 116269 - DNA, 22 bp, Artificial Sequence
  Synthetic oligonucleotide; TTG chr11 5378766 5378787 5378771 5378766 -
ccattctaactggtatgagatg

SEQ ID NO: 116270 - DNA, 22 bp, Artificial Sequence
  Synthetic oligonucleotide; TTC chr11 5378760 5378781 5378765 5378760 -
taactggtatgagatggtatct

SEQ ID NO: 116271 - DNA, 22 bp, Artificial Sequence
  Synthetic oligonucleotide; CTA chr11 5378758 5378779 5378763 5378758 -
actggtatgagatggtatctca

SEQ ID NO: 116272 - DNA, 22 bp, Artificial Sequence
  Synthetic oligonucleotide; CTG chr11 5378754 5378775 5378759 5378754 -
gtatgagatggtatctcattgt

SEQ ID NO: 116273 - DNA, 22 bp, Artificial Sequence
  Synthetic oligonucleotide; CTC chr11 5378737 5378758 5378742 5378737 -
attgtggttttgatttgcattt

SEQ ID NO: 116274 - DNA, 22 bp, Artificial Sequence
  Synthetic oligonucleotide; TTG chr11 5378733 5378754 5378738 5378733 -
tggttttgatttgcatttctct

SEQ ID NO: 116275 - DNA, 22 bp, Artificial Sequence
  Synthetic oligonucleotide; TTT chr11 5378727 5378748 5378732 5378727 -
tgatttgcatttctctgatggc

SEQ ID NO: 116276 - DNA, 22 bp, Artificial Sequence
  Synthetic oligonucleotide; TTT chr11 5378726 5378747 5378731 5378726 -
gatttgcatttctctgatggcc

SEQ ID NO: 116277 - DNA, 22 bp, Artificial Sequence
  Synthetic oligonucleotide; TTG chr11 5378725 5378746 5378730 5378725 -
atttgcatttctctgatggcca

SEQ ID NO: 116278 - DNA, 22 bp, Artificial Sequence
  Synthetic oligonucleotide; TTT chr11 5378721 5378742 5378726 5378721 -
gcatttctctgatggccagtga

SEQ ID NO: 116279 - DNA, 22 bp, Artificial Sequence
  Synthetic oligonucleotide; TTG chr11 5378720 5378741 5378725 5378720 -
catttctctgatggccagtgat

SEQ ID NO: 116280 - DNA, 22 bp, Artificial Sequence
  Synthetic oligonucleotide; TTT chr11 5378715 5378736 5378720 5378715 -
ctctgatggccagtgatgatga

SEQ ID NO: 116281 - DNA, 22 bp, Artificial Sequence
  Synthetic oligonucleotide; TTC chr11 5378714 5378735 5378719 5378714 -
tctgatggccagtgatgatgag

SEQ ID NO: 116282 - DNA, 22 bp, Artificial Sequence
  Synthetic oligonucleotide; CTC chr11 5378712 5378733 5378717 5378712 -
tgatggccagtgatgatgagca

SEQ ID NO: 116283 - DNA, 22 bp, Artificial Sequence
  Synthetic oligonucleotide; CTG chr11 5378710 5378731 5378715 5378710 -
atggccagtgatgatgagcatt

SEQ ID NO: 116284 - DNA, 22 bp, Artificial Sequence
  Synthetic oligonucleotide; TTT chr11 5378687 5378708 5378692 5378687 -
tttcatgtgtcttttggttgca

SEQ ID NO: 116285 - DNA, 22 bp, Artificial Sequence
  Synthetic oligonucleotide; TTT chr11 5378686 5378707 5378691 5378686 -
ttcatgtgtcttttggttgcat

SEQ ID NO: 116286 - DNA, 22 bp, Artificial Sequence
  Synthetic oligonucleotide; TTT chr11 5378685 5378706 5378690 5378685 -
tcatgtgtcttttggttgcata

SEQ ID NO: 116287 - DNA, 22 bp, Artificial Sequence
  Synthetic oligonucleotide; TTT chr11 5378684 5378705 5378689 5378684 -
catgtgtcttttggttgcataa

SEQ ID NO: 116288 - DNA, 22 bp, Artificial Sequence
  Synthetic oligonucleotide; TTC chr11 5378683 5378704 5378688 5378683 -
atgtgtcttttggttgcataaa

SEQ ID NO: 116289 - DNA, 22 bp, Artificial Sequence
  Synthetic oligonucleotide; CTT chr11 5378674 5378695 5378679 5378674 -
ttggttgcataaatgttttctt

SEQ ID NO: 116290 - DNA, 22 bp, Artificial Sequence
  Synthetic oligonucleotide; TTT chr11 5378673 5378694 5378678 5378673 -
tggttgcataaatgttttcttt

SEQ ID NO: 116291 - DNA, 22 bp, Artificial Sequence
  Synthetic oligonucleotide; TTT chr11 5378672 5378693 5378677 5378672 -
ggttgcataaatgttttctttt

SEQ ID NO: 116292 - DNA, 22 bp, Artificial Sequence
  Synthetic oligonucleotide; TTG chr11 5378671 5378692 5378676 5378671 -
gttgcataaatgttttcttttg

SEQ ID NO: 116293 - DNA, 22 bp, Artificial Sequence
  Synthetic oligonucleotide; TTG chr11 5378667 5378688 5378672 5378667 -
cataaatgttttcttttgagaa

SEQ ID NO: 116294 - DNA, 22 bp, Artificial Sequence
  Synthetic oligonucleotide; TTT chr11 5378656 5378677 5378661 5378656 -
tcttttgagaagtgtctgttca

SEQ ID NO: 116295 - DNA, 22 bp, Artificial Sequence
  Synthetic oligonucleotide; TTT chr11 5378655 5378676 5378660 5378655 -
cttttgagaagtgtctgttcat

SEQ ID NO: 116296 - DNA, 22 bp, Artificial Sequence
  Synthetic oligonucleotide; TTC chr11 5378654 5378675 5378659 5378654 -
ttttgagaagtgtctgttcata

SEQ ID NO: 116297 - DNA, 22 bp, Artificial Sequence
  Synthetic oligonucleotide; CTT chr11 5378652 5378673 5378657 5378652 -
ttgagaagtgtctgttcatatc

SEQ ID NO: 116298 - DNA, 22 bp, Artificial Sequence
  Synthetic oligonucleotide; TTT chr11 5378651 5378672 5378656 5378651 -
tgagaagtgtctgttcatatcc

SEQ ID NO: 116299 - DNA, 22 bp, Artificial Sequence
  Synthetic oligonucleotide; TTT chr11 5378650 5378671 5378655 5378650 -
gagaagtgtctgttcatatcct

SEQ ID NO: 116300 - DNA, 22 bp, Artificial Sequence
  Synthetic oligonucleotide; TTG chr11 5378649 5378670 5378654 5378649 -
agaagtgtctgttcatatcctt

SEQ ID NO: 116301 - DNA, 22 bp, Artificial Sequence
  Synthetic oligonucleotide; CTG chr11 5378638 5378659 5378643 5378638 -
ttcatatcctttgcccacttgt

SEQ ID NO: 116302 - DNA, 22 bp, Artificial Sequence
  Synthetic oligonucleotide; TTC chr11 5378635 5378656 5378640 5378635 -
atatcctttgcccacttgttga

SEQ ID NO: 116303 - DNA, 22 bp, Artificial Sequence
  Synthetic oligonucleotide; CTT chr11 5378627 5378648 5378632 5378627 -
tgcccacttgttgatggggctg

SEQ ID NO: 116304 - DNA, 22 bp, Artificial Sequence
  Synthetic oligonucleotide; TTT chr11 5378626 5378647 5378631 5378626 -
gcccacttgttgatggggctgt

SEQ ID NO: 116305 - DNA, 22 bp, Artificial Sequence
  Synthetic oligonucleotide; TTG chr11 5378625 5378646 5378630 5378625 -
cccacttgttgatggggctgtt

SEQ ID NO: 116306 - DNA, 22 bp, Artificial Sequence
  Synthetic oligonucleotide; CTT chr11 5378618 5378639 5378623 5378618 -
gttgatggggctgtttgttttt

SEQ ID NO: 116307 - DNA, 22 bp, Artificial Sequence
  Synthetic oligonucleotide; TTG chr11 5378617 5378638 5378622 5378617 -
ttgatggggctgtttgtttttt

SEQ ID NO: 116308 - DNA, 22 bp, Artificial Sequence
  Synthetic oligonucleotide; TTG chr11 5378614 5378635 5378619 5378614 -
atggggctgtttgtttttttct

SEQ ID NO: 116309 - DNA, 22 bp, Artificial Sequence
  Synthetic oligonucleotide; CTG chr11 5378605 5378626 5378610 5378605 -
tttgtttttttcttgtaaattt

SEQ ID NO: 116310 - DNA, 22 bp, Artificial Sequence
  Synthetic oligonucleotide; TTT chr11 5378602 5378623 5378607 5378602 -
gtttttttcttgtaaatttgtt

SEQ ID NO: 116311 - DNA, 22 bp, Artificial Sequence
  Synthetic oligonucleotide; TTG chr11 5378601 5378622 5378606 5378601 -
tttttttcttgtaaatttgttt

SEQ ID NO: 116312 - DNA, 22 bp, Artificial Sequence
  Synthetic oligonucleotide; TTT chr11 5378598 5378619 5378603 5378598 -
ttttcttgtaaatttgtttgag

SEQ ID NO: 116313 - DNA, 22 bp, Artificial Sequence
  Synthetic oligonucleotide; TTT chr11 5378597 5378618 5378602 5378597 -
tttcttgtaaatttgtttgagt

SEQ ID NO: 116314 - DNA, 22 bp, Artificial Sequence
  Synthetic oligonucleotide; TTT chr11 5378596 5378617 5378601 5378596 -
ttcttgtaaatttgtttgagtt

SEQ ID NO: 116315 - DNA, 22 bp, Artificial Sequence
  Synthetic oligonucleotide; TTT chr11 5378595 5378616 5378600 5378595 -
tcttgtaaatttgtttgagttc

SEQ ID NO: 116316 - DNA, 22 bp, Artificial Sequence
  Synthetic oligonucleotide; TTT chr11 5378594 5378615 5378599 5378594 -
cttgtaaatttgtttgagttca

SEQ ID NO: 116317 - DNA, 22 bp, Artificial Sequence
  Synthetic oligonucleotide; TTC chr11 5378593 5378614 5378598 5378593 -
ttgtaaatttgtttgagttcat

SEQ ID NO: 116318 - DNA, 22 bp, Artificial Sequence
  Synthetic oligonucleotide; CTT chr11 5378591 5378612 5378596 5378591 -
gtaaatttgtttgagttcatta

SEQ ID NO: 116319 - DNA, 22 bp, Artificial Sequence
  Synthetic oligonucleotide; TTG chr11 5378590 5378611 5378595 5378590 -
taaatttgtttgagttcattat

SEQ ID NO: 116320 - DNA, 22 bp, Artificial Sequence
  Synthetic oligonucleotide; TTT chr11 5378583 5378604 5378588 5378583 -
gtttgagttcattatagattct

SEQ ID NO: 116321 - DNA, 22 bp, Artificial Sequence
  Synthetic oligonucleotide; TTG chr11 5378582 5378603 5378587 5378582 -
tttgagttcattatagattctg

SEQ ID NO: 116322 - DNA, 22 bp, Artificial Sequence
  Synthetic oligonucleotide; TTT chr11 5378579 5378600 5378584 5378579 -
gagttcattatagattctggat

SEQ ID NO: 116323 - DNA, 22 bp, Artificial Sequence
  Synthetic oligonucleotide; TTG chr11 5378578 5378599 5378583 5378578 -
agttcattatagattctggata

SEQ ID NO: 116324 - DNA, 22 bp, Artificial Sequence
  Synthetic oligonucleotide; TTC chr11 5378573 5378594 5378578 5378573 -
attatagattctggatattagc

SEQ ID NO: 116325 - DNA, 22 bp, Artificial Sequence
  Synthetic oligonucleotide; TTA chr11 5378569 5378590 5378574 5378569 -
tagattctggatattagccctt

SEQ ID NO: 116326 - DNA, 22 bp, Artificial Sequence
  Synthetic oligonucleotide; TTC chr11 5378562 5378583 5378567 5378562 -
tggatattagccctttgtcaga

SEQ ID NO: 116327 - DNA, 22 bp, Artificial Sequence
  Synthetic oligonucleotide; CTG chr11 5378560 5378581 5378565 5378560 -
gatattagccctttgtcagatg

SEQ ID NO: 116328 - DNA, 22 bp, Artificial Sequence
  Synthetic oligonucleotide; TTA chr11 5378553 5378574 5378558 5378553 -
gccctttgtcagatgagtaggt

SEQ ID NO: 116329 - DNA, 22 bp, Artificial Sequence
  Synthetic oligonucleotide; CTT chr11 5378547 5378568 5378552 5378547 -
tgtcagatgagtaggttgtgaa

SEQ ID NO: 116330 - DNA, 22 bp, Artificial Sequence
  Synthetic oligonucleotide; TTT chr11 5378546 5378567 5378551 5378546 -
gtcagatgagtaggttgtgaaa

SEQ ID NO: 116331 - DNA, 22 bp, Artificial Sequence
  Synthetic oligonucleotide; TTG chr11 5378545 5378566 5378550 5378545 -
tcagatgagtaggttgtgaaaa

SEQ ID NO: 116332 - DNA, 22 bp, Artificial Sequence
  Synthetic oligonucleotide; TTG chr11 5378529 5378550 5378534 5378529 -
tgaaaattttctcccattgtgt

SEQ ID NO: 116333 - DNA, 22 bp, Artificial Sequence
  Synthetic oligonucleotide; TTT chr11 5378520 5378541 5378525 5378520 -
tctcccattgtgtaggttgcct

SEQ ID NO: 116334 - DNA, 22 bp, Artificial Sequence
  Synthetic oligonucleotide; TTT chr11 5378519 5378540 5378524 5378519 -
ctcccattgtgtaggttgcctg

SEQ ID NO: 116335 - DNA, 22 bp, Artificial Sequence
  Synthetic oligonucleotide; TTC chr11 5378518 5378539 5378523 5378518 -
tcccattgtgtaggttgcctgt

SEQ ID NO: 116336 - DNA, 22 bp, Artificial Sequence
  Synthetic oligonucleotide; CTC chr11 5378516 5378537 5378521 5378516 -
ccattgtgtaggttgcctgttc

SEQ ID NO: 116337 - DNA, 22 bp, Artificial Sequence
  Synthetic oligonucleotide; TTG chr11 5378510 5378531 5378515 5378510 -
tgtaggttgcctgttcactctg

SEQ ID NO: 116338 - DNA, 22 bp, Artificial Sequence
  Synthetic oligonucleotide; TTG chr11 5378501 5378522 5378506 5378501 -
cctgttcactctgatggtagtt

SEQ ID NO: 116339 - DNA, 22 bp, Artificial Sequence
  Synthetic oligonucleotide; CTG chr11 5378497 5378518 5378502 5378497 -
ttcactctgatggtagtttctt

SEQ ID NO: 116340 - DNA, 22 bp, Artificial Sequence
  Synthetic oligonucleotide; TTC chr11 5378494 5378515 5378499 5378494 -
actctgatggtagtttctttag

SEQ ID NO: 116341 - DNA, 22 bp, Artificial Sequence
  Synthetic oligonucleotide; CTC chr11 5378490 5378511 5378495 5378490 -
tgatggtagtttctttagctgt

SEQ ID NO: 116342 - DNA, 22 bp, Artificial Sequence
  Synthetic oligonucleotide; CTG chr11 5378488 5378509 5378493 5378488 -
atggtagtttctttagctgtgc

SEQ ID NO: 116343 - DNA, 22 bp, Artificial Sequence
  Synthetic oligonucleotide; TTT chr11 5378478 5378499 5378483 5378478 -
ctttagctgtgcagaagctctt

SEQ ID NO: 116344 - DNA, 22 bp, Artificial Sequence
  Synthetic oligonucleotide; TTC chr11 5378477 5378498 5378482 5378477 -
tttagctgtgcagaagctcttt

SEQ ID NO: 116345 - DNA, 22 bp, Artificial Sequence
  Synthetic oligonucleotide; CTT chr11 5378475 5378496 5378480 5378475 -
tagctgtgcagaagctctttag

SEQ ID NO: 116346 - DNA, 22 bp, Artificial Sequence
  Synthetic oligonucleotide; TTT chr11 5378474 5378495 5378479 5378474 -
agctgtgcagaagctctttagt

SEQ ID NO: 116347 - DNA, 22 bp, Artificial Sequence
  Synthetic oligonucleotide; TTA chr11 5378473 5378494 5378478 5378473 -
gctgtgcagaagctctttagtt

SEQ ID NO: 116348 - DNA, 22 bp, Artificial Sequence
  Synthetic oligonucleotide; CTG chr11 5378469 5378490 5378474 5378469 -
tgcagaagctctttagtttcat

SEQ ID NO: 116349 - DNA, 22 bp, Artificial Sequence
  Synthetic oligonucleotide; CTC chr11 5378458 5378479 5378463 5378458 -
tttagtttcattagatcccatt

SEQ ID NO: 116350 - DNA, 22 bp, Artificial Sequence
  Synthetic oligonucleotide; CTT chr11 5378456 5378477 5378461 5378456 -
tagtttcattagatcccattag

SEQ ID NO: 116351 - DNA, 22 bp, Artificial Sequence
  Synthetic oligonucleotide; TTT chr11 5378455 5378476 5378460 5378455 -
agtttcattagatcccattagt

SEQ ID NO: 116352 - DNA, 22 bp, Artificial Sequence
  Synthetic oligonucleotide; TTA chr11 5378454 5378475 5378459 5378454 -
gtttcattagatcccattagtg

SEQ ID NO: 116353 - DNA, 22 bp, Artificial Sequence
  Synthetic oligonucleotide; TTT chr11 5378450 5378471 5378455 5378450 -
cattagatcccattagtgaatt

SEQ ID NO: 116354 - DNA, 22 bp, Artificial Sequence
  Synthetic oligonucleotide; TTC chr11 5378449 5378470 5378454 5378449 -
attagatcccattagtgaattt

SEQ ID NO: 116355 - DNA, 22 bp, Artificial Sequence
  Synthetic oligonucleotide; TTA chr11 5378445 5378466 5378450 5378445 -
gatcccattagtgaattttggc

SEQ ID NO: 116356 - DNA, 22 bp, Artificial Sequence
  Synthetic oligonucleotide; TTA chr11 5378435 5378456 5378440 5378435 -
gtgaattttggcttttgttgcc

SEQ ID NO: 116357 - DNA, 22 bp, Artificial Sequence
  Synthetic oligonucleotide; TTT chr11 5378427 5378448 5378432 5378427 -
tggcttttgttgccatcgcttt

SEQ ID NO: 116358 - DNA, 22 bp, Artificial Sequence
  Synthetic oligonucleotide; TTT chr11 5378426 5378447 5378431 5378426 -
ggcttttgttgccatcgctttt

SEQ ID NO: 116359 - DNA, 22 bp, Artificial Sequence
  Synthetic oligonucleotide; TTG chr11 5378425 5378446 5378430 5378425 -
gcttttgttgccatcgcttttg

SEQ ID NO: 116360 - DNA, 22 bp, Artificial Sequence
  Synthetic oligonucleotide; CTT chr11 5378421 5378442 5378426 5378421 -
ttgttgccatcgcttttggtgt

SEQ ID NO: 116361 - DNA, 22 bp, Artificial Sequence
  Synthetic oligonucleotide; TTT chr11 5378420 5378441 5378425 5378420 -
tgttgccatcgcttttggtgtt

SEQ ID NO: 116362 - DNA, 22 bp, Artificial Sequence
  Synthetic oligonucleotide; TTT chr11 5378419 5378440 5378424 5378419 -
gttgccatcgcttttggtgttt

SEQ ID NO: 116363 - DNA, 22 bp, Artificial Sequence
  Synthetic oligonucleotide; TTG chr11 5378418 5378439 5378423 5378418 -
ttgccatcgcttttggtgtttt

SEQ ID NO: 116364 - DNA, 22 bp, Artificial Sequence
  Synthetic oligonucleotide; TTG chr11 5378415 5378436 5378420 5378415 -
ccatcgcttttggtgttttaga

SEQ ID NO: 116365 - DNA, 22 bp, Artificial Sequence
  Synthetic oligonucleotide; CTT chr11 5378406 5378427 5378411 5378406 -
ttggtgttttagacatgaagtc

SEQ ID NO: 116366 - DNA, 22 bp, Artificial Sequence
  Synthetic oligonucleotide; TTT chr11 5378405 5378426 5378410 5378405 -
tggtgttttagacatgaagtcc

SEQ ID NO: 116367 - DNA, 22 bp, Artificial Sequence
  Synthetic oligonucleotide; TTT chr11 5378404 5378425 5378409 5378404 -
ggtgttttagacatgaagtcct

SEQ ID NO: 116368 - DNA, 22 bp, Artificial Sequence
  Synthetic oligonucleotide; TTG chr11 5378403 5378424 5378408 5378403 -
gtgttttagacatgaagtcctt

SEQ ID NO: 116369 - DNA, 22 bp, Artificial Sequence
  Synthetic oligonucleotide; TTT chr11 5378397 5378418 5378402 5378397 -
tagacatgaagtccttgcccat

SEQ ID NO: 116370 - DNA, 22 bp, Artificial Sequence
  Synthetic oligonucleotide; TTT chr11 5378396 5378417 5378401 5378396 -
agacatgaagtccttgcccatg

SEQ ID NO: 116371 - DNA, 22 bp, Artificial Sequence
  Synthetic oligonucleotide; TTA chr11 5378395 5378416 5378400 5378395 -
gacatgaagtccttgcccatgc

SEQ ID NO: 116372 - DNA, 22 bp, Artificial Sequence
  Synthetic oligonucleotide; CTT chr11 5378381 5378402 5378386 5378381 -
gcccatgcctatgtcctgaatg

SEQ ID NO: 116373 - DNA, 22 bp, Artificial Sequence
  Synthetic oligonucleotide; TTG chr11 5378380 5378401 5378385 5378380 -
cccatgcctatgtcctgaatgg

SEQ ID NO: 116374 - DNA, 22 bp, Artificial Sequence
  Synthetic oligonucleotide; CTA chr11 5378370 5378391 5378375 5378370 -
tgtcctgaatggtaatgcctgc

SEQ ID NO: 116375 - DNA, 22 bp, Artificial Sequence
  Synthetic oligonucleotide; CTG chr11 5378363 5378384 5378368 5378363 -
aatggtaatgcctgcgttttct

SEQ ID NO: 116376 - DNA, 22 bp, Artificial Sequence
  Synthetic oligonucleotide; CTG chr11 5378349 5378370 5378354 5378349 -
cgttttcttctagggtttttat

SEQ ID NO: 116377 - DNA, 22 bp, Artificial Sequence
  Synthetic oligonucleotide; TTT chr11 5378344 5378365 5378349 5378344 -
tcttctagggtttttatggttt

SEQ ID NO: 116378 - DNA, 22 bp, Artificial Sequence
  Synthetic oligonucleotide; TTT chr11 5378343 5378364 5378348 5378343 -
cttctagggtttttatggtttt

SEQ ID NO: 116379 - DNA, 22 bp, Artificial Sequence
  Synthetic oligonucleotide; TTC chr11 5378342 5378363 5378347 5378342 -
ttctagggtttttatggtttta

SEQ ID NO: 116380 - DNA, 22 bp, Artificial Sequence
  Synthetic oligonucleotide; CTT chr11 5378340 5378361 5378345 5378340 -
ctagggtttttatggttttagg

SEQ ID NO: 116381 - DNA, 22 bp, Artificial Sequence
  Synthetic oligonucleotide; TTC chr11 5378339 5378360 5378344 5378339 -
tagggtttttatggttttaggt

SEQ ID NO: 116382 - DNA, 22 bp, Artificial Sequence
  Synthetic oligonucleotide; CTA chr11 5378337 5378358 5378342 5378337 -
gggtttttatggttttaggtct

SEQ ID NO: 116383 - DNA, 22 bp, Artificial Sequence
  Synthetic oligonucleotide; TTT chr11 5378331 5378352 5378336 5378331 -
ttatggttttaggtctaatgtt

SEQ ID NO: 116384 - DNA, 22 bp, Artificial Sequence
  Synthetic oligonucleotide; TTT chr11 5378330 5378351 5378335 5378330 -
tatggttttaggtctaatgttt

SEQ ID NO: 116385 - DNA, 22 bp, Artificial Sequence
  Synthetic oligonucleotide; TTT chr11 5378329 5378350 5378334 5378329 -
atggttttaggtctaatgttta

SEQ ID NO: 116386 - DNA, 22 bp, Artificial Sequence
  Synthetic oligonucleotide; TTA chr11 5378328 5378349 5378333 5378328 -
tggttttaggtctaatgtttaa

SEQ ID NO: 116387 - DNA, 22 bp, Artificial Sequence
  Synthetic oligonucleotide; TTT chr11 5378322 5378343 5378327 5378322 -
taggtctaatgtttaagtcttt

SEQ ID NO: 116388 - DNA, 22 bp, Artificial Sequence
  Synthetic oligonucleotide; TTT chr11 5378321 5378342 5378326 5378321 -
aggtctaatgtttaagtcttta

SEQ ID NO: 116389 - DNA, 22 bp, Artificial Sequence
  Synthetic oligonucleotide; TTA chr11 5378320 5378341 5378325 5378320 -
ggtctaatgtttaagtctttaa

SEQ ID NO: 116390 - DNA, 22 bp, Artificial Sequence
  Synthetic oligonucleotide; CTA chr11 5378314 5378335 5378319 5378314 -
atgtttaagtctttaatccatc

SEQ ID NO: 116391 - DNA, 22 bp, Artificial Sequence
  Synthetic oligonucleotide; TTT chr11 5378308 5378329 5378313 5378308 -
aagtctttaatccatcttgaat

SEQ ID NO: 116392 - DNA, 22 bp, Artificial Sequence
  Synthetic oligonucleotide; TTA chr11 5378307 5378328 5378312 5378307 -
agtctttaatccatcttgaatt

SEQ ID NO: 116393 - DNA, 22 bp, Artificial Sequence
  Synthetic oligonucleotide; CTT chr11 5378301 5378322 5378306 5378301 -
taatccatcttgaattaatttt

SEQ ID NO: 116394 - DNA, 22 bp, Artificial Sequence
  Synthetic oligonucleotide; TTT chr11 5378300 5378321 5378305 5378300 -
aatccatcttgaattaattttt

SEQ ID NO: 116395 - DNA, 22 bp, Artificial Sequence
  Synthetic oligonucleotide; TTA chr11 5378299 5378320 5378304 5378299 -
atccatcttgaattaatttttg

SEQ ID NO: 116396 - DNA, 22 bp, Artificial Sequence
  Synthetic oligonucleotide; CTT chr11 5378290 5378311 5378295 5378290 -
gaattaatttttgtataaggtg

SEQ ID NO: 116397 - DNA, 22 bp, Artificial Sequence
  Synthetic oligonucleotide; TTG chr11 5378289 5378310 5378294 5378289 -
aattaatttttgtataaggtgt

SEQ ID NO: 116398 - DNA, 22 bp, Artificial Sequence
  Synthetic oligonucleotide; TTA chr11 5378284 5378305 5378289 5378284 -
atttttgtataaggtgtaagga

SEQ ID NO: 116399 - DNA, 22 bp, Artificial Sequence
  Synthetic oligonucleotide; TTT chr11 5378280 5378301 5378285 5378280 -
ttgtataaggtgtaaggaaggg

SEQ ID NO: 116400 - DNA, 22 bp, Artificial Sequence
  Synthetic oligonucleotide; TTT chr11 5378279 5378300 5378284 5378279 -
tgtataaggtgtaaggaaggga

SEQ ID NO: 116401 - DNA, 22 bp, Artificial Sequence
  Synthetic oligonucleotide; TTT chr11 5378278 5378299 5378283 5378278 -
gtataaggtgtaaggaagggat

SEQ ID NO: 116402 - DNA, 22 bp, Artificial Sequence
  Synthetic oligonucleotide; TTG chr11 5378277 5378298 5378282 5378277 -
tataaggtgtaaggaagggatc

SEQ ID NO: 116403 - DNA, 22 bp, Artificial Sequence
  Synthetic oligonucleotide; TTT chr11 5378249 5378270 5378254 5378249 -
cagcattctacatatggctagc

SEQ ID NO: 116404 - DNA, 22 bp, Artificial Sequence
  Synthetic oligonucleotide; TTC chr11 5378248 5378269 5378253 5378248 -
agcattctacatatggctagcc

SEQ ID NO: 116405 - DNA, 22 bp, Artificial Sequence
  Synthetic oligonucleotide; TTC chr11 5378241 5378262 5378246 5378241 -
tacatatggctagccagttctc

SEQ ID NO: 116406 - DNA, 22 bp, Artificial Sequence
  Synthetic oligonucleotide; CTA chr11 5378239 5378260 5378244 5378239 -
catatggctagccagttctccc

SEQ ID NO: 116407 - DNA, 22 bp, Artificial Sequence
  Synthetic oligonucleotide; CTA chr11 5378229 5378250 5378234 5378229 -
gccagttctcccagcaccattt

SEQ ID NO: 116408 - DNA, 22 bp, Artificial Sequence
  Synthetic oligonucleotide; TTC chr11 5378221 5378242 5378226 5378221 -
tcccagcaccatttattaaata

SEQ ID NO: 116409 - DNA, 22 bp, Artificial Sequence
  Synthetic oligonucleotide; CTC chr11 5378219 5378240 5378224 5378219 -
ccagcaccatttattaaatagg

SEQ ID NO: 116410 - DNA, 22 bp, Artificial Sequence
  Synthetic oligonucleotide; TTT chr11 5378207 5378228 5378212 5378207 -
attaaatagggaatcctttccc

SEQ ID NO: 116411 - DNA, 22 bp, Artificial Sequence
  Synthetic oligonucleotide; TTA chr11 5378206 5378227 5378211 5378206 -
ttaaatagggaatcctttcccc

SEQ ID NO: 116412 - DNA, 22 bp, Artificial Sequence
  Synthetic oligonucleotide; TTA chr11 5378203 5378224 5378208 5378203 -
aatagggaatcctttccccatt

SEQ ID NO: 116413 - DNA, 22 bp, Artificial Sequence
  Synthetic oligonucleotide; CTT chr11 5378189 5378210 5378194 5378189 -
tccccatttcttgtttttctca

SEQ ID NO: 116414 - DNA, 22 bp, Artificial Sequence
  Synthetic oligonucleotide; TTT chr11 5378188 5378209 5378193 5378188 -
ccccatttcttgtttttctcag

SEQ ID NO: 116415 - DNA, 22 bp, Artificial Sequence
  Synthetic oligonucleotide; TTC chr11 5378187 5378208 5378192 5378187 -
cccatttcttgtttttctcagg

SEQ ID NO: 116416 - DNA, 22 bp, Artificial Sequence
  Synthetic oligonucleotide; TTT chr11 5378180 5378201 5378185 5378180 -
cttgtttttctcaggtttttca

SEQ ID NO: 116417 - DNA, 22 bp, Artificial Sequence
  Synthetic oligonucleotide; TTC chr11 5378179 5378200 5378184 5378179 -
ttgtttttctcaggtttttcaa

SEQ ID NO: 116418 - DNA, 22 bp, Artificial Sequence
  Synthetic oligonucleotide; CTT chr11 5378177 5378198 5378182 5378177 -
gtttttctcaggtttttcaaag

SEQ ID NO: 116419 - DNA, 22 bp, Artificial Sequence
  Synthetic oligonucleotide; TTG chr11 5378176 5378197 5378181 5378176 -
tttttctcaggtttttcaaaga

SEQ ID NO: 116420 - DNA, 22 bp, Artificial Sequence
  Synthetic oligonucleotide; TTT chr11 5378173 5378194 5378178 5378173 -
ttctcaggtttttcaaagatca

SEQ ID NO: 116421 - DNA, 22 bp, Artificial Sequence
  Synthetic oligonucleotide; TTT chr11 5378172 5378193 5378177 5378172 -
tctcaggtttttcaaagatcag

SEQ ID NO: 116422 - DNA, 22 bp, Artificial Sequence
  Synthetic oligonucleotide; TTT chr11 5378171 5378192 5378176 5378171 -
ctcaggtttttcaaagatcaga

SEQ ID NO: 116423 - DNA, 22 bp, Artificial Sequence
  Synthetic oligonucleotide; TTC chr11 5378170 5378191 5378175 5378170 -
tcaggtttttcaaagatcagat

SEQ ID NO: 116424 - DNA, 22 bp, Artificial Sequence
  Synthetic oligonucleotide; CTC chr11 5378168 5378189 5378173 5378168 -
aggtttttcaaagatcagatag

SEQ ID NO: 116425 - DNA, 22 bp, Artificial Sequence
  Synthetic oligonucleotide; TTT chr11 5378162 5378183 5378167 5378162 -
ttcaaagatcagatagttgtag

SEQ ID NO: 116426 - DNA, 22 bp, Artificial Sequence
  Synthetic oligonucleotide; TTT chr11 5378161 5378182 5378166 5378161 -
tcaaagatcagatagttgtaga

SEQ ID NO: 116427 - DNA, 22 bp, Artificial Sequence
  Synthetic oligonucleotide; TTT chr11 5378160 5378181 5378165 5378160 -
caaagatcagatagttgtagat

SEQ ID NO: 116428 - DNA, 22 bp, Artificial Sequence
  Synthetic oligonucleotide; TTC chr11 5378159 5378180 5378164 5378159 -
aaagatcagatagttgtagata

SEQ ID NO: 116429 - DNA, 22 bp, Artificial Sequence
  Synthetic oligonucleotide; TTG chr11 5378143 5378164 5378148 5378143 -
tagatatgcgtcgttatttctg

SEQ ID NO: 116430 - DNA, 22 bp, Artificial Sequence
  Synthetic oligonucleotide; TTA chr11 5378127 5378148 5378132 5378127 -
tttctgagggctctgttctgtt

SEQ ID NO: 116431 - DNA, 22 bp, Artificial Sequence
  Synthetic oligonucleotide; TTT chr11 5378124 5378145 5378129 5378124 -
ctgagggctctgttctgttcca

SEQ ID NO: 116432 - DNA, 22 bp, Artificial Sequence
  Synthetic oligonucleotide; TTC chr11 5378123 5378144 5378128 5378123 -
tgagggctctgttctgttccat

SEQ ID NO: 116433 - DNA, 22 bp, Artificial Sequence
  Synthetic oligonucleotide; CTG chr11 5378121 5378142 5378126 5378121 -
agggctctgttctgttccattg

SEQ ID NO: 116434 - DNA, 22 bp, Artificial Sequence
  Synthetic oligonucleotide; CTC chr11 5378114 5378135 5378119 5378114 -
tgttctgttccattgatctata

SEQ ID NO: 116435 - DNA, 22 bp, Artificial Sequence
  Synthetic oligonucleotide; CTG chr11 5378112 5378133 5378117 5378112 -
ttctgttccattgatctatatc

SEQ ID NO: 116436 - DNA, 22 bp, Artificial Sequence
  Synthetic oligonucleotide; TTC chr11 5378109 5378130 5378114 5378109 -
tgttccattgatctatatctgt

SEQ ID NO: 116437 - DNA, 22 bp, Artificial Sequence
  Synthetic oligonucleotide; CTG chr11 5378107 5378128 5378112 5378107 -
ttccattgatctatatctgtgt

SEQ ID NO: 116438 - DNA, 22 bp, Artificial Sequence
  Synthetic oligonucleotide; TTC chr11 5378104 5378125 5378109 5378104 -
cattgatctatatctgtgtttt

SEQ ID NO: 116439 - DNA, 22 bp, Artificial Sequence
  Synthetic oligonucleotide; TTG chr11 5378099 5378120 5378104 5378099 -
atctatatctgtgttttggtac

SEQ ID NO: 116440 - DNA, 22 bp, Artificial Sequence
  Synthetic oligonucleotide; CTA chr11 5378094 5378115 5378099 5378094 -
tatctgtgttttggtaccagta

SEQ ID NO: 116441 - DNA, 22 bp, Artificial Sequence
  Synthetic oligonucleotide; CTG chr11 5378088 5378109 5378093 5378088 -
tgttttggtaccagtaacatgc

SEQ ID NO: 116442 - DNA, 22 bp, Artificial Sequence
  Synthetic oligonucleotide; TTT chr11 5378083 5378104 5378088 5378083 -
tggtaccagtaacatgctgttt

SEQ ID NO: 116443 - DNA, 22 bp, Artificial Sequence
  Synthetic oligonucleotide; TTT chr11 5378082 5378103 5378087 5378082 -
ggtaccagtaacatgctgtttt

SEQ ID NO: 116444 - DNA, 22 bp, Artificial Sequence
  Synthetic oligonucleotide; TTG chr11 5378081 5378102 5378086 5378081 -
gtaccagtaacatgctgttttg

SEQ ID NO: 116445 - DNA, 22 bp, Artificial Sequence
  Synthetic oligonucleotide; CTG chr11 5378064 5378085 5378069 5378064 -
ttttggttactgtagccttgta

SEQ ID NO: 116446 - DNA, 22 bp, Artificial Sequence
  Synthetic oligonucleotide; TTT chr11 5378061 5378082 5378066 5378061 -
tggttactgtagccttgtagta

SEQ ID NO: 116447 - DNA, 22 bp, Artificial Sequence
  Synthetic oligonucleotide; TTT chr11 5378060 5378081 5378065 5378060 -
ggttactgtagccttgtagtat

SEQ ID NO: 116448 - DNA, 22 bp, Artificial Sequence
  Synthetic oligonucleotide; TTG chr11 5378059 5378080 5378064 5378059 -
gttactgtagccttgtagtata

SEQ ID NO: 116449 - DNA, 22 bp, Artificial Sequence
  Synthetic oligonucleotide; TTA chr11 5378055 5378076 5378060 5378055 -
ctgtagccttgtagtatagttt

SEQ ID NO: 116450 - DNA, 22 bp, Artificial Sequence
  Synthetic oligonucleotide; CTG chr11 5378052 5378073 5378057 5378052 -
tagccttgtagtatagtttgaa

SEQ ID NO: 116451 - DNA, 22 bp, Artificial Sequence
  Synthetic oligonucleotide; CTT chr11 5378045 5378066 5378050 5378045 -
gtagtatagtttgaagtgaggt

SEQ ID NO: 116452 - DNA, 22 bp, Artificial Sequence
  Synthetic oligonucleotide; TTG chr11 5378044 5378065 5378049 5378044 -
tagtatagtttgaagtgaggta

SEQ ID NO: 116453 - DNA, 22 bp, Artificial Sequence
  Synthetic oligonucleotide; TTT chr11 5378033 5378054 5378038 5378033 -
gaagtgaggtagcctgatgcct

SEQ ID NO: 116454 - DNA, 22 bp, Artificial Sequence
  Synthetic oligonucleotide; TTG chr11 5378032 5378053 5378037 5378032 -
aagtgaggtagcctgatgcctc

SEQ ID NO: 116455 - DNA, 22 bp, Artificial Sequence
  Synthetic oligonucleotide; CTG chr11 5378017 5378038 5378022 5378017 -
atgcctccagctttgttctttt

SEQ ID NO: 116456 - DNA, 22 bp, Artificial Sequence
  Synthetic oligonucleotide; CTC chr11 5378010 5378031 5378015 5378010 -
cagctttgttcttttggcttag

SEQ ID NO: 116457 - DNA, 22 bp, Artificial Sequence
  Synthetic oligonucleotide; CTT chr11 5378004 5378025 5378009 5378004 -
tgttcttttggcttaggattga

SEQ ID NO: 116458 - DNA, 22 bp, Artificial Sequence
  Synthetic oligonucleotide; TTT chr11 5378003 5378024 5378008 5378003 -
gttcttttggcttaggattgac

SEQ ID NO: 116459 - DNA, 22 bp, Artificial Sequence
  Synthetic oligonucleotide; TTG chr11 5378002 5378023 5378007 5378002 -
ttcttttggcttaggattgact

SEQ ID NO: 116460 - DNA, 22 bp, Artificial Sequence
  Synthetic oligonucleotide; TTC chr11 5377999 5378020 5378004 5377999 -
ttttggcttaggattgacttgg

SEQ ID NO: 116461 - DNA, 22 bp, Artificial Sequence
  Synthetic oligonucleotide; CTT chr11 5377997 5378018 5378002 5377997 -
ttggcttaggattgacttggca

SEQ ID NO: 116462 - DNA, 22 bp, Artificial Sequence
  Synthetic oligonucleotide; TTT chr11 5377996 5378017 5378001 5377996 -
tggcttaggattgacttggcaa

SEQ ID NO: 116463 - DNA, 22 bp, Artificial Sequence
  Synthetic oligonucleotide; TTT chr11 5377995 5378016 5378000 5377995 -
ggcttaggattgacttggcaat

SEQ ID NO: 116464 - DNA, 22 bp, Artificial Sequence
  Synthetic oligonucleotide; TTG chr11 5377994 5378015 5377999 5377994 -
gcttaggattgacttggcaatg

SEQ ID NO: 116465 - DNA, 22 bp, Artificial Sequence
  Synthetic oligonucleotide; CTT chr11 5377990 5378011 5377995 5377990 -
aggattgacttggcaatgcagg

SEQ ID NO: 116466 - DNA, 22 bp, Artificial Sequence
  Synthetic oligonucleotide; TTA chr11 5377989 5378010 5377994 5377989 -
ggattgacttggcaatgcaggc

SEQ ID NO: 116467 - DNA, 22 bp, Artificial Sequence
  Synthetic oligonucleotide; TTG chr11 5377983 5378004 5377988 5377983 -
acttggcaatgcaggctctttt

SEQ ID NO: 116468 - DNA, 22 bp, Artificial Sequence
  Synthetic oligonucleotide; CTT chr11 5377979 5378000 5377984 5377979 -
ggcaatgcaggctcttttttgg

SEQ ID NO: 116469 - DNA, 22 bp, Artificial Sequence
  Synthetic oligonucleotide; TTG chr11 5377978 5377999 5377983 5377978 -
gcaatgcaggctcttttttggt

SEQ ID NO: 116470 - DNA, 22 bp, Artificial Sequence
  Synthetic oligonucleotide; CTC chr11 5377965 5377986 5377970 5377965 -
ttttttggttccatatgaactt

SEQ ID NO: 116471 - DNA, 22 bp, Artificial Sequence
  Synthetic oligonucleotide; CTT chr11 5377963 5377984 5377968 5377963 -
ttttggttccatatgaacttta

SEQ ID NO: 116472 - DNA, 22 bp, Artificial Sequence
  Synthetic oligonucleotide; TTT chr11 5377962 5377983 5377967 5377962 -
tttggttccatatgaactttaa

SEQ ID NO: 116473 - DNA, 22 bp, Artificial Sequence
  Synthetic oligonucleotide; TTT chr11 5377961 5377982 5377966 5377961 -
ttggttccatatgaactttaaa

SEQ ID NO: 116474 - DNA, 22 bp, Artificial Sequence
  Synthetic oligonucleotide; TTT chr11 5377960 5377981 5377965 5377960 -
tggttccatatgaactttaaag

SEQ ID NO: 116475 - DNA, 22 bp, Artificial Sequence
  Synthetic oligonucleotide; TTT chr11 5377959 5377980 5377964 5377959 -
ggttccatatgaactttaaagt

SEQ ID NO: 116476 - DNA, 22 bp, Artificial Sequence
  Synthetic oligonucleotide; TTG chr11 5377958 5377979 5377963 5377958 -
gttccatatgaactttaaagtc

SEQ ID NO: 116477 - DNA, 22 bp, Artificial Sequence
  Synthetic oligonucleotide; TTC chr11 5377954 5377975 5377959 5377954 -
catatgaactttaaagtcgttt

SEQ ID NO: 116478 - DNA, 22 bp, Artificial Sequence
  Synthetic oligonucleotide; CTT chr11 5377943 5377964 5377948 5377943 -
taaagtcgtttttccaattctg

SEQ ID NO: 116479 - DNA, 22 bp, Artificial Sequence
  Synthetic oligonucleotide; TTT chr11 5377942 5377963 5377947 5377942 -
aaagtcgtttttccaattctgt

SEQ ID NO: 116480 - DNA, 22 bp, Artificial Sequence
  Synthetic oligonucleotide; TTA chr11 5377941 5377962 5377946 5377941 -
aagtcgtttttccaattctgtg

SEQ ID NO: 116481 - DNA, 22 bp, Artificial Sequence
  Synthetic oligonucleotide; TTT chr11 5377932 5377953 5377937 5377932 -
ttccaattctgtgaagaaaatc

SEQ ID NO: 116482 - DNA, 22 bp, Artificial Sequence
  Synthetic oligonucleotide; TTT chr11 5377931 5377952 5377936 5377931 -
tccaattctgtgaagaaaatca

SEQ ID NO: 116483 - DNA, 22 bp, Artificial Sequence
  Synthetic oligonucleotide; TTT chr11 5377930 5377951 5377935 5377930 -
ccaattctgtgaagaaaatcat

SEQ ID NO: 116484 - DNA, 22 bp, Artificial Sequence
  Synthetic oligonucleotide; TTC chr11 5377929 5377950 5377934 5377929 -
caattctgtgaagaaaatcatt

SEQ ID NO: 116485 - DNA, 22 bp, Artificial Sequence
  Synthetic oligonucleotide; TTC chr11 5377923 5377944 5377928 5377923 -
tgtgaagaaaatcattggtagc

SEQ ID NO: 116486 - DNA, 22 bp, Artificial Sequence
  Synthetic oligonucleotide; CTG chr11 5377921 5377942 5377926 5377921 -
tgaagaaaatcattggtagctt

SEQ ID NO: 116487 - DNA, 22 bp, Artificial Sequence
  Synthetic oligonucleotide; TTG chr11 5377906 5377927 5377911 5377906 -
gtagcttgatggggatggcatt

SEQ ID NO: 116488 - DNA, 22 bp, Artificial Sequence
  Synthetic oligonucleotide; CTT chr11 5377899 5377920 5377904 5377899 -
gatggggatggcattgaatcta

SEQ ID NO: 116489 - DNA, 22 bp, Artificial Sequence
  Synthetic oligonucleotide; TTG chr11 5377898 5377919 5377903 5377898 -
atggggatggcattgaatctat

SEQ ID NO: 116490 - DNA, 22 bp, Artificial Sequence
  Synthetic oligonucleotide; TTG chr11 5377883 5377904 5377888 5377883 -
aatctataaattaccttgggca

SEQ ID NO: 116491 - DNA, 22 bp, Artificial Sequence
  Synthetic oligonucleotide; CTA chr11 5377877 5377898 5377882 5377877 -
taaattaccttgggcattatgg

SEQ ID NO: 116492 - DNA, 22 bp, Artificial Sequence
  Synthetic oligonucleotide; TTA chr11 5377870 5377891 5377875 5377870 -
ccttgggcattatggccatttt

SEQ ID NO: 116493 - DNA, 22 bp, Artificial Sequence
  Synthetic oligonucleotide; CTT chr11 5377866 5377887 5377871 5377866 -
gggcattatggccattttgatg

SEQ ID NO: 116494 - DNA, 22 bp, Artificial Sequence
  Synthetic oligonucleotide; TTG chr11 5377865 5377886 5377870 5377865 -
ggcattatggccattttgatga

SEQ ID NO: 116495 - DNA, 22 bp, Artificial Sequence
  Synthetic oligonucleotide; TTA chr11 5377858 5377879 5377863 5377858 -
tggccattttgatgatattgat

SEQ ID NO: 116496 - DNA, 22 bp, Artificial Sequence
  Synthetic oligonucleotide; TTT chr11 5377849 5377870 5377854 5377849 -
tgatgatattgattcttcctac

SEQ ID NO: 116497 - DNA, 22 bp, Artificial Sequence
  Synthetic oligonucleotide; TTT chr11 5377848 5377869 5377853 5377848 -
gatgatattgattcttcctacc

SEQ ID NO: 116498 - DNA, 22 bp, Artificial Sequence
  Synthetic oligonucleotide; TTG chr11 5377847 5377868 5377852 5377847 -
atgatattgattcttcctaccc

SEQ ID NO: 116499 - DNA, 22 bp, Artificial Sequence
  Synthetic oligonucleotide; TTG chr11 5377838 5377859 5377843 5377838 -
attcttcctacccataagcatg

SEQ ID NO: 116500 - DNA, 22 bp, Artificial Sequence
  Synthetic oligonucleotide; TTC chr11 5377834 5377855 5377839 5377834 -
ttcctacccataagcatggaat

SEQ ID NO: 116501 - DNA, 22 bp, Artificial Sequence
  Synthetic oligonucleotide; CTT chr11 5377832 5377853 5377837 5377832 -
cctacccataagcatggaatgt

SEQ ID NO: 116502 - DNA, 22 bp, Artificial Sequence
  Synthetic oligonucleotide; TTC chr11 5377831 5377852 5377836 5377831 -
ctacccataagcatggaatgtt

SEQ ID NO: 116503 - DNA, 22 bp, Artificial Sequence
  Synthetic oligonucleotide; CTA chr11 5377828 5377849 5377833 5377828 -
cccataagcatggaatgttctt

SEQ ID NO: 116504 - DNA, 22 bp, Artificial Sequence
  Synthetic oligonucleotide; TTC chr11 5377808 5377829 5377813 5377808 -
ttccatttgtttgtatcttctt

SEQ ID NO: 116505 - DNA, 22 bp, Artificial Sequence
  Synthetic oligonucleotide; CTT chr11 5377806 5377827 5377811 5377806 -
ccatttgtttgtatcttctttt

SEQ ID NO: 116506 - DNA, 22 bp, Artificial Sequence
  Synthetic oligonucleotide; TTC chr11 5377805 5377826 5377810 5377805 -
catttgtttgtatcttctttta

SEQ ID NO: 116507 - DNA, 22 bp, Artificial Sequence
  Synthetic oligonucleotide; TTT chr11 5377800 5377821 5377805 5377800 -
gtttgtatcttcttttatttca

SEQ ID NO: 116508 - DNA, 22 bp, Artificial Sequence
  Synthetic oligonucleotide; TTG chr11 5377799 5377820 5377804 5377799 -
tttgtatcttcttttatttcat

SEQ ID NO: 116509 - DNA, 22 bp, Artificial Sequence
  Synthetic oligonucleotide; TTT chr11 5377796 5377817 5377801 5377796 -
gtatcttcttttatttcattga

SEQ ID NO: 116510 - DNA, 22 bp, Artificial Sequence
  Synthetic oligonucleotide; TTG chr11 5377795 5377816 5377800 5377795 -
tatcttcttttatttcattgag

SEQ ID NO: 116511 - DNA, 22 bp, Artificial Sequence
  Synthetic oligonucleotide; CTT chr11 5377789 5377810 5377794 5377789 -
cttttatttcattgagcagtgg

SEQ ID NO: 116512 - DNA, 22 bp, Artificial Sequence
  Synthetic oligonucleotide; TTC chr11 5377788 5377809 5377793 5377788 -
ttttatttcattgagcagtggt

SEQ ID NO: 116513 - DNA, 22 bp, Artificial Sequence
  Synthetic oligonucleotide; CTT chr11 5377786 5377807 5377791 5377786 -
ttatttcattgagcagtggttt

SEQ ID NO: 116514 - DNA, 22 bp, Artificial Sequence
  Synthetic oligonucleotide; TTT chr11 5377785 5377806 5377790 5377785 -
tatttcattgagcagtggtttg

SEQ ID NO: 116515 - DNA, 22 bp, Artificial Sequence
  Synthetic oligonucleotide; TTT chr11 5377784 5377805 5377789 5377784 -
atttcattgagcagtggtttgt

SEQ ID NO: 116516 - DNA, 22 bp, Artificial Sequence
  Synthetic oligonucleotide; TTA chr11 5377783 5377804 5377788 5377783 -
tttcattgagcagtggtttgta

SEQ ID NO: 116517 - DNA, 22 bp, Artificial Sequence
  Synthetic oligonucleotide; TTT chr11 5377780 5377801 5377785 5377780 -
cattgagcagtggtttgtagtt

SEQ ID NO: 116518 - DNA, 22 bp, Artificial Sequence
  Synthetic oligonucleotide; TTC chr11 5377779 5377800 5377784 5377779 -
attgagcagtggtttgtagttc

SEQ ID NO: 116519 - DNA, 22 bp, Artificial Sequence
  Synthetic oligonucleotide; TTG chr11 5377775 5377796 5377780 5377775 -
agcagtggtttgtagttctcct

SEQ ID NO: 116520 - DNA, 22 bp, Artificial Sequence
  Synthetic oligonucleotide; TTT chr11 5377764 5377785 5377769 5377764 -
gtagttctccttgaagaggtcc

SEQ ID NO: 116521 - DNA, 22 bp, Artificial Sequence
  Synthetic oligonucleotide; TTG chr11 5377763 5377784 5377768 5377763 -
tagttctccttgaagaggtcct

SEQ ID NO: 116522 - DNA, 22 bp, Artificial Sequence
  Synthetic oligonucleotide; TTC chr11 5377757 5377778 5377762 5377757 -
tccttgaagaggtccttcacat

SEQ ID NO: 116523 - DNA, 22 bp, Artificial Sequence
  Synthetic oligonucleotide; CTC chr11 5377755 5377776 5377760 5377755 -
cttgaagaggtccttcacatcc

SEQ ID NO: 116524 - DNA, 22 bp, Artificial Sequence
  Synthetic oligonucleotide; CTT chr11 5377752 5377773 5377757 5377752 -
gaagaggtccttcacatccctt

SEQ ID NO: 116525 - DNA, 22 bp, Artificial Sequence
  Synthetic oligonucleotide; TTG chr11 5377751 5377772 5377756 5377751 -
aagaggtccttcacatcccttg

SEQ ID NO: 116526 - DNA, 22 bp, Artificial Sequence
  Synthetic oligonucleotide; CTT chr11 5377740 5377761 5377745 5377740 -
cacatcccttgtaagttggatt

SEQ ID NO: 116527 - DNA, 22 bp, Artificial Sequence
  Synthetic oligonucleotide; TTC chr11 5377739 5377760 5377744 5377739 -
acatcccttgtaagttggattc

SEQ ID NO: 116528 - DNA, 22 bp, Artificial Sequence
  Synthetic oligonucleotide; CTT chr11 5377730 5377751 5377735 5377730 -
gtaagttggattcctaggtatt

SEQ ID NO: 116529 - DNA, 22 bp, Artificial Sequence
  Synthetic oligonucleotide; TTG chr11 5377729 5377750 5377734 5377729 -
taagttggattcctaggtattt

SEQ ID NO: 116530 - DNA, 22 bp, Artificial Sequence
  Synthetic oligonucleotide; TTG chr11 5377722 5377743 5377727 5377722 -
gattcctaggtattttattctc

SEQ ID NO: 116531 - DNA, 22 bp, Artificial Sequence
  Synthetic oligonucleotide; TTC chr11 5377717 5377738 5377722 5377717 -
ctaggtattttattctctttga

SEQ ID NO: 116532 - DNA, 22 bp, Artificial Sequence
  Synthetic oligonucleotide; CTA chr11 5377714 5377735 5377719 5377714 -
ggtattttattctctttgaagc

SEQ ID NO: 116533 - DNA, 22 bp, Artificial Sequence
  Synthetic oligonucleotide; TTT chr11 5377707 5377728 5377712 5377707 -
tattctctttgaagcaattgtg

SEQ ID NO: 116534 - DNA, 22 bp, Artificial Sequence
  Synthetic oligonucleotide; TTT chr11 5377706 5377727 5377711 5377706 -
attctctttgaagcaattgtga

SEQ ID NO: 116535 - DNA, 22 bp, Artificial Sequence
  Synthetic oligonucleotide; TTA chr11 5377705 5377726 5377710 5377705 -
ttctctttgaagcaattgtgaa

SEQ ID NO: 116536 - DNA, 22 bp, Artificial Sequence
  Synthetic oligonucleotide; TTC chr11 5377702 5377723 5377707 5377702 -
tctttgaagcaattgtgaatgg

SEQ ID NO: 116537 - DNA, 22 bp, Artificial Sequence
  Synthetic oligonucleotide; CTC chr11 5377700 5377721 5377705 5377700 -
tttgaagcaattgtgaatggga

SEQ ID NO: 116538 - DNA, 22 bp, Artificial Sequence
  Synthetic oligonucleotide; CTT chr11 5377698 5377719 5377703 5377698 -
tgaagcaattgtgaatgggagt

SEQ ID NO: 116539 - DNA, 22 bp, Artificial Sequence
  Synthetic oligonucleotide; TTT chr11 5377697 5377718 5377702 5377697 -
gaagcaattgtgaatgggagtt

SEQ ID NO: 116540 - DNA, 22 bp, Artificial Sequence
  Synthetic oligonucleotide; TTG chr11 5377696 5377717 5377701 5377696 -
aagcaattgtgaatgggagttc

SEQ ID NO: 116541 - DNA, 22 bp, Artificial Sequence
  Synthetic oligonucleotide; TTG chr11 5377687 5377708 5377692 5377687 -
tgaatgggagttccctcatgat

SEQ ID NO: 116542 - DNA, 22 bp, Artificial Sequence
  Synthetic oligonucleotide; TTC chr11 5377674 5377695 5377679 5377674 -
cctcatgatttggctctctgtt

SEQ ID NO: 116543 - DNA, 22 bp, Artificial Sequence
  Synthetic oligonucleotide; CTC chr11 5377670 5377691 5377675 5377670 -
atgatttggctctctgtttgtc

SEQ ID NO: 116544 - DNA, 22 bp, Artificial Sequence
  Synthetic oligonucleotide; TTT chr11 5377663 5377684 5377668 5377663 -
ggctctctgtttgtctgttatt

SEQ ID NO: 116545 - DNA, 22 bp, Artificial Sequence
  Synthetic oligonucleotide; TTG chr11 5377662 5377683 5377667 5377662 -
gctctctgtttgtctgttattg

SEQ ID NO: 116546 - DNA, 22 bp, Artificial Sequence
  Synthetic oligonucleotide; CTC chr11 5377658 5377679 5377663 5377658 -
tctgtttgtctgttattggtgt

SEQ ID NO: 116547 - DNA, 22 bp, Artificial Sequence
  Synthetic oligonucleotide; CTC chr11 5377656 5377677 5377661 5377656 -
tgtttgtctgttattggtgtat

SEQ ID NO: 116548 - DNA, 22 bp, Artificial Sequence
  Synthetic oligonucleotide; CTG chr11 5377654 5377675 5377659 5377654 -
tttgtctgttattggtgtataa

SEQ ID NO: 116549 - DNA, 22 bp, Artificial Sequence
  Synthetic oligonucleotide; TTT chr11 5377651 5377672 5377656 5377651 -
gtctgttattggtgtataagaa

SEQ ID NO: 116550 - DNA, 22 bp, Artificial Sequence
  Synthetic oligonucleotide; TTG chr11 5377650 5377671 5377655 5377650 -
tctgttattggtgtataagaat

SEQ ID NO: 116551 - DNA, 22 bp, Artificial Sequence
  Synthetic oligonucleotide; CTG chr11 5377646 5377667 5377651 5377646 -
ttattggtgtataagaatgctt

SEQ ID NO: 116552 - DNA, 22 bp, Artificial Sequence
  Synthetic oligonucleotide; TTA chr11 5377643 5377664 5377648 5377643 -
ttggtgtataagaatgcttgtg

SEQ ID NO: 116553 - DNA, 22 bp, Artificial Sequence
  Synthetic oligonucleotide; TTG chr11 5377640 5377661 5377645 5377640 -
gtgtataagaatgcttgtgatt

SEQ ID NO: 116554 - DNA, 22 bp, Artificial Sequence
  Synthetic oligonucleotide; CTT chr11 5377624 5377645 5377629 5377624 -
gtgatttttgcacattggtttt

SEQ ID NO: 116555 - DNA, 22 bp, Artificial Sequence
  Synthetic oligonucleotide; TTG chr11 5377623 5377644 5377628 5377623 -
tgatttttgcacattggttttg

SEQ ID NO: 116556 - DNA, 22 bp, Artificial Sequence
  Synthetic oligonucleotide; TTT chr11 5377617 5377638 5377622 5377617 -
ttgcacattggttttgtatcct

SEQ ID NO: 116557 - DNA, 22 bp, Artificial Sequence
  Synthetic oligonucleotide; TTT chr11 5377616 5377637 5377621 5377616 -
tgcacattggttttgtatcctg

SEQ ID NO: 116558 - DNA, 22 bp, Artificial Sequence
  Synthetic oligonucleotide; TTT chr11 5377615 5377636 5377620 5377615 -
gcacattggttttgtatcctga

SEQ ID NO: 116559 - DNA, 22 bp, Artificial Sequence
  Synthetic oligonucleotide; TTG chr11 5377614 5377635 5377619 5377614 -
cacattggttttgtatcctgag

SEQ ID NO: 116560 - DNA, 22 bp, Artificial Sequence
  Synthetic oligonucleotide; TTG chr11 5377607 5377628 5377612 5377607 -
gttttgtatcctgaggctttgc

SEQ ID NO: 116561 - DNA, 22 bp, Artificial Sequence
  Synthetic oligonucleotide; TTT chr11 5377603 5377624 5377608 5377603 -
tgtatcctgaggctttgctgaa

SEQ ID NO: 116562 - DNA, 22 bp, Artificial Sequence
  Synthetic oligonucleotide; TTT chr11 5377602 5377623 5377607 5377602 -
gtatcctgaggctttgctgaag

SEQ ID NO: 116563 - DNA, 22 bp, Artificial Sequence
  Synthetic oligonucleotide; TTG chr11 5377601 5377622 5377606 5377601 -
tatcctgaggctttgctgaagt

SEQ ID NO: 116564 - DNA, 22 bp, Artificial Sequence
  Synthetic oligonucleotide; CTG chr11 5377594 5377615 5377599 5377594 -
aggctttgctgaagttgcttat

SEQ ID NO: 116565 - DNA, 22 bp, Artificial Sequence
  Synthetic oligonucleotide; CTT chr11 5377588 5377609 5377593 5377588 -
tgctgaagttgcttatcagctt

SEQ ID NO: 116566 - DNA, 22 bp, Artificial Sequence
  Synthetic oligonucleotide; TTT chr11 5377587 5377608 5377592 5377587 -
gctgaagttgcttatcagctta

SEQ ID NO: 116567 - DNA, 22 bp, Artificial Sequence
  Synthetic oligonucleotide; TTG chr11 5377586 5377607 5377591 5377586 -
ctgaagttgcttatcagcttaa

SEQ ID NO: 116568 - DNA, 22 bp, Artificial Sequence
  Synthetic oligonucleotide; CTG chr11 5377583 5377604 5377588 5377583 -
aagttgcttatcagcttaagga

SEQ ID NO: 116569 - DNA, 22 bp, Artificial Sequence
  Synthetic oligonucleotide; TTG chr11 5377577 5377598 5377582 5377577 -
cttatcagcttaaggagatttt

SEQ ID NO: 116570 - DNA, 22 bp, Artificial Sequence
  Synthetic oligonucleotide; CTT chr11 5377574 5377595 5377579 5377574 -
atcagcttaaggagattttggg

SEQ ID NO: 116571 - DNA, 22 bp, Artificial Sequence
  Synthetic oligonucleotide; TTA chr11 5377573 5377594 5377578 5377573 -
tcagcttaaggagattttgggc

SEQ ID NO: 116572 - DNA, 22 bp, Artificial Sequence
  Synthetic oligonucleotide; CTT chr11 5377566 5377587 5377571 5377566 -
aaggagattttgggctgagaca

SEQ ID NO: 116573 - DNA, 22 bp, Artificial Sequence
  Synthetic oligonucleotide; TTA chr11 5377565 5377586 5377570 5377565 -
aggagattttgggctgagacaa

SEQ ID NO: 116574 - DNA, 22 bp, Artificial Sequence
  Synthetic oligonucleotide; TTT chr11 5377556 5377577 5377561 5377556 -
tgggctgagacaagggggtttt

SEQ ID NO: 116575 - DNA, 22 bp, Artificial Sequence
  Synthetic oligonucleotide; TTT chr11 5377555 5377576 5377560 5377555 -
gggctgagacaagggggttttc

SEQ ID NO: 116576 - DNA, 22 bp, Artificial Sequence
  Synthetic oligonucleotide; TTG chr11 5377554 5377575 5377559 5377554 -
ggctgagacaagggggttttct

SEQ ID NO: 116577 - DNA, 22 bp, Artificial Sequence
  Synthetic oligonucleotide; CTG chr11 5377549 5377570 5377554 5377549 -
agacaagggggttttctagata

SEQ ID NO: 116578 - DNA, 22 bp, Artificial Sequence
  Synthetic oligonucleotide; TTT chr11 5377535 5377556 5377540 5377535 -
tctagatatacaatcatgtcgt

SEQ ID NO: 116579 - DNA, 22 bp, Artificial Sequence
  Synthetic oligonucleotide; TTT chr11 5377534 5377555 5377539 5377534 -
ctagatatacaatcatgtcgtc

SEQ ID NO: 116580 - DNA, 22 bp, Artificial Sequence
  Synthetic oligonucleotide; TTC chr11 5377533 5377554 5377538 5377533 -
tagatatacaatcatgtcgtct

SEQ ID NO: 116581 - DNA, 22 bp, Artificial Sequence
  Synthetic oligonucleotide; CTA chr11 5377531 5377552 5377536 5377531 -
gatatacaatcatgtcgtctgc

SEQ ID NO: 116582 - DNA, 22 bp, Artificial Sequence
  Synthetic oligonucleotide; CTG chr11 5377510 5377531 5377515 5377510 -
caaacagggacaatttgacttc

SEQ ID NO: 116583 - DNA, 22 bp, Artificial Sequence
  Synthetic oligonucleotide; TTT chr11 5377494 5377515 5377499 5377494 -
gacttcctcttttcttaattga

SEQ ID NO: 116584 - DNA, 22 bp, Artificial Sequence
  Synthetic oligonucleotide; TTG chr11 5377493 5377514 5377498 5377493 -
acttcctcttttcttaattgaa

SEQ ID NO: 116585 - DNA, 22 bp, Artificial Sequence
  Synthetic oligonucleotide; CTT chr11 5377489 5377510 5377494 5377489 -
cctcttttcttaattgaatacc

SEQ ID NO: 116586 - DNA, 22 bp, Artificial Sequence
  Synthetic oligonucleotide; TTC chr11 5377488 5377509 5377493 5377488 -
ctcttttcttaattgaataccc

SEQ ID NO: 116587 - DNA, 22 bp, Artificial Sequence
  Synthetic oligonucleotide; CTC chr11 5377485 5377506 5377490 5377485 -
ttttcttaattgaatacccttt

SEQ ID NO: 116588 - DNA, 22 bp, Artificial Sequence
  Synthetic oligonucleotide; CTT chr11 5377483 5377504 5377488 5377483 -
ttcttaattgaatacccttttt

SEQ ID NO: 116589 - DNA, 22 bp, Artificial Sequence
  Synthetic oligonucleotide; TTT chr11 5377482 5377503 5377487 5377482 -
tcttaattgaataccctttttt

SEQ ID NO: 116590 - DNA, 22 bp, Artificial Sequence
  Synthetic oligonucleotide; TTT chr11 5377481 5377502 5377486 5377481 -
cttaattgaatacccttttttc

SEQ ID NO: 116591 - DNA, 22 bp, Artificial Sequence
  Synthetic oligonucleotide; TTC chr11 5377480 5377501 5377485 5377480 -
ttaattgaatacccttttttcc

SEQ ID NO: 116592 - DNA, 22 bp, Artificial Sequence
  Synthetic oligonucleotide; CTT chr11 5377478 5377499 5377483 5377478 -
aattgaatacccttttttcctg

SEQ ID NO: 116593 - DNA, 22 bp, Artificial Sequence
  Synthetic oligonucleotide; TTA chr11 5377477 5377498 5377482 5377477 -
attgaatacccttttttcctgt

SEQ ID NO: 116594 - DNA, 22 bp, Artificial Sequence
  Synthetic oligonucleotide; TTG chr11 5377473 5377494 5377478 5377473 -
aatacccttttttcctgtcttc

SEQ ID NO: 116595 - DNA, 22 bp, Artificial Sequence
  Synthetic oligonucleotide; CTT chr11 5377464 5377485 5377469 5377464 -
ttttcctgtcttctgcctaatt

SEQ ID NO: 116596 - DNA, 22 bp, Artificial Sequence
  Synthetic oligonucleotide; TTT chr11 5377463 5377484 5377468 5377463 -
tttcctgtcttctgcctaattg

SEQ ID NO: 116597 - DNA, 22 bp, Artificial Sequence
  Synthetic oligonucleotide; TTT chr11 5377462 5377483 5377467 5377462 -
ttcctgtcttctgcctaattgc

SEQ ID NO: 116598 - DNA, 22 bp, Artificial Sequence
  Synthetic oligonucleotide; TTT chr11 5377461 5377482 5377466 5377461 -
tcctgtcttctgcctaattgcc

SEQ ID NO: 116599 - DNA, 22 bp, Artificial Sequence
  Synthetic oligonucleotide; TTT chr11 5377460 5377481 5377465 5377460 -
cctgtcttctgcctaattgccc

SEQ ID NO: 116600 - DNA, 22 bp, Artificial Sequence
  Synthetic oligonucleotide; TTC chr11 5377459 5377480 5377464 5377459 -
ctgtcttctgcctaattgccct

SEQ ID NO: 116601 - DNA, 22 bp, Artificial Sequence
  Synthetic oligonucleotide; CTG chr11 5377456 5377477 5377461 5377456 -
tcttctgcctaattgccctggc

SEQ ID NO: 116602 - DNA, 22 bp, Artificial Sequence
  Synthetic oligonucleotide; CTT chr11 5377452 5377473 5377457 5377452 -
ctgcctaattgccctggccaga

SEQ ID NO: 116603 - DNA, 22 bp, Artificial Sequence
  Synthetic oligonucleotide; TTC chr11 5377451 5377472 5377456 5377451 -
tgcctaattgccctggccagaa

SEQ ID NO: 116604 - DNA, 22 bp, Artificial Sequence
  Synthetic oligonucleotide; CTG chr11 5377449 5377470 5377454 5377449 -
cctaattgccctggccagaact

SEQ ID NO: 116605 - DNA, 22 bp, Artificial Sequence
  Synthetic oligonucleotide; CTA chr11 5377445 5377466 5377450 5377445 -
attgccctggccagaacttcca

SEQ ID NO: 116606 - DNA, 22 bp, Artificial Sequence
  Synthetic oligonucleotide; TTG chr11 5377441 5377462 5377446 5377441 -
ccctggccagaacttccaacac

SEQ ID NO: 116607 - DNA, 22 bp, Artificial Sequence
  Synthetic oligonucleotide; CTG chr11 5377436 5377457 5377441 5377436 -
gccagaacttccaacactatgt

SEQ ID NO: 116608 - DNA, 22 bp, Artificial Sequence
  Synthetic oligonucleotide; CTT chr11 5377426 5377447 5377431 5377426 -
ccaacactatgttgaataggag

SEQ ID NO: 116609 - DNA, 22 bp, Artificial Sequence
  Synthetic oligonucleotide; TTC chr11 5377425 5377446 5377430 5377425 -
caacactatgttgaataggagt

SEQ ID NO: 116610 - DNA, 22 bp, Artificial Sequence
  Synthetic oligonucleotide; CTA chr11 5377417 5377438 5377422 5377417 -
tgttgaataggagtagtgagag

SEQ ID NO: 116611 - DNA, 22 bp, Artificial Sequence
  Synthetic oligonucleotide; TTG chr11 5377412 5377433 5377417 5377412 -
aataggagtagtgagagagggc

SEQ ID NO: 116612 - DNA, 22 bp, Artificial Sequence
  Synthetic oligonucleotide; CTG chr11 5377383 5377404 5377388 5377383 -
tcttgtgccagtttacaaaggg

SEQ ID NO: 116613 - DNA, 22 bp, Artificial Sequence
  Synthetic oligonucleotide; CTT chr11 5377379 5377400 5377384 5377379 -
gtgccagtttacaaagggaatg

SEQ ID NO: 116614 - DNA, 22 bp, Artificial Sequence
  Synthetic oligonucleotide; TTG chr11 5377378 5377399 5377383 5377378 -
tgccagtttacaaagggaatgc

SEQ ID NO: 116615 - DNA, 22 bp, Artificial Sequence
  Synthetic oligonucleotide; TTT chr11 5377369 5377390 5377374 5377369 -
acaaagggaatgcttccagttt

SEQ ID NO: 116616 - DNA, 22 bp, Artificial Sequence
  Synthetic oligonucleotide; TTA chr11 5377368 5377389 5377373 5377368 -
caaagggaatgcttccagtttt

SEQ ID NO: 116617 - DNA, 22 bp, Artificial Sequence
  Synthetic oligonucleotide; CTT chr11 5377354 5377375 5377359 5377354 -
ccagtttttgcccattcagtat

SEQ ID NO: 116618 - DNA, 22 bp, Artificial Sequence
  Synthetic oligonucleotide; TTC chr11 5377353 5377374 5377358 5377353 -
cagtttttgcccattcagtatg

SEQ ID NO: 116619 - DNA, 22 bp, Artificial Sequence
  Synthetic oligonucleotide; TTT chr11 5377347 5377368 5377352 5377347 -
ttgcccattcagtatgatattg

SEQ ID NO: 116620 - DNA, 22 bp, Artificial Sequence
  Synthetic oligonucleotide; TTT chr11 5377346 5377367 5377351 5377346 -
tgcccattcagtatgatattgg

SEQ ID NO: 116621 - DNA, 22 bp, Artificial Sequence
  Synthetic oligonucleotide; TTT chr11 5377345 5377366 5377350 5377345 -
gcccattcagtatgatattggc

SEQ ID NO: 116622 - DNA, 22 bp, Artificial Sequence
  Synthetic oligonucleotide; TTG chr11 5377344 5377365 5377349 5377344 -
cccattcagtatgatattggct

SEQ ID NO: 116623 - DNA, 22 bp, Artificial Sequence
  Synthetic oligonucleotide; TTC chr11 5377337 5377358 5377342 5377337 -
agtatgatattggctgtgggtt

SEQ ID NO: 116624 - DNA, 22 bp, Artificial Sequence
  Synthetic oligonucleotide; TTG chr11 5377325 5377346 5377330 5377325 -
gctgtgggtttgtcatagatag

SEQ ID NO: 116625 - DNA, 22 bp, Artificial Sequence
  Synthetic oligonucleotide; CTG chr11 5377321 5377342 5377326 5377321 -
tgggtttgtcatagatagctct

SEQ ID NO: 116626 - DNA, 22 bp, Artificial Sequence
  Synthetic oligonucleotide; TTT chr11 5377314 5377335 5377319 5377314 -
gtcatagatagctcttattatt

SEQ ID NO: 116627 - DNA, 22 bp, Artificial Sequence
  Synthetic oligonucleotide; TTG chr11 5377313 5377334 5377318 5377313 -
tcatagatagctcttattattt

SEQ ID NO: 116628 - DNA, 22 bp, Artificial Sequence
  Synthetic oligonucleotide; CTC chr11 5377300 5377321 5377305 5377300 -
ttattattttgagatatgtccc

SEQ ID NO: 116629 - DNA, 22 bp, Artificial Sequence
  Synthetic oligonucleotide; CTT chr11 5377298 5377319 5377303 5377298 -
attattttgagatatgtcccat

SEQ ID NO: 116630 - DNA, 22 bp, Artificial Sequence
  Synthetic oligonucleotide; TTA chr11 5377297 5377318 5377302 5377297 -
ttattttgagatatgtcccatc

SEQ ID NO: 116631 - DNA, 22 bp, Artificial Sequence
  Synthetic oligonucleotide; TTA chr11 5377294 5377315 5377299 5377294 -
ttttgagatatgtcccatcaat

SEQ ID NO: 116632 - DNA, 22 bp, Artificial Sequence
  Synthetic oligonucleotide; TTT chr11 5377291 5377312 5377296 5377291 -
tgagatatgtcccatcaatacc

SEQ ID NO: 116633 - DNA, 22 bp, Artificial Sequence
  Synthetic oligonucleotide; TTT chr11 5377290 5377311 5377295 5377290 -
gagatatgtcccatcaatacct

SEQ ID NO: 116634 - DNA, 22 bp, Artificial Sequence
  Synthetic oligonucleotide; TTG chr11 5377289 5377310 5377294 5377289 -
agatatgtcccatcaataccta

SEQ ID NO: 116635 - DNA, 22 bp, Artificial Sequence
  Synthetic oligonucleotide; CTA chr11 5377267 5377288 5377272 5377267 -
atttattgaaagtttttagcat

SEQ ID NO: 116636 - DNA, 22 bp, Artificial Sequence
  Synthetic oligonucleotide; TTT chr11 5377263 5377284 5377268 5377263 -
attgaaagtttttagcatgaag

SEQ ID NO: 116637 - DNA, 22 bp, Artificial Sequence
  Synthetic oligonucleotide; TTA chr11 5377262 5377283 5377267 5377262 -
ttgaaagtttttagcatgaagg

SEQ ID NO: 116638 - DNA, 22 bp, Artificial Sequence
  Synthetic oligonucleotide; TTG chr11 5377259 5377280 5377264 5377259 -
aaagtttttagcatgaagggtt

SEQ ID NO: 116639 - DNA, 22 bp, Artificial Sequence
  Synthetic oligonucleotide; TTT chr11 5377252 5377273 5377257 5377252 -
ttagcatgaagggttgttgaat

SEQ ID NO: 116640 - DNA, 22 bp, Artificial Sequence
  Synthetic oligonucleotide; TTT chr11 5377251 5377272 5377256 5377251 -
tagcatgaagggttgttgaatt

SEQ ID NO: 116641 - DNA, 22 bp, Artificial Sequence
  Synthetic oligonucleotide; TTT chr11 5377250 5377271 5377255 5377250 -
agcatgaagggttgttgaattt

SEQ ID NO: 116642 - DNA, 22 bp, Artificial Sequence
  Synthetic oligonucleotide; TTA chr11 5377249 5377270 5377254 5377249 -
gcatgaagggttgttgaatttt

SEQ ID NO: 116643 - DNA, 22 bp, Artificial Sequence
  Synthetic oligonucleotide; TTG chr11 5377236 5377257 5377241 5377236 -
ttgaattttgtcaaaggccttt

SEQ ID NO: 116644 - DNA, 22 bp, Artificial Sequence
  Synthetic oligonucleotide; TTG chr11 5377233 5377254 5377238 5377233 -
aattttgtcaaaggccttttct

SEQ ID NO: 116645 - DNA, 22 bp, Artificial Sequence
  Synthetic oligonucleotide; TTT chr11 5377228 5377249 5377233 5377228 -
tgtcaaaggccttttctgcatc

SEQ ID NO: 116646 - DNA, 22 bp, Artificial Sequence
  Synthetic oligonucleotide; TTT chr11 5377227 5377248 5377232 5377227 -
gtcaaaggccttttctgcatct

SEQ ID NO: 116647 - DNA, 22 bp, Artificial Sequence
  Synthetic oligonucleotide; TTG chr11 5377226 5377247 5377231 5377226 -
tcaaaggccttttctgcatcta

SEQ ID NO: 116648 - DNA, 22 bp, Artificial Sequence
  Synthetic oligonucleotide; CTT chr11 5377215 5377236 5377220 5377215 -
ttctgcatctattgagataatc

SEQ ID NO: 116649 - DNA, 22 bp, Artificial Sequence
  Synthetic oligonucleotide; TTT chr11 5377214 5377235 5377219 5377214 -
tctgcatctattgagataatca

SEQ ID NO: 116650 - DNA, 22 bp, Artificial Sequence
  Synthetic oligonucleotide; TTT chr11 5377213 5377234 5377218 5377213 -
ctgcatctattgagataatcat

SEQ ID NO: 116651 - DNA, 22 bp, Artificial Sequence
  Synthetic oligonucleotide; TTC chr11 5377212 5377233 5377217 5377212 -
tgcatctattgagataatcatg

SEQ ID NO: 116652 - DNA, 22 bp, Artificial Sequence
  Synthetic oligonucleotide; CTG chr11 5377210 5377231 5377215 5377210 -
catctattgagataatcatgtg

SEQ ID NO: 116653 - DNA, 22 bp, Artificial Sequence
  Synthetic oligonucleotide; CTA chr11 5377204 5377225 5377209 5377204 -
ttgagataatcatgtggttttt

SEQ ID NO: 116654 - DNA, 22 bp, Artificial Sequence
  Synthetic oligonucleotide; TTG chr11 5377201 5377222 5377206 5377201 -
agataatcatgtggtttttgtc

SEQ ID NO: 116655 - DNA, 22 bp, Artificial Sequence
  Synthetic oligonucleotide; TTT chr11 5377184 5377205 5377189 5377184 -
ttgtctttggttctgtttatat

SEQ ID NO: 116656 - DNA, 22 bp, Artificial Sequence
  Synthetic oligonucleotide; TTT chr11 5377183 5377204 5377188 5377183 -
tgtctttggttctgtttatatg

SEQ ID NO: 116657 - DNA, 22 bp, Artificial Sequence
  Synthetic oligonucleotide; TTT chr11 5377182 5377203 5377187 5377182 -
gtctttggttctgtttatatgc

SEQ ID NO: 116658 - DNA, 22 bp, Artificial Sequence
  Synthetic oligonucleotide; TTG chr11 5377181 5377202 5377186 5377181 -
tctttggttctgtttatatgct

SEQ ID NO: 116659 - DNA, 22 bp, Artificial Sequence
  Synthetic oligonucleotide; CTT chr11 5377177 5377198 5377182 5377177 -
tggttctgtttatatgctggat

SEQ ID NO: 116660 - DNA, 22 bp, Artificial Sequence
  Synthetic oligonucleotide; TTT chr11 5377176 5377197 5377181 5377176 -
ggttctgtttatatgctggatt

SEQ ID NO: 116661 - DNA, 22 bp, Artificial Sequence
  Synthetic oligonucleotide; TTG chr11 5377175 5377196 5377180 5377175 -
gttctgtttatatgctggatta

SEQ ID NO: 116662 - DNA, 22 bp, Artificial Sequence
  Synthetic oligonucleotide; TTC chr11 5377171 5377192 5377176 5377171 -
tgtttatatgctggattacatt

SEQ ID NO: 116663 - DNA, 22 bp, Artificial Sequence
  Synthetic oligonucleotide; CTG chr11 5377169 5377190 5377174 5377169 -
tttatatgctggattacattta

SEQ ID NO: 116664 - DNA, 22 bp, Artificial Sequence
  Synthetic oligonucleotide; TTT chr11 5377166 5377187 5377171 5377166 -
atatgctggattacatttattg

SEQ ID NO: 116665 - DNA, 22 bp, Artificial Sequence
  Synthetic oligonucleotide; TTA chr11 5377165 5377186 5377170 5377165 -
tatgctggattacatttattga

SEQ ID NO: 116666 - DNA, 22 bp, Artificial Sequence
  Synthetic oligonucleotide; CTG chr11 5377158 5377179 5377163 5377158 -
gattacatttattgatttgcat

SEQ ID NO: 116667 - DNA, 22 bp, Artificial Sequence
  Synthetic oligonucleotide; TTA chr11 5377153 5377174 5377158 5377153 -
catttattgatttgcatatatt

SEQ ID NO: 116668 - DNA, 22 bp, Artificial Sequence
  Synthetic oligonucleotide; TTT chr11 5377148 5377169 5377153 5377148 -
attgatttgcatatattgaacc

SEQ ID NO: 116669 - DNA, 22 bp, Artificial Sequence
  Synthetic oligonucleotide; TTA chr11 5377147 5377168 5377152 5377147 -
ttgatttgcatatattgaacca

SEQ ID NO: 116670 - DNA, 22 bp, Artificial Sequence
  Synthetic oligonucleotide; TTG chr11 5377144 5377165 5377149 5377144 -
atttgcatatattgaaccagcc

SEQ ID NO: 116671 - DNA, 22 bp, Artificial Sequence
  Synthetic oligonucleotide; TTT chr11 5377140 5377161 5377145 5377140 -
gcatatattgaaccagccttgc

SEQ ID NO: 116672 - DNA, 22 bp, Artificial Sequence
  Synthetic oligonucleotide; TTG chr11 5377139 5377160 5377144 5377139 -
catatattgaaccagccttgca

SEQ ID NO: 116673 - DNA, 22 bp, Artificial Sequence
  Synthetic oligonucleotide; TTG chr11 5377130 5377151 5377135 5377130 -
aaccagccttgcatcccaggga

SEQ ID NO: 116674 - DNA, 22 bp, Artificial Sequence
  Synthetic oligonucleotide; CTT chr11 5377120 5377141 5377125 5377120 -
gcatcccagggatgaagtccac

SEQ ID NO: 116675 - DNA, 22 bp, Artificial Sequence
  Synthetic oligonucleotide; TTG chr11 5377119 5377140 5377124 5377119 -
catcccagggatgaagtccact

SEQ ID NO: 116676 - DNA, 22 bp, Artificial Sequence
  Synthetic oligonucleotide; CTT chr11 5377096 5377117 5377101 5377096 -
gatcatcgtggataagcttttt

SEQ ID NO: 116677 - DNA, 22 bp, Artificial Sequence
  Synthetic oligonucleotide; TTG chr11 5377095 5377116 5377100 5377095 -
atcatcgtggataagctttttg

SEQ ID NO: 116678 - DNA, 22 bp, Artificial Sequence
  Synthetic oligonucleotide; CTT chr11 5377077 5377098 5377082 5377077 -
tttgatgtgctgctggattcgg

SEQ ID NO: 116679 - DNA, 22 bp, Artificial Sequence
  Synthetic oligonucleotide; TTT chr11 5377076 5377097 5377081 5377076 -
ttgatgtgctgctggattcggt

SEQ ID NO: 116680 - DNA, 22 bp, Artificial Sequence
  Synthetic oligonucleotide; TTT chr11 5377075 5377096 5377080 5377075 -
tgatgtgctgctggattcggtt

SEQ ID NO: 116681 - DNA, 22 bp, Artificial Sequence
  Synthetic oligonucleotide; TTT chr11 5377074 5377095 5377079 5377074 -
gatgtgctgctggattcggttt

SEQ ID NO: 116682 - DNA, 22 bp, Artificial Sequence
  Synthetic oligonucleotide; TTG chr11 5377073 5377094 5377078 5377073 -
atgtgctgctggattcggtttg

SEQ ID NO: 116683 - DNA, 22 bp, Artificial Sequence
  Synthetic oligonucleotide; CTG chr11 5377065 5377086 5377070 5377065 -
ctggattcggtttgccagtatt

SEQ ID NO: 116684 - DNA, 22 bp, Artificial Sequence
  Synthetic oligonucleotide; CTG chr11 5377062 5377083 5377067 5377062 -
gattcggtttgccagtatttta

SEQ ID NO: 116685 - DNA, 22 bp, Artificial Sequence
  Synthetic oligonucleotide; TTC chr11 5377057 5377078 5377062 5377057 -
ggtttgccagtattttattgag

SEQ ID NO: 116686 - DNA, 22 bp, Artificial Sequence
  Synthetic oligonucleotide; TTT chr11 5377052 5377073 5377057 5377052 -
gccagtattttattgaggattt

SEQ ID NO: 116687 - DNA, 22 bp, Artificial Sequence
  Synthetic oligonucleotide; TTG chr11 5377051 5377072 5377056 5377051 -
ccagtattttattgaggatttt

SEQ ID NO: 116688 - DNA, 22 bp, Artificial Sequence
  Synthetic oligonucleotide; TTT chr11 5377042 5377063 5377047 5377042 -
tattgaggatttttgcatcgat

SEQ ID NO: 116689 - DNA, 22 bp, Artificial Sequence
  Synthetic oligonucleotide; TTT chr11 5377041 5377062 5377046 5377041 -
attgaggatttttgcatcgatg

SEQ ID NO: 116690 - DNA, 22 bp, Artificial Sequence
  Synthetic oligonucleotide; TTA chr11 5377040 5377061 5377045 5377040 -
ttgaggatttttgcatcgatgt

SEQ ID NO: 116691 - DNA, 22 bp, Artificial Sequence
  Synthetic oligonucleotide; TTG chr11 5377037 5377058 5377042 5377037 -
aggatttttgcatcgatgttca

SEQ ID NO: 116692 - DNA, 22 bp, Artificial Sequence
  Synthetic oligonucleotide; TTT chr11 5377030 5377051 5377035 5377030 -
ttgcatcgatgttcatcaggga

SEQ ID NO: 116693 - DNA, 22 bp, Artificial Sequence
  Synthetic oligonucleotide; TTT chr11 5377029 5377050 5377034 5377029 -
tgcatcgatgttcatcagggat

SEQ ID NO: 116694 - DNA, 22 bp, Artificial Sequence
  Synthetic oligonucleotide; TTT chr11 5377028 5377049 5377033 5377028 -
gcatcgatgttcatcagggata

SEQ ID NO: 116695 - DNA, 22 bp, Artificial Sequence
  Synthetic oligonucleotide; TTG chr11 5377027 5377048 5377032 5377027 -
catcgatgttcatcagggatat

SEQ ID NO: 116696 - DNA, 22 bp, Artificial Sequence
  Synthetic oligonucleotide; TTC chr11 5377016 5377037 5377021 5377016 -
atcagggatattcatctaaaat

SEQ ID NO: 116697 - DNA, 22 bp, Artificial Sequence
  Synthetic oligonucleotide; TTC chr11 5377003 5377024 5377008 5377003 -
atctaaaattctcttttttggt

SEQ ID NO: 116698 - DNA, 22 bp, Artificial Sequence
  Synthetic oligonucleotide; CTA chr11 5376998 5377019 5377003 5376998 -
aaattctcttttttggttgtgt

SEQ ID NO: 116699 - DNA, 22 bp, Artificial Sequence
  Synthetic oligonucleotide; TTC chr11 5376992 5377013 5376997 5376992 -
tcttttttggttgtgtctcttt

SEQ ID NO: 116700 - DNA, 22 bp, Artificial Sequence
  Synthetic oligonucleotide; CTC chr11 5376990 5377011 5376995 5376990 -
ttttttggttgtgtctctttct

SEQ ID NO: 116701 - DNA, 22 bp, Artificial Sequence
  Synthetic oligonucleotide; CTT chr11 5376988 5377009 5376993 5376988 -
ttttggttgtgtctctttctgg

SEQ ID NO: 116702 - DNA, 22 bp, Artificial Sequence
  Synthetic oligonucleotide; TTT chr11 5376987 5377008 5376992 5376987 -
tttggttgtgtctctttctggc

SEQ ID NO: 116703 - DNA, 22 bp, Artificial Sequence
  Synthetic oligonucleotide; TTT chr11 5376986 5377007 5376991 5376986 -
ttggttgtgtctctttctggct

SEQ ID NO: 116704 - DNA, 22 bp, Artificial Sequence
  Synthetic oligonucleotide; TTT chr11 5376985 5377006 5376990 5376985 -
tggttgtgtctctttctggctt

SEQ ID NO: 116705 - DNA, 22 bp, Artificial Sequence
  Synthetic oligonucleotide; TTT chr11 5376984 5377005 5376989 5376984 -
ggttgtgtctctttctggcttt

SEQ ID NO: 116706 - DNA, 22 bp, Artificial Sequence
  Synthetic oligonucleotide; TTG chr11 5376983 5377004 5376988 5376983 -
gttgtgtctctttctggctttg

SEQ ID NO: 116707 - DNA, 22 bp, Artificial Sequence
  Synthetic oligonucleotide; TTG chr11 5376979 5377000 5376984 5376979 -
tgtctctttctggctttggtat

SEQ ID NO: 116708 - DNA, 22 bp, Artificial Sequence
  Synthetic oligonucleotide; CTC chr11 5376973 5376994 5376978 5376973 -
tttctggctttggtattaggat

SEQ ID NO: 116709 - DNA, 22 bp, Artificial Sequence
  Synthetic oligonucleotide; CTT chr11 5376971 5376992 5376976 5376971 -
tctggctttggtattaggatga

SEQ ID NO: 116710 - DNA, 22 bp, Artificial Sequence
  Synthetic oligonucleotide; TTT chr11 5376970 5376991 5376975 5376970 -
ctggctttggtattaggatgat

SEQ ID NO: 116711 - DNA, 22 bp, Artificial Sequence
  Synthetic oligonucleotide; TTC chr11 5376969 5376990 5376974 5376969 -
tggctttggtattaggatgatg

SEQ ID NO: 116712 - DNA, 22 bp, Artificial Sequence
  Synthetic oligonucleotide; CTG chr11 5376967 5376988 5376972 5376967 -
gctttggtattaggatgatgct

SEQ ID NO: 116713 - DNA, 22 bp, Artificial Sequence
  Synthetic oligonucleotide; CTT chr11 5376963 5376984 5376968 5376963 -
tggtattaggatgatgctggcc

SEQ ID NO: 116714 - DNA, 22 bp, Artificial Sequence
  Synthetic oligonucleotide; TTT chr11 5376962 5376983 5376967 5376962 -
ggtattaggatgatgctggcct

SEQ ID NO: 116715 - DNA, 22 bp, Artificial Sequence
  Synthetic oligonucleotide; TTG chr11 5376961 5376982 5376966 5376961 -
gtattaggatgatgctggcctc

SEQ ID NO: 116716 - DNA, 22 bp, Artificial Sequence
  Synthetic oligonucleotide; TTA chr11 5376955 5376976 5376960 5376955 -
ggatgatgctggcctcataaaa

SEQ ID NO: 116717 - DNA, 22 bp, Artificial Sequence
  Synthetic oligonucleotide; CTG chr11 5376944 5376965 5376949 5376944 -
gcctcataaaatgagttaggga

SEQ ID NO: 116718 - DNA, 22 bp, Artificial Sequence
  Synthetic oligonucleotide; CTC chr11 5376939 5376960 5376944 5376939 -
ataaaatgagttagggaggatt

SEQ ID NO: 116719 - DNA, 22 bp, Artificial Sequence
  Synthetic oligonucleotide; TTA chr11 5376926 5376947 5376931 5376926 -
gggaggattccttctttttctg

SEQ ID NO: 116720 - DNA, 22 bp, Artificial Sequence
  Synthetic oligonucleotide; TTC chr11 5376916 5376937 5376921 5376916 -
cttctttttctgttgattggaa

SEQ ID NO: 116721 - DNA, 22 bp, Artificial Sequence
  Synthetic oligonucleotide; CTT chr11 5376913 5376934 5376918 5376913 -
ctttttctgttgattggaatag

SEQ ID NO: 116722 - DNA, 22 bp, Artificial Sequence
  Synthetic oligonucleotide; TTC chr11 5376912 5376933 5376917 5376912 -
tttttctgttgattggaatagt

SEQ ID NO: 116723 - DNA, 22 bp, Artificial Sequence
  Synthetic oligonucleotide; CTT chr11 5376910 5376931 5376915 5376910 -
tttctgttgattggaatagttt

SEQ ID NO: 116724 - DNA, 22 bp, Artificial Sequence
  Synthetic oligonucleotide; TTT chr11 5376909 5376930 5376914 5376909 -
ttctgttgattggaatagtttc

SEQ ID NO: 116725 - DNA, 22 bp, Artificial Sequence
  Synthetic oligonucleotide; TTT chr11 5376908 5376929 5376913 5376908 -
tctgttgattggaatagtttca

SEQ ID NO: 116726 - DNA, 22 bp, Artificial Sequence
  Synthetic oligonucleotide; TTT chr11 5376907 5376928 5376912 5376907 -
ctgttgattggaatagtttcag

SEQ ID NO: 116727 - DNA, 22 bp, Artificial Sequence
  Synthetic oligonucleotide; TTC chr11 5376906 5376927 5376911 5376906 -
tgttgattggaatagtttcaga

SEQ ID NO: 116728 - DNA, 22 bp, Artificial Sequence
  Synthetic oligonucleotide; CTG chr11 5376904 5376925 5376909 5376904 -
ttgattggaatagtttcagaag

SEQ ID NO: 116729 - DNA, 22 bp, Artificial Sequence
  Synthetic oligonucleotide; TTG chr11 5376901 5376922 5376906 5376901 -
attggaatagtttcagaaggaa

SEQ ID NO: 116730 - DNA, 22 bp, Artificial Sequence
  Synthetic oligonucleotide; TTG chr11 5376897 5376918 5376902 5376897 -
gaatagtttcagaaggaatggt

SEQ ID NO: 116731 - DNA, 22 bp, Artificial Sequence
  Synthetic oligonucleotide; TTT chr11 5376888 5376909 5376893 5376888 -
cagaaggaatggtaccaattcc

SEQ ID NO: 116732 - DNA, 22 bp, Artificial Sequence
  Synthetic oligonucleotide; TTC chr11 5376887 5376908 5376892 5376887 -
agaaggaatggtaccaattcct

SEQ ID NO: 116733 - DNA, 22 bp, Artificial Sequence
  Synthetic oligonucleotide; TTC chr11 5376867 5376888 5376872 5376867 -
ctccttgtacctctgttagaat

SEQ ID NO: 116734 - DNA, 22 bp, Artificial Sequence
  Synthetic oligonucleotide; CTC chr11 5376864 5376885 5376869 5376864 -
cttgtacctctgttagaatttg

SEQ ID NO: 116735 - DNA, 22 bp, Artificial Sequence
  Synthetic oligonucleotide; CTT chr11 5376861 5376882 5376866 5376861 -
gtacctctgttagaatttggct

SEQ ID NO: 116736 - DNA, 22 bp, Artificial Sequence
  Synthetic oligonucleotide; TTG chr11 5376860 5376881 5376865 5376860 -
tacctctgttagaatttggctg

SEQ ID NO: 116737 - DNA, 22 bp, Artificial Sequence
  Synthetic oligonucleotide; CTC chr11 5376854 5376875 5376859 5376854 -
tgttagaatttggctgtgaatc

SEQ ID NO: 116738 - DNA, 22 bp, Artificial Sequence
  Synthetic oligonucleotide; CTG chr11 5376852 5376873 5376857 5376852 -
ttagaatttggctgtgaatcca

SEQ ID NO: 116739 - DNA, 22 bp, Artificial Sequence
  Synthetic oligonucleotide; TTA chr11 5376849 5376870 5376854 5376849 -
gaatttggctgtgaatccatct

SEQ ID NO: 116740 - DNA, 22 bp, Artificial Sequence
  Synthetic oligonucleotide; TTT chr11 5376843 5376864 5376848 5376843 -
ggctgtgaatccatctggtcct

SEQ ID NO: 116741 - DNA, 22 bp, Artificial Sequence
  Synthetic oligonucleotide; TTG chr11 5376842 5376863 5376847 5376842 -
gctgtgaatccatctggtcctg

SEQ ID NO: 116742 - DNA, 22 bp, Artificial Sequence
  Synthetic oligonucleotide; CTG chr11 5376838 5376859 5376843 5376838 -
tgaatccatctggtcctggact

SEQ ID NO: 116743 - DNA, 22 bp, Artificial Sequence
  Synthetic oligonucleotide; CTG chr11 5376826 5376847 5376831 5376826 -
gtcctggactctttttggttgg

SEQ ID NO: 116744 - DNA, 22 bp, Artificial Sequence
  Synthetic oligonucleotide; CTG chr11 5376820 5376841 5376825 5376820 -
gactctttttggttggtaagct

SEQ ID NO: 116745 - DNA, 22 bp, Artificial Sequence
  Synthetic oligonucleotide; CTC chr11 5376815 5376836 5376820 5376815 -
tttttggttggtaagctattga

SEQ ID NO: 116746 - DNA, 22 bp, Artificial Sequence
  Synthetic oligonucleotide; CTT chr11 5376813 5376834 5376818 5376813 -
tttggttggtaagctattgatt

SEQ ID NO: 116747 - DNA, 22 bp, Artificial Sequence
  Synthetic oligonucleotide; TTT chr11 5376812 5376833 5376817 5376812 -
ttggttggtaagctattgatta

SEQ ID NO: 116748 - DNA, 22 bp, Artificial Sequence
  Synthetic oligonucleotide; TTT chr11 5376811 5376832 5376816 5376811 -
tggttggtaagctattgattat

SEQ ID NO: 116749 - DNA, 22 bp, Artificial Sequence
  Synthetic oligonucleotide; TTT chr11 5376810 5376831 5376815 5376810 -
ggttggtaagctattgattatt

SEQ ID NO: 116750 - DNA, 22 bp, Artificial Sequence
  Synthetic oligonucleotide; TTG chr11 5376809 5376830 5376814 5376809 -
gttggtaagctattgattattg

SEQ ID NO: 116751 - DNA, 22 bp, Artificial Sequence
  Synthetic oligonucleotide; TTG chr11 5376805 5376826 5376810 5376805 -
gtaagctattgattattgccac

SEQ ID NO: 116752 - DNA, 22 bp, Artificial Sequence
  Synthetic oligonucleotide; CTA chr11 5376797 5376818 5376802 5376797 -
ttgattattgccacaatttcag

SEQ ID NO: 116753 - DNA, 22 bp, Artificial Sequence
  Synthetic oligonucleotide; TTG chr11 5376794 5376815 5376799 5376794 -
attattgccacaatttcagatc

SEQ ID NO: 116754 - DNA, 22 bp, Artificial Sequence
  Synthetic oligonucleotide; TTA chr11 5376790 5376811 5376795 5376790 -
ttgccacaatttcagatcctgt

SEQ ID NO: 116755 - DNA, 22 bp, Artificial Sequence
  Synthetic oligonucleotide; TTG chr11 5376787 5376808 5376792 5376787 -
ccacaatttcagatcctgttat

SEQ ID NO: 116756 - DNA, 22 bp, Artificial Sequence
  Synthetic oligonucleotide; TTT chr11 5376778 5376799 5376783 5376778 -
cagatcctgttattggtctatt

SEQ ID NO: 116757 - DNA, 22 bp, Artificial Sequence
  Synthetic oligonucleotide; TTC chr11 5376777 5376798 5376782 5376777 -
agatcctgttattggtctattc

SEQ ID NO: 116758 - DNA, 22 bp, Artificial Sequence
  Synthetic oligonucleotide; CTG chr11 5376769 5376790 5376774 5376769 -
ttattggtctattcagagattc

SEQ ID NO: 116759 - DNA, 22 bp, Artificial Sequence
  Synthetic oligonucleotide; TTA chr11 5376766 5376787 5376771 5376766 -
ttggtctattcagagattcaac

SEQ ID NO: 116760 - DNA, 22 bp, Artificial Sequence
  Synthetic oligonucleotide; TTG chr11 5376763 5376784 5376768 5376763 -
gtctattcagagattcaacttc

SEQ ID NO: 116761 - DNA, 22 bp, Artificial Sequence
  Synthetic oligonucleotide; CTA chr11 5376758 5376779 5376763 5376758 -
ttcagagattcaacttcttcct

SEQ ID NO: 116762 - DNA, 22 bp, Artificial Sequence
  Synthetic oligonucleotide; TTC chr11 5376755 5376776 5376760 5376755 -
agagattcaacttcttcctggt

SEQ ID NO: 116763 - DNA, 22 bp, Artificial Sequence
  Synthetic oligonucleotide; TTC chr11 5376747 5376768 5376752 5376747 -
aacttcttcctggtttagtctt

SEQ ID NO: 116764 - DNA, 22 bp, Artificial Sequence
  Synthetic oligonucleotide; CTT chr11 5376742 5376763 5376747 5376742 -
cttcctggtttagtcttgggat

SEQ ID NO: 116765 - DNA, 22 bp, Artificial Sequence
  Synthetic oligonucleotide; TTC chr11 5376741 5376762 5376746 5376741 -
ttcctggtttagtcttgggata

SEQ ID NO: 116766 - DNA, 22 bp, Artificial Sequence
  Synthetic oligonucleotide; CTT chr11 5376739 5376760 5376744 5376739 -
cctggtttagtcttgggatagt

SEQ ID NO: 116767 - DNA, 22 bp, Artificial Sequence
  Synthetic oligonucleotide; TTC chr11 5376738 5376759 5376743 5376738 -
ctggtttagtcttgggatagtg

SEQ ID NO: 116768 - DNA, 22 bp, Artificial Sequence
  Synthetic oligonucleotide; CTG chr11 5376735 5376756 5376740 5376735 -
gtttagtcttgggatagtgtat

SEQ ID NO: 116769 - DNA, 22 bp, Artificial Sequence
  Synthetic oligonucleotide; TTT chr11 5376731 5376752 5376736 5376731 -
agtcttgggatagtgtatgtgt

SEQ ID NO: 116770 - DNA, 22 bp, Artificial Sequence
  Synthetic oligonucleotide; TTA chr11 5376730 5376751 5376735 5376730 -
gtcttgggatagtgtatgtgtc

SEQ ID NO: 116771 - DNA, 22 bp, Artificial Sequence
  Synthetic oligonucleotide; CTT chr11 5376725 5376746 5376730 5376725 -
gggatagtgtatgtgtccagga

SEQ ID NO: 116772 - DNA, 22 bp, Artificial Sequence
  Synthetic oligonucleotide; TTG chr11 5376724 5376745 5376729 5376724 -
ggatagtgtatgtgtccaggaa

SEQ ID NO: 116773 - DNA, 22 bp, Artificial Sequence
  Synthetic oligonucleotide; TTT chr11 5376699 5376720 5376704 5376699 -
atccatttcttctagattttct

SEQ ID NO: 116774 - DNA, 22 bp, Artificial Sequence
  Synthetic oligonucleotide; TTA chr11 5376698 5376719 5376703 5376698 -
tccatttcttctagattttcta

SEQ ID NO: 116775 - DNA, 22 bp, Artificial Sequence
  Synthetic oligonucleotide; TTT chr11 5376691 5376712 5376696 5376691 -
cttctagattttctagtttatt

SEQ ID NO: 116776 - DNA, 22 bp, Artificial Sequence
  Synthetic oligonucleotide; TTC chr11 5376690 5376711 5376695 5376690 -
ttctagattttctagtttattt

SEQ ID NO: 116777 - DNA, 22 bp, Artificial Sequence
  Synthetic oligonucleotide; CTT chr11 5376688 5376709 5376693 5376688 -
ctagattttctagtttatttgc

SEQ ID NO: 116778 - DNA, 22 bp, Artificial Sequence
  Synthetic oligonucleotide; TTC chr11 5376687 5376708 5376692 5376687 -
tagattttctagtttatttgcg

SEQ ID NO: 116779 - DNA, 22 bp, Artificial Sequence
  Synthetic oligonucleotide; CTA chr11 5376685 5376706 5376690 5376685 -
gattttctagtttatttgcgta

SEQ ID NO: 116780 - DNA, 22 bp, Artificial Sequence
  Synthetic oligonucleotide; TTT chr11 5376680 5376701 5376685 5376680 -
tctagtttatttgcgtagaggt

SEQ ID NO: 116781 - DNA, 22 bp, Artificial Sequence
  Synthetic oligonucleotide; TTT chr11 5376679 5376700 5376684 5376679 -
ctagtttatttgcgtagaggtg

SEQ ID NO: 116782 - DNA, 22 bp, Artificial Sequence
  Synthetic oligonucleotide; TTC chr11 5376678 5376699 5376683 5376678 -
tagtttatttgcgtagaggtgt

SEQ ID NO: 116783 - DNA, 22 bp, Artificial Sequence
  Synthetic oligonucleotide; CTA chr11 5376676 5376697 5376681 5376676 -
gtttatttgcgtagaggtgttt

SEQ ID NO: 116784 - DNA, 22 bp, Artificial Sequence
  Synthetic oligonucleotide; TTT chr11 5376672 5376693 5376677 5376672 -
atttgcgtagaggtgtttgtag

SEQ ID NO: 116785 - DNA, 22 bp, Artificial Sequence
  Synthetic oligonucleotide; TTA chr11 5376671 5376692 5376676 5376671 -
tttgcgtagaggtgtttgtagt

SEQ ID NO: 116786 - DNA, 22 bp, Artificial Sequence
  Synthetic oligonucleotide; TTT chr11 5376668 5376689 5376673 5376668 -
gcgtagaggtgtttgtagtatt

SEQ ID NO: 116787 - DNA, 22 bp, Artificial Sequence
  Synthetic oligonucleotide; TTG chr11 5376667 5376688 5376672 5376667 -
cgtagaggtgtttgtagtattc

SEQ ID NO: 116788 - DNA, 22 bp, Artificial Sequence
  Synthetic oligonucleotide; TTT chr11 5376654 5376675 5376659 5376654 -
gtagtattctctgatggcagtt

SEQ ID NO: 116789 - DNA, 22 bp, Artificial Sequence
  Synthetic oligonucleotide; TTG chr11 5376653 5376674 5376658 5376653 -
tagtattctctgatggcagttt

SEQ ID NO: 116790 - DNA, 22 bp, Artificial Sequence
  Synthetic oligonucleotide; TTC chr11 5376645 5376666 5376650 5376645 -
tctgatggcagtttgtatttct

SEQ ID NO: 116791 - DNA, 22 bp, Artificial Sequence
  Synthetic oligonucleotide; CTC chr11 5376643 5376664 5376648 5376643 -
tgatggcagtttgtatttctgt

SEQ ID NO: 116792 - DNA, 22 bp, Artificial Sequence
  Synthetic oligonucleotide; CTG chr11 5376641 5376662 5376646 5376641 -
atggcagtttgtatttctgtgg

SEQ ID NO: 116793 - DNA, 22 bp, Artificial Sequence
  Synthetic oligonucleotide; TTT chr11 5376631 5376652 5376636 5376631 -
gtatttctgtgggatcggtggt

SEQ ID NO: 116794 - DNA, 22 bp, Artificial Sequence
  Synthetic oligonucleotide; TTG chr11 5376630 5376651 5376635 5376630 -
tatttctgtgggatcggtggtg

SEQ ID NO: 116795 - DNA, 22 bp, Artificial Sequence
  Synthetic oligonucleotide; TTT chr11 5376625 5376646 5376630 5376625 -
ctgtgggatcggtggtgatatc

SEQ ID NO: 116796 - DNA, 22 bp, Artificial Sequence
  Synthetic oligonucleotide; TTC chr11 5376624 5376645 5376629 5376624 -
tgtgggatcggtggtgatatcc

SEQ ID NO: 116797 - DNA, 22 bp, Artificial Sequence
  Synthetic oligonucleotide; CTG chr11 5376622 5376643 5376627 5376622 -
tgggatcggtggtgatatcccc

SEQ ID NO: 116798 - DNA, 22 bp, Artificial Sequence
  Synthetic oligonucleotide; CTT chr11 5376598 5376619 5376603 5376598 -
tatcatttttttattgtgtcta

SEQ ID NO: 116799 - DNA, 22 bp, Artificial Sequence
  Synthetic oligonucleotide; TTT chr11 5376597 5376618 5376602 5376597 -
atcatttttttattgtgtctat

SEQ ID NO: 116800 - DNA, 22 bp, Artificial Sequence
  Synthetic oligonucleotide; TTA chr11 5376596 5376617 5376601 5376596 -
tcatttttttattgtgtctatt

SEQ ID NO: 116801 - DNA, 22 bp, Artificial Sequence
  Synthetic oligonucleotide; TTT chr11 5376590 5376611 5376595 5376590 -
ttttattgtgtctatttgattc

SEQ ID NO: 116802 - DNA, 22 bp, Artificial Sequence
  Synthetic oligonucleotide; TTT chr11 5376589 5376610 5376594 5376589 -
tttattgtgtctatttgattct

SEQ ID NO: 116803 - DNA, 22 bp, Artificial Sequence
  Synthetic oligonucleotide; TTT chr11 5376588 5376609 5376593 5376588 -
ttattgtgtctatttgattctt

SEQ ID NO: 116804 - DNA, 22 bp, Artificial Sequence
  Synthetic oligonucleotide; TTT chr11 5376587 5376608 5376592 5376587 -
tattgtgtctatttgattcttc

SEQ ID NO: 116805 - DNA, 22 bp, Artificial Sequence
  Synthetic oligonucleotide; TTT chr11 5376586 5376607 5376591 5376586 -
attgtgtctatttgattcttct

SEQ ID NO: 116806 - DNA, 22 bp, Artificial Sequence
  Synthetic oligonucleotide; TTA chr11 5376585 5376606 5376590 5376585 -
ttgtgtctatttgattcttctc

SEQ ID NO: 116807 - DNA, 22 bp, Artificial Sequence
  Synthetic oligonucleotide; TTG chr11 5376582 5376603 5376587 5376582 -
tgtctatttgattcttctctct

SEQ ID NO: 116808 - DNA, 22 bp, Artificial Sequence
  Synthetic oligonucleotide; CTA chr11 5376576 5376597 5376581 5376576 -
tttgattcttctctcttttctt

SEQ ID NO: 116809 - DNA, 22 bp, Artificial Sequence
  Synthetic oligonucleotide; TTT chr11 5376573 5376594 5376578 5376573 -
gattcttctctcttttcttatt

SEQ ID NO: 116810 - DNA, 22 bp, Artificial Sequence
  Synthetic oligonucleotide; TTG chr11 5376572 5376593 5376577 5376572 -
attcttctctcttttcttatta

SEQ ID NO: 116811 - DNA, 22 bp, Artificial Sequence
  Synthetic oligonucleotide; TTC chr11 5376568 5376589 5376573 5376568 -
ttctctcttttcttattagtct

SEQ ID NO: 116812 - DNA, 22 bp, Artificial Sequence
  Synthetic oligonucleotide; CTT chr11 5376566 5376587 5376571 5376566 -
ctctcttttcttattagtcttg

SEQ ID NO: 116813 - DNA, 22 bp, Artificial Sequence
  Synthetic oligonucleotide; TTC chr11 5376565 5376586 5376570 5376565 -
tctcttttcttattagtcttgc

SEQ ID NO: 116814 - DNA, 22 bp, Artificial Sequence
  Synthetic oligonucleotide; CTC chr11 5376563 5376584 5376568 5376563 -
tcttttcttattagtcttgcta

SEQ ID NO: 116815 - DNA, 22 bp, Artificial Sequence
  Synthetic oligonucleotide; CTC chr11 5376561 5376582 5376566 5376561 -
ttttcttattagtcttgctagc

SEQ ID NO: 116816 - DNA, 22 bp, Artificial Sequence
  Synthetic oligonucleotide; CTT chr11 5376559 5376580 5376564 5376559 -
ttcttattagtcttgctagcgg

SEQ ID NO: 116817 - DNA, 22 bp, Artificial Sequence
  Synthetic oligonucleotide; TTT chr11 5376558 5376579 5376563 5376558 -
tcttattagtcttgctagcggt

SEQ ID NO: 116818 - DNA, 22 bp, Artificial Sequence
  Synthetic oligonucleotide; TTT chr11 5376557 5376578 5376562 5376557 -
cttattagtcttgctagcggtc

SEQ ID NO: 116819 - DNA, 22 bp, Artificial Sequence
  Synthetic oligonucleotide; TTC chr11 5376556 5376577 5376561 5376556 -
ttattagtcttgctagcggtct

SEQ ID NO: 116820 - DNA, 22 bp, Artificial Sequence
  Synthetic oligonucleotide; CTT chr11 5376554 5376575 5376559 5376554 -
attagtcttgctagcggtctat

SEQ ID NO: 116821 - DNA, 22 bp, Artificial Sequence
  Synthetic oligonucleotide; TTA chr11 5376553 5376574 5376558 5376553 -
ttagtcttgctagcggtctatc

SEQ ID NO: 116822 - DNA, 22 bp, Artificial Sequence
  Synthetic oligonucleotide; TTA chr11 5376550 5376571 5376555 5376550 -
gtcttgctagcggtctatcagt

SEQ ID NO: 116823 - DNA, 22 bp, Artificial Sequence
  Synthetic oligonucleotide; CTT chr11 5376545 5376566 5376550 5376545 -
gctagcggtctatcagttttgt

SEQ ID NO: 116824 - DNA, 22 bp, Artificial Sequence
  Synthetic oligonucleotide; TTG chr11 5376544 5376565 5376549 5376544 -
ctagcggtctatcagttttgtt

SEQ ID NO: 116825 - DNA, 22 bp, Artificial Sequence
  Synthetic oligonucleotide; CTA chr11 5376541 5376562 5376546 5376541 -
gcggtctatcagttttgttgat

SEQ ID NO: 116826 - DNA, 22 bp, Artificial Sequence
  Synthetic oligonucleotide; CTA chr11 5376533 5376554 5376538 5376533 -
tcagttttgttgatcctttcaa

SEQ ID NO: 116827 - DNA, 22 bp, Artificial Sequence
  Synthetic oligonucleotide; TTT chr11 5376526 5376547 5376531 5376526 -
tgttgatcctttcaaaaaacca

SEQ ID NO: 116828 - DNA, 22 bp, Artificial Sequence
  Synthetic oligonucleotide; TTT chr11 5376525 5376546 5376530 5376525 -
gttgatcctttcaaaaaaccag

SEQ ID NO: 116829 - DNA, 22 bp, Artificial Sequence
  Synthetic oligonucleotide; TTG chr11 5376524 5376545 5376529 5376524 -
ttgatcctttcaaaaaaccagc

SEQ ID NO: 116830 - DNA, 22 bp, Artificial Sequence
  Synthetic oligonucleotide; TTG chr11 5376521 5376542 5376526 5376521 -
atcctttcaaaaaaccagctcc

SEQ ID NO: 116831 - DNA, 22 bp, Artificial Sequence
  Synthetic oligonucleotide; CTT chr11 5376515 5376536 5376520 5376515 -
tcaaaaaaccagctcccagatt

SEQ ID NO: 116832 - DNA, 22 bp, Artificial Sequence
  Synthetic oligonucleotide; TTT chr11 5376514 5376535 5376519 5376514 -
caaaaaaccagctcccagattc

SEQ ID NO: 116833 - DNA, 22 bp, Artificial Sequence
  Synthetic oligonucleotide; TTC chr11 5376513 5376534 5376518 5376513 -
aaaaaaccagctcccagattca

SEQ ID NO: 116834 - DNA, 22 bp, Artificial Sequence
  Synthetic oligonucleotide; CTC chr11 5376500 5376521 5376505 5376500 -
ccagattcattaattttttgaa

SEQ ID NO: 116835 - DNA, 22 bp, Artificial Sequence
  Synthetic oligonucleotide; TTC chr11 5376492 5376513 5376497 5376492 -
attaattttttgaagggttttt

SEQ ID NO: 116836 - DNA, 22 bp, Artificial Sequence
  Synthetic oligonucleotide; TTA chr11 5376488 5376509 5376493 5376488 -
attttttgaagggttttttgtg

SEQ ID NO: 116837 - DNA, 22 bp, Artificial Sequence
  Synthetic oligonucleotide; TTT chr11 5376484 5376505 5376489 5376484 -
tttgaagggttttttgtgtctc

SEQ ID NO: 116838 - DNA, 22 bp, Artificial Sequence
  Synthetic oligonucleotide; TTT chr11 5376483 5376504 5376488 5376483 -
ttgaagggttttttgtgtctct

SEQ ID NO: 116839 - DNA, 22 bp, Artificial Sequence
  Synthetic oligonucleotide; TTT chr11 5376482 5376503 5376487 5376482 -
tgaagggttttttgtgtctctg

SEQ ID NO: 116840 - DNA, 22 bp, Artificial Sequence
  Synthetic oligonucleotide; TTT chr11 5376481 5376502 5376486 5376481 -
gaagggttttttgtgtctctgt

SEQ ID NO: 116841 - DNA, 22 bp, Artificial Sequence
  Synthetic oligonucleotide; TTG chr11 5376480 5376501 5376485 5376480 -
aagggttttttgtgtctctgtt

SEQ ID NO: 116842 - DNA, 22 bp, Artificial Sequence
  Synthetic oligonucleotide; TTT chr11 5376472 5376493 5376477 5376472 -
tttgtgtctctgtttccttcag

SEQ ID NO: 116843 - DNA, 22 bp, Artificial Sequence
  Synthetic oligonucleotide; TTT chr11 5376471 5376492 5376476 5376471 -
ttgtgtctctgtttccttcagt

SEQ ID NO: 116844 - DNA, 22 bp, Artificial Sequence
  Synthetic oligonucleotide; TTT chr11 5376470 5376491 5376475 5376470 -
tgtgtctctgtttccttcagtt

SEQ ID NO: 116845 - DNA, 22 bp, Artificial Sequence
  Synthetic oligonucleotide; TTT chr11 5376469 5376490 5376474 5376469 -
gtgtctctgtttccttcagttc

SEQ ID NO: 116846 - DNA, 22 bp, Artificial Sequence
  Synthetic oligonucleotide; TTG chr11 5376468 5376489 5376473 5376468 -
tgtctctgtttccttcagttct

SEQ ID NO: 116847 - DNA, 22 bp, Artificial Sequence
  Synthetic oligonucleotide; CTC chr11 5376462 5376483 5376467 5376462 -
tgtttccttcagttctgctctg

SEQ ID NO: 116848 - DNA, 22 bp, Artificial Sequence
  Synthetic oligonucleotide; CTG chr11 5376460 5376481 5376465 5376460 -
tttccttcagttctgctctgat

SEQ ID NO: 116849 - DNA, 22 bp, Artificial Sequence
  Synthetic oligonucleotide; TTT chr11 5376457 5376478 5376462 5376457 -
ccttcagttctgctctgatttt

SEQ ID NO: 116850 - DNA, 22 bp, Artificial Sequence
  Synthetic oligonucleotide; TTC chr11 5376456 5376477 5376461 5376456 -
cttcagttctgctctgatttta

SEQ ID NO: 116851 - DNA, 22 bp, Artificial Sequence
  Synthetic oligonucleotide; CTT chr11 5376453 5376474 5376458 5376453 -
cagttctgctctgattttagtt

SEQ ID NO: 116852 - DNA, 22 bp, Artificial Sequence
  Synthetic oligonucleotide; TTC chr11 5376452 5376473 5376457 5376452 -
agttctgctctgattttagtta

SEQ ID NO: 116853 - DNA, 22 bp, Artificial Sequence
  Synthetic oligonucleotide; TTC chr11 5376447 5376468 5376452 5376447 -
tgctctgattttagttatttct

SEQ ID NO: 116854 - DNA, 22 bp, Artificial Sequence
  Synthetic oligonucleotide; CTG chr11 5376445 5376466 5376450 5376445 -
ctctgattttagttatttcttg

SEQ ID NO: 116855 - DNA, 22 bp, Artificial Sequence
  Synthetic oligonucleotide; CTC chr11 5376442 5376463 5376447 5376442 -
tgattttagttatttcttgact

SEQ ID NO: 116856 - DNA, 22 bp, Artificial Sequence
  Synthetic oligonucleotide; CTG chr11 5376440 5376461 5376445 5376440 -
attttagttatttcttgacttc

SEQ ID NO: 116857 - DNA, 22 bp, Artificial Sequence
  Synthetic oligonucleotide; TTT chr11 5376436 5376457 5376441 5376436 -
tagttatttcttgacttctgct

SEQ ID NO: 116858 - DNA, 22 bp, Artificial Sequence
  Synthetic oligonucleotide; TTT chr11 5376435 5376456 5376440 5376435 -
agttatttcttgacttctgcta

SEQ ID NO: 116859 - DNA, 22 bp, Artificial Sequence
  Synthetic oligonucleotide; TTA chr11 5376434 5376455 5376439 5376434 -
gttatttcttgacttctgctag

SEQ ID NO: 116860 - DNA, 22 bp, Artificial Sequence
  Synthetic oligonucleotide; TTA chr11 5376430 5376451 5376435 5376430 -
tttcttgacttctgctagcttt

SEQ ID NO: 116861 - DNA, 22 bp, Artificial Sequence
  Synthetic oligonucleotide; TTT chr11 5376427 5376448 5376432 5376427 -
cttgacttctgctagcttttga

SEQ ID NO: 116862 - DNA, 22 bp, Artificial Sequence
  Synthetic oligonucleotide; TTC chr11 5376426 5376447 5376431 5376426 -
ttgacttctgctagcttttgaa

SEQ ID NO: 116863 - DNA, 22 bp, Artificial Sequence
  Synthetic oligonucleotide; CTT chr11 5376424 5376445 5376429 5376424 -
gacttctgctagcttttgaatg

SEQ ID NO: 116864 - DNA, 22 bp, Artificial Sequence
  Synthetic oligonucleotide; TTG chr11 5376423 5376444 5376428 5376423 -
acttctgctagcttttgaatgt

SEQ ID NO: 116865 - DNA, 22 bp, Artificial Sequence
  Synthetic oligonucleotide; CTT chr11 5376419 5376440 5376424 5376419 -
ctgctagcttttgaatgtgttt

SEQ ID NO: 116866 - DNA, 22 bp, Artificial Sequence
  Synthetic oligonucleotide; TTC chr11 5376418 5376439 5376423 5376418 -
tgctagcttttgaatgtgtttg

SEQ ID NO: 116867 - DNA, 22 bp, Artificial Sequence
  Synthetic oligonucleotide; CTG chr11 5376416 5376437 5376421 5376416 -
ctagcttttgaatgtgtttgct

SEQ ID NO: 116868 - DNA, 22 bp, Artificial Sequence
  Synthetic oligonucleotide; CTA chr11 5376413 5376434 5376418 5376413 -
gcttttgaatgtgtttgctctt

SEQ ID NO: 116869 - DNA, 22 bp, Artificial Sequence
  Synthetic oligonucleotide; CTT chr11 5376409 5376430 5376414 5376409 -
ttgaatgtgtttgctcttgctt

SEQ ID NO: 116870 - DNA, 22 bp, Artificial Sequence
  Synthetic oligonucleotide; TTT chr11 5376408 5376429 5376413 5376408 -
tgaatgtgtttgctcttgctta

SEQ ID NO: 116871 - DNA, 22 bp, Artificial Sequence
  Synthetic oligonucleotide; TTT chr11 5376407 5376428 5376412 5376407 -
gaatgtgtttgctcttgcttat

SEQ ID NO: 116872 - DNA, 22 bp, Artificial Sequence
  Synthetic oligonucleotide; TTG chr11 5376406 5376427 5376411 5376406 -
aatgtgtttgctcttgcttatc

SEQ ID NO: 116873 - DNA, 22 bp, Artificial Sequence
  Synthetic oligonucleotide; TTT chr11 5376397 5376418 5376402 5376397 -
gctcttgcttatctagttcttt

SEQ ID NO: 116874 - DNA, 22 bp, Artificial Sequence
  Synthetic oligonucleotide; TTG chr11 5376396 5376417 5376401 5376396 -
ctcttgcttatctagttctttt

SEQ ID NO: 116875 - DNA, 22 bp, Artificial Sequence
  Synthetic oligonucleotide; CTC chr11 5376393 5376414 5376398 5376393 -
ttgcttatctagttcttttaat

SEQ ID NO: 116876 - DNA, 22 bp, Artificial Sequence
  Synthetic oligonucleotide; CTT chr11 5376391 5376412 5376396 5376391 -
gcttatctagttcttttaattg

SEQ ID NO: 116877 - DNA, 22 bp, Artificial Sequence
  Synthetic oligonucleotide; TTG chr11 5376390 5376411 5376395 5376390 -
cttatctagttcttttaattgt

SEQ ID NO: 116878 - DNA, 22 bp, Artificial Sequence
  Synthetic oligonucleotide; CTT chr11 5376387 5376408 5376392 5376387 -
atctagttcttttaattgtgat

SEQ ID NO: 116879 - DNA, 22 bp, Artificial Sequence
  Synthetic oligonucleotide; TTA chr11 5376386 5376407 5376391 5376386 -
tctagttcttttaattgtgatg

SEQ ID NO: 116880 - DNA, 22 bp, Artificial Sequence
  Synthetic oligonucleotide; CTA chr11 5376382 5376403 5376387 5376382 -
gttcttttaattgtgatgttag

SEQ ID NO: 116881 - DNA, 22 bp, Artificial Sequence
  Synthetic oligonucleotide; TTC chr11 5376378 5376399 5376383 5376378 -
ttttaattgtgatgttagggtg

SEQ ID NO: 116882 - DNA, 22 bp, Artificial Sequence
  Synthetic oligonucleotide; CTT chr11 5376376 5376397 5376381 5376376 -
ttaattgtgatgttagggtgtc

SEQ ID NO: 116883 - DNA, 22 bp, Artificial Sequence
  Synthetic oligonucleotide; TTT chr11 5376375 5376396 5376380 5376375 -
taattgtgatgttagggtgtca

SEQ ID NO: 116884 - DNA, 22 bp, Artificial Sequence
  Synthetic oligonucleotide; TTT chr11 5376374 5376395 5376379 5376374 -
aattgtgatgttagggtgtcaa

SEQ ID NO: 116885 - DNA, 22 bp, Artificial Sequence
  Synthetic oligonucleotide; TTA chr11 5376373 5376394 5376378 5376373 -
attgtgatgttagggtgtcaat

SEQ ID NO: 116886 - DNA, 22 bp, Artificial Sequence
  Synthetic oligonucleotide; TTG chr11 5376369 5376390 5376374 5376369 -
tgatgttagggtgtcaattttg

SEQ ID NO: 116887 - DNA, 22 bp, Artificial Sequence
  Synthetic oligonucleotide; TTA chr11 5376361 5376382 5376366 5376361 -
gggtgtcaattttggatctttc

SEQ ID NO: 116888 - DNA, 22 bp, Artificial Sequence
  Synthetic oligonucleotide; TTT chr11 5376349 5376370 5376354 5376349 -
tggatctttcttgctttctctt

SEQ ID NO: 116889 - DNA, 22 bp, Artificial Sequence
  Synthetic oligonucleotide; TTT chr11 5376348 5376369 5376353 5376348 -
ggatctttcttgctttctcttg

SEQ ID NO: 116890 - DNA, 22 bp, Artificial Sequence
  Synthetic oligonucleotide; TTG chr11 5376347 5376368 5376352 5376347 -
gatctttcttgctttctcttgt

SEQ ID NO: 116891 - DNA, 22 bp, Artificial Sequence
  Synthetic oligonucleotide; CTT chr11 5376341 5376362 5376346 5376341 -
tcttgctttctcttgtgggcgt

SEQ ID NO: 116892 - DNA, 22 bp, Artificial Sequence
  Synthetic oligonucleotide; TTT chr11 5376340 5376361 5376345 5376340 -
cttgctttctcttgtgggcgtt

SEQ ID NO: 116893 - DNA, 22 bp, Artificial Sequence
  Synthetic oligonucleotide; TTC chr11 5376339 5376360 5376344 5376339 -
ttgctttctcttgtgggcgttt

SEQ ID NO: 116894 - DNA, 22 bp, Artificial Sequence
  Synthetic oligonucleotide; CTT chr11 5376337 5376358 5376342 5376337 -
gctttctcttgtgggcgtttag

SEQ ID NO: 116895 - DNA, 22 bp, Artificial Sequence
  Synthetic oligonucleotide; TTG chr11 5376336 5376357 5376341 5376336 -
ctttctcttgtgggcgtttagt

SEQ ID NO: 116896 - DNA, 22 bp, Artificial Sequence
  Synthetic oligonucleotide; CTT chr11 5376333 5376354 5376338 5376333 -
tctcttgtgggcgtttagtgct

SEQ ID NO: 116897 - DNA, 22 bp, Artificial Sequence
  Synthetic oligonucleotide; TTT chr11 5376332 5376353 5376337 5376332 -
ctcttgtgggcgtttagtgcta

SEQ ID NO: 116898 - DNA, 22 bp, Artificial Sequence
  Synthetic oligonucleotide; TTC chr11 5376331 5376352 5376336 5376331 -
tcttgtgggcgtttagtgctat

SEQ ID NO: 116899 - DNA, 22 bp, Artificial Sequence
  Synthetic oligonucleotide; CTC chr11 5376329 5376350 5376334 5376329 -
ttgtgggcgtttagtgctataa

SEQ ID NO: 116900 - DNA, 22 bp, Artificial Sequence
  Synthetic oligonucleotide; CTT chr11 5376327 5376348 5376332 5376327 -
gtgggcgtttagtgctataaat

SEQ ID NO: 116901 - DNA, 22 bp, Artificial Sequence
  Synthetic oligonucleotide; TTG chr11 5376326 5376347 5376331 5376326 -
tgggcgtttagtgctataaatt

SEQ ID NO: 116902 - DNA, 22 bp, Artificial Sequence
  Synthetic oligonucleotide; TTT chr11 5376317 5376338 5376322 5376317 -
agtgctataaatttccccctac

SEQ ID NO: 116903 - DNA, 22 bp, Artificial Sequence
  Synthetic oligonucleotide; TTA chr11 5376316 5376337 5376321 5376316 -
gtgctataaatttccccctaca

SEQ ID NO: 116904 - DNA, 22 bp, Artificial Sequence
  Synthetic oligonucleotide; CTA chr11 5376310 5376331 5376315 5376310 -
taaatttccccctacacactga

SEQ ID NO: 116905 - DNA, 22 bp, Artificial Sequence
  Synthetic oligonucleotide; TTT chr11 5376303 5376324 5376308 5376303 -
ccccctacacactgattcgaat

SEQ ID NO: 116906 - DNA, 22 bp, Artificial Sequence
  Synthetic oligonucleotide; TTC chr11 5376302 5376323 5376307 5376302 -
cccctacacactgattcgaatg

SEQ ID NO: 116907 - DNA, 22 bp, Artificial Sequence
  Synthetic oligonucleotide; CTA chr11 5376296 5376317 5376301 5376296 -
cacactgattcgaatgtgtccc

SEQ ID NO: 116908 - DNA, 22 bp, Artificial Sequence
  Synthetic oligonucleotide; CTG chr11 5376289 5376310 5376294 5376289 -
attcgaatgtgtcccagagatt

SEQ ID NO: 116909 - DNA, 22 bp, Artificial Sequence
  Synthetic oligonucleotide; TTC chr11 5376285 5376306 5376290 5376285 -
gaatgtgtcccagagattctgg

SEQ ID NO: 116910 - DNA, 22 bp, Artificial Sequence
  Synthetic oligonucleotide; TTC chr11 5376266 5376287 5376271 5376266 -
tggtatgttgtgtctttgttct

SEQ ID NO: 116911 - DNA, 22 bp, Artificial Sequence
  Synthetic oligonucleotide; CTG chr11 5376264 5376285 5376269 5376264 -
gtatgttgtgtctttgttctca

SEQ ID NO: 116912 - DNA, 22 bp, Artificial Sequence
  Synthetic oligonucleotide; TTG chr11 5376256 5376277 5376261 5376256 -
tgtctttgttctcattggtttc

SEQ ID NO: 116913 - DNA, 22 bp, Artificial Sequence
  Synthetic oligonucleotide; CTT chr11 5376250 5376271 5376255 5376250 -
tgttctcattggtttcaaagaa

SEQ ID NO: 116914 - DNA, 22 bp, Artificial Sequence
  Synthetic oligonucleotide; TTT chr11 5376249 5376270 5376254 5376249 -
gttctcattggtttcaaagaac

SEQ ID NO: 116915 - DNA, 22 bp, Artificial Sequence
  Synthetic oligonucleotide; TTG chr11 5376248 5376269 5376253 5376248 -
ttctcattggtttcaaagaaca

SEQ ID NO: 116916 - DNA, 22 bp, Artificial Sequence
  Synthetic oligonucleotide; TTC chr11 5376245 5376266 5376250 5376245 -
tcattggtttcaaagaacatct

SEQ ID NO: 116917 - DNA, 22 bp, Artificial Sequence
  Synthetic oligonucleotide; CTC chr11 5376243 5376264 5376248 5376243 -
attggtttcaaagaacatcttt

SEQ ID NO: 116918 - DNA, 22 bp, Artificial Sequence
  Synthetic oligonucleotide; TTG chr11 5376239 5376260 5376244 5376239 -
gtttcaaagaacatctttattt

SEQ ID NO: 116919 - DNA, 22 bp, Artificial Sequence
  Synthetic oligonucleotide; TTT chr11 5376235 5376256 5376240 5376235 -
caaagaacatctttatttctgc

SEQ ID NO: 116920 - DNA, 22 bp, Artificial Sequence
  Synthetic oligonucleotide; TTC chr11 5376234 5376255 5376239 5376234 -
aaagaacatctttatttctgcc

SEQ ID NO: 116921 - DNA, 22 bp, Artificial Sequence
  Synthetic oligonucleotide; CTT chr11 5376222 5376243 5376227 5376222 -
tatttctgccttcatttcgtta

SEQ ID NO: 116922 - DNA, 22 bp, Artificial Sequence
  Synthetic oligonucleotide; TTT chr11 5376221 5376242 5376226 5376221 -
atttctgccttcatttcgttat

SEQ ID NO: 116923 - DNA, 22 bp, Artificial Sequence
  Synthetic oligonucleotide; TTA chr11 5376220 5376241 5376225 5376220 -
tttctgccttcatttcgttatg

SEQ ID NO: 116924 - DNA, 22 bp, Artificial Sequence
  Synthetic oligonucleotide; TTT chr11 5376217 5376238 5376222 5376217 -
ctgccttcatttcgttatgtac

SEQ ID NO: 116925 - DNA, 22 bp, Artificial Sequence
  Synthetic oligonucleotide; TTC chr11 5376216 5376237 5376221 5376216 -
tgccttcatttcgttatgtacc

SEQ ID NO: 116926 - DNA, 22 bp, Artificial Sequence
  Synthetic oligonucleotide; CTG chr11 5376214 5376235 5376219 5376214 -
ccttcatttcgttatgtaccca

SEQ ID NO: 116927 - DNA, 22 bp, Artificial Sequence
  Synthetic oligonucleotide; CTT chr11 5376210 5376231 5376215 5376210 -
catttcgttatgtacccagtag

SEQ ID NO: 116928 - DNA, 22 bp, Artificial Sequence
  Synthetic oligonucleotide; TTC chr11 5376209 5376230 5376214 5376209 -
atttcgttatgtacccagtagt

SEQ ID NO: 116929 - DNA, 22 bp, Artificial Sequence
  Synthetic oligonucleotide; TTT chr11 5376205 5376226 5376210 5376205 -
cgttatgtacccagtagtcatt

SEQ ID NO: 116930 - DNA, 22 bp, Artificial Sequence
  Synthetic oligonucleotide; TTC chr11 5376204 5376225 5376209 5376204 -
gttatgtacccagtagtcattc

SEQ ID NO: 116931 - DNA, 22 bp, Artificial Sequence
  Synthetic oligonucleotide; TTA chr11 5376200 5376221 5376205 5376200 -
tgtacccagtagtcattcagga

SEQ ID NO: 116932 - DNA, 22 bp, Artificial Sequence
  Synthetic oligonucleotide; TTC chr11 5376182 5376203 5376187 5376182 -
aggagcaggttgttcagtttcc

SEQ ID NO: 116933 - DNA, 22 bp, Artificial Sequence
  Synthetic oligonucleotide; TTG chr11 5376170 5376191 5376175 5376170 -
ttcagtttccatgtagttgagt

SEQ ID NO: 116934 - DNA, 22 bp, Artificial Sequence
  Synthetic oligonucleotide; TTC chr11 5376167 5376188 5376172 5376167 -
agtttccatgtagttgagtggt

SEQ ID NO: 116935 - DNA, 22 bp, Artificial Sequence
  Synthetic oligonucleotide; TTT chr11 5376162 5376183 5376167 5376162 -
ccatgtagttgagtggttttga

SEQ ID NO: 116936 - DNA, 22 bp, Artificial Sequence
  Synthetic oligonucleotide; TTC chr11 5376161 5376182 5376166 5376161 -
catgtagttgagtggttttgag

SEQ ID NO: 116937 - DNA, 22 bp, Artificial Sequence
  Synthetic oligonucleotide; TTG chr11 5376151 5376172 5376156 5376151 -
agtggttttgagtgagtttctt

SEQ ID NO: 116938 - DNA, 22 bp, Artificial Sequence
  Synthetic oligonucleotide; TTT chr11 5376143 5376164 5376148 5376143 -
tgagtgagtttcttaatcctga

SEQ ID NO: 116939 - DNA, 22 bp, Artificial Sequence
  Synthetic oligonucleotide; TTT chr11 5376142 5376163 5376147 5376142 -
gagtgagtttcttaatcctgag

SEQ ID NO: 116940 - DNA, 22 bp, Artificial Sequence
  Synthetic oligonucleotide; TTG chr11 5376141 5376162 5376146 5376141 -
agtgagtttcttaatcctgagt

SEQ ID NO: 116941 - DNA, 22 bp, Artificial Sequence
  Synthetic oligonucleotide; TTT chr11 5376132 5376153 5376137 5376132 -
cttaatcctgagttctagtttg

SEQ ID NO: 116942 - DNA, 22 bp, Artificial Sequence
  Synthetic oligonucleotide; TTC chr11 5376131 5376152 5376136 5376131 -
ttaatcctgagttctagtttga

SEQ ID NO: 116943 - DNA, 22 bp, Artificial Sequence
  Synthetic oligonucleotide; CTT chr11 5376129 5376150 5376134 5376129 -
aatcctgagttctagtttgatt

SEQ ID NO: 116944 - DNA, 22 bp, Artificial Sequence
  Synthetic oligonucleotide; TTA chr11 5376128 5376149 5376133 5376128 -
atcctgagttctagtttgattg

SEQ ID NO: 116945 - DNA, 22 bp, Artificial Sequence
  Synthetic oligonucleotide; CTG chr11 5376122 5376143 5376127 5376122 -
agttctagtttgattgcactgt

SEQ ID NO: 116946 - DNA, 22 bp, Artificial Sequence
  Synthetic oligonucleotide; TTC chr11 5376117 5376138 5376122 5376117 -
tagtttgattgcactgtggtct

SEQ ID NO: 116947 - DNA, 22 bp, Artificial Sequence
  Synthetic oligonucleotide; CTA chr11 5376115 5376136 5376120 5376115 -
gtttgattgcactgtggtctga

SEQ ID NO: 116948 - DNA, 22 bp, Artificial Sequence
  Synthetic oligonucleotide; TTT chr11 5376111 5376132 5376116 5376111 -
gattgcactgtggtctgagaga

SEQ ID NO: 116949 - DNA, 22 bp, Artificial Sequence
  Synthetic oligonucleotide; TTG chr11 5376110 5376131 5376115 5376110 -
attgcactgtggtctgagagac

SEQ ID NO: 116950 - DNA, 22 bp, Artificial Sequence
  Synthetic oligonucleotide; TTG chr11 5376106 5376127 5376111 5376106 -
cactgtggtctgagagacagtt

SEQ ID NO: 116951 - DNA, 22 bp, Artificial Sequence
  Synthetic oligonucleotide; CTG chr11 5376101 5376122 5376106 5376101 -
tggtctgagagacagtttgtta

SEQ ID NO: 116952 - DNA, 22 bp, Artificial Sequence
  Synthetic oligonucleotide; CTG chr11 5376094 5376115 5376099 5376094 -
agagacagtttgttataatttc

SEQ ID NO: 116953 - DNA, 22 bp, Artificial Sequence
  Synthetic oligonucleotide; TTT chr11 5376083 5376104 5376088 5376083 -
gttataatttctgttcttttat

SEQ ID NO: 116954 - DNA, 22 bp, Artificial Sequence
  Synthetic oligonucleotide; TTG chr11 5376082 5376103 5376087 5376082 -
ttataatttctgttcttttata

SEQ ID NO: 116955 - DNA, 22 bp, Artificial Sequence
  Synthetic oligonucleotide; TTA chr11 5376079 5376100 5376084 5376079 -
taatttctgttcttttatattt

SEQ ID NO: 116956 - DNA, 22 bp, Artificial Sequence
  Synthetic oligonucleotide; TTT chr11 5376073 5376094 5376078 5376073 -
ctgttcttttatatttgctgag

SEQ ID NO: 116957 - DNA, 22 bp, Artificial Sequence
  Synthetic oligonucleotide; TTC chr11 5376072 5376093 5376077 5376072 -
tgttcttttatatttgctgagg

SEQ ID NO: 116958 - DNA, 22 bp, Artificial Sequence
  Synthetic oligonucleotide; CTG chr11 5376070 5376091 5376075 5376070 -
ttcttttatatttgctgaggag

SEQ ID NO: 116959 - DNA, 22 bp, Artificial Sequence
  Synthetic oligonucleotide; TTC chr11 5376067 5376088 5376072 5376067 -
ttttatatttgctgaggagagc

SEQ ID NO: 116960 - DNA, 22 bp, Artificial Sequence
  Synthetic oligonucleotide; CTT chr11 5376065 5376086 5376070 5376065 -
ttatatttgctgaggagagctt

SEQ ID NO: 116961 - DNA, 22 bp, Artificial Sequence
  Synthetic oligonucleotide; TTT chr11 5376064 5376085 5376069 5376064 -
tatatttgctgaggagagcttt

SEQ ID NO: 116962 - DNA, 22 bp, Artificial Sequence
  Synthetic oligonucleotide; TTT chr11 5376063 5376084 5376068 5376063 -
atatttgctgaggagagcttta

SEQ ID NO: 116963 - DNA, 22 bp, Artificial Sequence
  Synthetic oligonucleotide; TTA chr11 5376062 5376083 5376067 5376062 -
tatttgctgaggagagctttac

SEQ ID NO: 116964 - DNA, 22 bp, Artificial Sequence
  Synthetic oligonucleotide; TTT chr11 5376057 5376078 5376062 5376057 -
gctgaggagagctttacttcca

SEQ ID NO: 116965 - DNA, 22 bp, Artificial Sequence
  Synthetic oligonucleotide; TTG chr11 5376056 5376077 5376061 5376056 -
ctgaggagagctttacttccaa

SEQ ID NO: 116966 - DNA, 22 bp, Artificial Sequence
  Synthetic oligonucleotide; CTG chr11 5376053 5376074 5376058 5376053 -
aggagagctttacttccaagta

SEQ ID NO: 116967 - DNA, 22 bp, Artificial Sequence
  Synthetic oligonucleotide; CTT chr11 5376043 5376064 5376048 5376043 -
tacttccaagtatgtggtcaat

SEQ ID NO: 116968 - DNA, 22 bp, Artificial Sequence
  Synthetic oligonucleotide; TTT chr11 5376042 5376063 5376047 5376042 -
acttccaagtatgtggtcaatt

SEQ ID NO: 116969 - DNA, 22 bp, Artificial Sequence
  Synthetic oligonucleotide; TTA chr11 5376041 5376062 5376046 5376041 -
cttccaagtatgtggtcaattt

SEQ ID NO: 116970 - DNA, 22 bp, Artificial Sequence
  Synthetic oligonucleotide; CTT chr11 5376038 5376059 5376043 5376038 -
ccaagtatgtggtcaattttgg

SEQ ID NO: 116971 - DNA, 22 bp, Artificial Sequence
  Synthetic oligonucleotide; TTC chr11 5376037 5376058 5376042 5376037 -
caagtatgtggtcaattttgga

SEQ ID NO: 116972 - DNA, 22 bp, Artificial Sequence
  Synthetic oligonucleotide; TTT chr11 5376019 5376040 5376024 5376019 -
tggaataggtgttgtgtggtgc

SEQ ID NO: 116973 - DNA, 22 bp, Artificial Sequence
  Synthetic oligonucleotide; TTT chr11 5376018 5376039 5376023 5376018 -
ggaataggtgttgtgtggtgct

SEQ ID NO: 116974 - DNA, 22 bp, Artificial Sequence
  Synthetic oligonucleotide; TTG chr11 5376017 5376038 5376022 5376017 -
gaataggtgttgtgtggtgctg

SEQ ID NO: 116975 - DNA, 22 bp, Artificial Sequence
  Synthetic oligonucleotide; TTG chr11 5376005 5376026 5376010 5376005 -
tgtggtgctgaaaaaaaatgta

SEQ ID NO: 116976 - DNA, 22 bp, Artificial Sequence
  Synthetic oligonucleotide; CTG chr11 5375995 5376016 5376000 5375995 -
aaaaaaaatgtatattctgttg

SEQ ID NO: 116977 - DNA, 22 bp, Artificial Sequence
  Synthetic oligonucleotide; TTC chr11 5375978 5375999 5375983 5375978 -
tgttgatttggggtggagagtt

SEQ ID NO: 116978 - DNA, 22 bp, Artificial Sequence
  Synthetic oligonucleotide; CTG chr11 5375976 5375997 5375981 5375976 -
ttgatttggggtggagagttct

SEQ ID NO: 116979 - DNA, 22 bp, Artificial Sequence
  Synthetic oligonucleotide; TTG chr11 5375973 5375994 5375978 5375973 -
atttggggtggagagttctgta

SEQ ID NO: 116980 - DNA, 22 bp, Artificial Sequence
  Synthetic oligonucleotide; TTT chr11 5375969 5375990 5375974 5375969 -
ggggtggagagttctgtagatg

SEQ ID NO: 116981 - DNA, 22 bp, Artificial Sequence
  Synthetic oligonucleotide; TTG chr11 5375968 5375989 5375973 5375968 -
gggtggagagttctgtagatgt

SEQ ID NO: 116982 - DNA, 22 bp, Artificial Sequence
  Synthetic oligonucleotide; TTC chr11 5375955 5375976 5375960 5375955 -
tgtagatgtctattaggtctgc

SEQ ID NO: 116983 - DNA, 22 bp, Artificial Sequence
  Synthetic oligonucleotide; CTG chr11 5375953 5375974 5375958 5375953 -
tagatgtctattaggtctgctt

SEQ ID NO: 116984 - DNA, 22 bp, Artificial Sequence
  Synthetic oligonucleotide; CTA chr11 5375943 5375964 5375948 5375943 -
ttaggtctgcttggtgcagagc

SEQ ID NO: 116985 - DNA, 22 bp, Artificial Sequence
  Synthetic oligonucleotide; TTA chr11 5375940 5375961 5375945 5375940 -
ggtctgcttggtgcagagctgt

SEQ ID NO: 116986 - DNA, 22 bp, Artificial Sequence
  Synthetic oligonucleotide; CTG chr11 5375934 5375955 5375939 5375934 -
cttggtgcagagctgtgttcaa

SEQ ID NO: 116987 - DNA, 22 bp, Artificial Sequence
  Synthetic oligonucleotide; CTT chr11 5375931 5375952 5375936 5375931 -
ggtgcagagctgtgttcaattc

SEQ ID NO: 116988 - DNA, 22 bp, Artificial Sequence
  Synthetic oligonucleotide; TTG chr11 5375930 5375951 5375935 5375930 -
gtgcagagctgtgttcaattcc

SEQ ID NO: 116989 - DNA, 22 bp, Artificial Sequence
  Synthetic oligonucleotide; CTG chr11 5375919 5375940 5375924 5375919 -
tgttcaattcctggatatcctt

SEQ ID NO: 116990 - DNA, 22 bp, Artificial Sequence
  Synthetic oligonucleotide; TTC chr11 5375914 5375935 5375919 5375914 -
aattcctggatatccttgttaa

SEQ ID NO: 116991 - DNA, 22 bp, Artificial Sequence
  Synthetic oligonucleotide; TTC chr11 5375909 5375930 5375914 5375909 -
ctggatatccttgttaactttc

SEQ ID NO: 116992 - DNA, 22 bp, Artificial Sequence
  Synthetic oligonucleotide; CTG chr11 5375906 5375927 5375911 5375906 -
gatatccttgttaactttctgt

SEQ ID NO: 116993 - DNA, 22 bp, Artificial Sequence
  Synthetic oligonucleotide; CTT chr11 5375897 5375918 5375902 5375897 -
gttaactttctgtctcgttgat

SEQ ID NO: 116994 - DNA, 22 bp, Artificial Sequence
  Synthetic oligonucleotide; TTG chr11 5375896 5375917 5375901 5375896 -
ttaactttctgtctcgttgatc

SEQ ID NO: 116995 - DNA, 22 bp, Artificial Sequence
  Synthetic oligonucleotide; TTA chr11 5375893 5375914 5375898 5375893 -
actttctgtctcgttgatctgt

SEQ ID NO: 116996 - DNA, 22 bp, Artificial Sequence
  Synthetic oligonucleotide; CTT chr11 5375889 5375910 5375894 5375889 -
tctgtctcgttgatctgtctaa

SEQ ID NO: 116997 - DNA, 22 bp, Artificial Sequence
  Synthetic oligonucleotide; TTT chr11 5375888 5375909 5375893 5375888 -
ctgtctcgttgatctgtctaat

SEQ ID NO: 116998 - DNA, 22 bp, Artificial Sequence
  Synthetic oligonucleotide; TTC chr11 5375887 5375908 5375892 5375887 -
tgtctcgttgatctgtctaatg

SEQ ID NO: 116999 - DNA, 22 bp, Artificial Sequence
  Synthetic oligonucleotide; CTG chr11 5375885 5375906 5375890 5375885 -
tctcgttgatctgtctaatgtt

SEQ ID NO: 117000 - DNA, 22 bp, Artificial Sequence
  Synthetic oligonucleotide; CTC chr11 5375881 5375902 5375886 5375881 -
gttgatctgtctaatgttgaca

SEQ ID NO: 117001 - DNA, 22 bp, Artificial Sequence
  Synthetic oligonucleotide; TTG chr11 5375877 5375898 5375882 5375877 -
atctgtctaatgttgacagtgg

SEQ ID NO: 117002 - DNA, 22 bp, Artificial Sequence
  Synthetic oligonucleotide; CTG chr11 5375872 5375893 5375877 5375872 -
tctaatgttgacagtggggtat

SEQ ID NO: 117003 - DNA, 22 bp, Artificial Sequence
  Synthetic oligonucleotide; CTA chr11 5375868 5375889 5375873 5375868 -
atgttgacagtggggtattaaa

SEQ ID NO: 117004 - DNA, 22 bp, Artificial Sequence
  Synthetic oligonucleotide; TTG chr11 5375862 5375883 5375867 5375862 -
acagtggggtattaaagtctcc

SEQ ID NO: 117005 - DNA, 22 bp, Artificial Sequence
  Synthetic oligonucleotide; TTA chr11 5375848 5375869 5375853 5375848 -
aagtctcccattattaaagtgt

SEQ ID NO: 117006 - DNA, 22 bp, Artificial Sequence
  Synthetic oligonucleotide; CTC chr11 5375841 5375862 5375846 5375841 -
ccattattaaagtgtgggagtc

SEQ ID NO: 117007 - DNA, 22 bp, Artificial Sequence
  Synthetic oligonucleotide; TTA chr11 5375835 5375856 5375840 5375835 -
ttaaagtgtgggagtctaagtc

SEQ ID NO: 117008 - DNA, 22 bp, Artificial Sequence
  Synthetic oligonucleotide; TTA chr11 5375832 5375853 5375837 5375832 -
aagtgtgggagtctaagtctct

SEQ ID NO: 117009 - DNA, 22 bp, Artificial Sequence
  Synthetic oligonucleotide; CTA chr11 5375817 5375838 5375822 5375817 -
agtctctttgtaggtctctaag

SEQ ID NO: 117010 - DNA, 22 bp, Artificial Sequence
  Synthetic oligonucleotide; CTC chr11 5375811 5375832 5375816 5375811 -
tttgtaggtctctaaggacttg

SEQ ID NO: 117011 - DNA, 22 bp, Artificial Sequence
  Synthetic oligonucleotide; CTT chr11 5375809 5375830 5375814 5375809 -
tgtaggtctctaaggacttgct

SEQ ID NO: 117012 - DNA, 22 bp, Artificial Sequence
  Synthetic oligonucleotide; TTT chr11 5375808 5375829 5375813 5375808 -
gtaggtctctaaggacttgctt

SEQ ID NO: 117013 - DNA, 22 bp, Artificial Sequence
  Synthetic oligonucleotide; TTG chr11 5375807 5375828 5375812 5375807 -
taggtctctaaggacttgcttt

SEQ ID NO: 117014 - DNA, 22 bp, Artificial Sequence
  Synthetic oligonucleotide; CTC chr11 5375799 5375820 5375804 5375799 -
taaggacttgctttatgaatct

SEQ ID NO: 117015 - DNA, 22 bp, Artificial Sequence
  Synthetic oligonucleotide; CTA chr11 5375797 5375818 5375802 5375797 -
aggacttgctttatgaatctgg

SEQ ID NO: 117016 - DNA, 22 bp, Artificial Sequence
  Synthetic oligonucleotide; CTT chr11 5375790 5375811 5375795 5375790 -
gctttatgaatctgggtgctcc

SEQ ID NO: 117017 - DNA, 22 bp, Artificial Sequence
  Synthetic oligonucleotide; TTG chr11 5375789 5375810 5375794 5375789 -
ctttatgaatctgggtgctcct

SEQ ID NO: 117018 - DNA, 22 bp, Artificial Sequence
  Synthetic oligonucleotide; CTT chr11 5375786 5375807 5375791 5375786 -
tatgaatctgggtgctcctgta

SEQ ID NO: 117019 - DNA, 22 bp, Artificial Sequence
  Synthetic oligonucleotide; TTT chr11 5375785 5375806 5375790 5375785 -
atgaatctgggtgctcctgtat

SEQ ID NO: 117020 - DNA, 22 bp, Artificial Sequence
  Synthetic oligonucleotide; TTA chr11 5375784 5375805 5375789 5375784 -
tgaatctgggtgctcctgtatt

SEQ ID NO: 117021 - DNA, 22 bp, Artificial Sequence
  Synthetic oligonucleotide; CTG chr11 5375776 5375797 5375781 5375776 -
ggtgctcctgtattgggtgcat

SEQ ID NO: 117022 - DNA, 22 bp, Artificial Sequence
  Synthetic oligonucleotide; CTC chr11 5375769 5375790 5375774 5375769 -
ctgtattgggtgcatatatatt

SEQ ID NO: 117023 - DNA, 22 bp, Artificial Sequence
  Synthetic oligonucleotide; CTG chr11 5375766 5375787 5375771 5375766 -
tattgggtgcatatatatttag

SEQ ID NO: 117024 - DNA, 22 bp, Artificial Sequence
  Synthetic oligonucleotide; TTG chr11 5375761 5375782 5375766 5375761 -
ggtgcatatatatttaggatag

SEQ ID NO: 117025 - DNA, 22 bp, Artificial Sequence
  Synthetic oligonucleotide; TTT chr11 5375746 5375767 5375751 5375746 -
aggatagttagctcttcttgtt

SEQ ID NO: 117026 - DNA, 22 bp, Artificial Sequence
  Synthetic oligonucleotide; TTA chr11 5375745 5375766 5375750 5375745 -
ggatagttagctcttcttgttg

SEQ ID NO: 117027 - DNA, 22 bp, Artificial Sequence
  Synthetic oligonucleotide; TTA chr11 5375736 5375757 5375741 5375736 -
gctcttcttgttgaattgatcc

SEQ ID NO: 117028 - DNA, 22 bp, Artificial Sequence
  Synthetic oligonucleotide; CTC chr11 5375732 5375753 5375737 5375732 -
ttcttgttgaattgatcccttt

SEQ ID NO: 117029 - DNA, 22 bp, Artificial Sequence
  Synthetic oligonucleotide; CTT chr11 5375730 5375751 5375735 5375730 -
cttgttgaattgatccctttac

SEQ ID NO: 117030 - DNA, 22 bp, Artificial Sequence
  Synthetic oligonucleotide; TTC chr11 5375729 5375750 5375734 5375729 -
ttgttgaattgatccctttacc

SEQ ID NO: 117031 - DNA, 22 bp, Artificial Sequence
  Synthetic oligonucleotide; CTT chr11 5375727 5375748 5375732 5375727 -
gttgaattgatccctttaccat

SEQ ID NO: 117032 - DNA, 22 bp, Artificial Sequence
  Synthetic oligonucleotide; TTG chr11 5375726 5375747 5375731 5375726 -
ttgaattgatccctttaccatt

SEQ ID NO: 117033 - DNA, 22 bp, Artificial Sequence
  Synthetic oligonucleotide; TTG chr11 5375723 5375744 5375728 5375723 -
aattgatccctttaccattatg

SEQ ID NO: 117034 - DNA, 22 bp, Artificial Sequence
  Synthetic oligonucleotide; TTG chr11 5375718 5375739 5375723 5375718 -
atccctttaccattatgtaatg

SEQ ID NO: 117035 - DNA, 22 bp, Artificial Sequence
  Synthetic oligonucleotide; CTT chr11 5375711 5375732 5375716 5375711 -
taccattatgtaatggccttct

SEQ ID NO: 117036 - DNA, 22 bp, Artificial Sequence
  Synthetic oligonucleotide; TTT chr11 5375710 5375731 5375715 5375710 -
accattatgtaatggccttctt

SEQ ID NO: 117037 - DNA, 22 bp, Artificial Sequence
  Synthetic oligonucleotide; TTA chr11 5375709 5375730 5375714 5375709 -
ccattatgtaatggccttcttt

SEQ ID NO: 117038 - DNA, 22 bp, Artificial Sequence
  Synthetic oligonucleotide; TTA chr11 5375703 5375724 5375708 5375703 -
tgtaatggccttctttgtctct

SEQ ID NO: 117039 - DNA, 22 bp, Artificial Sequence
  Synthetic oligonucleotide; CTT chr11 5375691 5375712 5375696 5375691 -
ctttgtctcttttgatctttgt

SEQ ID NO: 117040 - DNA, 22 bp, Artificial Sequence
  Synthetic oligonucleotide; TTC chr11 5375690 5375711 5375695 5375690 -
tttgtctcttttgatctttgtt

SEQ ID NO: 117041 - DNA, 22 bp, Artificial Sequence
  Synthetic oligonucleotide; CTT chr11 5375688 5375709 5375693 5375688 -
tgtctcttttgatctttgttgg

SEQ ID NO: 117042 - DNA, 22 bp, Artificial Sequence
  Synthetic oligonucleotide; TTT chr11 5375687 5375708 5375692 5375687 -
gtctcttttgatctttgttggt

SEQ ID NO: 117043 - DNA, 22 bp, Artificial Sequence
  Synthetic oligonucleotide; TTG chr11 5375686 5375707 5375691 5375686 -
tctcttttgatctttgttggtt

SEQ ID NO: 117044 - DNA, 22 bp, Artificial Sequence
  Synthetic oligonucleotide; CTC chr11 5375682 5375703 5375687 5375682 -
ttttgatctttgttggtttaaa

SEQ ID NO: 117045 - DNA, 22 bp, Artificial Sequence
  Synthetic oligonucleotide; CTT chr11 5375680 5375701 5375685 5375680 -
ttgatctttgttggtttaaagc

SEQ ID NO: 117046 - DNA, 22 bp, Artificial Sequence
  Synthetic oligonucleotide; TTT chr11 5375679 5375700 5375684 5375679 -
tgatctttgttggtttaaagcc

SEQ ID NO: 117047 - DNA, 22 bp, Artificial Sequence
  Synthetic oligonucleotide; TTT chr11 5375678 5375699 5375683 5375678 -
gatctttgttggtttaaagcct

SEQ ID NO: 117048 - DNA, 22 bp, Artificial Sequence
  Synthetic oligonucleotide; TTG chr11 5375677 5375698 5375682 5375677 -
atctttgttggtttaaagcctg

SEQ ID NO: 117049 - DNA, 22 bp, Artificial Sequence
  Synthetic oligonucleotide; CTT chr11 5375672 5375693 5375677 5375672 -
tgttggtttaaagcctgtttta

SEQ ID NO: 117050 - DNA, 22 bp, Artificial Sequence
  Synthetic oligonucleotide; TTT chr11 5375671 5375692 5375676 5375671 -
gttggtttaaagcctgttttat

SEQ ID NO: 117051 - DNA, 22 bp, Artificial Sequence
  Synthetic oligonucleotide; TTG chr11 5375670 5375691 5375675 5375670 -
ttggtttaaagcctgttttatc

SEQ ID NO: 117052 - DNA, 22 bp, Artificial Sequence
  Synthetic oligonucleotide; TTG chr11 5375667 5375688 5375672 5375667 -
gtttaaagcctgttttatcaga

SEQ ID NO: 117053 - DNA, 22 bp, Artificial Sequence
  Synthetic oligonucleotide; TTT chr11 5375663 5375684 5375668 5375663 -
aaagcctgttttatcagagact

SEQ ID NO: 117054 - DNA, 22 bp, Artificial Sequence
  Synthetic oligonucleotide; TTA chr11 5375662 5375683 5375667 5375662 -
aagcctgttttatcagagacta

SEQ ID NO: 117055 - DNA, 22 bp, Artificial Sequence
  Synthetic oligonucleotide; CTG chr11 5375655 5375676 5375660 5375655 -
ttttatcagagactaggattgc

SEQ ID NO: 117056 - DNA, 22 bp, Artificial Sequence
  Synthetic oligonucleotide; TTT chr11 5375652 5375673 5375657 5375652 -
tatcagagactaggattgcaac

SEQ ID NO: 117057 - DNA, 22 bp, Artificial Sequence
  Synthetic oligonucleotide; TTT chr11 5375651 5375672 5375656 5375651 -
atcagagactaggattgcaacc

SEQ ID NO: 117058 - DNA, 22 bp, Artificial Sequence
  Synthetic oligonucleotide; TTA chr11 5375650 5375671 5375655 5375650 -
tcagagactaggattgcaaccc

SEQ ID NO: 117059 - DNA, 22 bp, Artificial Sequence
  Synthetic oligonucleotide; CTA chr11 5375640 5375661 5375645 5375640 -
ggattgcaacccctgccttttt

SEQ ID NO: 117060 - DNA, 22 bp, Artificial Sequence
  Synthetic oligonucleotide; TTG chr11 5375634 5375655 5375639 5375634 -
caacccctgcctttttttgttt

SEQ ID NO: 117061 - DNA, 22 bp, Artificial Sequence
  Synthetic oligonucleotide; CTG chr11 5375625 5375646 5375630 5375625 -
cctttttttgttttccatttgc

SEQ ID NO: 117062 - DNA, 22 bp, Artificial Sequence
  Synthetic oligonucleotide; CTT chr11 5375621 5375642 5375626 5375621 -
tttttgttttccatttgcttgg

SEQ ID NO: 117063 - DNA, 22 bp, Artificial Sequence
  Synthetic oligonucleotide; TTT chr11 5375620 5375641 5375625 5375620 -
ttttgttttccatttgcttggt

SEQ ID NO: 117064 - DNA, 22 bp, Artificial Sequence
  Synthetic oligonucleotide; TTT chr11 5375619 5375640 5375624 5375619 -
tttgttttccatttgcttggta

SEQ ID NO: 117065 - DNA, 22 bp, Artificial Sequence
  Synthetic oligonucleotide; TTT chr11 5375618 5375639 5375623 5375618 -
ttgttttccatttgcttggtag

SEQ ID NO: 117066 - DNA, 22 bp, Artificial Sequence
  Synthetic oligonucleotide; TTT chr11 5375617 5375638 5375622 5375617 -
tgttttccatttgcttggtaga

SEQ ID NO: 117067 - DNA, 22 bp, Artificial Sequence
  Synthetic oligonucleotide; TTT chr11 5375616 5375637 5375621 5375616 -
gttttccatttgcttggtagat

SEQ ID NO: 117068 - DNA, 22 bp, Artificial Sequence
  Synthetic oligonucleotide; TTG chr11 5375615 5375636 5375620 5375615 -
ttttccatttgcttggtagatc

SEQ ID NO: 117069 - DNA, 22 bp, Artificial Sequence
  Synthetic oligonucleotide; TTT chr11 5375612 5375633 5375617 5375612 -
tccatttgcttggtagatcttc

SEQ ID NO: 117070 - DNA, 22 bp, Artificial Sequence
  Synthetic oligonucleotide; TTT chr11 5375611 5375632 5375616 5375611 -
ccatttgcttggtagatcttcc

SEQ ID NO: 117071 - DNA, 22 bp, Artificial Sequence
  Synthetic oligonucleotide; TTC chr11 5375610 5375631 5375615 5375610 -
catttgcttggtagatcttcct

SEQ ID NO: 117072 - DNA, 22 bp, Artificial Sequence
  Synthetic oligonucleotide; TTT chr11 5375605 5375626 5375610 5375605 -
gcttggtagatcttcctccatc

SEQ ID NO: 117073 - DNA, 22 bp, Artificial Sequence
  Synthetic oligonucleotide; TTG chr11 5375604 5375625 5375609 5375604 -
cttggtagatcttcctccatcc

SEQ ID NO: 117074 - DNA, 22 bp, Artificial Sequence
  Synthetic oligonucleotide; CTT chr11 5375601 5375622 5375606 5375601 -
ggtagatcttcctccatccttt

SEQ ID NO: 117075 - DNA, 22 bp, Artificial Sequence
  Synthetic oligonucleotide; TTG chr11 5375600 5375621 5375605 5375600 -
gtagatcttcctccatcctttt

SEQ ID NO: 117076 - DNA, 22 bp, Artificial Sequence
  Synthetic oligonucleotide; CTT chr11 5375591 5375612 5375596 5375591 -
cctccatccttttattttgagc

SEQ ID NO: 117077 - DNA, 22 bp, Artificial Sequence
  Synthetic oligonucleotide; TTC chr11 5375590 5375611 5375595 5375590 -
ctccatccttttattttgagcc

SEQ ID NO: 117078 - DNA, 22 bp, Artificial Sequence
  Synthetic oligonucleotide; CTC chr11 5375587 5375608 5375592 5375587 -
catccttttattttgagcctat

SEQ ID NO: 117079 - DNA, 22 bp, Artificial Sequence
  Synthetic oligonucleotide; CTT chr11 5375580 5375601 5375585 5375580 -
ttattttgagcctatgtgtgtg

SEQ ID NO: 117080 - DNA, 22 bp, Artificial Sequence
  Synthetic oligonucleotide; TTT chr11 5375579 5375600 5375584 5375579 -
tattttgagcctatgtgtgtgt

SEQ ID NO: 117081 - DNA, 22 bp, Artificial Sequence
  Synthetic oligonucleotide; TTT chr11 5375578 5375599 5375583 5375578 -
attttgagcctatgtgtgtgtg

SEQ ID NO: 117082 - DNA, 22 bp, Artificial Sequence
  Synthetic oligonucleotide; TTA chr11 5375577 5375598 5375582 5375577 -
ttttgagcctatgtgtgtgtgt

SEQ ID NO: 117083 - DNA, 22 bp, Artificial Sequence
  Synthetic oligonucleotide; TTT chr11 5375574 5375595 5375579 5375574 -
tgagcctatgtgtgtgtgtgca

SEQ ID NO: 117084 - DNA, 22 bp, Artificial Sequence
  Synthetic oligonucleotide; TTT chr11 5375573 5375594 5375578 5375573 -
gagcctatgtgtgtgtgtgcac

SEQ ID NO: 117085 - DNA, 22 bp, Artificial Sequence
  Synthetic oligonucleotide; TTG chr11 5375572 5375593 5375577 5375572 -
agcctatgtgtgtgtgtgcaca

SEQ ID NO: 117086 - DNA, 22 bp, Artificial Sequence
  Synthetic oligonucleotide; CTA chr11 5375566 5375587 5375571 5375566 -
tgtgtgtgtgtgcacatgagat

SEQ ID NO: 117087 - DNA, 22 bp, Artificial Sequence
  Synthetic oligonucleotide; TTT chr11 5375538 5375559 5375543 5375538 -
cctgaatacactctttatccaa

SEQ ID NO: 117088 - DNA, 22 bp, Artificial Sequence
  Synthetic oligonucleotide; TTC chr11 5375537 5375558 5375542 5375537 -
ctgaatacactctttatccaat

SEQ ID NO: 117089 - DNA, 22 bp, Artificial Sequence
  Synthetic oligonucleotide; CTG chr11 5375534 5375555 5375539 5375534 -
aatacactctttatccaatttg

SEQ ID NO: 117090 - DNA, 22 bp, Artificial Sequence
  Synthetic oligonucleotide; CTC chr11 5375525 5375546 5375530 5375525 -
tttatccaatttgccagtctgt

SEQ ID NO: 117091 - DNA, 22 bp, Artificial Sequence
  Synthetic oligonucleotide; CTT chr11 5375523 5375544 5375528 5375523 -
tatccaatttgccagtctgtgt

SEQ ID NO: 117092 - DNA, 22 bp, Artificial Sequence
  Synthetic oligonucleotide; TTT chr11 5375522 5375543 5375527 5375522 -
atccaatttgccagtctgtgtc

SEQ ID NO: 117093 - DNA, 22 bp, Artificial Sequence
  Synthetic oligonucleotide; TTA chr11 5375521 5375542 5375526 5375521 -
tccaatttgccagtctgtgtct

SEQ ID NO: 117094 - DNA, 22 bp, Artificial Sequence
  Synthetic oligonucleotide; TTT chr11 5375513 5375534 5375518 5375513 -
gccagtctgtgtctttcaattg

SEQ ID NO: 117095 - DNA, 22 bp, Artificial Sequence
  Synthetic oligonucleotide; TTG chr11 5375512 5375533 5375517 5375512 -
ccagtctgtgtctttcaattgg

SEQ ID NO: 117096 - DNA, 22 bp, Artificial Sequence
  Synthetic oligonucleotide; CTG chr11 5375504 5375525 5375509 5375504 -
tgtctttcaattggagcactta

SEQ ID NO: 117097 - DNA, 22 bp, Artificial Sequence
  Synthetic oligonucleotide; CTT chr11 5375498 5375519 5375503 5375498 -
tcaattggagcacttagtccat

SEQ ID NO: 117098 - DNA, 22 bp, Artificial Sequence
  Synthetic oligonucleotide; TTT chr11 5375497 5375518 5375502 5375497 -
caattggagcacttagtccatt

SEQ ID NO: 117099 - DNA, 22 bp, Artificial Sequence
  Synthetic oligonucleotide; TTC chr11 5375496 5375517 5375501 5375496 -
aattggagcacttagtccattt

SEQ ID NO: 117100 - DNA, 22 bp, Artificial Sequence
  Synthetic oligonucleotide; TTG chr11 5375491 5375512 5375496 5375491 -
gagcacttagtccatttacatt

SEQ ID NO: 117101 - DNA, 22 bp, Artificial Sequence
  Synthetic oligonucleotide; CTT chr11 5375483 5375504 5375488 5375483 -
agtccatttacatttaaagtta

SEQ ID NO: 117102 - DNA, 22 bp, Artificial Sequence
  Synthetic oligonucleotide; TTA chr11 5375482 5375503 5375487 5375482 -
gtccatttacatttaaagttaa

SEQ ID NO: 117103 - DNA, 22 bp, Artificial Sequence
  Synthetic oligonucleotide; TTT chr11 5375474 5375495 5375479 5375474 -
acatttaaagttaatattgtat

SEQ ID NO: 117104 - DNA, 22 bp, Artificial Sequence
  Synthetic oligonucleotide; TTA chr11 5375473 5375494 5375478 5375473 -
catttaaagttaatattgtatg

SEQ ID NO: 117105 - DNA, 22 bp, Artificial Sequence
  Synthetic oligonucleotide; TTT chr11 5375468 5375489 5375473 5375468 -
aaagttaatattgtatgtgtga

SEQ ID NO: 117106 - DNA, 22 bp, Artificial Sequence
  Synthetic oligonucleotide; TTA chr11 5375467 5375488 5375472 5375467 -
aagttaatattgtatgtgtgaa

SEQ ID NO: 117107 - DNA, 22 bp, Artificial Sequence
  Synthetic oligonucleotide; TTA chr11 5375461 5375482 5375466 5375461 -
atattgtatgtgtgaatttgat

SEQ ID NO: 117108 - DNA, 22 bp, Artificial Sequence
  Synthetic oligonucleotide; TTG chr11 5375455 5375476 5375460 5375455 -
tatgtgtgaatttgatcctgtc

SEQ ID NO: 117109 - DNA, 22 bp, Artificial Sequence
  Synthetic oligonucleotide; TTT chr11 5375442 5375463 5375447 5375442 -
gatcctgtcattatgatagctg

SEQ ID NO: 117110 - DNA, 22 bp, Artificial Sequence
  Synthetic oligonucleotide; TTG chr11 5375441 5375462 5375446 5375441 -
atcctgtcattatgatagctgg

SEQ ID NO: 117111 - DNA, 22 bp, Artificial Sequence
  Synthetic oligonucleotide; CTG chr11 5375435 5375456 5375440 5375435 -
tcattatgatagctggttattt

SEQ ID NO: 117112 - DNA, 22 bp, Artificial Sequence
  Synthetic oligonucleotide; TTA chr11 5375429 5375450 5375434 5375429 -
tgatagctggttattttgctcg

SEQ ID NO: 117113 - DNA, 22 bp, Artificial Sequence
  Synthetic oligonucleotide; CTG chr11 5375420 5375441 5375425 5375420 -
gttattttgctcgttagttgat

SEQ ID NO: 117114 - DNA, 22 bp, Artificial Sequence
  Synthetic oligonucleotide; TTA chr11 5375416 5375437 5375421 5375416 -
ttttgctcgttagttgatgcag

SEQ ID NO: 117115 - DNA, 22 bp, Artificial Sequence
  Synthetic oligonucleotide; TTT chr11 5375413 5375434 5375418 5375413 -
tgctcgttagttgatgcagttt

SEQ ID NO: 117116 - DNA, 22 bp, Artificial Sequence
  Synthetic oligonucleotide; TTT chr11 5375412 5375433 5375417 5375412 -
gctcgttagttgatgcagtttc

SEQ ID NO: 117117 - DNA, 22 bp, Artificial Sequence
  Synthetic oligonucleotide; TTG chr11 5375411 5375432 5375416 5375411 -
ctcgttagttgatgcagtttct

SEQ ID NO: 117118 - DNA, 22 bp, Artificial Sequence
  Synthetic oligonucleotide; CTC chr11 5375408 5375429 5375413 5375408 -
gttagttgatgcagtttcttcc

SEQ ID NO: 117119 - DNA, 22 bp, Artificial Sequence
  Synthetic oligonucleotide; TTA chr11 5375404 5375425 5375409 5375404 -
gttgatgcagtttcttcctagt

SEQ ID NO: 117120 - DNA, 22 bp, Artificial Sequence
  Synthetic oligonucleotide; TTG chr11 5375400 5375421 5375405 5375400 -
atgcagtttcttcctagtcttg

SEQ ID NO: 117121 - DNA, 22 bp, Artificial Sequence
  Synthetic oligonucleotide; TTT chr11 5375391 5375412 5375396 5375391 -
cttcctagtcttgatggtcttc

SEQ ID NO: 117122 - DNA, 22 bp, Artificial Sequence
  Synthetic oligonucleotide; TTC chr11 5375390 5375411 5375395 5375390 -
ttcctagtcttgatggtcttca

SEQ ID NO: 117123 - DNA, 22 bp, Artificial Sequence
  Synthetic oligonucleotide; CTT chr11 5375388 5375409 5375393 5375388 -
cctagtcttgatggtcttcaca

SEQ ID NO: 117124 - DNA, 22 bp, Artificial Sequence
  Synthetic oligonucleotide; TTC chr11 5375387 5375408 5375392 5375387 -
ctagtcttgatggtcttcacat

SEQ ID NO: 117125 - DNA, 22 bp, Artificial Sequence
  Synthetic oligonucleotide; CTA chr11 5375384 5375405 5375389 5375384 -
gtcttgatggtcttcacatttt

SEQ ID NO: 117126 - DNA, 22 bp, Artificial Sequence
  Synthetic oligonucleotide; CTT chr11 5375379 5375400 5375384 5375379 -
gatggtcttcacattttggcct

SEQ ID NO: 117127 - DNA, 22 bp, Artificial Sequence
  Synthetic oligonucleotide; TTG chr11 5375378 5375399 5375383 5375378 -
atggtcttcacattttggcctg

SEQ ID NO: 117128 - DNA, 22 bp, Artificial Sequence
  Synthetic oligonucleotide; CTT chr11 5375370 5375391 5375375 5375370 -
cacattttggcctgattttgca

SEQ ID NO: 117129 - DNA, 22 bp, Artificial Sequence
  Synthetic oligonucleotide; TTC chr11 5375369 5375390 5375374 5375369 -
acattttggcctgattttgcag

SEQ ID NO: 117130 - DNA, 22 bp, Artificial Sequence
  Synthetic oligonucleotide; TTT chr11 5375363 5375384 5375368 5375363 -
tggcctgattttgcagtggctg

SEQ ID NO: 117131 - DNA, 22 bp, Artificial Sequence
  Synthetic oligonucleotide; TTT chr11 5375362 5375383 5375367 5375362 -
ggcctgattttgcagtggctgg

SEQ ID NO: 117132 - DNA, 22 bp, Artificial Sequence
  Synthetic oligonucleotide; TTG chr11 5375361 5375382 5375366 5375361 -
gcctgattttgcagtggctggt

SEQ ID NO: 117133 - DNA, 22 bp, Artificial Sequence
  Synthetic oligonucleotide; CTG chr11 5375356 5375377 5375361 5375356 -
attttgcagtggctggtaccgg

SEQ ID NO: 117134 - DNA, 22 bp, Artificial Sequence
  Synthetic oligonucleotide; TTT chr11 5375352 5375373 5375357 5375352 -
tgcagtggctggtaccggttgt

SEQ ID NO: 117135 - DNA, 22 bp, Artificial Sequence
  Synthetic oligonucleotide; TTT chr11 5375351 5375372 5375356 5375351 -
gcagtggctggtaccggttgtg

SEQ ID NO: 117136 - DNA, 22 bp, Artificial Sequence
  Synthetic oligonucleotide; TTG chr11 5375350 5375371 5375355 5375350 -
cagtggctggtaccggttgtgc

SEQ ID NO: 117137 - DNA, 22 bp, Artificial Sequence
  Synthetic oligonucleotide; CTG chr11 5375341 5375362 5375346 5375341 -
gtaccggttgtgcctttccatg

SEQ ID NO: 117138 - DNA, 22 bp, Artificial Sequence
  Synthetic oligonucleotide; TTG chr11 5375331 5375352 5375336 5375331 -
tgcctttccatgtttagtgctt

SEQ ID NO: 117139 - DNA, 22 bp, Artificial Sequence
  Synthetic oligonucleotide; CTT chr11 5375325 5375346 5375330 5375325 -
tccatgtttagtgcttccttca

SEQ ID NO: 117140 - DNA, 22 bp, Artificial Sequence
  Synthetic oligonucleotide; TTT chr11 5375324 5375345 5375329 5375324 -
ccatgtttagtgcttccttcag

SEQ ID NO: 117141 - DNA, 22 bp, Artificial Sequence
  Synthetic oligonucleotide; TTC chr11 5375323 5375344 5375328 5375323 -
catgtttagtgcttccttcagg

SEQ ID NO: 117142 - DNA, 22 bp, Artificial Sequence
  Synthetic oligonucleotide; TTT chr11 5375316 5375337 5375321 5375316 -
agtgcttccttcaggagctctt

SEQ ID NO: 117143 - DNA, 22 bp, Artificial Sequence
  Synthetic oligonucleotide; TTA chr11 5375315 5375336 5375320 5375315 -
gtgcttccttcaggagctcttt

SEQ ID NO: 117144 - DNA, 22 bp, Artificial Sequence
  Synthetic oligonucleotide; CTT chr11 5375309 5375330 5375314 5375309 -
ccttcaggagctcttttaggtc

SEQ ID NO: 117145 - DNA, 22 bp, Artificial Sequence
  Synthetic oligonucleotide; TTC chr11 5375308 5375329 5375313 5375308 -
cttcaggagctcttttaggtca

SEQ ID NO: 117146 - DNA, 22 bp, Artificial Sequence
  Synthetic oligonucleotide; CTT chr11 5375305 5375326 5375310 5375305 -
caggagctcttttaggtcaggc

SEQ ID NO: 117147 - DNA, 22 bp, Artificial Sequence
  Synthetic oligonucleotide; TTC chr11 5375304 5375325 5375309 5375304 -
aggagctcttttaggtcaggcc

SEQ ID NO: 117148 - DNA, 22 bp, Artificial Sequence
  Synthetic oligonucleotide; CTC chr11 5375296 5375317 5375301 5375296 -
ttttaggtcaggcctggtgatg

SEQ ID NO: 117149 - DNA, 22 bp, Artificial Sequence
  Synthetic oligonucleotide; CTT chr11 5375294 5375315 5375299 5375294 -
ttaggtcaggcctggtgatgac

SEQ ID NO: 117150 - DNA, 22 bp, Artificial Sequence
  Synthetic oligonucleotide; TTT chr11 5375293 5375314 5375298 5375293 -
taggtcaggcctggtgatgaca

SEQ ID NO: 117151 - DNA, 22 bp, Artificial Sequence
  Synthetic oligonucleotide; TTT chr11 5375292 5375313 5375297 5375292 -
aggtcaggcctggtgatgacaa

SEQ ID NO: 117152 - DNA, 22 bp, Artificial Sequence
  Synthetic oligonucleotide; TTA chr11 5375291 5375312 5375296 5375291 -
ggtcaggcctggtgatgacaaa

SEQ ID NO: 117153 - DNA, 22 bp, Artificial Sequence
  Synthetic oligonucleotide; CTG chr11 5375280 5375301 5375285 5375280 -
gtgatgacaaaatctctcagca

SEQ ID NO: 117154 - DNA, 22 bp, Artificial Sequence
  Synthetic oligonucleotide; CTC chr11 5375264 5375285 5375269 5375264 -
tcagcatttgcttgtctgtaaa

SEQ ID NO: 117155 - DNA, 22 bp, Artificial Sequence
  Synthetic oligonucleotide; CTC chr11 5375262 5375283 5375267 5375262 -
agcatttgcttgtctgtaaagt

SEQ ID NO: 117156 - DNA, 22 bp, Artificial Sequence
  Synthetic oligonucleotide; TTT chr11 5375255 5375276 5375260 5375255 -
gcttgtctgtaaagtattttat

SEQ ID NO: 117157 - DNA, 22 bp, Artificial Sequence
  Synthetic oligonucleotide; TTG chr11 5375254 5375275 5375259 5375254 -
cttgtctgtaaagtattttatt

SEQ ID NO: 117158 - DNA, 22 bp, Artificial Sequence
  Synthetic oligonucleotide; CTT chr11 5375251 5375272 5375256 5375251 -
gtctgtaaagtattttatttct

SEQ ID NO: 117159 - DNA, 22 bp, Artificial Sequence
  Synthetic oligonucleotide; TTG chr11 5375250 5375271 5375255 5375250 -
tctgtaaagtattttatttctc

SEQ ID NO: 117160 - DNA, 22 bp, Artificial Sequence
  Synthetic oligonucleotide; CTG chr11 5375246 5375267 5375251 5375246 -
taaagtattttatttctccttc

SEQ ID NO: 117161 - DNA, 22 bp, Artificial Sequence
  Synthetic oligonucleotide; TTT chr11 5375236 5375257 5375241 5375236 -
tatttctccttcacttatgaag

SEQ ID NO: 117162 - DNA, 22 bp, Artificial Sequence
  Synthetic oligonucleotide; TTT chr11 5375235 5375256 5375240 5375235 -
atttctccttcacttatgaagc

SEQ ID NO: 117163 - DNA, 22 bp, Artificial Sequence
  Synthetic oligonucleotide; TTA chr11 5375234 5375255 5375239 5375234 -
tttctccttcacttatgaagct

SEQ ID NO: 117164 - DNA, 22 bp, Artificial Sequence
  Synthetic oligonucleotide; TTT chr11 5375231 5375252 5375236 5375231 -
ctccttcacttatgaagcttag

SEQ ID NO: 117165 - DNA, 22 bp, Artificial Sequence
  Synthetic oligonucleotide; TTC chr11 5375230 5375251 5375235 5375230 -
tccttcacttatgaagcttagt

SEQ ID NO: 117166 - DNA, 22 bp, Artificial Sequence
  Synthetic oligonucleotide; CTC chr11 5375228 5375249 5375233 5375228 -
cttcacttatgaagcttagttt

SEQ ID NO: 117167 - DNA, 22 bp, Artificial Sequence
  Synthetic oligonucleotide; CTT chr11 5375225 5375246 5375230 5375225 -
cacttatgaagcttagtttggc

SEQ ID NO: 117168 - DNA, 22 bp, Artificial Sequence
  Synthetic oligonucleotide; TTC chr11 5375224 5375245 5375229 5375224 -
acttatgaagcttagtttggct

SEQ ID NO: 117169 - DNA, 22 bp, Artificial Sequence
  Synthetic oligonucleotide; CTT chr11 5375220 5375241 5375225 5375220 -
atgaagcttagtttggctggat

SEQ ID NO: 117170 - DNA, 22 bp, Artificial Sequence
  Synthetic oligonucleotide; TTA chr11 5375219 5375240 5375224 5375219 -
tgaagcttagtttggctggata

SEQ ID NO: 117171 - DNA, 22 bp, Artificial Sequence
  Synthetic oligonucleotide; CTT chr11 5375211 5375232 5375216 5375211 -
agtttggctggatattaaattc

SEQ ID NO: 117172 - DNA, 22 bp, Artificial Sequence
  Synthetic oligonucleotide; TTA chr11 5375210 5375231 5375215 5375210 -
gtttggctggatattaaattct

SEQ ID NO: 117173 - DNA, 22 bp, Artificial Sequence
  Synthetic oligonucleotide; TTT chr11 5375206 5375227 5375211 5375206 -
ggctggatattaaattctgtgt

SEQ ID NO: 117174 - DNA, 22 bp, Artificial Sequence
  Synthetic oligonucleotide; TTG chr11 5375205 5375226 5375210 5375205 -
gctggatattaaattctgtgtt

SEQ ID NO: 117175 - DNA, 22 bp, Artificial Sequence
  Synthetic oligonucleotide; CTG chr11 5375201 5375222 5375206 5375201 -
gatattaaattctgtgttgaaa

SEQ ID NO: 117176 - DNA, 22 bp, Artificial Sequence
  Synthetic oligonucleotide; TTA chr11 5375194 5375215 5375199 5375194 -
aattctgtgttgaaaattcttt

SEQ ID NO: 117177 - DNA, 22 bp, Artificial Sequence
  Synthetic oligonucleotide; TTC chr11 5375189 5375210 5375194 5375189 -
tgtgttgaaaattctttccttt

SEQ ID NO: 117178 - DNA, 22 bp, Artificial Sequence
  Synthetic oligonucleotide; CTG chr11 5375187 5375208 5375192 5375187 -
tgttgaaaattctttcctttaa

SEQ ID NO: 117179 - DNA, 22 bp, Artificial Sequence
  Synthetic oligonucleotide; TTG chr11 5375182 5375203 5375187 5375182 -
aaaattctttcctttaaggatg

SEQ ID NO: 117180 - DNA, 22 bp, Artificial Sequence
  Synthetic oligonucleotide; TTC chr11 5375175 5375196 5375180 5375175 -
tttcctttaaggatgttgaata

SEQ ID NO: 117181 - DNA, 22 bp, Artificial Sequence
  Synthetic oligonucleotide; CTT chr11 5375173 5375194 5375178 5375173 -
tcctttaaggatgttgaatatt

SEQ ID NO: 117182 - DNA, 22 bp, Artificial Sequence
  Synthetic oligonucleotide; TTT chr11 5375172 5375193 5375177 5375172 -
cctttaaggatgttgaatattg

SEQ ID NO: 117183 - DNA, 22 bp, Artificial Sequence
  Synthetic oligonucleotide; TTC chr11 5375171 5375192 5375176 5375171 -
ctttaaggatgttgaatattgg

SEQ ID NO: 117184 - DNA, 22 bp, Artificial Sequence
  Synthetic oligonucleotide; CTT chr11 5375168 5375189 5375173 5375168 -
taaggatgttgaatattggccc

SEQ ID NO: 117185 - DNA, 22 bp, Artificial Sequence
  Synthetic oligonucleotide; TTT chr11 5375167 5375188 5375172 5375167 -
aaggatgttgaatattggcccc

SEQ ID NO: 117186 - DNA, 22 bp, Artificial Sequence
  Synthetic oligonucleotide; TTA chr11 5375166 5375187 5375171 5375166 -
aggatgttgaatattggccccc

SEQ ID NO: 117187 - DNA, 22 bp, Artificial Sequence
  Synthetic oligonucleotide; TTG chr11 5375157 5375178 5375162 5375157 -
aatattggcccccactctcttc

SEQ ID NO: 117188 - DNA, 22 bp, Artificial Sequence
  Synthetic oligonucleotide; TTG chr11 5375150 5375171 5375155 5375150 -
gcccccactctcttctggcttg

SEQ ID NO: 117189 - DNA, 22 bp, Artificial Sequence
  Synthetic oligonucleotide; CTC chr11 5375140 5375161 5375145 5375140 -
tcttctggcttgtagagtttct

SEQ ID NO: 117190 - DNA, 22 bp, Artificial Sequence
  Synthetic oligonucleotide; CTC chr11 5375138 5375159 5375143 5375138 -
ttctggcttgtagagtttctgc

SEQ ID NO: 117191 - DNA, 22 bp, Artificial Sequence
  Synthetic oligonucleotide; CTT chr11 5375136 5375157 5375141 5375136 -
ctggcttgtagagtttctgcca

SEQ ID NO: 117192 - DNA, 22 bp, Artificial Sequence
  Synthetic oligonucleotide; TTC chr11 5375135 5375156 5375140 5375135 -
tggcttgtagagtttctgccaa

SEQ ID NO: 117193 - DNA, 22 bp, Artificial Sequence
  Synthetic oligonucleotide; CTG chr11 5375133 5375154 5375138 5375133 -
gcttgtagagtttctgccaaga

SEQ ID NO: 117194 - DNA, 22 bp, Artificial Sequence
  Synthetic oligonucleotide; CTT chr11 5375129 5375150 5375134 5375129 -
gtagagtttctgccaagagagc

SEQ ID NO: 117195 - DNA, 22 bp, Artificial Sequence
  Synthetic oligonucleotide; TTG chr11 5375128 5375149 5375133 5375128 -
tagagtttctgccaagagagct

SEQ ID NO: 117196 - DNA, 22 bp, Artificial Sequence
  Synthetic oligonucleotide; TTT chr11 5375120 5375141 5375125 5375120 -
ctgccaagagagctgctgttag

SEQ ID NO: 117197 - DNA, 22 bp, Artificial Sequence
  Synthetic oligonucleotide; TTC chr11 5375119 5375140 5375124 5375119 -
tgccaagagagctgctgttagt

SEQ ID NO: 117198 - DNA, 22 bp, Artificial Sequence
  Synthetic oligonucleotide; CTG chr11 5375117 5375138 5375122 5375117 -
ccaagagagctgctgttagtct

SEQ ID NO: 117199 - DNA, 22 bp, Artificial Sequence
  Synthetic oligonucleotide; CTG chr11 5375105 5375126 5375110 5375105 -
ctgttagtctgatgggcttccc

SEQ ID NO: 117200 - DNA, 22 bp, Artificial Sequence
  Synthetic oligonucleotide; CTG chr11 5375102 5375123 5375107 5375102 -
ttagtctgatgggcttcccttt

SEQ ID NO: 117201 - DNA, 22 bp, Artificial Sequence
  Synthetic oligonucleotide; TTA chr11 5375099 5375120 5375104 5375099 -
gtctgatgggcttccctttgtg

SEQ ID NO: 117202 - DNA, 22 bp, Artificial Sequence
  Synthetic oligonucleotide; CTG chr11 5375094 5375115 5375099 5375094 -
atgggcttccctttgtgggtaa

SEQ ID NO: 117203 - DNA, 22 bp, Artificial Sequence
  Synthetic oligonucleotide; CTT chr11 5375086 5375107 5375091 5375086 -
ccctttgtgggtaacccgacct

SEQ ID NO: 117204 - DNA, 22 bp, Artificial Sequence
  Synthetic oligonucleotide; TTC chr11 5375085 5375106 5375090 5375085 -
cctttgtgggtaacccgacctt

SEQ ID NO: 117205 - DNA, 22 bp, Artificial Sequence
  Synthetic oligonucleotide; CTT chr11 5375081 5375102 5375086 5375081 -
tgtgggtaacccgacctttctc

SEQ ID NO: 117206 - DNA, 22 bp, Artificial Sequence
  Synthetic oligonucleotide; TTT chr11 5375080 5375101 5375085 5375080 -
gtgggtaacccgacctttctct

SEQ ID NO: 117207 - DNA, 22 bp, Artificial Sequence
  Synthetic oligonucleotide; TTG chr11 5375079 5375100 5375084 5375079 -
tgggtaacccgacctttctctc

SEQ ID NO: 117208 - DNA, 22 bp, Artificial Sequence
  Synthetic oligonucleotide; CTT chr11 5375063 5375084 5375068 5375063 -
tctctctggctgcccttaacat

SEQ ID NO: 117209 - DNA, 22 bp, Artificial Sequence
  Synthetic oligonucleotide; TTT chr11 5375062 5375083 5375067 5375062 -
ctctctggctgcccttaacatt

SEQ ID NO: 117210 - DNA, 22 bp, Artificial Sequence
  Synthetic oligonucleotide; TTC chr11 5375061 5375082 5375066 5375061 -
tctctggctgcccttaacattt

SEQ ID NO: 117211 - DNA, 22 bp, Artificial Sequence
  Synthetic oligonucleotide; CTC chr11 5375059 5375080 5375064 5375059 -
tctggctgcccttaacattttt

SEQ ID NO: 117212 - DNA, 22 bp, Artificial Sequence
  Synthetic oligonucleotide; CTC chr11 5375057 5375078 5375062 5375057 -
tggctgcccttaacattttttc

SEQ ID NO: 117213 - DNA, 22 bp, Artificial Sequence
  Synthetic oligonucleotide; CTG chr11 5375055 5375076 5375060 5375055 -
gctgcccttaacattttttcct

SEQ ID NO: 117214 - DNA, 22 bp, Artificial Sequence
  Synthetic oligonucleotide; CTG chr11 5375051 5375072 5375056 5375051 -
cccttaacattttttccttcat

SEQ ID NO: 117215 - DNA, 22 bp, Artificial Sequence
  Synthetic oligonucleotide; CTT chr11 5375046 5375067 5375051 5375046 -
aacattttttccttcatttcaa

SEQ ID NO: 117216 - DNA, 22 bp, Artificial Sequence
  Synthetic oligonucleotide; TTA chr11 5375045 5375066 5375050 5375045 -
acattttttccttcatttcaac

SEQ ID NO: 117217 - DNA, 22 bp, Artificial Sequence
  Synthetic oligonucleotide; TTT chr11 5375039 5375060 5375044 5375039 -
tttccttcatttcaactttggt

SEQ ID NO: 117218 - DNA, 22 bp, Artificial Sequence
  Synthetic oligonucleotide; TTT chr11 5375038 5375059 5375043 5375038 -
ttccttcatttcaactttggtg

SEQ ID NO: 117219 - DNA, 22 bp, Artificial Sequence
  Synthetic oligonucleotide; TTT chr11 5375037 5375058 5375042 5375037 -
tccttcatttcaactttggtga

SEQ ID NO: 117220 - DNA, 22 bp, Artificial Sequence
  Synthetic oligonucleotide; TTT chr11 5375036 5375057 5375041 5375036 -
ccttcatttcaactttggtgaa

SEQ ID NO: 117221 - DNA, 22 bp, Artificial Sequence
  Synthetic oligonucleotide; TTC chr11 5375035 5375056 5375040 5375035 -
cttcatttcaactttggtgaat

SEQ ID NO: 117222 - DNA, 22 bp, Artificial Sequence
  Synthetic oligonucleotide; CTT chr11 5375032 5375053 5375037 5375032 -
catttcaactttggtgaatctg

SEQ ID NO: 117223 - DNA, 22 bp, Artificial Sequence
  Synthetic oligonucleotide; TTC chr11 5375031 5375052 5375036 5375031 -
atttcaactttggtgaatctga

SEQ ID NO: 117224 - DNA, 22 bp, Artificial Sequence
  Synthetic oligonucleotide; TTT chr11 5375027 5375048 5375032 5375027 -
caactttggtgaatctgacaat

SEQ ID NO: 117225 - DNA, 22 bp, Artificial Sequence
  Synthetic oligonucleotide; TTC chr11 5375026 5375047 5375031 5375026 -
aactttggtgaatctgacaatt

SEQ ID NO: 117226 - DNA, 22 bp, Artificial Sequence
  Synthetic oligonucleotide; CTT chr11 5375021 5375042 5375026 5375021 -
tggtgaatctgacaattatgtg

SEQ ID NO: 117227 - DNA, 22 bp, Artificial Sequence
  Synthetic oligonucleotide; TTT chr11 5375020 5375041 5375025 5375020 -
ggtgaatctgacaattatgtgt

SEQ ID NO: 117228 - DNA, 22 bp, Artificial Sequence
  Synthetic oligonucleotide; TTG chr11 5375019 5375040 5375024 5375019 -
gtgaatctgacaattatgtgtc

SEQ ID NO: 117229 - DNA, 22 bp, Artificial Sequence
  Synthetic oligonucleotide; CTG chr11 5375010 5375031 5375015 5375010 -
acaattatgtgtcttggagttg

SEQ ID NO: 117230 - DNA, 22 bp, Artificial Sequence
  Synthetic oligonucleotide; TTA chr11 5375003 5375024 5375008 5375003 -
tgtgtcttggagttgctcttct

SEQ ID NO: 117231 - DNA, 22 bp, Artificial Sequence
  Synthetic oligonucleotide; CTT chr11 5374995 5375016 5375000 5374995 -
ggagttgctcttctcgaggagt

SEQ ID NO: 117232 - DNA, 22 bp, Artificial Sequence
  Synthetic oligonucleotide; TTG chr11 5374994 5375015 5374999 5374994 -
gagttgctcttctcgaggagta

SEQ ID NO: 117233 - DNA, 22 bp, Artificial Sequence
  Synthetic oligonucleotide; TTG chr11 5374988 5375009 5374993 5374988 -
ctcttctcgaggagtatgtttg

SEQ ID NO: 117234 - DNA, 22 bp, Artificial Sequence
  Synthetic oligonucleotide; CTC chr11 5374985 5375006 5374990 5374985 -
ttctcgaggagtatgtttgtgg

SEQ ID NO: 117235 - DNA, 22 bp, Artificial Sequence
  Synthetic oligonucleotide; CTT chr11 5374983 5375004 5374988 5374983 -
ctcgaggagtatgtttgtggcg

SEQ ID NO: 117236 - DNA, 22 bp, Artificial Sequence
  Synthetic oligonucleotide; TTC chr11 5374982 5375003 5374987 5374982 -
tcgaggagtatgtttgtggcgt

SEQ ID NO: 117237 - DNA, 22 bp, Artificial Sequence
  Synthetic oligonucleotide; CTC chr11 5374980 5375001 5374985 5374980 -
gaggagtatgtttgtggcgttc

SEQ ID NO: 117238 - DNA, 22 bp, Artificial Sequence
  Synthetic oligonucleotide; TTT chr11 5374967 5374988 5374972 5374967 -
gtggcgttctctgtatttcctg

SEQ ID NO: 117239 - DNA, 22 bp, Artificial Sequence
  Synthetic oligonucleotide; TTG chr11 5374966 5374987 5374971 5374966 -
tggcgttctctgtatttcctga

SEQ ID NO: 117240 - DNA, 22 bp, Artificial Sequence
  Synthetic oligonucleotide; TTC chr11 5374958 5374979 5374963 5374958 -
tctgtatttcctgaatctgaat

SEQ ID NO: 117241 - DNA, 22 bp, Artificial Sequence
  Synthetic oligonucleotide; CTC chr11 5374956 5374977 5374961 5374956 -
tgtatttcctgaatctgaatgt

SEQ ID NO: 117242 - DNA, 22 bp, Artificial Sequence
  Synthetic oligonucleotide; CTG chr11 5374954 5374975 5374959 5374954 -
tatttcctgaatctgaatgttg

SEQ ID NO: 117243 - DNA, 22 bp, Artificial Sequence
  Synthetic oligonucleotide; TTT chr11 5374949 5374970 5374954 5374949 -
cctgaatctgaatgttggcctg

SEQ ID NO: 117244 - DNA, 22 bp, Artificial Sequence
  Synthetic oligonucleotide; TTC chr11 5374948 5374969 5374953 5374948 -
ctgaatctgaatgttggcctgc

SEQ ID NO: 117245 - DNA, 22 bp, Artificial Sequence
  Synthetic oligonucleotide; CTG chr11 5374945 5374966 5374950 5374945 -
aatctgaatgttggcctgcctt

SEQ ID NO: 117246 - DNA, 22 bp, Artificial Sequence
  Synthetic oligonucleotide; CTG chr11 5374939 5374960 5374944 5374939 -
aatgttggcctgccttgctaga

SEQ ID NO: 117247 - DNA, 22 bp, Artificial Sequence
  Synthetic oligonucleotide; TTG chr11 5374932 5374953 5374937 5374932 -
gcctgccttgctagattgggga

SEQ ID NO: 117248 - DNA, 22 bp, Artificial Sequence
  Synthetic oligonucleotide; CTG chr11 5374927 5374948 5374932 5374927 -
ccttgctagattggggaagttc

SEQ ID NO: 117249 - DNA, 22 bp, Artificial Sequence
  Synthetic oligonucleotide; CTT chr11 5374923 5374944 5374928 5374923 -
gctagattggggaagttctcct

SEQ ID NO: 117250 - DNA, 22 bp, Artificial Sequence
  Synthetic oligonucleotide; TTG chr11 5374922 5374943 5374927 5374922 -
ctagattggggaagttctcctg

SEQ ID NO: 117251 - DNA, 22 bp, Artificial Sequence
  Synthetic oligonucleotide; CTA chr11 5374919 5374940 5374924 5374919 -
gattggggaagttctcctggat

SEQ ID NO: 117252 - DNA, 22 bp, Artificial Sequence
  Synthetic oligonucleotide; TTG chr11 5374914 5374935 5374919 5374914 -
gggaagttctcctggataatat

SEQ ID NO: 117253 - DNA, 22 bp, Artificial Sequence
  Synthetic oligonucleotide; TTC chr11 5374905 5374926 5374910 5374905 -
tcctggataatatcctgcagag

SEQ ID NO: 117254 - DNA, 22 bp, Artificial Sequence
  Synthetic oligonucleotide; CTC chr11 5374903 5374924 5374908 5374903 -
ctggataatatcctgcagagtg

SEQ ID NO: 117255 - DNA, 22 bp, Artificial Sequence
  Synthetic oligonucleotide; CTG chr11 5374900 5374921 5374905 5374900 -
gataatatcctgcagagtgttt

SEQ ID NO: 117256 - DNA, 22 bp, Artificial Sequence
  Synthetic oligonucleotide; CTG chr11 5374888 5374909 5374893 5374888 -
cagagtgttttccaacttggtt

SEQ ID NO: 117257 - DNA, 22 bp, Artificial Sequence
  Synthetic oligonucleotide; TTT chr11 5374878 5374899 5374883 5374878 -
tccaacttggttcgattctccc

SEQ ID NO: 117258 - DNA, 22 bp, Artificial Sequence
  Synthetic oligonucleotide; TTT chr11 5374877 5374898 5374882 5374877 -
ccaacttggttcgattctcccc

SEQ ID NO: 117259 - DNA, 22 bp, Artificial Sequence
  Synthetic oligonucleotide; TTC chr11 5374876 5374897 5374881 5374876 -
caacttggttcgattctccccg

SEQ ID NO: 117260 - DNA, 22 bp, Artificial Sequence
  Synthetic oligonucleotide; CTT chr11 5374870 5374891 5374875 5374870 -
ggttcgattctccccgtcactt

SEQ ID NO: 117261 - DNA, 22 bp, Artificial Sequence
  Synthetic oligonucleotide; TTG chr11 5374869 5374890 5374874 5374869 -
gttcgattctccccgtcacttt

SEQ ID NO: 117262 - DNA, 22 bp, Artificial Sequence
  Synthetic oligonucleotide; TTC chr11 5374865 5374886 5374870 5374865 -
gattctccccgtcactttcagg

SEQ ID NO: 117263 - DNA, 22 bp, Artificial Sequence
  Synthetic oligonucleotide; TTC chr11 5374860 5374881 5374865 5374860 -
tccccgtcactttcaggtacac

SEQ ID NO: 117264 - DNA, 22 bp, Artificial Sequence
  Synthetic oligonucleotide; CTC chr11 5374858 5374879 5374863 5374858 -
cccgtcactttcaggtacacca

SEQ ID NO: 117265 - DNA, 22 bp, Artificial Sequence
  Synthetic oligonucleotide; CTT chr11 5374848 5374869 5374853 5374848 -
tcaggtacaccaatcagaccta

SEQ ID NO: 117266 - DNA, 22 bp, Artificial Sequence
  Synthetic oligonucleotide; TTT chr11 5374847 5374868 5374852 5374847 -
caggtacaccaatcagacctag

SEQ ID NO: 117267 - DNA, 22 bp, Artificial Sequence
  Synthetic oligonucleotide; TTC chr11 5374846 5374867 5374851 5374846 -
aggtacaccaatcagacctaga

SEQ ID NO: 117268 - DNA, 22 bp, Artificial Sequence
  Synthetic oligonucleotide; CTA chr11 5374826 5374847 5374831 5374826 -
gatttgatcttttcacatagtc

SEQ ID NO: 117269 - DNA, 22 bp, Artificial Sequence
  Synthetic oligonucleotide; TTT chr11 5374821 5374842 5374826 5374821 -
gatcttttcacatagtcccata

SEQ ID NO: 117270 - DNA, 22 bp, Artificial Sequence
  Synthetic oligonucleotide; TTG chr11 5374820 5374841 5374825 5374820 -
atcttttcacatagtcccatat

SEQ ID NO: 117271 - DNA, 22 bp, Artificial Sequence
  Synthetic oligonucleotide; CTT chr11 5374815 5374836 5374820 5374815 -
ttcacatagtcccatatttctt

SEQ ID NO: 117272 - DNA, 22 bp, Artificial Sequence
  Synthetic oligonucleotide; TTT chr11 5374814 5374835 5374819 5374814 -
tcacatagtcccatatttcttg

SEQ ID NO: 117273 - DNA, 22 bp, Artificial Sequence
  Synthetic oligonucleotide; TTT chr11 5374813 5374834 5374818 5374813 -
cacatagtcccatatttcttgg

SEQ ID NO: 117274 - DNA, 22 bp, Artificial Sequence
  Synthetic oligonucleotide; TTC chr11 5374812 5374833 5374817 5374812 -
acatagtcccatatttcttgga

SEQ ID NO: 117275 - DNA, 22 bp, Artificial Sequence
  Synthetic oligonucleotide; TTT chr11 5374796 5374817 5374801 5374796 -
cttggaggctttgttcatttct

SEQ ID NO: 117276 - DNA, 22 bp, Artificial Sequence
  Synthetic oligonucleotide; TTC chr11 5374795 5374816 5374800 5374795 -
ttggaggctttgttcatttctt

SEQ ID NO: 117277 - DNA, 22 bp, Artificial Sequence
  Synthetic oligonucleotide; CTT chr11 5374793 5374814 5374798 5374793 -
ggaggctttgttcatttctttt

SEQ ID NO: 117278 - DNA, 22 bp, Artificial Sequence
  Synthetic oligonucleotide; TTG chr11 5374792 5374813 5374797 5374792 -
gaggctttgttcatttcttttt

SEQ ID NO: 117279 - DNA, 22 bp, Artificial Sequence
  Synthetic oligonucleotide; CTT chr11 5374785 5374806 5374790 5374785 -
tgttcatttctttttattcttt

SEQ ID NO: 117280 - DNA, 22 bp, Artificial Sequence
  Synthetic oligonucleotide; TTT chr11 5374784 5374805 5374789 5374784 -
gttcatttctttttattctttt

SEQ ID NO: 117281 - DNA, 22 bp, Artificial Sequence
  Synthetic oligonucleotide; TTG chr11 5374783 5374804 5374788 5374783 -
ttcatttctttttattcttttt

SEQ ID NO: 117282 - DNA, 22 bp, Artificial Sequence
  Synthetic oligonucleotide; TTC chr11 5374780 5374801 5374785 5374780 -
atttctttttattcttttttct

SEQ ID NO: 117283 - DNA, 22 bp, Artificial Sequence
  Synthetic oligonucleotide; TTT chr11 5374776 5374797 5374781 5374776 -
ctttttattcttttttctctaa

SEQ ID NO: 117284 - DNA, 22 bp, Artificial Sequence
  Synthetic oligonucleotide; TTC chr11 5374775 5374796 5374780 5374775 -
tttttattcttttttctctaaa

SEQ ID NO: 117285 - DNA, 22 bp, Artificial Sequence
  Synthetic oligonucleotide; CTT chr11 5374773 5374794 5374778 5374773 -
tttattcttttttctctaaact

SEQ ID NO: 117286 - DNA, 22 bp, Artificial Sequence
  Synthetic oligonucleotide; TTT chr11 5374772 5374793 5374777 5374772 -
ttattcttttttctctaaactt

SEQ ID NO: 117287 - DNA, 22 bp, Artificial Sequence
  Synthetic oligonucleotide; TTT chr11 5374771 5374792 5374776 5374771 -
tattcttttttctctaaacttc

SEQ ID NO: 117288 - DNA, 22 bp, Artificial Sequence
  Synthetic oligonucleotide; TTT chr11 5374770 5374791 5374775 5374770 -
attcttttttctctaaacttcc

SEQ ID NO: 117289 - DNA, 22 bp, Artificial Sequence
  Synthetic oligonucleotide; TTA chr11 5374769 5374790 5374774 5374769 -
ttcttttttctctaaacttccc

SEQ ID NO: 117290 - DNA, 22 bp, Artificial Sequence
  Synthetic oligonucleotide; TTC chr11 5374766 5374787 5374771 5374766 -
ttttttctctaaacttcccttc

SEQ ID NO: 117291 - DNA, 22 bp, Artificial Sequence
  Synthetic oligonucleotide; CTT chr11 5374764 5374785 5374769 5374764 -
ttttctctaaacttcccttctc

SEQ ID NO: 117292 - DNA, 22 bp, Artificial Sequence
  Synthetic oligonucleotide; TTT chr11 5374763 5374784 5374768 5374763 -
tttctctaaacttcccttctcg

SEQ ID NO: 117293 - DNA, 22 bp, Artificial Sequence
  Synthetic oligonucleotide; TTT chr11 5374762 5374783 5374767 5374762 -
ttctctaaacttcccttctcgc

SEQ ID NO: 117294 - DNA, 22 bp, Artificial Sequence
  Synthetic oligonucleotide; TTT chr11 5374761 5374782 5374766 5374761 -
tctctaaacttcccttctcgct

SEQ ID NO: 117295 - DNA, 22 bp, Artificial Sequence
  Synthetic oligonucleotide; TTT chr11 5374760 5374781 5374765 5374760 -
ctctaaacttcccttctcgctt

SEQ ID NO: 117296 - DNA, 22 bp, Artificial Sequence
  Synthetic oligonucleotide; TTC chr11 5374759 5374780 5374764 5374759 -
tctaaacttcccttctcgcttc

SEQ ID NO: 117297 - DNA, 22 bp, Artificial Sequence
  Synthetic oligonucleotide; CTC chr11 5374757 5374778 5374762 5374757 -
taaacttcccttctcgcttcat

SEQ ID NO: 117298 - DNA, 22 bp, Artificial Sequence
  Synthetic oligonucleotide; CTA chr11 5374755 5374776 5374760 5374755 -
aacttcccttctcgcttcattt

SEQ ID NO: 117299 - DNA, 22 bp, Artificial Sequence
  Synthetic oligonucleotide; CTT chr11 5374750 5374771 5374755 5374750 -
cccttctcgcttcatttcattt

SEQ ID NO: 117300 - DNA, 22 bp, Artificial Sequence
  Synthetic oligonucleotide; TTC chr11 5374749 5374770 5374754 5374749 -
ccttctcgcttcatttcattta

SEQ ID NO: 117301 - DNA, 22 bp, Artificial Sequence
  Synthetic oligonucleotide; CTT chr11 5374745 5374766 5374750 5374745 -
ctcgcttcatttcatttatttc

SEQ ID NO: 117302 - DNA, 22 bp, Artificial Sequence
  Synthetic oligonucleotide; TTC chr11 5374744 5374765 5374749 5374744 -
tcgcttcatttcatttatttca

SEQ ID NO: 117303 - DNA, 22 bp, Artificial Sequence
  Synthetic oligonucleotide; CTC chr11 5374742 5374763 5374747 5374742 -
gcttcatttcatttatttcatc

SEQ ID NO: 117304 - DNA, 22 bp, Artificial Sequence
  Synthetic oligonucleotide; CTT chr11 5374738 5374759 5374743 5374738 -
catttcatttatttcatcttcc

SEQ ID NO: 117305 - DNA, 22 bp, Artificial Sequence
  Synthetic oligonucleotide; TTC chr11 5374737 5374758 5374742 5374737 -
atttcatttatttcatcttcca

SEQ ID NO: 117306 - DNA, 22 bp, Artificial Sequence
  Synthetic oligonucleotide; TTT chr11 5374733 5374754 5374738 5374733 -
catttatttcatcttccatcac

SEQ ID NO: 117307 - DNA, 22 bp, Artificial Sequence
  Synthetic oligonucleotide; TTC chr11 5374732 5374753 5374737 5374732 -
atttatttcatcttccatcact

SEQ ID NO: 117308 - DNA, 22 bp, Artificial Sequence
  Synthetic oligonucleotide; TTT chr11 5374728 5374749 5374733 5374728 -
atttcatcttccatcactgata

SEQ ID NO: 117309 - DNA, 22 bp, Artificial Sequence
  Synthetic oligonucleotide; TTA chr11 5374727 5374748 5374732 5374727 -
tttcatcttccatcactgatac

SEQ ID NO: 117310 - DNA, 22 bp, Artificial Sequence
  Synthetic oligonucleotide; TTT chr11 5374724 5374745 5374729 5374724 -
catcttccatcactgataccct

SEQ ID NO: 117311 - DNA, 22 bp, Artificial Sequence
  Synthetic oligonucleotide; TTC chr11 5374723 5374744 5374728 5374723 -
atcttccatcactgataccctt

SEQ ID NO: 117312 - DNA, 22 bp, Artificial Sequence
  Synthetic oligonucleotide; CTT chr11 5374718 5374739 5374723 5374718 -
ccatcactgataccctttcttc

SEQ ID NO: 117313 - DNA, 22 bp, Artificial Sequence
  Synthetic oligonucleotide; TTC chr11 5374717 5374738 5374722 5374717 -
catcactgataccctttcttcc

SEQ ID NO: 117314 - DNA, 22 bp, Artificial Sequence
  Synthetic oligonucleotide; CTG chr11 5374709 5374730 5374714 5374709 -
ataccctttcttccagttgatc

SEQ ID NO: 117315 - DNA, 22 bp, Artificial Sequence
  Synthetic oligonucleotide; CTT chr11 5374701 5374722 5374706 5374701 -
tcttccagttgatcgcatcagc

SEQ ID NO: 117316 - DNA, 22 bp, Artificial Sequence
  Synthetic oligonucleotide; TTT chr11 5374700 5374721 5374705 5374700 -
cttccagttgatcgcatcagct

SEQ ID NO: 117317 - DNA, 22 bp, Artificial Sequence
  Synthetic oligonucleotide; TTC chr11 5374699 5374720 5374704 5374699 -
ttccagttgatcgcatcagctc

SEQ ID NO: 117318 - DNA, 22 bp, Artificial Sequence
  Synthetic oligonucleotide; CTT chr11 5374697 5374718 5374702 5374697 -
ccagttgatcgcatcagctcct

SEQ ID NO: 117319 - DNA, 22 bp, Artificial Sequence
  Synthetic oligonucleotide; TTC chr11 5374696 5374717 5374701 5374696 -
cagttgatcgcatcagctcctg

SEQ ID NO: 117320 - DNA, 22 bp, Artificial Sequence
  Synthetic oligonucleotide; TTG chr11 5374690 5374711 5374695 5374690 -
atcgcatcagctcctgaggctt

SEQ ID NO: 117321 - DNA, 22 bp, Artificial Sequence
  Synthetic oligonucleotide; CTC chr11 5374677 5374698 5374682 5374677 -
ctgaggcttctccattcttcac

SEQ ID NO: 117322 - DNA, 22 bp, Artificial Sequence
  Synthetic oligonucleotide; CTG chr11 5374674 5374695 5374679 5374674 -
aggcttctccattcttcacgtc

SEQ ID NO: 117323 - DNA, 22 bp, Artificial Sequence
  Synthetic oligonucleotide; CTT chr11 5374668 5374689 5374673 5374668 -
ctccattcttcacgtcattctc

SEQ ID NO: 117324 - DNA, 22 bp, Artificial Sequence
  Synthetic oligonucleotide; TTC chr11 5374667 5374688 5374672 5374667 -
tccattcttcacgtcattctcg

SEQ ID NO: 117325 - DNA, 22 bp, Artificial Sequence
  Synthetic oligonucleotide; CTC chr11 5374665 5374686 5374670 5374665 -
cattcttcacgtcattctcgag

SEQ ID NO: 117326 - DNA, 22 bp, Artificial Sequence
  Synthetic oligonucleotide; TTC chr11 5374660 5374681 5374665 5374660 -
ttcacgtcattctcgagccttg

SEQ ID NO: 117327 - DNA, 22 bp, Artificial Sequence
  Synthetic oligonucleotide; CTT chr11 5374658 5374679 5374663 5374658 -
cacgtcattctcgagccttggc

SEQ ID NO: 117328 - DNA, 22 bp, Artificial Sequence
  Synthetic oligonucleotide; TTC chr11 5374657 5374678 5374662 5374657 -
acgtcattctcgagccttggct

SEQ ID NO: 117329 - DNA, 22 bp, Artificial Sequence
  Synthetic oligonucleotide; TTC chr11 5374648 5374669 5374653 5374648 -
tcgagccttggctttcagctcc

SEQ ID NO: 117330 - DNA, 22 bp, Artificial Sequence
  Synthetic oligonucleotide; CTC chr11 5374646 5374667 5374651 5374646 -
gagccttggctttcagctccat

SEQ ID NO: 117331 - DNA, 22 bp, Artificial Sequence
  Synthetic oligonucleotide; CTT chr11 5374639 5374660 5374644 5374639 -
ggctttcagctccatcagctcc

SEQ ID NO: 117332 - DNA, 22 bp, Artificial Sequence
  Synthetic oligonucleotide; TTG chr11 5374638 5374659 5374643 5374638 -
gctttcagctccatcagctcct

SEQ ID NO: 117333 - DNA, 22 bp, Artificial Sequence
  Synthetic oligonucleotide; CTT chr11 5374634 5374655 5374639 5374634 -
tcagctccatcagctcctttaa

SEQ ID NO: 117334 - DNA, 22 bp, Artificial Sequence
  Synthetic oligonucleotide; TTT chr11 5374633 5374654 5374638 5374633 -
cagctccatcagctcctttaag

SEQ ID NO: 117335 - DNA, 22 bp, Artificial Sequence
  Synthetic oligonucleotide; TTC chr11 5374632 5374653 5374637 5374632 -
agctccatcagctcctttaagc

SEQ ID NO: 117336 - DNA, 22 bp, Artificial Sequence
  Synthetic oligonucleotide; CTC chr11 5374627 5374648 5374632 5374627 -
catcagctcctttaagcacttc

SEQ ID NO: 117337 - DNA, 22 bp, Artificial Sequence
  Synthetic oligonucleotide; CTC chr11 5374618 5374639 5374623 5374618 -
ctttaagcacttctctgtattg

SEQ ID NO: 117338 - DNA, 22 bp, Artificial Sequence
  Synthetic oligonucleotide; CTT chr11 5374615 5374636 5374620 5374615 -
taagcacttctctgtattggtt

SEQ ID NO: 117339 - DNA, 22 bp, Artificial Sequence
  Synthetic oligonucleotide; TTT chr11 5374614 5374635 5374619 5374614 -
aagcacttctctgtattggtta

SEQ ID NO: 117340 - DNA, 22 bp, Artificial Sequence
  Synthetic oligonucleotide; TTA chr11 5374613 5374634 5374618 5374613 -
agcacttctctgtattggttat

SEQ ID NO: 117341 - DNA, 22 bp, Artificial Sequence
  Synthetic oligonucleotide; CTT chr11 5374606 5374627 5374611 5374606 -
ctctgtattggttattctagtt

SEQ ID NO: 117342 - DNA, 22 bp, Artificial Sequence
  Synthetic oligonucleotide; TTC chr11 5374605 5374626 5374610 5374605 -
tctgtattggttattctagtta

SEQ ID NO: 117343 - DNA, 22 bp, Artificial Sequence
  Synthetic oligonucleotide; CTC chr11 5374603 5374624 5374608 5374603 -
tgtattggttattctagttata

SEQ ID NO: 117344 - DNA, 22 bp, Artificial Sequence
  Synthetic oligonucleotide; CTG chr11 5374601 5374622 5374606 5374601 -
tattggttattctagttataca

SEQ ID NO: 117345 - DNA, 22 bp, Artificial Sequence
  Synthetic oligonucleotide; TTG chr11 5374596 5374617 5374601 5374596 -
gttattctagttatacattcat

SEQ ID NO: 117346 - DNA, 22 bp, Artificial Sequence
  Synthetic oligonucleotide; TTA chr11 5374592 5374613 5374597 5374592 -
ttctagttatacattcatctaa

SEQ ID NO: 117347 - DNA, 22 bp, Artificial Sequence
  Synthetic oligonucleotide; TTC chr11 5374589 5374610 5374594 5374589 -
tagttatacattcatctaaatt

SEQ ID NO: 117348 - DNA, 22 bp, Artificial Sequence
  Synthetic oligonucleotide; CTA chr11 5374587 5374608 5374592 5374587 -
gttatacattcatctaaatttt

SEQ ID NO: 117349 - DNA, 22 bp, Artificial Sequence
  Synthetic oligonucleotide; TTA chr11 5374583 5374604 5374588 5374583 -
tacattcatctaaatttttttt

SEQ ID NO: 117350 - DNA, 22 bp, Artificial Sequence
  Synthetic oligonucleotide; TTC chr11 5374576 5374597 5374581 5374576 -
atctaaattttttttcaaagtt

SEQ ID NO: 117351 - DNA, 22 bp, Artificial Sequence
  Synthetic oligonucleotide; CTA chr11 5374571 5374592 5374576 5374571 -
aattttttttcaaagtttttat

SEQ ID NO: 117352 - DNA, 22 bp, Artificial Sequence
  Synthetic oligonucleotide; TTT chr11 5374566 5374587 5374571 5374566 -
tttttcaaagtttttatcttct

SEQ ID NO: 117353 - DNA, 22 bp, Artificial Sequence
  Synthetic oligonucleotide; TTT chr11 5374565 5374586 5374570 5374565 -
ttttcaaagtttttatcttctt

SEQ ID NO: 117354 - DNA, 22 bp, Artificial Sequence
  Synthetic oligonucleotide; TTT chr11 5374564 5374585 5374569 5374564 -
tttcaaagtttttatcttcttt

SEQ ID NO: 117355 - DNA, 22 bp, Artificial Sequence
  Synthetic oligonucleotide; TTT chr11 5374563 5374584 5374568 5374563 -
ttcaaagtttttatcttctttg

SEQ ID NO: 117356 - DNA, 22 bp, Artificial Sequence
  Synthetic oligonucleotide; TTT chr11 5374562 5374583 5374567 5374562 -
tcaaagtttttatcttctttgc

SEQ ID NO: 117357 - DNA, 22 bp, Artificial Sequence
  Synthetic oligonucleotide; TTT chr11 5374561 5374582 5374566 5374561 -
caaagtttttatcttctttgcc

SEQ ID NO: 117358 - DNA, 22 bp, Artificial Sequence
  Synthetic oligonucleotide; TTC chr11 5374560 5374581 5374565 5374560 -
aaagtttttatcttctttgcct

SEQ ID NO: 117359 - DNA, 22 bp, Artificial Sequence
  Synthetic oligonucleotide; TTT chr11 5374553 5374574 5374558 5374553 -
ttatcttctttgcctttggttt

SEQ ID NO: 117360 - DNA, 22 bp, Artificial Sequence
  Synthetic oligonucleotide; TTT chr11 5374552 5374573 5374557 5374552 -
tatcttctttgcctttggtttg

SEQ ID NO: 117361 - DNA, 22 bp, Artificial Sequence
  Synthetic oligonucleotide; TTT chr11 5374551 5374572 5374556 5374551 -
atcttctttgcctttggtttga

SEQ ID NO: 117362 - DNA, 22 bp, Artificial Sequence
  Synthetic oligonucleotide; TTA chr11 5374550 5374571 5374555 5374550 -
tcttctttgcctttggtttgaa

SEQ ID NO: 117363 - DNA, 22 bp, Artificial Sequence
  Synthetic oligonucleotide; CTT chr11 5374546 5374567 5374551 5374546 -
ctttgcctttggtttgaatttc

SEQ ID NO: 117364 - DNA, 22 bp, Artificial Sequence
  Synthetic oligonucleotide; TTC chr11 5374545 5374566 5374550 5374545 -
tttgcctttggtttgaatttcc

SEQ ID NO: 117365 - DNA, 22 bp, Artificial Sequence
  Synthetic oligonucleotide; CTT chr11 5374543 5374564 5374548 5374543 -
tgcctttggtttgaatttcctc

SEQ ID NO: 117366 - DNA, 22 bp, Artificial Sequence
  Synthetic oligonucleotide; TTT chr11 5374542 5374563 5374547 5374542 -
gcctttggtttgaatttcctcc

SEQ ID NO: 117367 - DNA, 22 bp, Artificial Sequence
  Synthetic oligonucleotide; TTG chr11 5374541 5374562 5374546 5374541 -
cctttggtttgaatttcctcct

SEQ ID NO: 117368 - DNA, 22 bp, Artificial Sequence
  Synthetic oligonucleotide; CTT chr11 5374537 5374558 5374542 5374537 -
tggtttgaatttcctcctgtag

SEQ ID NO: 117369 - DNA, 22 bp, Artificial Sequence
  Synthetic oligonucleotide; TTT chr11 5374536 5374557 5374541 5374536 -
ggtttgaatttcctcctgtagc

SEQ ID NO: 117370 - DNA, 22 bp, Artificial Sequence
  Synthetic oligonucleotide; TTG chr11 5374535 5374556 5374540 5374535 -
gtttgaatttcctcctgtagct

SEQ ID NO: 117371 - DNA, 22 bp, Artificial Sequence
  Synthetic oligonucleotide; TTT chr11 5374531 5374552 5374536 5374531 -
gaatttcctcctgtagctcgga

SEQ ID NO: 117372 - DNA, 22 bp, Artificial Sequence
  Synthetic oligonucleotide; TTG chr11 5374530 5374551 5374535 5374530 -
aatttcctcctgtagctcggag

SEQ ID NO: 117373 - DNA, 22 bp, Artificial Sequence
  Synthetic oligonucleotide; TTT chr11 5374525 5374546 5374530 5374525 -
cctcctgtagctcggagtagtt

SEQ ID NO: 117374 - DNA, 22 bp, Artificial Sequence
  Synthetic oligonucleotide; TTC chr11 5374524 5374545 5374529 5374524 -
ctcctgtagctcggagtagttt

SEQ ID NO: 117375 - DNA, 22 bp, Artificial Sequence
  Synthetic oligonucleotide; CTC chr11 5374521 5374542 5374526 5374521 -
ctgtagctcggagtagtttcat

SEQ ID NO: 117376 - DNA, 22 bp, Artificial Sequence
  Synthetic oligonucleotide; CTG chr11 5374518 5374539 5374523 5374518 -
tagctcggagtagtttcatcgt

SEQ ID NO: 117377 - DNA, 22 bp, Artificial Sequence
  Synthetic oligonucleotide; CTC chr11 5374512 5374533 5374517 5374512 -
ggagtagtttcatcgtctgaag

SEQ ID NO: 117378 - DNA, 22 bp, Artificial Sequence
  Synthetic oligonucleotide; TTT chr11 5374502 5374523 5374507 5374502 -
catcgtctgaagtcttcttctc

SEQ ID NO: 117379 - DNA, 22 bp, Artificial Sequence
  Synthetic oligonucleotide; TTC chr11 5374501 5374522 5374506 5374501 -
atcgtctgaagtcttcttctct

SEQ ID NO: 117380 - DNA, 22 bp, Artificial Sequence
  Synthetic oligonucleotide; CTG chr11 5374493 5374514 5374498 5374493 -
aagtcttcttctctcagctcgt

SEQ ID NO: 117381 - DNA, 22 bp, Artificial Sequence
  Synthetic oligonucleotide; CTT chr11 5374486 5374507 5374491 5374486 -
cttctctcagctcgtcaaagtc

SEQ ID NO: 117382 - DNA, 22 bp, Artificial Sequence
  Synthetic oligonucleotide; TTC chr11 5374485 5374506 5374490 5374485 -
ttctctcagctcgtcaaagtca

SEQ ID NO: 117383 - DNA, 22 bp, Artificial Sequence
  Synthetic oligonucleotide; CTT chr11 5374483 5374504 5374488 5374483 -
ctctcagctcgtcaaagtcatt

SEQ ID NO: 117384 - DNA, 22 bp, Artificial Sequence
  Synthetic oligonucleotide; TTC chr11 5374482 5374503 5374487 5374482 -
tctcagctcgtcaaagtcattc

SEQ ID NO: 117385 - DNA, 22 bp, Artificial Sequence
  Synthetic oligonucleotide; CTC chr11 5374480 5374501 5374485 5374480 -
tcagctcgtcaaagtcattctc

SEQ ID NO: 117386 - DNA, 22 bp, Artificial Sequence
  Synthetic oligonucleotide; CTC chr11 5374478 5374499 5374483 5374478 -
agctcgtcaaagtcattctcca

SEQ ID NO: 117387 - DNA, 22 bp, Artificial Sequence
  Synthetic oligonucleotide; CTC chr11 5374473 5374494 5374478 5374473 -
gtcaaagtcattctccatccag

SEQ ID NO: 117388 - DNA, 22 bp, Artificial Sequence
  Synthetic oligonucleotide; TTC chr11 5374460 5374481 5374465 5374460 -
tccatccagctttgttccgttg

SEQ ID NO: 117389 - DNA, 22 bp, Artificial Sequence
  Synthetic oligonucleotide; CTC chr11 5374458 5374479 5374463 5374458 -
catccagctttgttccgttgct

SEQ ID NO: 117390 - DNA, 22 bp, Artificial Sequence
  Synthetic oligonucleotide; CTT chr11 5374448 5374469 5374453 5374448 -
tgttccgttgctggtgaggaac

SEQ ID NO: 117391 - DNA, 22 bp, Artificial Sequence
  Synthetic oligonucleotide; TTT chr11 5374447 5374468 5374452 5374447 -
gttccgttgctggtgaggaact

SEQ ID NO: 117392 - DNA, 22 bp, Artificial Sequence
  Synthetic oligonucleotide; TTG chr11 5374446 5374467 5374451 5374446 -
ttccgttgctggtgaggaactg

SEQ ID NO: 117393 - DNA, 22 bp, Artificial Sequence
  Synthetic oligonucleotide; TTC chr11 5374443 5374464 5374448 5374443 -
cgttgctggtgaggaactgctt

SEQ ID NO: 117394 - DNA, 22 bp, Artificial Sequence
  Synthetic oligonucleotide; TTG chr11 5374438 5374459 5374443 5374438 -
ctggtgaggaactgctttcctt

SEQ ID NO: 117395 - DNA, 22 bp, Artificial Sequence
  Synthetic oligonucleotide; CTG chr11 5374435 5374456 5374440 5374435 -
gtgaggaactgctttcctttgg

SEQ ID NO: 117396 - DNA, 22 bp, Artificial Sequence
  Synthetic oligonucleotide; CTG chr11 5374424 5374445 5374429 5374424 -
ctttcctttggaggaggaaagg

SEQ ID NO: 117397 - DNA, 22 bp, Artificial Sequence
  Synthetic oligonucleotide; CTT chr11 5374421 5374442 5374426 5374421 -
tcctttggaggaggaaaggtgc

SEQ ID NO: 117398 - DNA, 22 bp, Artificial Sequence
  Synthetic oligonucleotide; TTT chr11 5374420 5374441 5374425 5374420 -
cctttggaggaggaaaggtgct

SEQ ID NO: 117399 - DNA, 22 bp, Artificial Sequence
  Synthetic oligonucleotide; TTC chr11 5374419 5374440 5374424 5374419 -
ctttggaggaggaaaggtgctc

SEQ ID NO: 117400 - DNA, 22 bp, Artificial Sequence
  Synthetic oligonucleotide; CTT chr11 5374416 5374437 5374421 5374416 -
tggaggaggaaaggtgctctgc

SEQ ID NO: 117401 - DNA, 22 bp, Artificial Sequence
  Synthetic oligonucleotide; TTT chr11 5374415 5374436 5374420 5374415 -
ggaggaggaaaggtgctctgct

SEQ ID NO: 117402 - DNA, 22 bp, Artificial Sequence
  Synthetic oligonucleotide; TTG chr11 5374414 5374435 5374419 5374414 -
gaggaggaaaggtgctctgctt

SEQ ID NO: 117403 - DNA, 22 bp, Artificial Sequence
  Synthetic oligonucleotide; CTC chr11 5374397 5374418 5374402 5374397 -
tgctttttagagtttccagttt

SEQ ID NO: 117404 - DNA, 22 bp, Artificial Sequence
  Synthetic oligonucleotide; CTG chr11 5374395 5374416 5374400 5374395 -
ctttttagagtttccagttttt

SEQ ID NO: 117405 - DNA, 22 bp, Artificial Sequence
  Synthetic oligonucleotide; CTT chr11 5374392 5374413 5374397 5374392 -
tttagagtttccagtttttctg

SEQ ID NO: 117406 - DNA, 22 bp, Artificial Sequence
  Synthetic oligonucleotide; TTT chr11 5374391 5374412 5374396 5374391 -
ttagagtttccagtttttctgc

SEQ ID NO: 117407 - DNA, 22 bp, Artificial Sequence
  Synthetic oligonucleotide; TTT chr11 5374390 5374411 5374395 5374390 -
tagagtttccagtttttctgct

SEQ ID NO: 117408 - DNA, 22 bp, Artificial Sequence
  Synthetic oligonucleotide; TTT chr11 5374389 5374410 5374394 5374389 -
agagtttccagtttttctgctc

SEQ ID NO: 117409 - DNA, 22 bp, Artificial Sequence
  Synthetic oligonucleotide; TTA chr11 5374388 5374409 5374393 5374388 -
gagtttccagtttttctgctct

SEQ ID NO: 117410 - DNA, 22 bp, Artificial Sequence
  Synthetic oligonucleotide; TTT chr11 5374382 5374403 5374387 5374382 -
ccagtttttctgctctgttttt

SEQ ID NO: 117411 - DNA, 22 bp, Artificial Sequence
  Synthetic oligonucleotide; TTC chr11 5374381 5374402 5374386 5374381 -
cagtttttctgctctgtttttt

SEQ ID NO: 117412 - DNA, 22 bp, Artificial Sequence
  Synthetic oligonucleotide; TTT chr11 5374375 5374396 5374380 5374375 -
ttctgctctgttttttccccaa

SEQ ID NO: 117413 - DNA, 22 bp, Artificial Sequence
  Synthetic oligonucleotide; TTT chr11 5374374 5374395 5374379 5374374 -
tctgctctgttttttccccaac

SEQ ID NO: 117414 - DNA, 22 bp, Artificial Sequence
  Synthetic oligonucleotide; TTT chr11 5374373 5374394 5374378 5374373 -
ctgctctgttttttccccaact

SEQ ID NO: 117415 - DNA, 22 bp, Artificial Sequence
  Synthetic oligonucleotide; TTC chr11 5374372 5374393 5374377 5374372 -
tgctctgttttttccccaactt

SEQ ID NO: 117416 - DNA, 22 bp, Artificial Sequence
  Synthetic oligonucleotide; CTG chr11 5374370 5374391 5374375 5374370 -
ctctgttttttccccaactttg

SEQ ID NO: 117417 - DNA, 22 bp, Artificial Sequence
  Synthetic oligonucleotide; CTC chr11 5374367 5374388 5374372 5374367 -
tgttttttccccaactttgtgg

SEQ ID NO: 117418 - DNA, 22 bp, Artificial Sequence
  Synthetic oligonucleotide; CTG chr11 5374365 5374386 5374370 5374365 -
ttttttccccaactttgtggtt

SEQ ID NO: 117419 - DNA, 22 bp, Artificial Sequence
  Synthetic oligonucleotide; TTT chr11 5374362 5374383 5374367 5374362 -
tttccccaactttgtggttgta

SEQ ID NO: 117420 - DNA, 22 bp, Artificial Sequence
  Synthetic oligonucleotide; TTT chr11 5374361 5374382 5374366 5374361 -
ttccccaactttgtggttgtat

SEQ ID NO: 117421 - DNA, 22 bp, Artificial Sequence
  Synthetic oligonucleotide; TTT chr11 5374360 5374381 5374365 5374360 -
tccccaactttgtggttgtatc

SEQ ID NO: 117422 - DNA, 22 bp, Artificial Sequence
  Synthetic oligonucleotide; TTT chr11 5374359 5374380 5374364 5374359 -
ccccaactttgtggttgtatct

SEQ ID NO: 117423 - DNA, 22 bp, Artificial Sequence
  Synthetic oligonucleotide; TTC chr11 5374358 5374379 5374363 5374358 -
cccaactttgtggttgtatcta

SEQ ID NO: 117424 - DNA, 22 bp, Artificial Sequence
  Synthetic oligonucleotide; CTT chr11 5374350 5374371 5374355 5374350 -
tgtggttgtatctacttttggt

SEQ ID NO: 117425 - DNA, 22 bp, Artificial Sequence
  Synthetic oligonucleotide; TTT chr11 5374349 5374370 5374354 5374349 -
gtggttgtatctacttttggtc

SEQ ID NO: 117426 - DNA, 22 bp, Artificial Sequence
  Synthetic oligonucleotide; TTG chr11 5374348 5374369 5374353 5374348 -
tggttgtatctacttttggtct

SEQ ID NO: 117427 - DNA, 22 bp, Artificial Sequence
  Synthetic oligonucleotide; TTG chr11 5374342 5374363 5374347 5374342 -
tatctacttttggtctttgatg

SEQ ID NO: 117428 - DNA, 22 bp, Artificial Sequence
  Synthetic oligonucleotide; CTA chr11 5374336 5374357 5374341 5374336 -
cttttggtctttgatgatagtg

SEQ ID NO: 117429 - DNA, 22 bp, Artificial Sequence
  Synthetic oligonucleotide; CTT chr11 5374333 5374354 5374338 5374333 -
ttggtctttgatgatagtgatg

SEQ ID NO: 117430 - DNA, 22 bp, Artificial Sequence
  Synthetic oligonucleotide; TTT chr11 5374332 5374353 5374337 5374332 -
tggtctttgatgatagtgatgt

SEQ ID NO: 117431 - DNA, 22 bp, Artificial Sequence
  Synthetic oligonucleotide; TTT chr11 5374331 5374352 5374336 5374331 -
ggtctttgatgatagtgatgta

SEQ ID NO: 117432 - DNA, 22 bp, Artificial Sequence
  Synthetic oligonucleotide; TTG chr11 5374330 5374351 5374335 5374330 -
gtctttgatgatagtgatgtac

SEQ ID NO: 117433 - DNA, 22 bp, Artificial Sequence
  Synthetic oligonucleotide; CTT chr11 5374325 5374346 5374330 5374325 -
tgatgatagtgatgtaccgatg

SEQ ID NO: 117434 - DNA, 22 bp, Artificial Sequence
  Synthetic oligonucleotide; TTT chr11 5374324 5374345 5374329 5374324 -
gatgatagtgatgtaccgatgg

SEQ ID NO: 117435 - DNA, 22 bp, Artificial Sequence
  Synthetic oligonucleotide; TTG chr11 5374323 5374344 5374328 5374323 -
atgatagtgatgtaccgatggg

SEQ ID NO: 117436 - DNA, 22 bp, Artificial Sequence
  Synthetic oligonucleotide; TTT chr11 5374298 5374319 5374303 5374298 -
ttggtgtggatgtcctttctgt

SEQ ID NO: 117437 - DNA, 22 bp, Artificial Sequence
  Synthetic oligonucleotide; TTT chr11 5374297 5374318 5374302 5374297 -
tggtgtggatgtcctttctgtt

SEQ ID NO: 117438 - DNA, 22 bp, Artificial Sequence
  Synthetic oligonucleotide; TTT chr11 5374296 5374317 5374301 5374296 -
ggtgtggatgtcctttctgttt

SEQ ID NO: 117439 - DNA, 22 bp, Artificial Sequence
  Synthetic oligonucleotide; TTG chr11 5374295 5374316 5374300 5374295 -
gtgtggatgtcctttctgtttg

SEQ ID NO: 117440 - DNA, 22 bp, Artificial Sequence
  Synthetic oligonucleotide; CTT chr11 5374281 5374302 5374286 5374281 -
tctgtttgttagttttccttct

SEQ ID NO: 117441 - DNA, 22 bp, Artificial Sequence
  Synthetic oligonucleotide; TTT chr11 5374280 5374301 5374285 5374280 -
ctgtttgttagttttccttcta

SEQ ID NO: 117442 - DNA, 22 bp, Artificial Sequence
  Synthetic oligonucleotide; TTC chr11 5374279 5374300 5374284 5374279 -
tgtttgttagttttccttctaa

SEQ ID NO: 117443 - DNA, 22 bp, Artificial Sequence
  Synthetic oligonucleotide; CTG chr11 5374277 5374298 5374282 5374277 -
tttgttagttttccttctaaca

SEQ ID NO: 117444 - DNA, 22 bp, Artificial Sequence
  Synthetic oligonucleotide; TTT chr11 5374274 5374295 5374279 5374274 -
gttagttttccttctaacagac

SEQ ID NO: 117445 - DNA, 22 bp, Artificial Sequence
  Synthetic oligonucleotide; TTG chr11 5374273 5374294 5374278 5374273 -
ttagttttccttctaacagaca

SEQ ID NO: 117446 - DNA, 22 bp, Artificial Sequence
  Synthetic oligonucleotide; TTA chr11 5374270 5374291 5374275 5374270 -
gttttccttctaacagacagga

SEQ ID NO: 117447 - DNA, 22 bp, Artificial Sequence
  Synthetic oligonucleotide; TTT chr11 5374266 5374287 5374271 5374266 -
tccttctaacagacaggaccct

SEQ ID NO: 117448 - DNA, 22 bp, Artificial Sequence
  Synthetic oligonucleotide; TTT chr11 5374265 5374286 5374270 5374265 -
ccttctaacagacaggaccctc

SEQ ID NO: 117449 - DNA, 22 bp, Artificial Sequence
  Synthetic oligonucleotide; TTC chr11 5374264 5374285 5374269 5374264 -
cttctaacagacaggaccctca

SEQ ID NO: 117450 - DNA, 22 bp, Artificial Sequence
  Synthetic oligonucleotide; CTT chr11 5374261 5374282 5374266 5374261 -
ctaacagacaggaccctcagct

SEQ ID NO: 117451 - DNA, 22 bp, Artificial Sequence
  Synthetic oligonucleotide; TTC chr11 5374260 5374281 5374265 5374260 -
taacagacaggaccctcagctg

SEQ ID NO: 117452 - DNA, 22 bp, Artificial Sequence
  Synthetic oligonucleotide; CTA chr11 5374258 5374279 5374263 5374258 -
acagacaggaccctcagctgca

SEQ ID NO: 117453 - DNA, 22 bp, Artificial Sequence
  Synthetic oligonucleotide; CTC chr11 5374243 5374264 5374248 5374243 -
agctgcaggtctgttggagttt

SEQ ID NO: 117454 - DNA, 22 bp, Artificial Sequence
  Synthetic oligonucleotide; CTG chr11 5374238 5374259 5374243 5374238 -
caggtctgttggagtttgctag

SEQ ID NO: 117455 - DNA, 22 bp, Artificial Sequence
  Synthetic oligonucleotide; CTG chr11 5374230 5374251 5374235 5374230 -
ttggagtttgctagaggtccac

SEQ ID NO: 117456 - DNA, 22 bp, Artificial Sequence
  Synthetic oligonucleotide; TTG chr11 5374227 5374248 5374232 5374227 -
gagtttgctagaggtccactcc

SEQ ID NO: 117457 - DNA, 22 bp, Artificial Sequence
  Synthetic oligonucleotide; TTT chr11 5374221 5374242 5374226 5374221 -
gctagaggtccactccagaccc

SEQ ID NO: 117458 - DNA, 22 bp, Artificial Sequence
  Synthetic oligonucleotide; TTG chr11 5374220 5374241 5374225 5374220 -
ctagaggtccactccagaccct

SEQ ID NO: 117459 - DNA, 22 bp, Artificial Sequence
  Synthetic oligonucleotide; CTA chr11 5374217 5374238 5374222 5374217 -
gaggtccactccagaccctgtt

SEQ ID NO: 117460 - DNA, 22 bp, Artificial Sequence
  Synthetic oligonucleotide; CTC chr11 5374206 5374227 5374211 5374206 -
cagaccctgtttgcctgggtat

SEQ ID NO: 117461 - DNA, 22 bp, Artificial Sequence
  Synthetic oligonucleotide; CTG chr11 5374197 5374218 5374202 5374197 -
tttgcctgggtatcagcagcgg

SEQ ID NO: 117462 - DNA, 22 bp, Artificial Sequence
  Synthetic oligonucleotide; TTT chr11 5374194 5374215 5374199 5374194 -
gcctgggtatcagcagcggtgt

SEQ ID NO: 117463 - DNA, 22 bp, Artificial Sequence
  Synthetic oligonucleotide; TTG chr11 5374193 5374214 5374198 5374193 -
cctgggtatcagcagcggtgtc

SEQ ID NO: 117464 - DNA, 22 bp, Artificial Sequence
  Synthetic oligonucleotide; CTG chr11 5374189 5374210 5374194 5374189 -
ggtatcagcagcggtgtctgca

SEQ ID NO: 117465 - DNA, 22 bp, Artificial Sequence
  Synthetic oligonucleotide; CTG chr11 5374169 5374190 5374174 5374169 -
cagaaccgcagattttcgtgat

SEQ ID NO: 117466 - DNA, 22 bp, Artificial Sequence
  Synthetic oligonucleotide; TTT chr11 5374154 5374175 5374159 5374154 -
tcgtgatccgcgaatgctgctg

SEQ ID NO: 117467 - DNA, 22 bp, Artificial Sequence
  Synthetic oligonucleotide; TTT chr11 5374153 5374174 5374158 5374153 -
cgtgatccgcgaatgctgctgt

SEQ ID NO: 117468 - DNA, 22 bp, Artificial Sequence
  Synthetic oligonucleotide; TTC chr11 5374152 5374173 5374157 5374152 -
gtgatccgcgaatgctgctgtc

SEQ ID NO: 117469 - DNA, 22 bp, Artificial Sequence
  Synthetic oligonucleotide; CTG chr11 5374135 5374156 5374140 5374135 -
ctgtctgatcgttcctctggaa

SEQ ID NO: 117470 - DNA, 22 bp, Artificial Sequence
  Synthetic oligonucleotide; CTG chr11 5374132 5374153 5374137 5374132 -
tctgatcgttcctctggaagtt

SEQ ID NO: 117471 - DNA, 22 bp, Artificial Sequence
  Synthetic oligonucleotide; CTG chr11 5374128 5374149 5374133 5374128 -
atcgttcctctggaagttttgt

SEQ ID NO: 117472 - DNA, 22 bp, Artificial Sequence
  Synthetic oligonucleotide; TTC chr11 5374121 5374142 5374126 5374121 -
ctctggaagttttgtctcagag

SEQ ID NO: 117473 - DNA, 22 bp, Artificial Sequence
  Synthetic oligonucleotide; CTC chr11 5374118 5374139 5374123 5374118 -
tggaagttttgtctcagaggag

SEQ ID NO: 117474 - DNA, 22 bp, Artificial Sequence
  Synthetic oligonucleotide; CTG chr11 5374116 5374137 5374121 5374116 -
gaagttttgtctcagaggagta

SEQ ID NO: 117475 - DNA, 22 bp, Artificial Sequence
  Synthetic oligonucleotide; TTT chr11 5374109 5374130 5374114 5374109 -
tgtctcagaggagtacctggcc

SEQ ID NO: 117476 - DNA, 22 bp, Artificial Sequence
  Synthetic oligonucleotide; TTT chr11 5374108 5374129 5374113 5374108 -
gtctcagaggagtacctggccg

SEQ ID NO: 117477 - DNA, 22 bp, Artificial Sequence
  Synthetic oligonucleotide; TTG chr11 5374107 5374128 5374112 5374107 -
tctcagaggagtacctggccgt

SEQ ID NO: 117478 - DNA, 22 bp, Artificial Sequence
  Synthetic oligonucleotide; CTC chr11 5374103 5374124 5374108 5374103 -
agaggagtacctggccgtgtga

SEQ ID NO: 117479 - DNA, 22 bp, Artificial Sequence
  Synthetic oligonucleotide; CTG chr11 5374090 5374111 5374095 5374090 -
gccgtgtgaggtgtcagtctgc

SEQ ID NO: 117480 - DNA, 22 bp, Artificial Sequence
  Synthetic oligonucleotide; CTG chr11 5374069 5374090 5374074 5374069 -
cccttacttgggggtgcctccc

SEQ ID NO: 117481 - DNA, 22 bp, Artificial Sequence
  Synthetic oligonucleotide; CTT chr11 5374064 5374085 5374069 5374064 -
acttgggggtgcctcccagtta

SEQ ID NO: 117482 - DNA, 22 bp, Artificial Sequence
  Synthetic oligonucleotide; TTA chr11 5374063 5374084 5374068 5374063 -
cttgggggtgcctcccagttag

SEQ ID NO: 117483 - DNA, 22 bp, Artificial Sequence
  Synthetic oligonucleotide; CTT chr11 5374060 5374081 5374065 5374060 -
gggggtgcctcccagttaggct

SEQ ID NO: 117484 - DNA, 22 bp, Artificial Sequence
  Synthetic oligonucleotide; TTG chr11 5374059 5374080 5374064 5374059 -
ggggtgcctcccagttaggctg

SEQ ID NO: 117485 - DNA, 22 bp, Artificial Sequence
  Synthetic oligonucleotide; CTC chr11 5374049 5374070 5374054 5374049 -
ccagttaggctgctcgggggtc

SEQ ID NO: 117486 - DNA, 22 bp, Artificial Sequence
  Synthetic oligonucleotide; TTA chr11 5374042 5374063 5374047 5374042 -
ggctgctcgggggtcaggggtc

SEQ ID NO: 117487 - DNA, 22 bp, Artificial Sequence
  Synthetic oligonucleotide; CTG chr11 5374037 5374058 5374042 5374037 -
ctcgggggtcaggggtcaggga

SEQ ID NO: 117488 - DNA, 22 bp, Artificial Sequence
  Synthetic oligonucleotide; CTC chr11 5374034 5374055 5374039 5374034 -
gggggtcaggggtcagggaccc

SEQ ID NO: 117489 - DNA, 22 bp, Artificial Sequence
  Synthetic oligonucleotide; CTT chr11 5374008 5374029 5374013 5374008 -
gaggaggcagtctgcccgttct

SEQ ID NO: 117490 - DNA, 22 bp, Artificial Sequence
  Synthetic oligonucleotide; TTG chr11 5374007 5374028 5374012 5374007 -
aggaggcagtctgcccgttctc

SEQ ID NO: 117491 - DNA, 22 bp, Artificial Sequence
  Synthetic oligonucleotide; CTG chr11 5373994 5374015 5373999 5373994 -
cccgttctcagatctccagctg

SEQ ID NO: 117492 - DNA, 22 bp, Artificial Sequence
  Synthetic oligonucleotide; TTC chr11 5373987 5374008 5373992 5373987 -
tcagatctccagctgtgtgctg

SEQ ID NO: 117493 - DNA, 22 bp, Artificial Sequence
  Synthetic oligonucleotide; CTC chr11 5373985 5374006 5373990 5373985 -
agatctccagctgtgtgctggg

SEQ ID NO: 117494 - DNA, 22 bp, Artificial Sequence
  Synthetic oligonucleotide; CTC chr11 5373978 5373999 5373983 5373978 -
cagctgtgtgctgggagaacca

SEQ ID NO: 117495 - DNA, 22 bp, Artificial Sequence
  Synthetic oligonucleotide; CTG chr11 5373972 5373993 5373977 5373972 -
tgtgctgggagaaccactgctc

SEQ ID NO: 117496 - DNA, 22 bp, Artificial Sequence
  Synthetic oligonucleotide; CTG chr11 5373965 5373986 5373970 5373965 -
ggagaaccactgctctcctcaa

SEQ ID NO: 117497 - DNA, 22 bp, Artificial Sequence
  Synthetic oligonucleotide; CTG chr11 5373953 5373974 5373958 5373953 -
ctctcctcaaagctgtcagaca

SEQ ID NO: 117498 - DNA, 22 bp, Artificial Sequence
  Synthetic oligonucleotide; CTC chr11 5373950 5373971 5373955 5373950 -
tcctcaaagctgtcagacaggg

SEQ ID NO: 117499 - DNA, 22 bp, Artificial Sequence
  Synthetic oligonucleotide; CTC chr11 5373948 5373969 5373953 5373948 -
ctcaaagctgtcagacagggac

SEQ ID NO: 117500 - DNA, 22 bp, Artificial Sequence
  Synthetic oligonucleotide; CTC chr11 5373945 5373966 5373950 5373945 -
aaagctgtcagacagggacatt

SEQ ID NO: 117501 - DNA, 22 bp, Artificial Sequence
  Synthetic oligonucleotide; CTG chr11 5373938 5373959 5373943 5373938 -
tcagacagggacatttaagtct

SEQ ID NO: 117502 - DNA, 22 bp, Artificial Sequence
  Synthetic oligonucleotide; TTT chr11 5373922 5373943 5373927 5373922 -
aagtctgcagaggttactgctg

SEQ ID NO: 117503 - DNA, 22 bp, Artificial Sequence
  Synthetic oligonucleotide; TTA chr11 5373921 5373942 5373926 5373921 -
agtctgcagaggttactgctgt

SEQ ID NO: 117504 - DNA, 22 bp, Artificial Sequence
  Synthetic oligonucleotide; CTG chr11 5373915 5373936 5373920 5373915 -
cagaggttactgctgtcttttt

SEQ ID NO: 117505 - DNA, 22 bp, Artificial Sequence
  Synthetic oligonucleotide; TTA chr11 5373906 5373927 5373911 5373906 -
ctgctgtctttttgtttgtctg

SEQ ID NO: 117506 - DNA, 22 bp, Artificial Sequence
  Synthetic oligonucleotide; CTG chr11 5373903 5373924 5373908 5373903 -
ctgtctttttgtttgtctgtgc

SEQ ID NO: 117507 - DNA, 22 bp, Artificial Sequence
  Synthetic oligonucleotide; CTG chr11 5373900 5373921 5373905 5373900 -
tctttttgtttgtctgtgccct

SEQ ID NO: 117508 - DNA, 22 bp, Artificial Sequence
  Synthetic oligonucleotide; CTT chr11 5373896 5373917 5373901 5373896 -
tttgtttgtctgtgccctgccc

SEQ ID NO: 117509 - DNA, 22 bp, Artificial Sequence
  Synthetic oligonucleotide; TTT chr11 5373895 5373916 5373900 5373895 -
ttgtttgtctgtgccctgcccc

SEQ ID NO: 117510 - DNA, 22 bp, Artificial Sequence
  Synthetic oligonucleotide; TTT chr11 5373894 5373915 5373899 5373894 -
tgtttgtctgtgccctgccccc

SEQ ID NO: 117511 - DNA, 22 bp, Artificial Sequence
  Synthetic oligonucleotide; TTT chr11 5373893 5373914 5373898 5373893 -
gtttgtctgtgccctgccccca

SEQ ID NO: 117512 - DNA, 22 bp, Artificial Sequence
  Synthetic oligonucleotide; TTG chr11 5373892 5373913 5373897 5373892 -
tttgtctgtgccctgcccccaa

SEQ ID NO: 117513 - DNA, 22 bp, Artificial Sequence
  Synthetic oligonucleotide; TTT chr11 5373889 5373910 5373894 5373889 -
gtctgtgccctgcccccaaagg

SEQ ID NO: 117514 - DNA, 22 bp, Artificial Sequence
  Synthetic oligonucleotide; TTG chr11 5373888 5373909 5373893 5373888 -
tctgtgccctgcccccaaaggt

SEQ ID NO: 117515 - DNA, 22 bp, Artificial Sequence
  Synthetic oligonucleotide; CTG chr11 5373884 5373905 5373889 5373884 -
tgccctgcccccaaaggtggag

SEQ ID NO: 117516 - DNA, 22 bp, Artificial Sequence
  Synthetic oligonucleotide; CTG chr11 5373877 5373898 5373882 5373877 -
cccccaaaggtggagcctacag

SEQ ID NO: 117517 - DNA, 22 bp, Artificial Sequence
  Synthetic oligonucleotide; CTA chr11 5373858 5373879 5373863 5373858 -
cagaggcaggcaggcctccttg

SEQ ID NO: 117518 - DNA, 22 bp, Artificial Sequence
  Synthetic oligonucleotide; CTC chr11 5373840 5373861 5373845 5373840 -
cttgagctgtggtggggtccac

SEQ ID NO: 117519 - DNA, 22 bp, Artificial Sequence
  Synthetic oligonucleotide; CTT chr11 5373837 5373858 5373842 5373837 -
gagctgtggtggggtccaccca

SEQ ID NO: 117520 - DNA, 22 bp, Artificial Sequence
  Synthetic oligonucleotide; TTG chr11 5373836 5373857 5373841 5373836 -
agctgtggtggggtccacccag

SEQ ID NO: 117521 - DNA, 22 bp, Artificial Sequence
  Synthetic oligonucleotide; CTG chr11 5373831 5373852 5373836 5373831 -
tggtggggtccacccagtttga

SEQ ID NO: 117522 - DNA, 22 bp, Artificial Sequence
  Synthetic oligonucleotide; TTT chr11 5373811 5373832 5373816 5373811 -
gagcttcctggctgctttgttt

SEQ ID NO: 117523 - DNA, 22 bp, Artificial Sequence
  Synthetic oligonucleotide; TTG chr11 5373810 5373831 5373815 5373810 -
agcttcctggctgctttgttta

SEQ ID NO: 117524 - DNA, 22 bp, Artificial Sequence
  Synthetic oligonucleotide; CTT chr11 5373805 5373826 5373810 5373805 -
cctggctgctttgtttacctaa

SEQ ID NO: 117525 - DNA, 22 bp, Artificial Sequence
  Synthetic oligonucleotide; TTC chr11 5373804 5373825 5373809 5373804 -
ctggctgctttgtttacctaag

SEQ ID NO: 117526 - DNA, 22 bp, Artificial Sequence
  Synthetic oligonucleotide; CTG chr11 5373801 5373822 5373806 5373801 -
gctgctttgtttacctaagcaa

SEQ ID NO: 117527 - DNA, 22 bp, Artificial Sequence
  Synthetic oligonucleotide; CTG chr11 5373797 5373818 5373802 5373797 -
ctttgtttacctaagcaagcct

SEQ ID NO: 117528 - DNA, 22 bp, Artificial Sequence
  Synthetic oligonucleotide; CTT chr11 5373794 5373815 5373799 5373794 -
tgtttacctaagcaagcctggg

SEQ ID NO: 117529 - DNA, 22 bp, Artificial Sequence
  Synthetic oligonucleotide; TTT chr11 5373793 5373814 5373798 5373793 -
gtttacctaagcaagcctgggc

SEQ ID NO: 117530 - DNA, 22 bp, Artificial Sequence
  Synthetic oligonucleotide; TTG chr11 5373792 5373813 5373797 5373792 -
tttacctaagcaagcctgggca

SEQ ID NO: 117531 - DNA, 22 bp, Artificial Sequence
  Synthetic oligonucleotide; TTT chr11 5373789 5373810 5373794 5373789 -
acctaagcaagcctgggcaatg

SEQ ID NO: 117532 - DNA, 22 bp, Artificial Sequence
  Synthetic oligonucleotide; TTA chr11 5373788 5373809 5373793 5373788 -
cctaagcaagcctgggcaatgg

SEQ ID NO: 117533 - DNA, 22 bp, Artificial Sequence
  Synthetic oligonucleotide; CTA chr11 5373784 5373805 5373789 5373784 -
agcaagcctgggcaatggcggc

SEQ ID NO: 117534 - DNA, 22 bp, Artificial Sequence
  Synthetic oligonucleotide; CTG chr11 5373774 5373795 5373779 5373774 -
ggcaatggcggctgcccctccc

SEQ ID NO: 117535 - DNA, 22 bp, Artificial Sequence
  Synthetic oligonucleotide; CTG chr11 5373760 5373781 5373765 5373760 -
cccctcccccagcctcgctgcc

SEQ ID NO: 117536 - DNA, 22 bp, Artificial Sequence
  Synthetic oligonucleotide; CTC chr11 5373754 5373775 5373759 5373754 -
ccccagcctcgctgccaccttg

SEQ ID NO: 117537 - DNA, 22 bp, Artificial Sequence
  Synthetic oligonucleotide; CTC chr11 5373744 5373765 5373749 5373744 -
gctgccaccttgcagtttgatc

SEQ ID NO: 117538 - DNA, 22 bp, Artificial Sequence
  Synthetic oligonucleotide; CTG chr11 5373740 5373761 5373745 5373740 -
ccaccttgcagtttgatctcag

SEQ ID NO: 117539 - DNA, 22 bp, Artificial Sequence
  Synthetic oligonucleotide; CTT chr11 5373733 5373754 5373738 5373733 -
gcagtttgatctcagactgctg

SEQ ID NO: 117540 - DNA, 22 bp, Artificial Sequence
  Synthetic oligonucleotide; TTG chr11 5373732 5373753 5373737 5373732 -
cagtttgatctcagactgctgt

SEQ ID NO: 117541 - DNA, 22 bp, Artificial Sequence
  Synthetic oligonucleotide; TTT chr11 5373726 5373747 5373731 5373726 -
gatctcagactgctgtgctagc

SEQ ID NO: 117542 - DNA, 22 bp, Artificial Sequence
  Synthetic oligonucleotide; TTG chr11 5373725 5373746 5373730 5373725 -
atctcagactgctgtgctagca

SEQ ID NO: 117543 - DNA, 22 bp, Artificial Sequence
  Synthetic oligonucleotide; CTC chr11 5373720 5373741 5373725 5373720 -
agactgctgtgctagcaatcag

SEQ ID NO: 117544 - DNA, 22 bp, Artificial Sequence
  Synthetic oligonucleotide; CTG chr11 5373714 5373735 5373719 5373714 -
ctgtgctagcaatcagggagac

SEQ ID NO: 117545 - DNA, 22 bp, Artificial Sequence
  Synthetic oligonucleotide; CTG chr11 5373711 5373732 5373716 5373711 -
tgctagcaatcagggagactcc

SEQ ID NO: 117546 - DNA, 22 bp, Artificial Sequence
  Synthetic oligonucleotide; CTA chr11 5373706 5373727 5373711 5373706 -
gcaatcagggagactccgtggg

SEQ ID NO: 117547 - DNA, 22 bp, Artificial Sequence
  Synthetic oligonucleotide; CTC chr11 5373690 5373711 5373695 5373690 -
cgtgggcgtaggaccctcggag

SEQ ID NO: 117548 - DNA, 22 bp, Artificial Sequence
  Synthetic oligonucleotide; CTC chr11 5373672 5373693 5373677 5373672 -
ggagccatgtgcaggatataat

SEQ ID NO: 117549 - DNA, 22 bp, Artificial Sequence
  Synthetic oligonucleotide; CTC chr11 5373647 5373668 5373652 5373647 -
ctggtgcgccatttcctaagcc

SEQ ID NO: 117550 - DNA, 22 bp, Artificial Sequence
  Synthetic oligonucleotide; CTG chr11 5373644 5373665 5373649 5373644 -
gtgcgccatttcctaagcctgt

SEQ ID NO: 117551 - DNA, 22 bp, Artificial Sequence
  Synthetic oligonucleotide; TTT chr11 5373633 5373654 5373638 5373633 -
cctaagcctgtcagaaaagcac

SEQ ID NO: 117552 - DNA, 22 bp, Artificial Sequence
  Synthetic oligonucleotide; TTC chr11 5373632 5373653 5373637 5373632 -
ctaagcctgtcagaaaagcaca

SEQ ID NO: 117553 - DNA, 22 bp, Artificial Sequence
  Synthetic oligonucleotide; CTA chr11 5373629 5373650 5373634 5373629 -
agcctgtcagaaaagcacagta

SEQ ID NO: 117554 - DNA, 22 bp, Artificial Sequence
  Synthetic oligonucleotide; CTG chr11 5373623 5373644 5373628 5373623 -
tcagaaaagcacagtattcggg

SEQ ID NO: 117555 - DNA, 22 bp, Artificial Sequence
  Synthetic oligonucleotide; TTC chr11 5373604 5373625 5373609 5373604 -
gggtgggagtggcccaattttc

SEQ ID NO: 117556 - DNA, 22 bp, Artificial Sequence
  Synthetic oligonucleotide; TTT chr11 5373584 5373605 5373589 5373584 -
tccaggtgccgtatgtcacccc

SEQ ID NO: 117557 - DNA, 22 bp, Artificial Sequence
  Synthetic oligonucleotide; TTT chr11 5373583 5373604 5373588 5373583 -
ccaggtgccgtatgtcacccct

SEQ ID NO: 117558 - DNA, 22 bp, Artificial Sequence
  Synthetic oligonucleotide; TTC chr11 5373582 5373603 5373587 5373582 -
caggtgccgtatgtcacccctt

SEQ ID NO: 117559 - DNA, 22 bp, Artificial Sequence
  Synthetic oligonucleotide; CTT chr11 5373560 5373581 5373565 5373560 -
tccttgaccaggaaagggaact

SEQ ID NO: 117560 - DNA, 22 bp, Artificial Sequence
  Synthetic oligonucleotide; TTT chr11 5373559 5373580 5373564 5373559 -
ccttgaccaggaaagggaactc

SEQ ID NO: 117561 - DNA, 22 bp, Artificial Sequence
  Synthetic oligonucleotide; TTC chr11 5373558 5373579 5373563 5373558 -
cttgaccaggaaagggaactcc

SEQ ID NO: 117562 - DNA, 22 bp, Artificial Sequence
  Synthetic oligonucleotide; CTT chr11 5373555 5373576 5373560 5373555 -
gaccaggaaagggaactccatg

SEQ ID NO: 117563 - DNA, 22 bp, Artificial Sequence
  Synthetic oligonucleotide; TTG chr11 5373554 5373575 5373559 5373554 -
accaggaaagggaactccatga

SEQ ID NO: 117564 - DNA, 22 bp, Artificial Sequence
  Synthetic oligonucleotide; CTC chr11 5373537 5373558 5373542 5373537 -
catgaccccttgtgcttcccaa

SEQ ID NO: 117565 - DNA, 22 bp, Artificial Sequence
  Synthetic oligonucleotide; CTT chr11 5373526 5373547 5373531 5373526 -
gtgcttcccaagtgaggcaatg

SEQ ID NO: 117566 - DNA, 22 bp, Artificial Sequence
  Synthetic oligonucleotide; TTG chr11 5373525 5373546 5373530 5373525 -
tgcttcccaagtgaggcaatgc

SEQ ID NO: 117567 - DNA, 22 bp, Artificial Sequence
  Synthetic oligonucleotide; CTT chr11 5373520 5373541 5373525 5373520 -
cccaagtgaggcaatgcctcac

SEQ ID NO: 117568 - DNA, 22 bp, Artificial Sequence
  Synthetic oligonucleotide; TTC chr11 5373519 5373540 5373524 5373519 -
ccaagtgaggcaatgcctcacc

SEQ ID NO: 117569 - DNA, 22 bp, Artificial Sequence
  Synthetic oligonucleotide; CTC chr11 5373500 5373521 5373505 5373500 -
accctgcttcggctggtgcatg

SEQ ID NO: 117570 - DNA, 22 bp, Artificial Sequence
  Synthetic oligonucleotide; CTG chr11 5373494 5373515 5373499 5373494 -
cttcggctggtgcatggtgtgc

SEQ ID NO: 117571 - DNA, 22 bp, Artificial Sequence
  Synthetic oligonucleotide; CTT chr11 5373491 5373512 5373496 5373491 -
cggctggtgcatggtgtgctgc

SEQ ID NO: 117572 - DNA, 22 bp, Artificial Sequence
  Synthetic oligonucleotide; TTC chr11 5373490 5373511 5373495 5373490 -
ggctggtgcatggtgtgctgca

SEQ ID NO: 117573 - DNA, 22 bp, Artificial Sequence
  Synthetic oligonucleotide; CTG chr11 5373485 5373506 5373490 5373485 -
gtgcatggtgtgctgcacccac

SEQ ID NO: 117574 - DNA, 22 bp, Artificial Sequence
  Synthetic oligonucleotide; CTG chr11 5373470 5373491 5373475 5373470 -
cacccactgacctgtgcccact

SEQ ID NO: 117575 - DNA, 22 bp, Artificial Sequence
  Synthetic oligonucleotide; CTG chr11 5373461 5373482 5373466 5373461 -
acctgtgcccactgtctggcac

SEQ ID NO: 117576 - DNA, 22 bp, Artificial Sequence
  Synthetic oligonucleotide; CTG chr11 5373456 5373477 5373461 5373456 -
tgcccactgtctggcactccct

SEQ ID NO: 117577 - DNA, 22 bp, Artificial Sequence
  Synthetic oligonucleotide; CTG chr11 5373447 5373468 5373452 5373447 -
tctggcactccctagcgagatg

SEQ ID NO: 117578 - DNA, 22 bp, Artificial Sequence
  Synthetic oligonucleotide; CTG chr11 5373443 5373464 5373448 5373443 -
gcactccctagcgagatgaacc

SEQ ID NO: 117579 - DNA, 22 bp, Artificial Sequence
  Synthetic oligonucleotide; CTC chr11 5373437 5373458 5373442 5373437 -
cctagcgagatgaaccccatac

SEQ ID NO: 117580 - DNA, 22 bp, Artificial Sequence
  Synthetic oligonucleotide; CTA chr11 5373433 5373454 5373438 5373433 -
gcgagatgaaccccatacctca

SEQ ID NO: 117581 - DNA, 22 bp, Artificial Sequence
  Synthetic oligonucleotide; CTC chr11 5373412 5373433 5373417 5373412 -
agatggaaatgcagaaatcacc

SEQ ID NO: 117582 - DNA, 22 bp, Artificial Sequence
  Synthetic oligonucleotide; CTT chr11 5373384 5373405 5373389 5373384 -
ctgtgttgttcacgctgggagc

SEQ ID NO: 117583 - DNA, 22 bp, Artificial Sequence
  Synthetic oligonucleotide; TTC chr11 5373383 5373404 5373388 5373383 -
tgtgttgttcacgctgggagct

SEQ ID NO: 117584 - DNA, 22 bp, Artificial Sequence
  Synthetic oligonucleotide; CTG chr11 5373381 5373402 5373386 5373381 -
tgttgttcacgctgggagctgt

SEQ ID NO: 117585 - DNA, 22 bp, Artificial Sequence
  Synthetic oligonucleotide; TTG chr11 5373376 5373397 5373381 5373376 -
ttcacgctgggagctgtagacc

SEQ ID NO: 117586 - DNA, 22 bp, Artificial Sequence
  Synthetic oligonucleotide; TTC chr11 5373373 5373394 5373378 5373373 -
acgctgggagctgtagaccaga

SEQ ID NO: 117587 - DNA, 22 bp, Artificial Sequence
  Synthetic oligonucleotide; CTG chr11 5373367 5373388 5373372 5373367 -
ggagctgtagaccagagctgtt

SEQ ID NO: 117588 - DNA, 22 bp, Artificial Sequence
  Synthetic oligonucleotide; CTG chr11 5373360 5373381 5373365 5373360 -
tagaccagagctgttcctattt

SEQ ID NO: 117589 - DNA, 22 bp, Artificial Sequence
  Synthetic oligonucleotide; CTG chr11 5373347 5373368 5373352 5373347 -
ttcctatttggccatcttggct

SEQ ID NO: 117590 - DNA, 22 bp, Artificial Sequence
  Synthetic oligonucleotide; TTC chr11 5373344 5373365 5373349 5373344 -
ctatttggccatcttggctcaa

SEQ ID NO: 117591 - DNA, 22 bp, Artificial Sequence
  Synthetic oligonucleotide; CTA chr11 5373341 5373362 5373346 5373341 -
tttggccatcttggctcaaaaa

SEQ ID NO: 117592 - DNA, 22 bp, Artificial Sequence
  Synthetic oligonucleotide; TTT chr11 5373338 5373359 5373343 5373338 -
ggccatcttggctcaaaaactg

SEQ ID NO: 117593 - DNA, 22 bp, Artificial Sequence
  Synthetic oligonucleotide; TTG chr11 5373337 5373358 5373342 5373337 -
gccatcttggctcaaaaactgg

SEQ ID NO: 117594 - DNA, 22 bp, Artificial Sequence
  Synthetic oligonucleotide; CTT chr11 5373329 5373350 5373334 5373329 -
ggctcaaaaactggaactttat

SEQ ID NO: 117595 - DNA, 22 bp, Artificial Sequence
  Synthetic oligonucleotide; TTG chr11 5373328 5373349 5373333 5373328 -
gctcaaaaactggaactttatt

SEQ ID NO: 117596 - DNA, 22 bp, Artificial Sequence
  Synthetic oligonucleotide; CTC chr11 5373324 5373345 5373329 5373324 -
aaaaactggaactttatttgtg

SEQ ID NO: 117597 - DNA, 22 bp, Artificial Sequence
  Synthetic oligonucleotide; CTG chr11 5373316 5373337 5373321 5373316 -
gaactttatttgtgaaagaaaa

SEQ ID NO: 117598 - DNA, 22 bp, Artificial Sequence
  Synthetic oligonucleotide; CTT chr11 5373310 5373331 5373315 5373310 -
tatttgtgaaagaaaaaatcga

SEQ ID NO: 117599 - DNA, 22 bp, Artificial Sequence
  Synthetic oligonucleotide; TTT chr11 5373309 5373330 5373314 5373309 -
atttgtgaaagaaaaaatcgat

SEQ ID NO: 117600 - DNA, 22 bp, Artificial Sequence
  Synthetic oligonucleotide; TTA chr11 5373308 5373329 5373313 5373308 -
tttgtgaaagaaaaaatcgatc

SEQ ID NO: 117601 - DNA, 22 bp, Artificial Sequence
  Synthetic oligonucleotide; TTT chr11 5373305 5373326 5373310 5373305 -
gtgaaagaaaaaatcgatcaat

SEQ ID NO: 117602 - DNA, 22 bp, Artificial Sequence
  Synthetic oligonucleotide; TTG chr11 5373304 5373325 5373309 5373304 -
tgaaagaaaaaatcgatcaata

SEQ ID NO: 117603 - DNA, 22 bp, Artificial Sequence
  Synthetic oligonucleotide; CTT chr11 5373275 5373296 5373280 5373275 -
ccagtgaaaattttcttcaaat

SEQ ID NO: 117604 - DNA, 22 bp, Artificial Sequence
  Synthetic oligonucleotide; TTC chr11 5373274 5373295 5373279 5373274 -
cagtgaaaattttcttcaaatc

SEQ ID NO: 117605 - DNA, 22 bp, Artificial Sequence
  Synthetic oligonucleotide; TTT chr11 5373262 5373283 5373267 5373262 -
tcttcaaatcaagacaatatct

SEQ ID NO: 117606 - DNA, 22 bp, Artificial Sequence
  Synthetic oligonucleotide; TTT chr11 5373261 5373282 5373266 5373261 -
cttcaaatcaagacaatatcta

SEQ ID NO: 117607 - DNA, 22 bp, Artificial Sequence
  Synthetic oligonucleotide; TTC chr11 5373260 5373281 5373265 5373260 -
ttcaaatcaagacaatatctaa

SEQ ID NO: 117608 - DNA, 22 bp, Artificial Sequence
  Synthetic oligonucleotide; CTT chr11 5373258 5373279 5373263 5373258 -
caaatcaagacaatatctaaaa

SEQ ID NO: 117609 - DNA, 22 bp, Artificial Sequence
  Synthetic oligonucleotide; TTC chr11 5373257 5373278 5373262 5373257 -
aaatcaagacaatatctaaaaa

SEQ ID NO: 117610 - DNA, 22 bp, Artificial Sequence
  Synthetic oligonucleotide; CTA chr11 5373239 5373260 5373244 5373239 -
aaaaattgccgagactgatatc

SEQ ID NO: 117611 - DNA, 22 bp, Artificial Sequence
  Synthetic oligonucleotide; TTG chr11 5373231 5373252 5373236 5373231 -
ccgagactgatatcaagcagct

SEQ ID NO: 117612 - DNA, 22 bp, Artificial Sequence
  Synthetic oligonucleotide; CTG chr11 5373222 5373243 5373227 5373222 -
atatcaagcagctatctctata

SEQ ID NO: 117613 - DNA, 22 bp, Artificial Sequence
  Synthetic oligonucleotide; CTA chr11 5373208 5373229 5373213 5373208 -
tctctatacatgttcttccagg

SEQ ID NO: 117614 - DNA, 22 bp, Artificial Sequence
  Synthetic oligonucleotide; CTC chr11 5373204 5373225 5373209 5373204 -
tatacatgttcttccaggagtt

SEQ ID NO: 117615 - DNA, 22 bp, Artificial Sequence
  Synthetic oligonucleotide; CTA chr11 5373202 5373223 5373207 5373202 -
tacatgttcttccaggagtttt

SEQ ID NO: 117616 - DNA, 22 bp, Artificial Sequence
  Synthetic oligonucleotide; TTC chr11 5373193 5373214 5373198 5373193 -
ttccaggagttttgtgatttca

SEQ ID NO: 117617 - DNA, 22 bp, Artificial Sequence
  Synthetic oligonucleotide; CTT chr11 5373191 5373212 5373196 5373191 -
ccaggagttttgtgatttcagg

SEQ ID NO: 117618 - DNA, 22 bp, Artificial Sequence
  Synthetic oligonucleotide; TTC chr11 5373190 5373211 5373195 5373190 -
caggagttttgtgatttcaggt

SEQ ID NO: 117619 - DNA, 22 bp, Artificial Sequence
  Synthetic oligonucleotide; TTT chr11 5373181 5373202 5373186 5373181 -
tgtgatttcaggtcttacattt

SEQ ID NO: 117620 - DNA, 22 bp, Artificial Sequence
  Synthetic oligonucleotide; TTT chr11 5373180 5373201 5373185 5373180 -
gtgatttcaggtcttacattta

SEQ ID NO: 117621 - DNA, 22 bp, Artificial Sequence
  Synthetic oligonucleotide; TTG chr11 5373179 5373200 5373184 5373179 -
tgatttcaggtcttacatttat

SEQ ID NO: 117622 - DNA, 22 bp, Artificial Sequence
  Synthetic oligonucleotide; TTT chr11 5373173 5373194 5373178 5373173 -
caggtcttacatttatgtcttt

SEQ ID NO: 117623 - DNA, 22 bp, Artificial Sequence
  Synthetic oligonucleotide; TTC chr11 5373172 5373193 5373177 5373172 -
aggtcttacatttatgtcttta

SEQ ID NO: 117624 - DNA, 22 bp, Artificial Sequence
  Synthetic oligonucleotide; CTT chr11 5373165 5373186 5373170 5373165 -
acatttatgtctttaatctatt

SEQ ID NO: 117625 - DNA, 22 bp, Artificial Sequence
  Synthetic oligonucleotide; TTA chr11 5373164 5373185 5373169 5373164 -
catttatgtctttaatctattt

SEQ ID NO: 117626 - DNA, 22 bp, Artificial Sequence
  Synthetic oligonucleotide; TTT chr11 5373159 5373180 5373164 5373159 -
atgtctttaatctattttgagt

SEQ ID NO: 117627 - DNA, 22 bp, Artificial Sequence
  Synthetic oligonucleotide; TTA chr11 5373158 5373179 5373163 5373158 -
tgtctttaatctattttgagtt

SEQ ID NO: 117628 - DNA, 22 bp, Artificial Sequence
  Synthetic oligonucleotide; CTT chr11 5373152 5373173 5373157 5373152 -
taatctattttgagttgactta

SEQ ID NO: 117629 - DNA, 22 bp, Artificial Sequence
  Synthetic oligonucleotide; TTT chr11 5373151 5373172 5373156 5373151 -
aatctattttgagttgacttat

SEQ ID NO: 117630 - DNA, 22 bp, Artificial Sequence
  Synthetic oligonucleotide; TTA chr11 5373150 5373171 5373155 5373150 -
atctattttgagttgacttatg

SEQ ID NO: 117631 - DNA, 22 bp, Artificial Sequence
  Synthetic oligonucleotide; CTA chr11 5373145 5373166 5373150 5373145 -
ttttgagttgacttatggctta

SEQ ID NO: 117632 - DNA, 22 bp, Artificial Sequence
  Synthetic oligonucleotide; TTT chr11 5373142 5373163 5373147 5373142 -
tgagttgacttatggcttaagg

SEQ ID NO: 117633 - DNA, 22 bp, Artificial Sequence
  Synthetic oligonucleotide; TTT chr11 5373141 5373162 5373146 5373141 -
gagttgacttatggcttaaggt

SEQ ID NO: 117634 - DNA, 22 bp, Artificial Sequence
  Synthetic oligonucleotide; TTG chr11 5373140 5373161 5373145 5373140 -
agttgacttatggcttaaggta

SEQ ID NO: 117635 - DNA, 22 bp, Artificial Sequence
  Synthetic oligonucleotide; TTG chr11 5373135 5373156 5373140 5373135 -
acttatggcttaaggtaaaggt

SEQ ID NO: 117636 - DNA, 22 bp, Artificial Sequence
  Synthetic oligonucleotide; CTT chr11 5373131 5373152 5373136 5373131 -
atggcttaaggtaaaggtccaa

SEQ ID NO: 117637 - DNA, 22 bp, Artificial Sequence
  Synthetic oligonucleotide; TTA chr11 5373130 5373151 5373135 5373130 -
tggcttaaggtaaaggtccaat

SEQ ID NO: 117638 - DNA, 22 bp, Artificial Sequence
  Synthetic oligonucleotide; CTT chr11 5373124 5373145 5373129 5373124 -
aaggtaaaggtccaattttatt

SEQ ID NO: 117639 - DNA, 22 bp, Artificial Sequence
  Synthetic oligonucleotide; TTA chr11 5373123 5373144 5373128 5373123 -
aggtaaaggtccaattttattc

SEQ ID NO: 117640 - DNA, 22 bp, Artificial Sequence
  Synthetic oligonucleotide; TTT chr11 5373106 5373127 5373111 5373106 -
tattcttttgcatttggatatc

SEQ ID NO: 117641 - DNA, 22 bp, Artificial Sequence
  Synthetic oligonucleotide; TTT chr11 5373105 5373126 5373110 5373105 -
attcttttgcatttggatatcc

SEQ ID NO: 117642 - DNA, 22 bp, Artificial Sequence
  Synthetic oligonucleotide; TTA chr11 5373104 5373125 5373109 5373104 -
ttcttttgcatttggatatcca

SEQ ID NO: 117643 - DNA, 22 bp, Artificial Sequence
  Synthetic oligonucleotide; TTC chr11 5373101 5373122 5373106 5373101 -
ttttgcatttggatatccagtt

SEQ ID NO: 117644 - DNA, 22 bp, Artificial Sequence
  Synthetic oligonucleotide; CTT chr11 5373099 5373120 5373104 5373099 -
ttgcatttggatatccagtttt

SEQ ID NO: 117645 - DNA, 22 bp, Artificial Sequence
  Synthetic oligonucleotide; TTT chr11 5373098 5373119 5373103 5373098 -
tgcatttggatatccagttttc

SEQ ID NO: 117646 - DNA, 22 bp, Artificial Sequence
  Synthetic oligonucleotide; TTT chr11 5373097 5373118 5373102 5373097 -
gcatttggatatccagttttcc

SEQ ID NO: 117647 - DNA, 22 bp, Artificial Sequence
  Synthetic oligonucleotide; TTG chr11 5373096 5373117 5373101 5373096 -
catttggatatccagttttccc

SEQ ID NO: 117648 - DNA, 22 bp, Artificial Sequence
  Synthetic oligonucleotide; TTT chr11 5373091 5373112 5373096 5373091 -
ggatatccagttttcccaacac

SEQ ID NO: 117649 - DNA, 22 bp, Artificial Sequence
  Synthetic oligonucleotide; TTG chr11 5373090 5373111 5373095 5373090 -
gatatccagttttcccaacact

SEQ ID NO: 117650 - DNA, 22 bp, Artificial Sequence
  Synthetic oligonucleotide; TTT chr11 5373078 5373099 5373083 5373078 -
tcccaacactatttgttgagga

SEQ ID NO: 117651 - DNA, 22 bp, Artificial Sequence
  Synthetic oligonucleotide; TTT chr11 5373077 5373098 5373082 5373077 -
cccaacactatttgttgaggag

SEQ ID NO: 117652 - DNA, 22 bp, Artificial Sequence
  Synthetic oligonucleotide; TTC chr11 5373076 5373097 5373081 5373076 -
ccaacactatttgttgaggaga

SEQ ID NO: 117653 - DNA, 22 bp, Artificial Sequence
  Synthetic oligonucleotide; CTA chr11 5373067 5373088 5373072 5373067 -
tttgttgaggagactatccttc

SEQ ID NO: 117654 - DNA, 22 bp, Artificial Sequence
  Synthetic oligonucleotide; TTT chr11 5373064 5373085 5373069 5373064 -
gttgaggagactatccttcccc

SEQ ID NO: 117655 - DNA, 22 bp, Artificial Sequence
  Synthetic oligonucleotide; TTG chr11 5373063 5373084 5373068 5373063 -
ttgaggagactatccttcccct

SEQ ID NO: 117656 - DNA, 22 bp, Artificial Sequence
  Synthetic oligonucleotide; TTG chr11 5373060 5373081 5373065 5373060 -
aggagactatccttcccctatt

SEQ ID NO: 117657 - DNA, 22 bp, Artificial Sequence
  Synthetic oligonucleotide; CTA chr11 5373051 5373072 5373056 5373051 -
tccttcccctattgtgttggtg

SEQ ID NO: 117658 - DNA, 22 bp, Artificial Sequence
  Synthetic oligonucleotide; CTT chr11 5373046 5373067 5373051 5373046 -
cccctattgtgttggtggcctt

SEQ ID NO: 117659 - DNA, 22 bp, Artificial Sequence
  Synthetic oligonucleotide; TTC chr11 5373045 5373066 5373050 5373045 -
ccctattgtgttggtggccttg

SEQ ID NO: 117660 - DNA, 22 bp, Artificial Sequence
  Synthetic oligonucleotide; CTA chr11 5373040 5373061 5373045 5373040 -
ttgtgttggtggccttgttgag

SEQ ID NO: 117661 - DNA, 22 bp, Artificial Sequence
  Synthetic oligonucleotide; TTG chr11 5373037 5373058 5373042 5373037 -
tgttggtggccttgttgagaat

SEQ ID NO: 117662 - DNA, 22 bp, Artificial Sequence
  Synthetic oligonucleotide; TTG chr11 5373032 5373053 5373037 5373032 -
gtggccttgttgagaattactg

SEQ ID NO: 117663 - DNA, 22 bp, Artificial Sequence
  Synthetic oligonucleotide; CTT chr11 5373024 5373045 5373029 5373024 -
gttgagaattactggactgtat

SEQ ID NO: 117664 - DNA, 22 bp, Artificial Sequence
  Synthetic oligonucleotide; TTG chr11 5373023 5373044 5373028 5373023 -
ttgagaattactggactgtata

SEQ ID NO: 117665 - DNA, 22 bp, Artificial Sequence
  Synthetic oligonucleotide; TTG chr11 5373020 5373041 5373025 5373020 -
agaattactggactgtatatac

SEQ ID NO: 117666 - DNA, 22 bp, Artificial Sequence
  Synthetic oligonucleotide; TTA chr11 5373013 5373034 5373018 5373013 -
ctggactgtatatacgtaaatt

SEQ ID NO: 117667 - DNA, 22 bp, Artificial Sequence
  Synthetic oligonucleotide; CTG chr11 5373010 5373031 5373015 5373010 -
gactgtatatacgtaaatttat

SEQ ID NO: 117668 - DNA, 22 bp, Artificial Sequence
  Synthetic oligonucleotide; CTG chr11 5373005 5373026 5373010 5373005 -
tatatacgtaaatttatttctg

SEQ ID NO: 117669 - DNA, 22 bp, Artificial Sequence
  Synthetic oligonucleotide; TTT chr11 5372990 5373011 5372995 5372990 -
atttctgggctctttattctgt

SEQ ID NO: 117670 - DNA, 22 bp, Artificial Sequence
  Synthetic oligonucleotide; TTA chr11 5372989 5373010 5372994 5372989 -
tttctgggctctttattctgtt

SEQ ID NO: 117671 - DNA, 22 bp, Artificial Sequence
  Synthetic oligonucleotide; TTT chr11 5372986 5373007 5372991 5372986 -
ctgggctctttattctgttcaa

SEQ ID NO: 117672 - DNA, 22 bp, Artificial Sequence
  Synthetic oligonucleotide; TTC chr11 5372985 5373006 5372990 5372985 -
tgggctctttattctgttcaat

SEQ ID NO: 117673 - DNA, 22 bp, Artificial Sequence
  Synthetic oligonucleotide; CTG chr11 5372983 5373004 5372988 5372983 -
ggctctttattctgttcaattt

SEQ ID NO: 117674 - DNA, 22 bp, Artificial Sequence
  Synthetic oligonucleotide; CTC chr11 5372978 5372999 5372983 5372978 -
tttattctgttcaatttggtct

SEQ ID NO: 117675 - DNA, 22 bp, Artificial Sequence
  Synthetic oligonucleotide; CTT chr11 5372976 5372997 5372981 5372976 -
tattctgttcaatttggtctat

SEQ ID NO: 117676 - DNA, 22 bp, Artificial Sequence
  Synthetic oligonucleotide; TTT chr11 5372975 5372996 5372980 5372975 -
attctgttcaatttggtctatg

SEQ ID NO: 117677 - DNA, 22 bp, Artificial Sequence
  Synthetic oligonucleotide; TTA chr11 5372974 5372995 5372979 5372974 -
ttctgttcaatttggtctatgt

SEQ ID NO: 117678 - DNA, 22 bp, Artificial Sequence
  Synthetic oligonucleotide; TTC chr11 5372971 5372992 5372976 5372971 -
tgttcaatttggtctatgtgtc

SEQ ID NO: 117679 - DNA, 22 bp, Artificial Sequence
  Synthetic oligonucleotide; CTG chr11 5372969 5372990 5372974 5372969 -
ttcaatttggtctatgtgtcta

SEQ ID NO: 117680 - DNA, 22 bp, Artificial Sequence
  Synthetic oligonucleotide; TTC chr11 5372966 5372987 5372971 5372966 -
aatttggtctatgtgtctattt

SEQ ID NO: 117681 - DNA, 22 bp, Artificial Sequence
  Synthetic oligonucleotide; TTT chr11 5372961 5372982 5372966 5372961 -
ggtctatgtgtctatttatgtg

SEQ ID NO: 117682 - DNA, 22 bp, Artificial Sequence
  Synthetic oligonucleotide; TTG chr11 5372960 5372981 5372965 5372960 -
gtctatgtgtctatttatgtga

SEQ ID NO: 117683 - DNA, 22 bp, Artificial Sequence
  Synthetic oligonucleotide; CTA chr11 5372955 5372976 5372960 5372955 -
tgtgtctatttatgtgatagta

SEQ ID NO: 117684 - DNA, 22 bp, Artificial Sequence
  Synthetic oligonucleotide; CTA chr11 5372947 5372968 5372952 5372947 -
tttatgtgatagtaccatactt

SEQ ID NO: 117685 - DNA, 22 bp, Artificial Sequence
  Synthetic oligonucleotide; TTT chr11 5372944 5372965 5372949 5372944 -
atgtgatagtaccatacttttt

SEQ ID NO: 117686 - DNA, 22 bp, Artificial Sequence
  Synthetic oligonucleotide; TTA chr11 5372943 5372964 5372948 5372943 -
tgtgatagtaccatactttttt

SEQ ID NO: 117687 - DNA, 22 bp, Artificial Sequence
  Synthetic oligonucleotide; CTT chr11 5372925 5372946 5372930 5372925 -
ttttggttactatagctttgta

SEQ ID NO: 117688 - DNA, 22 bp, Artificial Sequence
  Synthetic oligonucleotide; TTT chr11 5372924 5372945 5372929 5372924 -
tttggttactatagctttgtaa

SEQ ID NO: 117689 - DNA, 22 bp, Artificial Sequence
  Synthetic oligonucleotide; TTT chr11 5372923 5372944 5372928 5372923 -
ttggttactatagctttgtaat

SEQ ID NO: 117690 - DNA, 22 bp, Artificial Sequence
  Synthetic oligonucleotide; TTT chr11 5372922 5372943 5372927 5372922 -
tggttactatagctttgtaata

SEQ ID NO: 117691 - DNA, 22 bp, Artificial Sequence
  Synthetic oligonucleotide; TTT chr11 5372921 5372942 5372926 5372921 -
ggttactatagctttgtaatat

SEQ ID NO: 117692 - DNA, 22 bp, Artificial Sequence
  Synthetic oligonucleotide; TTG chr11 5372920 5372941 5372925 5372920 -
gttactatagctttgtaatata

SEQ ID NO: 117693 - DNA, 22 bp, Artificial Sequence
  Synthetic oligonucleotide; TTA chr11 5372916 5372937 5372921 5372916 -
ctatagctttgtaatataattt

SEQ ID NO: 117694 - DNA, 22 bp, Artificial Sequence
  Synthetic oligonucleotide; CTA chr11 5372913 5372934 5372918 5372913 -
tagctttgtaatataatttgaa

SEQ ID NO: 117695 - DNA, 22 bp, Artificial Sequence
  Synthetic oligonucleotide; CTT chr11 5372907 5372928 5372912 5372907 -
tgtaatataatttgaaatcaga

SEQ ID NO: 117696 - DNA, 22 bp, Artificial Sequence
  Synthetic oligonucleotide; TTT chr11 5372906 5372927 5372911 5372906 -
gtaatataatttgaaatcagaa

SEQ ID NO: 117697 - DNA, 22 bp, Artificial Sequence
  Synthetic oligonucleotide; TTG chr11 5372905 5372926 5372910 5372905 -
taatataatttgaaatcagaac

SEQ ID NO: 117698 - DNA, 22 bp, Artificial Sequence
  Synthetic oligonucleotide; TTT chr11 5372894 5372915 5372899 5372894 -
gaaatcagaacgtgtgctgcca

SEQ ID NO: 117699 - DNA, 22 bp, Artificial Sequence
  Synthetic oligonucleotide; TTG chr11 5372893 5372914 5372898 5372893 -
aaatcagaacgtgtgctgccat

SEQ ID NO: 117700 - DNA, 22 bp, Artificial Sequence
  Synthetic oligonucleotide; CTG chr11 5372875 5372896 5372880 5372875 -
ccatcaagttggtttttctttc

SEQ ID NO: 117701 - DNA, 22 bp, Artificial Sequence
  Synthetic oligonucleotide; TTG chr11 5372864 5372885 5372869 5372864 -
gtttttctttctcaagattgtt

SEQ ID NO: 117702 - DNA, 22 bp, Artificial Sequence
  Synthetic oligonucleotide; TTT chr11 5372860 5372881 5372865 5372860 -
ttctttctcaagattgttttgg

SEQ ID NO: 117703 - DNA, 22 bp, Artificial Sequence
  Synthetic oligonucleotide; TTT chr11 5372859 5372880 5372864 5372859 -
tctttctcaagattgttttggc

SEQ ID NO: 117704 - DNA, 22 bp, Artificial Sequence
  Synthetic oligonucleotide; TTT chr11 5372858 5372879 5372863 5372858 -
ctttctcaagattgttttggcc

SEQ ID NO: 117705 - DNA, 22 bp, Artificial Sequence
  Synthetic oligonucleotide; TTC chr11 5372857 5372878 5372862 5372857 -
tttctcaagattgttttggcca

SEQ ID NO: 117706 - DNA, 22 bp, Artificial Sequence
  Synthetic oligonucleotide; CTT chr11 5372855 5372876 5372860 5372855 -
tctcaagattgttttggccatt

SEQ ID NO: 117707 - DNA, 22 bp, Artificial Sequence
  Synthetic oligonucleotide; TTT chr11 5372854 5372875 5372859 5372854 -
ctcaagattgttttggccattt

SEQ ID NO: 117708 - DNA, 22 bp, Artificial Sequence
  Synthetic oligonucleotide; TTC chr11 5372853 5372874 5372858 5372853 -
tcaagattgttttggccatttg

SEQ ID NO: 117709 - DNA, 22 bp, Artificial Sequence
  Synthetic oligonucleotide; CTC chr11 5372851 5372872 5372856 5372851 -
aagattgttttggccatttggg

SEQ ID NO: 117710 - DNA, 22 bp, Artificial Sequence
  Synthetic oligonucleotide; TTG chr11 5372844 5372865 5372849 5372844 -
ttttggccatttgggggtgttc

SEQ ID NO: 117711 - DNA, 22 bp, Artificial Sequence
  Synthetic oligonucleotide; TTT chr11 5372841 5372862 5372846 5372841 -
tggccatttgggggtgttctgt

SEQ ID NO: 117712 - DNA, 22 bp, Artificial Sequence
  Synthetic oligonucleotide; TTT chr11 5372840 5372861 5372845 5372840 -
ggccatttgggggtgttctgtg

SEQ ID NO: 117713 - DNA, 22 bp, Artificial Sequence
  Synthetic oligonucleotide; TTG chr11 5372839 5372860 5372844 5372839 -
gccatttgggggtgttctgtgg

SEQ ID NO: 117714 - DNA, 22 bp, Artificial Sequence
  Synthetic oligonucleotide; TTT chr11 5372832 5372853 5372837 5372832 -
gggggtgttctgtggtttcata

SEQ ID NO: 117715 - DNA, 22 bp, Artificial Sequence
  Synthetic oligonucleotide; TTG chr11 5372831 5372852 5372836 5372831 -
ggggtgttctgtggtttcatac

SEQ ID NO: 117716 - DNA, 22 bp, Artificial Sequence
  Synthetic oligonucleotide; TTC chr11 5372822 5372843 5372827 5372822 -
tgtggtttcatacaaattttca

SEQ ID NO: 117717 - DNA, 22 bp, Artificial Sequence
  Synthetic oligonucleotide; CTG chr11 5372820 5372841 5372825 5372820 -
tggtttcatacaaattttcaaa

SEQ ID NO: 117718 - DNA, 22 bp, Artificial Sequence
  Synthetic oligonucleotide; TTT chr11 5372814 5372835 5372819 5372814 -
catacaaattttcaaattgttt

SEQ ID NO: 117719 - DNA, 22 bp, Artificial Sequence
  Synthetic oligonucleotide; TTC chr11 5372813 5372834 5372818 5372813 -
atacaaattttcaaattgtttt

SEQ ID NO: 117720 - DNA, 22 bp, Artificial Sequence
  Synthetic oligonucleotide; TTT chr11 5372803 5372824 5372808 5372803 -
tcaaattgttttctgtaaaatg

SEQ ID NO: 117721 - DNA, 22 bp, Artificial Sequence
  Synthetic oligonucleotide; TTT chr11 5372802 5372823 5372807 5372802 -
caaattgttttctgtaaaatgt

SEQ ID NO: 117722 - DNA, 22 bp, Artificial Sequence
  Synthetic oligonucleotide; TTC chr11 5372801 5372822 5372806 5372801 -
aaattgttttctgtaaaatgtg

SEQ ID NO: 117723 - DNA, 22 bp, Artificial Sequence
  Synthetic oligonucleotide; TTG chr11 5372795 5372816 5372800 5372795 -
ttttctgtaaaatgtgccagag

SEQ ID NO: 117724 - DNA, 22 bp, Artificial Sequence
  Synthetic oligonucleotide; TTT chr11 5372792 5372813 5372797 5372792 -
tctgtaaaatgtgccagagctc

SEQ ID NO: 117725 - DNA, 22 bp, Artificial Sequence
  Synthetic oligonucleotide; TTT chr11 5372791 5372812 5372796 5372791 -
ctgtaaaatgtgccagagctca

SEQ ID NO: 117726 - DNA, 22 bp, Artificial Sequence
  Synthetic oligonucleotide; TTC chr11 5372790 5372811 5372795 5372790 -
tgtaaaatgtgccagagctcag

SEQ ID NO: 117727 - DNA, 22 bp, Artificial Sequence
  Synthetic oligonucleotide; CTG chr11 5372788 5372809 5372793 5372788 -
taaaatgtgccagagctcaggt

SEQ ID NO: 117728 - DNA, 22 bp, Artificial Sequence
  Synthetic oligonucleotide; CTC chr11 5372770 5372791 5372775 5372770 -
aggtaacaaaagcaaaaataaa

SEQ ID NO: 117729 - DNA, 22 bp, Artificial Sequence
  Synthetic oligonucleotide; CTA chr11 5372726 5372747 5372731 5372726 -
aatattttctgcacagcaaaga

SEQ ID NO: 117730 - DNA, 22 bp, Artificial Sequence
  Synthetic oligonucleotide; TTT chr11 5372719 5372740 5372724 5372719 -
tctgcacagcaaagaaaacaat

SEQ ID NO: 117731 - DNA, 22 bp, Artificial Sequence
  Synthetic oligonucleotide; TTT chr11 5372718 5372739 5372723 5372718 -
ctgcacagcaaagaaaacaatc

SEQ ID NO: 117732 - DNA, 22 bp, Artificial Sequence
  Synthetic oligonucleotide; TTC chr11 5372717 5372738 5372722 5372717 -
tgcacagcaaagaaaacaatca

SEQ ID NO: 117733 - DNA, 22 bp, Artificial Sequence
  Synthetic oligonucleotide; CTG chr11 5372715 5372736 5372720 5372715 -
cacagcaaagaaaacaatcatc

SEQ ID NO: 117734 - DNA, 22 bp, Artificial Sequence
  Synthetic oligonucleotide; TTT chr11 5372679 5372700 5372684 5372679 -
gggagaaaatatttacagatca

SEQ ID NO: 117735 - DNA, 22 bp, Artificial Sequence
  Synthetic oligonucleotide; TTG chr11 5372678 5372699 5372683 5372678 -
ggagaaaatatttacagatcat

SEQ ID NO: 117736 - DNA, 22 bp, Artificial Sequence
  Synthetic oligonucleotide; TTT chr11 5372665 5372686 5372670 5372665 -
acagatcatatatctgatacaa

SEQ ID NO: 117737 - DNA, 22 bp, Artificial Sequence
  Synthetic oligonucleotide; TTA chr11 5372664 5372685 5372669 5372664 -
cagatcatatatctgatacaag

SEQ ID NO: 117738 - DNA, 22 bp, Artificial Sequence
  Synthetic oligonucleotide; CTG chr11 5372649 5372670 5372654 5372649 -
atacaagtctaatacccaaaat

SEQ ID NO: 117739 - DNA, 22 bp, Artificial Sequence
  Synthetic oligonucleotide; CTA chr11 5372638 5372659 5372643 5372638 -
atacccaaaatatataaggaac

SEQ ID NO: 117740 - DNA, 22 bp, Artificial Sequence
  Synthetic oligonucleotide; CTC chr11 5372614 5372635 5372619 5372614 -
aatcaactaaatatgaaaaaat

SEQ ID NO: 117741 - DNA, 22 bp, Artificial Sequence
  Synthetic oligonucleotide; CTA chr11 5372605 5372626 5372610 5372605 -
aatatgaaaaaatataatagta

SEQ ID NO: 117742 - DNA, 22 bp, Artificial Sequence
  Synthetic oligonucleotide; CTA chr11 5372578 5372599 5372583 5372578 -
agtaaaaatgggcaaaggatct

SEQ ID NO: 117743 - DNA, 22 bp, Artificial Sequence
  Synthetic oligonucleotide; CTG chr11 5372555 5372576 5372560 5372555 -
aatatacatttctctgaagaca

SEQ ID NO: 117744 - DNA, 22 bp, Artificial Sequence
  Synthetic oligonucleotide; TTT chr11 5372544 5372565 5372549 5372544 -
ctctgaagacatgcaaatggtc

SEQ ID NO: 117745 - DNA, 22 bp, Artificial Sequence
  Synthetic oligonucleotide; TTC chr11 5372543 5372564 5372548 5372543 -
tctgaagacatgcaaatggtca

SEQ ID NO: 117746 - DNA, 22 bp, Artificial Sequence
  Synthetic oligonucleotide; CTC chr11 5372541 5372562 5372546 5372541 -
tgaagacatgcaaatggtcagc

SEQ ID NO: 117747 - DNA, 22 bp, Artificial Sequence
  Synthetic oligonucleotide; CTG chr11 5372539 5372560 5372544 5372539 -
aagacatgcaaatggtcagcag

SEQ ID NO: 117748 - DNA, 22 bp, Artificial Sequence
  Synthetic oligonucleotide; CTA chr11 5372497 5372518 5372502 5372497 -
catcaccaatcatcaggaaaat

SEQ ID NO: 117749 - DNA, 22 bp, Artificial Sequence
  Synthetic oligonucleotide; CTC chr11 5372449 5372470 5372454 5372449 -
acacctgttgagatggctatta

SEQ ID NO: 117750 - DNA, 22 bp, Artificial Sequence
  Synthetic oligonucleotide; CTG chr11 5372442 5372463 5372447 5372442 -
ttgagatggctattatcaaaaa

SEQ ID NO: 117751 - DNA, 22 bp, Artificial Sequence
  Synthetic oligonucleotide; TTG chr11 5372439 5372460 5372444 5372439 -
agatggctattatcaaaaaaga

SEQ ID NO: 117752 - DNA, 22 bp, Artificial Sequence
  Synthetic oligonucleotide; CTA chr11 5372430 5372451 5372435 5372430 -
ttatcaaaaaagacaagagata

SEQ ID NO: 117753 - DNA, 22 bp, Artificial Sequence
  Synthetic oligonucleotide; TTA chr11 5372427 5372448 5372432 5372427 -
tcaaaaaagacaagagataggg

SEQ ID NO: 117754 - DNA, 22 bp, Artificial Sequence
  Synthetic oligonucleotide; TTG chr11 5372401 5372422 5372406 5372401 -
gagaggctgtggagaaaggaga

SEQ ID NO: 117755 - DNA, 22 bp, Artificial Sequence
  Synthetic oligonucleotide; CTG chr11 5372392 5372413 5372397 5372392 -
tggagaaaggagaactcttgtg

SEQ ID NO: 117756 - DNA, 22 bp, Artificial Sequence
  Synthetic oligonucleotide; CTC chr11 5372375 5372396 5372380 5372375 -
ttgtgcatagctggtgggaatg

SEQ ID NO: 117757 - DNA, 22 bp, Artificial Sequence
  Synthetic oligonucleotide; CTT chr11 5372373 5372394 5372378 5372373 -
gtgcatagctggtgggaatgta

SEQ ID NO: 117758 - DNA, 22 bp, Artificial Sequence
  Synthetic oligonucleotide; TTG chr11 5372372 5372393 5372377 5372372 -
tgcatagctggtgggaatgtaa

SEQ ID NO: 117759 - DNA, 22 bp, Artificial Sequence
  Synthetic oligonucleotide; CTG chr11 5372362 5372383 5372367 5372362 -
gtgggaatgtaagttaacatag

SEQ ID NO: 117760 - DNA, 22 bp, Artificial Sequence
  Synthetic oligonucleotide; TTA chr11 5372346 5372367 5372351 5372346 -
acatagccattatagaaaacgt

SEQ ID NO: 117761 - DNA, 22 bp, Artificial Sequence
  Synthetic oligonucleotide; TTA chr11 5372334 5372355 5372339 5372334 -
tagaaaacgtatggaagtttct

SEQ ID NO: 117762 - DNA, 22 bp, Artificial Sequence
  Synthetic oligonucleotide; TTT chr11 5372314 5372335 5372319 5372314 -
ctcaaacaactaaaaatagagt

SEQ ID NO: 117763 - DNA, 22 bp, Artificial Sequence
  Synthetic oligonucleotide; TTC chr11 5372313 5372334 5372318 5372313 -
tcaaacaactaaaaatagagtt

SEQ ID NO: 117764 - DNA, 22 bp, Artificial Sequence
  Synthetic oligonucleotide; CTC chr11 5372311 5372332 5372316 5372311 -
aaacaactaaaaatagagttat

SEQ ID NO: 117765 - DNA, 22 bp, Artificial Sequence
  Synthetic oligonucleotide; CTA chr11 5372302 5372323 5372307 5372302 -
aaaatagagttattgtatgatg

SEQ ID NO: 117766 - DNA, 22 bp, Artificial Sequence
  Synthetic oligonucleotide; TTA chr11 5372290 5372311 5372295 5372290 -
ttgtatgatgaagaaatttctc

SEQ ID NO: 117767 - DNA, 22 bp, Artificial Sequence
  Synthetic oligonucleotide; TTG chr11 5372287 5372308 5372292 5372287 -
tatgatgaagaaatttctctgc

SEQ ID NO: 117768 - DNA, 22 bp, Artificial Sequence
  Synthetic oligonucleotide; TTT chr11 5372271 5372292 5372276 5372271 -
ctctgctgtatatgtatccaaa

SEQ ID NO: 117769 - DNA, 22 bp, Artificial Sequence
  Synthetic oligonucleotide; TTC chr11 5372270 5372291 5372275 5372270 -
tctgctgtatatgtatccaaaa

SEQ ID NO: 117770 - DNA, 22 bp, Artificial Sequence
  Synthetic oligonucleotide; CTC chr11 5372268 5372289 5372273 5372268 -
tgctgtatatgtatccaaaata

SEQ ID NO: 117771 - DNA, 22 bp, Artificial Sequence
  Synthetic oligonucleotide; CTG chr11 5372266 5372287 5372271 5372266 -
ctgtatatgtatccaaaataaa

SEQ ID NO: 117772 - DNA, 22 bp, Artificial Sequence
  Synthetic oligonucleotide; CTG chr11 5372263 5372284 5372268 5372263 -
tatatgtatccaaaataaataa

SEQ ID NO: 117773 - DNA, 22 bp, Artificial Sequence
  Synthetic oligonucleotide; TTT chr11 5372230 5372251 5372235 5372230 -
tctagagctatctgcactctca

SEQ ID NO: 117774 - DNA, 22 bp, Artificial Sequence
  Synthetic oligonucleotide; TTT chr11 5372229 5372250 5372234 5372229 -
ctagagctatctgcactctcat

SEQ ID NO: 117775 - DNA, 22 bp, Artificial Sequence
  Synthetic oligonucleotide; TTC chr11 5372228 5372249 5372233 5372228 -
tagagctatctgcactctcatg

SEQ ID NO: 117776 - DNA, 22 bp, Artificial Sequence
  Synthetic oligonucleotide; CTA chr11 5372226 5372247 5372231 5372226 -
gagctatctgcactctcatgtt

SEQ ID NO: 117777 - DNA, 22 bp, Artificial Sequence
  Synthetic oligonucleotide; CTA chr11 5372220 5372241 5372225 5372220 -
tctgcactctcatgttaattgc

SEQ ID NO: 117778 - DNA, 22 bp, Artificial Sequence
  Synthetic oligonucleotide; CTG chr11 5372216 5372237 5372221 5372216 -
cactctcatgttaattgcagca

SEQ ID NO: 117779 - DNA, 22 bp, Artificial Sequence
  Synthetic oligonucleotide; CTC chr11 5372211 5372232 5372216 5372211 -
tcatgttaattgcagcattatt

SEQ ID NO: 117780 - DNA, 22 bp, Artificial Sequence
  Synthetic oligonucleotide; CTC chr11 5372209 5372230 5372214 5372209 -
atgttaattgcagcattattca

SEQ ID NO: 117781 - DNA, 22 bp, Artificial Sequence
  Synthetic oligonucleotide; TTA chr11 5372203 5372224 5372208 5372203 -
attgcagcattattcacaatag

SEQ ID NO: 117782 - DNA, 22 bp, Artificial Sequence
  Synthetic oligonucleotide; TTG chr11 5372199 5372220 5372204 5372199 -
cagcattattcacaatagccaa

SEQ ID NO: 117783 - DNA, 22 bp, Artificial Sequence
  Synthetic oligonucleotide; TTA chr11 5372191 5372212 5372196 5372191 -
ttcacaatagccaagacatgga

SEQ ID NO: 117784 - DNA, 22 bp, Artificial Sequence
  Synthetic oligonucleotide; TTC chr11 5372188 5372209 5372193 5372188 -
acaatagccaagacatggaaac

SEQ ID NO: 117785 - DNA, 22 bp, Artificial Sequence
  Synthetic oligonucleotide; CTA chr11 5372160 5372181 5372165 5372160 -
agtggtatctatatatagatga

SEQ ID NO: 117786 - DNA, 22 bp, Artificial Sequence
  Synthetic oligonucleotide; CTA chr11 5372149 5372170 5372154 5372149 -
tatatagatgaacagataaaga

SEQ ID NO: 117787 - DNA, 22 bp, Artificial Sequence
  Synthetic oligonucleotide; TTG chr11 5372122 5372143 5372127 5372122 -
tgacaggtctgtatatgatatt

SEQ ID NO: 117788 - DNA, 22 bp, Artificial Sequence
  Synthetic oligonucleotide; CTG chr11 5372111 5372132 5372116 5372111 -
tatatgatattgtgatatatgt

SEQ ID NO: 117789 - DNA, 22 bp, Artificial Sequence
  Synthetic oligonucleotide; TTG chr11 5372099 5372120 5372104 5372099 -
tgatatatgtcatatgtatgta

SEQ ID NO: 117790 - DNA, 22 bp, Artificial Sequence
  Synthetic oligonucleotide; TTA chr11 5372061 5372082 5372066 5372061 -
ttcagccttaaaaaaggagatg

SEQ ID NO: 117791 - DNA, 22 bp, Artificial Sequence
  Synthetic oligonucleotide; TTC chr11 5372058 5372079 5372063 5372058 -
agccttaaaaaaggagatgggg

SEQ ID NO: 117792 - DNA, 22 bp, Artificial Sequence
  Synthetic oligonucleotide; CTT chr11 5372052 5372073 5372057 5372052 -
aaaaaaggagatggggggaatg

SEQ ID NO: 117793 - DNA, 22 bp, Artificial Sequence
  Synthetic oligonucleotide; TTA chr11 5372051 5372072 5372056 5372051 -
aaaaaggagatggggggaatgt

SEQ ID NO: 117794 - DNA, 22 bp, Artificial Sequence
  Synthetic oligonucleotide; CTA chr11 5372020 5372041 5372025 5372020 -
gagtacattttgctaagtgaaa

SEQ ID NO: 117795 - DNA, 22 bp, Artificial Sequence
  Synthetic oligonucleotide; TTT chr11 5372010 5372031 5372015 5372010 -
tgctaagtgaaataaaccagac

SEQ ID NO: 117796 - DNA, 22 bp, Artificial Sequence
  Synthetic oligonucleotide; TTT chr11 5372009 5372030 5372014 5372009 -
gctaagtgaaataaaccagaca

SEQ ID NO: 117797 - DNA, 22 bp, Artificial Sequence
  Synthetic oligonucleotide; TTG chr11 5372008 5372029 5372013 5372008 -
ctaagtgaaataaaccagacac

SEQ ID NO: 117798 - DNA, 22 bp, Artificial Sequence
  Synthetic oligonucleotide; CTA chr11 5372005 5372026 5372010 5372005 -
agtgaaataaaccagacacaga

SEQ ID NO: 117799 - DNA, 22 bp, Artificial Sequence
  Synthetic oligonucleotide; TTA chr11 5371961 5371982 5371966 5371961 -
cttatatgtggaatctcaaaag

SEQ ID NO: 117800 - DNA, 22 bp, Artificial Sequence
  Synthetic oligonucleotide; CTT chr11 5371958 5371979 5371963 5371958 -
atatgtggaatctcaaaagaaa

SEQ ID NO: 117801 - DNA, 22 bp, Artificial Sequence
  Synthetic oligonucleotide; TTA chr11 5371957 5371978 5371962 5371957 -
tatgtggaatctcaaaagaaaa

SEQ ID NO: 117802 - DNA, 22 bp, Artificial Sequence
  Synthetic oligonucleotide; CTC chr11 5371944 5371965 5371949 5371944 -
aaaagaaaaataaggtcaaatg

SEQ ID NO: 117803 - DNA, 22 bp, Artificial Sequence
  Synthetic oligonucleotide; TTA chr11 5371858 5371879 5371863 5371858 -
taaacttgcagctgtataggat

SEQ ID NO: 117804 - DNA, 22 bp, Artificial Sequence
  Synthetic oligonucleotide; CTT chr11 5371851 5371872 5371856 5371851 -
gcagctgtataggataaataag

SEQ ID NO: 117805 - DNA, 22 bp, Artificial Sequence
  Synthetic oligonucleotide; TTG chr11 5371850 5371871 5371855 5371850 -
cagctgtataggataaataagt

SEQ ID NO: 117806 - DNA, 22 bp, Artificial Sequence
  Synthetic oligonucleotide; CTG chr11 5371844 5371865 5371849 5371844 -
tataggataaataagtttagag

SEQ ID NO: 117807 - DNA, 22 bp, Artificial Sequence
  Synthetic oligonucleotide; TTT chr11 5371826 5371847 5371831 5371826 -
agagatctagtgtatggcatga

SEQ ID NO: 117808 - DNA, 22 bp, Artificial Sequence
  Synthetic oligonucleotide; TTA chr11 5371825 5371846 5371830 5371825 -
gagatctagtgtatggcatgaa

SEQ ID NO: 117809 - DNA, 22 bp, Artificial Sequence
  Synthetic oligonucleotide; CTA chr11 5371817 5371838 5371822 5371817 -
gtgtatggcatgaagacttaat

SEQ ID NO: 117810 - DNA, 22 bp, Artificial Sequence
  Synthetic oligonucleotide; CTT chr11 5371798 5371819 5371803 5371798 -
aatactgtactgtaaactaaac

SEQ ID NO: 117811 - DNA, 22 bp, Artificial Sequence
  Synthetic oligonucleotide; TTA chr11 5371797 5371818 5371802 5371797 -
atactgtactgtaaactaaaca

SEQ ID NO: 117812 - DNA, 22 bp, Artificial Sequence
  Synthetic oligonucleotide; CTG chr11 5371791 5371812 5371796 5371791 -
tactgtaaactaaacatttgtt

SEQ ID NO: 117813 - DNA, 22 bp, Artificial Sequence
  Synthetic oligonucleotide; CTG chr11 5371786 5371807 5371791 5371786 -
taaactaaacatttgttatgac

SEQ ID NO: 117814 - DNA, 22 bp, Artificial Sequence
  Synthetic oligonucleotide; CTA chr11 5371779 5371800 5371784 5371779 -
aacatttgttatgacagtagat

SEQ ID NO: 117815 - DNA, 22 bp, Artificial Sequence
  Synthetic oligonucleotide; TTT chr11 5371772 5371793 5371777 5371772 -
gttatgacagtagatgttagat

SEQ ID NO: 117816 - DNA, 22 bp, Artificial Sequence
  Synthetic oligonucleotide; TTG chr11 5371771 5371792 5371776 5371771 -
ttatgacagtagatgttagatg

SEQ ID NO: 117817 - DNA, 22 bp, Artificial Sequence
  Synthetic oligonucleotide; TTA chr11 5371768 5371789 5371773 5371768 -
tgacagtagatgttagatgccc

SEQ ID NO: 117818 - DNA, 22 bp, Artificial Sequence
  Synthetic oligonucleotide; TTA chr11 5371753 5371774 5371758 5371753 -
gatgcccttacacaaagaaaaa

SEQ ID NO: 117819 - DNA, 22 bp, Artificial Sequence
  Synthetic oligonucleotide; CTT chr11 5371744 5371765 5371749 5371744 -
acacaaagaaaaagcaaaaggt

SEQ ID NO: 117820 - DNA, 22 bp, Artificial Sequence
  Synthetic oligonucleotide; TTA chr11 5371743 5371764 5371748 5371743 -
cacaaagaaaaagcaaaaggta

SEQ ID NO: 117821 - DNA, 22 bp, Artificial Sequence
  Synthetic oligonucleotide; CTA chr11 5371717 5371738 5371722 5371717 -
tggaaggtgttgtattgatgga

SEQ ID NO: 117822 - DNA, 22 bp, Artificial Sequence
  Synthetic oligonucleotide; TTG chr11 5371705 5371726 5371710 5371705 -
tattgatggataggttaatttg

SEQ ID NO: 117823 - DNA, 22 bp, Artificial Sequence
  Synthetic oligonucleotide; TTG chr11 5371700 5371721 5371705 5371700 -
atggataggttaatttgcttga

SEQ ID NO: 117824 - DNA, 22 bp, Artificial Sequence
  Synthetic oligonucleotide; TTA chr11 5371688 5371709 5371693 5371688 -
atttgcttgattgaagtaatca

SEQ ID NO: 117825 - DNA, 22 bp, Artificial Sequence
  Synthetic oligonucleotide; TTT chr11 5371684 5371705 5371689 5371684 -
gcttgattgaagtaatcatctc

SEQ ID NO: 117826 - DNA, 22 bp, Artificial Sequence
  Synthetic oligonucleotide; TTG chr11 5371683 5371704 5371688 5371683 -
cttgattgaagtaatcatctca

SEQ ID NO: 117827 - DNA, 22 bp, Artificial Sequence
  Synthetic oligonucleotide; CTT chr11 5371680 5371701 5371685 5371680 -
gattgaagtaatcatctcacta

SEQ ID NO: 117828 - DNA, 22 bp, Artificial Sequence
  Synthetic oligonucleotide; TTG chr11 5371679 5371700 5371684 5371679 -
attgaagtaatcatctcactat

SEQ ID NO: 117829 - DNA, 22 bp, Artificial Sequence
  Synthetic oligonucleotide; TTG chr11 5371675 5371696 5371680 5371675 -
aagtaatcatctcactatgtac

SEQ ID NO: 117830 - DNA, 22 bp, Artificial Sequence
  Synthetic oligonucleotide; CTC chr11 5371662 5371683 5371667 5371662 -
actatgtacacatatatcctat

SEQ ID NO: 117831 - DNA, 22 bp, Artificial Sequence
  Synthetic oligonucleotide; CTA chr11 5371658 5371679 5371663 5371658 -
tgtacacatatatcctatattt

SEQ ID NO: 117832 - DNA, 22 bp, Artificial Sequence
  Synthetic oligonucleotide; CTA chr11 5371641 5371662 5371646 5371641 -
tattttttgaacaagcttactt

SEQ ID NO: 117833 - DNA, 22 bp, Artificial Sequence
  Synthetic oligonucleotide; TTT chr11 5371636 5371657 5371641 5371636 -
tttgaacaagcttacttgtttc

SEQ ID NO: 117834 - DNA, 22 bp, Artificial Sequence
  Synthetic oligonucleotide; TTT chr11 5371635 5371656 5371640 5371635 -
ttgaacaagcttacttgtttca

SEQ ID NO: 117835 - DNA, 22 bp, Artificial Sequence
  Synthetic oligonucleotide; TTT chr11 5371634 5371655 5371639 5371634 -
tgaacaagcttacttgtttcag

SEQ ID NO: 117836 - DNA, 22 bp, Artificial Sequence
  Synthetic oligonucleotide; TTT chr11 5371633 5371654 5371638 5371633 -
gaacaagcttacttgtttcaga

SEQ ID NO: 117837 - DNA, 22 bp, Artificial Sequence
  Synthetic oligonucleotide; TTG chr11 5371632 5371653 5371637 5371632 -
aacaagcttacttgtttcagat

SEQ ID NO: 117838 - DNA, 22 bp, Artificial Sequence
  Synthetic oligonucleotide; CTT chr11 5371623 5371644 5371628 5371623 -
acttgtttcagataaaatattt

SEQ ID NO: 117839 - DNA, 22 bp, Artificial Sequence
  Synthetic oligonucleotide; TTA chr11 5371622 5371643 5371627 5371622 -
cttgtttcagataaaatatttt

SEQ ID NO: 117840 - DNA, 22 bp, Artificial Sequence
  Synthetic oligonucleotide; CTT chr11 5371619 5371640 5371624 5371619 -
gtttcagataaaatattttaaa

SEQ ID NO: 117841 - DNA, 22 bp, Artificial Sequence
  Synthetic oligonucleotide; TTG chr11 5371618 5371639 5371623 5371618 -
tttcagataaaatattttaaaa

SEQ ID NO: 117842 - DNA, 22 bp, Artificial Sequence
  Synthetic oligonucleotide; TTT chr11 5371615 5371636 5371620 5371615 -
cagataaaatattttaaaagct

SEQ ID NO: 117843 - DNA, 22 bp, Artificial Sequence
  Synthetic oligonucleotide; TTC chr11 5371614 5371635 5371619 5371614 -
agataaaatattttaaaagctt

SEQ ID NO: 117844 - DNA, 22 bp, Artificial Sequence
  Synthetic oligonucleotide; TTT chr11 5371601 5371622 5371606 5371601 -
taaaagcttttatctgaagcaa

SEQ ID NO: 117845 - DNA, 22 bp, Artificial Sequence
  Synthetic oligonucleotide; TTT chr11 5371600 5371621 5371605 5371600 -
aaaagcttttatctgaagcaag

SEQ ID NO: 117846 - DNA, 22 bp, Artificial Sequence
  Synthetic oligonucleotide; TTA chr11 5371599 5371620 5371604 5371599 -
aaagcttttatctgaagcaagt

SEQ ID NO: 117847 - DNA, 22 bp, Artificial Sequence
  Synthetic oligonucleotide; CTT chr11 5371592 5371613 5371597 5371592 -
ttatctgaagcaagtcaaattt

SEQ ID NO: 117848 - DNA, 22 bp, Artificial Sequence
  Synthetic oligonucleotide; TTT chr11 5371591 5371612 5371596 5371591 -
tatctgaagcaagtcaaatttc

SEQ ID NO: 117849 - DNA, 22 bp, Artificial Sequence
  Synthetic oligonucleotide; TTT chr11 5371590 5371611 5371595 5371590 -
atctgaagcaagtcaaatttct

SEQ ID NO: 117850 - DNA, 22 bp, Artificial Sequence
  Synthetic oligonucleotide; TTA chr11 5371589 5371610 5371594 5371589 -
tctgaagcaagtcaaatttctg

SEQ ID NO: 117851 - DNA, 22 bp, Artificial Sequence
  Synthetic oligonucleotide; CTG chr11 5371585 5371606 5371590 5371585 -
aagcaagtcaaatttctgtttc

SEQ ID NO: 117852 - DNA, 22 bp, Artificial Sequence
  Synthetic oligonucleotide; TTT chr11 5371570 5371591 5371575 5371570 -
ctgtttcctaattgtttagggt

SEQ ID NO: 117853 - DNA, 22 bp, Artificial Sequence
  Synthetic oligonucleotide; TTC chr11 5371569 5371590 5371574 5371569 -
tgtttcctaattgtttagggtc

SEQ ID NO: 117854 - DNA, 22 bp, Artificial Sequence
  Synthetic oligonucleotide; CTG chr11 5371567 5371588 5371572 5371567 -
tttcctaattgtttagggtcct

SEQ ID NO: 117855 - DNA, 22 bp, Artificial Sequence
  Synthetic oligonucleotide; TTT chr11 5371564 5371585 5371569 5371564 -
cctaattgtttagggtccttca

SEQ ID NO: 117856 - DNA, 22 bp, Artificial Sequence
  Synthetic oligonucleotide; TTC chr11 5371563 5371584 5371568 5371563 -
ctaattgtttagggtccttcat

SEQ ID NO: 117857 - DNA, 22 bp, Artificial Sequence
  Synthetic oligonucleotide; CTA chr11 5371560 5371581 5371565 5371560 -
attgtttagggtccttcatgtt

SEQ ID NO: 117858 - DNA, 22 bp, Artificial Sequence
  Synthetic oligonucleotide; TTG chr11 5371556 5371577 5371561 5371556 -
tttagggtccttcatgttattt

SEQ ID NO: 117859 - DNA, 22 bp, Artificial Sequence
  Synthetic oligonucleotide; TTT chr11 5371553 5371574 5371558 5371553 -
agggtccttcatgttatttcca

SEQ ID NO: 117860 - DNA, 22 bp, Artificial Sequence
  Synthetic oligonucleotide; TTA chr11 5371552 5371573 5371557 5371552 -
gggtccttcatgttatttccac

SEQ ID NO: 117861 - DNA, 22 bp, Artificial Sequence
  Synthetic oligonucleotide; CTT chr11 5371544 5371565 5371549 5371544 -
catgttatttccactcttaaaa

SEQ ID NO: 117862 - DNA, 22 bp, Artificial Sequence
  Synthetic oligonucleotide; TTC chr11 5371543 5371564 5371548 5371543 -
atgttatttccactcttaaaac

SEQ ID NO: 117863 - DNA, 22 bp, Artificial Sequence
  Synthetic oligonucleotide; TTA chr11 5371537 5371558 5371542 5371537 -
tttccactcttaaaacttatgt

SEQ ID NO: 117864 - DNA, 22 bp, Artificial Sequence
  Synthetic oligonucleotide; TTT chr11 5371534 5371555 5371539 5371534 -
ccactcttaaaacttatgtaac

SEQ ID NO: 117865 - DNA, 22 bp, Artificial Sequence
  Synthetic oligonucleotide; TTC chr11 5371533 5371554 5371538 5371533 -
cactcttaaaacttatgtaacc

SEQ ID NO: 117866 - DNA, 22 bp, Artificial Sequence
  Synthetic oligonucleotide; CTC chr11 5371528 5371549 5371533 5371528 -
ttaaaacttatgtaaccctttg

SEQ ID NO: 117867 - DNA, 22 bp, Artificial Sequence
  Synthetic oligonucleotide; CTT chr11 5371526 5371547 5371531 5371526 -
aaaacttatgtaaccctttgga

SEQ ID NO: 117868 - DNA, 22 bp, Artificial Sequence
  Synthetic oligonucleotide; TTA chr11 5371525 5371546 5371530 5371525 -
aaacttatgtaaccctttggat

SEQ ID NO: 117869 - DNA, 22 bp, Artificial Sequence
  Synthetic oligonucleotide; CTT chr11 5371519 5371540 5371524 5371519 -
atgtaaccctttggatataatg

SEQ ID NO: 117870 - DNA, 22 bp, Artificial Sequence
  Synthetic oligonucleotide; TTA chr11 5371518 5371539 5371523 5371518 -
tgtaaccctttggatataatga

SEQ ID NO: 117871 - DNA, 22 bp, Artificial Sequence
  Synthetic oligonucleotide; CTT chr11 5371508 5371529 5371513 5371508 -
tggatataatgagatatatgtt

SEQ ID NO: 117872 - DNA, 22 bp, Artificial Sequence
  Synthetic oligonucleotide; TTT chr11 5371507 5371528 5371512 5371507 -
ggatataatgagatatatgttt

SEQ ID NO: 117873 - DNA, 22 bp, Artificial Sequence
  Synthetic oligonucleotide; TTG chr11 5371506 5371527 5371511 5371506 -
gatataatgagatatatgtttt

SEQ ID NO: 117874 - DNA, 22 bp, Artificial Sequence
  Synthetic oligonucleotide; TTT chr11 5371485 5371506 5371490 5371485 -
ttctctatttttaatatcagta

SEQ ID NO: 117875 - DNA, 22 bp, Artificial Sequence
  Synthetic oligonucleotide; TTT chr11 5371484 5371505 5371489 5371484 -
tctctatttttaatatcagtac

SEQ ID NO: 117876 - DNA, 22 bp, Artificial Sequence
  Synthetic oligonucleotide; TTT chr11 5371483 5371504 5371488 5371483 -
ctctatttttaatatcagtact

SEQ ID NO: 117877 - DNA, 22 bp, Artificial Sequence
  Synthetic oligonucleotide; TTC chr11 5371482 5371503 5371487 5371482 -
tctatttttaatatcagtactc

SEQ ID NO: 117878 - DNA, 22 bp, Artificial Sequence
  Synthetic oligonucleotide; CTC chr11 5371480 5371501 5371485 5371480 -
tatttttaatatcagtactctt

SEQ ID NO: 117879 - DNA, 22 bp, Artificial Sequence
  Synthetic oligonucleotide; CTA chr11 5371478 5371499 5371483 5371478 -
tttttaatatcagtactcttta

SEQ ID NO: 117880 - DNA, 22 bp, Artificial Sequence
  Synthetic oligonucleotide; TTT chr11 5371475 5371496 5371480 5371475 -
ttaatatcagtactctttagat

SEQ ID NO: 117881 - DNA, 22 bp, Artificial Sequence
  Synthetic oligonucleotide; TTT chr11 5371474 5371495 5371479 5371474 -
taatatcagtactctttagata

SEQ ID NO: 117882 - DNA, 22 bp, Artificial Sequence
  Synthetic oligonucleotide; TTT chr11 5371473 5371494 5371478 5371473 -
aatatcagtactctttagatac

SEQ ID NO: 117883 - DNA, 22 bp, Artificial Sequence
  Synthetic oligonucleotide; TTA chr11 5371472 5371493 5371477 5371472 -
atatcagtactctttagataca

SEQ ID NO: 117884 - DNA, 22 bp, Artificial Sequence
  Synthetic oligonucleotide; CTC chr11 5371460 5371481 5371465 5371460 -
tttagatacagctatcactgtc

SEQ ID NO: 117885 - DNA, 22 bp, Artificial Sequence
  Synthetic oligonucleotide; CTT chr11 5371458 5371479 5371463 5371458 -
tagatacagctatcactgtctc

SEQ ID NO: 117886 - DNA, 22 bp, Artificial Sequence
  Synthetic oligonucleotide; TTT chr11 5371457 5371478 5371462 5371457 -
agatacagctatcactgtctct

SEQ ID NO: 117887 - DNA, 22 bp, Artificial Sequence
  Synthetic oligonucleotide; TTA chr11 5371456 5371477 5371461 5371456 -
gatacagctatcactgtctctc

SEQ ID NO: 117888 - DNA, 22 bp, Artificial Sequence
  Synthetic oligonucleotide; CTA chr11 5371446 5371467 5371451 5371446 -
tcactgtctctcagggtacctc

SEQ ID NO: 117889 - DNA, 22 bp, Artificial Sequence
  Synthetic oligonucleotide; CTG chr11 5371440 5371461 5371445 5371440 -
tctctcagggtacctctgcctc

SEQ ID NO: 117890 - DNA, 22 bp, Artificial Sequence
  Synthetic oligonucleotide; CTC chr11 5371436 5371457 5371441 5371436 -
tcagggtacctctgcctctggt

SEQ ID NO: 117891 - DNA, 22 bp, Artificial Sequence
  Synthetic oligonucleotide; CTC chr11 5371434 5371455 5371439 5371434 -
agggtacctctgcctctggtca

SEQ ID NO: 117892 - DNA, 22 bp, Artificial Sequence
  Synthetic oligonucleotide; CTC chr11 5371424 5371445 5371429 5371424 -
tgcctctggtcattttgttcat

SEQ ID NO: 117893 - DNA, 22 bp, Artificial Sequence
  Synthetic oligonucleotide; CTG chr11 5371422 5371443 5371427 5371422 -
cctctggtcattttgttcattc

SEQ ID NO: 117894 - DNA, 22 bp, Artificial Sequence
  Synthetic oligonucleotide; CTC chr11 5371418 5371439 5371423 5371418 -
tggtcattttgttcattcttta

SEQ ID NO: 117895 - DNA, 22 bp, Artificial Sequence
  Synthetic oligonucleotide; CTG chr11 5371416 5371437 5371421 5371416 -
gtcattttgttcattctttatg

SEQ ID NO: 117896 - DNA, 22 bp, Artificial Sequence
  Synthetic oligonucleotide; TTT chr11 5371409 5371430 5371414 5371409 -
tgttcattctttatgttgaaat

SEQ ID NO: 117897 - DNA, 22 bp, Artificial Sequence
  Synthetic oligonucleotide; TTT chr11 5371408 5371429 5371413 5371408 -
gttcattctttatgttgaaatt

SEQ ID NO: 117898 - DNA, 22 bp, Artificial Sequence
  Synthetic oligonucleotide; TTG chr11 5371407 5371428 5371412 5371407 -
ttcattctttatgttgaaattt

SEQ ID NO: 117899 - DNA, 22 bp, Artificial Sequence
  Synthetic oligonucleotide; TTC chr11 5371404 5371425 5371409 5371404 -
attctttatgttgaaattttat

SEQ ID NO: 117900 - DNA, 22 bp, Artificial Sequence
  Synthetic oligonucleotide; TTC chr11 5371400 5371421 5371405 5371400 -
tttatgttgaaattttatatct

SEQ ID NO: 117901 - DNA, 22 bp, Artificial Sequence
  Synthetic oligonucleotide; CTT chr11 5371398 5371419 5371403 5371398 -
tatgttgaaattttatatctcc

SEQ ID NO: 117902 - DNA, 22 bp, Artificial Sequence
  Synthetic oligonucleotide; TTT chr11 5371397 5371418 5371402 5371397 -
atgttgaaattttatatctccg

SEQ ID NO: 117903 - DNA, 22 bp, Artificial Sequence
  Synthetic oligonucleotide; TTA chr11 5371396 5371417 5371401 5371396 -
tgttgaaattttatatctccgg

SEQ ID NO: 117904 - DNA, 22 bp, Artificial Sequence
  Synthetic oligonucleotide; TTG chr11 5371391 5371412 5371396 5371391 -
aaattttatatctccggcctac

SEQ ID NO: 117905 - DNA, 22 bp, Artificial Sequence
  Synthetic oligonucleotide; TTT chr11 5371385 5371406 5371390 5371385 -
tatatctccggcctacaactca

SEQ ID NO: 117906 - DNA, 22 bp, Artificial Sequence
  Synthetic oligonucleotide; TTT chr11 5371384 5371405 5371389 5371384 -
atatctccggcctacaactcag

SEQ ID NO: 117907 - DNA, 22 bp, Artificial Sequence
  Synthetic oligonucleotide; TTA chr11 5371383 5371404 5371388 5371383 -
tatctccggcctacaactcagg

SEQ ID NO: 117908 - DNA, 22 bp, Artificial Sequence
  Synthetic oligonucleotide; CTC chr11 5371377 5371398 5371382 5371377 -
cggcctacaactcagggtttta

SEQ ID NO: 117909 - DNA, 22 bp, Artificial Sequence
  Synthetic oligonucleotide; CTA chr11 5371370 5371391 5371375 5371370 -
caactcagggttttacagtttc

SEQ ID NO: 117910 - DNA, 22 bp, Artificial Sequence
  Synthetic oligonucleotide; CTC chr11 5371364 5371385 5371369 5371364 -
agggttttacagtttcatcaat

SEQ ID NO: 117911 - DNA, 22 bp, Artificial Sequence
  Synthetic oligonucleotide; TTT chr11 5371357 5371378 5371362 5371357 -
tacagtttcatcaatgtctcta

SEQ ID NO: 117912 - DNA, 22 bp, Artificial Sequence
  Synthetic oligonucleotide; TTT chr11 5371356 5371377 5371361 5371356 -
acagtttcatcaatgtctctat

SEQ ID NO: 117913 - DNA, 22 bp, Artificial Sequence
  Synthetic oligonucleotide; TTA chr11 5371355 5371376 5371360 5371355 -
cagtttcatcaatgtctctatt

SEQ ID NO: 117914 - DNA, 22 bp, Artificial Sequence
  Synthetic oligonucleotide; TTT chr11 5371349 5371370 5371354 5371349 -
catcaatgtctctattaaatgt

SEQ ID NO: 117915 - DNA, 22 bp, Artificial Sequence
  Synthetic oligonucleotide; TTC chr11 5371348 5371369 5371353 5371348 -
atcaatgtctctattaaatgtt

SEQ ID NO: 117916 - DNA, 22 bp, Artificial Sequence
  Synthetic oligonucleotide; CTC chr11 5371337 5371358 5371342 5371337 -
tattaaatgtttatgagccaca

SEQ ID NO: 117917 - DNA, 22 bp, Artificial Sequence
  Synthetic oligonucleotide; CTA chr11 5371335 5371356 5371340 5371335 -
ttaaatgtttatgagccacaga

SEQ ID NO: 117918 - DNA, 22 bp, Artificial Sequence
  Synthetic oligonucleotide; TTA chr11 5371332 5371353 5371337 5371332 -
aatgtttatgagccacagagaa

SEQ ID NO: 117919 - DNA, 22 bp, Artificial Sequence
  Synthetic oligonucleotide; TTT chr11 5371325 5371346 5371330 5371325 -
atgagccacagagaatgagaat

SEQ ID NO: 117920 - DNA, 22 bp, Artificial Sequence
  Synthetic oligonucleotide; TTA chr11 5371324 5371345 5371329 5371324 -
tgagccacagagaatgagaatt

SEQ ID NO: 117921 - DNA, 22 bp, Artificial Sequence
  Synthetic oligonucleotide; TTA chr11 5371301 5371322 5371306 5371301 -
tatgttcaatttttttgaactt

SEQ ID NO: 117922 - DNA, 22 bp, Artificial Sequence
  Synthetic oligonucleotide; TTC chr11 5371294 5371315 5371299 5371294 -
aatttttttgaacttctgtgtt

SEQ ID NO: 117923 - DNA, 22 bp, Artificial Sequence
  Synthetic oligonucleotide; TTT chr11 5371289 5371310 5371294 5371289 -
ttttgaacttctgtgtttgagt

SEQ ID NO: 117924 - DNA, 22 bp, Artificial Sequence
  Synthetic oligonucleotide; TTT chr11 5371288 5371309 5371293 5371288 -
tttgaacttctgtgtttgagtt

SEQ ID NO: 117925 - DNA, 22 bp, Artificial Sequence
  Synthetic oligonucleotide; TTT chr11 5371287 5371308 5371292 5371287 -
ttgaacttctgtgtttgagttt

SEQ ID NO: 117926 - DNA, 22 bp, Artificial Sequence
  Synthetic oligonucleotide; TTT chr11 5371286 5371307 5371291 5371286 -
tgaacttctgtgtttgagtttt

SEQ ID NO: 117927 - DNA, 22 bp, Artificial Sequence
  Synthetic oligonucleotide; TTT chr11 5371285 5371306 5371290 5371285 -
gaacttctgtgtttgagtttta

SEQ ID NO: 117928 - DNA, 22 bp, Artificial Sequence
  Synthetic oligonucleotide; TTG chr11 5371284 5371305 5371289 5371284 -
aacttctgtgtttgagttttaa

SEQ ID NO: 117929 - DNA, 22 bp, Artificial Sequence
  Synthetic oligonucleotide; CTT chr11 5371279 5371300 5371284 5371279 -
ctgtgtttgagttttaaaaaaa

SEQ ID NO: 117930 - DNA, 22 bp, Artificial Sequence
  Synthetic oligonucleotide; TTC chr11 5371278 5371299 5371283 5371278 -
tgtgtttgagttttaaaaaaat

SEQ ID NO: 117931 - DNA, 22 bp, Artificial Sequence
  Synthetic oligonucleotide; CTG chr11 5371276 5371297 5371281 5371276 -
tgtttgagttttaaaaaaatta

SEQ ID NO: 117932 - DNA, 22 bp, Artificial Sequence
  Synthetic oligonucleotide; TTT chr11 5371271 5371292 5371276 5371271 -
gagttttaaaaaaattaaccta

SEQ ID NO: 117933 - DNA, 22 bp, Artificial Sequence
  Synthetic oligonucleotide; TTG chr11 5371270 5371291 5371275 5371270 -
agttttaaaaaaattaacctaa

SEQ ID NO: 117934 - DNA, 22 bp, Artificial Sequence
  Synthetic oligonucleotide; TTT chr11 5371265 5371286 5371270 5371265 -
taaaaaaattaacctaatgtga

SEQ ID NO: 117935 - DNA, 22 bp, Artificial Sequence
  Synthetic oligonucleotide; TTT chr11 5371264 5371285 5371269 5371264 -
aaaaaaattaacctaatgtgaa

SEQ ID NO: 117936 - DNA, 22 bp, Artificial Sequence
  Synthetic oligonucleotide; TTA chr11 5371263 5371284 5371268 5371263 -
aaaaaattaacctaatgtgaaa

SEQ ID NO: 117937 - DNA, 22 bp, Artificial Sequence
  Synthetic oligonucleotide; TTA chr11 5371254 5371275 5371259 5371254 -
acctaatgtgaaagaccctaga

SEQ ID NO: 117938 - DNA, 22 bp, Artificial Sequence
  Synthetic oligonucleotide; CTA chr11 5371249 5371270 5371254 5371249 -
atgtgaaagaccctagatccgg

SEQ ID NO: 117939 - DNA, 22 bp, Artificial Sequence
  Synthetic oligonucleotide; CTA chr11 5371234 5371255 5371239 5371234 -
gatccggggaaaggtgctgtgt

SEQ ID NO: 117940 - DNA, 22 bp, Artificial Sequence
  Synthetic oligonucleotide; CTG chr11 5371215 5371236 5371220 5371215 -
tgtggcttagagtataaacatc

SEQ ID NO: 117941 - DNA, 22 bp, Artificial Sequence
  Synthetic oligonucleotide; CTT chr11 5371207 5371228 5371212 5371207 -
agagtataaacatcagaatgtg

SEQ ID NO: 117942 - DNA, 22 bp, Artificial Sequence
  Synthetic oligonucleotide; TTA chr11 5371206 5371227 5371211 5371206 -
gagtataaacatcagaatgtgc

SEQ ID NO: 117943 - DNA, 22 bp, Artificial Sequence
  Synthetic oligonucleotide; CTA chr11 5371182 5371203 5371187 5371182 -
tggactttctagaatatttcag

SEQ ID NO: 117944 - DNA, 22 bp, Artificial Sequence
  Synthetic oligonucleotide; CTT chr11 5371175 5371196 5371180 5371175 -
tctagaatatttcagtgccctt

SEQ ID NO: 117945 - DNA, 22 bp, Artificial Sequence
  Synthetic oligonucleotide; TTT chr11 5371174 5371195 5371179 5371174 -
ctagaatatttcagtgcccttg

SEQ ID NO: 117946 - DNA, 22 bp, Artificial Sequence
  Synthetic oligonucleotide; TTC chr11 5371173 5371194 5371178 5371173 -
tagaatatttcagtgcccttgt

SEQ ID NO: 117947 - DNA, 22 bp, Artificial Sequence
  Synthetic oligonucleotide; CTA chr11 5371171 5371192 5371176 5371171 -
gaatatttcagtgcccttgtat

SEQ ID NO: 117948 - DNA, 22 bp, Artificial Sequence
  Synthetic oligonucleotide; TTT chr11 5371163 5371184 5371168 5371163 -
cagtgcccttgtatatcctcag

SEQ ID NO: 117949 - DNA, 22 bp, Artificial Sequence
  Synthetic oligonucleotide; TTC chr11 5371162 5371183 5371167 5371162 -
agtgcccttgtatatcctcaga

SEQ ID NO: 117950 - DNA, 22 bp, Artificial Sequence
  Synthetic oligonucleotide; CTT chr11 5371153 5371174 5371158 5371153 -
gtatatcctcagaatgtgtgga

SEQ ID NO: 117951 - DNA, 22 bp, Artificial Sequence
  Synthetic oligonucleotide; TTG chr11 5371152 5371173 5371157 5371152 -
tatatcctcagaatgtgtggag

SEQ ID NO: 117952 - DNA, 22 bp, Artificial Sequence
  Synthetic oligonucleotide; CTC chr11 5371143 5371164 5371148 5371143 -
agaatgtgtggagagtaattcc

SEQ ID NO: 117953 - DNA, 22 bp, Artificial Sequence
  Synthetic oligonucleotide; TTC chr11 5371122 5371143 5371127 5371122 -
caaaacaaagcccttacttcaa

SEQ ID NO: 117954 - DNA, 22 bp, Artificial Sequence
  Synthetic oligonucleotide; CTT chr11 5371107 5371128 5371112 5371107 -
acttcaatatccatggtggtcc

SEQ ID NO: 117955 - DNA, 22 bp, Artificial Sequence
  Synthetic oligonucleotide; TTA chr11 5371106 5371127 5371111 5371106 -
cttcaatatccatggtggtcca

SEQ ID NO: 117956 - DNA, 22 bp, Artificial Sequence
  Synthetic oligonucleotide; CTT chr11 5371103 5371124 5371108 5371103 -
caatatccatggtggtccatag

SEQ ID NO: 117957 - DNA, 22 bp, Artificial Sequence
  Synthetic oligonucleotide; TTC chr11 5371102 5371123 5371107 5371102 -
aatatccatggtggtccatagc

SEQ ID NO: 117958 - DNA, 22 bp, Artificial Sequence
  Synthetic oligonucleotide; CTA chr11 5371078 5371099 5371083 5371078 -
gggctagcagaaggaagggttc

SEQ ID NO: 117959 - DNA, 22 bp, Artificial Sequence
  Synthetic oligonucleotide; CTA chr11 5371072 5371093 5371077 5371072 -
gcagaaggaagggttcaaaatc

SEQ ID NO: 117960 - DNA, 22 bp, Artificial Sequence
  Synthetic oligonucleotide; TTC chr11 5371056 5371077 5371061 5371056 -
aaaatcactatttttatcactc

SEQ ID NO: 117961 - DNA, 22 bp, Artificial Sequence
  Synthetic oligonucleotide; CTA chr11 5371046 5371067 5371051 5371046 -
tttttatcactcaaattatctg

SEQ ID NO: 117962 - DNA, 22 bp, Artificial Sequence
  Synthetic oligonucleotide; TTT chr11 5371043 5371064 5371048 5371043 -
ttatcactcaaattatctgctc

SEQ ID NO: 117963 - DNA, 22 bp, Artificial Sequence
  Synthetic oligonucleotide; TTT chr11 5371042 5371063 5371047 5371042 -
tatcactcaaattatctgctct

SEQ ID NO: 117964 - DNA, 22 bp, Artificial Sequence
  Synthetic oligonucleotide; TTT chr11 5371041 5371062 5371046 5371041 -
atcactcaaattatctgctctt

SEQ ID NO: 117965 - DNA, 22 bp, Artificial Sequence
  Synthetic oligonucleotide; TTA chr11 5371040 5371061 5371045 5371040 -
tcactcaaattatctgctcttg

SEQ ID NO: 117966 - DNA, 22 bp, Artificial Sequence
  Synthetic oligonucleotide; CTC chr11 5371034 5371055 5371039 5371034 -
aaattatctgctcttggaaaaa

SEQ ID NO: 117967 - DNA, 22 bp, Artificial Sequence
  Synthetic oligonucleotide; TTA chr11 5371028 5371049 5371033 5371028 -
tctgctcttggaaaaaccagtc

SEQ ID NO: 117968 - DNA, 22 bp, Artificial Sequence
  Synthetic oligonucleotide; CTG chr11 5371024 5371045 5371029 5371024 -
ctcttggaaaaaccagtccctt

SEQ ID NO: 117969 - DNA, 22 bp, Artificial Sequence
  Synthetic oligonucleotide; CTC chr11 5371021 5371042 5371026 5371021 -
ttggaaaaaccagtccctttgg

SEQ ID NO: 117970 - DNA, 22 bp, Artificial Sequence
  Synthetic oligonucleotide; CTT chr11 5371019 5371040 5371024 5371019 -
ggaaaaaccagtccctttgggt

SEQ ID NO: 117971 - DNA, 22 bp, Artificial Sequence
  Synthetic oligonucleotide; TTG chr11 5371018 5371039 5371023 5371018 -
gaaaaaccagtccctttgggta

SEQ ID NO: 117972 - DNA, 22 bp, Artificial Sequence
  Synthetic oligonucleotide; CTT chr11 5371002 5371023 5371007 5371002 -
tgggtagccccaatcatgtgta

SEQ ID NO: 117973 - DNA, 22 bp, Artificial Sequence
  Synthetic oligonucleotide; TTT chr11 5371001 5371022 5371006 5371001 -
gggtagccccaatcatgtgtaa

SEQ ID NO: 117974 - DNA, 22 bp, Artificial Sequence
  Synthetic oligonucleotide; TTG chr11 5371000 5371021 5371005 5371000 -
ggtagccccaatcatgtgtaag

SEQ ID NO: 117975 - DNA, 22 bp, Artificial Sequence
  Synthetic oligonucleotide; CTT chr11 5370974 5370995 5370979 5370974 -
tttcctgaagtatgatcatatg

SEQ ID NO: 117976 - DNA, 22 bp, Artificial Sequence
  Synthetic oligonucleotide; TTT chr11 5370973 5370994 5370978 5370973 -
ttcctgaagtatgatcatatgg

SEQ ID NO: 117977 - DNA, 22 bp, Artificial Sequence
  Synthetic oligonucleotide; TTT chr11 5370972 5370993 5370977 5370972 -
tcctgaagtatgatcatatggt

SEQ ID NO: 117978 - DNA, 22 bp, Artificial Sequence
  Synthetic oligonucleotide; TTT chr11 5370971 5370992 5370976 5370971 -
cctgaagtatgatcatatggtt

SEQ ID NO: 117979 - DNA, 22 bp, Artificial Sequence
  Synthetic oligonucleotide; TTC chr11 5370970 5370991 5370975 5370970 -
ctgaagtatgatcatatggttc

SEQ ID NO: 117980 - DNA, 22 bp, Artificial Sequence
  Synthetic oligonucleotide; CTG chr11 5370967 5370988 5370972 5370967 -
aagtatgatcatatggttctct

SEQ ID NO: 117981 - DNA, 22 bp, Artificial Sequence
  Synthetic oligonucleotide; TTC chr11 5370948 5370969 5370953 5370948 -
tcttccttctgtctgctcattg

SEQ ID NO: 117982 - DNA, 22 bp, Artificial Sequence
  Synthetic oligonucleotide; CTC chr11 5370946 5370967 5370951 5370946 -
ttccttctgtctgctcattgaa

SEQ ID NO: 117983 - DNA, 22 bp, Artificial Sequence
  Synthetic oligonucleotide; CTT chr11 5370944 5370965 5370949 5370944 -
ccttctgtctgctcattgaacc

SEQ ID NO: 117984 - DNA, 22 bp, Artificial Sequence
  Synthetic oligonucleotide; TTC chr11 5370943 5370964 5370948 5370943 -
cttctgtctgctcattgaacca

SEQ ID NO: 117985 - DNA, 22 bp, Artificial Sequence
  Synthetic oligonucleotide; CTT chr11 5370940 5370961 5370945 5370940 -
ctgtctgctcattgaaccagag

SEQ ID NO: 117986 - DNA, 22 bp, Artificial Sequence
  Synthetic oligonucleotide; TTC chr11 5370939 5370960 5370944 5370939 -
tgtctgctcattgaaccagagc

SEQ ID NO: 117987 - DNA, 22 bp, Artificial Sequence
  Synthetic oligonucleotide; CTG chr11 5370937 5370958 5370942 5370937 -
tctgctcattgaaccagagctc

SEQ ID NO: 117988 - DNA, 22 bp, Artificial Sequence
  Synthetic oligonucleotide; CTG chr11 5370933 5370954 5370938 5370933 -
ctcattgaaccagagctccagg

SEQ ID NO: 117989 - DNA, 22 bp, Artificial Sequence
  Synthetic oligonucleotide; CTC chr11 5370930 5370951 5370935 5370930 -
attgaaccagagctccaggacc

SEQ ID NO: 117990 - DNA, 22 bp, Artificial Sequence
  Synthetic oligonucleotide; TTG chr11 5370926 5370947 5370931 5370926 -
aaccagagctccaggaccaata

SEQ ID NO: 117991 - DNA, 22 bp, Artificial Sequence
  Synthetic oligonucleotide; CTC chr11 5370915 5370936 5370920 5370915 -
caggaccaataccactatggca

SEQ ID NO: 117992 - DNA, 22 bp, Artificial Sequence
  Synthetic oligonucleotide; CTA chr11 5370898 5370919 5370903 5370898 -
tggcaatacttcttttgcctct

SEQ ID NO: 117993 - DNA, 22 bp, Artificial Sequence
  Synthetic oligonucleotide; CTT chr11 5370887 5370908 5370892 5370887 -
cttttgcctctacaactctcag

SEQ ID NO: 117994 - DNA, 22 bp, Artificial Sequence
  Synthetic oligonucleotide; TTC chr11 5370886 5370907 5370891 5370886 -
ttttgcctctacaactctcagg

SEQ ID NO: 117995 - DNA, 22 bp, Artificial Sequence
  Synthetic oligonucleotide; CTT chr11 5370884 5370905 5370889 5370884 -
ttgcctctacaactctcaggtc

SEQ ID NO: 117996 - DNA, 22 bp, Artificial Sequence
  Synthetic oligonucleotide; TTT chr11 5370883 5370904 5370888 5370883 -
tgcctctacaactctcaggtca

SEQ ID NO: 117997 - DNA, 22 bp, Artificial Sequence
  Synthetic oligonucleotide; TTT chr11 5370882 5370903 5370887 5370882 -
gcctctacaactctcaggtcac

SEQ ID NO: 117998 - DNA, 22 bp, Artificial Sequence
  Synthetic oligonucleotide; TTG chr11 5370881 5370902 5370886 5370881 -
cctctacaactctcaggtcaca

SEQ ID NO: 117999 - DNA, 22 bp, Artificial Sequence
  Synthetic oligonucleotide; CTC chr11 5370877 5370898 5370882 5370877 -
tacaactctcaggtcacagctg

SEQ ID NO: 118000 - DNA, 22 bp, Artificial Sequence
  Synthetic oligonucleotide; CTA chr11 5370875 5370896 5370880 5370875 -
caactctcaggtcacagctgaa

SEQ ID NO: 118001 - DNA, 22 bp, Artificial Sequence
  Synthetic oligonucleotide; CTC chr11 5370869 5370890 5370874 5370869 -
tcaggtcacagctgaaatatta

SEQ ID NO: 118002 - DNA, 22 bp, Artificial Sequence
  Synthetic oligonucleotide; CTC chr11 5370867 5370888 5370872 5370867 -
aggtcacagctgaaatattacc

SEQ ID NO: 118003 - DNA, 22 bp, Artificial Sequence
  Synthetic oligonucleotide; CTG chr11 5370855 5370876 5370860 5370855 -
aaatattacctcctctcagaac

SEQ ID NO: 118004 - DNA, 22 bp, Artificial Sequence
  Synthetic oligonucleotide; TTA chr11 5370847 5370868 5370852 5370847 -
cctcctctcagaacccgcattt

SEQ ID NO: 118005 - DNA, 22 bp, Artificial Sequence
  Synthetic oligonucleotide; CTC chr11 5370843 5370864 5370848 5370843 -
ctctcagaacccgcatttgtca

SEQ ID NO: 118006 - DNA, 22 bp, Artificial Sequence
  Synthetic oligonucleotide; CTC chr11 5370840 5370861 5370845 5370840 -
tcagaacccgcatttgtcacac

SEQ ID NO: 118007 - DNA, 22 bp, Artificial Sequence
  Synthetic oligonucleotide; CTC chr11 5370838 5370859 5370843 5370838 -
agaacccgcatttgtcacacta

SEQ ID NO: 118008 - DNA, 22 bp, Artificial Sequence
  Synthetic oligonucleotide; TTT chr11 5370825 5370846 5370830 5370825 -
gtcacactagcttacataaatt

SEQ ID NO: 118009 - DNA, 22 bp, Artificial Sequence
  Synthetic oligonucleotide; TTG chr11 5370824 5370845 5370829 5370824 -
tcacactagcttacataaattt

SEQ ID NO: 118010 - DNA, 22 bp, Artificial Sequence
  Synthetic oligonucleotide; CTA chr11 5370816 5370837 5370821 5370816 -
gcttacataaattttgttattc

SEQ ID NO: 118011 - DNA, 22 bp, Artificial Sequence
  Synthetic oligonucleotide; CTT chr11 5370812 5370833 5370817 5370812 -
acataaattttgttattctcta

SEQ ID NO: 118012 - DNA, 22 bp, Artificial Sequence
  Synthetic oligonucleotide; TTA chr11 5370811 5370832 5370816 5370811 -
cataaattttgttattctctat

SEQ ID NO: 118013 - DNA, 22 bp, Artificial Sequence
  Synthetic oligonucleotide; TTT chr11 5370802 5370823 5370807 5370802 -
tgttattctctattgcatcaaa

SEQ ID NO: 118014 - DNA, 22 bp, Artificial Sequence
  Synthetic oligonucleotide; TTT chr11 5370801 5370822 5370806 5370801 -
gttattctctattgcatcaaat

SEQ ID NO: 118015 - DNA, 22 bp, Artificial Sequence
  Synthetic oligonucleotide; TTG chr11 5370800 5370821 5370805 5370800 -
ttattctctattgcatcaaatt

SEQ ID NO: 118016 - DNA, 22 bp, Artificial Sequence
  Synthetic oligonucleotide; TTA chr11 5370797 5370818 5370802 5370797 -
ttctctattgcatcaaattttt

SEQ ID NO: 118017 - DNA, 22 bp, Artificial Sequence
  Synthetic oligonucleotide; TTC chr11 5370794 5370815 5370799 5370794 -
tctattgcatcaaattttttct

SEQ ID NO: 118018 - DNA, 22 bp, Artificial Sequence
  Synthetic oligonucleotide; CTC chr11 5370792 5370813 5370797 5370792 -
tattgcatcaaattttttcttt

SEQ ID NO: 118019 - DNA, 22 bp, Artificial Sequence
  Synthetic oligonucleotide; CTA chr11 5370790 5370811 5370795 5370790 -
ttgcatcaaattttttctttct

SEQ ID NO: 118020 - DNA, 22 bp, Artificial Sequence
  Synthetic oligonucleotide; TTG chr11 5370787 5370808 5370792 5370787 -
catcaaattttttctttctttc

SEQ ID NO: 118021 - DNA, 22 bp, Artificial Sequence
  Synthetic oligonucleotide; TTT chr11 5370777 5370798 5370782 5370777 -
tttctttctttcatagcagcta

SEQ ID NO: 118022 - DNA, 22 bp, Artificial Sequence
  Synthetic oligonucleotide; TTT chr11 5370776 5370797 5370781 5370776 -
ttctttctttcatagcagctat

SEQ ID NO: 118023 - DNA, 22 bp, Artificial Sequence
  Synthetic oligonucleotide; TTT chr11 5370775 5370796 5370780 5370775 -
tctttctttcatagcagctata

SEQ ID NO: 118024 - DNA, 22 bp, Artificial Sequence
  Synthetic oligonucleotide; TTT chr11 5370774 5370795 5370779 5370774 -
ctttctttcatagcagctatat

SEQ ID NO: 118025 - DNA, 22 bp, Artificial Sequence
  Synthetic oligonucleotide; TTC chr11 5370773 5370794 5370778 5370773 -
tttctttcatagcagctatatg

SEQ ID NO: 118026 - DNA, 22 bp, Artificial Sequence
  Synthetic oligonucleotide; CTT chr11 5370771 5370792 5370776 5370771 -
tctttcatagcagctatatgag

SEQ ID NO: 118027 - DNA, 22 bp, Artificial Sequence
  Synthetic oligonucleotide; TTT chr11 5370770 5370791 5370775 5370770 -
ctttcatagcagctatatgagg

SEQ ID NO: 118028 - DNA, 22 bp, Artificial Sequence
  Synthetic oligonucleotide; TTC chr11 5370769 5370790 5370774 5370769 -
tttcatagcagctatatgaggt

SEQ ID NO: 118029 - DNA, 22 bp, Artificial Sequence
  Synthetic oligonucleotide; CTT chr11 5370767 5370788 5370772 5370767 -
tcatagcagctatatgaggttg

SEQ ID NO: 118030 - DNA, 22 bp, Artificial Sequence
  Synthetic oligonucleotide; TTT chr11 5370766 5370787 5370771 5370766 -
catagcagctatatgaggttgt

SEQ ID NO: 118031 - DNA, 22 bp, Artificial Sequence
  Synthetic oligonucleotide; TTC chr11 5370765 5370786 5370770 5370765 -
atagcagctatatgaggttgta

SEQ ID NO: 118032 - DNA, 22 bp, Artificial Sequence
  Synthetic oligonucleotide; CTA chr11 5370755 5370776 5370760 5370755 -
tatgaggttgtaattatttttg

SEQ ID NO: 118033 - DNA, 22 bp, Artificial Sequence
  Synthetic oligonucleotide; TTG chr11 5370745 5370766 5370750 5370745 -
taattatttttgtcactttttt

SEQ ID NO: 118034 - DNA, 22 bp, Artificial Sequence
  Synthetic oligonucleotide; TTA chr11 5370739 5370760 5370744 5370739 -
tttttgtcacttttttattatt

SEQ ID NO: 118035 - DNA, 22 bp, Artificial Sequence
  Synthetic oligonucleotide; TTT chr11 5370736 5370757 5370741 5370736 -
ttgtcacttttttattatttcc

SEQ ID NO: 118036 - DNA, 22 bp, Artificial Sequence
  Synthetic oligonucleotide; TTT chr11 5370735 5370756 5370740 5370735 -
tgtcacttttttattatttcct

SEQ ID NO: 118037 - DNA, 22 bp, Artificial Sequence
  Synthetic oligonucleotide; TTT chr11 5370734 5370755 5370739 5370734 -
gtcacttttttattatttcctt

SEQ ID NO: 118038 - DNA, 22 bp, Artificial Sequence
  Synthetic oligonucleotide; TTG chr11 5370733 5370754 5370738 5370733 -
tcacttttttattatttccttt

SEQ ID NO: 118039 - DNA, 22 bp, Artificial Sequence
  Synthetic oligonucleotide; CTT chr11 5370727 5370748 5370732 5370727 -
ttttattatttcctttccgtta

SEQ ID NO: 118040 - DNA, 22 bp, Artificial Sequence
  Synthetic oligonucleotide; TTT chr11 5370726 5370747 5370731 5370726 -
tttattatttcctttccgttaa

SEQ ID NO: 118041 - DNA, 22 bp, Artificial Sequence
  Synthetic oligonucleotide; TTT chr11 5370725 5370746 5370730 5370725 -
ttattatttcctttccgttaaa

SEQ ID NO: 118042 - DNA, 22 bp, Artificial Sequence
  Synthetic oligonucleotide; TTT chr11 5370724 5370745 5370729 5370724 -
tattatttcctttccgttaaaa

SEQ ID NO: 118043 - DNA, 22 bp, Artificial Sequence
  Synthetic oligonucleotide; TTT chr11 5370723 5370744 5370728 5370723 -
attatttcctttccgttaaaat

SEQ ID NO: 118044 - DNA, 22 bp, Artificial Sequence
  Synthetic oligonucleotide; TTA chr11 5370722 5370743 5370727 5370722 -
ttatttcctttccgttaaaata

SEQ ID NO: 118045 - DNA, 22 bp, Artificial Sequence
  Synthetic oligonucleotide; TTA chr11 5370719 5370740 5370724 5370719 -
tttcctttccgttaaaatacaa

SEQ ID NO: 118046 - DNA, 22 bp, Artificial Sequence
  Synthetic oligonucleotide; TTT chr11 5370716 5370737 5370721 5370716 -
cctttccgttaaaatacaagct

SEQ ID NO: 118047 - DNA, 22 bp, Artificial Sequence
  Synthetic oligonucleotide; TTC chr11 5370715 5370736 5370720 5370715 -
ctttccgttaaaatacaagctt

SEQ ID NO: 118048 - DNA, 22 bp, Artificial Sequence
  Synthetic oligonucleotide; CTT chr11 5370712 5370733 5370717 5370712 -
tccgttaaaatacaagcttcat

SEQ ID NO: 118049 - DNA, 22 bp, Artificial Sequence
  Synthetic oligonucleotide; TTT chr11 5370711 5370732 5370716 5370711 -
ccgttaaaatacaagcttcata

SEQ ID NO: 118050 - DNA, 22 bp, Artificial Sequence
  Synthetic oligonucleotide; TTC chr11 5370710 5370731 5370715 5370710 -
cgttaaaatacaagcttcatag

SEQ ID NO: 118051 - DNA, 22 bp, Artificial Sequence
  Synthetic oligonucleotide; TTA chr11 5370705 5370726 5370710 5370705 -
aaatacaagcttcataggaaca

SEQ ID NO: 118052 - DNA, 22 bp, Artificial Sequence
  Synthetic oligonucleotide; CTT chr11 5370693 5370714 5370698 5370693 -
cataggaacagagaatatatgc

SEQ ID NO: 118053 - DNA, 22 bp, Artificial Sequence
  Synthetic oligonucleotide; TTC chr11 5370692 5370713 5370697 5370692 -
ataggaacagagaatatatgca

SEQ ID NO: 118054 - DNA, 22 bp, Artificial Sequence
  Synthetic oligonucleotide; TTT chr11 5370659 5370680 5370664 5370659 -
ttgtacccagtagttgctaaaa

SEQ ID NO: 118055 - DNA, 22 bp, Artificial Sequence
  Synthetic oligonucleotide; TTT chr11 5370658 5370679 5370663 5370658 -
tgtacccagtagttgctaaaat

SEQ ID NO: 118056 - DNA, 22 bp, Artificial Sequence
  Synthetic oligonucleotide; TTT chr11 5370657 5370678 5370662 5370657 -
gtacccagtagttgctaaaata

SEQ ID NO: 118057 - DNA, 22 bp, Artificial Sequence
  Synthetic oligonucleotide; TTG chr11 5370656 5370677 5370661 5370656 -
tacccagtagttgctaaaatag

SEQ ID NO: 118058 - DNA, 22 bp, Artificial Sequence
  Synthetic oligonucleotide; TTG chr11 5370643 5370664 5370648 5370643 -
ctaaaatagagaagcctctcat

SEQ ID NO: 118059 - DNA, 22 bp, Artificial Sequence
  Synthetic oligonucleotide; CTA chr11 5370640 5370661 5370645 5370640 -
aaatagagaagcctctcattag

SEQ ID NO: 118060 - DNA, 22 bp, Artificial Sequence
  Synthetic oligonucleotide; CTC chr11 5370625 5370646 5370630 5370625 -
tcattagataaacaaacaacta

SEQ ID NO: 118061 - DNA, 22 bp, Artificial Sequence
  Synthetic oligonucleotide; CTC chr11 5370623 5370644 5370628 5370623 -
attagataaacaaacaactaaa

SEQ ID NO: 118062 - DNA, 22 bp, Artificial Sequence
  Synthetic oligonucleotide; TTA chr11 5370619 5370640 5370624 5370619 -
gataaacaaacaactaaacaat

SEQ ID NO: 118063 - DNA, 22 bp, Artificial Sequence
  Synthetic oligonucleotide; CTA chr11 5370603 5370624 5370608 5370603 -
aacaatgaccgcttgttaaata

SEQ ID NO: 118064 - DNA, 22 bp, Artificial Sequence
  Synthetic oligonucleotide; CTT chr11 5370589 5370610 5370594 5370589 -
gttaaataaatgtatttagtta

SEQ ID NO: 118065 - DNA, 22 bp, Artificial Sequence
  Synthetic oligonucleotide; TTG chr11 5370588 5370609 5370593 5370588 -
ttaaataaatgtatttagttat

SEQ ID NO: 118066 - DNA, 22 bp, Artificial Sequence
  Synthetic oligonucleotide; TTA chr11 5370585 5370606 5370590 5370585 -
aataaatgtatttagttattct

SEQ ID NO: 118067 - DNA, 22 bp, Artificial Sequence
  Synthetic oligonucleotide; TTT chr11 5370572 5370593 5370577 5370572 -
agttattctattattcatttct

SEQ ID NO: 118068 - DNA, 22 bp, Artificial Sequence
  Synthetic oligonucleotide; TTA chr11 5370571 5370592 5370576 5370571 -
gttattctattattcatttcta

SEQ ID NO: 118069 - DNA, 22 bp, Artificial Sequence
  Synthetic oligonucleotide; TTA chr11 5370567 5370588 5370572 5370567 -
ttctattattcatttctaaaca

SEQ ID NO: 118070 - DNA, 22 bp, Artificial Sequence
  Synthetic oligonucleotide; TTC chr11 5370564 5370585 5370569 5370564 -
tattattcatttctaaacacag

SEQ ID NO: 118071 - DNA, 22 bp, Artificial Sequence
  Synthetic oligonucleotide; CTA chr11 5370562 5370583 5370567 5370562 -
ttattcatttctaaacacagaa

SEQ ID NO: 118072 - DNA, 22 bp, Artificial Sequence
  Synthetic oligonucleotide; TTA chr11 5370559 5370580 5370564 5370559 -
ttcatttctaaacacagaaaga

SEQ ID NO: 118073 - DNA, 22 bp, Artificial Sequence
  Synthetic oligonucleotide; TTC chr11 5370556 5370577 5370561 5370556 -
atttctaaacacagaaagagtg

SEQ ID NO: 118074 - DNA, 22 bp, Artificial Sequence
  Synthetic oligonucleotide; TTT chr11 5370552 5370573 5370557 5370552 -
ctaaacacagaaagagtgagaa

SEQ ID NO: 118075 - DNA, 22 bp, Artificial Sequence
  Synthetic oligonucleotide; TTC chr11 5370551 5370572 5370556 5370551 -
taaacacagaaagagtgagaaa

SEQ ID NO: 118076 - DNA, 22 bp, Artificial Sequence
  Synthetic oligonucleotide; CTA chr11 5370549 5370570 5370554 5370549 -
aacacagaaagagtgagaaagg

SEQ ID NO: 118077 - DNA, 22 bp, Artificial Sequence
  Synthetic oligonucleotide; TTT chr11 5370471 5370492 5370476 5370471 -
tctggcattaaattattgccct

SEQ ID NO: 118078 - DNA, 22 bp, Artificial Sequence
  Synthetic oligonucleotide; TTT chr11 5370470 5370491 5370475 5370470 -
ctggcattaaattattgccctc

SEQ ID NO: 118079 - DNA, 22 bp, Artificial Sequence
  Synthetic oligonucleotide; TTC chr11 5370469 5370490 5370474 5370469 -
tggcattaaattattgccctca

SEQ ID NO: 118080 - DNA, 22 bp, Artificial Sequence
  Synthetic oligonucleotide; CTG chr11 5370467 5370488 5370472 5370467 -
gcattaaattattgccctcaaa

SEQ ID NO: 118081 - DNA, 22 bp, Artificial Sequence
  Synthetic oligonucleotide; TTA chr11 5370461 5370482 5370466 5370461 -
aattattgccctcaaattggac

SEQ ID NO: 118082 - DNA, 22 bp, Artificial Sequence
  Synthetic oligonucleotide; TTA chr11 5370456 5370477 5370461 5370456 -
ttgccctcaaattggacagaga

SEQ ID NO: 118083 - DNA, 22 bp, Artificial Sequence
  Synthetic oligonucleotide; TTG chr11 5370453 5370474 5370458 5370453 -
ccctcaaattggacagagacat

SEQ ID NO: 118084 - DNA, 22 bp, Artificial Sequence
  Synthetic oligonucleotide; CTC chr11 5370448 5370469 5370453 5370448 -
aaattggacagagacataccaa

SEQ ID NO: 118085 - DNA, 22 bp, Artificial Sequence
  Synthetic oligonucleotide; TTG chr11 5370442 5370463 5370447 5370442 -
gacagagacataccaacaaatg

SEQ ID NO: 118086 - DNA, 22 bp, Artificial Sequence
  Synthetic oligonucleotide; CTC chr11 5370414 5370435 5370419 5370414 -
tgaagatttgaatttaattttc

SEQ ID NO: 118087 - DNA, 22 bp, Artificial Sequence
  Synthetic oligonucleotide; CTG chr11 5370412 5370433 5370417 5370412 -
aagatttgaatttaattttccc

SEQ ID NO: 118088 - DNA, 22 bp, Artificial Sequence
  Synthetic oligonucleotide; TTT chr11 5370405 5370426 5370410 5370405 -
gaatttaattttccctgtaaat

SEQ ID NO: 118089 - DNA, 22 bp, Artificial Sequence
  Synthetic oligonucleotide; TTG chr11 5370404 5370425 5370409 5370404 -
aatttaattttccctgtaaatt

SEQ ID NO: 118090 - DNA, 22 bp, Artificial Sequence
  Synthetic oligonucleotide; TTT chr11 5370399 5370420 5370404 5370399 -
aattttccctgtaaattgctct

SEQ ID NO: 118091 - DNA, 22 bp, Artificial Sequence
  Synthetic oligonucleotide; TTA chr11 5370398 5370419 5370403 5370398 -
attttccctgtaaattgctctg

SEQ ID NO: 118092 - DNA, 22 bp, Artificial Sequence
  Synthetic oligonucleotide; TTT chr11 5370394 5370415 5370399 5370394 -
tccctgtaaattgctctgacct

SEQ ID NO: 118093 - DNA, 22 bp, Artificial Sequence
  Synthetic oligonucleotide; TTT chr11 5370393 5370414 5370398 5370393 -
ccctgtaaattgctctgacctg

SEQ ID NO: 118094 - DNA, 22 bp, Artificial Sequence
  Synthetic oligonucleotide; TTC chr11 5370392 5370413 5370397 5370392 -
cctgtaaattgctctgacctga

SEQ ID NO: 118095 - DNA, 22 bp, Artificial Sequence
  Synthetic oligonucleotide; CTG chr11 5370388 5370409 5370393 5370388 -
taaattgctctgacctgacaac

SEQ ID NO: 118096 - DNA, 22 bp, Artificial Sequence
  Synthetic oligonucleotide; TTG chr11 5370381 5370402 5370386 5370381 -
ctctgacctgacaacccagcta

SEQ ID NO: 118097 - DNA, 22 bp, Artificial Sequence
  Synthetic oligonucleotide; CTC chr11 5370378 5370399 5370383 5370378 -
tgacctgacaacccagctattt

SEQ ID NO: 118098 - DNA, 22 bp, Artificial Sequence
  Synthetic oligonucleotide; CTG chr11 5370376 5370397 5370381 5370376 -
acctgacaacccagctatttta

SEQ ID NO: 118099 - DNA, 22 bp, Artificial Sequence
  Synthetic oligonucleotide; CTG chr11 5370371 5370392 5370376 5370371 -
acaacccagctattttagttta

SEQ ID NO: 118100 - DNA, 22 bp, Artificial Sequence
  Synthetic oligonucleotide; CTA chr11 5370359 5370380 5370364 5370359 -
ttttagtttagtctttgcagat

SEQ ID NO: 118101 - DNA, 22 bp, Artificial Sequence
  Synthetic oligonucleotide; TTT chr11 5370356 5370377 5370361 5370356 -
tagtttagtctttgcagatgat

SEQ ID NO: 118102 - DNA, 22 bp, Artificial Sequence
  Synthetic oligonucleotide; TTT chr11 5370355 5370376 5370360 5370355 -
agtttagtctttgcagatgata

SEQ ID NO: 118103 - DNA, 22 bp, Artificial Sequence
  Synthetic oligonucleotide; TTA chr11 5370354 5370375 5370359 5370354 -
gtttagtctttgcagatgatat

SEQ ID NO: 118104 - DNA, 22 bp, Artificial Sequence
  Synthetic oligonucleotide; TTT chr11 5370350 5370371 5370355 5370350 -
agtctttgcagatgatatacat

SEQ ID NO: 118105 - DNA, 22 bp, Artificial Sequence
  Synthetic oligonucleotide; TTA chr11 5370349 5370370 5370354 5370349 -
gtctttgcagatgatatacata

SEQ ID NO: 118106 - DNA, 22 bp, Artificial Sequence
  Synthetic oligonucleotide; CTT chr11 5370344 5370365 5370349 5370344 -
tgcagatgatatacataaaatg

SEQ ID NO: 118107 - DNA, 22 bp, Artificial Sequence
  Synthetic oligonucleotide; TTT chr11 5370343 5370364 5370348 5370343 -
gcagatgatatacataaaatgc

SEQ ID NO: 118108 - DNA, 22 bp, Artificial Sequence
  Synthetic oligonucleotide; TTG chr11 5370342 5370363 5370347 5370342 -
cagatgatatacataaaatgcc

SEQ ID NO: 118109 - DNA, 22 bp, Artificial Sequence
  Synthetic oligonucleotide; CTA chr11 5370318 5370339 5370323 5370318 -
tctcactttgctgtagcatttc

SEQ ID NO: 118110 - DNA, 22 bp, Artificial Sequence
  Synthetic oligonucleotide; CTC chr11 5370314 5370335 5370319 5370314 -
actttgctgtagcatttccaat

SEQ ID NO: 118111 - DNA, 22 bp, Artificial Sequence
  Synthetic oligonucleotide; CTT chr11 5370310 5370331 5370315 5370310 -
tgctgtagcatttccaatcctg

SEQ ID NO: 118112 - DNA, 22 bp, Artificial Sequence
  Synthetic oligonucleotide; TTT chr11 5370309 5370330 5370314 5370309 -
gctgtagcatttccaatcctgg

SEQ ID NO: 118113 - DNA, 22 bp, Artificial Sequence
  Synthetic oligonucleotide; TTG chr11 5370308 5370329 5370313 5370308 -
ctgtagcatttccaatcctgga

SEQ ID NO: 118114 - DNA, 22 bp, Artificial Sequence
  Synthetic oligonucleotide; CTG chr11 5370305 5370326 5370310 5370305 -
tagcatttccaatcctggacag

SEQ ID NO: 118115 - DNA, 22 bp, Artificial Sequence
  Synthetic oligonucleotide; TTT chr11 5370297 5370318 5370302 5370297 -
ccaatcctggacagtcagcata

SEQ ID NO: 118116 - DNA, 22 bp, Artificial Sequence
  Synthetic oligonucleotide; TTC chr11 5370296 5370317 5370301 5370296 -
caatcctggacagtcagcataa

SEQ ID NO: 118117 - DNA, 22 bp, Artificial Sequence
  Synthetic oligonucleotide; CTG chr11 5370288 5370309 5370293 5370288 -
gacagtcagcataaaagatact

SEQ ID NO: 118118 - DNA, 22 bp, Artificial Sequence
  Synthetic oligonucleotide; CTA chr11 5370265 5370286 5370270 5370265 -
tcgtcacttatttaatatttca

SEQ ID NO: 118119 - DNA, 22 bp, Artificial Sequence
  Synthetic oligonucleotide; CTT chr11 5370256 5370277 5370261 5370256 -
atttaatatttcatagcattaa

SEQ ID NO: 118120 - DNA, 22 bp, Artificial Sequence
  Synthetic oligonucleotide; TTA chr11 5370255 5370276 5370260 5370255 -
tttaatatttcatagcattaaa

SEQ ID NO: 118121 - DNA, 22 bp, Artificial Sequence
  Synthetic oligonucleotide; TTT chr11 5370252 5370273 5370257 5370252 -
aatatttcatagcattaaacat

SEQ ID NO: 118122 - DNA, 22 bp, Artificial Sequence
  Synthetic oligonucleotide; TTA chr11 5370251 5370272 5370256 5370251 -
atatttcatagcattaaacatt

SEQ ID NO: 118123 - DNA, 22 bp, Artificial Sequence
  Synthetic oligonucleotide; TTT chr11 5370245 5370266 5370250 5370245 -
catagcattaaacattcaaacc

SEQ ID NO: 118124 - DNA, 22 bp, Artificial Sequence
  Synthetic oligonucleotide; TTC chr11 5370244 5370265 5370249 5370244 -
atagcattaaacattcaaacct

SEQ ID NO: 118125 - DNA, 22 bp, Artificial Sequence
  Synthetic oligonucleotide; TTA chr11 5370235 5370256 5370240 5370235 -
aacattcaaaccttcaacttta

SEQ ID NO: 118126 - DNA, 22 bp, Artificial Sequence
  Synthetic oligonucleotide; TTC chr11 5370228 5370249 5370233 5370228 -
aaaccttcaactttaggattta

SEQ ID NO: 118127 - DNA, 22 bp, Artificial Sequence
  Synthetic oligonucleotide; CTT chr11 5370221 5370242 5370226 5370221 -
caactttaggatttactataaa

SEQ ID NO: 118128 - DNA, 22 bp, Artificial Sequence
  Synthetic oligonucleotide; TTC chr11 5370220 5370241 5370225 5370220 -
aactttaggatttactataaaa

SEQ ID NO: 118129 - DNA, 22 bp, Artificial Sequence
  Synthetic oligonucleotide; CTT chr11 5370215 5370236 5370220 5370215 -
taggatttactataaaagactg

SEQ ID NO: 118130 - DNA, 22 bp, Artificial Sequence
  Synthetic oligonucleotide; TTT chr11 5370214 5370235 5370219 5370214 -
aggatttactataaaagactgt

SEQ ID NO: 118131 - DNA, 22 bp, Artificial Sequence
  Synthetic oligonucleotide; TTA chr11 5370213 5370234 5370218 5370213 -
ggatttactataaaagactgtg

SEQ ID NO: 118132 - DNA, 22 bp, Artificial Sequence
  Synthetic oligonucleotide; TTT chr11 5370207 5370228 5370212 5370207 -
actataaaagactgtgactgtt

SEQ ID NO: 118133 - DNA, 22 bp, Artificial Sequence
  Synthetic oligonucleotide; TTA chr11 5370206 5370227 5370211 5370206 -
ctataaaagactgtgactgtta

SEQ ID NO: 118134 - DNA, 22 bp, Artificial Sequence
  Synthetic oligonucleotide; CTA chr11 5370203 5370224 5370208 5370203 -
taaaagactgtgactgttaatg

SEQ ID NO: 118135 - DNA, 22 bp, Artificial Sequence
  Synthetic oligonucleotide; CTG chr11 5370193 5370214 5370198 5370193 -
tgactgttaatgataataataa

SEQ ID NO: 118136 - DNA, 22 bp, Artificial Sequence
  Synthetic oligonucleotide; CTG chr11 5370187 5370208 5370192 5370187 -
ttaatgataataataaatacat

SEQ ID NO: 118137 - DNA, 22 bp, Artificial Sequence
  Synthetic oligonucleotide; TTA chr11 5370184 5370205 5370189 5370184 -
atgataataataaatacattga

SEQ ID NO: 118138 - DNA, 22 bp, Artificial Sequence
  Synthetic oligonucleotide; TTG chr11 5370163 5370184 5370168 5370163 -
atgattatgagcattattttta

SEQ ID NO: 118139 - DNA, 22 bp, Artificial Sequence
  Synthetic oligonucleotide; TTA chr11 5370156 5370177 5370161 5370156 -
tgagcattatttttaaattaca

SEQ ID NO: 118140 - DNA, 22 bp, Artificial Sequence
  Synthetic oligonucleotide; TTA chr11 5370147 5370168 5370152 5370147 -
tttttaaattacaacttggtag

SEQ ID NO: 118141 - DNA, 22 bp, Artificial Sequence
  Synthetic oligonucleotide; TTT chr11 5370144 5370165 5370149 5370144 -
ttaaattacaacttggtagcct

SEQ ID NO: 118142 - DNA, 22 bp, Artificial Sequence
  Synthetic oligonucleotide; TTT chr11 5370143 5370164 5370148 5370143 -
taaattacaacttggtagcctc

SEQ ID NO: 118143 - DNA, 22 bp, Artificial Sequence
  Synthetic oligonucleotide; TTT chr11 5370142 5370163 5370147 5370142 -
aaattacaacttggtagcctct

SEQ ID NO: 118144 - DNA, 22 bp, Artificial Sequence
  Synthetic oligonucleotide; TTA chr11 5370141 5370162 5370146 5370141 -
aattacaacttggtagcctcta

SEQ ID NO: 118145 - DNA, 22 bp, Artificial Sequence
  Synthetic oligonucleotide; TTA chr11 5370136 5370157 5370141 5370136 -
caacttggtagcctctagcatt

SEQ ID NO: 118146 - DNA, 22 bp, Artificial Sequence
  Synthetic oligonucleotide; CTT chr11 5370130 5370151 5370135 5370130 -
ggtagcctctagcatttatata

SEQ ID NO: 118147 - DNA, 22 bp, Artificial Sequence
  Synthetic oligonucleotide; TTG chr11 5370129 5370150 5370134 5370129 -
gtagcctctagcatttatatac

SEQ ID NO: 118148 - DNA, 22 bp, Artificial Sequence
  Synthetic oligonucleotide; CTC chr11 5370121 5370142 5370126 5370121 -
tagcatttatatacctgtattt

SEQ ID NO: 118149 - DNA, 22 bp, Artificial Sequence
  Synthetic oligonucleotide; CTA chr11 5370119 5370140 5370124 5370119 -
gcatttatatacctgtattttc

SEQ ID NO: 118150 - DNA, 22 bp, Artificial Sequence
  Synthetic oligonucleotide; TTT chr11 5370113 5370134 5370118 5370113 -
atatacctgtattttctatatg

SEQ ID NO: 118151 - DNA, 22 bp, Artificial Sequence
  Synthetic oligonucleotide; TTA chr11 5370112 5370133 5370117 5370112 -
tatacctgtattttctatatgc

SEQ ID NO: 118152 - DNA, 22 bp, Artificial Sequence
  Synthetic oligonucleotide; CTG chr11 5370104 5370125 5370109 5370104 -
tattttctatatgcatttctat

SEQ ID NO: 118153 - DNA, 22 bp, Artificial Sequence
  Synthetic oligonucleotide; TTT chr11 5370099 5370120 5370104 5370099 -
tctatatgcatttctatagaag

SEQ ID NO: 118154 - DNA, 22 bp, Artificial Sequence
  Synthetic oligonucleotide; TTT chr11 5370098 5370119 5370103 5370098 -
ctatatgcatttctatagaagc

SEQ ID NO: 118155 - DNA, 22 bp, Artificial Sequence
  Synthetic oligonucleotide; TTC chr11 5370097 5370118 5370102 5370097 -
tatatgcatttctatagaagca

SEQ ID NO: 118156 - DNA, 22 bp, Artificial Sequence
  Synthetic oligonucleotide; CTA chr11 5370095 5370116 5370100 5370095 -
tatgcatttctatagaagcagc

SEQ ID NO: 118157 - DNA, 22 bp, Artificial Sequence
  Synthetic oligonucleotide; TTT chr11 5370086 5370107 5370091 5370086 -
ctatagaagcagcttgcacatg

SEQ ID NO: 118158 - DNA, 22 bp, Artificial Sequence
  Synthetic oligonucleotide; TTC chr11 5370085 5370106 5370090 5370085 -
tatagaagcagcttgcacatgc

SEQ ID NO: 118159 - DNA, 22 bp, Artificial Sequence
  Synthetic oligonucleotide; CTA chr11 5370083 5370104 5370088 5370083 -
tagaagcagcttgcacatgctg

SEQ ID NO: 118160 - DNA, 22 bp, Artificial Sequence
  Synthetic oligonucleotide; CTT chr11 5370071 5370092 5370076 5370071 -
gcacatgctgtacaaaccataa

SEQ ID NO: 118161 - DNA, 22 bp, Artificial Sequence
  Synthetic oligonucleotide; TTG chr11 5370070 5370091 5370075 5370070 -
cacatgctgtacaaaccataag

SEQ ID NO: 118162 - DNA, 22 bp, Artificial Sequence
  Synthetic oligonucleotide; CTG chr11 5370061 5370082 5370066 5370061 -
tacaaaccataagatggcagga

SEQ ID NO: 118163 - DNA, 22 bp, Artificial Sequence
  Synthetic oligonucleotide; TTT chr11 5370032 5370053 5370037 5370032 -
gtggaacactgactctcctggg

SEQ ID NO: 118164 - DNA, 22 bp, Artificial Sequence
  Synthetic oligonucleotide; TTG chr11 5370031 5370052 5370036 5370031 -
tggaacactgactctcctgggg

SEQ ID NO: 118165 - DNA, 22 bp, Artificial Sequence
  Synthetic oligonucleotide; CTG chr11 5370021 5370042 5370026 5370021 -
actctcctggggccatgcagag

SEQ ID NO: 118166 - DNA, 22 bp, Artificial Sequence
  Synthetic oligonucleotide; CTC chr11 5370017 5370038 5370022 5370017 -
tcctggggccatgcagagggag

SEQ ID NO: 118167 - DNA, 22 bp, Artificial Sequence
  Synthetic oligonucleotide; CTC chr11 5370015 5370036 5370020 5370015 -
ctggggccatgcagagggaggt

SEQ ID NO: 118168 - DNA, 22 bp, Artificial Sequence
  Synthetic oligonucleotide; CTG chr11 5370012 5370033 5370017 5370012 -
gggccatgcagagggaggtttg

SEQ ID NO: 118169 - DNA, 22 bp, Artificial Sequence
  Synthetic oligonucleotide; TTT chr11 5369991 5370012 5369996 5369991 -
gaagatcttgttgatacagatt

SEQ ID NO: 118170 - DNA, 22 bp, Artificial Sequence
  Synthetic oligonucleotide; TTG chr11 5369990 5370011 5369995 5369990 -
aagatcttgttgatacagattg

SEQ ID NO: 118171 - DNA, 22 bp, Artificial Sequence
  Synthetic oligonucleotide; CTT chr11 5369982 5370003 5369987 5369982 -
gttgatacagattgacacagaa

SEQ ID NO: 118172 - DNA, 22 bp, Artificial Sequence
  Synthetic oligonucleotide; TTG chr11 5369981 5370002 5369986 5369981 -
ttgatacagattgacacagaat

SEQ ID NO: 118173 - DNA, 22 bp, Artificial Sequence
  Synthetic oligonucleotide; TTG chr11 5369978 5369999 5369983 5369978 -
atacagattgacacagaatacc

SEQ ID NO: 118174 - DNA, 22 bp, Artificial Sequence
  Synthetic oligonucleotide; TTG chr11 5369968 5369989 5369973 5369968 -
acacagaataccaaagcctctt

SEQ ID NO: 118175 - DNA, 22 bp, Artificial Sequence
  Synthetic oligonucleotide; CTC chr11 5369948 5369969 5369953 5369948 -
tttccccactgcctttccttga

SEQ ID NO: 118176 - DNA, 22 bp, Artificial Sequence
  Synthetic oligonucleotide; CTT chr11 5369946 5369967 5369951 5369946 -
tccccactgcctttccttgagt

SEQ ID NO: 118177 - DNA, 22 bp, Artificial Sequence
  Synthetic oligonucleotide; TTT chr11 5369945 5369966 5369950 5369945 -
ccccactgcctttccttgagta

SEQ ID NO: 118178 - DNA, 22 bp, Artificial Sequence
  Synthetic oligonucleotide; TTC chr11 5369944 5369965 5369949 5369944 -
cccactgcctttccttgagtaa

SEQ ID NO: 118179 - DNA, 22 bp, Artificial Sequence
  Synthetic oligonucleotide; CTG chr11 5369937 5369958 5369942 5369937 -
cctttccttgagtaaaaatcct

SEQ ID NO: 118180 - DNA, 22 bp, Artificial Sequence
  Synthetic oligonucleotide; CTT chr11 5369933 5369954 5369938 5369933 -
tccttgagtaaaaatcctgaga

SEQ ID NO: 118181 - DNA, 22 bp, Artificial Sequence
  Synthetic oligonucleotide; TTT chr11 5369932 5369953 5369937 5369932 -
ccttgagtaaaaatcctgagaa

SEQ ID NO: 118182 - DNA, 22 bp, Artificial Sequence
  Synthetic oligonucleotide; TTC chr11 5369931 5369952 5369936 5369931 -
cttgagtaaaaatcctgagaaa

SEQ ID NO: 118183 - DNA, 22 bp, Artificial Sequence
  Synthetic oligonucleotide; CTT chr11 5369928 5369949 5369933 5369928 -
gagtaaaaatcctgagaaaatg

SEQ ID NO: 118184 - DNA, 22 bp, Artificial Sequence
  Synthetic oligonucleotide; TTG chr11 5369927 5369948 5369932 5369927 -
agtaaaaatcctgagaaaatgt

SEQ ID NO: 118185 - DNA, 22 bp, Artificial Sequence
  Synthetic oligonucleotide; CTG chr11 5369914 5369935 5369919 5369914 -
agaaaatgtcttccctttcttt

SEQ ID NO: 118186 - DNA, 22 bp, Artificial Sequence
  Synthetic oligonucleotide; CTT chr11 5369902 5369923 5369907 5369902 -
ccctttctttctatgttgatag

SEQ ID NO: 118187 - DNA, 22 bp, Artificial Sequence
  Synthetic oligonucleotide; TTC chr11 5369901 5369922 5369906 5369901 -
cctttctttctatgttgatagc

SEQ ID NO: 118188 - DNA, 22 bp, Artificial Sequence
  Synthetic oligonucleotide; CTT chr11 5369897 5369918 5369902 5369897 -
tctttctatgttgatagcaaaa

SEQ ID NO: 118189 - DNA, 22 bp, Artificial Sequence
  Synthetic oligonucleotide; TTT chr11 5369896 5369917 5369901 5369896 -
ctttctatgttgatagcaaaac

SEQ ID NO: 118190 - DNA, 22 bp, Artificial Sequence
  Synthetic oligonucleotide; TTC chr11 5369895 5369916 5369900 5369895 -
tttctatgttgatagcaaaacc

SEQ ID NO: 118191 - DNA, 22 bp, Artificial Sequence
  Synthetic oligonucleotide; CTT chr11 5369893 5369914 5369898 5369893 -
tctatgttgatagcaaaaccaa

SEQ ID NO: 118192 - DNA, 22 bp, Artificial Sequence
  Synthetic oligonucleotide; TTT chr11 5369892 5369913 5369897 5369892 -
ctatgttgatagcaaaaccaat

SEQ ID NO: 118193 - DNA, 22 bp, Artificial Sequence
  Synthetic oligonucleotide; TTC chr11 5369891 5369912 5369896 5369891 -
tatgttgatagcaaaaccaatg

SEQ ID NO: 118194 - DNA, 22 bp, Artificial Sequence
  Synthetic oligonucleotide; CTA chr11 5369889 5369910 5369894 5369889 -
tgttgatagcaaaaccaatgag

SEQ ID NO: 118195 - DNA, 22 bp, Artificial Sequence
  Synthetic oligonucleotide; TTG chr11 5369884 5369905 5369889 5369884 -
atagcaaaaccaatgaggtcat

SEQ ID NO: 118196 - DNA, 22 bp, Artificial Sequence
  Synthetic oligonucleotide; CTT chr11 5369857 5369878 5369862 5369857 -
ttaacaactgttgacttatttt

SEQ ID NO: 118197 - DNA, 22 bp, Artificial Sequence
  Synthetic oligonucleotide; TTT chr11 5369856 5369877 5369861 5369856 -
taacaactgttgacttattttg

SEQ ID NO: 118198 - DNA, 22 bp, Artificial Sequence
  Synthetic oligonucleotide; TTT chr11 5369855 5369876 5369860 5369855 -
aacaactgttgacttattttgg

SEQ ID NO: 118199 - DNA, 22 bp, Artificial Sequence
  Synthetic oligonucleotide; TTA chr11 5369854 5369875 5369859 5369854 -
acaactgttgacttattttgga

SEQ ID NO: 118200 - DNA, 22 bp, Artificial Sequence
  Synthetic oligonucleotide; CTG chr11 5369847 5369868 5369852 5369847 -
ttgacttattttggattttagt

SEQ ID NO: 118201 - DNA, 22 bp, Artificial Sequence
  Synthetic oligonucleotide; TTG chr11 5369844 5369865 5369849 5369844 -
acttattttggattttagtcta

SEQ ID NO: 118202 - DNA, 22 bp, Artificial Sequence
  Synthetic oligonucleotide; CTT chr11 5369840 5369861 5369845 5369840 -
attttggattttagtctacatt

SEQ ID NO: 118203 - DNA, 22 bp, Artificial Sequence
  Synthetic oligonucleotide; TTA chr11 5369839 5369860 5369844 5369839 -
ttttggattttagtctacattc

SEQ ID NO: 118204 - DNA, 22 bp, Artificial Sequence
  Synthetic oligonucleotide; TTT chr11 5369836 5369857 5369841 5369836 -
tggattttagtctacattcact

SEQ ID NO: 118205 - DNA, 22 bp, Artificial Sequence
  Synthetic oligonucleotide; TTT chr11 5369835 5369856 5369840 5369835 -
ggattttagtctacattcactg

SEQ ID NO: 118206 - DNA, 22 bp, Artificial Sequence
  Synthetic oligonucleotide; TTG chr11 5369834 5369855 5369839 5369834 -
gattttagtctacattcactgt

SEQ ID NO: 118207 - DNA, 22 bp, Artificial Sequence
  Synthetic oligonucleotide; TTT chr11 5369829 5369850 5369834 5369829 -
tagtctacattcactgtaacac

SEQ ID NO: 118208 - DNA, 22 bp, Artificial Sequence
  Synthetic oligonucleotide; TTT chr11 5369828 5369849 5369833 5369828 -
agtctacattcactgtaacaca

SEQ ID NO: 118209 - DNA, 22 bp, Artificial Sequence
  Synthetic oligonucleotide; TTA chr11 5369827 5369848 5369832 5369827 -
gtctacattcactgtaacacaa

SEQ ID NO: 118210 - DNA, 22 bp, Artificial Sequence
  Synthetic oligonucleotide; CTA chr11 5369822 5369843 5369827 5369822 -
cattcactgtaacacaaaaatg

SEQ ID NO: 118211 - DNA, 22 bp, Artificial Sequence
  Synthetic oligonucleotide; TTC chr11 5369817 5369838 5369822 5369817 -
actgtaacacaaaaatgcagac

SEQ ID NO: 118212 - DNA, 22 bp, Artificial Sequence
  Synthetic oligonucleotide; CTG chr11 5369813 5369834 5369818 5369813 -
taacacaaaaatgcagacaagc

SEQ ID NO: 118213 - DNA, 22 bp, Artificial Sequence
  Synthetic oligonucleotide; CTG chr11 5369784 5369805 5369789 5369784 -
attttagtgtggcatcatggaa

SEQ ID NO: 118214 - DNA, 22 bp, Artificial Sequence
  Synthetic oligonucleotide; TTT chr11 5369780 5369801 5369785 5369780 -
tagtgtggcatcatggaaataa

SEQ ID NO: 118215 - DNA, 22 bp, Artificial Sequence
  Synthetic oligonucleotide; TTT chr11 5369779 5369800 5369784 5369779 -
agtgtggcatcatggaaataac

SEQ ID NO: 118216 - DNA, 22 bp, Artificial Sequence
  Synthetic oligonucleotide; TTA chr11 5369778 5369799 5369783 5369778 -
gtgtggcatcatggaaataaca

SEQ ID NO: 118217 - DNA, 22 bp, Artificial Sequence
  Synthetic oligonucleotide; CTA chr11 5369750 5369771 5369755 5369750 -
cacatagcccttgctaccagcc

SEQ ID NO: 118218 - DNA, 22 bp, Artificial Sequence
  Synthetic oligonucleotide; CTT chr11 5369738 5369759 5369743 5369738 -
gctaccagccaataggactatt

SEQ ID NO: 118219 - DNA, 22 bp, Artificial Sequence
  Synthetic oligonucleotide; TTG chr11 5369737 5369758 5369742 5369737 -
ctaccagccaataggactattt

SEQ ID NO: 118220 - DNA, 22 bp, Artificial Sequence
  Synthetic oligonucleotide; CTA chr11 5369734 5369755 5369739 5369734 -
ccagccaataggactatttatt

SEQ ID NO: 118221 - DNA, 22 bp, Artificial Sequence
  Synthetic oligonucleotide; CTA chr11 5369718 5369739 5369723 5369718 -
tttatttgagtatgttcatata

SEQ ID NO: 118222 - DNA, 22 bp, Artificial Sequence
  Synthetic oligonucleotide; TTT chr11 5369715 5369736 5369720 5369715 -
atttgagtatgttcatatatgt

SEQ ID NO: 118223 - DNA, 22 bp, Artificial Sequence
  Synthetic oligonucleotide; TTA chr11 5369714 5369735 5369719 5369714 -
tttgagtatgttcatatatgta

SEQ ID NO: 118224 - DNA, 22 bp, Artificial Sequence
  Synthetic oligonucleotide; TTT chr11 5369711 5369732 5369716 5369711 -
gagtatgttcatatatgtatat

SEQ ID NO: 118225 - DNA, 22 bp, Artificial Sequence
  Synthetic oligonucleotide; TTG chr11 5369710 5369731 5369715 5369710 -
agtatgttcatatatgtatata

SEQ ID NO: 118226 - DNA, 22 bp, Artificial Sequence
  Synthetic oligonucleotide; TTC chr11 5369701 5369722 5369706 5369701 -
atatatgtatatataaatgtgt

SEQ ID NO: 118227 - DNA, 22 bp, Artificial Sequence
  Synthetic oligonucleotide; TTG chr11 5369669 5369690 5369674 5369669 -
cagagaaatgtatggcagatta

SEQ ID NO: 118228 - DNA, 22 bp, Artificial Sequence
  Synthetic oligonucleotide; TTA chr11 5369647 5369668 5369652 5369647 -
taaagggaaattatctccaggg

SEQ ID NO: 118229 - DNA, 22 bp, Artificial Sequence
  Synthetic oligonucleotide; TTA chr11 5369634 5369655 5369639 5369634 -
tctccagggaggatagaaaggt

SEQ ID NO: 118230 - DNA, 22 bp, Artificial Sequence
  Synthetic oligonucleotide; CTC chr11 5369630 5369651 5369635 5369630 -
cagggaggatagaaaggtaagg

SEQ ID NO: 118231 - DNA, 22 bp, Artificial Sequence
  Synthetic oligonucleotide; CTT chr11 5369596 5369617 5369601 5369596 -
tactttatatttaatatacatg

SEQ ID NO: 118232 - DNA, 22 bp, Artificial Sequence
  Synthetic oligonucleotide; TTT chr11 5369595 5369616 5369600 5369595 -
actttatatttaatatacatgg

SEQ ID NO: 118233 - DNA, 22 bp, Artificial Sequence
  Synthetic oligonucleotide; TTA chr11 5369594 5369615 5369599 5369594 -
ctttatatttaatatacatgga

SEQ ID NO: 118234 - DNA, 22 bp, Artificial Sequence
  Synthetic oligonucleotide; CTT chr11 5369591 5369612 5369596 5369591 -
tatatttaatatacatggagta

SEQ ID NO: 118235 - DNA, 22 bp, Artificial Sequence
  Synthetic oligonucleotide; TTT chr11 5369590 5369611 5369595 5369590 -
atatttaatatacatggagtat

SEQ ID NO: 118236 - DNA, 22 bp, Artificial Sequence
  Synthetic oligonucleotide; TTA chr11 5369589 5369610 5369594 5369589 -
tatttaatatacatggagtata

SEQ ID NO: 118237 - DNA, 22 bp, Artificial Sequence
  Synthetic oligonucleotide; TTT chr11 5369584 5369605 5369589 5369584 -
aatatacatggagtatatataa

SEQ ID NO: 118238 - DNA, 22 bp, Artificial Sequence
  Synthetic oligonucleotide; TTA chr11 5369583 5369604 5369588 5369583 -
atatacatggagtatatataat

SEQ ID NO: 118239 - DNA, 22 bp, Artificial Sequence
  Synthetic oligonucleotide; TTT chr11 5369559 5369580 5369564 5369559 -
tttaaattatatcatagacata

SEQ ID NO: 118240 - DNA, 22 bp, Artificial Sequence
  Synthetic oligonucleotide; TTT chr11 5369558 5369579 5369563 5369558 -
ttaaattatatcatagacatat

SEQ ID NO: 118241 - DNA, 22 bp, Artificial Sequence
  Synthetic oligonucleotide; TTT chr11 5369557 5369578 5369562 5369557 -
taaattatatcatagacatatt

SEQ ID NO: 118242 - DNA, 22 bp, Artificial Sequence
  Synthetic oligonucleotide; TTT chr11 5369556 5369577 5369561 5369556 -
aaattatatcatagacatattt

SEQ ID NO: 118243 - DNA, 22 bp, Artificial Sequence
  Synthetic oligonucleotide; TTA chr11 5369555 5369576 5369560 5369555 -
aattatatcatagacatattta

SEQ ID NO: 118244 - DNA, 22 bp, Artificial Sequence
  Synthetic oligonucleotide; TTA chr11 5369550 5369571 5369555 5369550 -
tatcatagacatatttaggata

SEQ ID NO: 118245 - DNA, 22 bp, Artificial Sequence
  Synthetic oligonucleotide; TTT chr11 5369534 5369555 5369539 5369534 -
aggatagtgaatggaaaatttt

SEQ ID NO: 118246 - DNA, 22 bp, Artificial Sequence
  Synthetic oligonucleotide; TTA chr11 5369533 5369554 5369538 5369533 -
ggatagtgaatggaaaatttta

SEQ ID NO: 118247 - DNA, 22 bp, Artificial Sequence
  Synthetic oligonucleotide; TTT chr11 5369513 5369534 5369518 5369513 -
taaaaatacaactacttactag

SEQ ID NO: 118248 - DNA, 22 bp, Artificial Sequence
  Synthetic oligonucleotide; TTT chr11 5369512 5369533 5369517 5369512 -
aaaaatacaactacttactagt

SEQ ID NO: 118249 - DNA, 22 bp, Artificial Sequence
  Synthetic oligonucleotide; TTA chr11 5369511 5369532 5369516 5369511 -
aaaatacaactacttactagtt

SEQ ID NO: 118250 - DNA, 22 bp, Artificial Sequence
  Synthetic oligonucleotide; CTA chr11 5369499 5369520 5369504 5369499 -
cttactagttgtatactttttt

SEQ ID NO: 118251 - DNA, 22 bp, Artificial Sequence
  Synthetic oligonucleotide; CTT chr11 5369496 5369517 5369501 5369496 -
actagttgtatacttttttaaa

SEQ ID NO: 118252 - DNA, 22 bp, Artificial Sequence
  Synthetic oligonucleotide; TTA chr11 5369495 5369516 5369500 5369495 -
ctagttgtatacttttttaaat

SEQ ID NO: 118253 - DNA, 22 bp, Artificial Sequence
  Synthetic oligonucleotide; CTA chr11 5369492 5369513 5369497 5369492 -
gttgtatacttttttaaatgtc

SEQ ID NO: 118254 - DNA, 22 bp, Artificial Sequence
  Synthetic oligonucleotide; TTG chr11 5369488 5369509 5369493 5369488 -
tatacttttttaaatgtctcaa

SEQ ID NO: 118255 - DNA, 22 bp, Artificial Sequence
  Synthetic oligonucleotide; CTT chr11 5369481 5369502 5369486 5369481 -
ttttaaatgtctcaaattatca

SEQ ID NO: 118256 - DNA, 22 bp, Artificial Sequence
  Synthetic oligonucleotide; TTT chr11 5369480 5369501 5369485 5369480 -
tttaaatgtctcaaattatcag

SEQ ID NO: 118257 - DNA, 22 bp, Artificial Sequence
  Synthetic oligonucleotide; TTT chr11 5369479 5369500 5369484 5369479 -
ttaaatgtctcaaattatcaga

SEQ ID NO: 118258 - DNA, 22 bp, Artificial Sequence
  Synthetic oligonucleotide; TTT chr11 5369478 5369499 5369483 5369478 -
taaatgtctcaaattatcagat

SEQ ID NO: 118259 - DNA, 22 bp, Artificial Sequence
  Synthetic oligonucleotide; TTT chr11 5369477 5369498 5369482 5369477 -
aaatgtctcaaattatcagatt

SEQ ID NO: 118260 - DNA, 22 bp, Artificial Sequence
  Synthetic oligonucleotide; TTA chr11 5369476 5369497 5369481 5369476 -
aatgtctcaaattatcagattt

SEQ ID NO: 118261 - DNA, 22 bp, Artificial Sequence
  Synthetic oligonucleotide; CTC chr11 5369468 5369489 5369473 5369468 -
aaattatcagattttatttttt

SEQ ID NO: 118262 - DNA, 22 bp, Artificial Sequence
  Synthetic oligonucleotide; TTA chr11 5369462 5369483 5369467 5369462 -
tcagattttattttttatccag

SEQ ID NO: 118263 - DNA, 22 bp, Artificial Sequence
  Synthetic oligonucleotide; TTT chr11 5369454 5369475 5369459 5369454 -
tattttttatccagaaaaaata

SEQ ID NO: 118264 - DNA, 22 bp, Artificial Sequence
  Synthetic oligonucleotide; TTT chr11 5369453 5369474 5369458 5369453 -
attttttatccagaaaaaatat

SEQ ID NO: 118265 - DNA, 22 bp, Artificial Sequence
  Synthetic oligonucleotide; TTA chr11 5369452 5369473 5369457 5369452 -
ttttttatccagaaaaaatata

SEQ ID NO: 118266 - DNA, 22 bp, Artificial Sequence
  Synthetic oligonucleotide; TTT chr11 5369449 5369470 5369454 5369449 -
tttatccagaaaaaatatataa

SEQ ID NO: 118267 - DNA, 22 bp, Artificial Sequence
  Synthetic oligonucleotide; TTT chr11 5369448 5369469 5369453 5369448 -
ttatccagaaaaaatatataaa

SEQ ID NO: 118268 - DNA, 22 bp, Artificial Sequence
  Synthetic oligonucleotide; TTT chr11 5369447 5369468 5369452 5369447 -
tatccagaaaaaatatataaaa

SEQ ID NO: 118269 - DNA, 22 bp, Artificial Sequence
  Synthetic oligonucleotide; TTT chr11 5369446 5369467 5369451 5369446 -
atccagaaaaaatatataaaaa

SEQ ID NO: 118270 - DNA, 22 bp, Artificial Sequence
  Synthetic oligonucleotide; TTA chr11 5369445 5369466 5369450 5369445 -
tccagaaaaaatatataaaaag

SEQ ID NO: 118271 - DNA, 22 bp, Artificial Sequence
  Synthetic oligonucleotide; CTG chr11 5369419 5369440 5369424 5369419 -
tttcatagagttttactgaggt

SEQ ID NO: 118272 - DNA, 22 bp, Artificial Sequence
  Synthetic oligonucleotide; TTT chr11 5369416 5369437 5369421 5369416 -
catagagttttactgaggtata

SEQ ID NO: 118273 - DNA, 22 bp, Artificial Sequence
  Synthetic oligonucleotide; TTC chr11 5369415 5369436 5369420 5369415 -
atagagttttactgaggtataa

SEQ ID NO: 118274 - DNA, 22 bp, Artificial Sequence
  Synthetic oligonucleotide; TTT chr11 5369406 5369427 5369411 5369406 -
tactgaggtataatagatgtaa

SEQ ID NO: 118275 - DNA, 22 bp, Artificial Sequence
  Synthetic oligonucleotide; TTT chr11 5369405 5369426 5369410 5369405 -
actgaggtataatagatgtaat

SEQ ID NO: 118276 - DNA, 22 bp, Artificial Sequence
  Synthetic oligonucleotide; TTA chr11 5369404 5369425 5369409 5369404 -
ctgaggtataatagatgtaatt

SEQ ID NO: 118277 - DNA, 22 bp, Artificial Sequence
  Synthetic oligonucleotide; CTG chr11 5369401 5369422 5369406 5369401 -
aggtataatagatgtaattctc

SEQ ID NO: 118278 - DNA, 22 bp, Artificial Sequence
  Synthetic oligonucleotide; TTC chr11 5369381 5369402 5369386 5369381 -
tcctaaaagtgttatattttgc

SEQ ID NO: 118279 - DNA, 22 bp, Artificial Sequence
  Synthetic oligonucleotide; CTC chr11 5369379 5369400 5369384 5369379 -
ctaaaagtgttatattttgcaa

SEQ ID NO: 118280 - DNA, 22 bp, Artificial Sequence
  Synthetic oligonucleotide; CTA chr11 5369376 5369397 5369381 5369376 -
aaagtgttatattttgcaaata

SEQ ID NO: 118281 - DNA, 22 bp, Artificial Sequence
  Synthetic oligonucleotide; TTA chr11 5369367 5369388 5369372 5369367 -
tattttgcaaatagtggctgct

SEQ ID NO: 118282 - DNA, 22 bp, Artificial Sequence
  Synthetic oligonucleotide; TTT chr11 5369362 5369383 5369367 5369362 -
tgcaaatagtggctgctaaaat

SEQ ID NO: 118283 - DNA, 22 bp, Artificial Sequence
  Synthetic oligonucleotide; TTT chr11 5369361 5369382 5369366 5369361 -
gcaaatagtggctgctaaaata

SEQ ID NO: 118284 - DNA, 22 bp, Artificial Sequence
  Synthetic oligonucleotide; TTG chr11 5369360 5369381 5369365 5369360 -
caaatagtggctgctaaaatat

SEQ ID NO: 118285 - DNA, 22 bp, Artificial Sequence
  Synthetic oligonucleotide; CTG chr11 5369347 5369368 5369352 5369347 -
ctaaaatattattgttaatagt

SEQ ID NO: 118286 - DNA, 22 bp, Artificial Sequence
  Synthetic oligonucleotide; CTA chr11 5369344 5369365 5369349 5369344 -
aaatattattgttaatagtatt

SEQ ID NO: 118287 - DNA, 22 bp, Artificial Sequence
  Synthetic oligonucleotide; TTA chr11 5369336 5369357 5369341 5369336 -
ttgttaatagtattccactaac

SEQ ID NO: 118288 - DNA, 22 bp, Artificial Sequence
  Synthetic oligonucleotide; TTG chr11 5369333 5369354 5369338 5369333 -
ttaatagtattccactaactag

SEQ ID NO: 118289 - DNA, 22 bp, Artificial Sequence
  Synthetic oligonucleotide; TTA chr11 5369330 5369351 5369335 5369330 -
atagtattccactaactagtaa

SEQ ID NO: 118290 - DNA, 22 bp, Artificial Sequence
  Synthetic oligonucleotide; TTC chr11 5369321 5369342 5369326 5369321 -
cactaactagtaataataactt

SEQ ID NO: 118291 - DNA, 22 bp, Artificial Sequence
  Synthetic oligonucleotide; CTA chr11 5369316 5369337 5369321 5369316 -
actagtaataataactttaatt

SEQ ID NO: 118292 - DNA, 22 bp, Artificial Sequence
  Synthetic oligonucleotide; CTA chr11 5369312 5369333 5369317 5369312 -
gtaataataactttaattaata

SEQ ID NO: 118293 - DNA, 22 bp, Artificial Sequence
  Synthetic oligonucleotide; CTT chr11 5369299 5369320 5369304 5369299 -
taattaatatttgttaagccgt

SEQ ID NO: 118294 - DNA, 22 bp, Artificial Sequence
  Synthetic oligonucleotide; TTT chr11 5369298 5369319 5369303 5369298 -
aattaatatttgttaagccgtg

SEQ ID NO: 118295 - DNA, 22 bp, Artificial Sequence
  Synthetic oligonucleotide; TTA chr11 5369297 5369318 5369302 5369297 -
attaatatttgttaagccgtga

SEQ ID NO: 118296 - DNA, 22 bp, Artificial Sequence
  Synthetic oligonucleotide; TTA chr11 5369293 5369314 5369298 5369293 -
atatttgttaagccgtgacttt

SEQ ID NO: 118297 - DNA, 22 bp, Artificial Sequence
  Synthetic oligonucleotide; TTT chr11 5369287 5369308 5369292 5369287 -
gttaagccgtgactttgtttct

SEQ ID NO: 118298 - DNA, 22 bp, Artificial Sequence
  Synthetic oligonucleotide; TTG chr11 5369286 5369307 5369291 5369286 -
ttaagccgtgactttgtttcta

SEQ ID NO: 118299 - DNA, 22 bp, Artificial Sequence
  Synthetic oligonucleotide; TTA chr11 5369283 5369304 5369288 5369283 -
agccgtgactttgtttctacta

SEQ ID NO: 118300 - DNA, 22 bp, Artificial Sequence
  Synthetic oligonucleotide; CTT chr11 5369272 5369293 5369277 5369272 -
tgtttctactaccccacacaca

SEQ ID NO: 118301 - DNA, 22 bp, Artificial Sequence
  Synthetic oligonucleotide; TTT chr11 5369271 5369292 5369276 5369271 -
gtttctactaccccacacacat

SEQ ID NO: 118302 - DNA, 22 bp, Artificial Sequence
  Synthetic oligonucleotide; TTG chr11 5369270 5369291 5369275 5369270 -
tttctactaccccacacacatg

SEQ ID NO: 118303 - DNA, 22 bp, Artificial Sequence
  Synthetic oligonucleotide; TTT chr11 5369267 5369288 5369272 5369267 -
ctactaccccacacacatgggc

SEQ ID NO: 118304 - DNA, 22 bp, Artificial Sequence
  Synthetic oligonucleotide; TTC chr11 5369266 5369287 5369271 5369266 -
tactaccccacacacatgggca

SEQ ID NO: 118305 - DNA, 22 bp, Artificial Sequence
  Synthetic oligonucleotide; CTA chr11 5369264 5369285 5369269 5369264 -
ctaccccacacacatgggcata

SEQ ID NO: 118306 - DNA, 22 bp, Artificial Sequence
  Synthetic oligonucleotide; CTA chr11 5369261 5369282 5369266 5369261 -
ccccacacacatgggcatacat

SEQ ID NO: 118307 - DNA, 22 bp, Artificial Sequence
  Synthetic oligonucleotide; CTT chr11 5369234 5369255 5369239 5369234 -
cttctatcatgttggcctcatt

SEQ ID NO: 118308 - DNA, 22 bp, Artificial Sequence
  Synthetic oligonucleotide; TTC chr11 5369233 5369254 5369238 5369233 -
ttctatcatgttggcctcattc

SEQ ID NO: 118309 - DNA, 22 bp, Artificial Sequence
  Synthetic oligonucleotide; CTT chr11 5369231 5369252 5369236 5369231 -
ctatcatgttggcctcattcag

SEQ ID NO: 118310 - DNA, 22 bp, Artificial Sequence
  Synthetic oligonucleotide; TTC chr11 5369230 5369251 5369235 5369230 -
tatcatgttggcctcattcagt

SEQ ID NO: 118311 - DNA, 22 bp, Artificial Sequence
  Synthetic oligonucleotide; CTA chr11 5369228 5369249 5369233 5369228 -
tcatgttggcctcattcagtac

SEQ ID NO: 118312 - DNA, 22 bp, Artificial Sequence
  Synthetic oligonucleotide; TTG chr11 5369220 5369241 5369225 5369220 -
gcctcattcagtacagtactag

SEQ ID NO: 118313 - DNA, 22 bp, Artificial Sequence
  Synthetic oligonucleotide; CTC chr11 5369215 5369236 5369220 5369215 -
attcagtacagtactagaaaat

SEQ ID NO: 118314 - DNA, 22 bp, Artificial Sequence
  Synthetic oligonucleotide; TTC chr11 5369211 5369232 5369216 5369211 -
agtacagtactagaaaatcagt

SEQ ID NO: 118315 - DNA, 22 bp, Artificial Sequence
  Synthetic oligonucleotide; CTA chr11 5369199 5369220 5369204 5369199 -
gaaaatcagtagggactcaggt

SEQ ID NO: 118316 - DNA, 22 bp, Artificial Sequence
  Synthetic oligonucleotide; CTC chr11 5369181 5369202 5369186 5369181 -
aggttatatgtgtgaatggatg

SEQ ID NO: 118317 - DNA, 22 bp, Artificial Sequence
  Synthetic oligonucleotide; TTA chr11 5369175 5369196 5369180 5369175 -
tatgtgtgaatggatgaataaa

SEQ ID NO: 118318 - DNA, 22 bp, Artificial Sequence
  Synthetic oligonucleotide; CTA chr11 5369139 5369160 5369144 5369139 -
tttttaaagacttcatcctttc

SEQ ID NO: 118319 - DNA, 22 bp, Artificial Sequence
  Synthetic oligonucleotide; TTT chr11 5369136 5369157 5369141 5369136 -
ttaaagacttcatcctttctgt

SEQ ID NO: 118320 - DNA, 22 bp, Artificial Sequence
  Synthetic oligonucleotide; TTT chr11 5369135 5369156 5369140 5369135 -
taaagacttcatcctttctgta

SEQ ID NO: 118321 - DNA, 22 bp, Artificial Sequence
  Synthetic oligonucleotide; TTT chr11 5369134 5369155 5369139 5369134 -
aaagacttcatcctttctgtat

SEQ ID NO: 118322 - DNA, 22 bp, Artificial Sequence
  Synthetic oligonucleotide; TTA chr11 5369133 5369154 5369138 5369133 -
aagacttcatcctttctgtatg

SEQ ID NO: 118323 - DNA, 22 bp, Artificial Sequence
  Synthetic oligonucleotide; CTT chr11 5369126 5369147 5369131 5369126 -
catcctttctgtatgtctaacc

SEQ ID NO: 118324 - DNA, 22 bp, Artificial Sequence
  Synthetic oligonucleotide; TTC chr11 5369125 5369146 5369130 5369125 -
atcctttctgtatgtctaacct

SEQ ID NO: 118325 - DNA, 22 bp, Artificial Sequence
  Synthetic oligonucleotide; CTT chr11 5369119 5369140 5369124 5369119 -
tctgtatgtctaaccttagatt

SEQ ID NO: 118326 - DNA, 22 bp, Artificial Sequence
  Synthetic oligonucleotide; TTT chr11 5369118 5369139 5369123 5369118 -
ctgtatgtctaaccttagattc

SEQ ID NO: 118327 - DNA, 22 bp, Artificial Sequence
  Synthetic oligonucleotide; TTC chr11 5369117 5369138 5369122 5369117 -
tgtatgtctaaccttagattct

SEQ ID NO: 118328 - DNA, 22 bp, Artificial Sequence
  Synthetic oligonucleotide; CTG chr11 5369115 5369136 5369120 5369115 -
tatgtctaaccttagattctag

SEQ ID NO: 118329 - DNA, 22 bp, Artificial Sequence
  Synthetic oligonucleotide; CTA chr11 5369107 5369128 5369112 5369107 -
accttagattctagtcatggcc

SEQ ID NO: 118330 - DNA, 22 bp, Artificial Sequence
  Synthetic oligonucleotide; CTT chr11 5369102 5369123 5369107 5369102 -
agattctagtcatggccatatg

SEQ ID NO: 118331 - DNA, 22 bp, Artificial Sequence
  Synthetic oligonucleotide; TTA chr11 5369101 5369122 5369106 5369101 -
gattctagtcatggccatatgt

SEQ ID NO: 118332 - DNA, 22 bp, Artificial Sequence
  Synthetic oligonucleotide; TTC chr11 5369096 5369117 5369101 5369096 -
tagtcatggccatatgtctcta

SEQ ID NO: 118333 - DNA, 22 bp, Artificial Sequence
  Synthetic oligonucleotide; CTA chr11 5369094 5369115 5369099 5369094 -
gtcatggccatatgtctctagg

SEQ ID NO: 118334 - DNA, 22 bp, Artificial Sequence
  Synthetic oligonucleotide; CTC chr11 5369076 5369097 5369081 5369076 -
taggtggcccaaccaccctatc

SEQ ID NO: 118335 - DNA, 22 bp, Artificial Sequence
  Synthetic oligonucleotide; CTA chr11 5369074 5369095 5369079 5369074 -
ggtggcccaaccaccctatcac

SEQ ID NO: 118336 - DNA, 22 bp, Artificial Sequence
  Synthetic oligonucleotide; CTA chr11 5369056 5369077 5369061 5369056 -
tcacagattctgcttcaaaggc

SEQ ID NO: 118337 - DNA, 22 bp, Artificial Sequence
  Synthetic oligonucleotide; TTC chr11 5369046 5369067 5369051 5369046 -
tgcttcaaaggcactcatcttg

SEQ ID NO: 118338 - DNA, 22 bp, Artificial Sequence
  Synthetic oligonucleotide; CTG chr11 5369044 5369065 5369049 5369044 -
cttcaaaggcactcatcttggt

SEQ ID NO: 118339 - DNA, 22 bp, Artificial Sequence
  Synthetic oligonucleotide; CTT chr11 5369041 5369062 5369046 5369041 -
caaaggcactcatcttggtgaa

SEQ ID NO: 118340 - DNA, 22 bp, Artificial Sequence
  Synthetic oligonucleotide; TTC chr11 5369040 5369061 5369045 5369040 -
aaaggcactcatcttggtgaat

SEQ ID NO: 118341 - DNA, 22 bp, Artificial Sequence
  Synthetic oligonucleotide; CTC chr11 5369030 5369051 5369035 5369030 -
atcttggtgaatgaatatctag

SEQ ID NO: 118342 - DNA, 22 bp, Artificial Sequence
  Synthetic oligonucleotide; CTT chr11 5369025 5369046 5369030 5369025 -
ggtgaatgaatatctagtccca

SEQ ID NO: 118343 - DNA, 22 bp, Artificial Sequence
  Synthetic oligonucleotide; TTG chr11 5369024 5369045 5369029 5369024 -
gtgaatgaatatctagtcccag

SEQ ID NO: 118344 - DNA, 22 bp, Artificial Sequence
  Synthetic oligonucleotide; CTA chr11 5369009 5369030 5369014 5369009 -
gtcccagaaggaggctaaaaac

SEQ ID NO: 118345 - DNA, 22 bp, Artificial Sequence
  Synthetic oligonucleotide; CTA chr11 5368992 5369013 5368997 5368992 -
aaaactatcttgtccacatcta

SEQ ID NO: 118346 - DNA, 22 bp, Artificial Sequence
  Synthetic oligonucleotide; CTA chr11 5368985 5369006 5368990 5368985 -
tcttgtccacatctagttggct

SEQ ID NO: 118347 - DNA, 22 bp, Artificial Sequence
  Synthetic oligonucleotide; CTT chr11 5368981 5369002 5368986 5368981 -
gtccacatctagttggctgaca

SEQ ID NO: 118348 - DNA, 22 bp, Artificial Sequence
  Synthetic oligonucleotide; TTG chr11 5368980 5369001 5368985 5368980 -
tccacatctagttggctgacac

SEQ ID NO: 118349 - DNA, 22 bp, Artificial Sequence
  Synthetic oligonucleotide; CTA chr11 5368970 5368991 5368975 5368970 -
gttggctgacacacaatttagg

SEQ ID NO: 118350 - DNA, 22 bp, Artificial Sequence
  Synthetic oligonucleotide; TTG chr11 5368966 5368987 5368971 5368966 -
gctgacacacaatttaggcttc

SEQ ID NO: 118351 - DNA, 22 bp, Artificial Sequence
  Synthetic oligonucleotide; CTG chr11 5368962 5368983 5368967 5368962 -
acacacaatttaggcttcttgg

SEQ ID NO: 118352 - DNA, 22 bp, Artificial Sequence
  Synthetic oligonucleotide; TTT chr11 5368951 5368972 5368956 5368951 -
aggcttcttgggtgtaatcaga

SEQ ID NO: 118353 - DNA, 22 bp, Artificial Sequence
  Synthetic oligonucleotide; TTA chr11 5368950 5368971 5368955 5368950 -
ggcttcttgggtgtaatcagat

SEQ ID NO: 118354 - DNA, 22 bp, Artificial Sequence
  Synthetic oligonucleotide; CTT chr11 5368945 5368966 5368950 5368945 -
cttgggtgtaatcagatctgta

SEQ ID NO: 118355 - DNA, 22 bp, Artificial Sequence
  Synthetic oligonucleotide; TTC chr11 5368944 5368965 5368949 5368944 -
ttgggtgtaatcagatctgtaa

SEQ ID NO: 118356 - DNA, 22 bp, Artificial Sequence
  Synthetic oligonucleotide; CTT chr11 5368942 5368963 5368947 5368942 -
gggtgtaatcagatctgtaagc

SEQ ID NO: 118357 - DNA, 22 bp, Artificial Sequence
  Synthetic oligonucleotide; TTG chr11 5368941 5368962 5368946 5368941 -
ggtgtaatcagatctgtaagca

SEQ ID NO: 118358 - DNA, 22 bp, Artificial Sequence
  Synthetic oligonucleotide; CTG chr11 5368925 5368946 5368930 5368925 -
taagcatgatccggaaagaaaa

SEQ ID NO: 118359 - DNA, 22 bp, Artificial Sequence
  Synthetic oligonucleotide; TTC chr11 5368898 5368919 5368903 5368898 -
ctgaacagaggcttccaacatc

SEQ ID NO: 118360 - DNA, 22 bp, Artificial Sequence
  Synthetic oligonucleotide; CTG chr11 5368895 5368916 5368900 5368895 -
aacagaggcttccaacatcctc

SEQ ID NO: 118361 - DNA, 22 bp, Artificial Sequence
  Synthetic oligonucleotide; CTT chr11 5368884 5368905 5368889 5368884 -
ccaacatcctcagaaggaaacc

SEQ ID NO: 118362 - DNA, 22 bp, Artificial Sequence
  Synthetic oligonucleotide; TTC chr11 5368883 5368904 5368888 5368883 -
caacatcctcagaaggaaacct

SEQ ID NO: 118363 - DNA, 22 bp, Artificial Sequence
  Synthetic oligonucleotide; CTC chr11 5368873 5368894 5368878 5368873 -
agaaggaaacctctcttaatcc

SEQ ID NO: 118364 - DNA, 22 bp, Artificial Sequence
  Synthetic oligonucleotide; CTC chr11 5368860 5368881 5368865 5368860 -
tcttaatccacataagaatggt

SEQ ID NO: 118365 - DNA, 22 bp, Artificial Sequence
  Synthetic oligonucleotide; CTC chr11 5368858 5368879 5368863 5368858 -
ttaatccacataagaatggtgt

SEQ ID NO: 118366 - DNA, 22 bp, Artificial Sequence
  Synthetic oligonucleotide; CTT chr11 5368856 5368877 5368861 5368856 -
aatccacataagaatggtgtaa

SEQ ID NO: 118367 - DNA, 22 bp, Artificial Sequence
  Synthetic oligonucleotide; TTA chr11 5368855 5368876 5368860 5368855 -
atccacataagaatggtgtaaa

SEQ ID NO: 118368 - DNA, 22 bp, Artificial Sequence
  Synthetic oligonucleotide; TTC chr11 5368830 5368851 5368835 5368830 -
caacatcttgctcctaagaaca

SEQ ID NO: 118369 - DNA, 22 bp, Artificial Sequence
  Synthetic oligonucleotide; CTT chr11 5368821 5368842 5368826 5368821 -
gctcctaagaacactttgccct

SEQ ID NO: 118370 - DNA, 22 bp, Artificial Sequence
  Synthetic oligonucleotide; TTG chr11 5368820 5368841 5368825 5368820 -
ctcctaagaacactttgccctg

SEQ ID NO: 118371 - DNA, 22 bp, Artificial Sequence
  Synthetic oligonucleotide; CTC chr11 5368817 5368838 5368822 5368817 -
ctaagaacactttgccctgggg

SEQ ID NO: 118372 - DNA, 22 bp, Artificial Sequence
  Synthetic oligonucleotide; CTA chr11 5368814 5368835 5368819 5368814 -
agaacactttgccctgggggaa

SEQ ID NO: 118373 - DNA, 22 bp, Artificial Sequence
  Synthetic oligonucleotide; CTT chr11 5368805 5368826 5368810 5368805 -
tgccctgggggaaaaaaagaaa

SEQ ID NO: 118374 - DNA, 22 bp, Artificial Sequence
  Synthetic oligonucleotide; TTT chr11 5368804 5368825 5368809 5368804 -
gccctgggggaaaaaaagaaaa

SEQ ID NO: 118375 - DNA, 22 bp, Artificial Sequence
  Synthetic oligonucleotide; TTG chr11 5368803 5368824 5368808 5368803 -
ccctgggggaaaaaaagaaaag

SEQ ID NO: 118376 - DNA, 22 bp, Artificial Sequence
  Synthetic oligonucleotide; CTG chr11 5368798 5368819 5368803 5368798 -
ggggaaaaaaagaaaagccatc

SEQ ID NO: 118377 - DNA, 22 bp, Artificial Sequence
  Synthetic oligonucleotide; CTT chr11 5368768 5368789 5368773 5368768 -
tcagaaggcctatgctgaggtt

SEQ ID NO: 118378 - DNA, 22 bp, Artificial Sequence
  Synthetic oligonucleotide; TTT chr11 5368767 5368788 5368772 5368767 -
cagaaggcctatgctgaggttt

SEQ ID NO: 118379 - DNA, 22 bp, Artificial Sequence
  Synthetic oligonucleotide; TTC chr11 5368766 5368787 5368771 5368766 -
agaaggcctatgctgaggtttt

SEQ ID NO: 118380 - DNA, 22 bp, Artificial Sequence
  Synthetic oligonucleotide; CTA chr11 5368756 5368777 5368761 5368756 -
tgctgaggttttgcttccttca

SEQ ID NO: 118381 - DNA, 22 bp, Artificial Sequence
  Synthetic oligonucleotide; CTG chr11 5368751 5368772 5368756 5368751 -
aggttttgcttccttcagtttt

SEQ ID NO: 118382 - DNA, 22 bp, Artificial Sequence
  Synthetic oligonucleotide; TTT chr11 5368745 5368766 5368750 5368745 -
tgcttccttcagttttaaagca

SEQ ID NO: 118383 - DNA, 22 bp, Artificial Sequence
  Synthetic oligonucleotide; TTT chr11 5368744 5368765 5368749 5368744 -
gcttccttcagttttaaagcat

SEQ ID NO: 118384 - DNA, 22 bp, Artificial Sequence
  Synthetic oligonucleotide; TTG chr11 5368743 5368764 5368748 5368743 -
cttccttcagttttaaagcata

SEQ ID NO: 118385 - DNA, 22 bp, Artificial Sequence
  Synthetic oligonucleotide; CTT chr11 5368740 5368761 5368745 5368740 -
ccttcagttttaaagcataata

SEQ ID NO: 118386 - DNA, 22 bp, Artificial Sequence
  Synthetic oligonucleotide; TTC chr11 5368739 5368760 5368744 5368739 -
cttcagttttaaagcataatat

SEQ ID NO: 118387 - DNA, 22 bp, Artificial Sequence
  Synthetic oligonucleotide; CTT chr11 5368736 5368757 5368741 5368736 -
cagttttaaagcataatatttt

SEQ ID NO: 118388 - DNA, 22 bp, Artificial Sequence
  Synthetic oligonucleotide; TTC chr11 5368735 5368756 5368740 5368735 -
agttttaaagcataatattttg

SEQ ID NO: 118389 - DNA, 22 bp, Artificial Sequence
  Synthetic oligonucleotide; TTT chr11 5368730 5368751 5368735 5368730 -
taaagcataatattttgagtaa

SEQ ID NO: 118390 - DNA, 22 bp, Artificial Sequence
  Synthetic oligonucleotide; TTT chr11 5368729 5368750 5368734 5368729 -
aaagcataatattttgagtaac

SEQ ID NO: 118391 - DNA, 22 bp, Artificial Sequence
  Synthetic oligonucleotide; TTA chr11 5368728 5368749 5368733 5368728 -
aagcataatattttgagtaact

SEQ ID NO: 118392 - DNA, 22 bp, Artificial Sequence
  Synthetic oligonucleotide; TTT chr11 5368715 5368736 5368720 5368715 -
tgagtaactcaatgtttagaaa

SEQ ID NO: 118393 - DNA, 22 bp, Artificial Sequence
  Synthetic oligonucleotide; TTT chr11 5368714 5368735 5368719 5368714 -
gagtaactcaatgtttagaaac

SEQ ID NO: 118394 - DNA, 22 bp, Artificial Sequence
  Synthetic oligonucleotide; TTG chr11 5368713 5368734 5368718 5368713 -
agtaactcaatgtttagaaacc

SEQ ID NO: 118395 - DNA, 22 bp, Artificial Sequence
  Synthetic oligonucleotide; CTC chr11 5368705 5368726 5368710 5368705 -
aatgtttagaaacctcaaattt

SEQ ID NO: 118396 - DNA, 22 bp, Artificial Sequence
  Synthetic oligonucleotide; TTT chr11 5368698 5368719 5368703 5368698 -
agaaacctcaaattttgctctt

SEQ ID NO: 118397 - DNA, 22 bp, Artificial Sequence
  Synthetic oligonucleotide; TTA chr11 5368697 5368718 5368702 5368697 -
gaaacctcaaattttgctcttg

SEQ ID NO: 118398 - DNA, 22 bp, Artificial Sequence
  Synthetic oligonucleotide; CTC chr11 5368689 5368710 5368694 5368689 -
aaattttgctcttgacagataa

SEQ ID NO: 118399 - DNA, 22 bp, Artificial Sequence
  Synthetic oligonucleotide; TTT chr11 5368683 5368704 5368688 5368683 -
tgctcttgacagataaaactga

SEQ ID NO: 118400 - DNA, 22 bp, Artificial Sequence
  Synthetic oligonucleotide; TTT chr11 5368682 5368703 5368687 5368682 -
gctcttgacagataaaactgaa

SEQ ID NO: 118401 - DNA, 22 bp, Artificial Sequence
  Synthetic oligonucleotide; TTG chr11 5368681 5368702 5368686 5368681 -
ctcttgacagataaaactgaaa

SEQ ID NO: 118402 - DNA, 22 bp, Artificial Sequence
  Synthetic oligonucleotide; CTC chr11 5368678 5368699 5368683 5368678 -
ttgacagataaaactgaaacct

SEQ ID NO: 118403 - DNA, 22 bp, Artificial Sequence
  Synthetic oligonucleotide; CTT chr11 5368676 5368697 5368681 5368676 -
gacagataaaactgaaacctct

SEQ ID NO: 118404 - DNA, 22 bp, Artificial Sequence
  Synthetic oligonucleotide; TTG chr11 5368675 5368696 5368680 5368675 -
acagataaaactgaaacctcta

SEQ ID NO: 118405 - DNA, 22 bp, Artificial Sequence
  Synthetic oligonucleotide; CTG chr11 5368662 5368683 5368667 5368662 -
aaacctctactatgctctgctt

SEQ ID NO: 118406 - DNA, 22 bp, Artificial Sequence
  Synthetic oligonucleotide; CTC chr11 5368655 5368676 5368660 5368655 -
tactatgctctgctttctcaca

SEQ ID NO: 118407 - DNA, 22 bp, Artificial Sequence
  Synthetic oligonucleotide; CTA chr11 5368653 5368674 5368658 5368653 -
ctatgctctgctttctcacagg

SEQ ID NO: 118408 - DNA, 22 bp, Artificial Sequence
  Synthetic oligonucleotide; CTA chr11 5368650 5368671 5368655 5368650 -
tgctctgctttctcacaggatg

SEQ ID NO: 118409 - DNA, 22 bp, Artificial Sequence
  Synthetic oligonucleotide; CTC chr11 5368645 5368666 5368650 5368645 -
tgctttctcacaggatgcatgt

SEQ ID NO: 118410 - DNA, 22 bp, Artificial Sequence
  Synthetic oligonucleotide; CTG chr11 5368643 5368664 5368648 5368643 -
ctttctcacaggatgcatgtga

SEQ ID NO: 118411 - DNA, 22 bp, Artificial Sequence
  Synthetic oligonucleotide; CTT chr11 5368640 5368661 5368645 5368640 -
tctcacaggatgcatgtgagaa

SEQ ID NO: 118412 - DNA, 22 bp, Artificial Sequence
  Synthetic oligonucleotide; TTT chr11 5368639 5368660 5368644 5368639 -
ctcacaggatgcatgtgagaat

SEQ ID NO: 118413 - DNA, 22 bp, Artificial Sequence
  Synthetic oligonucleotide; TTC chr11 5368638 5368659 5368643 5368638 -
tcacaggatgcatgtgagaata

SEQ ID NO: 118414 - DNA, 22 bp, Artificial Sequence
  Synthetic oligonucleotide; CTC chr11 5368636 5368657 5368641 5368636 -
acaggatgcatgtgagaataaa

SEQ ID NO: 118415 - DNA, 22 bp, Artificial Sequence
  Synthetic oligonucleotide; CTT chr11 5368602 5368623 5368607 5368602 -
tatgttagaatatcttgtgtaa

SEQ ID NO: 118416 - DNA, 22 bp, Artificial Sequence
  Synthetic oligonucleotide; TTT chr11 5368601 5368622 5368606 5368601 -
atgttagaatatcttgtgtaac

SEQ ID NO: 118417 - DNA, 22 bp, Artificial Sequence
  Synthetic oligonucleotide; TTA chr11 5368600 5368621 5368605 5368600 -
tgttagaatatcttgtgtaact

SEQ ID NO: 118418 - DNA, 22 bp, Artificial Sequence
  Synthetic oligonucleotide; TTA chr11 5368595 5368616 5368600 5368595 -
gaatatcttgtgtaacttcaag

SEQ ID NO: 118419 - DNA, 22 bp, Artificial Sequence
  Synthetic oligonucleotide; CTT chr11 5368586 5368607 5368591 5368586 -
gtgtaacttcaagtattacgat

SEQ ID NO: 118420 - DNA, 22 bp, Artificial Sequence
  Synthetic oligonucleotide; TTG chr11 5368585 5368606 5368590 5368585 -
tgtaacttcaagtattacgatt

SEQ ID NO: 118421 - DNA, 22 bp, Artificial Sequence
  Synthetic oligonucleotide; CTT chr11 5368577 5368598 5368582 5368577 -
caagtattacgattgtgagaga

SEQ ID NO: 118422 - DNA, 22 bp, Artificial Sequence
  Synthetic oligonucleotide; TTC chr11 5368576 5368597 5368581 5368576 -
aagtattacgattgtgagagag

SEQ ID NO: 118423 - DNA, 22 bp, Artificial Sequence
  Synthetic oligonucleotide; TTA chr11 5368568 5368589 5368573 5368568 -
cgattgtgagagagctttttaa

SEQ ID NO: 118424 - DNA, 22 bp, Artificial Sequence
  Synthetic oligonucleotide; TTG chr11 5368562 5368583 5368567 5368562 -
tgagagagctttttaaaggttt

SEQ ID NO: 118425 - DNA, 22 bp, Artificial Sequence
  Synthetic oligonucleotide; CTT chr11 5368551 5368572 5368556 5368551 -
tttaaaggtttttattttcttt

SEQ ID NO: 118426 - DNA, 22 bp, Artificial Sequence
  Synthetic oligonucleotide; TTT chr11 5368550 5368571 5368555 5368550 -
ttaaaggtttttattttctttg

SEQ ID NO: 118427 - DNA, 22 bp, Artificial Sequence
  Synthetic oligonucleotide; TTT chr11 5368549 5368570 5368554 5368549 -
taaaggtttttattttctttgt

SEQ ID NO: 118428 - DNA, 22 bp, Artificial Sequence
  Synthetic oligonucleotide; TTT chr11 5368548 5368569 5368553 5368548 -
aaaggtttttattttctttgtc

SEQ ID NO: 118429 - DNA, 22 bp, Artificial Sequence
  Synthetic oligonucleotide; TTA chr11 5368547 5368568 5368552 5368547 -
aaggtttttattttctttgtca

SEQ ID NO: 118430 - DNA, 22 bp, Artificial Sequence
  Synthetic oligonucleotide; TTT chr11 5368540 5368561 5368545 5368540 -
ttattttctttgtcagagctag

SEQ ID NO: 118431 - DNA, 22 bp, Artificial Sequence
  Synthetic oligonucleotide; TTT chr11 5368539 5368560 5368544 5368539 -
tattttctttgtcagagctaga

SEQ ID NO: 118432 - DNA, 22 bp, Artificial Sequence
  Synthetic oligonucleotide; TTT chr11 5368538 5368559 5368543 5368538 -
attttctttgtcagagctagac

SEQ ID NO: 118433 - DNA, 22 bp, Artificial Sequence
  Synthetic oligonucleotide; TTA chr11 5368537 5368558 5368542 5368537 -
ttttctttgtcagagctagaca

SEQ ID NO: 118434 - DNA, 22 bp, Artificial Sequence
  Synthetic oligonucleotide; TTT chr11 5368534 5368555 5368539 5368534 -
tctttgtcagagctagacagag

SEQ ID NO: 118435 - DNA, 22 bp, Artificial Sequence
  Synthetic oligonucleotide; TTT chr11 5368533 5368554 5368538 5368533 -
ctttgtcagagctagacagagt

SEQ ID NO: 118436 - DNA, 22 bp, Artificial Sequence
  Synthetic oligonucleotide; TTC chr11 5368532 5368553 5368537 5368532 -
tttgtcagagctagacagagta

SEQ ID NO: 118437 - DNA, 22 bp, Artificial Sequence
  Synthetic oligonucleotide; CTT chr11 5368530 5368551 5368535 5368530 -
tgtcagagctagacagagtatc

SEQ ID NO: 118438 - DNA, 22 bp, Artificial Sequence
  Synthetic oligonucleotide; TTT chr11 5368529 5368550 5368534 5368529 -
gtcagagctagacagagtatct

SEQ ID NO: 118439 - DNA, 22 bp, Artificial Sequence
  Synthetic oligonucleotide; TTG chr11 5368528 5368549 5368533 5368528 -
tcagagctagacagagtatctt

SEQ ID NO: 118440 - DNA, 22 bp, Artificial Sequence
  Synthetic oligonucleotide; CTA chr11 5368519 5368540 5368524 5368519 -
gacagagtatcttctcagccca

SEQ ID NO: 118441 - DNA, 22 bp, Artificial Sequence
  Synthetic oligonucleotide; CTT chr11 5368506 5368527 5368511 5368506 -
ctcagcccaaaggtcaaattgt

SEQ ID NO: 118442 - DNA, 22 bp, Artificial Sequence
  Synthetic oligonucleotide; TTC chr11 5368505 5368526 5368510 5368505 -
tcagcccaaaggtcaaattgtc

SEQ ID NO: 118443 - DNA, 22 bp, Artificial Sequence
  Synthetic oligonucleotide; CTC chr11 5368503 5368524 5368508 5368503 -
agcccaaaggtcaaattgtctc

SEQ ID NO: 118444 - DNA, 22 bp, Artificial Sequence
  Synthetic oligonucleotide; TTG chr11 5368485 5368506 5368490 5368485 -
tctcattttcacaaaattttca

SEQ ID NO: 118445 - DNA, 22 bp, Artificial Sequence
  Synthetic oligonucleotide; CTC chr11 5368481 5368502 5368486 5368481 -
attttcacaaaattttcaatga

SEQ ID NO: 118446 - DNA, 22 bp, Artificial Sequence
  Synthetic oligonucleotide; TTT chr11 5368477 5368498 5368482 5368477 -
tcacaaaattttcaatgatgat

SEQ ID NO: 118447 - DNA, 22 bp, Artificial Sequence
  Synthetic oligonucleotide; TTT chr11 5368476 5368497 5368481 5368476 -
cacaaaattttcaatgatgatt

SEQ ID NO: 118448 - DNA, 22 bp, Artificial Sequence
  Synthetic oligonucleotide; TTC chr11 5368475 5368496 5368480 5368475 -
acaaaattttcaatgatgatta

SEQ ID NO: 118449 - DNA, 22 bp, Artificial Sequence
  Synthetic oligonucleotide; TTT chr11 5368466 5368487 5368471 5368466 -
tcaatgatgattatagtaataa

SEQ ID NO: 118450 - DNA, 22 bp, Artificial Sequence
  Synthetic oligonucleotide; TTT chr11 5368465 5368486 5368470 5368465 -
caatgatgattatagtaataat

SEQ ID NO: 118451 - DNA, 22 bp, Artificial Sequence
  Synthetic oligonucleotide; TTC chr11 5368464 5368485 5368469 5368464 -
aatgatgattatagtaataata

SEQ ID NO: 118452 - DNA, 22 bp, Artificial Sequence
  Synthetic oligonucleotide; TTA chr11 5368453 5368474 5368458 5368453 -
tagtaataatagcaatgatttc

SEQ ID NO: 118453 - DNA, 22 bp, Artificial Sequence
  Synthetic oligonucleotide; TTT chr11 5368432 5368453 5368437 5368432 -
ctataatacttacaatggacca

SEQ ID NO: 118454 - DNA, 22 bp, Artificial Sequence
  Synthetic oligonucleotide; TTC chr11 5368431 5368452 5368436 5368431 -
tataatacttacaatggaccag

SEQ ID NO: 118455 - DNA, 22 bp, Artificial Sequence
  Synthetic oligonucleotide; CTA chr11 5368429 5368450 5368434 5368429 -
taatacttacaatggaccaggc

SEQ ID NO: 118456 - DNA, 22 bp, Artificial Sequence
  Synthetic oligonucleotide; CTT chr11 5368421 5368442 5368426 5368421 -
acaatggaccaggcactattga

SEQ ID NO: 118457 - DNA, 22 bp, Artificial Sequence
  Synthetic oligonucleotide; TTA chr11 5368420 5368441 5368425 5368420 -
caatggaccaggcactattgaa

SEQ ID NO: 118458 - DNA, 22 bp, Artificial Sequence
  Synthetic oligonucleotide; CTA chr11 5368403 5368424 5368408 5368403 -
ttgaacacgttagacatattaa

SEQ ID NO: 118459 - DNA, 22 bp, Artificial Sequence
  Synthetic oligonucleotide; TTG chr11 5368400 5368421 5368405 5368400 -
aacacgttagacatattaatgt

SEQ ID NO: 118460 - DNA, 22 bp, Artificial Sequence
  Synthetic oligonucleotide; TTA chr11 5368391 5368412 5368396 5368391 -
gacatattaatgtatttaatca

SEQ ID NO: 118461 - DNA, 22 bp, Artificial Sequence
  Synthetic oligonucleotide; TTA chr11 5368382 5368403 5368387 5368382 -
atgtatttaatcattaaaataa

SEQ ID NO: 118462 - DNA, 22 bp, Artificial Sequence
  Synthetic oligonucleotide; TTT chr11 5368374 5368395 5368379 5368374 -
aatcattaaaataattcaacca

SEQ ID NO: 118463 - DNA, 22 bp, Artificial Sequence
  Synthetic oligonucleotide; TTA chr11 5368373 5368394 5368378 5368373 -
atcattaaaataattcaaccat

SEQ ID NO: 118464 - DNA, 22 bp, Artificial Sequence
  Synthetic oligonucleotide; TTA chr11 5368366 5368387 5368371 5368366 -
aaataattcaaccatgtgggta

SEQ ID NO: 118465 - DNA, 22 bp, Artificial Sequence
  Synthetic oligonucleotide; TTC chr11 5368357 5368378 5368362 5368357 -
aaccatgtgggtactattggta

SEQ ID NO: 118466 - DNA, 22 bp, Artificial Sequence
  Synthetic oligonucleotide; CTA chr11 5368341 5368362 5368346 5368341 -
ttggtatccccacttaaagatg

SEQ ID NO: 118467 - DNA, 22 bp, Artificial Sequence
  Synthetic oligonucleotide; TTG chr11 5368338 5368359 5368343 5368338 -
gtatccccacttaaagatgagt

SEQ ID NO: 118468 - DNA, 22 bp, Artificial Sequence
  Synthetic oligonucleotide; CTT chr11 5368326 5368347 5368331 5368326 -
aaagatgagtggaccaaaacac

SEQ ID NO: 118469 - DNA, 22 bp, Artificial Sequence
  Synthetic oligonucleotide; TTA chr11 5368325 5368346 5368330 5368325 -
aagatgagtggaccaaaacaca

SEQ ID NO: 118470 - DNA, 22 bp, Artificial Sequence
  Synthetic oligonucleotide; TTG chr11 5368290 5368311 5368295 5368290 -
ctttgctatagggtacgcagcc

SEQ ID NO: 118471 - DNA, 22 bp, Artificial Sequence
  Synthetic oligonucleotide; CTT chr11 5368287 5368308 5368292 5368287 -
tgctatagggtacgcagccaat

SEQ ID NO: 118472 - DNA, 22 bp, Artificial Sequence
  Synthetic oligonucleotide; TTT chr11 5368286 5368307 5368291 5368286 -
gctatagggtacgcagccaata

SEQ ID NO: 118473 - DNA, 22 bp, Artificial Sequence
  Synthetic oligonucleotide; TTG chr11 5368285 5368306 5368290 5368285 -
ctatagggtacgcagccaataa

SEQ ID NO: 118474 - DNA, 22 bp, Artificial Sequence
  Synthetic oligonucleotide; CTA chr11 5368282 5368303 5368287 5368282 -
tagggtacgcagccaataagtg

SEQ ID NO: 118475 - DNA, 22 bp, Artificial Sequence
  Synthetic oligonucleotide; TTG chr11 5368247 5368268 5368252 5368247 -
taaaccaaactgtttaattccc

SEQ ID NO: 118476 - DNA, 22 bp, Artificial Sequence
  Synthetic oligonucleotide; CTG chr11 5368235 5368256 5368240 5368235 -
tttaattcccaaaactactgca

SEQ ID NO: 118477 - DNA, 22 bp, Artificial Sequence
  Synthetic oligonucleotide; TTT chr11 5368232 5368253 5368237 5368232 -
aattcccaaaactactgcataa

SEQ ID NO: 118478 - DNA, 22 bp, Artificial Sequence
  Synthetic oligonucleotide; TTA chr11 5368231 5368252 5368236 5368231 -
attcccaaaactactgcataag

SEQ ID NO: 118479 - DNA, 22 bp, Artificial Sequence
  Synthetic oligonucleotide; TTC chr11 5368227 5368248 5368232 5368227 -
ccaaaactactgcataagactg

SEQ ID NO: 118480 - DNA, 22 bp, Artificial Sequence
  Synthetic oligonucleotide; CTA chr11 5368218 5368239 5368223 5368218 -
ctgcataagactgtatgaagaa

SEQ ID NO: 118481 - DNA, 22 bp, Artificial Sequence
  Synthetic oligonucleotide; CTG chr11 5368215 5368236 5368220 5368215 -
cataagactgtatgaagaagca

SEQ ID NO: 118482 - DNA, 22 bp, Artificial Sequence
  Synthetic oligonucleotide; CTG chr11 5368205 5368226 5368210 5368205 -
tatgaagaagcatgaaacaata

SEQ ID NO: 118483 - DNA, 22 bp, Artificial Sequence
  Synthetic oligonucleotide; TTT chr11 5368178 5368199 5368183 5368178 -
caagaagcctacagaacactta

SEQ ID NO: 118484 - DNA, 22 bp, Artificial Sequence
  Synthetic oligonucleotide; TTC chr11 5368177 5368198 5368182 5368177 -
aagaagcctacagaacacttaa

SEQ ID NO: 118485 - DNA, 22 bp, Artificial Sequence
  Synthetic oligonucleotide; CTA chr11 5368167 5368188 5368172 5368167 -
cagaacacttaacaggattttt

SEQ ID NO: 118486 - DNA, 22 bp, Artificial Sequence
  Synthetic oligonucleotide; CTT chr11 5368157 5368178 5368162 5368157 -
aacaggatttttcatgctggtt

SEQ ID NO: 118487 - DNA, 22 bp, Artificial Sequence
  Synthetic oligonucleotide; TTA chr11 5368156 5368177 5368161 5368156 -
acaggatttttcatgctggttc

SEQ ID NO: 118488 - DNA, 22 bp, Artificial Sequence
  Synthetic oligonucleotide; TTT chr11 5368147 5368168 5368152 5368147 -
ttcatgctggttcatagttaag

SEQ ID NO: 118489 - DNA, 22 bp, Artificial Sequence
  Synthetic oligonucleotide; TTT chr11 5368146 5368167 5368151 5368146 -
tcatgctggttcatagttaagt

SEQ ID NO: 118490 - DNA, 22 bp, Artificial Sequence
  Synthetic oligonucleotide; TTT chr11 5368145 5368166 5368150 5368145 -
catgctggttcatagttaagtt

SEQ ID NO: 118491 - DNA, 22 bp, Artificial Sequence
  Synthetic oligonucleotide; TTC chr11 5368144 5368165 5368149 5368144 -
atgctggttcatagttaagtta

SEQ ID NO: 118492 - DNA, 22 bp, Artificial Sequence
  Synthetic oligonucleotide; CTG chr11 5368138 5368159 5368143 5368138 -
gttcatagttaagttattggtt

SEQ ID NO: 118493 - DNA, 22 bp, Artificial Sequence
  Synthetic oligonucleotide; TTC chr11 5368134 5368155 5368139 5368134 -
atagttaagttattggttgaag

SEQ ID NO: 118494 - DNA, 22 bp, Artificial Sequence
  Synthetic oligonucleotide; TTA chr11 5368127 5368148 5368132 5368127 -
agttattggttgaagatgcaac

SEQ ID NO: 118495 - DNA, 22 bp, Artificial Sequence
  Synthetic oligonucleotide; TTA chr11 5368122 5368143 5368127 5368122 -
ttggttgaagatgcaacaaatc

SEQ ID NO: 118496 - DNA, 22 bp, Artificial Sequence
  Synthetic oligonucleotide; TTG chr11 5368119 5368140 5368124 5368119 -
gttgaagatgcaacaaatctga

SEQ ID NO: 118497 - DNA, 22 bp, Artificial Sequence
  Synthetic oligonucleotide; TTG chr11 5368115 5368136 5368120 5368115 -
aagatgcaacaaatctgaatgg

SEQ ID NO: 118498 - DNA, 22 bp, Artificial Sequence
  Synthetic oligonucleotide; CTG chr11 5368098 5368119 5368103 5368098 -
aatggcagaggaaaaaacaaag

SEQ ID NO: 118499 - DNA, 22 bp, Artificial Sequence
  Synthetic oligonucleotide; TTC chr11 5368065 5368086 5368070 5368065 -
tgagtgagcctgggtctccata

SEQ ID NO: 118500 - DNA, 22 bp, Artificial Sequence
  Synthetic oligonucleotide; CTG chr11 5368063 5368084 5368068 5368063 -
agtgagcctgggtctccatagg

SEQ ID NO: 118501 - DNA, 22 bp, Artificial Sequence
  Synthetic oligonucleotide; CTG chr11 5368053 5368074 5368058 5368053 -
ggtctccataggagcaaagaac

SEQ ID NO: 118502 - DNA, 22 bp, Artificial Sequence
  Synthetic oligonucleotide; CTC chr11 5368047 5368068 5368052 5368047 -
cataggagcaaagaaccaagtg

SEQ ID NO: 118503 - DNA, 22 bp, Artificial Sequence
  Synthetic oligonucleotide; CTT chr11 5368019 5368040 5368024 5368019 -
gggttagttgtggggtgtaaga

SEQ ID NO: 118504 - DNA, 22 bp, Artificial Sequence
  Synthetic oligonucleotide; TTG chr11 5368018 5368039 5368023 5368018 -
ggttagttgtggggtgtaagat

SEQ ID NO: 118505 - DNA, 22 bp, Artificial Sequence
  Synthetic oligonucleotide; TTA chr11 5368013 5368034 5368018 5368013 -
gttgtggggtgtaagatataat

SEQ ID NO: 118506 - DNA, 22 bp, Artificial Sequence
  Synthetic oligonucleotide; TTG chr11 5368009 5368030 5368014 5368009 -
tggggtgtaagatataattaga

SEQ ID NO: 118507 - DNA, 22 bp, Artificial Sequence
  Synthetic oligonucleotide; TTA chr11 5367989 5368010 5367994 5367989 -
gaagagaagtagctctactctg

SEQ ID NO: 118508 - DNA, 22 bp, Artificial Sequence
  Synthetic oligonucleotide; CTC chr11 5367974 5367995 5367979 5367974 -
tactctggtagaagtgaaactt

SEQ ID NO: 118509 - DNA, 22 bp, Artificial Sequence
  Synthetic oligonucleotide; CTA chr11 5367972 5367993 5367977 5367972 -
ctctggtagaagtgaaactttg

SEQ ID NO: 118510 - DNA, 22 bp, Artificial Sequence
  Synthetic oligonucleotide; CTC chr11 5367969 5367990 5367974 5367969 -
tggtagaagtgaaactttgaag

SEQ ID NO: 118511 - DNA, 22 bp, Artificial Sequence
  Synthetic oligonucleotide; CTG chr11 5367967 5367988 5367972 5367967 -
gtagaagtgaaactttgaagaa

SEQ ID NO: 118512 - DNA, 22 bp, Artificial Sequence
  Synthetic oligonucleotide; CTT chr11 5367952 5367973 5367957 5367952 -
tgaagaatgtctgattcctcac

SEQ ID NO: 118513 - DNA, 22 bp, Artificial Sequence
  Synthetic oligonucleotide; TTT chr11 5367951 5367972 5367956 5367951 -
gaagaatgtctgattcctcaca

SEQ ID NO: 118514 - DNA, 22 bp, Artificial Sequence
  Synthetic oligonucleotide; TTG chr11 5367950 5367971 5367955 5367950 -
aagaatgtctgattcctcacaa

SEQ ID NO: 118515 - DNA, 22 bp, Artificial Sequence
  Synthetic oligonucleotide; CTG chr11 5367939 5367960 5367944 5367939 -
attcctcacaaactgctgagta

SEQ ID NO: 118516 - DNA, 22 bp, Artificial Sequence
  Synthetic oligonucleotide; TTC chr11 5367935 5367956 5367940 5367935 -
ctcacaaactgctgagtaagga

SEQ ID NO: 118517 - DNA, 22 bp, Artificial Sequence
  Synthetic oligonucleotide; CTC chr11 5367932 5367953 5367937 5367932 -
acaaactgctgagtaaggatag

SEQ ID NO: 118518 - DNA, 22 bp, Artificial Sequence
  Synthetic oligonucleotide; CTG chr11 5367924 5367945 5367929 5367924 -
ctgagtaaggataggaaaatgc

SEQ ID NO: 118519 - DNA, 22 bp, Artificial Sequence
  Synthetic oligonucleotide; CTG chr11 5367921 5367942 5367926 5367921 -
agtaaggataggaaaatgcata

SEQ ID NO: 118520 - DNA, 22 bp, Artificial Sequence
  Synthetic oligonucleotide; CTT chr11 5367894 5367915 5367899 5367894 -
ggtcaagatttaagcatgagga

SEQ ID NO: 118521 - DNA, 22 bp, Artificial Sequence
  Synthetic oligonucleotide; TTG chr11 5367893 5367914 5367898 5367893 -
gtcaagatttaagcatgaggac

SEQ ID NO: 118522 - DNA, 22 bp, Artificial Sequence
  Synthetic oligonucleotide; TTT chr11 5367883 5367904 5367888 5367883 -
aagcatgaggacataaaaatag

SEQ ID NO: 118523 - DNA, 22 bp, Artificial Sequence
  Synthetic oligonucleotide; TTA chr11 5367882 5367903 5367887 5367882 -
agcatgaggacataaaaataga

SEQ ID NO: 118524 - DNA, 22 bp, Artificial Sequence
  Synthetic oligonucleotide; TTT chr11 5367824 5367845 5367829 5367824 -
ttgaatgcatatattgtgcaag

SEQ ID NO: 118525 - DNA, 22 bp, Artificial Sequence
  Synthetic oligonucleotide; TTT chr11 5367823 5367844 5367828 5367823 -
tgaatgcatatattgtgcaagt

SEQ ID NO: 118526 - DNA, 22 bp, Artificial Sequence
  Synthetic oligonucleotide; TTT chr11 5367822 5367843 5367827 5367822 -
gaatgcatatattgtgcaagtg

SEQ ID NO: 118527 - DNA, 22 bp, Artificial Sequence
  Synthetic oligonucleotide; TTG chr11 5367821 5367842 5367826 5367821 -
aatgcatatattgtgcaagtgc

SEQ ID NO: 118528 - DNA, 22 bp, Artificial Sequence
  Synthetic oligonucleotide; TTG chr11 5367808 5367829 5367813 5367808 -
tgcaagtgcctctattctgggt

SEQ ID NO: 118529 - DNA, 22 bp, Artificial Sequence
  Synthetic oligonucleotide; CTC chr11 5367796 5367817 5367801 5367796 -
tattctgggtgctagcatacca

SEQ ID NO: 118530 - DNA, 22 bp, Artificial Sequence
  Synthetic oligonucleotide; CTA chr11 5367794 5367815 5367799 5367794 -
ttctgggtgctagcataccaga

SEQ ID NO: 118531 - DNA, 22 bp, Artificial Sequence
  Synthetic oligonucleotide; TTC chr11 5367791 5367812 5367796 5367791 -
tgggtgctagcataccagaaac

SEQ ID NO: 118532 - DNA, 22 bp, Artificial Sequence
  Synthetic oligonucleotide; CTG chr11 5367789 5367810 5367794 5367789 -
ggtgctagcataccagaaacaa

SEQ ID NO: 118533 - DNA, 22 bp, Artificial Sequence
  Synthetic oligonucleotide; CTA chr11 5367782 5367803 5367787 5367782 -
gcataccagaaacaacattttt

SEQ ID NO: 118534 - DNA, 22 bp, Artificial Sequence
  Synthetic oligonucleotide; TTT chr11 5367762 5367783 5367767 5367762 -
ttgttccttttgtcagaggcat

SEQ ID NO: 118535 - DNA, 22 bp, Artificial Sequence
  Synthetic oligonucleotide; TTT chr11 5367761 5367782 5367766 5367761 -
tgttccttttgtcagaggcatt

SEQ ID NO: 118536 - DNA, 22 bp, Artificial Sequence
  Synthetic oligonucleotide; TTT chr11 5367760 5367781 5367765 5367760 -
gttccttttgtcagaggcattt

SEQ ID NO: 118537 - DNA, 22 bp, Artificial Sequence
  Synthetic oligonucleotide; TTG chr11 5367759 5367780 5367764 5367759 -
ttccttttgtcagaggcatttg

SEQ ID NO: 118538 - DNA, 22 bp, Artificial Sequence
  Synthetic oligonucleotide; TTC chr11 5367756 5367777 5367761 5367756 -
cttttgtcagaggcatttgaac

SEQ ID NO: 118539 - DNA, 22 bp, Artificial Sequence
  Synthetic oligonucleotide; CTT chr11 5367753 5367774 5367758 5367753 -
ttgtcagaggcatttgaaccag

SEQ ID NO: 118540 - DNA, 22 bp, Artificial Sequence
  Synthetic oligonucleotide; TTT chr11 5367752 5367773 5367757 5367752 -
tgtcagaggcatttgaaccaga

SEQ ID NO: 118541 - DNA, 22 bp, Artificial Sequence
  Synthetic oligonucleotide; TTT chr11 5367751 5367772 5367756 5367751 -
gtcagaggcatttgaaccagag

SEQ ID NO: 118542 - DNA, 22 bp, Artificial Sequence
  Synthetic oligonucleotide; TTG chr11 5367750 5367771 5367755 5367750 -
tcagaggcatttgaaccagagc

SEQ ID NO: 118543 - DNA, 22 bp, Artificial Sequence
  Synthetic oligonucleotide; TTT chr11 5367738 5367759 5367743 5367738 -
gaaccagagcaactccatctta

SEQ ID NO: 118544 - DNA, 22 bp, Artificial Sequence
  Synthetic oligonucleotide; TTG chr11 5367737 5367758 5367742 5367737 -
aaccagagcaactccatcttaa

SEQ ID NO: 118545 - DNA, 22 bp, Artificial Sequence
  Synthetic oligonucleotide; CTC chr11 5367723 5367744 5367728 5367723 -
catcttaaataggagctgggta

SEQ ID NO: 118546 - DNA, 22 bp, Artificial Sequence
  Synthetic oligonucleotide; CTT chr11 5367717 5367738 5367722 5367717 -
aaataggagctgggtacaataa

SEQ ID NO: 118547 - DNA, 22 bp, Artificial Sequence
  Synthetic oligonucleotide; TTA chr11 5367716 5367737 5367721 5367716 -
aataggagctgggtacaataag

SEQ ID NO: 118548 - DNA, 22 bp, Artificial Sequence
  Synthetic oligonucleotide; CTG chr11 5367705 5367726 5367710 5367705 -
ggtacaataaggctgagaccta

SEQ ID NO: 118549 - DNA, 22 bp, Artificial Sequence
  Synthetic oligonucleotide; CTG chr11 5367690 5367711 5367695 5367690 -
agacctactgggctgtattccc

SEQ ID NO: 118550 - DNA, 22 bp, Artificial Sequence
  Synthetic oligonucleotide; CTA chr11 5367683 5367704 5367688 5367683 -
ctgggctgtattcccagaaagt

SEQ ID NO: 118551 - DNA, 22 bp, Artificial Sequence
  Synthetic oligonucleotide; CTG chr11 5367680 5367701 5367685 5367680 -
ggctgtattcccagaaagttag

SEQ ID NO: 118552 - DNA, 22 bp, Artificial Sequence
  Synthetic oligonucleotide; CTG chr11 5367675 5367696 5367680 5367675 -
tattcccagaaagttaggcatt

SEQ ID NO: 118553 - DNA, 22 bp, Artificial Sequence
  Synthetic oligonucleotide; TTC chr11 5367670 5367691 5367675 5367670 -
ccagaaagttaggcattctcag

SEQ ID NO: 118554 - DNA, 22 bp, Artificial Sequence
  Synthetic oligonucleotide; TTA chr11 5367659 5367680 5367664 5367659 -
ggcattctcagtcacaggatga

SEQ ID NO: 118555 - DNA, 22 bp, Artificial Sequence
  Synthetic oligonucleotide; TTC chr11 5367652 5367673 5367657 5367652 -
tcagtcacaggatgagataaga

SEQ ID NO: 118556 - DNA, 22 bp, Artificial Sequence
  Synthetic oligonucleotide; CTC chr11 5367650 5367671 5367655 5367650 -
agtcacaggatgagataagagg

SEQ ID NO: 118557 - DNA, 22 bp, Artificial Sequence
  Synthetic oligonucleotide; TTG chr11 5367625 5367646 5367630 5367625 -
gcacaagatacaggtcataaag

SEQ ID NO: 118558 - DNA, 22 bp, Artificial Sequence
  Synthetic oligonucleotide; CTT chr11 5367598 5367619 5367603 5367598 -
gctgaaaaaacagtttgcagta

SEQ ID NO: 118559 - DNA, 22 bp, Artificial Sequence
  Synthetic oligonucleotide; TTG chr11 5367597 5367618 5367602 5367597 -
ctgaaaaaacagtttgcagtaa

SEQ ID NO: 118560 - DNA, 22 bp, Artificial Sequence
  Synthetic oligonucleotide; CTG chr11 5367594 5367615 5367599 5367594 -
aaaaaacagtttgcagtaaaga

SEQ ID NO: 118561 - DNA, 22 bp, Artificial Sequence
  Synthetic oligonucleotide; TTT chr11 5367582 5367603 5367587 5367582 -
gcagtaaagaagctggctgaaa

SEQ ID NO: 118562 - DNA, 22 bp, Artificial Sequence
  Synthetic oligonucleotide; TTG chr11 5367581 5367602 5367586 5367581 -
cagtaaagaagctggctgaaac

SEQ ID NO: 118563 - DNA, 22 bp, Artificial Sequence
  Synthetic oligonucleotide; CTG chr11 5367567 5367588 5367572 5367567 -
gctgaaacccaccaaaccaaga

SEQ ID NO: 118564 - DNA, 22 bp, Artificial Sequence
  Synthetic oligonucleotide; CTG chr11 5367563 5367584 5367568 5367563 -
aaacccaccaaaccaagattgt

SEQ ID NO: 118565 - DNA, 22 bp, Artificial Sequence
  Synthetic oligonucleotide; TTG chr11 5367542 5367563 5367547 5367542 -
tgatgagagtgacctctggtag

SEQ ID NO: 118566 - DNA, 22 bp, Artificial Sequence
  Synthetic oligonucleotide; CTC chr11 5367526 5367547 5367531 5367526 -
tggtagtcctcactgctactct

SEQ ID NO: 118567 - DNA, 22 bp, Artificial Sequence
  Synthetic oligonucleotide; CTG chr11 5367524 5367545 5367529 5367524 -
gtagtcctcactgctactctcc

SEQ ID NO: 118568 - DNA, 22 bp, Artificial Sequence
  Synthetic oligonucleotide; CTC chr11 5367515 5367536 5367520 5367515 -
actgctactctcccaccagcac

SEQ ID NO: 118569 - DNA, 22 bp, Artificial Sequence
  Synthetic oligonucleotide; CTG chr11 5367511 5367532 5367516 5367511 -
ctactctcccaccagcactatg

SEQ ID NO: 118570 - DNA, 22 bp, Artificial Sequence
  Synthetic oligonucleotide; CTA chr11 5367508 5367529 5367513 5367508 -
ctctcccaccagcactatgact

SEQ ID NO: 118571 - DNA, 22 bp, Artificial Sequence
  Synthetic oligonucleotide; CTC chr11 5367505 5367526 5367510 5367505 -
tcccaccagcactatgactgtt

SEQ ID NO: 118572 - DNA, 22 bp, Artificial Sequence
  Synthetic oligonucleotide; CTC chr11 5367503 5367524 5367508 5367503 -
ccaccagcactatgactgttta

SEQ ID NO: 118573 - DNA, 22 bp, Artificial Sequence
  Synthetic oligonucleotide; CTA chr11 5367491 5367512 5367496 5367491 -
tgactgtttagaaatgccatgg

SEQ ID NO: 118574 - DNA, 22 bp, Artificial Sequence
  Synthetic oligonucleotide; CTG chr11 5367485 5367506 5367490 5367485 -
tttagaaatgccatggcaacat

SEQ ID NO: 118575 - DNA, 22 bp, Artificial Sequence
  Synthetic oligonucleotide; TTT chr11 5367482 5367503 5367487 5367482 -
agaaatgccatggcaacatcag

SEQ ID NO: 118576 - DNA, 22 bp, Artificial Sequence
  Synthetic oligonucleotide; TTA chr11 5367481 5367502 5367486 5367481 -
gaaatgccatggcaacatcagg

SEQ ID NO: 118577 - DNA, 22 bp, Artificial Sequence
  Synthetic oligonucleotide; TTA chr11 5367453 5367474 5367458 5367453 -
cgctaagcggtctgaaaagggg

SEQ ID NO: 118578 - DNA, 22 bp, Artificial Sequence
  Synthetic oligonucleotide; CTA chr11 5367448 5367469 5367453 5367448 -
agcggtctgaaaaggggaggca

SEQ ID NO: 118579 - DNA, 22 bp, Artificial Sequence
  Synthetic oligonucleotide; CTG chr11 5367439 5367460 5367444 5367439 -
aaaaggggaggcatgaataatc

SEQ ID NO: 118580 - DNA, 22 bp, Artificial Sequence
  Synthetic oligonucleotide; CTT chr11 5367409 5367430 5367414 5367409 -
gtttagcatatcatcaataaat

SEQ ID NO: 118581 - DNA, 22 bp, Artificial Sequence
  Synthetic oligonucleotide; TTG chr11 5367408 5367429 5367413 5367408 -
tttagcatatcatcaataaata

SEQ ID NO: 118582 - DNA, 22 bp, Artificial Sequence
  Synthetic oligonucleotide; TTT chr11 5367405 5367426 5367410 5367405 -
agcatatcatcaataaataacc

SEQ ID NO: 118583 - DNA, 22 bp, Artificial Sequence
  Synthetic oligonucleotide; TTA chr11 5367404 5367425 5367409 5367404 -
gcatatcatcaataaataacca

SEQ ID NO: 118584 - DNA, 22 bp, Artificial Sequence
  Synthetic oligonucleotide; CTC chr11 5367357 5367378 5367362 5367357 -
aggactgttctgcctatagggt

SEQ ID NO: 118585 - DNA, 22 bp, Artificial Sequence
  Synthetic oligonucleotide; CTG chr11 5367350 5367371 5367355 5367350 -
ttctgcctatagggtagccatt

SEQ ID NO: 118586 - DNA, 22 bp, Artificial Sequence
  Synthetic oligonucleotide; TTC chr11 5367347 5367368 5367352 5367347 -
tgcctatagggtagccattatt

SEQ ID NO: 118587 - DNA, 22 bp, Artificial Sequence
  Synthetic oligonucleotide; CTG chr11 5367345 5367366 5367350 5367345 -
cctatagggtagccattatttt

SEQ ID NO: 118588 - DNA, 22 bp, Artificial Sequence
  Synthetic oligonucleotide; CTA chr11 5367341 5367362 5367346 5367341 -
tagggtagccattattttactc

SEQ ID NO: 118589 - DNA, 22 bp, Artificial Sequence
  Synthetic oligonucleotide; TTA chr11 5367327 5367348 5367332 5367327 -
ttttactcctttactttcttaa

SEQ ID NO: 118590 - DNA, 22 bp, Artificial Sequence
  Synthetic oligonucleotide; TTT chr11 5367324 5367345 5367329 5367324 -
tactcctttactttcttaatta

SEQ ID NO: 118591 - DNA, 22 bp, Artificial Sequence
  Synthetic oligonucleotide; TTT chr11 5367323 5367344 5367328 5367323 -
actcctttactttcttaattaa

SEQ ID NO: 118592 - DNA, 22 bp, Artificial Sequence
  Synthetic oligonucleotide; TTA chr11 5367322 5367343 5367327 5367322 -
ctcctttactttcttaattaac

SEQ ID NO: 118593 - DNA, 22 bp, Artificial Sequence
  Synthetic oligonucleotide; CTC chr11 5367319 5367340 5367324 5367319 -
ctttactttcttaattaacttg

SEQ ID NO: 118594 - DNA, 22 bp, Artificial Sequence
  Synthetic oligonucleotide; CTT chr11 5367316 5367337 5367321 5367316 -
tactttcttaattaacttgctt

SEQ ID NO: 118595 - DNA, 22 bp, Artificial Sequence
  Synthetic oligonucleotide; TTT chr11 5367315 5367336 5367320 5367315 -
actttcttaattaacttgcttt

SEQ ID NO: 118596 - DNA, 22 bp, Artificial Sequence
  Synthetic oligonucleotide; TTA chr11 5367314 5367335 5367319 5367314 -
ctttcttaattaacttgctttc

SEQ ID NO: 118597 - DNA, 22 bp, Artificial Sequence
  Synthetic oligonucleotide; CTT chr11 5367311 5367332 5367316 5367311 -
tcttaattaacttgctttcact

SEQ ID NO: 118598 - DNA, 22 bp, Artificial Sequence
  Synthetic oligonucleotide; TTT chr11 5367310 5367331 5367315 5367310 -
cttaattaacttgctttcactt

SEQ ID NO: 118599 - DNA, 22 bp, Artificial Sequence
  Synthetic oligonucleotide; TTC chr11 5367309 5367330 5367314 5367309 -
ttaattaacttgctttcacttt

SEQ ID NO: 118600 - DNA, 22 bp, Artificial Sequence
  Synthetic oligonucleotide; CTT chr11 5367307 5367328 5367312 5367307 -
aattaacttgctttcacttttc

SEQ ID NO: 118601 - DNA, 22 bp, Artificial Sequence
  Synthetic oligonucleotide; TTA chr11 5367306 5367327 5367311 5367306 -
attaacttgctttcacttttct

SEQ ID NO: 118602 - DNA, 22 bp, Artificial Sequence
  Synthetic oligonucleotide; TTA chr11 5367302 5367323 5367307 5367302 -
acttgctttcacttttctgtat

SEQ ID NO: 118603 - DNA, 22 bp, Artificial Sequence
  Synthetic oligonucleotide; CTT chr11 5367298 5367319 5367303 5367298 -
gctttcacttttctgtatggat

SEQ ID NO: 118604 - DNA, 22 bp, Artificial Sequence
  Synthetic oligonucleotide; TTG chr11 5367297 5367318 5367302 5367297 -
ctttcacttttctgtatggatt

SEQ ID NO: 118605 - DNA, 22 bp, Artificial Sequence
  Synthetic oligonucleotide; CTT chr11 5367294 5367315 5367299 5367294 -
tcacttttctgtatggatttgc

SEQ ID NO: 118606 - DNA, 22 bp, Artificial Sequence
  Synthetic oligonucleotide; TTT chr11 5367293 5367314 5367298 5367293 -
cacttttctgtatggatttgcc

SEQ ID NO: 118607 - DNA, 22 bp, Artificial Sequence
  Synthetic oligonucleotide; TTC chr11 5367292 5367313 5367297 5367292 -
acttttctgtatggatttgccc

SEQ ID NO: 118608 - DNA, 22 bp, Artificial Sequence
  Synthetic oligonucleotide; CTT chr11 5367288 5367309 5367293 5367288 -
ttctgtatggatttgccccaaa

SEQ ID NO: 118609 - DNA, 22 bp, Artificial Sequence
  Synthetic oligonucleotide; TTT chr11 5367287 5367308 5367292 5367287 -
tctgtatggatttgccccaaat

SEQ ID NO: 118610 - DNA, 22 bp, Artificial Sequence
  Synthetic oligonucleotide; TTT chr11 5367286 5367307 5367291 5367286 -
ctgtatggatttgccccaaatt

SEQ ID NO: 118611 - DNA, 22 bp, Artificial Sequence
  Synthetic oligonucleotide; TTC chr11 5367285 5367306 5367290 5367285 -
tgtatggatttgccccaaattc

SEQ ID NO: 118612 - DNA, 22 bp, Artificial Sequence
  Synthetic oligonucleotide; CTG chr11 5367283 5367304 5367288 5367283 -
tatggatttgccccaaattctt

SEQ ID NO: 118613 - DNA, 22 bp, Artificial Sequence
  Synthetic oligonucleotide; TTT chr11 5367274 5367295 5367279 5367274 -
gccccaaattctttcttgggca

SEQ ID NO: 118614 - DNA, 22 bp, Artificial Sequence
  Synthetic oligonucleotide; TTG chr11 5367273 5367294 5367278 5367273 -
ccccaaattctttcttgggcac

SEQ ID NO: 118615 - DNA, 22 bp, Artificial Sequence
  Synthetic oligonucleotide; TTC chr11 5367263 5367284 5367268 5367263 -
tttcttgggcacgaaatccaag

SEQ ID NO: 118616 - DNA, 22 bp, Artificial Sequence
  Synthetic oligonucleotide; CTT chr11 5367261 5367282 5367266 5367261 -
tcttgggcacgaaatccaagaa

SEQ ID NO: 118617 - DNA, 22 bp, Artificial Sequence
  Synthetic oligonucleotide; TTT chr11 5367260 5367281 5367265 5367260 -
cttgggcacgaaatccaagaac

SEQ ID NO: 118618 - DNA, 22 bp, Artificial Sequence
  Synthetic oligonucleotide; TTC chr11 5367259 5367280 5367264 5367259 -
ttgggcacgaaatccaagaacc

SEQ ID NO: 118619 - DNA, 22 bp, Artificial Sequence
  Synthetic oligonucleotide; CTT chr11 5367257 5367278 5367262 5367257 -
gggcacgaaatccaagaaccct

SEQ ID NO: 118620 - DNA, 22 bp, Artificial Sequence
  Synthetic oligonucleotide; TTG chr11 5367256 5367277 5367261 5367256 -
ggcacgaaatccaagaaccctc

SEQ ID NO: 118621 - DNA, 22 bp, Artificial Sequence
  Synthetic oligonucleotide; CTC chr11 5367234 5367255 5367239 5367234 -
tcttagggtctggattgtgact

SEQ ID NO: 118622 - DNA, 22 bp, Artificial Sequence
  Synthetic oligonucleotide; CTC chr11 5367232 5367253 5367237 5367232 -
ttagggtctggattgtgactcc

SEQ ID NO: 118623 - DNA, 22 bp, Artificial Sequence
  Synthetic oligonucleotide; CTT chr11 5367230 5367251 5367235 5367230 -
agggtctggattgtgactcctt

SEQ ID NO: 118624 - DNA, 22 bp, Artificial Sequence
  Synthetic oligonucleotide; TTA chr11 5367229 5367250 5367234 5367229 -
gggtctggattgtgactccttt

SEQ ID NO: 118625 - DNA, 22 bp, Artificial Sequence
  Synthetic oligonucleotide; CTG chr11 5367222 5367243 5367227 5367222 -
gattgtgactcctttctggcaa

SEQ ID NO: 118626 - DNA, 22 bp, Artificial Sequence
  Synthetic oligonucleotide; TTG chr11 5367217 5367238 5367222 5367217 -
tgactcctttctggcaatgctt

SEQ ID NO: 118627 - DNA, 22 bp, Artificial Sequence
  Synthetic oligonucleotide; CTC chr11 5367211 5367232 5367216 5367211 -
ctttctggcaatgcttttaact

SEQ ID NO: 118628 - DNA, 22 bp, Artificial Sequence
  Synthetic oligonucleotide; CTT chr11 5367208 5367229 5367213 5367208 -
tctggcaatgcttttaacttca

SEQ ID NO: 118629 - DNA, 22 bp, Artificial Sequence
  Synthetic oligonucleotide; TTT chr11 5367207 5367228 5367212 5367207 -
ctggcaatgcttttaacttcaa

SEQ ID NO: 118630 - DNA, 22 bp, Artificial Sequence
  Synthetic oligonucleotide; TTC chr11 5367206 5367227 5367211 5367206 -
tggcaatgcttttaacttcaaa

SEQ ID NO: 118631 - DNA, 22 bp, Artificial Sequence
  Synthetic oligonucleotide; CTG chr11 5367204 5367225 5367209 5367204 -
gcaatgcttttaacttcaaaaa

SEQ ID NO: 118632 - DNA, 22 bp, Artificial Sequence
  Synthetic oligonucleotide; CTT chr11 5367195 5367216 5367200 5367195 -
ttaacttcaaaaatctcctttc

SEQ ID NO: 118633 - DNA, 22 bp, Artificial Sequence
  Synthetic oligonucleotide; TTT chr11 5367194 5367215 5367199 5367194 -
taacttcaaaaatctcctttca

SEQ ID NO: 118634 - DNA, 22 bp, Artificial Sequence
  Synthetic oligonucleotide; TTT chr11 5367193 5367214 5367198 5367193 -
aacttcaaaaatctcctttcaa

SEQ ID NO: 118635 - DNA, 22 bp, Artificial Sequence
  Synthetic oligonucleotide; TTA chr11 5367192 5367213 5367197 5367192 -
acttcaaaaatctcctttcaaa

SEQ ID NO: 118636 - DNA, 22 bp, Artificial Sequence
  Synthetic oligonucleotide; CTT chr11 5367188 5367209 5367193 5367188 -
caaaaatctcctttcaaaatga

SEQ ID NO: 118637 - DNA, 22 bp, Artificial Sequence
  Synthetic oligonucleotide; TTC chr11 5367187 5367208 5367192 5367187 -
aaaaatctcctttcaaaatgat

SEQ ID NO: 118638 - DNA, 22 bp, Artificial Sequence
  Synthetic oligonucleotide; CTC chr11 5367178 5367199 5367183 5367178 -
ctttcaaaatgattttattcca

SEQ ID NO: 118639 - DNA, 22 bp, Artificial Sequence
  Synthetic oligonucleotide; CTT chr11 5367175 5367196 5367180 5367175 -
tcaaaatgattttattccagtt

SEQ ID NO: 118640 - DNA, 22 bp, Artificial Sequence
  Synthetic oligonucleotide; TTT chr11 5367174 5367195 5367179 5367174 -
caaaatgattttattccagttc

SEQ ID NO: 118641 - DNA, 22 bp, Artificial Sequence
  Synthetic oligonucleotide; TTC chr11 5367173 5367194 5367178 5367173 -
aaaatgattttattccagttca

SEQ ID NO: 118642 - DNA, 22 bp, Artificial Sequence
  Synthetic oligonucleotide; TTT chr11 5367163 5367184 5367168 5367163 -
tattccagttcacaatgaaata

SEQ ID NO: 118643 - DNA, 22 bp, Artificial Sequence
  Synthetic oligonucleotide; TTT chr11 5367162 5367183 5367167 5367162 -
attccagttcacaatgaaataa

SEQ ID NO: 118644 - DNA, 22 bp, Artificial Sequence
  Synthetic oligonucleotide; TTA chr11 5367161 5367182 5367166 5367161 -
ttccagttcacaatgaaataac

SEQ ID NO: 118645 - DNA, 22 bp, Artificial Sequence
  Synthetic oligonucleotide; TTC chr11 5367158 5367179 5367163 5367158 -
cagttcacaatgaaataactaa

SEQ ID NO: 118646 - DNA, 22 bp, Artificial Sequence
  Synthetic oligonucleotide; TTC chr11 5367152 5367173 5367157 5367152 -
acaatgaaataactaaaactct

SEQ ID NO: 118647 - DNA, 22 bp, Artificial Sequence
  Synthetic oligonucleotide; CTA chr11 5367137 5367158 5367142 5367137 -
aaactctgtgtcactaagtggc

SEQ ID NO: 118648 - DNA, 22 bp, Artificial Sequence
  Synthetic oligonucleotide; CTC chr11 5367131 5367152 5367136 5367131 -
tgtgtcactaagtggctttgca

SEQ ID NO: 118649 - DNA, 22 bp, Artificial Sequence
  Synthetic oligonucleotide; CTG chr11 5367129 5367150 5367134 5367129 -
tgtcactaagtggctttgcaag

SEQ ID NO: 118650 - DNA, 22 bp, Artificial Sequence
  Synthetic oligonucleotide; CTA chr11 5367121 5367142 5367126 5367121 -
agtggctttgcaaggtggcatg

SEQ ID NO: 118651 - DNA, 22 bp, Artificial Sequence
  Synthetic oligonucleotide; CTT chr11 5367113 5367134 5367118 5367113 -
tgcaaggtggcatgtgtatgtg

SEQ ID NO: 118652 - DNA, 22 bp, Artificial Sequence
  Synthetic oligonucleotide; TTT chr11 5367112 5367133 5367117 5367112 -
gcaaggtggcatgtgtatgtgt

SEQ ID NO: 118653 - DNA, 22 bp, Artificial Sequence
  Synthetic oligonucleotide; TTG chr11 5367111 5367132 5367116 5367111 -
caaggtggcatgtgtatgtgtg

SEQ ID NO: 118654 - DNA, 22 bp, Artificial Sequence
  Synthetic oligonucleotide; CTT chr11 5367080 5367101 5367085 5367080 -
ctcttccttcagaaccacattc

SEQ ID NO: 118655 - DNA, 22 bp, Artificial Sequence
  Synthetic oligonucleotide; TTC chr11 5367079 5367100 5367084 5367079 -
tcttccttcagaaccacattcc

SEQ ID NO: 118656 - DNA, 22 bp, Artificial Sequence
  Synthetic oligonucleotide; CTC chr11 5367077 5367098 5367082 5367077 -
ttccttcagaaccacattcctg

SEQ ID NO: 118657 - DNA, 22 bp, Artificial Sequence
  Synthetic oligonucleotide; CTT chr11 5367075 5367096 5367080 5367075 -
ccttcagaaccacattcctgag

SEQ ID NO: 118658 - DNA, 22 bp, Artificial Sequence
  Synthetic oligonucleotide; TTC chr11 5367074 5367095 5367079 5367074 -
cttcagaaccacattcctgaga

SEQ ID NO: 118659 - DNA, 22 bp, Artificial Sequence
  Synthetic oligonucleotide; CTT chr11 5367071 5367092 5367076 5367071 -
cagaaccacattcctgagactt

SEQ ID NO: 118660 - DNA, 22 bp, Artificial Sequence
  Synthetic oligonucleotide; TTC chr11 5367070 5367091 5367075 5367070 -
agaaccacattcctgagacttg

SEQ ID NO: 118661 - DNA, 22 bp, Artificial Sequence
  Synthetic oligonucleotide; TTC chr11 5367058 5367079 5367063 5367058 -
ctgagacttgagagaatgtctt

SEQ ID NO: 118662 - DNA, 22 bp, Artificial Sequence
  Synthetic oligonucleotide; CTG chr11 5367055 5367076 5367060 5367055 -
agacttgagagaatgtctttgg

SEQ ID NO: 118663 - DNA, 22 bp, Artificial Sequence
  Synthetic oligonucleotide; CTT chr11 5367049 5367070 5367054 5367049 -
gagagaatgtctttggtctctg

SEQ ID NO: 118664 - DNA, 22 bp, Artificial Sequence
  Synthetic oligonucleotide; TTG chr11 5367048 5367069 5367053 5367048 -
agagaatgtctttggtctctgc

SEQ ID NO: 118665 - DNA, 22 bp, Artificial Sequence
  Synthetic oligonucleotide; CTT chr11 5367036 5367057 5367041 5367036 -
tggtctctgctgctagagaatt

SEQ ID NO: 118666 - DNA, 22 bp, Artificial Sequence
  Synthetic oligonucleotide; TTT chr11 5367035 5367056 5367040 5367035 -
ggtctctgctgctagagaattt

SEQ ID NO: 118667 - DNA, 22 bp, Artificial Sequence
  Synthetic oligonucleotide; TTG chr11 5367034 5367055 5367039 5367034 -
gtctctgctgctagagaatttt

SEQ ID NO: 118668 - DNA, 22 bp, Artificial Sequence
  Synthetic oligonucleotide; CTC chr11 5367029 5367050 5367034 5367029 -
tgctgctagagaattttatcct

SEQ ID NO: 118669 - DNA, 22 bp, Artificial Sequence
  Synthetic oligonucleotide; CTG chr11 5367027 5367048 5367032 5367027 -
ctgctagagaattttatcctgg

SEQ ID NO: 118670 - DNA, 22 bp, Artificial Sequence
  Synthetic oligonucleotide; CTG chr11 5367024 5367045 5367029 5367024 -
ctagagaattttatcctggttc

SEQ ID NO: 118671 - DNA, 22 bp, Artificial Sequence
  Synthetic oligonucleotide; CTA chr11 5367021 5367042 5367026 5367021 -
gagaattttatcctggttcatg

SEQ ID NO: 118672 - DNA, 22 bp, Artificial Sequence
  Synthetic oligonucleotide; TTT chr11 5367013 5367034 5367018 5367013 -
tatcctggttcatggactgcag

SEQ ID NO: 118673 - DNA, 22 bp, Artificial Sequence
  Synthetic oligonucleotide; TTT chr11 5367012 5367033 5367017 5367012 -
atcctggttcatggactgcagc

SEQ ID NO: 118674 - DNA, 22 bp, Artificial Sequence
  Synthetic oligonucleotide; TTA chr11 5367011 5367032 5367016 5367011 -
tcctggttcatggactgcagcg

SEQ ID NO: 118675 - DNA, 22 bp, Artificial Sequence
  Synthetic oligonucleotide; CTG chr11 5367006 5367027 5367011 5367006 -
gttcatggactgcagcgggagg

SEQ ID NO: 118676 - DNA, 22 bp, Artificial Sequence
  Synthetic oligonucleotide; TTC chr11 5367002 5367023 5367007 5367002 -
atggactgcagcgggaggtgga

SEQ ID NO: 118677 - DNA, 22 bp, Artificial Sequence
  Synthetic oligonucleotide; CTG chr11 5366994 5367015 5366999 5366994 -
cagcgggaggtggaagcatttt

SEQ ID NO: 118678 - DNA, 22 bp, Artificial Sequence
  Synthetic oligonucleotide; TTT chr11 5366973 5366994 5366978 5366973 -
tcaaactttgggaggggaatgt

SEQ ID NO: 118679 - DNA, 22 bp, Artificial Sequence
  Synthetic oligonucleotide; TTT chr11 5366972 5366993 5366977 5366972 -
caaactttgggaggggaatgtt

SEQ ID NO: 118680 - DNA, 22 bp, Artificial Sequence
  Synthetic oligonucleotide; TTC chr11 5366971 5366992 5366976 5366971 -
aaactttgggaggggaatgtta

SEQ ID NO: 118681 - DNA, 22 bp, Artificial Sequence
  Synthetic oligonucleotide; CTT chr11 5366965 5366986 5366970 5366965 -
tgggaggggaatgttaggagac

SEQ ID NO: 118682 - DNA, 22 bp, Artificial Sequence
  Synthetic oligonucleotide; TTT chr11 5366964 5366985 5366969 5366964 -
gggaggggaatgttaggagacc

SEQ ID NO: 118683 - DNA, 22 bp, Artificial Sequence
  Synthetic oligonucleotide; TTG chr11 5366963 5366984 5366968 5366963 -
ggaggggaatgttaggagacca

SEQ ID NO: 118684 - DNA, 22 bp, Artificial Sequence
  Synthetic oligonucleotide; TTA chr11 5366949 5366970 5366954 5366949 -
ggagaccattaggcatgtgctc

SEQ ID NO: 118685 - DNA, 22 bp, Artificial Sequence
  Synthetic oligonucleotide; TTA chr11 5366938 5366959 5366943 5366938 -
ggcatgtgctcaagagatgaca

SEQ ID NO: 118686 - DNA, 22 bp, Artificial Sequence
  Synthetic oligonucleotide; CTC chr11 5366927 5366948 5366932 5366927 -
aagagatgacaccaagtccagg

SEQ ID NO: 118687 - DNA, 22 bp, Artificial Sequence
  Synthetic oligonucleotide; CTA chr11 5366896 5366917 5366901 5366896 -
aaactttgtgcctgttgtctca

SEQ ID NO: 118688 - DNA, 22 bp, Artificial Sequence
  Synthetic oligonucleotide; CTT chr11 5366890 5366911 5366895 5366890 -
tgtgcctgttgtctcatgaatc

SEQ ID NO: 118689 - DNA, 22 bp, Artificial Sequence
  Synthetic oligonucleotide; TTT chr11 5366889 5366910 5366894 5366889 -
gtgcctgttgtctcatgaatca

SEQ ID NO: 118690 - DNA, 22 bp, Artificial Sequence
  Synthetic oligonucleotide; TTG chr11 5366888 5366909 5366893 5366888 -
tgcctgttgtctcatgaatcag

SEQ ID NO: 118691 - DNA, 22 bp, Artificial Sequence
  Synthetic oligonucleotide; CTG chr11 5366882 5366903 5366887 5366882 -
ttgtctcatgaatcagatagca

SEQ ID NO: 118692 - DNA, 22 bp, Artificial Sequence
  Synthetic oligonucleotide; TTG chr11 5366879 5366900 5366884 5366879 -
tctcatgaatcagatagcaccc

SEQ ID NO: 118693 - DNA, 22 bp, Artificial Sequence
  Synthetic oligonucleotide; CTC chr11 5366875 5366896 5366880 5366875 -
atgaatcagatagcacccctgc

SEQ ID NO: 118694 - DNA, 22 bp, Artificial Sequence
  Synthetic oligonucleotide; CTG chr11 5366854 5366875 5366859 5366854 -
cctaaaccttcccagtcctgca

SEQ ID NO: 118695 - DNA, 22 bp, Artificial Sequence
  Synthetic oligonucleotide; CTA chr11 5366850 5366871 5366855 5366850 -
aaccttcccagtcctgcattgc

SEQ ID NO: 118696 - DNA, 22 bp, Artificial Sequence
  Synthetic oligonucleotide; CTT chr11 5366844 5366865 5366849 5366844 -
cccagtcctgcattgcacagag

SEQ ID NO: 118697 - DNA, 22 bp, Artificial Sequence
  Synthetic oligonucleotide; TTC chr11 5366843 5366864 5366848 5366843 -
ccagtcctgcattgcacagaga

SEQ ID NO: 118698 - DNA, 22 bp, Artificial Sequence
  Synthetic oligonucleotide; CTG chr11 5366834 5366855 5366839 5366834 -
cattgcacagagacccgtgctt

SEQ ID NO: 118699 - DNA, 22 bp, Artificial Sequence
  Synthetic oligonucleotide; TTG chr11 5366829 5366850 5366834 5366829 -
cacagagacccgtgcttgggat

SEQ ID NO: 118700 - DNA, 22 bp, Artificial Sequence
  Synthetic oligonucleotide; CTT chr11 5366812 5366833 5366817 5366812 -
gggattggaattagtcatcaat

SEQ ID NO: 118701 - DNA, 22 bp, Artificial Sequence
  Synthetic oligonucleotide; TTG chr11 5366811 5366832 5366816 5366811 -
ggattggaattagtcatcaata

SEQ ID NO: 118702 - DNA, 22 bp, Artificial Sequence
  Synthetic oligonucleotide; TTG chr11 5366805 5366826 5366810 5366805 -
gaattagtcatcaatacaaact

SEQ ID NO: 118703 - DNA, 22 bp, Artificial Sequence
  Synthetic oligonucleotide; TTA chr11 5366799 5366820 5366804 5366799 -
gtcatcaatacaaacttatttt

SEQ ID NO: 118704 - DNA, 22 bp, Artificial Sequence
  Synthetic oligonucleotide; CTT chr11 5366782 5366803 5366787 5366782 -
attttcccaaattttaattttt

SEQ ID NO: 118705 - DNA, 22 bp, Artificial Sequence
  Synthetic oligonucleotide; TTA chr11 5366781 5366802 5366786 5366781 -
ttttcccaaattttaattttta

SEQ ID NO: 118706 - DNA, 22 bp, Artificial Sequence
  Synthetic oligonucleotide; TTT chr11 5366778 5366799 5366783 5366778 -
tcccaaattttaatttttattc

SEQ ID NO: 118707 - DNA, 22 bp, Artificial Sequence
  Synthetic oligonucleotide; TTT chr11 5366777 5366798 5366782 5366777 -
cccaaattttaatttttattct

SEQ ID NO: 118708 - DNA, 22 bp, Artificial Sequence
  Synthetic oligonucleotide; TTC chr11 5366776 5366797 5366781 5366776 -
ccaaattttaatttttattcta

SEQ ID NO: 118709 - DNA, 22 bp, Artificial Sequence
  Synthetic oligonucleotide; TTT chr11 5366768 5366789 5366773 5366768 -
taatttttattctaaagacttt

SEQ ID NO: 118710 - DNA, 22 bp, Artificial Sequence
  Synthetic oligonucleotide; TTT chr11 5366767 5366788 5366772 5366767 -
aatttttattctaaagactttg

SEQ ID NO: 118711 - DNA, 22 bp, Artificial Sequence
  Synthetic oligonucleotide; TTA chr11 5366766 5366787 5366771 5366766 -
atttttattctaaagactttga

SEQ ID NO: 118712 - DNA, 22 bp, Artificial Sequence
  Synthetic oligonucleotide; TTT chr11 5366762 5366783 5366767 5366762 -
ttattctaaagactttgaatct

SEQ ID NO: 118713 - DNA, 22 bp, Artificial Sequence
  Synthetic oligonucleotide; TTT chr11 5366761 5366782 5366766 5366761 -
tattctaaagactttgaatctc

SEQ ID NO: 118714 - DNA, 22 bp, Artificial Sequence
  Synthetic oligonucleotide; TTT chr11 5366760 5366781 5366765 5366760 -
attctaaagactttgaatctca

SEQ ID NO: 118715 - DNA, 22 bp, Artificial Sequence
  Synthetic oligonucleotide; TTA chr11 5366759 5366780 5366764 5366759 -
ttctaaagactttgaatctcaa

SEQ ID NO: 118716 - DNA, 22 bp, Artificial Sequence
  Synthetic oligonucleotide; TTC chr11 5366756 5366777 5366761 5366756 -
taaagactttgaatctcaagtg

SEQ ID NO: 118717 - DNA, 22 bp, Artificial Sequence
  Synthetic oligonucleotide; CTA chr11 5366754 5366775 5366759 5366754 -
aagactttgaatctcaagtgaa

SEQ ID NO: 118718 - DNA, 22 bp, Artificial Sequence
  Synthetic oligonucleotide; CTT chr11 5366747 5366768 5366752 5366747 -
tgaatctcaagtgaataccctg

SEQ ID NO: 118719 - DNA, 22 bp, Artificial Sequence
  Synthetic oligonucleotide; TTT chr11 5366746 5366767 5366751 5366746 -
gaatctcaagtgaataccctga

SEQ ID NO: 118720 - DNA, 22 bp, Artificial Sequence
  Synthetic oligonucleotide; TTG chr11 5366745 5366766 5366750 5366745 -
aatctcaagtgaataccctgat

SEQ ID NO: 118721 - DNA, 22 bp, Artificial Sequence
  Synthetic oligonucleotide; CTC chr11 5366739 5366760 5366744 5366739 -
aagtgaataccctgatttcctt

SEQ ID NO: 118722 - DNA, 22 bp, Artificial Sequence
  Synthetic oligonucleotide; CTG chr11 5366725 5366746 5366730 5366725 -
atttccttccttccttctttcc

SEQ ID NO: 118723 - DNA, 22 bp, Artificial Sequence
  Synthetic oligonucleotide; TTT chr11 5366721 5366742 5366726 5366721 -
ccttccttccttctttcctttc

SEQ ID NO: 118724 - DNA, 22 bp, Artificial Sequence
  Synthetic oligonucleotide; TTC chr11 5366720 5366741 5366725 5366720 -
cttccttccttctttcctttcc

SEQ ID NO: 118725 - DNA, 22 bp, Artificial Sequence
  Synthetic oligonucleotide; CTT chr11 5366717 5366738 5366722 5366717 -
ccttccttctttcctttccttt

SEQ ID NO: 118726 - DNA, 22 bp, Artificial Sequence
  Synthetic oligonucleotide; TTC chr11 5366716 5366737 5366721 5366716 -
cttccttctttcctttcctttc

SEQ ID NO: 118727 - DNA, 22 bp, Artificial Sequence
  Synthetic oligonucleotide; CTT chr11 5366713 5366734 5366718 5366713 -
ccttctttcctttcctttcctc

SEQ ID NO: 118728 - DNA, 22 bp, Artificial Sequence
  Synthetic oligonucleotide; TTC chr11 5366712 5366733 5366717 5366712 -
cttctttcctttcctttcctcc

SEQ ID NO: 118729 - DNA, 22 bp, Artificial Sequence
  Synthetic oligonucleotide; CTT chr11 5366709 5366730 5366714 5366709 -
ctttcctttcctttcctcctcc

SEQ ID NO: 118730 - DNA, 22 bp, Artificial Sequence
  Synthetic oligonucleotide; TTC chr11 5366708 5366729 5366713 5366708 -
tttcctttcctttcctcctcct

SEQ ID NO: 118731 - DNA, 22 bp, Artificial Sequence
  Synthetic oligonucleotide; CTT chr11 5366706 5366727 5366711 5366706 -
tcctttcctttcctcctcctct

SEQ ID NO: 118732 - DNA, 22 bp, Artificial Sequence
  Synthetic oligonucleotide; TTT chr11 5366705 5366726 5366710 5366705 -
cctttcctttcctcctcctcta

SEQ ID NO: 118733 - DNA, 22 bp, Artificial Sequence
  Synthetic oligonucleotide; TTC chr11 5366704 5366725 5366709 5366704 -
ctttcctttcctcctcctctac

SEQ ID NO: 118734 - DNA, 22 bp, Artificial Sequence
  Synthetic oligonucleotide; CTT chr11 5366701 5366722 5366706 5366701 -
tcctttcctcctcctctacttt

SEQ ID NO: 118735 - DNA, 22 bp, Artificial Sequence
  Synthetic oligonucleotide; TTT chr11 5366700 5366721 5366705 5366700 -
cctttcctcctcctctactttt

SEQ ID NO: 118736 - DNA, 22 bp, Artificial Sequence
  Synthetic oligonucleotide; TTC chr11 5366699 5366720 5366704 5366699 -
ctttcctcctcctctacttttt

SEQ ID NO: 118737 - DNA, 22 bp, Artificial Sequence
  Synthetic oligonucleotide; CTT chr11 5366696 5366717 5366701 5366696 -
tcctcctcctctactttttctt

SEQ ID NO: 118738 - DNA, 22 bp, Artificial Sequence
  Synthetic oligonucleotide; TTT chr11 5366695 5366716 5366700 5366695 -
cctcctcctctactttttcttc

SEQ ID NO: 118739 - DNA, 22 bp, Artificial Sequence
  Synthetic oligonucleotide; TTC chr11 5366694 5366715 5366699 5366694 -
ctcctcctctactttttcttct

SEQ ID NO: 118740 - DNA, 22 bp, Artificial Sequence
  Synthetic oligonucleotide; CTC chr11 5366691 5366712 5366696 5366691 -
ctcctctactttttcttctcct

SEQ ID NO: 118741 - DNA, 22 bp, Artificial Sequence
  Synthetic oligonucleotide; CTC chr11 5366688 5366709 5366693 5366688 -
ctctactttttcttctccttct

SEQ ID NO: 118742 - DNA, 22 bp, Artificial Sequence
  Synthetic oligonucleotide; CTC chr11 5366685 5366706 5366690 5366685 -
tactttttcttctccttctcct

SEQ ID NO: 118743 - DNA, 22 bp, Artificial Sequence
  Synthetic oligonucleotide; CTA chr11 5366683 5366704 5366688 5366683 -
ctttttcttctccttctccttc

SEQ ID NO: 118744 - DNA, 22 bp, Artificial Sequence
  Synthetic oligonucleotide; CTT chr11 5366680 5366701 5366685 5366680 -
tttcttctccttctccttcttc

SEQ ID NO: 118745 - DNA, 22 bp, Artificial Sequence
  Synthetic oligonucleotide; TTT chr11 5366679 5366700 5366684 5366679 -
ttcttctccttctccttcttct

SEQ ID NO: 118746 - DNA, 22 bp, Artificial Sequence
  Synthetic oligonucleotide; TTT chr11 5366678 5366699 5366683 5366678 -
tcttctccttctccttcttctt

SEQ ID NO: 118747 - DNA, 22 bp, Artificial Sequence
  Synthetic oligonucleotide; TTT chr11 5366677 5366698 5366682 5366677 -
cttctccttctccttcttcttc

SEQ ID NO: 118748 - DNA, 22 bp, Artificial Sequence
  Synthetic oligonucleotide; TTC chr11 5366676 5366697 5366681 5366676 -
ttctccttctccttcttcttct

SEQ ID NO: 118749 - DNA, 22 bp, Artificial Sequence
  Synthetic oligonucleotide; CTT chr11 5366674 5366695 5366679 5366674 -
ctccttctccttcttcttcttc

SEQ ID NO: 118750 - DNA, 22 bp, Artificial Sequence
  Synthetic oligonucleotide; TTC chr11 5366673 5366694 5366678 5366673 -
tccttctccttcttcttcttct

SEQ ID NO: 118751 - DNA, 22 bp, Artificial Sequence
  Synthetic oligonucleotide; CTC chr11 5366671 5366692 5366676 5366671 -
cttctccttcttcttcttcttc

SEQ ID NO: 118752 - DNA, 22 bp, Artificial Sequence
  Synthetic oligonucleotide; CTT chr11 5366668 5366689 5366673 5366668 -
ctccttcttcttcttcttctct

SEQ ID NO: 118753 - DNA, 22 bp, Artificial Sequence
  Synthetic oligonucleotide; TTC chr11 5366667 5366688 5366672 5366667 -
tccttcttcttcttcttctctt

SEQ ID NO: 118754 - DNA, 22 bp, Artificial Sequence
  Synthetic oligonucleotide; CTC chr11 5366665 5366686 5366670 5366665 -
cttcttcttcttcttctcttcc

SEQ ID NO: 118755 - DNA, 22 bp, Artificial Sequence
  Synthetic oligonucleotide; CTT chr11 5366662 5366683 5366667 5366662 -
cttcttcttcttctcttccttc

SEQ ID NO: 118756 - DNA, 22 bp, Artificial Sequence
  Synthetic oligonucleotide; TTC chr11 5366661 5366682 5366666 5366661 -
ttcttcttcttctcttccttcc

SEQ ID NO: 118757 - DNA, 22 bp, Artificial Sequence
  Synthetic oligonucleotide; CTT chr11 5366659 5366680 5366664 5366659 -
cttcttcttctcttccttcctt

SEQ ID NO: 118758 - DNA, 22 bp, Artificial Sequence
  Synthetic oligonucleotide; TTC chr11 5366658 5366679 5366663 5366658 -
ttcttcttctcttccttccttt

SEQ ID NO: 118759 - DNA, 22 bp, Artificial Sequence
  Synthetic oligonucleotide; CTT chr11 5366656 5366677 5366661 5366656 -
cttcttctcttccttcctttcc

SEQ ID NO: 118760 - DNA, 22 bp, Artificial Sequence
  Synthetic oligonucleotide; TTC chr11 5366655 5366676 5366660 5366655 -
ttcttctcttccttcctttcct

SEQ ID NO: 118761 - DNA, 22 bp, Artificial Sequence
  Synthetic oligonucleotide; CTT chr11 5366653 5366674 5366658 5366653 -
cttctcttccttcctttccttc

SEQ ID NO: 118762 - DNA, 22 bp, Artificial Sequence
  Synthetic oligonucleotide; TTC chr11 5366652 5366673 5366657 5366652 -
ttctcttccttcctttccttcc

SEQ ID NO: 118763 - DNA, 22 bp, Artificial Sequence
  Synthetic oligonucleotide; CTT chr11 5366650 5366671 5366655 5366650 -
ctcttccttcctttccttccct

SEQ ID NO: 118764 - DNA, 22 bp, Artificial Sequence
  Synthetic oligonucleotide; TTC chr11 5366649 5366670 5366654 5366649 -
tcttccttcctttccttccctt

SEQ ID NO: 118765 - DNA, 22 bp, Artificial Sequence
  Synthetic oligonucleotide; CTC chr11 5366647 5366668 5366652 5366647 -
ttccttcctttccttcccttcc

SEQ ID NO: 118766 - DNA, 22 bp, Artificial Sequence
  Synthetic oligonucleotide; CTT chr11 5366645 5366666 5366650 5366645 -
ccttcctttccttcccttcctt

SEQ ID NO: 118767 - DNA, 22 bp, Artificial Sequence
  Synthetic oligonucleotide; TTC chr11 5366644 5366665 5366649 5366644 -
cttcctttccttcccttccttc

SEQ ID NO: 118768 - DNA, 22 bp, Artificial Sequence
  Synthetic oligonucleotide; CTT chr11 5366641 5366662 5366646 5366641 -
cctttccttcccttccttcctc

SEQ ID NO: 118769 - DNA, 22 bp, Artificial Sequence
  Synthetic oligonucleotide; TTC chr11 5366640 5366661 5366645 5366640 -
ctttccttcccttccttcctcc

SEQ ID NO: 118770 - DNA, 22 bp, Artificial Sequence
  Synthetic oligonucleotide; CTT chr11 5366637 5366658 5366642 5366637 -
tccttcccttccttcctccctc

SEQ ID NO: 118771 - DNA, 22 bp, Artificial Sequence
  Synthetic oligonucleotide; TTT chr11 5366636 5366657 5366641 5366636 -
ccttcccttccttcctccctcc

SEQ ID NO: 118772 - DNA, 22 bp, Artificial Sequence
  Synthetic oligonucleotide; TTC chr11 5366635 5366656 5366640 5366635 -
cttcccttccttcctccctccc

SEQ ID NO: 118773 - DNA, 22 bp, Artificial Sequence
  Synthetic oligonucleotide; CTT chr11 5366632 5366653 5366637 5366632 -
cccttccttcctccctccctac

SEQ ID NO: 118774 - DNA, 22 bp, Artificial Sequence
  Synthetic oligonucleotide; TTC chr11 5366631 5366652 5366636 5366631 -
ccttccttcctccctccctacc

SEQ ID NO: 118775 - DNA, 22 bp, Artificial Sequence
  Synthetic oligonucleotide; CTT chr11 5366627 5366648 5366632 5366627 -
ccttcctccctccctacctctc

SEQ ID NO: 118776 - DNA, 22 bp, Artificial Sequence
  Synthetic oligonucleotide; TTC chr11 5366626 5366647 5366631 5366626 -
cttcctccctccctacctctct

SEQ ID NO: 118777 - DNA, 22 bp, Artificial Sequence
  Synthetic oligonucleotide; CTT chr11 5366623 5366644 5366628 5366623 -
cctccctccctacctctctctc

SEQ ID NO: 118778 - DNA, 22 bp, Artificial Sequence
  Synthetic oligonucleotide; TTC chr11 5366622 5366643 5366627 5366622 -
ctccctccctacctctctctct

SEQ ID NO: 118779 - DNA, 22 bp, Artificial Sequence
  Synthetic oligonucleotide; CTC chr11 5366619 5366640 5366624 5366619 -
cctccctacctctctctctttc

SEQ ID NO: 118780 - DNA, 22 bp, Artificial Sequence
  Synthetic oligonucleotide; CTC chr11 5366615 5366636 5366620 5366615 -
cctacctctctctctttctcta

SEQ ID NO: 118781 - DNA, 22 bp, Artificial Sequence
  Synthetic oligonucleotide; CTA chr11 5366611 5366632 5366616 5366611 -
cctctctctctttctctatttc

SEQ ID NO: 118782 - DNA, 22 bp, Artificial Sequence
  Synthetic oligonucleotide; CTC chr11 5366607 5366628 5366612 5366607 -
tctctctttctctatttctttc

SEQ ID NO: 118783 - DNA, 22 bp, Artificial Sequence
  Synthetic oligonucleotide; CTC chr11 5366605 5366626 5366610 5366605 -
tctctttctctatttctttctc

SEQ ID NO: 118784 - DNA, 22 bp, Artificial Sequence
  Synthetic oligonucleotide; CTC chr11 5366603 5366624 5366608 5366603 -
tctttctctatttctttctcat

SEQ ID NO: 118785 - DNA, 22 bp, Artificial Sequence
  Synthetic oligonucleotide; CTC chr11 5366601 5366622 5366606 5366601 -
tttctctatttctttctcatct

SEQ ID NO: 118786 - DNA, 22 bp, Artificial Sequence
  Synthetic oligonucleotide; CTT chr11 5366599 5366620 5366604 5366599 -
tctctatttctttctcatcttg

SEQ ID NO: 118787 - DNA, 22 bp, Artificial Sequence
  Synthetic oligonucleotide; TTT chr11 5366598 5366619 5366603 5366598 -
ctctatttctttctcatcttgc

SEQ ID NO: 118788 - DNA, 22 bp, Artificial Sequence
  Synthetic oligonucleotide; TTC chr11 5366597 5366618 5366602 5366597 -
tctatttctttctcatcttgct

SEQ ID NO: 118789 - DNA, 22 bp, Artificial Sequence
  Synthetic oligonucleotide; CTC chr11 5366595 5366616 5366600 5366595 -
tatttctttctcatcttgcttt

SEQ ID NO: 118790 - DNA, 22 bp, Artificial Sequence
  Synthetic oligonucleotide; CTA chr11 5366593 5366614 5366598 5366593 -
tttctttctcatcttgcttttg

SEQ ID NO: 118791 - DNA, 22 bp, Artificial Sequence
  Synthetic oligonucleotide; TTT chr11 5366590 5366611 5366595 5366590 -
ctttctcatcttgcttttgcct

SEQ ID NO: 118792 - DNA, 22 bp, Artificial Sequence
  Synthetic oligonucleotide; TTC chr11 5366589 5366610 5366594 5366589 -
tttctcatcttgcttttgcctt

SEQ ID NO: 118793 - DNA, 22 bp, Artificial Sequence
  Synthetic oligonucleotide; CTT chr11 5366587 5366608 5366592 5366587 -
tctcatcttgcttttgccttcc

SEQ ID NO: 118794 - DNA, 22 bp, Artificial Sequence
  Synthetic oligonucleotide; TTT chr11 5366586 5366607 5366591 5366586 -
ctcatcttgcttttgccttcca

SEQ ID NO: 118795 - DNA, 22 bp, Artificial Sequence
  Synthetic oligonucleotide; TTC chr11 5366585 5366606 5366590 5366585 -
tcatcttgcttttgccttccag

SEQ ID NO: 118796 - DNA, 22 bp, Artificial Sequence
  Synthetic oligonucleotide; CTC chr11 5366583 5366604 5366588 5366583 -
atcttgcttttgccttccaggc

SEQ ID NO: 118797 - DNA, 22 bp, Artificial Sequence
  Synthetic oligonucleotide; CTT chr11 5366578 5366599 5366583 5366578 -
gcttttgccttccaggctgctg

SEQ ID NO: 118798 - DNA, 22 bp, Artificial Sequence
  Synthetic oligonucleotide; TTG chr11 5366577 5366598 5366582 5366577 -
cttttgccttccaggctgctgg

SEQ ID NO: 118799 - DNA, 22 bp, Artificial Sequence
  Synthetic oligonucleotide; CTT chr11 5366574 5366595 5366579 5366574 -
ttgccttccaggctgctggagt

SEQ ID NO: 118800 - DNA, 22 bp, Artificial Sequence
  Synthetic oligonucleotide; TTT chr11 5366573 5366594 5366578 5366573 -
tgccttccaggctgctggagtg

SEQ ID NO: 118801 - DNA, 22 bp, Artificial Sequence
  Synthetic oligonucleotide; TTT chr11 5366572 5366593 5366577 5366572 -
gccttccaggctgctggagtgc

SEQ ID NO: 118802 - DNA, 22 bp, Artificial Sequence
  Synthetic oligonucleotide; TTG chr11 5366571 5366592 5366576 5366571 -
ccttccaggctgctggagtgca

SEQ ID NO: 118803 - DNA, 22 bp, Artificial Sequence
  Synthetic oligonucleotide; CTT chr11 5366567 5366588 5366572 5366567 -
ccaggctgctggagtgcaatgg

SEQ ID NO: 118804 - DNA, 22 bp, Artificial Sequence
  Synthetic oligonucleotide; TTC chr11 5366566 5366587 5366571 5366566 -
caggctgctggagtgcaatggc

SEQ ID NO: 118805 - DNA, 22 bp, Artificial Sequence
  Synthetic oligonucleotide; CTG chr11 5366559 5366580 5366564 5366559 -
ctggagtgcaatggcgcgatct

SEQ ID NO: 118806 - DNA, 22 bp, Artificial Sequence
  Synthetic oligonucleotide; CTG chr11 5366556 5366577 5366561 5366556 -
gagtgcaatggcgcgatctcgg

SEQ ID NO: 118807 - DNA, 22 bp, Artificial Sequence
  Synthetic oligonucleotide; CTC chr11 5366536 5366557 5366541 5366536 -
ggctcactgcaacctccgcctc

SEQ ID NO: 118808 - DNA, 22 bp, Artificial Sequence
  Synthetic oligonucleotide; CTC chr11 5366531 5366552 5366536 5366531 -
actgcaacctccgcctcccagg

SEQ ID NO: 118809 - DNA, 22 bp, Artificial Sequence
  Synthetic oligonucleotide; CTG chr11 5366527 5366548 5366532 5366527 -
caacctccgcctcccaggttca

SEQ ID NO: 118810 - DNA, 22 bp, Artificial Sequence
  Synthetic oligonucleotide; CTC chr11 5366520 5366541 5366525 5366520 -
cgcctcccaggttcaagcgatt

SEQ ID NO: 118811 - DNA, 22 bp, Artificial Sequence
  Synthetic oligonucleotide; CTC chr11 5366514 5366535 5366519 5366514 -
ccaggttcaagcgattctccta

SEQ ID NO: 118812 - DNA, 22 bp, Artificial Sequence
  Synthetic oligonucleotide; TTC chr11 5366506 5366527 5366511 5366506 -
aagcgattctcctacctcagcc

SEQ ID NO: 118813 - DNA, 22 bp, Artificial Sequence
  Synthetic oligonucleotide; TTC chr11 5366497 5366518 5366502 5366497 -
tcctacctcagcctcctgtgta

SEQ ID NO: 118814 - DNA, 22 bp, Artificial Sequence
  Synthetic oligonucleotide; CTC chr11 5366495 5366516 5366500 5366495 -
ctacctcagcctcctgtgtagc

SEQ ID NO: 118815 - DNA, 22 bp, Artificial Sequence
  Synthetic oligonucleotide; CTA chr11 5366492 5366513 5366497 5366492 -
cctcagcctcctgtgtagctgc

SEQ ID NO: 118816 - DNA, 22 bp, Artificial Sequence
  Synthetic oligonucleotide; CTC chr11 5366488 5366509 5366493 5366488 -
agcctcctgtgtagctgcaatt

SEQ ID NO: 118817 - DNA, 22 bp, Artificial Sequence
  Synthetic oligonucleotide; CTC chr11 5366482 5366503 5366487 5366482 -
ctgtgtagctgcaattacaggc

SEQ ID NO: 118818 - DNA, 22 bp, Artificial Sequence
  Synthetic oligonucleotide; CTG chr11 5366479 5366500 5366484 5366479 -
tgtagctgcaattacaggcatc

SEQ ID NO: 118819 - DNA, 22 bp, Artificial Sequence
  Synthetic oligonucleotide; CTG chr11 5366471 5366492 5366476 5366471 -
caattacaggcatctgccacca

SEQ ID NO: 118820 - DNA, 22 bp, Artificial Sequence
  Synthetic oligonucleotide; TTA chr11 5366465 5366486 5366470 5366465 -
caggcatctgccaccaggccct

SEQ ID NO: 118821 - DNA, 22 bp, Artificial Sequence
  Synthetic oligonucleotide; CTG chr11 5366455 5366476 5366460 5366455 -
ccaccaggccctgctaattttt

SEQ ID NO: 118822 - DNA, 22 bp, Artificial Sequence
  Synthetic oligonucleotide; CTG chr11 5366442 5366463 5366447 5366442 -
ctaatttttttgtatttttatt

SEQ ID NO: 118823 - DNA, 22 bp, Artificial Sequence
  Synthetic oligonucleotide; CTA chr11 5366439 5366460 5366444 5366439 -
atttttttgtatttttattaga

SEQ ID NO: 118824 - DNA, 22 bp, Artificial Sequence
  Synthetic oligonucleotide; TTT chr11 5366435 5366456 5366440 5366435 -
ttttgtatttttattagagaca

SEQ ID NO: 118825 - DNA, 22 bp, Artificial Sequence
  Synthetic oligonucleotide; TTT chr11 5366434 5366455 5366439 5366434 -
tttgtatttttattagagacag

SEQ ID NO: 118826 - DNA, 22 bp, Artificial Sequence
  Synthetic oligonucleotide; TTT chr11 5366433 5366454 5366438 5366433 -
ttgtatttttattagagacagg

SEQ ID NO: 118827 - DNA, 22 bp, Artificial Sequence
  Synthetic oligonucleotide; TTT chr11 5366432 5366453 5366437 5366432 -
tgtatttttattagagacaggg

SEQ ID NO: 118828 - DNA, 22 bp, Artificial Sequence
  Synthetic oligonucleotide; TTT chr11 5366431 5366452 5366436 5366431 -
gtatttttattagagacagggt

SEQ ID NO: 118829 - DNA, 22 bp, Artificial Sequence
  Synthetic oligonucleotide; TTG chr11 5366430 5366451 5366435 5366430 -
tatttttattagagacagggtt

SEQ ID NO: 118830 - DNA, 22 bp, Artificial Sequence
  Synthetic oligonucleotide; TTT chr11 5366425 5366446 5366430 5366425 -
ttattagagacagggtttcacc

SEQ ID NO: 118831 - DNA, 22 bp, Artificial Sequence
  Synthetic oligonucleotide; TTT chr11 5366424 5366445 5366429 5366424 -
tattagagacagggtttcacca

SEQ ID NO: 118832 - DNA, 22 bp, Artificial Sequence
  Synthetic oligonucleotide; TTT chr11 5366423 5366444 5366428 5366423 -
attagagacagggtttcaccat

SEQ ID NO: 118833 - DNA, 22 bp, Artificial Sequence
  Synthetic oligonucleotide; TTA chr11 5366422 5366443 5366427 5366422 -
ttagagacagggtttcaccatg

SEQ ID NO: 118834 - DNA, 22 bp, Artificial Sequence
  Synthetic oligonucleotide; TTA chr11 5366419 5366440 5366424 5366419 -
gagacagggtttcaccatgttg

SEQ ID NO: 118835 - DNA, 22 bp, Artificial Sequence
  Synthetic oligonucleotide; TTT chr11 5366407 5366428 5366412 5366407 -
caccatgttggtcaggctggtc

SEQ ID NO: 118836 - DNA, 22 bp, Artificial Sequence
  Synthetic oligonucleotide; TTC chr11 5366406 5366427 5366411 5366406 -
accatgttggtcaggctggtct

SEQ ID NO: 118837 - DNA, 22 bp, Artificial Sequence
  Synthetic oligonucleotide; TTG chr11 5366397 5366418 5366402 5366397 -
gtcaggctggtctcgaactctt

SEQ ID NO: 118838 - DNA, 22 bp, Artificial Sequence
  Synthetic oligonucleotide; CTG chr11 5366388 5366409 5366393 5366388 -
gtctcgaactcttgccctcagg

SEQ ID NO: 118839 - DNA, 22 bp, Artificial Sequence
  Synthetic oligonucleotide; CTC chr11 5366383 5366404 5366388 5366383 -
gaactcttgccctcaggtgatc

SEQ ID NO: 118840 - DNA, 22 bp, Artificial Sequence
  Synthetic oligonucleotide; CTC chr11 5366377 5366398 5366382 5366377 -
ttgccctcaggtgatcctcctg

SEQ ID NO: 118841 - DNA, 22 bp, Artificial Sequence
  Synthetic oligonucleotide; CTT chr11 5366375 5366396 5366380 5366375 -
gccctcaggtgatcctcctgcc

SEQ ID NO: 118842 - DNA, 22 bp, Artificial Sequence
  Synthetic oligonucleotide; TTG chr11 5366374 5366395 5366379 5366374 -
ccctcaggtgatcctcctgcct

SEQ ID NO: 118843 - DNA, 22 bp, Artificial Sequence
  Synthetic oligonucleotide; CTC chr11 5366369 5366390 5366374 5366369 -
aggtgatcctcctgcctcagcc

SEQ ID NO: 118844 - DNA, 22 bp, Artificial Sequence
  Synthetic oligonucleotide; CTC chr11 5366358 5366379 5366363 5366358 -
ctgcctcagccacccaaagtgc

SEQ ID NO: 118845 - DNA, 22 bp, Artificial Sequence
  Synthetic oligonucleotide; CTG chr11 5366355 5366376 5366360 5366355 -
cctcagccacccaaagtgctgg

SEQ ID NO: 118846 - DNA, 22 bp, Artificial Sequence
  Synthetic oligonucleotide; CTC chr11 5366351 5366372 5366356 5366351 -
agccacccaaagtgctgggatt

SEQ ID NO: 118847 - DNA, 22 bp, Artificial Sequence
  Synthetic oligonucleotide; CTG chr11 5366334 5366355 5366339 5366334 -
ggattacaggcatgagtctgta

SEQ ID NO: 118848 - DNA, 22 bp, Artificial Sequence
  Synthetic oligonucleotide; TTA chr11 5366328 5366349 5366333 5366328 -
caggcatgagtctgtaatgtag

SEQ ID NO: 118849 - DNA, 22 bp, Artificial Sequence
  Synthetic oligonucleotide; CTG chr11 5366314 5366335 5366319 5366314 -
taatgtagccttttctttaaca

SEQ ID NO: 118850 - DNA, 22 bp, Artificial Sequence
  Synthetic oligonucleotide; CTT chr11 5366302 5366323 5366307 5366302 -
ttctttaacaggctacccacag

SEQ ID NO: 118851 - DNA, 22 bp, Artificial Sequence
  Synthetic oligonucleotide; TTT chr11 5366301 5366322 5366306 5366301 -
tctttaacaggctacccacaga

SEQ ID NO: 118852 - DNA, 22 bp, Artificial Sequence
  Synthetic oligonucleotide; TTT chr11 5366300 5366321 5366305 5366300 -
ctttaacaggctacccacagag

SEQ ID NO: 118853 - DNA, 22 bp, Artificial Sequence
  Synthetic oligonucleotide; TTC chr11 5366299 5366320 5366304 5366299 -
tttaacaggctacccacagagg

SEQ ID NO: 118854 - DNA, 22 bp, Artificial Sequence
  Synthetic oligonucleotide; CTT chr11 5366297 5366318 5366302 5366297 -
taacaggctacccacagaggaa

SEQ ID NO: 118855 - DNA, 22 bp, Artificial Sequence
  Synthetic oligonucleotide; TTT chr11 5366296 5366317 5366301 5366296 -
aacaggctacccacagaggaac

SEQ ID NO: 118856 - DNA, 22 bp, Artificial Sequence
  Synthetic oligonucleotide; TTA chr11 5366295 5366316 5366300 5366295 -
acaggctacccacagaggaacc

SEQ ID NO: 118857 - DNA, 22 bp, Artificial Sequence
  Synthetic oligonucleotide; CTA chr11 5366287 5366308 5366292 5366287 -
cccacagaggaaccttcccttg

SEQ ID NO: 118858 - DNA, 22 bp, Artificial Sequence
  Synthetic oligonucleotide; CTT chr11 5366271 5366292 5366276 5366271 -
cccttgagctccttttcagatt

SEQ ID NO: 118859 - DNA, 22 bp, Artificial Sequence
  Synthetic oligonucleotide; TTC chr11 5366270 5366291 5366275 5366270 -
ccttgagctccttttcagattc

SEQ ID NO: 118860 - DNA, 22 bp, Artificial Sequence
  Synthetic oligonucleotide; CTT chr11 5366266 5366287 5366271 5366266 -
gagctccttttcagattcttcc

SEQ ID NO: 118861 - DNA, 22 bp, Artificial Sequence
  Synthetic oligonucleotide; TTG chr11 5366265 5366286 5366270 5366265 -
agctccttttcagattcttcct

SEQ ID NO: 118862 - DNA, 22 bp, Artificial Sequence
  Synthetic oligonucleotide; CTC chr11 5366260 5366281 5366265 5366260 -
cttttcagattcttccttctgt

SEQ ID NO: 118863 - DNA, 22 bp, Artificial Sequence
  Synthetic oligonucleotide; CTT chr11 5366257 5366278 5366262 5366257 -
ttcagattcttccttctgtttc

SEQ ID NO: 118864 - DNA, 22 bp, Artificial Sequence
  Synthetic oligonucleotide; TTT chr11 5366256 5366277 5366261 5366256 -
tcagattcttccttctgtttct

SEQ ID NO: 118865 - DNA, 22 bp, Artificial Sequence
  Synthetic oligonucleotide; TTT chr11 5366255 5366276 5366260 5366255 -
cagattcttccttctgtttctc

SEQ ID NO: 118866 - DNA, 22 bp, Artificial Sequence
  Synthetic oligonucleotide; TTC chr11 5366254 5366275 5366259 5366254 -
agattcttccttctgtttctct

SEQ ID NO: 118867 - DNA, 22 bp, Artificial Sequence
  Synthetic oligonucleotide; TTC chr11 5366248 5366269 5366253 5366248 -
ttccttctgtttctctggccct

SEQ ID NO: 118868 - DNA, 22 bp, Artificial Sequence
  Synthetic oligonucleotide; CTT chr11 5366246 5366267 5366251 5366246 -
ccttctgtttctctggcccttt

SEQ ID NO: 118869 - DNA, 22 bp, Artificial Sequence
  Synthetic oligonucleotide; TTC chr11 5366245 5366266 5366250 5366245 -
cttctgtttctctggccctttc

SEQ ID NO: 118870 - DNA, 22 bp, Artificial Sequence
  Synthetic oligonucleotide; CTT chr11 5366242 5366263 5366247 5366242 -
ctgtttctctggccctttctcc

SEQ ID NO: 118871 - DNA, 22 bp, Artificial Sequence
  Synthetic oligonucleotide; TTC chr11 5366241 5366262 5366246 5366241 -
tgtttctctggccctttctcct

SEQ ID NO: 118872 - DNA, 22 bp, Artificial Sequence
  Synthetic oligonucleotide; CTG chr11 5366239 5366260 5366244 5366239 -
tttctctggccctttctccttt

SEQ ID NO: 118873 - DNA, 22 bp, Artificial Sequence
  Synthetic oligonucleotide; TTT chr11 5366236 5366257 5366241 5366236 -
ctctggccctttctcctttgtc

SEQ ID NO: 118874 - DNA, 22 bp, Artificial Sequence
  Synthetic oligonucleotide; TTC chr11 5366235 5366256 5366240 5366235 -
tctggccctttctcctttgtct

SEQ ID NO: 118875 - DNA, 22 bp, Artificial Sequence
  Synthetic oligonucleotide; CTC chr11 5366233 5366254 5366238 5366233 -
tggccctttctcctttgtcttc

SEQ ID NO: 118876 - DNA, 22 bp, Artificial Sequence
  Synthetic oligonucleotide; CTG chr11 5366231 5366252 5366236 5366231 -
gccctttctcctttgtcttcta

SEQ ID NO: 118877 - DNA, 22 bp, Artificial Sequence
  Synthetic oligonucleotide; CTT chr11 5366225 5366246 5366230 5366225 -
tctcctttgtcttctatacttt

SEQ ID NO: 118878 - DNA, 22 bp, Artificial Sequence
  Synthetic oligonucleotide; TTT chr11 5366224 5366245 5366229 5366224 -
ctcctttgtcttctatactttc

SEQ ID NO: 118879 - DNA, 22 bp, Artificial Sequence
  Synthetic oligonucleotide; TTC chr11 5366223 5366244 5366228 5366223 -
tcctttgtcttctatactttcc

SEQ ID NO: 118880 - DNA, 22 bp, Artificial Sequence
  Synthetic oligonucleotide; CTC chr11 5366221 5366242 5366226 5366221 -
ctttgtcttctatactttccta

SEQ ID NO: 118881 - DNA, 22 bp, Artificial Sequence
  Synthetic oligonucleotide; CTT chr11 5366218 5366239 5366223 5366218 -
tgtcttctatactttcctactg

SEQ ID NO: 118882 - DNA, 22 bp, Artificial Sequence
  Synthetic oligonucleotide; TTT chr11 5366217 5366238 5366222 5366217 -
gtcttctatactttcctactga

SEQ ID NO: 118883 - DNA, 22 bp, Artificial Sequence
  Synthetic oligonucleotide; TTG chr11 5366216 5366237 5366221 5366216 -
tcttctatactttcctactgat

SEQ ID NO: 118884 - DNA, 22 bp, Artificial Sequence
  Synthetic oligonucleotide; CTT chr11 5366212 5366233 5366217 5366212 -
ctatactttcctactgattttc

SEQ ID NO: 118885 - DNA, 22 bp, Artificial Sequence
  Synthetic oligonucleotide; TTC chr11 5366211 5366232 5366216 5366211 -
tatactttcctactgattttcc

SEQ ID NO: 118886 - DNA, 22 bp, Artificial Sequence
  Synthetic oligonucleotide; CTA chr11 5366209 5366230 5366214 5366209 -
tactttcctactgattttcctt

SEQ ID NO: 118887 - DNA, 22 bp, Artificial Sequence
  Synthetic oligonucleotide; CTT chr11 5366204 5366225 5366209 5366204 -
tcctactgattttccttcctgt

SEQ ID NO: 118888 - DNA, 22 bp, Artificial Sequence
  Synthetic oligonucleotide; TTT chr11 5366203 5366224 5366208 5366203 -
cctactgattttccttcctgtt

SEQ ID NO: 118889 - DNA, 22 bp, Artificial Sequence
  Synthetic oligonucleotide; TTC chr11 5366202 5366223 5366207 5366202 -
ctactgattttccttcctgttt

SEQ ID NO: 118890 - DNA, 22 bp, Artificial Sequence
  Synthetic oligonucleotide; CTA chr11 5366199 5366220 5366204 5366199 -
ctgattttccttcctgtttccc

SEQ ID NO: 118891 - DNA, 22 bp, Artificial Sequence
  Synthetic oligonucleotide; CTG chr11 5366196 5366217 5366201 5366196 -
attttccttcctgtttccctca

SEQ ID NO: 118892 - DNA, 22 bp, Artificial Sequence
  Synthetic oligonucleotide; TTT chr11 5366192 5366213 5366197 5366192 -
tccttcctgtttccctcatcct

SEQ ID NO: 118893 - DNA, 22 bp, Artificial Sequence
  Synthetic oligonucleotide; TTT chr11 5366191 5366212 5366196 5366191 -
ccttcctgtttccctcatcctt

SEQ ID NO: 118894 - DNA, 22 bp, Artificial Sequence
  Synthetic oligonucleotide; TTC chr11 5366190 5366211 5366195 5366190 -
cttcctgtttccctcatcctta

SEQ ID NO: 118895 - DNA, 22 bp, Artificial Sequence
  Synthetic oligonucleotide; CTT chr11 5366187 5366208 5366192 5366187 -
cctgtttccctcatccttaact

SEQ ID NO: 118896 - DNA, 22 bp, Artificial Sequence
  Synthetic oligonucleotide; TTC chr11 5366186 5366207 5366191 5366186 -
ctgtttccctcatccttaactt

SEQ ID NO: 118897 - DNA, 22 bp, Artificial Sequence
  Synthetic oligonucleotide; CTG chr11 5366183 5366204 5366188 5366183 -
tttccctcatccttaacttcct

SEQ ID NO: 118898 - DNA, 22 bp, Artificial Sequence
  Synthetic oligonucleotide; TTT chr11 5366180 5366201 5366185 5366180 -
ccctcatccttaacttcctact

SEQ ID NO: 118899 - DNA, 22 bp, Artificial Sequence
  Synthetic oligonucleotide; TTC chr11 5366179 5366200 5366184 5366179 -
cctcatccttaacttcctactt

SEQ ID NO: 118900 - DNA, 22 bp, Artificial Sequence
  Synthetic oligonucleotide; CTC chr11 5366175 5366196 5366180 5366175 -
atccttaacttcctacttaagg

SEQ ID NO: 118901 - DNA, 22 bp, Artificial Sequence
  Synthetic oligonucleotide; CTT chr11 5366169 5366190 5366174 5366169 -
aacttcctacttaaggcttgct

SEQ ID NO: 118902 - DNA, 22 bp, Artificial Sequence
  Synthetic oligonucleotide; TTA chr11 5366168 5366189 5366173 5366168 -
acttcctacttaaggcttgctc

SEQ ID NO: 118903 - DNA, 22 bp, Artificial Sequence
  Synthetic oligonucleotide; CTT chr11 5366164 5366185 5366169 5366164 -
cctacttaaggcttgctctatc

SEQ ID NO: 118904 - DNA, 22 bp, Artificial Sequence
  Synthetic oligonucleotide; TTC chr11 5366163 5366184 5366168 5366163 -
ctacttaaggcttgctctatcc

SEQ ID NO: 118905 - DNA, 22 bp, Artificial Sequence
  Synthetic oligonucleotide; CTA chr11 5366160 5366181 5366165 5366160 -
cttaaggcttgctctatcctct

SEQ ID NO: 118906 - DNA, 22 bp, Artificial Sequence
  Synthetic oligonucleotide; CTT chr11 5366157 5366178 5366162 5366157 -
aaggcttgctctatcctcttca

SEQ ID NO: 118907 - DNA, 22 bp, Artificial Sequence
  Synthetic oligonucleotide; TTA chr11 5366156 5366177 5366161 5366156 -
aggcttgctctatcctcttcac

SEQ ID NO: 118908 - DNA, 22 bp, Artificial Sequence
  Synthetic oligonucleotide; CTT chr11 5366150 5366171 5366155 5366150 -
gctctatcctcttcacatactg

SEQ ID NO: 118909 - DNA, 22 bp, Artificial Sequence
  Synthetic oligonucleotide; TTG chr11 5366149 5366170 5366154 5366149 -
ctctatcctcttcacatactgt

SEQ ID NO: 118910 - DNA, 22 bp, Artificial Sequence
  Synthetic oligonucleotide; CTC chr11 5366146 5366167 5366151 5366146 -
tatcctcttcacatactgtttc

SEQ ID NO: 118911 - DNA, 22 bp, Artificial Sequence
  Synthetic oligonucleotide; CTA chr11 5366144 5366165 5366149 5366144 -
tcctcttcacatactgtttctt

SEQ ID NO: 118912 - DNA, 22 bp, Artificial Sequence
  Synthetic oligonucleotide; CTC chr11 5366139 5366160 5366144 5366139 -
ttcacatactgtttcttatttt

SEQ ID NO: 118913 - DNA, 22 bp, Artificial Sequence
  Synthetic oligonucleotide; CTT chr11 5366137 5366158 5366142 5366137 -
cacatactgtttcttattttgc

SEQ ID NO: 118914 - DNA, 22 bp, Artificial Sequence
  Synthetic oligonucleotide; TTC chr11 5366136 5366157 5366141 5366136 -
acatactgtttcttattttgcc

SEQ ID NO: 118915 - DNA, 22 bp, Artificial Sequence
  Synthetic oligonucleotide; CTG chr11 5366128 5366149 5366133 5366128 -
tttcttattttgcccactgggt

SEQ ID NO: 118916 - DNA, 22 bp, Artificial Sequence
  Synthetic oligonucleotide; TTT chr11 5366125 5366146 5366130 5366125 -
cttattttgcccactgggttca

SEQ ID NO: 118917 - DNA, 22 bp, Artificial Sequence
  Synthetic oligonucleotide; TTC chr11 5366124 5366145 5366129 5366124 -
ttattttgcccactgggttcac

SEQ ID NO: 118918 - DNA, 22 bp, Artificial Sequence
  Synthetic oligonucleotide; CTT chr11 5366122 5366143 5366127 5366122 -
attttgcccactgggttcacct

SEQ ID NO: 118919 - DNA, 22 bp, Artificial Sequence
  Synthetic oligonucleotide; TTA chr11 5366121 5366142 5366126 5366121 -
ttttgcccactgggttcacctc

SEQ ID NO: 118920 - DNA, 22 bp, Artificial Sequence
  Synthetic oligonucleotide; TTT chr11 5366118 5366139 5366123 5366118 -
tgcccactgggttcacctctaa

SEQ ID NO: 118921 - DNA, 22 bp, Artificial Sequence
  Synthetic oligonucleotide; TTT chr11 5366117 5366138 5366122 5366117 -
gcccactgggttcacctctaag

SEQ ID NO: 118922 - DNA, 22 bp, Artificial Sequence
  Synthetic oligonucleotide; TTG chr11 5366116 5366137 5366121 5366116 -
cccactgggttcacctctaagt

SEQ ID NO: 118923 - DNA, 22 bp, Artificial Sequence
  Synthetic oligonucleotide; CTG chr11 5366109 5366130 5366114 5366109 -
ggttcacctctaagtcacacac

SEQ ID NO: 118924 - DNA, 22 bp, Artificial Sequence
  Synthetic oligonucleotide; TTC chr11 5366104 5366125 5366109 5366104 -
acctctaagtcacacacaactg

SEQ ID NO: 118925 - DNA, 22 bp, Artificial Sequence
  Synthetic oligonucleotide; CTC chr11 5366099 5366120 5366104 5366099 -
taagtcacacacaactggacaa

SEQ ID NO: 118926 - DNA, 22 bp, Artificial Sequence
  Synthetic oligonucleotide; CTA chr11 5366097 5366118 5366102 5366097 -
agtcacacacaactggacaagt

SEQ ID NO: 118927 - DNA, 22 bp, Artificial Sequence
  Synthetic oligonucleotide; CTG chr11 5366082 5366103 5366087 5366082 -
gacaagtaagcatacccctcag

SEQ ID NO: 118928 - DNA, 22 bp, Artificial Sequence
  Synthetic oligonucleotide; CTC chr11 5366062 5366083 5366067 5366062 -
agcaactcttccattaacagcc

SEQ ID NO: 118929 - DNA, 22 bp, Artificial Sequence
  Synthetic oligonucleotide; CTC chr11 5366054 5366075 5366059 5366054 -
ttccattaacagcccccaaaca

SEQ ID NO: 118930 - DNA, 22 bp, Artificial Sequence
  Synthetic oligonucleotide; CTT chr11 5366052 5366073 5366057 5366052 -
ccattaacagcccccaaacatg

SEQ ID NO: 118931 - DNA, 22 bp, Artificial Sequence
  Synthetic oligonucleotide; TTC chr11 5366051 5366072 5366056 5366051 -
cattaacagcccccaaacatgc

SEQ ID NO: 118932 - DNA, 22 bp, Artificial Sequence
  Synthetic oligonucleotide; TTA chr11 5366046 5366067 5366051 5366046 -
acagcccccaaacatgctgatt

SEQ ID NO: 118933 - DNA, 22 bp, Artificial Sequence
  Synthetic oligonucleotide; CTG chr11 5366027 5366048 5366032 5366027 -
attacctggctgctccataggg

SEQ ID NO: 118934 - DNA, 22 bp, Artificial Sequence
  Synthetic oligonucleotide; TTA chr11 5366023 5366044 5366028 5366023 -
cctggctgctccatagggtggt

SEQ ID NO: 118935 - DNA, 22 bp, Artificial Sequence
  Synthetic oligonucleotide; CTG chr11 5366019 5366040 5366024 5366019 -
gctgctccatagggtggttggt

SEQ ID NO: 118936 - DNA, 22 bp, Artificial Sequence
  Synthetic oligonucleotide; CTG chr11 5366015 5366036 5366020 5366015 -
ctccatagggtggttggttggt

SEQ ID NO: 118937 - DNA, 22 bp, Artificial Sequence
  Synthetic oligonucleotide; CTC chr11 5366012 5366033 5366017 5366012 -
catagggtggttggttggtctt

SEQ ID NO: 118938 - DNA, 22 bp, Artificial Sequence
  Synthetic oligonucleotide; TTG chr11 5365999 5366020 5366004 5365999 -
gttggtcttaagtctcccacta

SEQ ID NO: 118939 - DNA, 22 bp, Artificial Sequence
  Synthetic oligonucleotide; TTG chr11 5365995 5366016 5366000 5365995 -
gtcttaagtctcccactagcca

SEQ ID NO: 118940 - DNA, 22 bp, Artificial Sequence
  Synthetic oligonucleotide; CTT chr11 5365990 5366011 5365995 5365990 -
aagtctcccactagccagcacc

SEQ ID NO: 118941 - DNA, 22 bp, Artificial Sequence
  Synthetic oligonucleotide; TTA chr11 5365989 5366010 5365994 5365989 -
agtctcccactagccagcacct

SEQ ID NO: 118942 - DNA, 22 bp, Artificial Sequence
  Synthetic oligonucleotide; CTC chr11 5365983 5366004 5365988 5365983 -
ccactagccagcacctagcagt

SEQ ID NO: 118943 - DNA, 22 bp, Artificial Sequence
  Synthetic oligonucleotide; CTA chr11 5365977 5365998 5365982 5365977 -
gccagcacctagcagttcttca

SEQ ID NO: 118944 - DNA, 22 bp, Artificial Sequence
  Synthetic oligonucleotide; CTA chr11 5365966 5365987 5365971 5365966 -
gcagttcttcagtttgtgtggt

SEQ ID NO: 118945 - DNA, 22 bp, Artificial Sequence
  Synthetic oligonucleotide; TTC chr11 5365959 5365980 5365964 5365959 -
ttcagtttgtgtggttctcagt

SEQ ID NO: 118946 - DNA, 22 bp, Artificial Sequence
  Synthetic oligonucleotide; CTT chr11 5365957 5365978 5365962 5365957 -
cagtttgtgtggttctcagtgc

SEQ ID NO: 118947 - DNA, 22 bp, Artificial Sequence
  Synthetic oligonucleotide; TTC chr11 5365956 5365977 5365961 5365956 -
agtttgtgtggttctcagtgct

SEQ ID NO: 118948 - DNA, 22 bp, Artificial Sequence
  Synthetic oligonucleotide; TTT chr11 5365951 5365972 5365956 5365951 -
gtgtggttctcagtgctggtga

SEQ ID NO: 118949 - DNA, 22 bp, Artificial Sequence
  Synthetic oligonucleotide; TTG chr11 5365950 5365971 5365955 5365950 -
tgtggttctcagtgctggtgat

SEQ ID NO: 118950 - DNA, 22 bp, Artificial Sequence
  Synthetic oligonucleotide; TTC chr11 5365942 5365963 5365947 5365942 -
tcagtgctggtgatcatgctga

SEQ ID NO: 118951 - DNA, 22 bp, Artificial Sequence
  Synthetic oligonucleotide; CTC chr11 5365940 5365961 5365945 5365940 -
agtgctggtgatcatgctgagc

SEQ ID NO: 118952 - DNA, 22 bp, Artificial Sequence
  Synthetic oligonucleotide; CTG chr11 5365933 5365954 5365938 5365933 -
gtgatcatgctgagcctgcccc

SEQ ID NO: 118953 - DNA, 22 bp, Artificial Sequence
  Synthetic oligonucleotide; CTG chr11 5365921 5365942 5365926 5365921 -
agcctgcccccttcatgcctct

SEQ ID NO: 118954 - DNA, 22 bp, Artificial Sequence
  Synthetic oligonucleotide; CTG chr11 5365915 5365936 5365920 5365915 -
cccccttcatgcctctctggtc

SEQ ID NO: 118955 - DNA, 22 bp, Artificial Sequence
  Synthetic oligonucleotide; CTT chr11 5365908 5365929 5365913 5365908 -
catgcctctctggtcagtcaga

SEQ ID NO: 118956 - DNA, 22 bp, Artificial Sequence
  Synthetic oligonucleotide; TTC chr11 5365907 5365928 5365912 5365907 -
atgcctctctggtcagtcagac

SEQ ID NO: 118957 - DNA, 22 bp, Artificial Sequence
  Synthetic oligonucleotide; CTC chr11 5365900 5365921 5365905 5365900 -
tctggtcagtcagacccttcag

SEQ ID NO: 118958 - DNA, 22 bp, Artificial Sequence
  Synthetic oligonucleotide; CTC chr11 5365898 5365919 5365903 5365898 -
tggtcagtcagacccttcagaa

SEQ ID NO: 118959 - DNA, 22 bp, Artificial Sequence
  Synthetic oligonucleotide; CTG chr11 5365896 5365917 5365901 5365896 -
gtcagtcagacccttcagaacc

SEQ ID NO: 118960 - DNA, 22 bp, Artificial Sequence
  Synthetic oligonucleotide; CTT chr11 5365881 5365902 5365886 5365881 -
cagaacccaagaggtaagcaga

SEQ ID NO: 118961 - DNA, 22 bp, Artificial Sequence
  Synthetic oligonucleotide; TTC chr11 5365880 5365901 5365885 5365880 -
agaacccaagaggtaagcagag

SEQ ID NO: 118962 - DNA, 22 bp, Artificial Sequence
  Synthetic oligonucleotide; TTC chr11 5365855 5365876 5365860 5365855 -
ctctaagaatggttagcaactt

SEQ ID NO: 118963 - DNA, 22 bp, Artificial Sequence
  Synthetic oligonucleotide; CTC chr11 5365852 5365873 5365857 5365852 -
taagaatggttagcaacttaaa

SEQ ID NO: 118964 - DNA, 22 bp, Artificial Sequence
  Synthetic oligonucleotide; CTA chr11 5365850 5365871 5365855 5365850 -
agaatggttagcaacttaaact

SEQ ID NO: 118965 - DNA, 22 bp, Artificial Sequence
  Synthetic oligonucleotide; TTA chr11 5365840 5365861 5365845 5365840 -
gcaacttaaacttcatcctgtc

SEQ ID NO: 118966 - DNA, 22 bp, Artificial Sequence
  Synthetic oligonucleotide; CTT chr11 5365833 5365854 5365838 5365833 -
aaacttcatcctgtcatcaagc

SEQ ID NO: 118967 - DNA, 22 bp, Artificial Sequence
  Synthetic oligonucleotide; TTA chr11 5365832 5365853 5365837 5365832 -
aacttcatcctgtcatcaagcc

SEQ ID NO: 118968 - DNA, 22 bp, Artificial Sequence
  Synthetic oligonucleotide; CTT chr11 5365827 5365848 5365832 5365827 -
catcctgtcatcaagccagcac

SEQ ID NO: 118969 - DNA, 22 bp, Artificial Sequence
  Synthetic oligonucleotide; TTC chr11 5365826 5365847 5365831 5365826 -
atcctgtcatcaagccagcaca

SEQ ID NO: 118970 - DNA, 22 bp, Artificial Sequence
  Synthetic oligonucleotide; CTG chr11 5365820 5365841 5365825 5365820 -
tcatcaagccagcacatactaa

SEQ ID NO: 118971 - DNA, 22 bp, Artificial Sequence
  Synthetic oligonucleotide; CTA chr11 5365799 5365820 5365804 5365799 -
agcatctataatgtgctagaca

SEQ ID NO: 118972 - DNA, 22 bp, Artificial Sequence
  Synthetic oligonucleotide; CTA chr11 5365791 5365812 5365796 5365791 -
taatgtgctagacaatgtgggt

SEQ ID NO: 118973 - DNA, 22 bp, Artificial Sequence
  Synthetic oligonucleotide; CTA chr11 5365781 5365802 5365786 5365781 -
gacaatgtgggtaatggaggtg

SEQ ID NO: 118974 - DNA, 22 bp, Artificial Sequence
  Synthetic oligonucleotide; CTG chr11 5365752 5365773 5365757 5365752 -
gattataatatctgccctcaaa

SEQ ID NO: 118975 - DNA, 22 bp, Artificial Sequence
  Synthetic oligonucleotide; TTA chr11 5365747 5365768 5365752 5365747 -
taatatctgccctcaaaagctt

SEQ ID NO: 118976 - DNA, 22 bp, Artificial Sequence
  Synthetic oligonucleotide; CTG chr11 5365738 5365759 5365743 5365738 -
ccctcaaaagcttatatctatt

SEQ ID NO: 118977 - DNA, 22 bp, Artificial Sequence
  Synthetic oligonucleotide; CTC chr11 5365733 5365754 5365738 5365733 -
aaaagcttatatctatttttta

SEQ ID NO: 118978 - DNA, 22 bp, Artificial Sequence
  Synthetic oligonucleotide; CTT chr11 5365725 5365746 5365730 5365725 -
atatctattttttaaataatta

SEQ ID NO: 118979 - DNA, 22 bp, Artificial Sequence
  Synthetic oligonucleotide; TTA chr11 5365724 5365745 5365729 5365724 -
tatctattttttaaataattac

SEQ ID NO: 118980 - DNA, 22 bp, Artificial Sequence
  Synthetic oligonucleotide; CTA chr11 5365718 5365739 5365723 5365718 -
ttttttaaataattacaggaca

SEQ ID NO: 118981 - DNA, 22 bp, Artificial Sequence
  Synthetic oligonucleotide; TTT chr11 5365715 5365736 5365720 5365715 -
tttaaataattacaggacaatt

SEQ ID NO: 118982 - DNA, 22 bp, Artificial Sequence
  Synthetic oligonucleotide; TTT chr11 5365714 5365735 5365719 5365714 -
ttaaataattacaggacaattt

SEQ ID NO: 118983 - DNA, 22 bp, Artificial Sequence
  Synthetic oligonucleotide; TTT chr11 5365713 5365734 5365718 5365713 -
taaataattacaggacaattta

SEQ ID NO: 118984 - DNA, 22 bp, Artificial Sequence
  Synthetic oligonucleotide; TTT chr11 5365712 5365733 5365717 5365712 -
aaataattacaggacaatttaa

SEQ ID NO: 118985 - DNA, 22 bp, Artificial Sequence
  Synthetic oligonucleotide; TTA chr11 5365711 5365732 5365716 5365711 -
aataattacaggacaatttaaa

SEQ ID NO: 118986 - DNA, 22 bp, Artificial Sequence
  Synthetic oligonucleotide; TTA chr11 5365703 5365724 5365708 5365703 -
caggacaatttaaatgtatcag

SEQ ID NO: 118987 - DNA, 22 bp, Artificial Sequence
  Synthetic oligonucleotide; TTT chr11 5365692 5365713 5365697 5365692 -
aaatgtatcagtttgggttgaa

SEQ ID NO: 118988 - DNA, 22 bp, Artificial Sequence
  Synthetic oligonucleotide; TTA chr11 5365691 5365712 5365696 5365691 -
aatgtatcagtttgggttgaat

SEQ ID NO: 118989 - DNA, 22 bp, Artificial Sequence
  Synthetic oligonucleotide; TTT chr11 5365678 5365699 5365683 5365678 -
gggttgaataaaatcagggatg

SEQ ID NO: 118990 - DNA, 22 bp, Artificial Sequence
  Synthetic oligonucleotide; TTG chr11 5365677 5365698 5365682 5365677 -
ggttgaataaaatcagggatgt

SEQ ID NO: 118991 - DNA, 22 bp, Artificial Sequence
  Synthetic oligonucleotide; TTG chr11 5365672 5365693 5365677 5365672 -
aataaaatcagggatgtttctc

SEQ ID NO: 118992 - DNA, 22 bp, Artificial Sequence
  Synthetic oligonucleotide; TTT chr11 5365653 5365674 5365658 5365653 -
ctcattagggcctcaacacatt

SEQ ID NO: 118993 - DNA, 22 bp, Artificial Sequence
  Synthetic oligonucleotide; TTC chr11 5365652 5365673 5365657 5365652 -
tcattagggcctcaacacattt

SEQ ID NO: 118994 - DNA, 22 bp, Artificial Sequence
  Synthetic oligonucleotide; CTC chr11 5365650 5365671 5365655 5365650 -
attagggcctcaacacatttgg

SEQ ID NO: 118995 - DNA, 22 bp, Artificial Sequence
  Synthetic oligonucleotide; TTA chr11 5365646 5365667 5365651 5365646 -
gggcctcaacacatttggaggt

SEQ ID NO: 118996 - DNA, 22 bp, Artificial Sequence
  Synthetic oligonucleotide; CTC chr11 5365639 5365660 5365644 5365639 -
aacacatttggaggtgtgttaa

SEQ ID NO: 118997 - DNA, 22 bp, Artificial Sequence
  Synthetic oligonucleotide; TTT chr11 5365630 5365651 5365635 5365630 -
ggaggtgtgttaagacagtagt

SEQ ID NO: 118998 - DNA, 22 bp, Artificial Sequence
  Synthetic oligonucleotide; TTG chr11 5365629 5365650 5365634 5365629 -
gaggtgtgttaagacagtagtc

SEQ ID NO: 118999 - DNA, 22 bp, Artificial Sequence
  Synthetic oligonucleotide; TTA chr11 5365618 5365639 5365623 5365618 -
agacagtagtcagattcacacc

SEQ ID NO: 119000 - DNA, 22 bp, Artificial Sequence
  Synthetic oligonucleotide; TTC chr11 5365601 5365622 5365606 5365601 -
acaccaagagccctgtcatggc

SEQ ID NO: 119001 - DNA, 22 bp, Artificial Sequence
  Synthetic oligonucleotide; CTG chr11 5365586 5365607 5365591 5365586 -
tcatggcaaaccgatgtcatgt

SEQ ID NO: 119002 - DNA, 22 bp, Artificial Sequence
  Synthetic oligonucleotide; CTC chr11 5365557 5365578 5365562 5365557 -
gataatgtttttgtgtatcaat

SEQ ID NO: 119003 - DNA, 22 bp, Artificial Sequence
  Synthetic oligonucleotide; TTT chr11 5365547 5365568 5365552 5365547 -
ttgtgtatcaatatgctttgtg

SEQ ID NO: 119004 - DNA, 22 bp, Artificial Sequence
  Synthetic oligonucleotide; TTT chr11 5365546 5365567 5365551 5365546 -
tgtgtatcaatatgctttgtga

SEQ ID NO: 119005 - DNA, 22 bp, Artificial Sequence
  Synthetic oligonucleotide; TTT chr11 5365545 5365566 5365550 5365545 -
gtgtatcaatatgctttgtgaa

SEQ ID NO: 119006 - DNA, 22 bp, Artificial Sequence
  Synthetic oligonucleotide; TTG chr11 5365544 5365565 5365549 5365544 -
tgtatcaatatgctttgtgaaa

SEQ ID NO: 119007 - DNA, 22 bp, Artificial Sequence
  Synthetic oligonucleotide; CTT chr11 5365529 5365550 5365534 5365529 -
tgtgaaaaaacttcgaggtagt

SEQ ID NO: 119008 - DNA, 22 bp, Artificial Sequence
  Synthetic oligonucleotide; TTT chr11 5365528 5365549 5365533 5365528 -
gtgaaaaaacttcgaggtagta

SEQ ID NO: 119009 - DNA, 22 bp, Artificial Sequence
  Synthetic oligonucleotide; TTG chr11 5365527 5365548 5365532 5365527 -
tgaaaaaacttcgaggtagtac

SEQ ID NO: 119010 - DNA, 22 bp, Artificial Sequence
  Synthetic oligonucleotide; CTT chr11 5365516 5365537 5365521 5365516 -
cgaggtagtacagccatatcct

SEQ ID NO: 119011 - DNA, 22 bp, Artificial Sequence
  Synthetic oligonucleotide; TTC chr11 5365515 5365536 5365520 5365515 -
gaggtagtacagccatatccta

SEQ ID NO: 119012 - DNA, 22 bp, Artificial Sequence
  Synthetic oligonucleotide; CTA chr11 5365493 5365514 5365498 5365493 -
tcctgtgcatagacaggaaaat

SEQ ID NO: 119013 - DNA, 22 bp, Artificial Sequence
  Synthetic oligonucleotide; CTG chr11 5365488 5365509 5365493 5365488 -
tgcatagacaggaaaatggttg

SEQ ID NO: 119014 - DNA, 22 bp, Artificial Sequence
  Synthetic oligonucleotide; TTG chr11 5365466 5365487 5365471 5365466 -
ctgactggcagaccagaattgg

SEQ ID NO: 119015 - DNA, 22 bp, Artificial Sequence
  Synthetic oligonucleotide; CTG chr11 5365463 5365484 5365468 5365463 -
actggcagaccagaattgggtt

SEQ ID NO: 119016 - DNA, 22 bp, Artificial Sequence
  Synthetic oligonucleotide; CTG chr11 5365459 5365480 5365464 5365459 -
gcagaccagaattgggttacct

SEQ ID NO: 119017 - DNA, 22 bp, Artificial Sequence
  Synthetic oligonucleotide; TTG chr11 5365445 5365466 5365450 5365445 -
ggttaccttttcatctaaatgc

SEQ ID NO: 119018 - DNA, 22 bp, Artificial Sequence
  Synthetic oligonucleotide; TTA chr11 5365440 5365461 5365445 5365440 -
ccttttcatctaaatgcatctc

SEQ ID NO: 119019 - DNA, 22 bp, Artificial Sequence
  Synthetic oligonucleotide; CTT chr11 5365436 5365457 5365441 5365436 -
ttcatctaaatgcatctctcca

SEQ ID NO: 119020 - DNA, 22 bp, Artificial Sequence
  Synthetic oligonucleotide; TTT chr11 5365435 5365456 5365440 5365435 -
tcatctaaatgcatctctccac

SEQ ID NO: 119021 - DNA, 22 bp, Artificial Sequence
  Synthetic oligonucleotide; TTT chr11 5365434 5365455 5365439 5365434 -
catctaaatgcatctctccaca

SEQ ID NO: 119022 - DNA, 22 bp, Artificial Sequence
  Synthetic oligonucleotide; TTC chr11 5365433 5365454 5365438 5365433 -
atctaaatgcatctctccacag

SEQ ID NO: 119023 - DNA, 22 bp, Artificial Sequence
  Synthetic oligonucleotide; CTA chr11 5365428 5365449 5365433 5365428 -
aatgcatctctccacagcgatt

SEQ ID NO: 119024 - DNA, 22 bp, Artificial Sequence
  Synthetic oligonucleotide; CTC chr11 5365418 5365439 5365423 5365418 -
tccacagcgatttctacagtat

SEQ ID NO: 119025 - DNA, 22 bp, Artificial Sequence
  Synthetic oligonucleotide; CTC chr11 5365416 5365437 5365421 5365416 -
cacagcgatttctacagtatgc

SEQ ID NO: 119026 - DNA, 22 bp, Artificial Sequence
  Synthetic oligonucleotide; TTT chr11 5365405 5365426 5365410 5365405 -
ctacagtatgcttgatcttgtc

SEQ ID NO: 119027 - DNA, 22 bp, Artificial Sequence
  Synthetic oligonucleotide; TTC chr11 5365404 5365425 5365409 5365404 -
tacagtatgcttgatcttgtct

SEQ ID NO: 119028 - DNA, 22 bp, Artificial Sequence
  Synthetic oligonucleotide; CTA chr11 5365402 5365423 5365407 5365402 -
cagtatgcttgatcttgtctct

SEQ ID NO: 119029 - DNA, 22 bp, Artificial Sequence
  Synthetic oligonucleotide; CTT chr11 5365392 5365413 5365397 5365392 -
gatcttgtctctcatcccatat

SEQ ID NO: 119030 - DNA, 22 bp, Artificial Sequence
  Synthetic oligonucleotide; TTG chr11 5365391 5365412 5365396 5365391 -
atcttgtctctcatcccatatt

SEQ ID NO: 119031 - DNA, 22 bp, Artificial Sequence
  Synthetic oligonucleotide; CTT chr11 5365386 5365407 5365391 5365386 -
gtctctcatcccatatttggtt

SEQ ID NO: 119032 - DNA, 22 bp, Artificial Sequence
  Synthetic oligonucleotide; TTG chr11 5365385 5365406 5365390 5365385 -
tctctcatcccatatttggtta

SEQ ID NO: 119033 - DNA, 22 bp, Artificial Sequence
  Synthetic oligonucleotide; CTC chr11 5365381 5365402 5365386 5365381 -
tcatcccatatttggttacttg

SEQ ID NO: 119034 - DNA, 22 bp, Artificial Sequence
  Synthetic oligonucleotide; CTC chr11 5365379 5365400 5365384 5365379 -
atcccatatttggttacttgtt

SEQ ID NO: 119035 - DNA, 22 bp, Artificial Sequence
  Synthetic oligonucleotide; TTT chr11 5365368 5365389 5365373 5365368 -
ggttacttgttgccatgccggg

SEQ ID NO: 119036 - DNA, 22 bp, Artificial Sequence
  Synthetic oligonucleotide; TTG chr11 5365367 5365388 5365372 5365367 -
gttacttgttgccatgccggga

SEQ ID NO: 119037 - DNA, 22 bp, Artificial Sequence
  Synthetic oligonucleotide; TTA chr11 5365363 5365384 5365368 5365363 -
cttgttgccatgccgggaccag

SEQ ID NO: 119038 - DNA, 22 bp, Artificial Sequence
  Synthetic oligonucleotide; CTT chr11 5365360 5365381 5365365 5365360 -
gttgccatgccgggaccagcca

SEQ ID NO: 119039 - DNA, 22 bp, Artificial Sequence
  Synthetic oligonucleotide; TTG chr11 5365359 5365380 5365364 5365359 -
ttgccatgccgggaccagccat

SEQ ID NO: 119040 - DNA, 22 bp, Artificial Sequence
  Synthetic oligonucleotide; TTG chr11 5365356 5365377 5365361 5365356 -
ccatgccgggaccagccatgca

SEQ ID NO: 119041 - DNA, 22 bp, Artificial Sequence
  Synthetic oligonucleotide; TTG chr11 5365331 5365352 5365336 5365331 -
gtttgcctttggcatcagtgta

SEQ ID NO: 119042 - DNA, 22 bp, Artificial Sequence
  Synthetic oligonucleotide; TTT chr11 5365327 5365348 5365332 5365327 -
gcctttggcatcagtgtatgct

SEQ ID NO: 119043 - DNA, 22 bp, Artificial Sequence
  Synthetic oligonucleotide; TTG chr11 5365326 5365347 5365331 5365326 -
cctttggcatcagtgtatgctc

SEQ ID NO: 119044 - DNA, 22 bp, Artificial Sequence
  Synthetic oligonucleotide; CTT chr11 5365322 5365343 5365327 5365322 -
tggcatcagtgtatgctctata

SEQ ID NO: 119045 - DNA, 22 bp, Artificial Sequence
  Synthetic oligonucleotide; TTT chr11 5365321 5365342 5365326 5365321 -
ggcatcagtgtatgctctatac

SEQ ID NO: 119046 - DNA, 22 bp, Artificial Sequence
  Synthetic oligonucleotide; TTG chr11 5365320 5365341 5365325 5365320 -
gcatcagtgtatgctctatacc

SEQ ID NO: 119047 - DNA, 22 bp, Artificial Sequence
  Synthetic oligonucleotide; CTC chr11 5365304 5365325 5365309 5365304 -
tatacccatgttttccacagct

SEQ ID NO: 119048 - DNA, 22 bp, Artificial Sequence
  Synthetic oligonucleotide; CTA chr11 5365302 5365323 5365307 5365302 -
tacccatgttttccacagctgg

SEQ ID NO: 119049 - DNA, 22 bp, Artificial Sequence
  Synthetic oligonucleotide; TTT chr11 5365291 5365312 5365296 5365291 -
tccacagctggcaaacaccagt

SEQ ID NO: 119050 - DNA, 22 bp, Artificial Sequence
  Synthetic oligonucleotide; TTT chr11 5365290 5365311 5365295 5365290 -
ccacagctggcaaacaccagtg

SEQ ID NO: 119051 - DNA, 22 bp, Artificial Sequence
  Synthetic oligonucleotide; TTC chr11 5365289 5365310 5365294 5365289 -
cacagctggcaaacaccagtgg

SEQ ID NO: 119052 - DNA, 22 bp, Artificial Sequence
  Synthetic oligonucleotide; CTG chr11 5365281 5365302 5365286 5365281 -
gcaaacaccagtggtattctaa

SEQ ID NO: 119053 - DNA, 22 bp, Artificial Sequence
  Synthetic oligonucleotide; TTC chr11 5365262 5365283 5365267 5365262 -
taataacactgttctcaccacc

SEQ ID NO: 119054 - DNA, 22 bp, Artificial Sequence
  Synthetic oligonucleotide; CTA chr11 5365260 5365281 5365265 5365260 -
ataacactgttctcaccaccag

SEQ ID NO: 119055 - DNA, 22 bp, Artificial Sequence
  Synthetic oligonucleotide; CTG chr11 5365251 5365272 5365256 5365251 -
ttctcaccaccagcccttctgg

SEQ ID NO: 119056 - DNA, 22 bp, Artificial Sequence
  Synthetic oligonucleotide; TTC chr11 5365248 5365269 5365253 5365248 -
tcaccaccagcccttctggttc

SEQ ID NO: 119057 - DNA, 22 bp, Artificial Sequence
  Synthetic oligonucleotide; CTC chr11 5365246 5365267 5365251 5365246 -
accaccagcccttctggttcac

SEQ ID NO: 119058 - DNA, 22 bp, Artificial Sequence
  Synthetic oligonucleotide; CTT chr11 5365233 5365254 5365238 5365233 -
ctggttcactagatgtttccat

SEQ ID NO: 119059 - DNA, 22 bp, Artificial Sequence
  Synthetic oligonucleotide; TTC chr11 5365232 5365253 5365237 5365232 -
tggttcactagatgtttccatg

SEQ ID NO: 119060 - DNA, 22 bp, Artificial Sequence
  Synthetic oligonucleotide; CTG chr11 5365230 5365251 5365235 5365230 -
gttcactagatgtttccatgga

SEQ ID NO: 119061 - DNA, 22 bp, Artificial Sequence
  Synthetic oligonucleotide; TTC chr11 5365226 5365247 5365231 5365226 -
actagatgtttccatggagtcc

SEQ ID NO: 119062 - DNA, 22 bp, Artificial Sequence
  Synthetic oligonucleotide; CTA chr11 5365222 5365243 5365227 5365222 -
gatgtttccatggagtcctgat

SEQ ID NO: 119063 - DNA, 22 bp, Artificial Sequence
  Synthetic oligonucleotide; TTT chr11 5365215 5365236 5365220 5365215 -
ccatggagtcctgatataatag

SEQ ID NO: 119064 - DNA, 22 bp, Artificial Sequence
  Synthetic oligonucleotide; TTC chr11 5365214 5365235 5365219 5365214 -
catggagtcctgatataataga

SEQ ID NO: 119065 - DNA, 22 bp, Artificial Sequence
  Synthetic oligonucleotide; CTG chr11 5365202 5365223 5365207 5365202 -
atataatagacaacttatttta

SEQ ID NO: 119066 - DNA, 22 bp, Artificial Sequence
  Synthetic oligonucleotide; CTT chr11 5365186 5365207 5365191 5365186 -
attttaaacacagttgccagcc

SEQ ID NO: 119067 - DNA, 22 bp, Artificial Sequence
  Synthetic oligonucleotide; TTA chr11 5365185 5365206 5365190 5365185 -
ttttaaacacagttgccagccc

SEQ ID NO: 119068 - DNA, 22 bp, Artificial Sequence
  Synthetic oligonucleotide; TTT chr11 5365182 5365203 5365187 5365182 -
taaacacagttgccagccctac

SEQ ID NO: 119069 - DNA, 22 bp, Artificial Sequence
  Synthetic oligonucleotide; TTT chr11 5365181 5365202 5365186 5365181 -
aaacacagttgccagccctaca

SEQ ID NO: 119070 - DNA, 22 bp, Artificial Sequence
  Synthetic oligonucleotide; TTA chr11 5365180 5365201 5365185 5365180 -
aacacagttgccagccctacac

SEQ ID NO: 119071 - DNA, 22 bp, Artificial Sequence
  Synthetic oligonucleotide; TTG chr11 5365170 5365191 5365175 5365170 -
ccagccctacactctaaatgtc

SEQ ID NO: 119072 - DNA, 22 bp, Artificial Sequence
  Synthetic oligonucleotide; CTA chr11 5365161 5365182 5365166 5365161 -
cactctaaatgtctacagaact

SEQ ID NO: 119073 - DNA, 22 bp, Artificial Sequence
  Synthetic oligonucleotide; CTC chr11 5365156 5365177 5365161 5365156 -
taaatgtctacagaactcacca

SEQ ID NO: 119074 - DNA, 22 bp, Artificial Sequence
  Synthetic oligonucleotide; CTA chr11 5365154 5365175 5365159 5365154 -
aatgtctacagaactcaccaga

SEQ ID NO: 119075 - DNA, 22 bp, Artificial Sequence
  Synthetic oligonucleotide; CTA chr11 5365146 5365167 5365151 5365146 -
cagaactcaccagacaaagaag

SEQ ID NO: 119076 - DNA, 22 bp, Artificial Sequence
  Synthetic oligonucleotide; CTC chr11 5365138 5365159 5365143 5365138 -
accagacaaagaagaaaagtta

SEQ ID NO: 119077 - DNA, 22 bp, Artificial Sequence
  Synthetic oligonucleotide; TTA chr11 5365116 5365137 5365121 5365116 -
tttagcagttgtgataagctac

SEQ ID NO: 119078 - DNA, 22 bp, Artificial Sequence
  Synthetic oligonucleotide; TTT chr11 5365113 5365134 5365118 5365113 -
agcagttgtgataagctaccac

SEQ ID NO: 119079 - DNA, 22 bp, Artificial Sequence
  Synthetic oligonucleotide; TTA chr11 5365112 5365133 5365117 5365112 -
gcagttgtgataagctaccact

SEQ ID NO: 119080 - DNA, 22 bp, Artificial Sequence
  Synthetic oligonucleotide; TTG chr11 5365105 5365126 5365110 5365105 -
tgataagctaccacttgaattc

SEQ ID NO: 119081 - DNA, 22 bp, Artificial Sequence
  Synthetic oligonucleotide; CTA chr11 5365095 5365116 5365100 5365095 -
ccacttgaattcaaggttatta

SEQ ID NO: 119082 - DNA, 22 bp, Artificial Sequence
  Synthetic oligonucleotide; CTT chr11 5365089 5365110 5365094 5365089 -
gaattcaaggttattacaagca

SEQ ID NO: 119083 - DNA, 22 bp, Artificial Sequence
  Synthetic oligonucleotide; TTG chr11 5365088 5365109 5365093 5365088 -
aattcaaggttattacaagcat

SEQ ID NO: 119084 - DNA, 22 bp, Artificial Sequence
  Synthetic oligonucleotide; TTC chr11 5365083 5365104 5365088 5365083 -
aaggttattacaagcatgatta

SEQ ID NO: 119085 - DNA, 22 bp, Artificial Sequence
  Synthetic oligonucleotide; TTA chr11 5365076 5365097 5365081 5365076 -
ttacaagcatgattattgacac

SEQ ID NO: 119086 - DNA, 22 bp, Artificial Sequence
  Synthetic oligonucleotide; TTA chr11 5365073 5365094 5365078 5365073 -
caagcatgattattgacacatt

SEQ ID NO: 119087 - DNA, 22 bp, Artificial Sequence
  Synthetic oligonucleotide; TTA chr11 5365061 5365082 5365066 5365061 -
ttgacacatttggttttattga

SEQ ID NO: 119088 - DNA, 22 bp, Artificial Sequence
  Synthetic oligonucleotide; TTG chr11 5365058 5365079 5365063 5365058 -
acacatttggttttattgagtg

SEQ ID NO: 119089 - DNA, 22 bp, Artificial Sequence
  Synthetic oligonucleotide; TTT chr11 5365050 5365071 5365055 5365050 -
ggttttattgagtgtcccttat

SEQ ID NO: 119090 - DNA, 22 bp, Artificial Sequence
  Synthetic oligonucleotide; TTG chr11 5365049 5365070 5365054 5365049 -
gttttattgagtgtcccttatt

SEQ ID NO: 119091 - DNA, 22 bp, Artificial Sequence
  Synthetic oligonucleotide; TTT chr11 5365045 5365066 5365050 5365045 -
tattgagtgtcccttatttgcc

SEQ ID NO: 119092 - DNA, 22 bp, Artificial Sequence
  Synthetic oligonucleotide; TTT chr11 5365044 5365065 5365049 5365044 -
attgagtgtcccttatttgccc

SEQ ID NO: 119093 - DNA, 22 bp, Artificial Sequence
  Synthetic oligonucleotide; TTA chr11 5365043 5365064 5365048 5365043 -
ttgagtgtcccttatttgccca

SEQ ID NO: 119094 - DNA, 22 bp, Artificial Sequence
  Synthetic oligonucleotide; TTG chr11 5365040 5365061 5365045 5365040 -
agtgtcccttatttgcccaaga

SEQ ID NO: 119095 - DNA, 22 bp, Artificial Sequence
  Synthetic oligonucleotide; CTT chr11 5365030 5365051 5365035 5365030 -
atttgcccaagattcattgctg

SEQ ID NO: 119096 - DNA, 22 bp, Artificial Sequence
  Synthetic oligonucleotide; TTA chr11 5365029 5365050 5365034 5365029 -
tttgcccaagattcattgctgt

SEQ ID NO: 119097 - DNA, 22 bp, Artificial Sequence
  Synthetic oligonucleotide; TTT chr11 5365026 5365047 5365031 5365026 -
gcccaagattcattgctgtgac

SEQ ID NO: 119098 - DNA, 22 bp, Artificial Sequence
  Synthetic oligonucleotide; TTG chr11 5365025 5365046 5365030 5365025 -
cccaagattcattgctgtgaca

SEQ ID NO: 119099 - DNA, 22 bp, Artificial Sequence
  Synthetic oligonucleotide; TTC chr11 5365015 5365036 5365020 5365015 -
attgctgtgacaagaatgacaa

SEQ ID NO: 119100 - DNA, 22 bp, Artificial Sequence
  Synthetic oligonucleotide; TTG chr11 5365011 5365032 5365016 5365011 -
ctgtgacaagaatgacaagaag

SEQ ID NO: 119101 - DNA, 22 bp, Artificial Sequence
  Synthetic oligonucleotide; CTG chr11 5365008 5365029 5365013 5365008 -
tgacaagaatgacaagaagaag

SEQ ID NO: 119102 - DNA, 22 bp, Artificial Sequence
  Synthetic oligonucleotide; TTA chr11 5364980 5365001 5364985 5364980 -
cttgagaaatccccttgtagcc

SEQ ID NO: 119103 - DNA, 22 bp, Artificial Sequence
  Synthetic oligonucleotide; CTT chr11 5364977 5364998 5364982 5364977 -
gagaaatccccttgtagccttc

SEQ ID NO: 119104 - DNA, 22 bp, Artificial Sequence
  Synthetic oligonucleotide; TTG chr11 5364976 5364997 5364981 5364976 -
agaaatccccttgtagccttct

SEQ ID NO: 119105 - DNA, 22 bp, Artificial Sequence
  Synthetic oligonucleotide; CTT chr11 5364964 5364985 5364969 5364964 -
gtagccttctgttacttcattt

SEQ ID NO: 119106 - DNA, 22 bp, Artificial Sequence
  Synthetic oligonucleotide; TTG chr11 5364963 5364984 5364968 5364963 -
tagccttctgttacttcatttt

SEQ ID NO: 119107 - DNA, 22 bp, Artificial Sequence
  Synthetic oligonucleotide; CTT chr11 5364956 5364977 5364961 5364956 -
ctgttacttcatttttttccct

SEQ ID NO: 119108 - DNA, 22 bp, Artificial Sequence
  Synthetic oligonucleotide; TTC chr11 5364955 5364976 5364960 5364955 -
tgttacttcatttttttccctc

SEQ ID NO: 119109 - DNA, 22 bp, Artificial Sequence
  Synthetic oligonucleotide; CTG chr11 5364953 5364974 5364958 5364953 -
ttacttcatttttttccctctc

SEQ ID NO: 119110 - DNA, 22 bp, Artificial Sequence
  Synthetic oligonucleotide; TTA chr11 5364950 5364971 5364955 5364950 -
cttcatttttttccctctctct

SEQ ID NO: 119111 - DNA, 22 bp, Artificial Sequence
  Synthetic oligonucleotide; CTT chr11 5364947 5364968 5364952 5364947 -
catttttttccctctctctctg

SEQ ID NO: 119112 - DNA, 22 bp, Artificial Sequence
  Synthetic oligonucleotide; TTC chr11 5364946 5364967 5364951 5364946 -
atttttttccctctctctctgc

SEQ ID NO: 119113 - DNA, 22 bp, Artificial Sequence
  Synthetic oligonucleotide; TTT chr11 5364942 5364963 5364947 5364942 -
ttttccctctctctctgcttct

SEQ ID NO: 119114 - DNA, 22 bp, Artificial Sequence
  Synthetic oligonucleotide; TTT chr11 5364941 5364962 5364946 5364941 -
tttccctctctctctgcttctc

SEQ ID NO: 119115 - DNA, 22 bp, Artificial Sequence
  Synthetic oligonucleotide; TTT chr11 5364940 5364961 5364945 5364940 -
ttccctctctctctgcttctcc

SEQ ID NO: 119116 - DNA, 22 bp, Artificial Sequence
  Synthetic oligonucleotide; TTT chr11 5364939 5364960 5364944 5364939 -
tccctctctctctgcttctcct

SEQ ID NO: 119117 - DNA, 22 bp, Artificial Sequence
  Synthetic oligonucleotide; TTT chr11 5364938 5364959 5364943 5364938 -
ccctctctctctgcttctcctt

SEQ ID NO: 119118 - DNA, 22 bp, Artificial Sequence
  Synthetic oligonucleotide; TTC chr11 5364937 5364958 5364942 5364937 -
cctctctctctgcttctccttg

SEQ ID NO: 119119 - DNA, 22 bp, Artificial Sequence
  Synthetic oligonucleotide; CTC chr11 5364933 5364954 5364938 5364933 -
tctctctgcttctccttgtgta

SEQ ID NO: 119120 - DNA, 22 bp, Artificial Sequence
  Synthetic oligonucleotide; CTC chr11 5364931 5364952 5364936 5364931 -
tctctgcttctccttgtgtatc

SEQ ID NO: 119121 - DNA, 22 bp, Artificial Sequence
  Synthetic oligonucleotide; CTC chr11 5364929 5364950 5364934 5364929 -
tctgcttctccttgtgtatcca

SEQ ID NO: 119122 - DNA, 22 bp, Artificial Sequence
  Synthetic oligonucleotide; CTC chr11 5364927 5364948 5364932 5364927 -
tgcttctccttgtgtatccacc

SEQ ID NO: 119123 - DNA, 22 bp, Artificial Sequence
  Synthetic oligonucleotide; CTG chr11 5364925 5364946 5364930 5364925 -
cttctccttgtgtatccaccat

SEQ ID NO: 119124 - DNA, 22 bp, Artificial Sequence
  Synthetic oligonucleotide; CTT chr11 5364922 5364943 5364927 5364922 -
ctccttgtgtatccaccataga

SEQ ID NO: 119125 - DNA, 22 bp, Artificial Sequence
  Synthetic oligonucleotide; TTC chr11 5364921 5364942 5364926 5364921 -
tccttgtgtatccaccatagaa

SEQ ID NO: 119126 - DNA, 22 bp, Artificial Sequence
  Synthetic oligonucleotide; CTC chr11 5364919 5364940 5364924 5364919 -
cttgtgtatccaccatagaagc

SEQ ID NO: 119127 - DNA, 22 bp, Artificial Sequence
  Synthetic oligonucleotide; CTT chr11 5364916 5364937 5364921 5364916 -
gtgtatccaccatagaagctac

SEQ ID NO: 119128 - DNA, 22 bp, Artificial Sequence
  Synthetic oligonucleotide; TTG chr11 5364915 5364936 5364920 5364915 -
tgtatccaccatagaagctaca

SEQ ID NO: 119129 - DNA, 22 bp, Artificial Sequence
  Synthetic oligonucleotide; CTA chr11 5364895 5364916 5364900 5364895 -
caatgattaaaaattatttact

SEQ ID NO: 119130 - DNA, 22 bp, Artificial Sequence
  Synthetic oligonucleotide; TTA chr11 5364886 5364907 5364891 5364886 -
aaaattatttactaaaatcatt

SEQ ID NO: 119131 - DNA, 22 bp, Artificial Sequence
  Synthetic oligonucleotide; TTA chr11 5364879 5364900 5364884 5364879 -
tttactaaaatcatttaataaa

SEQ ID NO: 119132 - DNA, 22 bp, Artificial Sequence
  Synthetic oligonucleotide; TTT chr11 5364876 5364897 5364881 5364876 -
actaaaatcatttaataaaact

SEQ ID NO: 119133 - DNA, 22 bp, Artificial Sequence
  Synthetic oligonucleotide; TTA chr11 5364875 5364896 5364880 5364875 -
ctaaaatcatttaataaaacta

SEQ ID NO: 119134 - DNA, 22 bp, Artificial Sequence
  Synthetic oligonucleotide; CTA chr11 5364872 5364893 5364877 5364872 -
aaatcatttaataaaactatat

SEQ ID NO: 119135 - DNA, 22 bp, Artificial Sequence
  Synthetic oligonucleotide; TTT chr11 5364863 5364884 5364868 5364863 -
aataaaactatattaaatggaa

SEQ ID NO: 119136 - DNA, 22 bp, Artificial Sequence
  Synthetic oligonucleotide; TTA chr11 5364862 5364883 5364867 5364862 -
ataaaactatattaaatggaaa

SEQ ID NO: 119137 - DNA, 22 bp, Artificial Sequence
  Synthetic oligonucleotide; CTA chr11 5364853 5364874 5364858 5364853 -
tattaaatggaaattcaccaat

SEQ ID NO: 119138 - DNA, 22 bp, Artificial Sequence
  Synthetic oligonucleotide; TTA chr11 5364848 5364869 5364853 5364848 -
aatggaaattcaccaatagaaa

SEQ ID NO: 119139 - DNA, 22 bp, Artificial Sequence
  Synthetic oligonucleotide; TTC chr11 5364837 5364858 5364842 5364837 -
accaatagaaacttaggaaagg

SEQ ID NO: 119140 - DNA, 22 bp, Artificial Sequence
  Synthetic oligonucleotide; CTT chr11 5364823 5364844 5364828 5364823 -
aggaaaggtaacaaagtcctgt

SEQ ID NO: 119141 - DNA, 22 bp, Artificial Sequence
  Synthetic oligonucleotide; TTA chr11 5364822 5364843 5364827 5364822 -
ggaaaggtaacaaagtcctgtg

SEQ ID NO: 119142 - DNA, 22 bp, Artificial Sequence
  Synthetic oligonucleotide; CTG chr11 5364802 5364823 5364807 5364802 -
tgaggttggcttcagcatatcc

SEQ ID NO: 119143 - DNA, 22 bp, Artificial Sequence
  Synthetic oligonucleotide; TTG chr11 5364794 5364815 5364799 5364794 -
gcttcagcatatccagaacaca

SEQ ID NO: 119144 - DNA, 22 bp, Artificial Sequence
  Synthetic oligonucleotide; CTT chr11 5364790 5364811 5364795 5364790 -
cagcatatccagaacacatgct

SEQ ID NO: 119145 - DNA, 22 bp, Artificial Sequence
  Synthetic oligonucleotide; TTC chr11 5364789 5364810 5364794 5364789 -
agcatatccagaacacatgctc

SEQ ID NO: 119146 - DNA, 22 bp, Artificial Sequence
  Synthetic oligonucleotide; CTC chr11 5364767 5364788 5364772 5364767 -
aggaaggaagagggtgggggga

SEQ ID NO: 119147 - DNA, 22 bp, Artificial Sequence
  Synthetic oligonucleotide; CTG chr11 5364740 5364761 5364745 5364740 -
taaacaagggactttgatcatt

SEQ ID NO: 119148 - DNA, 22 bp, Artificial Sequence
  Synthetic oligonucleotide; CTT chr11 5364726 5364747 5364731 5364726 -
tgatcattcactttgaagagtc

SEQ ID NO: 119149 - DNA, 22 bp, Artificial Sequence
  Synthetic oligonucleotide; TTT chr11 5364725 5364746 5364730 5364725 -
gatcattcactttgaagagtct

SEQ ID NO: 119150 - DNA, 22 bp, Artificial Sequence
  Synthetic oligonucleotide; TTG chr11 5364724 5364745 5364729 5364724 -
atcattcactttgaagagtctt

SEQ ID NO: 119151 - DNA, 22 bp, Artificial Sequence
  Synthetic oligonucleotide; TTC chr11 5364717 5364738 5364722 5364717 -
actttgaagagtcttctgtcat

SEQ ID NO: 119152 - DNA, 22 bp, Artificial Sequence
  Synthetic oligonucleotide; CTT chr11 5364713 5364734 5364718 5364713 -
tgaagagtcttctgtcatatgc

SEQ ID NO: 119153 - DNA, 22 bp, Artificial Sequence
  Synthetic oligonucleotide; TTT chr11 5364712 5364733 5364717 5364712 -
gaagagtcttctgtcatatgct

SEQ ID NO: 119154 - DNA, 22 bp, Artificial Sequence
  Synthetic oligonucleotide; TTG chr11 5364711 5364732 5364716 5364711 -
aagagtcttctgtcatatgctg

SEQ ID NO: 119155 - DNA, 22 bp, Artificial Sequence
  Synthetic oligonucleotide; CTT chr11 5364702 5364723 5364707 5364702 -
ctgtcatatgctggatgggcaa

SEQ ID NO: 119156 - DNA, 22 bp, Artificial Sequence
  Synthetic oligonucleotide; TTC chr11 5364701 5364722 5364706 5364701 -
tgtcatatgctggatgggcaaa

SEQ ID NO: 119157 - DNA, 22 bp, Artificial Sequence
  Synthetic oligonucleotide; CTG chr11 5364699 5364720 5364704 5364699 -
tcatatgctggatgggcaaaca

SEQ ID NO: 119158 - DNA, 22 bp, Artificial Sequence
  Synthetic oligonucleotide; CTG chr11 5364689 5364710 5364694 5364689 -
gatgggcaaacagcttagaggg

SEQ ID NO: 119159 - DNA, 22 bp, Artificial Sequence
  Synthetic oligonucleotide; CTT chr11 5364673 5364694 5364678 5364673 -
agagggctgccttagagtgcac

SEQ ID NO: 119160 - DNA, 22 bp, Artificial Sequence
  Synthetic oligonucleotide; TTA chr11 5364672 5364693 5364677 5364672 -
gagggctgccttagagtgcaca

SEQ ID NO: 119161 - DNA, 22 bp, Artificial Sequence
  Synthetic oligonucleotide; CTG chr11 5364664 5364685 5364669 5364664 -
ccttagagtgcacaaaatcaga

SEQ ID NO: 119162 - DNA, 22 bp, Artificial Sequence
  Synthetic oligonucleotide; CTT chr11 5364660 5364681 5364665 5364660 -
agagtgcacaaaatcagagata

SEQ ID NO: 119163 - DNA, 22 bp, Artificial Sequence
  Synthetic oligonucleotide; TTA chr11 5364659 5364680 5364664 5364659 -
gagtgcacaaaatcagagatat

SEQ ID NO: 119164 - DNA, 22 bp, Artificial Sequence
  Synthetic oligonucleotide; TTC chr11 5364635 5364656 5364640 5364635 -
agagatgcacatgaggatggag

SEQ ID NO: 119165 - DNA, 22 bp, Artificial Sequence
  Synthetic oligonucleotide; CTC chr11 5364579 5364600 5364584 5364579 -
tcacgcttagtttattttttca

SEQ ID NO: 119166 - DNA, 22 bp, Artificial Sequence
  Synthetic oligonucleotide; CTC chr11 5364577 5364598 5364582 5364577 -
acgcttagtttattttttcatt

SEQ ID NO: 119167 - DNA, 22 bp, Artificial Sequence
  Synthetic oligonucleotide; CTT chr11 5364571 5364592 5364576 5364571 -
agtttattttttcatttaatac

SEQ ID NO: 119168 - DNA, 22 bp, Artificial Sequence
  Synthetic oligonucleotide; TTA chr11 5364570 5364591 5364575 5364570 -
gtttattttttcatttaataca

SEQ ID NO: 119169 - DNA, 22 bp, Artificial Sequence
  Synthetic oligonucleotide; TTT chr11 5364566 5364587 5364571 5364566 -
attttttcatttaatacagaat

SEQ ID NO: 119170 - DNA, 22 bp, Artificial Sequence
  Synthetic oligonucleotide; TTA chr11 5364565 5364586 5364570 5364565 -
ttttttcatttaatacagaata

SEQ ID NO: 119171 - DNA, 22 bp, Artificial Sequence
  Synthetic oligonucleotide; TTT chr11 5364562 5364583 5364567 5364562 -
tttcatttaatacagaatattt

SEQ ID NO: 119172 - DNA, 22 bp, Artificial Sequence
  Synthetic oligonucleotide; TTT chr11 5364561 5364582 5364566 5364561 -
ttcatttaatacagaatatttt

SEQ ID NO: 119173 - DNA, 22 bp, Artificial Sequence
  Synthetic oligonucleotide; TTT chr11 5364560 5364581 5364565 5364560 -
tcatttaatacagaatattttt

SEQ ID NO: 119174 - DNA, 22 bp, Artificial Sequence
  Synthetic oligonucleotide; TTT chr11 5364559 5364580 5364564 5364559 -
catttaatacagaatatttttt

SEQ ID NO: 119175 - DNA, 22 bp, Artificial Sequence
  Synthetic oligonucleotide; TTC chr11 5364558 5364579 5364563 5364558 -
atttaatacagaatatttttta

SEQ ID NO: 119176 - DNA, 22 bp, Artificial Sequence
  Synthetic oligonucleotide; TTT chr11 5364554 5364575 5364559 5364554 -
aatacagaatattttttaagct

SEQ ID NO: 119177 - DNA, 22 bp, Artificial Sequence
  Synthetic oligonucleotide; TTA chr11 5364553 5364574 5364558 5364553 -
atacagaatattttttaagctc

SEQ ID NO: 119178 - DNA, 22 bp, Artificial Sequence
  Synthetic oligonucleotide; TTT chr11 5364540 5364561 5364545 5364540 -
tttaagctcctactctcttcaa

SEQ ID NO: 119179 - DNA, 22 bp, Artificial Sequence
  Synthetic oligonucleotide; TTT chr11 5364539 5364560 5364544 5364539 -
ttaagctcctactctcttcaaa

SEQ ID NO: 119180 - DNA, 22 bp, Artificial Sequence
  Synthetic oligonucleotide; TTT chr11 5364538 5364559 5364543 5364538 -
taagctcctactctcttcaaag

SEQ ID NO: 119181 - DNA, 22 bp, Artificial Sequence
  Synthetic oligonucleotide; TTT chr11 5364537 5364558 5364542 5364537 -
aagctcctactctcttcaaagc

SEQ ID NO: 119182 - DNA, 22 bp, Artificial Sequence
  Synthetic oligonucleotide; TTA chr11 5364536 5364557 5364541 5364536 -
agctcctactctcttcaaagca

SEQ ID NO: 119183 - DNA, 22 bp, Artificial Sequence
  Synthetic oligonucleotide; CTC chr11 5364531 5364552 5364536 5364531 -
ctactctcttcaaagcactgtg

SEQ ID NO: 119184 - DNA, 22 bp, Artificial Sequence
  Synthetic oligonucleotide; CTA chr11 5364528 5364549 5364533 5364528 -
ctctcttcaaagcactgtgctt

SEQ ID NO: 119185 - DNA, 22 bp, Artificial Sequence
  Synthetic oligonucleotide; CTC chr11 5364525 5364546 5364530 5364525 -
tcttcaaagcactgtgcttaaa

SEQ ID NO: 119186 - DNA, 22 bp, Artificial Sequence
  Synthetic oligonucleotide; CTC chr11 5364523 5364544 5364528 5364523 -
ttcaaagcactgtgcttaaagc

SEQ ID NO: 119187 - DNA, 22 bp, Artificial Sequence
  Synthetic oligonucleotide; CTT chr11 5364521 5364542 5364526 5364521 -
caaagcactgtgcttaaagctg

SEQ ID NO: 119188 - DNA, 22 bp, Artificial Sequence
  Synthetic oligonucleotide; TTC chr11 5364520 5364541 5364525 5364520 -
aaagcactgtgcttaaagctgg

SEQ ID NO: 119189 - DNA, 22 bp, Artificial Sequence
  Synthetic oligonucleotide; CTG chr11 5364511 5364532 5364516 5364511 -
tgcttaaagctggcatgtagtt

SEQ ID NO: 119190 - DNA, 22 bp, Artificial Sequence
  Synthetic oligonucleotide; CTT chr11 5364506 5364527 5364511 5364506 -
aaagctggcatgtagttgaatt

SEQ ID NO: 119191 - DNA, 22 bp, Artificial Sequence
  Synthetic oligonucleotide; TTA chr11 5364505 5364526 5364510 5364505 -
aagctggcatgtagttgaattt

SEQ ID NO: 119192 - DNA, 22 bp, Artificial Sequence
  Synthetic oligonucleotide; CTG chr11 5364499 5364520 5364504 5364499 -
gcatgtagttgaatttatagtc

SEQ ID NO: 119193 - DNA, 22 bp, Artificial Sequence
  Synthetic oligonucleotide; TTG chr11 5364488 5364509 5364493 5364488 -
aatttatagtccagcaaggaga

SEQ ID NO: 119194 - DNA, 22 bp, Artificial Sequence
  Synthetic oligonucleotide; TTT chr11 5364483 5364504 5364488 5364483 -
atagtccagcaaggagactgac

SEQ ID NO: 119195 - DNA, 22 bp, Artificial Sequence
  Synthetic oligonucleotide; TTA chr11 5364482 5364503 5364487 5364482 -
tagtccagcaaggagactgacc

SEQ ID NO: 119196 - DNA, 22 bp, Artificial Sequence
  Synthetic oligonucleotide; CTG chr11 5364463 5364484 5364468 5364463 -
accattgagaattacaaatatg

SEQ ID NO: 119197 - DNA, 22 bp, Artificial Sequence
  Synthetic oligonucleotide; TTG chr11 5364456 5364477 5364461 5364456 -
agaattacaaatatggcaggaa

SEQ ID NO: 119198 - DNA, 22 bp, Artificial Sequence
  Synthetic oligonucleotide; TTA chr11 5364449 5364470 5364454 5364449 -
caaatatggcaggaatttctaa

SEQ ID NO: 119199 - DNA, 22 bp, Artificial Sequence
  Synthetic oligonucleotide; TTT chr11 5364431 5364452 5364436 5364431 -
ctaaacagaaagatgtgcagct

SEQ ID NO: 119200 - DNA, 22 bp, Artificial Sequence
  Synthetic oligonucleotide; TTC chr11 5364430 5364451 5364435 5364430 -
taaacagaaagatgtgcagctc

SEQ ID NO: 119201 - DNA, 22 bp, Artificial Sequence
  Synthetic oligonucleotide; CTA chr11 5364428 5364449 5364433 5364428 -
aacagaaagatgtgcagctctc

SEQ ID NO: 119202 - DNA, 22 bp, Artificial Sequence
  Synthetic oligonucleotide; CTC chr11 5364408 5364429 5364413 5364408 -
tcatatcctgtcacagaaatga

SEQ ID NO: 119203 - DNA, 22 bp, Artificial Sequence
  Synthetic oligonucleotide; CTC chr11 5364406 5364427 5364411 5364406 -
atatcctgtcacagaaatgaca

SEQ ID NO: 119204 - DNA, 22 bp, Artificial Sequence
  Synthetic oligonucleotide; CTG chr11 5364398 5364419 5364403 5364398 -
tcacagaaatgacacatcacat

SEQ ID NO: 119205 - DNA, 22 bp, Artificial Sequence
  Synthetic oligonucleotide; CTC chr11 5364371 5364392 5364376 5364371 -
ctaaactgcatcatagccttac

SEQ ID NO: 119206 - DNA, 22 bp, Artificial Sequence
  Synthetic oligonucleotide; CTA chr11 5364368 5364389 5364373 5364368 -
aactgcatcatagccttaccat

SEQ ID NO: 119207 - DNA, 22 bp, Artificial Sequence
  Synthetic oligonucleotide; CTG chr11 5364363 5364384 5364368 5364363 -
catcatagccttaccatgacct

SEQ ID NO: 119208 - DNA, 22 bp, Artificial Sequence
  Synthetic oligonucleotide; CTT chr11 5364351 5364372 5364356 5364351 -
accatgacctcctgtttctgca

SEQ ID NO: 119209 - DNA, 22 bp, Artificial Sequence
  Synthetic oligonucleotide; TTA chr11 5364350 5364371 5364355 5364350 -
ccatgacctcctgtttctgcat

SEQ ID NO: 119210 - DNA, 22 bp, Artificial Sequence
  Synthetic oligonucleotide; CTC chr11 5364340 5364361 5364345 5364340 -
ctgtttctgcatttggcttgcc

SEQ ID NO: 119211 - DNA, 22 bp, Artificial Sequence
  Synthetic oligonucleotide; CTG chr11 5364337 5364358 5364342 5364337 -
tttctgcatttggcttgcctcc

SEQ ID NO: 119212 - DNA, 22 bp, Artificial Sequence
  Synthetic oligonucleotide; TTT chr11 5364334 5364355 5364339 5364334 -
ctgcatttggcttgcctccata

SEQ ID NO: 119213 - DNA, 22 bp, Artificial Sequence
  Synthetic oligonucleotide; TTC chr11 5364333 5364354 5364338 5364333 -
tgcatttggcttgcctccatat

SEQ ID NO: 119214 - DNA, 22 bp, Artificial Sequence
  Synthetic oligonucleotide; CTG chr11 5364331 5364352 5364336 5364331 -
catttggcttgcctccatatca

SEQ ID NO: 119215 - DNA, 22 bp, Artificial Sequence
  Synthetic oligonucleotide; TTT chr11 5364326 5364347 5364331 5364326 -
ggcttgcctccatatcacccca

SEQ ID NO: 119216 - DNA, 22 bp, Artificial Sequence
  Synthetic oligonucleotide; TTG chr11 5364325 5364346 5364330 5364325 -
gcttgcctccatatcaccccaa

SEQ ID NO: 119217 - DNA, 22 bp, Artificial Sequence
  Synthetic oligonucleotide; CTT chr11 5364321 5364342 5364326 5364321 -
gcctccatatcaccccaaattc

SEQ ID NO: 119218 - DNA, 22 bp, Artificial Sequence
  Synthetic oligonucleotide; TTG chr11 5364320 5364341 5364325 5364320 -
cctccatatcaccccaaattcc

SEQ ID NO: 119219 - DNA, 22 bp, Artificial Sequence
  Synthetic oligonucleotide; CTC chr11 5364316 5364337 5364321 5364316 -
catatcaccccaaattccaatg

SEQ ID NO: 119220 - DNA, 22 bp, Artificial Sequence
  Synthetic oligonucleotide; TTC chr11 5364299 5364320 5364304 5364299 -
caatggttttgtgaagtcaaga

SEQ ID NO: 119221 - DNA, 22 bp, Artificial Sequence
  Synthetic oligonucleotide; TTT chr11 5364290 5364311 5364295 5364290 -
tgtgaagtcaagattggtggtc

SEQ ID NO: 119222 - DNA, 22 bp, Artificial Sequence
  Synthetic oligonucleotide; TTT chr11 5364289 5364310 5364294 5364289 -
gtgaagtcaagattggtggtca

SEQ ID NO: 119223 - DNA, 22 bp, Artificial Sequence
  Synthetic oligonucleotide; TTG chr11 5364288 5364309 5364293 5364288 -
tgaagtcaagattggtggtcaa

SEQ ID NO: 119224 - DNA, 22 bp, Artificial Sequence
  Synthetic oligonucleotide; TTG chr11 5364274 5364295 5364279 5364274 -
gtggtcaaggtcgagggaaagt

SEQ ID NO: 119225 - DNA, 22 bp, Artificial Sequence
  Synthetic oligonucleotide; CTC chr11 5364235 5364256 5364240 5364235 -
atctaactatgtcaaactttgt

SEQ ID NO: 119226 - DNA, 22 bp, Artificial Sequence
  Synthetic oligonucleotide; CTA chr11 5364230 5364251 5364235 5364230 -
actatgtcaaactttgtcatag

SEQ ID NO: 119227 - DNA, 22 bp, Artificial Sequence
  Synthetic oligonucleotide; CTA chr11 5364226 5364247 5364231 5364226 -
tgtcaaactttgtcatagctag

SEQ ID NO: 119228 - DNA, 22 bp, Artificial Sequence
  Synthetic oligonucleotide; CTT chr11 5364216 5364237 5364221 5364216 -
tgtcatagctagatgagctttt

SEQ ID NO: 119229 - DNA, 22 bp, Artificial Sequence
  Synthetic oligonucleotide; TTT chr11 5364215 5364236 5364220 5364215 -
gtcatagctagatgagcttttt

SEQ ID NO: 119230 - DNA, 22 bp, Artificial Sequence
  Synthetic oligonucleotide; TTG chr11 5364214 5364235 5364219 5364214 -
tcatagctagatgagctttttg

SEQ ID NO: 119231 - DNA, 22 bp, Artificial Sequence
  Synthetic oligonucleotide; CTA chr11 5364205 5364226 5364210 5364205 -
gatgagctttttgaacttaaag

SEQ ID NO: 119232 - DNA, 22 bp, Artificial Sequence
  Synthetic oligonucleotide; CTT chr11 5364196 5364217 5364201 5364196 -
tttgaacttaaagtttgtcaaa

SEQ ID NO: 119233 - DNA, 22 bp, Artificial Sequence
  Synthetic oligonucleotide; TTT chr11 5364195 5364216 5364200 5364195 -
ttgaacttaaagtttgtcaaaa

SEQ ID NO: 119234 - DNA, 22 bp, Artificial Sequence
  Synthetic oligonucleotide; TTT chr11 5364194 5364215 5364199 5364194 -
tgaacttaaagtttgtcaaaat

SEQ ID NO: 119235 - DNA, 22 bp, Artificial Sequence
  Synthetic oligonucleotide; TTT chr11 5364193 5364214 5364198 5364193 -
gaacttaaagtttgtcaaaatt

SEQ ID NO: 119236 - DNA, 22 bp, Artificial Sequence
  Synthetic oligonucleotide; TTG chr11 5364192 5364213 5364197 5364192 -
aacttaaagtttgtcaaaattt

SEQ ID NO: 119237 - DNA, 22 bp, Artificial Sequence
  Synthetic oligonucleotide; CTT chr11 5364187 5364208 5364192 5364187 -
aaagtttgtcaaaatttaggaa

SEQ ID NO: 119238 - DNA, 22 bp, Artificial Sequence
  Synthetic oligonucleotide; TTA chr11 5364186 5364207 5364191 5364186 -
aagtttgtcaaaatttaggaaa

SEQ ID NO: 119239 - DNA, 22 bp, Artificial Sequence
  Synthetic oligonucleotide; TTT chr11 5364180 5364201 5364185 5364180 -
gtcaaaatttaggaaaatattt

SEQ ID NO: 119240 - DNA, 22 bp, Artificial Sequence
  Synthetic oligonucleotide; TTG chr11 5364179 5364200 5364184 5364179 -
tcaaaatttaggaaaatatttt

SEQ ID NO: 119241 - DNA, 22 bp, Artificial Sequence
  Synthetic oligonucleotide; TTT chr11 5364170 5364191 5364175 5364170 -
aggaaaatattttgcccttagg

SEQ ID NO: 119242 - DNA, 22 bp, Artificial Sequence
  Synthetic oligonucleotide; TTA chr11 5364169 5364190 5364174 5364169 -
ggaaaatattttgcccttaggt

SEQ ID NO: 119243 - DNA, 22 bp, Artificial Sequence
  Synthetic oligonucleotide; TTT chr11 5364158 5364179 5364163 5364158 -
tgcccttaggtggtcgcttgtt

SEQ ID NO: 119244 - DNA, 22 bp, Artificial Sequence
  Synthetic oligonucleotide; TTT chr11 5364157 5364178 5364162 5364157 -
gcccttaggtggtcgcttgttg

SEQ ID NO: 119245 - DNA, 22 bp, Artificial Sequence
  Synthetic oligonucleotide; TTG chr11 5364156 5364177 5364161 5364156 -
cccttaggtggtcgcttgttga

SEQ ID NO: 119246 - DNA, 22 bp, Artificial Sequence
  Synthetic oligonucleotide; CTT chr11 5364151 5364172 5364156 5364151 -
aggtggtcgcttgttgaaccct

SEQ ID NO: 119247 - DNA, 22 bp, Artificial Sequence
  Synthetic oligonucleotide; TTA chr11 5364150 5364171 5364155 5364150 -
ggtggtcgcttgttgaaccctg

SEQ ID NO: 119248 - DNA, 22 bp, Artificial Sequence
  Synthetic oligonucleotide; CTT chr11 5364139 5364160 5364144 5364139 -
gttgaaccctgaaaattttact

SEQ ID NO: 119249 - DNA, 22 bp, Artificial Sequence
  Synthetic oligonucleotide; TTG chr11 5364138 5364159 5364143 5364138 -
ttgaaccctgaaaattttactc

SEQ ID NO: 119250 - DNA, 22 bp, Artificial Sequence
  Synthetic oligonucleotide; TTG chr11 5364135 5364156 5364140 5364135 -
aaccctgaaaattttactcttt

SEQ ID NO: 119251 - DNA, 22 bp, Artificial Sequence
  Synthetic oligonucleotide; CTG chr11 5364128 5364149 5364133 5364128 -
aaaattttactctttctttagt

SEQ ID NO: 119252 - DNA, 22 bp, Artificial Sequence
  Synthetic oligonucleotide; TTT chr11 5364121 5364142 5364126 5364121 -
tactctttctttagtgttgaga

SEQ ID NO: 119253 - DNA, 22 bp, Artificial Sequence
  Synthetic oligonucleotide; TTT chr11 5364120 5364141 5364125 5364120 -
actctttctttagtgttgagat

SEQ ID NO: 119254 - DNA, 22 bp, Artificial Sequence
  Synthetic oligonucleotide; TTA chr11 5364119 5364140 5364124 5364119 -
ctctttctttagtgttgagata

SEQ ID NO: 119255 - DNA, 22 bp, Artificial Sequence
  Synthetic oligonucleotide; CTC chr11 5364116 5364137 5364121 5364116 -
tttctttagtgttgagatacct

SEQ ID NO: 119256 - DNA, 22 bp, Artificial Sequence
  Synthetic oligonucleotide; CTT chr11 5364114 5364135 5364119 5364114 -
tctttagtgttgagatacctct

SEQ ID NO: 119257 - DNA, 22 bp, Artificial Sequence
  Synthetic oligonucleotide; TTT chr11 5364113 5364134 5364118 5364113 -
ctttagtgttgagatacctctt

SEQ ID NO: 119258 - DNA, 22 bp, Artificial Sequence
  Synthetic oligonucleotide; TTC chr11 5364112 5364133 5364117 5364112 -
tttagtgttgagatacctcttc

SEQ ID NO: 119259 - DNA, 22 bp, Artificial Sequence
  Synthetic oligonucleotide; CTT chr11 5364110 5364131 5364115 5364110 -
tagtgttgagatacctcttcct

SEQ ID NO: 119260 - DNA, 22 bp, Artificial Sequence
  Synthetic oligonucleotide; TTT chr11 5364109 5364130 5364114 5364109 -
agtgttgagatacctcttcctt

SEQ ID NO: 119261 - DNA, 22 bp, Artificial Sequence
  Synthetic oligonucleotide; TTA chr11 5364108 5364129 5364113 5364108 -
gtgttgagatacctcttccttt

SEQ ID NO: 119262 - DNA, 22 bp, Artificial Sequence
  Synthetic oligonucleotide; TTG chr11 5364102 5364123 5364107 5364102 -
agatacctcttcctttattgaa

SEQ ID NO: 119263 - DNA, 22 bp, Artificial Sequence
  Synthetic oligonucleotide; CTC chr11 5364093 5364114 5364098 5364093 -
ttcctttattgaatctataatc

SEQ ID NO: 119264 - DNA, 22 bp, Artificial Sequence
  Synthetic oligonucleotide; CTT chr11 5364091 5364112 5364096 5364091 -
cctttattgaatctataatcga

SEQ ID NO: 119265 - DNA, 22 bp, Artificial Sequence
  Synthetic oligonucleotide; TTC chr11 5364090 5364111 5364095 5364090 -
ctttattgaatctataatcgac

SEQ ID NO: 119266 - DNA, 22 bp, Artificial Sequence
  Synthetic oligonucleotide; CTT chr11 5364087 5364108 5364092 5364087 -
tattgaatctataatcgacctt

SEQ ID NO: 119267 - DNA, 22 bp, Artificial Sequence
  Synthetic oligonucleotide; TTT chr11 5364086 5364107 5364091 5364086 -
attgaatctataatcgacctta

SEQ ID NO: 119268 - DNA, 22 bp, Artificial Sequence
  Synthetic oligonucleotide; TTA chr11 5364085 5364106 5364090 5364085 -
ttgaatctataatcgaccttat

SEQ ID NO: 119269 - DNA, 22 bp, Artificial Sequence
  Synthetic oligonucleotide; TTG chr11 5364082 5364103 5364087 5364082 -
aatctataatcgaccttattgc

SEQ ID NO: 119270 - DNA, 22 bp, Artificial Sequence
  Synthetic oligonucleotide; CTA chr11 5364076 5364097 5364081 5364076 -
taatcgaccttattgcaaccat

SEQ ID NO: 119271 - DNA, 22 bp, Artificial Sequence
  Synthetic oligonucleotide; CTT chr11 5364065 5364086 5364070 5364065 -
attgcaaccatggagaatgaga

SEQ ID NO: 119272 - DNA, 22 bp, Artificial Sequence
  Synthetic oligonucleotide; TTA chr11 5364064 5364085 5364069 5364064 -
ttgcaaccatggagaatgagat

SEQ ID NO: 119273 - DNA, 22 bp, Artificial Sequence
  Synthetic oligonucleotide; TTG chr11 5364061 5364082 5364066 5364061 -
caaccatggagaatgagatagt

SEQ ID NO: 119274 - DNA, 22 bp, Artificial Sequence
  Synthetic oligonucleotide; CTG chr11 5364034 5364055 5364039 5364034 -
gctcagaggtccacatcacata

SEQ ID NO: 119275 - DNA, 22 bp, Artificial Sequence
  Synthetic oligonucleotide; CTC chr11 5364030 5364051 5364035 5364030 -
agaggtccacatcacataatat

SEQ ID NO: 119276 - DNA, 22 bp, Artificial Sequence
  Synthetic oligonucleotide; CTA chr11 5363995 5364016 5364000 5363995 -
tcactacactgttgtgaagccc

SEQ ID NO: 119277 - DNA, 22 bp, Artificial Sequence
  Synthetic oligonucleotide; CTA chr11 5363989 5364010 5363994 5363989 -
cactgttgtgaagccctgttct

SEQ ID NO: 119278 - DNA, 22 bp, Artificial Sequence
  Synthetic oligonucleotide; CTG chr11 5363984 5364005 5363989 5363984 -
ttgtgaagccctgttctccagc

SEQ ID NO: 119279 - DNA, 22 bp, Artificial Sequence
  Synthetic oligonucleotide; TTG chr11 5363981 5364002 5363986 5363981 -
tgaagccctgttctccagccca

SEQ ID NO: 119280 - DNA, 22 bp, Artificial Sequence
  Synthetic oligonucleotide; CTG chr11 5363971 5363992 5363976 5363971 -
ttctccagcccaggcattcttc

SEQ ID NO: 119281 - DNA, 22 bp, Artificial Sequence
  Synthetic oligonucleotide; TTC chr11 5363968 5363989 5363973 5363968 -
tccagcccaggcattcttccat

SEQ ID NO: 119282 - DNA, 22 bp, Artificial Sequence
  Synthetic oligonucleotide; CTC chr11 5363966 5363987 5363971 5363966 -
cagcccaggcattcttccattc

SEQ ID NO: 119283 - DNA, 22 bp, Artificial Sequence
  Synthetic oligonucleotide; TTC chr11 5363952 5363973 5363957 5363952 -
ttccattcctaacacaagcttc

SEQ ID NO: 119284 - DNA, 22 bp, Artificial Sequence
  Synthetic oligonucleotide; CTT chr11 5363950 5363971 5363955 5363950 -
ccattcctaacacaagcttctc

SEQ ID NO: 119285 - DNA, 22 bp, Artificial Sequence
  Synthetic oligonucleotide; TTC chr11 5363949 5363970 5363954 5363949 -
cattcctaacacaagcttctcc

SEQ ID NO: 119286 - DNA, 22 bp, Artificial Sequence
  Synthetic oligonucleotide; TTC chr11 5363944 5363965 5363949 5363944 -
ctaacacaagcttctcctcctt

SEQ ID NO: 119287 - DNA, 22 bp, Artificial Sequence
  Synthetic oligonucleotide; CTA chr11 5363941 5363962 5363946 5363941 -
acacaagcttctcctcctttac

SEQ ID NO: 119288 - DNA, 22 bp, Artificial Sequence
  Synthetic oligonucleotide; CTT chr11 5363931 5363952 5363936 5363931 -
ctcctcctttacagaaatgggt

SEQ ID NO: 119289 - DNA, 22 bp, Artificial Sequence
  Synthetic oligonucleotide; TTC chr11 5363930 5363951 5363935 5363930 -
tcctcctttacagaaatgggtc

SEQ ID NO: 119290 - DNA, 22 bp, Artificial Sequence
  Synthetic oligonucleotide; CTC chr11 5363928 5363949 5363933 5363928 -
ctcctttacagaaatgggtctg

SEQ ID NO: 119291 - DNA, 22 bp, Artificial Sequence
  Synthetic oligonucleotide; CTC chr11 5363925 5363946 5363930 5363925 -
ctttacagaaatgggtctgagt

SEQ ID NO: 119292 - DNA, 22 bp, Artificial Sequence
  Synthetic oligonucleotide; CTT chr11 5363922 5363943 5363927 5363922 -
tacagaaatgggtctgagttgc

SEQ ID NO: 119293 - DNA, 22 bp, Artificial Sequence
  Synthetic oligonucleotide; TTT chr11 5363921 5363942 5363926 5363921 -
acagaaatgggtctgagttgcc

SEQ ID NO: 119294 - DNA, 22 bp, Artificial Sequence
  Synthetic oligonucleotide; TTA chr11 5363920 5363941 5363925 5363920 -
cagaaatgggtctgagttgcct

SEQ ID NO: 119295 - DNA, 22 bp, Artificial Sequence
  Synthetic oligonucleotide; CTG chr11 5363906 5363927 5363911 5363906 -
agttgcctatttttatacctgc

SEQ ID NO: 119296 - DNA, 22 bp, Artificial Sequence
  Synthetic oligonucleotide; TTG chr11 5363901 5363922 5363906 5363901 -
cctatttttatacctgccatgt

SEQ ID NO: 119297 - DNA, 22 bp, Artificial Sequence
  Synthetic oligonucleotide; CTA chr11 5363897 5363918 5363902 5363897 -
tttttatacctgccatgtcatg

SEQ ID NO: 119298 - DNA, 22 bp, Artificial Sequence
  Synthetic oligonucleotide; TTT chr11 5363894 5363915 5363899 5363894 -
ttatacctgccatgtcatgctg

SEQ ID NO: 119299 - DNA, 22 bp, Artificial Sequence
  Synthetic oligonucleotide; TTT chr11 5363893 5363914 5363898 5363893 -
tatacctgccatgtcatgctga

SEQ ID NO: 119300 - DNA, 22 bp, Artificial Sequence
  Synthetic oligonucleotide; TTT chr11 5363892 5363913 5363897 5363892 -
atacctgccatgtcatgctgag

SEQ ID NO: 119301 - DNA, 22 bp, Artificial Sequence
  Synthetic oligonucleotide; TTA chr11 5363891 5363912 5363896 5363891 -
tacctgccatgtcatgctgagt

SEQ ID NO: 119302 - DNA, 22 bp, Artificial Sequence
  Synthetic oligonucleotide; CTG chr11 5363885 5363906 5363890 5363885 -
ccatgtcatgctgagtgggggc

SEQ ID NO: 119303 - DNA, 22 bp, Artificial Sequence
  Synthetic oligonucleotide; CTG chr11 5363872 5363893 5363877 5363872 -
agtgggggctggggtttgcaaa

SEQ ID NO: 119304 - DNA, 22 bp, Artificial Sequence
  Synthetic oligonucleotide; CTG chr11 5363861 5363882 5363866 5363861 -
gggtttgcaaagagagaagaca

SEQ ID NO: 119305 - DNA, 22 bp, Artificial Sequence
  Synthetic oligonucleotide; TTT chr11 5363855 5363876 5363860 5363855 -
gcaaagagagaagacagctagg

SEQ ID NO: 119306 - DNA, 22 bp, Artificial Sequence
  Synthetic oligonucleotide; TTG chr11 5363854 5363875 5363859 5363854 -
caaagagagaagacagctaggg

SEQ ID NO: 119307 - DNA, 22 bp, Artificial Sequence
  Synthetic oligonucleotide; CTA chr11 5363835 5363856 5363840 5363835 -
gggaacataattgctatggtaa

SEQ ID NO: 119308 - DNA, 22 bp, Artificial Sequence
  Synthetic oligonucleotide; TTG chr11 5363822 5363843 5363827 5363822 -
ctatggtaattgctttctattg

SEQ ID NO: 119309 - DNA, 22 bp, Artificial Sequence
  Synthetic oligonucleotide; CTA chr11 5363819 5363840 5363824 5363819 -
tggtaattgctttctattgtac

SEQ ID NO: 119310 - DNA, 22 bp, Artificial Sequence
  Synthetic oligonucleotide; TTG chr11 5363810 5363831 5363815 5363810 -
ctttctattgtacactaaatat

SEQ ID NO: 119311 - DNA, 22 bp, Artificial Sequence
  Synthetic oligonucleotide; CTT chr11 5363807 5363828 5363812 5363807 -
tctattgtacactaaatatagt

SEQ ID NO: 119312 - DNA, 22 bp, Artificial Sequence
  Synthetic oligonucleotide; TTT chr11 5363806 5363827 5363811 5363806 -
ctattgtacactaaatatagtc

SEQ ID NO: 119313 - DNA, 22 bp, Artificial Sequence
  Synthetic oligonucleotide; TTC chr11 5363805 5363826 5363810 5363805 -
tattgtacactaaatatagtct

SEQ ID NO: 119314 - DNA, 22 bp, Artificial Sequence
  Synthetic oligonucleotide; CTA chr11 5363803 5363824 5363808 5363803 -
ttgtacactaaatatagtctgg

SEQ ID NO: 119315 - DNA, 22 bp, Artificial Sequence
  Synthetic oligonucleotide; TTG chr11 5363800 5363821 5363805 5363800 -
tacactaaatatagtctggatg

SEQ ID NO: 119316 - DNA, 22 bp, Artificial Sequence
  Synthetic oligonucleotide; CTA chr11 5363793 5363814 5363798 5363793 -
aatatagtctggatgtattgca

SEQ ID NO: 119317 - DNA, 22 bp, Artificial Sequence
  Synthetic oligonucleotide; CTG chr11 5363782 5363803 5363787 5363782 -
gatgtattgcatatggtcccta

SEQ ID NO: 119318 - DNA, 22 bp, Artificial Sequence
  Synthetic oligonucleotide; TTG chr11 5363773 5363794 5363778 5363773 -
catatggtccctagtttttaat

SEQ ID NO: 119319 - DNA, 22 bp, Artificial Sequence
  Synthetic oligonucleotide; CTA chr11 5363760 5363781 5363765 5363760 -
gtttttaatagaatcctcatga

SEQ ID NO: 119320 - DNA, 22 bp, Artificial Sequence
  Synthetic oligonucleotide; TTT chr11 5363756 5363777 5363761 5363756 -
ttaatagaatcctcatgaaaat

SEQ ID NO: 119321 - DNA, 22 bp, Artificial Sequence
  Synthetic oligonucleotide; TTT chr11 5363755 5363776 5363760 5363755 -
taatagaatcctcatgaaaatg

SEQ ID NO: 119322 - DNA, 22 bp, Artificial Sequence
  Synthetic oligonucleotide; TTT chr11 5363754 5363775 5363759 5363754 -
aatagaatcctcatgaaaatgc

SEQ ID NO: 119323 - DNA, 22 bp, Artificial Sequence
  Synthetic oligonucleotide; TTA chr11 5363753 5363774 5363758 5363753 -
atagaatcctcatgaaaatgct

SEQ ID NO: 119324 - DNA, 22 bp, Artificial Sequence
  Synthetic oligonucleotide; CTC chr11 5363742 5363763 5363747 5363742 -
atgaaaatgctactttcccgct

SEQ ID NO: 119325 - DNA, 22 bp, Artificial Sequence
  Synthetic oligonucleotide; CTA chr11 5363730 5363751 5363735 5363730 -
ctttcccgctttccaataacag

SEQ ID NO: 119326 - DNA, 22 bp, Artificial Sequence
  Synthetic oligonucleotide; CTT chr11 5363727 5363748 5363732 5363727 -
tcccgctttccaataacagaat

SEQ ID NO: 119327 - DNA, 22 bp, Artificial Sequence
  Synthetic oligonucleotide; TTT chr11 5363726 5363747 5363731 5363726 -
cccgctttccaataacagaatg

SEQ ID NO: 119328 - DNA, 22 bp, Artificial Sequence
  Synthetic oligonucleotide; TTC chr11 5363725 5363746 5363730 5363725 -
ccgctttccaataacagaatga

SEQ ID NO: 119329 - DNA, 22 bp, Artificial Sequence
  Synthetic oligonucleotide; CTT chr11 5363719 5363740 5363724 5363719 -
tccaataacagaatgatggaaa

SEQ ID NO: 119330 - DNA, 22 bp, Artificial Sequence
  Synthetic oligonucleotide; TTT chr11 5363718 5363739 5363723 5363718 -
ccaataacagaatgatggaaag

SEQ ID NO: 119331 - DNA, 22 bp, Artificial Sequence
  Synthetic oligonucleotide; TTC chr11 5363717 5363738 5363722 5363717 -
caataacagaatgatggaaaga

SEQ ID NO: 119332 - DNA, 22 bp, Artificial Sequence
  Synthetic oligonucleotide; CTT chr11 5363691 5363712 5363696 5363691 -
cacaagtccaaacacaagcaaa

SEQ ID NO: 119333 - DNA, 22 bp, Artificial Sequence
  Synthetic oligonucleotide; TTC chr11 5363690 5363711 5363695 5363690 -
acaagtccaaacacaagcaaat

SEQ ID NO: 119334 - DNA, 22 bp, Artificial Sequence
  Synthetic oligonucleotide; TTG chr11 5363650 5363671 5363655 5363650 -
ttctttttctgtgtcacataag

SEQ ID NO: 119335 - DNA, 22 bp, Artificial Sequence
  Synthetic oligonucleotide; TTC chr11 5363647 5363668 5363652 5363647 -
tttttctgtgtcacataagatt

SEQ ID NO: 119336 - DNA, 22 bp, Artificial Sequence
  Synthetic oligonucleotide; CTT chr11 5363645 5363666 5363650 5363645 -
tttctgtgtcacataagattcc

SEQ ID NO: 119337 - DNA, 22 bp, Artificial Sequence
  Synthetic oligonucleotide; TTT chr11 5363644 5363665 5363649 5363644 -
ttctgtgtcacataagattcca

SEQ ID NO: 119338 - DNA, 22 bp, Artificial Sequence
  Synthetic oligonucleotide; TTT chr11 5363643 5363664 5363648 5363643 -
tctgtgtcacataagattccag

SEQ ID NO: 119339 - DNA, 22 bp, Artificial Sequence
  Synthetic oligonucleotide; TTT chr11 5363642 5363663 5363647 5363642 -
ctgtgtcacataagattccaga

SEQ ID NO: 119340 - DNA, 22 bp, Artificial Sequence
  Synthetic oligonucleotide; TTC chr11 5363641 5363662 5363646 5363641 -
tgtgtcacataagattccagac

SEQ ID NO: 119341 - DNA, 22 bp, Artificial Sequence
  Synthetic oligonucleotide; CTG chr11 5363639 5363660 5363644 5363639 -
tgtcacataagattccagacaa

SEQ ID NO: 119342 - DNA, 22 bp, Artificial Sequence
  Synthetic oligonucleotide; TTC chr11 5363624 5363645 5363629 5363624 -
cagacaatataatcttagtagt

SEQ ID NO: 119343 - DNA, 22 bp, Artificial Sequence
  Synthetic oligonucleotide; CTT chr11 5363608 5363629 5363613 5363608 -
agtagtatctatgagaaaaatc

SEQ ID NO: 119344 - DNA, 22 bp, Artificial Sequence
  Synthetic oligonucleotide; TTA chr11 5363607 5363628 5363612 5363607 -
gtagtatctatgagaaaaatct

SEQ ID NO: 119345 - DNA, 22 bp, Artificial Sequence
  Synthetic oligonucleotide; CTA chr11 5363597 5363618 5363602 5363597 -
tgagaaaaatctacctcaatat

SEQ ID NO: 119346 - DNA, 22 bp, Artificial Sequence
  Synthetic oligonucleotide; CTA chr11 5363584 5363605 5363589 5363584 -
cctcaatatatcttctttctgc

SEQ ID NO: 119347 - DNA, 22 bp, Artificial Sequence
  Synthetic oligonucleotide; CTC chr11 5363580 5363601 5363585 5363580 -
aatatatcttctttctgcattc

SEQ ID NO: 119348 - DNA, 22 bp, Artificial Sequence
  Synthetic oligonucleotide; CTT chr11 5363570 5363591 5363575 5363570 -
ctttctgcattcacactcaaaa

SEQ ID NO: 119349 - DNA, 22 bp, Artificial Sequence
  Synthetic oligonucleotide; TTC chr11 5363569 5363590 5363574 5363569 -
tttctgcattcacactcaaaaa

SEQ ID NO: 119350 - DNA, 22 bp, Artificial Sequence
  Synthetic oligonucleotide; CTT chr11 5363567 5363588 5363572 5363567 -
tctgcattcacactcaaaaact

SEQ ID NO: 119351 - DNA, 22 bp, Artificial Sequence
  Synthetic oligonucleotide; TTT chr11 5363566 5363587 5363571 5363566 -
ctgcattcacactcaaaaactt

SEQ ID NO: 119352 - DNA, 22 bp, Artificial Sequence
  Synthetic oligonucleotide; TTC chr11 5363565 5363586 5363570 5363565 -
tgcattcacactcaaaaacttg

SEQ ID NO: 119353 - DNA, 22 bp, Artificial Sequence
  Synthetic oligonucleotide; CTG chr11 5363563 5363584 5363568 5363563 -
cattcacactcaaaaacttggt

SEQ ID NO: 119354 - DNA, 22 bp, Artificial Sequence
  Synthetic oligonucleotide; TTC chr11 5363558 5363579 5363563 5363558 -
acactcaaaaacttggtatctg

SEQ ID NO: 119355 - DNA, 22 bp, Artificial Sequence
  Synthetic oligonucleotide; CTC chr11 5363552 5363573 5363557 5363552 -
aaaaacttggtatctgtgcttg

SEQ ID NO: 119356 - DNA, 22 bp, Artificial Sequence
  Synthetic oligonucleotide; CTT chr11 5363544 5363565 5363549 5363544 -
ggtatctgtgcttggtttaata

SEQ ID NO: 119357 - DNA, 22 bp, Artificial Sequence
  Synthetic oligonucleotide; TTG chr11 5363543 5363564 5363548 5363543 -
gtatctgtgcttggtttaataa

SEQ ID NO: 119358 - DNA, 22 bp, Artificial Sequence
  Synthetic oligonucleotide; CTG chr11 5363536 5363557 5363541 5363536 -
tgcttggtttaataaaagtagt

SEQ ID NO: 119359 - DNA, 22 bp, Artificial Sequence
  Synthetic oligonucleotide; CTT chr11 5363531 5363552 5363536 5363531 -
ggtttaataaaagtagtgagtg

SEQ ID NO: 119360 - DNA, 22 bp, Artificial Sequence
  Synthetic oligonucleotide; TTG chr11 5363530 5363551 5363535 5363530 -
gtttaataaaagtagtgagtgt

SEQ ID NO: 119361 - DNA, 22 bp, Artificial Sequence
  Synthetic oligonucleotide; TTT chr11 5363526 5363547 5363531 5363526 -
aataaaagtagtgagtgtacct

SEQ ID NO: 119362 - DNA, 22 bp, Artificial Sequence
  Synthetic oligonucleotide; TTA chr11 5363525 5363546 5363530 5363525 -
ataaaagtagtgagtgtacctc

SEQ ID NO: 119363 - DNA, 22 bp, Artificial Sequence
  Synthetic oligonucleotide; CTC chr11 5363503 5363524 5363508 5363503 -
atggagctgagtggtggtgatg

SEQ ID NO: 119364 - DNA, 22 bp, Artificial Sequence
  Synthetic oligonucleotide; CTG chr11 5363494 5363515 5363499 5363494 -
agtggtggtgatgtgtgtttat

SEQ ID NO: 119365 - DNA, 22 bp, Artificial Sequence
  Synthetic oligonucleotide; TTT chr11 5363474 5363495 5363479 5363474 -
atgattgtgtgtgtggcgcttt

SEQ ID NO: 119366 - DNA, 22 bp, Artificial Sequence
  Synthetic oligonucleotide; TTA chr11 5363473 5363494 5363478 5363473 -
tgattgtgtgtgtggcgctttt

SEQ ID NO: 119367 - DNA, 22 bp, Artificial Sequence
  Synthetic oligonucleotide; TTG chr11 5363467 5363488 5363472 5363467 -
tgtgtgtggcgcttttgtgtga

SEQ ID NO: 119368 - DNA, 22 bp, Artificial Sequence
  Synthetic oligonucleotide; CTT chr11 5363453 5363474 5363458 5363453 -
ttgtgtgagagagagagtgtgt

SEQ ID NO: 119369 - DNA, 22 bp, Artificial Sequence
  Synthetic oligonucleotide; TTT chr11 5363452 5363473 5363457 5363452 -
tgtgtgagagagagagtgtgtg

SEQ ID NO: 119370 - DNA, 22 bp, Artificial Sequence
  Synthetic oligonucleotide; TTT chr11 5363451 5363472 5363456 5363451 -
gtgtgagagagagagtgtgtgt

SEQ ID NO: 119371 - DNA, 22 bp, Artificial Sequence
  Synthetic oligonucleotide; TTG chr11 5363450 5363471 5363455 5363450 -
tgtgagagagagagtgtgtgtg

SEQ ID NO: 119372 - DNA, 22 bp, Artificial Sequence
  Synthetic oligonucleotide; TTA chr11 5363409 5363430 5363414 5363409 -
agggcttaaaggaacaattaat

SEQ ID NO: 119373 - DNA, 22 bp, Artificial Sequence
  Synthetic oligonucleotide; CTT chr11 5363402 5363423 5363407 5363402 -
aaaggaacaattaattggtgat

SEQ ID NO: 119374 - DNA, 22 bp, Artificial Sequence
  Synthetic oligonucleotide; TTA chr11 5363401 5363422 5363406 5363401 -
aaggaacaattaattggtgatt

SEQ ID NO: 119375 - DNA, 22 bp, Artificial Sequence
  Synthetic oligonucleotide; TTA chr11 5363389 5363410 5363394 5363389 -
attggtgattaggatcatgtac

SEQ ID NO: 119376 - DNA, 22 bp, Artificial Sequence
  Synthetic oligonucleotide; TTG chr11 5363385 5363406 5363390 5363385 -
gtgattaggatcatgtactcaa

SEQ ID NO: 119377 - DNA, 22 bp, Artificial Sequence
  Synthetic oligonucleotide; TTA chr11 5363378 5363399 5363383 5363378 -
ggatcatgtactcaacaccata

SEQ ID NO: 119378 - DNA, 22 bp, Artificial Sequence
  Synthetic oligonucleotide; CTC chr11 5363365 5363386 5363370 5363365 -
aacaccatagcttgaagtaaaa

SEQ ID NO: 119379 - DNA, 22 bp, Artificial Sequence
  Synthetic oligonucleotide; CTT chr11 5363352 5363373 5363357 5363352 -
gaagtaaaaaaaaacaaaaacc

SEQ ID NO: 119380 - DNA, 22 bp, Artificial Sequence
  Synthetic oligonucleotide; TTG chr11 5363351 5363372 5363356 5363351 -
aagtaaaaaaaaacaaaaacca

SEQ ID NO: 119381 - DNA, 22 bp, Artificial Sequence
  Synthetic oligonucleotide; CTG chr11 5363319 5363340 5363324 5363319 -
taattccaatactgctgcatca

SEQ ID NO: 119382 - DNA, 22 bp, Artificial Sequence
  Synthetic oligonucleotide; TTC chr11 5363313 5363334 5363318 5363313 -
caatactgctgcatcatgactt

SEQ ID NO: 119383 - DNA, 22 bp, Artificial Sequence
  Synthetic oligonucleotide; CTG chr11 5363305 5363326 5363310 5363305 -
ctgcatcatgacttgaaaaacg

SEQ ID NO: 119384 - DNA, 22 bp, Artificial Sequence
  Synthetic oligonucleotide; CTG chr11 5363302 5363323 5363307 5363302 -
catcatgacttgaaaaacgatg

SEQ ID NO: 119385 - DNA, 22 bp, Artificial Sequence
  Synthetic oligonucleotide; CTT chr11 5363291 5363312 5363296 5363291 -
gaaaaacgatgtctgtccactc

SEQ ID NO: 119386 - DNA, 22 bp, Artificial Sequence
  Synthetic oligonucleotide; TTG chr11 5363290 5363311 5363295 5363290 -
aaaaacgatgtctgtccactca

SEQ ID NO: 119387 - DNA, 22 bp, Artificial Sequence
  Synthetic oligonucleotide; CTG chr11 5363276 5363297 5363281 5363276 -
tccactcaccggtgtgtgtgtg

SEQ ID NO: 119388 - DNA, 22 bp, Artificial Sequence
  Synthetic oligonucleotide; CTC chr11 5363269 5363290 5363274 5363269 -
accggtgtgtgtgtgtgtgtgt

SEQ ID NO: 119389 - DNA, 22 bp, Artificial Sequence
  Synthetic oligonucleotide; TTG chr11 5363208 5363229 5363213 5363208 -
ggttcgttgtggggaaacactt

SEQ ID NO: 119390 - DNA, 22 bp, Artificial Sequence
  Synthetic oligonucleotide; TTC chr11 5363203 5363224 5363208 5363203 -
gttgtggggaaacacttgagat

SEQ ID NO: 119391 - DNA, 22 bp, Artificial Sequence
  Synthetic oligonucleotide; TTG chr11 5363199 5363220 5363204 5363199 -
tggggaaacacttgagatcctg

SEQ ID NO: 119392 - DNA, 22 bp, Artificial Sequence
  Synthetic oligonucleotide; CTT chr11 5363186 5363207 5363191 5363186 -
gagatcctgtattgatgaaaaa

SEQ ID NO: 119393 - DNA, 22 bp, Artificial Sequence
  Synthetic oligonucleotide; TTG chr11 5363185 5363206 5363190 5363185 -
agatcctgtattgatgaaaaat

SEQ ID NO: 119394 - DNA, 22 bp, Artificial Sequence
  Synthetic oligonucleotide; CTG chr11 5363177 5363198 5363182 5363177 -
tattgatgaaaaatgatttctc

SEQ ID NO: 119395 - DNA, 22 bp, Artificial Sequence
  Synthetic oligonucleotide; TTG chr11 5363172 5363193 5363177 5363172 -
atgaaaaatgatttctccagac

SEQ ID NO: 119396 - DNA, 22 bp, Artificial Sequence
  Synthetic oligonucleotide; TTT chr11 5363158 5363179 5363163 5363158 -
ctccagactaatcattctgttc

SEQ ID NO: 119397 - DNA, 22 bp, Artificial Sequence
  Synthetic oligonucleotide; TTC chr11 5363157 5363178 5363162 5363157 -
tccagactaatcattctgttcg

SEQ ID NO: 119398 - DNA, 22 bp, Artificial Sequence
  Synthetic oligonucleotide; CTC chr11 5363155 5363176 5363160 5363155 -
cagactaatcattctgttcgta

SEQ ID NO: 119399 - DNA, 22 bp, Artificial Sequence
  Synthetic oligonucleotide; CTA chr11 5363148 5363169 5363153 5363148 -
atcattctgttcgtaaaacttt

SEQ ID NO: 119400 - DNA, 22 bp, Artificial Sequence
  Synthetic oligonucleotide; TTC chr11 5363141 5363162 5363146 5363141 -
tgttcgtaaaactttgagtttt

SEQ ID NO: 119401 - DNA, 22 bp, Artificial Sequence
  Synthetic oligonucleotide; CTG chr11 5363139 5363160 5363144 5363139 -
ttcgtaaaactttgagttttga

SEQ ID NO: 119402 - DNA, 22 bp, Artificial Sequence
  Synthetic oligonucleotide; TTC chr11 5363136 5363157 5363141 5363136 -
gtaaaactttgagttttgaaga

SEQ ID NO: 119403 - DNA, 22 bp, Artificial Sequence
  Synthetic oligonucleotide; CTT chr11 5363127 5363148 5363132 5363127 -
tgagttttgaagacactcaggg

SEQ ID NO: 119404 - DNA, 22 bp, Artificial Sequence
  Synthetic oligonucleotide; TTT chr11 5363126 5363147 5363131 5363126 -
gagttttgaagacactcagggt

SEQ ID NO: 119405 - DNA, 22 bp, Artificial Sequence
  Synthetic oligonucleotide; TTG chr11 5363125 5363146 5363130 5363125 -
agttttgaagacactcagggtc

SEQ ID NO: 119406 - DNA, 22 bp, Artificial Sequence
  Synthetic oligonucleotide; TTT chr11 5363120 5363141 5363125 5363120 -
tgaagacactcagggtctcttt

SEQ ID NO: 119407 - DNA, 22 bp, Artificial Sequence
  Synthetic oligonucleotide; TTT chr11 5363119 5363140 5363124 5363119 -
gaagacactcagggtctctttc

SEQ ID NO: 119408 - DNA, 22 bp, Artificial Sequence
  Synthetic oligonucleotide; TTG chr11 5363118 5363139 5363123 5363118 -
aagacactcagggtctctttct

SEQ ID NO: 119409 - DNA, 22 bp, Artificial Sequence
  Synthetic oligonucleotide; CTC chr11 5363109 5363130 5363114 5363109 -
agggtctctttcttcccttaag

SEQ ID NO: 119410 - DNA, 22 bp, Artificial Sequence
  Synthetic oligonucleotide; CTC chr11 5363101 5363122 5363106 5363101 -
tttcttcccttaagctttctct

SEQ ID NO: 119411 - DNA, 22 bp, Artificial Sequence
  Synthetic oligonucleotide; CTT chr11 5363099 5363120 5363104 5363099 -
tcttcccttaagctttctctca

SEQ ID NO: 119412 - DNA, 22 bp, Artificial Sequence
  Synthetic oligonucleotide; TTT chr11 5363098 5363119 5363103 5363098 -
cttcccttaagctttctctcat

SEQ ID NO: 119413 - DNA, 22 bp, Artificial Sequence
  Synthetic oligonucleotide; TTC chr11 5363097 5363118 5363102 5363097 -
ttcccttaagctttctctcatg

SEQ ID NO: 119414 - DNA, 22 bp, Artificial Sequence
  Synthetic oligonucleotide; CTT chr11 5363095 5363116 5363100 5363095 -
cccttaagctttctctcatgga

SEQ ID NO: 119415 - DNA, 22 bp, Artificial Sequence
  Synthetic oligonucleotide; TTC chr11 5363094 5363115 5363099 5363094 -
ccttaagctttctctcatggag

SEQ ID NO: 119416 - DNA, 22 bp, Artificial Sequence
  Synthetic oligonucleotide; CTT chr11 5363090 5363111 5363095 5363090 -
aagctttctctcatggaggaat

SEQ ID NO: 119417 - DNA, 22 bp, Artificial Sequence
  Synthetic oligonucleotide; TTA chr11 5363089 5363110 5363094 5363089 -
agctttctctcatggaggaatg

SEQ ID NO: 119418 - DNA, 22 bp, Artificial Sequence
  Synthetic oligonucleotide; CTT chr11 5363084 5363105 5363089 5363084 -
tctctcatggaggaatgccact

SEQ ID NO: 119419 - DNA, 22 bp, Artificial Sequence
  Synthetic oligonucleotide; TTT chr11 5363083 5363104 5363088 5363083 -
ctctcatggaggaatgccactc

SEQ ID NO: 119420 - DNA, 22 bp, Artificial Sequence
  Synthetic oligonucleotide; TTC chr11 5363082 5363103 5363087 5363082 -
tctcatggaggaatgccactca

SEQ ID NO: 119421 - DNA, 22 bp, Artificial Sequence
  Synthetic oligonucleotide; CTC chr11 5363080 5363101 5363085 5363080 -
tcatggaggaatgccactcaga

SEQ ID NO: 119422 - DNA, 22 bp, Artificial Sequence
  Synthetic oligonucleotide; CTC chr11 5363078 5363099 5363083 5363078 -
atggaggaatgccactcagaca

SEQ ID NO: 119423 - DNA, 22 bp, Artificial Sequence
  Synthetic oligonucleotide; CTC chr11 5363061 5363082 5363066 5363061 -
agacatctacttagcacatttt

SEQ ID NO: 119424 - DNA, 22 bp, Artificial Sequence
  Synthetic oligonucleotide; CTA chr11 5363052 5363073 5363057 5363052 -
cttagcacattttacaacactt

SEQ ID NO: 119425 - DNA, 22 bp, Artificial Sequence
  Synthetic oligonucleotide; CTT chr11 5363049 5363070 5363054 5363049 -
agcacattttacaacacttgca

SEQ ID NO: 119426 - DNA, 22 bp, Artificial Sequence
  Synthetic oligonucleotide; TTA chr11 5363048 5363069 5363053 5363048 -
gcacattttacaacacttgcat

SEQ ID NO: 119427 - DNA, 22 bp, Artificial Sequence
  Synthetic oligonucleotide; TTT chr11 5363040 5363061 5363045 5363040 -
tacaacacttgcatttccttgg

SEQ ID NO: 119428 - DNA, 22 bp, Artificial Sequence
  Synthetic oligonucleotide; TTT chr11 5363039 5363060 5363044 5363039 -
acaacacttgcatttccttggg

SEQ ID NO: 119429 - DNA, 22 bp, Artificial Sequence
  Synthetic oligonucleotide; TTA chr11 5363038 5363059 5363043 5363038 -
caacacttgcatttccttgggc

SEQ ID NO: 119430 - DNA, 22 bp, Artificial Sequence
  Synthetic oligonucleotide; CTT chr11 5363030 5363051 5363035 5363030 -
gcatttccttgggctccttttc

SEQ ID NO: 119431 - DNA, 22 bp, Artificial Sequence
  Synthetic oligonucleotide; TTG chr11 5363029 5363050 5363034 5363029 -
catttccttgggctccttttcc

SEQ ID NO: 119432 - DNA, 22 bp, Artificial Sequence
  Synthetic oligonucleotide; TTT chr11 5363024 5363045 5363029 5363024 -
ccttgggctccttttccttgtt

SEQ ID NO: 119433 - DNA, 22 bp, Artificial Sequence
  Synthetic oligonucleotide; TTC chr11 5363023 5363044 5363028 5363023 -
cttgggctccttttccttgttt

SEQ ID NO: 119434 - DNA, 22 bp, Artificial Sequence
  Synthetic oligonucleotide; CTT chr11 5363020 5363041 5363025 5363020 -
gggctccttttccttgttttca

SEQ ID NO: 119435 - DNA, 22 bp, Artificial Sequence
  Synthetic oligonucleotide; TTG chr11 5363019 5363040 5363024 5363019 -
ggctccttttccttgttttcaa

SEQ ID NO: 119436 - DNA, 22 bp, Artificial Sequence
  Synthetic oligonucleotide; CTC chr11 5363014 5363035 5363019 5363014 -
cttttccttgttttcaaccttc

SEQ ID NO: 119437 - DNA, 22 bp, Artificial Sequence
  Synthetic oligonucleotide; CTT chr11 5363011 5363032 5363016 5363011 -
ttccttgttttcaaccttcatg

SEQ ID NO: 119438 - DNA, 22 bp, Artificial Sequence
  Synthetic oligonucleotide; TTT chr11 5363010 5363031 5363015 5363010 -
tccttgttttcaaccttcatgc

SEQ ID NO: 119439 - DNA, 22 bp, Artificial Sequence
  Synthetic oligonucleotide; TTT chr11 5363009 5363030 5363014 5363009 -
ccttgttttcaaccttcatgcc

SEQ ID NO: 119440 - DNA, 22 bp, Artificial Sequence
  Synthetic oligonucleotide; TTC chr11 5363008 5363029 5363013 5363008 -
cttgttttcaaccttcatgccc

SEQ ID NO: 119441 - DNA, 22 bp, Artificial Sequence
  Synthetic oligonucleotide; CTT chr11 5363005 5363026 5363010 5363005 -
gttttcaaccttcatgccccaa

SEQ ID NO: 119442 - DNA, 22 bp, Artificial Sequence
  Synthetic oligonucleotide; TTG chr11 5363004 5363025 5363009 5363004 -
ttttcaaccttcatgccccaat

SEQ ID NO: 119443 - DNA, 22 bp, Artificial Sequence
  Synthetic oligonucleotide; TTT chr11 5363001 5363022 5363006 5363001 -
tcaaccttcatgccccaatccc

SEQ ID NO: 119444 - DNA, 22 bp, Artificial Sequence
  Synthetic oligonucleotide; TTT chr11 5363000 5363021 5363005 5363000 -
caaccttcatgccccaatccct

SEQ ID NO: 119445 - DNA, 22 bp, Artificial Sequence
  Synthetic oligonucleotide; TTC chr11 5362999 5363020 5363004 5362999 -
aaccttcatgccccaatccctg

SEQ ID NO: 119446 - DNA, 22 bp, Artificial Sequence
  Synthetic oligonucleotide; CTT chr11 5362993 5363014 5362998 5362993 -
catgccccaatccctgcctaac

SEQ ID NO: 119447 - DNA, 22 bp, Artificial Sequence
  Synthetic oligonucleotide; TTC chr11 5362992 5363013 5362997 5362992 -
atgccccaatccctgcctaact

SEQ ID NO: 119448 - DNA, 22 bp, Artificial Sequence
  Synthetic oligonucleotide; CTG chr11 5362977 5362998 5362982 5362977 -
cctaacttctattatttctttt

SEQ ID NO: 119449 - DNA, 22 bp, Artificial Sequence
  Synthetic oligonucleotide; CTA chr11 5362973 5362994 5362978 5362973 -
acttctattatttctttttttt

SEQ ID NO: 119450 - DNA, 22 bp, Artificial Sequence
  Synthetic oligonucleotide; CTT chr11 5362969 5362990 5362974 5362969 -
ctattatttctttttttttttt

SEQ ID NO: 119451 - DNA, 22 bp, Artificial Sequence
  Synthetic oligonucleotide; TTC chr11 5362968 5362989 5362973 5362968 -
tattatttctttttttttttta

SEQ ID NO: 119452 - DNA, 22 bp, Artificial Sequence
  Synthetic oligonucleotide; CTA chr11 5362966 5362987 5362971 5362966 -
ttatttcttttttttttttaat

SEQ ID NO: 119453 - DNA, 22 bp, Artificial Sequence
  Synthetic oligonucleotide; TTA chr11 5362963 5362984 5362968 5362963 -
tttcttttttttttttaatgcc

SEQ ID NO: 119454 - DNA, 22 bp, Artificial Sequence
  Synthetic oligonucleotide; TTT chr11 5362960 5362981 5362965 5362960 -
cttttttttttttaatgccata

SEQ ID NO: 119455 - DNA, 22 bp, Artificial Sequence
  Synthetic oligonucleotide; TTC chr11 5362959 5362980 5362964 5362959 -
ttttttttttttaatgccatac

SEQ ID NO: 119456 - DNA, 22 bp, Artificial Sequence
  Synthetic oligonucleotide; CTT chr11 5362957 5362978 5362962 5362957 -
ttttttttttaatgccatacat

SEQ ID NO: 119457 - DNA, 22 bp, Artificial Sequence
  Synthetic oligonucleotide; TTT chr11 5362956 5362977 5362961 5362956 -
tttttttttaatgccatacatc

SEQ ID NO: 119458 - DNA, 22 bp, Artificial Sequence
  Synthetic oligonucleotide; TTT chr11 5362955 5362976 5362960 5362955 -
ttttttttaatgccatacatct

SEQ ID NO: 119459 - DNA, 22 bp, Artificial Sequence
  Synthetic oligonucleotide; TTT chr11 5362954 5362975 5362959 5362954 -
tttttttaatgccatacatctg

SEQ ID NO: 119460 - DNA, 22 bp, Artificial Sequence
  Synthetic oligonucleotide; TTT chr11 5362953 5362974 5362958 5362953 -
ttttttaatgccatacatctgc

SEQ ID NO: 119461 - DNA, 22 bp, Artificial Sequence
  Synthetic oligonucleotide; TTT chr11 5362952 5362973 5362957 5362952 -
tttttaatgccatacatctgca

SEQ ID NO: 119462 - DNA, 22 bp, Artificial Sequence
  Synthetic oligonucleotide; TTT chr11 5362951 5362972 5362956 5362951 -
ttttaatgccatacatctgcat

SEQ ID NO: 119463 - DNA, 22 bp, Artificial Sequence
  Synthetic oligonucleotide; TTT chr11 5362950 5362971 5362955 5362950 -
tttaatgccatacatctgcatt

SEQ ID NO: 119464 - DNA, 22 bp, Artificial Sequence
  Synthetic oligonucleotide; TTT chr11 5362949 5362970 5362954 5362949 -
ttaatgccatacatctgcattt

SEQ ID NO: 119465 - DNA, 22 bp, Artificial Sequence
  Synthetic oligonucleotide; TTT chr11 5362948 5362969 5362953 5362948 -
taatgccatacatctgcattta

SEQ ID NO: 119466 - DNA, 22 bp, Artificial Sequence
  Synthetic oligonucleotide; TTT chr11 5362947 5362968 5362952 5362947 -
aatgccatacatctgcatttat

SEQ ID NO: 119467 - DNA, 22 bp, Artificial Sequence
  Synthetic oligonucleotide; TTA chr11 5362946 5362967 5362951 5362946 -
atgccatacatctgcatttatt

SEQ ID NO: 119468 - DNA, 22 bp, Artificial Sequence
  Synthetic oligonucleotide; CTG chr11 5362932 5362953 5362937 5362932 -
catttattataagcaacaggcg

SEQ ID NO: 119469 - DNA, 22 bp, Artificial Sequence
  Synthetic oligonucleotide; TTT chr11 5362927 5362948 5362932 5362927 -
attataagcaacaggcgggaca

SEQ ID NO: 119470 - DNA, 22 bp, Artificial Sequence
  Synthetic oligonucleotide; TTA chr11 5362926 5362947 5362931 5362926 -
ttataagcaacaggcgggacac

SEQ ID NO: 119471 - DNA, 22 bp, Artificial Sequence
  Synthetic oligonucleotide; TTA chr11 5362923 5362944 5362928 5362923 -
taagcaacaggcgggacacttc

SEQ ID NO: 119472 - DNA, 22 bp, Artificial Sequence
  Synthetic oligonucleotide; CTT chr11 5362902 5362923 5362907 5362902 -
ccagcaatagaaagaaaactta

SEQ ID NO: 119473 - DNA, 22 bp, Artificial Sequence
  Synthetic oligonucleotide; TTC chr11 5362901 5362922 5362906 5362901 -
cagcaatagaaagaaaacttaa

SEQ ID NO: 119474 - DNA, 22 bp, Artificial Sequence
  Synthetic oligonucleotide; CTT chr11 5362881 5362902 5362886 5362881 -
aatttacaaaagcagggattca

SEQ ID NO: 119475 - DNA, 22 bp, Artificial Sequence
  Synthetic oligonucleotide; TTA chr11 5362880 5362901 5362885 5362880 -
atttacaaaagcagggattcag

SEQ ID NO: 119476 - DNA, 22 bp, Artificial Sequence
  Synthetic oligonucleotide; TTT chr11 5362876 5362897 5362881 5362876 -
acaaaagcagggattcagtgaa

SEQ ID NO: 119477 - DNA, 22 bp, Artificial Sequence
  Synthetic oligonucleotide; TTA chr11 5362875 5362896 5362880 5362875 -
caaaagcagggattcagtgaag

SEQ ID NO: 119478 - DNA, 22 bp, Artificial Sequence
  Synthetic oligonucleotide; TTC chr11 5362860 5362881 5362865 5362860 -
agtgaagccacctggttgttac

SEQ ID NO: 119479 - DNA, 22 bp, Artificial Sequence
  Synthetic oligonucleotide; CTG chr11 5362846 5362867 5362851 5362846 -
gttgttactcttgggcactcac

SEQ ID NO: 119480 - DNA, 22 bp, Artificial Sequence
  Synthetic oligonucleotide; TTG chr11 5362842 5362863 5362847 5362842 -
ttactcttgggcactcacatgt

SEQ ID NO: 119481 - DNA, 22 bp, Artificial Sequence
  Synthetic oligonucleotide; TTA chr11 5362839 5362860 5362844 5362839 -
ctcttgggcactcacatgtaga

SEQ ID NO: 119482 - DNA, 22 bp, Artificial Sequence
  Synthetic oligonucleotide; CTC chr11 5362836 5362857 5362841 5362836 -
ttgggcactcacatgtagatgc

SEQ ID NO: 119483 - DNA, 22 bp, Artificial Sequence
  Synthetic oligonucleotide; CTT chr11 5362834 5362855 5362839 5362834 -
gggcactcacatgtagatgcca

SEQ ID NO: 119484 - DNA, 22 bp, Artificial Sequence
  Synthetic oligonucleotide; TTG chr11 5362833 5362854 5362838 5362833 -
ggcactcacatgtagatgccaa

SEQ ID NO: 119485 - DNA, 22 bp, Artificial Sequence
  Synthetic oligonucleotide; CTC chr11 5362826 5362847 5362831 5362826 -
acatgtagatgccaacccagag

SEQ ID NO: 119486 - DNA, 22 bp, Artificial Sequence
  Synthetic oligonucleotide; CTT chr11 5362787 5362808 5362792 5362787 -
caaagcccatgaagagtgaggc

SEQ ID NO: 119487 - DNA, 22 bp, Artificial Sequence
  Synthetic oligonucleotide; TTC chr11 5362786 5362807 5362791 5362786 -
aaagcccatgaagagtgaggcc

SEQ ID NO: 119488 - DNA, 22 bp, Artificial Sequence
  Synthetic oligonucleotide; CTC chr11 5362749 5362770 5362754 5362749 -
tttatagatatcacaagtgtac

SEQ ID NO: 119489 - DNA, 22 bp, Artificial Sequence
  Synthetic oligonucleotide; CTT chr11 5362747 5362768 5362752 5362747 -
tatagatatcacaagtgtactt

SEQ ID NO: 119490 - DNA, 22 bp, Artificial Sequence
  Synthetic oligonucleotide; TTT chr11 5362746 5362767 5362751 5362746 -
atagatatcacaagtgtacttg

SEQ ID NO: 119491 - DNA, 22 bp, Artificial Sequence
  Synthetic oligonucleotide; TTA chr11 5362745 5362766 5362750 5362745 -
tagatatcacaagtgtacttgg

SEQ ID NO: 119492 - DNA, 22 bp, Artificial Sequence
  Synthetic oligonucleotide; CTT chr11 5362725 5362746 5362730 5362725 -
ggtagaggtgacctcgtaaaca

SEQ ID NO: 119493 - DNA, 22 bp, Artificial Sequence
  Synthetic oligonucleotide; TTG chr11 5362724 5362745 5362729 5362724 -
gtagaggtgacctcgtaaacaa

SEQ ID NO: 119494 - DNA, 22 bp, Artificial Sequence
  Synthetic oligonucleotide; CTC chr11 5362710 5362731 5362715 5362710 -
gtaaacaaagaaccaggtggtg

SEQ ID NO: 119495 - DNA, 22 bp, Artificial Sequence
  Synthetic oligonucleotide; CTC chr11 5362662 5362683 5362667 5362662 -
tacaatcagatgggggaagaca

SEQ ID NO: 119496 - DNA, 22 bp, Artificial Sequence
  Synthetic oligonucleotide; CTA chr11 5362660 5362681 5362665 5362660 -
caatcagatgggggaagacagc

SEQ ID NO: 119497 - DNA, 22 bp, Artificial Sequence
  Synthetic oligonucleotide; CTG chr11 5362636 5362657 5362641 5362636 -
ggttgaccgggctgttgtatct

SEQ ID NO: 119498 - DNA, 22 bp, Artificial Sequence
  Synthetic oligonucleotide; TTG chr11 5362631 5362652 5362636 5362631 -
accgggctgttgtatctgctca

SEQ ID NO: 119499 - DNA, 22 bp, Artificial Sequence
  Synthetic oligonucleotide; CTG chr11 5362622 5362643 5362627 5362622 -
ttgtatctgctcatggccttga

SEQ ID NO: 119500 - DNA, 22 bp, Artificial Sequence
  Synthetic oligonucleotide; TTG chr11 5362619 5362640 5362624 5362619 -
tatctgctcatggccttgagct

SEQ ID NO: 119501 - DNA, 22 bp, Artificial Sequence
  Synthetic oligonucleotide; CTG chr11 5362613 5362634 5362618 5362613 -
ctcatggccttgagctccattt

SEQ ID NO: 119502 - DNA, 22 bp, Artificial Sequence
  Synthetic oligonucleotide; CTC chr11 5362610 5362631 5362615 5362610 -
atggccttgagctccattttgc

SEQ ID NO: 119503 - DNA, 22 bp, Artificial Sequence
  Synthetic oligonucleotide; CTT chr11 5362602 5362623 5362607 5362602 -
gagctccattttgccccagcag

SEQ ID NO: 119504 - DNA, 22 bp, Artificial Sequence
  Synthetic oligonucleotide; TTG chr11 5362601 5362622 5362606 5362601 -
agctccattttgccccagcagg

SEQ ID NO: 119505 - DNA, 22 bp, Artificial Sequence
  Synthetic oligonucleotide; CTC chr11 5362596 5362617 5362601 5362596 -
cattttgccccagcaggctaag

SEQ ID NO: 119506 - DNA, 22 bp, Artificial Sequence
  Synthetic oligonucleotide; TTT chr11 5362591 5362612 5362596 5362591 -
tgccccagcaggctaagccacc

SEQ ID NO: 119507 - DNA, 22 bp, Artificial Sequence
  Synthetic oligonucleotide; TTT chr11 5362590 5362611 5362595 5362590 -
gccccagcaggctaagccacca

SEQ ID NO: 119508 - DNA, 22 bp, Artificial Sequence
  Synthetic oligonucleotide; TTG chr11 5362589 5362610 5362594 5362589 -
ccccagcaggctaagccaccac

SEQ ID NO: 119509 - DNA, 22 bp, Artificial Sequence
  Synthetic oligonucleotide; CTA chr11 5362576 5362597 5362581 5362576 -
agccaccactctgccaccagaa

SEQ ID NO: 119510 - DNA, 22 bp, Artificial Sequence
  Synthetic oligonucleotide; CTC chr11 5362565 5362586 5362570 5362565 -
tgccaccagaagacttctgtta

SEQ ID NO: 119511 - DNA, 22 bp, Artificial Sequence
  Synthetic oligonucleotide; CTG chr11 5362563 5362584 5362568 5362563 -
ccaccagaagacttctgttatt

SEQ ID NO: 119512 - DNA, 22 bp, Artificial Sequence
  Synthetic oligonucleotide; CTT chr11 5362549 5362570 5362554 5362549 -
ctgttatttcttatcttttgct

SEQ ID NO: 119513 - DNA, 22 bp, Artificial Sequence
  Synthetic oligonucleotide; TTC chr11 5362548 5362569 5362553 5362548 -
tgttatttcttatcttttgctt

SEQ ID NO: 119514 - DNA, 22 bp, Artificial Sequence
  Synthetic oligonucleotide; CTG chr11 5362546 5362567 5362551 5362546 -
ttatttcttatcttttgctttc

SEQ ID NO: 119515 - DNA, 22 bp, Artificial Sequence
  Synthetic oligonucleotide; TTA chr11 5362543 5362564 5362548 5362543 -
tttcttatcttttgctttcctg

SEQ ID NO: 119516 - DNA, 22 bp, Artificial Sequence
  Synthetic oligonucleotide; TTT chr11 5362540 5362561 5362545 5362540 -
cttatcttttgctttcctgact

SEQ ID NO: 119517 - DNA, 22 bp, Artificial Sequence
  Synthetic oligonucleotide; TTC chr11 5362539 5362560 5362544 5362539 -
ttatcttttgctttcctgactt

SEQ ID NO: 119518 - DNA, 22 bp, Artificial Sequence
  Synthetic oligonucleotide; CTT chr11 5362537 5362558 5362542 5362537 -
atcttttgctttcctgacttca

SEQ ID NO: 119519 - DNA, 22 bp, Artificial Sequence
  Synthetic oligonucleotide; TTA chr11 5362536 5362557 5362541 5362536 -
tcttttgctttcctgacttcat

SEQ ID NO: 119520 - DNA, 22 bp, Artificial Sequence
  Synthetic oligonucleotide; CTT chr11 5362532 5362553 5362537 5362532 -
ttgctttcctgacttcatctct

SEQ ID NO: 119521 - DNA, 22 bp, Artificial Sequence
  Synthetic oligonucleotide; TTT chr11 5362531 5362552 5362536 5362531 -
tgctttcctgacttcatctctg

SEQ ID NO: 119522 - DNA, 22 bp, Artificial Sequence
  Synthetic oligonucleotide; TTT chr11 5362530 5362551 5362535 5362530 -
gctttcctgacttcatctctgc

SEQ ID NO: 119523 - DNA, 22 bp, Artificial Sequence
  Synthetic oligonucleotide; TTG chr11 5362529 5362550 5362534 5362529 -
ctttcctgacttcatctctgct

SEQ ID NO: 119524 - DNA, 22 bp, Artificial Sequence
  Synthetic oligonucleotide; CTT chr11 5362526 5362547 5362531 5362526 -
tcctgacttcatctctgctctc

SEQ ID NO: 119525 - DNA, 22 bp, Artificial Sequence
  Synthetic oligonucleotide; TTT chr11 5362525 5362546 5362530 5362525 -
cctgacttcatctctgctctct

SEQ ID NO: 119526 - DNA, 22 bp, Artificial Sequence
  Synthetic oligonucleotide; TTC chr11 5362524 5362545 5362529 5362524 -
ctgacttcatctctgctctctg

SEQ ID NO: 119527 - DNA, 22 bp, Artificial Sequence
  Synthetic oligonucleotide; CTG chr11 5362521 5362542 5362526 5362521 -
acttcatctctgctctctgact

SEQ ID NO: 119528 - DNA, 22 bp, Artificial Sequence
  Synthetic oligonucleotide; CTT chr11 5362517 5362538 5362522 5362517 -
catctctgctctctgactaggt

SEQ ID NO: 119529 - DNA, 22 bp, Artificial Sequence
  Synthetic oligonucleotide; TTC chr11 5362516 5362537 5362521 5362516 -
atctctgctctctgactaggta

SEQ ID NO: 119530 - DNA, 22 bp, Artificial Sequence
  Synthetic oligonucleotide; CTC chr11 5362511 5362532 5362516 5362511 -
tgctctctgactaggtaattat

SEQ ID NO: 119531 - DNA, 22 bp, Artificial Sequence
  Synthetic oligonucleotide; CTG chr11 5362509 5362530 5362514 5362509 -
ctctctgactaggtaattatat

SEQ ID NO: 119532 - DNA, 22 bp, Artificial Sequence
  Synthetic oligonucleotide; CTC chr11 5362506 5362527 5362511 5362506 -
tctgactaggtaattatatcta

SEQ ID NO: 119533 - DNA, 22 bp, Artificial Sequence
  Synthetic oligonucleotide; CTC chr11 5362504 5362525 5362509 5362504 -
tgactaggtaattatatctaac

SEQ ID NO: 119534 - DNA, 22 bp, Artificial Sequence
  Synthetic oligonucleotide; CTG chr11 5362502 5362523 5362507 5362502 -
actaggtaattatatctaacaa

SEQ ID NO: 119535 - DNA, 22 bp, Artificial Sequence
  Synthetic oligonucleotide; CTA chr11 5362498 5362519 5362503 5362498 -
ggtaattatatctaacaatgtt

SEQ ID NO: 119536 - DNA, 22 bp, Artificial Sequence
  Synthetic oligonucleotide; TTA chr11 5362490 5362511 5362495 5362490 -
tatctaacaatgttatctattc

SEQ ID NO: 119537 - DNA, 22 bp, Artificial Sequence
  Synthetic oligonucleotide; CTA chr11 5362484 5362505 5362489 5362484 -
acaatgttatctattctgattc

SEQ ID NO: 119538 - DNA, 22 bp, Artificial Sequence
  Synthetic oligonucleotide; TTA chr11 5362475 5362496 5362480 5362475 -
tctattctgattcatagtatcc

SEQ ID NO: 119539 - DNA, 22 bp, Artificial Sequence
  Synthetic oligonucleotide; CTA chr11 5362471 5362492 5362476 5362471 -
ttctgattcatagtatccagta

SEQ ID NO: 119540 - DNA, 22 bp, Artificial Sequence
  Synthetic oligonucleotide; TTC chr11 5362468 5362489 5362473 5362468 -
tgattcatagtatccagtagac

SEQ ID NO: 119541 - DNA, 22 bp, Artificial Sequence
  Synthetic oligonucleotide; CTG chr11 5362466 5362487 5362471 5362466 -
attcatagtatccagtagacct

SEQ ID NO: 119542 - DNA, 22 bp, Artificial Sequence
  Synthetic oligonucleotide; TTC chr11 5362462 5362483 5362467 5362462 -
atagtatccagtagacctgatt

SEQ ID NO: 119543 - DNA, 22 bp, Artificial Sequence
  Synthetic oligonucleotide; CTG chr11 5362443 5362464 5362448 5362443 -
atttaatcatcacattctcatt

SEQ ID NO: 119544 - DNA, 22 bp, Artificial Sequence
  Synthetic oligonucleotide; TTT chr11 5362439 5362460 5362444 5362439 -
aatcatcacattctcattataa

SEQ ID NO: 119545 - DNA, 22 bp, Artificial Sequence
  Synthetic oligonucleotide; TTA chr11 5362438 5362459 5362443 5362438 -
atcatcacattctcattataag

SEQ ID NO: 119546 - DNA, 22 bp, Artificial Sequence
  Synthetic oligonucleotide; TTC chr11 5362426 5362447 5362431 5362426 -
tcattataaggctcaacaacta

SEQ ID NO: 119547 - DNA, 22 bp, Artificial Sequence
  Synthetic oligonucleotide; CTC chr11 5362424 5362445 5362429 5362424 -
attataaggctcaacaactaat

SEQ ID NO: 119548 - DNA, 22 bp, Artificial Sequence
  Synthetic oligonucleotide; TTA chr11 5362420 5362441 5362425 5362420 -
taaggctcaacaactaatgttc

SEQ ID NO: 119549 - DNA, 22 bp, Artificial Sequence
  Synthetic oligonucleotide; CTC chr11 5362412 5362433 5362417 5362412 -
aacaactaatgttcacaatttt

SEQ ID NO: 119550 - DNA, 22 bp, Artificial Sequence
  Synthetic oligonucleotide; CTA chr11 5362404 5362425 5362409 5362404 -
atgttcacaattttccaaagcc

SEQ ID NO: 119551 - DNA, 22 bp, Artificial Sequence
  Synthetic oligonucleotide; TTC chr11 5362398 5362419 5362403 5362398 -
acaattttccaaagccatagac

SEQ ID NO: 119552 - DNA, 22 bp, Artificial Sequence
  Synthetic oligonucleotide; TTT chr11 5362391 5362412 5362396 5362391 -
tccaaagccatagactgatcat

SEQ ID NO: 119553 - DNA, 22 bp, Artificial Sequence
  Synthetic oligonucleotide; TTT chr11 5362390 5362411 5362395 5362390 -
ccaaagccatagactgatcatc

SEQ ID NO: 119554 - DNA, 22 bp, Artificial Sequence
  Synthetic oligonucleotide; TTC chr11 5362389 5362410 5362394 5362389 -
caaagccatagactgatcatct

SEQ ID NO: 119555 - DNA, 22 bp, Artificial Sequence
  Synthetic oligonucleotide; CTG chr11 5362374 5362395 5362379 5362374 -
atcatctgatctacaaatacac

SEQ ID NO: 119556 - DNA, 22 bp, Artificial Sequence
  Synthetic oligonucleotide; CTG chr11 5362366 5362387 5362371 5362366 -
atctacaaatacactaaattcc

SEQ ID NO: 119557 - DNA, 22 bp, Artificial Sequence
  Synthetic oligonucleotide; CTA chr11 5362361 5362382 5362366 5362361 -
caaatacactaaattcctgacc

SEQ ID NO: 119558 - DNA, 22 bp, Artificial Sequence
  Synthetic oligonucleotide; CTA chr11 5362350 5362371 5362355 5362350 -
aattcctgaccatcttcgtagt

SEQ ID NO: 119559 - DNA, 22 bp, Artificial Sequence
  Synthetic oligonucleotide; TTC chr11 5362345 5362366 5362350 5362345 -
ctgaccatcttcgtagttgatt

SEQ ID NO: 119560 - DNA, 22 bp, Artificial Sequence
  Synthetic oligonucleotide; CTG chr11 5362342 5362363 5362347 5362342 -
accatcttcgtagttgattatg

SEQ ID NO: 119561 - DNA, 22 bp, Artificial Sequence
  Synthetic oligonucleotide; CTT chr11 5362334 5362355 5362339 5362334 -
cgtagttgattatggctctgaa

SEQ ID NO: 119562 - DNA, 22 bp, Artificial Sequence
  Synthetic oligonucleotide; TTC chr11 5362333 5362354 5362338 5362333 -
gtagttgattatggctctgaat

SEQ ID NO: 119563 - DNA, 22 bp, Artificial Sequence
  Synthetic oligonucleotide; TTG chr11 5362326 5362347 5362331 5362326 -
attatggctctgaatggctttt

SEQ ID NO: 119564 - DNA, 22 bp, Artificial Sequence
  Synthetic oligonucleotide; TTA chr11 5362322 5362343 5362327 5362322 -
tggctctgaatggctttttgcc

SEQ ID NO: 119565 - DNA, 22 bp, Artificial Sequence
  Synthetic oligonucleotide; CTC chr11 5362316 5362337 5362321 5362316 -
tgaatggctttttgcccaaagc

SEQ ID NO: 119566 - DNA, 22 bp, Artificial Sequence
  Synthetic oligonucleotide; CTG chr11 5362314 5362335 5362319 5362314 -
aatggctttttgcccaaagcat

SEQ ID NO: 119567 - DNA, 22 bp, Artificial Sequence
  Synthetic oligonucleotide; CTT chr11 5362306 5362327 5362311 5362306 -
tttgcccaaagcatccagcacc

SEQ ID NO: 119568 - DNA, 22 bp, Artificial Sequence
  Synthetic oligonucleotide; TTT chr11 5362305 5362326 5362310 5362305 -
ttgcccaaagcatccagcacca

SEQ ID NO: 119569 - DNA, 22 bp, Artificial Sequence
  Synthetic oligonucleotide; TTT chr11 5362304 5362325 5362309 5362304 -
tgcccaaagcatccagcaccat

SEQ ID NO: 119570 - DNA, 22 bp, Artificial Sequence
  Synthetic oligonucleotide; TTT chr11 5362303 5362324 5362308 5362303 -
gcccaaagcatccagcaccatt

SEQ ID NO: 119571 - DNA, 22 bp, Artificial Sequence
  Synthetic oligonucleotide; TTG chr11 5362302 5362323 5362307 5362302 -
cccaaagcatccagcaccattt

SEQ ID NO: 119572 - DNA, 22 bp, Artificial Sequence
  Synthetic oligonucleotide; TTT chr11 5362280 5362301 5362285 5362280 -
tcatctgggtagtttcccctgc

SEQ ID NO: 119573 - DNA, 22 bp, Artificial Sequence
  Synthetic oligonucleotide; TTT chr11 5362279 5362300 5362284 5362279 -
catctgggtagtttcccctgct

SEQ ID NO: 119574 - DNA, 22 bp, Artificial Sequence
  Synthetic oligonucleotide; TTC chr11 5362278 5362299 5362283 5362278 -
atctgggtagtttcccctgctg

SEQ ID NO: 119575 - DNA, 22 bp, Artificial Sequence
  Synthetic oligonucleotide; CTG chr11 5362273 5362294 5362278 5362273 -
ggtagtttcccctgctggtaaa

SEQ ID NO: 119576 - DNA, 22 bp, Artificial Sequence
  Synthetic oligonucleotide; TTT chr11 5362265 5362286 5362270 5362265 -
cccctgctggtaaaaatagtaa

SEQ ID NO: 119577 - DNA, 22 bp, Artificial Sequence
  Synthetic oligonucleotide; TTC chr11 5362264 5362285 5362269 5362264 -
ccctgctggtaaaaatagtaaa

SEQ ID NO: 119578 - DNA, 22 bp, Artificial Sequence
  Synthetic oligonucleotide; CTG chr11 5362259 5362280 5362264 5362259 -
ctggtaaaaatagtaaacactt

SEQ ID NO: 119579 - DNA, 22 bp, Artificial Sequence
  Synthetic oligonucleotide; CTG chr11 5362256 5362277 5362261 5362256 -
gtaaaaatagtaaacacttttc

SEQ ID NO: 119580 - DNA, 22 bp, Artificial Sequence
  Synthetic oligonucleotide; CTT chr11 5362237 5362258 5362242 5362237 -
ttccttatctactcccatcccc

SEQ ID NO: 119581 - DNA, 22 bp, Artificial Sequence
  Synthetic oligonucleotide; TTT chr11 5362236 5362257 5362241 5362236 -
tccttatctactcccatccccc

SEQ ID NO: 119582 - DNA, 22 bp, Artificial Sequence
  Synthetic oligonucleotide; TTT chr11 5362235 5362256 5362240 5362235 -
ccttatctactcccatcccccg

SEQ ID NO: 119583 - DNA, 22 bp, Artificial Sequence
  Synthetic oligonucleotide; TTC chr11 5362234 5362255 5362239 5362234 -
cttatctactcccatcccccga

SEQ ID NO: 119584 - DNA, 22 bp, Artificial Sequence
  Synthetic oligonucleotide; CTT chr11 5362231 5362252 5362236 5362231 -
atctactcccatcccccgacag

SEQ ID NO: 119585 - DNA, 22 bp, Artificial Sequence
  Synthetic oligonucleotide; TTA chr11 5362230 5362251 5362235 5362230 -
tctactcccatcccccgacaga

SEQ ID NO: 119586 - DNA, 22 bp, Artificial Sequence
  Synthetic oligonucleotide; CTA chr11 5362226 5362247 5362231 5362226 -
ctcccatcccccgacagaaaca

SEQ ID NO: 119587 - DNA, 22 bp, Artificial Sequence
  Synthetic oligonucleotide; CTC chr11 5362223 5362244 5362228 5362223 -
ccatcccccgacagaaacacgg

SEQ ID NO: 119588 - DNA, 22 bp, Artificial Sequence
  Synthetic oligonucleotide; CTA chr11 5362192 5362213 5362197 5362192 -
tcactctctatctgggtgtggt

SEQ ID NO: 119589 - DNA, 22 bp, Artificial Sequence
  Synthetic oligonucleotide; CTC chr11 5362186 5362207 5362191 5362186 -
tctatctgggtgtggttgagat

SEQ ID NO: 119590 - DNA, 22 bp, Artificial Sequence
  Synthetic oligonucleotide; CTC chr11 5362184 5362205 5362189 5362184 -
tatctgggtgtggttgagatct

SEQ ID NO: 119591 - DNA, 22 bp, Artificial Sequence
  Synthetic oligonucleotide; CTA chr11 5362182 5362203 5362187 5362182 -
tctgggtgtggttgagatcttc

SEQ ID NO: 119592 - DNA, 22 bp, Artificial Sequence
  Synthetic oligonucleotide; CTG chr11 5362178 5362199 5362183 5362178 -
ggtgtggttgagatcttcaaaa

SEQ ID NO: 119593 - DNA, 22 bp, Artificial Sequence
  Synthetic oligonucleotide; TTG chr11 5362168 5362189 5362173 5362168 -
agatcttcaaaatctgcagtgc

SEQ ID NO: 119594 - DNA, 22 bp, Artificial Sequence
  Synthetic oligonucleotide; CTT chr11 5362161 5362182 5362166 5362161 -
caaaatctgcagtgctgatagc

SEQ ID NO: 119595 - DNA, 22 bp, Artificial Sequence
  Synthetic oligonucleotide; TTC chr11 5362160 5362181 5362165 5362160 -
aaaatctgcagtgctgatagct

SEQ ID NO: 119596 - DNA, 22 bp, Artificial Sequence
  Synthetic oligonucleotide; CTG chr11 5362152 5362173 5362157 5362152 -
cagtgctgatagctcagcatgg

SEQ ID NO: 119597 - DNA, 22 bp, Artificial Sequence
  Synthetic oligonucleotide; CTG chr11 5362144 5362165 5362149 5362144 -
atagctcagcatggaatgaagt

SEQ ID NO: 119598 - DNA, 22 bp, Artificial Sequence
  Synthetic oligonucleotide; CTC chr11 5362137 5362158 5362142 5362137 -
agcatggaatgaagtgaaccaa

SEQ ID NO: 119599 - DNA, 22 bp, Artificial Sequence
  Synthetic oligonucleotide; CTC chr11 5362108 5362129 5362113 5362108 -
tctctgactttggtttataagg

SEQ ID NO: 119600 - DNA, 22 bp, Artificial Sequence
  Synthetic oligonucleotide; CTC chr11 5362106 5362127 5362111 5362106 -
tctgactttggtttataaggat

SEQ ID NO: 119601 - DNA, 22 bp, Artificial Sequence
  Synthetic oligonucleotide; CTC chr11 5362104 5362125 5362109 5362104 -
tgactttggtttataaggattt

SEQ ID NO: 119602 - DNA, 22 bp, Artificial Sequence
  Synthetic oligonucleotide; CTG chr11 5362102 5362123 5362107 5362102 -
actttggtttataaggatttgc

SEQ ID NO: 119603 - DNA, 22 bp, Artificial Sequence
  Synthetic oligonucleotide; CTT chr11 5362098 5362119 5362103 5362098 -
tggtttataaggatttgcatac

SEQ ID NO: 119604 - DNA, 22 bp, Artificial Sequence
  Synthetic oligonucleotide; TTT chr11 5362097 5362118 5362102 5362097 -
ggtttataaggatttgcataca

SEQ ID NO: 119605 - DNA, 22 bp, Artificial Sequence
  Synthetic oligonucleotide; TTG chr11 5362096 5362117 5362101 5362096 -
gtttataaggatttgcatacat

SEQ ID NO: 119606 - DNA, 22 bp, Artificial Sequence
  Synthetic oligonucleotide; TTT chr11 5362092 5362113 5362097 5362092 -
ataaggatttgcatacattttc

SEQ ID NO: 119607 - DNA, 22 bp, Artificial Sequence
  Synthetic oligonucleotide; TTA chr11 5362091 5362112 5362096 5362091 -
taaggatttgcatacattttct

SEQ ID NO: 119608 - DNA, 22 bp, Artificial Sequence
  Synthetic oligonucleotide; TTT chr11 5362082 5362103 5362087 5362082 -
gcatacattttctgatggatac

SEQ ID NO: 119609 - DNA, 22 bp, Artificial Sequence
  Synthetic oligonucleotide; TTG chr11 5362081 5362102 5362086 5362081 -
catacattttctgatggatact

SEQ ID NO: 119610 - DNA, 22 bp, Artificial Sequence
  Synthetic oligonucleotide; TTT chr11 5362072 5362093 5362077 5362072 -
tctgatggatactaggctcatt

SEQ ID NO: 119611 - DNA, 22 bp, Artificial Sequence
  Synthetic oligonucleotide; TTT chr11 5362071 5362092 5362076 5362071 -
ctgatggatactaggctcattt

SEQ ID NO: 119612 - DNA, 22 bp, Artificial Sequence
  Synthetic oligonucleotide; TTC chr11 5362070 5362091 5362075 5362070 -
tgatggatactaggctcatttc

SEQ ID NO: 119613 - DNA, 22 bp, Artificial Sequence
  Synthetic oligonucleotide; CTG chr11 5362068 5362089 5362073 5362068 -
atggatactaggctcatttctg

SEQ ID NO: 119614 - DNA, 22 bp, Artificial Sequence
  Synthetic oligonucleotide; CTA chr11 5362058 5362079 5362063 5362058 -
ggctcatttctgggaatatgca

SEQ ID NO: 119615 - DNA, 22 bp, Artificial Sequence
  Synthetic oligonucleotide; CTC chr11 5362053 5362074 5362058 5362053 -
atttctgggaatatgcagcaat

SEQ ID NO: 119616 - DNA, 22 bp, Artificial Sequence
  Synthetic oligonucleotide; TTT chr11 5362049 5362070 5362054 5362049 -
ctgggaatatgcagcaatttaa

SEQ ID NO: 119617 - DNA, 22 bp, Artificial Sequence
  Synthetic oligonucleotide; TTC chr11 5362048 5362069 5362053 5362048 -
tgggaatatgcagcaatttaaa

SEQ ID NO: 119618 - DNA, 22 bp, Artificial Sequence
  Synthetic oligonucleotide; CTG chr11 5362046 5362067 5362051 5362046 -
ggaatatgcagcaatttaaagc

SEQ ID NO: 119619 - DNA, 22 bp, Artificial Sequence
  Synthetic oligonucleotide; TTT chr11 5362029 5362050 5362034 5362029 -
aaagcattgtgcctcatgtcaa

SEQ ID NO: 119620 - DNA, 22 bp, Artificial Sequence
  Synthetic oligonucleotide; TTA chr11 5362028 5362049 5362033 5362028 -
aagcattgtgcctcatgtcaaa

SEQ ID NO: 119621 - DNA, 22 bp, Artificial Sequence
  Synthetic oligonucleotide; TTG chr11 5362020 5362041 5362025 5362020 -
tgcctcatgtcaaagtttgctt

SEQ ID NO: 119622 - DNA, 22 bp, Artificial Sequence
  Synthetic oligonucleotide; CTC chr11 5362014 5362035 5362019 5362014 -
atgtcaaagtttgctttactca

SEQ ID NO: 119623 - DNA, 22 bp, Artificial Sequence
  Synthetic oligonucleotide; TTT chr11 5362002 5362023 5362007 5362002 -
gctttactcaatctgacactaa

SEQ ID NO: 119624 - DNA, 22 bp, Artificial Sequence
  Synthetic oligonucleotide; TTG chr11 5362001 5362022 5362006 5362001 -
ctttactcaatctgacactaat

SEQ ID NO: 119625 - DNA, 22 bp, Artificial Sequence
  Synthetic oligonucleotide; CTT chr11 5361998 5362019 5362003 5361998 -
tactcaatctgacactaatcta

SEQ ID NO: 119626 - DNA, 22 bp, Artificial Sequence
  Synthetic oligonucleotide; TTT chr11 5361997 5362018 5362002 5361997 -
actcaatctgacactaatctat

SEQ ID NO: 119627 - DNA, 22 bp, Artificial Sequence
  Synthetic oligonucleotide; TTA chr11 5361996 5362017 5362001 5361996 -
ctcaatctgacactaatctatt

SEQ ID NO: 119628 - DNA, 22 bp, Artificial Sequence
  Synthetic oligonucleotide; CTC chr11 5361993 5362014 5361998 5361993 -
aatctgacactaatctatttgg

SEQ ID NO: 119629 - DNA, 22 bp, Artificial Sequence
  Synthetic oligonucleotide; CTG chr11 5361987 5362008 5361992 5361987 -
acactaatctatttggtaagtt

SEQ ID NO: 119630 - DNA, 22 bp, Artificial Sequence
  Synthetic oligonucleotide; CTA chr11 5361981 5362002 5361986 5361981 -
atctatttggtaagtttttctt

SEQ ID NO: 119631 - DNA, 22 bp, Artificial Sequence
  Synthetic oligonucleotide; CTA chr11 5361976 5361997 5361981 5361976 -
tttggtaagtttttctttctgt

SEQ ID NO: 119632 - DNA, 22 bp, Artificial Sequence
  Synthetic oligonucleotide; TTT chr11 5361973 5361994 5361978 5361973 -
ggtaagtttttctttctgttag

SEQ ID NO: 119633 - DNA, 22 bp, Artificial Sequence
  Synthetic oligonucleotide; TTG chr11 5361972 5361993 5361977 5361972 -
gtaagtttttctttctgttagt

SEQ ID NO: 119634 - DNA, 22 bp, Artificial Sequence
  Synthetic oligonucleotide; TTT chr11 5361964 5361985 5361969 5361964 -
ttctttctgttagtctataccc

SEQ ID NO: 119635 - DNA, 22 bp, Artificial Sequence
  Synthetic oligonucleotide; TTT chr11 5361963 5361984 5361968 5361963 -
tctttctgttagtctataccct

SEQ ID NO: 119636 - DNA, 22 bp, Artificial Sequence
  Synthetic oligonucleotide; TTT chr11 5361962 5361983 5361967 5361962 -
ctttctgttagtctataccctt

SEQ ID NO: 119637 - DNA, 22 bp, Artificial Sequence
  Synthetic oligonucleotide; TTC chr11 5361961 5361982 5361966 5361961 -
tttctgttagtctatacccttg

SEQ ID NO: 119638 - DNA, 22 bp, Artificial Sequence
  Synthetic oligonucleotide; CTT chr11 5361959 5361980 5361964 5361959 -
tctgttagtctatacccttgtc

SEQ ID NO: 119639 - DNA, 22 bp, Artificial Sequence
  Synthetic oligonucleotide; TTT chr11 5361958 5361979 5361963 5361958 -
ctgttagtctatacccttgtca

SEQ ID NO: 119640 - DNA, 22 bp, Artificial Sequence
  Synthetic oligonucleotide; TTC chr11 5361957 5361978 5361962 5361957 -
tgttagtctatacccttgtcat

SEQ ID NO: 119641 - DNA, 22 bp, Artificial Sequence
  Synthetic oligonucleotide; CTG chr11 5361955 5361976 5361960 5361955 -
ttagtctatacccttgtcatta

SEQ ID NO: 119642 - DNA, 22 bp, Artificial Sequence
  Synthetic oligonucleotide; TTA chr11 5361952 5361973 5361957 5361952 -
gtctatacccttgtcattacag

SEQ ID NO: 119643 - DNA, 22 bp, Artificial Sequence
  Synthetic oligonucleotide; CTA chr11 5361947 5361968 5361952 5361947 -
tacccttgtcattacagtgtcc

SEQ ID NO: 119644 - DNA, 22 bp, Artificial Sequence
  Synthetic oligonucleotide; CTT chr11 5361940 5361961 5361945 5361940 -
gtcattacagtgtcccctatcc

SEQ ID NO: 119645 - DNA, 22 bp, Artificial Sequence
  Synthetic oligonucleotide; TTG chr11 5361939 5361960 5361944 5361939 -
tcattacagtgtcccctatcct

SEQ ID NO: 119646 - DNA, 22 bp, Artificial Sequence
  Synthetic oligonucleotide; TTA chr11 5361933 5361954 5361938 5361933 -
cagtgtcccctatcctcactct

SEQ ID NO: 119647 - DNA, 22 bp, Artificial Sequence
  Synthetic oligonucleotide; CTA chr11 5361921 5361942 5361926 5361921 -
tcctcactctaacttcatcttt

SEQ ID NO: 119648 - DNA, 22 bp, Artificial Sequence
  Synthetic oligonucleotide; CTC chr11 5361916 5361937 5361921 5361916 -
actctaacttcatcttttttgg

SEQ ID NO: 119649 - DNA, 22 bp, Artificial Sequence
  Synthetic oligonucleotide; CTC chr11 5361912 5361933 5361917 5361912 -
taacttcatcttttttgggagt

SEQ ID NO: 119650 - DNA, 22 bp, Artificial Sequence
  Synthetic oligonucleotide; CTA chr11 5361910 5361931 5361915 5361910 -
acttcatcttttttgggagtaa

SEQ ID NO: 119651 - DNA, 22 bp, Artificial Sequence
  Synthetic oligonucleotide; CTT chr11 5361906 5361927 5361911 5361906 -
catcttttttgggagtaagtac

SEQ ID NO: 119652 - DNA, 22 bp, Artificial Sequence
  Synthetic oligonucleotide; TTC chr11 5361905 5361926 5361910 5361905 -
atcttttttgggagtaagtact

SEQ ID NO: 119653 - DNA, 22 bp, Artificial Sequence
  Synthetic oligonucleotide; CTT chr11 5361900 5361921 5361905 5361900 -
ttttgggagtaagtacttggta

SEQ ID NO: 119654 - DNA, 22 bp, Artificial Sequence
  Synthetic oligonucleotide; TTT chr11 5361899 5361920 5361904 5361899 -
tttgggagtaagtacttggtag

SEQ ID NO: 119655 - DNA, 22 bp, Artificial Sequence
  Synthetic oligonucleotide; TTT chr11 5361898 5361919 5361903 5361898 -
ttgggagtaagtacttggtaga

SEQ ID NO: 119656 - DNA, 22 bp, Artificial Sequence
  Synthetic oligonucleotide; TTT chr11 5361897 5361918 5361902 5361897 -
tgggagtaagtacttggtagaa

SEQ ID NO: 119657 - DNA, 22 bp, Artificial Sequence
  Synthetic oligonucleotide; TTT chr11 5361896 5361917 5361901 5361896 -
gggagtaagtacttggtagaac

SEQ ID NO: 119658 - DNA, 22 bp, Artificial Sequence
  Synthetic oligonucleotide; TTG chr11 5361895 5361916 5361900 5361895 -
ggagtaagtacttggtagaaca

SEQ ID NO: 119659 - DNA, 22 bp, Artificial Sequence
  Synthetic oligonucleotide; CTT chr11 5361882 5361903 5361887 5361882 -
ggtagaacacatagaggcaaag

SEQ ID NO: 119660 - DNA, 22 bp, Artificial Sequence
  Synthetic oligonucleotide; TTG chr11 5361881 5361902 5361886 5361881 -
gtagaacacatagaggcaaaga

SEQ ID NO: 119661 - DNA, 22 bp, Artificial Sequence
  Synthetic oligonucleotide; CTG chr11 5361851 5361872 5361856 5361851 -
gtttatgcagcccgaagagagc

SEQ ID NO: 119662 - DNA, 22 bp, Artificial Sequence
  Synthetic oligonucleotide; TTT chr11 5361847 5361868 5361852 5361847 -
atgcagcccgaagagagcaaca

SEQ ID NO: 119663 - DNA, 22 bp, Artificial Sequence
  Synthetic oligonucleotide; TTA chr11 5361846 5361867 5361851 5361846 -
tgcagcccgaagagagcaacaa

SEQ ID NO: 119664 - DNA, 22 bp, Artificial Sequence
  Synthetic oligonucleotide; CTG chr11 5361795 5361816 5361800 5361795 -
gaactacaccagagatatcatt

SEQ ID NO: 119665 - DNA, 22 bp, Artificial Sequence
  Synthetic oligonucleotide; CTA chr11 5361789 5361810 5361794 5361789 -
caccagagatatcattctgtat

SEQ ID NO: 119666 - DNA, 22 bp, Artificial Sequence
  Synthetic oligonucleotide; TTC chr11 5361772 5361793 5361777 5361772 -
tgtattcccgtggattttcaac

SEQ ID NO: 119667 - DNA, 22 bp, Artificial Sequence
  Synthetic oligonucleotide; CTG chr11 5361770 5361791 5361775 5361770 -
tattcccgtggattttcaactt

SEQ ID NO: 119668 - DNA, 22 bp, Artificial Sequence
  Synthetic oligonucleotide; TTC chr11 5361765 5361786 5361770 5361765 -
ccgtggattttcaacttgattt

SEQ ID NO: 119669 - DNA, 22 bp, Artificial Sequence
  Synthetic oligonucleotide; TTT chr11 5361755 5361776 5361760 5361755 -
tcaacttgattttttcctaact

SEQ ID NO: 119670 - DNA, 22 bp, Artificial Sequence
  Synthetic oligonucleotide; TTT chr11 5361754 5361775 5361759 5361754 -
caacttgattttttcctaacta

SEQ ID NO: 119671 - DNA, 22 bp, Artificial Sequence
  Synthetic oligonucleotide; TTC chr11 5361753 5361774 5361758 5361753 -
aacttgattttttcctaactag

SEQ ID NO: 119672 - DNA, 22 bp, Artificial Sequence
  Synthetic oligonucleotide; CTT chr11 5361748 5361769 5361753 5361748 -
gattttttcctaactagatcac

SEQ ID NO: 119673 - DNA, 22 bp, Artificial Sequence
  Synthetic oligonucleotide; TTG chr11 5361747 5361768 5361752 5361747 -
attttttcctaactagatcact

SEQ ID NO: 119674 - DNA, 22 bp, Artificial Sequence
  Synthetic oligonucleotide; TTT chr11 5361743 5361764 5361748 5361743 -
tttcctaactagatcactctgc

SEQ ID NO: 119675 - DNA, 22 bp, Artificial Sequence
  Synthetic oligonucleotide; TTT chr11 5361742 5361763 5361747 5361742 -
ttcctaactagatcactctgct

SEQ ID NO: 119676 - DNA, 22 bp, Artificial Sequence
  Synthetic oligonucleotide; TTT chr11 5361741 5361762 5361746 5361741 -
tcctaactagatcactctgcta

SEQ ID NO: 119677 - DNA, 22 bp, Artificial Sequence
  Synthetic oligonucleotide; TTT chr11 5361740 5361761 5361745 5361740 -
cctaactagatcactctgctag

SEQ ID NO: 119678 - DNA, 22 bp, Artificial Sequence
  Synthetic oligonucleotide; TTC chr11 5361739 5361760 5361744 5361739 -
ctaactagatcactctgctagg

SEQ ID NO: 119679 - DNA, 22 bp, Artificial Sequence
  Synthetic oligonucleotide; CTA chr11 5361736 5361757 5361741 5361736 -
actagatcactctgctagggaa

SEQ ID NO: 119680 - DNA, 22 bp, Artificial Sequence
  Synthetic oligonucleotide; CTA chr11 5361732 5361753 5361737 5361732 -
gatcactctgctagggaatgaa

SEQ ID NO: 119681 - DNA, 22 bp, Artificial Sequence
  Synthetic oligonucleotide; CTC chr11 5361724 5361745 5361729 5361724 -
tgctagggaatgaaaaaggaga

SEQ ID NO: 119682 - DNA, 22 bp, Artificial Sequence
  Synthetic oligonucleotide; CTG chr11 5361722 5361743 5361727 5361722 -
ctagggaatgaaaaaggagatc

SEQ ID NO: 119683 - DNA, 22 bp, Artificial Sequence
  Synthetic oligonucleotide; CTA chr11 5361719 5361740 5361724 5361719 -
gggaatgaaaaaggagatctag

SEQ ID NO: 119684 - DNA, 22 bp, Artificial Sequence
  Synthetic oligonucleotide; CTA chr11 5361698 5361719 5361703 5361698 -
ggattttccctcttctaggaat

SEQ ID NO: 119685 - DNA, 22 bp, Artificial Sequence
  Synthetic oligonucleotide; TTT chr11 5361692 5361713 5361697 5361692 -
tccctcttctaggaatttgcaa

SEQ ID NO: 119686 - DNA, 22 bp, Artificial Sequence
  Synthetic oligonucleotide; TTT chr11 5361691 5361712 5361696 5361691 -
ccctcttctaggaatttgcaaa

SEQ ID NO: 119687 - DNA, 22 bp, Artificial Sequence
  Synthetic oligonucleotide; TTC chr11 5361690 5361711 5361695 5361690 -
cctcttctaggaatttgcaaaa

SEQ ID NO: 119688 - DNA, 22 bp, Artificial Sequence
  Synthetic oligonucleotide; CTC chr11 5361686 5361707 5361691 5361686 -
ttctaggaatttgcaaaagaga

SEQ ID NO: 119689 - DNA, 22 bp, Artificial Sequence
  Synthetic oligonucleotide; CTT chr11 5361684 5361705 5361689 5361684 -
ctaggaatttgcaaaagagatt

SEQ ID NO: 119690 - DNA, 22 bp, Artificial Sequence
  Synthetic oligonucleotide; TTC chr11 5361683 5361704 5361688 5361683 -
taggaatttgcaaaagagatta

SEQ ID NO: 119691 - DNA, 22 bp, Artificial Sequence
  Synthetic oligonucleotide; CTA chr11 5361681 5361702 5361686 5361681 -
ggaatttgcaaaagagattatt

SEQ ID NO: 119692 - DNA, 22 bp, Artificial Sequence
  Synthetic oligonucleotide; TTT chr11 5361674 5361695 5361679 5361674 -
gcaaaagagattattcagaagc

SEQ ID NO: 119693 - DNA, 22 bp, Artificial Sequence
  Synthetic oligonucleotide; TTG chr11 5361673 5361694 5361678 5361673 -
caaaagagattattcagaagcc

SEQ ID NO: 119694 - DNA, 22 bp, Artificial Sequence
  Synthetic oligonucleotide; TTA chr11 5361661 5361682 5361666 5361661 -
ttcagaagccaagttctaaaga

SEQ ID NO: 119695 - DNA, 22 bp, Artificial Sequence
  Synthetic oligonucleotide; TTC chr11 5361658 5361679 5361663 5361658 -
agaagccaagttctaaagattt

SEQ ID NO: 119696 - DNA, 22 bp, Artificial Sequence
  Synthetic oligonucleotide; TTC chr11 5361645 5361666 5361650 5361645 -
taaagattttagggagtctttg

SEQ ID NO: 119697 - DNA, 22 bp, Artificial Sequence
  Synthetic oligonucleotide; CTA chr11 5361643 5361664 5361648 5361643 -
aagattttagggagtctttggg

SEQ ID NO: 119698 - DNA, 22 bp, Artificial Sequence
  Synthetic oligonucleotide; TTT chr11 5361636 5361657 5361641 5361636 -
tagggagtctttgggatgatag

SEQ ID NO: 119699 - DNA, 22 bp, Artificial Sequence
  Synthetic oligonucleotide; TTT chr11 5361635 5361656 5361640 5361635 -
agggagtctttgggatgataga

SEQ ID NO: 119700 - DNA, 22 bp, Artificial Sequence
  Synthetic oligonucleotide; TTA chr11 5361634 5361655 5361639 5361634 -
gggagtctttgggatgatagat

SEQ ID NO: 119701 - DNA, 22 bp, Artificial Sequence
  Synthetic oligonucleotide; CTT chr11 5361625 5361646 5361630 5361625 -
tgggatgatagattcttatacc

SEQ ID NO: 119702 - DNA, 22 bp, Artificial Sequence
  Synthetic oligonucleotide; TTT chr11 5361624 5361645 5361629 5361624 -
gggatgatagattcttataccc

SEQ ID NO: 119703 - DNA, 22 bp, Artificial Sequence
  Synthetic oligonucleotide; TTG chr11 5361623 5361644 5361628 5361623 -
ggatgatagattcttatacccc

SEQ ID NO: 119704 - DNA, 22 bp, Artificial Sequence
  Synthetic oligonucleotide; TTC chr11 5361610 5361631 5361615 5361610 -
ttataccccatcacatcttgac

SEQ ID NO: 119705 - DNA, 22 bp, Artificial Sequence
  Synthetic oligonucleotide; CTT chr11 5361608 5361629 5361613 5361608 -
ataccccatcacatcttgactg

SEQ ID NO: 119706 - DNA, 22 bp, Artificial Sequence
  Synthetic oligonucleotide; TTA chr11 5361607 5361628 5361612 5361607 -
taccccatcacatcttgactga

SEQ ID NO: 119707 - DNA, 22 bp, Artificial Sequence
  Synthetic oligonucleotide; CTT chr11 5361591 5361612 5361596 5361591 -
gactgatacattactgcatttc

SEQ ID NO: 119708 - DNA, 22 bp, Artificial Sequence
  Synthetic oligonucleotide; TTG chr11 5361590 5361611 5361595 5361590 -
actgatacattactgcatttcc

SEQ ID NO: 119709 - DNA, 22 bp, Artificial Sequence
  Synthetic oligonucleotide; CTG chr11 5361586 5361607 5361591 5361586 -
atacattactgcatttccctct

SEQ ID NO: 119710 - DNA, 22 bp, Artificial Sequence
  Synthetic oligonucleotide; TTA chr11 5361578 5361599 5361583 5361578 -
ctgcatttccctctctgcaatc

SEQ ID NO: 119711 - DNA, 22 bp, Artificial Sequence
  Synthetic oligonucleotide; CTG chr11 5361575 5361596 5361580 5361575 -
catttccctctctgcaatctct

SEQ ID NO: 119712 - DNA, 22 bp, Artificial Sequence
  Synthetic oligonucleotide; TTT chr11 5361570 5361591 5361575 5361570 -
ccctctctgcaatctctgataa

SEQ ID NO: 119713 - DNA, 22 bp, Artificial Sequence
  Synthetic oligonucleotide; TTC chr11 5361569 5361590 5361574 5361569 -
cctctctgcaatctctgataag

SEQ ID NO: 119714 - DNA, 22 bp, Artificial Sequence
  Synthetic oligonucleotide; CTC chr11 5361565 5361586 5361570 5361565 -
tctgcaatctctgataagccaa

SEQ ID NO: 119715 - DNA, 22 bp, Artificial Sequence
  Synthetic oligonucleotide; CTC chr11 5361563 5361584 5361568 5361563 -
tgcaatctctgataagccaacc

SEQ ID NO: 119716 - DNA, 22 bp, Artificial Sequence
  Synthetic oligonucleotide; CTG chr11 5361561 5361582 5361566 5361561 -
caatctctgataagccaaccgt

SEQ ID NO: 119717 - DNA, 22 bp, Artificial Sequence
  Synthetic oligonucleotide; CTC chr11 5361554 5361575 5361559 5361554 -
tgataagccaaccgtctactgc

SEQ ID NO: 119718 - DNA, 22 bp, Artificial Sequence
  Synthetic oligonucleotide; CTG chr11 5361552 5361573 5361557 5361552 -
ataagccaaccgtctactgctc

SEQ ID NO: 119719 - DNA, 22 bp, Artificial Sequence
  Synthetic oligonucleotide; CTA chr11 5361536 5361557 5361541 5361536 -
ctgctcattcctatgcggagcc

SEQ ID NO: 119720 - DNA, 22 bp, Artificial Sequence
  Synthetic oligonucleotide; CTG chr11 5361533 5361554 5361538 5361533 -
ctcattcctatgcggagcctct

SEQ ID NO: 119721 - DNA, 22 bp, Artificial Sequence
  Synthetic oligonucleotide; CTC chr11 5361530 5361551 5361535 5361530 -
attcctatgcggagcctctagg

SEQ ID NO: 119722 - DNA, 22 bp, Artificial Sequence
  Synthetic oligonucleotide; TTC chr11 5361526 5361547 5361531 5361526 -
ctatgcggagcctctaggccaa

SEQ ID NO: 119723 - DNA, 22 bp, Artificial Sequence
  Synthetic oligonucleotide; CTA chr11 5361523 5361544 5361528 5361523 -
tgcggagcctctaggccaagac

SEQ ID NO: 119724 - DNA, 22 bp, Artificial Sequence
  Synthetic oligonucleotide; CTC chr11 5361512 5361533 5361517 5361512 -
taggccaagacacactggagtt

SEQ ID NO: 119725 - DNA, 22 bp, Artificial Sequence
  Synthetic oligonucleotide; CTA chr11 5361510 5361531 5361515 5361510 -
ggccaagacacactggagttct

SEQ ID NO: 119726 - DNA, 22 bp, Artificial Sequence
  Synthetic oligonucleotide; CTG chr11 5361495 5361516 5361500 5361495 -
gagttctttaccgacctgttca

SEQ ID NO: 119727 - DNA, 22 bp, Artificial Sequence
  Synthetic oligonucleotide; TTC chr11 5361489 5361510 5361494 5361489 -
tttaccgacctgttcataagtc

SEQ ID NO: 119728 - DNA, 22 bp, Artificial Sequence
  Synthetic oligonucleotide; CTT chr11 5361487 5361508 5361492 5361487 -
taccgacctgttcataagtctg

SEQ ID NO: 119729 - DNA, 22 bp, Artificial Sequence
  Synthetic oligonucleotide; TTT chr11 5361486 5361507 5361491 5361486 -
accgacctgttcataagtctgt

SEQ ID NO: 119730 - DNA, 22 bp, Artificial Sequence
  Synthetic oligonucleotide; TTA chr11 5361485 5361506 5361490 5361485 -
ccgacctgttcataagtctgtt

SEQ ID NO: 119731 - DNA, 22 bp, Artificial Sequence
  Synthetic oligonucleotide; CTG chr11 5361477 5361498 5361482 5361477 -
ttcataagtctgttcattgttg

SEQ ID NO: 119732 - DNA, 22 bp, Artificial Sequence
  Synthetic oligonucleotide; TTC chr11 5361474 5361495 5361479 5361474 -
ataagtctgttcattgttgcca

SEQ ID NO: 119733 - DNA, 22 bp, Artificial Sequence
  Synthetic oligonucleotide; CTG chr11 5361465 5361486 5361470 5361465 -
ttcattgttgccacagatgtga

SEQ ID NO: 119734 - DNA, 22 bp, Artificial Sequence
  Synthetic oligonucleotide; TTC chr11 5361462 5361483 5361467 5361462 -
attgttgccacagatgtgacta

SEQ ID NO: 119735 - DNA, 22 bp, Artificial Sequence
  Synthetic oligonucleotide; TTG chr11 5361458 5361479 5361463 5361458 -
ttgccacagatgtgactatgaa

SEQ ID NO: 119736 - DNA, 22 bp, Artificial Sequence
  Synthetic oligonucleotide; TTG chr11 5361455 5361476 5361460 5361455 -
ccacagatgtgactatgaaccc

SEQ ID NO: 119737 - DNA, 22 bp, Artificial Sequence
  Synthetic oligonucleotide; CTA chr11 5361440 5361461 5361445 5361440 -
tgaacccctaagcctggtcaag

SEQ ID NO: 119738 - DNA, 22 bp, Artificial Sequence
  Synthetic oligonucleotide; CTA chr11 5361430 5361451 5361435 5361430 -
agcctggtcaagatattggatc

SEQ ID NO: 119739 - DNA, 22 bp, Artificial Sequence
  Synthetic oligonucleotide; CTG chr11 5361424 5361445 5361429 5361424 -
gtcaagatattggatccaacac

SEQ ID NO: 119740 - DNA, 22 bp, Artificial Sequence
  Synthetic oligonucleotide; TTG chr11 5361412 5361433 5361417 5361412 -
gatccaacaccaactttttaga

SEQ ID NO: 119741 - DNA, 22 bp, Artificial Sequence
  Synthetic oligonucleotide; CTT chr11 5361396 5361417 5361401 5361396 -
tttagactatactcagaagcca

SEQ ID NO: 119742 - DNA, 22 bp, Artificial Sequence
  Synthetic oligonucleotide; TTT chr11 5361395 5361416 5361400 5361395 -
ttagactatactcagaagccaa

SEQ ID NO: 119743 - DNA, 22 bp, Artificial Sequence
  Synthetic oligonucleotide; TTT chr11 5361394 5361415 5361399 5361394 -
tagactatactcagaagccaag

SEQ ID NO: 119744 - DNA, 22 bp, Artificial Sequence
  Synthetic oligonucleotide; TTT chr11 5361393 5361414 5361398 5361393 -
agactatactcagaagccaagc

SEQ ID NO: 119745 - DNA, 22 bp, Artificial Sequence
  Synthetic oligonucleotide; TTA chr11 5361392 5361413 5361397 5361392 -
gactatactcagaagccaagct

SEQ ID NO: 119746 - DNA, 22 bp, Artificial Sequence
  Synthetic oligonucleotide; CTA chr11 5361387 5361408 5361392 5361387 -
tactcagaagccaagctgcaaa

SEQ ID NO: 119747 - DNA, 22 bp, Artificial Sequence
  Synthetic oligonucleotide; CTC chr11 5361382 5361403 5361387 5361382 -
agaagccaagctgcaaagaaaa

SEQ ID NO: 119748 - DNA, 22 bp, Artificial Sequence
  Synthetic oligonucleotide; CTG chr11 5361369 5361390 5361374 5361369 -
caaagaaaattagtttcagaaa

SEQ ID NO: 119749 - DNA, 22 bp, Artificial Sequence
  Synthetic oligonucleotide; TTA chr11 5361357 5361378 5361362 5361357 -
gtttcagaaactcctccctacg

SEQ ID NO: 119750 - DNA, 22 bp, Artificial Sequence
  Synthetic oligonucleotide; TTT chr11 5361353 5361374 5361358 5361353 -
cagaaactcctccctacggccc

SEQ ID NO: 119751 - DNA, 22 bp, Artificial Sequence
  Synthetic oligonucleotide; TTC chr11 5361352 5361373 5361357 5361352 -
agaaactcctccctacggccca

SEQ ID NO: 119752 - DNA, 22 bp, Artificial Sequence
  Synthetic oligonucleotide; CTC chr11 5361344 5361365 5361349 5361344 -
ctccctacggcccactcctctc

SEQ ID NO: 119753 - DNA, 22 bp, Artificial Sequence
  Synthetic oligonucleotide; CTC chr11 5361341 5361362 5361346 5361341 -
cctacggcccactcctctctcc

SEQ ID NO: 119754 - DNA, 22 bp, Artificial Sequence
  Synthetic oligonucleotide; CTA chr11 5361337 5361358 5361342 5361337 -
cggcccactcctctctcctccc

SEQ ID NO: 119755 - DNA, 22 bp, Artificial Sequence
  Synthetic oligonucleotide; CTC chr11 5361327 5361348 5361332 5361327 -
ctctctcctccctccttcttta

SEQ ID NO: 119756 - DNA, 22 bp, Artificial Sequence
  Synthetic oligonucleotide; CTC chr11 5361324 5361345 5361329 5361324 -
tctcctccctccttctttattc

SEQ ID NO: 119757 - DNA, 22 bp, Artificial Sequence
  Synthetic oligonucleotide; CTC chr11 5361322 5361343 5361327 5361322 -
tcctccctccttctttattctc

SEQ ID NO: 119758 - DNA, 22 bp, Artificial Sequence
  Synthetic oligonucleotide; CTC chr11 5361320 5361341 5361325 5361320 -
ctccctccttctttattctccc

SEQ ID NO: 119759 - DNA, 22 bp, Artificial Sequence
  Synthetic oligonucleotide; CTC chr11 5361317 5361338 5361322 5361317 -
cctccttctttattctcccagc

SEQ ID NO: 119760 - DNA, 22 bp, Artificial Sequence
  Synthetic oligonucleotide; CTC chr11 5361313 5361334 5361318 5361313 -
cttctttattctcccagcctga

SEQ ID NO: 119761 - DNA, 22 bp, Artificial Sequence
  Synthetic oligonucleotide; CTT chr11 5361310 5361331 5361315 5361310 -
ctttattctcccagcctgaggg

SEQ ID NO: 119762 - DNA, 22 bp, Artificial Sequence
  Synthetic oligonucleotide; TTC chr11 5361309 5361330 5361314 5361309 -
tttattctcccagcctgaggga

SEQ ID NO: 119763 - DNA, 22 bp, Artificial Sequence
  Synthetic oligonucleotide; CTT chr11 5361307 5361328 5361312 5361307 -
tattctcccagcctgagggatt

SEQ ID NO: 119764 - DNA, 22 bp, Artificial Sequence
  Synthetic oligonucleotide; TTT chr11 5361306 5361327 5361311 5361306 -
attctcccagcctgagggattt

SEQ ID NO: 119765 - DNA, 22 bp, Artificial Sequence
  Synthetic oligonucleotide; TTA chr11 5361305 5361326 5361310 5361305 -
ttctcccagcctgagggattta

SEQ ID NO: 119766 - DNA, 22 bp, Artificial Sequence
  Synthetic oligonucleotide; TTC chr11 5361302 5361323 5361307 5361302 -
tcccagcctgagggatttagaa

SEQ ID NO: 119767 - DNA, 22 bp, Artificial Sequence
  Synthetic oligonucleotide; CTC chr11 5361300 5361321 5361305 5361300 -
ccagcctgagggatttagaact

SEQ ID NO: 119768 - DNA, 22 bp, Artificial Sequence
  Synthetic oligonucleotide; CTG chr11 5361292 5361313 5361297 5361292 -
agggatttagaactttggaaca

SEQ ID NO: 119769 - DNA, 22 bp, Artificial Sequence
  Synthetic oligonucleotide; TTT chr11 5361284 5361305 5361289 5361284 -
agaactttggaacaggagtcgc

SEQ ID NO: 119770 - DNA, 22 bp, Artificial Sequence
  Synthetic oligonucleotide; TTA chr11 5361283 5361304 5361288 5361283 -
gaactttggaacaggagtcgct

SEQ ID NO: 119771 - DNA, 22 bp, Artificial Sequence
  Synthetic oligonucleotide; CTT chr11 5361277 5361298 5361282 5361277 -
tggaacaggagtcgctaaggtt

SEQ ID NO: 119772 - DNA, 22 bp, Artificial Sequence
  Synthetic oligonucleotide; TTT chr11 5361276 5361297 5361281 5361276 -
ggaacaggagtcgctaaggttt

SEQ ID NO: 119773 - DNA, 22 bp, Artificial Sequence
  Synthetic oligonucleotide; TTG chr11 5361275 5361296 5361280 5361275 -
gaacaggagtcgctaaggtttc

SEQ ID NO: 119774 - DNA, 22 bp, Artificial Sequence
  Synthetic oligonucleotide; CTA chr11 5361260 5361281 5361265 5361260 -
aggtttcttcctgcatctaggt

SEQ ID NO: 119775 - DNA, 22 bp, Artificial Sequence
  Synthetic oligonucleotide; TTT chr11 5361254 5361275 5361259 5361254 -
cttcctgcatctaggttaggga

SEQ ID NO: 119776 - DNA, 22 bp, Artificial Sequence
  Synthetic oligonucleotide; TTC chr11 5361253 5361274 5361258 5361253 -
ttcctgcatctaggttagggaa

SEQ ID NO: 119777 - DNA, 22 bp, Artificial Sequence
  Synthetic oligonucleotide; CTT chr11 5361251 5361272 5361256 5361251 -
cctgcatctaggttagggaatt

SEQ ID NO: 119778 - DNA, 22 bp, Artificial Sequence
  Synthetic oligonucleotide; TTC chr11 5361250 5361271 5361255 5361250 -
ctgcatctaggttagggaatta

SEQ ID NO: 119779 - DNA, 22 bp, Artificial Sequence
  Synthetic oligonucleotide; CTG chr11 5361247 5361268 5361252 5361247 -
catctaggttagggaattagcc

SEQ ID NO: 119780 - DNA, 22 bp, Artificial Sequence
  Synthetic oligonucleotide; CTA chr11 5361241 5361262 5361246 5361241 -
ggttagggaattagccacatct

SEQ ID NO: 119781 - DNA, 22 bp, Artificial Sequence
  Synthetic oligonucleotide; TTA chr11 5361236 5361257 5361241 5361236 -
gggaattagccacatctccaga

SEQ ID NO: 119782 - DNA, 22 bp, Artificial Sequence
  Synthetic oligonucleotide; TTA chr11 5361228 5361249 5361233 5361228 -
gccacatctccagaaataagat

SEQ ID NO: 119783 - DNA, 22 bp, Artificial Sequence
  Synthetic oligonucleotide; CTC chr11 5361218 5361239 5361223 5361218 -
cagaaataagatttattttaag

SEQ ID NO: 119784 - DNA, 22 bp, Artificial Sequence
  Synthetic oligonucleotide; TTT chr11 5361204 5361225 5361209 5361204 -
attttaagcatcacataggggt

SEQ ID NO: 119785 - DNA, 22 bp, Artificial Sequence
  Synthetic oligonucleotide; TTA chr11 5361203 5361224 5361208 5361203 -
ttttaagcatcacataggggta

SEQ ID NO: 119786 - DNA, 22 bp, Artificial Sequence
  Synthetic oligonucleotide; TTT chr11 5361200 5361221 5361205 5361200 -
taagcatcacataggggtagaa

SEQ ID NO: 119787 - DNA, 22 bp, Artificial Sequence
  Synthetic oligonucleotide; TTT chr11 5361199 5361220 5361204 5361199 -
aagcatcacataggggtagaaa

SEQ ID NO: 119788 - DNA, 22 bp, Artificial Sequence
  Synthetic oligonucleotide; TTA chr11 5361198 5361219 5361203 5361198 -
agcatcacataggggtagaaaa

SEQ ID NO: 119789 - DNA, 22 bp, Artificial Sequence
  Synthetic oligonucleotide; CTT chr11 5361153 5361174 5361158 5361153 -
tttgcagcagatttctttcttt

SEQ ID NO: 119790 - DNA, 22 bp, Artificial Sequence
  Synthetic oligonucleotide; TTT chr11 5361152 5361173 5361157 5361152 -
ttgcagcagatttctttctttc

SEQ ID NO: 119791 - DNA, 22 bp, Artificial Sequence
  Synthetic oligonucleotide; TTT chr11 5361151 5361172 5361156 5361151 -
tgcagcagatttctttctttct

SEQ ID NO: 119792 - DNA, 22 bp, Artificial Sequence
  Synthetic oligonucleotide; TTT chr11 5361150 5361171 5361155 5361150 -
gcagcagatttctttctttctt

SEQ ID NO: 119793 - DNA, 22 bp, Artificial Sequence
  Synthetic oligonucleotide; TTG chr11 5361149 5361170 5361154 5361149 -
cagcagatttctttctttcttt

SEQ ID NO: 119794 - DNA, 22 bp, Artificial Sequence
  Synthetic oligonucleotide; TTT chr11 5361139 5361160 5361144 5361139 -
ctttctttctttcttttattat

SEQ ID NO: 119795 - DNA, 22 bp, Artificial Sequence
  Synthetic oligonucleotide; TTC chr11 5361138 5361159 5361143 5361138 -
tttctttctttcttttattatt

SEQ ID NO: 119796 - DNA, 22 bp, Artificial Sequence
  Synthetic oligonucleotide; CTT chr11 5361136 5361157 5361141 5361136 -
tctttctttcttttattattat

SEQ ID NO: 119797 - DNA, 22 bp, Artificial Sequence
  Synthetic oligonucleotide; TTT chr11 5361135 5361156 5361140 5361135 -
ctttctttcttttattattata

SEQ ID NO: 119798 - DNA, 22 bp, Artificial Sequence
  Synthetic oligonucleotide; TTC chr11 5361134 5361155 5361139 5361134 -
tttctttcttttattattatac

SEQ ID NO: 119799 - DNA, 22 bp, Artificial Sequence
  Synthetic oligonucleotide; CTT chr11 5361132 5361153 5361137 5361132 -
tctttcttttattattatactt

SEQ ID NO: 119800 - DNA, 22 bp, Artificial Sequence
  Synthetic oligonucleotide; TTT chr11 5361131 5361152 5361136 5361131 -
ctttcttttattattatacttt

SEQ ID NO: 119801 - DNA, 22 bp, Artificial Sequence
  Synthetic oligonucleotide; TTC chr11 5361130 5361151 5361135 5361130 -
tttcttttattattatacttta

SEQ ID NO: 119802 - DNA, 22 bp, Artificial Sequence
  Synthetic oligonucleotide; CTT chr11 5361128 5361149 5361133 5361128 -
tcttttattattatactttaag

SEQ ID NO: 119803 - DNA, 22 bp, Artificial Sequence
  Synthetic oligonucleotide; TTT chr11 5361127 5361148 5361132 5361127 -
cttttattattatactttaagt

SEQ ID NO: 119804 - DNA, 22 bp, Artificial Sequence
  Synthetic oligonucleotide; TTC chr11 5361126 5361147 5361131 5361126 -
ttttattattatactttaagtt

SEQ ID NO: 119805 - DNA, 22 bp, Artificial Sequence
  Synthetic oligonucleotide; CTT chr11 5361124 5361145 5361129 5361124 -
ttattattatactttaagtttt

SEQ ID NO: 119806 - DNA, 22 bp, Artificial Sequence
  Synthetic oligonucleotide; TTT chr11 5361123 5361144 5361128 5361123 -
tattattatactttaagtttta

SEQ ID NO: 119807 - DNA, 22 bp, Artificial Sequence
  Synthetic oligonucleotide; TTT chr11 5361122 5361143 5361127 5361122 -
attattatactttaagttttag

SEQ ID NO: 119808 - DNA, 22 bp, Artificial Sequence
  Synthetic oligonucleotide; TTA chr11 5361121 5361142 5361126 5361121 -
ttattatactttaagttttagg

SEQ ID NO: 119809 - DNA, 22 bp, Artificial Sequence
  Synthetic oligonucleotide; TTA chr11 5361118 5361139 5361123 5361118 -
ttatactttaagttttagggta

SEQ ID NO: 119810 - DNA, 22 bp, Artificial Sequence
  Synthetic oligonucleotide; TTA chr11 5361115 5361136 5361120 5361115 -
tactttaagttttagggtacat

SEQ ID NO: 119811 - DNA, 22 bp, Artificial Sequence
  Synthetic oligonucleotide; CTT chr11 5361110 5361131 5361115 5361110 -
taagttttagggtacatttgca

SEQ ID NO: 119812 - DNA, 22 bp, Artificial Sequence
  Synthetic oligonucleotide; TTT chr11 5361109 5361130 5361114 5361109 -
aagttttagggtacatttgcac

SEQ ID NO: 119813 - DNA, 22 bp, Artificial Sequence
  Synthetic oligonucleotide; TTA chr11 5361108 5361129 5361113 5361108 -
agttttagggtacatttgcaca

SEQ ID NO: 119814 - DNA, 22 bp, Artificial Sequence
  Synthetic oligonucleotide; TTT chr11 5361103 5361124 5361108 5361103 -
tagggtacatttgcacaacgtg

SEQ ID NO: 119815 - DNA, 22 bp, Artificial Sequence
  Synthetic oligonucleotide; TTT chr11 5361102 5361123 5361107 5361102 -
agggtacatttgcacaacgtgc

SEQ ID NO: 119816 - DNA, 22 bp, Artificial Sequence
  Synthetic oligonucleotide; TTA chr11 5361101 5361122 5361106 5361101 -
gggtacatttgcacaacgtgca

SEQ ID NO: 119817 - DNA, 22 bp, Artificial Sequence
  Synthetic oligonucleotide; TTT chr11 5361091 5361112 5361096 5361091 -
gcacaacgtgcaggtttgttac

SEQ ID NO: 119818 - DNA, 22 bp, Artificial Sequence
  Synthetic oligonucleotide; TTG chr11 5361090 5361111 5361095 5361090 -
cacaacgtgcaggtttgttaca

SEQ ID NO: 119819 - DNA, 22 bp, Artificial Sequence
  Synthetic oligonucleotide; TTT chr11 5361074 5361095 5361079 5361074 -
gttacatatgtatacatgtgcc

SEQ ID NO: 119820 - DNA, 22 bp, Artificial Sequence
  Synthetic oligonucleotide; TTG chr11 5361073 5361094 5361078 5361073 -
ttacatatgtatacatgtgcca

SEQ ID NO: 119821 - DNA, 22 bp, Artificial Sequence
  Synthetic oligonucleotide; TTA chr11 5361070 5361091 5361075 5361070 -
catatgtatacatgtgccatgt

SEQ ID NO: 119822 - DNA, 22 bp, Artificial Sequence
  Synthetic oligonucleotide; TTG chr11 5361046 5361067 5361051 5361046 -
gtgtgctgcacccattaactcg

SEQ ID NO: 119823 - DNA, 22 bp, Artificial Sequence
  Synthetic oligonucleotide; CTG chr11 5361038 5361059 5361043 5361038 -
cacccattaactcgtcacttag

SEQ ID NO: 119824 - DNA, 22 bp, Artificial Sequence
  Synthetic oligonucleotide; TTA chr11 5361029 5361050 5361034 5361029 -
actcgtcacttagcattaggta

SEQ ID NO: 119825 - DNA, 22 bp, Artificial Sequence
  Synthetic oligonucleotide; CTC chr11 5361025 5361046 5361030 5361025 -
gtcacttagcattaggtatatc

SEQ ID NO: 119826 - DNA, 22 bp, Artificial Sequence
  Synthetic oligonucleotide; CTT chr11 5361018 5361039 5361023 5361018 -
agcattaggtatatctcctaat

SEQ ID NO: 119827 - DNA, 22 bp, Artificial Sequence
  Synthetic oligonucleotide; TTA chr11 5361017 5361038 5361022 5361017 -
gcattaggtatatctcctaatg

SEQ ID NO: 119828 - DNA, 22 bp, Artificial Sequence
  Synthetic oligonucleotide; TTA chr11 5361011 5361032 5361016 5361011 -
ggtatatctcctaatgctatcc

SEQ ID NO: 119829 - DNA, 22 bp, Artificial Sequence
  Synthetic oligonucleotide; CTC chr11 5361001 5361022 5361006 5361001 -
ctaatgctatccctccccccga

SEQ ID NO: 119830 - DNA, 22 bp, Artificial Sequence
  Synthetic oligonucleotide; CTA chr11 5360998 5361019 5361003 5360998 -
atgctatccctccccccgaccc

SEQ ID NO: 119831 - DNA, 22 bp, Artificial Sequence
  Synthetic oligonucleotide; CTA chr11 5360992 5361013 5360997 5360992 -
tccctccccccgacccccaccc

SEQ ID NO: 119832 - DNA, 22 bp, Artificial Sequence
  Synthetic oligonucleotide; CTC chr11 5360986 5361007 5360991 5360986 -
cccccgacccccaccccactgc

SEQ ID NO: 119833 - DNA, 22 bp, Artificial Sequence
  Synthetic oligonucleotide; CTG chr11 5360965 5360986 5360970 5360965 -
caggccctggtgtgtgatgttc

SEQ ID NO: 119834 - DNA, 22 bp, Artificial Sequence
  Synthetic oligonucleotide; CTG chr11 5360956 5360977 5360961 5360956 -
gtgtgtgatgttccccttcctg

SEQ ID NO: 119835 - DNA, 22 bp, Artificial Sequence
  Synthetic oligonucleotide; TTC chr11 5360943 5360964 5360948 5360943 -
cccttcctgtgtccatgtgttc

SEQ ID NO: 119836 - DNA, 22 bp, Artificial Sequence
  Synthetic oligonucleotide; CTT chr11 5360938 5360959 5360943 5360938 -
cctgtgtccatgtgttctcatt

SEQ ID NO: 119837 - DNA, 22 bp, Artificial Sequence
  Synthetic oligonucleotide; TTC chr11 5360937 5360958 5360942 5360937 -
ctgtgtccatgtgttctcattg

SEQ ID NO: 119838 - DNA, 22 bp, Artificial Sequence
  Synthetic oligonucleotide; CTG chr11 5360934 5360955 5360939 5360934 -
tgtccatgtgttctcattgttc

SEQ ID NO: 119839 - DNA, 22 bp, Artificial Sequence
  Synthetic oligonucleotide; TTC chr11 5360921 5360942 5360926 5360921 -
tcattgttcaattcccacctat

SEQ ID NO: 119840 - DNA, 22 bp, Artificial Sequence
  Synthetic oligonucleotide; CTC chr11 5360919 5360940 5360924 5360919 -
attgttcaattcccacctatga

SEQ ID NO: 119841 - DNA, 22 bp, Artificial Sequence
  Synthetic oligonucleotide; TTG chr11 5360915 5360936 5360920 5360915 -
ttcaattcccacctatgagtga

SEQ ID NO: 119842 - DNA, 22 bp, Artificial Sequence
  Synthetic oligonucleotide; TTC chr11 5360912 5360933 5360917 5360912 -
aattcccacctatgagtgagaa

SEQ ID NO: 119843 - DNA, 22 bp, Artificial Sequence
  Synthetic oligonucleotide; TTC chr11 5360907 5360928 5360912 5360907 -
ccacctatgagtgagaacatgc

SEQ ID NO: 119844 - DNA, 22 bp, Artificial Sequence
  Synthetic oligonucleotide; CTA chr11 5360900 5360921 5360905 5360900 -
tgagtgagaacatgcagtgttt

SEQ ID NO: 119845 - DNA, 22 bp, Artificial Sequence
  Synthetic oligonucleotide; TTT chr11 5360878 5360899 5360883 5360878 -
ggtttttgtccttgcgatagtt

SEQ ID NO: 119846 - DNA, 22 bp, Artificial Sequence
  Synthetic oligonucleotide; TTG chr11 5360877 5360898 5360882 5360877 -
gtttttgtccttgcgatagttt

SEQ ID NO: 119847 - DNA, 22 bp, Artificial Sequence
  Synthetic oligonucleotide; TTT chr11 5360873 5360894 5360878 5360873 -
ttgtccttgcgatagtttgctg

SEQ ID NO: 119848 - DNA, 22 bp, Artificial Sequence
  Synthetic oligonucleotide; TTT chr11 5360872 5360893 5360877 5360872 -
tgtccttgcgatagtttgctga

SEQ ID NO: 119849 - DNA, 22 bp, Artificial Sequence
  Synthetic oligonucleotide; TTT chr11 5360871 5360892 5360876 5360871 -
gtccttgcgatagtttgctgag

SEQ ID NO: 119850 - DNA, 22 bp, Artificial Sequence
  Synthetic oligonucleotide; TTG chr11 5360870 5360891 5360875 5360870 -
tccttgcgatagtttgctgaga

SEQ ID NO: 119851 - DNA, 22 bp, Artificial Sequence
  Synthetic oligonucleotide; CTT chr11 5360865 5360886 5360870 5360865 -
gcgatagtttgctgagaatgat

SEQ ID NO: 119852 - DNA, 22 bp, Artificial Sequence
  Synthetic oligonucleotide; TTG chr11 5360864 5360885 5360869 5360864 -
cgatagtttgctgagaatgatg

SEQ ID NO: 119853 - DNA, 22 bp, Artificial Sequence
  Synthetic oligonucleotide; TTT chr11 5360855 5360876 5360860 5360855 -
gctgagaatgatggtttccagc

SEQ ID NO: 119854 - DNA, 22 bp, Artificial Sequence
  Synthetic oligonucleotide; TTG chr11 5360854 5360875 5360859 5360854 -
ctgagaatgatggtttccagct

SEQ ID NO: 119855 - DNA, 22 bp, Artificial Sequence
  Synthetic oligonucleotide; CTG chr11 5360851 5360872 5360856 5360851 -
agaatgatggtttccagcttca

SEQ ID NO: 119856 - DNA, 22 bp, Artificial Sequence
  Synthetic oligonucleotide; TTT chr11 5360838 5360859 5360843 5360838 -
ccagcttcatccatgtccctac

SEQ ID NO: 119857 - DNA, 22 bp, Artificial Sequence
  Synthetic oligonucleotide; TTC chr11 5360837 5360858 5360842 5360837 -
cagcttcatccatgtccctaca

SEQ ID NO: 119858 - DNA, 22 bp, Artificial Sequence
  Synthetic oligonucleotide; CTT chr11 5360831 5360852 5360836 5360831 -
catccatgtccctacaaaggac

SEQ ID NO: 119859 - DNA, 22 bp, Artificial Sequence
  Synthetic oligonucleotide; TTC chr11 5360830 5360851 5360835 5360830 -
atccatgtccctacaaaggaca

SEQ ID NO: 119860 - DNA, 22 bp, Artificial Sequence
  Synthetic oligonucleotide; CTA chr11 5360817 5360838 5360822 5360817 -
caaaggacatgaactcttcatt

SEQ ID NO: 119861 - DNA, 22 bp, Artificial Sequence
  Synthetic oligonucleotide; CTC chr11 5360801 5360822 5360806 5360801 -
ttcattttttatggctgcatag

SEQ ID NO: 119862 - DNA, 22 bp, Artificial Sequence
  Synthetic oligonucleotide; CTT chr11 5360799 5360820 5360804 5360799 -
cattttttatggctgcatagta

SEQ ID NO: 119863 - DNA, 22 bp, Artificial Sequence
  Synthetic oligonucleotide; TTC chr11 5360798 5360819 5360803 5360798 -
attttttatggctgcatagtat

SEQ ID NO: 119864 - DNA, 22 bp, Artificial Sequence
  Synthetic oligonucleotide; TTT chr11 5360794 5360815 5360799 5360794 -
tttatggctgcatagtattcca

SEQ ID NO: 119865 - DNA, 22 bp, Artificial Sequence
  Synthetic oligonucleotide; TTT chr11 5360793 5360814 5360798 5360793 -
ttatggctgcatagtattccat

SEQ ID NO: 119866 - DNA, 22 bp, Artificial Sequence
  Synthetic oligonucleotide; TTT chr11 5360792 5360813 5360797 5360792 -
tatggctgcatagtattccatg

SEQ ID NO: 119867 - DNA, 22 bp, Artificial Sequence
  Synthetic oligonucleotide; TTT chr11 5360791 5360812 5360796 5360791 -
atggctgcatagtattccatgg

SEQ ID NO: 119868 - DNA, 22 bp, Artificial Sequence
  Synthetic oligonucleotide; TTA chr11 5360790 5360811 5360795 5360790 -
tggctgcatagtattccatggt

SEQ ID NO: 119869 - DNA, 22 bp, Artificial Sequence
  Synthetic oligonucleotide; CTG chr11 5360784 5360805 5360789 5360784 -
catagtattccatggtgtatat

SEQ ID NO: 119870 - DNA, 22 bp, Artificial Sequence
  Synthetic oligonucleotide; TTC chr11 5360774 5360795 5360779 5360774 -
catggtgtatatgtgccacgtt

SEQ ID NO: 119871 - DNA, 22 bp, Artificial Sequence
  Synthetic oligonucleotide; TTT chr11 5360751 5360772 5360756 5360751 -
tcttaatccagtctatcattgt

SEQ ID NO: 119872 - DNA, 22 bp, Artificial Sequence
  Synthetic oligonucleotide; TTT chr11 5360750 5360771 5360755 5360750 -
cttaatccagtctatcattgtt

SEQ ID NO: 119873 - DNA, 22 bp, Artificial Sequence
  Synthetic oligonucleotide; TTC chr11 5360749 5360770 5360754 5360749 -
ttaatccagtctatcattgttg

SEQ ID NO: 119874 - DNA, 22 bp, Artificial Sequence
  Synthetic oligonucleotide; CTT chr11 5360747 5360768 5360752 5360747 -
aatccagtctatcattgttgga

SEQ ID NO: 119875 - DNA, 22 bp, Artificial Sequence
  Synthetic oligonucleotide; TTA chr11 5360746 5360767 5360751 5360746 -
atccagtctatcattgttggac

SEQ ID NO: 119876 - DNA, 22 bp, Artificial Sequence
  Synthetic oligonucleotide; CTA chr11 5360736 5360757 5360741 5360736 -
tcattgttggacatttgggttg

SEQ ID NO: 119877 - DNA, 22 bp, Artificial Sequence
  Synthetic oligonucleotide; TTG chr11 5360730 5360751 5360735 5360730 -
ttggacatttgggttggttcca

SEQ ID NO: 119878 - DNA, 22 bp, Artificial Sequence
  Synthetic oligonucleotide; TTG chr11 5360727 5360748 5360732 5360727 -
gacatttgggttggttccaagt

SEQ ID NO: 119879 - DNA, 22 bp, Artificial Sequence
  Synthetic oligonucleotide; TTT chr11 5360720 5360741 5360725 5360720 -
gggttggttccaagtctttgct

SEQ ID NO: 119880 - DNA, 22 bp, Artificial Sequence
  Synthetic oligonucleotide; TTG chr11 5360719 5360740 5360724 5360719 -
ggttggttccaagtctttgcta

SEQ ID NO: 119881 - DNA, 22 bp, Artificial Sequence
  Synthetic oligonucleotide; TTG chr11 5360714 5360735 5360719 5360714 -
gttccaagtctttgctattgtg

SEQ ID NO: 119882 - DNA, 22 bp, Artificial Sequence
  Synthetic oligonucleotide; TTC chr11 5360710 5360731 5360715 5360710 -
caagtctttgctattgtgaata

SEQ ID NO: 119883 - DNA, 22 bp, Artificial Sequence
  Synthetic oligonucleotide; CTT chr11 5360702 5360723 5360707 5360702 -
tgctattgtgaatagtgccaca

SEQ ID NO: 119884 - DNA, 22 bp, Artificial Sequence
  Synthetic oligonucleotide; TTT chr11 5360701 5360722 5360706 5360701 -
gctattgtgaatagtgccacaa

SEQ ID NO: 119885 - DNA, 22 bp, Artificial Sequence
  Synthetic oligonucleotide; TTG chr11 5360700 5360721 5360705 5360700 -
ctattgtgaatagtgccacaat

SEQ ID NO: 119886 - DNA, 22 bp, Artificial Sequence
  Synthetic oligonucleotide; CTA chr11 5360697 5360718 5360702 5360697 -
ttgtgaatagtgccacaataaa

SEQ ID NO: 119887 - DNA, 22 bp, Artificial Sequence
  Synthetic oligonucleotide; TTG chr11 5360694 5360715 5360699 5360694 -
tgaatagtgccacaataaacat

SEQ ID NO: 119888 - DNA, 22 bp, Artificial Sequence
  Synthetic oligonucleotide; CTT chr11 5360655 5360676 5360660 5360655 -
tatagcagcatgatttataatc

SEQ ID NO: 119889 - DNA, 22 bp, Artificial Sequence
  Synthetic oligonucleotide; TTT chr11 5360654 5360675 5360659 5360654 -
atagcagcatgatttataatcc

SEQ ID NO: 119890 - DNA, 22 bp, Artificial Sequence
  Synthetic oligonucleotide; TTA chr11 5360653 5360674 5360658 5360653 -
tagcagcatgatttataatcct

SEQ ID NO: 119891 - DNA, 22 bp, Artificial Sequence
  Synthetic oligonucleotide; TTT chr11 5360639 5360660 5360644 5360639 -
ataatcctttgagtatgtaccc

SEQ ID NO: 119892 - DNA, 22 bp, Artificial Sequence
  Synthetic oligonucleotide; TTA chr11 5360638 5360659 5360643 5360638 -
taatcctttgagtatgtaccca

SEQ ID NO: 119893 - DNA, 22 bp, Artificial Sequence
  Synthetic oligonucleotide; CTT chr11 5360630 5360651 5360635 5360630 -
tgagtatgtacccagtaatggg

SEQ ID NO: 119894 - DNA, 22 bp, Artificial Sequence
  Synthetic oligonucleotide; TTT chr11 5360629 5360650 5360634 5360629 -
gagtatgtacccagtaatggga

SEQ ID NO: 119895 - DNA, 22 bp, Artificial Sequence
  Synthetic oligonucleotide; TTG chr11 5360628 5360649 5360633 5360628 -
agtatgtacccagtaatgggat

SEQ ID NO: 119896 - DNA, 22 bp, Artificial Sequence
  Synthetic oligonucleotide; CTG chr11 5360601 5360622 5360606 5360601 -
ggtcaaatggtatttctagttc

SEQ ID NO: 119897 - DNA, 22 bp, Artificial Sequence
  Synthetic oligonucleotide; TTT chr11 5360586 5360607 5360591 5360586 -
ctagttctagatccctgaggaa

SEQ ID NO: 119898 - DNA, 22 bp, Artificial Sequence
  Synthetic oligonucleotide; TTC chr11 5360585 5360606 5360590 5360585 -
tagttctagatccctgaggaat

SEQ ID NO: 119899 - DNA, 22 bp, Artificial Sequence
  Synthetic oligonucleotide; CTA chr11 5360583 5360604 5360588 5360583 -
gttctagatccctgaggaatcg

SEQ ID NO: 119900 - DNA, 22 bp, Artificial Sequence
  Synthetic oligonucleotide; TTC chr11 5360579 5360600 5360584 5360579 -
tagatccctgaggaatcgccac

SEQ ID NO: 119901 - DNA, 22 bp, Artificial Sequence
  Synthetic oligonucleotide; CTA chr11 5360577 5360598 5360582 5360577 -
gatccctgaggaatcgccacac

SEQ ID NO: 119902 - DNA, 22 bp, Artificial Sequence
  Synthetic oligonucleotide; CTG chr11 5360569 5360590 5360574 5360569 -
aggaatcgccacactgacttcc

SEQ ID NO: 119903 - DNA, 22 bp, Artificial Sequence
  Synthetic oligonucleotide; CTG chr11 5360553 5360574 5360558 5360553 -
acttccacaatggttgaactag

SEQ ID NO: 119904 - DNA, 22 bp, Artificial Sequence
  Synthetic oligonucleotide; CTT chr11 5360549 5360570 5360554 5360549 -
ccacaatggttgaactagttta

SEQ ID NO: 119905 - DNA, 22 bp, Artificial Sequence
  Synthetic oligonucleotide; TTC chr11 5360548 5360569 5360553 5360548 -
cacaatggttgaactagtttac

SEQ ID NO: 119906 - DNA, 22 bp, Artificial Sequence
  Synthetic oligonucleotide; TTG chr11 5360537 5360558 5360542 5360537 -
aactagtttacagtctcaccaa

SEQ ID NO: 119907 - DNA, 22 bp, Artificial Sequence
  Synthetic oligonucleotide; CTA chr11 5360532 5360553 5360537 5360532 -
gtttacagtctcaccaacagtg

SEQ ID NO: 119908 - DNA, 22 bp, Artificial Sequence
  Synthetic oligonucleotide; TTT chr11 5360528 5360549 5360533 5360528 -
acagtctcaccaacagtgtaaa

SEQ ID NO: 119909 - DNA, 22 bp, Artificial Sequence
  Synthetic oligonucleotide; TTA chr11 5360527 5360548 5360532 5360527 -
cagtctcaccaacagtgtaaaa

SEQ ID NO: 119910 - DNA, 22 bp, Artificial Sequence
  Synthetic oligonucleotide; CTC chr11 5360520 5360541 5360525 5360520 -
accaacagtgtaaaagtgttcc

SEQ ID NO: 119911 - DNA, 22 bp, Artificial Sequence
  Synthetic oligonucleotide; TTC chr11 5360499 5360520 5360504 5360499 -
ctacttcttcacatcctctcca

SEQ ID NO: 119912 - DNA, 22 bp, Artificial Sequence
  Synthetic oligonucleotide; CTA chr11 5360496 5360517 5360501 5360496 -
cttcttcacatcctctccagca

SEQ ID NO: 119913 - DNA, 22 bp, Artificial Sequence
  Synthetic oligonucleotide; CTT chr11 5360493 5360514 5360498 5360493 -
cttcacatcctctccagcacct

SEQ ID NO: 119914 - DNA, 22 bp, Artificial Sequence
  Synthetic oligonucleotide; TTC chr11 5360492 5360513 5360497 5360492 -
ttcacatcctctccagcacctg

SEQ ID NO: 119915 - DNA, 22 bp, Artificial Sequence
  Synthetic oligonucleotide; CTT chr11 5360490 5360511 5360495 5360490 -
cacatcctctccagcacctgtt

SEQ ID NO: 119916 - DNA, 22 bp, Artificial Sequence
  Synthetic oligonucleotide; TTC chr11 5360489 5360510 5360494 5360489 -
acatcctctccagcacctgttg

SEQ ID NO: 119917 - DNA, 22 bp, Artificial Sequence
  Synthetic oligonucleotide; CTC chr11 5360481 5360502 5360486 5360481 -
tccagcacctgttgtttcctga

SEQ ID NO: 119918 - DNA, 22 bp, Artificial Sequence
  Synthetic oligonucleotide; CTC chr11 5360479 5360500 5360484 5360479 -
cagcacctgttgtttcctgact

SEQ ID NO: 119919 - DNA, 22 bp, Artificial Sequence
  Synthetic oligonucleotide; CTG chr11 5360470 5360491 5360475 5360470 -
ttgtttcctgactttttaatga

SEQ ID NO: 119920 - DNA, 22 bp, Artificial Sequence
  Synthetic oligonucleotide; TTG chr11 5360467 5360488 5360472 5360467 -
tttcctgactttttaatgatcg

SEQ ID NO: 119921 - DNA, 22 bp, Artificial Sequence
  Synthetic oligonucleotide; TTT chr11 5360464 5360485 5360469 5360464 -
cctgactttttaatgatcgcca

SEQ ID NO: 119922 - DNA, 22 bp, Artificial Sequence
  Synthetic oligonucleotide; TTC chr11 5360463 5360484 5360468 5360463 -
ctgactttttaatgatcgccat

SEQ ID NO: 119923 - DNA, 22 bp, Artificial Sequence
  Synthetic oligonucleotide; CTG chr11 5360460 5360481 5360465 5360460 -
actttttaatgatcgccattct

SEQ ID NO: 119924 - DNA, 22 bp, Artificial Sequence
  Synthetic oligonucleotide; CTT chr11 5360456 5360477 5360461 5360456 -
tttaatgatcgccattctaact

SEQ ID NO: 119925 - DNA, 22 bp, Artificial Sequence
  Synthetic oligonucleotide; TTT chr11 5360455 5360476 5360460 5360455 -
ttaatgatcgccattctaactg

SEQ ID NO: 119926 - DNA, 22 bp, Artificial Sequence
  Synthetic oligonucleotide; TTT chr11 5360454 5360475 5360459 5360454 -
taatgatcgccattctaactgg

SEQ ID NO: 119927 - DNA, 22 bp, Artificial Sequence
  Synthetic oligonucleotide; TTT chr11 5360453 5360474 5360458 5360453 -
aatgatcgccattctaactggt

SEQ ID NO: 119928 - DNA, 22 bp, Artificial Sequence
  Synthetic oligonucleotide; TTA chr11 5360452 5360473 5360457 5360452 -
atgatcgccattctaactggtg

SEQ ID NO: 119929 - DNA, 22 bp, Artificial Sequence
  Synthetic oligonucleotide; TTC chr11 5360439 5360460 5360444 5360439 -
taactggtgtgagatggtatct

SEQ ID NO: 119930 - DNA, 22 bp, Artificial Sequence
  Synthetic oligonucleotide; CTA chr11 5360437 5360458 5360442 5360437 -
actggtgtgagatggtatctca

SEQ ID NO: 119931 - DNA, 22 bp, Artificial Sequence
  Synthetic oligonucleotide; CTG chr11 5360433 5360454 5360438 5360433 -
gtgtgagatggtatctcactgt

SEQ ID NO: 119932 - DNA, 22 bp, Artificial Sequence
  Synthetic oligonucleotide; CTC chr11 5360416 5360437 5360421 5360416 -
actgtggttttgatttgtattt

SEQ ID NO: 119933 - DNA, 22 bp, Artificial Sequence
  Synthetic oligonucleotide; CTG chr11 5360412 5360433 5360417 5360412 -
tggttttgatttgtatttctct

SEQ ID NO: 119934 - DNA, 22 bp, Artificial Sequence
  Synthetic oligonucleotide; TTT chr11 5360406 5360427 5360411 5360406 -
tgatttgtatttctctgatggc

SEQ ID NO: 119935 - DNA, 22 bp, Artificial Sequence
  Synthetic oligonucleotide; TTT chr11 5360405 5360426 5360410 5360405 -
gatttgtatttctctgatggcc

SEQ ID NO: 119936 - DNA, 22 bp, Artificial Sequence
  Synthetic oligonucleotide; TTG chr11 5360404 5360425 5360409 5360404 -
atttgtatttctctgatggcca

SEQ ID NO: 119937 - DNA, 22 bp, Artificial Sequence
  Synthetic oligonucleotide; TTT chr11 5360400 5360421 5360405 5360400 -
gtatttctctgatggccagtga

SEQ ID NO: 119938 - DNA, 22 bp, Artificial Sequence
  Synthetic oligonucleotide; TTG chr11 5360399 5360420 5360404 5360399 -
tatttctctgatggccagtgat

SEQ ID NO: 119939 - DNA, 22 bp, Artificial Sequence
  Synthetic oligonucleotide; TTT chr11 5360394 5360415 5360399 5360394 -
ctctgatggccagtgatgatga

SEQ ID NO: 119940 - DNA, 22 bp, Artificial Sequence
  Synthetic oligonucleotide; TTC chr11 5360393 5360414 5360398 5360393 -
tctgatggccagtgatgatgag

SEQ ID NO: 119941 - DNA, 22 bp, Artificial Sequence
  Synthetic oligonucleotide; CTC chr11 5360391 5360412 5360396 5360391 -
tgatggccagtgatgatgagca

SEQ ID NO: 119942 - DNA, 22 bp, Artificial Sequence
  Synthetic oligonucleotide; CTG chr11 5360389 5360410 5360394 5360389 -
atggccagtgatgatgagcatt

SEQ ID NO: 119943 - DNA, 22 bp, Artificial Sequence
  Synthetic oligonucleotide; TTT chr11 5360366 5360387 5360371 5360366 -
tttcatgtgtctgttgactgca

SEQ ID NO: 119944 - DNA, 22 bp, Artificial Sequence
  Synthetic oligonucleotide; TTT chr11 5360365 5360386 5360370 5360365 -
ttcatgtgtctgttgactgcat

SEQ ID NO: 119945 - DNA, 22 bp, Artificial Sequence
  Synthetic oligonucleotide; TTT chr11 5360364 5360385 5360369 5360364 -
tcatgtgtctgttgactgcata

SEQ ID NO: 119946 - DNA, 22 bp, Artificial Sequence
  Synthetic oligonucleotide; TTT chr11 5360363 5360384 5360368 5360363 -
catgtgtctgttgactgcataa

SEQ ID NO: 119947 - DNA, 22 bp, Artificial Sequence
  Synthetic oligonucleotide; TTC chr11 5360362 5360383 5360367 5360362 -
atgtgtctgttgactgcataaa

SEQ ID NO: 119948 - DNA, 22 bp, Artificial Sequence
  Synthetic oligonucleotide; CTG chr11 5360353 5360374 5360358 5360353 -
ttgactgcataaatgtcttctt

SEQ ID NO: 119949 - DNA, 22 bp, Artificial Sequence
  Synthetic oligonucleotide; TTG chr11 5360350 5360371 5360355 5360350 -
actgcataaatgtcttcttttg

SEQ ID NO: 119950 - DNA, 22 bp, Artificial Sequence
  Synthetic oligonucleotide; CTG chr11 5360346 5360367 5360351 5360346 -
cataaatgtcttcttttgagaa

SEQ ID NO: 119951 - DNA, 22 bp, Artificial Sequence
  Synthetic oligonucleotide; CTT chr11 5360334 5360355 5360339 5360334 -
cttttgagaagtgtctgttcat

SEQ ID NO: 119952 - DNA, 22 bp, Artificial Sequence
  Synthetic oligonucleotide; TTC chr11 5360333 5360354 5360338 5360333 -
ttttgagaagtgtctgttcata

SEQ ID NO: 119953 - DNA, 22 bp, Artificial Sequence
  Synthetic oligonucleotide; CTT chr11 5360331 5360352 5360336 5360331 -
ttgagaagtgtctgttcatatc

SEQ ID NO: 119954 - DNA, 22 bp, Artificial Sequence
  Synthetic oligonucleotide; TTT chr11 5360330 5360351 5360335 5360330 -
tgagaagtgtctgttcatatcc

SEQ ID NO: 119955 - DNA, 22 bp, Artificial Sequence
  Synthetic oligonucleotide; TTT chr11 5360329 5360350 5360334 5360329 -
gagaagtgtctgttcatatcct

SEQ ID NO: 119956 - DNA, 22 bp, Artificial Sequence
  Synthetic oligonucleotide; TTG chr11 5360328 5360349 5360333 5360328 -
agaagtgtctgttcatatcctt

SEQ ID NO: 119957 - DNA, 22 bp, Artificial Sequence
  Synthetic oligonucleotide; CTG chr11 5360317 5360338 5360322 5360317 -
ttcatatcctttgcccactttt

SEQ ID NO: 119958 - DNA, 22 bp, Artificial Sequence
  Synthetic oligonucleotide; TTC chr11 5360314 5360335 5360319 5360314 -
atatcctttgcccactttttga

SEQ ID NO: 119959 - DNA, 22 bp, Artificial Sequence
  Synthetic oligonucleotide; CTT chr11 5360306 5360327 5360311 5360306 -
tgcccactttttgatggggttg

SEQ ID NO: 119960 - DNA, 22 bp, Artificial Sequence
  Synthetic oligonucleotide; TTT chr11 5360305 5360326 5360310 5360305 -
gcccactttttgatggggttgt

SEQ ID NO: 119961 - DNA, 22 bp, Artificial Sequence
  Synthetic oligonucleotide; TTG chr11 5360304 5360325 5360309 5360304 -
cccactttttgatggggttgtt

SEQ ID NO: 119962 - DNA, 22 bp, Artificial Sequence
  Synthetic oligonucleotide; CTT chr11 5360297 5360318 5360302 5360297 -
tttgatggggttgtttttttct

SEQ ID NO: 119963 - DNA, 22 bp, Artificial Sequence
  Synthetic oligonucleotide; TTT chr11 5360296 5360317 5360301 5360296 -
ttgatggggttgtttttttctt

SEQ ID NO: 119964 - DNA, 22 bp, Artificial Sequence
  Synthetic oligonucleotide; TTT chr11 5360295 5360316 5360300 5360295 -
tgatggggttgtttttttcttg

SEQ ID NO: 119965 - DNA, 22 bp, Artificial Sequence
  Synthetic oligonucleotide; TTT chr11 5360294 5360315 5360299 5360294 -
gatggggttgtttttttcttgt

SEQ ID NO: 119966 - DNA, 22 bp, Artificial Sequence
  Synthetic oligonucleotide; TTG chr11 5360293 5360314 5360298 5360293 -
atggggttgtttttttcttgta

SEQ ID NO: 119967 - DNA, 22 bp, Artificial Sequence
  Synthetic oligonucleotide; TTG chr11 5360284 5360305 5360289 5360284 -
tttttttcttgtaaatttgttt

SEQ ID NO: 119968 - DNA, 22 bp, Artificial Sequence
  Synthetic oligonucleotide; TTT chr11 5360281 5360302 5360286 5360281 -
ttttcttgtaaatttgtttgag

SEQ ID NO: 119969 - DNA, 22 bp, Artificial Sequence
  Synthetic oligonucleotide; TTT chr11 5360280 5360301 5360285 5360280 -
tttcttgtaaatttgtttgagt

SEQ ID NO: 119970 - DNA, 22 bp, Artificial Sequence
  Synthetic oligonucleotide; TTT chr11 5360279 5360300 5360284 5360279 -
ttcttgtaaatttgtttgagtt

SEQ ID NO: 119971 - DNA, 22 bp, Artificial Sequence
  Synthetic oligonucleotide; TTT chr11 5360278 5360299 5360283 5360278 -
tcttgtaaatttgtttgagttc

SEQ ID NO: 119972 - DNA, 22 bp, Artificial Sequence
  Synthetic oligonucleotide; TTT chr11 5360277 5360298 5360282 5360277 -
cttgtaaatttgtttgagttca

SEQ ID NO: 119973 - DNA, 22 bp, Artificial Sequence
  Synthetic oligonucleotide; TTC chr11 5360276 5360297 5360281 5360276 -
ttgtaaatttgtttgagttcat

SEQ ID NO: 119974 - DNA, 22 bp, Artificial Sequence
  Synthetic oligonucleotide; CTT chr11 5360274 5360295 5360279 5360274 -
gtaaatttgtttgagttcatca

SEQ ID NO: 119975 - DNA, 22 bp, Artificial Sequence
  Synthetic oligonucleotide; TTG chr11 5360273 5360294 5360278 5360273 -
taaatttgtttgagttcatcat

SEQ ID NO: 119976 - DNA, 22 bp, Artificial Sequence
  Synthetic oligonucleotide; TTT chr11 5360266 5360287 5360271 5360266 -
gtttgagttcatcatagattct

SEQ ID NO: 119977 - DNA, 22 bp, Artificial Sequence
  Synthetic oligonucleotide; TTG chr11 5360265 5360286 5360270 5360265 -
tttgagttcatcatagattctg

SEQ ID NO: 119978 - DNA, 22 bp, Artificial Sequence
  Synthetic oligonucleotide; TTT chr11 5360262 5360283 5360267 5360262 -
gagttcatcatagattctggat

SEQ ID NO: 119979 - DNA, 22 bp, Artificial Sequence
  Synthetic oligonucleotide; TTG chr11 5360261 5360282 5360266 5360261 -
agttcatcatagattctggata

SEQ ID NO: 119980 - DNA, 22 bp, Artificial Sequence
  Synthetic oligonucleotide; TTC chr11 5360256 5360277 5360261 5360256 -
atcatagattctggatattagc

SEQ ID NO: 119981 - DNA, 22 bp, Artificial Sequence
  Synthetic oligonucleotide; TTC chr11 5360245 5360266 5360250 5360245 -
tggatattagccctttgtcgga

SEQ ID NO: 119982 - DNA, 22 bp, Artificial Sequence
  Synthetic oligonucleotide; CTG chr11 5360243 5360264 5360248 5360243 -
gatattagccctttgtcggatg

SEQ ID NO: 119983 - DNA, 22 bp, Artificial Sequence
  Synthetic oligonucleotide; TTA chr11 5360236 5360257 5360241 5360236 -
gccctttgtcggatgagtagat

SEQ ID NO: 119984 - DNA, 22 bp, Artificial Sequence
  Synthetic oligonucleotide; CTT chr11 5360230 5360251 5360235 5360230 -
tgtcggatgagtagattgcaaa

SEQ ID NO: 119985 - DNA, 22 bp, Artificial Sequence
  Synthetic oligonucleotide; TTT chr11 5360229 5360250 5360234 5360229 -
gtcggatgagtagattgcaaaa

SEQ ID NO: 119986 - DNA, 22 bp, Artificial Sequence
  Synthetic oligonucleotide; TTG chr11 5360228 5360249 5360233 5360228 -
tcggatgagtagattgcaaaaa

SEQ ID NO: 119987 - DNA, 22 bp, Artificial Sequence
  Synthetic oligonucleotide; TTG chr11 5360212 5360233 5360217 5360212 -
caaaaattttctcccattctgt

SEQ ID NO: 119988 - DNA, 22 bp, Artificial Sequence
  Synthetic oligonucleotide; TTT chr11 5360203 5360224 5360208 5360203 -
tctcccattctgtatgttgcct

SEQ ID NO: 119989 - DNA, 22 bp, Artificial Sequence
  Synthetic oligonucleotide; TTT chr11 5360202 5360223 5360207 5360202 -
ctcccattctgtatgttgcctg

SEQ ID NO: 119990 - DNA, 22 bp, Artificial Sequence
  Synthetic oligonucleotide; TTC chr11 5360201 5360222 5360206 5360201 -
tcccattctgtatgttgcctgt

SEQ ID NO: 119991 - DNA, 22 bp, Artificial Sequence
  Synthetic oligonucleotide; CTC chr11 5360199 5360220 5360204 5360199 -
ccattctgtatgttgcctgttc

SEQ ID NO: 119992 - DNA, 22 bp, Artificial Sequence
  Synthetic oligonucleotide; TTC chr11 5360193 5360214 5360198 5360193 -
tgtatgttgcctgttcactctg

SEQ ID NO: 119993 - DNA, 22 bp, Artificial Sequence
  Synthetic oligonucleotide; CTG chr11 5360191 5360212 5360196 5360191 -
tatgttgcctgttcactctgat

SEQ ID NO: 119994 - DNA, 22 bp, Artificial Sequence
  Synthetic oligonucleotide; TTG chr11 5360184 5360205 5360189 5360184 -
cctgttcactctgatggtagtt

SEQ ID NO: 119995 - DNA, 22 bp, Artificial Sequence
  Synthetic oligonucleotide; CTG chr11 5360180 5360201 5360185 5360180 -
ttcactctgatggtagtttctt

SEQ ID NO: 119996 - DNA, 22 bp, Artificial Sequence
  Synthetic oligonucleotide; TTC chr11 5360177 5360198 5360182 5360177 -
actctgatggtagtttcttttg

SEQ ID NO: 119997 - DNA, 22 bp, Artificial Sequence
  Synthetic oligonucleotide; CTC chr11 5360173 5360194 5360178 5360173 -
tgatggtagtttcttttgctgt

SEQ ID NO: 119998 - DNA, 22 bp, Artificial Sequence
  Synthetic oligonucleotide; CTG chr11 5360171 5360192 5360176 5360171 -
atggtagtttcttttgctgtgc

SEQ ID NO: 119999 - DNA, 22 bp, Artificial Sequence
  Synthetic oligonucleotide; TTT chr11 5360161 5360182 5360166 5360161 -
cttttgctgtgcagaagctctt

SEQ ID NO: 120000 - DNA, 22 bp, Artificial Sequence
  Synthetic oligonucleotide; TTC chr11 5360160 5360181 5360165 5360160 -
ttttgctgtgcagaagctcttt

SEQ ID NO: 120001 - DNA, 22 bp, Artificial Sequence
  Synthetic oligonucleotide; CTT chr11 5360158 5360179 5360163 5360158 -
ttgctgtgcagaagctctttag

SEQ ID NO: 120002 - DNA, 22 bp, Artificial Sequence
  Synthetic oligonucleotide; TTT chr11 5360157 5360178 5360162 5360157 -
tgctgtgcagaagctctttagt

SEQ ID NO: 120003 - DNA, 22 bp, Artificial Sequence
  Synthetic oligonucleotide; TTT chr11 5360156 5360177 5360161 5360156 -
gctgtgcagaagctctttagtt

SEQ ID NO: 120004 - DNA, 22 bp, Artificial Sequence
  Synthetic oligonucleotide; TTG chr11 5360155 5360176 5360160 5360155 -
ctgtgcagaagctctttagttt

SEQ ID NO: 120005 - DNA, 22 bp, Artificial Sequence
  Synthetic oligonucleotide; CTG chr11 5360152 5360173 5360157 5360152 -
tgcagaagctctttagtttaat

SEQ ID NO: 120006 - DNA, 22 bp, Artificial Sequence
  Synthetic oligonucleotide; CTC chr11 5360141 5360162 5360146 5360141 -
tttagtttaattagatcccatt

SEQ ID NO: 120007 - DNA, 22 bp, Artificial Sequence
  Synthetic oligonucleotide; CTT chr11 5360139 5360160 5360144 5360139 -
tagtttaattagatcccatttg

SEQ ID NO: 120008 - DNA, 22 bp, Artificial Sequence
  Synthetic oligonucleotide; TTT chr11 5360138 5360159 5360143 5360138 -
agtttaattagatcccatttgt

SEQ ID NO: 120009 - DNA, 22 bp, Artificial Sequence
  Synthetic oligonucleotide; TTA chr11 5360137 5360158 5360142 5360137 -
gtttaattagatcccatttgtc

SEQ ID NO: 120010 - DNA, 22 bp, Artificial Sequence
  Synthetic oligonucleotide; TTT chr11 5360133 5360154 5360138 5360133 -
aattagatcccatttgtccatt

SEQ ID NO: 120011 - DNA, 22 bp, Artificial Sequence
  Synthetic oligonucleotide; TTA chr11 5360132 5360153 5360137 5360132 -
attagatcccatttgtccattt

SEQ ID NO: 120012 - DNA, 22 bp, Artificial Sequence
  Synthetic oligonucleotide; TTA chr11 5360128 5360149 5360133 5360128 -
gatcccatttgtccattttggc

SEQ ID NO: 120013 - DNA, 22 bp, Artificial Sequence
  Synthetic oligonucleotide; TTT chr11 5360118 5360139 5360123 5360118 -
gtccattttggcttttgttgcc

SEQ ID NO: 120014 - DNA, 22 bp, Artificial Sequence
  Synthetic oligonucleotide; TTG chr11 5360117 5360138 5360122 5360117 -
tccattttggcttttgttgcca

SEQ ID NO: 120015 - DNA, 22 bp, Artificial Sequence
  Synthetic oligonucleotide; TTT chr11 5360110 5360131 5360115 5360110 -
tggcttttgttgccattgcttt

SEQ ID NO: 120016 - DNA, 22 bp, Artificial Sequence
  Synthetic oligonucleotide; TTT chr11 5360109 5360130 5360114 5360109 -
ggcttttgttgccattgctttt

SEQ ID NO: 120017 - DNA, 22 bp, Artificial Sequence
  Synthetic oligonucleotide; TTG chr11 5360108 5360129 5360113 5360108 -
gcttttgttgccattgcttttg

SEQ ID NO: 120018 - DNA, 22 bp, Artificial Sequence
  Synthetic oligonucleotide; CTT chr11 5360104 5360125 5360109 5360104 -
ttgttgccattgcttttggtgt

SEQ ID NO: 120019 - DNA, 22 bp, Artificial Sequence
  Synthetic oligonucleotide; TTT chr11 5360103 5360124 5360108 5360103 -
tgttgccattgcttttggtgtt

SEQ ID NO: 120020 - DNA, 22 bp, Artificial Sequence
  Synthetic oligonucleotide; TTT chr11 5360102 5360123 5360107 5360102 -
gttgccattgcttttggtgttt

SEQ ID NO: 120021 - DNA, 22 bp, Artificial Sequence
  Synthetic oligonucleotide; TTG chr11 5360101 5360122 5360106 5360101 -
ttgccattgcttttggtgtttt

SEQ ID NO: 120022 - DNA, 22 bp, Artificial Sequence
  Synthetic oligonucleotide; TTG chr11 5360098 5360119 5360103 5360098 -
ccattgcttttggtgttttaga

SEQ ID NO: 120023 - DNA, 22 bp, Artificial Sequence
  Synthetic oligonucleotide; TTG chr11 5360092 5360113 5360097 5360092 -
cttttggtgttttagacatgaa

SEQ ID NO: 120024 - DNA, 22 bp, Artificial Sequence
  Synthetic oligonucleotide; CTT chr11 5360089 5360110 5360094 5360089 -
ttggtgttttagacatgaagtc

SEQ ID NO: 120025 - DNA, 22 bp, Artificial Sequence
  Synthetic oligonucleotide; TTT chr11 5360088 5360109 5360093 5360088 -
tggtgttttagacatgaagtcc

SEQ ID NO: 120026 - DNA, 22 bp, Artificial Sequence
  Synthetic oligonucleotide; TTT chr11 5360087 5360108 5360092 5360087 -
ggtgttttagacatgaagtcct

SEQ ID NO: 120027 - DNA, 22 bp, Artificial Sequence
  Synthetic oligonucleotide; TTG chr11 5360086 5360107 5360091 5360086 -
gtgttttagacatgaagtcctt

SEQ ID NO: 120028 - DNA, 22 bp, Artificial Sequence
  Synthetic oligonucleotide; TTT chr11 5360080 5360101 5360085 5360080 -
tagacatgaagtccttgcccat

SEQ ID NO: 120029 - DNA, 22 bp, Artificial Sequence
  Synthetic oligonucleotide; TTT chr11 5360079 5360100 5360084 5360079 -
agacatgaagtccttgcccatg

SEQ ID NO: 120030 - DNA, 22 bp, Artificial Sequence
  Synthetic oligonucleotide; TTA chr11 5360078 5360099 5360083 5360078 -
gacatgaagtccttgcccatgc

SEQ ID NO: 120031 - DNA, 22 bp, Artificial Sequence
  Synthetic oligonucleotide; CTT chr11 5360064 5360085 5360069 5360064 -
gcccatgcctatgtcctgaatg

SEQ ID NO: 120032 - DNA, 22 bp, Artificial Sequence
  Synthetic oligonucleotide; TTG chr11 5360063 5360084 5360068 5360063 -
cccatgcctatgtcctgaatgg

SEQ ID NO: 120033 - DNA, 22 bp, Artificial Sequence
  Synthetic oligonucleotide; CTA chr11 5360053 5360074 5360058 5360053 -
tgtcctgaatggtattgcctag

SEQ ID NO: 120034 - DNA, 22 bp, Artificial Sequence
  Synthetic oligonucleotide; CTG chr11 5360046 5360067 5360051 5360046 -
aatggtattgcctaggttttct

SEQ ID NO: 120035 - DNA, 22 bp, Artificial Sequence
  Synthetic oligonucleotide; TTG chr11 5360036 5360057 5360041 5360036 -
cctaggttttcttccagagttt

SEQ ID NO: 120036 - DNA, 22 bp, Artificial Sequence
  Synthetic oligonucleotide; CTA chr11 5360032 5360053 5360037 5360032 -
ggttttcttccagagtttttat

SEQ ID NO: 120037 - DNA, 22 bp, Artificial Sequence
  Synthetic oligonucleotide; TTT chr11 5360027 5360048 5360032 5360027 -
tcttccagagtttttatggttt

SEQ ID NO: 120038 - DNA, 22 bp, Artificial Sequence
  Synthetic oligonucleotide; TTT chr11 5360026 5360047 5360031 5360026 -
cttccagagtttttatggtttt

SEQ ID NO: 120039 - DNA, 22 bp, Artificial Sequence
  Synthetic oligonucleotide; TTC chr11 5360025 5360046 5360030 5360025 -
ttccagagtttttatggttttc

SEQ ID NO: 120040 - DNA, 22 bp, Artificial Sequence
  Synthetic oligonucleotide; CTT chr11 5360023 5360044 5360028 5360023 -
ccagagtttttatggttttcag

SEQ ID NO: 120041 - DNA, 22 bp, Artificial Sequence
  Synthetic oligonucleotide; TTC chr11 5360022 5360043 5360027 5360022 -
cagagtttttatggttttcagt

SEQ ID NO: 120042 - DNA, 22 bp, Artificial Sequence
  Synthetic oligonucleotide; TTT chr11 5360014 5360035 5360019 5360014 -
ttatggttttcagtctaacatt

SEQ ID NO: 120043 - DNA, 22 bp, Artificial Sequence
  Synthetic oligonucleotide; TTT chr11 5360013 5360034 5360018 5360013 -
tatggttttcagtctaacattt

SEQ ID NO: 120044 - DNA, 22 bp, Artificial Sequence
  Synthetic oligonucleotide; TTT chr11 5360012 5360033 5360017 5360012 -
atggttttcagtctaacattta

SEQ ID NO: 120045 - DNA, 22 bp, Artificial Sequence
  Synthetic oligonucleotide; TTA chr11 5360011 5360032 5360016 5360011 -
tggttttcagtctaacatttaa

SEQ ID NO: 120046 - DNA, 22 bp, Artificial Sequence
  Synthetic oligonucleotide; TTT chr11 5360005 5360026 5360010 5360005 -
tcagtctaacatttaagtctgt

SEQ ID NO: 120047 - DNA, 22 bp, Artificial Sequence
  Synthetic oligonucleotide; TTT chr11 5360004 5360025 5360009 5360004 -
cagtctaacatttaagtctgta

SEQ ID NO: 120048 - DNA, 22 bp, Artificial Sequence
  Synthetic oligonucleotide; TTC chr11 5360003 5360024 5360008 5360003 -
agtctaacatttaagtctgtaa

SEQ ID NO: 120049 - DNA, 22 bp, Artificial Sequence
  Synthetic oligonucleotide; CTA chr11 5359997 5360018 5360002 5359997 -
acatttaagtctgtaatccatc

SEQ ID NO: 120050 - DNA, 22 bp, Artificial Sequence
  Synthetic oligonucleotide; TTT chr11 5359991 5360012 5359996 5359991 -
aagtctgtaatccatcttgaat

SEQ ID NO: 120051 - DNA, 22 bp, Artificial Sequence
  Synthetic oligonucleotide; TTA chr11 5359990 5360011 5359995 5359990 -
agtctgtaatccatcttgaatt

SEQ ID NO: 120052 - DNA, 22 bp, Artificial Sequence
  Synthetic oligonucleotide; CTG chr11 5359984 5360005 5359989 5359984 -
taatccatcttgaattaatttt

SEQ ID NO: 120053 - DNA, 22 bp, Artificial Sequence
  Synthetic oligonucleotide; CTT chr11 5359973 5359994 5359978 5359973 -
gaattaatttttgtataaggtg

SEQ ID NO: 120054 - DNA, 22 bp, Artificial Sequence
  Synthetic oligonucleotide; TTG chr11 5359972 5359993 5359977 5359972 -
aattaatttttgtataaggtgt

SEQ ID NO: 120055 - DNA, 22 bp, Artificial Sequence
  Synthetic oligonucleotide; TTA chr11 5359967 5359988 5359972 5359967 -
atttttgtataaggtgtaagaa

SEQ ID NO: 120056 - DNA, 22 bp, Artificial Sequence
  Synthetic oligonucleotide; TTT chr11 5359963 5359984 5359968 5359963 -
ttgtataaggtgtaagaaaggg

SEQ ID NO: 120057 - DNA, 22 bp, Artificial Sequence
  Synthetic oligonucleotide; TTT chr11 5359962 5359983 5359967 5359962 -
tgtataaggtgtaagaaaggga

SEQ ID NO: 120058 - DNA, 22 bp, Artificial Sequence
  Synthetic oligonucleotide; TTT chr11 5359961 5359982 5359966 5359961 -
gtataaggtgtaagaaagggat

SEQ ID NO: 120059 - DNA, 22 bp, Artificial Sequence
  Synthetic oligonucleotide; TTG chr11 5359960 5359981 5359965 5359960 -
tataaggtgtaagaaagggatc

SEQ ID NO: 120060 - DNA, 22 bp, Artificial Sequence
  Synthetic oligonucleotide; TTT chr11 5359932 5359953 5359937 5359932 -
cagctttctgcgtatggttagc

SEQ ID NO: 120061 - DNA, 22 bp, Artificial Sequence
  Synthetic oligonucleotide; TTC chr11 5359931 5359952 5359936 5359931 -
agctttctgcgtatggttagcc

SEQ ID NO: 120062 - DNA, 22 bp, Artificial Sequence
  Synthetic oligonucleotide; CTT chr11 5359926 5359947 5359931 5359926 -
tctgcgtatggttagccagttt

SEQ ID NO: 120063 - DNA, 22 bp, Artificial Sequence
  Synthetic oligonucleotide; TTT chr11 5359925 5359946 5359930 5359925 -
ctgcgtatggttagccagtttt

SEQ ID NO: 120064 - DNA, 22 bp, Artificial Sequence
  Synthetic oligonucleotide; TTC chr11 5359924 5359945 5359929 5359924 -
tgcgtatggttagccagttttc

SEQ ID NO: 120065 - DNA, 22 bp, Artificial Sequence
  Synthetic oligonucleotide; CTG chr11 5359922 5359943 5359927 5359922 -
cgtatggttagccagttttccc

SEQ ID NO: 120066 - DNA, 22 bp, Artificial Sequence
  Synthetic oligonucleotide; TTA chr11 5359912 5359933 5359917 5359912 -
gccagttttcccagcaccattt

SEQ ID NO: 120067 - DNA, 22 bp, Artificial Sequence
  Synthetic oligonucleotide; TTT chr11 5359904 5359925 5359909 5359904 -
tcccagcaccatttattaaata

SEQ ID NO: 120068 - DNA, 22 bp, Artificial Sequence
  Synthetic oligonucleotide; TTT chr11 5359903 5359924 5359908 5359903 -
cccagcaccatttattaaatag

SEQ ID NO: 120069 - DNA, 22 bp, Artificial Sequence
  Synthetic oligonucleotide; TTC chr11 5359902 5359923 5359907 5359902 -
ccagcaccatttattaaatagg

SEQ ID NO: 120070 - DNA, 22 bp, Artificial Sequence
  Synthetic oligonucleotide; TTT chr11 5359890 5359911 5359895 5359890 -
attaaatagggaatcctttccc

SEQ ID NO: 120071 - DNA, 22 bp, Artificial Sequence
  Synthetic oligonucleotide; TTA chr11 5359889 5359910 5359894 5359889 -
ttaaatagggaatcctttcccc

SEQ ID NO: 120072 - DNA, 22 bp, Artificial Sequence
  Synthetic oligonucleotide; TTA chr11 5359886 5359907 5359891 5359886 -
aatagggaatcctttccccatt

SEQ ID NO: 120073 - DNA, 22 bp, Artificial Sequence
  Synthetic oligonucleotide; CTT chr11 5359872 5359893 5359877 5359872 -
tccccatttgttttttttgtca

SEQ ID NO: 120074 - DNA, 22 bp, Artificial Sequence
  Synthetic oligonucleotide; TTT chr11 5359871 5359892 5359876 5359871 -
ccccatttgttttttttgtcag

SEQ ID NO: 120075 - DNA, 22 bp, Artificial Sequence
  Synthetic oligonucleotide; TTC chr11 5359870 5359891 5359875 5359870 -
cccatttgttttttttgtcagg

SEQ ID NO: 120076 - DNA, 22 bp, Artificial Sequence
  Synthetic oligonucleotide; TTT chr11 5359863 5359884 5359868 5359863 -
gttttttttgtcaggtttgtca

SEQ ID NO: 120077 - DNA, 22 bp, Artificial Sequence
  Synthetic oligonucleotide; TTG chr11 5359862 5359883 5359867 5359862 -
ttttttttgtcaggtttgtcaa

SEQ ID NO: 120078 - DNA, 22 bp, Artificial Sequence
  Synthetic oligonucleotide; TTT chr11 5359859 5359880 5359864 5359859 -
tttttgtcaggtttgtcaaaga

SEQ ID NO: 120079 - DNA, 22 bp, Artificial Sequence
  Synthetic oligonucleotide; TTT chr11 5359858 5359879 5359863 5359858 -
ttttgtcaggtttgtcaaagat

SEQ ID NO: 120080 - DNA, 22 bp, Artificial Sequence
  Synthetic oligonucleotide; TTT chr11 5359857 5359878 5359862 5359857 -
tttgtcaggtttgtcaaagatc

SEQ ID NO: 120081 - DNA, 22 bp, Artificial Sequence
  Synthetic oligonucleotide; TTT chr11 5359856 5359877 5359861 5359856 -
ttgtcaggtttgtcaaagatca

SEQ ID NO: 120082 - DNA, 22 bp, Artificial Sequence
  Synthetic oligonucleotide; TTT chr11 5359855 5359876 5359860 5359855 -
tgtcaggtttgtcaaagatcag

SEQ ID NO: 120083 - DNA, 22 bp, Artificial Sequence
  Synthetic oligonucleotide; TTT chr11 5359854 5359875 5359859 5359854 -
gtcaggtttgtcaaagatcaga

SEQ ID NO: 120084 - DNA, 22 bp, Artificial Sequence
  Synthetic oligonucleotide; TTG chr11 5359853 5359874 5359858 5359853 -
tcaggtttgtcaaagatcagat

SEQ ID NO: 120085 - DNA, 22 bp, Artificial Sequence
  Synthetic oligonucleotide; TTT chr11 5359845 5359866 5359850 5359845 -
gtcaaagatcagatggttgtag

SEQ ID NO: 120086 - DNA, 22 bp, Artificial Sequence
  Synthetic oligonucleotide; TTG chr11 5359844 5359865 5359849 5359844 -
tcaaagatcagatggttgtaga

SEQ ID NO: 120087 - DNA, 22 bp, Artificial Sequence
  Synthetic oligonucleotide; TTG chr11 5359826 5359847 5359831 5359826 -
tagacatgcggcattatttctg

SEQ ID NO: 120088 - DNA, 22 bp, Artificial Sequence
  Synthetic oligonucleotide; TTA chr11 5359810 5359831 5359815 5359810 -
tttctgaggcctctgttctgtt

SEQ ID NO: 120089 - DNA, 22 bp, Artificial Sequence
  Synthetic oligonucleotide; TTT chr11 5359807 5359828 5359812 5359807 -
ctgaggcctctgttctgttcca

SEQ ID NO: 120090 - DNA, 22 bp, Artificial Sequence
  Synthetic oligonucleotide; TTC chr11 5359806 5359827 5359811 5359806 -
tgaggcctctgttctgttccat

SEQ ID NO: 120091 - DNA, 22 bp, Artificial Sequence
  Synthetic oligonucleotide; CTG chr11 5359804 5359825 5359809 5359804 -
aggcctctgttctgttccattg

SEQ ID NO: 120092 - DNA, 22 bp, Artificial Sequence
  Synthetic oligonucleotide; CTC chr11 5359797 5359818 5359802 5359797 -
tgttctgttccattggtctata

SEQ ID NO: 120093 - DNA, 22 bp, Artificial Sequence
  Synthetic oligonucleotide; CTG chr11 5359795 5359816 5359800 5359795 -
ttctgttccattggtctatatc

SEQ ID NO: 120094 - DNA, 22 bp, Artificial Sequence
  Synthetic oligonucleotide; TTC chr11 5359792 5359813 5359797 5359792 -
tgttccattggtctatatctct

SEQ ID NO: 120095 - DNA, 22 bp, Artificial Sequence
  Synthetic oligonucleotide; CTG chr11 5359790 5359811 5359795 5359790 -
ttccattggtctatatctctgt

SEQ ID NO: 120096 - DNA, 22 bp, Artificial Sequence
  Synthetic oligonucleotide; TTC chr11 5359787 5359808 5359792 5359787 -
cattggtctatatctctgtttt

SEQ ID NO: 120097 - DNA, 22 bp, Artificial Sequence
  Synthetic oligonucleotide; TTG chr11 5359782 5359803 5359787 5359782 -
gtctatatctctgttttggtac

SEQ ID NO: 120098 - DNA, 22 bp, Artificial Sequence
  Synthetic oligonucleotide; CTA chr11 5359777 5359798 5359782 5359777 -
tatctctgttttggtaccagta

SEQ ID NO: 120099 - DNA, 22 bp, Artificial Sequence
  Synthetic oligonucleotide; CTC chr11 5359771 5359792 5359776 5359771 -
tgttttggtaccagtaccatgc

SEQ ID NO: 120100 - DNA, 22 bp, Artificial Sequence
  Synthetic oligonucleotide; CTG chr11 5359769 5359790 5359774 5359769 -
ttttggtaccagtaccatgctg

SEQ ID NO: 120101 - DNA, 22 bp, Artificial Sequence
  Synthetic oligonucleotide; TTT chr11 5359766 5359787 5359771 5359766 -
tggtaccagtaccatgctgttt

SEQ ID NO: 120102 - DNA, 22 bp, Artificial Sequence
  Synthetic oligonucleotide; TTT chr11 5359765 5359786 5359770 5359765 -
ggtaccagtaccatgctgtttt

SEQ ID NO: 120103 - DNA, 22 bp, Artificial Sequence
  Synthetic oligonucleotide; TTG chr11 5359764 5359785 5359769 5359764 -
gtaccagtaccatgctgttttg

SEQ ID NO: 120104 - DNA, 22 bp, Artificial Sequence
  Synthetic oligonucleotide; CTG chr11 5359747 5359768 5359752 5359747 -
ttttggttactgtagccttgta

SEQ ID NO: 120105 - DNA, 22 bp, Artificial Sequence
  Synthetic oligonucleotide; TTT chr11 5359744 5359765 5359749 5359744 -
tggttactgtagccttgtagta

SEQ ID NO: 120106 - DNA, 22 bp, Artificial Sequence
  Synthetic oligonucleotide; TTT chr11 5359743 5359764 5359748 5359743 -
ggttactgtagccttgtagtat

SEQ ID NO: 120107 - DNA, 22 bp, Artificial Sequence
  Synthetic oligonucleotide; TTG chr11 5359742 5359763 5359747 5359742 -
gttactgtagccttgtagtata

SEQ ID NO: 120108 - DNA, 22 bp, Artificial Sequence
  Synthetic oligonucleotide; TTA chr11 5359738 5359759 5359743 5359738 -
ctgtagccttgtagtatagttt

SEQ ID NO: 120109 - DNA, 22 bp, Artificial Sequence
  Synthetic oligonucleotide; CTG chr11 5359735 5359756 5359740 5359735 -
tagccttgtagtatagtttgaa

SEQ ID NO: 120110 - DNA, 22 bp, Artificial Sequence
  Synthetic oligonucleotide; CTT chr11 5359728 5359749 5359733 5359728 -
gtagtatagtttgaagtcaggt

SEQ ID NO: 120111 - DNA, 22 bp, Artificial Sequence
  Synthetic oligonucleotide; TTG chr11 5359727 5359748 5359732 5359727 -
tagtatagtttgaagtcaggta

SEQ ID NO: 120112 - DNA, 22 bp, Artificial Sequence
  Synthetic oligonucleotide; TTT chr11 5359716 5359737 5359721 5359716 -
gaagtcaggtagcgtgatgcct

SEQ ID NO: 120113 - DNA, 22 bp, Artificial Sequence
  Synthetic oligonucleotide; TTG chr11 5359715 5359736 5359720 5359715 -
aagtcaggtagcgtgatgcctc

SEQ ID NO: 120114 - DNA, 22 bp, Artificial Sequence
  Synthetic oligonucleotide; CTC chr11 5359693 5359714 5359698 5359693 -
cagctttgttcttttggcttag

SEQ ID NO: 120115 - DNA, 22 bp, Artificial Sequence
  Synthetic oligonucleotide; CTT chr11 5359687 5359708 5359692 5359687 -
tgttcttttggcttaggattgg

SEQ ID NO: 120116 - DNA, 22 bp, Artificial Sequence
  Synthetic oligonucleotide; TTT chr11 5359686 5359707 5359691 5359686 -
gttcttttggcttaggattggc

SEQ ID NO: 120117 - DNA, 22 bp, Artificial Sequence
  Synthetic oligonucleotide; TTG chr11 5359685 5359706 5359690 5359685 -
ttcttttggcttaggattggca

SEQ ID NO: 120118 - DNA, 22 bp, Artificial Sequence
  Synthetic oligonucleotide; TTC chr11 5359682 5359703 5359687 5359682 -
ttttggcttaggattggcatgt

SEQ ID NO: 120119 - DNA, 22 bp, Artificial Sequence
  Synthetic oligonucleotide; CTT chr11 5359680 5359701 5359685 5359680 -
ttggcttaggattggcatgtca

SEQ ID NO: 120120 - DNA, 22 bp, Artificial Sequence
  Synthetic oligonucleotide; TTT chr11 5359679 5359700 5359684 5359679 -
tggcttaggattggcatgtcaa

SEQ ID NO: 120121 - DNA, 22 bp, Artificial Sequence
  Synthetic oligonucleotide; TTT chr11 5359678 5359699 5359683 5359678 -
ggcttaggattggcatgtcaat

SEQ ID NO: 120122 - DNA, 22 bp, Artificial Sequence
  Synthetic oligonucleotide; TTG chr11 5359677 5359698 5359682 5359677 -
gcttaggattggcatgtcaatg

SEQ ID NO: 120123 - DNA, 22 bp, Artificial Sequence
  Synthetic oligonucleotide; CTT chr11 5359673 5359694 5359678 5359673 -
aggattggcatgtcaatgtggg

SEQ ID NO: 120124 - DNA, 22 bp, Artificial Sequence
  Synthetic oligonucleotide; TTA chr11 5359672 5359693 5359677 5359672 -
ggattggcatgtcaatgtgggc

SEQ ID NO: 120125 - DNA, 22 bp, Artificial Sequence
  Synthetic oligonucleotide; TTG chr11 5359666 5359687 5359671 5359666 -
gcatgtcaatgtgggctctttt

SEQ ID NO: 120126 - DNA, 22 bp, Artificial Sequence
  Synthetic oligonucleotide; CTC chr11 5359648 5359669 5359653 5359648 -
ttttttggttccatatgaactt

SEQ ID NO: 120127 - DNA, 22 bp, Artificial Sequence
  Synthetic oligonucleotide; CTT chr11 5359646 5359667 5359651 5359646 -
ttttggttccatatgaacttta

SEQ ID NO: 120128 - DNA, 22 bp, Artificial Sequence
  Synthetic oligonucleotide; TTT chr11 5359645 5359666 5359650 5359645 -
tttggttccatatgaactttaa

SEQ ID NO: 120129 - DNA, 22 bp, Artificial Sequence
  Synthetic oligonucleotide; TTT chr11 5359644 5359665 5359649 5359644 -
ttggttccatatgaactttaaa

SEQ ID NO: 120130 - DNA, 22 bp, Artificial Sequence
  Synthetic oligonucleotide; TTT chr11 5359643 5359664 5359648 5359643 -
tggttccatatgaactttaaag

SEQ ID NO: 120131 - DNA, 22 bp, Artificial Sequence
  Synthetic oligonucleotide; TTT chr11 5359642 5359663 5359647 5359642 -
ggttccatatgaactttaaagt

SEQ ID NO: 120132 - DNA, 22 bp, Artificial Sequence
  Synthetic oligonucleotide; TTG chr11 5359641 5359662 5359646 5359641 -
gttccatatgaactttaaagta

SEQ ID NO: 120133 - DNA, 22 bp, Artificial Sequence
  Synthetic oligonucleotide; TTC chr11 5359637 5359658 5359642 5359637 -
catatgaactttaaagtagttt

SEQ ID NO: 120134 - DNA, 22 bp, Artificial Sequence
  Synthetic oligonucleotide; CTT chr11 5359626 5359647 5359631 5359626 -
taaagtagttttttccaattct

SEQ ID NO: 120135 - DNA, 22 bp, Artificial Sequence
  Synthetic oligonucleotide; TTT chr11 5359625 5359646 5359630 5359625 -
aaagtagttttttccaattctg

SEQ ID NO: 120136 - DNA, 22 bp, Artificial Sequence
  Synthetic oligonucleotide; TTA chr11 5359624 5359645 5359629 5359624 -
aagtagttttttccaattctgt

SEQ ID NO: 120137 - DNA, 22 bp, Artificial Sequence
  Synthetic oligonucleotide; TTT chr11 5359615 5359636 5359620 5359615 -
tttccaattctgtgaagaaagt

SEQ ID NO: 120138 - DNA, 22 bp, Artificial Sequence
  Synthetic oligonucleotide; TTT chr11 5359614 5359635 5359619 5359614 -
ttccaattctgtgaagaaagtc

SEQ ID NO: 120139 - DNA, 22 bp, Artificial Sequence
  Synthetic oligonucleotide; TTT chr11 5359613 5359634 5359618 5359613 -
tccaattctgtgaagaaagtca

SEQ ID NO: 120140 - DNA, 22 bp, Artificial Sequence
  Synthetic oligonucleotide; TTT chr11 5359612 5359633 5359617 5359612 -
ccaattctgtgaagaaagtcat

SEQ ID NO: 120141 - DNA, 22 bp, Artificial Sequence
  Synthetic oligonucleotide; TTC chr11 5359611 5359632 5359616 5359611 -
caattctgtgaagaaagtcatt

SEQ ID NO: 120142 - DNA, 22 bp, Artificial Sequence
  Synthetic oligonucleotide; TTC chr11 5359605 5359626 5359610 5359605 -
tgtgaagaaagtcattggtagc

SEQ ID NO: 120143 - DNA, 22 bp, Artificial Sequence
  Synthetic oligonucleotide; CTG chr11 5359603 5359624 5359608 5359603 -
tgaagaaagtcattggtagctt

SEQ ID NO: 120144 - DNA, 22 bp, Artificial Sequence
  Synthetic oligonucleotide; TTG chr11 5359588 5359609 5359593 5359588 -
gtagcttgatggggatggcatt

SEQ ID NO: 120145 - DNA, 22 bp, Artificial Sequence
  Synthetic oligonucleotide; CTT chr11 5359581 5359602 5359586 5359581 -
gatggggatggcattgaatcta

SEQ ID NO: 120146 - DNA, 22 bp, Artificial Sequence
  Synthetic oligonucleotide; TTG chr11 5359580 5359601 5359585 5359580 -
atggggatggcattgaatctat

SEQ ID NO: 120147 - DNA, 22 bp, Artificial Sequence
  Synthetic oligonucleotide; TTG chr11 5359565 5359586 5359570 5359565 -
aatctataaattaccttgggct

SEQ ID NO: 120148 - DNA, 22 bp, Artificial Sequence
  Synthetic oligonucleotide; CTA chr11 5359559 5359580 5359564 5359559 -
taaattaccttgggctgtatgg

SEQ ID NO: 120149 - DNA, 22 bp, Artificial Sequence
  Synthetic oligonucleotide; TTA chr11 5359552 5359573 5359557 5359552 -
ccttgggctgtatggccatttt

SEQ ID NO: 120150 - DNA, 22 bp, Artificial Sequence
  Synthetic oligonucleotide; CTT chr11 5359548 5359569 5359553 5359548 -
gggctgtatggccattttcatg

SEQ ID NO: 120151 - DNA, 22 bp, Artificial Sequence
  Synthetic oligonucleotide; TTG chr11 5359547 5359568 5359552 5359547 -
ggctgtatggccattttcatga

SEQ ID NO: 120152 - DNA, 22 bp, Artificial Sequence
  Synthetic oligonucleotide; CTG chr11 5359542 5359563 5359547 5359542 -
tatggccattttcatgatattg

SEQ ID NO: 120153 - DNA, 22 bp, Artificial Sequence
  Synthetic oligonucleotide; TTT chr11 5359531 5359552 5359536 5359531 -
tcatgatattgattcttcctac

SEQ ID NO: 120154 - DNA, 22 bp, Artificial Sequence
  Synthetic oligonucleotide; TTT chr11 5359530 5359551 5359535 5359530 -
catgatattgattcttcctacc

SEQ ID NO: 120155 - DNA, 22 bp, Artificial Sequence
  Synthetic oligonucleotide; TTC chr11 5359529 5359550 5359534 5359529 -
atgatattgattcttcctaccc

SEQ ID NO: 120156 - DNA, 22 bp, Artificial Sequence
  Synthetic oligonucleotide; TTG chr11 5359520 5359541 5359525 5359520 -
attcttcctacccatgagcatg

SEQ ID NO: 120157 - DNA, 22 bp, Artificial Sequence
  Synthetic oligonucleotide; TTC chr11 5359516 5359537 5359521 5359516 -
ttcctacccatgagcatggaat

SEQ ID NO: 120158 - DNA, 22 bp, Artificial Sequence
  Synthetic oligonucleotide; CTT chr11 5359514 5359535 5359519 5359514 -
cctacccatgagcatggaatgt

SEQ ID NO: 120159 - DNA, 22 bp, Artificial Sequence
  Synthetic oligonucleotide; TTC chr11 5359513 5359534 5359518 5359513 -
ctacccatgagcatggaatgtt

SEQ ID NO: 120160 - DNA, 22 bp, Artificial Sequence
  Synthetic oligonucleotide; CTA chr11 5359510 5359531 5359515 5359510 -
cccatgagcatggaatgttctt

SEQ ID NO: 120161 - DNA, 22 bp, Artificial Sequence
  Synthetic oligonucleotide; TTC chr11 5359490 5359511 5359495 5359490 -
ttccatttgtttgtatcttctt

SEQ ID NO: 120162 - DNA, 22 bp, Artificial Sequence
  Synthetic oligonucleotide; CTT chr11 5359488 5359509 5359493 5359488 -
ccatttgtttgtatcttctttt

SEQ ID NO: 120163 - DNA, 22 bp, Artificial Sequence
  Synthetic oligonucleotide; TTC chr11 5359487 5359508 5359492 5359487 -
catttgtttgtatcttctttta

SEQ ID NO: 120164 - DNA, 22 bp, Artificial Sequence
  Synthetic oligonucleotide; TTT chr11 5359482 5359503 5359487 5359482 -
gtttgtatcttcttttatttca

SEQ ID NO: 120165 - DNA, 22 bp, Artificial Sequence
  Synthetic oligonucleotide; TTG chr11 5359481 5359502 5359486 5359481 -
tttgtatcttcttttatttcat

SEQ ID NO: 120166 - DNA, 22 bp, Artificial Sequence
  Synthetic oligonucleotide; TTT chr11 5359478 5359499 5359483 5359478 -
gtatcttcttttatttcattca

SEQ ID NO: 120167 - DNA, 22 bp, Artificial Sequence
  Synthetic oligonucleotide; TTG chr11 5359477 5359498 5359482 5359477 -
tatcttcttttatttcattcag

SEQ ID NO: 120168 - DNA, 22 bp, Artificial Sequence
  Synthetic oligonucleotide; CTT chr11 5359471 5359492 5359476 5359471 -
cttttatttcattcagcagtgg

SEQ ID NO: 120169 - DNA, 22 bp, Artificial Sequence
  Synthetic oligonucleotide; TTC chr11 5359470 5359491 5359475 5359470 -
ttttatttcattcagcagtggt

SEQ ID NO: 120170 - DNA, 22 bp, Artificial Sequence
  Synthetic oligonucleotide; CTT chr11 5359468 5359489 5359473 5359468 -
ttatttcattcagcagtggttt

SEQ ID NO: 120171 - DNA, 22 bp, Artificial Sequence
  Synthetic oligonucleotide; TTT chr11 5359467 5359488 5359472 5359467 -
tatttcattcagcagtggtttg

SEQ ID NO: 120172 - DNA, 22 bp, Artificial Sequence
  Synthetic oligonucleotide; TTT chr11 5359466 5359487 5359471 5359466 -
atttcattcagcagtggtttgt

SEQ ID NO: 120173 - DNA, 22 bp, Artificial Sequence
  Synthetic oligonucleotide; TTA chr11 5359465 5359486 5359470 5359465 -
tttcattcagcagtggtttgta

SEQ ID NO: 120174 - DNA, 22 bp, Artificial Sequence
  Synthetic oligonucleotide; TTT chr11 5359462 5359483 5359467 5359462 -
cattcagcagtggtttgtagtt

SEQ ID NO: 120175 - DNA, 22 bp, Artificial Sequence
  Synthetic oligonucleotide; TTC chr11 5359461 5359482 5359466 5359461 -
attcagcagtggtttgtagttc

SEQ ID NO: 120176 - DNA, 22 bp, Artificial Sequence
  Synthetic oligonucleotide; TTC chr11 5359457 5359478 5359462 5359457 -
agcagtggtttgtagttctcct

SEQ ID NO: 120177 - DNA, 22 bp, Artificial Sequence
  Synthetic oligonucleotide; TTT chr11 5359446 5359467 5359451 5359446 -
gtagttctccttgaagaggtcc

SEQ ID NO: 120178 - DNA, 22 bp, Artificial Sequence
  Synthetic oligonucleotide; TTG chr11 5359445 5359466 5359450 5359445 -
tagttctccttgaagaggtcct

SEQ ID NO: 120179 - DNA, 22 bp, Artificial Sequence
  Synthetic oligonucleotide; TTC chr11 5359439 5359460 5359444 5359439 -
tccttgaagaggtccttcacct

SEQ ID NO: 120180 - DNA, 22 bp, Artificial Sequence
  Synthetic oligonucleotide; CTC chr11 5359437 5359458 5359442 5359437 -
cttgaagaggtccttcacctct

SEQ ID NO: 120181 - DNA, 22 bp, Artificial Sequence
  Synthetic oligonucleotide; CTT chr11 5359434 5359455 5359439 5359434 -
gaagaggtccttcacctctctt

SEQ ID NO: 120182 - DNA, 22 bp, Artificial Sequence
  Synthetic oligonucleotide; TTG chr11 5359433 5359454 5359438 5359433 -
aagaggtccttcacctctcttg

SEQ ID NO: 120183 - DNA, 22 bp, Artificial Sequence
  Synthetic oligonucleotide; CTT chr11 5359422 5359443 5359427 5359422 -
cacctctcttgtaagttggatt

SEQ ID NO: 120184 - DNA, 22 bp, Artificial Sequence
  Synthetic oligonucleotide; TTC chr11 5359421 5359442 5359426 5359421 -
acctctcttgtaagttggattc

SEQ ID NO: 120185 - DNA, 22 bp, Artificial Sequence
  Synthetic oligonucleotide; CTC chr11 5359416 5359437 5359421 5359416 -
tcttgtaagttggattcctagg

SEQ ID NO: 120186 - DNA, 22 bp, Artificial Sequence
  Synthetic oligonucleotide; CTC chr11 5359414 5359435 5359419 5359414 -
ttgtaagttggattcctaggta

SEQ ID NO: 120187 - DNA, 22 bp, Artificial Sequence
  Synthetic oligonucleotide; CTT chr11 5359412 5359433 5359417 5359412 -
gtaagttggattcctaggtatt

SEQ ID NO: 120188 - DNA, 22 bp, Artificial Sequence
  Synthetic oligonucleotide; TTG chr11 5359411 5359432 5359416 5359411 -
taagttggattcctaggtattt

SEQ ID NO: 120189 - DNA, 22 bp, Artificial Sequence
  Synthetic oligonucleotide; TTG chr11 5359404 5359425 5359409 5359404 -
gattcctaggtattttattctc

SEQ ID NO: 120190 - DNA, 22 bp, Artificial Sequence
  Synthetic oligonucleotide; TTC chr11 5359399 5359420 5359404 5359399 -
ctaggtattttattctctttga

SEQ ID NO: 120191 - DNA, 22 bp, Artificial Sequence
  Synthetic oligonucleotide; CTA chr11 5359396 5359417 5359401 5359396 -
ggtattttattctctttgaagc

SEQ ID NO: 120192 - DNA, 22 bp, Artificial Sequence
  Synthetic oligonucleotide; TTT chr11 5359389 5359410 5359394 5359389 -
tattctctttgaagcaattgtg

SEQ ID NO: 120193 - DNA, 22 bp, Artificial Sequence
  Synthetic oligonucleotide; TTT chr11 5359388 5359409 5359393 5359388 -
attctctttgaagcaattgtga

SEQ ID NO: 120194 - DNA, 22 bp, Artificial Sequence
  Synthetic oligonucleotide; TTA chr11 5359387 5359408 5359392 5359387 -
ttctctttgaagcaattgtgaa

SEQ ID NO: 120195 - DNA, 22 bp, Artificial Sequence
  Synthetic oligonucleotide; TTC chr11 5359384 5359405 5359389 5359384 -
tctttgaagcaattgtgaatgg

SEQ ID NO: 120196 - DNA, 22 bp, Artificial Sequence
  Synthetic oligonucleotide; CTC chr11 5359382 5359403 5359387 5359382 -
tttgaagcaattgtgaatggga

SEQ ID NO: 120197 - DNA, 22 bp, Artificial Sequence
  Synthetic oligonucleotide; CTT chr11 5359380 5359401 5359385 5359380 -
tgaagcaattgtgaatgggagt

SEQ ID NO: 120198 - DNA, 22 bp, Artificial Sequence
  Synthetic oligonucleotide; TTT chr11 5359379 5359400 5359384 5359379 -
gaagcaattgtgaatgggagtt

SEQ ID NO: 120199 - DNA, 22 bp, Artificial Sequence
  Synthetic oligonucleotide; TTG chr11 5359378 5359399 5359383 5359378 -
aagcaattgtgaatgggagttc

SEQ ID NO: 120200 - DNA, 22 bp, Artificial Sequence
  Synthetic oligonucleotide; TTG chr11 5359369 5359390 5359374 5359369 -
tgaatgggagttccctcatgat

SEQ ID NO: 120201 - DNA, 22 bp, Artificial Sequence
  Synthetic oligonucleotide; TTC chr11 5359356 5359377 5359361 5359356 -
cctcatgatttggctctctgtt

SEQ ID NO: 120202 - DNA, 22 bp, Artificial Sequence
  Synthetic oligonucleotide; CTC chr11 5359352 5359373 5359357 5359352 -
atgatttggctctctgtttgtc

SEQ ID NO: 120203 - DNA, 22 bp, Artificial Sequence
  Synthetic oligonucleotide; TTT chr11 5359345 5359366 5359350 5359345 -
ggctctctgtttgtctgttatt

SEQ ID NO: 120204 - DNA, 22 bp, Artificial Sequence
  Synthetic oligonucleotide; TTG chr11 5359344 5359365 5359349 5359344 -
gctctctgtttgtctgttattg

SEQ ID NO: 120205 - DNA, 22 bp, Artificial Sequence
  Synthetic oligonucleotide; CTC chr11 5359340 5359361 5359345 5359340 -
tctgtttgtctgttattggtgt

SEQ ID NO: 120206 - DNA, 22 bp, Artificial Sequence
  Synthetic oligonucleotide; CTC chr11 5359338 5359359 5359343 5359338 -
tgtttgtctgttattggtgtat

SEQ ID NO: 120207 - DNA, 22 bp, Artificial Sequence
  Synthetic oligonucleotide; CTG chr11 5359336 5359357 5359341 5359336 -
tttgtctgttattggtgtataa

SEQ ID NO: 120208 - DNA, 22 bp, Artificial Sequence
  Synthetic oligonucleotide; TTT chr11 5359333 5359354 5359338 5359333 -
gtctgttattggtgtataagaa

SEQ ID NO: 120209 - DNA, 22 bp, Artificial Sequence
  Synthetic oligonucleotide; TTG chr11 5359332 5359353 5359337 5359332 -
tctgttattggtgtataagaat

SEQ ID NO: 120210 - DNA, 22 bp, Artificial Sequence
  Synthetic oligonucleotide; CTG chr11 5359328 5359349 5359333 5359328 -
ttattggtgtataagaatgctt

SEQ ID NO: 120211 - DNA, 22 bp, Artificial Sequence
  Synthetic oligonucleotide; TTA chr11 5359325 5359346 5359330 5359325 -
ttggtgtataagaatgcttgtg

SEQ ID NO: 120212 - DNA, 22 bp, Artificial Sequence
  Synthetic oligonucleotide; TTG chr11 5359322 5359343 5359327 5359322 -
gtgtataagaatgcttgtgatt

SEQ ID NO: 120213 - DNA, 22 bp, Artificial Sequence
  Synthetic oligonucleotide; CTT chr11 5359306 5359327 5359311 5359306 -
gtgatttttgcacattgatttt

SEQ ID NO: 120214 - DNA, 22 bp, Artificial Sequence
  Synthetic oligonucleotide; TTG chr11 5359305 5359326 5359310 5359305 -
tgatttttgcacattgattttg

SEQ ID NO: 120215 - DNA, 22 bp, Artificial Sequence
  Synthetic oligonucleotide; TTT chr11 5359299 5359320 5359304 5359299 -
ttgcacattgattttgtatcct

SEQ ID NO: 120216 - DNA, 22 bp, Artificial Sequence
  Synthetic oligonucleotide; TTT chr11 5359298 5359319 5359303 5359298 -
tgcacattgattttgtatcctg

SEQ ID NO: 120217 - DNA, 22 bp, Artificial Sequence
  Synthetic oligonucleotide; TTT chr11 5359297 5359318 5359302 5359297 -
gcacattgattttgtatcctga

SEQ ID NO: 120218 - DNA, 22 bp, Artificial Sequence
  Synthetic oligonucleotide; TTG chr11 5359296 5359317 5359301 5359296 -
cacattgattttgtatcctgag

SEQ ID NO: 120219 - DNA, 22 bp, Artificial Sequence
  Synthetic oligonucleotide; TTG chr11 5359289 5359310 5359294 5359289 -
attttgtatcctgagactttgc

SEQ ID NO: 120220 - DNA, 22 bp, Artificial Sequence
  Synthetic oligonucleotide; TTT chr11 5359285 5359306 5359290 5359285 -
tgtatcctgagactttgctgaa

SEQ ID NO: 120221 - DNA, 22 bp, Artificial Sequence
  Synthetic oligonucleotide; TTT chr11 5359284 5359305 5359289 5359284 -
gtatcctgagactttgctgaag

SEQ ID NO: 120222 - DNA, 22 bp, Artificial Sequence
  Synthetic oligonucleotide; TTG chr11 5359283 5359304 5359288 5359283 -
tatcctgagactttgctgaagt

SEQ ID NO: 120223 - DNA, 22 bp, Artificial Sequence
  Synthetic oligonucleotide; CTG chr11 5359276 5359297 5359281 5359276 -
agactttgctgaagttgcctat

SEQ ID NO: 120224 - DNA, 22 bp, Artificial Sequence
  Synthetic oligonucleotide; CTT chr11 5359270 5359291 5359275 5359270 -
tgctgaagttgcctatcagttt

SEQ ID NO: 120225 - DNA, 22 bp, Artificial Sequence
  Synthetic oligonucleotide; TTT chr11 5359269 5359290 5359274 5359269 -
gctgaagttgcctatcagttta

SEQ ID NO: 120226 - DNA, 22 bp, Artificial Sequence
  Synthetic oligonucleotide; TTG chr11 5359268 5359289 5359273 5359268 -
ctgaagttgcctatcagtttaa

SEQ ID NO: 120227 - DNA, 22 bp, Artificial Sequence
  Synthetic oligonucleotide; CTG chr11 5359265 5359286 5359270 5359265 -
aagttgcctatcagtttaagga

SEQ ID NO: 120228 - DNA, 22 bp, Artificial Sequence
  Synthetic oligonucleotide; TTG chr11 5359259 5359280 5359264 5359259 -
cctatcagtttaaggacatttt

SEQ ID NO: 120229 - DNA, 22 bp, Artificial Sequence
  Synthetic oligonucleotide; CTA chr11 5359255 5359276 5359260 5359255 -
tcagtttaaggacattttgggc

SEQ ID NO: 120230 - DNA, 22 bp, Artificial Sequence
  Synthetic oligonucleotide; TTT chr11 5359248 5359269 5359253 5359248 -
aaggacattttgggctgagaca

SEQ ID NO: 120231 - DNA, 22 bp, Artificial Sequence
  Synthetic oligonucleotide; TTA chr11 5359247 5359268 5359252 5359247 -
aggacattttgggctgagacag

SEQ ID NO: 120232 - DNA, 22 bp, Artificial Sequence
  Synthetic oligonucleotide; TTT chr11 5359238 5359259 5359243 5359238 -
tgggctgagacagtggggtttt

SEQ ID NO: 120233 - DNA, 22 bp, Artificial Sequence
  Synthetic oligonucleotide; TTT chr11 5359237 5359258 5359242 5359237 -
gggctgagacagtggggttttc

SEQ ID NO: 120234 - DNA, 22 bp, Artificial Sequence
  Synthetic oligonucleotide; TTG chr11 5359236 5359257 5359241 5359236 -
ggctgagacagtggggttttct

SEQ ID NO: 120235 - DNA, 22 bp, Artificial Sequence
  Synthetic oligonucleotide; CTG chr11 5359231 5359252 5359236 5359231 -
agacagtggggttttctagata

SEQ ID NO: 120236 - DNA, 22 bp, Artificial Sequence
  Synthetic oligonucleotide; TTT chr11 5359217 5359238 5359222 5359217 -
tctagatatacaatcgtgtcat

SEQ ID NO: 120237 - DNA, 22 bp, Artificial Sequence
  Synthetic oligonucleotide; TTT chr11 5359216 5359237 5359221 5359216 -
ctagatatacaatcgtgtcatc

SEQ ID NO: 120238 - DNA, 22 bp, Artificial Sequence
  Synthetic oligonucleotide; TTC chr11 5359215 5359236 5359220 5359215 -
tagatatacaatcgtgtcatct

SEQ ID NO: 120239 - DNA, 22 bp, Artificial Sequence
  Synthetic oligonucleotide; CTA chr11 5359213 5359234 5359218 5359213 -
gatatacaatcgtgtcatctgc

SEQ ID NO: 120240 - DNA, 22 bp, Artificial Sequence
  Synthetic oligonucleotide; CTG chr11 5359192 5359213 5359197 5359192 -
caaacagggacaatttgacttc

SEQ ID NO: 120241 - DNA, 22 bp, Artificial Sequence
  Synthetic oligonucleotide; TTT chr11 5359176 5359197 5359181 5359176 -
gacttcctcttttcctaattga

SEQ ID NO: 120242 - DNA, 22 bp, Artificial Sequence
  Synthetic oligonucleotide; TTG chr11 5359175 5359196 5359180 5359175 -
acttcctcttttcctaattgaa

SEQ ID NO: 120243 - DNA, 22 bp, Artificial Sequence
  Synthetic oligonucleotide; CTT chr11 5359171 5359192 5359176 5359171 -
cctcttttcctaattgaatacc

SEQ ID NO: 120244 - DNA, 22 bp, Artificial Sequence
  Synthetic oligonucleotide; TTC chr11 5359170 5359191 5359175 5359170 -
ctcttttcctaattgaatacct

SEQ ID NO: 120245 - DNA, 22 bp, Artificial Sequence
  Synthetic oligonucleotide; CTC chr11 5359167 5359188 5359172 5359167 -
ttttcctaattgaatacctttt

SEQ ID NO: 120246 - DNA, 22 bp, Artificial Sequence
  Synthetic oligonucleotide; CTT chr11 5359165 5359186 5359170 5359165 -
ttcctaattgaatacctttttt

SEQ ID NO: 120247 - DNA, 22 bp, Artificial Sequence
  Synthetic oligonucleotide; TTT chr11 5359164 5359185 5359169 5359164 -
tcctaattgaataccttttttt

SEQ ID NO: 120248 - DNA, 22 bp, Artificial Sequence
  Synthetic oligonucleotide; TTT chr11 5359163 5359184 5359168 5359163 -
cctaattgaatacctttttttc

SEQ ID NO: 120249 - DNA, 22 bp, Artificial Sequence
  Synthetic oligonucleotide; TTC chr11 5359162 5359183 5359167 5359162 -
ctaattgaatacctttttttcc

SEQ ID NO: 120250 - DNA, 22 bp, Artificial Sequence
  Synthetic oligonucleotide; CTA chr11 5359159 5359180 5359164 5359159 -
attgaatacctttttttccttc

SEQ ID NO: 120251 - DNA, 22 bp, Artificial Sequence
  Synthetic oligonucleotide; TTG chr11 5359155 5359176 5359160 5359155 -
aatacctttttttccttctcct

SEQ ID NO: 120252 - DNA, 22 bp, Artificial Sequence
  Synthetic oligonucleotide; CTT chr11 5359147 5359168 5359152 5359147 -
tttttccttctcctgcctaatt

SEQ ID NO: 120253 - DNA, 22 bp, Artificial Sequence
  Synthetic oligonucleotide; TTT chr11 5359146 5359167 5359151 5359146 -
ttttccttctcctgcctaattg

SEQ ID NO: 120254 - DNA, 22 bp, Artificial Sequence
  Synthetic oligonucleotide; TTT chr11 5359145 5359166 5359150 5359145 -
tttccttctcctgcctaattgc

SEQ ID NO: 120255 - DNA, 22 bp, Artificial Sequence
  Synthetic oligonucleotide; TTT chr11 5359144 5359165 5359149 5359144 -
ttccttctcctgcctaattgcc

SEQ ID NO: 120256 - DNA, 22 bp, Artificial Sequence
  Synthetic oligonucleotide; TTT chr11 5359143 5359164 5359148 5359143 -
tccttctcctgcctaattgccc

SEQ ID NO: 120257 - DNA, 22 bp, Artificial Sequence
  Synthetic oligonucleotide; TTT chr11 5359142 5359163 5359147 5359142 -
ccttctcctgcctaattgccct

SEQ ID NO: 120258 - DNA, 22 bp, Artificial Sequence
  Synthetic oligonucleotide; TTC chr11 5359141 5359162 5359146 5359141 -
cttctcctgcctaattgccctg

SEQ ID NO: 120259 - DNA, 22 bp, Artificial Sequence
  Synthetic oligonucleotide; CTT chr11 5359138 5359159 5359143 5359138 -
ctcctgcctaattgccctggcc

SEQ ID NO: 120260 - DNA, 22 bp, Artificial Sequence
  Synthetic oligonucleotide; TTC chr11 5359137 5359158 5359142 5359137 -
tcctgcctaattgccctggcca

SEQ ID NO: 120261 - DNA, 22 bp, Artificial Sequence
  Synthetic oligonucleotide; CTC chr11 5359135 5359156 5359140 5359135 -
ctgcctaattgccctggccaga

SEQ ID NO: 120262 - DNA, 22 bp, Artificial Sequence
  Synthetic oligonucleotide; CTG chr11 5359132 5359153 5359137 5359132 -
cctaattgccctggccagaaat

SEQ ID NO: 120263 - DNA, 22 bp, Artificial Sequence
  Synthetic oligonucleotide; CTA chr11 5359128 5359149 5359133 5359128 -
attgccctggccagaaattcca

SEQ ID NO: 120264 - DNA, 22 bp, Artificial Sequence
  Synthetic oligonucleotide; TTG chr11 5359124 5359145 5359129 5359124 -
ccctggccagaaattccaacac

SEQ ID NO: 120265 - DNA, 22 bp, Artificial Sequence
  Synthetic oligonucleotide; CTG chr11 5359119 5359140 5359124 5359119 -
gccagaaattccaacactatgt

SEQ ID NO: 120266 - DNA, 22 bp, Artificial Sequence
  Synthetic oligonucleotide; TTC chr11 5359108 5359129 5359113 5359108 -
caacactatgttgaataggagt

SEQ ID NO: 120267 - DNA, 22 bp, Artificial Sequence
  Synthetic oligonucleotide; CTA chr11 5359100 5359121 5359105 5359100 -
tgttgaataggagtagtgagag

SEQ ID NO: 120268 - DNA, 22 bp, Artificial Sequence
  Synthetic oligonucleotide; TTG chr11 5359095 5359116 5359100 5359095 -
aataggagtagtgagagagggc

SEQ ID NO: 120269 - DNA, 22 bp, Artificial Sequence
  Synthetic oligonucleotide; CTG chr11 5359066 5359087 5359071 5359066 -
tcttgtgccagttttcaaaggg

SEQ ID NO: 120270 - DNA, 22 bp, Artificial Sequence
  Synthetic oligonucleotide; CTT chr11 5359062 5359083 5359067 5359062 -
gtgccagttttcaaagggaatg

SEQ ID NO: 120271 - DNA, 22 bp, Artificial Sequence
  Synthetic oligonucleotide; TTG chr11 5359061 5359082 5359066 5359061 -
tgccagttttcaaagggaatgc

SEQ ID NO: 120272 - DNA, 22 bp, Artificial Sequence
  Synthetic oligonucleotide; TTT chr11 5359052 5359073 5359057 5359052 -
tcaaagggaatgcttccagttt

SEQ ID NO: 120273 - DNA, 22 bp, Artificial Sequence
  Synthetic oligonucleotide; TTT chr11 5359051 5359072 5359056 5359051 -
caaagggaatgcttccagtttt

SEQ ID NO: 120274 - DNA, 22 bp, Artificial Sequence
  Synthetic oligonucleotide; TTC chr11 5359050 5359071 5359055 5359050 -
aaagggaatgcttccagttttt

SEQ ID NO: 120275 - DNA, 22 bp, Artificial Sequence
  Synthetic oligonucleotide; CTT chr11 5359037 5359058 5359042 5359037 -
ccagtttttgtccattcagtat

SEQ ID NO: 120276 - DNA, 22 bp, Artificial Sequence
  Synthetic oligonucleotide; TTC chr11 5359036 5359057 5359041 5359036 -
cagtttttgtccattcagtatg

SEQ ID NO: 120277 - DNA, 22 bp, Artificial Sequence
  Synthetic oligonucleotide; TTT chr11 5359030 5359051 5359035 5359030 -
ttgtccattcagtatgatattg

SEQ ID NO: 120278 - DNA, 22 bp, Artificial Sequence
  Synthetic oligonucleotide; TTT chr11 5359029 5359050 5359034 5359029 -
tgtccattcagtatgatattgg

SEQ ID NO: 120279 - DNA, 22 bp, Artificial Sequence
  Synthetic oligonucleotide; TTT chr11 5359028 5359049 5359033 5359028 -
gtccattcagtatgatattggc

SEQ ID NO: 120280 - DNA, 22 bp, Artificial Sequence
  Synthetic oligonucleotide; TTG chr11 5359027 5359048 5359032 5359027 -
tccattcagtatgatattggct

SEQ ID NO: 120281 - DNA, 22 bp, Artificial Sequence
  Synthetic oligonucleotide; TTC chr11 5359020 5359041 5359025 5359020 -
agtatgatattggctgtgggtt

SEQ ID NO: 120282 - DNA, 22 bp, Artificial Sequence
  Synthetic oligonucleotide; TTG chr11 5359008 5359029 5359013 5359008 -
gctgtgggtttgtcatagatgg

SEQ ID NO: 120283 - DNA, 22 bp, Artificial Sequence
  Synthetic oligonucleotide; CTG chr11 5359004 5359025 5359009 5359004 -
tgggtttgtcatagatggctct

SEQ ID NO: 120284 - DNA, 22 bp, Artificial Sequence
  Synthetic oligonucleotide; TTT chr11 5358997 5359018 5359002 5358997 -
gtcatagatggctcttattatt

SEQ ID NO: 120285 - DNA, 22 bp, Artificial Sequence
  Synthetic oligonucleotide; TTG chr11 5358996 5359017 5359001 5358996 -
tcatagatggctcttattattt

SEQ ID NO: 120286 - DNA, 22 bp, Artificial Sequence
  Synthetic oligonucleotide; CTC chr11 5358983 5359004 5358988 5358983 -
ttattattttgagatacgtccc

SEQ ID NO: 120287 - DNA, 22 bp, Artificial Sequence
  Synthetic oligonucleotide; CTT chr11 5358981 5359002 5358986 5358981 -
attattttgagatacgtcccat

SEQ ID NO: 120288 - DNA, 22 bp, Artificial Sequence
  Synthetic oligonucleotide; TTA chr11 5358980 5359001 5358985 5358980 -
ttattttgagatacgtcccatc

SEQ ID NO: 120289 - DNA, 22 bp, Artificial Sequence
  Synthetic oligonucleotide; TTA chr11 5358977 5358998 5358982 5358977 -
ttttgagatacgtcccatcaat

SEQ ID NO: 120290 - DNA, 22 bp, Artificial Sequence
  Synthetic oligonucleotide; TTT chr11 5358974 5358995 5358979 5358974 -
tgagatacgtcccatcaatacc

SEQ ID NO: 120291 - DNA, 22 bp, Artificial Sequence
  Synthetic oligonucleotide; TTT chr11 5358973 5358994 5358978 5358973 -
gagatacgtcccatcaatacct

SEQ ID NO: 120292 - DNA, 22 bp, Artificial Sequence
  Synthetic oligonucleotide; TTG chr11 5358972 5358993 5358977 5358972 -
agatacgtcccatcaataccta

SEQ ID NO: 120293 - DNA, 22 bp, Artificial Sequence
  Synthetic oligonucleotide; CTA chr11 5358950 5358971 5358955 5358950 -
atttattgagagtttttagcat

SEQ ID NO: 120294 - DNA, 22 bp, Artificial Sequence
  Synthetic oligonucleotide; TTT chr11 5358946 5358967 5358951 5358946 -
attgagagtttttagcatgaag

SEQ ID NO: 120295 - DNA, 22 bp, Artificial Sequence
  Synthetic oligonucleotide; TTA chr11 5358945 5358966 5358950 5358945 -
ttgagagtttttagcatgaagg

SEQ ID NO: 120296 - DNA, 22 bp, Artificial Sequence
  Synthetic oligonucleotide; TTG chr11 5358942 5358963 5358947 5358942 -
agagtttttagcatgaagggtt

SEQ ID NO: 120297 - DNA, 22 bp, Artificial Sequence
  Synthetic oligonucleotide; TTT chr11 5358935 5358956 5358940 5358935 -
ttagcatgaagggttgttgaat

SEQ ID NO: 120298 - DNA, 22 bp, Artificial Sequence
  Synthetic oligonucleotide; TTT chr11 5358934 5358955 5358939 5358934 -
tagcatgaagggttgttgaatt

SEQ ID NO: 120299 - DNA, 22 bp, Artificial Sequence
  Synthetic oligonucleotide; TTT chr11 5358933 5358954 5358938 5358933 -
agcatgaagggttgttgaattt

SEQ ID NO: 120300 - DNA, 22 bp, Artificial Sequence
  Synthetic oligonucleotide; TTA chr11 5358932 5358953 5358937 5358932 -
gcatgaagggttgttgaatttt

SEQ ID NO: 120301 - DNA, 22 bp, Artificial Sequence
  Synthetic oligonucleotide; TTG chr11 5358919 5358940 5358924 5358919 -
ttgaattttgtcaaaggccttt

SEQ ID NO: 120302 - DNA, 22 bp, Artificial Sequence
  Synthetic oligonucleotide; TTG chr11 5358916 5358937 5358921 5358916 -
aattttgtcaaaggccttttct

SEQ ID NO: 120303 - DNA, 22 bp, Artificial Sequence
  Synthetic oligonucleotide; TTT chr11 5358911 5358932 5358916 5358911 -
tgtcaaaggccttttctgcatc

SEQ ID NO: 120304 - DNA, 22 bp, Artificial Sequence
  Synthetic oligonucleotide; TTT chr11 5358910 5358931 5358915 5358910 -
gtcaaaggccttttctgcatct

SEQ ID NO: 120305 - DNA, 22 bp, Artificial Sequence
  Synthetic oligonucleotide; TTG chr11 5358909 5358930 5358914 5358909 -
tcaaaggccttttctgcatcta

SEQ ID NO: 120306 - DNA, 22 bp, Artificial Sequence
  Synthetic oligonucleotide; CTT chr11 5358898 5358919 5358903 5358898 -
ttctgcatctattgagataatc

SEQ ID NO: 120307 - DNA, 22 bp, Artificial Sequence
  Synthetic oligonucleotide; TTT chr11 5358897 5358918 5358902 5358897 -
tctgcatctattgagataatca

SEQ ID NO: 120308 - DNA, 22 bp, Artificial Sequence
  Synthetic oligonucleotide; TTT chr11 5358896 5358917 5358901 5358896 -
ctgcatctattgagataatcat

SEQ ID NO: 120309 - DNA, 22 bp, Artificial Sequence
  Synthetic oligonucleotide; TTC chr11 5358895 5358916 5358900 5358895 -
tgcatctattgagataatcatg

SEQ ID NO: 120310 - DNA, 22 bp, Artificial Sequence
  Synthetic oligonucleotide; CTG chr11 5358893 5358914 5358898 5358893 -
catctattgagataatcatgtg

SEQ ID NO: 120311 - DNA, 22 bp, Artificial Sequence
  Synthetic oligonucleotide; CTA chr11 5358887 5358908 5358892 5358887 -
ttgagataatcatgtggttttt

SEQ ID NO: 120312 - DNA, 22 bp, Artificial Sequence
  Synthetic oligonucleotide; TTG chr11 5358884 5358905 5358889 5358884 -
agataatcatgtggtttttgtc

SEQ ID NO: 120313 - DNA, 22 bp, Artificial Sequence
  Synthetic oligonucleotide; TTT chr11 5358867 5358888 5358872 5358867 -
ttgtctttggttctgtttatat

SEQ ID NO: 120314 - DNA, 22 bp, Artificial Sequence
  Synthetic oligonucleotide; TTT chr11 5358866 5358887 5358871 5358866 -
tgtctttggttctgtttatatg

SEQ ID NO: 120315 - DNA, 22 bp, Artificial Sequence
  Synthetic oligonucleotide; TTT chr11 5358865 5358886 5358870 5358865 -
gtctttggttctgtttatatgc

SEQ ID NO: 120316 - DNA, 22 bp, Artificial Sequence
  Synthetic oligonucleotide; TTG chr11 5358864 5358885 5358869 5358864 -
tctttggttctgtttatatgct

SEQ ID NO: 120317 - DNA, 22 bp, Artificial Sequence
  Synthetic oligonucleotide; CTT chr11 5358860 5358881 5358865 5358860 -
tggttctgtttatatgctggat

SEQ ID NO: 120318 - DNA, 22 bp, Artificial Sequence
  Synthetic oligonucleotide; TTT chr11 5358859 5358880 5358864 5358859 -
ggttctgtttatatgctggatt

SEQ ID NO: 120319 - DNA, 22 bp, Artificial Sequence
  Synthetic oligonucleotide; TTG chr11 5358858 5358879 5358863 5358858 -
gttctgtttatatgctggatta

SEQ ID NO: 120320 - DNA, 22 bp, Artificial Sequence
  Synthetic oligonucleotide; TTC chr11 5358854 5358875 5358859 5358854 -
tgtttatatgctggattacatt

SEQ ID NO: 120321 - DNA, 22 bp, Artificial Sequence
  Synthetic oligonucleotide; CTG chr11 5358852 5358873 5358857 5358852 -
tttatatgctggattacattta

SEQ ID NO: 120322 - DNA, 22 bp, Artificial Sequence
  Synthetic oligonucleotide; TTT chr11 5358849 5358870 5358854 5358849 -
atatgctggattacatttattg

SEQ ID NO: 120323 - DNA, 22 bp, Artificial Sequence
  Synthetic oligonucleotide; TTA chr11 5358848 5358869 5358853 5358848 -
tatgctggattacatttattga

SEQ ID NO: 120324 - DNA, 22 bp, Artificial Sequence
  Synthetic oligonucleotide; CTG chr11 5358841 5358862 5358846 5358841 -
gattacatttattgatttgcat

SEQ ID NO: 120325 - DNA, 22 bp, Artificial Sequence
  Synthetic oligonucleotide; TTA chr11 5358836 5358857 5358841 5358836 -
catttattgatttgcatatgtt

SEQ ID NO: 120326 - DNA, 22 bp, Artificial Sequence
  Synthetic oligonucleotide; TTT chr11 5358831 5358852 5358836 5358831 -
attgatttgcatatgttgaacc

SEQ ID NO: 120327 - DNA, 22 bp, Artificial Sequence
  Synthetic oligonucleotide; TTA chr11 5358830 5358851 5358835 5358830 -
ttgatttgcatatgttgaacca

SEQ ID NO: 120328 - DNA, 22 bp, Artificial Sequence
  Synthetic oligonucleotide; TTG chr11 5358827 5358848 5358832 5358827 -
atttgcatatgttgaaccagcc

SEQ ID NO: 120329 - DNA, 22 bp, Artificial Sequence
  Synthetic oligonucleotide; TTT chr11 5358823 5358844 5358828 5358823 -
gcatatgttgaaccagccttgc

SEQ ID NO: 120330 - DNA, 22 bp, Artificial Sequence
  Synthetic oligonucleotide; TTG chr11 5358822 5358843 5358827 5358822 -
catatgttgaaccagccttgca

SEQ ID NO: 120331 - DNA, 22 bp, Artificial Sequence
  Synthetic oligonucleotide; TTG chr11 5358813 5358834 5358818 5358813 -
aaccagccttgcatcccaggga

SEQ ID NO: 120332 - DNA, 22 bp, Artificial Sequence
  Synthetic oligonucleotide; CTT chr11 5358803 5358824 5358808 5358803 -
gcatcccagggatgaagcccac

SEQ ID NO: 120333 - DNA, 22 bp, Artificial Sequence
  Synthetic oligonucleotide; TTG chr11 5358802 5358823 5358807 5358802 -
catcccagggatgaagcccact

SEQ ID NO: 120334 - DNA, 22 bp, Artificial Sequence
  Synthetic oligonucleotide; CTT chr11 5358779 5358800 5358784 5358779 -
gatcatggtggataagcttttg

SEQ ID NO: 120335 - DNA, 22 bp, Artificial Sequence
  Synthetic oligonucleotide; TTG chr11 5358778 5358799 5358783 5358778 -
atcatggtggataagcttttgg

SEQ ID NO: 120336 - DNA, 22 bp, Artificial Sequence
  Synthetic oligonucleotide; CTT chr11 5358760 5358781 5358765 5358760 -
ttggatgtgctgctggatttgc

SEQ ID NO: 120337 - DNA, 22 bp, Artificial Sequence
  Synthetic oligonucleotide; TTT chr11 5358759 5358780 5358764 5358759 -
tggatgtgctgctggatttgct

SEQ ID NO: 120338 - DNA, 22 bp, Artificial Sequence
  Synthetic oligonucleotide; TTT chr11 5358758 5358779 5358763 5358758 -
ggatgtgctgctggatttgctt

SEQ ID NO: 120339 - DNA, 22 bp, Artificial Sequence
  Synthetic oligonucleotide; TTG chr11 5358757 5358778 5358762 5358757 -
gatgtgctgctggatttgcttt

SEQ ID NO: 120340 - DNA, 22 bp, Artificial Sequence
  Synthetic oligonucleotide; CTG chr11 5358748 5358769 5358753 5358748 -
ctggatttgctttgccagtatt

SEQ ID NO: 120341 - DNA, 22 bp, Artificial Sequence
  Synthetic oligonucleotide; CTG chr11 5358745 5358766 5358750 5358745 -
gatttgctttgccagtatttta

SEQ ID NO: 120342 - DNA, 22 bp, Artificial Sequence
  Synthetic oligonucleotide; TTT chr11 5358740 5358761 5358745 5358740 -
gctttgccagtattttattgag

SEQ ID NO: 120343 - DNA, 22 bp, Artificial Sequence
  Synthetic oligonucleotide; TTG chr11 5358739 5358760 5358744 5358739 -
ctttgccagtattttattgagg

SEQ ID NO: 120344 - DNA, 22 bp, Artificial Sequence
  Synthetic oligonucleotide; CTT chr11 5358736 5358757 5358741 5358736 -
tgccagtattttattgaggttt

SEQ ID NO: 120345 - DNA, 22 bp, Artificial Sequence
  Synthetic oligonucleotide; TTT chr11 5358735 5358756 5358740 5358735 -
gccagtattttattgaggtttt

SEQ ID NO: 120346 - DNA, 22 bp, Artificial Sequence
  Synthetic oligonucleotide; TTG chr11 5358734 5358755 5358739 5358734 -
ccagtattttattgaggttttt

SEQ ID NO: 120347 - DNA, 22 bp, Artificial Sequence
  Synthetic oligonucleotide; TTT chr11 5358725 5358746 5358730 5358725 -
tattgaggttttttgcatcgat

SEQ ID NO: 120348 - DNA, 22 bp, Artificial Sequence
  Synthetic oligonucleotide; TTT chr11 5358724 5358745 5358729 5358724 -
attgaggttttttgcatcgatg

SEQ ID NO: 120349 - DNA, 22 bp, Artificial Sequence
  Synthetic oligonucleotide; TTA chr11 5358723 5358744 5358728 5358723 -
ttgaggttttttgcatcgatgt

SEQ ID NO: 120350 - DNA, 22 bp, Artificial Sequence
  Synthetic oligonucleotide; TTG chr11 5358720 5358741 5358725 5358720 -
aggttttttgcatcgatgtcca

SEQ ID NO: 120351 - DNA, 22 bp, Artificial Sequence
  Synthetic oligonucleotide; TTT chr11 5358714 5358735 5358719 5358714 -
tttgcatcgatgtccatcaggg

SEQ ID NO: 120352 - DNA, 22 bp, Artificial Sequence
  Synthetic oligonucleotide; TTT chr11 5358713 5358734 5358718 5358713 -
ttgcatcgatgtccatcaggga

SEQ ID NO: 120353 - DNA, 22 bp, Artificial Sequence
  Synthetic oligonucleotide; TTT chr11 5358712 5358733 5358717 5358712 -
tgcatcgatgtccatcagggat

SEQ ID NO: 120354 - DNA, 22 bp, Artificial Sequence
  Synthetic oligonucleotide; TTT chr11 5358711 5358732 5358716 5358711 -
gcatcgatgtccatcagggata

SEQ ID NO: 120355 - DNA, 22 bp, Artificial Sequence
  Synthetic oligonucleotide; TTG chr11 5358710 5358731 5358715 5358710 -
catcgatgtccatcagggatat

SEQ ID NO: 120356 - DNA, 22 bp, Artificial Sequence
  Synthetic oligonucleotide; TTG chr11 5358686 5358707 5358691 5358686 -
gtctaaaattctctttttttgt

SEQ ID NO: 120357 - DNA, 22 bp, Artificial Sequence
  Synthetic oligonucleotide; CTA chr11 5358681 5358702 5358686 5358681 -
aaattctctttttttgttgtgt

SEQ ID NO: 120358 - DNA, 22 bp, Artificial Sequence
  Synthetic oligonucleotide; TTC chr11 5358675 5358696 5358680 5358675 -
tctttttttgttgtgtctctgc

SEQ ID NO: 120359 - DNA, 22 bp, Artificial Sequence
  Synthetic oligonucleotide; CTC chr11 5358673 5358694 5358678 5358673 -
tttttttgttgtgtctctgccc

SEQ ID NO: 120360 - DNA, 22 bp, Artificial Sequence
  Synthetic oligonucleotide; CTT chr11 5358671 5358692 5358676 5358671 -
tttttgttgtgtctctgcccgg

SEQ ID NO: 120361 - DNA, 22 bp, Artificial Sequence
  Synthetic oligonucleotide; TTT chr11 5358670 5358691 5358675 5358670 -
ttttgttgtgtctctgcccggc

SEQ ID NO: 120362 - DNA, 22 bp, Artificial Sequence
  Synthetic oligonucleotide; TTT chr11 5358669 5358690 5358674 5358669 -
tttgttgtgtctctgcccggct

SEQ ID NO: 120363 - DNA, 22 bp, Artificial Sequence
  Synthetic oligonucleotide; TTT chr11 5358668 5358689 5358673 5358668 -
ttgttgtgtctctgcccggctt

SEQ ID NO: 120364 - DNA, 22 bp, Artificial Sequence
  Synthetic oligonucleotide; TTT chr11 5358667 5358688 5358672 5358667 -
tgttgtgtctctgcccggcttt

SEQ ID NO: 120365 - DNA, 22 bp, Artificial Sequence
  Synthetic oligonucleotide; TTT chr11 5358666 5358687 5358671 5358666 -
gttgtgtctctgcccggctttg

SEQ ID NO: 120366 - DNA, 22 bp, Artificial Sequence
  Synthetic oligonucleotide; TTG chr11 5358665 5358686 5358670 5358665 -
ttgtgtctctgcccggctttgg

SEQ ID NO: 120367 - DNA, 22 bp, Artificial Sequence
  Synthetic oligonucleotide; TTG chr11 5358662 5358683 5358667 5358662 -
tgtctctgcccggctttggtat

SEQ ID NO: 120368 - DNA, 22 bp, Artificial Sequence
  Synthetic oligonucleotide; CTC chr11 5358656 5358677 5358661 5358656 -
tgcccggctttggtatcaggat

SEQ ID NO: 120369 - DNA, 22 bp, Artificial Sequence
  Synthetic oligonucleotide; CTG chr11 5358654 5358675 5358659 5358654 -
cccggctttggtatcaggatga

SEQ ID NO: 120370 - DNA, 22 bp, Artificial Sequence
  Synthetic oligonucleotide; CTT chr11 5358646 5358667 5358651 5358646 -
tggtatcaggatgatgctggcc

SEQ ID NO: 120371 - DNA, 22 bp, Artificial Sequence
  Synthetic oligonucleotide; TTT chr11 5358645 5358666 5358650 5358645 -
ggtatcaggatgatgctggcct

SEQ ID NO: 120372 - DNA, 22 bp, Artificial Sequence
  Synthetic oligonucleotide; TTG chr11 5358644 5358665 5358649 5358644 -
gtatcaggatgatgctggcctc

SEQ ID NO: 120373 - DNA, 22 bp, Artificial Sequence
  Synthetic oligonucleotide; CTG chr11 5358627 5358648 5358632 5358627 -
gcctcataaaatgagttaggga

SEQ ID NO: 120374 - DNA, 22 bp, Artificial Sequence
  Synthetic oligonucleotide; CTC chr11 5358622 5358643 5358627 5358622 -
ataaaatgagttagggaggatt

SEQ ID NO: 120375 - DNA, 22 bp, Artificial Sequence
  Synthetic oligonucleotide; TTA chr11 5358609 5358630 5358614 5358609 -
gggaggattccctcttttacta

SEQ ID NO: 120376 - DNA, 22 bp, Artificial Sequence
  Synthetic oligonucleotide; TTC chr11 5358599 5358620 5358604 5358599 -
cctcttttactattgattcgaa

SEQ ID NO: 120377 - DNA, 22 bp, Artificial Sequence
  Synthetic oligonucleotide; CTC chr11 5358595 5358616 5358600 5358595 -
ttttactattgattcgaatagt

SEQ ID NO: 120378 - DNA, 22 bp, Artificial Sequence
  Synthetic oligonucleotide; CTT chr11 5358593 5358614 5358598 5358593 -
ttactattgattcgaatagttt

SEQ ID NO: 120379 - DNA, 22 bp, Artificial Sequence
  Synthetic oligonucleotide; TTT chr11 5358592 5358613 5358597 5358592 -
tactattgattcgaatagtttc

SEQ ID NO: 120380 - DNA, 22 bp, Artificial Sequence
  Synthetic oligonucleotide; TTT chr11 5358591 5358612 5358596 5358591 -
actattgattcgaatagtttca

SEQ ID NO: 120381 - DNA, 22 bp, Artificial Sequence
  Synthetic oligonucleotide; TTA chr11 5358590 5358611 5358595 5358590 -
ctattgattcgaatagtttcag

SEQ ID NO: 120382 - DNA, 22 bp, Artificial Sequence
  Synthetic oligonucleotide; CTA chr11 5358587 5358608 5358592 5358587 -
ttgattcgaatagtttcagagg

SEQ ID NO: 120383 - DNA, 22 bp, Artificial Sequence
  Synthetic oligonucleotide; TTG chr11 5358584 5358605 5358589 5358584 -
attcgaatagtttcagagggaa

SEQ ID NO: 120384 - DNA, 22 bp, Artificial Sequence
  Synthetic oligonucleotide; TTC chr11 5358580 5358601 5358585 5358580 -
gaatagtttcagagggaatggt

SEQ ID NO: 120385 - DNA, 22 bp, Artificial Sequence
  Synthetic oligonucleotide; TTT chr11 5358571 5358592 5358576 5358571 -
cagagggaatggtaccagctcc

SEQ ID NO: 120386 - DNA, 22 bp, Artificial Sequence
  Synthetic oligonucleotide; TTC chr11 5358570 5358591 5358575 5358570 -
agagggaatggtaccagctcct

SEQ ID NO: 120387 - DNA, 22 bp, Artificial Sequence
  Synthetic oligonucleotide; CTC chr11 5358550 5358571 5358555 5358550 -
ctccttgtacctctggtagaat

SEQ ID NO: 120388 - DNA, 22 bp, Artificial Sequence
  Synthetic oligonucleotide; CTC chr11 5358547 5358568 5358552 5358547 -
cttgtacctctggtagaatttg

SEQ ID NO: 120389 - DNA, 22 bp, Artificial Sequence
  Synthetic oligonucleotide; CTT chr11 5358544 5358565 5358549 5358544 -
gtacctctggtagaatttggct

SEQ ID NO: 120390 - DNA, 22 bp, Artificial Sequence
  Synthetic oligonucleotide; TTG chr11 5358543 5358564 5358548 5358543 -
tacctctggtagaatttggctg

SEQ ID NO: 120391 - DNA, 22 bp, Artificial Sequence
  Synthetic oligonucleotide; CTC chr11 5358537 5358558 5358542 5358537 -
tggtagaatttggctgtgactc

SEQ ID NO: 120392 - DNA, 22 bp, Artificial Sequence
  Synthetic oligonucleotide; CTG chr11 5358535 5358556 5358540 5358535 -
gtagaatttggctgtgactcca

SEQ ID NO: 120393 - DNA, 22 bp, Artificial Sequence
  Synthetic oligonucleotide; TTT chr11 5358526 5358547 5358531 5358526 -
ggctgtgactccatctggtcct

SEQ ID NO: 120394 - DNA, 22 bp, Artificial Sequence
  Synthetic oligonucleotide; TTG chr11 5358525 5358546 5358530 5358525 -
gctgtgactccatctggtcctg

SEQ ID NO: 120395 - DNA, 22 bp, Artificial Sequence
  Synthetic oligonucleotide; CTG chr11 5358521 5358542 5358526 5358521 -
tgactccatctggtcctggact

SEQ ID NO: 120396 - DNA, 22 bp, Artificial Sequence
  Synthetic oligonucleotide; CTC chr11 5358515 5358536 5358520 5358515 -
catctggtcctggactgttttt

SEQ ID NO: 120397 - DNA, 22 bp, Artificial Sequence
  Synthetic oligonucleotide; CTG chr11 5358509 5358530 5358514 5358509 -
gtcctggactgtttttggttgg

SEQ ID NO: 120398 - DNA, 22 bp, Artificial Sequence
  Synthetic oligonucleotide; CTG chr11 5358503 5358524 5358508 5358503 -
gactgtttttggttggtaagct

SEQ ID NO: 120399 - DNA, 22 bp, Artificial Sequence
  Synthetic oligonucleotide; CTG chr11 5358498 5358519 5358503 5358498 -
tttttggttggtaagctattaa

SEQ ID NO: 120400 - DNA, 22 bp, Artificial Sequence
  Synthetic oligonucleotide; TTT chr11 5358495 5358516 5358500 5358495 -
ttggttggtaagctattaatta

SEQ ID NO: 120401 - DNA, 22 bp, Artificial Sequence
  Synthetic oligonucleotide; TTT chr11 5358494 5358515 5358499 5358494 -
tggttggtaagctattaattat

SEQ ID NO: 120402 - DNA, 22 bp, Artificial Sequence
  Synthetic oligonucleotide; TTT chr11 5358493 5358514 5358498 5358493 -
ggttggtaagctattaattatt

SEQ ID NO: 120403 - DNA, 22 bp, Artificial Sequence
  Synthetic oligonucleotide; TTG chr11 5358492 5358513 5358497 5358492 -
gttggtaagctattaattattg

SEQ ID NO: 120404 - DNA, 22 bp, Artificial Sequence
  Synthetic oligonucleotide; TTG chr11 5358488 5358509 5358493 5358488 -
gtaagctattaattattgcctc

SEQ ID NO: 120405 - DNA, 22 bp, Artificial Sequence
  Synthetic oligonucleotide; CTA chr11 5358480 5358501 5358485 5358480 -
ttaattattgcctcaatttcag

SEQ ID NO: 120406 - DNA, 22 bp, Artificial Sequence
  Synthetic oligonucleotide; TTA chr11 5358477 5358498 5358482 5358477 -
attattgcctcaatttcagatc

SEQ ID NO: 120407 - DNA, 22 bp, Artificial Sequence
  Synthetic oligonucleotide; TTA chr11 5358473 5358494 5358478 5358473 -
ttgcctcaatttcagatcctgt

SEQ ID NO: 120408 - DNA, 22 bp, Artificial Sequence
  Synthetic oligonucleotide; TTG chr11 5358470 5358491 5358475 5358470 -
cctcaatttcagatcctgttat

SEQ ID NO: 120409 - DNA, 22 bp, Artificial Sequence
  Synthetic oligonucleotide; CTC chr11 5358466 5358487 5358471 5358466 -
aatttcagatcctgttattggt

SEQ ID NO: 120410 - DNA, 22 bp, Artificial Sequence
  Synthetic oligonucleotide; TTT chr11 5358461 5358482 5358466 5358461 -
cagatcctgttattggtctatt

SEQ ID NO: 120411 - DNA, 22 bp, Artificial Sequence
  Synthetic oligonucleotide; TTC chr11 5358460 5358481 5358465 5358460 -
agatcctgttattggtctattc

SEQ ID NO: 120412 - DNA, 22 bp, Artificial Sequence
  Synthetic oligonucleotide; CTG chr11 5358452 5358473 5358457 5358452 -
ttattggtctattcagagattc

SEQ ID NO: 120413 - DNA, 22 bp, Artificial Sequence
  Synthetic oligonucleotide; TTA chr11 5358449 5358470 5358454 5358449 -
ttggtctattcagagattcaac

SEQ ID NO: 120414 - DNA, 22 bp, Artificial Sequence
  Synthetic oligonucleotide; TTG chr11 5358446 5358467 5358451 5358446 -
gtctattcagagattcaacttc

SEQ ID NO: 120415 - DNA, 22 bp, Artificial Sequence
  Synthetic oligonucleotide; CTA chr11 5358441 5358462 5358446 5358441 -
ttcagagattcaacttcttcct

SEQ ID NO: 120416 - DNA, 22 bp, Artificial Sequence
  Synthetic oligonucleotide; TTC chr11 5358438 5358459 5358443 5358438 -
agagattcaacttcttcctggt

SEQ ID NO: 120417 - DNA, 22 bp, Artificial Sequence
  Synthetic oligonucleotide; TTC chr11 5358430 5358451 5358435 5358430 -
aacttcttcctggtttagtctt

SEQ ID NO: 120418 - DNA, 22 bp, Artificial Sequence
  Synthetic oligonucleotide; CTT chr11 5358425 5358446 5358430 5358425 -
cttcctggtttagtcttgggag

SEQ ID NO: 120419 - DNA, 22 bp, Artificial Sequence
  Synthetic oligonucleotide; TTC chr11 5358424 5358445 5358429 5358424 -
ttcctggtttagtcttgggagg

SEQ ID NO: 120420 - DNA, 22 bp, Artificial Sequence
  Synthetic oligonucleotide; CTT chr11 5358422 5358443 5358427 5358422 -
cctggtttagtcttgggagggt

SEQ ID NO: 120421 - DNA, 22 bp, Artificial Sequence
  Synthetic oligonucleotide; TTC chr11 5358421 5358442 5358426 5358421 -
ctggtttagtcttgggagggtg

SEQ ID NO: 120422 - DNA, 22 bp, Artificial Sequence
  Synthetic oligonucleotide; CTG chr11 5358418 5358439 5358423 5358418 -
gtttagtcttgggagggtgtat

SEQ ID NO: 120423 - DNA, 22 bp, Artificial Sequence
  Synthetic oligonucleotide; TTT chr11 5358414 5358435 5358419 5358414 -
agtcttgggagggtgtatgtgt

SEQ ID NO: 120424 - DNA, 22 bp, Artificial Sequence
  Synthetic oligonucleotide; TTA chr11 5358413 5358434 5358418 5358413 -
gtcttgggagggtgtatgtgtc

SEQ ID NO: 120425 - DNA, 22 bp, Artificial Sequence
  Synthetic oligonucleotide; CTT chr11 5358408 5358429 5358413 5358408 -
gggagggtgtatgtgtcaagga

SEQ ID NO: 120426 - DNA, 22 bp, Artificial Sequence
  Synthetic oligonucleotide; TTG chr11 5358407 5358428 5358412 5358407 -
ggagggtgtatgtgtcaaggaa

SEQ ID NO: 120427 - DNA, 22 bp, Artificial Sequence
  Synthetic oligonucleotide; TTT chr11 5358382 5358403 5358387 5358382 -
atccatttcttctagattttct

SEQ ID NO: 120428 - DNA, 22 bp, Artificial Sequence
  Synthetic oligonucleotide; TTA chr11 5358381 5358402 5358386 5358381 -
tccatttcttctagattttcta

SEQ ID NO: 120429 - DNA, 22 bp, Artificial Sequence
  Synthetic oligonucleotide; TTT chr11 5358374 5358395 5358379 5358374 -
cttctagattttctagtttatt

SEQ ID NO: 120430 - DNA, 22 bp, Artificial Sequence
  Synthetic oligonucleotide; TTC chr11 5358373 5358394 5358378 5358373 -
ttctagattttctagtttattt

SEQ ID NO: 120431 - DNA, 22 bp, Artificial Sequence
  Synthetic oligonucleotide; CTT chr11 5358371 5358392 5358376 5358371 -
ctagattttctagtttatttgt

SEQ ID NO: 120432 - DNA, 22 bp, Artificial Sequence
  Synthetic oligonucleotide; TTC chr11 5358370 5358391 5358375 5358370 -
tagattttctagtttatttgtg

SEQ ID NO: 120433 - DNA, 22 bp, Artificial Sequence
  Synthetic oligonucleotide; CTA chr11 5358368 5358389 5358373 5358368 -
gattttctagtttatttgtgta

SEQ ID NO: 120434 - DNA, 22 bp, Artificial Sequence
  Synthetic oligonucleotide; TTT chr11 5358363 5358384 5358368 5358363 -
tctagtttatttgtgtagaggt

SEQ ID NO: 120435 - DNA, 22 bp, Artificial Sequence
  Synthetic oligonucleotide; TTT chr11 5358362 5358383 5358367 5358362 -
ctagtttatttgtgtagaggtg

SEQ ID NO: 120436 - DNA, 22 bp, Artificial Sequence
  Synthetic oligonucleotide; TTC chr11 5358361 5358382 5358366 5358361 -
tagtttatttgtgtagaggtgt

SEQ ID NO: 120437 - DNA, 22 bp, Artificial Sequence
  Synthetic oligonucleotide; CTA chr11 5358359 5358380 5358364 5358359 -
gtttatttgtgtagaggtgttt

SEQ ID NO: 120438 - DNA, 22 bp, Artificial Sequence
  Synthetic oligonucleotide; TTT chr11 5358355 5358376 5358360 5358355 -
atttgtgtagaggtgtttatag

SEQ ID NO: 120439 - DNA, 22 bp, Artificial Sequence
  Synthetic oligonucleotide; TTA chr11 5358354 5358375 5358359 5358354 -
tttgtgtagaggtgtttatagt

SEQ ID NO: 120440 - DNA, 22 bp, Artificial Sequence
  Synthetic oligonucleotide; TTT chr11 5358351 5358372 5358356 5358351 -
gtgtagaggtgtttatagtatt

SEQ ID NO: 120441 - DNA, 22 bp, Artificial Sequence
  Synthetic oligonucleotide; TTG chr11 5358350 5358371 5358355 5358350 -
tgtagaggtgtttatagtattc

SEQ ID NO: 120442 - DNA, 22 bp, Artificial Sequence
  Synthetic oligonucleotide; TTT chr11 5358337 5358358 5358342 5358337 -
atagtattctctgatggtggtt

SEQ ID NO: 120443 - DNA, 22 bp, Artificial Sequence
  Synthetic oligonucleotide; TTA chr11 5358336 5358357 5358341 5358336 -
tagtattctctgatggtggttt

SEQ ID NO: 120444 - DNA, 22 bp, Artificial Sequence
  Synthetic oligonucleotide; TTC chr11 5358328 5358349 5358333 5358328 -
tctgatggtggtttgtatttct

SEQ ID NO: 120445 - DNA, 22 bp, Artificial Sequence
  Synthetic oligonucleotide; CTC chr11 5358326 5358347 5358331 5358326 -
tgatggtggtttgtatttctgt

SEQ ID NO: 120446 - DNA, 22 bp, Artificial Sequence
  Synthetic oligonucleotide; CTG chr11 5358324 5358345 5358329 5358324 -
atggtggtttgtatttctgtgg

SEQ ID NO: 120447 - DNA, 22 bp, Artificial Sequence
  Synthetic oligonucleotide; TTT chr11 5358314 5358335 5358319 5358314 -
gtatttctgtgggatcggtggt

SEQ ID NO: 120448 - DNA, 22 bp, Artificial Sequence
  Synthetic oligonucleotide; TTG chr11 5358313 5358334 5358318 5358313 -
tatttctgtgggatcggtggtg

SEQ ID NO: 120449 - DNA, 22 bp, Artificial Sequence
  Synthetic oligonucleotide; TTT chr11 5358308 5358329 5358313 5358308 -
ctgtgggatcggtggtgatata

SEQ ID NO: 120450 - DNA, 22 bp, Artificial Sequence
  Synthetic oligonucleotide; TTC chr11 5358307 5358328 5358312 5358307 -
tgtgggatcggtggtgatatac

SEQ ID NO: 120451 - DNA, 22 bp, Artificial Sequence
  Synthetic oligonucleotide; CTG chr11 5358305 5358326 5358310 5358305 -
tgggatcggtggtgatataccc

SEQ ID NO: 120452 - DNA, 22 bp, Artificial Sequence
  Synthetic oligonucleotide; CTT chr11 5358281 5358302 5358286 5358281 -
tatcattttttattgcatctat

SEQ ID NO: 120453 - DNA, 22 bp, Artificial Sequence
  Synthetic oligonucleotide; TTT chr11 5358280 5358301 5358285 5358280 -
atcattttttattgcatctatt

SEQ ID NO: 120454 - DNA, 22 bp, Artificial Sequence
  Synthetic oligonucleotide; TTA chr11 5358279 5358300 5358284 5358279 -
tcattttttattgcatctattt

SEQ ID NO: 120455 - DNA, 22 bp, Artificial Sequence
  Synthetic oligonucleotide; TTT chr11 5358273 5358294 5358278 5358273 -
tttattgcatctatttgattct

SEQ ID NO: 120456 - DNA, 22 bp, Artificial Sequence
  Synthetic oligonucleotide; TTT chr11 5358272 5358293 5358277 5358272 -
ttattgcatctatttgattctt

SEQ ID NO: 120457 - DNA, 22 bp, Artificial Sequence
  Synthetic oligonucleotide; TTT chr11 5358271 5358292 5358276 5358271 -
tattgcatctatttgattcttc

SEQ ID NO: 120458 - DNA, 22 bp, Artificial Sequence
  Synthetic oligonucleotide; TTT chr11 5358270 5358291 5358275 5358270 -
attgcatctatttgattcttct

SEQ ID NO: 120459 - DNA, 22 bp, Artificial Sequence
  Synthetic oligonucleotide; TTA chr11 5358269 5358290 5358274 5358269 -
ttgcatctatttgattcttctc

SEQ ID NO: 120460 - DNA, 22 bp, Artificial Sequence
  Synthetic oligonucleotide; TTG chr11 5358266 5358287 5358271 5358266 -
catctatttgattcttctctct

SEQ ID NO: 120461 - DNA, 22 bp, Artificial Sequence
  Synthetic oligonucleotide; CTA chr11 5358260 5358281 5358265 5358260 -
tttgattcttctctcttttctt

SEQ ID NO: 120462 - DNA, 22 bp, Artificial Sequence
  Synthetic oligonucleotide; TTT chr11 5358257 5358278 5358262 5358257 -
gattcttctctcttttcttctt

SEQ ID NO: 120463 - DNA, 22 bp, Artificial Sequence
  Synthetic oligonucleotide; TTG chr11 5358256 5358277 5358261 5358256 -
attcttctctcttttcttcttt

SEQ ID NO: 120464 - DNA, 22 bp, Artificial Sequence
  Synthetic oligonucleotide; TTC chr11 5358252 5358273 5358257 5358252 -
ttctctcttttcttctttatta

SEQ ID NO: 120465 - DNA, 22 bp, Artificial Sequence
  Synthetic oligonucleotide; CTT chr11 5358250 5358271 5358255 5358250 -
ctctcttttcttctttattagt

SEQ ID NO: 120466 - DNA, 22 bp, Artificial Sequence
  Synthetic oligonucleotide; TTC chr11 5358249 5358270 5358254 5358249 -
tctcttttcttctttattagtc

SEQ ID NO: 120467 - DNA, 22 bp, Artificial Sequence
  Synthetic oligonucleotide; CTC chr11 5358247 5358268 5358252 5358247 -
tcttttcttctttattagtctt

SEQ ID NO: 120468 - DNA, 22 bp, Artificial Sequence
  Synthetic oligonucleotide; CTC chr11 5358245 5358266 5358250 5358245 -
ttttcttctttattagtcttgc

SEQ ID NO: 120469 - DNA, 22 bp, Artificial Sequence
  Synthetic oligonucleotide; CTT chr11 5358243 5358264 5358248 5358243 -
ttcttctttattagtcttgcta

SEQ ID NO: 120470 - DNA, 22 bp, Artificial Sequence
  Synthetic oligonucleotide; TTT chr11 5358242 5358263 5358247 5358242 -
tcttctttattagtcttgctag

SEQ ID NO: 120471 - DNA, 22 bp, Artificial Sequence
  Synthetic oligonucleotide; TTT chr11 5358241 5358262 5358246 5358241 -
cttctttattagtcttgctagc

SEQ ID NO: 120472 - DNA, 22 bp, Artificial Sequence
  Synthetic oligonucleotide; TTC chr11 5358240 5358261 5358245 5358240 -
ttctttattagtcttgctagca

SEQ ID NO: 120473 - DNA, 22 bp, Artificial Sequence
  Synthetic oligonucleotide; CTT chr11 5358238 5358259 5358243 5358238 -
ctttattagtcttgctagcagt

SEQ ID NO: 120474 - DNA, 22 bp, Artificial Sequence
  Synthetic oligonucleotide; TTC chr11 5358237 5358258 5358242 5358237 -
tttattagtcttgctagcagtc

SEQ ID NO: 120475 - DNA, 22 bp, Artificial Sequence
  Synthetic oligonucleotide; CTT chr11 5358235 5358256 5358240 5358235 -
tattagtcttgctagcagtcta

SEQ ID NO: 120476 - DNA, 22 bp, Artificial Sequence
  Synthetic oligonucleotide; TTT chr11 5358234 5358255 5358239 5358234 -
attagtcttgctagcagtctat

SEQ ID NO: 120477 - DNA, 22 bp, Artificial Sequence
  Synthetic oligonucleotide; TTA chr11 5358233 5358254 5358238 5358233 -
ttagtcttgctagcagtctatc

SEQ ID NO: 120478 - DNA, 22 bp, Artificial Sequence
  Synthetic oligonucleotide; TTA chr11 5358230 5358251 5358235 5358230 -
gtcttgctagcagtctatcaat

SEQ ID NO: 120479 - DNA, 22 bp, Artificial Sequence
  Synthetic oligonucleotide; CTT chr11 5358225 5358246 5358230 5358225 -
gctagcagtctatcaattttgt

SEQ ID NO: 120480 - DNA, 22 bp, Artificial Sequence
  Synthetic oligonucleotide; TTG chr11 5358224 5358245 5358229 5358224 -
ctagcagtctatcaattttgtt

SEQ ID NO: 120481 - DNA, 22 bp, Artificial Sequence
  Synthetic oligonucleotide; CTA chr11 5358221 5358242 5358226 5358221 -
gcagtctatcaattttgttgat

SEQ ID NO: 120482 - DNA, 22 bp, Artificial Sequence
  Synthetic oligonucleotide; CTA chr11 5358213 5358234 5358218 5358213 -
tcaattttgttgatctttttga

SEQ ID NO: 120483 - DNA, 22 bp, Artificial Sequence
  Synthetic oligonucleotide; TTT chr11 5358206 5358227 5358211 5358206 -
tgttgatctttttgaaaaacca

SEQ ID NO: 120484 - DNA, 22 bp, Artificial Sequence
  Synthetic oligonucleotide; TTT chr11 5358205 5358226 5358210 5358205 -
gttgatctttttgaaaaaccag

SEQ ID NO: 120485 - DNA, 22 bp, Artificial Sequence
  Synthetic oligonucleotide; TTG chr11 5358204 5358225 5358209 5358204 -
ttgatctttttgaaaaaccagc

SEQ ID NO: 120486 - DNA, 22 bp, Artificial Sequence
  Synthetic oligonucleotide; TTG chr11 5358201 5358222 5358206 5358201 -
atctttttgaaaaaccagcttc

SEQ ID NO: 120487 - DNA, 22 bp, Artificial Sequence
  Synthetic oligonucleotide; CTT chr11 5358196 5358217 5358201 5358196 -
tttgaaaaaccagcttctggat

SEQ ID NO: 120488 - DNA, 22 bp, Artificial Sequence
  Synthetic oligonucleotide; TTT chr11 5358195 5358216 5358200 5358195 -
ttgaaaaaccagcttctggatt

SEQ ID NO: 120489 - DNA, 22 bp, Artificial Sequence
  Synthetic oligonucleotide; TTT chr11 5358194 5358215 5358199 5358194 -
tgaaaaaccagcttctggattc

SEQ ID NO: 120490 - DNA, 22 bp, Artificial Sequence
  Synthetic oligonucleotide; TTT chr11 5358193 5358214 5358198 5358193 -
gaaaaaccagcttctggattca

SEQ ID NO: 120491 - DNA, 22 bp, Artificial Sequence
  Synthetic oligonucleotide; TTG chr11 5358192 5358213 5358197 5358192 -
aaaaaccagcttctggattcat

SEQ ID NO: 120492 - DNA, 22 bp, Artificial Sequence
  Synthetic oligonucleotide; CTT chr11 5358180 5358201 5358185 5358180 -
ctggattcattgattttttgaa

SEQ ID NO: 120493 - DNA, 22 bp, Artificial Sequence
  Synthetic oligonucleotide; TTC chr11 5358179 5358200 5358184 5358179 -
tggattcattgattttttgaag

SEQ ID NO: 120494 - DNA, 22 bp, Artificial Sequence
  Synthetic oligonucleotide; CTG chr11 5358177 5358198 5358182 5358177 -
gattcattgattttttgaaggg

SEQ ID NO: 120495 - DNA, 22 bp, Artificial Sequence
  Synthetic oligonucleotide; TTC chr11 5358172 5358193 5358177 5358172 -
attgattttttgaagggttttt

SEQ ID NO: 120496 - DNA, 22 bp, Artificial Sequence
  Synthetic oligonucleotide; TTG chr11 5358168 5358189 5358173 5358168 -
attttttgaagggtttttttgt

SEQ ID NO: 120497 - DNA, 22 bp, Artificial Sequence
  Synthetic oligonucleotide; TTT chr11 5358164 5358185 5358169 5358164 -
tttgaagggtttttttgtgtct

SEQ ID NO: 120498 - DNA, 22 bp, Artificial Sequence
  Synthetic oligonucleotide; TTT chr11 5358163 5358184 5358168 5358163 -
ttgaagggtttttttgtgtctc

SEQ ID NO: 120499 - DNA, 22 bp, Artificial Sequence
  Synthetic oligonucleotide; TTT chr11 5358162 5358183 5358167 5358162 -
tgaagggtttttttgtgtctct

SEQ ID NO: 120500 - DNA, 22 bp, Artificial Sequence
  Synthetic oligonucleotide; TTT chr11 5358161 5358182 5358166 5358161 -
gaagggtttttttgtgtctcta

SEQ ID NO: 120501 - DNA, 22 bp, Artificial Sequence
  Synthetic oligonucleotide; TTG chr11 5358160 5358181 5358165 5358160 -
aagggtttttttgtgtctctat

SEQ ID NO: 120502 - DNA, 22 bp, Artificial Sequence
  Synthetic oligonucleotide; TTT chr11 5358152 5358173 5358157 5358152 -
ttttgtgtctctatttccttca

SEQ ID NO: 120503 - DNA, 22 bp, Artificial Sequence
  Synthetic oligonucleotide; TTT chr11 5358151 5358172 5358156 5358151 -
tttgtgtctctatttccttcag

SEQ ID NO: 120504 - DNA, 22 bp, Artificial Sequence
  Synthetic oligonucleotide; TTT chr11 5358150 5358171 5358155 5358150 -
ttgtgtctctatttccttcagt

SEQ ID NO: 120505 - DNA, 22 bp, Artificial Sequence
  Synthetic oligonucleotide; TTT chr11 5358149 5358170 5358154 5358149 -
tgtgtctctatttccttcagtt

SEQ ID NO: 120506 - DNA, 22 bp, Artificial Sequence
  Synthetic oligonucleotide; TTT chr11 5358148 5358169 5358153 5358148 -
gtgtctctatttccttcagttc

SEQ ID NO: 120507 - DNA, 22 bp, Artificial Sequence
  Synthetic oligonucleotide; TTG chr11 5358147 5358168 5358152 5358147 -
tgtctctatttccttcagttct

SEQ ID NO: 120508 - DNA, 22 bp, Artificial Sequence
  Synthetic oligonucleotide; CTC chr11 5358141 5358162 5358146 5358141 -
tatttccttcagttctgctctg

SEQ ID NO: 120509 - DNA, 22 bp, Artificial Sequence
  Synthetic oligonucleotide; CTA chr11 5358139 5358160 5358144 5358139 -
tttccttcagttctgctctgat

SEQ ID NO: 120510 - DNA, 22 bp, Artificial Sequence
  Synthetic oligonucleotide; TTT chr11 5358136 5358157 5358141 5358136 -
ccttcagttctgctctgatttt

SEQ ID NO: 120511 - DNA, 22 bp, Artificial Sequence
  Synthetic oligonucleotide; TTC chr11 5358135 5358156 5358140 5358135 -
cttcagttctgctctgatttta

SEQ ID NO: 120512 - DNA, 22 bp, Artificial Sequence
  Synthetic oligonucleotide; CTT chr11 5358132 5358153 5358137 5358132 -
cagttctgctctgattttagtt

SEQ ID NO: 120513 - DNA, 22 bp, Artificial Sequence
  Synthetic oligonucleotide; TTC chr11 5358131 5358152 5358136 5358131 -
agttctgctctgattttagtta

SEQ ID NO: 120514 - DNA, 22 bp, Artificial Sequence
  Synthetic oligonucleotide; TTC chr11 5358126 5358147 5358131 5358126 -
tgctctgattttagttatttct

SEQ ID NO: 120515 - DNA, 22 bp, Artificial Sequence
  Synthetic oligonucleotide; CTG chr11 5358124 5358145 5358129 5358124 -
ctctgattttagttatttcttg

SEQ ID NO: 120516 - DNA, 22 bp, Artificial Sequence
  Synthetic oligonucleotide; CTC chr11 5358121 5358142 5358126 5358121 -
tgattttagttatttcttgcct

SEQ ID NO: 120517 - DNA, 22 bp, Artificial Sequence
  Synthetic oligonucleotide; CTG chr11 5358119 5358140 5358124 5358119 -
attttagttatttcttgccttc

SEQ ID NO: 120518 - DNA, 22 bp, Artificial Sequence
  Synthetic oligonucleotide; TTT chr11 5358115 5358136 5358120 5358115 -
tagttatttcttgccttctgct

SEQ ID NO: 120519 - DNA, 22 bp, Artificial Sequence
  Synthetic oligonucleotide; TTT chr11 5358114 5358135 5358119 5358114 -
agttatttcttgccttctgcta

SEQ ID NO: 120520 - DNA, 22 bp, Artificial Sequence
  Synthetic oligonucleotide; TTA chr11 5358113 5358134 5358118 5358113 -
gttatttcttgccttctgctag

SEQ ID NO: 120521 - DNA, 22 bp, Artificial Sequence
  Synthetic oligonucleotide; TTA chr11 5358109 5358130 5358114 5358109 -
tttcttgccttctgctagcatt

SEQ ID NO: 120522 - DNA, 22 bp, Artificial Sequence
  Synthetic oligonucleotide; TTT chr11 5358106 5358127 5358111 5358106 -
cttgccttctgctagcatttga

SEQ ID NO: 120523 - DNA, 22 bp, Artificial Sequence
  Synthetic oligonucleotide; TTC chr11 5358105 5358126 5358110 5358105 -
ttgccttctgctagcatttgaa

SEQ ID NO: 120524 - DNA, 22 bp, Artificial Sequence
  Synthetic oligonucleotide; CTT chr11 5358103 5358124 5358108 5358103 -
gccttctgctagcatttgaatg

SEQ ID NO: 120525 - DNA, 22 bp, Artificial Sequence
  Synthetic oligonucleotide; TTG chr11 5358102 5358123 5358107 5358102 -
ccttctgctagcatttgaatgt

SEQ ID NO: 120526 - DNA, 22 bp, Artificial Sequence
  Synthetic oligonucleotide; CTT chr11 5358098 5358119 5358103 5358098 -
ctgctagcatttgaatgtgttt

SEQ ID NO: 120527 - DNA, 22 bp, Artificial Sequence
  Synthetic oligonucleotide; TTC chr11 5358097 5358118 5358102 5358097 -
tgctagcatttgaatgtgtttg

SEQ ID NO: 120528 - DNA, 22 bp, Artificial Sequence
  Synthetic oligonucleotide; CTG chr11 5358095 5358116 5358100 5358095 -
ctagcatttgaatgtgtttgct

SEQ ID NO: 120529 - DNA, 22 bp, Artificial Sequence
  Synthetic oligonucleotide; CTA chr11 5358092 5358113 5358097 5358092 -
gcatttgaatgtgtttgctctt

SEQ ID NO: 120530 - DNA, 22 bp, Artificial Sequence
  Synthetic oligonucleotide; TTT chr11 5358086 5358107 5358091 5358086 -
gaatgtgtttgctcttgcttct

SEQ ID NO: 120531 - DNA, 22 bp, Artificial Sequence
  Synthetic oligonucleotide; TTG chr11 5358085 5358106 5358090 5358085 -
aatgtgtttgctcttgcttctc

SEQ ID NO: 120532 - DNA, 22 bp, Artificial Sequence
  Synthetic oligonucleotide; TTT chr11 5358076 5358097 5358081 5358076 -
gctcttgcttctctagttcttt

SEQ ID NO: 120533 - DNA, 22 bp, Artificial Sequence
  Synthetic oligonucleotide; TTG chr11 5358075 5358096 5358080 5358075 -
ctcttgcttctctagttctttt

SEQ ID NO: 120534 - DNA, 22 bp, Artificial Sequence
  Synthetic oligonucleotide; CTC chr11 5358072 5358093 5358077 5358072 -
ttgcttctctagttcttttaat

SEQ ID NO: 120535 - DNA, 22 bp, Artificial Sequence
  Synthetic oligonucleotide; CTT chr11 5358070 5358091 5358075 5358070 -
gcttctctagttcttttaattg

SEQ ID NO: 120536 - DNA, 22 bp, Artificial Sequence
  Synthetic oligonucleotide; TTG chr11 5358069 5358090 5358074 5358069 -
cttctctagttcttttaattgt

SEQ ID NO: 120537 - DNA, 22 bp, Artificial Sequence
  Synthetic oligonucleotide; CTT chr11 5358066 5358087 5358071 5358066 -
ctctagttcttttaattgtgat

SEQ ID NO: 120538 - DNA, 22 bp, Artificial Sequence
  Synthetic oligonucleotide; TTC chr11 5358065 5358086 5358070 5358065 -
tctagttcttttaattgtgatg

SEQ ID NO: 120539 - DNA, 22 bp, Artificial Sequence
  Synthetic oligonucleotide; CTC chr11 5358063 5358084 5358068 5358063 -
tagttcttttaattgtgatgtt

SEQ ID NO: 120540 - DNA, 22 bp, Artificial Sequence
  Synthetic oligonucleotide; CTA chr11 5358061 5358082 5358066 5358061 -
gttcttttaattgtgatgttag

SEQ ID NO: 120541 - DNA, 22 bp, Artificial Sequence
  Synthetic oligonucleotide; TTC chr11 5358057 5358078 5358062 5358057 -
ttttaattgtgatgttagggtg

SEQ ID NO: 120542 - DNA, 22 bp, Artificial Sequence
  Synthetic oligonucleotide; CTT chr11 5358055 5358076 5358060 5358055 -
ttaattgtgatgttagggtgtc

SEQ ID NO: 120543 - DNA, 22 bp, Artificial Sequence
  Synthetic oligonucleotide; TTT chr11 5358054 5358075 5358059 5358054 -
taattgtgatgttagggtgtca

SEQ ID NO: 120544 - DNA, 22 bp, Artificial Sequence
  Synthetic oligonucleotide; TTT chr11 5358053 5358074 5358058 5358053 -
aattgtgatgttagggtgtcaa

SEQ ID NO: 120545 - DNA, 22 bp, Artificial Sequence
  Synthetic oligonucleotide; TTA chr11 5358052 5358073 5358057 5358052 -
attgtgatgttagggtgtcaat

SEQ ID NO: 120546 - DNA, 22 bp, Artificial Sequence
  Synthetic oligonucleotide; TTG chr11 5358048 5358069 5358053 5358048 -
tgatgttagggtgtcaatttta

SEQ ID NO: 120547 - DNA, 22 bp, Artificial Sequence
  Synthetic oligonucleotide; TTA chr11 5358040 5358061 5358045 5358040 -
gggtgtcaattttagatctttc

SEQ ID NO: 120548 - DNA, 22 bp, Artificial Sequence
  Synthetic oligonucleotide; TTT chr11 5358028 5358049 5358033 5358028 -
tagatctttcctgctttctctt

SEQ ID NO: 120549 - DNA, 22 bp, Artificial Sequence
  Synthetic oligonucleotide; TTT chr11 5358027 5358048 5358032 5358027 -
agatctttcctgctttctcttc

SEQ ID NO: 120550 - DNA, 22 bp, Artificial Sequence
  Synthetic oligonucleotide; TTA chr11 5358026 5358047 5358031 5358026 -
gatctttcctgctttctcttct

SEQ ID NO: 120551 - DNA, 22 bp, Artificial Sequence
  Synthetic oligonucleotide; CTT chr11 5358020 5358041 5358025 5358020 -
tcctgctttctcttctgggcgt

SEQ ID NO: 120552 - DNA, 22 bp, Artificial Sequence
  Synthetic oligonucleotide; TTT chr11 5358019 5358040 5358024 5358019 -
cctgctttctcttctgggcgtt

SEQ ID NO: 120553 - DNA, 22 bp, Artificial Sequence
  Synthetic oligonucleotide; TTC chr11 5358018 5358039 5358023 5358018 -
ctgctttctcttctgggcgttt

SEQ ID NO: 120554 - DNA, 22 bp, Artificial Sequence
  Synthetic oligonucleotide; CTG chr11 5358015 5358036 5358020 5358015 -
ctttctcttctgggcgtttagt

SEQ ID NO: 120555 - DNA, 22 bp, Artificial Sequence
  Synthetic oligonucleotide; CTT chr11 5358012 5358033 5358017 5358012 -
tctcttctgggcgtttagtgct

SEQ ID NO: 120556 - DNA, 22 bp, Artificial Sequence
  Synthetic oligonucleotide; TTT chr11 5358011 5358032 5358016 5358011 -
ctcttctgggcgtttagtgcta

SEQ ID NO: 120557 - DNA, 22 bp, Artificial Sequence
  Synthetic oligonucleotide; TTC chr11 5358010 5358031 5358015 5358010 -
tcttctgggcgtttagtgctat

SEQ ID NO: 120558 - DNA, 22 bp, Artificial Sequence
  Synthetic oligonucleotide; CTC chr11 5358008 5358029 5358013 5358008 -
ttctgggcgtttagtgctataa

SEQ ID NO: 120559 - DNA, 22 bp, Artificial Sequence
  Synthetic oligonucleotide; CTT chr11 5358006 5358027 5358011 5358006 -
ctgggcgtttagtgctataaat

SEQ ID NO: 120560 - DNA, 22 bp, Artificial Sequence
  Synthetic oligonucleotide; TTC chr11 5358005 5358026 5358010 5358005 -
tgggcgtttagtgctataaatt

SEQ ID NO: 120561 - DNA, 22 bp, Artificial Sequence
  Synthetic oligonucleotide; CTG chr11 5358003 5358024 5358008 5358003 -
ggcgtttagtgctataaatttc

SEQ ID NO: 120562 - DNA, 22 bp, Artificial Sequence
  Synthetic oligonucleotide; TTT chr11 5357996 5358017 5358001 5357996 -
agtgctataaatttccctctac

SEQ ID NO: 120563 - DNA, 22 bp, Artificial Sequence
  Synthetic oligonucleotide; TTA chr11 5357995 5358016 5358000 5357995 -
gtgctataaatttccctctaca

SEQ ID NO: 120564 - DNA, 22 bp, Artificial Sequence
  Synthetic oligonucleotide; CTA chr11 5357989 5358010 5357994 5357989 -
taaatttccctctacacactgc

SEQ ID NO: 120565 - DNA, 22 bp, Artificial Sequence
  Synthetic oligonucleotide; TTT chr11 5357982 5358003 5357987 5357982 -
ccctctacacactgctttgaat

SEQ ID NO: 120566 - DNA, 22 bp, Artificial Sequence
  Synthetic oligonucleotide; TTC chr11 5357981 5358002 5357986 5357981 -
cctctacacactgctttgaatg

SEQ ID NO: 120567 - DNA, 22 bp, Artificial Sequence
  Synthetic oligonucleotide; CTC chr11 5357977 5357998 5357982 5357977 -
tacacactgctttgaatgtgtc

SEQ ID NO: 120568 - DNA, 22 bp, Artificial Sequence
  Synthetic oligonucleotide; CTA chr11 5357975 5357996 5357980 5357975 -
cacactgctttgaatgtgtccc

SEQ ID NO: 120569 - DNA, 22 bp, Artificial Sequence
  Synthetic oligonucleotide; CTG chr11 5357968 5357989 5357973 5357968 -
ctttgaatgtgtcccagagatt

SEQ ID NO: 120570 - DNA, 22 bp, Artificial Sequence
  Synthetic oligonucleotide; CTT chr11 5357965 5357986 5357970 5357965 -
tgaatgtgtcccagagattctg

SEQ ID NO: 120571 - DNA, 22 bp, Artificial Sequence
  Synthetic oligonucleotide; TTT chr11 5357964 5357985 5357969 5357964 -
gaatgtgtcccagagattctgg

SEQ ID NO: 120572 - DNA, 22 bp, Artificial Sequence
  Synthetic oligonucleotide; TTG chr11 5357963 5357984 5357968 5357963 -
aatgtgtcccagagattctggt

SEQ ID NO: 120573 - DNA, 22 bp, Artificial Sequence
  Synthetic oligonucleotide; TTC chr11 5357945 5357966 5357950 5357945 -
tggtatgttgtgtctttgttct

SEQ ID NO: 120574 - DNA, 22 bp, Artificial Sequence
  Synthetic oligonucleotide; CTG chr11 5357943 5357964 5357948 5357943 -
gtatgttgtgtctttgttctct

SEQ ID NO: 120575 - DNA, 22 bp, Artificial Sequence
  Synthetic oligonucleotide; TTG chr11 5357935 5357956 5357940 5357935 -
tgtctttgttctctttggttcc

SEQ ID NO: 120576 - DNA, 22 bp, Artificial Sequence
  Synthetic oligonucleotide; CTT chr11 5357929 5357950 5357934 5357929 -
tgttctctttggttccaaagaa

SEQ ID NO: 120577 - DNA, 22 bp, Artificial Sequence
  Synthetic oligonucleotide; TTT chr11 5357928 5357949 5357933 5357928 -
gttctctttggttccaaagaac

SEQ ID NO: 120578 - DNA, 22 bp, Artificial Sequence
  Synthetic oligonucleotide; TTG chr11 5357927 5357948 5357932 5357927 -
ttctctttggttccaaagaaca

SEQ ID NO: 120579 - DNA, 22 bp, Artificial Sequence
  Synthetic oligonucleotide; TTC chr11 5357924 5357945 5357929 5357924 -
tctttggttccaaagaacattt

SEQ ID NO: 120580 - DNA, 22 bp, Artificial Sequence
  Synthetic oligonucleotide; CTC chr11 5357922 5357943 5357927 5357922 -
tttggttccaaagaacattttt

SEQ ID NO: 120581 - DNA, 22 bp, Artificial Sequence
  Synthetic oligonucleotide; CTT chr11 5357920 5357941 5357925 5357920 -
tggttccaaagaacatttttat

SEQ ID NO: 120582 - DNA, 22 bp, Artificial Sequence
  Synthetic oligonucleotide; TTT chr11 5357919 5357940 5357924 5357919 -
ggttccaaagaacatttttatt

SEQ ID NO: 120583 - DNA, 22 bp, Artificial Sequence
  Synthetic oligonucleotide; TTG chr11 5357918 5357939 5357923 5357918 -
gttccaaagaacatttttattt

SEQ ID NO: 120584 - DNA, 22 bp, Artificial Sequence
  Synthetic oligonucleotide; TTC chr11 5357914 5357935 5357919 5357914 -
caaagaacatttttatttctgc

SEQ ID NO: 120585 - DNA, 22 bp, Artificial Sequence
  Synthetic oligonucleotide; TTT chr11 5357902 5357923 5357907 5357902 -
ttatttctgccttcattttgtt

SEQ ID NO: 120586 - DNA, 22 bp, Artificial Sequence
  Synthetic oligonucleotide; TTT chr11 5357901 5357922 5357906 5357901 -
tatttctgccttcattttgtta

SEQ ID NO: 120587 - DNA, 22 bp, Artificial Sequence
  Synthetic oligonucleotide; TTT chr11 5357900 5357921 5357905 5357900 -
atttctgccttcattttgttat

SEQ ID NO: 120588 - DNA, 22 bp, Artificial Sequence
  Synthetic oligonucleotide; TTA chr11 5357899 5357920 5357904 5357899 -
tttctgccttcattttgttatg

SEQ ID NO: 120589 - DNA, 22 bp, Artificial Sequence
  Synthetic oligonucleotide; TTT chr11 5357896 5357917 5357901 5357896 -
ctgccttcattttgttatgaac

SEQ ID NO: 120590 - DNA, 22 bp, Artificial Sequence
  Synthetic oligonucleotide; TTC chr11 5357895 5357916 5357900 5357895 -
tgccttcattttgttatgaacc

SEQ ID NO: 120591 - DNA, 22 bp, Artificial Sequence
  Synthetic oligonucleotide; CTG chr11 5357893 5357914 5357898 5357893 -
ccttcattttgttatgaaccca

SEQ ID NO: 120592 - DNA, 22 bp, Artificial Sequence
  Synthetic oligonucleotide; CTT chr11 5357889 5357910 5357894 5357889 -
cattttgttatgaacccagtag

SEQ ID NO: 120593 - DNA, 22 bp, Artificial Sequence
  Synthetic oligonucleotide; TTC chr11 5357888 5357909 5357893 5357888 -
attttgttatgaacccagtagt

SEQ ID NO: 120594 - DNA, 22 bp, Artificial Sequence
  Synthetic oligonucleotide; TTT chr11 5357884 5357905 5357889 5357884 -
tgttatgaacccagtagtcatt

SEQ ID NO: 120595 - DNA, 22 bp, Artificial Sequence
  Synthetic oligonucleotide; TTT chr11 5357883 5357904 5357888 5357883 -
gttatgaacccagtagtcattc

SEQ ID NO: 120596 - DNA, 22 bp, Artificial Sequence
  Synthetic oligonucleotide; TTG chr11 5357882 5357903 5357887 5357882 -
ttatgaacccagtagtcattca

SEQ ID NO: 120597 - DNA, 22 bp, Artificial Sequence
  Synthetic oligonucleotide; TTA chr11 5357879 5357900 5357884 5357879 -
tgaacccagtagtcattcagga

SEQ ID NO: 120598 - DNA, 22 bp, Artificial Sequence
  Synthetic oligonucleotide; TTC chr11 5357861 5357882 5357866 5357861 -
aggagcaatttgttcggtttcc

SEQ ID NO: 120599 - DNA, 22 bp, Artificial Sequence
  Synthetic oligonucleotide; TTT chr11 5357850 5357871 5357855 5357850 -
gttcggtttccatgtagttgag

SEQ ID NO: 120600 - DNA, 22 bp, Artificial Sequence
  Synthetic oligonucleotide; TTG chr11 5357849 5357870 5357854 5357849 -
ttcggtttccatgtagttgagc

SEQ ID NO: 120601 - DNA, 22 bp, Artificial Sequence
  Synthetic oligonucleotide; TTC chr11 5357846 5357867 5357851 5357846 -
ggtttccatgtagttgagcggt

SEQ ID NO: 120602 - DNA, 22 bp, Artificial Sequence
  Synthetic oligonucleotide; TTT chr11 5357841 5357862 5357846 5357841 -
ccatgtagttgagcggttttga

SEQ ID NO: 120603 - DNA, 22 bp, Artificial Sequence
  Synthetic oligonucleotide; TTC chr11 5357840 5357861 5357845 5357840 -
catgtagttgagcggttttgag

SEQ ID NO: 120604 - DNA, 22 bp, Artificial Sequence
  Synthetic oligonucleotide; TTG chr11 5357830 5357851 5357835 5357830 -
agcggttttgagtgagtttctt

SEQ ID NO: 120605 - DNA, 22 bp, Artificial Sequence
  Synthetic oligonucleotide; TTT chr11 5357822 5357843 5357827 5357822 -
tgagtgagtttcttaatcctga

SEQ ID NO: 120606 - DNA, 22 bp, Artificial Sequence
  Synthetic oligonucleotide; TTT chr11 5357821 5357842 5357826 5357821 -
gagtgagtttcttaatcctgag

SEQ ID NO: 120607 - DNA, 22 bp, Artificial Sequence
  Synthetic oligonucleotide; TTG chr11 5357820 5357841 5357825 5357820 -
agtgagtttcttaatcctgagt

SEQ ID NO: 120608 - DNA, 22 bp, Artificial Sequence
  Synthetic oligonucleotide; TTT chr11 5357811 5357832 5357816 5357811 -
cttaatcctgagttctagtttg

SEQ ID NO: 120609 - DNA, 22 bp, Artificial Sequence
  Synthetic oligonucleotide; TTC chr11 5357810 5357831 5357815 5357810 -
ttaatcctgagttctagtttga

SEQ ID NO: 120610 - DNA, 22 bp, Artificial Sequence
  Synthetic oligonucleotide; CTT chr11 5357808 5357829 5357813 5357808 -
aatcctgagttctagtttgatt

SEQ ID NO: 120611 - DNA, 22 bp, Artificial Sequence
  Synthetic oligonucleotide; TTA chr11 5357807 5357828 5357812 5357807 -
atcctgagttctagtttgattg

SEQ ID NO: 120612 - DNA, 22 bp, Artificial Sequence
  Synthetic oligonucleotide; CTG chr11 5357801 5357822 5357806 5357801 -
agttctagtttgattgcactgt

SEQ ID NO: 120613 - DNA, 22 bp, Artificial Sequence
  Synthetic oligonucleotide; TTC chr11 5357796 5357817 5357801 5357796 -
tagtttgattgcactgtggtct

SEQ ID NO: 120614 - DNA, 22 bp, Artificial Sequence
  Synthetic oligonucleotide; CTA chr11 5357794 5357815 5357799 5357794 -
gtttgattgcactgtggtctga

SEQ ID NO: 120615 - DNA, 22 bp, Artificial Sequence
  Synthetic oligonucleotide; TTT chr11 5357790 5357811 5357795 5357790 -
gattgcactgtggtctgagaga

SEQ ID NO: 120616 - DNA, 22 bp, Artificial Sequence
  Synthetic oligonucleotide; TTG chr11 5357789 5357810 5357794 5357789 -
attgcactgtggtctgagagac

SEQ ID NO: 120617 - DNA, 22 bp, Artificial Sequence
  Synthetic oligonucleotide; TTG chr11 5357785 5357806 5357790 5357785 -
cactgtggtctgagagacagtt

SEQ ID NO: 120618 - DNA, 22 bp, Artificial Sequence
  Synthetic oligonucleotide; CTG chr11 5357780 5357801 5357785 5357780 -
tggtctgagagacagtttgtta

SEQ ID NO: 120619 - DNA, 22 bp, Artificial Sequence
  Synthetic oligonucleotide; CTG chr11 5357773 5357794 5357778 5357773 -
agagacagtttgttataatttc

SEQ ID NO: 120620 - DNA, 22 bp, Artificial Sequence
  Synthetic oligonucleotide; TTT chr11 5357762 5357783 5357767 5357762 -
gttataatttctgttcttttac

SEQ ID NO: 120621 - DNA, 22 bp, Artificial Sequence
  Synthetic oligonucleotide; TTG chr11 5357761 5357782 5357766 5357761 -
ttataatttctgttcttttaca

SEQ ID NO: 120622 - DNA, 22 bp, Artificial Sequence
  Synthetic oligonucleotide; TTA chr11 5357758 5357779 5357763 5357758 -
taatttctgttcttttacattt

SEQ ID NO: 120623 - DNA, 22 bp, Artificial Sequence
  Synthetic oligonucleotide; TTT chr11 5357752 5357773 5357757 5357752 -
ctgttcttttacatttgctgag

SEQ ID NO: 120624 - DNA, 22 bp, Artificial Sequence
  Synthetic oligonucleotide; TTC chr11 5357751 5357772 5357756 5357751 -
tgttcttttacatttgctgagg

SEQ ID NO: 120625 - DNA, 22 bp, Artificial Sequence
  Synthetic oligonucleotide; CTG chr11 5357749 5357770 5357754 5357749 -
ttcttttacatttgctgaggag

SEQ ID NO: 120626 - DNA, 22 bp, Artificial Sequence
  Synthetic oligonucleotide; TTC chr11 5357746 5357767 5357751 5357746 -
ttttacatttgctgaggagtgc

SEQ ID NO: 120627 - DNA, 22 bp, Artificial Sequence
  Synthetic oligonucleotide; CTT chr11 5357744 5357765 5357749 5357744 -
ttacatttgctgaggagtgctt

SEQ ID NO: 120628 - DNA, 22 bp, Artificial Sequence
  Synthetic oligonucleotide; TTT chr11 5357743 5357764 5357748 5357743 -
tacatttgctgaggagtgcttt

SEQ ID NO: 120629 - DNA, 22 bp, Artificial Sequence
  Synthetic oligonucleotide; TTT chr11 5357742 5357763 5357747 5357742 -
acatttgctgaggagtgcttta

SEQ ID NO: 120630 - DNA, 22 bp, Artificial Sequence
  Synthetic oligonucleotide; TTA chr11 5357741 5357762 5357746 5357741 -
catttgctgaggagtgctttac

SEQ ID NO: 120631 - DNA, 22 bp, Artificial Sequence
  Synthetic oligonucleotide; TTT chr11 5357736 5357757 5357741 5357736 -
gctgaggagtgctttacttcca

SEQ ID NO: 120632 - DNA, 22 bp, Artificial Sequence
  Synthetic oligonucleotide; TTG chr11 5357735 5357756 5357740 5357735 -
ctgaggagtgctttacttccaa

SEQ ID NO: 120633 - DNA, 22 bp, Artificial Sequence
  Synthetic oligonucleotide; CTG chr11 5357732 5357753 5357737 5357732 -
aggagtgctttacttccaacta

SEQ ID NO: 120634 - DNA, 22 bp, Artificial Sequence
  Synthetic oligonucleotide; CTT chr11 5357722 5357743 5357727 5357722 -
tacttccaactatgtggtcaat

SEQ ID NO: 120635 - DNA, 22 bp, Artificial Sequence
  Synthetic oligonucleotide; TTT chr11 5357721 5357742 5357726 5357721 -
acttccaactatgtggtcaatt

SEQ ID NO: 120636 - DNA, 22 bp, Artificial Sequence
  Synthetic oligonucleotide; TTA chr11 5357720 5357741 5357725 5357720 -
cttccaactatgtggtcaattt

SEQ ID NO: 120637 - DNA, 22 bp, Artificial Sequence
  Synthetic oligonucleotide; CTT chr11 5357717 5357738 5357722 5357717 -
ccaactatgtggtcaattttgg

SEQ ID NO: 120638 - DNA, 22 bp, Artificial Sequence
  Synthetic oligonucleotide; TTC chr11 5357716 5357737 5357721 5357716 -
caactatgtggtcaattttgga

SEQ ID NO: 120639 - DNA, 22 bp, Artificial Sequence
  Synthetic oligonucleotide; CTA chr11 5357710 5357731 5357715 5357710 -
tgtggtcaattttggaataggt

SEQ ID NO: 120640 - DNA, 22 bp, Artificial Sequence
  Synthetic oligonucleotide; TTT chr11 5357698 5357719 5357703 5357698 -
tggaataggtgtggtgtggtgc

SEQ ID NO: 120641 - DNA, 22 bp, Artificial Sequence
  Synthetic oligonucleotide; TTT chr11 5357697 5357718 5357702 5357697 -
ggaataggtgtggtgtggtgct

SEQ ID NO: 120642 - DNA, 22 bp, Artificial Sequence
  Synthetic oligonucleotide; TTG chr11 5357696 5357717 5357701 5357696 -
gaataggtgtggtgtggtgctg

SEQ ID NO: 120643 - DNA, 22 bp, Artificial Sequence
  Synthetic oligonucleotide; CTG chr11 5357674 5357695 5357679 5357674 -
aaaagaatgtatattctgttga

SEQ ID NO: 120644 - DNA, 22 bp, Artificial Sequence
  Synthetic oligonucleotide; TTC chr11 5357658 5357679 5357663 5357658 -
tgttgatttggggtggagagtt

SEQ ID NO: 120645 - DNA, 22 bp, Artificial Sequence
  Synthetic oligonucleotide; CTG chr11 5357656 5357677 5357661 5357656 -
ttgatttggggtggagagttct

SEQ ID NO: 120646 - DNA, 22 bp, Artificial Sequence
  Synthetic oligonucleotide; TTG chr11 5357653 5357674 5357658 5357653 -
atttggggtggagagttctgta

SEQ ID NO: 120647 - DNA, 22 bp, Artificial Sequence
  Synthetic oligonucleotide; TTT chr11 5357649 5357670 5357654 5357649 -
ggggtggagagttctgtagatg

SEQ ID NO: 120648 - DNA, 22 bp, Artificial Sequence
  Synthetic oligonucleotide; TTG chr11 5357648 5357669 5357653 5357648 -
gggtggagagttctgtagatgt

SEQ ID NO: 120649 - DNA, 22 bp, Artificial Sequence
  Synthetic oligonucleotide; TTC chr11 5357635 5357656 5357640 5357635 -
tgtagatgtctattaggtccgc

SEQ ID NO: 120650 - DNA, 22 bp, Artificial Sequence
  Synthetic oligonucleotide; CTG chr11 5357633 5357654 5357638 5357633 -
tagatgtctattaggtccgctt

SEQ ID NO: 120651 - DNA, 22 bp, Artificial Sequence
  Synthetic oligonucleotide; CTA chr11 5357623 5357644 5357628 5357623 -
ttaggtccgcttggtgcagagc

SEQ ID NO: 120652 - DNA, 22 bp, Artificial Sequence
  Synthetic oligonucleotide; TTA chr11 5357620 5357641 5357625 5357620 -
ggtccgcttggtgcagagctga

SEQ ID NO: 120653 - DNA, 22 bp, Artificial Sequence
  Synthetic oligonucleotide; CTT chr11 5357611 5357632 5357616 5357611 -
ggtgcagagctgagttcaattc

SEQ ID NO: 120654 - DNA, 22 bp, Artificial Sequence
  Synthetic oligonucleotide; TTG chr11 5357610 5357631 5357615 5357610 -
gtgcagagctgagttcaattcc

SEQ ID NO: 120655 - DNA, 22 bp, Artificial Sequence
  Synthetic oligonucleotide; CTG chr11 5357599 5357620 5357604 5357599 -
agttcaattcctggatatcctt

SEQ ID NO: 120656 - DNA, 22 bp, Artificial Sequence
  Synthetic oligonucleotide; TTC chr11 5357594 5357615 5357599 5357594 -
aattcctggatatccttgttaa

SEQ ID NO: 120657 - DNA, 22 bp, Artificial Sequence
  Synthetic oligonucleotide; TTC chr11 5357589 5357610 5357594 5357589 -
ctggatatccttgttaactttc

SEQ ID NO: 120658 - DNA, 22 bp, Artificial Sequence
  Synthetic oligonucleotide; CTG chr11 5357586 5357607 5357591 5357586 -
gatatccttgttaactttctgt

SEQ ID NO: 120659 - DNA, 22 bp, Artificial Sequence
  Synthetic oligonucleotide; CTT chr11 5357577 5357598 5357582 5357577 -
gttaactttctgtctcgttgat

SEQ ID NO: 120660 - DNA, 22 bp, Artificial Sequence
  Synthetic oligonucleotide; TTG chr11 5357576 5357597 5357581 5357576 -
ttaactttctgtctcgttgatc

SEQ ID NO: 120661 - DNA, 22 bp, Artificial Sequence
  Synthetic oligonucleotide; TTA chr11 5357573 5357594 5357578 5357573 -
actttctgtctcgttgatctgt

SEQ ID NO: 120662 - DNA, 22 bp, Artificial Sequence
  Synthetic oligonucleotide; CTT chr11 5357569 5357590 5357574 5357569 -
tctgtctcgttgatctgtctaa

SEQ ID NO: 120663 - DNA, 22 bp, Artificial Sequence
  Synthetic oligonucleotide; TTT chr11 5357568 5357589 5357573 5357568 -
ctgtctcgttgatctgtctaat

SEQ ID NO: 120664 - DNA, 22 bp, Artificial Sequence
  Synthetic oligonucleotide; TTC chr11 5357567 5357588 5357572 5357567 -
tgtctcgttgatctgtctaatg

SEQ ID NO: 120665 - DNA, 22 bp, Artificial Sequence
  Synthetic oligonucleotide; CTG chr11 5357565 5357586 5357570 5357565 -
tctcgttgatctgtctaatgtt

SEQ ID NO: 120666 - DNA, 22 bp, Artificial Sequence
  Synthetic oligonucleotide; CTC chr11 5357561 5357582 5357566 5357561 -
gttgatctgtctaatgttgatc

SEQ ID NO: 120667 - DNA, 22 bp, Artificial Sequence
  Synthetic oligonucleotide; TTG chr11 5357557 5357578 5357562 5357557 -
atctgtctaatgttgatctgtc

SEQ ID NO: 120668 - DNA, 22 bp, Artificial Sequence
  Synthetic oligonucleotide; CTG chr11 5357552 5357573 5357557 5357552 -
tctaatgttgatctgtctaatg

SEQ ID NO: 120669 - DNA, 22 bp, Artificial Sequence
  Synthetic oligonucleotide; CTA chr11 5357548 5357569 5357553 5357548 -
atgttgatctgtctaatgttga

SEQ ID NO: 120670 - DNA, 22 bp, Artificial Sequence
  Synthetic oligonucleotide; TTG chr11 5357542 5357563 5357547 5357542 -
atctgtctaatgttgacagtgg

SEQ ID NO: 120671 - DNA, 22 bp, Artificial Sequence
  Synthetic oligonucleotide; CTG chr11 5357537 5357558 5357542 5357537 -
tctaatgttgacagtggggtgt

SEQ ID NO: 120672 - DNA, 22 bp, Artificial Sequence
  Synthetic oligonucleotide; CTA chr11 5357533 5357554 5357538 5357533 -
atgttgacagtggggtgttaaa

SEQ ID NO: 120673 - DNA, 22 bp, Artificial Sequence
  Synthetic oligonucleotide; TTG chr11 5357527 5357548 5357532 5357527 -
acagtggggtgttaaagtctcc

SEQ ID NO: 120674 - DNA, 22 bp, Artificial Sequence
  Synthetic oligonucleotide; TTA chr11 5357513 5357534 5357518 5357513 -
aagtctcccattgttattgtgt

SEQ ID NO: 120675 - DNA, 22 bp, Artificial Sequence
  Synthetic oligonucleotide; CTC chr11 5357506 5357527 5357511 5357506 -
ccattgttattgtgtgagagtc

SEQ ID NO: 120676 - DNA, 22 bp, Artificial Sequence
  Synthetic oligonucleotide; TTG chr11 5357500 5357521 5357505 5357500 -
ttattgtgtgagagtctaagtc

SEQ ID NO: 120677 - DNA, 22 bp, Artificial Sequence
  Synthetic oligonucleotide; TTA chr11 5357497 5357518 5357502 5357497 -
ttgtgtgagagtctaagtctct

SEQ ID NO: 120678 - DNA, 22 bp, Artificial Sequence
  Synthetic oligonucleotide; TTG chr11 5357494 5357515 5357499 5357494 -
tgtgagagtctaagtctctttg

SEQ ID NO: 120679 - DNA, 22 bp, Artificial Sequence
  Synthetic oligonucleotide; CTA chr11 5357482 5357503 5357487 5357482 -
agtctctttgtaggtctctaag

SEQ ID NO: 120680 - DNA, 22 bp, Artificial Sequence
  Synthetic oligonucleotide; CTC chr11 5357476 5357497 5357481 5357476 -
tttgtaggtctctaaggacttg

SEQ ID NO: 120681 - DNA, 22 bp, Artificial Sequence
  Synthetic oligonucleotide; CTT chr11 5357474 5357495 5357479 5357474 -
tgtaggtctctaaggacttgct

SEQ ID NO: 120682 - DNA, 22 bp, Artificial Sequence
  Synthetic oligonucleotide; TTT chr11 5357473 5357494 5357478 5357473 -
gtaggtctctaaggacttgctt

SEQ ID NO: 120683 - DNA, 22 bp, Artificial Sequence
  Synthetic oligonucleotide; TTG chr11 5357472 5357493 5357477 5357472 -
taggtctctaaggacttgcttt

SEQ ID NO: 120684 - DNA, 22 bp, Artificial Sequence
  Synthetic oligonucleotide; CTC chr11 5357464 5357485 5357469 5357464 -
taaggacttgctttatgaacct

SEQ ID NO: 120685 - DNA, 22 bp, Artificial Sequence
  Synthetic oligonucleotide; CTA chr11 5357462 5357483 5357467 5357462 -
aggacttgctttatgaacctgg

SEQ ID NO: 120686 - DNA, 22 bp, Artificial Sequence
  Synthetic oligonucleotide; CTT chr11 5357455 5357476 5357460 5357455 -
gctttatgaacctgggtgttcc

SEQ ID NO: 120687 - DNA, 22 bp, Artificial Sequence
  Synthetic oligonucleotide; TTG chr11 5357454 5357475 5357459 5357454 -
ctttatgaacctgggtgttcct

SEQ ID NO: 120688 - DNA, 22 bp, Artificial Sequence
  Synthetic oligonucleotide; CTT chr11 5357451 5357472 5357456 5357451 -
tatgaacctgggtgttcctgta

SEQ ID NO: 120689 - DNA, 22 bp, Artificial Sequence
  Synthetic oligonucleotide; TTT chr11 5357450 5357471 5357455 5357450 -
atgaacctgggtgttcctgtat

SEQ ID NO: 120690 - DNA, 22 bp, Artificial Sequence
  Synthetic oligonucleotide; TTA chr11 5357449 5357470 5357454 5357449 -
tgaacctgggtgttcctgtatt

SEQ ID NO: 120691 - DNA, 22 bp, Artificial Sequence
  Synthetic oligonucleotide; CTG chr11 5357441 5357462 5357446 5357441 -
ggtgttcctgtattgggtgcat

SEQ ID NO: 120692 - DNA, 22 bp, Artificial Sequence
  Synthetic oligonucleotide; TTC chr11 5357434 5357455 5357439 5357434 -
ctgtattgggtgcatatatgtt

SEQ ID NO: 120693 - DNA, 22 bp, Artificial Sequence
  Synthetic oligonucleotide; CTG chr11 5357431 5357452 5357436 5357431 -
tattgggtgcatatatgtttag

SEQ ID NO: 120694 - DNA, 22 bp, Artificial Sequence
  Synthetic oligonucleotide; TTG chr11 5357426 5357447 5357431 5357426 -
ggtgcatatatgtttaggatag

SEQ ID NO: 120695 - DNA, 22 bp, Artificial Sequence
  Synthetic oligonucleotide; TTT chr11 5357411 5357432 5357416 5357411 -
aggatagttagctcttcttgtt

SEQ ID NO: 120696 - DNA, 22 bp, Artificial Sequence
  Synthetic oligonucleotide; TTA chr11 5357410 5357431 5357415 5357410 -
ggatagttagctcttcttgttg

SEQ ID NO: 120697 - DNA, 22 bp, Artificial Sequence
  Synthetic oligonucleotide; TTA chr11 5357401 5357422 5357406 5357401 -
gctcttcttgttgaattgatcc

SEQ ID NO: 120698 - DNA, 22 bp, Artificial Sequence
  Synthetic oligonucleotide; CTC chr11 5357397 5357418 5357402 5357397 -
ttcttgttgaattgatcccttt

SEQ ID NO: 120699 - DNA, 22 bp, Artificial Sequence
  Synthetic oligonucleotide; CTT chr11 5357395 5357416 5357400 5357395 -
cttgttgaattgatccctttac

SEQ ID NO: 120700 - DNA, 22 bp, Artificial Sequence
  Synthetic oligonucleotide; TTC chr11 5357394 5357415 5357399 5357394 -
ttgttgaattgatccctttacc

SEQ ID NO: 120701 - DNA, 22 bp, Artificial Sequence
  Synthetic oligonucleotide; CTT chr11 5357392 5357413 5357397 5357392 -
gttgaattgatccctttaccat

SEQ ID NO: 120702 - DNA, 22 bp, Artificial Sequence
  Synthetic oligonucleotide; TTG chr11 5357391 5357412 5357396 5357391 -
ttgaattgatccctttaccatt

SEQ ID NO: 120703 - DNA, 22 bp, Artificial Sequence
  Synthetic oligonucleotide; TTG chr11 5357388 5357409 5357393 5357388 -
aattgatccctttaccattatg

SEQ ID NO: 120704 - DNA, 22 bp, Artificial Sequence
  Synthetic oligonucleotide; TTG chr11 5357383 5357404 5357388 5357383 -
atccctttaccattatgtaatg

SEQ ID NO: 120705 - DNA, 22 bp, Artificial Sequence
  Synthetic oligonucleotide; CTT chr11 5357376 5357397 5357381 5357376 -
taccattatgtaatggccttct

SEQ ID NO: 120706 - DNA, 22 bp, Artificial Sequence
  Synthetic oligonucleotide; TTT chr11 5357375 5357396 5357380 5357375 -
accattatgtaatggccttctt

SEQ ID NO: 120707 - DNA, 22 bp, Artificial Sequence
  Synthetic oligonucleotide; TTA chr11 5357374 5357395 5357379 5357374 -
ccattatgtaatggccttcttt

SEQ ID NO: 120708 - DNA, 22 bp, Artificial Sequence
  Synthetic oligonucleotide; TTA chr11 5357368 5357389 5357373 5357368 -
tgtaatggccttctttgtctct

SEQ ID NO: 120709 - DNA, 22 bp, Artificial Sequence
  Synthetic oligonucleotide; CTT chr11 5357356 5357377 5357361 5357356 -
ctttgtctcttttgatctttgt

SEQ ID NO: 120710 - DNA, 22 bp, Artificial Sequence
  Synthetic oligonucleotide; TTC chr11 5357355 5357376 5357360 5357355 -
tttgtctcttttgatctttgtt

SEQ ID NO: 120711 - DNA, 22 bp, Artificial Sequence
  Synthetic oligonucleotide; CTT chr11 5357353 5357374 5357358 5357353 -
tgtctcttttgatctttgttgg

SEQ ID NO: 120712 - DNA, 22 bp, Artificial Sequence
  Synthetic oligonucleotide; TTT chr11 5357352 5357373 5357357 5357352 -
gtctcttttgatctttgttggt

SEQ ID NO: 120713 - DNA, 22 bp, Artificial Sequence
  Synthetic oligonucleotide; TTG chr11 5357351 5357372 5357356 5357351 -
tctcttttgatctttgttggtt

SEQ ID NO: 120714 - DNA, 22 bp, Artificial Sequence
  Synthetic oligonucleotide; CTC chr11 5357347 5357368 5357352 5357347 -
ttttgatctttgttggtttaaa

SEQ ID NO: 120715 - DNA, 22 bp, Artificial Sequence
  Synthetic oligonucleotide; CTT chr11 5357345 5357366 5357350 5357345 -
ttgatctttgttggtttaaagc

SEQ ID NO: 120716 - DNA, 22 bp, Artificial Sequence
  Synthetic oligonucleotide; TTT chr11 5357344 5357365 5357349 5357344 -
tgatctttgttggtttaaagcc

SEQ ID NO: 120717 - DNA, 22 bp, Artificial Sequence
  Synthetic oligonucleotide; TTT chr11 5357343 5357364 5357348 5357343 -
gatctttgttggtttaaagcct

SEQ ID NO: 120718 - DNA, 22 bp, Artificial Sequence
  Synthetic oligonucleotide; TTG chr11 5357342 5357363 5357347 5357342 -
atctttgttggtttaaagcctg

SEQ ID NO: 120719 - DNA, 22 bp, Artificial Sequence
  Synthetic oligonucleotide; CTT chr11 5357337 5357358 5357342 5357337 -
tgttggtttaaagcctgtttta

SEQ ID NO: 120720 - DNA, 22 bp, Artificial Sequence
  Synthetic oligonucleotide; TTT chr11 5357336 5357357 5357341 5357336 -
gttggtttaaagcctgttttat

SEQ ID NO: 120721 - DNA, 22 bp, Artificial Sequence
  Synthetic oligonucleotide; TTG chr11 5357335 5357356 5357340 5357335 -
ttggtttaaagcctgttttatc

SEQ ID NO: 120722 - DNA, 22 bp, Artificial Sequence
  Synthetic oligonucleotide; TTG chr11 5357332 5357353 5357337 5357332 -
gtttaaagcctgttttatcaga

SEQ ID NO: 120723 - DNA, 22 bp, Artificial Sequence
  Synthetic oligonucleotide; TTT chr11 5357328 5357349 5357333 5357328 -
aaagcctgttttatcagagatg

SEQ ID NO: 120724 - DNA, 22 bp, Artificial Sequence
  Synthetic oligonucleotide; TTA chr11 5357327 5357348 5357332 5357327 -
aagcctgttttatcagagatga

SEQ ID NO: 120725 - DNA, 22 bp, Artificial Sequence
  Synthetic oligonucleotide; CTG chr11 5357320 5357341 5357325 5357320 -
ttttatcagagatgaggattgc

SEQ ID NO: 120726 - DNA, 22 bp, Artificial Sequence
  Synthetic oligonucleotide; TTT chr11 5357317 5357338 5357322 5357317 -
tatcagagatgaggattgcaac

SEQ ID NO: 120727 - DNA, 22 bp, Artificial Sequence
  Synthetic oligonucleotide; TTT chr11 5357316 5357337 5357321 5357316 -
atcagagatgaggattgcaacc

SEQ ID NO: 120728 - DNA, 22 bp, Artificial Sequence
  Synthetic oligonucleotide; TTA chr11 5357315 5357336 5357320 5357315 -
tcagagatgaggattgcaaccc

SEQ ID NO: 120729 - DNA, 22 bp, Artificial Sequence
  Synthetic oligonucleotide; TTG chr11 5357299 5357320 5357304 5357299 -
caacccctgcctttttttgttt

SEQ ID NO: 120730 - DNA, 22 bp, Artificial Sequence
  Synthetic oligonucleotide; CTG chr11 5357290 5357311 5357295 5357290 -
cctttttttgttttccattttc

SEQ ID NO: 120731 - DNA, 22 bp, Artificial Sequence
  Synthetic oligonucleotide; CTT chr11 5357286 5357307 5357291 5357286 -
tttttgttttccattttcttgg

SEQ ID NO: 120732 - DNA, 22 bp, Artificial Sequence
  Synthetic oligonucleotide; TTT chr11 5357285 5357306 5357290 5357285 -
ttttgttttccattttcttggt

SEQ ID NO: 120733 - DNA, 22 bp, Artificial Sequence
  Synthetic oligonucleotide; TTT chr11 5357284 5357305 5357289 5357284 -
tttgttttccattttcttggta

SEQ ID NO: 120734 - DNA, 22 bp, Artificial Sequence
  Synthetic oligonucleotide; TTT chr11 5357283 5357304 5357288 5357283 -
ttgttttccattttcttggtag

SEQ ID NO: 120735 - DNA, 22 bp, Artificial Sequence
  Synthetic oligonucleotide; TTT chr11 5357282 5357303 5357287 5357282 -
tgttttccattttcttggtaga

SEQ ID NO: 120736 - DNA, 22 bp, Artificial Sequence
  Synthetic oligonucleotide; TTT chr11 5357281 5357302 5357286 5357281 -
gttttccattttcttggtagat

SEQ ID NO: 120737 - DNA, 22 bp, Artificial Sequence
  Synthetic oligonucleotide; TTG chr11 5357280 5357301 5357285 5357280 -
ttttccattttcttggtagatc

SEQ ID NO: 120738 - DNA, 22 bp, Artificial Sequence
  Synthetic oligonucleotide; TTT chr11 5357277 5357298 5357282 5357277 -
tccattttcttggtagatcttc

SEQ ID NO: 120739 - DNA, 22 bp, Artificial Sequence
  Synthetic oligonucleotide; TTT chr11 5357276 5357297 5357281 5357276 -
ccattttcttggtagatcttcc

SEQ ID NO: 120740 - DNA, 22 bp, Artificial Sequence
  Synthetic oligonucleotide; TTC chr11 5357275 5357296 5357280 5357275 -
cattttcttggtagatcttcct

SEQ ID NO: 120741 - DNA, 22 bp, Artificial Sequence
  Synthetic oligonucleotide; TTT chr11 5357270 5357291 5357275 5357270 -
tcttggtagatcttcctccatc

SEQ ID NO: 120742 - DNA, 22 bp, Artificial Sequence
  Synthetic oligonucleotide; TTT chr11 5357269 5357290 5357274 5357269 -
cttggtagatcttcctccatcc

SEQ ID NO: 120743 - DNA, 22 bp, Artificial Sequence
  Synthetic oligonucleotide; TTC chr11 5357268 5357289 5357273 5357268 -
ttggtagatcttcctccatccc

SEQ ID NO: 120744 - DNA, 22 bp, Artificial Sequence
  Synthetic oligonucleotide; CTT chr11 5357266 5357287 5357271 5357266 -
ggtagatcttcctccatccctt

SEQ ID NO: 120745 - DNA, 22 bp, Artificial Sequence
  Synthetic oligonucleotide; TTG chr11 5357265 5357286 5357270 5357265 -
gtagatcttcctccatcccttt

SEQ ID NO: 120746 - DNA, 22 bp, Artificial Sequence
  Synthetic oligonucleotide; CTT chr11 5357256 5357277 5357261 5357256 -
cctccatccctttattttgagc

SEQ ID NO: 120747 - DNA, 22 bp, Artificial Sequence
  Synthetic oligonucleotide; TTC chr11 5357255 5357276 5357260 5357255 -
ctccatccctttattttgagcc

SEQ ID NO: 120748 - DNA, 22 bp, Artificial Sequence
  Synthetic oligonucleotide; CTC chr11 5357252 5357273 5357257 5357252 -
catccctttattttgagcctat

SEQ ID NO: 120749 - DNA, 22 bp, Artificial Sequence
  Synthetic oligonucleotide; CTT chr11 5357244 5357265 5357249 5357244 -
tattttgagcctatgtgtgtgt

SEQ ID NO: 120750 - DNA, 22 bp, Artificial Sequence
  Synthetic oligonucleotide; TTT chr11 5357243 5357264 5357248 5357243 -
attttgagcctatgtgtgtgtg

SEQ ID NO: 120751 - DNA, 22 bp, Artificial Sequence
  Synthetic oligonucleotide; TTA chr11 5357242 5357263 5357247 5357242 -
ttttgagcctatgtgtgtgtgt

SEQ ID NO: 120752 - DNA, 22 bp, Artificial Sequence
  Synthetic oligonucleotide; TTT chr11 5357239 5357260 5357244 5357239 -
tgagcctatgtgtgtgtgtgca

SEQ ID NO: 120753 - DNA, 22 bp, Artificial Sequence
  Synthetic oligonucleotide; TTT chr11 5357238 5357259 5357243 5357238 -
gagcctatgtgtgtgtgtgcac

SEQ ID NO: 120754 - DNA, 22 bp, Artificial Sequence
  Synthetic oligonucleotide; TTG chr11 5357237 5357258 5357242 5357237 -
agcctatgtgtgtgtgtgcaca

SEQ ID NO: 120755 - DNA, 22 bp, Artificial Sequence
  Synthetic oligonucleotide; CTA chr11 5357231 5357252 5357236 5357231 -
tgtgtgtgtgtgcacatgagat

SEQ ID NO: 120756 - DNA, 22 bp, Artificial Sequence
  Synthetic oligonucleotide; TTT chr11 5357203 5357224 5357208 5357203 -
cctgaatacagcacactgatgg

SEQ ID NO: 120757 - DNA, 22 bp, Artificial Sequence
  Synthetic oligonucleotide; TTC chr11 5357202 5357223 5357207 5357202 -
ctgaatacagcacactgatggg

SEQ ID NO: 120758 - DNA, 22 bp, Artificial Sequence
  Synthetic oligonucleotide; CTG chr11 5357199 5357220 5357204 5357199 -
aatacagcacactgatgggtct

SEQ ID NO: 120759 - DNA, 22 bp, Artificial Sequence
  Synthetic oligonucleotide; CTG chr11 5357185 5357206 5357190 5357185 -
atgggtcttgactctttatcta

SEQ ID NO: 120760 - DNA, 22 bp, Artificial Sequence
  Synthetic oligonucleotide; CTT chr11 5357176 5357197 5357181 5357176 -
gactctttatctaatttgcccg

SEQ ID NO: 120761 - DNA, 22 bp, Artificial Sequence
  Synthetic oligonucleotide; TTG chr11 5357175 5357196 5357180 5357175 -
actctttatctaatttgcccgt

SEQ ID NO: 120762 - DNA, 22 bp, Artificial Sequence
  Synthetic oligonucleotide; CTC chr11 5357171 5357192 5357176 5357171 -
tttatctaatttgcccgtctgt

SEQ ID NO: 120763 - DNA, 22 bp, Artificial Sequence
  Synthetic oligonucleotide; CTT chr11 5357169 5357190 5357174 5357169 -
tatctaatttgcccgtctgtgt

SEQ ID NO: 120764 - DNA, 22 bp, Artificial Sequence
  Synthetic oligonucleotide; TTT chr11 5357168 5357189 5357173 5357168 -
atctaatttgcccgtctgtgtc

SEQ ID NO: 120765 - DNA, 22 bp, Artificial Sequence
  Synthetic oligonucleotide; TTA chr11 5357167 5357188 5357172 5357167 -
tctaatttgcccgtctgtgtct

SEQ ID NO: 120766 - DNA, 22 bp, Artificial Sequence
  Synthetic oligonucleotide; CTA chr11 5357163 5357184 5357168 5357163 -
atttgcccgtctgtgtcttttt

SEQ ID NO: 120767 - DNA, 22 bp, Artificial Sequence
  Synthetic oligonucleotide; TTT chr11 5357159 5357180 5357164 5357159 -
gcccgtctgtgtctttttactg

SEQ ID NO: 120768 - DNA, 22 bp, Artificial Sequence
  Synthetic oligonucleotide; TTG chr11 5357158 5357179 5357163 5357158 -
cccgtctgtgtctttttactgg

SEQ ID NO: 120769 - DNA, 22 bp, Artificial Sequence
  Synthetic oligonucleotide; CTG chr11 5357150 5357171 5357155 5357150 -
tgtctttttactggagcattta

SEQ ID NO: 120770 - DNA, 22 bp, Artificial Sequence
  Synthetic oligonucleotide; CTT chr11 5357144 5357165 5357149 5357144 -
tttactggagcatttagcccat

SEQ ID NO: 120771 - DNA, 22 bp, Artificial Sequence
  Synthetic oligonucleotide; TTT chr11 5357143 5357164 5357148 5357143 -
ttactggagcatttagcccatt

SEQ ID NO: 120772 - DNA, 22 bp, Artificial Sequence
  Synthetic oligonucleotide; TTT chr11 5357142 5357163 5357147 5357142 -
tactggagcatttagcccattt

SEQ ID NO: 120773 - DNA, 22 bp, Artificial Sequence
  Synthetic oligonucleotide; TTT chr11 5357141 5357162 5357146 5357141 -
actggagcatttagcccattta

SEQ ID NO: 120774 - DNA, 22 bp, Artificial Sequence
  Synthetic oligonucleotide; TTA chr11 5357140 5357161 5357145 5357140 -
ctggagcatttagcccatttac

SEQ ID NO: 120775 - DNA, 22 bp, Artificial Sequence
  Synthetic oligonucleotide; CTG chr11 5357137 5357158 5357142 5357137 -
gagcatttagcccatttacatt

SEQ ID NO: 120776 - DNA, 22 bp, Artificial Sequence
  Synthetic oligonucleotide; TTT chr11 5357129 5357150 5357134 5357129 -
agcccatttacattaaggttaa

SEQ ID NO: 120777 - DNA, 22 bp, Artificial Sequence
  Synthetic oligonucleotide; TTA chr11 5357128 5357149 5357133 5357128 -
gcccatttacattaaggttaat

SEQ ID NO: 120778 - DNA, 22 bp, Artificial Sequence
  Synthetic oligonucleotide; TTT chr11 5357120 5357141 5357125 5357120 -
acattaaggttaatattgttat

SEQ ID NO: 120779 - DNA, 22 bp, Artificial Sequence
  Synthetic oligonucleotide; TTA chr11 5357119 5357140 5357124 5357119 -
cattaaggttaatattgttatg

SEQ ID NO: 120780 - DNA, 22 bp, Artificial Sequence
  Synthetic oligonucleotide; TTA chr11 5357114 5357135 5357119 5357114 -
aggttaatattgttatgtgtga

SEQ ID NO: 120781 - DNA, 22 bp, Artificial Sequence
  Synthetic oligonucleotide; TTA chr11 5357108 5357129 5357113 5357108 -
atattgttatgtgtgaatttga

SEQ ID NO: 120782 - DNA, 22 bp, Artificial Sequence
  Synthetic oligonucleotide; TTG chr11 5357102 5357123 5357107 5357102 -
ttatgtgtgaatttgatcctgt

SEQ ID NO: 120783 - DNA, 22 bp, Artificial Sequence
  Synthetic oligonucleotide; TTA chr11 5357099 5357120 5357104 5357099 -
tgtgtgaatttgatcctgtcat

SEQ ID NO: 120784 - DNA, 22 bp, Artificial Sequence
  Synthetic oligonucleotide; TTT chr11 5357088 5357109 5357093 5357088 -
gatcctgtcattatgatgttag

SEQ ID NO: 120785 - DNA, 22 bp, Artificial Sequence
  Synthetic oligonucleotide; TTG chr11 5357087 5357108 5357092 5357087 -
atcctgtcattatgatgttagc

SEQ ID NO: 120786 - DNA, 22 bp, Artificial Sequence
  Synthetic oligonucleotide; CTG chr11 5357081 5357102 5357086 5357081 -
tcattatgatgttagctggtta

SEQ ID NO: 120787 - DNA, 22 bp, Artificial Sequence
  Synthetic oligonucleotide; TTA chr11 5357075 5357096 5357080 5357075 -
tgatgttagctggttattttgc

SEQ ID NO: 120788 - DNA, 22 bp, Artificial Sequence
  Synthetic oligonucleotide; TTA chr11 5357067 5357088 5357072 5357067 -
gctggttattttgctcattagt

SEQ ID NO: 120789 - DNA, 22 bp, Artificial Sequence
  Synthetic oligonucleotide; CTG chr11 5357063 5357084 5357068 5357063 -
gttattttgctcattagttgat

SEQ ID NO: 120790 - DNA, 22 bp, Artificial Sequence
  Synthetic oligonucleotide; TTA chr11 5357059 5357080 5357064 5357059 -
ttttgctcattagttgatgcag

SEQ ID NO: 120791 - DNA, 22 bp, Artificial Sequence
  Synthetic oligonucleotide; TTT chr11 5357056 5357077 5357061 5357056 -
tgctcattagttgatgcagttt

SEQ ID NO: 120792 - DNA, 22 bp, Artificial Sequence
  Synthetic oligonucleotide; TTT chr11 5357055 5357076 5357060 5357055 -
gctcattagttgatgcagtttc

SEQ ID NO: 120793 - DNA, 22 bp, Artificial Sequence
  Synthetic oligonucleotide; TTG chr11 5357054 5357075 5357059 5357054 -
ctcattagttgatgcagtttct

SEQ ID NO: 120794 - DNA, 22 bp, Artificial Sequence
  Synthetic oligonucleotide; CTC chr11 5357051 5357072 5357056 5357051 -
attagttgatgcagtttcttcc

SEQ ID NO: 120795 - DNA, 22 bp, Artificial Sequence
  Synthetic oligonucleotide; TTA chr11 5357047 5357068 5357052 5357047 -
gttgatgcagtttcttcctagc

SEQ ID NO: 120796 - DNA, 22 bp, Artificial Sequence
  Synthetic oligonucleotide; TTG chr11 5357043 5357064 5357048 5357043 -
atgcagtttcttcctagcctca

SEQ ID NO: 120797 - DNA, 22 bp, Artificial Sequence
  Synthetic oligonucleotide; TTT chr11 5357034 5357055 5357039 5357034 -
cttcctagcctcaatggtcttt

SEQ ID NO: 120798 - DNA, 22 bp, Artificial Sequence
  Synthetic oligonucleotide; TTC chr11 5357033 5357054 5357038 5357033 -
ttcctagcctcaatggtcttta

SEQ ID NO: 120799 - DNA, 22 bp, Artificial Sequence
  Synthetic oligonucleotide; CTT chr11 5357031 5357052 5357036 5357031 -
cctagcctcaatggtctttaca

SEQ ID NO: 120800 - DNA, 22 bp, Artificial Sequence
  Synthetic oligonucleotide; TTC chr11 5357030 5357051 5357035 5357030 -
ctagcctcaatggtctttacaa

SEQ ID NO: 120801 - DNA, 22 bp, Artificial Sequence
  Synthetic oligonucleotide; CTA chr11 5357027 5357048 5357032 5357027 -
gcctcaatggtctttacaattt

SEQ ID NO: 120802 - DNA, 22 bp, Artificial Sequence
  Synthetic oligonucleotide; CTC chr11 5357022 5357043 5357027 5357022 -
aatggtctttacaatttggcat

SEQ ID NO: 120803 - DNA, 22 bp, Artificial Sequence
  Synthetic oligonucleotide; CTT chr11 5357013 5357034 5357018 5357013 -
tacaatttggcatgtttttgca

SEQ ID NO: 120804 - DNA, 22 bp, Artificial Sequence
  Synthetic oligonucleotide; TTT chr11 5357012 5357033 5357017 5357012 -
acaatttggcatgtttttgcag

SEQ ID NO: 120805 - DNA, 22 bp, Artificial Sequence
  Synthetic oligonucleotide; TTA chr11 5357011 5357032 5357016 5357011 -
caatttggcatgtttttgcagt

SEQ ID NO: 120806 - DNA, 22 bp, Artificial Sequence
  Synthetic oligonucleotide; TTT chr11 5357005 5357026 5357010 5357005 -
ggcatgtttttgcagtggctgg

SEQ ID NO: 120807 - DNA, 22 bp, Artificial Sequence
  Synthetic oligonucleotide; TTG chr11 5357004 5357025 5357009 5357004 -
gcatgtttttgcagtggctggt

SEQ ID NO: 120808 - DNA, 22 bp, Artificial Sequence
  Synthetic oligonucleotide; TTT chr11 5356996 5357017 5357001 5356996 -
ttgcagtggctggtaccggttg

SEQ ID NO: 120809 - DNA, 22 bp, Artificial Sequence
  Synthetic oligonucleotide; TTT chr11 5356995 5357016 5357000 5356995 -
tgcagtggctggtaccggttgt

SEQ ID NO: 120810 - DNA, 22 bp, Artificial Sequence
  Synthetic oligonucleotide; TTT chr11 5356994 5357015 5356999 5356994 -
gcagtggctggtaccggttgtg

SEQ ID NO: 120811 - DNA, 22 bp, Artificial Sequence
  Synthetic oligonucleotide; TTG chr11 5356993 5357014 5356998 5356993 -
cagtggctggtaccggttgtgc

SEQ ID NO: 120812 - DNA, 22 bp, Artificial Sequence
  Synthetic oligonucleotide; CTG chr11 5356984 5357005 5356989 5356984 -
gtaccggttgtgcctttccata

SEQ ID NO: 120813 - DNA, 22 bp, Artificial Sequence
  Synthetic oligonucleotide; TTG chr11 5356974 5356995 5356979 5356974 -
tgcctttccatatttagtgctt

SEQ ID NO: 120814 - DNA, 22 bp, Artificial Sequence
  Synthetic oligonucleotide; CTT chr11 5356968 5356989 5356973 5356968 -
tccatatttagtgcttccttca

SEQ ID NO: 120815 - DNA, 22 bp, Artificial Sequence
  Synthetic oligonucleotide; TTT chr11 5356967 5356988 5356972 5356967 -
ccatatttagtgcttccttcag

SEQ ID NO: 120816 - DNA, 22 bp, Artificial Sequence
  Synthetic oligonucleotide; TTC chr11 5356966 5356987 5356971 5356966 -
catatttagtgcttccttcagg

SEQ ID NO: 120817 - DNA, 22 bp, Artificial Sequence
  Synthetic oligonucleotide; TTT chr11 5356959 5356980 5356964 5356959 -
agtgcttccttcaggagctctt

SEQ ID NO: 120818 - DNA, 22 bp, Artificial Sequence
  Synthetic oligonucleotide; TTA chr11 5356958 5356979 5356963 5356958 -
gtgcttccttcaggagctcttt

SEQ ID NO: 120819 - DNA, 22 bp, Artificial Sequence
  Synthetic oligonucleotide; CTT chr11 5356952 5356973 5356957 5356952 -
ccttcaggagctcttttaggtc

SEQ ID NO: 120820 - DNA, 22 bp, Artificial Sequence
  Synthetic oligonucleotide; TTC chr11 5356951 5356972 5356956 5356951 -
cttcaggagctcttttaggtca

SEQ ID NO: 120821 - DNA, 22 bp, Artificial Sequence
  Synthetic oligonucleotide; CTT chr11 5356948 5356969 5356953 5356948 -
caggagctcttttaggtcaggc

SEQ ID NO: 120822 - DNA, 22 bp, Artificial Sequence
  Synthetic oligonucleotide; TTC chr11 5356947 5356968 5356952 5356947 -
aggagctcttttaggtcaggcc

SEQ ID NO: 120823 - DNA, 22 bp, Artificial Sequence
  Synthetic oligonucleotide; CTC chr11 5356939 5356960 5356944 5356939 -
ttttaggtcaggcctggtgatg

SEQ ID NO: 120824 - DNA, 22 bp, Artificial Sequence
  Synthetic oligonucleotide; CTT chr11 5356937 5356958 5356942 5356937 -
ttaggtcaggcctggtgatgac

SEQ ID NO: 120825 - DNA, 22 bp, Artificial Sequence
  Synthetic oligonucleotide; TTT chr11 5356936 5356957 5356941 5356936 -
taggtcaggcctggtgatgaca

SEQ ID NO: 120826 - DNA, 22 bp, Artificial Sequence
  Synthetic oligonucleotide; TTT chr11 5356935 5356956 5356940 5356935 -
aggtcaggcctggtgatgacaa

SEQ ID NO: 120827 - DNA, 22 bp, Artificial Sequence
  Synthetic oligonucleotide; TTA chr11 5356934 5356955 5356939 5356934 -
ggtcaggcctggtgatgacaaa

SEQ ID NO: 120828 - DNA, 22 bp, Artificial Sequence
  Synthetic oligonucleotide; CTG chr11 5356923 5356944 5356928 5356923 -
gtgatgacaaaatctctcagca

SEQ ID NO: 120829 - DNA, 22 bp, Artificial Sequence
  Synthetic oligonucleotide; CTC chr11 5356907 5356928 5356912 5356907 -
tcagcatttgcttgtctgtaaa

SEQ ID NO: 120830 - DNA, 22 bp, Artificial Sequence
  Synthetic oligonucleotide; CTC chr11 5356905 5356926 5356910 5356905 -
agcatttgcttgtctgtaaagt

SEQ ID NO: 120831 - DNA, 22 bp, Artificial Sequence
  Synthetic oligonucleotide; TTT chr11 5356898 5356919 5356903 5356898 -
gcttgtctgtaaagtattttat

SEQ ID NO: 120832 - DNA, 22 bp, Artificial Sequence
  Synthetic oligonucleotide; TTG chr11 5356897 5356918 5356902 5356897 -
cttgtctgtaaagtattttatt

SEQ ID NO: 120833 - DNA, 22 bp, Artificial Sequence
  Synthetic oligonucleotide; CTT chr11 5356894 5356915 5356899 5356894 -
gtctgtaaagtattttatttct

SEQ ID NO: 120834 - DNA, 22 bp, Artificial Sequence
  Synthetic oligonucleotide; TTG chr11 5356893 5356914 5356898 5356893 -
tctgtaaagtattttatttctc

SEQ ID NO: 120835 - DNA, 22 bp, Artificial Sequence
  Synthetic oligonucleotide; CTG chr11 5356889 5356910 5356894 5356889 -
taaagtattttatttctccttc

SEQ ID NO: 120836 - DNA, 22 bp, Artificial Sequence
  Synthetic oligonucleotide; TTT chr11 5356879 5356900 5356884 5356879 -
tatttctccttcacttatgaag

SEQ ID NO: 120837 - DNA, 22 bp, Artificial Sequence
  Synthetic oligonucleotide; TTT chr11 5356878 5356899 5356883 5356878 -
atttctccttcacttatgaagc

SEQ ID NO: 120838 - DNA, 22 bp, Artificial Sequence
  Synthetic oligonucleotide; TTA chr11 5356877 5356898 5356882 5356877 -
tttctccttcacttatgaagct

SEQ ID NO: 120839 - DNA, 22 bp, Artificial Sequence
  Synthetic oligonucleotide; TTT chr11 5356874 5356895 5356879 5356874 -
ctccttcacttatgaagcttag

SEQ ID NO: 120840 - DNA, 22 bp, Artificial Sequence
  Synthetic oligonucleotide; TTC chr11 5356873 5356894 5356878 5356873 -
tccttcacttatgaagcttagt

SEQ ID NO: 120841 - DNA, 22 bp, Artificial Sequence
  Synthetic oligonucleotide; CTC chr11 5356871 5356892 5356876 5356871 -
cttcacttatgaagcttagttt

SEQ ID NO: 120842 - DNA, 22 bp, Artificial Sequence
  Synthetic oligonucleotide; CTT chr11 5356868 5356889 5356873 5356868 -
cacttatgaagcttagtttggc

SEQ ID NO: 120843 - DNA, 22 bp, Artificial Sequence
  Synthetic oligonucleotide; TTC chr11 5356867 5356888 5356872 5356867 -
acttatgaagcttagtttggct

SEQ ID NO: 120844 - DNA, 22 bp, Artificial Sequence
  Synthetic oligonucleotide; CTT chr11 5356863 5356884 5356868 5356863 -
atgaagcttagtttggctggat

SEQ ID NO: 120845 - DNA, 22 bp, Artificial Sequence
  Synthetic oligonucleotide; TTA chr11 5356862 5356883 5356867 5356862 -
tgaagcttagtttggctggata

SEQ ID NO: 120846 - DNA, 22 bp, Artificial Sequence
  Synthetic oligonucleotide; CTT chr11 5356854 5356875 5356859 5356854 -
agtttggctggatatgaaattc

SEQ ID NO: 120847 - DNA, 22 bp, Artificial Sequence
  Synthetic oligonucleotide; TTA chr11 5356853 5356874 5356858 5356853 -
gtttggctggatatgaaattct

SEQ ID NO: 120848 - DNA, 22 bp, Artificial Sequence
  Synthetic oligonucleotide; TTT chr11 5356849 5356870 5356854 5356849 -
ggctggatatgaaattctgtgt

SEQ ID NO: 120849 - DNA, 22 bp, Artificial Sequence
  Synthetic oligonucleotide; TTG chr11 5356848 5356869 5356853 5356848 -
gctggatatgaaattctgtgtt

SEQ ID NO: 120850 - DNA, 22 bp, Artificial Sequence
  Synthetic oligonucleotide; CTG chr11 5356844 5356865 5356849 5356844 -
gatatgaaattctgtgttgaaa

SEQ ID NO: 120851 - DNA, 22 bp, Artificial Sequence
  Synthetic oligonucleotide; TTC chr11 5356832 5356853 5356837 5356832 -
tgtgttgaaaattctttccttt

SEQ ID NO: 120852 - DNA, 22 bp, Artificial Sequence
  Synthetic oligonucleotide; CTG chr11 5356830 5356851 5356835 5356830 -
tgttgaaaattctttcctttaa

SEQ ID NO: 120853 - DNA, 22 bp, Artificial Sequence
  Synthetic oligonucleotide; TTG chr11 5356825 5356846 5356830 5356825 -
aaaattctttcctttaaggatg

SEQ ID NO: 120854 - DNA, 22 bp, Artificial Sequence
  Synthetic oligonucleotide; TTC chr11 5356818 5356839 5356823 5356818 -
tttcctttaaggatgttgaata

SEQ ID NO: 120855 - DNA, 22 bp, Artificial Sequence
  Synthetic oligonucleotide; CTT chr11 5356816 5356837 5356821 5356816 -
tcctttaaggatgttgaatatt

SEQ ID NO: 120856 - DNA, 22 bp, Artificial Sequence
  Synthetic oligonucleotide; TTT chr11 5356815 5356836 5356820 5356815 -
cctttaaggatgttgaatattg

SEQ ID NO: 120857 - DNA, 22 bp, Artificial Sequence
  Synthetic oligonucleotide; TTC chr11 5356814 5356835 5356819 5356814 -
ctttaaggatgttgaatattgg

SEQ ID NO: 120858 - DNA, 22 bp, Artificial Sequence
  Synthetic oligonucleotide; CTT chr11 5356811 5356832 5356816 5356811 -
taaggatgttgaatattggccc

SEQ ID NO: 120859 - DNA, 22 bp, Artificial Sequence
  Synthetic oligonucleotide; TTT chr11 5356810 5356831 5356815 5356810 -
aaggatgttgaatattggcccc

SEQ ID NO: 120860 - DNA, 22 bp, Artificial Sequence
  Synthetic oligonucleotide; TTA chr11 5356809 5356830 5356814 5356809 -
aggatgttgaatattggccccc

SEQ ID NO: 120861 - DNA, 22 bp, Artificial Sequence
  Synthetic oligonucleotide; TTG chr11 5356800 5356821 5356805 5356800 -
aatattggcccccactctcttc

SEQ ID NO: 120862 - DNA, 22 bp, Artificial Sequence
  Synthetic oligonucleotide; TTG chr11 5356793 5356814 5356798 5356793 -
gcccccactctcttctggcttg

SEQ ID NO: 120863 - DNA, 22 bp, Artificial Sequence
  Synthetic oligonucleotide; CTC chr11 5356783 5356804 5356788 5356783 -
tcttctggcttgtagagtttct

SEQ ID NO: 120864 - DNA, 22 bp, Artificial Sequence
  Synthetic oligonucleotide; CTC chr11 5356781 5356802 5356786 5356781 -
ttctggcttgtagagtttctgc

SEQ ID NO: 120865 - DNA, 22 bp, Artificial Sequence
  Synthetic oligonucleotide; CTT chr11 5356779 5356800 5356784 5356779 -
ctggcttgtagagtttctgctg

SEQ ID NO: 120866 - DNA, 22 bp, Artificial Sequence
  Synthetic oligonucleotide; TTC chr11 5356778 5356799 5356783 5356778 -
tggcttgtagagtttctgctga

SEQ ID NO: 120867 - DNA, 22 bp, Artificial Sequence
  Synthetic oligonucleotide; CTG chr11 5356776 5356797 5356781 5356776 -
gcttgtagagtttctgctgaga

SEQ ID NO: 120868 - DNA, 22 bp, Artificial Sequence
  Synthetic oligonucleotide; CTT chr11 5356772 5356793 5356777 5356772 -
gtagagtttctgctgagagatc

SEQ ID NO: 120869 - DNA, 22 bp, Artificial Sequence
  Synthetic oligonucleotide; TTG chr11 5356771 5356792 5356776 5356771 -
tagagtttctgctgagagatct

SEQ ID NO: 120870 - DNA, 22 bp, Artificial Sequence
  Synthetic oligonucleotide; TTT chr11 5356763 5356784 5356768 5356763 -
ctgctgagagatctgctgttat

SEQ ID NO: 120871 - DNA, 22 bp, Artificial Sequence
  Synthetic oligonucleotide; TTC chr11 5356762 5356783 5356767 5356762 -
tgctgagagatctgctgttatt

SEQ ID NO: 120872 - DNA, 22 bp, Artificial Sequence
  Synthetic oligonucleotide; CTG chr11 5356760 5356781 5356765 5356760 -
ctgagagatctgctgttattct

SEQ ID NO: 120873 - DNA, 22 bp, Artificial Sequence
  Synthetic oligonucleotide; CTG chr11 5356757 5356778 5356762 5356757 -
agagatctgctgttattctgat

SEQ ID NO: 120874 - DNA, 22 bp, Artificial Sequence
  Synthetic oligonucleotide; CTG chr11 5356748 5356769 5356753 5356748 -
ctgttattctgatgggcttccc

SEQ ID NO: 120875 - DNA, 22 bp, Artificial Sequence
  Synthetic oligonucleotide; CTG chr11 5356745 5356766 5356750 5356745 -
ttattctgatgggcttcccttt

SEQ ID NO: 120876 - DNA, 22 bp, Artificial Sequence
  Synthetic oligonucleotide; TTA chr11 5356742 5356763 5356747 5356742 -
ttctgatgggcttccctttgtg

SEQ ID NO: 120877 - DNA, 22 bp, Artificial Sequence
  Synthetic oligonucleotide; TTC chr11 5356739 5356760 5356744 5356739 -
tgatgggcttccctttgtgggt

SEQ ID NO: 120878 - DNA, 22 bp, Artificial Sequence
  Synthetic oligonucleotide; CTG chr11 5356737 5356758 5356742 5356737 -
atgggcttccctttgtgggtaa

SEQ ID NO: 120879 - DNA, 22 bp, Artificial Sequence
  Synthetic oligonucleotide; CTT chr11 5356729 5356750 5356734 5356729 -
ccctttgtgggtaacccgacct

SEQ ID NO: 120880 - DNA, 22 bp, Artificial Sequence
  Synthetic oligonucleotide; TTC chr11 5356728 5356749 5356733 5356728 -
cctttgtgggtaacccgacctt

SEQ ID NO: 120881 - DNA, 22 bp, Artificial Sequence
  Synthetic oligonucleotide; CTT chr11 5356724 5356745 5356729 5356724 -
tgtgggtaacccgacctttctc

SEQ ID NO: 120882 - DNA, 22 bp, Artificial Sequence
  Synthetic oligonucleotide; TTT chr11 5356723 5356744 5356728 5356723 -
gtgggtaacccgacctttctct

SEQ ID NO: 120883 - DNA, 22 bp, Artificial Sequence
  Synthetic oligonucleotide; TTG chr11 5356722 5356743 5356727 5356722 -
tgggtaacccgacctttctctc

SEQ ID NO: 120884 - DNA, 22 bp, Artificial Sequence
  Synthetic oligonucleotide; CTT chr11 5356706 5356727 5356711 5356706 -
tctctctggctacccttaacat

SEQ ID NO: 120885 - DNA, 22 bp, Artificial Sequence
  Synthetic oligonucleotide; TTT chr11 5356705 5356726 5356710 5356705 -
ctctctggctacccttaacatt

SEQ ID NO: 120886 - DNA, 22 bp, Artificial Sequence
  Synthetic oligonucleotide; TTC chr11 5356704 5356725 5356709 5356704 -
tctctggctacccttaacattt

SEQ ID NO: 120887 - DNA, 22 bp, Artificial Sequence
  Synthetic oligonucleotide; CTC chr11 5356702 5356723 5356707 5356702 -
tctggctacccttaacattttt

SEQ ID NO: 120888 - DNA, 22 bp, Artificial Sequence
  Synthetic oligonucleotide; CTC chr11 5356700 5356721 5356705 5356700 -
tggctacccttaacatttttcc

SEQ ID NO: 120889 - DNA, 22 bp, Artificial Sequence
  Synthetic oligonucleotide; CTG chr11 5356698 5356719 5356703 5356698 -
gctacccttaacatttttccct

SEQ ID NO: 120890 - DNA, 22 bp, Artificial Sequence
  Synthetic oligonucleotide; CTA chr11 5356694 5356715 5356699 5356694 -
cccttaacatttttcccttcat

SEQ ID NO: 120891 - DNA, 22 bp, Artificial Sequence
  Synthetic oligonucleotide; CTT chr11 5356689 5356710 5356694 5356689 -
aacatttttcccttcatttcaa

SEQ ID NO: 120892 - DNA, 22 bp, Artificial Sequence
  Synthetic oligonucleotide; TTA chr11 5356688 5356709 5356693 5356688 -
acatttttcccttcatttcaac

SEQ ID NO: 120893 - DNA, 22 bp, Artificial Sequence
  Synthetic oligonucleotide; TTT chr11 5356682 5356703 5356687 5356682 -
ttcccttcatttcaactttggt

SEQ ID NO: 120894 - DNA, 22 bp, Artificial Sequence
  Synthetic oligonucleotide; TTT chr11 5356681 5356702 5356686 5356681 -
tcccttcatttcaactttggtg

SEQ ID NO: 120895 - DNA, 22 bp, Artificial Sequence
  Synthetic oligonucleotide; TTT chr11 5356680 5356701 5356685 5356680 -
cccttcatttcaactttggtga

SEQ ID NO: 120896 - DNA, 22 bp, Artificial Sequence
  Synthetic oligonucleotide; TTC chr11 5356679 5356700 5356684 5356679 -
ccttcatttcaactttggtgaa

SEQ ID NO: 120897 - DNA, 22 bp, Artificial Sequence
  Synthetic oligonucleotide; CTT chr11 5356675 5356696 5356680 5356675 -
catttcaactttggtgaatctg

SEQ ID NO: 120898 - DNA, 22 bp, Artificial Sequence
  Synthetic oligonucleotide; TTC chr11 5356674 5356695 5356679 5356674 -
atttcaactttggtgaatctga

SEQ ID NO: 120899 - DNA, 22 bp, Artificial Sequence
  Synthetic oligonucleotide; TTT chr11 5356670 5356691 5356675 5356670 -
caactttggtgaatctgacaat

SEQ ID NO: 120900 - DNA, 22 bp, Artificial Sequence
  Synthetic oligonucleotide; TTC chr11 5356669 5356690 5356674 5356669 -
aactttggtgaatctgacaatt

SEQ ID NO: 120901 - DNA, 22 bp, Artificial Sequence
  Synthetic oligonucleotide; CTT chr11 5356664 5356685 5356669 5356664 -
tggtgaatctgacaattatgtg

SEQ ID NO: 120902 - DNA, 22 bp, Artificial Sequence
  Synthetic oligonucleotide; TTT chr11 5356663 5356684 5356668 5356663 -
ggtgaatctgacaattatgtgc

SEQ ID NO: 120903 - DNA, 22 bp, Artificial Sequence
  Synthetic oligonucleotide; TTG chr11 5356662 5356683 5356667 5356662 -
gtgaatctgacaattatgtgcc

SEQ ID NO: 120904 - DNA, 22 bp, Artificial Sequence
  Synthetic oligonucleotide; CTG chr11 5356653 5356674 5356658 5356653 -
acaattatgtgccttgtagttg

SEQ ID NO: 120905 - DNA, 22 bp, Artificial Sequence
  Synthetic oligonucleotide; TTA chr11 5356646 5356667 5356651 5356646 -
tgtgccttgtagttgctcttct

SEQ ID NO: 120906 - DNA, 22 bp, Artificial Sequence
  Synthetic oligonucleotide; CTT chr11 5356638 5356659 5356643 5356638 -
gtagttgctcttctcaaggagt

SEQ ID NO: 120907 - DNA, 22 bp, Artificial Sequence
  Synthetic oligonucleotide; TTG chr11 5356637 5356658 5356642 5356637 -
tagttgctcttctcaaggagta

SEQ ID NO: 120908 - DNA, 22 bp, Artificial Sequence
  Synthetic oligonucleotide; TTG chr11 5356631 5356652 5356636 5356631 -
ctcttctcaaggagtatctttg

SEQ ID NO: 120909 - DNA, 22 bp, Artificial Sequence
  Synthetic oligonucleotide; CTC chr11 5356628 5356649 5356633 5356628 -
ttctcaaggagtatctttgtgg

SEQ ID NO: 120910 - DNA, 22 bp, Artificial Sequence
  Synthetic oligonucleotide; CTT chr11 5356626 5356647 5356631 5356626 -
ctcaaggagtatctttgtggcg

SEQ ID NO: 120911 - DNA, 22 bp, Artificial Sequence
  Synthetic oligonucleotide; TTC chr11 5356625 5356646 5356630 5356625 -
tcaaggagtatctttgtggcgt

SEQ ID NO: 120912 - DNA, 22 bp, Artificial Sequence
  Synthetic oligonucleotide; CTC chr11 5356623 5356644 5356628 5356623 -
aaggagtatctttgtggcgttc

SEQ ID NO: 120913 - DNA, 22 bp, Artificial Sequence
  Synthetic oligonucleotide; CTT chr11 5356611 5356632 5356616 5356611 -
tgtggcgttctctgtatttcct

SEQ ID NO: 120914 - DNA, 22 bp, Artificial Sequence
  Synthetic oligonucleotide; TTT chr11 5356610 5356631 5356615 5356610 -
gtggcgttctctgtatttcctg

SEQ ID NO: 120915 - DNA, 22 bp, Artificial Sequence
  Synthetic oligonucleotide; TTG chr11 5356609 5356630 5356614 5356609 -
tggcgttctctgtatttcctga

SEQ ID NO: 120916 - DNA, 22 bp, Artificial Sequence
  Synthetic oligonucleotide; TTC chr11 5356601 5356622 5356606 5356601 -
tctgtatttcctgaatttgaat

SEQ ID NO: 120917 - DNA, 22 bp, Artificial Sequence
  Synthetic oligonucleotide; CTC chr11 5356599 5356620 5356604 5356599 -
tgtatttcctgaatttgaatgt

SEQ ID NO: 120918 - DNA, 22 bp, Artificial Sequence
  Synthetic oligonucleotide; CTG chr11 5356597 5356618 5356602 5356597 -
tatttcctgaatttgaatgttg

SEQ ID NO: 120919 - DNA, 22 bp, Artificial Sequence
  Synthetic oligonucleotide; TTT chr11 5356592 5356613 5356597 5356592 -
cctgaatttgaatgttgacctg

SEQ ID NO: 120920 - DNA, 22 bp, Artificial Sequence
  Synthetic oligonucleotide; TTC chr11 5356591 5356612 5356596 5356591 -
ctgaatttgaatgttgacctgc

SEQ ID NO: 120921 - DNA, 22 bp, Artificial Sequence
  Synthetic oligonucleotide; CTG chr11 5356588 5356609 5356593 5356588 -
aatttgaatgttgacctgcctt

SEQ ID NO: 120922 - DNA, 22 bp, Artificial Sequence
  Synthetic oligonucleotide; TTT chr11 5356583 5356604 5356588 5356583 -
gaatgttgacctgccttgctag

SEQ ID NO: 120923 - DNA, 22 bp, Artificial Sequence
  Synthetic oligonucleotide; TTG chr11 5356582 5356603 5356587 5356582 -
aatgttgacctgccttgctaga

SEQ ID NO: 120924 - DNA, 22 bp, Artificial Sequence
  Synthetic oligonucleotide; TTG chr11 5356575 5356596 5356580 5356575 -
acctgccttgctagattgggga

SEQ ID NO: 120925 - DNA, 22 bp, Artificial Sequence
  Synthetic oligonucleotide; CTG chr11 5356570 5356591 5356575 5356570 -
ccttgctagattggggaagttc

SEQ ID NO: 120926 - DNA, 22 bp, Artificial Sequence
  Synthetic oligonucleotide; CTT chr11 5356566 5356587 5356571 5356566 -
gctagattggggaagttctcct

SEQ ID NO: 120927 - DNA, 22 bp, Artificial Sequence
  Synthetic oligonucleotide; TTG chr11 5356565 5356586 5356570 5356565 -
ctagattggggaagttctcctg

SEQ ID NO: 120928 - DNA, 22 bp, Artificial Sequence
  Synthetic oligonucleotide; CTA chr11 5356562 5356583 5356567 5356562 -
gattggggaagttctcctggat

SEQ ID NO: 120929 - DNA, 22 bp, Artificial Sequence
  Synthetic oligonucleotide; TTG chr11 5356557 5356578 5356562 5356557 -
gggaagttctcctggataatat

SEQ ID NO: 120930 - DNA, 22 bp, Artificial Sequence
  Synthetic oligonucleotide; TTC chr11 5356548 5356569 5356553 5356548 -
tcctggataatatcctgcagag

SEQ ID NO: 120931 - DNA, 22 bp, Artificial Sequence
  Synthetic oligonucleotide; CTC chr11 5356546 5356567 5356551 5356546 -
ctggataatatcctgcagagtg

SEQ ID NO: 120932 - DNA, 22 bp, Artificial Sequence
  Synthetic oligonucleotide; CTG chr11 5356543 5356564 5356548 5356543 -
gataatatcctgcagagtgttt

SEQ ID NO: 120933 - DNA, 22 bp, Artificial Sequence
  Synthetic oligonucleotide; CTG chr11 5356531 5356552 5356536 5356531 -
cagagtgttttccaacttggtt

SEQ ID NO: 120934 - DNA, 22 bp, Artificial Sequence
  Synthetic oligonucleotide; TTT chr11 5356521 5356542 5356526 5356521 -
tccaacttggttccattctgcc

SEQ ID NO: 120935 - DNA, 22 bp, Artificial Sequence
  Synthetic oligonucleotide; TTT chr11 5356520 5356541 5356525 5356520 -
ccaacttggttccattctgccc

SEQ ID NO: 120936 - DNA, 22 bp, Artificial Sequence
  Synthetic oligonucleotide; TTC chr11 5356519 5356540 5356524 5356519 -
caacttggttccattctgcccg

SEQ ID NO: 120937 - DNA, 22 bp, Artificial Sequence
  Synthetic oligonucleotide; CTT chr11 5356513 5356534 5356518 5356513 -
ggttccattctgcccgtcactt

SEQ ID NO: 120938 - DNA, 22 bp, Artificial Sequence
  Synthetic oligonucleotide; TTG chr11 5356512 5356533 5356517 5356512 -
gttccattctgcccgtcacttt

SEQ ID NO: 120939 - DNA, 22 bp, Artificial Sequence
  Synthetic oligonucleotide; TTC chr11 5356508 5356529 5356513 5356508 -
cattctgcccgtcactttcagg

SEQ ID NO: 120940 - DNA, 22 bp, Artificial Sequence
  Synthetic oligonucleotide; TTC chr11 5356503 5356524 5356508 5356503 -
tgcccgtcactttcaggtacac

SEQ ID NO: 120941 - DNA, 22 bp, Artificial Sequence
  Synthetic oligonucleotide; CTG chr11 5356501 5356522 5356506 5356501 -
cccgtcactttcaggtacacca

SEQ ID NO: 120942 - DNA, 22 bp, Artificial Sequence
  Synthetic oligonucleotide; CTT chr11 5356491 5356512 5356496 5356491 -
tcaggtacaccaatcagatata

SEQ ID NO: 120943 - DNA, 22 bp, Artificial Sequence
  Synthetic oligonucleotide; TTT chr11 5356490 5356511 5356495 5356490 -
caggtacaccaatcagatatag

SEQ ID NO: 120944 - DNA, 22 bp, Artificial Sequence
  Synthetic oligonucleotide; TTC chr11 5356489 5356510 5356494 5356489 -
aggtacaccaatcagatataga

SEQ ID NO: 120945 - DNA, 22 bp, Artificial Sequence
  Synthetic oligonucleotide; TTT chr11 5356464 5356485 5356469 5356464 -
ggtcttttcacatagtcccata

SEQ ID NO: 120946 - DNA, 22 bp, Artificial Sequence
  Synthetic oligonucleotide; TTG chr11 5356463 5356484 5356468 5356463 -
gtcttttcacatagtcccatat

SEQ ID NO: 120947 - DNA, 22 bp, Artificial Sequence
  Synthetic oligonucleotide; CTT chr11 5356458 5356479 5356463 5356458 -
ttcacatagtcccatatttctt

SEQ ID NO: 120948 - DNA, 22 bp, Artificial Sequence
  Synthetic oligonucleotide; TTT chr11 5356457 5356478 5356462 5356457 -
tcacatagtcccatatttcttg

SEQ ID NO: 120949 - DNA, 22 bp, Artificial Sequence
  Synthetic oligonucleotide; TTT chr11 5356456 5356477 5356461 5356456 -
cacatagtcccatatttcttgg

SEQ ID NO: 120950 - DNA, 22 bp, Artificial Sequence
  Synthetic oligonucleotide; TTC chr11 5356455 5356476 5356460 5356455 -
acatagtcccatatttcttgga

SEQ ID NO: 120951 - DNA, 22 bp, Artificial Sequence
  Synthetic oligonucleotide; TTT chr11 5356439 5356460 5356444 5356439 -
cttggaggctttgttcatttct

SEQ ID NO: 120952 - DNA, 22 bp, Artificial Sequence
  Synthetic oligonucleotide; TTC chr11 5356438 5356459 5356443 5356438 -
ttggaggctttgttcatttctt

SEQ ID NO: 120953 - DNA, 22 bp, Artificial Sequence
  Synthetic oligonucleotide; CTT chr11 5356436 5356457 5356441 5356436 -
ggaggctttgttcatttctttt

SEQ ID NO: 120954 - DNA, 22 bp, Artificial Sequence
  Synthetic oligonucleotide; TTG chr11 5356435 5356456 5356440 5356435 -
gaggctttgttcatttcttttt

SEQ ID NO: 120955 - DNA, 22 bp, Artificial Sequence
  Synthetic oligonucleotide; CTT chr11 5356428 5356449 5356433 5356428 -
tgttcatttctttttattcttt

SEQ ID NO: 120956 - DNA, 22 bp, Artificial Sequence
  Synthetic oligonucleotide; TTT chr11 5356427 5356448 5356432 5356427 -
gttcatttctttttattctttt

SEQ ID NO: 120957 - DNA, 22 bp, Artificial Sequence
  Synthetic oligonucleotide; TTG chr11 5356426 5356447 5356431 5356426 -
ttcatttctttttattcttttt

SEQ ID NO: 120958 - DNA, 22 bp, Artificial Sequence
  Synthetic oligonucleotide; TTC chr11 5356423 5356444 5356428 5356423 -
atttctttttattcttttttct

SEQ ID NO: 120959 - DNA, 22 bp, Artificial Sequence
  Synthetic oligonucleotide; TTT chr11 5356419 5356440 5356424 5356419 -
ctttttattcttttttctctaa

SEQ ID NO: 120960 - DNA, 22 bp, Artificial Sequence
  Synthetic oligonucleotide; TTC chr11 5356418 5356439 5356423 5356418 -
tttttattcttttttctctaaa

SEQ ID NO: 120961 - DNA, 22 bp, Artificial Sequence
  Synthetic oligonucleotide; CTT chr11 5356416 5356437 5356421 5356416 -
tttattcttttttctctaaact

SEQ ID NO: 120962 - DNA, 22 bp, Artificial Sequence
  Synthetic oligonucleotide; TTT chr11 5356415 5356436 5356420 5356415 -
ttattcttttttctctaaactt

SEQ ID NO: 120963 - DNA, 22 bp, Artificial Sequence
  Synthetic oligonucleotide; TTT chr11 5356414 5356435 5356419 5356414 -
tattcttttttctctaaacttc

SEQ ID NO: 120964 - DNA, 22 bp, Artificial Sequence
  Synthetic oligonucleotide; TTT chr11 5356413 5356434 5356418 5356413 -
attcttttttctctaaacttct

SEQ ID NO: 120965 - DNA, 22 bp, Artificial Sequence
  Synthetic oligonucleotide; TTA chr11 5356412 5356433 5356417 5356412 -
ttcttttttctctaaacttctc

SEQ ID NO: 120966 - DNA, 22 bp, Artificial Sequence
  Synthetic oligonucleotide; TTC chr11 5356409 5356430 5356414 5356409 -
ttttttctctaaacttctcttc

SEQ ID NO: 120967 - DNA, 22 bp, Artificial Sequence
  Synthetic oligonucleotide; CTT chr11 5356407 5356428 5356412 5356407 -
ttttctctaaacttctcttctt

SEQ ID NO: 120968 - DNA, 22 bp, Artificial Sequence
  Synthetic oligonucleotide; TTT chr11 5356406 5356427 5356411 5356406 -
tttctctaaacttctcttcttg

SEQ ID NO: 120969 - DNA, 22 bp, Artificial Sequence
  Synthetic oligonucleotide; TTT chr11 5356405 5356426 5356410 5356405 -
ttctctaaacttctcttcttgc

SEQ ID NO: 120970 - DNA, 22 bp, Artificial Sequence
  Synthetic oligonucleotide; TTT chr11 5356404 5356425 5356409 5356404 -
tctctaaacttctcttcttgct

SEQ ID NO: 120971 - DNA, 22 bp, Artificial Sequence
  Synthetic oligonucleotide; TTT chr11 5356403 5356424 5356408 5356403 -
ctctaaacttctcttcttgctt

SEQ ID NO: 120972 - DNA, 22 bp, Artificial Sequence
  Synthetic oligonucleotide; TTC chr11 5356402 5356423 5356407 5356402 -
tctaaacttctcttcttgcttc

SEQ ID NO: 120973 - DNA, 22 bp, Artificial Sequence
  Synthetic oligonucleotide; CTC chr11 5356400 5356421 5356405 5356400 -
taaacttctcttcttgcttcat

SEQ ID NO: 120974 - DNA, 22 bp, Artificial Sequence
  Synthetic oligonucleotide; CTA chr11 5356398 5356419 5356403 5356398 -
aacttctcttcttgcttcattt

SEQ ID NO: 120975 - DNA, 22 bp, Artificial Sequence
  Synthetic oligonucleotide; CTT chr11 5356393 5356414 5356398 5356393 -
ctcttcttgcttcatttcattc

SEQ ID NO: 120976 - DNA, 22 bp, Artificial Sequence
  Synthetic oligonucleotide; TTC chr11 5356392 5356413 5356397 5356392 -
tcttcttgcttcatttcattca

SEQ ID NO: 120977 - DNA, 22 bp, Artificial Sequence
  Synthetic oligonucleotide; CTC chr11 5356390 5356411 5356395 5356390 -
ttcttgcttcatttcattcatt

SEQ ID NO: 120978 - DNA, 22 bp, Artificial Sequence
  Synthetic oligonucleotide; CTT chr11 5356388 5356409 5356393 5356388 -
cttgcttcatttcattcatttg

SEQ ID NO: 120979 - DNA, 22 bp, Artificial Sequence
  Synthetic oligonucleotide; TTC chr11 5356387 5356408 5356392 5356387 -
ttgcttcatttcattcatttga

SEQ ID NO: 120980 - DNA, 22 bp, Artificial Sequence
  Synthetic oligonucleotide; CTT chr11 5356385 5356406 5356390 5356385 -
gcttcatttcattcatttgatc

SEQ ID NO: 120981 - DNA, 22 bp, Artificial Sequence
  Synthetic oligonucleotide; TTG chr11 5356384 5356405 5356389 5356384 -
cttcatttcattcatttgatct

SEQ ID NO: 120982 - DNA, 22 bp, Artificial Sequence
  Synthetic oligonucleotide; CTT chr11 5356381 5356402 5356386 5356381 -
catttcattcatttgatcttcc

SEQ ID NO: 120983 - DNA, 22 bp, Artificial Sequence
  Synthetic oligonucleotide; TTC chr11 5356380 5356401 5356385 5356380 -
atttcattcatttgatcttcca

SEQ ID NO: 120984 - DNA, 22 bp, Artificial Sequence
  Synthetic oligonucleotide; TTT chr11 5356376 5356397 5356381 5356376 -
cattcatttgatcttccatcac

SEQ ID NO: 120985 - DNA, 22 bp, Artificial Sequence
  Synthetic oligonucleotide; TTC chr11 5356375 5356396 5356380 5356375 -
attcatttgatcttccatcact

SEQ ID NO: 120986 - DNA, 22 bp, Artificial Sequence
  Synthetic oligonucleotide; TTC chr11 5356371 5356392 5356376 5356371 -
atttgatcttccatcactgata

SEQ ID NO: 120987 - DNA, 22 bp, Artificial Sequence
  Synthetic oligonucleotide; TTT chr11 5356367 5356388 5356372 5356367 -
gatcttccatcactgataccct

SEQ ID NO: 120988 - DNA, 22 bp, Artificial Sequence
  Synthetic oligonucleotide; TTG chr11 5356366 5356387 5356371 5356366 -
atcttccatcactgataccctt

SEQ ID NO: 120989 - DNA, 22 bp, Artificial Sequence
  Synthetic oligonucleotide; CTT chr11 5356361 5356382 5356366 5356361 -
ccatcactgataccctttcttc

SEQ ID NO: 120990 - DNA, 22 bp, Artificial Sequence
  Synthetic oligonucleotide; TTC chr11 5356360 5356381 5356365 5356360 -
catcactgataccctttcttcc

SEQ ID NO: 120991 - DNA, 22 bp, Artificial Sequence
  Synthetic oligonucleotide; CTG chr11 5356352 5356373 5356357 5356352 -
ataccctttcttccagttgatc

SEQ ID NO: 120992 - DNA, 22 bp, Artificial Sequence
  Synthetic oligonucleotide; CTT chr11 5356344 5356365 5356349 5356344 -
tcttccagttgatcgaatcagc

SEQ ID NO: 120993 - DNA, 22 bp, Artificial Sequence
  Synthetic oligonucleotide; TTT chr11 5356343 5356364 5356348 5356343 -
cttccagttgatcgaatcagct

SEQ ID NO: 120994 - DNA, 22 bp, Artificial Sequence
  Synthetic oligonucleotide; TTC chr11 5356342 5356363 5356347 5356342 -
ttccagttgatcgaatcagcta

SEQ ID NO: 120995 - DNA, 22 bp, Artificial Sequence
  Synthetic oligonucleotide; CTT chr11 5356340 5356361 5356345 5356340 -
ccagttgatcgaatcagctact

SEQ ID NO: 120996 - DNA, 22 bp, Artificial Sequence
  Synthetic oligonucleotide; TTC chr11 5356339 5356360 5356344 5356339 -
cagttgatcgaatcagctactg

SEQ ID NO: 120997 - DNA, 22 bp, Artificial Sequence
  Synthetic oligonucleotide; TTG chr11 5356333 5356354 5356338 5356333 -
atcgaatcagctactgagtctt

SEQ ID NO: 120998 - DNA, 22 bp, Artificial Sequence
  Synthetic oligonucleotide; CTA chr11 5356320 5356341 5356325 5356320 -
ctgagtcttgtgcattcatcat

SEQ ID NO: 120999 - DNA, 22 bp, Artificial Sequence
  Synthetic oligonucleotide; CTG chr11 5356317 5356338 5356322 5356317 -
agtcttgtgcattcatcatgta

SEQ ID NO: 121000 - DNA, 22 bp, Artificial Sequence
  Synthetic oligonucleotide; CTT chr11 5356311 5356332 5356316 5356311 -
gtgcattcatcatgtagttctc

SEQ ID NO: 121001 - DNA, 22 bp, Artificial Sequence
  Synthetic oligonucleotide; TTG chr11 5356310 5356331 5356315 5356310 -
tgcattcatcatgtagttctca

SEQ ID NO: 121002 - DNA, 22 bp, Artificial Sequence
  Synthetic oligonucleotide; TTC chr11 5356303 5356324 5356308 5356303 -
atcatgtagttctcatgccttg

SEQ ID NO: 121003 - DNA, 22 bp, Artificial Sequence
  Synthetic oligonucleotide; TTC chr11 5356291 5356312 5356296 5356291 -
tcatgccttggttttcagctcc

SEQ ID NO: 121004 - DNA, 22 bp, Artificial Sequence
  Synthetic oligonucleotide; CTC chr11 5356289 5356310 5356294 5356289 -
atgccttggttttcagctccat

SEQ ID NO: 121005 - DNA, 22 bp, Artificial Sequence
  Synthetic oligonucleotide; CTT chr11 5356282 5356303 5356287 5356282 -
ggttttcagctccatcaggtcc

SEQ ID NO: 121006 - DNA, 22 bp, Artificial Sequence
  Synthetic oligonucleotide; TTG chr11 5356281 5356302 5356286 5356281 -
gttttcagctccatcaggtcct

SEQ ID NO: 121007 - DNA, 22 bp, Artificial Sequence
  Synthetic oligonucleotide; TTT chr11 5356277 5356298 5356282 5356277 -
tcagctccatcaggtcctttaa

SEQ ID NO: 121008 - DNA, 22 bp, Artificial Sequence
  Synthetic oligonucleotide; TTT chr11 5356276 5356297 5356281 5356276 -
cagctccatcaggtcctttaag

SEQ ID NO: 121009 - DNA, 22 bp, Artificial Sequence
  Synthetic oligonucleotide; TTC chr11 5356275 5356296 5356280 5356275 -
agctccatcaggtcctttaagg

SEQ ID NO: 121010 - DNA, 22 bp, Artificial Sequence
  Synthetic oligonucleotide; CTC chr11 5356270 5356291 5356275 5356270 -
catcaggtcctttaaggacttc

SEQ ID NO: 121011 - DNA, 22 bp, Artificial Sequence
  Synthetic oligonucleotide; CTT chr11 5356258 5356279 5356263 5356258 -
taaggacttctctgtattggtt

SEQ ID NO: 121012 - DNA, 22 bp, Artificial Sequence
  Synthetic oligonucleotide; TTT chr11 5356257 5356278 5356262 5356257 -
aaggacttctctgtattggtta

SEQ ID NO: 121013 - DNA, 22 bp, Artificial Sequence
  Synthetic oligonucleotide; TTA chr11 5356256 5356277 5356261 5356256 -
aggacttctctgtattggttat

SEQ ID NO: 121014 - DNA, 22 bp, Artificial Sequence
  Synthetic oligonucleotide; CTT chr11 5356249 5356270 5356254 5356249 -
ctctgtattggttattctagtt

SEQ ID NO: 121015 - DNA, 22 bp, Artificial Sequence
  Synthetic oligonucleotide; TTC chr11 5356248 5356269 5356253 5356248 -
tctgtattggttattctagtta

SEQ ID NO: 121016 - DNA, 22 bp, Artificial Sequence
  Synthetic oligonucleotide; CTC chr11 5356246 5356267 5356251 5356246 -
tgtattggttattctagttagc

SEQ ID NO: 121017 - DNA, 22 bp, Artificial Sequence
  Synthetic oligonucleotide; CTG chr11 5356244 5356265 5356249 5356244 -
tattggttattctagttagcca

SEQ ID NO: 121018 - DNA, 22 bp, Artificial Sequence
  Synthetic oligonucleotide; TTG chr11 5356239 5356260 5356244 5356239 -
gttattctagttagccattagt

SEQ ID NO: 121019 - DNA, 22 bp, Artificial Sequence
  Synthetic oligonucleotide; TTA chr11 5356235 5356256 5356240 5356235 -
ttctagttagccattagtctaa

SEQ ID NO: 121020 - DNA, 22 bp, Artificial Sequence
  Synthetic oligonucleotide; TTC chr11 5356232 5356253 5356237 5356232 -
tagttagccattagtctaattt

SEQ ID NO: 121021 - DNA, 22 bp, Artificial Sequence
  Synthetic oligonucleotide; CTA chr11 5356230 5356251 5356235 5356230 -
gttagccattagtctaatttat

SEQ ID NO: 121022 - DNA, 22 bp, Artificial Sequence
  Synthetic oligonucleotide; TTA chr11 5356226 5356247 5356231 5356226 -
gccattagtctaatttattttc

SEQ ID NO: 121023 - DNA, 22 bp, Artificial Sequence
  Synthetic oligonucleotide; TTA chr11 5356219 5356240 5356224 5356219 -
gtctaatttattttcaaggttt

SEQ ID NO: 121024 - DNA, 22 bp, Artificial Sequence
  Synthetic oligonucleotide; CTA chr11 5356214 5356235 5356219 5356214 -
atttattttcaaggtttttaac

SEQ ID NO: 121025 - DNA, 22 bp, Artificial Sequence
  Synthetic oligonucleotide; TTT chr11 5356210 5356231 5356215 5356210 -
attttcaaggtttttaactttt

SEQ ID NO: 121026 - DNA, 22 bp, Artificial Sequence
  Synthetic oligonucleotide; TTA chr11 5356209 5356230 5356214 5356209 -
ttttcaaggtttttaacttttt

SEQ ID NO: 121027 - DNA, 22 bp, Artificial Sequence
  Synthetic oligonucleotide; TTT chr11 5356206 5356227 5356211 5356206 -
tcaaggtttttaacttttttgc

SEQ ID NO: 121028 - DNA, 22 bp, Artificial Sequence
  Synthetic oligonucleotide; TTT chr11 5356205 5356226 5356210 5356205 -
caaggtttttaacttttttgcc

SEQ ID NO: 121029 - DNA, 22 bp, Artificial Sequence
  Synthetic oligonucleotide; TTC chr11 5356204 5356225 5356209 5356204 -
aaggtttttaacttttttgcca

SEQ ID NO: 121030 - DNA, 22 bp, Artificial Sequence
  Synthetic oligonucleotide; TTT chr11 5356197 5356218 5356202 5356197 -
ttaacttttttgccatgggttc

SEQ ID NO: 121031 - DNA, 22 bp, Artificial Sequence
  Synthetic oligonucleotide; TTT chr11 5356196 5356217 5356201 5356196 -
taacttttttgccatgggttcg

SEQ ID NO: 121032 - DNA, 22 bp, Artificial Sequence
  Synthetic oligonucleotide; TTT chr11 5356195 5356216 5356200 5356195 -
aacttttttgccatgggttcga

SEQ ID NO: 121033 - DNA, 22 bp, Artificial Sequence
  Synthetic oligonucleotide; TTA chr11 5356194 5356215 5356199 5356194 -
acttttttgccatgggttcgag

SEQ ID NO: 121034 - DNA, 22 bp, Artificial Sequence
  Synthetic oligonucleotide; CTT chr11 5356190 5356211 5356195 5356190 -
ttttgccatgggttcgagcttc

SEQ ID NO: 121035 - DNA, 22 bp, Artificial Sequence
  Synthetic oligonucleotide; TTT chr11 5356189 5356210 5356194 5356189 -
tttgccatgggttcgagcttcc

SEQ ID NO: 121036 - DNA, 22 bp, Artificial Sequence
  Synthetic oligonucleotide; TTT chr11 5356188 5356209 5356193 5356188 -
ttgccatgggttcgagcttcct

SEQ ID NO: 121037 - DNA, 22 bp, Artificial Sequence
  Synthetic oligonucleotide; TTT chr11 5356187 5356208 5356192 5356187 -
tgccatgggttcgagcttcctc

SEQ ID NO: 121038 - DNA, 22 bp, Artificial Sequence
  Synthetic oligonucleotide; TTT chr11 5356186 5356207 5356191 5356186 -
gccatgggttcgagcttcctcc

SEQ ID NO: 121039 - DNA, 22 bp, Artificial Sequence
  Synthetic oligonucleotide; TTG chr11 5356185 5356206 5356190 5356185 -
ccatgggttcgagcttcctcct

SEQ ID NO: 121040 - DNA, 22 bp, Artificial Sequence
  Synthetic oligonucleotide; TTC chr11 5356175 5356196 5356180 5356175 -
gagcttcctcctttagctcgga

SEQ ID NO: 121041 - DNA, 22 bp, Artificial Sequence
  Synthetic oligonucleotide; CTT chr11 5356169 5356190 5356174 5356169 -
cctcctttagctcggagtagtt

SEQ ID NO: 121042 - DNA, 22 bp, Artificial Sequence
  Synthetic oligonucleotide; TTC chr11 5356168 5356189 5356173 5356168 -
ctcctttagctcggagtagttt

SEQ ID NO: 121043 - DNA, 22 bp, Artificial Sequence
  Synthetic oligonucleotide; CTC chr11 5356165 5356186 5356170 5356165 -
ctttagctcggagtagtttgat

SEQ ID NO: 121044 - DNA, 22 bp, Artificial Sequence
  Synthetic oligonucleotide; CTT chr11 5356162 5356183 5356167 5356162 -
tagctcggagtagtttgatcgt

SEQ ID NO: 121045 - DNA, 22 bp, Artificial Sequence
  Synthetic oligonucleotide; TTT chr11 5356161 5356182 5356166 5356161 -
agctcggagtagtttgatcgtc

SEQ ID NO: 121046 - DNA, 22 bp, Artificial Sequence
  Synthetic oligonucleotide; TTA chr11 5356160 5356181 5356165 5356160 -
gctcggagtagtttgatcgtct

SEQ ID NO: 121047 - DNA, 22 bp, Artificial Sequence
  Synthetic oligonucleotide; CTC chr11 5356156 5356177 5356161 5356156 -
ggagtagtttgatcgtctgaag

SEQ ID NO: 121048 - DNA, 22 bp, Artificial Sequence
  Synthetic oligonucleotide; TTT chr11 5356146 5356167 5356151 5356146 -
gatcgtctgaagccttcttctc

SEQ ID NO: 121049 - DNA, 22 bp, Artificial Sequence
  Synthetic oligonucleotide; TTG chr11 5356145 5356166 5356150 5356145 -
atcgtctgaagccttcttctct

SEQ ID NO: 121050 - DNA, 22 bp, Artificial Sequence
  Synthetic oligonucleotide; CTG chr11 5356137 5356158 5356142 5356137 -
aagccttcttctctcaacttgt

SEQ ID NO: 121051 - DNA, 22 bp, Artificial Sequence
  Synthetic oligonucleotide; CTT chr11 5356130 5356151 5356135 5356130 -
cttctctcaacttgtcaaagtc

SEQ ID NO: 121052 - DNA, 22 bp, Artificial Sequence
  Synthetic oligonucleotide; TTC chr11 5356129 5356150 5356134 5356129 -
ttctctcaacttgtcaaagtca

SEQ ID NO: 121053 - DNA, 22 bp, Artificial Sequence
  Synthetic oligonucleotide; CTT chr11 5356127 5356148 5356132 5356127 -
ctctcaacttgtcaaagtcatt

SEQ ID NO: 121054 - DNA, 22 bp, Artificial Sequence
  Synthetic oligonucleotide; TTC chr11 5356126 5356147 5356131 5356126 -
tctcaacttgtcaaagtcattc

SEQ ID NO: 121055 - DNA, 22 bp, Artificial Sequence
  Synthetic oligonucleotide; CTC chr11 5356124 5356145 5356129 5356124 -
tcaacttgtcaaagtcattctc

SEQ ID NO: 121056 - DNA, 22 bp, Artificial Sequence
  Synthetic oligonucleotide; CTC chr11 5356122 5356143 5356127 5356122 -
aacttgtcaaagtcattctctg

SEQ ID NO: 121057 - DNA, 22 bp, Artificial Sequence
  Synthetic oligonucleotide; CTT chr11 5356117 5356138 5356122 5356117 -
gtcaaagtcattctctgtccag

SEQ ID NO: 121058 - DNA, 22 bp, Artificial Sequence
  Synthetic oligonucleotide; TTG chr11 5356116 5356137 5356121 5356116 -
tcaaagtcattctctgtccagc

SEQ ID NO: 121059 - DNA, 22 bp, Artificial Sequence
  Synthetic oligonucleotide; TTC chr11 5356104 5356125 5356109 5356104 -
tctgtccagctttgtaccgttg

SEQ ID NO: 121060 - DNA, 22 bp, Artificial Sequence
  Synthetic oligonucleotide; CTC chr11 5356102 5356123 5356107 5356102 -
tgtccagctttgtaccgttgct

SEQ ID NO: 121061 - DNA, 22 bp, Artificial Sequence
  Synthetic oligonucleotide; CTG chr11 5356100 5356121 5356105 5356100 -
tccagctttgtaccgttgctgg

SEQ ID NO: 121062 - DNA, 22 bp, Artificial Sequence
  Synthetic oligonucleotide; CTT chr11 5356092 5356113 5356097 5356092 -
tgtaccgttgctggtgaggagc

SEQ ID NO: 121063 - DNA, 22 bp, Artificial Sequence
  Synthetic oligonucleotide; TTT chr11 5356091 5356112 5356096 5356091 -
gtaccgttgctggtgaggagct

SEQ ID NO: 121064 - DNA, 22 bp, Artificial Sequence
  Synthetic oligonucleotide; TTG chr11 5356090 5356111 5356095 5356090 -
taccgttgctggtgaggagctg

SEQ ID NO: 121065 - DNA, 22 bp, Artificial Sequence
  Synthetic oligonucleotide; TTG chr11 5356082 5356103 5356087 5356082 -
ctggtgaggagctgcattcctt

SEQ ID NO: 121066 - DNA, 22 bp, Artificial Sequence
  Synthetic oligonucleotide; CTG chr11 5356079 5356100 5356084 5356079 -
gtgaggagctgcattcctttgg

SEQ ID NO: 121067 - DNA, 22 bp, Artificial Sequence
  Synthetic oligonucleotide; CTG chr11 5356068 5356089 5356073 5356068 -
cattcctttggaggaggagagg

SEQ ID NO: 121068 - DNA, 22 bp, Artificial Sequence
  Synthetic oligonucleotide; TTC chr11 5356063 5356084 5356068 5356063 -
ctttggaggaggagaggcactc

SEQ ID NO: 121069 - DNA, 22 bp, Artificial Sequence
  Synthetic oligonucleotide; CTT chr11 5356060 5356081 5356065 5356060 -
tggaggaggagaggcactctga

SEQ ID NO: 121070 - DNA, 22 bp, Artificial Sequence
  Synthetic oligonucleotide; TTT chr11 5356059 5356080 5356064 5356059 -
ggaggaggagaggcactctgat

SEQ ID NO: 121071 - DNA, 22 bp, Artificial Sequence
  Synthetic oligonucleotide; TTG chr11 5356058 5356079 5356063 5356058 -
gaggaggagaggcactctgatt

SEQ ID NO: 121072 - DNA, 22 bp, Artificial Sequence
  Synthetic oligonucleotide; CTC chr11 5356041 5356062 5356046 5356041 -
tgatttttagagtttccagttt

SEQ ID NO: 121073 - DNA, 22 bp, Artificial Sequence
  Synthetic oligonucleotide; CTG chr11 5356039 5356060 5356044 5356039 -
atttttagagtttccagttttt

SEQ ID NO: 121074 - DNA, 22 bp, Artificial Sequence
  Synthetic oligonucleotide; TTT chr11 5356035 5356056 5356040 5356035 -
ttagagtttccagtttttctgc

SEQ ID NO: 121075 - DNA, 22 bp, Artificial Sequence
  Synthetic oligonucleotide; TTT chr11 5356034 5356055 5356039 5356034 -
tagagtttccagtttttctgct

SEQ ID NO: 121076 - DNA, 22 bp, Artificial Sequence
  Synthetic oligonucleotide; TTT chr11 5356033 5356054 5356038 5356033 -
agagtttccagtttttctgctc

SEQ ID NO: 121077 - DNA, 22 bp, Artificial Sequence
  Synthetic oligonucleotide; TTA chr11 5356032 5356053 5356037 5356032 -
gagtttccagtttttctgctct

SEQ ID NO: 121078 - DNA, 22 bp, Artificial Sequence
  Synthetic oligonucleotide; TTT chr11 5356026 5356047 5356031 5356026 -
ccagtttttctgctctgttttt

SEQ ID NO: 121079 - DNA, 22 bp, Artificial Sequence
  Synthetic oligonucleotide; TTC chr11 5356025 5356046 5356030 5356025 -
cagtttttctgctctgtttttc

SEQ ID NO: 121080 - DNA, 22 bp, Artificial Sequence
  Synthetic oligonucleotide; TTT chr11 5356019 5356040 5356024 5356019 -
ttctgctctgtttttccccatc

SEQ ID NO: 121081 - DNA, 22 bp, Artificial Sequence
  Synthetic oligonucleotide; TTT chr11 5356018 5356039 5356023 5356018 -
tctgctctgtttttccccatct

SEQ ID NO: 121082 - DNA, 22 bp, Artificial Sequence
  Synthetic oligonucleotide; TTT chr11 5356017 5356038 5356022 5356017 -
ctgctctgtttttccccatctt

SEQ ID NO: 121083 - DNA, 22 bp, Artificial Sequence
  Synthetic oligonucleotide; TTC chr11 5356016 5356037 5356021 5356016 -
tgctctgtttttccccatcttt

SEQ ID NO: 121084 - DNA, 22 bp, Artificial Sequence
  Synthetic oligonucleotide; CTG chr11 5356014 5356035 5356019 5356014 -
ctctgtttttccccatctttgt

SEQ ID NO: 121085 - DNA, 22 bp, Artificial Sequence
  Synthetic oligonucleotide; CTC chr11 5356011 5356032 5356016 5356011 -
tgtttttccccatctttgtggt

SEQ ID NO: 121086 - DNA, 22 bp, Artificial Sequence
  Synthetic oligonucleotide; CTG chr11 5356009 5356030 5356014 5356009 -
tttttccccatctttgtggttt

SEQ ID NO: 121087 - DNA, 22 bp, Artificial Sequence
  Synthetic oligonucleotide; TTT chr11 5356006 5356027 5356011 5356006 -
ttccccatctttgtggttttat

SEQ ID NO: 121088 - DNA, 22 bp, Artificial Sequence
  Synthetic oligonucleotide; TTT chr11 5356005 5356026 5356010 5356005 -
tccccatctttgtggttttatc

SEQ ID NO: 121089 - DNA, 22 bp, Artificial Sequence
  Synthetic oligonucleotide; TTT chr11 5356004 5356025 5356009 5356004 -
ccccatctttgtggttttatct

SEQ ID NO: 121090 - DNA, 22 bp, Artificial Sequence
  Synthetic oligonucleotide; TTC chr11 5356003 5356024 5356008 5356003 -
cccatctttgtggttttatcta

SEQ ID NO: 121091 - DNA, 22 bp, Artificial Sequence
  Synthetic oligonucleotide; CTT chr11 5355995 5356016 5356000 5355995 -
tgtggttttatctacctttggt

SEQ ID NO: 121092 - DNA, 22 bp, Artificial Sequence
  Synthetic oligonucleotide; TTT chr11 5355994 5356015 5355999 5355994 -
gtggttttatctacctttggtc

SEQ ID NO: 121093 - DNA, 22 bp, Artificial Sequence
  Synthetic oligonucleotide; TTG chr11 5355993 5356014 5355998 5355993 -
tggttttatctacctttggtct

SEQ ID NO: 121094 - DNA, 22 bp, Artificial Sequence
  Synthetic oligonucleotide; TTT chr11 5355987 5356008 5355992 5355987 -
tatctacctttggtctttgatg

SEQ ID NO: 121095 - DNA, 22 bp, Artificial Sequence
  Synthetic oligonucleotide; TTT chr11 5355986 5356007 5355991 5355986 -
atctacctttggtctttgatga

SEQ ID NO: 121096 - DNA, 22 bp, Artificial Sequence
  Synthetic oligonucleotide; TTA chr11 5355985 5356006 5355990 5355985 -
tctacctttggtctttgatgat

SEQ ID NO: 121097 - DNA, 22 bp, Artificial Sequence
  Synthetic oligonucleotide; CTA chr11 5355981 5356002 5355986 5355981 -
cctttggtctttgatgatggtg

SEQ ID NO: 121098 - DNA, 22 bp, Artificial Sequence
  Synthetic oligonucleotide; CTT chr11 5355977 5355998 5355982 5355977 -
tggtctttgatgatggtgacgt

SEQ ID NO: 121099 - DNA, 22 bp, Artificial Sequence
  Synthetic oligonucleotide; TTT chr11 5355976 5355997 5355981 5355976 -
ggtctttgatgatggtgacgta

SEQ ID NO: 121100 - DNA, 22 bp, Artificial Sequence
  Synthetic oligonucleotide; TTG chr11 5355975 5355996 5355980 5355975 -
gtctttgatgatggtgacgtac

SEQ ID NO: 121101 - DNA, 22 bp, Artificial Sequence
  Synthetic oligonucleotide; CTT chr11 5355970 5355991 5355975 5355970 -
tgatgatggtgacgtacagatg

SEQ ID NO: 121102 - DNA, 22 bp, Artificial Sequence
  Synthetic oligonucleotide; TTT chr11 5355969 5355990 5355974 5355969 -
gatgatggtgacgtacagatgg

SEQ ID NO: 121103 - DNA, 22 bp, Artificial Sequence
  Synthetic oligonucleotide; TTG chr11 5355968 5355989 5355973 5355968 -
atgatggtgacgtacagatggg

SEQ ID NO: 121104 - DNA, 22 bp, Artificial Sequence
  Synthetic oligonucleotide; TTT chr11 5355943 5355964 5355948 5355943 -
ttggtgtggatgtcctttctgt

SEQ ID NO: 121105 - DNA, 22 bp, Artificial Sequence
  Synthetic oligonucleotide; TTT chr11 5355942 5355963 5355947 5355942 -
tggtgtggatgtcctttctgtt

SEQ ID NO: 121106 - DNA, 22 bp, Artificial Sequence
  Synthetic oligonucleotide; TTT chr11 5355941 5355962 5355946 5355941 -
ggtgtggatgtcctttctgttt

SEQ ID NO: 121107 - DNA, 22 bp, Artificial Sequence
  Synthetic oligonucleotide; TTG chr11 5355940 5355961 5355945 5355940 -
gtgtggatgtcctttctgtttg

SEQ ID NO: 121108 - DNA, 22 bp, Artificial Sequence
  Synthetic oligonucleotide; CTT chr11 5355926 5355947 5355931 5355926 -
tctgtttgttagttttccttct

SEQ ID NO: 121109 - DNA, 22 bp, Artificial Sequence
  Synthetic oligonucleotide; TTT chr11 5355925 5355946 5355930 5355925 -
ctgtttgttagttttccttcta

SEQ ID NO: 121110 - DNA, 22 bp, Artificial Sequence
  Synthetic oligonucleotide; TTC chr11 5355924 5355945 5355929 5355924 -
tgtttgttagttttccttctaa

SEQ ID NO: 121111 - DNA, 22 bp, Artificial Sequence
  Synthetic oligonucleotide; CTG chr11 5355922 5355943 5355927 5355922 -
tttgttagttttccttctaaca

SEQ ID NO: 121112 - DNA, 22 bp, Artificial Sequence
  Synthetic oligonucleotide; TTT chr11 5355919 5355940 5355924 5355919 -
gttagttttccttctaacagga

SEQ ID NO: 121113 - DNA, 22 bp, Artificial Sequence
  Synthetic oligonucleotide; TTG chr11 5355918 5355939 5355923 5355918 -
ttagttttccttctaacaggac

SEQ ID NO: 121114 - DNA, 22 bp, Artificial Sequence
  Synthetic oligonucleotide; TTA chr11 5355915 5355936 5355920 5355915 -
gttttccttctaacaggaccct

SEQ ID NO: 121115 - DNA, 22 bp, Artificial Sequence
  Synthetic oligonucleotide; TTT chr11 5355911 5355932 5355916 5355911 -
tccttctaacaggaccctcagc

SEQ ID NO: 121116 - DNA, 22 bp, Artificial Sequence
  Synthetic oligonucleotide; TTT chr11 5355910 5355931 5355915 5355910 -
ccttctaacaggaccctcagct

SEQ ID NO: 121117 - DNA, 22 bp, Artificial Sequence
  Synthetic oligonucleotide; TTC chr11 5355909 5355930 5355914 5355909 -
cttctaacaggaccctcagctt

SEQ ID NO: 121118 - DNA, 22 bp, Artificial Sequence
  Synthetic oligonucleotide; CTT chr11 5355906 5355927 5355911 5355906 -
ctaacaggaccctcagcttgca

SEQ ID NO: 121119 - DNA, 22 bp, Artificial Sequence
  Synthetic oligonucleotide; TTC chr11 5355905 5355926 5355910 5355905 -
taacaggaccctcagcttgcag

SEQ ID NO: 121120 - DNA, 22 bp, Artificial Sequence
  Synthetic oligonucleotide; CTA chr11 5355903 5355924 5355908 5355903 -
acaggaccctcagcttgcagca

SEQ ID NO: 121121 - DNA, 22 bp, Artificial Sequence
  Synthetic oligonucleotide; CTC chr11 5355892 5355913 5355897 5355892 -
agcttgcagcagatttttaaaa

SEQ ID NO: 121122 - DNA, 22 bp, Artificial Sequence
  Synthetic oligonucleotide; CTT chr11 5355887 5355908 5355892 5355887 -
gcagcagatttttaaaagaact

SEQ ID NO: 121123 - DNA, 22 bp, Artificial Sequence
  Synthetic oligonucleotide; TTG chr11 5355886 5355907 5355891 5355886 -
cagcagatttttaaaagaactt

SEQ ID NO: 121124 - DNA, 22 bp, Artificial Sequence
  Synthetic oligonucleotide; TTT chr11 5355876 5355897 5355881 5355876 -
ttaaaagaacttccaggacctt

SEQ ID NO: 121125 - DNA, 22 bp, Artificial Sequence
  Synthetic oligonucleotide; TTT chr11 5355875 5355896 5355880 5355875 -
taaaagaacttccaggaccttg

SEQ ID NO: 121126 - DNA, 22 bp, Artificial Sequence
  Synthetic oligonucleotide; TTT chr11 5355874 5355895 5355879 5355874 -
aaaagaacttccaggaccttgt

SEQ ID NO: 121127 - DNA, 22 bp, Artificial Sequence
  Synthetic oligonucleotide; TTA chr11 5355873 5355894 5355878 5355873 -
aaagaacttccaggaccttgtc

SEQ ID NO: 121128 - DNA, 22 bp, Artificial Sequence
  Synthetic oligonucleotide; CTT chr11 5355864 5355885 5355869 5355864 -
ccaggaccttgtctgtatattg

SEQ ID NO: 121129 - DNA, 22 bp, Artificial Sequence
  Synthetic oligonucleotide; TTC chr11 5355863 5355884 5355868 5355863 -
caggaccttgtctgtatattga

SEQ ID NO: 121130 - DNA, 22 bp, Artificial Sequence
  Synthetic oligonucleotide; CTT chr11 5355854 5355875 5355859 5355854 -
gtctgtatattgacgcctatgt

SEQ ID NO: 121131 - DNA, 22 bp, Artificial Sequence
  Synthetic oligonucleotide; TTG chr11 5355853 5355874 5355858 5355853 -
tctgtatattgacgcctatgtc

SEQ ID NO: 121132 - DNA, 22 bp, Artificial Sequence
  Synthetic oligonucleotide; CTG chr11 5355849 5355870 5355854 5355849 -
tatattgacgcctatgtcacta

SEQ ID NO: 121133 - DNA, 22 bp, Artificial Sequence
  Synthetic oligonucleotide; TTG chr11 5355842 5355863 5355847 5355842 -
acgcctatgtcactacaggaat

SEQ ID NO: 121134 - DNA, 22 bp, Artificial Sequence
  Synthetic oligonucleotide; CTA chr11 5355835 5355856 5355840 5355835 -
tgtcactacaggaatcagagca

SEQ ID NO: 121135 - DNA, 22 bp, Artificial Sequence
  Synthetic oligonucleotide; CTA chr11 5355827 5355848 5355832 5355827 -
caggaatcagagcagggcatta

SEQ ID NO: 121136 - DNA, 22 bp, Artificial Sequence
  Synthetic oligonucleotide; TTA chr11 5355805 5355826 5355810 5355805 -
cattgatcctttaagaaaattt

SEQ ID NO: 121137 - DNA, 22 bp, Artificial Sequence
  Synthetic oligonucleotide; TTG chr11 5355800 5355821 5355805 5355800 -
atcctttaagaaaattttgcta

SEQ ID NO: 121138 - DNA, 22 bp, Artificial Sequence
  Synthetic oligonucleotide; CTT chr11 5355794 5355815 5355799 5355794 -
taagaaaattttgctaccctat

SEQ ID NO: 121139 - DNA, 22 bp, Artificial Sequence
  Synthetic oligonucleotide; TTT chr11 5355793 5355814 5355798 5355793 -
aagaaaattttgctaccctata

SEQ ID NO: 121140 - DNA, 22 bp, Artificial Sequence
  Synthetic oligonucleotide; TTA chr11 5355792 5355813 5355797 5355792 -
agaaaattttgctaccctatac

SEQ ID NO: 121141 - DNA, 22 bp, Artificial Sequence
  Synthetic oligonucleotide; TTT chr11 5355783 5355804 5355788 5355783 -
tgctaccctataccccttgacc

SEQ ID NO: 121142 - DNA, 22 bp, Artificial Sequence
  Synthetic oligonucleotide; TTT chr11 5355782 5355803 5355787 5355782 -
gctaccctataccccttgaccc

SEQ ID NO: 121143 - DNA, 22 bp, Artificial Sequence
  Synthetic oligonucleotide; TTG chr11 5355781 5355802 5355786 5355781 -
ctaccctataccccttgaccct

SEQ ID NO: 121144 - DNA, 22 bp, Artificial Sequence
  Synthetic oligonucleotide; CTA chr11 5355778 5355799 5355783 5355778 -
ccctataccccttgaccctact

SEQ ID NO: 121145 - DNA, 22 bp, Artificial Sequence
  Synthetic oligonucleotide; CTA chr11 5355773 5355794 5355778 5355773 -
taccccttgaccctactctttt

SEQ ID NO: 121146 - DNA, 22 bp, Artificial Sequence
  Synthetic oligonucleotide; CTT chr11 5355765 5355786 5355770 5355765 -
gaccctactctttttttttttt

SEQ ID NO: 121147 - DNA, 22 bp, Artificial Sequence
  Synthetic oligonucleotide; TTG chr11 5355764 5355785 5355769 5355764 -
accctactcttttttttttttt

SEQ ID NO: 121148 - DNA, 22 bp, Artificial Sequence
  Synthetic oligonucleotide; CTA chr11 5355758 5355779 5355763 5355758 -
ctcttttttttttttttaattt

SEQ ID NO: 121149 - DNA, 22 bp, Artificial Sequence
  Synthetic oligonucleotide; CTC chr11 5355755 5355776 5355760 5355755 -
ttttttttttttttaattttta

SEQ ID NO: 121150 - DNA, 22 bp, Artificial Sequence
  Synthetic oligonucleotide; CTT chr11 5355753 5355774 5355758 5355753 -
ttttttttttttaatttttaaa

SEQ ID NO: 121151 - DNA, 22 bp, Artificial Sequence
  Synthetic oligonucleotide; TTT chr11 5355752 5355773 5355757 5355752 -
tttttttttttaatttttaaag

SEQ ID NO: 121152 - DNA, 22 bp, Artificial Sequence
  Synthetic oligonucleotide; TTT chr11 5355751 5355772 5355756 5355751 -
ttttttttttaatttttaaagg

SEQ ID NO: 121153 - DNA, 22 bp, Artificial Sequence
  Synthetic oligonucleotide; TTT chr11 5355750 5355771 5355755 5355750 -
tttttttttaatttttaaaggt

SEQ ID NO: 121154 - DNA, 22 bp, Artificial Sequence
  Synthetic oligonucleotide; TTT chr11 5355749 5355770 5355754 5355749 -
ttttttttaatttttaaaggta

SEQ ID NO: 121155 - DNA, 22 bp, Artificial Sequence
  Synthetic oligonucleotide; TTT chr11 5355748 5355769 5355753 5355748 -
tttttttaatttttaaaggtaa

SEQ ID NO: 121156 - DNA, 22 bp, Artificial Sequence
  Synthetic oligonucleotide; TTT chr11 5355747 5355768 5355752 5355747 -
ttttttaatttttaaaggtaat

SEQ ID NO: 121157 - DNA, 22 bp, Artificial Sequence
  Synthetic oligonucleotide; TTT chr11 5355746 5355767 5355751 5355746 -
tttttaatttttaaaggtaatt

SEQ ID NO: 121158 - DNA, 22 bp, Artificial Sequence
  Synthetic oligonucleotide; TTT chr11 5355745 5355766 5355750 5355745 -
ttttaatttttaaaggtaattg

SEQ ID NO: 121159 - DNA, 22 bp, Artificial Sequence
  Synthetic oligonucleotide; TTT chr11 5355744 5355765 5355749 5355744 -
tttaatttttaaaggtaattgt

SEQ ID NO: 121160 - DNA, 22 bp, Artificial Sequence
  Synthetic oligonucleotide; TTT chr11 5355743 5355764 5355748 5355743 -
ttaatttttaaaggtaattgtt

SEQ ID NO: 121161 - DNA, 22 bp, Artificial Sequence
  Synthetic oligonucleotide; TTT chr11 5355742 5355763 5355747 5355742 -
taatttttaaaggtaattgtta

SEQ ID NO: 121162 - DNA, 22 bp, Artificial Sequence
  Synthetic oligonucleotide; TTT chr11 5355741 5355762 5355746 5355741 -
aatttttaaaggtaattgttag

SEQ ID NO: 121163 - DNA, 22 bp, Artificial Sequence
  Synthetic oligonucleotide; TTA chr11 5355740 5355761 5355745 5355740 -
atttttaaaggtaattgttaga

SEQ ID NO: 121164 - DNA, 22 bp, Artificial Sequence
  Synthetic oligonucleotide; TTT chr11 5355736 5355757 5355741 5355736 -
ttaaaggtaattgttagaaatt

SEQ ID NO: 121165 - DNA, 22 bp, Artificial Sequence
  Synthetic oligonucleotide; TTT chr11 5355735 5355756 5355740 5355735 -
taaaggtaattgttagaaattt

SEQ ID NO: 121166 - DNA, 22 bp, Artificial Sequence
  Synthetic oligonucleotide; TTT chr11 5355734 5355755 5355739 5355734 -
aaaggtaattgttagaaatttc

SEQ ID NO: 121167 - DNA, 22 bp, Artificial Sequence
  Synthetic oligonucleotide; TTA chr11 5355733 5355754 5355738 5355733 -
aaggtaattgttagaaatttcc

SEQ ID NO: 121168 - DNA, 22 bp, Artificial Sequence
  Synthetic oligonucleotide; TTG chr11 5355723 5355744 5355728 5355723 -
ttagaaatttcccaaggtttat

SEQ ID NO: 121169 - DNA, 22 bp, Artificial Sequence
  Synthetic oligonucleotide; TTA chr11 5355720 5355741 5355725 5355720 -
gaaatttcccaaggtttatttg

SEQ ID NO: 121170 - DNA, 22 bp, Artificial Sequence
  Synthetic oligonucleotide; TTT chr11 5355713 5355734 5355718 5355713 -
cccaaggtttatttgaaatgac

SEQ ID NO: 121171 - DNA, 22 bp, Artificial Sequence
  Synthetic oligonucleotide; TTC chr11 5355712 5355733 5355717 5355712 -
ccaaggtttatttgaaatgaca

SEQ ID NO: 121172 - DNA, 22 bp, Artificial Sequence
  Synthetic oligonucleotide; TTT chr11 5355703 5355724 5355708 5355703 -
atttgaaatgacacaccactga

SEQ ID NO: 121173 - DNA, 22 bp, Artificial Sequence
  Synthetic oligonucleotide; TTA chr11 5355702 5355723 5355707 5355702 -
tttgaaatgacacaccactgaa

SEQ ID NO: 121174 - DNA, 22 bp, Artificial Sequence
  Synthetic oligonucleotide; TTT chr11 5355699 5355720 5355704 5355699 -
gaaatgacacaccactgaaaac

SEQ ID NO: 121175 - DNA, 22 bp, Artificial Sequence
  Synthetic oligonucleotide; TTG chr11 5355698 5355719 5355703 5355698 -
aaatgacacaccactgaaaaca

SEQ ID NO: 121176 - DNA, 22 bp, Artificial Sequence
  Synthetic oligonucleotide; CTG chr11 5355682 5355703 5355687 5355682 -
aaaacataacttttacagatga

SEQ ID NO: 121177 - DNA, 22 bp, Artificial Sequence
  Synthetic oligonucleotide; CTT chr11 5355670 5355691 5355675 5355670 -
ttacagatgatttgtggataca

SEQ ID NO: 121178 - DNA, 22 bp, Artificial Sequence
  Synthetic oligonucleotide; TTT chr11 5355669 5355690 5355674 5355669 -
tacagatgatttgtggatacag

SEQ ID NO: 121179 - DNA, 22 bp, Artificial Sequence
  Synthetic oligonucleotide; TTT chr11 5355668 5355689 5355673 5355668 -
acagatgatttgtggatacagt

SEQ ID NO: 121180 - DNA, 22 bp, Artificial Sequence
  Synthetic oligonucleotide; TTA chr11 5355667 5355688 5355672 5355667 -
cagatgatttgtggatacagta

SEQ ID NO: 121181 - DNA, 22 bp, Artificial Sequence
  Synthetic oligonucleotide; TTT chr11 5355657 5355678 5355662 5355657 -
gtggatacagtacacatcacct

SEQ ID NO: 121182 - DNA, 22 bp, Artificial Sequence
  Synthetic oligonucleotide; TTG chr11 5355656 5355677 5355661 5355656 -
tggatacagtacacatcaccta

SEQ ID NO: 121183 - DNA, 22 bp, Artificial Sequence
  Synthetic oligonucleotide; CTA chr11 5355634 5355655 5355639 5355634 -
tcttactttaggacagtctgtg

SEQ ID NO: 121184 - DNA, 22 bp, Artificial Sequence
  Synthetic oligonucleotide; CTT chr11 5355630 5355651 5355635 5355630 -
actttaggacagtctgtgaaga

SEQ ID NO: 121185 - DNA, 22 bp, Artificial Sequence
  Synthetic oligonucleotide; TTA chr11 5355629 5355650 5355634 5355629 -
ctttaggacagtctgtgaagat

SEQ ID NO: 121186 - DNA, 22 bp, Artificial Sequence
  Synthetic oligonucleotide; CTT chr11 5355626 5355647 5355631 5355626 -
taggacagtctgtgaagatgat

SEQ ID NO: 121187 - DNA, 22 bp, Artificial Sequence
  Synthetic oligonucleotide; TTT chr11 5355625 5355646 5355630 5355625 -
aggacagtctgtgaagatgata

SEQ ID NO: 121188 - DNA, 22 bp, Artificial Sequence
  Synthetic oligonucleotide; TTA chr11 5355624 5355645 5355629 5355624 -
ggacagtctgtgaagatgatat

SEQ ID NO: 121189 - DNA, 22 bp, Artificial Sequence
  Synthetic oligonucleotide; CTG chr11 5355614 5355635 5355619 5355614 -
tgaagatgatatttttcctgct

SEQ ID NO: 121190 - DNA, 22 bp, Artificial Sequence
  Synthetic oligonucleotide; TTT chr11 5355600 5355621 5355605 5355600 -
ttcctgctgcagttcctttgtc

SEQ ID NO: 121191 - DNA, 22 bp, Artificial Sequence
  Synthetic oligonucleotide; TTT chr11 5355599 5355620 5355604 5355599 -
tcctgctgcagttcctttgtca

SEQ ID NO: 121192 - DNA, 22 bp, Artificial Sequence
  Synthetic oligonucleotide; TTT chr11 5355598 5355619 5355603 5355598 -
cctgctgcagttcctttgtcaa

SEQ ID NO: 121193 - DNA, 22 bp, Artificial Sequence
  Synthetic oligonucleotide; TTC chr11 5355597 5355618 5355602 5355597 -
ctgctgcagttcctttgtcaag

SEQ ID NO: 121194 - DNA, 22 bp, Artificial Sequence
  Synthetic oligonucleotide; CTG chr11 5355594 5355615 5355599 5355594 -
ctgcagttcctttgtcaagtga

SEQ ID NO: 121195 - DNA, 22 bp, Artificial Sequence
  Synthetic oligonucleotide; CTG chr11 5355591 5355612 5355596 5355591 -
cagttcctttgtcaagtgactt

SEQ ID NO: 121196 - DNA, 22 bp, Artificial Sequence
  Synthetic oligonucleotide; TTC chr11 5355585 5355606 5355590 5355585 -
ctttgtcaagtgactttagaca

SEQ ID NO: 121197 - DNA, 22 bp, Artificial Sequence
  Synthetic oligonucleotide; CTT chr11 5355582 5355603 5355587 5355582 -
tgtcaagtgactttagacagat

SEQ ID NO: 121198 - DNA, 22 bp, Artificial Sequence
  Synthetic oligonucleotide; TTT chr11 5355581 5355602 5355586 5355581 -
gtcaagtgactttagacagata

SEQ ID NO: 121199 - DNA, 22 bp, Artificial Sequence
  Synthetic oligonucleotide; TTG chr11 5355580 5355601 5355585 5355580 -
tcaagtgactttagacagatac

SEQ ID NO: 121200 - DNA, 22 bp, Artificial Sequence
  Synthetic oligonucleotide; CTT chr11 5355569 5355590 5355574 5355569 -
tagacagatacaggactgcaag

SEQ ID NO: 121201 - DNA, 22 bp, Artificial Sequence
  Synthetic oligonucleotide; TTT chr11 5355568 5355589 5355573 5355568 -
agacagatacaggactgcaaga

SEQ ID NO: 121202 - DNA, 22 bp, Artificial Sequence
  Synthetic oligonucleotide; TTA chr11 5355567 5355588 5355572 5355567 -
gacagatacaggactgcaagag

SEQ ID NO: 121203 - DNA, 22 bp, Artificial Sequence
  Synthetic oligonucleotide; CTG chr11 5355551 5355572 5355556 5355551 -
caagagtgactcaggtcatgct

SEQ ID NO: 121204 - DNA, 22 bp, Artificial Sequence
  Synthetic oligonucleotide; CTC chr11 5355539 5355560 5355544 5355539 -
aggtcatgctggcataggagaa

SEQ ID NO: 121205 - DNA, 22 bp, Artificial Sequence
  Synthetic oligonucleotide; CTG chr11 5355528 5355549 5355533 5355528 -
gcataggagaagcaggtgctag

SEQ ID NO: 121206 - DNA, 22 bp, Artificial Sequence
  Synthetic oligonucleotide; CTA chr11 5355507 5355528 5355512 5355507 -
gtgtttcacttgaactagttgt

SEQ ID NO: 121207 - DNA, 22 bp, Artificial Sequence
  Synthetic oligonucleotide; TTT chr11 5355501 5355522 5355506 5355501 -
cacttgaactagttgttgggct

SEQ ID NO: 121208 - DNA, 22 bp, Artificial Sequence
  Synthetic oligonucleotide; TTC chr11 5355500 5355521 5355505 5355500 -
acttgaactagttgttgggctg

SEQ ID NO: 121209 - DNA, 22 bp, Artificial Sequence
  Synthetic oligonucleotide; CTT chr11 5355496 5355517 5355501 5355496 -
gaactagttgttgggctggggt

SEQ ID NO: 121210 - DNA, 22 bp, Artificial Sequence
  Synthetic oligonucleotide; TTG chr11 5355495 5355516 5355500 5355495 -
aactagttgttgggctggggtg

SEQ ID NO: 121211 - DNA, 22 bp, Artificial Sequence
  Synthetic oligonucleotide; CTA chr11 5355490 5355511 5355495 5355490 -
gttgttgggctggggtggaatg

SEQ ID NO: 121212 - DNA, 22 bp, Artificial Sequence
  Synthetic oligonucleotide; TTG chr11 5355486 5355507 5355491 5355486 -
ttgggctggggtggaatgaaag

SEQ ID NO: 121213 - DNA, 22 bp, Artificial Sequence
  Synthetic oligonucleotide; TTG chr11 5355483 5355504 5355488 5355483 -
ggctggggtggaatgaaagctc

SEQ ID NO: 121214 - DNA, 22 bp, Artificial Sequence
  Synthetic oligonucleotide; CTG chr11 5355478 5355499 5355483 5355478 -
gggtggaatgaaagctccctag

SEQ ID NO: 121215 - DNA, 22 bp, Artificial Sequence
  Synthetic oligonucleotide; CTC chr11 5355461 5355482 5355466 5355461 -
cctaggccatgaggacatcttt

SEQ ID NO: 121216 - DNA, 22 bp, Artificial Sequence
  Synthetic oligonucleotide; CTA chr11 5355457 5355478 5355462 5355457 -
ggccatgaggacatctttgcaa

SEQ ID NO: 121217 - DNA, 22 bp, Artificial Sequence
  Synthetic oligonucleotide; CTT chr11 5355440 5355461 5355445 5355440 -
tgcaatgtggagaggacccaaa

SEQ ID NO: 121218 - DNA, 22 bp, Artificial Sequence
  Synthetic oligonucleotide; TTT chr11 5355439 5355460 5355444 5355439 -
gcaatgtggagaggacccaaat

SEQ ID NO: 121219 - DNA, 22 bp, Artificial Sequence
  Synthetic oligonucleotide; TTG chr11 5355438 5355459 5355443 5355438 -
caatgtggagaggacccaaatc

SEQ ID NO: 121220 - DNA, 22 bp, Artificial Sequence
  Synthetic oligonucleotide; TTG chr11 5355405 5355426 5355410 5355405 -
ctctttgaatgttgaaggcctt

SEQ ID NO: 121221 - DNA, 22 bp, Artificial Sequence
  Synthetic oligonucleotide; CTC chr11 5355402 5355423 5355407 5355402 -
tttgaatgttgaaggccttgtc

SEQ ID NO: 121222 - DNA, 22 bp, Artificial Sequence
  Synthetic oligonucleotide; CTT chr11 5355400 5355421 5355405 5355400 -
tgaatgttgaaggccttgtcag

SEQ ID NO: 121223 - DNA, 22 bp, Artificial Sequence
  Synthetic oligonucleotide; TTT chr11 5355399 5355420 5355404 5355399 -
gaatgttgaaggccttgtcagc

SEQ ID NO: 121224 - DNA, 22 bp, Artificial Sequence
  Synthetic oligonucleotide; TTG chr11 5355398 5355419 5355403 5355398 -
aatgttgaaggccttgtcagca

SEQ ID NO: 121225 - DNA, 22 bp, Artificial Sequence
  Synthetic oligonucleotide; TTG chr11 5355391 5355412 5355396 5355391 -
aaggccttgtcagcatactggt

SEQ ID NO: 121226 - DNA, 22 bp, Artificial Sequence
  Synthetic oligonucleotide; CTT chr11 5355383 5355404 5355388 5355383 -
gtcagcatactggtcacccagt

SEQ ID NO: 121227 - DNA, 22 bp, Artificial Sequence
  Synthetic oligonucleotide; TTG chr11 5355382 5355403 5355387 5355382 -
tcagcatactggtcacccagtt

SEQ ID NO: 121228 - DNA, 22 bp, Artificial Sequence
  Synthetic oligonucleotide; CTG chr11 5355371 5355392 5355376 5355371 -
gtcacccagtttcatcatcact

SEQ ID NO: 121229 - DNA, 22 bp, Artificial Sequence
  Synthetic oligonucleotide; TTT chr11 5355359 5355380 5355364 5355359 -
catcatcacttcatactgtttg

SEQ ID NO: 121230 - DNA, 22 bp, Artificial Sequence
  Synthetic oligonucleotide; TTC chr11 5355358 5355379 5355363 5355358 -
atcatcacttcatactgtttgt

SEQ ID NO: 121231 - DNA, 22 bp, Artificial Sequence
  Synthetic oligonucleotide; CTT chr11 5355348 5355369 5355353 5355348 -
catactgtttgtaccaaagcac

SEQ ID NO: 121232 - DNA, 22 bp, Artificial Sequence
  Synthetic oligonucleotide; TTC chr11 5355347 5355368 5355352 5355347 -
atactgtttgtaccaaagcacc

SEQ ID NO: 121233 - DNA, 22 bp, Artificial Sequence
  Synthetic oligonucleotide; CTG chr11 5355341 5355362 5355346 5355341 -
tttgtaccaaagcaccacagtt

SEQ ID NO: 121234 - DNA, 22 bp, Artificial Sequence
  Synthetic oligonucleotide; TTT chr11 5355338 5355359 5355343 5355338 -
gtaccaaagcaccacagtttcc

SEQ ID NO: 121235 - DNA, 22 bp, Artificial Sequence
  Synthetic oligonucleotide; TTG chr11 5355337 5355358 5355342 5355337 -
taccaaagcaccacagtttcct

SEQ ID NO: 121236 - DNA, 22 bp, Artificial Sequence
  Synthetic oligonucleotide; TTT chr11 5355318 5355339 5355323 5355318 -
ccttatgaaacttagcttcaag

SEQ ID NO: 121237 - DNA, 22 bp, Artificial Sequence
  Synthetic oligonucleotide; TTC chr11 5355317 5355338 5355322 5355317 -
cttatgaaacttagcttcaagg

SEQ ID NO: 121238 - DNA, 22 bp, Artificial Sequence
  Synthetic oligonucleotide; CTT chr11 5355314 5355335 5355319 5355314 -
atgaaacttagcttcaaggctg

SEQ ID NO: 121239 - DNA, 22 bp, Artificial Sequence
  Synthetic oligonucleotide; TTA chr11 5355313 5355334 5355318 5355313 -
tgaaacttagcttcaaggctgg

SEQ ID NO: 121240 - DNA, 22 bp, Artificial Sequence
  Synthetic oligonucleotide; CTT chr11 5355305 5355326 5355310 5355305 -
agcttcaaggctggagatgttt

SEQ ID NO: 121241 - DNA, 22 bp, Artificial Sequence
  Synthetic oligonucleotide; TTA chr11 5355304 5355325 5355309 5355304 -
gcttcaaggctggagatgtttt

SEQ ID NO: 121242 - DNA, 22 bp, Artificial Sequence
  Synthetic oligonucleotide; CTT chr11 5355300 5355321 5355305 5355300 -
caaggctggagatgtttttgaa

SEQ ID NO: 121243 - DNA, 22 bp, Artificial Sequence
  Synthetic oligonucleotide; TTC chr11 5355299 5355320 5355304 5355299 -
aaggctggagatgtttttgaaa

SEQ ID NO: 121244 - DNA, 22 bp, Artificial Sequence
  Synthetic oligonucleotide; CTG chr11 5355292 5355313 5355297 5355292 -
gagatgtttttgaaagtattaa

SEQ ID NO: 121245 - DNA, 22 bp, Artificial Sequence
  Synthetic oligonucleotide; TTT chr11 5355283 5355304 5355288 5355283 -
ttgaaagtattaatataaaatc

SEQ ID NO: 121246 - DNA, 22 bp, Artificial Sequence
  Synthetic oligonucleotide; TTT chr11 5355282 5355303 5355287 5355282 -
tgaaagtattaatataaaatcc

SEQ ID NO: 121247 - DNA, 22 bp, Artificial Sequence
  Synthetic oligonucleotide; TTT chr11 5355281 5355302 5355286 5355281 -
gaaagtattaatataaaatcca

SEQ ID NO: 121248 - DNA, 22 bp, Artificial Sequence
  Synthetic oligonucleotide; TTG chr11 5355280 5355301 5355285 5355280 -
aaagtattaatataaaatccaa

SEQ ID NO: 121249 - DNA, 22 bp, Artificial Sequence
  Synthetic oligonucleotide; TTA chr11 5355271 5355292 5355276 5355271 -
atataaaatccaattcgtcttg

SEQ ID NO: 121250 - DNA, 22 bp, Artificial Sequence
  Synthetic oligonucleotide; TTC chr11 5355255 5355276 5355260 5355255 -
gtcttgactataataatggtaa

SEQ ID NO: 121251 - DNA, 22 bp, Artificial Sequence
  Synthetic oligonucleotide; CTT chr11 5355250 5355271 5355255 5355250 -
gactataataatggtaactttt

SEQ ID NO: 121252 - DNA, 22 bp, Artificial Sequence
  Synthetic oligonucleotide; TTG chr11 5355249 5355270 5355254 5355249 -
actataataatggtaacttttc

SEQ ID NO: 121253 - DNA, 22 bp, Artificial Sequence
  Synthetic oligonucleotide; CTA chr11 5355245 5355266 5355250 5355245 -
taataatggtaacttttcttgt

SEQ ID NO: 121254 - DNA, 22 bp, Artificial Sequence
  Synthetic oligonucleotide; CTT chr11 5355230 5355251 5355235 5355230 -
ttcttgtaagtcaccattaaac

SEQ ID NO: 121255 - DNA, 22 bp, Artificial Sequence
  Synthetic oligonucleotide; TTT chr11 5355229 5355250 5355234 5355229 -
tcttgtaagtcaccattaaact

SEQ ID NO: 121256 - DNA, 22 bp, Artificial Sequence
  Synthetic oligonucleotide; TTT chr11 5355228 5355249 5355233 5355228 -
cttgtaagtcaccattaaactc

SEQ ID NO: 121257 - DNA, 22 bp, Artificial Sequence
  Synthetic oligonucleotide; TTC chr11 5355227 5355248 5355232 5355227 -
ttgtaagtcaccattaaactct

SEQ ID NO: 121258 - DNA, 22 bp, Artificial Sequence
  Synthetic oligonucleotide; CTT chr11 5355225 5355246 5355230 5355225 -
gtaagtcaccattaaactcttc

SEQ ID NO: 121259 - DNA, 22 bp, Artificial Sequence
  Synthetic oligonucleotide; TTG chr11 5355224 5355245 5355229 5355224 -
taagtcaccattaaactcttca

SEQ ID NO: 121260 - DNA, 22 bp, Artificial Sequence
  Synthetic oligonucleotide; TTA chr11 5355211 5355232 5355216 5355211 -
aactcttcaaactttctctatg

SEQ ID NO: 121261 - DNA, 22 bp, Artificial Sequence
  Synthetic oligonucleotide; CTC chr11 5355206 5355227 5355211 5355206 -
ttcaaactttctctatgctttc

SEQ ID NO: 121262 - DNA, 22 bp, Artificial Sequence
  Synthetic oligonucleotide; CTT chr11 5355204 5355225 5355209 5355204 -
caaactttctctatgctttctg

SEQ ID NO: 121263 - DNA, 22 bp, Artificial Sequence
  Synthetic oligonucleotide; TTC chr11 5355203 5355224 5355208 5355203 -
aaactttctctatgctttctga

SEQ ID NO: 121264 - DNA, 22 bp, Artificial Sequence
  Synthetic oligonucleotide; CTT chr11 5355197 5355218 5355202 5355197 -
tctctatgctttctgaaattct

SEQ ID NO: 121265 - DNA, 22 bp, Artificial Sequence
  Synthetic oligonucleotide; TTT chr11 5355196 5355217 5355201 5355196 -
ctctatgctttctgaaattcta

SEQ ID NO: 121266 - DNA, 22 bp, Artificial Sequence
  Synthetic oligonucleotide; TTC chr11 5355195 5355216 5355200 5355195 -
tctatgctttctgaaattctac

SEQ ID NO: 121267 - DNA, 22 bp, Artificial Sequence
  Synthetic oligonucleotide; CTC chr11 5355193 5355214 5355198 5355193 -
tatgctttctgaaattctactt

SEQ ID NO: 121268 - DNA, 22 bp, Artificial Sequence
  Synthetic oligonucleotide; CTA chr11 5355191 5355212 5355196 5355191 -
tgctttctgaaattctacttct

SEQ ID NO: 121269 - DNA, 22 bp, Artificial Sequence
  Synthetic oligonucleotide; CTT chr11 5355186 5355207 5355191 5355186 -
tctgaaattctacttctgcctt

SEQ ID NO: 121270 - DNA, 22 bp, Artificial Sequence
  Synthetic oligonucleotide; TTT chr11 5355185 5355206 5355190 5355185 -
ctgaaattctacttctgcctta

SEQ ID NO: 121271 - DNA, 22 bp, Artificial Sequence
  Synthetic oligonucleotide; TTC chr11 5355184 5355205 5355189 5355184 -
tgaaattctacttctgccttag

SEQ ID NO: 121272 - DNA, 22 bp, Artificial Sequence
  Synthetic oligonucleotide; CTG chr11 5355182 5355203 5355187 5355182 -
aaattctacttctgccttagac

SEQ ID NO: 121273 - DNA, 22 bp, Artificial Sequence
  Synthetic oligonucleotide; TTC chr11 5355176 5355197 5355181 5355176 -
tacttctgccttagacagaggc

SEQ ID NO: 121274 - DNA, 22 bp, Artificial Sequence
  Synthetic oligonucleotide; CTA chr11 5355174 5355195 5355179 5355174 -
cttctgccttagacagaggctc

SEQ ID NO: 121275 - DNA, 22 bp, Artificial Sequence
  Synthetic oligonucleotide; CTT chr11 5355171 5355192 5355176 5355171 -
ctgccttagacagaggctccta

SEQ ID NO: 121276 - DNA, 22 bp, Artificial Sequence
  Synthetic oligonucleotide; TTC chr11 5355170 5355191 5355175 5355170 -
tgccttagacagaggctcctat

SEQ ID NO: 121277 - DNA, 22 bp, Artificial Sequence
  Synthetic oligonucleotide; CTG chr11 5355168 5355189 5355173 5355168 -
ccttagacagaggctcctatcc

SEQ ID NO: 121278 - DNA, 22 bp, Artificial Sequence
  Synthetic oligonucleotide; CTT chr11 5355164 5355185 5355169 5355164 -
agacagaggctcctatccttcc

SEQ ID NO: 121279 - DNA, 22 bp, Artificial Sequence
  Synthetic oligonucleotide; TTA chr11 5355163 5355184 5355168 5355163 -
gacagaggctcctatccttcct

SEQ ID NO: 121280 - DNA, 22 bp, Artificial Sequence
  Synthetic oligonucleotide; CTC chr11 5355152 5355173 5355157 5355152 -
ctatccttcctcctgaagctct

SEQ ID NO: 121281 - DNA, 22 bp, Artificial Sequence
  Synthetic oligonucleotide; CTA chr11 5355149 5355170 5355154 5355149 -
tccttcctcctgaagctctgtt

SEQ ID NO: 121282 - DNA, 22 bp, Artificial Sequence
  Synthetic oligonucleotide; CTT chr11 5355144 5355165 5355149 5355144 -
cctcctgaagctctgttgagcc

SEQ ID NO: 121283 - DNA, 22 bp, Artificial Sequence
  Synthetic oligonucleotide; TTC chr11 5355143 5355164 5355148 5355143 -
ctcctgaagctctgttgagccc

SEQ ID NO: 121284 - DNA, 22 bp, Artificial Sequence
  Synthetic oligonucleotide; CTC chr11 5355140 5355161 5355145 5355140 -
ctgaagctctgttgagcccgat

SEQ ID NO: 121285 - DNA, 22 bp, Artificial Sequence
  Synthetic oligonucleotide; CTG chr11 5355137 5355158 5355142 5355137 -
aagctctgttgagcccgatgga

SEQ ID NO: 121286 - DNA, 22 bp, Artificial Sequence
  Synthetic oligonucleotide; CTC chr11 5355131 5355152 5355136 5355131 -
tgttgagcccgatggaggtggg

SEQ ID NO: 121287 - DNA, 22 bp, Artificial Sequence
  Synthetic oligonucleotide; CTG chr11 5355129 5355150 5355134 5355129 -
ttgagcccgatggaggtgggca

SEQ ID NO: 121288 - DNA, 22 bp, Artificial Sequence
  Synthetic oligonucleotide; TTG chr11 5355126 5355147 5355131 5355126 -
agcccgatggaggtgggcaggc

SEQ ID NO: 121289 - DNA, 22 bp, Artificial Sequence
  Synthetic oligonucleotide; CTG chr11 5355100 5355121 5355105 5355100 -
tcatagtccgtaagcttcctgc

SEQ ID NO: 121290 - DNA, 22 bp, Artificial Sequence
  Synthetic oligonucleotide; CTT chr11 5355083 5355104 5355088 5355083 -
cctgctgcacttggtgatgtga

SEQ ID NO: 121291 - DNA, 22 bp, Artificial Sequence
  Synthetic oligonucleotide; TTC chr11 5355082 5355103 5355087 5355082 -
ctgctgcacttggtgatgtgat

SEQ ID NO: 121292 - DNA, 22 bp, Artificial Sequence
  Synthetic oligonucleotide; CTG chr11 5355079 5355100 5355084 5355079 -
ctgcacttggtgatgtgattct

SEQ ID NO: 121293 - DNA, 22 bp, Artificial Sequence
  Synthetic oligonucleotide; CTG chr11 5355076 5355097 5355081 5355076 -
cacttggtgatgtgattcttca

SEQ ID NO: 121294 - DNA, 22 bp, Artificial Sequence
  Synthetic oligonucleotide; CTT chr11 5355071 5355092 5355076 5355071 -
ggtgatgtgattcttcaagtca

SEQ ID NO: 121295 - DNA, 22 bp, Artificial Sequence
  Synthetic oligonucleotide; TTG chr11 5355070 5355091 5355075 5355070 -
gtgatgtgattcttcaagtcag

SEQ ID NO: 121296 - DNA, 22 bp, Artificial Sequence
  Synthetic oligonucleotide; TTC chr11 5355058 5355079 5355063 5355058 -
ttcaagtcaggaaattggtcca

SEQ ID NO: 121297 - DNA, 22 bp, Artificial Sequence
  Synthetic oligonucleotide; CTT chr11 5355056 5355077 5355061 5355056 -
caagtcaggaaattggtccagg

SEQ ID NO: 121298 - DNA, 22 bp, Artificial Sequence
  Synthetic oligonucleotide; TTC chr11 5355055 5355076 5355060 5355055 -
aagtcaggaaattggtccaggt

SEQ ID NO: 121299 - DNA, 22 bp, Artificial Sequence
  Synthetic oligonucleotide; TTG chr11 5355041 5355062 5355046 5355041 -
gtccaggtagttttccagtgtt

SEQ ID NO: 121300 - DNA, 22 bp, Artificial Sequence
  Synthetic oligonucleotide; TTT chr11 5355028 5355049 5355033 5355028 -
tccagtgttagcaaggatgcat

SEQ ID NO: 121301 - DNA, 22 bp, Artificial Sequence
  Synthetic oligonucleotide; TTT chr11 5355027 5355048 5355032 5355027 -
ccagtgttagcaaggatgcatc

SEQ ID NO: 121302 - DNA, 22 bp, Artificial Sequence
  Synthetic oligonucleotide; TTC chr11 5355026 5355047 5355031 5355026 -
cagtgttagcaaggatgcatcc

SEQ ID NO: 121303 - DNA, 22 bp, Artificial Sequence
  Synthetic oligonucleotide; TTA chr11 5355018 5355039 5355023 5355018 -
gcaaggatgcatccatgagttt

SEQ ID NO: 121304 - DNA, 22 bp, Artificial Sequence
  Synthetic oligonucleotide; TTT chr11 5354996 5355017 5355001 5354996 -
tttgtggatatcctcccagagc

SEQ ID NO: 121305 - DNA, 22 bp, Artificial Sequence
  Synthetic oligonucleotide; TTT chr11 5354995 5355016 5355000 5354995 -
ttgtggatatcctcccagagca

SEQ ID NO: 121306 - DNA, 22 bp, Artificial Sequence
  Synthetic oligonucleotide; TTT chr11 5354994 5355015 5354999 5354994 -
tgtggatatcctcccagagcac

SEQ ID NO: 121307 - DNA, 22 bp, Artificial Sequence
  Synthetic oligonucleotide; TTT chr11 5354993 5355014 5354998 5354993 -
gtggatatcctcccagagcaca

SEQ ID NO: 121308 - DNA, 22 bp, Artificial Sequence
  Synthetic oligonucleotide; TTG chr11 5354992 5355013 5354997 5354992 -
tggatatcctcccagagcacat

SEQ ID NO: 121309 - DNA, 22 bp, Artificial Sequence
  Synthetic oligonucleotide; CTC chr11 5354981 5355002 5354986 5354981 -
ccagagcacatcacctttctca

SEQ ID NO: 121310 - DNA, 22 bp, Artificial Sequence
  Synthetic oligonucleotide; CTT chr11 5354964 5354985 5354969 5354964 -
tctcaccaaccattttcacacc

SEQ ID NO: 121311 - DNA, 22 bp, Artificial Sequence
  Synthetic oligonucleotide; TTT chr11 5354963 5354984 5354968 5354963 -
ctcaccaaccattttcacacct

SEQ ID NO: 121312 - DNA, 22 bp, Artificial Sequence
  Synthetic oligonucleotide; TTC chr11 5354962 5354983 5354967 5354962 -
tcaccaaccattttcacacctt

SEQ ID NO: 121313 - DNA, 22 bp, Artificial Sequence
  Synthetic oligonucleotide; CTC chr11 5354960 5354981 5354965 5354960 -
accaaccattttcacaccttcc

SEQ ID NO: 121314 - DNA, 22 bp, Artificial Sequence
  Synthetic oligonucleotide; TTT chr11 5354949 5354970 5354954 5354949 -
tcacaccttcctgcccagacca

SEQ ID NO: 121315 - DNA, 22 bp, Artificial Sequence
  Synthetic oligonucleotide; TTT chr11 5354948 5354969 5354953 5354948 -
cacaccttcctgcccagaccaa

SEQ ID NO: 121316 - DNA, 22 bp, Artificial Sequence
  Synthetic oligonucleotide; TTC chr11 5354947 5354968 5354952 5354947 -
acaccttcctgcccagaccaat

SEQ ID NO: 121317 - DNA, 22 bp, Artificial Sequence
  Synthetic oligonucleotide; CTT chr11 5354940 5354961 5354945 5354940 -
cctgcccagaccaatccagcgc

SEQ ID NO: 121318 - DNA, 22 bp, Artificial Sequence
  Synthetic oligonucleotide; TTC chr11 5354939 5354960 5354944 5354939 -
ctgcccagaccaatccagcgca

SEQ ID NO: 121319 - DNA, 22 bp, Artificial Sequence
  Synthetic oligonucleotide; CTG chr11 5354936 5354957 5354941 5354936 -
cccagaccaatccagcgcacag

SEQ ID NO: 121320 - DNA, 22 bp, Artificial Sequence
  Synthetic oligonucleotide; CTT chr11 5354910 5354931 5354915 5354910 -
cacacagtgactcagcttcgtc

SEQ ID NO: 121321 - DNA, 22 bp, Artificial Sequence
  Synthetic oligonucleotide; TTC chr11 5354909 5354930 5354914 5354909 -
acacagtgactcagcttcgtca

SEQ ID NO: 121322 - DNA, 22 bp, Artificial Sequence
  Synthetic oligonucleotide; CTC chr11 5354897 5354918 5354902 5354897 -
agcttcgtcaaggtctcttgaa

SEQ ID NO: 121323 - DNA, 22 bp, Artificial Sequence
  Synthetic oligonucleotide; CTT chr11 5354892 5354913 5354897 5354892 -
cgtcaaggtctcttgaatgcct

SEQ ID NO: 121324 - DNA, 22 bp, Artificial Sequence
  Synthetic oligonucleotide; TTC chr11 5354891 5354912 5354896 5354891 -
gtcaaggtctcttgaatgcctt

SEQ ID NO: 121325 - DNA, 22 bp, Artificial Sequence
  Synthetic oligonucleotide; CTC chr11 5354880 5354901 5354885 5354880 -
ttgaatgcctttgattgcttct

SEQ ID NO: 121326 - DNA, 22 bp, Artificial Sequence
  Synthetic oligonucleotide; CTT chr11 5354878 5354899 5354883 5354878 -
gaatgcctttgattgcttctaa

SEQ ID NO: 121327 - DNA, 22 bp, Artificial Sequence
  Synthetic oligonucleotide; TTG chr11 5354877 5354898 5354882 5354877 -
aatgcctttgattgcttctaaa

SEQ ID NO: 121328 - DNA, 22 bp, Artificial Sequence
  Synthetic oligonucleotide; CTT chr11 5354869 5354890 5354874 5354869 -
tgattgcttctaaacatcctca

SEQ ID NO: 121329 - DNA, 22 bp, Artificial Sequence
  Synthetic oligonucleotide; TTT chr11 5354868 5354889 5354873 5354868 -
gattgcttctaaacatcctcag

SEQ ID NO: 121330 - DNA, 22 bp, Artificial Sequence
  Synthetic oligonucleotide; TTG chr11 5354867 5354888 5354872 5354867 -
attgcttctaaacatcctcaga

SEQ ID NO: 121331 - DNA, 22 bp, Artificial Sequence
  Synthetic oligonucleotide; TTG chr11 5354863 5354884 5354868 5354863 -
cttctaaacatcctcagagttc

SEQ ID NO: 121332 - DNA, 22 bp, Artificial Sequence
  Synthetic oligonucleotide; CTT chr11 5354860 5354881 5354865 5354860 -
ctaaacatcctcagagttctct

SEQ ID NO: 121333 - DNA, 22 bp, Artificial Sequence
  Synthetic oligonucleotide; TTC chr11 5354859 5354880 5354864 5354859 -
taaacatcctcagagttctctc

SEQ ID NO: 121334 - DNA, 22 bp, Artificial Sequence
  Synthetic oligonucleotide; CTA chr11 5354857 5354878 5354862 5354857 -
aacatcctcagagttctctcag

SEQ ID NO: 121335 - DNA, 22 bp, Artificial Sequence
  Synthetic oligonucleotide; CTC chr11 5354848 5354869 5354853 5354848 -
agagttctctcaggtctggtac

SEQ ID NO: 121336 - DNA, 22 bp, Artificial Sequence
  Synthetic oligonucleotide; TTC chr11 5354841 5354862 5354846 5354841 -
tctcaggtctggtaccctctgc

SEQ ID NO: 121337 - DNA, 22 bp, Artificial Sequence
  Synthetic oligonucleotide; CTC chr11 5354839 5354860 5354844 5354839 -
tcaggtctggtaccctctgctt

SEQ ID NO: 121338 - DNA, 22 bp, Artificial Sequence
  Synthetic oligonucleotide; CTC chr11 5354837 5354858 5354842 5354837 -
aggtctggtaccctctgcttct

SEQ ID NO: 121339 - DNA, 22 bp, Artificial Sequence
  Synthetic oligonucleotide; CTG chr11 5354830 5354851 5354835 5354830 -
gtaccctctgcttcttgtggct

SEQ ID NO: 121340 - DNA, 22 bp, Artificial Sequence
  Synthetic oligonucleotide; CTC chr11 5354822 5354843 5354827 5354822 -
tgcttcttgtggcttgaagttc

SEQ ID NO: 121341 - DNA, 22 bp, Artificial Sequence
  Synthetic oligonucleotide; CTG chr11 5354820 5354841 5354825 5354820 -
cttcttgtggcttgaagttctg

SEQ ID NO: 121342 - DNA, 22 bp, Artificial Sequence
  Synthetic oligonucleotide; CTT chr11 5354817 5354838 5354822 5354817 -
cttgtggcttgaagttctggac

SEQ ID NO: 121343 - DNA, 22 bp, Artificial Sequence
  Synthetic oligonucleotide; TTC chr11 5354816 5354837 5354821 5354816 -
ttgtggcttgaagttctggaca

SEQ ID NO: 121344 - DNA, 22 bp, Artificial Sequence
  Synthetic oligonucleotide; CTT chr11 5354814 5354835 5354819 5354814 -
gtggcttgaagttctggacata

SEQ ID NO: 121345 - DNA, 22 bp, Artificial Sequence
  Synthetic oligonucleotide; TTG chr11 5354813 5354834 5354818 5354813 -
tggcttgaagttctggacatat

SEQ ID NO: 121346 - DNA, 22 bp, Artificial Sequence
  Synthetic oligonucleotide; CTT chr11 5354807 5354828 5354812 5354807 -
gaagttctggacatattcttca

SEQ ID NO: 121347 - DNA, 22 bp, Artificial Sequence
  Synthetic oligonucleotide; TTG chr11 5354806 5354827 5354811 5354806 -
aagttctggacatattcttcaa

SEQ ID NO: 121348 - DNA, 22 bp, Artificial Sequence
  Synthetic oligonucleotide; TTC chr11 5354800 5354821 5354805 5354800 -
tggacatattcttcaaactgtt

SEQ ID NO: 121349 - DNA, 22 bp, Artificial Sequence
  Synthetic oligonucleotide; CTG chr11 5354798 5354819 5354803 5354798 -
gacatattcttcaaactgtttg

SEQ ID NO: 121350 - DNA, 22 bp, Artificial Sequence
  Synthetic oligonucleotide; TTC chr11 5354789 5354810 5354794 5354789 -
ttcaaactgtttgtcttttgtc

SEQ ID NO: 121351 - DNA, 22 bp, Artificial Sequence
  Synthetic oligonucleotide; CTT chr11 5354787 5354808 5354792 5354787 -
caaactgtttgtcttttgtctc

SEQ ID NO: 121352 - DNA, 22 bp, Artificial Sequence
  Synthetic oligonucleotide; TTC chr11 5354786 5354807 5354791 5354786 -
aaactgtttgtcttttgtctca

SEQ ID NO: 121353 - DNA, 22 bp, Artificial Sequence
  Synthetic oligonucleotide; CTG chr11 5354780 5354801 5354785 5354780 -
tttgtcttttgtctcagcagct

SEQ ID NO: 121354 - DNA, 22 bp, Artificial Sequence
  Synthetic oligonucleotide; TTT chr11 5354777 5354798 5354782 5354777 -
gtcttttgtctcagcagctttc

SEQ ID NO: 121355 - DNA, 22 bp, Artificial Sequence
  Synthetic oligonucleotide; TTG chr11 5354776 5354797 5354781 5354776 -
tcttttgtctcagcagctttcc

SEQ ID NO: 121356 - DNA, 22 bp, Artificial Sequence
  Synthetic oligonucleotide; CTT chr11 5354772 5354793 5354777 5354772 -
ttgtctcagcagctttccctgg

SEQ ID NO: 121357 - DNA, 22 bp, Artificial Sequence
  Synthetic oligonucleotide; TTT chr11 5354771 5354792 5354776 5354771 -
tgtctcagcagctttccctggc

SEQ ID NO: 121358 - DNA, 22 bp, Artificial Sequence
  Synthetic oligonucleotide; TTT chr11 5354770 5354791 5354775 5354770 -
gtctcagcagctttccctggct

SEQ ID NO: 121359 - DNA, 22 bp, Artificial Sequence
  Synthetic oligonucleotide; TTG chr11 5354769 5354790 5354774 5354769 -
tctcagcagctttccctggctt

SEQ ID NO: 121360 - DNA, 22 bp, Artificial Sequence
  Synthetic oligonucleotide; CTC chr11 5354765 5354786 5354770 5354765 -
agcagctttccctggcttctgg

SEQ ID NO: 121361 - DNA, 22 bp, Artificial Sequence
  Synthetic oligonucleotide; CTT chr11 5354757 5354778 5354762 5354757 -
tccctggcttctggaggacgtt

SEQ ID NO: 121362 - DNA, 22 bp, Artificial Sequence
  Synthetic oligonucleotide; TTT chr11 5354756 5354777 5354761 5354756 -
ccctggcttctggaggacgttt

SEQ ID NO: 121363 - DNA, 22 bp, Artificial Sequence
  Synthetic oligonucleotide; TTC chr11 5354755 5354776 5354760 5354755 -
cctggcttctggaggacgtttt

SEQ ID NO: 121364 - DNA, 22 bp, Artificial Sequence
  Synthetic oligonucleotide; CTG chr11 5354751 5354772 5354756 5354751 -
gcttctggaggacgttttcctg

SEQ ID NO: 121365 - DNA, 22 bp, Artificial Sequence
  Synthetic oligonucleotide; CTT chr11 5354747 5354768 5354752 5354747 -
ctggaggacgttttcctgtgag

SEQ ID NO: 121366 - DNA, 22 bp, Artificial Sequence
  Synthetic oligonucleotide; TTC chr11 5354746 5354767 5354751 5354746 -
tggaggacgttttcctgtgagt

SEQ ID NO: 121367 - DNA, 22 bp, Artificial Sequence
  Synthetic oligonucleotide; CTG chr11 5354744 5354765 5354749 5354744 -
gaggacgttttcctgtgagtgg

SEQ ID NO: 121368 - DNA, 22 bp, Artificial Sequence
  Synthetic oligonucleotide; TTT chr11 5354734 5354755 5354739 5354734 -
tcctgtgagtggctgagtctct

SEQ ID NO: 121369 - DNA, 22 bp, Artificial Sequence
  Synthetic oligonucleotide; TTT chr11 5354733 5354754 5354738 5354733 -
cctgtgagtggctgagtctctt

SEQ ID NO: 121370 - DNA, 22 bp, Artificial Sequence
  Synthetic oligonucleotide; TTC chr11 5354732 5354753 5354737 5354732 -
ctgtgagtggctgagtctcttc

SEQ ID NO: 121371 - DNA, 22 bp, Artificial Sequence
  Synthetic oligonucleotide; CTG chr11 5354729 5354750 5354734 5354729 -
tgagtggctgagtctcttccag

SEQ ID NO: 121372 - DNA, 22 bp, Artificial Sequence
  Synthetic oligonucleotide; CTG chr11 5354719 5354740 5354724 5354719 -
agtctcttccaggcattcttgg

SEQ ID NO: 121373 - DNA, 22 bp, Artificial Sequence
  Synthetic oligonucleotide; CTC chr11 5354713 5354734 5354718 5354713 -
ttccaggcattcttggcaaaga

SEQ ID NO: 121374 - DNA, 22 bp, Artificial Sequence
  Synthetic oligonucleotide; CTT chr11 5354711 5354732 5354716 5354711 -
ccaggcattcttggcaaagatg

SEQ ID NO: 121375 - DNA, 22 bp, Artificial Sequence
  Synthetic oligonucleotide; TTC chr11 5354710 5354731 5354715 5354710 -
caggcattcttggcaaagatgc

SEQ ID NO: 121376 - DNA, 22 bp, Artificial Sequence
  Synthetic oligonucleotide; TTC chr11 5354701 5354722 5354706 5354701 -
ttggcaaagatgccctcttgat

SEQ ID NO: 121377 - DNA, 22 bp, Artificial Sequence
  Synthetic oligonucleotide; CTT chr11 5354699 5354720 5354704 5354699 -
ggcaaagatgccctcttgatgt

SEQ ID NO: 121378 - DNA, 22 bp, Artificial Sequence
  Synthetic oligonucleotide; TTG chr11 5354698 5354719 5354703 5354698 -
gcaaagatgccctcttgatgtt

SEQ ID NO: 121379 - DNA, 22 bp, Artificial Sequence
  Synthetic oligonucleotide; CTC chr11 5354684 5354705 5354689 5354684 -
ttgatgttggccagggctgcag

SEQ ID NO: 121380 - DNA, 22 bp, Artificial Sequence
  Synthetic oligonucleotide; CTT chr11 5354682 5354703 5354687 5354682 -
gatgttggccagggctgcaggt

SEQ ID NO: 121381 - DNA, 22 bp, Artificial Sequence
  Synthetic oligonucleotide; TTG chr11 5354681 5354702 5354686 5354681 -
atgttggccagggctgcaggtc

SEQ ID NO: 121382 - DNA, 22 bp, Artificial Sequence
  Synthetic oligonucleotide; TTG chr11 5354675 5354696 5354680 5354675 -
gccagggctgcaggtccaggac

SEQ ID NO: 121383 - DNA, 22 bp, Artificial Sequence
  Synthetic oligonucleotide; CTG chr11 5354665 5354686 5354670 5354665 -
caggtccaggacctgggaggag

SEQ ID NO: 121384 - DNA, 22 bp, Artificial Sequence
  Synthetic oligonucleotide; CTG chr11 5354650 5354671 5354655 5354650 -
ggaggagctgagcgctcagtgt

SEQ ID NO: 121385 - DNA, 22 bp, Artificial Sequence
  Synthetic oligonucleotide; CTG chr11 5354640 5354661 5354645 5354640 -
agcgctcagtgtggctggtggc

SEQ ID NO: 121386 - DNA, 22 bp, Artificial Sequence
  Synthetic oligonucleotide; CTC chr11 5354633 5354654 5354638 5354633 -
agtgtggctggtggcgtggagg

SEQ ID NO: 121387 - DNA, 22 bp, Artificial Sequence
  Synthetic oligonucleotide; CTG chr11 5354623 5354644 5354628 5354623 -
gtggcgtggaggggcgggagga

SEQ ID NO: 121388 - DNA, 22 bp, Artificial Sequence
  Synthetic oligonucleotide; CTT chr11 5354568 5354589 5354573 5354568 -
cgaccctactgttgatatgttg

SEQ ID NO: 121389 - DNA, 22 bp, Artificial Sequence
  Synthetic oligonucleotide; TTC chr11 5354567 5354588 5354572 5354567 -
gaccctactgttgatatgttgt

SEQ ID NO: 121390 - DNA, 22 bp, Artificial Sequence
  Synthetic oligonucleotide; CTA chr11 5354560 5354581 5354565 5354560 -
ctgttgatatgttgttcaggga

SEQ ID NO: 121391 - DNA, 22 bp, Artificial Sequence
  Synthetic oligonucleotide; CTG chr11 5354557 5354578 5354562 5354557 -
ttgatatgttgttcagggacca

SEQ ID NO: 121392 - DNA, 22 bp, Artificial Sequence
  Synthetic oligonucleotide; TTG chr11 5354554 5354575 5354559 5354554 -
atatgttgttcagggaccatcg

SEQ ID NO: 121393 - DNA, 22 bp, Artificial Sequence
  Synthetic oligonucleotide; TTG chr11 5354546 5354567 5354551 5354546 -
ttcagggaccatcgggagccca

SEQ ID NO: 121394 - DNA, 22 bp, Artificial Sequence
  Synthetic oligonucleotide; TTC chr11 5354543 5354564 5354548 5354543 -
agggaccatcgggagcccagag

SEQ ID NO: 121395 - DNA, 22 bp, Artificial Sequence
  Synthetic oligonucleotide; CTC chr11 5354518 5354539 5354523 5354518 -
tgctctgtttcacgggactcca

SEQ ID NO: 121396 - DNA, 22 bp, Artificial Sequence
  Synthetic oligonucleotide; CTG chr11 5354516 5354537 5354521 5354516 -
ctctgtttcacgggactccaca

SEQ ID NO: 121397 - DNA, 22 bp, Artificial Sequence
  Synthetic oligonucleotide; CTC chr11 5354513 5354534 5354518 5354513 -
tgtttcacgggactccacaaag

SEQ ID NO: 121398 - DNA, 22 bp, Artificial Sequence
  Synthetic oligonucleotide; CTG chr11 5354511 5354532 5354516 5354511 -
tttcacgggactccacaaagag

SEQ ID NO: 121399 - DNA, 22 bp, Artificial Sequence
  Synthetic oligonucleotide; TTT chr11 5354508 5354529 5354513 5354508 -
cacgggactccacaaagagaac

SEQ ID NO: 121400 - DNA, 22 bp, Artificial Sequence
  Synthetic oligonucleotide; TTC chr11 5354507 5354528 5354512 5354507 -
acgggactccacaaagagaact

SEQ ID NO: 121401 - DNA, 22 bp, Artificial Sequence
  Synthetic oligonucleotide; CTC chr11 5354498 5354519 5354503 5354498 -
cacaaagagaactgcaagtccc

SEQ ID NO: 121402 - DNA, 22 bp, Artificial Sequence
  Synthetic oligonucleotide; CTG chr11 5354484 5354505 5354489 5354484 -
caagtcccagtctttcacctct

SEQ ID NO: 121403 - DNA, 22 bp, Artificial Sequence
  Synthetic oligonucleotide; CTT chr11 5354470 5354491 5354475 5354470 -
tcacctctcttggactttttat

SEQ ID NO: 121404 - DNA, 22 bp, Artificial Sequence
  Synthetic oligonucleotide; TTT chr11 5354469 5354490 5354474 5354469 -
cacctctcttggactttttatc

SEQ ID NO: 121405 - DNA, 22 bp, Artificial Sequence
  Synthetic oligonucleotide; TTC chr11 5354468 5354489 5354473 5354468 -
acctctcttggactttttatct

SEQ ID NO: 121406 - DNA, 22 bp, Artificial Sequence
  Synthetic oligonucleotide; CTC chr11 5354463 5354484 5354468 5354463 -
tcttggactttttatcttgtct

SEQ ID NO: 121407 - DNA, 22 bp, Artificial Sequence
  Synthetic oligonucleotide; CTC chr11 5354461 5354482 5354466 5354461 -
ttggactttttatcttgtctct

SEQ ID NO: 121408 - DNA, 22 bp, Artificial Sequence
  Synthetic oligonucleotide; CTT chr11 5354459 5354480 5354464 5354459 -
ggactttttatcttgtctcttc

SEQ ID NO: 121409 - DNA, 22 bp, Artificial Sequence
  Synthetic oligonucleotide; TTG chr11 5354458 5354479 5354463 5354458 -
gactttttatcttgtctcttca

SEQ ID NO: 121410 - DNA, 22 bp, Artificial Sequence
  Synthetic oligonucleotide; CTT chr11 5354453 5354474 5354458 5354453 -
tttatcttgtctcttcatcaca

SEQ ID NO: 121411 - DNA, 22 bp, Artificial Sequence
  Synthetic oligonucleotide; TTT chr11 5354452 5354473 5354457 5354452 -
ttatcttgtctcttcatcacat

SEQ ID NO: 121412 - DNA, 22 bp, Artificial Sequence
  Synthetic oligonucleotide; TTT chr11 5354451 5354472 5354456 5354451 -
tatcttgtctcttcatcacatc

SEQ ID NO: 121413 - DNA, 22 bp, Artificial Sequence
  Synthetic oligonucleotide; TTT chr11 5354450 5354471 5354455 5354450 -
atcttgtctcttcatcacatct

SEQ ID NO: 121414 - DNA, 22 bp, Artificial Sequence
  Synthetic oligonucleotide; TTA chr11 5354449 5354470 5354454 5354449 -
tcttgtctcttcatcacatctc

SEQ ID NO: 121415 - DNA, 22 bp, Artificial Sequence
  Synthetic oligonucleotide; CTT chr11 5354445 5354466 5354450 5354445 -
gtctcttcatcacatctcttca

SEQ ID NO: 121416 - DNA, 22 bp, Artificial Sequence
  Synthetic oligonucleotide; TTG chr11 5354444 5354465 5354449 5354444 -
tctcttcatcacatctcttcag

SEQ ID NO: 121417 - DNA, 22 bp, Artificial Sequence
  Synthetic oligonucleotide; CTC chr11 5354440 5354461 5354445 5354440 -
ttcatcacatctcttcagtata

SEQ ID NO: 121418 - DNA, 22 bp, Artificial Sequence
  Synthetic oligonucleotide; CTT chr11 5354438 5354459 5354443 5354438 -
catcacatctcttcagtataag

SEQ ID NO: 121419 - DNA, 22 bp, Artificial Sequence
  Synthetic oligonucleotide; TTC chr11 5354437 5354458 5354442 5354437 -
atcacatctcttcagtataagg

SEQ ID NO: 121420 - DNA, 22 bp, Artificial Sequence
  Synthetic oligonucleotide; CTC chr11 5354427 5354448 5354432 5354427 -
ttcagtataaggaagaacagaa

SEQ ID NO: 121421 - DNA, 22 bp, Artificial Sequence
  Synthetic oligonucleotide; CTT chr11 5354425 5354446 5354430 5354425 -
cagtataaggaagaacagaaag

SEQ ID NO: 121422 - DNA, 22 bp, Artificial Sequence
  Synthetic oligonucleotide; TTC chr11 5354424 5354445 5354429 5354424 -
agtataaggaagaacagaaagg

SEQ ID NO: 121423 - DNA, 22 bp, Artificial Sequence
  Synthetic oligonucleotide; CTC chr11 5354388 5354409 5354393 5354388 -
agggttgtcagtcaaatgtgtc

SEQ ID NO: 121424 - DNA, 22 bp, Artificial Sequence
  Synthetic oligonucleotide; TTG chr11 5354381 5354402 5354386 5354381 -
tcagtcaaatgtgtccatttac

SEQ ID NO: 121425 - DNA, 22 bp, Artificial Sequence
  Synthetic oligonucleotide; TTT chr11 5354361 5354382 5354366 5354361 -
acagaatttataaaatgtattg

SEQ ID NO: 121426 - DNA, 22 bp, Artificial Sequence
  Synthetic oligonucleotide; TTA chr11 5354360 5354381 5354365 5354360 -
cagaatttataaaatgtattgt

SEQ ID NO: 121427 - DNA, 22 bp, Artificial Sequence
  Synthetic oligonucleotide; TTT chr11 5354352 5354373 5354357 5354352 -
ataaaatgtattgttatcctag

SEQ ID NO: 121428 - DNA, 22 bp, Artificial Sequence
  Synthetic oligonucleotide; TTA chr11 5354351 5354372 5354356 5354351 -
taaaatgtattgttatcctagt

SEQ ID NO: 121429 - DNA, 22 bp, Artificial Sequence
  Synthetic oligonucleotide; TTG chr11 5354339 5354360 5354344 5354339 -
ttatcctagttatctttatact

SEQ ID NO: 121430 - DNA, 22 bp, Artificial Sequence
  Synthetic oligonucleotide; TTA chr11 5354336 5354357 5354341 5354336 -
tcctagttatctttatactagc

SEQ ID NO: 121431 - DNA, 22 bp, Artificial Sequence
  Synthetic oligonucleotide; CTA chr11 5354331 5354352 5354336 5354331 -
gttatctttatactagcctgct

SEQ ID NO: 121432 - DNA, 22 bp, Artificial Sequence
  Synthetic oligonucleotide; TTA chr11 5354327 5354348 5354332 5354327 -
tctttatactagcctgctatgg

SEQ ID NO: 121433 - DNA, 22 bp, Artificial Sequence
  Synthetic oligonucleotide; CTT chr11 5354323 5354344 5354328 5354323 -
tatactagcctgctatggcagg

SEQ ID NO: 121434 - DNA, 22 bp, Artificial Sequence
  Synthetic oligonucleotide; TTT chr11 5354322 5354343 5354327 5354322 -
atactagcctgctatggcaggt

SEQ ID NO: 121435 - DNA, 22 bp, Artificial Sequence
  Synthetic oligonucleotide; TTA chr11 5354321 5354342 5354326 5354321 -
tactagcctgctatggcaggtt

SEQ ID NO: 121436 - DNA, 22 bp, Artificial Sequence
  Synthetic oligonucleotide; CTA chr11 5354316 5354337 5354321 5354316 -
gcctgctatggcaggtttcagg

SEQ ID NO: 121437 - DNA, 22 bp, Artificial Sequence
  Synthetic oligonucleotide; CTG chr11 5354311 5354332 5354316 5354311 -
ctatggcaggtttcaggatcac

SEQ ID NO: 121438 - DNA, 22 bp, Artificial Sequence
  Synthetic oligonucleotide; CTA chr11 5354308 5354329 5354313 5354308 -
tggcaggtttcaggatcactgg

SEQ ID NO: 121439 - DNA, 22 bp, Artificial Sequence
  Synthetic oligonucleotide; TTT chr11 5354298 5354319 5354303 5354298 -
caggatcactggacctagaggg

SEQ ID NO: 121440 - DNA, 22 bp, Artificial Sequence
  Synthetic oligonucleotide; TTC chr11 5354297 5354318 5354302 5354297 -
aggatcactggacctagagggt

SEQ ID NO: 121441 - DNA, 22 bp, Artificial Sequence
  Synthetic oligonucleotide; CTG chr11 5354287 5354308 5354292 5354287 -
gacctagagggtgagtcaagaa

SEQ ID NO: 121442 - DNA, 22 bp, Artificial Sequence
  Synthetic oligonucleotide; CTA chr11 5354281 5354302 5354286 5354281 -
gagggtgagtcaagaaagattt

SEQ ID NO: 121443 - DNA, 22 bp, Artificial Sequence
  Synthetic oligonucleotide; TTT chr11 5354259 5354280 5354264 5354259 -
tctttgatgtggcttagatccc

SEQ ID NO: 121444 - DNA, 22 bp, Artificial Sequence
  Synthetic oligonucleotide; TTT chr11 5354258 5354279 5354263 5354258 -
ctttgatgtggcttagatcccc

SEQ ID NO: 121445 - DNA, 22 bp, Artificial Sequence
  Synthetic oligonucleotide; TTC chr11 5354257 5354278 5354262 5354257 -
tttgatgtggcttagatccccc

SEQ ID NO: 121446 - DNA, 22 bp, Artificial Sequence
  Synthetic oligonucleotide; CTT chr11 5354255 5354276 5354260 5354255 -
tgatgtggcttagatccccctg

SEQ ID NO: 121447 - DNA, 22 bp, Artificial Sequence
  Synthetic oligonucleotide; TTT chr11 5354254 5354275 5354259 5354254 -
gatgtggcttagatccccctga

SEQ ID NO: 121448 - DNA, 22 bp, Artificial Sequence
  Synthetic oligonucleotide; TTG chr11 5354253 5354274 5354258 5354253 -
atgtggcttagatccccctgaa

SEQ ID NO: 121449 - DNA, 22 bp, Artificial Sequence
  Synthetic oligonucleotide; CTT chr11 5354244 5354265 5354249 5354244 -
agatccccctgaattcattccc

SEQ ID NO: 121450 - DNA, 22 bp, Artificial Sequence
  Synthetic oligonucleotide; TTA chr11 5354243 5354264 5354248 5354243 -
gatccccctgaattcattccca

SEQ ID NO: 121451 - DNA, 22 bp, Artificial Sequence
  Synthetic oligonucleotide; CTG chr11 5354233 5354254 5354238 5354233 -
aattcattcccaaaagcccaag

SEQ ID NO: 121452 - DNA, 22 bp, Artificial Sequence
  Synthetic oligonucleotide; TTC chr11 5354228 5354249 5354233 5354228 -
attcccaaaagcccaagggaag

SEQ ID NO: 121453 - DNA, 22 bp, Artificial Sequence
  Synthetic oligonucleotide; TTC chr11 5354224 5354245 5354229 5354224 -
ccaaaagcccaagggaagaaag

SEQ ID NO: 121454 - DNA, 22 bp, Artificial Sequence
  Synthetic oligonucleotide; TTA chr11 5354192 5354213 5354197 5354192 -
agtatacattgcccatatcttg

SEQ ID NO: 121455 - DNA, 22 bp, Artificial Sequence
  Synthetic oligonucleotide; TTG chr11 5354181 5354202 5354186 5354181 -
cccatatcttggaagacaatac

SEQ ID NO: 121456 - DNA, 22 bp, Artificial Sequence
  Synthetic oligonucleotide; CTT chr11 5354171 5354192 5354176 5354171 -
ggaagacaatacagagagcagt

SEQ ID NO: 121457 - DNA, 22 bp, Artificial Sequence
  Synthetic oligonucleotide; TTG chr11 5354170 5354191 5354175 5354170 -
gaagacaatacagagagcagta

SEQ ID NO: 121458 - DNA, 22 bp, Artificial Sequence
  Synthetic oligonucleotide; CTA chr11 5354132 5354153 5354137 5354132 -
gcagacacacagaaagacatgg

SEQ ID NO: 121459 - DNA, 22 bp, Artificial Sequence
  Synthetic oligonucleotide; CTT chr11 5354103 5354124 5354108 5354103 -
taaattttatttattcatttta

SEQ ID NO: 121460 - DNA, 22 bp, Artificial Sequence
  Synthetic oligonucleotide; TTT chr11 5354102 5354123 5354107 5354102 -
aaattttatttattcattttaa

SEQ ID NO: 121461 - DNA, 22 bp, Artificial Sequence
  Synthetic oligonucleotide; TTA chr11 5354101 5354122 5354106 5354101 -
aattttatttattcattttaat

SEQ ID NO: 121462 - DNA, 22 bp, Artificial Sequence
  Synthetic oligonucleotide; TTT chr11 5354096 5354117 5354101 5354096 -
tatttattcattttaatgaaaa

SEQ ID NO: 121463 - DNA, 22 bp, Artificial Sequence
  Synthetic oligonucleotide; TTT chr11 5354095 5354116 5354100 5354095 -
atttattcattttaatgaaaaa

SEQ ID NO: 121464 - DNA, 22 bp, Artificial Sequence
  Synthetic oligonucleotide; TTA chr11 5354094 5354115 5354099 5354094 -
tttattcattttaatgaaaaat

SEQ ID NO: 121465 - DNA, 22 bp, Artificial Sequence
  Synthetic oligonucleotide; TTT chr11 5354091 5354112 5354096 5354091 -
attcattttaatgaaaaattat

SEQ ID NO: 121466 - DNA, 22 bp, Artificial Sequence
  Synthetic oligonucleotide; TTA chr11 5354090 5354111 5354095 5354090 -
ttcattttaatgaaaaattata

SEQ ID NO: 121467 - DNA, 22 bp, Artificial Sequence
  Synthetic oligonucleotide; TTC chr11 5354087 5354108 5354092 5354087 -
attttaatgaaaaattatattt

SEQ ID NO: 121468 - DNA, 22 bp, Artificial Sequence
  Synthetic oligonucleotide; TTT chr11 5354083 5354104 5354088 5354083 -
taatgaaaaattatattttgtt

SEQ ID NO: 121469 - DNA, 22 bp, Artificial Sequence
  Synthetic oligonucleotide; TTT chr11 5354082 5354103 5354087 5354082 -
aatgaaaaattatattttgtta

SEQ ID NO: 121470 - DNA, 22 bp, Artificial Sequence
  Synthetic oligonucleotide; TTA chr11 5354081 5354102 5354086 5354081 -
atgaaaaattatattttgttaa

SEQ ID NO: 121471 - DNA, 22 bp, Artificial Sequence
  Synthetic oligonucleotide; TTA chr11 5354070 5354091 5354075 5354070 -
tattttgttaaaaatggtctat

SEQ ID NO: 121472 - DNA, 22 bp, Artificial Sequence
  Synthetic oligonucleotide; TTT chr11 5354065 5354086 5354070 5354065 -
tgttaaaaatggtctatgtgag

SEQ ID NO: 121473 - DNA, 22 bp, Artificial Sequence
  Synthetic oligonucleotide; TTT chr11 5354064 5354085 5354069 5354064 -
gttaaaaatggtctatgtgaga

SEQ ID NO: 121474 - DNA, 22 bp, Artificial Sequence
  Synthetic oligonucleotide; TTG chr11 5354063 5354084 5354068 5354063 -
ttaaaaatggtctatgtgagaa

SEQ ID NO: 121475 - DNA, 22 bp, Artificial Sequence
  Synthetic oligonucleotide; TTA chr11 5354060 5354081 5354065 5354060 -
aaaatggtctatgtgagaagtt

SEQ ID NO: 121476 - DNA, 22 bp, Artificial Sequence
  Synthetic oligonucleotide; CTA chr11 5354049 5354070 5354054 5354049 -
tgtgagaagttctgtaatacag

SEQ ID NO: 121477 - DNA, 22 bp, Artificial Sequence
  Synthetic oligonucleotide; TTC chr11 5354037 5354058 5354042 5354037 -
tgtaatacagtagggaataaga

SEQ ID NO: 121478 - DNA, 22 bp, Artificial Sequence
  Synthetic oligonucleotide; CTG chr11 5354035 5354056 5354040 5354035 -
taatacagtagggaataagaac

SEQ ID NO: 121479 - DNA, 22 bp, Artificial Sequence
  Synthetic oligonucleotide; CTA chr11 5354011 5354032 5354016 5354011 -
tgttatatttaccatcctcgag

SEQ ID NO: 121480 - DNA, 22 bp, Artificial Sequence
  Synthetic oligonucleotide; TTA chr11 5354006 5354027 5354011 5354006 -
tatttaccatcctcgagcacac

SEQ ID NO: 121481 - DNA, 22 bp, Artificial Sequence
  Synthetic oligonucleotide; TTT chr11 5354001 5354022 5354006 5354001 -
accatcctcgagcacacagtca

SEQ ID NO: 121482 - DNA, 22 bp, Artificial Sequence
  Synthetic oligonucleotide; TTA chr11 5354000 5354021 5354005 5354000 -
ccatcctcgagcacacagtcaa

SEQ ID NO: 121483 - DNA, 22 bp, Artificial Sequence
  Synthetic oligonucleotide; CTC chr11 5353992 5354013 5353997 5353992 -
gagcacacagtcaagaagctac

SEQ ID NO: 121484 - DNA, 22 bp, Artificial Sequence
  Synthetic oligonucleotide; CTA chr11 5353971 5353992 5353976 5353971 -
caaaagagaaaggcaaatttca

SEQ ID NO: 121485 - DNA, 22 bp, Artificial Sequence
  Synthetic oligonucleotide; TTT chr11 5353951 5353972 5353956 5353951 -
cacacacagccaagttgagtaa

SEQ ID NO: 121486 - DNA, 22 bp, Artificial Sequence
  Synthetic oligonucleotide; TTC chr11 5353950 5353971 5353955 5353950 -
acacacagccaagttgagtaaa

SEQ ID NO: 121487 - DNA, 22 bp, Artificial Sequence
  Synthetic oligonucleotide; TTG chr11 5353934 5353955 5353939 5353934 -
agtaaaacaaacaaaatctttt

SEQ ID NO: 121488 - DNA, 22 bp, Artificial Sequence
  Synthetic oligonucleotide; CTT chr11 5353914 5353935 5353919 5353914 -
ttggtctaatcagataaagatc

SEQ ID NO: 121489 - DNA, 22 bp, Artificial Sequence
  Synthetic oligonucleotide; TTT chr11 5353913 5353934 5353918 5353913 -
tggtctaatcagataaagatca

SEQ ID NO: 121490 - DNA, 22 bp, Artificial Sequence
  Synthetic oligonucleotide; TTT chr11 5353912 5353933 5353917 5353912 -
ggtctaatcagataaagatcat

SEQ ID NO: 121491 - DNA, 22 bp, Artificial Sequence
  Synthetic oligonucleotide; TTG chr11 5353911 5353932 5353916 5353911 -
gtctaatcagataaagatcatt

SEQ ID NO: 121492 - DNA, 22 bp, Artificial Sequence
  Synthetic oligonucleotide; CTA chr11 5353906 5353927 5353911 5353906 -
atcagataaagatcatttacta

SEQ ID NO: 121493 - DNA, 22 bp, Artificial Sequence
  Synthetic oligonucleotide; TTT chr11 5353888 5353909 5353893 5353888 -
actagcctggaaactattgtga

SEQ ID NO: 121494 - DNA, 22 bp, Artificial Sequence
  Synthetic oligonucleotide; TTA chr11 5353887 5353908 5353892 5353887 -
ctagcctggaaactattgtgaa

SEQ ID NO: 121495 - DNA, 22 bp, Artificial Sequence
  Synthetic oligonucleotide; CTA chr11 5353884 5353905 5353889 5353884 -
gcctggaaactattgtgaaggt

SEQ ID NO: 121496 - DNA, 22 bp, Artificial Sequence
  Synthetic oligonucleotide; CTG chr11 5353879 5353900 5353884 5353879 -
gaaactattgtgaaggtattat

SEQ ID NO: 121497 - DNA, 22 bp, Artificial Sequence
  Synthetic oligonucleotide; CTA chr11 5353872 5353893 5353877 5353872 -
ttgtgaaggtattattttattt

SEQ ID NO: 121498 - DNA, 22 bp, Artificial Sequence
  Synthetic oligonucleotide; TTG chr11 5353869 5353890 5353874 5353869 -
tgaaggtattattttatttttg

SEQ ID NO: 121499 - DNA, 22 bp, Artificial Sequence
  Synthetic oligonucleotide; TTA chr11 5353858 5353879 5353863 5353858 -
ttttatttttgttttctctgtg

SEQ ID NO: 121500 - DNA, 22 bp, Artificial Sequence
  Synthetic oligonucleotide; TTT chr11 5353855 5353876 5353860 5353855 -
tatttttgttttctctgtgtta

SEQ ID NO: 121501 - DNA, 22 bp, Artificial Sequence
  Synthetic oligonucleotide; TTT chr11 5353854 5353875 5353859 5353854 -
atttttgttttctctgtgttat

SEQ ID NO: 121502 - DNA, 22 bp, Artificial Sequence
  Synthetic oligonucleotide; TTA chr11 5353853 5353874 5353858 5353853 -
tttttgttttctctgtgttatt

SEQ ID NO: 121503 - DNA, 22 bp, Artificial Sequence
  Synthetic oligonucleotide; TTT chr11 5353850 5353871 5353855 5353850 -
ttgttttctctgtgttatttat

SEQ ID NO: 121504 - DNA, 22 bp, Artificial Sequence
  Synthetic oligonucleotide; TTT chr11 5353849 5353870 5353854 5353849 -
tgttttctctgtgttatttata

SEQ ID NO: 121505 - DNA, 22 bp, Artificial Sequence
  Synthetic oligonucleotide; TTT chr11 5353848 5353869 5353853 5353848 -
gttttctctgtgttatttatac

SEQ ID NO: 121506 - DNA, 22 bp, Artificial Sequence
  Synthetic oligonucleotide; TTG chr11 5353847 5353868 5353852 5353847 -
ttttctctgtgttatttataca

SEQ ID NO: 121507 - DNA, 22 bp, Artificial Sequence
  Synthetic oligonucleotide; TTT chr11 5353844 5353865 5353849 5353844 -
tctctgtgttatttatacatcc

SEQ ID NO: 121508 - DNA, 22 bp, Artificial Sequence
  Synthetic oligonucleotide; TTT chr11 5353843 5353864 5353848 5353843 -
ctctgtgttatttatacatccc

SEQ ID NO: 121509 - DNA, 22 bp, Artificial Sequence
  Synthetic oligonucleotide; TTC chr11 5353842 5353863 5353847 5353842 -
tctgtgttatttatacatccca

SEQ ID NO: 121510 - DNA, 22 bp, Artificial Sequence
  Synthetic oligonucleotide; CTC chr11 5353840 5353861 5353845 5353840 -
tgtgttatttatacatcccaag

SEQ ID NO: 121511 - DNA, 22 bp, Artificial Sequence
  Synthetic oligonucleotide; CTG chr11 5353838 5353859 5353843 5353838 -
tgttatttatacatcccaagaa

SEQ ID NO: 121512 - DNA, 22 bp, Artificial Sequence
  Synthetic oligonucleotide; TTA chr11 5353833 5353854 5353838 5353833 -
tttatacatcccaagaatccta

SEQ ID NO: 121513 - DNA, 22 bp, Artificial Sequence
  Synthetic oligonucleotide; TTT chr11 5353830 5353851 5353835 5353830 -
atacatcccaagaatcctaaaa

SEQ ID NO: 121514 - DNA, 22 bp, Artificial Sequence
  Synthetic oligonucleotide; TTA chr11 5353829 5353850 5353834 5353829 -
tacatcccaagaatcctaaaaa

SEQ ID NO: 121515 - DNA, 22 bp, Artificial Sequence
  Synthetic oligonucleotide; CTA chr11 5353811 5353832 5353816 5353811 -
aaaaatccccacctttctgtga

SEQ ID NO: 121516 - DNA, 22 bp, Artificial Sequence
  Synthetic oligonucleotide; CTT chr11 5353796 5353817 5353801 5353796 -
tctgtgatgaagagtaggtggg

SEQ ID NO: 121517 - DNA, 22 bp, Artificial Sequence
  Synthetic oligonucleotide; TTT chr11 5353795 5353816 5353800 5353795 -
ctgtgatgaagagtaggtgggc

SEQ ID NO: 121518 - DNA, 22 bp, Artificial Sequence
  Synthetic oligonucleotide; TTC chr11 5353794 5353815 5353799 5353794 -
tgtgatgaagagtaggtgggca

SEQ ID NO: 121519 - DNA, 22 bp, Artificial Sequence
  Synthetic oligonucleotide; CTG chr11 5353792 5353813 5353797 5353792 -
tgatgaagagtaggtgggcagc

SEQ ID NO: 121520 - DNA, 22 bp, Artificial Sequence
  Synthetic oligonucleotide; CTG chr11 5353758 5353779 5353763 5353758 -
agtgtcagtatgacagaggcca

SEQ ID NO: 121521 - DNA, 22 bp, Artificial Sequence
  Synthetic oligonucleotide; CTG chr11 5353715 5353736 5353720 5353715 -
actggtcactgggtggcccctt

SEQ ID NO: 121522 - DNA, 22 bp, Artificial Sequence
  Synthetic oligonucleotide; CTG chr11 5353711 5353732 5353716 5353711 -
gtcactgggtggccccttgtgt

SEQ ID NO: 121523 - DNA, 22 bp, Artificial Sequence
  Synthetic oligonucleotide; CTG chr11 5353704 5353725 5353709 5353704 -
ggtggccccttgtgtagtccaa

SEQ ID NO: 121524 - DNA, 22 bp, Artificial Sequence
  Synthetic oligonucleotide; CTT chr11 5353693 5353714 5353698 5353693 -
gtgtagtccaagcacatcatac

SEQ ID NO: 121525 - DNA, 22 bp, Artificial Sequence
  Synthetic oligonucleotide; TTG chr11 5353692 5353713 5353697 5353692 -
tgtagtccaagcacatcatacc

SEQ ID NO: 121526 - DNA, 22 bp, Artificial Sequence
  Synthetic oligonucleotide; CTG chr11 5353667 5353688 5353672 5353667 -
tattttggtcaaaagaatatct

SEQ ID NO: 121527 - DNA, 22 bp, Artificial Sequence
  Synthetic oligonucleotide; TTT chr11 5353662 5353683 5353667 5353662 -
tggtcaaaagaatatctttctt

SEQ ID NO: 121528 - DNA, 22 bp, Artificial Sequence
  Synthetic oligonucleotide; TTT chr11 5353661 5353682 5353666 5353661 -
ggtcaaaagaatatctttcttt

SEQ ID NO: 121529 - DNA, 22 bp, Artificial Sequence
  Synthetic oligonucleotide; TTG chr11 5353660 5353681 5353665 5353660 -
gtcaaaagaatatctttctttt

SEQ ID NO: 121530 - DNA, 22 bp, Artificial Sequence
  Synthetic oligonucleotide; CTT chr11 5353644 5353665 5353649 5353644 -
tcttttaaaattaatttaaaac

SEQ ID NO: 121531 - DNA, 22 bp, Artificial Sequence
  Synthetic oligonucleotide; TTT chr11 5353643 5353664 5353648 5353643 -
cttttaaaattaatttaaaact

SEQ ID NO: 121532 - DNA, 22 bp, Artificial Sequence
  Synthetic oligonucleotide; TTC chr11 5353642 5353663 5353647 5353642 -
ttttaaaattaatttaaaactt

SEQ ID NO: 121533 - DNA, 22 bp, Artificial Sequence
  Synthetic oligonucleotide; CTT chr11 5353640 5353661 5353645 5353640 -
ttaaaattaatttaaaacttat

SEQ ID NO: 121534 - DNA, 22 bp, Artificial Sequence
  Synthetic oligonucleotide; TTT chr11 5353639 5353660 5353644 5353639 -
taaaattaatttaaaacttatc

SEQ ID NO: 121535 - DNA, 22 bp, Artificial Sequence
  Synthetic oligonucleotide; TTT chr11 5353638 5353659 5353643 5353638 -
aaaattaatttaaaacttatca

SEQ ID NO: 121536 - DNA, 22 bp, Artificial Sequence
  Synthetic oligonucleotide; TTA chr11 5353637 5353658 5353642 5353637 -
aaattaatttaaaacttatcat

SEQ ID NO: 121537 - DNA, 22 bp, Artificial Sequence
  Synthetic oligonucleotide; TTA chr11 5353631 5353652 5353636 5353631 -
atttaaaacttatcatttgagt

SEQ ID NO: 121538 - DNA, 22 bp, Artificial Sequence
  Synthetic oligonucleotide; TTT chr11 5353627 5353648 5353632 5353627 -
aaaacttatcatttgagtcatg

SEQ ID NO: 121539 - DNA, 22 bp, Artificial Sequence
  Synthetic oligonucleotide; TTA chr11 5353626 5353647 5353631 5353626 -
aaacttatcatttgagtcatgg

SEQ ID NO: 121540 - DNA, 22 bp, Artificial Sequence
  Synthetic oligonucleotide; CTT chr11 5353620 5353641 5353625 5353620 -
atcatttgagtcatggatactg

SEQ ID NO: 121541 - DNA, 22 bp, Artificial Sequence
  Synthetic oligonucleotide; TTA chr11 5353619 5353640 5353624 5353619 -
tcatttgagtcatggatactgg

SEQ ID NO: 121542 - DNA, 22 bp, Artificial Sequence
  Synthetic oligonucleotide; TTT chr11 5353613 5353634 5353618 5353613 -
gagtcatggatactggctcttc

SEQ ID NO: 121543 - DNA, 22 bp, Artificial Sequence
  Synthetic oligonucleotide; TTG chr11 5353612 5353633 5353617 5353612 -
agtcatggatactggctcttca

SEQ ID NO: 121544 - DNA, 22 bp, Artificial Sequence
  Synthetic oligonucleotide; CTG chr11 5353598 5353619 5353603 5353598 -
gctcttcacctggccataggac

SEQ ID NO: 121545 - DNA, 22 bp, Artificial Sequence
  Synthetic oligonucleotide; CTC chr11 5353594 5353615 5353599 5353594 -
ttcacctggccataggaccaca

SEQ ID NO: 121546 - DNA, 22 bp, Artificial Sequence
  Synthetic oligonucleotide; CTT chr11 5353592 5353613 5353597 5353592 -
cacctggccataggaccacaaa

SEQ ID NO: 121547 - DNA, 22 bp, Artificial Sequence
  Synthetic oligonucleotide; TTC chr11 5353591 5353612 5353596 5353591 -
acctggccataggaccacaaac

SEQ ID NO: 121548 - DNA, 22 bp, Artificial Sequence
  Synthetic oligonucleotide; CTG chr11 5353586 5353607 5353591 5353586 -
gccataggaccacaaaccccct

SEQ ID NO: 121549 - DNA, 22 bp, Artificial Sequence
  Synthetic oligonucleotide; CTC chr11 5353563 5353584 5353568 5353563 -
ttctcatgcctagactctgaaa

SEQ ID NO: 121550 - DNA, 22 bp, Artificial Sequence
  Synthetic oligonucleotide; CTT chr11 5353561 5353582 5353566 5353561 -
ctcatgcctagactctgaaaag

SEQ ID NO: 121551 - DNA, 22 bp, Artificial Sequence
  Synthetic oligonucleotide; TTC chr11 5353560 5353581 5353565 5353560 -
tcatgcctagactctgaaaaga

SEQ ID NO: 121552 - DNA, 22 bp, Artificial Sequence
  Synthetic oligonucleotide; CTC chr11 5353558 5353579 5353563 5353558 -
atgcctagactctgaaaagaat

SEQ ID NO: 121553 - DNA, 22 bp, Artificial Sequence
  Synthetic oligonucleotide; CTA chr11 5353551 5353572 5353556 5353551 -
gactctgaaaagaatcaaaagt

SEQ ID NO: 121554 - DNA, 22 bp, Artificial Sequence
  Synthetic oligonucleotide; CTC chr11 5353546 5353567 5353551 5353546 -
tgaaaagaatcaaaagtatttg

SEQ ID NO: 121555 - DNA, 22 bp, Artificial Sequence
  Synthetic oligonucleotide; CTG chr11 5353544 5353565 5353549 5353544 -
aaaagaatcaaaagtatttgga

SEQ ID NO: 121556 - DNA, 22 bp, Artificial Sequence
  Synthetic oligonucleotide; TTT chr11 5353525 5353546 5353530 5353525 -
ggagccagaaaaggccatttta

SEQ ID NO: 121557 - DNA, 22 bp, Artificial Sequence
  Synthetic oligonucleotide; TTG chr11 5353524 5353545 5353529 5353524 -
gagccagaaaaggccattttat

SEQ ID NO: 121558 - DNA, 22 bp, Artificial Sequence
  Synthetic oligonucleotide; TTT chr11 5353505 5353526 5353510 5353505 -
tatcttctagttatgagcattg

SEQ ID NO: 121559 - DNA, 22 bp, Artificial Sequence
  Synthetic oligonucleotide; TTT chr11 5353504 5353525 5353509 5353504 -
atcttctagttatgagcattgc

SEQ ID NO: 121560 - DNA, 22 bp, Artificial Sequence
  Synthetic oligonucleotide; TTA chr11 5353503 5353524 5353508 5353503 -
tcttctagttatgagcattgcc

SEQ ID NO: 121561 - DNA, 22 bp, Artificial Sequence
  Synthetic oligonucleotide; CTT chr11 5353499 5353520 5353504 5353499 -
ctagttatgagcattgcctcca

SEQ ID NO: 121562 - DNA, 22 bp, Artificial Sequence
  Synthetic oligonucleotide; TTC chr11 5353498 5353519 5353503 5353498 -
tagttatgagcattgcctccat

SEQ ID NO: 121563 - DNA, 22 bp, Artificial Sequence
  Synthetic oligonucleotide; CTA chr11 5353496 5353517 5353501 5353496 -
gttatgagcattgcctccatcc

SEQ ID NO: 121564 - DNA, 22 bp, Artificial Sequence
  Synthetic oligonucleotide; TTA chr11 5353492 5353513 5353497 5353492 -
tgagcattgcctccatcctctc

SEQ ID NO: 121565 - DNA, 22 bp, Artificial Sequence
  Synthetic oligonucleotide; TTG chr11 5353483 5353504 5353488 5353483 -
cctccatcctctcccttcctcc

SEQ ID NO: 121566 - DNA, 22 bp, Artificial Sequence
  Synthetic oligonucleotide; CTC chr11 5353479 5353500 5353484 5353479 -
catcctctcccttcctccccac

SEQ ID NO: 121567 - DNA, 22 bp, Artificial Sequence
  Synthetic oligonucleotide; CTC chr11 5353472 5353493 5353477 5353472 -
tcccttcctccccactctccac

SEQ ID NO: 121568 - DNA, 22 bp, Artificial Sequence
  Synthetic oligonucleotide; CTC chr11 5353470 5353491 5353475 5353470 -
ccttcctccccactctccacat

SEQ ID NO: 121569 - DNA, 22 bp, Artificial Sequence
  Synthetic oligonucleotide; CTT chr11 5353466 5353487 5353471 5353466 -
cctccccactctccacatatga

SEQ ID NO: 121570 - DNA, 22 bp, Artificial Sequence
  Synthetic oligonucleotide; TTC chr11 5353465 5353486 5353470 5353465 -
ctccccactctccacatatgac

SEQ ID NO: 121571 - DNA, 22 bp, Artificial Sequence
  Synthetic oligonucleotide; CTC chr11 5353462 5353483 5353467 5353462 -
cccactctccacatatgaccaa

SEQ ID NO: 121572 - DNA, 22 bp, Artificial Sequence
  Synthetic oligonucleotide; CTC chr11 5353455 5353476 5353460 5353455 -
tccacatatgaccaactgtttg

SEQ ID NO: 121573 - DNA, 22 bp, Artificial Sequence
  Synthetic oligonucleotide; CTC chr11 5353453 5353474 5353458 5353453 -
cacatatgaccaactgtttgtt

SEQ ID NO: 121574 - DNA, 22 bp, Artificial Sequence
  Synthetic oligonucleotide; CTG chr11 5353437 5353458 5353442 5353437 -
tttgtttttcaactctgctatt

SEQ ID NO: 121575 - DNA, 22 bp, Artificial Sequence
  Synthetic oligonucleotide; TTT chr11 5353434 5353455 5353439 5353434 -
gtttttcaactctgctattttg

SEQ ID NO: 121576 - DNA, 22 bp, Artificial Sequence
  Synthetic oligonucleotide; TTG chr11 5353433 5353454 5353438 5353433 -
tttttcaactctgctattttgc

SEQ ID NO: 121577 - DNA, 22 bp, Artificial Sequence
  Synthetic oligonucleotide; TTT chr11 5353430 5353451 5353435 5353430 -
ttcaactctgctattttgcaca

SEQ ID NO: 121578 - DNA, 22 bp, Artificial Sequence
  Synthetic oligonucleotide; TTT chr11 5353429 5353450 5353434 5353429 -
tcaactctgctattttgcacat

SEQ ID NO: 121579 - DNA, 22 bp, Artificial Sequence
  Synthetic oligonucleotide; TTT chr11 5353428 5353449 5353433 5353428 -
caactctgctattttgcacatg

SEQ ID NO: 121580 - DNA, 22 bp, Artificial Sequence
  Synthetic oligonucleotide; TTC chr11 5353427 5353448 5353432 5353427 -
aactctgctattttgcacatgc

SEQ ID NO: 121581 - DNA, 22 bp, Artificial Sequence
  Synthetic oligonucleotide; CTC chr11 5353422 5353443 5353427 5353422 -
tgctattttgcacatgccagac

SEQ ID NO: 121582 - DNA, 22 bp, Artificial Sequence
  Synthetic oligonucleotide; CTG chr11 5353420 5353441 5353425 5353420 -
ctattttgcacatgccagacac

SEQ ID NO: 121583 - DNA, 22 bp, Artificial Sequence
  Synthetic oligonucleotide; CTA chr11 5353417 5353438 5353422 5353417 -
ttttgcacatgccagacacccc

SEQ ID NO: 121584 - DNA, 22 bp, Artificial Sequence
  Synthetic oligonucleotide; TTT chr11 5353414 5353435 5353419 5353414 -
tgcacatgccagacacccctat

SEQ ID NO: 121585 - DNA, 22 bp, Artificial Sequence
  Synthetic oligonucleotide; TTT chr11 5353413 5353434 5353418 5353413 -
gcacatgccagacacccctatc

SEQ ID NO: 121586 - DNA, 22 bp, Artificial Sequence
  Synthetic oligonucleotide; TTG chr11 5353412 5353433 5353417 5353412 -
cacatgccagacacccctatct

SEQ ID NO: 121587 - DNA, 22 bp, Artificial Sequence
  Synthetic oligonucleotide; CTA chr11 5353393 5353414 5353398 5353393 -
tctagtcttatctctgatgttc

SEQ ID NO: 121588 - DNA, 22 bp, Artificial Sequence
  Synthetic oligonucleotide; CTA chr11 5353389 5353410 5353394 5353389 -
gtcttatctctgatgttcccct

SEQ ID NO: 121589 - DNA, 22 bp, Artificial Sequence
  Synthetic oligonucleotide; CTT chr11 5353384 5353405 5353389 5353384 -
atctctgatgttcccctaaacc

SEQ ID NO: 121590 - DNA, 22 bp, Artificial Sequence
  Synthetic oligonucleotide; TTA chr11 5353383 5353404 5353388 5353383 -
tctctgatgttcccctaaacca

SEQ ID NO: 121591 - DNA, 22 bp, Artificial Sequence
  Synthetic oligonucleotide; CTC chr11 5353379 5353400 5353384 5353379 -
tgatgttcccctaaaccagacc

SEQ ID NO: 121592 - DNA, 22 bp, Artificial Sequence
  Synthetic oligonucleotide; CTG chr11 5353377 5353398 5353382 5353377 -
atgttcccctaaaccagacctc

SEQ ID NO: 121593 - DNA, 22 bp, Artificial Sequence
  Synthetic oligonucleotide; TTC chr11 5353371 5353392 5353376 5353371 -
ccctaaaccagacctctcatac

SEQ ID NO: 121594 - DNA, 22 bp, Artificial Sequence
  Synthetic oligonucleotide; CTA chr11 5353366 5353387 5353371 5353366 -
aaccagacctctcataccactt

SEQ ID NO: 121595 - DNA, 22 bp, Artificial Sequence
  Synthetic oligonucleotide; CTC chr11 5353355 5353376 5353360 5353355 -
tcataccactttatgaaaatgc

SEQ ID NO: 121596 - DNA, 22 bp, Artificial Sequence
  Synthetic oligonucleotide; CTC chr11 5353353 5353374 5353358 5353353 -
ataccactttatgaaaatgcat

SEQ ID NO: 121597 - DNA, 22 bp, Artificial Sequence
  Synthetic oligonucleotide; CTT chr11 5353344 5353365 5353349 5353344 -
tatgaaaatgcatctctctgtt

SEQ ID NO: 121598 - DNA, 22 bp, Artificial Sequence
  Synthetic oligonucleotide; TTT chr11 5353343 5353364 5353348 5353343 -
atgaaaatgcatctctctgttc

SEQ ID NO: 121599 - DNA, 22 bp, Artificial Sequence
  Synthetic oligonucleotide; TTA chr11 5353342 5353363 5353347 5353342 -
tgaaaatgcatctctctgttca

SEQ ID NO: 121600 - DNA, 22 bp, Artificial Sequence
  Synthetic oligonucleotide; CTC chr11 5353328 5353349 5353333 5353328 -
tctgttcagtagtaactggaat

SEQ ID NO: 121601 - DNA, 22 bp, Artificial Sequence
  Synthetic oligonucleotide; CTC chr11 5353326 5353347 5353331 5353326 -
tgttcagtagtaactggaatta

SEQ ID NO: 121602 - DNA, 22 bp, Artificial Sequence
  Synthetic oligonucleotide; CTG chr11 5353324 5353345 5353329 5353324 -
ttcagtagtaactggaattaac

SEQ ID NO: 121603 - DNA, 22 bp, Artificial Sequence
  Synthetic oligonucleotide; TTC chr11 5353321 5353342 5353326 5353321 -
agtagtaactggaattaactat

SEQ ID NO: 121604 - DNA, 22 bp, Artificial Sequence
  Synthetic oligonucleotide; CTG chr11 5353310 5353331 5353315 5353310 -
gaattaactatcaagacaatgg

SEQ ID NO: 121605 - DNA, 22 bp, Artificial Sequence
  Synthetic oligonucleotide; TTA chr11 5353304 5353325 5353309 5353304 -
actatcaagacaatggtcatct

SEQ ID NO: 121606 - DNA, 22 bp, Artificial Sequence
  Synthetic oligonucleotide; CTA chr11 5353300 5353321 5353305 5353300 -
tcaagacaatggtcatctgaat

SEQ ID NO: 121607 - DNA, 22 bp, Artificial Sequence
  Synthetic oligonucleotide; CTG chr11 5353281 5353302 5353286 5353281 -
aattagaaattatatctctgtt

SEQ ID NO: 121608 - DNA, 22 bp, Artificial Sequence
  Synthetic oligonucleotide; TTA chr11 5353276 5353297 5353281 5353276 -
gaaattatatctctgttttcaa

SEQ ID NO: 121609 - DNA, 22 bp, Artificial Sequence
  Synthetic oligonucleotide; TTA chr11 5353269 5353290 5353274 5353269 -
tatctctgttttcaaattatta

SEQ ID NO: 121610 - DNA, 22 bp, Artificial Sequence
  Synthetic oligonucleotide; CTC chr11 5353263 5353284 5353268 5353263 -
tgttttcaaattattatcaata

SEQ ID NO: 121611 - DNA, 22 bp, Artificial Sequence
  Synthetic oligonucleotide; CTG chr11 5353261 5353282 5353266 5353261 -
ttttcaaattattatcaatatt

SEQ ID NO: 121612 - DNA, 22 bp, Artificial Sequence
  Synthetic oligonucleotide; TTT chr11 5353258 5353279 5353263 5353258 -
tcaaattattatcaatattatt

SEQ ID NO: 121613 - DNA, 22 bp, Artificial Sequence
  Synthetic oligonucleotide; TTT chr11 5353257 5353278 5353262 5353257 -
caaattattatcaatattattt

SEQ ID NO: 121614 - DNA, 22 bp, Artificial Sequence
  Synthetic oligonucleotide; TTC chr11 5353256 5353277 5353261 5353256 -
aaattattatcaatattatttg

SEQ ID NO: 121615 - DNA, 22 bp, Artificial Sequence
  Synthetic oligonucleotide; TTA chr11 5353250 5353271 5353255 5353250 -
ttatcaatattatttgataaat

SEQ ID NO: 121616 - DNA, 22 bp, Artificial Sequence
  Synthetic oligonucleotide; TTA chr11 5353247 5353268 5353252 5353247 -
tcaatattatttgataaatgtt

SEQ ID NO: 121617 - DNA, 22 bp, Artificial Sequence
  Synthetic oligonucleotide; TTA chr11 5353238 5353259 5353243 5353238 -
tttgataaatgttaaccaaagt

SEQ ID NO: 121618 - DNA, 22 bp, Artificial Sequence
  Synthetic oligonucleotide; TTT chr11 5353235 5353256 5353240 5353235 -
gataaatgttaaccaaagtttt

SEQ ID NO: 121619 - DNA, 22 bp, Artificial Sequence
  Synthetic oligonucleotide; TTG chr11 5353234 5353255 5353239 5353234 -
ataaatgttaaccaaagtttta

SEQ ID NO: 121620 - DNA, 22 bp, Artificial Sequence
  Synthetic oligonucleotide; TTA chr11 5353224 5353245 5353229 5353224 -
accaaagttttaactgaacaca

SEQ ID NO: 121621 - DNA, 22 bp, Artificial Sequence
  Synthetic oligonucleotide; TTT chr11 5353214 5353235 5353219 5353214 -
taactgaacacatttctcatag

SEQ ID NO: 121622 - DNA, 22 bp, Artificial Sequence
  Synthetic oligonucleotide; TTT chr11 5353213 5353234 5353218 5353213 -
aactgaacacatttctcataga

SEQ ID NO: 121623 - DNA, 22 bp, Artificial Sequence
  Synthetic oligonucleotide; TTA chr11 5353212 5353233 5353217 5353212 -
actgaacacatttctcatagag

SEQ ID NO: 121624 - DNA, 22 bp, Artificial Sequence
  Synthetic oligonucleotide; CTG chr11 5353208 5353229 5353213 5353208 -
aacacatttctcatagagatac

SEQ ID NO: 121625 - DNA, 22 bp, Artificial Sequence
  Synthetic oligonucleotide; TTT chr11 5353199 5353220 5353204 5353199 -
ctcatagagatactttccctag

SEQ ID NO: 121626 - DNA, 22 bp, Artificial Sequence
  Synthetic oligonucleotide; TTC chr11 5353198 5353219 5353203 5353198 -
tcatagagatactttccctaga

SEQ ID NO: 121627 - DNA, 22 bp, Artificial Sequence
  Synthetic oligonucleotide; CTC chr11 5353196 5353217 5353201 5353196 -
atagagatactttccctagact

SEQ ID NO: 121628 - DNA, 22 bp, Artificial Sequence
  Synthetic oligonucleotide; CTT chr11 5353184 5353205 5353189 5353184 -
tccctagactcatcattttgaa

SEQ ID NO: 121629 - DNA, 22 bp, Artificial Sequence
  Synthetic oligonucleotide; TTT chr11 5353183 5353204 5353188 5353183 -
ccctagactcatcattttgaat

SEQ ID NO: 121630 - DNA, 22 bp, Artificial Sequence
  Synthetic oligonucleotide; TTC chr11 5353182 5353203 5353187 5353182 -
cctagactcatcattttgaatt

SEQ ID NO: 121631 - DNA, 22 bp, Artificial Sequence
  Synthetic oligonucleotide; CTA chr11 5353178 5353199 5353183 5353178 -
gactcatcattttgaattgagg

SEQ ID NO: 121632 - DNA, 22 bp, Artificial Sequence
  Synthetic oligonucleotide; CTC chr11 5353173 5353194 5353178 5353173 -
atcattttgaattgagggaaat

SEQ ID NO: 121633 - DNA, 22 bp, Artificial Sequence
  Synthetic oligonucleotide; TTT chr11 5353166 5353187 5353171 5353166 -
tgaattgagggaaatggtttac

SEQ ID NO: 121634 - DNA, 22 bp, Artificial Sequence
  Synthetic oligonucleotide; TTT chr11 5353165 5353186 5353170 5353165 -
gaattgagggaaatggtttacc

SEQ ID NO: 121635 - DNA, 22 bp, Artificial Sequence
  Synthetic oligonucleotide; TTG chr11 5353164 5353185 5353169 5353164 -
aattgagggaaatggtttaccc

SEQ ID NO: 121636 - DNA, 22 bp, Artificial Sequence
  Synthetic oligonucleotide; TTG chr11 5353159 5353180 5353164 5353159 -
agggaaatggtttaccctcatt

SEQ ID NO: 121637 - DNA, 22 bp, Artificial Sequence
  Synthetic oligonucleotide; TTT chr11 5353146 5353167 5353151 5353146 -
accctcattgaagaaagtaatt

SEQ ID NO: 121638 - DNA, 22 bp, Artificial Sequence
  Synthetic oligonucleotide; TTA chr11 5353145 5353166 5353150 5353145 -
ccctcattgaagaaagtaattg

SEQ ID NO: 121639 - DNA, 22 bp, Artificial Sequence
  Synthetic oligonucleotide; CTC chr11 5353140 5353161 5353145 5353140 -
attgaagaaagtaattgaggga

SEQ ID NO: 121640 - DNA, 22 bp, Artificial Sequence
  Synthetic oligonucleotide; TTG chr11 5353136 5353157 5353141 5353136 -
aagaaagtaattgagggaaatg

SEQ ID NO: 121641 - DNA, 22 bp, Artificial Sequence
  Synthetic oligonucleotide; TTG chr11 5353123 5353144 5353128 5353123 -
agggaaatggcttactctcatt

SEQ ID NO: 121642 - DNA, 22 bp, Artificial Sequence
  Synthetic oligonucleotide; CTT chr11 5353110 5353131 5353115 5353110 -
actctcattgaagaaagtctca

SEQ ID NO: 121643 - DNA, 22 bp, Artificial Sequence
  Synthetic oligonucleotide; TTA chr11 5353109 5353130 5353114 5353109 -
ctctcattgaagaaagtctcat

SEQ ID NO: 121644 - DNA, 22 bp, Artificial Sequence
  Synthetic oligonucleotide; CTC chr11 5353106 5353127 5353111 5353106 -
tcattgaagaaagtctcatttc

SEQ ID NO: 121645 - DNA, 22 bp, Artificial Sequence
  Synthetic oligonucleotide; CTC chr11 5353104 5353125 5353109 5353104 -
attgaagaaagtctcatttctt

SEQ ID NO: 121646 - DNA, 22 bp, Artificial Sequence
  Synthetic oligonucleotide; TTG chr11 5353100 5353121 5353105 5353100 -
aagaaagtctcatttcttcacg

SEQ ID NO: 121647 - DNA, 22 bp, Artificial Sequence
  Synthetic oligonucleotide; CTC chr11 5353089 5353110 5353094 5353089 -
atttcttcacgtgcaattttct

SEQ ID NO: 121648 - DNA, 22 bp, Artificial Sequence
  Synthetic oligonucleotide; TTT chr11 5353085 5353106 5353090 5353085 -
cttcacgtgcaattttctagaa

SEQ ID NO: 121649 - DNA, 22 bp, Artificial Sequence
  Synthetic oligonucleotide; TTC chr11 5353084 5353105 5353089 5353084 -
ttcacgtgcaattttctagaaa

SEQ ID NO: 121650 - DNA, 22 bp, Artificial Sequence
  Synthetic oligonucleotide; CTT chr11 5353082 5353103 5353087 5353082 -
cacgtgcaattttctagaaaca

SEQ ID NO: 121651 - DNA, 22 bp, Artificial Sequence
  Synthetic oligonucleotide; TTC chr11 5353081 5353102 5353086 5353081 -
acgtgcaattttctagaaacag

SEQ ID NO: 121652 - DNA, 22 bp, Artificial Sequence
  Synthetic oligonucleotide; TTT chr11 5353070 5353091 5353075 5353070 -
tctagaaacagcagccagctcc

SEQ ID NO: 121653 - DNA, 22 bp, Artificial Sequence
  Synthetic oligonucleotide; TTT chr11 5353069 5353090 5353074 5353069 -
ctagaaacagcagccagctcca

SEQ ID NO: 121654 - DNA, 22 bp, Artificial Sequence
  Synthetic oligonucleotide; TTC chr11 5353068 5353089 5353073 5353068 -
tagaaacagcagccagctccat

SEQ ID NO: 121655 - DNA, 22 bp, Artificial Sequence
  Synthetic oligonucleotide; CTA chr11 5353066 5353087 5353071 5353066 -
gaaacagcagccagctccatat

SEQ ID NO: 121656 - DNA, 22 bp, Artificial Sequence
  Synthetic oligonucleotide; CTC chr11 5353049 5353070 5353054 5353049 -
catatatgcaagagaactggat

SEQ ID NO: 121657 - DNA, 22 bp, Artificial Sequence
  Synthetic oligonucleotide; CTG chr11 5353030 5353051 5353035 5353030 -
gatgtatgtctgaagccaaaaa

SEQ ID NO: 121658 - DNA, 22 bp, Artificial Sequence
  Synthetic oligonucleotide; CTG chr11 5353018 5353039 5353023 5353018 -
aagccaaaaatgccttattcct

SEQ ID NO: 121659 - DNA, 22 bp, Artificial Sequence
  Synthetic oligonucleotide; CTT chr11 5353002 5353023 5353007 5353002 -
attcctatgtataacaggacta

SEQ ID NO: 121660 - DNA, 22 bp, Artificial Sequence
  Synthetic oligonucleotide; TTA chr11 5353001 5353022 5353006 5353001 -
ttcctatgtataacaggactaa

SEQ ID NO: 121661 - DNA, 22 bp, Artificial Sequence
  Synthetic oligonucleotide; TTC chr11 5352998 5353019 5353003 5352998 -
ctatgtataacaggactaatat

SEQ ID NO: 121662 - DNA, 22 bp, Artificial Sequence
  Synthetic oligonucleotide; CTA chr11 5352995 5353016 5353000 5352995 -
tgtataacaggactaatatatg

SEQ ID NO: 121663 - DNA, 22 bp, Artificial Sequence
  Synthetic oligonucleotide; CTA chr11 5352980 5353001 5352985 5352980 -
atatatgcaagccatatggaga

SEQ ID NO: 121664 - DNA, 22 bp, Artificial Sequence
  Synthetic oligonucleotide; TTG chr11 5352945 5352966 5352950 5352945 -
actgaaatgccggtgacccaaa

SEQ ID NO: 121665 - DNA, 22 bp, Artificial Sequence
  Synthetic oligonucleotide; CTG chr11 5352941 5352962 5352946 5352941 -
aaatgccggtgacccaaatcat

SEQ ID NO: 121666 - DNA, 22 bp, Artificial Sequence
  Synthetic oligonucleotide; TTA chr11 5352905 5352926 5352910 5352905 -
tatatataattggttcatatat

SEQ ID NO: 121667 - DNA, 22 bp, Artificial Sequence
  Synthetic oligonucleotide; TTG chr11 5352893 5352914 5352898 5352893 -
gttcatatatatatattattta

SEQ ID NO: 121668 - DNA, 22 bp, Artificial Sequence
  Synthetic oligonucleotide; TTC chr11 5352889 5352910 5352894 5352889 -
atatatatatattatttatata

SEQ ID NO: 121669 - DNA, 22 bp, Artificial Sequence
  Synthetic oligonucleotide; TTA chr11 5352875 5352896 5352880 5352875 -
tttatataatatatataaacac

SEQ ID NO: 121670 - DNA, 22 bp, Artificial Sequence
  Synthetic oligonucleotide; TTT chr11 5352872 5352893 5352877 5352872 -
atataatatatataaacacaca

SEQ ID NO: 121671 - DNA, 22 bp, Artificial Sequence
  Synthetic oligonucleotide; TTA chr11 5352871 5352892 5352876 5352871 -
tataatatatataaacacacac

SEQ ID NO: 121672 - DNA, 22 bp, Artificial Sequence
  Synthetic oligonucleotide; CTA chr11 5352831 5352852 5352836 5352831 -
ttatatattaagtatatataat

SEQ ID NO: 121673 - DNA, 22 bp, Artificial Sequence
  Synthetic oligonucleotide; TTA chr11 5352828 5352849 5352833 5352828 -
tatattaagtatatataatagt

SEQ ID NO: 121674 - DNA, 22 bp, Artificial Sequence
  Synthetic oligonucleotide; TTA chr11 5352821 5352842 5352826 5352821 -
agtatatataatagtgtgtatt

SEQ ID NO: 121675 - DNA, 22 bp, Artificial Sequence
  Synthetic oligonucleotide; TTA chr11 5352798 5352819 5352803 5352798 -
tatatattaaatatatataata

SEQ ID NO: 121676 - DNA, 22 bp, Artificial Sequence
  Synthetic oligonucleotide; TTA chr11 5352789 5352810 5352794 5352789 -
aatatatataatagtgtatggg

SEQ ID NO: 121677 - DNA, 22 bp, Artificial Sequence
  Synthetic oligonucleotide; CTG chr11 5352757 5352778 5352762 5352757 -
tgtgtgtatatgtatgtgtgta

SEQ ID NO: 121678 - DNA, 22 bp, Artificial Sequence
  Synthetic oligonucleotide; CTA chr11 5352698 5352719 5352703 5352698 -
atcaaacaatgtgagttaaatt

SEQ ID NO: 121679 - DNA, 22 bp, Artificial Sequence
  Synthetic oligonucleotide; TTA chr11 5352680 5352701 5352685 5352680 -
aattacctgagaaaacaatatc

SEQ ID NO: 121680 - DNA, 22 bp, Artificial Sequence
  Synthetic oligonucleotide; TTA chr11 5352675 5352696 5352680 5352675 -
cctgagaaaacaatatcagttg

SEQ ID NO: 121681 - DNA, 22 bp, Artificial Sequence
  Synthetic oligonucleotide; CTG chr11 5352671 5352692 5352676 5352671 -
agaaaacaatatcagttgagca

SEQ ID NO: 121682 - DNA, 22 bp, Artificial Sequence
  Synthetic oligonucleotide; TTG chr11 5352653 5352674 5352658 5352653 -
agcactgagatatgtacttagt

SEQ ID NO: 121683 - DNA, 22 bp, Artificial Sequence
  Synthetic oligonucleotide; CTG chr11 5352646 5352667 5352651 5352646 -
agatatgtacttagtgttgtac

SEQ ID NO: 121684 - DNA, 22 bp, Artificial Sequence
  Synthetic oligonucleotide; CTT chr11 5352634 5352655 5352639 5352634 -
agtgttgtacatatatcttata

SEQ ID NO: 121685 - DNA, 22 bp, Artificial Sequence
  Synthetic oligonucleotide; TTA chr11 5352633 5352654 5352638 5352633 -
gtgttgtacatatatcttatac

SEQ ID NO: 121686 - DNA, 22 bp, Artificial Sequence
  Synthetic oligonucleotide; TTG chr11 5352627 5352648 5352632 5352627 -
tacatatatcttatacaaatca

SEQ ID NO: 121687 - DNA, 22 bp, Artificial Sequence
  Synthetic oligonucleotide; CTT chr11 5352615 5352636 5352620 5352615 -
atacaaatcagcaatagacagg

SEQ ID NO: 121688 - DNA, 22 bp, Artificial Sequence
  Synthetic oligonucleotide; TTA chr11 5352614 5352635 5352619 5352614 -
tacaaatcagcaatagacaggc

SEQ ID NO: 121689 - DNA, 22 bp, Artificial Sequence
  Synthetic oligonucleotide; TTC chr11 5352575 5352596 5352580 5352575 -
taagtagcagagggattgactg

SEQ ID NO: 121690 - DNA, 22 bp, Artificial Sequence
  Synthetic oligonucleotide; CTA chr11 5352573 5352594 5352578 5352573 -
agtagcagagggattgactgat

SEQ ID NO: 121691 - DNA, 22 bp, Artificial Sequence
  Synthetic oligonucleotide; TTG chr11 5352557 5352578 5352562 5352557 -
actgatttccactgaaatgctc

SEQ ID NO: 121692 - DNA, 22 bp, Artificial Sequence
  Synthetic oligonucleotide; CTG chr11 5352553 5352574 5352558 5352553 -
atttccactgaaatgctcaggg

SEQ ID NO: 121693 - DNA, 22 bp, Artificial Sequence
  Synthetic oligonucleotide; TTT chr11 5352549 5352570 5352554 5352549 -
ccactgaaatgctcagggattg

SEQ ID NO: 121694 - DNA, 22 bp, Artificial Sequence
  Synthetic oligonucleotide; TTC chr11 5352548 5352569 5352553 5352548 -
cactgaaatgctcagggattga

SEQ ID NO: 121695 - DNA, 22 bp, Artificial Sequence
  Synthetic oligonucleotide; CTG chr11 5352543 5352564 5352548 5352543 -
aaatgctcagggattgattagt

SEQ ID NO: 121696 - DNA, 22 bp, Artificial Sequence
  Synthetic oligonucleotide; CTC chr11 5352535 5352556 5352540 5352535 -
agggattgattagttctcattg

SEQ ID NO: 121697 - DNA, 22 bp, Artificial Sequence
  Synthetic oligonucleotide; TTG chr11 5352527 5352548 5352532 5352527 -
attagttctcattgaaatgact

SEQ ID NO: 121698 - DNA, 22 bp, Artificial Sequence
  Synthetic oligonucleotide; TTA chr11 5352523 5352544 5352528 5352523 -
gttctcattgaaatgactttcc

SEQ ID NO: 121699 - DNA, 22 bp, Artificial Sequence
  Synthetic oligonucleotide; TTC chr11 5352519 5352540 5352524 5352519 -
tcattgaaatgactttccctag

SEQ ID NO: 121700 - DNA, 22 bp, Artificial Sequence
  Synthetic oligonucleotide; CTC chr11 5352517 5352538 5352522 5352517 -
attgaaatgactttccctagtt

SEQ ID NO: 121701 - DNA, 22 bp, Artificial Sequence
  Synthetic oligonucleotide; TTG chr11 5352513 5352534 5352518 5352513 -
aaatgactttccctagttactt

SEQ ID NO: 121702 - DNA, 22 bp, Artificial Sequence
  Synthetic oligonucleotide; CTT chr11 5352504 5352525 5352509 5352504 -
tccctagttacttatgctggca

SEQ ID NO: 121703 - DNA, 22 bp, Artificial Sequence
  Synthetic oligonucleotide; TTT chr11 5352503 5352524 5352508 5352503 -
ccctagttacttatgctggcaa

SEQ ID NO: 121704 - DNA, 22 bp, Artificial Sequence
  Synthetic oligonucleotide; TTC chr11 5352502 5352523 5352507 5352502 -
cctagttacttatgctggcaac

SEQ ID NO: 121705 - DNA, 22 bp, Artificial Sequence
  Synthetic oligonucleotide; CTA chr11 5352498 5352519 5352503 5352498 -
gttacttatgctggcaacattg

SEQ ID NO: 121706 - DNA, 22 bp, Artificial Sequence
  Synthetic oligonucleotide; TTA chr11 5352494 5352515 5352499 5352494 -
cttatgctggcaacattgtcat

SEQ ID NO: 121707 - DNA, 22 bp, Artificial Sequence
  Synthetic oligonucleotide; CTT chr11 5352491 5352512 5352496 5352491 -
atgctggcaacattgtcatcct

SEQ ID NO: 121708 - DNA, 22 bp, Artificial Sequence
  Synthetic oligonucleotide; TTA chr11 5352490 5352511 5352495 5352490 -
tgctggcaacattgtcatcctg

SEQ ID NO: 121709 - DNA, 22 bp, Artificial Sequence
  Synthetic oligonucleotide; CTG chr11 5352485 5352506 5352490 5352485 -
gcaacattgtcatcctgtccag

SEQ ID NO: 121710 - DNA, 22 bp, Artificial Sequence
  Synthetic oligonucleotide; TTG chr11 5352476 5352497 5352481 5352476 -
tcatcctgtccaggtcccctga

SEQ ID NO: 121711 - DNA, 22 bp, Artificial Sequence
  Synthetic oligonucleotide; CTG chr11 5352468 5352489 5352473 5352468 -
tccaggtcccctgaattattcc

SEQ ID NO: 121712 - DNA, 22 bp, Artificial Sequence
  Synthetic oligonucleotide; CTG chr11 5352455 5352476 5352460 5352455 -
aattattcctcagagaccagtg

SEQ ID NO: 121713 - DNA, 22 bp, Artificial Sequence
  Synthetic oligonucleotide; TTA chr11 5352450 5352471 5352455 5352450 -
ttcctcagagaccagtgaaaca

SEQ ID NO: 121714 - DNA, 22 bp, Artificial Sequence
  Synthetic oligonucleotide; TTC chr11 5352447 5352468 5352452 5352447 -
ctcagagaccagtgaaacaatg

SEQ ID NO: 121715 - DNA, 22 bp, Artificial Sequence
  Synthetic oligonucleotide; CTC chr11 5352444 5352465 5352449 5352444 -
agagaccagtgaaacaatgtca

SEQ ID NO: 121716 - DNA, 22 bp, Artificial Sequence
  Synthetic oligonucleotide; CTC chr11 5352417 5352438 5352422 5352417 -
tagagtgaggcagagagaataa

SEQ ID NO: 121717 - DNA, 22 bp, Artificial Sequence
  Synthetic oligonucleotide; CTA chr11 5352415 5352436 5352420 5352415 -
gagtgaggcagagagaataaac

SEQ ID NO: 121718 - DNA, 22 bp, Artificial Sequence
  Synthetic oligonucleotide; CTC chr11 5352379 5352400 5352384 5352379 -
tgaatctgcttagttttaatgc

SEQ ID NO: 121719 - DNA, 22 bp, Artificial Sequence
  Synthetic oligonucleotide; CTG chr11 5352377 5352398 5352382 5352377 -
aatctgcttagttttaatgcta

SEQ ID NO: 121720 - DNA, 22 bp, Artificial Sequence
  Synthetic oligonucleotide; CTG chr11 5352371 5352392 5352376 5352371 -
cttagttttaatgctatagata

SEQ ID NO: 121721 - DNA, 22 bp, Artificial Sequence
  Synthetic oligonucleotide; CTT chr11 5352368 5352389 5352373 5352368 -
agttttaatgctatagataaat

SEQ ID NO: 121722 - DNA, 22 bp, Artificial Sequence
  Synthetic oligonucleotide; TTA chr11 5352367 5352388 5352372 5352367 -
gttttaatgctatagataaatg

SEQ ID NO: 121723 - DNA, 22 bp, Artificial Sequence
  Synthetic oligonucleotide; TTT chr11 5352363 5352384 5352368 5352363 -
taatgctatagataaatgggtt

SEQ ID NO: 121724 - DNA, 22 bp, Artificial Sequence
  Synthetic oligonucleotide; TTT chr11 5352362 5352383 5352367 5352362 -
aatgctatagataaatgggttc

SEQ ID NO: 121725 - DNA, 22 bp, Artificial Sequence
  Synthetic oligonucleotide; TTA chr11 5352361 5352382 5352366 5352361 -
atgctatagataaatgggttca

SEQ ID NO: 121726 - DNA, 22 bp, Artificial Sequence
  Synthetic oligonucleotide; CTA chr11 5352355 5352376 5352360 5352355 -
tagataaatgggttcataaaag

SEQ ID NO: 121727 - DNA, 22 bp, Artificial Sequence
  Synthetic oligonucleotide; TTC chr11 5352340 5352361 5352345 5352340 -
ataaaaggtgggaaaaggaagt

SEQ ID NO: 121728 - DNA, 22 bp, Artificial Sequence
  Synthetic oligonucleotide; CTC chr11 5352307 5352328 5352312 5352307 -
attgtgatgtgaacgacatgag

SEQ ID NO: 121729 - DNA, 22 bp, Artificial Sequence
  Synthetic oligonucleotide; TTG chr11 5352303 5352324 5352308 5352303 -
tgatgtgaacgacatgaggaac

SEQ ID NO: 121730 - DNA, 22 bp, Artificial Sequence
  Synthetic oligonucleotide; CTT chr11 5352275 5352296 5352280 5352275 -
tccaaacctatgaataaatgtc

SEQ ID NO: 121731 - DNA, 22 bp, Artificial Sequence
  Synthetic oligonucleotide; TTT chr11 5352274 5352295 5352279 5352274 -
ccaaacctatgaataaatgtca

SEQ ID NO: 121732 - DNA, 22 bp, Artificial Sequence
  Synthetic oligonucleotide; TTC chr11 5352273 5352294 5352278 5352273 -
caaacctatgaataaatgtcag

SEQ ID NO: 121733 - DNA, 22 bp, Artificial Sequence
  Synthetic oligonucleotide; CTA chr11 5352265 5352286 5352270 5352265 -
tgaataaatgtcagacaaacta

SEQ ID NO: 121734 - DNA, 22 bp, Artificial Sequence
  Synthetic oligonucleotide; CTA chr11 5352243 5352264 5352248 5352243 -
cagtgacatagaagaccaggat

SEQ ID NO: 121735 - DNA, 22 bp, Artificial Sequence
  Synthetic oligonucleotide; TTG chr11 5352193 5352214 5352198 5352193 -
agggccttggccctttctcctc

SEQ ID NO: 121736 - DNA, 22 bp, Artificial Sequence
  Synthetic oligonucleotide; CTT chr11 5352185 5352206 5352190 5352185 -
ggccctttctcctccagaacca

SEQ ID NO: 121737 - DNA, 22 bp, Artificial Sequence
  Synthetic oligonucleotide; TTG chr11 5352184 5352205 5352189 5352184 -
gccctttctcctccagaaccaa

SEQ ID NO: 121738 - DNA, 22 bp, Artificial Sequence
  Synthetic oligonucleotide; CTT chr11 5352178 5352199 5352183 5352178 -
tctcctccagaaccaatgccca

SEQ ID NO: 121739 - DNA, 22 bp, Artificial Sequence
  Synthetic oligonucleotide; TTT chr11 5352177 5352198 5352182 5352177 -
ctcctccagaaccaatgcccat

SEQ ID NO: 121740 - DNA, 22 bp, Artificial Sequence
  Synthetic oligonucleotide; TTC chr11 5352176 5352197 5352181 5352176 -
tcctccagaaccaatgcccatg

SEQ ID NO: 121741 - DNA, 22 bp, Artificial Sequence
  Synthetic oligonucleotide; CTC chr11 5352174 5352195 5352179 5352174 -
ctccagaaccaatgcccatgac

SEQ ID NO: 121742 - DNA, 22 bp, Artificial Sequence
  Synthetic oligonucleotide; CTC chr11 5352171 5352192 5352176 5352171 -
cagaaccaatgcccatgacagt

SEQ ID NO: 121743 - DNA, 22 bp, Artificial Sequence
  Synthetic oligonucleotide; CTT chr11 5352146 5352167 5352151 5352146 -
gagaatcaaaatgtaggagaaa

SEQ ID NO: 121744 - DNA, 22 bp, Artificial Sequence
  Synthetic oligonucleotide; TTG chr11 5352145 5352166 5352150 5352145 -
agaatcaaaatgtaggagaaaa

SEQ ID NO: 121745 - DNA, 22 bp, Artificial Sequence
  Synthetic oligonucleotide; TTG chr11 5352093 5352114 5352098 5352093 -
caaataaaactacaactggata

SEQ ID NO: 121746 - DNA, 22 bp, Artificial Sequence
  Synthetic oligonucleotide; CTA chr11 5352081 5352102 5352086 5352081 -
caactggatagagacggttgaa

SEQ ID NO: 121747 - DNA, 22 bp, Artificial Sequence
  Synthetic oligonucleotide; CTG chr11 5352075 5352096 5352080 5352075 -
gatagagacggttgaaggtgat

SEQ ID NO: 121748 - DNA, 22 bp, Artificial Sequence
  Synthetic oligonucleotide; TTG chr11 5352061 5352082 5352066 5352061 -
aaggtgatgtcagcacaggcta

SEQ ID NO: 121749 - DNA, 22 bp, Artificial Sequence
  Synthetic oligonucleotide; CTA chr11 5352039 5352060 5352044 5352039 -
gcttgatgacatcttggtgtag

SEQ ID NO: 121750 - DNA, 22 bp, Artificial Sequence
  Synthetic oligonucleotide; CTT chr11 5352035 5352056 5352040 5352035 -
gatgacatcttggtgtagacag

SEQ ID NO: 121751 - DNA, 22 bp, Artificial Sequence
  Synthetic oligonucleotide; TTG chr11 5352034 5352055 5352039 5352034 -
atgacatcttggtgtagacaga

SEQ ID NO: 121752 - DNA, 22 bp, Artificial Sequence
  Synthetic oligonucleotide; CTT chr11 5352024 5352045 5352029 5352024 -
ggtgtagacagaaagcatggga

SEQ ID NO: 121753 - DNA, 22 bp, Artificial Sequence
  Synthetic oligonucleotide; TTG chr11 5352023 5352044 5352028 5352023 -
gtgtagacagaaagcatgggag

SEQ ID NO: 121754 - DNA, 22 bp, Artificial Sequence
  Synthetic oligonucleotide; CTA chr11 5351955 5351976 5351960 5351955 -
ttggcataatggacagaccagc

SEQ ID NO: 121755 - DNA, 22 bp, Artificial Sequence
  Synthetic oligonucleotide; TTG chr11 5351952 5351973 5351957 5351952 -
gcataatggacagaccagccct

SEQ ID NO: 121756 - DNA, 22 bp, Artificial Sequence
  Synthetic oligonucleotide; CTT chr11 5351929 5351950 5351934 5351929 -
gtcaatacccgcacaccaatct

SEQ ID NO: 121757 - DNA, 22 bp, Artificial Sequence
  Synthetic oligonucleotide; TTG chr11 5351928 5351949 5351933 5351928 -
tcaatacccgcacaccaatctt

SEQ ID NO: 121758 - DNA, 22 bp, Artificial Sequence
  Synthetic oligonucleotide; CTT chr11 5351906 5351927 5351911 5351906 -
cattacctgggtgttggtcagg

SEQ ID NO: 121759 - DNA, 22 bp, Artificial Sequence
  Synthetic oligonucleotide; TTC chr11 5351905 5351926 5351910 5351905 -
attacctgggtgttggtcagga

SEQ ID NO: 121760 - DNA, 22 bp, Artificial Sequence
  Synthetic oligonucleotide; TTA chr11 5351901 5351922 5351906 5351901 -
cctgggtgttggtcaggataga

SEQ ID NO: 121761 - DNA, 22 bp, Artificial Sequence
  Synthetic oligonucleotide; CTG chr11 5351897 5351918 5351902 5351897 -
ggtgttggtcaggatagaggta

SEQ ID NO: 121762 - DNA, 22 bp, Artificial Sequence
  Synthetic oligonucleotide; TTG chr11 5351890 5351911 5351895 5351890 -
gtcaggatagaggtatatctta

SEQ ID NO: 121763 - DNA, 22 bp, Artificial Sequence
  Synthetic oligonucleotide; CTT chr11 5351869 5351890 5351874 5351869 -
aaggggctgcggatggtaatga

SEQ ID NO: 121764 - DNA, 22 bp, Artificial Sequence
  Synthetic oligonucleotide; TTA chr11 5351868 5351889 5351873 5351868 -
aggggctgcggatggtaatgaa

SEQ ID NO: 121765 - DNA, 22 bp, Artificial Sequence
  Synthetic oligonucleotide; CTG chr11 5351860 5351881 5351865 5351860 -
cggatggtaatgaaacagtcat

SEQ ID NO: 121766 - DNA, 22 bp, Artificial Sequence
  Synthetic oligonucleotide; CTG chr11 5351814 5351835 5351819 5351814 -
actccatgacagaaagagtatg

SEQ ID NO: 121767 - DNA, 22 bp, Artificial Sequence
  Synthetic oligonucleotide; CTC chr11 5351810 5351831 5351815 5351810 -
catgacagaaagagtatggata

SEQ ID NO: 121768 - DNA, 22 bp, Artificial Sequence
  Synthetic oligonucleotide; CTG chr11 5351777 5351798 5351782 5351777 -
agagaagcaggctccatggcca

SEQ ID NO: 121769 - DNA, 22 bp, Artificial Sequence
  Synthetic oligonucleotide; CTC chr11 5351763 5351784 5351768 5351763 -
catggccaatctccctgtgatc

SEQ ID NO: 121770 - DNA, 22 bp, Artificial Sequence
  Synthetic oligonucleotide; CTC chr11 5351750 5351771 5351755 5351750 -
cctgtgatctaaccacagaaca

SEQ ID NO: 121771 - DNA, 22 bp, Artificial Sequence
  Synthetic oligonucleotide; CTG chr11 5351746 5351767 5351751 5351746 -
tgatctaaccacagaacaccta

SEQ ID NO: 121772 - DNA, 22 bp, Artificial Sequence
  Synthetic oligonucleotide; CTA chr11 5351739 5351760 5351744 5351739 -
accacagaacacctagcactgt

SEQ ID NO: 121773 - DNA, 22 bp, Artificial Sequence
  Synthetic oligonucleotide; CTA chr11 5351724 5351745 5351729 5351724 -
gcactgtgggcattgtggtcaa

SEQ ID NO: 121774 - DNA, 22 bp, Artificial Sequence
  Synthetic oligonucleotide; CTG chr11 5351718 5351739 5351723 5351718 -
tgggcattgtggtcaatgtcac

SEQ ID NO: 121775 - DNA, 22 bp, Artificial Sequence
  Synthetic oligonucleotide; TTG chr11 5351709 5351730 5351714 5351709 -
tggtcaatgtcactccgaggtc

SEQ ID NO: 121776 - DNA, 22 bp, Artificial Sequence
  Synthetic oligonucleotide; CTC chr11 5351694 5351715 5351699 5351694 -
cgaggtctgtagctgccaacat

SEQ ID NO: 121777 - DNA, 22 bp, Artificial Sequence
  Synthetic oligonucleotide; CTG chr11 5351685 5351706 5351690 5351685 -
tagctgccaacatagctaagaa

SEQ ID NO: 121778 - DNA, 22 bp, Artificial Sequence
  Synthetic oligonucleotide; CTG chr11 5351679 5351700 5351684 5351679 -
ccaacatagctaagaaatagta

SEQ ID NO: 121779 - DNA, 22 bp, Artificial Sequence
  Synthetic oligonucleotide; CTA chr11 5351667 5351688 5351672 5351667 -
agaaatagtacatgggctcatg

SEQ ID NO: 121780 - DNA, 22 bp, Artificial Sequence
  Synthetic oligonucleotide; CTC chr11 5351648 5351669 5351653 5351648 -
atggaggttatgatcattcctg

SEQ ID NO: 121781 - DNA, 22 bp, Artificial Sequence
  Synthetic oligonucleotide; TTA chr11 5351638 5351659 5351643 5351638 -
tgatcattcctgatgagaaaga

SEQ ID NO: 121782 - DNA, 22 bp, Artificial Sequence
  Synthetic oligonucleotide; TTC chr11 5351629 5351650 5351634 5351629 -
ctgatgagaaagagaagagtgc

SEQ ID NO: 121783 - DNA, 22 bp, Artificial Sequence
  Synthetic oligonucleotide; CTG chr11 5351626 5351647 5351631 5351626 -
atgagaaagagaagagtgccat

SEQ ID NO: 121784 - DNA, 22 bp, Artificial Sequence
  Synthetic oligonucleotide; TTG chr11 5351602 5351623 5351607 5351602 -
ccaagaagtatggagatgtagg

SEQ ID NO: 121785 - DNA, 22 bp, Artificial Sequence
  Synthetic oligonucleotide; CTG chr11 5351577 5351598 5351582 5351577 -
ccaataatgggatgaatatcca

SEQ ID NO: 121786 - DNA, 22 bp, Artificial Sequence
  Synthetic oligonucleotide; CTT chr11 5351543 5351564 5351548 5351543 -
ctccatgcctgggaagccagta

SEQ ID NO: 121787 - DNA, 22 bp, Artificial Sequence
  Synthetic oligonucleotide; TTC chr11 5351542 5351563 5351547 5351542 -
tccatgcctgggaagccagtaa

SEQ ID NO: 121788 - DNA, 22 bp, Artificial Sequence
  Synthetic oligonucleotide; CTC chr11 5351540 5351561 5351545 5351540 -
catgcctgggaagccagtaagc

SEQ ID NO: 121789 - DNA, 22 bp, Artificial Sequence
  Synthetic oligonucleotide; CTG chr11 5351532 5351553 5351537 5351532 -
ggaagccagtaagctggaaggt

SEQ ID NO: 121790 - DNA, 22 bp, Artificial Sequence
  Synthetic oligonucleotide; CTG chr11 5351516 5351537 5351521 5351516 -
gaaggtggaagcagacttattg

SEQ ID NO: 121791 - DNA, 22 bp, Artificial Sequence
  Synthetic oligonucleotide; CTT chr11 5351498 5351519 5351503 5351498 -
attgagccccattgccagcttt

SEQ ID NO: 121792 - DNA, 22 bp, Artificial Sequence
  Synthetic oligonucleotide; TTA chr11 5351497 5351518 5351502 5351497 -
ttgagccccattgccagctttg

SEQ ID NO: 121793 - DNA, 22 bp, Artificial Sequence
  Synthetic oligonucleotide; TTG chr11 5351494 5351515 5351499 5351494 -
agccccattgccagctttgcaa

SEQ ID NO: 121794 - DNA, 22 bp, Artificial Sequence
  Synthetic oligonucleotide; TTG chr11 5351484 5351505 5351489 5351484 -
ccagctttgcaaagaggcaaat

SEQ ID NO: 121795 - DNA, 22 bp, Artificial Sequence
  Synthetic oligonucleotide; CTT chr11 5351477 5351498 5351482 5351477 -
tgcaaagaggcaaatatttact

SEQ ID NO: 121796 - DNA, 22 bp, Artificial Sequence
  Synthetic oligonucleotide; TTT chr11 5351476 5351497 5351481 5351476 -
gcaaagaggcaaatatttactc

SEQ ID NO: 121797 - DNA, 22 bp, Artificial Sequence
  Synthetic oligonucleotide; TTG chr11 5351475 5351496 5351480 5351475 -
caaagaggcaaatatttactcc

SEQ ID NO: 121798 - DNA, 22 bp, Artificial Sequence
  Synthetic oligonucleotide; TTT chr11 5351458 5351479 5351463 5351458 -
actccaggtaaagcaatagtaa

SEQ ID NO: 121799 - DNA, 22 bp, Artificial Sequence
  Synthetic oligonucleotide; TTA chr11 5351457 5351478 5351462 5351457 -
ctccaggtaaagcaatagtaat

SEQ ID NO: 121800 - DNA, 22 bp, Artificial Sequence
  Synthetic oligonucleotide; CTC chr11 5351454 5351475 5351459 5351454 -
caggtaaagcaatagtaatcag

SEQ ID NO: 121801 - DNA, 22 bp, Artificial Sequence
  Synthetic oligonucleotide; TTG chr11 5351429 5351450 5351434 5351429 -
tataaaagttgctccttgagaa

SEQ ID NO: 121802 - DNA, 22 bp, Artificial Sequence
  Synthetic oligonucleotide; TTG chr11 5351418 5351439 5351423 5351418 -
ctccttgagaattctacctgtt

SEQ ID NO: 121803 - DNA, 22 bp, Artificial Sequence
  Synthetic oligonucleotide; CTC chr11 5351415 5351436 5351420 5351415 -
cttgagaattctacctgttcat

SEQ ID NO: 121804 - DNA, 22 bp, Artificial Sequence
  Synthetic oligonucleotide; CTT chr11 5351412 5351433 5351417 5351412 -
gagaattctacctgttcataag

SEQ ID NO: 121805 - DNA, 22 bp, Artificial Sequence
  Synthetic oligonucleotide; TTG chr11 5351411 5351432 5351416 5351411 -
agaattctacctgttcataaga

SEQ ID NO: 121806 - DNA, 22 bp, Artificial Sequence
  Synthetic oligonucleotide; TTC chr11 5351404 5351425 5351409 5351404 -
tacctgttcataagatgttcac

SEQ ID NO: 121807 - DNA, 22 bp, Artificial Sequence
  Synthetic oligonucleotide; CTA chr11 5351402 5351423 5351407 5351402 -
cctgttcataagatgttcacca

SEQ ID NO: 121808 - DNA, 22 bp, Artificial Sequence
  Synthetic oligonucleotide; CTG chr11 5351398 5351419 5351403 5351398 -
ttcataagatgttcaccagtcc

SEQ ID NO: 121809 - DNA, 22 bp, Artificial Sequence
  Synthetic oligonucleotide; TTC chr11 5351395 5351416 5351400 5351395 -
ataagatgttcaccagtcctga

SEQ ID NO: 121810 - DNA, 22 bp, Artificial Sequence
  Synthetic oligonucleotide; TTC chr11 5351384 5351405 5351389 5351384 -
accagtcctgactttcagtgac

SEQ ID NO: 121811 - DNA, 22 bp, Artificial Sequence
  Synthetic oligonucleotide; CTG chr11 5351374 5351395 5351379 5351374 -
actttcagtgacagcaaggatg

SEQ ID NO: 121812 - DNA, 22 bp, Artificial Sequence
  Synthetic oligonucleotide; CTT chr11 5351370 5351391 5351375 5351370 -
tcagtgacagcaaggatgataa

SEQ ID NO: 121813 - DNA, 22 bp, Artificial Sequence
  Synthetic oligonucleotide; TTT chr11 5351369 5351390 5351374 5351369 -
cagtgacagcaaggatgataat

SEQ ID NO: 121814 - DNA, 22 bp, Artificial Sequence
  Synthetic oligonucleotide; TTC chr11 5351368 5351389 5351373 5351368 -
agtgacagcaaggatgataatt

SEQ ID NO: 121815 - DNA, 22 bp, Artificial Sequence
  Synthetic oligonucleotide; TTT chr11 5351345 5351366 5351350 5351345 -
agtcattcctgggagatcctag

SEQ ID NO: 121816 - DNA, 22 bp, Artificial Sequence
  Synthetic oligonucleotide; TTA chr11 5351344 5351365 5351349 5351344 -
gtcattcctgggagatcctagg

SEQ ID NO: 121817 - DNA, 22 bp, Artificial Sequence
  Synthetic oligonucleotide; TTC chr11 5351337 5351358 5351342 5351337 -
ctgggagatcctaggtatggga

SEQ ID NO: 121818 - DNA, 22 bp, Artificial Sequence
  Synthetic oligonucleotide; CTG chr11 5351334 5351355 5351339 5351334 -
ggagatcctaggtatgggaaaa

SEQ ID NO: 121819 - DNA, 22 bp, Artificial Sequence
  Synthetic oligonucleotide; CTA chr11 5351324 5351345 5351329 5351324 -
ggtatgggaaaatagaatgtat

SEQ ID NO: 121820 - DNA, 22 bp, Artificial Sequence
  Synthetic oligonucleotide; TTA chr11 5351289 5351310 5351294 5351289 -
tttagggtttactctatgtaag

SEQ ID NO: 121821 - DNA, 22 bp, Artificial Sequence
  Synthetic oligonucleotide; TTT chr11 5351286 5351307 5351291 5351286 -
agggtttactctatgtaagatt

SEQ ID NO: 121822 - DNA, 22 bp, Artificial Sequence
  Synthetic oligonucleotide; TTA chr11 5351285 5351306 5351290 5351285 -
gggtttactctatgtaagatta

SEQ ID NO: 121823 - DNA, 22 bp, Artificial Sequence
  Synthetic oligonucleotide; TTT chr11 5351279 5351300 5351284 5351279 -
actctatgtaagattattggat

SEQ ID NO: 121824 - DNA, 22 bp, Artificial Sequence
  Synthetic oligonucleotide; TTA chr11 5351278 5351299 5351283 5351278 -
ctctatgtaagattattggata

SEQ ID NO: 121825 - DNA, 22 bp, Artificial Sequence
  Synthetic oligonucleotide; CTC chr11 5351275 5351296 5351280 5351275 -
tatgtaagattattggatacta

SEQ ID NO: 121826 - DNA, 22 bp, Artificial Sequence
  Synthetic oligonucleotide; CTA chr11 5351273 5351294 5351278 5351273 -
tgtaagattattggatactacg

SEQ ID NO: 121827 - DNA, 22 bp, Artificial Sequence
  Synthetic oligonucleotide; TTA chr11 5351263 5351284 5351268 5351263 -
ttggatactacgttggggatac

SEQ ID NO: 121828 - DNA, 22 bp, Artificial Sequence
  Synthetic oligonucleotide; TTG chr11 5351260 5351281 5351265 5351260 -
gatactacgttggggatacagc

SEQ ID NO: 121829 - DNA, 22 bp, Artificial Sequence
  Synthetic oligonucleotide; CTA chr11 5351253 5351274 5351258 5351253 -
cgttggggatacagctattcat

SEQ ID NO: 121830 - DNA, 22 bp, Artificial Sequence
  Synthetic oligonucleotide; TTG chr11 5351248 5351269 5351253 5351248 -
gggatacagctattcatgcaga

SEQ ID NO: 121831 - DNA, 22 bp, Artificial Sequence
  Synthetic oligonucleotide; CTA chr11 5351236 5351257 5351241 5351236 -
ttcatgcagaataaacattgtt

SEQ ID NO: 121832 - DNA, 22 bp, Artificial Sequence
  Synthetic oligonucleotide; TTC chr11 5351233 5351254 5351238 5351233 -
atgcagaataaacattgttgaa

SEQ ID NO: 121833 - DNA, 22 bp, Artificial Sequence
  Synthetic oligonucleotide; TTG chr11 5351216 5351237 5351221 5351216 -
ttgaattcattgtaaatcatat

SEQ ID NO: 121834 - DNA, 22 bp, Artificial Sequence
  Synthetic oligonucleotide; TTG chr11 5351213 5351234 5351218 5351213 -
aattcattgtaaatcatataac

SEQ ID NO: 121835 - DNA, 22 bp, Artificial Sequence
  Synthetic oligonucleotide; TTC chr11 5351208 5351229 5351213 5351208 -
attgtaaatcatataacccaga

SEQ ID NO: 121836 - DNA, 22 bp, Artificial Sequence
  Synthetic oligonucleotide; TTG chr11 5351204 5351225 5351209 5351204 -
taaatcatataacccagaaaat

SEQ ID NO: 121837 - DNA, 22 bp, Artificial Sequence
  Synthetic oligonucleotide; CTA chr11 5351154 5351175 5351159 5351154 -
tatttgaatagtgctgtaatgg

SEQ ID NO: 121838 - DNA, 22 bp, Artificial Sequence
  Synthetic oligonucleotide; TTT chr11 5351149 5351170 5351154 5351149 -
gaatagtgctgtaatggcctga

SEQ ID NO: 121839 - DNA, 22 bp, Artificial Sequence
  Synthetic oligonucleotide; TTG chr11 5351148 5351169 5351153 5351148 -
aatagtgctgtaatggcctgaa

SEQ ID NO: 121840 - DNA, 22 bp, Artificial Sequence
  Synthetic oligonucleotide; CTG chr11 5351138 5351159 5351143 5351138 -
taatggcctgaaacttataggt

SEQ ID NO: 121841 - DNA, 22 bp, Artificial Sequence
  Synthetic oligonucleotide; CTG chr11 5351128 5351149 5351133 5351128 -
aaacttataggtcacttttcat

SEQ ID NO: 121842 - DNA, 22 bp, Artificial Sequence
  Synthetic oligonucleotide; CTT chr11 5351122 5351143 5351127 5351122 -
ataggtcacttttcatggtgct

SEQ ID NO: 121843 - DNA, 22 bp, Artificial Sequence
  Synthetic oligonucleotide; TTA chr11 5351121 5351142 5351126 5351121 -
taggtcacttttcatggtgctc

SEQ ID NO: 121844 - DNA, 22 bp, Artificial Sequence
  Synthetic oligonucleotide; CTT chr11 5351111 5351132 5351116 5351111 -
ttcatggtgctcttcatcctga

SEQ ID NO: 121845 - DNA, 22 bp, Artificial Sequence
  Synthetic oligonucleotide; TTT chr11 5351110 5351131 5351115 5351110 -
tcatggtgctcttcatcctgac

SEQ ID NO: 121846 - DNA, 22 bp, Artificial Sequence
  Synthetic oligonucleotide; TTT chr11 5351109 5351130 5351114 5351109 -
catggtgctcttcatcctgact

SEQ ID NO: 121847 - DNA, 22 bp, Artificial Sequence
  Synthetic oligonucleotide; TTC chr11 5351108 5351129 5351113 5351108 -
atggtgctcttcatcctgactg

SEQ ID NO: 121848 - DNA, 22 bp, Artificial Sequence
  Synthetic oligonucleotide; CTC chr11 5351099 5351120 5351104 5351099 -
ttcatcctgactggtggtatta

SEQ ID NO: 121849 - DNA, 22 bp, Artificial Sequence
  Synthetic oligonucleotide; CTT chr11 5351097 5351118 5351102 5351097 -
catcctgactggtggtattata

SEQ ID NO: 121850 - DNA, 22 bp, Artificial Sequence
  Synthetic oligonucleotide; TTC chr11 5351096 5351117 5351101 5351096 -
atcctgactggtggtattatag

SEQ ID NO: 121851 - DNA, 22 bp, Artificial Sequence
  Synthetic oligonucleotide; CTG chr11 5351090 5351111 5351095 5351090 -
actggtggtattatagggtgga

SEQ ID NO: 121852 - DNA, 22 bp, Artificial Sequence
  Synthetic oligonucleotide; CTG chr11 5351086 5351107 5351091 5351086 -
gtggtattatagggtggatgta

SEQ ID NO: 121853 - DNA, 22 bp, Artificial Sequence
  Synthetic oligonucleotide; TTA chr11 5351077 5351098 5351082 5351077 -
tagggtggatgtaaaggtttcc

SEQ ID NO: 121854 - DNA, 22 bp, Artificial Sequence
  Synthetic oligonucleotide; TTT chr11 5351057 5351078 5351062 5351057 -
cccaggctatgtgagacctaaa

SEQ ID NO: 121855 - DNA, 22 bp, Artificial Sequence
  Synthetic oligonucleotide; TTC chr11 5351056 5351077 5351061 5351056 -
ccaggctatgtgagacctaaaa

SEQ ID NO: 121856 - DNA, 22 bp, Artificial Sequence
  Synthetic oligonucleotide; CTA chr11 5351048 5351069 5351053 5351048 -
tgtgagacctaaaagatcagta

SEQ ID NO: 121857 - DNA, 22 bp, Artificial Sequence
  Synthetic oligonucleotide; CTA chr11 5351037 5351058 5351042 5351037 -
aaagatcagtagaaaaatggtt

SEQ ID NO: 121858 - DNA, 22 bp, Artificial Sequence
  Synthetic oligonucleotide; TTC chr11 5351014 5351035 5351019 5351014 -
taagcactattggaaaagcaga

SEQ ID NO: 121859 - DNA, 22 bp, Artificial Sequence
  Synthetic oligonucleotide; CTA chr11 5351012 5351033 5351017 5351012 -
agcactattggaaaagcagata

SEQ ID NO: 121860 - DNA, 22 bp, Artificial Sequence
  Synthetic oligonucleotide; CTA chr11 5351005 5351026 5351010 5351005 -
ttggaaaagcagatataaagat

SEQ ID NO: 121861 - DNA, 22 bp, Artificial Sequence
  Synthetic oligonucleotide; TTG chr11 5351002 5351023 5351007 5351002 -
gaaaagcagatataaagattat

SEQ ID NO: 121862 - DNA, 22 bp, Artificial Sequence
  Synthetic oligonucleotide; TTA chr11 5350981 5351002 5350986 5350981 -
tatggaaaaacaaatacacaag

SEQ ID NO: 121863 - DNA, 22 bp, Artificial Sequence
  Synthetic oligonucleotide; TTT chr11 5350920 5350941 5350925 5350920 -
cagagattgacttttcttcaat

SEQ ID NO: 121864 - DNA, 22 bp, Artificial Sequence
  Synthetic oligonucleotide; TTC chr11 5350919 5350940 5350924 5350919 -
agagattgacttttcttcaata

SEQ ID NO: 121865 - DNA, 22 bp, Artificial Sequence
  Synthetic oligonucleotide; TTG chr11 5350911 5350932 5350916 5350911 -
acttttcttcaatattcctgga

SEQ ID NO: 121866 - DNA, 22 bp, Artificial Sequence
  Synthetic oligonucleotide; CTT chr11 5350907 5350928 5350912 5350907 -
ttcttcaatattcctggaggga

SEQ ID NO: 121867 - DNA, 22 bp, Artificial Sequence
  Synthetic oligonucleotide; TTT chr11 5350906 5350927 5350911 5350906 -
tcttcaatattcctggagggaa

SEQ ID NO: 121868 - DNA, 22 bp, Artificial Sequence
  Synthetic oligonucleotide; TTT chr11 5350905 5350926 5350910 5350905 -
cttcaatattcctggagggaaa

SEQ ID NO: 121869 - DNA, 22 bp, Artificial Sequence
  Synthetic oligonucleotide; TTC chr11 5350904 5350925 5350909 5350904 -
ttcaatattcctggagggaaaa

SEQ ID NO: 121870 - DNA, 22 bp, Artificial Sequence
  Synthetic oligonucleotide; CTT chr11 5350902 5350923 5350907 5350902 -
caatattcctggagggaaaatt

SEQ ID NO: 121871 - DNA, 22 bp, Artificial Sequence
  Synthetic oligonucleotide; TTC chr11 5350901 5350922 5350906 5350901 -
aatattcctggagggaaaattc

SEQ ID NO: 121872 - DNA, 22 bp, Artificial Sequence
  Synthetic oligonucleotide; TTC chr11 5350894 5350915 5350899 5350894 -
ctggagggaaaattcaattgat

SEQ ID NO: 121873 - DNA, 22 bp, Artificial Sequence
  Synthetic oligonucleotide; CTG chr11 5350891 5350912 5350896 5350891 -
gagggaaaattcaattgatgaa

SEQ ID NO: 121874 - DNA, 22 bp, Artificial Sequence
  Synthetic oligonucleotide; TTC chr11 5350879 5350900 5350884 5350879 -
aattgatgaagctccagagact

SEQ ID NO: 121875 - DNA, 22 bp, Artificial Sequence
  Synthetic oligonucleotide; TTG chr11 5350874 5350895 5350879 5350874 -
atgaagctccagagacttttgg

SEQ ID NO: 121876 - DNA, 22 bp, Artificial Sequence
  Synthetic oligonucleotide; CTC chr11 5350865 5350886 5350870 5350865 -
cagagacttttgggtagttaga

SEQ ID NO: 121877 - DNA, 22 bp, Artificial Sequence
  Synthetic oligonucleotide; CTT chr11 5350856 5350877 5350861 5350856 -
ttgggtagttagaaaatgacgt

SEQ ID NO: 121878 - DNA, 22 bp, Artificial Sequence
  Synthetic oligonucleotide; TTT chr11 5350855 5350876 5350860 5350855 -
tgggtagttagaaaatgacgta

SEQ ID NO: 121879 - DNA, 22 bp, Artificial Sequence
  Synthetic oligonucleotide; TTT chr11 5350854 5350875 5350859 5350854 -
gggtagttagaaaatgacgtaa

SEQ ID NO: 121880 - DNA, 22 bp, Artificial Sequence
  Synthetic oligonucleotide; TTG chr11 5350853 5350874 5350858 5350853 -
ggtagttagaaaatgacgtaag

SEQ ID NO: 121881 - DNA, 22 bp, Artificial Sequence
  Synthetic oligonucleotide; TTA chr11 5350845 5350866 5350850 5350845 -
gaaaatgacgtaagagtgactt

SEQ ID NO: 121882 - DNA, 22 bp, Artificial Sequence
  Synthetic oligonucleotide; CTT chr11 5350823 5350844 5350828 5350823 -
acctgtgtgtgtttccaaagca

SEQ ID NO: 121883 - DNA, 22 bp, Artificial Sequence
  Synthetic oligonucleotide; TTA chr11 5350822 5350843 5350827 5350822 -
cctgtgtgtgtttccaaagcac

SEQ ID NO: 121884 - DNA, 22 bp, Artificial Sequence
  Synthetic oligonucleotide; CTG chr11 5350818 5350839 5350823 5350818 -
tgtgtgtttccaaagcacatag

SEQ ID NO: 121885 - DNA, 22 bp, Artificial Sequence
  Synthetic oligonucleotide; TTT chr11 5350809 5350830 5350814 5350809 -
ccaaagcacatagaactctaag

SEQ ID NO: 121886 - DNA, 22 bp, Artificial Sequence
  Synthetic oligonucleotide; TTC chr11 5350808 5350829 5350813 5350808 -
caaagcacatagaactctaagt

SEQ ID NO: 121887 - DNA, 22 bp, Artificial Sequence
  Synthetic oligonucleotide; CTC chr11 5350791 5350812 5350796 5350791 -
taagttgcccagctttataacc

SEQ ID NO: 121888 - DNA, 22 bp, Artificial Sequence
  Synthetic oligonucleotide; CTA chr11 5350789 5350810 5350794 5350789 -
agttgcccagctttataaccct

SEQ ID NO: 121889 - DNA, 22 bp, Artificial Sequence
  Synthetic oligonucleotide; TTG chr11 5350784 5350805 5350789 5350784 -
cccagctttataaccctagtta

SEQ ID NO: 121890 - DNA, 22 bp, Artificial Sequence
  Synthetic oligonucleotide; CTT chr11 5350776 5350797 5350781 5350776 -
tataaccctagttattgataca

SEQ ID NO: 121891 - DNA, 22 bp, Artificial Sequence
  Synthetic oligonucleotide; TTT chr11 5350775 5350796 5350780 5350775 -
ataaccctagttattgatacac

SEQ ID NO: 121892 - DNA, 22 bp, Artificial Sequence
  Synthetic oligonucleotide; TTA chr11 5350774 5350795 5350779 5350774 -
taaccctagttattgatacact

SEQ ID NO: 121893 - DNA, 22 bp, Artificial Sequence
  Synthetic oligonucleotide; CTA chr11 5350766 5350787 5350771 5350766 -
gttattgatacactgcttcaaa

SEQ ID NO: 121894 - DNA, 22 bp, Artificial Sequence
  Synthetic oligonucleotide; TTA chr11 5350762 5350783 5350767 5350762 -
ttgatacactgcttcaaagaat

SEQ ID NO: 121895 - DNA, 22 bp, Artificial Sequence
  Synthetic oligonucleotide; TTG chr11 5350759 5350780 5350764 5350759 -
atacactgcttcaaagaattca

SEQ ID NO: 121896 - DNA, 22 bp, Artificial Sequence
  Synthetic oligonucleotide; CTG chr11 5350751 5350772 5350756 5350751 -
cttcaaagaattcaaattttca

SEQ ID NO: 121897 - DNA, 22 bp, Artificial Sequence
  Synthetic oligonucleotide; CTT chr11 5350748 5350769 5350753 5350748 -
caaagaattcaaattttcataa

SEQ ID NO: 121898 - DNA, 22 bp, Artificial Sequence
  Synthetic oligonucleotide; TTC chr11 5350747 5350768 5350752 5350747 -
aaagaattcaaattttcataat

SEQ ID NO: 121899 - DNA, 22 bp, Artificial Sequence
  Synthetic oligonucleotide; TTC chr11 5350738 5350759 5350743 5350738 -
aaattttcataatataaattga

SEQ ID NO: 121900 - DNA, 22 bp, Artificial Sequence
  Synthetic oligonucleotide; TTT chr11 5350732 5350753 5350737 5350732 -
tcataatataaattgaagaata

SEQ ID NO: 121901 - DNA, 22 bp, Artificial Sequence
  Synthetic oligonucleotide; TTT chr11 5350731 5350752 5350736 5350731 -
cataatataaattgaagaataa

SEQ ID NO: 121902 - DNA, 22 bp, Artificial Sequence
  Synthetic oligonucleotide; TTC chr11 5350730 5350751 5350735 5350730 -
ataatataaattgaagaataaa

SEQ ID NO: 121903 - DNA, 22 bp, Artificial Sequence
  Synthetic oligonucleotide; TTG chr11 5350717 5350738 5350722 5350717 -
aagaataaacagtaaaatgtgg

SEQ ID NO: 121904 - DNA, 22 bp, Artificial Sequence
  Synthetic oligonucleotide; TTT chr11 5350691 5350712 5350696 5350691 -
gatgataagcttttgaaggcac

SEQ ID NO: 121905 - DNA, 22 bp, Artificial Sequence
  Synthetic oligonucleotide; TTG chr11 5350690 5350711 5350695 5350690 -
atgataagcttttgaaggcact

SEQ ID NO: 121906 - DNA, 22 bp, Artificial Sequence
  Synthetic oligonucleotide; CTT chr11 5350679 5350700 5350684 5350679 -
ttgaaggcactaattgataata

SEQ ID NO: 121907 - DNA, 22 bp, Artificial Sequence
  Synthetic oligonucleotide; TTT chr11 5350678 5350699 5350683 5350678 -
tgaaggcactaattgataatag

SEQ ID NO: 121908 - DNA, 22 bp, Artificial Sequence
  Synthetic oligonucleotide; TTT chr11 5350677 5350698 5350682 5350677 -
gaaggcactaattgataatagc

SEQ ID NO: 121909 - DNA, 22 bp, Artificial Sequence
  Synthetic oligonucleotide; TTG chr11 5350676 5350697 5350681 5350676 -
aaggcactaattgataatagca

SEQ ID NO: 121910 - DNA, 22 bp, Artificial Sequence
  Synthetic oligonucleotide; CTA chr11 5350667 5350688 5350672 5350667 -
attgataatagcaccaaactac

SEQ ID NO: 121911 - DNA, 22 bp, Artificial Sequence
  Synthetic oligonucleotide; TTG chr11 5350663 5350684 5350668 5350663 -
ataatagcaccaaactactgtt

SEQ ID NO: 121912 - DNA, 22 bp, Artificial Sequence
  Synthetic oligonucleotide; CTA chr11 5350646 5350667 5350651 5350646 -
ctgttgcatatcacctacttgg

SEQ ID NO: 121913 - DNA, 22 bp, Artificial Sequence
  Synthetic oligonucleotide; CTG chr11 5350643 5350664 5350648 5350643 -
ttgcatatcacctacttggtga

SEQ ID NO: 121914 - DNA, 22 bp, Artificial Sequence
  Synthetic oligonucleotide; TTG chr11 5350640 5350661 5350645 5350640 -
catatcacctacttggtgatgc

SEQ ID NO: 121915 - DNA, 22 bp, Artificial Sequence
  Synthetic oligonucleotide; CTA chr11 5350629 5350650 5350634 5350629 -
cttggtgatgcaaaaataaaaa

SEQ ID NO: 121916 - DNA, 22 bp, Artificial Sequence
  Synthetic oligonucleotide; CTT chr11 5350626 5350647 5350631 5350626 -
ggtgatgcaaaaataaaaattg

SEQ ID NO: 121917 - DNA, 22 bp, Artificial Sequence
  Synthetic oligonucleotide; TTG chr11 5350625 5350646 5350630 5350625 -
gtgatgcaaaaataaaaattgg

SEQ ID NO: 121918 - DNA, 22 bp, Artificial Sequence
  Synthetic oligonucleotide; TTG chr11 5350604 5350625 5350609 5350604 -
gtaatttaggcaagatcaagga

SEQ ID NO: 121919 - DNA, 22 bp, Artificial Sequence
  Synthetic oligonucleotide; TTT chr11 5350597 5350618 5350602 5350597 -
aggcaagatcaaggagaatttt

SEQ ID NO: 121920 - DNA, 22 bp, Artificial Sequence
  Synthetic oligonucleotide; TTA chr11 5350596 5350617 5350601 5350596 -
ggcaagatcaaggagaattttt

SEQ ID NO: 121921 - DNA, 22 bp, Artificial Sequence
  Synthetic oligonucleotide; TTT chr11 5350576 5350597 5350581 5350576 -
tttttttaaaactatggaatct

SEQ ID NO: 121922 - DNA, 22 bp, Artificial Sequence
  Synthetic oligonucleotide; TTT chr11 5350575 5350596 5350580 5350575 -
ttttttaaaactatggaatctg

SEQ ID NO: 121923 - DNA, 22 bp, Artificial Sequence
  Synthetic oligonucleotide; TTT chr11 5350574 5350595 5350579 5350574 -
tttttaaaactatggaatctga

SEQ ID NO: 121924 - DNA, 22 bp, Artificial Sequence
  Synthetic oligonucleotide; TTT chr11 5350573 5350594 5350578 5350573 -
ttttaaaactatggaatctgat

SEQ ID NO: 121925 - DNA, 22 bp, Artificial Sequence
  Synthetic oligonucleotide; TTT chr11 5350572 5350593 5350577 5350572 -
tttaaaactatggaatctgatg

SEQ ID NO: 121926 - DNA, 22 bp, Artificial Sequence
  Synthetic oligonucleotide; TTT chr11 5350571 5350592 5350576 5350571 -
ttaaaactatggaatctgatgg

SEQ ID NO: 121927 - DNA, 22 bp, Artificial Sequence
  Synthetic oligonucleotide; TTT chr11 5350570 5350591 5350575 5350570 -
taaaactatggaatctgatggg

SEQ ID NO: 121928 - DNA, 22 bp, Artificial Sequence
  Synthetic oligonucleotide; TTT chr11 5350569 5350590 5350574 5350569 -
aaaactatggaatctgatggga

SEQ ID NO: 121929 - DNA, 22 bp, Artificial Sequence
  Synthetic oligonucleotide; TTA chr11 5350568 5350589 5350573 5350568 -
aaactatggaatctgatgggat

SEQ ID NO: 121930 - DNA, 22 bp, Artificial Sequence
  Synthetic oligonucleotide; CTA chr11 5350562 5350583 5350567 5350562 -
tggaatctgatgggatttgaca

SEQ ID NO: 121931 - DNA, 22 bp, Artificial Sequence
  Synthetic oligonucleotide; CTG chr11 5350553 5350574 5350558 5350553 -
atgggatttgacaaaagtgaga

SEQ ID NO: 121932 - DNA, 22 bp, Artificial Sequence
  Synthetic oligonucleotide; TTT chr11 5350544 5350565 5350549 5350544 -
gacaaaagtgagaaggctctgt

SEQ ID NO: 121933 - DNA, 22 bp, Artificial Sequence
  Synthetic oligonucleotide; TTG chr11 5350543 5350564 5350548 5350543 -
acaaaagtgagaaggctctgtg

SEQ ID NO: 121934 - DNA, 22 bp, Artificial Sequence
  Synthetic oligonucleotide; CTC chr11 5350525 5350546 5350530 5350525 -
tgtgactcattagaattctaag

SEQ ID NO: 121935 - DNA, 22 bp, Artificial Sequence
  Synthetic oligonucleotide; CTG chr11 5350523 5350544 5350528 5350523 -
tgactcattagaattctaagat

SEQ ID NO: 121936 - DNA, 22 bp, Artificial Sequence
  Synthetic oligonucleotide; CTC chr11 5350517 5350538 5350522 5350517 -
attagaattctaagatttcagc

SEQ ID NO: 121937 - DNA, 22 bp, Artificial Sequence
  Synthetic oligonucleotide; TTA chr11 5350513 5350534 5350518 5350513 -
gaattctaagatttcagctggt

SEQ ID NO: 121938 - DNA, 22 bp, Artificial Sequence
  Synthetic oligonucleotide; TTC chr11 5350507 5350528 5350512 5350507 -
taagatttcagctggtgcaggc

SEQ ID NO: 121939 - DNA, 22 bp, Artificial Sequence
  Synthetic oligonucleotide; CTA chr11 5350505 5350526 5350510 5350505 -
agatttcagctggtgcaggcag

SEQ ID NO: 121940 - DNA, 22 bp, Artificial Sequence
  Synthetic oligonucleotide; TTT chr11 5350499 5350520 5350504 5350499 -
cagctggtgcaggcagccaacc

SEQ ID NO: 121941 - DNA, 22 bp, Artificial Sequence
  Synthetic oligonucleotide; TTC chr11 5350498 5350519 5350503 5350498 -
agctggtgcaggcagccaacct

SEQ ID NO: 121942 - DNA, 22 bp, Artificial Sequence
  Synthetic oligonucleotide; CTG chr11 5350493 5350514 5350498 5350493 -
gtgcaggcagccaacctctgag

SEQ ID NO: 121943 - DNA, 22 bp, Artificial Sequence
  Synthetic oligonucleotide; CTC chr11 5350475 5350496 5350480 5350475 -
tgagaatacataaattgtgtgt

SEQ ID NO: 121944 - DNA, 22 bp, Artificial Sequence
  Synthetic oligonucleotide; CTG chr11 5350473 5350494 5350478 5350473 -
agaatacataaattgtgtgttg

SEQ ID NO: 121945 - DNA, 22 bp, Artificial Sequence
  Synthetic oligonucleotide; TTG chr11 5350458 5350479 5350463 5350458 -
tgtgttggtggcatgagccaga

SEQ ID NO: 121946 - DNA, 22 bp, Artificial Sequence
  Synthetic oligonucleotide; TTG chr11 5350451 5350472 5350456 5350451 -
gtggcatgagccagagaaaata

SEQ ID NO: 121947 - DNA, 22 bp, Artificial Sequence
  Synthetic oligonucleotide; CTT chr11 5350419 5350440 5350424 5350419 -
ctcttatggttggtttggacta

SEQ ID NO: 121948 - DNA, 22 bp, Artificial Sequence
  Synthetic oligonucleotide; TTC chr11 5350418 5350439 5350423 5350418 -
tcttatggttggtttggactat

SEQ ID NO: 121949 - DNA, 22 bp, Artificial Sequence
  Synthetic oligonucleotide; CTC chr11 5350416 5350437 5350421 5350416 -
ttatggttggtttggactatac

SEQ ID NO: 121950 - DNA, 22 bp, Artificial Sequence
  Synthetic oligonucleotide; CTT chr11 5350414 5350435 5350419 5350414 -
atggttggtttggactatacat

SEQ ID NO: 121951 - DNA, 22 bp, Artificial Sequence
  Synthetic oligonucleotide; TTA chr11 5350413 5350434 5350418 5350413 -
tggttggtttggactatacatc

SEQ ID NO: 121952 - DNA, 22 bp, Artificial Sequence
  Synthetic oligonucleotide; TTG chr11 5350407 5350428 5350412 5350407 -
gtttggactatacatctcatat

SEQ ID NO: 121953 - DNA, 22 bp, Artificial Sequence
  Synthetic oligonucleotide; TTT chr11 5350403 5350424 5350408 5350403 -
ggactatacatctcatatacta

SEQ ID NO: 121954 - DNA, 22 bp, Artificial Sequence
  Synthetic oligonucleotide; TTG chr11 5350402 5350423 5350407 5350402 -
gactatacatctcatatactat

SEQ ID NO: 121955 - DNA, 22 bp, Artificial Sequence
  Synthetic oligonucleotide; CTA chr11 5350397 5350418 5350402 5350397 -
tacatctcatatactattgaaa

SEQ ID NO: 121956 - DNA, 22 bp, Artificial Sequence
  Synthetic oligonucleotide; CTC chr11 5350389 5350410 5350394 5350389 -
atatactattgaaagagcatat

SEQ ID NO: 121957 - DNA, 22 bp, Artificial Sequence
  Synthetic oligonucleotide; CTA chr11 5350381 5350402 5350386 5350381 -
ttgaaagagcatattgatgtaa

SEQ ID NO: 121958 - DNA, 22 bp, Artificial Sequence
  Synthetic oligonucleotide; TTG chr11 5350378 5350399 5350383 5350378 -
aaagagcatattgatgtaaatt

SEQ ID NO: 121959 - DNA, 22 bp, Artificial Sequence
  Synthetic oligonucleotide; TTG chr11 5350365 5350386 5350370 5350365 -
atgtaaatttatgcacgattta

SEQ ID NO: 121960 - DNA, 22 bp, Artificial Sequence
  Synthetic oligonucleotide; TTT chr11 5350355 5350376 5350360 5350355 -
atgcacgatttacaagacctct

SEQ ID NO: 121961 - DNA, 22 bp, Artificial Sequence
  Synthetic oligonucleotide; TTA chr11 5350354 5350375 5350359 5350354 -
tgcacgatttacaagacctctt

SEQ ID NO: 121962 - DNA, 22 bp, Artificial Sequence
  Synthetic oligonucleotide; TTT chr11 5350344 5350365 5350349 5350344 -
acaagacctctttctgtccatg

SEQ ID NO: 121963 - DNA, 22 bp, Artificial Sequence
  Synthetic oligonucleotide; TTA chr11 5350343 5350364 5350348 5350343 -
caagacctctttctgtccatga

SEQ ID NO: 121964 - DNA, 22 bp, Artificial Sequence
  Synthetic oligonucleotide; CTC chr11 5350334 5350355 5350339 5350334 -
tttctgtccatgaaaagaatgc

SEQ ID NO: 121965 - DNA, 22 bp, Artificial Sequence
  Synthetic oligonucleotide; CTT chr11 5350332 5350353 5350337 5350332 -
tctgtccatgaaaagaatgcat

SEQ ID NO: 121966 - DNA, 22 bp, Artificial Sequence
  Synthetic oligonucleotide; TTT chr11 5350331 5350352 5350336 5350331 -
ctgtccatgaaaagaatgcatc

SEQ ID NO: 121967 - DNA, 22 bp, Artificial Sequence
  Synthetic oligonucleotide; TTC chr11 5350330 5350351 5350335 5350330 -
tgtccatgaaaagaatgcatcc

SEQ ID NO: 121968 - DNA, 22 bp, Artificial Sequence
  Synthetic oligonucleotide; CTG chr11 5350328 5350349 5350333 5350328 -
tccatgaaaagaatgcatccaa

SEQ ID NO: 121969 - DNA, 22 bp, Artificial Sequence
  Synthetic oligonucleotide; TTA chr11 5350301 5350322 5350306 5350301 -
ctggactttcattttcagaaga

SEQ ID NO: 121970 - DNA, 22 bp, Artificial Sequence
  Synthetic oligonucleotide; CTG chr11 5350298 5350319 5350303 5350298 -
gactttcattttcagaagaatt

SEQ ID NO: 121971 - DNA, 22 bp, Artificial Sequence
  Synthetic oligonucleotide; CTT chr11 5350293 5350314 5350298 5350293 -
tcattttcagaagaatttgttg

SEQ ID NO: 121972 - DNA, 22 bp, Artificial Sequence
  Synthetic oligonucleotide; TTT chr11 5350292 5350313 5350297 5350292 -
cattttcagaagaatttgttga

SEQ ID NO: 121973 - DNA, 22 bp, Artificial Sequence
  Synthetic oligonucleotide; TTC chr11 5350291 5350312 5350296 5350291 -
attttcagaagaatttgttgaa

SEQ ID NO: 121974 - DNA, 22 bp, Artificial Sequence
  Synthetic oligonucleotide; TTT chr11 5350287 5350308 5350292 5350287 -
tcagaagaatttgttgaagttt

SEQ ID NO: 121975 - DNA, 22 bp, Artificial Sequence
  Synthetic oligonucleotide; TTT chr11 5350286 5350307 5350291 5350286 -
cagaagaatttgttgaagtttc

SEQ ID NO: 121976 - DNA, 22 bp, Artificial Sequence
  Synthetic oligonucleotide; TTC chr11 5350285 5350306 5350290 5350285 -
agaagaatttgttgaagtttca

SEQ ID NO: 121977 - DNA, 22 bp, Artificial Sequence
  Synthetic oligonucleotide; TTT chr11 5350275 5350296 5350280 5350275 -
gttgaagtttcagctctgctct

SEQ ID NO: 121978 - DNA, 22 bp, Artificial Sequence
  Synthetic oligonucleotide; TTG chr11 5350274 5350295 5350279 5350274 -
ttgaagtttcagctctgctctt

SEQ ID NO: 121979 - DNA, 22 bp, Artificial Sequence
  Synthetic oligonucleotide; TTG chr11 5350271 5350292 5350276 5350271 -
aagtttcagctctgctctttct

SEQ ID NO: 121980 - DNA, 22 bp, Artificial Sequence
  Synthetic oligonucleotide; TTT chr11 5350265 5350286 5350270 5350265 -
cagctctgctctttctaacaat

SEQ ID NO: 121981 - DNA, 22 bp, Artificial Sequence
  Synthetic oligonucleotide; TTC chr11 5350264 5350285 5350269 5350264 -
agctctgctctttctaacaata

SEQ ID NO: 121982 - DNA, 22 bp, Artificial Sequence
  Synthetic oligonucleotide; CTC chr11 5350259 5350280 5350264 5350259 -
tgctctttctaacaataatgat

SEQ ID NO: 121983 - DNA, 22 bp, Artificial Sequence
  Synthetic oligonucleotide; CTG chr11 5350257 5350278 5350262 5350257 -
ctctttctaacaataatgatct

SEQ ID NO: 121984 - DNA, 22 bp, Artificial Sequence
  Synthetic oligonucleotide; CTC chr11 5350254 5350275 5350259 5350254 -
tttctaacaataatgatcttgg

SEQ ID NO: 121985 - DNA, 22 bp, Artificial Sequence
  Synthetic oligonucleotide; CTT chr11 5350252 5350273 5350257 5350252 -
tctaacaataatgatcttggga

SEQ ID NO: 121986 - DNA, 22 bp, Artificial Sequence
  Synthetic oligonucleotide; TTT chr11 5350251 5350272 5350256 5350251 -
ctaacaataatgatcttgggaa

SEQ ID NO: 121987 - DNA, 22 bp, Artificial Sequence
  Synthetic oligonucleotide; TTC chr11 5350250 5350271 5350255 5350250 -
taacaataatgatcttgggaaa

SEQ ID NO: 121988 - DNA, 22 bp, Artificial Sequence
  Synthetic oligonucleotide; CTA chr11 5350248 5350269 5350253 5350248 -
acaataatgatcttgggaaagt

SEQ ID NO: 121989 - DNA, 22 bp, Artificial Sequence
  Synthetic oligonucleotide; CTT chr11 5350234 5350255 5350239 5350234 -
gggaaagtaatttaatcttgag

SEQ ID NO: 121990 - DNA, 22 bp, Artificial Sequence
  Synthetic oligonucleotide; TTG chr11 5350233 5350254 5350238 5350233 -
ggaaagtaatttaatcttgaga

SEQ ID NO: 121991 - DNA, 22 bp, Artificial Sequence
  Synthetic oligonucleotide; TTT chr11 5350221 5350242 5350226 5350221 -
aatcttgagatttggttacata

SEQ ID NO: 121992 - DNA, 22 bp, Artificial Sequence
  Synthetic oligonucleotide; TTA chr11 5350220 5350241 5350225 5350220 -
atcttgagatttggttacataa

SEQ ID NO: 121993 - DNA, 22 bp, Artificial Sequence
  Synthetic oligonucleotide; CTT chr11 5350215 5350236 5350220 5350215 -
gagatttggttacataacctgt

SEQ ID NO: 121994 - DNA, 22 bp, Artificial Sequence
  Synthetic oligonucleotide; TTG chr11 5350214 5350235 5350219 5350214 -
agatttggttacataacctgta

SEQ ID NO: 121995 - DNA, 22 bp, Artificial Sequence
  Synthetic oligonucleotide; TTT chr11 5350208 5350229 5350213 5350208 -
ggttacataacctgtaaagact

SEQ ID NO: 121996 - DNA, 22 bp, Artificial Sequence
  Synthetic oligonucleotide; TTG chr11 5350207 5350228 5350212 5350207 -
gttacataacctgtaaagacta

SEQ ID NO: 121997 - DNA, 22 bp, Artificial Sequence
  Synthetic oligonucleotide; TTA chr11 5350203 5350224 5350208 5350203 -
cataacctgtaaagactactag

SEQ ID NO: 121998 - DNA, 22 bp, Artificial Sequence
  Synthetic oligonucleotide; CTG chr11 5350194 5350215 5350199 5350194 -
taaagactactagtgatttctg

SEQ ID NO: 121999 - DNA, 22 bp, Artificial Sequence
  Synthetic oligonucleotide; CTA chr11 5350185 5350206 5350190 5350185 -
ctagtgatttctgtcttctcag

SEQ ID NO: 122000 - DNA, 22 bp, Artificial Sequence
  Synthetic oligonucleotide; CTA chr11 5350182 5350203 5350187 5350182 -
gtgatttctgtcttctcagtca

SEQ ID NO: 122001 - DNA, 22 bp, Artificial Sequence
  Synthetic oligonucleotide; TTT chr11 5350175 5350196 5350180 5350175 -
ctgtcttctcagtcattctctt

SEQ ID NO: 122002 - DNA, 22 bp, Artificial Sequence
  Synthetic oligonucleotide; TTC chr11 5350174 5350195 5350179 5350174 -
tgtcttctcagtcattctcttg

SEQ ID NO: 122003 - DNA, 22 bp, Artificial Sequence
  Synthetic oligonucleotide; CTG chr11 5350172 5350193 5350177 5350172 -
tcttctcagtcattctcttgac

SEQ ID NO: 122004 - DNA, 22 bp, Artificial Sequence
  Synthetic oligonucleotide; CTT chr11 5350168 5350189 5350173 5350168 -
ctcagtcattctcttgacacaa

SEQ ID NO: 122005 - DNA, 22 bp, Artificial Sequence
  Synthetic oligonucleotide; TTC chr11 5350167 5350188 5350172 5350167 -
tcagtcattctcttgacacaaa

SEQ ID NO: 122006 - DNA, 22 bp, Artificial Sequence
  Synthetic oligonucleotide; CTC chr11 5350165 5350186 5350170 5350165 -
agtcattctcttgacacaaagt

SEQ ID NO: 122007 - DNA, 22 bp, Artificial Sequence
  Synthetic oligonucleotide; TTC chr11 5350157 5350178 5350162 5350157 -
tcttgacacaaagtaaggggaa

SEQ ID NO: 122008 - DNA, 22 bp, Artificial Sequence
  Synthetic oligonucleotide; CTC chr11 5350155 5350176 5350160 5350155 -
ttgacacaaagtaaggggaaat

SEQ ID NO: 122009 - DNA, 22 bp, Artificial Sequence
  Synthetic oligonucleotide; CTT chr11 5350153 5350174 5350158 5350153 -
gacacaaagtaaggggaaatgt

SEQ ID NO: 122010 - DNA, 22 bp, Artificial Sequence
  Synthetic oligonucleotide; TTG chr11 5350152 5350173 5350157 5350152 -
acacaaagtaaggggaaatgtt

SEQ ID NO: 122011 - DNA, 22 bp, Artificial Sequence
  Synthetic oligonucleotide; TTT chr11 5350129 5350150 5350134 5350129 -
tgtaaagagtggataatttttt

SEQ ID NO: 122012 - DNA, 22 bp, Artificial Sequence
  Synthetic oligonucleotide; TTT chr11 5350128 5350149 5350133 5350128 -
gtaaagagtggataattttttt

SEQ ID NO: 122013 - DNA, 22 bp, Artificial Sequence
  Synthetic oligonucleotide; TTG chr11 5350127 5350148 5350132 5350127 -
taaagagtggataattttttta

SEQ ID NO: 122014 - DNA, 22 bp, Artificial Sequence
  Synthetic oligonucleotide; TTT chr11 5350110 5350131 5350115 5350110 -
ttttatttttgtgtttttgtta

SEQ ID NO: 122015 - DNA, 22 bp, Artificial Sequence
  Synthetic oligonucleotide; TTT chr11 5350109 5350130 5350114 5350109 -
tttatttttgtgtttttgttat

SEQ ID NO: 122016 - DNA, 22 bp, Artificial Sequence
  Synthetic oligonucleotide; TTT chr11 5350108 5350129 5350113 5350108 -
ttatttttgtgtttttgttatt

SEQ ID NO: 122017 - DNA, 22 bp, Artificial Sequence
  Synthetic oligonucleotide; TTT chr11 5350107 5350128 5350112 5350107 -
tatttttgtgtttttgttattg

SEQ ID NO: 122018 - DNA, 22 bp, Artificial Sequence
  Synthetic oligonucleotide; TTT chr11 5350106 5350127 5350111 5350106 -
atttttgtgtttttgttattgt

SEQ ID NO: 122019 - DNA, 22 bp, Artificial Sequence
  Synthetic oligonucleotide; TTA chr11 5350105 5350126 5350110 5350105 -
tttttgtgtttttgttattgtt

SEQ ID NO: 122020 - DNA, 22 bp, Artificial Sequence
  Synthetic oligonucleotide; TTT chr11 5350102 5350123 5350107 5350102 -
ttgtgtttttgttattgtttca

SEQ ID NO: 122021 - DNA, 22 bp, Artificial Sequence
  Synthetic oligonucleotide; TTT chr11 5350101 5350122 5350106 5350101 -
tgtgtttttgttattgtttcag

SEQ ID NO: 122022 - DNA, 22 bp, Artificial Sequence
  Synthetic oligonucleotide; TTT chr11 5350100 5350121 5350105 5350100 -
gtgtttttgttattgtttcaga

SEQ ID NO: 122023 - DNA, 22 bp, Artificial Sequence
  Synthetic oligonucleotide; TTG chr11 5350099 5350120 5350104 5350099 -
tgtttttgttattgtttcagag

SEQ ID NO: 122024 - DNA, 22 bp, Artificial Sequence
  Synthetic oligonucleotide; TTT chr11 5350094 5350115 5350099 5350094 -
ttgttattgtttcagagaagta

SEQ ID NO: 122025 - DNA, 22 bp, Artificial Sequence
  Synthetic oligonucleotide; TTT chr11 5350093 5350114 5350098 5350093 -
tgttattgtttcagagaagtac

SEQ ID NO: 122026 - DNA, 22 bp, Artificial Sequence
  Synthetic oligonucleotide; TTT chr11 5350092 5350113 5350097 5350092 -
gttattgtttcagagaagtacc

SEQ ID NO: 122027 - DNA, 22 bp, Artificial Sequence
  Synthetic oligonucleotide; TTG chr11 5350091 5350112 5350096 5350091 -
ttattgtttcagagaagtacct

SEQ ID NO: 122028 - DNA, 22 bp, Artificial Sequence
  Synthetic oligonucleotide; TTA chr11 5350088 5350109 5350093 5350088 -
ttgtttcagagaagtacctcct

SEQ ID NO: 122029 - DNA, 22 bp, Artificial Sequence
  Synthetic oligonucleotide; TTG chr11 5350085 5350106 5350090 5350085 -
tttcagagaagtacctcctttc

SEQ ID NO: 122030 - DNA, 22 bp, Artificial Sequence
  Synthetic oligonucleotide; TTT chr11 5350082 5350103 5350087 5350082 -
cagagaagtacctcctttctct

SEQ ID NO: 122031 - DNA, 22 bp, Artificial Sequence
  Synthetic oligonucleotide; TTC chr11 5350081 5350102 5350086 5350081 -
agagaagtacctcctttctctt

SEQ ID NO: 122032 - DNA, 22 bp, Artificial Sequence
  Synthetic oligonucleotide; CTC chr11 5350068 5350089 5350073 5350068 -
ctttctctttctctagtgagta

SEQ ID NO: 122033 - DNA, 22 bp, Artificial Sequence
  Synthetic oligonucleotide; CTT chr11 5350065 5350086 5350070 5350065 -
tctctttctctagtgagtacat

SEQ ID NO: 122034 - DNA, 22 bp, Artificial Sequence
  Synthetic oligonucleotide; TTT chr11 5350064 5350085 5350069 5350064 -
ctctttctctagtgagtacatg

SEQ ID NO: 122035 - DNA, 22 bp, Artificial Sequence
  Synthetic oligonucleotide; TTC chr11 5350063 5350084 5350068 5350063 -
tctttctctagtgagtacatgt

SEQ ID NO: 122036 - DNA, 22 bp, Artificial Sequence
  Synthetic oligonucleotide; CTC chr11 5350061 5350082 5350066 5350061 -
tttctctagtgagtacatgtca

SEQ ID NO: 122037 - DNA, 22 bp, Artificial Sequence
  Synthetic oligonucleotide; CTT chr11 5350059 5350080 5350064 5350059 -
tctctagtgagtacatgtcagg

SEQ ID NO: 122038 - DNA, 22 bp, Artificial Sequence
  Synthetic oligonucleotide; TTT chr11 5350058 5350079 5350063 5350058 -
ctctagtgagtacatgtcagga

SEQ ID NO: 122039 - DNA, 22 bp, Artificial Sequence
  Synthetic oligonucleotide; TTC chr11 5350057 5350078 5350062 5350057 -
tctagtgagtacatgtcaggat

SEQ ID NO: 122040 - DNA, 22 bp, Artificial Sequence
  Synthetic oligonucleotide; CTC chr11 5350055 5350076 5350060 5350055 -
tagtgagtacatgtcaggatta

SEQ ID NO: 122041 - DNA, 22 bp, Artificial Sequence
  Synthetic oligonucleotide; CTA chr11 5350053 5350074 5350058 5350053 -
gtgagtacatgtcaggattatt

SEQ ID NO: 122042 - DNA, 22 bp, Artificial Sequence
  Synthetic oligonucleotide; TTA chr11 5350033 5350054 5350038 5350033 -
ttcacccagaggtgtgtcaaat

SEQ ID NO: 122043 - DNA, 22 bp, Artificial Sequence
  Synthetic oligonucleotide; TTC chr11 5350030 5350051 5350035 5350030 -
acccagaggtgtgtcaaatgat

SEQ ID NO: 122044 - DNA, 22 bp, Artificial Sequence
  Synthetic oligonucleotide; TTT chr11 5350006 5350027 5350011 5350006 -
cctttttttctgtggaagcctt

SEQ ID NO: 122045 - DNA, 22 bp, Artificial Sequence
  Synthetic oligonucleotide; TTC chr11 5350005 5350026 5350010 5350005 -
ctttttttctgtggaagccttg

SEQ ID NO: 122046 - DNA, 22 bp, Artificial Sequence
  Synthetic oligonucleotide; CTT chr11 5350002 5350023 5350007 5350002 -
tttttctgtggaagccttggga

SEQ ID NO: 122047 - DNA, 22 bp, Artificial Sequence
  Synthetic oligonucleotide; TTT chr11 5350001 5350022 5350006 5350001 -
ttttctgtggaagccttgggaa

SEQ ID NO: 122048 - DNA, 22 bp, Artificial Sequence
  Synthetic oligonucleotide; TTT chr11 5350000 5350021 5350005 5350000 -
tttctgtggaagccttgggaac

SEQ ID NO: 122049 - DNA, 22 bp, Artificial Sequence
  Synthetic oligonucleotide; TTT chr11 5349999 5350020 5350004 5349999 -
ttctgtggaagccttgggaaca

SEQ ID NO: 122050 - DNA, 22 bp, Artificial Sequence
  Synthetic oligonucleotide; TTT chr11 5349998 5350019 5350003 5349998 -
tctgtggaagccttgggaacag

SEQ ID NO: 122051 - DNA, 22 bp, Artificial Sequence
  Synthetic oligonucleotide; TTT chr11 5349997 5350018 5350002 5349997 -
ctgtggaagccttgggaacaga

SEQ ID NO: 122052 - DNA, 22 bp, Artificial Sequence
  Synthetic oligonucleotide; TTC chr11 5349996 5350017 5350001 5349996 -
tgtggaagccttgggaacagat

SEQ ID NO: 122053 - DNA, 22 bp, Artificial Sequence
  Synthetic oligonucleotide; CTG chr11 5349994 5350015 5349999 5349994 -
tggaagccttgggaacagatat

SEQ ID NO: 122054 - DNA, 22 bp, Artificial Sequence
  Synthetic oligonucleotide; CTT chr11 5349984 5350005 5349989 5349984 -
gggaacagatataagatgatga

SEQ ID NO: 122055 - DNA, 22 bp, Artificial Sequence
  Synthetic oligonucleotide; TTG chr11 5349983 5350004 5349988 5349983 -
ggaacagatataagatgatgat

SEQ ID NO: 122056 - DNA, 22 bp, Artificial Sequence
  Synthetic oligonucleotide; TTT chr11 5349954 5349975 5349959 5349954 -
ttaggagcctgtgtttgacttt

SEQ ID NO: 122057 - DNA, 22 bp, Artificial Sequence
  Synthetic oligonucleotide; TTT chr11 5349953 5349974 5349958 5349953 -
taggagcctgtgtttgacttta

SEQ ID NO: 122058 - DNA, 22 bp, Artificial Sequence
  Synthetic oligonucleotide; TTT chr11 5349952 5349973 5349957 5349952 -
aggagcctgtgtttgactttaa

SEQ ID NO: 122059 - DNA, 22 bp, Artificial Sequence
  Synthetic oligonucleotide; TTA chr11 5349951 5349972 5349956 5349951 -
ggagcctgtgtttgactttaaa

SEQ ID NO: 122060 - DNA, 22 bp, Artificial Sequence
  Synthetic oligonucleotide; CTG chr11 5349943 5349964 5349948 5349943 -
tgtttgactttaaataaagata

SEQ ID NO: 122061 - DNA, 22 bp, Artificial Sequence
  Synthetic oligonucleotide; TTT chr11 5349938 5349959 5349943 5349938 -
gactttaaataaagatattaaa

SEQ ID NO: 122062 - DNA, 22 bp, Artificial Sequence
  Synthetic oligonucleotide; TTG chr11 5349937 5349958 5349942 5349937 -
actttaaataaagatattaaac

SEQ ID NO: 122063 - DNA, 22 bp, Artificial Sequence
  Synthetic oligonucleotide; CTT chr11 5349933 5349954 5349938 5349933 -
taaataaagatattaaactata

SEQ ID NO: 122064 - DNA, 22 bp, Artificial Sequence
  Synthetic oligonucleotide; TTT chr11 5349932 5349953 5349937 5349932 -
aaataaagatattaaactatag

SEQ ID NO: 122065 - DNA, 22 bp, Artificial Sequence
  Synthetic oligonucleotide; TTA chr11 5349931 5349952 5349936 5349931 -
aataaagatattaaactatagt

SEQ ID NO: 122066 - DNA, 22 bp, Artificial Sequence
  Synthetic oligonucleotide; TTA chr11 5349918 5349939 5349923 5349918 -
aactatagtttctctaatcagc

SEQ ID NO: 122067 - DNA, 22 bp, Artificial Sequence
  Synthetic oligonucleotide; CTA chr11 5349913 5349934 5349918 5349913 -
tagtttctctaatcagcagata

SEQ ID NO: 122068 - DNA, 22 bp, Artificial Sequence
  Synthetic oligonucleotide; TTT chr11 5349907 5349928 5349912 5349907 -
ctctaatcagcagataaaatgt

SEQ ID NO: 122069 - DNA, 22 bp, Artificial Sequence
  Synthetic oligonucleotide; TTC chr11 5349906 5349927 5349911 5349906 -
tctaatcagcagataaaatgtg

SEQ ID NO: 122070 - DNA, 22 bp, Artificial Sequence
  Synthetic oligonucleotide; CTC chr11 5349904 5349925 5349909 5349904 -
taatcagcagataaaatgtgat

SEQ ID NO: 122071 - DNA, 22 bp, Artificial Sequence
  Synthetic oligonucleotide; CTA chr11 5349902 5349923 5349907 5349902 -
atcagcagataaaatgtgatat

SEQ ID NO: 122072 - DNA, 22 bp, Artificial Sequence
  Synthetic oligonucleotide; CTG chr11 5349875 5349896 5349880 5349875 -
ggtgggaaagggaaaggagaaa

SEQ ID NO: 122073 - DNA, 22 bp, Artificial Sequence
  Synthetic oligonucleotide; TTG chr11 5349847 5349868 5349852 5349847 -
atgagccaatgtgggaacttct

SEQ ID NO: 122074 - DNA, 22 bp, Artificial Sequence
  Synthetic oligonucleotide; CTT chr11 5349827 5349848 5349832 5349827 -
ctgacatagctaaaagtaacgt

SEQ ID NO: 122075 - DNA, 22 bp, Artificial Sequence
  Synthetic oligonucleotide; TTC chr11 5349826 5349847 5349831 5349826 -
tgacatagctaaaagtaacgtt

SEQ ID NO: 122076 - DNA, 22 bp, Artificial Sequence
  Synthetic oligonucleotide; CTG chr11 5349824 5349845 5349829 5349824 -
acatagctaaaagtaacgttga

SEQ ID NO: 122077 - DNA, 22 bp, Artificial Sequence
  Synthetic oligonucleotide; CTA chr11 5349815 5349836 5349820 5349815 -
aaagtaacgttgagcctggggc

SEQ ID NO: 122078 - DNA, 22 bp, Artificial Sequence
  Synthetic oligonucleotide; TTG chr11 5349803 5349824 5349808 5349803 -
agcctggggcattgggactgag

SEQ ID NO: 122079 - DNA, 22 bp, Artificial Sequence
  Synthetic oligonucleotide; CTG chr11 5349797 5349818 5349802 5349797 -
gggcattgggactgagggaagt

SEQ ID NO: 122080 - DNA, 22 bp, Artificial Sequence
  Synthetic oligonucleotide; TTG chr11 5349789 5349810 5349794 5349789 -
ggactgagggaagtagagggga

SEQ ID NO: 122081 - DNA, 22 bp, Artificial Sequence
  Synthetic oligonucleotide; CTG chr11 5349783 5349804 5349788 5349783 -
agggaagtagaggggaaagcaa

SEQ ID NO: 122082 - DNA, 22 bp, Artificial Sequence
  Synthetic oligonucleotide; CTC chr11 5349758 5349779 5349763 5349758 -
tgtcctcaaaaagtgagaaaag

SEQ ID NO: 122083 - DNA, 22 bp, Artificial Sequence
  Synthetic oligonucleotide; CTG chr11 5349756 5349777 5349761 5349756 -
tcctcaaaaagtgagaaaagga

SEQ ID NO: 122084 - DNA, 22 bp, Artificial Sequence
  Synthetic oligonucleotide; CTC chr11 5349751 5349772 5349756 5349751 -
aaaaagtgagaaaaggaggtat

SEQ ID NO: 122085 - DNA, 22 bp, Artificial Sequence
  Synthetic oligonucleotide; TTA chr11 5349727 5349748 5349732 5349727 -
ttgctcaatctgcctgccagtg

SEQ ID NO: 122086 - DNA, 22 bp, Artificial Sequence
  Synthetic oligonucleotide; TTG chr11 5349724 5349745 5349729 5349724 -
ctcaatctgcctgccagtgaga

SEQ ID NO: 122087 - DNA, 22 bp, Artificial Sequence
  Synthetic oligonucleotide; CTC chr11 5349721 5349742 5349726 5349721 -
aatctgcctgccagtgagaggt

SEQ ID NO: 122088 - DNA, 22 bp, Artificial Sequence
  Synthetic oligonucleotide; CTG chr11 5349715 5349736 5349720 5349715 -
cctgccagtgagaggttcagac

SEQ ID NO: 122089 - DNA, 22 bp, Artificial Sequence
  Synthetic oligonucleotide; CTG chr11 5349711 5349732 5349716 5349711 -
ccagtgagaggttcagacaata

SEQ ID NO: 122090 - DNA, 22 bp, Artificial Sequence
  Synthetic oligonucleotide; TTC chr11 5349697 5349718 5349702 5349697 -
agacaatactcagcttatgcag

SEQ ID NO: 122091 - DNA, 22 bp, Artificial Sequence
  Synthetic oligonucleotide; CTC chr11 5349686 5349707 5349691 5349686 -
agcttatgcaggattaaagaag

SEQ ID NO: 122092 - DNA, 22 bp, Artificial Sequence
  Synthetic oligonucleotide; CTT chr11 5349681 5349702 5349686 5349681 -
atgcaggattaaagaagcagta

SEQ ID NO: 122093 - DNA, 22 bp, Artificial Sequence
  Synthetic oligonucleotide; TTA chr11 5349680 5349701 5349685 5349680 -
tgcaggattaaagaagcagtat

SEQ ID NO: 122094 - DNA, 22 bp, Artificial Sequence
  Synthetic oligonucleotide; TTA chr11 5349670 5349691 5349675 5349670 -
aagaagcagtatggcaaataaa

SEQ ID NO: 122095 - DNA, 22 bp, Artificial Sequence
  Synthetic oligonucleotide; TTG chr11 5349643 5349664 5349648 5349643 -
tacataggtatataacttattg

SEQ ID NO: 122096 - DNA, 22 bp, Artificial Sequence
  Synthetic oligonucleotide; CTT chr11 5349625 5349646 5349630 5349625 -
attgttttattataggtattca

SEQ ID NO: 122097 - DNA, 22 bp, Artificial Sequence
  Synthetic oligonucleotide; TTA chr11 5349624 5349645 5349629 5349624 -
ttgttttattataggtattcat

SEQ ID NO: 122098 - DNA, 22 bp, Artificial Sequence
  Synthetic oligonucleotide; TTG chr11 5349621 5349642 5349626 5349621 -
ttttattataggtattcattgt

SEQ ID NO: 122099 - DNA, 22 bp, Artificial Sequence
  Synthetic oligonucleotide; TTT chr11 5349618 5349639 5349623 5349618 -
tattataggtattcattgttaa

SEQ ID NO: 122100 - DNA, 22 bp, Artificial Sequence
  Synthetic oligonucleotide; TTT chr11 5349617 5349638 5349622 5349617 -
attataggtattcattgttaaa

SEQ ID NO: 122101 - DNA, 22 bp, Artificial Sequence
  Synthetic oligonucleotide; TTA chr11 5349616 5349637 5349621 5349616 -
ttataggtattcattgttaaat

SEQ ID NO: 122102 - DNA, 22 bp, Artificial Sequence
  Synthetic oligonucleotide; TTA chr11 5349613 5349634 5349618 5349613 -
taggtattcattgttaaatgat

SEQ ID NO: 122103 - DNA, 22 bp, Artificial Sequence
  Synthetic oligonucleotide; TTC chr11 5349604 5349625 5349609 5349604 -
attgttaaatgattaccataat

SEQ ID NO: 122104 - DNA, 22 bp, Artificial Sequence
  Synthetic oligonucleotide; TTG chr11 5349600 5349621 5349605 5349600 -
ttaaatgattaccataatcaaa

SEQ ID NO: 122105 - DNA, 22 bp, Artificial Sequence
  Synthetic oligonucleotide; TTA chr11 5349597 5349618 5349602 5349597 -
aatgattaccataatcaaacta

SEQ ID NO: 122106 - DNA, 22 bp, Artificial Sequence
  Synthetic oligonucleotide; TTA chr11 5349589 5349610 5349594 5349589 -
ccataatcaaactaattaatat

SEQ ID NO: 122107 - DNA, 22 bp, Artificial Sequence
  Synthetic oligonucleotide; CTA chr11 5349575 5349596 5349580 5349575 -
attaatatatctatcacctcac

SEQ ID NO: 122108 - DNA, 22 bp, Artificial Sequence
  Synthetic oligonucleotide; TTA chr11 5349571 5349592 5349576 5349571 -
atatatctatcacctcacataa

SEQ ID NO: 122109 - DNA, 22 bp, Artificial Sequence
  Synthetic oligonucleotide; CTA chr11 5349562 5349583 5349567 5349562 -
tcacctcacataataactttaa

SEQ ID NO: 122110 - DNA, 22 bp, Artificial Sequence
  Synthetic oligonucleotide; CTC chr11 5349555 5349576 5349560 5349555 -
acataataactttaattttttt

SEQ ID NO: 122111 - DNA, 22 bp, Artificial Sequence
  Synthetic oligonucleotide; CTT chr11 5349543 5349564 5349548 5349543 -
taatttttttggtagtaaaaat

SEQ ID NO: 122112 - DNA, 22 bp, Artificial Sequence
  Synthetic oligonucleotide; TTT chr11 5349542 5349563 5349547 5349542 -
aatttttttggtagtaaaaata

SEQ ID NO: 122113 - DNA, 22 bp, Artificial Sequence
  Synthetic oligonucleotide; TTA chr11 5349541 5349562 5349546 5349541 -
atttttttggtagtaaaaatat

SEQ ID NO: 122114 - DNA, 22 bp, Artificial Sequence
  Synthetic oligonucleotide; TTT chr11 5349537 5349558 5349542 5349537 -
ttttggtagtaaaaatatgtga

SEQ ID NO: 122115 - DNA, 22 bp, Artificial Sequence
  Synthetic oligonucleotide; TTT chr11 5349536 5349557 5349541 5349536 -
tttggtagtaaaaatatgtgag

SEQ ID NO: 122116 - DNA, 22 bp, Artificial Sequence
  Synthetic oligonucleotide; TTT chr11 5349535 5349556 5349540 5349535 -
ttggtagtaaaaatatgtgagg

SEQ ID NO: 122117 - DNA, 22 bp, Artificial Sequence
  Synthetic oligonucleotide; TTT chr11 5349534 5349555 5349539 5349534 -
tggtagtaaaaatatgtgaggt

SEQ ID NO: 122118 - DNA, 22 bp, Artificial Sequence
  Synthetic oligonucleotide; TTT chr11 5349533 5349554 5349538 5349533 -
ggtagtaaaaatatgtgaggtc

SEQ ID NO: 122119 - DNA, 22 bp, Artificial Sequence
  Synthetic oligonucleotide; TTG chr11 5349532 5349553 5349537 5349532 -
gtagtaaaaatatgtgaggtct

SEQ ID NO: 122120 - DNA, 22 bp, Artificial Sequence
  Synthetic oligonucleotide; CTG chr11 5349509 5349530 5349514 5349509 -
ctttcttagcaaattttaaata

SEQ ID NO: 122121 - DNA, 22 bp, Artificial Sequence
  Synthetic oligonucleotide; CTT chr11 5349506 5349527 5349511 5349506 -
tcttagcaaattttaaatatac

SEQ ID NO: 122122 - DNA, 22 bp, Artificial Sequence
  Synthetic oligonucleotide; TTT chr11 5349505 5349526 5349510 5349505 -
cttagcaaattttaaatatacc

SEQ ID NO: 122123 - DNA, 22 bp, Artificial Sequence
  Synthetic oligonucleotide; TTC chr11 5349504 5349525 5349509 5349504 -
ttagcaaattttaaatatacct

SEQ ID NO: 122124 - DNA, 22 bp, Artificial Sequence
  Synthetic oligonucleotide; CTT chr11 5349502 5349523 5349507 5349502 -
agcaaattttaaatatacctaa

SEQ ID NO: 122125 - DNA, 22 bp, Artificial Sequence
  Synthetic oligonucleotide; TTA chr11 5349501 5349522 5349506 5349501 -
gcaaattttaaatatacctaaa

SEQ ID NO: 122126 - DNA, 22 bp, Artificial Sequence
  Synthetic oligonucleotide; TTT chr11 5349493 5349514 5349498 5349493 -
taaatatacctaaataaagctg

SEQ ID NO: 122127 - DNA, 22 bp, Artificial Sequence
  Synthetic oligonucleotide; TTT chr11 5349492 5349513 5349497 5349492 -
aaatatacctaaataaagctgg

SEQ ID NO: 122128 - DNA, 22 bp, Artificial Sequence
  Synthetic oligonucleotide; TTA chr11 5349491 5349512 5349496 5349491 -
aatatacctaaataaagctggg

SEQ ID NO: 122129 - DNA, 22 bp, Artificial Sequence
  Synthetic oligonucleotide; CTA chr11 5349481 5349502 5349486 5349481 -
aataaagctgggagggaaaaga

SEQ ID NO: 122130 - DNA, 22 bp, Artificial Sequence
  Synthetic oligonucleotide; CTG chr11 5349471 5349492 5349476 5349471 -
ggagggaaaagataatacagaa

SEQ ID NO: 122131 - DNA, 22 bp, Artificial Sequence
  Synthetic oligonucleotide; TTA chr11 5349444 5349465 5349449 5349444 -
atctagttaattgtgttatatt

SEQ ID NO: 122132 - DNA, 22 bp, Artificial Sequence
  Synthetic oligonucleotide; CTA chr11 5349439 5349460 5349444 5349439 -
gttaattgtgttatattactac

SEQ ID NO: 122133 - DNA, 22 bp, Artificial Sequence
  Synthetic oligonucleotide; TTA chr11 5349435 5349456 5349440 5349435 -
attgtgttatattactactaaa

SEQ ID NO: 122134 - DNA, 22 bp, Artificial Sequence
  Synthetic oligonucleotide; TTG chr11 5349431 5349452 5349436 5349431 -
tgttatattactactaaataaa

SEQ ID NO: 122135 - DNA, 22 bp, Artificial Sequence
  Synthetic oligonucleotide; TTA chr11 5349426 5349447 5349431 5349426 -
tattactactaaataaacatat

SEQ ID NO: 122136 - DNA, 22 bp, Artificial Sequence
  Synthetic oligonucleotide; TTA chr11 5349421 5349442 5349426 5349421 -
ctactaaataaacatataattg

SEQ ID NO: 122137 - DNA, 22 bp, Artificial Sequence
  Synthetic oligonucleotide; CTA chr11 5349418 5349439 5349423 5349418 -
ctaaataaacatataattgata

SEQ ID NO: 122138 - DNA, 22 bp, Artificial Sequence
  Synthetic oligonucleotide; CTA chr11 5349415 5349436 5349420 5349415 -
aataaacatataattgataaat

SEQ ID NO: 122139 - DNA, 22 bp, Artificial Sequence
  Synthetic oligonucleotide; TTG chr11 5349399 5349420 5349404 5349399 -
ataaattaaaaaaaaacaggag

SEQ ID NO: 122140 - DNA, 22 bp, Artificial Sequence
  Synthetic oligonucleotide; TTA chr11 5349391 5349412 5349396 5349391 -
aaaaaaaacaggagtaggaata

SEQ ID NO: 122141 - DNA, 22 bp, Artificial Sequence
  Synthetic oligonucleotide; CTG chr11 5349347 5349368 5349352 5349347 -
agaaacaaatgtatggaacaaa

SEQ ID NO: 122142 - DNA, 22 bp, Artificial Sequence
  Synthetic oligonucleotide; TTG chr11 5349319 5349340 5349324 5349319 -
ttgaatttctaccgtgtgtcaa

SEQ ID NO: 122143 - DNA, 22 bp, Artificial Sequence
  Synthetic oligonucleotide; TTG chr11 5349316 5349337 5349321 5349316 -
aatttctaccgtgtgtcaagta

SEQ ID NO: 122144 - DNA, 22 bp, Artificial Sequence
  Synthetic oligonucleotide; TTT chr11 5349311 5349332 5349316 5349311 -
ctaccgtgtgtcaagtattgga

SEQ ID NO: 122145 - DNA, 22 bp, Artificial Sequence
  Synthetic oligonucleotide; TTC chr11 5349310 5349331 5349315 5349310 -
taccgtgtgtcaagtattggac

SEQ ID NO: 122146 - DNA, 22 bp, Artificial Sequence
  Synthetic oligonucleotide; CTA chr11 5349308 5349329 5349313 5349308 -
ccgtgtgtcaagtattggactg

SEQ ID NO: 122147 - DNA, 22 bp, Artificial Sequence
  Synthetic oligonucleotide; TTG chr11 5349291 5349312 5349296 5349291 -
gactggggcattatatacacct

SEQ ID NO: 122148 - DNA, 22 bp, Artificial Sequence
  Synthetic oligonucleotide; CTG chr11 5349286 5349307 5349291 5349286 -
gggcattatatacacctcattt

SEQ ID NO: 122149 - DNA, 22 bp, Artificial Sequence
  Synthetic oligonucleotide; TTA chr11 5349278 5349299 5349283 5349278 -
tatacacctcattttttgggaa

SEQ ID NO: 122150 - DNA, 22 bp, Artificial Sequence
  Synthetic oligonucleotide; CTC chr11 5349268 5349289 5349273 5349268 -
attttttgggaagaatccttaa

SEQ ID NO: 122151 - DNA, 22 bp, Artificial Sequence
  Synthetic oligonucleotide; TTT chr11 5349264 5349285 5349269 5349264 -
tttgggaagaatccttaaaata

SEQ ID NO: 122152 - DNA, 22 bp, Artificial Sequence
  Synthetic oligonucleotide; TTT chr11 5349263 5349284 5349268 5349263 -
ttgggaagaatccttaaaatag

SEQ ID NO: 122153 - DNA, 22 bp, Artificial Sequence
  Synthetic oligonucleotide; TTT chr11 5349262 5349283 5349267 5349262 -
tgggaagaatccttaaaatagc

SEQ ID NO: 122154 - DNA, 22 bp, Artificial Sequence
  Synthetic oligonucleotide; TTT chr11 5349261 5349282 5349266 5349261 -
gggaagaatccttaaaatagct

SEQ ID NO: 122155 - DNA, 22 bp, Artificial Sequence
  Synthetic oligonucleotide; TTG chr11 5349260 5349281 5349265 5349260 -
ggaagaatccttaaaatagctg

SEQ ID NO: 122156 - DNA, 22 bp, Artificial Sequence
  Synthetic oligonucleotide; CTT chr11 5349248 5349269 5349253 5349248 -
aaaatagctgtttgtcttgtct

SEQ ID NO: 122157 - DNA, 22 bp, Artificial Sequence
  Synthetic oligonucleotide; TTA chr11 5349247 5349268 5349252 5349247 -
aaatagctgtttgtcttgtctg

SEQ ID NO: 122158 - DNA, 22 bp, Artificial Sequence
  Synthetic oligonucleotide; CTG chr11 5349238 5349259 5349243 5349238 -
tttgtcttgtctgttttcatat

SEQ ID NO: 122159 - DNA, 22 bp, Artificial Sequence
  Synthetic oligonucleotide; TTT chr11 5349235 5349256 5349240 5349235 -
gtcttgtctgttttcatattga

SEQ ID NO: 122160 - DNA, 22 bp, Artificial Sequence
  Synthetic oligonucleotide; TTG chr11 5349234 5349255 5349239 5349234 -
tcttgtctgttttcatattgaa

SEQ ID NO: 122161 - DNA, 22 bp, Artificial Sequence
  Synthetic oligonucleotide; CTT chr11 5349230 5349251 5349235 5349230 -
gtctgttttcatattgaaaact

SEQ ID NO: 122162 - DNA, 22 bp, Artificial Sequence
  Synthetic oligonucleotide; TTG chr11 5349229 5349250 5349234 5349229 -
tctgttttcatattgaaaactg

SEQ ID NO: 122163 - DNA, 22 bp, Artificial Sequence
  Synthetic oligonucleotide; CTG chr11 5349225 5349246 5349230 5349225 -
ttttcatattgaaaactgagtg

SEQ ID NO: 122164 - DNA, 22 bp, Artificial Sequence
  Synthetic oligonucleotide; TTT chr11 5349222 5349243 5349227 5349222 -
tcatattgaaaactgagtgctt

SEQ ID NO: 122165 - DNA, 22 bp, Artificial Sequence
  Synthetic oligonucleotide; TTT chr11 5349221 5349242 5349226 5349221 -
catattgaaaactgagtgcttt

SEQ ID NO: 122166 - DNA, 22 bp, Artificial Sequence
  Synthetic oligonucleotide; TTC chr11 5349220 5349241 5349225 5349220 -
atattgaaaactgagtgctttc

SEQ ID NO: 122167 - DNA, 22 bp, Artificial Sequence
  Synthetic oligonucleotide; TTG chr11 5349214 5349235 5349219 5349214 -
aaaactgagtgctttcacttga

SEQ ID NO: 122168 - DNA, 22 bp, Artificial Sequence
  Synthetic oligonucleotide; CTG chr11 5349207 5349228 5349212 5349207 -
agtgctttcacttgattcactc

SEQ ID NO: 122169 - DNA, 22 bp, Artificial Sequence
  Synthetic oligonucleotide; CTT chr11 5349200 5349221 5349205 5349200 -
tcacttgattcactcagttgct

SEQ ID NO: 122170 - DNA, 22 bp, Artificial Sequence
  Synthetic oligonucleotide; TTT chr11 5349199 5349220 5349204 5349199 -
cacttgattcactcagttgctt

SEQ ID NO: 122171 - DNA, 22 bp, Artificial Sequence
  Synthetic oligonucleotide; TTC chr11 5349198 5349219 5349203 5349198 -
acttgattcactcagttgcttt

SEQ ID NO: 122172 - DNA, 22 bp, Artificial Sequence
  Synthetic oligonucleotide; CTT chr11 5349194 5349215 5349199 5349194 -
gattcactcagttgcttttgtg

SEQ ID NO: 122173 - DNA, 22 bp, Artificial Sequence
  Synthetic oligonucleotide; TTG chr11 5349193 5349214 5349198 5349193 -
attcactcagttgcttttgtgg

SEQ ID NO: 122174 - DNA, 22 bp, Artificial Sequence
  Synthetic oligonucleotide; TTC chr11 5349189 5349210 5349194 5349189 -
actcagttgcttttgtggtata

SEQ ID NO: 122175 - DNA, 22 bp, Artificial Sequence
  Synthetic oligonucleotide; CTC chr11 5349185 5349206 5349190 5349185 -
agttgcttttgtggtatatgag

SEQ ID NO: 122176 - DNA, 22 bp, Artificial Sequence
  Synthetic oligonucleotide; TTG chr11 5349180 5349201 5349185 5349180 -
cttttgtggtatatgagatgat

SEQ ID NO: 122177 - DNA, 22 bp, Artificial Sequence
  Synthetic oligonucleotide; CTT chr11 5349177 5349198 5349182 5349177 -
ttgtggtatatgagatgatctg

SEQ ID NO: 122178 - DNA, 22 bp, Artificial Sequence
  Synthetic oligonucleotide; TTT chr11 5349176 5349197 5349181 5349176 -
tgtggtatatgagatgatctgt

SEQ ID NO: 122179 - DNA, 22 bp, Artificial Sequence
  Synthetic oligonucleotide; TTT chr11 5349175 5349196 5349180 5349175 -
gtggtatatgagatgatctgtg

SEQ ID NO: 122180 - DNA, 22 bp, Artificial Sequence
  Synthetic oligonucleotide; TTG chr11 5349174 5349195 5349179 5349174 -
tggtatatgagatgatctgtga

SEQ ID NO: 122181 - DNA, 22 bp, Artificial Sequence
  Synthetic oligonucleotide; CTG chr11 5349155 5349176 5349160 5349155 -
tgagtttcagaggggataaaaa

SEQ ID NO: 122182 - DNA, 22 bp, Artificial Sequence
  Synthetic oligonucleotide; TTT chr11 5349148 5349169 5349153 5349148 -
cagaggggataaaaatctaaaa

SEQ ID NO: 122183 - DNA, 22 bp, Artificial Sequence
  Synthetic oligonucleotide; TTC chr11 5349147 5349168 5349152 5349147 -
agaggggataaaaatctaaaac

SEQ ID NO: 122184 - DNA, 22 bp, Artificial Sequence
  Synthetic oligonucleotide; CTA chr11 5349129 5349150 5349134 5349129 -
aaacctttgcctcatccctgca

SEQ ID NO: 122185 - DNA, 22 bp, Artificial Sequence
  Synthetic oligonucleotide; CTT chr11 5349122 5349143 5349127 5349122 -
tgcctcatccctgcagccattc

SEQ ID NO: 122186 - DNA, 22 bp, Artificial Sequence
  Synthetic oligonucleotide; TTT chr11 5349121 5349142 5349126 5349121 -
gcctcatccctgcagccattca

SEQ ID NO: 122187 - DNA, 22 bp, Artificial Sequence
  Synthetic oligonucleotide; TTG chr11 5349120 5349141 5349125 5349120 -
cctcatccctgcagccattcac

SEQ ID NO: 122188 - DNA, 22 bp, Artificial Sequence
  Synthetic oligonucleotide; CTC chr11 5349116 5349137 5349121 5349116 -
atccctgcagccattcaccctc

SEQ ID NO: 122189 - DNA, 22 bp, Artificial Sequence
  Synthetic oligonucleotide; CTG chr11 5349109 5349130 5349114 5349109 -
cagccattcaccctcttccagg

SEQ ID NO: 122190 - DNA, 22 bp, Artificial Sequence
  Synthetic oligonucleotide; TTC chr11 5349100 5349121 5349105 5349100 -
accctcttccagggtctctgtc

SEQ ID NO: 122191 - DNA, 22 bp, Artificial Sequence
  Synthetic oligonucleotide; CTC chr11 5349094 5349115 5349099 5349094 -
ttccagggtctctgtcatagaa

SEQ ID NO: 122192 - DNA, 22 bp, Artificial Sequence
  Synthetic oligonucleotide; CTT chr11 5349092 5349113 5349097 5349092 -
ccagggtctctgtcatagaata

SEQ ID NO: 122193 - DNA, 22 bp, Artificial Sequence
  Synthetic oligonucleotide; TTC chr11 5349091 5349112 5349096 5349091 -
cagggtctctgtcatagaatag

SEQ ID NO: 122194 - DNA, 22 bp, Artificial Sequence
  Synthetic oligonucleotide; CTC chr11 5349082 5349103 5349087 5349082 -
tgtcatagaatagacttgagtt

SEQ ID NO: 122195 - DNA, 22 bp, Artificial Sequence
  Synthetic oligonucleotide; CTG chr11 5349080 5349101 5349085 5349080 -
tcatagaatagacttgagtttt

SEQ ID NO: 122196 - DNA, 22 bp, Artificial Sequence
  Synthetic oligonucleotide; CTT chr11 5349065 5349086 5349070 5349065 -
gagtttttattaatgagaaact

SEQ ID NO: 122197 - DNA, 22 bp, Artificial Sequence
  Synthetic oligonucleotide; TTG chr11 5349064 5349085 5349069 5349064 -
agtttttattaatgagaaacta

SEQ ID NO: 122198 - DNA, 22 bp, Artificial Sequence
  Synthetic oligonucleotide; TTT chr11 5349059 5349080 5349064 5349059 -
ttattaatgagaaactaattct

SEQ ID NO: 122199 - DNA, 22 bp, Artificial Sequence
  Synthetic oligonucleotide; TTT chr11 5349058 5349079 5349063 5349058 -
tattaatgagaaactaattctc

SEQ ID NO: 122200 - DNA, 22 bp, Artificial Sequence
  Synthetic oligonucleotide; TTT chr11 5349057 5349078 5349062 5349057 -
attaatgagaaactaattctca

SEQ ID NO: 122201 - DNA, 22 bp, Artificial Sequence
  Synthetic oligonucleotide; TTA chr11 5349056 5349077 5349061 5349056 -
ttaatgagaaactaattctcaa

SEQ ID NO: 122202 - DNA, 22 bp, Artificial Sequence
  Synthetic oligonucleotide; TTA chr11 5349053 5349074 5349058 5349053 -
atgagaaactaattctcaaagt

SEQ ID NO: 122203 - DNA, 22 bp, Artificial Sequence
  Synthetic oligonucleotide; CTA chr11 5349042 5349063 5349047 5349042 -
attctcaaagtctcaaactctg

SEQ ID NO: 122204 - DNA, 22 bp, Artificial Sequence
  Synthetic oligonucleotide; TTC chr11 5349038 5349059 5349043 5349038 -
tcaaagtctcaaactctgccgc

SEQ ID NO: 122205 - DNA, 22 bp, Artificial Sequence
  Synthetic oligonucleotide; CTC chr11 5349036 5349057 5349041 5349036 -
aaagtctcaaactctgccgcat

SEQ ID NO: 122206 - DNA, 22 bp, Artificial Sequence
  Synthetic oligonucleotide; CTC chr11 5349028 5349049 5349033 5349028 -
aaactctgccgcataaactgat

SEQ ID NO: 122207 - DNA, 22 bp, Artificial Sequence
  Synthetic oligonucleotide; CTC chr11 5349022 5349043 5349027 5349022 -
tgccgcataaactgatggctct

SEQ ID NO: 122208 - DNA, 22 bp, Artificial Sequence
  Synthetic oligonucleotide; CTG chr11 5349020 5349041 5349025 5349020 -
ccgcataaactgatggctctat

SEQ ID NO: 122209 - DNA, 22 bp, Artificial Sequence
  Synthetic oligonucleotide; CTG chr11 5349008 5349029 5349013 5349008 -
atggctctatgcagacacctca

SEQ ID NO: 122210 - DNA, 22 bp, Artificial Sequence
  Synthetic oligonucleotide; CTC chr11 5349001 5349022 5349006 5349001 -
tatgcagacacctcagcaggag

SEQ ID NO: 122211 - DNA, 22 bp, Artificial Sequence
  Synthetic oligonucleotide; CTA chr11 5348999 5349020 5349004 5348999 -
tgcagacacctcagcaggagcc

SEQ ID NO: 122212 - DNA, 22 bp, Artificial Sequence
  Synthetic oligonucleotide; CTC chr11 5348987 5349008 5348992 5348987 -
agcaggagcccattcagatgtt

SEQ ID NO: 122213 - DNA, 22 bp, Artificial Sequence
  Synthetic oligonucleotide; TTC chr11 5348972 5348993 5348977 5348972 -
agatgttaactttcatatattc

SEQ ID NO: 122214 - DNA, 22 bp, Artificial Sequence
  Synthetic oligonucleotide; TTA chr11 5348964 5348985 5348969 5348964 -
actttcatatattctctcacct

SEQ ID NO: 122215 - DNA, 22 bp, Artificial Sequence
  Synthetic oligonucleotide; CTT chr11 5348960 5348981 5348965 5348960 -
tcatatattctctcaccttccc

SEQ ID NO: 122216 - DNA, 22 bp, Artificial Sequence
  Synthetic oligonucleotide; TTT chr11 5348959 5348980 5348964 5348959 -
catatattctctcaccttccct

SEQ ID NO: 122217 - DNA, 22 bp, Artificial Sequence
  Synthetic oligonucleotide; TTC chr11 5348958 5348979 5348963 5348958 -
atatattctctcaccttccctt

SEQ ID NO: 122218 - DNA, 22 bp, Artificial Sequence
  Synthetic oligonucleotide; TTC chr11 5348950 5348971 5348955 5348950 -
tctcaccttccctttggctttt

SEQ ID NO: 122219 - DNA, 22 bp, Artificial Sequence
  Synthetic oligonucleotide; CTC chr11 5348948 5348969 5348953 5348948 -
tcaccttccctttggctttttt

SEQ ID NO: 122220 - DNA, 22 bp, Artificial Sequence
  Synthetic oligonucleotide; CTC chr11 5348946 5348967 5348951 5348946 -
accttccctttggcttttttcc

SEQ ID NO: 122221 - DNA, 22 bp, Artificial Sequence
  Synthetic oligonucleotide; CTT chr11 5348941 5348962 5348946 5348941 -
ccctttggcttttttccttcac

SEQ ID NO: 122222 - DNA, 22 bp, Artificial Sequence
  Synthetic oligonucleotide; TTC chr11 5348940 5348961 5348945 5348940 -
cctttggcttttttccttcact

SEQ ID NO: 122223 - DNA, 22 bp, Artificial Sequence
  Synthetic oligonucleotide; CTT chr11 5348936 5348957 5348941 5348936 -
tggcttttttccttcacttttc

SEQ ID NO: 122224 - DNA, 22 bp, Artificial Sequence
  Synthetic oligonucleotide; TTT chr11 5348935 5348956 5348940 5348935 -
ggcttttttccttcacttttcc

SEQ ID NO: 122225 - DNA, 22 bp, Artificial Sequence
  Synthetic oligonucleotide; TTG chr11 5348934 5348955 5348939 5348934 -
gcttttttccttcacttttcct

SEQ ID NO: 122226 - DNA, 22 bp, Artificial Sequence
  Synthetic oligonucleotide; CTT chr11 5348930 5348951 5348935 5348930 -
ttttccttcacttttcctgaca

SEQ ID NO: 122227 - DNA, 22 bp, Artificial Sequence
  Synthetic oligonucleotide; TTT chr11 5348929 5348950 5348934 5348929 -
tttccttcacttttcctgacac

SEQ ID NO: 122228 - DNA, 22 bp, Artificial Sequence
  Synthetic oligonucleotide; TTT chr11 5348928 5348949 5348933 5348928 -
ttccttcacttttcctgacact

SEQ ID NO: 122229 - DNA, 22 bp, Artificial Sequence
  Synthetic oligonucleotide; TTT chr11 5348927 5348948 5348932 5348927 -
tccttcacttttcctgacactc

SEQ ID NO: 122230 - DNA, 22 bp, Artificial Sequence
  Synthetic oligonucleotide; TTT chr11 5348926 5348947 5348931 5348926 -
ccttcacttttcctgacactct

SEQ ID NO: 122231 - DNA, 22 bp, Artificial Sequence
  Synthetic oligonucleotide; TTC chr11 5348925 5348946 5348930 5348925 -
cttcacttttcctgacactctt

SEQ ID NO: 122232 - DNA, 22 bp, Artificial Sequence
  Synthetic oligonucleotide; CTT chr11 5348922 5348943 5348927 5348922 -
cacttttcctgacactcttttc

SEQ ID NO: 122233 - DNA, 22 bp, Artificial Sequence
  Synthetic oligonucleotide; TTC chr11 5348921 5348942 5348926 5348921 -
acttttcctgacactcttttct

SEQ ID NO: 122234 - DNA, 22 bp, Artificial Sequence
  Synthetic oligonucleotide; CTT chr11 5348917 5348938 5348922 5348917 -
ttcctgacactcttttctgtct

SEQ ID NO: 122235 - DNA, 22 bp, Artificial Sequence
  Synthetic oligonucleotide; TTT chr11 5348916 5348937 5348921 5348916 -
tcctgacactcttttctgtctc

SEQ ID NO: 122236 - DNA, 22 bp, Artificial Sequence
  Synthetic oligonucleotide; TTT chr11 5348915 5348936 5348920 5348915 -
cctgacactcttttctgtctca

SEQ ID NO: 122237 - DNA, 22 bp, Artificial Sequence
  Synthetic oligonucleotide; TTC chr11 5348914 5348935 5348919 5348914 -
ctgacactcttttctgtctcaa

SEQ ID NO: 122238 - DNA, 22 bp, Artificial Sequence
  Synthetic oligonucleotide; CTG chr11 5348911 5348932 5348916 5348911 -
acactcttttctgtctcaagca

SEQ ID NO: 122239 - DNA, 22 bp, Artificial Sequence
  Synthetic oligonucleotide; CTC chr11 5348905 5348926 5348910 5348905 -
ttttctgtctcaagcacttagt

SEQ ID NO: 122240 - DNA, 22 bp, Artificial Sequence
  Synthetic oligonucleotide; CTT chr11 5348903 5348924 5348908 5348903 -
ttctgtctcaagcacttagtat

SEQ ID NO: 122241 - DNA, 22 bp, Artificial Sequence
  Synthetic oligonucleotide; TTT chr11 5348902 5348923 5348907 5348902 -
tctgtctcaagcacttagtatc

SEQ ID NO: 122242 - DNA, 22 bp, Artificial Sequence
  Synthetic oligonucleotide; TTT chr11 5348901 5348922 5348906 5348901 -
ctgtctcaagcacttagtatct

SEQ ID NO: 122243 - DNA, 22 bp, Artificial Sequence
  Synthetic oligonucleotide; TTC chr11 5348900 5348921 5348905 5348900 -
tgtctcaagcacttagtatctc

SEQ ID NO: 122244 - DNA, 22 bp, Artificial Sequence
  Synthetic oligonucleotide; CTG chr11 5348898 5348919 5348903 5348898 -
tctcaagcacttagtatctcca

SEQ ID NO: 122245 - DNA, 22 bp, Artificial Sequence
  Synthetic oligonucleotide; CTC chr11 5348894 5348915 5348899 5348894 -
aagcacttagtatctccatcct

SEQ ID NO: 122246 - DNA, 22 bp, Artificial Sequence
  Synthetic oligonucleotide; CTT chr11 5348886 5348907 5348891 5348886 -
agtatctccatcctttttttac

SEQ ID NO: 122247 - DNA, 22 bp, Artificial Sequence
  Synthetic oligonucleotide; TTA chr11 5348885 5348906 5348890 5348885 -
gtatctccatcctttttttacc

SEQ ID NO: 122248 - DNA, 22 bp, Artificial Sequence
  Synthetic oligonucleotide; CTC chr11 5348878 5348899 5348883 5348878 -
catcctttttttacccccttac

SEQ ID NO: 122249 - DNA, 22 bp, Artificial Sequence
  Synthetic oligonucleotide; CTT chr11 5348871 5348892 5348876 5348871 -
tttttacccccttacctttggc

SEQ ID NO: 122250 - DNA, 22 bp, Artificial Sequence
  Synthetic oligonucleotide; TTT chr11 5348870 5348891 5348875 5348870 -
ttttacccccttacctttggct

SEQ ID NO: 122251 - DNA, 22 bp, Artificial Sequence
  Synthetic oligonucleotide; TTT chr11 5348869 5348890 5348874 5348869 -
tttacccccttacctttggcta

SEQ ID NO: 122252 - DNA, 22 bp, Artificial Sequence
  Synthetic oligonucleotide; TTT chr11 5348868 5348889 5348873 5348868 -
ttacccccttacctttggctat

SEQ ID NO: 122253 - DNA, 22 bp, Artificial Sequence
  Synthetic oligonucleotide; TTT chr11 5348867 5348888 5348872 5348867 -
tacccccttacctttggctatt

SEQ ID NO: 122254 - DNA, 22 bp, Artificial Sequence
  Synthetic oligonucleotide; TTT chr11 5348866 5348887 5348871 5348866 -
acccccttacctttggctatta

SEQ ID NO: 122255 - DNA, 22 bp, Artificial Sequence
  Synthetic oligonucleotide; TTA chr11 5348865 5348886 5348870 5348865 -
cccccttacctttggctattat

SEQ ID NO: 122256 - DNA, 22 bp, Artificial Sequence
  Synthetic oligonucleotide; CTT chr11 5348858 5348879 5348863 5348858 -
acctttggctattatcctttct

SEQ ID NO: 122257 - DNA, 22 bp, Artificial Sequence
  Synthetic oligonucleotide; TTA chr11 5348857 5348878 5348862 5348857 -
cctttggctattatcctttctg

SEQ ID NO: 122258 - DNA, 22 bp, Artificial Sequence
  Synthetic oligonucleotide; CTT chr11 5348853 5348874 5348858 5348853 -
tggctattatcctttctgtgat

SEQ ID NO: 122259 - DNA, 22 bp, Artificial Sequence
  Synthetic oligonucleotide; TTT chr11 5348852 5348873 5348857 5348852 -
ggctattatcctttctgtgatg

SEQ ID NO: 122260 - DNA, 22 bp, Artificial Sequence
  Synthetic oligonucleotide; TTG chr11 5348851 5348872 5348856 5348851 -
gctattatcctttctgtgatgg

SEQ ID NO: 122261 - DNA, 22 bp, Artificial Sequence
  Synthetic oligonucleotide; CTA chr11 5348847 5348868 5348852 5348847 -
ttatcctttctgtgatggttaa

SEQ ID NO: 122262 - DNA, 22 bp, Artificial Sequence
  Synthetic oligonucleotide; TTA chr11 5348844 5348865 5348849 5348844 -
tcctttctgtgatggttaatat

SEQ ID NO: 122263 - DNA, 22 bp, Artificial Sequence
  Synthetic oligonucleotide; CTT chr11 5348839 5348860 5348844 5348839 -
tctgtgatggttaatattgagt

SEQ ID NO: 122264 - DNA, 22 bp, Artificial Sequence
  Synthetic oligonucleotide; TTT chr11 5348838 5348859 5348843 5348838 -
ctgtgatggttaatattgagtg

SEQ ID NO: 122265 - DNA, 22 bp, Artificial Sequence
  Synthetic oligonucleotide; TTC chr11 5348837 5348858 5348842 5348837 -
tgtgatggttaatattgagtgc

SEQ ID NO: 122266 - DNA, 22 bp, Artificial Sequence
  Synthetic oligonucleotide; CTG chr11 5348835 5348856 5348840 5348835 -
tgatggttaatattgagtgcaa

SEQ ID NO: 122267 - DNA, 22 bp, Artificial Sequence
  Synthetic oligonucleotide; TTA chr11 5348826 5348847 5348831 5348826 -
atattgagtgcaaacttgattg

SEQ ID NO: 122268 - DNA, 22 bp, Artificial Sequence
  Synthetic oligonucleotide; TTG chr11 5348820 5348841 5348825 5348820 -
agtgcaaacttgattggattga

SEQ ID NO: 122269 - DNA, 22 bp, Artificial Sequence
  Synthetic oligonucleotide; CTT chr11 5348809 5348830 5348814 5348809 -
gattggattgaaggatgcaaag

SEQ ID NO: 122270 - DNA, 22 bp, Artificial Sequence
  Synthetic oligonucleotide; TTG chr11 5348808 5348829 5348813 5348808 -
attggattgaaggatgcaaagt

SEQ ID NO: 122271 - DNA, 22 bp, Artificial Sequence
  Synthetic oligonucleotide; TTG chr11 5348804 5348825 5348809 5348804 -
gattgaaggatgcaaagtattg

SEQ ID NO: 122272 - DNA, 22 bp, Artificial Sequence
  Synthetic oligonucleotide; TTG chr11 5348799 5348820 5348804 5348799 -
aaggatgcaaagtattgttcct

SEQ ID NO: 122273 - DNA, 22 bp, Artificial Sequence
  Synthetic oligonucleotide; TTG chr11 5348782 5348803 5348787 5348782 -
ttcctgggtgtgctgtaagggt

SEQ ID NO: 122274 - DNA, 22 bp, Artificial Sequence
  Synthetic oligonucleotide; TTC chr11 5348779 5348800 5348784 5348779 -
ctgggtgtgctgtaagggtgtt

SEQ ID NO: 122275 - DNA, 22 bp, Artificial Sequence
  Synthetic oligonucleotide; CTG chr11 5348776 5348797 5348781 5348776 -
ggtgtgctgtaagggtgttgcc

SEQ ID NO: 122276 - DNA, 22 bp, Artificial Sequence
  Synthetic oligonucleotide; CTG chr11 5348767 5348788 5348772 5348767 -
taagggtgttgccaaaggagat

SEQ ID NO: 122277 - DNA, 22 bp, Artificial Sequence
  Synthetic oligonucleotide; TTG chr11 5348756 5348777 5348761 5348756 -
ccaaaggagattaacatttgag

SEQ ID NO: 122278 - DNA, 22 bp, Artificial Sequence
  Synthetic oligonucleotide; TTA chr11 5348743 5348764 5348748 5348743 -
acatttgagtcagtagactggg

SEQ ID NO: 122279 - DNA, 22 bp, Artificial Sequence
  Synthetic oligonucleotide; TTT chr11 5348737 5348758 5348742 5348737 -
gagtcagtagactgggagaggc

SEQ ID NO: 122280 - DNA, 22 bp, Artificial Sequence
  Synthetic oligonucleotide; TTG chr11 5348736 5348757 5348741 5348736 -
agtcagtagactgggagaggca

SEQ ID NO: 122281 - DNA, 22 bp, Artificial Sequence
  Synthetic oligonucleotide; CTG chr11 5348723 5348744 5348728 5348723 -
ggagaggcagacccacccaccc

SEQ ID NO: 122282 - DNA, 22 bp, Artificial Sequence
  Synthetic oligonucleotide; CTC chr11 5348699 5348720 5348704 5348699 -
cgtctgggtgggtactatctaa

SEQ ID NO: 122283 - DNA, 22 bp, Artificial Sequence
  Synthetic oligonucleotide; CTG chr11 5348693 5348714 5348698 5348693 -
ggtgggtactatctaatcagct

SEQ ID NO: 122284 - DNA, 22 bp, Artificial Sequence
  Synthetic oligonucleotide; CTA chr11 5348682 5348703 5348687 5348682 -
tctaatcagctgccagggcggc

SEQ ID NO: 122285 - DNA, 22 bp, Artificial Sequence
  Synthetic oligonucleotide; CTA chr11 5348678 5348699 5348683 5348678 -
atcagctgccagggcggctaga

SEQ ID NO: 122286 - DNA, 22 bp, Artificial Sequence
  Synthetic oligonucleotide; CTG chr11 5348670 5348691 5348675 5348670 -
ccagggcggctagaagaaagca

SEQ ID NO: 122287 - DNA, 22 bp, Artificial Sequence
  Synthetic oligonucleotide; CTA chr11 5348658 5348679 5348663 5348658 -
gaagaaagcaggcaaaagaaga

SEQ ID NO: 122288 - DNA, 22 bp, Artificial Sequence
  Synthetic oligonucleotide; CTG chr11 5348615 5348636 5348620 5348615 -
ttacacaatataaacctttcca

SEQ ID NO: 122289 - DNA, 22 bp, Artificial Sequence
  Synthetic oligonucleotide; TTA chr11 5348612 5348633 5348617 5348612 -
cacaatataaacctttccaggt

SEQ ID NO: 122290 - DNA, 22 bp, Artificial Sequence
  Synthetic oligonucleotide; CTT chr11 5348597 5348618 5348602 5348597 -
tccaggtgctaaagtcacacag

SEQ ID NO: 122291 - DNA, 22 bp, Artificial Sequence
  Synthetic oligonucleotide; TTT chr11 5348596 5348617 5348601 5348596 -
ccaggtgctaaagtcacacagg

SEQ ID NO: 122292 - DNA, 22 bp, Artificial Sequence
  Synthetic oligonucleotide; TTC chr11 5348595 5348616 5348600 5348595 -
caggtgctaaagtcacacaggc

SEQ ID NO: 122293 - DNA, 22 bp, Artificial Sequence
  Synthetic oligonucleotide; CTA chr11 5348586 5348607 5348591 5348586 -
aagtcacacaggctatgtgaat

SEQ ID NO: 122294 - DNA, 22 bp, Artificial Sequence
  Synthetic oligonucleotide; CTA chr11 5348571 5348592 5348576 5348571 -
tgtgaatctgtacccctgatcc

SEQ ID NO: 122295 - DNA, 22 bp, Artificial Sequence
  Synthetic oligonucleotide; CTG chr11 5348561 5348582 5348566 5348561 -
tacccctgatccagaggcacac

SEQ ID NO: 122296 - DNA, 22 bp, Artificial Sequence
  Synthetic oligonucleotide; CTG chr11 5348553 5348574 5348558 5348553 -
atccagaggcacacataaccca

SEQ ID NO: 122297 - DNA, 22 bp, Artificial Sequence
  Synthetic oligonucleotide; CTC chr11 5348526 5348547 5348531 5348526 -
cgtccaagcttaattttgaatt

SEQ ID NO: 122298 - DNA, 22 bp, Artificial Sequence
  Synthetic oligonucleotide; CTT chr11 5348515 5348536 5348520 5348515 -
aattttgaattggtttattagt

SEQ ID NO: 122299 - DNA, 22 bp, Artificial Sequence
  Synthetic oligonucleotide; TTA chr11 5348514 5348535 5348519 5348514 -
attttgaattggtttattagtc

SEQ ID NO: 122300 - DNA, 22 bp, Artificial Sequence
  Synthetic oligonucleotide; TTT chr11 5348510 5348531 5348515 5348510 -
tgaattggtttattagtcatat

SEQ ID NO: 122301 - DNA, 22 bp, Artificial Sequence
  Synthetic oligonucleotide; TTT chr11 5348509 5348530 5348514 5348509 -
gaattggtttattagtcatatg

SEQ ID NO: 122302 - DNA, 22 bp, Artificial Sequence
  Synthetic oligonucleotide; TTG chr11 5348508 5348529 5348513 5348508 -
aattggtttattagtcatatgg

SEQ ID NO: 122303 - DNA, 22 bp, Artificial Sequence
  Synthetic oligonucleotide; TTG chr11 5348503 5348524 5348508 5348503 -
gtttattagtcatatggtcaga

SEQ ID NO: 122304 - DNA, 22 bp, Artificial Sequence
  Synthetic oligonucleotide; TTT chr11 5348499 5348520 5348504 5348499 -
attagtcatatggtcagatagt

SEQ ID NO: 122305 - DNA, 22 bp, Artificial Sequence
  Synthetic oligonucleotide; TTA chr11 5348498 5348519 5348503 5348498 -
ttagtcatatggtcagatagtg

SEQ ID NO: 122306 - DNA, 22 bp, Artificial Sequence
  Synthetic oligonucleotide; TTA chr11 5348495 5348516 5348500 5348495 -
gtcatatggtcagatagtgact

SEQ ID NO: 122307 - DNA, 22 bp, Artificial Sequence
  Synthetic oligonucleotide; CTT chr11 5348472 5348493 5348477 5348472 -
tttttctagaaagtatttgaac

SEQ ID NO: 122308 - DNA, 22 bp, Artificial Sequence
  Synthetic oligonucleotide; TTT chr11 5348471 5348492 5348476 5348471 -
ttttctagaaagtatttgaacc

SEQ ID NO: 122309 - DNA, 22 bp, Artificial Sequence
  Synthetic oligonucleotide; TTT chr11 5348470 5348491 5348475 5348470 -
tttctagaaagtatttgaacct

SEQ ID NO: 122310 - DNA, 22 bp, Artificial Sequence
  Synthetic oligonucleotide; TTT chr11 5348469 5348490 5348474 5348469 -
ttctagaaagtatttgaacctc

SEQ ID NO: 122311 - DNA, 22 bp, Artificial Sequence
  Synthetic oligonucleotide; TTT chr11 5348468 5348489 5348473 5348468 -
tctagaaagtatttgaacctct

SEQ ID NO: 122312 - DNA, 22 bp, Artificial Sequence
  Synthetic oligonucleotide; TTT chr11 5348467 5348488 5348472 5348467 -
ctagaaagtatttgaacctctg

SEQ ID NO: 122313 - DNA, 22 bp, Artificial Sequence
  Synthetic oligonucleotide; TTC chr11 5348466 5348487 5348471 5348466 -
tagaaagtatttgaacctctga

SEQ ID NO: 122314 - DNA, 22 bp, Artificial Sequence
  Synthetic oligonucleotide; CTA chr11 5348464 5348485 5348469 5348464 -
gaaagtatttgaacctctgatg

SEQ ID NO: 122315 - DNA, 22 bp, Artificial Sequence
  Synthetic oligonucleotide; TTT chr11 5348454 5348475 5348459 5348454 -
gaacctctgatgattacagagg

SEQ ID NO: 122316 - DNA, 22 bp, Artificial Sequence
  Synthetic oligonucleotide; TTG chr11 5348453 5348474 5348458 5348453 -
aacctctgatgattacagaggt

SEQ ID NO: 122317 - DNA, 22 bp, Artificial Sequence
  Synthetic oligonucleotide; CTC chr11 5348447 5348468 5348452 5348447 -
tgatgattacagaggtatacct

SEQ ID NO: 122318 - DNA, 22 bp, Artificial Sequence
  Synthetic oligonucleotide; CTG chr11 5348445 5348466 5348450 5348445 -
atgattacagaggtatacctcc

SEQ ID NO: 122319 - DNA, 22 bp, Artificial Sequence
  Synthetic oligonucleotide; TTA chr11 5348438 5348459 5348443 5348438 -
cagaggtatacctcctcaagaa

SEQ ID NO: 122320 - DNA, 22 bp, Artificial Sequence
  Synthetic oligonucleotide; CTC chr11 5348424 5348445 5348429 5348424 -
ctcaagaatttggaagagttga

SEQ ID NO: 122321 - DNA, 22 bp, Artificial Sequence
  Synthetic oligonucleotide; CTC chr11 5348421 5348442 5348426 5348421 -
aagaatttggaagagttgattc

SEQ ID NO: 122322 - DNA, 22 bp, Artificial Sequence
  Synthetic oligonucleotide; TTT chr11 5348413 5348434 5348418 5348413 -
ggaagagttgattctatatttg

SEQ ID NO: 122323 - DNA, 22 bp, Artificial Sequence
  Synthetic oligonucleotide; TTG chr11 5348412 5348433 5348417 5348412 -
gaagagttgattctatatttgg

SEQ ID NO: 122324 - DNA, 22 bp, Artificial Sequence
  Synthetic oligonucleotide; TTG chr11 5348403 5348424 5348408 5348403 -
attctatatttggcacttatct

SEQ ID NO: 122325 - DNA, 22 bp, Artificial Sequence
  Synthetic oligonucleotide; TTC chr11 5348399 5348420 5348404 5348399 -
tatatttggcacttatctggac

SEQ ID NO: 122326 - DNA, 22 bp, Artificial Sequence
  Synthetic oligonucleotide; CTA chr11 5348397 5348418 5348402 5348397 -
tatttggcacttatctggactt

SEQ ID NO: 122327 - DNA, 22 bp, Artificial Sequence
  Synthetic oligonucleotide; TTT chr11 5348392 5348413 5348397 5348392 -
ggcacttatctggacttctaag

SEQ ID NO: 122328 - DNA, 22 bp, Artificial Sequence
  Synthetic oligonucleotide; TTG chr11 5348391 5348412 5348396 5348391 -
gcacttatctggacttctaagg

SEQ ID NO: 122329 - DNA, 22 bp, Artificial Sequence
  Synthetic oligonucleotide; CTT chr11 5348385 5348406 5348390 5348385 -
atctggacttctaaggtaaaag

SEQ ID NO: 122330 - DNA, 22 bp, Artificial Sequence
  Synthetic oligonucleotide; TTA chr11 5348384 5348405 5348389 5348384 -
tctggacttctaaggtaaaaga

SEQ ID NO: 122331 - DNA, 22 bp, Artificial Sequence
  Synthetic oligonucleotide; CTG chr11 5348380 5348401 5348385 5348380 -
gacttctaaggtaaaagacatg

SEQ ID NO: 122332 - DNA, 22 bp, Artificial Sequence
  Synthetic oligonucleotide; CTT chr11 5348375 5348396 5348380 5348375 -
ctaaggtaaaagacatggggtt

SEQ ID NO: 122333 - DNA, 22 bp, Artificial Sequence
  Synthetic oligonucleotide; TTC chr11 5348374 5348395 5348379 5348374 -
taaggtaaaagacatggggttg

SEQ ID NO: 122334 - DNA, 22 bp, Artificial Sequence
  Synthetic oligonucleotide; CTA chr11 5348372 5348393 5348377 5348372 -
aggtaaaagacatggggttggg

SEQ ID NO: 122335 - DNA, 22 bp, Artificial Sequence
  Synthetic oligonucleotide; TTG chr11 5348352 5348373 5348357 5348352 -
ggggcagggggactctcagggt

SEQ ID NO: 122336 - DNA, 22 bp, Artificial Sequence
  Synthetic oligonucleotide; CTC chr11 5348337 5348358 5348342 5348337 -
tcagggttagaatggaagccag

SEQ ID NO: 122337 - DNA, 22 bp, Artificial Sequence
  Synthetic oligonucleotide; CTC chr11 5348335 5348356 5348340 5348335 -
agggttagaatggaagccagag

SEQ ID NO: 122338 - DNA, 22 bp, Artificial Sequence
  Synthetic oligonucleotide; TTA chr11 5348328 5348349 5348333 5348328 -
gaatggaagccagagagattaa

SEQ ID NO: 122339 - DNA, 22 bp, Artificial Sequence
  Synthetic oligonucleotide; TTA chr11 5348307 5348328 5348312 5348307 -
aagaatcagtcaggtggagaga

SEQ ID NO: 122340 - DNA, 22 bp, Artificial Sequence
  Synthetic oligonucleotide; TTA chr11 5348280 5348301 5348285 5348280 -
ctacaaccccataattcatgcc

SEQ ID NO: 122341 - DNA, 22 bp, Artificial Sequence
  Synthetic oligonucleotide; CTA chr11 5348277 5348298 5348282 5348277 -
caaccccataattcatgcctga

SEQ ID NO: 122342 - DNA, 22 bp, Artificial Sequence
  Synthetic oligonucleotide; TTC chr11 5348263 5348284 5348268 5348263 -
atgcctgagtcaacacccatgc

SEQ ID NO: 122343 - DNA, 22 bp, Artificial Sequence
  Synthetic oligonucleotide; CTG chr11 5348256 5348277 5348261 5348256 -
agtcaacacccatgctctggtt

SEQ ID NO: 122344 - DNA, 22 bp, Artificial Sequence
  Synthetic oligonucleotide; CTC chr11 5348239 5348260 5348244 5348239 -
tggtttgttcgtagaattgttt

SEQ ID NO: 122345 - DNA, 22 bp, Artificial Sequence
  Synthetic oligonucleotide; CTG chr11 5348237 5348258 5348242 5348237 -
gtttgttcgtagaattgtttgc

SEQ ID NO: 122346 - DNA, 22 bp, Artificial Sequence
  Synthetic oligonucleotide; TTT chr11 5348233 5348254 5348238 5348233 -
gttcgtagaattgtttgcctta

SEQ ID NO: 122347 - DNA, 22 bp, Artificial Sequence
  Synthetic oligonucleotide; TTG chr11 5348232 5348253 5348237 5348232 -
ttcgtagaattgtttgccttat

SEQ ID NO: 122348 - DNA, 22 bp, Artificial Sequence
  Synthetic oligonucleotide; TTC chr11 5348229 5348250 5348234 5348229 -
gtagaattgtttgccttatgtg

SEQ ID NO: 122349 - DNA, 22 bp, Artificial Sequence
  Synthetic oligonucleotide; TTG chr11 5348220 5348241 5348225 5348220 -
tttgccttatgtgttccagaat

SEQ ID NO: 122350 - DNA, 22 bp, Artificial Sequence
  Synthetic oligonucleotide; TTT chr11 5348217 5348238 5348222 5348217 -
gccttatgtgttccagaatcta

SEQ ID NO: 122351 - DNA, 22 bp, Artificial Sequence
  Synthetic oligonucleotide; TTG chr11 5348216 5348237 5348221 5348216 -
ccttatgtgttccagaatctat

SEQ ID NO: 122352 - DNA, 22 bp, Artificial Sequence
  Synthetic oligonucleotide; CTT chr11 5348212 5348233 5348217 5348212 -
atgtgttccagaatctatcctt

SEQ ID NO: 122353 - DNA, 22 bp, Artificial Sequence
  Synthetic oligonucleotide; TTA chr11 5348211 5348232 5348216 5348211 -
tgtgttccagaatctatccttc

SEQ ID NO: 122354 - DNA, 22 bp, Artificial Sequence
  Synthetic oligonucleotide; TTC chr11 5348204 5348225 5348209 5348204 -
cagaatctatccttcacttttt

SEQ ID NO: 122355 - DNA, 22 bp, Artificial Sequence
  Synthetic oligonucleotide; CTA chr11 5348195 5348216 5348200 5348195 -
tccttcacttttttatatttga

SEQ ID NO: 122356 - DNA, 22 bp, Artificial Sequence
  Synthetic oligonucleotide; CTT chr11 5348190 5348211 5348195 5348190 -
cacttttttatatttgaagagg

SEQ ID NO: 122357 - DNA, 22 bp, Artificial Sequence
  Synthetic oligonucleotide; TTC chr11 5348189 5348210 5348194 5348189 -
acttttttatatttgaagaggt

SEQ ID NO: 122358 - DNA, 22 bp, Artificial Sequence
  Synthetic oligonucleotide; CTT chr11 5348185 5348206 5348190 5348185 -
ttttatatttgaagaggtaact

SEQ ID NO: 122359 - DNA, 22 bp, Artificial Sequence
  Synthetic oligonucleotide; TTT chr11 5348184 5348205 5348189 5348184 -
tttatatttgaagaggtaactc

SEQ ID NO: 122360 - DNA, 22 bp, Artificial Sequence
  Synthetic oligonucleotide; TTT chr11 5348183 5348204 5348188 5348183 -
ttatatttgaagaggtaactct

SEQ ID NO: 122361 - DNA, 22 bp, Artificial Sequence
  Synthetic oligonucleotide; TTT chr11 5348182 5348203 5348187 5348182 -
tatatttgaagaggtaactctc

SEQ ID NO: 122362 - DNA, 22 bp, Artificial Sequence
  Synthetic oligonucleotide; TTT chr11 5348181 5348202 5348186 5348181 -
atatttgaagaggtaactctca

SEQ ID NO: 122363 - DNA, 22 bp, Artificial Sequence
  Synthetic oligonucleotide; TTA chr11 5348180 5348201 5348185 5348180 -
tatttgaagaggtaactctcaa

SEQ ID NO: 122364 - DNA, 22 bp, Artificial Sequence
  Synthetic oligonucleotide; TTT chr11 5348175 5348196 5348180 5348175 -
gaagaggtaactctcaaagaaa

SEQ ID NO: 122365 - DNA, 22 bp, Artificial Sequence
  Synthetic oligonucleotide; TTG chr11 5348174 5348195 5348179 5348174 -
aagaggtaactctcaaagaaac

SEQ ID NO: 122366 - DNA, 22 bp, Artificial Sequence
  Synthetic oligonucleotide; CTC chr11 5348162 5348183 5348167 5348162 -
tcaaagaaaccaagttttagag

SEQ ID NO: 122367 - DNA, 22 bp, Artificial Sequence
  Synthetic oligonucleotide; CTC chr11 5348160 5348181 5348165 5348160 -
aaagaaaccaagttttagagat

SEQ ID NO: 122368 - DNA, 22 bp, Artificial Sequence
  Synthetic oligonucleotide; TTT chr11 5348145 5348166 5348150 5348145 -
tagagatgtcagggagtcttta

SEQ ID NO: 122369 - DNA, 22 bp, Artificial Sequence
  Synthetic oligonucleotide; TTT chr11 5348144 5348165 5348149 5348144 -
agagatgtcagggagtctttag

SEQ ID NO: 122370 - DNA, 22 bp, Artificial Sequence
  Synthetic oligonucleotide; TTA chr11 5348143 5348164 5348148 5348143 -
gagatgtcagggagtctttagg

SEQ ID NO: 122371 - DNA, 22 bp, Artificial Sequence
  Synthetic oligonucleotide; CTT chr11 5348125 5348146 5348130 5348125 -
taggacccatgcctactacata

SEQ ID NO: 122372 - DNA, 22 bp, Artificial Sequence
  Synthetic oligonucleotide; TTT chr11 5348124 5348145 5348129 5348124 -
aggacccatgcctactacatat

SEQ ID NO: 122373 - DNA, 22 bp, Artificial Sequence
  Synthetic oligonucleotide; TTA chr11 5348123 5348144 5348128 5348123 -
ggacccatgcctactacatata

SEQ ID NO: 122374 - DNA, 22 bp, Artificial Sequence
  Synthetic oligonucleotide; CTA chr11 5348110 5348131 5348115 5348110 -
ctacatatatctactcttagca

SEQ ID NO: 122375 - DNA, 22 bp, Artificial Sequence
  Synthetic oligonucleotide; CTA chr11 5348107 5348128 5348112 5348107 -
catatatctactcttagcagac

SEQ ID NO: 122376 - DNA, 22 bp, Artificial Sequence
  Synthetic oligonucleotide; CTA chr11 5348097 5348118 5348102 5348097 -
ctcttagcagacaacactatta

SEQ ID NO: 122377 - DNA, 22 bp, Artificial Sequence
  Synthetic oligonucleotide; CTC chr11 5348094 5348115 5348099 5348094 -
ttagcagacaacactattactt

SEQ ID NO: 122378 - DNA, 22 bp, Artificial Sequence
  Synthetic oligonucleotide; CTT chr11 5348092 5348113 5348097 5348092 -
agcagacaacactattactttt

SEQ ID NO: 122379 - DNA, 22 bp, Artificial Sequence
  Synthetic oligonucleotide; TTA chr11 5348091 5348112 5348096 5348091 -
gcagacaacactattacttttc

SEQ ID NO: 122380 - DNA, 22 bp, Artificial Sequence
  Synthetic oligonucleotide; CTA chr11 5348078 5348099 5348083 5348078 -
ttacttttctcttgctaagaaa

SEQ ID NO: 122381 - DNA, 22 bp, Artificial Sequence
  Synthetic oligonucleotide; TTA chr11 5348075 5348096 5348080 5348075 -
cttttctcttgctaagaaatca

SEQ ID NO: 122382 - DNA, 22 bp, Artificial Sequence
  Synthetic oligonucleotide; CTT chr11 5348072 5348093 5348077 5348072 -
ttctcttgctaagaaatcagct

SEQ ID NO: 122383 - DNA, 22 bp, Artificial Sequence
  Synthetic oligonucleotide; TTT chr11 5348071 5348092 5348076 5348071 -
tctcttgctaagaaatcagctt

SEQ ID NO: 122384 - DNA, 22 bp, Artificial Sequence
  Synthetic oligonucleotide; TTT chr11 5348070 5348091 5348075 5348070 -
ctcttgctaagaaatcagcttc

SEQ ID NO: 122385 - DNA, 22 bp, Artificial Sequence
  Synthetic oligonucleotide; TTC chr11 5348069 5348090 5348074 5348069 -
tcttgctaagaaatcagcttcg

SEQ ID NO: 122386 - DNA, 22 bp, Artificial Sequence
  Synthetic oligonucleotide; CTC chr11 5348067 5348088 5348072 5348067 -
ttgctaagaaatcagcttcgat

SEQ ID NO: 122387 - DNA, 22 bp, Artificial Sequence
  Synthetic oligonucleotide; CTT chr11 5348065 5348086 5348070 5348065 -
gctaagaaatcagcttcgatct

SEQ ID NO: 122388 - DNA, 22 bp, Artificial Sequence
  Synthetic oligonucleotide; TTG chr11 5348064 5348085 5348069 5348064 -
ctaagaaatcagcttcgatctc

SEQ ID NO: 122389 - DNA, 22 bp, Artificial Sequence
  Synthetic oligonucleotide; CTA chr11 5348061 5348082 5348066 5348061 -
agaaatcagcttcgatctctct

SEQ ID NO: 122390 - DNA, 22 bp, Artificial Sequence
  Synthetic oligonucleotide; CTT chr11 5348049 5348070 5348054 5348049 -
cgatctctctgttttttttttg

SEQ ID NO: 122391 - DNA, 22 bp, Artificial Sequence
  Synthetic oligonucleotide; TTC chr11 5348048 5348069 5348053 5348048 -
gatctctctgttttttttttgc

SEQ ID NO: 122392 - DNA, 22 bp, Artificial Sequence
  Synthetic oligonucleotide; CTC chr11 5348042 5348063 5348047 5348042 -
tctgttttttttttgccttggt

SEQ ID NO: 122393 - DNA, 22 bp, Artificial Sequence
  Synthetic oligonucleotide; CTC chr11 5348040 5348061 5348045 5348040 -
tgttttttttttgccttggttc

SEQ ID NO: 122394 - DNA, 22 bp, Artificial Sequence
  Synthetic oligonucleotide; CTG chr11 5348038 5348059 5348043 5348038 -
ttttttttttgccttggttcct

SEQ ID NO: 122395 - DNA, 22 bp, Artificial Sequence
  Synthetic oligonucleotide; TTT chr11 5348035 5348056 5348040 5348035 -
tttttttgccttggttcctgca

SEQ ID NO: 122396 - DNA, 22 bp, Artificial Sequence
  Synthetic oligonucleotide; TTT chr11 5348034 5348055 5348039 5348034 -
ttttttgccttggttcctgcaa

SEQ ID NO: 122397 - DNA, 22 bp, Artificial Sequence
  Synthetic oligonucleotide; TTT chr11 5348033 5348054 5348038 5348033 -
tttttgccttggttcctgcaat

SEQ ID NO: 122398 - DNA, 22 bp, Artificial Sequence
  Synthetic oligonucleotide; TTT chr11 5348032 5348053 5348037 5348032 -
ttttgccttggttcctgcaatg

SEQ ID NO: 122399 - DNA, 22 bp, Artificial Sequence
  Synthetic oligonucleotide; TTT chr11 5348031 5348052 5348036 5348031 -
tttgccttggttcctgcaatga

SEQ ID NO: 122400 - DNA, 22 bp, Artificial Sequence
  Synthetic oligonucleotide; TTT chr11 5348030 5348051 5348035 5348030 -
ttgccttggttcctgcaatgag

SEQ ID NO: 122401 - DNA, 22 bp, Artificial Sequence
  Synthetic oligonucleotide; TTT chr11 5348029 5348050 5348034 5348029 -
tgccttggttcctgcaatgaga

SEQ ID NO: 122402 - DNA, 22 bp, Artificial Sequence
  Synthetic oligonucleotide; TTT chr11 5348028 5348049 5348033 5348028 -
gccttggttcctgcaatgagat

SEQ ID NO: 122403 - DNA, 22 bp, Artificial Sequence
  Synthetic oligonucleotide; TTG chr11 5348027 5348048 5348032 5348027 -
ccttggttcctgcaatgagatc

SEQ ID NO: 122404 - DNA, 22 bp, Artificial Sequence
  Synthetic oligonucleotide; CTT chr11 5348023 5348044 5348028 5348023 -
ggttcctgcaatgagatcttac

SEQ ID NO: 122405 - DNA, 22 bp, Artificial Sequence
  Synthetic oligonucleotide; TTG chr11 5348022 5348043 5348027 5348022 -
gttcctgcaatgagatcttaca

SEQ ID NO: 122406 - DNA, 22 bp, Artificial Sequence
  Synthetic oligonucleotide; TTC chr11 5348018 5348039 5348023 5348018 -
ctgcaatgagatcttacagagg

SEQ ID NO: 122407 - DNA, 22 bp, Artificial Sequence
  Synthetic oligonucleotide; CTG chr11 5348015 5348036 5348020 5348015 -
caatgagatcttacagaggaga

SEQ ID NO: 122408 - DNA, 22 bp, Artificial Sequence
  Synthetic oligonucleotide; CTT chr11 5348003 5348024 5348008 5348003 -
acagaggagattcattaaatac

SEQ ID NO: 122409 - DNA, 22 bp, Artificial Sequence
  Synthetic oligonucleotide; TTA chr11 5348002 5348023 5348007 5348002 -
cagaggagattcattaaatacc

SEQ ID NO: 122410 - DNA, 22 bp, Artificial Sequence
  Synthetic oligonucleotide; TTC chr11 5347990 5348011 5347995 5347990 -
attaaataccctcactgacctg

SEQ ID NO: 122411 - DNA, 22 bp, Artificial Sequence
  Synthetic oligonucleotide; TTA chr11 5347986 5348007 5347991 5347986 -
aataccctcactgacctgaaac

SEQ ID NO: 122412 - DNA, 22 bp, Artificial Sequence
  Synthetic oligonucleotide; CTC chr11 5347977 5347998 5347982 5347977 -
actgacctgaaactttgttccc

SEQ ID NO: 122413 - DNA, 22 bp, Artificial Sequence
  Synthetic oligonucleotide; CTG chr11 5347973 5347994 5347978 5347973 -
acctgaaactttgttcccttcc

SEQ ID NO: 122414 - DNA, 22 bp, Artificial Sequence
  Synthetic oligonucleotide; CTG chr11 5347968 5347989 5347973 5347968 -
aaactttgttcccttccattct

SEQ ID NO: 122415 - DNA, 22 bp, Artificial Sequence
  Synthetic oligonucleotide; CTT chr11 5347962 5347983 5347967 5347962 -
tgttcccttccattcttcagtt

SEQ ID NO: 122416 - DNA, 22 bp, Artificial Sequence
  Synthetic oligonucleotide; TTT chr11 5347961 5347982 5347966 5347961 -
gttcccttccattcttcagttc

SEQ ID NO: 122417 - DNA, 22 bp, Artificial Sequence
  Synthetic oligonucleotide; TTG chr11 5347960 5347981 5347965 5347960 -
ttcccttccattcttcagttcc

SEQ ID NO: 122418 - DNA, 22 bp, Artificial Sequence
  Synthetic oligonucleotide; TTC chr11 5347957 5347978 5347962 5347957 -
ccttccattcttcagttccata

SEQ ID NO: 122419 - DNA, 22 bp, Artificial Sequence
  Synthetic oligonucleotide; CTT chr11 5347953 5347974 5347958 5347953 -
ccattcttcagttccatagtca

SEQ ID NO: 122420 - DNA, 22 bp, Artificial Sequence
  Synthetic oligonucleotide; TTC chr11 5347952 5347973 5347957 5347952 -
cattcttcagttccatagtcat

SEQ ID NO: 122421 - DNA, 22 bp, Artificial Sequence
  Synthetic oligonucleotide; TTC chr11 5347947 5347968 5347952 5347947 -
ttcagttccatagtcatgtatc

SEQ ID NO: 122422 - DNA, 22 bp, Artificial Sequence
  Synthetic oligonucleotide; CTT chr11 5347945 5347966 5347950 5347945 -
cagttccatagtcatgtatctc

SEQ ID NO: 122423 - DNA, 22 bp, Artificial Sequence
  Synthetic oligonucleotide; TTC chr11 5347944 5347965 5347949 5347944 -
agttccatagtcatgtatctca

SEQ ID NO: 122424 - DNA, 22 bp, Artificial Sequence
  Synthetic oligonucleotide; TTC chr11 5347939 5347960 5347944 5347939 -
catagtcatgtatctcacatct

SEQ ID NO: 122425 - DNA, 22 bp, Artificial Sequence
  Synthetic oligonucleotide; CTC chr11 5347923 5347944 5347928 5347923 -
acatctttagccgtatgaaaga

SEQ ID NO: 122426 - DNA, 22 bp, Artificial Sequence
  Synthetic oligonucleotide; CTT chr11 5347916 5347937 5347921 5347916 -
tagccgtatgaaagatttgggc

SEQ ID NO: 122427 - DNA, 22 bp, Artificial Sequence
  Synthetic oligonucleotide; TTT chr11 5347915 5347936 5347920 5347915 -
agccgtatgaaagatttgggca

SEQ ID NO: 122428 - DNA, 22 bp, Artificial Sequence
  Synthetic oligonucleotide; TTA chr11 5347914 5347935 5347919 5347914 -
gccgtatgaaagatttgggcat

SEQ ID NO: 122429 - DNA, 22 bp, Artificial Sequence
  Synthetic oligonucleotide; TTT chr11 5347898 5347919 5347903 5347898 -
gggcatcatcttttcagaatct

SEQ ID NO: 122430 - DNA, 22 bp, Artificial Sequence
  Synthetic oligonucleotide; TTG chr11 5347897 5347918 5347902 5347897 -
ggcatcatcttttcagaatctg

SEQ ID NO: 122431 - DNA, 22 bp, Artificial Sequence
  Synthetic oligonucleotide; CTT chr11 5347886 5347907 5347891 5347886 -
ttcagaatctgcacatgagcct

SEQ ID NO: 122432 - DNA, 22 bp, Artificial Sequence
  Synthetic oligonucleotide; TTT chr11 5347885 5347906 5347890 5347885 -
tcagaatctgcacatgagcctg

SEQ ID NO: 122433 - DNA, 22 bp, Artificial Sequence
  Synthetic oligonucleotide; TTT chr11 5347884 5347905 5347889 5347884 -
cagaatctgcacatgagcctgg

SEQ ID NO: 122434 - DNA, 22 bp, Artificial Sequence
  Synthetic oligonucleotide; TTC chr11 5347883 5347904 5347888 5347883 -
agaatctgcacatgagcctggc

SEQ ID NO: 122435 - DNA, 22 bp, Artificial Sequence
  Synthetic oligonucleotide; CTG chr11 5347875 5347896 5347880 5347875 -
cacatgagcctggctggtagga

SEQ ID NO: 122436 - DNA, 22 bp, Artificial Sequence
  Synthetic oligonucleotide; CTG chr11 5347863 5347884 5347868 5347863 -
gctggtaggaacatttatttta

SEQ ID NO: 122437 - DNA, 22 bp, Artificial Sequence
  Synthetic oligonucleotide; CTG chr11 5347859 5347880 5347864 5347859 -
gtaggaacatttattttagaag

SEQ ID NO: 122438 - DNA, 22 bp, Artificial Sequence
  Synthetic oligonucleotide; TTT chr11 5347847 5347868 5347852 5347847 -
attttagaagctcctccccaga

SEQ ID NO: 122439 - DNA, 22 bp, Artificial Sequence
  Synthetic oligonucleotide; TTA chr11 5347846 5347867 5347851 5347846 -
ttttagaagctcctccccagag

SEQ ID NO: 122440 - DNA, 22 bp, Artificial Sequence
  Synthetic oligonucleotide; TTT chr11 5347843 5347864 5347848 5347843 -
tagaagctcctccccagagacc

SEQ ID NO: 122441 - DNA, 22 bp, Artificial Sequence
  Synthetic oligonucleotide; TTT chr11 5347842 5347863 5347847 5347842 -
agaagctcctccccagagacca

SEQ ID NO: 122442 - DNA, 22 bp, Artificial Sequence
  Synthetic oligonucleotide; TTA chr11 5347841 5347862 5347846 5347841 -
gaagctcctccccagagaccat

SEQ ID NO: 122443 - DNA, 22 bp, Artificial Sequence
  Synthetic oligonucleotide; CTC chr11 5347834 5347855 5347839 5347834 -
ctccccagagaccattcctgat

SEQ ID NO: 122444 - DNA, 22 bp, Artificial Sequence
  Synthetic oligonucleotide; CTC chr11 5347831 5347852 5347836 5347831 -
cccagagaccattcctgattta

SEQ ID NO: 122445 - DNA, 22 bp, Artificial Sequence
  Synthetic oligonucleotide; TTC chr11 5347817 5347838 5347822 5347817 -
ctgatttagataattattgttc

SEQ ID NO: 122446 - DNA, 22 bp, Artificial Sequence
  Synthetic oligonucleotide; CTG chr11 5347814 5347835 5347819 5347814 -
atttagataattattgttcttc

SEQ ID NO: 122447 - DNA, 22 bp, Artificial Sequence
  Synthetic oligonucleotide; TTT chr11 5347810 5347831 5347815 5347810 -
agataattattgttcttccctc

SEQ ID NO: 122448 - DNA, 22 bp, Artificial Sequence
  Synthetic oligonucleotide; TTA chr11 5347809 5347830 5347814 5347809 -
gataattattgttcttccctcc

SEQ ID NO: 122449 - DNA, 22 bp, Artificial Sequence
  Synthetic oligonucleotide; TTA chr11 5347801 5347822 5347806 5347801 -
ttgttcttccctccctccctct

SEQ ID NO: 122450 - DNA, 22 bp, Artificial Sequence
  Synthetic oligonucleotide; TTG chr11 5347798 5347819 5347803 5347798 -
ttcttccctccctccctcttct

SEQ ID NO: 122451 - DNA, 22 bp, Artificial Sequence
  Synthetic oligonucleotide; TTC chr11 5347795 5347816 5347800 5347795 -
ttccctccctccctcttctgct

SEQ ID NO: 122452 - DNA, 22 bp, Artificial Sequence
  Synthetic oligonucleotide; CTT chr11 5347793 5347814 5347798 5347793 -
ccctccctccctcttctgctcc

SEQ ID NO: 122453 - DNA, 22 bp, Artificial Sequence
  Synthetic oligonucleotide; TTC chr11 5347792 5347813 5347797 5347792 -
cctccctccctcttctgctccc

SEQ ID NO: 122454 - DNA, 22 bp, Artificial Sequence
  Synthetic oligonucleotide; CTC chr11 5347788 5347809 5347793 5347788 -
cctccctcttctgctccctcct

SEQ ID NO: 122455 - DNA, 22 bp, Artificial Sequence
  Synthetic oligonucleotide; CTC chr11 5347784 5347805 5347789 5347784 -
cctcttctgctccctcctctct

SEQ ID NO: 122456 - DNA, 22 bp, Artificial Sequence
  Synthetic oligonucleotide; CTC chr11 5347780 5347801 5347785 5347780 -
ttctgctccctcctctcttccc

SEQ ID NO: 122457 - DNA, 22 bp, Artificial Sequence
  Synthetic oligonucleotide; CTT chr11 5347778 5347799 5347783 5347778 -
ctgctccctcctctcttccctc

SEQ ID NO: 122458 - DNA, 22 bp, Artificial Sequence
  Synthetic oligonucleotide; TTC chr11 5347777 5347798 5347782 5347777 -
tgctccctcctctcttccctct

SEQ ID NO: 122459 - DNA, 22 bp, Artificial Sequence
  Synthetic oligonucleotide; CTG chr11 5347775 5347796 5347780 5347775 -
ctccctcctctcttccctctct

SEQ ID NO: 122460 - DNA, 22 bp, Artificial Sequence
  Synthetic oligonucleotide; CTC chr11 5347772 5347793 5347777 5347772 -
cctcctctcttccctctctccc

SEQ ID NO: 122461 - DNA, 22 bp, Artificial Sequence
  Synthetic oligonucleotide; CTC chr11 5347768 5347789 5347773 5347768 -
ctctcttccctctctccctacc

SEQ ID NO: 122462 - DNA, 22 bp, Artificial Sequence
  Synthetic oligonucleotide; CTC chr11 5347765 5347786 5347770 5347765 -
tcttccctctctccctacctcc

SEQ ID NO: 122463 - DNA, 22 bp, Artificial Sequence
  Synthetic oligonucleotide; CTC chr11 5347763 5347784 5347768 5347763 -
ttccctctctccctacctcctt

SEQ ID NO: 122464 - DNA, 22 bp, Artificial Sequence
  Synthetic oligonucleotide; CTT chr11 5347761 5347782 5347766 5347761 -
ccctctctccctacctccttcc

SEQ ID NO: 122465 - DNA, 22 bp, Artificial Sequence
  Synthetic oligonucleotide; TTC chr11 5347760 5347781 5347765 5347760 -
cctctctccctacctccttcct

SEQ ID NO: 122466 - DNA, 22 bp, Artificial Sequence
  Synthetic oligonucleotide; CTC chr11 5347756 5347777 5347761 5347756 -
tctccctacctccttccttcca

SEQ ID NO: 122467 - DNA, 22 bp, Artificial Sequence
  Synthetic oligonucleotide; CTC chr11 5347754 5347775 5347759 5347754 -
tccctacctccttccttccatc

SEQ ID NO: 122468 - DNA, 22 bp, Artificial Sequence
  Synthetic oligonucleotide; CTC chr11 5347752 5347773 5347757 5347752 -
cctacctccttccttccatctt

SEQ ID NO: 122469 - DNA, 22 bp, Artificial Sequence
  Synthetic oligonucleotide; CTA chr11 5347748 5347769 5347753 5347748 -
cctccttccttccatctttttc

SEQ ID NO: 122470 - DNA, 22 bp, Artificial Sequence
  Synthetic oligonucleotide; CTC chr11 5347744 5347765 5347749 5347744 -
cttccttccatctttttctcta

SEQ ID NO: 122471 - DNA, 22 bp, Artificial Sequence
  Synthetic oligonucleotide; CTT chr11 5347741 5347762 5347746 5347741 -
ccttccatctttttctctatta

SEQ ID NO: 122472 - DNA, 22 bp, Artificial Sequence
  Synthetic oligonucleotide; TTC chr11 5347740 5347761 5347745 5347740 -
cttccatctttttctctattat

SEQ ID NO: 122473 - DNA, 22 bp, Artificial Sequence
  Synthetic oligonucleotide; CTT chr11 5347737 5347758 5347742 5347737 -
ccatctttttctctattatttg

SEQ ID NO: 122474 - DNA, 22 bp, Artificial Sequence
  Synthetic oligonucleotide; TTC chr11 5347736 5347757 5347741 5347736 -
catctttttctctattatttgt

SEQ ID NO: 122475 - DNA, 22 bp, Artificial Sequence
  Synthetic oligonucleotide; CTT chr11 5347730 5347751 5347735 5347730 -
tttctctattatttgtgccctc

SEQ ID NO: 122476 - DNA, 22 bp, Artificial Sequence
  Synthetic oligonucleotide; TTT chr11 5347729 5347750 5347734 5347729 -
ttctctattatttgtgccctca

SEQ ID NO: 122477 - DNA, 22 bp, Artificial Sequence
  Synthetic oligonucleotide; TTT chr11 5347728 5347749 5347733 5347728 -
tctctattatttgtgccctcag

SEQ ID NO: 122478 - DNA, 22 bp, Artificial Sequence
  Synthetic oligonucleotide; TTT chr11 5347727 5347748 5347732 5347727 -
ctctattatttgtgccctcagc

SEQ ID NO: 122479 - DNA, 22 bp, Artificial Sequence
  Synthetic oligonucleotide; TTC chr11 5347726 5347747 5347731 5347726 -
tctattatttgtgccctcagcc

SEQ ID NO: 122480 - DNA, 22 bp, Artificial Sequence
  Synthetic oligonucleotide; CTC chr11 5347724 5347745 5347729 5347724 -
tattatttgtgccctcagcctt

SEQ ID NO: 122481 - DNA, 22 bp, Artificial Sequence
  Synthetic oligonucleotide; CTA chr11 5347722 5347743 5347727 5347722 -
ttatttgtgccctcagccttgt

SEQ ID NO: 122482 - DNA, 22 bp, Artificial Sequence
  Synthetic oligonucleotide; TTA chr11 5347719 5347740 5347724 5347719 -
tttgtgccctcagccttgtggg

SEQ ID NO: 122483 - DNA, 22 bp, Artificial Sequence
  Synthetic oligonucleotide; TTT chr11 5347716 5347737 5347721 5347716 -
gtgccctcagccttgtgggtat

SEQ ID NO: 122484 - DNA, 22 bp, Artificial Sequence
  Synthetic oligonucleotide; TTG chr11 5347715 5347736 5347720 5347715 -
tgccctcagccttgtgggtatt

SEQ ID NO: 122485 - DNA, 22 bp, Artificial Sequence
  Synthetic oligonucleotide; CTC chr11 5347708 5347729 5347713 5347708 -
agccttgtgggtattgggcttt

SEQ ID NO: 122486 - DNA, 22 bp, Artificial Sequence
  Synthetic oligonucleotide; CTT chr11 5347702 5347723 5347707 5347702 -
gtgggtattgggctttgaacag

SEQ ID NO: 122487 - DNA, 22 bp, Artificial Sequence
  Synthetic oligonucleotide; TTG chr11 5347701 5347722 5347706 5347701 -
tgggtattgggctttgaacagc

SEQ ID NO: 122488 - DNA, 22 bp, Artificial Sequence
  Synthetic oligonucleotide; TTG chr11 5347692 5347713 5347697 5347692 -
ggctttgaacagcacaactcaa

SEQ ID NO: 122489 - DNA, 22 bp, Artificial Sequence
  Synthetic oligonucleotide; CTT chr11 5347687 5347708 5347692 5347687 -
tgaacagcacaactcaagatct

SEQ ID NO: 122490 - DNA, 22 bp, Artificial Sequence
  Synthetic oligonucleotide; TTT chr11 5347686 5347707 5347691 5347686 -
gaacagcacaactcaagatctc

SEQ ID NO: 122491 - DNA, 22 bp, Artificial Sequence
  Synthetic oligonucleotide; TTG chr11 5347685 5347706 5347690 5347685 -
aacagcacaactcaagatctct

SEQ ID NO: 122492 - DNA, 22 bp, Artificial Sequence
  Synthetic oligonucleotide; CTC chr11 5347672 5347693 5347677 5347672 -
aagatctctgtctctgtcctgg

SEQ ID NO: 122493 - DNA, 22 bp, Artificial Sequence
  Synthetic oligonucleotide; CTC chr11 5347664 5347685 5347669 5347664 -
tgtctctgtcctggcttttact

SEQ ID NO: 122494 - DNA, 22 bp, Artificial Sequence
  Synthetic oligonucleotide; CTG chr11 5347662 5347683 5347667 5347662 -
tctctgtcctggcttttactgg

SEQ ID NO: 122495 - DNA, 22 bp, Artificial Sequence
  Synthetic oligonucleotide; CTC chr11 5347658 5347679 5347663 5347658 -
tgtcctggcttttactggaggt

SEQ ID NO: 122496 - DNA, 22 bp, Artificial Sequence
  Synthetic oligonucleotide; CTG chr11 5347656 5347677 5347661 5347656 -
tcctggcttttactggaggttt

SEQ ID NO: 122497 - DNA, 22 bp, Artificial Sequence
  Synthetic oligonucleotide; CTG chr11 5347651 5347672 5347656 5347651 -
gcttttactggaggttttcctc

SEQ ID NO: 122498 - DNA, 22 bp, Artificial Sequence
  Synthetic oligonucleotide; CTT chr11 5347647 5347668 5347652 5347647 -
ttactggaggttttcctctgtt

SEQ ID NO: 122499 - DNA, 22 bp, Artificial Sequence
  Synthetic oligonucleotide; TTT chr11 5347646 5347667 5347651 5347646 -
tactggaggttttcctctgttg

SEQ ID NO: 122500 - DNA, 22 bp, Artificial Sequence
  Synthetic oligonucleotide; TTT chr11 5347645 5347666 5347650 5347645 -
actggaggttttcctctgttgg

SEQ ID NO: 122501 - DNA, 22 bp, Artificial Sequence
  Synthetic oligonucleotide; TTA chr11 5347644 5347665 5347649 5347644 -
ctggaggttttcctctgttgga

SEQ ID NO: 122502 - DNA, 22 bp, Artificial Sequence
  Synthetic oligonucleotide; CTG chr11 5347641 5347662 5347646 5347641 -
gaggttttcctctgttggaggt

SEQ ID NO: 122503 - DNA, 22 bp, Artificial Sequence
  Synthetic oligonucleotide; TTT chr11 5347634 5347655 5347639 5347634 -
tcctctgttggaggttgaatat

SEQ ID NO: 122504 - DNA, 22 bp, Artificial Sequence
  Synthetic oligonucleotide; TTT chr11 5347633 5347654 5347638 5347633 -
cctctgttggaggttgaatatt

SEQ ID NO: 122505 - DNA, 22 bp, Artificial Sequence
  Synthetic oligonucleotide; TTC chr11 5347632 5347653 5347637 5347632 -
ctctgttggaggttgaatattt

SEQ ID NO: 122506 - DNA, 22 bp, Artificial Sequence
  Synthetic oligonucleotide; CTC chr11 5347629 5347650 5347634 5347629 -
tgttggaggttgaatattttgt

SEQ ID NO: 122507 - DNA, 22 bp, Artificial Sequence
  Synthetic oligonucleotide; CTG chr11 5347627 5347648 5347632 5347627 -
ttggaggttgaatattttgtct

SEQ ID NO: 122508 - DNA, 22 bp, Artificial Sequence
  Synthetic oligonucleotide; TTG chr11 5347624 5347645 5347629 5347624 -
gaggttgaatattttgtctaca

SEQ ID NO: 122509 - DNA, 22 bp, Artificial Sequence
  Synthetic oligonucleotide; TTG chr11 5347617 5347638 5347622 5347617 -
aatattttgtctacattgtggc

SEQ ID NO: 122510 - DNA, 22 bp, Artificial Sequence
  Synthetic oligonucleotide; TTT chr11 5347610 5347631 5347615 5347610 -
tgtctacattgtggctttggct

SEQ ID NO: 122511 - DNA, 22 bp, Artificial Sequence
  Synthetic oligonucleotide; TTT chr11 5347609 5347630 5347614 5347609 -
gtctacattgtggctttggctc

SEQ ID NO: 122512 - DNA, 22 bp, Artificial Sequence
  Synthetic oligonucleotide; TTG chr11 5347608 5347629 5347613 5347608 -
tctacattgtggctttggctct

SEQ ID NO: 122513 - DNA, 22 bp, Artificial Sequence
  Synthetic oligonucleotide; CTA chr11 5347604 5347625 5347609 5347604 -
cattgtggctttggctcttgct

SEQ ID NO: 122514 - DNA, 22 bp, Artificial Sequence
  Synthetic oligonucleotide; TTG chr11 5347599 5347620 5347604 5347599 -
tggctttggctcttgctgtgct

SEQ ID NO: 122515 - DNA, 22 bp, Artificial Sequence
  Synthetic oligonucleotide; CTT chr11 5347593 5347614 5347598 5347593 -
tggctcttgctgtgctactttg

SEQ ID NO: 122516 - DNA, 22 bp, Artificial Sequence
  Synthetic oligonucleotide; TTT chr11 5347592 5347613 5347597 5347592 -
ggctcttgctgtgctactttgg

SEQ ID NO: 122517 - DNA, 22 bp, Artificial Sequence
  Synthetic oligonucleotide; TTG chr11 5347591 5347612 5347596 5347591 -
gctcttgctgtgctactttgga

SEQ ID NO: 122518 - DNA, 22 bp, Artificial Sequence
  Synthetic oligonucleotide; CTC chr11 5347587 5347608 5347592 5347587 -
ttgctgtgctactttggaatta

SEQ ID NO: 122519 - DNA, 22 bp, Artificial Sequence
  Synthetic oligonucleotide; CTT chr11 5347585 5347606 5347590 5347585 -
gctgtgctactttggaattatt

SEQ ID NO: 122520 - DNA, 22 bp, Artificial Sequence
  Synthetic oligonucleotide; TTG chr11 5347584 5347605 5347589 5347584 -
ctgtgctactttggaattattt

SEQ ID NO: 122521 - DNA, 22 bp, Artificial Sequence
  Synthetic oligonucleotide; CTG chr11 5347581 5347602 5347586 5347581 -
tgctactttggaattattttat

SEQ ID NO: 122522 - DNA, 22 bp, Artificial Sequence
  Synthetic oligonucleotide; CTA chr11 5347576 5347597 5347581 5347576 -
ctttggaattattttatctcat

SEQ ID NO: 122523 - DNA, 22 bp, Artificial Sequence
  Synthetic oligonucleotide; CTT chr11 5347573 5347594 5347578 5347573 -
tggaattattttatctcattgc

SEQ ID NO: 122524 - DNA, 22 bp, Artificial Sequence
  Synthetic oligonucleotide; TTT chr11 5347572 5347593 5347577 5347572 -
ggaattattttatctcattgca

SEQ ID NO: 122525 - DNA, 22 bp, Artificial Sequence
  Synthetic oligonucleotide; TTG chr11 5347571 5347592 5347576 5347571 -
gaattattttatctcattgcat

SEQ ID NO: 122526 - DNA, 22 bp, Artificial Sequence
  Synthetic oligonucleotide; TTA chr11 5347565 5347586 5347570 5347565 -
ttttatctcattgcatttcata

SEQ ID NO: 122527 - DNA, 22 bp, Artificial Sequence
  Synthetic oligonucleotide; TTT chr11 5347562 5347583 5347567 5347562 -
tatctcattgcatttcatagtc

SEQ ID NO: 122528 - DNA, 22 bp, Artificial Sequence
  Synthetic oligonucleotide; TTT chr11 5347561 5347582 5347566 5347561 -
atctcattgcatttcatagtcc

SEQ ID NO: 122529 - DNA, 22 bp, Artificial Sequence
  Synthetic oligonucleotide; TTA chr11 5347560 5347581 5347565 5347560 -
tctcattgcatttcatagtcct

SEQ ID NO: 122530 - DNA, 22 bp, Artificial Sequence
  Synthetic oligonucleotide; CTC chr11 5347556 5347577 5347561 5347556 -
attgcatttcatagtccttact

SEQ ID NO: 122531 - DNA, 22 bp, Artificial Sequence
  Synthetic oligonucleotide; TTG chr11 5347552 5347573 5347557 5347552 -
catttcatagtccttactgtaa

SEQ ID NO: 122532 - DNA, 22 bp, Artificial Sequence
  Synthetic oligonucleotide; TTT chr11 5347547 5347568 5347552 5347547 -
catagtccttactgtaaaacgc

SEQ ID NO: 122533 - DNA, 22 bp, Artificial Sequence
  Synthetic oligonucleotide; TTC chr11 5347546 5347567 5347551 5347546 -
atagtccttactgtaaaacgca

SEQ ID NO: 122534 - DNA, 22 bp, Artificial Sequence
  Synthetic oligonucleotide; CTT chr11 5347537 5347558 5347542 5347537 -
actgtaaaacgcatataataat

SEQ ID NO: 122535 - DNA, 22 bp, Artificial Sequence
  Synthetic oligonucleotide; TTA chr11 5347536 5347557 5347541 5347536 -
ctgtaaaacgcatataataatt

SEQ ID NO: 122536 - DNA, 22 bp, Artificial Sequence
  Synthetic oligonucleotide; CTG chr11 5347533 5347554 5347538 5347533 -
taaaacgcatataataattgcc

SEQ ID NO: 122537 - DNA, 22 bp, Artificial Sequence
  Synthetic oligonucleotide; TTG chr11 5347513 5347534 5347518 5347513 -
ccatcacaaagtgatgtggtgt

SEQ ID NO: 122538 - DNA, 22 bp, Artificial Sequence
  Synthetic oligonucleotide; CTT chr11 5347487 5347508 5347492 5347487 -
ggctgaagcaccatgtgatgag

SEQ ID NO: 122539 - DNA, 22 bp, Artificial Sequence
  Synthetic oligonucleotide; TTG chr11 5347486 5347507 5347491 5347486 -
gctgaagcaccatgtgatgagt

SEQ ID NO: 122540 - DNA, 22 bp, Artificial Sequence
  Synthetic oligonucleotide; CTG chr11 5347482 5347503 5347487 5347482 -
aagcaccatgtgatgagtatgc

SEQ ID NO: 122541 - DNA, 22 bp, Artificial Sequence
  Synthetic oligonucleotide; CTG chr11 5347457 5347478 5347462 5347457 -
ctgcatcccctggaaaagagaa

SEQ ID NO: 122542 - DNA, 22 bp, Artificial Sequence
  Synthetic oligonucleotide; CTG chr11 5347454 5347475 5347459 5347454 -
catcccctggaaaagagaaaac

SEQ ID NO: 122543 - DNA, 22 bp, Artificial Sequence
  Synthetic oligonucleotide; CTG chr11 5347445 5347466 5347450 5347445 -
gaaaagagaaaacttctggtag

SEQ ID NO: 122544 - DNA, 22 bp, Artificial Sequence
  Synthetic oligonucleotide; CTT chr11 5347430 5347451 5347435 5347430 -
ctggtaggctaaactcaagaag

SEQ ID NO: 122545 - DNA, 22 bp, Artificial Sequence
  Synthetic oligonucleotide; TTC chr11 5347429 5347450 5347434 5347429 -
tggtaggctaaactcaagaagg

SEQ ID NO: 122546 - DNA, 22 bp, Artificial Sequence
  Synthetic oligonucleotide; CTG chr11 5347427 5347448 5347432 5347427 -
gtaggctaaactcaagaaggga

SEQ ID NO: 122547 - DNA, 22 bp, Artificial Sequence
  Synthetic oligonucleotide; CTA chr11 5347419 5347440 5347424 5347419 -
aactcaagaagggaatagttag

SEQ ID NO: 122548 - DNA, 22 bp, Artificial Sequence
  Synthetic oligonucleotide; CTC chr11 5347414 5347435 5347419 5347414 -
aagaagggaatagttagtgata

SEQ ID NO: 122549 - DNA, 22 bp, Artificial Sequence
  Synthetic oligonucleotide; TTA chr11 5347398 5347419 5347403 5347398 -
gtgataactgcagaatgtgcgt

SEQ ID NO: 122550 - DNA, 22 bp, Artificial Sequence
  Synthetic oligonucleotide; CTG chr11 5347388 5347409 5347393 5347388 -
cagaatgtgcgttcacgttggg

SEQ ID NO: 122551 - DNA, 22 bp, Artificial Sequence
  Synthetic oligonucleotide; TTC chr11 5347374 5347395 5347379 5347374 -
acgttgggtactagagaaggct

SEQ ID NO: 122552 - DNA, 22 bp, Artificial Sequence
  Synthetic oligonucleotide; TTG chr11 5347368 5347389 5347373 5347368 -
ggtactagagaaggctgcctga

SEQ ID NO: 122553 - DNA, 22 bp, Artificial Sequence
  Synthetic oligonucleotide; CTA chr11 5347361 5347382 5347366 5347361 -
gagaaggctgcctgaattttat

SEQ ID NO: 122554 - DNA, 22 bp, Artificial Sequence
  Synthetic oligonucleotide; CTG chr11 5347351 5347372 5347356 5347351 -
cctgaattttattatattgact

SEQ ID NO: 122555 - DNA, 22 bp, Artificial Sequence
  Synthetic oligonucleotide; CTG chr11 5347347 5347368 5347352 5347347 -
aattttattatattgactctag

SEQ ID NO: 122556 - DNA, 22 bp, Artificial Sequence
  Synthetic oligonucleotide; TTT chr11 5347342 5347363 5347347 5347342 -
tattatattgactctagtctat

SEQ ID NO: 122557 - DNA, 22 bp, Artificial Sequence
  Synthetic oligonucleotide; TTT chr11 5347341 5347362 5347346 5347341 -
attatattgactctagtctatc

SEQ ID NO: 122558 - DNA, 22 bp, Artificial Sequence
  Synthetic oligonucleotide; TTA chr11 5347340 5347361 5347345 5347340 -
ttatattgactctagtctatct

SEQ ID NO: 122559 - DNA, 22 bp, Artificial Sequence
  Synthetic oligonucleotide; TTA chr11 5347337 5347358 5347342 5347337 -
tattgactctagtctatctagc

SEQ ID NO: 122560 - DNA, 22 bp, Artificial Sequence
  Synthetic oligonucleotide; TTG chr11 5347332 5347353 5347337 5347332 -
actctagtctatctagctctct

SEQ ID NO: 122561 - DNA, 22 bp, Artificial Sequence
  Synthetic oligonucleotide; CTC chr11 5347328 5347349 5347333 5347328 -
tagtctatctagctctctgctt

SEQ ID NO: 122562 - DNA, 22 bp, Artificial Sequence
  Synthetic oligonucleotide; CTA chr11 5347326 5347347 5347331 5347326 -
gtctatctagctctctgctttc

SEQ ID NO: 122563 - DNA, 22 bp, Artificial Sequence
  Synthetic oligonucleotide; CTA chr11 5347321 5347342 5347326 5347321 -
tctagctctctgctttcaagct

SEQ ID NO: 122564 - DNA, 22 bp, Artificial Sequence
  Synthetic oligonucleotide; CTA chr11 5347317 5347338 5347322 5347317 -
gctctctgctttcaagctttct

SEQ ID NO: 122565 - DNA, 22 bp, Artificial Sequence
  Synthetic oligonucleotide; CTC chr11 5347313 5347334 5347318 5347313 -
tctgctttcaagctttctctga

SEQ ID NO: 122566 - DNA, 22 bp, Artificial Sequence
  Synthetic oligonucleotide; CTC chr11 5347311 5347332 5347316 5347311 -
tgctttcaagctttctctgatc

SEQ ID NO: 122567 - DNA, 22 bp, Artificial Sequence
  Synthetic oligonucleotide; CTG chr11 5347309 5347330 5347314 5347309 -
ctttcaagctttctctgatcta

SEQ ID NO: 122568 - DNA, 22 bp, Artificial Sequence
  Synthetic oligonucleotide; CTT chr11 5347306 5347327 5347311 5347306 -
tcaagctttctctgatctaaac

SEQ ID NO: 122569 - DNA, 22 bp, Artificial Sequence
  Synthetic oligonucleotide; TTT chr11 5347305 5347326 5347310 5347305 -
caagctttctctgatctaaacc

SEQ ID NO: 122570 - DNA, 22 bp, Artificial Sequence
  Synthetic oligonucleotide; TTC chr11 5347304 5347325 5347309 5347304 -
aagctttctctgatctaaacca

SEQ ID NO: 122571 - DNA, 22 bp, Artificial Sequence
  Synthetic oligonucleotide; CTT chr11 5347298 5347319 5347303 5347298 -
tctctgatctaaaccaagcagg

SEQ ID NO: 122572 - DNA, 22 bp, Artificial Sequence
  Synthetic oligonucleotide; TTT chr11 5347297 5347318 5347302 5347297 -
ctctgatctaaaccaagcagga

SEQ ID NO: 122573 - DNA, 22 bp, Artificial Sequence
  Synthetic oligonucleotide; TTC chr11 5347296 5347317 5347301 5347296 -
tctgatctaaaccaagcaggaa

SEQ ID NO: 122574 - DNA, 22 bp, Artificial Sequence
  Synthetic oligonucleotide; CTC chr11 5347294 5347315 5347299 5347294 -
tgatctaaaccaagcaggaaat

SEQ ID NO: 122575 - DNA, 22 bp, Artificial Sequence
  Synthetic oligonucleotide; CTG chr11 5347292 5347313 5347297 5347292 -
atctaaaccaagcaggaaatat

SEQ ID NO: 122576 - DNA, 22 bp, Artificial Sequence
  Synthetic oligonucleotide; CTA chr11 5347287 5347308 5347292 5347287 -
aaccaagcaggaaatatagtag

SEQ ID NO: 122577 - DNA, 22 bp, Artificial Sequence
  Synthetic oligonucleotide; TTC chr11 5347259 5347280 5347264 5347259 -
aggttacataggccaagaagat

SEQ ID NO: 122578 - DNA, 22 bp, Artificial Sequence
  Synthetic oligonucleotide; TTA chr11 5347253 5347274 5347258 5347253 -
cataggccaagaagatatatag

SEQ ID NO: 122579 - DNA, 22 bp, Artificial Sequence
  Synthetic oligonucleotide; CTT chr11 5347227 5347248 5347232 5347227 -
tctcttgagataaactgggaaa

SEQ ID NO: 122580 - DNA, 22 bp, Artificial Sequence
  Synthetic oligonucleotide; TTT chr11 5347226 5347247 5347231 5347226 -
ctcttgagataaactgggaaag

SEQ ID NO: 122581 - DNA, 22 bp, Artificial Sequence
  Synthetic oligonucleotide; TTC chr11 5347225 5347246 5347230 5347225 -
tcttgagataaactgggaaaga

SEQ ID NO: 122582 - DNA, 22 bp, Artificial Sequence
  Synthetic oligonucleotide; CTC chr11 5347223 5347244 5347228 5347223 -
ttgagataaactgggaaagatt

SEQ ID NO: 122583 - DNA, 22 bp, Artificial Sequence
  Synthetic oligonucleotide; CTT chr11 5347221 5347242 5347226 5347221 -
gagataaactgggaaagatttg

SEQ ID NO: 122584 - DNA, 22 bp, Artificial Sequence
  Synthetic oligonucleotide; TTG chr11 5347220 5347241 5347225 5347220 -
agataaactgggaaagatttga

SEQ ID NO: 122585 - DNA, 22 bp, Artificial Sequence
  Synthetic oligonucleotide; CTG chr11 5347210 5347231 5347215 5347210 -
ggaaagatttgactgttgaagt

SEQ ID NO: 122586 - DNA, 22 bp, Artificial Sequence
  Synthetic oligonucleotide; TTT chr11 5347200 5347221 5347205 5347200 -
gactgttgaagtaaatgtaggg

SEQ ID NO: 122587 - DNA, 22 bp, Artificial Sequence
  Synthetic oligonucleotide; TTG chr11 5347199 5347220 5347204 5347199 -
actgttgaagtaaatgtaggga

SEQ ID NO: 122588 - DNA, 22 bp, Artificial Sequence
  Synthetic oligonucleotide; CTG chr11 5347195 5347216 5347200 5347195 -
ttgaagtaaatgtagggaataa

SEQ ID NO: 122589 - DNA, 22 bp, Artificial Sequence
  Synthetic oligonucleotide; TTG chr11 5347192 5347213 5347197 5347192 -
aagtaaatgtagggaataaatt

SEQ ID NO: 122590 - DNA, 22 bp, Artificial Sequence
  Synthetic oligonucleotide; TTA chr11 5347169 5347190 5347174 5347169 -
cctcccagaggtgataccagag

SEQ ID NO: 122591 - DNA, 22 bp, Artificial Sequence
  Synthetic oligonucleotide; CTC chr11 5347165 5347186 5347170 5347165 -
ccagaggtgataccagagtctg

SEQ ID NO: 122592 - DNA, 22 bp, Artificial Sequence
  Synthetic oligonucleotide; CTG chr11 5347143 5347164 5347148 5347143 -
ctggggctatgaagacaggctg

SEQ ID NO: 122593 - DNA, 22 bp, Artificial Sequence
  Synthetic oligonucleotide; CTG chr11 5347140 5347161 5347145 5347140 -
gggctatgaagacaggctgtct

SEQ ID NO: 122594 - DNA, 22 bp, Artificial Sequence
  Synthetic oligonucleotide; CTA chr11 5347134 5347155 5347139 5347134 -
tgaagacaggctgtctgattcc

SEQ ID NO: 122595 - DNA, 22 bp, Artificial Sequence
  Synthetic oligonucleotide; CTG chr11 5347121 5347142 5347126 5347121 -
tctgattccccacacataaagg

SEQ ID NO: 122596 - DNA, 22 bp, Artificial Sequence
  Synthetic oligonucleotide; CTG chr11 5347117 5347138 5347122 5347117 -
attccccacacataaaggtcct

SEQ ID NO: 122597 - DNA, 22 bp, Artificial Sequence
  Synthetic oligonucleotide; TTC chr11 5347113 5347134 5347118 5347113 -
cccacacataaaggtcctacca

SEQ ID NO: 122598 - DNA, 22 bp, Artificial Sequence
  Synthetic oligonucleotide; CTA chr11 5347094 5347115 5347099 5347094 -
ccagtggcttgattcagccagt

SEQ ID NO: 122599 - DNA, 22 bp, Artificial Sequence
  Synthetic oligonucleotide; CTT chr11 5347084 5347105 5347089 5347084 -
gattcagccagtaacttatttg

SEQ ID NO: 122600 - DNA, 22 bp, Artificial Sequence
  Synthetic oligonucleotide; TTG chr11 5347083 5347104 5347088 5347083 -
attcagccagtaacttatttga

SEQ ID NO: 122601 - DNA, 22 bp, Artificial Sequence
  Synthetic oligonucleotide; TTC chr11 5347079 5347100 5347084 5347079 -
agccagtaacttatttgaaaaa

SEQ ID NO: 122602 - DNA, 22 bp, Artificial Sequence
  Synthetic oligonucleotide; CTT chr11 5347067 5347088 5347072 5347067 -
atttgaaaaaagaaagattatt

SEQ ID NO: 122603 - DNA, 22 bp, Artificial Sequence
  Synthetic oligonucleotide; TTA chr11 5347066 5347087 5347071 5347066 -
tttgaaaaaagaaagattattt

SEQ ID NO: 122604 - DNA, 22 bp, Artificial Sequence
  Synthetic oligonucleotide; TTT chr11 5347063 5347084 5347068 5347063 -
gaaaaaagaaagattatttaaa

SEQ ID NO: 122605 - DNA, 22 bp, Artificial Sequence
  Synthetic oligonucleotide; TTG chr11 5347062 5347083 5347067 5347062 -
aaaaaagaaagattatttaaaa

SEQ ID NO: 122606 - DNA, 22 bp, Artificial Sequence
  Synthetic oligonucleotide; TTA chr11 5347047 5347068 5347052 5347047 -
tttaaaagcttggggggactaa

SEQ ID NO: 122607 - DNA, 22 bp, Artificial Sequence
  Synthetic oligonucleotide; TTT chr11 5347044 5347065 5347049 5347044 -
aaaagcttggggggactaatta

SEQ ID NO: 122608 - DNA, 22 bp, Artificial Sequence
  Synthetic oligonucleotide; TTA chr11 5347043 5347064 5347048 5347043 -
aaagcttggggggactaattaa

SEQ ID NO: 122609 - DNA, 22 bp, Artificial Sequence
  Synthetic oligonucleotide; CTT chr11 5347036 5347057 5347041 5347036 -
ggggggactaattaagtgttcc

SEQ ID NO: 122610 - DNA, 22 bp, Artificial Sequence
  Synthetic oligonucleotide; TTG chr11 5347035 5347056 5347040 5347035 -
gggggactaattaagtgttcca

SEQ ID NO: 122611 - DNA, 22 bp, Artificial Sequence
  Synthetic oligonucleotide; CTA chr11 5347026 5347047 5347031 5347026 -
attaagtgttccagctccctct

SEQ ID NO: 122612 - DNA, 22 bp, Artificial Sequence
  Synthetic oligonucleotide; TTA chr11 5347022 5347043 5347027 5347022 -
agtgttccagctccctctaagg

SEQ ID NO: 122613 - DNA, 22 bp, Artificial Sequence
  Synthetic oligonucleotide; TTC chr11 5347015 5347036 5347020 5347015 -
cagctccctctaaggaggagtt

SEQ ID NO: 122614 - DNA, 22 bp, Artificial Sequence
  Synthetic oligonucleotide; CTC chr11 5347009 5347030 5347014 5347009 -
cctctaaggaggagttaataca

SEQ ID NO: 122615 - DNA, 22 bp, Artificial Sequence
  Synthetic oligonucleotide; CTC chr11 5347005 5347026 5347010 5347005 -
taaggaggagttaatacagagt

SEQ ID NO: 122616 - DNA, 22 bp, Artificial Sequence
  Synthetic oligonucleotide; CTA chr11 5347003 5347024 5347008 5347003 -
aggaggagttaatacagagtaa

SEQ ID NO: 122617 - DNA, 22 bp, Artificial Sequence
  Synthetic oligonucleotide; TTA chr11 5346992 5347013 5346997 5346992 -
atacagagtaaatatttcttaa

SEQ ID NO: 122618 - DNA, 22 bp, Artificial Sequence
  Synthetic oligonucleotide; TTT chr11 5346975 5346996 5346980 5346975 -
cttaagatccaagttggctata

SEQ ID NO: 122619 - DNA, 22 bp, Artificial Sequence
  Synthetic oligonucleotide; TTC chr11 5346974 5346995 5346979 5346974 -
ttaagatccaagttggctataa

SEQ ID NO: 122620 - DNA, 22 bp, Artificial Sequence
  Synthetic oligonucleotide; CTT chr11 5346972 5346993 5346977 5346972 -
aagatccaagttggctataaaa

SEQ ID NO: 122621 - DNA, 22 bp, Artificial Sequence
  Synthetic oligonucleotide; TTA chr11 5346971 5346992 5346976 5346971 -
agatccaagttggctataaaag

SEQ ID NO: 122622 - DNA, 22 bp, Artificial Sequence
  Synthetic oligonucleotide; TTG chr11 5346959 5346980 5346964 5346959 -
gctataaaagggagacatctgg

SEQ ID NO: 122623 - DNA, 22 bp, Artificial Sequence
  Synthetic oligonucleotide; CTA chr11 5346955 5346976 5346960 5346955 -
taaaagggagacatctgggaag

SEQ ID NO: 122624 - DNA, 22 bp, Artificial Sequence
  Synthetic oligonucleotide; CTG chr11 5346938 5346959 5346943 5346938 -
ggaaggtgctatctttattaat

SEQ ID NO: 122625 - DNA, 22 bp, Artificial Sequence
  Synthetic oligonucleotide; CTA chr11 5346927 5346948 5346932 5346927 -
tctttattaataaccacagtga

SEQ ID NO: 122626 - DNA, 22 bp, Artificial Sequence
  Synthetic oligonucleotide; CTT chr11 5346923 5346944 5346928 5346923 -
tattaataaccacagtgactgc

SEQ ID NO: 122627 - DNA, 22 bp, Artificial Sequence
  Synthetic oligonucleotide; TTT chr11 5346922 5346943 5346927 5346922 -
attaataaccacagtgactgct

SEQ ID NO: 122628 - DNA, 22 bp, Artificial Sequence
  Synthetic oligonucleotide; TTA chr11 5346921 5346942 5346926 5346921 -
ttaataaccacagtgactgctt

SEQ ID NO: 122629 - DNA, 22 bp, Artificial Sequence
  Synthetic oligonucleotide; TTA chr11 5346918 5346939 5346923 5346918 -
ataaccacagtgactgcttctc

SEQ ID NO: 122630 - DNA, 22 bp, Artificial Sequence
  Synthetic oligonucleotide; CTG chr11 5346902 5346923 5346907 5346902 -
cttctcttcacagatgttgaga

SEQ ID NO: 122631 - DNA, 22 bp, Artificial Sequence
  Synthetic oligonucleotide; CTT chr11 5346899 5346920 5346904 5346899 -
ctcttcacagatgttgagaagg

SEQ ID NO: 122632 - DNA, 22 bp, Artificial Sequence
  Synthetic oligonucleotide; TTC chr11 5346898 5346919 5346903 5346898 -
tcttcacagatgttgagaagga

SEQ ID NO: 122633 - DNA, 22 bp, Artificial Sequence
  Synthetic oligonucleotide; CTC chr11 5346896 5346917 5346901 5346896 -
ttcacagatgttgagaaggaac

SEQ ID NO: 122634 - DNA, 22 bp, Artificial Sequence
  Synthetic oligonucleotide; CTT chr11 5346894 5346915 5346899 5346894 -
cacagatgttgagaaggaacaa

SEQ ID NO: 122635 - DNA, 22 bp, Artificial Sequence
  Synthetic oligonucleotide; TTC chr11 5346893 5346914 5346898 5346893 -
acagatgttgagaaggaacaac

SEQ ID NO: 122636 - DNA, 22 bp, Artificial Sequence
  Synthetic oligonucleotide; TTG chr11 5346883 5346904 5346888 5346883 -
agaaggaacaacatgatctaag

SEQ ID NO: 122637 - DNA, 22 bp, Artificial Sequence
  Synthetic oligonucleotide; CTA chr11 5346863 5346884 5346868 5346863 -
agtctttaggtaagacacaaga

SEQ ID NO: 122638 - DNA, 22 bp, Artificial Sequence
  Synthetic oligonucleotide; CTT chr11 5346857 5346878 5346862 5346857 -
taggtaagacacaagaaccctg

SEQ ID NO: 122639 - DNA, 22 bp, Artificial Sequence
  Synthetic oligonucleotide; TTT chr11 5346856 5346877 5346861 5346856 -
aggtaagacacaagaaccctgc

SEQ ID NO: 122640 - DNA, 22 bp, Artificial Sequence
  Synthetic oligonucleotide; TTA chr11 5346855 5346876 5346860 5346855 -
ggtaagacacaagaaccctgct

SEQ ID NO: 122641 - DNA, 22 bp, Artificial Sequence
  Synthetic oligonucleotide; CTG chr11 5346835 5346856 5346840 5346835 -
ctcttcctcaccatcaaacaag

SEQ ID NO: 122642 - DNA, 22 bp, Artificial Sequence
  Synthetic oligonucleotide; CTC chr11 5346832 5346853 5346837 5346832 -
ttcctcaccatcaaacaagtta

SEQ ID NO: 122643 - DNA, 22 bp, Artificial Sequence
  Synthetic oligonucleotide; CTT chr11 5346830 5346851 5346835 5346830 -
cctcaccatcaaacaagttatg

SEQ ID NO: 122644 - DNA, 22 bp, Artificial Sequence
  Synthetic oligonucleotide; TTC chr11 5346829 5346850 5346834 5346829 -
ctcaccatcaaacaagttatgg

SEQ ID NO: 122645 - DNA, 22 bp, Artificial Sequence
  Synthetic oligonucleotide; CTC chr11 5346826 5346847 5346831 5346826 -
accatcaaacaagttatggtac

SEQ ID NO: 122646 - DNA, 22 bp, Artificial Sequence
  Synthetic oligonucleotide; TTA chr11 5346810 5346831 5346815 5346810 -
tggtacctgggagtatggtgaa

SEQ ID NO: 122647 - DNA, 22 bp, Artificial Sequence
  Synthetic oligonucleotide; CTG chr11 5346801 5346822 5346806 5346801 -
ggagtatggtgaaatactccta

SEQ ID NO: 122648 - DNA, 22 bp, Artificial Sequence
  Synthetic oligonucleotide; CTC chr11 5346782 5346803 5346787 5346782 -
ctagatatataaagagtgtact

SEQ ID NO: 122649 - DNA, 22 bp, Artificial Sequence
  Synthetic oligonucleotide; CTA chr11 5346779 5346800 5346784 5346779 -
gatatataaagagtgtactagg

SEQ ID NO: 122650 - DNA, 22 bp, Artificial Sequence
  Synthetic oligonucleotide; CTA chr11 5346759 5346780 5346764 5346759 -
ggagactcctctataagctctc

SEQ ID NO: 122651 - DNA, 22 bp, Artificial Sequence
  Synthetic oligonucleotide; CTC chr11 5346751 5346772 5346756 5346751 -
ctctataagctctccagagaaa

SEQ ID NO: 122652 - DNA, 22 bp, Artificial Sequence
  Synthetic oligonucleotide; CTC chr11 5346748 5346769 5346753 5346748 -
tataagctctccagagaaagat

SEQ ID NO: 122653 - DNA, 22 bp, Artificial Sequence
  Synthetic oligonucleotide; CTA chr11 5346746 5346767 5346751 5346746 -
taagctctccagagaaagatac

SEQ ID NO: 122654 - DNA, 22 bp, Artificial Sequence
  Synthetic oligonucleotide; CTC chr11 5346739 5346760 5346744 5346739 -
tccagagaaagatacggagaag

SEQ ID NO: 122655 - DNA, 22 bp, Artificial Sequence
  Synthetic oligonucleotide; CTC chr11 5346737 5346758 5346742 5346737 -
cagagaaagatacggagaagaa

SEQ ID NO: 122656 - DNA, 22 bp, Artificial Sequence
  Synthetic oligonucleotide; CTC chr11 5346703 5346724 5346708 5346703 -
aatagtccacagctttggatgt

SEQ ID NO: 122657 - DNA, 22 bp, Artificial Sequence
  Synthetic oligonucleotide; CTT chr11 5346688 5346709 5346693 5346688 -
tggatgtgtgcacagatttcag

SEQ ID NO: 122658 - DNA, 22 bp, Artificial Sequence
  Synthetic oligonucleotide; TTT chr11 5346687 5346708 5346692 5346687 -
ggatgtgtgcacagatttcagt

SEQ ID NO: 122659 - DNA, 22 bp, Artificial Sequence
  Synthetic oligonucleotide; TTG chr11 5346686 5346707 5346691 5346686 -
gatgtgtgcacagatttcagtc

SEQ ID NO: 122660 - DNA, 22 bp, Artificial Sequence
  Synthetic oligonucleotide; TTT chr11 5346669 5346690 5346674 5346669 -
cagtctgaagttgatagaactt

SEQ ID NO: 122661 - DNA, 22 bp, Artificial Sequence
  Synthetic oligonucleotide; TTC chr11 5346668 5346689 5346673 5346668 -
agtctgaagttgatagaacttc

SEQ ID NO: 122662 - DNA, 22 bp, Artificial Sequence
  Synthetic oligonucleotide; CTG chr11 5346662 5346683 5346667 5346662 -
aagttgatagaacttcaaaagc

SEQ ID NO: 122663 - DNA, 22 bp, Artificial Sequence
  Synthetic oligonucleotide; TTG chr11 5346656 5346677 5346661 5346656 -
atagaacttcaaaagcaattcc

SEQ ID NO: 122664 - DNA, 22 bp, Artificial Sequence
  Synthetic oligonucleotide; CTT chr11 5346647 5346668 5346652 5346647 -
caaaagcaattccaagtgctac

SEQ ID NO: 122665 - DNA, 22 bp, Artificial Sequence
  Synthetic oligonucleotide; TTC chr11 5346646 5346667 5346651 5346646 -
aaaagcaattccaagtgctacc

SEQ ID NO: 122666 - DNA, 22 bp, Artificial Sequence
  Synthetic oligonucleotide; TTC chr11 5346635 5346656 5346640 5346635 -
caagtgctaccaaccaactacc

SEQ ID NO: 122667 - DNA, 22 bp, Artificial Sequence
  Synthetic oligonucleotide; CTA chr11 5346626 5346647 5346631 5346626 -
ccaaccaactacctaagacctt

SEQ ID NO: 122668 - DNA, 22 bp, Artificial Sequence
  Synthetic oligonucleotide; CTA chr11 5346615 5346636 5346620 5346615 -
cctaagaccttctgtactcagt

SEQ ID NO: 122669 - DNA, 22 bp, Artificial Sequence
  Synthetic oligonucleotide; CTA chr11 5346611 5346632 5346616 5346611 -
agaccttctgtactcagtgatg

SEQ ID NO: 122670 - DNA, 22 bp, Artificial Sequence
  Synthetic oligonucleotide; CTT chr11 5346604 5346625 5346609 5346604 -
ctgtactcagtgatgtgaatat

SEQ ID NO: 122671 - DNA, 22 bp, Artificial Sequence
  Synthetic oligonucleotide; TTC chr11 5346603 5346624 5346608 5346603 -
tgtactcagtgatgtgaatatg

SEQ ID NO: 122672 - DNA, 22 bp, Artificial Sequence
  Synthetic oligonucleotide; CTG chr11 5346601 5346622 5346606 5346601 -
tactcagtgatgtgaatatgat

SEQ ID NO: 122673 - DNA, 22 bp, Artificial Sequence
  Synthetic oligonucleotide; CTC chr11 5346596 5346617 5346601 5346596 -
agtgatgtgaatatgattgacc

SEQ ID NO: 122674 - DNA, 22 bp, Artificial Sequence
  Synthetic oligonucleotide; TTG chr11 5346577 5346598 5346582 5346577 -
accctctcatatgtcttctttc

SEQ ID NO: 122675 - DNA, 22 bp, Artificial Sequence
  Synthetic oligonucleotide; CTC chr11 5346571 5346592 5346576 5346571 -
tcatatgtcttctttcctttct

SEQ ID NO: 122676 - DNA, 22 bp, Artificial Sequence
  Synthetic oligonucleotide; CTC chr11 5346569 5346590 5346574 5346569 -
atatgtcttctttcctttctaa

SEQ ID NO: 122677 - DNA, 22 bp, Artificial Sequence
  Synthetic oligonucleotide; CTT chr11 5346560 5346581 5346565 5346560 -
ctttcctttctaaaagatgaac

SEQ ID NO: 122678 - DNA, 22 bp, Artificial Sequence
  Synthetic oligonucleotide; TTC chr11 5346559 5346580 5346564 5346559 -
tttcctttctaaaagatgaaca

SEQ ID NO: 122679 - DNA, 22 bp, Artificial Sequence
  Synthetic oligonucleotide; CTT chr11 5346557 5346578 5346562 5346557 -
tcctttctaaaagatgaacagg

SEQ ID NO: 122680 - DNA, 22 bp, Artificial Sequence
  Synthetic oligonucleotide; TTT chr11 5346556 5346577 5346561 5346556 -
cctttctaaaagatgaacagga

SEQ ID NO: 122681 - DNA, 22 bp, Artificial Sequence
  Synthetic oligonucleotide; TTC chr11 5346555 5346576 5346560 5346555 -
ctttctaaaagatgaacaggaa

SEQ ID NO: 122682 - DNA, 22 bp, Artificial Sequence
  Synthetic oligonucleotide; CTT chr11 5346552 5346573 5346557 5346552 -
tctaaaagatgaacaggaaggc

SEQ ID NO: 122683 - DNA, 22 bp, Artificial Sequence
  Synthetic oligonucleotide; TTT chr11 5346551 5346572 5346556 5346551 -
ctaaaagatgaacaggaaggca

SEQ ID NO: 122684 - DNA, 22 bp, Artificial Sequence
  Synthetic oligonucleotide; TTC chr11 5346550 5346571 5346555 5346550 -
taaaagatgaacaggaaggcac

SEQ ID NO: 122685 - DNA, 22 bp, Artificial Sequence
  Synthetic oligonucleotide; CTA chr11 5346548 5346569 5346553 5346548 -
aaagatgaacaggaaggcacct

SEQ ID NO: 122686 - DNA, 22 bp, Artificial Sequence
  Synthetic oligonucleotide; CTC chr11 5346525 5346546 5346530 5346525 -
ttattctactacattttacttt

SEQ ID NO: 122687 - DNA, 22 bp, Artificial Sequence
  Synthetic oligonucleotide; CTT chr11 5346523 5346544 5346528 5346523 -
attctactacattttacttttt

SEQ ID NO: 122688 - DNA, 22 bp, Artificial Sequence
  Synthetic oligonucleotide; TTA chr11 5346522 5346543 5346527 5346522 -
ttctactacattttacttttta

SEQ ID NO: 122689 - DNA, 22 bp, Artificial Sequence
  Synthetic oligonucleotide; TTC chr11 5346519 5346540 5346524 5346519 -
tactacattttactttttaaac

SEQ ID NO: 122690 - DNA, 22 bp, Artificial Sequence
  Synthetic oligonucleotide; CTA chr11 5346517 5346538 5346522 5346517 -
ctacattttactttttaaacaa

SEQ ID NO: 122691 - DNA, 22 bp, Artificial Sequence
  Synthetic oligonucleotide; CTA chr11 5346514 5346535 5346519 5346514 -
cattttactttttaaacaaagc

SEQ ID NO: 122692 - DNA, 22 bp, Artificial Sequence
  Synthetic oligonucleotide; TTT chr11 5346509 5346530 5346514 5346509 -
tactttttaaacaaagcagaga

SEQ ID NO: 122693 - DNA, 22 bp, Artificial Sequence
  Synthetic oligonucleotide; TTT chr11 5346508 5346529 5346513 5346508 -
actttttaaacaaagcagagaa

SEQ ID NO: 122694 - DNA, 22 bp, Artificial Sequence
  Synthetic oligonucleotide; TTA chr11 5346507 5346528 5346512 5346507 -
ctttttaaacaaagcagagaaa

SEQ ID NO: 122695 - DNA, 22 bp, Artificial Sequence
  Synthetic oligonucleotide; CTT chr11 5346504 5346525 5346509 5346504 -
tttaaacaaagcagagaaaaat

SEQ ID NO: 122696 - DNA, 22 bp, Artificial Sequence
  Synthetic oligonucleotide; TTT chr11 5346503 5346524 5346508 5346503 -
ttaaacaaagcagagaaaaatt

SEQ ID NO: 122697 - DNA, 22 bp, Artificial Sequence
  Synthetic oligonucleotide; TTT chr11 5346502 5346523 5346507 5346502 -
taaacaaagcagagaaaaatta

SEQ ID NO: 122698 - DNA, 22 bp, Artificial Sequence
  Synthetic oligonucleotide; TTT chr11 5346501 5346522 5346506 5346501 -
aaacaaagcagagaaaaattat

SEQ ID NO: 122699 - DNA, 22 bp, Artificial Sequence
  Synthetic oligonucleotide; TTA chr11 5346500 5346521 5346505 5346500 -
aacaaagcagagaaaaattatg

SEQ ID NO: 122700 - DNA, 22 bp, Artificial Sequence
  Synthetic oligonucleotide; TTA chr11 5346480 5346501 5346485 5346480 -
tggctgtaaatgttagaagttt

SEQ ID NO: 122701 - DNA, 22 bp, Artificial Sequence
  Synthetic oligonucleotide; CTG chr11 5346474 5346495 5346479 5346474 -
taaatgttagaagtttatctga

SEQ ID NO: 122702 - DNA, 22 bp, Artificial Sequence
  Synthetic oligonucleotide; TTA chr11 5346465 5346486 5346470 5346465 -
gaagtttatctgattttctagg

SEQ ID NO: 122703 - DNA, 22 bp, Artificial Sequence
  Synthetic oligonucleotide; TTT chr11 5346458 5346479 5346463 5346458 -
atctgattttctaggtgttcca

SEQ ID NO: 122704 - DNA, 22 bp, Artificial Sequence
  Synthetic oligonucleotide; TTA chr11 5346457 5346478 5346462 5346457 -
tctgattttctaggtgttccat

SEQ ID NO: 122705 - DNA, 22 bp, Artificial Sequence
  Synthetic oligonucleotide; CTG chr11 5346453 5346474 5346458 5346453 -
attttctaggtgttccattata

SEQ ID NO: 122706 - DNA, 22 bp, Artificial Sequence
  Synthetic oligonucleotide; TTT chr11 5346449 5346470 5346454 5346449 -
tctaggtgttccattatagaat

SEQ ID NO: 122707 - DNA, 22 bp, Artificial Sequence
  Synthetic oligonucleotide; TTT chr11 5346448 5346469 5346453 5346448 -
ctaggtgttccattatagaatc

SEQ ID NO: 122708 - DNA, 22 bp, Artificial Sequence
  Synthetic oligonucleotide; TTC chr11 5346447 5346468 5346452 5346447 -
taggtgttccattatagaatct

SEQ ID NO: 122709 - DNA, 22 bp, Artificial Sequence
  Synthetic oligonucleotide; CTA chr11 5346445 5346466 5346450 5346445 -
ggtgttccattatagaatcttc

SEQ ID NO: 122710 - DNA, 22 bp, Artificial Sequence
  Synthetic oligonucleotide; TTC chr11 5346438 5346459 5346443 5346438 -
cattatagaatcttcttgcttc

SEQ ID NO: 122711 - DNA, 22 bp, Artificial Sequence
  Synthetic oligonucleotide; TTA chr11 5346433 5346454 5346438 5346433 -
tagaatcttcttgcttctatcc

SEQ ID NO: 122712 - DNA, 22 bp, Artificial Sequence
  Synthetic oligonucleotide; CTT chr11 5346424 5346445 5346429 5346424 -
cttgcttctatcctcagtcttt

SEQ ID NO: 122713 - DNA, 22 bp, Artificial Sequence
  Synthetic oligonucleotide; TTC chr11 5346423 5346444 5346428 5346423 -
ttgcttctatcctcagtcttta

SEQ ID NO: 122714 - DNA, 22 bp, Artificial Sequence
  Synthetic oligonucleotide; CTT chr11 5346421 5346442 5346426 5346421 -
gcttctatcctcagtctttatg

SEQ ID NO: 122715 - DNA, 22 bp, Artificial Sequence
  Synthetic oligonucleotide; TTG chr11 5346420 5346441 5346425 5346420 -
cttctatcctcagtctttatga

SEQ ID NO: 122716 - DNA, 22 bp, Artificial Sequence
  Synthetic oligonucleotide; CTT chr11 5346417 5346438 5346422 5346417 -
ctatcctcagtctttatgatct

SEQ ID NO: 122717 - DNA, 22 bp, Artificial Sequence
  Synthetic oligonucleotide; TTC chr11 5346416 5346437 5346421 5346416 -
tatcctcagtctttatgatctc

SEQ ID NO: 122718 - DNA, 22 bp, Artificial Sequence
  Synthetic oligonucleotide; CTA chr11 5346414 5346435 5346419 5346414 -
tcctcagtctttatgatctctt

SEQ ID NO: 122719 - DNA, 22 bp, Artificial Sequence
  Synthetic oligonucleotide; CTC chr11 5346409 5346430 5346414 5346409 -
agtctttatgatctctttcctt

SEQ ID NO: 122720 - DNA, 22 bp, Artificial Sequence
  Synthetic oligonucleotide; CTT chr11 5346403 5346424 5346408 5346403 -
tatgatctctttccttccctat

SEQ ID NO: 122721 - DNA, 22 bp, Artificial Sequence
  Synthetic oligonucleotide; TTT chr11 5346402 5346423 5346407 5346402 -
atgatctctttccttccctata

SEQ ID NO: 122722 - DNA, 22 bp, Artificial Sequence
  Synthetic oligonucleotide; TTA chr11 5346401 5346422 5346406 5346401 -
tgatctctttccttccctatat

SEQ ID NO: 122723 - DNA, 22 bp, Artificial Sequence
  Synthetic oligonucleotide; CTC chr11 5346394 5346415 5346399 5346394 -
tttccttccctatatttttttt

SEQ ID NO: 122724 - DNA, 22 bp, Artificial Sequence
  Synthetic oligonucleotide; CTT chr11 5346392 5346413 5346397 5346392 -
tccttccctatattttttttcc

SEQ ID NO: 122725 - DNA, 22 bp, Artificial Sequence
  Synthetic oligonucleotide; TTT chr11 5346391 5346412 5346396 5346391 -
ccttccctatattttttttcct

SEQ ID NO: 122726 - DNA, 22 bp, Artificial Sequence
  Synthetic oligonucleotide; TTC chr11 5346390 5346411 5346395 5346390 -
cttccctatattttttttcctc

SEQ ID NO: 122727 - DNA, 22 bp, Artificial Sequence
  Synthetic oligonucleotide; CTT chr11 5346387 5346408 5346392 5346387 -
ccctatattttttttcctcagc

SEQ ID NO: 122728 - DNA, 22 bp, Artificial Sequence
  Synthetic oligonucleotide; TTC chr11 5346386 5346407 5346391 5346386 -
cctatattttttttcctcagct

SEQ ID NO: 122729 - DNA, 22 bp, Artificial Sequence
  Synthetic oligonucleotide; CTA chr11 5346382 5346403 5346387 5346382 -
tattttttttcctcagctttta

SEQ ID NO: 122730 - DNA, 22 bp, Artificial Sequence
  Synthetic oligonucleotide; TTT chr11 5346377 5346398 5346382 5346377 -
tttttcctcagcttttatctct

SEQ ID NO: 122731 - DNA, 22 bp, Artificial Sequence
  Synthetic oligonucleotide; TTT chr11 5346376 5346397 5346381 5346376 -
ttttcctcagcttttatctctt

SEQ ID NO: 122732 - DNA, 22 bp, Artificial Sequence
  Synthetic oligonucleotide; TTT chr11 5346375 5346396 5346380 5346375 -
tttcctcagcttttatctcttc

SEQ ID NO: 122733 - DNA, 22 bp, Artificial Sequence
  Synthetic oligonucleotide; TTT chr11 5346374 5346395 5346379 5346374 -
ttcctcagcttttatctcttct

SEQ ID NO: 122734 - DNA, 22 bp, Artificial Sequence
  Synthetic oligonucleotide; TTT chr11 5346373 5346394 5346378 5346373 -
tcctcagcttttatctcttctc

SEQ ID NO: 122735 - DNA, 22 bp, Artificial Sequence
  Synthetic oligonucleotide; TTT chr11 5346372 5346393 5346377 5346372 -
cctcagcttttatctcttctct

SEQ ID NO: 122736 - DNA, 22 bp, Artificial Sequence
  Synthetic oligonucleotide; TTC chr11 5346371 5346392 5346376 5346371 -
ctcagcttttatctcttctctc

SEQ ID NO: 122737 - DNA, 22 bp, Artificial Sequence
  Synthetic oligonucleotide; CTC chr11 5346368 5346389 5346373 5346368 -
agcttttatctcttctctcatt

SEQ ID NO: 122738 - DNA, 22 bp, Artificial Sequence
  Synthetic oligonucleotide; CTT chr11 5346363 5346384 5346368 5346363 -
ttatctcttctctcattgtctt

SEQ ID NO: 122739 - DNA, 22 bp, Artificial Sequence
  Synthetic oligonucleotide; TTT chr11 5346362 5346383 5346367 5346362 -
tatctcttctctcattgtcttt

SEQ ID NO: 122740 - DNA, 22 bp, Artificial Sequence
  Synthetic oligonucleotide; TTT chr11 5346361 5346382 5346366 5346361 -
atctcttctctcattgtctttc

SEQ ID NO: 122741 - DNA, 22 bp, Artificial Sequence
  Synthetic oligonucleotide; TTA chr11 5346360 5346381 5346365 5346360 -
tctcttctctcattgtctttct

SEQ ID NO: 122742 - DNA, 22 bp, Artificial Sequence
  Synthetic oligonucleotide; CTC chr11 5346356 5346377 5346361 5346356 -
ttctctcattgtctttcttctc

SEQ ID NO: 122743 - DNA, 22 bp, Artificial Sequence
  Synthetic oligonucleotide; CTT chr11 5346354 5346375 5346359 5346354 -
ctctcattgtctttcttctcag

SEQ ID NO: 122744 - DNA, 22 bp, Artificial Sequence
  Synthetic oligonucleotide; TTC chr11 5346353 5346374 5346358 5346353 -
tctcattgtctttcttctcaga

SEQ ID NO: 122745 - DNA, 22 bp, Artificial Sequence
  Synthetic oligonucleotide; CTC chr11 5346351 5346372 5346356 5346351 -
tcattgtctttcttctcagaaa

SEQ ID NO: 122746 - DNA, 22 bp, Artificial Sequence
  Synthetic oligonucleotide; CTC chr11 5346349 5346370 5346354 5346349 -
attgtctttcttctcagaaacc

SEQ ID NO: 122747 - DNA, 22 bp, Artificial Sequence
  Synthetic oligonucleotide; TTG chr11 5346345 5346366 5346350 5346345 -
tctttcttctcagaaaccaaga

SEQ ID NO: 122748 - DNA, 22 bp, Artificial Sequence
  Synthetic oligonucleotide; CTT chr11 5346341 5346362 5346346 5346341 -
tcttctcagaaaccaagagcca

SEQ ID NO: 122749 - DNA, 22 bp, Artificial Sequence
  Synthetic oligonucleotide; TTT chr11 5346340 5346361 5346345 5346340 -
cttctcagaaaccaagagccac

SEQ ID NO: 122750 - DNA, 22 bp, Artificial Sequence
  Synthetic oligonucleotide; TTC chr11 5346339 5346360 5346344 5346339 -
ttctcagaaaccaagagccacg

SEQ ID NO: 122751 - DNA, 22 bp, Artificial Sequence
  Synthetic oligonucleotide; CTT chr11 5346337 5346358 5346342 5346337 -
ctcagaaaccaagagccacgac

SEQ ID NO: 122752 - DNA, 22 bp, Artificial Sequence
  Synthetic oligonucleotide; TTC chr11 5346336 5346357 5346341 5346336 -
tcagaaaccaagagccacgact

SEQ ID NO: 122753 - DNA, 22 bp, Artificial Sequence
  Synthetic oligonucleotide; CTC chr11 5346334 5346355 5346339 5346334 -
agaaaccaagagccacgactag

SEQ ID NO: 122754 - DNA, 22 bp, Artificial Sequence
  Synthetic oligonucleotide; CTA chr11 5346313 5346334 5346318 5346313 -
gctgaggacacaagaattttca

SEQ ID NO: 122755 - DNA, 22 bp, Artificial Sequence
  Synthetic oligonucleotide; CTG chr11 5346309 5346330 5346314 5346309 -
aggacacaagaattttcacaaa

SEQ ID NO: 122756 - DNA, 22 bp, Artificial Sequence
  Synthetic oligonucleotide; TTT chr11 5346294 5346315 5346299 5346294 -
tcacaaaacaaagtagagtgat

SEQ ID NO: 122757 - DNA, 22 bp, Artificial Sequence
  Synthetic oligonucleotide; TTT chr11 5346293 5346314 5346298 5346293 -
cacaaaacaaagtagagtgatt

SEQ ID NO: 122758 - DNA, 22 bp, Artificial Sequence
  Synthetic oligonucleotide; TTC chr11 5346292 5346313 5346297 5346292 -
acaaaacaaagtagagtgattc

SEQ ID NO: 122759 - DNA, 22 bp, Artificial Sequence
  Synthetic oligonucleotide; TTC chr11 5346270 5346291 5346275 5346270 -
catagatcactattatagctgc

SEQ ID NO: 122760 - DNA, 22 bp, Artificial Sequence
  Synthetic oligonucleotide; CTA chr11 5346258 5346279 5346263 5346258 -
ttatagctgcattaccaggtat

SEQ ID NO: 122761 - DNA, 22 bp, Artificial Sequence
  Synthetic oligonucleotide; TTA chr11 5346255 5346276 5346260 5346255 -
tagctgcattaccaggtatgtc

SEQ ID NO: 122762 - DNA, 22 bp, Artificial Sequence
  Synthetic oligonucleotide; CTG chr11 5346249 5346270 5346254 5346249 -
cattaccaggtatgtctgcatg

SEQ ID NO: 122763 - DNA, 22 bp, Artificial Sequence
  Synthetic oligonucleotide; TTA chr11 5346244 5346265 5346249 5346244 -
ccaggtatgtctgcatggaatt

SEQ ID NO: 122764 - DNA, 22 bp, Artificial Sequence
  Synthetic oligonucleotide; CTG chr11 5346231 5346252 5346236 5346231 -
catggaattcttgggaatggag

SEQ ID NO: 122765 - DNA, 22 bp, Artificial Sequence
  Synthetic oligonucleotide; TTC chr11 5346221 5346242 5346226 5346221 -
ttgggaatggagaaggaggaaa

SEQ ID NO: 122766 - DNA, 22 bp, Artificial Sequence
  Synthetic oligonucleotide; CTT chr11 5346219 5346240 5346224 5346219 -
gggaatggagaaggaggaaact

SEQ ID NO: 122767 - DNA, 22 bp, Artificial Sequence
  Synthetic oligonucleotide; TTG chr11 5346218 5346239 5346223 5346218 -
ggaatggagaaggaggaaactt

SEQ ID NO: 122768 - DNA, 22 bp, Artificial Sequence
  Synthetic oligonucleotide; CTT chr11 5346196 5346217 5346201 5346196 -
taagttgcaggttattattggc

SEQ ID NO: 122769 - DNA, 22 bp, Artificial Sequence
  Synthetic oligonucleotide; TTT chr11 5346195 5346216 5346200 5346195 -
aagttgcaggttattattggca

SEQ ID NO: 122770 - DNA, 22 bp, Artificial Sequence
  Synthetic oligonucleotide; TTA chr11 5346194 5346215 5346199 5346194 -
agttgcaggttattattggcaa

SEQ ID NO: 122771 - DNA, 22 bp, Artificial Sequence
  Synthetic oligonucleotide; TTG chr11 5346189 5346210 5346194 5346189 -
caggttattattggcaaaatac

SEQ ID NO: 122772 - DNA, 22 bp, Artificial Sequence
  Synthetic oligonucleotide; TTA chr11 5346182 5346203 5346187 5346182 -
ttattggcaaaatacaatcatt

SEQ ID NO: 122773 - DNA, 22 bp, Artificial Sequence
  Synthetic oligonucleotide; TTA chr11 5346179 5346200 5346184 5346179 -
ttggcaaaatacaatcattgcc

SEQ ID NO: 122774 - DNA, 22 bp, Artificial Sequence
  Synthetic oligonucleotide; TTG chr11 5346176 5346197 5346181 5346176 -
gcaaaatacaatcattgcctta

SEQ ID NO: 122775 - DNA, 22 bp, Artificial Sequence
  Synthetic oligonucleotide; TTG chr11 5346159 5346180 5346164 5346159 -
ccttacagtttggttagctttc

SEQ ID NO: 122776 - DNA, 22 bp, Artificial Sequence
  Synthetic oligonucleotide; CTT chr11 5346155 5346176 5346160 5346155 -
acagtttggttagctttccctg

SEQ ID NO: 122777 - DNA, 22 bp, Artificial Sequence
  Synthetic oligonucleotide; TTA chr11 5346154 5346175 5346159 5346154 -
cagtttggttagctttccctgt

SEQ ID NO: 122778 - DNA, 22 bp, Artificial Sequence
  Synthetic oligonucleotide; TTT chr11 5346148 5346169 5346153 5346148 -
ggttagctttccctgtagtgat

SEQ ID NO: 122779 - DNA, 22 bp, Artificial Sequence
  Synthetic oligonucleotide; TTG chr11 5346147 5346168 5346152 5346147 -
gttagctttccctgtagtgatt

SEQ ID NO: 122780 - DNA, 22 bp, Artificial Sequence
  Synthetic oligonucleotide; TTA chr11 5346143 5346164 5346148 5346143 -
gctttccctgtagtgattcatc

SEQ ID NO: 122781 - DNA, 22 bp, Artificial Sequence
  Synthetic oligonucleotide; CTT chr11 5346139 5346160 5346144 5346139 -
tccctgtagtgattcatcactt

SEQ ID NO: 122782 - DNA, 22 bp, Artificial Sequence
  Synthetic oligonucleotide; TTT chr11 5346138 5346159 5346143 5346138 -
ccctgtagtgattcatcacttg

SEQ ID NO: 122783 - DNA, 22 bp, Artificial Sequence
  Synthetic oligonucleotide; TTC chr11 5346137 5346158 5346142 5346137 -
cctgtagtgattcatcacttgt

SEQ ID NO: 122784 - DNA, 22 bp, Artificial Sequence
  Synthetic oligonucleotide; CTG chr11 5346133 5346154 5346138 5346133 -
tagtgattcatcacttgtgctg

SEQ ID NO: 122785 - DNA, 22 bp, Artificial Sequence
  Synthetic oligonucleotide; TTC chr11 5346124 5346145 5346129 5346124 -
atcacttgtgctgcatattctc

SEQ ID NO: 122786 - DNA, 22 bp, Artificial Sequence
  Synthetic oligonucleotide; CTT chr11 5346117 5346138 5346122 5346117 -
gtgctgcatattctctgataag

SEQ ID NO: 122787 - DNA, 22 bp, Artificial Sequence
  Synthetic oligonucleotide; TTG chr11 5346116 5346137 5346121 5346116 -
tgctgcatattctctgataaga

SEQ ID NO: 122788 - DNA, 22 bp, Artificial Sequence
  Synthetic oligonucleotide; CTG chr11 5346111 5346132 5346116 5346111 -
catattctctgataagaaggaa

SEQ ID NO: 122789 - DNA, 22 bp, Artificial Sequence
  Synthetic oligonucleotide; TTC chr11 5346104 5346125 5346109 5346104 -
tctgataagaaggaatttttca

SEQ ID NO: 122790 - DNA, 22 bp, Artificial Sequence
  Synthetic oligonucleotide; CTC chr11 5346102 5346123 5346107 5346102 -
tgataagaaggaatttttcaca

SEQ ID NO: 122791 - DNA, 22 bp, Artificial Sequence
  Synthetic oligonucleotide; CTG chr11 5346100 5346121 5346105 5346100 -
ataagaaggaatttttcacaaa

SEQ ID NO: 122792 - DNA, 22 bp, Artificial Sequence
  Synthetic oligonucleotide; TTT chr11 5346086 5346107 5346091 5346086 -
ttcacaaagttgagatacagtg

SEQ ID NO: 122793 - DNA, 22 bp, Artificial Sequence
  Synthetic oligonucleotide; TTT chr11 5346085 5346106 5346090 5346085 -
tcacaaagttgagatacagtga

SEQ ID NO: 122794 - DNA, 22 bp, Artificial Sequence
  Synthetic oligonucleotide; TTT chr11 5346084 5346105 5346089 5346084 -
cacaaagttgagatacagtgaa

SEQ ID NO: 122795 - DNA, 22 bp, Artificial Sequence
  Synthetic oligonucleotide; TTC chr11 5346083 5346104 5346088 5346083 -
acaaagttgagatacagtgaaa

SEQ ID NO: 122796 - DNA, 22 bp, Artificial Sequence
  Synthetic oligonucleotide; TTG chr11 5346074 5346095 5346079 5346074 -
agatacagtgaaagattaggtt

SEQ ID NO: 122797 - DNA, 22 bp, Artificial Sequence
  Synthetic oligonucleotide; TTA chr11 5346056 5346077 5346061 5346056 -
ggttaaaggagattattgctga

SEQ ID NO: 122798 - DNA, 22 bp, Artificial Sequence
  Synthetic oligonucleotide; TTA chr11 5346051 5346072 5346056 5346051 -
aaggagattattgctgaaacgt

SEQ ID NO: 122799 - DNA, 22 bp, Artificial Sequence
  Synthetic oligonucleotide; TTA chr11 5346041 5346062 5346046 5346041 -
ttgctgaaacgtcagagaagta

SEQ ID NO: 122800 - DNA, 22 bp, Artificial Sequence
  Synthetic oligonucleotide; TTG chr11 5346038 5346059 5346043 5346038 -
ctgaaacgtcagagaagtaaga

SEQ ID NO: 122801 - DNA, 22 bp, Artificial Sequence
  Synthetic oligonucleotide; CTG chr11 5346035 5346056 5346040 5346035 -
aaacgtcagagaagtaagagtg

SEQ ID NO: 122802 - DNA, 22 bp, Artificial Sequence
  Synthetic oligonucleotide; TTG chr11 5346010 5346031 5346015 5346010 -
acagagaaatgaagtacataga

SEQ ID NO: 122803 - DNA, 22 bp, Artificial Sequence
  Synthetic oligonucleotide; CTA chr11 5345968 5345989 5345973 5345968 -
agctggattatctttgcgtcta

SEQ ID NO: 122804 - DNA, 22 bp, Artificial Sequence
  Synthetic oligonucleotide; CTG chr11 5345963 5345984 5345968 5345963 -
gattatctttgcgtctagtaac

SEQ ID NO: 122805 - DNA, 22 bp, Artificial Sequence
  Synthetic oligonucleotide; TTA chr11 5345958 5345979 5345963 5345958 -
tctttgcgtctagtaactgaag

SEQ ID NO: 122806 - DNA, 22 bp, Artificial Sequence
  Synthetic oligonucleotide; CTT chr11 5345954 5345975 5345959 5345954 -
tgcgtctagtaactgaagaata

SEQ ID NO: 122807 - DNA, 22 bp, Artificial Sequence
  Synthetic oligonucleotide; TTT chr11 5345953 5345974 5345958 5345953 -
gcgtctagtaactgaagaatat

SEQ ID NO: 122808 - DNA, 22 bp, Artificial Sequence
  Synthetic oligonucleotide; TTG chr11 5345952 5345973 5345957 5345952 -
cgtctagtaactgaagaatata

SEQ ID NO: 122809 - DNA, 22 bp, Artificial Sequence
  Synthetic oligonucleotide; CTA chr11 5345946 5345967 5345951 5345946 -
gtaactgaagaatatacatcac

SEQ ID NO: 122810 - DNA, 22 bp, Artificial Sequence
  Synthetic oligonucleotide; CTG chr11 5345939 5345960 5345944 5345939 -
aagaatatacatcactcattgt

SEQ ID NO: 122811 - DNA, 22 bp, Artificial Sequence
  Synthetic oligonucleotide; CTC chr11 5345922 5345943 5345927 5345922 -
attgtatgttcagtaggcactg

SEQ ID NO: 122812 - DNA, 22 bp, Artificial Sequence
  Synthetic oligonucleotide; TTG chr11 5345918 5345939 5345923 5345918 -
tatgttcagtaggcactgaatt

SEQ ID NO: 122813 - DNA, 22 bp, Artificial Sequence
  Synthetic oligonucleotide; TTC chr11 5345911 5345932 5345916 5345911 -
agtaggcactgaattctggttt

SEQ ID NO: 122814 - DNA, 22 bp, Artificial Sequence
  Synthetic oligonucleotide; CTG chr11 5345900 5345921 5345905 5345900 -
aattctggtttatgtctctcag

SEQ ID NO: 122815 - DNA, 22 bp, Artificial Sequence
  Synthetic oligonucleotide; TTC chr11 5345895 5345916 5345900 5345895 -
tggtttatgtctctcagtccta

SEQ ID NO: 122816 - DNA, 22 bp, Artificial Sequence
  Synthetic oligonucleotide; CTG chr11 5345893 5345914 5345898 5345893 -
gtttatgtctctcagtcctagg

SEQ ID NO: 122817 - DNA, 22 bp, Artificial Sequence
  Synthetic oligonucleotide; TTT chr11 5345889 5345910 5345894 5345889 -
atgtctctcagtcctaggacag

SEQ ID NO: 122818 - DNA, 22 bp, Artificial Sequence
  Synthetic oligonucleotide; TTA chr11 5345888 5345909 5345893 5345888 -
tgtctctcagtcctaggacaga

SEQ ID NO: 122819 - DNA, 22 bp, Artificial Sequence
  Synthetic oligonucleotide; CTC chr11 5345882 5345903 5345887 5345882 -
tcagtcctaggacagaatatgg

SEQ ID NO: 122820 - DNA, 22 bp, Artificial Sequence
  Synthetic oligonucleotide; CTC chr11 5345880 5345901 5345885 5345880 -
agtcctaggacagaatatggat

SEQ ID NO: 122821 - DNA, 22 bp, Artificial Sequence
  Synthetic oligonucleotide; CTA chr11 5345873 5345894 5345878 5345873 -
ggacagaatatggatgctgaaa

SEQ ID NO: 122822 - DNA, 22 bp, Artificial Sequence
  Synthetic oligonucleotide; CTG chr11 5345854 5345875 5345859 5345854 -
aaaaatgattctttcaaagtgc

SEQ ID NO: 122823 - DNA, 22 bp, Artificial Sequence
  Synthetic oligonucleotide; TTC chr11 5345843 5345864 5345848 5345843 -
tttcaaagtgctgagttgttgc

SEQ ID NO: 122824 - DNA, 22 bp, Artificial Sequence
  Synthetic oligonucleotide; CTT chr11 5345841 5345862 5345846 5345841 -
tcaaagtgctgagttgttgcct

SEQ ID NO: 122825 - DNA, 22 bp, Artificial Sequence
  Synthetic oligonucleotide; TTT chr11 5345840 5345861 5345845 5345840 -
caaagtgctgagttgttgcctc

SEQ ID NO: 122826 - DNA, 22 bp, Artificial Sequence
  Synthetic oligonucleotide; TTC chr11 5345839 5345860 5345844 5345839 -
aaagtgctgagttgttgcctca

SEQ ID NO: 122827 - DNA, 22 bp, Artificial Sequence
  Synthetic oligonucleotide; CTG chr11 5345830 5345851 5345835 5345830 -
agttgttgcctcacgcccagtt

SEQ ID NO: 122828 - DNA, 22 bp, Artificial Sequence
  Synthetic oligonucleotide; TTG chr11 5345825 5345846 5345830 5345825 -
ttgcctcacgcccagttgtctg

SEQ ID NO: 122829 - DNA, 22 bp, Artificial Sequence
  Synthetic oligonucleotide; TTG chr11 5345822 5345843 5345827 5345822 -
cctcacgcccagttgtctggca

SEQ ID NO: 122830 - DNA, 22 bp, Artificial Sequence
  Synthetic oligonucleotide; CTC chr11 5345818 5345839 5345823 5345818 -
acgcccagttgtctggcatctc

SEQ ID NO: 122831 - DNA, 22 bp, Artificial Sequence
  Synthetic oligonucleotide; TTG chr11 5345807 5345828 5345812 5345807 -
tctggcatctcttcactgaaac

SEQ ID NO: 122832 - DNA, 22 bp, Artificial Sequence
  Synthetic oligonucleotide; CTG chr11 5345803 5345824 5345808 5345803 -
gcatctcttcactgaaactatt

SEQ ID NO: 122833 - DNA, 22 bp, Artificial Sequence
  Synthetic oligonucleotide; CTC chr11 5345796 5345817 5345801 5345796 -
ttcactgaaactattacagtta

SEQ ID NO: 122834 - DNA, 22 bp, Artificial Sequence
  Synthetic oligonucleotide; CTT chr11 5345794 5345815 5345799 5345794 -
cactgaaactattacagttaga

SEQ ID NO: 122835 - DNA, 22 bp, Artificial Sequence
  Synthetic oligonucleotide; TTC chr11 5345793 5345814 5345798 5345793 -
actgaaactattacagttagat

SEQ ID NO: 122836 - DNA, 22 bp, Artificial Sequence
  Synthetic oligonucleotide; CTG chr11 5345789 5345810 5345794 5345789 -
aaactattacagttagatctca

SEQ ID NO: 122837 - DNA, 22 bp, Artificial Sequence
  Synthetic oligonucleotide; CTA chr11 5345783 5345804 5345788 5345783 -
ttacagttagatctcatctcta

SEQ ID NO: 122838 - DNA, 22 bp, Artificial Sequence
  Synthetic oligonucleotide; TTA chr11 5345780 5345801 5345785 5345780 -
cagttagatctcatctctatgg

SEQ ID NO: 122839 - DNA, 22 bp, Artificial Sequence
  Synthetic oligonucleotide; TTA chr11 5345774 5345795 5345779 5345774 -
gatctcatctctatgggtggaa

SEQ ID NO: 122840 - DNA, 22 bp, Artificial Sequence
  Synthetic oligonucleotide; CTC chr11 5345768 5345789 5345773 5345768 -
atctctatgggtggaaggtaag

SEQ ID NO: 122841 - DNA, 22 bp, Artificial Sequence
  Synthetic oligonucleotide; CTC chr11 5345763 5345784 5345768 5345763 -
tatgggtggaaggtaagaggat

SEQ ID NO: 122842 - DNA, 22 bp, Artificial Sequence
  Synthetic oligonucleotide; CTA chr11 5345761 5345782 5345766 5345761 -
tgggtggaaggtaagaggatcg

SEQ ID NO: 122843 - DNA, 22 bp, Artificial Sequence
  Synthetic oligonucleotide; TTT chr11 5345736 5345757 5345741 5345736 -
cctttggtggcatctttagggt

SEQ ID NO: 122844 - DNA, 22 bp, Artificial Sequence
  Synthetic oligonucleotide; TTC chr11 5345735 5345756 5345740 5345735 -
ctttggtggcatctttagggta

SEQ ID NO: 122845 - DNA, 22 bp, Artificial Sequence
  Synthetic oligonucleotide; CTT chr11 5345732 5345753 5345737 5345732 -
tggtggcatctttagggtagtg

SEQ ID NO: 122846 - DNA, 22 bp, Artificial Sequence
  Synthetic oligonucleotide; TTT chr11 5345731 5345752 5345736 5345731 -
ggtggcatctttagggtagtgc

SEQ ID NO: 122847 - DNA, 22 bp, Artificial Sequence
  Synthetic oligonucleotide; TTG chr11 5345730 5345751 5345735 5345730 -
gtggcatctttagggtagtgcc

SEQ ID NO: 122848 - DNA, 22 bp, Artificial Sequence
  Synthetic oligonucleotide; CTT chr11 5345720 5345741 5345725 5345720 -
tagggtagtgccttacactgac

SEQ ID NO: 122849 - DNA, 22 bp, Artificial Sequence
  Synthetic oligonucleotide; TTT chr11 5345719 5345740 5345724 5345719 -
agggtagtgccttacactgaca

SEQ ID NO: 122850 - DNA, 22 bp, Artificial Sequence
  Synthetic oligonucleotide; TTA chr11 5345718 5345739 5345723 5345718 -
gggtagtgccttacactgacaa

SEQ ID NO: 122851 - DNA, 22 bp, Artificial Sequence
  Synthetic oligonucleotide; CTT chr11 5345706 5345727 5345711 5345706 -
acactgacaaagtaactctgaa

SEQ ID NO: 122852 - DNA, 22 bp, Artificial Sequence
  Synthetic oligonucleotide; TTA chr11 5345705 5345726 5345710 5345705 -
cactgacaaagtaactctgaag

SEQ ID NO: 122853 - DNA, 22 bp, Artificial Sequence
  Synthetic oligonucleotide; CTG chr11 5345700 5345721 5345705 5345700 -
acaaagtaactctgaaggggta

SEQ ID NO: 122854 - DNA, 22 bp, Artificial Sequence
  Synthetic oligonucleotide; CTC chr11 5345688 5345709 5345693 5345688 -
tgaaggggtatatttggatacg

SEQ ID NO: 122855 - DNA, 22 bp, Artificial Sequence
  Synthetic oligonucleotide; CTG chr11 5345686 5345707 5345691 5345686 -
aaggggtatatttggatacgac

SEQ ID NO: 122856 - DNA, 22 bp, Artificial Sequence
  Synthetic oligonucleotide; TTT chr11 5345673 5345694 5345678 5345673 -
ggatacgaccatctttttaact

SEQ ID NO: 122857 - DNA, 22 bp, Artificial Sequence
  Synthetic oligonucleotide; TTG chr11 5345672 5345693 5345677 5345672 -
gatacgaccatctttttaactt

SEQ ID NO: 122858 - DNA, 22 bp, Artificial Sequence
  Synthetic oligonucleotide; CTT chr11 5345658 5345679 5345663 5345658 -
tttaacttaggataaaaacaac

SEQ ID NO: 122859 - DNA, 22 bp, Artificial Sequence
  Synthetic oligonucleotide; TTT chr11 5345657 5345678 5345662 5345657 -
ttaacttaggataaaaacaact

SEQ ID NO: 122860 - DNA, 22 bp, Artificial Sequence
  Synthetic oligonucleotide; TTT chr11 5345656 5345677 5345661 5345656 -
taacttaggataaaaacaactt

SEQ ID NO: 122861 - DNA, 22 bp, Artificial Sequence
  Synthetic oligonucleotide; TTT chr11 5345655 5345676 5345660 5345655 -
aacttaggataaaaacaacttc

SEQ ID NO: 122862 - DNA, 22 bp, Artificial Sequence
  Synthetic oligonucleotide; TTA chr11 5345654 5345675 5345659 5345654 -
acttaggataaaaacaacttca

SEQ ID NO: 122863 - DNA, 22 bp, Artificial Sequence
  Synthetic oligonucleotide; CTT chr11 5345650 5345671 5345655 5345650 -
aggataaaaacaacttcaagaa

SEQ ID NO: 122864 - DNA, 22 bp, Artificial Sequence
  Synthetic oligonucleotide; TTA chr11 5345649 5345670 5345654 5345649 -
ggataaaaacaacttcaagaag

SEQ ID NO: 122865 - DNA, 22 bp, Artificial Sequence
  Synthetic oligonucleotide; CTT chr11 5345634 5345655 5345639 5345634 -
caagaagttgttctggcatgtg

SEQ ID NO: 122866 - DNA, 22 bp, Artificial Sequence
  Synthetic oligonucleotide; TTC chr11 5345633 5345654 5345638 5345633 -
aagaagttgttctggcatgtga

SEQ ID NO: 122867 - DNA, 22 bp, Artificial Sequence
  Synthetic oligonucleotide; TTG chr11 5345624 5345645 5345629 5345624 -
ttctggcatgtgacaagaaaaa

SEQ ID NO: 122868 - DNA, 22 bp, Artificial Sequence
  Synthetic oligonucleotide; TTC chr11 5345621 5345642 5345626 5345621 -
tggcatgtgacaagaaaaaaaa

SEQ ID NO: 122869 - DNA, 22 bp, Artificial Sequence
  Synthetic oligonucleotide; CTG chr11 5345619 5345640 5345624 5345619 -
gcatgtgacaagaaaaaaaagc

SEQ ID NO: 122870 - DNA, 22 bp, Artificial Sequence
  Synthetic oligonucleotide; TTT chr11 5345584 5345605 5345589 5345584 -
gctctaattcagctatatttac

SEQ ID NO: 122871 - DNA, 22 bp, Artificial Sequence
  Synthetic oligonucleotide; TTG chr11 5345583 5345604 5345588 5345583 -
ctctaattcagctatatttact

SEQ ID NO: 122872 - DNA, 22 bp, Artificial Sequence
  Synthetic oligonucleotide; CTC chr11 5345580 5345601 5345585 5345580 -
taattcagctatatttactaat

SEQ ID NO: 122873 - DNA, 22 bp, Artificial Sequence
  Synthetic oligonucleotide; CTA chr11 5345578 5345599 5345583 5345578 -
attcagctatatttactaatga

SEQ ID NO: 122874 - DNA, 22 bp, Artificial Sequence
  Synthetic oligonucleotide; TTC chr11 5345574 5345595 5345579 5345574 -
agctatatttactaatgactct

SEQ ID NO: 122875 - DNA, 22 bp, Artificial Sequence
  Synthetic oligonucleotide; CTA chr11 5345569 5345590 5345574 5345569 -
tatttactaatgactcttgatt

SEQ ID NO: 122876 - DNA, 22 bp, Artificial Sequence
  Synthetic oligonucleotide; TTT chr11 5345564 5345585 5345569 5345564 -
actaatgactcttgatttcctc

SEQ ID NO: 122877 - DNA, 22 bp, Artificial Sequence
  Synthetic oligonucleotide; TTA chr11 5345563 5345584 5345568 5345563 -
ctaatgactcttgatttcctca

SEQ ID NO: 122878 - DNA, 22 bp, Artificial Sequence
  Synthetic oligonucleotide; CTA chr11 5345560 5345581 5345565 5345560 -
atgactcttgatttcctcacaa

SEQ ID NO: 122879 - DNA, 22 bp, Artificial Sequence
  Synthetic oligonucleotide; CTC chr11 5345553 5345574 5345558 5345553 -
ttgatttcctcacaagtgaata

SEQ ID NO: 122880 - DNA, 22 bp, Artificial Sequence
  Synthetic oligonucleotide; CTT chr11 5345551 5345572 5345556 5345551 -
gatttcctcacaagtgaatatg

SEQ ID NO: 122881 - DNA, 22 bp, Artificial Sequence
  Synthetic oligonucleotide; TTG chr11 5345550 5345571 5345555 5345550 -
atttcctcacaagtgaatatgt

SEQ ID NO: 122882 - DNA, 22 bp, Artificial Sequence
  Synthetic oligonucleotide; TTT chr11 5345546 5345567 5345551 5345546 -
cctcacaagtgaatatgtatcc

SEQ ID NO: 122883 - DNA, 22 bp, Artificial Sequence
  Synthetic oligonucleotide; TTC chr11 5345545 5345566 5345550 5345545 -
ctcacaagtgaatatgtatccc

SEQ ID NO: 122884 - DNA, 22 bp, Artificial Sequence
  Synthetic oligonucleotide; CTC chr11 5345542 5345563 5345547 5345542 -
acaagtgaatatgtatccccct

SEQ ID NO: 122885 - DNA, 22 bp, Artificial Sequence
  Synthetic oligonucleotide; CTC chr11 5345519 5345540 5345524 5345519 -
agacttccattttgagtaaatg

SEQ ID NO: 122886 - DNA, 22 bp, Artificial Sequence
  Synthetic oligonucleotide; CTT chr11 5345513 5345534 5345518 5345513 -
ccattttgagtaaatggcttca

SEQ ID NO: 122887 - DNA, 22 bp, Artificial Sequence
  Synthetic oligonucleotide; TTC chr11 5345512 5345533 5345517 5345512 -
cattttgagtaaatggcttcac

SEQ ID NO: 122888 - DNA, 22 bp, Artificial Sequence
  Synthetic oligonucleotide; TTT chr11 5345507 5345528 5345512 5345507 -
tgagtaaatggcttcaccattc

SEQ ID NO: 122889 - DNA, 22 bp, Artificial Sequence
  Synthetic oligonucleotide; TTT chr11 5345506 5345527 5345511 5345506 -
gagtaaatggcttcaccattct

SEQ ID NO: 122890 - DNA, 22 bp, Artificial Sequence
  Synthetic oligonucleotide; TTG chr11 5345505 5345526 5345510 5345505 -
agtaaatggcttcaccattctt

SEQ ID NO: 122891 - DNA, 22 bp, Artificial Sequence
  Synthetic oligonucleotide; CTT chr11 5345493 5345514 5345498 5345493 -
caccattctttcatttgttcaa

SEQ ID NO: 122892 - DNA, 22 bp, Artificial Sequence
  Synthetic oligonucleotide; TTC chr11 5345492 5345513 5345497 5345492 -
accattctttcatttgttcaaa

SEQ ID NO: 122893 - DNA, 22 bp, Artificial Sequence
  Synthetic oligonucleotide; TTC chr11 5345485 5345506 5345490 5345485 -
tttcatttgttcaaacagaaat

SEQ ID NO: 122894 - DNA, 22 bp, Artificial Sequence
  Synthetic oligonucleotide; CTT chr11 5345483 5345504 5345488 5345483 -
tcatttgttcaaacagaaatct

SEQ ID NO: 122895 - DNA, 22 bp, Artificial Sequence
  Synthetic oligonucleotide; TTT chr11 5345482 5345503 5345487 5345482 -
catttgttcaaacagaaatcta

SEQ ID NO: 122896 - DNA, 22 bp, Artificial Sequence
  Synthetic oligonucleotide; TTC chr11 5345481 5345502 5345486 5345481 -
atttgttcaaacagaaatctag

SEQ ID NO: 122897 - DNA, 22 bp, Artificial Sequence
  Synthetic oligonucleotide; TTT chr11 5345477 5345498 5345482 5345477 -
gttcaaacagaaatctagggga

SEQ ID NO: 122898 - DNA, 22 bp, Artificial Sequence
  Synthetic oligonucleotide; TTG chr11 5345476 5345497 5345481 5345476 -
ttcaaacagaaatctaggggaa

SEQ ID NO: 122899 - DNA, 22 bp, Artificial Sequence
  Synthetic oligonucleotide; TTC chr11 5345473 5345494 5345478 5345473 -
aaacagaaatctaggggaaacc

SEQ ID NO: 122900 - DNA, 22 bp, Artificial Sequence
  Synthetic oligonucleotide; CTA chr11 5345460 5345481 5345465 5345460 -
ggggaaacctcatttgattttt

SEQ ID NO: 122901 - DNA, 22 bp, Artificial Sequence
  Synthetic oligonucleotide; CTC chr11 5345449 5345470 5345454 5345449 -
atttgatttttccctcactccc

SEQ ID NO: 122902 - DNA, 22 bp, Artificial Sequence
  Synthetic oligonucleotide; TTT chr11 5345445 5345466 5345450 5345445 -
gatttttccctcactcccattt

SEQ ID NO: 122903 - DNA, 22 bp, Artificial Sequence
  Synthetic oligonucleotide; TTG chr11 5345444 5345465 5345449 5345444 -
atttttccctcactcccatttt

SEQ ID NO: 122904 - DNA, 22 bp, Artificial Sequence
  Synthetic oligonucleotide; TTT chr11 5345440 5345461 5345445 5345440 -
ttccctcactcccatttttaat

SEQ ID NO: 122905 - DNA, 22 bp, Artificial Sequence
  Synthetic oligonucleotide; TTT chr11 5345439 5345460 5345444 5345439 -
tccctcactcccatttttaata

SEQ ID NO: 122906 - DNA, 22 bp, Artificial Sequence
  Synthetic oligonucleotide; TTT chr11 5345438 5345459 5345443 5345438 -
ccctcactcccatttttaatat

SEQ ID NO: 122907 - DNA, 22 bp, Artificial Sequence
  Synthetic oligonucleotide; TTC chr11 5345437 5345458 5345442 5345437 -
cctcactcccatttttaatata

SEQ ID NO: 122908 - DNA, 22 bp, Artificial Sequence
  Synthetic oligonucleotide; CTC chr11 5345433 5345454 5345438 5345433 -
actcccatttttaatatatcag

SEQ ID NO: 122909 - DNA, 22 bp, Artificial Sequence
  Synthetic oligonucleotide; CTC chr11 5345429 5345450 5345434 5345429 -
ccatttttaatatatcagcaaa

SEQ ID NO: 122910 - DNA, 22 bp, Artificial Sequence
  Synthetic oligonucleotide; TTT chr11 5345423 5345444 5345428 5345423 -
ttaatatatcagcaaatcttgg

SEQ ID NO: 122911 - DNA, 22 bp, Artificial Sequence
  Synthetic oligonucleotide; TTT chr11 5345422 5345443 5345427 5345422 -
taatatatcagcaaatcttggc

SEQ ID NO: 122912 - DNA, 22 bp, Artificial Sequence
  Synthetic oligonucleotide; TTT chr11 5345421 5345442 5345426 5345421 -
aatatatcagcaaatcttggca

SEQ ID NO: 122913 - DNA, 22 bp, Artificial Sequence
  Synthetic oligonucleotide; TTA chr11 5345420 5345441 5345425 5345420 -
atatatcagcaaatcttggcac

SEQ ID NO: 122914 - DNA, 22 bp, Artificial Sequence
  Synthetic oligonucleotide; CTT chr11 5345403 5345424 5345408 5345403 -
ggcactacttcaaaaatgcatc

SEQ ID NO: 122915 - DNA, 22 bp, Artificial Sequence
  Synthetic oligonucleotide; TTG chr11 5345402 5345423 5345407 5345402 -
gcactacttcaaaaatgcatct

SEQ ID NO: 122916 - DNA, 22 bp, Artificial Sequence
  Synthetic oligonucleotide; CTA chr11 5345396 5345417 5345401 5345396 -
cttcaaaaatgcatctgtctct

SEQ ID NO: 122917 - DNA, 22 bp, Artificial Sequence
  Synthetic oligonucleotide; CTT chr11 5345393 5345414 5345398 5345393 -
caaaaatgcatctgtctctgtt

SEQ ID NO: 122918 - DNA, 22 bp, Artificial Sequence
  Synthetic oligonucleotide; TTC chr11 5345392 5345413 5345397 5345392 -
aaaaatgcatctgtctctgttt

SEQ ID NO: 122919 - DNA, 22 bp, Artificial Sequence
  Synthetic oligonucleotide; CTG chr11 5345379 5345400 5345384 5345379 -
tctctgtttaagtttttctatt

SEQ ID NO: 122920 - DNA, 22 bp, Artificial Sequence
  Synthetic oligonucleotide; CTC chr11 5345375 5345396 5345380 5345375 -
tgtttaagtttttctatttttc

SEQ ID NO: 122921 - DNA, 22 bp, Artificial Sequence
  Synthetic oligonucleotide; CTG chr11 5345373 5345394 5345378 5345373 -
tttaagtttttctatttttctc

SEQ ID NO: 122922 - DNA, 22 bp, Artificial Sequence
  Synthetic oligonucleotide; TTT chr11 5345370 5345391 5345375 5345370 -
aagtttttctatttttctcttt

SEQ ID NO: 122923 - DNA, 22 bp, Artificial Sequence
  Synthetic oligonucleotide; TTA chr11 5345369 5345390 5345374 5345369 -
agtttttctatttttctctttt

SEQ ID NO: 122924 - DNA, 22 bp, Artificial Sequence
  Synthetic oligonucleotide; TTT chr11 5345364 5345385 5345369 5345364 -
ttctatttttctctttttttca

SEQ ID NO: 122925 - DNA, 22 bp, Artificial Sequence
  Synthetic oligonucleotide; TTT chr11 5345363 5345384 5345368 5345363 -
tctatttttctctttttttcat

SEQ ID NO: 122926 - DNA, 22 bp, Artificial Sequence
  Synthetic oligonucleotide; TTT chr11 5345362 5345383 5345367 5345362 -
ctatttttctctttttttcatt

SEQ ID NO: 122927 - DNA, 22 bp, Artificial Sequence
  Synthetic oligonucleotide; TTC chr11 5345361 5345382 5345366 5345361 -
tatttttctctttttttcattt

SEQ ID NO: 122928 - DNA, 22 bp, Artificial Sequence
  Synthetic oligonucleotide; CTA chr11 5345359 5345380 5345364 5345359 -
tttttctctttttttcatttcc

SEQ ID NO: 122929 - DNA, 22 bp, Artificial Sequence
  Synthetic oligonucleotide; TTT chr11 5345356 5345377 5345361 5345356 -
ttctctttttttcatttcccct

SEQ ID NO: 122930 - DNA, 22 bp, Artificial Sequence
  Synthetic oligonucleotide; TTT chr11 5345355 5345376 5345360 5345355 -
tctctttttttcatttcccctg

SEQ ID NO: 122931 - DNA, 22 bp, Artificial Sequence
  Synthetic oligonucleotide; TTT chr11 5345354 5345375 5345359 5345354 -
ctctttttttcatttcccctgc

SEQ ID NO: 122932 - DNA, 22 bp, Artificial Sequence
  Synthetic oligonucleotide; TTC chr11 5345353 5345374 5345358 5345353 -
tctttttttcatttcccctgct

SEQ ID NO: 122933 - DNA, 22 bp, Artificial Sequence
  Synthetic oligonucleotide; CTC chr11 5345351 5345372 5345356 5345351 -
tttttttcatttcccctgcttc

SEQ ID NO: 122934 - DNA, 22 bp, Artificial Sequence
  Synthetic oligonucleotide; CTT chr11 5345349 5345370 5345354 5345349 -
tttttcatttcccctgcttctc

SEQ ID NO: 122935 - DNA, 22 bp, Artificial Sequence
  Synthetic oligonucleotide; TTT chr11 5345348 5345369 5345353 5345348 -
ttttcatttcccctgcttctct

SEQ ID NO: 122936 - DNA, 22 bp, Artificial Sequence
  Synthetic oligonucleotide; TTT chr11 5345347 5345368 5345352 5345347 -
tttcatttcccctgcttctctc

SEQ ID NO: 122937 - DNA, 22 bp, Artificial Sequence
  Synthetic oligonucleotide; TTT chr11 5345346 5345367 5345351 5345346 -
ttcatttcccctgcttctctcc

SEQ ID NO: 122938 - DNA, 22 bp, Artificial Sequence
  Synthetic oligonucleotide; TTT chr11 5345345 5345366 5345350 5345345 -
tcatttcccctgcttctctcct

SEQ ID NO: 122939 - DNA, 22 bp, Artificial Sequence
  Synthetic oligonucleotide; TTT chr11 5345344 5345365 5345349 5345344 -
catttcccctgcttctctccta

SEQ ID NO: 122940 - DNA, 22 bp, Artificial Sequence
  Synthetic oligonucleotide; TTC chr11 5345343 5345364 5345348 5345343 -
atttcccctgcttctctcctag

SEQ ID NO: 122941 - DNA, 22 bp, Artificial Sequence
  Synthetic oligonucleotide; TTT chr11 5345339 5345360 5345344 5345339 -
cccctgcttctctcctagtcaa

SEQ ID NO: 122942 - DNA, 22 bp, Artificial Sequence
  Synthetic oligonucleotide; TTC chr11 5345338 5345359 5345343 5345338 -
ccctgcttctctcctagtcaag

SEQ ID NO: 122943 - DNA, 22 bp, Artificial Sequence
  Synthetic oligonucleotide; CTG chr11 5345333 5345354 5345338 5345333 -
cttctctcctagtcaaggtcac

SEQ ID NO: 122944 - DNA, 22 bp, Artificial Sequence
  Synthetic oligonucleotide; CTT chr11 5345330 5345351 5345335 5345330 -
ctctcctagtcaaggtcaccat

SEQ ID NO: 122945 - DNA, 22 bp, Artificial Sequence
  Synthetic oligonucleotide; TTC chr11 5345329 5345350 5345334 5345329 -
tctcctagtcaaggtcaccatg

SEQ ID NO: 122946 - DNA, 22 bp, Artificial Sequence
  Synthetic oligonucleotide; CTC chr11 5345327 5345348 5345332 5345327 -
tcctagtcaaggtcaccatgac

SEQ ID NO: 122947 - DNA, 22 bp, Artificial Sequence
  Synthetic oligonucleotide; CTC chr11 5345325 5345346 5345330 5345325 -
ctagtcaaggtcaccatgactc

SEQ ID NO: 122948 - DNA, 22 bp, Artificial Sequence
  Synthetic oligonucleotide; CTA chr11 5345322 5345343 5345327 5345322 -
gtcaaggtcaccatgactcttc

SEQ ID NO: 122949 - DNA, 22 bp, Artificial Sequence
  Synthetic oligonucleotide; CTC chr11 5345303 5345324 5345308 5345303 -
ttcatatggatttttaaaatag

SEQ ID NO: 122950 - DNA, 22 bp, Artificial Sequence
  Synthetic oligonucleotide; CTT chr11 5345301 5345322 5345306 5345301 -
catatggatttttaaaatagct

SEQ ID NO: 122951 - DNA, 22 bp, Artificial Sequence
  Synthetic oligonucleotide; TTC chr11 5345300 5345321 5345305 5345300 -
atatggatttttaaaatagctt

SEQ ID NO: 122952 - DNA, 22 bp, Artificial Sequence
  Synthetic oligonucleotide; TTT chr11 5345290 5345311 5345295 5345290 -
ttaaaatagctttctaactcat

SEQ ID NO: 122953 - DNA, 22 bp, Artificial Sequence
  Synthetic oligonucleotide; TTT chr11 5345289 5345310 5345294 5345289 -
taaaatagctttctaactcatc

SEQ ID NO: 122954 - DNA, 22 bp, Artificial Sequence
  Synthetic oligonucleotide; TTT chr11 5345288 5345309 5345293 5345288 -
aaaatagctttctaactcatct

SEQ ID NO: 122955 - DNA, 22 bp, Artificial Sequence
  Synthetic oligonucleotide; TTA chr11 5345287 5345308 5345292 5345287 -
aaatagctttctaactcatctc

SEQ ID NO: 122956 - DNA, 22 bp, Artificial Sequence
  Synthetic oligonucleotide; CTT chr11 5345278 5345299 5345283 5345278 -
tctaactcatctcttttcttgt

SEQ ID NO: 122957 - DNA, 22 bp, Artificial Sequence
  Synthetic oligonucleotide; TTT chr11 5345277 5345298 5345282 5345277 -
ctaactcatctcttttcttgtc

SEQ ID NO: 122958 - DNA, 22 bp, Artificial Sequence
  Synthetic oligonucleotide; TTC chr11 5345276 5345297 5345281 5345276 -
taactcatctcttttcttgtct

SEQ ID NO: 122959 - DNA, 22 bp, Artificial Sequence
  Synthetic oligonucleotide; CTA chr11 5345274 5345295 5345279 5345274 -
actcatctcttttcttgtctct

SEQ ID NO: 122960 - DNA, 22 bp, Artificial Sequence
  Synthetic oligonucleotide; CTC chr11 5345270 5345291 5345275 5345270 -
atctcttttcttgtctcttgct

SEQ ID NO: 122961 - DNA, 22 bp, Artificial Sequence
  Synthetic oligonucleotide; CTC chr11 5345265 5345286 5345270 5345265 -
ttttcttgtctcttgcttagtc

SEQ ID NO: 122962 - DNA, 22 bp, Artificial Sequence
  Synthetic oligonucleotide; CTT chr11 5345263 5345284 5345268 5345263 -
ttcttgtctcttgcttagtctt

SEQ ID NO: 122963 - DNA, 22 bp, Artificial Sequence
  Synthetic oligonucleotide; TTT chr11 5345262 5345283 5345267 5345262 -
tcttgtctcttgcttagtcttc

SEQ ID NO: 122964 - DNA, 22 bp, Artificial Sequence
  Synthetic oligonucleotide; TTT chr11 5345261 5345282 5345266 5345261 -
cttgtctcttgcttagtcttct

SEQ ID NO: 122965 - DNA, 22 bp, Artificial Sequence
  Synthetic oligonucleotide; TTC chr11 5345260 5345281 5345265 5345260 -
ttgtctcttgcttagtcttctt

SEQ ID NO: 122966 - DNA, 22 bp, Artificial Sequence
  Synthetic oligonucleotide; CTT chr11 5345258 5345279 5345263 5345258 -
gtctcttgcttagtcttcttca

SEQ ID NO: 122967 - DNA, 22 bp, Artificial Sequence
  Synthetic oligonucleotide; TTG chr11 5345257 5345278 5345262 5345257 -
tctcttgcttagtcttcttcac

SEQ ID NO: 122968 - DNA, 22 bp, Artificial Sequence
  Synthetic oligonucleotide; CTC chr11 5345253 5345274 5345258 5345253 -
ttgcttagtcttcttcacatag

SEQ ID NO: 122969 - DNA, 22 bp, Artificial Sequence
  Synthetic oligonucleotide; CTT chr11 5345251 5345272 5345256 5345251 -
gcttagtcttcttcacatagca

SEQ ID NO: 122970 - DNA, 22 bp, Artificial Sequence
  Synthetic oligonucleotide; TTG chr11 5345250 5345271 5345255 5345250 -
cttagtcttcttcacatagcag

SEQ ID NO: 122971 - DNA, 22 bp, Artificial Sequence
  Synthetic oligonucleotide; CTT chr11 5345247 5345268 5345252 5345247 -
agtcttcttcacatagcagtct

SEQ ID NO: 122972 - DNA, 22 bp, Artificial Sequence
  Synthetic oligonucleotide; TTA chr11 5345246 5345267 5345251 5345246 -
gtcttcttcacatagcagtcta

SEQ ID NO: 122973 - DNA, 22 bp, Artificial Sequence
  Synthetic oligonucleotide; CTT chr11 5345241 5345262 5345246 5345241 -
cttcacatagcagtctaagtga

SEQ ID NO: 122974 - DNA, 22 bp, Artificial Sequence
  Synthetic oligonucleotide; TTC chr11 5345240 5345261 5345245 5345240 -
ttcacatagcagtctaagtgag

SEQ ID NO: 122975 - DNA, 22 bp, Artificial Sequence
  Synthetic oligonucleotide; CTT chr11 5345238 5345259 5345243 5345238 -
cacatagcagtctaagtgagta

SEQ ID NO: 122976 - DNA, 22 bp, Artificial Sequence
  Synthetic oligonucleotide; TTC chr11 5345237 5345258 5345242 5345237 -
acatagcagtctaagtgagtaa

SEQ ID NO: 122977 - DNA, 22 bp, Artificial Sequence
  Synthetic oligonucleotide; CTA chr11 5345224 5345245 5345229 5345224 -
agtgagtaatttaaaaatacaa

SEQ ID NO: 122978 - DNA, 22 bp, Artificial Sequence
  Synthetic oligonucleotide; TTT chr11 5345212 5345233 5345217 5345212 -
aaaaatacaaatcagaatatat

SEQ ID NO: 122979 - DNA, 22 bp, Artificial Sequence
  Synthetic oligonucleotide; TTA chr11 5345211 5345232 5345216 5345211 -
aaaatacaaatcagaatatatc

SEQ ID NO: 122980 - DNA, 22 bp, Artificial Sequence
  Synthetic oligonucleotide; CTA chr11 5345180 5345201 5345185 5345180 -
ttttccattgtgattttcaaag

SEQ ID NO: 122981 - DNA, 22 bp, Artificial Sequence
  Synthetic oligonucleotide; TTT chr11 5345177 5345198 5345182 5345177 -
tccattgtgattttcaaagtgt

SEQ ID NO: 122982 - DNA, 22 bp, Artificial Sequence
  Synthetic oligonucleotide; TTT chr11 5345176 5345197 5345181 5345176 -
ccattgtgattttcaaagtgtc

SEQ ID NO: 122983 - DNA, 22 bp, Artificial Sequence
  Synthetic oligonucleotide; TTC chr11 5345175 5345196 5345180 5345175 -
cattgtgattttcaaagtgtcc

SEQ ID NO: 122984 - DNA, 22 bp, Artificial Sequence
  Synthetic oligonucleotide; TTG chr11 5345170 5345191 5345175 5345170 -
tgattttcaaagtgtcctaatg

SEQ ID NO: 122985 - DNA, 22 bp, Artificial Sequence
  Synthetic oligonucleotide; TTT chr11 5345164 5345185 5345169 5345164 -
tcaaagtgtcctaatgtcttta

SEQ ID NO: 122986 - DNA, 22 bp, Artificial Sequence
  Synthetic oligonucleotide; TTT chr11 5345163 5345184 5345168 5345163 -
caaagtgtcctaatgtctttac

SEQ ID NO: 122987 - DNA, 22 bp, Artificial Sequence
  Synthetic oligonucleotide; TTC chr11 5345162 5345183 5345167 5345162 -
aaagtgtcctaatgtctttact

SEQ ID NO: 122988 - DNA, 22 bp, Artificial Sequence
  Synthetic oligonucleotide; CTA chr11 5345151 5345172 5345156 5345151 -
atgtctttactacatttatagt

SEQ ID NO: 122989 - DNA, 22 bp, Artificial Sequence
  Synthetic oligonucleotide; CTT chr11 5345144 5345165 5345149 5345144 -
tactacatttatagtaagaaga

SEQ ID NO: 122990 - DNA, 22 bp, Artificial Sequence
  Synthetic oligonucleotide; TTT chr11 5345143 5345164 5345148 5345143 -
actacatttatagtaagaagaa

SEQ ID NO: 122991 - DNA, 22 bp, Artificial Sequence
  Synthetic oligonucleotide; TTA chr11 5345142 5345163 5345147 5345142 -
ctacatttatagtaagaagaaa

SEQ ID NO: 122992 - DNA, 22 bp, Artificial Sequence
  Synthetic oligonucleotide; CTA chr11 5345139 5345160 5345144 5345139 -
catttatagtaagaagaaaaca

SEQ ID NO: 122993 - DNA, 22 bp, Artificial Sequence
  Synthetic oligonucleotide; TTT chr11 5345134 5345155 5345139 5345134 -
atagtaagaagaaaacaaaaca

SEQ ID NO: 122994 - DNA, 22 bp, Artificial Sequence
  Synthetic oligonucleotide; TTA chr11 5345133 5345154 5345138 5345133 -
tagtaagaagaaaacaaaacaa

SEQ ID NO: 122995 - DNA, 22 bp, Artificial Sequence
  Synthetic oligonucleotide; TTC chr11 5345100 5345121 5345105 5345100 -
cgtggtggtctgtaaggcccta

SEQ ID NO: 122996 - DNA, 22 bp, Artificial Sequence
  Synthetic oligonucleotide; CTG chr11 5345088 5345109 5345093 5345088 -
taaggccctatgacacttgatt

SEQ ID NO: 122997 - DNA, 22 bp, Artificial Sequence
  Synthetic oligonucleotide; CTA chr11 5345078 5345099 5345083 5345078 -
tgacacttgattactacctgct

SEQ ID NO: 122998 - DNA, 22 bp, Artificial Sequence
  Synthetic oligonucleotide; CTT chr11 5345070 5345091 5345075 5345070 -
gattactacctgcttctttgac

SEQ ID NO: 122999 - DNA, 22 bp, Artificial Sequence
  Synthetic oligonucleotide; TTG chr11 5345069 5345090 5345074 5345069 -
attactacctgcttctttgaca

SEQ ID NO: 123000 - DNA, 22 bp, Artificial Sequence
  Synthetic oligonucleotide; TTA chr11 5345065 5345086 5345070 5345065 -
ctacctgcttctttgacatcat

SEQ ID NO: 123001 - DNA, 22 bp, Artificial Sequence
  Synthetic oligonucleotide; CTA chr11 5345062 5345083 5345067 5345062 -
cctgcttctttgacatcatcta

SEQ ID NO: 123002 - DNA, 22 bp, Artificial Sequence
  Synthetic oligonucleotide; CTG chr11 5345058 5345079 5345063 5345058 -
cttctttgacatcatctattgt

SEQ ID NO: 123003 - DNA, 22 bp, Artificial Sequence
  Synthetic oligonucleotide; CTT chr11 5345055 5345076 5345060 5345055 -
ctttgacatcatctattgtccc

SEQ ID NO: 123004 - DNA, 22 bp, Artificial Sequence
  Synthetic oligonucleotide; TTC chr11 5345054 5345075 5345059 5345054 -
tttgacatcatctattgtccct

SEQ ID NO: 123005 - DNA, 22 bp, Artificial Sequence
  Synthetic oligonucleotide; CTT chr11 5345052 5345073 5345057 5345052 -
tgacatcatctattgtccctct

SEQ ID NO: 123006 - DNA, 22 bp, Artificial Sequence
  Synthetic oligonucleotide; TTT chr11 5345051 5345072 5345056 5345051 -
gacatcatctattgtccctctc

SEQ ID NO: 123007 - DNA, 22 bp, Artificial Sequence
  Synthetic oligonucleotide; TTG chr11 5345050 5345071 5345055 5345050 -
acatcatctattgtccctctcc

SEQ ID NO: 123008 - DNA, 22 bp, Artificial Sequence
  Synthetic oligonucleotide; CTA chr11 5345040 5345061 5345045 5345040 -
ttgtccctctcctgttttctta

SEQ ID NO: 123009 - DNA, 22 bp, Artificial Sequence
  Synthetic oligonucleotide; TTG chr11 5345037 5345058 5345042 5345037 -
tccctctcctgttttcttatca

SEQ ID NO: 123010 - DNA, 22 bp, Artificial Sequence
  Synthetic oligonucleotide; CTC chr11 5345031 5345052 5345036 5345031 -
tcctgttttcttatcaaatgcc

SEQ ID NO: 123011 - DNA, 22 bp, Artificial Sequence
  Synthetic oligonucleotide; CTC chr11 5345029 5345050 5345034 5345029 -
ctgttttcttatcaaatgccag

SEQ ID NO: 123012 - DNA, 22 bp, Artificial Sequence
  Synthetic oligonucleotide; CTG chr11 5345026 5345047 5345031 5345026 -
ttttcttatcaaatgccagtca

SEQ ID NO: 123013 - DNA, 22 bp, Artificial Sequence
  Synthetic oligonucleotide; TTT chr11 5345023 5345044 5345028 5345023 -
tcttatcaaatgccagtcatgc

SEQ ID NO: 123014 - DNA, 22 bp, Artificial Sequence
  Synthetic oligonucleotide; TTT chr11 5345022 5345043 5345027 5345022 -
cttatcaaatgccagtcatgct

SEQ ID NO: 123015 - DNA, 22 bp, Artificial Sequence
  Synthetic oligonucleotide; TTC chr11 5345021 5345042 5345026 5345021 -
ttatcaaatgccagtcatgctg

SEQ ID NO: 123016 - DNA, 22 bp, Artificial Sequence
  Synthetic oligonucleotide; CTT chr11 5345019 5345040 5345024 5345019 -
atcaaatgccagtcatgctgat

SEQ ID NO: 123017 - DNA, 22 bp, Artificial Sequence
  Synthetic oligonucleotide; TTA chr11 5345018 5345039 5345023 5345018 -
tcaaatgccagtcatgctgatt

SEQ ID NO: 123018 - DNA, 22 bp, Artificial Sequence
  Synthetic oligonucleotide; CTG chr11 5344999 5345020 5345004 5344999 -
attttccctctggaacagtttt

SEQ ID NO: 123019 - DNA, 22 bp, Artificial Sequence
  Synthetic oligonucleotide; TTT chr11 5344995 5345016 5345000 5344995 -
tccctctggaacagttttcctc

SEQ ID NO: 123020 - DNA, 22 bp, Artificial Sequence
  Synthetic oligonucleotide; TTT chr11 5344994 5345015 5344999 5344994 -
ccctctggaacagttttcctct

SEQ ID NO: 123021 - DNA, 22 bp, Artificial Sequence
  Synthetic oligonucleotide; TTC chr11 5344993 5345014 5344998 5344993 -
cctctggaacagttttcctcta

SEQ ID NO: 123022 - DNA, 22 bp, Artificial Sequence
  Synthetic oligonucleotide; CTC chr11 5344989 5345010 5344994 5344989 -
tggaacagttttcctctaggtc

SEQ ID NO: 123023 - DNA, 22 bp, Artificial Sequence
  Synthetic oligonucleotide; CTG chr11 5344987 5345008 5344992 5344987 -
gaacagttttcctctaggtctg

SEQ ID NO: 123024 - DNA, 22 bp, Artificial Sequence
  Synthetic oligonucleotide; TTT chr11 5344978 5344999 5344983 5344978 -
tcctctaggtctgtatacggtc

SEQ ID NO: 123025 - DNA, 22 bp, Artificial Sequence
  Synthetic oligonucleotide; TTT chr11 5344977 5344998 5344982 5344977 -
cctctaggtctgtatacggtca

SEQ ID NO: 123026 - DNA, 22 bp, Artificial Sequence
  Synthetic oligonucleotide; TTC chr11 5344976 5344997 5344981 5344976 -
ctctaggtctgtatacggtcag

SEQ ID NO: 123027 - DNA, 22 bp, Artificial Sequence
  Synthetic oligonucleotide; CTC chr11 5344973 5344994 5344978 5344973 -
taggtctgtatacggtcaggtt

SEQ ID NO: 123028 - DNA, 22 bp, Artificial Sequence
  Synthetic oligonucleotide; CTA chr11 5344971 5344992 5344976 5344971 -
ggtctgtatacggtcaggtttt

SEQ ID NO: 123029 - DNA, 22 bp, Artificial Sequence
  Synthetic oligonucleotide; CTG chr11 5344965 5344986 5344970 5344965 -
tatacggtcaggttttcttttg

SEQ ID NO: 123030 - DNA, 22 bp, Artificial Sequence
  Synthetic oligonucleotide; TTT chr11 5344950 5344971 5344955 5344950 -
tcttttgtattgaggtctcagt

SEQ ID NO: 123031 - DNA, 22 bp, Artificial Sequence
  Synthetic oligonucleotide; TTT chr11 5344949 5344970 5344954 5344949 -
cttttgtattgaggtctcagtt

SEQ ID NO: 123032 - DNA, 22 bp, Artificial Sequence
  Synthetic oligonucleotide; TTC chr11 5344948 5344969 5344953 5344948 -
ttttgtattgaggtctcagttc

SEQ ID NO: 123033 - DNA, 22 bp, Artificial Sequence
  Synthetic oligonucleotide; CTT chr11 5344946 5344967 5344951 5344946 -
ttgtattgaggtctcagttcaa

SEQ ID NO: 123034 - DNA, 22 bp, Artificial Sequence
  Synthetic oligonucleotide; TTT chr11 5344945 5344966 5344950 5344945 -
tgtattgaggtctcagttcaaa

SEQ ID NO: 123035 - DNA, 22 bp, Artificial Sequence
  Synthetic oligonucleotide; TTT chr11 5344944 5344965 5344949 5344944 -
gtattgaggtctcagttcaaat

SEQ ID NO: 123036 - DNA, 22 bp, Artificial Sequence
  Synthetic oligonucleotide; TTG chr11 5344943 5344964 5344948 5344943 -
tattgaggtctcagttcaaatg

SEQ ID NO: 123037 - DNA, 22 bp, Artificial Sequence
  Synthetic oligonucleotide; TTG chr11 5344938 5344959 5344943 5344938 -
aggtctcagttcaaatgggacc

SEQ ID NO: 123038 - DNA, 22 bp, Artificial Sequence
  Synthetic oligonucleotide; CTC chr11 5344931 5344952 5344936 5344931 -
agttcaaatgggacctcctcat

SEQ ID NO: 123039 - DNA, 22 bp, Artificial Sequence
  Synthetic oligonucleotide; TTC chr11 5344926 5344947 5344931 5344926 -
aaatgggacctcctcataggtg

SEQ ID NO: 123040 - DNA, 22 bp, Artificial Sequence
  Synthetic oligonucleotide; CTC chr11 5344914 5344935 5344919 5344914 -
ctcataggtgcagttctaggcc

SEQ ID NO: 123041 - DNA, 22 bp, Artificial Sequence
  Synthetic oligonucleotide; CTC chr11 5344911 5344932 5344916 5344911 -
ataggtgcagttctaggcccct

SEQ ID NO: 123042 - DNA, 22 bp, Artificial Sequence
  Synthetic oligonucleotide; TTC chr11 5344898 5344919 5344903 5344898 -
taggcccctcaaactgctatac

SEQ ID NO: 123043 - DNA, 22 bp, Artificial Sequence
  Synthetic oligonucleotide; CTA chr11 5344896 5344917 5344901 5344896 -
ggcccctcaaactgctatacta

SEQ ID NO: 123044 - DNA, 22 bp, Artificial Sequence
  Synthetic oligonucleotide; CTC chr11 5344888 5344909 5344893 5344888 -
aaactgctatactatcttgtat

SEQ ID NO: 123045 - DNA, 22 bp, Artificial Sequence
  Synthetic oligonucleotide; CTG chr11 5344882 5344903 5344887 5344882 -
ctatactatcttgtatacaata

SEQ ID NO: 123046 - DNA, 22 bp, Artificial Sequence
  Synthetic oligonucleotide; CTA chr11 5344879 5344900 5344884 5344879 -
tactatcttgtatacaatacca

SEQ ID NO: 123047 - DNA, 22 bp, Artificial Sequence
  Synthetic oligonucleotide; CTA chr11 5344874 5344895 5344879 5344874 -
tcttgtatacaataccatccaa

SEQ ID NO: 123048 - DNA, 22 bp, Artificial Sequence
  Synthetic oligonucleotide; CTT chr11 5344870 5344891 5344875 5344870 -
gtatacaataccatccaattaa

SEQ ID NO: 123049 - DNA, 22 bp, Artificial Sequence
  Synthetic oligonucleotide; TTG chr11 5344869 5344890 5344874 5344869 -
tatacaataccatccaattaat

SEQ ID NO: 123050 - DNA, 22 bp, Artificial Sequence
  Synthetic oligonucleotide; TTA chr11 5344849 5344870 5344854 5344849 -
atctacatcaagtagtactgtt

SEQ ID NO: 123051 - DNA, 22 bp, Artificial Sequence
  Synthetic oligonucleotide; CTA chr11 5344844 5344865 5344849 5344844 -
catcaagtagtactgttttatg

SEQ ID NO: 123052 - DNA, 22 bp, Artificial Sequence
  Synthetic oligonucleotide; CTG chr11 5344829 5344850 5344834 5344829 -
ttttatgttaaacttgcattta

SEQ ID NO: 123053 - DNA, 22 bp, Artificial Sequence
  Synthetic oligonucleotide; TTT chr11 5344826 5344847 5344831 5344826 -
tatgttaaacttgcatttatat

SEQ ID NO: 123054 - DNA, 22 bp, Artificial Sequence
  Synthetic oligonucleotide; TTT chr11 5344825 5344846 5344830 5344825 -
atgttaaacttgcatttatatt

SEQ ID NO: 123055 - DNA, 22 bp, Artificial Sequence
  Synthetic oligonucleotide; TTA chr11 5344824 5344845 5344829 5344824 -
tgttaaacttgcatttatattt

SEQ ID NO: 123056 - DNA, 22 bp, Artificial Sequence
  Synthetic oligonucleotide; TTA chr11 5344819 5344840 5344824 5344819 -
aacttgcatttatatttgttta

SEQ ID NO: 123057 - DNA, 22 bp, Artificial Sequence
  Synthetic oligonucleotide; CTT chr11 5344814 5344835 5344819 5344814 -
gcatttatatttgtttaaaatt

SEQ ID NO: 123058 - DNA, 22 bp, Artificial Sequence
  Synthetic oligonucleotide; TTG chr11 5344813 5344834 5344818 5344813 -
catttatatttgtttaaaattg

SEQ ID NO: 123059 - DNA, 22 bp, Artificial Sequence
  Synthetic oligonucleotide; TTT chr11 5344808 5344829 5344813 5344808 -
atatttgtttaaaattgtctta

SEQ ID NO: 123060 - DNA, 22 bp, Artificial Sequence
  Synthetic oligonucleotide; TTA chr11 5344807 5344828 5344812 5344807 -
tatttgtttaaaattgtcttat

SEQ ID NO: 123061 - DNA, 22 bp, Artificial Sequence
  Synthetic oligonucleotide; TTT chr11 5344802 5344823 5344807 5344802 -
gtttaaaattgtcttatttatt

SEQ ID NO: 123062 - DNA, 22 bp, Artificial Sequence
  Synthetic oligonucleotide; TTG chr11 5344801 5344822 5344806 5344801 -
tttaaaattgtcttatttattt

SEQ ID NO: 123063 - DNA, 22 bp, Artificial Sequence
  Synthetic oligonucleotide; TTT chr11 5344798 5344819 5344803 5344798 -
aaaattgtcttatttatttttc

SEQ ID NO: 123064 - DNA, 22 bp, Artificial Sequence
  Synthetic oligonucleotide; TTA chr11 5344797 5344818 5344802 5344797 -
aaattgtcttatttatttttca

SEQ ID NO: 123065 - DNA, 22 bp, Artificial Sequence
  Synthetic oligonucleotide; TTG chr11 5344791 5344812 5344796 5344791 -
tcttatttatttttcaacttaa

SEQ ID NO: 123066 - DNA, 22 bp, Artificial Sequence
  Synthetic oligonucleotide; CTT chr11 5344787 5344808 5344792 5344787 -
atttatttttcaacttaattta

SEQ ID NO: 123067 - DNA, 22 bp, Artificial Sequence
  Synthetic oligonucleotide; TTA chr11 5344786 5344807 5344791 5344786 -
tttatttttcaacttaatttat

SEQ ID NO: 123068 - DNA, 22 bp, Artificial Sequence
  Synthetic oligonucleotide; TTT chr11 5344783 5344804 5344788 5344783 -
atttttcaacttaatttatggt

SEQ ID NO: 123069 - DNA, 22 bp, Artificial Sequence
  Synthetic oligonucleotide; TTA chr11 5344782 5344803 5344787 5344782 -
tttttcaacttaatttatggtt

SEQ ID NO: 123070 - DNA, 22 bp, Artificial Sequence
  Synthetic oligonucleotide; TTT chr11 5344779 5344800 5344784 5344779 -
ttcaacttaatttatggtttat

SEQ ID NO: 123071 - DNA, 22 bp, Artificial Sequence
  Synthetic oligonucleotide; TTT chr11 5344778 5344799 5344783 5344778 -
tcaacttaatttatggtttata

SEQ ID NO: 123072 - DNA, 22 bp, Artificial Sequence
  Synthetic oligonucleotide; TTT chr11 5344777 5344798 5344782 5344777 -
caacttaatttatggtttataa

SEQ ID NO: 123073 - DNA, 22 bp, Artificial Sequence
  Synthetic oligonucleotide; TTC chr11 5344776 5344797 5344781 5344776 -
aacttaatttatggtttataag

SEQ ID NO: 123074 - DNA, 22 bp, Artificial Sequence
  Synthetic oligonucleotide; CTT chr11 5344771 5344792 5344776 5344771 -
aatttatggtttataagattag

SEQ ID NO: 123075 - DNA, 22 bp, Artificial Sequence
  Synthetic oligonucleotide; TTA chr11 5344770 5344791 5344775 5344770 -
atttatggtttataagattagg

SEQ ID NO: 123076 - DNA, 22 bp, Artificial Sequence
  Synthetic oligonucleotide; TTT chr11 5344766 5344787 5344771 5344766 -
atggtttataagattagggact

SEQ ID NO: 123077 - DNA, 22 bp, Artificial Sequence
  Synthetic oligonucleotide; TTA chr11 5344765 5344786 5344770 5344765 -
tggtttataagattagggactt

SEQ ID NO: 123078 - DNA, 22 bp, Artificial Sequence
  Synthetic oligonucleotide; TTT chr11 5344759 5344780 5344764 5344759 -
ataagattagggactttgtctt

SEQ ID NO: 123079 - DNA, 22 bp, Artificial Sequence
  Synthetic oligonucleotide; TTA chr11 5344758 5344779 5344763 5344758 -
taagattagggactttgtctta

SEQ ID NO: 123080 - DNA, 22 bp, Artificial Sequence
  Synthetic oligonucleotide; TTA chr11 5344750 5344771 5344755 5344750 -
gggactttgtcttattaccatt

SEQ ID NO: 123081 - DNA, 22 bp, Artificial Sequence
  Synthetic oligonucleotide; CTT chr11 5344743 5344764 5344748 5344743 -
tgtcttattaccatttaattcc

SEQ ID NO: 123082 - DNA, 22 bp, Artificial Sequence
  Synthetic oligonucleotide; TTT chr11 5344742 5344763 5344747 5344742 -
gtcttattaccatttaattcca

SEQ ID NO: 123083 - DNA, 22 bp, Artificial Sequence
  Synthetic oligonucleotide; TTG chr11 5344741 5344762 5344746 5344741 -
tcttattaccatttaattccag

SEQ ID NO: 123084 - DNA, 22 bp, Artificial Sequence
  Synthetic oligonucleotide; CTT chr11 5344737 5344758 5344742 5344737 -
attaccatttaattccagagag

SEQ ID NO: 123085 - DNA, 22 bp, Artificial Sequence
  Synthetic oligonucleotide; TTA chr11 5344736 5344757 5344741 5344736 -
ttaccatttaattccagagagc

SEQ ID NO: 123086 - DNA, 22 bp, Artificial Sequence
  Synthetic oligonucleotide; TTA chr11 5344733 5344754 5344738 5344733 -
ccatttaattccagagagcttt

SEQ ID NO: 123087 - DNA, 22 bp, Artificial Sequence
  Synthetic oligonucleotide; TTT chr11 5344727 5344748 5344732 5344727 -
aattccagagagctttaaatat

SEQ ID NO: 123088 - DNA, 22 bp, Artificial Sequence
  Synthetic oligonucleotide; TTA chr11 5344726 5344747 5344731 5344726 -
attccagagagctttaaatatc

SEQ ID NO: 123089 - DNA, 22 bp, Artificial Sequence
  Synthetic oligonucleotide; TTC chr11 5344722 5344743 5344727 5344722 -
cagagagctttaaatatcatgg

SEQ ID NO: 123090 - DNA, 22 bp, Artificial Sequence
  Synthetic oligonucleotide; CTT chr11 5344712 5344733 5344717 5344712 -
taaatatcatggctgtcacatg

SEQ ID NO: 123091 - DNA, 22 bp, Artificial Sequence
  Synthetic oligonucleotide; TTT chr11 5344711 5344732 5344716 5344711 -
aaatatcatggctgtcacatga

SEQ ID NO: 123092 - DNA, 22 bp, Artificial Sequence
  Synthetic oligonucleotide; TTA chr11 5344710 5344731 5344715 5344710 -
aatatcatggctgtcacatgat

SEQ ID NO: 123093 - DNA, 22 bp, Artificial Sequence
  Synthetic oligonucleotide; CTG chr11 5344697 5344718 5344702 5344697 -
tcacatgatgcgtgttcacaaa

SEQ ID NO: 123094 - DNA, 22 bp, Artificial Sequence
  Synthetic oligonucleotide; TTC chr11 5344680 5344701 5344685 5344680 -
acaaatattaggtgaactaaga

SEQ ID NO: 123095 - DNA, 22 bp, Artificial Sequence
  Synthetic oligonucleotide; TTA chr11 5344670 5344691 5344675 5344670 -
ggtgaactaagaaatgtttatc

SEQ ID NO: 123096 - DNA, 22 bp, Artificial Sequence
  Synthetic oligonucleotide; CTA chr11 5344661 5344682 5344666 5344661 -
agaaatgtttatcagtcacatg

SEQ ID NO: 123097 - DNA, 22 bp, Artificial Sequence
  Synthetic oligonucleotide; TTT chr11 5344651 5344672 5344656 5344651 -
atcagtcacatgttagatactt

SEQ ID NO: 123098 - DNA, 22 bp, Artificial Sequence
  Synthetic oligonucleotide; TTA chr11 5344650 5344671 5344655 5344650 -
tcagtcacatgttagatacttt

SEQ ID NO: 123099 - DNA, 22 bp, Artificial Sequence
  Synthetic oligonucleotide; TTA chr11 5344636 5344657 5344641 5344636 -
gatactttgcaaggtgttgagc

SEQ ID NO: 123100 - DNA, 22 bp, Artificial Sequence
  Synthetic oligonucleotide; CTT chr11 5344629 5344650 5344634 5344629 -
tgcaaggtgttgagcaaagcaa

SEQ ID NO: 123101 - DNA, 22 bp, Artificial Sequence
  Synthetic oligonucleotide; TTT chr11 5344628 5344649 5344633 5344628 -
gcaaggtgttgagcaaagcaaa

SEQ ID NO: 123102 - DNA, 22 bp, Artificial Sequence
  Synthetic oligonucleotide; TTG chr11 5344627 5344648 5344632 5344627 -
caaggtgttgagcaaagcaaat

SEQ ID NO: 123103 - DNA, 22 bp, Artificial Sequence
  Synthetic oligonucleotide; TTG chr11 5344617 5344638 5344622 5344617 -
agcaaagcaaataaacaccatg

SEQ ID NO: 123104 - DNA, 22 bp, Artificial Sequence
  Synthetic oligonucleotide; CTA chr11 5344591 5344612 5344596 5344591 -
tatgcaagaagcccctagtcta

SEQ ID NO: 123105 - DNA, 22 bp, Artificial Sequence
  Synthetic oligonucleotide; CTA chr11 5344574 5344595 5344579 5344574 -
gtctagtggcagaaggaatatt

SEQ ID NO: 123106 - DNA, 22 bp, Artificial Sequence
  Synthetic oligonucleotide; CTA chr11 5344569 5344590 5344574 5344569 -
gtggcagaaggaatattaaaac

SEQ ID NO: 123107 - DNA, 22 bp, Artificial Sequence
  Synthetic oligonucleotide; TTA chr11 5344551 5344572 5344556 5344551 -
aaaccttctcaaaggactaatc

SEQ ID NO: 123108 - DNA, 22 bp, Artificial Sequence
  Synthetic oligonucleotide; CTT chr11 5344544 5344565 5344549 5344544 -
ctcaaaggactaatctcttctc

SEQ ID NO: 123109 - DNA, 22 bp, Artificial Sequence
  Synthetic oligonucleotide; TTC chr11 5344543 5344564 5344548 5344543 -
tcaaaggactaatctcttctct

SEQ ID NO: 123110 - DNA, 22 bp, Artificial Sequence
  Synthetic oligonucleotide; CTC chr11 5344541 5344562 5344546 5344541 -
aaaggactaatctcttctcttc

SEQ ID NO: 123111 - DNA, 22 bp, Artificial Sequence
  Synthetic oligonucleotide; CTA chr11 5344532 5344553 5344537 5344532 -
atctcttctcttcagtaaaaga

SEQ ID NO: 123112 - DNA, 22 bp, Artificial Sequence
  Synthetic oligonucleotide; CTC chr11 5344527 5344548 5344532 5344527 -
ttctcttcagtaaaagacagca

SEQ ID NO: 123113 - DNA, 22 bp, Artificial Sequence
  Synthetic oligonucleotide; CTT chr11 5344525 5344546 5344530 5344525 -
ctcttcagtaaaagacagcacc

SEQ ID NO: 123114 - DNA, 22 bp, Artificial Sequence
  Synthetic oligonucleotide; TTC chr11 5344524 5344545 5344529 5344524 -
tcttcagtaaaagacagcacca

SEQ ID NO: 123115 - DNA, 22 bp, Artificial Sequence
  Synthetic oligonucleotide; CTC chr11 5344522 5344543 5344527 5344522 -
ttcagtaaaagacagcaccacg

SEQ ID NO: 123116 - DNA, 22 bp, Artificial Sequence
  Synthetic oligonucleotide; CTT chr11 5344520 5344541 5344525 5344520 -
cagtaaaagacagcaccacgtt

SEQ ID NO: 123117 - DNA, 22 bp, Artificial Sequence
  Synthetic oligonucleotide; TTC chr11 5344519 5344540 5344524 5344519 -
agtaaaagacagcaccacgttt

SEQ ID NO: 123118 - DNA, 22 bp, Artificial Sequence
  Synthetic oligonucleotide; TTT chr11 5344497 5344518 5344502 5344497 -
aagcagggaaatagctctcact

SEQ ID NO: 123119 - DNA, 22 bp, Artificial Sequence
  Synthetic oligonucleotide; TTA chr11 5344496 5344517 5344501 5344496 -
agcagggaaatagctctcactc

SEQ ID NO: 123120 - DNA, 22 bp, Artificial Sequence
  Synthetic oligonucleotide; CTC chr11 5344480 5344501 5344485 5344480 -
tcactcagtattggggagaaca

SEQ ID NO: 123121 - DNA, 22 bp, Artificial Sequence
  Synthetic oligonucleotide; CTC chr11 5344478 5344499 5344483 5344478 -
actcagtattggggagaacaga

SEQ ID NO: 123122 - DNA, 22 bp, Artificial Sequence
  Synthetic oligonucleotide; CTC chr11 5344474 5344495 5344479 5344474 -
agtattggggagaacagattca

SEQ ID NO: 123123 - DNA, 22 bp, Artificial Sequence
  Synthetic oligonucleotide; TTG chr11 5344467 5344488 5344472 5344467 -
gggagaacagattcagaagcct

SEQ ID NO: 123124 - DNA, 22 bp, Artificial Sequence
  Synthetic oligonucleotide; TTC chr11 5344453 5344474 5344458 5344453 -
agaagcctatggctggggataa

SEQ ID NO: 123125 - DNA, 22 bp, Artificial Sequence
  Synthetic oligonucleotide; CTA chr11 5344444 5344465 5344449 5344444 -
tggctggggataaagggaagga

SEQ ID NO: 123126 - DNA, 22 bp, Artificial Sequence
  Synthetic oligonucleotide; CTG chr11 5344438 5344459 5344443 5344438 -
gggataaagggaaggaaaccag

SEQ ID NO: 123127 - DNA, 22 bp, Artificial Sequence
  Synthetic oligonucleotide; TTT chr11 5344402 5344423 5344407 5344402 -
aaatataaatggagaacttgaa

SEQ ID NO: 123128 - DNA, 22 bp, Artificial Sequence
  Synthetic oligonucleotide; TTA chr11 5344401 5344422 5344406 5344401 -
aatataaatggagaacttgaaa

SEQ ID NO: 123129 - DNA, 22 bp, Artificial Sequence
  Synthetic oligonucleotide; CTT chr11 5344383 5344404 5344388 5344383 -
gaaatgagagaggtcagattct

SEQ ID NO: 123130 - DNA, 22 bp, Artificial Sequence
  Synthetic oligonucleotide; TTG chr11 5344382 5344403 5344387 5344382 -
aaatgagagaggtcagattcta

SEQ ID NO: 123131 - DNA, 22 bp, Artificial Sequence
  Synthetic oligonucleotide; TTC chr11 5344362 5344383 5344367 5344362 -
tagggaattacttcagtaggcc

SEQ ID NO: 123132 - DNA, 22 bp, Artificial Sequence
  Synthetic oligonucleotide; CTA chr11 5344360 5344381 5344365 5344360 -
gggaattacttcagtaggccta

SEQ ID NO: 123133 - DNA, 22 bp, Artificial Sequence
  Synthetic oligonucleotide; TTA chr11 5344352 5344373 5344357 5344352 -
cttcagtaggcctatagaaaaa

SEQ ID NO: 123134 - DNA, 22 bp, Artificial Sequence
  Synthetic oligonucleotide; CTT chr11 5344349 5344370 5344354 5344349 -
cagtaggcctatagaaaaataa

SEQ ID NO: 123135 - DNA, 22 bp, Artificial Sequence
  Synthetic oligonucleotide; TTC chr11 5344348 5344369 5344353 5344348 -
agtaggcctatagaaaaataat

SEQ ID NO: 123136 - DNA, 22 bp, Artificial Sequence
  Synthetic oligonucleotide; CTA chr11 5344338 5344359 5344343 5344338 -
tagaaaaataatttaaaaagaa

SEQ ID NO: 123137 - DNA, 22 bp, Artificial Sequence
  Synthetic oligonucleotide; TTT chr11 5344324 5344345 5344329 5344324 -
aaaaagaaaaagacactacttg

SEQ ID NO: 123138 - DNA, 22 bp, Artificial Sequence
  Synthetic oligonucleotide; TTA chr11 5344323 5344344 5344328 5344323 -
aaaagaaaaagacactacttgt

SEQ ID NO: 123139 - DNA, 22 bp, Artificial Sequence
  Synthetic oligonucleotide; CTA chr11 5344306 5344327 5344311 5344306 -
cttgtaaataagaaacagtaag

SEQ ID NO: 123140 - DNA, 22 bp, Artificial Sequence
  Synthetic oligonucleotide; CTT chr11 5344303 5344324 5344308 5344303 -
gtaaataagaaacagtaagatg

SEQ ID NO: 123141 - DNA, 22 bp, Artificial Sequence
  Synthetic oligonucleotide; TTG chr11 5344302 5344323 5344307 5344302 -
taaataagaaacagtaagatgt

SEQ ID NO: 123142 - DNA, 22 bp, Artificial Sequence
  Synthetic oligonucleotide; TTT chr11 5344278 5344299 5344283 5344278 -
aaactgaaggagatacactatt

SEQ ID NO: 123143 - DNA, 22 bp, Artificial Sequence
  Synthetic oligonucleotide; TTA chr11 5344277 5344298 5344282 5344277 -
aactgaaggagatacactatta

SEQ ID NO: 123144 - DNA, 22 bp, Artificial Sequence
  Synthetic oligonucleotide; CTG chr11 5344272 5344293 5344277 5344272 -
aaggagatacactattataagt

SEQ ID NO: 123145 - DNA, 22 bp, Artificial Sequence
  Synthetic oligonucleotide; CTA chr11 5344258 5344279 5344263 5344258 -
ttataagtgatgtctttggctg

SEQ ID NO: 123146 - DNA, 22 bp, Artificial Sequence
  Synthetic oligonucleotide; TTA chr11 5344255 5344276 5344260 5344255 -
taagtgatgtctttggctggcc

SEQ ID NO: 123147 - DNA, 22 bp, Artificial Sequence
  Synthetic oligonucleotide; CTT chr11 5344242 5344263 5344247 5344242 -
tggctggcctaatcatttattc

SEQ ID NO: 123148 - DNA, 22 bp, Artificial Sequence
  Synthetic oligonucleotide; TTT chr11 5344241 5344262 5344246 5344241 -
ggctggcctaatcatttattcc

SEQ ID NO: 123149 - DNA, 22 bp, Artificial Sequence
  Synthetic oligonucleotide; TTG chr11 5344240 5344261 5344245 5344240 -
gctggcctaatcatttattcca

SEQ ID NO: 123150 - DNA, 22 bp, Artificial Sequence
  Synthetic oligonucleotide; CTG chr11 5344236 5344257 5344241 5344236 -
gcctaatcatttattccagccc

SEQ ID NO: 123151 - DNA, 22 bp, Artificial Sequence
  Synthetic oligonucleotide; CTA chr11 5344231 5344252 5344236 5344231 -
atcatttattccagccccaaag

SEQ ID NO: 123152 - DNA, 22 bp, Artificial Sequence
  Synthetic oligonucleotide; TTT chr11 5344224 5344245 5344229 5344224 -
attccagccccaaagtctaact

SEQ ID NO: 123153 - DNA, 22 bp, Artificial Sequence
  Synthetic oligonucleotide; TTA chr11 5344223 5344244 5344228 5344223 -
ttccagccccaaagtctaactt

SEQ ID NO: 123154 - DNA, 22 bp, Artificial Sequence
  Synthetic oligonucleotide; TTC chr11 5344220 5344241 5344225 5344220 -
cagccccaaagtctaacttata

SEQ ID NO: 123155 - DNA, 22 bp, Artificial Sequence
  Synthetic oligonucleotide; CTA chr11 5344205 5344226 5344210 5344205 -
acttataattagactgagctat

SEQ ID NO: 123156 - DNA, 22 bp, Artificial Sequence
  Synthetic oligonucleotide; CTT chr11 5344201 5344222 5344206 5344201 -
ataattagactgagctattgtc

SEQ ID NO: 123157 - DNA, 22 bp, Artificial Sequence
  Synthetic oligonucleotide; TTA chr11 5344200 5344221 5344205 5344200 -
taattagactgagctattgtca

SEQ ID NO: 123158 - DNA, 22 bp, Artificial Sequence
  Synthetic oligonucleotide; TTA chr11 5344194 5344215 5344199 5344194 -
gactgagctattgtcacaagta

SEQ ID NO: 123159 - DNA, 22 bp, Artificial Sequence
  Synthetic oligonucleotide; CTG chr11 5344189 5344210 5344194 5344189 -
agctattgtcacaagtagtgag

SEQ ID NO: 123160 - DNA, 22 bp, Artificial Sequence
  Synthetic oligonucleotide; CTA chr11 5344184 5344205 5344189 5344184 -
ttgtcacaagtagtgagtagta

SEQ ID NO: 123161 - DNA, 22 bp, Artificial Sequence
  Synthetic oligonucleotide; TTG chr11 5344181 5344202 5344186 5344181 -
tcacaagtagtgagtagtactg

SEQ ID NO: 123162 - DNA, 22 bp, Artificial Sequence
  Synthetic oligonucleotide; CTG chr11 5344159 5344180 5344164 5344159 -
aaggattctacaagagggtaat

SEQ ID NO: 123163 - DNA, 22 bp, Artificial Sequence
  Synthetic oligonucleotide; TTC chr11 5344151 5344172 5344156 5344151 -
tacaagagggtaattcacacta

SEQ ID NO: 123164 - DNA, 22 bp, Artificial Sequence
  Synthetic oligonucleotide; CTA chr11 5344149 5344170 5344154 5344149 -
caagagggtaattcacactaat

SEQ ID NO: 123165 - DNA, 22 bp, Artificial Sequence
  Synthetic oligonucleotide; TTC chr11 5344135 5344156 5344140 5344135 -
acactaatcgtgaatgtctgtt

SEQ ID NO: 123166 - DNA, 22 bp, Artificial Sequence
  Synthetic oligonucleotide; CTA chr11 5344129 5344150 5344134 5344129 -
atcgtgaatgtctgttccccat

SEQ ID NO: 123167 - DNA, 22 bp, Artificial Sequence
  Synthetic oligonucleotide; CTG chr11 5344115 5344136 5344120 5344115 -
ttccccatcactagtccatgaa

SEQ ID NO: 123168 - DNA, 22 bp, Artificial Sequence
  Synthetic oligonucleotide; TTC chr11 5344112 5344133 5344117 5344112 -
cccatcactagtccatgaaatc

SEQ ID NO: 123169 - DNA, 22 bp, Artificial Sequence
  Synthetic oligonucleotide; CTA chr11 5344102 5344123 5344107 5344102 -
gtccatgaaatctggaggccaa

SEQ ID NO: 123170 - DNA, 22 bp, Artificial Sequence
  Synthetic oligonucleotide; CTG chr11 5344088 5344109 5344093 5344088 -
gaggccaagtgtctctttctca

SEQ ID NO: 123171 - DNA, 22 bp, Artificial Sequence
  Synthetic oligonucleotide; CTC chr11 5344073 5344094 5344078 5344073 -
tttctcaatctgactgctcctt

SEQ ID NO: 123172 - DNA, 22 bp, Artificial Sequence
  Synthetic oligonucleotide; CTT chr11 5344071 5344092 5344076 5344071 -
tctcaatctgactgctccttag

SEQ ID NO: 123173 - DNA, 22 bp, Artificial Sequence
  Synthetic oligonucleotide; TTT chr11 5344070 5344091 5344075 5344070 -
ctcaatctgactgctccttagc

SEQ ID NO: 123174 - DNA, 22 bp, Artificial Sequence
  Synthetic oligonucleotide; TTC chr11 5344069 5344090 5344074 5344069 -
tcaatctgactgctccttagct

SEQ ID NO: 123175 - DNA, 22 bp, Artificial Sequence
  Synthetic oligonucleotide; CTC chr11 5344067 5344088 5344072 5344067 -
aatctgactgctccttagctac

SEQ ID NO: 123176 - DNA, 22 bp, Artificial Sequence
  Synthetic oligonucleotide; CTG chr11 5344061 5344082 5344066 5344061 -
actgctccttagctacagtggt

SEQ ID NO: 123177 - DNA, 22 bp, Artificial Sequence
  Synthetic oligonucleotide; CTG chr11 5344057 5344078 5344062 5344057 -
ctccttagctacagtggtagtg

SEQ ID NO: 123178 - DNA, 22 bp, Artificial Sequence
  Synthetic oligonucleotide; CTC chr11 5344054 5344075 5344059 5344054 -
cttagctacagtggtagtggca

SEQ ID NO: 123179 - DNA, 22 bp, Artificial Sequence
  Synthetic oligonucleotide; CTT chr11 5344051 5344072 5344056 5344051 -
agctacagtggtagtggcagag

SEQ ID NO: 123180 - DNA, 22 bp, Artificial Sequence
  Synthetic oligonucleotide; TTA chr11 5344050 5344071 5344055 5344050 -
gctacagtggtagtggcagagt

SEQ ID NO: 123181 - DNA, 22 bp, Artificial Sequence
  Synthetic oligonucleotide; CTA chr11 5344046 5344067 5344051 5344046 -
cagtggtagtggcagagtttct

SEQ ID NO: 123182 - DNA, 22 bp, Artificial Sequence
  Synthetic oligonucleotide; TTT chr11 5344026 5344047 5344031 5344026 -
ctcttcccacacttttctttct

SEQ ID NO: 123183 - DNA, 22 bp, Artificial Sequence
  Synthetic oligonucleotide; TTC chr11 5344025 5344046 5344030 5344025 -
tcttcccacacttttctttctt

SEQ ID NO: 123184 - DNA, 22 bp, Artificial Sequence
  Synthetic oligonucleotide; CTC chr11 5344023 5344044 5344028 5344023 -
ttcccacacttttctttcttag

SEQ ID NO: 123185 - DNA, 22 bp, Artificial Sequence
  Synthetic oligonucleotide; CTT chr11 5344021 5344042 5344026 5344021 -
cccacacttttctttcttaggc

SEQ ID NO: 123186 - DNA, 22 bp, Artificial Sequence
  Synthetic oligonucleotide; TTC chr11 5344020 5344041 5344025 5344020 -
ccacacttttctttcttaggct

SEQ ID NO: 123187 - DNA, 22 bp, Artificial Sequence
  Synthetic oligonucleotide; CTT chr11 5344012 5344033 5344017 5344012 -
ttctttcttaggctgttgagac

SEQ ID NO: 123188 - DNA, 22 bp, Artificial Sequence
  Synthetic oligonucleotide; TTT chr11 5344011 5344032 5344016 5344011 -
tctttcttaggctgttgagact

SEQ ID NO: 123189 - DNA, 22 bp, Artificial Sequence
  Synthetic oligonucleotide; TTT chr11 5344010 5344031 5344015 5344010 -
ctttcttaggctgttgagactt

SEQ ID NO: 123190 - DNA, 22 bp, Artificial Sequence
  Synthetic oligonucleotide; TTC chr11 5344009 5344030 5344014 5344009 -
tttcttaggctgttgagacttt

SEQ ID NO: 123191 - DNA, 22 bp, Artificial Sequence
  Synthetic oligonucleotide; CTT chr11 5344007 5344028 5344012 5344007 -
tcttaggctgttgagactttag

SEQ ID NO: 123192 - DNA, 22 bp, Artificial Sequence
  Synthetic oligonucleotide; TTT chr11 5344006 5344027 5344011 5344006 -
cttaggctgttgagactttagc

SEQ ID NO: 123193 - DNA, 22 bp, Artificial Sequence
  Synthetic oligonucleotide; TTC chr11 5344005 5344026 5344010 5344005 -
ttaggctgttgagactttagct

SEQ ID NO: 123194 - DNA, 22 bp, Artificial Sequence
  Synthetic oligonucleotide; CTT chr11 5344003 5344024 5344008 5344003 -
aggctgttgagactttagctga

SEQ ID NO: 123195 - DNA, 22 bp, Artificial Sequence
  Synthetic oligonucleotide; TTA chr11 5344002 5344023 5344007 5344002 -
ggctgttgagactttagctgat

SEQ ID NO: 123196 - DNA, 22 bp, Artificial Sequence
  Synthetic oligonucleotide; CTG chr11 5343997 5344018 5344002 5343997 -
ttgagactttagctgataattc

SEQ ID NO: 123197 - DNA, 22 bp, Artificial Sequence
  Synthetic oligonucleotide; TTG chr11 5343994 5344015 5343999 5343994 -
agactttagctgataattcagg

SEQ ID NO: 123198 - DNA, 22 bp, Artificial Sequence
  Synthetic oligonucleotide; CTT chr11 5343988 5344009 5343993 5343988 -
tagctgataattcaggtaagtc

SEQ ID NO: 123199 - DNA, 22 bp, Artificial Sequence
  Synthetic oligonucleotide; TTT chr11 5343987 5344008 5343992 5343987 -
agctgataattcaggtaagtct

SEQ ID NO: 123200 - DNA, 22 bp, Artificial Sequence
  Synthetic oligonucleotide; TTA chr11 5343986 5344007 5343991 5343986 -
gctgataattcaggtaagtctt

SEQ ID NO: 123201 - DNA, 22 bp, Artificial Sequence
  Synthetic oligonucleotide; CTG chr11 5343982 5344003 5343987 5343982 -
ataattcaggtaagtctttaca

SEQ ID NO: 123202 - DNA, 22 bp, Artificial Sequence
  Synthetic oligonucleotide; TTC chr11 5343975 5343996 5343980 5343975 -
aggtaagtctttacatgcagga

SEQ ID NO: 123203 - DNA, 22 bp, Artificial Sequence
  Synthetic oligonucleotide; CTT chr11 5343964 5343985 5343969 5343964 -
tacatgcaggaaaatgtggatt

SEQ ID NO: 123204 - DNA, 22 bp, Artificial Sequence
  Synthetic oligonucleotide; TTT chr11 5343963 5343984 5343968 5343963 -
acatgcaggaaaatgtggatta

SEQ ID NO: 123205 - DNA, 22 bp, Artificial Sequence
  Synthetic oligonucleotide; TTA chr11 5343962 5343983 5343967 5343962 -
catgcaggaaaatgtggattag

SEQ ID NO: 123206 - DNA, 22 bp, Artificial Sequence
  Synthetic oligonucleotide; TTA chr11 5343941 5343962 5343946 5343941 -
gggatcactactgtgaaggcaa

SEQ ID NO: 123207 - DNA, 22 bp, Artificial Sequence
  Synthetic oligonucleotide; CTA chr11 5343931 5343952 5343936 5343931 -
ctgtgaaggcaattacaggttt

SEQ ID NO: 123208 - DNA, 22 bp, Artificial Sequence
  Synthetic oligonucleotide; CTG chr11 5343928 5343949 5343933 5343928 -
tgaaggcaattacaggtttagg

SEQ ID NO: 123209 - DNA, 22 bp, Artificial Sequence
  Synthetic oligonucleotide; TTA chr11 5343916 5343937 5343921 5343916 -
caggtttaggtggtagaccaga

SEQ ID NO: 123210 - DNA, 22 bp, Artificial Sequence
  Synthetic oligonucleotide; TTT chr11 5343909 5343930 5343914 5343909 -
aggtggtagaccagaaaaaaat

SEQ ID NO: 123211 - DNA, 22 bp, Artificial Sequence
  Synthetic oligonucleotide; TTA chr11 5343908 5343929 5343913 5343908 -
ggtggtagaccagaaaaaaatt

SEQ ID NO: 123212 - DNA, 22 bp, Artificial Sequence
  Synthetic oligonucleotide; TTA chr11 5343885 5343906 5343890 5343885 -
gtgttagctttctggaaatccc

SEQ ID NO: 123213 - DNA, 22 bp, Artificial Sequence
  Synthetic oligonucleotide; TTA chr11 5343879 5343900 5343884 5343879 -
gctttctggaaatccccttgaa

SEQ ID NO: 123214 - DNA, 22 bp, Artificial Sequence
  Synthetic oligonucleotide; CTT chr11 5343875 5343896 5343880 5343875 -
tctggaaatccccttgaatgcc

SEQ ID NO: 123215 - DNA, 22 bp, Artificial Sequence
  Synthetic oligonucleotide; TTT chr11 5343874 5343895 5343879 5343874 -
ctggaaatccccttgaatgccc

SEQ ID NO: 123216 - DNA, 22 bp, Artificial Sequence
  Synthetic oligonucleotide; TTC chr11 5343873 5343894 5343878 5343873 -
tggaaatccccttgaatgcccc

SEQ ID NO: 123217 - DNA, 22 bp, Artificial Sequence
  Synthetic oligonucleotide; CTG chr11 5343871 5343892 5343876 5343871 -
gaaatccccttgaatgccccat

SEQ ID NO: 123218 - DNA, 22 bp, Artificial Sequence
  Synthetic oligonucleotide; CTT chr11 5343860 5343881 5343865 5343860 -
gaatgccccatagaatacgaat

SEQ ID NO: 123219 - DNA, 22 bp, Artificial Sequence
  Synthetic oligonucleotide; TTG chr11 5343859 5343880 5343864 5343859 -
aatgccccatagaatacgaatt

SEQ ID NO: 123220 - DNA, 22 bp, Artificial Sequence
  Synthetic oligonucleotide; TTC chr11 5343836 5343857 5343841 5343836 -
tttaaaatctgcatagttaagg

SEQ ID NO: 123221 - DNA, 22 bp, Artificial Sequence
  Synthetic oligonucleotide; CTT chr11 5343834 5343855 5343839 5343834 -
taaaatctgcatagttaagggt

SEQ ID NO: 123222 - DNA, 22 bp, Artificial Sequence
  Synthetic oligonucleotide; TTT chr11 5343833 5343854 5343838 5343833 -
aaaatctgcatagttaagggta

SEQ ID NO: 123223 - DNA, 22 bp, Artificial Sequence
  Synthetic oligonucleotide; TTA chr11 5343832 5343853 5343837 5343832 -
aaatctgcatagttaagggtaa

SEQ ID NO: 123224 - DNA, 22 bp, Artificial Sequence
  Synthetic oligonucleotide; CTG chr11 5343825 5343846 5343830 5343825 -
catagttaagggtaacagttta

SEQ ID NO: 123225 - DNA, 22 bp, Artificial Sequence
  Synthetic oligonucleotide; TTA chr11 5343817 5343838 5343822 5343817 -
agggtaacagtttagaagttgt

SEQ ID NO: 123226 - DNA, 22 bp, Artificial Sequence
  Synthetic oligonucleotide; TTT chr11 5343804 5343825 5343809 5343804 -
agaagttgtagtttacataatt

SEQ ID NO: 123227 - DNA, 22 bp, Artificial Sequence
  Synthetic oligonucleotide; TTA chr11 5343803 5343824 5343808 5343803 -
gaagttgtagtttacataattt

SEQ ID NO: 123228 - DNA, 22 bp, Artificial Sequence
  Synthetic oligonucleotide; TTG chr11 5343796 5343817 5343801 5343796 -
tagtttacataattttttttct

SEQ ID NO: 123229 - DNA, 22 bp, Artificial Sequence
  Synthetic oligonucleotide; TTT chr11 5343790 5343811 5343795 5343790 -
acataattttttttctgaagag

SEQ ID NO: 123230 - DNA, 22 bp, Artificial Sequence
  Synthetic oligonucleotide; TTA chr11 5343789 5343810 5343794 5343789 -
cataattttttttctgaagaga

SEQ ID NO: 123231 - DNA, 22 bp, Artificial Sequence
  Synthetic oligonucleotide; TTT chr11 5343781 5343802 5343786 5343781 -
tttttctgaagagaatgcttaa

SEQ ID NO: 123232 - DNA, 22 bp, Artificial Sequence
  Synthetic oligonucleotide; TTT chr11 5343780 5343801 5343785 5343780 -
ttttctgaagagaatgcttaaa

SEQ ID NO: 123233 - DNA, 22 bp, Artificial Sequence
  Synthetic oligonucleotide; TTT chr11 5343779 5343800 5343784 5343779 -
tttctgaagagaatgcttaaat

SEQ ID NO: 123234 - DNA, 22 bp, Artificial Sequence
  Synthetic oligonucleotide; TTT chr11 5343778 5343799 5343783 5343778 -
ttctgaagagaatgcttaaatg

SEQ ID NO: 123235 - DNA, 22 bp, Artificial Sequence
  Synthetic oligonucleotide; TTT chr11 5343777 5343798 5343782 5343777 -
tctgaagagaatgcttaaatgc

SEQ ID NO: 123236 - DNA, 22 bp, Artificial Sequence
  Synthetic oligonucleotide; TTT chr11 5343776 5343797 5343781 5343776 -
ctgaagagaatgcttaaatgca

SEQ ID NO: 123237 - DNA, 22 bp, Artificial Sequence
  Synthetic oligonucleotide; TTC chr11 5343775 5343796 5343780 5343775 -
tgaagagaatgcttaaatgcat

SEQ ID NO: 123238 - DNA, 22 bp, Artificial Sequence
  Synthetic oligonucleotide; CTG chr11 5343773 5343794 5343778 5343773 -
aagagaatgcttaaatgcatat

SEQ ID NO: 123239 - DNA, 22 bp, Artificial Sequence
  Synthetic oligonucleotide; CTT chr11 5343761 5343782 5343766 5343761 -
aaatgcatataaacagttgaaa

SEQ ID NO: 123240 - DNA, 22 bp, Artificial Sequence
  Synthetic oligonucleotide; TTA chr11 5343760 5343781 5343765 5343760 -
aatgcatataaacagttgaaac

SEQ ID NO: 123241 - DNA, 22 bp, Artificial Sequence
  Synthetic oligonucleotide; TTG chr11 5343742 5343763 5343747 5343742 -
aaactccaagaatttgattacg

SEQ ID NO: 123242 - DNA, 22 bp, Artificial Sequence
  Synthetic oligonucleotide; CTC chr11 5343736 5343757 5343741 5343736 -
caagaatttgattacgtaggta

SEQ ID NO: 123243 - DNA, 22 bp, Artificial Sequence
  Synthetic oligonucleotide; TTT chr11 5343727 5343748 5343732 5343727 -
gattacgtaggtaggagataga

SEQ ID NO: 123244 - DNA, 22 bp, Artificial Sequence
  Synthetic oligonucleotide; TTG chr11 5343726 5343747 5343731 5343726 -
attacgtaggtaggagatagat

SEQ ID NO: 123245 - DNA, 22 bp, Artificial Sequence
  Synthetic oligonucleotide; TTA chr11 5343722 5343743 5343727 5343722 -
cgtaggtaggagatagatcctg

SEQ ID NO: 123246 - DNA, 22 bp, Artificial Sequence
  Synthetic oligonucleotide; CTG chr11 5343700 5343721 5343705 5343700 -
gaatgtgcagttaagaatacaa

SEQ ID NO: 123247 - DNA, 22 bp, Artificial Sequence
  Synthetic oligonucleotide; TTA chr11 5343687 5343708 5343692 5343687 -
agaatacaaatagtatgagtaa

SEQ ID NO: 123248 - DNA, 22 bp, Artificial Sequence
  Synthetic oligonucleotide; CTG chr11 5343660 5343681 5343665 5343660 -
agaatgtattttgagaaacaat

SEQ ID NO: 123249 - DNA, 22 bp, Artificial Sequence
  Synthetic oligonucleotide; TTT chr11 5343649 5343670 5343654 5343649 -
tgagaaacaatcacttatattg

SEQ ID NO: 123250 - DNA, 22 bp, Artificial Sequence
  Synthetic oligonucleotide; TTT chr11 5343648 5343669 5343653 5343648 -
gagaaacaatcacttatattga

SEQ ID NO: 123251 - DNA, 22 bp, Artificial Sequence
  Synthetic oligonucleotide; TTG chr11 5343647 5343668 5343652 5343647 -
agaaacaatcacttatattgat

SEQ ID NO: 123252 - DNA, 22 bp, Artificial Sequence
  Synthetic oligonucleotide; CTT chr11 5343633 5343654 5343638 5343633 -
atattgatgtcattattatctt

SEQ ID NO: 123253 - DNA, 22 bp, Artificial Sequence
  Synthetic oligonucleotide; TTA chr11 5343632 5343653 5343637 5343632 -
tattgatgtcattattatcttt

SEQ ID NO: 123254 - DNA, 22 bp, Artificial Sequence
  Synthetic oligonucleotide; TTG chr11 5343627 5343648 5343632 5343627 -
atgtcattattatctttaggaa

SEQ ID NO: 123255 - DNA, 22 bp, Artificial Sequence
  Synthetic oligonucleotide; TTA chr11 5343618 5343639 5343623 5343618 -
ttatctttaggaaaaaattctg

SEQ ID NO: 123256 - DNA, 22 bp, Artificial Sequence
  Synthetic oligonucleotide; TTA chr11 5343615 5343636 5343620 5343615 -
tctttaggaaaaaattctgaga

SEQ ID NO: 123257 - DNA, 22 bp, Artificial Sequence
  Synthetic oligonucleotide; CTT chr11 5343611 5343632 5343616 5343611 -
taggaaaaaattctgagaatga

SEQ ID NO: 123258 - DNA, 22 bp, Artificial Sequence
  Synthetic oligonucleotide; TTT chr11 5343610 5343631 5343615 5343610 -
aggaaaaaattctgagaatgat

SEQ ID NO: 123259 - DNA, 22 bp, Artificial Sequence
  Synthetic oligonucleotide; TTA chr11 5343609 5343630 5343614 5343609 -
ggaaaaaattctgagaatgata

SEQ ID NO: 123260 - DNA, 22 bp, Artificial Sequence
  Synthetic oligonucleotide; TTC chr11 5343598 5343619 5343603 5343598 -
tgagaatgatatagtcgaagtg

SEQ ID NO: 123261 - DNA, 22 bp, Artificial Sequence
  Synthetic oligonucleotide; CTG chr11 5343596 5343617 5343601 5343596 -
agaatgatatagtcgaagtgat

SEQ ID NO: 123262 - DNA, 22 bp, Artificial Sequence
  Synthetic oligonucleotide; CTT chr11 5343569 5343590 5343574 5343569 -
gaaggtagaactgtgcactgtg

SEQ ID NO: 123263 - DNA, 22 bp, Artificial Sequence
  Synthetic oligonucleotide; TTG chr11 5343568 5343589 5343573 5343568 -
aaggtagaactgtgcactgtgg

SEQ ID NO: 123264 - DNA, 22 bp, Artificial Sequence
  Synthetic oligonucleotide; CTG chr11 5343556 5343577 5343561 5343556 -
tgcactgtggtaataacagaaa

SEQ ID NO: 123265 - DNA, 22 bp, Artificial Sequence
  Synthetic oligonucleotide; CTG chr11 5343549 5343570 5343554 5343549 -
tggtaataacagaaacagaaag

SEQ ID NO: 123266 - DNA, 22 bp, Artificial Sequence
  Synthetic oligonucleotide; TTT chr11 5343521 5343542 5343526 5343521 -
cttctatataaacccaggatgt

SEQ ID NO: 123267 - DNA, 22 bp, Artificial Sequence
  Synthetic oligonucleotide; TTC chr11 5343520 5343541 5343525 5343520 -
ttctatataaacccaggatgtc

SEQ ID NO: 123268 - DNA, 22 bp, Artificial Sequence
  Synthetic oligonucleotide; CTT chr11 5343518 5343539 5343523 5343518 -
ctatataaacccaggatgtcgt

SEQ ID NO: 123269 - DNA, 22 bp, Artificial Sequence
  Synthetic oligonucleotide; TTC chr11 5343517 5343538 5343522 5343517 -
tatataaacccaggatgtcgtc

SEQ ID NO: 123270 - DNA, 22 bp, Artificial Sequence
  Synthetic oligonucleotide; CTA chr11 5343515 5343536 5343520 5343515 -
tataaacccaggatgtcgtcca

SEQ ID NO: 123271 - DNA, 22 bp, Artificial Sequence
  Synthetic oligonucleotide; CTC chr11 5343483 5343504 5343488 5343483 -
ccatcccttcctattgactggt

SEQ ID NO: 123272 - DNA, 22 bp, Artificial Sequence
  Synthetic oligonucleotide; CTT chr11 5343474 5343495 5343479 5343474 -
cctattgactggttttccaggc

SEQ ID NO: 123273 - DNA, 22 bp, Artificial Sequence
  Synthetic oligonucleotide; TTC chr11 5343473 5343494 5343478 5343473 -
ctattgactggttttccaggct

SEQ ID NO: 123274 - DNA, 22 bp, Artificial Sequence
  Synthetic oligonucleotide; CTA chr11 5343470 5343491 5343475 5343470 -
ttgactggttttccaggcttgg

SEQ ID NO: 123275 - DNA, 22 bp, Artificial Sequence
  Synthetic oligonucleotide; TTG chr11 5343467 5343488 5343472 5343467 -
actggttttccaggcttggagg

SEQ ID NO: 123276 - DNA, 22 bp, Artificial Sequence
  Synthetic oligonucleotide; CTG chr11 5343463 5343484 5343468 5343463 -
gttttccaggcttggaggaagc

SEQ ID NO: 123277 - DNA, 22 bp, Artificial Sequence
  Synthetic oligonucleotide; TTT chr11 5343459 5343480 5343464 5343459 -
tccaggcttggaggaagctcat

SEQ ID NO: 123278 - DNA, 22 bp, Artificial Sequence
  Synthetic oligonucleotide; TTT chr11 5343458 5343479 5343463 5343458 -
ccaggcttggaggaagctcatc

SEQ ID NO: 123279 - DNA, 22 bp, Artificial Sequence
  Synthetic oligonucleotide; TTC chr11 5343457 5343478 5343462 5343457 -
caggcttggaggaagctcatca

SEQ ID NO: 123280 - DNA, 22 bp, Artificial Sequence
  Synthetic oligonucleotide; CTT chr11 5343450 5343471 5343455 5343450 -
ggaggaagctcatcactggatt

SEQ ID NO: 123281 - DNA, 22 bp, Artificial Sequence
  Synthetic oligonucleotide; TTG chr11 5343449 5343470 5343454 5343449 -
gaggaagctcatcactggattt

SEQ ID NO: 123282 - DNA, 22 bp, Artificial Sequence
  Synthetic oligonucleotide; CTC chr11 5343439 5343460 5343444 5343439 -
atcactggatttccgtattttt

SEQ ID NO: 123283 - DNA, 22 bp, Artificial Sequence
  Synthetic oligonucleotide; CTG chr11 5343432 5343453 5343437 5343432 -
gatttccgtatttttcttgttc

SEQ ID NO: 123284 - DNA, 22 bp, Artificial Sequence
  Synthetic oligonucleotide; TTT chr11 5343427 5343448 5343432 5343427 -
ccgtatttttcttgttcatgta

SEQ ID NO: 123285 - DNA, 22 bp, Artificial Sequence
  Synthetic oligonucleotide; TTC chr11 5343426 5343447 5343431 5343426 -
cgtatttttcttgttcatgtat

SEQ ID NO: 123286 - DNA, 22 bp, Artificial Sequence
  Synthetic oligonucleotide; TTT chr11 5343419 5343440 5343424 5343419 -
ttcttgttcatgtatatatcca

SEQ ID NO: 123287 - DNA, 22 bp, Artificial Sequence
  Synthetic oligonucleotide; TTT chr11 5343418 5343439 5343423 5343418 -
tcttgttcatgtatatatccat

SEQ ID NO: 123288 - DNA, 22 bp, Artificial Sequence
  Synthetic oligonucleotide; TTT chr11 5343417 5343438 5343422 5343417 -
cttgttcatgtatatatccatc

SEQ ID NO: 123289 - DNA, 22 bp, Artificial Sequence
  Synthetic oligonucleotide; TTC chr11 5343416 5343437 5343421 5343416 -
ttgttcatgtatatatccatcc

SEQ ID NO: 123290 - DNA, 22 bp, Artificial Sequence
  Synthetic oligonucleotide; CTT chr11 5343414 5343435 5343419 5343414 -
gttcatgtatatatccatcctt

SEQ ID NO: 123291 - DNA, 22 bp, Artificial Sequence
  Synthetic oligonucleotide; TTG chr11 5343413 5343434 5343418 5343413 -
ttcatgtatatatccatccttt

SEQ ID NO: 123292 - DNA, 22 bp, Artificial Sequence
  Synthetic oligonucleotide; TTC chr11 5343410 5343431 5343415 5343410 -
atgtatatatccatcctttttg

SEQ ID NO: 123293 - DNA, 22 bp, Artificial Sequence
  Synthetic oligonucleotide; CTT chr11 5343392 5343413 5343397 5343392 -
tttggcaatggcaccctccttc

SEQ ID NO: 123294 - DNA, 22 bp, Artificial Sequence
  Synthetic oligonucleotide; TTT chr11 5343391 5343412 5343396 5343391 -
ttggcaatggcaccctccttct

SEQ ID NO: 123295 - DNA, 22 bp, Artificial Sequence
  Synthetic oligonucleotide; TTT chr11 5343390 5343411 5343395 5343390 -
tggcaatggcaccctccttctt

SEQ ID NO: 123296 - DNA, 22 bp, Artificial Sequence
  Synthetic oligonucleotide; TTT chr11 5343389 5343410 5343394 5343389 -
ggcaatggcaccctccttcttc

SEQ ID NO: 123297 - DNA, 22 bp, Artificial Sequence
  Synthetic oligonucleotide; TTG chr11 5343388 5343409 5343393 5343388 -
gcaatggcaccctccttcttct

SEQ ID NO: 123298 - DNA, 22 bp, Artificial Sequence
  Synthetic oligonucleotide; CTC chr11 5343374 5343395 5343379 5343374 -
cttcttctcattaaggaagatc

SEQ ID NO: 123299 - DNA, 22 bp, Artificial Sequence
  Synthetic oligonucleotide; CTT chr11 5343371 5343392 5343376 5343371 -
cttctcattaaggaagatcaca

SEQ ID NO: 123300 - DNA, 22 bp, Artificial Sequence
  Synthetic oligonucleotide; TTC chr11 5343370 5343391 5343375 5343370 -
ttctcattaaggaagatcacaa

SEQ ID NO: 123301 - DNA, 22 bp, Artificial Sequence
  Synthetic oligonucleotide; CTT chr11 5343368 5343389 5343373 5343368 -
ctcattaaggaagatcacaatc

SEQ ID NO: 123302 - DNA, 22 bp, Artificial Sequence
  Synthetic oligonucleotide; TTC chr11 5343367 5343388 5343372 5343367 -
tcattaaggaagatcacaatct

SEQ ID NO: 123303 - DNA, 22 bp, Artificial Sequence
  Synthetic oligonucleotide; CTC chr11 5343365 5343386 5343370 5343365 -
attaaggaagatcacaatcttc

SEQ ID NO: 123304 - DNA, 22 bp, Artificial Sequence
  Synthetic oligonucleotide; TTA chr11 5343361 5343382 5343366 5343361 -
aggaagatcacaatcttcatga

SEQ ID NO: 123305 - DNA, 22 bp, Artificial Sequence
  Synthetic oligonucleotide; CTT chr11 5343344 5343365 5343349 5343344 -
catgagcccatgtacttctttc

SEQ ID NO: 123306 - DNA, 22 bp, Artificial Sequence
  Synthetic oligonucleotide; TTC chr11 5343343 5343364 5343348 5343343 -
atgagcccatgtacttctttct

SEQ ID NO: 123307 - DNA, 22 bp, Artificial Sequence
  Synthetic oligonucleotide; CTT chr11 5343327 5343348 5343332 5343327 -
ctttctggccatgctggctgcc

SEQ ID NO: 123308 - DNA, 22 bp, Artificial Sequence
  Synthetic oligonucleotide; TTC chr11 5343326 5343347 5343331 5343326 -
tttctggccatgctggctgcca

SEQ ID NO: 123309 - DNA, 22 bp, Artificial Sequence
  Synthetic oligonucleotide; CTT chr11 5343324 5343345 5343329 5343324 -
tctggccatgctggctgccaca

SEQ ID NO: 123310 - DNA, 22 bp, Artificial Sequence
  Synthetic oligonucleotide; TTT chr11 5343323 5343344 5343328 5343323 -
ctggccatgctggctgccacag

SEQ ID NO: 123311 - DNA, 22 bp, Artificial Sequence
  Synthetic oligonucleotide; TTC chr11 5343322 5343343 5343327 5343322 -
tggccatgctggctgccacaga

SEQ ID NO: 123312 - DNA, 22 bp, Artificial Sequence
  Synthetic oligonucleotide; CTG chr11 5343320 5343341 5343325 5343320 -
gccatgctggctgccacagacc

SEQ ID NO: 123313 - DNA, 22 bp, Artificial Sequence
  Synthetic oligonucleotide; CTG chr11 5343311 5343332 5343316 5343311 -
gctgccacagacctggggctgg

SEQ ID NO: 123314 - DNA, 22 bp, Artificial Sequence
  Synthetic oligonucleotide; CTG chr11 5343307 5343328 5343312 5343307 -
ccacagacctggggctggccct

SEQ ID NO: 123315 - DNA, 22 bp, Artificial Sequence
  Synthetic oligonucleotide; CTG chr11 5343296 5343317 5343301 5343296 -
gggctggccctgaccacaatgc

SEQ ID NO: 123316 - DNA, 22 bp, Artificial Sequence
  Synthetic oligonucleotide; CTG chr11 5343290 5343311 5343295 5343290 -
gccctgaccacaatgcccacgg

SEQ ID NO: 123317 - DNA, 22 bp, Artificial Sequence
  Synthetic oligonucleotide; CTG chr11 5343284 5343305 5343289 5343284 -
accacaatgcccacggtgctgg

SEQ ID NO: 123318 - DNA, 22 bp, Artificial Sequence
  Synthetic oligonucleotide; CTG chr11 5343263 5343284 5343268 5343263 -
ggagtcctctggctggatcaca

SEQ ID NO: 123319 - DNA, 22 bp, Artificial Sequence
  Synthetic oligonucleotide; CTC chr11 5343254 5343275 5343259 5343254 -
tggctggatcacagggagattg

SEQ ID NO: 123320 - DNA, 22 bp, Artificial Sequence
  Synthetic oligonucleotide; CTG chr11 5343252 5343273 5343257 5343252 -
gctggatcacagggagattgga

SEQ ID NO: 123321 - DNA, 22 bp, Artificial Sequence
  Synthetic oligonucleotide; CTG chr11 5343248 5343269 5343253 5343248 -
gatcacagggagattggaagtg

SEQ ID NO: 123322 - DNA, 22 bp, Artificial Sequence
  Synthetic oligonucleotide; TTG chr11 5343232 5343253 5343237 5343232 -
gaagtgcggcctgcttttccca

SEQ ID NO: 123323 - DNA, 22 bp, Artificial Sequence
  Synthetic oligonucleotide; CTG chr11 5343219 5343240 5343224 5343219 -
cttttcccaggcctactttata

SEQ ID NO: 123324 - DNA, 22 bp, Artificial Sequence
  Synthetic oligonucleotide; CTT chr11 5343216 5343237 5343221 5343216 -
ttcccaggcctactttatacac

SEQ ID NO: 123325 - DNA, 22 bp, Artificial Sequence
  Synthetic oligonucleotide; TTT chr11 5343215 5343236 5343220 5343215 -
tcccaggcctactttatacact

SEQ ID NO: 123326 - DNA, 22 bp, Artificial Sequence
  Synthetic oligonucleotide; TTT chr11 5343214 5343235 5343219 5343214 -
cccaggcctactttatacactc

SEQ ID NO: 123327 - DNA, 22 bp, Artificial Sequence
  Synthetic oligonucleotide; TTC chr11 5343213 5343234 5343218 5343213 -
ccaggcctactttatacactca

SEQ ID NO: 123328 - DNA, 22 bp, Artificial Sequence
  Synthetic oligonucleotide; CTA chr11 5343204 5343225 5343209 5343204 -
ctttatacactcactttccttt

SEQ ID NO: 123329 - DNA, 22 bp, Artificial Sequence
  Synthetic oligonucleotide; CTT chr11 5343201 5343222 5343206 5343201 -
tatacactcactttcctttctc

SEQ ID NO: 123330 - DNA, 22 bp, Artificial Sequence
  Synthetic oligonucleotide; TTT chr11 5343200 5343221 5343205 5343200 -
atacactcactttcctttctcg

SEQ ID NO: 123331 - DNA, 22 bp, Artificial Sequence
  Synthetic oligonucleotide; TTA chr11 5343199 5343220 5343204 5343199 -
tacactcactttcctttctcga

SEQ ID NO: 123332 - DNA, 22 bp, Artificial Sequence
  Synthetic oligonucleotide; CTC chr11 5343192 5343213 5343197 5343192 -
actttcctttctcgagtctggc

SEQ ID NO: 123333 - DNA, 22 bp, Artificial Sequence
  Synthetic oligonucleotide; CTT chr11 5343188 5343209 5343193 5343188 -
tcctttctcgagtctggcattc

SEQ ID NO: 123334 - DNA, 22 bp, Artificial Sequence
  Synthetic oligonucleotide; TTT chr11 5343187 5343208 5343192 5343187 -
cctttctcgagtctggcattct

SEQ ID NO: 123335 - DNA, 22 bp, Artificial Sequence
  Synthetic oligonucleotide; TTC chr11 5343186 5343207 5343191 5343186 -
ctttctcgagtctggcattctg

SEQ ID NO: 123336 - DNA, 22 bp, Artificial Sequence
  Synthetic oligonucleotide; CTT chr11 5343183 5343204 5343188 5343183 -
tctcgagtctggcattctgctt

SEQ ID NO: 123337 - DNA, 22 bp, Artificial Sequence
  Synthetic oligonucleotide; TTT chr11 5343182 5343203 5343187 5343182 -
ctcgagtctggcattctgcttg

SEQ ID NO: 123338 - DNA, 22 bp, Artificial Sequence
  Synthetic oligonucleotide; TTC chr11 5343181 5343202 5343186 5343181 -
tcgagtctggcattctgcttgc

SEQ ID NO: 123339 - DNA, 22 bp, Artificial Sequence
  Synthetic oligonucleotide; CTC chr11 5343179 5343200 5343184 5343179 -
gagtctggcattctgcttgcca

SEQ ID NO: 123340 - DNA, 22 bp, Artificial Sequence
  Synthetic oligonucleotide; CTG chr11 5343172 5343193 5343177 5343172 -
gcattctgcttgccatggccta

SEQ ID NO: 123341 - DNA, 22 bp, Artificial Sequence
  Synthetic oligonucleotide; TTC chr11 5343166 5343187 5343171 5343166 -
tgcttgccatggcctatgaccg

SEQ ID NO: 123342 - DNA, 22 bp, Artificial Sequence
  Synthetic oligonucleotide; CTG chr11 5343164 5343185 5343169 5343164 -
cttgccatggcctatgaccgtt

SEQ ID NO: 123343 - DNA, 22 bp, Artificial Sequence
  Synthetic oligonucleotide; CTT chr11 5343161 5343182 5343166 5343161 -
gccatggcctatgaccgtttta

SEQ ID NO: 123344 - DNA, 22 bp, Artificial Sequence
  Synthetic oligonucleotide; TTG chr11 5343160 5343181 5343165 5343160 -
ccatggcctatgaccgttttat

SEQ ID NO: 123345 - DNA, 22 bp, Artificial Sequence
  Synthetic oligonucleotide; CTA chr11 5343150 5343171 5343155 5343150 -
tgaccgttttattgccatctgc

SEQ ID NO: 123346 - DNA, 22 bp, Artificial Sequence
  Synthetic oligonucleotide; TTT chr11 5343141 5343162 5343146 5343141 -
tattgccatctgcaaccctctt

SEQ ID NO: 123347 - DNA, 22 bp, Artificial Sequence
  Synthetic oligonucleotide; TTT chr11 5343140 5343161 5343145 5343140 -
attgccatctgcaaccctctta

SEQ ID NO: 123348 - DNA, 22 bp, Artificial Sequence
  Synthetic oligonucleotide; TTA chr11 5343139 5343160 5343144 5343139 -
ttgccatctgcaaccctcttag

SEQ ID NO: 123349 - DNA, 22 bp, Artificial Sequence
  Synthetic oligonucleotide; TTG chr11 5343136 5343157 5343141 5343136 -
ccatctgcaaccctcttagata

SEQ ID NO: 123350 - DNA, 22 bp, Artificial Sequence
  Synthetic oligonucleotide; CTG chr11 5343129 5343150 5343134 5343129 -
caaccctcttagatatacctct

SEQ ID NO: 123351 - DNA, 22 bp, Artificial Sequence
  Synthetic oligonucleotide; CTC chr11 5343121 5343142 5343126 5343121 -
ttagatatacctctgtacttac

SEQ ID NO: 123352 - DNA, 22 bp, Artificial Sequence
  Synthetic oligonucleotide; CTT chr11 5343119 5343140 5343124 5343119 -
agatatacctctgtacttacta

SEQ ID NO: 123353 - DNA, 22 bp, Artificial Sequence
  Synthetic oligonucleotide; TTA chr11 5343118 5343139 5343123 5343118 -
gatatacctctgtacttactaa

SEQ ID NO: 123354 - DNA, 22 bp, Artificial Sequence
  Synthetic oligonucleotide; CTC chr11 5343108 5343129 5343113 5343108 -
tgtacttactaatactcgagta

SEQ ID NO: 123355 - DNA, 22 bp, Artificial Sequence
  Synthetic oligonucleotide; CTG chr11 5343106 5343127 5343111 5343106 -
tacttactaatactcgagtagt

SEQ ID NO: 123356 - DNA, 22 bp, Artificial Sequence
  Synthetic oligonucleotide; CTT chr11 5343101 5343122 5343106 5343101 -
actaatactcgagtagtgaaga

SEQ ID NO: 123357 - DNA, 22 bp, Artificial Sequence
  Synthetic oligonucleotide; TTA chr11 5343100 5343121 5343105 5343100 -
ctaatactcgagtagtgaagat

SEQ ID NO: 123358 - DNA, 22 bp, Artificial Sequence
  Synthetic oligonucleotide; CTA chr11 5343097 5343118 5343102 5343097 -
atactcgagtagtgaagattgg

SEQ ID NO: 123359 - DNA, 22 bp, Artificial Sequence
  Synthetic oligonucleotide; CTC chr11 5343091 5343112 5343096 5343091 -
gagtagtgaagattgggctggg

SEQ ID NO: 123360 - DNA, 22 bp, Artificial Sequence
  Synthetic oligonucleotide; TTG chr11 5343076 5343097 5343081 5343076 -
ggctgggagttctgatgagggg

SEQ ID NO: 123361 - DNA, 22 bp, Artificial Sequence
  Synthetic oligonucleotide; CTG chr11 5343071 5343092 5343076 5343071 -
ggagttctgatgaggggatttg

SEQ ID NO: 123362 - DNA, 22 bp, Artificial Sequence
  Synthetic oligonucleotide; TTC chr11 5343064 5343085 5343069 5343064 -
tgatgaggggatttgtatccgt

SEQ ID NO: 123363 - DNA, 22 bp, Artificial Sequence
  Synthetic oligonucleotide; CTG chr11 5343062 5343083 5343067 5343062 -
atgaggggatttgtatccgttg

SEQ ID NO: 123364 - DNA, 22 bp, Artificial Sequence
  Synthetic oligonucleotide; TTT chr11 5343050 5343071 5343055 5343050 -
gtatccgttgttcccccaatca

SEQ ID NO: 123365 - DNA, 22 bp, Artificial Sequence
  Synthetic oligonucleotide; TTG chr11 5343049 5343070 5343054 5343049 -
tatccgttgttcccccaatcag

SEQ ID NO: 123366 - DNA, 22 bp, Artificial Sequence
  Synthetic oligonucleotide; TTG chr11 5343040 5343061 5343045 5343040 -
ttcccccaatcaggcccctcta

SEQ ID NO: 123367 - DNA, 22 bp, Artificial Sequence
  Synthetic oligonucleotide; TTC chr11 5343037 5343058 5343042 5343037 -
ccccaatcaggcccctctattt

SEQ ID NO: 123368 - DNA, 22 bp, Artificial Sequence
  Synthetic oligonucleotide; CTC chr11 5343020 5343041 5343025 5343020 -
tatttttttctgtattgtcact

SEQ ID NO: 123369 - DNA, 22 bp, Artificial Sequence
  Synthetic oligonucleotide; CTA chr11 5343018 5343039 5343023 5343018 -
tttttttctgtattgtcactcc

SEQ ID NO: 123370 - DNA, 22 bp, Artificial Sequence
  Synthetic oligonucleotide; TTT chr11 5343015 5343036 5343020 5343015 -
ttttctgtattgtcactcccat

SEQ ID NO: 123371 - DNA, 22 bp, Artificial Sequence
  Synthetic oligonucleotide; TTT chr11 5343014 5343035 5343019 5343014 -
tttctgtattgtcactcccatg

SEQ ID NO: 123372 - DNA, 22 bp, Artificial Sequence
  Synthetic oligonucleotide; TTT chr11 5343013 5343034 5343018 5343013 -
ttctgtattgtcactcccatgt

SEQ ID NO: 123373 - DNA, 22 bp, Artificial Sequence
  Synthetic oligonucleotide; TTT chr11 5343012 5343033 5343017 5343012 -
tctgtattgtcactcccatgtt

SEQ ID NO: 123374 - DNA, 22 bp, Artificial Sequence
  Synthetic oligonucleotide; TTT chr11 5343011 5343032 5343016 5343011 -
ctgtattgtcactcccatgttc

SEQ ID NO: 123375 - DNA, 22 bp, Artificial Sequence
  Synthetic oligonucleotide; TTC chr11 5343010 5343031 5343015 5343010 -
tgtattgtcactcccatgttct

SEQ ID NO: 123376 - DNA, 22 bp, Artificial Sequence
  Synthetic oligonucleotide; CTG chr11 5343008 5343029 5343013 5343008 -
tattgtcactcccatgttcttt

SEQ ID NO: 123377 - DNA, 22 bp, Artificial Sequence
  Synthetic oligonucleotide; TTG chr11 5343003 5343024 5343008 5343003 -
tcactcccatgttctttcacat

SEQ ID NO: 123378 - DNA, 22 bp, Artificial Sequence
  Synthetic oligonucleotide; CTC chr11 5342997 5343018 5343002 5342997 -
ccatgttctttcacatgcattc

SEQ ID NO: 123379 - DNA, 22 bp, Artificial Sequence
  Synthetic oligonucleotide; TTC chr11 5342989 5343010 5342994 5342989 -
tttcacatgcattctgccttca

SEQ ID NO: 123380 - DNA, 22 bp, Artificial Sequence
  Synthetic oligonucleotide; CTT chr11 5342987 5343008 5342992 5342987 -
tcacatgcattctgccttcacc

SEQ ID NO: 123381 - DNA, 22 bp, Artificial Sequence
  Synthetic oligonucleotide; TTT chr11 5342986 5343007 5342991 5342986 -
cacatgcattctgccttcacca

SEQ ID NO: 123382 - DNA, 22 bp, Artificial Sequence
  Synthetic oligonucleotide; TTC chr11 5342985 5343006 5342990 5342985 -
acatgcattctgccttcaccag

SEQ ID NO: 123383 - DNA, 22 bp, Artificial Sequence
  Synthetic oligonucleotide; TTC chr11 5342975 5342996 5342980 5342975 -
tgccttcaccaggatgtcatta

SEQ ID NO: 123384 - DNA, 22 bp, Artificial Sequence
  Synthetic oligonucleotide; CTG chr11 5342973 5342994 5342978 5342973 -
ccttcaccaggatgtcattaaa

SEQ ID NO: 123385 - DNA, 22 bp, Artificial Sequence
  Synthetic oligonucleotide; CTT chr11 5342969 5342990 5342974 5342969 -
caccaggatgtcattaaactcg

SEQ ID NO: 123386 - DNA, 22 bp, Artificial Sequence
  Synthetic oligonucleotide; TTC chr11 5342968 5342989 5342973 5342968 -
accaggatgtcattaaactcgc

SEQ ID NO: 123387 - DNA, 22 bp, Artificial Sequence
  Synthetic oligonucleotide; TTA chr11 5342953 5342974 5342958 5342953 -
aactcgcctgtgctgataccac

SEQ ID NO: 123388 - DNA, 22 bp, Artificial Sequence
  Synthetic oligonucleotide; CTC chr11 5342948 5342969 5342953 5342948 -
gcctgtgctgataccaccttca

SEQ ID NO: 123389 - DNA, 22 bp, Artificial Sequence
  Synthetic oligonucleotide; CTG chr11 5342943 5342964 5342948 5342943 -
tgctgataccaccttcaaccga

SEQ ID NO: 123390 - DNA, 22 bp, Artificial Sequence
  Synthetic oligonucleotide; CTG chr11 5342938 5342959 5342943 5342938 -
ataccaccttcaaccgactgta

SEQ ID NO: 123391 - DNA, 22 bp, Artificial Sequence
  Synthetic oligonucleotide; CTT chr11 5342928 5342949 5342933 5342928 -
caaccgactgtacccagctgtg

SEQ ID NO: 123392 - DNA, 22 bp, Artificial Sequence
  Synthetic oligonucleotide; TTC chr11 5342927 5342948 5342932 5342927 -
aaccgactgtacccagctgtgc

SEQ ID NO: 123393 - DNA, 22 bp, Artificial Sequence
  Synthetic oligonucleotide; CTG chr11 5342918 5342939 5342923 5342918 -
tacccagctgtgcttgtagtct

SEQ ID NO: 123394 - DNA, 22 bp, Artificial Sequence
  Synthetic oligonucleotide; CTG chr11 5342908 5342929 5342913 5342908 -
tgcttgtagtctttatatttgt

SEQ ID NO: 123395 - DNA, 22 bp, Artificial Sequence
  Synthetic oligonucleotide; CTT chr11 5342903 5342924 5342908 5342903 -
gtagtctttatatttgtgctgg

SEQ ID NO: 123396 - DNA, 22 bp, Artificial Sequence
  Synthetic oligonucleotide; TTG chr11 5342902 5342923 5342907 5342902 -
tagtctttatatttgtgctgga

SEQ ID NO: 123397 - DNA, 22 bp, Artificial Sequence
  Synthetic oligonucleotide; CTT chr11 5342895 5342916 5342900 5342895 -
tatatttgtgctggattatctg

SEQ ID NO: 123398 - DNA, 22 bp, Artificial Sequence
  Synthetic oligonucleotide; TTT chr11 5342894 5342915 5342899 5342894 -
atatttgtgctggattatctga

SEQ ID NO: 123399 - DNA, 22 bp, Artificial Sequence
  Synthetic oligonucleotide; TTA chr11 5342893 5342914 5342898 5342893 -
tatttgtgctggattatctgat

SEQ ID NO: 123400 - DNA, 22 bp, Artificial Sequence
  Synthetic oligonucleotide; TTT chr11 5342888 5342909 5342893 5342888 -
gtgctggattatctgattatct

SEQ ID NO: 123401 - DNA, 22 bp, Artificial Sequence
  Synthetic oligonucleotide; TTG chr11 5342887 5342908 5342892 5342887 -
tgctggattatctgattatctt

SEQ ID NO: 123402 - DNA, 22 bp, Artificial Sequence
  Synthetic oligonucleotide; CTG chr11 5342882 5342903 5342887 5342882 -
gattatctgattatcttcatct

SEQ ID NO: 123403 - DNA, 22 bp, Artificial Sequence
  Synthetic oligonucleotide; TTA chr11 5342877 5342898 5342882 5342877 -
tctgattatcttcatctcctat

SEQ ID NO: 123404 - DNA, 22 bp, Artificial Sequence
  Synthetic oligonucleotide; CTG chr11 5342873 5342894 5342878 5342873 -
attatcttcatctcctatgtgt

SEQ ID NO: 123405 - DNA, 22 bp, Artificial Sequence
  Synthetic oligonucleotide; TTA chr11 5342869 5342890 5342874 5342869 -
tcttcatctcctatgtgttgat

SEQ ID NO: 123406 - DNA, 22 bp, Artificial Sequence
  Synthetic oligonucleotide; CTT chr11 5342865 5342886 5342870 5342865 -
catctcctatgtgttgatactc

SEQ ID NO: 123407 - DNA, 22 bp, Artificial Sequence
  Synthetic oligonucleotide; TTC chr11 5342864 5342885 5342869 5342864 -
atctcctatgtgttgatactca

SEQ ID NO: 123408 - DNA, 22 bp, Artificial Sequence
  Synthetic oligonucleotide; CTC chr11 5342859 5342880 5342864 5342859 -
ctatgtgttgatactcaagact

SEQ ID NO: 123409 - DNA, 22 bp, Artificial Sequence
  Synthetic oligonucleotide; CTA chr11 5342856 5342877 5342861 5342856 -
tgtgttgatactcaagactgtc

SEQ ID NO: 123410 - DNA, 22 bp, Artificial Sequence
  Synthetic oligonucleotide; TTG chr11 5342849 5342870 5342854 5342849 -
atactcaagactgtcctgagca

SEQ ID NO: 123411 - DNA, 22 bp, Artificial Sequence
  Synthetic oligonucleotide; CTC chr11 5342843 5342864 5342848 5342843 -
aagactgtcctgagcattgcct

SEQ ID NO: 123412 - DNA, 22 bp, Artificial Sequence
  Synthetic oligonucleotide; CTG chr11 5342836 5342857 5342841 5342836 -
tcctgagcattgcctccagaga

SEQ ID NO: 123413 - DNA, 22 bp, Artificial Sequence
  Synthetic oligonucleotide; CTG chr11 5342831 5342852 5342836 5342831 -
agcattgcctccagagaggaga

SEQ ID NO: 123414 - DNA, 22 bp, Artificial Sequence
  Synthetic oligonucleotide; TTG chr11 5342824 5342845 5342829 5342824 -
cctccagagaggagagggccaa

SEQ ID NO: 123415 - DNA, 22 bp, Artificial Sequence
  Synthetic oligonucleotide; CTC chr11 5342820 5342841 5342825 5342820 -
cagagaggagagggccaaggct

SEQ ID NO: 123416 - DNA, 22 bp, Artificial Sequence
  Synthetic oligonucleotide; CTC chr11 5342797 5342818 5342802 5342797 -
tcattacctgtgtctcccatat

SEQ ID NO: 123417 - DNA, 22 bp, Artificial Sequence
  Synthetic oligonucleotide; CTC chr11 5342795 5342816 5342800 5342795 -
attacctgtgtctcccatatct

SEQ ID NO: 123418 - DNA, 22 bp, Artificial Sequence
  Synthetic oligonucleotide; TTA chr11 5342791 5342812 5342796 5342791 -
cctgtgtctcccatatctgctg

SEQ ID NO: 123419 - DNA, 22 bp, Artificial Sequence
  Synthetic oligonucleotide; CTG chr11 5342787 5342808 5342792 5342787 -
tgtctcccatatctgctgtgtc

SEQ ID NO: 123420 - DNA, 22 bp, Artificial Sequence
  Synthetic oligonucleotide; CTC chr11 5342781 5342802 5342786 5342781 -
ccatatctgctgtgtcctggtt

SEQ ID NO: 123421 - DNA, 22 bp, Artificial Sequence
  Synthetic oligonucleotide; CTG chr11 5342772 5342793 5342777 5342772 -
ctgtgtcctggttttttatgtc

SEQ ID NO: 123422 - DNA, 22 bp, Artificial Sequence
  Synthetic oligonucleotide; CTG chr11 5342769 5342790 5342774 5342769 -
tgtcctggttttttatgtcaca

SEQ ID NO: 123423 - DNA, 22 bp, Artificial Sequence
  Synthetic oligonucleotide; CTG chr11 5342762 5342783 5342767 5342762 -
gttttttatgtcacagtgattg

SEQ ID NO: 123424 - DNA, 22 bp, Artificial Sequence
  Synthetic oligonucleotide; TTT chr11 5342758 5342779 5342763 5342758 -
tttatgtcacagtgattggatt

SEQ ID NO: 123425 - DNA, 22 bp, Artificial Sequence
  Synthetic oligonucleotide; TTT chr11 5342757 5342778 5342762 5342757 -
ttatgtcacagtgattggattg

SEQ ID NO: 123426 - DNA, 22 bp, Artificial Sequence
  Synthetic oligonucleotide; TTT chr11 5342756 5342777 5342761 5342756 -
tatgtcacagtgattggattgt

SEQ ID NO: 123427 - DNA, 22 bp, Artificial Sequence
  Synthetic oligonucleotide; TTT chr11 5342755 5342776 5342760 5342755 -
atgtcacagtgattggattgtc

SEQ ID NO: 123428 - DNA, 22 bp, Artificial Sequence
  Synthetic oligonucleotide; TTA chr11 5342754 5342775 5342759 5342754 -
tgtcacagtgattggattgtct

SEQ ID NO: 123429 - DNA, 22 bp, Artificial Sequence
  Synthetic oligonucleotide; TTG chr11 5342740 5342761 5342745 5342740 -
gattgtctctgattcatcgttt

SEQ ID NO: 123430 - DNA, 22 bp, Artificial Sequence
  Synthetic oligonucleotide; TTG chr11 5342735 5342756 5342740 5342735 -
tctctgattcatcgttttggaa

SEQ ID NO: 123431 - DNA, 22 bp, Artificial Sequence
  Synthetic oligonucleotide; CTC chr11 5342731 5342752 5342736 5342731 -
tgattcatcgttttggaaagca

SEQ ID NO: 123432 - DNA, 22 bp, Artificial Sequence
  Synthetic oligonucleotide; CTG chr11 5342729 5342750 5342734 5342729 -
attcatcgttttggaaagcagg

SEQ ID NO: 123433 - DNA, 22 bp, Artificial Sequence
  Synthetic oligonucleotide; TTC chr11 5342725 5342746 5342730 5342725 -
atcgttttggaaagcaggttcc

SEQ ID NO: 123434 - DNA, 22 bp, Artificial Sequence
  Synthetic oligonucleotide; TTT chr11 5342718 5342739 5342723 5342718 -
tggaaagcaggttccacatatt

SEQ ID NO: 123435 - DNA, 22 bp, Artificial Sequence
  Synthetic oligonucleotide; TTT chr11 5342717 5342738 5342722 5342717 -
ggaaagcaggttccacatattg

SEQ ID NO: 123436 - DNA, 22 bp, Artificial Sequence
  Synthetic oligonucleotide; TTG chr11 5342716 5342737 5342721 5342716 -
gaaagcaggttccacatattgt

SEQ ID NO: 123437 - DNA, 22 bp, Artificial Sequence
  Synthetic oligonucleotide; TTC chr11 5342704 5342725 5342709 5342704 -
cacatattgttcacctcattat

SEQ ID NO: 123438 - DNA, 22 bp, Artificial Sequence
  Synthetic oligonucleotide; TTG chr11 5342695 5342716 5342700 5342695 -
ttcacctcattatgagctatgc

SEQ ID NO: 123439 - DNA, 22 bp, Artificial Sequence
  Synthetic oligonucleotide; TTC chr11 5342692 5342713 5342697 5342692 -
acctcattatgagctatgccta

SEQ ID NO: 123440 - DNA, 22 bp, Artificial Sequence
  Synthetic oligonucleotide; CTC chr11 5342687 5342708 5342692 5342687 -
attatgagctatgcctattttc

SEQ ID NO: 123441 - DNA, 22 bp, Artificial Sequence
  Synthetic oligonucleotide; TTA chr11 5342683 5342704 5342688 5342683 -
tgagctatgcctattttctgtt

SEQ ID NO: 123442 - DNA, 22 bp, Artificial Sequence
  Synthetic oligonucleotide; CTA chr11 5342676 5342697 5342681 5342676 -
tgcctattttctgttccctcca

SEQ ID NO: 123443 - DNA, 22 bp, Artificial Sequence
  Synthetic oligonucleotide; CTA chr11 5342670 5342691 5342675 5342670 -
ttttctgttccctccactaatg

SEQ ID NO: 123444 - DNA, 22 bp, Artificial Sequence
  Synthetic oligonucleotide; TTT chr11 5342667 5342688 5342672 5342667 -
tctgttccctccactaatgaat

SEQ ID NO: 123445 - DNA, 22 bp, Artificial Sequence
  Synthetic oligonucleotide; TTT chr11 5342666 5342687 5342671 5342666 -
ctgttccctccactaatgaatc

SEQ ID NO: 123446 - DNA, 22 bp, Artificial Sequence
  Synthetic oligonucleotide; TTC chr11 5342665 5342686 5342670 5342665 -
tgttccctccactaatgaatcc

SEQ ID NO: 123447 - DNA, 22 bp, Artificial Sequence
  Synthetic oligonucleotide; CTG chr11 5342663 5342684 5342668 5342663 -
ttccctccactaatgaatccta

SEQ ID NO: 123448 - DNA, 22 bp, Artificial Sequence
  Synthetic oligonucleotide; TTC chr11 5342660 5342681 5342665 5342660 -
cctccactaatgaatcctataa

SEQ ID NO: 123449 - DNA, 22 bp, Artificial Sequence
  Synthetic oligonucleotide; CTC chr11 5342656 5342677 5342661 5342656 -
cactaatgaatcctataacata

SEQ ID NO: 123450 - DNA, 22 bp, Artificial Sequence
  Synthetic oligonucleotide; CTA chr11 5342651 5342672 5342656 5342651 -
atgaatcctataacatatagtg

SEQ ID NO: 123451 - DNA, 22 bp, Artificial Sequence
  Synthetic oligonucleotide; CTA chr11 5342641 5342662 5342646 5342641 -
taacatatagtgtcaagaccaa

SEQ ID NO: 123452 - DNA, 22 bp, Artificial Sequence
  Synthetic oligonucleotide; TTC chr11 5342611 5342632 5342616 5342611 -
agaatgccattcttcacctttt

SEQ ID NO: 123453 - DNA, 22 bp, Artificial Sequence
  Synthetic oligonucleotide; TTC chr11 5342599 5342620 5342604 5342599 -
ttcacctttttactacccatag

SEQ ID NO: 123454 - DNA, 22 bp, Artificial Sequence
  Synthetic oligonucleotide; CTT chr11 5342597 5342618 5342602 5342597 -
cacctttttactacccatagaa

SEQ ID NO: 123455 - DNA, 22 bp, Artificial Sequence
  Synthetic oligonucleotide; TTC chr11 5342596 5342617 5342601 5342596 -
acctttttactacccatagaat

SEQ ID NO: 123456 - DNA, 22 bp, Artificial Sequence
  Synthetic oligonucleotide; CTT chr11 5342591 5342612 5342596 5342591 -
tttactacccatagaattggaa

SEQ ID NO: 123457 - DNA, 22 bp, Artificial Sequence
  Synthetic oligonucleotide; TTT chr11 5342590 5342611 5342595 5342590 -
ttactacccatagaattggaac

SEQ ID NO: 123458 - DNA, 22 bp, Artificial Sequence
  Synthetic oligonucleotide; TTT chr11 5342589 5342610 5342594 5342589 -
tactacccatagaattggaacc

SEQ ID NO: 123459 - DNA, 22 bp, Artificial Sequence
  Synthetic oligonucleotide; TTT chr11 5342588 5342609 5342593 5342588 -
actacccatagaattggaacct

SEQ ID NO: 123460 - DNA, 22 bp, Artificial Sequence
  Synthetic oligonucleotide; TTA chr11 5342587 5342608 5342592 5342587 -
ctacccatagaattggaacctg

SEQ ID NO: 123461 - DNA, 22 bp, Artificial Sequence
  Synthetic oligonucleotide; CTA chr11 5342584 5342605 5342589 5342584 -
cccatagaattggaacctgatc

SEQ ID NO: 123462 - DNA, 22 bp, Artificial Sequence
  Synthetic oligonucleotide; TTG chr11 5342572 5342593 5342577 5342572 -
gaacctgatctccaatcatcac

SEQ ID NO: 123463 - DNA, 22 bp, Artificial Sequence
  Synthetic oligonucleotide; CTG chr11 5342565 5342586 5342570 5342565 -
atctccaatcatcacagtcact

SEQ ID NO: 123464 - DNA, 22 bp, Artificial Sequence
  Synthetic oligonucleotide; CTC chr11 5342560 5342581 5342565 5342560 -
caatcatcacagtcactctcac

SEQ ID NO: 123465 - DNA, 22 bp, Artificial Sequence
  Synthetic oligonucleotide; CTC chr11 5342542 5342563 5342547 5342542 -
tcacagaatgtaaaaactctaa

SEQ ID NO: 123466 - DNA, 22 bp, Artificial Sequence
  Synthetic oligonucleotide; CTC chr11 5342540 5342561 5342545 5342540 -
acagaatgtaaaaactctaata

SEQ ID NO: 123467 - DNA, 22 bp, Artificial Sequence
  Synthetic oligonucleotide; CTC chr11 5342523 5342544 5342528 5342523 -
taatatttagcaggagagcaaa

SEQ ID NO: 123468 - DNA, 22 bp, Artificial Sequence
  Synthetic oligonucleotide; CTA chr11 5342521 5342542 5342526 5342521 -
atatttagcaggagagcaaaga

SEQ ID NO: 123469 - DNA, 22 bp, Artificial Sequence
  Synthetic oligonucleotide; TTT chr11 5342515 5342536 5342520 5342515 -
agcaggagagcaaagaagtctc

SEQ ID NO: 123470 - DNA, 22 bp, Artificial Sequence
  Synthetic oligonucleotide; TTA chr11 5342514 5342535 5342519 5342514 -
gcaggagagcaaagaagtctca

SEQ ID NO: 123471 - DNA, 22 bp, Artificial Sequence
  Synthetic oligonucleotide; CTC chr11 5342493 5342514 5342498 5342493 -
atatctagcatgcatgctcata

SEQ ID NO: 123472 - DNA, 22 bp, Artificial Sequence
  Synthetic oligonucleotide; CTA chr11 5342486 5342507 5342491 5342486 -
gcatgcatgctcatatgacttg

SEQ ID NO: 123473 - DNA, 22 bp, Artificial Sequence
  Synthetic oligonucleotide; CTC chr11 5342474 5342495 5342479 5342474 -
atatgacttggtaaaataggtg

SEQ ID NO: 123474 - DNA, 22 bp, Artificial Sequence
  Synthetic oligonucleotide; CTT chr11 5342465 5342486 5342470 5342465 -
ggtaaaataggtgttaaaatac

SEQ ID NO: 123475 - DNA, 22 bp, Artificial Sequence
  Synthetic oligonucleotide; TTG chr11 5342464 5342485 5342469 5342464 -
gtaaaataggtgttaaaataca

SEQ ID NO: 123476 - DNA, 22 bp, Artificial Sequence
  Synthetic oligonucleotide; TTA chr11 5342449 5342470 5342454 5342449 -
aaatacagcttcaagtttccct

SEQ ID NO: 123477 - DNA, 22 bp, Artificial Sequence
  Synthetic oligonucleotide; CTT chr11 5342438 5342459 5342443 5342438 -
caagtttccctaaggtatctct

SEQ ID NO: 123478 - DNA, 22 bp, Artificial Sequence
  Synthetic oligonucleotide; TTC chr11 5342437 5342458 5342442 5342437 -
aagtttccctaaggtatctctt

SEQ ID NO: 123479 - DNA, 22 bp, Artificial Sequence
  Synthetic oligonucleotide; TTT chr11 5342431 5342452 5342436 5342431 -
ccctaaggtatctctttaagcc

SEQ ID NO: 123480 - DNA, 22 bp, Artificial Sequence
  Synthetic oligonucleotide; TTC chr11 5342430 5342451 5342435 5342430 -
cctaaggtatctctttaagccc

SEQ ID NO: 123481 - DNA, 22 bp, Artificial Sequence
  Synthetic oligonucleotide; CTA chr11 5342426 5342447 5342431 5342426 -
aggtatctctttaagcccaact

SEQ ID NO: 123482 - DNA, 22 bp, Artificial Sequence
  Synthetic oligonucleotide; CTC chr11 5342417 5342438 5342422 5342417 -
tttaagcccaactctttagcta

SEQ ID NO: 123483 - DNA, 22 bp, Artificial Sequence
  Synthetic oligonucleotide; CTT chr11 5342415 5342436 5342420 5342415 -
taagcccaactctttagctaaa

SEQ ID NO: 123484 - DNA, 22 bp, Artificial Sequence
  Synthetic oligonucleotide; TTT chr11 5342414 5342435 5342419 5342414 -
aagcccaactctttagctaaat

SEQ ID NO: 123485 - DNA, 22 bp, Artificial Sequence
  Synthetic oligonucleotide; TTA chr11 5342413 5342434 5342418 5342413 -
agcccaactctttagctaaatg

SEQ ID NO: 123486 - DNA, 22 bp, Artificial Sequence
  Synthetic oligonucleotide; CTC chr11 5342403 5342424 5342408 5342403 -
tttagctaaatgtagtttgtac

SEQ ID NO: 123487 - DNA, 22 bp, Artificial Sequence
  Synthetic oligonucleotide; CTT chr11 5342401 5342422 5342406 5342401 -
tagctaaatgtagtttgtacaa

SEQ ID NO: 123488 - DNA, 22 bp, Artificial Sequence
  Synthetic oligonucleotide; TTT chr11 5342400 5342421 5342405 5342400 -
agctaaatgtagtttgtacaaa

SEQ ID NO: 123489 - DNA, 22 bp, Artificial Sequence
  Synthetic oligonucleotide; TTA chr11 5342399 5342420 5342404 5342399 -
gctaaatgtagtttgtacaaat

SEQ ID NO: 123490 - DNA, 22 bp, Artificial Sequence
  Synthetic oligonucleotide; CTA chr11 5342395 5342416 5342400 5342395 -
aatgtagtttgtacaaattttt

SEQ ID NO: 123491 - DNA, 22 bp, Artificial Sequence
  Synthetic oligonucleotide; TTT chr11 5342385 5342406 5342390 5342385 -
gtacaaatttttgttgcattcc

SEQ ID NO: 123492 - DNA, 22 bp, Artificial Sequence
  Synthetic oligonucleotide; TTG chr11 5342384 5342405 5342389 5342384 -
tacaaatttttgttgcattcct

SEQ ID NO: 123493 - DNA, 22 bp, Artificial Sequence
  Synthetic oligonucleotide; TTT chr11 5342375 5342396 5342380 5342375 -
ttgttgcattcctgtaaacgga

SEQ ID NO: 123494 - DNA, 22 bp, Artificial Sequence
  Synthetic oligonucleotide; TTT chr11 5342374 5342395 5342379 5342374 -
tgttgcattcctgtaaacggaa

SEQ ID NO: 123495 - DNA, 22 bp, Artificial Sequence
  Synthetic oligonucleotide; TTT chr11 5342373 5342394 5342378 5342373 -
gttgcattcctgtaaacggaat

SEQ ID NO: 123496 - DNA, 22 bp, Artificial Sequence
  Synthetic oligonucleotide; TTG chr11 5342372 5342393 5342377 5342372 -
ttgcattcctgtaaacggaata

SEQ ID NO: 123497 - DNA, 22 bp, Artificial Sequence
  Synthetic oligonucleotide; TTG chr11 5342369 5342390 5342374 5342369 -
cattcctgtaaacggaatattt

SEQ ID NO: 123498 - DNA, 22 bp, Artificial Sequence
  Synthetic oligonucleotide; TTC chr11 5342364 5342385 5342369 5342364 -
ctgtaaacggaatatttctcta

SEQ ID NO: 123499 - DNA, 22 bp, Artificial Sequence
  Synthetic oligonucleotide; CTG chr11 5342361 5342382 5342366 5342361 -
taaacggaatatttctctaagc

SEQ ID NO: 123500 - DNA, 22 bp, Artificial Sequence
  Synthetic oligonucleotide; TTT chr11 5342347 5342368 5342352 5342347 -
ctctaagctttccactaaatta

SEQ ID NO: 123501 - DNA, 22 bp, Artificial Sequence
  Synthetic oligonucleotide; TTC chr11 5342346 5342367 5342351 5342346 -
tctaagctttccactaaattat

SEQ ID NO: 123502 - DNA, 22 bp, Artificial Sequence
  Synthetic oligonucleotide; CTC chr11 5342344 5342365 5342349 5342344 -
taagctttccactaaattattg

SEQ ID NO: 123503 - DNA, 22 bp, Artificial Sequence
  Synthetic oligonucleotide; CTA chr11 5342342 5342363 5342347 5342342 -
agctttccactaaattattgtg

SEQ ID NO: 123504 - DNA, 22 bp, Artificial Sequence
  Synthetic oligonucleotide; CTT chr11 5342337 5342358 5342342 5342337 -
tccactaaattattgtgataac

SEQ ID NO: 123505 - DNA, 22 bp, Artificial Sequence
  Synthetic oligonucleotide; TTT chr11 5342336 5342357 5342341 5342336 -
ccactaaattattgtgataaca

SEQ ID NO: 123506 - DNA, 22 bp, Artificial Sequence
  Synthetic oligonucleotide; TTC chr11 5342335 5342356 5342340 5342335 -
cactaaattattgtgataacaa

SEQ ID NO: 123507 - DNA, 22 bp, Artificial Sequence
  Synthetic oligonucleotide; CTA chr11 5342330 5342351 5342335 5342330 -
aattattgtgataacaatacct

SEQ ID NO: 123508 - DNA, 22 bp, Artificial Sequence
  Synthetic oligonucleotide; TTA chr11 5342325 5342346 5342330 5342325 -
ttgtgataacaataccttaggc

SEQ ID NO: 123509 - DNA, 22 bp, Artificial Sequence
  Synthetic oligonucleotide; TTG chr11 5342322 5342343 5342327 5342322 -
tgataacaataccttaggcatc

SEQ ID NO: 123510 - DNA, 22 bp, Artificial Sequence
  Synthetic oligonucleotide; CTT chr11 5342307 5342328 5342312 5342307 -
aggcatctattggtatgtctat

SEQ ID NO: 123511 - DNA, 22 bp, Artificial Sequence
  Synthetic oligonucleotide; TTA chr11 5342306 5342327 5342311 5342306 -
ggcatctattggtatgtctata

SEQ ID NO: 123512 - DNA, 22 bp, Artificial Sequence
  Synthetic oligonucleotide; CTA chr11 5342298 5342319 5342303 5342298 -
ttggtatgtctataatgtaact

SEQ ID NO: 123513 - DNA, 22 bp, Artificial Sequence
  Synthetic oligonucleotide; TTG chr11 5342295 5342316 5342300 5342295 -
gtatgtctataatgtaactaac

SEQ ID NO: 123514 - DNA, 22 bp, Artificial Sequence
  Synthetic oligonucleotide; CTA chr11 5342286 5342307 5342291 5342286 -
taatgtaactaacatatgttta

SEQ ID NO: 123515 - DNA, 22 bp, Artificial Sequence
  Synthetic oligonucleotide; CTA chr11 5342275 5342296 5342280 5342275 -
acatatgtttatttcatggtat

SEQ ID NO: 123516 - DNA, 22 bp, Artificial Sequence
  Synthetic oligonucleotide; TTT chr11 5342265 5342286 5342270 5342265 -
atttcatggtataaagttagca

SEQ ID NO: 123517 - DNA, 22 bp, Artificial Sequence
  Synthetic oligonucleotide; TTA chr11 5342264 5342285 5342269 5342264 -
tttcatggtataaagttagcag

SEQ ID NO: 123518 - DNA, 22 bp, Artificial Sequence
  Synthetic oligonucleotide; TTT chr11 5342261 5342282 5342266 5342261 -
catggtataaagttagcagata

SEQ ID NO: 123519 - DNA, 22 bp, Artificial Sequence
  Synthetic oligonucleotide; TTC chr11 5342260 5342281 5342265 5342260 -
atggtataaagttagcagatag

SEQ ID NO: 123520 - DNA, 22 bp, Artificial Sequence
  Synthetic oligonucleotide; TTA chr11 5342246 5342267 5342251 5342246 -
gcagataggaacagaatcataa

SEQ ID NO: 123521 - DNA, 22 bp, Artificial Sequence
  Synthetic oligonucleotide; TTA chr11 5342211 5342232 5342216 5342211 -
ttagttggttcgagtgaaatgg

SEQ ID NO: 123522 - DNA, 22 bp, Artificial Sequence
  Synthetic oligonucleotide; TTA chr11 5342208 5342229 5342213 5342208 -
gttggttcgagtgaaatggaat

SEQ ID NO: 123523 - DNA, 22 bp, Artificial Sequence
  Synthetic oligonucleotide; TTG chr11 5342204 5342225 5342209 5342204 -
gttcgagtgaaatggaatagag

SEQ ID NO: 123524 - DNA, 22 bp, Artificial Sequence
  Synthetic oligonucleotide; TTC chr11 5342200 5342221 5342205 5342200 -
gagtgaaatggaatagagtttg

SEQ ID NO: 123525 - DNA, 22 bp, Artificial Sequence
  Synthetic oligonucleotide; TTT chr11 5342179 5342200 5342184 5342179 -
ggtttactatgtcaaatctaat

SEQ ID NO: 123526 - DNA, 22 bp, Artificial Sequence
  Synthetic oligonucleotide; TTG chr11 5342178 5342199 5342183 5342178 -
gtttactatgtcaaatctaatt

SEQ ID NO: 123527 - DNA, 22 bp, Artificial Sequence
  Synthetic oligonucleotide; TTT chr11 5342174 5342195 5342179 5342174 -
actatgtcaaatctaatttcca

SEQ ID NO: 123528 - DNA, 22 bp, Artificial Sequence
  Synthetic oligonucleotide; TTA chr11 5342173 5342194 5342178 5342173 -
ctatgtcaaatctaatttccaa

SEQ ID NO: 123529 - DNA, 22 bp, Artificial Sequence
  Synthetic oligonucleotide; CTA chr11 5342170 5342191 5342175 5342170 -
tgtcaaatctaatttccaactc

SEQ ID NO: 123530 - DNA, 22 bp, Artificial Sequence
  Synthetic oligonucleotide; CTA chr11 5342159 5342180 5342164 5342159 -
atttccaactcttatgaatttc

SEQ ID NO: 123531 - DNA, 22 bp, Artificial Sequence
  Synthetic oligonucleotide; TTT chr11 5342155 5342176 5342160 5342155 -
ccaactcttatgaatttctctg

SEQ ID NO: 123532 - DNA, 22 bp, Artificial Sequence
  Synthetic oligonucleotide; TTC chr11 5342154 5342175 5342159 5342154 -
caactcttatgaatttctctgc

SEQ ID NO: 123533 - DNA, 22 bp, Artificial Sequence
  Synthetic oligonucleotide; CTC chr11 5342148 5342169 5342153 5342148 -
ttatgaatttctctgcaggtgt

SEQ ID NO: 123534 - DNA, 22 bp, Artificial Sequence
  Synthetic oligonucleotide; CTT chr11 5342146 5342167 5342151 5342146 -
atgaatttctctgcaggtgtcc

SEQ ID NO: 123535 - DNA, 22 bp, Artificial Sequence
  Synthetic oligonucleotide; TTA chr11 5342145 5342166 5342150 5342145 -
tgaatttctctgcaggtgtcca

SEQ ID NO: 123536 - DNA, 22 bp, Artificial Sequence
  Synthetic oligonucleotide; TTT chr11 5342138 5342159 5342143 5342138 -
ctctgcaggtgtccatacaaac

SEQ ID NO: 123537 - DNA, 22 bp, Artificial Sequence
  Synthetic oligonucleotide; TTC chr11 5342137 5342158 5342142 5342137 -
tctgcaggtgtccatacaaaca

SEQ ID NO: 123538 - DNA, 22 bp, Artificial Sequence
  Synthetic oligonucleotide; CTC chr11 5342135 5342156 5342140 5342135 -
tgcaggtgtccatacaaacaat

SEQ ID NO: 123539 - DNA, 22 bp, Artificial Sequence
  Synthetic oligonucleotide; CTG chr11 5342133 5342154 5342138 5342133 -
caggtgtccatacaaacaatgg

SEQ ID NO: 123540 - DNA, 22 bp, Artificial Sequence
  Synthetic oligonucleotide; CTA chr11 5342104 5342125 5342109 5342104 -
taaatttggtcactgaagtcca

SEQ ID NO: 123541 - DNA, 22 bp, Artificial Sequence
  Synthetic oligonucleotide; TTT chr11 5342097 5342118 5342102 5342097 -
ggtcactgaagtccaggaattt

SEQ ID NO: 123542 - DNA, 22 bp, Artificial Sequence
  Synthetic oligonucleotide; TTG chr11 5342096 5342117 5342101 5342096 -
gtcactgaagtccaggaatttt

SEQ ID NO: 123543 - DNA, 22 bp, Artificial Sequence
  Synthetic oligonucleotide; CTG chr11 5342089 5342110 5342094 5342089 -
aagtccaggaattttcctgcaa

SEQ ID NO: 123544 - DNA, 22 bp, Artificial Sequence
  Synthetic oligonucleotide; TTT chr11 5342075 5342096 5342080 5342075 -
tcctgcaaaaaagaatataatc

SEQ ID NO: 123545 - DNA, 22 bp, Artificial Sequence
  Synthetic oligonucleotide; TTT chr11 5342074 5342095 5342079 5342074 -
cctgcaaaaaagaatataatct

SEQ ID NO: 123546 - DNA, 22 bp, Artificial Sequence
  Synthetic oligonucleotide; TTC chr11 5342073 5342094 5342078 5342073 -
ctgcaaaaaagaatataatctt

SEQ ID NO: 123547 - DNA, 22 bp, Artificial Sequence
  Synthetic oligonucleotide; CTG chr11 5342070 5342091 5342075 5342070 -
caaaaaagaatataatcttctt

SEQ ID NO: 123548 - DNA, 22 bp, Artificial Sequence
  Synthetic oligonucleotide; CTT chr11 5342051 5342072 5342056 5342051 -
ctttgatcagtgacctaattac

SEQ ID NO: 123549 - DNA, 22 bp, Artificial Sequence
  Synthetic oligonucleotide; TTC chr11 5342050 5342071 5342055 5342050 -
tttgatcagtgacctaattact

SEQ ID NO: 123550 - DNA, 22 bp, Artificial Sequence
  Synthetic oligonucleotide; CTT chr11 5342048 5342069 5342053 5342048 -
tgatcagtgacctaattactta

SEQ ID NO: 123551 - DNA, 22 bp, Artificial Sequence
  Synthetic oligonucleotide; TTT chr11 5342047 5342068 5342052 5342047 -
gatcagtgacctaattacttat

SEQ ID NO: 123552 - DNA, 22 bp, Artificial Sequence
  Synthetic oligonucleotide; TTG chr11 5342046 5342067 5342051 5342046 -
atcagtgacctaattacttatc

SEQ ID NO: 123553 - DNA, 22 bp, Artificial Sequence
  Synthetic oligonucleotide; CTA chr11 5342034 5342055 5342039 5342034 -
attacttatcatctcaacagtc

SEQ ID NO: 123554 - DNA, 22 bp, Artificial Sequence
  Synthetic oligonucleotide; TTA chr11 5342030 5342051 5342035 5342030 -
cttatcatctcaacagtctagt

SEQ ID NO: 123555 - DNA, 22 bp, Artificial Sequence
  Synthetic oligonucleotide; CTT chr11 5342027 5342048 5342032 5342027 -
atcatctcaacagtctagttgg

SEQ ID NO: 123556 - DNA, 22 bp, Artificial Sequence
  Synthetic oligonucleotide; TTA chr11 5342026 5342047 5342031 5342026 -
tcatctcaacagtctagttggt

SEQ ID NO: 123557 - DNA, 22 bp, Artificial Sequence
  Synthetic oligonucleotide; CTC chr11 5342019 5342040 5342024 5342019 -
aacagtctagttggttcctcct

SEQ ID NO: 123558 - DNA, 22 bp, Artificial Sequence
  Synthetic oligonucleotide; CTA chr11 5342010 5342031 5342015 5342010 -
gttggttcctcctccctccatc

SEQ ID NO: 123559 - DNA, 22 bp, Artificial Sequence
  Synthetic oligonucleotide; TTG chr11 5342006 5342027 5342011 5342006 -
gttcctcctccctccatcaaat

SEQ ID NO: 123560 - DNA, 22 bp, Artificial Sequence
  Synthetic oligonucleotide; TTC chr11 5342002 5342023 5342007 5342002 -
ctcctccctccatcaaattata

SEQ ID NO: 123561 - DNA, 22 bp, Artificial Sequence
  Synthetic oligonucleotide; CTC chr11 5341999 5342020 5342004 5341999 -
ctccctccatcaaattataatg

SEQ ID NO: 123562 - DNA, 22 bp, Artificial Sequence
  Synthetic oligonucleotide; CTC chr11 5341996 5342017 5342001 5341996 -
cctccatcaaattataatgaat

SEQ ID NO: 123563 - DNA, 22 bp, Artificial Sequence
  Synthetic oligonucleotide; CTC chr11 5341992 5342013 5341997 5341992 -
catcaaattataatgaatttgt

SEQ ID NO: 123564 - DNA, 22 bp, Artificial Sequence
  Synthetic oligonucleotide; TTA chr11 5341982 5342003 5341987 5341982 -
taatgaatttgtctcaaaaacc

SEQ ID NO: 123565 - DNA, 22 bp, Artificial Sequence
  Synthetic oligonucleotide; TTT chr11 5341972 5341993 5341977 5341972 -
gtctcaaaaaccataaactcat

SEQ ID NO: 123566 - DNA, 22 bp, Artificial Sequence
  Synthetic oligonucleotide; TTG chr11 5341971 5341992 5341976 5341971 -
tctcaaaaaccataaactcata

SEQ ID NO: 123567 - DNA, 22 bp, Artificial Sequence
  Synthetic oligonucleotide; CTC chr11 5341967 5341988 5341972 5341967 -
aaaaaccataaactcatattta

SEQ ID NO: 123568 - DNA, 22 bp, Artificial Sequence
  Synthetic oligonucleotide; CTC chr11 5341952 5341973 5341957 5341952 -
atatttattccccaaggcagta

SEQ ID NO: 123569 - DNA, 22 bp, Artificial Sequence
  Synthetic oligonucleotide; TTT chr11 5341946 5341967 5341951 5341946 -
attccccaaggcagtaccttct

SEQ ID NO: 123570 - DNA, 22 bp, Artificial Sequence
  Synthetic oligonucleotide; TTA chr11 5341945 5341966 5341950 5341945 -
ttccccaaggcagtaccttctg

SEQ ID NO: 123571 - DNA, 22 bp, Artificial Sequence
  Synthetic oligonucleotide; TTC chr11 5341942 5341963 5341947 5341942 -
cccaaggcagtaccttctgaca

SEQ ID NO: 123572 - DNA, 22 bp, Artificial Sequence
  Synthetic oligonucleotide; CTT chr11 5341926 5341947 5341931 5341926 -
ctgacaaacttgtaacaaaaaa

SEQ ID NO: 123573 - DNA, 22 bp, Artificial Sequence
  Synthetic oligonucleotide; TTC chr11 5341925 5341946 5341930 5341925 -
tgacaaacttgtaacaaaaaaa

SEQ ID NO: 123574 - DNA, 22 bp, Artificial Sequence
  Synthetic oligonucleotide; CTG chr11 5341923 5341944 5341928 5341923 -
acaaacttgtaacaaaaaaatg

SEQ ID NO: 123575 - DNA, 22 bp, Artificial Sequence
  Synthetic oligonucleotide; CTT chr11 5341915 5341936 5341920 5341915 -
gtaacaaaaaaatgtgagaaga

SEQ ID NO: 123576 - DNA, 22 bp, Artificial Sequence
  Synthetic oligonucleotide; TTG chr11 5341914 5341935 5341919 5341914 -
taacaaaaaaatgtgagaagag

SEQ ID NO: 123577 - DNA, 22 bp, Artificial Sequence
  Synthetic oligonucleotide; CTC chr11 5341849 5341870 5341854 5341849 -
cttctatcttgctctcattctt

SEQ ID NO: 123578 - DNA, 22 bp, Artificial Sequence
  Synthetic oligonucleotide; CTT chr11 5341846 5341867 5341851 5341846 -
ctatcttgctctcattcttatt

SEQ ID NO: 123579 - DNA, 22 bp, Artificial Sequence
  Synthetic oligonucleotide; TTC chr11 5341845 5341866 5341850 5341845 -
tatcttgctctcattcttattc

SEQ ID NO: 123580 - DNA, 22 bp, Artificial Sequence
  Synthetic oligonucleotide; CTA chr11 5341843 5341864 5341848 5341843 -
tcttgctctcattcttattcta

SEQ ID NO: 123581 - DNA, 22 bp, Artificial Sequence
  Synthetic oligonucleotide; CTT chr11 5341839 5341860 5341844 5341839 -
gctctcattcttattctactac

SEQ ID NO: 123582 - DNA, 22 bp, Artificial Sequence
  Synthetic oligonucleotide; TTG chr11 5341838 5341859 5341843 5341838 -
ctctcattcttattctactacc

SEQ ID NO: 123583 - DNA, 22 bp, Artificial Sequence
  Synthetic oligonucleotide; CTC chr11 5341835 5341856 5341840 5341835 -
tcattcttattctactacccta

SEQ ID NO: 123584 - DNA, 22 bp, Artificial Sequence
  Synthetic oligonucleotide; CTC chr11 5341833 5341854 5341838 5341833 -
attcttattctactaccctagt

SEQ ID NO: 123585 - DNA, 22 bp, Artificial Sequence
  Synthetic oligonucleotide; TTC chr11 5341829 5341850 5341834 5341829 -
ttattctactaccctagttgct

SEQ ID NO: 123586 - DNA, 22 bp, Artificial Sequence
  Synthetic oligonucleotide; CTT chr11 5341827 5341848 5341832 5341827 -
attctactaccctagttgctag

SEQ ID NO: 123587 - DNA, 22 bp, Artificial Sequence
  Synthetic oligonucleotide; TTA chr11 5341826 5341847 5341831 5341826 -
ttctactaccctagttgctagc

SEQ ID NO: 123588 - DNA, 22 bp, Artificial Sequence
  Synthetic oligonucleotide; TTC chr11 5341823 5341844 5341828 5341823 -
tactaccctagttgctagctcc

SEQ ID NO: 123589 - DNA, 22 bp, Artificial Sequence
  Synthetic oligonucleotide; CTA chr11 5341821 5341842 5341826 5341821 -
ctaccctagttgctagctccaa

SEQ ID NO: 123590 - DNA, 22 bp, Artificial Sequence
  Synthetic oligonucleotide; CTA chr11 5341818 5341839 5341823 5341818 -
ccctagttgctagctccaatgt

SEQ ID NO: 123591 - DNA, 22 bp, Artificial Sequence
  Synthetic oligonucleotide; CTA chr11 5341813 5341834 5341818 5341813 -
gttgctagctccaatgttgagg

SEQ ID NO: 123592 - DNA, 22 bp, Artificial Sequence
  Synthetic oligonucleotide; TTG chr11 5341809 5341830 5341814 5341809 -
ctagctccaatgttgaggccat

SEQ ID NO: 123593 - DNA, 22 bp, Artificial Sequence
  Synthetic oligonucleotide; CTA chr11 5341806 5341827 5341811 5341806 -
gctccaatgttgaggccatcct

SEQ ID NO: 123594 - DNA, 22 bp, Artificial Sequence
  Synthetic oligonucleotide; CTC chr11 5341802 5341823 5341807 5341802 -
caatgttgaggccatcctcaga

SEQ ID NO: 123595 - DNA, 22 bp, Artificial Sequence
  Synthetic oligonucleotide; TTG chr11 5341794 5341815 5341799 5341794 -
aggccatcctcagatatctacg

SEQ ID NO: 123596 - DNA, 22 bp, Artificial Sequence
  Synthetic oligonucleotide; CTC chr11 5341783 5341804 5341788 5341783 -
agatatctacgctggctgacta

SEQ ID NO: 123597 - DNA, 22 bp, Artificial Sequence
  Synthetic oligonucleotide; CTA chr11 5341774 5341795 5341779 5341774 -
cgctggctgactagtccaaatt

SEQ ID NO: 123598 - DNA, 22 bp, Artificial Sequence
  Synthetic oligonucleotide; CTG chr11 5341769 5341790 5341774 5341769 -
gctgactagtccaaattagtgg

SEQ ID NO: 123599 - DNA, 22 bp, Artificial Sequence
  Synthetic oligonucleotide; CTG chr11 5341765 5341786 5341770 5341765 -
actagtccaaattagtggaaga

SEQ ID NO: 123600 - DNA, 22 bp, Artificial Sequence
  Synthetic oligonucleotide; CTA chr11 5341761 5341782 5341766 5341761 -
gtccaaattagtggaagagaca

SEQ ID NO: 123601 - DNA, 22 bp, Artificial Sequence
  Synthetic oligonucleotide; TTA chr11 5341751 5341772 5341756 5341751 -
gtggaagagacagttccttcac

SEQ ID NO: 123602 - DNA, 22 bp, Artificial Sequence
  Synthetic oligonucleotide; TTC chr11 5341735 5341756 5341740 5341735 -
cttcaccctccttttgctatga

SEQ ID NO: 123603 - DNA, 22 bp, Artificial Sequence
  Synthetic oligonucleotide; CTT chr11 5341732 5341753 5341737 5341732 -
caccctccttttgctatgaaaa

SEQ ID NO: 123604 - DNA, 22 bp, Artificial Sequence
  Synthetic oligonucleotide; TTC chr11 5341731 5341752 5341736 5341731 -
accctccttttgctatgaaaaa

SEQ ID NO: 123605 - DNA, 22 bp, Artificial Sequence
  Synthetic oligonucleotide; CTC chr11 5341725 5341746 5341730 5341725 -
cttttgctatgaaaaaggtctg

SEQ ID NO: 123606 - DNA, 22 bp, Artificial Sequence
  Synthetic oligonucleotide; CTT chr11 5341722 5341743 5341727 5341722 -
ttgctatgaaaaaggtctgaag

SEQ ID NO: 123607 - DNA, 22 bp, Artificial Sequence
  Synthetic oligonucleotide; TTT chr11 5341721 5341742 5341726 5341721 -
tgctatgaaaaaggtctgaagg

SEQ ID NO: 123608 - DNA, 22 bp, Artificial Sequence
  Synthetic oligonucleotide; TTT chr11 5341720 5341741 5341725 5341720 -
gctatgaaaaaggtctgaagga

SEQ ID NO: 123609 - DNA, 22 bp, Artificial Sequence
  Synthetic oligonucleotide; TTG chr11 5341719 5341740 5341724 5341719 -
ctatgaaaaaggtctgaaggaa

SEQ ID NO: 123610 - DNA, 22 bp, Artificial Sequence
  Synthetic oligonucleotide; CTA chr11 5341716 5341737 5341721 5341716 -
tgaaaaaggtctgaaggaacaa

SEQ ID NO: 123611 - DNA, 22 bp, Artificial Sequence
  Synthetic oligonucleotide; CTG chr11 5341703 5341724 5341708 5341703 -
aaggaacaaaaaaaaataggtt

SEQ ID NO: 123612 - DNA, 22 bp, Artificial Sequence
  Synthetic oligonucleotide; TTT chr11 5341680 5341701 5341685 5341680 -
ctgcatttttttgaagaatgat

SEQ ID NO: 123613 - DNA, 22 bp, Artificial Sequence
  Synthetic oligonucleotide; TTC chr11 5341679 5341700 5341684 5341679 -
tgcatttttttgaagaatgatt

SEQ ID NO: 123614 - DNA, 22 bp, Artificial Sequence
  Synthetic oligonucleotide; CTG chr11 5341677 5341698 5341682 5341677 -
catttttttgaagaatgattgc

SEQ ID NO: 123615 - DNA, 22 bp, Artificial Sequence
  Synthetic oligonucleotide; TTT chr11 5341672 5341693 5341677 5341672 -
ttttgaagaatgattgctttct

SEQ ID NO: 123616 - DNA, 22 bp, Artificial Sequence
  Synthetic oligonucleotide; TTT chr11 5341671 5341692 5341676 5341671 -
tttgaagaatgattgctttctg

SEQ ID NO: 123617 - DNA, 22 bp, Artificial Sequence
  Synthetic oligonucleotide; TTT chr11 5341670 5341691 5341675 5341670 -
ttgaagaatgattgctttctgt

SEQ ID NO: 123618 - DNA, 22 bp, Artificial Sequence
  Synthetic oligonucleotide; TTT chr11 5341669 5341690 5341674 5341669 -
tgaagaatgattgctttctgta

SEQ ID NO: 123619 - DNA, 22 bp, Artificial Sequence
  Synthetic oligonucleotide; TTT chr11 5341668 5341689 5341673 5341668 -
gaagaatgattgctttctgtac

SEQ ID NO: 123620 - DNA, 22 bp, Artificial Sequence
  Synthetic oligonucleotide; TTG chr11 5341667 5341688 5341672 5341667 -
aagaatgattgctttctgtaca

SEQ ID NO: 123621 - DNA, 22 bp, Artificial Sequence
  Synthetic oligonucleotide; TTG chr11 5341656 5341677 5341661 5341656 -
ctttctgtacatacattctgat

SEQ ID NO: 123622 - DNA, 22 bp, Artificial Sequence
  Synthetic oligonucleotide; CTT chr11 5341653 5341674 5341658 5341653 -
tctgtacatacattctgattcc

SEQ ID NO: 123623 - DNA, 22 bp, Artificial Sequence
  Synthetic oligonucleotide; TTT chr11 5341652 5341673 5341657 5341652 -
ctgtacatacattctgattcca

SEQ ID NO: 123624 - DNA, 22 bp, Artificial Sequence
  Synthetic oligonucleotide; TTC chr11 5341651 5341672 5341656 5341651 -
tgtacatacattctgattccat

SEQ ID NO: 123625 - DNA, 22 bp, Artificial Sequence
  Synthetic oligonucleotide; CTG chr11 5341649 5341670 5341654 5341649 -
tacatacattctgattccatgt

SEQ ID NO: 123626 - DNA, 22 bp, Artificial Sequence
  Synthetic oligonucleotide; TTC chr11 5341638 5341659 5341643 5341638 -
tgattccatgtaataagtgtaa

SEQ ID NO: 123627 - DNA, 22 bp, Artificial Sequence
  Synthetic oligonucleotide; CTG chr11 5341636 5341657 5341641 5341636 -
attccatgtaataagtgtaaat

SEQ ID NO: 123628 - DNA, 22 bp, Artificial Sequence
  Synthetic oligonucleotide; TTC chr11 5341632 5341653 5341637 5341632 -
catgtaataagtgtaaatttcc

SEQ ID NO: 123629 - DNA, 22 bp, Artificial Sequence
  Synthetic oligonucleotide; TTT chr11 5341612 5341633 5341617 5341612 -
cccaaagaatacaacaatgtca

SEQ ID NO: 123630 - DNA, 22 bp, Artificial Sequence
  Synthetic oligonucleotide; TTC chr11 5341611 5341632 5341616 5341611 -
ccaaagaatacaacaatgtcat

SEQ ID NO: 123631 - DNA, 22 bp, Artificial Sequence
  Synthetic oligonucleotide; TTC chr11 5341587 5341608 5341592 5341587 -
tcatttgattaaaattgtctga

SEQ ID NO: 123632 - DNA, 22 bp, Artificial Sequence
  Synthetic oligonucleotide; CTC chr11 5341585 5341606 5341590 5341585 -
atttgattaaaattgtctgatg

SEQ ID NO: 123633 - DNA, 22 bp, Artificial Sequence
  Synthetic oligonucleotide; TTT chr11 5341581 5341602 5341586 5341581 -
gattaaaattgtctgatgagtt

SEQ ID NO: 123634 - DNA, 22 bp, Artificial Sequence
  Synthetic oligonucleotide; TTG chr11 5341580 5341601 5341585 5341580 -
attaaaattgtctgatgagtta

SEQ ID NO: 123635 - DNA, 22 bp, Artificial Sequence
  Synthetic oligonucleotide; TTA chr11 5341576 5341597 5341581 5341576 -
aaattgtctgatgagttaggaa

SEQ ID NO: 123636 - DNA, 22 bp, Artificial Sequence
  Synthetic oligonucleotide; TTG chr11 5341570 5341591 5341575 5341570 -
tctgatgagttaggaagggacc

SEQ ID NO: 123637 - DNA, 22 bp, Artificial Sequence
  Synthetic oligonucleotide; CTG chr11 5341566 5341587 5341571 5341566 -
atgagttaggaagggacccata

SEQ ID NO: 123638 - DNA, 22 bp, Artificial Sequence
  Synthetic oligonucleotide; TTA chr11 5341558 5341579 5341563 5341558 -
ggaagggacccataactcaatt

SEQ ID NO: 123639 - DNA, 22 bp, Artificial Sequence
  Synthetic oligonucleotide; CTC chr11 5341540 5341561 5341545 5341540 -
aatttaaaatatcctaaaaaga

SEQ ID NO: 123640 - DNA, 22 bp, Artificial Sequence
  Synthetic oligonucleotide; TTT chr11 5341535 5341556 5341540 5341535 -
aaaatatcctaaaaagagggag

SEQ ID NO: 123641 - DNA, 22 bp, Artificial Sequence
  Synthetic oligonucleotide; TTA chr11 5341534 5341555 5341539 5341534 -
aaatatcctaaaaagagggagg

SEQ ID NO: 123642 - DNA, 22 bp, Artificial Sequence
  Synthetic oligonucleotide; CTA chr11 5341524 5341545 5341529 5341524 -
aaaagagggaggttatgtctta

SEQ ID NO: 123643 - DNA, 22 bp, Artificial Sequence
  Synthetic oligonucleotide; TTA chr11 5341509 5341530 5341514 5341509 -
tgtcttaattatactttaatca

SEQ ID NO: 123644 - DNA, 22 bp, Artificial Sequence
  Synthetic oligonucleotide; CTT chr11 5341503 5341524 5341508 5341503 -
aattatactttaatcagagcaa

SEQ ID NO: 123645 - DNA, 22 bp, Artificial Sequence
  Synthetic oligonucleotide; TTA chr11 5341502 5341523 5341507 5341502 -
attatactttaatcagagcaaa

SEQ ID NO: 123646 - DNA, 22 bp, Artificial Sequence
  Synthetic oligonucleotide; TTA chr11 5341498 5341519 5341503 5341498 -
tactttaatcagagcaaaaata

SEQ ID NO: 123647 - DNA, 22 bp, Artificial Sequence
  Synthetic oligonucleotide; CTT chr11 5341493 5341514 5341498 5341493 -
taatcagagcaaaaataatact

SEQ ID NO: 123648 - DNA, 22 bp, Artificial Sequence
  Synthetic oligonucleotide; TTT chr11 5341492 5341513 5341497 5341492 -
aatcagagcaaaaataatactt

SEQ ID NO: 123649 - DNA, 22 bp, Artificial Sequence
  Synthetic oligonucleotide; TTA chr11 5341491 5341512 5341496 5341491 -
atcagagcaaaaataatacttc

SEQ ID NO: 123650 - DNA, 22 bp, Artificial Sequence
  Synthetic oligonucleotide; CTT chr11 5341470 5341491 5341475 5341470 -
cagtgagacaagagaggggact

SEQ ID NO: 123651 - DNA, 22 bp, Artificial Sequence
  Synthetic oligonucleotide; TTC chr11 5341469 5341490 5341474 5341469 -
agtgagacaagagaggggacta

SEQ ID NO: 123652 - DNA, 22 bp, Artificial Sequence
  Synthetic oligonucleotide; CTA chr11 5341447 5341468 5341452 5341447 -
tatagaagatattgtttatgtc

SEQ ID NO: 123653 - DNA, 22 bp, Artificial Sequence
  Synthetic oligonucleotide; TTG chr11 5341433 5341454 5341438 5341433 -
tttatgtctttggtgttttacc

SEQ ID NO: 123654 - DNA, 22 bp, Artificial Sequence
  Synthetic oligonucleotide; TTT chr11 5341430 5341451 5341435 5341430 -
atgtctttggtgttttaccccg

SEQ ID NO: 123655 - DNA, 22 bp, Artificial Sequence
  Synthetic oligonucleotide; TTA chr11 5341429 5341450 5341434 5341429 -
tgtctttggtgttttaccccga

SEQ ID NO: 123656 - DNA, 22 bp, Artificial Sequence
  Synthetic oligonucleotide; CTT chr11 5341423 5341444 5341428 5341423 -
tggtgttttaccccgatcattt

SEQ ID NO: 123657 - DNA, 22 bp, Artificial Sequence
  Synthetic oligonucleotide; TTT chr11 5341422 5341443 5341427 5341422 -
ggtgttttaccccgatcatttt

SEQ ID NO: 123658 - DNA, 22 bp, Artificial Sequence
  Synthetic oligonucleotide; TTG chr11 5341421 5341442 5341426 5341421 -
gtgttttaccccgatcatttta

SEQ ID NO: 123659 - DNA, 22 bp, Artificial Sequence
  Synthetic oligonucleotide; TTT chr11 5341415 5341436 5341420 5341415 -
taccccgatcattttacagaat

SEQ ID NO: 123660 - DNA, 22 bp, Artificial Sequence
  Synthetic oligonucleotide; TTT chr11 5341414 5341435 5341419 5341414 -
accccgatcattttacagaatt

SEQ ID NO: 123661 - DNA, 22 bp, Artificial Sequence
  Synthetic oligonucleotide; TTA chr11 5341413 5341434 5341418 5341413 -
ccccgatcattttacagaattg

SEQ ID NO: 123662 - DNA, 22 bp, Artificial Sequence
  Synthetic oligonucleotide; TTT chr11 5341401 5341422 5341406 5341401 -
tacagaattgtgcacctgtgaa

SEQ ID NO: 123663 - DNA, 22 bp, Artificial Sequence
  Synthetic oligonucleotide; TTT chr11 5341400 5341421 5341405 5341400 -
acagaattgtgcacctgtgaat

SEQ ID NO: 123664 - DNA, 22 bp, Artificial Sequence
  Synthetic oligonucleotide; TTA chr11 5341399 5341420 5341404 5341399 -
cagaattgtgcacctgtgaatg

SEQ ID NO: 123665 - DNA, 22 bp, Artificial Sequence
  Synthetic oligonucleotide; TTG chr11 5341391 5341412 5341396 5341391 -
tgcacctgtgaatgttggctgc

SEQ ID NO: 123666 - DNA, 22 bp, Artificial Sequence
  Synthetic oligonucleotide; CTG chr11 5341383 5341404 5341388 5341383 -
tgaatgttggctgctcattgtt

SEQ ID NO: 123667 - DNA, 22 bp, Artificial Sequence
  Synthetic oligonucleotide; TTG chr11 5341374 5341395 5341379 5341374 -
gctgctcattgttcatgtttct

SEQ ID NO: 123668 - DNA, 22 bp, Artificial Sequence
  Synthetic oligonucleotide; CTG chr11 5341370 5341391 5341375 5341370 -
ctcattgttcatgtttctgctt

SEQ ID NO: 123669 - DNA, 22 bp, Artificial Sequence
  Synthetic oligonucleotide; CTC chr11 5341367 5341388 5341372 5341367 -
attgttcatgtttctgctttct

SEQ ID NO: 123670 - DNA, 22 bp, Artificial Sequence
  Synthetic oligonucleotide; TTG chr11 5341363 5341384 5341368 5341363 -
ttcatgtttctgctttctgcag

SEQ ID NO: 123671 - DNA, 22 bp, Artificial Sequence
  Synthetic oligonucleotide; TTC chr11 5341360 5341381 5341365 5341360 -
atgtttctgctttctgcaggtt

SEQ ID NO: 123672 - DNA, 22 bp, Artificial Sequence
  Synthetic oligonucleotide; TTT chr11 5341354 5341375 5341359 5341354 -
ctgctttctgcaggttgttgtt

SEQ ID NO: 123673 - DNA, 22 bp, Artificial Sequence
  Synthetic oligonucleotide; TTC chr11 5341353 5341374 5341358 5341353 -
tgctttctgcaggttgttgttc

SEQ ID NO: 123674 - DNA, 22 bp, Artificial Sequence
  Synthetic oligonucleotide; CTG chr11 5341351 5341372 5341356 5341351 -
ctttctgcaggttgttgttctc

SEQ ID NO: 123675 - DNA, 22 bp, Artificial Sequence
  Synthetic oligonucleotide; CTT chr11 5341348 5341369 5341353 5341348 -
tctgcaggttgttgttctcaac

SEQ ID NO: 123676 - DNA, 22 bp, Artificial Sequence
  Synthetic oligonucleotide; TTT chr11 5341347 5341368 5341352 5341347 -
ctgcaggttgttgttctcaact

SEQ ID NO: 123677 - DNA, 22 bp, Artificial Sequence
  Synthetic oligonucleotide; TTC chr11 5341346 5341367 5341351 5341346 -
tgcaggttgttgttctcaactc

SEQ ID NO: 123678 - DNA, 22 bp, Artificial Sequence
  Synthetic oligonucleotide; CTG chr11 5341344 5341365 5341349 5341344 -
caggttgttgttctcaactcag

SEQ ID NO: 123679 - DNA, 22 bp, Artificial Sequence
  Synthetic oligonucleotide; TTG chr11 5341337 5341358 5341342 5341337 -
ttgttctcaactcagcaggaaa

SEQ ID NO: 123680 - DNA, 22 bp, Artificial Sequence
  Synthetic oligonucleotide; TTG chr11 5341334 5341355 5341339 5341334 -
ttctcaactcagcaggaaatgt

SEQ ID NO: 123681 - DNA, 22 bp, Artificial Sequence
  Synthetic oligonucleotide; TTC chr11 5341331 5341352 5341336 5341331 -
tcaactcagcaggaaatgtctt

SEQ ID NO: 123682 - DNA, 22 bp, Artificial Sequence
  Synthetic oligonucleotide; CTC chr11 5341329 5341350 5341334 5341329 -
aactcagcaggaaatgtcttat

SEQ ID NO: 123683 - DNA, 22 bp, Artificial Sequence
  Synthetic oligonucleotide; CTC chr11 5341324 5341345 5341329 5341324 -
agcaggaaatgtcttatgaaga

SEQ ID NO: 123684 - DNA, 22 bp, Artificial Sequence
  Synthetic oligonucleotide; CTT chr11 5341309 5341330 5341314 5341309 -
atgaagaaaatggcccctgctc

SEQ ID NO: 123685 - DNA, 22 bp, Artificial Sequence
  Synthetic oligonucleotide; TTA chr11 5341308 5341329 5341313 5341308 -
tgaagaaaatggcccctgctcc

SEQ ID NO: 123686 - DNA, 22 bp, Artificial Sequence
  Synthetic oligonucleotide; CTG chr11 5341290 5341311 5341295 5341290 -
ctccttaggtagcaggccatag

SEQ ID NO: 123687 - DNA, 22 bp, Artificial Sequence
  Synthetic oligonucleotide; CTC chr11 5341287 5341308 5341292 5341287 -
cttaggtagcaggccataggca

SEQ ID NO: 123688 - DNA, 22 bp, Artificial Sequence
  Synthetic oligonucleotide; CTT chr11 5341284 5341305 5341289 5341284 -
aggtagcaggccataggcaaat

SEQ ID NO: 123689 - DNA, 22 bp, Artificial Sequence
  Synthetic oligonucleotide; TTA chr11 5341283 5341304 5341288 5341283 -
ggtagcaggccataggcaaata

SEQ ID NO: 123690 - DNA, 22 bp, Artificial Sequence
  Synthetic oligonucleotide; CTG chr11 5341258 5341279 5341263 5341258 -
accctcttgccttctgaagcta

SEQ ID NO: 123691 - DNA, 22 bp, Artificial Sequence
  Synthetic oligonucleotide; CTC chr11 5341252 5341273 5341257 5341252 -
ttgccttctgaagctaagctcc

SEQ ID NO: 123692 - DNA, 22 bp, Artificial Sequence
  Synthetic oligonucleotide; CTT chr11 5341250 5341271 5341255 5341250 -
gccttctgaagctaagctccag

SEQ ID NO: 123693 - DNA, 22 bp, Artificial Sequence
  Synthetic oligonucleotide; TTG chr11 5341249 5341270 5341254 5341249 -
ccttctgaagctaagctccagc

SEQ ID NO: 123694 - DNA, 22 bp, Artificial Sequence
  Synthetic oligonucleotide; CTT chr11 5341245 5341266 5341250 5341245 -
ctgaagctaagctccagcttca

SEQ ID NO: 123695 - DNA, 22 bp, Artificial Sequence
  Synthetic oligonucleotide; TTC chr11 5341244 5341265 5341249 5341244 -
tgaagctaagctccagcttcag

SEQ ID NO: 123696 - DNA, 22 bp, Artificial Sequence
  Synthetic oligonucleotide; CTG chr11 5341242 5341263 5341247 5341242 -
aagctaagctccagcttcagta

SEQ ID NO: 123697 - DNA, 22 bp, Artificial Sequence
  Synthetic oligonucleotide; CTA chr11 5341236 5341257 5341241 5341236 -
agctccagcttcagtatgcact

SEQ ID NO: 123698 - DNA, 22 bp, Artificial Sequence
  Synthetic oligonucleotide; CTC chr11 5341231 5341252 5341236 5341231 -
cagcttcagtatgcacttgctt

SEQ ID NO: 123699 - DNA, 22 bp, Artificial Sequence
  Synthetic oligonucleotide; CTT chr11 5341225 5341246 5341230 5341225 -
cagtatgcacttgcttacctcc

SEQ ID NO: 123700 - DNA, 22 bp, Artificial Sequence
  Synthetic oligonucleotide; TTC chr11 5341224 5341245 5341229 5341224 -
agtatgcacttgcttacctcct

SEQ ID NO: 123701 - DNA, 22 bp, Artificial Sequence
  Synthetic oligonucleotide; CTT chr11 5341213 5341234 5341218 5341213 -
gcttacctccttcccctgtcca

SEQ ID NO: 123702 - DNA, 22 bp, Artificial Sequence
  Synthetic oligonucleotide; TTG chr11 5341212 5341233 5341217 5341212 -
cttacctccttcccctgtccac

SEQ ID NO: 123703 - DNA, 22 bp, Artificial Sequence
  Synthetic oligonucleotide; CTT chr11 5341209 5341230 5341214 5341209 -
acctccttcccctgtccacact

SEQ ID NO: 123704 - DNA, 22 bp, Artificial Sequence
  Synthetic oligonucleotide; TTA chr11 5341208 5341229 5341213 5341208 -
cctccttcccctgtccacactg

SEQ ID NO: 123705 - DNA, 22 bp, Artificial Sequence
  Synthetic oligonucleotide; CTC chr11 5341204 5341225 5341209 5341204 -
cttcccctgtccacactgcttt

SEQ ID NO: 123706 - DNA, 22 bp, Artificial Sequence
  Synthetic oligonucleotide; CTT chr11 5341201 5341222 5341206 5341201 -
cccctgtccacactgcttttac

SEQ ID NO: 123707 - DNA, 22 bp, Artificial Sequence
  Synthetic oligonucleotide; TTC chr11 5341200 5341221 5341205 5341200 -
ccctgtccacactgcttttact

SEQ ID NO: 123708 - DNA, 22 bp, Artificial Sequence
  Synthetic oligonucleotide; CTG chr11 5341195 5341216 5341200 5341195 -
tccacactgcttttacttgctc

SEQ ID NO: 123709 - DNA, 22 bp, Artificial Sequence
  Synthetic oligonucleotide; CTG chr11 5341186 5341207 5341191 5341186 -
cttttacttgctccctgtctcc

SEQ ID NO: 123710 - DNA, 22 bp, Artificial Sequence
  Synthetic oligonucleotide; CTT chr11 5341183 5341204 5341188 5341183 -
ttacttgctccctgtctcctga

SEQ ID NO: 123711 - DNA, 22 bp, Artificial Sequence
  Synthetic oligonucleotide; TTT chr11 5341182 5341203 5341187 5341182 -
tacttgctccctgtctcctgag

SEQ ID NO: 123712 - DNA, 22 bp, Artificial Sequence
  Synthetic oligonucleotide; TTT chr11 5341181 5341202 5341186 5341181 -
acttgctccctgtctcctgaga

SEQ ID NO: 123713 - DNA, 22 bp, Artificial Sequence
  Synthetic oligonucleotide; TTA chr11 5341180 5341201 5341185 5341180 -
cttgctccctgtctcctgagag

SEQ ID NO: 123714 - DNA, 22 bp, Artificial Sequence
  Synthetic oligonucleotide; CTT chr11 5341177 5341198 5341182 5341177 -
gctccctgtctcctgagagcat

SEQ ID NO: 123715 - DNA, 22 bp, Artificial Sequence
  Synthetic oligonucleotide; TTG chr11 5341176 5341197 5341181 5341176 -
ctccctgtctcctgagagcatt

SEQ ID NO: 123716 - DNA, 22 bp, Artificial Sequence
  Synthetic oligonucleotide; CTC chr11 5341173 5341194 5341178 5341173 -
cctgtctcctgagagcattcat

SEQ ID NO: 123717 - DNA, 22 bp, Artificial Sequence
  Synthetic oligonucleotide; CTG chr11 5341169 5341190 5341174 5341169 -
tctcctgagagcattcattaat

SEQ ID NO: 123718 - DNA, 22 bp, Artificial Sequence
  Synthetic oligonucleotide; CTC chr11 5341165 5341186 5341170 5341165 -
ctgagagcattcattaataaat

SEQ ID NO: 123719 - DNA, 22 bp, Artificial Sequence
  Synthetic oligonucleotide; CTG chr11 5341162 5341183 5341167 5341162 -
agagcattcattaataaattgc

SEQ ID NO: 123720 - DNA, 22 bp, Artificial Sequence
  Synthetic oligonucleotide; TTC chr11 5341153 5341174 5341158 5341153 -
attaataaattgcacacatttg

SEQ ID NO: 123721 - DNA, 22 bp, Artificial Sequence
  Synthetic oligonucleotide; TTA chr11 5341149 5341170 5341154 5341149 -
ataaattgcacacatttgaatc

SEQ ID NO: 123722 - DNA, 22 bp, Artificial Sequence
  Synthetic oligonucleotide; TTG chr11 5341141 5341162 5341146 5341141 -
cacacatttgaatccctatctc

SEQ ID NO: 123723 - DNA, 22 bp, Artificial Sequence
  Synthetic oligonucleotide; TTT chr11 5341132 5341153 5341137 5341132 -
gaatccctatctcaggtattgc

SEQ ID NO: 123724 - DNA, 22 bp, Artificial Sequence
  Synthetic oligonucleotide; TTG chr11 5341131 5341152 5341136 5341131 -
aatccctatctcaggtattgct

SEQ ID NO: 123725 - DNA, 22 bp, Artificial Sequence
  Synthetic oligonucleotide; CTA chr11 5341123 5341144 5341128 5341123 -
tctcaggtattgctcatagaga

SEQ ID NO: 123726 - DNA, 22 bp, Artificial Sequence
  Synthetic oligonucleotide; CTC chr11 5341119 5341140 5341124 5341119 -
aggtattgctcatagagagtcc

SEQ ID NO: 123727 - DNA, 22 bp, Artificial Sequence
  Synthetic oligonucleotide; TTG chr11 5341111 5341132 5341116 5341111 -
ctcatagagagtccaacttaag

SEQ ID NO: 123728 - DNA, 22 bp, Artificial Sequence
  Synthetic oligonucleotide; CTC chr11 5341108 5341129 5341113 5341108 -
atagagagtccaacttaagaaa

SEQ ID NO: 123729 - DNA, 22 bp, Artificial Sequence
  Synthetic oligonucleotide; CTT chr11 5341092 5341113 5341097 5341092 -
aagaaaaactgcaatccttatt

SEQ ID NO: 123730 - DNA, 22 bp, Artificial Sequence
  Synthetic oligonucleotide; TTA chr11 5341091 5341112 5341096 5341091 -
agaaaaactgcaatccttattt

SEQ ID NO: 123731 - DNA, 22 bp, Artificial Sequence
  Synthetic oligonucleotide; CTG chr11 5341081 5341102 5341086 5341081 -
caatccttatttatattctgtt

SEQ ID NO: 123732 - DNA, 22 bp, Artificial Sequence
  Synthetic oligonucleotide; CTT chr11 5341073 5341094 5341078 5341073 -
atttatattctgtttcattaag

SEQ ID NO: 123733 - DNA, 22 bp, Artificial Sequence
  Synthetic oligonucleotide; TTA chr11 5341072 5341093 5341077 5341072 -
tttatattctgtttcattaaga

SEQ ID NO: 123734 - DNA, 22 bp, Artificial Sequence
  Synthetic oligonucleotide; TTT chr11 5341069 5341090 5341074 5341069 -
atattctgtttcattaagagat

SEQ ID NO: 123735 - DNA, 22 bp, Artificial Sequence
  Synthetic oligonucleotide; TTA chr11 5341068 5341089 5341073 5341068 -
tattctgtttcattaagagatg

SEQ ID NO: 123736 - DNA, 22 bp, Artificial Sequence
  Synthetic oligonucleotide; TTC chr11 5341063 5341084 5341068 5341063 -
tgtttcattaagagatgtaatt

SEQ ID NO: 123737 - DNA, 22 bp, Artificial Sequence
  Synthetic oligonucleotide; CTG chr11 5341061 5341082 5341066 5341061 -
tttcattaagagatgtaattgt

SEQ ID NO: 123738 - DNA, 22 bp, Artificial Sequence
  Synthetic oligonucleotide; TTT chr11 5341058 5341079 5341063 5341058 -
cattaagagatgtaattgtgaa

SEQ ID NO: 123739 - DNA, 22 bp, Artificial Sequence
  Synthetic oligonucleotide; TTC chr11 5341057 5341078 5341062 5341057 -
attaagagatgtaattgtgaaa

SEQ ID NO: 123740 - DNA, 22 bp, Artificial Sequence
  Synthetic oligonucleotide; TTA chr11 5341053 5341074 5341058 5341053 -
agagatgtaattgtgaaagaac

SEQ ID NO: 123741 - DNA, 22 bp, Artificial Sequence
  Synthetic oligonucleotide; TTG chr11 5341040 5341061 5341045 5341040 -
tgaaagaactgaacatataaaa

SEQ ID NO: 123742 - DNA, 22 bp, Artificial Sequence
  Synthetic oligonucleotide; CTG chr11 5341029 5341050 5341034 5341029 -
aacatataaaaaaatcagcttt

SEQ ID NO: 123743 - DNA, 22 bp, Artificial Sequence
  Synthetic oligonucleotide; CTT chr11 5341008 5341029 5341013 5341008 -
tatcatgttttttatccttgtc

SEQ ID NO: 123744 - DNA, 22 bp, Artificial Sequence
  Synthetic oligonucleotide; TTT chr11 5341007 5341028 5341012 5341007 -
atcatgttttttatccttgtca

SEQ ID NO: 123745 - DNA, 22 bp, Artificial Sequence
  Synthetic oligonucleotide; TTA chr11 5341006 5341027 5341011 5341006 -
tcatgttttttatccttgtcac

SEQ ID NO: 123746 - DNA, 22 bp, Artificial Sequence
  Synthetic oligonucleotide; TTT chr11 5340998 5341019 5341003 5340998 -
tttatccttgtcacgccatgtc

SEQ ID NO: 123747 - DNA, 22 bp, Artificial Sequence
  Synthetic oligonucleotide; TTT chr11 5340997 5341018 5341002 5340997 -
ttatccttgtcacgccatgtca

SEQ ID NO: 123748 - DNA, 22 bp, Artificial Sequence
  Synthetic oligonucleotide; TTT chr11 5340996 5341017 5341001 5340996 -
tatccttgtcacgccatgtcac

SEQ ID NO: 123749 - DNA, 22 bp, Artificial Sequence
  Synthetic oligonucleotide; TTT chr11 5340995 5341016 5341000 5340995 -
atccttgtcacgccatgtcacc

SEQ ID NO: 123750 - DNA, 22 bp, Artificial Sequence
  Synthetic oligonucleotide; TTA chr11 5340994 5341015 5340999 5340994 -
tccttgtcacgccatgtcacct

SEQ ID NO: 123751 - DNA, 22 bp, Artificial Sequence
  Synthetic oligonucleotide; CTT chr11 5340989 5341010 5340994 5340989 -
gtcacgccatgtcacctgagca

SEQ ID NO: 123752 - DNA, 22 bp, Artificial Sequence
  Synthetic oligonucleotide; TTG chr11 5340988 5341009 5340993 5340988 -
tcacgccatgtcacctgagcaa

SEQ ID NO: 123753 - DNA, 22 bp, Artificial Sequence
  Synthetic oligonucleotide; CTG chr11 5340971 5340992 5340976 5340971 -
agcaacacagtctgaatactaa

SEQ ID NO: 123754 - DNA, 22 bp, Artificial Sequence
  Synthetic oligonucleotide; CTG chr11 5340957 5340978 5340962 5340957 -
aatactaaattgtgagtgtgag

SEQ ID NO: 123755 - DNA, 22 bp, Artificial Sequence
  Synthetic oligonucleotide; CTA chr11 5340950 5340971 5340955 5340950 -
aattgtgagtgtgagtgcatat

SEQ ID NO: 123756 - DNA, 22 bp, Artificial Sequence
  Synthetic oligonucleotide; TTG chr11 5340945 5340966 5340950 5340945 -
tgagtgtgagtgcatatatgtg

SEQ ID NO: 123757 - DNA, 22 bp, Artificial Sequence
  Synthetic oligonucleotide; TTT chr11 5340912 5340933 5340917 5340912 -
ttgtcctgttttcaatcattca

SEQ ID NO: 123758 - DNA, 22 bp, Artificial Sequence
  Synthetic oligonucleotide; TTT chr11 5340911 5340932 5340916 5340911 -
tgtcctgttttcaatcattcat

SEQ ID NO: 123759 - DNA, 22 bp, Artificial Sequence
  Synthetic oligonucleotide; TTT chr11 5340910 5340931 5340915 5340910 -
gtcctgttttcaatcattcata

SEQ ID NO: 123760 - DNA, 22 bp, Artificial Sequence
  Synthetic oligonucleotide; TTG chr11 5340909 5340930 5340914 5340909 -
tcctgttttcaatcattcataa

SEQ ID NO: 123761 - DNA, 22 bp, Artificial Sequence
  Synthetic oligonucleotide; CTG chr11 5340904 5340925 5340909 5340904 -
ttttcaatcattcataaaacca

SEQ ID NO: 123762 - DNA, 22 bp, Artificial Sequence
  Synthetic oligonucleotide; TTT chr11 5340901 5340922 5340906 5340901 -
tcaatcattcataaaaccaaac

SEQ ID NO: 123763 - DNA, 22 bp, Artificial Sequence
  Synthetic oligonucleotide; TTT chr11 5340900 5340921 5340905 5340900 -
caatcattcataaaaccaaaca

SEQ ID NO: 123764 - DNA, 22 bp, Artificial Sequence
  Synthetic oligonucleotide; TTC chr11 5340899 5340920 5340904 5340899 -
aatcattcataaaaccaaacat

SEQ ID NO: 123765 - DNA, 22 bp, Artificial Sequence
  Synthetic oligonucleotide; TTC chr11 5340891 5340912 5340896 5340891 -
ataaaaccaaacatgtgtccct

SEQ ID NO: 123766 - DNA, 22 bp, Artificial Sequence
  Synthetic oligonucleotide; CTT chr11 5340868 5340889 5340873 5340868 -
aattatgctctactacatccac

SEQ ID NO: 123767 - DNA, 22 bp, Artificial Sequence
  Synthetic oligonucleotide; TTA chr11 5340867 5340888 5340872 5340867 -
attatgctctactacatccaca

SEQ ID NO: 123768 - DNA, 22 bp, Artificial Sequence
  Synthetic oligonucleotide; TTA chr11 5340863 5340884 5340868 5340863 -
tgctctactacatccacaactt

SEQ ID NO: 123769 - DNA, 22 bp, Artificial Sequence
  Synthetic oligonucleotide; CTC chr11 5340858 5340879 5340863 5340858 -
tactacatccacaacttatttt

SEQ ID NO: 123770 - DNA, 22 bp, Artificial Sequence
  Synthetic oligonucleotide; CTA chr11 5340856 5340877 5340861 5340856 -
ctacatccacaacttattttat

SEQ ID NO: 123771 - DNA, 22 bp, Artificial Sequence
  Synthetic oligonucleotide; CTA chr11 5340853 5340874 5340858 5340853 -
catccacaacttattttattca

SEQ ID NO: 123772 - DNA, 22 bp, Artificial Sequence
  Synthetic oligonucleotide; CTT chr11 5340841 5340862 5340846 5340841 -
attttattcataaaaatattgt

SEQ ID NO: 123773 - DNA, 22 bp, Artificial Sequence
  Synthetic oligonucleotide; TTA chr11 5340840 5340861 5340845 5340840 -
ttttattcataaaaatattgtg

SEQ ID NO: 123774 - DNA, 22 bp, Artificial Sequence
  Synthetic oligonucleotide; TTT chr11 5340837 5340858 5340842 5340837 -
tattcataaaaatattgtgggg

SEQ ID NO: 123775 - DNA, 22 bp, Artificial Sequence
  Synthetic oligonucleotide; TTT chr11 5340836 5340857 5340841 5340836 -
attcataaaaatattgtggggt

SEQ ID NO: 123776 - DNA, 22 bp, Artificial Sequence
  Synthetic oligonucleotide; TTA chr11 5340835 5340856 5340840 5340835 -
ttcataaaaatattgtggggta

SEQ ID NO: 123777 - DNA, 22 bp, Artificial Sequence
  Synthetic oligonucleotide; TTC chr11 5340832 5340853 5340837 5340832 -
ataaaaatattgtggggtagat

SEQ ID NO: 123778 - DNA, 22 bp, Artificial Sequence
  Synthetic oligonucleotide; TTG chr11 5340820 5340841 5340825 5340820 -
tggggtagatattatcactgtt

SEQ ID NO: 123779 - DNA, 22 bp, Artificial Sequence
  Synthetic oligonucleotide; TTA chr11 5340806 5340827 5340811 5340806 -
tcactgttttcttgatggggaa

SEQ ID NO: 123780 - DNA, 22 bp, Artificial Sequence
  Synthetic oligonucleotide; CTG chr11 5340800 5340821 5340805 5340800 -
ttttcttgatggggaaatttaa

SEQ ID NO: 123781 - DNA, 22 bp, Artificial Sequence
  Synthetic oligonucleotide; TTT chr11 5340797 5340818 5340802 5340797 -
tcttgatggggaaatttaatat

SEQ ID NO: 123782 - DNA, 22 bp, Artificial Sequence
  Synthetic oligonucleotide; TTT chr11 5340796 5340817 5340801 5340796 -
cttgatggggaaatttaatata

SEQ ID NO: 123783 - DNA, 22 bp, Artificial Sequence
  Synthetic oligonucleotide; TTC chr11 5340795 5340816 5340800 5340795 -
ttgatggggaaatttaatataa

SEQ ID NO: 123784 - DNA, 22 bp, Artificial Sequence
  Synthetic oligonucleotide; CTT chr11 5340793 5340814 5340798 5340793 -
gatggggaaatttaatataaaa

SEQ ID NO: 123785 - DNA, 22 bp, Artificial Sequence
  Synthetic oligonucleotide; TTG chr11 5340792 5340813 5340797 5340792 -
atggggaaatttaatataaaaa

SEQ ID NO: 123786 - DNA, 22 bp, Artificial Sequence
  Synthetic oligonucleotide; TTT chr11 5340780 5340801 5340785 5340780 -
aatataaaaaagttaaatattc

SEQ ID NO: 123787 - DNA, 22 bp, Artificial Sequence
  Synthetic oligonucleotide; TTA chr11 5340779 5340800 5340784 5340779 -
atataaaaaagttaaatattcc

SEQ ID NO: 123788 - DNA, 22 bp, Artificial Sequence
  Synthetic oligonucleotide; TTA chr11 5340765 5340786 5340770 5340765 -
aatattccctccaagggcataa

SEQ ID NO: 123789 - DNA, 22 bp, Artificial Sequence
  Synthetic oligonucleotide; TTC chr11 5340758 5340779 5340763 5340758 -
cctccaagggcataacattttt

SEQ ID NO: 123790 - DNA, 22 bp, Artificial Sequence
  Synthetic oligonucleotide; CTC chr11 5340754 5340775 5340759 5340754 -
caagggcataacatttttaatt

SEQ ID NO: 123791 - DNA, 22 bp, Artificial Sequence
  Synthetic oligonucleotide; TTT chr11 5340738 5340759 5340743 5340738 -
ttaattggtatagtcatgattc

SEQ ID NO: 123792 - DNA, 22 bp, Artificial Sequence
  Synthetic oligonucleotide; TTT chr11 5340737 5340758 5340742 5340737 -
taattggtatagtcatgattca

SEQ ID NO: 123793 - DNA, 22 bp, Artificial Sequence
  Synthetic oligonucleotide; TTT chr11 5340736 5340757 5340741 5340736 -
aattggtatagtcatgattcaa

SEQ ID NO: 123794 - DNA, 22 bp, Artificial Sequence
  Synthetic oligonucleotide; TTA chr11 5340735 5340756 5340740 5340735 -
attggtatagtcatgattcaaa

SEQ ID NO: 123795 - DNA, 22 bp, Artificial Sequence
  Synthetic oligonucleotide; TTG chr11 5340731 5340752 5340736 5340731 -
gtatagtcatgattcaaattta

SEQ ID NO: 123796 - DNA, 22 bp, Artificial Sequence
  Synthetic oligonucleotide; TTC chr11 5340716 5340737 5340721 5340716 -
aaatttatatcttctaactata

SEQ ID NO: 123797 - DNA, 22 bp, Artificial Sequence
  Synthetic oligonucleotide; TTT chr11 5340710 5340731 5340715 5340710 -
atatcttctaactataaggcca

SEQ ID NO: 123798 - DNA, 22 bp, Artificial Sequence
  Synthetic oligonucleotide; TTA chr11 5340709 5340730 5340714 5340709 -
tatcttctaactataaggccag

SEQ ID NO: 123799 - DNA, 22 bp, Artificial Sequence
  Synthetic oligonucleotide; CTT chr11 5340703 5340724 5340708 5340703 -
ctaactataaggccagtgtgaa

SEQ ID NO: 123800 - DNA, 22 bp, Artificial Sequence
  Synthetic oligonucleotide; TTC chr11 5340702 5340723 5340707 5340702 -
taactataaggccagtgtgaat

SEQ ID NO: 123801 - DNA, 22 bp, Artificial Sequence
  Synthetic oligonucleotide; CTA chr11 5340700 5340721 5340705 5340700 -
actataaggccagtgtgaatgg

SEQ ID NO: 123802 - DNA, 22 bp, Artificial Sequence
  Synthetic oligonucleotide; CTA chr11 5340696 5340717 5340701 5340696 -
taaggccagtgtgaatggtact

SEQ ID NO: 123803 - DNA, 22 bp, Artificial Sequence
  Synthetic oligonucleotide; CTC chr11 5340673 5340694 5340678 5340673 -
cactacagtagactatccttag

SEQ ID NO: 123804 - DNA, 22 bp, Artificial Sequence
  Synthetic oligonucleotide; CTA chr11 5340668 5340689 5340673 5340668 -
cagtagactatccttagtggct

SEQ ID NO: 123805 - DNA, 22 bp, Artificial Sequence
  Synthetic oligonucleotide; CTA chr11 5340658 5340679 5340663 5340658 -
tccttagtggcttctacttttt

SEQ ID NO: 123806 - DNA, 22 bp, Artificial Sequence
  Synthetic oligonucleotide; CTT chr11 5340653 5340674 5340658 5340653 -
agtggcttctactttttgcctt

SEQ ID NO: 123807 - DNA, 22 bp, Artificial Sequence
  Synthetic oligonucleotide; TTA chr11 5340652 5340673 5340657 5340652 -
gtggcttctactttttgccttg

SEQ ID NO: 123808 - DNA, 22 bp, Artificial Sequence
  Synthetic oligonucleotide; CTT chr11 5340645 5340666 5340650 5340645 -
ctactttttgccttgtattccg

SEQ ID NO: 123809 - DNA, 22 bp, Artificial Sequence
  Synthetic oligonucleotide; TTC chr11 5340644 5340665 5340649 5340644 -
tactttttgccttgtattccgt

SEQ ID NO: 123810 - DNA, 22 bp, Artificial Sequence
  Synthetic oligonucleotide; CTA chr11 5340642 5340663 5340647 5340642 -
ctttttgccttgtattccgtca

SEQ ID NO: 123811 - DNA, 22 bp, Artificial Sequence
  Synthetic oligonucleotide; CTT chr11 5340639 5340660 5340644 5340639 -
tttgccttgtattccgtcatgc

SEQ ID NO: 123812 - DNA, 22 bp, Artificial Sequence
  Synthetic oligonucleotide; TTT chr11 5340638 5340659 5340643 5340638 -
ttgccttgtattccgtcatgct

SEQ ID NO: 123813 - DNA, 22 bp, Artificial Sequence
  Synthetic oligonucleotide; TTT chr11 5340637 5340658 5340642 5340637 -
tgccttgtattccgtcatgctt

SEQ ID NO: 123814 - DNA, 22 bp, Artificial Sequence
  Synthetic oligonucleotide; TTT chr11 5340636 5340657 5340641 5340636 -
gccttgtattccgtcatgcttg

SEQ ID NO: 123815 - DNA, 22 bp, Artificial Sequence
  Synthetic oligonucleotide; TTG chr11 5340635 5340656 5340640 5340635 -
ccttgtattccgtcatgcttgt

SEQ ID NO: 123816 - DNA, 22 bp, Artificial Sequence
  Synthetic oligonucleotide; CTT chr11 5340631 5340652 5340636 5340631 -
gtattccgtcatgcttgtagta

SEQ ID NO: 123817 - DNA, 22 bp, Artificial Sequence
  Synthetic oligonucleotide; TTG chr11 5340630 5340651 5340635 5340630 -
tattccgtcatgcttgtagtac

SEQ ID NO: 123818 - DNA, 22 bp, Artificial Sequence
  Synthetic oligonucleotide; TTC chr11 5340625 5340646 5340630 5340625 -
cgtcatgcttgtagtacctact

SEQ ID NO: 123819 - DNA, 22 bp, Artificial Sequence
  Synthetic oligonucleotide; CTT chr11 5340615 5340636 5340620 5340615 -
gtagtacctactttctttttct

SEQ ID NO: 123820 - DNA, 22 bp, Artificial Sequence
  Synthetic oligonucleotide; TTG chr11 5340614 5340635 5340619 5340614 -
tagtacctactttctttttctg

SEQ ID NO: 123821 - DNA, 22 bp, Artificial Sequence
  Synthetic oligonucleotide; CTA chr11 5340605 5340626 5340610 5340605 -
ctttctttttctgaaaatttct

SEQ ID NO: 123822 - DNA, 22 bp, Artificial Sequence
  Synthetic oligonucleotide; CTT chr11 5340602 5340623 5340607 5340602 -
tctttttctgaaaatttctcct

SEQ ID NO: 123823 - DNA, 22 bp, Artificial Sequence
  Synthetic oligonucleotide; TTT chr11 5340601 5340622 5340606 5340601 -
ctttttctgaaaatttctcctc

SEQ ID NO: 123824 - DNA, 22 bp, Artificial Sequence
  Synthetic oligonucleotide; TTC chr11 5340600 5340621 5340605 5340600 -
tttttctgaaaatttctcctcc

SEQ ID NO: 123825 - DNA, 22 bp, Artificial Sequence
  Synthetic oligonucleotide; CTT chr11 5340598 5340619 5340603 5340598 -
tttctgaaaatttctcctcctt

SEQ ID NO: 123826 - DNA, 22 bp, Artificial Sequence
  Synthetic oligonucleotide; TTT chr11 5340597 5340618 5340602 5340597 -
ttctgaaaatttctcctccttc

SEQ ID NO: 123827 - DNA, 22 bp, Artificial Sequence
  Synthetic oligonucleotide; TTT chr11 5340596 5340617 5340601 5340596 -
tctgaaaatttctcctccttct

SEQ ID NO: 123828 - DNA, 22 bp, Artificial Sequence
  Synthetic oligonucleotide; TTT chr11 5340595 5340616 5340600 5340595 -
ctgaaaatttctcctccttcta

SEQ ID NO: 123829 - DNA, 22 bp, Artificial Sequence
  Synthetic oligonucleotide; TTC chr11 5340594 5340615 5340599 5340594 -
tgaaaatttctcctccttctac

SEQ ID NO: 123830 - DNA, 22 bp, Artificial Sequence
  Synthetic oligonucleotide; CTG chr11 5340592 5340613 5340597 5340592 -
aaaatttctcctccttctactc

SEQ ID NO: 123831 - DNA, 22 bp, Artificial Sequence
  Synthetic oligonucleotide; TTT chr11 5340585 5340606 5340590 5340585 -
ctcctccttctactccaaaaat

SEQ ID NO: 123832 - DNA, 22 bp, Artificial Sequence
  Synthetic oligonucleotide; TTC chr11 5340584 5340605 5340589 5340584 -
tcctccttctactccaaaaata

SEQ ID NO: 123833 - DNA, 22 bp, Artificial Sequence
  Synthetic oligonucleotide; CTC chr11 5340582 5340603 5340587 5340582 -
ctccttctactccaaaaatatt

SEQ ID NO: 123834 - DNA, 22 bp, Artificial Sequence
  Synthetic oligonucleotide; CTC chr11 5340579 5340600 5340584 5340579 -
cttctactccaaaaatattgtt

SEQ ID NO: 123835 - DNA, 22 bp, Artificial Sequence
  Synthetic oligonucleotide; CTT chr11 5340576 5340597 5340581 5340576 -
ctactccaaaaatattgttccc

SEQ ID NO: 123836 - DNA, 22 bp, Artificial Sequence
  Synthetic oligonucleotide; TTC chr11 5340575 5340596 5340580 5340575 -
tactccaaaaatattgttccct

SEQ ID NO: 123837 - DNA, 22 bp, Artificial Sequence
  Synthetic oligonucleotide; CTA chr11 5340573 5340594 5340578 5340573 -
ctccaaaaatattgttccctat

SEQ ID NO: 123838 - DNA, 22 bp, Artificial Sequence
  Synthetic oligonucleotide; CTC chr11 5340570 5340591 5340575 5340570 -
caaaaatattgttccctatgaa

SEQ ID NO: 123839 - DNA, 22 bp, Artificial Sequence
  Synthetic oligonucleotide; TTG chr11 5340559 5340580 5340564 5340559 -
ttccctatgaaaactgatattt

SEQ ID NO: 123840 - DNA, 22 bp, Artificial Sequence
  Synthetic oligonucleotide; TTC chr11 5340556 5340577 5340561 5340556 -
cctatgaaaactgatattttgc

SEQ ID NO: 123841 - DNA, 22 bp, Artificial Sequence
  Synthetic oligonucleotide; CTA chr11 5340552 5340573 5340557 5340552 -
tgaaaactgatattttgcattg

SEQ ID NO: 123842 - DNA, 22 bp, Artificial Sequence
  Synthetic oligonucleotide; CTG chr11 5340543 5340564 5340548 5340543 -
atattttgcattgtatctccaa

SEQ ID NO: 123843 - DNA, 22 bp, Artificial Sequence
  Synthetic oligonucleotide; TTT chr11 5340537 5340558 5340542 5340537 -
tgcattgtatctccaaactcct

SEQ ID NO: 123844 - DNA, 22 bp, Artificial Sequence
  Synthetic oligonucleotide; TTT chr11 5340536 5340557 5340541 5340536 -
gcattgtatctccaaactccta

SEQ ID NO: 123845 - DNA, 22 bp, Artificial Sequence
  Synthetic oligonucleotide; TTG chr11 5340535 5340556 5340540 5340535 -
cattgtatctccaaactcctaa

SEQ ID NO: 123846 - DNA, 22 bp, Artificial Sequence
  Synthetic oligonucleotide; TTG chr11 5340530 5340551 5340535 5340530 -
tatctccaaactcctaaccgca

SEQ ID NO: 123847 - DNA, 22 bp, Artificial Sequence
  Synthetic oligonucleotide; CTC chr11 5340524 5340545 5340529 5340524 -
caaactcctaaccgcagtagaa

SEQ ID NO: 123848 - DNA, 22 bp, Artificial Sequence
  Synthetic oligonucleotide; CTC chr11 5340517 5340538 5340522 5340517 -
ctaaccgcagtagaagaacttt

SEQ ID NO: 123849 - DNA, 22 bp, Artificial Sequence
  Synthetic oligonucleotide; CTA chr11 5340514 5340535 5340519 5340514 -
accgcagtagaagaactttttt

SEQ ID NO: 123850 - DNA, 22 bp, Artificial Sequence
  Synthetic oligonucleotide; CTT chr11 5340496 5340517 5340501 5340496 -
ttttaaaaagaatttttcaata

SEQ ID NO: 123851 - DNA, 22 bp, Artificial Sequence
  Synthetic oligonucleotide; TTT chr11 5340495 5340516 5340500 5340495 -
tttaaaaagaatttttcaatat

SEQ ID NO: 123852 - DNA, 22 bp, Artificial Sequence
  Synthetic oligonucleotide; TTT chr11 5340494 5340515 5340499 5340494 -
ttaaaaagaatttttcaatatg

SEQ ID NO: 123853 - DNA, 22 bp, Artificial Sequence
  Synthetic oligonucleotide; TTT chr11 5340493 5340514 5340498 5340493 -
taaaaagaatttttcaatatga

SEQ ID NO: 123854 - DNA, 22 bp, Artificial Sequence
  Synthetic oligonucleotide; TTT chr11 5340492 5340513 5340497 5340492 -
aaaaagaatttttcaatatgac

SEQ ID NO: 123855 - DNA, 22 bp, Artificial Sequence
  Synthetic oligonucleotide; TTA chr11 5340491 5340512 5340496 5340491 -
aaaagaatttttcaatatgaca

SEQ ID NO: 123856 - DNA, 22 bp, Artificial Sequence
  Synthetic oligonucleotide; TTT chr11 5340481 5340502 5340486 5340481 -
ttcaatatgacattgcaaaaaa

SEQ ID NO: 123857 - DNA, 22 bp, Artificial Sequence
  Synthetic oligonucleotide; TTT chr11 5340480 5340501 5340485 5340480 -
tcaatatgacattgcaaaaaaa

SEQ ID NO: 123858 - DNA, 22 bp, Artificial Sequence
  Synthetic oligonucleotide; TTT chr11 5340479 5340500 5340484 5340479 -
caatatgacattgcaaaaaaaa

SEQ ID NO: 123859 - DNA, 22 bp, Artificial Sequence
  Synthetic oligonucleotide; TTC chr11 5340478 5340499 5340483 5340478 -
aatatgacattgcaaaaaaaaa

SEQ ID NO: 123860 - DNA, 22 bp, Artificial Sequence
  Synthetic oligonucleotide; TTG chr11 5340466 5340487 5340471 5340466 -
caaaaaaaaaaagagtaatgct

SEQ ID NO: 123861 - DNA, 22 bp, Artificial Sequence
  Synthetic oligonucleotide; CTT chr11 5340443 5340464 5340448 5340443 -
ttgttgtagaattactaaaatg

SEQ ID NO: 123862 - DNA, 22 bp, Artificial Sequence
  Synthetic oligonucleotide; TTT chr11 5340442 5340463 5340447 5340442 -
tgttgtagaattactaaaatgc

SEQ ID NO: 123863 - DNA, 22 bp, Artificial Sequence
  Synthetic oligonucleotide; TTT chr11 5340441 5340462 5340446 5340441 -
gttgtagaattactaaaatgca

SEQ ID NO: 123864 - DNA, 22 bp, Artificial Sequence
  Synthetic oligonucleotide; TTG chr11 5340440 5340461 5340445 5340440 -
ttgtagaattactaaaatgcaa

SEQ ID NO: 123865 - DNA, 22 bp, Artificial Sequence
  Synthetic oligonucleotide; TTG chr11 5340437 5340458 5340442 5340437 -
tagaattactaaaatgcaatgc

SEQ ID NO: 123866 - DNA, 22 bp, Artificial Sequence
  Synthetic oligonucleotide; TTA chr11 5340429 5340450 5340434 5340429 -
ctaaaatgcaatgcttagaatt

SEQ ID NO: 123867 - DNA, 22 bp, Artificial Sequence
  Synthetic oligonucleotide; CTA chr11 5340426 5340447 5340431 5340426 -
aaatgcaatgcttagaattgtt

SEQ ID NO: 123868 - DNA, 22 bp, Artificial Sequence
  Synthetic oligonucleotide; CTT chr11 5340413 5340434 5340418 5340413 -
agaattgttaatgacaatgttt

SEQ ID NO: 123869 - DNA, 22 bp, Artificial Sequence
  Synthetic oligonucleotide; TTA chr11 5340412 5340433 5340417 5340412 -
gaattgttaatgacaatgtttt

SEQ ID NO: 123870 - DNA, 22 bp, Artificial Sequence
  Synthetic oligonucleotide; TTG chr11 5340406 5340427 5340411 5340406 -
ttaatgacaatgtttttcatca

SEQ ID NO: 123871 - DNA, 22 bp, Artificial Sequence
  Synthetic oligonucleotide; TTA chr11 5340403 5340424 5340408 5340403 -
atgacaatgtttttcatcaggc

SEQ ID NO: 123872 - DNA, 22 bp, Artificial Sequence
  Synthetic oligonucleotide; TTT chr11 5340391 5340412 5340396 5340391 -
ttcatcaggcaagtgacttcaa

SEQ ID NO: 123873 - DNA, 22 bp, Artificial Sequence
  Synthetic oligonucleotide; TTT chr11 5340390 5340411 5340395 5340390 -
tcatcaggcaagtgacttcaaa

SEQ ID NO: 123874 - DNA, 22 bp, Artificial Sequence
  Synthetic oligonucleotide; TTT chr11 5340389 5340410 5340394 5340389 -
catcaggcaagtgacttcaaac

SEQ ID NO: 123875 - DNA, 22 bp, Artificial Sequence
  Synthetic oligonucleotide; TTC chr11 5340388 5340409 5340393 5340388 -
atcaggcaagtgacttcaaact

SEQ ID NO: 123876 - DNA, 22 bp, Artificial Sequence
  Synthetic oligonucleotide; CTT chr11 5340372 5340393 5340377 5340372 -
caaactataataaatatttaga

SEQ ID NO: 123877 - DNA, 22 bp, Artificial Sequence
  Synthetic oligonucleotide; TTC chr11 5340371 5340392 5340376 5340371 -
aaactataataaatatttagag

SEQ ID NO: 123878 - DNA, 22 bp, Artificial Sequence
  Synthetic oligonucleotide; CTA chr11 5340365 5340386 5340370 5340365 -
taataaatatttagagtaaatt

SEQ ID NO: 123879 - DNA, 22 bp, Artificial Sequence
  Synthetic oligonucleotide; TTT chr11 5340353 5340374 5340358 5340353 -
agagtaaattatagataaagaa

SEQ ID NO: 123880 - DNA, 22 bp, Artificial Sequence
  Synthetic oligonucleotide; TTA chr11 5340352 5340373 5340357 5340352 -
gagtaaattatagataaagaaa

SEQ ID NO: 123881 - DNA, 22 bp, Artificial Sequence
  Synthetic oligonucleotide; TTA chr11 5340342 5340363 5340347 5340342 -
tagataaagaaatgataataaa

SEQ ID NO: 123882 - DNA, 22 bp, Artificial Sequence
  Synthetic oligonucleotide; CTT chr11 5340307 5340328 5340312 5340307 -
caaatctctgattccatgtttt

SEQ ID NO: 123883 - DNA, 22 bp, Artificial Sequence
  Synthetic oligonucleotide; TTC chr11 5340306 5340327 5340311 5340306 -
aaatctctgattccatgttttc

SEQ ID NO: 123884 - DNA, 22 bp, Artificial Sequence
  Synthetic oligonucleotide; CTC chr11 5340299 5340320 5340304 5340299 -
tgattccatgttttcctgagac

SEQ ID NO: 123885 - DNA, 22 bp, Artificial Sequence
  Synthetic oligonucleotide; CTG chr11 5340297 5340318 5340302 5340297 -
attccatgttttcctgagactc

SEQ ID NO: 123886 - DNA, 22 bp, Artificial Sequence
  Synthetic oligonucleotide; TTC chr11 5340293 5340314 5340298 5340293 -
catgttttcctgagactcagtg

SEQ ID NO: 123887 - DNA, 22 bp, Artificial Sequence
  Synthetic oligonucleotide; TTT chr11 5340286 5340307 5340291 5340286 -
tcctgagactcagtgacaagga

SEQ ID NO: 123888 - DNA, 22 bp, Artificial Sequence
  Synthetic oligonucleotide; TTT chr11 5340285 5340306 5340290 5340285 -
cctgagactcagtgacaaggag

SEQ ID NO: 123889 - DNA, 22 bp, Artificial Sequence
  Synthetic oligonucleotide; TTC chr11 5340284 5340305 5340289 5340284 -
ctgagactcagtgacaaggagg

SEQ ID NO: 123890 - DNA, 22 bp, Artificial Sequence
  Synthetic oligonucleotide; CTG chr11 5340281 5340302 5340286 5340281 -
agactcagtgacaaggaggaca

SEQ ID NO: 123891 - DNA, 22 bp, Artificial Sequence
  Synthetic oligonucleotide; CTC chr11 5340275 5340296 5340280 5340275 -
agtgacaaggaggacagtttga

SEQ ID NO: 123892 - DNA, 22 bp, Artificial Sequence
  Synthetic oligonucleotide; TTT chr11 5340255 5340276 5340260 5340255 -
gaatcttttttttgattccaca

SEQ ID NO: 123893 - DNA, 22 bp, Artificial Sequence
  Synthetic oligonucleotide; TTG chr11 5340254 5340275 5340259 5340254 -
aatcttttttttgattccacag

SEQ ID NO: 123894 - DNA, 22 bp, Artificial Sequence
  Synthetic oligonucleotide; CTT chr11 5340248 5340269 5340253 5340248 -
ttttttgattccacagcctaat

SEQ ID NO: 123895 - DNA, 22 bp, Artificial Sequence
  Synthetic oligonucleotide; TTT chr11 5340247 5340268 5340252 5340247 -
tttttgattccacagcctaata

SEQ ID NO: 123896 - DNA, 22 bp, Artificial Sequence
  Synthetic oligonucleotide; TTT chr11 5340246 5340267 5340251 5340246 -
ttttgattccacagcctaataa

SEQ ID NO: 123897 - DNA, 22 bp, Artificial Sequence
  Synthetic oligonucleotide; TTT chr11 5340245 5340266 5340250 5340245 -
tttgattccacagcctaataaa

SEQ ID NO: 123898 - DNA, 22 bp, Artificial Sequence
  Synthetic oligonucleotide; TTT chr11 5340244 5340265 5340249 5340244 -
ttgattccacagcctaataaac

SEQ ID NO: 123899 - DNA, 22 bp, Artificial Sequence
  Synthetic oligonucleotide; TTT chr11 5340243 5340264 5340248 5340243 -
tgattccacagcctaataaact

SEQ ID NO: 123900 - DNA, 22 bp, Artificial Sequence
  Synthetic oligonucleotide; TTT chr11 5340242 5340263 5340247 5340242 -
gattccacagcctaataaactc

SEQ ID NO: 123901 - DNA, 22 bp, Artificial Sequence
  Synthetic oligonucleotide; TTG chr11 5340241 5340262 5340246 5340241 -
attccacagcctaataaactcc

SEQ ID NO: 123902 - DNA, 22 bp, Artificial Sequence
  Synthetic oligonucleotide; TTC chr11 5340237 5340258 5340242 5340237 -
cacagcctaataaactcctctt

SEQ ID NO: 123903 - DNA, 22 bp, Artificial Sequence
  Synthetic oligonucleotide; CTA chr11 5340228 5340249 5340233 5340228 -
ataaactcctcttcttgtaatt

SEQ ID NO: 123904 - DNA, 22 bp, Artificial Sequence
  Synthetic oligonucleotide; CTC chr11 5340220 5340241 5340225 5340220 -
ctcttcttgtaatttgttttgt

SEQ ID NO: 123905 - DNA, 22 bp, Artificial Sequence
  Synthetic oligonucleotide; CTC chr11 5340217 5340238 5340222 5340217 -
ttcttgtaatttgttttgttca

SEQ ID NO: 123906 - DNA, 22 bp, Artificial Sequence
  Synthetic oligonucleotide; CTT chr11 5340215 5340236 5340220 5340215 -
cttgtaatttgttttgttcagc

SEQ ID NO: 123907 - DNA, 22 bp, Artificial Sequence
  Synthetic oligonucleotide; TTC chr11 5340214 5340235 5340219 5340214 -
ttgtaatttgttttgttcagcc

SEQ ID NO: 123908 - DNA, 22 bp, Artificial Sequence
  Synthetic oligonucleotide; CTT chr11 5340212 5340233 5340217 5340212 -
gtaatttgttttgttcagccta

SEQ ID NO: 123909 - DNA, 22 bp, Artificial Sequence
  Synthetic oligonucleotide; TTG chr11 5340211 5340232 5340216 5340211 -
taatttgttttgttcagcctag

SEQ ID NO: 123910 - DNA, 22 bp, Artificial Sequence
  Synthetic oligonucleotide; TTT chr11 5340205 5340226 5340210 5340205 -
gttttgttcagcctagtttcag

SEQ ID NO: 123911 - DNA, 22 bp, Artificial Sequence
  Synthetic oligonucleotide; TTG chr11 5340204 5340225 5340209 5340204 -
ttttgttcagcctagtttcagt

SEQ ID NO: 123912 - DNA, 22 bp, Artificial Sequence
  Synthetic oligonucleotide; TTT chr11 5340201 5340222 5340206 5340201 -
tgttcagcctagtttcagttga

SEQ ID NO: 123913 - DNA, 22 bp, Artificial Sequence
  Synthetic oligonucleotide; TTT chr11 5340200 5340221 5340205 5340200 -
gttcagcctagtttcagttgag

SEQ ID NO: 123914 - DNA, 22 bp, Artificial Sequence
  Synthetic oligonucleotide; TTG chr11 5340199 5340220 5340204 5340199 -
ttcagcctagtttcagttgagt

SEQ ID NO: 123915 - DNA, 22 bp, Artificial Sequence
  Synthetic oligonucleotide; TTC chr11 5340196 5340217 5340201 5340196 -
agcctagtttcagttgagtttc

SEQ ID NO: 123916 - DNA, 22 bp, Artificial Sequence
  Synthetic oligonucleotide; CTA chr11 5340190 5340211 5340195 5340190 -
gtttcagttgagtttcacttat

SEQ ID NO: 123917 - DNA, 22 bp, Artificial Sequence
  Synthetic oligonucleotide; TTT chr11 5340186 5340207 5340191 5340186 -
cagttgagtttcacttataacc

SEQ ID NO: 123918 - DNA, 22 bp, Artificial Sequence
  Synthetic oligonucleotide; TTC chr11 5340185 5340206 5340190 5340185 -
agttgagtttcacttataacca

SEQ ID NO: 123919 - DNA, 22 bp, Artificial Sequence
  Synthetic oligonucleotide; TTG chr11 5340180 5340201 5340185 5340180 -
agtttcacttataaccaaaggc

SEQ ID NO: 123920 - DNA, 22 bp, Artificial Sequence
  Synthetic oligonucleotide; TTT chr11 5340175 5340196 5340180 5340175 -
cacttataaccaaaggctatta

SEQ ID NO: 123921 - DNA, 22 bp, Artificial Sequence
  Synthetic oligonucleotide; TTC chr11 5340174 5340195 5340179 5340174 -
acttataaccaaaggctattaa

SEQ ID NO: 123922 - DNA, 22 bp, Artificial Sequence
  Synthetic oligonucleotide; CTT chr11 5340170 5340191 5340175 5340170 -
ataaccaaaggctattaataat

SEQ ID NO: 123923 - DNA, 22 bp, Artificial Sequence
  Synthetic oligonucleotide; TTA chr11 5340169 5340190 5340174 5340169 -
taaccaaaggctattaataatt

SEQ ID NO: 123924 - DNA, 22 bp, Artificial Sequence
  Synthetic oligonucleotide; CTA chr11 5340156 5340177 5340161 5340156 -
ttaataattatatcatctcagt

SEQ ID NO: 123925 - DNA, 22 bp, Artificial Sequence
  Synthetic oligonucleotide; TTA chr11 5340153 5340174 5340158 5340153 -
ataattatatcatctcagttat

SEQ ID NO: 123926 - DNA, 22 bp, Artificial Sequence
  Synthetic oligonucleotide; TTA chr11 5340146 5340167 5340151 5340146 -
tatcatctcagttatagatatg

SEQ ID NO: 123927 - DNA, 22 bp, Artificial Sequence
  Synthetic oligonucleotide; CTC chr11 5340137 5340158 5340142 5340137 -
agttatagatatgtgaatcttc

SEQ ID NO: 123928 - DNA, 22 bp, Artificial Sequence
  Synthetic oligonucleotide; TTA chr11 5340132 5340153 5340137 5340132 -
tagatatgtgaatcttctctaa

SEQ ID NO: 123929 - DNA, 22 bp, Artificial Sequence
  Synthetic oligonucleotide; CTT chr11 5340116 5340137 5340121 5340116 -
ctctaactaatatttaaaactg

SEQ ID NO: 123930 - DNA, 22 bp, Artificial Sequence
  Synthetic oligonucleotide; TTC chr11 5340115 5340136 5340120 5340115 -
tctaactaatatttaaaactgg

SEQ ID NO: 123931 - DNA, 22 bp, Artificial Sequence
  Synthetic oligonucleotide; CTC chr11 5340113 5340134 5340118 5340113 -
taactaatatttaaaactggaa

SEQ ID NO: 123932 - DNA, 22 bp, Artificial Sequence
  Synthetic oligonucleotide; CTA chr11 5340111 5340132 5340116 5340111 -
actaatatttaaaactggaaaa

SEQ ID NO: 123933 - DNA, 22 bp, Artificial Sequence
  Synthetic oligonucleotide; CTA chr11 5340107 5340128 5340112 5340107 -
atatttaaaactggaaaatact

SEQ ID NO: 123934 - DNA, 22 bp, Artificial Sequence
  Synthetic oligonucleotide; TTT chr11 5340101 5340122 5340106 5340101 -
aaaactggaaaatactgttagg

SEQ ID NO: 123935 - DNA, 22 bp, Artificial Sequence
  Synthetic oligonucleotide; TTA chr11 5340100 5340121 5340105 5340100 -
aaactggaaaatactgttaggt

SEQ ID NO: 123936 - DNA, 22 bp, Artificial Sequence
  Synthetic oligonucleotide; CTG chr11 5340094 5340115 5340099 5340094 -
gaaaatactgttaggtagaaga

SEQ ID NO: 123937 - DNA, 22 bp, Artificial Sequence
  Synthetic oligonucleotide; CTG chr11 5340084 5340105 5340089 5340084 -
ttaggtagaagagctgcctctt

SEQ ID NO: 123938 - DNA, 22 bp, Artificial Sequence
  Synthetic oligonucleotide; TTA chr11 5340081 5340102 5340086 5340081 -
ggtagaagagctgcctcttttt

SEQ ID NO: 123939 - DNA, 22 bp, Artificial Sequence
  Synthetic oligonucleotide; CTG chr11 5340068 5340089 5340073 5340068 -
cctctttttctaaaatacagga

SEQ ID NO: 123940 - DNA, 22 bp, Artificial Sequence
  Synthetic oligonucleotide; CTC chr11 5340064 5340085 5340069 5340064 -
tttttctaaaatacaggaaatg

SEQ ID NO: 123941 - DNA, 22 bp, Artificial Sequence
  Synthetic oligonucleotide; CTT chr11 5340062 5340083 5340067 5340062 -
tttctaaaatacaggaaatgga

SEQ ID NO: 123942 - DNA, 22 bp, Artificial Sequence
  Synthetic oligonucleotide; TTT chr11 5340061 5340082 5340066 5340061 -
ttctaaaatacaggaaatggaa

SEQ ID NO: 123943 - DNA, 22 bp, Artificial Sequence
  Synthetic oligonucleotide; TTT chr11 5340060 5340081 5340065 5340060 -
tctaaaatacaggaaatggaac

SEQ ID NO: 123944 - DNA, 22 bp, Artificial Sequence
  Synthetic oligonucleotide; TTT chr11 5340059 5340080 5340064 5340059 -
ctaaaatacaggaaatggaacc

SEQ ID NO: 123945 - DNA, 22 bp, Artificial Sequence
  Synthetic oligonucleotide; TTC chr11 5340058 5340079 5340063 5340058 -
taaaatacaggaaatggaacct

SEQ ID NO: 123946 - DNA, 22 bp, Artificial Sequence
  Synthetic oligonucleotide; CTA chr11 5340056 5340077 5340061 5340056 -
aaatacaggaaatggaacctaa

SEQ ID NO: 123947 - DNA, 22 bp, Artificial Sequence
  Synthetic oligonucleotide; CTA chr11 5340035 5340056 5340040 5340035 -
aaaatggcaggaaagttgacca

SEQ ID NO: 123948 - DNA, 22 bp, Artificial Sequence
  Synthetic oligonucleotide; TTG chr11 5340017 5340038 5340022 5340017 -
accatttggtgaatgatttatg

SEQ ID NO: 123949 - DNA, 22 bp, Artificial Sequence
  Synthetic oligonucleotide; TTT chr11 5340010 5340031 5340015 5340010 -
ggtgaatgatttatgaagttat

SEQ ID NO: 123950 - DNA, 22 bp, Artificial Sequence
  Synthetic oligonucleotide; TTG chr11 5340009 5340030 5340014 5340009 -
gtgaatgatttatgaagttatt

SEQ ID NO: 123951 - DNA, 22 bp, Artificial Sequence
  Synthetic oligonucleotide; TTT chr11 5339998 5340019 5340003 5339998 -
atgaagttatttcccttgttta

SEQ ID NO: 123952 - DNA, 22 bp, Artificial Sequence
  Synthetic oligonucleotide; TTA chr11 5339997 5340018 5340002 5339997 -
tgaagttatttcccttgtttaa

SEQ ID NO: 123953 - DNA, 22 bp, Artificial Sequence
  Synthetic oligonucleotide; TTA chr11 5339989 5340010 5339994 5339989 -
tttcccttgtttaagaagttca

SEQ ID NO: 123954 - DNA, 22 bp, Artificial Sequence
  Synthetic oligonucleotide; TTT chr11 5339986 5340007 5339991 5339986 -
cccttgtttaagaagttcattt

SEQ ID NO: 123955 - DNA, 22 bp, Artificial Sequence
  Synthetic oligonucleotide; TTC chr11 5339985 5340006 5339990 5339985 -
ccttgtttaagaagttcatttc

SEQ ID NO: 123956 - DNA, 22 bp, Artificial Sequence
  Synthetic oligonucleotide; CTT chr11 5339981 5340002 5339986 5339981 -
gtttaagaagttcatttctgac

SEQ ID NO: 123957 - DNA, 22 bp, Artificial Sequence
  Synthetic oligonucleotide; TTG chr11 5339980 5340001 5339985 5339980 -
tttaagaagttcatttctgact

SEQ ID NO: 123958 - DNA, 22 bp, Artificial Sequence
  Synthetic oligonucleotide; TTT chr11 5339977 5339998 5339982 5339977 -
aagaagttcatttctgacttga

SEQ ID NO: 123959 - DNA, 22 bp, Artificial Sequence
  Synthetic oligonucleotide; TTA chr11 5339976 5339997 5339981 5339976 -
agaagttcatttctgacttgaa

SEQ ID NO: 123960 - DNA, 22 bp, Artificial Sequence
  Synthetic oligonucleotide; TTC chr11 5339968 5339989 5339973 5339968 -
atttctgacttgaaagtaagtg

SEQ ID NO: 123961 - DNA, 22 bp, Artificial Sequence
  Synthetic oligonucleotide; TTT chr11 5339964 5339985 5339969 5339964 -
ctgacttgaaagtaagtgtgaa

SEQ ID NO: 123962 - DNA, 22 bp, Artificial Sequence
  Synthetic oligonucleotide; TTC chr11 5339963 5339984 5339968 5339963 -
tgacttgaaagtaagtgtgaaa

SEQ ID NO: 123963 - DNA, 22 bp, Artificial Sequence
  Synthetic oligonucleotide; CTG chr11 5339961 5339982 5339966 5339961 -
acttgaaagtaagtgtgaaact

SEQ ID NO: 123964 - DNA, 22 bp, Artificial Sequence
  Synthetic oligonucleotide; CTT chr11 5339957 5339978 5339962 5339957 -
gaaagtaagtgtgaaactaaat

SEQ ID NO: 123965 - DNA, 22 bp, Artificial Sequence
  Synthetic oligonucleotide; TTG chr11 5339956 5339977 5339961 5339956 -
aaagtaagtgtgaaactaaatt

SEQ ID NO: 123966 - DNA, 22 bp, Artificial Sequence
  Synthetic oligonucleotide; CTA chr11 5339938 5339959 5339943 5339938 -
aattcactgagaagatgctgta

SEQ ID NO: 123967 - DNA, 22 bp, Artificial Sequence
  Synthetic oligonucleotide; TTC chr11 5339933 5339954 5339938 5339933 -
actgagaagatgctgtaggatg

SEQ ID NO: 123968 - DNA, 22 bp, Artificial Sequence
  Synthetic oligonucleotide; CTG chr11 5339929 5339950 5339934 5339929 -
agaagatgctgtaggatgaata

SEQ ID NO: 123969 - DNA, 22 bp, Artificial Sequence
  Synthetic oligonucleotide; CTG chr11 5339918 5339939 5339923 5339918 -
taggatgaatacagacacagga

SEQ ID NO: 123970 - DNA, 22 bp, Artificial Sequence
  Synthetic oligonucleotide; CTA chr11 5339873 5339894 5339878 5339873 -
aataattatctcaaacttagtt

SEQ ID NO: 123971 - DNA, 22 bp, Artificial Sequence
  Synthetic oligonucleotide; TTA chr11 5339865 5339886 5339870 5339865 -
tctcaaacttagttatacagaa

SEQ ID NO: 123972 - DNA, 22 bp, Artificial Sequence
  Synthetic oligonucleotide; CTC chr11 5339861 5339882 5339866 5339861 -
aaacttagttatacagaaggct

SEQ ID NO: 123973 - DNA, 22 bp, Artificial Sequence
  Synthetic oligonucleotide; CTT chr11 5339855 5339876 5339860 5339855 -
agttatacagaaggctacatgg

SEQ ID NO: 123974 - DNA, 22 bp, Artificial Sequence
  Synthetic oligonucleotide; TTA chr11 5339854 5339875 5339859 5339854 -
gttatacagaaggctacatggt

SEQ ID NO: 123975 - DNA, 22 bp, Artificial Sequence
  Synthetic oligonucleotide; TTA chr11 5339850 5339871 5339855 5339850 -
tacagaaggctacatggtggaa

SEQ ID NO: 123976 - DNA, 22 bp, Artificial Sequence
  Synthetic oligonucleotide; CTA chr11 5339838 5339859 5339843 5339838 -
catggtggaaatccactcagac

SEQ ID NO: 123977 - DNA, 22 bp, Artificial Sequence
  Synthetic oligonucleotide; CTC chr11 5339820 5339841 5339825 5339820 -
agacatgtttttctattcaaaa

SEQ ID NO: 123978 - DNA, 22 bp, Artificial Sequence
  Synthetic oligonucleotide; TTT chr11 5339810 5339831 5339815 5339810 -
ttctattcaaaacccattgtaa

SEQ ID NO: 123979 - DNA, 22 bp, Artificial Sequence
  Synthetic oligonucleotide; TTT chr11 5339809 5339830 5339814 5339809 -
tctattcaaaacccattgtaac

SEQ ID NO: 123980 - DNA, 22 bp, Artificial Sequence
  Synthetic oligonucleotide; TTT chr11 5339808 5339829 5339813 5339808 -
ctattcaaaacccattgtaaca

SEQ ID NO: 123981 - DNA, 22 bp, Artificial Sequence
  Synthetic oligonucleotide; TTC chr11 5339807 5339828 5339812 5339807 -
tattcaaaacccattgtaacaa

SEQ ID NO: 123982 - DNA, 22 bp, Artificial Sequence
  Synthetic oligonucleotide; CTA chr11 5339805 5339826 5339810 5339805 -
ttcaaaacccattgtaacaatc

SEQ ID NO: 123983 - DNA, 22 bp, Artificial Sequence
  Synthetic oligonucleotide; TTC chr11 5339802 5339823 5339807 5339802 -
aaaacccattgtaacaatcaac

SEQ ID NO: 123984 - DNA, 22 bp, Artificial Sequence
  Synthetic oligonucleotide; TTG chr11 5339791 5339812 5339796 5339791 -
taacaatcaacataaacacagt

SEQ ID NO: 123985 - DNA, 22 bp, Artificial Sequence
  Synthetic oligonucleotide; TTA chr11 5339763 5339784 5339768 5339763 -
gtattatcataaaatttagaac

SEQ ID NO: 123986 - DNA, 22 bp, Artificial Sequence
  Synthetic oligonucleotide; TTA chr11 5339757 5339778 5339762 5339757 -
tcataaaatttagaactttctg

SEQ ID NO: 123987 - DNA, 22 bp, Artificial Sequence
  Synthetic oligonucleotide; TTT chr11 5339746 5339767 5339751 5339746 -
agaactttctgtgatctcctac

SEQ ID NO: 123988 - DNA, 22 bp, Artificial Sequence
  Synthetic oligonucleotide; TTA chr11 5339745 5339766 5339750 5339745 -
gaactttctgtgatctcctaca

SEQ ID NO: 123989 - DNA, 22 bp, Artificial Sequence
  Synthetic oligonucleotide; CTT chr11 5339739 5339760 5339744 5339739 -
tctgtgatctcctacaagtctt

SEQ ID NO: 123990 - DNA, 22 bp, Artificial Sequence
  Synthetic oligonucleotide; TTT chr11 5339738 5339759 5339743 5339738 -
ctgtgatctcctacaagtcttc

SEQ ID NO: 123991 - DNA, 22 bp, Artificial Sequence
  Synthetic oligonucleotide; TTC chr11 5339737 5339758 5339742 5339737 -
tgtgatctcctacaagtcttcc

SEQ ID NO: 123992 - DNA, 22 bp, Artificial Sequence
  Synthetic oligonucleotide; CTG chr11 5339735 5339756 5339740 5339735 -
tgatctcctacaagtcttcctg

SEQ ID NO: 123993 - DNA, 22 bp, Artificial Sequence
  Synthetic oligonucleotide; CTC chr11 5339728 5339749 5339733 5339728 -
ctacaagtcttcctgtggtaaa

SEQ ID NO: 123994 - DNA, 22 bp, Artificial Sequence
  Synthetic oligonucleotide; CTA chr11 5339725 5339746 5339730 5339725 -
caagtcttcctgtggtaaaatg

SEQ ID NO: 123995 - DNA, 22 bp, Artificial Sequence
  Synthetic oligonucleotide; CTT chr11 5339717 5339738 5339722 5339717 -
cctgtggtaaaatgctatgtac

SEQ ID NO: 123996 - DNA, 22 bp, Artificial Sequence
  Synthetic oligonucleotide; TTC chr11 5339716 5339737 5339721 5339716 -
ctgtggtaaaatgctatgtact

SEQ ID NO: 123997 - DNA, 22 bp, Artificial Sequence
  Synthetic oligonucleotide; CTG chr11 5339713 5339734 5339718 5339713 -
tggtaaaatgctatgtactatt

SEQ ID NO: 123998 - DNA, 22 bp, Artificial Sequence
  Synthetic oligonucleotide; CTA chr11 5339700 5339721 5339705 5339700 -
tgtactattagaagccttagca

SEQ ID NO: 123999 - DNA, 22 bp, Artificial Sequence
  Synthetic oligonucleotide; CTA chr11 5339693 5339714 5339698 5339693 -
ttagaagccttagcaaattaat

SEQ ID NO: 124000 - DNA, 22 bp, Artificial Sequence
  Synthetic oligonucleotide; TTA chr11 5339690 5339711 5339695 5339690 -
gaagccttagcaaattaataca

SEQ ID NO: 124001 - DNA, 22 bp, Artificial Sequence
  Synthetic oligonucleotide; CTT chr11 5339682 5339703 5339687 5339682 -
agcaaattaatacaggaacaga

SEQ ID NO: 124002 - DNA, 22 bp, Artificial Sequence
  Synthetic oligonucleotide; TTA chr11 5339681 5339702 5339686 5339681 -
gcaaattaatacaggaacagaa

SEQ ID NO: 124003 - DNA, 22 bp, Artificial Sequence
  Synthetic oligonucleotide; TTA chr11 5339673 5339694 5339678 5339673 -
atacaggaacagaaaaccaaat

SEQ ID NO: 124004 - DNA, 22 bp, Artificial Sequence
  Synthetic oligonucleotide; TTC chr11 5339640 5339661 5339645 5339640 -
tcacttatgagtgggagctaaa

SEQ ID NO: 124005 - DNA, 22 bp, Artificial Sequence
  Synthetic oligonucleotide; CTC chr11 5339638 5339659 5339643 5339638 -
acttatgagtgggagctaaatg

SEQ ID NO: 124006 - DNA, 22 bp, Artificial Sequence
  Synthetic oligonucleotide; CTT chr11 5339634 5339655 5339639 5339634 -
atgagtgggagctaaatgatga

SEQ ID NO: 124007 - DNA, 22 bp, Artificial Sequence
  Synthetic oligonucleotide; TTA chr11 5339633 5339654 5339638 5339633 -
tgagtgggagctaaatgatgag

SEQ ID NO: 124008 - DNA, 22 bp, Artificial Sequence
  Synthetic oligonucleotide; CTA chr11 5339620 5339641 5339625 5339620 -
aatgatgagaacacatggacac

SEQ ID NO: 124009 - DNA, 22 bp, Artificial Sequence
  Synthetic oligonucleotide; CTG chr11 5339575 5339596 5339580 5339575 -
gggcctattggaggatggaggg

SEQ ID NO: 124010 - DNA, 22 bp, Artificial Sequence
  Synthetic oligonucleotide; CTA chr11 5339568 5339589 5339573 5339568 -
ttggaggatggagggtgaaagg

SEQ ID NO: 124011 - DNA, 22 bp, Artificial Sequence
  Synthetic oligonucleotide; TTG chr11 5339565 5339586 5339570 5339565 -
gaggatggagggtgaaaggagg

SEQ ID NO: 124012 - DNA, 22 bp, Artificial Sequence
  Synthetic oligonucleotide; CTA chr11 5339510 5339531 5339515 5339510 -
ggcttaatacctgagtgagtga

SEQ ID NO: 124013 - DNA, 22 bp, Artificial Sequence
  Synthetic oligonucleotide; CTT chr11 5339505 5339526 5339510 5339505 -
aatacctgagtgagtgatgaca

SEQ ID NO: 124014 - DNA, 22 bp, Artificial Sequence
  Synthetic oligonucleotide; TTA chr11 5339504 5339525 5339509 5339504 -
atacctgagtgagtgatgacat

SEQ ID NO: 124015 - DNA, 22 bp, Artificial Sequence
  Synthetic oligonucleotide; CTG chr11 5339497 5339518 5339502 5339497 -
agtgagtgatgacataatctgt

SEQ ID NO: 124016 - DNA, 22 bp, Artificial Sequence
  Synthetic oligonucleotide; CTG chr11 5339476 5339497 5339481 5339476 -
tacaacaaaccctcgtgacaca

SEQ ID NO: 124017 - DNA, 22 bp, Artificial Sequence
  Synthetic oligonucleotide; CTC chr11 5339462 5339483 5339467 5339462 -
gtgacacaagtttaaatatgta

SEQ ID NO: 124018 - DNA, 22 bp, Artificial Sequence
  Synthetic oligonucleotide; TTT chr11 5339449 5339470 5339454 5339449 -
aaatatgtaacagacctgctct

SEQ ID NO: 124019 - DNA, 22 bp, Artificial Sequence
  Synthetic oligonucleotide; TTA chr11 5339448 5339469 5339453 5339448 -
aatatgtaacagacctgctctt

SEQ ID NO: 124020 - DNA, 22 bp, Artificial Sequence
  Synthetic oligonucleotide; CTG chr11 5339431 5339452 5339436 5339431 -
ctcttgtactcctgaacctaaa

SEQ ID NO: 124021 - DNA, 22 bp, Artificial Sequence
  Synthetic oligonucleotide; CTC chr11 5339428 5339449 5339433 5339428 -
ttgtactcctgaacctaaaata

SEQ ID NO: 124022 - DNA, 22 bp, Artificial Sequence
  Synthetic oligonucleotide; CTT chr11 5339426 5339447 5339431 5339426 -
gtactcctgaacctaaaataaa

SEQ ID NO: 124023 - DNA, 22 bp, Artificial Sequence
  Synthetic oligonucleotide; TTG chr11 5339425 5339446 5339430 5339425 -
tactcctgaacctaaaataaaa

SEQ ID NO: 124024 - DNA, 22 bp, Artificial Sequence
  Synthetic oligonucleotide; CTC chr11 5339420 5339441 5339425 5339420 -
ctgaacctaaaataaaagttag

SEQ ID NO: 124025 - DNA, 22 bp, Artificial Sequence
  Synthetic oligonucleotide; CTG chr11 5339417 5339438 5339422 5339417 -
aacctaaaataaaagttagtta

SEQ ID NO: 124026 - DNA, 22 bp, Artificial Sequence
  Synthetic oligonucleotide; CTA chr11 5339411 5339432 5339416 5339411 -
aaataaaagttagttaggaaaa

SEQ ID NO: 124027 - DNA, 22 bp, Artificial Sequence
  Synthetic oligonucleotide; TTA chr11 5339399 5339420 5339404 5339399 -
gttaggaaaagaagcctattta

SEQ ID NO: 124028 - DNA, 22 bp, Artificial Sequence
  Synthetic oligonucleotide; TTA chr11 5339395 5339416 5339400 5339395 -
ggaaaagaagcctatttataac

SEQ ID NO: 124029 - DNA, 22 bp, Artificial Sequence
  Synthetic oligonucleotide; CTA chr11 5339381 5339402 5339386 5339381 -
tttataacactatctcctagga

SEQ ID NO: 124030 - DNA, 22 bp, Artificial Sequence
  Synthetic oligonucleotide; TTT chr11 5339378 5339399 5339383 5339378 -
ataacactatctcctaggaaac

SEQ ID NO: 124031 - DNA, 22 bp, Artificial Sequence
  Synthetic oligonucleotide; TTA chr11 5339377 5339398 5339382 5339377 -
taacactatctcctaggaaaca

SEQ ID NO: 124032 - DNA, 22 bp, Artificial Sequence
  Synthetic oligonucleotide; CTA chr11 5339369 5339390 5339374 5339369 -
tctcctaggaaacactgcacat

SEQ ID NO: 124033 - DNA, 22 bp, Artificial Sequence
  Synthetic oligonucleotide; CTC chr11 5339365 5339386 5339370 5339365 -
ctaggaaacactgcacatgaat

SEQ ID NO: 124034 - DNA, 22 bp, Artificial Sequence
  Synthetic oligonucleotide; CTA chr11 5339362 5339383 5339367 5339362 -
ggaaacactgcacatgaatttg

SEQ ID NO: 124035 - DNA, 22 bp, Artificial Sequence
  Synthetic oligonucleotide; CTG chr11 5339352 5339373 5339357 5339352 -
cacatgaatttgtattcataag

SEQ ID NO: 124036 - DNA, 22 bp, Artificial Sequence
  Synthetic oligonucleotide; TTT chr11 5339341 5339362 5339346 5339341 -
gtattcataagaagagtagaat

SEQ ID NO: 124037 - DNA, 22 bp, Artificial Sequence
  Synthetic oligonucleotide; TTG chr11 5339340 5339361 5339345 5339340 -
tattcataagaagagtagaatt

SEQ ID NO: 124038 - DNA, 22 bp, Artificial Sequence
  Synthetic oligonucleotide; TTC chr11 5339335 5339356 5339340 5339335 -
ataagaagagtagaattcagag

SEQ ID NO: 124039 - DNA, 22 bp, Artificial Sequence
  Synthetic oligonucleotide; TTC chr11 5339317 5339338 5339322 5339317 -
agagtggtccagtggactaaca

SEQ ID NO: 124040 - DNA, 22 bp, Artificial Sequence
  Synthetic oligonucleotide; CTA chr11 5339298 5339319 5339303 5339298 -
acaaactggtgaaccaccttct

SEQ ID NO: 124041 - DNA, 22 bp, Artificial Sequence
  Synthetic oligonucleotide; CTG chr11 5339290 5339311 5339295 5339290 -
gtgaaccaccttcttacagcag

SEQ ID NO: 124042 - DNA, 22 bp, Artificial Sequence
  Synthetic oligonucleotide; CTT chr11 5339278 5339299 5339283 5339278 -
cttacagcaggtgaagcctgta

SEQ ID NO: 124043 - DNA, 22 bp, Artificial Sequence
  Synthetic oligonucleotide; TTC chr11 5339277 5339298 5339282 5339277 -
ttacagcaggtgaagcctgtaa

SEQ ID NO: 124044 - DNA, 22 bp, Artificial Sequence
  Synthetic oligonucleotide; CTT chr11 5339275 5339296 5339280 5339275 -
acagcaggtgaagcctgtaatt

SEQ ID NO: 124045 - DNA, 22 bp, Artificial Sequence
  Synthetic oligonucleotide; TTA chr11 5339274 5339295 5339279 5339274 -
cagcaggtgaagcctgtaattc

SEQ ID NO: 124046 - DNA, 22 bp, Artificial Sequence
  Synthetic oligonucleotide; CTG chr11 5339258 5339279 5339263 5339258 -
taattcagcttttcatcattca

SEQ ID NO: 124047 - DNA, 22 bp, Artificial Sequence
  Synthetic oligonucleotide; TTC chr11 5339252 5339273 5339257 5339252 -
agcttttcatcattcaagactg

SEQ ID NO: 124048 - DNA, 22 bp, Artificial Sequence
  Synthetic oligonucleotide; CTT chr11 5339247 5339268 5339252 5339247 -
ttcatcattcaagactgaaaga

SEQ ID NO: 124049 - DNA, 22 bp, Artificial Sequence
  Synthetic oligonucleotide; TTT chr11 5339246 5339267 5339251 5339246 -
tcatcattcaagactgaaagaa

SEQ ID NO: 124050 - DNA, 22 bp, Artificial Sequence
  Synthetic oligonucleotide; TTT chr11 5339245 5339266 5339250 5339245 -
catcattcaagactgaaagaag

SEQ ID NO: 124051 - DNA, 22 bp, Artificial Sequence
  Synthetic oligonucleotide; TTC chr11 5339244 5339265 5339249 5339244 -
atcattcaagactgaaagaaga

SEQ ID NO: 124052 - DNA, 22 bp, Artificial Sequence
  Synthetic oligonucleotide; TTC chr11 5339237 5339258 5339242 5339237 -
aagactgaaagaagaatataac

SEQ ID NO: 124053 - DNA, 22 bp, Artificial Sequence
  Synthetic oligonucleotide; CTG chr11 5339230 5339251 5339235 5339230 -
aaagaagaatataacttatata

SEQ ID NO: 124054 - DNA, 22 bp, Artificial Sequence
  Synthetic oligonucleotide; CTT chr11 5339213 5339234 5339218 5339213 -
atatagagaaggacctcatgag

SEQ ID NO: 124055 - DNA, 22 bp, Artificial Sequence
  Synthetic oligonucleotide; TTA chr11 5339212 5339233 5339217 5339212 -
tatagagaaggacctcatgagg

SEQ ID NO: 124056 - DNA, 22 bp, Artificial Sequence
  Synthetic oligonucleotide; CTC chr11 5339196 5339217 5339201 5339196 -
atgaggaataaatttcatggtg

SEQ ID NO: 124057 - DNA, 22 bp, Artificial Sequence
  Synthetic oligonucleotide; TTT chr11 5339181 5339202 5339186 5339181 -
catggtgcctattaagataaat

SEQ ID NO: 124058 - DNA, 22 bp, Artificial Sequence
  Synthetic oligonucleotide; TTC chr11 5339180 5339201 5339185 5339180 -
atggtgcctattaagataaata

SEQ ID NO: 124059 - DNA, 22 bp, Artificial Sequence
  Synthetic oligonucleotide; CTA chr11 5339170 5339191 5339175 5339170 -
ttaagataaataagtaccatgt

SEQ ID NO: 124060 - DNA, 22 bp, Artificial Sequence
  Synthetic oligonucleotide; TTA chr11 5339167 5339188 5339172 5339167 -
agataaataagtaccatgtagt

SEQ ID NO: 124061 - DNA, 22 bp, Artificial Sequence
  Synthetic oligonucleotide; TTA chr11 5339143 5339164 5339148 5339143 -
tgggaaatctaaggtgtaaaag

SEQ ID NO: 124062 - DNA, 22 bp, Artificial Sequence
  Synthetic oligonucleotide; CTA chr11 5339132 5339153 5339137 5339132 -
aggtgtaaaagaatatacatta

SEQ ID NO: 124063 - DNA, 22 bp, Artificial Sequence
  Synthetic oligonucleotide; TTA chr11 5339110 5339131 5339115 5339110 -
aaaaaagcccttgccaaatacc

SEQ ID NO: 124064 - DNA, 22 bp, Artificial Sequence
  Synthetic oligonucleotide; CTT chr11 5339098 5339119 5339103 5339098 -
gccaaataccatcctttctttt

SEQ ID NO: 124065 - DNA, 22 bp, Artificial Sequence
  Synthetic oligonucleotide; TTG chr11 5339097 5339118 5339102 5339097 -
ccaaataccatcctttcttttt

SEQ ID NO: 124066 - DNA, 22 bp, Artificial Sequence
  Synthetic oligonucleotide; CTT chr11 5339082 5339103 5339087 5339082 -
tctttttcaaataataatatac

SEQ ID NO: 124067 - DNA, 22 bp, Artificial Sequence
  Synthetic oligonucleotide; TTT chr11 5339081 5339102 5339086 5339081 -
ctttttcaaataataatatact

SEQ ID NO: 124068 - DNA, 22 bp, Artificial Sequence
  Synthetic oligonucleotide; TTC chr11 5339080 5339101 5339085 5339080 -
tttttcaaataataatatactt

SEQ ID NO: 124069 - DNA, 22 bp, Artificial Sequence
  Synthetic oligonucleotide; CTT chr11 5339078 5339099 5339083 5339078 -
tttcaaataataatatacttgt

SEQ ID NO: 124070 - DNA, 22 bp, Artificial Sequence
  Synthetic oligonucleotide; TTT chr11 5339077 5339098 5339082 5339077 -
ttcaaataataatatacttgtg

SEQ ID NO: 124071 - DNA, 22 bp, Artificial Sequence
  Synthetic oligonucleotide; TTT chr11 5339076 5339097 5339081 5339076 -
tcaaataataatatacttgtgt

SEQ ID NO: 124072 - DNA, 22 bp, Artificial Sequence
  Synthetic oligonucleotide; TTT chr11 5339075 5339096 5339080 5339075 -
caaataataatatacttgtgta

SEQ ID NO: 124073 - DNA, 22 bp, Artificial Sequence
  Synthetic oligonucleotide; TTC chr11 5339074 5339095 5339079 5339074 -
aaataataatatacttgtgtag

SEQ ID NO: 124074 - DNA, 22 bp, Artificial Sequence
  Synthetic oligonucleotide; CTT chr11 5339058 5339079 5339063 5339058 -
gtgtagtatgggcttgaaggga

SEQ ID NO: 124075 - DNA, 22 bp, Artificial Sequence
  Synthetic oligonucleotide; TTG chr11 5339057 5339078 5339062 5339057 -
tgtagtatgggcttgaagggat

SEQ ID NO: 124076 - DNA, 22 bp, Artificial Sequence
  Synthetic oligonucleotide; CTT chr11 5339043 5339064 5339048 5339043 -
gaagggataacataccataaga

SEQ ID NO: 124077 - DNA, 22 bp, Artificial Sequence
  Synthetic oligonucleotide; TTG chr11 5339042 5339063 5339047 5339042 -
aagggataacataccataagaa

SEQ ID NO: 124078 - DNA, 22 bp, Artificial Sequence
  Synthetic oligonucleotide; TTT chr11 5339015 5339036 5339020 5339015 -
aatttgagtcaggaaatgaaag

SEQ ID NO: 124079 - DNA, 22 bp, Artificial Sequence
  Synthetic oligonucleotide; TTA chr11 5339014 5339035 5339019 5339014 -
atttgagtcaggaaatgaaagg

SEQ ID NO: 124080 - DNA, 22 bp, Artificial Sequence
  Synthetic oligonucleotide; TTT chr11 5339010 5339031 5339015 5339010 -
gagtcaggaaatgaaaggctaa

SEQ ID NO: 124081 - DNA, 22 bp, Artificial Sequence
  Synthetic oligonucleotide; TTG chr11 5339009 5339030 5339014 5339009 -
agtcaggaaatgaaaggctaag

SEQ ID NO: 124082 - DNA, 22 bp, Artificial Sequence
  Synthetic oligonucleotide; CTA chr11 5338989 5339010 5338994 5338989 -
agtgtgcatttctgtagactaa

SEQ ID NO: 124083 - DNA, 22 bp, Artificial Sequence
  Synthetic oligonucleotide; TTT chr11 5338978 5338999 5338983 5338978 -
ctgtagactaagccaatcttag

SEQ ID NO: 124084 - DNA, 22 bp, Artificial Sequence
  Synthetic oligonucleotide; TTC chr11 5338977 5338998 5338982 5338977 -
tgtagactaagccaatcttaga

SEQ ID NO: 124085 - DNA, 22 bp, Artificial Sequence
  Synthetic oligonucleotide; CTG chr11 5338975 5338996 5338980 5338975 -
tagactaagccaatcttagaaa

SEQ ID NO: 124086 - DNA, 22 bp, Artificial Sequence
  Synthetic oligonucleotide; CTA chr11 5338968 5338989 5338973 5338968 -
agccaatcttagaaatgattaa

SEQ ID NO: 124087 - DNA, 22 bp, Artificial Sequence
  Synthetic oligonucleotide; CTT chr11 5338958 5338979 5338963 5338958 -
agaaatgattaagaagacgtgg

SEQ ID NO: 124088 - DNA, 22 bp, Artificial Sequence
  Synthetic oligonucleotide; TTA chr11 5338957 5338978 5338962 5338957 -
gaaatgattaagaagacgtgga

SEQ ID NO: 124089 - DNA, 22 bp, Artificial Sequence
  Synthetic oligonucleotide; TTA chr11 5338947 5338968 5338952 5338947 -
agaagacgtggaagaatcttag

SEQ ID NO: 124090 - DNA, 22 bp, Artificial Sequence
  Synthetic oligonucleotide; CTT chr11 5338927 5338948 5338932 5338927 -
agagacacactgaaaaaatatg

SEQ ID NO: 124091 - DNA, 22 bp, Artificial Sequence
  Synthetic oligonucleotide; TTA chr11 5338926 5338947 5338931 5338926 -
gagacacactgaaaaaatatgt

SEQ ID NO: 124092 - DNA, 22 bp, Artificial Sequence
  Synthetic oligonucleotide; CTG chr11 5338915 5338936 5338920 5338915 -
aaaaaatatgtatggtctaatg

SEQ ID NO: 124093 - DNA, 22 bp, Artificial Sequence
  Synthetic oligonucleotide; CTA chr11 5338896 5338917 5338901 5338896 -
atgagtttacagatcacttttc

SEQ ID NO: 124094 - DNA, 22 bp, Artificial Sequence
  Synthetic oligonucleotide; TTT chr11 5338888 5338909 5338893 5338888 -
acagatcacttttcctcccata

SEQ ID NO: 124095 - DNA, 22 bp, Artificial Sequence
  Synthetic oligonucleotide; TTA chr11 5338887 5338908 5338892 5338887 -
cagatcacttttcctcccatat

SEQ ID NO: 124096 - DNA, 22 bp, Artificial Sequence
  Synthetic oligonucleotide; CTT chr11 5338877 5338898 5338882 5338877 -
ttcctcccatataaaatgaatt

SEQ ID NO: 124097 - DNA, 22 bp, Artificial Sequence
  Synthetic oligonucleotide; TTT chr11 5338876 5338897 5338881 5338876 -
tcctcccatataaaatgaattt

SEQ ID NO: 124098 - DNA, 22 bp, Artificial Sequence
  Synthetic oligonucleotide; TTT chr11 5338875 5338896 5338880 5338875 -
cctcccatataaaatgaattta

SEQ ID NO: 124099 - DNA, 22 bp, Artificial Sequence
  Synthetic oligonucleotide; TTC chr11 5338874 5338895 5338879 5338874 -
ctcccatataaaatgaatttat

SEQ ID NO: 124100 - DNA, 22 bp, Artificial Sequence
  Synthetic oligonucleotide; CTC chr11 5338871 5338892 5338876 5338871 -
ccatataaaatgaatttatact

SEQ ID NO: 124101 - DNA, 22 bp, Artificial Sequence
  Synthetic oligonucleotide; TTT chr11 5338854 5338875 5338859 5338854 -
atactagataaggggaagatga

SEQ ID NO: 124102 - DNA, 22 bp, Artificial Sequence
  Synthetic oligonucleotide; TTA chr11 5338853 5338874 5338858 5338853 -
tactagataaggggaagatgaa

SEQ ID NO: 124103 - DNA, 22 bp, Artificial Sequence
  Synthetic oligonucleotide; CTA chr11 5338848 5338869 5338853 5338848 -
gataaggggaagatgaacttta

SEQ ID NO: 124104 - DNA, 22 bp, Artificial Sequence
  Synthetic oligonucleotide; CTT chr11 5338828 5338849 5338833 5338828 -
tattcctctcattaacaaataa

SEQ ID NO: 124105 - DNA, 22 bp, Artificial Sequence
  Synthetic oligonucleotide; TTT chr11 5338827 5338848 5338832 5338827 -
attcctctcattaacaaataat

SEQ ID NO: 124106 - DNA, 22 bp, Artificial Sequence
  Synthetic oligonucleotide; TTA chr11 5338826 5338847 5338831 5338826 -
ttcctctcattaacaaataatt

SEQ ID NO: 124107 - DNA, 22 bp, Artificial Sequence
  Synthetic oligonucleotide; TTC chr11 5338823 5338844 5338828 5338823 -
ctctcattaacaaataattgct

SEQ ID NO: 124108 - DNA, 22 bp, Artificial Sequence
  Synthetic oligonucleotide; CTC chr11 5338820 5338841 5338825 5338820 -
tcattaacaaataattgctggg

SEQ ID NO: 124109 - DNA, 22 bp, Artificial Sequence
  Synthetic oligonucleotide; CTC chr11 5338818 5338839 5338823 5338818 -
attaacaaataattgctgggtt

SEQ ID NO: 124110 - DNA, 22 bp, Artificial Sequence
  Synthetic oligonucleotide; TTA chr11 5338814 5338835 5338819 5338814 -
acaaataattgctgggttcctt

SEQ ID NO: 124111 - DNA, 22 bp, Artificial Sequence
  Synthetic oligonucleotide; TTG chr11 5338803 5338824 5338808 5338803 -
ctgggttccttcaccagagatg

SEQ ID NO: 124112 - DNA, 22 bp, Artificial Sequence
  Synthetic oligonucleotide; CTG chr11 5338800 5338821 5338805 5338800 -
ggttccttcaccagagatgcag

SEQ ID NO: 124113 - DNA, 22 bp, Artificial Sequence
  Synthetic oligonucleotide; TTC chr11 5338795 5338816 5338800 5338795 -
cttcaccagagatgcagatttt

SEQ ID NO: 124114 - DNA, 22 bp, Artificial Sequence
  Synthetic oligonucleotide; CTT chr11 5338792 5338813 5338797 5338792 -
caccagagatgcagatttttat

SEQ ID NO: 124115 - DNA, 22 bp, Artificial Sequence
  Synthetic oligonucleotide; TTC chr11 5338791 5338812 5338796 5338791 -
accagagatgcagatttttata

SEQ ID NO: 124116 - DNA, 22 bp, Artificial Sequence
  Synthetic oligonucleotide; TTT chr11 5338774 5338795 5338779 5338774 -
ttatagggtaaatgaaaggtga

SEQ ID NO: 124117 - DNA, 22 bp, Artificial Sequence
  Synthetic oligonucleotide; TTT chr11 5338773 5338794 5338778 5338773 -
tatagggtaaatgaaaggtgat

SEQ ID NO: 124118 - DNA, 22 bp, Artificial Sequence
  Synthetic oligonucleotide; TTT chr11 5338772 5338793 5338777 5338772 -
atagggtaaatgaaaggtgata

SEQ ID NO: 124119 - DNA, 22 bp, Artificial Sequence
  Synthetic oligonucleotide; TTA chr11 5338771 5338792 5338776 5338771 -
tagggtaaatgaaaggtgatat

SEQ ID NO: 124120 - DNA, 22 bp, Artificial Sequence
  Synthetic oligonucleotide; TTT chr11 5338745 5338766 5338750 5338745 -
aaagatacttactagattatat

SEQ ID NO: 124121 - DNA, 22 bp, Artificial Sequence
  Synthetic oligonucleotide; TTA chr11 5338744 5338765 5338749 5338744 -
aagatacttactagattatatg

SEQ ID NO: 124122 - DNA, 22 bp, Artificial Sequence
  Synthetic oligonucleotide; CTT chr11 5338735 5338756 5338740 5338735 -
actagattatatgagtattaaa

SEQ ID NO: 124123 - DNA, 22 bp, Artificial Sequence
  Synthetic oligonucleotide; TTA chr11 5338734 5338755 5338739 5338734 -
ctagattatatgagtattaaat

SEQ ID NO: 124124 - DNA, 22 bp, Artificial Sequence
  Synthetic oligonucleotide; CTA chr11 5338731 5338752 5338736 5338731 -
gattatatgagtattaaattgg

SEQ ID NO: 124125 - DNA, 22 bp, Artificial Sequence
  Synthetic oligonucleotide; TTA chr11 5338726 5338747 5338731 5338726 -
tatgagtattaaattgggcagc

SEQ ID NO: 124126 - DNA, 22 bp, Artificial Sequence
  Synthetic oligonucleotide; TTA chr11 5338715 5338736 5338720 5338715 -
aattgggcagcaaggatgatta

SEQ ID NO: 124127 - DNA, 22 bp, Artificial Sequence
  Synthetic oligonucleotide; TTG chr11 5338710 5338731 5338715 5338710 -
ggcagcaaggatgattagaaat

SEQ ID NO: 124128 - DNA, 22 bp, Artificial Sequence
  Synthetic oligonucleotide; TTA chr11 5338693 5338714 5338698 5338693 -
gaaatgattaaggacccagagg

SEQ ID NO: 124129 - DNA, 22 bp, Artificial Sequence
  Synthetic oligonucleotide; TTA chr11 5338683 5338704 5338688 5338683 -
aggacccagaggtctccatgtc

SEQ ID NO: 124130 - DNA, 22 bp, Artificial Sequence
  Synthetic oligonucleotide; CTC chr11 5338667 5338688 5338672 5338667 -
catgtccaattaaagaatgtaa

SEQ ID NO: 124131 - DNA, 22 bp, Artificial Sequence
  Synthetic oligonucleotide; TTA chr11 5338655 5338676 5338660 5338655 -
aagaatgtaaatctgtttttga

SEQ ID NO: 124132 - DNA, 22 bp, Artificial Sequence
  Synthetic oligonucleotide; CTG chr11 5338640 5338661 5338645 5338640 -
tttttgattttatagcctaaat

SEQ ID NO: 124133 - DNA, 22 bp, Artificial Sequence
  Synthetic oligonucleotide; TTT chr11 5338637 5338658 5338642 5338637 -
ttgattttatagcctaaatcct

SEQ ID NO: 124134 - DNA, 22 bp, Artificial Sequence
  Synthetic oligonucleotide; TTT chr11 5338636 5338657 5338641 5338636 -
tgattttatagcctaaatcctt

SEQ ID NO: 124135 - DNA, 22 bp, Artificial Sequence
  Synthetic oligonucleotide; TTT chr11 5338635 5338656 5338640 5338635 -
gattttatagcctaaatcctta

SEQ ID NO: 124136 - DNA, 22 bp, Artificial Sequence
  Synthetic oligonucleotide; TTG chr11 5338634 5338655 5338639 5338634 -
attttatagcctaaatccttag

SEQ ID NO: 124137 - DNA, 22 bp, Artificial Sequence
  Synthetic oligonucleotide; TTT chr11 5338630 5338651 5338635 5338630 -
tatagcctaaatccttagacac

SEQ ID NO: 124138 - DNA, 22 bp, Artificial Sequence
  Synthetic oligonucleotide; TTT chr11 5338629 5338650 5338634 5338629 -
atagcctaaatccttagacaca

SEQ ID NO: 124139 - DNA, 22 bp, Artificial Sequence
  Synthetic oligonucleotide; TTA chr11 5338628 5338649 5338633 5338628 -
tagcctaaatccttagacacag

SEQ ID NO: 124140 - DNA, 22 bp, Artificial Sequence
  Synthetic oligonucleotide; CTA chr11 5338621 5338642 5338626 5338621 -
aatccttagacacagtcattgt

SEQ ID NO: 124141 - DNA, 22 bp, Artificial Sequence
  Synthetic oligonucleotide; CTT chr11 5338614 5338635 5338619 5338614 -
agacacagtcattgttattaat

SEQ ID NO: 124142 - DNA, 22 bp, Artificial Sequence
  Synthetic oligonucleotide; TTA chr11 5338613 5338634 5338618 5338613 -
gacacagtcattgttattaata

SEQ ID NO: 124143 - DNA, 22 bp, Artificial Sequence
  Synthetic oligonucleotide; TTG chr11 5338600 5338621 5338605 5338600 -
ttattaataaactcatagacaa

SEQ ID NO: 124144 - DNA, 22 bp, Artificial Sequence
  Synthetic oligonucleotide; TTA chr11 5338597 5338618 5338602 5338597 -
ttaataaactcatagacaaaat

SEQ ID NO: 124145 - DNA, 22 bp, Artificial Sequence
  Synthetic oligonucleotide; TTA chr11 5338594 5338615 5338599 5338594 -
ataaactcatagacaaaattta

SEQ ID NO: 124146 - DNA, 22 bp, Artificial Sequence
  Synthetic oligonucleotide; CTC chr11 5338586 5338607 5338591 5338586 -
atagacaaaatttattttatgg

SEQ ID NO: 124147 - DNA, 22 bp, Artificial Sequence
  Synthetic oligonucleotide; TTT chr11 5338573 5338594 5338578 5338573 -
attttatgggaaatttaggagt

SEQ ID NO: 124148 - DNA, 22 bp, Artificial Sequence
  Synthetic oligonucleotide; TTA chr11 5338572 5338593 5338577 5338572 -
ttttatgggaaatttaggagtt

SEQ ID NO: 124149 - DNA, 22 bp, Artificial Sequence
  Synthetic oligonucleotide; TTT chr11 5338569 5338590 5338574 5338569 -
tatgggaaatttaggagtttat

SEQ ID NO: 124150 - DNA, 22 bp, Artificial Sequence
  Synthetic oligonucleotide; TTT chr11 5338568 5338589 5338573 5338568 -
atgggaaatttaggagtttatg

SEQ ID NO: 124151 - DNA, 22 bp, Artificial Sequence
  Synthetic oligonucleotide; TTA chr11 5338567 5338588 5338572 5338567 -
tgggaaatttaggagtttatgt

SEQ ID NO: 124152 - DNA, 22 bp, Artificial Sequence
  Synthetic oligonucleotide; TTT chr11 5338557 5338578 5338562 5338557 -
aggagtttatgtccctagattt

SEQ ID NO: 124153 - DNA, 22 bp, Artificial Sequence
  Synthetic oligonucleotide; TTA chr11 5338556 5338577 5338561 5338556 -
ggagtttatgtccctagatttc

SEQ ID NO: 124154 - DNA, 22 bp, Artificial Sequence
  Synthetic oligonucleotide; TTT chr11 5338549 5338570 5338554 5338549 -
atgtccctagatttcaagtaca

SEQ ID NO: 124155 - DNA, 22 bp, Artificial Sequence
  Synthetic oligonucleotide; TTA chr11 5338548 5338569 5338553 5338548 -
tgtccctagatttcaagtacat

SEQ ID NO: 124156 - DNA, 22 bp, Artificial Sequence
  Synthetic oligonucleotide; CTA chr11 5338540 5338561 5338545 5338540 -
gatttcaagtacatgccaccaa

SEQ ID NO: 124157 - DNA, 22 bp, Artificial Sequence
  Synthetic oligonucleotide; TTT chr11 5338535 5338556 5338540 5338535 -
caagtacatgccaccaaactga

SEQ ID NO: 124158 - DNA, 22 bp, Artificial Sequence
  Synthetic oligonucleotide; TTC chr11 5338534 5338555 5338539 5338534 -
aagtacatgccaccaaactgac

SEQ ID NO: 124159 - DNA, 22 bp, Artificial Sequence
  Synthetic oligonucleotide; CTG chr11 5338514 5338535 5338519 5338514 -
acagatgacagtgattagtcac

SEQ ID NO: 124160 - DNA, 22 bp, Artificial Sequence
  Synthetic oligonucleotide; TTA chr11 5338497 5338518 5338502 5338497 -
gtcacaaagtgcctcaaaaata

SEQ ID NO: 124161 - DNA, 22 bp, Artificial Sequence
  Synthetic oligonucleotide; CTC chr11 5338482 5338503 5338487 5338482 -
aaaaatagatggccctatgtta

SEQ ID NO: 124162 - DNA, 22 bp, Artificial Sequence
  Synthetic oligonucleotide; CTA chr11 5338465 5338486 5338470 5338465 -
tgttagtcatggttctccagaa

SEQ ID NO: 124163 - DNA, 22 bp, Artificial Sequence
  Synthetic oligonucleotide; TTA chr11 5338460 5338481 5338465 5338460 -
gtcatggttctccagaaaaata

SEQ ID NO: 124164 - DNA, 22 bp, Artificial Sequence
  Synthetic oligonucleotide; TTC chr11 5338450 5338471 5338455 5338450 -
tccagaaaaatagaatcaacag

SEQ ID NO: 124165 - DNA, 22 bp, Artificial Sequence
  Synthetic oligonucleotide; CTC chr11 5338448 5338469 5338453 5338448 -
cagaaaaatagaatcaacagga

SEQ ID NO: 124166 - DNA, 22 bp, Artificial Sequence
  Synthetic oligonucleotide; TTT chr11 5338423 5338444 5338428 5338423 -
acccaacttcaaattatactac

SEQ ID NO: 124167 - DNA, 22 bp, Artificial Sequence
  Synthetic oligonucleotide; TTA chr11 5338422 5338443 5338427 5338422 -
cccaacttcaaattatactaca

SEQ ID NO: 124168 - DNA, 22 bp, Artificial Sequence
  Synthetic oligonucleotide; CTT chr11 5338414 5338435 5338419 5338414 -
caaattatactacaaggtgaca

SEQ ID NO: 124169 - DNA, 22 bp, Artificial Sequence
  Synthetic oligonucleotide; TTC chr11 5338413 5338434 5338418 5338413 -
aaattatactacaaggtgacag

SEQ ID NO: 124170 - DNA, 22 bp, Artificial Sequence
  Synthetic oligonucleotide; TTA chr11 5338407 5338428 5338412 5338407 -
tactacaaggtgacagtaacta

SEQ ID NO: 124171 - DNA, 22 bp, Artificial Sequence
  Synthetic oligonucleotide; CTA chr11 5338402 5338423 5338407 5338402 -
caaggtgacagtaactaactga

SEQ ID NO: 124172 - DNA, 22 bp, Artificial Sequence
  Synthetic oligonucleotide; CTA chr11 5338385 5338406 5338390 5338385 -
actgaaacagcatggtactgat

SEQ ID NO: 124173 - DNA, 22 bp, Artificial Sequence
  Synthetic oligonucleotide; CTG chr11 5338381 5338402 5338386 5338381 -
aaacagcatggtactgatacca

SEQ ID NO: 124174 - DNA, 22 bp, Artificial Sequence
  Synthetic oligonucleotide; CTG chr11 5338365 5338386 5338370 5338365 -
ataccaaacagacacactgact

SEQ ID NO: 124175 - DNA, 22 bp, Artificial Sequence
  Synthetic oligonucleotide; CTG chr11 5338346 5338367 5338351 5338346 -
actaatggaacagaatggagaa

SEQ ID NO: 124176 - DNA, 22 bp, Artificial Sequence
  Synthetic oligonucleotide; CTA chr11 5338342 5338363 5338347 5338342 -
atggaacagaatggagaactca

SEQ ID NO: 124177 - DNA, 22 bp, Artificial Sequence
  Synthetic oligonucleotide; CTC chr11 5338321 5338342 5338326 5338321 -
agaagtaagaccgcgcatctga

SEQ ID NO: 124178 - DNA, 22 bp, Artificial Sequence
  Synthetic oligonucleotide; CTG chr11 5338300 5338321 5338305 5338300 -
aaacaatctgatcttcaacaaa

SEQ ID NO: 124179 - DNA, 22 bp, Artificial Sequence
  Synthetic oligonucleotide; CTG chr11 5338290 5338311 5338295 5338290 -
atcttcaacaaacctggtaaaa

SEQ ID NO: 124180 - DNA, 22 bp, Artificial Sequence
  Synthetic oligonucleotide; CTT chr11 5338285 5338306 5338290 5338285 -
caacaaacctggtaaaaacaag

SEQ ID NO: 124181 - DNA, 22 bp, Artificial Sequence
  Synthetic oligonucleotide; TTC chr11 5338284 5338305 5338289 5338284 -
aacaaacctggtaaaaacaagt

SEQ ID NO: 124182 - DNA, 22 bp, Artificial Sequence
  Synthetic oligonucleotide; CTG chr11 5338274 5338295 5338279 5338274 -
gtaaaaacaagtaatggggaag

SEQ ID NO: 124183 - DNA, 22 bp, Artificial Sequence
  Synthetic oligonucleotide; TTC chr11 5338246 5338267 5338251 5338246 -
cctattttataaattgtgctgg

SEQ ID NO: 124184 - DNA, 22 bp, Artificial Sequence
  Synthetic oligonucleotide; CTA chr11 5338242 5338263 5338247 5338242 -
ttttataaattgtgctgggaga

SEQ ID NO: 124185 - DNA, 22 bp, Artificial Sequence
  Synthetic oligonucleotide; TTT chr11 5338239 5338260 5338244 5338239 -
tataaattgtgctgggagaact

SEQ ID NO: 124186 - DNA, 22 bp, Artificial Sequence
  Synthetic oligonucleotide; TTT chr11 5338238 5338259 5338243 5338238 -
ataaattgtgctgggagaactg

SEQ ID NO: 124187 - DNA, 22 bp, Artificial Sequence
  Synthetic oligonucleotide; TTA chr11 5338237 5338258 5338242 5338237 -
taaattgtgctgggagaactgg

SEQ ID NO: 124188 - DNA, 22 bp, Artificial Sequence
  Synthetic oligonucleotide; TTG chr11 5338230 5338251 5338235 5338230 -
tgctgggagaactggctagcca

SEQ ID NO: 124189 - DNA, 22 bp, Artificial Sequence
  Synthetic oligonucleotide; CTG chr11 5338225 5338246 5338230 5338225 -
ggagaactggctagccatatgc

SEQ ID NO: 124190 - DNA, 22 bp, Artificial Sequence
  Synthetic oligonucleotide; CTG chr11 5338216 5338237 5338221 5338216 -
gctagccatatgcagaaaattg

SEQ ID NO: 124191 - DNA, 22 bp, Artificial Sequence
  Synthetic oligonucleotide; CTA chr11 5338212 5338233 5338217 5338212 -
gccatatgcagaaaattgaaac

SEQ ID NO: 124192 - DNA, 22 bp, Artificial Sequence
  Synthetic oligonucleotide; TTG chr11 5338194 5338215 5338199 5338194 -
aaactggaccccttccttacat

SEQ ID NO: 124193 - DNA, 22 bp, Artificial Sequence
  Synthetic oligonucleotide; CTG chr11 5338188 5338209 5338193 5338188 -
gaccccttccttacatcttata

SEQ ID NO: 124194 - DNA, 22 bp, Artificial Sequence
  Synthetic oligonucleotide; CTT chr11 5338180 5338201 5338185 5338180 -
ccttacatcttatacataaatt

SEQ ID NO: 124195 - DNA, 22 bp, Artificial Sequence
  Synthetic oligonucleotide; TTC chr11 5338179 5338200 5338184 5338179 -
cttacatcttatacataaatta

SEQ ID NO: 124196 - DNA, 22 bp, Artificial Sequence
  Synthetic oligonucleotide; CTT chr11 5338176 5338197 5338181 5338176 -
acatcttatacataaattaact

SEQ ID NO: 124197 - DNA, 22 bp, Artificial Sequence
  Synthetic oligonucleotide; TTA chr11 5338175 5338196 5338180 5338175 -
catcttatacataaattaactc

SEQ ID NO: 124198 - DNA, 22 bp, Artificial Sequence
  Synthetic oligonucleotide; CTT chr11 5338169 5338190 5338174 5338169 -
atacataaattaactcaagatg

SEQ ID NO: 124199 - DNA, 22 bp, Artificial Sequence
  Synthetic oligonucleotide; TTA chr11 5338168 5338189 5338173 5338168 -
tacataaattaactcaagatgc

SEQ ID NO: 124200 - DNA, 22 bp, Artificial Sequence
  Synthetic oligonucleotide; TTA chr11 5338157 5338178 5338162 5338157 -
actcaagatgcattaaagactt

SEQ ID NO: 124201 - DNA, 22 bp, Artificial Sequence
  Synthetic oligonucleotide; CTC chr11 5338153 5338174 5338158 5338153 -
aagatgcattaaagacttaagt

SEQ ID NO: 124202 - DNA, 22 bp, Artificial Sequence
  Synthetic oligonucleotide; TTA chr11 5338142 5338163 5338147 5338142 -
aagacttaagtgtaaaacccaa

SEQ ID NO: 124203 - DNA, 22 bp, Artificial Sequence
  Synthetic oligonucleotide; CTT chr11 5338135 5338156 5338140 5338135 -
aagtgtaaaacccaaaactata

SEQ ID NO: 124204 - DNA, 22 bp, Artificial Sequence
  Synthetic oligonucleotide; TTA chr11 5338134 5338155 5338139 5338134 -
agtgtaaaacccaaaactataa

SEQ ID NO: 124205 - DNA, 22 bp, Artificial Sequence
  Synthetic oligonucleotide; CTA chr11 5338115 5338136 5338120 5338115 -
taaaaactttagaagaaaacct

SEQ ID NO: 124206 - DNA, 22 bp, Artificial Sequence
  Synthetic oligonucleotide; CTT chr11 5338106 5338127 5338111 5338106 -
tagaagaaaacctaggcaatac

SEQ ID NO: 124207 - DNA, 22 bp, Artificial Sequence
  Synthetic oligonucleotide; TTT chr11 5338105 5338126 5338110 5338105 -
agaagaaaacctaggcaatacc

SEQ ID NO: 124208 - DNA, 22 bp, Artificial Sequence
  Synthetic oligonucleotide; TTA chr11 5338104 5338125 5338109 5338104 -
gaagaaaacctaggcaatacca

SEQ ID NO: 124209 - DNA, 22 bp, Artificial Sequence
  Synthetic oligonucleotide; CTA chr11 5338092 5338113 5338097 5338092 -
ggcaataccattccggacatag

SEQ ID NO: 124210 - DNA, 22 bp, Artificial Sequence
  Synthetic oligonucleotide; TTC chr11 5338079 5338100 5338084 5338079 -
cggacatagacacaggcaaaga

SEQ ID NO: 124211 - DNA, 22 bp, Artificial Sequence
  Synthetic oligonucleotide; TTT chr11 5338054 5338075 5338059 5338054 -
catgatgaaaatgtcaaaaaca

SEQ ID NO: 124212 - DNA, 22 bp, Artificial Sequence
  Synthetic oligonucleotide; TTC chr11 5338053 5338074 5338058 5338053 -
atgatgaaaatgtcaaaaacaa

SEQ ID NO: 124213 - DNA, 22 bp, Artificial Sequence
  Synthetic oligonucleotide; TTG chr11 5338028 5338049 5338033 5338028 -
caacaaaagcaaacactgtcaa

SEQ ID NO: 124214 - DNA, 22 bp, Artificial Sequence
  Synthetic oligonucleotide; CTG chr11 5338010 5338031 5338015 5338010 -
tcaaatgagatctaattaaact

SEQ ID NO: 124215 - DNA, 22 bp, Artificial Sequence
  Synthetic oligonucleotide; CTA chr11 5337996 5338017 5338001 5337996 -
attaaactaaagagatcgggca

SEQ ID NO: 124216 - DNA, 22 bp, Artificial Sequence
  Synthetic oligonucleotide; TTA chr11 5337992 5338013 5337997 5337992 -
aactaaagagatcgggcatggt

SEQ ID NO: 124217 - DNA, 22 bp, Artificial Sequence
  Synthetic oligonucleotide; CTA chr11 5337987 5338008 5337992 5337987 -
aagagatcgggcatggtggctc

SEQ ID NO: 124218 - DNA, 22 bp, Artificial Sequence
  Synthetic oligonucleotide; CTC chr11 5337965 5337986 5337970 5337965 -
acgcctgtaatcccagcacttt

SEQ ID NO: 124219 - DNA, 22 bp, Artificial Sequence
  Synthetic oligonucleotide; CTG chr11 5337958 5337979 5337963 5337958 -
taatcccagcactttgggaggc

SEQ ID NO: 124220 - DNA, 22 bp, Artificial Sequence
  Synthetic oligonucleotide; CTT chr11 5337944 5337965 5337949 5337944 -
tgggaggccaaggtgggtggat

SEQ ID NO: 124221 - DNA, 22 bp, Artificial Sequence
  Synthetic oligonucleotide; TTT chr11 5337943 5337964 5337948 5337943 -
gggaggccaaggtgggtggatc

SEQ ID NO: 124222 - DNA, 22 bp, Artificial Sequence
  Synthetic oligonucleotide; TTG chr11 5337942 5337963 5337947 5337942 -
ggaggccaaggtgggtggatca

SEQ ID NO: 124223 - DNA, 22 bp, Artificial Sequence
  Synthetic oligonucleotide; CTT chr11 5337917 5337938 5337922 5337917 -
gaggtggggagtataagagcag

SEQ ID NO: 124224 - DNA, 22 bp, Artificial Sequence
  Synthetic oligonucleotide; TTG chr11 5337916 5337937 5337921 5337916 -
aggtggggagtataagagcagc

SEQ ID NO: 124225 - DNA, 22 bp, Artificial Sequence
  Synthetic oligonucleotide; CTG chr11 5337891 5337912 5337896 5337891 -
gccaacatggtgaaactccatc

SEQ ID NO: 124226 - DNA, 22 bp, Artificial Sequence
  Synthetic oligonucleotide; CTC chr11 5337873 5337894 5337878 5337873 -
catctctactaaaaatacaaaa

SEQ ID NO: 124227 - DNA, 22 bp, Artificial Sequence
  Synthetic oligonucleotide; CTC chr11 5337867 5337888 5337872 5337867 -
tactaaaaatacaaaaaatgtg

SEQ ID NO: 124228 - DNA, 22 bp, Artificial Sequence
  Synthetic oligonucleotide; CTA chr11 5337865 5337886 5337870 5337865 -
ctaaaaatacaaaaaatgtgct

SEQ ID NO: 124229 - DNA, 22 bp, Artificial Sequence
  Synthetic oligonucleotide; CTA chr11 5337862 5337883 5337867 5337862 -
aaaatacaaaaaatgtgctggg

SEQ ID NO: 124230 - DNA, 22 bp, Artificial Sequence
  Synthetic oligonucleotide; CTG chr11 5337842 5337863 5337847 5337842 -
ggtatggtggtgcgtacctgta

SEQ ID NO: 124231 - DNA, 22 bp, Artificial Sequence
  Synthetic oligonucleotide; CTG chr11 5337822 5337843 5337827 5337822 -
taatctcagctactcaggaggc

SEQ ID NO: 124232 - DNA, 22 bp, Artificial Sequence
  Synthetic oligonucleotide; CTC chr11 5337815 5337836 5337820 5337815 -
agctactcaggaggctgaggca

SEQ ID NO: 124233 - DNA, 22 bp, Artificial Sequence
  Synthetic oligonucleotide; CTA chr11 5337810 5337831 5337815 5337810 -
ctcaggaggctgaggcaggaga

SEQ ID NO: 124234 - DNA, 22 bp, Artificial Sequence
  Synthetic oligonucleotide; CTC chr11 5337807 5337828 5337812 5337807 -
aggaggctgaggcaggagaatt

SEQ ID NO: 124235 - DNA, 22 bp, Artificial Sequence
  Synthetic oligonucleotide; CTG chr11 5337798 5337819 5337803 5337798 -
aggcaggagaattgcttgaacc

SEQ ID NO: 124236 - DNA, 22 bp, Artificial Sequence
  Synthetic oligonucleotide; TTG chr11 5337784 5337805 5337789 5337784 -
cttgaacccaggaggcagaggt

SEQ ID NO: 124237 - DNA, 22 bp, Artificial Sequence
  Synthetic oligonucleotide; CTT chr11 5337781 5337802 5337786 5337781 -
gaacccaggaggcagaggttgc

SEQ ID NO: 124238 - DNA, 22 bp, Artificial Sequence
  Synthetic oligonucleotide; TTG chr11 5337780 5337801 5337785 5337780 -
aacccaggaggcagaggttgca

SEQ ID NO: 124239 - DNA, 22 bp, Artificial Sequence
  Synthetic oligonucleotide; TTG chr11 5337760 5337781 5337765 5337760 -
cagtgagctgagatcgcaccac

SEQ ID NO: 124240 - DNA, 22 bp, Artificial Sequence
  Synthetic oligonucleotide; CTG chr11 5337750 5337771 5337755 5337750 -
agatcgcaccactgcactctag

SEQ ID NO: 124241 - DNA, 22 bp, Artificial Sequence
  Synthetic oligonucleotide; CTG chr11 5337736 5337757 5337741 5337736 -
cactctagcatgggtgaaagag

SEQ ID NO: 124242 - DNA, 22 bp, Artificial Sequence
  Synthetic oligonucleotide; CTC chr11 5337731 5337752 5337736 5337731 -
tagcatgggtgaaagagtgaga

SEQ ID NO: 124243 - DNA, 22 bp, Artificial Sequence
  Synthetic oligonucleotide; CTA chr11 5337729 5337750 5337734 5337729 -
gcatgggtgaaagagtgagact

SEQ ID NO: 124244 - DNA, 22 bp, Artificial Sequence
  Synthetic oligonucleotide; CTT chr11 5337706 5337727 5337711 5337706 -
catctcaaaataaagaaaaata

SEQ ID NO: 124245 - DNA, 22 bp, Artificial Sequence
  Synthetic oligonucleotide; TTC chr11 5337705 5337726 5337710 5337705 -
atctcaaaataaagaaaaatac

SEQ ID NO: 124246 - DNA, 22 bp, Artificial Sequence
  Synthetic oligonucleotide; CTC chr11 5337700 5337721 5337705 5337700 -
aaaataaagaaaaatacaatta

SEQ ID NO: 124247 - DNA, 22 bp, Artificial Sequence
  Synthetic oligonucleotide; TTA chr11 5337678 5337699 5337683 5337678 -
aatacagagcttctaaacagca

SEQ ID NO: 124248 - DNA, 22 bp, Artificial Sequence
  Synthetic oligonucleotide; CTT chr11 5337666 5337687 5337671 5337666 -
ctaaacagcaaaataaactatc

SEQ ID NO: 124249 - DNA, 22 bp, Artificial Sequence
  Synthetic oligonucleotide; TTC chr11 5337665 5337686 5337670 5337665 -
taaacagcaaaataaactatca

SEQ ID NO: 124250 - DNA, 22 bp, Artificial Sequence
  Synthetic oligonucleotide; CTA chr11 5337663 5337684 5337668 5337663 -
aacagcaaaataaactatcatc

SEQ ID NO: 124251 - DNA, 22 bp, Artificial Sequence
  Synthetic oligonucleotide; CTA chr11 5337646 5337667 5337651 5337646 -
tcatcagagcgaacaggcaacc

SEQ ID NO: 124252 - DNA, 22 bp, Artificial Sequence
  Synthetic oligonucleotide; CTA chr11 5337622 5337643 5337627 5337622 -
cagaatgggagaaaatttctgc

SEQ ID NO: 124253 - DNA, 22 bp, Artificial Sequence
  Synthetic oligonucleotide; TTT chr11 5337604 5337625 5337609 5337604 -
ctgcaatctacccatctgacaa

SEQ ID NO: 124254 - DNA, 22 bp, Artificial Sequence
  Synthetic oligonucleotide; TTC chr11 5337603 5337624 5337608 5337603 -
tgcaatctacccatctgacaaa

SEQ ID NO: 124255 - DNA, 22 bp, Artificial Sequence
  Synthetic oligonucleotide; CTG chr11 5337601 5337622 5337606 5337601 -
caatctacccatctgacaaagg

SEQ ID NO: 124256 - DNA, 22 bp, Artificial Sequence
  Synthetic oligonucleotide; CTA chr11 5337594 5337615 5337599 5337594 -
cccatctgacaaaggtctaata

SEQ ID NO: 124257 - DNA, 22 bp, Artificial Sequence
  Synthetic oligonucleotide; CTG chr11 5337586 5337607 5337591 5337586 -
acaaaggtctaatatccagaat

SEQ ID NO: 124258 - DNA, 22 bp, Artificial Sequence
  Synthetic oligonucleotide; CTA chr11 5337575 5337596 5337580 5337575 -
atatccagaatctatgaggaac

SEQ ID NO: 124259 - DNA, 22 bp, Artificial Sequence
  Synthetic oligonucleotide; CTA chr11 5337561 5337582 5337566 5337561 -
tgaggaacttagacatatttac

SEQ ID NO: 124260 - DNA, 22 bp, Artificial Sequence
  Synthetic oligonucleotide; CTT chr11 5337551 5337572 5337556 5337551 -
agacatatttacaaaagaaaca

SEQ ID NO: 124261 - DNA, 22 bp, Artificial Sequence
  Synthetic oligonucleotide; TTA chr11 5337550 5337571 5337555 5337550 -
gacatatttacaaaagaaacac

SEQ ID NO: 124262 - DNA, 22 bp, Artificial Sequence
  Synthetic oligonucleotide; TTT chr11 5337541 5337562 5337546 5337541 -
acaaaagaaacacacaaacaac

SEQ ID NO: 124263 - DNA, 22 bp, Artificial Sequence
  Synthetic oligonucleotide; TTA chr11 5337540 5337561 5337545 5337540 -
caaaagaaacacacaaacaacc

SEQ ID NO: 124264 - DNA, 22 bp, Artificial Sequence
  Synthetic oligonucleotide; TTA chr11 5337512 5337533 5337517 5337512 -
aaaagtgggcaaaggacatgaa

SEQ ID NO: 124265 - DNA, 22 bp, Artificial Sequence
  Synthetic oligonucleotide; CTT chr11 5337481 5337502 5337486 5337481 -
ctcaaaagaagacatttatgtg

SEQ ID NO: 124266 - DNA, 22 bp, Artificial Sequence
  Synthetic oligonucleotide; TTC chr11 5337480 5337501 5337485 5337480 -
tcaaaagaagacatttatgtgg

SEQ ID NO: 124267 - DNA, 22 bp, Artificial Sequence
  Synthetic oligonucleotide; CTC chr11 5337478 5337499 5337483 5337478 -
aaaagaagacatttatgtggct

SEQ ID NO: 124268 - DNA, 22 bp, Artificial Sequence
  Synthetic oligonucleotide; TTT chr11 5337464 5337485 5337469 5337464 -
atgtggctaagaaacatacgaa

SEQ ID NO: 124269 - DNA, 22 bp, Artificial Sequence
  Synthetic oligonucleotide; TTA chr11 5337463 5337484 5337468 5337463 -
tgtggctaagaaacatacgaaa

SEQ ID NO: 124270 - DNA, 22 bp, Artificial Sequence
  Synthetic oligonucleotide; CTA chr11 5337455 5337476 5337460 5337455 -
agaaacatacgaaaaaagtctc

SEQ ID NO: 124271 - DNA, 22 bp, Artificial Sequence
  Synthetic oligonucleotide; CTC chr11 5337433 5337454 5337438 5337433 -
aatgtcactgatcattagagaa

SEQ ID NO: 124272 - DNA, 22 bp, Artificial Sequence
  Synthetic oligonucleotide; CTG chr11 5337423 5337444 5337428 5337423 -
atcattagagaaatgcaaatca

SEQ ID NO: 124273 - DNA, 22 bp, Artificial Sequence
  Synthetic oligonucleotide; TTA chr11 5337416 5337437 5337421 5337416 -
gagaaatgcaaatcaaaaccac

SEQ ID NO: 124274 - DNA, 22 bp, Artificial Sequence
  Synthetic oligonucleotide; CTG chr11 5337378 5337399 5337383 5337378 -
acaccagtcagaatggtggttt

SEQ ID NO: 124275 - DNA, 22 bp, Artificial Sequence
  Synthetic oligonucleotide; TTT chr11 5337356 5337377 5337361 5337356 -
ttaaagtcaagaaacaacagat

SEQ ID NO: 124276 - DNA, 22 bp, Artificial Sequence
  Synthetic oligonucleotide; TTT chr11 5337355 5337376 5337360 5337355 -
taaagtcaagaaacaacagatg

SEQ ID NO: 124277 - DNA, 22 bp, Artificial Sequence
  Synthetic oligonucleotide; TTT chr11 5337354 5337375 5337359 5337354 -
aaagtcaagaaacaacagatgc

SEQ ID NO: 124278 - DNA, 22 bp, Artificial Sequence
  Synthetic oligonucleotide; TTA chr11 5337353 5337374 5337358 5337353 -
aagtcaagaaacaacagatgct

SEQ ID NO: 124279 - DNA, 22 bp, Artificial Sequence
  Synthetic oligonucleotide; CTA chr11 5337330 5337351 5337335 5337330 -
gcaaggttgcagagaaatagga

SEQ ID NO: 124280 - DNA, 22 bp, Artificial Sequence
  Synthetic oligonucleotide; TTG chr11 5337321 5337342 5337326 5337321 -
cagagaaataggaacactttta

SEQ ID NO: 124281 - DNA, 22 bp, Artificial Sequence
  Synthetic oligonucleotide; CTT chr11 5337302 5337323 5337307 5337302 -
ttacactgttggtgggactgta

SEQ ID NO: 124282 - DNA, 22 bp, Artificial Sequence
  Synthetic oligonucleotide; TTT chr11 5337301 5337322 5337306 5337301 -
tacactgttggtgggactgtaa

SEQ ID NO: 124283 - DNA, 22 bp, Artificial Sequence
  Synthetic oligonucleotide; TTT chr11 5337300 5337321 5337305 5337300 -
acactgttggtgggactgtaaa

SEQ ID NO: 124284 - DNA, 22 bp, Artificial Sequence
  Synthetic oligonucleotide; TTA chr11 5337299 5337320 5337304 5337299 -
cactgttggtgggactgtaaac

SEQ ID NO: 124285 - DNA, 22 bp, Artificial Sequence
  Synthetic oligonucleotide; CTG chr11 5337294 5337315 5337299 5337294 -
ttggtgggactgtaaactaatt

SEQ ID NO: 124286 - DNA, 22 bp, Artificial Sequence
  Synthetic oligonucleotide; TTG chr11 5337291 5337312 5337296 5337291 -
gtgggactgtaaactaattcaa

SEQ ID NO: 124287 - DNA, 22 bp, Artificial Sequence
  Synthetic oligonucleotide; CTG chr11 5337282 5337303 5337287 5337282 -
taaactaattcaaccattgtgg

SEQ ID NO: 124288 - DNA, 22 bp, Artificial Sequence
  Synthetic oligonucleotide; CTA chr11 5337275 5337296 5337280 5337275 -
attcaaccattgtggaagacag

SEQ ID NO: 124289 - DNA, 22 bp, Artificial Sequence
  Synthetic oligonucleotide; TTC chr11 5337271 5337292 5337276 5337271 -
aaccattgtggaagacagtgtg

SEQ ID NO: 124290 - DNA, 22 bp, Artificial Sequence
  Synthetic oligonucleotide; TTG chr11 5337263 5337284 5337268 5337263 -
tggaagacagtgtggcaattcc

SEQ ID NO: 124291 - DNA, 22 bp, Artificial Sequence
  Synthetic oligonucleotide; TTC chr11 5337242 5337263 5337247 5337242 -
ctcaaagatttagaaccagaaa

SEQ ID NO: 124292 - DNA, 22 bp, Artificial Sequence
  Synthetic oligonucleotide; CTC chr11 5337239 5337260 5337244 5337239 -
aaagatttagaaccagaaatac

SEQ ID NO: 124293 - DNA, 22 bp, Artificial Sequence
  Synthetic oligonucleotide; TTT chr11 5337231 5337252 5337236 5337231 -
agaaccagaaataccatttgac

SEQ ID NO: 124294 - DNA, 22 bp, Artificial Sequence
  Synthetic oligonucleotide; TTA chr11 5337230 5337251 5337235 5337230 -
gaaccagaaataccatttgacc

SEQ ID NO: 124295 - DNA, 22 bp, Artificial Sequence
  Synthetic oligonucleotide; TTT chr11 5337212 5337233 5337217 5337212 -
gacctcacaatcccattactgg

SEQ ID NO: 124296 - DNA, 22 bp, Artificial Sequence
  Synthetic oligonucleotide; TTG chr11 5337211 5337232 5337216 5337211 -
acctcacaatcccattactggg

SEQ ID NO: 124297 - DNA, 22 bp, Artificial Sequence
  Synthetic oligonucleotide; CTC chr11 5337206 5337227 5337211 5337206 -
acaatcccattactgggtatat

SEQ ID NO: 124298 - DNA, 22 bp, Artificial Sequence
  Synthetic oligonucleotide; TTA chr11 5337194 5337215 5337199 5337194 -
ctgggtatatacctaaaggagt

SEQ ID NO: 124299 - DNA, 22 bp, Artificial Sequence
  Synthetic oligonucleotide; CTG chr11 5337191 5337212 5337196 5337191 -
ggtatatacctaaaggagtata

SEQ ID NO: 124300 - DNA, 22 bp, Artificial Sequence
  Synthetic oligonucleotide; CTA chr11 5337179 5337200 5337184 5337179 -
aaggagtataaatcattctatt

SEQ ID NO: 124301 - DNA, 22 bp, Artificial Sequence
  Synthetic oligonucleotide; TTC chr11 5337161 5337182 5337166 5337161 -
tattactaagatacatgcacat

SEQ ID NO: 124302 - DNA, 22 bp, Artificial Sequence
  Synthetic oligonucleotide; CTA chr11 5337159 5337180 5337164 5337159 -
ttactaagatacatgcacatgt

SEQ ID NO: 124303 - DNA, 22 bp, Artificial Sequence
  Synthetic oligonucleotide; TTA chr11 5337156 5337177 5337161 5337156 -
ctaagatacatgcacatgtatg

SEQ ID NO: 124304 - DNA, 22 bp, Artificial Sequence
  Synthetic oligonucleotide; CTA chr11 5337153 5337174 5337158 5337153 -
agatacatgcacatgtatgttc

SEQ ID NO: 124305 - DNA, 22 bp, Artificial Sequence
  Synthetic oligonucleotide; TTC chr11 5337131 5337152 5337136 5337131 -
attgtagcactattcacaatag

SEQ ID NO: 124306 - DNA, 22 bp, Artificial Sequence
  Synthetic oligonucleotide; TTG chr11 5337127 5337148 5337132 5337127 -
tagcactattcacaatagcaaa

SEQ ID NO: 124307 - DNA, 22 bp, Artificial Sequence
  Synthetic oligonucleotide; CTA chr11 5337119 5337140 5337124 5337119 -
ttcacaatagcaaagacataga

SEQ ID NO: 124308 - DNA, 22 bp, Artificial Sequence
  Synthetic oligonucleotide; TTC chr11 5337116 5337137 5337121 5337116 -
acaatagcaaagacatagaatc

SEQ ID NO: 124309 - DNA, 22 bp, Artificial Sequence
  Synthetic oligonucleotide; TTT chr11 5337063 5337084 5337068 5337063 -
aaaaaatgtggtacatataaac

SEQ ID NO: 124310 - DNA, 22 bp, Artificial Sequence
  Synthetic oligonucleotide; TTA chr11 5337062 5337083 5337067 5337062 -
aaaaatgtggtacatataaacc

SEQ ID NO: 124311 - DNA, 22 bp, Artificial Sequence
  Synthetic oligonucleotide; CTA chr11 5337029 5337050 5337034 5337029 -
tctaaccataaaaagggatgag

SEQ ID NO: 124312 - DNA, 22 bp, Artificial Sequence
  Synthetic oligonucleotide; CTA chr11 5337025 5337046 5337030 5337025 -
accataaaaagggatgagatca

SEQ ID NO: 124313 - DNA, 22 bp, Artificial Sequence
  Synthetic oligonucleotide; CTT chr11 5336996 5337017 5337001 5336996 -
tgctgggacatggatggagccg

SEQ ID NO: 124314 - DNA, 22 bp, Artificial Sequence
  Synthetic oligonucleotide; TTT chr11 5336995 5337016 5337000 5336995 -
gctgggacatggatggagccga

SEQ ID NO: 124315 - DNA, 22 bp, Artificial Sequence
  Synthetic oligonucleotide; TTG chr11 5336994 5337015 5336999 5336994 -
ctgggacatggatggagccgaa

SEQ ID NO: 124316 - DNA, 22 bp, Artificial Sequence
  Synthetic oligonucleotide; CTG chr11 5336991 5337012 5336996 5336991 -
ggacatggatggagccgaaagc

SEQ ID NO: 124317 - DNA, 22 bp, Artificial Sequence
  Synthetic oligonucleotide; TTA chr11 5336964 5336985 5336969 5336964 -
tcttcagtaaactaatgcagga

SEQ ID NO: 124318 - DNA, 22 bp, Artificial Sequence
  Synthetic oligonucleotide; CTT chr11 5336960 5336981 5336965 5336960 -
cagtaaactaatgcaggaacag

SEQ ID NO: 124319 - DNA, 22 bp, Artificial Sequence
  Synthetic oligonucleotide; TTC chr11 5336959 5336980 5336964 5336959 -
agtaaactaatgcaggaacaga

SEQ ID NO: 124320 - DNA, 22 bp, Artificial Sequence
  Synthetic oligonucleotide; CTA chr11 5336950 5336971 5336955 5336950 -
atgcaggaacagaaaaccaaac

SEQ ID NO: 124321 - DNA, 22 bp, Artificial Sequence
  Synthetic oligonucleotide; TTC chr11 5336917 5336938 5336922 5336917 -
tcacttagaagtgggagctgaa

SEQ ID NO: 124322 - DNA, 22 bp, Artificial Sequence
  Synthetic oligonucleotide; CTC chr11 5336915 5336936 5336920 5336915 -
acttagaagtgggagctgaaca

SEQ ID NO: 124323 - DNA, 22 bp, Artificial Sequence
  Synthetic oligonucleotide; CTT chr11 5336911 5336932 5336916 5336911 -
agaagtgggagctgaacaatga

SEQ ID NO: 124324 - DNA, 22 bp, Artificial Sequence
  Synthetic oligonucleotide; TTA chr11 5336910 5336931 5336915 5336910 -
gaagtgggagctgaacaatgag

SEQ ID NO: 124325 - DNA, 22 bp, Artificial Sequence
  Synthetic oligonucleotide; CTG chr11 5336897 5336918 5336902 5336897 -
aacaatgagaatgagaacacat

SEQ ID NO: 124326 - DNA, 22 bp, Artificial Sequence
  Synthetic oligonucleotide; CTG chr11 5336846 5336867 5336851 5336846 -
gagcctgtcagggcatggggtg

SEQ ID NO: 124327 - DNA, 22 bp, Artificial Sequence
  Synthetic oligonucleotide; CTG chr11 5336839 5336860 5336844 5336839 -
tcagggcatggggtgtggtgaa

SEQ ID NO: 124328 - DNA, 22 bp, Artificial Sequence
  Synthetic oligonucleotide; TTA chr11 5336806 5336827 5336811 5336806 -
gaaaaaatagctaatgcatgct

SEQ ID NO: 124329 - DNA, 22 bp, Artificial Sequence
  Synthetic oligonucleotide; CTA chr11 5336793 5336814 5336798 5336793 -
atgcatgctgggcttaacacct

SEQ ID NO: 124330 - DNA, 22 bp, Artificial Sequence
  Synthetic oligonucleotide; CTG chr11 5336783 5336804 5336788 5336783 -
ggcttaacacctaggtgatggg

SEQ ID NO: 124331 - DNA, 22 bp, Artificial Sequence
  Synthetic oligonucleotide; CTT chr11 5336778 5336799 5336783 5336778 -
aacacctaggtgatgggttgat

SEQ ID NO: 124332 - DNA, 22 bp, Artificial Sequence
  Synthetic oligonucleotide; TTA chr11 5336777 5336798 5336782 5336777 -
acacctaggtgatgggttgata

SEQ ID NO: 124333 - DNA, 22 bp, Artificial Sequence
  Synthetic oligonucleotide; CTA chr11 5336770 5336791 5336775 5336770 -
ggtgatgggttgataggtacag

SEQ ID NO: 124334 - DNA, 22 bp, Artificial Sequence
  Synthetic oligonucleotide; TTG chr11 5336758 5336779 5336763 5336758 -
ataggtacagcaaaccaccatt

SEQ ID NO: 124335 - DNA, 22 bp, Artificial Sequence
  Synthetic oligonucleotide; TTG chr11 5336735 5336756 5336740 5336735 -
cacacatttacgtatgtaataa

SEQ ID NO: 124336 - DNA, 22 bp, Artificial Sequence
  Synthetic oligonucleotide; TTT chr11 5336726 5336747 5336731 5336726 -
acgtatgtaataaacctgcaca

SEQ ID NO: 124337 - DNA, 22 bp, Artificial Sequence
  Synthetic oligonucleotide; TTA chr11 5336725 5336746 5336730 5336725 -
cgtatgtaataaacctgcacat

SEQ ID NO: 124338 - DNA, 22 bp, Artificial Sequence
  Synthetic oligonucleotide; CTG chr11 5336708 5336729 5336713 5336708 -
cacatcctgcacatgtacctca

SEQ ID NO: 124339 - DNA, 22 bp, Artificial Sequence
  Synthetic oligonucleotide; CTG chr11 5336699 5336720 5336704 5336699 -
cacatgtacctcagaacttaaa

SEQ ID NO: 124340 - DNA, 22 bp, Artificial Sequence
  Synthetic oligonucleotide; CTC chr11 5336687 5336708 5336692 5336687 -
agaacttaaaaattaaaaaaat

SEQ ID NO: 124341 - DNA, 22 bp, Artificial Sequence
  Synthetic oligonucleotide; CTT chr11 5336680 5336701 5336685 5336680 -
aaaaattaaaaaaattgaatgt

SEQ ID NO: 124342 - DNA, 22 bp, Artificial Sequence
  Synthetic oligonucleotide; TTA chr11 5336679 5336700 5336684 5336679 -
aaaattaaaaaaattgaatgta

SEQ ID NO: 124343 - DNA, 22 bp, Artificial Sequence
  Synthetic oligonucleotide; TTA chr11 5336672 5336693 5336677 5336672 -
aaaaaattgaatgtacataaaa

SEQ ID NO: 124344 - DNA, 22 bp, Artificial Sequence
  Synthetic oligonucleotide; TTG chr11 5336663 5336684 5336668 5336663 -
aatgtacataaaaatatggaaa

SEQ ID NO: 124345 - DNA, 22 bp, Artificial Sequence
  Synthetic oligonucleotide; TTA chr11 5336638 5336659 5336643 5336638 -
ataaatgtaattcactgcatta

SEQ ID NO: 124346 - DNA, 22 bp, Artificial Sequence
  Synthetic oligonucleotide; TTC chr11 5336625 5336646 5336630 5336625 -
actgcattaaaaaaaaataatg

SEQ ID NO: 124347 - DNA, 22 bp, Artificial Sequence
  Synthetic oligonucleotide; CTG chr11 5336621 5336642 5336626 5336621 -
cattaaaaaaaaataatggcaa

SEQ ID NO: 124348 - DNA, 22 bp, Artificial Sequence
  Synthetic oligonucleotide; TTA chr11 5336616 5336637 5336621 5336616 -
aaaaaaaataatggcaaaaact

SEQ ID NO: 124349 - DNA, 22 bp, Artificial Sequence
  Synthetic oligonucleotide; CTG chr11 5336593 5336614 5336598 5336593 -
caattactgttgcaccaaccta

SEQ ID NO: 124350 - DNA, 22 bp, Artificial Sequence
  Synthetic oligonucleotide; TTA chr11 5336587 5336608 5336592 5336587 -
ctgttgcaccaacctaatataa

SEQ ID NO: 124351 - DNA, 22 bp, Artificial Sequence
  Synthetic oligonucleotide; CTG chr11 5336584 5336605 5336589 5336584 -
ttgcaccaacctaatataagga

SEQ ID NO: 124352 - DNA, 22 bp, Artificial Sequence
  Synthetic oligonucleotide; TTG chr11 5336581 5336602 5336586 5336581 -
caccaacctaatataaggaaat

SEQ ID NO: 124353 - DNA, 22 bp, Artificial Sequence
  Synthetic oligonucleotide; CTA chr11 5336571 5336592 5336576 5336571 -
atataaggaaatagcagatgtg

SEQ ID NO: 124354 - DNA, 22 bp, Artificial Sequence
  Synthetic oligonucleotide; TTA chr11 5336545 5336566 5336550 5336545 -
tggaggaaggcaagtcccaaga

SEQ ID NO: 124355 - DNA, 22 bp, Artificial Sequence
  Synthetic oligonucleotide; TTG chr11 5336499 5336520 5336504 5336499 -
aaaactcaagagagcctggtag

SEQ ID NO: 124356 - DNA, 22 bp, Artificial Sequence
  Synthetic oligonucleotide; CTC chr11 5336492 5336513 5336497 5336492 -
aagagagcctggtagtttagtc

SEQ ID NO: 124357 - DNA, 22 bp, Artificial Sequence
  Synthetic oligonucleotide; CTG chr11 5336481 5336502 5336486 5336481 -
gtagtttagtcccagtccaagt

SEQ ID NO: 124358 - DNA, 22 bp, Artificial Sequence
  Synthetic oligonucleotide; TTT chr11 5336474 5336495 5336479 5336474 -
agtcccagtccaagtctgaagg

SEQ ID NO: 124359 - DNA, 22 bp, Artificial Sequence
  Synthetic oligonucleotide; TTA chr11 5336473 5336494 5336478 5336473 -
gtcccagtccaagtctgaaggc

SEQ ID NO: 124360 - DNA, 22 bp, Artificial Sequence
  Synthetic oligonucleotide; CTG chr11 5336456 5336477 5336461 5336456 -
aaggcctgggaaacaggaggat

SEQ ID NO: 124361 - DNA, 22 bp, Artificial Sequence
  Synthetic oligonucleotide; CTG chr11 5336448 5336469 5336453 5336448 -
ggaaacaggaggattgatggtg

SEQ ID NO: 124362 - DNA, 22 bp, Artificial Sequence
  Synthetic oligonucleotide; TTG chr11 5336432 5336453 5336437 5336432 -
atggtgtacttgcaacccaaaa

SEQ ID NO: 124363 - DNA, 22 bp, Artificial Sequence
  Synthetic oligonucleotide; CTT chr11 5336421 5336442 5336426 5336421 -
gcaacccaaaagccatcaggct

SEQ ID NO: 124364 - DNA, 22 bp, Artificial Sequence
  Synthetic oligonucleotide; TTG chr11 5336420 5336441 5336425 5336420 -
caacccaaaagccatcaggctt

SEQ ID NO: 124365 - DNA, 22 bp, Artificial Sequence
  Synthetic oligonucleotide; CTT chr11 5336398 5336419 5336403 5336398 -
cagacccaggaagttttgatgt

SEQ ID NO: 124366 - DNA, 22 bp, Artificial Sequence
  Synthetic oligonucleotide; TTC chr11 5336397 5336418 5336402 5336397 -
agacccaggaagttttgatgtt

SEQ ID NO: 124367 - DNA, 22 bp, Artificial Sequence
  Synthetic oligonucleotide; TTT chr11 5336382 5336403 5336387 5336382 -
tgatgtttcagttcaatctaaa

SEQ ID NO: 124368 - DNA, 22 bp, Artificial Sequence
  Synthetic oligonucleotide; TTT chr11 5336381 5336402 5336386 5336381 -
gatgtttcagttcaatctaaag

SEQ ID NO: 124369 - DNA, 22 bp, Artificial Sequence
  Synthetic oligonucleotide; TTG chr11 5336380 5336401 5336385 5336380 -
atgtttcagttcaatctaaagg

SEQ ID NO: 124370 - DNA, 22 bp, Artificial Sequence
  Synthetic oligonucleotide; TTT chr11 5336374 5336395 5336379 5336374 -
cagttcaatctaaaggcagaaa

SEQ ID NO: 124371 - DNA, 22 bp, Artificial Sequence
  Synthetic oligonucleotide; TTC chr11 5336373 5336394 5336378 5336373 -
agttcaatctaaaggcagaaaa

SEQ ID NO: 124372 - DNA, 22 bp, Artificial Sequence
  Synthetic oligonucleotide; TTC chr11 5336368 5336389 5336373 5336368 -
aatctaaaggcagaaaaaaagg

SEQ ID NO: 124373 - DNA, 22 bp, Artificial Sequence
  Synthetic oligonucleotide; CTA chr11 5336362 5336383 5336367 5336362 -
aaggcagaaaaaaaggtctaga

SEQ ID NO: 124374 - DNA, 22 bp, Artificial Sequence
  Synthetic oligonucleotide; CTA chr11 5336342 5336363 5336347 5336342 -
gattccagtttgaaggccatca

SEQ ID NO: 124375 - DNA, 22 bp, Artificial Sequence
  Synthetic oligonucleotide; TTC chr11 5336337 5336358 5336342 5336337 -
cagtttgaaggccatcaataag

SEQ ID NO: 124376 - DNA, 22 bp, Artificial Sequence
  Synthetic oligonucleotide; TTT chr11 5336331 5336352 5336336 5336331 -
gaaggccatcaataaggaataa

SEQ ID NO: 124377 - DNA, 22 bp, Artificial Sequence
  Synthetic oligonucleotide; TTG chr11 5336330 5336351 5336335 5336330 -
aaggccatcaataaggaataat

SEQ ID NO: 124378 - DNA, 22 bp, Artificial Sequence
  Synthetic oligonucleotide; TTC chr11 5336306 5336327 5336311 5336306 -
tctctgatttggggaagggtca

SEQ ID NO: 124379 - DNA, 22 bp, Artificial Sequence
  Synthetic oligonucleotide; CTC chr11 5336304 5336325 5336309 5336304 -
tctgatttggggaagggtcaga

SEQ ID NO: 124380 - DNA, 22 bp, Artificial Sequence
  Synthetic oligonucleotide; CTC chr11 5336302 5336323 5336307 5336302 -
tgatttggggaagggtcagact

SEQ ID NO: 124381 - DNA, 22 bp, Artificial Sequence
  Synthetic oligonucleotide; CTG chr11 5336300 5336321 5336305 5336300 -
atttggggaagggtcagacttt

SEQ ID NO: 124382 - DNA, 22 bp, Artificial Sequence
  Synthetic oligonucleotide; TTT chr11 5336296 5336317 5336301 5336296 -
ggggaagggtcagactttttgt

SEQ ID NO: 124383 - DNA, 22 bp, Artificial Sequence
  Synthetic oligonucleotide; TTG chr11 5336295 5336316 5336300 5336295 -
gggaagggtcagactttttgtt

SEQ ID NO: 124384 - DNA, 22 bp, Artificial Sequence
  Synthetic oligonucleotide; CTT chr11 5336279 5336300 5336284 5336279 -
tttgttctattcaggttttcaa

SEQ ID NO: 124385 - DNA, 22 bp, Artificial Sequence
  Synthetic oligonucleotide; TTT chr11 5336278 5336299 5336283 5336278 -
ttgttctattcaggttttcaac

SEQ ID NO: 124386 - DNA, 22 bp, Artificial Sequence
  Synthetic oligonucleotide; TTT chr11 5336277 5336298 5336282 5336277 -
tgttctattcaggttttcaact

SEQ ID NO: 124387 - DNA, 22 bp, Artificial Sequence
  Synthetic oligonucleotide; TTT chr11 5336276 5336297 5336281 5336276 -
gttctattcaggttttcaactg

SEQ ID NO: 124388 - DNA, 22 bp, Artificial Sequence
  Synthetic oligonucleotide; TTG chr11 5336275 5336296 5336280 5336275 -
ttctattcaggttttcaactga

SEQ ID NO: 124389 - DNA, 22 bp, Artificial Sequence
  Synthetic oligonucleotide; TTC chr11 5336272 5336293 5336277 5336272 -
tattcaggttttcaactgattg

SEQ ID NO: 124390 - DNA, 22 bp, Artificial Sequence
  Synthetic oligonucleotide; CTA chr11 5336270 5336291 5336275 5336270 -
ttcaggttttcaactgattgga

SEQ ID NO: 124391 - DNA, 22 bp, Artificial Sequence
  Synthetic oligonucleotide; TTC chr11 5336267 5336288 5336272 5336267 -
aggttttcaactgattggagga

SEQ ID NO: 124392 - DNA, 22 bp, Artificial Sequence
  Synthetic oligonucleotide; TTT chr11 5336261 5336282 5336266 5336261 -
tcaactgattggaggaagccgc

SEQ ID NO: 124393 - DNA, 22 bp, Artificial Sequence
  Synthetic oligonucleotide; TTT chr11 5336260 5336281 5336265 5336260 -
caactgattggaggaagccgcc

SEQ ID NO: 124394 - DNA, 22 bp, Artificial Sequence
  Synthetic oligonucleotide; TTC chr11 5336259 5336280 5336264 5336259 -
aactgattggaggaagccgcct

SEQ ID NO: 124395 - DNA, 22 bp, Artificial Sequence
  Synthetic oligonucleotide; CTG chr11 5336254 5336275 5336259 5336254 -
attggaggaagccgcctgcaat

SEQ ID NO: 124396 - DNA, 22 bp, Artificial Sequence
  Synthetic oligonucleotide; TTG chr11 5336250 5336271 5336255 5336250 -
gaggaagccgcctgcaatagga

SEQ ID NO: 124397 - DNA, 22 bp, Artificial Sequence
  Synthetic oligonucleotide; CTG chr11 5336236 5336257 5336241 5336236 -
caataggaaggaccatctgctc

SEQ ID NO: 124398 - DNA, 22 bp, Artificial Sequence
  Synthetic oligonucleotide; CTG chr11 5336217 5336238 5336222 5336217 -
ctctacttggtctaccgattta

SEQ ID NO: 124399 - DNA, 22 bp, Artificial Sequence
  Synthetic oligonucleotide; CTC chr11 5336214 5336235 5336219 5336214 -
tacttggtctaccgatttaaat

SEQ ID NO: 124400 - DNA, 22 bp, Artificial Sequence
  Synthetic oligonucleotide; CTA chr11 5336212 5336233 5336217 5336212 -
cttggtctaccgatttaaatgt

SEQ ID NO: 124401 - DNA, 22 bp, Artificial Sequence
  Synthetic oligonucleotide; CTT chr11 5336209 5336230 5336214 5336209 -
ggtctaccgatttaaatgttaa

SEQ ID NO: 124402 - DNA, 22 bp, Artificial Sequence
  Synthetic oligonucleotide; TTG chr11 5336208 5336229 5336213 5336208 -
gtctaccgatttaaatgttaat

SEQ ID NO: 124403 - DNA, 22 bp, Artificial Sequence
  Synthetic oligonucleotide; CTA chr11 5336203 5336224 5336208 5336203 -
ccgatttaaatgttaatcttgc

SEQ ID NO: 124404 - DNA, 22 bp, Artificial Sequence
  Synthetic oligonucleotide; TTT chr11 5336196 5336217 5336201 5336196 -
aaatgttaatcttgcctaaaaa

SEQ ID NO: 124405 - DNA, 22 bp, Artificial Sequence
  Synthetic oligonucleotide; TTA chr11 5336195 5336216 5336200 5336195 -
aatgttaatcttgcctaaaaac

SEQ ID NO: 124406 - DNA, 22 bp, Artificial Sequence
  Synthetic oligonucleotide; TTA chr11 5336188 5336209 5336193 5336188 -
atcttgcctaaaaacaccctca

SEQ ID NO: 124407 - DNA, 22 bp, Artificial Sequence
  Synthetic oligonucleotide; CTT chr11 5336183 5336204 5336188 5336183 -
gcctaaaaacaccctcacaaaa

SEQ ID NO: 124408 - DNA, 22 bp, Artificial Sequence
  Synthetic oligonucleotide; TTG chr11 5336182 5336203 5336187 5336182 -
cctaaaaacaccctcacaaaaa

SEQ ID NO: 124409 - DNA, 22 bp, Artificial Sequence
  Synthetic oligonucleotide; CTA chr11 5336178 5336199 5336183 5336178 -
aaaacaccctcacaaaaacatc

SEQ ID NO: 124410 - DNA, 22 bp, Artificial Sequence
  Synthetic oligonucleotide; CTC chr11 5336167 5336188 5336172 5336167 -
acaaaaacatctagaataatgt

SEQ ID NO: 124411 - DNA, 22 bp, Artificial Sequence
  Synthetic oligonucleotide; CTA chr11 5336154 5336175 5336159 5336154 -
gaataatgtttgacaaatattt

SEQ ID NO: 124412 - DNA, 22 bp, Artificial Sequence
  Synthetic oligonucleotide; TTT chr11 5336143 5336164 5336148 5336143 -
gacaaatatttgggcaccccat

SEQ ID NO: 124413 - DNA, 22 bp, Artificial Sequence
  Synthetic oligonucleotide; TTG chr11 5336142 5336163 5336147 5336142 -
acaaatatttgggcaccccatg

SEQ ID NO: 124414 - DNA, 22 bp, Artificial Sequence
  Synthetic oligonucleotide; TTT chr11 5336132 5336153 5336137 5336132 -
gggcaccccatggcccagtcaa

SEQ ID NO: 124415 - DNA, 22 bp, Artificial Sequence
  Synthetic oligonucleotide; TTG chr11 5336131 5336152 5336136 5336131 -
ggcaccccatggcccagtcaaa

SEQ ID NO: 124416 - DNA, 22 bp, Artificial Sequence
  Synthetic oligonucleotide; TTG chr11 5336106 5336127 5336111 5336106 -
gcatataaaattaaccatcaga

SEQ ID NO: 124417 - DNA, 22 bp, Artificial Sequence
  Synthetic oligonucleotide; TTA chr11 5336093 5336114 5336098 5336093 -
accatcagagcctgtagaggat

SEQ ID NO: 124418 - DNA, 22 bp, Artificial Sequence
  Synthetic oligonucleotide; CTG chr11 5336079 5336100 5336084 5336079 -
tagaggatgagttaaaggatgg

SEQ ID NO: 124419 - DNA, 22 bp, Artificial Sequence
  Synthetic oligonucleotide; TTA chr11 5336065 5336086 5336070 5336065 -
aaggatggaatcttcggagata

SEQ ID NO: 124420 - DNA, 22 bp, Artificial Sequence
  Synthetic oligonucleotide; CTT chr11 5336051 5336072 5336056 5336051 -
cggagataattgtggaatccag

SEQ ID NO: 124421 - DNA, 22 bp, Artificial Sequence
  Synthetic oligonucleotide; TTC chr11 5336050 5336071 5336055 5336050 -
ggagataattgtggaatccaga

SEQ ID NO: 124422 - DNA, 22 bp, Artificial Sequence
  Synthetic oligonucleotide; TTG chr11 5336039 5336060 5336044 5336039 -
tggaatccagaaggctgacaga

SEQ ID NO: 124423 - DNA, 22 bp, Artificial Sequence
  Synthetic oligonucleotide; CTG chr11 5336022 5336043 5336027 5336022 -
acagataatagaatcaaactac

SEQ ID NO: 124424 - DNA, 22 bp, Artificial Sequence
  Synthetic oligonucleotide; CTA chr11 5336001 5336022 5336006 5336001 -
cacagaaaaaaaaaaaaaagaa

SEQ ID NO: 124425 - DNA, 22 bp, Artificial Sequence
  Synthetic oligonucleotide; CTG chr11 5335975 5335996 5335980 5335975 -
gtattgtcagcacagacttact

SEQ ID NO: 124426 - DNA, 22 bp, Artificial Sequence
  Synthetic oligonucleotide; TTG chr11 5335969 5335990 5335974 5335969 -
tcagcacagacttactcaacaa

SEQ ID NO: 124427 - DNA, 22 bp, Artificial Sequence
  Synthetic oligonucleotide; CTT chr11 5335956 5335977 5335961 5335956 -
actcaacaaacagcaaaaatcc

SEQ ID NO: 124428 - DNA, 22 bp, Artificial Sequence
  Synthetic oligonucleotide; TTA chr11 5335955 5335976 5335960 5335955 -
ctcaacaaacagcaaaaatcct

SEQ ID NO: 124429 - DNA, 22 bp, Artificial Sequence
  Synthetic oligonucleotide; CTC chr11 5335952 5335973 5335957 5335952 -
aacaaacagcaaaaatcctagg

SEQ ID NO: 124430 - DNA, 22 bp, Artificial Sequence
  Synthetic oligonucleotide; CTA chr11 5335932 5335953 5335937 5335932 -
ggatagagaccttcctgaatcg

SEQ ID NO: 124431 - DNA, 22 bp, Artificial Sequence
  Synthetic oligonucleotide; CTT chr11 5335919 5335940 5335924 5335919 -
cctgaatcgttagcgatataag

SEQ ID NO: 124432 - DNA, 22 bp, Artificial Sequence
  Synthetic oligonucleotide; TTC chr11 5335918 5335939 5335923 5335918 -
ctgaatcgttagcgatataagc

SEQ ID NO: 124433 - DNA, 22 bp, Artificial Sequence
  Synthetic oligonucleotide; CTG chr11 5335915 5335936 5335920 5335915 -
aatcgttagcgatataagctta

SEQ ID NO: 124434 - DNA, 22 bp, Artificial Sequence
  Synthetic oligonucleotide; TTA chr11 5335907 5335928 5335912 5335907 -
gcgatataagcttattatactt

SEQ ID NO: 124435 - DNA, 22 bp, Artificial Sequence
  Synthetic oligonucleotide; CTT chr11 5335894 5335915 5335899 5335894 -
attatacttgaatgttgccttc

SEQ ID NO: 124436 - DNA, 22 bp, Artificial Sequence
  Synthetic oligonucleotide; TTA chr11 5335893 5335914 5335898 5335893 -
ttatacttgaatgttgccttcc

SEQ ID NO: 124437 - DNA, 22 bp, Artificial Sequence
  Synthetic oligonucleotide; TTA chr11 5335890 5335911 5335895 5335890 -
tacttgaatgttgccttcctat

SEQ ID NO: 124438 - DNA, 22 bp, Artificial Sequence
  Synthetic oligonucleotide; CTT chr11 5335885 5335906 5335890 5335885 -
gaatgttgccttcctatatgcc

SEQ ID NO: 124439 - DNA, 22 bp, Artificial Sequence
  Synthetic oligonucleotide; TTG chr11 5335884 5335905 5335889 5335884 -
aatgttgccttcctatatgcca

SEQ ID NO: 124440 - DNA, 22 bp, Artificial Sequence
  Synthetic oligonucleotide; TTG chr11 5335877 5335898 5335882 5335877 -
ccttcctatatgccatatgtaa

SEQ ID NO: 124441 - DNA, 22 bp, Artificial Sequence
  Synthetic oligonucleotide; CTT chr11 5335873 5335894 5335878 5335873 -
cctatatgccatatgtaatata

SEQ ID NO: 124442 - DNA, 22 bp, Artificial Sequence
  Synthetic oligonucleotide; TTC chr11 5335872 5335893 5335877 5335872 -
ctatatgccatatgtaatataa

SEQ ID NO: 124443 - DNA, 22 bp, Artificial Sequence
  Synthetic oligonucleotide; CTA chr11 5335869 5335890 5335874 5335869 -
tatgccatatgtaatataaggc

SEQ ID NO: 124444 - DNA, 22 bp, Artificial Sequence
  Synthetic oligonucleotide; TTA chr11 5335839 5335860 5335844 5335839 -
gatatagactgtgatgccagag

SEQ ID NO: 124445 - DNA, 22 bp, Artificial Sequence
  Synthetic oligonucleotide; CTG chr11 5335828 5335849 5335833 5335828 -
tgatgccagagctcagaccaag

SEQ ID NO: 124446 - DNA, 22 bp, Artificial Sequence
  Synthetic oligonucleotide; CTC chr11 5335814 5335835 5335819 5335814 -
agaccaagagccaaggaatagg

SEQ ID NO: 124447 - DNA, 22 bp, Artificial Sequence
  Synthetic oligonucleotide; TTT chr11 5335774 5335795 5335779 5335774 -
tcattttaaaaagttaggtaat

SEQ ID NO: 124448 - DNA, 22 bp, Artificial Sequence
  Synthetic oligonucleotide; TTT chr11 5335773 5335794 5335778 5335773 -
cattttaaaaagttaggtaatt

SEQ ID NO: 124449 - DNA, 22 bp, Artificial Sequence
  Synthetic oligonucleotide; TTC chr11 5335772 5335793 5335777 5335772 -
attttaaaaagttaggtaattt

SEQ ID NO: 124450 - DNA, 22 bp, Artificial Sequence
  Synthetic oligonucleotide; TTT chr11 5335768 5335789 5335773 5335768 -
taaaaagttaggtaatttctaa

SEQ ID NO: 124451 - DNA, 22 bp, Artificial Sequence
  Synthetic oligonucleotide; TTT chr11 5335767 5335788 5335772 5335767 -
aaaaagttaggtaatttctaat

SEQ ID NO: 124452 - DNA, 22 bp, Artificial Sequence
  Synthetic oligonucleotide; TTA chr11 5335766 5335787 5335771 5335766 -
aaaagttaggtaatttctaata

SEQ ID NO: 124453 - DNA, 22 bp, Artificial Sequence
  Synthetic oligonucleotide; TTA chr11 5335758 5335779 5335763 5335758 -
ggtaatttctaataatgtggct

SEQ ID NO: 124454 - DNA, 22 bp, Artificial Sequence
  Synthetic oligonucleotide; TTT chr11 5335750 5335771 5335755 5335750 -
ctaataatgtggctgcctgagt

SEQ ID NO: 124455 - DNA, 22 bp, Artificial Sequence
  Synthetic oligonucleotide; TTC chr11 5335749 5335770 5335754 5335749 -
taataatgtggctgcctgagta

SEQ ID NO: 124456 - DNA, 22 bp, Artificial Sequence
  Synthetic oligonucleotide; CTA chr11 5335747 5335768 5335752 5335747 -
ataatgtggctgcctgagtatt

SEQ ID NO: 124457 - DNA, 22 bp, Artificial Sequence
  Synthetic oligonucleotide; CTG chr11 5335735 5335756 5335740 5335735 -
cctgagtattttcagcacagat

SEQ ID NO: 124458 - DNA, 22 bp, Artificial Sequence
  Synthetic oligonucleotide; CTG chr11 5335731 5335752 5335736 5335731 -
agtattttcagcacagatattc

SEQ ID NO: 124459 - DNA, 22 bp, Artificial Sequence
  Synthetic oligonucleotide; TTT chr11 5335724 5335745 5335729 5335724 -
tcagcacagatattctaataaa

SEQ ID NO: 124460 - DNA, 22 bp, Artificial Sequence
  Synthetic oligonucleotide; TTT chr11 5335723 5335744 5335728 5335723 -
cagcacagatattctaataaat

SEQ ID NO: 124461 - DNA, 22 bp, Artificial Sequence
  Synthetic oligonucleotide; TTC chr11 5335722 5335743 5335727 5335722 -
agcacagatattctaataaata

SEQ ID NO: 124462 - DNA, 22 bp, Artificial Sequence
  Synthetic oligonucleotide; TTC chr11 5335709 5335730 5335714 5335709 -
taataaatattgtgttatgtga

SEQ ID NO: 124463 - DNA, 22 bp, Artificial Sequence
  Synthetic oligonucleotide; CTA chr11 5335707 5335728 5335712 5335707 -
ataaatattgtgttatgtgatt

SEQ ID NO: 124464 - DNA, 22 bp, Artificial Sequence
  Synthetic oligonucleotide; TTG chr11 5335697 5335718 5335702 5335697 -
tgttatgtgatttagaaagaga

SEQ ID NO: 124465 - DNA, 22 bp, Artificial Sequence
  Synthetic oligonucleotide; TTA chr11 5335692 5335713 5335697 5335692 -
tgtgatttagaaagagacaggc

SEQ ID NO: 124466 - DNA, 22 bp, Artificial Sequence
  Synthetic oligonucleotide; TTT chr11 5335684 5335705 5335689 5335684 -
agaaagagacaggcactcagcg

SEQ ID NO: 124467 - DNA, 22 bp, Artificial Sequence
  Synthetic oligonucleotide; TTA chr11 5335683 5335704 5335688 5335683 -
gaaagagacaggcactcagcgg

SEQ ID NO: 124468 - DNA, 22 bp, Artificial Sequence
  Synthetic oligonucleotide; CTC chr11 5335666 5335687 5335671 5335666 -
agcggatgacccttgtcaggaa

SEQ ID NO: 124469 - DNA, 22 bp, Artificial Sequence
  Synthetic oligonucleotide; CTT chr11 5335652 5335673 5335657 5335652 -
gtcaggaaacactgcatcaaag

SEQ ID NO: 124470 - DNA, 22 bp, Artificial Sequence
  Synthetic oligonucleotide; TTG chr11 5335651 5335672 5335656 5335651 -
tcaggaaacactgcatcaaaga

SEQ ID NO: 124471 - DNA, 22 bp, Artificial Sequence
  Synthetic oligonucleotide; CTG chr11 5335638 5335659 5335643 5335638 -
catcaaagaaggcttttattac

SEQ ID NO: 124472 - DNA, 22 bp, Artificial Sequence
  Synthetic oligonucleotide; CTT chr11 5335623 5335644 5335628 5335623 -
ttattacaggagatggaggtcc

SEQ ID NO: 124473 - DNA, 22 bp, Artificial Sequence
  Synthetic oligonucleotide; TTT chr11 5335622 5335643 5335627 5335622 -
tattacaggagatggaggtcct

SEQ ID NO: 124474 - DNA, 22 bp, Artificial Sequence
  Synthetic oligonucleotide; TTT chr11 5335621 5335642 5335626 5335621 -
attacaggagatggaggtcctt

SEQ ID NO: 124475 - DNA, 22 bp, Artificial Sequence
  Synthetic oligonucleotide; TTA chr11 5335620 5335641 5335625 5335620 -
ttacaggagatggaggtccttc

SEQ ID NO: 124476 - DNA, 22 bp, Artificial Sequence
  Synthetic oligonucleotide; TTA chr11 5335617 5335638 5335622 5335617 -
caggagatggaggtccttccca

SEQ ID NO: 124477 - DNA, 22 bp, Artificial Sequence
  Synthetic oligonucleotide; CTT chr11 5335599 5335620 5335604 5335599 -
cccaatctgagattatgctgct

SEQ ID NO: 124478 - DNA, 22 bp, Artificial Sequence
  Synthetic oligonucleotide; TTC chr11 5335598 5335619 5335603 5335598 -
ccaatctgagattatgctgctg

SEQ ID NO: 124479 - DNA, 22 bp, Artificial Sequence
  Synthetic oligonucleotide; CTG chr11 5335590 5335611 5335595 5335590 -
agattatgctgctgtgacatga

SEQ ID NO: 124480 - DNA, 22 bp, Artificial Sequence
  Synthetic oligonucleotide; TTA chr11 5335584 5335605 5335589 5335584 -
tgctgctgtgacatgatacttt

SEQ ID NO: 124481 - DNA, 22 bp, Artificial Sequence
  Synthetic oligonucleotide; CTG chr11 5335579 5335600 5335584 5335579 -
ctgtgacatgatactttacttc

SEQ ID NO: 124482 - DNA, 22 bp, Artificial Sequence
  Synthetic oligonucleotide; CTG chr11 5335576 5335597 5335581 5335576 -
tgacatgatactttacttcaca

SEQ ID NO: 124483 - DNA, 22 bp, Artificial Sequence
  Synthetic oligonucleotide; CTT chr11 5335563 5335584 5335568 5335563 -
tacttcacaggcaatacagcag

SEQ ID NO: 124484 - DNA, 22 bp, Artificial Sequence
  Synthetic oligonucleotide; TTT chr11 5335562 5335583 5335567 5335562 -
acttcacaggcaatacagcagg

SEQ ID NO: 124485 - DNA, 22 bp, Artificial Sequence
  Synthetic oligonucleotide; TTA chr11 5335561 5335582 5335566 5335561 -
cttcacaggcaatacagcagga

SEQ ID NO: 124486 - DNA, 22 bp, Artificial Sequence
  Synthetic oligonucleotide; CTT chr11 5335558 5335579 5335563 5335558 -
cacaggcaatacagcaggaaat

SEQ ID NO: 124487 - DNA, 22 bp, Artificial Sequence
  Synthetic oligonucleotide; TTC chr11 5335557 5335578 5335562 5335557 -
acaggcaatacagcaggaaata

SEQ ID NO: 124488 - DNA, 22 bp, Artificial Sequence
  Synthetic oligonucleotide; CTT chr11 5335513 5335534 5335518 5335513 -
agaaaatacatgaatgagagac

SEQ ID NO: 124489 - DNA, 22 bp, Artificial Sequence
  Synthetic oligonucleotide; TTA chr11 5335512 5335533 5335517 5335512 -
gaaaatacatgaatgagagaca

SEQ ID NO: 124490 - DNA, 22 bp, Artificial Sequence
  Synthetic oligonucleotide; CTA chr11 5335478 5335499 5335483 5335478 -
tttaaggaaatagaagatattt

SEQ ID NO: 124491 - DNA, 22 bp, Artificial Sequence
  Synthetic oligonucleotide; TTT chr11 5335475 5335496 5335480 5335475 -
aaggaaatagaagatattttgg

SEQ ID NO: 124492 - DNA, 22 bp, Artificial Sequence
  Synthetic oligonucleotide; TTA chr11 5335474 5335495 5335479 5335474 -
aggaaatagaagatattttggg

SEQ ID NO: 124493 - DNA, 22 bp, Artificial Sequence
  Synthetic oligonucleotide; TTT chr11 5335456 5335477 5335461 5335456 -
tgggtgccctgcctacttcctc

SEQ ID NO: 124494 - DNA, 22 bp, Artificial Sequence
  Synthetic oligonucleotide; TTT chr11 5335455 5335476 5335460 5335455 -
gggtgccctgcctacttcctcc

SEQ ID NO: 124495 - DNA, 22 bp, Artificial Sequence
  Synthetic oligonucleotide; TTG chr11 5335454 5335475 5335459 5335454 -
ggtgccctgcctacttcctccc

SEQ ID NO: 124496 - DNA, 22 bp, Artificial Sequence
  Synthetic oligonucleotide; CTG chr11 5335445 5335466 5335450 5335445 -
cctacttcctcccagtgcccct

SEQ ID NO: 124497 - DNA, 22 bp, Artificial Sequence
  Synthetic oligonucleotide; CTA chr11 5335441 5335462 5335446 5335441 -
cttcctcccagtgcccctaagc

SEQ ID NO: 124498 - DNA, 22 bp, Artificial Sequence
  Synthetic oligonucleotide; CTT chr11 5335438 5335459 5335443 5335438 -
cctcccagtgcccctaagcttg

SEQ ID NO: 124499 - DNA, 22 bp, Artificial Sequence
  Synthetic oligonucleotide; TTC chr11 5335437 5335458 5335442 5335437 -
ctcccagtgcccctaagcttgg

SEQ ID NO: 124500 - DNA, 22 bp, Artificial Sequence
  Synthetic oligonucleotide; CTC chr11 5335434 5335455 5335439 5335434 -
ccagtgcccctaagcttggtga

SEQ ID NO: 124501 - DNA, 22 bp, Artificial Sequence
  Synthetic oligonucleotide; CTA chr11 5335422 5335443 5335427 5335422 -
agcttggtgactttgagtgttg

SEQ ID NO: 124502 - DNA, 22 bp, Artificial Sequence
  Synthetic oligonucleotide; CTT chr11 5335417 5335438 5335422 5335417 -
ggtgactttgagtgttggctga

SEQ ID NO: 124503 - DNA, 22 bp, Artificial Sequence
  Synthetic oligonucleotide; TTG chr11 5335416 5335437 5335421 5335416 -
gtgactttgagtgttggctgat

SEQ ID NO: 124504 - DNA, 22 bp, Artificial Sequence
  Synthetic oligonucleotide; CTT chr11 5335409 5335430 5335414 5335409 -
tgagtgttggctgataatagtt

SEQ ID NO: 124505 - DNA, 22 bp, Artificial Sequence
  Synthetic oligonucleotide; TTT chr11 5335408 5335429 5335413 5335408 -
gagtgttggctgataatagttg

SEQ ID NO: 124506 - DNA, 22 bp, Artificial Sequence
  Synthetic oligonucleotide; TTG chr11 5335407 5335428 5335412 5335407 -
agtgttggctgataatagttgt

SEQ ID NO: 124507 - DNA, 22 bp, Artificial Sequence
  Synthetic oligonucleotide; TTG chr11 5335400 5335421 5335405 5335400 -
gctgataatagttgttcccatt

SEQ ID NO: 124508 - DNA, 22 bp, Artificial Sequence
  Synthetic oligonucleotide; CTG chr11 5335396 5335417 5335401 5335396 -
ataatagttgttcccattctct

SEQ ID NO: 124509 - DNA, 22 bp, Artificial Sequence
  Synthetic oligonucleotide; TTG chr11 5335386 5335407 5335391 5335386 -
ttcccattctctggaggcttat

SEQ ID NO: 124510 - DNA, 22 bp, Artificial Sequence
  Synthetic oligonucleotide; TTC chr11 5335383 5335404 5335388 5335383 -
ccattctctggaggcttatcct

SEQ ID NO: 124511 - DNA, 22 bp, Artificial Sequence
  Synthetic oligonucleotide; TTC chr11 5335377 5335398 5335382 5335377 -
tctggaggcttatcctccacca

SEQ ID NO: 124512 - DNA, 22 bp, Artificial Sequence
  Synthetic oligonucleotide; CTC chr11 5335375 5335396 5335380 5335375 -
tggaggcttatcctccaccaac

SEQ ID NO: 124513 - DNA, 22 bp, Artificial Sequence
  Synthetic oligonucleotide; CTG chr11 5335373 5335394 5335378 5335373 -
gaggcttatcctccaccaacag

SEQ ID NO: 124514 - DNA, 22 bp, Artificial Sequence
  Synthetic oligonucleotide; CTT chr11 5335366 5335387 5335371 5335366 -
atcctccaccaacagtgtcact

SEQ ID NO: 124515 - DNA, 22 bp, Artificial Sequence
  Synthetic oligonucleotide; TTA chr11 5335365 5335386 5335370 5335365 -
tcctccaccaacagtgtcactt

SEQ ID NO: 124516 - DNA, 22 bp, Artificial Sequence
  Synthetic oligonucleotide; CTC chr11 5335360 5335381 5335365 5335360 -
caccaacagtgtcacttcacat

SEQ ID NO: 124517 - DNA, 22 bp, Artificial Sequence
  Synthetic oligonucleotide; CTT chr11 5335343 5335364 5335348 5335343 -
cacatgagattttatcccaact

SEQ ID NO: 124518 - DNA, 22 bp, Artificial Sequence
  Synthetic oligonucleotide; TTC chr11 5335342 5335363 5335347 5335342 -
acatgagattttatcccaactc

SEQ ID NO: 124519 - DNA, 22 bp, Artificial Sequence
  Synthetic oligonucleotide; TTT chr11 5335331 5335352 5335336 5335331 -
tatcccaactctggggcagtct

SEQ ID NO: 124520 - DNA, 22 bp, Artificial Sequence
  Synthetic oligonucleotide; TTT chr11 5335330 5335351 5335335 5335330 -
atcccaactctggggcagtctg

SEQ ID NO: 124521 - DNA, 22 bp, Artificial Sequence
  Synthetic oligonucleotide; TTA chr11 5335329 5335350 5335334 5335329 -
tcccaactctggggcagtctgc

SEQ ID NO: 124522 - DNA, 22 bp, Artificial Sequence
  Synthetic oligonucleotide; CTC chr11 5335320 5335341 5335325 5335320 -
tggggcagtctgcaggaaatta

SEQ ID NO: 124523 - DNA, 22 bp, Artificial Sequence
  Synthetic oligonucleotide; CTG chr11 5335318 5335339 5335323 5335318 -
gggcagtctgcaggaaattact

SEQ ID NO: 124524 - DNA, 22 bp, Artificial Sequence
  Synthetic oligonucleotide; CTG chr11 5335308 5335329 5335313 5335308 -
caggaaattactttatatctgt

SEQ ID NO: 124525 - DNA, 22 bp, Artificial Sequence
  Synthetic oligonucleotide; TTA chr11 5335298 5335319 5335303 5335298 -
ctttatatctgttctaagataa

SEQ ID NO: 124526 - DNA, 22 bp, Artificial Sequence
  Synthetic oligonucleotide; CTT chr11 5335295 5335316 5335300 5335295 -
tatatctgttctaagataagtg

SEQ ID NO: 124527 - DNA, 22 bp, Artificial Sequence
  Synthetic oligonucleotide; TTT chr11 5335294 5335315 5335299 5335294 -
atatctgttctaagataagtga

SEQ ID NO: 124528 - DNA, 22 bp, Artificial Sequence
  Synthetic oligonucleotide; TTA chr11 5335293 5335314 5335298 5335293 -
tatctgttctaagataagtgat

SEQ ID NO: 124529 - DNA, 22 bp, Artificial Sequence
  Synthetic oligonucleotide; CTG chr11 5335287 5335308 5335292 5335287 -
ttctaagataagtgatgtttcc

SEQ ID NO: 124530 - DNA, 22 bp, Artificial Sequence
  Synthetic oligonucleotide; TTC chr11 5335284 5335305 5335289 5335284 -
taagataagtgatgtttccagg

SEQ ID NO: 124531 - DNA, 22 bp, Artificial Sequence
  Synthetic oligonucleotide; CTA chr11 5335282 5335303 5335287 5335282 -
agataagtgatgtttccaggaa

SEQ ID NO: 124532 - DNA, 22 bp, Artificial Sequence
  Synthetic oligonucleotide; TTT chr11 5335267 5335288 5335272 5335267 -
ccaggaatagagtcatatttat

SEQ ID NO: 124533 - DNA, 22 bp, Artificial Sequence
  Synthetic oligonucleotide; TTC chr11 5335266 5335287 5335271 5335266 -
caggaatagagtcatatttatg

SEQ ID NO: 124534 - DNA, 22 bp, Artificial Sequence
  Synthetic oligonucleotide; TTT chr11 5335247 5335268 5335252 5335247 -
atggggcagaagattcgtgtac

SEQ ID NO: 124535 - DNA, 22 bp, Artificial Sequence
  Synthetic oligonucleotide; TTA chr11 5335246 5335267 5335251 5335246 -
tggggcagaagattcgtgtact

SEQ ID NO: 124536 - DNA, 22 bp, Artificial Sequence
  Synthetic oligonucleotide; TTC chr11 5335231 5335252 5335236 5335231 -
gtgtactgccagtgagagggtc

SEQ ID NO: 124537 - DNA, 22 bp, Artificial Sequence
  Synthetic oligonucleotide; CTG chr11 5335223 5335244 5335228 5335223 -
ccagtgagagggtcaatatacc

SEQ ID NO: 124538 - DNA, 22 bp, Artificial Sequence
  Synthetic oligonucleotide; CTA chr11 5335199 5335220 5335204 5335199 -
ctaatgaaatgggagggcagcc

SEQ ID NO: 124539 - DNA, 22 bp, Artificial Sequence
  Synthetic oligonucleotide; CTA chr11 5335196 5335217 5335201 5335196 -
atgaaatgggagggcagcctga

SEQ ID NO: 124540 - DNA, 22 bp, Artificial Sequence
  Synthetic oligonucleotide; CTG chr11 5335175 5335196 5335180 5335175 -
aaattaaatcagttatctcagg

SEQ ID NO: 124541 - DNA, 22 bp, Artificial Sequence
  Synthetic oligonucleotide; TTA chr11 5335169 5335190 5335174 5335169 -
aatcagttatctcagggtctta

SEQ ID NO: 124542 - DNA, 22 bp, Artificial Sequence
  Synthetic oligonucleotide; TTA chr11 5335160 5335181 5335165 5335160 -
tctcagggtcttactacctcac

SEQ ID NO: 124543 - DNA, 22 bp, Artificial Sequence
  Synthetic oligonucleotide; CTC chr11 5335156 5335177 5335161 5335156 -
agggtcttactacctcacctca

SEQ ID NO: 124544 - DNA, 22 bp, Artificial Sequence
  Synthetic oligonucleotide; CTT chr11 5335148 5335169 5335153 5335148 -
actacctcacctcattttaagt

SEQ ID NO: 124545 - DNA, 22 bp, Artificial Sequence
  Synthetic oligonucleotide; TTA chr11 5335147 5335168 5335152 5335147 -
ctacctcacctcattttaagtt

SEQ ID NO: 124546 - DNA, 22 bp, Artificial Sequence
  Synthetic oligonucleotide; CTA chr11 5335144 5335165 5335149 5335144 -
cctcacctcattttaagttcaa

SEQ ID NO: 124547 - DNA, 22 bp, Artificial Sequence
  Synthetic oligonucleotide; CTC chr11 5335140 5335161 5335145 5335140 -
acctcattttaagttcaaagca

SEQ ID NO: 124548 - DNA, 22 bp, Artificial Sequence
  Synthetic oligonucleotide; CTC chr11 5335135 5335156 5335140 5335135 -
attttaagttcaaagcatggct

SEQ ID NO: 124549 - DNA, 22 bp, Artificial Sequence
  Synthetic oligonucleotide; TTT chr11 5335131 5335152 5335136 5335131 -
taagttcaaagcatggctcccc

SEQ ID NO: 124550 - DNA, 22 bp, Artificial Sequence
  Synthetic oligonucleotide; TTT chr11 5335130 5335151 5335135 5335130 -
aagttcaaagcatggctcccct

SEQ ID NO: 124551 - DNA, 22 bp, Artificial Sequence
  Synthetic oligonucleotide; TTA chr11 5335129 5335150 5335134 5335129 -
agttcaaagcatggctccccta

SEQ ID NO: 124552 - DNA, 22 bp, Artificial Sequence
  Synthetic oligonucleotide; TTC chr11 5335124 5335145 5335129 5335124 -
aaagcatggctcccctaaatca

SEQ ID NO: 124553 - DNA, 22 bp, Artificial Sequence
  Synthetic oligonucleotide; CTC chr11 5335112 5335133 5335117 5335112 -
ccctaaatcaatccagacctaa

SEQ ID NO: 124554 - DNA, 22 bp, Artificial Sequence
  Synthetic oligonucleotide; CTA chr11 5335107 5335128 5335112 5335107 -
aatcaatccagacctaaatttt

SEQ ID NO: 124555 - DNA, 22 bp, Artificial Sequence
  Synthetic oligonucleotide; CTA chr11 5335091 5335112 5335096 5335091 -
aattttaacttagtacaaagag

SEQ ID NO: 124556 - DNA, 22 bp, Artificial Sequence
  Synthetic oligonucleotide; TTT chr11 5335086 5335107 5335091 5335086 -
taacttagtacaaagaggacac

SEQ ID NO: 124557 - DNA, 22 bp, Artificial Sequence
  Synthetic oligonucleotide; TTT chr11 5335085 5335106 5335090 5335085 -
aacttagtacaaagaggacaca

SEQ ID NO: 124558 - DNA, 22 bp, Artificial Sequence
  Synthetic oligonucleotide; TTA chr11 5335084 5335105 5335089 5335084 -
acttagtacaaagaggacacac

SEQ ID NO: 124559 - DNA, 22 bp, Artificial Sequence
  Synthetic oligonucleotide; CTT chr11 5335080 5335101 5335085 5335080 -
agtacaaagaggacacacaaat

SEQ ID NO: 124560 - DNA, 22 bp, Artificial Sequence
  Synthetic oligonucleotide; TTA chr11 5335079 5335100 5335084 5335079 -
gtacaaagaggacacacaaatt

SEQ ID NO: 124561 - DNA, 22 bp, Artificial Sequence
  Synthetic oligonucleotide; TTT chr11 5335056 5335077 5335061 5335056 -
tcagacttaagccatttccaga

SEQ ID NO: 124562 - DNA, 22 bp, Artificial Sequence
  Synthetic oligonucleotide; TTT chr11 5335055 5335076 5335060 5335055 -
cagacttaagccatttccagag

SEQ ID NO: 124563 - DNA, 22 bp, Artificial Sequence
  Synthetic oligonucleotide; TTC chr11 5335054 5335075 5335059 5335054 -
agacttaagccatttccagaga

SEQ ID NO: 124564 - DNA, 22 bp, Artificial Sequence
  Synthetic oligonucleotide; CTT chr11 5335048 5335069 5335053 5335048 -
aagccatttccagagactgact

SEQ ID NO: 124565 - DNA, 22 bp, Artificial Sequence
  Synthetic oligonucleotide; TTA chr11 5335047 5335068 5335052 5335047 -
agccatttccagagactgactt

SEQ ID NO: 124566 - DNA, 22 bp, Artificial Sequence
  Synthetic oligonucleotide; TTT chr11 5335039 5335060 5335044 5335039 -
ccagagactgacttttaatcat

SEQ ID NO: 124567 - DNA, 22 bp, Artificial Sequence
  Synthetic oligonucleotide; TTC chr11 5335038 5335059 5335043 5335038 -
cagagactgacttttaatcatg

SEQ ID NO: 124568 - DNA, 22 bp, Artificial Sequence
  Synthetic oligonucleotide; CTG chr11 5335029 5335050 5335034 5335029 -
acttttaatcatgatttcctac

SEQ ID NO: 124569 - DNA, 22 bp, Artificial Sequence
  Synthetic oligonucleotide; CTT chr11 5335025 5335046 5335030 5335025 -
ttaatcatgatttcctactact

SEQ ID NO: 124570 - DNA, 22 bp, Artificial Sequence
  Synthetic oligonucleotide; TTT chr11 5335024 5335045 5335029 5335024 -
taatcatgatttcctactacta

SEQ ID NO: 124571 - DNA, 22 bp, Artificial Sequence
  Synthetic oligonucleotide; TTT chr11 5335023 5335044 5335028 5335023 -
aatcatgatttcctactactat

SEQ ID NO: 124572 - DNA, 22 bp, Artificial Sequence
  Synthetic oligonucleotide; TTA chr11 5335022 5335043 5335027 5335022 -
atcatgatttcctactactatt

SEQ ID NO: 124573 - DNA, 22 bp, Artificial Sequence
  Synthetic oligonucleotide; TTT chr11 5335012 5335033 5335017 5335012 -
cctactactattctgcttacat

SEQ ID NO: 124574 - DNA, 22 bp, Artificial Sequence
  Synthetic oligonucleotide; TTC chr11 5335011 5335032 5335016 5335011 -
ctactactattctgcttacatt

SEQ ID NO: 124575 - DNA, 22 bp, Artificial Sequence
  Synthetic oligonucleotide; CTA chr11 5335008 5335029 5335013 5335008 -
ctactattctgcttacatttag

SEQ ID NO: 124576 - DNA, 22 bp, Artificial Sequence
  Synthetic oligonucleotide; CTA chr11 5335005 5335026 5335010 5335005 -
ctattctgcttacatttaggaa

SEQ ID NO: 124577 - DNA, 22 bp, Artificial Sequence
  Synthetic oligonucleotide; CTA chr11 5335002 5335023 5335007 5335002 -
ttctgcttacatttaggaagac

SEQ ID NO: 124578 - DNA, 22 bp, Artificial Sequence
  Synthetic oligonucleotide; TTC chr11 5334999 5335020 5335004 5334999 -
tgcttacatttaggaagaccta

SEQ ID NO: 124579 - DNA, 22 bp, Artificial Sequence
  Synthetic oligonucleotide; CTG chr11 5334997 5335018 5335002 5334997 -
cttacatttaggaagacctatg

SEQ ID NO: 124580 - DNA, 22 bp, Artificial Sequence
  Synthetic oligonucleotide; CTT chr11 5334994 5335015 5334999 5334994 -
acatttaggaagacctatgagc

SEQ ID NO: 124581 - DNA, 22 bp, Artificial Sequence
  Synthetic oligonucleotide; TTA chr11 5334993 5335014 5334998 5334993 -
catttaggaagacctatgagca

SEQ ID NO: 124582 - DNA, 22 bp, Artificial Sequence
  Synthetic oligonucleotide; TTT chr11 5334988 5335009 5334993 5334988 -
aggaagacctatgagcagaatg

SEQ ID NO: 124583 - DNA, 22 bp, Artificial Sequence
  Synthetic oligonucleotide; TTA chr11 5334987 5335008 5334992 5334987 -
ggaagacctatgagcagaatgc

SEQ ID NO: 124584 - DNA, 22 bp, Artificial Sequence
  Synthetic oligonucleotide; CTA chr11 5334977 5334998 5334982 5334977 -
tgagcagaatgcagttcaggag

SEQ ID NO: 124585 - DNA, 22 bp, Artificial Sequence
  Synthetic oligonucleotide; TTC chr11 5334960 5334981 5334965 5334960 -
aggaggaacttaactgatgtga

SEQ ID NO: 124586 - DNA, 22 bp, Artificial Sequence
  Synthetic oligonucleotide; CTT chr11 5334949 5334970 5334954 5334949 -
aactgatgtgaaatgtcaggca

SEQ ID NO: 124587 - DNA, 22 bp, Artificial Sequence
  Synthetic oligonucleotide; TTA chr11 5334948 5334969 5334953 5334948 -
actgatgtgaaatgtcaggcac

SEQ ID NO: 124588 - DNA, 22 bp, Artificial Sequence
  Synthetic oligonucleotide; CTG chr11 5334944 5334965 5334949 5334944 -
atgtgaaatgtcaggcaccaaa

SEQ ID NO: 124589 - DNA, 22 bp, Artificial Sequence
  Synthetic oligonucleotide; CTC chr11 5334911 5334932 5334916 5334911 -
atggttcaccacattgcaccca

SEQ ID NO: 124590 - DNA, 22 bp, Artificial Sequence
  Synthetic oligonucleotide; TTC chr11 5334904 5334925 5334909 5334904 -
accacattgcacccatactcat

SEQ ID NO: 124591 - DNA, 22 bp, Artificial Sequence
  Synthetic oligonucleotide; TTG chr11 5334895 5334916 5334900 5334895 -
cacccatactcattttaaaatc

SEQ ID NO: 124592 - DNA, 22 bp, Artificial Sequence
  Synthetic oligonucleotide; CTC chr11 5334884 5334905 5334889 5334884 -
attttaaaatctcatagttggg

SEQ ID NO: 124593 - DNA, 22 bp, Artificial Sequence
  Synthetic oligonucleotide; TTT chr11 5334880 5334901 5334885 5334880 -
taaaatctcatagttgggctaa

SEQ ID NO: 124594 - DNA, 22 bp, Artificial Sequence
  Synthetic oligonucleotide; TTT chr11 5334879 5334900 5334884 5334879 -
aaaatctcatagttgggctaag

SEQ ID NO: 124595 - DNA, 22 bp, Artificial Sequence
  Synthetic oligonucleotide; TTA chr11 5334878 5334899 5334883 5334878 -
aaatctcatagttgggctaagt

SEQ ID NO: 124596 - DNA, 22 bp, Artificial Sequence
  Synthetic oligonucleotide; CTC chr11 5334871 5334892 5334876 5334871 -
atagttgggctaagttccagga

SEQ ID NO: 124597 - DNA, 22 bp, Artificial Sequence
  Synthetic oligonucleotide; TTG chr11 5334864 5334885 5334869 5334864 -
ggctaagttccaggataaattt

SEQ ID NO: 124598 - DNA, 22 bp, Artificial Sequence
  Synthetic oligonucleotide; CTA chr11 5334859 5334880 5334864 5334859 -
agttccaggataaatttaggat

SEQ ID NO: 124599 - DNA, 22 bp, Artificial Sequence
  Synthetic oligonucleotide; TTC chr11 5334854 5334875 5334859 5334854 -
caggataaatttaggatttaag

SEQ ID NO: 124600 - DNA, 22 bp, Artificial Sequence
  Synthetic oligonucleotide; TTT chr11 5334842 5334863 5334847 5334842 -
aggatttaagactgatgagaca

SEQ ID NO: 124601 - DNA, 22 bp, Artificial Sequence
  Synthetic oligonucleotide; TTA chr11 5334841 5334862 5334846 5334841 -
ggatttaagactgatgagacaa

SEQ ID NO: 124602 - DNA, 22 bp, Artificial Sequence
  Synthetic oligonucleotide; TTT chr11 5334835 5334856 5334840 5334835 -
aagactgatgagacaatagaaa

SEQ ID NO: 124603 - DNA, 22 bp, Artificial Sequence
  Synthetic oligonucleotide; TTA chr11 5334834 5334855 5334839 5334834 -
agactgatgagacaatagaaat

SEQ ID NO: 124604 - DNA, 22 bp, Artificial Sequence
  Synthetic oligonucleotide; CTG chr11 5334828 5334849 5334833 5334828 -
atgagacaatagaaattctcag

SEQ ID NO: 124605 - DNA, 22 bp, Artificial Sequence
  Synthetic oligonucleotide; TTC chr11 5334810 5334831 5334815 5334810 -
tcagatccttatttctctgaca

SEQ ID NO: 124606 - DNA, 22 bp, Artificial Sequence
  Synthetic oligonucleotide; CTC chr11 5334808 5334829 5334813 5334808 -
agatccttatttctctgacaga

SEQ ID NO: 124607 - DNA, 22 bp, Artificial Sequence
  Synthetic oligonucleotide; CTT chr11 5334800 5334821 5334805 5334800 -
atttctctgacagactatgaga

SEQ ID NO: 124608 - DNA, 22 bp, Artificial Sequence
  Synthetic oligonucleotide; TTA chr11 5334799 5334820 5334804 5334799 -
tttctctgacagactatgagat

SEQ ID NO: 124609 - DNA, 22 bp, Artificial Sequence
  Synthetic oligonucleotide; TTT chr11 5334796 5334817 5334801 5334796 -
ctctgacagactatgagatgat

SEQ ID NO: 124610 - DNA, 22 bp, Artificial Sequence
  Synthetic oligonucleotide; TTC chr11 5334795 5334816 5334800 5334795 -
tctgacagactatgagatgatt

SEQ ID NO: 124611 - DNA, 22 bp, Artificial Sequence
  Synthetic oligonucleotide; CTC chr11 5334793 5334814 5334798 5334793 -
tgacagactatgagatgattgt

SEQ ID NO: 124612 - DNA, 22 bp, Artificial Sequence
  Synthetic oligonucleotide; CTG chr11 5334791 5334812 5334796 5334791 -
acagactatgagatgattgtat

SEQ ID NO: 124613 - DNA, 22 bp, Artificial Sequence
  Synthetic oligonucleotide; CTA chr11 5334783 5334804 5334788 5334783 -
tgagatgattgtattcaagtac

SEQ ID NO: 124614 - DNA, 22 bp, Artificial Sequence
  Synthetic oligonucleotide; TTG chr11 5334772 5334793 5334777 5334772 -
tattcaagtacaaattgtcaga

SEQ ID NO: 124615 - DNA, 22 bp, Artificial Sequence
  Synthetic oligonucleotide; TTC chr11 5334767 5334788 5334772 5334767 -
aagtacaaattgtcagacaaag

SEQ ID NO: 124616 - DNA, 22 bp, Artificial Sequence
  Synthetic oligonucleotide; TTG chr11 5334755 5334776 5334760 5334755 -
tcagacaaagccagggattaaa

SEQ ID NO: 124617 - DNA, 22 bp, Artificial Sequence
  Synthetic oligonucleotide; TTA chr11 5334735 5334756 5334740 5334735 -
aagaatacctccaccatgtccc

SEQ ID NO: 124618 - DNA, 22 bp, Artificial Sequence
  Synthetic oligonucleotide; CTC chr11 5334724 5334745 5334729 5334724 -
caccatgtcccctttttaacat

SEQ ID NO: 124619 - DNA, 22 bp, Artificial Sequence
  Synthetic oligonucleotide; CTT chr11 5334710 5334731 5334715 5334710 -
tttaacattactacaggacact

SEQ ID NO: 124620 - DNA, 22 bp, Artificial Sequence
  Synthetic oligonucleotide; TTT chr11 5334709 5334730 5334714 5334709 -
ttaacattactacaggacactt

SEQ ID NO: 124621 - DNA, 22 bp, Artificial Sequence
  Synthetic oligonucleotide; TTT chr11 5334708 5334729 5334713 5334708 -
taacattactacaggacactta

SEQ ID NO: 124622 - DNA, 22 bp, Artificial Sequence
  Synthetic oligonucleotide; TTT chr11 5334707 5334728 5334712 5334707 -
aacattactacaggacacttaa

SEQ ID NO: 124623 - DNA, 22 bp, Artificial Sequence
  Synthetic oligonucleotide; TTA chr11 5334706 5334727 5334711 5334706 -
acattactacaggacacttaaa

SEQ ID NO: 124624 - DNA, 22 bp, Artificial Sequence
  Synthetic oligonucleotide; TTA chr11 5334700 5334721 5334705 5334700 -
ctacaggacacttaaataaaat

SEQ ID NO: 124625 - DNA, 22 bp, Artificial Sequence
  Synthetic oligonucleotide; CTA chr11 5334697 5334718 5334702 5334697 -
caggacacttaaataaaatttt

SEQ ID NO: 124626 - DNA, 22 bp, Artificial Sequence
  Synthetic oligonucleotide; CTT chr11 5334687 5334708 5334692 5334687 -
aaataaaattttttaaacttga

SEQ ID NO: 124627 - DNA, 22 bp, Artificial Sequence
  Synthetic oligonucleotide; TTA chr11 5334686 5334707 5334691 5334686 -
aataaaattttttaaacttgat

SEQ ID NO: 124628 - DNA, 22 bp, Artificial Sequence
  Synthetic oligonucleotide; TTT chr11 5334676 5334697 5334681 5334676 -
tttaaacttgatttatattgct

SEQ ID NO: 124629 - DNA, 22 bp, Artificial Sequence
  Synthetic oligonucleotide; TTT chr11 5334675 5334696 5334680 5334675 -
ttaaacttgatttatattgctc

SEQ ID NO: 124630 - DNA, 22 bp, Artificial Sequence
  Synthetic oligonucleotide; TTT chr11 5334674 5334695 5334679 5334674 -
taaacttgatttatattgctcc

SEQ ID NO: 124631 - DNA, 22 bp, Artificial Sequence
  Synthetic oligonucleotide; TTT chr11 5334673 5334694 5334678 5334673 -
aaacttgatttatattgctcca

SEQ ID NO: 124632 - DNA, 22 bp, Artificial Sequence
  Synthetic oligonucleotide; TTA chr11 5334672 5334693 5334677 5334672 -
aacttgatttatattgctccag

SEQ ID NO: 124633 - DNA, 22 bp, Artificial Sequence
  Synthetic oligonucleotide; CTT chr11 5334667 5334688 5334672 5334667 -
gatttatattgctccagaagca

SEQ ID NO: 124634 - DNA, 22 bp, Artificial Sequence
  Synthetic oligonucleotide; TTG chr11 5334666 5334687 5334671 5334666 -
atttatattgctccagaagcag

SEQ ID NO: 124635 - DNA, 22 bp, Artificial Sequence
  Synthetic oligonucleotide; TTT chr11 5334662 5334683 5334667 5334662 -
atattgctccagaagcagtaac

SEQ ID NO: 124636 - DNA, 22 bp, Artificial Sequence
  Synthetic oligonucleotide; TTA chr11 5334661 5334682 5334666 5334661 -
tattgctccagaagcagtaact

SEQ ID NO: 124637 - DNA, 22 bp, Artificial Sequence
  Synthetic oligonucleotide; TTG chr11 5334656 5334677 5334661 5334656 -
ctccagaagcagtaactctgat

SEQ ID NO: 124638 - DNA, 22 bp, Artificial Sequence
  Synthetic oligonucleotide; CTC chr11 5334653 5334674 5334658 5334653 -
cagaagcagtaactctgattct

SEQ ID NO: 124639 - DNA, 22 bp, Artificial Sequence
  Synthetic oligonucleotide; CTC chr11 5334638 5334659 5334643 5334638 -
tgattcttgggcaagacttacc

SEQ ID NO: 124640 - DNA, 22 bp, Artificial Sequence
  Synthetic oligonucleotide; CTG chr11 5334636 5334657 5334641 5334636 -
attcttgggcaagacttaccaa

SEQ ID NO: 124641 - DNA, 22 bp, Artificial Sequence
  Synthetic oligonucleotide; TTC chr11 5334632 5334653 5334637 5334632 -
ttgggcaagacttaccaagaga

SEQ ID NO: 124642 - DNA, 22 bp, Artificial Sequence
  Synthetic oligonucleotide; CTT chr11 5334630 5334651 5334635 5334630 -
gggcaagacttaccaagagaca

SEQ ID NO: 124643 - DNA, 22 bp, Artificial Sequence
  Synthetic oligonucleotide; TTG chr11 5334629 5334650 5334634 5334629 -
ggcaagacttaccaagagacag

SEQ ID NO: 124644 - DNA, 22 bp, Artificial Sequence
  Synthetic oligonucleotide; CTT chr11 5334619 5334640 5334624 5334619 -
accaagagacagaaaacaagct

SEQ ID NO: 124645 - DNA, 22 bp, Artificial Sequence
  Synthetic oligonucleotide; TTA chr11 5334618 5334639 5334623 5334618 -
ccaagagacagaaaacaagctt

SEQ ID NO: 124646 - DNA, 22 bp, Artificial Sequence
  Synthetic oligonucleotide; CTT chr11 5334596 5334617 5334601 5334596 -
actgtttgaaagaacttatcag

SEQ ID NO: 124647 - DNA, 22 bp, Artificial Sequence
  Synthetic oligonucleotide; TTA chr11 5334595 5334616 5334600 5334595 -
ctgtttgaaagaacttatcagc

SEQ ID NO: 124648 - DNA, 22 bp, Artificial Sequence
  Synthetic oligonucleotide; CTG chr11 5334592 5334613 5334597 5334592 -
tttgaaagaacttatcagcagc

SEQ ID NO: 124649 - DNA, 22 bp, Artificial Sequence
  Synthetic oligonucleotide; TTT chr11 5334589 5334610 5334594 5334589 -
gaaagaacttatcagcagcact

SEQ ID NO: 124650 - DNA, 22 bp, Artificial Sequence
  Synthetic oligonucleotide; TTG chr11 5334588 5334609 5334593 5334588 -
aaagaacttatcagcagcactc

SEQ ID NO: 124651 - DNA, 22 bp, Artificial Sequence
  Synthetic oligonucleotide; CTT chr11 5334579 5334600 5334584 5334579 -
atcagcagcactcatttgtgag

SEQ ID NO: 124652 - DNA, 22 bp, Artificial Sequence
  Synthetic oligonucleotide; TTA chr11 5334578 5334599 5334583 5334578 -
tcagcagcactcatttgtgagt

SEQ ID NO: 124653 - DNA, 22 bp, Artificial Sequence
  Synthetic oligonucleotide; CTC chr11 5334566 5334587 5334571 5334566 -
atttgtgagtatatataacaaa

SEQ ID NO: 124654 - DNA, 22 bp, Artificial Sequence
  Synthetic oligonucleotide; TTT chr11 5334562 5334583 5334567 5334562 -
gtgagtatatataacaaacaat

SEQ ID NO: 124655 - DNA, 22 bp, Artificial Sequence
  Synthetic oligonucleotide; TTG chr11 5334561 5334582 5334566 5334561 -
tgagtatatataacaaacaatc

SEQ ID NO: 124656 - DNA, 22 bp, Artificial Sequence
  Synthetic oligonucleotide; CTT chr11 5334537 5334558 5334542 5334537 -
atttgaaaccaagaaaagatta

SEQ ID NO: 124657 - DNA, 22 bp, Artificial Sequence
  Synthetic oligonucleotide; TTA chr11 5334536 5334557 5334541 5334536 -
tttgaaaccaagaaaagattaa

SEQ ID NO: 124658 - DNA, 22 bp, Artificial Sequence
  Synthetic oligonucleotide; TTT chr11 5334533 5334554 5334538 5334533 -
gaaaccaagaaaagattaagtg

SEQ ID NO: 124659 - DNA, 22 bp, Artificial Sequence
  Synthetic oligonucleotide; TTG chr11 5334532 5334553 5334537 5334532 -
aaaccaagaaaagattaagtgt

SEQ ID NO: 124660 - DNA, 22 bp, Artificial Sequence
  Synthetic oligonucleotide; TTA chr11 5334515 5334536 5334520 5334515 -
agtgtgagggattattaagctt

SEQ ID NO: 124661 - DNA, 22 bp, Artificial Sequence
  Synthetic oligonucleotide; TTA chr11 5334501 5334522 5334506 5334501 -
ttaagctttgtctaagttgagt

SEQ ID NO: 124662 - DNA, 22 bp, Artificial Sequence
  Synthetic oligonucleotide; TTA chr11 5334498 5334519 5334503 5334498 -
agctttgtctaagttgagtgag

SEQ ID NO: 124663 - DNA, 22 bp, Artificial Sequence
  Synthetic oligonucleotide; CTT chr11 5334493 5334514 5334498 5334493 -
tgtctaagttgagtgagcttat

SEQ ID NO: 124664 - DNA, 22 bp, Artificial Sequence
  Synthetic oligonucleotide; TTT chr11 5334492 5334513 5334497 5334492 -
gtctaagttgagtgagcttatt

SEQ ID NO: 124665 - DNA, 22 bp, Artificial Sequence
  Synthetic oligonucleotide; TTG chr11 5334491 5334512 5334496 5334491 -
tctaagttgagtgagcttattg

SEQ ID NO: 124666 - DNA, 22 bp, Artificial Sequence
  Synthetic oligonucleotide; CTA chr11 5334487 5334508 5334492 5334487 -
agttgagtgagcttattggcta

SEQ ID NO: 124667 - DNA, 22 bp, Artificial Sequence
  Synthetic oligonucleotide; TTG chr11 5334482 5334503 5334487 5334482 -
agtgagcttattggctacaggg

SEQ ID NO: 124668 - DNA, 22 bp, Artificial Sequence
  Synthetic oligonucleotide; CTT chr11 5334473 5334494 5334478 5334473 -
attggctacagggttaaggaat

SEQ ID NO: 124669 - DNA, 22 bp, Artificial Sequence
  Synthetic oligonucleotide; TTA chr11 5334472 5334493 5334477 5334472 -
ttggctacagggttaaggaata

SEQ ID NO: 124670 - DNA, 22 bp, Artificial Sequence
  Synthetic oligonucleotide; TTG chr11 5334469 5334490 5334474 5334469 -
gctacagggttaaggaataaca

SEQ ID NO: 124671 - DNA, 22 bp, Artificial Sequence
  Synthetic oligonucleotide; CTA chr11 5334465 5334486 5334470 5334465 -
cagggttaaggaataacaaaag

SEQ ID NO: 124672 - DNA, 22 bp, Artificial Sequence
  Synthetic oligonucleotide; TTA chr11 5334457 5334478 5334462 5334457 -
aggaataacaaaagtaggcttc

SEQ ID NO: 124673 - DNA, 22 bp, Artificial Sequence
  Synthetic oligonucleotide; CTT chr11 5334436 5334457 5334441 5334436 -
cacggtatcttctttttgaggt

SEQ ID NO: 124674 - DNA, 22 bp, Artificial Sequence
  Synthetic oligonucleotide; TTC chr11 5334435 5334456 5334440 5334435 -
acggtatcttctttttgaggtg

SEQ ID NO: 124675 - DNA, 22 bp, Artificial Sequence
  Synthetic oligonucleotide; CTT chr11 5334425 5334446 5334430 5334425 -
ctttttgaggtggggaatcata

SEQ ID NO: 124676 - DNA, 22 bp, Artificial Sequence
  Synthetic oligonucleotide; TTC chr11 5334424 5334445 5334429 5334424 -
tttttgaggtggggaatcatac

SEQ ID NO: 124677 - DNA, 22 bp, Artificial Sequence
  Synthetic oligonucleotide; CTT chr11 5334422 5334443 5334427 5334422 -
tttgaggtggggaatcatacaa

SEQ ID NO: 124678 - DNA, 22 bp, Artificial Sequence
  Synthetic oligonucleotide; TTT chr11 5334421 5334442 5334426 5334421 -
ttgaggtggggaatcatacaag

SEQ ID NO: 124679 - DNA, 22 bp, Artificial Sequence
  Synthetic oligonucleotide; TTT chr11 5334420 5334441 5334425 5334420 -
tgaggtggggaatcatacaagg

SEQ ID NO: 124680 - DNA, 22 bp, Artificial Sequence
  Synthetic oligonucleotide; TTT chr11 5334419 5334440 5334424 5334419 -
gaggtggggaatcatacaaggc

SEQ ID NO: 124681 - DNA, 22 bp, Artificial Sequence
  Synthetic oligonucleotide; TTG chr11 5334418 5334439 5334423 5334418 -
aggtggggaatcatacaaggca

SEQ ID NO: 124682 - DNA, 22 bp, Artificial Sequence
  Synthetic oligonucleotide; TTA chr11 5334386 5334407 5334391 5334386 -
gatagcatgacttccatgtgct

SEQ ID NO: 124683 - DNA, 22 bp, Artificial Sequence
  Synthetic oligonucleotide; CTT chr11 5334373 5334394 5334378 5334373 -
ccatgtgctggatgaagctaca

SEQ ID NO: 124684 - DNA, 22 bp, Artificial Sequence
  Synthetic oligonucleotide; TTC chr11 5334372 5334393 5334377 5334372 -
catgtgctggatgaagctacaa

SEQ ID NO: 124685 - DNA, 22 bp, Artificial Sequence
  Synthetic oligonucleotide; CTG chr11 5334363 5334384 5334368 5334363 -
gatgaagctacaattctgtttt

SEQ ID NO: 124686 - DNA, 22 bp, Artificial Sequence
  Synthetic oligonucleotide; CTA chr11 5334353 5334374 5334358 5334353 -
caattctgttttctttttgcaa

SEQ ID NO: 124687 - DNA, 22 bp, Artificial Sequence
  Synthetic oligonucleotide; TTC chr11 5334347 5334368 5334352 5334347 -
tgttttctttttgcaaagaaaa

SEQ ID NO: 124688 - DNA, 22 bp, Artificial Sequence
  Synthetic oligonucleotide; CTG chr11 5334345 5334366 5334350 5334345 -
ttttctttttgcaaagaaaata

SEQ ID NO: 124689 - DNA, 22 bp, Artificial Sequence
  Synthetic oligonucleotide; TTT chr11 5334342 5334363 5334347 5334342 -
tctttttgcaaagaaaatatgg

SEQ ID NO: 124690 - DNA, 22 bp, Artificial Sequence
  Synthetic oligonucleotide; TTT chr11 5334341 5334362 5334346 5334341 -
ctttttgcaaagaaaatatggg

SEQ ID NO: 124691 - DNA, 22 bp, Artificial Sequence
  Synthetic oligonucleotide; TTC chr11 5334340 5334361 5334345 5334340 -
tttttgcaaagaaaatatgggg

SEQ ID NO: 124692 - DNA, 22 bp, Artificial Sequence
  Synthetic oligonucleotide; CTT chr11 5334338 5334359 5334343 5334338 -
tttgcaaagaaaatatggggct

SEQ ID NO: 124693 - DNA, 22 bp, Artificial Sequence
  Synthetic oligonucleotide; TTT chr11 5334337 5334358 5334342 5334337 -
ttgcaaagaaaatatggggctt

SEQ ID NO: 124694 - DNA, 22 bp, Artificial Sequence
  Synthetic oligonucleotide; TTT chr11 5334336 5334357 5334341 5334336 -
tgcaaagaaaatatggggcttt

SEQ ID NO: 124695 - DNA, 22 bp, Artificial Sequence
  Synthetic oligonucleotide; TTT chr11 5334335 5334356 5334340 5334335 -
gcaaagaaaatatggggcttta

SEQ ID NO: 124696 - DNA, 22 bp, Artificial Sequence
  Synthetic oligonucleotide; TTG chr11 5334334 5334355 5334339 5334334 -
caaagaaaatatggggctttaa

SEQ ID NO: 124697 - DNA, 22 bp, Artificial Sequence
  Synthetic oligonucleotide; CTT chr11 5334315 5334336 5334320 5334315 -
taagaacacagttctggagccc

SEQ ID NO: 124698 - DNA, 22 bp, Artificial Sequence
  Synthetic oligonucleotide; TTT chr11 5334314 5334335 5334319 5334314 -
aagaacacagttctggagccca

SEQ ID NO: 124699 - DNA, 22 bp, Artificial Sequence
  Synthetic oligonucleotide; TTA chr11 5334313 5334334 5334318 5334313 -
agaacacagttctggagcccac

SEQ ID NO: 124700 - DNA, 22 bp, Artificial Sequence
  Synthetic oligonucleotide; TTC chr11 5334301 5334322 5334306 5334301 -
tggagcccacttccttctccaa

SEQ ID NO: 124701 - DNA, 22 bp, Artificial Sequence
  Synthetic oligonucleotide; CTG chr11 5334299 5334320 5334304 5334299 -
gagcccacttccttctccaaag

SEQ ID NO: 124702 - DNA, 22 bp, Artificial Sequence
  Synthetic oligonucleotide; CTT chr11 5334289 5334310 5334294 5334289 -
ccttctccaaaggaggcttgaa

SEQ ID NO: 124703 - DNA, 22 bp, Artificial Sequence
  Synthetic oligonucleotide; TTC chr11 5334288 5334309 5334293 5334288 -
cttctccaaaggaggcttgaaa

SEQ ID NO: 124704 - DNA, 22 bp, Artificial Sequence
  Synthetic oligonucleotide; CTT chr11 5334285 5334306 5334290 5334285 -
ctccaaaggaggcttgaaaaaa

SEQ ID NO: 124705 - DNA, 22 bp, Artificial Sequence
  Synthetic oligonucleotide; TTC chr11 5334284 5334305 5334289 5334284 -
tccaaaggaggcttgaaaaaaa

SEQ ID NO: 124706 - DNA, 22 bp, Artificial Sequence
  Synthetic oligonucleotide; CTC chr11 5334282 5334303 5334287 5334282 -
caaaggaggcttgaaaaaaaat

SEQ ID NO: 124707 - DNA, 22 bp, Artificial Sequence
  Synthetic oligonucleotide; CTT chr11 5334270 5334291 5334275 5334270 -
gaaaaaaaatatcccagtagcc

SEQ ID NO: 124708 - DNA, 22 bp, Artificial Sequence
  Synthetic oligonucleotide; TTG chr11 5334269 5334290 5334274 5334269 -
aaaaaaaatatcccagtagcct

SEQ ID NO: 124709 - DNA, 22 bp, Artificial Sequence
  Synthetic oligonucleotide; CTA chr11 5334246 5334267 5334251 5334246 -
attatccagcatcaagacagat

SEQ ID NO: 124710 - DNA, 22 bp, Artificial Sequence
  Synthetic oligonucleotide; TTA chr11 5334242 5334263 5334247 5334242 -
tccagcatcaagacagatactg

SEQ ID NO: 124711 - DNA, 22 bp, Artificial Sequence
  Synthetic oligonucleotide; CTG chr11 5334220 5334241 5334225 5334220 -
gggaacaattttgaatacaaat

SEQ ID NO: 124712 - DNA, 22 bp, Artificial Sequence
  Synthetic oligonucleotide; TTT chr11 5334209 5334230 5334214 5334209 -
tgaatacaaataacctcacaaa

SEQ ID NO: 124713 - DNA, 22 bp, Artificial Sequence
  Synthetic oligonucleotide; TTT chr11 5334208 5334229 5334213 5334208 -
gaatacaaataacctcacaaat

SEQ ID NO: 124714 - DNA, 22 bp, Artificial Sequence
  Synthetic oligonucleotide; TTG chr11 5334207 5334228 5334212 5334207 -
aatacaaataacctcacaaatt

SEQ ID NO: 124715 - DNA, 22 bp, Artificial Sequence
  Synthetic oligonucleotide; CTC chr11 5334192 5334213 5334197 5334192 -
acaaattaaccctgttagcagt

SEQ ID NO: 124716 - DNA, 22 bp, Artificial Sequence
  Synthetic oligonucleotide; TTA chr11 5334184 5334205 5334189 5334184 -
accctgttagcagtcttcagag

SEQ ID NO: 124717 - DNA, 22 bp, Artificial Sequence
  Synthetic oligonucleotide; CTG chr11 5334178 5334199 5334183 5334178 -
ttagcagtcttcagagatacca

SEQ ID NO: 124718 - DNA, 22 bp, Artificial Sequence
  Synthetic oligonucleotide; TTA chr11 5334175 5334196 5334180 5334175 -
gcagtcttcagagataccattt

SEQ ID NO: 124719 - DNA, 22 bp, Artificial Sequence
  Synthetic oligonucleotide; CTT chr11 5334167 5334188 5334172 5334167 -
cagagataccatttaaaccaat

SEQ ID NO: 124720 - DNA, 22 bp, Artificial Sequence
  Synthetic oligonucleotide; TTC chr11 5334166 5334187 5334171 5334166 -
agagataccatttaaaccaatt

SEQ ID NO: 124721 - DNA, 22 bp, Artificial Sequence
  Synthetic oligonucleotide; TTT chr11 5334153 5334174 5334158 5334153 -
aaaccaatttctacaccaggac

SEQ ID NO: 124722 - DNA, 22 bp, Artificial Sequence
  Synthetic oligonucleotide; TTA chr11 5334152 5334173 5334157 5334152 -
aaccaatttctacaccaggact

SEQ ID NO: 124723 - DNA, 22 bp, Artificial Sequence
  Synthetic oligonucleotide; TTT chr11 5334143 5334164 5334148 5334143 -
ctacaccaggactcagcaatta

SEQ ID NO: 124724 - DNA, 22 bp, Artificial Sequence
  Synthetic oligonucleotide; TTC chr11 5334142 5334163 5334147 5334142 -
tacaccaggactcagcaattac

SEQ ID NO: 124725 - DNA, 22 bp, Artificial Sequence
  Synthetic oligonucleotide; CTA chr11 5334140 5334161 5334145 5334140 -
caccaggactcagcaattacct

SEQ ID NO: 124726 - DNA, 22 bp, Artificial Sequence
  Synthetic oligonucleotide; CTC chr11 5334129 5334150 5334134 5334129 -
agcaattacctctccccttaat

SEQ ID NO: 124727 - DNA, 22 bp, Artificial Sequence
  Synthetic oligonucleotide; TTA chr11 5334121 5334142 5334126 5334121 -
cctctccccttaatttctgata

SEQ ID NO: 124728 - DNA, 22 bp, Artificial Sequence
  Synthetic oligonucleotide; CTC chr11 5334117 5334138 5334122 5334117 -
tccccttaatttctgatacccc

SEQ ID NO: 124729 - DNA, 22 bp, Artificial Sequence
  Synthetic oligonucleotide; CTC chr11 5334115 5334136 5334120 5334115 -
cccttaatttctgataccccag

SEQ ID NO: 124730 - DNA, 22 bp, Artificial Sequence
  Synthetic oligonucleotide; CTT chr11 5334110 5334131 5334115 5334110 -
aatttctgataccccaggtcag

SEQ ID NO: 124731 - DNA, 22 bp, Artificial Sequence
  Synthetic oligonucleotide; TTA chr11 5334109 5334130 5334114 5334109 -
atttctgataccccaggtcagg

SEQ ID NO: 124732 - DNA, 22 bp, Artificial Sequence
  Synthetic oligonucleotide; TTT chr11 5334105 5334126 5334110 5334105 -
ctgataccccaggtcaggctct

SEQ ID NO: 124733 - DNA, 22 bp, Artificial Sequence
  Synthetic oligonucleotide; TTC chr11 5334104 5334125 5334109 5334104 -
tgataccccaggtcaggctcta

SEQ ID NO: 124734 - DNA, 22 bp, Artificial Sequence
  Synthetic oligonucleotide; CTG chr11 5334102 5334123 5334107 5334102 -
ataccccaggtcaggctctagt

SEQ ID NO: 124735 - DNA, 22 bp, Artificial Sequence
  Synthetic oligonucleotide; CTC chr11 5334084 5334105 5334089 5334084 -
tagtgactatgggagaatggaa

SEQ ID NO: 124736 - DNA, 22 bp, Artificial Sequence
  Synthetic oligonucleotide; CTA chr11 5334082 5334103 5334087 5334082 -
gtgactatgggagaatggaatg

SEQ ID NO: 124737 - DNA, 22 bp, Artificial Sequence
  Synthetic oligonucleotide; CTA chr11 5334075 5334096 5334080 5334075 -
tgggagaatggaatgaaggtaa

SEQ ID NO: 124738 - DNA, 22 bp, Artificial Sequence
  Synthetic oligonucleotide; TTG chr11 5334050 5334071 5334055 5334050 -
agaggaaaataaagactaatct

SEQ ID NO: 124739 - DNA, 22 bp, Artificial Sequence
  Synthetic oligonucleotide; CTA chr11 5334032 5334053 5334037 5334032 -
atcttcttggattctcttccac

SEQ ID NO: 124740 - DNA, 22 bp, Artificial Sequence
  Synthetic oligonucleotide; CTT chr11 5334027 5334048 5334032 5334027 -
cttggattctcttccaccacat

SEQ ID NO: 124741 - DNA, 22 bp, Artificial Sequence
  Synthetic oligonucleotide; TTC chr11 5334026 5334047 5334031 5334026 -
ttggattctcttccaccacata

SEQ ID NO: 124742 - DNA, 22 bp, Artificial Sequence
  Synthetic oligonucleotide; CTT chr11 5334024 5334045 5334029 5334024 -
ggattctcttccaccacatagt

SEQ ID NO: 124743 - DNA, 22 bp, Artificial Sequence
  Synthetic oligonucleotide; TTG chr11 5334023 5334044 5334028 5334023 -
gattctcttccaccacatagtt

SEQ ID NO: 124744 - DNA, 22 bp, Artificial Sequence
  Synthetic oligonucleotide; TTC chr11 5334018 5334039 5334023 5334018 -
tcttccaccacatagttgttgc

SEQ ID NO: 124745 - DNA, 22 bp, Artificial Sequence
  Synthetic oligonucleotide; CTC chr11 5334016 5334037 5334021 5334016 -
ttccaccacatagttgttgcaa

SEQ ID NO: 124746 - DNA, 22 bp, Artificial Sequence
  Synthetic oligonucleotide; CTT chr11 5334014 5334035 5334019 5334014 -
ccaccacatagttgttgcaaga

SEQ ID NO: 124747 - DNA, 22 bp, Artificial Sequence
  Synthetic oligonucleotide; TTC chr11 5334013 5334034 5334018 5334013 -
caccacatagttgttgcaagag

SEQ ID NO: 124748 - DNA, 22 bp, Artificial Sequence
  Synthetic oligonucleotide; TTG chr11 5334000 5334021 5334005 5334000 -
ttgcaagagggtaaatagagaa

SEQ ID NO: 124749 - DNA, 22 bp, Artificial Sequence
  Synthetic oligonucleotide; TTG chr11 5333997 5334018 5334002 5333997 -
caagagggtaaatagagaaaag

SEQ ID NO: 124750 - DNA, 22 bp, Artificial Sequence
  Synthetic oligonucleotide; CTG chr11 5333961 5333982 5333966 5333961 -
tatctacagattctgccgggtg

SEQ ID NO: 124751 - DNA, 22 bp, Artificial Sequence
  Synthetic oligonucleotide; CTA chr11 5333955 5333976 5333960 5333955 -
cagattctgccgggtgtatcaa

SEQ ID NO: 124752 - DNA, 22 bp, Artificial Sequence
  Synthetic oligonucleotide; TTC chr11 5333948 5333969 5333953 5333948 -
tgccgggtgtatcaacctccaa

SEQ ID NO: 124753 - DNA, 22 bp, Artificial Sequence
  Synthetic oligonucleotide; CTG chr11 5333946 5333967 5333951 5333946 -
ccgggtgtatcaacctccaaca

SEQ ID NO: 124754 - DNA, 22 bp, Artificial Sequence
  Synthetic oligonucleotide; CTC chr11 5333929 5333950 5333934 5333929 -
caacataaaagttcaacttcct

SEQ ID NO: 124755 - DNA, 22 bp, Artificial Sequence
  Synthetic oligonucleotide; TTC chr11 5333915 5333936 5333920 5333915 -
aacttcctagcaaatgttaact

SEQ ID NO: 124756 - DNA, 22 bp, Artificial Sequence
  Synthetic oligonucleotide; CTT chr11 5333910 5333931 5333915 5333910 -
cctagcaaatgttaactctgaa

SEQ ID NO: 124757 - DNA, 22 bp, Artificial Sequence
  Synthetic oligonucleotide; TTC chr11 5333909 5333930 5333914 5333909 -
ctagcaaatgttaactctgaaa

SEQ ID NO: 124758 - DNA, 22 bp, Artificial Sequence
  Synthetic oligonucleotide; CTA chr11 5333906 5333927 5333911 5333906 -
gcaaatgttaactctgaaataa

SEQ ID NO: 124759 - DNA, 22 bp, Artificial Sequence
  Synthetic oligonucleotide; TTA chr11 5333896 5333917 5333901 5333896 -
actctgaaataaaaacagtagt

SEQ ID NO: 124760 - DNA, 22 bp, Artificial Sequence
  Synthetic oligonucleotide; CTC chr11 5333892 5333913 5333897 5333892 -
tgaaataaaaacagtagtttta

SEQ ID NO: 124761 - DNA, 22 bp, Artificial Sequence
  Synthetic oligonucleotide; CTG chr11 5333890 5333911 5333895 5333890 -
aaataaaaacagtagttttatg

SEQ ID NO: 124762 - DNA, 22 bp, Artificial Sequence
  Synthetic oligonucleotide; TTT chr11 5333872 5333893 5333877 5333872 -
tatgtgatgggtgcttacatga

SEQ ID NO: 124763 - DNA, 22 bp, Artificial Sequence
  Synthetic oligonucleotide; TTT chr11 5333871 5333892 5333876 5333871 -
atgtgatgggtgcttacatgaa

SEQ ID NO: 124764 - DNA, 22 bp, Artificial Sequence
  Synthetic oligonucleotide; TTA chr11 5333870 5333891 5333875 5333870 -
tgtgatgggtgcttacatgaat

SEQ ID NO: 124765 - DNA, 22 bp, Artificial Sequence
  Synthetic oligonucleotide; CTT chr11 5333856 5333877 5333861 5333856 -
acatgaataattaagagttctg

SEQ ID NO: 124766 - DNA, 22 bp, Artificial Sequence
  Synthetic oligonucleotide; TTA chr11 5333855 5333876 5333860 5333855 -
catgaataattaagagttctga

SEQ ID NO: 124767 - DNA, 22 bp, Artificial Sequence
  Synthetic oligonucleotide; TTA chr11 5333843 5333864 5333848 5333843 -
agagttctgagttgatatctag

SEQ ID NO: 124768 - DNA, 22 bp, Artificial Sequence
  Synthetic oligonucleotide; TTC chr11 5333836 5333857 5333841 5333836 -
tgagttgatatctagaagttct

SEQ ID NO: 124769 - DNA, 22 bp, Artificial Sequence
  Synthetic oligonucleotide; CTG chr11 5333834 5333855 5333839 5333834 -
agttgatatctagaagttcttg

SEQ ID NO: 124770 - DNA, 22 bp, Artificial Sequence
  Synthetic oligonucleotide; TTG chr11 5333829 5333850 5333834 5333829 -
atatctagaagttcttgttagc

SEQ ID NO: 124771 - DNA, 22 bp, Artificial Sequence
  Synthetic oligonucleotide; CTA chr11 5333822 5333843 5333827 5333822 -
gaagttcttgttagctcagcgc

SEQ ID NO: 124772 - DNA, 22 bp, Artificial Sequence
  Synthetic oligonucleotide; TTC chr11 5333815 5333836 5333820 5333815 -
ttgttagctcagcgctattaag

SEQ ID NO: 124773 - DNA, 22 bp, Artificial Sequence
  Synthetic oligonucleotide; CTT chr11 5333813 5333834 5333818 5333813 -
gttagctcagcgctattaagaa

SEQ ID NO: 124774 - DNA, 22 bp, Artificial Sequence
  Synthetic oligonucleotide; TTG chr11 5333812 5333833 5333817 5333812 -
ttagctcagcgctattaagaac

SEQ ID NO: 124775 - DNA, 22 bp, Artificial Sequence
  Synthetic oligonucleotide; TTA chr11 5333809 5333830 5333814 5333809 -
gctcagcgctattaagaacact

SEQ ID NO: 124776 - DNA, 22 bp, Artificial Sequence
  Synthetic oligonucleotide; CTC chr11 5333805 5333826 5333810 5333805 -
agcgctattaagaacacttttc

SEQ ID NO: 124777 - DNA, 22 bp, Artificial Sequence
  Synthetic oligonucleotide; CTA chr11 5333798 5333819 5333803 5333798 -
ttaagaacacttttcctacaat

SEQ ID NO: 124778 - DNA, 22 bp, Artificial Sequence
  Synthetic oligonucleotide; TTA chr11 5333795 5333816 5333800 5333795 -
agaacacttttcctacaataga

SEQ ID NO: 124779 - DNA, 22 bp, Artificial Sequence
  Synthetic oligonucleotide; CTT chr11 5333786 5333807 5333791 5333786 -
ttcctacaatagaaattttctt

SEQ ID NO: 124780 - DNA, 22 bp, Artificial Sequence
  Synthetic oligonucleotide; TTT chr11 5333785 5333806 5333790 5333785 -
tcctacaatagaaattttcttt

SEQ ID NO: 124781 - DNA, 22 bp, Artificial Sequence
  Synthetic oligonucleotide; TTT chr11 5333784 5333805 5333789 5333784 -
cctacaatagaaattttctttg

SEQ ID NO: 124782 - DNA, 22 bp, Artificial Sequence
  Synthetic oligonucleotide; TTC chr11 5333783 5333804 5333788 5333783 -
ctacaatagaaattttctttgg

SEQ ID NO: 124783 - DNA, 22 bp, Artificial Sequence
  Synthetic oligonucleotide; CTA chr11 5333780 5333801 5333785 5333780 -
caatagaaattttctttggaag

SEQ ID NO: 124784 - DNA, 22 bp, Artificial Sequence
  Synthetic oligonucleotide; TTT chr11 5333768 5333789 5333773 5333768 -
tctttggaagaggcaggagagg

SEQ ID NO: 124785 - DNA, 22 bp, Artificial Sequence
  Synthetic oligonucleotide; TTT chr11 5333767 5333788 5333772 5333767 -
ctttggaagaggcaggagagga

SEQ ID NO: 124786 - DNA, 22 bp, Artificial Sequence
  Synthetic oligonucleotide; TTC chr11 5333766 5333787 5333771 5333766 -
tttggaagaggcaggagaggaa

SEQ ID NO: 124787 - DNA, 22 bp, Artificial Sequence
  Synthetic oligonucleotide; CTT chr11 5333764 5333785 5333769 5333764 -
tggaagaggcaggagaggaaag

SEQ ID NO: 124788 - DNA, 22 bp, Artificial Sequence
  Synthetic oligonucleotide; TTT chr11 5333763 5333784 5333768 5333763 -
ggaagaggcaggagaggaaaga

SEQ ID NO: 124789 - DNA, 22 bp, Artificial Sequence
  Synthetic oligonucleotide; TTG chr11 5333762 5333783 5333767 5333762 -
gaagaggcaggagaggaaagag

SEQ ID NO: 124790 - DNA, 22 bp, Artificial Sequence
  Synthetic oligonucleotide; CTG chr11 5333736 5333757 5333741 5333736 -
actctgggagtgaatgtgcagg

SEQ ID NO: 124791 - DNA, 22 bp, Artificial Sequence
  Synthetic oligonucleotide; CTC chr11 5333732 5333753 5333737 5333732 -
tgggagtgaatgtgcagggtgg

SEQ ID NO: 124792 - DNA, 22 bp, Artificial Sequence
  Synthetic oligonucleotide; CTG chr11 5333730 5333751 5333735 5333730 -
ggagtgaatgtgcagggtgggg

SEQ ID NO: 124793 - DNA, 22 bp, Artificial Sequence
  Synthetic oligonucleotide; CTG chr11 5333693 5333714 5333698 5333693 -
taggtctctatactacctctcc

SEQ ID NO: 124794 - DNA, 22 bp, Artificial Sequence
  Synthetic oligonucleotide; CTC chr11 5333685 5333706 5333690 5333685 -
tatactacctctcctcctcctc

SEQ ID NO: 124795 - DNA, 22 bp, Artificial Sequence
  Synthetic oligonucleotide; CTA chr11 5333683 5333704 5333688 5333683 -
tactacctctcctcctcctctt

SEQ ID NO: 124796 - DNA, 22 bp, Artificial Sequence
  Synthetic oligonucleotide; CTA chr11 5333678 5333699 5333683 5333678 -
cctctcctcctcctcttgatgc

SEQ ID NO: 124797 - DNA, 22 bp, Artificial Sequence
  Synthetic oligonucleotide; CTC chr11 5333674 5333695 5333679 5333674 -
tcctcctcctcttgatgcagtt

SEQ ID NO: 124798 - DNA, 22 bp, Artificial Sequence
  Synthetic oligonucleotide; CTC chr11 5333672 5333693 5333677 5333672 -
ctcctcctcttgatgcagttct

SEQ ID NO: 124799 - DNA, 22 bp, Artificial Sequence
  Synthetic oligonucleotide; CTC chr11 5333669 5333690 5333674 5333669 -
ctcctcttgatgcagttctcta

SEQ ID NO: 124800 - DNA, 22 bp, Artificial Sequence
  Synthetic oligonucleotide; CTC chr11 5333666 5333687 5333671 5333666 -
ctcttgatgcagttctctaggc

SEQ ID NO: 124801 - DNA, 22 bp, Artificial Sequence
  Synthetic oligonucleotide; CTC chr11 5333663 5333684 5333668 5333663 -
ttgatgcagttctctaggctca

SEQ ID NO: 124802 - DNA, 22 bp, Artificial Sequence
  Synthetic oligonucleotide; CTT chr11 5333661 5333682 5333666 5333661 -
gatgcagttctctaggctcagt

SEQ ID NO: 124803 - DNA, 22 bp, Artificial Sequence
  Synthetic oligonucleotide; TTG chr11 5333660 5333681 5333665 5333660 -
atgcagttctctaggctcagtt

SEQ ID NO: 124804 - DNA, 22 bp, Artificial Sequence
  Synthetic oligonucleotide; TTC chr11 5333651 5333672 5333656 5333651 -
tctaggctcagttttctctatc

SEQ ID NO: 124805 - DNA, 22 bp, Artificial Sequence
  Synthetic oligonucleotide; CTC chr11 5333649 5333670 5333654 5333649 -
taggctcagttttctctatctt

SEQ ID NO: 124806 - DNA, 22 bp, Artificial Sequence
  Synthetic oligonucleotide; CTA chr11 5333647 5333668 5333652 5333647 -
ggctcagttttctctatcttac

SEQ ID NO: 124807 - DNA, 22 bp, Artificial Sequence
  Synthetic oligonucleotide; CTC chr11 5333642 5333663 5333647 5333642 -
agttttctctatcttacatcca

SEQ ID NO: 124808 - DNA, 22 bp, Artificial Sequence
  Synthetic oligonucleotide; TTT chr11 5333637 5333658 5333642 5333637 -
tctctatcttacatccacctat

SEQ ID NO: 124809 - DNA, 22 bp, Artificial Sequence
  Synthetic oligonucleotide; TTT chr11 5333636 5333657 5333641 5333636 -
ctctatcttacatccacctatg

SEQ ID NO: 124810 - DNA, 22 bp, Artificial Sequence
  Synthetic oligonucleotide; TTC chr11 5333635 5333656 5333640 5333635 -
tctatcttacatccacctatgt

SEQ ID NO: 124811 - DNA, 22 bp, Artificial Sequence
  Synthetic oligonucleotide; CTC chr11 5333633 5333654 5333638 5333633 -
tatcttacatccacctatgttc

SEQ ID NO: 124812 - DNA, 22 bp, Artificial Sequence
  Synthetic oligonucleotide; CTA chr11 5333631 5333652 5333636 5333631 -
tcttacatccacctatgttccc

SEQ ID NO: 124813 - DNA, 22 bp, Artificial Sequence
  Synthetic oligonucleotide; CTT chr11 5333627 5333648 5333632 5333627 -
acatccacctatgttccctttc

SEQ ID NO: 124814 - DNA, 22 bp, Artificial Sequence
  Synthetic oligonucleotide; TTA chr11 5333626 5333647 5333631 5333626 -
catccacctatgttccctttct

SEQ ID NO: 124815 - DNA, 22 bp, Artificial Sequence
  Synthetic oligonucleotide; CTA chr11 5333616 5333637 5333621 5333616 -
tgttccctttctgccttcttcc

SEQ ID NO: 124816 - DNA, 22 bp, Artificial Sequence
  Synthetic oligonucleotide; TTC chr11 5333611 5333632 5333616 5333611 -
cctttctgccttcttcctcctc

SEQ ID NO: 124817 - DNA, 22 bp, Artificial Sequence
  Synthetic oligonucleotide; CTT chr11 5333607 5333628 5333612 5333607 -
tctgccttcttcctcctctact

SEQ ID NO: 124818 - DNA, 22 bp, Artificial Sequence
  Synthetic oligonucleotide; TTT chr11 5333606 5333627 5333611 5333606 -
ctgccttcttcctcctctactt

SEQ ID NO: 124819 - DNA, 22 bp, Artificial Sequence
  Synthetic oligonucleotide; TTC chr11 5333605 5333626 5333610 5333605 -
tgccttcttcctcctctacttt

SEQ ID NO: 124820 - DNA, 22 bp, Artificial Sequence
  Synthetic oligonucleotide; CTG chr11 5333603 5333624 5333608 5333603 -
ccttcttcctcctctactttgt

SEQ ID NO: 124821 - DNA, 22 bp, Artificial Sequence
  Synthetic oligonucleotide; CTT chr11 5333599 5333620 5333604 5333599 -
cttcctcctctactttgtagct

SEQ ID NO: 124822 - DNA, 22 bp, Artificial Sequence
  Synthetic oligonucleotide; TTC chr11 5333598 5333619 5333603 5333598 -
ttcctcctctactttgtagctc

SEQ ID NO: 124823 - DNA, 22 bp, Artificial Sequence
  Synthetic oligonucleotide; CTT chr11 5333596 5333617 5333601 5333596 -
cctcctctactttgtagctccc

SEQ ID NO: 124824 - DNA, 22 bp, Artificial Sequence
  Synthetic oligonucleotide; TTC chr11 5333595 5333616 5333600 5333595 -
ctcctctactttgtagctccca

SEQ ID NO: 124825 - DNA, 22 bp, Artificial Sequence
  Synthetic oligonucleotide; CTC chr11 5333592 5333613 5333597 5333592 -
ctctactttgtagctcccacat

SEQ ID NO: 124826 - DNA, 22 bp, Artificial Sequence
  Synthetic oligonucleotide; CTC chr11 5333589 5333610 5333594 5333589 -
tactttgtagctcccacatttt

SEQ ID NO: 124827 - DNA, 22 bp, Artificial Sequence
  Synthetic oligonucleotide; CTA chr11 5333587 5333608 5333592 5333587 -
ctttgtagctcccacattttca

SEQ ID NO: 124828 - DNA, 22 bp, Artificial Sequence
  Synthetic oligonucleotide; CTT chr11 5333584 5333605 5333589 5333584 -
tgtagctcccacattttcagct

SEQ ID NO: 124829 - DNA, 22 bp, Artificial Sequence
  Synthetic oligonucleotide; TTT chr11 5333583 5333604 5333588 5333583 -
gtagctcccacattttcagctt

SEQ ID NO: 124830 - DNA, 22 bp, Artificial Sequence
  Synthetic oligonucleotide; TTG chr11 5333582 5333603 5333587 5333582 -
tagctcccacattttcagctta

SEQ ID NO: 124831 - DNA, 22 bp, Artificial Sequence
  Synthetic oligonucleotide; CTC chr11 5333576 5333597 5333581 5333576 -
ccacattttcagcttatatatt

SEQ ID NO: 124832 - DNA, 22 bp, Artificial Sequence
  Synthetic oligonucleotide; TTT chr11 5333568 5333589 5333573 5333568 -
tcagcttatatattagccaatt

SEQ ID NO: 124833 - DNA, 22 bp, Artificial Sequence
  Synthetic oligonucleotide; TTT chr11 5333567 5333588 5333572 5333567 -
cagcttatatattagccaatta

SEQ ID NO: 124834 - DNA, 22 bp, Artificial Sequence
  Synthetic oligonucleotide; TTC chr11 5333566 5333587 5333571 5333566 -
agcttatatattagccaattag

SEQ ID NO: 124835 - DNA, 22 bp, Artificial Sequence
  Synthetic oligonucleotide; CTT chr11 5333561 5333582 5333566 5333561 -
atatattagccaattagtatat

SEQ ID NO: 124836 - DNA, 22 bp, Artificial Sequence
  Synthetic oligonucleotide; TTA chr11 5333560 5333581 5333565 5333560 -
tatattagccaattagtatatt

SEQ ID NO: 124837 - DNA, 22 bp, Artificial Sequence
  Synthetic oligonucleotide; TTA chr11 5333553 5333574 5333558 5333553 -
gccaattagtatattagtaata

SEQ ID NO: 124838 - DNA, 22 bp, Artificial Sequence
  Synthetic oligonucleotide; TTA chr11 5333545 5333566 5333550 5333545 -
gtatattagtaatattttgaag

SEQ ID NO: 124839 - DNA, 22 bp, Artificial Sequence
  Synthetic oligonucleotide; TTA chr11 5333537 5333558 5333542 5333537 -
gtaatattttgaagtcactgtt

SEQ ID NO: 124840 - DNA, 22 bp, Artificial Sequence
  Synthetic oligonucleotide; TTT chr11 5333528 5333549 5333533 5333528 -
tgaagtcactgttcttacctaa

SEQ ID NO: 124841 - DNA, 22 bp, Artificial Sequence
  Synthetic oligonucleotide; TTT chr11 5333527 5333548 5333532 5333527 -
gaagtcactgttcttacctaag

SEQ ID NO: 124842 - DNA, 22 bp, Artificial Sequence
  Synthetic oligonucleotide; TTG chr11 5333526 5333547 5333531 5333526 -
aagtcactgttcttacctaagt

SEQ ID NO: 124843 - DNA, 22 bp, Artificial Sequence
  Synthetic oligonucleotide; CTG chr11 5333517 5333538 5333522 5333517 -
ttcttacctaagtcagtttaac

SEQ ID NO: 124844 - DNA, 22 bp, Artificial Sequence
  Synthetic oligonucleotide; TTC chr11 5333514 5333535 5333519 5333514 -
ttacctaagtcagtttaacaat

SEQ ID NO: 124845 - DNA, 22 bp, Artificial Sequence
  Synthetic oligonucleotide; CTT chr11 5333512 5333533 5333517 5333512 -
acctaagtcagtttaacaatca

SEQ ID NO: 124846 - DNA, 22 bp, Artificial Sequence
  Synthetic oligonucleotide; TTA chr11 5333511 5333532 5333516 5333511 -
cctaagtcagtttaacaatcag

SEQ ID NO: 124847 - DNA, 22 bp, Artificial Sequence
  Synthetic oligonucleotide; CTA chr11 5333507 5333528 5333512 5333507 -
agtcagtttaacaatcagcata

SEQ ID NO: 124848 - DNA, 22 bp, Artificial Sequence
  Synthetic oligonucleotide; TTT chr11 5333498 5333519 5333503 5333498 -
aacaatcagcataccagtcagt

SEQ ID NO: 124849 - DNA, 22 bp, Artificial Sequence
  Synthetic oligonucleotide; TTA chr11 5333497 5333518 5333502 5333497 -
acaatcagcataccagtcagtt

SEQ ID NO: 124850 - DNA, 22 bp, Artificial Sequence
  Synthetic oligonucleotide; TTA chr11 5333474 5333495 5333479 5333474 -
gtgatcaatgtgttaatcataa

SEQ ID NO: 124851 - DNA, 22 bp, Artificial Sequence
  Synthetic oligonucleotide; TTA chr11 5333459 5333480 5333464 5333459 -
atcataaagtaattaaaatttt

SEQ ID NO: 124852 - DNA, 22 bp, Artificial Sequence
  Synthetic oligonucleotide; TTA chr11 5333444 5333465 5333449 5333444 -
aaattttataaataaccttaca

SEQ ID NO: 124853 - DNA, 22 bp, Artificial Sequence
  Synthetic oligonucleotide; TTT chr11 5333438 5333459 5333443 5333438 -
tataaataaccttacaatcaat

SEQ ID NO: 124854 - DNA, 22 bp, Artificial Sequence
  Synthetic oligonucleotide; TTT chr11 5333437 5333458 5333442 5333437 -
ataaataaccttacaatcaata

SEQ ID NO: 124855 - DNA, 22 bp, Artificial Sequence
  Synthetic oligonucleotide; TTA chr11 5333436 5333457 5333441 5333436 -
taaataaccttacaatcaatat

SEQ ID NO: 124856 - DNA, 22 bp, Artificial Sequence
  Synthetic oligonucleotide; CTT chr11 5333425 5333446 5333430 5333425 -
acaatcaatatgtcaaactctg

SEQ ID NO: 124857 - DNA, 22 bp, Artificial Sequence
  Synthetic oligonucleotide; TTA chr11 5333424 5333445 5333429 5333424 -
caatcaatatgtcaaactctgt

SEQ ID NO: 124858 - DNA, 22 bp, Artificial Sequence
  Synthetic oligonucleotide; CTC chr11 5333405 5333426 5333410 5333405 -
tgtcattgcttccagggccatt

SEQ ID NO: 124859 - DNA, 22 bp, Artificial Sequence
  Synthetic oligonucleotide; CTG chr11 5333403 5333424 5333408 5333403 -
tcattgcttccagggccattgg

SEQ ID NO: 124860 - DNA, 22 bp, Artificial Sequence
  Synthetic oligonucleotide; TTG chr11 5333397 5333418 5333402 5333397 -
cttccagggccattggtgtgtt

SEQ ID NO: 124861 - DNA, 22 bp, Artificial Sequence
  Synthetic oligonucleotide; CTT chr11 5333394 5333415 5333399 5333394 -
ccagggccattggtgtgttaat

SEQ ID NO: 124862 - DNA, 22 bp, Artificial Sequence
  Synthetic oligonucleotide; TTC chr11 5333393 5333414 5333398 5333393 -
cagggccattggtgtgttaata

SEQ ID NO: 124863 - DNA, 22 bp, Artificial Sequence
  Synthetic oligonucleotide; TTG chr11 5333382 5333403 5333387 5333382 -
gtgtgttaatacaacacttagt

SEQ ID NO: 124864 - DNA, 22 bp, Artificial Sequence
  Synthetic oligonucleotide; TTA chr11 5333374 5333395 5333379 5333374 -
atacaacacttagtaaagtaag

SEQ ID NO: 124865 - DNA, 22 bp, Artificial Sequence
  Synthetic oligonucleotide; CTT chr11 5333363 5333384 5333368 5333363 -
agtaaagtaagcaatgttagtg

SEQ ID NO: 124866 - DNA, 22 bp, Artificial Sequence
  Synthetic oligonucleotide; TTA chr11 5333362 5333383 5333367 5333362 -
gtaaagtaagcaatgttagtgt

SEQ ID NO: 124867 - DNA, 22 bp, Artificial Sequence
  Synthetic oligonucleotide; TTA chr11 5333344 5333365 5333349 5333344 -
gtgttggagtgggagtagaacc

SEQ ID NO: 124868 - DNA, 22 bp, Artificial Sequence
  Synthetic oligonucleotide; TTG chr11 5333338 5333359 5333343 5333338 -
gagtgggagtagaaccgtgttt

SEQ ID NO: 124869 - DNA, 22 bp, Artificial Sequence
  Synthetic oligonucleotide; TTT chr11 5333316 5333337 5333321 5333316 -
tttactacaatgagttagagcc

SEQ ID NO: 124870 - DNA, 22 bp, Artificial Sequence
  Synthetic oligonucleotide; TTT chr11 5333315 5333336 5333320 5333315 -
ttactacaatgagttagagcca

SEQ ID NO: 124871 - DNA, 22 bp, Artificial Sequence
  Synthetic oligonucleotide; TTT chr11 5333314 5333335 5333319 5333314 -
tactacaatgagttagagccac

SEQ ID NO: 124872 - DNA, 22 bp, Artificial Sequence
  Synthetic oligonucleotide; TTT chr11 5333313 5333334 5333318 5333313 -
actacaatgagttagagccact

SEQ ID NO: 124873 - DNA, 22 bp, Artificial Sequence
  Synthetic oligonucleotide; TTA chr11 5333312 5333333 5333317 5333312 -
ctacaatgagttagagccacta

SEQ ID NO: 124874 - DNA, 22 bp, Artificial Sequence
  Synthetic oligonucleotide; CTA chr11 5333309 5333330 5333314 5333309 -
caatgagttagagccactaggt

SEQ ID NO: 124875 - DNA, 22 bp, Artificial Sequence
  Synthetic oligonucleotide; TTA chr11 5333299 5333320 5333304 5333299 -
gagccactaggtctgagagact

SEQ ID NO: 124876 - DNA, 22 bp, Artificial Sequence
  Synthetic oligonucleotide; CTA chr11 5333290 5333311 5333295 5333290 -
ggtctgagagactagtaaaaga

SEQ ID NO: 124877 - DNA, 22 bp, Artificial Sequence
  Synthetic oligonucleotide; CTG chr11 5333284 5333305 5333289 5333284 -
agagactagtaaaagaatgtaa

SEQ ID NO: 124878 - DNA, 22 bp, Artificial Sequence
  Synthetic oligonucleotide; CTA chr11 5333276 5333297 5333281 5333276 -
gtaaaagaatgtaaacagtaaa

SEQ ID NO: 124879 - DNA, 22 bp, Artificial Sequence
  Synthetic oligonucleotide; TTT chr11 5333249 5333270 5333254 5333249 -
tgtgctaagttttatgctaaag

SEQ ID NO: 124880 - DNA, 22 bp, Artificial Sequence
  Synthetic oligonucleotide; TTT chr11 5333248 5333269 5333253 5333248 -
gtgctaagttttatgctaaagt

SEQ ID NO: 124881 - DNA, 22 bp, Artificial Sequence
  Synthetic oligonucleotide; TTG chr11 5333247 5333268 5333252 5333247 -
tgctaagttttatgctaaagtc

SEQ ID NO: 124882 - DNA, 22 bp, Artificial Sequence
  Synthetic oligonucleotide; CTA chr11 5333242 5333263 5333247 5333242 -
agttttatgctaaagtctgggt

SEQ ID NO: 124883 - DNA, 22 bp, Artificial Sequence
  Synthetic oligonucleotide; TTT chr11 5333237 5333258 5333242 5333237 -
tatgctaaagtctgggtgatgc

SEQ ID NO: 124884 - DNA, 22 bp, Artificial Sequence
  Synthetic oligonucleotide; TTT chr11 5333236 5333257 5333241 5333236 -
atgctaaagtctgggtgatgca

SEQ ID NO: 124885 - DNA, 22 bp, Artificial Sequence
  Synthetic oligonucleotide; TTA chr11 5333235 5333256 5333240 5333235 -
tgctaaagtctgggtgatgcaa

SEQ ID NO: 124886 - DNA, 22 bp, Artificial Sequence
  Synthetic oligonucleotide; CTA chr11 5333230 5333251 5333235 5333230 -
aagtctgggtgatgcaaaagag

SEQ ID NO: 124887 - DNA, 22 bp, Artificial Sequence
  Synthetic oligonucleotide; CTG chr11 5333223 5333244 5333228 5333223 -
ggtgatgcaaaagagacatctg

SEQ ID NO: 124888 - DNA, 22 bp, Artificial Sequence
  Synthetic oligonucleotide; CTG chr11 5333201 5333222 5333206 5333201 -
gggtttagttagagagggcaaa

SEQ ID NO: 124889 - DNA, 22 bp, Artificial Sequence
  Synthetic oligonucleotide; TTT chr11 5333195 5333216 5333200 5333195 -
agttagagagggcaaaataaga

SEQ ID NO: 124890 - DNA, 22 bp, Artificial Sequence
  Synthetic oligonucleotide; TTA chr11 5333194 5333215 5333199 5333194 -
gttagagagggcaaaataagag

SEQ ID NO: 124891 - DNA, 22 bp, Artificial Sequence
  Synthetic oligonucleotide; TTA chr11 5333190 5333211 5333195 5333190 -
gagagggcaaaataagagacaa

SEQ ID NO: 124892 - DNA, 22 bp, Artificial Sequence
  Synthetic oligonucleotide; CTG chr11 5333085 5333106 5333090 5333085 -
caccctatgtacctgagcagat

SEQ ID NO: 124893 - DNA, 22 bp, Artificial Sequence
  Synthetic oligonucleotide; CTA chr11 5333078 5333099 5333083 5333078 -
tgtacctgagcagatggtgcag

SEQ ID NO: 124894 - DNA, 22 bp, Artificial Sequence
  Synthetic oligonucleotide; CTG chr11 5333070 5333091 5333075 5333070 -
agcagatggtgcagaaatgatc

SEQ ID NO: 124895 - DNA, 22 bp, Artificial Sequence
  Synthetic oligonucleotide; CTG chr11 5333041 5333062 5333046 5333041 -
cccagccaagcccagcctaaat

SEQ ID NO: 124896 - DNA, 22 bp, Artificial Sequence
  Synthetic oligonucleotide; CTA chr11 5333022 5333043 5333027 5333022 -
aataagttgaaccatgcattag

SEQ ID NO: 124897 - DNA, 22 bp, Artificial Sequence
  Synthetic oligonucleotide; TTG chr11 5333013 5333034 5333018 5333013 -
aaccatgcattagagtgaaaaa

SEQ ID NO: 124898 - DNA, 22 bp, Artificial Sequence
  Synthetic oligonucleotide; TTA chr11 5333001 5333022 5333006 5333001 -
gagtgaaaaataaatgtttaat

SEQ ID NO: 124899 - DNA, 22 bp, Artificial Sequence
  Synthetic oligonucleotide; TTT chr11 5332982 5333003 5332987 5332982 -
aatgttgtcagccactgatgct

SEQ ID NO: 124900 - DNA, 22 bp, Artificial Sequence
  Synthetic oligonucleotide; TTA chr11 5332981 5333002 5332986 5332981 -
atgttgtcagccactgatgcta

SEQ ID NO: 124901 - DNA, 22 bp, Artificial Sequence
  Synthetic oligonucleotide; TTG chr11 5332975 5332996 5332980 5332975 -
tcagccactgatgctatacagg

SEQ ID NO: 124902 - DNA, 22 bp, Artificial Sequence
  Synthetic oligonucleotide; CTG chr11 5332965 5332986 5332970 5332965 -
atgctatacagggctttgtgat

SEQ ID NO: 124903 - DNA, 22 bp, Artificial Sequence
  Synthetic oligonucleotide; CTA chr11 5332959 5332980 5332964 5332959 -
tacagggctttgtgatgtgaca

SEQ ID NO: 124904 - DNA, 22 bp, Artificial Sequence
  Synthetic oligonucleotide; CTT chr11 5332949 5332970 5332954 5332949 -
tgtgatgtgacaattctgtgat

SEQ ID NO: 124905 - DNA, 22 bp, Artificial Sequence
  Synthetic oligonucleotide; TTT chr11 5332948 5332969 5332953 5332948 -
gtgatgtgacaattctgtgata

SEQ ID NO: 124906 - DNA, 22 bp, Artificial Sequence
  Synthetic oligonucleotide; TTG chr11 5332947 5332968 5332952 5332947 -
tgatgtgacaattctgtgataa

SEQ ID NO: 124907 - DNA, 22 bp, Artificial Sequence
  Synthetic oligonucleotide; TTC chr11 5332933 5332954 5332938 5332933 -
tgtgataatagataaatgatac

SEQ ID NO: 124908 - DNA, 22 bp, Artificial Sequence
  Synthetic oligonucleotide; CTG chr11 5332931 5332952 5332936 5332931 -
tgataatagataaatgatacaa

SEQ ID NO: 124909 - DNA, 22 bp, Artificial Sequence
  Synthetic oligonucleotide; TTT chr11 5332903 5332924 5332908 5332903 -
acataaaccctgtaaatattag

SEQ ID NO: 124910 - DNA, 22 bp, Artificial Sequence
  Synthetic oligonucleotide; TTA chr11 5332902 5332923 5332907 5332902 -
cataaaccctgtaaatattagt

SEQ ID NO: 124911 - DNA, 22 bp, Artificial Sequence
  Synthetic oligonucleotide; CTG chr11 5332891 5332912 5332896 5332891 -
taaatattagtttattatagaa

SEQ ID NO: 124912 - DNA, 22 bp, Artificial Sequence
  Synthetic oligonucleotide; TTA chr11 5332882 5332903 5332887 5332882 -
gtttattatagaactctataaa

SEQ ID NO: 124913 - DNA, 22 bp, Artificial Sequence
  Synthetic oligonucleotide; TTT chr11 5332878 5332899 5332883 5332878 -
attatagaactctataaactct

SEQ ID NO: 124914 - DNA, 22 bp, Artificial Sequence
  Synthetic oligonucleotide; TTA chr11 5332877 5332898 5332882 5332877 -
ttatagaactctataaactctt

SEQ ID NO: 124915 - DNA, 22 bp, Artificial Sequence
  Synthetic oligonucleotide; TTA chr11 5332874 5332895 5332879 5332874 -
tagaactctataaactcttaat

SEQ ID NO: 124916 - DNA, 22 bp, Artificial Sequence
  Synthetic oligonucleotide; CTC chr11 5332866 5332887 5332871 5332866 -
tataaactcttaataaaatatg

SEQ ID NO: 124917 - DNA, 22 bp, Artificial Sequence
  Synthetic oligonucleotide; CTA chr11 5332864 5332885 5332869 5332864 -
taaactcttaataaaatatgga

SEQ ID NO: 124918 - DNA, 22 bp, Artificial Sequence
  Synthetic oligonucleotide; CTC chr11 5332857 5332878 5332862 5332857 -
ttaataaaatatggataatagt

SEQ ID NO: 124919 - DNA, 22 bp, Artificial Sequence
  Synthetic oligonucleotide; CTT chr11 5332855 5332876 5332860 5332855 -
aataaaatatggataatagtaa

SEQ ID NO: 124920 - DNA, 22 bp, Artificial Sequence
  Synthetic oligonucleotide; TTA chr11 5332854 5332875 5332859 5332854 -
ataaaatatggataatagtaat

SEQ ID NO: 124921 - DNA, 22 bp, Artificial Sequence
  Synthetic oligonucleotide; CTT chr11 5332828 5332849 5332833 5332828 -
tgcattagttttctattgttat

SEQ ID NO: 124922 - DNA, 22 bp, Artificial Sequence
  Synthetic oligonucleotide; TTT chr11 5332827 5332848 5332832 5332827 -
gcattagttttctattgttata

SEQ ID NO: 124923 - DNA, 22 bp, Artificial Sequence
  Synthetic oligonucleotide; TTG chr11 5332826 5332847 5332831 5332826 -
cattagttttctattgttatac

SEQ ID NO: 124924 - DNA, 22 bp, Artificial Sequence
  Synthetic oligonucleotide; TTA chr11 5332821 5332842 5332826 5332821 -
gttttctattgttatacataaa

SEQ ID NO: 124925 - DNA, 22 bp, Artificial Sequence
  Synthetic oligonucleotide; TTT chr11 5332817 5332838 5332822 5332817 -
tctattgttatacataaattac

SEQ ID NO: 124926 - DNA, 22 bp, Artificial Sequence
  Synthetic oligonucleotide; TTT chr11 5332816 5332837 5332821 5332816 -
ctattgttatacataaattact

SEQ ID NO: 124927 - DNA, 22 bp, Artificial Sequence
  Synthetic oligonucleotide; TTC chr11 5332815 5332836 5332820 5332815 -
tattgttatacataaattactg

SEQ ID NO: 124928 - DNA, 22 bp, Artificial Sequence
  Synthetic oligonucleotide; CTA chr11 5332813 5332834 5332818 5332813 -
ttgttatacataaattactgca

SEQ ID NO: 124929 - DNA, 22 bp, Artificial Sequence
  Synthetic oligonucleotide; TTG chr11 5332810 5332831 5332815 5332810 -
ttatacataaattactgcaact

SEQ ID NO: 124930 - DNA, 22 bp, Artificial Sequence
  Synthetic oligonucleotide; TTA chr11 5332807 5332828 5332812 5332807 -
tacataaattactgcaacttga

SEQ ID NO: 124931 - DNA, 22 bp, Artificial Sequence
  Synthetic oligonucleotide; TTA chr11 5332796 5332817 5332801 5332796 -
ctgcaacttgagctgcttcaaa

SEQ ID NO: 124932 - DNA, 22 bp, Artificial Sequence
  Synthetic oligonucleotide; CTG chr11 5332793 5332814 5332798 5332793 -
caacttgagctgcttcaaacat

SEQ ID NO: 124933 - DNA, 22 bp, Artificial Sequence
  Synthetic oligonucleotide; CTT chr11 5332787 5332808 5332792 5332787 -
gagctgcttcaaacattattag

SEQ ID NO: 124934 - DNA, 22 bp, Artificial Sequence
  Synthetic oligonucleotide; TTG chr11 5332786 5332807 5332791 5332786 -
agctgcttcaaacattattagt

SEQ ID NO: 124935 - DNA, 22 bp, Artificial Sequence
  Synthetic oligonucleotide; CTG chr11 5332781 5332802 5332786 5332781 -
cttcaaacattattagtttatt

SEQ ID NO: 124936 - DNA, 22 bp, Artificial Sequence
  Synthetic oligonucleotide; CTT chr11 5332778 5332799 5332783 5332778 -
caaacattattagtttattata

SEQ ID NO: 124937 - DNA, 22 bp, Artificial Sequence
  Synthetic oligonucleotide; TTC chr11 5332777 5332798 5332782 5332777 -
aaacattattagtttattatat

SEQ ID NO: 124938 - DNA, 22 bp, Artificial Sequence
  Synthetic oligonucleotide; TTA chr11 5332769 5332790 5332774 5332769 -
ttagtttattatatcacatttc

SEQ ID NO: 124939 - DNA, 22 bp, Artificial Sequence
  Synthetic oligonucleotide; TTA chr11 5332766 5332787 5332771 5332766 -
gtttattatatcacatttctat

SEQ ID NO: 124940 - DNA, 22 bp, Artificial Sequence
  Synthetic oligonucleotide; TTT chr11 5332762 5332783 5332767 5332762 -
attatatcacatttctataggt

SEQ ID NO: 124941 - DNA, 22 bp, Artificial Sequence
  Synthetic oligonucleotide; TTA chr11 5332761 5332782 5332766 5332761 -
ttatatcacatttctataggtc

SEQ ID NO: 124942 - DNA, 22 bp, Artificial Sequence
  Synthetic oligonucleotide; TTA chr11 5332758 5332779 5332763 5332758 -
tatcacatttctataggtctgc

SEQ ID NO: 124943 - DNA, 22 bp, Artificial Sequence
  Synthetic oligonucleotide; TTT chr11 5332748 5332769 5332753 5332748 -
ctataggtctgcactctcatag

SEQ ID NO: 124944 - DNA, 22 bp, Artificial Sequence
  Synthetic oligonucleotide; TTC chr11 5332747 5332768 5332752 5332747 -
tataggtctgcactctcatagg

SEQ ID NO: 124945 - DNA, 22 bp, Artificial Sequence
  Synthetic oligonucleotide; CTA chr11 5332745 5332766 5332750 5332745 -
taggtctgcactctcataggct

SEQ ID NO: 124946 - DNA, 22 bp, Artificial Sequence
  Synthetic oligonucleotide; CTG chr11 5332737 5332758 5332742 5332737 -
cactctcataggcttaactgag

SEQ ID NO: 124947 - DNA, 22 bp, Artificial Sequence
  Synthetic oligonucleotide; CTC chr11 5332732 5332753 5332737 5332732 -
tcataggcttaactgagttctc

SEQ ID NO: 124948 - DNA, 22 bp, Artificial Sequence
  Synthetic oligonucleotide; CTC chr11 5332730 5332751 5332735 5332730 -
ataggcttaactgagttctctg

SEQ ID NO: 124949 - DNA, 22 bp, Artificial Sequence
  Synthetic oligonucleotide; CTT chr11 5332722 5332743 5332727 5332722 -
aactgagttctctgcttagggt

SEQ ID NO: 124950 - DNA, 22 bp, Artificial Sequence
  Synthetic oligonucleotide; TTA chr11 5332721 5332742 5332726 5332721 -
actgagttctctgcttagggta

SEQ ID NO: 124951 - DNA, 22 bp, Artificial Sequence
  Synthetic oligonucleotide; CTG chr11 5332717 5332738 5332722 5332717 -
agttctctgcttagggtatcat

SEQ ID NO: 124952 - DNA, 22 bp, Artificial Sequence
  Synthetic oligonucleotide; TTC chr11 5332712 5332733 5332717 5332712 -
tctgcttagggtatcataaggt

SEQ ID NO: 124953 - DNA, 22 bp, Artificial Sequence
  Synthetic oligonucleotide; CTC chr11 5332710 5332731 5332715 5332710 -
tgcttagggtatcataaggtca

SEQ ID NO: 124954 - DNA, 22 bp, Artificial Sequence
  Synthetic oligonucleotide; CTG chr11 5332708 5332729 5332713 5332708 -
cttagggtatcataaggtcaaa

SEQ ID NO: 124955 - DNA, 22 bp, Artificial Sequence
  Synthetic oligonucleotide; CTT chr11 5332705 5332726 5332710 5332705 -
agggtatcataaggtcaaattc

SEQ ID NO: 124956 - DNA, 22 bp, Artificial Sequence
  Synthetic oligonucleotide; TTA chr11 5332704 5332725 5332709 5332704 -
gggtatcataaggtcaaattca

SEQ ID NO: 124957 - DNA, 22 bp, Artificial Sequence
  Synthetic oligonucleotide; TTC chr11 5332683 5332704 5332688 5332683 -
aaaatatcgggagggctgggct

SEQ ID NO: 124958 - DNA, 22 bp, Artificial Sequence
  Synthetic oligonucleotide; CTG chr11 5332665 5332686 5332670 5332665 -
ggctcttatccaaaggctctgg

SEQ ID NO: 124959 - DNA, 22 bp, Artificial Sequence
  Synthetic oligonucleotide; CTC chr11 5332660 5332681 5332665 5332660 -
ttatccaaaggctctggggaag

SEQ ID NO: 124960 - DNA, 22 bp, Artificial Sequence
  Synthetic oligonucleotide; CTT chr11 5332658 5332679 5332663 5332658 -
atccaaaggctctggggaagaa

SEQ ID NO: 124961 - DNA, 22 bp, Artificial Sequence
  Synthetic oligonucleotide; TTA chr11 5332657 5332678 5332662 5332657 -
tccaaaggctctggggaagaat

SEQ ID NO: 124962 - DNA, 22 bp, Artificial Sequence
  Synthetic oligonucleotide; CTC chr11 5332646 5332667 5332651 5332646 -
tggggaagaattcgcttccacg

SEQ ID NO: 124963 - DNA, 22 bp, Artificial Sequence
  Synthetic oligonucleotide; CTG chr11 5332644 5332665 5332649 5332644 -
gggaagaattcgcttccacgtt

SEQ ID NO: 124964 - DNA, 22 bp, Artificial Sequence
  Synthetic oligonucleotide; TTC chr11 5332633 5332654 5332638 5332633 -
gcttccacgttcattcagattg

SEQ ID NO: 124965 - DNA, 22 bp, Artificial Sequence
  Synthetic oligonucleotide; CTT chr11 5332629 5332650 5332634 5332629 -
ccacgttcattcagattgtagt

SEQ ID NO: 124966 - DNA, 22 bp, Artificial Sequence
  Synthetic oligonucleotide; TTC chr11 5332628 5332649 5332633 5332628 -
cacgttcattcagattgtagtc

SEQ ID NO: 124967 - DNA, 22 bp, Artificial Sequence
  Synthetic oligonucleotide; TTC chr11 5332621 5332642 5332626 5332621 -
attcagattgtagtcagagctc

SEQ ID NO: 124968 - DNA, 22 bp, Artificial Sequence
  Synthetic oligonucleotide; TTC chr11 5332617 5332638 5332622 5332617 -
agattgtagtcagagctcagtt

SEQ ID NO: 124969 - DNA, 22 bp, Artificial Sequence
  Synthetic oligonucleotide; TTG chr11 5332611 5332632 5332616 5332611 -
tagtcagagctcagtttctttt

SEQ ID NO: 124970 - DNA, 22 bp, Artificial Sequence
  Synthetic oligonucleotide; CTC chr11 5332599 5332620 5332604 5332599 -
agtttctttttttttctttttt

SEQ ID NO: 124971 - DNA, 22 bp, Artificial Sequence
  Synthetic oligonucleotide; TTT chr11 5332594 5332615 5332599 5332594 -
ctttttttttcttttttttttt

SEQ ID NO: 124972 - DNA, 22 bp, Artificial Sequence
  Synthetic oligonucleotide; TTC chr11 5332593 5332614 5332598 5332593 -
tttttttttctttttttttttt

SEQ ID NO: 124973 - DNA, 22 bp, Artificial Sequence
  Synthetic oligonucleotide; CTT chr11 5332591 5332612 5332596 5332591 -
tttttttctttttttttttttt

SEQ ID NO: 124974 - DNA, 22 bp, Artificial Sequence
  Synthetic oligonucleotide; TTT chr11 5332590 5332611 5332595 5332590 -
ttttttcttttttttttttttt

SEQ ID NO: 124975 - DNA, 22 bp, Artificial Sequence
  Synthetic oligonucleotide; TTT chr11 5332589 5332610 5332594 5332589 -
tttttctttttttttttttttt

SEQ ID NO: 124976 - DNA, 22 bp, Artificial Sequence
  Synthetic oligonucleotide; TTT chr11 5332588 5332609 5332593 5332588 -
ttttcttttttttttttttttt

SEQ ID NO: 124977 - DNA, 22 bp, Artificial Sequence
  Synthetic oligonucleotide; TTT chr11 5332587 5332608 5332592 5332587 -
tttctttttttttttttttttt

SEQ ID NO: 124978 - DNA, 22 bp, Artificial Sequence
  Synthetic oligonucleotide; TTT chr11 5332586 5332607 5332591 5332586 -
ttcttttttttttttttttttt

SEQ ID NO: 124979 - DNA, 22 bp, Artificial Sequence
  Synthetic oligonucleotide; TTT chr11 5332585 5332606 5332590 5332585 -
tctttttttttttttttttttt

SEQ ID NO: 124980 - DNA, 22 bp, Artificial Sequence
  Synthetic oligonucleotide; TTT chr11 5332584 5332605 5332589 5332584 -
cttttttttttttttttttttg

SEQ ID NO: 124981 - DNA, 22 bp, Artificial Sequence
  Synthetic oligonucleotide; TTC chr11 5332583 5332604 5332588 5332583 -
ttttttttttttttttttttga

SEQ ID NO: 124982 - DNA, 22 bp, Artificial Sequence
  Synthetic oligonucleotide; CTT chr11 5332581 5332602 5332586 5332581 -
ttttttttttttttttttgaga

SEQ ID NO: 124983 - DNA, 22 bp, Artificial Sequence
  Synthetic oligonucleotide; TTT chr11 5332580 5332601 5332585 5332580 -
tttttttttttttttttgagat

SEQ ID NO: 124984 - DNA, 22 bp, Artificial Sequence
  Synthetic oligonucleotide; TTT chr11 5332579 5332600 5332584 5332579 -
ttttttttttttttttgagatg

SEQ ID NO: 124985 - DNA, 22 bp, Artificial Sequence
  Synthetic oligonucleotide; TTT chr11 5332578 5332599 5332583 5332578 -
tttttttttttttttgagatgg

SEQ ID NO: 124986 - DNA, 22 bp, Artificial Sequence
  Synthetic oligonucleotide; TTT chr11 5332577 5332598 5332582 5332577 -
ttttttttttttttgagatgga

SEQ ID NO: 124987 - DNA, 22 bp, Artificial Sequence
  Synthetic oligonucleotide; TTT chr11 5332576 5332597 5332581 5332576 -
tttttttttttttgagatggag

SEQ ID NO: 124988 - DNA, 22 bp, Artificial Sequence
  Synthetic oligonucleotide; TTT chr11 5332575 5332596 5332580 5332575 -
ttttttttttttgagatggagt

SEQ ID NO: 124989 - DNA, 22 bp, Artificial Sequence
  Synthetic oligonucleotide; TTT chr11 5332574 5332595 5332579 5332574 -
tttttttttttgagatggagtc

SEQ ID NO: 124990 - DNA, 22 bp, Artificial Sequence
  Synthetic oligonucleotide; TTT chr11 5332573 5332594 5332578 5332573 -
ttttttttttgagatggagtct

SEQ ID NO: 124991 - DNA, 22 bp, Artificial Sequence
  Synthetic oligonucleotide; TTT chr11 5332572 5332593 5332577 5332572 -
tttttttttgagatggagtctc

SEQ ID NO: 124992 - DNA, 22 bp, Artificial Sequence
  Synthetic oligonucleotide; TTT chr11 5332571 5332592 5332576 5332571 -
ttttttttgagatggagtctcg

SEQ ID NO: 124993 - DNA, 22 bp, Artificial Sequence
  Synthetic oligonucleotide; TTT chr11 5332570 5332591 5332575 5332570 -
tttttttgagatggagtctcgc

SEQ ID NO: 124994 - DNA, 22 bp, Artificial Sequence
  Synthetic oligonucleotide; TTT chr11 5332569 5332590 5332574 5332569 -
ttttttgagatggagtctcgct

SEQ ID NO: 124995 - DNA, 22 bp, Artificial Sequence
  Synthetic oligonucleotide; TTT chr11 5332568 5332589 5332573 5332568 -
tttttgagatggagtctcgctc

SEQ ID NO: 124996 - DNA, 22 bp, Artificial Sequence
  Synthetic oligonucleotide; TTT chr11 5332567 5332588 5332572 5332567 -
ttttgagatggagtctcgctct

SEQ ID NO: 124997 - DNA, 22 bp, Artificial Sequence
  Synthetic oligonucleotide; TTT chr11 5332566 5332587 5332571 5332566 -
tttgagatggagtctcgctctg

SEQ ID NO: 124998 - DNA, 22 bp, Artificial Sequence
  Synthetic oligonucleotide; TTT chr11 5332565 5332586 5332570 5332565 -
ttgagatggagtctcgctctgt

SEQ ID NO: 124999 - DNA, 22 bp, Artificial Sequence
  Synthetic oligonucleotide; TTT chr11 5332564 5332585 5332569 5332564 -
tgagatggagtctcgctctgtc

SEQ ID NO: 125000 - DNA, 22 bp, Artificial Sequence
  Synthetic oligonucleotide; TTT chr11 5332563 5332584 5332568 5332563 -
gagatggagtctcgctctgtca

SEQ ID NO: 125001 - DNA, 22 bp, Artificial Sequence
  Synthetic oligonucleotide; TTG chr11 5332562 5332583 5332567 5332562 -
agatggagtctcgctctgtcac

SEQ ID NO: 125002 - DNA, 22 bp, Artificial Sequence
  Synthetic oligonucleotide; CTC chr11 5332550 5332571 5332555 5332550 -
gctctgtcacccagcctggagt

SEQ ID NO: 125003 - DNA, 22 bp, Artificial Sequence
  Synthetic oligonucleotide; CTC chr11 5332546 5332567 5332551 5332546 -
tgtcacccagcctggagtgcag

SEQ ID NO: 125004 - DNA, 22 bp, Artificial Sequence
  Synthetic oligonucleotide; CTG chr11 5332544 5332565 5332549 5332544 -
tcacccagcctggagtgcagtg

SEQ ID NO: 125005 - DNA, 22 bp, Artificial Sequence
  Synthetic oligonucleotide; CTG chr11 5332532 5332553 5332537 5332532 -
gagtgcagtggcacaatctctt

SEQ ID NO: 125006 - DNA, 22 bp, Artificial Sequence
  Synthetic oligonucleotide; CTC chr11 5332512 5332533 5332517 5332512 -
ttgctccctgcaacctgtgcct

SEQ ID NO: 125007 - DNA, 22 bp, Artificial Sequence
  Synthetic oligonucleotide; CTT chr11 5332510 5332531 5332515 5332510 -
gctccctgcaacctgtgcctcc

SEQ ID NO: 125008 - DNA, 22 bp, Artificial Sequence
  Synthetic oligonucleotide; TTG chr11 5332509 5332530 5332514 5332509 -
ctccctgcaacctgtgcctccc

SEQ ID NO: 125009 - DNA, 22 bp, Artificial Sequence
  Synthetic oligonucleotide; CTC chr11 5332506 5332527 5332511 5332506 -
cctgcaacctgtgcctcccggg

SEQ ID NO: 125010 - DNA, 22 bp, Artificial Sequence
  Synthetic oligonucleotide; CTG chr11 5332502 5332523 5332507 5332502 -
caacctgtgcctcccgggttca

SEQ ID NO: 125011 - DNA, 22 bp, Artificial Sequence
  Synthetic oligonucleotide; CTG chr11 5332495 5332516 5332500 5332495 -
tgcctcccgggttcaagcaatt

SEQ ID NO: 125012 - DNA, 22 bp, Artificial Sequence
  Synthetic oligonucleotide; CTC chr11 5332489 5332510 5332494 5332489 -
ccgggttcaagcaattctcctg

SEQ ID NO: 125013 - DNA, 22 bp, Artificial Sequence
  Synthetic oligonucleotide; TTC chr11 5332481 5332502 5332486 5332481 -
aagcaattctcctgcctcagtt

SEQ ID NO: 125014 - DNA, 22 bp, Artificial Sequence
  Synthetic oligonucleotide; TTC chr11 5332472 5332493 5332477 5332472 -
tcctgcctcagtttcccaagta

SEQ ID NO: 125015 - DNA, 22 bp, Artificial Sequence
  Synthetic oligonucleotide; CTC chr11 5332470 5332491 5332475 5332470 -
ctgcctcagtttcccaagtagc

SEQ ID NO: 125016 - DNA, 22 bp, Artificial Sequence
  Synthetic oligonucleotide; CTG chr11 5332467 5332488 5332472 5332467 -
cctcagtttcccaagtagctgg

SEQ ID NO: 125017 - DNA, 22 bp, Artificial Sequence
  Synthetic oligonucleotide; CTC chr11 5332463 5332484 5332468 5332463 -
agtttcccaagtagctggaact

SEQ ID NO: 125018 - DNA, 22 bp, Artificial Sequence
  Synthetic oligonucleotide; TTT chr11 5332458 5332479 5332463 5332458 -
cccaagtagctggaactacagg

SEQ ID NO: 125019 - DNA, 22 bp, Artificial Sequence
  Synthetic oligonucleotide; TTC chr11 5332457 5332478 5332462 5332457 -
ccaagtagctggaactacaggc

SEQ ID NO: 125020 - DNA, 22 bp, Artificial Sequence
  Synthetic oligonucleotide; CTG chr11 5332446 5332467 5332451 5332446 -
gaactacaggcaactgcaacca

SEQ ID NO: 125021 - DNA, 22 bp, Artificial Sequence
  Synthetic oligonucleotide; CTA chr11 5332440 5332461 5332445 5332440 -
caggcaactgcaaccacacctg

SEQ ID NO: 125022 - DNA, 22 bp, Artificial Sequence
  Synthetic oligonucleotide; CTG chr11 5332430 5332451 5332435 5332430 -
caaccacacctggctaattttt

SEQ ID NO: 125023 - DNA, 22 bp, Artificial Sequence
  Synthetic oligonucleotide; CTG chr11 5332418 5332439 5332423 5332418 -
gctaatttttatattttttggt

SEQ ID NO: 125024 - DNA, 22 bp, Artificial Sequence
  Synthetic oligonucleotide; CTA chr11 5332414 5332435 5332419 5332414 -
atttttatattttttggtaggg

SEQ ID NO: 125025 - DNA, 22 bp, Artificial Sequence
  Synthetic oligonucleotide; TTT chr11 5332410 5332431 5332415 5332410 -
ttatattttttggtagggatgg

SEQ ID NO: 125026 - DNA, 22 bp, Artificial Sequence
  Synthetic oligonucleotide; TTT chr11 5332409 5332430 5332414 5332409 -
tatattttttggtagggatgga

SEQ ID NO: 125027 - DNA, 22 bp, Artificial Sequence
  Synthetic oligonucleotide; TTT chr11 5332408 5332429 5332413 5332408 -
atattttttggtagggatggaa

SEQ ID NO: 125028 - DNA, 22 bp, Artificial Sequence
  Synthetic oligonucleotide; TTA chr11 5332407 5332428 5332412 5332407 -
tattttttggtagggatggaat

SEQ ID NO: 125029 - DNA, 22 bp, Artificial Sequence
  Synthetic oligonucleotide; TTT chr11 5332402 5332423 5332407 5332402 -
tttggtagggatggaatttcac

SEQ ID NO: 125030 - DNA, 22 bp, Artificial Sequence
  Synthetic oligonucleotide; TTT chr11 5332401 5332422 5332406 5332401 -
ttggtagggatggaatttcacc

SEQ ID NO: 125031 - DNA, 22 bp, Artificial Sequence
  Synthetic oligonucleotide; TTT chr11 5332400 5332421 5332405 5332400 -
tggtagggatggaatttcacca

SEQ ID NO: 125032 - DNA, 22 bp, Artificial Sequence
  Synthetic oligonucleotide; TTT chr11 5332399 5332420 5332404 5332399 -
ggtagggatggaatttcaccat

SEQ ID NO: 125033 - DNA, 22 bp, Artificial Sequence
  Synthetic oligonucleotide; TTG chr11 5332398 5332419 5332403 5332398 -
gtagggatggaatttcaccatg

SEQ ID NO: 125034 - DNA, 22 bp, Artificial Sequence
  Synthetic oligonucleotide; TTT chr11 5332383 5332404 5332388 5332383 -
caccatgttggccaggctggtc

SEQ ID NO: 125035 - DNA, 22 bp, Artificial Sequence
  Synthetic oligonucleotide; TTC chr11 5332382 5332403 5332387 5332382 -
accatgttggccaggctggtct

SEQ ID NO: 125036 - DNA, 22 bp, Artificial Sequence
  Synthetic oligonucleotide; TTG chr11 5332373 5332394 5332378 5332373 -
gccaggctggtctggaactcct

SEQ ID NO: 125037 - DNA, 22 bp, Artificial Sequence
  Synthetic oligonucleotide; CTG chr11 5332364 5332385 5332369 5332364 -
gtctggaactcctgacctcagg

SEQ ID NO: 125038 - DNA, 22 bp, Artificial Sequence
  Synthetic oligonucleotide; CTG chr11 5332359 5332380 5332364 5332359 -
gaactcctgacctcaggtgatc

SEQ ID NO: 125039 - DNA, 22 bp, Artificial Sequence
  Synthetic oligonucleotide; CTC chr11 5332353 5332374 5332358 5332353 -
ctgacctcaggtgatccgcccg

SEQ ID NO: 125040 - DNA, 22 bp, Artificial Sequence
  Synthetic oligonucleotide; CTG chr11 5332350 5332371 5332355 5332350 -
acctcaggtgatccgcccgcct

SEQ ID NO: 125041 - DNA, 22 bp, Artificial Sequence
  Synthetic oligonucleotide; CTC chr11 5332345 5332366 5332350 5332345 -
aggtgatccgcccgccttggcc

SEQ ID NO: 125042 - DNA, 22 bp, Artificial Sequence
  Synthetic oligonucleotide; CTT chr11 5332327 5332348 5332332 5332327 -
ggcctcccaaagtgctgggatt

SEQ ID NO: 125043 - DNA, 22 bp, Artificial Sequence
  Synthetic oligonucleotide; TTG chr11 5332326 5332347 5332331 5332326 -
gcctcccaaagtgctgggatta

SEQ ID NO: 125044 - DNA, 22 bp, Artificial Sequence
  Synthetic oligonucleotide; CTC chr11 5332321 5332342 5332326 5332321 -
ccaaagtgctgggattacaggc

SEQ ID NO: 125045 - DNA, 22 bp, Artificial Sequence
  Synthetic oligonucleotide; CTG chr11 5332310 5332331 5332315 5332310 -
ggattacaggcttgaatgagcc

SEQ ID NO: 125046 - DNA, 22 bp, Artificial Sequence
  Synthetic oligonucleotide; TTA chr11 5332304 5332325 5332309 5332304 -
caggcttgaatgagccattgca

SEQ ID NO: 125047 - DNA, 22 bp, Artificial Sequence
  Synthetic oligonucleotide; CTT chr11 5332297 5332318 5332302 5332297 -
gaatgagccattgcacccggct

SEQ ID NO: 125048 - DNA, 22 bp, Artificial Sequence
  Synthetic oligonucleotide; TTG chr11 5332296 5332317 5332301 5332296 -
aatgagccattgcacccggctg

SEQ ID NO: 125049 - DNA, 22 bp, Artificial Sequence
  Synthetic oligonucleotide; TTG chr11 5332284 5332305 5332289 5332284 -
cacccggctgtcagagttcagt

SEQ ID NO: 125050 - DNA, 22 bp, Artificial Sequence
  Synthetic oligonucleotide; CTG chr11 5332274 5332295 5332279 5332274 -
tcagagttcagtttcctactgc

SEQ ID NO: 125051 - DNA, 22 bp, Artificial Sequence
  Synthetic oligonucleotide; TTC chr11 5332265 5332286 5332270 5332265 -
agtttcctactgctgaactctg

SEQ ID NO: 125052 - DNA, 22 bp, Artificial Sequence
  Synthetic oligonucleotide; TTT chr11 5332260 5332281 5332265 5332260 -
cctactgctgaactctgaagtc

SEQ ID NO: 125053 - DNA, 22 bp, Artificial Sequence
  Synthetic oligonucleotide; TTC chr11 5332259 5332280 5332264 5332259 -
ctactgctgaactctgaagtcc

SEQ ID NO: 125054 - DNA, 22 bp, Artificial Sequence
  Synthetic oligonucleotide; CTA chr11 5332256 5332277 5332261 5332256 -
ctgctgaactctgaagtccctg

SEQ ID NO: 125055 - DNA, 22 bp, Artificial Sequence
  Synthetic oligonucleotide; CTG chr11 5332253 5332274 5332258 5332253 -
ctgaactctgaagtccctgttt

SEQ ID NO: 125056 - DNA, 22 bp, Artificial Sequence
  Synthetic oligonucleotide; CTG chr11 5332250 5332271 5332255 5332250 -
aactctgaagtccctgtttgtt

SEQ ID NO: 125057 - DNA, 22 bp, Artificial Sequence
  Synthetic oligonucleotide; CTC chr11 5332245 5332266 5332250 5332245 -
tgaagtccctgtttgtttttgt

SEQ ID NO: 125058 - DNA, 22 bp, Artificial Sequence
  Synthetic oligonucleotide; CTG chr11 5332243 5332264 5332248 5332243 -
aagtccctgtttgtttttgttt

SEQ ID NO: 125059 - DNA, 22 bp, Artificial Sequence
  Synthetic oligonucleotide; CTG chr11 5332234 5332255 5332239 5332234 -
tttgtttttgtttttgtttttt

SEQ ID NO: 125060 - DNA, 22 bp, Artificial Sequence
  Synthetic oligonucleotide; TTT chr11 5332231 5332252 5332236 5332231 -
gtttttgtttttgttttttgtt

SEQ ID NO: 125061 - DNA, 22 bp, Artificial Sequence
  Synthetic oligonucleotide; TTG chr11 5332230 5332251 5332235 5332230 -
tttttgtttttgttttttgttt

SEQ ID NO: 125062 - DNA, 22 bp, Artificial Sequence
  Synthetic oligonucleotide; TTT chr11 5332227 5332248 5332232 5332227 -
ttgtttttgttttttgtttgtt

SEQ ID NO: 125063 - DNA, 22 bp, Artificial Sequence
  Synthetic oligonucleotide; TTT chr11 5332226 5332247 5332231 5332226 -
tgtttttgttttttgtttgttt

SEQ ID NO: 125064 - DNA, 22 bp, Artificial Sequence
  Synthetic oligonucleotide; TTT chr11 5332225 5332246 5332230 5332225 -
gtttttgttttttgtttgtttg

SEQ ID NO: 125065 - DNA, 22 bp, Artificial Sequence
  Synthetic oligonucleotide; TTG chr11 5332224 5332245 5332229 5332224 -
tttttgttttttgtttgtttgt

SEQ ID NO: 125066 - DNA, 22 bp, Artificial Sequence
  Synthetic oligonucleotide; TTT chr11 5332221 5332242 5332226 5332221 -
ttgttttttgtttgtttgtttg

SEQ ID NO: 125067 - DNA, 22 bp, Artificial Sequence
  Synthetic oligonucleotide; TTT chr11 5332220 5332241 5332225 5332220 -
tgttttttgtttgtttgtttgc

SEQ ID NO: 125068 - DNA, 22 bp, Artificial Sequence
  Synthetic oligonucleotide; TTT chr11 5332219 5332240 5332224 5332219 -
gttttttgtttgtttgtttgca

SEQ ID NO: 125069 - DNA, 22 bp, Artificial Sequence
  Synthetic oligonucleotide; TTG chr11 5332218 5332239 5332223 5332218 -
ttttttgtttgtttgtttgcag

SEQ ID NO: 125070 - DNA, 22 bp, Artificial Sequence
  Synthetic oligonucleotide; TTT chr11 5332215 5332236 5332220 5332215 -
tttgtttgtttgtttgcaggct

SEQ ID NO: 125071 - DNA, 22 bp, Artificial Sequence
  Synthetic oligonucleotide; TTT chr11 5332214 5332235 5332219 5332214 -
ttgtttgtttgtttgcaggctg

SEQ ID NO: 125072 - DNA, 22 bp, Artificial Sequence
  Synthetic oligonucleotide; TTT chr11 5332213 5332234 5332218 5332213 -
tgtttgtttgtttgcaggctgt

SEQ ID NO: 125073 - DNA, 22 bp, Artificial Sequence
  Synthetic oligonucleotide; TTT chr11 5332212 5332233 5332217 5332212 -
gtttgtttgtttgcaggctgtt

SEQ ID NO: 125074 - DNA, 22 bp, Artificial Sequence
  Synthetic oligonucleotide; TTG chr11 5332211 5332232 5332216 5332211 -
tttgtttgtttgcaggctgtta

SEQ ID NO: 125075 - DNA, 22 bp, Artificial Sequence
  Synthetic oligonucleotide; TTT chr11 5332208 5332229 5332213 5332208 -
gtttgtttgcaggctgttagct

SEQ ID NO: 125076 - DNA, 22 bp, Artificial Sequence
  Synthetic oligonucleotide; TTG chr11 5332207 5332228 5332212 5332207 -
tttgtttgcaggctgttagcta

SEQ ID NO: 125077 - DNA, 22 bp, Artificial Sequence
  Synthetic oligonucleotide; TTT chr11 5332204 5332225 5332209 5332204 -
gtttgcaggctgttagctagga

SEQ ID NO: 125078 - DNA, 22 bp, Artificial Sequence
  Synthetic oligonucleotide; TTG chr11 5332203 5332224 5332208 5332203 -
tttgcaggctgttagctaggat

SEQ ID NO: 125079 - DNA, 22 bp, Artificial Sequence
  Synthetic oligonucleotide; TTT chr11 5332200 5332221 5332205 5332200 -
gcaggctgttagctaggatgcc

SEQ ID NO: 125080 - DNA, 22 bp, Artificial Sequence
  Synthetic oligonucleotide; TTG chr11 5332199 5332220 5332204 5332199 -
caggctgttagctaggatgccc

SEQ ID NO: 125081 - DNA, 22 bp, Artificial Sequence
  Synthetic oligonucleotide; CTG chr11 5332192 5332213 5332197 5332192 -
ttagctaggatgcccgttctgt

SEQ ID NO: 125082 - DNA, 22 bp, Artificial Sequence
  Synthetic oligonucleotide; TTA chr11 5332189 5332210 5332194 5332189 -
gctaggatgcccgttctgtacc

SEQ ID NO: 125083 - DNA, 22 bp, Artificial Sequence
  Synthetic oligonucleotide; CTA chr11 5332185 5332206 5332190 5332185 -
ggatgcccgttctgtacctagg

SEQ ID NO: 125084 - DNA, 22 bp, Artificial Sequence
  Synthetic oligonucleotide; TTC chr11 5332173 5332194 5332178 5332173 -
tgtacctaggggcttcttgcat

SEQ ID NO: 125085 - DNA, 22 bp, Artificial Sequence
  Synthetic oligonucleotide; CTG chr11 5332171 5332192 5332176 5332171 -
tacctaggggcttcttgcattc

SEQ ID NO: 125086 - DNA, 22 bp, Artificial Sequence
  Synthetic oligonucleotide; CTA chr11 5332165 5332186 5332170 5332165 -
ggggcttcttgcattccttctt

SEQ ID NO: 125087 - DNA, 22 bp, Artificial Sequence
  Synthetic oligonucleotide; CTT chr11 5332158 5332179 5332163 5332158 -
cttgcattccttcttttgtgac

SEQ ID NO: 125088 - DNA, 22 bp, Artificial Sequence
  Synthetic oligonucleotide; TTC chr11 5332157 5332178 5332162 5332157 -
ttgcattccttcttttgtgacc

SEQ ID NO: 125089 - DNA, 22 bp, Artificial Sequence
  Synthetic oligonucleotide; CTT chr11 5332155 5332176 5332160 5332155 -
gcattccttcttttgtgacctc

SEQ ID NO: 125090 - DNA, 22 bp, Artificial Sequence
  Synthetic oligonucleotide; TTG chr11 5332154 5332175 5332159 5332154 -
cattccttcttttgtgacctcc

SEQ ID NO: 125091 - DNA, 22 bp, Artificial Sequence
  Synthetic oligonucleotide; TTC chr11 5332149 5332170 5332154 5332149 -
cttcttttgtgacctccttata

SEQ ID NO: 125092 - DNA, 22 bp, Artificial Sequence
  Synthetic oligonucleotide; CTT chr11 5332146 5332167 5332151 5332146 -
cttttgtgacctccttatattt

SEQ ID NO: 125093 - DNA, 22 bp, Artificial Sequence
  Synthetic oligonucleotide; TTC chr11 5332145 5332166 5332150 5332145 -
ttttgtgacctccttatatttc

SEQ ID NO: 125094 - DNA, 22 bp, Artificial Sequence
  Synthetic oligonucleotide; CTT chr11 5332143 5332164 5332148 5332143 -
ttgtgacctccttatatttcaa

SEQ ID NO: 125095 - DNA, 22 bp, Artificial Sequence
  Synthetic oligonucleotide; TTT chr11 5332142 5332163 5332147 5332142 -
tgtgacctccttatatttcaaa

SEQ ID NO: 125096 - DNA, 22 bp, Artificial Sequence
  Synthetic oligonucleotide; TTT chr11 5332141 5332162 5332146 5332141 -
gtgacctccttatatttcaaac

SEQ ID NO: 125097 - DNA, 22 bp, Artificial Sequence
  Synthetic oligonucleotide; TTG chr11 5332140 5332161 5332145 5332140 -
tgacctccttatatttcaaacc

SEQ ID NO: 125098 - DNA, 22 bp, Artificial Sequence
  Synthetic oligonucleotide; CTC chr11 5332133 5332154 5332138 5332133 -
cttatatttcaaaccagcaact

SEQ ID NO: 125099 - DNA, 22 bp, Artificial Sequence
  Synthetic oligonucleotide; CTT chr11 5332130 5332151 5332135 5332130 -
atatttcaaaccagcaactgac

SEQ ID NO: 125100 - DNA, 22 bp, Artificial Sequence
  Synthetic oligonucleotide; TTA chr11 5332129 5332150 5332134 5332129 -
tatttcaaaccagcaactgacc

SEQ ID NO: 125101 - DNA, 22 bp, Artificial Sequence
  Synthetic oligonucleotide; TTT chr11 5332124 5332145 5332129 5332124 -
caaaccagcaactgacccatga

SEQ ID NO: 125102 - DNA, 22 bp, Artificial Sequence
  Synthetic oligonucleotide; TTC chr11 5332123 5332144 5332128 5332123 -
aaaccagcaactgacccatgaa

SEQ ID NO: 125103 - DNA, 22 bp, Artificial Sequence
  Synthetic oligonucleotide; CTG chr11 5332110 5332131 5332115 5332110 -
acccatgaacctttctcaaatt

SEQ ID NO: 125104 - DNA, 22 bp, Artificial Sequence
  Synthetic oligonucleotide; CTT chr11 5332097 5332118 5332102 5332097 -
tctcaaattttgaatatgtctg

SEQ ID NO: 125105 - DNA, 22 bp, Artificial Sequence
  Synthetic oligonucleotide; TTT chr11 5332096 5332117 5332101 5332096 -
ctcaaattttgaatatgtctgg

SEQ ID NO: 125106 - DNA, 22 bp, Artificial Sequence
  Synthetic oligonucleotide; TTC chr11 5332095 5332116 5332100 5332095 -
tcaaattttgaatatgtctggc

SEQ ID NO: 125107 - DNA, 22 bp, Artificial Sequence
  Synthetic oligonucleotide; CTC chr11 5332093 5332114 5332098 5332093 -
aaattttgaatatgtctggctt

SEQ ID NO: 125108 - DNA, 22 bp, Artificial Sequence
  Synthetic oligonucleotide; TTT chr11 5332087 5332108 5332092 5332087 -
tgaatatgtctggcttcctatt

SEQ ID NO: 125109 - DNA, 22 bp, Artificial Sequence
  Synthetic oligonucleotide; TTT chr11 5332086 5332107 5332091 5332086 -
gaatatgtctggcttcctattc

SEQ ID NO: 125110 - DNA, 22 bp, Artificial Sequence
  Synthetic oligonucleotide; TTG chr11 5332085 5332106 5332090 5332085 -
aatatgtctggcttcctattct

SEQ ID NO: 125111 - DNA, 22 bp, Artificial Sequence
  Synthetic oligonucleotide; CTG chr11 5332075 5332096 5332080 5332075 -
gcttcctattctcctactactt

SEQ ID NO: 125112 - DNA, 22 bp, Artificial Sequence
  Synthetic oligonucleotide; CTT chr11 5332071 5332092 5332076 5332071 -
cctattctcctactacttggtg

SEQ ID NO: 125113 - DNA, 22 bp, Artificial Sequence
  Synthetic oligonucleotide; TTC chr11 5332070 5332091 5332075 5332070 -
ctattctcctactacttggtga

SEQ ID NO: 125114 - DNA, 22 bp, Artificial Sequence
  Synthetic oligonucleotide; CTA chr11 5332067 5332088 5332072 5332067 -
ttctcctactacttggtgaaaa

SEQ ID NO: 125115 - DNA, 22 bp, Artificial Sequence
  Synthetic oligonucleotide; TTC chr11 5332064 5332085 5332069 5332064 -
tcctactacttggtgaaaactc

SEQ ID NO: 125116 - DNA, 22 bp, Artificial Sequence
  Synthetic oligonucleotide; CTC chr11 5332062 5332083 5332067 5332062 -
ctactacttggtgaaaactctg

SEQ ID NO: 125117 - DNA, 22 bp, Artificial Sequence
  Synthetic oligonucleotide; CTA chr11 5332059 5332080 5332064 5332059 -
ctacttggtgaaaactctgctt

SEQ ID NO: 125118 - DNA, 22 bp, Artificial Sequence
  Synthetic oligonucleotide; CTA chr11 5332056 5332077 5332061 5332056 -
cttggtgaaaactctgctttta

SEQ ID NO: 125119 - DNA, 22 bp, Artificial Sequence
  Synthetic oligonucleotide; CTT chr11 5332053 5332074 5332058 5332053 -
ggtgaaaactctgcttttaggg

SEQ ID NO: 125120 - DNA, 22 bp, Artificial Sequence
  Synthetic oligonucleotide; TTG chr11 5332052 5332073 5332057 5332052 -
gtgaaaactctgcttttagggg

SEQ ID NO: 125121 - DNA, 22 bp, Artificial Sequence
  Synthetic oligonucleotide; CTC chr11 5332042 5332063 5332047 5332042 -
tgcttttaggggctcatggaat

SEQ ID NO: 125122 - DNA, 22 bp, Artificial Sequence
  Synthetic oligonucleotide; CTG chr11 5332040 5332061 5332045 5332040 -
cttttaggggctcatggaatta

SEQ ID NO: 125123 - DNA, 22 bp, Artificial Sequence
  Synthetic oligonucleotide; CTT chr11 5332037 5332058 5332042 5332037 -
ttaggggctcatggaattagac

SEQ ID NO: 125124 - DNA, 22 bp, Artificial Sequence
  Synthetic oligonucleotide; TTT chr11 5332036 5332057 5332041 5332036 -
taggggctcatggaattagact

SEQ ID NO: 125125 - DNA, 22 bp, Artificial Sequence
  Synthetic oligonucleotide; TTT chr11 5332035 5332056 5332040 5332035 -
aggggctcatggaattagacta

SEQ ID NO: 125126 - DNA, 22 bp, Artificial Sequence
  Synthetic oligonucleotide; TTA chr11 5332034 5332055 5332039 5332034 -
ggggctcatggaattagactag

SEQ ID NO: 125127 - DNA, 22 bp, Artificial Sequence
  Synthetic oligonucleotide; CTC chr11 5332027 5332048 5332032 5332027 -
atggaattagactaggttcccc

SEQ ID NO: 125128 - DNA, 22 bp, Artificial Sequence
  Synthetic oligonucleotide; TTA chr11 5332018 5332039 5332023 5332018 -
gactaggttcccctgagtaatt

SEQ ID NO: 125129 - DNA, 22 bp, Artificial Sequence
  Synthetic oligonucleotide; CTA chr11 5332013 5332034 5332018 5332013 -
ggttcccctgagtaatttcctt

SEQ ID NO: 125130 - DNA, 22 bp, Artificial Sequence
  Synthetic oligonucleotide; TTC chr11 5332008 5332029 5332013 5332008 -
ccctgagtaatttccttttcaa

SEQ ID NO: 125131 - DNA, 22 bp, Artificial Sequence
  Synthetic oligonucleotide; CTG chr11 5332003 5332024 5332008 5332003 -
agtaatttccttttcaattaac

SEQ ID NO: 125132 - DNA, 22 bp, Artificial Sequence
  Synthetic oligonucleotide; TTT chr11 5331995 5332016 5332000 5331995 -
ccttttcaattaactcaaagtc

SEQ ID NO: 125133 - DNA, 22 bp, Artificial Sequence
  Synthetic oligonucleotide; TTC chr11 5331994 5332015 5331999 5331994 -
cttttcaattaactcaaagtca

SEQ ID NO: 125134 - DNA, 22 bp, Artificial Sequence
  Synthetic oligonucleotide; CTT chr11 5331991 5332012 5331996 5331991 -
ttcaattaactcaaagtcaata

SEQ ID NO: 125135 - DNA, 22 bp, Artificial Sequence
  Synthetic oligonucleotide; TTT chr11 5331990 5332011 5331995 5331990 -
tcaattaactcaaagtcaatag

SEQ ID NO: 125136 - DNA, 22 bp, Artificial Sequence
  Synthetic oligonucleotide; TTT chr11 5331989 5332010 5331994 5331989 -
caattaactcaaagtcaataga

SEQ ID NO: 125137 - DNA, 22 bp, Artificial Sequence
  Synthetic oligonucleotide; TTC chr11 5331988 5332009 5331993 5331988 -
aattaactcaaagtcaatagat

SEQ ID NO: 125138 - DNA, 22 bp, Artificial Sequence
  Synthetic oligonucleotide; TTA chr11 5331983 5332004 5331988 5331983 -
actcaaagtcaatagatcagca

SEQ ID NO: 125139 - DNA, 22 bp, Artificial Sequence
  Synthetic oligonucleotide; CTC chr11 5331979 5332000 5331984 5331979 -
aaagtcaatagatcagcaactt

SEQ ID NO: 125140 - DNA, 22 bp, Artificial Sequence
  Synthetic oligonucleotide; CTT chr11 5331957 5331978 5331962 5331957 -
taattacatctgtataacccca

SEQ ID NO: 125141 - DNA, 22 bp, Artificial Sequence
  Synthetic oligonucleotide; TTT chr11 5331956 5331977 5331961 5331956 -
aattacatctgtataaccccaa

SEQ ID NO: 125142 - DNA, 22 bp, Artificial Sequence
  Synthetic oligonucleotide; TTA chr11 5331955 5331976 5331960 5331955 -
attacatctgtataaccccaag

SEQ ID NO: 125143 - DNA, 22 bp, Artificial Sequence
  Synthetic oligonucleotide; TTA chr11 5331951 5331972 5331956 5331951 -
catctgtataaccccaagcatg

SEQ ID NO: 125144 - DNA, 22 bp, Artificial Sequence
  Synthetic oligonucleotide; CTG chr11 5331945 5331966 5331950 5331945 -
tataaccccaagcatgatattg

SEQ ID NO: 125145 - DNA, 22 bp, Artificial Sequence
  Synthetic oligonucleotide; TTG chr11 5331923 5331944 5331928 5331923 -
tatcatattcacagtcctagaa

SEQ ID NO: 125146 - DNA, 22 bp, Artificial Sequence
  Synthetic oligonucleotide; TTC chr11 5331913 5331934 5331918 5331913 -
acagtcctagaaattaggatag

SEQ ID NO: 125147 - DNA, 22 bp, Artificial Sequence
  Synthetic oligonucleotide; CTA chr11 5331904 5331925 5331909 5331904 -
gaaattaggataggaaatcttg

SEQ ID NO: 125148 - DNA, 22 bp, Artificial Sequence
  Synthetic oligonucleotide; TTA chr11 5331897 5331918 5331902 5331897 -
ggataggaaatcttgtggtaga

SEQ ID NO: 125149 - DNA, 22 bp, Artificial Sequence
  Synthetic oligonucleotide; CTT chr11 5331883 5331904 5331888 5331883 -
gtggtagaaaggtttttaaaat

SEQ ID NO: 125150 - DNA, 22 bp, Artificial Sequence
  Synthetic oligonucleotide; TTG chr11 5331882 5331903 5331887 5331882 -
tggtagaaaggtttttaaaatt

SEQ ID NO: 125151 - DNA, 22 bp, Artificial Sequence
  Synthetic oligonucleotide; TTT chr11 5331868 5331889 5331873 5331868 -
ttaaaattatgcctatcacacc

SEQ ID NO: 125152 - DNA, 22 bp, Artificial Sequence
  Synthetic oligonucleotide; TTT chr11 5331867 5331888 5331872 5331867 -
taaaattatgcctatcacacca

SEQ ID NO: 125153 - DNA, 22 bp, Artificial Sequence
  Synthetic oligonucleotide; TTT chr11 5331866 5331887 5331871 5331866 -
aaaattatgcctatcacaccat

SEQ ID NO: 125154 - DNA, 22 bp, Artificial Sequence
  Synthetic oligonucleotide; TTA chr11 5331865 5331886 5331870 5331865 -
aaattatgcctatcacaccatt

SEQ ID NO: 125155 - DNA, 22 bp, Artificial Sequence
  Synthetic oligonucleotide; TTA chr11 5331859 5331880 5331864 5331859 -
tgcctatcacaccatttaaaaa

SEQ ID NO: 125156 - DNA, 22 bp, Artificial Sequence
  Synthetic oligonucleotide; CTA chr11 5331853 5331874 5331858 5331853 -
tcacaccatttaaaaaatagct

SEQ ID NO: 125157 - DNA, 22 bp, Artificial Sequence
  Synthetic oligonucleotide; TTT chr11 5331842 5331863 5331847 5331842 -
aaaaaatagctagtgagagagg

SEQ ID NO: 125158 - DNA, 22 bp, Artificial Sequence
  Synthetic oligonucleotide; TTA chr11 5331841 5331862 5331846 5331841 -
aaaaatagctagtgagagagga

SEQ ID NO: 125159 - DNA, 22 bp, Artificial Sequence
  Synthetic oligonucleotide; CTA chr11 5331830 5331851 5331835 5331830 -
gtgagagaggagactttctttt

SEQ ID NO: 125160 - DNA, 22 bp, Artificial Sequence
  Synthetic oligonucleotide; CTT chr11 5331814 5331835 5331819 5331814 -
tcttttccaatatatgtgttag

SEQ ID NO: 125161 - DNA, 22 bp, Artificial Sequence
  Synthetic oligonucleotide; TTT chr11 5331813 5331834 5331818 5331813 -
cttttccaatatatgtgttagt

SEQ ID NO: 125162 - DNA, 22 bp, Artificial Sequence
  Synthetic oligonucleotide; TTC chr11 5331812 5331833 5331817 5331812 -
ttttccaatatatgtgttagtt

SEQ ID NO: 125163 - DNA, 22 bp, Artificial Sequence
  Synthetic oligonucleotide; CTT chr11 5331810 5331831 5331815 5331810 -
ttccaatatatgtgttagtttt

SEQ ID NO: 125164 - DNA, 22 bp, Artificial Sequence
  Synthetic oligonucleotide; TTT chr11 5331809 5331830 5331814 5331809 -
tccaatatatgtgttagtttta

SEQ ID NO: 125165 - DNA, 22 bp, Artificial Sequence
  Synthetic oligonucleotide; TTT chr11 5331808 5331829 5331813 5331808 -
ccaatatatgtgttagttttaa

SEQ ID NO: 125166 - DNA, 22 bp, Artificial Sequence
  Synthetic oligonucleotide; TTC chr11 5331807 5331828 5331812 5331807 -
caatatatgtgttagttttaaa

SEQ ID NO: 125167 - DNA, 22 bp, Artificial Sequence
  Synthetic oligonucleotide; TTA chr11 5331793 5331814 5331798 5331793 -
gttttaaagtatgtgtgaaata

SEQ ID NO: 125168 - DNA, 22 bp, Artificial Sequence
  Synthetic oligonucleotide; TTT chr11 5331789 5331810 5331794 5331789 -
taaagtatgtgtgaaataattt

SEQ ID NO: 125169 - DNA, 22 bp, Artificial Sequence
  Synthetic oligonucleotide; TTT chr11 5331788 5331809 5331793 5331788 -
aaagtatgtgtgaaataatttt

SEQ ID NO: 125170 - DNA, 22 bp, Artificial Sequence
  Synthetic oligonucleotide; TTA chr11 5331787 5331808 5331792 5331787 -
aagtatgtgtgaaataattttt

SEQ ID NO: 125171 - DNA, 22 bp, Artificial Sequence
  Synthetic oligonucleotide; TTT chr11 5331767 5331788 5331772 5331767 -
ttattcttaacatttttttgat

SEQ ID NO: 125172 - DNA, 22 bp, Artificial Sequence
  Synthetic oligonucleotide; TTT chr11 5331766 5331787 5331771 5331766 -
tattcttaacatttttttgatg

SEQ ID NO: 125173 - DNA, 22 bp, Artificial Sequence
  Synthetic oligonucleotide; TTT chr11 5331765 5331786 5331770 5331765 -
attcttaacatttttttgatga

SEQ ID NO: 125174 - DNA, 22 bp, Artificial Sequence
  Synthetic oligonucleotide; TTA chr11 5331764 5331785 5331769 5331764 -
ttcttaacatttttttgatgaa

SEQ ID NO: 125175 - DNA, 22 bp, Artificial Sequence
  Synthetic oligonucleotide; TTC chr11 5331761 5331782 5331766 5331761 -
ttaacatttttttgatgaagca

SEQ ID NO: 125176 - DNA, 22 bp, Artificial Sequence
  Synthetic oligonucleotide; CTT chr11 5331759 5331780 5331764 5331759 -
aacatttttttgatgaagcaca

SEQ ID NO: 125177 - DNA, 22 bp, Artificial Sequence
  Synthetic oligonucleotide; TTA chr11 5331758 5331779 5331763 5331758 -
acatttttttgatgaagcacaa

SEQ ID NO: 125178 - DNA, 22 bp, Artificial Sequence
  Synthetic oligonucleotide; TTT chr11 5331752 5331773 5331757 5331752 -
ttttgatgaagcacaatgtctg

SEQ ID NO: 125179 - DNA, 22 bp, Artificial Sequence
  Synthetic oligonucleotide; TTT chr11 5331751 5331772 5331756 5331751 -
tttgatgaagcacaatgtctga

SEQ ID NO: 125180 - DNA, 22 bp, Artificial Sequence
  Synthetic oligonucleotide; TTT chr11 5331750 5331771 5331755 5331750 -
ttgatgaagcacaatgtctgaa

SEQ ID NO: 125181 - DNA, 22 bp, Artificial Sequence
  Synthetic oligonucleotide; TTT chr11 5331749 5331770 5331754 5331749 -
tgatgaagcacaatgtctgaaa

SEQ ID NO: 125182 - DNA, 22 bp, Artificial Sequence
  Synthetic oligonucleotide; TTT chr11 5331748 5331769 5331753 5331748 -
gatgaagcacaatgtctgaaag

SEQ ID NO: 125183 - DNA, 22 bp, Artificial Sequence
  Synthetic oligonucleotide; TTG chr11 5331747 5331768 5331752 5331747 -
atgaagcacaatgtctgaaagg

SEQ ID NO: 125184 - DNA, 22 bp, Artificial Sequence
  Synthetic oligonucleotide; CTG chr11 5331730 5331751 5331735 5331730 -
aaagggtggtagaaagcagctg

SEQ ID NO: 125185 - DNA, 22 bp, Artificial Sequence
  Synthetic oligonucleotide; CTG chr11 5331708 5331729 5331713 5331708 -
gagtcgaaactgaggatgaagt

SEQ ID NO: 125186 - DNA, 22 bp, Artificial Sequence
  Synthetic oligonucleotide; CTG chr11 5331696 5331717 5331701 5331696 -
aggatgaagtcgtatagtctag

SEQ ID NO: 125187 - DNA, 22 bp, Artificial Sequence
  Synthetic oligonucleotide; CTA chr11 5331675 5331696 5331680 5331675 -
gagctgtgctgtccaaaacagt

SEQ ID NO: 125188 - DNA, 22 bp, Artificial Sequence
  Synthetic oligonucleotide; CTG chr11 5331669 5331690 5331674 5331669 -
tgctgtccaaaacagtagcatc

SEQ ID NO: 125189 - DNA, 22 bp, Artificial Sequence
  Synthetic oligonucleotide; CTG chr11 5331664 5331685 5331669 5331664 -
tccaaaacagtagcatctggtt

SEQ ID NO: 125190 - DNA, 22 bp, Artificial Sequence
  Synthetic oligonucleotide; CTG chr11 5331645 5331666 5331650 5331645 -
gttagcttgagtcagaattttc

SEQ ID NO: 125191 - DNA, 22 bp, Artificial Sequence
  Synthetic oligonucleotide; TTA chr11 5331641 5331662 5331646 5331641 -
gcttgagtcagaattttctgta

SEQ ID NO: 125192 - DNA, 22 bp, Artificial Sequence
  Synthetic oligonucleotide; CTT chr11 5331637 5331658 5331642 5331637 -
gagtcagaattttctgtaagtg

SEQ ID NO: 125193 - DNA, 22 bp, Artificial Sequence
  Synthetic oligonucleotide; TTG chr11 5331636 5331657 5331641 5331636 -
agtcagaattttctgtaagtgt

SEQ ID NO: 125194 - DNA, 22 bp, Artificial Sequence
  Synthetic oligonucleotide; TTT chr11 5331625 5331646 5331630 5331625 -
tctgtaagtgtaaacactcgat

SEQ ID NO: 125195 - DNA, 22 bp, Artificial Sequence
  Synthetic oligonucleotide; TTT chr11 5331624 5331645 5331629 5331624 -
ctgtaagtgtaaacactcgatt

SEQ ID NO: 125196 - DNA, 22 bp, Artificial Sequence
  Synthetic oligonucleotide; TTC chr11 5331623 5331644 5331628 5331623 -
tgtaagtgtaaacactcgattt

SEQ ID NO: 125197 - DNA, 22 bp, Artificial Sequence
  Synthetic oligonucleotide; CTG chr11 5331621 5331642 5331626 5331621 -
taagtgtaaacactcgattttg

SEQ ID NO: 125198 - DNA, 22 bp, Artificial Sequence
  Synthetic oligonucleotide; CTC chr11 5331606 5331627 5331611 5331606 -
gattttgaagaatttgtaccaa

SEQ ID NO: 125199 - DNA, 22 bp, Artificial Sequence
  Synthetic oligonucleotide; TTT chr11 5331601 5331622 5331606 5331601 -
tgaagaatttgtaccaaaaaaa

SEQ ID NO: 125200 - DNA, 22 bp, Artificial Sequence
  Synthetic oligonucleotide; TTT chr11 5331600 5331621 5331605 5331600 -
gaagaatttgtaccaaaaaaaa

SEQ ID NO: 125201 - DNA, 22 bp, Artificial Sequence
  Synthetic oligonucleotide; TTG chr11 5331599 5331620 5331604 5331599 -
aagaatttgtaccaaaaaaaaa

SEQ ID NO: 125202 - DNA, 22 bp, Artificial Sequence
  Synthetic oligonucleotide; TTT chr11 5331591 5331612 5331596 5331591 -
gtaccaaaaaaaaatcgtggga

SEQ ID NO: 125203 - DNA, 22 bp, Artificial Sequence
  Synthetic oligonucleotide; TTG chr11 5331590 5331611 5331595 5331590 -
taccaaaaaaaaatcgtgggaa

SEQ ID NO: 125204 - DNA, 22 bp, Artificial Sequence
  Synthetic oligonucleotide; CTA chr11 5331565 5331586 5331570 5331565 -
tctcatatatgatttttatgct

SEQ ID NO: 125205 - DNA, 22 bp, Artificial Sequence
  Synthetic oligonucleotide; CTC chr11 5331561 5331582 5331566 5331561 -
atatatgatttttatgctgatt

SEQ ID NO: 125206 - DNA, 22 bp, Artificial Sequence
  Synthetic oligonucleotide; TTT chr11 5331550 5331571 5331555 5331550 -
ttatgctgattatctattaaaa

SEQ ID NO: 125207 - DNA, 22 bp, Artificial Sequence
  Synthetic oligonucleotide; TTT chr11 5331549 5331570 5331554 5331549 -
tatgctgattatctattaaaat

SEQ ID NO: 125208 - DNA, 22 bp, Artificial Sequence
  Synthetic oligonucleotide; TTT chr11 5331548 5331569 5331553 5331548 -
atgctgattatctattaaaatg

SEQ ID NO: 125209 - DNA, 22 bp, Artificial Sequence
  Synthetic oligonucleotide; TTA chr11 5331547 5331568 5331552 5331547 -
tgctgattatctattaaaatga

SEQ ID NO: 125210 - DNA, 22 bp, Artificial Sequence
  Synthetic oligonucleotide; CTG chr11 5331542 5331563 5331547 5331542 -
attatctattaaaatgataata

SEQ ID NO: 125211 - DNA, 22 bp, Artificial Sequence
  Synthetic oligonucleotide; TTA chr11 5331538 5331559 5331543 5331538 -
tctattaaaatgataatatttt

SEQ ID NO: 125212 - DNA, 22 bp, Artificial Sequence
  Synthetic oligonucleotide; CTA chr11 5331534 5331555 5331539 5331534 -
ttaaaatgataatatttttgat

SEQ ID NO: 125213 - DNA, 22 bp, Artificial Sequence
  Synthetic oligonucleotide; TTA chr11 5331531 5331552 5331536 5331531 -
aaatgataatatttttgatata

SEQ ID NO: 125214 - DNA, 22 bp, Artificial Sequence
  Synthetic oligonucleotide; TTT chr11 5331517 5331538 5331522 5331517 -
ttgatatagtagcttaaataag

SEQ ID NO: 125215 - DNA, 22 bp, Artificial Sequence
  Synthetic oligonucleotide; TTT chr11 5331516 5331537 5331521 5331516 -
tgatatagtagcttaaataaga

SEQ ID NO: 125216 - DNA, 22 bp, Artificial Sequence
  Synthetic oligonucleotide; TTT chr11 5331515 5331536 5331520 5331515 -
gatatagtagcttaaataagac

SEQ ID NO: 125217 - DNA, 22 bp, Artificial Sequence
  Synthetic oligonucleotide; TTG chr11 5331514 5331535 5331519 5331514 -
atatagtagcttaaataagaca

SEQ ID NO: 125218 - DNA, 22 bp, Artificial Sequence
  Synthetic oligonucleotide; CTT chr11 5331502 5331523 5331507 5331502 -
aaataagacatactaatattaa

SEQ ID NO: 125219 - DNA, 22 bp, Artificial Sequence
  Synthetic oligonucleotide; TTA chr11 5331501 5331522 5331506 5331501 -
aataagacatactaatattaat

SEQ ID NO: 125220 - DNA, 22 bp, Artificial Sequence
  Synthetic oligonucleotide; CTA chr11 5331487 5331508 5331492 5331487 -
atattaattttaccacttttct

SEQ ID NO: 125221 - DNA, 22 bp, Artificial Sequence
  Synthetic oligonucleotide; TTA chr11 5331481 5331502 5331486 5331481 -
attttaccacttttctttttac

SEQ ID NO: 125222 - DNA, 22 bp, Artificial Sequence
  Synthetic oligonucleotide; TTT chr11 5331477 5331498 5331482 5331477 -
taccacttttctttttactcct

SEQ ID NO: 125223 - DNA, 22 bp, Artificial Sequence
  Synthetic oligonucleotide; TTT chr11 5331476 5331497 5331481 5331476 -
accacttttctttttactcctt

SEQ ID NO: 125224 - DNA, 22 bp, Artificial Sequence
  Synthetic oligonucleotide; TTA chr11 5331475 5331496 5331480 5331475 -
ccacttttctttttactccttt

SEQ ID NO: 125225 - DNA, 22 bp, Artificial Sequence
  Synthetic oligonucleotide; CTT chr11 5331469 5331490 5331474 5331469 -
ttctttttactccttttaatgt

SEQ ID NO: 125226 - DNA, 22 bp, Artificial Sequence
  Synthetic oligonucleotide; TTT chr11 5331468 5331489 5331473 5331468 -
tctttttactccttttaatgtg

SEQ ID NO: 125227 - DNA, 22 bp, Artificial Sequence
  Synthetic oligonucleotide; TTT chr11 5331467 5331488 5331472 5331467 -
ctttttactccttttaatgtga

SEQ ID NO: 125228 - DNA, 22 bp, Artificial Sequence
  Synthetic oligonucleotide; TTC chr11 5331466 5331487 5331471 5331466 -
tttttactccttttaatgtgac

SEQ ID NO: 125229 - DNA, 22 bp, Artificial Sequence
  Synthetic oligonucleotide; CTT chr11 5331464 5331485 5331469 5331464 -
tttactccttttaatgtgacta

SEQ ID NO: 125230 - DNA, 22 bp, Artificial Sequence
  Synthetic oligonucleotide; TTT chr11 5331463 5331484 5331468 5331463 -
ttactccttttaatgtgactac

SEQ ID NO: 125231 - DNA, 22 bp, Artificial Sequence
  Synthetic oligonucleotide; TTT chr11 5331462 5331483 5331467 5331462 -
tactccttttaatgtgactacc

SEQ ID NO: 125232 - DNA, 22 bp, Artificial Sequence
  Synthetic oligonucleotide; TTT chr11 5331461 5331482 5331466 5331461 -
actccttttaatgtgactacca

SEQ ID NO: 125233 - DNA, 22 bp, Artificial Sequence
  Synthetic oligonucleotide; TTA chr11 5331460 5331481 5331465 5331460 -
ctccttttaatgtgactaccag

SEQ ID NO: 125234 - DNA, 22 bp, Artificial Sequence
  Synthetic oligonucleotide; CTC chr11 5331457 5331478 5331462 5331457 -
cttttaatgtgactaccagaac

SEQ ID NO: 125235 - DNA, 22 bp, Artificial Sequence
  Synthetic oligonucleotide; CTT chr11 5331454 5331475 5331459 5331454 -
ttaatgtgactaccagaacatt

SEQ ID NO: 125236 - DNA, 22 bp, Artificial Sequence
  Synthetic oligonucleotide; TTT chr11 5331453 5331474 5331458 5331453 -
taatgtgactaccagaacattt

SEQ ID NO: 125237 - DNA, 22 bp, Artificial Sequence
  Synthetic oligonucleotide; TTT chr11 5331452 5331473 5331457 5331452 -
aatgtgactaccagaacattta

SEQ ID NO: 125238 - DNA, 22 bp, Artificial Sequence
  Synthetic oligonucleotide; TTA chr11 5331451 5331472 5331456 5331451 -
atgtgactaccagaacatttaa

SEQ ID NO: 125239 - DNA, 22 bp, Artificial Sequence
  Synthetic oligonucleotide; CTA chr11 5331442 5331463 5331447 5331442 -
ccagaacatttaacatcacata

SEQ ID NO: 125240 - DNA, 22 bp, Artificial Sequence
  Synthetic oligonucleotide; TTT chr11 5331431 5331452 5331436 5331431 -
aacatcacatatttagctctaa

SEQ ID NO: 125241 - DNA, 22 bp, Artificial Sequence
  Synthetic oligonucleotide; TTA chr11 5331430 5331451 5331435 5331430 -
acatcacatatttagctctaat

SEQ ID NO: 125242 - DNA, 22 bp, Artificial Sequence
  Synthetic oligonucleotide; TTT chr11 5331417 5331438 5331422 5331417 -
agctctaattatatttccacca

SEQ ID NO: 125243 - DNA, 22 bp, Artificial Sequence
  Synthetic oligonucleotide; TTA chr11 5331416 5331437 5331421 5331416 -
gctctaattatatttccaccac

SEQ ID NO: 125244 - DNA, 22 bp, Artificial Sequence
  Synthetic oligonucleotide; CTC chr11 5331412 5331433 5331417 5331412 -
taattatatttccaccacatag

SEQ ID NO: 125245 - DNA, 22 bp, Artificial Sequence
  Synthetic oligonucleotide; CTA chr11 5331410 5331431 5331415 5331410 -
attatatttccaccacatagtg

SEQ ID NO: 125246 - DNA, 22 bp, Artificial Sequence
  Synthetic oligonucleotide; TTA chr11 5331406 5331427 5331411 5331406 -
tatttccaccacatagtgctgg

SEQ ID NO: 125247 - DNA, 22 bp, Artificial Sequence
  Synthetic oligonucleotide; TTT chr11 5331401 5331422 5331406 5331401 -
ccaccacatagtgctggtctag

SEQ ID NO: 125248 - DNA, 22 bp, Artificial Sequence
  Synthetic oligonucleotide; TTC chr11 5331400 5331421 5331405 5331400 -
caccacatagtgctggtctaga

SEQ ID NO: 125249 - DNA, 22 bp, Artificial Sequence
  Synthetic oligonucleotide; CTG chr11 5331385 5331406 5331390 5331385 -
gtctagagagctgttttgtttg

SEQ ID NO: 125250 - DNA, 22 bp, Artificial Sequence
  Synthetic oligonucleotide; CTA chr11 5331380 5331401 5331385 5331380 -
gagagctgttttgtttgtttgt

SEQ ID NO: 125251 - DNA, 22 bp, Artificial Sequence
  Synthetic oligonucleotide; CTG chr11 5331372 5331393 5331377 5331372 -
ttttgtttgtttgtttctcctc

SEQ ID NO: 125252 - DNA, 22 bp, Artificial Sequence
  Synthetic oligonucleotide; TTT chr11 5331369 5331390 5331374 5331369 -
tgtttgtttgtttctcctcagg

SEQ ID NO: 125253 - DNA, 22 bp, Artificial Sequence
  Synthetic oligonucleotide; TTT chr11 5331368 5331389 5331373 5331368 -
gtttgtttgtttctcctcaggt

SEQ ID NO: 125254 - DNA, 22 bp, Artificial Sequence
  Synthetic oligonucleotide; TTG chr11 5331367 5331388 5331372 5331367 -
tttgtttgtttctcctcaggta

SEQ ID NO: 125255 - DNA, 22 bp, Artificial Sequence
  Synthetic oligonucleotide; TTT chr11 5331364 5331385 5331369 5331364 -
gtttgtttctcctcaggtatcc

SEQ ID NO: 125256 - DNA, 22 bp, Artificial Sequence
  Synthetic oligonucleotide; TTG chr11 5331363 5331384 5331368 5331363 -
tttgtttctcctcaggtatcca

SEQ ID NO: 125257 - DNA, 22 bp, Artificial Sequence
  Synthetic oligonucleotide; TTT chr11 5331360 5331381 5331365 5331360 -
gtttctcctcaggtatccacca

SEQ ID NO: 125258 - DNA, 22 bp, Artificial Sequence
  Synthetic oligonucleotide; TTG chr11 5331359 5331380 5331364 5331359 -
tttctcctcaggtatccaccat

SEQ ID NO: 125259 - DNA, 22 bp, Artificial Sequence
  Synthetic oligonucleotide; TTT chr11 5331356 5331377 5331361 5331356 -
ctcctcaggtatccaccatgtc

SEQ ID NO: 125260 - DNA, 22 bp, Artificial Sequence
  Synthetic oligonucleotide; TTC chr11 5331355 5331376 5331360 5331355 -
tcctcaggtatccaccatgtca

SEQ ID NO: 125261 - DNA, 22 bp, Artificial Sequence
  Synthetic oligonucleotide; CTC chr11 5331353 5331374 5331358 5331353 -
ctcaggtatccaccatgtcacc

SEQ ID NO: 125262 - DNA, 22 bp, Artificial Sequence
  Synthetic oligonucleotide; CTC chr11 5331350 5331371 5331355 5331350 -
aggtatccaccatgtcacccac

SEQ ID NO: 125263 - DNA, 22 bp, Artificial Sequence
  Synthetic oligonucleotide; TTA chr11 5331323 5331344 5331328 5331323 -
ctgctgccccttttctcctcac

SEQ ID NO: 125264 - DNA, 22 bp, Artificial Sequence
  Synthetic oligonucleotide; CTG chr11 5331320 5331341 5331325 5331320 -
ctgccccttttctcctcactgg

SEQ ID NO: 125265 - DNA, 22 bp, Artificial Sequence
  Synthetic oligonucleotide; CTG chr11 5331317 5331338 5331322 5331317 -
ccccttttctcctcactggctt

SEQ ID NO: 125266 - DNA, 22 bp, Artificial Sequence
  Synthetic oligonucleotide; CTT chr11 5331311 5331332 5331316 5331311 -
ttctcctcactggctttccagg

SEQ ID NO: 125267 - DNA, 22 bp, Artificial Sequence
  Synthetic oligonucleotide; TTT chr11 5331310 5331331 5331315 5331310 -
tctcctcactggctttccaggt

SEQ ID NO: 125268 - DNA, 22 bp, Artificial Sequence
  Synthetic oligonucleotide; TTT chr11 5331309 5331330 5331314 5331309 -
ctcctcactggctttccaggtc

SEQ ID NO: 125269 - DNA, 22 bp, Artificial Sequence
  Synthetic oligonucleotide; TTC chr11 5331308 5331329 5331313 5331308 -
tcctcactggctttccaggtct

SEQ ID NO: 125270 - DNA, 22 bp, Artificial Sequence
  Synthetic oligonucleotide; CTC chr11 5331306 5331327 5331311 5331306 -
ctcactggctttccaggtctgg

SEQ ID NO: 125271 - DNA, 22 bp, Artificial Sequence
  Synthetic oligonucleotide; CTC chr11 5331303 5331324 5331308 5331303 -
actggctttccaggtctggaga

SEQ ID NO: 125272 - DNA, 22 bp, Artificial Sequence
  Synthetic oligonucleotide; CTG chr11 5331299 5331320 5331304 5331299 -
gctttccaggtctggagagatt

SEQ ID NO: 125273 - DNA, 22 bp, Artificial Sequence
  Synthetic oligonucleotide; CTT chr11 5331295 5331316 5331300 5331295 -
tccaggtctggagagatttcat

SEQ ID NO: 125274 - DNA, 22 bp, Artificial Sequence
  Synthetic oligonucleotide; TTT chr11 5331294 5331315 5331299 5331294 -
ccaggtctggagagatttcatc

SEQ ID NO: 125275 - DNA, 22 bp, Artificial Sequence
  Synthetic oligonucleotide; TTC chr11 5331293 5331314 5331298 5331293 -
caggtctggagagatttcatcc

SEQ ID NO: 125276 - DNA, 22 bp, Artificial Sequence
  Synthetic oligonucleotide; CTG chr11 5331285 5331306 5331290 5331285 -
gagagatttcatccttggagtt

SEQ ID NO: 125277 - DNA, 22 bp, Artificial Sequence
  Synthetic oligonucleotide; TTT chr11 5331276 5331297 5331281 5331276 -
catccttggagttctatctcct

SEQ ID NO: 125278 - DNA, 22 bp, Artificial Sequence
  Synthetic oligonucleotide; TTC chr11 5331275 5331296 5331280 5331275 -
atccttggagttctatctcctt

SEQ ID NO: 125279 - DNA, 22 bp, Artificial Sequence
  Synthetic oligonucleotide; CTT chr11 5331269 5331290 5331274 5331269 -
ggagttctatctccttctttat

SEQ ID NO: 125280 - DNA, 22 bp, Artificial Sequence
  Synthetic oligonucleotide; TTG chr11 5331268 5331289 5331273 5331268 -
gagttctatctccttctttatc

SEQ ID NO: 125281 - DNA, 22 bp, Artificial Sequence
  Synthetic oligonucleotide; TTC chr11 5331262 5331283 5331267 5331262 -
tatctccttctttatcatctat

SEQ ID NO: 125282 - DNA, 22 bp, Artificial Sequence
  Synthetic oligonucleotide; CTA chr11 5331260 5331281 5331265 5331260 -
tctccttctttatcatctatgt

SEQ ID NO: 125283 - DNA, 22 bp, Artificial Sequence
  Synthetic oligonucleotide; CTC chr11 5331256 5331277 5331261 5331256 -
cttctttatcatctatgtctct

SEQ ID NO: 125284 - DNA, 22 bp, Artificial Sequence
  Synthetic oligonucleotide; CTT chr11 5331253 5331274 5331258 5331253 -
ctttatcatctatgtctctaca

SEQ ID NO: 125285 - DNA, 22 bp, Artificial Sequence
  Synthetic oligonucleotide; TTC chr11 5331252 5331273 5331257 5331252 -
tttatcatctatgtctctacag

SEQ ID NO: 125286 - DNA, 22 bp, Artificial Sequence
  Synthetic oligonucleotide; CTT chr11 5331250 5331271 5331255 5331250 -
tatcatctatgtctctacagtc

SEQ ID NO: 125287 - DNA, 22 bp, Artificial Sequence
  Synthetic oligonucleotide; TTT chr11 5331249 5331270 5331254 5331249 -
atcatctatgtctctacagtcc

SEQ ID NO: 125288 - DNA, 22 bp, Artificial Sequence
  Synthetic oligonucleotide; TTA chr11 5331248 5331269 5331253 5331248 -
tcatctatgtctctacagtcct

SEQ ID NO: 125289 - DNA, 22 bp, Artificial Sequence
  Synthetic oligonucleotide; CTA chr11 5331241 5331262 5331246 5331241 -
tgtctctacagtccttggcaat

SEQ ID NO: 125290 - DNA, 22 bp, Artificial Sequence
  Synthetic oligonucleotide; CTC chr11 5331235 5331256 5331240 5331235 -
tacagtccttggcaatggcagc

SEQ ID NO: 125291 - DNA, 22 bp, Artificial Sequence
  Synthetic oligonucleotide; CTA chr11 5331233 5331254 5331238 5331233 -
cagtccttggcaatggcagcct

SEQ ID NO: 125292 - DNA, 22 bp, Artificial Sequence
  Synthetic oligonucleotide; CTT chr11 5331225 5331246 5331230 5331225 -
ggcaatggcagcctcctcctct

SEQ ID NO: 125293 - DNA, 22 bp, Artificial Sequence
  Synthetic oligonucleotide; TTG chr11 5331224 5331245 5331229 5331224 -
gcaatggcagcctcctcctctt

SEQ ID NO: 125294 - DNA, 22 bp, Artificial Sequence
  Synthetic oligonucleotide; CTC chr11 5331210 5331231 5331215 5331210 -
ctcctctttatcagagaagact

SEQ ID NO: 125295 - DNA, 22 bp, Artificial Sequence
  Synthetic oligonucleotide; CTC chr11 5331207 5331228 5331212 5331207 -
ctctttatcagagaagactgca

SEQ ID NO: 125296 - DNA, 22 bp, Artificial Sequence
  Synthetic oligonucleotide; CTC chr11 5331204 5331225 5331209 5331204 -
tttatcagagaagactgcactc

SEQ ID NO: 125297 - DNA, 22 bp, Artificial Sequence
  Synthetic oligonucleotide; CTT chr11 5331202 5331223 5331207 5331202 -
tatcagagaagactgcactctt

SEQ ID NO: 125298 - DNA, 22 bp, Artificial Sequence
  Synthetic oligonucleotide; TTT chr11 5331201 5331222 5331206 5331201 -
atcagagaagactgcactcttc

SEQ ID NO: 125299 - DNA, 22 bp, Artificial Sequence
  Synthetic oligonucleotide; TTA chr11 5331200 5331221 5331205 5331200 -
tcagagaagactgcactcttca

SEQ ID NO: 125300 - DNA, 22 bp, Artificial Sequence
  Synthetic oligonucleotide; CTG chr11 5331187 5331208 5331192 5331187 -
cactcttcatgagcccgtgtac

SEQ ID NO: 125301 - DNA, 22 bp, Artificial Sequence
  Synthetic oligonucleotide; CTC chr11 5331182 5331203 5331187 5331182 -
ttcatgagcccgtgtactactc

SEQ ID NO: 125302 - DNA, 22 bp, Artificial Sequence
  Synthetic oligonucleotide; CTT chr11 5331180 5331201 5331185 5331180 -
catgagcccgtgtactactctc

SEQ ID NO: 125303 - DNA, 22 bp, Artificial Sequence
  Synthetic oligonucleotide; TTC chr11 5331179 5331200 5331184 5331179 -
atgagcccgtgtactactctct

SEQ ID NO: 125304 - DNA, 22 bp, Artificial Sequence
  Synthetic oligonucleotide; CTA chr11 5331163 5331184 5331168 5331163 -
ctctctgactatactggcagcc

SEQ ID NO: 125305 - DNA, 22 bp, Artificial Sequence
  Synthetic oligonucleotide; CTC chr11 5331160 5331181 5331165 5331160 -
tctgactatactggcagccata

SEQ ID NO: 125306 - DNA, 22 bp, Artificial Sequence
  Synthetic oligonucleotide; CTC chr11 5331158 5331179 5331163 5331158 -
tgactatactggcagccataga

SEQ ID NO: 125307 - DNA, 22 bp, Artificial Sequence
  Synthetic oligonucleotide; CTG chr11 5331156 5331177 5331161 5331156 -
actatactggcagccatagacc

SEQ ID NO: 125308 - DNA, 22 bp, Artificial Sequence
  Synthetic oligonucleotide; CTA chr11 5331152 5331173 5331157 5331152 -
tactggcagccatagaccttgg

SEQ ID NO: 125309 - DNA, 22 bp, Artificial Sequence
  Synthetic oligonucleotide; CTG chr11 5331147 5331168 5331152 5331147 -
gcagccatagaccttggtgtaa

SEQ ID NO: 125310 - DNA, 22 bp, Artificial Sequence
  Synthetic oligonucleotide; CTT chr11 5331132 5331153 5331137 5331132 -
ggtgtaactttgacaacaatgt

SEQ ID NO: 125311 - DNA, 22 bp, Artificial Sequence
  Synthetic oligonucleotide; TTG chr11 5331131 5331152 5331136 5331131 -
gtgtaactttgacaacaatgtc

SEQ ID NO: 125312 - DNA, 22 bp, Artificial Sequence
  Synthetic oligonucleotide; CTT chr11 5331122 5331143 5331127 5331122 -
tgacaacaatgtccactgtcct

SEQ ID NO: 125313 - DNA, 22 bp, Artificial Sequence
  Synthetic oligonucleotide; TTT chr11 5331121 5331142 5331126 5331121 -
gacaacaatgtccactgtcctt

SEQ ID NO: 125314 - DNA, 22 bp, Artificial Sequence
  Synthetic oligonucleotide; TTG chr11 5331120 5331141 5331125 5331120 -
acaacaatgtccactgtccttg

SEQ ID NO: 125315 - DNA, 22 bp, Artificial Sequence
  Synthetic oligonucleotide; CTG chr11 5331104 5331125 5331109 5331104 -
tccttggtgttctctggctaga

SEQ ID NO: 125316 - DNA, 22 bp, Artificial Sequence
  Synthetic oligonucleotide; CTT chr11 5331099 5331120 5331104 5331099 -
ggtgttctctggctagatcaca

SEQ ID NO: 125317 - DNA, 22 bp, Artificial Sequence
  Synthetic oligonucleotide; TTG chr11 5331098 5331119 5331103 5331098 -
gtgttctctggctagatcacag

SEQ ID NO: 125318 - DNA, 22 bp, Artificial Sequence
  Synthetic oligonucleotide; TTC chr11 5331092 5331113 5331097 5331092 -
tctggctagatcacaggaaaat

SEQ ID NO: 125319 - DNA, 22 bp, Artificial Sequence
  Synthetic oligonucleotide; CTC chr11 5331090 5331111 5331095 5331090 -
tggctagatcacaggaaaatga

SEQ ID NO: 125320 - DNA, 22 bp, Artificial Sequence
  Synthetic oligonucleotide; CTG chr11 5331088 5331109 5331093 5331088 -
gctagatcacaggaaaatgagc

SEQ ID NO: 125321 - DNA, 22 bp, Artificial Sequence
  Synthetic oligonucleotide; CTA chr11 5331084 5331105 5331089 5331084 -
gatcacaggaaaatgagccatg

SEQ ID NO: 125322 - DNA, 22 bp, Artificial Sequence
  Synthetic oligonucleotide; CTG chr11 5331055 5331076 5331060 5331055 -
cttcctccaggcctatctaatc

SEQ ID NO: 125323 - DNA, 22 bp, Artificial Sequence
  Synthetic oligonucleotide; CTT chr11 5331052 5331073 5331057 5331052 -
cctccaggcctatctaatccac

SEQ ID NO: 125324 - DNA, 22 bp, Artificial Sequence
  Synthetic oligonucleotide; TTC chr11 5331051 5331072 5331056 5331051 -
ctccaggcctatctaatccact

SEQ ID NO: 125325 - DNA, 22 bp, Artificial Sequence
  Synthetic oligonucleotide; CTC chr11 5331048 5331069 5331053 5331048 -
caggcctatctaatccactccc

SEQ ID NO: 125326 - DNA, 22 bp, Artificial Sequence
  Synthetic oligonucleotide; CTA chr11 5331040 5331061 5331045 5331040 -
tctaatccactccctctctatc

SEQ ID NO: 125327 - DNA, 22 bp, Artificial Sequence
  Synthetic oligonucleotide; CTA chr11 5331036 5331057 5331041 5331036 -
atccactccctctctatcgtgg

SEQ ID NO: 125328 - DNA, 22 bp, Artificial Sequence
  Synthetic oligonucleotide; CTC chr11 5331028 5331049 5331033 5331028 -
cctctctatcgtggagtccaga

SEQ ID NO: 125329 - DNA, 22 bp, Artificial Sequence
  Synthetic oligonucleotide; CTC chr11 5331024 5331045 5331029 5331024 -
tctatcgtggagtccagagtgt

SEQ ID NO: 125330 - DNA, 22 bp, Artificial Sequence
  Synthetic oligonucleotide; CTC chr11 5331022 5331043 5331027 5331022 -
tatcgtggagtccagagtgttg

SEQ ID NO: 125331 - DNA, 22 bp, Artificial Sequence
  Synthetic oligonucleotide; CTA chr11 5331020 5331041 5331025 5331020 -
tcgtggagtccagagtgttgct

SEQ ID NO: 125332 - DNA, 22 bp, Artificial Sequence
  Synthetic oligonucleotide; TTG chr11 5331000 5331021 5331005 5331000 -
ctcatcatggcccatgactgtt

SEQ ID NO: 125333 - DNA, 22 bp, Artificial Sequence
  Synthetic oligonucleotide; CTC chr11 5330997 5331018 5331002 5330997 -
atcatggcccatgactgtttta

SEQ ID NO: 125334 - DNA, 22 bp, Artificial Sequence
  Synthetic oligonucleotide; CTG chr11 5330980 5331001 5330985 5330980 -
ttttattggcatccataatccc

SEQ ID NO: 125335 - DNA, 22 bp, Artificial Sequence
  Synthetic oligonucleotide; TTT chr11 5330977 5330998 5330982 5330977 -
tattggcatccataatcccctg

SEQ ID NO: 125336 - DNA, 22 bp, Artificial Sequence
  Synthetic oligonucleotide; TTT chr11 5330976 5330997 5330981 5330976 -
attggcatccataatcccctga

SEQ ID NO: 125337 - DNA, 22 bp, Artificial Sequence
  Synthetic oligonucleotide; TTA chr11 5330975 5330996 5330980 5330975 -
ttggcatccataatcccctgag

SEQ ID NO: 125338 - DNA, 22 bp, Artificial Sequence
  Synthetic oligonucleotide; TTG chr11 5330972 5330993 5330977 5330972 -
gcatccataatcccctgagata

SEQ ID NO: 125339 - DNA, 22 bp, Artificial Sequence
  Synthetic oligonucleotide; CTG chr11 5330955 5330976 5330960 5330955 -
agatacacctccattctcacca

SEQ ID NO: 125340 - DNA, 22 bp, Artificial Sequence
  Synthetic oligonucleotide; CTC chr11 5330944 5330965 5330949 5330944 -
cattctcaccaatgctaaggtg

SEQ ID NO: 125341 - DNA, 22 bp, Artificial Sequence
  Synthetic oligonucleotide; TTC chr11 5330939 5330960 5330944 5330939 -
tcaccaatgctaaggtggtgaa

SEQ ID NO: 125342 - DNA, 22 bp, Artificial Sequence
  Synthetic oligonucleotide; CTC chr11 5330937 5330958 5330942 5330937 -
accaatgctaaggtggtgaaga

SEQ ID NO: 125343 - DNA, 22 bp, Artificial Sequence
  Synthetic oligonucleotide; CTA chr11 5330927 5330948 5330932 5330927 -
aggtggtgaagatagatctggg

SEQ ID NO: 125344 - DNA, 22 bp, Artificial Sequence
  Synthetic oligonucleotide; CTG chr11 5330907 5330928 5330912 5330907 -
ggggttcaaatgaggggatttg

SEQ ID NO: 125345 - DNA, 22 bp, Artificial Sequence
  Synthetic oligonucleotide; TTC chr11 5330900 5330921 5330905 5330900 -
aaatgaggggatttgttatgct

SEQ ID NO: 125346 - DNA, 22 bp, Artificial Sequence
  Synthetic oligonucleotide; TTT chr11 5330886 5330907 5330891 5330886 -
gttatgctaattgtgcccataa

SEQ ID NO: 125347 - DNA, 22 bp, Artificial Sequence
  Synthetic oligonucleotide; TTG chr11 5330885 5330906 5330890 5330885 -
ttatgctaattgtgcccataat

SEQ ID NO: 125348 - DNA, 22 bp, Artificial Sequence
  Synthetic oligonucleotide; TTA chr11 5330882 5330903 5330887 5330882 -
tgctaattgtgcccataatcat

SEQ ID NO: 125349 - DNA, 22 bp, Artificial Sequence
  Synthetic oligonucleotide; CTA chr11 5330877 5330898 5330882 5330877 -
attgtgcccataatcatcaccc

SEQ ID NO: 125350 - DNA, 22 bp, Artificial Sequence
  Synthetic oligonucleotide; TTG chr11 5330873 5330894 5330878 5330873 -
tgcccataatcatcaccctctc

SEQ ID NO: 125351 - DNA, 22 bp, Artificial Sequence
  Synthetic oligonucleotide; CTC chr11 5330853 5330874 5330858 5330853 -
tctggattcccctactgtcaat

SEQ ID NO: 125352 - DNA, 22 bp, Artificial Sequence
  Synthetic oligonucleotide; CTC chr11 5330851 5330872 5330856 5330851 -
tggattcccctactgtcaatcc

SEQ ID NO: 125353 - DNA, 22 bp, Artificial Sequence
  Synthetic oligonucleotide; CTG chr11 5330849 5330870 5330854 5330849 -
gattcccctactgtcaatccca

SEQ ID NO: 125354 - DNA, 22 bp, Artificial Sequence
  Synthetic oligonucleotide; TTC chr11 5330844 5330865 5330849 5330844 -
ccctactgtcaatcccatgtcc

SEQ ID NO: 125355 - DNA, 22 bp, Artificial Sequence
  Synthetic oligonucleotide; CTA chr11 5330839 5330860 5330844 5330839 -
ctgtcaatcccatgtcctctcc

SEQ ID NO: 125356 - DNA, 22 bp, Artificial Sequence
  Synthetic oligonucleotide; CTG chr11 5330836 5330857 5330841 5330836 -
tcaatcccatgtcctctcccat

SEQ ID NO: 125357 - DNA, 22 bp, Artificial Sequence
  Synthetic oligonucleotide; CTC chr11 5330820 5330841 5330825 5330820 -
tcccatgctttctgcctgcacc

SEQ ID NO: 125358 - DNA, 22 bp, Artificial Sequence
  Synthetic oligonucleotide; CTC chr11 5330818 5330839 5330823 5330818 -
ccatgctttctgcctgcaccag

SEQ ID NO: 125359 - DNA, 22 bp, Artificial Sequence
  Synthetic oligonucleotide; CTT chr11 5330810 5330831 5330815 5330810 -
tctgcctgcaccagatgtgatc

SEQ ID NO: 125360 - DNA, 22 bp, Artificial Sequence
  Synthetic oligonucleotide; TTT chr11 5330809 5330830 5330814 5330809 -
ctgcctgcaccagatgtgatca

SEQ ID NO: 125361 - DNA, 22 bp, Artificial Sequence
  Synthetic oligonucleotide; TTC chr11 5330808 5330829 5330813 5330808 -
tgcctgcaccagatgtgatcaa

SEQ ID NO: 125362 - DNA, 22 bp, Artificial Sequence
  Synthetic oligonucleotide; CTG chr11 5330806 5330827 5330811 5330806 -
cctgcaccagatgtgatcaaac

SEQ ID NO: 125363 - DNA, 22 bp, Artificial Sequence
  Synthetic oligonucleotide; CTG chr11 5330802 5330823 5330807 5330802 -
caccagatgtgatcaaactggc

SEQ ID NO: 125364 - DNA, 22 bp, Artificial Sequence
  Synthetic oligonucleotide; CTG chr11 5330782 5330803 5330787 5330782 -
gcctgtgcagacatcaccttta

SEQ ID NO: 125365 - DNA, 22 bp, Artificial Sequence
  Synthetic oligonucleotide; CTG chr11 5330777 5330798 5330782 5330777 -
tgcagacatcacctttaataga

SEQ ID NO: 125366 - DNA, 22 bp, Artificial Sequence
  Synthetic oligonucleotide; CTT chr11 5330762 5330783 5330767 5330762 -
taatagactttatcctatagtc

SEQ ID NO: 125367 - DNA, 22 bp, Artificial Sequence
  Synthetic oligonucleotide; TTT chr11 5330761 5330782 5330766 5330761 -
aatagactttatcctatagtcc

SEQ ID NO: 125368 - DNA, 22 bp, Artificial Sequence
  Synthetic oligonucleotide; TTA chr11 5330760 5330781 5330765 5330760 -
atagactttatcctatagtcct

SEQ ID NO: 125369 - DNA, 22 bp, Artificial Sequence
  Synthetic oligonucleotide; CTT chr11 5330752 5330773 5330757 5330752 -
tatcctatagtcctggtctcat

SEQ ID NO: 125370 - DNA, 22 bp, Artificial Sequence
  Synthetic oligonucleotide; TTT chr11 5330751 5330772 5330756 5330751 -
atcctatagtcctggtctcatc

SEQ ID NO: 125371 - DNA, 22 bp, Artificial Sequence
  Synthetic oligonucleotide; TTA chr11 5330750 5330771 5330755 5330750 -
tcctatagtcctggtctcatca

SEQ ID NO: 125372 - DNA, 22 bp, Artificial Sequence
  Synthetic oligonucleotide; CTA chr11 5330745 5330766 5330750 5330745 -
tagtcctggtctcatcaactgg

SEQ ID NO: 125373 - DNA, 22 bp, Artificial Sequence
  Synthetic oligonucleotide; CTG chr11 5330737 5330758 5330742 5330737 -
gtctcatcaactggtttcttgg

SEQ ID NO: 125374 - DNA, 22 bp, Artificial Sequence
  Synthetic oligonucleotide; CTC chr11 5330732 5330753 5330737 5330732 -
atcaactggtttcttggacttt

SEQ ID NO: 125375 - DNA, 22 bp, Artificial Sequence
  Synthetic oligonucleotide; CTG chr11 5330724 5330745 5330729 5330724 -
gtttcttggactttgtgcttat

SEQ ID NO: 125376 - DNA, 22 bp, Artificial Sequence
  Synthetic oligonucleotide; TTT chr11 5330720 5330741 5330725 5330720 -
cttggactttgtgcttatcctt

SEQ ID NO: 125377 - DNA, 22 bp, Artificial Sequence
  Synthetic oligonucleotide; TTC chr11 5330719 5330740 5330724 5330719 -
ttggactttgtgcttatcctta

SEQ ID NO: 125378 - DNA, 22 bp, Artificial Sequence
  Synthetic oligonucleotide; CTT chr11 5330717 5330738 5330722 5330717 -
ggactttgtgcttatccttatc

SEQ ID NO: 125379 - DNA, 22 bp, Artificial Sequence
  Synthetic oligonucleotide; TTG chr11 5330716 5330737 5330721 5330716 -
gactttgtgcttatccttatct

SEQ ID NO: 125380 - DNA, 22 bp, Artificial Sequence
  Synthetic oligonucleotide; CTT chr11 5330711 5330732 5330716 5330711 -
tgtgcttatccttatctcttac

SEQ ID NO: 125381 - DNA, 22 bp, Artificial Sequence
  Synthetic oligonucleotide; TTT chr11 5330710 5330731 5330715 5330710 -
gtgcttatccttatctcttaca

SEQ ID NO: 125382 - DNA, 22 bp, Artificial Sequence
  Synthetic oligonucleotide; TTG chr11 5330709 5330730 5330714 5330709 -
tgcttatccttatctcttacat

SEQ ID NO: 125383 - DNA, 22 bp, Artificial Sequence
  Synthetic oligonucleotide; CTT chr11 5330704 5330725 5330709 5330704 -
atccttatctcttacattctga

SEQ ID NO: 125384 - DNA, 22 bp, Artificial Sequence
  Synthetic oligonucleotide; TTA chr11 5330703 5330724 5330708 5330703 -
tccttatctcttacattctgat

SEQ ID NO: 125385 - DNA, 22 bp, Artificial Sequence
  Synthetic oligonucleotide; CTT chr11 5330698 5330719 5330703 5330698 -
atctcttacattctgatcctta

SEQ ID NO: 125386 - DNA, 22 bp, Artificial Sequence
  Synthetic oligonucleotide; TTA chr11 5330697 5330718 5330702 5330697 -
tctcttacattctgatccttaa

SEQ ID NO: 125387 - DNA, 22 bp, Artificial Sequence
  Synthetic oligonucleotide; CTC chr11 5330693 5330714 5330698 5330693 -
ttacattctgatccttaagaag

SEQ ID NO: 125388 - DNA, 22 bp, Artificial Sequence
  Synthetic oligonucleotide; CTT chr11 5330691 5330712 5330696 5330691 -
acattctgatccttaagaaggt

SEQ ID NO: 125389 - DNA, 22 bp, Artificial Sequence
  Synthetic oligonucleotide; TTA chr11 5330690 5330711 5330695 5330690 -
cattctgatccttaagaaggtc

SEQ ID NO: 125390 - DNA, 22 bp, Artificial Sequence
  Synthetic oligonucleotide; TTC chr11 5330685 5330706 5330690 5330685 -
tgatccttaagaaggtcatggg

SEQ ID NO: 125391 - DNA, 22 bp, Artificial Sequence
  Synthetic oligonucleotide; CTG chr11 5330683 5330704 5330688 5330683 -
atccttaagaaggtcatgggaa

SEQ ID NO: 125392 - DNA, 22 bp, Artificial Sequence
  Synthetic oligonucleotide; CTT chr11 5330677 5330698 5330682 5330677 -
aagaaggtcatgggaattgcct

SEQ ID NO: 125393 - DNA, 22 bp, Artificial Sequence
  Synthetic oligonucleotide; TTA chr11 5330676 5330697 5330681 5330676 -
agaaggtcatgggaattgcctc

SEQ ID NO: 125394 - DNA, 22 bp, Artificial Sequence
  Synthetic oligonucleotide; TTG chr11 5330658 5330679 5330663 5330658 -
cctcagacaaggagcagactaa

SEQ ID NO: 125395 - DNA, 22 bp, Artificial Sequence
  Synthetic oligonucleotide; CTC chr11 5330654 5330675 5330659 5330654 -
agacaaggagcagactaaggcc

SEQ ID NO: 125396 - DNA, 22 bp, Artificial Sequence
  Synthetic oligonucleotide; CTA chr11 5330637 5330658 5330642 5330637 -
aggccctaaatacttgtatttc

SEQ ID NO: 125397 - DNA, 22 bp, Artificial Sequence
  Synthetic oligonucleotide; CTA chr11 5330629 5330650 5330634 5330629 -
aatacttgtatttctcacatta

SEQ ID NO: 125398 - DNA, 22 bp, Artificial Sequence
  Synthetic oligonucleotide; CTT chr11 5330622 5330643 5330627 5330622 -
gtatttctcacattagctgtgt

SEQ ID NO: 125399 - DNA, 22 bp, Artificial Sequence
  Synthetic oligonucleotide; TTG chr11 5330621 5330642 5330626 5330621 -
tatttctcacattagctgtgtt

SEQ ID NO: 125400 - DNA, 22 bp, Artificial Sequence
  Synthetic oligonucleotide; TTT chr11 5330616 5330637 5330621 5330616 -
ctcacattagctgtgttctggt

SEQ ID NO: 125401 - DNA, 22 bp, Artificial Sequence
  Synthetic oligonucleotide; TTC chr11 5330615 5330636 5330620 5330615 -
tcacattagctgtgttctggtt

SEQ ID NO: 125402 - DNA, 22 bp, Artificial Sequence
  Synthetic oligonucleotide; CTC chr11 5330613 5330634 5330618 5330613 -
acattagctgtgttctggtttt

SEQ ID NO: 125403 - DNA, 22 bp, Artificial Sequence
  Synthetic oligonucleotide; TTA chr11 5330607 5330628 5330612 5330607 -
gctgtgttctggtttttaatgt

SEQ ID NO: 125404 - DNA, 22 bp, Artificial Sequence
  Synthetic oligonucleotide; CTG chr11 5330603 5330624 5330608 5330603 -
tgttctggtttttaatgtcact

SEQ ID NO: 125405 - DNA, 22 bp, Artificial Sequence
  Synthetic oligonucleotide; TTC chr11 5330598 5330619 5330603 5330598 -
tggtttttaatgtcacttgatt

SEQ ID NO: 125406 - DNA, 22 bp, Artificial Sequence
  Synthetic oligonucleotide; CTG chr11 5330596 5330617 5330601 5330596 -
gtttttaatgtcacttgattgg

SEQ ID NO: 125407 - DNA, 22 bp, Artificial Sequence
  Synthetic oligonucleotide; TTT chr11 5330592 5330613 5330597 5330592 -
ttaatgtcacttgattgggcta

SEQ ID NO: 125408 - DNA, 22 bp, Artificial Sequence
  Synthetic oligonucleotide; TTT chr11 5330591 5330612 5330596 5330591 -
taatgtcacttgattgggctac

SEQ ID NO: 125409 - DNA, 22 bp, Artificial Sequence
  Synthetic oligonucleotide; TTT chr11 5330590 5330611 5330595 5330590 -
aatgtcacttgattgggctacc

SEQ ID NO: 125410 - DNA, 22 bp, Artificial Sequence
  Synthetic oligonucleotide; TTA chr11 5330589 5330610 5330594 5330589 -
atgtcacttgattgggctacca

SEQ ID NO: 125411 - DNA, 22 bp, Artificial Sequence
  Synthetic oligonucleotide; CTT chr11 5330580 5330601 5330585 5330580 -
gattgggctaccaccctttcag

SEQ ID NO: 125412 - DNA, 22 bp, Artificial Sequence
  Synthetic oligonucleotide; TTG chr11 5330579 5330600 5330584 5330579 -
attgggctaccaccctttcaga

SEQ ID NO: 125413 - DNA, 22 bp, Artificial Sequence
  Synthetic oligonucleotide; TTG chr11 5330575 5330596 5330580 5330575 -
ggctaccaccctttcagacact

SEQ ID NO: 125414 - DNA, 22 bp, Artificial Sequence
  Synthetic oligonucleotide; CTA chr11 5330570 5330591 5330575 5330570 -
ccaccctttcagacactgtgct

SEQ ID NO: 125415 - DNA, 22 bp, Artificial Sequence
  Synthetic oligonucleotide; CTT chr11 5330562 5330583 5330567 5330562 -
tcagacactgtgcttcatcaaa

SEQ ID NO: 125416 - DNA, 22 bp, Artificial Sequence
  Synthetic oligonucleotide; TTT chr11 5330561 5330582 5330566 5330561 -
cagacactgtgcttcatcaaaa

SEQ ID NO: 125417 - DNA, 22 bp, Artificial Sequence
  Synthetic oligonucleotide; TTC chr11 5330560 5330581 5330565 5330560 -
agacactgtgcttcatcaaaaa

SEQ ID NO: 125418 - DNA, 22 bp, Artificial Sequence
  Synthetic oligonucleotide; CTG chr11 5330552 5330573 5330557 5330552 -
tgcttcatcaaaaaaatgttaa

SEQ ID NO: 125419 - DNA, 22 bp, Artificial Sequence
  Synthetic oligonucleotide; CTT chr11 5330547 5330568 5330552 5330547 -
catcaaaaaaatgttaagaata

SEQ ID NO: 125420 - DNA, 22 bp, Artificial Sequence
  Synthetic oligonucleotide; TTC chr11 5330546 5330567 5330551 5330546 -
atcaaaaaaatgttaagaataa

SEQ ID NO: 125421 - DNA, 22 bp, Artificial Sequence
  Synthetic oligonucleotide; TTA chr11 5330531 5330552 5330536 5330531 -
agaataaaaattatttcacaca

SEQ ID NO: 125422 - DNA, 22 bp, Artificial Sequence
  Synthetic oligonucleotide; TTA chr11 5330518 5330539 5330523 5330518 -
tttcacacatactttaaaacta

SEQ ID NO: 125423 - DNA, 22 bp, Artificial Sequence
  Synthetic oligonucleotide; TTT chr11 5330515 5330536 5330520 5330515 -
cacacatactttaaaactaaca

SEQ ID NO: 125424 - DNA, 22 bp, Artificial Sequence
  Synthetic oligonucleotide; TTC chr11 5330514 5330535 5330519 5330514 -
acacatactttaaaactaacac

SEQ ID NO: 125425 - DNA, 22 bp, Artificial Sequence
  Synthetic oligonucleotide; CTT chr11 5330504 5330525 5330509 5330504 -
taaaactaacacgtcacaatgc

SEQ ID NO: 125426 - DNA, 22 bp, Artificial Sequence
  Synthetic oligonucleotide; TTT chr11 5330503 5330524 5330508 5330503 -
aaaactaacacgtcacaatgca

SEQ ID NO: 125427 - DNA, 22 bp, Artificial Sequence
  Synthetic oligonucleotide; TTA chr11 5330502 5330523 5330507 5330502 -
aaactaacacgtcacaatgcaa

SEQ ID NO: 125428 - DNA, 22 bp, Artificial Sequence
  Synthetic oligonucleotide; CTA chr11 5330496 5330517 5330501 5330496 -
acacgtcacaatgcaaatcaaa

SEQ ID NO: 125429 - DNA, 22 bp, Artificial Sequence
  Synthetic oligonucleotide; CTC chr11 5330453 5330474 5330458 5330453 -
acaccagttagaatggcaatca

SEQ ID NO: 125430 - DNA, 22 bp, Artificial Sequence
  Synthetic oligonucleotide; TTA chr11 5330443 5330464 5330448 5330443 -
gaatggcaatcattaaaaagtc

SEQ ID NO: 125431 - DNA, 22 bp, Artificial Sequence
  Synthetic oligonucleotide; TTA chr11 5330428 5330449 5330433 5330428 -
aaaagtcagggaacaacaggtg

SEQ ID NO: 125432 - DNA, 22 bp, Artificial Sequence
  Synthetic oligonucleotide; CTG chr11 5330403 5330424 5330408 5330403 -
gagaggatgtggagaaatagga

SEQ ID NO: 125433 - DNA, 22 bp, Artificial Sequence
  Synthetic oligonucleotide; CTT chr11 5330375 5330396 5330380 5330375 -
ttacactcttggtgggactgta

SEQ ID NO: 125434 - DNA, 22 bp, Artificial Sequence
  Synthetic oligonucleotide; TTT chr11 5330374 5330395 5330379 5330374 -
tacactcttggtgggactgtaa

SEQ ID NO: 125435 - DNA, 22 bp, Artificial Sequence
  Synthetic oligonucleotide; TTT chr11 5330373 5330394 5330378 5330373 -
acactcttggtgggactgtaaa

SEQ ID NO: 125436 - DNA, 22 bp, Artificial Sequence
  Synthetic oligonucleotide; TTA chr11 5330372 5330393 5330377 5330372 -
cactcttggtgggactgtaaac

SEQ ID NO: 125437 - DNA, 22 bp, Artificial Sequence
  Synthetic oligonucleotide; CTC chr11 5330367 5330388 5330372 5330367 -
ttggtgggactgtaaactagtt

SEQ ID NO: 125438 - DNA, 22 bp, Artificial Sequence
  Synthetic oligonucleotide; CTT chr11 5330365 5330386 5330370 5330365 -
ggtgggactgtaaactagttca

SEQ ID NO: 125439 - DNA, 22 bp, Artificial Sequence
  Synthetic oligonucleotide; TTG chr11 5330364 5330385 5330369 5330364 -
gtgggactgtaaactagttcaa

SEQ ID NO: 125440 - DNA, 22 bp, Artificial Sequence
  Synthetic oligonucleotide; CTG chr11 5330355 5330376 5330360 5330355 -
taaactagttcaaccattgtgg

SEQ ID NO: 125441 - DNA, 22 bp, Artificial Sequence
  Synthetic oligonucleotide; CTA chr11 5330348 5330369 5330353 5330348 -
gttcaaccattgtggaagtcag

SEQ ID NO: 125442 - DNA, 22 bp, Artificial Sequence
  Synthetic oligonucleotide; TTC chr11 5330344 5330365 5330349 5330344 -
aaccattgtggaagtcagtgtg

SEQ ID NO: 125443 - DNA, 22 bp, Artificial Sequence
  Synthetic oligonucleotide; TTG chr11 5330336 5330357 5330341 5330336 -
tggaagtcagtgtggcgattcc

SEQ ID NO: 125444 - DNA, 22 bp, Artificial Sequence
  Synthetic oligonucleotide; TTC chr11 5330315 5330336 5330320 5330315 -
ctcagggatctagaactagaaa

SEQ ID NO: 125445 - DNA, 22 bp, Artificial Sequence
  Synthetic oligonucleotide; CTC chr11 5330312 5330333 5330317 5330312 -
agggatctagaactagaaatac

SEQ ID NO: 125446 - DNA, 22 bp, Artificial Sequence
  Synthetic oligonucleotide; CTA chr11 5330303 5330324 5330308 5330303 -
gaactagaaataccatttgacc

SEQ ID NO: 125447 - DNA, 22 bp, Artificial Sequence
  Synthetic oligonucleotide; CTA chr11 5330297 5330318 5330302 5330297 -
gaaataccatttgacccagcca

SEQ ID NO: 125448 - DNA, 22 bp, Artificial Sequence
  Synthetic oligonucleotide; TTT chr11 5330285 5330306 5330290 5330285 -
gacccagccatcccattactgg

SEQ ID NO: 125449 - DNA, 22 bp, Artificial Sequence
  Synthetic oligonucleotide; TTG chr11 5330284 5330305 5330289 5330284 -
acccagccatcccattactggg

SEQ ID NO: 125450 - DNA, 22 bp, Artificial Sequence
  Synthetic oligonucleotide; TTA chr11 5330267 5330288 5330272 5330267 -
ctgggtatatacccaacggatt

SEQ ID NO: 125451 - DNA, 22 bp, Artificial Sequence
  Synthetic oligonucleotide; CTG chr11 5330264 5330285 5330269 5330264 -
ggtatatacccaacggattata

SEQ ID NO: 125452 - DNA, 22 bp, Artificial Sequence
  Synthetic oligonucleotide; TTA chr11 5330244 5330265 5330249 5330244 -
taaatcatgctgctataaagac

SEQ ID NO: 125453 - DNA, 22 bp, Artificial Sequence
  Synthetic oligonucleotide; CTG chr11 5330232 5330253 5330237 5330232 -
ctataaagacacatgcacacgt

SEQ ID NO: 125454 - DNA, 22 bp, Artificial Sequence
  Synthetic oligonucleotide; CTA chr11 5330229 5330250 5330234 5330229 -
taaagacacatgcacacgtatg

SEQ ID NO: 125455 - DNA, 22 bp, Artificial Sequence
  Synthetic oligonucleotide; TTT chr11 5330204 5330225 5330209 5330204 -
actgtggcactattcacaatag

SEQ ID NO: 125456 - DNA, 22 bp, Artificial Sequence
  Synthetic oligonucleotide; TTA chr11 5330203 5330224 5330208 5330203 -
ctgtggcactattcacaatagc

SEQ ID NO: 125457 - DNA, 22 bp, Artificial Sequence
  Synthetic oligonucleotide; CTG chr11 5330200 5330221 5330205 5330200 -
tggcactattcacaatagcaaa

SEQ ID NO: 125458 - DNA, 22 bp, Artificial Sequence
  Synthetic oligonucleotide; CTA chr11 5330192 5330213 5330197 5330192 -
ttcacaatagcaaagacttgga

SEQ ID NO: 125459 - DNA, 22 bp, Artificial Sequence
  Synthetic oligonucleotide; TTC chr11 5330189 5330210 5330194 5330189 -
acaatagcaaagacttggaacc

SEQ ID NO: 125460 - DNA, 22 bp, Artificial Sequence
  Synthetic oligonucleotide; CTT chr11 5330173 5330194 5330178 5330173 -
ggaaccaacccaaatgtccaac

SEQ ID NO: 125461 - DNA, 22 bp, Artificial Sequence
  Synthetic oligonucleotide; TTG chr11 5330172 5330193 5330177 5330172 -
gaaccaacccaaatgtccaaca

SEQ ID NO: 125462 - DNA, 22 bp, Artificial Sequence
  Synthetic oligonucleotide; CTG chr11 5330139 5330160 5330144 5330139 -
aattaagaaaatgtggcacata

SEQ ID NO: 125463 - DNA, 22 bp, Artificial Sequence
  Synthetic oligonucleotide; TTA chr11 5330134 5330155 5330139 5330134 -
agaaaatgtggcacatatacac

SEQ ID NO: 125464 - DNA, 22 bp, Artificial Sequence
  Synthetic oligonucleotide; CTA chr11 5330100 5330121 5330105 5330100 -
tgcagccataaaaaatgaagag

SEQ ID NO: 125465 - DNA, 22 bp, Artificial Sequence
  Synthetic oligonucleotide; TTC chr11 5330075 5330096 5330080 5330075 -
atgtcatttgtagggacatgga

SEQ ID NO: 125466 - DNA, 22 bp, Artificial Sequence
  Synthetic oligonucleotide; TTT chr11 5330066 5330087 5330071 5330066 -
gtagggacatggatgaaactgg

SEQ ID NO: 125467 - DNA, 22 bp, Artificial Sequence
  Synthetic oligonucleotide; TTG chr11 5330065 5330086 5330070 5330065 -
tagggacatggatgaaactgga

SEQ ID NO: 125468 - DNA, 22 bp, Artificial Sequence
  Synthetic oligonucleotide; CTG chr11 5330045 5330066 5330050 5330045 -
gaaaccatcattctcagcaaac

SEQ ID NO: 125469 - DNA, 22 bp, Artificial Sequence
  Synthetic oligonucleotide; TTC chr11 5330032 5330053 5330037 5330032 -
tcagcaaactatcgcaaggaca

SEQ ID NO: 125470 - DNA, 22 bp, Artificial Sequence
  Synthetic oligonucleotide; CTC chr11 5330030 5330051 5330035 5330030 -
agcaaactatcgcaaggacaaa

SEQ ID NO: 125471 - DNA, 22 bp, Artificial Sequence
  Synthetic oligonucleotide; CTA chr11 5330021 5330042 5330026 5330021 -
tcgcaaggacaaaaaaccaagc

SEQ ID NO: 125472 - DNA, 22 bp, Artificial Sequence
  Synthetic oligonucleotide; CTG chr11 5329995 5330016 5330000 5329995 -
catgttctcactcataggtggg

SEQ ID NO: 125473 - DNA, 22 bp, Artificial Sequence
  Synthetic oligonucleotide; TTC chr11 5329988 5330009 5329993 5329988 -
tcactcataggtgggaattgaa

SEQ ID NO: 125474 - DNA, 22 bp, Artificial Sequence
  Synthetic oligonucleotide; CTC chr11 5329986 5330007 5329991 5329986 -
actcataggtgggaattgaaca

SEQ ID NO: 125475 - DNA, 22 bp, Artificial Sequence
  Synthetic oligonucleotide; CTC chr11 5329982 5330003 5329987 5329982 -
ataggtgggaattgaacaatga

SEQ ID NO: 125476 - DNA, 22 bp, Artificial Sequence
  Synthetic oligonucleotide; TTG chr11 5329968 5329989 5329973 5329968 -
aacaatgagaacacatggacac

SEQ ID NO: 125477 - DNA, 22 bp, Artificial Sequence
  Synthetic oligonucleotide; CTC chr11 5329925 5329946 5329930 5329925 -
cggggactgttgtgaggtgggg

SEQ ID NO: 125478 - DNA, 22 bp, Artificial Sequence
  Synthetic oligonucleotide; CTG chr11 5329916 5329937 5329921 5329916 -
ttgtgaggtggggggaaggggg

SEQ ID NO: 125479 - DNA, 22 bp, Artificial Sequence
  Synthetic oligonucleotide; TTG chr11 5329913 5329934 5329918 5329913 -
tgaggtggggggaagggggaga

SEQ ID NO: 125480 - DNA, 22 bp, Artificial Sequence
  Synthetic oligonucleotide; TTA chr11 5329881 5329902 5329886 5329881 -
ggagatatacctaatgctaagt

SEQ ID NO: 125481 - DNA, 22 bp, Artificial Sequence
  Synthetic oligonucleotide; CTA chr11 5329868 5329889 5329873 5329868 -
atgctaagtgacaagttaatgg

SEQ ID NO: 125482 - DNA, 22 bp, Artificial Sequence
  Synthetic oligonucleotide; CTA chr11 5329862 5329883 5329867 5329862 -
agtgacaagttaatgggtgcag

SEQ ID NO: 125483 - DNA, 22 bp, Artificial Sequence
  Synthetic oligonucleotide; TTA chr11 5329850 5329871 5329855 5329850 -
atgggtgcagcacaccaacatg

SEQ ID NO: 125484 - DNA, 22 bp, Artificial Sequence
  Synthetic oligonucleotide; CTG chr11 5329800 5329821 5329805 5329800 -
cacattgtgcacatgtacccta

SEQ ID NO: 125485 - DNA, 22 bp, Artificial Sequence
  Synthetic oligonucleotide; TTG chr11 5329793 5329814 5329798 5329793 -
tgcacatgtaccctaaaactta

SEQ ID NO: 125486 - DNA, 22 bp, Artificial Sequence
  Synthetic oligonucleotide; CTA chr11 5329778 5329799 5329783 5329778 -
aaacttaaagtataataataat

SEQ ID NO: 125487 - DNA, 22 bp, Artificial Sequence
  Synthetic oligonucleotide; CTT chr11 5329772 5329793 5329777 5329772 -
aaagtataataataataataat

SEQ ID NO: 125488 - DNA, 22 bp, Artificial Sequence
  Synthetic oligonucleotide; TTA chr11 5329771 5329792 5329776 5329771 -
aagtataataataataataata

SEQ ID NO: 125489 - DNA, 22 bp, Artificial Sequence
  Synthetic oligonucleotide; TTA chr11 5329738 5329759 5329743 5329738 -
ttttggattaacaaaaaccaac

SEQ ID NO: 125490 - DNA, 22 bp, Artificial Sequence
  Synthetic oligonucleotide; TTT chr11 5329735 5329756 5329740 5329735 -
tggattaacaaaaaccaacagg

SEQ ID NO: 125491 - DNA, 22 bp, Artificial Sequence
  Synthetic oligonucleotide; TTT chr11 5329734 5329755 5329739 5329734 -
ggattaacaaaaaccaacaggc

SEQ ID NO: 125492 - DNA, 22 bp, Artificial Sequence
  Synthetic oligonucleotide; TTG chr11 5329733 5329754 5329738 5329733 -
gattaacaaaaaccaacaggct

SEQ ID NO: 125493 - DNA, 22 bp, Artificial Sequence
  Synthetic oligonucleotide; TTA chr11 5329728 5329749 5329733 5329728 -
acaaaaaccaacaggctaccac

SEQ ID NO: 125494 - DNA, 22 bp, Artificial Sequence
  Synthetic oligonucleotide; CTA chr11 5329710 5329731 5329715 5329710 -
ccacagattctctttgtgttca

SEQ ID NO: 125495 - DNA, 22 bp, Artificial Sequence
  Synthetic oligonucleotide; TTC chr11 5329700 5329721 5329705 5329700 -
tctttgtgttcaattttctcac

SEQ ID NO: 125496 - DNA, 22 bp, Artificial Sequence
  Synthetic oligonucleotide; CTC chr11 5329698 5329719 5329703 5329698 -
tttgtgttcaattttctcacat

SEQ ID NO: 125497 - DNA, 22 bp, Artificial Sequence
  Synthetic oligonucleotide; CTT chr11 5329696 5329717 5329701 5329696 -
tgtgttcaattttctcacatgt

SEQ ID NO: 125498 - DNA, 22 bp, Artificial Sequence
  Synthetic oligonucleotide; TTT chr11 5329695 5329716 5329700 5329695 -
gtgttcaattttctcacatgtt

SEQ ID NO: 125499 - DNA, 22 bp, Artificial Sequence
  Synthetic oligonucleotide; TTG chr11 5329694 5329715 5329699 5329694 -
tgttcaattttctcacatgttt

SEQ ID NO: 125500 - DNA, 22 bp, Artificial Sequence
  Synthetic oligonucleotide; TTC chr11 5329689 5329710 5329694 5329689 -
aattttctcacatgttttgtta

SEQ ID NO: 125501 - DNA, 22 bp, Artificial Sequence
  Synthetic oligonucleotide; TTT chr11 5329684 5329705 5329689 5329684 -
tctcacatgttttgttattctg

SEQ ID NO: 125502 - DNA, 22 bp, Artificial Sequence
  Synthetic oligonucleotide; TTT chr11 5329683 5329704 5329688 5329683 -
ctcacatgttttgttattctgg

SEQ ID NO: 125503 - DNA, 22 bp, Artificial Sequence
  Synthetic oligonucleotide; TTC chr11 5329682 5329703 5329687 5329682 -
tcacatgttttgttattctggc

SEQ ID NO: 125504 - DNA, 22 bp, Artificial Sequence
  Synthetic oligonucleotide; CTC chr11 5329680 5329701 5329685 5329680 -
acatgttttgttattctggctc

SEQ ID NO: 125505 - DNA, 22 bp, Artificial Sequence
  Synthetic oligonucleotide; TTT chr11 5329672 5329693 5329677 5329672 -
tgttattctggctctgctagaa

SEQ ID NO: 125506 - DNA, 22 bp, Artificial Sequence
  Synthetic oligonucleotide; TTT chr11 5329671 5329692 5329676 5329671 -
gttattctggctctgctagaat

SEQ ID NO: 125507 - DNA, 22 bp, Artificial Sequence
  Synthetic oligonucleotide; TTG chr11 5329670 5329691 5329675 5329670 -
ttattctggctctgctagaatt

SEQ ID NO: 125508 - DNA, 22 bp, Artificial Sequence
  Synthetic oligonucleotide; TTA chr11 5329667 5329688 5329672 5329667 -
ttctggctctgctagaattctc

SEQ ID NO: 125509 - DNA, 22 bp, Artificial Sequence
  Synthetic oligonucleotide; TTC chr11 5329664 5329685 5329669 5329664 -
tggctctgctagaattctcttg

SEQ ID NO: 125510 - DNA, 22 bp, Artificial Sequence
  Synthetic oligonucleotide; CTG chr11 5329662 5329683 5329667 5329662 -
gctctgctagaattctcttgat

SEQ ID NO: 125511 - DNA, 22 bp, Artificial Sequence
  Synthetic oligonucleotide; CTC chr11 5329658 5329679 5329663 5329658 -
tgctagaattctcttgatttga

SEQ ID NO: 125512 - DNA, 22 bp, Artificial Sequence
  Synthetic oligonucleotide; CTG chr11 5329656 5329677 5329661 5329656 -
ctagaattctcttgatttgagt

SEQ ID NO: 125513 - DNA, 22 bp, Artificial Sequence
  Synthetic oligonucleotide; CTA chr11 5329653 5329674 5329658 5329653 -
gaattctcttgatttgagtttg

SEQ ID NO: 125514 - DNA, 22 bp, Artificial Sequence
  Synthetic oligonucleotide; TTC chr11 5329647 5329668 5329652 5329647 -
tcttgatttgagtttgtcatat

SEQ ID NO: 125515 - DNA, 22 bp, Artificial Sequence
  Synthetic oligonucleotide; CTC chr11 5329645 5329666 5329650 5329645 -
ttgatttgagtttgtcatattt

SEQ ID NO: 125516 - DNA, 22 bp, Artificial Sequence
  Synthetic oligonucleotide; CTT chr11 5329643 5329664 5329648 5329643 -
gatttgagtttgtcatattttc

SEQ ID NO: 125517 - DNA, 22 bp, Artificial Sequence
  Synthetic oligonucleotide; TTG chr11 5329642 5329663 5329647 5329642 -
atttgagtttgtcatattttct

SEQ ID NO: 125518 - DNA, 22 bp, Artificial Sequence
  Synthetic oligonucleotide; TTT chr11 5329638 5329659 5329643 5329638 -
gagtttgtcatattttctcttt

SEQ ID NO: 125519 - DNA, 22 bp, Artificial Sequence
  Synthetic oligonucleotide; TTG chr11 5329637 5329658 5329642 5329637 -
agtttgtcatattttctctttc

SEQ ID NO: 125520 - DNA, 22 bp, Artificial Sequence
  Synthetic oligonucleotide; TTT chr11 5329632 5329653 5329637 5329632 -
gtcatattttctctttccccat

SEQ ID NO: 125521 - DNA, 22 bp, Artificial Sequence
  Synthetic oligonucleotide; TTG chr11 5329631 5329652 5329636 5329631 -
tcatattttctctttccccata

SEQ ID NO: 125522 - DNA, 22 bp, Artificial Sequence
  Synthetic oligonucleotide; TTT chr11 5329623 5329644 5329628 5329623 -
tctctttccccatagcctgtgt

SEQ ID NO: 125523 - DNA, 22 bp, Artificial Sequence
  Synthetic oligonucleotide; TTT chr11 5329622 5329643 5329627 5329622 -
ctctttccccatagcctgtgta

SEQ ID NO: 125524 - DNA, 22 bp, Artificial Sequence
  Synthetic oligonucleotide; TTC chr11 5329621 5329642 5329626 5329621 -
tctttccccatagcctgtgtat

SEQ ID NO: 125525 - DNA, 22 bp, Artificial Sequence
  Synthetic oligonucleotide; CTC chr11 5329619 5329640 5329624 5329619 -
tttccccatagcctgtgtattt

SEQ ID NO: 125526 - DNA, 22 bp, Artificial Sequence
  Synthetic oligonucleotide; CTT chr11 5329617 5329638 5329622 5329617 -
tccccatagcctgtgtattttt

SEQ ID NO: 125527 - DNA, 22 bp, Artificial Sequence
  Synthetic oligonucleotide; TTT chr11 5329616 5329637 5329621 5329616 -
ccccatagcctgtgtatttttt

SEQ ID NO: 125528 - DNA, 22 bp, Artificial Sequence
  Synthetic oligonucleotide; TTC chr11 5329615 5329636 5329620 5329615 -
cccatagcctgtgtattttttc

SEQ ID NO: 125529 - DNA, 22 bp, Artificial Sequence
  Synthetic oligonucleotide; CTG chr11 5329604 5329625 5329609 5329604 -
tgtattttttcttcctttataa

SEQ ID NO: 125530 - DNA, 22 bp, Artificial Sequence
  Synthetic oligonucleotide; TTT chr11 5329597 5329618 5329602 5329597 -
tttcttcctttataaactgtac

SEQ ID NO: 125531 - DNA, 22 bp, Artificial Sequence
  Synthetic oligonucleotide; TTT chr11 5329596 5329617 5329601 5329596 -
ttcttcctttataaactgtacc

SEQ ID NO: 125532 - DNA, 22 bp, Artificial Sequence
  Synthetic oligonucleotide; TTT chr11 5329595 5329616 5329600 5329595 -
tcttcctttataaactgtaccc

SEQ ID NO: 125533 - DNA, 22 bp, Artificial Sequence
  Synthetic oligonucleotide; TTT chr11 5329594 5329615 5329599 5329594 -
cttcctttataaactgtacccc

SEQ ID NO: 125534 - DNA, 22 bp, Artificial Sequence
  Synthetic oligonucleotide; TTC chr11 5329593 5329614 5329598 5329593 -
ttcctttataaactgtacccca

SEQ ID NO: 125535 - DNA, 22 bp, Artificial Sequence
  Synthetic oligonucleotide; CTT chr11 5329591 5329612 5329596 5329591 -
cctttataaactgtaccccact

SEQ ID NO: 125536 - DNA, 22 bp, Artificial Sequence
  Synthetic oligonucleotide; TTC chr11 5329590 5329611 5329595 5329590 -
ctttataaactgtaccccactt

SEQ ID NO: 125537 - DNA, 22 bp, Artificial Sequence
  Synthetic oligonucleotide; CTT chr11 5329587 5329608 5329592 5329587 -
tataaactgtaccccacttata

SEQ ID NO: 125538 - DNA, 22 bp, Artificial Sequence
  Synthetic oligonucleotide; TTT chr11 5329586 5329607 5329591 5329586 -
ataaactgtaccccacttatac

SEQ ID NO: 125539 - DNA, 22 bp, Artificial Sequence
  Synthetic oligonucleotide; TTA chr11 5329585 5329606 5329590 5329585 -
taaactgtaccccacttataca

SEQ ID NO: 125540 - DNA, 22 bp, Artificial Sequence
  Synthetic oligonucleotide; CTG chr11 5329578 5329599 5329583 5329578 -
taccccacttatacaaacacta

SEQ ID NO: 125541 - DNA, 22 bp, Artificial Sequence
  Synthetic oligonucleotide; CTT chr11 5329568 5329589 5329573 5329568 -
atacaaacactatatttgttac

SEQ ID NO: 125542 - DNA, 22 bp, Artificial Sequence
  Synthetic oligonucleotide; TTA chr11 5329567 5329588 5329572 5329567 -
tacaaacactatatttgttacc

SEQ ID NO: 125543 - DNA, 22 bp, Artificial Sequence
  Synthetic oligonucleotide; CTA chr11 5329556 5329577 5329561 5329556 -
tatttgttaccttccttgtttt

SEQ ID NO: 125544 - DNA, 22 bp, Artificial Sequence
  Synthetic oligonucleotide; TTT chr11 5329551 5329572 5329556 5329551 -
gttaccttccttgtttttcaat

SEQ ID NO: 125545 - DNA, 22 bp, Artificial Sequence
  Synthetic oligonucleotide; TTG chr11 5329550 5329571 5329555 5329550 -
ttaccttccttgtttttcaatt

SEQ ID NO: 125546 - DNA, 22 bp, Artificial Sequence
  Synthetic oligonucleotide; TTA chr11 5329547 5329568 5329552 5329547 -
ccttccttgtttttcaattatt

SEQ ID NO: 125547 - DNA, 22 bp, Artificial Sequence
  Synthetic oligonucleotide; CTT chr11 5329543 5329564 5329548 5329543 -
ccttgtttttcaattattagct

SEQ ID NO: 125548 - DNA, 22 bp, Artificial Sequence
  Synthetic oligonucleotide; TTC chr11 5329542 5329563 5329547 5329542 -
cttgtttttcaattattagctt

SEQ ID NO: 125549 - DNA, 22 bp, Artificial Sequence
  Synthetic oligonucleotide; CTT chr11 5329539 5329560 5329544 5329539 -
gtttttcaattattagcttaaa

SEQ ID NO: 125550 - DNA, 22 bp, Artificial Sequence
  Synthetic oligonucleotide; TTG chr11 5329538 5329559 5329543 5329538 -
tttttcaattattagcttaaat

SEQ ID NO: 125551 - DNA, 22 bp, Artificial Sequence
  Synthetic oligonucleotide; TTT chr11 5329535 5329556 5329540 5329535 -
ttcaattattagcttaaataat

SEQ ID NO: 125552 - DNA, 22 bp, Artificial Sequence
  Synthetic oligonucleotide; TTT chr11 5329534 5329555 5329539 5329534 -
tcaattattagcttaaataata

SEQ ID NO: 125553 - DNA, 22 bp, Artificial Sequence
  Synthetic oligonucleotide; TTT chr11 5329533 5329554 5329538 5329533 -
caattattagcttaaataatat

SEQ ID NO: 125554 - DNA, 22 bp, Artificial Sequence
  Synthetic oligonucleotide; TTC chr11 5329532 5329553 5329537 5329532 -
aattattagcttaaataatatt

SEQ ID NO: 125555 - DNA, 22 bp, Artificial Sequence
  Synthetic oligonucleotide; TTA chr11 5329527 5329548 5329532 5329527 -
ttagcttaaataatatttcttt

SEQ ID NO: 125556 - DNA, 22 bp, Artificial Sequence
  Synthetic oligonucleotide; TTA chr11 5329524 5329545 5329529 5329524 -
gcttaaataatatttcttttga

SEQ ID NO: 125557 - DNA, 22 bp, Artificial Sequence
  Synthetic oligonucleotide; CTT chr11 5329520 5329541 5329525 5329520 -
aaataatatttcttttgagaaa

SEQ ID NO: 125558 - DNA, 22 bp, Artificial Sequence
  Synthetic oligonucleotide; TTA chr11 5329519 5329540 5329524 5329519 -
aataatatttcttttgagaaat

SEQ ID NO: 125559 - DNA, 22 bp, Artificial Sequence
  Synthetic oligonucleotide; TTT chr11 5329509 5329530 5329514 5329509 -
cttttgagaaattttcccctgc

SEQ ID NO: 125560 - DNA, 22 bp, Artificial Sequence
  Synthetic oligonucleotide; TTC chr11 5329508 5329529 5329513 5329508 -
ttttgagaaattttcccctgcc

SEQ ID NO: 125561 - DNA, 22 bp, Artificial Sequence
  Synthetic oligonucleotide; CTT chr11 5329506 5329527 5329511 5329506 -
ttgagaaattttcccctgcccc

SEQ ID NO: 125562 - DNA, 22 bp, Artificial Sequence
  Synthetic oligonucleotide; TTT chr11 5329505 5329526 5329510 5329505 -
tgagaaattttcccctgcccca

SEQ ID NO: 125563 - DNA, 22 bp, Artificial Sequence
  Synthetic oligonucleotide; TTT chr11 5329504 5329525 5329509 5329504 -
gagaaattttcccctgccccaa

SEQ ID NO: 125564 - DNA, 22 bp, Artificial Sequence
  Synthetic oligonucleotide; TTG chr11 5329503 5329524 5329508 5329503 -
agaaattttcccctgccccaaa

SEQ ID NO: 125565 - DNA, 22 bp, Artificial Sequence
  Synthetic oligonucleotide; TTT chr11 5329495 5329516 5329500 5329495 -
tcccctgccccaaagatgcttt

SEQ ID NO: 125566 - DNA, 22 bp, Artificial Sequence
  Synthetic oligonucleotide; TTT chr11 5329494 5329515 5329499 5329494 -
cccctgccccaaagatgctttc

SEQ ID NO: 125567 - DNA, 22 bp, Artificial Sequence
  Synthetic oligonucleotide; TTC chr11 5329493 5329514 5329498 5329493 -
ccctgccccaaagatgctttct

SEQ ID NO: 125568 - DNA, 22 bp, Artificial Sequence
  Synthetic oligonucleotide; CTG chr11 5329488 5329509 5329493 5329488 -
ccccaaagatgctttctgtggg

SEQ ID NO: 125569 - DNA, 22 bp, Artificial Sequence
  Synthetic oligonucleotide; CTT chr11 5329474 5329495 5329479 5329474 -
tctgtgggctccctttagcatg

SEQ ID NO: 125570 - DNA, 22 bp, Artificial Sequence
  Synthetic oligonucleotide; TTT chr11 5329473 5329494 5329478 5329473 -
ctgtgggctccctttagcatgc

SEQ ID NO: 125571 - DNA, 22 bp, Artificial Sequence
  Synthetic oligonucleotide; TTC chr11 5329472 5329493 5329477 5329472 -
tgtgggctccctttagcatgct

SEQ ID NO: 125572 - DNA, 22 bp, Artificial Sequence
  Synthetic oligonucleotide; CTG chr11 5329470 5329491 5329475 5329470 -
tgggctccctttagcatgctac

SEQ ID NO: 125573 - DNA, 22 bp, Artificial Sequence
  Synthetic oligonucleotide; CTC chr11 5329463 5329484 5329468 5329463 -
cctttagcatgctaccatctat

SEQ ID NO: 125574 - DNA, 22 bp, Artificial Sequence
  Synthetic oligonucleotide; CTT chr11 5329459 5329480 5329464 5329459 -
tagcatgctaccatctatgcag

SEQ ID NO: 125575 - DNA, 22 bp, Artificial Sequence
  Synthetic oligonucleotide; TTT chr11 5329458 5329479 5329463 5329458 -
agcatgctaccatctatgcagt

SEQ ID NO: 125576 - DNA, 22 bp, Artificial Sequence
  Synthetic oligonucleotide; TTA chr11 5329457 5329478 5329462 5329457 -
gcatgctaccatctatgcagta

SEQ ID NO: 125577 - DNA, 22 bp, Artificial Sequence
  Synthetic oligonucleotide; CTA chr11 5329449 5329470 5329454 5329449 -
ccatctatgcagtaatgatagt

SEQ ID NO: 125578 - DNA, 22 bp, Artificial Sequence
  Synthetic oligonucleotide; CTA chr11 5329442 5329463 5329447 5329442 -
tgcagtaatgatagtgctatga

SEQ ID NO: 125579 - DNA, 22 bp, Artificial Sequence
  Synthetic oligonucleotide; CTA chr11 5329423 5329444 5329428 5329423 -
tgaaaatttgtggtaactattt

SEQ ID NO: 125580 - DNA, 22 bp, Artificial Sequence
  Synthetic oligonucleotide; TTT chr11 5329414 5329435 5329419 5329414 -
gtggtaactattttctttatat

SEQ ID NO: 125581 - DNA, 22 bp, Artificial Sequence
  Synthetic oligonucleotide; TTG chr11 5329413 5329434 5329418 5329413 -
tggtaactattttctttatatt

SEQ ID NO: 125582 - DNA, 22 bp, Artificial Sequence
  Synthetic oligonucleotide; CTA chr11 5329404 5329425 5329409 5329404 -
ttttctttatattacacactat

SEQ ID NO: 125583 - DNA, 22 bp, Artificial Sequence
  Synthetic oligonucleotide; TTT chr11 5329401 5329422 5329406 5329401 -
tctttatattacacactattta

SEQ ID NO: 125584 - DNA, 22 bp, Artificial Sequence
  Synthetic oligonucleotide; TTT chr11 5329400 5329421 5329405 5329400 -
ctttatattacacactatttac

SEQ ID NO: 125585 - DNA, 22 bp, Artificial Sequence
  Synthetic oligonucleotide; TTC chr11 5329399 5329420 5329404 5329399 -
tttatattacacactatttaca

SEQ ID NO: 125586 - DNA, 22 bp, Artificial Sequence
  Synthetic oligonucleotide; CTT chr11 5329397 5329418 5329402 5329397 -
tatattacacactatttacatt

SEQ ID NO: 125587 - DNA, 22 bp, Artificial Sequence
  Synthetic oligonucleotide; TTT chr11 5329396 5329417 5329401 5329396 -
atattacacactatttacattc

SEQ ID NO: 125588 - DNA, 22 bp, Artificial Sequence
  Synthetic oligonucleotide; TTA chr11 5329395 5329416 5329400 5329395 -
tattacacactatttacattct

SEQ ID NO: 125589 - DNA, 22 bp, Artificial Sequence
  Synthetic oligonucleotide; TTA chr11 5329390 5329411 5329395 5329390 -
cacactatttacattctgtgaa

SEQ ID NO: 125590 - DNA, 22 bp, Artificial Sequence
  Synthetic oligonucleotide; CTA chr11 5329383 5329404 5329388 5329383 -
tttacattctgtgaataaagac

SEQ ID NO: 125591 - DNA, 22 bp, Artificial Sequence
  Synthetic oligonucleotide; TTT chr11 5329380 5329401 5329385 5329380 -
acattctgtgaataaagactat

SEQ ID NO: 125592 - DNA, 22 bp, Artificial Sequence
  Synthetic oligonucleotide; TTA chr11 5329379 5329400 5329384 5329379 -
cattctgtgaataaagactatg

SEQ ID NO: 125593 - DNA, 22 bp, Artificial Sequence
  Synthetic oligonucleotide; TTC chr11 5329374 5329395 5329379 5329374 -
tgtgaataaagactatgctcct

SEQ ID NO: 125594 - DNA, 22 bp, Artificial Sequence
  Synthetic oligonucleotide; CTG chr11 5329372 5329393 5329377 5329372 -
tgaataaagactatgctcctca

SEQ ID NO: 125595 - DNA, 22 bp, Artificial Sequence
  Synthetic oligonucleotide; CTA chr11 5329359 5329380 5329364 5329359 -
tgctcctcattgtgtatctggc

SEQ ID NO: 125596 - DNA, 22 bp, Artificial Sequence
  Synthetic oligonucleotide; CTC chr11 5329354 5329375 5329359 5329354 -
ctcattgtgtatctggcaaaaa

SEQ ID NO: 125597 - DNA, 22 bp, Artificial Sequence
  Synthetic oligonucleotide; CTC chr11 5329351 5329372 5329356 5329351 -
attgtgtatctggcaaaaaaaa

SEQ ID NO: 125598 - DNA, 22 bp, Artificial Sequence
  Synthetic oligonucleotide; TTG chr11 5329347 5329368 5329352 5329347 -
tgtatctggcaaaaaaaaaaaa

SEQ ID NO: 125599 - DNA, 22 bp, Artificial Sequence
  Synthetic oligonucleotide; CTG chr11 5329339 5329360 5329344 5329339 -
gcaaaaaaaaaaaaaaagggca

SEQ ID NO: 125600 - DNA, 22 bp, Artificial Sequence
  Synthetic oligonucleotide; CTA chr11 5329309 5329330 5329314 5329309 -
caagtaatataattttaagata

SEQ ID NO: 125601 - DNA, 22 bp, Artificial Sequence
  Synthetic oligonucleotide; TTT chr11 5329294 5329315 5329299 5329294 -
taagataaaaagctgaatgtca

SEQ ID NO: 125602 - DNA, 22 bp, Artificial Sequence
  Synthetic oligonucleotide; TTT chr11 5329293 5329314 5329298 5329293 -
aagataaaaagctgaatgtcag

SEQ ID NO: 125603 - DNA, 22 bp, Artificial Sequence
  Synthetic oligonucleotide; TTA chr11 5329292 5329313 5329297 5329292 -
agataaaaagctgaatgtcagc

SEQ ID NO: 125604 - DNA, 22 bp, Artificial Sequence
  Synthetic oligonucleotide; CTG chr11 5329279 5329300 5329284 5329279 -
aatgtcagccgggcgcagtgac

SEQ ID NO: 125605 - DNA, 22 bp, Artificial Sequence
  Synthetic oligonucleotide; CTC chr11 5329255 5329276 5329260 5329255 -
acacctgcaatcccagcacttt

SEQ ID NO: 125606 - DNA, 22 bp, Artificial Sequence
  Synthetic oligonucleotide; CTG chr11 5329248 5329269 5329253 5329248 -
caatcccagcactttgggaggc

SEQ ID NO: 125607 - DNA, 22 bp, Artificial Sequence
  Synthetic oligonucleotide; CTT chr11 5329234 5329255 5329239 5329234 -
tgggaggccaaggagggtggat

SEQ ID NO: 125608 - DNA, 22 bp, Artificial Sequence
  Synthetic oligonucleotide; TTT chr11 5329233 5329254 5329238 5329233 -
gggaggccaaggagggtggatc

SEQ ID NO: 125609 - DNA, 22 bp, Artificial Sequence
  Synthetic oligonucleotide; TTG chr11 5329232 5329253 5329237 5329232 -
ggaggccaaggagggtggatca

SEQ ID NO: 125610 - DNA, 22 bp, Artificial Sequence
  Synthetic oligonucleotide; CTG chr11 5329183 5329204 5329188 5329183 -
gccaatatggtgaaaccccgtg

SEQ ID NO: 125611 - DNA, 22 bp, Artificial Sequence
  Synthetic oligonucleotide; CTA chr11 5329157 5329178 5329162 5329157 -
ctaaaaatacaaaaattagctg

SEQ ID NO: 125612 - DNA, 22 bp, Artificial Sequence
  Synthetic oligonucleotide; CTA chr11 5329154 5329175 5329159 5329154 -
aaaatacaaaaattagctgggt

SEQ ID NO: 125613 - DNA, 22 bp, Artificial Sequence
  Synthetic oligonucleotide; TTA chr11 5329139 5329160 5329144 5329139 -
gctgggtgtggtgacgcgctac

SEQ ID NO: 125614 - DNA, 22 bp, Artificial Sequence
  Synthetic oligonucleotide; CTG chr11 5329135 5329156 5329140 5329135 -
ggtgtggtgacgcgctactgta

SEQ ID NO: 125615 - DNA, 22 bp, Artificial Sequence
  Synthetic oligonucleotide; CTA chr11 5329118 5329139 5329123 5329118 -
ctgtagtcccagcttctcagga

SEQ ID NO: 125616 - DNA, 22 bp, Artificial Sequence
  Synthetic oligonucleotide; CTG chr11 5329115 5329136 5329120 5329115 -
tagtcccagcttctcaggaggc

SEQ ID NO: 125617 - DNA, 22 bp, Artificial Sequence
  Synthetic oligonucleotide; CTT chr11 5329103 5329124 5329108 5329103 -
ctcaggaggctgtggcaggaga

SEQ ID NO: 125618 - DNA, 22 bp, Artificial Sequence
  Synthetic oligonucleotide; TTC chr11 5329102 5329123 5329107 5329102 -
tcaggaggctgtggcaggagaa

SEQ ID NO: 125619 - DNA, 22 bp, Artificial Sequence
  Synthetic oligonucleotide; CTC chr11 5329100 5329121 5329105 5329100 -
aggaggctgtggcaggagaatc

SEQ ID NO: 125620 - DNA, 22 bp, Artificial Sequence
  Synthetic oligonucleotide; CTG chr11 5329091 5329112 5329096 5329091 -
tggcaggagaatcacttgaacc

SEQ ID NO: 125621 - DNA, 22 bp, Artificial Sequence
  Synthetic oligonucleotide; CTT chr11 5329074 5329095 5329079 5329074 -
gaacctgggaggtggagtttgc

SEQ ID NO: 125622 - DNA, 22 bp, Artificial Sequence
  Synthetic oligonucleotide; TTG chr11 5329073 5329094 5329078 5329073 -
aacctgggaggtggagtttgca

SEQ ID NO: 125623 - DNA, 22 bp, Artificial Sequence
  Synthetic oligonucleotide; CTG chr11 5329067 5329088 5329072 5329067 -
ggaggtggagtttgcagtgagc

SEQ ID NO: 125624 - DNA, 22 bp, Artificial Sequence
  Synthetic oligonucleotide; TTT chr11 5329054 5329075 5329059 5329054 -
gcagtgagctgagattgtgcta

SEQ ID NO: 125625 - DNA, 22 bp, Artificial Sequence
  Synthetic oligonucleotide; TTG chr11 5329053 5329074 5329058 5329053 -
cagtgagctgagattgtgctac

SEQ ID NO: 125626 - DNA, 22 bp, Artificial Sequence
  Synthetic oligonucleotide; CTG chr11 5329043 5329064 5329048 5329043 -
agattgtgctactgcactccag

SEQ ID NO: 125627 - DNA, 22 bp, Artificial Sequence
  Synthetic oligonucleotide; TTG chr11 5329037 5329058 5329042 5329037 -
tgctactgcactccagcctggc

SEQ ID NO: 125628 - DNA, 22 bp, Artificial Sequence
  Synthetic oligonucleotide; CTA chr11 5329032 5329053 5329037 5329032 -
ctgcactccagcctggcgacag

SEQ ID NO: 125629 - DNA, 22 bp, Artificial Sequence
  Synthetic oligonucleotide; CTG chr11 5329029 5329050 5329034 5329029 -
cactccagcctggcgacagagt

SEQ ID NO: 125630 - DNA, 22 bp, Artificial Sequence
  Synthetic oligonucleotide; CTC chr11 5329024 5329045 5329029 5329024 -
cagcctggcgacagagtgagac

SEQ ID NO: 125631 - DNA, 22 bp, Artificial Sequence
  Synthetic oligonucleotide; CTG chr11 5329017 5329038 5329022 5329017 -
gcgacagagtgagactctatct

SEQ ID NO: 125632 - DNA, 22 bp, Artificial Sequence
  Synthetic oligonucleotide; CTC chr11 5329000 5329021 5329005 5329000 -
tatctaaaaaaaaaaaaaaaaa

SEQ ID NO: 125633 - DNA, 22 bp, Artificial Sequence
  Synthetic oligonucleotide; CTA chr11 5328998 5329019 5329003 5328998 -
tctaaaaaaaaaaaaaaaaaaa

SEQ ID NO: 125634 - DNA, 22 bp, Artificial Sequence
  Synthetic oligonucleotide; CTA chr11 5328994 5329015 5328999 5328994 -
aaaaaaaaaaaaaaaaaaaaaa

SEQ ID NO: 125635 - DNA, 22 bp, Artificial Sequence
  Synthetic oligonucleotide; CTG chr11 5328963 5328984 5328968 5328963 -
aatgtcatgaatctgcatgact

SEQ ID NO: 125636 - DNA, 22 bp, Artificial Sequence
  Synthetic oligonucleotide; CTG chr11 5328948 5328969 5328953 5328948 -
catgactattaacagatccatt

SEQ ID NO: 125637 - DNA, 22 bp, Artificial Sequence
  Synthetic oligonucleotide; CTA chr11 5328940 5328961 5328945 5328940 -
ttaacagatccattgaagttcc

SEQ ID NO: 125638 - DNA, 22 bp, Artificial Sequence
  Synthetic oligonucleotide; TTA chr11 5328937 5328958 5328942 5328937 -
acagatccattgaagttccagt

SEQ ID NO: 125639 - DNA, 22 bp, Artificial Sequence
  Synthetic oligonucleotide; TTG chr11 5328925 5328946 5328930 5328925 -
aagttccagtagataagaacaa

SEQ ID NO: 125640 - DNA, 22 bp, Artificial Sequence
  Synthetic oligonucleotide; TTC chr11 5328919 5328940 5328924 5328919 -
cagtagataagaacaaatttta

SEQ ID NO: 125641 - DNA, 22 bp, Artificial Sequence
  Synthetic oligonucleotide; TTT chr11 5328899 5328920 5328904 5328899 -
taccaaagtaacaggaaagaca

SEQ ID NO: 125642 - DNA, 22 bp, Artificial Sequence
  Synthetic oligonucleotide; TTT chr11 5328898 5328919 5328903 5328898 -
accaaagtaacaggaaagacaa

SEQ ID NO: 125643 - DNA, 22 bp, Artificial Sequence
  Synthetic oligonucleotide; TTA chr11 5328897 5328918 5328902 5328897 -
ccaaagtaacaggaaagacaaa

SEQ ID NO: 125644 - DNA, 22 bp, Artificial Sequence
  Synthetic oligonucleotide; TTG chr11 5328865 5328886 5328870 5328865 -
gaattcataagctctaggaccc

SEQ ID NO: 125645 - DNA, 22 bp, Artificial Sequence
  Synthetic oligonucleotide; TTC chr11 5328859 5328880 5328864 5328859 -
ataagctctaggacccgtagag

SEQ ID NO: 125646 - DNA, 22 bp, Artificial Sequence
  Synthetic oligonucleotide; CTC chr11 5328851 5328872 5328856 5328851 -
taggacccgtagaggtacatat

SEQ ID NO: 125647 - DNA, 22 bp, Artificial Sequence
  Synthetic oligonucleotide; CTA chr11 5328849 5328870 5328854 5328849 -
ggacccgtagaggtacatatga

SEQ ID NO: 125648 - DNA, 22 bp, Artificial Sequence
  Synthetic oligonucleotide; CTG chr11 5328821 5328842 5328826 5328821 -
aagacaaccgatatcccctaac

SEQ ID NO: 125649 - DNA, 22 bp, Artificial Sequence
  Synthetic oligonucleotide; CTA chr11 5328801 5328822 5328806 5328801 -
accctttcaaataaactaagtt

SEQ ID NO: 125650 - DNA, 22 bp, Artificial Sequence
  Synthetic oligonucleotide; CTT chr11 5328795 5328816 5328800 5328795 -
tcaaataaactaagttatgatg

SEQ ID NO: 125651 - DNA, 22 bp, Artificial Sequence
  Synthetic oligonucleotide; TTT chr11 5328794 5328815 5328799 5328794 -
caaataaactaagttatgatgc

SEQ ID NO: 125652 - DNA, 22 bp, Artificial Sequence
  Synthetic oligonucleotide; TTC chr11 5328793 5328814 5328798 5328793 -
aaataaactaagttatgatgct

SEQ ID NO: 125653 - DNA, 22 bp, Artificial Sequence
  Synthetic oligonucleotide; CTA chr11 5328783 5328804 5328788 5328783 -
agttatgatgctgagcctcctt

SEQ ID NO: 125654 - DNA, 22 bp, Artificial Sequence
  Synthetic oligonucleotide; TTA chr11 5328778 5328799 5328783 5328778 -
tgatgctgagcctccttgggtc

SEQ ID NO: 125655 - DNA, 22 bp, Artificial Sequence
  Synthetic oligonucleotide; CTG chr11 5328770 5328791 5328775 5328770 -
agcctccttgggtcacataacc

SEQ ID NO: 125656 - DNA, 22 bp, Artificial Sequence
  Synthetic oligonucleotide; CTC chr11 5328764 5328785 5328769 5328764 -
cttgggtcacataaccaagccc

SEQ ID NO: 125657 - DNA, 22 bp, Artificial Sequence
  Synthetic oligonucleotide; CTT chr11 5328761 5328782 5328766 5328761 -
gggtcacataaccaagccctgg

SEQ ID NO: 125658 - DNA, 22 bp, Artificial Sequence
  Synthetic oligonucleotide; TTG chr11 5328760 5328781 5328765 5328760 -
ggtcacataaccaagccctggt

SEQ ID NO: 125659 - DNA, 22 bp, Artificial Sequence
  Synthetic oligonucleotide; CTG chr11 5328740 5328761 5328745 5328740 -
gtatccctatcttacatcagct

SEQ ID NO: 125660 - DNA, 22 bp, Artificial Sequence
  Synthetic oligonucleotide; CTA chr11 5328731 5328752 5328736 5328731 -
tcttacatcagctggtttttga

SEQ ID NO: 125661 - DNA, 22 bp, Artificial Sequence
  Synthetic oligonucleotide; CTT chr11 5328727 5328748 5328732 5328727 -
acatcagctggtttttgaattt

SEQ ID NO: 125662 - DNA, 22 bp, Artificial Sequence
  Synthetic oligonucleotide; TTA chr11 5328726 5328747 5328731 5328726 -
catcagctggtttttgaatttc

SEQ ID NO: 125663 - DNA, 22 bp, Artificial Sequence
  Synthetic oligonucleotide; CTG chr11 5328717 5328738 5328722 5328717 -
gtttttgaatttcaaattttcc

SEQ ID NO: 125664 - DNA, 22 bp, Artificial Sequence
  Synthetic oligonucleotide; TTT chr11 5328713 5328734 5328718 5328713 -
ttgaatttcaaattttcctcac

SEQ ID NO: 125665 - DNA, 22 bp, Artificial Sequence
  Synthetic oligonucleotide; TTT chr11 5328712 5328733 5328717 5328712 -
tgaatttcaaattttcctcacc

SEQ ID NO: 125666 - DNA, 22 bp, Artificial Sequence
  Synthetic oligonucleotide; TTT chr11 5328711 5328732 5328716 5328711 -
gaatttcaaattttcctcaccc

SEQ ID NO: 125667 - DNA, 22 bp, Artificial Sequence
  Synthetic oligonucleotide; TTG chr11 5328710 5328731 5328715 5328710 -
aatttcaaattttcctcacccc

SEQ ID NO: 125668 - DNA, 22 bp, Artificial Sequence
  Synthetic oligonucleotide; TTT chr11 5328705 5328726 5328710 5328705 -
caaattttcctcaccccattct

SEQ ID NO: 125669 - DNA, 22 bp, Artificial Sequence
  Synthetic oligonucleotide; TTC chr11 5328704 5328725 5328709 5328704 -
aaattttcctcaccccattctt

SEQ ID NO: 125670 - DNA, 22 bp, Artificial Sequence
  Synthetic oligonucleotide; TTT chr11 5328698 5328719 5328703 5328698 -
tcctcaccccattcttcaggaa

SEQ ID NO: 125671 - DNA, 22 bp, Artificial Sequence
  Synthetic oligonucleotide; TTT chr11 5328697 5328718 5328702 5328697 -
cctcaccccattcttcaggaaa

SEQ ID NO: 125672 - DNA, 22 bp, Artificial Sequence
  Synthetic oligonucleotide; TTC chr11 5328696 5328717 5328701 5328696 -
ctcaccccattcttcaggaaac

SEQ ID NO: 125673 - DNA, 22 bp, Artificial Sequence
  Synthetic oligonucleotide; CTC chr11 5328693 5328714 5328698 5328693 -
accccattcttcaggaaacacc

SEQ ID NO: 125674 - DNA, 22 bp, Artificial Sequence
  Synthetic oligonucleotide; TTC chr11 5328684 5328705 5328689 5328684 -
ttcaggaaacacctgaaaatcc

SEQ ID NO: 125675 - DNA, 22 bp, Artificial Sequence
  Synthetic oligonucleotide; CTT chr11 5328682 5328703 5328687 5328682 -
caggaaacacctgaaaatcccg

SEQ ID NO: 125676 - DNA, 22 bp, Artificial Sequence
  Synthetic oligonucleotide; TTC chr11 5328681 5328702 5328686 5328681 -
aggaaacacctgaaaatcccga

SEQ ID NO: 125677 - DNA, 22 bp, Artificial Sequence
  Synthetic oligonucleotide; CTG chr11 5328669 5328690 5328674 5328669 -
aaaatcccgaggacatcagttg

SEQ ID NO: 125678 - DNA, 22 bp, Artificial Sequence
  Synthetic oligonucleotide; TTG chr11 5328647 5328668 5328652 5328647 -
tggggccctgttcctcccgaac

SEQ ID NO: 125679 - DNA, 22 bp, Artificial Sequence
  Synthetic oligonucleotide; CTG chr11 5328637 5328658 5328642 5328637 -
ttcctcccgaacagagaagaga

SEQ ID NO: 125680 - DNA, 22 bp, Artificial Sequence
  Synthetic oligonucleotide; TTC chr11 5328634 5328655 5328639 5328634 -
ctcccgaacagagaagagaggg

SEQ ID NO: 125681 - DNA, 22 bp, Artificial Sequence
  Synthetic oligonucleotide; CTC chr11 5328631 5328652 5328636 5328631 -
ccgaacagagaagagagggaag

SEQ ID NO: 125682 - DNA, 22 bp, Artificial Sequence
  Synthetic oligonucleotide; CTC chr11 5328592 5328613 5328597 5328592 -
ctgagatgctagaaagatgaaa

SEQ ID NO: 125683 - DNA, 22 bp, Artificial Sequence
  Synthetic oligonucleotide; CTG chr11 5328589 5328610 5328594 5328589 -
agatgctagaaagatgaaactc

SEQ ID NO: 125684 - DNA, 22 bp, Artificial Sequence
  Synthetic oligonucleotide; CTA chr11 5328581 5328602 5328586 5328581 -
gaaagatgaaactcaggggagg

SEQ ID NO: 125685 - DNA, 22 bp, Artificial Sequence
  Synthetic oligonucleotide; CTC chr11 5328567 5328588 5328572 5328567 -
aggggaggtgatttccacatgc

SEQ ID NO: 125686 - DNA, 22 bp, Artificial Sequence
  Synthetic oligonucleotide; TTT chr11 5328553 5328574 5328558 5328553 -
ccacatgcataagctttaaaat

SEQ ID NO: 125687 - DNA, 22 bp, Artificial Sequence
  Synthetic oligonucleotide; TTC chr11 5328552 5328573 5328557 5328552 -
cacatgcataagctttaaaatg

SEQ ID NO: 125688 - DNA, 22 bp, Artificial Sequence
  Synthetic oligonucleotide; CTT chr11 5328537 5328558 5328542 5328537 -
taaaatgaggcctcatgagagg

SEQ ID NO: 125689 - DNA, 22 bp, Artificial Sequence
  Synthetic oligonucleotide; TTT chr11 5328536 5328557 5328541 5328536 -
aaaatgaggcctcatgagaggt

SEQ ID NO: 125690 - DNA, 22 bp, Artificial Sequence
  Synthetic oligonucleotide; TTA chr11 5328535 5328556 5328540 5328535 -
aaatgaggcctcatgagaggtc

SEQ ID NO: 125691 - DNA, 22 bp, Artificial Sequence
  Synthetic oligonucleotide; CTC chr11 5328523 5328544 5328528 5328523 -
atgagaggtctgtgagtgaatg

SEQ ID NO: 125692 - DNA, 22 bp, Artificial Sequence
  Synthetic oligonucleotide; CTG chr11 5328511 5328532 5328516 5328511 -
tgagtgaatgatctgaactgag

SEQ ID NO: 125693 - DNA, 22 bp, Artificial Sequence
  Synthetic oligonucleotide; CTG chr11 5328496 5328517 5328501 5328496 -
aactgagtcctcaaagaggaca

SEQ ID NO: 125694 - DNA, 22 bp, Artificial Sequence
  Synthetic oligonucleotide; CTG chr11 5328491 5328512 5328496 5328491 -
agtcctcaaagaggacaggaat

SEQ ID NO: 125695 - DNA, 22 bp, Artificial Sequence
  Synthetic oligonucleotide; CTC chr11 5328484 5328505 5328489 5328484 -
aaagaggacaggaataggttcc

SEQ ID NO: 125696 - DNA, 22 bp, Artificial Sequence
  Synthetic oligonucleotide; TTC chr11 5328463 5328484 5328468 5328463 -
ctattttagccacaatactgtg

SEQ ID NO: 125697 - DNA, 22 bp, Artificial Sequence
  Synthetic oligonucleotide; CTA chr11 5328460 5328481 5328465 5328460 -
ttttagccacaatactgtgagt

SEQ ID NO: 125698 - DNA, 22 bp, Artificial Sequence
  Synthetic oligonucleotide; TTT chr11 5328457 5328478 5328462 5328457 -
tagccacaatactgtgagtggg

SEQ ID NO: 125699 - DNA, 22 bp, Artificial Sequence
  Synthetic oligonucleotide; TTT chr11 5328456 5328477 5328461 5328456 -
agccacaatactgtgagtgggt

SEQ ID NO: 125700 - DNA, 22 bp, Artificial Sequence
  Synthetic oligonucleotide; TTA chr11 5328455 5328476 5328460 5328455 -
gccacaatactgtgagtgggtg

SEQ ID NO: 125701 - DNA, 22 bp, Artificial Sequence
  Synthetic oligonucleotide; CTG chr11 5328443 5328464 5328448 5328443 -
tgagtgggtgagtgccaggaac

SEQ ID NO: 125702 - DNA, 22 bp, Artificial Sequence
  Synthetic oligonucleotide; CTT chr11 5328419 5328440 5328424 5328419 -
gaatatggaatgattcctctct

SEQ ID NO: 125703 - DNA, 22 bp, Artificial Sequence
  Synthetic oligonucleotide; TTG chr11 5328418 5328439 5328423 5328418 -
aatatggaatgattcctctctc

SEQ ID NO: 125704 - DNA, 22 bp, Artificial Sequence
  Synthetic oligonucleotide; TTC chr11 5328403 5328424 5328408 5328403 -
ctctctcttctgatgtgagatg

SEQ ID NO: 125705 - DNA, 22 bp, Artificial Sequence
  Synthetic oligonucleotide; CTC chr11 5328400 5328421 5328405 5328400 -
tctcttctgatgtgagatgcac

SEQ ID NO: 125706 - DNA, 22 bp, Artificial Sequence
  Synthetic oligonucleotide; CTC chr11 5328398 5328419 5328403 5328398 -
tcttctgatgtgagatgcactc

SEQ ID NO: 125707 - DNA, 22 bp, Artificial Sequence
  Synthetic oligonucleotide; CTC chr11 5328396 5328417 5328401 5328396 -
ttctgatgtgagatgcactcaa

SEQ ID NO: 125708 - DNA, 22 bp, Artificial Sequence
  Synthetic oligonucleotide; CTT chr11 5328394 5328415 5328399 5328394 -
ctgatgtgagatgcactcaagg

SEQ ID NO: 125709 - DNA, 22 bp, Artificial Sequence
  Synthetic oligonucleotide; TTC chr11 5328393 5328414 5328398 5328393 -
tgatgtgagatgcactcaagga

SEQ ID NO: 125710 - DNA, 22 bp, Artificial Sequence
  Synthetic oligonucleotide; CTG chr11 5328391 5328412 5328396 5328391 -
atgtgagatgcactcaaggaaa

SEQ ID NO: 125711 - DNA, 22 bp, Artificial Sequence
  Synthetic oligonucleotide; CTC chr11 5328376 5328397 5328381 5328376 -
aaggaaagcatataagaaggtt

SEQ ID NO: 125712 - DNA, 22 bp, Artificial Sequence
  Synthetic oligonucleotide; TTT chr11 5328353 5328374 5328358 5328353 -
tccagaggtctgcctagaggta

SEQ ID NO: 125713 - DNA, 22 bp, Artificial Sequence
  Synthetic oligonucleotide; TTT chr11 5328352 5328373 5328357 5328352 -
ccagaggtctgcctagaggtaa

SEQ ID NO: 125714 - DNA, 22 bp, Artificial Sequence
  Synthetic oligonucleotide; TTC chr11 5328351 5328372 5328356 5328351 -
cagaggtctgcctagaggtaaa

SEQ ID NO: 125715 - DNA, 22 bp, Artificial Sequence
  Synthetic oligonucleotide; CTG chr11 5328341 5328362 5328346 5328341 -
cctagaggtaaagatcacagct

SEQ ID NO: 125716 - DNA, 22 bp, Artificial Sequence
  Synthetic oligonucleotide; CTA chr11 5328337 5328358 5328342 5328337 -
gaggtaaagatcacagctgagg

SEQ ID NO: 125717 - DNA, 22 bp, Artificial Sequence
  Synthetic oligonucleotide; CTG chr11 5328318 5328339 5328323 5328318 -
aggtgggatatcctacagcaca

SEQ ID NO: 125718 - DNA, 22 bp, Artificial Sequence
  Synthetic oligonucleotide; CTA chr11 5328303 5328324 5328308 5328303 -
cagcacagatttttttttttct

SEQ ID NO: 125719 - DNA, 22 bp, Artificial Sequence
  Synthetic oligonucleotide; TTT chr11 5328291 5328312 5328296 5328291 -
ttttttttcttttttgaaagag

SEQ ID NO: 125720 - DNA, 22 bp, Artificial Sequence
  Synthetic oligonucleotide; TTT chr11 5328290 5328311 5328295 5328290 -
tttttttcttttttgaaagagt

SEQ ID NO: 125721 - DNA, 22 bp, Artificial Sequence
  Synthetic oligonucleotide; TTT chr11 5328289 5328310 5328294 5328289 -
ttttttcttttttgaaagagta

SEQ ID NO: 125722 - DNA, 22 bp, Artificial Sequence
  Synthetic oligonucleotide; TTT chr11 5328288 5328309 5328293 5328288 -
tttttcttttttgaaagagtat

SEQ ID NO: 125723 - DNA, 22 bp, Artificial Sequence
  Synthetic oligonucleotide; TTT chr11 5328287 5328308 5328292 5328287 -
ttttcttttttgaaagagtatt

SEQ ID NO: 125724 - DNA, 22 bp, Artificial Sequence
  Synthetic oligonucleotide; TTT chr11 5328286 5328307 5328291 5328286 -
tttcttttttgaaagagtattt

SEQ ID NO: 125725 - DNA, 22 bp, Artificial Sequence
  Synthetic oligonucleotide; TTT chr11 5328285 5328306 5328290 5328285 -
ttcttttttgaaagagtattta

SEQ ID NO: 125726 - DNA, 22 bp, Artificial Sequence
  Synthetic oligonucleotide; TTT chr11 5328284 5328305 5328289 5328284 -
tcttttttgaaagagtatttaa

SEQ ID NO: 125727 - DNA, 22 bp, Artificial Sequence
  Synthetic oligonucleotide; TTT chr11 5328283 5328304 5328288 5328283 -
cttttttgaaagagtatttaag

SEQ ID NO: 125728 - DNA, 22 bp, Artificial Sequence
  Synthetic oligonucleotide; TTC chr11 5328282 5328303 5328287 5328282 -
ttttttgaaagagtatttaagg

SEQ ID NO: 125729 - DNA, 22 bp, Artificial Sequence
  Synthetic oligonucleotide; CTT chr11 5328280 5328301 5328285 5328280 -
ttttgaaagagtatttaaggaa

SEQ ID NO: 125730 - DNA, 22 bp, Artificial Sequence
  Synthetic oligonucleotide; TTT chr11 5328279 5328300 5328284 5328279 -
tttgaaagagtatttaaggaac

SEQ ID NO: 125731 - DNA, 22 bp, Artificial Sequence
  Synthetic oligonucleotide; TTT chr11 5328278 5328299 5328283 5328278 -
ttgaaagagtatttaaggaact

SEQ ID NO: 125732 - DNA, 22 bp, Artificial Sequence
  Synthetic oligonucleotide; TTT chr11 5328277 5328298 5328282 5328277 -
tgaaagagtatttaaggaactg

SEQ ID NO: 125733 - DNA, 22 bp, Artificial Sequence
  Synthetic oligonucleotide; TTT chr11 5328276 5328297 5328281 5328276 -
gaaagagtatttaaggaactgt

SEQ ID NO: 125734 - DNA, 22 bp, Artificial Sequence
  Synthetic oligonucleotide; TTG chr11 5328275 5328296 5328280 5328275 -
aaagagtatttaaggaactgtg

SEQ ID NO: 125735 - DNA, 22 bp, Artificial Sequence
  Synthetic oligonucleotide; TTT chr11 5328264 5328285 5328269 5328264 -
aaggaactgtgatagatttagg

SEQ ID NO: 125736 - DNA, 22 bp, Artificial Sequence
  Synthetic oligonucleotide; TTA chr11 5328263 5328284 5328268 5328263 -
aggaactgtgatagatttaggt

SEQ ID NO: 125737 - DNA, 22 bp, Artificial Sequence
  Synthetic oligonucleotide; CTG chr11 5328255 5328276 5328260 5328255 -
tgatagatttaggttttctaat

SEQ ID NO: 125738 - DNA, 22 bp, Artificial Sequence
  Synthetic oligonucleotide; TTT chr11 5328245 5328266 5328250 5328245 -
aggttttctaatctgggaccct

SEQ ID NO: 125739 - DNA, 22 bp, Artificial Sequence
  Synthetic oligonucleotide; TTA chr11 5328244 5328265 5328249 5328244 -
ggttttctaatctgggaccctt

SEQ ID NO: 125740 - DNA, 22 bp, Artificial Sequence
  Synthetic oligonucleotide; TTT chr11 5328239 5328260 5328244 5328239 -
tctaatctgggacccttggatt

SEQ ID NO: 125741 - DNA, 22 bp, Artificial Sequence
  Synthetic oligonucleotide; TTT chr11 5328238 5328259 5328243 5328238 -
ctaatctgggacccttggattg

SEQ ID NO: 125742 - DNA, 22 bp, Artificial Sequence
  Synthetic oligonucleotide; TTC chr11 5328237 5328258 5328242 5328237 -
taatctgggacccttggattgg

SEQ ID NO: 125743 - DNA, 22 bp, Artificial Sequence
  Synthetic oligonucleotide; CTA chr11 5328235 5328256 5328240 5328235 -
atctgggacccttggattggca

SEQ ID NO: 125744 - DNA, 22 bp, Artificial Sequence
  Synthetic oligonucleotide; CTG chr11 5328230 5328251 5328235 5328230 -
ggacccttggattggcataagt

SEQ ID NO: 125745 - DNA, 22 bp, Artificial Sequence
  Synthetic oligonucleotide; CTT chr11 5328222 5328243 5328227 5328222 -
ggattggcataagtataattgt

SEQ ID NO: 125746 - DNA, 22 bp, Artificial Sequence
  Synthetic oligonucleotide; TTG chr11 5328221 5328242 5328226 5328221 -
gattggcataagtataattgtt

SEQ ID NO: 125747 - DNA, 22 bp, Artificial Sequence
  Synthetic oligonucleotide; TTG chr11 5328216 5328237 5328221 5328216 -
gcataagtataattgttaatgc

SEQ ID NO: 125748 - DNA, 22 bp, Artificial Sequence
  Synthetic oligonucleotide; TTG chr11 5328201 5328222 5328206 5328201 -
ttaatgctcagaactgcatgtg

SEQ ID NO: 125749 - DNA, 22 bp, Artificial Sequence
  Synthetic oligonucleotide; TTA chr11 5328198 5328219 5328203 5328198 -
atgctcagaactgcatgtgtca

SEQ ID NO: 125750 - DNA, 22 bp, Artificial Sequence
  Synthetic oligonucleotide; CTC chr11 5328192 5328213 5328197 5328192 -
agaactgcatgtgtcattgtgc

SEQ ID NO: 125751 - DNA, 22 bp, Artificial Sequence
  Synthetic oligonucleotide; CTG chr11 5328185 5328206 5328190 5328185 -
catgtgtcattgtgcattctta

SEQ ID NO: 125752 - DNA, 22 bp, Artificial Sequence
  Synthetic oligonucleotide; TTG chr11 5328173 5328194 5328178 5328173 -
tgcattcttactcatttttcta

SEQ ID NO: 125753 - DNA, 22 bp, Artificial Sequence
  Synthetic oligonucleotide; TTC chr11 5328166 5328187 5328171 5328166 -
ttactcatttttctatgtagat

SEQ ID NO: 125754 - DNA, 22 bp, Artificial Sequence
  Synthetic oligonucleotide; CTT chr11 5328164 5328185 5328169 5328164 -
actcatttttctatgtagatgt

SEQ ID NO: 125755 - DNA, 22 bp, Artificial Sequence
  Synthetic oligonucleotide; TTA chr11 5328163 5328184 5328168 5328163 -
ctcatttttctatgtagatgtt

SEQ ID NO: 125756 - DNA, 22 bp, Artificial Sequence
  Synthetic oligonucleotide; CTC chr11 5328160 5328181 5328165 5328160 -
atttttctatgtagatgtttat

SEQ ID NO: 125757 - DNA, 22 bp, Artificial Sequence
  Synthetic oligonucleotide; TTT chr11 5328156 5328177 5328161 5328156 -
ttctatgtagatgtttatagct

SEQ ID NO: 125758 - DNA, 22 bp, Artificial Sequence
  Synthetic oligonucleotide; TTT chr11 5328155 5328176 5328160 5328155 -
tctatgtagatgtttatagctt

SEQ ID NO: 125759 - DNA, 22 bp, Artificial Sequence
  Synthetic oligonucleotide; TTT chr11 5328154 5328175 5328159 5328154 -
ctatgtagatgtttatagcttt

SEQ ID NO: 125760 - DNA, 22 bp, Artificial Sequence
  Synthetic oligonucleotide; TTC chr11 5328153 5328174 5328158 5328153 -
tatgtagatgtttatagctttt

SEQ ID NO: 125761 - DNA, 22 bp, Artificial Sequence
  Synthetic oligonucleotide; CTA chr11 5328151 5328172 5328156 5328151 -
tgtagatgtttatagctttttt

SEQ ID NO: 125762 - DNA, 22 bp, Artificial Sequence
  Synthetic oligonucleotide; TTT chr11 5328140 5328161 5328145 5328140 -
atagcttttttttcagagaata

SEQ ID NO: 125763 - DNA, 22 bp, Artificial Sequence
  Synthetic oligonucleotide; TTA chr11 5328139 5328160 5328144 5328139 -
tagcttttttttcagagaatat

SEQ ID NO: 125764 - DNA, 22 bp, Artificial Sequence
  Synthetic oligonucleotide; CTT chr11 5328133 5328154 5328138 5328133 -
ttttttcagagaatatttcttc

SEQ ID NO: 125765 - DNA, 22 bp, Artificial Sequence
  Synthetic oligonucleotide; TTT chr11 5328132 5328153 5328137 5328132 -
tttttcagagaatatttcttca

SEQ ID NO: 125766 - DNA, 22 bp, Artificial Sequence
  Synthetic oligonucleotide; TTT chr11 5328131 5328152 5328136 5328131 -
ttttcagagaatatttcttcat

SEQ ID NO: 125767 - DNA, 22 bp, Artificial Sequence
  Synthetic oligonucleotide; TTT chr11 5328130 5328151 5328135 5328130 -
tttcagagaatatttcttcatt

SEQ ID NO: 125768 - DNA, 22 bp, Artificial Sequence
  Synthetic oligonucleotide; TTT chr11 5328129 5328150 5328134 5328129 -
ttcagagaatatttcttcattc

SEQ ID NO: 125769 - DNA, 22 bp, Artificial Sequence
  Synthetic oligonucleotide; TTT chr11 5328128 5328149 5328133 5328128 -
tcagagaatatttcttcattcc

SEQ ID NO: 125770 - DNA, 22 bp, Artificial Sequence
  Synthetic oligonucleotide; TTT chr11 5328127 5328148 5328132 5328127 -
cagagaatatttcttcattcca

SEQ ID NO: 125771 - DNA, 22 bp, Artificial Sequence
  Synthetic oligonucleotide; TTC chr11 5328126 5328147 5328131 5328126 -
agagaatatttcttcattccaa

SEQ ID NO: 125772 - DNA, 22 bp, Artificial Sequence
  Synthetic oligonucleotide; TTT chr11 5328115 5328136 5328120 5328115 -
cttcattccaaaacagctttgt

SEQ ID NO: 125773 - DNA, 22 bp, Artificial Sequence
  Synthetic oligonucleotide; TTC chr11 5328114 5328135 5328119 5328114 -
ttcattccaaaacagctttgtt

SEQ ID NO: 125774 - DNA, 22 bp, Artificial Sequence
  Synthetic oligonucleotide; CTT chr11 5328112 5328133 5328117 5328112 -
cattccaaaacagctttgttat

SEQ ID NO: 125775 - DNA, 22 bp, Artificial Sequence
  Synthetic oligonucleotide; TTC chr11 5328111 5328132 5328116 5328111 -
attccaaaacagctttgttatc

SEQ ID NO: 125776 - DNA, 22 bp, Artificial Sequence
  Synthetic oligonucleotide; TTC chr11 5328107 5328128 5328112 5328107 -
caaaacagctttgttatcactc

SEQ ID NO: 125777 - DNA, 22 bp, Artificial Sequence
  Synthetic oligonucleotide; CTT chr11 5328096 5328117 5328101 5328096 -
tgttatcactcacctcctttgt

SEQ ID NO: 125778 - DNA, 22 bp, Artificial Sequence
  Synthetic oligonucleotide; TTT chr11 5328095 5328116 5328100 5328095 -
gttatcactcacctcctttgtt

SEQ ID NO: 125779 - DNA, 22 bp, Artificial Sequence
  Synthetic oligonucleotide; TTG chr11 5328094 5328115 5328099 5328094 -
ttatcactcacctcctttgttc

SEQ ID NO: 125780 - DNA, 22 bp, Artificial Sequence
  Synthetic oligonucleotide; TTA chr11 5328091 5328112 5328096 5328091 -
tcactcacctcctttgttcagt

SEQ ID NO: 125781 - DNA, 22 bp, Artificial Sequence
  Synthetic oligonucleotide; CTC chr11 5328085 5328106 5328090 5328085 -
acctcctttgttcagttattgg

SEQ ID NO: 125782 - DNA, 22 bp, Artificial Sequence
  Synthetic oligonucleotide; CTC chr11 5328080 5328101 5328085 5328080 -
ctttgttcagttattggtaaat

SEQ ID NO: 125783 - DNA, 22 bp, Artificial Sequence
  Synthetic oligonucleotide; CTT chr11 5328077 5328098 5328082 5328077 -
tgttcagttattggtaaatata

SEQ ID NO: 125784 - DNA, 22 bp, Artificial Sequence
  Synthetic oligonucleotide; TTT chr11 5328076 5328097 5328081 5328076 -
gttcagttattggtaaatatat

SEQ ID NO: 125785 - DNA, 22 bp, Artificial Sequence
  Synthetic oligonucleotide; TTG chr11 5328075 5328096 5328080 5328075 -
ttcagttattggtaaatatatt

SEQ ID NO: 125786 - DNA, 22 bp, Artificial Sequence
  Synthetic oligonucleotide; TTC chr11 5328072 5328093 5328077 5328072 -
agttattggtaaatatattaca

SEQ ID NO: 125787 - DNA, 22 bp, Artificial Sequence
  Synthetic oligonucleotide; TTA chr11 5328067 5328088 5328072 5328067 -
ttggtaaatatattacatttat

SEQ ID NO: 125788 - DNA, 22 bp, Artificial Sequence
  Synthetic oligonucleotide; TTG chr11 5328064 5328085 5328069 5328064 -
gtaaatatattacatttatatt

SEQ ID NO: 125789 - DNA, 22 bp, Artificial Sequence
  Synthetic oligonucleotide; TTA chr11 5328052 5328073 5328057 5328052 -
catttatatttgtaatagttcc

SEQ ID NO: 125790 - DNA, 22 bp, Artificial Sequence
  Synthetic oligonucleotide; TTT chr11 5328047 5328068 5328052 5328047 -
atatttgtaatagttccagcaa

SEQ ID NO: 125791 - DNA, 22 bp, Artificial Sequence
  Synthetic oligonucleotide; TTA chr11 5328046 5328067 5328051 5328046 -
tatttgtaatagttccagcaat

SEQ ID NO: 125792 - DNA, 22 bp, Artificial Sequence
  Synthetic oligonucleotide; TTT chr11 5328041 5328062 5328046 5328041 -
gtaatagttccagcaatgcaat

SEQ ID NO: 125793 - DNA, 22 bp, Artificial Sequence
  Synthetic oligonucleotide; TTG chr11 5328040 5328061 5328045 5328040 -
taatagttccagcaatgcaatt

SEQ ID NO: 125794 - DNA, 22 bp, Artificial Sequence
  Synthetic oligonucleotide; TTC chr11 5328031 5328052 5328036 5328031 -
cagcaatgcaattctatttttt

SEQ ID NO: 125795 - DNA, 22 bp, Artificial Sequence
  Synthetic oligonucleotide; TTC chr11 5328017 5328038 5328022 5328017 -
tattttttattgtaatacattc

SEQ ID NO: 125796 - DNA, 22 bp, Artificial Sequence
  Synthetic oligonucleotide; CTA chr11 5328015 5328036 5328020 5328015 -
ttttttattgtaatacattcat

SEQ ID NO: 125797 - DNA, 22 bp, Artificial Sequence
  Synthetic oligonucleotide; TTT chr11 5328012 5328033 5328017 5328012 -
tttattgtaatacattcatttt

SEQ ID NO: 125798 - DNA, 22 bp, Artificial Sequence
  Synthetic oligonucleotide; TTT chr11 5328011 5328032 5328016 5328011 -
ttattgtaatacattcattttt

SEQ ID NO: 125799 - DNA, 22 bp, Artificial Sequence
  Synthetic oligonucleotide; TTT chr11 5328010 5328031 5328015 5328010 -
tattgtaatacattcatttttg

SEQ ID NO: 125800 - DNA, 22 bp, Artificial Sequence
  Synthetic oligonucleotide; TTT chr11 5328009 5328030 5328014 5328009 -
attgtaatacattcatttttga

SEQ ID NO: 125801 - DNA, 22 bp, Artificial Sequence
  Synthetic oligonucleotide; TTA chr11 5328008 5328029 5328013 5328008 -
ttgtaatacattcatttttgaa

SEQ ID NO: 125802 - DNA, 22 bp, Artificial Sequence
  Synthetic oligonucleotide; TTG chr11 5328005 5328026 5328010 5328005 -
taatacattcatttttgaaaat

SEQ ID NO: 125803 - DNA, 22 bp, Artificial Sequence
  Synthetic oligonucleotide; TTC chr11 5327995 5328016 5328000 5327995 -
atttttgaaaataagaagcaga

SEQ ID NO: 125804 - DNA, 22 bp, Artificial Sequence
  Synthetic oligonucleotide; TTT chr11 5327991 5328012 5327996 5327991 -
ttgaaaataagaagcagaaagg

SEQ ID NO: 125805 - DNA, 22 bp, Artificial Sequence
  Synthetic oligonucleotide; TTT chr11 5327990 5328011 5327995 5327990 -
tgaaaataagaagcagaaagga

SEQ ID NO: 125806 - DNA, 22 bp, Artificial Sequence
  Synthetic oligonucleotide; TTT chr11 5327989 5328010 5327994 5327989 -
gaaaataagaagcagaaaggaa

SEQ ID NO: 125807 - DNA, 22 bp, Artificial Sequence
  Synthetic oligonucleotide; TTG chr11 5327988 5328009 5327993 5327988 -
aaaataagaagcagaaaggaat

SEQ ID NO: 125808 - DNA, 22 bp, Artificial Sequence
  Synthetic oligonucleotide; CTT chr11 5327948 5327969 5327953 5327948 -
ctataatgacatgactatcttt

SEQ ID NO: 125809 - DNA, 22 bp, Artificial Sequence
  Synthetic oligonucleotide; TTC chr11 5327947 5327968 5327952 5327947 -
tataatgacatgactatcttta

SEQ ID NO: 125810 - DNA, 22 bp, Artificial Sequence
  Synthetic oligonucleotide; CTA chr11 5327945 5327966 5327950 5327945 -
taatgacatgactatctttact

SEQ ID NO: 125811 - DNA, 22 bp, Artificial Sequence
  Synthetic oligonucleotide; CTA chr11 5327931 5327952 5327936 5327931 -
tctttactggtgcttttgtcat

SEQ ID NO: 125812 - DNA, 22 bp, Artificial Sequence
  Synthetic oligonucleotide; CTT chr11 5327927 5327948 5327932 5327927 -
tactggtgcttttgtcatttta

SEQ ID NO: 125813 - DNA, 22 bp, Artificial Sequence
  Synthetic oligonucleotide; TTT chr11 5327926 5327947 5327931 5327926 -
actggtgcttttgtcattttat

SEQ ID NO: 125814 - DNA, 22 bp, Artificial Sequence
  Synthetic oligonucleotide; TTA chr11 5327925 5327946 5327930 5327925 -
ctggtgcttttgtcattttatg

SEQ ID NO: 125815 - DNA, 22 bp, Artificial Sequence
  Synthetic oligonucleotide; CTG chr11 5327922 5327943 5327927 5327922 -
gtgcttttgtcattttatgtag

SEQ ID NO: 125816 - DNA, 22 bp, Artificial Sequence
  Synthetic oligonucleotide; CTT chr11 5327916 5327937 5327921 5327916 -
ttgtcattttatgtagattcaa

SEQ ID NO: 125817 - DNA, 22 bp, Artificial Sequence
  Synthetic oligonucleotide; TTT chr11 5327915 5327936 5327920 5327915 -
tgtcattttatgtagattcaaa

SEQ ID NO: 125818 - DNA, 22 bp, Artificial Sequence
  Synthetic oligonucleotide; TTT chr11 5327914 5327935 5327919 5327914 -
gtcattttatgtagattcaaat

SEQ ID NO: 125819 - DNA, 22 bp, Artificial Sequence
  Synthetic oligonucleotide; TTG chr11 5327913 5327934 5327918 5327913 -
tcattttatgtagattcaaatg

SEQ ID NO: 125820 - DNA, 22 bp, Artificial Sequence
  Synthetic oligonucleotide; TTT chr11 5327907 5327928 5327912 5327907 -
tatgtagattcaaatgatcatc

SEQ ID NO: 125821 - DNA, 22 bp, Artificial Sequence
  Synthetic oligonucleotide; TTT chr11 5327906 5327927 5327911 5327906 -
atgtagattcaaatgatcatct

SEQ ID NO: 125822 - DNA, 22 bp, Artificial Sequence
  Synthetic oligonucleotide; TTA chr11 5327905 5327926 5327910 5327905 -
tgtagattcaaatgatcatctt

SEQ ID NO: 125823 - DNA, 22 bp, Artificial Sequence
  Synthetic oligonucleotide; TTC chr11 5327896 5327917 5327901 5327896 -
aaatgatcatctttggtcattt

SEQ ID NO: 125824 - DNA, 22 bp, Artificial Sequence
  Synthetic oligonucleotide; CTT chr11 5327883 5327904 5327888 5327883 -
tggtcatttggtttcaacttag

SEQ ID NO: 125825 - DNA, 22 bp, Artificial Sequence
  Synthetic oligonucleotide; TTT chr11 5327882 5327903 5327887 5327882 -
ggtcatttggtttcaacttagt

SEQ ID NO: 125826 - DNA, 22 bp, Artificial Sequence
  Synthetic oligonucleotide; TTG chr11 5327881 5327902 5327886 5327881 -
gtcatttggtttcaacttagtt

SEQ ID NO: 125827 - DNA, 22 bp, Artificial Sequence
  Synthetic oligonucleotide; TTT chr11 5327874 5327895 5327879 5327874 -
ggtttcaacttagttgaaatca

SEQ ID NO: 125828 - DNA, 22 bp, Artificial Sequence
  Synthetic oligonucleotide; TTG chr11 5327873 5327894 5327878 5327873 -
gtttcaacttagttgaaatcaa

SEQ ID NO: 125829 - DNA, 22 bp, Artificial Sequence
  Synthetic oligonucleotide; TTT chr11 5327869 5327890 5327874 5327869 -
caacttagttgaaatcaactca

SEQ ID NO: 125830 - DNA, 22 bp, Artificial Sequence
  Synthetic oligonucleotide; TTC chr11 5327868 5327889 5327873 5327868 -
aacttagttgaaatcaactcag

SEQ ID NO: 125831 - DNA, 22 bp, Artificial Sequence
  Synthetic oligonucleotide; CTT chr11 5327863 5327884 5327868 5327863 -
agttgaaatcaactcagttttt

SEQ ID NO: 125832 - DNA, 22 bp, Artificial Sequence
  Synthetic oligonucleotide; TTA chr11 5327862 5327883 5327867 5327862 -
gttgaaatcaactcagtttttg

SEQ ID NO: 125833 - DNA, 22 bp, Artificial Sequence
  Synthetic oligonucleotide; TTG chr11 5327858 5327879 5327863 5327858 -
aaatcaactcagtttttgttta

SEQ ID NO: 125834 - DNA, 22 bp, Artificial Sequence
  Synthetic oligonucleotide; CTC chr11 5327848 5327869 5327853 5327848 -
agtttttgtttatccagaaagg

SEQ ID NO: 125835 - DNA, 22 bp, Artificial Sequence
  Synthetic oligonucleotide; TTT chr11 5327843 5327864 5327848 5327843 -
ttgtttatccagaaagggctta

SEQ ID NO: 125836 - DNA, 22 bp, Artificial Sequence
  Synthetic oligonucleotide; TTT chr11 5327842 5327863 5327847 5327842 -
tgtttatccagaaagggcttat

SEQ ID NO: 125837 - DNA, 22 bp, Artificial Sequence
  Synthetic oligonucleotide; TTT chr11 5327841 5327862 5327846 5327841 -
gtttatccagaaagggcttatt

SEQ ID NO: 125838 - DNA, 22 bp, Artificial Sequence
  Synthetic oligonucleotide; TTG chr11 5327840 5327861 5327845 5327840 -
tttatccagaaagggcttattt

SEQ ID NO: 125839 - DNA, 22 bp, Artificial Sequence
  Synthetic oligonucleotide; TTT chr11 5327837 5327858 5327842 5327837 -
atccagaaagggcttattttac

SEQ ID NO: 125840 - DNA, 22 bp, Artificial Sequence
  Synthetic oligonucleotide; TTA chr11 5327836 5327857 5327841 5327836 -
tccagaaagggcttattttacg

SEQ ID NO: 125841 - DNA, 22 bp, Artificial Sequence
  Synthetic oligonucleotide; CTT chr11 5327822 5327843 5327827 5327822 -
attttacgtttattttttattg

SEQ ID NO: 125842 - DNA, 22 bp, Artificial Sequence
  Synthetic oligonucleotide; TTA chr11 5327821 5327842 5327826 5327821 -
ttttacgtttattttttattga

SEQ ID NO: 125843 - DNA, 22 bp, Artificial Sequence
  Synthetic oligonucleotide; TTT chr11 5327818 5327839 5327823 5327818 -
tacgtttattttttattgataa

SEQ ID NO: 125844 - DNA, 22 bp, Artificial Sequence
  Synthetic oligonucleotide; TTT chr11 5327817 5327838 5327822 5327817 -
acgtttattttttattgataac

SEQ ID NO: 125845 - DNA, 22 bp, Artificial Sequence
  Synthetic oligonucleotide; TTA chr11 5327816 5327837 5327821 5327816 -
cgtttattttttattgataact

SEQ ID NO: 125846 - DNA, 22 bp, Artificial Sequence
  Synthetic oligonucleotide; TTT chr11 5327811 5327832 5327816 5327811 -
attttttattgataactttcct

SEQ ID NO: 125847 - DNA, 22 bp, Artificial Sequence
  Synthetic oligonucleotide; TTA chr11 5327810 5327831 5327815 5327810 -
ttttttattgataactttcctg

SEQ ID NO: 125848 - DNA, 22 bp, Artificial Sequence
  Synthetic oligonucleotide; TTT chr11 5327807 5327828 5327812 5327807 -
tttattgataactttcctgttc

SEQ ID NO: 125849 - DNA, 22 bp, Artificial Sequence
  Synthetic oligonucleotide; TTT chr11 5327806 5327827 5327811 5327806 -
ttattgataactttcctgttca

SEQ ID NO: 125850 - DNA, 22 bp, Artificial Sequence
  Synthetic oligonucleotide; TTT chr11 5327805 5327826 5327810 5327805 -
tattgataactttcctgttcag

SEQ ID NO: 125851 - DNA, 22 bp, Artificial Sequence
  Synthetic oligonucleotide; TTT chr11 5327804 5327825 5327809 5327804 -
attgataactttcctgttcaga

SEQ ID NO: 125852 - DNA, 22 bp, Artificial Sequence
  Synthetic oligonucleotide; TTA chr11 5327803 5327824 5327808 5327803 -
ttgataactttcctgttcagag

SEQ ID NO: 125853 - DNA, 22 bp, Artificial Sequence
  Synthetic oligonucleotide; TTG chr11 5327800 5327821 5327805 5327800 -
ataactttcctgttcagaggat

SEQ ID NO: 125854 - DNA, 22 bp, Artificial Sequence
  Synthetic oligonucleotide; CTT chr11 5327793 5327814 5327798 5327793 -
tcctgttcagaggattttttgt

SEQ ID NO: 125855 - DNA, 22 bp, Artificial Sequence
  Synthetic oligonucleotide; TTT chr11 5327792 5327813 5327797 5327792 -
cctgttcagaggattttttgtt

SEQ ID NO: 125856 - DNA, 22 bp, Artificial Sequence
  Synthetic oligonucleotide; TTC chr11 5327791 5327812 5327796 5327791 -
ctgttcagaggattttttgttg

SEQ ID NO: 125857 - DNA, 22 bp, Artificial Sequence
  Synthetic oligonucleotide; CTG chr11 5327788 5327809 5327793 5327788 -
ttcagaggattttttgttgata

SEQ ID NO: 125858 - DNA, 22 bp, Artificial Sequence
  Synthetic oligonucleotide; TTC chr11 5327785 5327806 5327790 5327785 -
agaggattttttgttgatagtt

SEQ ID NO: 125859 - DNA, 22 bp, Artificial Sequence
  Synthetic oligonucleotide; TTT chr11 5327776 5327797 5327781 5327776 -
tttgttgatagtttttctctga

SEQ ID NO: 125860 - DNA, 22 bp, Artificial Sequence
  Synthetic oligonucleotide; TTT chr11 5327775 5327796 5327780 5327775 -
ttgttgatagtttttctctgaa

SEQ ID NO: 125861 - DNA, 22 bp, Artificial Sequence
  Synthetic oligonucleotide; TTT chr11 5327774 5327795 5327779 5327774 -
tgttgatagtttttctctgaag

SEQ ID NO: 125862 - DNA, 22 bp, Artificial Sequence
  Synthetic oligonucleotide; TTT chr11 5327773 5327794 5327778 5327773 -
gttgatagtttttctctgaaga

SEQ ID NO: 125863 - DNA, 22 bp, Artificial Sequence
  Synthetic oligonucleotide; TTG chr11 5327772 5327793 5327777 5327772 -
ttgatagtttttctctgaagag

SEQ ID NO: 125864 - DNA, 22 bp, Artificial Sequence
  Synthetic oligonucleotide; TTG chr11 5327769 5327790 5327774 5327769 -
atagtttttctctgaagagtag

SEQ ID NO: 125865 - DNA, 22 bp, Artificial Sequence
  Synthetic oligonucleotide; TTT chr11 5327762 5327783 5327767 5327762 -
ttctctgaagagtagacaaaaa

SEQ ID NO: 125866 - DNA, 22 bp, Artificial Sequence
  Synthetic oligonucleotide; TTT chr11 5327761 5327782 5327766 5327761 -
tctctgaagagtagacaaaaaa

SEQ ID NO: 125867 - DNA, 22 bp, Artificial Sequence
  Synthetic oligonucleotide; TTT chr11 5327760 5327781 5327765 5327760 -
ctctgaagagtagacaaaaaat

SEQ ID NO: 125868 - DNA, 22 bp, Artificial Sequence
  Synthetic oligonucleotide; TTC chr11 5327759 5327780 5327764 5327759 -
tctgaagagtagacaaaaaatt

SEQ ID NO: 125869 - DNA, 22 bp, Artificial Sequence
  Synthetic oligonucleotide; CTC chr11 5327757 5327778 5327762 5327757 -
tgaagagtagacaaaaaattct

SEQ ID NO: 125870 - DNA, 22 bp, Artificial Sequence
  Synthetic oligonucleotide; CTG chr11 5327755 5327776 5327760 5327755 -
aagagtagacaaaaaattctga

SEQ ID NO: 125871 - DNA, 22 bp, Artificial Sequence
  Synthetic oligonucleotide; TTC chr11 5327736 5327757 5327741 5327736 -
tgaatcgagttgaaaggcttag

SEQ ID NO: 125872 - DNA, 22 bp, Artificial Sequence
  Synthetic oligonucleotide; CTG chr11 5327734 5327755 5327739 5327734 -
aatcgagttgaaaggcttagaa

SEQ ID NO: 125873 - DNA, 22 bp, Artificial Sequence
  Synthetic oligonucleotide; TTG chr11 5327724 5327745 5327729 5327724 -
aaaggcttagaaaagggcagcc

SEQ ID NO: 125874 - DNA, 22 bp, Artificial Sequence
  Synthetic oligonucleotide; CTT chr11 5327716 5327737 5327721 5327716 -
agaaaagggcagccaaattaag

SEQ ID NO: 125875 - DNA, 22 bp, Artificial Sequence
  Synthetic oligonucleotide; TTA chr11 5327715 5327736 5327720 5327715 -
gaaaagggcagccaaattaaga

SEQ ID NO: 125876 - DNA, 22 bp, Artificial Sequence
  Synthetic oligonucleotide; TTA chr11 5327696 5327717 5327701 5327696 -
agatctaagaaagcaaattgga

SEQ ID NO: 125877 - DNA, 22 bp, Artificial Sequence
  Synthetic oligonucleotide; CTA chr11 5327689 5327710 5327694 5327689 -
agaaagcaaattggattgaaaa

SEQ ID NO: 125878 - DNA, 22 bp, Artificial Sequence
  Synthetic oligonucleotide; TTG chr11 5327676 5327697 5327681 5327676 -
gattgaaaatgaaatcatattg

SEQ ID NO: 125879 - DNA, 22 bp, Artificial Sequence
  Synthetic oligonucleotide; TTG chr11 5327671 5327692 5327676 5327671 -
aaaatgaaatcatattgatggc

SEQ ID NO: 125880 - DNA, 22 bp, Artificial Sequence
  Synthetic oligonucleotide; TTG chr11 5327654 5327675 5327659 5327654 -
atggcagatgataatatattgg

SEQ ID NO: 125881 - DNA, 22 bp, Artificial Sequence
  Synthetic oligonucleotide; TTG chr11 5327633 5327654 5327638 5327633 -
gactgggttggagaaggcagga

SEQ ID NO: 125882 - DNA, 22 bp, Artificial Sequence
  Synthetic oligonucleotide; CTG chr11 5327628 5327649 5327633 5327628 -
ggttggagaaggcaggaggaat

SEQ ID NO: 125883 - DNA, 22 bp, Artificial Sequence
  Synthetic oligonucleotide; TTG chr11 5327623 5327644 5327628 5327623 -
gagaaggcaggaggaatttaac

SEQ ID NO: 125884 - DNA, 22 bp, Artificial Sequence
  Synthetic oligonucleotide; TTT chr11 5327604 5327625 5327609 5327604 -
aacttgtggacaatagaaatct

SEQ ID NO: 125885 - DNA, 22 bp, Artificial Sequence
  Synthetic oligonucleotide; TTA chr11 5327603 5327624 5327608 5327603 -
acttgtggacaatagaaatctg

SEQ ID NO: 125886 - DNA, 22 bp, Artificial Sequence
  Synthetic oligonucleotide; CTT chr11 5327599 5327620 5327604 5327599 -
gtggacaatagaaatctgagag

SEQ ID NO: 125887 - DNA, 22 bp, Artificial Sequence
  Synthetic oligonucleotide; TTG chr11 5327598 5327619 5327603 5327598 -
tggacaatagaaatctgagagt

SEQ ID NO: 125888 - DNA, 22 bp, Artificial Sequence
  Synthetic oligonucleotide; CTG chr11 5327581 5327602 5327586 5327581 -
agagttgggtagtcccaactgt

SEQ ID NO: 125889 - DNA, 22 bp, Artificial Sequence
  Synthetic oligonucleotide; TTG chr11 5327574 5327595 5327579 5327574 -
ggtagtcccaactgtcaggccc

SEQ ID NO: 125890 - DNA, 22 bp, Artificial Sequence
  Synthetic oligonucleotide; CTG chr11 5327560 5327581 5327565 5327560 -
tcaggccctcaggactggggcc

SEQ ID NO: 125891 - DNA, 22 bp, Artificial Sequence
  Synthetic oligonucleotide; CTC chr11 5327550 5327571 5327555 5327550 -
aggactggggccaaatggagga

SEQ ID NO: 125892 - DNA, 22 bp, Artificial Sequence
  Synthetic oligonucleotide; CTG chr11 5327543 5327564 5327548 5327543 -
gggccaaatggaggactcactt

SEQ ID NO: 125893 - DNA, 22 bp, Artificial Sequence
  Synthetic oligonucleotide; CTC chr11 5327525 5327546 5327530 5327525 -
acttttttgaagattaaagaca

SEQ ID NO: 125894 - DNA, 22 bp, Artificial Sequence
  Synthetic oligonucleotide; CTT chr11 5327521 5327542 5327526 5327521 -
ttttgaagattaaagacaatgc

SEQ ID NO: 125895 - DNA, 22 bp, Artificial Sequence
  Synthetic oligonucleotide; TTT chr11 5327520 5327541 5327525 5327520 -
tttgaagattaaagacaatgcg

SEQ ID NO: 125896 - DNA, 22 bp, Artificial Sequence
  Synthetic oligonucleotide; TTT chr11 5327519 5327540 5327524 5327519 -
ttgaagattaaagacaatgcgt

SEQ ID NO: 125897 - DNA, 22 bp, Artificial Sequence
  Synthetic oligonucleotide; TTT chr11 5327518 5327539 5327523 5327518 -
tgaagattaaagacaatgcgtg

SEQ ID NO: 125898 - DNA, 22 bp, Artificial Sequence
  Synthetic oligonucleotide; TTT chr11 5327517 5327538 5327522 5327517 -
gaagattaaagacaatgcgtga

SEQ ID NO: 125899 - DNA, 22 bp, Artificial Sequence
  Synthetic oligonucleotide; TTG chr11 5327516 5327537 5327521 5327516 -
aagattaaagacaatgcgtgag

SEQ ID NO: 125900 - DNA, 22 bp, Artificial Sequence
  Synthetic oligonucleotide; TTA chr11 5327509 5327530 5327514 5327509 -
aagacaatgcgtgagagcacgg

SEQ ID NO: 125901 - DNA, 22 bp, Artificial Sequence
  Synthetic oligonucleotide; TTC chr11 5327482 5327503 5327487 5327482 -
tgaacctaaacaggctgagctt

SEQ ID NO: 125902 - DNA, 22 bp, Artificial Sequence
  Synthetic oligonucleotide; CTG chr11 5327480 5327501 5327485 5327480 -
aacctaaacaggctgagcttct

SEQ ID NO: 125903 - DNA, 22 bp, Artificial Sequence
  Synthetic oligonucleotide; CTA chr11 5327474 5327495 5327479 5327474 -
aacaggctgagcttctgcactc

SEQ ID NO: 125904 - DNA, 22 bp, Artificial Sequence
  Synthetic oligonucleotide; CTG chr11 5327465 5327486 5327470 5327465 -
agcttctgcactctgctaagat

SEQ ID NO: 125905 - DNA, 22 bp, Artificial Sequence
  Synthetic oligonucleotide; CTT chr11 5327460 5327481 5327465 5327460 -
ctgcactctgctaagatcctga

SEQ ID NO: 125906 - DNA, 22 bp, Artificial Sequence
  Synthetic oligonucleotide; TTC chr11 5327459 5327480 5327464 5327459 -
tgcactctgctaagatcctgaa

SEQ ID NO: 125907 - DNA, 22 bp, Artificial Sequence
  Synthetic oligonucleotide; CTG chr11 5327457 5327478 5327462 5327457 -
cactctgctaagatcctgaaat

SEQ ID NO: 125908 - DNA, 22 bp, Artificial Sequence
  Synthetic oligonucleotide; CTC chr11 5327452 5327473 5327457 5327452 -
tgctaagatcctgaaatttata

SEQ ID NO: 125909 - DNA, 22 bp, Artificial Sequence
  Synthetic oligonucleotide; CTG chr11 5327450 5327471 5327455 5327450 -
ctaagatcctgaaatttataga

SEQ ID NO: 125910 - DNA, 22 bp, Artificial Sequence
  Synthetic oligonucleotide; CTA chr11 5327447 5327468 5327452 5327447 -
agatcctgaaatttatagaaag

SEQ ID NO: 125911 - DNA, 22 bp, Artificial Sequence
  Synthetic oligonucleotide; CTG chr11 5327439 5327460 5327444 5327439 -
aaatttatagaaagaaaagtca

SEQ ID NO: 125912 - DNA, 22 bp, Artificial Sequence
  Synthetic oligonucleotide; TTT chr11 5327433 5327454 5327438 5327433 -
atagaaagaaaagtcaccattt

SEQ ID NO: 125913 - DNA, 22 bp, Artificial Sequence
  Synthetic oligonucleotide; TTA chr11 5327432 5327453 5327437 5327432 -
tagaaagaaaagtcaccatttt

SEQ ID NO: 125914 - DNA, 22 bp, Artificial Sequence
  Synthetic oligonucleotide; TTT chr11 5327411 5327432 5327416 5327411 -
taacatataacaatttaattta

SEQ ID NO: 125915 - DNA, 22 bp, Artificial Sequence
  Synthetic oligonucleotide; TTT chr11 5327410 5327431 5327415 5327410 -
aacatataacaatttaatttat

SEQ ID NO: 125916 - DNA, 22 bp, Artificial Sequence
  Synthetic oligonucleotide; TTA chr11 5327409 5327430 5327414 5327409 -
acatataacaatttaatttata

SEQ ID NO: 125917 - DNA, 22 bp, Artificial Sequence
  Synthetic oligonucleotide; TTT chr11 5327395 5327416 5327400 5327395 -
aatttataagatccaaacaaca

SEQ ID NO: 125918 - DNA, 22 bp, Artificial Sequence
  Synthetic oligonucleotide; TTA chr11 5327394 5327415 5327399 5327394 -
atttataagatccaaacaacac

SEQ ID NO: 125919 - DNA, 22 bp, Artificial Sequence
  Synthetic oligonucleotide; TTT chr11 5327390 5327411 5327395 5327390 -
ataagatccaaacaacacccct

SEQ ID NO: 125920 - DNA, 22 bp, Artificial Sequence
  Synthetic oligonucleotide; TTA chr11 5327389 5327410 5327394 5327389 -
taagatccaaacaacacccctt

SEQ ID NO: 125921 - DNA, 22 bp, Artificial Sequence
  Synthetic oligonucleotide; CTT chr11 5327367 5327388 5327372 5327367 -
gaaacacacacatgcatgtgtg

SEQ ID NO: 125922 - DNA, 22 bp, Artificial Sequence
  Synthetic oligonucleotide; TTG chr11 5327366 5327387 5327371 5327366 -
aaacacacacatgcatgtgtgt

SEQ ID NO: 125923 - DNA, 22 bp, Artificial Sequence
  Synthetic oligonucleotide; CTG chr11 5327341 5327362 5327346 5327341 -
tgtgtttgtttgaagaactgct

SEQ ID NO: 125924 - DNA, 22 bp, Artificial Sequence
  Synthetic oligonucleotide; TTT chr11 5327334 5327355 5327339 5327334 -
gtttgaagaactgctctaagag

SEQ ID NO: 125925 - DNA, 22 bp, Artificial Sequence
  Synthetic oligonucleotide; TTG chr11 5327333 5327354 5327338 5327333 -
tttgaagaactgctctaagaga

SEQ ID NO: 125926 - DNA, 22 bp, Artificial Sequence
  Synthetic oligonucleotide; TTT chr11 5327330 5327351 5327335 5327330 -
gaagaactgctctaagagatgg

SEQ ID NO: 125927 - DNA, 22 bp, Artificial Sequence
  Synthetic oligonucleotide; TTG chr11 5327329 5327350 5327334 5327329 -
aagaactgctctaagagatggc

SEQ ID NO: 125928 - DNA, 22 bp, Artificial Sequence
  Synthetic oligonucleotide; CTG chr11 5327321 5327342 5327326 5327321 -
ctctaagagatggcatgagtag

SEQ ID NO: 125929 - DNA, 22 bp, Artificial Sequence
  Synthetic oligonucleotide; CTC chr11 5327318 5327339 5327323 5327318 -
taagagatggcatgagtagtca

SEQ ID NO: 125930 - DNA, 22 bp, Artificial Sequence
  Synthetic oligonucleotide; CTA chr11 5327316 5327337 5327321 5327316 -
agagatggcatgagtagtcagt

SEQ ID NO: 125931 - DNA, 22 bp, Artificial Sequence
  Synthetic oligonucleotide; CTC chr11 5327287 5327308 5327292 5327287 -
actagaaaaattctagagacag

SEQ ID NO: 125932 - DNA, 22 bp, Artificial Sequence
  Synthetic oligonucleotide; CTA chr11 5327283 5327304 5327288 5327283 -
gaaaaattctagagacagggcc

SEQ ID NO: 125933 - DNA, 22 bp, Artificial Sequence
  Synthetic oligonucleotide; TTC chr11 5327274 5327295 5327279 5327274 -
tagagacagggcccatctcctt

SEQ ID NO: 125934 - DNA, 22 bp, Artificial Sequence
  Synthetic oligonucleotide; CTA chr11 5327272 5327293 5327277 5327272 -
gagacagggcccatctccttag

SEQ ID NO: 125935 - DNA, 22 bp, Artificial Sequence
  Synthetic oligonucleotide; CTC chr11 5327255 5327276 5327260 5327255 -
cttaggaaggtgcggggacaca

SEQ ID NO: 125936 - DNA, 22 bp, Artificial Sequence
  Synthetic oligonucleotide; CTT chr11 5327252 5327273 5327257 5327252 -
aggaaggtgcggggacacatct

SEQ ID NO: 125937 - DNA, 22 bp, Artificial Sequence
  Synthetic oligonucleotide; TTA chr11 5327251 5327272 5327256 5327251 -
ggaaggtgcggggacacatctt

SEQ ID NO: 125938 - DNA, 22 bp, Artificial Sequence
  Synthetic oligonucleotide; CTT chr11 5327229 5327250 5327234 5327229 -
ccatccaactcagaaggagggc

SEQ ID NO: 125939 - DNA, 22 bp, Artificial Sequence
  Synthetic oligonucleotide; TTC chr11 5327228 5327249 5327233 5327228 -
catccaactcagaaggagggca

SEQ ID NO: 125940 - DNA, 22 bp, Artificial Sequence
  Synthetic oligonucleotide; CTC chr11 5327218 5327239 5327223 5327218 -
agaaggagggcagagtaggaaa

SEQ ID NO: 125941 - DNA, 22 bp, Artificial Sequence
  Synthetic oligonucleotide; TTT chr11 5327164 5327185 5327169 5327164 -
tttcctctttcacttgtttatg

SEQ ID NO: 125942 - DNA, 22 bp, Artificial Sequence
  Synthetic oligonucleotide; TTT chr11 5327163 5327184 5327168 5327163 -
ttcctctttcacttgtttatgt

SEQ ID NO: 125943 - DNA, 22 bp, Artificial Sequence
  Synthetic oligonucleotide; TTT chr11 5327162 5327183 5327167 5327162 -
tcctctttcacttgtttatgta

SEQ ID NO: 125944 - DNA, 22 bp, Artificial Sequence
  Synthetic oligonucleotide; TTT chr11 5327161 5327182 5327166 5327161 -
cctctttcacttgtttatgtag

SEQ ID NO: 125945 - DNA, 22 bp, Artificial Sequence
  Synthetic oligonucleotide; TTC chr11 5327160 5327181 5327165 5327160 -
ctctttcacttgtttatgtaga

SEQ ID NO: 125946 - DNA, 22 bp, Artificial Sequence
  Synthetic oligonucleotide; CTC chr11 5327157 5327178 5327162 5327157 -
tttcacttgtttatgtagactg

SEQ ID NO: 125947 - DNA, 22 bp, Artificial Sequence
  Synthetic oligonucleotide; CTT chr11 5327155 5327176 5327160 5327155 -
tcacttgtttatgtagactgta

SEQ ID NO: 125948 - DNA, 22 bp, Artificial Sequence
  Synthetic oligonucleotide; TTT chr11 5327154 5327175 5327159 5327154 -
cacttgtttatgtagactgtat

SEQ ID NO: 125949 - DNA, 22 bp, Artificial Sequence
  Synthetic oligonucleotide; TTC chr11 5327153 5327174 5327158 5327153 -
acttgtttatgtagactgtata

SEQ ID NO: 125950 - DNA, 22 bp, Artificial Sequence
  Synthetic oligonucleotide; CTT chr11 5327149 5327170 5327154 5327149 -
gtttatgtagactgtataatag

SEQ ID NO: 125951 - DNA, 22 bp, Artificial Sequence
  Synthetic oligonucleotide; TTG chr11 5327148 5327169 5327153 5327148 -
tttatgtagactgtataataga

SEQ ID NO: 125952 - DNA, 22 bp, Artificial Sequence
  Synthetic oligonucleotide; TTT chr11 5327145 5327166 5327150 5327145 -
atgtagactgtataatagattc

SEQ ID NO: 125953 - DNA, 22 bp, Artificial Sequence
  Synthetic oligonucleotide; TTA chr11 5327144 5327165 5327149 5327144 -
tgtagactgtataatagattca

SEQ ID NO: 125954 - DNA, 22 bp, Artificial Sequence
  Synthetic oligonucleotide; CTG chr11 5327135 5327156 5327140 5327135 -
tataatagattcactatttact

SEQ ID NO: 125955 - DNA, 22 bp, Artificial Sequence
  Synthetic oligonucleotide; TTC chr11 5327123 5327144 5327128 5327123 -
actatttactacattttcttga

SEQ ID NO: 125956 - DNA, 22 bp, Artificial Sequence
  Synthetic oligonucleotide; CTA chr11 5327119 5327140 5327124 5327119 -
tttactacattttcttgaggct

SEQ ID NO: 125957 - DNA, 22 bp, Artificial Sequence
  Synthetic oligonucleotide; TTT chr11 5327116 5327137 5327121 5327116 -
actacattttcttgaggctaac

SEQ ID NO: 125958 - DNA, 22 bp, Artificial Sequence
  Synthetic oligonucleotide; TTA chr11 5327115 5327136 5327120 5327115 -
ctacattttcttgaggctaaca

SEQ ID NO: 125959 - DNA, 22 bp, Artificial Sequence
  Synthetic oligonucleotide; CTA chr11 5327112 5327133 5327117 5327112 -
cattttcttgaggctaacagat

SEQ ID NO: 125960 - DNA, 22 bp, Artificial Sequence
  Synthetic oligonucleotide; TTT chr11 5327107 5327128 5327112 5327107 -
tcttgaggctaacagatctttc

SEQ ID NO: 125961 - DNA, 22 bp, Artificial Sequence
  Synthetic oligonucleotide; TTT chr11 5327106 5327127 5327111 5327106 -
cttgaggctaacagatctttcc

SEQ ID NO: 125962 - DNA, 22 bp, Artificial Sequence
  Synthetic oligonucleotide; TTC chr11 5327105 5327126 5327110 5327105 -
ttgaggctaacagatctttcct

SEQ ID NO: 125963 - DNA, 22 bp, Artificial Sequence
  Synthetic oligonucleotide; CTT chr11 5327103 5327124 5327108 5327103 -
gaggctaacagatctttcctgt

SEQ ID NO: 125964 - DNA, 22 bp, Artificial Sequence
  Synthetic oligonucleotide; TTG chr11 5327102 5327123 5327107 5327102 -
aggctaacagatctttcctgtc

SEQ ID NO: 125965 - DNA, 22 bp, Artificial Sequence
  Synthetic oligonucleotide; CTA chr11 5327096 5327117 5327101 5327096 -
acagatctttcctgtctgttcc

SEQ ID NO: 125966 - DNA, 22 bp, Artificial Sequence
  Synthetic oligonucleotide; CTT chr11 5327087 5327108 5327092 5327087 -
tcctgtctgttccttcttcata

SEQ ID NO: 125967 - DNA, 22 bp, Artificial Sequence
  Synthetic oligonucleotide; TTT chr11 5327086 5327107 5327091 5327086 -
cctgtctgttccttcttcatac

SEQ ID NO: 125968 - DNA, 22 bp, Artificial Sequence
  Synthetic oligonucleotide; TTC chr11 5327085 5327106 5327090 5327085 -
ctgtctgttccttcttcatact

SEQ ID NO: 125969 - DNA, 22 bp, Artificial Sequence
  Synthetic oligonucleotide; CTG chr11 5327082 5327103 5327087 5327082 -
tctgttccttcttcatactaca

SEQ ID NO: 125970 - DNA, 22 bp, Artificial Sequence
  Synthetic oligonucleotide; CTG chr11 5327078 5327099 5327083 5327078 -
ttccttcttcatactacaaagt

SEQ ID NO: 125971 - DNA, 22 bp, Artificial Sequence
  Synthetic oligonucleotide; TTC chr11 5327075 5327096 5327080 5327075 -
cttcttcatactacaaagttcc

SEQ ID NO: 125972 - DNA, 22 bp, Artificial Sequence
  Synthetic oligonucleotide; CTT chr11 5327072 5327093 5327077 5327072 -
cttcatactacaaagttccctc

SEQ ID NO: 125973 - DNA, 22 bp, Artificial Sequence
  Synthetic oligonucleotide; TTC chr11 5327071 5327092 5327076 5327071 -
ttcatactacaaagttccctct

SEQ ID NO: 125974 - DNA, 22 bp, Artificial Sequence
  Synthetic oligonucleotide; CTT chr11 5327069 5327090 5327074 5327069 -
catactacaaagttccctctgt

SEQ ID NO: 125975 - DNA, 22 bp, Artificial Sequence
  Synthetic oligonucleotide; TTC chr11 5327068 5327089 5327073 5327068 -
atactacaaagttccctctgtc

SEQ ID NO: 125976 - DNA, 22 bp, Artificial Sequence
  Synthetic oligonucleotide; CTA chr11 5327062 5327083 5327067 5327062 -
caaagttccctctgtctccttt

SEQ ID NO: 125977 - DNA, 22 bp, Artificial Sequence
  Synthetic oligonucleotide; TTC chr11 5327054 5327075 5327059 5327054 -
cctctgtctcctttactccctt

SEQ ID NO: 125978 - DNA, 22 bp, Artificial Sequence
  Synthetic oligonucleotide; CTC chr11 5327050 5327071 5327055 5327050 -
tgtctcctttactcccttgtat

SEQ ID NO: 125979 - DNA, 22 bp, Artificial Sequence
  Synthetic oligonucleotide; CTG chr11 5327048 5327069 5327053 5327048 -
tctcctttactcccttgtatct

SEQ ID NO: 125980 - DNA, 22 bp, Artificial Sequence
  Synthetic oligonucleotide; CTC chr11 5327044 5327065 5327049 5327044 -
ctttactcccttgtatctggta

SEQ ID NO: 125981 - DNA, 22 bp, Artificial Sequence
  Synthetic oligonucleotide; CTT chr11 5327041 5327062 5327046 5327041 -
tactcccttgtatctggtaaca

SEQ ID NO: 125982 - DNA, 22 bp, Artificial Sequence
  Synthetic oligonucleotide; TTT chr11 5327040 5327061 5327045 5327040 -
actcccttgtatctggtaacat

SEQ ID NO: 125983 - DNA, 22 bp, Artificial Sequence
  Synthetic oligonucleotide; TTA chr11 5327039 5327060 5327044 5327039 -
ctcccttgtatctggtaacatt

SEQ ID NO: 125984 - DNA, 22 bp, Artificial Sequence
  Synthetic oligonucleotide; CTC chr11 5327036 5327057 5327041 5327036 -
ccttgtatctggtaacattcaa

SEQ ID NO: 125985 - DNA, 22 bp, Artificial Sequence
  Synthetic oligonucleotide; CTT chr11 5327032 5327053 5327037 5327032 -
gtatctggtaacattcaaatta

SEQ ID NO: 125986 - DNA, 22 bp, Artificial Sequence
  Synthetic oligonucleotide; TTG chr11 5327031 5327052 5327036 5327031 -
tatctggtaacattcaaattat

SEQ ID NO: 125987 - DNA, 22 bp, Artificial Sequence
  Synthetic oligonucleotide; CTG chr11 5327025 5327046 5327030 5327025 -
gtaacattcaaattatgttctc

SEQ ID NO: 125988 - DNA, 22 bp, Artificial Sequence
  Synthetic oligonucleotide; TTC chr11 5327016 5327037 5327021 5327016 -
aaattatgttctcaaagtgagc

SEQ ID NO: 125989 - DNA, 22 bp, Artificial Sequence
  Synthetic oligonucleotide; TTA chr11 5327010 5327031 5327015 5327010 -
tgttctcaaagtgagcatgaca

SEQ ID NO: 125990 - DNA, 22 bp, Artificial Sequence
  Synthetic oligonucleotide; TTC chr11 5327005 5327026 5327010 5327005 -
tcaaagtgagcatgacaacttt

SEQ ID NO: 125991 - DNA, 22 bp, Artificial Sequence
  Synthetic oligonucleotide; CTC chr11 5327003 5327024 5327008 5327003 -
aaagtgagcatgacaacttttt

SEQ ID NO: 125992 - DNA, 22 bp, Artificial Sequence
  Synthetic oligonucleotide; CTT chr11 5326984 5327005 5326989 5326984 -
ttttccatggacctgtatgtat

SEQ ID NO: 125993 - DNA, 22 bp, Artificial Sequence
  Synthetic oligonucleotide; TTT chr11 5326983 5327004 5326988 5326983 -
tttccatggacctgtatgtatt

SEQ ID NO: 125994 - DNA, 22 bp, Artificial Sequence
  Synthetic oligonucleotide; TTT chr11 5326982 5327003 5326987 5326982 -
ttccatggacctgtatgtattt

SEQ ID NO: 125995 - DNA, 22 bp, Artificial Sequence
  Synthetic oligonucleotide; TTT chr11 5326981 5327002 5326986 5326981 -
tccatggacctgtatgtattta

SEQ ID NO: 125996 - DNA, 22 bp, Artificial Sequence
  Synthetic oligonucleotide; TTT chr11 5326980 5327001 5326985 5326980 -
ccatggacctgtatgtatttat

SEQ ID NO: 125997 - DNA, 22 bp, Artificial Sequence
  Synthetic oligonucleotide; TTC chr11 5326979 5327000 5326984 5326979 -
catggacctgtatgtatttatg

SEQ ID NO: 125998 - DNA, 22 bp, Artificial Sequence
  Synthetic oligonucleotide; CTG chr11 5326969 5326990 5326974 5326969 -
tatgtatttatgcatcttggtg

SEQ ID NO: 125999 - DNA, 22 bp, Artificial Sequence
  Synthetic oligonucleotide; TTT chr11 5326960 5326981 5326965 5326960 -
atgcatcttggtgagagtgttg

SEQ ID NO: 126000 - DNA, 22 bp, Artificial Sequence
  Synthetic oligonucleotide; TTA chr11 5326959 5326980 5326964 5326959 -
tgcatcttggtgagagtgttgc

SEQ ID NO: 126001 - DNA, 22 bp, Artificial Sequence
  Synthetic oligonucleotide; CTT chr11 5326951 5326972 5326956 5326951 -
ggtgagagtgttgctacaagta

SEQ ID NO: 126002 - DNA, 22 bp, Artificial Sequence
  Synthetic oligonucleotide; TTG chr11 5326950 5326971 5326955 5326950 -
gtgagagtgttgctacaagtat

SEQ ID NO: 126003 - DNA, 22 bp, Artificial Sequence
  Synthetic oligonucleotide; TTG chr11 5326938 5326959 5326943 5326938 -
ctacaagtataggaatcttatt

SEQ ID NO: 126004 - DNA, 22 bp, Artificial Sequence
  Synthetic oligonucleotide; CTA chr11 5326935 5326956 5326940 5326935 -
caagtataggaatcttattcat

SEQ ID NO: 126005 - DNA, 22 bp, Artificial Sequence
  Synthetic oligonucleotide; CTT chr11 5326919 5326940 5326924 5326919 -
attcatctagaaatatatcatc

SEQ ID NO: 126006 - DNA, 22 bp, Artificial Sequence
  Synthetic oligonucleotide; TTA chr11 5326918 5326939 5326923 5326918 -
ttcatctagaaatatatcatca

SEQ ID NO: 126007 - DNA, 22 bp, Artificial Sequence
  Synthetic oligonucleotide; TTC chr11 5326915 5326936 5326920 5326915 -
atctagaaatatatcatcatgt

SEQ ID NO: 126008 - DNA, 22 bp, Artificial Sequence
  Synthetic oligonucleotide; CTA chr11 5326910 5326931 5326915 5326910 -
gaaatatatcatcatgtgaaat

SEQ ID NO: 126009 - DNA, 22 bp, Artificial Sequence
  Synthetic oligonucleotide; TTC chr11 5326886 5326907 5326891 5326886 -
aggtcaatagaacatctagaat

SEQ ID NO: 126010 - DNA, 22 bp, Artificial Sequence
  Synthetic oligonucleotide; CTA chr11 5326868 5326889 5326873 5326868 -
gaatgaagctagaatgaagcag

SEQ ID NO: 126011 - DNA, 22 bp, Artificial Sequence
  Synthetic oligonucleotide; CTA chr11 5326857 5326878 5326862 5326857 -
gaatgaagcagggcttagatct

SEQ ID NO: 126012 - DNA, 22 bp, Artificial Sequence
  Synthetic oligonucleotide; CTT chr11 5326841 5326862 5326846 5326841 -
agatctatgatttttctcaagt

SEQ ID NO: 126013 - DNA, 22 bp, Artificial Sequence
  Synthetic oligonucleotide; TTA chr11 5326840 5326861 5326845 5326840 -
gatctatgatttttctcaagtt

SEQ ID NO: 126014 - DNA, 22 bp, Artificial Sequence
  Synthetic oligonucleotide; CTA chr11 5326834 5326855 5326839 5326834 -
tgatttttctcaagttttcagc

SEQ ID NO: 126015 - DNA, 22 bp, Artificial Sequence
  Synthetic oligonucleotide; TTT chr11 5326828 5326849 5326833 5326828 -
ttctcaagttttcagcattatg

SEQ ID NO: 126016 - DNA, 22 bp, Artificial Sequence
  Synthetic oligonucleotide; TTT chr11 5326827 5326848 5326832 5326827 -
tctcaagttttcagcattatgg

SEQ ID NO: 126017 - DNA, 22 bp, Artificial Sequence
  Synthetic oligonucleotide; TTT chr11 5326826 5326847 5326831 5326826 -
ctcaagttttcagcattatgga

SEQ ID NO: 126018 - DNA, 22 bp, Artificial Sequence
  Synthetic oligonucleotide; TTC chr11 5326825 5326846 5326830 5326825 -
tcaagttttcagcattatggat

SEQ ID NO: 126019 - DNA, 22 bp, Artificial Sequence
  Synthetic oligonucleotide; CTC chr11 5326823 5326844 5326828 5326823 -
aagttttcagcattatggatcc

SEQ ID NO: 126020 - DNA, 22 bp, Artificial Sequence
  Synthetic oligonucleotide; TTT chr11 5326817 5326838 5326822 5326817 -
tcagcattatggatcctgttga

SEQ ID NO: 126021 - DNA, 22 bp, Artificial Sequence
  Synthetic oligonucleotide; TTT chr11 5326816 5326837 5326821 5326816 -
cagcattatggatcctgttgag

SEQ ID NO: 126022 - DNA, 22 bp, Artificial Sequence
  Synthetic oligonucleotide; TTC chr11 5326815 5326836 5326820 5326815 -
agcattatggatcctgttgaga

SEQ ID NO: 126023 - DNA, 22 bp, Artificial Sequence
  Synthetic oligonucleotide; TTA chr11 5326808 5326829 5326813 5326808 -
tggatcctgttgagacattcaa

SEQ ID NO: 126024 - DNA, 22 bp, Artificial Sequence
  Synthetic oligonucleotide; CTG chr11 5326799 5326820 5326804 5326799 -
ttgagacattcaagggcaatat

SEQ ID NO: 126025 - DNA, 22 bp, Artificial Sequence
  Synthetic oligonucleotide; TTG chr11 5326796 5326817 5326801 5326796 -
agacattcaagggcaatattct

SEQ ID NO: 126026 - DNA, 22 bp, Artificial Sequence
  Synthetic oligonucleotide; TTC chr11 5326788 5326809 5326793 5326788 -
aagggcaatattctgcataaaa

SEQ ID NO: 126027 - DNA, 22 bp, Artificial Sequence
  Synthetic oligonucleotide; TTC chr11 5326775 5326796 5326780 5326775 -
tgcataaaattgaagggagaat

SEQ ID NO: 126028 - DNA, 22 bp, Artificial Sequence
  Synthetic oligonucleotide; CTG chr11 5326773 5326794 5326778 5326773 -
cataaaattgaagggagaatat

SEQ ID NO: 126029 - DNA, 22 bp, Artificial Sequence
  Synthetic oligonucleotide; TTG chr11 5326763 5326784 5326768 5326763 -
aagggagaatattaagcactat

SEQ ID NO: 126030 - DNA, 22 bp, Artificial Sequence
  Synthetic oligonucleotide; TTA chr11 5326749 5326770 5326754 5326749 -
agcactattataaactcatagg

SEQ ID NO: 126031 - DNA, 22 bp, Artificial Sequence
  Synthetic oligonucleotide; CTA chr11 5326742 5326763 5326747 5326742 -
ttataaactcataggccatatt

SEQ ID NO: 126032 - DNA, 22 bp, Artificial Sequence
  Synthetic oligonucleotide; TTA chr11 5326739 5326760 5326744 5326739 -
taaactcataggccatattgag

SEQ ID NO: 126033 - DNA, 22 bp, Artificial Sequence
  Synthetic oligonucleotide; CTC chr11 5326732 5326753 5326737 5326732 -
ataggccatattgagagcttct

SEQ ID NO: 126034 - DNA, 22 bp, Artificial Sequence
  Synthetic oligonucleotide; TTG chr11 5326719 5326740 5326724 5326719 -
agagcttcttaagagcagactg

SEQ ID NO: 126035 - DNA, 22 bp, Artificial Sequence
  Synthetic oligonucleotide; CTT chr11 5326712 5326733 5326717 5326712 -
cttaagagcagactgtgcttat

SEQ ID NO: 126036 - DNA, 22 bp, Artificial Sequence
  Synthetic oligonucleotide; TTC chr11 5326711 5326732 5326716 5326711 -
ttaagagcagactgtgcttatt

SEQ ID NO: 126037 - DNA, 22 bp, Artificial Sequence
  Synthetic oligonucleotide; CTT chr11 5326709 5326730 5326714 5326709 -
aagagcagactgtgcttattac

SEQ ID NO: 126038 - DNA, 22 bp, Artificial Sequence
  Synthetic oligonucleotide; TTA chr11 5326708 5326729 5326713 5326708 -
agagcagactgtgcttattaca

SEQ ID NO: 126039 - DNA, 22 bp, Artificial Sequence
  Synthetic oligonucleotide; CTG chr11 5326697 5326718 5326702 5326697 -
tgcttattacatggttatttag

SEQ ID NO: 126040 - DNA, 22 bp, Artificial Sequence
  Synthetic oligonucleotide; CTT chr11 5326692 5326713 5326697 5326692 -
attacatggttatttagaacta

SEQ ID NO: 126041 - DNA, 22 bp, Artificial Sequence
  Synthetic oligonucleotide; TTA chr11 5326691 5326712 5326696 5326691 -
ttacatggttatttagaactaa

SEQ ID NO: 126042 - DNA, 22 bp, Artificial Sequence
  Synthetic oligonucleotide; TTA chr11 5326688 5326709 5326693 5326688 -
catggttatttagaactaaaca

SEQ ID NO: 126043 - DNA, 22 bp, Artificial Sequence
  Synthetic oligonucleotide; TTA chr11 5326680 5326701 5326685 5326680 -
tttagaactaaacacagtgcag

SEQ ID NO: 126044 - DNA, 22 bp, Artificial Sequence
  Synthetic oligonucleotide; TTT chr11 5326677 5326698 5326682 5326677 -
agaactaaacacagtgcagttg

SEQ ID NO: 126045 - DNA, 22 bp, Artificial Sequence
  Synthetic oligonucleotide; TTA chr11 5326676 5326697 5326681 5326676 -
gaactaaacacagtgcagttgt

SEQ ID NO: 126046 - DNA, 22 bp, Artificial Sequence
  Synthetic oligonucleotide; CTA chr11 5326670 5326691 5326675 5326670 -
aacacagtgcagttgtgtggca

SEQ ID NO: 126047 - DNA, 22 bp, Artificial Sequence
  Synthetic oligonucleotide; TTG chr11 5326655 5326676 5326660 5326655 -
tgtggcatgtgctcaccaattc

SEQ ID NO: 126048 - DNA, 22 bp, Artificial Sequence
  Synthetic oligonucleotide; CTC chr11 5326641 5326662 5326646 5326641 -
accaattctgtgctgactcaaa

SEQ ID NO: 126049 - DNA, 22 bp, Artificial Sequence
  Synthetic oligonucleotide; TTC chr11 5326633 5326654 5326638 5326633 -
tgtgctgactcaaaatagtcat

SEQ ID NO: 126050 - DNA, 22 bp, Artificial Sequence
  Synthetic oligonucleotide; CTG chr11 5326631 5326652 5326636 5326631 -
tgctgactcaaaatagtcattt

SEQ ID NO: 126051 - DNA, 22 bp, Artificial Sequence
  Synthetic oligonucleotide; CTG chr11 5326626 5326647 5326631 5326626 -
actcaaaatagtcattttccaa

SEQ ID NO: 126052 - DNA, 22 bp, Artificial Sequence
  Synthetic oligonucleotide; CTC chr11 5326622 5326643 5326627 5326622 -
aaaatagtcattttccaacttg

SEQ ID NO: 126053 - DNA, 22 bp, Artificial Sequence
  Synthetic oligonucleotide; TTT chr11 5326609 5326630 5326614 5326609 -
tccaacttgtcccagatggtat

SEQ ID NO: 126054 - DNA, 22 bp, Artificial Sequence
  Synthetic oligonucleotide; TTT chr11 5326608 5326629 5326613 5326608 -
ccaacttgtcccagatggtatt

SEQ ID NO: 126055 - DNA, 22 bp, Artificial Sequence
  Synthetic oligonucleotide; TTC chr11 5326607 5326628 5326612 5326607 -
caacttgtcccagatggtattg

SEQ ID NO: 126056 - DNA, 22 bp, Artificial Sequence
  Synthetic oligonucleotide; CTT chr11 5326601 5326622 5326606 5326601 -
gtcccagatggtattggtgaat

SEQ ID NO: 126057 - DNA, 22 bp, Artificial Sequence
  Synthetic oligonucleotide; TTG chr11 5326600 5326621 5326605 5326600 -
tcccagatggtattggtgaatg

SEQ ID NO: 126058 - DNA, 22 bp, Artificial Sequence
  Synthetic oligonucleotide; TTG chr11 5326585 5326606 5326590 5326585 -
gtgaatggagctcctacaggtt

SEQ ID NO: 126059 - DNA, 22 bp, Artificial Sequence
  Synthetic oligonucleotide; CTC chr11 5326572 5326593 5326577 5326572 -
ctacaggttgcttatatcttca

SEQ ID NO: 126060 - DNA, 22 bp, Artificial Sequence
  Synthetic oligonucleotide; CTA chr11 5326569 5326590 5326574 5326569 -
caggttgcttatatcttcatat

SEQ ID NO: 126061 - DNA, 22 bp, Artificial Sequence
  Synthetic oligonucleotide; TTG chr11 5326562 5326583 5326567 5326562 -
cttatatcttcatatatgatat

SEQ ID NO: 126062 - DNA, 22 bp, Artificial Sequence
  Synthetic oligonucleotide; CTT chr11 5326559 5326580 5326564 5326559 -
atatcttcatatatgatatatc

SEQ ID NO: 126063 - DNA, 22 bp, Artificial Sequence
  Synthetic oligonucleotide; TTA chr11 5326558 5326579 5326563 5326558 -
tatcttcatatatgatatatca

SEQ ID NO: 126064 - DNA, 22 bp, Artificial Sequence
  Synthetic oligonucleotide; CTT chr11 5326552 5326573 5326557 5326552 -
catatatgatatatcagttcaa

SEQ ID NO: 126065 - DNA, 22 bp, Artificial Sequence
  Synthetic oligonucleotide; TTC chr11 5326551 5326572 5326556 5326551 -
atatatgatatatcagttcaag

SEQ ID NO: 126066 - DNA, 22 bp, Artificial Sequence
  Synthetic oligonucleotide; TTC chr11 5326532 5326553 5326537 5326532 -
aaggaaaaatcatcacacatca

SEQ ID NO: 126067 - DNA, 22 bp, Artificial Sequence
  Synthetic oligonucleotide; CTT chr11 5326490 5326511 5326495 5326490 -
aggaaatcactaaacatttatg

SEQ ID NO: 126068 - DNA, 22 bp, Artificial Sequence
  Synthetic oligonucleotide; TTA chr11 5326489 5326510 5326494 5326489 -
ggaaatcactaaacatttatgt

SEQ ID NO: 126069 - DNA, 22 bp, Artificial Sequence
  Synthetic oligonucleotide; CTA chr11 5326478 5326499 5326483 5326478 -
aacatttatgttctgagttgag

SEQ ID NO: 126070 - DNA, 22 bp, Artificial Sequence
  Synthetic oligonucleotide; TTT chr11 5326471 5326492 5326476 5326471 -
atgttctgagttgagagctgcc

SEQ ID NO: 126071 - DNA, 22 bp, Artificial Sequence
  Synthetic oligonucleotide; TTA chr11 5326470 5326491 5326475 5326470 -
tgttctgagttgagagctgcct

SEQ ID NO: 126072 - DNA, 22 bp, Artificial Sequence
  Synthetic oligonucleotide; TTC chr11 5326465 5326486 5326470 5326465 -
tgagttgagagctgcctatcaa

SEQ ID NO: 126073 - DNA, 22 bp, Artificial Sequence
  Synthetic oligonucleotide; CTG chr11 5326463 5326484 5326468 5326463 -
agttgagagctgcctatcaatt

SEQ ID NO: 126074 - DNA, 22 bp, Artificial Sequence
  Synthetic oligonucleotide; TTG chr11 5326458 5326479 5326463 5326458 -
agagctgcctatcaatttcaca

SEQ ID NO: 126075 - DNA, 22 bp, Artificial Sequence
  Synthetic oligonucleotide; CTG chr11 5326451 5326472 5326456 5326451 -
cctatcaatttcacagccatag

SEQ ID NO: 126076 - DNA, 22 bp, Artificial Sequence
  Synthetic oligonucleotide; CTA chr11 5326447 5326468 5326452 5326447 -
tcaatttcacagccatagctgc

SEQ ID NO: 126077 - DNA, 22 bp, Artificial Sequence
  Synthetic oligonucleotide; TTT chr11 5326440 5326461 5326445 5326440 -
cacagccatagctgctccacct

SEQ ID NO: 126078 - DNA, 22 bp, Artificial Sequence
  Synthetic oligonucleotide; TTC chr11 5326439 5326460 5326444 5326439 -
acagccatagctgctccacctt

SEQ ID NO: 126079 - DNA, 22 bp, Artificial Sequence
  Synthetic oligonucleotide; CTG chr11 5326426 5326447 5326431 5326426 -
ctccacctttatccagaaaaac

SEQ ID NO: 126080 - DNA, 22 bp, Artificial Sequence
  Synthetic oligonucleotide; CTC chr11 5326423 5326444 5326428 5326423 -
cacctttatccagaaaaactag

SEQ ID NO: 126081 - DNA, 22 bp, Artificial Sequence
  Synthetic oligonucleotide; CTT chr11 5326417 5326438 5326422 5326417 -
tatccagaaaaactagttcttg

SEQ ID NO: 126082 - DNA, 22 bp, Artificial Sequence
  Synthetic oligonucleotide; TTT chr11 5326416 5326437 5326421 5326416 -
atccagaaaaactagttcttgt

SEQ ID NO: 126083 - DNA, 22 bp, Artificial Sequence
  Synthetic oligonucleotide; TTA chr11 5326415 5326436 5326420 5326415 -
tccagaaaaactagttcttgtg

SEQ ID NO: 126084 - DNA, 22 bp, Artificial Sequence
  Synthetic oligonucleotide; CTA chr11 5326402 5326423 5326407 5326402 -
gttcttgtgcttctagtataat

SEQ ID NO: 126085 - DNA, 22 bp, Artificial Sequence
  Synthetic oligonucleotide; TTC chr11 5326398 5326419 5326403 5326398 -
ttgtgcttctagtataattttc

SEQ ID NO: 126086 - DNA, 22 bp, Artificial Sequence
  Synthetic oligonucleotide; CTT chr11 5326396 5326417 5326401 5326396 -
gtgcttctagtataattttctt

SEQ ID NO: 126087 - DNA, 22 bp, Artificial Sequence
  Synthetic oligonucleotide; TTG chr11 5326395 5326416 5326400 5326395 -
tgcttctagtataattttctta

SEQ ID NO: 126088 - DNA, 22 bp, Artificial Sequence
  Synthetic oligonucleotide; CTT chr11 5326390 5326411 5326395 5326390 -
ctagtataattttcttaacact

SEQ ID NO: 126089 - DNA, 22 bp, Artificial Sequence
  Synthetic oligonucleotide; TTC chr11 5326389 5326410 5326394 5326389 -
tagtataattttcttaacactt

SEQ ID NO: 126090 - DNA, 22 bp, Artificial Sequence
  Synthetic oligonucleotide; CTA chr11 5326387 5326408 5326392 5326387 -
gtataattttcttaacacttgt

SEQ ID NO: 126091 - DNA, 22 bp, Artificial Sequence
  Synthetic oligonucleotide; TTT chr11 5326378 5326399 5326383 5326378 -
tcttaacacttgttaatagcta

SEQ ID NO: 126092 - DNA, 22 bp, Artificial Sequence
  Synthetic oligonucleotide; TTT chr11 5326377 5326398 5326382 5326377 -
cttaacacttgttaatagctaa

SEQ ID NO: 126093 - DNA, 22 bp, Artificial Sequence
  Synthetic oligonucleotide; TTC chr11 5326376 5326397 5326381 5326376 -
ttaacacttgttaatagctaag

SEQ ID NO: 126094 - DNA, 22 bp, Artificial Sequence
  Synthetic oligonucleotide; CTT chr11 5326374 5326395 5326379 5326374 -
aacacttgttaatagctaagcc

SEQ ID NO: 126095 - DNA, 22 bp, Artificial Sequence
  Synthetic oligonucleotide; TTA chr11 5326373 5326394 5326378 5326373 -
acacttgttaatagctaagcca

SEQ ID NO: 126096 - DNA, 22 bp, Artificial Sequence
  Synthetic oligonucleotide; CTT chr11 5326367 5326388 5326372 5326367 -
gttaatagctaagccatctgaa

SEQ ID NO: 126097 - DNA, 22 bp, Artificial Sequence
  Synthetic oligonucleotide; TTG chr11 5326366 5326387 5326371 5326366 -
ttaatagctaagccatctgaat

SEQ ID NO: 126098 - DNA, 22 bp, Artificial Sequence
  Synthetic oligonucleotide; TTA chr11 5326363 5326384 5326368 5326363 -
atagctaagccatctgaatgga

SEQ ID NO: 126099 - DNA, 22 bp, Artificial Sequence
  Synthetic oligonucleotide; CTA chr11 5326356 5326377 5326361 5326356 -
agccatctgaatggaattttgc

SEQ ID NO: 126100 - DNA, 22 bp, Artificial Sequence
  Synthetic oligonucleotide; CTG chr11 5326347 5326368 5326352 5326347 -
aatggaattttgccacatagtg

SEQ ID NO: 126101 - DNA, 22 bp, Artificial Sequence
  Synthetic oligonucleotide; TTT chr11 5326337 5326358 5326342 5326337 -
tgccacatagtgcagccttggg

SEQ ID NO: 126102 - DNA, 22 bp, Artificial Sequence
  Synthetic oligonucleotide; TTT chr11 5326336 5326357 5326341 5326336 -
gccacatagtgcagccttggga

SEQ ID NO: 126103 - DNA, 22 bp, Artificial Sequence
  Synthetic oligonucleotide; TTG chr11 5326335 5326356 5326340 5326335 -
ccacatagtgcagccttgggag

SEQ ID NO: 126104 - DNA, 22 bp, Artificial Sequence
  Synthetic oligonucleotide; CTT chr11 5326318 5326339 5326323 5326318 -
gggagcatgcatacagtatggc

SEQ ID NO: 126105 - DNA, 22 bp, Artificial Sequence
  Synthetic oligonucleotide; TTG chr11 5326317 5326338 5326322 5326317 -
ggagcatgcatacagtatggct

SEQ ID NO: 126106 - DNA, 22 bp, Artificial Sequence
  Synthetic oligonucleotide; CTT chr11 5326294 5326315 5326299 5326294 -
catctctggtgacactgcttat

SEQ ID NO: 126107 - DNA, 22 bp, Artificial Sequence
  Synthetic oligonucleotide; TTC chr11 5326293 5326314 5326298 5326293 -
atctctggtgacactgcttata

SEQ ID NO: 126108 - DNA, 22 bp, Artificial Sequence
  Synthetic oligonucleotide; CTC chr11 5326288 5326309 5326293 5326288 -
tggtgacactgcttatagtggg

SEQ ID NO: 126109 - DNA, 22 bp, Artificial Sequence
  Synthetic oligonucleotide; CTG chr11 5326286 5326307 5326291 5326286 -
gtgacactgcttatagtgggcc

SEQ ID NO: 126110 - DNA, 22 bp, Artificial Sequence
  Synthetic oligonucleotide; CTG chr11 5326277 5326298 5326282 5326277 -
cttatagtgggcctcagtttga

SEQ ID NO: 126111 - DNA, 22 bp, Artificial Sequence
  Synthetic oligonucleotide; CTT chr11 5326274 5326295 5326279 5326274 -
atagtgggcctcagtttgatga

SEQ ID NO: 126112 - DNA, 22 bp, Artificial Sequence
  Synthetic oligonucleotide; TTA chr11 5326273 5326294 5326278 5326273 -
tagtgggcctcagtttgatgac

SEQ ID NO: 126113 - DNA, 22 bp, Artificial Sequence
  Synthetic oligonucleotide; CTC chr11 5326262 5326283 5326267 5326262 -
agtttgatgacagtatctagct

SEQ ID NO: 126114 - DNA, 22 bp, Artificial Sequence
  Synthetic oligonucleotide; TTT chr11 5326257 5326278 5326262 5326257 -
gatgacagtatctagctctcct

SEQ ID NO: 126115 - DNA, 22 bp, Artificial Sequence
  Synthetic oligonucleotide; TTG chr11 5326256 5326277 5326261 5326256 -
atgacagtatctagctctccta

SEQ ID NO: 126116 - DNA, 22 bp, Artificial Sequence
  Synthetic oligonucleotide; CTA chr11 5326243 5326264 5326248 5326243 -
gctctcctagaatccccacacg

SEQ ID NO: 126117 - DNA, 22 bp, Artificial Sequence
  Synthetic oligonucleotide; CTC chr11 5326239 5326260 5326244 5326239 -
tcctagaatccccacacgcctg

SEQ ID NO: 126118 - DNA, 22 bp, Artificial Sequence
  Synthetic oligonucleotide; CTC chr11 5326237 5326258 5326242 5326237 -
ctagaatccccacacgcctgcc

SEQ ID NO: 126119 - DNA, 22 bp, Artificial Sequence
  Synthetic oligonucleotide; CTA chr11 5326234 5326255 5326239 5326234 -
gaatccccacacgcctgcctct

SEQ ID NO: 126120 - DNA, 22 bp, Artificial Sequence
  Synthetic oligonucleotide; CTG chr11 5326217 5326238 5326222 5326217 -
cctctgggtaaatatcaacggc

SEQ ID NO: 126121 - DNA, 22 bp, Artificial Sequence
  Synthetic oligonucleotide; CTC chr11 5326213 5326234 5326218 5326213 -
tgggtaaatatcaacggcttcc

SEQ ID NO: 126122 - DNA, 22 bp, Artificial Sequence
  Synthetic oligonucleotide; CTG chr11 5326211 5326232 5326216 5326211 -
ggtaaatatcaacggcttccca

SEQ ID NO: 126123 - DNA, 22 bp, Artificial Sequence
  Synthetic oligonucleotide; CTT chr11 5326193 5326214 5326198 5326193 -
cccagtgttgggcaggcttctt

SEQ ID NO: 126124 - DNA, 22 bp, Artificial Sequence
  Synthetic oligonucleotide; TTC chr11 5326192 5326213 5326197 5326192 -
ccagtgttgggcaggcttcttt

SEQ ID NO: 126125 - DNA, 22 bp, Artificial Sequence
  Synthetic oligonucleotide; TTG chr11 5326183 5326204 5326188 5326183 -
ggcaggcttcttttgtgtttct

SEQ ID NO: 126126 - DNA, 22 bp, Artificial Sequence
  Synthetic oligonucleotide; CTT chr11 5326174 5326195 5326179 5326174 -
cttttgtgtttctttttattcc

SEQ ID NO: 126127 - DNA, 22 bp, Artificial Sequence
  Synthetic oligonucleotide; TTC chr11 5326173 5326194 5326178 5326173 -
ttttgtgtttctttttattccc

SEQ ID NO: 126128 - DNA, 22 bp, Artificial Sequence
  Synthetic oligonucleotide; CTT chr11 5326171 5326192 5326176 5326171 -
ttgtgtttctttttattcccaa

SEQ ID NO: 126129 - DNA, 22 bp, Artificial Sequence
  Synthetic oligonucleotide; TTT chr11 5326170 5326191 5326175 5326170 -
tgtgtttctttttattcccaaa

SEQ ID NO: 126130 - DNA, 22 bp, Artificial Sequence
  Synthetic oligonucleotide; TTT chr11 5326169 5326190 5326174 5326169 -
gtgtttctttttattcccaaaa

SEQ ID NO: 126131 - DNA, 22 bp, Artificial Sequence
  Synthetic oligonucleotide; TTG chr11 5326168 5326189 5326173 5326168 -
tgtttctttttattcccaaaat

SEQ ID NO: 126132 - DNA, 22 bp, Artificial Sequence
  Synthetic oligonucleotide; TTT chr11 5326163 5326184 5326168 5326163 -
ctttttattcccaaaatctcag

SEQ ID NO: 126133 - DNA, 22 bp, Artificial Sequence
  Synthetic oligonucleotide; TTC chr11 5326162 5326183 5326167 5326162 -
tttttattcccaaaatctcaga

SEQ ID NO: 126134 - DNA, 22 bp, Artificial Sequence
  Synthetic oligonucleotide; CTT chr11 5326160 5326181 5326165 5326160 -
tttattcccaaaatctcagaca

SEQ ID NO: 126135 - DNA, 22 bp, Artificial Sequence
  Synthetic oligonucleotide; TTT chr11 5326159 5326180 5326164 5326159 -
ttattcccaaaatctcagacat

SEQ ID NO: 126136 - DNA, 22 bp, Artificial Sequence
  Synthetic oligonucleotide; TTT chr11 5326158 5326179 5326163 5326158 -
tattcccaaaatctcagacatg

SEQ ID NO: 126137 - DNA, 22 bp, Artificial Sequence
  Synthetic oligonucleotide; TTT chr11 5326157 5326178 5326162 5326157 -
attcccaaaatctcagacatga

SEQ ID NO: 126138 - DNA, 22 bp, Artificial Sequence
  Synthetic oligonucleotide; TTA chr11 5326156 5326177 5326161 5326156 -
ttcccaaaatctcagacatgat

SEQ ID NO: 126139 - DNA, 22 bp, Artificial Sequence
  Synthetic oligonucleotide; TTC chr11 5326153 5326174 5326158 5326153 -
ccaaaatctcagacatgattta

SEQ ID NO: 126140 - DNA, 22 bp, Artificial Sequence
  Synthetic oligonucleotide; CTC chr11 5326143 5326164 5326148 5326143 -
agacatgatttacctttcattt

SEQ ID NO: 126141 - DNA, 22 bp, Artificial Sequence
  Synthetic oligonucleotide; TTT chr11 5326132 5326153 5326137 5326132 -
acctttcattttctttgaggta

SEQ ID NO: 126142 - DNA, 22 bp, Artificial Sequence
  Synthetic oligonucleotide; TTA chr11 5326131 5326152 5326136 5326131 -
cctttcattttctttgaggtac

SEQ ID NO: 126143 - DNA, 22 bp, Artificial Sequence
  Synthetic oligonucleotide; CTT chr11 5326127 5326148 5326132 5326127 -
tcattttctttgaggtaccata

SEQ ID NO: 126144 - DNA, 22 bp, Artificial Sequence
  Synthetic oligonucleotide; TTT chr11 5326126 5326147 5326131 5326126 -
cattttctttgaggtaccataa

SEQ ID NO: 126145 - DNA, 22 bp, Artificial Sequence
  Synthetic oligonucleotide; TTC chr11 5326125 5326146 5326130 5326125 -
attttctttgaggtaccataac

SEQ ID NO: 126146 - DNA, 22 bp, Artificial Sequence
  Synthetic oligonucleotide; TTT chr11 5326121 5326142 5326126 5326121 -
tctttgaggtaccataaccttc

SEQ ID NO: 126147 - DNA, 22 bp, Artificial Sequence
  Synthetic oligonucleotide; TTT chr11 5326120 5326141 5326125 5326120 -
ctttgaggtaccataaccttcc

SEQ ID NO: 126148 - DNA, 22 bp, Artificial Sequence
  Synthetic oligonucleotide; TTC chr11 5326119 5326140 5326124 5326119 -
tttgaggtaccataaccttccc

SEQ ID NO: 126149 - DNA, 22 bp, Artificial Sequence
  Synthetic oligonucleotide; CTT chr11 5326117 5326138 5326122 5326117 -
tgaggtaccataaccttccctg

SEQ ID NO: 126150 - DNA, 22 bp, Artificial Sequence
  Synthetic oligonucleotide; TTT chr11 5326116 5326137 5326121 5326116 -
gaggtaccataaccttccctgt

SEQ ID NO: 126151 - DNA, 22 bp, Artificial Sequence
  Synthetic oligonucleotide; TTG chr11 5326115 5326136 5326120 5326115 -
aggtaccataaccttccctgtc

SEQ ID NO: 126152 - DNA, 22 bp, Artificial Sequence
  Synthetic oligonucleotide; CTT chr11 5326100 5326121 5326105 5326100 -
ccctgtcttacttttaatgacc

SEQ ID NO: 126153 - DNA, 22 bp, Artificial Sequence
  Synthetic oligonucleotide; TTC chr11 5326099 5326120 5326104 5326099 -
cctgtcttacttttaatgaccc

SEQ ID NO: 126154 - DNA, 22 bp, Artificial Sequence
  Synthetic oligonucleotide; CTG chr11 5326095 5326116 5326100 5326095 -
tcttacttttaatgacccaagc

SEQ ID NO: 126155 - DNA, 22 bp, Artificial Sequence
  Synthetic oligonucleotide; CTT chr11 5326091 5326112 5326096 5326091 -
acttttaatgacccaagcttag

SEQ ID NO: 126156 - DNA, 22 bp, Artificial Sequence
  Synthetic oligonucleotide; TTA chr11 5326090 5326111 5326095 5326090 -
cttttaatgacccaagcttaga

SEQ ID NO: 126157 - DNA, 22 bp, Artificial Sequence
  Synthetic oligonucleotide; CTT chr11 5326087 5326108 5326092 5326087 -
ttaatgacccaagcttagagat

SEQ ID NO: 126158 - DNA, 22 bp, Artificial Sequence
  Synthetic oligonucleotide; TTT chr11 5326086 5326107 5326091 5326086 -
taatgacccaagcttagagatg

SEQ ID NO: 126159 - DNA, 22 bp, Artificial Sequence
  Synthetic oligonucleotide; TTT chr11 5326085 5326106 5326090 5326085 -
aatgacccaagcttagagatgg

SEQ ID NO: 126160 - DNA, 22 bp, Artificial Sequence
  Synthetic oligonucleotide; TTA chr11 5326084 5326105 5326089 5326084 -
atgacccaagcttagagatgga

SEQ ID NO: 126161 - DNA, 22 bp, Artificial Sequence
  Synthetic oligonucleotide; CTT chr11 5326071 5326092 5326076 5326071 -
agagatggagggagatatgact

SEQ ID NO: 126162 - DNA, 22 bp, Artificial Sequence
  Synthetic oligonucleotide; TTA chr11 5326070 5326091 5326075 5326070 -
gagatggagggagatatgactg

SEQ ID NO: 126163 - DNA, 22 bp, Artificial Sequence
  Synthetic oligonucleotide; CTG chr11 5326048 5326069 5326053 5326048 -
taaacatttttttctgctcata

SEQ ID NO: 126164 - DNA, 22 bp, Artificial Sequence
  Synthetic oligonucleotide; TTT chr11 5326039 5326060 5326044 5326039 -
ttttctgctcataaatataata

SEQ ID NO: 126165 - DNA, 22 bp, Artificial Sequence
  Synthetic oligonucleotide; TTT chr11 5326038 5326059 5326043 5326038 -
tttctgctcataaatataataa

SEQ ID NO: 126166 - DNA, 22 bp, Artificial Sequence
  Synthetic oligonucleotide; TTT chr11 5326037 5326058 5326042 5326037 -
ttctgctcataaatataataaa

SEQ ID NO: 126167 - DNA, 22 bp, Artificial Sequence
  Synthetic oligonucleotide; TTT chr11 5326036 5326057 5326041 5326036 -
tctgctcataaatataataaaa

SEQ ID NO: 126168 - DNA, 22 bp, Artificial Sequence
  Synthetic oligonucleotide; TTT chr11 5326035 5326056 5326040 5326035 -
ctgctcataaatataataaaaa

SEQ ID NO: 126169 - DNA, 22 bp, Artificial Sequence
  Synthetic oligonucleotide; TTC chr11 5326034 5326055 5326039 5326034 -
tgctcataaatataataaaaaa

SEQ ID NO: 126170 - DNA, 22 bp, Artificial Sequence
  Synthetic oligonucleotide; CTG chr11 5326032 5326053 5326037 5326032 -
ctcataaatataataaaaaact

SEQ ID NO: 126171 - DNA, 22 bp, Artificial Sequence
  Synthetic oligonucleotide; CTC chr11 5326029 5326050 5326034 5326029 -
ataaatataataaaaaactttc

SEQ ID NO: 126172 - DNA, 22 bp, Artificial Sequence
  Synthetic oligonucleotide; CTT chr11 5326009 5326030 5326014 5326009 -
tcttttttggtttcaagtgttt

SEQ ID NO: 126173 - DNA, 22 bp, Artificial Sequence
  Synthetic oligonucleotide; TTT chr11 5326008 5326029 5326013 5326008 -
cttttttggtttcaagtgtttt

SEQ ID NO: 126174 - DNA, 22 bp, Artificial Sequence
  Synthetic oligonucleotide; TTC chr11 5326007 5326028 5326012 5326007 -
ttttttggtttcaagtgtttta

SEQ ID NO: 126175 - DNA, 22 bp, Artificial Sequence
  Synthetic oligonucleotide; CTT chr11 5326005 5326026 5326010 5326005 -
ttttggtttcaagtgttttatg

SEQ ID NO: 126176 - DNA, 22 bp, Artificial Sequence
  Synthetic oligonucleotide; TTT chr11 5326004 5326025 5326009 5326004 -
tttggtttcaagtgttttatgg

SEQ ID NO: 126177 - DNA, 22 bp, Artificial Sequence
  Synthetic oligonucleotide; TTT chr11 5326003 5326024 5326008 5326003 -
ttggtttcaagtgttttatggc

SEQ ID NO: 126178 - DNA, 22 bp, Artificial Sequence
  Synthetic oligonucleotide; TTT chr11 5326002 5326023 5326007 5326002 -
tggtttcaagtgttttatggcc

SEQ ID NO: 126179 - DNA, 22 bp, Artificial Sequence
  Synthetic oligonucleotide; TTT chr11 5326001 5326022 5326006 5326001 -
ggtttcaagtgttttatggcca

SEQ ID NO: 126180 - DNA, 22 bp, Artificial Sequence
  Synthetic oligonucleotide; TTG chr11 5326000 5326021 5326005 5326000 -
gtttcaagtgttttatggccaa

SEQ ID NO: 126181 - DNA, 22 bp, Artificial Sequence
  Synthetic oligonucleotide; TTT chr11 5325996 5326017 5326001 5325996 -
caagtgttttatggccaatttc

SEQ ID NO: 126182 - DNA, 22 bp, Artificial Sequence
  Synthetic oligonucleotide; TTC chr11 5325995 5326016 5326000 5325995 -
aagtgttttatggccaatttct

SEQ ID NO: 126183 - DNA, 22 bp, Artificial Sequence
  Synthetic oligonucleotide; TTT chr11 5325987 5326008 5325992 5325987 -
tatggccaatttctctaaagac

SEQ ID NO: 126184 - DNA, 22 bp, Artificial Sequence
  Synthetic oligonucleotide; TTT chr11 5325986 5326007 5325991 5325986 -
atggccaatttctctaaagacg

SEQ ID NO: 126185 - DNA, 22 bp, Artificial Sequence
  Synthetic oligonucleotide; TTA chr11 5325985 5326006 5325990 5325985 -
tggccaatttctctaaagacgt

SEQ ID NO: 126186 - DNA, 22 bp, Artificial Sequence
  Synthetic oligonucleotide; TTT chr11 5325975 5325996 5325980 5325975 -
ctctaaagacgttattgttttt

SEQ ID NO: 126187 - DNA, 22 bp, Artificial Sequence
  Synthetic oligonucleotide; TTC chr11 5325974 5325995 5325979 5325974 -
tctaaagacgttattgtttttt

SEQ ID NO: 126188 - DNA, 22 bp, Artificial Sequence
  Synthetic oligonucleotide; CTC chr11 5325972 5325993 5325977 5325972 -
taaagacgttattgttttttaa

SEQ ID NO: 126189 - DNA, 22 bp, Artificial Sequence
  Synthetic oligonucleotide; CTA chr11 5325970 5325991 5325975 5325970 -
aagacgttattgttttttaagg

SEQ ID NO: 126190 - DNA, 22 bp, Artificial Sequence
  Synthetic oligonucleotide; TTA chr11 5325961 5325982 5325966 5325961 -
ttgttttttaaggaaaagctca

SEQ ID NO: 126191 - DNA, 22 bp, Artificial Sequence
  Synthetic oligonucleotide; TTG chr11 5325958 5325979 5325963 5325958 -
ttttttaaggaaaagctcacaa

SEQ ID NO: 126192 - DNA, 22 bp, Artificial Sequence
  Synthetic oligonucleotide; TTT chr11 5325955 5325976 5325960 5325955 -
tttaaggaaaagctcacaaaca

SEQ ID NO: 126193 - DNA, 22 bp, Artificial Sequence
  Synthetic oligonucleotide; TTT chr11 5325954 5325975 5325959 5325954 -
ttaaggaaaagctcacaaacat

SEQ ID NO: 126194 - DNA, 22 bp, Artificial Sequence
  Synthetic oligonucleotide; TTT chr11 5325953 5325974 5325958 5325953 -
taaggaaaagctcacaaacatt

SEQ ID NO: 126195 - DNA, 22 bp, Artificial Sequence
  Synthetic oligonucleotide; TTT chr11 5325952 5325973 5325957 5325952 -
aaggaaaagctcacaaacattt

SEQ ID NO: 126196 - DNA, 22 bp, Artificial Sequence
  Synthetic oligonucleotide; TTA chr11 5325951 5325972 5325956 5325951 -
aggaaaagctcacaaacatttt

SEQ ID NO: 126197 - DNA, 22 bp, Artificial Sequence
  Synthetic oligonucleotide; CTC chr11 5325940 5325961 5325945 5325940 -
acaaacattttaaaaagtactt

SEQ ID NO: 126198 - DNA, 22 bp, Artificial Sequence
  Synthetic oligonucleotide; TTT chr11 5325930 5325951 5325935 5325930 -
taaaaagtacttgtgctctgga

SEQ ID NO: 126199 - DNA, 22 bp, Artificial Sequence
  Synthetic oligonucleotide; TTT chr11 5325929 5325950 5325934 5325929 -
aaaaagtacttgtgctctggaa

SEQ ID NO: 126200 - DNA, 22 bp, Artificial Sequence
  Synthetic oligonucleotide; TTA chr11 5325928 5325949 5325933 5325928 -
aaaagtacttgtgctctggaaa

SEQ ID NO: 126201 - DNA, 22 bp, Artificial Sequence
  Synthetic oligonucleotide; CTT chr11 5325918 5325939 5325923 5325918 -
gtgctctggaaatctagtttga

SEQ ID NO: 126202 - DNA, 22 bp, Artificial Sequence
  Synthetic oligonucleotide; TTG chr11 5325917 5325938 5325922 5325917 -
tgctctggaaatctagtttgat

SEQ ID NO: 126203 - DNA, 22 bp, Artificial Sequence
  Synthetic oligonucleotide; CTC chr11 5325912 5325933 5325917 5325912 -
tggaaatctagtttgatcctta

SEQ ID NO: 126204 - DNA, 22 bp, Artificial Sequence
  Synthetic oligonucleotide; CTG chr11 5325910 5325931 5325915 5325910 -
gaaatctagtttgatccttaca

SEQ ID NO: 126205 - DNA, 22 bp, Artificial Sequence
  Synthetic oligonucleotide; CTA chr11 5325902 5325923 5325907 5325902 -
gtttgatccttacacaattttt

SEQ ID NO: 126206 - DNA, 22 bp, Artificial Sequence
  Synthetic oligonucleotide; TTT chr11 5325898 5325919 5325903 5325898 -
gatccttacacaatttttttta

SEQ ID NO: 126207 - DNA, 22 bp, Artificial Sequence
  Synthetic oligonucleotide; TTG chr11 5325897 5325918 5325902 5325897 -
atccttacacaattttttttaa

SEQ ID NO: 126208 - DNA, 22 bp, Artificial Sequence
  Synthetic oligonucleotide; CTT chr11 5325891 5325912 5325896 5325891 -
acacaattttttttaaaggaat

SEQ ID NO: 126209 - DNA, 22 bp, Artificial Sequence
  Synthetic oligonucleotide; TTA chr11 5325890 5325911 5325895 5325890 -
cacaattttttttaaaggaatc

SEQ ID NO: 126210 - DNA, 22 bp, Artificial Sequence
  Synthetic oligonucleotide; TTT chr11 5325882 5325903 5325887 5325882 -
tttttaaaggaatcccagattt

SEQ ID NO: 126211 - DNA, 22 bp, Artificial Sequence
  Synthetic oligonucleotide; TTT chr11 5325881 5325902 5325886 5325881 -
ttttaaaggaatcccagatttt

SEQ ID NO: 126212 - DNA, 22 bp, Artificial Sequence
  Synthetic oligonucleotide; TTT chr11 5325880 5325901 5325885 5325880 -
tttaaaggaatcccagatttta

SEQ ID NO: 126213 - DNA, 22 bp, Artificial Sequence
  Synthetic oligonucleotide; TTT chr11 5325879 5325900 5325884 5325879 -
ttaaaggaatcccagattttat

SEQ ID NO: 126214 - DNA, 22 bp, Artificial Sequence
  Synthetic oligonucleotide; TTT chr11 5325878 5325899 5325883 5325878 -
taaaggaatcccagattttatg

SEQ ID NO: 126215 - DNA, 22 bp, Artificial Sequence
  Synthetic oligonucleotide; TTT chr11 5325877 5325898 5325882 5325877 -
aaaggaatcccagattttatgg

SEQ ID NO: 126216 - DNA, 22 bp, Artificial Sequence
  Synthetic oligonucleotide; TTA chr11 5325876 5325897 5325881 5325876 -
aaggaatcccagattttatggc

SEQ ID NO: 126217 - DNA, 22 bp, Artificial Sequence
  Synthetic oligonucleotide; TTT chr11 5325860 5325881 5325865 5325860 -
tatggctttctttttaaaaatt

SEQ ID NO: 126218 - DNA, 22 bp, Artificial Sequence
  Synthetic oligonucleotide; TTT chr11 5325859 5325880 5325864 5325859 -
atggctttctttttaaaaattt

SEQ ID NO: 126219 - DNA, 22 bp, Artificial Sequence
  Synthetic oligonucleotide; TTA chr11 5325858 5325879 5325863 5325858 -
tggctttctttttaaaaatttt

SEQ ID NO: 126220 - DNA, 22 bp, Artificial Sequence
  Synthetic oligonucleotide; CTT chr11 5325852 5325873 5325857 5325852 -
tctttttaaaaattttttattt

SEQ ID NO: 126221 - DNA, 22 bp, Artificial Sequence
  Synthetic oligonucleotide; TTT chr11 5325851 5325872 5325856 5325851 -
ctttttaaaaattttttatttt

SEQ ID NO: 126222 - DNA, 22 bp, Artificial Sequence
  Synthetic oligonucleotide; TTC chr11 5325850 5325871 5325855 5325850 -
tttttaaaaattttttattttt

SEQ ID NO: 126223 - DNA, 22 bp, Artificial Sequence
  Synthetic oligonucleotide; CTT chr11 5325848 5325869 5325853 5325848 -
tttaaaaattttttatttttaa

SEQ ID NO: 126224 - DNA, 22 bp, Artificial Sequence
  Synthetic oligonucleotide; TTT chr11 5325847 5325868 5325852 5325847 -
ttaaaaattttttatttttaaa

SEQ ID NO: 126225 - DNA, 22 bp, Artificial Sequence
  Synthetic oligonucleotide; TTT chr11 5325846 5325867 5325851 5325846 -
taaaaattttttatttttaaaa

SEQ ID NO: 126226 - DNA, 22 bp, Artificial Sequence
  Synthetic oligonucleotide; TTT chr11 5325845 5325866 5325850 5325845 -
aaaaattttttatttttaaaat

SEQ ID NO: 126227 - DNA, 22 bp, Artificial Sequence
  Synthetic oligonucleotide; TTA chr11 5325844 5325865 5325849 5325844 -
aaaattttttatttttaaaatt

SEQ ID NO: 126228 - DNA, 22 bp, Artificial Sequence
  Synthetic oligonucleotide; TTT chr11 5325837 5325858 5325842 5325837 -
tttatttttaaaattttttaaa

SEQ ID NO: 126229 - DNA, 22 bp, Artificial Sequence
  Synthetic oligonucleotide; TTT chr11 5325836 5325857 5325841 5325836 -
ttatttttaaaattttttaaaa

SEQ ID NO: 126230 - DNA, 22 bp, Artificial Sequence
  Synthetic oligonucleotide; TTT chr11 5325835 5325856 5325840 5325835 -
tatttttaaaattttttaaaac

SEQ ID NO: 126231 - DNA, 22 bp, Artificial Sequence
  Synthetic oligonucleotide; TTT chr11 5325834 5325855 5325839 5325834 -
atttttaaaattttttaaaact

SEQ ID NO: 126232 - DNA, 22 bp, Artificial Sequence
  Synthetic oligonucleotide; TTA chr11 5325833 5325854 5325838 5325833 -
tttttaaaattttttaaaactt

SEQ ID NO: 126233 - DNA, 22 bp, Artificial Sequence
  Synthetic oligonucleotide; TTT chr11 5325830 5325851 5325835 5325830 -
ttaaaattttttaaaactttaa

SEQ ID NO: 126234 - DNA, 22 bp, Artificial Sequence
  Synthetic oligonucleotide; TTT chr11 5325829 5325850 5325834 5325829 -
taaaattttttaaaactttaat

SEQ ID NO: 126235 - DNA, 22 bp, Artificial Sequence
  Synthetic oligonucleotide; TTT chr11 5325828 5325849 5325833 5325828 -
aaaattttttaaaactttaatt

SEQ ID NO: 126236 - DNA, 22 bp, Artificial Sequence
  Synthetic oligonucleotide; TTA chr11 5325827 5325848 5325832 5325827 -
aaattttttaaaactttaatta

SEQ ID NO: 126237 - DNA, 22 bp, Artificial Sequence
  Synthetic oligonucleotide; TTT chr11 5325821 5325842 5325826 5325821 -
tttaaaactttaattaaaaaaa

SEQ ID NO: 126238 - DNA, 22 bp, Artificial Sequence
  Synthetic oligonucleotide; TTT chr11 5325820 5325841 5325825 5325820 -
ttaaaactttaattaaaaaaaa

SEQ ID NO: 126239 - DNA, 22 bp, Artificial Sequence
  Synthetic oligonucleotide; TTT chr11 5325819 5325840 5325824 5325819 -
taaaactttaattaaaaaaaat

SEQ ID NO: 126240 - DNA, 22 bp, Artificial Sequence
  Synthetic oligonucleotide; TTT chr11 5325818 5325839 5325823 5325818 -
aaaactttaattaaaaaaaatt

SEQ ID NO: 126241 - DNA, 22 bp, Artificial Sequence
  Synthetic oligonucleotide; TTA chr11 5325817 5325838 5325822 5325817 -
aaactttaattaaaaaaaattt

SEQ ID NO: 126242 - DNA, 22 bp, Artificial Sequence
  Synthetic oligonucleotide; CTT chr11 5325811 5325832 5325816 5325811 -
taattaaaaaaaattttaatgt

SEQ ID NO: 126243 - DNA, 22 bp, Artificial Sequence
  Synthetic oligonucleotide; TTT chr11 5325810 5325831 5325815 5325810 -
aattaaaaaaaattttaatgtg

SEQ ID NO: 126244 - DNA, 22 bp, Artificial Sequence
  Synthetic oligonucleotide; TTA chr11 5325809 5325830 5325814 5325809 -
attaaaaaaaattttaatgtga

SEQ ID NO: 126245 - DNA, 22 bp, Artificial Sequence
  Synthetic oligonucleotide; TTA chr11 5325805 5325826 5325810 5325805 -
aaaaaaattttaatgtgacttt

SEQ ID NO: 126246 - DNA, 22 bp, Artificial Sequence
  Synthetic oligonucleotide; TTT chr11 5325795 5325816 5325800 5325795 -
taatgtgactttcttctatgtt

SEQ ID NO: 126247 - DNA, 22 bp, Artificial Sequence
  Synthetic oligonucleotide; TTT chr11 5325794 5325815 5325799 5325794 -
aatgtgactttcttctatgttt

SEQ ID NO: 126248 - DNA, 22 bp, Artificial Sequence
  Synthetic oligonucleotide; TTA chr11 5325793 5325814 5325798 5325793 -
atgtgactttcttctatgttta

SEQ ID NO: 126249 - DNA, 22 bp, Artificial Sequence
  Synthetic oligonucleotide; CTT chr11 5325784 5325805 5325789 5325784 -
tcttctatgtttacccttcaga

SEQ ID NO: 126250 - DNA, 22 bp, Artificial Sequence
  Synthetic oligonucleotide; TTT chr11 5325783 5325804 5325788 5325783 -
cttctatgtttacccttcagaa

SEQ ID NO: 126251 - DNA, 22 bp, Artificial Sequence
  Synthetic oligonucleotide; TTC chr11 5325782 5325803 5325787 5325782 -
ttctatgtttacccttcagaat

SEQ ID NO: 126252 - DNA, 22 bp, Artificial Sequence
  Synthetic oligonucleotide; CTT chr11 5325780 5325801 5325785 5325780 -
ctatgtttacccttcagaatat

SEQ ID NO: 126253 - DNA, 22 bp, Artificial Sequence
  Synthetic oligonucleotide; TTC chr11 5325779 5325800 5325784 5325779 -
tatgtttacccttcagaatatg

SEQ ID NO: 126254 - DNA, 22 bp, Artificial Sequence
  Synthetic oligonucleotide; CTA chr11 5325777 5325798 5325782 5325777 -
tgtttacccttcagaatatgtg

SEQ ID NO: 126255 - DNA, 22 bp, Artificial Sequence
  Synthetic oligonucleotide; TTT chr11 5325772 5325793 5325777 5325772 -
acccttcagaatatgtgtcacc

SEQ ID NO: 126256 - DNA, 22 bp, Artificial Sequence
  Synthetic oligonucleotide; TTA chr11 5325771 5325792 5325776 5325771 -
cccttcagaatatgtgtcacca

SEQ ID NO: 126257 - DNA, 22 bp, Artificial Sequence
  Synthetic oligonucleotide; CTT chr11 5325766 5325787 5325771 5325766 -
cagaatatgtgtcaccaatttg

SEQ ID NO: 126258 - DNA, 22 bp, Artificial Sequence
  Synthetic oligonucleotide; TTC chr11 5325765 5325786 5325770 5325765 -
agaatatgtgtcaccaatttgt

SEQ ID NO: 126259 - DNA, 22 bp, Artificial Sequence
  Synthetic oligonucleotide; TTT chr11 5325745 5325766 5325750 5325745 -
gtcctttctctaatctgccatt

SEQ ID NO: 126260 - DNA, 22 bp, Artificial Sequence
  Synthetic oligonucleotide; TTG chr11 5325744 5325765 5325749 5325744 -
tcctttctctaatctgccattc

SEQ ID NO: 126261 - DNA, 22 bp, Artificial Sequence
  Synthetic oligonucleotide; CTT chr11 5325739 5325760 5325744 5325739 -
tctctaatctgccattctcttc

SEQ ID NO: 126262 - DNA, 22 bp, Artificial Sequence
  Synthetic oligonucleotide; TTT chr11 5325738 5325759 5325743 5325738 -
ctctaatctgccattctcttcc

SEQ ID NO: 126263 - DNA, 22 bp, Artificial Sequence
  Synthetic oligonucleotide; TTC chr11 5325737 5325758 5325742 5325737 -
tctaatctgccattctcttcct

SEQ ID NO: 126264 - DNA, 22 bp, Artificial Sequence
  Synthetic oligonucleotide; CTC chr11 5325735 5325756 5325740 5325735 -
taatctgccattctcttcctcc

SEQ ID NO: 126265 - DNA, 22 bp, Artificial Sequence
  Synthetic oligonucleotide; CTA chr11 5325733 5325754 5325738 5325733 -
atctgccattctcttcctccta

SEQ ID NO: 126266 - DNA, 22 bp, Artificial Sequence
  Synthetic oligonucleotide; CTG chr11 5325728 5325749 5325733 5325728 -
ccattctcttcctcctatacct

SEQ ID NO: 126267 - DNA, 22 bp, Artificial Sequence
  Synthetic oligonucleotide; TTC chr11 5325722 5325743 5325727 5325722 -
tcttcctcctatacctcattcc

SEQ ID NO: 126268 - DNA, 22 bp, Artificial Sequence
  Synthetic oligonucleotide; CTC chr11 5325720 5325741 5325725 5325720 -
ttcctcctatacctcattccgt

SEQ ID NO: 126269 - DNA, 22 bp, Artificial Sequence
  Synthetic oligonucleotide; CTT chr11 5325718 5325739 5325723 5325718 -
cctcctatacctcattccgtac

SEQ ID NO: 126270 - DNA, 22 bp, Artificial Sequence
  Synthetic oligonucleotide; TTC chr11 5325717 5325738 5325722 5325717 -
ctcctatacctcattccgtaca

SEQ ID NO: 126271 - DNA, 22 bp, Artificial Sequence
  Synthetic oligonucleotide; CTC chr11 5325714 5325735 5325719 5325714 -
ctatacctcattccgtacatcc

SEQ ID NO: 126272 - DNA, 22 bp, Artificial Sequence
  Synthetic oligonucleotide; CTA chr11 5325711 5325732 5325716 5325711 -
tacctcattccgtacatcctct

SEQ ID NO: 126273 - DNA, 22 bp, Artificial Sequence
  Synthetic oligonucleotide; CTC chr11 5325705 5325726 5325710 5325705 -
attccgtacatcctcttattcc

SEQ ID NO: 126274 - DNA, 22 bp, Artificial Sequence
  Synthetic oligonucleotide; TTC chr11 5325701 5325722 5325706 5325701 -
cgtacatcctcttattcctcaa

SEQ ID NO: 126275 - DNA, 22 bp, Artificial Sequence
  Synthetic oligonucleotide; CTC chr11 5325690 5325711 5325695 5325690 -
ttattcctcaatctgtgttttt

SEQ ID NO: 126276 - DNA, 22 bp, Artificial Sequence
  Synthetic oligonucleotide; CTT chr11 5325688 5325709 5325693 5325688 -
attcctcaatctgtgtttttaa

SEQ ID NO: 126277 - DNA, 22 bp, Artificial Sequence
  Synthetic oligonucleotide; TTA chr11 5325687 5325708 5325692 5325687 -
ttcctcaatctgtgtttttaag

SEQ ID NO: 126278 - DNA, 22 bp, Artificial Sequence
  Synthetic oligonucleotide; TTC chr11 5325684 5325705 5325689 5325684 -
ctcaatctgtgtttttaagcat

SEQ ID NO: 126279 - DNA, 22 bp, Artificial Sequence
  Synthetic oligonucleotide; CTC chr11 5325681 5325702 5325686 5325681 -
aatctgtgtttttaagcatgaa

SEQ ID NO: 126280 - DNA, 22 bp, Artificial Sequence
  Synthetic oligonucleotide; CTG chr11 5325675 5325696 5325680 5325675 -
tgtttttaagcatgaaggatct

SEQ ID NO: 126281 - DNA, 22 bp, Artificial Sequence
  Synthetic oligonucleotide; TTT chr11 5325670 5325691 5325675 5325670 -
ttaagcatgaaggatctttcga

SEQ ID NO: 126282 - DNA, 22 bp, Artificial Sequence
  Synthetic oligonucleotide; TTT chr11 5325669 5325690 5325674 5325669 -
taagcatgaaggatctttcgaa

SEQ ID NO: 126283 - DNA, 22 bp, Artificial Sequence
  Synthetic oligonucleotide; TTT chr11 5325668 5325689 5325673 5325668 -
aagcatgaaggatctttcgaag

SEQ ID NO: 126284 - DNA, 22 bp, Artificial Sequence
  Synthetic oligonucleotide; TTA chr11 5325667 5325688 5325672 5325667 -
agcatgaaggatctttcgaagg

SEQ ID NO: 126285 - DNA, 22 bp, Artificial Sequence
  Synthetic oligonucleotide; CTT chr11 5325652 5325673 5325657 5325652 -
tcgaaggtagaacaacatttgt

SEQ ID NO: 126286 - DNA, 22 bp, Artificial Sequence
  Synthetic oligonucleotide; TTT chr11 5325651 5325672 5325656 5325651 -
cgaaggtagaacaacatttgtg

SEQ ID NO: 126287 - DNA, 22 bp, Artificial Sequence
  Synthetic oligonucleotide; TTC chr11 5325650 5325671 5325655 5325650 -
gaaggtagaacaacatttgtgt

SEQ ID NO: 126288 - DNA, 22 bp, Artificial Sequence
  Synthetic oligonucleotide; TTT chr11 5325632 5325653 5325637 5325632 -
gtgtaataattataattcagtc

SEQ ID NO: 126289 - DNA, 22 bp, Artificial Sequence
  Synthetic oligonucleotide; TTG chr11 5325631 5325652 5325636 5325631 -
tgtaataattataattcagtct

SEQ ID NO: 126290 - DNA, 22 bp, Artificial Sequence
  Synthetic oligonucleotide; TTA chr11 5325620 5325641 5325625 5325620 -
taattcagtcttctatatgaat

SEQ ID NO: 126291 - DNA, 22 bp, Artificial Sequence
  Synthetic oligonucleotide; TTC chr11 5325614 5325635 5325619 5325614 -
agtcttctatatgaattcaatg

SEQ ID NO: 126292 - DNA, 22 bp, Artificial Sequence
  Synthetic oligonucleotide; CTT chr11 5325608 5325629 5325613 5325608 -
ctatatgaattcaatgtgattt

SEQ ID NO: 126293 - DNA, 22 bp, Artificial Sequence
  Synthetic oligonucleotide; TTC chr11 5325607 5325628 5325612 5325607 -
tatatgaattcaatgtgattta

SEQ ID NO: 126294 - DNA, 22 bp, Artificial Sequence
  Synthetic oligonucleotide; CTA chr11 5325605 5325626 5325610 5325605 -
tatgaattcaatgtgatttaat

SEQ ID NO: 126295 - DNA, 22 bp, Artificial Sequence
  Synthetic oligonucleotide; TTC chr11 5325596 5325617 5325601 5325596 -
aatgtgatttaattttagggat

SEQ ID NO: 126296 - DNA, 22 bp, Artificial Sequence
  Synthetic oligonucleotide; TTT chr11 5325586 5325607 5325591 5325586 -
aattttagggattccctagtgt

SEQ ID NO: 126297 - DNA, 22 bp, Artificial Sequence
  Synthetic oligonucleotide; TTA chr11 5325585 5325606 5325590 5325585 -
attttagggattccctagtgtt

SEQ ID NO: 126298 - DNA, 22 bp, Artificial Sequence
  Synthetic oligonucleotide; TTT chr11 5325581 5325602 5325586 5325581 -
tagggattccctagtgttggtg

SEQ ID NO: 126299 - DNA, 22 bp, Artificial Sequence
  Synthetic oligonucleotide; TTT chr11 5325580 5325601 5325585 5325580 -
agggattccctagtgttggtga

SEQ ID NO: 126300 - DNA, 22 bp, Artificial Sequence
  Synthetic oligonucleotide; TTA chr11 5325579 5325600 5325584 5325579 -
gggattccctagtgttggtgat

SEQ ID NO: 126301 - DNA, 22 bp, Artificial Sequence
  Synthetic oligonucleotide; TTC chr11 5325572 5325593 5325577 5325572 -
cctagtgttggtgatttcaatc

SEQ ID NO: 126302 - DNA, 22 bp, Artificial Sequence
  Synthetic oligonucleotide; CTA chr11 5325568 5325589 5325573 5325568 -
gtgttggtgatttcaatctcag

SEQ ID NO: 126303 - DNA, 22 bp, Artificial Sequence
  Synthetic oligonucleotide; TTG chr11 5325562 5325583 5325567 5325562 -
gtgatttcaatctcagtaagtt

SEQ ID NO: 126304 - DNA, 22 bp, Artificial Sequence
  Synthetic oligonucleotide; TTT chr11 5325555 5325576 5325560 5325555 -
caatctcagtaagttagtaatc

SEQ ID NO: 126305 - DNA, 22 bp, Artificial Sequence
  Synthetic oligonucleotide; TTC chr11 5325554 5325575 5325559 5325554 -
aatctcagtaagttagtaatcc

SEQ ID NO: 126306 - DNA, 22 bp, Artificial Sequence
  Synthetic oligonucleotide; CTC chr11 5325548 5325569 5325553 5325548 -
agtaagttagtaatcctgactc

SEQ ID NO: 126307 - DNA, 22 bp, Artificial Sequence
  Synthetic oligonucleotide; TTA chr11 5325539 5325560 5325544 5325539 -
gtaatcctgactcacaggagct

SEQ ID NO: 126308 - DNA, 22 bp, Artificial Sequence
  Synthetic oligonucleotide; CTG chr11 5325530 5325551 5325535 5325530 -
actcacaggagctgatacagag

SEQ ID NO: 126309 - DNA, 22 bp, Artificial Sequence
  Synthetic oligonucleotide; CTC chr11 5325526 5325547 5325531 5325526 -
acaggagctgatacagaggtag

SEQ ID NO: 126310 - DNA, 22 bp, Artificial Sequence
  Synthetic oligonucleotide; CTG chr11 5325516 5325537 5325521 5325516 -
atacagaggtagcatcagaaca

SEQ ID NO: 126311 - DNA, 22 bp, Artificial Sequence
  Synthetic oligonucleotide; TTT chr11 5325491 5325512 5325496 5325491 -
ccttatacaatatgaaatgctt

SEQ ID NO: 126312 - DNA, 22 bp, Artificial Sequence
  Synthetic oligonucleotide; TTC chr11 5325490 5325511 5325495 5325490 -
cttatacaatatgaaatgcttt

SEQ ID NO: 126313 - DNA, 22 bp, Artificial Sequence
  Synthetic oligonucleotide; CTT chr11 5325487 5325508 5325492 5325487 -
atacaatatgaaatgctttgtg

SEQ ID NO: 126314 - DNA, 22 bp, Artificial Sequence
  Synthetic oligonucleotide; TTA chr11 5325486 5325507 5325491 5325486 -
tacaatatgaaatgctttgtga

SEQ ID NO: 126315 - DNA, 22 bp, Artificial Sequence
  Synthetic oligonucleotide; CTT chr11 5325469 5325490 5325474 5325469 -
tgtgatttcttctgattctgat

SEQ ID NO: 126316 - DNA, 22 bp, Artificial Sequence
  Synthetic oligonucleotide; TTT chr11 5325468 5325489 5325473 5325468 -
gtgatttcttctgattctgatt

SEQ ID NO: 126317 - DNA, 22 bp, Artificial Sequence
  Synthetic oligonucleotide; TTG chr11 5325467 5325488 5325472 5325467 -
tgatttcttctgattctgattt

SEQ ID NO: 126318 - DNA, 22 bp, Artificial Sequence
  Synthetic oligonucleotide; TTT chr11 5325461 5325482 5325466 5325461 -
cttctgattctgatttattttt

SEQ ID NO: 126319 - DNA, 22 bp, Artificial Sequence
  Synthetic oligonucleotide; TTC chr11 5325460 5325481 5325465 5325460 -
ttctgattctgatttatttttg

SEQ ID NO: 126320 - DNA, 22 bp, Artificial Sequence
  Synthetic oligonucleotide; CTT chr11 5325458 5325479 5325463 5325458 -
ctgattctgatttatttttgat

SEQ ID NO: 126321 - DNA, 22 bp, Artificial Sequence
  Synthetic oligonucleotide; TTC chr11 5325457 5325478 5325462 5325457 -
tgattctgatttatttttgata

SEQ ID NO: 126322 - DNA, 22 bp, Artificial Sequence
  Synthetic oligonucleotide; CTG chr11 5325455 5325476 5325460 5325455 -
attctgatttatttttgatact

SEQ ID NO: 126323 - DNA, 22 bp, Artificial Sequence
  Synthetic oligonucleotide; TTC chr11 5325451 5325472 5325456 5325451 -
tgatttatttttgatactgagg

SEQ ID NO: 126324 - DNA, 22 bp, Artificial Sequence
  Synthetic oligonucleotide; CTG chr11 5325449 5325470 5325454 5325449 -
atttatttttgatactgaggcc

SEQ ID NO: 126325 - DNA, 22 bp, Artificial Sequence
  Synthetic oligonucleotide; TTT chr11 5325445 5325466 5325450 5325445 -
atttttgatactgaggccattt

SEQ ID NO: 126326 - DNA, 22 bp, Artificial Sequence
  Synthetic oligonucleotide; TTA chr11 5325444 5325465 5325449 5325444 -
tttttgatactgaggccatttt

SEQ ID NO: 126327 - DNA, 22 bp, Artificial Sequence
  Synthetic oligonucleotide; TTT chr11 5325441 5325462 5325446 5325441 -
ttgatactgaggccattttatg

SEQ ID NO: 126328 - DNA, 22 bp, Artificial Sequence
  Synthetic oligonucleotide; TTT chr11 5325440 5325461 5325445 5325440 -
tgatactgaggccattttatga

SEQ ID NO: 126329 - DNA, 22 bp, Artificial Sequence
  Synthetic oligonucleotide; TTT chr11 5325439 5325460 5325444 5325439 -
gatactgaggccattttatgaa

SEQ ID NO: 126330 - DNA, 22 bp, Artificial Sequence
  Synthetic oligonucleotide; TTG chr11 5325438 5325459 5325443 5325438 -
atactgaggccattttatgaag

SEQ ID NO: 126331 - DNA, 22 bp, Artificial Sequence
  Synthetic oligonucleotide; CTG chr11 5325432 5325453 5325437 5325432 -
aggccattttatgaagaaaact

SEQ ID NO: 126332 - DNA, 22 bp, Artificial Sequence
  Synthetic oligonucleotide; TTT chr11 5325423 5325444 5325428 5325423 -
tatgaagaaaactgctaggtgc

SEQ ID NO: 126333 - DNA, 22 bp, Artificial Sequence
  Synthetic oligonucleotide; TTT chr11 5325422 5325443 5325427 5325422 -
atgaagaaaactgctaggtgct

SEQ ID NO: 126334 - DNA, 22 bp, Artificial Sequence
  Synthetic oligonucleotide; TTA chr11 5325421 5325442 5325426 5325421 -
tgaagaaaactgctaggtgcta

SEQ ID NO: 126335 - DNA, 22 bp, Artificial Sequence
  Synthetic oligonucleotide; CTG chr11 5325409 5325430 5325414 5325409 -
ctaggtgctaaagacttgcctc

SEQ ID NO: 126336 - DNA, 22 bp, Artificial Sequence
  Synthetic oligonucleotide; CTA chr11 5325406 5325427 5325411 5325406 -
ggtgctaaagacttgcctccag

SEQ ID NO: 126337 - DNA, 22 bp, Artificial Sequence
  Synthetic oligonucleotide; CTA chr11 5325399 5325420 5325404 5325399 -
aagacttgcctccaggattctg

SEQ ID NO: 126338 - DNA, 22 bp, Artificial Sequence
  Synthetic oligonucleotide; CTT chr11 5325392 5325413 5325397 5325392 -
gcctccaggattctgaatttct

SEQ ID NO: 126339 - DNA, 22 bp, Artificial Sequence
  Synthetic oligonucleotide; TTG chr11 5325391 5325412 5325396 5325391 -
cctccaggattctgaatttctc

SEQ ID NO: 126340 - DNA, 22 bp, Artificial Sequence
  Synthetic oligonucleotide; CTC chr11 5325387 5325408 5325392 5325387 -
caggattctgaatttctcgtta

SEQ ID NO: 126341 - DNA, 22 bp, Artificial Sequence
  Synthetic oligonucleotide; TTC chr11 5325379 5325400 5325384 5325379 -
tgaatttctcgttaaataagac

SEQ ID NO: 126342 - DNA, 22 bp, Artificial Sequence
  Synthetic oligonucleotide; CTG chr11 5325377 5325398 5325382 5325377 -
aatttctcgttaaataagactg

SEQ ID NO: 126343 - DNA, 22 bp, Artificial Sequence
  Synthetic oligonucleotide; TTT chr11 5325372 5325393 5325377 5325372 -
ctcgttaaataagactgcagca

SEQ ID NO: 126344 - DNA, 22 bp, Artificial Sequence
  Synthetic oligonucleotide; TTC chr11 5325371 5325392 5325376 5325371 -
tcgttaaataagactgcagcag

SEQ ID NO: 126345 - DNA, 22 bp, Artificial Sequence
  Synthetic oligonucleotide; CTC chr11 5325369 5325390 5325374 5325369 -
gttaaataagactgcagcagag

SEQ ID NO: 126346 - DNA, 22 bp, Artificial Sequence
  Synthetic oligonucleotide; TTA chr11 5325365 5325386 5325370 5325365 -
aataagactgcagcagagctgg

SEQ ID NO: 126347 - DNA, 22 bp, Artificial Sequence
  Synthetic oligonucleotide; CTG chr11 5325355 5325376 5325360 5325355 -
cagcagagctggtaataagctt

SEQ ID NO: 126348 - DNA, 22 bp, Artificial Sequence
  Synthetic oligonucleotide; CTG chr11 5325344 5325365 5325349 5325344 -
gtaataagcttcttctttctcc

SEQ ID NO: 126349 - DNA, 22 bp, Artificial Sequence
  Synthetic oligonucleotide; CTT chr11 5325333 5325354 5325338 5325333 -
cttctttctcccatacccctct

SEQ ID NO: 126350 - DNA, 22 bp, Artificial Sequence
  Synthetic oligonucleotide; TTC chr11 5325332 5325353 5325337 5325332 -
ttctttctcccatacccctctt

SEQ ID NO: 126351 - DNA, 22 bp, Artificial Sequence
  Synthetic oligonucleotide; CTT chr11 5325330 5325351 5325335 5325330 -
ctttctcccatacccctcttgg

SEQ ID NO: 126352 - DNA, 22 bp, Artificial Sequence
  Synthetic oligonucleotide; TTC chr11 5325329 5325350 5325334 5325329 -
tttctcccatacccctcttgga

SEQ ID NO: 126353 - DNA, 22 bp, Artificial Sequence
  Synthetic oligonucleotide; CTT chr11 5325327 5325348 5325332 5325327 -
tctcccatacccctcttggatc

SEQ ID NO: 126354 - DNA, 22 bp, Artificial Sequence
  Synthetic oligonucleotide; TTT chr11 5325326 5325347 5325331 5325326 -
ctcccatacccctcttggatcg

SEQ ID NO: 126355 - DNA, 22 bp, Artificial Sequence
  Synthetic oligonucleotide; TTC chr11 5325325 5325346 5325330 5325325 -
tcccatacccctcttggatcgt

SEQ ID NO: 126356 - DNA, 22 bp, Artificial Sequence
  Synthetic oligonucleotide; CTC chr11 5325323 5325344 5325328 5325323 -
ccatacccctcttggatcgtgg

SEQ ID NO: 126357 - DNA, 22 bp, Artificial Sequence
  Synthetic oligonucleotide; CTC chr11 5325312 5325333 5325317 5325312 -
ttggatcgtggcaaccaagaaa

SEQ ID NO: 126358 - DNA, 22 bp, Artificial Sequence
  Synthetic oligonucleotide; CTT chr11 5325310 5325331 5325315 5325310 -
ggatcgtggcaaccaagaaaac

SEQ ID NO: 126359 - DNA, 22 bp, Artificial Sequence
  Synthetic oligonucleotide; TTG chr11 5325309 5325330 5325314 5325309 -
gatcgtggcaaccaagaaaaca

SEQ ID NO: 126360 - DNA, 22 bp, Artificial Sequence
  Synthetic oligonucleotide; CTG chr11 5325268 5325289 5325273 5325268 -
gcatccttaggctgtggaaaca

SEQ ID NO: 126361 - DNA, 22 bp, Artificial Sequence
  Synthetic oligonucleotide; CTT chr11 5325260 5325281 5325265 5325260 -
aggctgtggaaacattataatt

SEQ ID NO: 126362 - DNA, 22 bp, Artificial Sequence
  Synthetic oligonucleotide; TTA chr11 5325259 5325280 5325264 5325259 -
ggctgtggaaacattataattt

SEQ ID NO: 126363 - DNA, 22 bp, Artificial Sequence
  Synthetic oligonucleotide; CTG chr11 5325254 5325275 5325259 5325254 -
tggaaacattataattttacct

SEQ ID NO: 126364 - DNA, 22 bp, Artificial Sequence
  Synthetic oligonucleotide; TTA chr11 5325243 5325264 5325248 5325243 -
taattttacctgttacagaact

SEQ ID NO: 126365 - DNA, 22 bp, Artificial Sequence
  Synthetic oligonucleotide; TTT chr11 5325237 5325258 5325242 5325237 -
tacctgttacagaactgcaaca

SEQ ID NO: 126366 - DNA, 22 bp, Artificial Sequence
  Synthetic oligonucleotide; TTT chr11 5325236 5325257 5325241 5325236 -
acctgttacagaactgcaacag

SEQ ID NO: 126367 - DNA, 22 bp, Artificial Sequence
  Synthetic oligonucleotide; TTA chr11 5325235 5325256 5325240 5325235 -
cctgttacagaactgcaacagt

SEQ ID NO: 126368 - DNA, 22 bp, Artificial Sequence
  Synthetic oligonucleotide; CTG chr11 5325231 5325252 5325236 5325231 -
ttacagaactgcaacagttcct

SEQ ID NO: 126369 - DNA, 22 bp, Artificial Sequence
  Synthetic oligonucleotide; TTA chr11 5325228 5325249 5325233 5325228 -
cagaactgcaacagttcctcag

SEQ ID NO: 126370 - DNA, 22 bp, Artificial Sequence
  Synthetic oligonucleotide; CTG chr11 5325220 5325241 5325225 5325220 -
caacagttcctcaggagtttgg

SEQ ID NO: 126371 - DNA, 22 bp, Artificial Sequence
  Synthetic oligonucleotide; TTC chr11 5325211 5325232 5325216 5325211 -
ctcaggagtttggagttgatgg

SEQ ID NO: 126372 - DNA, 22 bp, Artificial Sequence
  Synthetic oligonucleotide; CTC chr11 5325208 5325229 5325213 5325208 -
aggagtttggagttgatggaaa

SEQ ID NO: 126373 - DNA, 22 bp, Artificial Sequence
  Synthetic oligonucleotide; TTT chr11 5325200 5325221 5325205 5325200 -
ggagttgatggaaaagcagaga

SEQ ID NO: 126374 - DNA, 22 bp, Artificial Sequence
  Synthetic oligonucleotide; TTG chr11 5325199 5325220 5325204 5325199 -
gagttgatggaaaagcagagag

SEQ ID NO: 126375 - DNA, 22 bp, Artificial Sequence
  Synthetic oligonucleotide; TTG chr11 5325193 5325214 5325198 5325193 -
atggaaaagcagagagaggtaa

SEQ ID NO: 126376 - DNA, 22 bp, Artificial Sequence
  Synthetic oligonucleotide; CTA chr11 5325151 5325172 5325156 5325151 -
agtatttaattatgggaaataa

SEQ ID NO: 126377 - DNA, 22 bp, Artificial Sequence
  Synthetic oligonucleotide; TTT chr11 5325144 5325165 5325149 5325144 -
aattatgggaaataatgttgga

SEQ ID NO: 126378 - DNA, 22 bp, Artificial Sequence
  Synthetic oligonucleotide; TTA chr11 5325143 5325164 5325148 5325143 -
attatgggaaataatgttggaa

SEQ ID NO: 126379 - DNA, 22 bp, Artificial Sequence
  Synthetic oligonucleotide; TTA chr11 5325139 5325160 5325144 5325139 -
tgggaaataatgttggaaaggg

SEQ ID NO: 126380 - DNA, 22 bp, Artificial Sequence
  Synthetic oligonucleotide; TTG chr11 5325124 5325145 5325129 5325124 -
gaaagggcaagtggcagaaaga

SEQ ID NO: 126381 - DNA, 22 bp, Artificial Sequence
  Synthetic oligonucleotide; TTG chr11 5325062 5325083 5325067 5325062 -
tatgaagatatttggagaaaat

SEQ ID NO: 126382 - DNA, 22 bp, Artificial Sequence
  Synthetic oligonucleotide; TTT chr11 5325049 5325070 5325054 5325049 -
ggagaaaatgagaaaatcaact

SEQ ID NO: 126383 - DNA, 22 bp, Artificial Sequence
  Synthetic oligonucleotide; TTG chr11 5325048 5325069 5325053 5325048 -
gagaaaatgagaaaatcaactg

SEQ ID NO: 126384 - DNA, 22 bp, Artificial Sequence
  Synthetic oligonucleotide; CTG chr11 5325026 5325047 5325031 5325026 -
gatggaagcattaaaaggtttc

SEQ ID NO: 126385 - DNA, 22 bp, Artificial Sequence
  Synthetic oligonucleotide; TTA chr11 5325013 5325034 5325018 5325013 -
aaaggtttctatctcgaaagat

SEQ ID NO: 126386 - DNA, 22 bp, Artificial Sequence
  Synthetic oligonucleotide; TTT chr11 5325005 5325026 5325010 5325005 -
ctatctcgaaagatggattagg

SEQ ID NO: 126387 - DNA, 22 bp, Artificial Sequence
  Synthetic oligonucleotide; TTC chr11 5325004 5325025 5325009 5325004 -
tatctcgaaagatggattaggt

SEQ ID NO: 126388 - DNA, 22 bp, Artificial Sequence
  Synthetic oligonucleotide; CTA chr11 5325002 5325023 5325007 5325002 -
tctcgaaagatggattaggtat

SEQ ID NO: 126389 - DNA, 22 bp, Artificial Sequence
  Synthetic oligonucleotide; CTC chr11 5324998 5325019 5325003 5324998 -
gaaagatggattaggtatgaaa

SEQ ID NO: 126390 - DNA, 22 bp, Artificial Sequence
  Synthetic oligonucleotide; TTA chr11 5324985 5325006 5324990 5324985 -
ggtatgaaatgcttatagcagt

SEQ ID NO: 126391 - DNA, 22 bp, Artificial Sequence
  Synthetic oligonucleotide; CTT chr11 5324971 5324992 5324976 5324971 -
atagcagtgatgcccagacatt

SEQ ID NO: 126392 - DNA, 22 bp, Artificial Sequence
  Synthetic oligonucleotide; TTA chr11 5324970 5324991 5324975 5324970 -
tagcagtgatgcccagacattg

SEQ ID NO: 126393 - DNA, 22 bp, Artificial Sequence
  Synthetic oligonucleotide; TTG chr11 5324948 5324969 5324953 5324948 -
ttttgcactggaatcacctgag

SEQ ID NO: 126394 - DNA, 22 bp, Artificial Sequence
  Synthetic oligonucleotide; TTT chr11 5324945 5324966 5324950 5324945 -
tgcactggaatcacctgaggac

SEQ ID NO: 126395 - DNA, 22 bp, Artificial Sequence
  Synthetic oligonucleotide; TTT chr11 5324944 5324965 5324949 5324944 -
gcactggaatcacctgaggacc

SEQ ID NO: 126396 - DNA, 22 bp, Artificial Sequence
  Synthetic oligonucleotide; TTG chr11 5324943 5324964 5324948 5324943 -
cactggaatcacctgaggacct

SEQ ID NO: 126397 - DNA, 22 bp, Artificial Sequence
  Synthetic oligonucleotide; CTG chr11 5324938 5324959 5324943 5324938 -
gaatcacctgaggacctgaaaa

SEQ ID NO: 126398 - DNA, 22 bp, Artificial Sequence
  Synthetic oligonucleotide; CTG chr11 5324928 5324949 5324933 5324928 -
aggacctgaaaaaagcgaattt

SEQ ID NO: 126399 - DNA, 22 bp, Artificial Sequence
  Synthetic oligonucleotide; CTG chr11 5324920 5324941 5324925 5324920 -
aaaaaagcgaatttgattcaga

SEQ ID NO: 126400 - DNA, 22 bp, Artificial Sequence
  Synthetic oligonucleotide; TTT chr11 5324906 5324927 5324911 5324906 -
gattcagaatgttggaaggggc

SEQ ID NO: 126401 - DNA, 22 bp, Artificial Sequence
  Synthetic oligonucleotide; TTG chr11 5324905 5324926 5324910 5324905 -
attcagaatgttggaaggggca

SEQ ID NO: 126402 - DNA, 22 bp, Artificial Sequence
  Synthetic oligonucleotide; TTC chr11 5324901 5324922 5324906 5324901 -
agaatgttggaaggggcagaat

SEQ ID NO: 126403 - DNA, 22 bp, Artificial Sequence
  Synthetic oligonucleotide; TTG chr11 5324892 5324913 5324897 5324892 -
gaaggggcagaatctgaggctg

SEQ ID NO: 126404 - DNA, 22 bp, Artificial Sequence
  Synthetic oligonucleotide; CTG chr11 5324876 5324897 5324881 5324876 -
aggctgcatgcctaacaagccc

SEQ ID NO: 126405 - DNA, 22 bp, Artificial Sequence
  Synthetic oligonucleotide; CTG chr11 5324870 5324891 5324875 5324870 -
catgcctaacaagcccgctgct

SEQ ID NO: 126406 - DNA, 22 bp, Artificial Sequence
  Synthetic oligonucleotide; CTA chr11 5324862 5324883 5324867 5324862 -
acaagcccgctgcttgttagct

SEQ ID NO: 126407 - DNA, 22 bp, Artificial Sequence
  Synthetic oligonucleotide; CTG chr11 5324850 5324871 5324855 5324850 -
cttgttagctgcgtctagtctg

SEQ ID NO: 126408 - DNA, 22 bp, Artificial Sequence
  Synthetic oligonucleotide; CTT chr11 5324847 5324868 5324852 5324847 -
gttagctgcgtctagtctgtga

SEQ ID NO: 126409 - DNA, 22 bp, Artificial Sequence
  Synthetic oligonucleotide; TTG chr11 5324846 5324867 5324851 5324846 -
ttagctgcgtctagtctgtgat

SEQ ID NO: 126410 - DNA, 22 bp, Artificial Sequence
  Synthetic oligonucleotide; TTA chr11 5324843 5324864 5324848 5324843 -
gctgcgtctagtctgtgatcca

SEQ ID NO: 126411 - DNA, 22 bp, Artificial Sequence
  Synthetic oligonucleotide; CTG chr11 5324839 5324860 5324844 5324839 -
cgtctagtctgtgatccacaac

SEQ ID NO: 126412 - DNA, 22 bp, Artificial Sequence
  Synthetic oligonucleotide; CTA chr11 5324833 5324854 5324838 5324833 -
gtctgtgatccacaactctggt

SEQ ID NO: 126413 - DNA, 22 bp, Artificial Sequence
  Synthetic oligonucleotide; CTG chr11 5324828 5324849 5324833 5324828 -
tgatccacaactctggtggcca

SEQ ID NO: 126414 - DNA, 22 bp, Artificial Sequence
  Synthetic oligonucleotide; CTC chr11 5324815 5324836 5324820 5324815 -
tggtggccaagctcaagtaact

SEQ ID NO: 126415 - DNA, 22 bp, Artificial Sequence
  Synthetic oligonucleotide; CTG chr11 5324813 5324834 5324818 5324813 -
gtggccaagctcaagtaactgt

SEQ ID NO: 126416 - DNA, 22 bp, Artificial Sequence
  Synthetic oligonucleotide; CTC chr11 5324801 5324822 5324806 5324801 -
aagtaactgttagagtgacaaa

SEQ ID NO: 126417 - DNA, 22 bp, Artificial Sequence
  Synthetic oligonucleotide; CTG chr11 5324792 5324813 5324797 5324792 -
ttagagtgacaaagccgttcat

SEQ ID NO: 126418 - DNA, 22 bp, Artificial Sequence
  Synthetic oligonucleotide; TTA chr11 5324789 5324810 5324794 5324789 -
gagtgacaaagccgttcattgg

SEQ ID NO: 126419 - DNA, 22 bp, Artificial Sequence
  Synthetic oligonucleotide; TTC chr11 5324772 5324793 5324777 5324772 -
attggtagtgatggtgatgcac

SEQ ID NO: 126420 - DNA, 22 bp, Artificial Sequence
  Synthetic oligonucleotide; TTG chr11 5324768 5324789 5324773 5324768 -
gtagtgatggtgatgcacgcta

SEQ ID NO: 126421 - DNA, 22 bp, Artificial Sequence
  Synthetic oligonucleotide; CTA chr11 5324746 5324767 5324751 5324746 -
tagtgcataaaacactgacatt

SEQ ID NO: 126422 - DNA, 22 bp, Artificial Sequence
  Synthetic oligonucleotide; CTG chr11 5324729 5324750 5324734 5324729 -
acattcaatttccaaaaaaaat

SEQ ID NO: 126423 - DNA, 22 bp, Artificial Sequence
  Synthetic oligonucleotide; TTC chr11 5324723 5324744 5324728 5324723 -
aatttccaaaaaaaatgagaaa

SEQ ID NO: 126424 - DNA, 22 bp, Artificial Sequence
  Synthetic oligonucleotide; TTT chr11 5324718 5324739 5324723 5324718 -
ccaaaaaaaatgagaaaaactg

SEQ ID NO: 126425 - DNA, 22 bp, Artificial Sequence
  Synthetic oligonucleotide; TTC chr11 5324717 5324738 5324722 5324717 -
caaaaaaaatgagaaaaactgc

SEQ ID NO: 126426 - DNA, 22 bp, Artificial Sequence
  Synthetic oligonucleotide; CTG chr11 5324696 5324717 5324701 5324696 -
cattaactgaaaaaactgtctt

SEQ ID NO: 126427 - DNA, 22 bp, Artificial Sequence
  Synthetic oligonucleotide; TTA chr11 5324691 5324712 5324696 5324691 -
actgaaaaaactgtcttcatca

SEQ ID NO: 126428 - DNA, 22 bp, Artificial Sequence
  Synthetic oligonucleotide; CTG chr11 5324687 5324708 5324692 5324687 -
aaaaaactgtcttcatcataat

SEQ ID NO: 126429 - DNA, 22 bp, Artificial Sequence
  Synthetic oligonucleotide; CTG chr11 5324678 5324699 5324683 5324678 -
tcttcatcataatcgtgaaatg

SEQ ID NO: 126430 - DNA, 22 bp, Artificial Sequence
  Synthetic oligonucleotide; CTT chr11 5324674 5324695 5324679 5324674 -
catcataatcgtgaaatgtaaa

SEQ ID NO: 126431 - DNA, 22 bp, Artificial Sequence
  Synthetic oligonucleotide; TTC chr11 5324673 5324694 5324678 5324673 -
atcataatcgtgaaatgtaaaa

SEQ ID NO: 126432 - DNA, 22 bp, Artificial Sequence
  Synthetic oligonucleotide; TTA chr11 5324648 5324669 5324653 5324648 -
caacaatcatttccaaatggtc

SEQ ID NO: 126433 - DNA, 22 bp, Artificial Sequence
  Synthetic oligonucleotide; TTT chr11 5324636 5324657 5324641 5324636 -
ccaaatggtcagtaatcacagc

SEQ ID NO: 126434 - DNA, 22 bp, Artificial Sequence
  Synthetic oligonucleotide; TTC chr11 5324635 5324656 5324640 5324635 -
caaatggtcagtaatcacagca

SEQ ID NO: 126435 - DNA, 22 bp, Artificial Sequence
  Synthetic oligonucleotide; CTA chr11 5324601 5324622 5324606 5324601 -
agccagattattatccatttat

SEQ ID NO: 126436 - DNA, 22 bp, Artificial Sequence
  Synthetic oligonucleotide; TTA chr11 5324591 5324612 5324596 5324591 -
ttatccatttatgtatatttat

SEQ ID NO: 126437 - DNA, 22 bp, Artificial Sequence
  Synthetic oligonucleotide; TTA chr11 5324588 5324609 5324593 5324588 -
tccatttatgtatatttatgtt

SEQ ID NO: 126438 - DNA, 22 bp, Artificial Sequence
  Synthetic oligonucleotide; TTT chr11 5324581 5324602 5324586 5324581 -
atgtatatttatgttatgtgtt

SEQ ID NO: 126439 - DNA, 22 bp, Artificial Sequence
  Synthetic oligonucleotide; TTA chr11 5324580 5324601 5324585 5324580 -
tgtatatttatgttatgtgttt

SEQ ID NO: 126440 - DNA, 22 bp, Artificial Sequence
  Synthetic oligonucleotide; TTT chr11 5324571 5324592 5324576 5324571 -
atgttatgtgtttttgttatca

SEQ ID NO: 126441 - DNA, 22 bp, Artificial Sequence
  Synthetic oligonucleotide; TTA chr11 5324570 5324591 5324575 5324570 -
tgttatgtgtttttgttatcac

SEQ ID NO: 126442 - DNA, 22 bp, Artificial Sequence
  Synthetic oligonucleotide; TTA chr11 5324565 5324586 5324570 5324565 -
tgtgtttttgttatcactgttg

SEQ ID NO: 126443 - DNA, 22 bp, Artificial Sequence
  Synthetic oligonucleotide; TTT chr11 5324558 5324579 5324563 5324558 -
ttgttatcactgttgttgcaaa

SEQ ID NO: 126444 - DNA, 22 bp, Artificial Sequence
  Synthetic oligonucleotide; TTT chr11 5324557 5324578 5324562 5324557 -
tgttatcactgttgttgcaaat

SEQ ID NO: 126445 - DNA, 22 bp, Artificial Sequence
  Synthetic oligonucleotide; TTT chr11 5324556 5324577 5324561 5324556 -
gttatcactgttgttgcaaata

SEQ ID NO: 126446 - DNA, 22 bp, Artificial Sequence
  Synthetic oligonucleotide; TTG chr11 5324555 5324576 5324560 5324555 -
ttatcactgttgttgcaaatat

SEQ ID NO: 126447 - DNA, 22 bp, Artificial Sequence
  Synthetic oligonucleotide; TTA chr11 5324552 5324573 5324557 5324552 -
tcactgttgttgcaaatattta

SEQ ID NO: 126448 - DNA, 22 bp, Artificial Sequence
  Synthetic oligonucleotide; CTG chr11 5324546 5324567 5324551 5324546 -
ttgttgcaaatatttataagta

SEQ ID NO: 126449 - DNA, 22 bp, Artificial Sequence
  Synthetic oligonucleotide; TTG chr11 5324543 5324564 5324548 5324543 -
ttgcaaatatttataagtaccc

SEQ ID NO: 126450 - DNA, 22 bp, Artificial Sequence
  Synthetic oligonucleotide; TTG chr11 5324540 5324561 5324545 5324540 -
caaatatttataagtaccctca

SEQ ID NO: 126451 - DNA, 22 bp, Artificial Sequence
  Synthetic oligonucleotide; TTT chr11 5324531 5324552 5324536 5324531 -
ataagtaccctcaaaatagttg

SEQ ID NO: 126452 - DNA, 22 bp, Artificial Sequence
  Synthetic oligonucleotide; TTA chr11 5324530 5324551 5324535 5324530 -
taagtaccctcaaaatagttgc

SEQ ID NO: 126453 - DNA, 22 bp, Artificial Sequence
  Synthetic oligonucleotide; CTC chr11 5324519 5324540 5324524 5324519 -
aaaatagttgcggataatatat

SEQ ID NO: 126454 - DNA, 22 bp, Artificial Sequence
  Synthetic oligonucleotide; TTG chr11 5324509 5324530 5324514 5324509 -
cggataatatatttaaaattaa

SEQ ID NO: 126455 - DNA, 22 bp, Artificial Sequence
  Synthetic oligonucleotide; TTT chr11 5324495 5324516 5324500 5324495 -
aaaattaatgaaaaatttttga

SEQ ID NO: 126456 - DNA, 22 bp, Artificial Sequence
  Synthetic oligonucleotide; TTA chr11 5324494 5324515 5324499 5324494 -
aaattaatgaaaaatttttgaa

SEQ ID NO: 126457 - DNA, 22 bp, Artificial Sequence
  Synthetic oligonucleotide; TTA chr11 5324488 5324509 5324493 5324488 -
atgaaaaatttttgaatttgag

SEQ ID NO: 126458 - DNA, 22 bp, Artificial Sequence
  Synthetic oligonucleotide; TTT chr11 5324477 5324498 5324482 5324477 -
ttgaatttgagaaaaatcgaac

SEQ ID NO: 126459 - DNA, 22 bp, Artificial Sequence
  Synthetic oligonucleotide; TTT chr11 5324476 5324497 5324481 5324476 -
tgaatttgagaaaaatcgaacc

SEQ ID NO: 126460 - DNA, 22 bp, Artificial Sequence
  Synthetic oligonucleotide; TTT chr11 5324475 5324496 5324480 5324475 -
gaatttgagaaaaatcgaacca

SEQ ID NO: 126461 - DNA, 22 bp, Artificial Sequence
  Synthetic oligonucleotide; TTG chr11 5324474 5324495 5324479 5324474 -
aatttgagaaaaatcgaaccat

SEQ ID NO: 126462 - DNA, 22 bp, Artificial Sequence
  Synthetic oligonucleotide; TTT chr11 5324469 5324490 5324474 5324469 -
gagaaaaatcgaaccattaact

SEQ ID NO: 126463 - DNA, 22 bp, Artificial Sequence
  Synthetic oligonucleotide; TTG chr11 5324468 5324489 5324473 5324468 -
agaaaaatcgaaccattaactc

SEQ ID NO: 126464 - DNA, 22 bp, Artificial Sequence
  Synthetic oligonucleotide; TTA chr11 5324450 5324471 5324455 5324450 -
actcagtattttttctaattag

SEQ ID NO: 126465 - DNA, 22 bp, Artificial Sequence
  Synthetic oligonucleotide; CTC chr11 5324446 5324467 5324451 5324446 -
agtattttttctaattagggaa

SEQ ID NO: 126466 - DNA, 22 bp, Artificial Sequence
  Synthetic oligonucleotide; TTT chr11 5324439 5324460 5324444 5324439 -
tttctaattagggaaaaaacca

SEQ ID NO: 126467 - DNA, 22 bp, Artificial Sequence
  Synthetic oligonucleotide; TTT chr11 5324438 5324459 5324443 5324438 -
ttctaattagggaaaaaaccat

SEQ ID NO: 126468 - DNA, 22 bp, Artificial Sequence
  Synthetic oligonucleotide; TTT chr11 5324437 5324458 5324442 5324437 -
tctaattagggaaaaaaccata

SEQ ID NO: 126469 - DNA, 22 bp, Artificial Sequence
  Synthetic oligonucleotide; TTT chr11 5324436 5324457 5324441 5324436 -
ctaattagggaaaaaaccatag

SEQ ID NO: 126470 - DNA, 22 bp, Artificial Sequence
  Synthetic oligonucleotide; TTC chr11 5324435 5324456 5324440 5324435 -
taattagggaaaaaaccatagt

SEQ ID NO: 126471 - DNA, 22 bp, Artificial Sequence
  Synthetic oligonucleotide; CTA chr11 5324433 5324454 5324438 5324433 -
attagggaaaaaaccatagtct

SEQ ID NO: 126472 - DNA, 22 bp, Artificial Sequence
  Synthetic oligonucleotide; TTA chr11 5324429 5324450 5324434 5324429 -
gggaaaaaaccatagtctgtac

SEQ ID NO: 126473 - DNA, 22 bp, Artificial Sequence
  Synthetic oligonucleotide; CTG chr11 5324410 5324431 5324415 5324410 -
tacatgctattcttcttcagga

SEQ ID NO: 126474 - DNA, 22 bp, Artificial Sequence
  Synthetic oligonucleotide; CTA chr11 5324401 5324422 5324406 5324401 -
ttcttcttcaggaaaatagttg

SEQ ID NO: 126475 - DNA, 22 bp, Artificial Sequence
  Synthetic oligonucleotide; TTC chr11 5324398 5324419 5324403 5324398 -
ttcttcaggaaaatagttgcag

SEQ ID NO: 126476 - DNA, 22 bp, Artificial Sequence
  Synthetic oligonucleotide; CTT chr11 5324396 5324417 5324401 5324396 -
cttcaggaaaatagttgcagag

SEQ ID NO: 126477 - DNA, 22 bp, Artificial Sequence
  Synthetic oligonucleotide; TTC chr11 5324395 5324416 5324400 5324395 -
ttcaggaaaatagttgcagagt

SEQ ID NO: 126478 - DNA, 22 bp, Artificial Sequence
  Synthetic oligonucleotide; CTT chr11 5324393 5324414 5324398 5324393 -
caggaaaatagttgcagagtca

SEQ ID NO: 126479 - DNA, 22 bp, Artificial Sequence
  Synthetic oligonucleotide; TTC chr11 5324392 5324413 5324397 5324392 -
aggaaaatagttgcagagtcaa

SEQ ID NO: 126480 - DNA, 22 bp, Artificial Sequence
  Synthetic oligonucleotide; TTG chr11 5324379 5324400 5324384 5324379 -
cagagtcaaatttatcacacca

SEQ ID NO: 126481 - DNA, 22 bp, Artificial Sequence
  Synthetic oligonucleotide; TTT chr11 5324366 5324387 5324371 5324366 -
atcacaccagttaatcatctcc

SEQ ID NO: 126482 - DNA, 22 bp, Artificial Sequence
  Synthetic oligonucleotide; TTA chr11 5324365 5324386 5324370 5324365 -
tcacaccagttaatcatctcca

SEQ ID NO: 126483 - DNA, 22 bp, Artificial Sequence
  Synthetic oligonucleotide; TTA chr11 5324353 5324374 5324358 5324353 -
atcatctccaagcaggaagatt

SEQ ID NO: 126484 - DNA, 22 bp, Artificial Sequence
  Synthetic oligonucleotide; CTC chr11 5324345 5324366 5324350 5324345 -
caagcaggaagattggaggctc

SEQ ID NO: 126485 - DNA, 22 bp, Artificial Sequence
  Synthetic oligonucleotide; TTG chr11 5324330 5324351 5324335 5324330 -
gaggctcctggtttcaaggttt

SEQ ID NO: 126486 - DNA, 22 bp, Artificial Sequence
  Synthetic oligonucleotide; CTC chr11 5324323 5324344 5324328 5324323 -
ctggtttcaaggtttcaagaaa

SEQ ID NO: 126487 - DNA, 22 bp, Artificial Sequence
  Synthetic oligonucleotide; CTG chr11 5324320 5324341 5324325 5324320 -
gtttcaaggtttcaagaaatct

SEQ ID NO: 126488 - DNA, 22 bp, Artificial Sequence
  Synthetic oligonucleotide; TTT chr11 5324316 5324337 5324321 5324316 -
caaggtttcaagaaatctgatc

SEQ ID NO: 126489 - DNA, 22 bp, Artificial Sequence
  Synthetic oligonucleotide; TTC chr11 5324315 5324336 5324320 5324315 -
aaggtttcaagaaatctgatct

SEQ ID NO: 126490 - DNA, 22 bp, Artificial Sequence
  Synthetic oligonucleotide; TTT chr11 5324308 5324329 5324313 5324308 -
caagaaatctgatctttaccgg

SEQ ID NO: 126491 - DNA, 22 bp, Artificial Sequence
  Synthetic oligonucleotide; TTC chr11 5324307 5324328 5324312 5324307 -
aagaaatctgatctttaccggt

SEQ ID NO: 126492 - DNA, 22 bp, Artificial Sequence
  Synthetic oligonucleotide; CTG chr11 5324297 5324318 5324302 5324297 -
atctttaccggtggatacacta

SEQ ID NO: 126493 - DNA, 22 bp, Artificial Sequence
  Synthetic oligonucleotide; CTT chr11 5324292 5324313 5324297 5324292 -
taccggtggatacactatgtgg

SEQ ID NO: 126494 - DNA, 22 bp, Artificial Sequence
  Synthetic oligonucleotide; TTT chr11 5324291 5324312 5324296 5324291 -
accggtggatacactatgtggc

SEQ ID NO: 126495 - DNA, 22 bp, Artificial Sequence
  Synthetic oligonucleotide; TTA chr11 5324290 5324311 5324295 5324290 -
ccggtggatacactatgtggcc

SEQ ID NO: 126496 - DNA, 22 bp, Artificial Sequence
  Synthetic oligonucleotide; CTA chr11 5324275 5324296 5324280 5324275 -
tgtggcccaatattactgcagc

SEQ ID NO: 126497 - DNA, 22 bp, Artificial Sequence
  Synthetic oligonucleotide; TTA chr11 5324260 5324281 5324265 5324260 -
ctgcagccccttttttgctgac

SEQ ID NO: 126498 - DNA, 22 bp, Artificial Sequence
  Synthetic oligonucleotide; CTG chr11 5324257 5324278 5324262 5324257 -
cagccccttttttgctgactgg

SEQ ID NO: 126499 - DNA, 22 bp, Artificial Sequence
  Synthetic oligonucleotide; CTT chr11 5324248 5324269 5324253 5324248 -
ttttgctgactggctttccagg

SEQ ID NO: 126500 - DNA, 22 bp, Artificial Sequence
  Synthetic oligonucleotide; TTT chr11 5324247 5324268 5324252 5324247 -
tttgctgactggctttccaggg

SEQ ID NO: 126501 - DNA, 22 bp, Artificial Sequence
  Synthetic oligonucleotide; TTT chr11 5324246 5324267 5324251 5324246 -
ttgctgactggctttccagggc

SEQ ID NO: 126502 - DNA, 22 bp, Artificial Sequence
  Synthetic oligonucleotide; TTT chr11 5324245 5324266 5324250 5324245 -
tgctgactggctttccagggct

SEQ ID NO: 126503 - DNA, 22 bp, Artificial Sequence
  Synthetic oligonucleotide; TTT chr11 5324244 5324265 5324249 5324244 -
gctgactggctttccagggctg

SEQ ID NO: 126504 - DNA, 22 bp, Artificial Sequence
  Synthetic oligonucleotide; TTG chr11 5324243 5324264 5324248 5324243 -
ctgactggctttccagggctgg

SEQ ID NO: 126505 - DNA, 22 bp, Artificial Sequence
  Synthetic oligonucleotide; CTG chr11 5324240 5324261 5324245 5324240 -
actggctttccagggctggagg

SEQ ID NO: 126506 - DNA, 22 bp, Artificial Sequence
  Synthetic oligonucleotide; CTG chr11 5324236 5324257 5324241 5324236 -
gctttccagggctggaggcagc

SEQ ID NO: 126507 - DNA, 22 bp, Artificial Sequence
  Synthetic oligonucleotide; CTT chr11 5324232 5324253 5324237 5324232 -
tccagggctggaggcagctcat

SEQ ID NO: 126508 - DNA, 22 bp, Artificial Sequence
  Synthetic oligonucleotide; TTT chr11 5324231 5324252 5324236 5324231 -
ccagggctggaggcagctcatc

SEQ ID NO: 126509 - DNA, 22 bp, Artificial Sequence
  Synthetic oligonucleotide; TTC chr11 5324230 5324251 5324235 5324230 -
cagggctggaggcagctcatca

SEQ ID NO: 126510 - DNA, 22 bp, Artificial Sequence
  Synthetic oligonucleotide; CTG chr11 5324222 5324243 5324227 5324222 -
gaggcagctcatcactggatct

SEQ ID NO: 126511 - DNA, 22 bp, Artificial Sequence
  Synthetic oligonucleotide; CTC chr11 5324212 5324233 5324217 5324212 -
atcactggatctccatcccctt

SEQ ID NO: 126512 - DNA, 22 bp, Artificial Sequence
  Synthetic oligonucleotide; CTG chr11 5324205 5324226 5324210 5324205 -
gatctccatccccttctttgct

SEQ ID NO: 126513 - DNA, 22 bp, Artificial Sequence
  Synthetic oligonucleotide; CTC chr11 5324199 5324220 5324204 5324199 -
catccccttctttgctgtttat

SEQ ID NO: 126514 - DNA, 22 bp, Artificial Sequence
  Synthetic oligonucleotide; CTT chr11 5324190 5324211 5324195 5324190 -
ctttgctgtttatgtgtgcatc

SEQ ID NO: 126515 - DNA, 22 bp, Artificial Sequence
  Synthetic oligonucleotide; TTC chr11 5324189 5324210 5324194 5324189 -
tttgctgtttatgtgtgcatcc

SEQ ID NO: 126516 - DNA, 22 bp, Artificial Sequence
  Synthetic oligonucleotide; CTT chr11 5324187 5324208 5324192 5324187 -
tgctgtttatgtgtgcatcctt

SEQ ID NO: 126517 - DNA, 22 bp, Artificial Sequence
  Synthetic oligonucleotide; TTT chr11 5324186 5324207 5324191 5324186 -
gctgtttatgtgtgcatccttc

SEQ ID NO: 126518 - DNA, 22 bp, Artificial Sequence
  Synthetic oligonucleotide; TTG chr11 5324185 5324206 5324190 5324185 -
ctgtttatgtgtgcatccttct

SEQ ID NO: 126519 - DNA, 22 bp, Artificial Sequence
  Synthetic oligonucleotide; CTG chr11 5324182 5324203 5324187 5324182 -
tttatgtgtgcatccttctggg

SEQ ID NO: 126520 - DNA, 22 bp, Artificial Sequence
  Synthetic oligonucleotide; TTT chr11 5324179 5324200 5324184 5324179 -
atgtgtgcatccttctgggcaa

SEQ ID NO: 126521 - DNA, 22 bp, Artificial Sequence
  Synthetic oligonucleotide; TTA chr11 5324178 5324199 5324183 5324178 -
tgtgtgcatccttctgggcaat

SEQ ID NO: 126522 - DNA, 22 bp, Artificial Sequence
  Synthetic oligonucleotide; CTT chr11 5324165 5324186 5324170 5324165 -
ctgggcaatggcatgctcctct

SEQ ID NO: 126523 - DNA, 22 bp, Artificial Sequence
  Synthetic oligonucleotide; TTC chr11 5324164 5324185 5324169 5324164 -
tgggcaatggcatgctcctcta

SEQ ID NO: 126524 - DNA, 22 bp, Artificial Sequence
  Synthetic oligonucleotide; CTG chr11 5324162 5324183 5324167 5324162 -
ggcaatggcatgctcctctacc

SEQ ID NO: 126525 - DNA, 22 bp, Artificial Sequence
  Synthetic oligonucleotide; CTC chr11 5324147 5324168 5324152 5324147 -
ctctacctcatcaagcatgacc

SEQ ID NO: 126526 - DNA, 22 bp, Artificial Sequence
  Synthetic oligonucleotide; CTC chr11 5324144 5324165 5324149 5324144 -
tacctcatcaagcatgaccaca

SEQ ID NO: 126527 - DNA, 22 bp, Artificial Sequence
  Synthetic oligonucleotide; CTA chr11 5324142 5324163 5324147 5324142 -
cctcatcaagcatgaccacagt

SEQ ID NO: 126528 - DNA, 22 bp, Artificial Sequence
  Synthetic oligonucleotide; CTC chr11 5324138 5324159 5324143 5324138 -
atcaagcatgaccacagtcttc

SEQ ID NO: 126529 - DNA, 22 bp, Artificial Sequence
  Synthetic oligonucleotide; CTT chr11 5324117 5324138 5324122 5324117 -
catgagcccatgtactacttcc

SEQ ID NO: 126530 - DNA, 22 bp, Artificial Sequence
  Synthetic oligonucleotide; TTC chr11 5324116 5324137 5324121 5324116 -
atgagcccatgtactacttcct

SEQ ID NO: 126531 - DNA, 22 bp, Artificial Sequence
  Synthetic oligonucleotide; CTA chr11 5324100 5324121 5324105 5324100 -
cttcctcaccatgctggcaggc

SEQ ID NO: 126532 - DNA, 22 bp, Artificial Sequence
  Synthetic oligonucleotide; CTT chr11 5324097 5324118 5324102 5324097 -
cctcaccatgctggcaggcaca

SEQ ID NO: 126533 - DNA, 22 bp, Artificial Sequence
  Synthetic oligonucleotide; TTC chr11 5324096 5324117 5324101 5324096 -
ctcaccatgctggcaggcacag

SEQ ID NO: 126534 - DNA, 22 bp, Artificial Sequence
  Synthetic oligonucleotide; CTC chr11 5324093 5324114 5324098 5324093 -
accatgctggcaggcacagacc

SEQ ID NO: 126535 - DNA, 22 bp, Artificial Sequence
  Synthetic oligonucleotide; CTG chr11 5324084 5324105 5324089 5324084 -
gcaggcacagacctcatggtga

SEQ ID NO: 126536 - DNA, 22 bp, Artificial Sequence
  Synthetic oligonucleotide; CTC chr11 5324069 5324090 5324074 5324069 -
atggtgacattgaccacgatgc

SEQ ID NO: 126537 - DNA, 22 bp, Artificial Sequence
  Synthetic oligonucleotide; TTG chr11 5324057 5324078 5324062 5324057 -
accacgatgcctactgtaatgg

SEQ ID NO: 126538 - DNA, 22 bp, Artificial Sequence
  Synthetic oligonucleotide; CTA chr11 5324044 5324065 5324049 5324044 -
ctgtaatgggcatcctatgggt

SEQ ID NO: 126539 - DNA, 22 bp, Artificial Sequence
  Synthetic oligonucleotide; CTG chr11 5324041 5324062 5324046 5324041 -
taatgggcatcctatgggtgaa

SEQ ID NO: 126540 - DNA, 22 bp, Artificial Sequence
  Synthetic oligonucleotide; CTA chr11 5324027 5324048 5324032 5324027 -
tgggtgaatcacagggagatta

SEQ ID NO: 126541 - DNA, 22 bp, Artificial Sequence
  Synthetic oligonucleotide; TTA chr11 5324005 5324026 5324010 5324005 -
gcagtgtgggctgcttcctaca

SEQ ID NO: 126542 - DNA, 22 bp, Artificial Sequence
  Synthetic oligonucleotide; CTG chr11 5323992 5324013 5323997 5323992 -
cttcctacaggcttactttatt

SEQ ID NO: 126543 - DNA, 22 bp, Artificial Sequence
  Synthetic oligonucleotide; CTT chr11 5323989 5324010 5323994 5323989 -
cctacaggcttactttattcac

SEQ ID NO: 126544 - DNA, 22 bp, Artificial Sequence
  Synthetic oligonucleotide; TTC chr11 5323988 5324009 5323993 5323988 -
ctacaggcttactttattcact

SEQ ID NO: 126545 - DNA, 22 bp, Artificial Sequence
  Synthetic oligonucleotide; CTA chr11 5323985 5324006 5323990 5323985 -
caggcttactttattcactccc

SEQ ID NO: 126546 - DNA, 22 bp, Artificial Sequence
  Synthetic oligonucleotide; CTT chr11 5323978 5323999 5323983 5323978 -
actttattcactccctttctgt

SEQ ID NO: 126547 - DNA, 22 bp, Artificial Sequence
  Synthetic oligonucleotide; TTA chr11 5323977 5323998 5323982 5323977 -
ctttattcactccctttctgtt

SEQ ID NO: 126548 - DNA, 22 bp, Artificial Sequence
  Synthetic oligonucleotide; CTT chr11 5323974 5323995 5323979 5323974 -
tattcactccctttctgttgtg

SEQ ID NO: 126549 - DNA, 22 bp, Artificial Sequence
  Synthetic oligonucleotide; TTT chr11 5323973 5323994 5323978 5323973 -
attcactccctttctgttgtgg

SEQ ID NO: 126550 - DNA, 22 bp, Artificial Sequence
  Synthetic oligonucleotide; TTA chr11 5323972 5323993 5323977 5323972 -
ttcactccctttctgttgtgga

SEQ ID NO: 126551 - DNA, 22 bp, Artificial Sequence
  Synthetic oligonucleotide; TTC chr11 5323969 5323990 5323974 5323969 -
actccctttctgttgtggaatc

SEQ ID NO: 126552 - DNA, 22 bp, Artificial Sequence
  Synthetic oligonucleotide; CTC chr11 5323965 5323986 5323970 5323965 -
cctttctgttgtggaatcaggt

SEQ ID NO: 126553 - DNA, 22 bp, Artificial Sequence
  Synthetic oligonucleotide; CTT chr11 5323961 5323982 5323966 5323961 -
tctgttgtggaatcaggttccc

SEQ ID NO: 126554 - DNA, 22 bp, Artificial Sequence
  Synthetic oligonucleotide; TTT chr11 5323960 5323981 5323965 5323960 -
ctgttgtggaatcaggttccct

SEQ ID NO: 126555 - DNA, 22 bp, Artificial Sequence
  Synthetic oligonucleotide; TTC chr11 5323959 5323980 5323964 5323959 -
tgttgtggaatcaggttccctc

SEQ ID NO: 126556 - DNA, 22 bp, Artificial Sequence
  Synthetic oligonucleotide; CTG chr11 5323957 5323978 5323962 5323957 -
ttgtggaatcaggttccctcct

SEQ ID NO: 126557 - DNA, 22 bp, Artificial Sequence
  Synthetic oligonucleotide; TTG chr11 5323954 5323975 5323959 5323954 -
tggaatcaggttccctcctggc

SEQ ID NO: 126558 - DNA, 22 bp, Artificial Sequence
  Synthetic oligonucleotide; TTC chr11 5323941 5323962 5323946 5323941 -
cctcctggcaatggcatatgat

SEQ ID NO: 126559 - DNA, 22 bp, Artificial Sequence
  Synthetic oligonucleotide; CTC chr11 5323937 5323958 5323942 5323937 -
ctggcaatggcatatgattgtt

SEQ ID NO: 126560 - DNA, 22 bp, Artificial Sequence
  Synthetic oligonucleotide; CTG chr11 5323934 5323955 5323939 5323934 -
gcaatggcatatgattgtttca

SEQ ID NO: 126561 - DNA, 22 bp, Artificial Sequence
  Synthetic oligonucleotide; TTG chr11 5323917 5323938 5323922 5323917 -
tttcattgccatccgcaatcct

SEQ ID NO: 126562 - DNA, 22 bp, Artificial Sequence
  Synthetic oligonucleotide; TTT chr11 5323914 5323935 5323919 5323914 -
cattgccatccgcaatcctttg

SEQ ID NO: 126563 - DNA, 22 bp, Artificial Sequence
  Synthetic oligonucleotide; TTC chr11 5323913 5323934 5323918 5323913 -
attgccatccgcaatcctttga

SEQ ID NO: 126564 - DNA, 22 bp, Artificial Sequence
  Synthetic oligonucleotide; TTG chr11 5323909 5323930 5323914 5323909 -
ccatccgcaatcctttgagata

SEQ ID NO: 126565 - DNA, 22 bp, Artificial Sequence
  Synthetic oligonucleotide; CTT chr11 5323894 5323915 5323899 5323894 -
tgagatatgcttccattctcac

SEQ ID NO: 126566 - DNA, 22 bp, Artificial Sequence
  Synthetic oligonucleotide; TTT chr11 5323893 5323914 5323898 5323893 -
gagatatgcttccattctcacc

SEQ ID NO: 126567 - DNA, 22 bp, Artificial Sequence
  Synthetic oligonucleotide; TTG chr11 5323892 5323913 5323897 5323892 -
agatatgcttccattctcacca

SEQ ID NO: 126568 - DNA, 22 bp, Artificial Sequence
  Synthetic oligonucleotide; CTT chr11 5323882 5323903 5323887 5323882 -
ccattctcaccaatactagagt

SEQ ID NO: 126569 - DNA, 22 bp, Artificial Sequence
  Synthetic oligonucleotide; TTC chr11 5323881 5323902 5323886 5323881 -
cattctcaccaatactagagtc

SEQ ID NO: 126570 - DNA, 22 bp, Artificial Sequence
  Synthetic oligonucleotide; TTC chr11 5323876 5323897 5323881 5323876 -
tcaccaatactagagtcatagc

SEQ ID NO: 126571 - DNA, 22 bp, Artificial Sequence
  Synthetic oligonucleotide; CTC chr11 5323874 5323895 5323879 5323874 -
accaatactagagtcatagcgt

SEQ ID NO: 126572 - DNA, 22 bp, Artificial Sequence
  Synthetic oligonucleotide; CTA chr11 5323864 5323885 5323869 5323864 -
gagtcatagcgttaggagtggg

SEQ ID NO: 126573 - DNA, 22 bp, Artificial Sequence
  Synthetic oligonucleotide; TTA chr11 5323850 5323871 5323855 5323850 -
ggagtgggagtgtttctaaggg

SEQ ID NO: 126574 - DNA, 22 bp, Artificial Sequence
  Synthetic oligonucleotide; TTT chr11 5323835 5323856 5323840 5323835 -
ctaaggggttttgtatccatcc

SEQ ID NO: 126575 - DNA, 22 bp, Artificial Sequence
  Synthetic oligonucleotide; TTC chr11 5323834 5323855 5323839 5323834 -
taaggggttttgtatccatcct

SEQ ID NO: 126576 - DNA, 22 bp, Artificial Sequence
  Synthetic oligonucleotide; CTA chr11 5323832 5323853 5323837 5323832 -
aggggttttgtatccatcctgc

SEQ ID NO: 126577 - DNA, 22 bp, Artificial Sequence
  Synthetic oligonucleotide; TTT chr11 5323824 5323845 5323829 5323824 -
tgtatccatcctgcctgtaatt

SEQ ID NO: 126578 - DNA, 22 bp, Artificial Sequence
  Synthetic oligonucleotide; TTT chr11 5323823 5323844 5323828 5323823 -
gtatccatcctgcctgtaattt

SEQ ID NO: 126579 - DNA, 22 bp, Artificial Sequence
  Synthetic oligonucleotide; TTG chr11 5323822 5323843 5323827 5323822 -
tatccatcctgcctgtaatttt

SEQ ID NO: 126580 - DNA, 22 bp, Artificial Sequence
  Synthetic oligonucleotide; CTG chr11 5323811 5323832 5323816 5323811 -
cctgtaattttgcgtctttttt

SEQ ID NO: 126581 - DNA, 22 bp, Artificial Sequence
  Synthetic oligonucleotide; CTG chr11 5323807 5323828 5323812 5323807 -
taattttgcgtcttttttcatt

SEQ ID NO: 126582 - DNA, 22 bp, Artificial Sequence
  Synthetic oligonucleotide; TTT chr11 5323801 5323822 5323806 5323801 -
tgcgtcttttttcattttcata

SEQ ID NO: 126583 - DNA, 22 bp, Artificial Sequence
  Synthetic oligonucleotide; TTT chr11 5323800 5323821 5323805 5323800 -
gcgtcttttttcattttcatat

SEQ ID NO: 126584 - DNA, 22 bp, Artificial Sequence
  Synthetic oligonucleotide; TTG chr11 5323799 5323820 5323804 5323799 -
cgtcttttttcattttcatatt

SEQ ID NO: 126585 - DNA, 22 bp, Artificial Sequence
  Synthetic oligonucleotide; CTT chr11 5323793 5323814 5323798 5323793 -
ttttcattttcatattgcaaat

SEQ ID NO: 126586 - DNA, 22 bp, Artificial Sequence
  Synthetic oligonucleotide; TTT chr11 5323792 5323813 5323797 5323792 -
tttcattttcatattgcaaatc

SEQ ID NO: 126587 - DNA, 22 bp, Artificial Sequence
  Synthetic oligonucleotide; TTT chr11 5323791 5323812 5323796 5323791 -
ttcattttcatattgcaaatct

SEQ ID NO: 126588 - DNA, 22 bp, Artificial Sequence
  Synthetic oligonucleotide; TTT chr11 5323790 5323811 5323795 5323790 -
tcattttcatattgcaaatctc

SEQ ID NO: 126589 - DNA, 22 bp, Artificial Sequence
  Synthetic oligonucleotide; TTT chr11 5323789 5323810 5323794 5323789 -
cattttcatattgcaaatctca

SEQ ID NO: 126590 - DNA, 22 bp, Artificial Sequence
  Synthetic oligonucleotide; TTC chr11 5323788 5323809 5323793 5323788 -
attttcatattgcaaatctcat

SEQ ID NO: 126591 - DNA, 22 bp, Artificial Sequence
  Synthetic oligonucleotide; TTT chr11 5323784 5323805 5323789 5323784 -
tcatattgcaaatctcatgtta

SEQ ID NO: 126592 - DNA, 22 bp, Artificial Sequence
  Synthetic oligonucleotide; TTT chr11 5323783 5323804 5323788 5323783 -
catattgcaaatctcatgttat

SEQ ID NO: 126593 - DNA, 22 bp, Artificial Sequence
  Synthetic oligonucleotide; TTC chr11 5323782 5323803 5323787 5323782 -
atattgcaaatctcatgttatc

SEQ ID NO: 126594 - DNA, 22 bp, Artificial Sequence
  Synthetic oligonucleotide; TTG chr11 5323776 5323797 5323781 5323776 -
caaatctcatgttatcacacgt

SEQ ID NO: 126595 - DNA, 22 bp, Artificial Sequence
  Synthetic oligonucleotide; CTC chr11 5323768 5323789 5323773 5323768 -
atgttatcacacgtgctttctg

SEQ ID NO: 126596 - DNA, 22 bp, Artificial Sequence
  Synthetic oligonucleotide; TTA chr11 5323762 5323783 5323767 5323762 -
tcacacgtgctttctgcctcca

SEQ ID NO: 126597 - DNA, 22 bp, Artificial Sequence
  Synthetic oligonucleotide; CTT chr11 5323750 5323771 5323755 5323750 -
tctgcctccaccaagaaatcat

SEQ ID NO: 126598 - DNA, 22 bp, Artificial Sequence
  Synthetic oligonucleotide; TTT chr11 5323749 5323770 5323754 5323749 -
ctgcctccaccaagaaatcatg

SEQ ID NO: 126599 - DNA, 22 bp, Artificial Sequence
  Synthetic oligonucleotide; TTC chr11 5323748 5323769 5323753 5323748 -
tgcctccaccaagaaatcatga

SEQ ID NO: 126600 - DNA, 22 bp, Artificial Sequence
  Synthetic oligonucleotide; CTG chr11 5323746 5323767 5323751 5323746 -
cctccaccaagaaatcatgaga

SEQ ID NO: 126601 - DNA, 22 bp, Artificial Sequence
  Synthetic oligonucleotide; CTC chr11 5323742 5323763 5323747 5323742 -
caccaagaaatcatgagactgg

SEQ ID NO: 126602 - DNA, 22 bp, Artificial Sequence
  Synthetic oligonucleotide; CTG chr11 5323721 5323742 5323726 5323721 -
gcttgtgctgacataactttca

SEQ ID NO: 126603 - DNA, 22 bp, Artificial Sequence
  Synthetic oligonucleotide; CTT chr11 5323717 5323738 5323722 5323717 -
gtgctgacataactttcaatag

SEQ ID NO: 126604 - DNA, 22 bp, Artificial Sequence
  Synthetic oligonucleotide; TTG chr11 5323716 5323737 5323721 5323716 -
tgctgacataactttcaataga

SEQ ID NO: 126605 - DNA, 22 bp, Artificial Sequence
  Synthetic oligonucleotide; CTG chr11 5323711 5323732 5323716 5323711 -
acataactttcaatagacttta

SEQ ID NO: 126606 - DNA, 22 bp, Artificial Sequence
  Synthetic oligonucleotide; CTT chr11 5323702 5323723 5323707 5323702 -
tcaatagactttaccctgtaat

SEQ ID NO: 126607 - DNA, 22 bp, Artificial Sequence
  Synthetic oligonucleotide; TTT chr11 5323701 5323722 5323706 5323701 -
caatagactttaccctgtaatt

SEQ ID NO: 126608 - DNA, 22 bp, Artificial Sequence
  Synthetic oligonucleotide; TTC chr11 5323700 5323721 5323705 5323700 -
aatagactttaccctgtaattt

SEQ ID NO: 126609 - DNA, 22 bp, Artificial Sequence
  Synthetic oligonucleotide; CTT chr11 5323691 5323712 5323696 5323691 -
taccctgtaattttgatctctt

SEQ ID NO: 126610 - DNA, 22 bp, Artificial Sequence
  Synthetic oligonucleotide; TTT chr11 5323690 5323711 5323695 5323690 -
accctgtaattttgatctcttt

SEQ ID NO: 126611 - DNA, 22 bp, Artificial Sequence
  Synthetic oligonucleotide; TTA chr11 5323689 5323710 5323694 5323689 -
ccctgtaattttgatctcttta

SEQ ID NO: 126612 - DNA, 22 bp, Artificial Sequence
  Synthetic oligonucleotide; CTG chr11 5323684 5323705 5323689 5323684 -
taattttgatctctttaacaat

SEQ ID NO: 126613 - DNA, 22 bp, Artificial Sequence
  Synthetic oligonucleotide; TTT chr11 5323678 5323699 5323683 5323678 -
tgatctctttaacaatcttcct

SEQ ID NO: 126614 - DNA, 22 bp, Artificial Sequence
  Synthetic oligonucleotide; TTT chr11 5323677 5323698 5323682 5323677 -
gatctctttaacaatcttccta

SEQ ID NO: 126615 - DNA, 22 bp, Artificial Sequence
  Synthetic oligonucleotide; TTG chr11 5323676 5323697 5323681 5323676 -
atctctttaacaatcttcctag

SEQ ID NO: 126616 - DNA, 22 bp, Artificial Sequence
  Synthetic oligonucleotide; CTC chr11 5323671 5323692 5323676 5323671 -
tttaacaatcttcctagactgt

SEQ ID NO: 126617 - DNA, 22 bp, Artificial Sequence
  Synthetic oligonucleotide; CTT chr11 5323669 5323690 5323674 5323669 -
taacaatcttcctagactgtct

SEQ ID NO: 126618 - DNA, 22 bp, Artificial Sequence
  Synthetic oligonucleotide; TTT chr11 5323668 5323689 5323673 5323668 -
aacaatcttcctagactgtctg

SEQ ID NO: 126619 - DNA, 22 bp, Artificial Sequence
  Synthetic oligonucleotide; TTA chr11 5323667 5323688 5323672 5323667 -
acaatcttcctagactgtctga

SEQ ID NO: 126620 - DNA, 22 bp, Artificial Sequence
  Synthetic oligonucleotide; CTT chr11 5323659 5323680 5323664 5323659 -
cctagactgtctgatcatcctc

SEQ ID NO: 126621 - DNA, 22 bp, Artificial Sequence
  Synthetic oligonucleotide; TTC chr11 5323658 5323679 5323663 5323658 -
ctagactgtctgatcatcctct

SEQ ID NO: 126622 - DNA, 22 bp, Artificial Sequence
  Synthetic oligonucleotide; CTA chr11 5323655 5323676 5323660 5323655 -
gactgtctgatcatcctcttct

SEQ ID NO: 126623 - DNA, 22 bp, Artificial Sequence
  Synthetic oligonucleotide; CTG chr11 5323650 5323671 5323655 5323650 -
tctgatcatcctcttctcctat

SEQ ID NO: 126624 - DNA, 22 bp, Artificial Sequence
  Synthetic oligonucleotide; CTG chr11 5323646 5323667 5323651 5323646 -
atcatcctcttctcctatattc

SEQ ID NO: 126625 - DNA, 22 bp, Artificial Sequence
  Synthetic oligonucleotide; CTC chr11 5323637 5323658 5323642 5323637 -
ttctcctatattctaattctta

SEQ ID NO: 126626 - DNA, 22 bp, Artificial Sequence
  Synthetic oligonucleotide; CTT chr11 5323635 5323656 5323640 5323635 -
ctcctatattctaattcttaat

SEQ ID NO: 126627 - DNA, 22 bp, Artificial Sequence
  Synthetic oligonucleotide; TTC chr11 5323634 5323655 5323639 5323634 -
tcctatattctaattcttaata

SEQ ID NO: 126628 - DNA, 22 bp, Artificial Sequence
  Synthetic oligonucleotide; CTC chr11 5323632 5323653 5323637 5323632 -
ctatattctaattcttaatact

SEQ ID NO: 126629 - DNA, 22 bp, Artificial Sequence
  Synthetic oligonucleotide; CTA chr11 5323629 5323650 5323634 5323629 -
tattctaattcttaatactgtc

SEQ ID NO: 126630 - DNA, 22 bp, Artificial Sequence
  Synthetic oligonucleotide; TTC chr11 5323624 5323645 5323629 5323624 -
taattcttaatactgtcatagg

SEQ ID NO: 126631 - DNA, 22 bp, Artificial Sequence
  Synthetic oligonucleotide; CTA chr11 5323622 5323643 5323627 5323622 -
attcttaatactgtcataggca

SEQ ID NO: 126632 - DNA, 22 bp, Artificial Sequence
  Synthetic oligonucleotide; TTC chr11 5323618 5323639 5323623 5323618 -
ttaatactgtcataggcattgc

SEQ ID NO: 126633 - DNA, 22 bp, Artificial Sequence
  Synthetic oligonucleotide; CTT chr11 5323616 5323637 5323621 5323616 -
aatactgtcataggcattgctt

SEQ ID NO: 126634 - DNA, 22 bp, Artificial Sequence
  Synthetic oligonucleotide; TTA chr11 5323615 5323636 5323620 5323615 -
atactgtcataggcattgcttc

SEQ ID NO: 126635 - DNA, 22 bp, Artificial Sequence
  Synthetic oligonucleotide; CTG chr11 5323609 5323630 5323614 5323609 -
tcataggcattgcttctggtga

SEQ ID NO: 126636 - DNA, 22 bp, Artificial Sequence
  Synthetic oligonucleotide; TTG chr11 5323597 5323618 5323602 5323597 -
cttctggtgaagagagagccaa

SEQ ID NO: 126637 - DNA, 22 bp, Artificial Sequence
  Synthetic oligonucleotide; CTT chr11 5323594 5323615 5323599 5323594 -
ctggtgaagagagagccaaagc

SEQ ID NO: 126638 - DNA, 22 bp, Artificial Sequence
  Synthetic oligonucleotide; TTC chr11 5323593 5323614 5323598 5323593 -
tggtgaagagagagccaaagcc

SEQ ID NO: 126639 - DNA, 22 bp, Artificial Sequence
  Synthetic oligonucleotide; CTG chr11 5323591 5323612 5323596 5323591 -
gtgaagagagagccaaagccct

SEQ ID NO: 126640 - DNA, 22 bp, Artificial Sequence
  Synthetic oligonucleotide; CTC chr11 5323568 5323589 5323573 5323568 -
aatacctgtatctcccacatta

SEQ ID NO: 126641 - DNA, 22 bp, Artificial Sequence
  Synthetic oligonucleotide; CTG chr11 5323560 5323581 5323565 5323560 -
tatctcccacattagttgtgtt

SEQ ID NO: 126642 - DNA, 22 bp, Artificial Sequence
  Synthetic oligonucleotide; CTC chr11 5323554 5323575 5323559 5323554 -
ccacattagttgtgttcttatc

SEQ ID NO: 126643 - DNA, 22 bp, Artificial Sequence
  Synthetic oligonucleotide; TTA chr11 5323546 5323567 5323551 5323546 -
gttgtgttcttatcttctatgt

SEQ ID NO: 126644 - DNA, 22 bp, Artificial Sequence
  Synthetic oligonucleotide; TTG chr11 5323542 5323563 5323547 5323542 -
tgttcttatcttctatgttaca

SEQ ID NO: 126645 - DNA, 22 bp, Artificial Sequence
  Synthetic oligonucleotide; TTC chr11 5323537 5323558 5323542 5323537 -
ttatcttctatgttacagtgat

SEQ ID NO: 126646 - DNA, 22 bp, Artificial Sequence
  Synthetic oligonucleotide; CTT chr11 5323535 5323556 5323540 5323535 -
atcttctatgttacagtgatgg

SEQ ID NO: 126647 - DNA, 22 bp, Artificial Sequence
  Synthetic oligonucleotide; TTA chr11 5323534 5323555 5323539 5323534 -
tcttctatgttacagtgatggg

SEQ ID NO: 126648 - DNA, 22 bp, Artificial Sequence
  Synthetic oligonucleotide; CTT chr11 5323530 5323551 5323535 5323530 -
ctatgttacagtgatgggtttg

SEQ ID NO: 126649 - DNA, 22 bp, Artificial Sequence
  Synthetic oligonucleotide; TTC chr11 5323529 5323550 5323534 5323529 -
tatgttacagtgatgggtttga

SEQ ID NO: 126650 - DNA, 22 bp, Artificial Sequence
  Synthetic oligonucleotide; CTA chr11 5323527 5323548 5323532 5323527 -
tgttacagtgatgggtttgaca

SEQ ID NO: 126651 - DNA, 22 bp, Artificial Sequence
  Synthetic oligonucleotide; TTA chr11 5323522 5323543 5323527 5323522 -
cagtgatgggtttgacattcat

SEQ ID NO: 126652 - DNA, 22 bp, Artificial Sequence
  Synthetic oligonucleotide; TTT chr11 5323509 5323530 5323514 5323509 -
gacattcatttacagatttggg

SEQ ID NO: 126653 - DNA, 22 bp, Artificial Sequence
  Synthetic oligonucleotide; TTG chr11 5323508 5323529 5323513 5323508 -
acattcatttacagatttggga

SEQ ID NO: 126654 - DNA, 22 bp, Artificial Sequence
  Synthetic oligonucleotide; TTC chr11 5323502 5323523 5323507 5323502 -
atttacagatttgggaagaatg

SEQ ID NO: 126655 - DNA, 22 bp, Artificial Sequence
  Synthetic oligonucleotide; TTT chr11 5323498 5323519 5323503 5323498 -
acagatttgggaagaatgtgcc

SEQ ID NO: 126656 - DNA, 22 bp, Artificial Sequence
  Synthetic oligonucleotide; TTA chr11 5323497 5323518 5323502 5323497 -
cagatttgggaagaatgtgcca

SEQ ID NO: 126657 - DNA, 22 bp, Artificial Sequence
  Synthetic oligonucleotide; TTT chr11 5323490 5323511 5323495 5323490 -
gggaagaatgtgccagaggttg

SEQ ID NO: 126658 - DNA, 22 bp, Artificial Sequence
  Synthetic oligonucleotide; TTG chr11 5323489 5323510 5323494 5323489 -
ggaagaatgtgccagaggttgt

SEQ ID NO: 126659 - DNA, 22 bp, Artificial Sequence
  Synthetic oligonucleotide; TTG chr11 5323468 5323489 5323473 5323468 -
tccacattatcatgagttacat

SEQ ID NO: 126660 - DNA, 22 bp, Artificial Sequence
  Synthetic oligonucleotide; TTA chr11 5323459 5323480 5323464 5323459 -
tcatgagttacatctacttcct

SEQ ID NO: 126661 - DNA, 22 bp, Artificial Sequence
  Synthetic oligonucleotide; TTA chr11 5323449 5323470 5323454 5323449 -
catctacttcctctttcctcct

SEQ ID NO: 126662 - DNA, 22 bp, Artificial Sequence
  Synthetic oligonucleotide; CTA chr11 5323443 5323464 5323448 5323443 -
cttcctctttcctcctttaatg

SEQ ID NO: 126663 - DNA, 22 bp, Artificial Sequence
  Synthetic oligonucleotide; CTT chr11 5323440 5323461 5323445 5323440 -
cctctttcctcctttaatgaac

SEQ ID NO: 126664 - DNA, 22 bp, Artificial Sequence
  Synthetic oligonucleotide; TTC chr11 5323439 5323460 5323444 5323439 -
ctctttcctcctttaatgaacc

SEQ ID NO: 126665 - DNA, 22 bp, Artificial Sequence
  Synthetic oligonucleotide; CTC chr11 5323436 5323457 5323441 5323436 -
tttcctcctttaatgaaccctg

SEQ ID NO: 126666 - DNA, 22 bp, Artificial Sequence
  Synthetic oligonucleotide; CTT chr11 5323434 5323455 5323439 5323434 -
tcctcctttaatgaaccctgtc

SEQ ID NO: 126667 - DNA, 22 bp, Artificial Sequence
  Synthetic oligonucleotide; TTT chr11 5323433 5323454 5323438 5323433 -
cctcctttaatgaaccctgtca

SEQ ID NO: 126668 - DNA, 22 bp, Artificial Sequence
  Synthetic oligonucleotide; TTC chr11 5323432 5323453 5323437 5323432 -
ctcctttaatgaaccctgtcat

SEQ ID NO: 126669 - DNA, 22 bp, Artificial Sequence
  Synthetic oligonucleotide; CTC chr11 5323429 5323450 5323434 5323429 -
ctttaatgaaccctgtcatcta

SEQ ID NO: 126670 - DNA, 22 bp, Artificial Sequence
  Synthetic oligonucleotide; CTT chr11 5323426 5323447 5323431 5323426 -
taatgaaccctgtcatctacag

SEQ ID NO: 126671 - DNA, 22 bp, Artificial Sequence
  Synthetic oligonucleotide; TTT chr11 5323425 5323446 5323430 5323425 -
aatgaaccctgtcatctacagc

SEQ ID NO: 126672 - DNA, 22 bp, Artificial Sequence
  Synthetic oligonucleotide; TTA chr11 5323424 5323445 5323429 5323424 -
atgaaccctgtcatctacagca

SEQ ID NO: 126673 - DNA, 22 bp, Artificial Sequence
  Synthetic oligonucleotide; CTG chr11 5323414 5323435 5323419 5323414 -
tcatctacagcatcaaaaccaa

SEQ ID NO: 126674 - DNA, 22 bp, Artificial Sequence
  Synthetic oligonucleotide; CTA chr11 5323407 5323428 5323412 5323407 -
cagcatcaaaaccaagcaaata

SEQ ID NO: 126675 - DNA, 22 bp, Artificial Sequence
  Synthetic oligonucleotide; TTA chr11 5323372 5323393 5323377 5323372 -
tccgccttttatctaaacatag

SEQ ID NO: 126676 - DNA, 22 bp, Artificial Sequence
  Synthetic oligonucleotide; CTT chr11 5323364 5323385 5323369 5323364 -
ttatctaaacataggtttagta

SEQ ID NO: 126677 - DNA, 22 bp, Artificial Sequence
  Synthetic oligonucleotide; TTT chr11 5323363 5323384 5323368 5323363 -
tatctaaacataggtttagtag

SEQ ID NO: 126678 - DNA, 22 bp, Artificial Sequence
  Synthetic oligonucleotide; TTT chr11 5323362 5323383 5323367 5323362 -
atctaaacataggtttagtagt

SEQ ID NO: 126679 - DNA, 22 bp, Artificial Sequence
  Synthetic oligonucleotide; TTA chr11 5323361 5323382 5323366 5323361 -
tctaaacataggtttagtagtt

SEQ ID NO: 126680 - DNA, 22 bp, Artificial Sequence
  Synthetic oligonucleotide; CTA chr11 5323357 5323378 5323362 5323357 -
aacataggtttagtagttaaac

SEQ ID NO: 126681 - DNA, 22 bp, Artificial Sequence
  Synthetic oligonucleotide; TTT chr11 5323346 5323367 5323351 5323346 -
agtagttaaactcggatctgga

SEQ ID NO: 126682 - DNA, 22 bp, Artificial Sequence
  Synthetic oligonucleotide; TTA chr11 5323345 5323366 5323350 5323345 -
gtagttaaactcggatctggag

SEQ ID NO: 126683 - DNA, 22 bp, Artificial Sequence
  Synthetic oligonucleotide; TTA chr11 5323338 5323359 5323343 5323338 -
aactcggatctggagaatcaga

SEQ ID NO: 126684 - DNA, 22 bp, Artificial Sequence
  Synthetic oligonucleotide; CTC chr11 5323333 5323354 5323338 5323333 -
ggatctggagaatcagacacag

SEQ ID NO: 126685 - DNA, 22 bp, Artificial Sequence
  Synthetic oligonucleotide; CTG chr11 5323326 5323347 5323331 5323326 -
gagaatcagacacagacataaa

SEQ ID NO: 126686 - DNA, 22 bp, Artificial Sequence
  Synthetic oligonucleotide; CTG chr11 5323274 5323295 5323279 5323274 -
gagttctttcttagcaaagagc

SEQ ID NO: 126687 - DNA, 22 bp, Artificial Sequence
  Synthetic oligonucleotide; TTC chr11 5323268 5323289 5323273 5323268 -
tttcttagcaaagagcaagggt

SEQ ID NO: 126688 - DNA, 22 bp, Artificial Sequence
  Synthetic oligonucleotide; CTT chr11 5323266 5323287 5323271 5323266 -
tcttagcaaagagcaagggtat

SEQ ID NO: 126689 - DNA, 22 bp, Artificial Sequence
  Synthetic oligonucleotide; TTT chr11 5323265 5323286 5323270 5323265 -
cttagcaaagagcaagggtata

SEQ ID NO: 126690 - DNA, 22 bp, Artificial Sequence
  Synthetic oligonucleotide; TTC chr11 5323264 5323285 5323269 5323264 -
ttagcaaagagcaagggtatac

SEQ ID NO: 126691 - DNA, 22 bp, Artificial Sequence
  Synthetic oligonucleotide; CTT chr11 5323262 5323283 5323267 5323262 -
agcaaagagcaagggtatactg

SEQ ID NO: 126692 - DNA, 22 bp, Artificial Sequence
  Synthetic oligonucleotide; TTA chr11 5323261 5323282 5323266 5323261 -
gcaaagagcaagggtatactgg

SEQ ID NO: 126693 - DNA, 22 bp, Artificial Sequence
  Synthetic oligonucleotide; CTG chr11 5323240 5323261 5323245 5323240 -
gaagacaatgttgtcactcaca

SEQ ID NO: 126694 - DNA, 22 bp, Artificial Sequence
  Synthetic oligonucleotide; TTG chr11 5323227 5323248 5323232 5323227 -
tcactcacaaggacttaagtac

SEQ ID NO: 126695 - DNA, 22 bp, Artificial Sequence
  Synthetic oligonucleotide; CTC chr11 5323221 5323242 5323226 5323221 -
acaaggacttaagtactttacc

SEQ ID NO: 126696 - DNA, 22 bp, Artificial Sequence
  Synthetic oligonucleotide; CTT chr11 5323211 5323232 5323216 5323211 -
aagtactttaccatagggttgg

SEQ ID NO: 126697 - DNA, 22 bp, Artificial Sequence
  Synthetic oligonucleotide; TTA chr11 5323210 5323231 5323215 5323210 -
agtactttaccatagggttggg

SEQ ID NO: 126698 - DNA, 22 bp, Artificial Sequence
  Synthetic oligonucleotide; CTT chr11 5323203 5323224 5323208 5323203 -
taccatagggttgggggcatat

SEQ ID NO: 126699 - DNA, 22 bp, Artificial Sequence
  Synthetic oligonucleotide; TTT chr11 5323202 5323223 5323207 5323202 -
accatagggttgggggcatatc

SEQ ID NO: 126700 - DNA, 22 bp, Artificial Sequence
  Synthetic oligonucleotide; TTA chr11 5323201 5323222 5323206 5323201 -
ccatagggttgggggcatatct

SEQ ID NO: 126701 - DNA, 22 bp, Artificial Sequence
  Synthetic oligonucleotide; TTG chr11 5323190 5323211 5323195 5323190 -
ggggcatatcttaggagaagtc

SEQ ID NO: 126702 - DNA, 22 bp, Artificial Sequence
  Synthetic oligonucleotide; CTT chr11 5323178 5323199 5323183 5323178 -
aggagaagtctggtgacagaac

SEQ ID NO: 126703 - DNA, 22 bp, Artificial Sequence
  Synthetic oligonucleotide; TTA chr11 5323177 5323198 5323182 5323177 -
ggagaagtctggtgacagaaca

SEQ ID NO: 126704 - DNA, 22 bp, Artificial Sequence
  Synthetic oligonucleotide; CTG chr11 5323166 5323187 5323171 5323166 -
gtgacagaacactgaatagacc

SEQ ID NO: 126705 - DNA, 22 bp, Artificial Sequence
  Synthetic oligonucleotide; CTG chr11 5323152 5323173 5323157 5323152 -
aatagaccatatggaactgaaa

SEQ ID NO: 126706 - DNA, 22 bp, Artificial Sequence
  Synthetic oligonucleotide; CTG chr11 5323133 5323154 5323138 5323133 -
aaaaagtctatatttaaattct

SEQ ID NO: 126707 - DNA, 22 bp, Artificial Sequence
  Synthetic oligonucleotide; CTA chr11 5323123 5323144 5323128 5323123 -
tatttaaattcttctttcaaat

SEQ ID NO: 126708 - DNA, 22 bp, Artificial Sequence
  Synthetic oligonucleotide; TTT chr11 5323118 5323139 5323123 5323118 -
aaattcttctttcaaatgcacc

SEQ ID NO: 126709 - DNA, 22 bp, Artificial Sequence
  Synthetic oligonucleotide; TTA chr11 5323117 5323138 5323122 5323117 -
aattcttctttcaaatgcacct

SEQ ID NO: 126710 - DNA, 22 bp, Artificial Sequence
  Synthetic oligonucleotide; TTC chr11 5323112 5323133 5323117 5323112 -
ttctttcaaatgcacctgaaat

SEQ ID NO: 126711 - DNA, 22 bp, Artificial Sequence
  Synthetic oligonucleotide; CTT chr11 5323110 5323131 5323115 5323110 -
ctttcaaatgcacctgaaatta

SEQ ID NO: 126712 - DNA, 22 bp, Artificial Sequence
  Synthetic oligonucleotide; TTC chr11 5323109 5323130 5323114 5323109 -
tttcaaatgcacctgaaattag

SEQ ID NO: 126713 - DNA, 22 bp, Artificial Sequence
  Synthetic oligonucleotide; CTT chr11 5323107 5323128 5323112 5323107 -
tcaaatgcacctgaaattagcc

SEQ ID NO: 126714 - DNA, 22 bp, Artificial Sequence
  Synthetic oligonucleotide; TTT chr11 5323106 5323127 5323111 5323106 -
caaatgcacctgaaattagcca

SEQ ID NO: 126715 - DNA, 22 bp, Artificial Sequence
  Synthetic oligonucleotide; TTC chr11 5323105 5323126 5323110 5323105 -
aaatgcacctgaaattagccac

SEQ ID NO: 126716 - DNA, 22 bp, Artificial Sequence
  Synthetic oligonucleotide; CTG chr11 5323094 5323115 5323099 5323094 -
aaattagccacctcagtgaaat

SEQ ID NO: 126717 - DNA, 22 bp, Artificial Sequence
  Synthetic oligonucleotide; TTA chr11 5323088 5323109 5323093 5323088 -
gccacctcagtgaaatttgagg

SEQ ID NO: 126718 - DNA, 22 bp, Artificial Sequence
  Synthetic oligonucleotide; CTC chr11 5323080 5323101 5323085 5323080 -
agtgaaatttgaggaaaaggca

SEQ ID NO: 126719 - DNA, 22 bp, Artificial Sequence
  Synthetic oligonucleotide; TTT chr11 5323070 5323091 5323075 5323070 -
gaggaaaaggcagaacatataa

SEQ ID NO: 126720 - DNA, 22 bp, Artificial Sequence
  Synthetic oligonucleotide; TTG chr11 5323069 5323090 5323074 5323069 -
aggaaaaggcagaacatataat

SEQ ID NO: 126721 - DNA, 22 bp, Artificial Sequence
  Synthetic oligonucleotide; CTC chr11 5323044 5323065 5323049 5323044 -
tatgaaaaacttttgcctcagt

SEQ ID NO: 126722 - DNA, 22 bp, Artificial Sequence
  Synthetic oligonucleotide; CTA chr11 5323042 5323063 5323047 5323042 -
tgaaaaacttttgcctcagtgt

SEQ ID NO: 126723 - DNA, 22 bp, Artificial Sequence
  Synthetic oligonucleotide; CTT chr11 5323032 5323053 5323037 5323032 -
ttgcctcagtgtgcacatttgt

SEQ ID NO: 126724 - DNA, 22 bp, Artificial Sequence
  Synthetic oligonucleotide; TTT chr11 5323031 5323052 5323036 5323031 -
tgcctcagtgtgcacatttgtg

SEQ ID NO: 126725 - DNA, 22 bp, Artificial Sequence
  Synthetic oligonucleotide; TTT chr11 5323030 5323051 5323035 5323030 -
gcctcagtgtgcacatttgtgc

SEQ ID NO: 126726 - DNA, 22 bp, Artificial Sequence
  Synthetic oligonucleotide; TTG chr11 5323029 5323050 5323034 5323029 -
cctcagtgtgcacatttgtgca

SEQ ID NO: 126727 - DNA, 22 bp, Artificial Sequence
  Synthetic oligonucleotide; CTC chr11 5323025 5323046 5323030 5323025 -
agtgtgcacatttgtgcataca

SEQ ID NO: 126728 - DNA, 22 bp, Artificial Sequence
  Synthetic oligonucleotide; TTT chr11 5323012 5323033 5323017 5323012 -
gtgcatacatgtttatgtgttt

SEQ ID NO: 126729 - DNA, 22 bp, Artificial Sequence
  Synthetic oligonucleotide; TTG chr11 5323011 5323032 5323016 5323011 -
tgcatacatgtttatgtgtttg

SEQ ID NO: 126730 - DNA, 22 bp, Artificial Sequence
  Synthetic oligonucleotide; TTT chr11 5322998 5323019 5323003 5322998 -
atgtgtttgcataggctaatgc

SEQ ID NO: 126731 - DNA, 22 bp, Artificial Sequence
  Synthetic oligonucleotide; TTA chr11 5322997 5323018 5323002 5322997 -
tgtgtttgcataggctaatgca

SEQ ID NO: 126732 - DNA, 22 bp, Artificial Sequence
  Synthetic oligonucleotide; TTT chr11 5322990 5323011 5322995 5322990 -
gcataggctaatgcacacaagt

SEQ ID NO: 126733 - DNA, 22 bp, Artificial Sequence
  Synthetic oligonucleotide; TTG chr11 5322989 5323010 5322994 5322989 -
cataggctaatgcacacaagtg

SEQ ID NO: 126734 - DNA, 22 bp, Artificial Sequence
  Synthetic oligonucleotide; CTA chr11 5322980 5323001 5322985 5322980 -
atgcacacaagtgtaaaaaaaa

SEQ ID NO: 126735 - DNA, 22 bp, Artificial Sequence
  Synthetic oligonucleotide; TTG chr11 5322952 5322973 5322957 5322952 -
atcatcattctctagaaataaa

SEQ ID NO: 126736 - DNA, 22 bp, Artificial Sequence
  Synthetic oligonucleotide; TTC chr11 5322942 5322963 5322947 5322942 -
tctagaaataaattcttattta

SEQ ID NO: 126737 - DNA, 22 bp, Artificial Sequence
  Synthetic oligonucleotide; CTC chr11 5322940 5322961 5322945 5322940 -
tagaaataaattcttatttaaa

SEQ ID NO: 126738 - DNA, 22 bp, Artificial Sequence
  Synthetic oligonucleotide; CTA chr11 5322938 5322959 5322943 5322938 -
gaaataaattcttatttaaaat

SEQ ID NO: 126739 - DNA, 22 bp, Artificial Sequence
  Synthetic oligonucleotide; TTC chr11 5322927 5322948 5322932 5322927 -
ttatttaaaattttcattattc

SEQ ID NO: 126740 - DNA, 22 bp, Artificial Sequence
  Synthetic oligonucleotide; CTT chr11 5322925 5322946 5322930 5322925 -
atttaaaattttcattattctc

SEQ ID NO: 126741 - DNA, 22 bp, Artificial Sequence
  Synthetic oligonucleotide; TTA chr11 5322924 5322945 5322929 5322924 -
tttaaaattttcattattctca

SEQ ID NO: 126742 - DNA, 22 bp, Artificial Sequence
  Synthetic oligonucleotide; TTT chr11 5322921 5322942 5322926 5322921 -
aaaattttcattattctcatgg

SEQ ID NO: 126743 - DNA, 22 bp, Artificial Sequence
  Synthetic oligonucleotide; TTA chr11 5322920 5322941 5322925 5322920 -
aaattttcattattctcatggc

SEQ ID NO: 126744 - DNA, 22 bp, Artificial Sequence
  Synthetic oligonucleotide; TTT chr11 5322914 5322935 5322919 5322914 -
tcattattctcatggcaaatat

SEQ ID NO: 126745 - DNA, 22 bp, Artificial Sequence
  Synthetic oligonucleotide; TTT chr11 5322913 5322934 5322918 5322913 -
cattattctcatggcaaatata

SEQ ID NO: 126746 - DNA, 22 bp, Artificial Sequence
  Synthetic oligonucleotide; TTC chr11 5322912 5322933 5322917 5322912 -
attattctcatggcaaatatag

SEQ ID NO: 126747 - DNA, 22 bp, Artificial Sequence
  Synthetic oligonucleotide; TTA chr11 5322908 5322929 5322913 5322908 -
ttctcatggcaaatatagtgat

SEQ ID NO: 126748 - DNA, 22 bp, Artificial Sequence
  Synthetic oligonucleotide; TTC chr11 5322905 5322926 5322910 5322905 -
tcatggcaaatatagtgataag

SEQ ID NO: 126749 - DNA, 22 bp, Artificial Sequence
  Synthetic oligonucleotide; CTC chr11 5322903 5322924 5322908 5322903 -
atggcaaatatagtgataagaa

SEQ ID NO: 126750 - DNA, 22 bp, Artificial Sequence
  Synthetic oligonucleotide; CTA chr11 5322877 5322898 5322882 5322877 -
acattttaaatttacttttaaa

SEQ ID NO: 126751 - DNA, 22 bp, Artificial Sequence
  Synthetic oligonucleotide; TTT chr11 5322871 5322892 5322876 5322871 -
taaatttacttttaaataagta

SEQ ID NO: 126752 - DNA, 22 bp, Artificial Sequence
  Synthetic oligonucleotide; TTT chr11 5322870 5322891 5322875 5322870 -
aaatttacttttaaataagtaa

SEQ ID NO: 126753 - DNA, 22 bp, Artificial Sequence
  Synthetic oligonucleotide; TTA chr11 5322869 5322890 5322874 5322869 -
aatttacttttaaataagtaag

SEQ ID NO: 126754 - DNA, 22 bp, Artificial Sequence
  Synthetic oligonucleotide; TTT chr11 5322864 5322885 5322869 5322864 -
acttttaaataagtaagtgttg

SEQ ID NO: 126755 - DNA, 22 bp, Artificial Sequence
  Synthetic oligonucleotide; TTA chr11 5322863 5322884 5322868 5322863 -
cttttaaataagtaagtgttgg

SEQ ID NO: 126756 - DNA, 22 bp, Artificial Sequence
  Synthetic oligonucleotide; CTT chr11 5322860 5322881 5322865 5322860 -
ttaaataagtaagtgttggtta

SEQ ID NO: 126757 - DNA, 22 bp, Artificial Sequence
  Synthetic oligonucleotide; TTT chr11 5322859 5322880 5322864 5322859 -
taaataagtaagtgttggttat

SEQ ID NO: 126758 - DNA, 22 bp, Artificial Sequence
  Synthetic oligonucleotide; TTT chr11 5322858 5322879 5322863 5322858 -
aaataagtaagtgttggttatc

SEQ ID NO: 126759 - DNA, 22 bp, Artificial Sequence
  Synthetic oligonucleotide; TTA chr11 5322857 5322878 5322862 5322857 -
aataagtaagtgttggttatct

SEQ ID NO: 126760 - DNA, 22 bp, Artificial Sequence
  Synthetic oligonucleotide; TTG chr11 5322842 5322863 5322847 5322842 -
gttatcttttaactgtcctcta

SEQ ID NO: 126761 - DNA, 22 bp, Artificial Sequence
  Synthetic oligonucleotide; TTA chr11 5322838 5322859 5322843 5322838 -
tcttttaactgtcctctaccct

SEQ ID NO: 126762 - DNA, 22 bp, Artificial Sequence
  Synthetic oligonucleotide; CTT chr11 5322834 5322855 5322839 5322834 -
ttaactgtcctctaccctgagt

SEQ ID NO: 126763 - DNA, 22 bp, Artificial Sequence
  Synthetic oligonucleotide; TTT chr11 5322833 5322854 5322838 5322833 -
taactgtcctctaccctgagtt

SEQ ID NO: 126764 - DNA, 22 bp, Artificial Sequence
  Synthetic oligonucleotide; TTT chr11 5322832 5322853 5322837 5322832 -
aactgtcctctaccctgagtta

SEQ ID NO: 126765 - DNA, 22 bp, Artificial Sequence
  Synthetic oligonucleotide; TTA chr11 5322831 5322852 5322836 5322831 -
actgtcctctaccctgagttag

SEQ ID NO: 126766 - DNA, 22 bp, Artificial Sequence
  Synthetic oligonucleotide; CTG chr11 5322827 5322848 5322832 5322827 -
tcctctaccctgagttagggta

SEQ ID NO: 126767 - DNA, 22 bp, Artificial Sequence
  Synthetic oligonucleotide; CTC chr11 5322822 5322843 5322827 5322822 -
taccctgagttagggtactctc

SEQ ID NO: 126768 - DNA, 22 bp, Artificial Sequence
  Synthetic oligonucleotide; CTA chr11 5322820 5322841 5322825 5322820 -
ccctgagttagggtactctcta

SEQ ID NO: 126769 - DNA, 22 bp, Artificial Sequence
  Synthetic oligonucleotide; CTG chr11 5322815 5322836 5322820 5322815 -
agttagggtactctctagggcc

SEQ ID NO: 126770 - DNA, 22 bp, Artificial Sequence
  Synthetic oligonucleotide; TTA chr11 5322810 5322831 5322815 5322810 -
gggtactctctagggccatgat

SEQ ID NO: 126771 - DNA, 22 bp, Artificial Sequence
  Synthetic oligonucleotide; CTC chr11 5322802 5322823 5322807 5322802 -
tctagggccatgatttgcattt

SEQ ID NO: 126772 - DNA, 22 bp, Artificial Sequence
  Synthetic oligonucleotide; CTC chr11 5322800 5322821 5322805 5322800 -
tagggccatgatttgcatttaa

SEQ ID NO: 126773 - DNA, 22 bp, Artificial Sequence
  Synthetic oligonucleotide; CTA chr11 5322798 5322819 5322803 5322798 -
gggccatgatttgcatttaata

SEQ ID NO: 126774 - DNA, 22 bp, Artificial Sequence
  Synthetic oligonucleotide; TTT chr11 5322786 5322807 5322791 5322786 -
gcatttaatattttctaaatac

SEQ ID NO: 126775 - DNA, 22 bp, Artificial Sequence
  Synthetic oligonucleotide; TTG chr11 5322785 5322806 5322790 5322785 -
catttaatattttctaaataca

SEQ ID NO: 126776 - DNA, 22 bp, Artificial Sequence
  Synthetic oligonucleotide; TTT chr11 5322780 5322801 5322785 5322780 -
aatattttctaaatacagtcgt

SEQ ID NO: 126777 - DNA, 22 bp, Artificial Sequence
  Synthetic oligonucleotide; TTA chr11 5322779 5322800 5322784 5322779 -
atattttctaaatacagtcgta

SEQ ID NO: 126778 - DNA, 22 bp, Artificial Sequence
  Synthetic oligonucleotide; TTT chr11 5322773 5322794 5322778 5322773 -
tctaaatacagtcgtaagtcac

SEQ ID NO: 126779 - DNA, 22 bp, Artificial Sequence
  Synthetic oligonucleotide; TTT chr11 5322772 5322793 5322777 5322772 -
ctaaatacagtcgtaagtcact

SEQ ID NO: 126780 - DNA, 22 bp, Artificial Sequence
  Synthetic oligonucleotide; TTC chr11 5322771 5322792 5322776 5322771 -
taaatacagtcgtaagtcactt

SEQ ID NO: 126781 - DNA, 22 bp, Artificial Sequence
  Synthetic oligonucleotide; CTA chr11 5322769 5322790 5322774 5322769 -
aatacagtcgtaagtcacttac

SEQ ID NO: 126782 - DNA, 22 bp, Artificial Sequence
  Synthetic oligonucleotide; CTT chr11 5322749 5322770 5322754 5322749 -
acagagtatttcaataagagct

SEQ ID NO: 126783 - DNA, 22 bp, Artificial Sequence
  Synthetic oligonucleotide; TTA chr11 5322748 5322769 5322753 5322748 -
cagagtatttcaataagagctt

SEQ ID NO: 126784 - DNA, 22 bp, Artificial Sequence
  Synthetic oligonucleotide; TTT chr11 5322738 5322759 5322743 5322738 -
caataagagctttttaattttc

SEQ ID NO: 126785 - DNA, 22 bp, Artificial Sequence
  Synthetic oligonucleotide; TTC chr11 5322737 5322758 5322742 5322737 -
aataagagctttttaattttca

SEQ ID NO: 126786 - DNA, 22 bp, Artificial Sequence
  Synthetic oligonucleotide; CTT chr11 5322726 5322747 5322731 5322726 -
tttaattttcaatacattcctt

SEQ ID NO: 126787 - DNA, 22 bp, Artificial Sequence
  Synthetic oligonucleotide; TTT chr11 5322725 5322746 5322730 5322725 -
ttaattttcaatacattccttg

SEQ ID NO: 126788 - DNA, 22 bp, Artificial Sequence
  Synthetic oligonucleotide; TTT chr11 5322724 5322745 5322729 5322724 -
taattttcaatacattccttgc

SEQ ID NO: 126789 - DNA, 22 bp, Artificial Sequence
  Synthetic oligonucleotide; TTT chr11 5322723 5322744 5322728 5322723 -
aattttcaatacattccttgca

SEQ ID NO: 126790 - DNA, 22 bp, Artificial Sequence
  Synthetic oligonucleotide; TTA chr11 5322722 5322743 5322727 5322722 -
attttcaatacattccttgcag

SEQ ID NO: 126791 - DNA, 22 bp, Artificial Sequence
  Synthetic oligonucleotide; TTT chr11 5322718 5322739 5322723 5322718 -
tcaatacattccttgcaggatg

SEQ ID NO: 126792 - DNA, 22 bp, Artificial Sequence
  Synthetic oligonucleotide; TTT chr11 5322717 5322738 5322722 5322717 -
caatacattccttgcaggatgt

SEQ ID NO: 126793 - DNA, 22 bp, Artificial Sequence
  Synthetic oligonucleotide; TTC chr11 5322716 5322737 5322721 5322716 -
aatacattccttgcaggatgtc

SEQ ID NO: 126794 - DNA, 22 bp, Artificial Sequence
  Synthetic oligonucleotide; TTC chr11 5322707 5322728 5322712 5322707 -
cttgcaggatgtctggatttta

SEQ ID NO: 126795 - DNA, 22 bp, Artificial Sequence
  Synthetic oligonucleotide; CTT chr11 5322704 5322725 5322709 5322704 -
gcaggatgtctggattttataa

SEQ ID NO: 126796 - DNA, 22 bp, Artificial Sequence
  Synthetic oligonucleotide; TTG chr11 5322703 5322724 5322708 5322703 -
caggatgtctggattttataaa

SEQ ID NO: 126797 - DNA, 22 bp, Artificial Sequence
  Synthetic oligonucleotide; CTG chr11 5322692 5322713 5322697 5322692 -
gattttataaaagtgtatttct

SEQ ID NO: 126798 - DNA, 22 bp, Artificial Sequence
  Synthetic oligonucleotide; TTT chr11 5322687 5322708 5322692 5322687 -
tataaaagtgtatttctttacc

SEQ ID NO: 126799 - DNA, 22 bp, Artificial Sequence
  Synthetic oligonucleotide; TTT chr11 5322686 5322707 5322691 5322686 -
ataaaagtgtatttctttacct

SEQ ID NO: 126800 - DNA, 22 bp, Artificial Sequence
  Synthetic oligonucleotide; TTA chr11 5322685 5322706 5322690 5322685 -
taaaagtgtatttctttacctc

SEQ ID NO: 126801 - DNA, 22 bp, Artificial Sequence
  Synthetic oligonucleotide; TTT chr11 5322672 5322693 5322677 5322672 -
ctttacctcattcttctataaa

SEQ ID NO: 126802 - DNA, 22 bp, Artificial Sequence
  Synthetic oligonucleotide; TTC chr11 5322671 5322692 5322676 5322671 -
tttacctcattcttctataaat

SEQ ID NO: 126803 - DNA, 22 bp, Artificial Sequence
  Synthetic oligonucleotide; CTT chr11 5322669 5322690 5322674 5322669 -
tacctcattcttctataaatat

SEQ ID NO: 126804 - DNA, 22 bp, Artificial Sequence
  Synthetic oligonucleotide; TTT chr11 5322668 5322689 5322673 5322668 -
acctcattcttctataaatatt

SEQ ID NO: 126805 - DNA, 22 bp, Artificial Sequence
  Synthetic oligonucleotide; TTA chr11 5322667 5322688 5322672 5322667 -
cctcattcttctataaatattc

SEQ ID NO: 126806 - DNA, 22 bp, Artificial Sequence
  Synthetic oligonucleotide; CTC chr11 5322663 5322684 5322668 5322663 -
attcttctataaatattctttt

SEQ ID NO: 126807 - DNA, 22 bp, Artificial Sequence
  Synthetic oligonucleotide; TTC chr11 5322659 5322680 5322664 5322659 -
ttctataaatattcttttgccc

SEQ ID NO: 126808 - DNA, 22 bp, Artificial Sequence
  Synthetic oligonucleotide; CTT chr11 5322657 5322678 5322662 5322657 -
ctataaatattcttttgcccaa

SEQ ID NO: 126809 - DNA, 22 bp, Artificial Sequence
  Synthetic oligonucleotide; TTC chr11 5322656 5322677 5322661 5322656 -
tataaatattcttttgcccaaa

SEQ ID NO: 126810 - DNA, 22 bp, Artificial Sequence
  Synthetic oligonucleotide; CTA chr11 5322654 5322675 5322659 5322654 -
taaatattcttttgcccaaaaa

SEQ ID NO: 126811 - DNA, 22 bp, Artificial Sequence
  Synthetic oligonucleotide; TTC chr11 5322645 5322666 5322650 5322645 -
ttttgcccaaaaaaatcttaga

SEQ ID NO: 126812 - DNA, 22 bp, Artificial Sequence
  Synthetic oligonucleotide; CTT chr11 5322643 5322664 5322648 5322643 -
ttgcccaaaaaaatcttagaag

SEQ ID NO: 126813 - DNA, 22 bp, Artificial Sequence
  Synthetic oligonucleotide; TTT chr11 5322642 5322663 5322647 5322642 -
tgcccaaaaaaatcttagaagg

SEQ ID NO: 126814 - DNA, 22 bp, Artificial Sequence
  Synthetic oligonucleotide; TTT chr11 5322641 5322662 5322646 5322641 -
gcccaaaaaaatcttagaagga

SEQ ID NO: 126815 - DNA, 22 bp, Artificial Sequence
  Synthetic oligonucleotide; TTG chr11 5322640 5322661 5322645 5322640 -
cccaaaaaaatcttagaaggaa

SEQ ID NO: 126816 - DNA, 22 bp, Artificial Sequence
  Synthetic oligonucleotide; CTT chr11 5322626 5322647 5322631 5322626 -
agaaggaaaaacctagacaagc

SEQ ID NO: 126817 - DNA, 22 bp, Artificial Sequence
  Synthetic oligonucleotide; TTA chr11 5322625 5322646 5322630 5322625 -
gaaggaaaaacctagacaagct

SEQ ID NO: 126818 - DNA, 22 bp, Artificial Sequence
  Synthetic oligonucleotide; CTA chr11 5322611 5322632 5322616 5322611 -
gacaagcttcttgtcagctcgt

SEQ ID NO: 126819 - DNA, 22 bp, Artificial Sequence
  Synthetic oligonucleotide; CTT chr11 5322602 5322623 5322607 5322602 -
cttgtcagctcgtaaaaaagta

SEQ ID NO: 126820 - DNA, 22 bp, Artificial Sequence
  Synthetic oligonucleotide; TTC chr11 5322601 5322622 5322606 5322601 -
ttgtcagctcgtaaaaaagtaa

SEQ ID NO: 126821 - DNA, 22 bp, Artificial Sequence
  Synthetic oligonucleotide; CTT chr11 5322599 5322620 5322604 5322599 -
gtcagctcgtaaaaaagtaaaa

SEQ ID NO: 126822 - DNA, 22 bp, Artificial Sequence
  Synthetic oligonucleotide; TTG chr11 5322598 5322619 5322603 5322598 -
tcagctcgtaaaaaagtaaaaa

SEQ ID NO: 126823 - DNA, 22 bp, Artificial Sequence
  Synthetic oligonucleotide; CTC chr11 5322591 5322612 5322596 5322591 -
gtaaaaaagtaaaaagtgagtt

SEQ ID NO: 126824 - DNA, 22 bp, Artificial Sequence
  Synthetic oligonucleotide; TTT chr11 5322568 5322589 5322573 5322568 -
ttaagagtatgtttgctcttca

SEQ ID NO: 126825 - DNA, 22 bp, Artificial Sequence
  Synthetic oligonucleotide; TTT chr11 5322567 5322588 5322572 5322567 -
taagagtatgtttgctcttcag

SEQ ID NO: 126826 - DNA, 22 bp, Artificial Sequence
  Synthetic oligonucleotide; TTT chr11 5322566 5322587 5322571 5322566 -
aagagtatgtttgctcttcaga

SEQ ID NO: 126827 - DNA, 22 bp, Artificial Sequence
  Synthetic oligonucleotide; TTA chr11 5322565 5322586 5322570 5322565 -
agagtatgtttgctcttcagat

SEQ ID NO: 126828 - DNA, 22 bp, Artificial Sequence
  Synthetic oligonucleotide; TTT chr11 5322554 5322575 5322559 5322554 -
gctcttcagatgattttaacat

SEQ ID NO: 126829 - DNA, 22 bp, Artificial Sequence
  Synthetic oligonucleotide; TTG chr11 5322553 5322574 5322558 5322553 -
ctcttcagatgattttaacata

SEQ ID NO: 126830 - DNA, 22 bp, Artificial Sequence
  Synthetic oligonucleotide; CTC chr11 5322550 5322571 5322555 5322550 -
ttcagatgattttaacatactt

SEQ ID NO: 126831 - DNA, 22 bp, Artificial Sequence
  Synthetic oligonucleotide; CTT chr11 5322548 5322569 5322553 5322548 -
cagatgattttaacatactttt

SEQ ID NO: 126832 - DNA, 22 bp, Artificial Sequence
  Synthetic oligonucleotide; TTC chr11 5322547 5322568 5322552 5322547 -
agatgattttaacatacttttc

SEQ ID NO: 126833 - DNA, 22 bp, Artificial Sequence
  Synthetic oligonucleotide; TTT chr11 5322538 5322559 5322543 5322538 -
taacatacttttcccttggcct

SEQ ID NO: 126834 - DNA, 22 bp, Artificial Sequence
  Synthetic oligonucleotide; TTT chr11 5322537 5322558 5322542 5322537 -
aacatacttttcccttggccta

SEQ ID NO: 126835 - DNA, 22 bp, Artificial Sequence
  Synthetic oligonucleotide; TTA chr11 5322536 5322557 5322541 5322536 -
acatacttttcccttggcctaa

SEQ ID NO: 126836 - DNA, 22 bp, Artificial Sequence
  Synthetic oligonucleotide; CTT chr11 5322528 5322549 5322533 5322528 -
ttcccttggcctaataatagga

SEQ ID NO: 126837 - DNA, 22 bp, Artificial Sequence
  Synthetic oligonucleotide; TTT chr11 5322527 5322548 5322532 5322527 -
tcccttggcctaataataggaa

SEQ ID NO: 126838 - DNA, 22 bp, Artificial Sequence
  Synthetic oligonucleotide; TTT chr11 5322526 5322547 5322531 5322526 -
cccttggcctaataataggaag

SEQ ID NO: 126839 - DNA, 22 bp, Artificial Sequence
  Synthetic oligonucleotide; TTC chr11 5322525 5322546 5322530 5322525 -
ccttggcctaataataggaagg

SEQ ID NO: 126840 - DNA, 22 bp, Artificial Sequence
  Synthetic oligonucleotide; CTT chr11 5322521 5322542 5322526 5322521 -
ggcctaataataggaagggtca

SEQ ID NO: 126841 - DNA, 22 bp, Artificial Sequence
  Synthetic oligonucleotide; TTG chr11 5322520 5322541 5322525 5322520 -
gcctaataataggaagggtcaa

SEQ ID NO: 126842 - DNA, 22 bp, Artificial Sequence
  Synthetic oligonucleotide; CTA chr11 5322515 5322536 5322520 5322515 -
ataataggaagggtcaaggctc

SEQ ID NO: 126843 - DNA, 22 bp, Artificial Sequence
  Synthetic oligonucleotide; CTC chr11 5322493 5322514 5322498 5322493 -
tattcaaaaatagaaaatatag

SEQ ID NO: 126844 - DNA, 22 bp, Artificial Sequence
  Synthetic oligonucleotide; CTA chr11 5322491 5322512 5322496 5322491 -
ttcaaaaatagaaaatatagcc

SEQ ID NO: 126845 - DNA, 22 bp, Artificial Sequence
  Synthetic oligonucleotide; TTC chr11 5322488 5322509 5322493 5322488 -
aaaaatagaaaatatagccatt

SEQ ID NO: 126846 - DNA, 22 bp, Artificial Sequence
  Synthetic oligonucleotide; TTC chr11 5322465 5322486 5322470 5322465 -
tagaatgaaaaatatgagacat

SEQ ID NO: 126847 - DNA, 22 bp, Artificial Sequence
  Synthetic oligonucleotide; CTA chr11 5322463 5322484 5322468 5322463 -
gaatgaaaaatatgagacatca

SEQ ID NO: 126848 - DNA, 22 bp, Artificial Sequence
  Synthetic oligonucleotide; TTA chr11 5322438 5322459 5322443 5322438 -
cttcacaagttatatatacttt

SEQ ID NO: 126849 - DNA, 22 bp, Artificial Sequence
  Synthetic oligonucleotide; CTT chr11 5322435 5322456 5322440 5322435 -
cacaagttatatatactttata

SEQ ID NO: 126850 - DNA, 22 bp, Artificial Sequence
  Synthetic oligonucleotide; TTC chr11 5322434 5322455 5322439 5322434 -
acaagttatatatactttatat

SEQ ID NO: 126851 - DNA, 22 bp, Artificial Sequence
  Synthetic oligonucleotide; TTA chr11 5322426 5322447 5322431 5322426 -
tatatactttatatatgttcag

SEQ ID NO: 126852 - DNA, 22 bp, Artificial Sequence
  Synthetic oligonucleotide; CTT chr11 5322417 5322438 5322422 5322417 -
tatatatgttcagagggaaaaa

SEQ ID NO: 126853 - DNA, 22 bp, Artificial Sequence
  Synthetic oligonucleotide; TTT chr11 5322416 5322437 5322421 5322416 -
atatatgttcagagggaaaaat

SEQ ID NO: 126854 - DNA, 22 bp, Artificial Sequence
  Synthetic oligonucleotide; TTA chr11 5322415 5322436 5322420 5322415 -
tatatgttcagagggaaaaatt

SEQ ID NO: 126855 - DNA, 22 bp, Artificial Sequence
  Synthetic oligonucleotide; TTC chr11 5322406 5322427 5322411 5322406 -
agagggaaaaattagaaatggt

SEQ ID NO: 126856 - DNA, 22 bp, Artificial Sequence
  Synthetic oligonucleotide; TTA chr11 5322392 5322413 5322397 5322392 -
gaaatggtgattcttttgccat

SEQ ID NO: 126857 - DNA, 22 bp, Artificial Sequence
  Synthetic oligonucleotide; TTC chr11 5322379 5322400 5322384 5322379 -
ttttgccataaatactttctct

SEQ ID NO: 126858 - DNA, 22 bp, Artificial Sequence
  Synthetic oligonucleotide; CTT chr11 5322377 5322398 5322382 5322377 -
ttgccataaatactttctctga

SEQ ID NO: 126859 - DNA, 22 bp, Artificial Sequence
  Synthetic oligonucleotide; TTT chr11 5322376 5322397 5322381 5322376 -
tgccataaatactttctctgac

SEQ ID NO: 126860 - DNA, 22 bp, Artificial Sequence
  Synthetic oligonucleotide; TTT chr11 5322375 5322396 5322380 5322375 -
gccataaatactttctctgaca

SEQ ID NO: 126861 - DNA, 22 bp, Artificial Sequence
  Synthetic oligonucleotide; TTG chr11 5322374 5322395 5322379 5322374 -
ccataaatactttctctgacat

SEQ ID NO: 126862 - DNA, 22 bp, Artificial Sequence
  Synthetic oligonucleotide; CTT chr11 5322362 5322383 5322367 5322362 -
tctctgacatctactgtaaact

SEQ ID NO: 126863 - DNA, 22 bp, Artificial Sequence
  Synthetic oligonucleotide; TTT chr11 5322361 5322382 5322366 5322361 -
ctctgacatctactgtaaactc

SEQ ID NO: 126864 - DNA, 22 bp, Artificial Sequence
  Synthetic oligonucleotide; TTC chr11 5322360 5322381 5322365 5322360 -
tctgacatctactgtaaactct

SEQ ID NO: 126865 - DNA, 22 bp, Artificial Sequence
  Synthetic oligonucleotide; CTC chr11 5322358 5322379 5322363 5322358 -
tgacatctactgtaaactctct

SEQ ID NO: 126866 - DNA, 22 bp, Artificial Sequence
  Synthetic oligonucleotide; CTG chr11 5322356 5322377 5322361 5322356 -
acatctactgtaaactctctat

SEQ ID NO: 126867 - DNA, 22 bp, Artificial Sequence
  Synthetic oligonucleotide; CTA chr11 5322349 5322370 5322354 5322349 -
ctgtaaactctctatattagga

SEQ ID NO: 126868 - DNA, 22 bp, Artificial Sequence
  Synthetic oligonucleotide; CTG chr11 5322346 5322367 5322351 5322346 -
taaactctctatattaggaaga

SEQ ID NO: 126869 - DNA, 22 bp, Artificial Sequence
  Synthetic oligonucleotide; CTC chr11 5322339 5322360 5322344 5322339 -
tctatattaggaagaccaacaa

SEQ ID NO: 126870 - DNA, 22 bp, Artificial Sequence
  Synthetic oligonucleotide; CTC chr11 5322337 5322358 5322342 5322337 -
tatattaggaagaccaacaatg

SEQ ID NO: 126871 - DNA, 22 bp, Artificial Sequence
  Synthetic oligonucleotide; CTA chr11 5322335 5322356 5322340 5322335 -
tattaggaagaccaacaatgtt

SEQ ID NO: 126872 - DNA, 22 bp, Artificial Sequence
  Synthetic oligonucleotide; TTA chr11 5322330 5322351 5322335 5322330 -
ggaagaccaacaatgttgagag

SEQ ID NO: 126873 - DNA, 22 bp, Artificial Sequence
  Synthetic oligonucleotide; TTG chr11 5322312 5322333 5322317 5322312 -
agagaaatggatttcaattcat

SEQ ID NO: 126874 - DNA, 22 bp, Artificial Sequence
  Synthetic oligonucleotide; TTT chr11 5322298 5322319 5322303 5322298 -
caattcatccaatgactaaaaa

SEQ ID NO: 126875 - DNA, 22 bp, Artificial Sequence
  Synthetic oligonucleotide; TTC chr11 5322297 5322318 5322302 5322297 -
aattcatccaatgactaaaaaa

SEQ ID NO: 126876 - DNA, 22 bp, Artificial Sequence
  Synthetic oligonucleotide; TTC chr11 5322292 5322313 5322297 5322292 -
atccaatgactaaaaaattgtg

SEQ ID NO: 126877 - DNA, 22 bp, Artificial Sequence
  Synthetic oligonucleotide; CTA chr11 5322280 5322301 5322285 5322280 -
aaaaattgtggtgggaggagtt

SEQ ID NO: 126878 - DNA, 22 bp, Artificial Sequence
  Synthetic oligonucleotide; TTG chr11 5322272 5322293 5322277 5322272 -
tggtgggaggagtttttgtgtg

SEQ ID NO: 126879 - DNA, 22 bp, Artificial Sequence
  Synthetic oligonucleotide; TTT chr11 5322257 5322278 5322262 5322257 -
ttgtgtgactgtgtactaaaag

SEQ ID NO: 126880 - DNA, 22 bp, Artificial Sequence
  Synthetic oligonucleotide; TTT chr11 5322256 5322277 5322261 5322256 -
tgtgtgactgtgtactaaaagc

SEQ ID NO: 126881 - DNA, 22 bp, Artificial Sequence
  Synthetic oligonucleotide; TTT chr11 5322255 5322276 5322260 5322255 -
gtgtgactgtgtactaaaagct

SEQ ID NO: 126882 - DNA, 22 bp, Artificial Sequence
  Synthetic oligonucleotide; TTG chr11 5322254 5322275 5322259 5322254 -
tgtgactgtgtactaaaagctt

SEQ ID NO: 126883 - DNA, 22 bp, Artificial Sequence
  Synthetic oligonucleotide; CTG chr11 5322246 5322267 5322251 5322246 -
tgtactaaaagcttcttttaga

SEQ ID NO: 126884 - DNA, 22 bp, Artificial Sequence
  Synthetic oligonucleotide; CTA chr11 5322239 5322260 5322244 5322239 -
aaagcttcttttagactgattt

SEQ ID NO: 126885 - DNA, 22 bp, Artificial Sequence
  Synthetic oligonucleotide; CTT chr11 5322232 5322253 5322237 5322232 -
cttttagactgatttaattgtg

SEQ ID NO: 126886 - DNA, 22 bp, Artificial Sequence
  Synthetic oligonucleotide; TTC chr11 5322231 5322252 5322236 5322231 -
ttttagactgatttaattgtga

SEQ ID NO: 126887 - DNA, 22 bp, Artificial Sequence
  Synthetic oligonucleotide; CTT chr11 5322229 5322250 5322234 5322229 -
ttagactgatttaattgtgaaa

SEQ ID NO: 126888 - DNA, 22 bp, Artificial Sequence
  Synthetic oligonucleotide; TTT chr11 5322228 5322249 5322233 5322228 -
tagactgatttaattgtgaaac

SEQ ID NO: 126889 - DNA, 22 bp, Artificial Sequence
  Synthetic oligonucleotide; TTT chr11 5322227 5322248 5322232 5322227 -
agactgatttaattgtgaaaca

SEQ ID NO: 126890 - DNA, 22 bp, Artificial Sequence
  Synthetic oligonucleotide; TTA chr11 5322226 5322247 5322231 5322226 -
gactgatttaattgtgaaacag

SEQ ID NO: 126891 - DNA, 22 bp, Artificial Sequence
  Synthetic oligonucleotide; CTG chr11 5322221 5322242 5322226 5322221 -
atttaattgtgaaacaggattt

SEQ ID NO: 126892 - DNA, 22 bp, Artificial Sequence
  Synthetic oligonucleotide; TTT chr11 5322217 5322238 5322222 5322217 -
aattgtgaaacaggattttcat

SEQ ID NO: 126893 - DNA, 22 bp, Artificial Sequence
  Synthetic oligonucleotide; TTA chr11 5322216 5322237 5322221 5322216 -
attgtgaaacaggattttcatc

SEQ ID NO: 126894 - DNA, 22 bp, Artificial Sequence
  Synthetic oligonucleotide; TTG chr11 5322212 5322233 5322217 5322212 -
tgaaacaggattttcatccaca

SEQ ID NO: 126895 - DNA, 22 bp, Artificial Sequence
  Synthetic oligonucleotide; TTT chr11 5322199 5322220 5322204 5322199 -
tcatccacaaatttcaaaaggg

SEQ ID NO: 126896 - DNA, 22 bp, Artificial Sequence
  Synthetic oligonucleotide; TTT chr11 5322198 5322219 5322203 5322198 -
catccacaaatttcaaaagggg

SEQ ID NO: 126897 - DNA, 22 bp, Artificial Sequence
  Synthetic oligonucleotide; TTC chr11 5322197 5322218 5322202 5322197 -
atccacaaatttcaaaagggga

SEQ ID NO: 126898 - DNA, 22 bp, Artificial Sequence
  Synthetic oligonucleotide; TTT chr11 5322185 5322206 5322190 5322185 -
caaaaggggaaaacctatctca

SEQ ID NO: 126899 - DNA, 22 bp, Artificial Sequence
  Synthetic oligonucleotide; TTC chr11 5322184 5322205 5322189 5322184 -
aaaaggggaaaacctatctcag

SEQ ID NO: 126900 - DNA, 22 bp, Artificial Sequence
  Synthetic oligonucleotide; CTA chr11 5322168 5322189 5322173 5322168 -
tctcagagtataatgttcaagt

SEQ ID NO: 126901 - DNA, 22 bp, Artificial Sequence
  Synthetic oligonucleotide; CTC chr11 5322164 5322185 5322169 5322164 -
agagtataatgttcaagttatt

SEQ ID NO: 126902 - DNA, 22 bp, Artificial Sequence
  Synthetic oligonucleotide; TTC chr11 5322150 5322171 5322155 5322150 -
aagttattgatgctgaatataa

SEQ ID NO: 126903 - DNA, 22 bp, Artificial Sequence
  Synthetic oligonucleotide; TTA chr11 5322144 5322165 5322149 5322144 -
ttgatgctgaatataaactcaa

SEQ ID NO: 126904 - DNA, 22 bp, Artificial Sequence
  Synthetic oligonucleotide; TTG chr11 5322141 5322162 5322146 5322141 -
atgctgaatataaactcaaatc

SEQ ID NO: 126905 - DNA, 22 bp, Artificial Sequence
  Synthetic oligonucleotide; CTG chr11 5322135 5322156 5322140 5322135 -
aatataaactcaaatcctaaaa

SEQ ID NO: 126906 - DNA, 22 bp, Artificial Sequence
  Synthetic oligonucleotide; CTC chr11 5322124 5322145 5322129 5322124 -
aaatcctaaaagtcagttatct

SEQ ID NO: 126907 - DNA, 22 bp, Artificial Sequence
  Synthetic oligonucleotide; CTA chr11 5322116 5322137 5322121 5322116 -
aaagtcagttatctaccaaaga

SEQ ID NO: 126908 - DNA, 22 bp, Artificial Sequence
  Synthetic oligonucleotide; TTA chr11 5322105 5322126 5322110 5322105 -
tctaccaaagactttctctgtt

SEQ ID NO: 126909 - DNA, 22 bp, Artificial Sequence
  Synthetic oligonucleotide; CTA chr11 5322101 5322122 5322106 5322101 -
ccaaagactttctctgttcctt

SEQ ID NO: 126910 - DNA, 22 bp, Artificial Sequence
  Synthetic oligonucleotide; CTT chr11 5322091 5322112 5322096 5322091 -
tctctgttccttatatgtgacc

SEQ ID NO: 126911 - DNA, 22 bp, Artificial Sequence
  Synthetic oligonucleotide; TTT chr11 5322090 5322111 5322095 5322090 -
ctctgttccttatatgtgacca

SEQ ID NO: 126912 - DNA, 22 bp, Artificial Sequence
  Synthetic oligonucleotide; TTC chr11 5322089 5322110 5322094 5322089 -
tctgttccttatatgtgaccat

SEQ ID NO: 126913 - DNA, 22 bp, Artificial Sequence
  Synthetic oligonucleotide; CTC chr11 5322087 5322108 5322092 5322087 -
tgttccttatatgtgaccatga

SEQ ID NO: 126914 - DNA, 22 bp, Artificial Sequence
  Synthetic oligonucleotide; CTG chr11 5322085 5322106 5322090 5322085 -
ttccttatatgtgaccatgagg

SEQ ID NO: 126915 - DNA, 22 bp, Artificial Sequence
  Synthetic oligonucleotide; TTC chr11 5322082 5322103 5322087 5322082 -
cttatatgtgaccatgaggtct

SEQ ID NO: 126916 - DNA, 22 bp, Artificial Sequence
  Synthetic oligonucleotide; CTT chr11 5322079 5322100 5322084 5322079 -
atatgtgaccatgaggtctata

SEQ ID NO: 126917 - DNA, 22 bp, Artificial Sequence
  Synthetic oligonucleotide; TTA chr11 5322078 5322099 5322083 5322078 -
tatgtgaccatgaggtctataa

SEQ ID NO: 126918 - DNA, 22 bp, Artificial Sequence
  Synthetic oligonucleotide; CTA chr11 5322059 5322080 5322064 5322059 -
taatacatctaggcatcttaat

SEQ ID NO: 126919 - DNA, 22 bp, Artificial Sequence
  Synthetic oligonucleotide; CTA chr11 5322048 5322069 5322053 5322048 -
ggcatcttaatggaaaaatctc

SEQ ID NO: 126920 - DNA, 22 bp, Artificial Sequence
  Synthetic oligonucleotide; CTT chr11 5322040 5322061 5322045 5322040 -
aatggaaaaatctcatttcgga

SEQ ID NO: 126921 - DNA, 22 bp, Artificial Sequence
  Synthetic oligonucleotide; TTA chr11 5322039 5322060 5322044 5322039 -
atggaaaaatctcatttcggat

SEQ ID NO: 126922 - DNA, 22 bp, Artificial Sequence
  Synthetic oligonucleotide; CTC chr11 5322026 5322047 5322031 5322026 -
atttcggataattcccatcttg

SEQ ID NO: 126923 - DNA, 22 bp, Artificial Sequence
  Synthetic oligonucleotide; TTT chr11 5322022 5322043 5322027 5322022 -
cggataattcccatcttgattt

SEQ ID NO: 126924 - DNA, 22 bp, Artificial Sequence
  Synthetic oligonucleotide; TTC chr11 5322021 5322042 5322026 5322021 -
ggataattcccatcttgatttg

SEQ ID NO: 126925 - DNA, 22 bp, Artificial Sequence
  Synthetic oligonucleotide; TTC chr11 5322012 5322033 5322017 5322012 -
ccatcttgatttgctatcttga

SEQ ID NO: 126926 - DNA, 22 bp, Artificial Sequence
  Synthetic oligonucleotide; CTT chr11 5322005 5322026 5322010 5322005 -
gatttgctatcttgatgcagaa

SEQ ID NO: 126927 - DNA, 22 bp, Artificial Sequence
  Synthetic oligonucleotide; TTG chr11 5322004 5322025 5322009 5322004 -
atttgctatcttgatgcagaac

SEQ ID NO: 126928 - DNA, 22 bp, Artificial Sequence
  Synthetic oligonucleotide; TTT chr11 5322000 5322021 5322005 5322000 -
gctatcttgatgcagaacctct

SEQ ID NO: 126929 - DNA, 22 bp, Artificial Sequence
  Synthetic oligonucleotide; TTG chr11 5321999 5322020 5322004 5321999 -
ctatcttgatgcagaacctctt

SEQ ID NO: 126930 - DNA, 22 bp, Artificial Sequence
  Synthetic oligonucleotide; CTA chr11 5321996 5322017 5322001 5321996 -
tcttgatgcagaacctcttgta

SEQ ID NO: 126931 - DNA, 22 bp, Artificial Sequence
  Synthetic oligonucleotide; CTT chr11 5321992 5322013 5321997 5321992 -
gatgcagaacctcttgtagctg

SEQ ID NO: 126932 - DNA, 22 bp, Artificial Sequence
  Synthetic oligonucleotide; TTG chr11 5321991 5322012 5321996 5321991 -
atgcagaacctcttgtagctga

SEQ ID NO: 126933 - DNA, 22 bp, Artificial Sequence
  Synthetic oligonucleotide; CTC chr11 5321979 5322000 5321984 5321979 -
ttgtagctgaggaaagcctgcc

SEQ ID NO: 126934 - DNA, 22 bp, Artificial Sequence
  Synthetic oligonucleotide; CTT chr11 5321977 5321998 5321982 5321977 -
gtagctgaggaaagcctgcctt

SEQ ID NO: 126935 - DNA, 22 bp, Artificial Sequence
  Synthetic oligonucleotide; TTG chr11 5321976 5321997 5321981 5321976 -
tagctgaggaaagcctgccttt

SEQ ID NO: 126936 - DNA, 22 bp, Artificial Sequence
  Synthetic oligonucleotide; CTG chr11 5321970 5321991 5321975 5321970 -
aggaaagcctgcctttgtttcc

SEQ ID NO: 126937 - DNA, 22 bp, Artificial Sequence
  Synthetic oligonucleotide; CTG chr11 5321959 5321980 5321964 5321959 -
cctttgtttcccatctttgtag

SEQ ID NO: 126938 - DNA, 22 bp, Artificial Sequence
  Synthetic oligonucleotide; CTT chr11 5321955 5321976 5321960 5321955 -
tgtttcccatctttgtagaaca

SEQ ID NO: 126939 - DNA, 22 bp, Artificial Sequence
  Synthetic oligonucleotide; TTT chr11 5321954 5321975 5321959 5321954 -
gtttcccatctttgtagaacag

SEQ ID NO: 126940 - DNA, 22 bp, Artificial Sequence
  Synthetic oligonucleotide; TTG chr11 5321953 5321974 5321958 5321953 -
tttcccatctttgtagaacaga

SEQ ID NO: 126941 - DNA, 22 bp, Artificial Sequence
  Synthetic oligonucleotide; TTT chr11 5321950 5321971 5321955 5321950 -
cccatctttgtagaacagaagc

SEQ ID NO: 126942 - DNA, 22 bp, Artificial Sequence
  Synthetic oligonucleotide; TTC chr11 5321949 5321970 5321954 5321949 -
ccatctttgtagaacagaagct

SEQ ID NO: 126943 - DNA, 22 bp, Artificial Sequence
  Synthetic oligonucleotide; CTT chr11 5321942 5321963 5321947 5321942 -
tgtagaacagaagctgtgggac

SEQ ID NO: 126944 - DNA, 22 bp, Artificial Sequence
  Synthetic oligonucleotide; TTT chr11 5321941 5321962 5321946 5321941 -
gtagaacagaagctgtgggaca

SEQ ID NO: 126945 - DNA, 22 bp, Artificial Sequence
  Synthetic oligonucleotide; TTG chr11 5321940 5321961 5321945 5321940 -
tagaacagaagctgtgggacat

SEQ ID NO: 126946 - DNA, 22 bp, Artificial Sequence
  Synthetic oligonucleotide; CTG chr11 5321926 5321947 5321931 5321926 -
tgggacatcacaagttgctgtg

SEQ ID NO: 126947 - DNA, 22 bp, Artificial Sequence
  Synthetic oligonucleotide; TTG chr11 5321909 5321930 5321914 5321909 -
ctgtggtaatcacaagttactg

SEQ ID NO: 126948 - DNA, 22 bp, Artificial Sequence
  Synthetic oligonucleotide; CTG chr11 5321906 5321927 5321911 5321906 -
tggtaatcacaagttactgcga

SEQ ID NO: 126949 - DNA, 22 bp, Artificial Sequence
  Synthetic oligonucleotide; TTA chr11 5321890 5321911 5321895 5321890 -
ctgcgatattatatccccatct

SEQ ID NO: 126950 - DNA, 22 bp, Artificial Sequence
  Synthetic oligonucleotide; CTG chr11 5321887 5321908 5321892 5321887 -
cgatattatatccccatctgat

SEQ ID NO: 126951 - DNA, 22 bp, Artificial Sequence
  Synthetic oligonucleotide; TTA chr11 5321879 5321900 5321884 5321879 -
tatccccatctgatatctaaat

SEQ ID NO: 126952 - DNA, 22 bp, Artificial Sequence
  Synthetic oligonucleotide; CTG chr11 5321867 5321888 5321872 5321867 -
atatctaaattttgaggatagg

SEQ ID NO: 126953 - DNA, 22 bp, Artificial Sequence
  Synthetic oligonucleotide; CTA chr11 5321860 5321881 5321865 5321860 -
aattttgaggataggctatctg

SEQ ID NO: 126954 - DNA, 22 bp, Artificial Sequence
  Synthetic oligonucleotide; TTT chr11 5321855 5321876 5321860 5321855 -
tgaggataggctatctgtttta

SEQ ID NO: 126955 - DNA, 22 bp, Artificial Sequence
  Synthetic oligonucleotide; TTT chr11 5321854 5321875 5321859 5321854 -
gaggataggctatctgttttac

SEQ ID NO: 126956 - DNA, 22 bp, Artificial Sequence
  Synthetic oligonucleotide; TTG chr11 5321853 5321874 5321858 5321853 -
aggataggctatctgttttaca

SEQ ID NO: 126957 - DNA, 22 bp, Artificial Sequence
  Synthetic oligonucleotide; CTA chr11 5321842 5321863 5321847 5321842 -
tctgttttacagtgatacattt

SEQ ID NO: 126958 - DNA, 22 bp, Artificial Sequence
  Synthetic oligonucleotide; CTG chr11 5321838 5321859 5321843 5321838 -
ttttacagtgatacatttgatg

SEQ ID NO: 126959 - DNA, 22 bp, Artificial Sequence
  Synthetic oligonucleotide; TTT chr11 5321835 5321856 5321840 5321835 -
tacagtgatacatttgatggaa

SEQ ID NO: 126960 - DNA, 22 bp, Artificial Sequence
  Synthetic oligonucleotide; TTT chr11 5321834 5321855 5321839 5321834 -
acagtgatacatttgatggaag

SEQ ID NO: 126961 - DNA, 22 bp, Artificial Sequence
  Synthetic oligonucleotide; TTA chr11 5321833 5321854 5321838 5321833 -
cagtgatacatttgatggaagg

SEQ ID NO: 126962 - DNA, 22 bp, Artificial Sequence
  Synthetic oligonucleotide; TTT chr11 5321820 5321841 5321825 5321820 -
gatggaaggactcttagtttaa

SEQ ID NO: 126963 - DNA, 22 bp, Artificial Sequence
  Synthetic oligonucleotide; TTG chr11 5321819 5321840 5321824 5321819 -
atggaaggactcttagtttaac

SEQ ID NO: 126964 - DNA, 22 bp, Artificial Sequence
  Synthetic oligonucleotide; CTC chr11 5321807 5321828 5321812 5321807 -
ttagtttaactggccaaggcca

SEQ ID NO: 126965 - DNA, 22 bp, Artificial Sequence
  Synthetic oligonucleotide; CTT chr11 5321805 5321826 5321810 5321805 -
agtttaactggccaaggccagg

SEQ ID NO: 126966 - DNA, 22 bp, Artificial Sequence
  Synthetic oligonucleotide; TTA chr11 5321804 5321825 5321809 5321804 -
gtttaactggccaaggccagga

SEQ ID NO: 126967 - DNA, 22 bp, Artificial Sequence
  Synthetic oligonucleotide; TTT chr11 5321800 5321821 5321805 5321800 -
aactggccaaggccaggacttc

SEQ ID NO: 126968 - DNA, 22 bp, Artificial Sequence
  Synthetic oligonucleotide; TTA chr11 5321799 5321820 5321804 5321799 -
actggccaaggccaggacttca

SEQ ID NO: 126969 - DNA, 22 bp, Artificial Sequence
  Synthetic oligonucleotide; CTG chr11 5321795 5321816 5321800 5321795 -
gccaaggccaggacttcaagcc

SEQ ID NO: 126970 - DNA, 22 bp, Artificial Sequence
  Synthetic oligonucleotide; CTT chr11 5321779 5321800 5321784 5321779 -
caagccatagtttaattacctg

SEQ ID NO: 126971 - DNA, 22 bp, Artificial Sequence
  Synthetic oligonucleotide; TTC chr11 5321778 5321799 5321783 5321778 -
aagccatagtttaattacctgc

SEQ ID NO: 126972 - DNA, 22 bp, Artificial Sequence
  Synthetic oligonucleotide; TTT chr11 5321766 5321787 5321771 5321766 -
aattacctgccacatgtgtgag

SEQ ID NO: 126973 - DNA, 22 bp, Artificial Sequence
  Synthetic oligonucleotide; TTA chr11 5321765 5321786 5321770 5321765 -
attacctgccacatgtgtgaga

SEQ ID NO: 126974 - DNA, 22 bp, Artificial Sequence
  Synthetic oligonucleotide; TTA chr11 5321761 5321782 5321766 5321761 -
cctgccacatgtgtgagaaata

SEQ ID NO: 126975 - DNA, 22 bp, Artificial Sequence
  Synthetic oligonucleotide; CTG chr11 5321757 5321778 5321762 5321757 -
ccacatgtgtgagaaataagga

SEQ ID NO: 126976 - DNA, 22 bp, Artificial Sequence
  Synthetic oligonucleotide; TTT chr11 5321730 5321751 5321735 5321730 -
caaaccatgatggagcagcatc

SEQ ID NO: 126977 - DNA, 22 bp, Artificial Sequence
  Synthetic oligonucleotide; TTC chr11 5321729 5321750 5321734 5321729 -
aaaccatgatggagcagcatca

SEQ ID NO: 126978 - DNA, 22 bp, Artificial Sequence
  Synthetic oligonucleotide; CTG chr11 5321704 5321725 5321709 5321704 -
gcatgccttttgtgtatatggt

SEQ ID NO: 126979 - DNA, 22 bp, Artificial Sequence
  Synthetic oligonucleotide; CTT chr11 5321695 5321716 5321700 5321695 -
ttgtgtatatggtgggttgagg

SEQ ID NO: 126980 - DNA, 22 bp, Artificial Sequence
  Synthetic oligonucleotide; TTT chr11 5321694 5321715 5321699 5321694 -
tgtgtatatggtgggttgagga

SEQ ID NO: 126981 - DNA, 22 bp, Artificial Sequence
  Synthetic oligonucleotide; TTT chr11 5321693 5321714 5321698 5321693 -
gtgtatatggtgggttgaggat

SEQ ID NO: 126982 - DNA, 22 bp, Artificial Sequence
  Synthetic oligonucleotide; TTG chr11 5321692 5321713 5321697 5321692 -
tgtatatggtgggttgaggata

SEQ ID NO: 126983 - DNA, 22 bp, Artificial Sequence
  Synthetic oligonucleotide; TTG chr11 5321676 5321697 5321681 5321676 -
aggatatggcaatattgcagcc

SEQ ID NO: 126984 - DNA, 22 bp, Artificial Sequence
  Synthetic oligonucleotide; TTG chr11 5321659 5321680 5321664 5321659 -
cagcctcactgaataggtataa

SEQ ID NO: 126985 - DNA, 22 bp, Artificial Sequence
  Synthetic oligonucleotide; CTC chr11 5321652 5321673 5321657 5321652 -
actgaataggtataaggaggtg

SEQ ID NO: 126986 - DNA, 22 bp, Artificial Sequence
  Synthetic oligonucleotide; CTG chr11 5321648 5321669 5321653 5321648 -
aataggtataaggaggtgctta

SEQ ID NO: 126987 - DNA, 22 bp, Artificial Sequence
  Synthetic oligonucleotide; CTT chr11 5321627 5321648 5321632 5321627 -
actttggataagcagtgttgtt

SEQ ID NO: 126988 - DNA, 22 bp, Artificial Sequence
  Synthetic oligonucleotide; TTA chr11 5321626 5321647 5321631 5321626 -
ctttggataagcagtgttgttt

SEQ ID NO: 126989 - DNA, 22 bp, Artificial Sequence
  Synthetic oligonucleotide; CTT chr11 5321623 5321644 5321628 5321623 -
tggataagcagtgttgtttcca

SEQ ID NO: 126990 - DNA, 22 bp, Artificial Sequence
  Synthetic oligonucleotide; TTT chr11 5321622 5321643 5321627 5321622 -
ggataagcagtgttgtttccaa

SEQ ID NO: 126991 - DNA, 22 bp, Artificial Sequence
  Synthetic oligonucleotide; TTG chr11 5321621 5321642 5321626 5321621 -
gataagcagtgttgtttccaag

SEQ ID NO: 126992 - DNA, 22 bp, Artificial Sequence
  Synthetic oligonucleotide; TTG chr11 5321607 5321628 5321612 5321607 -
tttccaagatgaaagaagccca

SEQ ID NO: 126993 - DNA, 22 bp, Artificial Sequence
  Synthetic oligonucleotide; TTT chr11 5321604 5321625 5321609 5321604 -
ccaagatgaaagaagcccaaat

SEQ ID NO: 126994 - DNA, 22 bp, Artificial Sequence
  Synthetic oligonucleotide; TTC chr11 5321603 5321624 5321608 5321603 -
caagatgaaagaagcccaaatt

SEQ ID NO: 126995 - DNA, 22 bp, Artificial Sequence
  Synthetic oligonucleotide; TTA chr11 5321580 5321601 5321585 5321580 -
ttgggaaatatgtttattatta

SEQ ID NO: 126996 - DNA, 22 bp, Artificial Sequence
  Synthetic oligonucleotide; TTG chr11 5321577 5321598 5321582 5321577 -
ggaaatatgtttattattaatg

SEQ ID NO: 126997 - DNA, 22 bp, Artificial Sequence
  Synthetic oligonucleotide; TTT chr11 5321565 5321586 5321570 5321565 -
attattaatgacgttgtcctta

SEQ ID NO: 126998 - DNA, 22 bp, Artificial Sequence
  Synthetic oligonucleotide; TTA chr11 5321564 5321585 5321569 5321564 -
ttattaatgacgttgtccttaa

SEQ ID NO: 126999 - DNA, 22 bp, Artificial Sequence
  Synthetic oligonucleotide; TTA chr11 5321561 5321582 5321566 5321561 -
ttaatgacgttgtccttaaact

SEQ ID NO: 127000 - DNA, 22 bp, Artificial Sequence
  Synthetic oligonucleotide; TTA chr11 5321558 5321579 5321563 5321558 -
atgacgttgtccttaaactggt

SEQ ID NO: 127001 - DNA, 22 bp, Artificial Sequence
  Synthetic oligonucleotide; TTG chr11 5321549 5321570 5321554 5321549 -
tccttaaactggtttagacgtt

SEQ ID NO: 127002 - DNA, 22 bp, Artificial Sequence
  Synthetic oligonucleotide; CTT chr11 5321544 5321565 5321549 5321544 -
aaactggtttagacgttgaatt

SEQ ID NO: 127003 - DNA, 22 bp, Artificial Sequence
  Synthetic oligonucleotide; TTA chr11 5321543 5321564 5321548 5321543 -
aactggtttagacgttgaattc

SEQ ID NO: 127004 - DNA, 22 bp, Artificial Sequence
  Synthetic oligonucleotide; CTG chr11 5321538 5321559 5321543 5321538 -
gtttagacgttgaattctctgt

SEQ ID NO: 127005 - DNA, 22 bp, Artificial Sequence
  Synthetic oligonucleotide; TTT chr11 5321534 5321555 5321539 5321534 -
agacgttgaattctctgttctt

SEQ ID NO: 127006 - DNA, 22 bp, Artificial Sequence
  Synthetic oligonucleotide; TTA chr11 5321533 5321554 5321538 5321533 -
gacgttgaattctctgttcttg

SEQ ID NO: 127007 - DNA, 22 bp, Artificial Sequence
  Synthetic oligonucleotide; TTG chr11 5321526 5321547 5321531 5321526 -
aattctctgttcttggtgcctt

SEQ ID NO: 127008 - DNA, 22 bp, Artificial Sequence
  Synthetic oligonucleotide; TTC chr11 5321521 5321542 5321526 5321521 -
tctgttcttggtgccttcatgg

SEQ ID NO: 127009 - DNA, 22 bp, Artificial Sequence
  Synthetic oligonucleotide; CTC chr11 5321519 5321540 5321524 5321519 -
tgttcttggtgccttcatggtt

SEQ ID NO: 127010 - DNA, 22 bp, Artificial Sequence
  Synthetic oligonucleotide; CTG chr11 5321517 5321538 5321522 5321517 -
ttcttggtgccttcatggttgt

SEQ ID NO: 127011 - DNA, 22 bp, Artificial Sequence
  Synthetic oligonucleotide; TTC chr11 5321514 5321535 5321519 5321514 -
ttggtgccttcatggttgttta

SEQ ID NO: 127012 - DNA, 22 bp, Artificial Sequence
  Synthetic oligonucleotide; CTT chr11 5321512 5321533 5321517 5321512 -
ggtgccttcatggttgtttaaa

SEQ ID NO: 127013 - DNA, 22 bp, Artificial Sequence
  Synthetic oligonucleotide; TTG chr11 5321511 5321532 5321516 5321511 -
gtgccttcatggttgtttaaag

SEQ ID NO: 127014 - DNA, 22 bp, Artificial Sequence
  Synthetic oligonucleotide; CTT chr11 5321504 5321525 5321509 5321504 -
catggttgtttaaagaaaatat

SEQ ID NO: 127015 - DNA, 22 bp, Artificial Sequence
  Synthetic oligonucleotide; TTC chr11 5321503 5321524 5321508 5321503 -
atggttgtttaaagaaaatatt

SEQ ID NO: 127016 - DNA, 22 bp, Artificial Sequence
  Synthetic oligonucleotide; TTG chr11 5321496 5321517 5321501 5321496 -
tttaaagaaaatatttttcaaa

SEQ ID NO: 127017 - DNA, 22 bp, Artificial Sequence
  Synthetic oligonucleotide; TTT chr11 5321493 5321514 5321498 5321493 -
aaagaaaatatttttcaaattg

SEQ ID NO: 127018 - DNA, 22 bp, Artificial Sequence
  Synthetic oligonucleotide; TTA chr11 5321492 5321513 5321497 5321492 -
aagaaaatatttttcaaattga

SEQ ID NO: 127019 - DNA, 22 bp, Artificial Sequence
  Synthetic oligonucleotide; TTT chr11 5321480 5321501 5321485 5321480 -
ttcaaattgattctaagagggt

SEQ ID NO: 127020 - DNA, 22 bp, Artificial Sequence
  Synthetic oligonucleotide; TTT chr11 5321479 5321500 5321484 5321479 -
tcaaattgattctaagagggtg

SEQ ID NO: 127021 - DNA, 22 bp, Artificial Sequence
  Synthetic oligonucleotide; TTT chr11 5321478 5321499 5321483 5321478 -
caaattgattctaagagggtga

SEQ ID NO: 127022 - DNA, 22 bp, Artificial Sequence
  Synthetic oligonucleotide; TTC chr11 5321477 5321498 5321482 5321477 -
aaattgattctaagagggtgat

SEQ ID NO: 127023 - DNA, 22 bp, Artificial Sequence
  Synthetic oligonucleotide; TTG chr11 5321471 5321492 5321476 5321471 -
attctaagagggtgatctgaat

SEQ ID NO: 127024 - DNA, 22 bp, Artificial Sequence
  Synthetic oligonucleotide; TTC chr11 5321467 5321488 5321472 5321467 -
taagagggtgatctgaatccac

SEQ ID NO: 127025 - DNA, 22 bp, Artificial Sequence
  Synthetic oligonucleotide; CTA chr11 5321465 5321486 5321470 5321465 -
agagggtgatctgaatccacta

SEQ ID NO: 127026 - DNA, 22 bp, Artificial Sequence
  Synthetic oligonucleotide; CTG chr11 5321452 5321473 5321457 5321452 -
aatccactagcattttatttca

SEQ ID NO: 127027 - DNA, 22 bp, Artificial Sequence
  Synthetic oligonucleotide; CTA chr11 5321443 5321464 5321448 5321443 -
gcattttatttcattgagactt

SEQ ID NO: 127028 - DNA, 22 bp, Artificial Sequence
  Synthetic oligonucleotide; TTT chr11 5321437 5321458 5321442 5321437 -
tatttcattgagacttttcatc

SEQ ID NO: 127029 - DNA, 22 bp, Artificial Sequence
  Synthetic oligonucleotide; TTT chr11 5321436 5321457 5321441 5321436 -
atttcattgagacttttcatct

SEQ ID NO: 127030 - DNA, 22 bp, Artificial Sequence
  Synthetic oligonucleotide; TTA chr11 5321435 5321456 5321440 5321435 -
tttcattgagacttttcatctt

SEQ ID NO: 127031 - DNA, 22 bp, Artificial Sequence
  Synthetic oligonucleotide; TTT chr11 5321432 5321453 5321437 5321432 -
cattgagacttttcatctttta

SEQ ID NO: 127032 - DNA, 22 bp, Artificial Sequence
  Synthetic oligonucleotide; TTC chr11 5321431 5321452 5321436 5321431 -
attgagacttttcatcttttac

SEQ ID NO: 127033 - DNA, 22 bp, Artificial Sequence
  Synthetic oligonucleotide; TTG chr11 5321427 5321448 5321432 5321427 -
agacttttcatcttttacatag

SEQ ID NO: 127034 - DNA, 22 bp, Artificial Sequence
  Synthetic oligonucleotide; CTT chr11 5321421 5321442 5321426 5321421 -
ttcatcttttacatagaaggaa

SEQ ID NO: 127035 - DNA, 22 bp, Artificial Sequence
  Synthetic oligonucleotide; TTT chr11 5321420 5321441 5321425 5321420 -
tcatcttttacatagaaggaaa

SEQ ID NO: 127036 - DNA, 22 bp, Artificial Sequence
  Synthetic oligonucleotide; TTT chr11 5321419 5321440 5321424 5321419 -
catcttttacatagaaggaaac

SEQ ID NO: 127037 - DNA, 22 bp, Artificial Sequence
  Synthetic oligonucleotide; TTC chr11 5321418 5321439 5321423 5321418 -
atcttttacatagaaggaaact

SEQ ID NO: 127038 - DNA, 22 bp, Artificial Sequence
  Synthetic oligonucleotide; CTT chr11 5321413 5321434 5321418 5321413 -
ttacatagaaggaaactaagtt

SEQ ID NO: 127039 - DNA, 22 bp, Artificial Sequence
  Synthetic oligonucleotide; TTT chr11 5321412 5321433 5321417 5321412 -
tacatagaaggaaactaagtta

SEQ ID NO: 127040 - DNA, 22 bp, Artificial Sequence
  Synthetic oligonucleotide; TTT chr11 5321411 5321432 5321416 5321411 -
acatagaaggaaactaagttat

SEQ ID NO: 127041 - DNA, 22 bp, Artificial Sequence
  Synthetic oligonucleotide; TTA chr11 5321410 5321431 5321415 5321410 -
catagaaggaaactaagttatt

SEQ ID NO: 127042 - DNA, 22 bp, Artificial Sequence
  Synthetic oligonucleotide; CTA chr11 5321395 5321416 5321400 5321395 -
agttattagtgctctgaaatat

SEQ ID NO: 127043 - DNA, 22 bp, Artificial Sequence
  Synthetic oligonucleotide; TTA chr11 5321390 5321411 5321395 5321390 -
ttagtgctctgaaatatcaact

SEQ ID NO: 127044 - DNA, 22 bp, Artificial Sequence
  Synthetic oligonucleotide; TTA chr11 5321387 5321408 5321392 5321387 -
gtgctctgaaatatcaactttc

SEQ ID NO: 127045 - DNA, 22 bp, Artificial Sequence
  Synthetic oligonucleotide; CTC chr11 5321381 5321402 5321386 5321381 -
tgaaatatcaactttcatgata

SEQ ID NO: 127046 - DNA, 22 bp, Artificial Sequence
  Synthetic oligonucleotide; CTG chr11 5321379 5321400 5321384 5321379 -
aaatatcaactttcatgataaa

SEQ ID NO: 127047 - DNA, 22 bp, Artificial Sequence
  Synthetic oligonucleotide; CTT chr11 5321367 5321388 5321372 5321367 -
tcatgataaaagatacacagtc

SEQ ID NO: 127048 - DNA, 22 bp, Artificial Sequence
  Synthetic oligonucleotide; TTT chr11 5321366 5321387 5321371 5321366 -
catgataaaagatacacagtcc

SEQ ID NO: 127049 - DNA, 22 bp, Artificial Sequence
  Synthetic oligonucleotide; TTC chr11 5321365 5321386 5321370 5321365 -
atgataaaagatacacagtccc

SEQ ID NO: 127050 - DNA, 22 bp, Artificial Sequence
  Synthetic oligonucleotide; CTT chr11 5321341 5321362 5321346 5321341 -
ctgagggcacaagccaatactt

SEQ ID NO: 127051 - DNA, 22 bp, Artificial Sequence
  Synthetic oligonucleotide; TTC chr11 5321340 5321361 5321345 5321340 -
tgagggcacaagccaatacttc

SEQ ID NO: 127052 - DNA, 22 bp, Artificial Sequence
  Synthetic oligonucleotide; CTG chr11 5321338 5321359 5321343 5321338 -
agggcacaagccaatacttcat

SEQ ID NO: 127053 - DNA, 22 bp, Artificial Sequence
  Synthetic oligonucleotide; CTT chr11 5321319 5321340 5321324 5321319 -
cattaaaccaaaccagctatca

SEQ ID NO: 127054 - DNA, 22 bp, Artificial Sequence
  Synthetic oligonucleotide; TTC chr11 5321318 5321339 5321323 5321318 -
attaaaccaaaccagctatcac

SEQ ID NO: 127055 - DNA, 22 bp, Artificial Sequence
  Synthetic oligonucleotide; TTA chr11 5321314 5321335 5321319 5321314 -
aaccaaaccagctatcactctt

SEQ ID NO: 127056 - DNA, 22 bp, Artificial Sequence
  Synthetic oligonucleotide; CTA chr11 5321300 5321321 5321305 5321300 -
tcactcttctgtcatattttta

SEQ ID NO: 127057 - DNA, 22 bp, Artificial Sequence
  Synthetic oligonucleotide; CTC chr11 5321294 5321315 5321299 5321294 -
ttctgtcatatttttaataagg

SEQ ID NO: 127058 - DNA, 22 bp, Artificial Sequence
  Synthetic oligonucleotide; CTT chr11 5321292 5321313 5321297 5321292 -
ctgtcatatttttaataaggag

SEQ ID NO: 127059 - DNA, 22 bp, Artificial Sequence
  Synthetic oligonucleotide; TTC chr11 5321291 5321312 5321296 5321291 -
tgtcatatttttaataaggagg

SEQ ID NO: 127060 - DNA, 22 bp, Artificial Sequence
  Synthetic oligonucleotide; CTG chr11 5321289 5321310 5321294 5321289 -
tcatatttttaataaggaggac

SEQ ID NO: 127061 - DNA, 22 bp, Artificial Sequence
  Synthetic oligonucleotide; TTT chr11 5321281 5321302 5321286 5321281 -
ttaataaggaggacagcttcct

SEQ ID NO: 127062 - DNA, 22 bp, Artificial Sequence
  Synthetic oligonucleotide; TTT chr11 5321280 5321301 5321285 5321280 -
taataaggaggacagcttcctt

SEQ ID NO: 127063 - DNA, 22 bp, Artificial Sequence
  Synthetic oligonucleotide; TTT chr11 5321279 5321300 5321284 5321279 -
aataaggaggacagcttccttt

SEQ ID NO: 127064 - DNA, 22 bp, Artificial Sequence
  Synthetic oligonucleotide; TTA chr11 5321278 5321299 5321283 5321278 -
ataaggaggacagcttccttta

SEQ ID NO: 127065 - DNA, 22 bp, Artificial Sequence
  Synthetic oligonucleotide; CTT chr11 5321262 5321283 5321267 5321262 -
cctttaaattctctaaaaacaa

SEQ ID NO: 127066 - DNA, 22 bp, Artificial Sequence
  Synthetic oligonucleotide; TTC chr11 5321261 5321282 5321266 5321261 -
ctttaaattctctaaaaacaaa

SEQ ID NO: 127067 - DNA, 22 bp, Artificial Sequence
  Synthetic oligonucleotide; CTT chr11 5321258 5321279 5321263 5321258 -
taaattctctaaaaacaaaata

SEQ ID NO: 127068 - DNA, 22 bp, Artificial Sequence
  Synthetic oligonucleotide; TTT chr11 5321257 5321278 5321262 5321257 -
aaattctctaaaaacaaaataa

SEQ ID NO: 127069 - DNA, 22 bp, Artificial Sequence
  Synthetic oligonucleotide; TTA chr11 5321256 5321277 5321261 5321256 -
aattctctaaaaacaaaataat

SEQ ID NO: 127070 - DNA, 22 bp, Artificial Sequence
  Synthetic oligonucleotide; TTC chr11 5321251 5321272 5321256 5321251 -
tctaaaaacaaaataatatcct

SEQ ID NO: 127071 - DNA, 22 bp, Artificial Sequence
  Synthetic oligonucleotide; CTC chr11 5321249 5321270 5321254 5321249 -
taaaaacaaaataatatcctta

SEQ ID NO: 127072 - DNA, 22 bp, Artificial Sequence
  Synthetic oligonucleotide; CTA chr11 5321247 5321268 5321252 5321247 -
aaaacaaaataatatccttatt

SEQ ID NO: 127073 - DNA, 22 bp, Artificial Sequence
  Synthetic oligonucleotide; CTT chr11 5321228 5321249 5321233 5321228 -
attcagccttcccactttacca

SEQ ID NO: 127074 - DNA, 22 bp, Artificial Sequence
  Synthetic oligonucleotide; TTA chr11 5321227 5321248 5321232 5321227 -
ttcagccttcccactttaccac

SEQ ID NO: 127075 - DNA, 22 bp, Artificial Sequence
  Synthetic oligonucleotide; TTC chr11 5321224 5321245 5321229 5321224 -
agccttcccactttaccacatg

SEQ ID NO: 127076 - DNA, 22 bp, Artificial Sequence
  Synthetic oligonucleotide; CTT chr11 5321218 5321239 5321223 5321218 -
cccactttaccacatgacctga

SEQ ID NO: 127077 - DNA, 22 bp, Artificial Sequence
  Synthetic oligonucleotide; TTC chr11 5321217 5321238 5321222 5321217 -
ccactttaccacatgacctgat

SEQ ID NO: 127078 - DNA, 22 bp, Artificial Sequence
  Synthetic oligonucleotide; CTT chr11 5321211 5321232 5321216 5321211 -
taccacatgacctgattaacct

SEQ ID NO: 127079 - DNA, 22 bp, Artificial Sequence
  Synthetic oligonucleotide; TTT chr11 5321210 5321231 5321215 5321210 -
accacatgacctgattaaccta

SEQ ID NO: 127080 - DNA, 22 bp, Artificial Sequence
  Synthetic oligonucleotide; TTA chr11 5321209 5321230 5321214 5321209 -
ccacatgacctgattaacctat

SEQ ID NO: 127081 - DNA, 22 bp, Artificial Sequence
  Synthetic oligonucleotide; CTG chr11 5321197 5321218 5321202 5321197 -
attaacctattaatgacactgt

SEQ ID NO: 127082 - DNA, 22 bp, Artificial Sequence
  Synthetic oligonucleotide; TTA chr11 5321193 5321214 5321198 5321193 -
acctattaatgacactgtacta

SEQ ID NO: 127083 - DNA, 22 bp, Artificial Sequence
  Synthetic oligonucleotide; CTA chr11 5321188 5321209 5321193 5321188 -
ttaatgacactgtactatgtca

SEQ ID NO: 127084 - DNA, 22 bp, Artificial Sequence
  Synthetic oligonucleotide; TTA chr11 5321185 5321206 5321190 5321185 -
atgacactgtactatgtcaatt

SEQ ID NO: 127085 - DNA, 22 bp, Artificial Sequence
  Synthetic oligonucleotide; CTG chr11 5321176 5321197 5321181 5321176 -
tactatgtcaattatgatatcc

SEQ ID NO: 127086 - DNA, 22 bp, Artificial Sequence
  Synthetic oligonucleotide; CTA chr11 5321171 5321192 5321176 5321171 -
tgtcaattatgatatcctgtct

SEQ ID NO: 127087 - DNA, 22 bp, Artificial Sequence
  Synthetic oligonucleotide; TTA chr11 5321162 5321183 5321167 5321162 -
tgatatcctgtctttacctata

SEQ ID NO: 127088 - DNA, 22 bp, Artificial Sequence
  Synthetic oligonucleotide; CTG chr11 5321152 5321173 5321157 5321152 -
tctttacctatatgttaatgaa

SEQ ID NO: 127089 - DNA, 22 bp, Artificial Sequence
  Synthetic oligonucleotide; CTT chr11 5321148 5321169 5321153 5321148 -
tacctatatgttaatgaaactg

SEQ ID NO: 127090 - DNA, 22 bp, Artificial Sequence
  Synthetic oligonucleotide; TTT chr11 5321147 5321168 5321152 5321147 -
acctatatgttaatgaaactgt

SEQ ID NO: 127091 - DNA, 22 bp, Artificial Sequence
  Synthetic oligonucleotide; TTA chr11 5321146 5321167 5321151 5321146 -
cctatatgttaatgaaactgtt

SEQ ID NO: 127092 - DNA, 22 bp, Artificial Sequence
  Synthetic oligonucleotide; CTA chr11 5321142 5321163 5321147 5321142 -
tatgttaatgaaactgttagaa

SEQ ID NO: 127093 - DNA, 22 bp, Artificial Sequence
  Synthetic oligonucleotide; TTA chr11 5321135 5321156 5321140 5321135 -
atgaaactgttagaaaagaaaa

SEQ ID NO: 127094 - DNA, 22 bp, Artificial Sequence
  Synthetic oligonucleotide; CTG chr11 5321126 5321147 5321131 5321126 -
ttagaaaagaaaatgatatgag

SEQ ID NO: 127095 - DNA, 22 bp, Artificial Sequence
  Synthetic oligonucleotide; TTA chr11 5321123 5321144 5321128 5321123 -
gaaaagaaaatgatatgagtaa

SEQ ID NO: 127096 - DNA, 22 bp, Artificial Sequence
  Synthetic oligonucleotide; TTT chr11 5321098 5321119 5321103 5321098 -
tctccagggtatcctttgtgca

SEQ ID NO: 127097 - DNA, 22 bp, Artificial Sequence
  Synthetic oligonucleotide; TTT chr11 5321097 5321118 5321102 5321097 -
ctccagggtatcctttgtgcaa

SEQ ID NO: 127098 - DNA, 22 bp, Artificial Sequence
  Synthetic oligonucleotide; TTC chr11 5321096 5321117 5321101 5321096 -
tccagggtatcctttgtgcaaa

SEQ ID NO: 127099 - DNA, 22 bp, Artificial Sequence
  Synthetic oligonucleotide; CTC chr11 5321094 5321115 5321099 5321094 -
cagggtatcctttgtgcaaagc

SEQ ID NO: 127100 - DNA, 22 bp, Artificial Sequence
  Synthetic oligonucleotide; CTT chr11 5321082 5321103 5321087 5321082 -
tgtgcaaagcacttcattgaaa

SEQ ID NO: 127101 - DNA, 22 bp, Artificial Sequence
  Synthetic oligonucleotide; TTT chr11 5321081 5321102 5321086 5321081 -
gtgcaaagcacttcattgaaac

SEQ ID NO: 127102 - DNA, 22 bp, Artificial Sequence
  Synthetic oligonucleotide; TTG chr11 5321080 5321101 5321085 5321080 -
tgcaaagcacttcattgaaact

SEQ ID NO: 127103 - DNA, 22 bp, Artificial Sequence
  Synthetic oligonucleotide; CTT chr11 5321068 5321089 5321073 5321068 -
cattgaaactgattctcttcat

SEQ ID NO: 127104 - DNA, 22 bp, Artificial Sequence
  Synthetic oligonucleotide; TTC chr11 5321067 5321088 5321072 5321067 -
attgaaactgattctcttcatc

SEQ ID NO: 127105 - DNA, 22 bp, Artificial Sequence
  Synthetic oligonucleotide; TTG chr11 5321063 5321084 5321068 5321063 -
aaactgattctcttcatctttt

SEQ ID NO: 127106 - DNA, 22 bp, Artificial Sequence
  Synthetic oligonucleotide; CTG chr11 5321057 5321078 5321062 5321057 -
attctcttcatcttttctacaa

SEQ ID NO: 127107 - DNA, 22 bp, Artificial Sequence
  Synthetic oligonucleotide; TTC chr11 5321053 5321074 5321058 5321053 -
tcttcatcttttctacaaagtc

SEQ ID NO: 127108 - DNA, 22 bp, Artificial Sequence
  Synthetic oligonucleotide; CTC chr11 5321051 5321072 5321056 5321051 -
ttcatcttttctacaaagtcag

SEQ ID NO: 127109 - DNA, 22 bp, Artificial Sequence
  Synthetic oligonucleotide; CTT chr11 5321049 5321070 5321054 5321049 -
catcttttctacaaagtcagca

SEQ ID NO: 127110 - DNA, 22 bp, Artificial Sequence
  Synthetic oligonucleotide; TTC chr11 5321048 5321069 5321053 5321048 -
atcttttctacaaagtcagcat

SEQ ID NO: 127111 - DNA, 22 bp, Artificial Sequence
  Synthetic oligonucleotide; CTT chr11 5321043 5321064 5321048 5321043 -
ttctacaaagtcagcatgtaaa

SEQ ID NO: 127112 - DNA, 22 bp, Artificial Sequence
  Synthetic oligonucleotide; TTT chr11 5321042 5321063 5321047 5321042 -
tctacaaagtcagcatgtaaaa

SEQ ID NO: 127113 - DNA, 22 bp, Artificial Sequence
  Synthetic oligonucleotide; TTT chr11 5321041 5321062 5321046 5321041 -
ctacaaagtcagcatgtaaaac

SEQ ID NO: 127114 - DNA, 22 bp, Artificial Sequence
  Synthetic oligonucleotide; TTC chr11 5321040 5321061 5321045 5321040 -
tacaaagtcagcatgtaaaaca

SEQ ID NO: 127115 - DNA, 22 bp, Artificial Sequence
  Synthetic oligonucleotide; CTA chr11 5321038 5321059 5321043 5321038 -
caaagtcagcatgtaaaacact

SEQ ID NO: 127116 - DNA, 22 bp, Artificial Sequence
  Synthetic oligonucleotide; CTC chr11 5321015 5321036 5321020 5321015 -
attaatgtacaatgaccaatca

SEQ ID NO: 127117 - DNA, 22 bp, Artificial Sequence
  Synthetic oligonucleotide; TTA chr11 5321011 5321032 5321016 5321011 -
atgtacaatgaccaatcaataa

SEQ ID NO: 127118 - DNA, 22 bp, Artificial Sequence
  Synthetic oligonucleotide; CTG chr11 5320982 5321003 5320987 5320982 -
ttgattagtgaataaagtcatt

SEQ ID NO: 127119 - DNA, 22 bp, Artificial Sequence
  Synthetic oligonucleotide; TTG chr11 5320979 5321000 5320984 5320979 -
attagtgaataaagtcattatc

SEQ ID NO: 127120 - DNA, 22 bp, Artificial Sequence
  Synthetic oligonucleotide; TTA chr11 5320975 5320996 5320980 5320975 -
gtgaataaagtcattatcttct

SEQ ID NO: 127121 - DNA, 22 bp, Artificial Sequence
  Synthetic oligonucleotide; TTA chr11 5320959 5320980 5320964 5320959 -
tcttcttgtgataactatggaa

SEQ ID NO: 127122 - DNA, 22 bp, Artificial Sequence
  Synthetic oligonucleotide; CTT chr11 5320955 5320976 5320960 5320955 -
cttgtgataactatggaagtca

SEQ ID NO: 127123 - DNA, 22 bp, Artificial Sequence
  Synthetic oligonucleotide; TTC chr11 5320954 5320975 5320959 5320954 -
ttgtgataactatggaagtcaa

SEQ ID NO: 127124 - DNA, 22 bp, Artificial Sequence
  Synthetic oligonucleotide; CTT chr11 5320952 5320973 5320957 5320952 -
gtgataactatggaagtcaatg

SEQ ID NO: 127125 - DNA, 22 bp, Artificial Sequence
  Synthetic oligonucleotide; TTG chr11 5320951 5320972 5320956 5320951 -
tgataactatggaagtcaatgg

SEQ ID NO: 127126 - DNA, 22 bp, Artificial Sequence
  Synthetic oligonucleotide; CTA chr11 5320942 5320963 5320947 5320942 -
tggaagtcaatggaactactct

SEQ ID NO: 127127 - DNA, 22 bp, Artificial Sequence
  Synthetic oligonucleotide; CTA chr11 5320924 5320945 5320929 5320924 -
ctctccattcagcaaaactcag

SEQ ID NO: 127128 - DNA, 22 bp, Artificial Sequence
  Synthetic oligonucleotide; CTC chr11 5320921 5320942 5320926 5320921 -
tccattcagcaaaactcagaaa

SEQ ID NO: 127129 - DNA, 22 bp, Artificial Sequence
  Synthetic oligonucleotide; CTC chr11 5320919 5320940 5320924 5320919 -
cattcagcaaaactcagaaatt

SEQ ID NO: 127130 - DNA, 22 bp, Artificial Sequence
  Synthetic oligonucleotide; TTC chr11 5320914 5320935 5320919 5320914 -
agcaaaactcagaaattcaggt

SEQ ID NO: 127131 - DNA, 22 bp, Artificial Sequence
  Synthetic oligonucleotide; CTC chr11 5320904 5320925 5320909 5320904 -
agaaattcaggtggcattactt

SEQ ID NO: 127132 - DNA, 22 bp, Artificial Sequence
  Synthetic oligonucleotide; TTC chr11 5320896 5320917 5320901 5320896 -
aggtggcattacttacgcttct

SEQ ID NO: 127133 - DNA, 22 bp, Artificial Sequence
  Synthetic oligonucleotide; TTA chr11 5320885 5320906 5320890 5320885 -
cttacgcttctttctctttaat

SEQ ID NO: 127134 - DNA, 22 bp, Artificial Sequence
  Synthetic oligonucleotide; CTT chr11 5320882 5320903 5320887 5320882 -
acgcttctttctctttaatcta

SEQ ID NO: 127135 - DNA, 22 bp, Artificial Sequence
  Synthetic oligonucleotide; TTA chr11 5320881 5320902 5320886 5320881 -
cgcttctttctctttaatctac

SEQ ID NO: 127136 - DNA, 22 bp, Artificial Sequence
  Synthetic oligonucleotide; CTT chr11 5320876 5320897 5320881 5320876 -
ctttctctttaatctactacct

SEQ ID NO: 127137 - DNA, 22 bp, Artificial Sequence
  Synthetic oligonucleotide; TTC chr11 5320875 5320896 5320880 5320875 -
tttctctttaatctactacctt

SEQ ID NO: 127138 - DNA, 22 bp, Artificial Sequence
  Synthetic oligonucleotide; CTT chr11 5320873 5320894 5320878 5320873 -
tctctttaatctactaccttca

SEQ ID NO: 127139 - DNA, 22 bp, Artificial Sequence
  Synthetic oligonucleotide; TTT chr11 5320872 5320893 5320877 5320872 -
ctctttaatctactaccttcaa

SEQ ID NO: 127140 - DNA, 22 bp, Artificial Sequence
  Synthetic oligonucleotide; TTC chr11 5320871 5320892 5320876 5320871 -
tctttaatctactaccttcaat

SEQ ID NO: 127141 - DNA, 22 bp, Artificial Sequence
  Synthetic oligonucleotide; CTC chr11 5320869 5320890 5320874 5320869 -
tttaatctactaccttcaatca

SEQ ID NO: 127142 - DNA, 22 bp, Artificial Sequence
  Synthetic oligonucleotide; CTT chr11 5320867 5320888 5320872 5320867 -
taatctactaccttcaatcact

SEQ ID NO: 127143 - DNA, 22 bp, Artificial Sequence
  Synthetic oligonucleotide; TTT chr11 5320866 5320887 5320871 5320866 -
aatctactaccttcaatcactc

SEQ ID NO: 127144 - DNA, 22 bp, Artificial Sequence
  Synthetic oligonucleotide; TTA chr11 5320865 5320886 5320870 5320865 -
atctactaccttcaatcactca

SEQ ID NO: 127145 - DNA, 22 bp, Artificial Sequence
  Synthetic oligonucleotide; CTA chr11 5320860 5320881 5320865 5320860 -
ctaccttcaatcactcagttct

SEQ ID NO: 127146 - DNA, 22 bp, Artificial Sequence
  Synthetic oligonucleotide; CTA chr11 5320857 5320878 5320862 5320857 -
ccttcaatcactcagttctatt

SEQ ID NO: 127147 - DNA, 22 bp, Artificial Sequence
  Synthetic oligonucleotide; CTT chr11 5320853 5320874 5320858 5320853 -
caatcactcagttctattctaa

SEQ ID NO: 127148 - DNA, 22 bp, Artificial Sequence
  Synthetic oligonucleotide; TTC chr11 5320852 5320873 5320857 5320852 -
aatcactcagttctattctaag

SEQ ID NO: 127149 - DNA, 22 bp, Artificial Sequence
  Synthetic oligonucleotide; CTC chr11 5320844 5320865 5320849 5320844 -
agttctattctaagtcatagaa

SEQ ID NO: 127150 - DNA, 22 bp, Artificial Sequence
  Synthetic oligonucleotide; TTC chr11 5320839 5320860 5320844 5320839 -
tattctaagtcatagaatctct

SEQ ID NO: 127151 - DNA, 22 bp, Artificial Sequence
  Synthetic oligonucleotide; CTA chr11 5320837 5320858 5320842 5320837 -
ttctaagtcatagaatctctct

SEQ ID NO: 127152 - DNA, 22 bp, Artificial Sequence
  Synthetic oligonucleotide; TTC chr11 5320834 5320855 5320839 5320834 -
taagtcatagaatctctcttct

SEQ ID NO: 127153 - DNA, 22 bp, Artificial Sequence
  Synthetic oligonucleotide; CTA chr11 5320832 5320853 5320837 5320832 -
agtcatagaatctctcttctat

SEQ ID NO: 127154 - DNA, 22 bp, Artificial Sequence
  Synthetic oligonucleotide; CTC chr11 5320818 5320839 5320823 5320818 -
tcttctattcaagcctttctaa

SEQ ID NO: 127155 - DNA, 22 bp, Artificial Sequence
  Synthetic oligonucleotide; CTC chr11 5320816 5320837 5320821 5320816 -
ttctattcaagcctttctaatg

SEQ ID NO: 127156 - DNA, 22 bp, Artificial Sequence
  Synthetic oligonucleotide; CTT chr11 5320814 5320835 5320819 5320814 -
ctattcaagcctttctaatgct

SEQ ID NO: 127157 - DNA, 22 bp, Artificial Sequence
  Synthetic oligonucleotide; TTC chr11 5320813 5320834 5320818 5320813 -
tattcaagcctttctaatgcta

SEQ ID NO: 127158 - DNA, 22 bp, Artificial Sequence
  Synthetic oligonucleotide; CTA chr11 5320811 5320832 5320816 5320811 -
ttcaagcctttctaatgctact

SEQ ID NO: 127159 - DNA, 22 bp, Artificial Sequence
  Synthetic oligonucleotide; TTC chr11 5320808 5320829 5320813 5320808 -
aagcctttctaatgctactgat

SEQ ID NO: 127160 - DNA, 22 bp, Artificial Sequence
  Synthetic oligonucleotide; CTT chr11 5320801 5320822 5320806 5320801 -
tctaatgctactgataacaact

SEQ ID NO: 127161 - DNA, 22 bp, Artificial Sequence
  Synthetic oligonucleotide; TTT chr11 5320800 5320821 5320805 5320800 -
ctaatgctactgataacaacta

SEQ ID NO: 127162 - DNA, 22 bp, Artificial Sequence
  Synthetic oligonucleotide; TTC chr11 5320799 5320820 5320804 5320799 -
taatgctactgataacaactag

SEQ ID NO: 127163 - DNA, 22 bp, Artificial Sequence
  Synthetic oligonucleotide; CTA chr11 5320797 5320818 5320802 5320797 -
atgctactgataacaactagtc

SEQ ID NO: 127164 - DNA, 22 bp, Artificial Sequence
  Synthetic oligonucleotide; CTA chr11 5320791 5320812 5320796 5320791 -
ctgataacaactagtcaaaacc

SEQ ID NO: 127165 - DNA, 22 bp, Artificial Sequence
  Synthetic oligonucleotide; CTG chr11 5320788 5320809 5320793 5320788 -
ataacaactagtcaaaaccaca

SEQ ID NO: 127166 - DNA, 22 bp, Artificial Sequence
  Synthetic oligonucleotide; CTA chr11 5320778 5320799 5320783 5320778 -
gtcaaaaccacaccaacacaat

SEQ ID NO: 127167 - DNA, 22 bp, Artificial Sequence
  Synthetic oligonucleotide; TTT chr11 5320754 5320775 5320759 5320754 -
gacacgtgtattgtcatatcct

SEQ ID NO: 127168 - DNA, 22 bp, Artificial Sequence
  Synthetic oligonucleotide; TTG chr11 5320753 5320774 5320758 5320753 -
acacgtgtattgtcatatcctg

SEQ ID NO: 127169 - DNA, 22 bp, Artificial Sequence
  Synthetic oligonucleotide; TTG chr11 5320741 5320762 5320746 5320741 -
tcatatcctgatacttctttta

SEQ ID NO: 127170 - DNA, 22 bp, Artificial Sequence
  Synthetic oligonucleotide; CTG chr11 5320731 5320752 5320736 5320731 -
atacttcttttacctgttctcc

SEQ ID NO: 127171 - DNA, 22 bp, Artificial Sequence
  Synthetic oligonucleotide; CTT chr11 5320725 5320746 5320730 5320725 -
cttttacctgttctcccccttt

SEQ ID NO: 127172 - DNA, 22 bp, Artificial Sequence
  Synthetic oligonucleotide; TTC chr11 5320724 5320745 5320729 5320724 -
ttttacctgttctccccctttt

SEQ ID NO: 127173 - DNA, 22 bp, Artificial Sequence
  Synthetic oligonucleotide; CTT chr11 5320722 5320743 5320727 5320722 -
ttacctgttctcccccttttcc

SEQ ID NO: 127174 - DNA, 22 bp, Artificial Sequence
  Synthetic oligonucleotide; TTT chr11 5320721 5320742 5320726 5320721 -
tacctgttctcccccttttcca

SEQ ID NO: 127175 - DNA, 22 bp, Artificial Sequence
  Synthetic oligonucleotide; TTT chr11 5320720 5320741 5320725 5320720 -
acctgttctcccccttttccaa

SEQ ID NO: 127176 - DNA, 22 bp, Artificial Sequence
  Synthetic oligonucleotide; TTA chr11 5320719 5320740 5320724 5320719 -
cctgttctcccccttttccaac

SEQ ID NO: 127177 - DNA, 22 bp, Artificial Sequence
  Synthetic oligonucleotide; CTG chr11 5320715 5320736 5320720 5320715 -
ttctcccccttttccaacatgt

SEQ ID NO: 127178 - DNA, 22 bp, Artificial Sequence
  Synthetic oligonucleotide; TTC chr11 5320712 5320733 5320717 5320712 -
tcccccttttccaacatgtttc

SEQ ID NO: 127179 - DNA, 22 bp, Artificial Sequence
  Synthetic oligonucleotide; CTC chr11 5320710 5320731 5320715 5320710 -
ccccttttccaacatgtttctc

SEQ ID NO: 127180 - DNA, 22 bp, Artificial Sequence
  Synthetic oligonucleotide; CTT chr11 5320704 5320725 5320709 5320704 -
ttccaacatgtttctcatactg

SEQ ID NO: 127181 - DNA, 22 bp, Artificial Sequence
  Synthetic oligonucleotide; TTT chr11 5320703 5320724 5320708 5320703 -
tccaacatgtttctcatactgt

SEQ ID NO: 127182 - DNA, 22 bp, Artificial Sequence
  Synthetic oligonucleotide; TTT chr11 5320702 5320723 5320707 5320702 -
ccaacatgtttctcatactgta

SEQ ID NO: 127183 - DNA, 22 bp, Artificial Sequence
  Synthetic oligonucleotide; TTC chr11 5320701 5320722 5320706 5320701 -
caacatgtttctcatactgtag

SEQ ID NO: 127184 - DNA, 22 bp, Artificial Sequence
  Synthetic oligonucleotide; TTT chr11 5320691 5320712 5320696 5320691 -
ctcatactgtagccatagtaac

SEQ ID NO: 127185 - DNA, 22 bp, Artificial Sequence
  Synthetic oligonucleotide; TTC chr11 5320690 5320711 5320695 5320690 -
tcatactgtagccatagtaact

SEQ ID NO: 127186 - DNA, 22 bp, Artificial Sequence
  Synthetic oligonucleotide; CTC chr11 5320688 5320709 5320693 5320688 -
atactgtagccatagtaacttt

SEQ ID NO: 127187 - DNA, 22 bp, Artificial Sequence
  Synthetic oligonucleotide; CTG chr11 5320682 5320703 5320687 5320682 -
tagccatagtaactttaaacaa

SEQ ID NO: 127188 - DNA, 22 bp, Artificial Sequence
  Synthetic oligonucleotide; CTT chr11 5320667 5320688 5320672 5320667 -
taaacaataactacttgattat

SEQ ID NO: 127189 - DNA, 22 bp, Artificial Sequence
  Synthetic oligonucleotide; TTT chr11 5320666 5320687 5320671 5320666 -
aaacaataactacttgattata

SEQ ID NO: 127190 - DNA, 22 bp, Artificial Sequence
  Synthetic oligonucleotide; TTA chr11 5320665 5320686 5320670 5320665 -
aacaataactacttgattataa

SEQ ID NO: 127191 - DNA, 22 bp, Artificial Sequence
  Synthetic oligonucleotide; CTA chr11 5320654 5320675 5320659 5320654 -
cttgattataagtactcatcat

SEQ ID NO: 127192 - DNA, 22 bp, Artificial Sequence
  Synthetic oligonucleotide; CTT chr11 5320651 5320672 5320656 5320651 -
gattataagtactcatcatacc

SEQ ID NO: 127193 - DNA, 22 bp, Artificial Sequence
  Synthetic oligonucleotide; TTG chr11 5320650 5320671 5320655 5320650 -
attataagtactcatcatacct

SEQ ID NO: 127194 - DNA, 22 bp, Artificial Sequence
  Synthetic oligonucleotide; TTA chr11 5320646 5320667 5320651 5320646 -
taagtactcatcatacctcttg

SEQ ID NO: 127195 - DNA, 22 bp, Artificial Sequence
  Synthetic oligonucleotide; CTC chr11 5320637 5320658 5320642 5320637 -
atcatacctcttgttttatatt

SEQ ID NO: 127196 - DNA, 22 bp, Artificial Sequence
  Synthetic oligonucleotide; CTC chr11 5320627 5320648 5320632 5320627 -
ttgttttatattcattccctta

SEQ ID NO: 127197 - DNA, 22 bp, Artificial Sequence
  Synthetic oligonucleotide; CTT chr11 5320625 5320646 5320630 5320625 -
gttttatattcattcccttatg

SEQ ID NO: 127198 - DNA, 22 bp, Artificial Sequence
  Synthetic oligonucleotide; TTG chr11 5320624 5320645 5320629 5320624 -
ttttatattcattcccttatgg

SEQ ID NO: 127199 - DNA, 22 bp, Artificial Sequence
  Synthetic oligonucleotide; TTT chr11 5320621 5320642 5320626 5320621 -
tatattcattcccttatggtaa

SEQ ID NO: 127200 - DNA, 22 bp, Artificial Sequence
  Synthetic oligonucleotide; TTT chr11 5320620 5320641 5320625 5320620 -
atattcattcccttatggtaat

SEQ ID NO: 127201 - DNA, 22 bp, Artificial Sequence
  Synthetic oligonucleotide; TTA chr11 5320619 5320640 5320624 5320619 -
tattcattcccttatggtaatg

SEQ ID NO: 127202 - DNA, 22 bp, Artificial Sequence
  Synthetic oligonucleotide; TTC chr11 5320614 5320635 5320619 5320614 -
attcccttatggtaatgtcaaa

SEQ ID NO: 127203 - DNA, 22 bp, Artificial Sequence
  Synthetic oligonucleotide; TTC chr11 5320610 5320631 5320615 5320610 -
ccttatggtaatgtcaaaatgt

SEQ ID NO: 127204 - DNA, 22 bp, Artificial Sequence
  Synthetic oligonucleotide; CTT chr11 5320606 5320627 5320611 5320606 -
atggtaatgtcaaaatgtttta

SEQ ID NO: 127205 - DNA, 22 bp, Artificial Sequence
  Synthetic oligonucleotide; TTA chr11 5320605 5320626 5320610 5320605 -
tggtaatgtcaaaatgttttac

SEQ ID NO: 127206 - DNA, 22 bp, Artificial Sequence
  Synthetic oligonucleotide; TTT chr11 5320586 5320607 5320591 5320586 -
tacatgatttgcaagatatatt

SEQ ID NO: 127207 - DNA, 22 bp, Artificial Sequence
  Synthetic oligonucleotide; TTT chr11 5320585 5320606 5320590 5320585 -
acatgatttgcaagatatattg

SEQ ID NO: 127208 - DNA, 22 bp, Artificial Sequence
  Synthetic oligonucleotide; TTA chr11 5320584 5320605 5320589 5320584 -
catgatttgcaagatatattgt

SEQ ID NO: 127209 - DNA, 22 bp, Artificial Sequence
  Synthetic oligonucleotide; TTT chr11 5320576 5320597 5320581 5320576 -
gcaagatatattgtgatcagaa

SEQ ID NO: 127210 - DNA, 22 bp, Artificial Sequence
  Synthetic oligonucleotide; TTG chr11 5320575 5320596 5320580 5320575 -
caagatatattgtgatcagaac

SEQ ID NO: 127211 - DNA, 22 bp, Artificial Sequence
  Synthetic oligonucleotide; TTG chr11 5320563 5320584 5320568 5320563 -
tgatcagaacctgctactacta

SEQ ID NO: 127212 - DNA, 22 bp, Artificial Sequence
  Synthetic oligonucleotide; CTG chr11 5320550 5320571 5320555 5320550 -
ctactactacagattcattttc

SEQ ID NO: 127213 - DNA, 22 bp, Artificial Sequence
  Synthetic oligonucleotide; CTA chr11 5320547 5320568 5320552 5320547 -
ctactacagattcattttctct

SEQ ID NO: 127214 - DNA, 22 bp, Artificial Sequence
  Synthetic oligonucleotide; CTA chr11 5320544 5320565 5320549 5320544 -
ctacagattcattttctctcaa

SEQ ID NO: 127215 - DNA, 22 bp, Artificial Sequence
  Synthetic oligonucleotide; CTA chr11 5320541 5320562 5320546 5320541 -
cagattcattttctctcaagct

SEQ ID NO: 127216 - DNA, 22 bp, Artificial Sequence
  Synthetic oligonucleotide; TTC chr11 5320534 5320555 5320539 5320534 -
attttctctcaagctttttttc

SEQ ID NO: 127217 - DNA, 22 bp, Artificial Sequence
  Synthetic oligonucleotide; TTT chr11 5320530 5320551 5320535 5320530 -
tctctcaagctttttttcatgt

SEQ ID NO: 127218 - DNA, 22 bp, Artificial Sequence
  Synthetic oligonucleotide; TTT chr11 5320529 5320550 5320534 5320529 -
ctctcaagctttttttcatgta

SEQ ID NO: 127219 - DNA, 22 bp, Artificial Sequence
  Synthetic oligonucleotide; TTC chr11 5320528 5320549 5320533 5320528 -
tctcaagctttttttcatgtat

SEQ ID NO: 127220 - DNA, 22 bp, Artificial Sequence
  Synthetic oligonucleotide; CTC chr11 5320526 5320547 5320531 5320526 -
tcaagctttttttcatgtattg

SEQ ID NO: 127221 - DNA, 22 bp, Artificial Sequence
  Synthetic oligonucleotide; CTC chr11 5320524 5320545 5320529 5320524 -
aagctttttttcatgtattgtt

SEQ ID NO: 127222 - DNA, 22 bp, Artificial Sequence
  Synthetic oligonucleotide; CTT chr11 5320518 5320539 5320523 5320518 -
tttttcatgtattgttgttcaa

SEQ ID NO: 127223 - DNA, 22 bp, Artificial Sequence
  Synthetic oligonucleotide; TTT chr11 5320517 5320538 5320522 5320517 -
ttttcatgtattgttgttcaag

SEQ ID NO: 127224 - DNA, 22 bp, Artificial Sequence
  Synthetic oligonucleotide; TTT chr11 5320516 5320537 5320521 5320516 -
tttcatgtattgttgttcaaga

SEQ ID NO: 127225 - DNA, 22 bp, Artificial Sequence
  Synthetic oligonucleotide; TTT chr11 5320515 5320536 5320520 5320515 -
ttcatgtattgttgttcaagag

SEQ ID NO: 127226 - DNA, 22 bp, Artificial Sequence
  Synthetic oligonucleotide; TTT chr11 5320514 5320535 5320519 5320514 -
tcatgtattgttgttcaagaga

SEQ ID NO: 127227 - DNA, 22 bp, Artificial Sequence
  Synthetic oligonucleotide; TTT chr11 5320513 5320534 5320518 5320513 -
catgtattgttgttcaagagat

SEQ ID NO: 127228 - DNA, 22 bp, Artificial Sequence
  Synthetic oligonucleotide; TTC chr11 5320512 5320533 5320517 5320512 -
atgtattgttgttcaagagata

SEQ ID NO: 127229 - DNA, 22 bp, Artificial Sequence
  Synthetic oligonucleotide; TTG chr11 5320504 5320525 5320509 5320504 -
ttgttcaagagatattatactt

SEQ ID NO: 127230 - DNA, 22 bp, Artificial Sequence
  Synthetic oligonucleotide; TTG chr11 5320501 5320522 5320506 5320501 -
ttcaagagatattatacttcct

SEQ ID NO: 127231 - DNA, 22 bp, Artificial Sequence
  Synthetic oligonucleotide; TTC chr11 5320498 5320519 5320503 5320498 -
aagagatattatacttccttaa

SEQ ID NO: 127232 - DNA, 22 bp, Artificial Sequence
  Synthetic oligonucleotide; TTA chr11 5320487 5320508 5320492 5320487 -
tacttccttaatgtatattttg

SEQ ID NO: 127233 - DNA, 22 bp, Artificial Sequence
  Synthetic oligonucleotide; CTT chr11 5320482 5320503 5320487 5320482 -
ccttaatgtatattttgaataa

SEQ ID NO: 127234 - DNA, 22 bp, Artificial Sequence
  Synthetic oligonucleotide; TTC chr11 5320481 5320502 5320486 5320481 -
cttaatgtatattttgaataaa

SEQ ID NO: 127235 - DNA, 22 bp, Artificial Sequence
  Synthetic oligonucleotide; CTT chr11 5320478 5320499 5320483 5320478 -
aatgtatattttgaataaaatt

SEQ ID NO: 127236 - DNA, 22 bp, Artificial Sequence
  Synthetic oligonucleotide; TTA chr11 5320477 5320498 5320482 5320477 -
atgtatattttgaataaaatta

SEQ ID NO: 127237 - DNA, 22 bp, Artificial Sequence
  Synthetic oligonucleotide; TTT chr11 5320467 5320488 5320472 5320467 -
tgaataaaattatttttatttg

SEQ ID NO: 127238 - DNA, 22 bp, Artificial Sequence
  Synthetic oligonucleotide; TTT chr11 5320466 5320487 5320471 5320466 -
gaataaaattatttttatttga

SEQ ID NO: 127239 - DNA, 22 bp, Artificial Sequence
  Synthetic oligonucleotide; TTG chr11 5320465 5320486 5320470 5320465 -
aataaaattatttttatttgaa

SEQ ID NO: 127240 - DNA, 22 bp, Artificial Sequence
  Synthetic oligonucleotide; TTA chr11 5320455 5320476 5320460 5320455 -
tttttatttgaatttatagtat

SEQ ID NO: 127241 - DNA, 22 bp, Artificial Sequence
  Synthetic oligonucleotide; TTT chr11 5320452 5320473 5320457 5320452 -
ttatttgaatttatagtattta

SEQ ID NO: 127242 - DNA, 22 bp, Artificial Sequence
  Synthetic oligonucleotide; TTT chr11 5320451 5320472 5320456 5320451 -
tatttgaatttatagtatttaa

SEQ ID NO: 127243 - DNA, 22 bp, Artificial Sequence
  Synthetic oligonucleotide; TTT chr11 5320450 5320471 5320455 5320450 -
atttgaatttatagtatttaat

SEQ ID NO: 127244 - DNA, 22 bp, Artificial Sequence
  Synthetic oligonucleotide; TTA chr11 5320449 5320470 5320454 5320449 -
tttgaatttatagtatttaatc

SEQ ID NO: 127245 - DNA, 22 bp, Artificial Sequence
  Synthetic oligonucleotide; TTT chr11 5320446 5320467 5320451 5320446 -
gaatttatagtatttaatcttg

SEQ ID NO: 127246 - DNA, 22 bp, Artificial Sequence
  Synthetic oligonucleotide; TTG chr11 5320445 5320466 5320450 5320445 -
aatttatagtatttaatcttgc

SEQ ID NO: 127247 - DNA, 22 bp, Artificial Sequence
  Synthetic oligonucleotide; TTT chr11 5320440 5320461 5320445 5320440 -
atagtatttaatcttgccccat

SEQ ID NO: 127248 - DNA, 22 bp, Artificial Sequence
  Synthetic oligonucleotide; TTA chr11 5320439 5320460 5320444 5320439 -
tagtatttaatcttgccccatt

SEQ ID NO: 127249 - DNA, 22 bp, Artificial Sequence
  Synthetic oligonucleotide; TTT chr11 5320431 5320452 5320436 5320431 -
aatcttgccccattaccaatgt

SEQ ID NO: 127250 - DNA, 22 bp, Artificial Sequence
  Synthetic oligonucleotide; TTA chr11 5320430 5320451 5320435 5320430 -
atcttgccccattaccaatgta

SEQ ID NO: 127251 - DNA, 22 bp, Artificial Sequence
  Synthetic oligonucleotide; CTT chr11 5320425 5320446 5320430 5320425 -
gccccattaccaatgtacattt

SEQ ID NO: 127252 - DNA, 22 bp, Artificial Sequence
  Synthetic oligonucleotide; TTG chr11 5320424 5320445 5320429 5320424 -
ccccattaccaatgtacatttt

SEQ ID NO: 127253 - DNA, 22 bp, Artificial Sequence
  Synthetic oligonucleotide; TTA chr11 5320416 5320437 5320421 5320416 -
ccaatgtacattttacaaactt

SEQ ID NO: 127254 - DNA, 22 bp, Artificial Sequence
  Synthetic oligonucleotide; TTT chr11 5320403 5320424 5320408 5320403 -
tacaaactttaatttgtttact

SEQ ID NO: 127255 - DNA, 22 bp, Artificial Sequence
  Synthetic oligonucleotide; TTT chr11 5320402 5320423 5320407 5320402 -
acaaactttaatttgtttactt

SEQ ID NO: 127256 - DNA, 22 bp, Artificial Sequence
  Synthetic oligonucleotide; TTA chr11 5320401 5320422 5320406 5320401 -
caaactttaatttgtttacttg

SEQ ID NO: 127257 - DNA, 22 bp, Artificial Sequence
  Synthetic oligonucleotide; CTT chr11 5320394 5320415 5320399 5320394 -
taatttgtttacttgtttcgtt

SEQ ID NO: 127258 - DNA, 22 bp, Artificial Sequence
  Synthetic oligonucleotide; TTT chr11 5320393 5320414 5320398 5320393 -
aatttgtttacttgtttcgttt

SEQ ID NO: 127259 - DNA, 22 bp, Artificial Sequence
  Synthetic oligonucleotide; TTA chr11 5320392 5320413 5320397 5320392 -
atttgtttacttgtttcgtttt

SEQ ID NO: 127260 - DNA, 22 bp, Artificial Sequence
  Synthetic oligonucleotide; TTT chr11 5320388 5320409 5320393 5320388 -
gtttacttgtttcgttttgtgt

SEQ ID NO: 127261 - DNA, 22 bp, Artificial Sequence
  Synthetic oligonucleotide; TTG chr11 5320387 5320408 5320392 5320387 -
tttacttgtttcgttttgtgtt

SEQ ID NO: 127262 - DNA, 22 bp, Artificial Sequence
  Synthetic oligonucleotide; TTT chr11 5320384 5320405 5320389 5320384 -
acttgtttcgttttgtgtttgt

SEQ ID NO: 127263 - DNA, 22 bp, Artificial Sequence
  Synthetic oligonucleotide; TTA chr11 5320383 5320404 5320388 5320383 -
cttgtttcgttttgtgtttgtt

SEQ ID NO: 127264 - DNA, 22 bp, Artificial Sequence
  Synthetic oligonucleotide; CTT chr11 5320380 5320401 5320385 5320380 -
gtttcgttttgtgtttgttctt

SEQ ID NO: 127265 - DNA, 22 bp, Artificial Sequence
  Synthetic oligonucleotide; TTG chr11 5320379 5320400 5320384 5320379 -
tttcgttttgtgtttgttcttt

SEQ ID NO: 127266 - DNA, 22 bp, Artificial Sequence
  Synthetic oligonucleotide; TTT chr11 5320376 5320397 5320381 5320376 -
cgttttgtgtttgttcttttca

SEQ ID NO: 127267 - DNA, 22 bp, Artificial Sequence
  Synthetic oligonucleotide; TTC chr11 5320375 5320396 5320380 5320375 -
gttttgtgtttgttcttttcac

SEQ ID NO: 127268 - DNA, 22 bp, Artificial Sequence
  Synthetic oligonucleotide; TTT chr11 5320371 5320392 5320376 5320371 -
tgtgtttgttcttttcacctgt

SEQ ID NO: 127269 - DNA, 22 bp, Artificial Sequence
  Synthetic oligonucleotide; TTT chr11 5320370 5320391 5320375 5320370 -
gtgtttgttcttttcacctgta

SEQ ID NO: 127270 - DNA, 22 bp, Artificial Sequence
  Synthetic oligonucleotide; TTG chr11 5320369 5320390 5320374 5320369 -
tgtttgttcttttcacctgtac

SEQ ID NO: 127271 - DNA, 22 bp, Artificial Sequence
  Synthetic oligonucleotide; TTT chr11 5320364 5320385 5320369 5320364 -
gttcttttcacctgtacgcaat

SEQ ID NO: 127272 - DNA, 22 bp, Artificial Sequence
  Synthetic oligonucleotide; TTG chr11 5320363 5320384 5320368 5320363 -
ttcttttcacctgtacgcaatg

SEQ ID NO: 127273 - DNA, 22 bp, Artificial Sequence
  Synthetic oligonucleotide; TTC chr11 5320360 5320381 5320365 5320360 -
ttttcacctgtacgcaatgatt

SEQ ID NO: 127274 - DNA, 22 bp, Artificial Sequence
  Synthetic oligonucleotide; CTT chr11 5320358 5320379 5320363 5320358 -
ttcacctgtacgcaatgattgc

SEQ ID NO: 127275 - DNA, 22 bp, Artificial Sequence
  Synthetic oligonucleotide; TTT chr11 5320357 5320378 5320362 5320357 -
tcacctgtacgcaatgattgca

SEQ ID NO: 127276 - DNA, 22 bp, Artificial Sequence
  Synthetic oligonucleotide; TTT chr11 5320356 5320377 5320361 5320356 -
cacctgtacgcaatgattgcac

SEQ ID NO: 127277 - DNA, 22 bp, Artificial Sequence
  Synthetic oligonucleotide; TTC chr11 5320355 5320376 5320360 5320355 -
acctgtacgcaatgattgcact

SEQ ID NO: 127278 - DNA, 22 bp, Artificial Sequence
  Synthetic oligonucleotide; CTG chr11 5320350 5320371 5320355 5320350 -
tacgcaatgattgcactacccc

SEQ ID NO: 127279 - DNA, 22 bp, Artificial Sequence
  Synthetic oligonucleotide; TTG chr11 5320337 5320358 5320342 5320337 -
cactaccccaccaaatactact

SEQ ID NO: 127280 - DNA, 22 bp, Artificial Sequence
  Synthetic oligonucleotide; CTA chr11 5320332 5320353 5320337 5320332 -
ccccaccaaatactactacact

SEQ ID NO: 127281 - DNA, 22 bp, Artificial Sequence
  Synthetic oligonucleotide; CTA chr11 5320317 5320338 5320322 5320317 -
ctacactactaatatagtagca

SEQ ID NO: 127282 - DNA, 22 bp, Artificial Sequence
  Synthetic oligonucleotide; CTA chr11 5320314 5320335 5320319 5320314 -
cactactaatatagtagcattt

SEQ ID NO: 127283 - DNA, 22 bp, Artificial Sequence
  Synthetic oligonucleotide; CTA chr11 5320309 5320330 5320314 5320309 -
ctaatatagtagcatttaattc

SEQ ID NO: 127284 - DNA, 22 bp, Artificial Sequence
  Synthetic oligonucleotide; CTA chr11 5320306 5320327 5320311 5320306 -
atatagtagcatttaattctca

SEQ ID NO: 127285 - DNA, 22 bp, Artificial Sequence
  Synthetic oligonucleotide; TTT chr11 5320292 5320313 5320297 5320292 -
aattctcagcttaagtagcatt

SEQ ID NO: 127286 - DNA, 22 bp, Artificial Sequence
  Synthetic oligonucleotide; TTA chr11 5320291 5320312 5320296 5320291 -
attctcagcttaagtagcattt

SEQ ID NO: 127287 - DNA, 22 bp, Artificial Sequence
  Synthetic oligonucleotide; TTC chr11 5320287 5320308 5320292 5320287 -
tcagcttaagtagcatttcttc

SEQ ID NO: 127288 - DNA, 22 bp, Artificial Sequence
  Synthetic oligonucleotide; CTC chr11 5320285 5320306 5320290 5320285 -
agcttaagtagcatttcttctg

SEQ ID NO: 127289 - DNA, 22 bp, Artificial Sequence
  Synthetic oligonucleotide; CTT chr11 5320280 5320301 5320285 5320280 -
aagtagcatttcttctggaaaa

SEQ ID NO: 127290 - DNA, 22 bp, Artificial Sequence
  Synthetic oligonucleotide; TTA chr11 5320279 5320300 5320284 5320279 -
agtagcatttcttctggaaaat

SEQ ID NO: 127291 - DNA, 22 bp, Artificial Sequence
  Synthetic oligonucleotide; TTT chr11 5320269 5320290 5320274 5320269 -
cttctggaaaatgttccctgat

SEQ ID NO: 127292 - DNA, 22 bp, Artificial Sequence
  Synthetic oligonucleotide; TTC chr11 5320268 5320289 5320273 5320268 -
ttctggaaaatgttccctgatc

SEQ ID NO: 127293 - DNA, 22 bp, Artificial Sequence
  Synthetic oligonucleotide; CTT chr11 5320266 5320287 5320271 5320266 -
ctggaaaatgttccctgatccc

SEQ ID NO: 127294 - DNA, 22 bp, Artificial Sequence
  Synthetic oligonucleotide; TTC chr11 5320265 5320286 5320270 5320265 -
tggaaaatgttccctgatccca

SEQ ID NO: 127295 - DNA, 22 bp, Artificial Sequence
  Synthetic oligonucleotide; CTG chr11 5320263 5320284 5320268 5320263 -
gaaaatgttccctgatcccaga

SEQ ID NO: 127296 - DNA, 22 bp, Artificial Sequence
  Synthetic oligonucleotide; TTC chr11 5320253 5320274 5320258 5320253 -
cctgatcccagaaatttatttg

SEQ ID NO: 127297 - DNA, 22 bp, Artificial Sequence
  Synthetic oligonucleotide; CTG chr11 5320249 5320270 5320254 5320249 -
atcccagaaatttatttgatgt

SEQ ID NO: 127298 - DNA, 22 bp, Artificial Sequence
  Synthetic oligonucleotide; TTT chr11 5320236 5320257 5320241 5320236 -
atttgatgtgtctctcatagca

SEQ ID NO: 127299 - DNA, 22 bp, Artificial Sequence
  Synthetic oligonucleotide; TTA chr11 5320235 5320256 5320240 5320235 -
tttgatgtgtctctcatagcac

SEQ ID NO: 127300 - DNA, 22 bp, Artificial Sequence
  Synthetic oligonucleotide; TTT chr11 5320232 5320253 5320237 5320232 -
gatgtgtctctcatagcacact

SEQ ID NO: 127301 - DNA, 22 bp, Artificial Sequence
  Synthetic oligonucleotide; TTG chr11 5320231 5320252 5320236 5320231 -
atgtgtctctcatagcacacta

SEQ ID NO: 127302 - DNA, 22 bp, Artificial Sequence
  Synthetic oligonucleotide; CTC chr11 5320222 5320243 5320227 5320222 -
tcatagcacactaatattcacg

SEQ ID NO: 127303 - DNA, 22 bp, Artificial Sequence
  Synthetic oligonucleotide; CTC chr11 5320220 5320241 5320225 5320220 -
atagcacactaatattcacgta

SEQ ID NO: 127304 - DNA, 22 bp, Artificial Sequence
  Synthetic oligonucleotide; CTA chr11 5320209 5320230 5320214 5320209 -
atattcacgtagtaatgatagt

SEQ ID NO: 127305 - DNA, 22 bp, Artificial Sequence
  Synthetic oligonucleotide; TTC chr11 5320203 5320224 5320208 5320203 -
acgtagtaatgatagtgttgta

SEQ ID NO: 127306 - DNA, 22 bp, Artificial Sequence
  Synthetic oligonucleotide; TTG chr11 5320183 5320204 5320188 5320183 -
tatgaattcatggtaaatattt

SEQ ID NO: 127307 - DNA, 22 bp, Artificial Sequence
  Synthetic oligonucleotide; TTC chr11 5320174 5320195 5320179 5320174 -
atggtaaatattttctttctag

SEQ ID NO: 127308 - DNA, 22 bp, Artificial Sequence
  Synthetic oligonucleotide; TTT chr11 5320161 5320182 5320166 5320161 -
tctttctagtgcctgcttgggt

SEQ ID NO: 127309 - DNA, 22 bp, Artificial Sequence
  Synthetic oligonucleotide; TTT chr11 5320160 5320181 5320165 5320160 -
ctttctagtgcctgcttgggtt

SEQ ID NO: 127310 - DNA, 22 bp, Artificial Sequence
  Synthetic oligonucleotide; TTC chr11 5320159 5320180 5320164 5320159 -
tttctagtgcctgcttgggttt

SEQ ID NO: 127311 - DNA, 22 bp, Artificial Sequence
  Synthetic oligonucleotide; CTT chr11 5320157 5320178 5320162 5320157 -
tctagtgcctgcttgggtttta

SEQ ID NO: 127312 - DNA, 22 bp, Artificial Sequence
  Synthetic oligonucleotide; TTT chr11 5320156 5320177 5320161 5320156 -
ctagtgcctgcttgggttttaa

SEQ ID NO: 127313 - DNA, 22 bp, Artificial Sequence
  Synthetic oligonucleotide; TTC chr11 5320155 5320176 5320160 5320155 -
tagtgcctgcttgggttttaaa

SEQ ID NO: 127314 - DNA, 22 bp, Artificial Sequence
  Synthetic oligonucleotide; CTA chr11 5320153 5320174 5320158 5320153 -
gtgcctgcttgggttttaaatt

SEQ ID NO: 127315 - DNA, 22 bp, Artificial Sequence
  Synthetic oligonucleotide; CTG chr11 5320146 5320167 5320151 5320146 -
cttgggttttaaatttcaataa

SEQ ID NO: 127316 - DNA, 22 bp, Artificial Sequence
  Synthetic oligonucleotide; CTT chr11 5320143 5320164 5320148 5320143 -
gggttttaaatttcaataaaaa

SEQ ID NO: 127317 - DNA, 22 bp, Artificial Sequence
  Synthetic oligonucleotide; TTG chr11 5320142 5320163 5320147 5320142 -
ggttttaaatttcaataaaaag

SEQ ID NO: 127318 - DNA, 22 bp, Artificial Sequence
  Synthetic oligonucleotide; TTT chr11 5320137 5320158 5320142 5320137 -
taaatttcaataaaaagaacaa

SEQ ID NO: 127319 - DNA, 22 bp, Artificial Sequence
  Synthetic oligonucleotide; TTT chr11 5320136 5320157 5320141 5320136 -
aaatttcaataaaaagaacaag

SEQ ID NO: 127320 - DNA, 22 bp, Artificial Sequence
  Synthetic oligonucleotide; TTA chr11 5320135 5320156 5320140 5320135 -
aatttcaataaaaagaacaagt

SEQ ID NO: 127321 - DNA, 22 bp, Artificial Sequence
  Synthetic oligonucleotide; TTT chr11 5320130 5320151 5320135 5320130 -
caataaaaagaacaagtcctag

SEQ ID NO: 127322 - DNA, 22 bp, Artificial Sequence
  Synthetic oligonucleotide; TTC chr11 5320129 5320150 5320134 5320129 -
aataaaaagaacaagtcctagg

SEQ ID NO: 127323 - DNA, 22 bp, Artificial Sequence
  Synthetic oligonucleotide; CTA chr11 5320109 5320130 5320114 5320109 -
ggtatttcattttctttgtggc

SEQ ID NO: 127324 - DNA, 22 bp, Artificial Sequence
  Synthetic oligonucleotide; TTT chr11 5320102 5320123 5320107 5320102 -
cattttctttgtggctgttctt

SEQ ID NO: 127325 - DNA, 22 bp, Artificial Sequence
  Synthetic oligonucleotide; TTC chr11 5320101 5320122 5320106 5320101 -
attttctttgtggctgttctta

SEQ ID NO: 127326 - DNA, 22 bp, Artificial Sequence
  Synthetic oligonucleotide; TTT chr11 5320097 5320118 5320102 5320097 -
tctttgtggctgttcttaatgg

SEQ ID NO: 127327 - DNA, 22 bp, Artificial Sequence
  Synthetic oligonucleotide; TTT chr11 5320096 5320117 5320101 5320096 -
ctttgtggctgttcttaatggg

SEQ ID NO: 127328 - DNA, 22 bp, Artificial Sequence
  Synthetic oligonucleotide; TTC chr11 5320095 5320116 5320100 5320095 -
tttgtggctgttcttaatggga

SEQ ID NO: 127329 - DNA, 22 bp, Artificial Sequence
  Synthetic oligonucleotide; CTT chr11 5320093 5320114 5320098 5320093 -
tgtggctgttcttaatgggatt

SEQ ID NO: 127330 - DNA, 22 bp, Artificial Sequence
  Synthetic oligonucleotide; TTT chr11 5320092 5320113 5320097 5320092 -
gtggctgttcttaatgggattg

SEQ ID NO: 127331 - DNA, 22 bp, Artificial Sequence
  Synthetic oligonucleotide; TTG chr11 5320091 5320112 5320096 5320091 -
tggctgttcttaatgggattgt

SEQ ID NO: 127332 - DNA, 22 bp, Artificial Sequence
  Synthetic oligonucleotide; CTG chr11 5320085 5320106 5320090 5320085 -
ttcttaatgggattgtgttctc

SEQ ID NO: 127333 - DNA, 22 bp, Artificial Sequence
  Synthetic oligonucleotide; TTC chr11 5320082 5320103 5320087 5320082 -
ttaatgggattgtgttctcgat

SEQ ID NO: 127334 - DNA, 22 bp, Artificial Sequence
  Synthetic oligonucleotide; CTT chr11 5320080 5320101 5320085 5320080 -
aatgggattgtgttctcgattt

SEQ ID NO: 127335 - DNA, 22 bp, Artificial Sequence
  Synthetic oligonucleotide; TTA chr11 5320079 5320100 5320084 5320079 -
atgggattgtgttctcgatttg

SEQ ID NO: 127336 - DNA, 22 bp, Artificial Sequence
  Synthetic oligonucleotide; TTG chr11 5320070 5320091 5320075 5320070 -
tgttctcgatttgactctcagc

SEQ ID NO: 127337 - DNA, 22 bp, Artificial Sequence
  Synthetic oligonucleotide; TTC chr11 5320065 5320086 5320070 5320065 -
tcgatttgactctcagcctggg

SEQ ID NO: 127338 - DNA, 22 bp, Artificial Sequence
  Synthetic oligonucleotide; CTC chr11 5320063 5320084 5320068 5320063 -
gatttgactctcagcctgggcc

SEQ ID NO: 127339 - DNA, 22 bp, Artificial Sequence
  Synthetic oligonucleotide; TTT chr11 5320058 5320079 5320063 5320058 -
gactctcagcctgggccttatt

SEQ ID NO: 127340 - DNA, 22 bp, Artificial Sequence
  Synthetic oligonucleotide; TTG chr11 5320057 5320078 5320062 5320057 -
actctcagcctgggccttattg

SEQ ID NO: 127341 - DNA, 22 bp, Artificial Sequence
  Synthetic oligonucleotide; CTC chr11 5320053 5320074 5320058 5320053 -
tcagcctgggccttattggtgt

SEQ ID NO: 127342 - DNA, 22 bp, Artificial Sequence
  Synthetic oligonucleotide; CTC chr11 5320051 5320072 5320056 5320051 -
agcctgggccttattggtgtat

SEQ ID NO: 127343 - DNA, 22 bp, Artificial Sequence
  Synthetic oligonucleotide; CTG chr11 5320045 5320066 5320050 5320045 -
ggccttattggtgtatggaaat

SEQ ID NO: 127344 - DNA, 22 bp, Artificial Sequence
  Synthetic oligonucleotide; CTT chr11 5320039 5320060 5320044 5320039 -
attggtgtatggaaatgctact

SEQ ID NO: 127345 - DNA, 22 bp, Artificial Sequence
  Synthetic oligonucleotide; TTA chr11 5320038 5320059 5320043 5320038 -
ttggtgtatggaaatgctactg

SEQ ID NO: 127346 - DNA, 22 bp, Artificial Sequence
  Synthetic oligonucleotide; TTG chr11 5320035 5320056 5320040 5320035 -
gtgtatggaaatgctactgatt

SEQ ID NO: 127347 - DNA, 22 bp, Artificial Sequence
  Synthetic oligonucleotide; CTA chr11 5320019 5320040 5320024 5320019 -
ctgatttttgtatgtgattttg

SEQ ID NO: 127348 - DNA, 22 bp, Artificial Sequence
  Synthetic oligonucleotide; CTG chr11 5320016 5320037 5320021 5320016 -
atttttgtatgtgattttgtat

SEQ ID NO: 127349 - DNA, 22 bp, Artificial Sequence
  Synthetic oligonucleotide; TTT chr11 5320012 5320033 5320017 5320012 -
ttgtatgtgattttgtatcctg

SEQ ID NO: 127350 - DNA, 22 bp, Artificial Sequence
  Synthetic oligonucleotide; TTT chr11 5320011 5320032 5320016 5320011 -
tgtatgtgattttgtatcctga

SEQ ID NO: 127351 - DNA, 22 bp, Artificial Sequence
  Synthetic oligonucleotide; TTT chr11 5320010 5320031 5320015 5320010 -
gtatgtgattttgtatcctgaa

SEQ ID NO: 127352 - DNA, 22 bp, Artificial Sequence
  Synthetic oligonucleotide; TTG chr11 5320009 5320030 5320014 5320009 -
tatgtgattttgtatcctgaaa

SEQ ID NO: 127353 - DNA, 22 bp, Artificial Sequence
  Synthetic oligonucleotide; TTT chr11 5319999 5320020 5320004 5319999 -
tgtatcctgaaaccttgctaaa

SEQ ID NO: 127354 - DNA, 22 bp, Artificial Sequence
  Synthetic oligonucleotide; TTT chr11 5319998 5320019 5320003 5319998 -
gtatcctgaaaccttgctaaaa

SEQ ID NO: 127355 - DNA, 22 bp, Artificial Sequence
  Synthetic oligonucleotide; TTG chr11 5319997 5320018 5320002 5319997 -
tatcctgaaaccttgctaaaat

SEQ ID NO: 127356 - DNA, 22 bp, Artificial Sequence
  Synthetic oligonucleotide; CTG chr11 5319990 5320011 5319995 5319990 -
aaaccttgctaaaattgtttat

SEQ ID NO: 127357 - DNA, 22 bp, Artificial Sequence
  Synthetic oligonucleotide; CTT chr11 5319983 5320004 5319988 5319983 -
gctaaaattgtttatcagttct

SEQ ID NO: 127358 - DNA, 22 bp, Artificial Sequence
  Synthetic oligonucleotide; TTG chr11 5319982 5320003 5319987 5319982 -
ctaaaattgtttatcagttcta

SEQ ID NO: 127359 - DNA, 22 bp, Artificial Sequence
  Synthetic oligonucleotide; CTA chr11 5319979 5320000 5319984 5319979 -
aaattgtttatcagttctagca

SEQ ID NO: 127360 - DNA, 22 bp, Artificial Sequence
  Synthetic oligonucleotide; TTG chr11 5319973 5319994 5319978 5319973 -
tttatcagttctagcagccttt

SEQ ID NO: 127361 - DNA, 22 bp, Artificial Sequence
  Synthetic oligonucleotide; TTT chr11 5319970 5319991 5319975 5319970 -
atcagttctagcagccttttgg

SEQ ID NO: 127362 - DNA, 22 bp, Artificial Sequence
  Synthetic oligonucleotide; TTA chr11 5319969 5319990 5319974 5319969 -
tcagttctagcagccttttgga

SEQ ID NO: 127363 - DNA, 22 bp, Artificial Sequence
  Synthetic oligonucleotide; TTC chr11 5319962 5319983 5319967 5319962 -
tagcagccttttggaagaatct

SEQ ID NO: 127364 - DNA, 22 bp, Artificial Sequence
  Synthetic oligonucleotide; CTA chr11 5319960 5319981 5319965 5319960 -
gcagccttttggaagaatctgt

SEQ ID NO: 127365 - DNA, 22 bp, Artificial Sequence
  Synthetic oligonucleotide; CTT chr11 5319952 5319973 5319957 5319952 -
ttggaagaatctgtaggatttt

SEQ ID NO: 127366 - DNA, 22 bp, Artificial Sequence
  Synthetic oligonucleotide; TTT chr11 5319951 5319972 5319956 5319951 -
tggaagaatctgtaggattttc

SEQ ID NO: 127367 - DNA, 22 bp, Artificial Sequence
  Synthetic oligonucleotide; TTT chr11 5319950 5319971 5319955 5319950 -
ggaagaatctgtaggattttct

SEQ ID NO: 127368 - DNA, 22 bp, Artificial Sequence
  Synthetic oligonucleotide; TTG chr11 5319949 5319970 5319954 5319949 -
gaagaatctgtaggattttcta

SEQ ID NO: 127369 - DNA, 22 bp, Artificial Sequence
  Synthetic oligonucleotide; CTG chr11 5319939 5319960 5319944 5319939 -
taggattttctaagtatagagt

SEQ ID NO: 127370 - DNA, 22 bp, Artificial Sequence
  Synthetic oligonucleotide; TTT chr11 5319931 5319952 5319936 5319931 -
tctaagtatagagtcatatcat

SEQ ID NO: 127371 - DNA, 22 bp, Artificial Sequence
  Synthetic oligonucleotide; TTT chr11 5319930 5319951 5319935 5319930 -
ctaagtatagagtcatatcatc

SEQ ID NO: 127372 - DNA, 22 bp, Artificial Sequence
  Synthetic oligonucleotide; TTC chr11 5319929 5319950 5319934 5319929 -
taagtatagagtcatatcatca

SEQ ID NO: 127373 - DNA, 22 bp, Artificial Sequence
  Synthetic oligonucleotide; CTA chr11 5319927 5319948 5319932 5319927 -
agtatagagtcatatcatcagc

SEQ ID NO: 127374 - DNA, 22 bp, Artificial Sequence
  Synthetic oligonucleotide; TTT chr11 5319890 5319911 5319895 5319890 -
ggcttattgtcctattttgatg

SEQ ID NO: 127375 - DNA, 22 bp, Artificial Sequence
  Synthetic oligonucleotide; TTG chr11 5319889 5319910 5319894 5319889 -
gcttattgtcctattttgatgc

SEQ ID NO: 127376 - DNA, 22 bp, Artificial Sequence
  Synthetic oligonucleotide; CTT chr11 5319885 5319906 5319890 5319885 -
attgtcctattttgatgccatt

SEQ ID NO: 127377 - DNA, 22 bp, Artificial Sequence
  Synthetic oligonucleotide; TTA chr11 5319884 5319905 5319889 5319884 -
ttgtcctattttgatgccattt

SEQ ID NO: 127378 - DNA, 22 bp, Artificial Sequence
  Synthetic oligonucleotide; TTG chr11 5319881 5319902 5319886 5319881 -
tcctattttgatgccatttctt

SEQ ID NO: 127379 - DNA, 22 bp, Artificial Sequence
  Synthetic oligonucleotide; CTA chr11 5319876 5319897 5319881 5319876 -
ttttgatgccatttctttcttt

SEQ ID NO: 127380 - DNA, 22 bp, Artificial Sequence
  Synthetic oligonucleotide; TTT chr11 5319873 5319894 5319878 5319873 -
tgatgccatttctttctttctc

SEQ ID NO: 127381 - DNA, 22 bp, Artificial Sequence
  Synthetic oligonucleotide; TTT chr11 5319872 5319893 5319877 5319872 -
gatgccatttctttctttctct

SEQ ID NO: 127382 - DNA, 22 bp, Artificial Sequence
  Synthetic oligonucleotide; TTG chr11 5319871 5319892 5319876 5319871 -
atgccatttctttctttctctc

SEQ ID NO: 127383 - DNA, 22 bp, Artificial Sequence
  Synthetic oligonucleotide; TTT chr11 5319862 5319883 5319867 5319862 -
ctttctttctctcgcctgattg

SEQ ID NO: 127384 - DNA, 22 bp, Artificial Sequence
  Synthetic oligonucleotide; TTC chr11 5319861 5319882 5319866 5319861 -
tttctttctctcgcctgattgc

SEQ ID NO: 127385 - DNA, 22 bp, Artificial Sequence
  Synthetic oligonucleotide; CTT chr11 5319859 5319880 5319864 5319859 -
tctttctctcgcctgattgccc

SEQ ID NO: 127386 - DNA, 22 bp, Artificial Sequence
  Synthetic oligonucleotide; TTT chr11 5319858 5319879 5319863 5319858 -
ctttctctcgcctgattgccct

SEQ ID NO: 127387 - DNA, 22 bp, Artificial Sequence
  Synthetic oligonucleotide; TTC chr11 5319857 5319878 5319862 5319857 -
tttctctcgcctgattgccctg

SEQ ID NO: 127388 - DNA, 22 bp, Artificial Sequence
  Synthetic oligonucleotide; CTT chr11 5319855 5319876 5319860 5319855 -
tctctcgcctgattgccctggt

SEQ ID NO: 127389 - DNA, 22 bp, Artificial Sequence
  Synthetic oligonucleotide; TTT chr11 5319854 5319875 5319859 5319854 -
ctctcgcctgattgccctggtt

SEQ ID NO: 127390 - DNA, 22 bp, Artificial Sequence
  Synthetic oligonucleotide; TTC chr11 5319853 5319874 5319858 5319853 -
tctcgcctgattgccctggtta

SEQ ID NO: 127391 - DNA, 22 bp, Artificial Sequence
  Synthetic oligonucleotide; CTC chr11 5319851 5319872 5319856 5319851 -
tcgcctgattgccctggttagg

SEQ ID NO: 127392 - DNA, 22 bp, Artificial Sequence
  Synthetic oligonucleotide; CTC chr11 5319849 5319870 5319854 5319849 -
gcctgattgccctggttaggac

SEQ ID NO: 127393 - DNA, 22 bp, Artificial Sequence
  Synthetic oligonucleotide; CTG chr11 5319844 5319865 5319849 5319844 -
attgccctggttaggacttcca

SEQ ID NO: 127394 - DNA, 22 bp, Artificial Sequence
  Synthetic oligonucleotide; TTG chr11 5319840 5319861 5319845 5319840 -
ccctggttaggacttccaattt

SEQ ID NO: 127395 - DNA, 22 bp, Artificial Sequence
  Synthetic oligonucleotide; CTG chr11 5319835 5319856 5319840 5319835 -
gttaggacttccaattttatgt

SEQ ID NO: 127396 - DNA, 22 bp, Artificial Sequence
  Synthetic oligonucleotide; TTA chr11 5319831 5319852 5319836 5319831 -
ggacttccaattttatgttcac

SEQ ID NO: 127397 - DNA, 22 bp, Artificial Sequence
  Synthetic oligonucleotide; CTT chr11 5319825 5319846 5319830 5319825 -
ccaattttatgttcactaggag

SEQ ID NO: 127398 - DNA, 22 bp, Artificial Sequence
  Synthetic oligonucleotide; TTC chr11 5319824 5319845 5319829 5319824 -
caattttatgttcactaggagt

SEQ ID NO: 127399 - DNA, 22 bp, Artificial Sequence
  Synthetic oligonucleotide; TTT chr11 5319818 5319839 5319823 5319818 -
tatgttcactaggagtggtgag

SEQ ID NO: 127400 - DNA, 22 bp, Artificial Sequence
  Synthetic oligonucleotide; TTT chr11 5319817 5319838 5319822 5319817 -
atgttcactaggagtggtgaga

SEQ ID NO: 127401 - DNA, 22 bp, Artificial Sequence
  Synthetic oligonucleotide; TTA chr11 5319816 5319837 5319821 5319816 -
tgttcactaggagtggtgagaa

SEQ ID NO: 127402 - DNA, 22 bp, Artificial Sequence
  Synthetic oligonucleotide; TTC chr11 5319811 5319832 5319816 5319811 -
actaggagtggtgagaatggga

SEQ ID NO: 127403 - DNA, 22 bp, Artificial Sequence
  Synthetic oligonucleotide; CTA chr11 5319807 5319828 5319812 5319807 -
ggagtggtgagaatgggaatcc

SEQ ID NO: 127404 - DNA, 22 bp, Artificial Sequence
  Synthetic oligonucleotide; CTT chr11 5319783 5319804 5319788 5319783 -
gtcttgttgcagttttcgagga

SEQ ID NO: 127405 - DNA, 22 bp, Artificial Sequence
  Synthetic oligonucleotide; TTG chr11 5319782 5319803 5319787 5319782 -
tcttgttgcagttttcgaggag

SEQ ID NO: 127406 - DNA, 22 bp, Artificial Sequence
  Synthetic oligonucleotide; CTT chr11 5319778 5319799 5319783 5319778 -
gttgcagttttcgaggagaata

SEQ ID NO: 127407 - DNA, 22 bp, Artificial Sequence
  Synthetic oligonucleotide; TTG chr11 5319777 5319798 5319782 5319777 -
ttgcagttttcgaggagaatag

SEQ ID NO: 127408 - DNA, 22 bp, Artificial Sequence
  Synthetic oligonucleotide; TTG chr11 5319774 5319795 5319779 5319774 -
cagttttcgaggagaatagttc

SEQ ID NO: 127409 - DNA, 22 bp, Artificial Sequence
  Synthetic oligonucleotide; TTT chr11 5319768 5319789 5319773 5319768 -
tcgaggagaatagttccagctt

SEQ ID NO: 127410 - DNA, 22 bp, Artificial Sequence
  Synthetic oligonucleotide; TTT chr11 5319767 5319788 5319772 5319767 -
cgaggagaatagttccagcttt

SEQ ID NO: 127411 - DNA, 22 bp, Artificial Sequence
  Synthetic oligonucleotide; TTC chr11 5319766 5319787 5319771 5319766 -
gaggagaatagttccagctttt

SEQ ID NO: 127412 - DNA, 22 bp, Artificial Sequence
  Synthetic oligonucleotide; TTC chr11 5319752 5319773 5319757 5319752 -
cagcttttgcccattcagtatg

SEQ ID NO: 127413 - DNA, 22 bp, Artificial Sequence
  Synthetic oligonucleotide; CTT chr11 5319746 5319767 5319751 5319746 -
ttgcccattcagtatggttttg

SEQ ID NO: 127414 - DNA, 22 bp, Artificial Sequence
  Synthetic oligonucleotide; TTT chr11 5319745 5319766 5319750 5319745 -
tgcccattcagtatggttttgg

SEQ ID NO: 127415 - DNA, 22 bp, Artificial Sequence
  Synthetic oligonucleotide; TTT chr11 5319744 5319765 5319749 5319744 -
gcccattcagtatggttttggt

SEQ ID NO: 127416 - DNA, 22 bp, Artificial Sequence
  Synthetic oligonucleotide; TTG chr11 5319743 5319764 5319748 5319743 -
cccattcagtatggttttggtt

SEQ ID NO: 127417 - DNA, 22 bp, Artificial Sequence
  Synthetic oligonucleotide; TTC chr11 5319736 5319757 5319741 5319736 -
agtatggttttggttatgggtt

SEQ ID NO: 127418 - DNA, 22 bp, Artificial Sequence
  Synthetic oligonucleotide; TTT chr11 5319726 5319747 5319731 5319726 -
tggttatgggtttttcatacgt

SEQ ID NO: 127419 - DNA, 22 bp, Artificial Sequence
  Synthetic oligonucleotide; TTT chr11 5319725 5319746 5319730 5319725 -
ggttatgggtttttcatacgtg

SEQ ID NO: 127420 - DNA, 22 bp, Artificial Sequence
  Synthetic oligonucleotide; TTG chr11 5319724 5319745 5319729 5319724 -
gttatgggtttttcatacgtgg

SEQ ID NO: 127421 - DNA, 22 bp, Artificial Sequence
  Synthetic oligonucleotide; TTA chr11 5319720 5319741 5319725 5319720 -
tgggtttttcatacgtggcttt

SEQ ID NO: 127422 - DNA, 22 bp, Artificial Sequence
  Synthetic oligonucleotide; TTT chr11 5319713 5319734 5319718 5319713 -
ttcatacgtggcttttattctt

SEQ ID NO: 127423 - DNA, 22 bp, Artificial Sequence
  Synthetic oligonucleotide; TTT chr11 5319712 5319733 5319717 5319712 -
tcatacgtggcttttattcttt

SEQ ID NO: 127424 - DNA, 22 bp, Artificial Sequence
  Synthetic oligonucleotide; TTT chr11 5319711 5319732 5319716 5319711 -
catacgtggcttttattctttt

SEQ ID NO: 127425 - DNA, 22 bp, Artificial Sequence
  Synthetic oligonucleotide; TTC chr11 5319710 5319731 5319715 5319710 -
atacgtggcttttattcttttg

SEQ ID NO: 127426 - DNA, 22 bp, Artificial Sequence
  Synthetic oligonucleotide; CTT chr11 5319699 5319720 5319704 5319699 -
ttattcttttgaggtatgttcc

SEQ ID NO: 127427 - DNA, 22 bp, Artificial Sequence
  Synthetic oligonucleotide; TTT chr11 5319698 5319719 5319703 5319698 -
tattcttttgaggtatgttcct

SEQ ID NO: 127428 - DNA, 22 bp, Artificial Sequence
  Synthetic oligonucleotide; TTT chr11 5319697 5319718 5319702 5319697 -
attcttttgaggtatgttcctt

SEQ ID NO: 127429 - DNA, 22 bp, Artificial Sequence
  Synthetic oligonucleotide; TTA chr11 5319696 5319717 5319701 5319696 -
ttcttttgaggtatgttccttt

SEQ ID NO: 127430 - DNA, 22 bp, Artificial Sequence
  Synthetic oligonucleotide; TTC chr11 5319693 5319714 5319698 5319693 -
ttttgaggtatgttcctttgat

SEQ ID NO: 127431 - DNA, 22 bp, Artificial Sequence
  Synthetic oligonucleotide; CTT chr11 5319691 5319712 5319696 5319691 -
ttgaggtatgttcctttgatgc

SEQ ID NO: 127432 - DNA, 22 bp, Artificial Sequence
  Synthetic oligonucleotide; TTT chr11 5319690 5319711 5319695 5319690 -
tgaggtatgttcctttgatgcc

SEQ ID NO: 127433 - DNA, 22 bp, Artificial Sequence
  Synthetic oligonucleotide; TTT chr11 5319689 5319710 5319694 5319689 -
gaggtatgttcctttgatgcct

SEQ ID NO: 127434 - DNA, 22 bp, Artificial Sequence
  Synthetic oligonucleotide; TTG chr11 5319688 5319709 5319693 5319688 -
aggtatgttcctttgatgccta

SEQ ID NO: 127435 - DNA, 22 bp, Artificial Sequence
  Synthetic oligonucleotide; TTC chr11 5319678 5319699 5319683 5319678 -
ctttgatgcctagtctgttgga

SEQ ID NO: 127436 - DNA, 22 bp, Artificial Sequence
  Synthetic oligonucleotide; CTT chr11 5319675 5319696 5319680 5319675 -
tgatgcctagtctgttggaggt

SEQ ID NO: 127437 - DNA, 22 bp, Artificial Sequence
  Synthetic oligonucleotide; TTT chr11 5319674 5319695 5319679 5319674 -
gatgcctagtctgttggaggtt

SEQ ID NO: 127438 - DNA, 22 bp, Artificial Sequence
  Synthetic oligonucleotide; TTG chr11 5319673 5319694 5319678 5319673 -
atgcctagtctgttggaggttt

SEQ ID NO: 127439 - DNA, 22 bp, Artificial Sequence
  Synthetic oligonucleotide; CTA chr11 5319666 5319687 5319671 5319666 -
gtctgttggaggtttttatcat

SEQ ID NO: 127440 - DNA, 22 bp, Artificial Sequence
  Synthetic oligonucleotide; CTG chr11 5319661 5319682 5319666 5319661 -
ttggaggtttttatcatgaagg

SEQ ID NO: 127441 - DNA, 22 bp, Artificial Sequence
  Synthetic oligonucleotide; TTG chr11 5319658 5319679 5319663 5319658 -
gaggtttttatcatgaagggat

SEQ ID NO: 127442 - DNA, 22 bp, Artificial Sequence
  Synthetic oligonucleotide; TTT chr11 5319651 5319672 5319656 5319651 -
ttatcatgaagggatgttgaat

SEQ ID NO: 127443 - DNA, 22 bp, Artificial Sequence
  Synthetic oligonucleotide; TTT chr11 5319650 5319671 5319655 5319650 -
tatcatgaagggatgttgaatt

SEQ ID NO: 127444 - DNA, 22 bp, Artificial Sequence
  Synthetic oligonucleotide; TTT chr11 5319649 5319670 5319654 5319649 -
atcatgaagggatgttgaattt

SEQ ID NO: 127445 - DNA, 22 bp, Artificial Sequence
  Synthetic oligonucleotide; TTA chr11 5319648 5319669 5319653 5319648 -
tcatgaagggatgttgaatttt

SEQ ID NO: 127446 - DNA, 22 bp, Artificial Sequence
  Synthetic oligonucleotide; TTG chr11 5319632 5319653 5319637 5319632 -
aattttattgaaaggtttttct

SEQ ID NO: 127447 - DNA, 22 bp, Artificial Sequence
  Synthetic oligonucleotide; TTT chr11 5319627 5319648 5319632 5319627 -
tattgaaaggtttttctcagtc

SEQ ID NO: 127448 - DNA, 22 bp, Artificial Sequence
  Synthetic oligonucleotide; TTT chr11 5319626 5319647 5319631 5319626 -
attgaaaggtttttctcagtct

SEQ ID NO: 127449 - DNA, 22 bp, Artificial Sequence
  Synthetic oligonucleotide; TTA chr11 5319625 5319646 5319630 5319625 -
ttgaaaggtttttctcagtcta

SEQ ID NO: 127450 - DNA, 22 bp, Artificial Sequence
  Synthetic oligonucleotide; TTG chr11 5319622 5319643 5319627 5319622 -
aaaggtttttctcagtctattg

SEQ ID NO: 127451 - DNA, 22 bp, Artificial Sequence
  Synthetic oligonucleotide; TTT chr11 5319614 5319635 5319619 5319614 -
ttctcagtctattgagatgatc

SEQ ID NO: 127452 - DNA, 22 bp, Artificial Sequence
  Synthetic oligonucleotide; TTT chr11 5319613 5319634 5319618 5319613 -
tctcagtctattgagatgatca

SEQ ID NO: 127453 - DNA, 22 bp, Artificial Sequence
  Synthetic oligonucleotide; TTT chr11 5319612 5319633 5319617 5319612 -
ctcagtctattgagatgatcat

SEQ ID NO: 127454 - DNA, 22 bp, Artificial Sequence
  Synthetic oligonucleotide; TTC chr11 5319611 5319632 5319616 5319611 -
tcagtctattgagatgatcata

SEQ ID NO: 127455 - DNA, 22 bp, Artificial Sequence
  Synthetic oligonucleotide; CTC chr11 5319609 5319630 5319614 5319609 -
agtctattgagatgatcatatg

SEQ ID NO: 127456 - DNA, 22 bp, Artificial Sequence
  Synthetic oligonucleotide; CTA chr11 5319603 5319624 5319608 5319603 -
ttgagatgatcatatggtttgt

SEQ ID NO: 127457 - DNA, 22 bp, Artificial Sequence
  Synthetic oligonucleotide; TTG chr11 5319600 5319621 5319605 5319600 -
agatgatcatatggtttgtggg

SEQ ID NO: 127458 - DNA, 22 bp, Artificial Sequence
  Synthetic oligonucleotide; TTT chr11 5319583 5319604 5319588 5319583 -
gtgggaggtgaaagatctctac

SEQ ID NO: 127459 - DNA, 22 bp, Artificial Sequence
  Synthetic oligonucleotide; TTG chr11 5319582 5319603 5319587 5319582 -
tgggaggtgaaagatctctaca

SEQ ID NO: 127460 - DNA, 22 bp, Artificial Sequence
  Synthetic oligonucleotide; CTC chr11 5319564 5319585 5319569 5319564 -
tacaaggagaactacaaaacac

SEQ ID NO: 127461 - DNA, 22 bp, Artificial Sequence
  Synthetic oligonucleotide; CTA chr11 5319562 5319583 5319567 5319562 -
caaggagaactacaaaacactg

SEQ ID NO: 127462 - DNA, 22 bp, Artificial Sequence
  Synthetic oligonucleotide; CTA chr11 5319550 5319571 5319555 5319550 -
caaaacactgctgaaagaaatc

SEQ ID NO: 127463 - DNA, 22 bp, Artificial Sequence
  Synthetic oligonucleotide; CTG chr11 5319540 5319561 5319545 5319540 -
ctgaaagaaatcagaaacaaca

SEQ ID NO: 127464 - DNA, 22 bp, Artificial Sequence
  Synthetic oligonucleotide; CTG chr11 5319537 5319558 5319542 5319537 -
aaagaaatcagaaacaacacaa

SEQ ID NO: 127465 - DNA, 22 bp, Artificial Sequence
  Synthetic oligonucleotide; CTT chr11 5319497 5319518 5319502 5319497 -
tccaggctcatggattggaaga

SEQ ID NO: 127466 - DNA, 22 bp, Artificial Sequence
  Synthetic oligonucleotide; TTT chr11 5319496 5319517 5319501 5319496 -
ccaggctcatggattggaagaa

SEQ ID NO: 127467 - DNA, 22 bp, Artificial Sequence
  Synthetic oligonucleotide; TTC chr11 5319495 5319516 5319500 5319495 -
caggctcatggattggaagaat

SEQ ID NO: 127468 - DNA, 22 bp, Artificial Sequence
  Synthetic oligonucleotide; CTC chr11 5319488 5319509 5319493 5319488 -
atggattggaagaatcaatatg

SEQ ID NO: 127469 - DNA, 22 bp, Artificial Sequence
  Synthetic oligonucleotide; TTG chr11 5319480 5319501 5319485 5319480 -
gaagaatcaatatgaatttaaa

SEQ ID NO: 127470 - DNA, 22 bp, Artificial Sequence
  Synthetic oligonucleotide; TTT chr11 5319461 5319482 5319466 5319461 -
aaatggccatactgctcaaagc

SEQ ID NO: 127471 - DNA, 22 bp, Artificial Sequence
  Synthetic oligonucleotide; TTA chr11 5319460 5319481 5319465 5319460 -
aatggccatactgctcaaagca

SEQ ID NO: 127472 - DNA, 22 bp, Artificial Sequence
  Synthetic oligonucleotide; CTG chr11 5319447 5319468 5319452 5319447 -
ctcaaagcaatttagacattca

SEQ ID NO: 127473 - DNA, 22 bp, Artificial Sequence
  Synthetic oligonucleotide; CTC chr11 5319444 5319465 5319449 5319444 -
aaagcaatttagacattcattg

SEQ ID NO: 127474 - DNA, 22 bp, Artificial Sequence
  Synthetic oligonucleotide; TTT chr11 5319434 5319455 5319439 5319434 -
agacattcattgcaatttctat

SEQ ID NO: 127475 - DNA, 22 bp, Artificial Sequence
  Synthetic oligonucleotide; TTA chr11 5319433 5319454 5319438 5319433 -
gacattcattgcaatttctatc

SEQ ID NO: 127476 - DNA, 22 bp, Artificial Sequence
  Synthetic oligonucleotide; TTC chr11 5319426 5319447 5319431 5319426 -
attgcaatttctatccaattac

SEQ ID NO: 127477 - DNA, 22 bp, Artificial Sequence
  Synthetic oligonucleotide; TTG chr11 5319422 5319443 5319427 5319422 -
caatttctatccaattaccaat

SEQ ID NO: 127478 - DNA, 22 bp, Artificial Sequence
  Synthetic oligonucleotide; TTT chr11 5319416 5319437 5319421 5319416 -
ctatccaattaccaatgtcatt

SEQ ID NO: 127479 - DNA, 22 bp, Artificial Sequence
  Synthetic oligonucleotide; TTC chr11 5319415 5319436 5319420 5319415 -
tatccaattaccaatgtcattc

SEQ ID NO: 127480 - DNA, 22 bp, Artificial Sequence
  Synthetic oligonucleotide; CTA chr11 5319413 5319434 5319418 5319413 -
tccaattaccaatgtcattctt

SEQ ID NO: 127481 - DNA, 22 bp, Artificial Sequence
  Synthetic oligonucleotide; TTA chr11 5319405 5319426 5319410 5319405 -
ccaatgtcattcttcacagtat

SEQ ID NO: 127482 - DNA, 22 bp, Artificial Sequence
  Synthetic oligonucleotide; TTC chr11 5319393 5319414 5319398 5319393 -
ttcacagtattagaaaaactag

SEQ ID NO: 127483 - DNA, 22 bp, Artificial Sequence
  Synthetic oligonucleotide; CTT chr11 5319391 5319412 5319396 5319391 -
cacagtattagaaaaactagtt

SEQ ID NO: 127484 - DNA, 22 bp, Artificial Sequence
  Synthetic oligonucleotide; TTC chr11 5319390 5319411 5319395 5319390 -
acagtattagaaaaactagttt

SEQ ID NO: 127485 - DNA, 22 bp, Artificial Sequence
  Synthetic oligonucleotide; TTA chr11 5319381 5319402 5319386 5319381 -
gaaaaactagtttaaaattcat

SEQ ID NO: 127486 - DNA, 22 bp, Artificial Sequence
  Synthetic oligonucleotide; CTA chr11 5319372 5319393 5319377 5319372 -
gtttaaaattcatatggaacca

SEQ ID NO: 127487 - DNA, 22 bp, Artificial Sequence
  Synthetic oligonucleotide; TTT chr11 5319368 5319389 5319373 5319368 -
aaaattcatatggaaccaaaaa

SEQ ID NO: 127488 - DNA, 22 bp, Artificial Sequence
  Synthetic oligonucleotide; TTA chr11 5319367 5319388 5319372 5319367 -
aaattcatatggaaccaaaaag

SEQ ID NO: 127489 - DNA, 22 bp, Artificial Sequence
  Synthetic oligonucleotide; TTC chr11 5319361 5319382 5319366 5319361 -
atatggaaccaaaaagagcctg

SEQ ID NO: 127490 - DNA, 22 bp, Artificial Sequence
  Synthetic oligonucleotide; CTG chr11 5319339 5319360 5319344 5319339 -
aacaggcaaagcaatcttaagc

SEQ ID NO: 127491 - DNA, 22 bp, Artificial Sequence
  Synthetic oligonucleotide; CTT chr11 5319321 5319342 5319326 5319321 -
aagcagaaagaacaaaattgga

SEQ ID NO: 127492 - DNA, 22 bp, Artificial Sequence
  Synthetic oligonucleotide; TTA chr11 5319320 5319341 5319325 5319320 -
agcagaaagaacaaaattggaa

SEQ ID NO: 127493 - DNA, 22 bp, Artificial Sequence
  Synthetic oligonucleotide; TTG chr11 5319301 5319322 5319306 5319301 -
gaagcaccacaccacctgactt

SEQ ID NO: 127494 - DNA, 22 bp, Artificial Sequence
  Synthetic oligonucleotide; CTG chr11 5319283 5319304 5319288 5319283 -
acttgaaactacaggccaggca

SEQ ID NO: 127495 - DNA, 22 bp, Artificial Sequence
  Synthetic oligonucleotide; CTT chr11 5319279 5319300 5319284 5319279 -
gaaactacaggccaggcacggt

SEQ ID NO: 127496 - DNA, 22 bp, Artificial Sequence
  Synthetic oligonucleotide; TTG chr11 5319278 5319299 5319283 5319278 -
aaactacaggccaggcacggtg

SEQ ID NO: 127497 - DNA, 22 bp, Artificial Sequence
  Synthetic oligonucleotide; CTA chr11 5319272 5319293 5319277 5319272 -
caggccaggcacggtggctcac

SEQ ID NO: 127498 - DNA, 22 bp, Artificial Sequence
  Synthetic oligonucleotide; CTC chr11 5319252 5319273 5319257 5319252 -
acgcctgtaactctagcacttt

SEQ ID NO: 127499 - DNA, 22 bp, Artificial Sequence
  Synthetic oligonucleotide; CTG chr11 5319245 5319266 5319250 5319245 -
taactctagcactttagggggc

SEQ ID NO: 127500 - DNA, 22 bp, Artificial Sequence
  Synthetic oligonucleotide; CTC chr11 5319239 5319260 5319244 5319239 -
tagcactttagggggctgaggt

SEQ ID NO: 127501 - DNA, 22 bp, Artificial Sequence
  Synthetic oligonucleotide; CTA chr11 5319237 5319258 5319242 5319237 -
gcactttagggggctgaggtgg

SEQ ID NO: 127502 - DNA, 22 bp, Artificial Sequence
  Synthetic oligonucleotide; CTT chr11 5319231 5319252 5319236 5319231 -
tagggggctgaggtgggtgtat

SEQ ID NO: 127503 - DNA, 22 bp, Artificial Sequence
  Synthetic oligonucleotide; TTT chr11 5319230 5319251 5319235 5319230 -
agggggctgaggtgggtgtatc

SEQ ID NO: 127504 - DNA, 22 bp, Artificial Sequence
  Synthetic oligonucleotide; TTA chr11 5319229 5319250 5319234 5319229 -
gggggctgaggtgggtgtatca

SEQ ID NO: 127505 - DNA, 22 bp, Artificial Sequence
  Synthetic oligonucleotide; CTG chr11 5319221 5319242 5319226 5319221 -
aggtgggtgtatcacctgaggt

SEQ ID NO: 127506 - DNA, 22 bp, Artificial Sequence
  Synthetic oligonucleotide; CTG chr11 5319203 5319224 5319208 5319203 -
aggtcaggagttcaagaccagc

SEQ ID NO: 127507 - DNA, 22 bp, Artificial Sequence
  Synthetic oligonucleotide; TTC chr11 5319190 5319211 5319195 5319190 -
aagaccagcctggtcaacatgg

SEQ ID NO: 127508 - DNA, 22 bp, Artificial Sequence
  Synthetic oligonucleotide; CTG chr11 5319178 5319199 5319183 5319178 -
gtcaacatggtgaaacactgtc

SEQ ID NO: 127509 - DNA, 22 bp, Artificial Sequence
  Synthetic oligonucleotide; CTG chr11 5319158 5319179 5319163 5319158 -
tctctactaaaaatacaaaatt

SEQ ID NO: 127510 - DNA, 22 bp, Artificial Sequence
  Synthetic oligonucleotide; CTC chr11 5319154 5319175 5319159 5319154 -
tactaaaaatacaaaattagcc

SEQ ID NO: 127511 - DNA, 22 bp, Artificial Sequence
  Synthetic oligonucleotide; CTA chr11 5319152 5319173 5319157 5319152 -
ctaaaaatacaaaattagccgg

SEQ ID NO: 127512 - DNA, 22 bp, Artificial Sequence
  Synthetic oligonucleotide; CTA chr11 5319149 5319170 5319154 5319149 -
aaaatacaaaattagccggctg

SEQ ID NO: 127513 - DNA, 22 bp, Artificial Sequence
  Synthetic oligonucleotide; TTA chr11 5319135 5319156 5319140 5319135 -
gccggctgtggtggtgggggct

SEQ ID NO: 127514 - DNA, 22 bp, Artificial Sequence
  Synthetic oligonucleotide; CTG chr11 5319127 5319148 5319132 5319127 -
tggtggtgggggctgtaatccc

SEQ ID NO: 127515 - DNA, 22 bp, Artificial Sequence
  Synthetic oligonucleotide; CTG chr11 5319112 5319133 5319117 5319112 -
taatcccagctactcggaaggc

SEQ ID NO: 127516 - DNA, 22 bp, Artificial Sequence
  Synthetic oligonucleotide; CTA chr11 5319100 5319121 5319105 5319100 -
ctcggaaggctgaggcaggaga

SEQ ID NO: 127517 - DNA, 22 bp, Artificial Sequence
  Synthetic oligonucleotide; CTC chr11 5319097 5319118 5319102 5319097 -
ggaaggctgaggcaggagaatt

SEQ ID NO: 127518 - DNA, 22 bp, Artificial Sequence
  Synthetic oligonucleotide; CTG chr11 5319088 5319109 5319093 5319088 -
aggcaggagaattgcttgaact

SEQ ID NO: 127519 - DNA, 22 bp, Artificial Sequence
  Synthetic oligonucleotide; TTG chr11 5319074 5319095 5319079 5319074 -
cttgaactctggaggcagacgg

SEQ ID NO: 127520 - DNA, 22 bp, Artificial Sequence
  Synthetic oligonucleotide; CTT chr11 5319071 5319092 5319076 5319071 -
gaactctggaggcagacggtgc

SEQ ID NO: 127521 - DNA, 22 bp, Artificial Sequence
  Synthetic oligonucleotide; TTG chr11 5319070 5319091 5319075 5319070 -
aactctggaggcagacggtgca

SEQ ID NO: 127522 - DNA, 22 bp, Artificial Sequence
  Synthetic oligonucleotide; CTC chr11 5319065 5319086 5319070 5319065 -
tggaggcagacggtgcagtgag

SEQ ID NO: 127523 - DNA, 22 bp, Artificial Sequence
  Synthetic oligonucleotide; CTG chr11 5319063 5319084 5319068 5319063 -
gaggcagacggtgcagtgagcc

SEQ ID NO: 127524 - DNA, 22 bp, Artificial Sequence
  Synthetic oligonucleotide; CTG chr11 5319026 5319047 5319031 5319026 -
cactccagcctgggtgacagag

SEQ ID NO: 127525 - DNA, 22 bp, Artificial Sequence
  Synthetic oligonucleotide; CTC chr11 5319021 5319042 5319026 5319021 -
cagcctgggtgacagagtgaaa

SEQ ID NO: 127526 - DNA, 22 bp, Artificial Sequence
  Synthetic oligonucleotide; CTG chr11 5319014 5319035 5319019 5319014 -
ggtgacagagtgaaactctgaa

SEQ ID NO: 127527 - DNA, 22 bp, Artificial Sequence
  Synthetic oligonucleotide; CTC chr11 5318996 5319017 5319001 5318996 -
tgaaaaaataaaaaaagaaaga

SEQ ID NO: 127528 - DNA, 22 bp, Artificial Sequence
  Synthetic oligonucleotide; CTG chr11 5318994 5319015 5318999 5318994 -
aaaaaataaaaaaagaaagaaa

SEQ ID NO: 127529 - DNA, 22 bp, Artificial Sequence
  Synthetic oligonucleotide; CTA chr11 5318938 5318959 5318943 5318938 -
cattataaggccacagtacccc

SEQ ID NO: 127530 - DNA, 22 bp, Artificial Sequence
  Synthetic oligonucleotide; TTA chr11 5318933 5318954 5318938 5318933 -
taaggccacagtaccccaaaca

SEQ ID NO: 127531 - DNA, 22 bp, Artificial Sequence
  Synthetic oligonucleotide; TTG chr11 5318900 5318921 5318905 5318900 -
ttacaaaaatagacacattgac

SEQ ID NO: 127532 - DNA, 22 bp, Artificial Sequence
  Synthetic oligonucleotide; TTA chr11 5318897 5318918 5318902 5318897 -
caaaaatagacacattgactaa

SEQ ID NO: 127533 - DNA, 22 bp, Artificial Sequence
  Synthetic oligonucleotide; TTG chr11 5318880 5318901 5318885 5318880 -
actaaggaaacacaatagaaaa

SEQ ID NO: 127534 - DNA, 22 bp, Artificial Sequence
  Synthetic oligonucleotide; CTA chr11 5318876 5318897 5318881 5318876 -
aggaaacacaatagaaaactca

SEQ ID NO: 127535 - DNA, 22 bp, Artificial Sequence
  Synthetic oligonucleotide; CTC chr11 5318855 5318876 5318860 5318855 -
aaaaataaagctacatagttac

SEQ ID NO: 127536 - DNA, 22 bp, Artificial Sequence
  Synthetic oligonucleotide; CTA chr11 5318842 5318863 5318847 5318842 -
catagttacaaccatctgatct

SEQ ID NO: 127537 - DNA, 22 bp, Artificial Sequence
  Synthetic oligonucleotide; TTA chr11 5318834 5318855 5318839 5318834 -
caaccatctgatcttcaacaac

SEQ ID NO: 127538 - DNA, 22 bp, Artificial Sequence
  Synthetic oligonucleotide; CTG chr11 5318824 5318845 5318829 5318824 -
atcttcaacaacactgacaaaa

SEQ ID NO: 127539 - DNA, 22 bp, Artificial Sequence
  Synthetic oligonucleotide; CTT chr11 5318819 5318840 5318824 5318819 -
caacaacactgacaaaaacaag

SEQ ID NO: 127540 - DNA, 22 bp, Artificial Sequence
  Synthetic oligonucleotide; TTC chr11 5318818 5318839 5318823 5318818 -
aacaacactgacaaaaacaagc

SEQ ID NO: 127541 - DNA, 22 bp, Artificial Sequence
  Synthetic oligonucleotide; CTG chr11 5318808 5318829 5318813 5318808 -
acaaaaacaagcagcgggaaaa

SEQ ID NO: 127542 - DNA, 22 bp, Artificial Sequence
  Synthetic oligonucleotide; CTA chr11 5318780 5318801 5318785 5318780 -
cctatccaataaactgtgctgg

SEQ ID NO: 127543 - DNA, 22 bp, Artificial Sequence
  Synthetic oligonucleotide; CTA chr11 5318776 5318797 5318781 5318776 -
tccaataaactgtgctggaata

SEQ ID NO: 127544 - DNA, 22 bp, Artificial Sequence
  Synthetic oligonucleotide; CTG chr11 5318764 5318785 5318769 5318764 -
tgctggaatacgtggctagcca

SEQ ID NO: 127545 - DNA, 22 bp, Artificial Sequence
  Synthetic oligonucleotide; CTG chr11 5318759 5318780 5318764 5318759 -
gaatacgtggctagccatatgc

SEQ ID NO: 127546 - DNA, 22 bp, Artificial Sequence
  Synthetic oligonucleotide; CTA chr11 5318746 5318767 5318751 5318746 -
gccatatgcagaagaatgaaac

SEQ ID NO: 127547 - DNA, 22 bp, Artificial Sequence
  Synthetic oligonucleotide; CTA chr11 5318722 5318743 5318727 5318722 -
gacccttaccttacaccattta

SEQ ID NO: 127548 - DNA, 22 bp, Artificial Sequence
  Synthetic oligonucleotide; CTT chr11 5318715 5318736 5318720 5318715 -
accttacaccatttagagaaat

SEQ ID NO: 127549 - DNA, 22 bp, Artificial Sequence
  Synthetic oligonucleotide; TTA chr11 5318714 5318735 5318719 5318714 -
ccttacaccatttagagaaatc

SEQ ID NO: 127550 - DNA, 22 bp, Artificial Sequence
  Synthetic oligonucleotide; CTT chr11 5318710 5318731 5318715 5318710 -
acaccatttagagaaatcaact

SEQ ID NO: 127551 - DNA, 22 bp, Artificial Sequence
  Synthetic oligonucleotide; TTA chr11 5318709 5318730 5318714 5318709 -
caccatttagagaaatcaactg

SEQ ID NO: 127552 - DNA, 22 bp, Artificial Sequence
  Synthetic oligonucleotide; TTT chr11 5318701 5318722 5318706 5318701 -
agagaaatcaactgaaaatgaa

SEQ ID NO: 127553 - DNA, 22 bp, Artificial Sequence
  Synthetic oligonucleotide; TTA chr11 5318700 5318721 5318705 5318700 -
gagaaatcaactgaaaatgaat

SEQ ID NO: 127554 - DNA, 22 bp, Artificial Sequence
  Synthetic oligonucleotide; CTG chr11 5318687 5318708 5318692 5318687 -
aaaatgaattcaaaacttaaat

SEQ ID NO: 127555 - DNA, 22 bp, Artificial Sequence
  Synthetic oligonucleotide; TTC chr11 5318676 5318697 5318681 5318676 -
aaaacttaaatgtaagatctca

SEQ ID NO: 127556 - DNA, 22 bp, Artificial Sequence
  Synthetic oligonucleotide; CTT chr11 5318669 5318690 5318674 5318669 -
aaatgtaagatctcaaatctta

SEQ ID NO: 127557 - DNA, 22 bp, Artificial Sequence
  Synthetic oligonucleotide; TTA chr11 5318668 5318689 5318673 5318668 -
aatgtaagatctcaaatcttac

SEQ ID NO: 127558 - DNA, 22 bp, Artificial Sequence
  Synthetic oligonucleotide; CTC chr11 5318655 5318676 5318660 5318655 -
aaatcttacctgcactggcagt

SEQ ID NO: 127559 - DNA, 22 bp, Artificial Sequence
  Synthetic oligonucleotide; CTT chr11 5318648 5318669 5318653 5318648 -
acctgcactggcagtgcatttt

SEQ ID NO: 127560 - DNA, 22 bp, Artificial Sequence
  Synthetic oligonucleotide; TTA chr11 5318647 5318668 5318652 5318647 -
cctgcactggcagtgcattttt

SEQ ID NO: 127561 - DNA, 22 bp, Artificial Sequence
  Synthetic oligonucleotide; CTG chr11 5318643 5318664 5318648 5318643 -
cactggcagtgcatttttggct

SEQ ID NO: 127562 - DNA, 22 bp, Artificial Sequence
  Synthetic oligonucleotide; CTG chr11 5318638 5318659 5318643 5318638 -
gcagtgcatttttggctaagcc

SEQ ID NO: 127563 - DNA, 22 bp, Artificial Sequence
  Synthetic oligonucleotide; TTT chr11 5318627 5318648 5318632 5318627 -
ttggctaagcccccaaaagcaa

SEQ ID NO: 127564 - DNA, 22 bp, Artificial Sequence
  Synthetic oligonucleotide; TTT chr11 5318626 5318647 5318631 5318626 -
tggctaagcccccaaaagcaat

SEQ ID NO: 127565 - DNA, 22 bp, Artificial Sequence
  Synthetic oligonucleotide; TTT chr11 5318625 5318646 5318630 5318625 -
ggctaagcccccaaaagcaatt

SEQ ID NO: 127566 - DNA, 22 bp, Artificial Sequence
  Synthetic oligonucleotide; TTG chr11 5318624 5318645 5318629 5318624 -
gctaagcccccaaaagcaattg

SEQ ID NO: 127567 - DNA, 22 bp, Artificial Sequence
  Synthetic oligonucleotide; CTA chr11 5318620 5318641 5318625 5318620 -
agcccccaaaagcaattgcaat

SEQ ID NO: 127568 - DNA, 22 bp, Artificial Sequence
  Synthetic oligonucleotide; TTG chr11 5318602 5318623 5318607 5318602 -
caatgcaaagaaaaattcacaa

SEQ ID NO: 127569 - DNA, 22 bp, Artificial Sequence
  Synthetic oligonucleotide; TTC chr11 5318584 5318605 5318589 5318584 -
acaagtggaacctaattaaact

SEQ ID NO: 127570 - DNA, 22 bp, Artificial Sequence
  Synthetic oligonucleotide; CTA chr11 5318570 5318591 5318575 5318570 -
attaaactaaagagcttcacta

SEQ ID NO: 127571 - DNA, 22 bp, Artificial Sequence
  Synthetic oligonucleotide; TTA chr11 5318566 5318587 5318571 5318566 -
aactaaagagcttcactattca

SEQ ID NO: 127572 - DNA, 22 bp, Artificial Sequence
  Synthetic oligonucleotide; CTA chr11 5318561 5318582 5318566 5318561 -
aagagcttcactattcacaata

SEQ ID NO: 127573 - DNA, 22 bp, Artificial Sequence
  Synthetic oligonucleotide; CTT chr11 5318553 5318574 5318558 5318553 -
cactattcacaataacaaagac

SEQ ID NO: 127574 - DNA, 22 bp, Artificial Sequence
  Synthetic oligonucleotide; TTC chr11 5318552 5318573 5318557 5318552 -
actattcacaataacaaagact

SEQ ID NO: 127575 - DNA, 22 bp, Artificial Sequence
  Synthetic oligonucleotide; CTA chr11 5318548 5318569 5318553 5318548 -
ttcacaataacaaagacttgga

SEQ ID NO: 127576 - DNA, 22 bp, Artificial Sequence
  Synthetic oligonucleotide; TTC chr11 5318545 5318566 5318550 5318545 -
acaataacaaagacttggaacc

SEQ ID NO: 127577 - DNA, 22 bp, Artificial Sequence
  Synthetic oligonucleotide; CTT chr11 5318529 5318550 5318534 5318529 -
ggaaccaacccaaatgtccaac

SEQ ID NO: 127578 - DNA, 22 bp, Artificial Sequence
  Synthetic oligonucleotide; TTG chr11 5318528 5318549 5318533 5318528 -
gaaccaacccaaatgtccaaca

SEQ ID NO: 127579 - DNA, 22 bp, Artificial Sequence
  Synthetic oligonucleotide; TTA chr11 5318490 5318511 5318495 5318490 -
agaaaatgtggcacatatacac

SEQ ID NO: 127580 - DNA, 22 bp, Artificial Sequence
  Synthetic oligonucleotide; CTA chr11 5318456 5318477 5318461 5318456 -
tgcagccataaaaaatgatgag

SEQ ID NO: 127581 - DNA, 22 bp, Artificial Sequence
  Synthetic oligonucleotide; TTC chr11 5318431 5318452 5318436 5318431 -
atgtcctttgtagggacatgga

SEQ ID NO: 127582 - DNA, 22 bp, Artificial Sequence
  Synthetic oligonucleotide; CTT chr11 5318423 5318444 5318428 5318423 -
tgtagggacatggatgaagctg

SEQ ID NO: 127583 - DNA, 22 bp, Artificial Sequence
  Synthetic oligonucleotide; TTT chr11 5318422 5318443 5318427 5318422 -
gtagggacatggatgaagctgg

SEQ ID NO: 127584 - DNA, 22 bp, Artificial Sequence
  Synthetic oligonucleotide; TTG chr11 5318421 5318442 5318426 5318421 -
tagggacatggatgaagctgga

SEQ ID NO: 127585 - DNA, 22 bp, Artificial Sequence
  Synthetic oligonucleotide; CTG chr11 5318401 5318422 5318406 5318401 -
gaaaccatcattctcagcaaac

SEQ ID NO: 127586 - DNA, 22 bp, Artificial Sequence
  Synthetic oligonucleotide; TTC chr11 5318388 5318409 5318393 5318388 -
tcagcaaactatcacaaggaca

SEQ ID NO: 127587 - DNA, 22 bp, Artificial Sequence
  Synthetic oligonucleotide; CTC chr11 5318386 5318407 5318391 5318386 -
agcaaactatcacaaggacaaa

SEQ ID NO: 127588 - DNA, 22 bp, Artificial Sequence
  Synthetic oligonucleotide; CTA chr11 5318377 5318398 5318382 5318377 -
tcacaaggacaaaaaaccaaat

SEQ ID NO: 127589 - DNA, 22 bp, Artificial Sequence
  Synthetic oligonucleotide; TTC chr11 5318344 5318365 5318349 5318344 -
tcacttataggtgggaattgaa

SEQ ID NO: 127590 - DNA, 22 bp, Artificial Sequence
  Synthetic oligonucleotide; CTC chr11 5318342 5318363 5318347 5318342 -
acttataggtgggaattgaaca

SEQ ID NO: 127591 - DNA, 22 bp, Artificial Sequence
  Synthetic oligonucleotide; CTT chr11 5318338 5318359 5318343 5318338 -
ataggtgggaattgaacaatga

SEQ ID NO: 127592 - DNA, 22 bp, Artificial Sequence
  Synthetic oligonucleotide; TTA chr11 5318337 5318358 5318342 5318337 -
taggtgggaattgaacaatgag

SEQ ID NO: 127593 - DNA, 22 bp, Artificial Sequence
  Synthetic oligonucleotide; TTG chr11 5318324 5318345 5318329 5318324 -
aacaatgagaacacttggacag

SEQ ID NO: 127594 - DNA, 22 bp, Artificial Sequence
  Synthetic oligonucleotide; CTT chr11 5318308 5318329 5318313 5318308 -
ggacagaggaaggggaacatca

SEQ ID NO: 127595 - DNA, 22 bp, Artificial Sequence
  Synthetic oligonucleotide; TTG chr11 5318307 5318328 5318312 5318307 -
gacagaggaaggggaacatcac

SEQ ID NO: 127596 - DNA, 22 bp, Artificial Sequence
  Synthetic oligonucleotide; CTG chr11 5318272 5318293 5318277 5318272 -
ttgtggggtgggggtggggggt

SEQ ID NO: 127597 - DNA, 22 bp, Artificial Sequence
  Synthetic oligonucleotide; TTG chr11 5318269 5318290 5318274 5318269 -
tggggtgggggtggggggtgga

SEQ ID NO: 127598 - DNA, 22 bp, Artificial Sequence
  Synthetic oligonucleotide; TTA chr11 5318233 5318254 5318238 5318233 -
ggagatatacctaatgtaaatg

SEQ ID NO: 127599 - DNA, 22 bp, Artificial Sequence
  Synthetic oligonucleotide; CTA chr11 5318220 5318241 5318225 5318220 -
atgtaaatgatgagttaatggg

SEQ ID NO: 127600 - DNA, 22 bp, Artificial Sequence
  Synthetic oligonucleotide; TTA chr11 5318203 5318224 5318208 5318203 -
atgggtgcagcacaccaacatg

SEQ ID NO: 127601 - DNA, 22 bp, Artificial Sequence
  Synthetic oligonucleotide; CTG chr11 5318153 5318174 5318158 5318153 -
cacgttgcgcacatgtacccta

SEQ ID NO: 127602 - DNA, 22 bp, Artificial Sequence
  Synthetic oligonucleotide; TTG chr11 5318146 5318167 5318151 5318146 -
cgcacatgtaccctagaactta

SEQ ID NO: 127603 - DNA, 22 bp, Artificial Sequence
  Synthetic oligonucleotide; CTA chr11 5318131 5318152 5318136 5318131 -
gaacttaaagtataataataat

SEQ ID NO: 127604 - DNA, 22 bp, Artificial Sequence
  Synthetic oligonucleotide; CTT chr11 5318125 5318146 5318130 5318125 -
aaagtataataataataataaa

SEQ ID NO: 127605 - DNA, 22 bp, Artificial Sequence
  Synthetic oligonucleotide; TTA chr11 5318124 5318145 5318129 5318124 -
aagtataataataataataaaa

SEQ ID NO: 127606 - DNA, 22 bp, Artificial Sequence
  Synthetic oligonucleotide; CTT chr11 5318095 5318116 5318100 5318095 -
ctgtgcagcagaagaaactatc

SEQ ID NO: 127607 - DNA, 22 bp, Artificial Sequence
  Synthetic oligonucleotide; TTC chr11 5318094 5318115 5318099 5318094 -
tgtgcagcagaagaaactatca

SEQ ID NO: 127608 - DNA, 22 bp, Artificial Sequence
  Synthetic oligonucleotide; CTG chr11 5318092 5318113 5318097 5318092 -
tgcagcagaagaaactatcaac

SEQ ID NO: 127609 - DNA, 22 bp, Artificial Sequence
  Synthetic oligonucleotide; CTA chr11 5318075 5318096 5318080 5318075 -
tcaacagagtaaactgacaatc

SEQ ID NO: 127610 - DNA, 22 bp, Artificial Sequence
  Synthetic oligonucleotide; CTG chr11 5318059 5318080 5318064 5318059 -
acaatctacaggataggagaaa

SEQ ID NO: 127611 - DNA, 22 bp, Artificial Sequence
  Synthetic oligonucleotide; CTA chr11 5318051 5318072 5318056 5318051 -
caggataggagaaactattcac

SEQ ID NO: 127612 - DNA, 22 bp, Artificial Sequence
  Synthetic oligonucleotide; CTA chr11 5318034 5318055 5318039 5318034 -
ttcacaaactgtgcatctggaa

SEQ ID NO: 127613 - DNA, 22 bp, Artificial Sequence
  Synthetic oligonucleotide; TTC chr11 5318031 5318052 5318036 5318031 -
acaaactgtgcatctggaaaag

SEQ ID NO: 127614 - DNA, 22 bp, Artificial Sequence
  Synthetic oligonucleotide; CTG chr11 5318023 5318044 5318028 5318023 -
tgcatctggaaaaggtctaata

SEQ ID NO: 127615 - DNA, 22 bp, Artificial Sequence
  Synthetic oligonucleotide; CTG chr11 5318015 5318036 5318020 5318015 -
gaaaaggtctaatattcagaat

SEQ ID NO: 127616 - DNA, 22 bp, Artificial Sequence
  Synthetic oligonucleotide; CTA chr11 5318004 5318025 5318009 5318004 -
atattcagaatctataaggaat

SEQ ID NO: 127617 - DNA, 22 bp, Artificial Sequence
  Synthetic oligonucleotide; TTC chr11 5317998 5318019 5318003 5317998 -
agaatctataaggaattcgaac

SEQ ID NO: 127618 - DNA, 22 bp, Artificial Sequence
  Synthetic oligonucleotide; CTA chr11 5317990 5318011 5317995 5317990 -
taaggaattcgaacatatcagc

SEQ ID NO: 127619 - DNA, 22 bp, Artificial Sequence
  Synthetic oligonucleotide; TTC chr11 5317980 5318001 5317985 5317980 -
gaacatatcagcaagcaaaaag

SEQ ID NO: 127620 - DNA, 22 bp, Artificial Sequence
  Synthetic oligonucleotide; TTC chr11 5317948 5317969 5317953 5317948 -
catttaaaaatgggcaaaatcc

SEQ ID NO: 127621 - DNA, 22 bp, Artificial Sequence
  Synthetic oligonucleotide; TTT chr11 5317943 5317964 5317948 5317943 -
aaaaatgggcaaaatccacgaa

SEQ ID NO: 127622 - DNA, 22 bp, Artificial Sequence
  Synthetic oligonucleotide; TTA chr11 5317942 5317963 5317947 5317942 -
aaaatgggcaaaatccacgaac

SEQ ID NO: 127623 - DNA, 22 bp, Artificial Sequence
  Synthetic oligonucleotide; CTC chr11 5317914 5317935 5317919 5317914 -
ttctcaagagaagacatacagg

SEQ ID NO: 127624 - DNA, 22 bp, Artificial Sequence
  Synthetic oligonucleotide; CTT chr11 5317912 5317933 5317917 5317912 -
ctcaagagaagacatacaggca

SEQ ID NO: 127625 - DNA, 22 bp, Artificial Sequence
  Synthetic oligonucleotide; TTC chr11 5317911 5317932 5317916 5317911 -
tcaagagaagacatacaggcag

SEQ ID NO: 127626 - DNA, 22 bp, Artificial Sequence
  Synthetic oligonucleotide; CTC chr11 5317909 5317930 5317914 5317909 -
aagagaagacatacaggcagcc

SEQ ID NO: 127627 - DNA, 22 bp, Artificial Sequence
  Synthetic oligonucleotide; CTA chr11 5317854 5317875 5317859 5317854 -
atgagagaaatgcaaatcaaaa

SEQ ID NO: 127628 - DNA, 22 bp, Artificial Sequence
  Synthetic oligonucleotide; CTA chr11 5317817 5317838 5317822 5317817 -
tctcataccagtcagaatagct

SEQ ID NO: 127629 - DNA, 22 bp, Artificial Sequence
  Synthetic oligonucleotide; CTC chr11 5317813 5317834 5317818 5317813 -
ataccagtcagaatagctattt

SEQ ID NO: 127630 - DNA, 22 bp, Artificial Sequence
  Synthetic oligonucleotide; CTA chr11 5317794 5317815 5317799 5317794 -
tttttaaaaagccaaaaaacag

SEQ ID NO: 127631 - DNA, 22 bp, Artificial Sequence
  Synthetic oligonucleotide; TTT chr11 5317791 5317812 5317796 5317791 -
ttaaaaagccaaaaaacagatt

SEQ ID NO: 127632 - DNA, 22 bp, Artificial Sequence
  Synthetic oligonucleotide; TTT chr11 5317790 5317811 5317795 5317790 -
taaaaagccaaaaaacagattc

SEQ ID NO: 127633 - DNA, 22 bp, Artificial Sequence
  Synthetic oligonucleotide; TTT chr11 5317789 5317810 5317794 5317789 -
aaaaagccaaaaaacagattct

SEQ ID NO: 127634 - DNA, 22 bp, Artificial Sequence
  Synthetic oligonucleotide; TTA chr11 5317788 5317809 5317793 5317788 -
aaaagccaaaaaacagattctc

SEQ ID NO: 127635 - DNA, 22 bp, Artificial Sequence
  Synthetic oligonucleotide; TTC chr11 5317768 5317789 5317773 5317768 -
tcatgaggctatggagaaaagg

SEQ ID NO: 127636 - DNA, 22 bp, Artificial Sequence
  Synthetic oligonucleotide; CTC chr11 5317766 5317787 5317771 5317766 -
atgaggctatggagaaaaggga

SEQ ID NO: 127637 - DNA, 22 bp, Artificial Sequence
  Synthetic oligonucleotide; CTA chr11 5317757 5317778 5317762 5317757 -
tggagaaaagggaacacttata

SEQ ID NO: 127638 - DNA, 22 bp, Artificial Sequence
  Synthetic oligonucleotide; CTT chr11 5317738 5317759 5317743 5317738 -
atacaatgatgatggggatgta

SEQ ID NO: 127639 - DNA, 22 bp, Artificial Sequence
  Synthetic oligonucleotide; TTA chr11 5317737 5317758 5317742 5317737 -
tacaatgatgatggggatgtaa

SEQ ID NO: 127640 - DNA, 22 bp, Artificial Sequence
  Synthetic oligonucleotide; TTA chr11 5317711 5317732 5317716 5317711 -
gttcaaccactgcagaaaacag

SEQ ID NO: 127641 - DNA, 22 bp, Artificial Sequence
  Synthetic oligonucleotide; TTC chr11 5317707 5317728 5317712 5317707 -
aaccactgcagaaaacagtttg

SEQ ID NO: 127642 - DNA, 22 bp, Artificial Sequence
  Synthetic oligonucleotide; CTG chr11 5317699 5317720 5317704 5317699 -
cagaaaacagtttggagagtct

SEQ ID NO: 127643 - DNA, 22 bp, Artificial Sequence
  Synthetic oligonucleotide; TTT chr11 5317686 5317707 5317691 5317686 -
ggagagtcttcaaagaacttta

SEQ ID NO: 127644 - DNA, 22 bp, Artificial Sequence
  Synthetic oligonucleotide; TTG chr11 5317685 5317706 5317690 5317685 -
gagagtcttcaaagaactttaa

SEQ ID NO: 127645 - DNA, 22 bp, Artificial Sequence
  Synthetic oligonucleotide; CTT chr11 5317676 5317697 5317681 5317676 -
caaagaactttaagcagagcta

SEQ ID NO: 127646 - DNA, 22 bp, Artificial Sequence
  Synthetic oligonucleotide; TTC chr11 5317675 5317696 5317680 5317675 -
aaagaactttaagcagagctac

SEQ ID NO: 127647 - DNA, 22 bp, Artificial Sequence
  Synthetic oligonucleotide; CTT chr11 5317666 5317687 5317671 5317666 -
taagcagagctacaatttgaca

SEQ ID NO: 127648 - DNA, 22 bp, Artificial Sequence
  Synthetic oligonucleotide; TTT chr11 5317665 5317686 5317670 5317665 -
aagcagagctacaatttgacac

SEQ ID NO: 127649 - DNA, 22 bp, Artificial Sequence
  Synthetic oligonucleotide; TTA chr11 5317664 5317685 5317669 5317664 -
agcagagctacaatttgacaca

SEQ ID NO: 127650 - DNA, 22 bp, Artificial Sequence
  Synthetic oligonucleotide; CTA chr11 5317654 5317675 5317659 5317654 -
caatttgacacagcaatcccgc

SEQ ID NO: 127651 - DNA, 22 bp, Artificial Sequence
  Synthetic oligonucleotide; TTT chr11 5317648 5317669 5317653 5317648 -
gacacagcaatcccgctactgg

SEQ ID NO: 127652 - DNA, 22 bp, Artificial Sequence
  Synthetic oligonucleotide; TTG chr11 5317647 5317668 5317652 5317647 -
acacagcaatcccgctactggg

SEQ ID NO: 127653 - DNA, 22 bp, Artificial Sequence
  Synthetic oligonucleotide; CTA chr11 5317630 5317651 5317635 5317630 -
ctgggtatatatccataggaaa

SEQ ID NO: 127654 - DNA, 22 bp, Artificial Sequence
  Synthetic oligonucleotide; CTG chr11 5317627 5317648 5317632 5317627 -
ggtatatatccataggaaaaca

SEQ ID NO: 127655 - DNA, 22 bp, Artificial Sequence
  Synthetic oligonucleotide; TTA chr11 5317597 5317618 5317602 5317597 -
gaccaactagacacatgcactt

SEQ ID NO: 127656 - DNA, 22 bp, Artificial Sequence
  Synthetic oligonucleotide; CTA chr11 5317588 5317609 5317593 5317588 -
gacacatgcacttgcatgttca

SEQ ID NO: 127657 - DNA, 22 bp, Artificial Sequence
  Synthetic oligonucleotide; CTT chr11 5317575 5317596 5317580 5317575 -
gcatgttcactgtaatgctgtt

SEQ ID NO: 127658 - DNA, 22 bp, Artificial Sequence
  Synthetic oligonucleotide; TTG chr11 5317574 5317595 5317579 5317574 -
catgttcactgtaatgctgttt

SEQ ID NO: 127659 - DNA, 22 bp, Artificial Sequence
  Synthetic oligonucleotide; TTC chr11 5317567 5317588 5317572 5317567 -
actgtaatgctgtttagaatag

SEQ ID NO: 127660 - DNA, 22 bp, Artificial Sequence
  Synthetic oligonucleotide; CTG chr11 5317563 5317584 5317568 5317563 -
taatgctgtttagaatagcaaa

SEQ ID NO: 127661 - DNA, 22 bp, Artificial Sequence
  Synthetic oligonucleotide; CTG chr11 5317555 5317576 5317560 5317555 -
tttagaatagcaaatacaaata

SEQ ID NO: 127662 - DNA, 22 bp, Artificial Sequence
  Synthetic oligonucleotide; TTT chr11 5317552 5317573 5317557 5317552 -
agaatagcaaatacaaataact

SEQ ID NO: 127663 - DNA, 22 bp, Artificial Sequence
  Synthetic oligonucleotide; TTA chr11 5317551 5317572 5317556 5317551 -
gaatagcaaatacaaataactg

SEQ ID NO: 127664 - DNA, 22 bp, Artificial Sequence
  Synthetic oligonucleotide; CTG chr11 5317529 5317550 5317534 5317529 -
gcctaggtgtctatcaaaggcg

SEQ ID NO: 127665 - DNA, 22 bp, Artificial Sequence
  Synthetic oligonucleotide; CTA chr11 5317524 5317545 5317529 5317524 -
ggtgtctatcaaaggcggacgg

SEQ ID NO: 127666 - DNA, 22 bp, Artificial Sequence
  Synthetic oligonucleotide; CTA chr11 5317516 5317537 5317521 5317516 -
tcaaaggcggacgggataaaga

SEQ ID NO: 127667 - DNA, 22 bp, Artificial Sequence
  Synthetic oligonucleotide; CTG chr11 5317489 5317510 5317494 5317489 -
tggtacatatacaccaccacta

SEQ ID NO: 127668 - DNA, 22 bp, Artificial Sequence
  Synthetic oligonucleotide; CTA chr11 5317467 5317488 5317472 5317467 -
tgtggcaataagaacaaatgaa

SEQ ID NO: 127669 - DNA, 22 bp, Artificial Sequence
  Synthetic oligonucleotide; CTT chr11 5317434 5317455 5317439 5317434 -
ttcagcaacatgggtggagctg

SEQ ID NO: 127670 - DNA, 22 bp, Artificial Sequence
  Synthetic oligonucleotide; TTT chr11 5317433 5317454 5317438 5317433 -
tcagcaacatgggtggagctgg

SEQ ID NO: 127671 - DNA, 22 bp, Artificial Sequence
  Synthetic oligonucleotide; TTT chr11 5317432 5317453 5317437 5317432 -
cagcaacatgggtggagctgga

SEQ ID NO: 127672 - DNA, 22 bp, Artificial Sequence
  Synthetic oligonucleotide; TTC chr11 5317431 5317452 5317436 5317431 -
agcaacatgggtggagctggag

SEQ ID NO: 127673 - DNA, 22 bp, Artificial Sequence
  Synthetic oligonucleotide; CTG chr11 5317412 5317433 5317417 5317412 -
gaggctataatcctaagcaaat

SEQ ID NO: 127674 - DNA, 22 bp, Artificial Sequence
  Synthetic oligonucleotide; CTA chr11 5317405 5317426 5317410 5317405 -
taatcctaagcaaattaacgca

SEQ ID NO: 127675 - DNA, 22 bp, Artificial Sequence
  Synthetic oligonucleotide; CTA chr11 5317397 5317418 5317402 5317397 -
agcaaattaacgcaagaacaca

SEQ ID NO: 127676 - DNA, 22 bp, Artificial Sequence
  Synthetic oligonucleotide; TTA chr11 5317388 5317409 5317393 5317388 -
acgcaagaacacaaaagcaaat

SEQ ID NO: 127677 - DNA, 22 bp, Artificial Sequence
  Synthetic oligonucleotide; TTC chr11 5317355 5317376 5317360 5317355 -
tcatttataagtggaagctaaa

SEQ ID NO: 127678 - DNA, 22 bp, Artificial Sequence
  Synthetic oligonucleotide; CTC chr11 5317353 5317374 5317358 5317353 -
atttataagtggaagctaaaca

SEQ ID NO: 127679 - DNA, 22 bp, Artificial Sequence
  Synthetic oligonucleotide; TTT chr11 5317349 5317370 5317354 5317349 -
ataagtggaagctaaacattga

SEQ ID NO: 127680 - DNA, 22 bp, Artificial Sequence
  Synthetic oligonucleotide; TTA chr11 5317348 5317369 5317353 5317348 -
taagtggaagctaaacattgag

SEQ ID NO: 127681 - DNA, 22 bp, Artificial Sequence
  Synthetic oligonucleotide; CTA chr11 5317335 5317356 5317340 5317335 -
aacattgagtacacgtggatat

SEQ ID NO: 127682 - DNA, 22 bp, Artificial Sequence
  Synthetic oligonucleotide; TTG chr11 5317328 5317349 5317333 5317328 -
agtacacgtggatataaacatg

SEQ ID NO: 127683 - DNA, 22 bp, Artificial Sequence
  Synthetic oligonucleotide; CTT chr11 5317290 5317311 5317295 5317290 -
gaaactactacaaggggcaggg

SEQ ID NO: 127684 - DNA, 22 bp, Artificial Sequence
  Synthetic oligonucleotide; TTG chr11 5317289 5317310 5317294 5317289 -
aaactactacaaggggcaggga

SEQ ID NO: 127685 - DNA, 22 bp, Artificial Sequence
  Synthetic oligonucleotide; CTA chr11 5317283 5317304 5317288 5317283 -
ctacaaggggcagggagagatg

SEQ ID NO: 127686 - DNA, 22 bp, Artificial Sequence
  Synthetic oligonucleotide; CTA chr11 5317280 5317301 5317285 5317280 -
caaggggcagggagagatgcgg

SEQ ID NO: 127687 - DNA, 22 bp, Artificial Sequence
  Synthetic oligonucleotide; TTA chr11 5317248 5317269 5317253 5317248 -
aaaaatctattggatagtatgc

SEQ ID NO: 127688 - DNA, 22 bp, Artificial Sequence
  Synthetic oligonucleotide; CTA chr11 5317239 5317260 5317244 5317239 -
ttggatagtatgctcaccactg

SEQ ID NO: 127689 - DNA, 22 bp, Artificial Sequence
  Synthetic oligonucleotide; TTG chr11 5317236 5317257 5317241 5317236 -
gatagtatgctcaccactgcat

SEQ ID NO: 127690 - DNA, 22 bp, Artificial Sequence
  Synthetic oligonucleotide; CTC chr11 5317224 5317245 5317229 5317224 -
accactgcatgcaatatatcca

SEQ ID NO: 127691 - DNA, 22 bp, Artificial Sequence
  Synthetic oligonucleotide; CTG chr11 5317217 5317238 5317222 5317217 -
catgcaatatatccatgtaaaa

SEQ ID NO: 127692 - DNA, 22 bp, Artificial Sequence
  Synthetic oligonucleotide; CTG chr11 5317189 5317210 5317194 5317189 -
cacaagtacccactgtatctaa

SEQ ID NO: 127693 - DNA, 22 bp, Artificial Sequence
  Synthetic oligonucleotide; CTG chr11 5317174 5317195 5317179 5317174 -
tatctaaagtaaatgttgaaaa

SEQ ID NO: 127694 - DNA, 22 bp, Artificial Sequence
  Synthetic oligonucleotide; CTA chr11 5317168 5317189 5317173 5317168 -
aagtaaatgttgaaaatttaaa

SEQ ID NO: 127695 - DNA, 22 bp, Artificial Sequence
  Synthetic oligonucleotide; TTG chr11 5317156 5317177 5317161 5317156 -
aaaatttaaaagaaaaaacaaa

SEQ ID NO: 127696 - DNA, 22 bp, Artificial Sequence
  Synthetic oligonucleotide; TTT chr11 5317149 5317170 5317154 5317149 -
aaaagaaaaaacaaataaataa

SEQ ID NO: 127697 - DNA, 22 bp, Artificial Sequence
  Synthetic oligonucleotide; TTA chr11 5317148 5317169 5317153 5317148 -
aaagaaaaaacaaataaataaa

SEQ ID NO: 127698 - DNA, 22 bp, Artificial Sequence
  Synthetic oligonucleotide; CTA chr11 5317116 5317137 5317121 5317116 -
tcctgaacctggtatgaaatgg

SEQ ID NO: 127699 - DNA, 22 bp, Artificial Sequence
  Synthetic oligonucleotide; CTG chr11 5317111 5317132 5317116 5317111 -
aacctggtatgaaatgggcagt

SEQ ID NO: 127700 - DNA, 22 bp, Artificial Sequence
  Synthetic oligonucleotide; CTG chr11 5317105 5317126 5317110 5317105 -
gtatgaaatgggcagtgatttt

SEQ ID NO: 127701 - DNA, 22 bp, Artificial Sequence
  Synthetic oligonucleotide; TTT chr11 5317084 5317105 5317089 5317084 -
ttatataaacaaagttatttta

SEQ ID NO: 127702 - DNA, 22 bp, Artificial Sequence
  Synthetic oligonucleotide; TTT chr11 5317083 5317104 5317088 5317083 -
tatataaacaaagttattttaa

SEQ ID NO: 127703 - DNA, 22 bp, Artificial Sequence
  Synthetic oligonucleotide; TTT chr11 5317082 5317103 5317087 5317082 -
atataaacaaagttattttaag

SEQ ID NO: 127704 - DNA, 22 bp, Artificial Sequence
  Synthetic oligonucleotide; TTA chr11 5317081 5317102 5317086 5317081 -
tataaacaaagttattttaaga

SEQ ID NO: 127705 - DNA, 22 bp, Artificial Sequence
  Synthetic oligonucleotide; TTA chr11 5317067 5317088 5317072 5317067 -
ttttaagacaaaatataatagg

SEQ ID NO: 127706 - DNA, 22 bp, Artificial Sequence
  Synthetic oligonucleotide; TTT chr11 5317064 5317085 5317069 5317064 -
taagacaaaatataataggccc

SEQ ID NO: 127707 - DNA, 22 bp, Artificial Sequence
  Synthetic oligonucleotide; TTT chr11 5317063 5317084 5317068 5317063 -
aagacaaaatataataggccct

SEQ ID NO: 127708 - DNA, 22 bp, Artificial Sequence
  Synthetic oligonucleotide; TTA chr11 5317062 5317083 5317067 5317062 -
agacaaaatataataggccctt

SEQ ID NO: 127709 - DNA, 22 bp, Artificial Sequence
  Synthetic oligonucleotide; CTT chr11 5317040 5317061 5317045 5317040 -
catttacttggctattaataga

SEQ ID NO: 127710 - DNA, 22 bp, Artificial Sequence
  Synthetic oligonucleotide; TTC chr11 5317039 5317060 5317044 5317039 -
atttacttggctattaatagat

SEQ ID NO: 127711 - DNA, 22 bp, Artificial Sequence
  Synthetic oligonucleotide; TTT chr11 5317035 5317056 5317040 5317035 -
acttggctattaatagatccat

SEQ ID NO: 127712 - DNA, 22 bp, Artificial Sequence
  Synthetic oligonucleotide; TTA chr11 5317034 5317055 5317039 5317034 -
cttggctattaatagatccatt

SEQ ID NO: 127713 - DNA, 22 bp, Artificial Sequence
  Synthetic oligonucleotide; CTT chr11 5317031 5317052 5317036 5317031 -
ggctattaatagatccattgag

SEQ ID NO: 127714 - DNA, 22 bp, Artificial Sequence
  Synthetic oligonucleotide; TTG chr11 5317030 5317051 5317035 5317030 -
gctattaatagatccattgagg

SEQ ID NO: 127715 - DNA, 22 bp, Artificial Sequence
  Synthetic oligonucleotide; CTA chr11 5317026 5317047 5317031 5317026 -
ttaatagatccattgaggttcc

SEQ ID NO: 127716 - DNA, 22 bp, Artificial Sequence
  Synthetic oligonucleotide; TTA chr11 5317023 5317044 5317028 5317023 -
atagatccattgaggttcctgt

SEQ ID NO: 127717 - DNA, 22 bp, Artificial Sequence
  Synthetic oligonucleotide; TTG chr11 5317011 5317032 5317016 5317011 -
aggttcctgtggatcagaactg

SEQ ID NO: 127718 - DNA, 22 bp, Artificial Sequence
  Synthetic oligonucleotide; TTC chr11 5317005 5317026 5317010 5317005 -
ctgtggatcagaactgattttc

SEQ ID NO: 127719 - DNA, 22 bp, Artificial Sequence
  Synthetic oligonucleotide; CTG chr11 5317002 5317023 5317007 5317002 -
tggatcagaactgattttccca

SEQ ID NO: 127720 - DNA, 22 bp, Artificial Sequence
  Synthetic oligonucleotide; CTG chr11 5316989 5317010 5316994 5316989 -
attttcccaaagtatcagaaaa

SEQ ID NO: 127721 - DNA, 22 bp, Artificial Sequence
  Synthetic oligonucleotide; TTT chr11 5316985 5317006 5316990 5316985 -
tcccaaagtatcagaaaagaca

SEQ ID NO: 127722 - DNA, 22 bp, Artificial Sequence
  Synthetic oligonucleotide; TTT chr11 5316984 5317005 5316989 5316984 -
cccaaagtatcagaaaagacaa

SEQ ID NO: 127723 - DNA, 22 bp, Artificial Sequence
  Synthetic oligonucleotide; TTC chr11 5316983 5317004 5316988 5316983 -
ccaaagtatcagaaaagacaac

SEQ ID NO: 127724 - DNA, 22 bp, Artificial Sequence
  Synthetic oligonucleotide; TTG chr11 5316951 5316972 5316956 5316951 -
aaatgcataaactccaggacaa

SEQ ID NO: 127725 - DNA, 22 bp, Artificial Sequence
  Synthetic oligonucleotide; CTC chr11 5316937 5316958 5316942 5316937 -
caggacaaagacacatgtgacc

SEQ ID NO: 127726 - DNA, 22 bp, Artificial Sequence
  Synthetic oligonucleotide; CTG chr11 5316912 5316933 5316917 5316912 -
cattcaactagtatctctcaat

SEQ ID NO: 127727 - DNA, 22 bp, Artificial Sequence
  Synthetic oligonucleotide; TTC chr11 5316907 5316928 5316912 5316907 -
aactagtatctctcaatacttt

SEQ ID NO: 127728 - DNA, 22 bp, Artificial Sequence
  Synthetic oligonucleotide; CTA chr11 5316902 5316923 5316907 5316902 -
gtatctctcaatactttgcatt

SEQ ID NO: 127729 - DNA, 22 bp, Artificial Sequence
  Synthetic oligonucleotide; CTC chr11 5316895 5316916 5316900 5316895 -
tcaatactttgcattgtattga

SEQ ID NO: 127730 - DNA, 22 bp, Artificial Sequence
  Synthetic oligonucleotide; CTC chr11 5316893 5316914 5316898 5316893 -
aatactttgcattgtattgaga

SEQ ID NO: 127731 - DNA, 22 bp, Artificial Sequence
  Synthetic oligonucleotide; CTT chr11 5316886 5316907 5316891 5316886 -
tgcattgtattgagacagacaa

SEQ ID NO: 127732 - DNA, 22 bp, Artificial Sequence
  Synthetic oligonucleotide; TTT chr11 5316885 5316906 5316890 5316885 -
gcattgtattgagacagacaat

SEQ ID NO: 127733 - DNA, 22 bp, Artificial Sequence
  Synthetic oligonucleotide; TTG chr11 5316884 5316905 5316889 5316884 -
cattgtattgagacagacaatg

SEQ ID NO: 127734 - DNA, 22 bp, Artificial Sequence
  Synthetic oligonucleotide; TTG chr11 5316879 5316900 5316884 5316879 -
tattgagacagacaatgcaaag

SEQ ID NO: 127735 - DNA, 22 bp, Artificial Sequence
  Synthetic oligonucleotide; TTG chr11 5316874 5316895 5316879 5316874 -
agacagacaatgcaaagtacac

SEQ ID NO: 127736 - DNA, 22 bp, Artificial Sequence
  Synthetic oligonucleotide; CTG chr11 5316838 5316859 5316843 5316838 -
tgtactgatgcttagggtcctg

SEQ ID NO: 127737 - DNA, 22 bp, Artificial Sequence
  Synthetic oligonucleotide; CTG chr11 5316831 5316852 5316836 5316831 -
atgcttagggtcctgaagggtc

SEQ ID NO: 127738 - DNA, 22 bp, Artificial Sequence
  Synthetic oligonucleotide; CTT chr11 5316825 5316846 5316830 5316825 -
agggtcctgaagggtcacataa

SEQ ID NO: 127739 - DNA, 22 bp, Artificial Sequence
  Synthetic oligonucleotide; TTA chr11 5316824 5316845 5316829 5316824 -
gggtcctgaagggtcacataat

SEQ ID NO: 127740 - DNA, 22 bp, Artificial Sequence
  Synthetic oligonucleotide; CTG chr11 5316816 5316837 5316821 5316816 -
aagggtcacataattaagtcct

SEQ ID NO: 127741 - DNA, 22 bp, Artificial Sequence
  Synthetic oligonucleotide; TTA chr11 5316800 5316821 5316805 5316800 -
agtcctggcatcccaatgtaga

SEQ ID NO: 127742 - DNA, 22 bp, Artificial Sequence
  Synthetic oligonucleotide; CTG chr11 5316793 5316814 5316798 5316793 -
gcatcccaatgtagaggtggca

SEQ ID NO: 127743 - DNA, 22 bp, Artificial Sequence
  Synthetic oligonucleotide; TTG chr11 5316768 5316789 5316773 5316768 -
gagtatgcagcttttctcatcc

SEQ ID NO: 127744 - DNA, 22 bp, Artificial Sequence
  Synthetic oligonucleotide; CTT chr11 5316755 5316776 5316760 5316755 -
ttctcatccatccttggagaaa

SEQ ID NO: 127745 - DNA, 22 bp, Artificial Sequence
  Synthetic oligonucleotide; TTT chr11 5316754 5316775 5316759 5316754 -
tctcatccatccttggagaaat

SEQ ID NO: 127746 - DNA, 22 bp, Artificial Sequence
  Synthetic oligonucleotide; TTT chr11 5316753 5316774 5316758 5316753 -
ctcatccatccttggagaaata

SEQ ID NO: 127747 - DNA, 22 bp, Artificial Sequence
  Synthetic oligonucleotide; TTC chr11 5316752 5316773 5316757 5316752 -
tcatccatccttggagaaatac

SEQ ID NO: 127748 - DNA, 22 bp, Artificial Sequence
  Synthetic oligonucleotide; CTC chr11 5316750 5316771 5316755 5316750 -
atccatccttggagaaatacct

SEQ ID NO: 127749 - DNA, 22 bp, Artificial Sequence
  Synthetic oligonucleotide; CTT chr11 5316740 5316761 5316745 5316740 -
ggagaaatacctgaaagttccg

SEQ ID NO: 127750 - DNA, 22 bp, Artificial Sequence
  Synthetic oligonucleotide; TTG chr11 5316739 5316760 5316744 5316739 -
gagaaatacctgaaagttccga

SEQ ID NO: 127751 - DNA, 22 bp, Artificial Sequence
  Synthetic oligonucleotide; CTG chr11 5316727 5316748 5316732 5316727 -
aaagttccgaggacattggttg

SEQ ID NO: 127752 - DNA, 22 bp, Artificial Sequence
  Synthetic oligonucleotide; TTC chr11 5316720 5316741 5316725 5316720 -
cgaggacattggttgagcgtcc

SEQ ID NO: 127753 - DNA, 22 bp, Artificial Sequence
  Synthetic oligonucleotide; TTG chr11 5316709 5316730 5316714 5316709 -
gttgagcgtccctgcttctccc

SEQ ID NO: 127754 - DNA, 22 bp, Artificial Sequence
  Synthetic oligonucleotide; TTG chr11 5316705 5316726 5316710 5316705 -
agcgtccctgcttctcccagac

SEQ ID NO: 127755 - DNA, 22 bp, Artificial Sequence
  Synthetic oligonucleotide; CTG chr11 5316695 5316716 5316700 5316695 -
cttctcccagacagaggaggga

SEQ ID NO: 127756 - DNA, 22 bp, Artificial Sequence
  Synthetic oligonucleotide; CTT chr11 5316692 5316713 5316697 5316692 -
ctcccagacagaggagggaggg

SEQ ID NO: 127757 - DNA, 22 bp, Artificial Sequence
  Synthetic oligonucleotide; TTC chr11 5316691 5316712 5316696 5316691 -
tcccagacagaggagggagggg

SEQ ID NO: 127758 - DNA, 22 bp, Artificial Sequence
  Synthetic oligonucleotide; CTC chr11 5316689 5316710 5316694 5316689 -
ccagacagaggagggaggggag

SEQ ID NO: 127759 - DNA, 22 bp, Artificial Sequence
  Synthetic oligonucleotide; TTC chr11 5316656 5316677 5316661 5316656 -
ttctgagtatttggaaagagga

SEQ ID NO: 127760 - DNA, 22 bp, Artificial Sequence
  Synthetic oligonucleotide; CTT chr11 5316654 5316675 5316659 5316654 -
ctgagtatttggaaagaggaaa

SEQ ID NO: 127761 - DNA, 22 bp, Artificial Sequence
  Synthetic oligonucleotide; TTC chr11 5316653 5316674 5316658 5316653 -
tgagtatttggaaagaggaaac

SEQ ID NO: 127762 - DNA, 22 bp, Artificial Sequence
  Synthetic oligonucleotide; CTG chr11 5316651 5316672 5316656 5316651 -
agtatttggaaagaggaaactc

SEQ ID NO: 127763 - DNA, 22 bp, Artificial Sequence
  Synthetic oligonucleotide; TTT chr11 5316644 5316665 5316649 5316644 -
ggaaagaggaaactctggggaa

SEQ ID NO: 127764 - DNA, 22 bp, Artificial Sequence
  Synthetic oligonucleotide; TTG chr11 5316643 5316664 5316648 5316643 -
gaaagaggaaactctggggaag

SEQ ID NO: 127765 - DNA, 22 bp, Artificial Sequence
  Synthetic oligonucleotide; CTC chr11 5316629 5316650 5316634 5316629 -
tggggaagtgatttccacatac

SEQ ID NO: 127766 - DNA, 22 bp, Artificial Sequence
  Synthetic oligonucleotide; CTG chr11 5316627 5316648 5316632 5316627 -
gggaagtgatttccacatacat

SEQ ID NO: 127767 - DNA, 22 bp, Artificial Sequence
  Synthetic oligonucleotide; TTT chr11 5316615 5316636 5316620 5316615 -
ccacatacataaactctctaat

SEQ ID NO: 127768 - DNA, 22 bp, Artificial Sequence
  Synthetic oligonucleotide; TTC chr11 5316614 5316635 5316619 5316614 -
cacatacataaactctctaatt

SEQ ID NO: 127769 - DNA, 22 bp, Artificial Sequence
  Synthetic oligonucleotide; CTC chr11 5316599 5316620 5316604 5316599 -
tctaatttggcctcttgaatag

SEQ ID NO: 127770 - DNA, 22 bp, Artificial Sequence
  Synthetic oligonucleotide; CTC chr11 5316597 5316618 5316602 5316597 -
taatttggcctcttgaatagtc

SEQ ID NO: 127771 - DNA, 22 bp, Artificial Sequence
  Synthetic oligonucleotide; CTA chr11 5316595 5316616 5316600 5316595 -
atttggcctcttgaatagtctt

SEQ ID NO: 127772 - DNA, 22 bp, Artificial Sequence
  Synthetic oligonucleotide; TTT chr11 5316591 5316612 5316596 5316591 -
ggcctcttgaatagtctttgag

SEQ ID NO: 127773 - DNA, 22 bp, Artificial Sequence
  Synthetic oligonucleotide; TTG chr11 5316590 5316611 5316595 5316590 -
gcctcttgaatagtctttgaga

SEQ ID NO: 127774 - DNA, 22 bp, Artificial Sequence
  Synthetic oligonucleotide; CTC chr11 5316585 5316606 5316590 5316585 -
ttgaatagtctttgagaagtga

SEQ ID NO: 127775 - DNA, 22 bp, Artificial Sequence
  Synthetic oligonucleotide; CTT chr11 5316583 5316604 5316588 5316583 -
gaatagtctttgagaagtgagt

SEQ ID NO: 127776 - DNA, 22 bp, Artificial Sequence
  Synthetic oligonucleotide; TTG chr11 5316582 5316603 5316587 5316582 -
aatagtctttgagaagtgagtg

SEQ ID NO: 127777 - DNA, 22 bp, Artificial Sequence
  Synthetic oligonucleotide; CTT chr11 5316573 5316594 5316578 5316573 -
tgagaagtgagtgtctgaactg

SEQ ID NO: 127778 - DNA, 22 bp, Artificial Sequence
  Synthetic oligonucleotide; TTT chr11 5316572 5316593 5316577 5316572 -
gagaagtgagtgtctgaactga

SEQ ID NO: 127779 - DNA, 22 bp, Artificial Sequence
  Synthetic oligonucleotide; TTG chr11 5316571 5316592 5316576 5316571 -
agaagtgagtgtctgaactgag

SEQ ID NO: 127780 - DNA, 22 bp, Artificial Sequence
  Synthetic oligonucleotide; CTG chr11 5316556 5316577 5316561 5316556 -
aactgagtcttcaaatagagca

SEQ ID NO: 127781 - DNA, 22 bp, Artificial Sequence
  Synthetic oligonucleotide; CTG chr11 5316551 5316572 5316556 5316551 -
agtcttcaaatagagcaggaat

SEQ ID NO: 127782 - DNA, 22 bp, Artificial Sequence
  Synthetic oligonucleotide; CTT chr11 5316545 5316566 5316550 5316545 -
caaatagagcaggaatgggtcc

SEQ ID NO: 127783 - DNA, 22 bp, Artificial Sequence
  Synthetic oligonucleotide; TTC chr11 5316544 5316565 5316549 5316544 -
aaatagagcaggaatgggtcct

SEQ ID NO: 127784 - DNA, 22 bp, Artificial Sequence
  Synthetic oligonucleotide; CTT chr11 5316521 5316542 5316526 5316521 -
attccagcaagaaaatgacagc

SEQ ID NO: 127785 - DNA, 22 bp, Artificial Sequence
  Synthetic oligonucleotide; TTA chr11 5316520 5316541 5316525 5316520 -
ttccagcaagaaaatgacagca

SEQ ID NO: 127786 - DNA, 22 bp, Artificial Sequence
  Synthetic oligonucleotide; TTC chr11 5316517 5316538 5316522 5316517 -
cagcaagaaaatgacagcatag

SEQ ID NO: 127787 - DNA, 22 bp, Artificial Sequence
  Synthetic oligonucleotide; TTC chr11 5316462 5316483 5316467 5316462 -
ctcttccttcttatgttagatg

SEQ ID NO: 127788 - DNA, 22 bp, Artificial Sequence
  Synthetic oligonucleotide; CTC chr11 5316459 5316480 5316464 5316459 -
ttccttcttatgttagatgcag

SEQ ID NO: 127789 - DNA, 22 bp, Artificial Sequence
  Synthetic oligonucleotide; CTT chr11 5316457 5316478 5316462 5316457 -
ccttcttatgttagatgcagcg

SEQ ID NO: 127790 - DNA, 22 bp, Artificial Sequence
  Synthetic oligonucleotide; TTC chr11 5316456 5316477 5316461 5316456 -
cttcttatgttagatgcagcga

SEQ ID NO: 127791 - DNA, 22 bp, Artificial Sequence
  Synthetic oligonucleotide; CTT chr11 5316453 5316474 5316458 5316453 -
cttatgttagatgcagcgaaga

SEQ ID NO: 127792 - DNA, 22 bp, Artificial Sequence
  Synthetic oligonucleotide; TTC chr11 5316452 5316473 5316457 5316452 -
ttatgttagatgcagcgaagag

SEQ ID NO: 127793 - DNA, 22 bp, Artificial Sequence
  Synthetic oligonucleotide; CTT chr11 5316450 5316471 5316455 5316450 -
atgttagatgcagcgaagagaa

SEQ ID NO: 127794 - DNA, 22 bp, Artificial Sequence
  Synthetic oligonucleotide; TTA chr11 5316449 5316470 5316454 5316449 -
tgttagatgcagcgaagagaag

SEQ ID NO: 127795 - DNA, 22 bp, Artificial Sequence
  Synthetic oligonucleotide; TTA chr11 5316444 5316465 5316449 5316444 -
gatgcagcgaagagaagatagg

SEQ ID NO: 127796 - DNA, 22 bp, Artificial Sequence
  Synthetic oligonucleotide; TTT chr11 5316415 5316436 5316420 5316415 -
tcagaggtctgcataggagaac

SEQ ID NO: 127797 - DNA, 22 bp, Artificial Sequence
  Synthetic oligonucleotide; TTT chr11 5316414 5316435 5316419 5316414 -
cagaggtctgcataggagaaca

SEQ ID NO: 127798 - DNA, 22 bp, Artificial Sequence
  Synthetic oligonucleotide; TTC chr11 5316413 5316434 5316418 5316413 -
agaggtctgcataggagaacat

SEQ ID NO: 127799 - DNA, 22 bp, Artificial Sequence
  Synthetic oligonucleotide; CTG chr11 5316404 5316425 5316409 5316404 -
cataggagaacatactccatct

SEQ ID NO: 127800 - DNA, 22 bp, Artificial Sequence
  Synthetic oligonucleotide; CTC chr11 5316387 5316408 5316392 5316387 -
catctgggatgaccaacaccta

SEQ ID NO: 127801 - DNA, 22 bp, Artificial Sequence
  Synthetic oligonucleotide; CTG chr11 5316381 5316402 5316386 5316381 -
ggatgaccaacacctaaagcac

SEQ ID NO: 127802 - DNA, 22 bp, Artificial Sequence
  Synthetic oligonucleotide; CTA chr11 5316365 5316386 5316370 5316365 -
aagcacagactttttcatctca

SEQ ID NO: 127803 - DNA, 22 bp, Artificial Sequence
  Synthetic oligonucleotide; CTT chr11 5316353 5316374 5316358 5316353 -
tttcatctcaacacatgtttca

SEQ ID NO: 127804 - DNA, 22 bp, Artificial Sequence
  Synthetic oligonucleotide; TTT chr11 5316352 5316373 5316357 5316352 -
ttcatctcaacacatgtttcaa

SEQ ID NO: 127805 - DNA, 22 bp, Artificial Sequence
  Synthetic oligonucleotide; TTT chr11 5316351 5316372 5316356 5316351 -
tcatctcaacacatgtttcaag

SEQ ID NO: 127806 - DNA, 22 bp, Artificial Sequence
  Synthetic oligonucleotide; TTT chr11 5316350 5316371 5316355 5316350 -
catctcaacacatgtttcaagg

SEQ ID NO: 127807 - DNA, 22 bp, Artificial Sequence
  Synthetic oligonucleotide; TTC chr11 5316349 5316370 5316354 5316349 -
atctcaacacatgtttcaaggc

SEQ ID NO: 127808 - DNA, 22 bp, Artificial Sequence
  Synthetic oligonucleotide; CTC chr11 5316344 5316365 5316349 5316344 -
aacacatgtttcaaggcaggct

SEQ ID NO: 127809 - DNA, 22 bp, Artificial Sequence
  Synthetic oligonucleotide; TTT chr11 5316333 5316354 5316338 5316333 -
caaggcaggcttgaagtttcaa

SEQ ID NO: 127810 - DNA, 22 bp, Artificial Sequence
  Synthetic oligonucleotide; TTC chr11 5316332 5316353 5316337 5316332 -
aaggcaggcttgaagtttcaaa

SEQ ID NO: 127811 - DNA, 22 bp, Artificial Sequence
  Synthetic oligonucleotide; CTT chr11 5316321 5316342 5316326 5316321 -
gaagtttcaaatgtggtgctca

SEQ ID NO: 127812 - DNA, 22 bp, Artificial Sequence
  Synthetic oligonucleotide; TTG chr11 5316320 5316341 5316325 5316320 -
aagtttcaaatgtggtgctcat

SEQ ID NO: 127813 - DNA, 22 bp, Artificial Sequence
  Synthetic oligonucleotide; TTT chr11 5316314 5316335 5316319 5316314 -
caaatgtggtgctcatggatta

SEQ ID NO: 127814 - DNA, 22 bp, Artificial Sequence
  Synthetic oligonucleotide; TTC chr11 5316313 5316334 5316318 5316313 -
aaatgtggtgctcatggattag

SEQ ID NO: 127815 - DNA, 22 bp, Artificial Sequence
  Synthetic oligonucleotide; CTC chr11 5316300 5316321 5316305 5316300 -
atggattagcttcaggaaaacg

SEQ ID NO: 127816 - DNA, 22 bp, Artificial Sequence
  Synthetic oligonucleotide; TTA chr11 5316292 5316313 5316297 5316292 -
gcttcaggaaaacgtgtgaata

SEQ ID NO: 127817 - DNA, 22 bp, Artificial Sequence
  Synthetic oligonucleotide; CTT chr11 5316288 5316309 5316293 5316288 -
caggaaaacgtgtgaatatttt

SEQ ID NO: 127818 - DNA, 22 bp, Artificial Sequence
  Synthetic oligonucleotide; TTC chr11 5316287 5316308 5316292 5316287 -
aggaaaacgtgtgaatattttt

SEQ ID NO: 127819 - DNA, 22 bp, Artificial Sequence
  Synthetic oligonucleotide; TTT chr11 5316267 5316288 5316272 5316267 -
ttagactaaatgtgacgtcacc

SEQ ID NO: 127820 - DNA, 22 bp, Artificial Sequence
  Synthetic oligonucleotide; TTT chr11 5316266 5316287 5316271 5316266 -
tagactaaatgtgacgtcacct

SEQ ID NO: 127821 - DNA, 22 bp, Artificial Sequence
  Synthetic oligonucleotide; TTT chr11 5316265 5316286 5316270 5316265 -
agactaaatgtgacgtcacctg

SEQ ID NO: 127822 - DNA, 22 bp, Artificial Sequence
  Synthetic oligonucleotide; TTA chr11 5316264 5316285 5316269 5316264 -
gactaaatgtgacgtcacctgc

SEQ ID NO: 127823 - DNA, 22 bp, Artificial Sequence
  Synthetic oligonucleotide; CTA chr11 5316259 5316280 5316264 5316259 -
aatgtgacgtcacctgcttttg

SEQ ID NO: 127824 - DNA, 22 bp, Artificial Sequence
  Synthetic oligonucleotide; CTG chr11 5316243 5316264 5316248 5316243 -
cttttgtccatttttctccaca

SEQ ID NO: 127825 - DNA, 22 bp, Artificial Sequence
  Synthetic oligonucleotide; CTT chr11 5316240 5316261 5316245 5316240 -
ttgtccatttttctccacagag

SEQ ID NO: 127826 - DNA, 22 bp, Artificial Sequence
  Synthetic oligonucleotide; TTT chr11 5316239 5316260 5316244 5316239 -
tgtccatttttctccacagagg

SEQ ID NO: 127827 - DNA, 22 bp, Artificial Sequence
  Synthetic oligonucleotide; TTT chr11 5316238 5316259 5316243 5316238 -
gtccatttttctccacagaggg

SEQ ID NO: 127828 - DNA, 22 bp, Artificial Sequence
  Synthetic oligonucleotide; TTG chr11 5316237 5316258 5316242 5316237 -
tccatttttctccacagagggc

SEQ ID NO: 127829 - DNA, 22 bp, Artificial Sequence
  Synthetic oligonucleotide; TTT chr11 5316230 5316251 5316235 5316230 -
ttctccacagagggctcatggc

SEQ ID NO: 127830 - DNA, 22 bp, Artificial Sequence
  Synthetic oligonucleotide; TTT chr11 5316229 5316250 5316234 5316229 -
tctccacagagggctcatggct

SEQ ID NO: 127831 - DNA, 22 bp, Artificial Sequence
  Synthetic oligonucleotide; TTT chr11 5316228 5316249 5316233 5316228 -
ctccacagagggctcatggctt

SEQ ID NO: 127832 - DNA, 22 bp, Artificial Sequence
  Synthetic oligonucleotide; TTC chr11 5316227 5316248 5316232 5316227 -
tccacagagggctcatggcttt

SEQ ID NO: 127833 - DNA, 22 bp, Artificial Sequence
  Synthetic oligonucleotide; CTC chr11 5316225 5316246 5316230 5316225 -
cacagagggctcatggcttttg

SEQ ID NO: 127834 - DNA, 22 bp, Artificial Sequence
  Synthetic oligonucleotide; CTC chr11 5316213 5316234 5316218 5316213 -
atggcttttgttagaattccat

SEQ ID NO: 127835 - DNA, 22 bp, Artificial Sequence
  Synthetic oligonucleotide; CTT chr11 5316206 5316227 5316211 5316206 -
ttgttagaattccataaaacat

SEQ ID NO: 127836 - DNA, 22 bp, Artificial Sequence
  Synthetic oligonucleotide; TTT chr11 5316205 5316226 5316210 5316205 -
tgttagaattccataaaacatt

SEQ ID NO: 127837 - DNA, 22 bp, Artificial Sequence
  Synthetic oligonucleotide; TTT chr11 5316204 5316225 5316209 5316204 -
gttagaattccataaaacatta

SEQ ID NO: 127838 - DNA, 22 bp, Artificial Sequence
  Synthetic oligonucleotide; TTG chr11 5316203 5316224 5316208 5316203 -
ttagaattccataaaacattaa

SEQ ID NO: 127839 - DNA, 22 bp, Artificial Sequence
  Synthetic oligonucleotide; TTA chr11 5316200 5316221 5316205 5316200 -
gaattccataaaacattaacat

SEQ ID NO: 127840 - DNA, 22 bp, Artificial Sequence
  Synthetic oligonucleotide; TTC chr11 5316194 5316215 5316199 5316194 -
cataaaacattaacattctatt

SEQ ID NO: 127841 - DNA, 22 bp, Artificial Sequence
  Synthetic oligonucleotide; TTA chr11 5316182 5316203 5316187 5316182 -
acattctatttcaaaactaaac

SEQ ID NO: 127842 - DNA, 22 bp, Artificial Sequence
  Synthetic oligonucleotide; TTC chr11 5316176 5316197 5316181 5316176 -
tatttcaaaactaaacaaagaa

SEQ ID NO: 127843 - DNA, 22 bp, Artificial Sequence
  Synthetic oligonucleotide; CTA chr11 5316174 5316195 5316179 5316174 -
tttcaaaactaaacaaagaaaa

SEQ ID NO: 127844 - DNA, 22 bp, Artificial Sequence
  Synthetic oligonucleotide; TTT chr11 5316171 5316192 5316176 5316171 -
caaaactaaacaaagaaaagtt

SEQ ID NO: 127845 - DNA, 22 bp, Artificial Sequence
  Synthetic oligonucleotide; TTC chr11 5316170 5316191 5316175 5316170 -
aaaactaaacaaagaaaagttt

SEQ ID NO: 127846 - DNA, 22 bp, Artificial Sequence
  Synthetic oligonucleotide; CTA chr11 5316163 5316184 5316168 5316163 -
aacaaagaaaagttttctaaca

SEQ ID NO: 127847 - DNA, 22 bp, Artificial Sequence
  Synthetic oligonucleotide; TTT chr11 5316148 5316169 5316153 5316148 -
tctaacaaaacactatgtctat

SEQ ID NO: 127848 - DNA, 22 bp, Artificial Sequence
  Synthetic oligonucleotide; TTT chr11 5316147 5316168 5316152 5316147 -
ctaacaaaacactatgtctata

SEQ ID NO: 127849 - DNA, 22 bp, Artificial Sequence
  Synthetic oligonucleotide; TTC chr11 5316146 5316167 5316151 5316146 -
taacaaaacactatgtctatat

SEQ ID NO: 127850 - DNA, 22 bp, Artificial Sequence
  Synthetic oligonucleotide; CTA chr11 5316144 5316165 5316149 5316144 -
acaaaacactatgtctatatca

SEQ ID NO: 127851 - DNA, 22 bp, Artificial Sequence
  Synthetic oligonucleotide; CTA chr11 5316133 5316154 5316138 5316133 -
tgtctatatcatgattgtgaaa

SEQ ID NO: 127852 - DNA, 22 bp, Artificial Sequence
  Synthetic oligonucleotide; CTA chr11 5316127 5316148 5316132 5316127 -
tatcatgattgtgaaacataaa

SEQ ID NO: 127853 - DNA, 22 bp, Artificial Sequence
  Synthetic oligonucleotide; TTG chr11 5316116 5316137 5316121 5316116 -
tgaaacataaaataaaaatcaa

SEQ ID NO: 127854 - DNA, 22 bp, Artificial Sequence
  Synthetic oligonucleotide; TTT chr11 5316090 5316111 5316095 5316090 -
aaatgtatccaaatatgcaatt

SEQ ID NO: 127855 - DNA, 22 bp, Artificial Sequence
  Synthetic oligonucleotide; TTA chr11 5316089 5316110 5316094 5316089 -
aatgtatccaaatatgcaatta

SEQ ID NO: 127856 - DNA, 22 bp, Artificial Sequence
  Synthetic oligonucleotide; TTA chr11 5316067 5316088 5316072 5316067 -
agctaagcagcaggttaactat

SEQ ID NO: 127857 - DNA, 22 bp, Artificial Sequence
  Synthetic oligonucleotide; CTA chr11 5316062 5316083 5316067 5316062 -
agcagcaggttaactatgtaca

SEQ ID NO: 127858 - DNA, 22 bp, Artificial Sequence
  Synthetic oligonucleotide; TTA chr11 5316050 5316071 5316055 5316050 -
actatgtacaattattatctaa

SEQ ID NO: 127859 - DNA, 22 bp, Artificial Sequence
  Synthetic oligonucleotide; CTA chr11 5316046 5316067 5316051 5316046 -
tgtacaattattatctaattgc

SEQ ID NO: 127860 - DNA, 22 bp, Artificial Sequence
  Synthetic oligonucleotide; TTA chr11 5316036 5316057 5316041 5316036 -
ttatctaattgcatatatttgc

SEQ ID NO: 127861 - DNA, 22 bp, Artificial Sequence
  Synthetic oligonucleotide; TTA chr11 5316033 5316054 5316038 5316033 -
tctaattgcatatatttgcctt

SEQ ID NO: 127862 - DNA, 22 bp, Artificial Sequence
  Synthetic oligonucleotide; CTA chr11 5316029 5316050 5316034 5316029 -
attgcatatatttgccttcttt

SEQ ID NO: 127863 - DNA, 22 bp, Artificial Sequence
  Synthetic oligonucleotide; TTG chr11 5316025 5316046 5316030 5316025 -
catatatttgccttcttttttg

SEQ ID NO: 127864 - DNA, 22 bp, Artificial Sequence
  Synthetic oligonucleotide; TTT chr11 5316016 5316037 5316021 5316016 -
gccttcttttttgttactattg

SEQ ID NO: 127865 - DNA, 22 bp, Artificial Sequence
  Synthetic oligonucleotide; TTG chr11 5316015 5316036 5316020 5316015 -
ccttcttttttgttactattgg

SEQ ID NO: 127866 - DNA, 22 bp, Artificial Sequence
  Synthetic oligonucleotide; CTT chr11 5316011 5316032 5316016 5316011 -
cttttttgttactattggttca

SEQ ID NO: 127867 - DNA, 22 bp, Artificial Sequence
  Synthetic oligonucleotide; TTC chr11 5316010 5316031 5316015 5316010 -
ttttttgttactattggttcaa

SEQ ID NO: 127868 - DNA, 22 bp, Artificial Sequence
  Synthetic oligonucleotide; CTT chr11 5316008 5316029 5316013 5316008 -
ttttgttactattggttcaaac

SEQ ID NO: 127869 - DNA, 22 bp, Artificial Sequence
  Synthetic oligonucleotide; TTT chr11 5316007 5316028 5316012 5316007 -
tttgttactattggttcaaaca

SEQ ID NO: 127870 - DNA, 22 bp, Artificial Sequence
  Synthetic oligonucleotide; TTT chr11 5316006 5316027 5316011 5316006 -
ttgttactattggttcaaacat

SEQ ID NO: 127871 - DNA, 22 bp, Artificial Sequence
  Synthetic oligonucleotide; TTT chr11 5316005 5316026 5316010 5316005 -
tgttactattggttcaaacatt

SEQ ID NO: 127872 - DNA, 22 bp, Artificial Sequence
  Synthetic oligonucleotide; TTT chr11 5316004 5316025 5316009 5316004 -
gttactattggttcaaacattg

SEQ ID NO: 127873 - DNA, 22 bp, Artificial Sequence
  Synthetic oligonucleotide; TTG chr11 5316003 5316024 5316008 5316003 -
ttactattggttcaaacattgt

SEQ ID NO: 127874 - DNA, 22 bp, Artificial Sequence
  Synthetic oligonucleotide; TTA chr11 5316000 5316021 5316005 5316000 -
ctattggttcaaacattgtgca

SEQ ID NO: 127875 - DNA, 22 bp, Artificial Sequence
  Synthetic oligonucleotide; CTA chr11 5315997 5316018 5316002 5315997 -
ttggttcaaacattgtgcagca

SEQ ID NO: 127876 - DNA, 22 bp, Artificial Sequence
  Synthetic oligonucleotide; TTG chr11 5315994 5316015 5315999 5315994 -
gttcaaacattgtgcagcaagc

SEQ ID NO: 127877 - DNA, 22 bp, Artificial Sequence
  Synthetic oligonucleotide; TTC chr11 5315990 5316011 5315995 5315990 -
aaacattgtgcagcaagcacac

SEQ ID NO: 127878 - DNA, 22 bp, Artificial Sequence
  Synthetic oligonucleotide; TTG chr11 5315982 5316003 5315987 5315982 -
tgcagcaagcacaccacagagg

SEQ ID NO: 127879 - DNA, 22 bp, Artificial Sequence
  Synthetic oligonucleotide; TTT chr11 5315946 5315967 5315951 5315946 -
tttaaaatgtgttttttagatt

SEQ ID NO: 127880 - DNA, 22 bp, Artificial Sequence
  Synthetic oligonucleotide; TTT chr11 5315945 5315966 5315950 5315945 -
ttaaaatgtgttttttagatta

SEQ ID NO: 127881 - DNA, 22 bp, Artificial Sequence
  Synthetic oligonucleotide; TTT chr11 5315944 5315965 5315949 5315944 -
taaaatgtgttttttagattaa

SEQ ID NO: 127882 - DNA, 22 bp, Artificial Sequence
  Synthetic oligonucleotide; TTT chr11 5315943 5315964 5315948 5315943 -
aaaatgtgttttttagattaag

SEQ ID NO: 127883 - DNA, 22 bp, Artificial Sequence
  Synthetic oligonucleotide; TTA chr11 5315942 5315963 5315947 5315942 -
aaatgtgttttttagattaaga

SEQ ID NO: 127884 - DNA, 22 bp, Artificial Sequence
  Synthetic oligonucleotide; TTT chr11 5315932 5315953 5315937 5315932 -
tttagattaagaatgcttaact

SEQ ID NO: 127885 - DNA, 22 bp, Artificial Sequence
  Synthetic oligonucleotide; TTT chr11 5315931 5315952 5315936 5315931 -
ttagattaagaatgcttaacta

SEQ ID NO: 127886 - DNA, 22 bp, Artificial Sequence
  Synthetic oligonucleotide; TTT chr11 5315930 5315951 5315935 5315930 -
tagattaagaatgcttaactac

SEQ ID NO: 127887 - DNA, 22 bp, Artificial Sequence
  Synthetic oligonucleotide; TTT chr11 5315929 5315950 5315934 5315929 -
agattaagaatgcttaactact

SEQ ID NO: 127888 - DNA, 22 bp, Artificial Sequence
  Synthetic oligonucleotide; TTA chr11 5315928 5315949 5315933 5315928 -
gattaagaatgcttaactactt

SEQ ID NO: 127889 - DNA, 22 bp, Artificial Sequence
  Synthetic oligonucleotide; TTA chr11 5315923 5315944 5315928 5315923 -
agaatgcttaactacttaatta

SEQ ID NO: 127890 - DNA, 22 bp, Artificial Sequence
  Synthetic oligonucleotide; CTT chr11 5315914 5315935 5315919 5315914 -
aactacttaattattcataact

SEQ ID NO: 127891 - DNA, 22 bp, Artificial Sequence
  Synthetic oligonucleotide; TTA chr11 5315913 5315934 5315918 5315913 -
actacttaattattcataactg

SEQ ID NO: 127892 - DNA, 22 bp, Artificial Sequence
  Synthetic oligonucleotide; CTA chr11 5315909 5315930 5315914 5315909 -
cttaattattcataactgaaga

SEQ ID NO: 127893 - DNA, 22 bp, Artificial Sequence
  Synthetic oligonucleotide; CTT chr11 5315906 5315927 5315911 5315906 -
aattattcataactgaagaaat

SEQ ID NO: 127894 - DNA, 22 bp, Artificial Sequence
  Synthetic oligonucleotide; TTA chr11 5315905 5315926 5315910 5315905 -
attattcataactgaagaaatg

SEQ ID NO: 127895 - DNA, 22 bp, Artificial Sequence
  Synthetic oligonucleotide; TTA chr11 5315901 5315922 5315906 5315901 -
ttcataactgaagaaatgatca

SEQ ID NO: 127896 - DNA, 22 bp, Artificial Sequence
  Synthetic oligonucleotide; TTC chr11 5315898 5315919 5315903 5315898 -
ataactgaagaaatgatcatca

SEQ ID NO: 127897 - DNA, 22 bp, Artificial Sequence
  Synthetic oligonucleotide; CTG chr11 5315891 5315912 5315896 5315891 -
aagaaatgatcatcattcctta

SEQ ID NO: 127898 - DNA, 22 bp, Artificial Sequence
  Synthetic oligonucleotide; TTC chr11 5315873 5315894 5315878 5315873 -
cttatctctagcacagtctata

SEQ ID NO: 127899 - DNA, 22 bp, Artificial Sequence
  Synthetic oligonucleotide; CTT chr11 5315870 5315891 5315875 5315870 -
atctctagcacagtctataaat

SEQ ID NO: 127900 - DNA, 22 bp, Artificial Sequence
  Synthetic oligonucleotide; TTA chr11 5315869 5315890 5315874 5315869 -
tctctagcacagtctataaatg

SEQ ID NO: 127901 - DNA, 22 bp, Artificial Sequence
  Synthetic oligonucleotide; CTC chr11 5315865 5315886 5315870 5315865 -
tagcacagtctataaatgtatt

SEQ ID NO: 127902 - DNA, 22 bp, Artificial Sequence
  Synthetic oligonucleotide; CTA chr11 5315863 5315884 5315868 5315863 -
gcacagtctataaatgtattgc

SEQ ID NO: 127903 - DNA, 22 bp, Artificial Sequence
  Synthetic oligonucleotide; CTA chr11 5315853 5315874 5315858 5315853 -
taaatgtattgctcttctataa

SEQ ID NO: 127904 - DNA, 22 bp, Artificial Sequence
  Synthetic oligonucleotide; TTG chr11 5315842 5315863 5315847 5315842 -
ctcttctataagaaaattgttg

SEQ ID NO: 127905 - DNA, 22 bp, Artificial Sequence
  Synthetic oligonucleotide; CTC chr11 5315839 5315860 5315844 5315839 -
ttctataagaaaattgttgcac

SEQ ID NO: 127906 - DNA, 22 bp, Artificial Sequence
  Synthetic oligonucleotide; CTT chr11 5315837 5315858 5315842 5315837 -
ctataagaaaattgttgcacat

SEQ ID NO: 127907 - DNA, 22 bp, Artificial Sequence
  Synthetic oligonucleotide; TTC chr11 5315836 5315857 5315841 5315836 -
tataagaaaattgttgcacatt

SEQ ID NO: 127908 - DNA, 22 bp, Artificial Sequence
  Synthetic oligonucleotide; CTA chr11 5315834 5315855 5315839 5315834 -
taagaaaattgttgcacattca

SEQ ID NO: 127909 - DNA, 22 bp, Artificial Sequence
  Synthetic oligonucleotide; TTG chr11 5315823 5315844 5315828 5315823 -
ttgcacattcatgcatatacca

SEQ ID NO: 127910 - DNA, 22 bp, Artificial Sequence
  Synthetic oligonucleotide; TTG chr11 5315820 5315841 5315825 5315820 -
cacattcatgcatataccaata

SEQ ID NO: 127911 - DNA, 22 bp, Artificial Sequence
  Synthetic oligonucleotide; TTC chr11 5315813 5315834 5315818 5315813 -
atgcatataccaataaattatt

SEQ ID NO: 127912 - DNA, 22 bp, Artificial Sequence
  Synthetic oligonucleotide; TTA chr11 5315793 5315814 5315798 5315793 -
ttgctaaatatgaatattagga

SEQ ID NO: 127913 - DNA, 22 bp, Artificial Sequence
  Synthetic oligonucleotide; TTG chr11 5315790 5315811 5315795 5315790 -
ctaaatatgaatattaggattg

SEQ ID NO: 127914 - DNA, 22 bp, Artificial Sequence
  Synthetic oligonucleotide; CTA chr11 5315787 5315808 5315792 5315787 -
aatatgaatattaggattgagg

SEQ ID NO: 127915 - DNA, 22 bp, Artificial Sequence
  Synthetic oligonucleotide; TTA chr11 5315774 5315795 5315779 5315774 -
ggattgaggctgcagaaataca

SEQ ID NO: 127916 - DNA, 22 bp, Artificial Sequence
  Synthetic oligonucleotide; TTG chr11 5315768 5315789 5315773 5315768 -
aggctgcagaaatacagtttca

SEQ ID NO: 127917 - DNA, 22 bp, Artificial Sequence
  Synthetic oligonucleotide; CTG chr11 5315762 5315783 5315767 5315762 -
cagaaatacagtttcacaagaa

SEQ ID NO: 127918 - DNA, 22 bp, Artificial Sequence
  Synthetic oligonucleotide; TTT chr11 5315748 5315769 5315753 5315748 -
cacaagaaggtagtaaaaactg

SEQ ID NO: 127919 - DNA, 22 bp, Artificial Sequence
  Synthetic oligonucleotide; TTC chr11 5315747 5315768 5315752 5315747 -
acaagaaggtagtaaaaactga

SEQ ID NO: 127920 - DNA, 22 bp, Artificial Sequence
  Synthetic oligonucleotide; CTG chr11 5315726 5315747 5315731 5315726 -
ataaggcagggatttcagtgta

SEQ ID NO: 127921 - DNA, 22 bp, Artificial Sequence
  Synthetic oligonucleotide; TTT chr11 5315711 5315732 5315716 5315711 -
cagtgtaatagtttctataaag

SEQ ID NO: 127922 - DNA, 22 bp, Artificial Sequence
  Synthetic oligonucleotide; TTC chr11 5315710 5315731 5315715 5315710 -
agtgtaatagtttctataaagc

SEQ ID NO: 127923 - DNA, 22 bp, Artificial Sequence
  Synthetic oligonucleotide; TTT chr11 5315697 5315718 5315702 5315697 -
ctataaagctacttgccacttg

SEQ ID NO: 127924 - DNA, 22 bp, Artificial Sequence
  Synthetic oligonucleotide; TTC chr11 5315696 5315717 5315701 5315696 -
tataaagctacttgccacttgt

SEQ ID NO: 127925 - DNA, 22 bp, Artificial Sequence
  Synthetic oligonucleotide; CTA chr11 5315694 5315715 5315699 5315694 -
taaagctacttgccacttgtga

SEQ ID NO: 127926 - DNA, 22 bp, Artificial Sequence
  Synthetic oligonucleotide; CTA chr11 5315686 5315707 5315691 5315686 -
cttgccacttgtgaacacacaa

SEQ ID NO: 127927 - DNA, 22 bp, Artificial Sequence
  Synthetic oligonucleotide; CTT chr11 5315683 5315704 5315688 5315683 -
gccacttgtgaacacacaatgc

SEQ ID NO: 127928 - DNA, 22 bp, Artificial Sequence
  Synthetic oligonucleotide; TTG chr11 5315682 5315703 5315687 5315682 -
ccacttgtgaacacacaatgcg

SEQ ID NO: 127929 - DNA, 22 bp, Artificial Sequence
  Synthetic oligonucleotide; CTT chr11 5315676 5315697 5315681 5315676 -
gtgaacacacaatgcggctcct

SEQ ID NO: 127930 - DNA, 22 bp, Artificial Sequence
  Synthetic oligonucleotide; TTG chr11 5315675 5315696 5315680 5315675 -
tgaacacacaatgcggctcctt

SEQ ID NO: 127931 - DNA, 22 bp, Artificial Sequence
  Synthetic oligonucleotide; CTC chr11 5315656 5315677 5315661 5315656 -
cttttttgctgcctggcttttc

SEQ ID NO: 127932 - DNA, 22 bp, Artificial Sequence
  Synthetic oligonucleotide; CTT chr11 5315653 5315674 5315658 5315653 -
ttttgctgcctggcttttcagt

SEQ ID NO: 127933 - DNA, 22 bp, Artificial Sequence
  Synthetic oligonucleotide; TTT chr11 5315652 5315673 5315657 5315652 -
tttgctgcctggcttttcagta

SEQ ID NO: 127934 - DNA, 22 bp, Artificial Sequence
  Synthetic oligonucleotide; TTT chr11 5315651 5315672 5315656 5315651 -
ttgctgcctggcttttcagtac

SEQ ID NO: 127935 - DNA, 22 bp, Artificial Sequence
  Synthetic oligonucleotide; TTT chr11 5315650 5315671 5315655 5315650 -
tgctgcctggcttttcagtact

SEQ ID NO: 127936 - DNA, 22 bp, Artificial Sequence
  Synthetic oligonucleotide; TTT chr11 5315649 5315670 5315654 5315649 -
gctgcctggcttttcagtactg

SEQ ID NO: 127937 - DNA, 22 bp, Artificial Sequence
  Synthetic oligonucleotide; TTG chr11 5315648 5315669 5315653 5315648 -
ctgcctggcttttcagtactgg

SEQ ID NO: 127938 - DNA, 22 bp, Artificial Sequence
  Synthetic oligonucleotide; CTG chr11 5315645 5315666 5315650 5315645 -
cctggcttttcagtactggagg

SEQ ID NO: 127939 - DNA, 22 bp, Artificial Sequence
  Synthetic oligonucleotide; CTG chr11 5315641 5315662 5315646 5315641 -
gcttttcagtactggaggcaac

SEQ ID NO: 127940 - DNA, 22 bp, Artificial Sequence
  Synthetic oligonucleotide; CTT chr11 5315637 5315658 5315642 5315637 -
ttcagtactggaggcaacttat

SEQ ID NO: 127941 - DNA, 22 bp, Artificial Sequence
  Synthetic oligonucleotide; TTT chr11 5315636 5315657 5315641 5315636 -
tcagtactggaggcaacttatc

SEQ ID NO: 127942 - DNA, 22 bp, Artificial Sequence
  Synthetic oligonucleotide; TTT chr11 5315635 5315656 5315640 5315635 -
cagtactggaggcaacttatca

SEQ ID NO: 127943 - DNA, 22 bp, Artificial Sequence
  Synthetic oligonucleotide; TTC chr11 5315634 5315655 5315639 5315634 -
agtactggaggcaacttatcac

SEQ ID NO: 127944 - DNA, 22 bp, Artificial Sequence
  Synthetic oligonucleotide; CTG chr11 5315627 5315648 5315632 5315627 -
gaggcaacttatcactcgatct

SEQ ID NO: 127945 - DNA, 22 bp, Artificial Sequence
  Synthetic oligonucleotide; CTT chr11 5315617 5315638 5315622 5315617 -
atcactcgatctccatcccctt

SEQ ID NO: 127946 - DNA, 22 bp, Artificial Sequence
  Synthetic oligonucleotide; TTA chr11 5315616 5315637 5315621 5315616 -
tcactcgatctccatccccttc

SEQ ID NO: 127947 - DNA, 22 bp, Artificial Sequence
  Synthetic oligonucleotide; CTC chr11 5315610 5315631 5315615 5315610 -
gatctccatccccttctttgct

SEQ ID NO: 127948 - DNA, 22 bp, Artificial Sequence
  Synthetic oligonucleotide; CTC chr11 5315604 5315625 5315609 5315604 -
catccccttctttgctgtttat

SEQ ID NO: 127949 - DNA, 22 bp, Artificial Sequence
  Synthetic oligonucleotide; CTT chr11 5315595 5315616 5315600 5315595 -
ctttgctgtttatgtgtgcgtc

SEQ ID NO: 127950 - DNA, 22 bp, Artificial Sequence
  Synthetic oligonucleotide; TTC chr11 5315594 5315615 5315599 5315594 -
tttgctgtttatgtgtgcgtcc

SEQ ID NO: 127951 - DNA, 22 bp, Artificial Sequence
  Synthetic oligonucleotide; CTT chr11 5315592 5315613 5315597 5315592 -
tgctgtttatgtgtgcgtcctt

SEQ ID NO: 127952 - DNA, 22 bp, Artificial Sequence
  Synthetic oligonucleotide; TTT chr11 5315591 5315612 5315596 5315591 -
gctgtttatgtgtgcgtccttc

SEQ ID NO: 127953 - DNA, 22 bp, Artificial Sequence
  Synthetic oligonucleotide; TTG chr11 5315590 5315611 5315595 5315590 -
ctgtttatgtgtgcgtccttct

SEQ ID NO: 127954 - DNA, 22 bp, Artificial Sequence
  Synthetic oligonucleotide; CTG chr11 5315587 5315608 5315592 5315587 -
tttatgtgtgcgtccttcttgg

SEQ ID NO: 127955 - DNA, 22 bp, Artificial Sequence
  Synthetic oligonucleotide; TTT chr11 5315584 5315605 5315589 5315584 -
atgtgtgcgtccttcttggcaa

SEQ ID NO: 127956 - DNA, 22 bp, Artificial Sequence
  Synthetic oligonucleotide; TTA chr11 5315583 5315604 5315588 5315583 -
tgtgtgcgtccttcttggcaat

SEQ ID NO: 127957 - DNA, 22 bp, Artificial Sequence
  Synthetic oligonucleotide; CTT chr11 5315570 5315591 5315575 5315570 -
cttggcaatggcaagctcctct

SEQ ID NO: 127958 - DNA, 22 bp, Artificial Sequence
  Synthetic oligonucleotide; TTC chr11 5315569 5315590 5315574 5315569 -
ttggcaatggcaagctcctcta

SEQ ID NO: 127959 - DNA, 22 bp, Artificial Sequence
  Synthetic oligonucleotide; CTT chr11 5315567 5315588 5315572 5315567 -
ggcaatggcaagctcctctacc

SEQ ID NO: 127960 - DNA, 22 bp, Artificial Sequence
  Synthetic oligonucleotide; TTG chr11 5315566 5315587 5315571 5315566 -
gcaatggcaagctcctctacct

SEQ ID NO: 127961 - DNA, 22 bp, Artificial Sequence
  Synthetic oligonucleotide; CTC chr11 5315552 5315573 5315557 5315552 -
ctctacctcatcaagcatgacc

SEQ ID NO: 127962 - DNA, 22 bp, Artificial Sequence
  Synthetic oligonucleotide; CTC chr11 5315549 5315570 5315554 5315549 -
tacctcatcaagcatgaccaca

SEQ ID NO: 127963 - DNA, 22 bp, Artificial Sequence
  Synthetic oligonucleotide; CTA chr11 5315547 5315568 5315552 5315547 -
cctcatcaagcatgaccacagt

SEQ ID NO: 127964 - DNA, 22 bp, Artificial Sequence
  Synthetic oligonucleotide; CTC chr11 5315543 5315564 5315548 5315543 -
atcaagcatgaccacagtcttc

SEQ ID NO: 127965 - DNA, 22 bp, Artificial Sequence
  Synthetic oligonucleotide; CTT chr11 5315522 5315543 5315527 5315522 -
cacgaacccatgtactgtttcc

SEQ ID NO: 127966 - DNA, 22 bp, Artificial Sequence
  Synthetic oligonucleotide; TTC chr11 5315521 5315542 5315526 5315521 -
acgaacccatgtactgtttcct

SEQ ID NO: 127967 - DNA, 22 bp, Artificial Sequence
  Synthetic oligonucleotide; CTG chr11 5315505 5315526 5315510 5315505 -
tttccttgccacactgaggcaa

SEQ ID NO: 127968 - DNA, 22 bp, Artificial Sequence
  Synthetic oligonucleotide; TTT chr11 5315502 5315523 5315507 5315502 -
ccttgccacactgaggcaagac

SEQ ID NO: 127969 - DNA, 22 bp, Artificial Sequence
  Synthetic oligonucleotide; TTC chr11 5315501 5315522 5315506 5315501 -
cttgccacactgaggcaagacc

SEQ ID NO: 127970 - DNA, 22 bp, Artificial Sequence
  Synthetic oligonucleotide; CTT chr11 5315498 5315519 5315503 5315498 -
gccacactgaggcaagacctca

SEQ ID NO: 127971 - DNA, 22 bp, Artificial Sequence
  Synthetic oligonucleotide; TTG chr11 5315497 5315518 5315502 5315497 -
ccacactgaggcaagacctcat

SEQ ID NO: 127972 - DNA, 22 bp, Artificial Sequence
  Synthetic oligonucleotide; CTG chr11 5315489 5315510 5315494 5315489 -
aggcaagacctcatggtgaaat

SEQ ID NO: 127973 - DNA, 22 bp, Artificial Sequence
  Synthetic oligonucleotide; CTC chr11 5315477 5315498 5315482 5315477 -
atggtgaaattgaccatgatgc

SEQ ID NO: 127974 - DNA, 22 bp, Artificial Sequence
  Synthetic oligonucleotide; TTG chr11 5315465 5315486 5315470 5315465 -
accatgatgcccactgtaatgg

SEQ ID NO: 127975 - DNA, 22 bp, Artificial Sequence
  Synthetic oligonucleotide; CTG chr11 5315449 5315470 5315454 5315449 -
taatgggcgtcttgtggatgaa

SEQ ID NO: 127976 - DNA, 22 bp, Artificial Sequence
  Synthetic oligonucleotide; CTT chr11 5315436 5315457 5315441 5315436 -
gtggatgaatcacaaagaggtt

SEQ ID NO: 127977 - DNA, 22 bp, Artificial Sequence
  Synthetic oligonucleotide; TTG chr11 5315435 5315456 5315440 5315435 -
tggatgaatcacaaagaggtta

SEQ ID NO: 127978 - DNA, 22 bp, Artificial Sequence
  Synthetic oligonucleotide; TTA chr11 5315413 5315434 5315418 5315413 -
tccatggggcctgcttcttgca

SEQ ID NO: 127979 - DNA, 22 bp, Artificial Sequence
  Synthetic oligonucleotide; CTG chr11 5315400 5315421 5315405 5315400 -
cttcttgcaggtttacattatc

SEQ ID NO: 127980 - DNA, 22 bp, Artificial Sequence
  Synthetic oligonucleotide; CTT chr11 5315397 5315418 5315402 5315397 -
cttgcaggtttacattatccac

SEQ ID NO: 127981 - DNA, 22 bp, Artificial Sequence
  Synthetic oligonucleotide; TTC chr11 5315396 5315417 5315401 5315396 -
ttgcaggtttacattatccact

SEQ ID NO: 127982 - DNA, 22 bp, Artificial Sequence
  Synthetic oligonucleotide; CTT chr11 5315394 5315415 5315399 5315394 -
gcaggtttacattatccactcc

SEQ ID NO: 127983 - DNA, 22 bp, Artificial Sequence
  Synthetic oligonucleotide; TTG chr11 5315393 5315414 5315398 5315393 -
caggtttacattatccactccc

SEQ ID NO: 127984 - DNA, 22 bp, Artificial Sequence
  Synthetic oligonucleotide; TTT chr11 5315386 5315407 5315391 5315386 -
acattatccactcccattatcc

SEQ ID NO: 127985 - DNA, 22 bp, Artificial Sequence
  Synthetic oligonucleotide; TTA chr11 5315385 5315406 5315390 5315385 -
cattatccactcccattatcca

SEQ ID NO: 127986 - DNA, 22 bp, Artificial Sequence
  Synthetic oligonucleotide; TTA chr11 5315380 5315401 5315385 5315380 -
tccactcccattatccacttgc

SEQ ID NO: 127987 - DNA, 22 bp, Artificial Sequence
  Synthetic oligonucleotide; CTC chr11 5315373 5315394 5315378 5315373 -
ccattatccacttgcagaatca

SEQ ID NO: 127988 - DNA, 22 bp, Artificial Sequence
  Synthetic oligonucleotide; TTA chr11 5315367 5315388 5315372 5315367 -
tccacttgcagaatcaggtatt

SEQ ID NO: 127989 - DNA, 22 bp, Artificial Sequence
  Synthetic oligonucleotide; CTT chr11 5315360 5315381 5315365 5315360 -
gcagaatcaggtattctcctgt

SEQ ID NO: 127990 - DNA, 22 bp, Artificial Sequence
  Synthetic oligonucleotide; TTG chr11 5315359 5315380 5315364 5315359 -
cagaatcaggtattctcctgtc

SEQ ID NO: 127991 - DNA, 22 bp, Artificial Sequence
  Synthetic oligonucleotide; TTC chr11 5315344 5315365 5315349 5315344 -
tcctgtcaatggcctatgaccg

SEQ ID NO: 127992 - DNA, 22 bp, Artificial Sequence
  Synthetic oligonucleotide; CTC chr11 5315342 5315363 5315347 5315342 -
ctgtcaatggcctatgaccgtt

SEQ ID NO: 127993 - DNA, 22 bp, Artificial Sequence
  Synthetic oligonucleotide; CTG chr11 5315339 5315360 5315344 5315339 -
tcaatggcctatgaccgtttca

SEQ ID NO: 127994 - DNA, 22 bp, Artificial Sequence
  Synthetic oligonucleotide; CTA chr11 5315328 5315349 5315333 5315328 -
tgaccgtttcattatcatccac

SEQ ID NO: 127995 - DNA, 22 bp, Artificial Sequence
  Synthetic oligonucleotide; TTT chr11 5315319 5315340 5315324 5315319 -
cattatcatccacatgcttctc

SEQ ID NO: 127996 - DNA, 22 bp, Artificial Sequence
  Synthetic oligonucleotide; TTC chr11 5315318 5315339 5315323 5315318 -
attatcatccacatgcttctca

SEQ ID NO: 127997 - DNA, 22 bp, Artificial Sequence
  Synthetic oligonucleotide; TTA chr11 5315314 5315335 5315319 5315314 -
tcatccacatgcttctcaggta

SEQ ID NO: 127998 - DNA, 22 bp, Artificial Sequence
  Synthetic oligonucleotide; CTT chr11 5315300 5315321 5315305 5315300 -
ctcaggtataactatttctact

SEQ ID NO: 127999 - DNA, 22 bp, Artificial Sequence
  Synthetic oligonucleotide; TTC chr11 5315299 5315320 5315304 5315299 -
tcaggtataactatttctacta

SEQ ID NO: 128000 - DNA, 22 bp, Artificial Sequence
  Synthetic oligonucleotide; CTC chr11 5315297 5315318 5315302 5315297 -
aggtataactatttctactaaa

SEQ ID NO: 128001 - DNA, 22 bp, Artificial Sequence
  Synthetic oligonucleotide; CTA chr11 5315286 5315307 5315291 5315286 -
tttctactaaatcttgggtgaa

SEQ ID NO: 128002 - DNA, 22 bp, Artificial Sequence
  Synthetic oligonucleotide; TTT chr11 5315283 5315304 5315288 5315283 -
ctactaaatcttgggtgaagat

SEQ ID NO: 128003 - DNA, 22 bp, Artificial Sequence
  Synthetic oligonucleotide; TTC chr11 5315282 5315303 5315287 5315282 -
tactaaatcttgggtgaagata

SEQ ID NO: 128004 - DNA, 22 bp, Artificial Sequence
  Synthetic oligonucleotide; CTA chr11 5315280 5315301 5315285 5315280 -
ctaaatcttgggtgaagataga

SEQ ID NO: 128005 - DNA, 22 bp, Artificial Sequence
  Synthetic oligonucleotide; CTA chr11 5315277 5315298 5315282 5315277 -
aatcttgggtgaagatagaact

SEQ ID NO: 128006 - DNA, 22 bp, Artificial Sequence
  Synthetic oligonucleotide; CTT chr11 5315271 5315292 5315276 5315271 -
gggtgaagatagaactgtggct

SEQ ID NO: 128007 - DNA, 22 bp, Artificial Sequence
  Synthetic oligonucleotide; TTG chr11 5315270 5315291 5315275 5315270 -
ggtgaagatagaactgtggcta

SEQ ID NO: 128008 - DNA, 22 bp, Artificial Sequence
  Synthetic oligonucleotide; CTG chr11 5315254 5315275 5315259 5315254 -
tggctatttatgagggactttt

SEQ ID NO: 128009 - DNA, 22 bp, Artificial Sequence
  Synthetic oligonucleotide; CTA chr11 5315248 5315269 5315253 5315248 -
tttatgagggactttttatccc

SEQ ID NO: 128010 - DNA, 22 bp, Artificial Sequence
  Synthetic oligonucleotide; TTT chr11 5315245 5315266 5315250 5315245 -
atgagggactttttatccctcg

SEQ ID NO: 128011 - DNA, 22 bp, Artificial Sequence
  Synthetic oligonucleotide; TTA chr11 5315244 5315265 5315249 5315244 -
tgagggactttttatccctcgt

SEQ ID NO: 128012 - DNA, 22 bp, Artificial Sequence
  Synthetic oligonucleotide; CTT chr11 5315234 5315255 5315239 5315234 -
tttatccctcgtgcctccaatt

SEQ ID NO: 128013 - DNA, 22 bp, Artificial Sequence
  Synthetic oligonucleotide; TTT chr11 5315233 5315254 5315238 5315233 -
ttatccctcgtgcctccaattc

SEQ ID NO: 128014 - DNA, 22 bp, Artificial Sequence
  Synthetic oligonucleotide; TTT chr11 5315232 5315253 5315237 5315232 -
tatccctcgtgcctccaattct

SEQ ID NO: 128015 - DNA, 22 bp, Artificial Sequence
  Synthetic oligonucleotide; TTT chr11 5315231 5315252 5315236 5315231 -
atccctcgtgcctccaattctg

SEQ ID NO: 128016 - DNA, 22 bp, Artificial Sequence
  Synthetic oligonucleotide; TTA chr11 5315230 5315251 5315235 5315230 -
tccctcgtgcctccaattctgc

SEQ ID NO: 128017 - DNA, 22 bp, Artificial Sequence
  Synthetic oligonucleotide; CTC chr11 5315224 5315245 5315229 5315224 -
gtgcctccaattctgccactcc

SEQ ID NO: 128018 - DNA, 22 bp, Artificial Sequence
  Synthetic oligonucleotide; CTC chr11 5315217 5315238 5315222 5315217 -
caattctgccactccattgctt

SEQ ID NO: 128019 - DNA, 22 bp, Artificial Sequence
  Synthetic oligonucleotide; TTC chr11 5315211 5315232 5315216 5315211 -
tgccactccattgcttcccata

SEQ ID NO: 128020 - DNA, 22 bp, Artificial Sequence
  Synthetic oligonucleotide; CTG chr11 5315209 5315230 5315214 5315209 -
ccactccattgcttcccatatt

SEQ ID NO: 128021 - DNA, 22 bp, Artificial Sequence
  Synthetic oligonucleotide; CTC chr11 5315203 5315224 5315208 5315203 -
cattgcttcccatattgtcatt

SEQ ID NO: 128022 - DNA, 22 bp, Artificial Sequence
  Synthetic oligonucleotide; TTG chr11 5315198 5315219 5315203 5315198 -
cttcccatattgtcattcccat

SEQ ID NO: 128023 - DNA, 22 bp, Artificial Sequence
  Synthetic oligonucleotide; CTT chr11 5315195 5315216 5315200 5315195 -
cccatattgtcattcccatgtt

SEQ ID NO: 128024 - DNA, 22 bp, Artificial Sequence
  Synthetic oligonucleotide; TTC chr11 5315194 5315215 5315199 5315194 -
ccatattgtcattcccatgttc

SEQ ID NO: 128025 - DNA, 22 bp, Artificial Sequence
  Synthetic oligonucleotide; TTG chr11 5315186 5315207 5315191 5315186 -
tcattcccatgttctcttccac

SEQ ID NO: 128026 - DNA, 22 bp, Artificial Sequence
  Synthetic oligonucleotide; TTC chr11 5315180 5315201 5315185 5315180 -
ccatgttctcttccacaccttt

SEQ ID NO: 128027 - DNA, 22 bp, Artificial Sequence
  Synthetic oligonucleotide; TTC chr11 5315172 5315193 5315177 5315172 -
tcttccacaccttttttctcca

SEQ ID NO: 128028 - DNA, 22 bp, Artificial Sequence
  Synthetic oligonucleotide; CTC chr11 5315170 5315191 5315175 5315170 -
ttccacaccttttttctccatc

SEQ ID NO: 128029 - DNA, 22 bp, Artificial Sequence
  Synthetic oligonucleotide; CTT chr11 5315168 5315189 5315173 5315168 -
ccacaccttttttctccatcaa

SEQ ID NO: 128030 - DNA, 22 bp, Artificial Sequence
  Synthetic oligonucleotide; TTC chr11 5315167 5315188 5315172 5315167 -
cacaccttttttctccatcaag

SEQ ID NO: 128031 - DNA, 22 bp, Artificial Sequence
  Synthetic oligonucleotide; CTT chr11 5315159 5315180 5315164 5315159 -
ttttctccatcaagatgtcctg

SEQ ID NO: 128032 - DNA, 22 bp, Artificial Sequence
  Synthetic oligonucleotide; TTT chr11 5315158 5315179 5315163 5315158 -
tttctccatcaagatgtcctga

SEQ ID NO: 128033 - DNA, 22 bp, Artificial Sequence
  Synthetic oligonucleotide; TTT chr11 5315157 5315178 5315162 5315157 -
ttctccatcaagatgtcctgaa

SEQ ID NO: 128034 - DNA, 22 bp, Artificial Sequence
  Synthetic oligonucleotide; TTT chr11 5315156 5315177 5315161 5315156 -
tctccatcaagatgtcctgaaa

SEQ ID NO: 128035 - DNA, 22 bp, Artificial Sequence
  Synthetic oligonucleotide; TTT chr11 5315155 5315176 5315160 5315155 -
ctccatcaagatgtcctgaaac

SEQ ID NO: 128036 - DNA, 22 bp, Artificial Sequence
  Synthetic oligonucleotide; TTC chr11 5315154 5315175 5315159 5315154 -
tccatcaagatgtcctgaaact

SEQ ID NO: 128037 - DNA, 22 bp, Artificial Sequence
  Synthetic oligonucleotide; CTC chr11 5315152 5315173 5315157 5315152 -
catcaagatgtcctgaaacttg

SEQ ID NO: 128038 - DNA, 22 bp, Artificial Sequence
  Synthetic oligonucleotide; CTG chr11 5315137 5315158 5315142 5315137 -
aaacttgcctgtgctgatatta

SEQ ID NO: 128039 - DNA, 22 bp, Artificial Sequence
  Synthetic oligonucleotide; CTT chr11 5315131 5315152 5315136 5315131 -
gcctgtgctgatattacattca

SEQ ID NO: 128040 - DNA, 22 bp, Artificial Sequence
  Synthetic oligonucleotide; TTG chr11 5315130 5315151 5315135 5315130 -
cctgtgctgatattacattcaa

SEQ ID NO: 128041 - DNA, 22 bp, Artificial Sequence
  Synthetic oligonucleotide; CTG chr11 5315126 5315147 5315131 5315126 -
tgctgatattacattcaatcac

SEQ ID NO: 128042 - DNA, 22 bp, Artificial Sequence
  Synthetic oligonucleotide; CTG chr11 5315121 5315142 5315126 5315121 -
atattacattcaatcacttata

SEQ ID NO: 128043 - DNA, 22 bp, Artificial Sequence
  Synthetic oligonucleotide; TTA chr11 5315115 5315136 5315120 5315115 -
cattcaatcacttatacccagc

SEQ ID NO: 128044 - DNA, 22 bp, Artificial Sequence
  Synthetic oligonucleotide; TTC chr11 5315110 5315131 5315115 5315110 -
aatcacttatacccagctattc

SEQ ID NO: 128045 - DNA, 22 bp, Artificial Sequence
  Synthetic oligonucleotide; CTT chr11 5315102 5315123 5315107 5315102 -
atacccagctattctggttgct

SEQ ID NO: 128046 - DNA, 22 bp, Artificial Sequence
  Synthetic oligonucleotide; TTA chr11 5315101 5315122 5315106 5315101 -
tacccagctattctggttgctt

SEQ ID NO: 128047 - DNA, 22 bp, Artificial Sequence
  Synthetic oligonucleotide; CTA chr11 5315091 5315112 5315096 5315091 -
ttctggttgctttgattttctt

SEQ ID NO: 128048 - DNA, 22 bp, Artificial Sequence
  Synthetic oligonucleotide; TTC chr11 5315088 5315109 5315093 5315088 -
tggttgctttgattttcttcct

SEQ ID NO: 128049 - DNA, 22 bp, Artificial Sequence
  Synthetic oligonucleotide; CTG chr11 5315086 5315107 5315091 5315086 -
gttgctttgattttcttcctag

SEQ ID NO: 128050 - DNA, 22 bp, Artificial Sequence
  Synthetic oligonucleotide; TTG chr11 5315082 5315103 5315087 5315082 -
ctttgattttcttcctagacgc

SEQ ID NO: 128051 - DNA, 22 bp, Artificial Sequence
  Synthetic oligonucleotide; CTT chr11 5315079 5315100 5315084 5315079 -
tgattttcttcctagacgctct

SEQ ID NO: 128052 - DNA, 22 bp, Artificial Sequence
  Synthetic oligonucleotide; TTT chr11 5315078 5315099 5315083 5315078 -
gattttcttcctagacgctctg

SEQ ID NO: 128053 - DNA, 22 bp, Artificial Sequence
  Synthetic oligonucleotide; TTG chr11 5315077 5315098 5315082 5315077 -
attttcttcctagacgctctga

SEQ ID NO: 128054 - DNA, 22 bp, Artificial Sequence
  Synthetic oligonucleotide; TTT chr11 5315073 5315094 5315078 5315073 -
tcttcctagacgctctgatcat

SEQ ID NO: 128055 - DNA, 22 bp, Artificial Sequence
  Synthetic oligonucleotide; TTT chr11 5315072 5315093 5315077 5315072 -
cttcctagacgctctgatcatt

SEQ ID NO: 128056 - DNA, 22 bp, Artificial Sequence
  Synthetic oligonucleotide; TTC chr11 5315071 5315092 5315076 5315071 -
ttcctagacgctctgatcattg

SEQ ID NO: 128057 - DNA, 22 bp, Artificial Sequence
  Synthetic oligonucleotide; CTT chr11 5315069 5315090 5315074 5315069 -
cctagacgctctgatcattgtc

SEQ ID NO: 128058 - DNA, 22 bp, Artificial Sequence
  Synthetic oligonucleotide; TTC chr11 5315068 5315089 5315073 5315068 -
ctagacgctctgatcattgtct

SEQ ID NO: 128059 - DNA, 22 bp, Artificial Sequence
  Synthetic oligonucleotide; CTA chr11 5315065 5315086 5315070 5315065 -
gacgctctgatcattgtctttt

SEQ ID NO: 128060 - DNA, 22 bp, Artificial Sequence
  Synthetic oligonucleotide; CTC chr11 5315058 5315079 5315063 5315058 -
tgatcattgtcttttcttatat

SEQ ID NO: 128061 - DNA, 22 bp, Artificial Sequence
  Synthetic oligonucleotide; CTG chr11 5315056 5315077 5315061 5315056 -
atcattgtcttttcttatatcc

SEQ ID NO: 128062 - DNA, 22 bp, Artificial Sequence
  Synthetic oligonucleotide; TTG chr11 5315049 5315070 5315054 5315049 -
tcttttcttatatcctgatcct

SEQ ID NO: 128063 - DNA, 22 bp, Artificial Sequence
  Synthetic oligonucleotide; CTT chr11 5315045 5315066 5315050 5315045 -
ttcttatatcctgatccttaaa

SEQ ID NO: 128064 - DNA, 22 bp, Artificial Sequence
  Synthetic oligonucleotide; TTT chr11 5315044 5315065 5315049 5315044 -
tcttatatcctgatccttaaaa

SEQ ID NO: 128065 - DNA, 22 bp, Artificial Sequence
  Synthetic oligonucleotide; TTT chr11 5315043 5315064 5315048 5315043 -
cttatatcctgatccttaaaac

SEQ ID NO: 128066 - DNA, 22 bp, Artificial Sequence
  Synthetic oligonucleotide; TTC chr11 5315042 5315063 5315047 5315042 -
ttatatcctgatccttaaaaca

SEQ ID NO: 128067 - DNA, 22 bp, Artificial Sequence
  Synthetic oligonucleotide; CTT chr11 5315040 5315061 5315045 5315040 -
atatcctgatccttaaaacagt

SEQ ID NO: 128068 - DNA, 22 bp, Artificial Sequence
  Synthetic oligonucleotide; TTA chr11 5315039 5315060 5315044 5315039 -
tatcctgatccttaaaacagtt

SEQ ID NO: 128069 - DNA, 22 bp, Artificial Sequence
  Synthetic oligonucleotide; CTG chr11 5315032 5315053 5315037 5315032 -
atccttaaaacagttaaaggta

SEQ ID NO: 128070 - DNA, 22 bp, Artificial Sequence
  Synthetic oligonucleotide; CTT chr11 5315026 5315047 5315031 5315026 -
aaaacagttaaaggtattgcct

SEQ ID NO: 128071 - DNA, 22 bp, Artificial Sequence
  Synthetic oligonucleotide; TTA chr11 5315025 5315046 5315030 5315025 -
aaacagttaaaggtattgcctc

SEQ ID NO: 128072 - DNA, 22 bp, Artificial Sequence
  Synthetic oligonucleotide; TTA chr11 5315016 5315037 5315021 5315016 -
aaggtattgcctccagaaaaga

SEQ ID NO: 128073 - DNA, 22 bp, Artificial Sequence
  Synthetic oligonucleotide; TTG chr11 5315007 5315028 5315012 5315007 -
cctccagaaaagagcaagccaa

SEQ ID NO: 128074 - DNA, 22 bp, Artificial Sequence
  Synthetic oligonucleotide; CTC chr11 5315003 5315024 5315008 5315003 -
cagaaaagagcaagccaaagct

SEQ ID NO: 128075 - DNA, 22 bp, Artificial Sequence
  Synthetic oligonucleotide; CTC chr11 5314980 5315001 5314985 5314980 -
tcaacatgtgtgtctcccatat

SEQ ID NO: 128076 - DNA, 22 bp, Artificial Sequence
  Synthetic oligonucleotide; CTC chr11 5314978 5314999 5314983 5314978 -
aacatgtgtgtctcccatatca

SEQ ID NO: 128077 - DNA, 22 bp, Artificial Sequence
  Synthetic oligonucleotide; CTC chr11 5314964 5314985 5314969 5314964 -
ccatatcagctgtgtcttggta

SEQ ID NO: 128078 - DNA, 22 bp, Artificial Sequence
  Synthetic oligonucleotide; CTG chr11 5314952 5314973 5314957 5314952 -
tgtcttggtatttcacatcacc

SEQ ID NO: 128079 - DNA, 22 bp, Artificial Sequence
  Synthetic oligonucleotide; CTT chr11 5314946 5314967 5314951 5314946 -
ggtatttcacatcaccgtgatc

SEQ ID NO: 128080 - DNA, 22 bp, Artificial Sequence
  Synthetic oligonucleotide; TTG chr11 5314945 5314966 5314950 5314945 -
gtatttcacatcaccgtgatca

SEQ ID NO: 128081 - DNA, 22 bp, Artificial Sequence
  Synthetic oligonucleotide; TTT chr11 5314939 5314960 5314944 5314939 -
cacatcaccgtgatcagtgaga

SEQ ID NO: 128082 - DNA, 22 bp, Artificial Sequence
  Synthetic oligonucleotide; TTC chr11 5314938 5314959 5314943 5314938 -
acatcaccgtgatcagtgagac

SEQ ID NO: 128083 - DNA, 22 bp, Artificial Sequence
  Synthetic oligonucleotide; CTT chr11 5314914 5314935 5314919 5314914 -
tcattcacaggtttgggaaaca

SEQ ID NO: 128084 - DNA, 22 bp, Artificial Sequence
  Synthetic oligonucleotide; TTT chr11 5314913 5314934 5314918 5314913 -
cattcacaggtttgggaaacat

SEQ ID NO: 128085 - DNA, 22 bp, Artificial Sequence
  Synthetic oligonucleotide; TTC chr11 5314912 5314933 5314917 5314912 -
attcacaggtttgggaaacatg

SEQ ID NO: 128086 - DNA, 22 bp, Artificial Sequence
  Synthetic oligonucleotide; TTC chr11 5314908 5314929 5314913 5314908 -
acaggtttgggaaacatgcacc

SEQ ID NO: 128087 - DNA, 22 bp, Artificial Sequence
  Synthetic oligonucleotide; TTT chr11 5314900 5314921 5314905 5314900 -
gggaaacatgcaccacatgtgg

SEQ ID NO: 128088 - DNA, 22 bp, Artificial Sequence
  Synthetic oligonucleotide; TTG chr11 5314899 5314920 5314904 5314899 -
ggaaacatgcaccacatgtggt

SEQ ID NO: 128089 - DNA, 22 bp, Artificial Sequence
  Synthetic oligonucleotide; TTA chr11 5314869 5314890 5314874 5314869 -
ccgtgagctaatgactcatttc

SEQ ID NO: 128090 - DNA, 22 bp, Artificial Sequence
  Synthetic oligonucleotide; CTA chr11 5314859 5314880 5314864 5314859 -
atgactcatttctttttcctcc

SEQ ID NO: 128091 - DNA, 22 bp, Artificial Sequence
  Synthetic oligonucleotide; CTC chr11 5314852 5314873 5314857 5314852 -
atttctttttcctccattcatg

SEQ ID NO: 128092 - DNA, 22 bp, Artificial Sequence
  Synthetic oligonucleotide; TTT chr11 5314848 5314869 5314853 5314848 -
ctttttcctccattcatgaacc

SEQ ID NO: 128093 - DNA, 22 bp, Artificial Sequence
  Synthetic oligonucleotide; TTC chr11 5314847 5314868 5314852 5314847 -
tttttcctccattcatgaaccc

SEQ ID NO: 128094 - DNA, 22 bp, Artificial Sequence
  Synthetic oligonucleotide; CTT chr11 5314845 5314866 5314850 5314845 -
tttcctccattcatgaacccta

SEQ ID NO: 128095 - DNA, 22 bp, Artificial Sequence
  Synthetic oligonucleotide; TTT chr11 5314844 5314865 5314849 5314844 -
ttcctccattcatgaaccctat

SEQ ID NO: 128096 - DNA, 22 bp, Artificial Sequence
  Synthetic oligonucleotide; TTT chr11 5314843 5314864 5314848 5314843 -
tcctccattcatgaaccctatt

SEQ ID NO: 128097 - DNA, 22 bp, Artificial Sequence
  Synthetic oligonucleotide; TTT chr11 5314842 5314863 5314847 5314842 -
cctccattcatgaaccctatta

SEQ ID NO: 128098 - DNA, 22 bp, Artificial Sequence
  Synthetic oligonucleotide; TTC chr11 5314841 5314862 5314846 5314841 -
ctccattcatgaaccctattat

SEQ ID NO: 128099 - DNA, 22 bp, Artificial Sequence
  Synthetic oligonucleotide; CTC chr11 5314838 5314859 5314843 5314838 -
cattcatgaaccctattatata

SEQ ID NO: 128100 - DNA, 22 bp, Artificial Sequence
  Synthetic oligonucleotide; TTC chr11 5314833 5314854 5314838 5314833 -
atgaaccctattatatacagca

SEQ ID NO: 128101 - DNA, 22 bp, Artificial Sequence
  Synthetic oligonucleotide; CTA chr11 5314823 5314844 5314828 5314823 -
ttatatacagcatcaaaccaag

SEQ ID NO: 128102 - DNA, 22 bp, Artificial Sequence
  Synthetic oligonucleotide; TTA chr11 5314820 5314841 5314825 5314820 -
tatacagcatcaaaccaagcag

SEQ ID NO: 128103 - DNA, 22 bp, Artificial Sequence
  Synthetic oligonucleotide; TTG chr11 5314782 5314803 5314787 5314782 -
ttcgcctattttctgggcacag

SEQ ID NO: 128104 - DNA, 22 bp, Artificial Sequence
  Synthetic oligonucleotide; TTC chr11 5314779 5314800 5314784 5314779 -
gcctattttctgggcacagaat

SEQ ID NO: 128105 - DNA, 22 bp, Artificial Sequence
  Synthetic oligonucleotide; CTA chr11 5314774 5314795 5314779 5314774 -
ttttctgggcacagaatggctt

SEQ ID NO: 128106 - DNA, 22 bp, Artificial Sequence
  Synthetic oligonucleotide; TTT chr11 5314771 5314792 5314776 5314771 -
tctgggcacagaatggcttgag

SEQ ID NO: 128107 - DNA, 22 bp, Artificial Sequence
  Synthetic oligonucleotide; TTT chr11 5314770 5314791 5314775 5314770 -
ctgggcacagaatggcttgagc

SEQ ID NO: 128108 - DNA, 22 bp, Artificial Sequence
  Synthetic oligonucleotide; TTC chr11 5314769 5314790 5314774 5314769 -
tgggcacagaatggcttgagcc

SEQ ID NO: 128109 - DNA, 22 bp, Artificial Sequence
  Synthetic oligonucleotide; CTG chr11 5314767 5314788 5314772 5314767 -
ggcacagaatggcttgagccct

SEQ ID NO: 128110 - DNA, 22 bp, Artificial Sequence
  Synthetic oligonucleotide; CTT chr11 5314752 5314773 5314757 5314752 -
gagcccttttttcagaattttg

SEQ ID NO: 128111 - DNA, 22 bp, Artificial Sequence
  Synthetic oligonucleotide; TTG chr11 5314751 5314772 5314756 5314751 -
agcccttttttcagaattttgt

SEQ ID NO: 128112 - DNA, 22 bp, Artificial Sequence
  Synthetic oligonucleotide; CTT chr11 5314744 5314765 5314749 5314744 -
ttttcagaattttgtgatcttc

SEQ ID NO: 128113 - DNA, 22 bp, Artificial Sequence
  Synthetic oligonucleotide; TTT chr11 5314743 5314764 5314748 5314743 -
tttcagaattttgtgatcttca

SEQ ID NO: 128114 - DNA, 22 bp, Artificial Sequence
  Synthetic oligonucleotide; TTT chr11 5314742 5314763 5314747 5314742 -
ttcagaattttgtgatcttcat

SEQ ID NO: 128115 - DNA, 22 bp, Artificial Sequence
  Synthetic oligonucleotide; TTT chr11 5314741 5314762 5314746 5314741 -
tcagaattttgtgatcttcatg

SEQ ID NO: 128116 - DNA, 22 bp, Artificial Sequence
  Synthetic oligonucleotide; TTT chr11 5314740 5314761 5314745 5314740 -
cagaattttgtgatcttcatga

SEQ ID NO: 128117 - DNA, 22 bp, Artificial Sequence
  Synthetic oligonucleotide; TTC chr11 5314739 5314760 5314744 5314739 -
agaattttgtgatcttcatgat

SEQ ID NO: 128118 - DNA, 22 bp, Artificial Sequence
  Synthetic oligonucleotide; TTT chr11 5314732 5314753 5314737 5314732 -
tgtgatcttcatgatttctggg

SEQ ID NO: 128119 - DNA, 22 bp, Artificial Sequence
  Synthetic oligonucleotide; TTT chr11 5314731 5314752 5314736 5314731 -
gtgatcttcatgatttctgggc

SEQ ID NO: 128120 - DNA, 22 bp, Artificial Sequence
  Synthetic oligonucleotide; TTG chr11 5314730 5314751 5314735 5314730 -
tgatcttcatgatttctgggcc

SEQ ID NO: 128121 - DNA, 22 bp, Artificial Sequence
  Synthetic oligonucleotide; CTT chr11 5314723 5314744 5314728 5314723 -
catgatttctgggccttttgag

SEQ ID NO: 128122 - DNA, 22 bp, Artificial Sequence
  Synthetic oligonucleotide; TTC chr11 5314722 5314743 5314727 5314722 -
atgatttctgggccttttgagt

SEQ ID NO: 128123 - DNA, 22 bp, Artificial Sequence
  Synthetic oligonucleotide; TTT chr11 5314715 5314736 5314720 5314715 -
ctgggccttttgagtaattgga

SEQ ID NO: 128124 - DNA, 22 bp, Artificial Sequence
  Synthetic oligonucleotide; TTC chr11 5314714 5314735 5314719 5314714 -
tgggccttttgagtaattggaa

SEQ ID NO: 128125 - DNA, 22 bp, Artificial Sequence
  Synthetic oligonucleotide; CTG chr11 5314712 5314733 5314717 5314712 -
ggccttttgagtaattggaaag

SEQ ID NO: 128126 - DNA, 22 bp, Artificial Sequence
  Synthetic oligonucleotide; CTT chr11 5314706 5314727 5314711 5314706 -
ttgagtaattggaaaggagctt

SEQ ID NO: 128127 - DNA, 22 bp, Artificial Sequence
  Synthetic oligonucleotide; TTT chr11 5314705 5314726 5314710 5314705 -
tgagtaattggaaaggagctta

SEQ ID NO: 128128 - DNA, 22 bp, Artificial Sequence
  Synthetic oligonucleotide; TTT chr11 5314704 5314725 5314709 5314704 -
gagtaattggaaaggagcttat

SEQ ID NO: 128129 - DNA, 22 bp, Artificial Sequence
  Synthetic oligonucleotide; TTG chr11 5314703 5314724 5314708 5314703 -
agtaattggaaaggagcttatt

SEQ ID NO: 128130 - DNA, 22 bp, Artificial Sequence
  Synthetic oligonucleotide; TTG chr11 5314695 5314716 5314700 5314695 -
gaaaggagcttattttataccc

SEQ ID NO: 128131 - DNA, 22 bp, Artificial Sequence
  Synthetic oligonucleotide; CTT chr11 5314684 5314705 5314689 5314684 -
attttatacccaatatctcttg

SEQ ID NO: 128132 - DNA, 22 bp, Artificial Sequence
  Synthetic oligonucleotide; TTA chr11 5314683 5314704 5314688 5314683 -
ttttatacccaatatctcttgt

SEQ ID NO: 128133 - DNA, 22 bp, Artificial Sequence
  Synthetic oligonucleotide; TTT chr11 5314680 5314701 5314685 5314680 -
tatacccaatatctcttgtatc

SEQ ID NO: 128134 - DNA, 22 bp, Artificial Sequence
  Synthetic oligonucleotide; TTT chr11 5314679 5314700 5314684 5314679 -
atacccaatatctcttgtatca

SEQ ID NO: 128135 - DNA, 22 bp, Artificial Sequence
  Synthetic oligonucleotide; TTA chr11 5314678 5314699 5314683 5314678 -
tacccaatatctcttgtatcag

SEQ ID NO: 128136 - DNA, 22 bp, Artificial Sequence
  Synthetic oligonucleotide; CTC chr11 5314665 5314686 5314670 5314665 -
ttgtatcagtgttagataggct

SEQ ID NO: 128137 - DNA, 22 bp, Artificial Sequence
  Synthetic oligonucleotide; CTT chr11 5314663 5314684 5314668 5314663 -
gtatcagtgttagataggcttt

SEQ ID NO: 128138 - DNA, 22 bp, Artificial Sequence
  Synthetic oligonucleotide; TTG chr11 5314662 5314683 5314667 5314662 -
tatcagtgttagataggcttta

SEQ ID NO: 128139 - DNA, 22 bp, Artificial Sequence
  Synthetic oligonucleotide; TTA chr11 5314651 5314672 5314656 5314651 -
gataggctttaactattatcta

SEQ ID NO: 128140 - DNA, 22 bp, Artificial Sequence
  Synthetic oligonucleotide; CTT chr11 5314642 5314663 5314647 5314642 -
taactattatctaaagtgaaaa

SEQ ID NO: 128141 - DNA, 22 bp, Artificial Sequence
  Synthetic oligonucleotide; TTT chr11 5314641 5314662 5314646 5314641 -
aactattatctaaagtgaaaag

SEQ ID NO: 128142 - DNA, 22 bp, Artificial Sequence
  Synthetic oligonucleotide; TTA chr11 5314640 5314661 5314645 5314640 -
actattatctaaagtgaaaagc

SEQ ID NO: 128143 - DNA, 22 bp, Artificial Sequence
  Synthetic oligonucleotide; CTA chr11 5314636 5314657 5314641 5314636 -
ttatctaaagtgaaaagctaca

SEQ ID NO: 128144 - DNA, 22 bp, Artificial Sequence
  Synthetic oligonucleotide; TTA chr11 5314633 5314654 5314638 5314633 -
tctaaagtgaaaagctacatgg

SEQ ID NO: 128145 - DNA, 22 bp, Artificial Sequence
  Synthetic oligonucleotide; CTA chr11 5314629 5314650 5314634 5314629 -
aagtgaaaagctacatggaaca

SEQ ID NO: 128146 - DNA, 22 bp, Artificial Sequence
  Synthetic oligonucleotide; CTA chr11 5314616 5314637 5314621 5314616 -
catggaacaataatacaatgaa

SEQ ID NO: 128147 - DNA, 22 bp, Artificial Sequence
  Synthetic oligonucleotide; TTG chr11 5314579 5314600 5314584 5314579 -
atcaattgataaatacataaat

SEQ ID NO: 128148 - DNA, 22 bp, Artificial Sequence
  Synthetic oligonucleotide; TTG chr11 5314571 5314592 5314576 5314571 -
ataaatacataaatatatgtat

SEQ ID NO: 128149 - DNA, 22 bp, Artificial Sequence
  Synthetic oligonucleotide; TTC chr11 5314539 5314560 5314544 5314539 -
atatgtagatgtaaagctttat

SEQ ID NO: 128150 - DNA, 22 bp, Artificial Sequence
  Synthetic oligonucleotide; CTT chr11 5314520 5314541 5314525 5314520 -
tatcgagggagatatatctata

SEQ ID NO: 128151 - DNA, 22 bp, Artificial Sequence
  Synthetic oligonucleotide; TTT chr11 5314519 5314540 5314524 5314519 -
atcgagggagatatatctataa

SEQ ID NO: 128152 - DNA, 22 bp, Artificial Sequence
  Synthetic oligonucleotide; TTA chr11 5314518 5314539 5314523 5314518 -
tcgagggagatatatctataat

SEQ ID NO: 128153 - DNA, 22 bp, Artificial Sequence
  Synthetic oligonucleotide; CTA chr11 5314500 5314521 5314505 5314500 -
taatttacctatctattgagag

SEQ ID NO: 128154 - DNA, 22 bp, Artificial Sequence
  Synthetic oligonucleotide; TTT chr11 5314494 5314515 5314499 5314494 -
acctatctattgagagatacta

SEQ ID NO: 128155 - DNA, 22 bp, Artificial Sequence
  Synthetic oligonucleotide; TTA chr11 5314493 5314514 5314498 5314493 -
cctatctattgagagatactag

SEQ ID NO: 128156 - DNA, 22 bp, Artificial Sequence
  Synthetic oligonucleotide; CTA chr11 5314489 5314510 5314494 5314489 -
tctattgagagatactaggaaa

SEQ ID NO: 128157 - DNA, 22 bp, Artificial Sequence
  Synthetic oligonucleotide; CTA chr11 5314485 5314506 5314490 5314485 -
ttgagagatactaggaaagtgg

SEQ ID NO: 128158 - DNA, 22 bp, Artificial Sequence
  Synthetic oligonucleotide; TTG chr11 5314482 5314503 5314487 5314482 -
agagatactaggaaagtggaat

SEQ ID NO: 128159 - DNA, 22 bp, Artificial Sequence
  Synthetic oligonucleotide; CTA chr11 5314472 5314493 5314477 5314472 -
ggaaagtggaatactattgaat

SEQ ID NO: 128160 - DNA, 22 bp, Artificial Sequence
  Synthetic oligonucleotide; CTA chr11 5314456 5314477 5314461 5314456 -
ttgaatatggagataaaacatg

SEQ ID NO: 128161 - DNA, 22 bp, Artificial Sequence
  Synthetic oligonucleotide; TTG chr11 5314453 5314474 5314458 5314453 -
aatatggagataaaacatgtag

SEQ ID NO: 128162 - DNA, 22 bp, Artificial Sequence
  Synthetic oligonucleotide; CTA chr11 5314419 5314440 5314424 5314419 -
ataatcagggaaaatatggtta

SEQ ID NO: 128163 - DNA, 22 bp, Artificial Sequence
  Synthetic oligonucleotide; TTA chr11 5314397 5314418 5314402 5314397 -
ttcataacctgtattcataaga

SEQ ID NO: 128164 - DNA, 22 bp, Artificial Sequence
  Synthetic oligonucleotide; TTC chr11 5314394 5314415 5314399 5314394 -
ataacctgtattcataagaact

SEQ ID NO: 128165 - DNA, 22 bp, Artificial Sequence
  Synthetic oligonucleotide; CTG chr11 5314386 5314407 5314391 5314386 -
tattcataagaactgaaagtac

SEQ ID NO: 128166 - DNA, 22 bp, Artificial Sequence
  Synthetic oligonucleotide; TTC chr11 5314381 5314402 5314386 5314381 -
ataagaactgaaagtaccattt

SEQ ID NO: 128167 - DNA, 22 bp, Artificial Sequence
  Synthetic oligonucleotide; CTG chr11 5314371 5314392 5314376 5314371 -
aaagtaccattttaggaagagt

SEQ ID NO: 128168 - DNA, 22 bp, Artificial Sequence
  Synthetic oligonucleotide; TTT chr11 5314359 5314380 5314364 5314359 -
taggaagagtcaagtggccagt

SEQ ID NO: 128169 - DNA, 22 bp, Artificial Sequence
  Synthetic oligonucleotide; TTT chr11 5314358 5314379 5314363 5314358 -
aggaagagtcaagtggccagtc

SEQ ID NO: 128170 - DNA, 22 bp, Artificial Sequence
  Synthetic oligonucleotide; TTA chr11 5314357 5314378 5314362 5314357 -
ggaagagtcaagtggccagtct

SEQ ID NO: 128171 - DNA, 22 bp, Artificial Sequence
  Synthetic oligonucleotide; CTA chr11 5314334 5314355 5314339 5314334 -
gttcaaccaaagcctacagaag

SEQ ID NO: 128172 - DNA, 22 bp, Artificial Sequence
  Synthetic oligonucleotide; TTC chr11 5314330 5314351 5314335 5314330 -
aaccaaagcctacagaaggaaa

SEQ ID NO: 128173 - DNA, 22 bp, Artificial Sequence
  Synthetic oligonucleotide; CTA chr11 5314318 5314339 5314323 5314318 -
cagaaggaaaaatgtgcaattg

SEQ ID NO: 128174 - DNA, 22 bp, Artificial Sequence
  Synthetic oligonucleotide; TTG chr11 5314296 5314317 5314301 5314296 -
cagatctagttttggccatata

SEQ ID NO: 128175 - DNA, 22 bp, Artificial Sequence
  Synthetic oligonucleotide; CTA chr11 5314288 5314309 5314293 5314288 -
gttttggccatataaagatgaa

SEQ ID NO: 128176 - DNA, 22 bp, Artificial Sequence
  Synthetic oligonucleotide; TTT chr11 5314284 5314305 5314289 5314284 -
tggccatataaagatgaattat

SEQ ID NO: 128177 - DNA, 22 bp, Artificial Sequence
  Synthetic oligonucleotide; TTT chr11 5314283 5314304 5314288 5314283 -
ggccatataaagatgaattata

SEQ ID NO: 128178 - DNA, 22 bp, Artificial Sequence
  Synthetic oligonucleotide; TTG chr11 5314282 5314303 5314287 5314282 -
gccatataaagatgaattatag

SEQ ID NO: 128179 - DNA, 22 bp, Artificial Sequence
  Synthetic oligonucleotide; TTA chr11 5314263 5314284 5314268 5314263 -
tagcatgtgaattgaggtcatg

SEQ ID NO: 128180 - DNA, 22 bp, Artificial Sequence
  Synthetic oligonucleotide; TTG chr11 5314249 5314270 5314254 5314249 -
aggtcatggaactctactataa

SEQ ID NO: 128181 - DNA, 22 bp, Artificial Sequence
  Synthetic oligonucleotide; CTC chr11 5314235 5314256 5314240 5314235 -
tactataatctcaaaactactc

SEQ ID NO: 128182 - DNA, 22 bp, Artificial Sequence
  Synthetic oligonucleotide; CTA chr11 5314233 5314254 5314238 5314233 -
ctataatctcaaaactactcta

SEQ ID NO: 128183 - DNA, 22 bp, Artificial Sequence
  Synthetic oligonucleotide; CTA chr11 5314230 5314251 5314235 5314230 -
taatctcaaaactactctattt

SEQ ID NO: 128184 - DNA, 22 bp, Artificial Sequence
  Synthetic oligonucleotide; CTC chr11 5314223 5314244 5314228 5314223 -
aaaactactctatttcagggta

SEQ ID NO: 128185 - DNA, 22 bp, Artificial Sequence
  Synthetic oligonucleotide; CTA chr11 5314216 5314237 5314221 5314216 -
ctctatttcagggtagattttc

SEQ ID NO: 128186 - DNA, 22 bp, Artificial Sequence
  Synthetic oligonucleotide; CTC chr11 5314213 5314234 5314218 5314213 -
tatttcagggtagattttcctt

SEQ ID NO: 128187 - DNA, 22 bp, Artificial Sequence
  Synthetic oligonucleotide; CTA chr11 5314211 5314232 5314216 5314211 -
tttcagggtagattttcctttt

SEQ ID NO: 128188 - DNA, 22 bp, Artificial Sequence
  Synthetic oligonucleotide; TTT chr11 5314208 5314229 5314213 5314208 -
cagggtagattttccttttttt

SEQ ID NO: 128189 - DNA, 22 bp, Artificial Sequence
  Synthetic oligonucleotide; TTC chr11 5314207 5314228 5314212 5314207 -
agggtagattttcctttttttt

SEQ ID NO: 128190 - DNA, 22 bp, Artificial Sequence
  Synthetic oligonucleotide; TTT chr11 5314196 5314217 5314201 5314196 -
tcctttttttttttttttttta

SEQ ID NO: 128191 - DNA, 22 bp, Artificial Sequence
  Synthetic oligonucleotide; TTT chr11 5314195 5314216 5314200 5314195 -
ccttttttttttttttttttaa

SEQ ID NO: 128192 - DNA, 22 bp, Artificial Sequence
  Synthetic oligonucleotide; TTC chr11 5314194 5314215 5314199 5314194 -
cttttttttttttttttttaaa

SEQ ID NO: 128193 - DNA, 22 bp, Artificial Sequence
  Synthetic oligonucleotide; CTT chr11 5314191 5314212 5314196 5314191 -
ttttttttttttttttaaaata

SEQ ID NO: 128194 - DNA, 22 bp, Artificial Sequence
  Synthetic oligonucleotide; TTT chr11 5314190 5314211 5314195 5314190 -
tttttttttttttttaaaatag

SEQ ID NO: 128195 - DNA, 22 bp, Artificial Sequence
  Synthetic oligonucleotide; TTT chr11 5314189 5314210 5314194 5314189 -
ttttttttttttttaaaataga

SEQ ID NO: 128196 - DNA, 22 bp, Artificial Sequence
  Synthetic oligonucleotide; TTT chr11 5314188 5314209 5314193 5314188 -
tttttttttttttaaaatagat

SEQ ID NO: 128197 - DNA, 22 bp, Artificial Sequence
  Synthetic oligonucleotide; TTT chr11 5314187 5314208 5314192 5314187 -
ttttttttttttaaaatagatt

SEQ ID NO: 128198 - DNA, 22 bp, Artificial Sequence
  Synthetic oligonucleotide; TTT chr11 5314186 5314207 5314191 5314186 -
tttttttttttaaaatagattt

SEQ ID NO: 128199 - DNA, 22 bp, Artificial Sequence
  Synthetic oligonucleotide; TTT chr11 5314185 5314206 5314190 5314185 -
ttttttttttaaaatagatttt

SEQ ID NO: 128200 - DNA, 22 bp, Artificial Sequence
  Synthetic oligonucleotide; TTT chr11 5314184 5314205 5314189 5314184 -
tttttttttaaaatagatttta

SEQ ID NO: 128201 - DNA, 22 bp, Artificial Sequence
  Synthetic oligonucleotide; TTT chr11 5314183 5314204 5314188 5314183 -
ttttttttaaaatagattttat

SEQ ID NO: 128202 - DNA, 22 bp, Artificial Sequence
  Synthetic oligonucleotide; TTT chr11 5314182 5314203 5314187 5314182 -
tttttttaaaatagattttatt

SEQ ID NO: 128203 - DNA, 22 bp, Artificial Sequence
  Synthetic oligonucleotide; TTT chr11 5314181 5314202 5314186 5314181 -
ttttttaaaatagattttattt

SEQ ID NO: 128204 - DNA, 22 bp, Artificial Sequence
  Synthetic oligonucleotide; TTT chr11 5314180 5314201 5314185 5314180 -
tttttaaaatagattttatttt

SEQ ID NO: 128205 - DNA, 22 bp, Artificial Sequence
  Synthetic oligonucleotide; TTT chr11 5314179 5314200 5314184 5314179 -
ttttaaaatagattttattttc

SEQ ID NO: 128206 - DNA, 22 bp, Artificial Sequence
  Synthetic oligonucleotide; TTT chr11 5314178 5314199 5314183 5314178 -
tttaaaatagattttattttcc

SEQ ID NO: 128207 - DNA, 22 bp, Artificial Sequence
  Synthetic oligonucleotide; TTT chr11 5314177 5314198 5314182 5314177 -
ttaaaatagattttattttcct

SEQ ID NO: 128208 - DNA, 22 bp, Artificial Sequence
  Synthetic oligonucleotide; TTT chr11 5314176 5314197 5314181 5314176 -
taaaatagattttattttcctt

SEQ ID NO: 128209 - DNA, 22 bp, Artificial Sequence
  Synthetic oligonucleotide; TTT chr11 5314175 5314196 5314180 5314175 -
aaaatagattttattttccttc

SEQ ID NO: 128210 - DNA, 22 bp, Artificial Sequence
  Synthetic oligonucleotide; TTA chr11 5314174 5314195 5314179 5314174 -
aaatagattttattttccttca

SEQ ID NO: 128211 - DNA, 22 bp, Artificial Sequence
  Synthetic oligonucleotide; TTT chr11 5314164 5314185 5314169 5314164 -
tattttccttcaacttattagg

SEQ ID NO: 128212 - DNA, 22 bp, Artificial Sequence
  Synthetic oligonucleotide; TTT chr11 5314163 5314184 5314168 5314163 -
attttccttcaacttattaggt

SEQ ID NO: 128213 - DNA, 22 bp, Artificial Sequence
  Synthetic oligonucleotide; TTA chr11 5314162 5314183 5314167 5314162 -
ttttccttcaacttattaggta

SEQ ID NO: 128214 - DNA, 22 bp, Artificial Sequence
  Synthetic oligonucleotide; TTT chr11 5314159 5314180 5314164 5314159 -
tccttcaacttattaggtaggt

SEQ ID NO: 128215 - DNA, 22 bp, Artificial Sequence
  Synthetic oligonucleotide; TTT chr11 5314158 5314179 5314163 5314158 -
ccttcaacttattaggtaggtg

SEQ ID NO: 128216 - DNA, 22 bp, Artificial Sequence
  Synthetic oligonucleotide; TTC chr11 5314157 5314178 5314162 5314157 -
cttcaacttattaggtaggtgc

SEQ ID NO: 128217 - DNA, 22 bp, Artificial Sequence
  Synthetic oligonucleotide; CTT chr11 5314154 5314175 5314159 5314154 -
caacttattaggtaggtgcaaa

SEQ ID NO: 128218 - DNA, 22 bp, Artificial Sequence
  Synthetic oligonucleotide; TTC chr11 5314153 5314174 5314158 5314153 -
aacttattaggtaggtgcaaag

SEQ ID NO: 128219 - DNA, 22 bp, Artificial Sequence
  Synthetic oligonucleotide; CTT chr11 5314148 5314169 5314153 5314148 -
attaggtaggtgcaaaggtaat

SEQ ID NO: 128220 - DNA, 22 bp, Artificial Sequence
  Synthetic oligonucleotide; TTA chr11 5314147 5314168 5314152 5314147 -
ttaggtaggtgcaaaggtaatt

SEQ ID NO: 128221 - DNA, 22 bp, Artificial Sequence
  Synthetic oligonucleotide; TTA chr11 5314144 5314165 5314149 5314144 -
ggtaggtgcaaaggtaattgca

SEQ ID NO: 128222 - DNA, 22 bp, Artificial Sequence
  Synthetic oligonucleotide; TTG chr11 5314124 5314145 5314129 5314124 -
cagttcacagaaattacttttg

SEQ ID NO: 128223 - DNA, 22 bp, Artificial Sequence
  Synthetic oligonucleotide; TTC chr11 5314118 5314139 5314123 5314118 -
acagaaattacttttgtaccaa

SEQ ID NO: 128224 - DNA, 22 bp, Artificial Sequence
  Synthetic oligonucleotide; TTA chr11 5314108 5314129 5314113 5314108 -
cttttgtaccaacataatatat

SEQ ID NO: 128225 - DNA, 22 bp, Artificial Sequence
  Synthetic oligonucleotide; CTT chr11 5314105 5314126 5314110 5314105 -
ttgtaccaacataatatatttt

SEQ ID NO: 128226 - DNA, 22 bp, Artificial Sequence
  Synthetic oligonucleotide; TTT chr11 5314104 5314125 5314109 5314104 -
tgtaccaacataatatatttta

SEQ ID NO: 128227 - DNA, 22 bp, Artificial Sequence
  Synthetic oligonucleotide; TTT chr11 5314103 5314124 5314108 5314103 -
gtaccaacataatatattttaa

SEQ ID NO: 128228 - DNA, 22 bp, Artificial Sequence
  Synthetic oligonucleotide; TTG chr11 5314102 5314123 5314107 5314102 -
taccaacataatatattttaag

SEQ ID NO: 128229 - DNA, 22 bp, Artificial Sequence
  Synthetic oligonucleotide; TTT chr11 5314084 5314105 5314089 5314084 -
taagttccagggcacatgtgca

SEQ ID NO: 128230 - DNA, 22 bp, Artificial Sequence
  Synthetic oligonucleotide; TTT chr11 5314083 5314104 5314088 5314083 -
aagttccagggcacatgtgcag

SEQ ID NO: 128231 - DNA, 22 bp, Artificial Sequence
  Synthetic oligonucleotide; TTA chr11 5314082 5314103 5314087 5314082 -
agttccagggcacatgtgcagg

SEQ ID NO: 128232 - DNA, 22 bp, Artificial Sequence
  Synthetic oligonucleotide; TTC chr11 5314077 5314098 5314082 5314077 -
cagggcacatgtgcaggatgtg

SEQ ID NO: 128233 - DNA, 22 bp, Artificial Sequence
  Synthetic oligonucleotide; TTT chr11 5314048 5314069 5314053 5314048 -
attacataggtaaatgtgtgcc

SEQ ID NO: 128234 - DNA, 22 bp, Artificial Sequence
  Synthetic oligonucleotide; TTA chr11 5314047 5314068 5314052 5314047 -
ttacataggtaaatgtgtgcca

SEQ ID NO: 128235 - DNA, 22 bp, Artificial Sequence
  Synthetic oligonucleotide; TTA chr11 5314044 5314065 5314049 5314044 -
cataggtaaatgtgtgccatgc

SEQ ID NO: 128236 - DNA, 22 bp, Artificial Sequence
  Synthetic oligonucleotide; TTT chr11 5314016 5314037 5314021 5314016 -
gctgcattcgttagctattctt

SEQ ID NO: 128237 - DNA, 22 bp, Artificial Sequence
  Synthetic oligonucleotide; TTG chr11 5314015 5314036 5314020 5314015 -
ctgcattcgttagctattcttc

SEQ ID NO: 128238 - DNA, 22 bp, Artificial Sequence
  Synthetic oligonucleotide; CTG chr11 5314012 5314033 5314017 5314012 -
cattcgttagctattcttcctg

SEQ ID NO: 128239 - DNA, 22 bp, Artificial Sequence
  Synthetic oligonucleotide; TTC chr11 5314007 5314028 5314012 5314007 -
gttagctattcttcctggtgct

SEQ ID NO: 128240 - DNA, 22 bp, Artificial Sequence
  Synthetic oligonucleotide; TTA chr11 5314003 5314024 5314008 5314003 -
gctattcttcctggtgctctcc

SEQ ID NO: 128241 - DNA, 22 bp, Artificial Sequence
  Synthetic oligonucleotide; CTA chr11 5313999 5314020 5314004 5313999 -
ttcttcctggtgctctccctct

SEQ ID NO: 128242 - DNA, 22 bp, Artificial Sequence
  Synthetic oligonucleotide; TTC chr11 5313996 5314017 5314001 5313996 -
ttcctggtgctctccctctcct

SEQ ID NO: 128243 - DNA, 22 bp, Artificial Sequence
  Synthetic oligonucleotide; CTT chr11 5313994 5314015 5313999 5313994 -
cctggtgctctccctctcctcc

SEQ ID NO: 128244 - DNA, 22 bp, Artificial Sequence
  Synthetic oligonucleotide; TTC chr11 5313993 5314014 5313998 5313993 -
ctggtgctctccctctcctccc

SEQ ID NO: 128245 - DNA, 22 bp, Artificial Sequence
  Synthetic oligonucleotide; CTG chr11 5313990 5314011 5313995 5313990 -
gtgctctccctctcctccccac

SEQ ID NO: 128246 - DNA, 22 bp, Artificial Sequence
  Synthetic oligonucleotide; CTC chr11 5313984 5314005 5313989 5313984 -
tccctctcctccccacccacta

SEQ ID NO: 128247 - DNA, 22 bp, Artificial Sequence
  Synthetic oligonucleotide; CTC chr11 5313982 5314003 5313987 5313982 -
cctctcctccccacccactacc

SEQ ID NO: 128248 - DNA, 22 bp, Artificial Sequence
  Synthetic oligonucleotide; CTC chr11 5313978 5313999 5313983 5313978 -
tcctccccacccactaccggac

SEQ ID NO: 128249 - DNA, 22 bp, Artificial Sequence
  Synthetic oligonucleotide; CTC chr11 5313976 5313997 5313981 5313976 -
ctccccacccactaccggacag

SEQ ID NO: 128250 - DNA, 22 bp, Artificial Sequence
  Synthetic oligonucleotide; CTC chr11 5313973 5313994 5313978 5313973 -
cccacccactaccggacaggcc

SEQ ID NO: 128251 - DNA, 22 bp, Artificial Sequence
  Synthetic oligonucleotide; CTA chr11 5313962 5313983 5313967 5313962 -
ccggacaggcccctgtgtgtgt

SEQ ID NO: 128252 - DNA, 22 bp, Artificial Sequence
  Synthetic oligonucleotide; CTG chr11 5313947 5313968 5313952 5313947 -
tgtgtgttgttccccacaagtg

SEQ ID NO: 128253 - DNA, 22 bp, Artificial Sequence
  Synthetic oligonucleotide; TTG chr11 5313938 5313959 5313943 5313938 -
ttccccacaagtgtccatgtgt

SEQ ID NO: 128254 - DNA, 22 bp, Artificial Sequence
  Synthetic oligonucleotide; TTC chr11 5313935 5313956 5313940 5313935 -
cccacaagtgtccatgtgttct

SEQ ID NO: 128255 - DNA, 22 bp, Artificial Sequence
  Synthetic oligonucleotide; TTC chr11 5313914 5313935 5313919 5313914 -
tcactgttcagctcccatttct

SEQ ID NO: 128256 - DNA, 22 bp, Artificial Sequence
  Synthetic oligonucleotide; CTC chr11 5313912 5313933 5313917 5313912 -
actgttcagctcccatttctgt

SEQ ID NO: 128257 - DNA, 22 bp, Artificial Sequence
  Synthetic oligonucleotide; CTG chr11 5313908 5313929 5313913 5313908 -
ttcagctcccatttctgtgtga

SEQ ID NO: 128258 - DNA, 22 bp, Artificial Sequence
  Synthetic oligonucleotide; TTC chr11 5313905 5313926 5313910 5313905 -
agctcccatttctgtgtgagaa

SEQ ID NO: 128259 - DNA, 22 bp, Artificial Sequence
  Synthetic oligonucleotide; CTC chr11 5313900 5313921 5313905 5313900 -
ccatttctgtgtgagaacatgt

SEQ ID NO: 128260 - DNA, 22 bp, Artificial Sequence
  Synthetic oligonucleotide; TTT chr11 5313894 5313915 5313899 5313894 -
ctgtgtgagaacatgtgtgttt

SEQ ID NO: 128261 - DNA, 22 bp, Artificial Sequence
  Synthetic oligonucleotide; TTC chr11 5313893 5313914 5313898 5313893 -
tgtgtgagaacatgtgtgtttg

SEQ ID NO: 128262 - DNA, 22 bp, Artificial Sequence
  Synthetic oligonucleotide; CTG chr11 5313891 5313912 5313896 5313891 -
tgtgagaacatgtgtgtttggt

SEQ ID NO: 128263 - DNA, 22 bp, Artificial Sequence
  Synthetic oligonucleotide; TTT chr11 5313872 5313893 5313877 5313872 -
ggttttctgttcctgtgttagt

SEQ ID NO: 128264 - DNA, 22 bp, Artificial Sequence
  Synthetic oligonucleotide; TTG chr11 5313871 5313892 5313876 5313871 -
gttttctgttcctgtgttagtt

SEQ ID NO: 128265 - DNA, 22 bp, Artificial Sequence
  Synthetic oligonucleotide; TTT chr11 5313867 5313888 5313872 5313867 -
tctgttcctgtgttagtttgat

SEQ ID NO: 128266 - DNA, 22 bp, Artificial Sequence
  Synthetic oligonucleotide; TTT chr11 5313866 5313887 5313871 5313866 -
ctgttcctgtgttagtttgatg

SEQ ID NO: 128267 - DNA, 22 bp, Artificial Sequence
  Synthetic oligonucleotide; TTC chr11 5313865 5313886 5313870 5313865 -
tgttcctgtgttagtttgatga

SEQ ID NO: 128268 - DNA, 22 bp, Artificial Sequence
  Synthetic oligonucleotide; CTG chr11 5313863 5313884 5313868 5313863 -
ttcctgtgttagtttgatgagg

SEQ ID NO: 128269 - DNA, 22 bp, Artificial Sequence
  Synthetic oligonucleotide; TTC chr11 5313860 5313881 5313865 5313860 -
ctgtgttagtttgatgaggata

SEQ ID NO: 128270 - DNA, 22 bp, Artificial Sequence
  Synthetic oligonucleotide; CTG chr11 5313857 5313878 5313862 5313857 -
tgttagtttgatgaggataatg

SEQ ID NO: 128271 - DNA, 22 bp, Artificial Sequence
  Synthetic oligonucleotide; TTA chr11 5313852 5313873 5313857 5313852 -
gtttgatgaggataatggcttc

SEQ ID NO: 128272 - DNA, 22 bp, Artificial Sequence
  Synthetic oligonucleotide; TTT chr11 5313848 5313869 5313853 5313848 -
gatgaggataatggcttccagc

SEQ ID NO: 128273 - DNA, 22 bp, Artificial Sequence
  Synthetic oligonucleotide; TTG chr11 5313847 5313868 5313852 5313847 -
atgaggataatggcttccagct

SEQ ID NO: 128274 - DNA, 22 bp, Artificial Sequence
  Synthetic oligonucleotide; CTT chr11 5313831 5313852 5313836 5313831 -
ccagctccattcatgtccctgc

SEQ ID NO: 128275 - DNA, 22 bp, Artificial Sequence
  Synthetic oligonucleotide; TTC chr11 5313830 5313851 5313835 5313830 -
cagctccattcatgtccctgca

SEQ ID NO: 128276 - DNA, 22 bp, Artificial Sequence
  Synthetic oligonucleotide; CTC chr11 5313824 5313845 5313829 5313824 -
cattcatgtccctgcaaggaac

SEQ ID NO: 128277 - DNA, 22 bp, Artificial Sequence
  Synthetic oligonucleotide; TTC chr11 5313819 5313840 5313824 5313819 -
atgtccctgcaaggaacacaat

SEQ ID NO: 128278 - DNA, 22 bp, Artificial Sequence
  Synthetic oligonucleotide; CTG chr11 5313810 5313831 5313815 5313810 -
caaggaacacaatccttttcct

SEQ ID NO: 128279 - DNA, 22 bp, Artificial Sequence
  Synthetic oligonucleotide; CTT chr11 5313793 5313814 5313798 5313793 -
ttcctttttatggctgtatagt

SEQ ID NO: 128280 - DNA, 22 bp, Artificial Sequence
  Synthetic oligonucleotide; TTT chr11 5313792 5313813 5313797 5313792 -
tcctttttatggctgtatagta

SEQ ID NO: 128281 - DNA, 22 bp, Artificial Sequence
  Synthetic oligonucleotide; TTT chr11 5313791 5313812 5313796 5313791 -
cctttttatggctgtatagtat

SEQ ID NO: 128282 - DNA, 22 bp, Artificial Sequence
  Synthetic oligonucleotide; TTC chr11 5313790 5313811 5313795 5313790 -
ctttttatggctgtatagtatt

SEQ ID NO: 128283 - DNA, 22 bp, Artificial Sequence
  Synthetic oligonucleotide; CTT chr11 5313787 5313808 5313792 5313787 -
tttatggctgtatagtattcca

SEQ ID NO: 128284 - DNA, 22 bp, Artificial Sequence
  Synthetic oligonucleotide; TTT chr11 5313786 5313807 5313791 5313786 -
ttatggctgtatagtattccat

SEQ ID NO: 128285 - DNA, 22 bp, Artificial Sequence
  Synthetic oligonucleotide; TTT chr11 5313785 5313806 5313790 5313785 -
tatggctgtatagtattccatg

SEQ ID NO: 128286 - DNA, 22 bp, Artificial Sequence
  Synthetic oligonucleotide; TTT chr11 5313784 5313805 5313789 5313784 -
atggctgtatagtattccatgg

SEQ ID NO: 128287 - DNA, 22 bp, Artificial Sequence
  Synthetic oligonucleotide; TTA chr11 5313783 5313804 5313788 5313783 -
tggctgtatagtattccatggt

SEQ ID NO: 128288 - DNA, 22 bp, Artificial Sequence
  Synthetic oligonucleotide; CTG chr11 5313777 5313798 5313782 5313777 -
tatagtattccatggtatatat

SEQ ID NO: 128289 - DNA, 22 bp, Artificial Sequence
  Synthetic oligonucleotide; TTC chr11 5313767 5313788 5313772 5313767 -
catggtatatatgtaccacgtt

SEQ ID NO: 128290 - DNA, 22 bp, Artificial Sequence
  Synthetic oligonucleotide; TTT chr11 5313744 5313765 5313749 5313744 -
tctttatccactctatcattga

SEQ ID NO: 128291 - DNA, 22 bp, Artificial Sequence
  Synthetic oligonucleotide; TTT chr11 5313743 5313764 5313748 5313743 -
ctttatccactctatcattgat

SEQ ID NO: 128292 - DNA, 22 bp, Artificial Sequence
  Synthetic oligonucleotide; TTC chr11 5313742 5313763 5313747 5313742 -
tttatccactctatcattgatg

SEQ ID NO: 128293 - DNA, 22 bp, Artificial Sequence
  Synthetic oligonucleotide; CTT chr11 5313740 5313761 5313745 5313740 -
tatccactctatcattgatgga

SEQ ID NO: 128294 - DNA, 22 bp, Artificial Sequence
  Synthetic oligonucleotide; TTT chr11 5313739 5313760 5313744 5313739 -
atccactctatcattgatggac

SEQ ID NO: 128295 - DNA, 22 bp, Artificial Sequence
  Synthetic oligonucleotide; TTA chr11 5313738 5313759 5313743 5313738 -
tccactctatcattgatggaca

SEQ ID NO: 128296 - DNA, 22 bp, Artificial Sequence
  Synthetic oligonucleotide; CTC chr11 5313731 5313752 5313736 5313731 -
tatcattgatggacatttgggt

SEQ ID NO: 128297 - DNA, 22 bp, Artificial Sequence
  Synthetic oligonucleotide; CTA chr11 5313729 5313750 5313734 5313729 -
tcattgatggacatttgggttg

SEQ ID NO: 128298 - DNA, 22 bp, Artificial Sequence
  Synthetic oligonucleotide; TTG chr11 5313723 5313744 5313728 5313723 -
atggacatttgggttgattcca

SEQ ID NO: 128299 - DNA, 22 bp, Artificial Sequence
  Synthetic oligonucleotide; TTT chr11 5313713 5313734 5313718 5313713 -
gggttgattccacatcttggct

SEQ ID NO: 128300 - DNA, 22 bp, Artificial Sequence
  Synthetic oligonucleotide; TTG chr11 5313712 5313733 5313717 5313712 -
ggttgattccacatcttggcta

SEQ ID NO: 128301 - DNA, 22 bp, Artificial Sequence
  Synthetic oligonucleotide; TTG chr11 5313707 5313728 5313712 5313707 -
attccacatcttggctattatg

SEQ ID NO: 128302 - DNA, 22 bp, Artificial Sequence
  Synthetic oligonucleotide; TTC chr11 5313703 5313724 5313708 5313703 -
cacatcttggctattatgaata

SEQ ID NO: 128303 - DNA, 22 bp, Artificial Sequence
  Synthetic oligonucleotide; CTT chr11 5313695 5313716 5313700 5313695 -
ggctattatgaataatgctgca

SEQ ID NO: 128304 - DNA, 22 bp, Artificial Sequence
  Synthetic oligonucleotide; TTG chr11 5313694 5313715 5313699 5313694 -
gctattatgaataatgctgcaa

SEQ ID NO: 128305 - DNA, 22 bp, Artificial Sequence
  Synthetic oligonucleotide; CTA chr11 5313690 5313711 5313695 5313690 -
ttatgaataatgctgcaatgaa

SEQ ID NO: 128306 - DNA, 22 bp, Artificial Sequence
  Synthetic oligonucleotide; TTA chr11 5313687 5313708 5313692 5313687 -
tgaataatgctgcaatgaacat

SEQ ID NO: 128307 - DNA, 22 bp, Artificial Sequence
  Synthetic oligonucleotide; CTG chr11 5313675 5313696 5313680 5313675 -
caatgaacataagcatgcctgt

SEQ ID NO: 128308 - DNA, 22 bp, Artificial Sequence
  Synthetic oligonucleotide; CTG chr11 5313654 5313675 5313659 5313654 -
tatttttataatagattgattt

SEQ ID NO: 128309 - DNA, 22 bp, Artificial Sequence
  Synthetic oligonucleotide; TTT chr11 5313649 5313670 5313654 5313649 -
ttataatagattgatttatatt

SEQ ID NO: 128310 - DNA, 22 bp, Artificial Sequence
  Synthetic oligonucleotide; TTT chr11 5313648 5313669 5313653 5313648 -
tataatagattgatttatattc

SEQ ID NO: 128311 - DNA, 22 bp, Artificial Sequence
  Synthetic oligonucleotide; TTT chr11 5313647 5313668 5313652 5313647 -
ataatagattgatttatattcc

SEQ ID NO: 128312 - DNA, 22 bp, Artificial Sequence
  Synthetic oligonucleotide; TTA chr11 5313646 5313667 5313651 5313646 -
taatagattgatttatattcct

SEQ ID NO: 128313 - DNA, 22 bp, Artificial Sequence
  Synthetic oligonucleotide; TTG chr11 5313636 5313657 5313641 5313636 -
atttatattcctttgggtatat

SEQ ID NO: 128314 - DNA, 22 bp, Artificial Sequence
  Synthetic oligonucleotide; TTT chr11 5313632 5313653 5313637 5313632 -
atattcctttgggtatataccc

SEQ ID NO: 128315 - DNA, 22 bp, Artificial Sequence
  Synthetic oligonucleotide; TTA chr11 5313631 5313652 5313636 5313631 -
tattcctttgggtatataccca

SEQ ID NO: 128316 - DNA, 22 bp, Artificial Sequence
  Synthetic oligonucleotide; TTC chr11 5313626 5313647 5313631 5313626 -
ctttgggtatatacccagtaat

SEQ ID NO: 128317 - DNA, 22 bp, Artificial Sequence
  Synthetic oligonucleotide; CTT chr11 5313623 5313644 5313628 5313623 -
tgggtatatacccagtaatgag

SEQ ID NO: 128318 - DNA, 22 bp, Artificial Sequence
  Synthetic oligonucleotide; TTT chr11 5313622 5313643 5313627 5313622 -
gggtatatacccagtaatgaga

SEQ ID NO: 128319 - DNA, 22 bp, Artificial Sequence
  Synthetic oligonucleotide; TTG chr11 5313621 5313642 5313626 5313621 -
ggtatatacccagtaatgagat

SEQ ID NO: 128320 - DNA, 22 bp, Artificial Sequence
  Synthetic oligonucleotide; TTG chr11 5313597 5313618 5313602 5313597 -
ctgagtcaagtggtatttctgc

SEQ ID NO: 128321 - DNA, 22 bp, Artificial Sequence
  Synthetic oligonucleotide; CTG chr11 5313594 5313615 5313599 5313594 -
agtcaagtggtatttctgcttc

SEQ ID NO: 128322 - DNA, 22 bp, Artificial Sequence
  Synthetic oligonucleotide; TTT chr11 5313579 5313600 5313584 5313579 -
ctgcttctacatctttgaggaa

SEQ ID NO: 128323 - DNA, 22 bp, Artificial Sequence
  Synthetic oligonucleotide; TTC chr11 5313578 5313599 5313583 5313578 -
tgcttctacatctttgaggaaa

SEQ ID NO: 128324 - DNA, 22 bp, Artificial Sequence
  Synthetic oligonucleotide; CTG chr11 5313576 5313597 5313581 5313576 -
cttctacatctttgaggaaagg

SEQ ID NO: 128325 - DNA, 22 bp, Artificial Sequence
  Synthetic oligonucleotide; CTT chr11 5313573 5313594 5313578 5313573 -
ctacatctttgaggaaaggcta

SEQ ID NO: 128326 - DNA, 22 bp, Artificial Sequence
  Synthetic oligonucleotide; TTC chr11 5313572 5313593 5313577 5313572 -
tacatctttgaggaaaggctac

SEQ ID NO: 128327 - DNA, 22 bp, Artificial Sequence
  Synthetic oligonucleotide; CTA chr11 5313570 5313591 5313575 5313570 -
catctttgaggaaaggctacac

SEQ ID NO: 128328 - DNA, 22 bp, Artificial Sequence
  Synthetic oligonucleotide; CTT chr11 5313564 5313585 5313569 5313564 -
tgaggaaaggctacactctctt

SEQ ID NO: 128329 - DNA, 22 bp, Artificial Sequence
  Synthetic oligonucleotide; TTT chr11 5313563 5313584 5313568 5313563 -
gaggaaaggctacactctcttc

SEQ ID NO: 128330 - DNA, 22 bp, Artificial Sequence
  Synthetic oligonucleotide; TTG chr11 5313562 5313583 5313567 5313562 -
aggaaaggctacactctcttcc

SEQ ID NO: 128331 - DNA, 22 bp, Artificial Sequence
  Synthetic oligonucleotide; CTA chr11 5313551 5313572 5313556 5313551 -
cactctcttccacaatgtttga

SEQ ID NO: 128332 - DNA, 22 bp, Artificial Sequence
  Synthetic oligonucleotide; CTC chr11 5313546 5313567 5313551 5313546 -
tcttccacaatgtttgaactaa

SEQ ID NO: 128333 - DNA, 22 bp, Artificial Sequence
  Synthetic oligonucleotide; CTC chr11 5313544 5313565 5313549 5313544 -
ttccacaatgtttgaactaatt

SEQ ID NO: 128334 - DNA, 22 bp, Artificial Sequence
  Synthetic oligonucleotide; CTT chr11 5313542 5313563 5313547 5313542 -
ccacaatgtttgaactaattta

SEQ ID NO: 128335 - DNA, 22 bp, Artificial Sequence
  Synthetic oligonucleotide; TTC chr11 5313541 5313562 5313546 5313541 -
cacaatgtttgaactaatttac

SEQ ID NO: 128336 - DNA, 22 bp, Artificial Sequence
  Synthetic oligonucleotide; TTT chr11 5313531 5313552 5313536 5313531 -
gaactaatttactctcccgtta

SEQ ID NO: 128337 - DNA, 22 bp, Artificial Sequence
  Synthetic oligonucleotide; TTG chr11 5313530 5313551 5313535 5313530 -
aactaatttactctcccgttaa

SEQ ID NO: 128338 - DNA, 22 bp, Artificial Sequence
  Synthetic oligonucleotide; CTA chr11 5313525 5313546 5313530 5313525 -
atttactctcccgttaacagtg

SEQ ID NO: 128339 - DNA, 22 bp, Artificial Sequence
  Synthetic oligonucleotide; TTT chr11 5313521 5313542 5313526 5313521 -
actctcccgttaacagtgtaaa

SEQ ID NO: 128340 - DNA, 22 bp, Artificial Sequence
  Synthetic oligonucleotide; TTA chr11 5313520 5313541 5313525 5313520 -
ctctcccgttaacagtgtaaaa

SEQ ID NO: 128341 - DNA, 22 bp, Artificial Sequence
  Synthetic oligonucleotide; CTC chr11 5313517 5313538 5313522 5313517 -
tcccgttaacagtgtaaaagca

SEQ ID NO: 128342 - DNA, 22 bp, Artificial Sequence
  Synthetic oligonucleotide; CTC chr11 5313515 5313536 5313520 5313515 -
ccgttaacagtgtaaaagcatt

SEQ ID NO: 128343 - DNA, 22 bp, Artificial Sequence
  Synthetic oligonucleotide; TTA chr11 5313509 5313530 5313514 5313509 -
acagtgtaaaagcattccattc

SEQ ID NO: 128344 - DNA, 22 bp, Artificial Sequence
  Synthetic oligonucleotide; TTC chr11 5313492 5313513 5313497 5313492 -
cattcctttctctctgcaacct

SEQ ID NO: 128345 - DNA, 22 bp, Artificial Sequence
  Synthetic oligonucleotide; TTC chr11 5313487 5313508 5313492 5313487 -
ctttctctctgcaaccttgcca

SEQ ID NO: 128346 - DNA, 22 bp, Artificial Sequence
  Synthetic oligonucleotide; CTT chr11 5313484 5313505 5313489 5313484 -
tctctctgcaaccttgccagca

SEQ ID NO: 128347 - DNA, 22 bp, Artificial Sequence
  Synthetic oligonucleotide; TTT chr11 5313483 5313504 5313488 5313483 -
ctctctgcaaccttgccagcaa

SEQ ID NO: 128348 - DNA, 22 bp, Artificial Sequence
  Synthetic oligonucleotide; TTC chr11 5313482 5313503 5313487 5313482 -
tctctgcaaccttgccagcaac

SEQ ID NO: 128349 - DNA, 22 bp, Artificial Sequence
  Synthetic oligonucleotide; CTC chr11 5313480 5313501 5313485 5313480 -
tctgcaaccttgccagcaactg

SEQ ID NO: 128350 - DNA, 22 bp, Artificial Sequence
  Synthetic oligonucleotide; CTC chr11 5313478 5313499 5313483 5313478 -
tgcaaccttgccagcaactgtt

SEQ ID NO: 128351 - DNA, 22 bp, Artificial Sequence
  Synthetic oligonucleotide; CTG chr11 5313476 5313497 5313481 5313476 -
caaccttgccagcaactgttgt

SEQ ID NO: 128352 - DNA, 22 bp, Artificial Sequence
  Synthetic oligonucleotide; CTT chr11 5313469 5313490 5313474 5313469 -
gccagcaactgttgtttcttga

SEQ ID NO: 128353 - DNA, 22 bp, Artificial Sequence
  Synthetic oligonucleotide; TTG chr11 5313468 5313489 5313473 5313468 -
ccagcaactgttgtttcttgac

SEQ ID NO: 128354 - DNA, 22 bp, Artificial Sequence
  Synthetic oligonucleotide; CTG chr11 5313458 5313479 5313463 5313458 -
ttgtttcttgactttttaataa

SEQ ID NO: 128355 - DNA, 22 bp, Artificial Sequence
  Synthetic oligonucleotide; TTG chr11 5313455 5313476 5313460 5313455 -
tttcttgactttttaataattg

SEQ ID NO: 128356 - DNA, 22 bp, Artificial Sequence
  Synthetic oligonucleotide; TTT chr11 5313452 5313473 5313457 5313452 -
cttgactttttaataattgcca

SEQ ID NO: 128357 - DNA, 22 bp, Artificial Sequence
  Synthetic oligonucleotide; TTC chr11 5313451 5313472 5313456 5313451 -
ttgactttttaataattgccat

SEQ ID NO: 128358 - DNA, 22 bp, Artificial Sequence
  Synthetic oligonucleotide; CTT chr11 5313449 5313470 5313454 5313449 -
gactttttaataattgccattc

SEQ ID NO: 128359 - DNA, 22 bp, Artificial Sequence
  Synthetic oligonucleotide; TTG chr11 5313448 5313469 5313453 5313448 -
actttttaataattgccattct

SEQ ID NO: 128360 - DNA, 22 bp, Artificial Sequence
  Synthetic oligonucleotide; CTT chr11 5313444 5313465 5313449 5313444 -
tttaataattgccattctgact

SEQ ID NO: 128361 - DNA, 22 bp, Artificial Sequence
  Synthetic oligonucleotide; TTT chr11 5313443 5313464 5313448 5313443 -
ttaataattgccattctgactg

SEQ ID NO: 128362 - DNA, 22 bp, Artificial Sequence
  Synthetic oligonucleotide; TTT chr11 5313442 5313463 5313447 5313442 -
taataattgccattctgactgg

SEQ ID NO: 128363 - DNA, 22 bp, Artificial Sequence
  Synthetic oligonucleotide; TTT chr11 5313441 5313462 5313446 5313441 -
aataattgccattctgactggt

SEQ ID NO: 128364 - DNA, 22 bp, Artificial Sequence
  Synthetic oligonucleotide; TTA chr11 5313440 5313461 5313445 5313440 -
ataattgccattctgactggtg

SEQ ID NO: 128365 - DNA, 22 bp, Artificial Sequence
  Synthetic oligonucleotide; TTG chr11 5313433 5313454 5313438 5313433 -
ccattctgactggtgtgagatg

SEQ ID NO: 128366 - DNA, 22 bp, Artificial Sequence
  Synthetic oligonucleotide; TTC chr11 5313427 5313448 5313432 5313427 -
tgactggtgtgagatggtatcc

SEQ ID NO: 128367 - DNA, 22 bp, Artificial Sequence
  Synthetic oligonucleotide; CTG chr11 5313425 5313446 5313430 5313425 -
actggtgtgagatggtatccca

SEQ ID NO: 128368 - DNA, 22 bp, Artificial Sequence
  Synthetic oligonucleotide; CTG chr11 5313421 5313442 5313426 5313421 -
gtgtgagatggtatcccattgt

SEQ ID NO: 128369 - DNA, 22 bp, Artificial Sequence
  Synthetic oligonucleotide; TTG chr11 5313400 5313421 5313405 5313400 -
tggttttgatttgcatttttct

SEQ ID NO: 128370 - DNA, 22 bp, Artificial Sequence
  Synthetic oligonucleotide; TTT chr11 5313394 5313415 5313399 5313394 -
tgatttgcatttttctaatgac

SEQ ID NO: 128371 - DNA, 22 bp, Artificial Sequence
  Synthetic oligonucleotide; TTT chr11 5313393 5313414 5313398 5313393 -
gatttgcatttttctaatgacc

SEQ ID NO: 128372 - DNA, 22 bp, Artificial Sequence
  Synthetic oligonucleotide; TTG chr11 5313392 5313413 5313397 5313392 -
atttgcatttttctaatgacca

SEQ ID NO: 128373 - DNA, 22 bp, Artificial Sequence
  Synthetic oligonucleotide; TTT chr11 5313388 5313409 5313393 5313388 -
gcatttttctaatgaccagtaa

SEQ ID NO: 128374 - DNA, 22 bp, Artificial Sequence
  Synthetic oligonucleotide; TTG chr11 5313387 5313408 5313392 5313387 -
catttttctaatgaccagtaag

SEQ ID NO: 128375 - DNA, 22 bp, Artificial Sequence
  Synthetic oligonucleotide; TTT chr11 5313382 5313403 5313387 5313382 -
ttctaatgaccagtaaggttga

SEQ ID NO: 128376 - DNA, 22 bp, Artificial Sequence
  Synthetic oligonucleotide; TTT chr11 5313381 5313402 5313386 5313381 -
tctaatgaccagtaaggttgag

SEQ ID NO: 128377 - DNA, 22 bp, Artificial Sequence
  Synthetic oligonucleotide; TTT chr11 5313380 5313401 5313385 5313380 -
ctaatgaccagtaaggttgagc

SEQ ID NO: 128378 - DNA, 22 bp, Artificial Sequence
  Synthetic oligonucleotide; TTC chr11 5313379 5313400 5313384 5313379 -
taatgaccagtaaggttgagct

SEQ ID NO: 128379 - DNA, 22 bp, Artificial Sequence
  Synthetic oligonucleotide; CTA chr11 5313377 5313398 5313382 5313377 -
atgaccagtaaggttgagcttt

SEQ ID NO: 128380 - DNA, 22 bp, Artificial Sequence
  Synthetic oligonucleotide; TTG chr11 5313361 5313382 5313366 5313361 -
agctttttttttttcatatgtt

SEQ ID NO: 128381 - DNA, 22 bp, Artificial Sequence
  Synthetic oligonucleotide; CTT chr11 5313356 5313377 5313361 5313356 -
tttttttttcatatgtttatta

SEQ ID NO: 128382 - DNA, 22 bp, Artificial Sequence
  Synthetic oligonucleotide; TTT chr11 5313355 5313376 5313360 5313355 -
ttttttttcatatgtttattag

SEQ ID NO: 128383 - DNA, 22 bp, Artificial Sequence
  Synthetic oligonucleotide; TTT chr11 5313354 5313375 5313359 5313354 -
tttttttcatatgtttattaga

SEQ ID NO: 128384 - DNA, 22 bp, Artificial Sequence
  Synthetic oligonucleotide; TTT chr11 5313353 5313374 5313358 5313353 -
ttttttcatatgtttattagaa

SEQ ID NO: 128385 - DNA, 22 bp, Artificial Sequence
  Synthetic oligonucleotide; TTT chr11 5313352 5313373 5313357 5313352 -
tttttcatatgtttattagaag

SEQ ID NO: 128386 - DNA, 22 bp, Artificial Sequence
  Synthetic oligonucleotide; TTT chr11 5313351 5313372 5313356 5313351 -
ttttcatatgtttattagaagc

SEQ ID NO: 128387 - DNA, 22 bp, Artificial Sequence
  Synthetic oligonucleotide; TTT chr11 5313350 5313371 5313355 5313350 -
tttcatatgtttattagaagca

SEQ ID NO: 128388 - DNA, 22 bp, Artificial Sequence
  Synthetic oligonucleotide; TTT chr11 5313349 5313370 5313354 5313349 -
ttcatatgtttattagaagcat

SEQ ID NO: 128389 - DNA, 22 bp, Artificial Sequence
  Synthetic oligonucleotide; TTT chr11 5313348 5313369 5313353 5313348 -
tcatatgtttattagaagcatg

SEQ ID NO: 128390 - DNA, 22 bp, Artificial Sequence
  Synthetic oligonucleotide; TTT chr11 5313347 5313368 5313352 5313347 -
catatgtttattagaagcatga

SEQ ID NO: 128391 - DNA, 22 bp, Artificial Sequence
  Synthetic oligonucleotide; TTC chr11 5313346 5313367 5313351 5313346 -
atatgtttattagaagcatgaa

SEQ ID NO: 128392 - DNA, 22 bp, Artificial Sequence
  Synthetic oligonucleotide; TTT chr11 5313338 5313359 5313343 5313338 -
attagaagcatgaatgtcttct

SEQ ID NO: 128393 - DNA, 22 bp, Artificial Sequence
  Synthetic oligonucleotide; TTA chr11 5313337 5313358 5313342 5313337 -
ttagaagcatgaatgtcttctt

SEQ ID NO: 128394 - DNA, 22 bp, Artificial Sequence
  Synthetic oligonucleotide; TTA chr11 5313334 5313355 5313339 5313334 -
gaagcatgaatgtcttctttag

SEQ ID NO: 128395 - DNA, 22 bp, Artificial Sequence
  Synthetic oligonucleotide; CTT chr11 5313318 5313339 5313323 5313318 -
ctttagagaagtgtctattcat

SEQ ID NO: 128396 - DNA, 22 bp, Artificial Sequence
  Synthetic oligonucleotide; TTC chr11 5313317 5313338 5313322 5313317 -
tttagagaagtgtctattcatg

SEQ ID NO: 128397 - DNA, 22 bp, Artificial Sequence
  Synthetic oligonucleotide; CTT chr11 5313315 5313336 5313320 5313315 -
tagagaagtgtctattcatgtc

SEQ ID NO: 128398 - DNA, 22 bp, Artificial Sequence
  Synthetic oligonucleotide; TTT chr11 5313314 5313335 5313319 5313314 -
agagaagtgtctattcatgtca

SEQ ID NO: 128399 - DNA, 22 bp, Artificial Sequence
  Synthetic oligonucleotide; TTA chr11 5313313 5313334 5313318 5313313 -
gagaagtgtctattcatgtcat

SEQ ID NO: 128400 - DNA, 22 bp, Artificial Sequence
  Synthetic oligonucleotide; CTA chr11 5313301 5313322 5313306 5313301 -
ttcatgtcattccccacttttt

SEQ ID NO: 128401 - DNA, 22 bp, Artificial Sequence
  Synthetic oligonucleotide; TTC chr11 5313298 5313319 5313303 5313298 -
atgtcattccccactttttaat

SEQ ID NO: 128402 - DNA, 22 bp, Artificial Sequence
  Synthetic oligonucleotide; TTC chr11 5313289 5313310 5313294 5313289 -
cccactttttaatggggttgtt

SEQ ID NO: 128403 - DNA, 22 bp, Artificial Sequence
  Synthetic oligonucleotide; CTT chr11 5313282 5313303 5313287 5313282 -
tttaatggggttgtttttttct

SEQ ID NO: 128404 - DNA, 22 bp, Artificial Sequence
  Synthetic oligonucleotide; TTT chr11 5313281 5313302 5313286 5313281 -
ttaatggggttgtttttttctt

SEQ ID NO: 128405 - DNA, 22 bp, Artificial Sequence
  Synthetic oligonucleotide; TTT chr11 5313280 5313301 5313285 5313280 -
taatggggttgtttttttcttg

SEQ ID NO: 128406 - DNA, 22 bp, Artificial Sequence
  Synthetic oligonucleotide; TTT chr11 5313279 5313300 5313284 5313279 -
aatggggttgtttttttcttgt

SEQ ID NO: 128407 - DNA, 22 bp, Artificial Sequence
  Synthetic oligonucleotide; TTA chr11 5313278 5313299 5313283 5313278 -
atggggttgtttttttcttgta

SEQ ID NO: 128408 - DNA, 22 bp, Artificial Sequence
  Synthetic oligonucleotide; TTG chr11 5313269 5313290 5313274 5313269 -
tttttttcttgtaaatttgttt

SEQ ID NO: 128409 - DNA, 22 bp, Artificial Sequence
  Synthetic oligonucleotide; TTT chr11 5313266 5313287 5313271 5313266 -
ttttcttgtaaatttgttttag

SEQ ID NO: 128410 - DNA, 22 bp, Artificial Sequence
  Synthetic oligonucleotide; TTT chr11 5313265 5313286 5313270 5313265 -
tttcttgtaaatttgttttagt

SEQ ID NO: 128411 - DNA, 22 bp, Artificial Sequence
  Synthetic oligonucleotide; TTT chr11 5313264 5313285 5313269 5313264 -
ttcttgtaaatttgttttagtt

SEQ ID NO: 128412 - DNA, 22 bp, Artificial Sequence
  Synthetic oligonucleotide; TTT chr11 5313263 5313284 5313268 5313263 -
tcttgtaaatttgttttagttc

SEQ ID NO: 128413 - DNA, 22 bp, Artificial Sequence
  Synthetic oligonucleotide; TTT chr11 5313262 5313283 5313267 5313262 -
cttgtaaatttgttttagttcc

SEQ ID NO: 128414 - DNA, 22 bp, Artificial Sequence
  Synthetic oligonucleotide; TTC chr11 5313261 5313282 5313266 5313261 -
ttgtaaatttgttttagttcct

SEQ ID NO: 128415 - DNA, 22 bp, Artificial Sequence
  Synthetic oligonucleotide; CTT chr11 5313259 5313280 5313264 5313259 -
gtaaatttgttttagttcctca

SEQ ID NO: 128416 - DNA, 22 bp, Artificial Sequence
  Synthetic oligonucleotide; TTG chr11 5313258 5313279 5313263 5313258 -
taaatttgttttagttcctcat

SEQ ID NO: 128417 - DNA, 22 bp, Artificial Sequence
  Synthetic oligonucleotide; TTT chr11 5313251 5313272 5313256 5313251 -
gttttagttcctcatagactcc

SEQ ID NO: 128418 - DNA, 22 bp, Artificial Sequence
  Synthetic oligonucleotide; TTG chr11 5313250 5313271 5313255 5313250 -
ttttagttcctcatagactcca

SEQ ID NO: 128419 - DNA, 22 bp, Artificial Sequence
  Synthetic oligonucleotide; TTT chr11 5313247 5313268 5313252 5313247 -
tagttcctcatagactccagat

SEQ ID NO: 128420 - DNA, 22 bp, Artificial Sequence
  Synthetic oligonucleotide; TTT chr11 5313246 5313267 5313251 5313246 -
agttcctcatagactccagata

SEQ ID NO: 128421 - DNA, 22 bp, Artificial Sequence
  Synthetic oligonucleotide; TTA chr11 5313245 5313266 5313250 5313245 -
gttcctcatagactccagatat

SEQ ID NO: 128422 - DNA, 22 bp, Artificial Sequence
  Synthetic oligonucleotide; TTC chr11 5313241 5313262 5313246 5313241 -
ctcatagactccagatattaga

SEQ ID NO: 128423 - DNA, 22 bp, Artificial Sequence
  Synthetic oligonucleotide; CTC chr11 5313238 5313259 5313243 5313238 -
atagactccagatattagactt

SEQ ID NO: 128424 - DNA, 22 bp, Artificial Sequence
  Synthetic oligonucleotide; CTC chr11 5313230 5313251 5313235 5313230 -
cagatattagacttttgtcaga

SEQ ID NO: 128425 - DNA, 22 bp, Artificial Sequence
  Synthetic oligonucleotide; TTA chr11 5313221 5313242 5313226 5313221 -
gacttttgtcagatggagaaat

SEQ ID NO: 128426 - DNA, 22 bp, Artificial Sequence
  Synthetic oligonucleotide; CTT chr11 5313216 5313237 5313221 5313216 -
ttgtcagatggagaaattgcaa

SEQ ID NO: 128427 - DNA, 22 bp, Artificial Sequence
  Synthetic oligonucleotide; TTT chr11 5313215 5313236 5313220 5313215 -
tgtcagatggagaaattgcaaa

SEQ ID NO: 128428 - DNA, 22 bp, Artificial Sequence
  Synthetic oligonucleotide; TTT chr11 5313214 5313235 5313219 5313214 -
gtcagatggagaaattgcaaaa

SEQ ID NO: 128429 - DNA, 22 bp, Artificial Sequence
  Synthetic oligonucleotide; TTG chr11 5313213 5313234 5313218 5313213 -
tcagatggagaaattgcaaaaa

SEQ ID NO: 128430 - DNA, 22 bp, Artificial Sequence
  Synthetic oligonucleotide; TTG chr11 5313197 5313218 5313202 5313197 -
caaaaattttcttctattctgt

SEQ ID NO: 128431 - DNA, 22 bp, Artificial Sequence
  Synthetic oligonucleotide; TTT chr11 5313188 5313209 5313193 5313188 -
tcttctattctgtaggttgtct

SEQ ID NO: 128432 - DNA, 22 bp, Artificial Sequence
  Synthetic oligonucleotide; TTT chr11 5313187 5313208 5313192 5313187 -
cttctattctgtaggttgtctg

SEQ ID NO: 128433 - DNA, 22 bp, Artificial Sequence
  Synthetic oligonucleotide; TTC chr11 5313186 5313207 5313191 5313186 -
ttctattctgtaggttgtctgt

SEQ ID NO: 128434 - DNA, 22 bp, Artificial Sequence
  Synthetic oligonucleotide; CTT chr11 5313184 5313205 5313189 5313184 -
ctattctgtaggttgtctgtta

SEQ ID NO: 128435 - DNA, 22 bp, Artificial Sequence
  Synthetic oligonucleotide; TTC chr11 5313183 5313204 5313188 5313183 -
tattctgtaggttgtctgttat

SEQ ID NO: 128436 - DNA, 22 bp, Artificial Sequence
  Synthetic oligonucleotide; CTA chr11 5313181 5313202 5313186 5313181 -
ttctgtaggttgtctgttatct

SEQ ID NO: 128437 - DNA, 22 bp, Artificial Sequence
  Synthetic oligonucleotide; TTC chr11 5313178 5313199 5313183 5313178 -
tgtaggttgtctgttatctctg

SEQ ID NO: 128438 - DNA, 22 bp, Artificial Sequence
  Synthetic oligonucleotide; CTG chr11 5313176 5313197 5313181 5313176 -
taggttgtctgttatctctgat

SEQ ID NO: 128439 - DNA, 22 bp, Artificial Sequence
  Synthetic oligonucleotide; TTG chr11 5313169 5313190 5313174 5313169 -
tctgttatctctgatgatagtt

SEQ ID NO: 128440 - DNA, 22 bp, Artificial Sequence
  Synthetic oligonucleotide; CTG chr11 5313165 5313186 5313170 5313165 -
ttatctctgatgatagtttctt

SEQ ID NO: 128441 - DNA, 22 bp, Artificial Sequence
  Synthetic oligonucleotide; TTA chr11 5313162 5313183 5313167 5313162 -
tctctgatgatagtttcttttg

SEQ ID NO: 128442 - DNA, 22 bp, Artificial Sequence
  Synthetic oligonucleotide; CTC chr11 5313158 5313179 5313163 5313158 -
tgatgatagtttcttttgctgt

SEQ ID NO: 128443 - DNA, 22 bp, Artificial Sequence
  Synthetic oligonucleotide; CTG chr11 5313156 5313177 5313161 5313156 -
atgatagtttcttttgctgtgc

SEQ ID NO: 128444 - DNA, 22 bp, Artificial Sequence
  Synthetic oligonucleotide; TTT chr11 5313146 5313167 5313151 5313146 -
cttttgctgtgcagaagctctt

SEQ ID NO: 128445 - DNA, 22 bp, Artificial Sequence
  Synthetic oligonucleotide; TTC chr11 5313145 5313166 5313150 5313145 -
ttttgctgtgcagaagctcttt

SEQ ID NO: 128446 - DNA, 22 bp, Artificial Sequence
  Synthetic oligonucleotide; CTT chr11 5313143 5313164 5313148 5313143 -
ttgctgtgcagaagctctttaa

SEQ ID NO: 128447 - DNA, 22 bp, Artificial Sequence
  Synthetic oligonucleotide; TTT chr11 5313142 5313163 5313147 5313142 -
tgctgtgcagaagctctttaat

SEQ ID NO: 128448 - DNA, 22 bp, Artificial Sequence
  Synthetic oligonucleotide; TTT chr11 5313141 5313162 5313146 5313141 -
gctgtgcagaagctctttaatt

SEQ ID NO: 128449 - DNA, 22 bp, Artificial Sequence
  Synthetic oligonucleotide; TTG chr11 5313140 5313161 5313145 5313140 -
ctgtgcagaagctctttaattt

SEQ ID NO: 128450 - DNA, 22 bp, Artificial Sequence
  Synthetic oligonucleotide; CTG chr11 5313137 5313158 5313142 5313137 -
tgcagaagctctttaatttaat

SEQ ID NO: 128451 - DNA, 22 bp, Artificial Sequence
  Synthetic oligonucleotide; CTC chr11 5313126 5313147 5313131 5313126 -
tttaatttaattagatcccatt

SEQ ID NO: 128452 - DNA, 22 bp, Artificial Sequence
  Synthetic oligonucleotide; CTT chr11 5313124 5313145 5313129 5313124 -
taatttaattagatcccatttg

SEQ ID NO: 128453 - DNA, 22 bp, Artificial Sequence
  Synthetic oligonucleotide; TTT chr11 5313123 5313144 5313128 5313123 -
aatttaattagatcccatttgt

SEQ ID NO: 128454 - DNA, 22 bp, Artificial Sequence
  Synthetic oligonucleotide; TTA chr11 5313122 5313143 5313127 5313122 -
atttaattagatcccatttgtc

SEQ ID NO: 128455 - DNA, 22 bp, Artificial Sequence
  Synthetic oligonucleotide; TTT chr11 5313118 5313139 5313123 5313118 -
aattagatcccatttgtcaatt

SEQ ID NO: 128456 - DNA, 22 bp, Artificial Sequence
  Synthetic oligonucleotide; TTA chr11 5313117 5313138 5313122 5313117 -
attagatcccatttgtcaattt

SEQ ID NO: 128457 - DNA, 22 bp, Artificial Sequence
  Synthetic oligonucleotide; TTA chr11 5313113 5313134 5313118 5313113 -
gatcccatttgtcaattttttt

SEQ ID NO: 128458 - DNA, 22 bp, Artificial Sequence
  Synthetic oligonucleotide; TTT chr11 5313103 5313124 5313108 5313103 -
gtcaatttttttttgcagttgc

SEQ ID NO: 128459 - DNA, 22 bp, Artificial Sequence
  Synthetic oligonucleotide; TTG chr11 5313102 5313123 5313107 5313102 -
tcaatttttttttgcagttgct

SEQ ID NO: 128460 - DNA, 22 bp, Artificial Sequence
  Synthetic oligonucleotide; TTT chr11 5313095 5313116 5313100 5313095 -
ttttttgcagttgcttttggtg

SEQ ID NO: 128461 - DNA, 22 bp, Artificial Sequence
  Synthetic oligonucleotide; TTT chr11 5313094 5313115 5313099 5313094 -
tttttgcagttgcttttggtgt

SEQ ID NO: 128462 - DNA, 22 bp, Artificial Sequence
  Synthetic oligonucleotide; TTT chr11 5313093 5313114 5313098 5313093 -
ttttgcagttgcttttggtgtc

SEQ ID NO: 128463 - DNA, 22 bp, Artificial Sequence
  Synthetic oligonucleotide; TTT chr11 5313092 5313113 5313097 5313092 -
tttgcagttgcttttggtgtct

SEQ ID NO: 128464 - DNA, 22 bp, Artificial Sequence
  Synthetic oligonucleotide; TTT chr11 5313091 5313112 5313096 5313091 -
ttgcagttgcttttggtgtctt

SEQ ID NO: 128465 - DNA, 22 bp, Artificial Sequence
  Synthetic oligonucleotide; TTT chr11 5313090 5313111 5313095 5313090 -
tgcagttgcttttggtgtcttg

SEQ ID NO: 128466 - DNA, 22 bp, Artificial Sequence
  Synthetic oligonucleotide; TTT chr11 5313089 5313110 5313094 5313089 -
gcagttgcttttggtgtcttga

SEQ ID NO: 128467 - DNA, 22 bp, Artificial Sequence
  Synthetic oligonucleotide; TTG chr11 5313088 5313109 5313093 5313088 -
cagttgcttttggtgtcttgag

SEQ ID NO: 128468 - DNA, 22 bp, Artificial Sequence
  Synthetic oligonucleotide; TTG chr11 5313082 5313103 5313087 5313082 -
cttttggtgtcttgagttttct

SEQ ID NO: 128469 - DNA, 22 bp, Artificial Sequence
  Synthetic oligonucleotide; CTT chr11 5313079 5313100 5313084 5313079 -
ttggtgtcttgagttttctttc

SEQ ID NO: 128470 - DNA, 22 bp, Artificial Sequence
  Synthetic oligonucleotide; TTT chr11 5313078 5313099 5313083 5313078 -
tggtgtcttgagttttctttca

SEQ ID NO: 128471 - DNA, 22 bp, Artificial Sequence
  Synthetic oligonucleotide; TTT chr11 5313077 5313098 5313082 5313077 -
ggtgtcttgagttttctttcaa

SEQ ID NO: 128472 - DNA, 22 bp, Artificial Sequence
  Synthetic oligonucleotide; TTG chr11 5313076 5313097 5313081 5313076 -
gtgtcttgagttttctttcaaa

SEQ ID NO: 128473 - DNA, 22 bp, Artificial Sequence
  Synthetic oligonucleotide; CTT chr11 5313069 5313090 5313074 5313069 -
gagttttctttcaaaatgatac

SEQ ID NO: 128474 - DNA, 22 bp, Artificial Sequence
  Synthetic oligonucleotide; TTG chr11 5313068 5313089 5313073 5313068 -
agttttctttcaaaatgataca

SEQ ID NO: 128475 - DNA, 22 bp, Artificial Sequence
  Synthetic oligonucleotide; TTT chr11 5313063 5313084 5313068 5313063 -
tctttcaaaatgatacaatgtc

SEQ ID NO: 128476 - DNA, 22 bp, Artificial Sequence
  Synthetic oligonucleotide; TTT chr11 5313062 5313083 5313067 5313062 -
ctttcaaaatgatacaatgtca

SEQ ID NO: 128477 - DNA, 22 bp, Artificial Sequence
  Synthetic oligonucleotide; TTC chr11 5313061 5313082 5313066 5313061 -
tttcaaaatgatacaatgtcat

SEQ ID NO: 128478 - DNA, 22 bp, Artificial Sequence
  Synthetic oligonucleotide; CTT chr11 5313059 5313080 5313064 5313059 -
tcaaaatgatacaatgtcatct

SEQ ID NO: 128479 - DNA, 22 bp, Artificial Sequence
  Synthetic oligonucleotide; TTT chr11 5313058 5313079 5313063 5313058 -
caaaatgatacaatgtcatcta

SEQ ID NO: 128480 - DNA, 22 bp, Artificial Sequence
  Synthetic oligonucleotide; TTC chr11 5313057 5313078 5313062 5313057 -
aaaatgatacaatgtcatctat

SEQ ID NO: 128481 - DNA, 22 bp, Artificial Sequence
  Synthetic oligonucleotide; CTA chr11 5313036 5313057 5313041 5313036 -
taaagttttacagtagagactc

SEQ ID NO: 128482 - DNA, 22 bp, Artificial Sequence
  Synthetic oligonucleotide; TTT chr11 5313028 5313049 5313033 5313028 -
tacagtagagactctctaaatt

SEQ ID NO: 128483 - DNA, 22 bp, Artificial Sequence
  Synthetic oligonucleotide; TTT chr11 5313027 5313048 5313032 5313027 -
acagtagagactctctaaattc

SEQ ID NO: 128484 - DNA, 22 bp, Artificial Sequence
  Synthetic oligonucleotide; TTA chr11 5313026 5313047 5313031 5313026 -
cagtagagactctctaaattca

SEQ ID NO: 128485 - DNA, 22 bp, Artificial Sequence
  Synthetic oligonucleotide; CTC chr11 5313014 5313035 5313019 5313014 -
tctaaattcataaatttcctag

SEQ ID NO: 128486 - DNA, 22 bp, Artificial Sequence
  Synthetic oligonucleotide; CTC chr11 5313012 5313033 5313017 5313012 -
taaattcataaatttcctagtt

SEQ ID NO: 128487 - DNA, 22 bp, Artificial Sequence
  Synthetic oligonucleotide; CTA chr11 5313010 5313031 5313015 5313010 -
aattcataaatttcctagttgc

SEQ ID NO: 128488 - DNA, 22 bp, Artificial Sequence
  Synthetic oligonucleotide; TTC chr11 5313005 5313026 5313010 5313005 -
ataaatttcctagttgctcatt

SEQ ID NO: 128489 - DNA, 22 bp, Artificial Sequence
  Synthetic oligonucleotide; TTT chr11 5312997 5313018 5313002 5312997 -
cctagttgctcatttcatgagt

SEQ ID NO: 128490 - DNA, 22 bp, Artificial Sequence
  Synthetic oligonucleotide; TTC chr11 5312996 5313017 5313001 5312996 -
ctagttgctcatttcatgagtt

SEQ ID NO: 128491 - DNA, 22 bp, Artificial Sequence
  Synthetic oligonucleotide; CTA chr11 5312993 5313014 5312998 5312993 -
gttgctcatttcatgagttaat

SEQ ID NO: 128492 - DNA, 22 bp, Artificial Sequence
  Synthetic oligonucleotide; TTG chr11 5312989 5313010 5312994 5312989 -
ctcatttcatgagttaatgtat

SEQ ID NO: 128493 - DNA, 22 bp, Artificial Sequence
  Synthetic oligonucleotide; CTC chr11 5312986 5313007 5312991 5312986 -
atttcatgagttaatgtatttc

SEQ ID NO: 128494 - DNA, 22 bp, Artificial Sequence
  Synthetic oligonucleotide; TTT chr11 5312982 5313003 5312987 5312982 -
catgagttaatgtatttctttt

SEQ ID NO: 128495 - DNA, 22 bp, Artificial Sequence
  Synthetic oligonucleotide; TTC chr11 5312981 5313002 5312986 5312981 -
atgagttaatgtatttcttttg

SEQ ID NO: 128496 - DNA, 22 bp, Artificial Sequence
  Synthetic oligonucleotide; TTA chr11 5312973 5312994 5312978 5312973 -
atgtatttcttttgatcttgtg

SEQ ID NO: 128497 - DNA, 22 bp, Artificial Sequence
  Synthetic oligonucleotide; TTT chr11 5312965 5312986 5312970 5312965 -
cttttgatcttgtgttctctct

SEQ ID NO: 128498 - DNA, 22 bp, Artificial Sequence
  Synthetic oligonucleotide; TTC chr11 5312964 5312985 5312969 5312964 -
ttttgatcttgtgttctctcta

SEQ ID NO: 128499 - DNA, 22 bp, Artificial Sequence
  Synthetic oligonucleotide; CTT chr11 5312962 5312983 5312967 5312962 -
ttgatcttgtgttctctctaaa

SEQ ID NO: 128500 - DNA, 22 bp, Artificial Sequence
  Synthetic oligonucleotide; TTT chr11 5312961 5312982 5312966 5312961 -
tgatcttgtgttctctctaaat

SEQ ID NO: 128501 - DNA, 22 bp, Artificial Sequence
  Synthetic oligonucleotide; TTT chr11 5312960 5312981 5312965 5312960 -
gatcttgtgttctctctaaatg

SEQ ID NO: 128502 - DNA, 22 bp, Artificial Sequence
  Synthetic oligonucleotide; TTG chr11 5312959 5312980 5312964 5312959 -
atcttgtgttctctctaaatgc

SEQ ID NO: 128503 - DNA, 22 bp, Artificial Sequence
  Synthetic oligonucleotide; CTT chr11 5312954 5312975 5312959 5312954 -
gtgttctctctaaatgctggat

SEQ ID NO: 128504 - DNA, 22 bp, Artificial Sequence
  Synthetic oligonucleotide; TTG chr11 5312953 5312974 5312958 5312953 -
tgttctctctaaatgctggata

SEQ ID NO: 128505 - DNA, 22 bp, Artificial Sequence
  Synthetic oligonucleotide; TTC chr11 5312948 5312969 5312953 5312948 -
tctctaaatgctggatagaaac

SEQ ID NO: 128506 - DNA, 22 bp, Artificial Sequence
  Synthetic oligonucleotide; CTC chr11 5312946 5312967 5312951 5312946 -
tctaaatgctggatagaaacat

SEQ ID NO: 128507 - DNA, 22 bp, Artificial Sequence
  Synthetic oligonucleotide; CTC chr11 5312944 5312965 5312949 5312944 -
taaatgctggatagaaacattt

SEQ ID NO: 128508 - DNA, 22 bp, Artificial Sequence
  Synthetic oligonucleotide; CTA chr11 5312942 5312963 5312947 5312942 -
aatgctggatagaaacatttct

SEQ ID NO: 128509 - DNA, 22 bp, Artificial Sequence
  Synthetic oligonucleotide; CTG chr11 5312935 5312956 5312940 5312935 -
gatagaaacatttctgatatgt

SEQ ID NO: 128510 - DNA, 22 bp, Artificial Sequence
  Synthetic oligonucleotide; TTT chr11 5312922 5312943 5312927 5312922 -
ctgatatgtccaatagatgaaa

SEQ ID NO: 128511 - DNA, 22 bp, Artificial Sequence
  Synthetic oligonucleotide; TTC chr11 5312921 5312942 5312926 5312921 -
tgatatgtccaatagatgaaat

SEQ ID NO: 128512 - DNA, 22 bp, Artificial Sequence
  Synthetic oligonucleotide; CTG chr11 5312919 5312940 5312924 5312919 -
atatgtccaatagatgaaatat

SEQ ID NO: 128513 - DNA, 22 bp, Artificial Sequence
  Synthetic oligonucleotide; CTG chr11 5312891 5312912 5312896 5312891 -
atattttcctttttgtatattc

SEQ ID NO: 128514 - DNA, 22 bp, Artificial Sequence
  Synthetic oligonucleotide; TTT chr11 5312885 5312906 5312890 5312885 -
tcctttttgtatattcaattta

SEQ ID NO: 128515 - DNA, 22 bp, Artificial Sequence
  Synthetic oligonucleotide; TTT chr11 5312884 5312905 5312889 5312884 -
cctttttgtatattcaatttat

SEQ ID NO: 128516 - DNA, 22 bp, Artificial Sequence
  Synthetic oligonucleotide; TTC chr11 5312883 5312904 5312888 5312883 -
ctttttgtatattcaatttatt

SEQ ID NO: 128517 - DNA, 22 bp, Artificial Sequence
  Synthetic oligonucleotide; CTT chr11 5312880 5312901 5312885 5312880 -
tttgtatattcaatttattttt

SEQ ID NO: 128518 - DNA, 22 bp, Artificial Sequence
  Synthetic oligonucleotide; TTT chr11 5312879 5312900 5312884 5312879 -
ttgtatattcaatttatttttt

SEQ ID NO: 128519 - DNA, 22 bp, Artificial Sequence
  Synthetic oligonucleotide; TTT chr11 5312878 5312899 5312883 5312878 -
tgtatattcaatttatttttta

SEQ ID NO: 128520 - DNA, 22 bp, Artificial Sequence
  Synthetic oligonucleotide; TTT chr11 5312877 5312898 5312882 5312877 -
gtatattcaatttattttttat

SEQ ID NO: 128521 - DNA, 22 bp, Artificial Sequence
  Synthetic oligonucleotide; TTG chr11 5312876 5312897 5312881 5312876 -
tatattcaatttattttttatt

SEQ ID NO: 128522 - DNA, 22 bp, Artificial Sequence
  Synthetic oligonucleotide; TTC chr11 5312869 5312890 5312874 5312869 -
aatttattttttattctaataa

SEQ ID NO: 128523 - DNA, 22 bp, Artificial Sequence
  Synthetic oligonucleotide; TTT chr11 5312864 5312885 5312869 5312864 -
attttttattctaataaatcac

SEQ ID NO: 128524 - DNA, 22 bp, Artificial Sequence
  Synthetic oligonucleotide; TTA chr11 5312863 5312884 5312868 5312863 -
ttttttattctaataaatcaca

SEQ ID NO: 128525 - DNA, 22 bp, Artificial Sequence
  Synthetic oligonucleotide; TTT chr11 5312860 5312881 5312865 5312860 -
tttattctaataaatcacaagt

SEQ ID NO: 128526 - DNA, 22 bp, Artificial Sequence
  Synthetic oligonucleotide; TTT chr11 5312859 5312880 5312864 5312859 -
ttattctaataaatcacaagtg

SEQ ID NO: 128527 - DNA, 22 bp, Artificial Sequence
  Synthetic oligonucleotide; TTT chr11 5312858 5312879 5312863 5312858 -
tattctaataaatcacaagtga

SEQ ID NO: 128528 - DNA, 22 bp, Artificial Sequence
  Synthetic oligonucleotide; TTT chr11 5312857 5312878 5312862 5312857 -
attctaataaatcacaagtgat

SEQ ID NO: 128529 - DNA, 22 bp, Artificial Sequence
  Synthetic oligonucleotide; TTA chr11 5312856 5312877 5312861 5312856 -
ttctaataaatcacaagtgatc

SEQ ID NO: 128530 - DNA, 22 bp, Artificial Sequence
  Synthetic oligonucleotide; TTC chr11 5312853 5312874 5312858 5312853 -
taataaatcacaagtgatctca

SEQ ID NO: 128531 - DNA, 22 bp, Artificial Sequence
  Synthetic oligonucleotide; CTA chr11 5312851 5312872 5312856 5312851 -
ataaatcacaagtgatctcaat

SEQ ID NO: 128532 - DNA, 22 bp, Artificial Sequence
  Synthetic oligonucleotide; CTC chr11 5312832 5312853 5312837 5312832 -
aatttgttgcagcaacttggaa

SEQ ID NO: 128533 - DNA, 22 bp, Artificial Sequence
  Synthetic oligonucleotide; TTT chr11 5312827 5312848 5312832 5312827 -
gttgcagcaacttggaaatctc

SEQ ID NO: 128534 - DNA, 22 bp, Artificial Sequence
  Synthetic oligonucleotide; TTG chr11 5312826 5312847 5312831 5312826 -
ttgcagcaacttggaaatctca

SEQ ID NO: 128535 - DNA, 22 bp, Artificial Sequence
  Synthetic oligonucleotide; TTG chr11 5312823 5312844 5312828 5312823 -
cagcaacttggaaatctcacta

SEQ ID NO: 128536 - DNA, 22 bp, Artificial Sequence
  Synthetic oligonucleotide; CTT chr11 5312814 5312835 5312819 5312814 -
ggaaatctcactaggatttatt

SEQ ID NO: 128537 - DNA, 22 bp, Artificial Sequence
  Synthetic oligonucleotide; TTG chr11 5312813 5312834 5312818 5312813 -
gaaatctcactaggatttattt

SEQ ID NO: 128538 - DNA, 22 bp, Artificial Sequence
  Synthetic oligonucleotide; CTC chr11 5312805 5312826 5312810 5312805 -
actaggatttatttgatcatat

SEQ ID NO: 128539 - DNA, 22 bp, Artificial Sequence
  Synthetic oligonucleotide; CTA chr11 5312801 5312822 5312806 5312801 -
ggatttatttgatcatatattt

SEQ ID NO: 128540 - DNA, 22 bp, Artificial Sequence
  Synthetic oligonucleotide; TTT chr11 5312795 5312816 5312800 5312795 -
atttgatcatatattttgctaa

SEQ ID NO: 128541 - DNA, 22 bp, Artificial Sequence
  Synthetic oligonucleotide; TTA chr11 5312794 5312815 5312799 5312794 -
tttgatcatatattttgctaat

SEQ ID NO: 128542 - DNA, 22 bp, Artificial Sequence
  Synthetic oligonucleotide; TTT chr11 5312791 5312812 5312796 5312791 -
gatcatatattttgctaatttt

SEQ ID NO: 128543 - DNA, 22 bp, Artificial Sequence
  Synthetic oligonucleotide; TTG chr11 5312790 5312811 5312795 5312790 -
atcatatattttgctaattttc

SEQ ID NO: 128544 - DNA, 22 bp, Artificial Sequence
  Synthetic oligonucleotide; TTT chr11 5312779 5312800 5312784 5312779 -
tgctaattttcatccttttata

SEQ ID NO: 128545 - DNA, 22 bp, Artificial Sequence
  Synthetic oligonucleotide; TTT chr11 5312778 5312799 5312783 5312778 -
gctaattttcatccttttataa

SEQ ID NO: 128546 - DNA, 22 bp, Artificial Sequence
  Synthetic oligonucleotide; TTG chr11 5312777 5312798 5312782 5312777 -
ctaattttcatccttttataat

SEQ ID NO: 128547 - DNA, 22 bp, Artificial Sequence
  Synthetic oligonucleotide; CTA chr11 5312774 5312795 5312779 5312774 -
attttcatccttttataattga

SEQ ID NO: 128548 - DNA, 22 bp, Artificial Sequence
  Synthetic oligonucleotide; TTT chr11 5312770 5312791 5312775 5312770 -
tcatccttttataattgatttt

SEQ ID NO: 128549 - DNA, 22 bp, Artificial Sequence
  Synthetic oligonucleotide; TTT chr11 5312769 5312790 5312774 5312769 -
catccttttataattgatttta

SEQ ID NO: 128550 - DNA, 22 bp, Artificial Sequence
  Synthetic oligonucleotide; TTC chr11 5312768 5312789 5312773 5312768 -
atccttttataattgattttaa

SEQ ID NO: 128551 - DNA, 22 bp, Artificial Sequence
  Synthetic oligonucleotide; CTT chr11 5312762 5312783 5312767 5312762 -
ttataattgattttaagaagtt

SEQ ID NO: 128552 - DNA, 22 bp, Artificial Sequence
  Synthetic oligonucleotide; TTT chr11 5312761 5312782 5312766 5312761 -
tataattgattttaagaagttt

SEQ ID NO: 128553 - DNA, 22 bp, Artificial Sequence
  Synthetic oligonucleotide; TTT chr11 5312760 5312781 5312765 5312760 -
ataattgattttaagaagttta

SEQ ID NO: 128554 - DNA, 22 bp, Artificial Sequence
  Synthetic oligonucleotide; TTA chr11 5312759 5312780 5312764 5312759 -
taattgattttaagaagtttat

SEQ ID NO: 128555 - DNA, 22 bp, Artificial Sequence
  Synthetic oligonucleotide; TTG chr11 5312753 5312774 5312758 5312753 -
attttaagaagtttattatgta

SEQ ID NO: 128556 - DNA, 22 bp, Artificial Sequence
  Synthetic oligonucleotide; TTT chr11 5312749 5312770 5312754 5312749 -
taagaagtttattatgtattat

SEQ ID NO: 128557 - DNA, 22 bp, Artificial Sequence
  Synthetic oligonucleotide; TTT chr11 5312748 5312769 5312753 5312748 -
aagaagtttattatgtattatc

SEQ ID NO: 128558 - DNA, 22 bp, Artificial Sequence
  Synthetic oligonucleotide; TTA chr11 5312747 5312768 5312752 5312747 -
agaagtttattatgtattatct

SEQ ID NO: 128559 - DNA, 22 bp, Artificial Sequence
  Synthetic oligonucleotide; TTT chr11 5312739 5312760 5312744 5312739 -
attatgtattatctctagtgtt

SEQ ID NO: 128560 - DNA, 22 bp, Artificial Sequence
  Synthetic oligonucleotide; TTA chr11 5312738 5312759 5312743 5312738 -
ttatgtattatctctagtgttt

SEQ ID NO: 128561 - DNA, 22 bp, Artificial Sequence
  Synthetic oligonucleotide; TTA chr11 5312735 5312756 5312740 5312735 -
tgtattatctctagtgttttat

SEQ ID NO: 128562 - DNA, 22 bp, Artificial Sequence
  Synthetic oligonucleotide; TTA chr11 5312728 5312749 5312733 5312728 -
tctctagtgttttatttttagt

SEQ ID NO: 128563 - DNA, 22 bp, Artificial Sequence
  Synthetic oligonucleotide; CTC chr11 5312724 5312745 5312729 5312724 -
tagtgttttatttttagtgtac

SEQ ID NO: 128564 - DNA, 22 bp, Artificial Sequence
  Synthetic oligonucleotide; CTA chr11 5312722 5312743 5312727 5312722 -
gtgttttatttttagtgtacgt

SEQ ID NO: 128565 - DNA, 22 bp, Artificial Sequence
  Synthetic oligonucleotide; TTT chr11 5312716 5312737 5312721 5312716 -
tatttttagtgtacgtattttc

SEQ ID NO: 128566 - DNA, 22 bp, Artificial Sequence
  Synthetic oligonucleotide; TTT chr11 5312715 5312736 5312720 5312715 -
atttttagtgtacgtattttcc

SEQ ID NO: 128567 - DNA, 22 bp, Artificial Sequence
  Synthetic oligonucleotide; TTA chr11 5312714 5312735 5312719 5312714 -
tttttagtgtacgtattttccc

SEQ ID NO: 128568 - DNA, 22 bp, Artificial Sequence
  Synthetic oligonucleotide; TTT chr11 5312711 5312732 5312716 5312711 -
ttagtgtacgtattttcccagt

SEQ ID NO: 128569 - DNA, 22 bp, Artificial Sequence
  Synthetic oligonucleotide; TTT chr11 5312710 5312731 5312715 5312710 -
tagtgtacgtattttcccagtt

SEQ ID NO: 128570 - DNA, 22 bp, Artificial Sequence
  Synthetic oligonucleotide; TTT chr11 5312709 5312730 5312714 5312709 -
agtgtacgtattttcccagttt

SEQ ID NO: 128571 - DNA, 22 bp, Artificial Sequence
  Synthetic oligonucleotide; TTA chr11 5312708 5312729 5312713 5312708 -
gtgtacgtattttcccagtttt

SEQ ID NO: 128572 - DNA, 22 bp, Artificial Sequence
  Synthetic oligonucleotide; TTT chr11 5312696 5312717 5312701 5312696 -
tcccagttttctgtttgtcttg

SEQ ID NO: 128573 - DNA, 22 bp, Artificial Sequence
  Synthetic oligonucleotide; TTT chr11 5312695 5312716 5312700 5312695 -
cccagttttctgtttgtcttgc

SEQ ID NO: 128574 - DNA, 22 bp, Artificial Sequence
  Synthetic oligonucleotide; TTC chr11 5312694 5312715 5312699 5312694 -
ccagttttctgtttgtcttgct

SEQ ID NO: 128575 - DNA, 22 bp, Artificial Sequence
  Synthetic oligonucleotide; TTT chr11 5312687 5312708 5312692 5312687 -
tctgtttgtcttgctatataca

SEQ ID NO: 128576 - DNA, 22 bp, Artificial Sequence
  Synthetic oligonucleotide; TTT chr11 5312686 5312707 5312691 5312686 -
ctgtttgtcttgctatatacac

SEQ ID NO: 128577 - DNA, 22 bp, Artificial Sequence
  Synthetic oligonucleotide; TTC chr11 5312685 5312706 5312690 5312685 -
tgtttgtcttgctatatacaca

SEQ ID NO: 128578 - DNA, 22 bp, Artificial Sequence
  Synthetic oligonucleotide; CTG chr11 5312683 5312704 5312688 5312683 -
tttgtcttgctatatacacaat

SEQ ID NO: 128579 - DNA, 22 bp, Artificial Sequence
  Synthetic oligonucleotide; TTT chr11 5312680 5312701 5312685 5312680 -
gtcttgctatatacacaattta

SEQ ID NO: 128580 - DNA, 22 bp, Artificial Sequence
  Synthetic oligonucleotide; TTG chr11 5312679 5312700 5312684 5312679 -
tcttgctatatacacaatttaa

SEQ ID NO: 128581 - DNA, 22 bp, Artificial Sequence
  Synthetic oligonucleotide; CTT chr11 5312675 5312696 5312680 5312675 -
gctatatacacaatttaaaagc

SEQ ID NO: 128582 - DNA, 22 bp, Artificial Sequence
  Synthetic oligonucleotide; TTG chr11 5312674 5312695 5312679 5312674 -
ctatatacacaatttaaaagct

SEQ ID NO: 128583 - DNA, 22 bp, Artificial Sequence
  Synthetic oligonucleotide; CTA chr11 5312671 5312692 5312676 5312671 -
tatacacaatttaaaagcttac

SEQ ID NO: 128584 - DNA, 22 bp, Artificial Sequence
  Synthetic oligonucleotide; TTT chr11 5312659 5312680 5312664 5312659 -
aaaagcttacatatacattatt

SEQ ID NO: 128585 - DNA, 22 bp, Artificial Sequence
  Synthetic oligonucleotide; TTA chr11 5312658 5312679 5312663 5312658 -
aaagcttacatatacattattt

SEQ ID NO: 128586 - DNA, 22 bp, Artificial Sequence
  Synthetic oligonucleotide; CTT chr11 5312651 5312672 5312656 5312651 -
acatatacattattttattatt

SEQ ID NO: 128587 - DNA, 22 bp, Artificial Sequence
  Synthetic oligonucleotide; TTA chr11 5312650 5312671 5312655 5312650 -
catatacattattttattattt

SEQ ID NO: 128588 - DNA, 22 bp, Artificial Sequence
  Synthetic oligonucleotide; TTA chr11 5312639 5312660 5312644 5312639 -
ttttattatttactttatctac

SEQ ID NO: 128589 - DNA, 22 bp, Artificial Sequence
  Synthetic oligonucleotide; TTT chr11 5312636 5312657 5312641 5312636 -
tattatttactttatctactga

SEQ ID NO: 128590 - DNA, 22 bp, Artificial Sequence
  Synthetic oligonucleotide; TTT chr11 5312635 5312656 5312640 5312635 -
attatttactttatctactgaa

SEQ ID NO: 128591 - DNA, 22 bp, Artificial Sequence
  Synthetic oligonucleotide; TTA chr11 5312634 5312655 5312639 5312634 -
ttatttactttatctactgaag

SEQ ID NO: 128592 - DNA, 22 bp, Artificial Sequence
  Synthetic oligonucleotide; TTA chr11 5312631 5312652 5312636 5312631 -
tttactttatctactgaagtat

SEQ ID NO: 128593 - DNA, 22 bp, Artificial Sequence
  Synthetic oligonucleotide; TTT chr11 5312628 5312649 5312633 5312628 -
actttatctactgaagtattgg

SEQ ID NO: 128594 - DNA, 22 bp, Artificial Sequence
  Synthetic oligonucleotide; TTA chr11 5312627 5312648 5312632 5312627 -
ctttatctactgaagtattgga

SEQ ID NO: 128595 - DNA, 22 bp, Artificial Sequence
  Synthetic oligonucleotide; CTT chr11 5312624 5312645 5312629 5312624 -
tatctactgaagtattggagcc

SEQ ID NO: 128596 - DNA, 22 bp, Artificial Sequence
  Synthetic oligonucleotide; TTT chr11 5312623 5312644 5312628 5312623 -
atctactgaagtattggagcca

SEQ ID NO: 128597 - DNA, 22 bp, Artificial Sequence
  Synthetic oligonucleotide; TTA chr11 5312622 5312643 5312627 5312622 -
tctactgaagtattggagccat

SEQ ID NO: 128598 - DNA, 22 bp, Artificial Sequence
  Synthetic oligonucleotide; CTA chr11 5312618 5312639 5312623 5312618 -
ctgaagtattggagccatacta

SEQ ID NO: 128599 - DNA, 22 bp, Artificial Sequence
  Synthetic oligonucleotide; CTG chr11 5312615 5312636 5312620 5312615 -
aagtattggagccatactatca

SEQ ID NO: 128600 - DNA, 22 bp, Artificial Sequence
  Synthetic oligonucleotide; TTG chr11 5312607 5312628 5312612 5312607 -
gagccatactatcaaagccctt

SEQ ID NO: 128601 - DNA, 22 bp, Artificial Sequence
  Synthetic oligonucleotide; CTA chr11 5312596 5312617 5312601 5312596 -
tcaaagcccttgctgacttcag

SEQ ID NO: 128602 - DNA, 22 bp, Artificial Sequence
  Synthetic oligonucleotide; CTT chr11 5312585 5312606 5312590 5312585 -
gctgacttcaggtttatttata

SEQ ID NO: 128603 - DNA, 22 bp, Artificial Sequence
  Synthetic oligonucleotide; TTG chr11 5312584 5312605 5312589 5312584 -
ctgacttcaggtttatttatat

SEQ ID NO: 128604 - DNA, 22 bp, Artificial Sequence
  Synthetic oligonucleotide; CTG chr11 5312581 5312602 5312586 5312581 -
acttcaggtttatttatatctt

SEQ ID NO: 128605 - DNA, 22 bp, Artificial Sequence
  Synthetic oligonucleotide; CTT chr11 5312577 5312598 5312582 5312577 -
caggtttatttatatctttttc

SEQ ID NO: 128606 - DNA, 22 bp, Artificial Sequence
  Synthetic oligonucleotide; TTC chr11 5312576 5312597 5312581 5312576 -
aggtttatttatatctttttct

SEQ ID NO: 128607 - DNA, 22 bp, Artificial Sequence
  Synthetic oligonucleotide; TTT chr11 5312570 5312591 5312575 5312570 -
atttatatctttttcttatact

SEQ ID NO: 128608 - DNA, 22 bp, Artificial Sequence
  Synthetic oligonucleotide; TTA chr11 5312569 5312590 5312574 5312569 -
tttatatctttttcttatactt

SEQ ID NO: 128609 - DNA, 22 bp, Artificial Sequence
  Synthetic oligonucleotide; TTT chr11 5312566 5312587 5312571 5312566 -
atatctttttcttatacttttg

SEQ ID NO: 128610 - DNA, 22 bp, Artificial Sequence
  Synthetic oligonucleotide; TTA chr11 5312565 5312586 5312570 5312565 -
tatctttttcttatacttttgc

SEQ ID NO: 128611 - DNA, 22 bp, Artificial Sequence
  Synthetic oligonucleotide; CTT chr11 5312559 5312580 5312564 5312559 -
tttcttatacttttgcctaatt

SEQ ID NO: 128612 - DNA, 22 bp, Artificial Sequence
  Synthetic oligonucleotide; TTT chr11 5312558 5312579 5312563 5312558 -
ttcttatacttttgcctaattt

SEQ ID NO: 128613 - DNA, 22 bp, Artificial Sequence
  Synthetic oligonucleotide; TTT chr11 5312557 5312578 5312562 5312557 -
tcttatacttttgcctaattta

SEQ ID NO: 128614 - DNA, 22 bp, Artificial Sequence
  Synthetic oligonucleotide; TTT chr11 5312556 5312577 5312561 5312556 -
cttatacttttgcctaatttat

SEQ ID NO: 128615 - DNA, 22 bp, Artificial Sequence
  Synthetic oligonucleotide; TTC chr11 5312555 5312576 5312560 5312555 -
ttatacttttgcctaatttatt

SEQ ID NO: 128616 - DNA, 22 bp, Artificial Sequence
  Synthetic oligonucleotide; CTT chr11 5312553 5312574 5312558 5312553 -
atacttttgcctaatttatttg

SEQ ID NO: 128617 - DNA, 22 bp, Artificial Sequence
  Synthetic oligonucleotide; TTA chr11 5312552 5312573 5312557 5312552 -
tacttttgcctaatttatttgt

SEQ ID NO: 128618 - DNA, 22 bp, Artificial Sequence
  Synthetic oligonucleotide; CTT chr11 5312547 5312568 5312552 5312547 -
ttgcctaatttatttgtacata

SEQ ID NO: 128619 - DNA, 22 bp, Artificial Sequence
  Synthetic oligonucleotide; TTT chr11 5312546 5312567 5312551 5312546 -
tgcctaatttatttgtacatat

SEQ ID NO: 128620 - DNA, 22 bp, Artificial Sequence
  Synthetic oligonucleotide; TTT chr11 5312545 5312566 5312550 5312545 -
gcctaatttatttgtacatatc

SEQ ID NO: 128621 - DNA, 22 bp, Artificial Sequence
  Synthetic oligonucleotide; TTG chr11 5312544 5312565 5312549 5312544 -
cctaatttatttgtacatatcc

SEQ ID NO: 128622 - DNA, 22 bp, Artificial Sequence
  Synthetic oligonucleotide; CTA chr11 5312540 5312561 5312545 5312540 -
atttatttgtacatatcctatg

SEQ ID NO: 128623 - DNA, 22 bp, Artificial Sequence
  Synthetic oligonucleotide; TTT chr11 5312536 5312557 5312541 5312536 -
atttgtacatatcctatgttta

SEQ ID NO: 128624 - DNA, 22 bp, Artificial Sequence
  Synthetic oligonucleotide; TTA chr11 5312535 5312556 5312540 5312535 -
tttgtacatatcctatgtttaa

SEQ ID NO: 128625 - DNA, 22 bp, Artificial Sequence
  Synthetic oligonucleotide; TTT chr11 5312532 5312553 5312537 5312532 -
gtacatatcctatgtttaaaag

SEQ ID NO: 128626 - DNA, 22 bp, Artificial Sequence
  Synthetic oligonucleotide; TTG chr11 5312531 5312552 5312536 5312531 -
tacatatcctatgtttaaaagg

SEQ ID NO: 128627 - DNA, 22 bp, Artificial Sequence
  Synthetic oligonucleotide; CTA chr11 5312520 5312541 5312525 5312520 -
tgtttaaaagggtttgtgtttg

SEQ ID NO: 128628 - DNA, 22 bp, Artificial Sequence
  Synthetic oligonucleotide; TTT chr11 5312515 5312536 5312520 5312515 -
aaaagggtttgtgtttggagga

SEQ ID NO: 128629 - DNA, 22 bp, Artificial Sequence
  Synthetic oligonucleotide; TTA chr11 5312514 5312535 5312519 5312514 -
aaagggtttgtgtttggaggag

SEQ ID NO: 128630 - DNA, 22 bp, Artificial Sequence
  Synthetic oligonucleotide; TTT chr11 5312505 5312526 5312510 5312505 -
gtgtttggaggagagtaggact

SEQ ID NO: 128631 - DNA, 22 bp, Artificial Sequence
  Synthetic oligonucleotide; TTG chr11 5312504 5312525 5312509 5312504 -
tgtttggaggagagtaggactt

SEQ ID NO: 128632 - DNA, 22 bp, Artificial Sequence
  Synthetic oligonucleotide; TTT chr11 5312499 5312520 5312504 5312499 -
ggaggagagtaggactttaaat

SEQ ID NO: 128633 - DNA, 22 bp, Artificial Sequence
  Synthetic oligonucleotide; TTG chr11 5312498 5312519 5312503 5312498 -
gaggagagtaggactttaaatc

SEQ ID NO: 128634 - DNA, 22 bp, Artificial Sequence
  Synthetic oligonucleotide; CTT chr11 5312482 5312503 5312487 5312482 -
taaatcattcctcatgtgccta

SEQ ID NO: 128635 - DNA, 22 bp, Artificial Sequence
  Synthetic oligonucleotide; TTT chr11 5312481 5312502 5312486 5312481 -
aaatcattcctcatgtgcctat

SEQ ID NO: 128636 - DNA, 22 bp, Artificial Sequence
  Synthetic oligonucleotide; TTA chr11 5312480 5312501 5312485 5312480 -
aatcattcctcatgtgcctatt

SEQ ID NO: 128637 - DNA, 22 bp, Artificial Sequence
  Synthetic oligonucleotide; TTC chr11 5312472 5312493 5312477 5312472 -
ctcatgtgcctattttcgtgga

SEQ ID NO: 128638 - DNA, 22 bp, Artificial Sequence
  Synthetic oligonucleotide; CTC chr11 5312469 5312490 5312474 5312469 -
atgtgcctattttcgtggaaac

SEQ ID NO: 128639 - DNA, 22 bp, Artificial Sequence
  Synthetic oligonucleotide; CTA chr11 5312460 5312481 5312465 5312460 -
ttttcgtggaaacaccactaat

SEQ ID NO: 128640 - DNA, 22 bp, Artificial Sequence
  Synthetic oligonucleotide; TTT chr11 5312457 5312478 5312462 5312457 -
tcgtggaaacaccactaatatt

SEQ ID NO: 128641 - DNA, 22 bp, Artificial Sequence
  Synthetic oligonucleotide; TTT chr11 5312456 5312477 5312461 5312456 -
cgtggaaacaccactaatattt

SEQ ID NO: 128642 - DNA, 22 bp, Artificial Sequence
  Synthetic oligonucleotide; TTC chr11 5312455 5312476 5312460 5312455 -
gtggaaacaccactaatattta

SEQ ID NO: 128643 - DNA, 22 bp, Artificial Sequence
  Synthetic oligonucleotide; CTA chr11 5312440 5312461 5312445 5312440 -
atatttaatcattcctttggtt

SEQ ID NO: 128644 - DNA, 22 bp, Artificial Sequence
  Synthetic oligonucleotide; TTT chr11 5312434 5312455 5312439 5312434 -
aatcattcctttggttaatttt

SEQ ID NO: 128645 - DNA, 22 bp, Artificial Sequence
  Synthetic oligonucleotide; TTA chr11 5312433 5312454 5312438 5312433 -
atcattcctttggttaattttt

SEQ ID NO: 128646 - DNA, 22 bp, Artificial Sequence
  Synthetic oligonucleotide; TTC chr11 5312426 5312447 5312431 5312426 -
ctttggttaattttttaagggc

SEQ ID NO: 128647 - DNA, 22 bp, Artificial Sequence
  Synthetic oligonucleotide; CTT chr11 5312423 5312444 5312428 5312423 -
tggttaattttttaagggcact

SEQ ID NO: 128648 - DNA, 22 bp, Artificial Sequence
  Synthetic oligonucleotide; TTT chr11 5312422 5312443 5312427 5312422 -
ggttaattttttaagggcacta

SEQ ID NO: 128649 - DNA, 22 bp, Artificial Sequence
  Synthetic oligonucleotide; TTG chr11 5312421 5312442 5312426 5312421 -
gttaattttttaagggcactat

SEQ ID NO: 128650 - DNA, 22 bp, Artificial Sequence
  Synthetic oligonucleotide; TTA chr11 5312417 5312438 5312422 5312417 -
attttttaagggcactattatg

SEQ ID NO: 128651 - DNA, 22 bp, Artificial Sequence
  Synthetic oligonucleotide; TTT chr11 5312413 5312434 5312418 5312413 -
tttaagggcactattatgggtc

SEQ ID NO: 128652 - DNA, 22 bp, Artificial Sequence
  Synthetic oligonucleotide; TTT chr11 5312412 5312433 5312417 5312412 -
ttaagggcactattatgggtca

SEQ ID NO: 128653 - DNA, 22 bp, Artificial Sequence
  Synthetic oligonucleotide; TTT chr11 5312411 5312432 5312416 5312411 -
taagggcactattatgggtcac

SEQ ID NO: 128654 - DNA, 22 bp, Artificial Sequence
  Synthetic oligonucleotide; TTT chr11 5312410 5312431 5312415 5312410 -
aagggcactattatgggtcacc

SEQ ID NO: 128655 - DNA, 22 bp, Artificial Sequence
  Synthetic oligonucleotide; TTA chr11 5312409 5312430 5312414 5312409 -
agggcactattatgggtcacct

SEQ ID NO: 128656 - DNA, 22 bp, Artificial Sequence
  Synthetic oligonucleotide; CTA chr11 5312400 5312421 5312405 5312400 -
ttatgggtcaccttgctaagca

SEQ ID NO: 128657 - DNA, 22 bp, Artificial Sequence
  Synthetic oligonucleotide; TTA chr11 5312397 5312418 5312402 5312397 -
tgggtcaccttgctaagcaaaa

SEQ ID NO: 128658 - DNA, 22 bp, Artificial Sequence
  Synthetic oligonucleotide; CTT chr11 5312386 5312407 5312391 5312386 -
gctaagcaaaaatgatataaga

SEQ ID NO: 128659 - DNA, 22 bp, Artificial Sequence
  Synthetic oligonucleotide; TTG chr11 5312385 5312406 5312390 5312385 -
ctaagcaaaaatgatataagag

SEQ ID NO: 128660 - DNA, 22 bp, Artificial Sequence
  Synthetic oligonucleotide; CTA chr11 5312382 5312403 5312387 5312382 -
agcaaaaatgatataagagagc

SEQ ID NO: 128661 - DNA, 22 bp, Artificial Sequence
  Synthetic oligonucleotide; CTT chr11 5312346 5312367 5312351 5312346 -
ttcttcttaaagtcttcaaata

SEQ ID NO: 128662 - DNA, 22 bp, Artificial Sequence
  Synthetic oligonucleotide; TTT chr11 5312345 5312366 5312350 5312345 -
tcttcttaaagtcttcaaataa

SEQ ID NO: 128663 - DNA, 22 bp, Artificial Sequence
  Synthetic oligonucleotide; TTT chr11 5312344 5312365 5312349 5312344 -
cttcttaaagtcttcaaataag

SEQ ID NO: 128664 - DNA, 22 bp, Artificial Sequence
  Synthetic oligonucleotide; TTC chr11 5312343 5312364 5312348 5312343 -
ttcttaaagtcttcaaataagt

SEQ ID NO: 128665 - DNA, 22 bp, Artificial Sequence
  Synthetic oligonucleotide; CTT chr11 5312341 5312362 5312346 5312341 -
cttaaagtcttcaaataagtgg

SEQ ID NO: 128666 - DNA, 22 bp, Artificial Sequence
  Synthetic oligonucleotide; TTC chr11 5312340 5312361 5312345 5312340 -
ttaaagtcttcaaataagtggg

SEQ ID NO: 128667 - DNA, 22 bp, Artificial Sequence
  Synthetic oligonucleotide; CTT chr11 5312338 5312359 5312343 5312338 -
aaagtcttcaaataagtgggga

SEQ ID NO: 128668 - DNA, 22 bp, Artificial Sequence
  Synthetic oligonucleotide; TTA chr11 5312337 5312358 5312342 5312337 -
aagtcttcaaataagtggggac

SEQ ID NO: 128669 - DNA, 22 bp, Artificial Sequence
  Synthetic oligonucleotide; CTT chr11 5312330 5312351 5312335 5312330 -
caaataagtggggactcaaaga

SEQ ID NO: 128670 - DNA, 22 bp, Artificial Sequence
  Synthetic oligonucleotide; TTC chr11 5312329 5312350 5312334 5312329 -
aaataagtggggactcaaagaa

SEQ ID NO: 128671 - DNA, 22 bp, Artificial Sequence
  Synthetic oligonucleotide; CTC chr11 5312313 5312334 5312318 5312313 -
aaagaataaaagaaatccaaat

SEQ ID NO: 128672 - DNA, 22 bp, Artificial Sequence
  Synthetic oligonucleotide; TTT chr11 5312289 5312310 5312294 5312289 -
aaaacaagtgctgtgattaatc

SEQ ID NO: 128673 - DNA, 22 bp, Artificial Sequence
  Synthetic oligonucleotide; TTA chr11 5312288 5312309 5312293 5312288 -
aaacaagtgctgtgattaatca

SEQ ID NO: 128674 - DNA, 22 bp, Artificial Sequence
  Synthetic oligonucleotide; CTG chr11 5312276 5312297 5312281 5312276 -
tgattaatcataaagcagaaag

SEQ ID NO: 128675 - DNA, 22 bp, Artificial Sequence
  Synthetic oligonucleotide; TTA chr11 5312270 5312291 5312275 5312270 -
atcataaagcagaaagaagaca

SEQ ID NO: 128676 - DNA, 22 bp, Artificial Sequence
  Synthetic oligonucleotide; CTG chr11 5312245 5312266 5312250 5312245 -
aatggagagtgtgggtctcaaa

SEQ ID NO: 128677 - DNA, 22 bp, Artificial Sequence
  Synthetic oligonucleotide; CTC chr11 5312226 5312247 5312231 5312226 -
aaaaaaggcttgaggttatggc

SEQ ID NO: 128678 - DNA, 22 bp, Artificial Sequence
  Synthetic oligonucleotide; CTT chr11 5312215 5312236 5312220 5312215 -
gaggttatggcttgaaataagg

SEQ ID NO: 128679 - DNA, 22 bp, Artificial Sequence
  Synthetic oligonucleotide; TTG chr11 5312214 5312235 5312219 5312214 -
aggttatggcttgaaataaggg

SEQ ID NO: 128680 - DNA, 22 bp, Artificial Sequence
  Synthetic oligonucleotide; TTA chr11 5312208 5312229 5312213 5312208 -
tggcttgaaataagggtaagat

SEQ ID NO: 128681 - DNA, 22 bp, Artificial Sequence
  Synthetic oligonucleotide; CTT chr11 5312202 5312223 5312207 5312202 -
gaaataagggtaagattccctg

SEQ ID NO: 128682 - DNA, 22 bp, Artificial Sequence
  Synthetic oligonucleotide; TTG chr11 5312201 5312222 5312206 5312201 -
aaataagggtaagattccctga

SEQ ID NO: 128683 - DNA, 22 bp, Artificial Sequence
  Synthetic oligonucleotide; TTC chr11 5312184 5312205 5312189 5312184 -
cctgagaaagtgtcccttcagc

SEQ ID NO: 128684 - DNA, 22 bp, Artificial Sequence
  Synthetic oligonucleotide; CTG chr11 5312180 5312201 5312185 5312180 -
agaaagtgtcccttcagctgag

SEQ ID NO: 128685 - DNA, 22 bp, Artificial Sequence
  Synthetic oligonucleotide; CTT chr11 5312166 5312187 5312171 5312166 -
cagctgagacctgaaaatggat

SEQ ID NO: 128686 - DNA, 22 bp, Artificial Sequence
  Synthetic oligonucleotide; TTC chr11 5312165 5312186 5312170 5312165 -
agctgagacctgaaaatggatt

SEQ ID NO: 128687 - DNA, 22 bp, Artificial Sequence
  Synthetic oligonucleotide; CTG chr11 5312160 5312181 5312165 5312160 -
agacctgaaaatggattagaaa

SEQ ID NO: 128688 - DNA, 22 bp, Artificial Sequence
  Synthetic oligonucleotide; CTG chr11 5312153 5312174 5312158 5312153 -
aaaatggattagaaactaactg

SEQ ID NO: 128689 - DNA, 22 bp, Artificial Sequence
  Synthetic oligonucleotide; TTA chr11 5312142 5312163 5312147 5312142 -
gaaactaactggtgaaaataca

SEQ ID NO: 128690 - DNA, 22 bp, Artificial Sequence
  Synthetic oligonucleotide; CTA chr11 5312135 5312156 5312140 5312135 -
actggtgaaaatacagacaaga

SEQ ID NO: 128691 - DNA, 22 bp, Artificial Sequence
  Synthetic oligonucleotide; CTG chr11 5312131 5312152 5312136 5312131 -
gtgaaaatacagacaagaatat

SEQ ID NO: 128692 - DNA, 22 bp, Artificial Sequence
  Synthetic oligonucleotide; TTC chr11 5312107 5312128 5312112 5312107 -
taagactgaaggagtgtgtgtg

SEQ ID NO: 128693 - DNA, 22 bp, Artificial Sequence
  Synthetic oligonucleotide; CTA chr11 5312105 5312126 5312110 5312105 -
agactgaaggagtgtgtgtgga

SEQ ID NO: 128694 - DNA, 22 bp, Artificial Sequence
  Synthetic oligonucleotide; CTG chr11 5312099 5312120 5312104 5312099 -
aaggagtgtgtgtggagacctc

SEQ ID NO: 128695 - DNA, 22 bp, Artificial Sequence
  Synthetic oligonucleotide; CTC chr11 5312077 5312098 5312082 5312077 -
agctaggttggtttatattagg

SEQ ID NO: 128696 - DNA, 22 bp, Artificial Sequence
  Synthetic oligonucleotide; CTA chr11 5312072 5312093 5312077 5312072 -
ggttggtttatattagggaagg

SEQ ID NO: 128697 - DNA, 22 bp, Artificial Sequence
  Synthetic oligonucleotide; TTG chr11 5312067 5312088 5312072 5312067 -
gtttatattagggaaggtggct

SEQ ID NO: 128698 - DNA, 22 bp, Artificial Sequence
  Synthetic oligonucleotide; TTT chr11 5312063 5312084 5312068 5312063 -
atattagggaaggtggctactg

SEQ ID NO: 128699 - DNA, 22 bp, Artificial Sequence
  Synthetic oligonucleotide; TTA chr11 5312062 5312083 5312067 5312062 -
tattagggaaggtggctactgg

SEQ ID NO: 128700 - DNA, 22 bp, Artificial Sequence
  Synthetic oligonucleotide; TTA chr11 5312057 5312078 5312062 5312057 -
gggaaggtggctactggaagag

SEQ ID NO: 128701 - DNA, 22 bp, Artificial Sequence
  Synthetic oligonucleotide; CTA chr11 5312044 5312065 5312049 5312044 -
ctggaagagggtgtttgctttg

SEQ ID NO: 128702 - DNA, 22 bp, Artificial Sequence
  Synthetic oligonucleotide; CTG chr11 5312041 5312062 5312046 5312041 -
gaagagggtgtttgctttgaga

SEQ ID NO: 128703 - DNA, 22 bp, Artificial Sequence
  Synthetic oligonucleotide; TTT chr11 5312028 5312049 5312033 5312028 -
gctttgagaagaggctgaagag

SEQ ID NO: 128704 - DNA, 22 bp, Artificial Sequence
  Synthetic oligonucleotide; TTG chr11 5312027 5312048 5312032 5312027 -
ctttgagaagaggctgaagagg

SEQ ID NO: 128705 - DNA, 22 bp, Artificial Sequence
  Synthetic oligonucleotide; CTT chr11 5312024 5312045 5312029 5312024 -
tgagaagaggctgaagagggaa

SEQ ID NO: 128706 - DNA, 22 bp, Artificial Sequence
  Synthetic oligonucleotide; TTT chr11 5312023 5312044 5312028 5312023 -
gagaagaggctgaagagggaag

SEQ ID NO: 128707 - DNA, 22 bp, Artificial Sequence
  Synthetic oligonucleotide; TTG chr11 5312022 5312043 5312027 5312022 -
agaagaggctgaagagggaagg

SEQ ID NO: 128708 - DNA, 22 bp, Artificial Sequence
  Synthetic oligonucleotide; CTG chr11 5312011 5312032 5312016 5312011 -
aagagggaaggaatggccttat

SEQ ID NO: 128709 - DNA, 22 bp, Artificial Sequence
  Synthetic oligonucleotide; CTT chr11 5311991 5312012 5311996 5311991 -
attggtcatcataagagtttga

SEQ ID NO: 128710 - DNA, 22 bp, Artificial Sequence
  Synthetic oligonucleotide; TTA chr11 5311990 5312011 5311995 5311990 -
ttggtcatcataagagtttgag

SEQ ID NO: 128711 - DNA, 22 bp, Artificial Sequence
  Synthetic oligonucleotide; TTG chr11 5311987 5312008 5311992 5311987 -
gtcatcataagagtttgagtct

SEQ ID NO: 128712 - DNA, 22 bp, Artificial Sequence
  Synthetic oligonucleotide; TTT chr11 5311971 5311992 5311976 5311971 -
gagtctctactcggagtcatgg

SEQ ID NO: 128713 - DNA, 22 bp, Artificial Sequence
  Synthetic oligonucleotide; TTG chr11 5311970 5311991 5311975 5311970 -
agtctctactcggagtcatgga

SEQ ID NO: 128714 - DNA, 22 bp, Artificial Sequence
  Synthetic oligonucleotide; CTC chr11 5311964 5311985 5311969 5311964 -
tactcggagtcatggaaagcta

SEQ ID NO: 128715 - DNA, 22 bp, Artificial Sequence
  Synthetic oligonucleotide; CTA chr11 5311962 5311983 5311967 5311962 -
ctcggagtcatggaaagctact

SEQ ID NO: 128716 - DNA, 22 bp, Artificial Sequence
  Synthetic oligonucleotide; CTC chr11 5311959 5311980 5311964 5311959 -
ggagtcatggaaagctactgaa

SEQ ID NO: 128717 - DNA, 22 bp, Artificial Sequence
  Synthetic oligonucleotide; CTA chr11 5311942 5311963 5311947 5311942 -
ctgaaagaagctgcataattca

SEQ ID NO: 128718 - DNA, 22 bp, Artificial Sequence
  Synthetic oligonucleotide; CTG chr11 5311939 5311960 5311944 5311939 -
aaagaagctgcataattcattg

SEQ ID NO: 128719 - DNA, 22 bp, Artificial Sequence
  Synthetic oligonucleotide; CTG chr11 5311929 5311950 5311934 5311929 -
cataattcattgatgttttaaa

SEQ ID NO: 128720 - DNA, 22 bp, Artificial Sequence
  Synthetic oligonucleotide; TTC chr11 5311921 5311942 5311926 5311921 -
attgatgttttaaaattacttc

SEQ ID NO: 128721 - DNA, 22 bp, Artificial Sequence
  Synthetic oligonucleotide; TTG chr11 5311917 5311938 5311922 5311917 -
atgttttaaaattacttcaata

SEQ ID NO: 128722 - DNA, 22 bp, Artificial Sequence
  Synthetic oligonucleotide; TTT chr11 5311911 5311932 5311916 5311911 -
taaaattacttcaatattattt

SEQ ID NO: 128723 - DNA, 22 bp, Artificial Sequence
  Synthetic oligonucleotide; TTT chr11 5311910 5311931 5311915 5311910 -
aaaattacttcaatattattta

SEQ ID NO: 128724 - DNA, 22 bp, Artificial Sequence
  Synthetic oligonucleotide; TTA chr11 5311909 5311930 5311914 5311909 -
aaattacttcaatattatttat

SEQ ID NO: 128725 - DNA, 22 bp, Artificial Sequence
  Synthetic oligonucleotide; TTA chr11 5311903 5311924 5311908 5311903 -
cttcaatattatttataaaatg

SEQ ID NO: 128726 - DNA, 22 bp, Artificial Sequence
  Synthetic oligonucleotide; CTT chr11 5311900 5311921 5311905 5311900 -
caatattatttataaaatggaa

SEQ ID NO: 128727 - DNA, 22 bp, Artificial Sequence
  Synthetic oligonucleotide; TTC chr11 5311899 5311920 5311904 5311899 -
aatattatttataaaatggaat

SEQ ID NO: 128728 - DNA, 22 bp, Artificial Sequence
  Synthetic oligonucleotide; TTA chr11 5311892 5311913 5311897 5311892 -
tttataaaatggaattgaggga

SEQ ID NO: 128729 - DNA, 22 bp, Artificial Sequence
  Synthetic oligonucleotide; TTT chr11 5311889 5311910 5311894 5311889 -
ataaaatggaattgagggaggc

SEQ ID NO: 128730 - DNA, 22 bp, Artificial Sequence
  Synthetic oligonucleotide; TTA chr11 5311888 5311909 5311893 5311888 -
taaaatggaattgagggaggca

SEQ ID NO: 128731 - DNA, 22 bp, Artificial Sequence
  Synthetic oligonucleotide; TTG chr11 5311875 5311896 5311880 5311875 -
agggaggcagggaaagggcaga

SEQ ID NO: 128732 - DNA, 22 bp, Artificial Sequence
  Synthetic oligonucleotide; TTA chr11 5311847 5311868 5311852 5311847 -
gagtaatttgaagaaagataat

SEQ ID NO: 128733 - DNA, 22 bp, Artificial Sequence
  Synthetic oligonucleotide; TTT chr11 5311838 5311859 5311843 5311838 -
gaagaaagataatagtaactca

SEQ ID NO: 128734 - DNA, 22 bp, Artificial Sequence
  Synthetic oligonucleotide; TTG chr11 5311837 5311858 5311842 5311837 -
aagaaagataatagtaactcaa

SEQ ID NO: 128735 - DNA, 22 bp, Artificial Sequence
  Synthetic oligonucleotide; CTC chr11 5311817 5311838 5311822 5311817 -
aatttaggaaagtggaaatggt

SEQ ID NO: 128736 - DNA, 22 bp, Artificial Sequence
  Synthetic oligonucleotide; TTT chr11 5311812 5311833 5311817 5311812 -
aggaaagtggaaatggtaatgg

SEQ ID NO: 128737 - DNA, 22 bp, Artificial Sequence
  Synthetic oligonucleotide; TTA chr11 5311811 5311832 5311816 5311811 -
ggaaagtggaaatggtaatgga

SEQ ID NO: 128738 - DNA, 22 bp, Artificial Sequence
  Synthetic oligonucleotide; TTT chr11 5311771 5311792 5311776 5311771 -
aaggtctaaatataataaggtt

SEQ ID NO: 128739 - DNA, 22 bp, Artificial Sequence
  Synthetic oligonucleotide; TTA chr11 5311770 5311791 5311775 5311770 -
aggtctaaatataataaggttt

SEQ ID NO: 128740 - DNA, 22 bp, Artificial Sequence
  Synthetic oligonucleotide; CTA chr11 5311763 5311784 5311768 5311763 -
aatataataaggtttacaggtt

SEQ ID NO: 128741 - DNA, 22 bp, Artificial Sequence
  Synthetic oligonucleotide; TTT chr11 5311748 5311769 5311753 5311748 -
acaggttatttagaaaagcaga

SEQ ID NO: 128742 - DNA, 22 bp, Artificial Sequence
  Synthetic oligonucleotide; TTA chr11 5311747 5311768 5311752 5311747 -
caggttatttagaaaagcagag

SEQ ID NO: 128743 - DNA, 22 bp, Artificial Sequence
  Synthetic oligonucleotide; TTA chr11 5311740 5311761 5311745 5311740 -
tttagaaaagcagaggaaagaa

SEQ ID NO: 128744 - DNA, 22 bp, Artificial Sequence
  Synthetic oligonucleotide; TTT chr11 5311737 5311758 5311742 5311737 -
agaaaagcagaggaaagaaaga

SEQ ID NO: 128745 - DNA, 22 bp, Artificial Sequence
  Synthetic oligonucleotide; TTA chr11 5311736 5311757 5311741 5311736 -
gaaaagcagaggaaagaaagag

SEQ ID NO: 128746 - DNA, 22 bp, Artificial Sequence
  Synthetic oligonucleotide; TTG chr11 5311711 5311732 5311716 5311711 -
gaaaggagcaaaaatcaccatc

SEQ ID NO: 128747 - DNA, 22 bp, Artificial Sequence
  Synthetic oligonucleotide; TTT chr11 5311684 5311705 5311689 5311684 -
ctgacatgttcttggaagaaag

SEQ ID NO: 128748 - DNA, 22 bp, Artificial Sequence
  Synthetic oligonucleotide; TTC chr11 5311683 5311704 5311688 5311683 -
tgacatgttcttggaagaaagg

SEQ ID NO: 128749 - DNA, 22 bp, Artificial Sequence
  Synthetic oligonucleotide; CTG chr11 5311681 5311702 5311686 5311681 -
acatgttcttggaagaaaggca

SEQ ID NO: 128750 - DNA, 22 bp, Artificial Sequence
  Synthetic oligonucleotide; TTC chr11 5311673 5311694 5311678 5311673 -
ttggaagaaaggcagtgccaaa

SEQ ID NO: 128751 - DNA, 22 bp, Artificial Sequence
  Synthetic oligonucleotide; CTT chr11 5311671 5311692 5311676 5311671 -
ggaagaaaggcagtgccaaaag

SEQ ID NO: 128752 - DNA, 22 bp, Artificial Sequence
  Synthetic oligonucleotide; TTG chr11 5311670 5311691 5311675 5311670 -
gaagaaaggcagtgccaaaaga

SEQ ID NO: 128753 - DNA, 22 bp, Artificial Sequence
  Synthetic oligonucleotide; CTG chr11 5311635 5311656 5311640 5311635 -
attatgtattgtctataaataa

SEQ ID NO: 128754 - DNA, 22 bp, Artificial Sequence
  Synthetic oligonucleotide; TTA chr11 5311631 5311652 5311636 5311631 -
tgtattgtctataaataagaag

SEQ ID NO: 128755 - DNA, 22 bp, Artificial Sequence
  Synthetic oligonucleotide; TTG chr11 5311624 5311645 5311629 5311624 -
tctataaataagaagaatcatt

SEQ ID NO: 128756 - DNA, 22 bp, Artificial Sequence
  Synthetic oligonucleotide; CTA chr11 5311620 5311641 5311625 5311620 -
taaataagaagaatcattataa

SEQ ID NO: 128757 - DNA, 22 bp, Artificial Sequence
  Synthetic oligonucleotide; TTA chr11 5311601 5311622 5311606 5311601 -
taatttttaaagttgtgggaca

SEQ ID NO: 128758 - DNA, 22 bp, Artificial Sequence
  Synthetic oligonucleotide; TTT chr11 5311595 5311616 5311600 5311595 -
ttaaagttgtgggacactgaga

SEQ ID NO: 128759 - DNA, 22 bp, Artificial Sequence
  Synthetic oligonucleotide; TTT chr11 5311594 5311615 5311599 5311594 -
taaagttgtgggacactgagaa

SEQ ID NO: 128760 - DNA, 22 bp, Artificial Sequence
  Synthetic oligonucleotide; TTT chr11 5311593 5311614 5311598 5311593 -
aaagttgtgggacactgagaat

SEQ ID NO: 128761 - DNA, 22 bp, Artificial Sequence
  Synthetic oligonucleotide; TTA chr11 5311592 5311613 5311597 5311592 -
aagttgtgggacactgagaatg

SEQ ID NO: 128762 - DNA, 22 bp, Artificial Sequence
  Synthetic oligonucleotide; TTG chr11 5311586 5311607 5311591 5311586 -
tgggacactgagaatgagtcaa

SEQ ID NO: 128763 - DNA, 22 bp, Artificial Sequence
  Synthetic oligonucleotide; CTG chr11 5311576 5311597 5311581 5311576 -
agaatgagtcaaaataataaac

SEQ ID NO: 128764 - DNA, 22 bp, Artificial Sequence
  Synthetic oligonucleotide; TTT chr11 5311545 5311566 5311550 5311545 -
aagaaagcaattgaaggaagta

SEQ ID NO: 128765 - DNA, 22 bp, Artificial Sequence
  Synthetic oligonucleotide; TTA chr11 5311544 5311565 5311549 5311544 -
agaaagcaattgaaggaagtat

SEQ ID NO: 128766 - DNA, 22 bp, Artificial Sequence
  Synthetic oligonucleotide; TTG chr11 5311532 5311553 5311537 5311532 -
aaggaagtatttcaaactgtag

SEQ ID NO: 128767 - DNA, 22 bp, Artificial Sequence
  Synthetic oligonucleotide; TTT chr11 5311520 5311541 5311525 5311520 -
caaactgtagaactagactttt

SEQ ID NO: 128768 - DNA, 22 bp, Artificial Sequence
  Synthetic oligonucleotide; TTC chr11 5311519 5311540 5311524 5311519 -
aaactgtagaactagactttta

SEQ ID NO: 128769 - DNA, 22 bp, Artificial Sequence
  Synthetic oligonucleotide; CTG chr11 5311513 5311534 5311518 5311513 -
tagaactagacttttaaaaaca

SEQ ID NO: 128770 - DNA, 22 bp, Artificial Sequence
  Synthetic oligonucleotide; CTA chr11 5311505 5311526 5311510 5311505 -
gacttttaaaaacaaaatatta

SEQ ID NO: 128771 - DNA, 22 bp, Artificial Sequence
  Synthetic oligonucleotide; CTT chr11 5311500 5311521 5311505 5311500 -
ttaaaaacaaaatattagctta

SEQ ID NO: 128772 - DNA, 22 bp, Artificial Sequence
  Synthetic oligonucleotide; TTT chr11 5311499 5311520 5311504 5311499 -
taaaaacaaaatattagcttaa

SEQ ID NO: 128773 - DNA, 22 bp, Artificial Sequence
  Synthetic oligonucleotide; TTT chr11 5311498 5311519 5311503 5311498 -
aaaaacaaaatattagcttaat

SEQ ID NO: 128774 - DNA, 22 bp, Artificial Sequence
  Synthetic oligonucleotide; TTA chr11 5311497 5311518 5311502 5311497 -
aaaacaaaatattagcttaata

SEQ ID NO: 128775 - DNA, 22 bp, Artificial Sequence
  Synthetic oligonucleotide; TTA chr11 5311483 5311504 5311488 5311483 -
gcttaataattaaaaaaatcat

SEQ ID NO: 128776 - DNA, 22 bp, Artificial Sequence
  Synthetic oligonucleotide; CTT chr11 5311479 5311500 5311484 5311479 -
aataattaaaaaaatcattcat

SEQ ID NO: 128777 - DNA, 22 bp, Artificial Sequence
  Synthetic oligonucleotide; TTA chr11 5311478 5311499 5311483 5311478 -
ataattaaaaaaatcattcatt

SEQ ID NO: 128778 - DNA, 22 bp, Artificial Sequence
  Synthetic oligonucleotide; TTA chr11 5311471 5311492 5311476 5311471 -
aaaaaatcattcattcaaatca

SEQ ID NO: 128779 - DNA, 22 bp, Artificial Sequence
  Synthetic oligonucleotide; TTC chr11 5311459 5311480 5311464 5311459 -
attcaaatcatttcagtatgta

SEQ ID NO: 128780 - DNA, 22 bp, Artificial Sequence
  Synthetic oligonucleotide; TTC chr11 5311455 5311476 5311460 5311455 -
aaatcatttcagtatgtatttc

SEQ ID NO: 128781 - DNA, 22 bp, Artificial Sequence
  Synthetic oligonucleotide; TTT chr11 5311446 5311467 5311451 5311446 -
cagtatgtatttctttttgcct

SEQ ID NO: 128782 - DNA, 22 bp, Artificial Sequence
  Synthetic oligonucleotide; TTC chr11 5311445 5311466 5311450 5311445 -
agtatgtatttctttttgcctg

SEQ ID NO: 128783 - DNA, 22 bp, Artificial Sequence
  Synthetic oligonucleotide; TTT chr11 5311434 5311455 5311439 5311434 -
ctttttgcctgatcatgaagag

SEQ ID NO: 128784 - DNA, 22 bp, Artificial Sequence
  Synthetic oligonucleotide; TTC chr11 5311433 5311454 5311438 5311433 -
tttttgcctgatcatgaagagt

SEQ ID NO: 128785 - DNA, 22 bp, Artificial Sequence
  Synthetic oligonucleotide; CTT chr11 5311431 5311452 5311436 5311431 -
tttgcctgatcatgaagagtca

SEQ ID NO: 128786 - DNA, 22 bp, Artificial Sequence
  Synthetic oligonucleotide; TTT chr11 5311430 5311451 5311435 5311430 -
ttgcctgatcatgaagagtcat

SEQ ID NO: 128787 - DNA, 22 bp, Artificial Sequence
  Synthetic oligonucleotide; TTT chr11 5311429 5311450 5311434 5311429 -
tgcctgatcatgaagagtcata

SEQ ID NO: 128788 - DNA, 22 bp, Artificial Sequence
  Synthetic oligonucleotide; TTT chr11 5311428 5311449 5311433 5311428 -
gcctgatcatgaagagtcatag

SEQ ID NO: 128789 - DNA, 22 bp, Artificial Sequence
  Synthetic oligonucleotide; TTG chr11 5311427 5311448 5311432 5311427 -
cctgatcatgaagagtcatagt

SEQ ID NO: 128790 - DNA, 22 bp, Artificial Sequence
  Synthetic oligonucleotide; CTG chr11 5311423 5311444 5311428 5311423 -
atcatgaagagtcatagtaaag

SEQ ID NO: 128791 - DNA, 22 bp, Artificial Sequence
  Synthetic oligonucleotide; TTT chr11 5311369 5311390 5311374 5311369 -
acagatgcaagacaacagaaac

SEQ ID NO: 128792 - DNA, 22 bp, Artificial Sequence
  Synthetic oligonucleotide; TTA chr11 5311368 5311389 5311373 5311368 -
cagatgcaagacaacagaaaca

SEQ ID NO: 128793 - DNA, 22 bp, Artificial Sequence
  Synthetic oligonucleotide; CTG chr11 5311341 5311362 5311346 5311341 -
aagcagatgacacccaaagaag

SEQ ID NO: 128794 - DNA, 22 bp, Artificial Sequence
  Synthetic oligonucleotide; CTC chr11 5311292 5311313 5311297 5311292 -
actatcctaggagaaagcagga

SEQ ID NO: 128795 - DNA, 22 bp, Artificial Sequence
  Synthetic oligonucleotide; CTA chr11 5311288 5311309 5311293 5311288 -
tcctaggagaaagcaggataga

SEQ ID NO: 128796 - DNA, 22 bp, Artificial Sequence
  Synthetic oligonucleotide; CTA chr11 5311283 5311304 5311288 5311283 -
ggagaaagcaggatagatccgg

SEQ ID NO: 128797 - DNA, 22 bp, Artificial Sequence
  Synthetic oligonucleotide; TTT chr11 5311257 5311278 5311262 5311257 -
ttcttgggtgtcattcactgaa

SEQ ID NO: 128798 - DNA, 22 bp, Artificial Sequence
  Synthetic oligonucleotide; TTT chr11 5311256 5311277 5311261 5311256 -
tcttgggtgtcattcactgaag

SEQ ID NO: 128799 - DNA, 22 bp, Artificial Sequence
  Synthetic oligonucleotide; TTT chr11 5311255 5311276 5311260 5311255 -
cttgggtgtcattcactgaagt

SEQ ID NO: 128800 - DNA, 22 bp, Artificial Sequence
  Synthetic oligonucleotide; TTC chr11 5311254 5311275 5311259 5311254 -
ttgggtgtcattcactgaagta

SEQ ID NO: 128801 - DNA, 22 bp, Artificial Sequence
  Synthetic oligonucleotide; CTT chr11 5311252 5311273 5311257 5311252 -
gggtgtcattcactgaagtaga

SEQ ID NO: 128802 - DNA, 22 bp, Artificial Sequence
  Synthetic oligonucleotide; TTG chr11 5311251 5311272 5311256 5311251 -
ggtgtcattcactgaagtagac

SEQ ID NO: 128803 - DNA, 22 bp, Artificial Sequence
  Synthetic oligonucleotide; TTC chr11 5311241 5311262 5311246 5311241 -
actgaagtagacccagttttaa

SEQ ID NO: 128804 - DNA, 22 bp, Artificial Sequence
  Synthetic oligonucleotide; CTG chr11 5311237 5311258 5311242 5311237 -
aagtagacccagttttaaaata

SEQ ID NO: 128805 - DNA, 22 bp, Artificial Sequence
  Synthetic oligonucleotide; TTT chr11 5311222 5311243 5311227 5311222 -
taaaatagcagtccaaaaaata

SEQ ID NO: 128806 - DNA, 22 bp, Artificial Sequence
  Synthetic oligonucleotide; TTT chr11 5311221 5311242 5311226 5311221 -
aaaatagcagtccaaaaaatac

SEQ ID NO: 128807 - DNA, 22 bp, Artificial Sequence
  Synthetic oligonucleotide; TTA chr11 5311220 5311241 5311225 5311220 -
aaatagcagtccaaaaaatact

SEQ ID NO: 128808 - DNA, 22 bp, Artificial Sequence
  Synthetic oligonucleotide; CTG chr11 5311197 5311218 5311202 5311197 -
ccaaacgtgagataatatatca

SEQ ID NO: 128809 - DNA, 22 bp, Artificial Sequence
  Synthetic oligonucleotide; TTA chr11 5311171 5311192 5311176 5311171 -
tatgatacaactggttagagcc

SEQ ID NO: 128810 - DNA, 22 bp, Artificial Sequence
  Synthetic oligonucleotide; CTG chr11 5311158 5311179 5311163 5311158 -
gttagagccagataatctgata

SEQ ID NO: 128811 - DNA, 22 bp, Artificial Sequence
  Synthetic oligonucleotide; TTA chr11 5311154 5311175 5311159 5311154 -
gagccagataatctgatacaaa

SEQ ID NO: 128812 - DNA, 22 bp, Artificial Sequence
  Synthetic oligonucleotide; CTG chr11 5311139 5311160 5311144 5311139 -
atacaaacataaataggaagat

SEQ ID NO: 128813 - DNA, 22 bp, Artificial Sequence
  Synthetic oligonucleotide; TTA chr11 5311111 5311132 5311116 5311111 -
actaaattctgaattaccagat

SEQ ID NO: 128814 - DNA, 22 bp, Artificial Sequence
  Synthetic oligonucleotide; CTA chr11 5311107 5311128 5311112 5311107 -
aattctgaattaccagatgagt

SEQ ID NO: 128815 - DNA, 22 bp, Artificial Sequence
  Synthetic oligonucleotide; TTC chr11 5311102 5311123 5311107 5311102 -
tgaattaccagatgagtaaata

SEQ ID NO: 128816 - DNA, 22 bp, Artificial Sequence
  Synthetic oligonucleotide; CTG chr11 5311100 5311121 5311105 5311100 -
aattaccagatgagtaaataac

SEQ ID NO: 128817 - DNA, 22 bp, Artificial Sequence
  Synthetic oligonucleotide; TTA chr11 5311095 5311116 5311100 5311095 -
ccagatgagtaaataacaagaa

SEQ ID NO: 128818 - DNA, 22 bp, Artificial Sequence
  Synthetic oligonucleotide; TTT chr11 5311070 5311091 5311075 5311070 -
attgaaaaatgaagttttttca

SEQ ID NO: 128819 - DNA, 22 bp, Artificial Sequence
  Synthetic oligonucleotide; TTA chr11 5311069 5311090 5311074 5311069 -
ttgaaaaatgaagttttttcat

SEQ ID NO: 128820 - DNA, 22 bp, Artificial Sequence
  Synthetic oligonucleotide; TTG chr11 5311066 5311087 5311071 5311066 -
aaaaatgaagttttttcatgag

SEQ ID NO: 128821 - DNA, 22 bp, Artificial Sequence
  Synthetic oligonucleotide; TTT chr11 5311053 5311074 5311058 5311053 -
tttcatgagtgcttatgttagt

SEQ ID NO: 128822 - DNA, 22 bp, Artificial Sequence
  Synthetic oligonucleotide; TTT chr11 5311052 5311073 5311057 5311052 -
ttcatgagtgcttatgttagtt

SEQ ID NO: 128823 - DNA, 22 bp, Artificial Sequence
  Synthetic oligonucleotide; TTT chr11 5311051 5311072 5311056 5311051 -
tcatgagtgcttatgttagtta

SEQ ID NO: 128824 - DNA, 22 bp, Artificial Sequence
  Synthetic oligonucleotide; TTT chr11 5311050 5311071 5311055 5311050 -
catgagtgcttatgttagttac

SEQ ID NO: 128825 - DNA, 22 bp, Artificial Sequence
  Synthetic oligonucleotide; TTC chr11 5311049 5311070 5311054 5311049 -
atgagtgcttatgttagttacc

SEQ ID NO: 128826 - DNA, 22 bp, Artificial Sequence
  Synthetic oligonucleotide; CTT chr11 5311039 5311060 5311044 5311039 -
atgttagttaccctagatttgc

SEQ ID NO: 128827 - DNA, 22 bp, Artificial Sequence
  Synthetic oligonucleotide; TTA chr11 5311038 5311059 5311043 5311038 -
tgttagttaccctagatttgcg

SEQ ID NO: 128828 - DNA, 22 bp, Artificial Sequence
  Synthetic oligonucleotide; TTA chr11 5311033 5311054 5311038 5311033 -
gttaccctagatttgcggcatg

SEQ ID NO: 128829 - DNA, 22 bp, Artificial Sequence
  Synthetic oligonucleotide; TTA chr11 5311029 5311050 5311034 5311029 -
ccctagatttgcggcatgcctt

SEQ ID NO: 128830 - DNA, 22 bp, Artificial Sequence
  Synthetic oligonucleotide; CTA chr11 5311024 5311045 5311029 5311024 -
gatttgcggcatgccttcacag

SEQ ID NO: 128831 - DNA, 22 bp, Artificial Sequence
  Synthetic oligonucleotide; TTT chr11 5311019 5311040 5311024 5311019 -
gcggcatgccttcacagatgtc

SEQ ID NO: 128832 - DNA, 22 bp, Artificial Sequence
  Synthetic oligonucleotide; TTG chr11 5311018 5311039 5311023 5311018 -
cggcatgccttcacagatgtcc

SEQ ID NO: 128833 - DNA, 22 bp, Artificial Sequence
  Synthetic oligonucleotide; CTT chr11 5311007 5311028 5311012 5311007 -
cacagatgtccaatcatagata

SEQ ID NO: 128834 - DNA, 22 bp, Artificial Sequence
  Synthetic oligonucleotide; TTC chr11 5311006 5311027 5311011 5311006 -
acagatgtccaatcatagatat

SEQ ID NO: 128835 - DNA, 22 bp, Artificial Sequence
  Synthetic oligonucleotide; TTT chr11 5310982 5311003 5310987 5310982 -
gaggaggaccatatggaactga

SEQ ID NO: 128836 - DNA, 22 bp, Artificial Sequence
  Synthetic oligonucleotide; TTG chr11 5310981 5311002 5310986 5310981 -
aggaggaccatatggaactgaa

SEQ ID NO: 128837 - DNA, 22 bp, Artificial Sequence
  Synthetic oligonucleotide; CTG chr11 5310961 5310982 5310966 5310961 -
aaaataatctatgcttgattct

SEQ ID NO: 128838 - DNA, 22 bp, Artificial Sequence
  Synthetic oligonucleotide; CTA chr11 5310950 5310971 5310955 5310950 -
tgcttgattctttctctcaagt

SEQ ID NO: 128839 - DNA, 22 bp, Artificial Sequence
  Synthetic oligonucleotide; CTT chr11 5310945 5310966 5310950 5310945 -
gattctttctctcaagtgaaat

SEQ ID NO: 128840 - DNA, 22 bp, Artificial Sequence
  Synthetic oligonucleotide; TTG chr11 5310944 5310965 5310949 5310944 -
attctttctctcaagtgaaatt

SEQ ID NO: 128841 - DNA, 22 bp, Artificial Sequence
  Synthetic oligonucleotide; TTC chr11 5310940 5310961 5310945 5310940 -
tttctctcaagtgaaattgttg

SEQ ID NO: 128842 - DNA, 22 bp, Artificial Sequence
  Synthetic oligonucleotide; CTT chr11 5310938 5310959 5310943 5310938 -
tctctcaagtgaaattgttgag

SEQ ID NO: 128843 - DNA, 22 bp, Artificial Sequence
  Synthetic oligonucleotide; TTT chr11 5310937 5310958 5310942 5310937 -
ctctcaagtgaaattgttgagt

SEQ ID NO: 128844 - DNA, 22 bp, Artificial Sequence
  Synthetic oligonucleotide; TTC chr11 5310936 5310957 5310941 5310936 -
tctcaagtgaaattgttgagtc

SEQ ID NO: 128845 - DNA, 22 bp, Artificial Sequence
  Synthetic oligonucleotide; CTC chr11 5310934 5310955 5310939 5310934 -
tcaagtgaaattgttgagtcaa

SEQ ID NO: 128846 - DNA, 22 bp, Artificial Sequence
  Synthetic oligonucleotide; CTC chr11 5310932 5310953 5310937 5310932 -
aagtgaaattgttgagtcaacc

SEQ ID NO: 128847 - DNA, 22 bp, Artificial Sequence
  Synthetic oligonucleotide; TTG chr11 5310921 5310942 5310926 5310921 -
ttgagtcaaccatcctattcta

SEQ ID NO: 128848 - DNA, 22 bp, Artificial Sequence
  Synthetic oligonucleotide; TTG chr11 5310918 5310939 5310923 5310918 -
agtcaaccatcctattctattt

SEQ ID NO: 128849 - DNA, 22 bp, Artificial Sequence
  Synthetic oligonucleotide; CTA chr11 5310904 5310925 5310909 5310904 -
ttctatttattaaaatcaaata

SEQ ID NO: 128850 - DNA, 22 bp, Artificial Sequence
  Synthetic oligonucleotide; TTC chr11 5310901 5310922 5310906 5310901 -
tatttattaaaatcaaataaat

SEQ ID NO: 128851 - DNA, 22 bp, Artificial Sequence
  Synthetic oligonucleotide; CTA chr11 5310899 5310920 5310904 5310899 -
tttattaaaatcaaataaatgg

SEQ ID NO: 128852 - DNA, 22 bp, Artificial Sequence
  Synthetic oligonucleotide; TTT chr11 5310896 5310917 5310901 5310896 -
attaaaatcaaataaatggtct

SEQ ID NO: 128853 - DNA, 22 bp, Artificial Sequence
  Synthetic oligonucleotide; TTA chr11 5310895 5310916 5310900 5310895 -
ttaaaatcaaataaatggtctt

SEQ ID NO: 128854 - DNA, 22 bp, Artificial Sequence
  Synthetic oligonucleotide; TTA chr11 5310892 5310913 5310897 5310892 -
aaatcaaataaatggtctttaa

SEQ ID NO: 128855 - DNA, 22 bp, Artificial Sequence
  Synthetic oligonucleotide; CTT chr11 5310873 5310894 5310878 5310873 -
taagatataagagactttatcc

SEQ ID NO: 128856 - DNA, 22 bp, Artificial Sequence
  Synthetic oligonucleotide; TTT chr11 5310872 5310893 5310877 5310872 -
aagatataagagactttatcct

SEQ ID NO: 128857 - DNA, 22 bp, Artificial Sequence
  Synthetic oligonucleotide; TTA chr11 5310871 5310892 5310876 5310871 -
agatataagagactttatccta

SEQ ID NO: 128858 - DNA, 22 bp, Artificial Sequence
  Synthetic oligonucleotide; CTT chr11 5310856 5310877 5310861 5310856 -
tatcctagtatgtatatatata

SEQ ID NO: 128859 - DNA, 22 bp, Artificial Sequence
  Synthetic oligonucleotide; TTT chr11 5310855 5310876 5310860 5310855 -
atcctagtatgtatatatatag

SEQ ID NO: 128860 - DNA, 22 bp, Artificial Sequence
  Synthetic oligonucleotide; TTA chr11 5310854 5310875 5310859 5310854 -
tcctagtatgtatatatatagt

SEQ ID NO: 128861 - DNA, 22 bp, Artificial Sequence
  Synthetic oligonucleotide; CTA chr11 5310849 5310870 5310854 5310849 -
gtatgtatatatatagttgtgt

SEQ ID NO: 128862 - DNA, 22 bp, Artificial Sequence
  Synthetic oligonucleotide; TTG chr11 5310830 5310851 5310835 5310830 -
tgtttgcatgtgtgtgtggaca

SEQ ID NO: 128863 - DNA, 22 bp, Artificial Sequence
  Synthetic oligonucleotide; TTT chr11 5310825 5310846 5310830 5310825 -
gcatgtgtgtgtggacacctgc

SEQ ID NO: 128864 - DNA, 22 bp, Artificial Sequence
  Synthetic oligonucleotide; TTG chr11 5310824 5310845 5310829 5310824 -
catgtgtgtgtggacacctgca

SEQ ID NO: 128865 - DNA, 22 bp, Artificial Sequence
  Synthetic oligonucleotide; CTG chr11 5310804 5310825 5310809 5310804 -
cacatgtggaataaatctttta

SEQ ID NO: 128866 - DNA, 22 bp, Artificial Sequence
  Synthetic oligonucleotide; CTT chr11 5310785 5310806 5310790 5310785 -
ttaatattttatcttagacata

SEQ ID NO: 128867 - DNA, 22 bp, Artificial Sequence
  Synthetic oligonucleotide; TTT chr11 5310784 5310805 5310789 5310784 -
taatattttatcttagacataa

SEQ ID NO: 128868 - DNA, 22 bp, Artificial Sequence
  Synthetic oligonucleotide; TTT chr11 5310783 5310804 5310788 5310783 -
aatattttatcttagacataat

SEQ ID NO: 128869 - DNA, 22 bp, Artificial Sequence
  Synthetic oligonucleotide; TTA chr11 5310782 5310803 5310787 5310782 -
atattttatcttagacataatt

SEQ ID NO: 128870 - DNA, 22 bp, Artificial Sequence
  Synthetic oligonucleotide; TTT chr11 5310776 5310797 5310781 5310776 -
tatcttagacataatttttaac

SEQ ID NO: 128871 - DNA, 22 bp, Artificial Sequence
  Synthetic oligonucleotide; TTT chr11 5310775 5310796 5310780 5310775 -
atcttagacataatttttaacc

SEQ ID NO: 128872 - DNA, 22 bp, Artificial Sequence
  Synthetic oligonucleotide; TTA chr11 5310774 5310795 5310779 5310774 -
tcttagacataatttttaacct

SEQ ID NO: 128873 - DNA, 22 bp, Artificial Sequence
  Synthetic oligonucleotide; CTT chr11 5310770 5310791 5310775 5310770 -
agacataatttttaacctcaaa

SEQ ID NO: 128874 - DNA, 22 bp, Artificial Sequence
  Synthetic oligonucleotide; TTA chr11 5310769 5310790 5310774 5310769 -
gacataatttttaacctcaaac

SEQ ID NO: 128875 - DNA, 22 bp, Artificial Sequence
  Synthetic oligonucleotide; TTT chr11 5310759 5310780 5310764 5310759 -
ttaacctcaaactcttgttttt

SEQ ID NO: 128876 - DNA, 22 bp, Artificial Sequence
  Synthetic oligonucleotide; TTT chr11 5310758 5310779 5310763 5310758 -
taacctcaaactcttgttttta

SEQ ID NO: 128877 - DNA, 22 bp, Artificial Sequence
  Synthetic oligonucleotide; TTT chr11 5310757 5310778 5310762 5310757 -
aacctcaaactcttgtttttaa

SEQ ID NO: 128878 - DNA, 22 bp, Artificial Sequence
  Synthetic oligonucleotide; TTA chr11 5310756 5310777 5310761 5310756 -
acctcaaactcttgtttttaaa

SEQ ID NO: 128879 - DNA, 22 bp, Artificial Sequence
  Synthetic oligonucleotide; CTC chr11 5310751 5310772 5310756 5310751 -
aaactcttgtttttaaaccttt

SEQ ID NO: 128880 - DNA, 22 bp, Artificial Sequence
  Synthetic oligonucleotide; CTC chr11 5310745 5310766 5310750 5310745 -
ttgtttttaaacctttcacaat

SEQ ID NO: 128881 - DNA, 22 bp, Artificial Sequence
  Synthetic oligonucleotide; CTT chr11 5310743 5310764 5310748 5310743 -
gtttttaaacctttcacaataa

SEQ ID NO: 128882 - DNA, 22 bp, Artificial Sequence
  Synthetic oligonucleotide; TTG chr11 5310742 5310763 5310747 5310742 -
tttttaaacctttcacaataaa

SEQ ID NO: 128883 - DNA, 22 bp, Artificial Sequence
  Synthetic oligonucleotide; TTT chr11 5310739 5310760 5310744 5310739 -
ttaaacctttcacaataaattt

SEQ ID NO: 128884 - DNA, 22 bp, Artificial Sequence
  Synthetic oligonucleotide; TTT chr11 5310738 5310759 5310743 5310738 -
taaacctttcacaataaattta

SEQ ID NO: 128885 - DNA, 22 bp, Artificial Sequence
  Synthetic oligonucleotide; TTT chr11 5310737 5310758 5310742 5310737 -
aaacctttcacaataaatttaa

SEQ ID NO: 128886 - DNA, 22 bp, Artificial Sequence
  Synthetic oligonucleotide; TTA chr11 5310736 5310757 5310741 5310736 -
aacctttcacaataaatttaat

SEQ ID NO: 128887 - DNA, 22 bp, Artificial Sequence
  Synthetic oligonucleotide; CTT chr11 5310730 5310751 5310735 5310730 -
tcacaataaatttaatgaattg

SEQ ID NO: 128888 - DNA, 22 bp, Artificial Sequence
  Synthetic oligonucleotide; TTT chr11 5310729 5310750 5310734 5310729 -
cacaataaatttaatgaattga

SEQ ID NO: 128889 - DNA, 22 bp, Artificial Sequence
  Synthetic oligonucleotide; TTC chr11 5310728 5310749 5310733 5310728 -
acaataaatttaatgaattgaa

SEQ ID NO: 128890 - DNA, 22 bp, Artificial Sequence
  Synthetic oligonucleotide; TTT chr11 5310717 5310738 5310722 5310717 -
aatgaattgaaatacatttatt

SEQ ID NO: 128891 - DNA, 22 bp, Artificial Sequence
  Synthetic oligonucleotide; TTA chr11 5310716 5310737 5310721 5310716 -
atgaattgaaatacatttattg

SEQ ID NO: 128892 - DNA, 22 bp, Artificial Sequence
  Synthetic oligonucleotide; TTG chr11 5310708 5310729 5310713 5310708 -
aaatacatttattgttttattt

SEQ ID NO: 128893 - DNA, 22 bp, Artificial Sequence
  Synthetic oligonucleotide; TTT chr11 5310698 5310719 5310703 5310698 -
attgttttatttttatagtggt

SEQ ID NO: 128894 - DNA, 22 bp, Artificial Sequence
  Synthetic oligonucleotide; TTA chr11 5310697 5310718 5310702 5310697 -
ttgttttatttttatagtggta

SEQ ID NO: 128895 - DNA, 22 bp, Artificial Sequence
  Synthetic oligonucleotide; TTG chr11 5310694 5310715 5310699 5310694 -
ttttatttttatagtggtaata

SEQ ID NO: 128896 - DNA, 22 bp, Artificial Sequence
  Synthetic oligonucleotide; TTT chr11 5310691 5310712 5310696 5310691 -
tatttttatagtggtaatatat

SEQ ID NO: 128897 - DNA, 22 bp, Artificial Sequence
  Synthetic oligonucleotide; TTT chr11 5310690 5310711 5310695 5310690 -
atttttatagtggtaatatata

SEQ ID NO: 128898 - DNA, 22 bp, Artificial Sequence
  Synthetic oligonucleotide; TTA chr11 5310689 5310710 5310694 5310689 -
tttttatagtggtaatatatac

SEQ ID NO: 128899 - DNA, 22 bp, Artificial Sequence
  Synthetic oligonucleotide; TTT chr11 5310686 5310707 5310691 5310686 -
ttatagtggtaatatatacaat

SEQ ID NO: 128900 - DNA, 22 bp, Artificial Sequence
  Synthetic oligonucleotide; TTT chr11 5310685 5310706 5310690 5310685 -
tatagtggtaatatatacaatt

SEQ ID NO: 128901 - DNA, 22 bp, Artificial Sequence
  Synthetic oligonucleotide; TTT chr11 5310684 5310705 5310689 5310684 -
atagtggtaatatatacaattt

SEQ ID NO: 128902 - DNA, 22 bp, Artificial Sequence
  Synthetic oligonucleotide; TTA chr11 5310683 5310704 5310688 5310683 -
tagtggtaatatatacaatttg

SEQ ID NO: 128903 - DNA, 22 bp, Artificial Sequence
  Synthetic oligonucleotide; TTT chr11 5310662 5310683 5310667 5310662 -
gccactttagcctttttataat

SEQ ID NO: 128904 - DNA, 22 bp, Artificial Sequence
  Synthetic oligonucleotide; TTG chr11 5310661 5310682 5310666 5310661 -
ccactttagcctttttataatg

SEQ ID NO: 128905 - DNA, 22 bp, Artificial Sequence
  Synthetic oligonucleotide; CTT chr11 5310655 5310676 5310660 5310655 -
tagcctttttataatgtataat

SEQ ID NO: 128906 - DNA, 22 bp, Artificial Sequence
  Synthetic oligonucleotide; TTT chr11 5310654 5310675 5310659 5310654 -
agcctttttataatgtataatg

SEQ ID NO: 128907 - DNA, 22 bp, Artificial Sequence
  Synthetic oligonucleotide; TTA chr11 5310653 5310674 5310658 5310653 -
gcctttttataatgtataatgc

SEQ ID NO: 128908 - DNA, 22 bp, Artificial Sequence
  Synthetic oligonucleotide; CTT chr11 5310648 5310669 5310653 5310648 -
tttataatgtataatgcagtgg

SEQ ID NO: 128909 - DNA, 22 bp, Artificial Sequence
  Synthetic oligonucleotide; TTT chr11 5310647 5310668 5310652 5310647 -
ttataatgtataatgcagtggc

SEQ ID NO: 128910 - DNA, 22 bp, Artificial Sequence
  Synthetic oligonucleotide; TTT chr11 5310646 5310667 5310651 5310646 -
tataatgtataatgcagtggca

SEQ ID NO: 128911 - DNA, 22 bp, Artificial Sequence
  Synthetic oligonucleotide; TTT chr11 5310645 5310666 5310650 5310645 -
ataatgtataatgcagtggcac

SEQ ID NO: 128912 - DNA, 22 bp, Artificial Sequence
  Synthetic oligonucleotide; TTA chr11 5310644 5310665 5310649 5310644 -
taatgtataatgcagtggcact

SEQ ID NO: 128913 - DNA, 22 bp, Artificial Sequence
  Synthetic oligonucleotide; CTT chr11 5310621 5310642 5310626 5310621 -
attacatttgccatgttgtgca

SEQ ID NO: 128914 - DNA, 22 bp, Artificial Sequence
  Synthetic oligonucleotide; TTA chr11 5310620 5310641 5310625 5310620 -
ttacatttgccatgttgtgcaa

SEQ ID NO: 128915 - DNA, 22 bp, Artificial Sequence
  Synthetic oligonucleotide; TTA chr11 5310617 5310638 5310622 5310617 -
catttgccatgttgtgcaatca

SEQ ID NO: 128916 - DNA, 22 bp, Artificial Sequence
  Synthetic oligonucleotide; TTT chr11 5310612 5310633 5310617 5310612 -
gccatgttgtgcaatcaccacc

SEQ ID NO: 128917 - DNA, 22 bp, Artificial Sequence
  Synthetic oligonucleotide; TTG chr11 5310611 5310632 5310616 5310611 -
ccatgttgtgcaatcaccacca

SEQ ID NO: 128918 - DNA, 22 bp, Artificial Sequence
  Synthetic oligonucleotide; TTG chr11 5310603 5310624 5310608 5310603 -
tgcaatcaccaccactatttct

SEQ ID NO: 128919 - DNA, 22 bp, Artificial Sequence
  Synthetic oligonucleotide; CTA chr11 5310586 5310607 5310591 5310586 -
tttctaaaattttgtattacac

SEQ ID NO: 128920 - DNA, 22 bp, Artificial Sequence
  Synthetic oligonucleotide; TTT chr11 5310583 5310604 5310588 5310583 -
ctaaaattttgtattacaccaa

SEQ ID NO: 128921 - DNA, 22 bp, Artificial Sequence
  Synthetic oligonucleotide; TTC chr11 5310582 5310603 5310587 5310582 -
taaaattttgtattacaccaaa

SEQ ID NO: 128922 - DNA, 22 bp, Artificial Sequence
  Synthetic oligonucleotide; CTA chr11 5310580 5310601 5310585 5310580 -
aaattttgtattacaccaaata

SEQ ID NO: 128923 - DNA, 22 bp, Artificial Sequence
  Synthetic oligonucleotide; TTT chr11 5310574 5310595 5310579 5310574 -
tgtattacaccaaataaaaact

SEQ ID NO: 128924 - DNA, 22 bp, Artificial Sequence
  Synthetic oligonucleotide; TTT chr11 5310573 5310594 5310578 5310573 -
gtattacaccaaataaaaactc

SEQ ID NO: 128925 - DNA, 22 bp, Artificial Sequence
  Synthetic oligonucleotide; TTG chr11 5310572 5310593 5310577 5310572 -
tattacaccaaataaaaactct

SEQ ID NO: 128926 - DNA, 22 bp, Artificial Sequence
  Synthetic oligonucleotide; TTA chr11 5310567 5310588 5310572 5310567 -
caccaaataaaaactctatatt

SEQ ID NO: 128927 - DNA, 22 bp, Artificial Sequence
  Synthetic oligonucleotide; CTC chr11 5310551 5310572 5310556 5310551 -
tatattgattaatcagttactc

SEQ ID NO: 128928 - DNA, 22 bp, Artificial Sequence
  Synthetic oligonucleotide; CTA chr11 5310549 5310570 5310554 5310549 -
tattgattaatcagttactccc

SEQ ID NO: 128929 - DNA, 22 bp, Artificial Sequence
  Synthetic oligonucleotide; TTG chr11 5310544 5310565 5310549 5310544 -
attaatcagttactccccaatc

SEQ ID NO: 128930 - DNA, 22 bp, Artificial Sequence
  Synthetic oligonucleotide; TTA chr11 5310540 5310561 5310545 5310540 -
atcagttactccccaatccatg

SEQ ID NO: 128931 - DNA, 22 bp, Artificial Sequence
  Synthetic oligonucleotide; TTA chr11 5310532 5310553 5310537 5310532 -
ctccccaatccatgttcttcct

SEQ ID NO: 128932 - DNA, 22 bp, Artificial Sequence
  Synthetic oligonucleotide; CTC chr11 5310529 5310550 5310534 5310529 -
cccaatccatgttcttcctaca

SEQ ID NO: 128933 - DNA, 22 bp, Artificial Sequence
  Synthetic oligonucleotide; TTC chr11 5310515 5310536 5310520 5310515 -
ttcctacactctggtaacttct

SEQ ID NO: 128934 - DNA, 22 bp, Artificial Sequence
  Synthetic oligonucleotide; CTT chr11 5310513 5310534 5310518 5310513 -
cctacactctggtaacttctaa

SEQ ID NO: 128935 - DNA, 22 bp, Artificial Sequence
  Synthetic oligonucleotide; TTC chr11 5310512 5310533 5310517 5310512 -
ctacactctggtaacttctaat

SEQ ID NO: 128936 - DNA, 22 bp, Artificial Sequence
  Synthetic oligonucleotide; CTA chr11 5310509 5310530 5310514 5310509 -
cactctggtaacttctaatcta

SEQ ID NO: 128937 - DNA, 22 bp, Artificial Sequence
  Synthetic oligonucleotide; CTC chr11 5310504 5310525 5310509 5310504 -
tggtaacttctaatctactttt

SEQ ID NO: 128938 - DNA, 22 bp, Artificial Sequence
  Synthetic oligonucleotide; CTG chr11 5310502 5310523 5310507 5310502 -
gtaacttctaatctactttttg

SEQ ID NO: 128939 - DNA, 22 bp, Artificial Sequence
  Synthetic oligonucleotide; CTT chr11 5310495 5310516 5310500 5310495 -
ctaatctactttttgtctctat

SEQ ID NO: 128940 - DNA, 22 bp, Artificial Sequence
  Synthetic oligonucleotide; TTC chr11 5310494 5310515 5310499 5310494 -
taatctactttttgtctctatg

SEQ ID NO: 128941 - DNA, 22 bp, Artificial Sequence
  Synthetic oligonucleotide; CTA chr11 5310492 5310513 5310497 5310492 -
atctactttttgtctctatgaa

SEQ ID NO: 128942 - DNA, 22 bp, Artificial Sequence
  Synthetic oligonucleotide; CTA chr11 5310487 5310508 5310492 5310487 -
ctttttgtctctatgaatttgc

SEQ ID NO: 128943 - DNA, 22 bp, Artificial Sequence
  Synthetic oligonucleotide; CTT chr11 5310484 5310505 5310489 5310484 -
tttgtctctatgaatttgccta

SEQ ID NO: 128944 - DNA, 22 bp, Artificial Sequence
  Synthetic oligonucleotide; TTT chr11 5310483 5310504 5310488 5310483 -
ttgtctctatgaatttgcctat

SEQ ID NO: 128945 - DNA, 22 bp, Artificial Sequence
  Synthetic oligonucleotide; TTT chr11 5310482 5310503 5310487 5310482 -
tgtctctatgaatttgcctatt

SEQ ID NO: 128946 - DNA, 22 bp, Artificial Sequence
  Synthetic oligonucleotide; TTT chr11 5310481 5310502 5310486 5310481 -
gtctctatgaatttgcctattc

SEQ ID NO: 128947 - DNA, 22 bp, Artificial Sequence
  Synthetic oligonucleotide; TTG chr11 5310480 5310501 5310485 5310480 -
tctctatgaatttgcctattct

SEQ ID NO: 128948 - DNA, 22 bp, Artificial Sequence
  Synthetic oligonucleotide; CTC chr11 5310476 5310497 5310481 5310476 -
tatgaatttgcctattctagat

SEQ ID NO: 128949 - DNA, 22 bp, Artificial Sequence
  Synthetic oligonucleotide; CTA chr11 5310474 5310495 5310479 5310474 -
tgaatttgcctattctagatag

SEQ ID NO: 128950 - DNA, 22 bp, Artificial Sequence
  Synthetic oligonucleotide; TTT chr11 5310467 5310488 5310472 5310467 -
gcctattctagatagctcatgt

SEQ ID NO: 128951 - DNA, 22 bp, Artificial Sequence
  Synthetic oligonucleotide; TTG chr11 5310466 5310487 5310471 5310466 -
cctattctagatagctcatgta

SEQ ID NO: 128952 - DNA, 22 bp, Artificial Sequence
  Synthetic oligonucleotide; CTA chr11 5310462 5310483 5310467 5310462 -
ttctagatagctcatgtaagtg

SEQ ID NO: 128953 - DNA, 22 bp, Artificial Sequence
  Synthetic oligonucleotide; TTC chr11 5310459 5310480 5310464 5310459 -
tagatagctcatgtaagtgaaa

SEQ ID NO: 128954 - DNA, 22 bp, Artificial Sequence
  Synthetic oligonucleotide; CTA chr11 5310457 5310478 5310462 5310457 -
gatagctcatgtaagtgaaatc

SEQ ID NO: 128955 - DNA, 22 bp, Artificial Sequence
  Synthetic oligonucleotide; CTC chr11 5310449 5310470 5310454 5310449 -
atgtaagtgaaatcagacaatg

SEQ ID NO: 128956 - DNA, 22 bp, Artificial Sequence
  Synthetic oligonucleotide; TTC chr11 5310424 5310445 5310429 5310424 -
ttttgcgtatgacttattgcac

SEQ ID NO: 128957 - DNA, 22 bp, Artificial Sequence
  Synthetic oligonucleotide; CTT chr11 5310422 5310443 5310427 5310422 -
ttgcgtatgacttattgcactt

SEQ ID NO: 128958 - DNA, 22 bp, Artificial Sequence
  Synthetic oligonucleotide; TTT chr11 5310421 5310442 5310426 5310421 -
tgcgtatgacttattgcactta

SEQ ID NO: 128959 - DNA, 22 bp, Artificial Sequence
  Synthetic oligonucleotide; TTT chr11 5310420 5310441 5310425 5310420 -
gcgtatgacttattgcacttag

SEQ ID NO: 128960 - DNA, 22 bp, Artificial Sequence
  Synthetic oligonucleotide; TTG chr11 5310419 5310440 5310424 5310419 -
cgtatgacttattgcacttagg

SEQ ID NO: 128961 - DNA, 22 bp, Artificial Sequence
  Synthetic oligonucleotide; CTT chr11 5310409 5310430 5310414 5310409 -
attgcacttaggatagtttttt

SEQ ID NO: 128962 - DNA, 22 bp, Artificial Sequence
  Synthetic oligonucleotide; TTA chr11 5310408 5310429 5310413 5310408 -
ttgcacttaggatagtttttta

SEQ ID NO: 128963 - DNA, 22 bp, Artificial Sequence
  Synthetic oligonucleotide; TTG chr11 5310405 5310426 5310410 5310405 -
cacttaggatagttttttaagg

SEQ ID NO: 128964 - DNA, 22 bp, Artificial Sequence
  Synthetic oligonucleotide; CTT chr11 5310400 5310421 5310405 5310400 -
aggatagttttttaaggtttat

SEQ ID NO: 128965 - DNA, 22 bp, Artificial Sequence
  Synthetic oligonucleotide; TTA chr11 5310399 5310420 5310404 5310399 -
ggatagttttttaaggtttatt

SEQ ID NO: 128966 - DNA, 22 bp, Artificial Sequence
  Synthetic oligonucleotide; TTT chr11 5310390 5310411 5310395 5310390 -
tttaaggtttattcatgttgta

SEQ ID NO: 128967 - DNA, 22 bp, Artificial Sequence
  Synthetic oligonucleotide; TTT chr11 5310389 5310410 5310394 5310389 -
ttaaggtttattcatgttgtag

SEQ ID NO: 128968 - DNA, 22 bp, Artificial Sequence
  Synthetic oligonucleotide; TTT chr11 5310388 5310409 5310393 5310388 -
taaggtttattcatgttgtagc

SEQ ID NO: 128969 - DNA, 22 bp, Artificial Sequence
  Synthetic oligonucleotide; TTT chr11 5310387 5310408 5310392 5310387 -
aaggtttattcatgttgtagca

SEQ ID NO: 128970 - DNA, 22 bp, Artificial Sequence
  Synthetic oligonucleotide; TTA chr11 5310386 5310407 5310391 5310386 -
aggtttattcatgttgtagcat

SEQ ID NO: 128971 - DNA, 22 bp, Artificial Sequence
  Synthetic oligonucleotide; TTT chr11 5310380 5310401 5310385 5310380 -
attcatgttgtagcatgtgtca

SEQ ID NO: 128972 - DNA, 22 bp, Artificial Sequence
  Synthetic oligonucleotide; TTA chr11 5310379 5310400 5310384 5310379 -
ttcatgttgtagcatgtgtcag

SEQ ID NO: 128973 - DNA, 22 bp, Artificial Sequence
  Synthetic oligonucleotide; TTC chr11 5310376 5310397 5310381 5310376 -
atgttgtagcatgtgtcagacc

SEQ ID NO: 128974 - DNA, 22 bp, Artificial Sequence
  Synthetic oligonucleotide; TTG chr11 5310370 5310391 5310375 5310370 -
tagcatgtgtcagacctacttt

SEQ ID NO: 128975 - DNA, 22 bp, Artificial Sequence
  Synthetic oligonucleotide; CTA chr11 5310352 5310373 5310357 5310352 -
ctttttatagataaataatatt

SEQ ID NO: 128976 - DNA, 22 bp, Artificial Sequence
  Synthetic oligonucleotide; CTT chr11 5310349 5310370 5310354 5310349 -
tttatagataaataatattcta

SEQ ID NO: 128977 - DNA, 22 bp, Artificial Sequence
  Synthetic oligonucleotide; TTT chr11 5310348 5310369 5310353 5310348 -
ttatagataaataatattctat

SEQ ID NO: 128978 - DNA, 22 bp, Artificial Sequence
  Synthetic oligonucleotide; TTT chr11 5310347 5310368 5310352 5310347 -
tatagataaataatattctatc

SEQ ID NO: 128979 - DNA, 22 bp, Artificial Sequence
  Synthetic oligonucleotide; TTT chr11 5310346 5310367 5310351 5310346 -
atagataaataatattctatca

SEQ ID NO: 128980 - DNA, 22 bp, Artificial Sequence
  Synthetic oligonucleotide; TTA chr11 5310345 5310366 5310350 5310345 -
tagataaataatattctatcac

SEQ ID NO: 128981 - DNA, 22 bp, Artificial Sequence
  Synthetic oligonucleotide; TTC chr11 5310329 5310350 5310334 5310329 -
tatcacatatataagacatttt

SEQ ID NO: 128982 - DNA, 22 bp, Artificial Sequence
  Synthetic oligonucleotide; CTA chr11 5310327 5310348 5310332 5310327 -
tcacatatataagacattttgt

SEQ ID NO: 128983 - DNA, 22 bp, Artificial Sequence
  Synthetic oligonucleotide; TTT chr11 5310308 5310329 5310313 5310308 -
tgttgatatacgcatctgttga

SEQ ID NO: 128984 - DNA, 22 bp, Artificial Sequence
  Synthetic oligonucleotide; TTT chr11 5310307 5310328 5310312 5310307 -
gttgatatacgcatctgttgat

SEQ ID NO: 128985 - DNA, 22 bp, Artificial Sequence
  Synthetic oligonucleotide; TTG chr11 5310306 5310327 5310311 5310306 -
ttgatatacgcatctgttgata

SEQ ID NO: 128986 - DNA, 22 bp, Artificial Sequence
  Synthetic oligonucleotide; TTG chr11 5310303 5310324 5310308 5310303 -
atatacgcatctgttgatagat

SEQ ID NO: 128987 - DNA, 22 bp, Artificial Sequence
  Synthetic oligonucleotide; CTG chr11 5310290 5310311 5310295 5310290 -
ttgatagatacttgtattgttt

SEQ ID NO: 128988 - DNA, 22 bp, Artificial Sequence
  Synthetic oligonucleotide; TTG chr11 5310287 5310308 5310292 5310287 -
atagatacttgtattgtttcta

SEQ ID NO: 128989 - DNA, 22 bp, Artificial Sequence
  Synthetic oligonucleotide; CTT chr11 5310277 5310298 5310282 5310277 -
gtattgtttctattccttggct

SEQ ID NO: 128990 - DNA, 22 bp, Artificial Sequence
  Synthetic oligonucleotide; TTG chr11 5310276 5310297 5310281 5310276 -
tattgtttctattccttggcta

SEQ ID NO: 128991 - DNA, 22 bp, Artificial Sequence
  Synthetic oligonucleotide; TTG chr11 5310271 5310292 5310276 5310271 -
tttctattccttggctactgtg

SEQ ID NO: 128992 - DNA, 22 bp, Artificial Sequence
  Synthetic oligonucleotide; TTT chr11 5310268 5310289 5310273 5310268 -
ctattccttggctactgtgaat

SEQ ID NO: 128993 - DNA, 22 bp, Artificial Sequence
  Synthetic oligonucleotide; TTC chr11 5310267 5310288 5310272 5310267 -
tattccttggctactgtgaatt

SEQ ID NO: 128994 - DNA, 22 bp, Artificial Sequence
  Synthetic oligonucleotide; CTA chr11 5310265 5310286 5310270 5310265 -
ttccttggctactgtgaattat

SEQ ID NO: 128995 - DNA, 22 bp, Artificial Sequence
  Synthetic oligonucleotide; TTC chr11 5310262 5310283 5310267 5310262 -
cttggctactgtgaattattga

SEQ ID NO: 128996 - DNA, 22 bp, Artificial Sequence
  Synthetic oligonucleotide; CTT chr11 5310259 5310280 5310264 5310259 -
ggctactgtgaattattgatgt

SEQ ID NO: 128997 - DNA, 22 bp, Artificial Sequence
  Synthetic oligonucleotide; TTG chr11 5310258 5310279 5310263 5310258 -
gctactgtgaattattgatgtc

SEQ ID NO: 128998 - DNA, 22 bp, Artificial Sequence
  Synthetic oligonucleotide; CTA chr11 5310254 5310275 5310259 5310254 -
ctgtgaattattgatgtcttcc

SEQ ID NO: 128999 - DNA, 22 bp, Artificial Sequence
  Synthetic oligonucleotide; CTG chr11 5310251 5310272 5310256 5310251 -
tgaattattgatgtcttccctt

SEQ ID NO: 129000 - DNA, 22 bp, Artificial Sequence
  Synthetic oligonucleotide; TTA chr11 5310244 5310265 5310249 5310244 -
ttgatgtcttcccttcaatatg

SEQ ID NO: 129001 - DNA, 22 bp, Artificial Sequence
  Synthetic oligonucleotide; TTG chr11 5310241 5310262 5310246 5310241 -
atgtcttcccttcaatatgccc

SEQ ID NO: 129002 - DNA, 22 bp, Artificial Sequence
  Synthetic oligonucleotide; CTT chr11 5310234 5310255 5310239 5310234 -
cccttcaatatgcccagattct

SEQ ID NO: 129003 - DNA, 22 bp, Artificial Sequence
  Synthetic oligonucleotide; TTC chr11 5310233 5310254 5310238 5310233 -
ccttcaatatgcccagattcta

SEQ ID NO: 129004 - DNA, 22 bp, Artificial Sequence
  Synthetic oligonucleotide; CTT chr11 5310229 5310250 5310234 5310229 -
caatatgcccagattctaccta

SEQ ID NO: 129005 - DNA, 22 bp, Artificial Sequence
  Synthetic oligonucleotide; TTC chr11 5310228 5310249 5310233 5310228 -
aatatgcccagattctacctaa

SEQ ID NO: 129006 - DNA, 22 bp, Artificial Sequence
  Synthetic oligonucleotide; TTC chr11 5310213 5310234 5310218 5310213 -
tacctaaatatatctctctact

SEQ ID NO: 129007 - DNA, 22 bp, Artificial Sequence
  Synthetic oligonucleotide; CTA chr11 5310211 5310232 5310216 5310211 -
cctaaatatatctctctacttc

SEQ ID NO: 129008 - DNA, 22 bp, Artificial Sequence
  Synthetic oligonucleotide; CTA chr11 5310207 5310228 5310212 5310207 -
aatatatctctctacttcctct

SEQ ID NO: 129009 - DNA, 22 bp, Artificial Sequence
  Synthetic oligonucleotide; CTC chr11 5310197 5310218 5310202 5310197 -
tctacttcctctcactctgaat

SEQ ID NO: 129010 - DNA, 22 bp, Artificial Sequence
  Synthetic oligonucleotide; CTC chr11 5310195 5310216 5310200 5310195 -
tacttcctctcactctgaatat

SEQ ID NO: 129011 - DNA, 22 bp, Artificial Sequence
  Synthetic oligonucleotide; CTA chr11 5310193 5310214 5310198 5310193 -
cttcctctcactctgaatattc

SEQ ID NO: 129012 - DNA, 22 bp, Artificial Sequence
  Synthetic oligonucleotide; CTT chr11 5310190 5310211 5310195 5310190 -
cctctcactctgaatattctgc

SEQ ID NO: 129013 - DNA, 22 bp, Artificial Sequence
  Synthetic oligonucleotide; TTC chr11 5310189 5310210 5310194 5310189 -
ctctcactctgaatattctgct

SEQ ID NO: 129014 - DNA, 22 bp, Artificial Sequence
  Synthetic oligonucleotide; CTC chr11 5310186 5310207 5310191 5310186 -
tcactctgaatattctgctttt

SEQ ID NO: 129015 - DNA, 22 bp, Artificial Sequence
  Synthetic oligonucleotide; CTC chr11 5310184 5310205 5310189 5310184 -
actctgaatattctgcttttca

SEQ ID NO: 129016 - DNA, 22 bp, Artificial Sequence
  Synthetic oligonucleotide; CTC chr11 5310180 5310201 5310185 5310180 -
tgaatattctgcttttcaaaga

SEQ ID NO: 129017 - DNA, 22 bp, Artificial Sequence
  Synthetic oligonucleotide; CTG chr11 5310178 5310199 5310183 5310178 -
aatattctgcttttcaaagaat

SEQ ID NO: 129018 - DNA, 22 bp, Artificial Sequence
  Synthetic oligonucleotide; TTC chr11 5310171 5310192 5310176 5310171 -
tgcttttcaaagaatattcctt

SEQ ID NO: 129019 - DNA, 22 bp, Artificial Sequence
  Synthetic oligonucleotide; CTG chr11 5310169 5310190 5310174 5310169 -
cttttcaaagaatattccttgg

SEQ ID NO: 129020 - DNA, 22 bp, Artificial Sequence
  Synthetic oligonucleotide; CTT chr11 5310166 5310187 5310171 5310166 -
ttcaaagaatattccttggaat

SEQ ID NO: 129021 - DNA, 22 bp, Artificial Sequence
  Synthetic oligonucleotide; TTT chr11 5310165 5310186 5310170 5310165 -
tcaaagaatattccttggaata

SEQ ID NO: 129022 - DNA, 22 bp, Artificial Sequence
  Synthetic oligonucleotide; TTT chr11 5310164 5310185 5310169 5310164 -
caaagaatattccttggaatat

SEQ ID NO: 129023 - DNA, 22 bp, Artificial Sequence
  Synthetic oligonucleotide; TTC chr11 5310163 5310184 5310168 5310163 -
aaagaatattccttggaatatt

SEQ ID NO: 129024 - DNA, 22 bp, Artificial Sequence
  Synthetic oligonucleotide; TTC chr11 5310152 5310173 5310157 5310152 -
cttggaatattccatggaagaa

SEQ ID NO: 129025 - DNA, 22 bp, Artificial Sequence
  Synthetic oligonucleotide; CTT chr11 5310149 5310170 5310154 5310149 -
ggaatattccatggaagaagaa

SEQ ID NO: 129026 - DNA, 22 bp, Artificial Sequence
  Synthetic oligonucleotide; TTG chr11 5310148 5310169 5310153 5310148 -
gaatattccatggaagaagaaa

SEQ ID NO: 129027 - DNA, 22 bp, Artificial Sequence
  Synthetic oligonucleotide; TTC chr11 5310140 5310161 5310145 5310140 -
catggaagaagaaaatgagaca

SEQ ID NO: 129028 - DNA, 22 bp, Artificial Sequence
  Synthetic oligonucleotide; CTT chr11 5310113 5310134 5310118 5310113 -
tctggagaaaggaagttttcag

SEQ ID NO: 129029 - DNA, 22 bp, Artificial Sequence
  Synthetic oligonucleotide; TTT chr11 5310112 5310133 5310117 5310112 -
ctggagaaaggaagttttcagt

SEQ ID NO: 129030 - DNA, 22 bp, Artificial Sequence
  Synthetic oligonucleotide; TTC chr11 5310111 5310132 5310116 5310111 -
tggagaaaggaagttttcagtg

SEQ ID NO: 129031 - DNA, 22 bp, Artificial Sequence
  Synthetic oligonucleotide; CTG chr11 5310109 5310130 5310114 5310109 -
gagaaaggaagttttcagtgcc

SEQ ID NO: 129032 - DNA, 22 bp, Artificial Sequence
  Synthetic oligonucleotide; TTT chr11 5310095 5310116 5310100 5310095 -
tcagtgccttgatctcggctga

SEQ ID NO: 129033 - DNA, 22 bp, Artificial Sequence
  Synthetic oligonucleotide; TTT chr11 5310094 5310115 5310099 5310094 -
cagtgccttgatctcggctgac

SEQ ID NO: 129034 - DNA, 22 bp, Artificial Sequence
  Synthetic oligonucleotide; TTC chr11 5310093 5310114 5310098 5310093 -
agtgccttgatctcggctgact

SEQ ID NO: 129035 - DNA, 22 bp, Artificial Sequence
  Synthetic oligonucleotide; CTT chr11 5310085 5310106 5310090 5310085 -
gatctcggctgactgcaacctc

SEQ ID NO: 129036 - DNA, 22 bp, Artificial Sequence
  Synthetic oligonucleotide; TTG chr11 5310084 5310105 5310089 5310084 -
atctcggctgactgcaacctct

SEQ ID NO: 129037 - DNA, 22 bp, Artificial Sequence
  Synthetic oligonucleotide; CTC chr11 5310079 5310100 5310084 5310079 -
ggctgactgcaacctctgcctc

SEQ ID NO: 129038 - DNA, 22 bp, Artificial Sequence
  Synthetic oligonucleotide; CTG chr11 5310074 5310095 5310079 5310074 -
actgcaacctctgcctcctggg

SEQ ID NO: 129039 - DNA, 22 bp, Artificial Sequence
  Synthetic oligonucleotide; CTG chr11 5310070 5310091 5310075 5310070 -
caacctctgcctcctgggttca

SEQ ID NO: 129040 - DNA, 22 bp, Artificial Sequence
  Synthetic oligonucleotide; CTC chr11 5310063 5310084 5310068 5310063 -
tgcctcctgggttcagttttca

SEQ ID NO: 129041 - DNA, 22 bp, Artificial Sequence
  Synthetic oligonucleotide; CTG chr11 5310061 5310082 5310066 5310061 -
cctcctgggttcagttttcagt

SEQ ID NO: 129042 - DNA, 22 bp, Artificial Sequence
  Synthetic oligonucleotide; CTC chr11 5310057 5310078 5310062 5310057 -
ctgggttcagttttcagttaaa

SEQ ID NO: 129043 - DNA, 22 bp, Artificial Sequence
  Synthetic oligonucleotide; CTG chr11 5310054 5310075 5310059 5310054 -
ggttcagttttcagttaaagaa

SEQ ID NO: 129044 - DNA, 22 bp, Artificial Sequence
  Synthetic oligonucleotide; TTC chr11 5310049 5310070 5310054 5310049 -
agttttcagttaaagaaatgat

SEQ ID NO: 129045 - DNA, 22 bp, Artificial Sequence
  Synthetic oligonucleotide; TTT chr11 5310044 5310065 5310049 5310044 -
tcagttaaagaaatgatttaac

SEQ ID NO: 129046 - DNA, 22 bp, Artificial Sequence
  Synthetic oligonucleotide; TTT chr11 5310043 5310064 5310048 5310043 -
cagttaaagaaatgatttaaca

SEQ ID NO: 129047 - DNA, 22 bp, Artificial Sequence
  Synthetic oligonucleotide; TTC chr11 5310042 5310063 5310047 5310042 -
agttaaagaaatgatttaacaa

SEQ ID NO: 129048 - DNA, 22 bp, Artificial Sequence
  Synthetic oligonucleotide; TTA chr11 5310037 5310058 5310042 5310037 -
aagaaatgatttaacaaatttt

SEQ ID NO: 129049 - DNA, 22 bp, Artificial Sequence
  Synthetic oligonucleotide; TTT chr11 5310025 5310046 5310030 5310025 -
aacaaattttttcactcaacta

SEQ ID NO: 129050 - DNA, 22 bp, Artificial Sequence
  Synthetic oligonucleotide; TTA chr11 5310024 5310045 5310029 5310024 -
acaaattttttcactcaactag

SEQ ID NO: 129051 - DNA, 22 bp, Artificial Sequence
  Synthetic oligonucleotide; TTT chr11 5310016 5310037 5310021 5310016 -
tttcactcaactagagatttta

SEQ ID NO: 129052 - DNA, 22 bp, Artificial Sequence
  Synthetic oligonucleotide; TTT chr11 5310015 5310036 5310020 5310015 -
ttcactcaactagagattttat

SEQ ID NO: 129053 - DNA, 22 bp, Artificial Sequence
  Synthetic oligonucleotide; TTT chr11 5310014 5310035 5310019 5310014 -
tcactcaactagagattttatg

SEQ ID NO: 129054 - DNA, 22 bp, Artificial Sequence
  Synthetic oligonucleotide; TTT chr11 5310013 5310034 5310018 5310013 -
cactcaactagagattttatga

SEQ ID NO: 129055 - DNA, 22 bp, Artificial Sequence
  Synthetic oligonucleotide; TTC chr11 5310012 5310033 5310017 5310012 -
actcaactagagattttatgat

SEQ ID NO: 129056 - DNA, 22 bp, Artificial Sequence
  Synthetic oligonucleotide; CTC chr11 5310008 5310029 5310013 5310008 -
aactagagattttatgataatg

SEQ ID NO: 129057 - DNA, 22 bp, Artificial Sequence
  Synthetic oligonucleotide; CTA chr11 5310003 5310024 5310008 5310003 -
gagattttatgataatgcaata

SEQ ID NO: 129058 - DNA, 22 bp, Artificial Sequence
  Synthetic oligonucleotide; TTT chr11 5309996 5310017 5310001 5309996 -
tatgataatgcaatacagataa

SEQ ID NO: 129059 - DNA, 22 bp, Artificial Sequence
  Synthetic oligonucleotide; TTT chr11 5309995 5310016 5310000 5309995 -
atgataatgcaatacagataaa

SEQ ID NO: 129060 - DNA, 22 bp, Artificial Sequence
  Synthetic oligonucleotide; TTA chr11 5309994 5310015 5309999 5309994 -
tgataatgcaatacagataaaa

SEQ ID NO: 129061 - DNA, 22 bp, Artificial Sequence
  Synthetic oligonucleotide; CTT chr11 5309957 5309978 5309962 5309957 -
ccagacctaaaaatatgtggca

SEQ ID NO: 129062 - DNA, 22 bp, Artificial Sequence
  Synthetic oligonucleotide; TTC chr11 5309956 5309977 5309961 5309956 -
cagacctaaaaatatgtggcat

SEQ ID NO: 129063 - DNA, 22 bp, Artificial Sequence
  Synthetic oligonucleotide; CTA chr11 5309948 5309969 5309953 5309948 -
aaaatatgtggcatccacattt

SEQ ID NO: 129064 - DNA, 22 bp, Artificial Sequence
  Synthetic oligonucleotide; TTT chr11 5309926 5309947 5309931 5309926 -
tacaggtacattttcacggaga

SEQ ID NO: 129065 - DNA, 22 bp, Artificial Sequence
  Synthetic oligonucleotide; TTT chr11 5309925 5309946 5309930 5309925 -
acaggtacattttcacggagaa

SEQ ID NO: 129066 - DNA, 22 bp, Artificial Sequence
  Synthetic oligonucleotide; TTA chr11 5309924 5309945 5309929 5309924 -
caggtacattttcacggagaaa

SEQ ID NO: 129067 - DNA, 22 bp, Artificial Sequence
  Synthetic oligonucleotide; TTT chr11 5309913 5309934 5309918 5309913 -
tcacggagaaagataagaactg

SEQ ID NO: 129068 - DNA, 22 bp, Artificial Sequence
  Synthetic oligonucleotide; TTT chr11 5309912 5309933 5309917 5309912 -
cacggagaaagataagaactgg

SEQ ID NO: 129069 - DNA, 22 bp, Artificial Sequence
  Synthetic oligonucleotide; TTC chr11 5309911 5309932 5309916 5309911 -
acggagaaagataagaactggt

SEQ ID NO: 129070 - DNA, 22 bp, Artificial Sequence
  Synthetic oligonucleotide; CTG chr11 5309891 5309912 5309896 5309891 -
gtgatttgtttgcaacaaatct

SEQ ID NO: 129071 - DNA, 22 bp, Artificial Sequence
  Synthetic oligonucleotide; TTT chr11 5309884 5309905 5309889 5309884 -
gtttgcaacaaatctttgctct

SEQ ID NO: 129072 - DNA, 22 bp, Artificial Sequence
  Synthetic oligonucleotide; TTG chr11 5309883 5309904 5309888 5309883 -
tttgcaacaaatctttgctctg

SEQ ID NO: 129073 - DNA, 22 bp, Artificial Sequence
  Synthetic oligonucleotide; TTT chr11 5309880 5309901 5309885 5309880 -
gcaacaaatctttgctctggac

SEQ ID NO: 129074 - DNA, 22 bp, Artificial Sequence
  Synthetic oligonucleotide; TTG chr11 5309879 5309900 5309884 5309879 -
caacaaatctttgctctggact

SEQ ID NO: 129075 - DNA, 22 bp, Artificial Sequence
  Synthetic oligonucleotide; CTT chr11 5309868 5309889 5309873 5309868 -
tgctctggacttcactgagtaa

SEQ ID NO: 129076 - DNA, 22 bp, Artificial Sequence
  Synthetic oligonucleotide; TTT chr11 5309867 5309888 5309872 5309867 -
gctctggacttcactgagtaaa

SEQ ID NO: 129077 - DNA, 22 bp, Artificial Sequence
  Synthetic oligonucleotide; TTG chr11 5309866 5309887 5309871 5309866 -
ctctggacttcactgagtaaag

SEQ ID NO: 129078 - DNA, 22 bp, Artificial Sequence
  Synthetic oligonucleotide; CTC chr11 5309863 5309884 5309868 5309863 -
tggacttcactgagtaaagttt

SEQ ID NO: 129079 - DNA, 22 bp, Artificial Sequence
  Synthetic oligonucleotide; CTG chr11 5309861 5309882 5309866 5309861 -
gacttcactgagtaaagttttt

SEQ ID NO: 129080 - DNA, 22 bp, Artificial Sequence
  Synthetic oligonucleotide; CTT chr11 5309856 5309877 5309861 5309856 -
cactgagtaaagttttttttgc

SEQ ID NO: 129081 - DNA, 22 bp, Artificial Sequence
  Synthetic oligonucleotide; TTC chr11 5309855 5309876 5309860 5309855 -
actgagtaaagttttttttgct

SEQ ID NO: 129082 - DNA, 22 bp, Artificial Sequence
  Synthetic oligonucleotide; CTG chr11 5309851 5309872 5309856 5309851 -
agtaaagttttttttgctttgt

SEQ ID NO: 129083 - DNA, 22 bp, Artificial Sequence
  Synthetic oligonucleotide; TTT chr11 5309841 5309862 5309846 5309841 -
tttttgctttgttttgttttgt

SEQ ID NO: 129084 - DNA, 22 bp, Artificial Sequence
  Synthetic oligonucleotide; TTT chr11 5309840 5309861 5309845 5309840 -
ttttgctttgttttgttttgtt

SEQ ID NO: 129085 - DNA, 22 bp, Artificial Sequence
  Synthetic oligonucleotide; TTT chr11 5309839 5309860 5309844 5309839 -
tttgctttgttttgttttgttt

SEQ ID NO: 129086 - DNA, 22 bp, Artificial Sequence
  Synthetic oligonucleotide; TTT chr11 5309838 5309859 5309843 5309838 -
ttgctttgttttgttttgtttt

SEQ ID NO: 129087 - DNA, 22 bp, Artificial Sequence
  Synthetic oligonucleotide; TTT chr11 5309837 5309858 5309842 5309837 -
tgctttgttttgttttgttttt

SEQ ID NO: 129088 - DNA, 22 bp, Artificial Sequence
  Synthetic oligonucleotide; TTT chr11 5309836 5309857 5309841 5309836 -
gctttgttttgttttgtttttg

SEQ ID NO: 129089 - DNA, 22 bp, Artificial Sequence
  Synthetic oligonucleotide; TTG chr11 5309835 5309856 5309840 5309835 -
ctttgttttgttttgtttttga

SEQ ID NO: 129090 - DNA, 22 bp, Artificial Sequence
  Synthetic oligonucleotide; CTT chr11 5309832 5309853 5309837 5309832 -
tgttttgttttgtttttgagat

SEQ ID NO: 129091 - DNA, 22 bp, Artificial Sequence
  Synthetic oligonucleotide; TTT chr11 5309831 5309852 5309836 5309831 -
gttttgttttgtttttgagatg

SEQ ID NO: 129092 - DNA, 22 bp, Artificial Sequence
  Synthetic oligonucleotide; TTG chr11 5309830 5309851 5309835 5309830 -
ttttgttttgtttttgagatgg

SEQ ID NO: 129093 - DNA, 22 bp, Artificial Sequence
  Synthetic oligonucleotide; TTT chr11 5309827 5309848 5309832 5309827 -
tgttttgtttttgagatggagt

SEQ ID NO: 129094 - DNA, 22 bp, Artificial Sequence
  Synthetic oligonucleotide; TTT chr11 5309826 5309847 5309831 5309826 -
gttttgtttttgagatggagtc

SEQ ID NO: 129095 - DNA, 22 bp, Artificial Sequence
  Synthetic oligonucleotide; TTG chr11 5309825 5309846 5309830 5309825 -
ttttgtttttgagatggagtct

SEQ ID NO: 129096 - DNA, 22 bp, Artificial Sequence
  Synthetic oligonucleotide; TTT chr11 5309822 5309843 5309827 5309822 -
tgtttttgagatggagtctcgc

SEQ ID NO: 129097 - DNA, 22 bp, Artificial Sequence
  Synthetic oligonucleotide; TTT chr11 5309821 5309842 5309826 5309821 -
gtttttgagatggagtctcgct

SEQ ID NO: 129098 - DNA, 22 bp, Artificial Sequence
  Synthetic oligonucleotide; TTG chr11 5309820 5309841 5309825 5309820 -
tttttgagatggagtctcgctc

SEQ ID NO: 129099 - DNA, 22 bp, Artificial Sequence
  Synthetic oligonucleotide; TTT chr11 5309817 5309838 5309822 5309817 -
ttgagatggagtctcgctctgt

SEQ ID NO: 129100 - DNA, 22 bp, Artificial Sequence
  Synthetic oligonucleotide; TTT chr11 5309816 5309837 5309821 5309816 -
tgagatggagtctcgctctgtc

SEQ ID NO: 129101 - DNA, 22 bp, Artificial Sequence
  Synthetic oligonucleotide; TTT chr11 5309815 5309836 5309820 5309815 -
gagatggagtctcgctctgtcg

SEQ ID NO: 129102 - DNA, 22 bp, Artificial Sequence
  Synthetic oligonucleotide; TTG chr11 5309814 5309835 5309819 5309814 -
agatggagtctcgctctgtcgc

SEQ ID NO: 129103 - DNA, 22 bp, Artificial Sequence
  Synthetic oligonucleotide; CTC chr11 5309802 5309823 5309807 5309802 -
gctctgtcgcccaggctggagt

SEQ ID NO: 129104 - DNA, 22 bp, Artificial Sequence
  Synthetic oligonucleotide; CTC chr11 5309798 5309819 5309803 5309798 -
tgtcgcccaggctggagtgcag

SEQ ID NO: 129105 - DNA, 22 bp, Artificial Sequence
  Synthetic oligonucleotide; CTG chr11 5309796 5309817 5309801 5309796 -
tcgcccaggctggagtgcagtg

SEQ ID NO: 129106 - DNA, 22 bp, Artificial Sequence
  Synthetic oligonucleotide; CTG chr11 5309784 5309805 5309789 5309784 -
gagtgcagtggcgtgatctcag

SEQ ID NO: 129107 - DNA, 22 bp, Artificial Sequence
  Synthetic oligonucleotide; CTC chr11 5309764 5309785 5309769 5309764 -
agctcactgcaagctctgcctc

SEQ ID NO: 129108 - DNA, 22 bp, Artificial Sequence
  Synthetic oligonucleotide; CTC chr11 5309759 5309780 5309764 5309759 -
actgcaagctctgcctcccggg

SEQ ID NO: 129109 - DNA, 22 bp, Artificial Sequence
  Synthetic oligonucleotide; CTG chr11 5309755 5309776 5309760 5309755 -
caagctctgcctcccgggttca

SEQ ID NO: 129110 - DNA, 22 bp, Artificial Sequence
  Synthetic oligonucleotide; CTC chr11 5309748 5309769 5309753 5309748 -
tgcctcccgggttcacgccatt

SEQ ID NO: 129111 - DNA, 22 bp, Artificial Sequence
  Synthetic oligonucleotide; CTG chr11 5309746 5309767 5309751 5309746 -
cctcccgggttcacgccattct

SEQ ID NO: 129112 - DNA, 22 bp, Artificial Sequence
  Synthetic oligonucleotide; CTC chr11 5309742 5309763 5309747 5309742 -
ccgggttcacgccattctcctg

SEQ ID NO: 129113 - DNA, 22 bp, Artificial Sequence
  Synthetic oligonucleotide; TTC chr11 5309734 5309755 5309739 5309734 -
acgccattctcctgcctcagcc

SEQ ID NO: 129114 - DNA, 22 bp, Artificial Sequence
  Synthetic oligonucleotide; TTC chr11 5309725 5309746 5309730 5309725 -
tcctgcctcagcctcccgagta

SEQ ID NO: 129115 - DNA, 22 bp, Artificial Sequence
  Synthetic oligonucleotide; CTC chr11 5309723 5309744 5309728 5309723 -
ctgcctcagcctcccgagtagc

SEQ ID NO: 129116 - DNA, 22 bp, Artificial Sequence
  Synthetic oligonucleotide; CTG chr11 5309720 5309741 5309725 5309720 -
cctcagcctcccgagtagctgg

SEQ ID NO: 129117 - DNA, 22 bp, Artificial Sequence
  Synthetic oligonucleotide; CTC chr11 5309716 5309737 5309721 5309716 -
agcctcccgagtagctgggact

SEQ ID NO: 129118 - DNA, 22 bp, Artificial Sequence
  Synthetic oligonucleotide; CTC chr11 5309710 5309731 5309715 5309710 -
ccgagtagctgggactacaggc

SEQ ID NO: 129119 - DNA, 22 bp, Artificial Sequence
  Synthetic oligonucleotide; CTG chr11 5309699 5309720 5309704 5309699 -
ggactacaggcgcccgccacca

SEQ ID NO: 129120 - DNA, 22 bp, Artificial Sequence
  Synthetic oligonucleotide; CTA chr11 5309693 5309714 5309698 5309693 -
caggcgcccgccaccacgccag

SEQ ID NO: 129121 - DNA, 22 bp, Artificial Sequence
  Synthetic oligonucleotide; TTT chr11 5309663 5309684 5309668 5309663 -
ttttgtctttttagtagagacg

SEQ ID NO: 129122 - DNA, 22 bp, Artificial Sequence
  Synthetic oligonucleotide; TTT chr11 5309662 5309683 5309667 5309662 -
tttgtctttttagtagagacgg

SEQ ID NO: 129123 - DNA, 22 bp, Artificial Sequence
  Synthetic oligonucleotide; TTT chr11 5309661 5309682 5309666 5309661 -
ttgtctttttagtagagacggg

SEQ ID NO: 129124 - DNA, 22 bp, Artificial Sequence
  Synthetic oligonucleotide; TTT chr11 5309660 5309681 5309665 5309660 -
tgtctttttagtagagacgggg

SEQ ID NO: 129125 - DNA, 22 bp, Artificial Sequence
  Synthetic oligonucleotide; TTT chr11 5309659 5309680 5309664 5309659 -
gtctttttagtagagacggggt

SEQ ID NO: 129126 - DNA, 22 bp, Artificial Sequence
  Synthetic oligonucleotide; TTG chr11 5309658 5309679 5309663 5309658 -
tctttttagtagagacggggtt

SEQ ID NO: 129127 - DNA, 22 bp, Artificial Sequence
  Synthetic oligonucleotide; CTT chr11 5309654 5309675 5309659 5309654 -
tttagtagagacggggtttcac

SEQ ID NO: 129128 - DNA, 22 bp, Artificial Sequence
  Synthetic oligonucleotide; TTT chr11 5309653 5309674 5309658 5309653 -
ttagtagagacggggtttcact

SEQ ID NO: 129129 - DNA, 22 bp, Artificial Sequence
  Synthetic oligonucleotide; TTT chr11 5309652 5309673 5309657 5309652 -
tagtagagacggggtttcactg

SEQ ID NO: 129130 - DNA, 22 bp, Artificial Sequence
  Synthetic oligonucleotide; TTT chr11 5309651 5309672 5309656 5309651 -
agtagagacggggtttcactgt

SEQ ID NO: 129131 - DNA, 22 bp, Artificial Sequence
  Synthetic oligonucleotide; TTA chr11 5309650 5309671 5309655 5309650 -
gtagagacggggtttcactgtg

SEQ ID NO: 129132 - DNA, 22 bp, Artificial Sequence
  Synthetic oligonucleotide; TTT chr11 5309635 5309656 5309640 5309635 -
cactgtgttagccaggatggtc

SEQ ID NO: 129133 - DNA, 22 bp, Artificial Sequence
  Synthetic oligonucleotide; TTC chr11 5309634 5309655 5309639 5309634 -
actgtgttagccaggatggtct

SEQ ID NO: 129134 - DNA, 22 bp, Artificial Sequence
  Synthetic oligonucleotide; CTG chr11 5309630 5309651 5309635 5309630 -
tgttagccaggatggtctcgat

SEQ ID NO: 129135 - DNA, 22 bp, Artificial Sequence
  Synthetic oligonucleotide; TTA chr11 5309625 5309646 5309630 5309625 -
gccaggatggtctcgatctccc

SEQ ID NO: 129136 - DNA, 22 bp, Artificial Sequence
  Synthetic oligonucleotide; CTC chr11 5309611 5309632 5309616 5309611 -
gatctcccgacctcgtgatcca

SEQ ID NO: 129137 - DNA, 22 bp, Artificial Sequence
  Synthetic oligonucleotide; CTC chr11 5309605 5309626 5309610 5309605 -
ccgacctcgtgatccacccgcc

SEQ ID NO: 129138 - DNA, 22 bp, Artificial Sequence
  Synthetic oligonucleotide; CTC chr11 5309597 5309618 5309602 5309597 -
gtgatccacccgcctcggcctc

SEQ ID NO: 129139 - DNA, 22 bp, Artificial Sequence
  Synthetic oligonucleotide; CTC chr11 5309581 5309602 5309586 5309581 -
ggcctcccaaagtgctgggatt

SEQ ID NO: 129140 - DNA, 22 bp, Artificial Sequence
  Synthetic oligonucleotide; CTC chr11 5309575 5309596 5309580 5309575 -
ccaaagtgctgggattacaggc

SEQ ID NO: 129141 - DNA, 22 bp, Artificial Sequence
  Synthetic oligonucleotide; CTG chr11 5309564 5309585 5309569 5309564 -
ggattacaggcgtgagccaccg

SEQ ID NO: 129142 - DNA, 22 bp, Artificial Sequence
  Synthetic oligonucleotide; TTA chr11 5309558 5309579 5309563 5309558 -
caggcgtgagccaccgcgcccg

SEQ ID NO: 129143 - DNA, 22 bp, Artificial Sequence
  Synthetic oligonucleotide; CTG chr11 5309531 5309552 5309536 5309531 -
agtaaagttttatattgggaag

SEQ ID NO: 129144 - DNA, 22 bp, Artificial Sequence
  Synthetic oligonucleotide; TTT chr11 5309521 5309542 5309526 5309521 -
tatattgggaagacataaaaat

SEQ ID NO: 129145 - DNA, 22 bp, Artificial Sequence
  Synthetic oligonucleotide; TTT chr11 5309520 5309541 5309525 5309520 -
atattgggaagacataaaaatg

SEQ ID NO: 129146 - DNA, 22 bp, Artificial Sequence
  Synthetic oligonucleotide; TTA chr11 5309519 5309540 5309524 5309519 -
tattgggaagacataaaaatgt

SEQ ID NO: 129147 - DNA, 22 bp, Artificial Sequence
  Synthetic oligonucleotide; TTG chr11 5309514 5309535 5309519 5309514 -
ggaagacataaaaatgtggaga

SEQ ID NO: 129148 - DNA, 22 bp, Artificial Sequence
  Synthetic oligonucleotide; CTA chr11 5309474 5309495 5309479 5309474 -
tggaatgcttaaaaaaataggt

SEQ ID NO: 129149 - DNA, 22 bp, Artificial Sequence
  Synthetic oligonucleotide; CTT chr11 5309464 5309485 5309469 5309464 -
aaaaaaataggtgtaggcgcaa

SEQ ID NO: 129150 - DNA, 22 bp, Artificial Sequence
  Synthetic oligonucleotide; TTA chr11 5309463 5309484 5309468 5309463 -
aaaaaataggtgtaggcgcaag

SEQ ID NO: 129151 - DNA, 22 bp, Artificial Sequence
  Synthetic oligonucleotide; TTT chr11 5309438 5309459 5309443 5309438 -
tctgtatgtccttgtattaaaa

SEQ ID NO: 129152 - DNA, 22 bp, Artificial Sequence
  Synthetic oligonucleotide; TTT chr11 5309437 5309458 5309442 5309437 -
ctgtatgtccttgtattaaaac

SEQ ID NO: 129153 - DNA, 22 bp, Artificial Sequence
  Synthetic oligonucleotide; TTC chr11 5309436 5309457 5309441 5309436 -
tgtatgtccttgtattaaaact

SEQ ID NO: 129154 - DNA, 22 bp, Artificial Sequence
  Synthetic oligonucleotide; CTG chr11 5309434 5309455 5309439 5309434 -
tatgtccttgtattaaaacttt

SEQ ID NO: 129155 - DNA, 22 bp, Artificial Sequence
  Synthetic oligonucleotide; CTT chr11 5309425 5309446 5309430 5309425 -
gtattaaaactttttcatactg

SEQ ID NO: 129156 - DNA, 22 bp, Artificial Sequence
  Synthetic oligonucleotide; TTG chr11 5309424 5309445 5309429 5309424 -
tattaaaactttttcatactga

SEQ ID NO: 129157 - DNA, 22 bp, Artificial Sequence
  Synthetic oligonucleotide; TTA chr11 5309419 5309440 5309424 5309419 -
aaactttttcatactgaatcaa

SEQ ID NO: 129158 - DNA, 22 bp, Artificial Sequence
  Synthetic oligonucleotide; CTT chr11 5309413 5309434 5309418 5309413 -
tttcatactgaatcaattgtaa

SEQ ID NO: 129159 - DNA, 22 bp, Artificial Sequence
  Synthetic oligonucleotide; TTT chr11 5309412 5309433 5309417 5309412 -
ttcatactgaatcaattgtaaa

SEQ ID NO: 129160 - DNA, 22 bp, Artificial Sequence
  Synthetic oligonucleotide; TTT chr11 5309411 5309432 5309416 5309411 -
tcatactgaatcaattgtaaaa

SEQ ID NO: 129161 - DNA, 22 bp, Artificial Sequence
  Synthetic oligonucleotide; TTT chr11 5309410 5309431 5309415 5309410 -
catactgaatcaattgtaaaac

SEQ ID NO: 129162 - DNA, 22 bp, Artificial Sequence
  Synthetic oligonucleotide; TTC chr11 5309409 5309430 5309414 5309409 -
atactgaatcaattgtaaaacc

SEQ ID NO: 129163 - DNA, 22 bp, Artificial Sequence
  Synthetic oligonucleotide; CTG chr11 5309403 5309424 5309408 5309403 -
aatcaattgtaaaaccgattat

SEQ ID NO: 129164 - DNA, 22 bp, Artificial Sequence
  Synthetic oligonucleotide; TTG chr11 5309394 5309415 5309399 5309394 -
taaaaccgattatttacccaat

SEQ ID NO: 129165 - DNA, 22 bp, Artificial Sequence
  Synthetic oligonucleotide; TTA chr11 5309382 5309403 5309387 5309382 -
tttacccaatgcatgctgtaag

SEQ ID NO: 129166 - DNA, 22 bp, Artificial Sequence
  Synthetic oligonucleotide; TTT chr11 5309379 5309400 5309384 5309379 -
acccaatgcatgctgtaagcaa

SEQ ID NO: 129167 - DNA, 22 bp, Artificial Sequence
  Synthetic oligonucleotide; TTA chr11 5309378 5309399 5309383 5309378 -
cccaatgcatgctgtaagcaaa

SEQ ID NO: 129168 - DNA, 22 bp, Artificial Sequence
  Synthetic oligonucleotide; CTG chr11 5309364 5309385 5309369 5309364 -
taagcaaaattatatgctattg

SEQ ID NO: 129169 - DNA, 22 bp, Artificial Sequence
  Synthetic oligonucleotide; TTA chr11 5309352 5309373 5309357 5309352 -
tatgctattgagtacaatgttt

SEQ ID NO: 129170 - DNA, 22 bp, Artificial Sequence
  Synthetic oligonucleotide; CTA chr11 5309345 5309366 5309350 5309345 -
ttgagtacaatgtttaagctat

SEQ ID NO: 129171 - DNA, 22 bp, Artificial Sequence
  Synthetic oligonucleotide; TTG chr11 5309342 5309363 5309347 5309342 -
agtacaatgtttaagctattga

SEQ ID NO: 129172 - DNA, 22 bp, Artificial Sequence
  Synthetic oligonucleotide; TTT chr11 5309330 5309351 5309335 5309330 -
aagctattgatactgagtataa

SEQ ID NO: 129173 - DNA, 22 bp, Artificial Sequence
  Synthetic oligonucleotide; TTA chr11 5309329 5309350 5309334 5309329 -
agctattgatactgagtataaa

SEQ ID NO: 129174 - DNA, 22 bp, Artificial Sequence
  Synthetic oligonucleotide; CTA chr11 5309324 5309345 5309329 5309324 -
ttgatactgagtataaacacaa

SEQ ID NO: 129175 - DNA, 22 bp, Artificial Sequence
  Synthetic oligonucleotide; TTG chr11 5309321 5309342 5309326 5309321 -
atactgagtataaacacaaatc

SEQ ID NO: 129176 - DNA, 22 bp, Artificial Sequence
  Synthetic oligonucleotide; CTG chr11 5309315 5309336 5309320 5309315 -
agtataaacacaaatcttaaaa

SEQ ID NO: 129177 - DNA, 22 bp, Artificial Sequence
  Synthetic oligonucleotide; CTT chr11 5309297 5309318 5309302 5309297 -
aaaatctggttatcccccaaag

SEQ ID NO: 129178 - DNA, 22 bp, Artificial Sequence
  Synthetic oligonucleotide; TTA chr11 5309296 5309317 5309301 5309296 -
aaatctggttatcccccaaaga

SEQ ID NO: 129179 - DNA, 22 bp, Artificial Sequence
  Synthetic oligonucleotide; CTG chr11 5309289 5309310 5309294 5309289 -
gttatcccccaaagactcctct

SEQ ID NO: 129180 - DNA, 22 bp, Artificial Sequence
  Synthetic oligonucleotide; TTA chr11 5309285 5309306 5309290 5309285 -
tcccccaaagactcctctgttt

SEQ ID NO: 129181 - DNA, 22 bp, Artificial Sequence
  Synthetic oligonucleotide; CTC chr11 5309271 5309292 5309276 5309271 -
ctctgtttctcataatgtgccc

SEQ ID NO: 129182 - DNA, 22 bp, Artificial Sequence
  Synthetic oligonucleotide; CTC chr11 5309268 5309289 5309273 5309268 -
tgtttctcataatgtgcccagt

SEQ ID NO: 129183 - DNA, 22 bp, Artificial Sequence
  Synthetic oligonucleotide; CTG chr11 5309266 5309287 5309271 5309266 -
tttctcataatgtgcccagtaa

SEQ ID NO: 129184 - DNA, 22 bp, Artificial Sequence
  Synthetic oligonucleotide; TTT chr11 5309263 5309284 5309268 5309263 -
ctcataatgtgcccagtaagtt

SEQ ID NO: 129185 - DNA, 22 bp, Artificial Sequence
  Synthetic oligonucleotide; TTC chr11 5309262 5309283 5309267 5309262 -
tcataatgtgcccagtaagttc

SEQ ID NO: 129186 - DNA, 22 bp, Artificial Sequence
  Synthetic oligonucleotide; CTC chr11 5309260 5309281 5309265 5309260 -
ataatgtgcccagtaagttcct

SEQ ID NO: 129187 - DNA, 22 bp, Artificial Sequence
  Synthetic oligonucleotide; TTC chr11 5309240 5309261 5309245 5309240 -
ctaatgtttattagtgtgttgg

SEQ ID NO: 129188 - DNA, 22 bp, Artificial Sequence
  Synthetic oligonucleotide; CTA chr11 5309237 5309258 5309242 5309237 -
atgtttattagtgtgttggtag

SEQ ID NO: 129189 - DNA, 22 bp, Artificial Sequence
  Synthetic oligonucleotide; TTT chr11 5309231 5309252 5309236 5309231 -
attagtgtgttggtaggaaatt

SEQ ID NO: 129190 - DNA, 22 bp, Artificial Sequence
  Synthetic oligonucleotide; TTA chr11 5309230 5309251 5309235 5309230 -
ttagtgtgttggtaggaaattt

SEQ ID NO: 129191 - DNA, 22 bp, Artificial Sequence
  Synthetic oligonucleotide; TTA chr11 5309227 5309248 5309232 5309227 -
gtgtgttggtaggaaatttcaa

SEQ ID NO: 129192 - DNA, 22 bp, Artificial Sequence
  Synthetic oligonucleotide; TTG chr11 5309219 5309240 5309224 5309219 -
gtaggaaatttcaaccccgatc

SEQ ID NO: 129193 - DNA, 22 bp, Artificial Sequence
  Synthetic oligonucleotide; TTT chr11 5309208 5309229 5309213 5309208 -
caaccccgatcatttccatctt

SEQ ID NO: 129194 - DNA, 22 bp, Artificial Sequence
  Synthetic oligonucleotide; TTC chr11 5309207 5309228 5309212 5309207 -
aaccccgatcatttccatcttg

SEQ ID NO: 129195 - DNA, 22 bp, Artificial Sequence
  Synthetic oligonucleotide; TTT chr11 5309193 5309214 5309198 5309193 -
ccatcttgatttgctgacctgg

SEQ ID NO: 129196 - DNA, 22 bp, Artificial Sequence
  Synthetic oligonucleotide; TTC chr11 5309192 5309213 5309197 5309192 -
catcttgatttgctgacctggg

SEQ ID NO: 129197 - DNA, 22 bp, Artificial Sequence
  Synthetic oligonucleotide; CTT chr11 5309186 5309207 5309191 5309186 -
gatttgctgacctgggtgcagg

SEQ ID NO: 129198 - DNA, 22 bp, Artificial Sequence
  Synthetic oligonucleotide; TTG chr11 5309185 5309206 5309190 5309185 -
atttgctgacctgggtgcaggt

SEQ ID NO: 129199 - DNA, 22 bp, Artificial Sequence
  Synthetic oligonucleotide; TTT chr11 5309181 5309202 5309186 5309181 -
gctgacctgggtgcaggttctt

SEQ ID NO: 129200 - DNA, 22 bp, Artificial Sequence
  Synthetic oligonucleotide; TTG chr11 5309180 5309201 5309185 5309180 -
ctgacctgggtgcaggttctta

SEQ ID NO: 129201 - DNA, 22 bp, Artificial Sequence
  Synthetic oligonucleotide; CTG chr11 5309177 5309198 5309182 5309177 -
acctgggtgcaggttcttatga

SEQ ID NO: 129202 - DNA, 22 bp, Artificial Sequence
  Synthetic oligonucleotide; CTG chr11 5309172 5309193 5309177 5309172 -
ggtgcaggttcttatgacagag

SEQ ID NO: 129203 - DNA, 22 bp, Artificial Sequence
  Synthetic oligonucleotide; TTC chr11 5309161 5309182 5309166 5309161 -
ttatgacagaggaaagactgtc

SEQ ID NO: 129204 - DNA, 22 bp, Artificial Sequence
  Synthetic oligonucleotide; CTT chr11 5309159 5309180 5309164 5309159 -
atgacagaggaaagactgtctt

SEQ ID NO: 129205 - DNA, 22 bp, Artificial Sequence
  Synthetic oligonucleotide; TTA chr11 5309158 5309179 5309163 5309158 -
tgacagaggaaagactgtcttt

SEQ ID NO: 129206 - DNA, 22 bp, Artificial Sequence
  Synthetic oligonucleotide; CTG chr11 5309141 5309162 5309146 5309141 -
tctttgtaagttattttggaag

SEQ ID NO: 129207 - DNA, 22 bp, Artificial Sequence
  Synthetic oligonucleotide; CTT chr11 5309137 5309158 5309142 5309137 -
tgtaagttattttggaagaata

SEQ ID NO: 129208 - DNA, 22 bp, Artificial Sequence
  Synthetic oligonucleotide; TTT chr11 5309136 5309157 5309141 5309136 -
gtaagttattttggaagaatag

SEQ ID NO: 129209 - DNA, 22 bp, Artificial Sequence
  Synthetic oligonucleotide; TTG chr11 5309135 5309156 5309140 5309135 -
taagttattttggaagaataga

SEQ ID NO: 129210 - DNA, 22 bp, Artificial Sequence
  Synthetic oligonucleotide; TTA chr11 5309128 5309149 5309133 5309128 -
ttttggaagaatagaaactgtg

SEQ ID NO: 129211 - DNA, 22 bp, Artificial Sequence
  Synthetic oligonucleotide; TTT chr11 5309125 5309146 5309130 5309125 -
tggaagaatagaaactgtgaaa

SEQ ID NO: 129212 - DNA, 22 bp, Artificial Sequence
  Synthetic oligonucleotide; TTT chr11 5309124 5309145 5309129 5309124 -
ggaagaatagaaactgtgaaaa

SEQ ID NO: 129213 - DNA, 22 bp, Artificial Sequence
  Synthetic oligonucleotide; TTG chr11 5309123 5309144 5309128 5309123 -
gaagaatagaaactgtgaaaaa

SEQ ID NO: 129214 - DNA, 22 bp, Artificial Sequence
  Synthetic oligonucleotide; CTG chr11 5309108 5309129 5309113 5309108 -
tgaaaaatatatggcttctttg

SEQ ID NO: 129215 - DNA, 22 bp, Artificial Sequence
  Synthetic oligonucleotide; CTT chr11 5309091 5309112 5309096 5309091 -
ctttggtgctcatgaggtattt

SEQ ID NO: 129216 - DNA, 22 bp, Artificial Sequence
  Synthetic oligonucleotide; TTC chr11 5309090 5309111 5309095 5309090 -
tttggtgctcatgaggtatttt

SEQ ID NO: 129217 - DNA, 22 bp, Artificial Sequence
  Synthetic oligonucleotide; CTT chr11 5309088 5309109 5309093 5309088 -
tggtgctcatgaggtattttga

SEQ ID NO: 129218 - DNA, 22 bp, Artificial Sequence
  Synthetic oligonucleotide; TTT chr11 5309087 5309108 5309092 5309087 -
ggtgctcatgaggtattttgat

SEQ ID NO: 129219 - DNA, 22 bp, Artificial Sequence
  Synthetic oligonucleotide; TTG chr11 5309086 5309107 5309091 5309086 -
gtgctcatgaggtattttgata

SEQ ID NO: 129220 - DNA, 22 bp, Artificial Sequence
  Synthetic oligonucleotide; CTC chr11 5309080 5309101 5309085 5309080 -
atgaggtattttgatactgcat

SEQ ID NO: 129221 - DNA, 22 bp, Artificial Sequence
  Synthetic oligonucleotide; TTT chr11 5309069 5309090 5309074 5309069 -
tgatactgcatgctgctccaat

SEQ ID NO: 129222 - DNA, 22 bp, Artificial Sequence
  Synthetic oligonucleotide; TTT chr11 5309068 5309089 5309073 5309068 -
gatactgcatgctgctccaata

SEQ ID NO: 129223 - DNA, 22 bp, Artificial Sequence
  Synthetic oligonucleotide; TTG chr11 5309067 5309088 5309072 5309067 -
atactgcatgctgctccaatat

SEQ ID NO: 129224 - DNA, 22 bp, Artificial Sequence
  Synthetic oligonucleotide; CTG chr11 5309061 5309082 5309066 5309061 -
catgctgctccaatatctaaat

SEQ ID NO: 129225 - DNA, 22 bp, Artificial Sequence
  Synthetic oligonucleotide; CTG chr11 5309054 5309075 5309059 5309054 -
ctccaatatctaaattatacat

SEQ ID NO: 129226 - DNA, 22 bp, Artificial Sequence
  Synthetic oligonucleotide; CTC chr11 5309051 5309072 5309056 5309051 -
caatatctaaattatacatctg

SEQ ID NO: 129227 - DNA, 22 bp, Artificial Sequence
  Synthetic oligonucleotide; CTA chr11 5309042 5309063 5309047 5309042 -
aattatacatctgctcctcttt

SEQ ID NO: 129228 - DNA, 22 bp, Artificial Sequence
  Synthetic oligonucleotide; TTA chr11 5309037 5309058 5309042 5309037 -
tacatctgctcctcttttacag

SEQ ID NO: 129229 - DNA, 22 bp, Artificial Sequence
  Synthetic oligonucleotide; CTG chr11 5309029 5309050 5309034 5309029 -
ctcctcttttacagctttatct

SEQ ID NO: 129230 - DNA, 22 bp, Artificial Sequence
  Synthetic oligonucleotide; CTC chr11 5309026 5309047 5309031 5309026 -
ctcttttacagctttatcttag

SEQ ID NO: 129231 - DNA, 22 bp, Artificial Sequence
  Synthetic oligonucleotide; CTC chr11 5309023 5309044 5309028 5309023 -
ttttacagctttatcttaggtg

SEQ ID NO: 129232 - DNA, 22 bp, Artificial Sequence
  Synthetic oligonucleotide; CTT chr11 5309021 5309042 5309026 5309021 -
ttacagctttatcttaggtgga

SEQ ID NO: 129233 - DNA, 22 bp, Artificial Sequence
  Synthetic oligonucleotide; TTT chr11 5309020 5309041 5309025 5309020 -
tacagctttatcttaggtggaa

SEQ ID NO: 129234 - DNA, 22 bp, Artificial Sequence
  Synthetic oligonucleotide; TTT chr11 5309019 5309040 5309024 5309019 -
acagctttatcttaggtggaag

SEQ ID NO: 129235 - DNA, 22 bp, Artificial Sequence
  Synthetic oligonucleotide; TTA chr11 5309018 5309039 5309023 5309018 -
cagctttatcttaggtggaagg

SEQ ID NO: 129236 - DNA, 22 bp, Artificial Sequence
  Synthetic oligonucleotide; CTT chr11 5309012 5309033 5309017 5309012 -
tatcttaggtggaagggacttc

SEQ ID NO: 129237 - DNA, 22 bp, Artificial Sequence
  Synthetic oligonucleotide; TTT chr11 5309011 5309032 5309016 5309011 -
atcttaggtggaagggacttca

SEQ ID NO: 129238 - DNA, 22 bp, Artificial Sequence
  Synthetic oligonucleotide; TTA chr11 5309010 5309031 5309015 5309010 -
tcttaggtggaagggacttcag

SEQ ID NO: 129239 - DNA, 22 bp, Artificial Sequence
  Synthetic oligonucleotide; CTT chr11 5309006 5309027 5309011 5309006 -
aggtggaagggacttcagctaa

SEQ ID NO: 129240 - DNA, 22 bp, Artificial Sequence
  Synthetic oligonucleotide; TTA chr11 5309005 5309026 5309010 5309005 -
ggtggaagggacttcagctaag

SEQ ID NO: 129241 - DNA, 22 bp, Artificial Sequence
  Synthetic oligonucleotide; CTT chr11 5308991 5309012 5308996 5308991 -
cagctaagttggctaaggccct

SEQ ID NO: 129242 - DNA, 22 bp, Artificial Sequence
  Synthetic oligonucleotide; TTC chr11 5308990 5309011 5308995 5308990 -
agctaagttggctaaggccctt

SEQ ID NO: 129243 - DNA, 22 bp, Artificial Sequence
  Synthetic oligonucleotide; CTA chr11 5308985 5309006 5308990 5308985 -
agttggctaaggcccttcaaat

SEQ ID NO: 129244 - DNA, 22 bp, Artificial Sequence
  Synthetic oligonucleotide; TTG chr11 5308980 5309001 5308985 5308980 -
gctaaggcccttcaaattaaaa

SEQ ID NO: 129245 - DNA, 22 bp, Artificial Sequence
  Synthetic oligonucleotide; CTA chr11 5308976 5308997 5308981 5308976 -
aggcccttcaaattaaaactct

SEQ ID NO: 129246 - DNA, 22 bp, Artificial Sequence
  Synthetic oligonucleotide; CTT chr11 5308968 5308989 5308973 5308968 -
caaattaaaactctgttagttt

SEQ ID NO: 129247 - DNA, 22 bp, Artificial Sequence
  Synthetic oligonucleotide; TTC chr11 5308967 5308988 5308972 5308967 -
aaattaaaactctgttagtttt

SEQ ID NO: 129248 - DNA, 22 bp, Artificial Sequence
  Synthetic oligonucleotide; TTA chr11 5308961 5308982 5308966 5308961 -
aaactctgttagtttttctcat

SEQ ID NO: 129249 - DNA, 22 bp, Artificial Sequence
  Synthetic oligonucleotide; CTC chr11 5308955 5308976 5308960 5308955 -
tgttagtttttctcatgcttag

SEQ ID NO: 129250 - DNA, 22 bp, Artificial Sequence
  Synthetic oligonucleotide; CTG chr11 5308953 5308974 5308958 5308953 -
ttagtttttctcatgcttagtg

SEQ ID NO: 129251 - DNA, 22 bp, Artificial Sequence
  Synthetic oligonucleotide; TTA chr11 5308950 5308971 5308955 5308950 -
gtttttctcatgcttagtgaga

SEQ ID NO: 129252 - DNA, 22 bp, Artificial Sequence
  Synthetic oligonucleotide; TTT chr11 5308946 5308967 5308951 5308946 -
ttctcatgcttagtgagaaaga

SEQ ID NO: 129253 - DNA, 22 bp, Artificial Sequence
  Synthetic oligonucleotide; TTT chr11 5308945 5308966 5308950 5308945 -
tctcatgcttagtgagaaagat

SEQ ID NO: 129254 - DNA, 22 bp, Artificial Sequence
  Synthetic oligonucleotide; TTT chr11 5308944 5308965 5308949 5308944 -
ctcatgcttagtgagaaagatg

SEQ ID NO: 129255 - DNA, 22 bp, Artificial Sequence
  Synthetic oligonucleotide; TTC chr11 5308943 5308964 5308948 5308943 -
tcatgcttagtgagaaagatgc

SEQ ID NO: 129256 - DNA, 22 bp, Artificial Sequence
  Synthetic oligonucleotide; CTC chr11 5308941 5308962 5308946 5308941 -
atgcttagtgagaaagatgcca

SEQ ID NO: 129257 - DNA, 22 bp, Artificial Sequence
  Synthetic oligonucleotide; CTT chr11 5308935 5308956 5308940 5308935 -
agtgagaaagatgccaactttc

SEQ ID NO: 129258 - DNA, 22 bp, Artificial Sequence
  Synthetic oligonucleotide; TTA chr11 5308934 5308955 5308939 5308934 -
gtgagaaagatgccaactttct

SEQ ID NO: 129259 - DNA, 22 bp, Artificial Sequence
  Synthetic oligonucleotide; CTT chr11 5308915 5308936 5308920 5308915 -
tctgctatgaaacttcaagtta

SEQ ID NO: 129260 - DNA, 22 bp, Artificial Sequence
  Synthetic oligonucleotide; TTT chr11 5308914 5308935 5308919 5308914 -
ctgctatgaaacttcaagttat

SEQ ID NO: 129261 - DNA, 22 bp, Artificial Sequence
  Synthetic oligonucleotide; TTC chr11 5308913 5308934 5308918 5308913 -
tgctatgaaacttcaagttata

SEQ ID NO: 129262 - DNA, 22 bp, Artificial Sequence
  Synthetic oligonucleotide; CTG chr11 5308911 5308932 5308916 5308911 -
ctatgaaacttcaagttatagt

SEQ ID NO: 129263 - DNA, 22 bp, Artificial Sequence
  Synthetic oligonucleotide; CTA chr11 5308908 5308929 5308913 5308908 -
tgaaacttcaagttatagtttt

SEQ ID NO: 129264 - DNA, 22 bp, Artificial Sequence
  Synthetic oligonucleotide; CTT chr11 5308900 5308921 5308905 5308900 -
caagttatagttttttcaataa

SEQ ID NO: 129265 - DNA, 22 bp, Artificial Sequence
  Synthetic oligonucleotide; TTC chr11 5308899 5308920 5308904 5308899 -
aagttatagttttttcaataac

SEQ ID NO: 129266 - DNA, 22 bp, Artificial Sequence
  Synthetic oligonucleotide; TTA chr11 5308893 5308914 5308898 5308893 -
tagttttttcaataacctgcaa

SEQ ID NO: 129267 - DNA, 22 bp, Artificial Sequence
  Synthetic oligonucleotide; TTT chr11 5308887 5308908 5308892 5308887 -
tttcaataacctgcaatttacg

SEQ ID NO: 129268 - DNA, 22 bp, Artificial Sequence
  Synthetic oligonucleotide; TTT chr11 5308886 5308907 5308891 5308886 -
ttcaataacctgcaatttacgt

SEQ ID NO: 129269 - DNA, 22 bp, Artificial Sequence
  Synthetic oligonucleotide; TTT chr11 5308885 5308906 5308890 5308885 -
tcaataacctgcaatttacgtc

SEQ ID NO: 129270 - DNA, 22 bp, Artificial Sequence
  Synthetic oligonucleotide; TTT chr11 5308884 5308905 5308889 5308884 -
caataacctgcaatttacgtcc

SEQ ID NO: 129271 - DNA, 22 bp, Artificial Sequence
  Synthetic oligonucleotide; TTC chr11 5308883 5308904 5308888 5308883 -
aataacctgcaatttacgtcca

SEQ ID NO: 129272 - DNA, 22 bp, Artificial Sequence
  Synthetic oligonucleotide; CTG chr11 5308874 5308895 5308879 5308874 -
caatttacgtccaagaagaaag

SEQ ID NO: 129273 - DNA, 22 bp, Artificial Sequence
  Synthetic oligonucleotide; TTT chr11 5308868 5308889 5308873 5308868 -
acgtccaagaagaaaggaagat

SEQ ID NO: 129274 - DNA, 22 bp, Artificial Sequence
  Synthetic oligonucleotide; TTA chr11 5308867 5308888 5308872 5308867 -
cgtccaagaagaaaggaagatt

SEQ ID NO: 129275 - DNA, 22 bp, Artificial Sequence
  Synthetic oligonucleotide; TTC chr11 5308844 5308865 5308849 5308844 -
aatctatcttcagtgatgacca

SEQ ID NO: 129276 - DNA, 22 bp, Artificial Sequence
  Synthetic oligonucleotide; CTA chr11 5308838 5308859 5308843 5308838 -
tcttcagtgatgaccagcatca

SEQ ID NO: 129277 - DNA, 22 bp, Artificial Sequence
  Synthetic oligonucleotide; CTT chr11 5308834 5308855 5308839 5308834 -
cagtgatgaccagcatcactga

SEQ ID NO: 129278 - DNA, 22 bp, Artificial Sequence
  Synthetic oligonucleotide; TTC chr11 5308833 5308854 5308838 5308833 -
agtgatgaccagcatcactgaa

SEQ ID NO: 129279 - DNA, 22 bp, Artificial Sequence
  Synthetic oligonucleotide; CTG chr11 5308813 5308834 5308818 5308813 -
aacggttatctgggcctgttgt

SEQ ID NO: 129280 - DNA, 22 bp, Artificial Sequence
  Synthetic oligonucleotide; TTA chr11 5308805 5308826 5308810 5308805 -
tctgggcctgttgtggattgtg

SEQ ID NO: 129281 - DNA, 22 bp, Artificial Sequence
  Synthetic oligonucleotide; CTG chr11 5308801 5308822 5308806 5308801 -
ggcctgttgtggattgtgaata

SEQ ID NO: 129282 - DNA, 22 bp, Artificial Sequence
  Synthetic oligonucleotide; CTG chr11 5308795 5308816 5308800 5308795 -
ttgtggattgtgaatatgacaa

SEQ ID NO: 129283 - DNA, 22 bp, Artificial Sequence
  Synthetic oligonucleotide; TTG chr11 5308792 5308813 5308797 5308792 -
tggattgtgaatatgacaatat

SEQ ID NO: 129284 - DNA, 22 bp, Artificial Sequence
  Synthetic oligonucleotide; TTG chr11 5308785 5308806 5308790 5308785 -
tgaatatgacaatatttgaatc

SEQ ID NO: 129285 - DNA, 22 bp, Artificial Sequence
  Synthetic oligonucleotide; TTT chr11 5308768 5308789 5308773 5308768 -
gaatctctctgacgaggtataa

SEQ ID NO: 129286 - DNA, 22 bp, Artificial Sequence
  Synthetic oligonucleotide; TTG chr11 5308767 5308788 5308772 5308767 -
aatctctctgacgaggtataag

SEQ ID NO: 129287 - DNA, 22 bp, Artificial Sequence
  Synthetic oligonucleotide; CTC chr11 5308761 5308782 5308766 5308761 -
tctgacgaggtataagagaggg

SEQ ID NO: 129288 - DNA, 22 bp, Artificial Sequence
  Synthetic oligonucleotide; CTC chr11 5308759 5308780 5308764 5308759 -
tgacgaggtataagagagggac

SEQ ID NO: 129289 - DNA, 22 bp, Artificial Sequence
  Synthetic oligonucleotide; CTG chr11 5308757 5308778 5308762 5308757 -
acgaggtataagagagggacac

SEQ ID NO: 129290 - DNA, 22 bp, Artificial Sequence
  Synthetic oligonucleotide; CTC chr11 5308733 5308754 5308738 5308733 -
acttttgaatatgcagggctgt

SEQ ID NO: 129291 - DNA, 22 bp, Artificial Sequence
  Synthetic oligonucleotide; CTT chr11 5308729 5308750 5308734 5308729 -
ttgaatatgcagggctgtttcc

SEQ ID NO: 129292 - DNA, 22 bp, Artificial Sequence
  Synthetic oligonucleotide; TTT chr11 5308728 5308749 5308733 5308728 -
tgaatatgcagggctgtttcca

SEQ ID NO: 129293 - DNA, 22 bp, Artificial Sequence
  Synthetic oligonucleotide; TTT chr11 5308727 5308748 5308732 5308727 -
gaatatgcagggctgtttccat

SEQ ID NO: 129294 - DNA, 22 bp, Artificial Sequence
  Synthetic oligonucleotide; TTG chr11 5308726 5308747 5308731 5308726 -
aatatgcagggctgtttccatg

SEQ ID NO: 129295 - DNA, 22 bp, Artificial Sequence
  Synthetic oligonucleotide; CTG chr11 5308712 5308733 5308717 5308712 -
tttccatgatggaggaaagaga

SEQ ID NO: 129296 - DNA, 22 bp, Artificial Sequence
  Synthetic oligonucleotide; TTT chr11 5308709 5308730 5308714 5308709 -
ccatgatggaggaaagagattg

SEQ ID NO: 129297 - DNA, 22 bp, Artificial Sequence
  Synthetic oligonucleotide; TTC chr11 5308708 5308729 5308713 5308708 -
catgatggaggaaagagattgg

SEQ ID NO: 129298 - DNA, 22 bp, Artificial Sequence
  Synthetic oligonucleotide; TTG chr11 5308687 5308708 5308692 5308687 -
gaggaatgtagatttatgggtg

SEQ ID NO: 129299 - DNA, 22 bp, Artificial Sequence
  Synthetic oligonucleotide; TTT chr11 5308672 5308693 5308677 5308672 -
atgggtgaagttgtttggcttg

SEQ ID NO: 129300 - DNA, 22 bp, Artificial Sequence
  Synthetic oligonucleotide; TTA chr11 5308671 5308692 5308676 5308671 -
tgggtgaagttgtttggcttgg

SEQ ID NO: 129301 - DNA, 22 bp, Artificial Sequence
  Synthetic oligonucleotide; TTG chr11 5308659 5308680 5308664 5308659 -
tttggcttggaagttggatggt

SEQ ID NO: 129302 - DNA, 22 bp, Artificial Sequence
  Synthetic oligonucleotide; TTT chr11 5308656 5308677 5308661 5308656 -
ggcttggaagttggatggtcag

SEQ ID NO: 129303 - DNA, 22 bp, Artificial Sequence
  Synthetic oligonucleotide; TTG chr11 5308655 5308676 5308660 5308655 -
gcttggaagttggatggtcagt

SEQ ID NO: 129304 - DNA, 22 bp, Artificial Sequence
  Synthetic oligonucleotide; CTT chr11 5308651 5308672 5308656 5308651 -
ggaagttggatggtcagttcca

SEQ ID NO: 129305 - DNA, 22 bp, Artificial Sequence
  Synthetic oligonucleotide; TTG chr11 5308650 5308671 5308655 5308650 -
gaagttggatggtcagttccag

SEQ ID NO: 129306 - DNA, 22 bp, Artificial Sequence
  Synthetic oligonucleotide; TTG chr11 5308643 5308664 5308648 5308643 -
gatggtcagttccaggtgctac

SEQ ID NO: 129307 - DNA, 22 bp, Artificial Sequence
  Synthetic oligonucleotide; TTC chr11 5308631 5308652 5308636 5308631 -
caggtgctaccattggtgctga

SEQ ID NO: 129308 - DNA, 22 bp, Artificial Sequence
  Synthetic oligonucleotide; CTA chr11 5308622 5308643 5308627 5308622 -
ccattggtgctgaaggagaacg

SEQ ID NO: 129309 - DNA, 22 bp, Artificial Sequence
  Synthetic oligonucleotide; TTG chr11 5308616 5308637 5308621 5308616 -
gtgctgaaggagaacgtttcca

SEQ ID NO: 129310 - DNA, 22 bp, Artificial Sequence
  Synthetic oligonucleotide; CTG chr11 5308610 5308631 5308615 5308610 -
aaggagaacgtttccaaaatgt

SEQ ID NO: 129311 - DNA, 22 bp, Artificial Sequence
  Synthetic oligonucleotide; TTT chr11 5308597 5308618 5308602 5308597 -
ccaaaatgtctttggggaaata

SEQ ID NO: 129312 - DNA, 22 bp, Artificial Sequence
  Synthetic oligonucleotide; TTC chr11 5308596 5308617 5308601 5308596 -
caaaatgtctttggggaaatac

SEQ ID NO: 129313 - DNA, 22 bp, Artificial Sequence
  Synthetic oligonucleotide; CTT chr11 5308585 5308606 5308590 5308585 -
tggggaaatacaatttcctatc

SEQ ID NO: 129314 - DNA, 22 bp, Artificial Sequence
  Synthetic oligonucleotide; TTT chr11 5308584 5308605 5308589 5308584 -
ggggaaatacaatttcctatcg

SEQ ID NO: 129315 - DNA, 22 bp, Artificial Sequence
  Synthetic oligonucleotide; TTG chr11 5308583 5308604 5308588 5308583 -
gggaaatacaatttcctatcgt

SEQ ID NO: 129316 - DNA, 22 bp, Artificial Sequence
  Synthetic oligonucleotide; TTT chr11 5308569 5308590 5308574 5308569 -
cctatcgttttgtttagttgac

SEQ ID NO: 129317 - DNA, 22 bp, Artificial Sequence
  Synthetic oligonucleotide; TTC chr11 5308568 5308589 5308573 5308568 -
ctatcgttttgtttagttgaca

SEQ ID NO: 129318 - DNA, 22 bp, Artificial Sequence
  Synthetic oligonucleotide; CTA chr11 5308565 5308586 5308570 5308565 -
tcgttttgtttagttgacacaa

SEQ ID NO: 129319 - DNA, 22 bp, Artificial Sequence
  Synthetic oligonucleotide; TTT chr11 5308559 5308580 5308564 5308559 -
tgtttagttgacacaaaatctt

SEQ ID NO: 129320 - DNA, 22 bp, Artificial Sequence
  Synthetic oligonucleotide; TTT chr11 5308558 5308579 5308563 5308558 -
gtttagttgacacaaaatctta

SEQ ID NO: 129321 - DNA, 22 bp, Artificial Sequence
  Synthetic oligonucleotide; TTG chr11 5308557 5308578 5308562 5308557 -
tttagttgacacaaaatcttac

SEQ ID NO: 129322 - DNA, 22 bp, Artificial Sequence
  Synthetic oligonucleotide; TTT chr11 5308554 5308575 5308559 5308554 -
agttgacacaaaatcttactca

SEQ ID NO: 129323 - DNA, 22 bp, Artificial Sequence
  Synthetic oligonucleotide; TTA chr11 5308553 5308574 5308558 5308553 -
gttgacacaaaatcttactcag

SEQ ID NO: 129324 - DNA, 22 bp, Artificial Sequence
  Synthetic oligonucleotide; TTG chr11 5308549 5308570 5308554 5308549 -
acacaaaatcttactcagcagg

SEQ ID NO: 129325 - DNA, 22 bp, Artificial Sequence
  Synthetic oligonucleotide; CTT chr11 5308537 5308558 5308542 5308537 -
actcagcaggggcccaaagtgc

SEQ ID NO: 129326 - DNA, 22 bp, Artificial Sequence
  Synthetic oligonucleotide; TTA chr11 5308536 5308557 5308541 5308536 -
ctcagcaggggcccaaagtgca

SEQ ID NO: 129327 - DNA, 22 bp, Artificial Sequence
  Synthetic oligonucleotide; CTC chr11 5308533 5308554 5308538 5308533 -
agcaggggcccaaagtgcaatt

SEQ ID NO: 129328 - DNA, 22 bp, Artificial Sequence
  Synthetic oligonucleotide; TTG chr11 5308510 5308531 5308515 5308510 -
gtctatattatcaactcctcta

SEQ ID NO: 129329 - DNA, 22 bp, Artificial Sequence
  Synthetic oligonucleotide; CTA chr11 5308505 5308526 5308510 5308505 -
tattatcaactcctctatacat

SEQ ID NO: 129330 - DNA, 22 bp, Artificial Sequence
  Synthetic oligonucleotide; TTA chr11 5308500 5308521 5308505 5308500 -
tcaactcctctatacatattta

SEQ ID NO: 129331 - DNA, 22 bp, Artificial Sequence
  Synthetic oligonucleotide; CTC chr11 5308493 5308514 5308498 5308493 -
ctctatacatatttagacactt

SEQ ID NO: 129332 - DNA, 22 bp, Artificial Sequence
  Synthetic oligonucleotide; CTC chr11 5308490 5308511 5308495 5308490 -
tatacatatttagacacttcgc

SEQ ID NO: 129333 - DNA, 22 bp, Artificial Sequence
  Synthetic oligonucleotide; CTA chr11 5308488 5308509 5308493 5308488 -
tacatatttagacacttcgcag

SEQ ID NO: 129334 - DNA, 22 bp, Artificial Sequence
  Synthetic oligonucleotide; TTT chr11 5308479 5308500 5308484 5308479 -
agacacttcgcaggtatcaagt

SEQ ID NO: 129335 - DNA, 22 bp, Artificial Sequence
  Synthetic oligonucleotide; TTA chr11 5308478 5308499 5308483 5308478 -
gacacttcgcaggtatcaagtc

SEQ ID NO: 129336 - DNA, 22 bp, Artificial Sequence
  Synthetic oligonucleotide; CTT chr11 5308471 5308492 5308476 5308471 -
cgcaggtatcaagtcattacca

SEQ ID NO: 129337 - DNA, 22 bp, Artificial Sequence
  Synthetic oligonucleotide; TTC chr11 5308470 5308491 5308475 5308470 -
gcaggtatcaagtcattaccag

SEQ ID NO: 129338 - DNA, 22 bp, Artificial Sequence
  Synthetic oligonucleotide; TTA chr11 5308452 5308473 5308457 5308452 -
ccaggagcaccagcttagttgt

SEQ ID NO: 129339 - DNA, 22 bp, Artificial Sequence
  Synthetic oligonucleotide; CTT chr11 5308436 5308457 5308441 5308436 -
agttgtttcatcttctacaacc

SEQ ID NO: 129340 - DNA, 22 bp, Artificial Sequence
  Synthetic oligonucleotide; TTA chr11 5308435 5308456 5308440 5308435 -
gttgtttcatcttctacaacct

SEQ ID NO: 129341 - DNA, 22 bp, Artificial Sequence
  Synthetic oligonucleotide; TTG chr11 5308431 5308452 5308436 5308431 -
tttcatcttctacaacctcatt

SEQ ID NO: 129342 - DNA, 22 bp, Artificial Sequence
  Synthetic oligonucleotide; TTT chr11 5308428 5308449 5308433 5308428 -
catcttctacaacctcattaga

SEQ ID NO: 129343 - DNA, 22 bp, Artificial Sequence
  Synthetic oligonucleotide; TTC chr11 5308427 5308448 5308432 5308427 -
atcttctacaacctcattagat

SEQ ID NO: 129344 - DNA, 22 bp, Artificial Sequence
  Synthetic oligonucleotide; CTT chr11 5308422 5308443 5308427 5308422 -
ctacaacctcattagattgact

SEQ ID NO: 129345 - DNA, 22 bp, Artificial Sequence
  Synthetic oligonucleotide; TTC chr11 5308421 5308442 5308426 5308421 -
tacaacctcattagattgactg

SEQ ID NO: 129346 - DNA, 22 bp, Artificial Sequence
  Synthetic oligonucleotide; CTA chr11 5308419 5308440 5308424 5308419 -
caacctcattagattgactgac

SEQ ID NO: 129347 - DNA, 22 bp, Artificial Sequence
  Synthetic oligonucleotide; CTC chr11 5308412 5308433 5308417 5308412 -
attagattgactgactgtaact

SEQ ID NO: 129348 - DNA, 22 bp, Artificial Sequence
  Synthetic oligonucleotide; TTA chr11 5308408 5308429 5308413 5308408 -
gattgactgactgtaacttctt

SEQ ID NO: 129349 - DNA, 22 bp, Artificial Sequence
  Synthetic oligonucleotide; TTG chr11 5308403 5308424 5308408 5308403 -
actgactgtaacttctttcaac

SEQ ID NO: 129350 - DNA, 22 bp, Artificial Sequence
  Synthetic oligonucleotide; CTG chr11 5308399 5308420 5308404 5308399 -
actgtaacttctttcaacgtaa

SEQ ID NO: 129351 - DNA, 22 bp, Artificial Sequence
  Synthetic oligonucleotide; CTG chr11 5308395 5308416 5308400 5308395 -
taacttctttcaacgtaatctc

SEQ ID NO: 129352 - DNA, 22 bp, Artificial Sequence
  Synthetic oligonucleotide; CTT chr11 5308389 5308410 5308394 5308389 -
ctttcaacgtaatctccagaaa

SEQ ID NO: 129353 - DNA, 22 bp, Artificial Sequence
  Synthetic oligonucleotide; TTC chr11 5308388 5308409 5308393 5308388 -
tttcaacgtaatctccagaaaa

SEQ ID NO: 129354 - DNA, 22 bp, Artificial Sequence
  Synthetic oligonucleotide; CTT chr11 5308386 5308407 5308391 5308386 -
tcaacgtaatctccagaaaaca

SEQ ID NO: 129355 - DNA, 22 bp, Artificial Sequence
  Synthetic oligonucleotide; TTT chr11 5308385 5308406 5308390 5308385 -
caacgtaatctccagaaaacaa

SEQ ID NO: 129356 - DNA, 22 bp, Artificial Sequence
  Synthetic oligonucleotide; TTC chr11 5308384 5308405 5308389 5308384 -
aacgtaatctccagaaaacaag

SEQ ID NO: 129357 - DNA, 22 bp, Artificial Sequence
  Synthetic oligonucleotide; CTC chr11 5308373 5308394 5308378 5308373 -
cagaaaacaagttttactgcat

SEQ ID NO: 129358 - DNA, 22 bp, Artificial Sequence
  Synthetic oligonucleotide; TTT chr11 5308359 5308380 5308364 5308359 -
tactgcataccttcaaccttaa

SEQ ID NO: 129359 - DNA, 22 bp, Artificial Sequence
  Synthetic oligonucleotide; TTT chr11 5308358 5308379 5308363 5308358 -
actgcataccttcaaccttaaa

SEQ ID NO: 129360 - DNA, 22 bp, Artificial Sequence
  Synthetic oligonucleotide; TTA chr11 5308357 5308378 5308362 5308357 -
ctgcataccttcaaccttaaaa

SEQ ID NO: 129361 - DNA, 22 bp, Artificial Sequence
  Synthetic oligonucleotide; CTG chr11 5308354 5308375 5308359 5308354 -
cataccttcaaccttaaaatgt

SEQ ID NO: 129362 - DNA, 22 bp, Artificial Sequence
  Synthetic oligonucleotide; CTT chr11 5308346 5308367 5308351 5308346 -
caaccttaaaatgtctcctttc

SEQ ID NO: 129363 - DNA, 22 bp, Artificial Sequence
  Synthetic oligonucleotide; TTC chr11 5308345 5308366 5308350 5308345 -
aaccttaaaatgtctcctttca

SEQ ID NO: 129364 - DNA, 22 bp, Artificial Sequence
  Synthetic oligonucleotide; CTT chr11 5308339 5308360 5308344 5308339 -
aaaatgtctcctttcagccttg

SEQ ID NO: 129365 - DNA, 22 bp, Artificial Sequence
  Synthetic oligonucleotide; TTA chr11 5308338 5308359 5308343 5308338 -
aaatgtctcctttcagccttgt

SEQ ID NO: 129366 - DNA, 22 bp, Artificial Sequence
  Synthetic oligonucleotide; CTC chr11 5308329 5308350 5308334 5308329 -
ctttcagccttgtccctgtact

SEQ ID NO: 129367 - DNA, 22 bp, Artificial Sequence
  Synthetic oligonucleotide; CTT chr11 5308326 5308347 5308331 5308326 -
tcagccttgtccctgtactatt

SEQ ID NO: 129368 - DNA, 22 bp, Artificial Sequence
  Synthetic oligonucleotide; TTT chr11 5308325 5308346 5308330 5308325 -
cagccttgtccctgtactatta

SEQ ID NO: 129369 - DNA, 22 bp, Artificial Sequence
  Synthetic oligonucleotide; TTC chr11 5308324 5308345 5308329 5308324 -
agccttgtccctgtactattag

SEQ ID NO: 129370 - DNA, 22 bp, Artificial Sequence
  Synthetic oligonucleotide; CTT chr11 5308318 5308339 5308323 5308318 -
gtccctgtactattagtcctat

SEQ ID NO: 129371 - DNA, 22 bp, Artificial Sequence
  Synthetic oligonucleotide; TTG chr11 5308317 5308338 5308322 5308317 -
tccctgtactattagtcctatt

SEQ ID NO: 129372 - DNA, 22 bp, Artificial Sequence
  Synthetic oligonucleotide; CTG chr11 5308311 5308332 5308316 5308311 -
tactattagtcctatttgcctt

SEQ ID NO: 129373 - DNA, 22 bp, Artificial Sequence
  Synthetic oligonucleotide; CTA chr11 5308306 5308327 5308311 5308306 -
ttagtcctatttgccttgcata

SEQ ID NO: 129374 - DNA, 22 bp, Artificial Sequence
  Synthetic oligonucleotide; TTA chr11 5308303 5308324 5308308 5308303 -
gtcctatttgccttgcatagat

SEQ ID NO: 129375 - DNA, 22 bp, Artificial Sequence
  Synthetic oligonucleotide; CTA chr11 5308297 5308318 5308302 5308297 -
tttgccttgcatagatgtgaga

SEQ ID NO: 129376 - DNA, 22 bp, Artificial Sequence
  Synthetic oligonucleotide; TTT chr11 5308294 5308315 5308299 5308294 -
gccttgcatagatgtgagatgg

SEQ ID NO: 129377 - DNA, 22 bp, Artificial Sequence
  Synthetic oligonucleotide; TTG chr11 5308293 5308314 5308298 5308293 -
ccttgcatagatgtgagatggt

SEQ ID NO: 129378 - DNA, 22 bp, Artificial Sequence
  Synthetic oligonucleotide; CTT chr11 5308289 5308310 5308294 5308289 -
gcatagatgtgagatggtacac

SEQ ID NO: 129379 - DNA, 22 bp, Artificial Sequence
  Synthetic oligonucleotide; TTG chr11 5308288 5308309 5308293 5308288 -
catagatgtgagatggtacaca

SEQ ID NO: 129380 - DNA, 22 bp, Artificial Sequence
  Synthetic oligonucleotide; TTT chr11 5308259 5308280 5308264 5308259 -
cacttataattttctttctctt

SEQ ID NO: 129381 - DNA, 22 bp, Artificial Sequence
  Synthetic oligonucleotide; TTC chr11 5308258 5308279 5308263 5308258 -
acttataattttctttctcttc

SEQ ID NO: 129382 - DNA, 22 bp, Artificial Sequence
  Synthetic oligonucleotide; CTT chr11 5308254 5308275 5308259 5308254 -
ataattttctttctcttcctat

SEQ ID NO: 129383 - DNA, 22 bp, Artificial Sequence
  Synthetic oligonucleotide; TTA chr11 5308253 5308274 5308258 5308253 -
taattttctttctcttcctata

SEQ ID NO: 129384 - DNA, 22 bp, Artificial Sequence
  Synthetic oligonucleotide; TTT chr11 5308247 5308268 5308252 5308247 -
tctttctcttcctatatggtaa

SEQ ID NO: 129385 - DNA, 22 bp, Artificial Sequence
  Synthetic oligonucleotide; TTT chr11 5308246 5308267 5308251 5308246 -
ctttctcttcctatatggtaac

SEQ ID NO: 129386 - DNA, 22 bp, Artificial Sequence
  Synthetic oligonucleotide; TTC chr11 5308245 5308266 5308250 5308245 -
tttctcttcctatatggtaaca

SEQ ID NO: 129387 - DNA, 22 bp, Artificial Sequence
  Synthetic oligonucleotide; CTT chr11 5308243 5308264 5308248 5308243 -
tctcttcctatatggtaacata

SEQ ID NO: 129388 - DNA, 22 bp, Artificial Sequence
  Synthetic oligonucleotide; TTT chr11 5308242 5308263 5308247 5308242 -
ctcttcctatatggtaacataa

SEQ ID NO: 129389 - DNA, 22 bp, Artificial Sequence
  Synthetic oligonucleotide; TTC chr11 5308241 5308262 5308246 5308241 -
tcttcctatatggtaacataac

SEQ ID NO: 129390 - DNA, 22 bp, Artificial Sequence
  Synthetic oligonucleotide; CTC chr11 5308239 5308260 5308244 5308239 -
ttcctatatggtaacataactg

SEQ ID NO: 129391 - DNA, 22 bp, Artificial Sequence
  Synthetic oligonucleotide; CTT chr11 5308237 5308258 5308242 5308237 -
cctatatggtaacataactgat

SEQ ID NO: 129392 - DNA, 22 bp, Artificial Sequence
  Synthetic oligonucleotide; TTC chr11 5308236 5308257 5308241 5308236 -
ctatatggtaacataactgata

SEQ ID NO: 129393 - DNA, 22 bp, Artificial Sequence
  Synthetic oligonucleotide; CTA chr11 5308233 5308254 5308238 5308233 -
tatggtaacataactgataaga

SEQ ID NO: 129394 - DNA, 22 bp, Artificial Sequence
  Synthetic oligonucleotide; CTG chr11 5308217 5308238 5308222 5308217 -
ataagacacaaagaagataaaa

SEQ ID NO: 129395 - DNA, 22 bp, Artificial Sequence
  Synthetic oligonucleotide; CTG chr11 5308178 5308199 5308183 5308178 -
atatattattgttggggtacag

SEQ ID NO: 129396 - DNA, 22 bp, Artificial Sequence
  Synthetic oligonucleotide; TTA chr11 5308170 5308191 5308175 5308170 -
ttgttggggtacagttctttat

SEQ ID NO: 129397 - DNA, 22 bp, Artificial Sequence
  Synthetic oligonucleotide; TTG chr11 5308167 5308188 5308172 5308167 -
ttggggtacagttctttattga

SEQ ID NO: 129398 - DNA, 22 bp, Artificial Sequence
  Synthetic oligonucleotide; TTG chr11 5308164 5308185 5308169 5308164 -
gggtacagttctttattgagaa

SEQ ID NO: 129399 - DNA, 22 bp, Artificial Sequence
  Synthetic oligonucleotide; TTC chr11 5308153 5308174 5308158 5308153 -
tttattgagaataagagtttct

SEQ ID NO: 129400 - DNA, 22 bp, Artificial Sequence
  Synthetic oligonucleotide; CTT chr11 5308151 5308172 5308156 5308151 -
tattgagaataagagtttcttt

SEQ ID NO: 129401 - DNA, 22 bp, Artificial Sequence
  Synthetic oligonucleotide; TTT chr11 5308150 5308171 5308155 5308150 -
attgagaataagagtttctttt

SEQ ID NO: 129402 - DNA, 22 bp, Artificial Sequence
  Synthetic oligonucleotide; TTA chr11 5308149 5308170 5308154 5308149 -
ttgagaataagagtttcttttc

SEQ ID NO: 129403 - DNA, 22 bp, Artificial Sequence
  Synthetic oligonucleotide; TTG chr11 5308146 5308167 5308151 5308146 -
agaataagagtttcttttcatg

SEQ ID NO: 129404 - DNA, 22 bp, Artificial Sequence
  Synthetic oligonucleotide; TTT chr11 5308133 5308154 5308138 5308133 -
cttttcatgtattggtctagct

SEQ ID NO: 129405 - DNA, 22 bp, Artificial Sequence
  Synthetic oligonucleotide; TTC chr11 5308132 5308153 5308137 5308132 -
ttttcatgtattggtctagcta

SEQ ID NO: 129406 - DNA, 22 bp, Artificial Sequence
  Synthetic oligonucleotide; CTT chr11 5308130 5308151 5308135 5308130 -
ttcatgtattggtctagctatt

SEQ ID NO: 129407 - DNA, 22 bp, Artificial Sequence
  Synthetic oligonucleotide; TTT chr11 5308129 5308150 5308134 5308129 -
tcatgtattggtctagctattt

SEQ ID NO: 129408 - DNA, 22 bp, Artificial Sequence
  Synthetic oligonucleotide; TTT chr11 5308128 5308149 5308133 5308128 -
catgtattggtctagctattta

SEQ ID NO: 129409 - DNA, 22 bp, Artificial Sequence
  Synthetic oligonucleotide; TTC chr11 5308127 5308148 5308132 5308127 -
atgtattggtctagctatttag

SEQ ID NO: 129410 - DNA, 22 bp, Artificial Sequence
  Synthetic oligonucleotide; TTG chr11 5308119 5308140 5308124 5308119 -
gtctagctatttagtagtatag

SEQ ID NO: 129411 - DNA, 22 bp, Artificial Sequence
  Synthetic oligonucleotide; CTA chr11 5308114 5308135 5308119 5308114 -
gctatttagtagtatagataga

SEQ ID NO: 129412 - DNA, 22 bp, Artificial Sequence
  Synthetic oligonucleotide; CTA chr11 5308110 5308131 5308115 5308110 -
tttagtagtatagatagatcac

SEQ ID NO: 129413 - DNA, 22 bp, Artificial Sequence
  Synthetic oligonucleotide; TTT chr11 5308107 5308128 5308112 5308107 -
agtagtatagatagatcacagg

SEQ ID NO: 129414 - DNA, 22 bp, Artificial Sequence
  Synthetic oligonucleotide; TTA chr11 5308106 5308127 5308111 5308106 -
gtagtatagatagatcacagga

SEQ ID NO: 129415 - DNA, 22 bp, Artificial Sequence
  Synthetic oligonucleotide; TTG chr11 5308079 5308100 5308084 5308079 -
tagacttggtgtatttagacat

SEQ ID NO: 129416 - DNA, 22 bp, Artificial Sequence
  Synthetic oligonucleotide; CTT chr11 5308072 5308093 5308077 5308072 -
ggtgtatttagacatcaacaaa

SEQ ID NO: 129417 - DNA, 22 bp, Artificial Sequence
  Synthetic oligonucleotide; TTG chr11 5308071 5308092 5308076 5308071 -
gtgtatttagacatcaacaaaa

SEQ ID NO: 129418 - DNA, 22 bp, Artificial Sequence
  Synthetic oligonucleotide; TTT chr11 5308063 5308084 5308068 5308063 -
agacatcaacaaaaacattttc

SEQ ID NO: 129419 - DNA, 22 bp, Artificial Sequence
  Synthetic oligonucleotide; TTA chr11 5308062 5308083 5308067 5308062 -
gacatcaacaaaaacattttca

SEQ ID NO: 129420 - DNA, 22 bp, Artificial Sequence
  Synthetic oligonucleotide; TTT chr11 5308043 5308064 5308048 5308043 -
tcaaagtagtcttttcattgga

SEQ ID NO: 129421 - DNA, 22 bp, Artificial Sequence
  Synthetic oligonucleotide; TTT chr11 5308042 5308063 5308047 5308042 -
caaagtagtcttttcattggaa

SEQ ID NO: 129422 - DNA, 22 bp, Artificial Sequence
  Synthetic oligonucleotide; TTC chr11 5308041 5308062 5308046 5308041 -
aaagtagtcttttcattggaat

SEQ ID NO: 129423 - DNA, 22 bp, Artificial Sequence
  Synthetic oligonucleotide; CTT chr11 5308030 5308051 5308035 5308030 -
ttcattggaatgggagaatata

SEQ ID NO: 129424 - DNA, 22 bp, Artificial Sequence
  Synthetic oligonucleotide; TTT chr11 5308029 5308050 5308034 5308029 -
tcattggaatgggagaatataa

SEQ ID NO: 129425 - DNA, 22 bp, Artificial Sequence
  Synthetic oligonucleotide; TTT chr11 5308028 5308049 5308033 5308028 -
cattggaatgggagaatataag

SEQ ID NO: 129426 - DNA, 22 bp, Artificial Sequence
  Synthetic oligonucleotide; TTC chr11 5308027 5308048 5308032 5308027 -
attggaatgggagaatataagt

SEQ ID NO: 129427 - DNA, 22 bp, Artificial Sequence
  Synthetic oligonucleotide; TTG chr11 5308023 5308044 5308028 5308023 -
gaatgggagaatataagttcca

SEQ ID NO: 129428 - DNA, 22 bp, Artificial Sequence
  Synthetic oligonucleotide; TTC chr11 5308003 5308024 5308008 5308003 -
cataagtggttaaaacatctta

SEQ ID NO: 129429 - DNA, 22 bp, Artificial Sequence
  Synthetic oligonucleotide; TTA chr11 5307991 5308012 5307996 5307991 -
aaacatcttaccttgagactca

SEQ ID NO: 129430 - DNA, 22 bp, Artificial Sequence
  Synthetic oligonucleotide; CTT chr11 5307982 5308003 5307987 5307982 -
accttgagactcacttgcagcc

SEQ ID NO: 129431 - DNA, 22 bp, Artificial Sequence
  Synthetic oligonucleotide; TTA chr11 5307981 5308002 5307986 5307981 -
ccttgagactcacttgcagcca

SEQ ID NO: 129432 - DNA, 22 bp, Artificial Sequence
  Synthetic oligonucleotide; CTT chr11 5307977 5307998 5307982 5307977 -
gagactcacttgcagccaaagt

SEQ ID NO: 129433 - DNA, 22 bp, Artificial Sequence
  Synthetic oligonucleotide; TTG chr11 5307976 5307997 5307981 5307976 -
agactcacttgcagccaaagta

SEQ ID NO: 129434 - DNA, 22 bp, Artificial Sequence
  Synthetic oligonucleotide; CTC chr11 5307970 5307991 5307975 5307970 -
acttgcagccaaagtactaaga

SEQ ID NO: 129435 - DNA, 22 bp, Artificial Sequence
  Synthetic oligonucleotide; CTT chr11 5307966 5307987 5307971 5307966 -
gcagccaaagtactaagaagga

SEQ ID NO: 129436 - DNA, 22 bp, Artificial Sequence
  Synthetic oligonucleotide; TTG chr11 5307965 5307986 5307970 5307965 -
cagccaaagtactaagaaggaa

SEQ ID NO: 129437 - DNA, 22 bp, Artificial Sequence
  Synthetic oligonucleotide; CTA chr11 5307951 5307972 5307956 5307951 -
agaaggaaaaaaacacataaat

SEQ ID NO: 129438 - DNA, 22 bp, Artificial Sequence
  Synthetic oligonucleotide; CTC chr11 5307924 5307945 5307929 5307924 -
ttctcatgtggtcacagctatt

SEQ ID NO: 129439 - DNA, 22 bp, Artificial Sequence
  Synthetic oligonucleotide; CTT chr11 5307922 5307943 5307927 5307922 -
ctcatgtggtcacagctatttg

SEQ ID NO: 129440 - DNA, 22 bp, Artificial Sequence
  Synthetic oligonucleotide; TTC chr11 5307921 5307942 5307926 5307921 -
tcatgtggtcacagctatttgg

SEQ ID NO: 129441 - DNA, 22 bp, Artificial Sequence
  Synthetic oligonucleotide; CTC chr11 5307919 5307940 5307924 5307919 -
atgtggtcacagctatttggga

SEQ ID NO: 129442 - DNA, 22 bp, Artificial Sequence
  Synthetic oligonucleotide; CTA chr11 5307904 5307925 5307909 5307904 -
tttgggaggctgaggtgtaaaa

SEQ ID NO: 129443 - DNA, 22 bp, Artificial Sequence
  Synthetic oligonucleotide; TTT chr11 5307901 5307922 5307906 5307901 -
gggaggctgaggtgtaaaaatc

SEQ ID NO: 129444 - DNA, 22 bp, Artificial Sequence
  Synthetic oligonucleotide; TTG chr11 5307900 5307921 5307905 5307900 -
ggaggctgaggtgtaaaaatca

SEQ ID NO: 129445 - DNA, 22 bp, Artificial Sequence
  Synthetic oligonucleotide; CTG chr11 5307892 5307913 5307897 5307892 -
aggtgtaaaaatcacttaagcc

SEQ ID NO: 129446 - DNA, 22 bp, Artificial Sequence
  Synthetic oligonucleotide; CTT chr11 5307875 5307896 5307880 5307875 -
aagcctaaaagcttgaggctgc

SEQ ID NO: 129447 - DNA, 22 bp, Artificial Sequence
  Synthetic oligonucleotide; TTA chr11 5307874 5307895 5307879 5307874 -
agcctaaaagcttgaggctgca

SEQ ID NO: 129448 - DNA, 22 bp, Artificial Sequence
  Synthetic oligonucleotide; CTA chr11 5307868 5307889 5307873 5307868 -
aaagcttgaggctgcagtaaac

SEQ ID NO: 129449 - DNA, 22 bp, Artificial Sequence
  Synthetic oligonucleotide; CTT chr11 5307861 5307882 5307866 5307861 -
gaggctgcagtaaactatgatc

SEQ ID NO: 129450 - DNA, 22 bp, Artificial Sequence
  Synthetic oligonucleotide; TTG chr11 5307860 5307881 5307865 5307860 -
aggctgcagtaaactatgatct

SEQ ID NO: 129451 - DNA, 22 bp, Artificial Sequence
  Synthetic oligonucleotide; CTG chr11 5307854 5307875 5307859 5307854 -
cagtaaactatgatctcaccac

SEQ ID NO: 129452 - DNA, 22 bp, Artificial Sequence
  Synthetic oligonucleotide; CTA chr11 5307844 5307865 5307849 5307844 -
tgatctcaccactgcactccct

SEQ ID NO: 129453 - DNA, 22 bp, Artificial Sequence
  Synthetic oligonucleotide; CTC chr11 5307837 5307858 5307842 5307837 -
accactgcactccctcctgggt

SEQ ID NO: 129454 - DNA, 22 bp, Artificial Sequence
  Synthetic oligonucleotide; CTG chr11 5307830 5307851 5307835 5307830 -
cactccctcctgggtgacagag

SEQ ID NO: 129455 - DNA, 22 bp, Artificial Sequence
  Synthetic oligonucleotide; CTC chr11 5307825 5307846 5307830 5307825 -
cctcctgggtgacagagcaaga

SEQ ID NO: 129456 - DNA, 22 bp, Artificial Sequence
  Synthetic oligonucleotide; CTC chr11 5307821 5307842 5307826 5307821 -
ctgggtgacagagcaagacact

SEQ ID NO: 129457 - DNA, 22 bp, Artificial Sequence
  Synthetic oligonucleotide; CTG chr11 5307818 5307839 5307823 5307818 -
ggtgacagagcaagacactgtc

SEQ ID NO: 129458 - DNA, 22 bp, Artificial Sequence
  Synthetic oligonucleotide; CTG chr11 5307798 5307819 5307803 5307798 -
tctcaaaagagaggaaagaaaa

SEQ ID NO: 129459 - DNA, 22 bp, Artificial Sequence
  Synthetic oligonucleotide; CTC chr11 5307794 5307815 5307799 5307794 -
aaaagagaggaaagaaaagaaa

SEQ ID NO: 129460 - DNA, 22 bp, Artificial Sequence
  Synthetic oligonucleotide; CTT chr11 5307601 5307622 5307606 5307601 -
caaaaaatctttcttcttgatg

SEQ ID NO: 129461 - DNA, 22 bp, Artificial Sequence
  Synthetic oligonucleotide; TTC chr11 5307600 5307621 5307605 5307600 -
aaaaaatctttcttcttgatgt

SEQ ID NO: 129462 - DNA, 22 bp, Artificial Sequence
  Synthetic oligonucleotide; CTT chr11 5307590 5307611 5307595 5307590 -
tcttcttgatgttgttatggat

SEQ ID NO: 129463 - DNA, 22 bp, Artificial Sequence
  Synthetic oligonucleotide; TTT chr11 5307589 5307610 5307594 5307589 -
cttcttgatgttgttatggatt

SEQ ID NO: 129464 - DNA, 22 bp, Artificial Sequence
  Synthetic oligonucleotide; TTC chr11 5307588 5307609 5307593 5307588 -
ttcttgatgttgttatggattt

SEQ ID NO: 129465 - DNA, 22 bp, Artificial Sequence
  Synthetic oligonucleotide; CTT chr11 5307586 5307607 5307591 5307586 -
cttgatgttgttatggattttt

SEQ ID NO: 129466 - DNA, 22 bp, Artificial Sequence
  Synthetic oligonucleotide; TTC chr11 5307585 5307606 5307590 5307585 -
ttgatgttgttatggatttttc

SEQ ID NO: 129467 - DNA, 22 bp, Artificial Sequence
  Synthetic oligonucleotide; CTT chr11 5307583 5307604 5307588 5307583 -
gatgttgttatggatttttctc

SEQ ID NO: 129468 - DNA, 22 bp, Artificial Sequence
  Synthetic oligonucleotide; TTG chr11 5307582 5307603 5307587 5307582 -
atgttgttatggatttttctct

SEQ ID NO: 129469 - DNA, 22 bp, Artificial Sequence
  Synthetic oligonucleotide; TTG chr11 5307576 5307597 5307581 5307576 -
ttatggatttttctctgaacca

SEQ ID NO: 129470 - DNA, 22 bp, Artificial Sequence
  Synthetic oligonucleotide; TTA chr11 5307573 5307594 5307578 5307573 -
tggatttttctctgaaccatga

SEQ ID NO: 129471 - DNA, 22 bp, Artificial Sequence
  Synthetic oligonucleotide; TTT chr11 5307566 5307587 5307571 5307566 -
ttctctgaaccatgattgatgt

SEQ ID NO: 129472 - DNA, 22 bp, Artificial Sequence
  Synthetic oligonucleotide; TTT chr11 5307565 5307586 5307570 5307565 -
tctctgaaccatgattgatgta

SEQ ID NO: 129473 - DNA, 22 bp, Artificial Sequence
  Synthetic oligonucleotide; TTT chr11 5307564 5307585 5307569 5307564 -
ctctgaaccatgattgatgtaa

SEQ ID NO: 129474 - DNA, 22 bp, Artificial Sequence
  Synthetic oligonucleotide; TTC chr11 5307563 5307584 5307568 5307563 -
tctgaaccatgattgatgtaaa

SEQ ID NO: 129475 - DNA, 22 bp, Artificial Sequence
  Synthetic oligonucleotide; CTC chr11 5307561 5307582 5307566 5307561 -
tgaaccatgattgatgtaaaaa

SEQ ID NO: 129476 - DNA, 22 bp, Artificial Sequence
  Synthetic oligonucleotide; CTG chr11 5307559 5307580 5307564 5307559 -
aaccatgattgatgtaaaaatt

SEQ ID NO: 129477 - DNA, 22 bp, Artificial Sequence
  Synthetic oligonucleotide; TTG chr11 5307548 5307569 5307553 5307548 -
atgtaaaaattagagacatcga

SEQ ID NO: 129478 - DNA, 22 bp, Artificial Sequence
  Synthetic oligonucleotide; TTA chr11 5307536 5307557 5307541 5307536 -
gagacatcgaagtactaaacaa

SEQ ID NO: 129479 - DNA, 22 bp, Artificial Sequence
  Synthetic oligonucleotide; CTA chr11 5307519 5307540 5307524 5307519 -
aacaataaagaaaaggagatag

SEQ ID NO: 129480 - DNA, 22 bp, Artificial Sequence
  Synthetic oligonucleotide; TTG chr11 5307492 5307513 5307497 5307492 -
tttggcatgcttgaactagtaa

SEQ ID NO: 129481 - DNA, 22 bp, Artificial Sequence
  Synthetic oligonucleotide; TTT chr11 5307489 5307510 5307494 5307489 -
ggcatgcttgaactagtaatct

SEQ ID NO: 129482 - DNA, 22 bp, Artificial Sequence
  Synthetic oligonucleotide; TTG chr11 5307488 5307509 5307493 5307488 -
gcatgcttgaactagtaatctt

SEQ ID NO: 129483 - DNA, 22 bp, Artificial Sequence
  Synthetic oligonucleotide; CTT chr11 5307480 5307501 5307485 5307480 -
gaactagtaatcttattacaaa

SEQ ID NO: 129484 - DNA, 22 bp, Artificial Sequence
  Synthetic oligonucleotide; TTG chr11 5307479 5307500 5307484 5307479 -
aactagtaatcttattacaaac

SEQ ID NO: 129485 - DNA, 22 bp, Artificial Sequence
  Synthetic oligonucleotide; CTA chr11 5307474 5307495 5307479 5307474 -
gtaatcttattacaaacagatg

SEQ ID NO: 129486 - DNA, 22 bp, Artificial Sequence
  Synthetic oligonucleotide; CTT chr11 5307466 5307487 5307471 5307466 -
attacaaacagatgtagaggtt

SEQ ID NO: 129487 - DNA, 22 bp, Artificial Sequence
  Synthetic oligonucleotide; TTA chr11 5307465 5307486 5307470 5307465 -
ttacaaacagatgtagaggttg

SEQ ID NO: 129488 - DNA, 22 bp, Artificial Sequence
  Synthetic oligonucleotide; TTA chr11 5307462 5307483 5307467 5307462 -
caaacagatgtagaggttgtaa

SEQ ID NO: 129489 - DNA, 22 bp, Artificial Sequence
  Synthetic oligonucleotide; TTG chr11 5307443 5307464 5307448 5307443 -
taaaggtctacaatttggctac

SEQ ID NO: 129490 - DNA, 22 bp, Artificial Sequence
  Synthetic oligonucleotide; CTA chr11 5307433 5307454 5307438 5307433 -
caatttggctacaaaaccaatg

SEQ ID NO: 129491 - DNA, 22 bp, Artificial Sequence
  Synthetic oligonucleotide; TTT chr11 5307427 5307448 5307432 5307427 -
ggctacaaaaccaatggcttga

SEQ ID NO: 129492 - DNA, 22 bp, Artificial Sequence
  Synthetic oligonucleotide; TTG chr11 5307426 5307447 5307431 5307426 -
gctacaaaaccaatggcttgat

SEQ ID NO: 129493 - DNA, 22 bp, Artificial Sequence
  Synthetic oligonucleotide; CTA chr11 5307422 5307443 5307427 5307422 -
caaaaccaatggcttgatcaca

SEQ ID NO: 129494 - DNA, 22 bp, Artificial Sequence
  Synthetic oligonucleotide; CTT chr11 5307407 5307428 5307412 5307407 -
gatcacaagaatagcattcatt

SEQ ID NO: 129495 - DNA, 22 bp, Artificial Sequence
  Synthetic oligonucleotide; TTG chr11 5307406 5307427 5307411 5307406 -
atcacaagaatagcattcattt

SEQ ID NO: 129496 - DNA, 22 bp, Artificial Sequence
  Synthetic oligonucleotide; TTC chr11 5307388 5307409 5307393 5307388 -
atttgcttaactagtacttact

SEQ ID NO: 129497 - DNA, 22 bp, Artificial Sequence
  Synthetic oligonucleotide; TTT chr11 5307384 5307405 5307389 5307384 -
gcttaactagtacttactgagc

SEQ ID NO: 129498 - DNA, 22 bp, Artificial Sequence
  Synthetic oligonucleotide; TTG chr11 5307383 5307404 5307388 5307383 -
cttaactagtacttactgagca

SEQ ID NO: 129499 - DNA, 22 bp, Artificial Sequence
  Synthetic oligonucleotide; CTT chr11 5307380 5307401 5307385 5307380 -
aactagtacttactgagcaccc

SEQ ID NO: 129500 - DNA, 22 bp, Artificial Sequence
  Synthetic oligonucleotide; TTA chr11 5307379 5307400 5307384 5307379 -
actagtacttactgagcaccca

SEQ ID NO: 129501 - DNA, 22 bp, Artificial Sequence
  Synthetic oligonucleotide; CTA chr11 5307375 5307396 5307380 5307375 -
gtacttactgagcacccactat

SEQ ID NO: 129502 - DNA, 22 bp, Artificial Sequence
  Synthetic oligonucleotide; CTT chr11 5307369 5307390 5307374 5307369 -
actgagcacccactatatgtta

SEQ ID NO: 129503 - DNA, 22 bp, Artificial Sequence
  Synthetic oligonucleotide; TTA chr11 5307368 5307389 5307373 5307368 -
ctgagcacccactatatgttaa

SEQ ID NO: 129504 - DNA, 22 bp, Artificial Sequence
  Synthetic oligonucleotide; CTG chr11 5307365 5307386 5307370 5307365 -
agcacccactatatgttaagct

SEQ ID NO: 129505 - DNA, 22 bp, Artificial Sequence
  Synthetic oligonucleotide; CTA chr11 5307354 5307375 5307359 5307354 -
tatgttaagctccattttaagc

SEQ ID NO: 129506 - DNA, 22 bp, Artificial Sequence
  Synthetic oligonucleotide; TTA chr11 5307347 5307368 5307352 5307347 -
agctccattttaagcactgaaa

SEQ ID NO: 129507 - DNA, 22 bp, Artificial Sequence
  Synthetic oligonucleotide; CTC chr11 5307342 5307363 5307347 5307342 -
cattttaagcactgaaaatgtc

SEQ ID NO: 129508 - DNA, 22 bp, Artificial Sequence
  Synthetic oligonucleotide; TTT chr11 5307337 5307358 5307342 5307337 -
taagcactgaaaatgtcactca

SEQ ID NO: 129509 - DNA, 22 bp, Artificial Sequence
  Synthetic oligonucleotide; TTT chr11 5307336 5307357 5307341 5307336 -
aagcactgaaaatgtcactcac

SEQ ID NO: 129510 - DNA, 22 bp, Artificial Sequence
  Synthetic oligonucleotide; TTA chr11 5307335 5307356 5307340 5307335 -
agcactgaaaatgtcactcact

SEQ ID NO: 129511 - DNA, 22 bp, Artificial Sequence
  Synthetic oligonucleotide; CTG chr11 5307328 5307349 5307333 5307328 -
aaaatgtcactcacttaaaatc

SEQ ID NO: 129512 - DNA, 22 bp, Artificial Sequence
  Synthetic oligonucleotide; CTC chr11 5307316 5307337 5307321 5307316 -
acttaaaatctttcagaagttt

SEQ ID NO: 129513 - DNA, 22 bp, Artificial Sequence
  Synthetic oligonucleotide; CTT chr11 5307312 5307333 5307317 5307312 -
aaaatctttcagaagttttgtt

SEQ ID NO: 129514 - DNA, 22 bp, Artificial Sequence
  Synthetic oligonucleotide; TTA chr11 5307311 5307332 5307316 5307311 -
aaatctttcagaagttttgttt

SEQ ID NO: 129515 - DNA, 22 bp, Artificial Sequence
  Synthetic oligonucleotide; CTT chr11 5307304 5307325 5307309 5307304 -
tcagaagttttgttttactgtg

SEQ ID NO: 129516 - DNA, 22 bp, Artificial Sequence
  Synthetic oligonucleotide; TTT chr11 5307303 5307324 5307308 5307303 -
cagaagttttgttttactgtga

SEQ ID NO: 129517 - DNA, 22 bp, Artificial Sequence
  Synthetic oligonucleotide; TTC chr11 5307302 5307323 5307307 5307302 -
agaagttttgttttactgtgag

SEQ ID NO: 129518 - DNA, 22 bp, Artificial Sequence
  Synthetic oligonucleotide; TTT chr11 5307294 5307315 5307299 5307294 -
tgttttactgtgagtacaaaga

SEQ ID NO: 129519 - DNA, 22 bp, Artificial Sequence
  Synthetic oligonucleotide; TTT chr11 5307293 5307314 5307298 5307293 -
gttttactgtgagtacaaagag

SEQ ID NO: 129520 - DNA, 22 bp, Artificial Sequence
  Synthetic oligonucleotide; TTG chr11 5307292 5307313 5307297 5307292 -
ttttactgtgagtacaaagaga

SEQ ID NO: 129521 - DNA, 22 bp, Artificial Sequence
  Synthetic oligonucleotide; TTT chr11 5307289 5307310 5307294 5307289 -
tactgtgagtacaaagagaact

SEQ ID NO: 129522 - DNA, 22 bp, Artificial Sequence
  Synthetic oligonucleotide; TTT chr11 5307288 5307309 5307293 5307288 -
actgtgagtacaaagagaactg

SEQ ID NO: 129523 - DNA, 22 bp, Artificial Sequence
  Synthetic oligonucleotide; TTA chr11 5307287 5307308 5307292 5307287 -
ctgtgagtacaaagagaactga

SEQ ID NO: 129524 - DNA, 22 bp, Artificial Sequence
  Synthetic oligonucleotide; CTG chr11 5307284 5307305 5307289 5307284 -
tgagtacaaagagaactgactt

SEQ ID NO: 129525 - DNA, 22 bp, Artificial Sequence
  Synthetic oligonucleotide; CTG chr11 5307266 5307287 5307271 5307266 -
actttatgatatggttatttac

SEQ ID NO: 129526 - DNA, 22 bp, Artificial Sequence
  Synthetic oligonucleotide; CTT chr11 5307262 5307283 5307267 5307262 -
tatgatatggttatttaccaag

SEQ ID NO: 129527 - DNA, 22 bp, Artificial Sequence
  Synthetic oligonucleotide; TTT chr11 5307261 5307282 5307266 5307261 -
atgatatggttatttaccaagc

SEQ ID NO: 129528 - DNA, 22 bp, Artificial Sequence
  Synthetic oligonucleotide; TTA chr11 5307260 5307281 5307265 5307260 -
tgatatggttatttaccaagcc

SEQ ID NO: 129529 - DNA, 22 bp, Artificial Sequence
  Synthetic oligonucleotide; TTA chr11 5307249 5307270 5307254 5307249 -
tttaccaagccgtcacttctta

SEQ ID NO: 129530 - DNA, 22 bp, Artificial Sequence
  Synthetic oligonucleotide; TTT chr11 5307246 5307267 5307251 5307246 -
accaagccgtcacttcttagct

SEQ ID NO: 129531 - DNA, 22 bp, Artificial Sequence
  Synthetic oligonucleotide; TTA chr11 5307245 5307266 5307250 5307245 -
ccaagccgtcacttcttagcta

SEQ ID NO: 129532 - DNA, 22 bp, Artificial Sequence
  Synthetic oligonucleotide; CTT chr11 5307231 5307252 5307236 5307231 -
cttagctacaagtctagaatca

SEQ ID NO: 129533 - DNA, 22 bp, Artificial Sequence
  Synthetic oligonucleotide; TTC chr11 5307230 5307251 5307235 5307230 -
ttagctacaagtctagaatcaa

SEQ ID NO: 129534 - DNA, 22 bp, Artificial Sequence
  Synthetic oligonucleotide; CTT chr11 5307228 5307249 5307233 5307228 -
agctacaagtctagaatcaaca

SEQ ID NO: 129535 - DNA, 22 bp, Artificial Sequence
  Synthetic oligonucleotide; TTA chr11 5307227 5307248 5307232 5307227 -
gctacaagtctagaatcaacag

SEQ ID NO: 129536 - DNA, 22 bp, Artificial Sequence
  Synthetic oligonucleotide; CTA chr11 5307223 5307244 5307228 5307223 -
caagtctagaatcaacaggttc

SEQ ID NO: 129537 - DNA, 22 bp, Artificial Sequence
  Synthetic oligonucleotide; CTA chr11 5307215 5307236 5307220 5307215 -
gaatcaacaggttctgcaaaat

SEQ ID NO: 129538 - DNA, 22 bp, Artificial Sequence
  Synthetic oligonucleotide; TTC chr11 5307201 5307222 5307206 5307201 -
tgcaaaatgaattctggaatgc

SEQ ID NO: 129539 - DNA, 22 bp, Artificial Sequence
  Synthetic oligonucleotide; CTG chr11 5307199 5307220 5307204 5307199 -
caaaatgaattctggaatgcat

SEQ ID NO: 129540 - DNA, 22 bp, Artificial Sequence
  Synthetic oligonucleotide; TTC chr11 5307187 5307208 5307192 5307187 -
tggaatgcatttattgctgtat

SEQ ID NO: 129541 - DNA, 22 bp, Artificial Sequence
  Synthetic oligonucleotide; CTG chr11 5307185 5307206 5307190 5307185 -
gaatgcatttattgctgtatga

SEQ ID NO: 129542 - DNA, 22 bp, Artificial Sequence
  Synthetic oligonucleotide; TTT chr11 5307175 5307196 5307180 5307175 -
attgctgtatgacctaaaatca

SEQ ID NO: 129543 - DNA, 22 bp, Artificial Sequence
  Synthetic oligonucleotide; TTA chr11 5307174 5307195 5307179 5307174 -
ttgctgtatgacctaaaatcac

SEQ ID NO: 129544 - DNA, 22 bp, Artificial Sequence
  Synthetic oligonucleotide; TTG chr11 5307171 5307192 5307176 5307171 -
ctgtatgacctaaaatcacgtt

SEQ ID NO: 129545 - DNA, 22 bp, Artificial Sequence
  Synthetic oligonucleotide; CTG chr11 5307168 5307189 5307173 5307168 -
tatgacctaaaatcacgttttg

SEQ ID NO: 129546 - DNA, 22 bp, Artificial Sequence
  Synthetic oligonucleotide; CTA chr11 5307159 5307180 5307164 5307159 -
aaatcacgttttggcaaaatct

SEQ ID NO: 129547 - DNA, 22 bp, Artificial Sequence
  Synthetic oligonucleotide; TTT chr11 5307148 5307169 5307153 5307148 -
tggcaaaatcttacctgaatat

SEQ ID NO: 129548 - DNA, 22 bp, Artificial Sequence
  Synthetic oligonucleotide; TTT chr11 5307147 5307168 5307152 5307147 -
ggcaaaatcttacctgaatata

SEQ ID NO: 129549 - DNA, 22 bp, Artificial Sequence
  Synthetic oligonucleotide; TTG chr11 5307146 5307167 5307151 5307146 -
gcaaaatcttacctgaatatat

SEQ ID NO: 129550 - DNA, 22 bp, Artificial Sequence
  Synthetic oligonucleotide; CTT chr11 5307136 5307157 5307141 5307136 -
acctgaatatatgagaggatat

SEQ ID NO: 129551 - DNA, 22 bp, Artificial Sequence
  Synthetic oligonucleotide; TTA chr11 5307135 5307156 5307140 5307135 -
cctgaatatatgagaggatatt

SEQ ID NO: 129552 - DNA, 22 bp, Artificial Sequence
  Synthetic oligonucleotide; CTG chr11 5307131 5307152 5307136 5307131 -
aatatatgagaggatatttagg

SEQ ID NO: 129553 - DNA, 22 bp, Artificial Sequence
  Synthetic oligonucleotide; TTT chr11 5307112 5307133 5307117 5307112 -
aggtttttttcccctaagtata

SEQ ID NO: 129554 - DNA, 22 bp, Artificial Sequence
  Synthetic oligonucleotide; TTA chr11 5307111 5307132 5307116 5307111 -
ggtttttttcccctaagtataa

SEQ ID NO: 129555 - DNA, 22 bp, Artificial Sequence
  Synthetic oligonucleotide; TTT chr11 5307106 5307127 5307111 5307106 -
ttttcccctaagtataaacagg

SEQ ID NO: 129556 - DNA, 22 bp, Artificial Sequence
  Synthetic oligonucleotide; TTT chr11 5307105 5307126 5307110 5307105 -
tttcccctaagtataaacaggt

SEQ ID NO: 129557 - DNA, 22 bp, Artificial Sequence
  Synthetic oligonucleotide; TTT chr11 5307104 5307125 5307109 5307104 -
ttcccctaagtataaacaggtg

SEQ ID NO: 129558 - DNA, 22 bp, Artificial Sequence
  Synthetic oligonucleotide; TTT chr11 5307103 5307124 5307108 5307103 -
tcccctaagtataaacaggtga

SEQ ID NO: 129559 - DNA, 22 bp, Artificial Sequence
  Synthetic oligonucleotide; TTT chr11 5307102 5307123 5307107 5307102 -
cccctaagtataaacaggtgat

SEQ ID NO: 129560 - DNA, 22 bp, Artificial Sequence
  Synthetic oligonucleotide; TTC chr11 5307101 5307122 5307106 5307101 -
ccctaagtataaacaggtgata

SEQ ID NO: 129561 - DNA, 22 bp, Artificial Sequence
  Synthetic oligonucleotide; CTA chr11 5307096 5307117 5307101 5307096 -
agtataaacaggtgatagtaaa

SEQ ID NO: 129562 - DNA, 22 bp, Artificial Sequence
  Synthetic oligonucleotide; CTT chr11 5307063 5307084 5307068 5307063 -
gctgcgagtgtcacatatatta

SEQ ID NO: 129563 - DNA, 22 bp, Artificial Sequence
  Synthetic oligonucleotide; TTG chr11 5307062 5307083 5307067 5307062 -
ctgcgagtgtcacatatattat

SEQ ID NO: 129564 - DNA, 22 bp, Artificial Sequence
  Synthetic oligonucleotide; CTG chr11 5307059 5307080 5307064 5307059 -
cgagtgtcacatatattatgta

SEQ ID NO: 129565 - DNA, 22 bp, Artificial Sequence
  Synthetic oligonucleotide; TTA chr11 5307041 5307062 5307046 5307041 -
tgtagaatatgcattttatcac

SEQ ID NO: 129566 - DNA, 22 bp, Artificial Sequence
  Synthetic oligonucleotide; TTT chr11 5307025 5307046 5307030 5307025 -
tatcactattttaaatctgaaa

SEQ ID NO: 129567 - DNA, 22 bp, Artificial Sequence
  Synthetic oligonucleotide; TTT chr11 5307024 5307045 5307029 5307024 -
atcactattttaaatctgaaag

SEQ ID NO: 129568 - DNA, 22 bp, Artificial Sequence
  Synthetic oligonucleotide; TTA chr11 5307023 5307044 5307028 5307023 -
tcactattttaaatctgaaaga

SEQ ID NO: 129569 - DNA, 22 bp, Artificial Sequence
  Synthetic oligonucleotide; CTA chr11 5307017 5307038 5307022 5307017 -
ttttaaatctgaaagactgaat

SEQ ID NO: 129570 - DNA, 22 bp, Artificial Sequence
  Synthetic oligonucleotide; TTT chr11 5307014 5307035 5307019 5307014 -
taaatctgaaagactgaatttg

SEQ ID NO: 129571 - DNA, 22 bp, Artificial Sequence
  Synthetic oligonucleotide; TTT chr11 5307013 5307034 5307018 5307013 -
aaatctgaaagactgaatttga

SEQ ID NO: 129572 - DNA, 22 bp, Artificial Sequence
  Synthetic oligonucleotide; TTA chr11 5307012 5307033 5307017 5307012 -
aatctgaaagactgaatttgac

SEQ ID NO: 129573 - DNA, 22 bp, Artificial Sequence
  Synthetic oligonucleotide; CTG chr11 5307006 5307027 5307011 5307006 -
aaagactgaatttgacatgttt

SEQ ID NO: 129574 - DNA, 22 bp, Artificial Sequence
  Synthetic oligonucleotide; CTG chr11 5306998 5307019 5307003 5306998 -
aatttgacatgttttgagataa

SEQ ID NO: 129575 - DNA, 22 bp, Artificial Sequence
  Synthetic oligonucleotide; TTT chr11 5306993 5307014 5306998 5306993 -
gacatgttttgagataagagtt

SEQ ID NO: 129576 - DNA, 22 bp, Artificial Sequence
  Synthetic oligonucleotide; TTG chr11 5306992 5307013 5306997 5306992 -
acatgttttgagataagagttt

SEQ ID NO: 129577 - DNA, 22 bp, Artificial Sequence
  Synthetic oligonucleotide; TTT chr11 5306984 5307005 5306989 5306984 -
tgagataagagtttagggtaga

SEQ ID NO: 129578 - DNA, 22 bp, Artificial Sequence
  Synthetic oligonucleotide; TTT chr11 5306983 5307004 5306988 5306983 -
gagataagagtttagggtagag

SEQ ID NO: 129579 - DNA, 22 bp, Artificial Sequence
  Synthetic oligonucleotide; TTG chr11 5306982 5307003 5306987 5306982 -
agataagagtttagggtagagt

SEQ ID NO: 129580 - DNA, 22 bp, Artificial Sequence
  Synthetic oligonucleotide; TTT chr11 5306970 5306991 5306975 5306970 -
agggtagagttgtgtatctgca

SEQ ID NO: 129581 - DNA, 22 bp, Artificial Sequence
  Synthetic oligonucleotide; TTA chr11 5306969 5306990 5306974 5306969 -
gggtagagttgtgtatctgcac

SEQ ID NO: 129582 - DNA, 22 bp, Artificial Sequence
  Synthetic oligonucleotide; TTG chr11 5306958 5306979 5306963 5306958 -
tgtatctgcacgatcttagact

SEQ ID NO: 129583 - DNA, 22 bp, Artificial Sequence
  Synthetic oligonucleotide; CTG chr11 5306950 5306971 5306955 5306950 -
cacgatcttagactacttaaat

SEQ ID NO: 129584 - DNA, 22 bp, Artificial Sequence
  Synthetic oligonucleotide; CTT chr11 5306941 5306962 5306946 5306941 -
agactacttaaatagaaactca

SEQ ID NO: 129585 - DNA, 22 bp, Artificial Sequence
  Synthetic oligonucleotide; TTA chr11 5306940 5306961 5306945 5306940 -
gactacttaaatagaaactcag

SEQ ID NO: 129586 - DNA, 22 bp, Artificial Sequence
  Synthetic oligonucleotide; CTA chr11 5306935 5306956 5306940 5306935 -
cttaaatagaaactcagcacat

SEQ ID NO: 129587 - DNA, 22 bp, Artificial Sequence
  Synthetic oligonucleotide; CTT chr11 5306932 5306953 5306937 5306932 -
aaatagaaactcagcacataat

SEQ ID NO: 129588 - DNA, 22 bp, Artificial Sequence
  Synthetic oligonucleotide; TTA chr11 5306931 5306952 5306936 5306931 -
aatagaaactcagcacataatc

SEQ ID NO: 129589 - DNA, 22 bp, Artificial Sequence
  Synthetic oligonucleotide; CTC chr11 5306920 5306941 5306925 5306920 -
agcacataatccaatgaaaaaa

SEQ ID NO: 129590 - DNA, 22 bp, Artificial Sequence
  Synthetic oligonucleotide; TTT chr11 5306891 5306912 5306896 5306891 -
cagaatgggactaatatgacaa

SEQ ID NO: 129591 - DNA, 22 bp, Artificial Sequence
  Synthetic oligonucleotide; TTC chr11 5306890 5306911 5306895 5306890 -
agaatgggactaatatgacaac

SEQ ID NO: 129592 - DNA, 22 bp, Artificial Sequence
  Synthetic oligonucleotide; CTA chr11 5306878 5306899 5306883 5306878 -
atatgacaacatctggattatt

SEQ ID NO: 129593 - DNA, 22 bp, Artificial Sequence
  Synthetic oligonucleotide; CTG chr11 5306863 5306884 5306868 5306863 -
gattattatgttcaataaggtg

SEQ ID NO: 129594 - DNA, 22 bp, Artificial Sequence
  Synthetic oligonucleotide; TTA chr11 5306858 5306879 5306863 5306858 -
ttatgttcaataaggtggagca

SEQ ID NO: 129595 - DNA, 22 bp, Artificial Sequence
  Synthetic oligonucleotide; TTA chr11 5306855 5306876 5306860 5306855 -
tgttcaataaggtggagcatca

SEQ ID NO: 129596 - DNA, 22 bp, Artificial Sequence
  Synthetic oligonucleotide; TTC chr11 5306850 5306871 5306855 5306850 -
aataaggtggagcatcatagga

SEQ ID NO: 129597 - DNA, 22 bp, Artificial Sequence
  Synthetic oligonucleotide; TTA chr11 5306813 5306834 5306818 5306813 -
ggaataattacatgataaacat

SEQ ID NO: 129598 - DNA, 22 bp, Artificial Sequence
  Synthetic oligonucleotide; TTA chr11 5306803 5306824 5306808 5306803 -
catgataaacatttaaaggact

SEQ ID NO: 129599 - DNA, 22 bp, Artificial Sequence
  Synthetic oligonucleotide; TTT chr11 5306789 5306810 5306794 5306789 -
aaaggactgttgatattggttc

SEQ ID NO: 129600 - DNA, 22 bp, Artificial Sequence
  Synthetic oligonucleotide; TTA chr11 5306788 5306809 5306793 5306788 -
aaggactgttgatattggttca

SEQ ID NO: 129601 - DNA, 22 bp, Artificial Sequence
  Synthetic oligonucleotide; CTG chr11 5306780 5306801 5306785 5306780 -
ttgatattggttcacccatcag

SEQ ID NO: 129602 - DNA, 22 bp, Artificial Sequence
  Synthetic oligonucleotide; TTG chr11 5306777 5306798 5306782 5306777 -
atattggttcacccatcaggaa

SEQ ID NO: 129603 - DNA, 22 bp, Artificial Sequence
  Synthetic oligonucleotide; TTG chr11 5306771 5306792 5306776 5306771 -
gttcacccatcaggaaagaagt

SEQ ID NO: 129604 - DNA, 22 bp, Artificial Sequence
  Synthetic oligonucleotide; TTC chr11 5306767 5306788 5306772 5306767 -
acccatcaggaaagaagtctta

SEQ ID NO: 129605 - DNA, 22 bp, Artificial Sequence
  Synthetic oligonucleotide; CTT chr11 5306746 5306767 5306751 5306746 -
agggtttttaatgcagatatct

SEQ ID NO: 129606 - DNA, 22 bp, Artificial Sequence
  Synthetic oligonucleotide; TTA chr11 5306745 5306766 5306750 5306745 -
gggtttttaatgcagatatctt

SEQ ID NO: 129607 - DNA, 22 bp, Artificial Sequence
  Synthetic oligonucleotide; TTT chr11 5306739 5306760 5306744 5306739 -
ttaatgcagatatctttataca

SEQ ID NO: 129608 - DNA, 22 bp, Artificial Sequence
  Synthetic oligonucleotide; TTT chr11 5306738 5306759 5306743 5306738 -
taatgcagatatctttatacat

SEQ ID NO: 129609 - DNA, 22 bp, Artificial Sequence
  Synthetic oligonucleotide; TTT chr11 5306737 5306758 5306742 5306737 -
aatgcagatatctttatacatc

SEQ ID NO: 129610 - DNA, 22 bp, Artificial Sequence
  Synthetic oligonucleotide; TTA chr11 5306736 5306757 5306741 5306736 -
atgcagatatctttatacatct

SEQ ID NO: 129611 - DNA, 22 bp, Artificial Sequence
  Synthetic oligonucleotide; CTT chr11 5306723 5306744 5306728 5306723 -
tatacatctagaaaaaaattat

SEQ ID NO: 129612 - DNA, 22 bp, Artificial Sequence
  Synthetic oligonucleotide; TTT chr11 5306722 5306743 5306727 5306722 -
atacatctagaaaaaaattatg

SEQ ID NO: 129613 - DNA, 22 bp, Artificial Sequence
  Synthetic oligonucleotide; TTA chr11 5306721 5306742 5306726 5306721 -
tacatctagaaaaaaattatgt

SEQ ID NO: 129614 - DNA, 22 bp, Artificial Sequence
  Synthetic oligonucleotide; CTA chr11 5306713 5306734 5306718 5306713 -
gaaaaaaattatgtatgaatat

SEQ ID NO: 129615 - DNA, 22 bp, Artificial Sequence
  Synthetic oligonucleotide; TTA chr11 5306702 5306723 5306707 5306702 -
tgtatgaatataatggctaata

SEQ ID NO: 129616 - DNA, 22 bp, Artificial Sequence
  Synthetic oligonucleotide; CTA chr11 5306683 5306704 5306688 5306683 -
atatatggttattttattctgg

SEQ ID NO: 129617 - DNA, 22 bp, Artificial Sequence
  Synthetic oligonucleotide; TTA chr11 5306672 5306693 5306677 5306672 -
ttttattctggagatcagacct

SEQ ID NO: 129618 - DNA, 22 bp, Artificial Sequence
  Synthetic oligonucleotide; TTT chr11 5306669 5306690 5306674 5306669 -
tattctggagatcagacctaaa

SEQ ID NO: 129619 - DNA, 22 bp, Artificial Sequence
  Synthetic oligonucleotide; TTT chr11 5306668 5306689 5306673 5306668 -
attctggagatcagacctaaat

SEQ ID NO: 129620 - DNA, 22 bp, Artificial Sequence
  Synthetic oligonucleotide; TTA chr11 5306667 5306688 5306672 5306667 -
ttctggagatcagacctaaata

SEQ ID NO: 129621 - DNA, 22 bp, Artificial Sequence
  Synthetic oligonucleotide; TTC chr11 5306664 5306685 5306669 5306664 -
tggagatcagacctaaatataa

SEQ ID NO: 129622 - DNA, 22 bp, Artificial Sequence
  Synthetic oligonucleotide; CTG chr11 5306662 5306683 5306667 5306662 -
gagatcagacctaaatataagg

SEQ ID NO: 129623 - DNA, 22 bp, Artificial Sequence
  Synthetic oligonucleotide; CTA chr11 5306649 5306670 5306654 5306649 -
aatataaggagtagatattata

SEQ ID NO: 129624 - DNA, 22 bp, Artificial Sequence
  Synthetic oligonucleotide; TTA chr11 5306629 5306650 5306634 5306629 -
tatgtttcagagaagtatatgt

SEQ ID NO: 129625 - DNA, 22 bp, Artificial Sequence
  Synthetic oligonucleotide; TTT chr11 5306622 5306643 5306627 5306622 -
cagagaagtatatgtctctctc

SEQ ID NO: 129626 - DNA, 22 bp, Artificial Sequence
  Synthetic oligonucleotide; TTC chr11 5306621 5306642 5306626 5306621 -
agagaagtatatgtctctctct

SEQ ID NO: 129627 - DNA, 22 bp, Artificial Sequence
  Synthetic oligonucleotide; CTC chr11 5306604 5306625 5306609 5306604 -
tctctctctctcactgtctctg

SEQ ID NO: 129628 - DNA, 22 bp, Artificial Sequence
  Synthetic oligonucleotide; CTC chr11 5306602 5306623 5306607 5306602 -
tctctctctcactgtctctgtc

SEQ ID NO: 129629 - DNA, 22 bp, Artificial Sequence
  Synthetic oligonucleotide; CTC chr11 5306600 5306621 5306605 5306600 -
tctctctcactgtctctgtctg

SEQ ID NO: 129630 - DNA, 22 bp, Artificial Sequence
  Synthetic oligonucleotide; CTC chr11 5306598 5306619 5306603 5306598 -
tctctcactgtctctgtctgtg

SEQ ID NO: 129631 - DNA, 22 bp, Artificial Sequence
  Synthetic oligonucleotide; CTC chr11 5306596 5306617 5306601 5306596 -
tctcactgtctctgtctgtgaa

SEQ ID NO: 129632 - DNA, 22 bp, Artificial Sequence
  Synthetic oligonucleotide; CTC chr11 5306594 5306615 5306599 5306594 -
tcactgtctctgtctgtgaata

SEQ ID NO: 129633 - DNA, 22 bp, Artificial Sequence
  Synthetic oligonucleotide; CTC chr11 5306592 5306613 5306597 5306592 -
actgtctctgtctgtgaatata

SEQ ID NO: 129634 - DNA, 22 bp, Artificial Sequence
  Synthetic oligonucleotide; CTG chr11 5306588 5306609 5306593 5306588 -
tctctgtctgtgaatatatata

SEQ ID NO: 129635 - DNA, 22 bp, Artificial Sequence
  Synthetic oligonucleotide; CTC chr11 5306584 5306605 5306589 5306584 -
tgtctgtgaatatatatataca

SEQ ID NO: 129636 - DNA, 22 bp, Artificial Sequence
  Synthetic oligonucleotide; CTG chr11 5306582 5306603 5306587 5306582 -
tctgtgaatatatatatacaca

SEQ ID NO: 129637 - DNA, 22 bp, Artificial Sequence
  Synthetic oligonucleotide; CTG chr11 5306578 5306599 5306583 5306578 -
tgaatatatatatacacacaca

SEQ ID NO: 129638 - DNA, 22 bp, Artificial Sequence
  Synthetic oligonucleotide; CTA chr11 5306544 5306565 5306549 5306544 -
tgcatacatatattgatagtaa

SEQ ID NO: 129639 - DNA, 22 bp, Artificial Sequence
  Synthetic oligonucleotide; TTG chr11 5306529 5306550 5306534 5306529 -
atagtaaataccatatatacat

SEQ ID NO: 129640 - DNA, 22 bp, Artificial Sequence
  Synthetic oligonucleotide; CTA chr11 5306501 5306522 5306506 5306501 -
aataattaaatgaaacccacat

SEQ ID NO: 129641 - DNA, 22 bp, Artificial Sequence
  Synthetic oligonucleotide; TTA chr11 5306493 5306514 5306498 5306493 -
aatgaaacccacatatatatga

SEQ ID NO: 129642 - DNA, 22 bp, Artificial Sequence
  Synthetic oligonucleotide; CTC chr11 5306459 5306480 5306464 5306459 -
agggtagggtagtgagttttga

SEQ ID NO: 129643 - DNA, 22 bp, Artificial Sequence
  Synthetic oligonucleotide; TTT chr11 5306440 5306461 5306445 5306440 -
tgaatcaatagaaagaataaat

SEQ ID NO: 129644 - DNA, 22 bp, Artificial Sequence
  Synthetic oligonucleotide; TTT chr11 5306439 5306460 5306444 5306439 -
gaatcaatagaaagaataaata

SEQ ID NO: 129645 - DNA, 22 bp, Artificial Sequence
  Synthetic oligonucleotide; TTG chr11 5306438 5306459 5306443 5306438 -
aatcaatagaaagaataaataa

SEQ ID NO: 129646 - DNA, 22 bp, Artificial Sequence
  Synthetic oligonucleotide; CTG chr11 5306409 5306430 5306414 5306409 -
atgaataatcatcaagacgaaa

SEQ ID NO: 129647 - DNA, 22 bp, Artificial Sequence
  Synthetic oligonucleotide; TTT chr11 5306381 5306402 5306386 5306381 -
ggtggtggctcaaggattttgt

SEQ ID NO: 129648 - DNA, 22 bp, Artificial Sequence
  Synthetic oligonucleotide; TTG chr11 5306380 5306401 5306385 5306380 -
gtggtggctcaaggattttgta

SEQ ID NO: 129649 - DNA, 22 bp, Artificial Sequence
  Synthetic oligonucleotide; CTC chr11 5306370 5306391 5306375 5306370 -
aaggattttgtaaagggttgaa

SEQ ID NO: 129650 - DNA, 22 bp, Artificial Sequence
  Synthetic oligonucleotide; TTT chr11 5306362 5306383 5306367 5306362 -
tgtaaagggttgaattagagaa

SEQ ID NO: 129651 - DNA, 22 bp, Artificial Sequence
  Synthetic oligonucleotide; TTT chr11 5306361 5306382 5306366 5306361 -
gtaaagggttgaattagagaat

SEQ ID NO: 129652 - DNA, 22 bp, Artificial Sequence
  Synthetic oligonucleotide; TTG chr11 5306360 5306381 5306365 5306360 -
taaagggttgaattagagaata

SEQ ID NO: 129653 - DNA, 22 bp, Artificial Sequence
  Synthetic oligonucleotide; TTG chr11 5306350 5306371 5306355 5306350 -
aattagagaatataatacagtt

SEQ ID NO: 129654 - DNA, 22 bp, Artificial Sequence
  Synthetic oligonucleotide; TTA chr11 5306345 5306366 5306350 5306345 -
gagaatataatacagtttgaaa

SEQ ID NO: 129655 - DNA, 22 bp, Artificial Sequence
  Synthetic oligonucleotide; TTT chr11 5306327 5306348 5306332 5306327 -
gaaaaggggcaatgttcttcaa

SEQ ID NO: 129656 - DNA, 22 bp, Artificial Sequence
  Synthetic oligonucleotide; TTG chr11 5306326 5306347 5306331 5306326 -
aaaaggggcaatgttcttcaaa

SEQ ID NO: 129657 - DNA, 22 bp, Artificial Sequence
  Synthetic oligonucleotide; TTC chr11 5306310 5306331 5306315 5306310 -
ttcaaatgttaacatttacaaa

SEQ ID NO: 129658 - DNA, 22 bp, Artificial Sequence
  Synthetic oligonucleotide; CTT chr11 5306308 5306329 5306313 5306308 -
caaatgttaacatttacaaaga

SEQ ID NO: 129659 - DNA, 22 bp, Artificial Sequence
  Synthetic oligonucleotide; TTC chr11 5306307 5306328 5306312 5306307 -
aaatgttaacatttacaaagac

SEQ ID NO: 129660 - DNA, 22 bp, Artificial Sequence
  Synthetic oligonucleotide; TTA chr11 5306299 5306320 5306304 5306299 -
acatttacaaagacaaagtgac

SEQ ID NO: 129661 - DNA, 22 bp, Artificial Sequence
  Synthetic oligonucleotide; TTT chr11 5306293 5306314 5306298 5306293 -
acaaagacaaagtgactggtct

SEQ ID NO: 129662 - DNA, 22 bp, Artificial Sequence
  Synthetic oligonucleotide; TTA chr11 5306292 5306313 5306297 5306292 -
caaagacaaagtgactggtctt

SEQ ID NO: 129663 - DNA, 22 bp, Artificial Sequence
  Synthetic oligonucleotide; CTG chr11 5306275 5306296 5306280 5306275 -
gtcttcccactctaagaccaat

SEQ ID NO: 129664 - DNA, 22 bp, Artificial Sequence
  Synthetic oligonucleotide; CTT chr11 5306270 5306291 5306275 5306270 -
cccactctaagaccaatggaac

SEQ ID NO: 129665 - DNA, 22 bp, Artificial Sequence
  Synthetic oligonucleotide; TTC chr11 5306269 5306290 5306274 5306269 -
ccactctaagaccaatggaaca

SEQ ID NO: 129666 - DNA, 22 bp, Artificial Sequence
  Synthetic oligonucleotide; CTC chr11 5306263 5306284 5306268 5306263 -
taagaccaatggaacacttgag

SEQ ID NO: 129667 - DNA, 22 bp, Artificial Sequence
  Synthetic oligonucleotide; CTA chr11 5306261 5306282 5306266 5306261 -
agaccaatggaacacttgagag

SEQ ID NO: 129668 - DNA, 22 bp, Artificial Sequence
  Synthetic oligonucleotide; CTT chr11 5306244 5306265 5306249 5306244 -
gagagtgactcatttcggtcat

SEQ ID NO: 129669 - DNA, 22 bp, Artificial Sequence
  Synthetic oligonucleotide; TTG chr11 5306243 5306264 5306248 5306243 -
agagtgactcatttcggtcatg

SEQ ID NO: 129670 - DNA, 22 bp, Artificial Sequence
  Synthetic oligonucleotide; CTC chr11 5306233 5306254 5306238 5306233 -
atttcggtcatgcctcatctga

SEQ ID NO: 129671 - DNA, 22 bp, Artificial Sequence
  Synthetic oligonucleotide; TTT chr11 5306229 5306250 5306234 5306229 -
cggtcatgcctcatctgatgtt

SEQ ID NO: 129672 - DNA, 22 bp, Artificial Sequence
  Synthetic oligonucleotide; TTC chr11 5306228 5306249 5306233 5306228 -
ggtcatgcctcatctgatgtta

SEQ ID NO: 129673 - DNA, 22 bp, Artificial Sequence
  Synthetic oligonucleotide; CTC chr11 5306217 5306238 5306222 5306217 -
atctgatgttagagacacaact

SEQ ID NO: 129674 - DNA, 22 bp, Artificial Sequence
  Synthetic oligonucleotide; CTG chr11 5306212 5306233 5306217 5306212 -
atgttagagacacaacttctct

SEQ ID NO: 129675 - DNA, 22 bp, Artificial Sequence
  Synthetic oligonucleotide; TTA chr11 5306206 5306227 5306211 5306206 -
gagacacaacttctcttagaga

SEQ ID NO: 129676 - DNA, 22 bp, Artificial Sequence
  Synthetic oligonucleotide; CTT chr11 5306194 5306215 5306199 5306194 -
ctcttagagactctccttccaa

SEQ ID NO: 129677 - DNA, 22 bp, Artificial Sequence
  Synthetic oligonucleotide; TTC chr11 5306193 5306214 5306198 5306193 -
tcttagagactctccttccaaa

SEQ ID NO: 129678 - DNA, 22 bp, Artificial Sequence
  Synthetic oligonucleotide; CTC chr11 5306191 5306212 5306196 5306191 -
ttagagactctccttccaaaga

SEQ ID NO: 129679 - DNA, 22 bp, Artificial Sequence
  Synthetic oligonucleotide; CTT chr11 5306189 5306210 5306194 5306189 -
agagactctccttccaaagaaa

SEQ ID NO: 129680 - DNA, 22 bp, Artificial Sequence
  Synthetic oligonucleotide; TTA chr11 5306188 5306209 5306193 5306188 -
gagactctccttccaaagaaaa

SEQ ID NO: 129681 - DNA, 22 bp, Artificial Sequence
  Synthetic oligonucleotide; CTC chr11 5306181 5306202 5306186 5306181 -
tccttccaaagaaaaaataaag

SEQ ID NO: 129682 - DNA, 22 bp, Artificial Sequence
  Synthetic oligonucleotide; CTC chr11 5306179 5306200 5306184 5306179 -
cttccaaagaaaaaataaaggc

SEQ ID NO: 129683 - DNA, 22 bp, Artificial Sequence
  Synthetic oligonucleotide; CTT chr11 5306176 5306197 5306181 5306176 -
ccaaagaaaaaataaaggccat

SEQ ID NO: 129684 - DNA, 22 bp, Artificial Sequence
  Synthetic oligonucleotide; TTC chr11 5306175 5306196 5306180 5306175 -
caaagaaaaaataaaggccatg

SEQ ID NO: 129685 - DNA, 22 bp, Artificial Sequence
  Synthetic oligonucleotide; TTT chr11 5306142 5306163 5306147 5306142 -
caatggcccagatctttcccag

SEQ ID NO: 129686 - DNA, 22 bp, Artificial Sequence
  Synthetic oligonucleotide; TTC chr11 5306141 5306162 5306146 5306141 -
aatggcccagatctttcccagg

SEQ ID NO: 129687 - DNA, 22 bp, Artificial Sequence
  Synthetic oligonucleotide; CTT chr11 5306126 5306147 5306131 5306126 -
tcccaggttggggaggaaaaga

SEQ ID NO: 129688 - DNA, 22 bp, Artificial Sequence
  Synthetic oligonucleotide; TTT chr11 5306125 5306146 5306130 5306125 -
cccaggttggggaggaaaagag

SEQ ID NO: 129689 - DNA, 22 bp, Artificial Sequence
  Synthetic oligonucleotide; TTC chr11 5306124 5306145 5306129 5306124 -
ccaggttggggaggaaaagaga

SEQ ID NO: 129690 - DNA, 22 bp, Artificial Sequence
  Synthetic oligonucleotide; TTG chr11 5306116 5306137 5306121 5306116 -
gggaggaaaagagaattatttg

SEQ ID NO: 129691 - DNA, 22 bp, Artificial Sequence
  Synthetic oligonucleotide; TTA chr11 5306098 5306119 5306103 5306098 -
tttggtacactattcccaaata

SEQ ID NO: 129692 - DNA, 22 bp, Artificial Sequence
  Synthetic oligonucleotide; TTT chr11 5306095 5306116 5306100 5306095 -
ggtacactattcccaaatatcc

SEQ ID NO: 129693 - DNA, 22 bp, Artificial Sequence
  Synthetic oligonucleotide; TTG chr11 5306094 5306115 5306099 5306094 -
gtacactattcccaaatatcct

SEQ ID NO: 129694 - DNA, 22 bp, Artificial Sequence
  Synthetic oligonucleotide; CTA chr11 5306086 5306107 5306091 5306086 -
ttcccaaatatcctatgtggaa

SEQ ID NO: 129695 - DNA, 22 bp, Artificial Sequence
  Synthetic oligonucleotide; TTC chr11 5306083 5306104 5306088 5306083 -
ccaaatatcctatgtggaaatg

SEQ ID NO: 129696 - DNA, 22 bp, Artificial Sequence
  Synthetic oligonucleotide; CTA chr11 5306071 5306092 5306076 5306071 -
tgtggaaatgagctagaataac

SEQ ID NO: 129697 - DNA, 22 bp, Artificial Sequence
  Synthetic oligonucleotide; CTA chr11 5306056 5306077 5306061 5306056 -
gaataaccccttgagagttgtt

SEQ ID NO: 129698 - DNA, 22 bp, Artificial Sequence
  Synthetic oligonucleotide; CTT chr11 5306044 5306065 5306049 5306044 -
gagagttgtttgtgtaacaaat

SEQ ID NO: 129699 - DNA, 22 bp, Artificial Sequence
  Synthetic oligonucleotide; TTG chr11 5306043 5306064 5306048 5306043 -
agagttgtttgtgtaacaaata

SEQ ID NO: 129700 - DNA, 22 bp, Artificial Sequence
  Synthetic oligonucleotide; TTG chr11 5306036 5306057 5306041 5306036 -
tttgtgtaacaaatatatctct

SEQ ID NO: 129701 - DNA, 22 bp, Artificial Sequence
  Synthetic oligonucleotide; TTT chr11 5306033 5306054 5306038 5306033 -
gtgtaacaaatatatctctcat

SEQ ID NO: 129702 - DNA, 22 bp, Artificial Sequence
  Synthetic oligonucleotide; TTG chr11 5306032 5306053 5306037 5306032 -
tgtaacaaatatatctctcatc

SEQ ID NO: 129703 - DNA, 22 bp, Artificial Sequence
  Synthetic oligonucleotide; CTC chr11 5306015 5306036 5306020 5306015 -
tcatcagaattaagagtaaata

SEQ ID NO: 129704 - DNA, 22 bp, Artificial Sequence
  Synthetic oligonucleotide; CTC chr11 5306013 5306034 5306018 5306013 -
atcagaattaagagtaaatact

SEQ ID NO: 129705 - DNA, 22 bp, Artificial Sequence
  Synthetic oligonucleotide; TTA chr11 5306003 5306024 5306008 5306003 -
agagtaaatactgaggatatag

SEQ ID NO: 129706 - DNA, 22 bp, Artificial Sequence
  Synthetic oligonucleotide; CTG chr11 5305990 5306011 5305995 5305990 -
aggatatagcaaacaaccaata

SEQ ID NO: 129707 - DNA, 22 bp, Artificial Sequence
  Synthetic oligonucleotide; TTC chr11 5305965 5305986 5305970 5305965 -
aggtcatgctcagaaaccgcaa

SEQ ID NO: 129708 - DNA, 22 bp, Artificial Sequence
  Synthetic oligonucleotide; CTC chr11 5305954 5305975 5305959 5305954 -
agaaaccgcaaagagaaaactg

SEQ ID NO: 129709 - DNA, 22 bp, Artificial Sequence
  Synthetic oligonucleotide; CTG chr11 5305932 5305953 5305937 5305932 -
tggctcaggtaagaaaagccaa

SEQ ID NO: 129710 - DNA, 22 bp, Artificial Sequence
  Synthetic oligonucleotide; CTC chr11 5305926 5305947 5305931 5305926 -
aggtaagaaaagccaaggattc

SEQ ID NO: 129711 - DNA, 22 bp, Artificial Sequence
  Synthetic oligonucleotide; TTC chr11 5305904 5305925 5305909 5305904 -
aaatacgggaagcaagtttaac

SEQ ID NO: 129712 - DNA, 22 bp, Artificial Sequence
  Synthetic oligonucleotide; TTT chr11 5305885 5305906 5305890 5305885 -
aaccatttccatttgatggaca

SEQ ID NO: 129713 - DNA, 22 bp, Artificial Sequence
  Synthetic oligonucleotide; TTA chr11 5305884 5305905 5305889 5305884 -
accatttccatttgatggacat

SEQ ID NO: 129714 - DNA, 22 bp, Artificial Sequence
  Synthetic oligonucleotide; TTT chr11 5305877 5305898 5305882 5305877 -
ccatttgatggacattggttga

SEQ ID NO: 129715 - DNA, 22 bp, Artificial Sequence
  Synthetic oligonucleotide; TTC chr11 5305876 5305897 5305881 5305876 -
catttgatggacattggttgag

SEQ ID NO: 129716 - DNA, 22 bp, Artificial Sequence
  Synthetic oligonucleotide; TTT chr11 5305871 5305892 5305876 5305871 -
gatggacattggttgagaatat

SEQ ID NO: 129717 - DNA, 22 bp, Artificial Sequence
  Synthetic oligonucleotide; TTG chr11 5305870 5305891 5305875 5305870 -
atggacattggttgagaatatg

SEQ ID NO: 129718 - DNA, 22 bp, Artificial Sequence
  Synthetic oligonucleotide; TTG chr11 5305860 5305881 5305865 5305860 -
gttgagaatatgagcttgggtt

SEQ ID NO: 129719 - DNA, 22 bp, Artificial Sequence
  Synthetic oligonucleotide; TTG chr11 5305856 5305877 5305861 5305856 -
agaatatgagcttgggttttgg

SEQ ID NO: 129720 - DNA, 22 bp, Artificial Sequence
  Synthetic oligonucleotide; CTT chr11 5305843 5305864 5305848 5305843 -
gggttttgggttagataaacct

SEQ ID NO: 129721 - DNA, 22 bp, Artificial Sequence
  Synthetic oligonucleotide; TTG chr11 5305842 5305863 5305847 5305842 -
ggttttgggttagataaacctg

SEQ ID NO: 129722 - DNA, 22 bp, Artificial Sequence
  Synthetic oligonucleotide; TTT chr11 5305837 5305858 5305842 5305837 -
tgggttagataaacctgtgttt

SEQ ID NO: 129723 - DNA, 22 bp, Artificial Sequence
  Synthetic oligonucleotide; TTT chr11 5305836 5305857 5305841 5305836 -
gggttagataaacctgtgtttg

SEQ ID NO: 129724 - DNA, 22 bp, Artificial Sequence
  Synthetic oligonucleotide; TTG chr11 5305835 5305856 5305840 5305835 -
ggttagataaacctgtgtttga

SEQ ID NO: 129725 - DNA, 22 bp, Artificial Sequence
  Synthetic oligonucleotide; TTA chr11 5305830 5305851 5305835 5305830 -
gataaacctgtgtttgaattcc

SEQ ID NO: 129726 - DNA, 22 bp, Artificial Sequence
  Synthetic oligonucleotide; CTG chr11 5305820 5305841 5305825 5305820 -
tgtttgaattcctttatgacac

SEQ ID NO: 129727 - DNA, 22 bp, Artificial Sequence
  Synthetic oligonucleotide; TTT chr11 5305815 5305836 5305820 5305815 -
gaattcctttatgacacatatt

SEQ ID NO: 129728 - DNA, 22 bp, Artificial Sequence
  Synthetic oligonucleotide; TTG chr11 5305814 5305835 5305819 5305814 -
aattcctttatgacacatatta

SEQ ID NO: 129729 - DNA, 22 bp, Artificial Sequence
  Synthetic oligonucleotide; TTC chr11 5305809 5305830 5305814 5305809 -
ctttatgacacatattagttgc

SEQ ID NO: 129730 - DNA, 22 bp, Artificial Sequence
  Synthetic oligonucleotide; CTT chr11 5305806 5305827 5305811 5305806 -
tatgacacatattagttgcgtg

SEQ ID NO: 129731 - DNA, 22 bp, Artificial Sequence
  Synthetic oligonucleotide; TTT chr11 5305805 5305826 5305810 5305805 -
atgacacatattagttgcgtga

SEQ ID NO: 129732 - DNA, 22 bp, Artificial Sequence
  Synthetic oligonucleotide; TTA chr11 5305804 5305825 5305809 5305804 -
tgacacatattagttgcgtgat

SEQ ID NO: 129733 - DNA, 22 bp, Artificial Sequence
  Synthetic oligonucleotide; TTA chr11 5305792 5305813 5305797 5305792 -
gttgcgtgatcttaggctaatt

SEQ ID NO: 129734 - DNA, 22 bp, Artificial Sequence
  Synthetic oligonucleotide; TTG chr11 5305788 5305809 5305793 5305788 -
cgtgatcttaggctaattgctt

SEQ ID NO: 129735 - DNA, 22 bp, Artificial Sequence
  Synthetic oligonucleotide; CTT chr11 5305779 5305800 5305784 5305779 -
aggctaattgcttaacttgtct

SEQ ID NO: 129736 - DNA, 22 bp, Artificial Sequence
  Synthetic oligonucleotide; TTA chr11 5305778 5305799 5305783 5305778 -
ggctaattgcttaacttgtcta

SEQ ID NO: 129737 - DNA, 22 bp, Artificial Sequence
  Synthetic oligonucleotide; CTA chr11 5305773 5305794 5305778 5305773 -
attgcttaacttgtctaaggct

SEQ ID NO: 129738 - DNA, 22 bp, Artificial Sequence
  Synthetic oligonucleotide; TTG chr11 5305769 5305790 5305774 5305769 -
cttaacttgtctaaggctcaat

SEQ ID NO: 129739 - DNA, 22 bp, Artificial Sequence
  Synthetic oligonucleotide; CTT chr11 5305766 5305787 5305771 5305766 -
aacttgtctaaggctcaatttc

SEQ ID NO: 129740 - DNA, 22 bp, Artificial Sequence
  Synthetic oligonucleotide; TTA chr11 5305765 5305786 5305770 5305765 -
acttgtctaaggctcaatttcc

SEQ ID NO: 129741 - DNA, 22 bp, Artificial Sequence
  Synthetic oligonucleotide; CTT chr11 5305761 5305782 5305766 5305761 -
gtctaaggctcaatttcctcac

SEQ ID NO: 129742 - DNA, 22 bp, Artificial Sequence
  Synthetic oligonucleotide; TTG chr11 5305760 5305781 5305765 5305760 -
tctaaggctcaatttcctcacc

SEQ ID NO: 129743 - DNA, 22 bp, Artificial Sequence
  Synthetic oligonucleotide; CTA chr11 5305756 5305777 5305761 5305756 -
aggctcaatttcctcaccataa

SEQ ID NO: 129744 - DNA, 22 bp, Artificial Sequence
  Synthetic oligonucleotide; CTC chr11 5305750 5305771 5305755 5305750 -
aatttcctcaccataacaatat

SEQ ID NO: 129745 - DNA, 22 bp, Artificial Sequence
  Synthetic oligonucleotide; TTT chr11 5305745 5305766 5305750 5305745 -
cctcaccataacaatataaata

SEQ ID NO: 129746 - DNA, 22 bp, Artificial Sequence
  Synthetic oligonucleotide; TTC chr11 5305744 5305765 5305749 5305744 -
ctcaccataacaatataaataa

SEQ ID NO: 129747 - DNA, 22 bp, Artificial Sequence
  Synthetic oligonucleotide; CTC chr11 5305741 5305762 5305746 5305741 -
accataacaatataaataaaat

SEQ ID NO: 129748 - DNA, 22 bp, Artificial Sequence
  Synthetic oligonucleotide; TTG chr11 5305710 5305731 5305715 5305710 -
tctttactttcttgttttttac

SEQ ID NO: 129749 - DNA, 22 bp, Artificial Sequence
  Synthetic oligonucleotide; CTT chr11 5305706 5305727 5305711 5305706 -
tactttcttgttttttactcac

SEQ ID NO: 129750 - DNA, 22 bp, Artificial Sequence
  Synthetic oligonucleotide; TTT chr11 5305705 5305726 5305710 5305705 -
actttcttgttttttactcact

SEQ ID NO: 129751 - DNA, 22 bp, Artificial Sequence
  Synthetic oligonucleotide; TTA chr11 5305704 5305725 5305709 5305704 -
ctttcttgttttttactcactt

SEQ ID NO: 129752 - DNA, 22 bp, Artificial Sequence
  Synthetic oligonucleotide; CTT chr11 5305701 5305722 5305706 5305701 -
tcttgttttttactcacttttc

SEQ ID NO: 129753 - DNA, 22 bp, Artificial Sequence
  Synthetic oligonucleotide; TTT chr11 5305700 5305721 5305705 5305700 -
cttgttttttactcacttttct

SEQ ID NO: 129754 - DNA, 22 bp, Artificial Sequence
  Synthetic oligonucleotide; TTC chr11 5305699 5305720 5305704 5305699 -
ttgttttttactcacttttctt

SEQ ID NO: 129755 - DNA, 22 bp, Artificial Sequence
  Synthetic oligonucleotide; CTT chr11 5305697 5305718 5305702 5305697 -
gttttttactcacttttctttt

SEQ ID NO: 129756 - DNA, 22 bp, Artificial Sequence
  Synthetic oligonucleotide; TTG chr11 5305696 5305717 5305701 5305696 -
ttttttactcacttttcttttc

SEQ ID NO: 129757 - DNA, 22 bp, Artificial Sequence
  Synthetic oligonucleotide; TTT chr11 5305693 5305714 5305698 5305693 -
tttactcacttttcttttctct

SEQ ID NO: 129758 - DNA, 22 bp, Artificial Sequence
  Synthetic oligonucleotide; TTT chr11 5305692 5305713 5305697 5305692 -
ttactcacttttcttttctctc

SEQ ID NO: 129759 - DNA, 22 bp, Artificial Sequence
  Synthetic oligonucleotide; TTT chr11 5305691 5305712 5305696 5305691 -
tactcacttttcttttctctct

SEQ ID NO: 129760 - DNA, 22 bp, Artificial Sequence
  Synthetic oligonucleotide; TTT chr11 5305690 5305711 5305695 5305690 -
actcacttttcttttctctctc

SEQ ID NO: 129761 - DNA, 22 bp, Artificial Sequence
  Synthetic oligonucleotide; TTA chr11 5305689 5305710 5305694 5305689 -
ctcacttttcttttctctctct

SEQ ID NO: 129762 - DNA, 22 bp, Artificial Sequence
  Synthetic oligonucleotide; CTC chr11 5305686 5305707 5305691 5305686 -
acttttcttttctctctctctc

SEQ ID NO: 129763 - DNA, 22 bp, Artificial Sequence
  Synthetic oligonucleotide; CTT chr11 5305682 5305703 5305687 5305682 -
ttcttttctctctctctcttta

SEQ ID NO: 129764 - DNA, 22 bp, Artificial Sequence
  Synthetic oligonucleotide; TTT chr11 5305681 5305702 5305686 5305681 -
tcttttctctctctctctttaa

SEQ ID NO: 129765 - DNA, 22 bp, Artificial Sequence
  Synthetic oligonucleotide; TTT chr11 5305680 5305701 5305685 5305680 -
cttttctctctctctctttaac

SEQ ID NO: 129766 - DNA, 22 bp, Artificial Sequence
  Synthetic oligonucleotide; TTC chr11 5305679 5305700 5305684 5305679 -
ttttctctctctctctttaaca

SEQ ID NO: 129767 - DNA, 22 bp, Artificial Sequence
  Synthetic oligonucleotide; CTT chr11 5305677 5305698 5305682 5305677 -
ttctctctctctctttaacaga

SEQ ID NO: 129768 - DNA, 22 bp, Artificial Sequence
  Synthetic oligonucleotide; TTT chr11 5305676 5305697 5305681 5305676 -
tctctctctctctttaacagat

SEQ ID NO: 129769 - DNA, 22 bp, Artificial Sequence
  Synthetic oligonucleotide; TTT chr11 5305675 5305696 5305680 5305675 -
ctctctctctctttaacagatt

SEQ ID NO: 129770 - DNA, 22 bp, Artificial Sequence
  Synthetic oligonucleotide; TTC chr11 5305674 5305695 5305679 5305674 -
tctctctctctttaacagattt

SEQ ID NO: 129771 - DNA, 22 bp, Artificial Sequence
  Synthetic oligonucleotide; CTC chr11 5305672 5305693 5305677 5305672 -
tctctctctttaacagattttt

SEQ ID NO: 129772 - DNA, 22 bp, Artificial Sequence
  Synthetic oligonucleotide; CTC chr11 5305670 5305691 5305675 5305670 -
tctctctttaacagatttttct

SEQ ID NO: 129773 - DNA, 22 bp, Artificial Sequence
  Synthetic oligonucleotide; CTC chr11 5305668 5305689 5305673 5305668 -
tctctttaacagatttttctct

SEQ ID NO: 129774 - DNA, 22 bp, Artificial Sequence
  Synthetic oligonucleotide; CTC chr11 5305666 5305687 5305671 5305666 -
tctttaacagatttttctctgt

SEQ ID NO: 129775 - DNA, 22 bp, Artificial Sequence
  Synthetic oligonucleotide; CTC chr11 5305664 5305685 5305669 5305664 -
tttaacagatttttctctgttg

SEQ ID NO: 129776 - DNA, 22 bp, Artificial Sequence
  Synthetic oligonucleotide; CTT chr11 5305662 5305683 5305667 5305662 -
taacagatttttctctgttgcc

SEQ ID NO: 129777 - DNA, 22 bp, Artificial Sequence
  Synthetic oligonucleotide; TTT chr11 5305661 5305682 5305666 5305661 -
aacagatttttctctgttgccc

SEQ ID NO: 129778 - DNA, 22 bp, Artificial Sequence
  Synthetic oligonucleotide; TTA chr11 5305660 5305681 5305665 5305660 -
acagatttttctctgttgccca

SEQ ID NO: 129779 - DNA, 22 bp, Artificial Sequence
  Synthetic oligonucleotide; TTT chr11 5305652 5305673 5305657 5305652 -
ttctctgttgcccaggctagag

SEQ ID NO: 129780 - DNA, 22 bp, Artificial Sequence
  Synthetic oligonucleotide; TTT chr11 5305651 5305672 5305656 5305651 -
tctctgttgcccaggctagagt

SEQ ID NO: 129781 - DNA, 22 bp, Artificial Sequence
  Synthetic oligonucleotide; TTT chr11 5305650 5305671 5305655 5305650 -
ctctgttgcccaggctagagtg

SEQ ID NO: 129782 - DNA, 22 bp, Artificial Sequence
  Synthetic oligonucleotide; TTC chr11 5305649 5305670 5305654 5305649 -
tctgttgcccaggctagagtgc

SEQ ID NO: 129783 - DNA, 22 bp, Artificial Sequence
  Synthetic oligonucleotide; CTC chr11 5305647 5305668 5305652 5305647 -
tgttgcccaggctagagtgcag

SEQ ID NO: 129784 - DNA, 22 bp, Artificial Sequence
  Synthetic oligonucleotide; CTG chr11 5305645 5305666 5305650 5305645 -
ttgcccaggctagagtgcagtg

SEQ ID NO: 129785 - DNA, 22 bp, Artificial Sequence
  Synthetic oligonucleotide; TTG chr11 5305642 5305663 5305647 5305642 -
cccaggctagagtgcagtggtg

SEQ ID NO: 129786 - DNA, 22 bp, Artificial Sequence
  Synthetic oligonucleotide; CTA chr11 5305633 5305654 5305638 5305633 -
gagtgcagtggtgcgatctcag

SEQ ID NO: 129787 - DNA, 22 bp, Artificial Sequence
  Synthetic oligonucleotide; CTC chr11 5305613 5305634 5305618 5305613 -
agctcactgcgacctcctccac

SEQ ID NO: 129788 - DNA, 22 bp, Artificial Sequence
  Synthetic oligonucleotide; CTC chr11 5305608 5305629 5305613 5305608 -
actgcgacctcctccaccaggg

SEQ ID NO: 129789 - DNA, 22 bp, Artificial Sequence
  Synthetic oligonucleotide; CTG chr11 5305604 5305625 5305609 5305604 -
cgacctcctccaccagggttca

SEQ ID NO: 129790 - DNA, 22 bp, Artificial Sequence
  Synthetic oligonucleotide; CTC chr11 5305597 5305618 5305602 5305597 -
ctccaccagggttcaggggatt

SEQ ID NO: 129791 - DNA, 22 bp, Artificial Sequence
  Synthetic oligonucleotide; CTC chr11 5305594 5305615 5305599 5305594 -
caccagggttcaggggattctc

SEQ ID NO: 129792 - DNA, 22 bp, Artificial Sequence
  Synthetic oligonucleotide; TTC chr11 5305583 5305604 5305588 5305583 -
aggggattctcatgcctcagcc

SEQ ID NO: 129793 - DNA, 22 bp, Artificial Sequence
  Synthetic oligonucleotide; TTC chr11 5305574 5305595 5305579 5305574 -
tcatgcctcagcctccagagta

SEQ ID NO: 129794 - DNA, 22 bp, Artificial Sequence
  Synthetic oligonucleotide; CTC chr11 5305572 5305593 5305577 5305572 -
atgcctcagcctccagagtagc

SEQ ID NO: 129795 - DNA, 22 bp, Artificial Sequence
  Synthetic oligonucleotide; CTC chr11 5305565 5305586 5305570 5305565 -
agcctccagagtagctgggatt

SEQ ID NO: 129796 - DNA, 22 bp, Artificial Sequence
  Synthetic oligonucleotide; CTC chr11 5305559 5305580 5305564 5305559 -
cagagtagctgggattatgatc

SEQ ID NO: 129797 - DNA, 22 bp, Artificial Sequence
  Synthetic oligonucleotide; CTG chr11 5305548 5305569 5305553 5305548 -
ggattatgatcatgtgccacca

SEQ ID NO: 129798 - DNA, 22 bp, Artificial Sequence
  Synthetic oligonucleotide; TTA chr11 5305542 5305563 5305547 5305542 -
tgatcatgtgccaccacacctg

SEQ ID NO: 129799 - DNA, 22 bp, Artificial Sequence
  Synthetic oligonucleotide; CTG chr11 5305520 5305541 5305525 5305520 -
gcttatttttgtaattatagta

SEQ ID NO: 129800 - DNA, 22 bp, Artificial Sequence
  Synthetic oligonucleotide; CTT chr11 5305516 5305537 5305521 5305516 -
atttttgtaattatagtagtga

SEQ ID NO: 129801 - DNA, 22 bp, Artificial Sequence
  Synthetic oligonucleotide; TTA chr11 5305515 5305536 5305520 5305515 -
tttttgtaattatagtagtgat

SEQ ID NO: 129802 - DNA, 22 bp, Artificial Sequence
  Synthetic oligonucleotide; TTT chr11 5305512 5305533 5305517 5305512 -
ttgtaattatagtagtgatggt

SEQ ID NO: 129803 - DNA, 22 bp, Artificial Sequence
  Synthetic oligonucleotide; TTT chr11 5305511 5305532 5305516 5305511 -
tgtaattatagtagtgatggtg

SEQ ID NO: 129804 - DNA, 22 bp, Artificial Sequence
  Synthetic oligonucleotide; TTT chr11 5305510 5305531 5305515 5305510 -
gtaattatagtagtgatggtgt

SEQ ID NO: 129805 - DNA, 22 bp, Artificial Sequence
  Synthetic oligonucleotide; TTG chr11 5305509 5305530 5305514 5305509 -
taattatagtagtgatggtgtt

SEQ ID NO: 129806 - DNA, 22 bp, Artificial Sequence
  Synthetic oligonucleotide; TTA chr11 5305503 5305524 5305508 5305503 -
tagtagtgatggtgttttgcca

SEQ ID NO: 129807 - DNA, 22 bp, Artificial Sequence
  Synthetic oligonucleotide; TTT chr11 5305486 5305507 5305491 5305486 -
tgccatgttggcccagctggtc

SEQ ID NO: 129808 - DNA, 22 bp, Artificial Sequence
  Synthetic oligonucleotide; TTT chr11 5305485 5305506 5305490 5305485 -
gccatgttggcccagctggtct

SEQ ID NO: 129809 - DNA, 22 bp, Artificial Sequence
  Synthetic oligonucleotide; TTG chr11 5305484 5305505 5305489 5305484 -
ccatgttggcccagctggtctc

SEQ ID NO: 129810 - DNA, 22 bp, Artificial Sequence
  Synthetic oligonucleotide; TTG chr11 5305476 5305497 5305481 5305476 -
gcccagctggtctcgaactcct

SEQ ID NO: 129811 - DNA, 22 bp, Artificial Sequence
  Synthetic oligonucleotide; CTG chr11 5305467 5305488 5305472 5305467 -
gtctcgaactcctgaactcaag

SEQ ID NO: 129812 - DNA, 22 bp, Artificial Sequence
  Synthetic oligonucleotide; CTC chr11 5305462 5305483 5305467 5305462 -
gaactcctgaactcaagtgatc

SEQ ID NO: 129813 - DNA, 22 bp, Artificial Sequence
  Synthetic oligonucleotide; CTC chr11 5305456 5305477 5305461 5305456 -
ctgaactcaagtgatccaccct

SEQ ID NO: 129814 - DNA, 22 bp, Artificial Sequence
  Synthetic oligonucleotide; CTG chr11 5305453 5305474 5305458 5305453 -
aactcaagtgatccaccctcct

SEQ ID NO: 129815 - DNA, 22 bp, Artificial Sequence
  Synthetic oligonucleotide; CTC chr11 5305448 5305469 5305453 5305448 -
aagtgatccaccctcctcggcc

SEQ ID NO: 129816 - DNA, 22 bp, Artificial Sequence
  Synthetic oligonucleotide; CTC chr11 5305433 5305454 5305438 5305433 -
ctcggcctcccaaagtgctggg

SEQ ID NO: 129817 - DNA, 22 bp, Artificial Sequence
  Synthetic oligonucleotide; CTC chr11 5305430 5305451 5305435 5305430 -
ggcctcccaaagtgctgggatt

SEQ ID NO: 129818 - DNA, 22 bp, Artificial Sequence
  Synthetic oligonucleotide; CTC chr11 5305424 5305445 5305429 5305424 -
ccaaagtgctgggattataggc

SEQ ID NO: 129819 - DNA, 22 bp, Artificial Sequence
  Synthetic oligonucleotide; CTG chr11 5305413 5305434 5305418 5305413 -
ggattataggcatgagccaccg

SEQ ID NO: 129820 - DNA, 22 bp, Artificial Sequence
  Synthetic oligonucleotide; TTA chr11 5305407 5305428 5305412 5305407 -
taggcatgagccaccgtgccca

SEQ ID NO: 129821 - DNA, 22 bp, Artificial Sequence
  Synthetic oligonucleotide; CTG chr11 5305381 5305402 5305386 5305381 -
ttttttactcactttttgtctc

SEQ ID NO: 129822 - DNA, 22 bp, Artificial Sequence
  Synthetic oligonucleotide; TTT chr11 5305378 5305399 5305383 5305378 -
tttactcactttttgtctcaca

SEQ ID NO: 129823 - DNA, 22 bp, Artificial Sequence
  Synthetic oligonucleotide; TTT chr11 5305377 5305398 5305382 5305377 -
ttactcactttttgtctcacag

SEQ ID NO: 129824 - DNA, 22 bp, Artificial Sequence
  Synthetic oligonucleotide; TTT chr11 5305376 5305397 5305381 5305376 -
tactcactttttgtctcacagt

SEQ ID NO: 129825 - DNA, 22 bp, Artificial Sequence
  Synthetic oligonucleotide; TTT chr11 5305375 5305396 5305380 5305375 -
actcactttttgtctcacagtc

SEQ ID NO: 129826 - DNA, 22 bp, Artificial Sequence
  Synthetic oligonucleotide; TTA chr11 5305374 5305395 5305379 5305374 -
ctcactttttgtctcacagtca

SEQ ID NO: 129827 - DNA, 22 bp, Artificial Sequence
  Synthetic oligonucleotide; CTC chr11 5305371 5305392 5305376 5305371 -
actttttgtctcacagtcatta

SEQ ID NO: 129828 - DNA, 22 bp, Artificial Sequence
  Synthetic oligonucleotide; CTT chr11 5305367 5305388 5305372 5305367 -
tttgtctcacagtcattaggca

SEQ ID NO: 129829 - DNA, 22 bp, Artificial Sequence
  Synthetic oligonucleotide; TTT chr11 5305366 5305387 5305371 5305366 -
ttgtctcacagtcattaggcat

SEQ ID NO: 129830 - DNA, 22 bp, Artificial Sequence
  Synthetic oligonucleotide; TTT chr11 5305365 5305386 5305370 5305365 -
tgtctcacagtcattaggcatt

SEQ ID NO: 129831 - DNA, 22 bp, Artificial Sequence
  Synthetic oligonucleotide; TTT chr11 5305364 5305385 5305369 5305364 -
gtctcacagtcattaggcattc

SEQ ID NO: 129832 - DNA, 22 bp, Artificial Sequence
  Synthetic oligonucleotide; TTG chr11 5305363 5305384 5305368 5305363 -
tctcacagtcattaggcattca

SEQ ID NO: 129833 - DNA, 22 bp, Artificial Sequence
  Synthetic oligonucleotide; CTC chr11 5305359 5305380 5305364 5305359 -
acagtcattaggcattcatttc

SEQ ID NO: 129834 - DNA, 22 bp, Artificial Sequence
  Synthetic oligonucleotide; TTA chr11 5305349 5305370 5305354 5305349 -
ggcattcatttctgccattatg

SEQ ID NO: 129835 - DNA, 22 bp, Artificial Sequence
  Synthetic oligonucleotide; TTC chr11 5305342 5305363 5305347 5305342 -
atttctgccattatgttgaaat

SEQ ID NO: 129836 - DNA, 22 bp, Artificial Sequence
  Synthetic oligonucleotide; TTT chr11 5305338 5305359 5305343 5305338 -
ctgccattatgttgaaattgtc

SEQ ID NO: 129837 - DNA, 22 bp, Artificial Sequence
  Synthetic oligonucleotide; TTC chr11 5305337 5305358 5305342 5305337 -
tgccattatgttgaaattgtca

SEQ ID NO: 129838 - DNA, 22 bp, Artificial Sequence
  Synthetic oligonucleotide; CTG chr11 5305335 5305356 5305340 5305335 -
ccattatgttgaaattgtcaat

SEQ ID NO: 129839 - DNA, 22 bp, Artificial Sequence
  Synthetic oligonucleotide; TTA chr11 5305329 5305350 5305334 5305329 -
tgttgaaattgtcaatattacc

SEQ ID NO: 129840 - DNA, 22 bp, Artificial Sequence
  Synthetic oligonucleotide; TTG chr11 5305324 5305345 5305329 5305324 -
aaattgtcaatattaccaaaga

SEQ ID NO: 129841 - DNA, 22 bp, Artificial Sequence
  Synthetic oligonucleotide; TTG chr11 5305318 5305339 5305323 5305318 -
tcaatattaccaaagacctagt

SEQ ID NO: 129842 - DNA, 22 bp, Artificial Sequence
  Synthetic oligonucleotide; TTA chr11 5305309 5305330 5305314 5305309 -
ccaaagacctagttgccccaaa

SEQ ID NO: 129843 - DNA, 22 bp, Artificial Sequence
  Synthetic oligonucleotide; CTA chr11 5305298 5305319 5305303 5305298 -
gttgccccaaacaatcaacacc

SEQ ID NO: 129844 - DNA, 22 bp, Artificial Sequence
  Synthetic oligonucleotide; TTG chr11 5305294 5305315 5305299 5305294 -
ccccaaacaatcaacacctcta

SEQ ID NO: 129845 - DNA, 22 bp, Artificial Sequence
  Synthetic oligonucleotide; CTC chr11 5305274 5305295 5305279 5305274 -
tatgtttatattaattgataat

SEQ ID NO: 129846 - DNA, 22 bp, Artificial Sequence
  Synthetic oligonucleotide; CTA chr11 5305272 5305293 5305277 5305272 -
tgtttatattaattgataattc

SEQ ID NO: 129847 - DNA, 22 bp, Artificial Sequence
  Synthetic oligonucleotide; TTT chr11 5305267 5305288 5305272 5305267 -
atattaattgataattctatat

SEQ ID NO: 129848 - DNA, 22 bp, Artificial Sequence
  Synthetic oligonucleotide; TTA chr11 5305266 5305287 5305271 5305266 -
tattaattgataattctatatt

SEQ ID NO: 129849 - DNA, 22 bp, Artificial Sequence
  Synthetic oligonucleotide; TTA chr11 5305261 5305282 5305266 5305261 -
attgataattctatatttttca

SEQ ID NO: 129850 - DNA, 22 bp, Artificial Sequence
  Synthetic oligonucleotide; TTG chr11 5305257 5305278 5305262 5305257 -
ataattctatatttttcactat

SEQ ID NO: 129851 - DNA, 22 bp, Artificial Sequence
  Synthetic oligonucleotide; TTC chr11 5305250 5305271 5305255 5305250 -
tatatttttcactattaaccta

SEQ ID NO: 129852 - DNA, 22 bp, Artificial Sequence
  Synthetic oligonucleotide; CTA chr11 5305248 5305269 5305253 5305248 -
tatttttcactattaacctacc

SEQ ID NO: 129853 - DNA, 22 bp, Artificial Sequence
  Synthetic oligonucleotide; TTT chr11 5305243 5305264 5305248 5305243 -
ttcactattaacctaccatagt

SEQ ID NO: 129854 - DNA, 22 bp, Artificial Sequence
  Synthetic oligonucleotide; TTT chr11 5305242 5305263 5305247 5305242 -
tcactattaacctaccatagta

SEQ ID NO: 129855 - DNA, 22 bp, Artificial Sequence
  Synthetic oligonucleotide; TTT chr11 5305241 5305262 5305246 5305241 -
cactattaacctaccatagtat

SEQ ID NO: 129856 - DNA, 22 bp, Artificial Sequence
  Synthetic oligonucleotide; TTC chr11 5305240 5305261 5305245 5305240 -
actattaacctaccatagtatc

SEQ ID NO: 129857 - DNA, 22 bp, Artificial Sequence
  Synthetic oligonucleotide; CTA chr11 5305236 5305257 5305241 5305236 -
ttaacctaccatagtatccact

SEQ ID NO: 129858 - DNA, 22 bp, Artificial Sequence
  Synthetic oligonucleotide; TTA chr11 5305233 5305254 5305238 5305233 -
acctaccatagtatccactcct

SEQ ID NO: 129859 - DNA, 22 bp, Artificial Sequence
  Synthetic oligonucleotide; CTA chr11 5305228 5305249 5305233 5305228 -
ccatagtatccactcctataaa

SEQ ID NO: 129860 - DNA, 22 bp, Artificial Sequence
  Synthetic oligonucleotide; CTC chr11 5305213 5305234 5305218 5305213 -
ctataaacttcccttttcattg

SEQ ID NO: 129861 - DNA, 22 bp, Artificial Sequence
  Synthetic oligonucleotide; CTA chr11 5305210 5305231 5305215 5305210 -
taaacttcccttttcattgttt

SEQ ID NO: 129862 - DNA, 22 bp, Artificial Sequence
  Synthetic oligonucleotide; CTT chr11 5305203 5305224 5305208 5305203 -
cccttttcattgtttttttgta

SEQ ID NO: 129863 - DNA, 22 bp, Artificial Sequence
  Synthetic oligonucleotide; TTC chr11 5305202 5305223 5305207 5305202 -
ccttttcattgtttttttgtaa

SEQ ID NO: 129864 - DNA, 22 bp, Artificial Sequence
  Synthetic oligonucleotide; CTT chr11 5305198 5305219 5305203 5305198 -
ttcattgtttttttgtaaatac

SEQ ID NO: 129865 - DNA, 22 bp, Artificial Sequence
  Synthetic oligonucleotide; TTT chr11 5305197 5305218 5305202 5305197 -
tcattgtttttttgtaaataca

SEQ ID NO: 129866 - DNA, 22 bp, Artificial Sequence
  Synthetic oligonucleotide; TTT chr11 5305196 5305217 5305201 5305196 -
cattgtttttttgtaaatacag

SEQ ID NO: 129867 - DNA, 22 bp, Artificial Sequence
  Synthetic oligonucleotide; TTC chr11 5305195 5305216 5305200 5305195 -
attgtttttttgtaaatacaga

SEQ ID NO: 129868 - DNA, 22 bp, Artificial Sequence
  Synthetic oligonucleotide; TTG chr11 5305191 5305212 5305196 5305191 -
tttttttgtaaatacagatcaa

SEQ ID NO: 129869 - DNA, 22 bp, Artificial Sequence
  Synthetic oligonucleotide; TTT chr11 5305188 5305209 5305193 5305188 -
ttttgtaaatacagatcaactt

SEQ ID NO: 129870 - DNA, 22 bp, Artificial Sequence
  Synthetic oligonucleotide; TTT chr11 5305187 5305208 5305192 5305187 -
tttgtaaatacagatcaacttt

SEQ ID NO: 129871 - DNA, 22 bp, Artificial Sequence
  Synthetic oligonucleotide; TTT chr11 5305186 5305207 5305191 5305186 -
ttgtaaatacagatcaactttg

SEQ ID NO: 129872 - DNA, 22 bp, Artificial Sequence
  Synthetic oligonucleotide; TTT chr11 5305185 5305206 5305190 5305185 -
tgtaaatacagatcaactttgc

SEQ ID NO: 129873 - DNA, 22 bp, Artificial Sequence
  Synthetic oligonucleotide; TTT chr11 5305184 5305205 5305189 5305184 -
gtaaatacagatcaactttgct

SEQ ID NO: 129874 - DNA, 22 bp, Artificial Sequence
  Synthetic oligonucleotide; TTG chr11 5305183 5305204 5305188 5305183 -
taaatacagatcaactttgcta

SEQ ID NO: 129875 - DNA, 22 bp, Artificial Sequence
  Synthetic oligonucleotide; CTT chr11 5305166 5305187 5305171 5305166 -
tgctatcctcttacatctgtgc

SEQ ID NO: 129876 - DNA, 22 bp, Artificial Sequence
  Synthetic oligonucleotide; TTT chr11 5305165 5305186 5305170 5305165 -
gctatcctcttacatctgtgcc

SEQ ID NO: 129877 - DNA, 22 bp, Artificial Sequence
  Synthetic oligonucleotide; TTG chr11 5305164 5305185 5305169 5305164 -
ctatcctcttacatctgtgcct

SEQ ID NO: 129878 - DNA, 22 bp, Artificial Sequence
  Synthetic oligonucleotide; CTA chr11 5305161 5305182 5305166 5305161 -
tcctcttacatctgtgcctgct

SEQ ID NO: 129879 - DNA, 22 bp, Artificial Sequence
  Synthetic oligonucleotide; CTC chr11 5305156 5305177 5305161 5305156 -
ttacatctgtgcctgcttcttt

SEQ ID NO: 129880 - DNA, 22 bp, Artificial Sequence
  Synthetic oligonucleotide; CTT chr11 5305154 5305175 5305159 5305154 -
acatctgtgcctgcttctttgt

SEQ ID NO: 129881 - DNA, 22 bp, Artificial Sequence
  Synthetic oligonucleotide; TTA chr11 5305153 5305174 5305158 5305153 -
catctgtgcctgcttctttgtc

SEQ ID NO: 129882 - DNA, 22 bp, Artificial Sequence
  Synthetic oligonucleotide; CTG chr11 5305147 5305168 5305152 5305147 -
tgcctgcttctttgtctatctc

SEQ ID NO: 129883 - DNA, 22 bp, Artificial Sequence
  Synthetic oligonucleotide; CTG chr11 5305141 5305162 5305146 5305141 -
cttctttgtctatctcctttga

SEQ ID NO: 129884 - DNA, 22 bp, Artificial Sequence
  Synthetic oligonucleotide; CTT chr11 5305138 5305159 5305143 5305138 -
ctttgtctatctcctttgagat

SEQ ID NO: 129885 - DNA, 22 bp, Artificial Sequence
  Synthetic oligonucleotide; TTC chr11 5305137 5305158 5305142 5305137 -
tttgtctatctcctttgagatc

SEQ ID NO: 129886 - DNA, 22 bp, Artificial Sequence
  Synthetic oligonucleotide; CTT chr11 5305135 5305156 5305140 5305135 -
tgtctatctcctttgagatctt

SEQ ID NO: 129887 - DNA, 22 bp, Artificial Sequence
  Synthetic oligonucleotide; TTT chr11 5305134 5305155 5305139 5305134 -
gtctatctcctttgagatcttt

SEQ ID NO: 129888 - DNA, 22 bp, Artificial Sequence
  Synthetic oligonucleotide; TTG chr11 5305133 5305154 5305138 5305133 -
tctatctcctttgagatctttc

SEQ ID NO: 129889 - DNA, 22 bp, Artificial Sequence
  Synthetic oligonucleotide; CTA chr11 5305129 5305150 5305134 5305129 -
tctcctttgagatctttctttt

SEQ ID NO: 129890 - DNA, 22 bp, Artificial Sequence
  Synthetic oligonucleotide; CTC chr11 5305125 5305146 5305130 5305125 -
ctttgagatctttctttttact

SEQ ID NO: 129891 - DNA, 22 bp, Artificial Sequence
  Synthetic oligonucleotide; CTT chr11 5305122 5305143 5305127 5305122 -
tgagatctttctttttactgag

SEQ ID NO: 129892 - DNA, 22 bp, Artificial Sequence
  Synthetic oligonucleotide; TTT chr11 5305121 5305142 5305126 5305121 -
gagatctttctttttactgaga

SEQ ID NO: 129893 - DNA, 22 bp, Artificial Sequence
  Synthetic oligonucleotide; TTG chr11 5305120 5305141 5305125 5305120 -
agatctttctttttactgagag

SEQ ID NO: 129894 - DNA, 22 bp, Artificial Sequence
  Synthetic oligonucleotide; CTT chr11 5305113 5305134 5305118 5305113 -
tctttttactgagagcaaaatt

SEQ ID NO: 129895 - DNA, 22 bp, Artificial Sequence
  Synthetic oligonucleotide; TTT chr11 5305112 5305133 5305117 5305112 -
ctttttactgagagcaaaattt

SEQ ID NO: 129896 - DNA, 22 bp, Artificial Sequence
  Synthetic oligonucleotide; TTC chr11 5305111 5305132 5305116 5305111 -
tttttactgagagcaaaatttg

SEQ ID NO: 129897 - DNA, 22 bp, Artificial Sequence
  Synthetic oligonucleotide; CTT chr11 5305109 5305130 5305114 5305109 -
tttactgagagcaaaatttgtc

SEQ ID NO: 129898 - DNA, 22 bp, Artificial Sequence
  Synthetic oligonucleotide; TTT chr11 5305108 5305129 5305113 5305108 -
ttactgagagcaaaatttgtcc

SEQ ID NO: 129899 - DNA, 22 bp, Artificial Sequence
  Synthetic oligonucleotide; TTT chr11 5305107 5305128 5305112 5305107 -
tactgagagcaaaatttgtcct

SEQ ID NO: 129900 - DNA, 22 bp, Artificial Sequence
  Synthetic oligonucleotide; TTT chr11 5305106 5305127 5305111 5305106 -
actgagagcaaaatttgtccta

SEQ ID NO: 129901 - DNA, 22 bp, Artificial Sequence
  Synthetic oligonucleotide; TTA chr11 5305105 5305126 5305110 5305105 -
ctgagagcaaaatttgtcctag

SEQ ID NO: 129902 - DNA, 22 bp, Artificial Sequence
  Synthetic oligonucleotide; CTG chr11 5305102 5305123 5305107 5305102 -
agagcaaaatttgtcctagttt

SEQ ID NO: 129903 - DNA, 22 bp, Artificial Sequence
  Synthetic oligonucleotide; TTT chr11 5305090 5305111 5305095 5305090 -
gtcctagtttcccaatgtttct

SEQ ID NO: 129904 - DNA, 22 bp, Artificial Sequence
  Synthetic oligonucleotide; TTG chr11 5305089 5305110 5305094 5305089 -
tcctagtttcccaatgtttctc

SEQ ID NO: 129905 - DNA, 22 bp, Artificial Sequence
  Synthetic oligonucleotide; CTA chr11 5305084 5305105 5305089 5305084 -
gtttcccaatgtttctctccaa

SEQ ID NO: 129906 - DNA, 22 bp, Artificial Sequence
  Synthetic oligonucleotide; TTT chr11 5305080 5305101 5305085 5305080 -
cccaatgtttctctccaaacct

SEQ ID NO: 129907 - DNA, 22 bp, Artificial Sequence
  Synthetic oligonucleotide; TTC chr11 5305079 5305100 5305084 5305079 -
ccaatgtttctctccaaacctt

SEQ ID NO: 129908 - DNA, 22 bp, Artificial Sequence
  Synthetic oligonucleotide; TTT chr11 5305070 5305091 5305075 5305070 -
ctctccaaaccttttttttttt

SEQ ID NO: 129909 - DNA, 22 bp, Artificial Sequence
  Synthetic oligonucleotide; TTC chr11 5305069 5305090 5305074 5305069 -
tctccaaacctttttttttttt

SEQ ID NO: 129910 - DNA, 22 bp, Artificial Sequence
  Synthetic oligonucleotide; CTC chr11 5305067 5305088 5305072 5305067 -
tccaaacctttttttttttttt

SEQ ID NO: 129911 - DNA, 22 bp, Artificial Sequence
  Synthetic oligonucleotide; CTC chr11 5305065 5305086 5305070 5305065 -
caaacctttttttttttttttt

SEQ ID NO: 129912 - DNA, 22 bp, Artificial Sequence
  Synthetic oligonucleotide; CTT chr11 5305057 5305078 5305062 5305057 -
ttttttttttttttttgagaca

SEQ ID NO: 129913 - DNA, 22 bp, Artificial Sequence
  Synthetic oligonucleotide; TTT chr11 5305056 5305077 5305061 5305056 -
tttttttttttttttgagacag

SEQ ID NO: 129914 - DNA, 22 bp, Artificial Sequence
  Synthetic oligonucleotide; TTT chr11 5305055 5305076 5305060 5305055 -
ttttttttttttttgagacaga

SEQ ID NO: 129915 - DNA, 22 bp, Artificial Sequence
  Synthetic oligonucleotide; TTT chr11 5305054 5305075 5305059 5305054 -
tttttttttttttgagacagag

SEQ ID NO: 129916 - DNA, 22 bp, Artificial Sequence
  Synthetic oligonucleotide; TTT chr11 5305053 5305074 5305058 5305053 -
ttttttttttttgagacagagc

SEQ ID NO: 129917 - DNA, 22 bp, Artificial Sequence
  Synthetic oligonucleotide; TTT chr11 5305052 5305073 5305057 5305052 -
tttttttttttgagacagagcc

SEQ ID NO: 129918 - DNA, 22 bp, Artificial Sequence
  Synthetic oligonucleotide; TTT chr11 5305051 5305072 5305056 5305051 -
ttttttttttgagacagagcct

SEQ ID NO: 129919 - DNA, 22 bp, Artificial Sequence
  Synthetic oligonucleotide; TTT chr11 5305050 5305071 5305055 5305050 -
tttttttttgagacagagcctt

SEQ ID NO: 129920 - DNA, 22 bp, Artificial Sequence
  Synthetic oligonucleotide; TTT chr11 5305049 5305070 5305054 5305049 -
ttttttttgagacagagccttg

SEQ ID NO: 129921 - DNA, 22 bp, Artificial Sequence
  Synthetic oligonucleotide; TTT chr11 5305048 5305069 5305053 5305048 -
tttttttgagacagagccttgc

SEQ ID NO: 129922 - DNA, 22 bp, Artificial Sequence
  Synthetic oligonucleotide; TTT chr11 5305047 5305068 5305052 5305047 -
ttttttgagacagagccttgct

SEQ ID NO: 129923 - DNA, 22 bp, Artificial Sequence
  Synthetic oligonucleotide; TTT chr11 5305046 5305067 5305051 5305046 -
tttttgagacagagccttgctt

SEQ ID NO: 129924 - DNA, 22 bp, Artificial Sequence
  Synthetic oligonucleotide; TTT chr11 5305045 5305066 5305050 5305045 -
ttttgagacagagccttgcttt

SEQ ID NO: 129925 - DNA, 22 bp, Artificial Sequence
  Synthetic oligonucleotide; TTT chr11 5305044 5305065 5305049 5305044 -
tttgagacagagccttgctttg

SEQ ID NO: 129926 - DNA, 22 bp, Artificial Sequence
  Synthetic oligonucleotide; TTT chr11 5305043 5305064 5305048 5305043 -
ttgagacagagccttgctttgt

SEQ ID NO: 129927 - DNA, 22 bp, Artificial Sequence
  Synthetic oligonucleotide; TTT chr11 5305042 5305063 5305047 5305042 -
tgagacagagccttgctttgtc

SEQ ID NO: 129928 - DNA, 22 bp, Artificial Sequence
  Synthetic oligonucleotide; TTT chr11 5305041 5305062 5305046 5305041 -
gagacagagccttgctttgtcg

SEQ ID NO: 129929 - DNA, 22 bp, Artificial Sequence
  Synthetic oligonucleotide; TTG chr11 5305040 5305061 5305045 5305040 -
agacagagccttgctttgtcgc

SEQ ID NO: 129930 - DNA, 22 bp, Artificial Sequence
  Synthetic oligonucleotide; CTT chr11 5305028 5305049 5305033 5305028 -
gctttgtcgcccaggctgtagt

SEQ ID NO: 129931 - DNA, 22 bp, Artificial Sequence
  Synthetic oligonucleotide; TTG chr11 5305027 5305048 5305032 5305027 -
ctttgtcgcccaggctgtagtg

SEQ ID NO: 129932 - DNA, 22 bp, Artificial Sequence
  Synthetic oligonucleotide; CTT chr11 5305024 5305045 5305029 5305024 -
tgtcgcccaggctgtagtgcag

SEQ ID NO: 129933 - DNA, 22 bp, Artificial Sequence
  Synthetic oligonucleotide; TTT chr11 5305023 5305044 5305028 5305023 -
gtcgcccaggctgtagtgcagt

SEQ ID NO: 129934 - DNA, 22 bp, Artificial Sequence
  Synthetic oligonucleotide; TTG chr11 5305022 5305043 5305027 5305022 -
tcgcccaggctgtagtgcagtg

SEQ ID NO: 129935 - DNA, 22 bp, Artificial Sequence
  Synthetic oligonucleotide; CTG chr11 5305010 5305031 5305015 5305010 -
tagtgcagtggcacaatcttgg

SEQ ID NO: 129936 - DNA, 22 bp, Artificial Sequence
  Synthetic oligonucleotide; CTT chr11 5304990 5305011 5304995 5304990 -
ggctcactgcgacgacctctgc

SEQ ID NO: 129937 - DNA, 22 bp, Artificial Sequence
  Synthetic oligonucleotide; TTG chr11 5304989 5305010 5304994 5304989 -
gctcactgcgacgacctctgct

SEQ ID NO: 129938 - DNA, 22 bp, Artificial Sequence
  Synthetic oligonucleotide; CTC chr11 5304985 5305006 5304990 5304985 -
actgcgacgacctctgctcccc

SEQ ID NO: 129939 - DNA, 22 bp, Artificial Sequence
  Synthetic oligonucleotide; CTG chr11 5304981 5305002 5304986 5304981 -
cgacgacctctgctccccagtt

SEQ ID NO: 129940 - DNA, 22 bp, Artificial Sequence
  Synthetic oligonucleotide; CTC chr11 5304971 5304992 5304976 5304971 -
tgctccccagtttttttaaagc

SEQ ID NO: 129941 - DNA, 22 bp, Artificial Sequence
  Synthetic oligonucleotide; CTG chr11 5304969 5304990 5304974 5304969 -
ctccccagtttttttaaagcaa

SEQ ID NO: 129942 - DNA, 22 bp, Artificial Sequence
  Synthetic oligonucleotide; CTC chr11 5304966 5304987 5304971 5304966 -
cccagtttttttaaagcaattc

SEQ ID NO: 129943 - DNA, 22 bp, Artificial Sequence
  Synthetic oligonucleotide; TTT chr11 5304958 5304979 5304963 5304958 -
ttttaaagcaattctcctgcct

SEQ ID NO: 129944 - DNA, 22 bp, Artificial Sequence
  Synthetic oligonucleotide; TTT chr11 5304957 5304978 5304962 5304957 -
tttaaagcaattctcctgcctc

SEQ ID NO: 129945 - DNA, 22 bp, Artificial Sequence
  Synthetic oligonucleotide; TTT chr11 5304956 5304977 5304961 5304956 -
ttaaagcaattctcctgcctca

SEQ ID NO: 129946 - DNA, 22 bp, Artificial Sequence
  Synthetic oligonucleotide; TTT chr11 5304955 5304976 5304960 5304955 -
taaagcaattctcctgcctcag

SEQ ID NO: 129947 - DNA, 22 bp, Artificial Sequence
  Synthetic oligonucleotide; TTT chr11 5304954 5304975 5304959 5304954 -
aaagcaattctcctgcctcagc

SEQ ID NO: 129948 - DNA, 22 bp, Artificial Sequence
  Synthetic oligonucleotide; TTA chr11 5304953 5304974 5304958 5304953 -
aagcaattctcctgcctcagcc

SEQ ID NO: 129949 - DNA, 22 bp, Artificial Sequence
  Synthetic oligonucleotide; TTC chr11 5304944 5304965 5304949 5304944 -
tcctgcctcagcctcccgagta

SEQ ID NO: 129950 - DNA, 22 bp, Artificial Sequence
  Synthetic oligonucleotide; CTC chr11 5304942 5304963 5304947 5304942 -
ctgcctcagcctcccgagtagc

SEQ ID NO: 129951 - DNA, 22 bp, Artificial Sequence
  Synthetic oligonucleotide; CTG chr11 5304939 5304960 5304944 5304939 -
cctcagcctcccgagtagctgg

SEQ ID NO: 129952 - DNA, 22 bp, Artificial Sequence
  Synthetic oligonucleotide; CTC chr11 5304935 5304956 5304940 5304935 -
agcctcccgagtagctgggatt

SEQ ID NO: 129953 - DNA, 22 bp, Artificial Sequence
  Synthetic oligonucleotide; CTC chr11 5304929 5304950 5304934 5304929 -
ccgagtagctgggattacaggc

SEQ ID NO: 129954 - DNA, 22 bp, Artificial Sequence
  Synthetic oligonucleotide; CTG chr11 5304918 5304939 5304923 5304918 -
ggattacaggcgctcaccacca

SEQ ID NO: 129955 - DNA, 22 bp, Artificial Sequence
  Synthetic oligonucleotide; TTA chr11 5304912 5304933 5304917 5304912 -
caggcgctcaccaccacaccca

SEQ ID NO: 129956 - DNA, 22 bp, Artificial Sequence
  Synthetic oligonucleotide; CTC chr11 5304903 5304924 5304908 5304903 -
accaccacacccagctaatttt

SEQ ID NO: 129957 - DNA, 22 bp, Artificial Sequence
  Synthetic oligonucleotide; CTA chr11 5304886 5304907 5304891 5304886 -
atttttgtatttttagtagaga

SEQ ID NO: 129958 - DNA, 22 bp, Artificial Sequence
  Synthetic oligonucleotide; TTT chr11 5304882 5304903 5304887 5304882 -
ttgtatttttagtagagacagg

SEQ ID NO: 129959 - DNA, 22 bp, Artificial Sequence
  Synthetic oligonucleotide; TTT chr11 5304881 5304902 5304886 5304881 -
tgtatttttagtagagacaggg

SEQ ID NO: 129960 - DNA, 22 bp, Artificial Sequence
  Synthetic oligonucleotide; TTT chr11 5304880 5304901 5304885 5304880 -
gtatttttagtagagacagggt

SEQ ID NO: 129961 - DNA, 22 bp, Artificial Sequence
  Synthetic oligonucleotide; TTG chr11 5304879 5304900 5304884 5304879 -
tatttttagtagagacagggtt

SEQ ID NO: 129962 - DNA, 22 bp, Artificial Sequence
  Synthetic oligonucleotide; TTT chr11 5304874 5304895 5304879 5304874 -
ttagtagagacagggtttcacc

SEQ ID NO: 129963 - DNA, 22 bp, Artificial Sequence
  Synthetic oligonucleotide; TTT chr11 5304873 5304894 5304878 5304873 -
tagtagagacagggtttcacca

SEQ ID NO: 129964 - DNA, 22 bp, Artificial Sequence
  Synthetic oligonucleotide; TTT chr11 5304872 5304893 5304877 5304872 -
agtagagacagggtttcaccat

SEQ ID NO: 129965 - DNA, 22 bp, Artificial Sequence
  Synthetic oligonucleotide; TTA chr11 5304871 5304892 5304876 5304871 -
gtagagacagggtttcaccatg

SEQ ID NO: 129966 - DNA, 22 bp, Artificial Sequence
  Synthetic oligonucleotide; TTT chr11 5304856 5304877 5304861 5304856 -
caccatgttggccaggctagtc

SEQ ID NO: 129967 - DNA, 22 bp, Artificial Sequence
  Synthetic oligonucleotide; TTC chr11 5304855 5304876 5304860 5304855 -
accatgttggccaggctagtct

SEQ ID NO: 129968 - DNA, 22 bp, Artificial Sequence
  Synthetic oligonucleotide; TTG chr11 5304846 5304867 5304851 5304846 -
gccaggctagtctcaaactgct

SEQ ID NO: 129969 - DNA, 22 bp, Artificial Sequence
  Synthetic oligonucleotide; CTA chr11 5304837 5304858 5304842 5304837 -
gtctcaaactgctgacctcgtg

SEQ ID NO: 129970 - DNA, 22 bp, Artificial Sequence
  Synthetic oligonucleotide; CTC chr11 5304832 5304853 5304837 5304832 -
aaactgctgacctcgtgatcca

SEQ ID NO: 129971 - DNA, 22 bp, Artificial Sequence
  Synthetic oligonucleotide; CTG chr11 5304826 5304847 5304831 5304826 -
ctgacctcgtgatccacctcag

SEQ ID NO: 129972 - DNA, 22 bp, Artificial Sequence
  Synthetic oligonucleotide; CTG chr11 5304823 5304844 5304828 5304823 -
acctcgtgatccacctcagcct

SEQ ID NO: 129973 - DNA, 22 bp, Artificial Sequence
  Synthetic oligonucleotide; CTC chr11 5304818 5304839 5304823 5304818 -
gtgatccacctcagccttccaa

SEQ ID NO: 129974 - DNA, 22 bp, Artificial Sequence
  Synthetic oligonucleotide; CTC chr11 5304806 5304827 5304811 5304806 -
agccttccaaagtgctaggatt

SEQ ID NO: 129975 - DNA, 22 bp, Artificial Sequence
  Synthetic oligonucleotide; CTT chr11 5304800 5304821 5304805 5304800 -
ccaaagtgctaggattacaggc

SEQ ID NO: 129976 - DNA, 22 bp, Artificial Sequence
  Synthetic oligonucleotide; TTC chr11 5304799 5304820 5304804 5304799 -
caaagtgctaggattacaggca

SEQ ID NO: 129977 - DNA, 22 bp, Artificial Sequence
  Synthetic oligonucleotide; CTA chr11 5304789 5304810 5304794 5304789 -
ggattacaggcatgagcctctg

SEQ ID NO: 129978 - DNA, 22 bp, Artificial Sequence
  Synthetic oligonucleotide; TTA chr11 5304783 5304804 5304788 5304783 -
caggcatgagcctctgtgcctg

SEQ ID NO: 129979 - DNA, 22 bp, Artificial Sequence
  Synthetic oligonucleotide; CTC chr11 5304769 5304790 5304774 5304769 -
tgtgcctggccacctcttccat

SEQ ID NO: 129980 - DNA, 22 bp, Artificial Sequence
  Synthetic oligonucleotide; CTG chr11 5304767 5304788 5304772 5304767 -
tgcctggccacctcttccattt

SEQ ID NO: 129981 - DNA, 22 bp, Artificial Sequence
  Synthetic oligonucleotide; CTG chr11 5304761 5304782 5304766 5304761 -
gccacctcttccattttaattt

SEQ ID NO: 129982 - DNA, 22 bp, Artificial Sequence
  Synthetic oligonucleotide; CTC chr11 5304753 5304774 5304758 5304753 -
ttccattttaatttgtacttaa

SEQ ID NO: 129983 - DNA, 22 bp, Artificial Sequence
  Synthetic oligonucleotide; CTT chr11 5304751 5304772 5304756 5304751 -
ccattttaatttgtacttaagg

SEQ ID NO: 129984 - DNA, 22 bp, Artificial Sequence
  Synthetic oligonucleotide; TTC chr11 5304750 5304771 5304755 5304750 -
cattttaatttgtacttaaggt

SEQ ID NO: 129985 - DNA, 22 bp, Artificial Sequence
  Synthetic oligonucleotide; TTT chr11 5304745 5304766 5304750 5304745 -
taatttgtacttaaggtaagat

SEQ ID NO: 129986 - DNA, 22 bp, Artificial Sequence
  Synthetic oligonucleotide; TTT chr11 5304744 5304765 5304749 5304744 -
aatttgtacttaaggtaagata

SEQ ID NO: 129987 - DNA, 22 bp, Artificial Sequence
  Synthetic oligonucleotide; TTA chr11 5304743 5304764 5304748 5304743 -
atttgtacttaaggtaagatat

SEQ ID NO: 129988 - DNA, 22 bp, Artificial Sequence
  Synthetic oligonucleotide; TTT chr11 5304739 5304760 5304744 5304739 -
gtacttaaggtaagatataaaa

SEQ ID NO: 129989 - DNA, 22 bp, Artificial Sequence
  Synthetic oligonucleotide; TTG chr11 5304738 5304759 5304743 5304738 -
tacttaaggtaagatataaaaa

SEQ ID NO: 129990 - DNA, 22 bp, Artificial Sequence
  Synthetic oligonucleotide; CTT chr11 5304733 5304754 5304738 5304733 -
aaggtaagatataaaaaagtca

SEQ ID NO: 129991 - DNA, 22 bp, Artificial Sequence
  Synthetic oligonucleotide; TTA chr11 5304732 5304753 5304737 5304732 -
aggtaagatataaaaaagtcac

SEQ ID NO: 129992 - DNA, 22 bp, Artificial Sequence
  Synthetic oligonucleotide; CTT chr11 5304708 5304729 5304713 5304708 -
aaaagctgagatttttcagata

SEQ ID NO: 129993 - DNA, 22 bp, Artificial Sequence
  Synthetic oligonucleotide; TTA chr11 5304707 5304728 5304712 5304707 -
aaagctgagatttttcagatat

SEQ ID NO: 129994 - DNA, 22 bp, Artificial Sequence
  Synthetic oligonucleotide; CTG chr11 5304700 5304721 5304705 5304700 -
agatttttcagatattttgtct

SEQ ID NO: 129995 - DNA, 22 bp, Artificial Sequence
  Synthetic oligonucleotide; TTT chr11 5304694 5304715 5304699 5304694 -
ttcagatattttgtcttcatct

SEQ ID NO: 129996 - DNA, 22 bp, Artificial Sequence
  Synthetic oligonucleotide; TTT chr11 5304693 5304714 5304698 5304693 -
tcagatattttgtcttcatctc

SEQ ID NO: 129997 - DNA, 22 bp, Artificial Sequence
  Synthetic oligonucleotide; TTT chr11 5304692 5304713 5304697 5304692 -
cagatattttgtcttcatctca

SEQ ID NO: 129998 - DNA, 22 bp, Artificial Sequence
  Synthetic oligonucleotide; TTC chr11 5304691 5304712 5304696 5304691 -
agatattttgtcttcatctcat

SEQ ID NO: 129999 - DNA, 22 bp, Artificial Sequence
  Synthetic oligonucleotide; TTT chr11 5304683 5304704 5304688 5304683 -
tgtcttcatctcatggcttccc

SEQ ID NO: 130000 - DNA, 22 bp, Artificial Sequence
  Synthetic oligonucleotide; TTT chr11 5304682 5304703 5304687 5304682 -
gtcttcatctcatggcttccca

SEQ ID NO: 130001 - DNA, 22 bp, Artificial Sequence
  Synthetic oligonucleotide; TTG chr11 5304681 5304702 5304686 5304681 -
tcttcatctcatggcttcccat

SEQ ID NO: 130002 - DNA, 22 bp, Artificial Sequence
  Synthetic oligonucleotide; CTT chr11 5304677 5304698 5304682 5304677 -
catctcatggcttcccattgtc

SEQ ID NO: 130003 - DNA, 22 bp, Artificial Sequence
  Synthetic oligonucleotide; TTC chr11 5304676 5304697 5304681 5304676 -
atctcatggcttcccattgtca

SEQ ID NO: 130004 - DNA, 22 bp, Artificial Sequence
  Synthetic oligonucleotide; CTC chr11 5304671 5304692 5304676 5304671 -
atggcttcccattgtcagttga

SEQ ID NO: 130005 - DNA, 22 bp, Artificial Sequence
  Synthetic oligonucleotide; CTT chr11 5304664 5304685 5304669 5304664 -
cccattgtcagttgactttaaa

SEQ ID NO: 130006 - DNA, 22 bp, Artificial Sequence
  Synthetic oligonucleotide; TTC chr11 5304663 5304684 5304668 5304663 -
ccattgtcagttgactttaaat

SEQ ID NO: 130007 - DNA, 22 bp, Artificial Sequence
  Synthetic oligonucleotide; TTG chr11 5304657 5304678 5304662 5304657 -
tcagttgactttaaatatttat

SEQ ID NO: 130008 - DNA, 22 bp, Artificial Sequence
  Synthetic oligonucleotide; TTG chr11 5304650 5304671 5304655 5304650 -
actttaaatatttattttggta

SEQ ID NO: 130009 - DNA, 22 bp, Artificial Sequence
  Synthetic oligonucleotide; CTT chr11 5304646 5304667 5304651 5304646 -
taaatatttattttggtatatt

SEQ ID NO: 130010 - DNA, 22 bp, Artificial Sequence
  Synthetic oligonucleotide; TTT chr11 5304645 5304666 5304650 5304645 -
aaatatttattttggtatattt

SEQ ID NO: 130011 - DNA, 22 bp, Artificial Sequence
  Synthetic oligonucleotide; TTA chr11 5304644 5304665 5304649 5304644 -
aatatttattttggtatattta

SEQ ID NO: 130012 - DNA, 22 bp, Artificial Sequence
  Synthetic oligonucleotide; TTT chr11 5304637 5304658 5304642 5304637 -
attttggtatatttattaattt

SEQ ID NO: 130013 - DNA, 22 bp, Artificial Sequence
  Synthetic oligonucleotide; TTA chr11 5304636 5304657 5304641 5304636 -
ttttggtatatttattaatttc

SEQ ID NO: 130014 - DNA, 22 bp, Artificial Sequence
  Synthetic oligonucleotide; TTT chr11 5304633 5304654 5304638 5304633 -
tggtatatttattaatttcttc

SEQ ID NO: 130015 - DNA, 22 bp, Artificial Sequence
  Synthetic oligonucleotide; TTT chr11 5304632 5304653 5304637 5304632 -
ggtatatttattaatttcttct

SEQ ID NO: 130016 - DNA, 22 bp, Artificial Sequence
  Synthetic oligonucleotide; TTG chr11 5304631 5304652 5304636 5304631 -
gtatatttattaatttcttcta

SEQ ID NO: 130017 - DNA, 22 bp, Artificial Sequence
  Synthetic oligonucleotide; TTT chr11 5304623 5304644 5304628 5304623 -
attaatttcttctataggaaca

SEQ ID NO: 130018 - DNA, 22 bp, Artificial Sequence
  Synthetic oligonucleotide; TTA chr11 5304622 5304643 5304627 5304622 -
ttaatttcttctataggaacac

SEQ ID NO: 130019 - DNA, 22 bp, Artificial Sequence
  Synthetic oligonucleotide; TTA chr11 5304619 5304640 5304624 5304619 -
atttcttctataggaacacaat

SEQ ID NO: 130020 - DNA, 22 bp, Artificial Sequence
  Synthetic oligonucleotide; TTT chr11 5304615 5304636 5304620 5304615 -
cttctataggaacacaattttg

SEQ ID NO: 130021 - DNA, 22 bp, Artificial Sequence
  Synthetic oligonucleotide; TTC chr11 5304614 5304635 5304619 5304614 -
ttctataggaacacaattttgg

SEQ ID NO: 130022 - DNA, 22 bp, Artificial Sequence
  Synthetic oligonucleotide; CTT chr11 5304612 5304633 5304617 5304612 -
ctataggaacacaattttgggg

SEQ ID NO: 130023 - DNA, 22 bp, Artificial Sequence
  Synthetic oligonucleotide; TTC chr11 5304611 5304632 5304616 5304611 -
tataggaacacaattttggggc

SEQ ID NO: 130024 - DNA, 22 bp, Artificial Sequence
  Synthetic oligonucleotide; CTA chr11 5304609 5304630 5304614 5304609 -
taggaacacaattttggggcaa

SEQ ID NO: 130025 - DNA, 22 bp, Artificial Sequence
  Synthetic oligonucleotide; TTT chr11 5304595 5304616 5304600 5304595 -
tggggcaatatgtggagatgaa

SEQ ID NO: 130026 - DNA, 22 bp, Artificial Sequence
  Synthetic oligonucleotide; TTT chr11 5304594 5304615 5304599 5304594 -
ggggcaatatgtggagatgaaa

SEQ ID NO: 130027 - DNA, 22 bp, Artificial Sequence
  Synthetic oligonucleotide; TTG chr11 5304593 5304614 5304598 5304593 -
gggcaatatgtggagatgaaaa

SEQ ID NO: 130028 - DNA, 22 bp, Artificial Sequence
  Synthetic oligonucleotide; TTC chr11 5304562 5304583 5304567 5304562 -
aggggacactgattgtacaggg

SEQ ID NO: 130029 - DNA, 22 bp, Artificial Sequence
  Synthetic oligonucleotide; CTG chr11 5304551 5304572 5304556 5304551 -
attgtacagggcacttgcagat

SEQ ID NO: 130030 - DNA, 22 bp, Artificial Sequence
  Synthetic oligonucleotide; TTG chr11 5304547 5304568 5304552 5304547 -
tacagggcacttgcagattatc

SEQ ID NO: 130031 - DNA, 22 bp, Artificial Sequence
  Synthetic oligonucleotide; CTT chr11 5304535 5304556 5304540 5304535 -
gcagattatctggaactaaacg

SEQ ID NO: 130032 - DNA, 22 bp, Artificial Sequence
  Synthetic oligonucleotide; TTG chr11 5304534 5304555 5304539 5304534 -
cagattatctggaactaaacgg

SEQ ID NO: 130033 - DNA, 22 bp, Artificial Sequence
  Synthetic oligonucleotide; TTA chr11 5304527 5304548 5304532 5304527 -
tctggaactaaacggaagactg

SEQ ID NO: 130034 - DNA, 22 bp, Artificial Sequence
  Synthetic oligonucleotide; CTG chr11 5304523 5304544 5304528 5304523 -
gaactaaacggaagactgttct

SEQ ID NO: 130035 - DNA, 22 bp, Artificial Sequence
  Synthetic oligonucleotide; CTA chr11 5304517 5304538 5304522 5304517 -
aacggaagactgttctttttta

SEQ ID NO: 130036 - DNA, 22 bp, Artificial Sequence
  Synthetic oligonucleotide; CTG chr11 5304505 5304526 5304510 5304505 -
ttcttttttaacacgatcttaa

SEQ ID NO: 130037 - DNA, 22 bp, Artificial Sequence
  Synthetic oligonucleotide; TTC chr11 5304502 5304523 5304507 5304502 -
ttttttaacacgatcttaatat

SEQ ID NO: 130038 - DNA, 22 bp, Artificial Sequence
  Synthetic oligonucleotide; CTT chr11 5304500 5304521 5304505 5304500 -
ttttaacacgatcttaatattc

SEQ ID NO: 130039 - DNA, 22 bp, Artificial Sequence
  Synthetic oligonucleotide; TTT chr11 5304499 5304520 5304504 5304499 -
tttaacacgatcttaatattct

SEQ ID NO: 130040 - DNA, 22 bp, Artificial Sequence
  Synthetic oligonucleotide; TTT chr11 5304498 5304519 5304503 5304498 -
ttaacacgatcttaatattctc

SEQ ID NO: 130041 - DNA, 22 bp, Artificial Sequence
  Synthetic oligonucleotide; TTT chr11 5304497 5304518 5304502 5304497 -
taacacgatcttaatattctct

SEQ ID NO: 130042 - DNA, 22 bp, Artificial Sequence
  Synthetic oligonucleotide; TTT chr11 5304496 5304517 5304501 5304496 -
aacacgatcttaatattctctt

SEQ ID NO: 130043 - DNA, 22 bp, Artificial Sequence
  Synthetic oligonucleotide; TTA chr11 5304495 5304516 5304500 5304495 -
acacgatcttaatattctcttt

SEQ ID NO: 130044 - DNA, 22 bp, Artificial Sequence
  Synthetic oligonucleotide; CTT chr11 5304485 5304506 5304490 5304485 -
aatattctctttttgtcttctc

SEQ ID NO: 130045 - DNA, 22 bp, Artificial Sequence
  Synthetic oligonucleotide; TTA chr11 5304484 5304505 5304489 5304484 -
atattctctttttgtcttctca

SEQ ID NO: 130046 - DNA, 22 bp, Artificial Sequence
  Synthetic oligonucleotide; TTC chr11 5304478 5304499 5304483 5304478 -
tctttttgtcttctcattttag

SEQ ID NO: 130047 - DNA, 22 bp, Artificial Sequence
  Synthetic oligonucleotide; CTC chr11 5304476 5304497 5304481 5304476 -
tttttgtcttctcattttagtt

SEQ ID NO: 130048 - DNA, 22 bp, Artificial Sequence
  Synthetic oligonucleotide; CTT chr11 5304474 5304495 5304479 5304474 -
tttgtcttctcattttagttta

SEQ ID NO: 130049 - DNA, 22 bp, Artificial Sequence
  Synthetic oligonucleotide; TTT chr11 5304473 5304494 5304478 5304473 -
ttgtcttctcattttagtttat

SEQ ID NO: 130050 - DNA, 22 bp, Artificial Sequence
  Synthetic oligonucleotide; TTT chr11 5304472 5304493 5304477 5304472 -
tgtcttctcattttagtttatg

SEQ ID NO: 130051 - DNA, 22 bp, Artificial Sequence
  Synthetic oligonucleotide; TTT chr11 5304471 5304492 5304476 5304471 -
gtcttctcattttagtttatgt

SEQ ID NO: 130052 - DNA, 22 bp, Artificial Sequence
  Synthetic oligonucleotide; TTG chr11 5304470 5304491 5304475 5304470 -
tcttctcattttagtttatgtc

SEQ ID NO: 130053 - DNA, 22 bp, Artificial Sequence
  Synthetic oligonucleotide; CTT chr11 5304466 5304487 5304471 5304466 -
ctcattttagtttatgtcttta

SEQ ID NO: 130054 - DNA, 22 bp, Artificial Sequence
  Synthetic oligonucleotide; TTC chr11 5304465 5304486 5304470 5304465 -
tcattttagtttatgtctttat

SEQ ID NO: 130055 - DNA, 22 bp, Artificial Sequence
  Synthetic oligonucleotide; CTC chr11 5304463 5304484 5304468 5304463 -
attttagtttatgtctttataa

SEQ ID NO: 130056 - DNA, 22 bp, Artificial Sequence
  Synthetic oligonucleotide; TTT chr11 5304459 5304480 5304464 5304459 -
tagtttatgtctttataaatgg

SEQ ID NO: 130057 - DNA, 22 bp, Artificial Sequence
  Synthetic oligonucleotide; TTT chr11 5304458 5304479 5304463 5304458 -
agtttatgtctttataaatggt

SEQ ID NO: 130058 - DNA, 22 bp, Artificial Sequence
  Synthetic oligonucleotide; TTA chr11 5304457 5304478 5304462 5304457 -
gtttatgtctttataaatggtt

SEQ ID NO: 130059 - DNA, 22 bp, Artificial Sequence
  Synthetic oligonucleotide; TTT chr11 5304453 5304474 5304458 5304453 -
atgtctttataaatggtttcct

SEQ ID NO: 130060 - DNA, 22 bp, Artificial Sequence
  Synthetic oligonucleotide; TTA chr11 5304452 5304473 5304457 5304452 -
tgtctttataaatggtttcctg

SEQ ID NO: 130061 - DNA, 22 bp, Artificial Sequence
  Synthetic oligonucleotide; CTT chr11 5304446 5304467 5304451 5304446 -
tataaatggtttcctgaacagt

SEQ ID NO: 130062 - DNA, 22 bp, Artificial Sequence
  Synthetic oligonucleotide; TTT chr11 5304445 5304466 5304450 5304445 -
ataaatggtttcctgaacagtt

SEQ ID NO: 130063 - DNA, 22 bp, Artificial Sequence
  Synthetic oligonucleotide; TTA chr11 5304444 5304465 5304449 5304444 -
taaatggtttcctgaacagttc

SEQ ID NO: 130064 - DNA, 22 bp, Artificial Sequence
  Synthetic oligonucleotide; TTT chr11 5304434 5304455 5304439 5304434 -
cctgaacagttcctaagctttt

SEQ ID NO: 130065 - DNA, 22 bp, Artificial Sequence
  Synthetic oligonucleotide; TTC chr11 5304433 5304454 5304438 5304433 -
ctgaacagttcctaagcttttt

SEQ ID NO: 130066 - DNA, 22 bp, Artificial Sequence
  Synthetic oligonucleotide; CTG chr11 5304430 5304451 5304435 5304430 -
aacagttcctaagctttttgtc

SEQ ID NO: 130067 - DNA, 22 bp, Artificial Sequence
  Synthetic oligonucleotide; TTC chr11 5304422 5304443 5304427 5304422 -
ctaagctttttgtcagcatggc

SEQ ID NO: 130068 - DNA, 22 bp, Artificial Sequence
  Synthetic oligonucleotide; CTA chr11 5304419 5304440 5304424 5304419 -
agctttttgtcagcatggcaag

SEQ ID NO: 130069 - DNA, 22 bp, Artificial Sequence
  Synthetic oligonucleotide; CTT chr11 5304414 5304435 5304419 5304414 -
tttgtcagcatggcaagttgaa

SEQ ID NO: 130070 - DNA, 22 bp, Artificial Sequence
  Synthetic oligonucleotide; TTT chr11 5304413 5304434 5304418 5304413 -
ttgtcagcatggcaagttgaag

SEQ ID NO: 130071 - DNA, 22 bp, Artificial Sequence
  Synthetic oligonucleotide; TTT chr11 5304412 5304433 5304417 5304412 -
tgtcagcatggcaagttgaaga

SEQ ID NO: 130072 - DNA, 22 bp, Artificial Sequence
  Synthetic oligonucleotide; TTT chr11 5304411 5304432 5304416 5304411 -
gtcagcatggcaagttgaagaa

SEQ ID NO: 130073 - DNA, 22 bp, Artificial Sequence
  Synthetic oligonucleotide; TTG chr11 5304410 5304431 5304415 5304410 -
tcagcatggcaagttgaagaag

SEQ ID NO: 130074 - DNA, 22 bp, Artificial Sequence
  Synthetic oligonucleotide; TTG chr11 5304394 5304415 5304399 5304394 -
aagaagctctggatgatggatc

SEQ ID NO: 130075 - DNA, 22 bp, Artificial Sequence
  Synthetic oligonucleotide; CTC chr11 5304385 5304406 5304390 5304385 -
tggatgatggatctatgttacc

SEQ ID NO: 130076 - DNA, 22 bp, Artificial Sequence
  Synthetic oligonucleotide; CTG chr11 5304383 5304404 5304388 5304383 -
gatgatggatctatgttacctt

SEQ ID NO: 130077 - DNA, 22 bp, Artificial Sequence
  Synthetic oligonucleotide; CTA chr11 5304370 5304391 5304375 5304370 -
tgttaccttcagaaactcttga

SEQ ID NO: 130078 - DNA, 22 bp, Artificial Sequence
  Synthetic oligonucleotide; TTA chr11 5304365 5304386 5304370 5304365 -
ccttcagaaactcttgaggact

SEQ ID NO: 130079 - DNA, 22 bp, Artificial Sequence
  Synthetic oligonucleotide; CTT chr11 5304361 5304382 5304366 5304361 -
cagaaactcttgaggactctgg

SEQ ID NO: 130080 - DNA, 22 bp, Artificial Sequence
  Synthetic oligonucleotide; TTC chr11 5304360 5304381 5304365 5304360 -
agaaactcttgaggactctggg

SEQ ID NO: 130081 - DNA, 22 bp, Artificial Sequence
  Synthetic oligonucleotide; CTC chr11 5304352 5304373 5304357 5304352 -
ttgaggactctgggatagttgc

SEQ ID NO: 130082 - DNA, 22 bp, Artificial Sequence
  Synthetic oligonucleotide; CTT chr11 5304350 5304371 5304355 5304350 -
gaggactctgggatagttgctg

SEQ ID NO: 130083 - DNA, 22 bp, Artificial Sequence
  Synthetic oligonucleotide; TTG chr11 5304349 5304370 5304354 5304349 -
aggactctgggatagttgctgt

SEQ ID NO: 130084 - DNA, 22 bp, Artificial Sequence
  Synthetic oligonucleotide; CTC chr11 5304342 5304363 5304347 5304342 -
tgggatagttgctgtcaaagaa

SEQ ID NO: 130085 - DNA, 22 bp, Artificial Sequence
  Synthetic oligonucleotide; CTG chr11 5304340 5304361 5304345 5304340 -
ggatagttgctgtcaaagaatc

SEQ ID NO: 130086 - DNA, 22 bp, Artificial Sequence
  Synthetic oligonucleotide; TTG chr11 5304331 5304352 5304336 5304331 -
ctgtcaaagaatcagtccaaag

SEQ ID NO: 130087 - DNA, 22 bp, Artificial Sequence
  Synthetic oligonucleotide; CTG chr11 5304328 5304349 5304333 5304328 -
tcaaagaatcagtccaaaggca

SEQ ID NO: 130088 - DNA, 22 bp, Artificial Sequence
  Synthetic oligonucleotide; CTC chr11 5304303 5304324 5304308 5304303 -
agaaaggggcaagagaacagtg

SEQ ID NO: 130089 - DNA, 22 bp, Artificial Sequence
  Synthetic oligonucleotide; TTT chr11 5304269 5304290 5304274 5304269 -
ttgcatccctcagggggcctct

SEQ ID NO: 130090 - DNA, 22 bp, Artificial Sequence
  Synthetic oligonucleotide; TTT chr11 5304268 5304289 5304273 5304268 -
tgcatccctcagggggcctcta

SEQ ID NO: 130091 - DNA, 22 bp, Artificial Sequence
  Synthetic oligonucleotide; TTT chr11 5304267 5304288 5304272 5304267 -
gcatccctcagggggcctctat

SEQ ID NO: 130092 - DNA, 22 bp, Artificial Sequence
  Synthetic oligonucleotide; TTG chr11 5304266 5304287 5304271 5304266 -
catccctcagggggcctctatg

SEQ ID NO: 130093 - DNA, 22 bp, Artificial Sequence
  Synthetic oligonucleotide; CTC chr11 5304258 5304279 5304263 5304258 -
agggggcctctatgcttgcctg

SEQ ID NO: 130094 - DNA, 22 bp, Artificial Sequence
  Synthetic oligonucleotide; CTC chr11 5304248 5304269 5304253 5304248 -
tatgcttgcctgagagtgataa

SEQ ID NO: 130095 - DNA, 22 bp, Artificial Sequence
  Synthetic oligonucleotide; CTA chr11 5304246 5304267 5304251 5304246 -
tgcttgcctgagagtgataaat

SEQ ID NO: 130096 - DNA, 22 bp, Artificial Sequence
  Synthetic oligonucleotide; CTT chr11 5304241 5304262 5304246 5304241 -
gcctgagagtgataaattccac

SEQ ID NO: 130097 - DNA, 22 bp, Artificial Sequence
  Synthetic oligonucleotide; TTG chr11 5304240 5304261 5304245 5304240 -
cctgagagtgataaattccact

SEQ ID NO: 130098 - DNA, 22 bp, Artificial Sequence
  Synthetic oligonucleotide; CTG chr11 5304236 5304257 5304241 5304236 -
agagtgataaattccactaaag

SEQ ID NO: 130099 - DNA, 22 bp, Artificial Sequence
  Synthetic oligonucleotide; TTC chr11 5304222 5304243 5304227 5304222 -
cactaaagttatgactctcact

SEQ ID NO: 130100 - DNA, 22 bp, Artificial Sequence
  Synthetic oligonucleotide; CTA chr11 5304217 5304238 5304222 5304217 -
aagttatgactctcacttttgt

SEQ ID NO: 130101 - DNA, 22 bp, Artificial Sequence
  Synthetic oligonucleotide; TTA chr11 5304211 5304232 5304216 5304211 -
tgactctcacttttgtcatgta

SEQ ID NO: 130102 - DNA, 22 bp, Artificial Sequence
  Synthetic oligonucleotide; CTC chr11 5304205 5304226 5304210 5304205 -
tcacttttgtcatgtatcacat

SEQ ID NO: 130103 - DNA, 22 bp, Artificial Sequence
  Synthetic oligonucleotide; CTC chr11 5304203 5304224 5304208 5304203 -
acttttgtcatgtatcacattc

SEQ ID NO: 130104 - DNA, 22 bp, Artificial Sequence
  Synthetic oligonucleotide; CTT chr11 5304199 5304220 5304204 5304199 -
ttgtcatgtatcacattctagg

SEQ ID NO: 130105 - DNA, 22 bp, Artificial Sequence
  Synthetic oligonucleotide; TTT chr11 5304198 5304219 5304203 5304198 -
tgtcatgtatcacattctagga

SEQ ID NO: 130106 - DNA, 22 bp, Artificial Sequence
  Synthetic oligonucleotide; TTT chr11 5304197 5304218 5304202 5304197 -
gtcatgtatcacattctaggag

SEQ ID NO: 130107 - DNA, 22 bp, Artificial Sequence
  Synthetic oligonucleotide; TTG chr11 5304196 5304217 5304201 5304196 -
tcatgtatcacattctaggaga

SEQ ID NO: 130108 - DNA, 22 bp, Artificial Sequence
  Synthetic oligonucleotide; TTC chr11 5304181 5304202 5304186 5304181 -
taggagactccctaaactatta

SEQ ID NO: 130109 - DNA, 22 bp, Artificial Sequence
  Synthetic oligonucleotide; CTA chr11 5304179 5304200 5304184 5304179 -
ggagactccctaaactattagg

SEQ ID NO: 130110 - DNA, 22 bp, Artificial Sequence
  Synthetic oligonucleotide; CTC chr11 5304171 5304192 5304176 5304171 -
cctaaactattagggcaactat

SEQ ID NO: 130111 - DNA, 22 bp, Artificial Sequence
  Synthetic oligonucleotide; CTA chr11 5304167 5304188 5304172 5304167 -
aactattagggcaactattctc

SEQ ID NO: 130112 - DNA, 22 bp, Artificial Sequence
  Synthetic oligonucleotide; CTA chr11 5304162 5304183 5304167 5304162 -
ttagggcaactattctccctgg

SEQ ID NO: 130113 - DNA, 22 bp, Artificial Sequence
  Synthetic oligonucleotide; TTA chr11 5304159 5304180 5304164 5304159 -
gggcaactattctccctggaat

SEQ ID NO: 130114 - DNA, 22 bp, Artificial Sequence
  Synthetic oligonucleotide; CTA chr11 5304150 5304171 5304155 5304150 -
ttctccctggaatatttgggta

SEQ ID NO: 130115 - DNA, 22 bp, Artificial Sequence
  Synthetic oligonucleotide; TTC chr11 5304147 5304168 5304152 5304147 -
tccctggaatatttgggtatgt

SEQ ID NO: 130116 - DNA, 22 bp, Artificial Sequence
  Synthetic oligonucleotide; CTC chr11 5304145 5304166 5304150 5304145 -
cctggaatatttgggtatgtgg

SEQ ID NO: 130117 - DNA, 22 bp, Artificial Sequence
  Synthetic oligonucleotide; CTG chr11 5304141 5304162 5304146 5304141 -
gaatatttgggtatgtggacag

SEQ ID NO: 130118 - DNA, 22 bp, Artificial Sequence
  Synthetic oligonucleotide; TTT chr11 5304133 5304154 5304138 5304133 -
gggtatgtggacagtttctggt

SEQ ID NO: 130119 - DNA, 22 bp, Artificial Sequence
  Synthetic oligonucleotide; TTG chr11 5304132 5304153 5304137 5304132 -
ggtatgtggacagtttctggta

SEQ ID NO: 130120 - DNA, 22 bp, Artificial Sequence
  Synthetic oligonucleotide; TTT chr11 5304116 5304137 5304121 5304116 -
ctggtactaccaaatttgccac

SEQ ID NO: 130121 - DNA, 22 bp, Artificial Sequence
  Synthetic oligonucleotide; TTC chr11 5304115 5304136 5304120 5304115 -
tggtactaccaaatttgccaca

SEQ ID NO: 130122 - DNA, 22 bp, Artificial Sequence
  Synthetic oligonucleotide; CTG chr11 5304113 5304134 5304118 5304113 -
gtactaccaaatttgccacaat

SEQ ID NO: 130123 - DNA, 22 bp, Artificial Sequence
  Synthetic oligonucleotide; CTA chr11 5304107 5304128 5304112 5304107 -
ccaaatttgccacaattaaatg

SEQ ID NO: 130124 - DNA, 22 bp, Artificial Sequence
  Synthetic oligonucleotide; TTT chr11 5304099 5304120 5304104 5304099 -
gccacaattaaatgccagcgta

SEQ ID NO: 130125 - DNA, 22 bp, Artificial Sequence
  Synthetic oligonucleotide; TTG chr11 5304098 5304119 5304103 5304098 -
ccacaattaaatgccagcgtag

SEQ ID NO: 130126 - DNA, 22 bp, Artificial Sequence
  Synthetic oligonucleotide; TTA chr11 5304089 5304110 5304094 5304089 -
aatgccagcgtagctgttttgc

SEQ ID NO: 130127 - DNA, 22 bp, Artificial Sequence
  Synthetic oligonucleotide; CTG chr11 5304073 5304094 5304078 5304073 -
ttttgctagagactgcagatgt

SEQ ID NO: 130128 - DNA, 22 bp, Artificial Sequence
  Synthetic oligonucleotide; TTT chr11 5304070 5304091 5304075 5304070 -
tgctagagactgcagatgttaa

SEQ ID NO: 130129 - DNA, 22 bp, Artificial Sequence
  Synthetic oligonucleotide; TTT chr11 5304069 5304090 5304074 5304069 -
gctagagactgcagatgttaaa

SEQ ID NO: 130130 - DNA, 22 bp, Artificial Sequence
  Synthetic oligonucleotide; TTG chr11 5304068 5304089 5304073 5304068 -
ctagagactgcagatgttaaat

SEQ ID NO: 130131 - DNA, 22 bp, Artificial Sequence
  Synthetic oligonucleotide; CTA chr11 5304065 5304086 5304070 5304065 -
gagactgcagatgttaaataga

SEQ ID NO: 130132 - DNA, 22 bp, Artificial Sequence
  Synthetic oligonucleotide; CTG chr11 5304058 5304079 5304063 5304058 -
cagatgttaaatagagggctat

SEQ ID NO: 130133 - DNA, 22 bp, Artificial Sequence
  Synthetic oligonucleotide; TTA chr11 5304049 5304070 5304054 5304049 -
aatagagggctatctttaggtc

SEQ ID NO: 130134 - DNA, 22 bp, Artificial Sequence
  Synthetic oligonucleotide; CTA chr11 5304037 5304058 5304042 5304037 -
tctttaggtcaataaaatatac

SEQ ID NO: 130135 - DNA, 22 bp, Artificial Sequence
  Synthetic oligonucleotide; CTT chr11 5304033 5304054 5304038 5304033 -
taggtcaataaaatatacttat

SEQ ID NO: 130136 - DNA, 22 bp, Artificial Sequence
  Synthetic oligonucleotide; TTT chr11 5304032 5304053 5304037 5304032 -
aggtcaataaaatatacttata

SEQ ID NO: 130137 - DNA, 22 bp, Artificial Sequence
  Synthetic oligonucleotide; TTA chr11 5304031 5304052 5304036 5304031 -
ggtcaataaaatatacttataa

SEQ ID NO: 130138 - DNA, 22 bp, Artificial Sequence
  Synthetic oligonucleotide; CTT chr11 5304013 5304034 5304018 5304013 -
ataaattgtattaactatttcc

SEQ ID NO: 130139 - DNA, 22 bp, Artificial Sequence
  Synthetic oligonucleotide; TTA chr11 5304012 5304033 5304017 5304012 -
taaattgtattaactatttccc

SEQ ID NO: 130140 - DNA, 22 bp, Artificial Sequence
  Synthetic oligonucleotide; TTG chr11 5304005 5304026 5304010 5304005 -
tattaactatttccccagtaat

SEQ ID NO: 130141 - DNA, 22 bp, Artificial Sequence
  Synthetic oligonucleotide; TTA chr11 5304000 5304021 5304005 5304000 -
actatttccccagtaattacca

SEQ ID NO: 130142 - DNA, 22 bp, Artificial Sequence
  Synthetic oligonucleotide; CTA chr11 5303996 5304017 5304001 5303996 -
tttccccagtaattaccacaca

SEQ ID NO: 130143 - DNA, 22 bp, Artificial Sequence
  Synthetic oligonucleotide; TTT chr11 5303993 5304014 5303998 5303993 -
ccccagtaattaccacacagtt

SEQ ID NO: 130144 - DNA, 22 bp, Artificial Sequence
  Synthetic oligonucleotide; TTC chr11 5303992 5304013 5303997 5303992 -
cccagtaattaccacacagttt

SEQ ID NO: 130145 - DNA, 22 bp, Artificial Sequence
  Synthetic oligonucleotide; TTA chr11 5303981 5304002 5303986 5303981 -
ccacacagttttaataaaaccc

SEQ ID NO: 130146 - DNA, 22 bp, Artificial Sequence
  Synthetic oligonucleotide; TTT chr11 5303970 5303991 5303975 5303970 -
taataaaaccctgtgcatccgc

SEQ ID NO: 130147 - DNA, 22 bp, Artificial Sequence
  Synthetic oligonucleotide; TTT chr11 5303969 5303990 5303974 5303969 -
aataaaaccctgtgcatccgca

SEQ ID NO: 130148 - DNA, 22 bp, Artificial Sequence
  Synthetic oligonucleotide; TTA chr11 5303968 5303989 5303973 5303968 -
ataaaaccctgtgcatccgcat

SEQ ID NO: 130149 - DNA, 22 bp, Artificial Sequence
  Synthetic oligonucleotide; CTG chr11 5303957 5303978 5303962 5303957 -
tgcatccgcatgtcccaaacgc

SEQ ID NO: 130150 - DNA, 22 bp, Artificial Sequence
  Synthetic oligonucleotide; CTC chr11 5303930 5303951 5303935 5303930 -
aggttttgaaaacacgactata

SEQ ID NO: 130151 - DNA, 22 bp, Artificial Sequence
  Synthetic oligonucleotide; TTT chr11 5303924 5303945 5303929 5303924 -
tgaaaacacgactatagtttaa

SEQ ID NO: 130152 - DNA, 22 bp, Artificial Sequence
  Synthetic oligonucleotide; TTT chr11 5303923 5303944 5303928 5303923 -
gaaaacacgactatagtttaag

SEQ ID NO: 130153 - DNA, 22 bp, Artificial Sequence
  Synthetic oligonucleotide; TTG chr11 5303922 5303943 5303927 5303922 -
aaaacacgactatagtttaaga

SEQ ID NO: 130154 - DNA, 22 bp, Artificial Sequence
  Synthetic oligonucleotide; CTA chr11 5303910 5303931 5303915 5303910 -
tagtttaagaataatcaggcct

SEQ ID NO: 130155 - DNA, 22 bp, Artificial Sequence
  Synthetic oligonucleotide; TTT chr11 5303904 5303925 5303909 5303904 -
aagaataatcaggcctcctccg

SEQ ID NO: 130156 - DNA, 22 bp, Artificial Sequence
  Synthetic oligonucleotide; TTA chr11 5303903 5303924 5303908 5303903 -
agaataatcaggcctcctccgg

SEQ ID NO: 130157 - DNA, 22 bp, Artificial Sequence
  Synthetic oligonucleotide; CTC chr11 5303887 5303908 5303892 5303887 -
ctccggcttcctccatctggtc

SEQ ID NO: 130158 - DNA, 22 bp, Artificial Sequence
  Synthetic oligonucleotide; CTC chr11 5303884 5303905 5303889 5303884 -
cggcttcctccatctggtccat

SEQ ID NO: 130159 - DNA, 22 bp, Artificial Sequence
  Synthetic oligonucleotide; CTT chr11 5303878 5303899 5303883 5303878 -
cctccatctggtccattatctg

SEQ ID NO: 130160 - DNA, 22 bp, Artificial Sequence
  Synthetic oligonucleotide; TTC chr11 5303877 5303898 5303882 5303877 -
ctccatctggtccattatctgg

SEQ ID NO: 130161 - DNA, 22 bp, Artificial Sequence
  Synthetic oligonucleotide; CTC chr11 5303874 5303895 5303879 5303874 -
catctggtccattatctgggtg

SEQ ID NO: 130162 - DNA, 22 bp, Artificial Sequence
  Synthetic oligonucleotide; CTG chr11 5303868 5303889 5303873 5303868 -
gtccattatctgggtgacagta

SEQ ID NO: 130163 - DNA, 22 bp, Artificial Sequence
  Synthetic oligonucleotide; TTA chr11 5303860 5303881 5303865 5303860 -
tctgggtgacagtagatccaaa

SEQ ID NO: 130164 - DNA, 22 bp, Artificial Sequence
  Synthetic oligonucleotide; CTG chr11 5303856 5303877 5303861 5303856 -
ggtgacagtagatccaaataag

SEQ ID NO: 130165 - DNA, 22 bp, Artificial Sequence
  Synthetic oligonucleotide; TTA chr11 5303828 5303849 5303833 5303828 -
gctcttatcctgtacaacaaat

SEQ ID NO: 130166 - DNA, 22 bp, Artificial Sequence
  Synthetic oligonucleotide; CTC chr11 5303824 5303845 5303829 5303824 -
ttatcctgtacaacaaattttg

SEQ ID NO: 130167 - DNA, 22 bp, Artificial Sequence
  Synthetic oligonucleotide; CTT chr11 5303822 5303843 5303827 5303822 -
atcctgtacaacaaattttggc

SEQ ID NO: 130168 - DNA, 22 bp, Artificial Sequence
  Synthetic oligonucleotide; TTA chr11 5303821 5303842 5303826 5303821 -
tcctgtacaacaaattttggca

SEQ ID NO: 130169 - DNA, 22 bp, Artificial Sequence
  Synthetic oligonucleotide; CTG chr11 5303816 5303837 5303821 5303816 -
tacaacaaattttggcattaat

SEQ ID NO: 130170 - DNA, 22 bp, Artificial Sequence
  Synthetic oligonucleotide; TTT chr11 5303804 5303825 5303809 5303804 -
tggcattaatccattctcttat

SEQ ID NO: 130171 - DNA, 22 bp, Artificial Sequence
  Synthetic oligonucleotide; TTT chr11 5303803 5303824 5303808 5303803 -
ggcattaatccattctcttata

SEQ ID NO: 130172 - DNA, 22 bp, Artificial Sequence
  Synthetic oligonucleotide; TTG chr11 5303802 5303823 5303807 5303802 -
gcattaatccattctcttataa

SEQ ID NO: 130173 - DNA, 22 bp, Artificial Sequence
  Synthetic oligonucleotide; TTA chr11 5303796 5303817 5303801 5303796 -
atccattctcttataaggcaac

SEQ ID NO: 130174 - DNA, 22 bp, Artificial Sequence
  Synthetic oligonucleotide; TTC chr11 5303788 5303809 5303793 5303788 -
tcttataaggcaacattggaag

SEQ ID NO: 130175 - DNA, 22 bp, Artificial Sequence
  Synthetic oligonucleotide; CTC chr11 5303786 5303807 5303791 5303786 -
ttataaggcaacattggaaggt

SEQ ID NO: 130176 - DNA, 22 bp, Artificial Sequence
  Synthetic oligonucleotide; CTT chr11 5303784 5303805 5303789 5303784 -
ataaggcaacattggaaggtta

SEQ ID NO: 130177 - DNA, 22 bp, Artificial Sequence
  Synthetic oligonucleotide; TTA chr11 5303783 5303804 5303788 5303783 -
taaggcaacattggaaggttaa

SEQ ID NO: 130178 - DNA, 22 bp, Artificial Sequence
  Synthetic oligonucleotide; TTG chr11 5303770 5303791 5303775 5303770 -
gaaggttaagagaacttataat

SEQ ID NO: 130179 - DNA, 22 bp, Artificial Sequence
  Synthetic oligonucleotide; TTA chr11 5303762 5303783 5303767 5303762 -
agagaacttataatgatataca

SEQ ID NO: 130180 - DNA, 22 bp, Artificial Sequence
  Synthetic oligonucleotide; CTT chr11 5303753 5303774 5303758 5303753 -
ataatgatatacacatcactcc

SEQ ID NO: 130181 - DNA, 22 bp, Artificial Sequence
  Synthetic oligonucleotide; TTA chr11 5303752 5303773 5303757 5303752 -
taatgatatacacatcactcct

SEQ ID NO: 130182 - DNA, 22 bp, Artificial Sequence
  Synthetic oligonucleotide; CTC chr11 5303732 5303753 5303737 5303732 -
ctgtggcggtagataagttctg

SEQ ID NO: 130183 - DNA, 22 bp, Artificial Sequence
  Synthetic oligonucleotide; CTG chr11 5303729 5303750 5303734 5303729 -
tggcggtagataagttctgcca

SEQ ID NO: 130184 - DNA, 22 bp, Artificial Sequence
  Synthetic oligonucleotide; TTC chr11 5303712 5303733 5303717 5303712 -
tgccacattaagcactatgcag

SEQ ID NO: 130185 - DNA, 22 bp, Artificial Sequence
  Synthetic oligonucleotide; CTG chr11 5303710 5303731 5303715 5303710 -
ccacattaagcactatgcaggt

SEQ ID NO: 130186 - DNA, 22 bp, Artificial Sequence
  Synthetic oligonucleotide; TTA chr11 5303702 5303723 5303707 5303702 -
agcactatgcaggtcataattc

SEQ ID NO: 130187 - DNA, 22 bp, Artificial Sequence
  Synthetic oligonucleotide; CTA chr11 5303695 5303716 5303700 5303695 -
tgcaggtcataattcagtggat

SEQ ID NO: 130188 - DNA, 22 bp, Artificial Sequence
  Synthetic oligonucleotide; TTC chr11 5303680 5303701 5303685 5303680 -
agtggatcaagttagttagcag

SEQ ID NO: 130189 - DNA, 22 bp, Artificial Sequence
  Synthetic oligonucleotide; TTA chr11 5303666 5303687 5303671 5303666 -
gttagcagtgtttttagtatcc

SEQ ID NO: 130190 - DNA, 22 bp, Artificial Sequence
  Synthetic oligonucleotide; TTA chr11 5303662 5303683 5303667 5303662 -
gcagtgtttttagtatccatat

SEQ ID NO: 130191 - DNA, 22 bp, Artificial Sequence
  Synthetic oligonucleotide; TTT chr11 5303653 5303674 5303658 5303653 -
ttagtatccatatgaacatagt

SEQ ID NO: 130192 - DNA, 22 bp, Artificial Sequence
  Synthetic oligonucleotide; TTT chr11 5303652 5303673 5303657 5303652 -
tagtatccatatgaacatagtc

SEQ ID NO: 130193 - DNA, 22 bp, Artificial Sequence
  Synthetic oligonucleotide; TTT chr11 5303651 5303672 5303656 5303651 -
agtatccatatgaacatagtct

SEQ ID NO: 130194 - DNA, 22 bp, Artificial Sequence
  Synthetic oligonucleotide; TTA chr11 5303650 5303671 5303655 5303650 -
gtatccatatgaacatagtctc

SEQ ID NO: 130195 - DNA, 22 bp, Artificial Sequence
  Synthetic oligonucleotide; CTC chr11 5303628 5303649 5303633 5303628 -
tgctactgcagtgcctagactg

SEQ ID NO: 130196 - DNA, 22 bp, Artificial Sequence
  Synthetic oligonucleotide; CTG chr11 5303626 5303647 5303631 5303626 -
ctactgcagtgcctagactgac

SEQ ID NO: 130197 - DNA, 22 bp, Artificial Sequence
  Synthetic oligonucleotide; CTA chr11 5303623 5303644 5303628 5303623 -
ctgcagtgcctagactgacatt

SEQ ID NO: 130198 - DNA, 22 bp, Artificial Sequence
  Synthetic oligonucleotide; CTG chr11 5303620 5303641 5303625 5303620 -
cagtgcctagactgacattttt

SEQ ID NO: 130199 - DNA, 22 bp, Artificial Sequence
  Synthetic oligonucleotide; CTA chr11 5303611 5303632 5303616 5303611 -
gactgacatttttgttatcaac

SEQ ID NO: 130200 - DNA, 22 bp, Artificial Sequence
  Synthetic oligonucleotide; CTG chr11 5303606 5303627 5303611 5303606 -
acatttttgttatcaacagtgt

SEQ ID NO: 130201 - DNA, 22 bp, Artificial Sequence
  Synthetic oligonucleotide; TTT chr11 5303600 5303621 5303605 5303600 -
ttgttatcaacagtgtcccctg

SEQ ID NO: 130202 - DNA, 22 bp, Artificial Sequence
  Synthetic oligonucleotide; TTT chr11 5303599 5303620 5303604 5303599 -
tgttatcaacagtgtcccctga

SEQ ID NO: 130203 - DNA, 22 bp, Artificial Sequence
  Synthetic oligonucleotide; TTT chr11 5303598 5303619 5303603 5303598 -
gttatcaacagtgtcccctgaa

SEQ ID NO: 130204 - DNA, 22 bp, Artificial Sequence
  Synthetic oligonucleotide; TTG chr11 5303597 5303618 5303602 5303597 -
ttatcaacagtgtcccctgaag

SEQ ID NO: 130205 - DNA, 22 bp, Artificial Sequence
  Synthetic oligonucleotide; TTA chr11 5303594 5303615 5303599 5303594 -
tcaacagtgtcccctgaagtag

SEQ ID NO: 130206 - DNA, 22 bp, Artificial Sequence
  Synthetic oligonucleotide; CTG chr11 5303578 5303599 5303583 5303578 -
aagtagcagccctttcaaaagt

SEQ ID NO: 130207 - DNA, 22 bp, Artificial Sequence
  Synthetic oligonucleotide; CTT chr11 5303564 5303585 5303569 5303564 -
tcaaaagtcctttcacctttcc

SEQ ID NO: 130208 - DNA, 22 bp, Artificial Sequence
  Synthetic oligonucleotide; TTT chr11 5303563 5303584 5303568 5303563 -
caaaagtcctttcacctttcct

SEQ ID NO: 130209 - DNA, 22 bp, Artificial Sequence
  Synthetic oligonucleotide; TTC chr11 5303562 5303583 5303567 5303562 -
aaaagtcctttcacctttcctc

SEQ ID NO: 130210 - DNA, 22 bp, Artificial Sequence
  Synthetic oligonucleotide; CTT chr11 5303552 5303573 5303557 5303552 -
tcacctttcctctgtccatctc

SEQ ID NO: 130211 - DNA, 22 bp, Artificial Sequence
  Synthetic oligonucleotide; TTT chr11 5303551 5303572 5303556 5303551 -
cacctttcctctgtccatctct

SEQ ID NO: 130212 - DNA, 22 bp, Artificial Sequence
  Synthetic oligonucleotide; TTC chr11 5303550 5303571 5303555 5303550 -
acctttcctctgtccatctctc

SEQ ID NO: 130213 - DNA, 22 bp, Artificial Sequence
  Synthetic oligonucleotide; CTT chr11 5303545 5303566 5303550 5303545 -
tcctctgtccatctctctccac

SEQ ID NO: 130214 - DNA, 22 bp, Artificial Sequence
  Synthetic oligonucleotide; TTT chr11 5303544 5303565 5303549 5303544 -
cctctgtccatctctctccacc

SEQ ID NO: 130215 - DNA, 22 bp, Artificial Sequence
  Synthetic oligonucleotide; TTC chr11 5303543 5303564 5303548 5303543 -
ctctgtccatctctctccacca

SEQ ID NO: 130216 - DNA, 22 bp, Artificial Sequence
  Synthetic oligonucleotide; CTC chr11 5303540 5303561 5303545 5303540 -
tgtccatctctctccaccaata

SEQ ID NO: 130217 - DNA, 22 bp, Artificial Sequence
  Synthetic oligonucleotide; CTG chr11 5303538 5303559 5303543 5303538 -
tccatctctctccaccaataat

SEQ ID NO: 130218 - DNA, 22 bp, Artificial Sequence
  Synthetic oligonucleotide; CTC chr11 5303530 5303551 5303535 5303530 -
tctccaccaataattgcttata

SEQ ID NO: 130219 - DNA, 22 bp, Artificial Sequence
  Synthetic oligonucleotide; CTC chr11 5303528 5303549 5303533 5303528 -
tccaccaataattgcttatatt

SEQ ID NO: 130220 - DNA, 22 bp, Artificial Sequence
  Synthetic oligonucleotide; CTC chr11 5303526 5303547 5303531 5303526 -
caccaataattgcttatattag

SEQ ID NO: 130221 - DNA, 22 bp, Artificial Sequence
  Synthetic oligonucleotide; TTG chr11 5303514 5303535 5303519 5303514 -
cttatattagagatgttactat

SEQ ID NO: 130222 - DNA, 22 bp, Artificial Sequence
  Synthetic oligonucleotide; CTT chr11 5303511 5303532 5303516 5303511 -
atattagagatgttactatgtg

SEQ ID NO: 130223 - DNA, 22 bp, Artificial Sequence
  Synthetic oligonucleotide; TTA chr11 5303510 5303531 5303515 5303510 -
tattagagatgttactatgtgc

SEQ ID NO: 130224 - DNA, 22 bp, Artificial Sequence
  Synthetic oligonucleotide; TTA chr11 5303505 5303526 5303510 5303505 -
gagatgttactatgtgccaaaa

SEQ ID NO: 130225 - DNA, 22 bp, Artificial Sequence
  Synthetic oligonucleotide; TTA chr11 5303496 5303517 5303501 5303496 -
ctatgtgccaaaattctgaaac

SEQ ID NO: 130226 - DNA, 22 bp, Artificial Sequence
  Synthetic oligonucleotide; CTA chr11 5303493 5303514 5303498 5303493 -
tgtgccaaaattctgaaacata

SEQ ID NO: 130227 - DNA, 22 bp, Artificial Sequence
  Synthetic oligonucleotide; TTC chr11 5303480 5303501 5303485 5303480 -
tgaaacatataattattattgt

SEQ ID NO: 130228 - DNA, 22 bp, Artificial Sequence
  Synthetic oligonucleotide; CTG chr11 5303478 5303499 5303483 5303478 -
aaacatataattattattgttt

SEQ ID NO: 130229 - DNA, 22 bp, Artificial Sequence
  Synthetic oligonucleotide; TTA chr11 5303465 5303486 5303470 5303465 -
ttattgtttctataggttttta

SEQ ID NO: 130230 - DNA, 22 bp, Artificial Sequence
  Synthetic oligonucleotide; TTA chr11 5303462 5303483 5303467 5303462 -
ttgtttctataggtttttataa

SEQ ID NO: 130231 - DNA, 22 bp, Artificial Sequence
  Synthetic oligonucleotide; TTG chr11 5303459 5303480 5303464 5303459 -
tttctataggtttttataaaat

SEQ ID NO: 130232 - DNA, 22 bp, Artificial Sequence
  Synthetic oligonucleotide; TTT chr11 5303456 5303477 5303461 5303456 -
ctataggtttttataaaataaa

SEQ ID NO: 130233 - DNA, 22 bp, Artificial Sequence
  Synthetic oligonucleotide; TTC chr11 5303455 5303476 5303460 5303455 -
tataggtttttataaaataaaa

SEQ ID NO: 130234 - DNA, 22 bp, Artificial Sequence
  Synthetic oligonucleotide; CTA chr11 5303453 5303474 5303458 5303453 -
taggtttttataaaataaaaaa

SEQ ID NO: 130235 - DNA, 22 bp, Artificial Sequence
  Synthetic oligonucleotide; TTT chr11 5303446 5303467 5303451 5303446 -
ttataaaataaaaaaggtgcaa

SEQ ID NO: 130236 - DNA, 22 bp, Artificial Sequence
  Synthetic oligonucleotide; TTT chr11 5303445 5303466 5303450 5303445 -
tataaaataaaaaaggtgcaaa

SEQ ID NO: 130237 - DNA, 22 bp, Artificial Sequence
  Synthetic oligonucleotide; TTT chr11 5303444 5303465 5303449 5303444 -
ataaaataaaaaaggtgcaaag

SEQ ID NO: 130238 - DNA, 22 bp, Artificial Sequence
  Synthetic oligonucleotide; TTA chr11 5303443 5303464 5303448 5303443 -
taaaataaaaaaggtgcaaaga

SEQ ID NO: 130239 - DNA, 22 bp, Artificial Sequence
  Synthetic oligonucleotide; TTG chr11 5303418 5303439 5303423 5303418 -
ttatcacttcatttttactgaa

SEQ ID NO: 130240 - DNA, 22 bp, Artificial Sequence
  Synthetic oligonucleotide; TTA chr11 5303415 5303436 5303420 5303415 -
tcacttcatttttactgaatta

SEQ ID NO: 130241 - DNA, 22 bp, Artificial Sequence
  Synthetic oligonucleotide; CTT chr11 5303409 5303430 5303414 5303409 -
catttttactgaattacacttc

SEQ ID NO: 130242 - DNA, 22 bp, Artificial Sequence
  Synthetic oligonucleotide; TTC chr11 5303408 5303429 5303413 5303408 -
atttttactgaattacacttca

SEQ ID NO: 130243 - DNA, 22 bp, Artificial Sequence
  Synthetic oligonucleotide; TTT chr11 5303404 5303425 5303409 5303404 -
ttactgaattacacttcaaagg

SEQ ID NO: 130244 - DNA, 22 bp, Artificial Sequence
  Synthetic oligonucleotide; TTT chr11 5303403 5303424 5303408 5303403 -
tactgaattacacttcaaaggt

SEQ ID NO: 130245 - DNA, 22 bp, Artificial Sequence
  Synthetic oligonucleotide; TTT chr11 5303402 5303423 5303407 5303402 -
actgaattacacttcaaaggtg

SEQ ID NO: 130246 - DNA, 22 bp, Artificial Sequence
  Synthetic oligonucleotide; TTA chr11 5303401 5303422 5303406 5303401 -
ctgaattacacttcaaaggtgt

SEQ ID NO: 130247 - DNA, 22 bp, Artificial Sequence
  Synthetic oligonucleotide; CTG chr11 5303398 5303419 5303403 5303398 -
aattacacttcaaaggtgtcgg

SEQ ID NO: 130248 - DNA, 22 bp, Artificial Sequence
  Synthetic oligonucleotide; TTA chr11 5303393 5303414 5303398 5303393 -
cacttcaaaggtgtcggtagta

SEQ ID NO: 130249 - DNA, 22 bp, Artificial Sequence
  Synthetic oligonucleotide; CTT chr11 5303388 5303409 5303393 5303388 -
caaaggtgtcggtagtaatatt

SEQ ID NO: 130250 - DNA, 22 bp, Artificial Sequence
  Synthetic oligonucleotide; TTC chr11 5303387 5303408 5303392 5303387 -
aaaggtgtcggtagtaatattt

SEQ ID NO: 130251 - DNA, 22 bp, Artificial Sequence
  Synthetic oligonucleotide; TTT chr11 5303365 5303386 5303370 5303365 -
ataatattgaatgatattttaa

SEQ ID NO: 130252 - DNA, 22 bp, Artificial Sequence
  Synthetic oligonucleotide; TTA chr11 5303364 5303385 5303369 5303364 -
taatattgaatgatattttaaa

SEQ ID NO: 130253 - DNA, 22 bp, Artificial Sequence
  Synthetic oligonucleotide; TTG chr11 5303356 5303377 5303361 5303356 -
aatgatattttaaaagactctg

SEQ ID NO: 130254 - DNA, 22 bp, Artificial Sequence
  Synthetic oligonucleotide; TTT chr11 5303346 5303367 5303351 5303346 -
taaaagactctggacacataca

SEQ ID NO: 130255 - DNA, 22 bp, Artificial Sequence
  Synthetic oligonucleotide; TTT chr11 5303345 5303366 5303350 5303345 -
aaaagactctggacacatacag

SEQ ID NO: 130256 - DNA, 22 bp, Artificial Sequence
  Synthetic oligonucleotide; TTA chr11 5303344 5303365 5303349 5303344 -
aaagactctggacacatacaga

SEQ ID NO: 130257 - DNA, 22 bp, Artificial Sequence
  Synthetic oligonucleotide; CTC chr11 5303336 5303357 5303341 5303336 -
tggacacatacagaatcaattg

SEQ ID NO: 130258 - DNA, 22 bp, Artificial Sequence
  Synthetic oligonucleotide; CTG chr11 5303334 5303355 5303339 5303334 -
gacacatacagaatcaattgaa

SEQ ID NO: 130259 - DNA, 22 bp, Artificial Sequence
  Synthetic oligonucleotide; TTG chr11 5303314 5303335 5303319 5303314 -
aatttgggagaaactgagtttc

SEQ ID NO: 130260 - DNA, 22 bp, Artificial Sequence
  Synthetic oligonucleotide; TTT chr11 5303309 5303330 5303314 5303309 -
gggagaaactgagtttcccttg

SEQ ID NO: 130261 - DNA, 22 bp, Artificial Sequence
  Synthetic oligonucleotide; TTG chr11 5303308 5303329 5303313 5303308 -
ggagaaactgagtttcccttgt

SEQ ID NO: 130262 - DNA, 22 bp, Artificial Sequence
  Synthetic oligonucleotide; CTG chr11 5303298 5303319 5303303 5303298 -
agtttcccttgtagttctcttt

SEQ ID NO: 130263 - DNA, 22 bp, Artificial Sequence
  Synthetic oligonucleotide; TTT chr11 5303293 5303314 5303298 5303293 -
cccttgtagttctctttgtttt

SEQ ID NO: 130264 - DNA, 22 bp, Artificial Sequence
  Synthetic oligonucleotide; TTC chr11 5303292 5303313 5303297 5303292 -
ccttgtagttctctttgttttc

SEQ ID NO: 130265 - DNA, 22 bp, Artificial Sequence
  Synthetic oligonucleotide; CTT chr11 5303288 5303309 5303293 5303288 -
gtagttctctttgttttcccaa

SEQ ID NO: 130266 - DNA, 22 bp, Artificial Sequence
  Synthetic oligonucleotide; TTG chr11 5303287 5303308 5303292 5303287 -
tagttctctttgttttcccaat

SEQ ID NO: 130267 - DNA, 22 bp, Artificial Sequence
  Synthetic oligonucleotide; TTC chr11 5303281 5303302 5303286 5303281 -
tctttgttttcccaataaacct

SEQ ID NO: 130268 - DNA, 22 bp, Artificial Sequence
  Synthetic oligonucleotide; CTC chr11 5303279 5303300 5303284 5303279 -
tttgttttcccaataaacctgc

SEQ ID NO: 130269 - DNA, 22 bp, Artificial Sequence
  Synthetic oligonucleotide; CTT chr11 5303277 5303298 5303282 5303277 -
tgttttcccaataaacctgcta

SEQ ID NO: 130270 - DNA, 22 bp, Artificial Sequence
  Synthetic oligonucleotide; TTT chr11 5303276 5303297 5303281 5303276 -
gttttcccaataaacctgctac

SEQ ID NO: 130271 - DNA, 22 bp, Artificial Sequence
  Synthetic oligonucleotide; TTG chr11 5303275 5303296 5303280 5303275 -
ttttcccaataaacctgctaca

SEQ ID NO: 130272 - DNA, 22 bp, Artificial Sequence
  Synthetic oligonucleotide; TTT chr11 5303272 5303293 5303277 5303272 -
tcccaataaacctgctacaaaa

SEQ ID NO: 130273 - DNA, 22 bp, Artificial Sequence
  Synthetic oligonucleotide; TTT chr11 5303271 5303292 5303276 5303271 -
cccaataaacctgctacaaaat

SEQ ID NO: 130274 - DNA, 22 bp, Artificial Sequence
  Synthetic oligonucleotide; TTC chr11 5303270 5303291 5303275 5303270 -
ccaataaacctgctacaaaatt

SEQ ID NO: 130275 - DNA, 22 bp, Artificial Sequence
  Synthetic oligonucleotide; CTG chr11 5303258 5303279 5303263 5303258 -
ctacaaaatttcttggtatcac

SEQ ID NO: 130276 - DNA, 22 bp, Artificial Sequence
  Synthetic oligonucleotide; CTA chr11 5303255 5303276 5303260 5303255 -
caaaatttcttggtatcacaac

SEQ ID NO: 130277 - DNA, 22 bp, Artificial Sequence
  Synthetic oligonucleotide; TTT chr11 5303247 5303268 5303252 5303247 -
cttggtatcacaacaacaaaaa

SEQ ID NO: 130278 - DNA, 22 bp, Artificial Sequence
  Synthetic oligonucleotide; TTC chr11 5303246 5303267 5303251 5303246 -
ttggtatcacaacaacaaaaat

SEQ ID NO: 130279 - DNA, 22 bp, Artificial Sequence
  Synthetic oligonucleotide; CTT chr11 5303244 5303265 5303249 5303244 -
ggtatcacaacaacaaaaatct

SEQ ID NO: 130280 - DNA, 22 bp, Artificial Sequence
  Synthetic oligonucleotide; TTG chr11 5303243 5303264 5303248 5303243 -
gtatcacaacaacaaaaatctt

SEQ ID NO: 130281 - DNA, 22 bp, Artificial Sequence
  Synthetic oligonucleotide; CTT chr11 5303221 5303242 5303226 5303221 -
gactttgtaaaagtgtaattat

SEQ ID NO: 130282 - DNA, 22 bp, Artificial Sequence
  Synthetic oligonucleotide; TTG chr11 5303220 5303241 5303225 5303220 -
actttgtaaaagtgtaattata

SEQ ID NO: 130283 - DNA, 22 bp, Artificial Sequence
  Synthetic oligonucleotide; CTT chr11 5303216 5303237 5303221 5303216 -
tgtaaaagtgtaattataaata

SEQ ID NO: 130284 - DNA, 22 bp, Artificial Sequence
  Synthetic oligonucleotide; TTT chr11 5303215 5303236 5303220 5303215 -
gtaaaagtgtaattataaatat

SEQ ID NO: 130285 - DNA, 22 bp, Artificial Sequence
  Synthetic oligonucleotide; TTG chr11 5303214 5303235 5303219 5303214 -
taaaagtgtaattataaatata

SEQ ID NO: 130286 - DNA, 22 bp, Artificial Sequence
  Synthetic oligonucleotide; TTA chr11 5303200 5303221 5303205 5303200 -
taaatataaataaatattaatt

SEQ ID NO: 130287 - DNA, 22 bp, Artificial Sequence
  Synthetic oligonucleotide; TTA chr11 5303181 5303202 5303186 5303181 -
attataaatagacttcatagtt

SEQ ID NO: 130288 - DNA, 22 bp, Artificial Sequence
  Synthetic oligonucleotide; TTA chr11 5303177 5303198 5303182 5303177 -
taaatagacttcatagttccct

SEQ ID NO: 130289 - DNA, 22 bp, Artificial Sequence
  Synthetic oligonucleotide; CTT chr11 5303166 5303187 5303171 5303166 -
catagttccctatgaggatcct

SEQ ID NO: 130290 - DNA, 22 bp, Artificial Sequence
  Synthetic oligonucleotide; TTC chr11 5303165 5303186 5303170 5303165 -
atagttccctatgaggatcctt

SEQ ID NO: 130291 - DNA, 22 bp, Artificial Sequence
  Synthetic oligonucleotide; TTC chr11 5303158 5303179 5303163 5303158 -
cctatgaggatccttgtgaatt

SEQ ID NO: 130292 - DNA, 22 bp, Artificial Sequence
  Synthetic oligonucleotide; CTA chr11 5303154 5303175 5303159 5303154 -
tgaggatccttgtgaatttttc

SEQ ID NO: 130293 - DNA, 22 bp, Artificial Sequence
  Synthetic oligonucleotide; CTT chr11 5303143 5303164 5303148 5303143 -
gtgaatttttctcaatacgagt

SEQ ID NO: 130294 - DNA, 22 bp, Artificial Sequence
  Synthetic oligonucleotide; TTG chr11 5303142 5303163 5303147 5303142 -
tgaatttttctcaatacgagtc

SEQ ID NO: 130295 - DNA, 22 bp, Artificial Sequence
  Synthetic oligonucleotide; TTT chr11 5303135 5303156 5303140 5303135 -
ttctcaatacgagtcttacaga

SEQ ID NO: 130296 - DNA, 22 bp, Artificial Sequence
  Synthetic oligonucleotide; TTT chr11 5303134 5303155 5303139 5303134 -
tctcaatacgagtcttacagat

SEQ ID NO: 130297 - DNA, 22 bp, Artificial Sequence
  Synthetic oligonucleotide; TTT chr11 5303133 5303154 5303138 5303133 -
ctcaatacgagtcttacagatt

SEQ ID NO: 130298 - DNA, 22 bp, Artificial Sequence
  Synthetic oligonucleotide; TTC chr11 5303132 5303153 5303137 5303132 -
tcaatacgagtcttacagattc

SEQ ID NO: 130299 - DNA, 22 bp, Artificial Sequence
  Synthetic oligonucleotide; CTC chr11 5303130 5303151 5303135 5303130 -
aatacgagtcttacagattcat

SEQ ID NO: 130300 - DNA, 22 bp, Artificial Sequence
  Synthetic oligonucleotide; CTT chr11 5303118 5303139 5303123 5303118 -
acagattcataatgattagagg

SEQ ID NO: 130301 - DNA, 22 bp, Artificial Sequence
  Synthetic oligonucleotide; TTA chr11 5303117 5303138 5303122 5303117 -
cagattcataatgattagaggg

SEQ ID NO: 130302 - DNA, 22 bp, Artificial Sequence
  Synthetic oligonucleotide; TTC chr11 5303110 5303131 5303115 5303110 -
ataatgattagagggtctgtaa

SEQ ID NO: 130303 - DNA, 22 bp, Artificial Sequence
  Synthetic oligonucleotide; TTA chr11 5303100 5303121 5303105 5303100 -
gagggtctgtaagattgtctcc

SEQ ID NO: 130304 - DNA, 22 bp, Artificial Sequence
  Synthetic oligonucleotide; CTG chr11 5303091 5303112 5303096 5303091 -
taagattgtctccatcagcaac

SEQ ID NO: 130305 - DNA, 22 bp, Artificial Sequence
  Synthetic oligonucleotide; TTG chr11 5303083 5303104 5303088 5303083 -
tctccatcagcaacatagttgc

SEQ ID NO: 130306 - DNA, 22 bp, Artificial Sequence
  Synthetic oligonucleotide; CTC chr11 5303079 5303100 5303084 5303079 -
catcagcaacatagttgccgta

SEQ ID NO: 130307 - DNA, 22 bp, Artificial Sequence
  Synthetic oligonucleotide; TTG chr11 5303062 5303083 5303067 5303062 -
ccgtattttctctctgggagtg

SEQ ID NO: 130308 - DNA, 22 bp, Artificial Sequence
  Synthetic oligonucleotide; TTT chr11 5303054 5303075 5303059 5303054 -
tctctctgggagtgcttatctt

SEQ ID NO: 130309 - DNA, 22 bp, Artificial Sequence
  Synthetic oligonucleotide; TTT chr11 5303053 5303074 5303058 5303053 -
ctctctgggagtgcttatcttt

SEQ ID NO: 130310 - DNA, 22 bp, Artificial Sequence
  Synthetic oligonucleotide; TTC chr11 5303052 5303073 5303057 5303052 -
tctctgggagtgcttatctttt

SEQ ID NO: 130311 - DNA, 22 bp, Artificial Sequence
  Synthetic oligonucleotide; CTC chr11 5303050 5303071 5303055 5303050 -
tctgggagtgcttatcttttcc

SEQ ID NO: 130312 - DNA, 22 bp, Artificial Sequence
  Synthetic oligonucleotide; CTC chr11 5303048 5303069 5303053 5303048 -
tgggagtgcttatcttttccct

SEQ ID NO: 130313 - DNA, 22 bp, Artificial Sequence
  Synthetic oligonucleotide; CTG chr11 5303046 5303067 5303051 5303046 -
ggagtgcttatcttttccctag

SEQ ID NO: 130314 - DNA, 22 bp, Artificial Sequence
  Synthetic oligonucleotide; CTT chr11 5303037 5303058 5303042 5303037 -
atcttttccctagaactggttg

SEQ ID NO: 130315 - DNA, 22 bp, Artificial Sequence
  Synthetic oligonucleotide; TTA chr11 5303036 5303057 5303041 5303036 -
tcttttccctagaactggttgt

SEQ ID NO: 130316 - DNA, 22 bp, Artificial Sequence
  Synthetic oligonucleotide; CTT chr11 5303032 5303053 5303037 5303032 -
ttccctagaactggttgtgtga

SEQ ID NO: 130317 - DNA, 22 bp, Artificial Sequence
  Synthetic oligonucleotide; TTT chr11 5303031 5303052 5303036 5303031 -
tccctagaactggttgtgtgaa

SEQ ID NO: 130318 - DNA, 22 bp, Artificial Sequence
  Synthetic oligonucleotide; TTT chr11 5303030 5303051 5303035 5303030 -
ccctagaactggttgtgtgaag

SEQ ID NO: 130319 - DNA, 22 bp, Artificial Sequence
  Synthetic oligonucleotide; TTC chr11 5303029 5303050 5303034 5303029 -
cctagaactggttgtgtgaagt

SEQ ID NO: 130320 - DNA, 22 bp, Artificial Sequence
  Synthetic oligonucleotide; CTA chr11 5303025 5303046 5303030 5303025 -
gaactggttgtgtgaagtttat

SEQ ID NO: 130321 - DNA, 22 bp, Artificial Sequence
  Synthetic oligonucleotide; CTG chr11 5303019 5303040 5303024 5303019 -
gttgtgtgaagtttattaactc

SEQ ID NO: 130322 - DNA, 22 bp, Artificial Sequence
  Synthetic oligonucleotide; TTG chr11 5303015 5303036 5303020 5303015 -
tgtgaagtttattaactcaatt

SEQ ID NO: 130323 - DNA, 22 bp, Artificial Sequence
  Synthetic oligonucleotide; TTT chr11 5303005 5303026 5303010 5303005 -
attaactcaattaccaacttcc

SEQ ID NO: 130324 - DNA, 22 bp, Artificial Sequence
  Synthetic oligonucleotide; TTA chr11 5303004 5303025 5303009 5303004 -
ttaactcaattaccaacttccg

SEQ ID NO: 130325 - DNA, 22 bp, Artificial Sequence
  Synthetic oligonucleotide; TTA chr11 5303001 5303022 5303006 5303001 -
actcaattaccaacttccgata

SEQ ID NO: 130326 - DNA, 22 bp, Artificial Sequence
  Synthetic oligonucleotide; CTC chr11 5302997 5303018 5303002 5302997 -
aattaccaacttccgatattac

SEQ ID NO: 130327 - DNA, 22 bp, Artificial Sequence
  Synthetic oligonucleotide; TTA chr11 5302992 5303013 5302997 5302992 -
ccaacttccgatattactattg

SEQ ID NO: 130328 - DNA, 22 bp, Artificial Sequence
  Synthetic oligonucleotide; CTT chr11 5302985 5303006 5302990 5302985 -
ccgatattactattgcccttca

SEQ ID NO: 130329 - DNA, 22 bp, Artificial Sequence
  Synthetic oligonucleotide; TTC chr11 5302984 5303005 5302989 5302984 -
cgatattactattgcccttcag

SEQ ID NO: 130330 - DNA, 22 bp, Artificial Sequence
  Synthetic oligonucleotide; TTA chr11 5302976 5302997 5302981 5302976 -
ctattgcccttcagatcaacat

SEQ ID NO: 130331 - DNA, 22 bp, Artificial Sequence
  Synthetic oligonucleotide; CTA chr11 5302973 5302994 5302978 5302973 -
ttgcccttcagatcaacatact

SEQ ID NO: 130332 - DNA, 22 bp, Artificial Sequence
  Synthetic oligonucleotide; TTG chr11 5302970 5302991 5302975 5302970 -
cccttcagatcaacatacttac

SEQ ID NO: 130333 - DNA, 22 bp, Artificial Sequence
  Synthetic oligonucleotide; CTT chr11 5302965 5302986 5302970 5302965 -
cagatcaacatacttacgaatc

SEQ ID NO: 130334 - DNA, 22 bp, Artificial Sequence
  Synthetic oligonucleotide; TTC chr11 5302964 5302985 5302969 5302964 -
agatcaacatacttacgaatct

SEQ ID NO: 130335 - DNA, 22 bp, Artificial Sequence
  Synthetic oligonucleotide; CTT chr11 5302950 5302971 5302955 5302950 -
acgaatctatgactctaacaag

SEQ ID NO: 130336 - DNA, 22 bp, Artificial Sequence
  Synthetic oligonucleotide; TTA chr11 5302949 5302970 5302954 5302949 -
cgaatctatgactctaacaagt

SEQ ID NO: 130337 - DNA, 22 bp, Artificial Sequence
  Synthetic oligonucleotide; CTA chr11 5302941 5302962 5302946 5302941 -
tgactctaacaagtattaggct

SEQ ID NO: 130338 - DNA, 22 bp, Artificial Sequence
  Synthetic oligonucleotide; CTC chr11 5302935 5302956 5302940 5302935 -
taacaagtattaggcttttgtg

SEQ ID NO: 130339 - DNA, 22 bp, Artificial Sequence
  Synthetic oligonucleotide; CTA chr11 5302933 5302954 5302938 5302933 -
acaagtattaggcttttgtgga

SEQ ID NO: 130340 - DNA, 22 bp, Artificial Sequence
  Synthetic oligonucleotide; TTA chr11 5302923 5302944 5302928 5302923 -
ggcttttgtggaggccctcatt

SEQ ID NO: 130341 - DNA, 22 bp, Artificial Sequence
  Synthetic oligonucleotide; CTT chr11 5302918 5302939 5302923 5302918 -
ttgtggaggccctcattgtaga

SEQ ID NO: 130342 - DNA, 22 bp, Artificial Sequence
  Synthetic oligonucleotide; TTT chr11 5302917 5302938 5302922 5302917 -
tgtggaggccctcattgtagaa

SEQ ID NO: 130343 - DNA, 22 bp, Artificial Sequence
  Synthetic oligonucleotide; TTT chr11 5302916 5302937 5302921 5302916 -
gtggaggccctcattgtagaag

SEQ ID NO: 130344 - DNA, 22 bp, Artificial Sequence
  Synthetic oligonucleotide; TTG chr11 5302915 5302936 5302920 5302915 -
tggaggccctcattgtagaagt

SEQ ID NO: 130345 - DNA, 22 bp, Artificial Sequence
  Synthetic oligonucleotide; CTC chr11 5302904 5302925 5302909 5302904 -
attgtagaagtatgtccttaaa

SEQ ID NO: 130346 - DNA, 22 bp, Artificial Sequence
  Synthetic oligonucleotide; TTG chr11 5302900 5302921 5302905 5302900 -
tagaagtatgtccttaaaatat

SEQ ID NO: 130347 - DNA, 22 bp, Artificial Sequence
  Synthetic oligonucleotide; CTT chr11 5302885 5302906 5302890 5302885 -
aaaatatttccgttatgagctt

SEQ ID NO: 130348 - DNA, 22 bp, Artificial Sequence
  Synthetic oligonucleotide; TTA chr11 5302884 5302905 5302889 5302884 -
aaatatttccgttatgagcttc

SEQ ID NO: 130349 - DNA, 22 bp, Artificial Sequence
  Synthetic oligonucleotide; TTT chr11 5302876 5302897 5302881 5302876 -
ccgttatgagcttccaacatga

SEQ ID NO: 130350 - DNA, 22 bp, Artificial Sequence
  Synthetic oligonucleotide; TTC chr11 5302875 5302896 5302880 5302875 -
cgttatgagcttccaacatgag

SEQ ID NO: 130351 - DNA, 22 bp, Artificial Sequence
  Synthetic oligonucleotide; TTA chr11 5302870 5302891 5302875 5302870 -
tgagcttccaacatgagtctcc

SEQ ID NO: 130352 - DNA, 22 bp, Artificial Sequence
  Synthetic oligonucleotide; CTT chr11 5302863 5302884 5302868 5302863 -
ccaacatgagtctcctattttc

SEQ ID NO: 130353 - DNA, 22 bp, Artificial Sequence
  Synthetic oligonucleotide; TTC chr11 5302862 5302883 5302867 5302862 -
caacatgagtctcctattttca

SEQ ID NO: 130354 - DNA, 22 bp, Artificial Sequence
  Synthetic oligonucleotide; CTC chr11 5302849 5302870 5302854 5302849 -
ctattttcatgtttgtccctaa

SEQ ID NO: 130355 - DNA, 22 bp, Artificial Sequence
  Synthetic oligonucleotide; CTA chr11 5302846 5302867 5302851 5302846 -
ttttcatgtttgtccctaatgt

SEQ ID NO: 130356 - DNA, 22 bp, Artificial Sequence
  Synthetic oligonucleotide; TTT chr11 5302843 5302864 5302848 5302843 -
tcatgtttgtccctaatgtgcc

SEQ ID NO: 130357 - DNA, 22 bp, Artificial Sequence
  Synthetic oligonucleotide; TTT chr11 5302842 5302863 5302847 5302842 -
catgtttgtccctaatgtgcca

SEQ ID NO: 130358 - DNA, 22 bp, Artificial Sequence
  Synthetic oligonucleotide; TTC chr11 5302841 5302862 5302846 5302841 -
atgtttgtccctaatgtgccaa

SEQ ID NO: 130359 - DNA, 22 bp, Artificial Sequence
  Synthetic oligonucleotide; TTT chr11 5302835 5302856 5302840 5302835 -
gtccctaatgtgccaaaactca

SEQ ID NO: 130360 - DNA, 22 bp, Artificial Sequence
  Synthetic oligonucleotide; TTG chr11 5302834 5302855 5302839 5302834 -
tccctaatgtgccaaaactcag

SEQ ID NO: 130361 - DNA, 22 bp, Artificial Sequence
  Synthetic oligonucleotide; CTA chr11 5302828 5302849 5302833 5302828 -
atgtgccaaaactcagactttt

SEQ ID NO: 130362 - DNA, 22 bp, Artificial Sequence
  Synthetic oligonucleotide; CTC chr11 5302814 5302835 5302819 5302814 -
agactttttgcagcatagggaa

SEQ ID NO: 130363 - DNA, 22 bp, Artificial Sequence
  Synthetic oligonucleotide; CTT chr11 5302808 5302829 5302813 5302808 -
tttgcagcatagggaacttgct

SEQ ID NO: 130364 - DNA, 22 bp, Artificial Sequence
  Synthetic oligonucleotide; TTT chr11 5302807 5302828 5302812 5302807 -
ttgcagcatagggaacttgctg

SEQ ID NO: 130365 - DNA, 22 bp, Artificial Sequence
  Synthetic oligonucleotide; TTT chr11 5302806 5302827 5302811 5302806 -
tgcagcatagggaacttgctga

SEQ ID NO: 130366 - DNA, 22 bp, Artificial Sequence
  Synthetic oligonucleotide; TTT chr11 5302805 5302826 5302810 5302805 -
gcagcatagggaacttgctgag

SEQ ID NO: 130367 - DNA, 22 bp, Artificial Sequence
  Synthetic oligonucleotide; TTG chr11 5302804 5302825 5302809 5302804 -
cagcatagggaacttgctgagt

SEQ ID NO: 130368 - DNA, 22 bp, Artificial Sequence
  Synthetic oligonucleotide; CTT chr11 5302789 5302810 5302794 5302789 -
gctgagtcccaagtccactgag

SEQ ID NO: 130369 - DNA, 22 bp, Artificial Sequence
  Synthetic oligonucleotide; TTG chr11 5302788 5302809 5302793 5302788 -
ctgagtcccaagtccactgagt

SEQ ID NO: 130370 - DNA, 22 bp, Artificial Sequence
  Synthetic oligonucleotide; CTG chr11 5302785 5302806 5302790 5302785 -
agtcccaagtccactgagtaat

SEQ ID NO: 130371 - DNA, 22 bp, Artificial Sequence
  Synthetic oligonucleotide; CTG chr11 5302769 5302790 5302774 5302769 -
agtaattacacctttctaaaat

SEQ ID NO: 130372 - DNA, 22 bp, Artificial Sequence
  Synthetic oligonucleotide; TTA chr11 5302761 5302782 5302766 5302761 -
cacctttctaaaatgagtttac

SEQ ID NO: 130373 - DNA, 22 bp, Artificial Sequence
  Synthetic oligonucleotide; CTT chr11 5302755 5302776 5302760 5302755 -
tctaaaatgagtttactaactt

SEQ ID NO: 130374 - DNA, 22 bp, Artificial Sequence
  Synthetic oligonucleotide; TTT chr11 5302754 5302775 5302759 5302754 -
ctaaaatgagtttactaacttt

SEQ ID NO: 130375 - DNA, 22 bp, Artificial Sequence
  Synthetic oligonucleotide; TTC chr11 5302753 5302774 5302758 5302753 -
taaaatgagtttactaacttta

SEQ ID NO: 130376 - DNA, 22 bp, Artificial Sequence
  Synthetic oligonucleotide; CTA chr11 5302751 5302772 5302756 5302751 -
aaatgagtttactaactttacc

SEQ ID NO: 130377 - DNA, 22 bp, Artificial Sequence
  Synthetic oligonucleotide; TTT chr11 5302741 5302762 5302746 5302741 -
actaactttacccacttgttca

SEQ ID NO: 130378 - DNA, 22 bp, Artificial Sequence
  Synthetic oligonucleotide; TTA chr11 5302740 5302761 5302745 5302740 -
ctaactttacccacttgttcag

SEQ ID NO: 130379 - DNA, 22 bp, Artificial Sequence
  Synthetic oligonucleotide; CTA chr11 5302737 5302758 5302742 5302737 -
actttacccacttgttcaggtg

SEQ ID NO: 130380 - DNA, 22 bp, Artificial Sequence
  Synthetic oligonucleotide; CTT chr11 5302733 5302754 5302738 5302733 -
tacccacttgttcaggtgttca

SEQ ID NO: 130381 - DNA, 22 bp, Artificial Sequence
  Synthetic oligonucleotide; TTT chr11 5302732 5302753 5302737 5302732 -
acccacttgttcaggtgttcag

SEQ ID NO: 130382 - DNA, 22 bp, Artificial Sequence
  Synthetic oligonucleotide; TTA chr11 5302731 5302752 5302736 5302731 -
cccacttgttcaggtgttcaga

SEQ ID NO: 130383 - DNA, 22 bp, Artificial Sequence
  Synthetic oligonucleotide; CTT chr11 5302724 5302745 5302729 5302724 -
gttcaggtgttcagatttctgt

SEQ ID NO: 130384 - DNA, 22 bp, Artificial Sequence
  Synthetic oligonucleotide; TTG chr11 5302723 5302744 5302728 5302723 -
ttcaggtgttcagatttctgtg

SEQ ID NO: 130385 - DNA, 22 bp, Artificial Sequence
  Synthetic oligonucleotide; TTC chr11 5302720 5302741 5302725 5302720 -
aggtgttcagatttctgtggaa

SEQ ID NO: 130386 - DNA, 22 bp, Artificial Sequence
  Synthetic oligonucleotide; TTC chr11 5302712 5302733 5302717 5302712 -
agatttctgtggaaactcacaa

SEQ ID NO: 130387 - DNA, 22 bp, Artificial Sequence
  Synthetic oligonucleotide; TTT chr11 5302706 5302727 5302711 5302706 -
ctgtggaaactcacaatagatg

SEQ ID NO: 130388 - DNA, 22 bp, Artificial Sequence
  Synthetic oligonucleotide; TTC chr11 5302705 5302726 5302710 5302705 -
tgtggaaactcacaatagatga

SEQ ID NO: 130389 - DNA, 22 bp, Artificial Sequence
  Synthetic oligonucleotide; CTG chr11 5302703 5302724 5302708 5302703 -
tggaaactcacaatagatgagt

SEQ ID NO: 130390 - DNA, 22 bp, Artificial Sequence
  Synthetic oligonucleotide; CTC chr11 5302694 5302715 5302699 5302694 -
acaatagatgagttattttctt

SEQ ID NO: 130391 - DNA, 22 bp, Artificial Sequence
  Synthetic oligonucleotide; TTA chr11 5302679 5302700 5302684 5302679 -
ttttctttcgttttattttatt

SEQ ID NO: 130392 - DNA, 22 bp, Artificial Sequence
  Synthetic oligonucleotide; TTT chr11 5302676 5302697 5302681 5302676 -
tctttcgttttattttatttta

SEQ ID NO: 130393 - DNA, 22 bp, Artificial Sequence
  Synthetic oligonucleotide; TTT chr11 5302675 5302696 5302680 5302675 -
ctttcgttttattttattttat

SEQ ID NO: 130394 - DNA, 22 bp, Artificial Sequence
  Synthetic oligonucleotide; TTC chr11 5302674 5302695 5302679 5302674 -
tttcgttttattttattttatt

SEQ ID NO: 130395 - DNA, 22 bp, Artificial Sequence
  Synthetic oligonucleotide; CTT chr11 5302672 5302693 5302677 5302672 -
tcgttttattttattttatttt

SEQ ID NO: 130396 - DNA, 22 bp, Artificial Sequence
  Synthetic oligonucleotide; TTT chr11 5302671 5302692 5302676 5302671 -
cgttttattttattttattttt

SEQ ID NO: 130397 - DNA, 22 bp, Artificial Sequence
  Synthetic oligonucleotide; TTC chr11 5302670 5302691 5302675 5302670 -
gttttattttattttatttttt

SEQ ID NO: 130398 - DNA, 22 bp, Artificial Sequence
  Synthetic oligonucleotide; TTT chr11 5302666 5302687 5302671 5302666 -
tattttattttattttttatag

SEQ ID NO: 130399 - DNA, 22 bp, Artificial Sequence
  Synthetic oligonucleotide; TTT chr11 5302665 5302686 5302670 5302665 -
attttattttattttttataga

SEQ ID NO: 130400 - DNA, 22 bp, Artificial Sequence
  Synthetic oligonucleotide; TTA chr11 5302664 5302685 5302669 5302664 -
ttttattttattttttatagag

SEQ ID NO: 130401 - DNA, 22 bp, Artificial Sequence
  Synthetic oligonucleotide; TTT chr11 5302661 5302682 5302666 5302661 -
tattttattttttatagagaca

SEQ ID NO: 130402 - DNA, 22 bp, Artificial Sequence
  Synthetic oligonucleotide; TTT chr11 5302660 5302681 5302665 5302660 -
attttattttttatagagacag

SEQ ID NO: 130403 - DNA, 22 bp, Artificial Sequence
  Synthetic oligonucleotide; TTA chr11 5302659 5302680 5302664 5302659 -
ttttattttttatagagacaga

SEQ ID NO: 130404 - DNA, 22 bp, Artificial Sequence
  Synthetic oligonucleotide; TTT chr11 5302656 5302677 5302661 5302656 -
tattttttatagagacagagtc

SEQ ID NO: 130405 - DNA, 22 bp, Artificial Sequence
  Synthetic oligonucleotide; TTT chr11 5302655 5302676 5302660 5302655 -
attttttatagagacagagtct

SEQ ID NO: 130406 - DNA, 22 bp, Artificial Sequence
  Synthetic oligonucleotide; TTA chr11 5302654 5302675 5302659 5302654 -
ttttttatagagacagagtctg

SEQ ID NO: 130407 - DNA, 22 bp, Artificial Sequence
  Synthetic oligonucleotide; TTT chr11 5302651 5302672 5302656 5302651 -
tttatagagacagagtctgact

SEQ ID NO: 130408 - DNA, 22 bp, Artificial Sequence
  Synthetic oligonucleotide; TTT chr11 5302650 5302671 5302655 5302650 -
ttatagagacagagtctgactc

SEQ ID NO: 130409 - DNA, 22 bp, Artificial Sequence
  Synthetic oligonucleotide; TTT chr11 5302649 5302670 5302654 5302649 -
tatagagacagagtctgactcc

SEQ ID NO: 130410 - DNA, 22 bp, Artificial Sequence
  Synthetic oligonucleotide; TTT chr11 5302648 5302669 5302653 5302648 -
atagagacagagtctgactccg

SEQ ID NO: 130411 - DNA, 22 bp, Artificial Sequence
  Synthetic oligonucleotide; TTA chr11 5302647 5302668 5302652 5302647 -
tagagacagagtctgactccgt

SEQ ID NO: 130412 - DNA, 22 bp, Artificial Sequence
  Synthetic oligonucleotide; CTG chr11 5302632 5302653 5302637 5302632 -
actccgttgcccaggctggaga

SEQ ID NO: 130413 - DNA, 22 bp, Artificial Sequence
  Synthetic oligonucleotide; CTC chr11 5302628 5302649 5302633 5302628 -
cgttgcccaggctggagagcag

SEQ ID NO: 130414 - DNA, 22 bp, Artificial Sequence
  Synthetic oligonucleotide; TTG chr11 5302623 5302644 5302628 5302623 -
cccaggctggagagcagtgctg

SEQ ID NO: 130415 - DNA, 22 bp, Artificial Sequence
  Synthetic oligonucleotide; CTG chr11 5302614 5302635 5302619 5302614 -
gagagcagtgctgcaatcatag

SEQ ID NO: 130416 - DNA, 22 bp, Artificial Sequence
  Synthetic oligonucleotide; CTG chr11 5302601 5302622 5302606 5302601 -
caatcatagctccctgcagcct

SEQ ID NO: 130417 - DNA, 22 bp, Artificial Sequence
  Synthetic oligonucleotide; CTC chr11 5302589 5302610 5302594 5302589 -
cctgcagcctcacagtcctggg

SEQ ID NO: 130418 - DNA, 22 bp, Artificial Sequence
  Synthetic oligonucleotide; CTG chr11 5302585 5302606 5302590 5302585 -
cagcctcacagtcctgggctca

SEQ ID NO: 130419 - DNA, 22 bp, Artificial Sequence
  Synthetic oligonucleotide; CTC chr11 5302578 5302599 5302583 5302578 -
acagtcctgggctcaggtgatg

SEQ ID NO: 130420 - DNA, 22 bp, Artificial Sequence
  Synthetic oligonucleotide; CTG chr11 5302569 5302590 5302574 5302569 -
ggctcaggtgatgtgtgcccct

SEQ ID NO: 130421 - DNA, 22 bp, Artificial Sequence
  Synthetic oligonucleotide; CTC chr11 5302564 5302585 5302569 5302564 -
aggtgatgtgtgcccctgtgcc

SEQ ID NO: 130422 - DNA, 22 bp, Artificial Sequence
  Synthetic oligonucleotide; CTG chr11 5302546 5302567 5302551 5302546 -
tgcccagctaatttttatcttt

SEQ ID NO: 130423 - DNA, 22 bp, Artificial Sequence
  Synthetic oligonucleotide; CTA chr11 5302536 5302557 5302541 5302536 -
atttttatcttttctttttttt

SEQ ID NO: 130424 - DNA, 22 bp, Artificial Sequence
  Synthetic oligonucleotide; TTT chr11 5302532 5302553 5302537 5302532 -
ttatcttttcttttttttttgg

SEQ ID NO: 130425 - DNA, 22 bp, Artificial Sequence
  Synthetic oligonucleotide; TTT chr11 5302531 5302552 5302536 5302531 -
tatcttttcttttttttttggt

SEQ ID NO: 130426 - DNA, 22 bp, Artificial Sequence
  Synthetic oligonucleotide; TTT chr11 5302530 5302551 5302535 5302530 -
atcttttcttttttttttggtg

SEQ ID NO: 130427 - DNA, 22 bp, Artificial Sequence
  Synthetic oligonucleotide; TTA chr11 5302529 5302550 5302534 5302529 -
tcttttcttttttttttggtgg

SEQ ID NO: 130428 - DNA, 22 bp, Artificial Sequence
  Synthetic oligonucleotide; CTT chr11 5302525 5302546 5302530 5302525 -
ttcttttttttttggtggaggc

SEQ ID NO: 130429 - DNA, 22 bp, Artificial Sequence
  Synthetic oligonucleotide; TTT chr11 5302524 5302545 5302529 5302524 -
tcttttttttttggtggaggca

SEQ ID NO: 130430 - DNA, 22 bp, Artificial Sequence
  Synthetic oligonucleotide; TTT chr11 5302523 5302544 5302528 5302523 -
cttttttttttggtggaggcag

SEQ ID NO: 130431 - DNA, 22 bp, Artificial Sequence
  Synthetic oligonucleotide; TTC chr11 5302522 5302543 5302527 5302522 -
ttttttttttggtggaggcagg

SEQ ID NO: 130432 - DNA, 22 bp, Artificial Sequence
  Synthetic oligonucleotide; CTT chr11 5302520 5302541 5302525 5302520 -
ttttttttggtggaggcagggt

SEQ ID NO: 130433 - DNA, 22 bp, Artificial Sequence
  Synthetic oligonucleotide; TTT chr11 5302519 5302540 5302524 5302519 -
tttttttggtggaggcagggtc

SEQ ID NO: 130434 - DNA, 22 bp, Artificial Sequence
  Synthetic oligonucleotide; TTT chr11 5302518 5302539 5302523 5302518 -
ttttttggtggaggcagggtct

SEQ ID NO: 130435 - DNA, 22 bp, Artificial Sequence
  Synthetic oligonucleotide; TTT chr11 5302517 5302538 5302522 5302517 -
tttttggtggaggcagggtcta

SEQ ID NO: 130436 - DNA, 22 bp, Artificial Sequence
  Synthetic oligonucleotide; TTT chr11 5302516 5302537 5302521 5302516 -
ttttggtggaggcagggtctag

SEQ ID NO: 130437 - DNA, 22 bp, Artificial Sequence
  Synthetic oligonucleotide; TTT chr11 5302515 5302536 5302520 5302515 -
tttggtggaggcagggtctagc

SEQ ID NO: 130438 - DNA, 22 bp, Artificial Sequence
  Synthetic oligonucleotide; TTT chr11 5302514 5302535 5302519 5302514 -
ttggtggaggcagggtctagct

SEQ ID NO: 130439 - DNA, 22 bp, Artificial Sequence
  Synthetic oligonucleotide; TTT chr11 5302513 5302534 5302518 5302513 -
tggtggaggcagggtctagcta

SEQ ID NO: 130440 - DNA, 22 bp, Artificial Sequence
  Synthetic oligonucleotide; TTT chr11 5302512 5302533 5302517 5302512 -
ggtggaggcagggtctagctat

SEQ ID NO: 130441 - DNA, 22 bp, Artificial Sequence
  Synthetic oligonucleotide; TTG chr11 5302511 5302532 5302516 5302511 -
gtggaggcagggtctagctatg

SEQ ID NO: 130442 - DNA, 22 bp, Artificial Sequence
  Synthetic oligonucleotide; CTA chr11 5302495 5302516 5302500 5302495 -
gctatgttgcccaggctgggtt

SEQ ID NO: 130443 - DNA, 22 bp, Artificial Sequence
  Synthetic oligonucleotide; CTA chr11 5302491 5302512 5302496 5302491 -
tgttgcccaggctgggttctct

SEQ ID NO: 130444 - DNA, 22 bp, Artificial Sequence
  Synthetic oligonucleotide; TTG chr11 5302486 5302507 5302491 5302486 -
cccaggctgggttctcttctta

SEQ ID NO: 130445 - DNA, 22 bp, Artificial Sequence
  Synthetic oligonucleotide; CTG chr11 5302477 5302498 5302482 5302477 -
ggttctcttcttattcacagtc

SEQ ID NO: 130446 - DNA, 22 bp, Artificial Sequence
  Synthetic oligonucleotide; TTC chr11 5302472 5302493 5302477 5302472 -
tcttcttattcacagtccactt

SEQ ID NO: 130447 - DNA, 22 bp, Artificial Sequence
  Synthetic oligonucleotide; CTC chr11 5302470 5302491 5302475 5302470 -
ttcttattcacagtccacttga

SEQ ID NO: 130448 - DNA, 22 bp, Artificial Sequence
  Synthetic oligonucleotide; CTT chr11 5302468 5302489 5302473 5302468 -
cttattcacagtccacttgaga

SEQ ID NO: 130449 - DNA, 22 bp, Artificial Sequence
  Synthetic oligonucleotide; TTC chr11 5302467 5302488 5302472 5302467 -
ttattcacagtccacttgagat

SEQ ID NO: 130450 - DNA, 22 bp, Artificial Sequence
  Synthetic oligonucleotide; CTT chr11 5302465 5302486 5302470 5302465 -
attcacagtccacttgagatag

SEQ ID NO: 130451 - DNA, 22 bp, Artificial Sequence
  Synthetic oligonucleotide; TTA chr11 5302464 5302485 5302469 5302464 -
ttcacagtccacttgagatagc

SEQ ID NO: 130452 - DNA, 22 bp, Artificial Sequence
  Synthetic oligonucleotide; TTC chr11 5302461 5302482 5302466 5302461 -
acagtccacttgagatagcaac

SEQ ID NO: 130453 - DNA, 22 bp, Artificial Sequence
  Synthetic oligonucleotide; CTT chr11 5302450 5302471 5302455 5302450 -
gagatagcaacattgatcacaa

SEQ ID NO: 130454 - DNA, 22 bp, Artificial Sequence
  Synthetic oligonucleotide; TTG chr11 5302449 5302470 5302454 5302449 -
agatagcaacattgatcacaat

SEQ ID NO: 130455 - DNA, 22 bp, Artificial Sequence
  Synthetic oligonucleotide; TTG chr11 5302435 5302456 5302440 5302435 -
atcacaatatttctcagtcatt

SEQ ID NO: 130456 - DNA, 22 bp, Artificial Sequence
  Synthetic oligonucleotide; TTT chr11 5302423 5302444 5302428 5302423 -
ctcagtcatttctattgaataa

SEQ ID NO: 130457 - DNA, 22 bp, Artificial Sequence
  Synthetic oligonucleotide; TTC chr11 5302422 5302443 5302427 5302422 -
tcagtcatttctattgaataag

SEQ ID NO: 130458 - DNA, 22 bp, Artificial Sequence
  Synthetic oligonucleotide; CTC chr11 5302420 5302441 5302425 5302420 -
agtcatttctattgaataagca

SEQ ID NO: 130459 - DNA, 22 bp, Artificial Sequence
  Synthetic oligonucleotide; TTT chr11 5302412 5302433 5302417 5302412 -
ctattgaataagcattttcctc

SEQ ID NO: 130460 - DNA, 22 bp, Artificial Sequence
  Synthetic oligonucleotide; TTC chr11 5302411 5302432 5302416 5302411 -
tattgaataagcattttcctca

SEQ ID NO: 130461 - DNA, 22 bp, Artificial Sequence
  Synthetic oligonucleotide; CTA chr11 5302409 5302430 5302414 5302409 -
ttgaataagcattttcctcagt

SEQ ID NO: 130462 - DNA, 22 bp, Artificial Sequence
  Synthetic oligonucleotide; TTG chr11 5302406 5302427 5302411 5302406 -
aataagcattttcctcagtggt

SEQ ID NO: 130463 - DNA, 22 bp, Artificial Sequence
  Synthetic oligonucleotide; TTT chr11 5302395 5302416 5302400 5302395 -
tcctcagtggttaatcctaaat

SEQ ID NO: 130464 - DNA, 22 bp, Artificial Sequence
  Synthetic oligonucleotide; TTT chr11 5302394 5302415 5302399 5302394 -
cctcagtggttaatcctaaata

SEQ ID NO: 130465 - DNA, 22 bp, Artificial Sequence
  Synthetic oligonucleotide; TTC chr11 5302393 5302414 5302398 5302393 -
ctcagtggttaatcctaaatac

SEQ ID NO: 130466 - DNA, 22 bp, Artificial Sequence
  Synthetic oligonucleotide; CTC chr11 5302390 5302411 5302395 5302390 -
agtggttaatcctaaatacagc

SEQ ID NO: 130467 - DNA, 22 bp, Artificial Sequence
  Synthetic oligonucleotide; TTA chr11 5302382 5302403 5302387 5302382 -
atcctaaatacagctgtcccat

SEQ ID NO: 130468 - DNA, 22 bp, Artificial Sequence
  Synthetic oligonucleotide; CTA chr11 5302376 5302397 5302381 5302376 -
aatacagctgtcccattagttt

SEQ ID NO: 130469 - DNA, 22 bp, Artificial Sequence
  Synthetic oligonucleotide; CTG chr11 5302366 5302387 5302371 5302366 -
tcccattagtttcaagagaaaa

SEQ ID NO: 130470 - DNA, 22 bp, Artificial Sequence
  Synthetic oligonucleotide; TTA chr11 5302358 5302379 5302363 5302358 -
gtttcaagagaaaaaatttgaa

SEQ ID NO: 130471 - DNA, 22 bp, Artificial Sequence
  Synthetic oligonucleotide; TTT chr11 5302354 5302375 5302359 5302354 -
caagagaaaaaatttgaactga

SEQ ID NO: 130472 - DNA, 22 bp, Artificial Sequence
  Synthetic oligonucleotide; TTC chr11 5302353 5302374 5302358 5302353 -
aagagaaaaaatttgaactgac

SEQ ID NO: 130473 - DNA, 22 bp, Artificial Sequence
  Synthetic oligonucleotide; TTT chr11 5302339 5302360 5302344 5302339 -
gaactgactcaacttggatagt

SEQ ID NO: 130474 - DNA, 22 bp, Artificial Sequence
  Synthetic oligonucleotide; TTG chr11 5302338 5302359 5302343 5302338 -
aactgactcaacttggatagta

SEQ ID NO: 130475 - DNA, 22 bp, Artificial Sequence
  Synthetic oligonucleotide; CTG chr11 5302333 5302354 5302338 5302333 -
actcaacttggatagtaacaca

SEQ ID NO: 130476 - DNA, 22 bp, Artificial Sequence
  Synthetic oligonucleotide; CTC chr11 5302329 5302350 5302334 5302329 -
aacttggatagtaacacagtaa

SEQ ID NO: 130477 - DNA, 22 bp, Artificial Sequence
  Synthetic oligonucleotide; CTT chr11 5302324 5302345 5302329 5302324 -
ggatagtaacacagtaagggcc

SEQ ID NO: 130478 - DNA, 22 bp, Artificial Sequence
  Synthetic oligonucleotide; TTG chr11 5302323 5302344 5302328 5302323 -
gatagtaacacagtaagggccc

SEQ ID NO: 130479 - DNA, 22 bp, Artificial Sequence
  Synthetic oligonucleotide; CTA chr11 5302236 5302257 5302241 5302236 -
tttgggaccaagagtcaaggct

SEQ ID NO: 130480 - DNA, 22 bp, Artificial Sequence
  Synthetic oligonucleotide; TTT chr11 5302233 5302254 5302238 5302233 -
gggaccaagagtcaaggctatg

SEQ ID NO: 130481 - DNA, 22 bp, Artificial Sequence
  Synthetic oligonucleotide; TTG chr11 5302232 5302253 5302237 5302232 -
ggaccaagagtcaaggctatga

SEQ ID NO: 130482 - DNA, 22 bp, Artificial Sequence
  Synthetic oligonucleotide; CTA chr11 5302213 5302234 5302218 5302213 -
tgagcacagacgtaagatgagt

SEQ ID NO: 130483 - DNA, 22 bp, Artificial Sequence
  Synthetic oligonucleotide; TTG chr11 5302187 5302208 5302192 5302187 -
aaaaaataaaggttgtatgctt

SEQ ID NO: 130484 - DNA, 22 bp, Artificial Sequence
  Synthetic oligonucleotide; TTG chr11 5302172 5302193 5302177 5302172 -
tatgcttcatagtgaattggaa

SEQ ID NO: 130485 - DNA, 22 bp, Artificial Sequence
  Synthetic oligonucleotide; CTT chr11 5302165 5302186 5302170 5302165 -
catagtgaattggaattattat

SEQ ID NO: 130486 - DNA, 22 bp, Artificial Sequence
  Synthetic oligonucleotide; TTC chr11 5302164 5302185 5302169 5302164 -
atagtgaattggaattattatt

SEQ ID NO: 130487 - DNA, 22 bp, Artificial Sequence
  Synthetic oligonucleotide; TTG chr11 5302153 5302174 5302158 5302153 -
gaattattattctgaccatgat

SEQ ID NO: 130488 - DNA, 22 bp, Artificial Sequence
  Synthetic oligonucleotide; TTA chr11 5302147 5302168 5302152 5302147 -
ttattctgaccatgatttttgt

SEQ ID NO: 130489 - DNA, 22 bp, Artificial Sequence
  Synthetic oligonucleotide; TTA chr11 5302144 5302165 5302149 5302144 -
ttctgaccatgatttttgttat

SEQ ID NO: 130490 - DNA, 22 bp, Artificial Sequence
  Synthetic oligonucleotide; TTC chr11 5302141 5302162 5302146 5302141 -
tgaccatgatttttgttatttg

SEQ ID NO: 130491 - DNA, 22 bp, Artificial Sequence
  Synthetic oligonucleotide; CTG chr11 5302139 5302160 5302144 5302139 -
accatgatttttgttatttgtt

SEQ ID NO: 130492 - DNA, 22 bp, Artificial Sequence
  Synthetic oligonucleotide; TTT chr11 5302129 5302150 5302134 5302129 -
ttgttatttgttattctaggga

SEQ ID NO: 130493 - DNA, 22 bp, Artificial Sequence
  Synthetic oligonucleotide; TTT chr11 5302128 5302149 5302133 5302128 -
tgttatttgttattctagggaa

SEQ ID NO: 130494 - DNA, 22 bp, Artificial Sequence
  Synthetic oligonucleotide; TTT chr11 5302127 5302148 5302132 5302127 -
gttatttgttattctagggaaa

SEQ ID NO: 130495 - DNA, 22 bp, Artificial Sequence
  Synthetic oligonucleotide; TTG chr11 5302126 5302147 5302131 5302126 -
ttatttgttattctagggaaag

SEQ ID NO: 130496 - DNA, 22 bp, Artificial Sequence
  Synthetic oligonucleotide; TTA chr11 5302123 5302144 5302128 5302123 -
tttgttattctagggaaaggcc

SEQ ID NO: 130497 - DNA, 22 bp, Artificial Sequence
  Synthetic oligonucleotide; TTT chr11 5302120 5302141 5302125 5302120 -
gttattctagggaaaggccttg

SEQ ID NO: 130498 - DNA, 22 bp, Artificial Sequence
  Synthetic oligonucleotide; TTG chr11 5302119 5302140 5302124 5302119 -
ttattctagggaaaggccttgt

SEQ ID NO: 130499 - DNA, 22 bp, Artificial Sequence
  Synthetic oligonucleotide; TTA chr11 5302116 5302137 5302121 5302116 -
ttctagggaaaggccttgtgag

SEQ ID NO: 130500 - DNA, 22 bp, Artificial Sequence
  Synthetic oligonucleotide; TTC chr11 5302113 5302134 5302118 5302113 -
tagggaaaggccttgtgagtac

SEQ ID NO: 130501 - DNA, 22 bp, Artificial Sequence
  Synthetic oligonucleotide; CTA chr11 5302111 5302132 5302116 5302111 -
gggaaaggccttgtgagtacag

SEQ ID NO: 130502 - DNA, 22 bp, Artificial Sequence
  Synthetic oligonucleotide; CTT chr11 5302099 5302120 5302104 5302099 -
gtgagtacaggcttacaattaa

SEQ ID NO: 130503 - DNA, 22 bp, Artificial Sequence
  Synthetic oligonucleotide; TTG chr11 5302098 5302119 5302103 5302098 -
tgagtacaggcttacaattaat

SEQ ID NO: 130504 - DNA, 22 bp, Artificial Sequence
  Synthetic oligonucleotide; CTT chr11 5302085 5302106 5302090 5302085 -
acaattaattaagtatgagaca

SEQ ID NO: 130505 - DNA, 22 bp, Artificial Sequence
  Synthetic oligonucleotide; TTA chr11 5302084 5302105 5302089 5302084 -
caattaattaagtatgagacaa

SEQ ID NO: 130506 - DNA, 22 bp, Artificial Sequence
  Synthetic oligonucleotide; TTA chr11 5302078 5302099 5302083 5302078 -
attaagtatgagacaatccaga

SEQ ID NO: 130507 - DNA, 22 bp, Artificial Sequence
  Synthetic oligonucleotide; TTA chr11 5302074 5302095 5302079 5302074 -
agtatgagacaatccagaaaaa

SEQ ID NO: 130508 - DNA, 22 bp, Artificial Sequence
  Synthetic oligonucleotide; TTT chr11 5302047 5302068 5302052 5302047 -
aagttttgaggtaaaaaatggc

SEQ ID NO: 130509 - DNA, 22 bp, Artificial Sequence
  Synthetic oligonucleotide; TTA chr11 5302046 5302067 5302051 5302046 -
agttttgaggtaaaaaatggcc

SEQ ID NO: 130510 - DNA, 22 bp, Artificial Sequence
  Synthetic oligonucleotide; TTT chr11 5302041 5302062 5302046 5302041 -
tgaggtaaaaaatggcctgatg

SEQ ID NO: 130511 - DNA, 22 bp, Artificial Sequence
  Synthetic oligonucleotide; TTT chr11 5302040 5302061 5302045 5302040 -
gaggtaaaaaatggcctgatga

SEQ ID NO: 130512 - DNA, 22 bp, Artificial Sequence
  Synthetic oligonucleotide; TTG chr11 5302039 5302060 5302044 5302039 -
aggtaaaaaatggcctgatgat

SEQ ID NO: 130513 - DNA, 22 bp, Artificial Sequence
  Synthetic oligonucleotide; CTG chr11 5302022 5302043 5302027 5302022 -
atgatgtgctacaagaagattg

SEQ ID NO: 130514 - DNA, 22 bp, Artificial Sequence
  Synthetic oligonucleotide; CTA chr11 5302011 5302032 5302016 5302011 -
caagaagattgtgagagaaaaa

SEQ ID NO: 130515 - DNA, 22 bp, Artificial Sequence
  Synthetic oligonucleotide; TTG chr11 5302000 5302021 5302005 5302000 -
tgagagaaaaaagaaaactgca

SEQ ID NO: 130516 - DNA, 22 bp, Artificial Sequence
  Synthetic oligonucleotide; CTG chr11 5301980 5302001 5301985 5301980 -
catctttggaggtcatcacccc

SEQ ID NO: 130517 - DNA, 22 bp, Artificial Sequence
  Synthetic oligonucleotide; CTT chr11 5301974 5301995 5301979 5301974 -
tggaggtcatcacccctaaaaa

SEQ ID NO: 130518 - DNA, 22 bp, Artificial Sequence
  Synthetic oligonucleotide; TTT chr11 5301973 5301994 5301978 5301973 -
ggaggtcatcacccctaaaaaa

SEQ ID NO: 130519 - DNA, 22 bp, Artificial Sequence
  Synthetic oligonucleotide; TTG chr11 5301972 5301993 5301977 5301972 -
gaggtcatcacccctaaaaaat

SEQ ID NO: 130520 - DNA, 22 bp, Artificial Sequence
  Synthetic oligonucleotide; CTA chr11 5301956 5301977 5301961 5301956 -
aaaaatatcttctccacctgca

SEQ ID NO: 130521 - DNA, 22 bp, Artificial Sequence
  Synthetic oligonucleotide; CTT chr11 5301945 5301966 5301950 5301945 -
ctccacctgcaaaacctaccat

SEQ ID NO: 130522 - DNA, 22 bp, Artificial Sequence
  Synthetic oligonucleotide; TTC chr11 5301944 5301965 5301949 5301944 -
tccacctgcaaaacctaccatg

SEQ ID NO: 130523 - DNA, 22 bp, Artificial Sequence
  Synthetic oligonucleotide; CTC chr11 5301942 5301963 5301947 5301942 -
cacctgcaaaacctaccatgtg

SEQ ID NO: 130524 - DNA, 22 bp, Artificial Sequence
  Synthetic oligonucleotide; CTG chr11 5301936 5301957 5301941 5301936 -
caaaacctaccatgtggtataa

SEQ ID NO: 130525 - DNA, 22 bp, Artificial Sequence
  Synthetic oligonucleotide; CTA chr11 5301927 5301948 5301932 5301927 -
ccatgtggtataacaacagtgc

SEQ ID NO: 130526 - DNA, 22 bp, Artificial Sequence
  Synthetic oligonucleotide; CTG chr11 5301903 5301924 5301908 5301903 -
gccccttcttgctgactggctt

SEQ ID NO: 130527 - DNA, 22 bp, Artificial Sequence
  Synthetic oligonucleotide; CTT chr11 5301896 5301917 5301901 5301896 -
cttgctgactggcttcttgggc

SEQ ID NO: 130528 - DNA, 22 bp, Artificial Sequence
  Synthetic oligonucleotide; TTC chr11 5301895 5301916 5301900 5301895 -
ttgctgactggcttcttgggct

SEQ ID NO: 130529 - DNA, 22 bp, Artificial Sequence
  Synthetic oligonucleotide; CTT chr11 5301893 5301914 5301898 5301893 -
gctgactggcttcttgggctca

SEQ ID NO: 130530 - DNA, 22 bp, Artificial Sequence
  Synthetic oligonucleotide; TTG chr11 5301892 5301913 5301897 5301892 -
ctgactggcttcttgggctcag

SEQ ID NO: 130531 - DNA, 22 bp, Artificial Sequence
  Synthetic oligonucleotide; CTG chr11 5301889 5301910 5301894 5301889 -
actggcttcttgggctcagagg

SEQ ID NO: 130532 - DNA, 22 bp, Artificial Sequence
  Synthetic oligonucleotide; CTG chr11 5301885 5301906 5301890 5301885 -
gcttcttgggctcagaggcagt

SEQ ID NO: 130533 - DNA, 22 bp, Artificial Sequence
  Synthetic oligonucleotide; CTT chr11 5301881 5301902 5301886 5301881 -
cttgggctcagaggcagttcac

SEQ ID NO: 130534 - DNA, 22 bp, Artificial Sequence
  Synthetic oligonucleotide; TTC chr11 5301880 5301901 5301885 5301880 -
ttgggctcagaggcagttcact

SEQ ID NO: 130535 - DNA, 22 bp, Artificial Sequence
  Synthetic oligonucleotide; CTT chr11 5301878 5301899 5301883 5301878 -
gggctcagaggcagttcactac

SEQ ID NO: 130536 - DNA, 22 bp, Artificial Sequence
  Synthetic oligonucleotide; TTG chr11 5301877 5301898 5301882 5301877 -
ggctcagaggcagttcactacc

SEQ ID NO: 130537 - DNA, 22 bp, Artificial Sequence
  Synthetic oligonucleotide; CTC chr11 5301872 5301893 5301877 5301872 -
agaggcagttcactaccggatc

SEQ ID NO: 130538 - DNA, 22 bp, Artificial Sequence
  Synthetic oligonucleotide; TTC chr11 5301861 5301882 5301866 5301861 -
actaccggatctctatgtcctt

SEQ ID NO: 130539 - DNA, 22 bp, Artificial Sequence
  Synthetic oligonucleotide; CTA chr11 5301857 5301878 5301862 5301857 -
ccggatctctatgtccttcttt

SEQ ID NO: 130540 - DNA, 22 bp, Artificial Sequence
  Synthetic oligonucleotide; CTC chr11 5301848 5301869 5301853 5301848 -
tatgtccttctttgtcatctac

SEQ ID NO: 130541 - DNA, 22 bp, Artificial Sequence
  Synthetic oligonucleotide; CTA chr11 5301846 5301867 5301851 5301846 -
tgtccttctttgtcatctactt

SEQ ID NO: 130542 - DNA, 22 bp, Artificial Sequence
  Synthetic oligonucleotide; CTT chr11 5301839 5301860 5301844 5301839 -
ctttgtcatctacttctccgtc

SEQ ID NO: 130543 - DNA, 22 bp, Artificial Sequence
  Synthetic oligonucleotide; TTC chr11 5301838 5301859 5301843 5301838 -
tttgtcatctacttctccgtcc

SEQ ID NO: 130544 - DNA, 22 bp, Artificial Sequence
  Synthetic oligonucleotide; CTT chr11 5301836 5301857 5301841 5301836 -
tgtcatctacttctccgtcctt

SEQ ID NO: 130545 - DNA, 22 bp, Artificial Sequence
  Synthetic oligonucleotide; TTT chr11 5301835 5301856 5301840 5301835 -
gtcatctacttctccgtccttt

SEQ ID NO: 130546 - DNA, 22 bp, Artificial Sequence
  Synthetic oligonucleotide; TTG chr11 5301834 5301855 5301839 5301834 -
tcatctacttctccgtcctttt

SEQ ID NO: 130547 - DNA, 22 bp, Artificial Sequence
  Synthetic oligonucleotide; CTA chr11 5301827 5301848 5301832 5301827 -
cttctccgtcctttttggaaat

SEQ ID NO: 130548 - DNA, 22 bp, Artificial Sequence
  Synthetic oligonucleotide; CTT chr11 5301824 5301845 5301829 5301824 -
ctccgtcctttttggaaatggc

SEQ ID NO: 130549 - DNA, 22 bp, Artificial Sequence
  Synthetic oligonucleotide; TTC chr11 5301823 5301844 5301828 5301823 -
tccgtcctttttggaaatggca

SEQ ID NO: 130550 - DNA, 22 bp, Artificial Sequence
  Synthetic oligonucleotide; CTC chr11 5301821 5301842 5301826 5301821 -
cgtcctttttggaaatggcact

SEQ ID NO: 130551 - DNA, 22 bp, Artificial Sequence
  Synthetic oligonucleotide; CTT chr11 5301814 5301835 5301819 5301814 -
tttggaaatggcactcttcttg

SEQ ID NO: 130552 - DNA, 22 bp, Artificial Sequence
  Synthetic oligonucleotide; TTT chr11 5301813 5301834 5301818 5301813 -
ttggaaatggcactcttcttgt

SEQ ID NO: 130553 - DNA, 22 bp, Artificial Sequence
  Synthetic oligonucleotide; TTT chr11 5301812 5301833 5301817 5301812 -
tggaaatggcactcttcttgtc

SEQ ID NO: 130554 - DNA, 22 bp, Artificial Sequence
  Synthetic oligonucleotide; TTT chr11 5301811 5301832 5301816 5301811 -
ggaaatggcactcttcttgtcc

SEQ ID NO: 130555 - DNA, 22 bp, Artificial Sequence
  Synthetic oligonucleotide; TTG chr11 5301810 5301831 5301815 5301810 -
gaaatggcactcttcttgtcct

SEQ ID NO: 130556 - DNA, 22 bp, Artificial Sequence
  Synthetic oligonucleotide; CTC chr11 5301798 5301819 5301803 5301798 -
ttcttgtcctcatttggaatga

SEQ ID NO: 130557 - DNA, 22 bp, Artificial Sequence
  Synthetic oligonucleotide; CTT chr11 5301796 5301817 5301801 5301796 -
cttgtcctcatttggaatgatc

SEQ ID NO: 130558 - DNA, 22 bp, Artificial Sequence
  Synthetic oligonucleotide; TTC chr11 5301795 5301816 5301800 5301795 -
ttgtcctcatttggaatgatca

SEQ ID NO: 130559 - DNA, 22 bp, Artificial Sequence
  Synthetic oligonucleotide; CTT chr11 5301793 5301814 5301798 5301793 -
gtcctcatttggaatgatcaca

SEQ ID NO: 130560 - DNA, 22 bp, Artificial Sequence
  Synthetic oligonucleotide; TTG chr11 5301792 5301813 5301797 5301792 -
tcctcatttggaatgatcacag

SEQ ID NO: 130561 - DNA, 22 bp, Artificial Sequence
  Synthetic oligonucleotide; CTC chr11 5301787 5301808 5301792 5301787 -
atttggaatgatcacagcctcc

SEQ ID NO: 130562 - DNA, 22 bp, Artificial Sequence
  Synthetic oligonucleotide; TTT chr11 5301783 5301804 5301788 5301783 -
ggaatgatcacagcctccatga

SEQ ID NO: 130563 - DNA, 22 bp, Artificial Sequence
  Synthetic oligonucleotide; TTG chr11 5301782 5301803 5301787 5301782 -
gaatgatcacagcctccatgag

SEQ ID NO: 130564 - DNA, 22 bp, Artificial Sequence
  Synthetic oligonucleotide; CTC chr11 5301766 5301787 5301771 5301766 -
catgagcccatgtactacttcc

SEQ ID NO: 130565 - DNA, 22 bp, Artificial Sequence
  Synthetic oligonucleotide; CTA chr11 5301749 5301770 5301754 5301749 -
cttcctggctatgctggcagac

SEQ ID NO: 130566 - DNA, 22 bp, Artificial Sequence
  Synthetic oligonucleotide; CTT chr11 5301746 5301767 5301751 5301746 -
cctggctatgctggcagacacg

SEQ ID NO: 130567 - DNA, 22 bp, Artificial Sequence
  Synthetic oligonucleotide; TTC chr11 5301745 5301766 5301750 5301745 -
ctggctatgctggcagacacgg

SEQ ID NO: 130568 - DNA, 22 bp, Artificial Sequence
  Synthetic oligonucleotide; CTG chr11 5301742 5301763 5301747 5301742 -
gctatgctggcagacacggacc

SEQ ID NO: 130569 - DNA, 22 bp, Artificial Sequence
  Synthetic oligonucleotide; CTA chr11 5301738 5301759 5301743 5301738 -
tgctggcagacacggaccttgg

SEQ ID NO: 130570 - DNA, 22 bp, Artificial Sequence
  Synthetic oligonucleotide; CTG chr11 5301733 5301754 5301738 5301733 -
gcagacacggaccttgggatga

SEQ ID NO: 130571 - DNA, 22 bp, Artificial Sequence
  Synthetic oligonucleotide; CTT chr11 5301718 5301739 5301723 5301718 -
gggatgacattcactacaatgc

SEQ ID NO: 130572 - DNA, 22 bp, Artificial Sequence
  Synthetic oligonucleotide; TTG chr11 5301717 5301738 5301722 5301717 -
ggatgacattcactacaatgcc

SEQ ID NO: 130573 - DNA, 22 bp, Artificial Sequence
  Synthetic oligonucleotide; TTC chr11 5301706 5301727 5301711 5301706 -
actacaatgcccacagtcctgg

SEQ ID NO: 130574 - DNA, 22 bp, Artificial Sequence
  Synthetic oligonucleotide; CTA chr11 5301702 5301723 5301707 5301702 -
caatgcccacagtcctgggtgt

SEQ ID NO: 130575 - DNA, 22 bp, Artificial Sequence
  Synthetic oligonucleotide; CTG chr11 5301685 5301706 5301690 5301685 -
ggtgtcctgctgctagaccaga

SEQ ID NO: 130576 - DNA, 22 bp, Artificial Sequence
  Synthetic oligonucleotide; CTG chr11 5301676 5301697 5301681 5301676 -
ctgctagaccagagggagattg

SEQ ID NO: 130577 - DNA, 22 bp, Artificial Sequence
  Synthetic oligonucleotide; CTG chr11 5301673 5301694 5301678 5301673 -
ctagaccagagggagattgccc

SEQ ID NO: 130578 - DNA, 22 bp, Artificial Sequence
  Synthetic oligonucleotide; CTA chr11 5301670 5301691 5301675 5301670 -
gaccagagggagattgcccatg

SEQ ID NO: 130579 - DNA, 22 bp, Artificial Sequence
  Synthetic oligonucleotide; TTG chr11 5301654 5301675 5301659 5301654 -
cccatgctgcctgtttcaccca

SEQ ID NO: 130580 - DNA, 22 bp, Artificial Sequence
  Synthetic oligonucleotide; CTG chr11 5301645 5301666 5301650 5301645 -
cctgtttcacccaatccttcat

SEQ ID NO: 130581 - DNA, 22 bp, Artificial Sequence
  Synthetic oligonucleotide; CTG chr11 5301641 5301662 5301646 5301641 -
tttcacccaatccttcattcat

SEQ ID NO: 130582 - DNA, 22 bp, Artificial Sequence
  Synthetic oligonucleotide; TTT chr11 5301638 5301659 5301643 5301638 -
cacccaatccttcattcattca

SEQ ID NO: 130583 - DNA, 22 bp, Artificial Sequence
  Synthetic oligonucleotide; TTC chr11 5301637 5301658 5301642 5301637 -
acccaatccttcattcattcac

SEQ ID NO: 130584 - DNA, 22 bp, Artificial Sequence
  Synthetic oligonucleotide; CTT chr11 5301626 5301647 5301631 5301626 -
cattcattcactggccattgta

SEQ ID NO: 130585 - DNA, 22 bp, Artificial Sequence
  Synthetic oligonucleotide; TTC chr11 5301625 5301646 5301630 5301625 -
attcattcactggccattgtag

SEQ ID NO: 130586 - DNA, 22 bp, Artificial Sequence
  Synthetic oligonucleotide; TTC chr11 5301621 5301642 5301626 5301621 -
attcactggccattgtagaatc

SEQ ID NO: 130587 - DNA, 22 bp, Artificial Sequence
  Synthetic oligonucleotide; TTC chr11 5301617 5301638 5301622 5301617 -
actggccattgtagaatcaggt

SEQ ID NO: 130588 - DNA, 22 bp, Artificial Sequence
  Synthetic oligonucleotide; CTG chr11 5301613 5301634 5301618 5301613 -
gccattgtagaatcaggtatct

SEQ ID NO: 130589 - DNA, 22 bp, Artificial Sequence
  Synthetic oligonucleotide; TTG chr11 5301606 5301627 5301611 5301606 -
tagaatcaggtatcttgcttgt

SEQ ID NO: 130590 - DNA, 22 bp, Artificial Sequence
  Synthetic oligonucleotide; CTT chr11 5301590 5301611 5301595 5301590 -
gcttgttttggcctatgactgt

SEQ ID NO: 130591 - DNA, 22 bp, Artificial Sequence
  Synthetic oligonucleotide; TTG chr11 5301589 5301610 5301594 5301589 -
cttgttttggcctatgactgtt

SEQ ID NO: 130592 - DNA, 22 bp, Artificial Sequence
  Synthetic oligonucleotide; CTT chr11 5301586 5301607 5301591 5301586 -
gttttggcctatgactgtttca

SEQ ID NO: 130593 - DNA, 22 bp, Artificial Sequence
  Synthetic oligonucleotide; TTG chr11 5301585 5301606 5301590 5301585 -
ttttggcctatgactgtttcat

SEQ ID NO: 130594 - DNA, 22 bp, Artificial Sequence
  Synthetic oligonucleotide; TTT chr11 5301582 5301603 5301587 5301582 -
tggcctatgactgtttcattgc

SEQ ID NO: 130595 - DNA, 22 bp, Artificial Sequence
  Synthetic oligonucleotide; TTT chr11 5301581 5301602 5301586 5301581 -
ggcctatgactgtttcattgcc

SEQ ID NO: 130596 - DNA, 22 bp, Artificial Sequence
  Synthetic oligonucleotide; TTG chr11 5301580 5301601 5301585 5301580 -
gcctatgactgtttcattgcca

SEQ ID NO: 130597 - DNA, 22 bp, Artificial Sequence
  Synthetic oligonucleotide; CTA chr11 5301575 5301596 5301580 5301575 -
tgactgtttcattgccatccgc

SEQ ID NO: 130598 - DNA, 22 bp, Artificial Sequence
  Synthetic oligonucleotide; CTG chr11 5301569 5301590 5301574 5301569 -
tttcattgccatccgcacacca

SEQ ID NO: 130599 - DNA, 22 bp, Artificial Sequence
  Synthetic oligonucleotide; TTT chr11 5301566 5301587 5301571 5301566 -
cattgccatccgcacaccactg

SEQ ID NO: 130600 - DNA, 22 bp, Artificial Sequence
  Synthetic oligonucleotide; TTC chr11 5301565 5301586 5301570 5301565 -
attgccatccgcacaccactga

SEQ ID NO: 130601 - DNA, 22 bp, Artificial Sequence
  Synthetic oligonucleotide; TTG chr11 5301561 5301582 5301566 5301561 -
ccatccgcacaccactgaggta

SEQ ID NO: 130602 - DNA, 22 bp, Artificial Sequence
  Synthetic oligonucleotide; CTG chr11 5301544 5301565 5301549 5301544 -
aggtacaactgcattcttacca

SEQ ID NO: 130603 - DNA, 22 bp, Artificial Sequence
  Synthetic oligonucleotide; CTG chr11 5301533 5301554 5301538 5301533 -
cattcttaccaattcccgagtg

SEQ ID NO: 130604 - DNA, 22 bp, Artificial Sequence
  Synthetic oligonucleotide; TTC chr11 5301528 5301549 5301533 5301528 -
ttaccaattcccgagtgatgaa

SEQ ID NO: 130605 - DNA, 22 bp, Artificial Sequence
  Synthetic oligonucleotide; CTT chr11 5301526 5301547 5301531 5301526 -
accaattcccgagtgatgaaca

SEQ ID NO: 130606 - DNA, 22 bp, Artificial Sequence
  Synthetic oligonucleotide; TTA chr11 5301525 5301546 5301530 5301525 -
ccaattcccgagtgatgaacat

SEQ ID NO: 130607 - DNA, 22 bp, Artificial Sequence
  Synthetic oligonucleotide; TTC chr11 5301518 5301539 5301523 5301518 -
ccgagtgatgaacataggactg

SEQ ID NO: 130608 - DNA, 22 bp, Artificial Sequence
  Synthetic oligonucleotide; CTG chr11 5301496 5301517 5301501 5301496 -
ggggtactgatgagaggtttta

SEQ ID NO: 130609 - DNA, 22 bp, Artificial Sequence
  Synthetic oligonucleotide; CTG chr11 5301487 5301508 5301492 5301487 -
atgagaggttttatgtccattt

SEQ ID NO: 130610 - DNA, 22 bp, Artificial Sequence
  Synthetic oligonucleotide; TTT chr11 5301476 5301497 5301481 5301476 -
tatgtccattttgcccataatt

SEQ ID NO: 130611 - DNA, 22 bp, Artificial Sequence
  Synthetic oligonucleotide; TTT chr11 5301475 5301496 5301480 5301475 -
atgtccattttgcccataattc

SEQ ID NO: 130612 - DNA, 22 bp, Artificial Sequence
  Synthetic oligonucleotide; TTA chr11 5301474 5301495 5301479 5301474 -
tgtccattttgcccataattct

SEQ ID NO: 130613 - DNA, 22 bp, Artificial Sequence
  Synthetic oligonucleotide; TTT chr11 5301465 5301486 5301470 5301465 -
tgcccataattctttcactcta

SEQ ID NO: 130614 - DNA, 22 bp, Artificial Sequence
  Synthetic oligonucleotide; TTT chr11 5301464 5301485 5301469 5301464 -
gcccataattctttcactctac

SEQ ID NO: 130615 - DNA, 22 bp, Artificial Sequence
  Synthetic oligonucleotide; TTG chr11 5301463 5301484 5301468 5301463 -
cccataattctttcactctact

SEQ ID NO: 130616 - DNA, 22 bp, Artificial Sequence
  Synthetic oligonucleotide; TTC chr11 5301453 5301474 5301458 5301453 -
tttcactctactgctacccata

SEQ ID NO: 130617 - DNA, 22 bp, Artificial Sequence
  Synthetic oligonucleotide; CTT chr11 5301451 5301472 5301456 5301451 -
tcactctactgctacccatatt

SEQ ID NO: 130618 - DNA, 22 bp, Artificial Sequence
  Synthetic oligonucleotide; TTT chr11 5301450 5301471 5301455 5301450 -
cactctactgctacccatattg

SEQ ID NO: 130619 - DNA, 22 bp, Artificial Sequence
  Synthetic oligonucleotide; TTC chr11 5301449 5301470 5301454 5301449 -
actctactgctacccatattgt

SEQ ID NO: 130620 - DNA, 22 bp, Artificial Sequence
  Synthetic oligonucleotide; CTC chr11 5301445 5301466 5301450 5301445 -
tactgctacccatattgtggtt

SEQ ID NO: 130621 - DNA, 22 bp, Artificial Sequence
  Synthetic oligonucleotide; CTA chr11 5301443 5301464 5301448 5301443 -
ctgctacccatattgtggttcc

SEQ ID NO: 130622 - DNA, 22 bp, Artificial Sequence
  Synthetic oligonucleotide; CTG chr11 5301440 5301461 5301445 5301440 -
ctacccatattgtggttcccgt

SEQ ID NO: 130623 - DNA, 22 bp, Artificial Sequence
  Synthetic oligonucleotide; CTA chr11 5301437 5301458 5301442 5301437 -
cccatattgtggttcccgtgcc

SEQ ID NO: 130624 - DNA, 22 bp, Artificial Sequence
  Synthetic oligonucleotide; TTG chr11 5301428 5301449 5301433 5301428 -
tggttcccgtgccctcttgcac

SEQ ID NO: 130625 - DNA, 22 bp, Artificial Sequence
  Synthetic oligonucleotide; TTC chr11 5301422 5301443 5301427 5301422 -
ccgtgccctcttgcacacattt

SEQ ID NO: 130626 - DNA, 22 bp, Artificial Sequence
  Synthetic oligonucleotide; CTC chr11 5301412 5301433 5301417 5301412 -
ttgcacacattttgcctccatc

SEQ ID NO: 130627 - DNA, 22 bp, Artificial Sequence
  Synthetic oligonucleotide; CTT chr11 5301410 5301431 5301415 5301410 -
gcacacattttgcctccatcaa

SEQ ID NO: 130628 - DNA, 22 bp, Artificial Sequence
  Synthetic oligonucleotide; TTG chr11 5301409 5301430 5301414 5301409 -
cacacattttgcctccatcaag

SEQ ID NO: 130629 - DNA, 22 bp, Artificial Sequence
  Synthetic oligonucleotide; TTT chr11 5301400 5301421 5301405 5301400 -
tgcctccatcaagatgtcataa

SEQ ID NO: 130630 - DNA, 22 bp, Artificial Sequence
  Synthetic oligonucleotide; TTT chr11 5301399 5301420 5301404 5301399 -
gcctccatcaagatgtcataaa

SEQ ID NO: 130631 - DNA, 22 bp, Artificial Sequence
  Synthetic oligonucleotide; TTG chr11 5301398 5301419 5301403 5301398 -
cctccatcaagatgtcataaaa

SEQ ID NO: 130632 - DNA, 22 bp, Artificial Sequence
  Synthetic oligonucleotide; CTC chr11 5301394 5301415 5301399 5301394 -
catcaagatgtcataaaactcg

SEQ ID NO: 130633 - DNA, 22 bp, Artificial Sequence
  Synthetic oligonucleotide; CTC chr11 5301373 5301394 5301378 5301373 -
gcctgtgctgatatcacgttta

SEQ ID NO: 130634 - DNA, 22 bp, Artificial Sequence
  Synthetic oligonucleotide; CTG chr11 5301368 5301389 5301373 5301368 -
tgctgatatcacgtttaatcac

SEQ ID NO: 130635 - DNA, 22 bp, Artificial Sequence
  Synthetic oligonucleotide; CTG chr11 5301363 5301384 5301368 5301363 -
atatcacgtttaatcacatata

SEQ ID NO: 130636 - DNA, 22 bp, Artificial Sequence
  Synthetic oligonucleotide; TTT chr11 5301352 5301373 5301357 5301352 -
aatcacatatatccaattattc

SEQ ID NO: 130637 - DNA, 22 bp, Artificial Sequence
  Synthetic oligonucleotide; TTA chr11 5301351 5301372 5301356 5301351 -
atcacatatatccaattattca

SEQ ID NO: 130638 - DNA, 22 bp, Artificial Sequence
  Synthetic oligonucleotide; TTA chr11 5301333 5301354 5301338 5301333 -
ttcagacttctttgactgtctt

SEQ ID NO: 130639 - DNA, 22 bp, Artificial Sequence
  Synthetic oligonucleotide; TTC chr11 5301330 5301351 5301335 5301330 -
agacttctttgactgtcttttt

SEQ ID NO: 130640 - DNA, 22 bp, Artificial Sequence
  Synthetic oligonucleotide; CTT chr11 5301324 5301345 5301329 5301324 -
ctttgactgtctttttagatgc

SEQ ID NO: 130641 - DNA, 22 bp, Artificial Sequence
  Synthetic oligonucleotide; TTC chr11 5301323 5301344 5301328 5301323 -
tttgactgtctttttagatgct

SEQ ID NO: 130642 - DNA, 22 bp, Artificial Sequence
  Synthetic oligonucleotide; CTT chr11 5301321 5301342 5301326 5301321 -
tgactgtctttttagatgctct

SEQ ID NO: 130643 - DNA, 22 bp, Artificial Sequence
  Synthetic oligonucleotide; TTT chr11 5301320 5301341 5301325 5301320 -
gactgtctttttagatgctcta

SEQ ID NO: 130644 - DNA, 22 bp, Artificial Sequence
  Synthetic oligonucleotide; TTG chr11 5301319 5301340 5301324 5301319 -
actgtctttttagatgctctaa

SEQ ID NO: 130645 - DNA, 22 bp, Artificial Sequence
  Synthetic oligonucleotide; CTG chr11 5301315 5301336 5301320 5301315 -
tctttttagatgctctaatcat

SEQ ID NO: 130646 - DNA, 22 bp, Artificial Sequence
  Synthetic oligonucleotide; CTT chr11 5301311 5301332 5301316 5301311 -
tttagatgctctaatcatcatc

SEQ ID NO: 130647 - DNA, 22 bp, Artificial Sequence
  Synthetic oligonucleotide; TTT chr11 5301310 5301331 5301315 5301310 -
ttagatgctctaatcatcatct

SEQ ID NO: 130648 - DNA, 22 bp, Artificial Sequence
  Synthetic oligonucleotide; TTT chr11 5301309 5301330 5301314 5301309 -
tagatgctctaatcatcatctt

SEQ ID NO: 130649 - DNA, 22 bp, Artificial Sequence
  Synthetic oligonucleotide; TTT chr11 5301308 5301329 5301313 5301308 -
agatgctctaatcatcatcttt

SEQ ID NO: 130650 - DNA, 22 bp, Artificial Sequence
  Synthetic oligonucleotide; TTA chr11 5301307 5301328 5301312 5301307 -
gatgctctaatcatcatctttt

SEQ ID NO: 130651 - DNA, 22 bp, Artificial Sequence
  Synthetic oligonucleotide; CTC chr11 5301300 5301321 5301305 5301300 -
taatcatcatcttttcttatat

SEQ ID NO: 130652 - DNA, 22 bp, Artificial Sequence
  Synthetic oligonucleotide; CTA chr11 5301298 5301319 5301303 5301298 -
atcatcatcttttcttatatac

SEQ ID NO: 130653 - DNA, 22 bp, Artificial Sequence
  Synthetic oligonucleotide; CTT chr11 5301287 5301308 5301292 5301287 -
ttcttatatactaatcctcaag

SEQ ID NO: 130654 - DNA, 22 bp, Artificial Sequence
  Synthetic oligonucleotide; TTT chr11 5301286 5301307 5301291 5301286 -
tcttatatactaatcctcaaga

SEQ ID NO: 130655 - DNA, 22 bp, Artificial Sequence
  Synthetic oligonucleotide; TTT chr11 5301285 5301306 5301290 5301285 -
cttatatactaatcctcaagac

SEQ ID NO: 130656 - DNA, 22 bp, Artificial Sequence
  Synthetic oligonucleotide; TTC chr11 5301284 5301305 5301289 5301284 -
ttatatactaatcctcaagaca

SEQ ID NO: 130657 - DNA, 22 bp, Artificial Sequence
  Synthetic oligonucleotide; CTT chr11 5301282 5301303 5301287 5301282 -
atatactaatcctcaagacagt

SEQ ID NO: 130658 - DNA, 22 bp, Artificial Sequence
  Synthetic oligonucleotide; TTA chr11 5301281 5301302 5301286 5301281 -
tatactaatcctcaagacagtg

SEQ ID NO: 130659 - DNA, 22 bp, Artificial Sequence
  Synthetic oligonucleotide; CTA chr11 5301274 5301295 5301279 5301274 -
atcctcaagacagtgatgggca

SEQ ID NO: 130660 - DNA, 22 bp, Artificial Sequence
  Synthetic oligonucleotide; CTC chr11 5301268 5301289 5301273 5301268 -
aagacagtgatgggcattgcgt

SEQ ID NO: 130661 - DNA, 22 bp, Artificial Sequence
  Synthetic oligonucleotide; TTG chr11 5301249 5301270 5301254 5301249 -
cgtctggacaagaggaagctaa

SEQ ID NO: 130662 - DNA, 22 bp, Artificial Sequence
  Synthetic oligonucleotide; CTG chr11 5301243 5301264 5301248 5301243 -
gacaagaggaagctaaatctct

SEQ ID NO: 130663 - DNA, 22 bp, Artificial Sequence
  Synthetic oligonucleotide; CTA chr11 5301228 5301249 5301233 5301228 -
aatctctcaacacttgtgtctc

SEQ ID NO: 130664 - DNA, 22 bp, Artificial Sequence
  Synthetic oligonucleotide; CTC chr11 5301222 5301243 5301227 5301222 -
tcaacacttgtgtctcccatat

SEQ ID NO: 130665 - DNA, 22 bp, Artificial Sequence
  Synthetic oligonucleotide; CTC chr11 5301220 5301241 5301225 5301220 -
aacacttgtgtctcccatatta

SEQ ID NO: 130666 - DNA, 22 bp, Artificial Sequence
  Synthetic oligonucleotide; CTT chr11 5301213 5301234 5301218 5301213 -
gtgtctcccatattagctgtgt

SEQ ID NO: 130667 - DNA, 22 bp, Artificial Sequence
  Synthetic oligonucleotide; TTG chr11 5301212 5301233 5301217 5301212 -
tgtctcccatattagctgtgtc

SEQ ID NO: 130668 - DNA, 22 bp, Artificial Sequence
  Synthetic oligonucleotide; CTC chr11 5301206 5301227 5301211 5301206 -
ccatattagctgtgtcctagta

SEQ ID NO: 130669 - DNA, 22 bp, Artificial Sequence
  Synthetic oligonucleotide; TTA chr11 5301198 5301219 5301203 5301198 -
gctgtgtcctagtatttcacat

SEQ ID NO: 130670 - DNA, 22 bp, Artificial Sequence
  Synthetic oligonucleotide; CTG chr11 5301194 5301215 5301199 5301194 -
tgtcctagtatttcacatcact

SEQ ID NO: 130671 - DNA, 22 bp, Artificial Sequence
  Synthetic oligonucleotide; CTA chr11 5301187 5301208 5301192 5301187 -
gtatttcacatcactgtgatgg

SEQ ID NO: 130672 - DNA, 22 bp, Artificial Sequence
  Synthetic oligonucleotide; TTT chr11 5301181 5301202 5301186 5301181 -
cacatcactgtgatgggactgt

SEQ ID NO: 130673 - DNA, 22 bp, Artificial Sequence
  Synthetic oligonucleotide; TTC chr11 5301180 5301201 5301185 5301180 -
acatcactgtgatgggactgtc

SEQ ID NO: 130674 - DNA, 22 bp, Artificial Sequence
  Synthetic oligonucleotide; CTG chr11 5301171 5301192 5301176 5301171 -
tgatgggactgtcattcattca

SEQ ID NO: 130675 - DNA, 22 bp, Artificial Sequence
  Synthetic oligonucleotide; CTG chr11 5301160 5301181 5301165 5301160 -
tcattcattcacaggtttggga

SEQ ID NO: 130676 - DNA, 22 bp, Artificial Sequence
  Synthetic oligonucleotide; TTC chr11 5301154 5301175 5301159 5301154 -
attcacaggtttgggaaacatg

SEQ ID NO: 130677 - DNA, 22 bp, Artificial Sequence
  Synthetic oligonucleotide; TTC chr11 5301150 5301171 5301155 5301150 -
acaggtttgggaaacatgcacc

SEQ ID NO: 130678 - DNA, 22 bp, Artificial Sequence
  Synthetic oligonucleotide; TTT chr11 5301142 5301163 5301147 5301142 -
gggaaacatgcacctcatgtgg

SEQ ID NO: 130679 - DNA, 22 bp, Artificial Sequence
  Synthetic oligonucleotide; TTG chr11 5301141 5301162 5301146 5301141 -
ggaaacatgcacctcatgtggt

SEQ ID NO: 130680 - DNA, 22 bp, Artificial Sequence
  Synthetic oligonucleotide; CTC chr11 5301126 5301147 5301131 5301126 -
atgtggtccccattaccatgag

SEQ ID NO: 130681 - DNA, 22 bp, Artificial Sequence
  Synthetic oligonucleotide; TTA chr11 5301111 5301132 5301116 5301111 -
ccatgagctatgtccattttct

SEQ ID NO: 130682 - DNA, 22 bp, Artificial Sequence
  Synthetic oligonucleotide; CTA chr11 5301101 5301122 5301106 5301101 -
tgtccattttctctttcctcca

SEQ ID NO: 130683 - DNA, 22 bp, Artificial Sequence
  Synthetic oligonucleotide; TTT chr11 5301092 5301113 5301097 5301092 -
tctctttcctccattcgtgaat

SEQ ID NO: 130684 - DNA, 22 bp, Artificial Sequence
  Synthetic oligonucleotide; TTT chr11 5301091 5301112 5301096 5301091 -
ctctttcctccattcgtgaatc

SEQ ID NO: 130685 - DNA, 22 bp, Artificial Sequence
  Synthetic oligonucleotide; TTC chr11 5301090 5301111 5301095 5301090 -
tctttcctccattcgtgaatcc

SEQ ID NO: 130686 - DNA, 22 bp, Artificial Sequence
  Synthetic oligonucleotide; CTC chr11 5301088 5301109 5301093 5301088 -
tttcctccattcgtgaatccta

SEQ ID NO: 130687 - DNA, 22 bp, Artificial Sequence
  Synthetic oligonucleotide; CTT chr11 5301086 5301107 5301091 5301086 -
tcctccattcgtgaatcctatc

SEQ ID NO: 130688 - DNA, 22 bp, Artificial Sequence
  Synthetic oligonucleotide; TTT chr11 5301085 5301106 5301090 5301085 -
cctccattcgtgaatcctatca

SEQ ID NO: 130689 - DNA, 22 bp, Artificial Sequence
  Synthetic oligonucleotide; TTC chr11 5301084 5301105 5301089 5301084 -
ctccattcgtgaatcctatcat

SEQ ID NO: 130690 - DNA, 22 bp, Artificial Sequence
  Synthetic oligonucleotide; CTC chr11 5301081 5301102 5301086 5301081 -
cattcgtgaatcctatcattta

SEQ ID NO: 130691 - DNA, 22 bp, Artificial Sequence
  Synthetic oligonucleotide; TTC chr11 5301076 5301097 5301081 5301076 -
gtgaatcctatcatttatagca

SEQ ID NO: 130692 - DNA, 22 bp, Artificial Sequence
  Synthetic oligonucleotide; CTA chr11 5301066 5301087 5301071 5301066 -
tcatttatagcatcaagaccaa

SEQ ID NO: 130693 - DNA, 22 bp, Artificial Sequence
  Synthetic oligonucleotide; TTT chr11 5301060 5301081 5301065 5301060 -
atagcatcaagaccaagcagat

SEQ ID NO: 130694 - DNA, 22 bp, Artificial Sequence
  Synthetic oligonucleotide; TTA chr11 5301059 5301080 5301064 5301059 -
tagcatcaagaccaagcagatt

SEQ ID NO: 130695 - DNA, 22 bp, Artificial Sequence
  Synthetic oligonucleotide; TTC chr11 5301036 5301057 5301041 5301036 -
aaagaagcattattcgcctatt

SEQ ID NO: 130696 - DNA, 22 bp, Artificial Sequence
  Synthetic oligonucleotide; TTA chr11 5301024 5301045 5301029 5301024 -
ttcgcctattttctgggcagag

SEQ ID NO: 130697 - DNA, 22 bp, Artificial Sequence
  Synthetic oligonucleotide; TTC chr11 5301021 5301042 5301026 5301021 -
gcctattttctgggcagagtag

SEQ ID NO: 130698 - DNA, 22 bp, Artificial Sequence
  Synthetic oligonucleotide; CTA chr11 5301016 5301037 5301021 5301016 -
ttttctgggcagagtagggctt

SEQ ID NO: 130699 - DNA, 22 bp, Artificial Sequence
  Synthetic oligonucleotide; TTT chr11 5301013 5301034 5301018 5301013 -
tctgggcagagtagggcttgag

SEQ ID NO: 130700 - DNA, 22 bp, Artificial Sequence
  Synthetic oligonucleotide; TTT chr11 5301012 5301033 5301017 5301012 -
ctgggcagagtagggcttgagc

SEQ ID NO: 130701 - DNA, 22 bp, Artificial Sequence
  Synthetic oligonucleotide; TTC chr11 5301011 5301032 5301016 5301011 -
tgggcagagtagggcttgagcc

SEQ ID NO: 130702 - DNA, 22 bp, Artificial Sequence
  Synthetic oligonucleotide; CTG chr11 5301009 5301030 5301014 5301009 -
ggcagagtagggcttgagccct

SEQ ID NO: 130703 - DNA, 22 bp, Artificial Sequence
  Synthetic oligonucleotide; CTT chr11 5300994 5301015 5300999 5300994 -
gagcccttatttcagaatctca

SEQ ID NO: 130704 - DNA, 22 bp, Artificial Sequence
  Synthetic oligonucleotide; TTG chr11 5300993 5301014 5300998 5300993 -
agcccttatttcagaatctcaa

SEQ ID NO: 130705 - DNA, 22 bp, Artificial Sequence
  Synthetic oligonucleotide; CTT chr11 5300986 5301007 5300991 5300986 -
atttcagaatctcaagatctct

SEQ ID NO: 130706 - DNA, 22 bp, Artificial Sequence
  Synthetic oligonucleotide; TTA chr11 5300985 5301006 5300990 5300985 -
tttcagaatctcaagatctcta

SEQ ID NO: 130707 - DNA, 22 bp, Artificial Sequence
  Synthetic oligonucleotide; TTT chr11 5300982 5301003 5300987 5300982 -
cagaatctcaagatctctagga

SEQ ID NO: 130708 - DNA, 22 bp, Artificial Sequence
  Synthetic oligonucleotide; TTC chr11 5300981 5301002 5300986 5300981 -
agaatctcaagatctctaggat

SEQ ID NO: 130709 - DNA, 22 bp, Artificial Sequence
  Synthetic oligonucleotide; CTC chr11 5300973 5300994 5300978 5300973 -
aagatctctaggatttctgggc

SEQ ID NO: 130710 - DNA, 22 bp, Artificial Sequence
  Synthetic oligonucleotide; CTC chr11 5300965 5300986 5300970 5300965 -
taggatttctgggcctctccca

SEQ ID NO: 130711 - DNA, 22 bp, Artificial Sequence
  Synthetic oligonucleotide; CTA chr11 5300963 5300984 5300968 5300963 -
ggatttctgggcctctcccatt

SEQ ID NO: 130712 - DNA, 22 bp, Artificial Sequence
  Synthetic oligonucleotide; TTT chr11 5300957 5300978 5300962 5300957 -
ctgggcctctcccattactgaa

SEQ ID NO: 130713 - DNA, 22 bp, Artificial Sequence
  Synthetic oligonucleotide; TTC chr11 5300956 5300977 5300961 5300956 -
tgggcctctcccattactgaaa

SEQ ID NO: 130714 - DNA, 22 bp, Artificial Sequence
  Synthetic oligonucleotide; CTG chr11 5300954 5300975 5300959 5300954 -
ggcctctcccattactgaaaag

SEQ ID NO: 130715 - DNA, 22 bp, Artificial Sequence
  Synthetic oligonucleotide; CTC chr11 5300948 5300969 5300953 5300948 -
tcccattactgaaaaggaaccc

SEQ ID NO: 130716 - DNA, 22 bp, Artificial Sequence
  Synthetic oligonucleotide; CTC chr11 5300946 5300967 5300951 5300946 -
ccattactgaaaaggaaccctg

SEQ ID NO: 130717 - DNA, 22 bp, Artificial Sequence
  Synthetic oligonucleotide; TTA chr11 5300940 5300961 5300945 5300940 -
ctgaaaaggaaccctggtttta

SEQ ID NO: 130718 - DNA, 22 bp, Artificial Sequence
  Synthetic oligonucleotide; CTG chr11 5300937 5300958 5300942 5300937 -
aaaaggaaccctggttttatat

SEQ ID NO: 130719 - DNA, 22 bp, Artificial Sequence
  Synthetic oligonucleotide; CTG chr11 5300924 5300945 5300929 5300924 -
gttttatatccacacttttttt

SEQ ID NO: 130720 - DNA, 22 bp, Artificial Sequence
  Synthetic oligonucleotide; TTT chr11 5300920 5300941 5300925 5300920 -
tatatccacacttttttttcct

SEQ ID NO: 130721 - DNA, 22 bp, Artificial Sequence
  Synthetic oligonucleotide; TTT chr11 5300919 5300940 5300924 5300919 -
atatccacacttttttttcctc

SEQ ID NO: 130722 - DNA, 22 bp, Artificial Sequence
  Synthetic oligonucleotide; TTA chr11 5300918 5300939 5300923 5300918 -
tatccacacttttttttcctca

SEQ ID NO: 130723 - DNA, 22 bp, Artificial Sequence
  Synthetic oligonucleotide; CTT chr11 5300907 5300928 5300912 5300907 -
ttttttcctcagagttagattc

SEQ ID NO: 130724 - DNA, 22 bp, Artificial Sequence
  Synthetic oligonucleotide; TTT chr11 5300906 5300927 5300911 5300906 -
tttttcctcagagttagattca

SEQ ID NO: 130725 - DNA, 22 bp, Artificial Sequence
  Synthetic oligonucleotide; TTT chr11 5300905 5300926 5300910 5300905 -
ttttcctcagagttagattcaa

SEQ ID NO: 130726 - DNA, 22 bp, Artificial Sequence
  Synthetic oligonucleotide; TTT chr11 5300904 5300925 5300909 5300904 -
tttcctcagagttagattcaat

SEQ ID NO: 130727 - DNA, 22 bp, Artificial Sequence
  Synthetic oligonucleotide; TTT chr11 5300903 5300924 5300908 5300903 -
ttcctcagagttagattcaatt

SEQ ID NO: 130728 - DNA, 22 bp, Artificial Sequence
  Synthetic oligonucleotide; TTT chr11 5300902 5300923 5300907 5300902 -
tcctcagagttagattcaattt

SEQ ID NO: 130729 - DNA, 22 bp, Artificial Sequence
  Synthetic oligonucleotide; TTT chr11 5300901 5300922 5300906 5300901 -
cctcagagttagattcaatttt

SEQ ID NO: 130730 - DNA, 22 bp, Artificial Sequence
  Synthetic oligonucleotide; TTC chr11 5300900 5300921 5300905 5300900 -
ctcagagttagattcaatttta

SEQ ID NO: 130731 - DNA, 22 bp, Artificial Sequence
  Synthetic oligonucleotide; CTC chr11 5300897 5300918 5300902 5300897 -
agagttagattcaattttaatt

SEQ ID NO: 130732 - DNA, 22 bp, Artificial Sequence
  Synthetic oligonucleotide; TTA chr11 5300890 5300911 5300895 5300890 -
gattcaattttaattatcacat

SEQ ID NO: 130733 - DNA, 22 bp, Artificial Sequence
  Synthetic oligonucleotide; TTC chr11 5300885 5300906 5300890 5300885 -
aattttaattatcacatgaaaa

SEQ ID NO: 130734 - DNA, 22 bp, Artificial Sequence
  Synthetic oligonucleotide; TTT chr11 5300880 5300901 5300885 5300880 -
taattatcacatgaaaaagctg

SEQ ID NO: 130735 - DNA, 22 bp, Artificial Sequence
  Synthetic oligonucleotide; TTT chr11 5300879 5300900 5300884 5300879 -
aattatcacatgaaaaagctga

SEQ ID NO: 130736 - DNA, 22 bp, Artificial Sequence
  Synthetic oligonucleotide; TTA chr11 5300878 5300899 5300883 5300878 -
attatcacatgaaaaagctgat

SEQ ID NO: 130737 - DNA, 22 bp, Artificial Sequence
  Synthetic oligonucleotide; TTA chr11 5300874 5300895 5300879 5300874 -
tcacatgaaaaagctgatgtga

SEQ ID NO: 130738 - DNA, 22 bp, Artificial Sequence
  Synthetic oligonucleotide; CTG chr11 5300858 5300879 5300863 5300858 -
atgtgagcgagaaatttttata

SEQ ID NO: 130739 - DNA, 22 bp, Artificial Sequence
  Synthetic oligonucleotide; TTT chr11 5300841 5300862 5300846 5300841 -
ttatacatatgtgtgtgtgtgt

SEQ ID NO: 130740 - DNA, 22 bp, Artificial Sequence
  Synthetic oligonucleotide; TTT chr11 5300840 5300861 5300845 5300840 -
tatacatatgtgtgtgtgtgtg

SEQ ID NO: 130741 - DNA, 22 bp, Artificial Sequence
  Synthetic oligonucleotide; TTT chr11 5300839 5300860 5300844 5300839 -
atacatatgtgtgtgtgtgtgt

SEQ ID NO: 130742 - DNA, 22 bp, Artificial Sequence
  Synthetic oligonucleotide; TTA chr11 5300838 5300859 5300843 5300838 -
tacatatgtgtgtgtgtgtgtg

SEQ ID NO: 130743 - DNA, 22 bp, Artificial Sequence
  Synthetic oligonucleotide; CTA chr11 5300787 5300808 5300792 5300787 -
ataaagagggaatgccagtgat

SEQ ID NO: 130744 - DNA, 22 bp, Artificial Sequence
  Synthetic oligonucleotide; CTG chr11 5300761 5300782 5300766 5300761 -
aagaaaaagaatacaggaagca

SEQ ID NO: 130745 - DNA, 22 bp, Artificial Sequence
  Synthetic oligonucleotide; CTA chr11 5300705 5300726 5300710 5300705 -
tgatttcagaaatagtcaagat

SEQ ID NO: 130746 - DNA, 22 bp, Artificial Sequence
  Synthetic oligonucleotide; TTT chr11 5300699 5300720 5300704 5300699 -
cagaaatagtcaagataagtgg

SEQ ID NO: 130747 - DNA, 22 bp, Artificial Sequence
  Synthetic oligonucleotide; TTC chr11 5300698 5300719 5300703 5300698 -
agaaatagtcaagataagtgga

SEQ ID NO: 130748 - DNA, 22 bp, Artificial Sequence
  Synthetic oligonucleotide; CTA chr11 5300673 5300694 5300678 5300673 -
aagcagcttgggtcaaatacag

SEQ ID NO: 130749 - DNA, 22 bp, Artificial Sequence
  Synthetic oligonucleotide; CTT chr11 5300664 5300685 5300669 5300664 -
gggtcaaatacagttcatctaa

SEQ ID NO: 130750 - DNA, 22 bp, Artificial Sequence
  Synthetic oligonucleotide; TTG chr11 5300663 5300684 5300668 5300663 -
ggtcaaatacagttcatctaaa

SEQ ID NO: 130751 - DNA, 22 bp, Artificial Sequence
  Synthetic oligonucleotide; TTC chr11 5300648 5300669 5300653 5300648 -
atctaaagaaaaatgtgcagtt

SEQ ID NO: 130752 - DNA, 22 bp, Artificial Sequence
  Synthetic oligonucleotide; CTA chr11 5300643 5300664 5300648 5300643 -
aagaaaaatgtgcagttggagg

SEQ ID NO: 130753 - DNA, 22 bp, Artificial Sequence
  Synthetic oligonucleotide; TTG chr11 5300625 5300646 5300630 5300625 -
gaggtacattttatgtgtctta

SEQ ID NO: 130754 - DNA, 22 bp, Artificial Sequence
  Synthetic oligonucleotide; TTT chr11 5300614 5300635 5300619 5300614 -
tatgtgtcttataaaggtgaat

SEQ ID NO: 130755 - DNA, 22 bp, Artificial Sequence
  Synthetic oligonucleotide; TTT chr11 5300613 5300634 5300618 5300613 -
atgtgtcttataaaggtgaatt

SEQ ID NO: 130756 - DNA, 22 bp, Artificial Sequence
  Synthetic oligonucleotide; TTA chr11 5300612 5300633 5300617 5300612 -
tgtgtcttataaaggtgaattt

SEQ ID NO: 130757 - DNA, 22 bp, Artificial Sequence
  Synthetic oligonucleotide; CTT chr11 5300604 5300625 5300609 5300604 -
ataaaggtgaatttgaataata

SEQ ID NO: 130758 - DNA, 22 bp, Artificial Sequence
  Synthetic oligonucleotide; TTA chr11 5300603 5300624 5300608 5300603 -
taaaggtgaatttgaataatac

SEQ ID NO: 130759 - DNA, 22 bp, Artificial Sequence
  Synthetic oligonucleotide; TTT chr11 5300590 5300611 5300595 5300590 -
gaataatacatgatcatatttt

SEQ ID NO: 130760 - DNA, 22 bp, Artificial Sequence
  Synthetic oligonucleotide; TTG chr11 5300589 5300610 5300594 5300589 -
aataatacatgatcatattttc

SEQ ID NO: 130761 - DNA, 22 bp, Artificial Sequence
  Synthetic oligonucleotide; TTT chr11 5300569 5300590 5300574 5300569 -
tcatctccatactttgaaacta

SEQ ID NO: 130762 - DNA, 22 bp, Artificial Sequence
  Synthetic oligonucleotide; TTT chr11 5300568 5300589 5300573 5300568 -
catctccatactttgaaactag

SEQ ID NO: 130763 - DNA, 22 bp, Artificial Sequence
  Synthetic oligonucleotide; TTC chr11 5300567 5300588 5300572 5300567 -
atctccatactttgaaactagt

SEQ ID NO: 130764 - DNA, 22 bp, Artificial Sequence
  Synthetic oligonucleotide; CTC chr11 5300562 5300583 5300567 5300562 -
catactttgaaactagttactc

SEQ ID NO: 130765 - DNA, 22 bp, Artificial Sequence
  Synthetic oligonucleotide; CTT chr11 5300555 5300576 5300560 5300555 -
tgaaactagttactctgaaaag

SEQ ID NO: 130766 - DNA, 22 bp, Artificial Sequence
  Synthetic oligonucleotide; TTT chr11 5300554 5300575 5300559 5300554 -
gaaactagttactctgaaaagg

SEQ ID NO: 130767 - DNA, 22 bp, Artificial Sequence
  Synthetic oligonucleotide; TTG chr11 5300553 5300574 5300558 5300553 -
aaactagttactctgaaaagga

SEQ ID NO: 130768 - DNA, 22 bp, Artificial Sequence
  Synthetic oligonucleotide; CTA chr11 5300547 5300568 5300552 5300547 -
gttactctgaaaaggatcttgc

SEQ ID NO: 130769 - DNA, 22 bp, Artificial Sequence
  Synthetic oligonucleotide; TTA chr11 5300543 5300564 5300548 5300543 -
ctctgaaaaggatcttgcttga

SEQ ID NO: 130770 - DNA, 22 bp, Artificial Sequence
  Synthetic oligonucleotide; CTC chr11 5300540 5300561 5300545 5300540 -
tgaaaaggatcttgcttgatta

SEQ ID NO: 130771 - DNA, 22 bp, Artificial Sequence
  Synthetic oligonucleotide; CTG chr11 5300538 5300559 5300543 5300538 -
aaaaggatcttgcttgattagt

SEQ ID NO: 130772 - DNA, 22 bp, Artificial Sequence
  Synthetic oligonucleotide; CTT chr11 5300527 5300548 5300532 5300527 -
gcttgattagtaagcaaacttg

SEQ ID NO: 130773 - DNA, 22 bp, Artificial Sequence
  Synthetic oligonucleotide; TTG chr11 5300526 5300547 5300531 5300526 -
cttgattagtaagcaaacttgt

SEQ ID NO: 130774 - DNA, 22 bp, Artificial Sequence
  Synthetic oligonucleotide; CTT chr11 5300523 5300544 5300528 5300523 -
gattagtaagcaaacttgtgtg

SEQ ID NO: 130775 - DNA, 22 bp, Artificial Sequence
  Synthetic oligonucleotide; TTG chr11 5300522 5300543 5300527 5300522 -
attagtaagcaaacttgtgtga

SEQ ID NO: 130776 - DNA, 22 bp, Artificial Sequence
  Synthetic oligonucleotide; TTA chr11 5300518 5300539 5300523 5300518 -
gtaagcaaacttgtgtgaggct

SEQ ID NO: 130777 - DNA, 22 bp, Artificial Sequence
  Synthetic oligonucleotide; CTT chr11 5300506 5300527 5300511 5300506 -
gtgtgaggctaaacagcaaata

SEQ ID NO: 130778 - DNA, 22 bp, Artificial Sequence
  Synthetic oligonucleotide; TTG chr11 5300505 5300526 5300510 5300505 -
tgtgaggctaaacagcaaatat

SEQ ID NO: 130779 - DNA, 22 bp, Artificial Sequence
  Synthetic oligonucleotide; CTA chr11 5300495 5300516 5300500 5300495 -
aacagcaaatatctagaacttt

SEQ ID NO: 130780 - DNA, 22 bp, Artificial Sequence
  Synthetic oligonucleotide; CTA chr11 5300480 5300501 5300485 5300480 -
gaactttaggaagcttactcat

SEQ ID NO: 130781 - DNA, 22 bp, Artificial Sequence
  Synthetic oligonucleotide; CTT chr11 5300474 5300495 5300479 5300474 -
taggaagcttactcatgaaatg

SEQ ID NO: 130782 - DNA, 22 bp, Artificial Sequence
  Synthetic oligonucleotide; TTT chr11 5300473 5300494 5300478 5300473 -
aggaagcttactcatgaaatgt

SEQ ID NO: 130783 - DNA, 22 bp, Artificial Sequence
  Synthetic oligonucleotide; TTA chr11 5300472 5300493 5300477 5300472 -
ggaagcttactcatgaaatgta

SEQ ID NO: 130784 - DNA, 22 bp, Artificial Sequence
  Synthetic oligonucleotide; CTT chr11 5300464 5300485 5300469 5300464 -
actcatgaaatgtaatttccct

SEQ ID NO: 130785 - DNA, 22 bp, Artificial Sequence
  Synthetic oligonucleotide; TTA chr11 5300463 5300484 5300468 5300463 -
ctcatgaaatgtaatttccctt

SEQ ID NO: 130786 - DNA, 22 bp, Artificial Sequence
  Synthetic oligonucleotide; CTC chr11 5300460 5300481 5300465 5300460 -
atgaaatgtaatttcccttagt

SEQ ID NO: 130787 - DNA, 22 bp, Artificial Sequence
  Synthetic oligonucleotide; TTT chr11 5300446 5300467 5300451 5300446 -
cccttagtagactggcatattt

SEQ ID NO: 130788 - DNA, 22 bp, Artificial Sequence
  Synthetic oligonucleotide; TTC chr11 5300445 5300466 5300450 5300445 -
ccttagtagactggcatatttt

SEQ ID NO: 130789 - DNA, 22 bp, Artificial Sequence
  Synthetic oligonucleotide; CTT chr11 5300441 5300462 5300446 5300441 -
agtagactggcatattttacta

SEQ ID NO: 130790 - DNA, 22 bp, Artificial Sequence
  Synthetic oligonucleotide; TTA chr11 5300440 5300461 5300445 5300440 -
gtagactggcatattttactac

SEQ ID NO: 130791 - DNA, 22 bp, Artificial Sequence
  Synthetic oligonucleotide; CTG chr11 5300432 5300453 5300437 5300432 -
gcatattttactactaaaaggc

SEQ ID NO: 130792 - DNA, 22 bp, Artificial Sequence
  Synthetic oligonucleotide; TTT chr11 5300424 5300445 5300429 5300424 -
tactactaaaaggcgtgtgata

SEQ ID NO: 130793 - DNA, 22 bp, Artificial Sequence
  Synthetic oligonucleotide; TTT chr11 5300423 5300444 5300428 5300423 -
actactaaaaggcgtgtgatac

SEQ ID NO: 130794 - DNA, 22 bp, Artificial Sequence
  Synthetic oligonucleotide; TTA chr11 5300422 5300443 5300427 5300422 -
ctactaaaaggcgtgtgataca

SEQ ID NO: 130795 - DNA, 22 bp, Artificial Sequence
  Synthetic oligonucleotide; CTA chr11 5300419 5300440 5300424 5300419 -
ctaaaaggcgtgtgatacagac

SEQ ID NO: 130796 - DNA, 22 bp, Artificial Sequence
  Synthetic oligonucleotide; CTA chr11 5300416 5300437 5300421 5300416 -
aaaggcgtgtgatacagactaa

SEQ ID NO: 130797 - DNA, 22 bp, Artificial Sequence
  Synthetic oligonucleotide; CTA chr11 5300395 5300416 5300400 5300395 -
acagctaaatagcagcaaacac

SEQ ID NO: 130798 - DNA, 22 bp, Artificial Sequence
  Synthetic oligonucleotide; CTA chr11 5300388 5300409 5300393 5300388 -
aatagcagcaaacacatttctt

SEQ ID NO: 130799 - DNA, 22 bp, Artificial Sequence
  Synthetic oligonucleotide; TTT chr11 5300369 5300390 5300374 5300369 -
cttatcatctcgtggaagccag

SEQ ID NO: 130800 - DNA, 22 bp, Artificial Sequence
  Synthetic oligonucleotide; TTC chr11 5300368 5300389 5300373 5300368 -
ttatcatctcgtggaagccaga

SEQ ID NO: 130801 - DNA, 22 bp, Artificial Sequence
  Synthetic oligonucleotide; CTT chr11 5300366 5300387 5300371 5300366 -
atcatctcgtggaagccagata

SEQ ID NO: 130802 - DNA, 22 bp, Artificial Sequence
  Synthetic oligonucleotide; TTA chr11 5300365 5300386 5300370 5300365 -
tcatctcgtggaagccagatat

SEQ ID NO: 130803 - DNA, 22 bp, Artificial Sequence
  Synthetic oligonucleotide; CTC chr11 5300358 5300379 5300363 5300358 -
gtggaagccagatatcccagcc

SEQ ID NO: 130804 - DNA, 22 bp, Artificial Sequence
  Synthetic oligonucleotide; TTT chr11 5300330 5300351 5300335 5300330 -
tccttcttcccattgtctgctg

SEQ ID NO: 130805 - DNA, 22 bp, Artificial Sequence
  Synthetic oligonucleotide; TTT chr11 5300329 5300350 5300334 5300329 -
ccttcttcccattgtctgctga

SEQ ID NO: 130806 - DNA, 22 bp, Artificial Sequence
  Synthetic oligonucleotide; TTC chr11 5300328 5300349 5300333 5300328 -
cttcttcccattgtctgctgaa

SEQ ID NO: 130807 - DNA, 22 bp, Artificial Sequence
  Synthetic oligonucleotide; CTT chr11 5300325 5300346 5300330 5300325 -
cttcccattgtctgctgaaact

SEQ ID NO: 130808 - DNA, 22 bp, Artificial Sequence
  Synthetic oligonucleotide; TTC chr11 5300324 5300345 5300329 5300324 -
ttcccattgtctgctgaaacta

SEQ ID NO: 130809 - DNA, 22 bp, Artificial Sequence
  Synthetic oligonucleotide; CTT chr11 5300322 5300343 5300327 5300322 -
cccattgtctgctgaaactaac

SEQ ID NO: 130810 - DNA, 22 bp, Artificial Sequence
  Synthetic oligonucleotide; TTC chr11 5300321 5300342 5300326 5300321 -
ccattgtctgctgaaactaact

SEQ ID NO: 130811 - DNA, 22 bp, Artificial Sequence
  Synthetic oligonucleotide; TTG chr11 5300315 5300336 5300320 5300315 -
tctgctgaaactaacttaatac

SEQ ID NO: 130812 - DNA, 22 bp, Artificial Sequence
  Synthetic oligonucleotide; CTG chr11 5300311 5300332 5300316 5300311 -
ctgaaactaacttaatactttt

SEQ ID NO: 130813 - DNA, 22 bp, Artificial Sequence
  Synthetic oligonucleotide; CTG chr11 5300308 5300329 5300313 5300308 -
aaactaacttaatactttttct

SEQ ID NO: 130814 - DNA, 22 bp, Artificial Sequence
  Synthetic oligonucleotide; CTA chr11 5300302 5300323 5300307 5300302 -
acttaatactttttcttctttc

SEQ ID NO: 130815 - DNA, 22 bp, Artificial Sequence
  Synthetic oligonucleotide; CTT chr11 5300298 5300319 5300303 5300298 -
aatactttttcttctttccagc

SEQ ID NO: 130816 - DNA, 22 bp, Artificial Sequence
  Synthetic oligonucleotide; TTA chr11 5300297 5300318 5300302 5300297 -
atactttttcttctttccagct

SEQ ID NO: 130817 - DNA, 22 bp, Artificial Sequence
  Synthetic oligonucleotide; CTT chr11 5300291 5300312 5300296 5300291 -
tttcttctttccagctttctat

SEQ ID NO: 130818 - DNA, 22 bp, Artificial Sequence
  Synthetic oligonucleotide; TTT chr11 5300290 5300311 5300295 5300290 -
ttcttctttccagctttctatt

SEQ ID NO: 130819 - DNA, 22 bp, Artificial Sequence
  Synthetic oligonucleotide; TTT chr11 5300289 5300310 5300294 5300289 -
tcttctttccagctttctattt

SEQ ID NO: 130820 - DNA, 22 bp, Artificial Sequence
  Synthetic oligonucleotide; TTT chr11 5300288 5300309 5300293 5300288 -
cttctttccagctttctatttt

SEQ ID NO: 130821 - DNA, 22 bp, Artificial Sequence
  Synthetic oligonucleotide; TTC chr11 5300287 5300308 5300292 5300287 -
ttctttccagctttctattttg

SEQ ID NO: 130822 - DNA, 22 bp, Artificial Sequence
  Synthetic oligonucleotide; CTT chr11 5300285 5300306 5300290 5300285 -
ctttccagctttctattttgtc

SEQ ID NO: 130823 - DNA, 22 bp, Artificial Sequence
  Synthetic oligonucleotide; TTC chr11 5300284 5300305 5300289 5300284 -
tttccagctttctattttgtct

SEQ ID NO: 130824 - DNA, 22 bp, Artificial Sequence
  Synthetic oligonucleotide; CTT chr11 5300282 5300303 5300287 5300282 -
tccagctttctattttgtctcc

SEQ ID NO: 130825 - DNA, 22 bp, Artificial Sequence
  Synthetic oligonucleotide; TTT chr11 5300281 5300302 5300286 5300281 -
ccagctttctattttgtctcct

SEQ ID NO: 130826 - DNA, 22 bp, Artificial Sequence
  Synthetic oligonucleotide; TTC chr11 5300280 5300301 5300285 5300280 -
cagctttctattttgtctcctg

SEQ ID NO: 130827 - DNA, 22 bp, Artificial Sequence
  Synthetic oligonucleotide; CTT chr11 5300274 5300295 5300279 5300274 -
tctattttgtctcctgacattt

SEQ ID NO: 130828 - DNA, 22 bp, Artificial Sequence
  Synthetic oligonucleotide; TTT chr11 5300273 5300294 5300278 5300273 -
ctattttgtctcctgacatttt

SEQ ID NO: 130829 - DNA, 22 bp, Artificial Sequence
  Synthetic oligonucleotide; TTC chr11 5300272 5300293 5300277 5300272 -
tattttgtctcctgacattttt

SEQ ID NO: 130830 - DNA, 22 bp, Artificial Sequence
  Synthetic oligonucleotide; CTA chr11 5300270 5300291 5300275 5300270 -
ttttgtctcctgacatttttct

SEQ ID NO: 130831 - DNA, 22 bp, Artificial Sequence
  Synthetic oligonucleotide; TTT chr11 5300267 5300288 5300272 5300267 -
tgtctcctgacatttttcttct

SEQ ID NO: 130832 - DNA, 22 bp, Artificial Sequence
  Synthetic oligonucleotide; TTT chr11 5300266 5300287 5300271 5300266 -
gtctcctgacatttttcttctg

SEQ ID NO: 130833 - DNA, 22 bp, Artificial Sequence
  Synthetic oligonucleotide; TTG chr11 5300265 5300286 5300270 5300265 -
tctcctgacatttttcttctga

SEQ ID NO: 130834 - DNA, 22 bp, Artificial Sequence
  Synthetic oligonucleotide; CTC chr11 5300261 5300282 5300266 5300261 -
ctgacatttttcttctgaaaaa

SEQ ID NO: 130835 - DNA, 22 bp, Artificial Sequence
  Synthetic oligonucleotide; CTG chr11 5300258 5300279 5300263 5300258 -
acatttttcttctgaaaaaaat

SEQ ID NO: 130836 - DNA, 22 bp, Artificial Sequence
  Synthetic oligonucleotide; TTT chr11 5300252 5300273 5300257 5300252 -
ttcttctgaaaaaaataaccaa

SEQ ID NO: 130837 - DNA, 22 bp, Artificial Sequence
  Synthetic oligonucleotide; TTT chr11 5300251 5300272 5300256 5300251 -
tcttctgaaaaaaataaccaac

SEQ ID NO: 130838 - DNA, 22 bp, Artificial Sequence
  Synthetic oligonucleotide; TTT chr11 5300250 5300271 5300255 5300250 -
cttctgaaaaaaataaccaact

SEQ ID NO: 130839 - DNA, 22 bp, Artificial Sequence
  Synthetic oligonucleotide; TTC chr11 5300249 5300270 5300254 5300249 -
ttctgaaaaaaataaccaacta

SEQ ID NO: 130840 - DNA, 22 bp, Artificial Sequence
  Synthetic oligonucleotide; CTT chr11 5300247 5300268 5300252 5300247 -
ctgaaaaaaataaccaactata

SEQ ID NO: 130841 - DNA, 22 bp, Artificial Sequence
  Synthetic oligonucleotide; TTC chr11 5300246 5300267 5300251 5300246 -
tgaaaaaaataaccaactataa

SEQ ID NO: 130842 - DNA, 22 bp, Artificial Sequence
  Synthetic oligonucleotide; CTG chr11 5300244 5300265 5300249 5300244 -
aaaaaaataaccaactataaat

SEQ ID NO: 130843 - DNA, 22 bp, Artificial Sequence
  Synthetic oligonucleotide; CTA chr11 5300227 5300248 5300232 5300227 -
taaatttagatatcaccaccca

SEQ ID NO: 130844 - DNA, 22 bp, Artificial Sequence
  Synthetic oligonucleotide; TTT chr11 5300220 5300241 5300225 5300220 -
agatatcaccacccatttctat

SEQ ID NO: 130845 - DNA, 22 bp, Artificial Sequence
  Synthetic oligonucleotide; TTA chr11 5300219 5300240 5300224 5300219 -
gatatcaccacccatttctatt

SEQ ID NO: 130846 - DNA, 22 bp, Artificial Sequence
  Synthetic oligonucleotide; TTT chr11 5300202 5300223 5300207 5300202 -
ctatttcccctcttgcttctca

SEQ ID NO: 130847 - DNA, 22 bp, Artificial Sequence
  Synthetic oligonucleotide; TTC chr11 5300201 5300222 5300206 5300201 -
tatttcccctcttgcttctcac

SEQ ID NO: 130848 - DNA, 22 bp, Artificial Sequence
  Synthetic oligonucleotide; CTA chr11 5300199 5300220 5300204 5300199 -
tttcccctcttgcttctcacat

SEQ ID NO: 130849 - DNA, 22 bp, Artificial Sequence
  Synthetic oligonucleotide; TTT chr11 5300196 5300217 5300201 5300196 -
cccctcttgcttctcacataaa

SEQ ID NO: 130850 - DNA, 22 bp, Artificial Sequence
  Synthetic oligonucleotide; TTC chr11 5300195 5300216 5300200 5300195 -
ccctcttgcttctcacataaaa

SEQ ID NO: 130851 - DNA, 22 bp, Artificial Sequence
  Synthetic oligonucleotide; CTC chr11 5300190 5300211 5300195 5300190 -
ttgcttctcacataaaaaatct

SEQ ID NO: 130852 - DNA, 22 bp, Artificial Sequence
  Synthetic oligonucleotide; CTT chr11 5300188 5300209 5300193 5300188 -
gcttctcacataaaaaatctcg

SEQ ID NO: 130853 - DNA, 22 bp, Artificial Sequence
  Synthetic oligonucleotide; TTG chr11 5300187 5300208 5300192 5300187 -
cttctcacataaaaaatctcga

SEQ ID NO: 130854 - DNA, 22 bp, Artificial Sequence
  Synthetic oligonucleotide; CTT chr11 5300184 5300205 5300189 5300184 -
ctcacataaaaaatctcgagac

SEQ ID NO: 130855 - DNA, 22 bp, Artificial Sequence
  Synthetic oligonucleotide; TTC chr11 5300183 5300204 5300188 5300183 -
tcacataaaaaatctcgagact

SEQ ID NO: 130856 - DNA, 22 bp, Artificial Sequence
  Synthetic oligonucleotide; CTC chr11 5300181 5300202 5300186 5300181 -
acataaaaaatctcgagacttt

SEQ ID NO: 130857 - DNA, 22 bp, Artificial Sequence
  Synthetic oligonucleotide; CTC chr11 5300167 5300188 5300172 5300167 -
gagactttttcacttcatgaaa

SEQ ID NO: 130858 - DNA, 22 bp, Artificial Sequence
  Synthetic oligonucleotide; CTT chr11 5300160 5300181 5300165 5300160 -
tttcacttcatgaaatagtttt

SEQ ID NO: 130859 - DNA, 22 bp, Artificial Sequence
  Synthetic oligonucleotide; TTT chr11 5300159 5300180 5300164 5300159 -
ttcacttcatgaaatagttttg

SEQ ID NO: 130860 - DNA, 22 bp, Artificial Sequence
  Synthetic oligonucleotide; TTT chr11 5300158 5300179 5300163 5300158 -
tcacttcatgaaatagttttga

SEQ ID NO: 130861 - DNA, 22 bp, Artificial Sequence
  Synthetic oligonucleotide; TTT chr11 5300157 5300178 5300162 5300157 -
cacttcatgaaatagttttgat

SEQ ID NO: 130862 - DNA, 22 bp, Artificial Sequence
  Synthetic oligonucleotide; TTC chr11 5300156 5300177 5300161 5300156 -
acttcatgaaatagttttgata

SEQ ID NO: 130863 - DNA, 22 bp, Artificial Sequence
  Synthetic oligonucleotide; CTT chr11 5300152 5300173 5300157 5300152 -
catgaaatagttttgataatta

SEQ ID NO: 130864 - DNA, 22 bp, Artificial Sequence
  Synthetic oligonucleotide; TTC chr11 5300151 5300172 5300156 5300151 -
atgaaatagttttgataattaa

SEQ ID NO: 130865 - DNA, 22 bp, Artificial Sequence
  Synthetic oligonucleotide; TTT chr11 5300139 5300160 5300144 5300139 -
tgataattaatgcaaaaacttg

SEQ ID NO: 130866 - DNA, 22 bp, Artificial Sequence
  Synthetic oligonucleotide; TTT chr11 5300138 5300159 5300143 5300138 -
gataattaatgcaaaaacttgg

SEQ ID NO: 130867 - DNA, 22 bp, Artificial Sequence
  Synthetic oligonucleotide; TTG chr11 5300137 5300158 5300142 5300137 -
ataattaatgcaaaaacttggc

SEQ ID NO: 130868 - DNA, 22 bp, Artificial Sequence
  Synthetic oligonucleotide; TTA chr11 5300130 5300151 5300135 5300130 -
atgcaaaaacttggcaaaggta

SEQ ID NO: 130869 - DNA, 22 bp, Artificial Sequence
  Synthetic oligonucleotide; CTT chr11 5300118 5300139 5300123 5300118 -
ggcaaaggtaatgttatatttt

SEQ ID NO: 130870 - DNA, 22 bp, Artificial Sequence
  Synthetic oligonucleotide; TTG chr11 5300117 5300138 5300122 5300117 -
gcaaaggtaatgttatatttta

SEQ ID NO: 130871 - DNA, 22 bp, Artificial Sequence
  Synthetic oligonucleotide; TTA chr11 5300102 5300123 5300107 5300102 -
tattttagaaatttttcactga

SEQ ID NO: 130872 - DNA, 22 bp, Artificial Sequence
  Synthetic oligonucleotide; TTT chr11 5300097 5300118 5300102 5300097 -
tagaaatttttcactgatggaa

SEQ ID NO: 130873 - DNA, 22 bp, Artificial Sequence
  Synthetic oligonucleotide; TTT chr11 5300096 5300117 5300101 5300096 -
agaaatttttcactgatggaat

SEQ ID NO: 130874 - DNA, 22 bp, Artificial Sequence
  Synthetic oligonucleotide; TTA chr11 5300095 5300116 5300100 5300095 -
gaaatttttcactgatggaata

SEQ ID NO: 130875 - DNA, 22 bp, Artificial Sequence
  Synthetic oligonucleotide; TTT chr11 5300088 5300109 5300093 5300088 -
ttcactgatggaatagtttctt

SEQ ID NO: 130876 - DNA, 22 bp, Artificial Sequence
  Synthetic oligonucleotide; TTT chr11 5300087 5300108 5300092 5300087 -
tcactgatggaatagtttcttc

SEQ ID NO: 130877 - DNA, 22 bp, Artificial Sequence
  Synthetic oligonucleotide; TTT chr11 5300086 5300107 5300091 5300086 -
cactgatggaatagtttcttcc

SEQ ID NO: 130878 - DNA, 22 bp, Artificial Sequence
  Synthetic oligonucleotide; TTC chr11 5300085 5300106 5300090 5300085 -
actgatggaatagtttcttcct

SEQ ID NO: 130879 - DNA, 22 bp, Artificial Sequence
  Synthetic oligonucleotide; CTG chr11 5300081 5300102 5300086 5300081 -
atggaatagtttcttccttcaa

SEQ ID NO: 130880 - DNA, 22 bp, Artificial Sequence
  Synthetic oligonucleotide; TTT chr11 5300069 5300090 5300074 5300069 -
cttccttcaatcttcttcaaag

SEQ ID NO: 130881 - DNA, 22 bp, Artificial Sequence
  Synthetic oligonucleotide; TTC chr11 5300068 5300089 5300073 5300068 -
ttccttcaatcttcttcaaagt

SEQ ID NO: 130882 - DNA, 22 bp, Artificial Sequence
  Synthetic oligonucleotide; CTT chr11 5300066 5300087 5300071 5300066 -
ccttcaatcttcttcaaagtgt

SEQ ID NO: 130883 - DNA, 22 bp, Artificial Sequence
  Synthetic oligonucleotide; TTC chr11 5300065 5300086 5300070 5300065 -
cttcaatcttcttcaaagtgtt

SEQ ID NO: 130884 - DNA, 22 bp, Artificial Sequence
  Synthetic oligonucleotide; CTT chr11 5300062 5300083 5300067 5300062 -
caatcttcttcaaagtgtttgt

SEQ ID NO: 130885 - DNA, 22 bp, Artificial Sequence
  Synthetic oligonucleotide; TTC chr11 5300061 5300082 5300066 5300061 -
aatcttcttcaaagtgtttgta

SEQ ID NO: 130886 - DNA, 22 bp, Artificial Sequence
  Synthetic oligonucleotide; CTT chr11 5300055 5300076 5300060 5300055 -
cttcaaagtgtttgtaagtctt

SEQ ID NO: 130887 - DNA, 22 bp, Artificial Sequence
  Synthetic oligonucleotide; TTC chr11 5300054 5300075 5300059 5300054 -
ttcaaagtgtttgtaagtcttt

SEQ ID NO: 130888 - DNA, 22 bp, Artificial Sequence
  Synthetic oligonucleotide; CTT chr11 5300052 5300073 5300057 5300052 -
caaagtgtttgtaagtctttat

SEQ ID NO: 130889 - DNA, 22 bp, Artificial Sequence
  Synthetic oligonucleotide; TTC chr11 5300051 5300072 5300056 5300051 -
aaagtgtttgtaagtctttatg

SEQ ID NO: 130890 - DNA, 22 bp, Artificial Sequence
  Synthetic oligonucleotide; TTT chr11 5300042 5300063 5300047 5300042 -
gtaagtctttatgctgttcatt

SEQ ID NO: 130891 - DNA, 22 bp, Artificial Sequence
  Synthetic oligonucleotide; TTG chr11 5300041 5300062 5300046 5300041 -
taagtctttatgctgttcattg

SEQ ID NO: 130892 - DNA, 22 bp, Artificial Sequence
  Synthetic oligonucleotide; CTT chr11 5300033 5300054 5300038 5300033 -
tatgctgttcattgggtctgaa

SEQ ID NO: 130893 - DNA, 22 bp, Artificial Sequence
  Synthetic oligonucleotide; TTT chr11 5300032 5300053 5300037 5300032 -
atgctgttcattgggtctgaac

SEQ ID NO: 130894 - DNA, 22 bp, Artificial Sequence
  Synthetic oligonucleotide; TTA chr11 5300031 5300052 5300036 5300031 -
tgctgttcattgggtctgaacc

SEQ ID NO: 130895 - DNA, 22 bp, Artificial Sequence
  Synthetic oligonucleotide; CTG chr11 5300026 5300047 5300031 5300026 -
ttcattgggtctgaaccgcagt

SEQ ID NO: 130896 - DNA, 22 bp, Artificial Sequence
  Synthetic oligonucleotide; TTC chr11 5300023 5300044 5300028 5300023 -
attgggtctgaaccgcagtcta

SEQ ID NO: 130897 - DNA, 22 bp, Artificial Sequence
  Synthetic oligonucleotide; TTG chr11 5300019 5300040 5300024 5300019 -
ggtctgaaccgcagtctaccac

SEQ ID NO: 130898 - DNA, 22 bp, Artificial Sequence
  Synthetic oligonucleotide; CTG chr11 5300013 5300034 5300018 5300013 -
aaccgcagtctaccacttgcta

SEQ ID NO: 130899 - DNA, 22 bp, Artificial Sequence
  Synthetic oligonucleotide; CTA chr11 5300001 5300022 5300006 5300001 -
ccacttgctattagtgtaacag

SEQ ID NO: 130900 - DNA, 22 bp, Artificial Sequence
  Synthetic oligonucleotide; CTT chr11 5299995 5300016 5300000 5299995 -
gctattagtgtaacaggggatg

SEQ ID NO: 130901 - DNA, 22 bp, Artificial Sequence
  Synthetic oligonucleotide; TTG chr11 5299994 5300015 5299999 5299994 -
ctattagtgtaacaggggatga

SEQ ID NO: 130902 - DNA, 22 bp, Artificial Sequence
  Synthetic oligonucleotide; CTA chr11 5299991 5300012 5299996 5299991 -
ttagtgtaacaggggatgacaa

SEQ ID NO: 130903 - DNA, 22 bp, Artificial Sequence
  Synthetic oligonucleotide; TTA chr11 5299988 5300009 5299993 5299988 -
gtgtaacaggggatgacaattt

SEQ ID NO: 130904 - DNA, 22 bp, Artificial Sequence
  Synthetic oligonucleotide; TTT chr11 5299966 5299987 5299971 5299966 -
cttcatctactgctagttctgc

SEQ ID NO: 130905 - DNA, 22 bp, Artificial Sequence
  Synthetic oligonucleotide; TTC chr11 5299965 5299986 5299970 5299965 -
ttcatctactgctagttctgcg

SEQ ID NO: 130906 - DNA, 22 bp, Artificial Sequence
  Synthetic oligonucleotide; CTT chr11 5299963 5299984 5299968 5299963 -
catctactgctagttctgcgct

SEQ ID NO: 130907 - DNA, 22 bp, Artificial Sequence
  Synthetic oligonucleotide; TTC chr11 5299962 5299983 5299967 5299962 -
atctactgctagttctgcgcta

SEQ ID NO: 130908 - DNA, 22 bp, Artificial Sequence
  Synthetic oligonucleotide; CTA chr11 5299957 5299978 5299962 5299957 -
ctgctagttctgcgctagtatt

SEQ ID NO: 130909 - DNA, 22 bp, Artificial Sequence
  Synthetic oligonucleotide; CTG chr11 5299954 5299975 5299959 5299954 -
ctagttctgcgctagtatttgc

SEQ ID NO: 130910 - DNA, 22 bp, Artificial Sequence
  Synthetic oligonucleotide; CTA chr11 5299951 5299972 5299956 5299951 -
gttctgcgctagtatttgcagc

SEQ ID NO: 130911 - DNA, 22 bp, Artificial Sequence
  Synthetic oligonucleotide; TTC chr11 5299947 5299968 5299952 5299947 -
tgcgctagtatttgcagctgat

SEQ ID NO: 130912 - DNA, 22 bp, Artificial Sequence
  Synthetic oligonucleotide; CTG chr11 5299945 5299966 5299950 5299945 -
cgctagtatttgcagctgatct

SEQ ID NO: 130913 - DNA, 22 bp, Artificial Sequence
  Synthetic oligonucleotide; CTA chr11 5299940 5299961 5299945 5299940 -
gtatttgcagctgatctcctta

SEQ ID NO: 130914 - DNA, 22 bp, Artificial Sequence
  Synthetic oligonucleotide; TTT chr11 5299934 5299955 5299939 5299934 -
gcagctgatctccttataggaa

SEQ ID NO: 130915 - DNA, 22 bp, Artificial Sequence
  Synthetic oligonucleotide; TTG chr11 5299933 5299954 5299938 5299933 -
cagctgatctccttataggaaa

SEQ ID NO: 130916 - DNA, 22 bp, Artificial Sequence
  Synthetic oligonucleotide; CTG chr11 5299927 5299948 5299932 5299927 -
atctccttataggaaactaatc

SEQ ID NO: 130917 - DNA, 22 bp, Artificial Sequence
  Synthetic oligonucleotide; CTC chr11 5299922 5299943 5299927 5299922 -
cttataggaaactaatctcaaa

SEQ ID NO: 130918 - DNA, 22 bp, Artificial Sequence
  Synthetic oligonucleotide; CTT chr11 5299919 5299940 5299924 5299919 -
ataggaaactaatctcaaaagt

SEQ ID NO: 130919 - DNA, 22 bp, Artificial Sequence
  Synthetic oligonucleotide; TTA chr11 5299918 5299939 5299923 5299918 -
taggaaactaatctcaaaagtt

SEQ ID NO: 130920 - DNA, 22 bp, Artificial Sequence
  Synthetic oligonucleotide; CTA chr11 5299908 5299929 5299913 5299908 -
atctcaaaagttgcattcattc

SEQ ID NO: 130921 - DNA, 22 bp, Artificial Sequence
  Synthetic oligonucleotide; CTC chr11 5299903 5299924 5299908 5299903 -
aaaagttgcattcattcctctc

SEQ ID NO: 130922 - DNA, 22 bp, Artificial Sequence
  Synthetic oligonucleotide; TTG chr11 5299895 5299916 5299900 5299895 -
cattcattcctctctgaagact

SEQ ID NO: 130923 - DNA, 22 bp, Artificial Sequence
  Synthetic oligonucleotide; TTC chr11 5299890 5299911 5299895 5299890 -
attcctctctgaagactgctgt

SEQ ID NO: 130924 - DNA, 22 bp, Artificial Sequence
  Synthetic oligonucleotide; TTC chr11 5299886 5299907 5299891 5299886 -
ctctctgaagactgctgtttct

SEQ ID NO: 130925 - DNA, 22 bp, Artificial Sequence
  Synthetic oligonucleotide; CTC chr11 5299883 5299904 5299888 5299883 -
tctgaagactgctgtttcttcc

SEQ ID NO: 130926 - DNA, 22 bp, Artificial Sequence
  Synthetic oligonucleotide; CTC chr11 5299881 5299902 5299886 5299881 -
tgaagactgctgtttcttccaa

SEQ ID NO: 130927 - DNA, 22 bp, Artificial Sequence
  Synthetic oligonucleotide; CTG chr11 5299879 5299900 5299884 5299879 -
aagactgctgtttcttccaatt

SEQ ID NO: 130928 - DNA, 22 bp, Artificial Sequence
  Synthetic oligonucleotide; CTG chr11 5299872 5299893 5299877 5299872 -
ctgtttcttccaatttttaagt

SEQ ID NO: 130929 - DNA, 22 bp, Artificial Sequence
  Synthetic oligonucleotide; CTG chr11 5299869 5299890 5299874 5299869 -
tttcttccaatttttaagttct

SEQ ID NO: 130930 - DNA, 22 bp, Artificial Sequence
  Synthetic oligonucleotide; TTT chr11 5299866 5299887 5299871 5299866 -
cttccaatttttaagttctcgt

SEQ ID NO: 130931 - DNA, 22 bp, Artificial Sequence
  Synthetic oligonucleotide; TTC chr11 5299865 5299886 5299870 5299865 -
ttccaatttttaagttctcgtt

SEQ ID NO: 130932 - DNA, 22 bp, Artificial Sequence
  Synthetic oligonucleotide; CTT chr11 5299863 5299884 5299868 5299863 -
ccaatttttaagttctcgttga

SEQ ID NO: 130933 - DNA, 22 bp, Artificial Sequence
  Synthetic oligonucleotide; TTC chr11 5299862 5299883 5299867 5299862 -
caatttttaagttctcgttgag

SEQ ID NO: 130934 - DNA, 22 bp, Artificial Sequence
  Synthetic oligonucleotide; TTT chr11 5299856 5299877 5299861 5299856 -
ttaagttctcgttgagcttgct

SEQ ID NO: 130935 - DNA, 22 bp, Artificial Sequence
  Synthetic oligonucleotide; TTT chr11 5299855 5299876 5299860 5299855 -
taagttctcgttgagcttgctt

SEQ ID NO: 130936 - DNA, 22 bp, Artificial Sequence
  Synthetic oligonucleotide; TTT chr11 5299854 5299875 5299859 5299854 -
aagttctcgttgagcttgcttc

SEQ ID NO: 130937 - DNA, 22 bp, Artificial Sequence
  Synthetic oligonucleotide; TTA chr11 5299853 5299874 5299858 5299853 -
agttctcgttgagcttgcttct

SEQ ID NO: 130938 - DNA, 22 bp, Artificial Sequence
  Synthetic oligonucleotide; TTC chr11 5299848 5299869 5299853 5299848 -
tcgttgagcttgcttctaatat

SEQ ID NO: 130939 - DNA, 22 bp, Artificial Sequence
  Synthetic oligonucleotide; CTC chr11 5299846 5299867 5299851 5299846 -
gttgagcttgcttctaatattt

SEQ ID NO: 130940 - DNA, 22 bp, Artificial Sequence
  Synthetic oligonucleotide; TTG chr11 5299842 5299863 5299847 5299842 -
agcttgcttctaatattttctt

SEQ ID NO: 130941 - DNA, 22 bp, Artificial Sequence
  Synthetic oligonucleotide; CTT chr11 5299837 5299858 5299842 5299837 -
gcttctaatattttcttttctg

SEQ ID NO: 130942 - DNA, 22 bp, Artificial Sequence
  Synthetic oligonucleotide; TTG chr11 5299836 5299857 5299841 5299836 -
cttctaatattttcttttctga

SEQ ID NO: 130943 - DNA, 22 bp, Artificial Sequence
  Synthetic oligonucleotide; CTT chr11 5299833 5299854 5299838 5299833 -
ctaatattttcttttctgattg

SEQ ID NO: 130944 - DNA, 22 bp, Artificial Sequence
  Synthetic oligonucleotide; TTC chr11 5299832 5299853 5299837 5299832 -
taatattttcttttctgattga

SEQ ID NO: 130945 - DNA, 22 bp, Artificial Sequence
  Synthetic oligonucleotide; CTA chr11 5299830 5299851 5299835 5299830 -
atattttcttttctgattgaaa

SEQ ID NO: 130946 - DNA, 22 bp, Artificial Sequence
  Synthetic oligonucleotide; TTT chr11 5299824 5299845 5299829 5299824 -
tcttttctgattgaaagtccat

SEQ ID NO: 130947 - DNA, 22 bp, Artificial Sequence
  Synthetic oligonucleotide; TTT chr11 5299823 5299844 5299828 5299823 -
cttttctgattgaaagtccatg

SEQ ID NO: 130948 - DNA, 22 bp, Artificial Sequence
  Synthetic oligonucleotide; TTC chr11 5299822 5299843 5299827 5299822 -
ttttctgattgaaagtccatgt

SEQ ID NO: 130949 - DNA, 22 bp, Artificial Sequence
  Synthetic oligonucleotide; CTT chr11 5299820 5299841 5299825 5299820 -
ttctgattgaaagtccatgttc

SEQ ID NO: 130950 - DNA, 22 bp, Artificial Sequence
  Synthetic oligonucleotide; TTT chr11 5299819 5299840 5299824 5299819 -
tctgattgaaagtccatgttca

SEQ ID NO: 130951 - DNA, 22 bp, Artificial Sequence
  Synthetic oligonucleotide; TTT chr11 5299818 5299839 5299823 5299818 -
ctgattgaaagtccatgttcag

SEQ ID NO: 130952 - DNA, 22 bp, Artificial Sequence
  Synthetic oligonucleotide; TTC chr11 5299817 5299838 5299822 5299817 -
tgattgaaagtccatgttcaga

SEQ ID NO: 130953 - DNA, 22 bp, Artificial Sequence
  Synthetic oligonucleotide; CTG chr11 5299815 5299836 5299820 5299815 -
attgaaagtccatgttcagaac

SEQ ID NO: 130954 - DNA, 22 bp, Artificial Sequence
  Synthetic oligonucleotide; TTG chr11 5299811 5299832 5299816 5299811 -
aaagtccatgttcagaacccag

SEQ ID NO: 130955 - DNA, 22 bp, Artificial Sequence
  Synthetic oligonucleotide; TTC chr11 5299798 5299819 5299803 5299798 -
agaacccagtatataattattc

SEQ ID NO: 130956 - DNA, 22 bp, Artificial Sequence
  Synthetic oligonucleotide; TTA chr11 5299779 5299800 5299784 5299779 -
ttccattctaaattctctctgc

SEQ ID NO: 130957 - DNA, 22 bp, Artificial Sequence
  Synthetic oligonucleotide; TTC chr11 5299776 5299797 5299781 5299776 -
cattctaaattctctctgcttc

SEQ ID NO: 130958 - DNA, 22 bp, Artificial Sequence
  Synthetic oligonucleotide; TTC chr11 5299771 5299792 5299776 5299771 -
taaattctctctgcttcactta

SEQ ID NO: 130959 - DNA, 22 bp, Artificial Sequence
  Synthetic oligonucleotide; CTA chr11 5299769 5299790 5299774 5299769 -
aattctctctgcttcacttaag

SEQ ID NO: 130960 - DNA, 22 bp, Artificial Sequence
  Synthetic oligonucleotide; TTC chr11 5299764 5299785 5299769 5299764 -
tctctgcttcacttaagaaatc

SEQ ID NO: 130961 - DNA, 22 bp, Artificial Sequence
  Synthetic oligonucleotide; CTC chr11 5299762 5299783 5299767 5299762 -
tctgcttcacttaagaaatctt

SEQ ID NO: 130962 - DNA, 22 bp, Artificial Sequence
  Synthetic oligonucleotide; CTC chr11 5299760 5299781 5299765 5299760 -
tgcttcacttaagaaatctttc

SEQ ID NO: 130963 - DNA, 22 bp, Artificial Sequence
  Synthetic oligonucleotide; CTG chr11 5299758 5299779 5299763 5299758 -
cttcacttaagaaatctttcat

SEQ ID NO: 130964 - DNA, 22 bp, Artificial Sequence
  Synthetic oligonucleotide; CTT chr11 5299755 5299776 5299760 5299755 -
cacttaagaaatctttcatatt

SEQ ID NO: 130965 - DNA, 22 bp, Artificial Sequence
  Synthetic oligonucleotide; TTC chr11 5299754 5299775 5299759 5299754 -
acttaagaaatctttcatattt

SEQ ID NO: 130966 - DNA, 22 bp, Artificial Sequence
  Synthetic oligonucleotide; CTT chr11 5299750 5299771 5299755 5299750 -
aagaaatctttcatatttattt

SEQ ID NO: 130967 - DNA, 22 bp, Artificial Sequence
  Synthetic oligonucleotide; TTA chr11 5299749 5299770 5299754 5299749 -
agaaatctttcatatttatttt

SEQ ID NO: 130968 - DNA, 22 bp, Artificial Sequence
  Synthetic oligonucleotide; CTT chr11 5299740 5299761 5299745 5299740 -
tcatatttattttacatctgga

SEQ ID NO: 130969 - DNA, 22 bp, Artificial Sequence
  Synthetic oligonucleotide; TTT chr11 5299739 5299760 5299744 5299739 -
catatttattttacatctggac

SEQ ID NO: 130970 - DNA, 22 bp, Artificial Sequence
  Synthetic oligonucleotide; TTC chr11 5299738 5299759 5299743 5299738 -
atatttattttacatctggaca

SEQ ID NO: 130971 - DNA, 22 bp, Artificial Sequence
  Synthetic oligonucleotide; TTT chr11 5299732 5299753 5299737 5299732 -
attttacatctggacagtgagc

SEQ ID NO: 130972 - DNA, 22 bp, Artificial Sequence
  Synthetic oligonucleotide; TTA chr11 5299731 5299752 5299736 5299731 -
ttttacatctggacagtgagca

SEQ ID NO: 130973 - DNA, 22 bp, Artificial Sequence
  Synthetic oligonucleotide; TTT chr11 5299728 5299749 5299733 5299728 -
tacatctggacagtgagcactc

SEQ ID NO: 130974 - DNA, 22 bp, Artificial Sequence
  Synthetic oligonucleotide; TTT chr11 5299727 5299748 5299732 5299727 -
acatctggacagtgagcactct

SEQ ID NO: 130975 - DNA, 22 bp, Artificial Sequence
  Synthetic oligonucleotide; TTA chr11 5299726 5299747 5299731 5299726 -
catctggacagtgagcactctg

SEQ ID NO: 130976 - DNA, 22 bp, Artificial Sequence
  Synthetic oligonucleotide; CTG chr11 5299720 5299741 5299725 5299720 -
gacagtgagcactctgaaaata

SEQ ID NO: 130977 - DNA, 22 bp, Artificial Sequence
  Synthetic oligonucleotide; CTC chr11 5299706 5299727 5299711 5299706 -
tgaaaatattccagagatttga

SEQ ID NO: 130978 - DNA, 22 bp, Artificial Sequence
  Synthetic oligonucleotide; CTG chr11 5299704 5299725 5299709 5299704 -
aaaatattccagagatttgata

SEQ ID NO: 130979 - DNA, 22 bp, Artificial Sequence
  Synthetic oligonucleotide; TTC chr11 5299695 5299716 5299700 5299695 -
cagagatttgataagaaaatac

SEQ ID NO: 130980 - DNA, 22 bp, Artificial Sequence
  Synthetic oligonucleotide; TTT chr11 5299686 5299707 5299691 5299686 -
gataagaaaatacttactgaaa

SEQ ID NO: 130981 - DNA, 22 bp, Artificial Sequence
  Synthetic oligonucleotide; TTG chr11 5299685 5299706 5299690 5299685 -
ataagaaaatacttactgaaaa

SEQ ID NO: 130982 - DNA, 22 bp, Artificial Sequence
  Synthetic oligonucleotide; CTT chr11 5299671 5299692 5299676 5299671 -
actgaaaactaaagctaaataa

SEQ ID NO: 130983 - DNA, 22 bp, Artificial Sequence
  Synthetic oligonucleotide; TTA chr11 5299670 5299691 5299675 5299670 -
ctgaaaactaaagctaaataat

SEQ ID NO: 130984 - DNA, 22 bp, Artificial Sequence
  Synthetic oligonucleotide; CTG chr11 5299667 5299688 5299672 5299667 -
aaaactaaagctaaataatgca

SEQ ID NO: 130985 - DNA, 22 bp, Artificial Sequence
  Synthetic oligonucleotide; CTA chr11 5299660 5299681 5299665 5299660 -
aagctaaataatgcagtatttc

SEQ ID NO: 130986 - DNA, 22 bp, Artificial Sequence
  Synthetic oligonucleotide; CTA chr11 5299654 5299675 5299659 5299654 -
aataatgcagtatttctccaaa

SEQ ID NO: 130987 - DNA, 22 bp, Artificial Sequence
  Synthetic oligonucleotide; TTT chr11 5299639 5299660 5299644 5299639 -
ctccaaattagaaggcccattt

SEQ ID NO: 130988 - DNA, 22 bp, Artificial Sequence
  Synthetic oligonucleotide; TTC chr11 5299638 5299659 5299643 5299638 -
tccaaattagaaggcccatttg

SEQ ID NO: 130989 - DNA, 22 bp, Artificial Sequence
  Synthetic oligonucleotide; CTC chr11 5299636 5299657 5299641 5299636 -
caaattagaaggcccatttgga

SEQ ID NO: 130990 - DNA, 22 bp, Artificial Sequence
  Synthetic oligonucleotide; TTA chr11 5299629 5299650 5299634 5299629 -
gaaggcccatttggatgcagga

SEQ ID NO: 130991 - DNA, 22 bp, Artificial Sequence
  Synthetic oligonucleotide; TTT chr11 5299617 5299638 5299622 5299617 -
ggatgcaggaaaaataaaaact

SEQ ID NO: 130992 - DNA, 22 bp, Artificial Sequence
  Synthetic oligonucleotide; TTG chr11 5299616 5299637 5299621 5299616 -
gatgcaggaaaaataaaaacta

SEQ ID NO: 130993 - DNA, 22 bp, Artificial Sequence
  Synthetic oligonucleotide; CTA chr11 5299594 5299615 5299599 5299594 -
ataaatgactactcctgaagga

SEQ ID NO: 130994 - DNA, 22 bp, Artificial Sequence
  Synthetic oligonucleotide; CTA chr11 5299583 5299604 5299588 5299583 -
ctcctgaaggattcagttattg

SEQ ID NO: 130995 - DNA, 22 bp, Artificial Sequence
  Synthetic oligonucleotide; CTC chr11 5299580 5299601 5299585 5299580 -
ctgaaggattcagttattgtgc

SEQ ID NO: 130996 - DNA, 22 bp, Artificial Sequence
  Synthetic oligonucleotide; CTG chr11 5299577 5299598 5299582 5299577 -
aaggattcagttattgtgcgaa

SEQ ID NO: 130997 - DNA, 22 bp, Artificial Sequence
  Synthetic oligonucleotide; TTC chr11 5299569 5299590 5299574 5299569 -
agttattgtgcgaattgtttgt

SEQ ID NO: 130998 - DNA, 22 bp, Artificial Sequence
  Synthetic oligonucleotide; TTA chr11 5299564 5299585 5299569 5299564 -
ttgtgcgaattgtttgtgagag

SEQ ID NO: 130999 - DNA, 22 bp, Artificial Sequence
  Synthetic oligonucleotide; TTG chr11 5299561 5299582 5299566 5299561 -
tgcgaattgtttgtgagagttc

SEQ ID NO: 131000 - DNA, 22 bp, Artificial Sequence
  Synthetic oligonucleotide; TTG chr11 5299552 5299573 5299557 5299552 -
tttgtgagagttctttgaaagt

SEQ ID NO: 131001 - DNA, 22 bp, Artificial Sequence
  Synthetic oligonucleotide; TTT chr11 5299549 5299570 5299554 5299549 -
gtgagagttctttgaaagtagg

SEQ ID NO: 131002 - DNA, 22 bp, Artificial Sequence
  Synthetic oligonucleotide; TTG chr11 5299548 5299569 5299553 5299548 -
tgagagttctttgaaagtagga

SEQ ID NO: 131003 - DNA, 22 bp, Artificial Sequence
  Synthetic oligonucleotide; TTC chr11 5299539 5299560 5299544 5299539 -
tttgaaagtaggacgtgggggg

SEQ ID NO: 131004 - DNA, 22 bp, Artificial Sequence
  Synthetic oligonucleotide; CTT chr11 5299537 5299558 5299542 5299537 -
tgaaagtaggacgtggggggtt

SEQ ID NO: 131005 - DNA, 22 bp, Artificial Sequence
  Synthetic oligonucleotide; TTT chr11 5299536 5299557 5299541 5299536 -
gaaagtaggacgtggggggttt

SEQ ID NO: 131006 - DNA, 22 bp, Artificial Sequence
  Synthetic oligonucleotide; TTG chr11 5299535 5299556 5299540 5299535 -
aaagtaggacgtggggggttta

SEQ ID NO: 131007 - DNA, 22 bp, Artificial Sequence
  Synthetic oligonucleotide; TTT chr11 5299514 5299535 5299519 5299514 -
attcattgtcattttagttgtt

SEQ ID NO: 131008 - DNA, 22 bp, Artificial Sequence
  Synthetic oligonucleotide; TTA chr11 5299513 5299534 5299518 5299513 -
ttcattgtcattttagttgtta

SEQ ID NO: 131009 - DNA, 22 bp, Artificial Sequence
  Synthetic oligonucleotide; TTC chr11 5299510 5299531 5299515 5299510 -
attgtcattttagttgttattc

SEQ ID NO: 131010 - DNA, 22 bp, Artificial Sequence
  Synthetic oligonucleotide; TTG chr11 5299506 5299527 5299511 5299506 -
tcattttagttgttattctctg

SEQ ID NO: 131011 - DNA, 22 bp, Artificial Sequence
  Synthetic oligonucleotide; TTT chr11 5299500 5299521 5299505 5299500 -
tagttgttattctctgtgtaaa

SEQ ID NO: 131012 - DNA, 22 bp, Artificial Sequence
  Synthetic oligonucleotide; TTT chr11 5299499 5299520 5299504 5299499 -
agttgttattctctgtgtaaaa

SEQ ID NO: 131013 - DNA, 22 bp, Artificial Sequence
  Synthetic oligonucleotide; TTA chr11 5299498 5299519 5299503 5299498 -
gttgttattctctgtgtaaaat

SEQ ID NO: 131014 - DNA, 22 bp, Artificial Sequence
  Synthetic oligonucleotide; TTG chr11 5299494 5299515 5299499 5299494 -
ttattctctgtgtaaaatttat

SEQ ID NO: 131015 - DNA, 22 bp, Artificial Sequence
  Synthetic oligonucleotide; TTA chr11 5299491 5299512 5299496 5299491 -
ttctctgtgtaaaatttattta

SEQ ID NO: 131016 - DNA, 22 bp, Artificial Sequence
  Synthetic oligonucleotide; TTC chr11 5299488 5299509 5299493 5299488 -
tctgtgtaaaatttatttattt

SEQ ID NO: 131017 - DNA, 22 bp, Artificial Sequence
  Synthetic oligonucleotide; CTC chr11 5299486 5299507 5299491 5299486 -
tgtgtaaaatttatttatttgt

SEQ ID NO: 131018 - DNA, 22 bp, Artificial Sequence
  Synthetic oligonucleotide; CTG chr11 5299484 5299505 5299489 5299484 -
tgtaaaatttatttatttgttt

SEQ ID NO: 131019 - DNA, 22 bp, Artificial Sequence
  Synthetic oligonucleotide; TTT chr11 5299474 5299495 5299479 5299474 -
atttatttgtttttccaaagtt

SEQ ID NO: 131020 - DNA, 22 bp, Artificial Sequence
  Synthetic oligonucleotide; TTA chr11 5299473 5299494 5299478 5299473 -
tttatttgtttttccaaagttg

SEQ ID NO: 131021 - DNA, 22 bp, Artificial Sequence
  Synthetic oligonucleotide; TTT chr11 5299470 5299491 5299475 5299470 -
atttgtttttccaaagttggca

SEQ ID NO: 131022 - DNA, 22 bp, Artificial Sequence
  Synthetic oligonucleotide; TTA chr11 5299469 5299490 5299474 5299469 -
tttgtttttccaaagttggcat

SEQ ID NO: 131023 - DNA, 22 bp, Artificial Sequence
  Synthetic oligonucleotide; TTT chr11 5299466 5299487 5299471 5299466 -
gtttttccaaagttggcataca

SEQ ID NO: 131024 - DNA, 22 bp, Artificial Sequence
  Synthetic oligonucleotide; TTG chr11 5299465 5299486 5299470 5299465 -
tttttccaaagttggcatacag

SEQ ID NO: 131025 - DNA, 22 bp, Artificial Sequence
  Synthetic oligonucleotide; TTT chr11 5299462 5299483 5299467 5299462 -
ttccaaagttggcatacagagt

SEQ ID NO: 131026 - DNA, 22 bp, Artificial Sequence
  Synthetic oligonucleotide; TTT chr11 5299461 5299482 5299466 5299461 -
tccaaagttggcatacagagtt

SEQ ID NO: 131027 - DNA, 22 bp, Artificial Sequence
  Synthetic oligonucleotide; TTT chr11 5299460 5299481 5299465 5299460 -
ccaaagttggcatacagagttt

SEQ ID NO: 131028 - DNA, 22 bp, Artificial Sequence
  Synthetic oligonucleotide; TTC chr11 5299459 5299480 5299464 5299459 -
caaagttggcatacagagttta

SEQ ID NO: 131029 - DNA, 22 bp, Artificial Sequence
  Synthetic oligonucleotide; TTG chr11 5299451 5299472 5299456 5299451 -
gcatacagagtttattctattt

SEQ ID NO: 131030 - DNA, 22 bp, Artificial Sequence
  Synthetic oligonucleotide; TTT chr11 5299438 5299459 5299443 5299438 -
attctatttagaaacgtcgttt

SEQ ID NO: 131031 - DNA, 22 bp, Artificial Sequence
  Synthetic oligonucleotide; TTA chr11 5299437 5299458 5299442 5299437 -
ttctatttagaaacgtcgtttt

SEQ ID NO: 131032 - DNA, 22 bp, Artificial Sequence
  Synthetic oligonucleotide; TTC chr11 5299434 5299455 5299439 5299434 -
tatttagaaacgtcgttttctg

SEQ ID NO: 131033 - DNA, 22 bp, Artificial Sequence
  Synthetic oligonucleotide; CTA chr11 5299432 5299453 5299437 5299432 -
tttagaaacgtcgttttctggt

SEQ ID NO: 131034 - DNA, 22 bp, Artificial Sequence
  Synthetic oligonucleotide; TTT chr11 5299429 5299450 5299434 5299429 -
agaaacgtcgttttctggttgc

SEQ ID NO: 131035 - DNA, 22 bp, Artificial Sequence
  Synthetic oligonucleotide; TTA chr11 5299428 5299449 5299433 5299428 -
gaaacgtcgttttctggttgcc

SEQ ID NO: 131036 - DNA, 22 bp, Artificial Sequence
  Synthetic oligonucleotide; TTT chr11 5299416 5299437 5299421 5299416 -
tctggttgcctttgttgtttgg

SEQ ID NO: 131037 - DNA, 22 bp, Artificial Sequence
  Synthetic oligonucleotide; TTT chr11 5299415 5299436 5299420 5299415 -
ctggttgcctttgttgtttggt

SEQ ID NO: 131038 - DNA, 22 bp, Artificial Sequence
  Synthetic oligonucleotide; TTC chr11 5299414 5299435 5299419 5299414 -
tggttgcctttgttgtttggtc

SEQ ID NO: 131039 - DNA, 22 bp, Artificial Sequence
  Synthetic oligonucleotide; CTG chr11 5299412 5299433 5299417 5299412 -
gttgcctttgttgtttggtcta

SEQ ID NO: 131040 - DNA, 22 bp, Artificial Sequence
  Synthetic oligonucleotide; TTG chr11 5299408 5299429 5299413 5299408 -
cctttgttgtttggtctaaaat

SEQ ID NO: 131041 - DNA, 22 bp, Artificial Sequence
  Synthetic oligonucleotide; CTT chr11 5299404 5299425 5299409 5299404 -
tgttgtttggtctaaaatgcac

SEQ ID NO: 131042 - DNA, 22 bp, Artificial Sequence
  Synthetic oligonucleotide; TTT chr11 5299403 5299424 5299408 5299403 -
gttgtttggtctaaaatgcaca

SEQ ID NO: 131043 - DNA, 22 bp, Artificial Sequence
  Synthetic oligonucleotide; TTG chr11 5299402 5299423 5299407 5299402 -
ttgtttggtctaaaatgcacat

SEQ ID NO: 131044 - DNA, 22 bp, Artificial Sequence
  Synthetic oligonucleotide; TTG chr11 5299399 5299420 5299404 5299399 -
tttggtctaaaatgcacattgt

SEQ ID NO: 131045 - DNA, 22 bp, Artificial Sequence
  Synthetic oligonucleotide; TTT chr11 5299396 5299417 5299401 5299396 -
ggtctaaaatgcacattgtgct

SEQ ID NO: 131046 - DNA, 22 bp, Artificial Sequence
  Synthetic oligonucleotide; TTG chr11 5299395 5299416 5299400 5299395 -
gtctaaaatgcacattgtgcta

SEQ ID NO: 131047 - DNA, 22 bp, Artificial Sequence
  Synthetic oligonucleotide; CTA chr11 5299390 5299411 5299395 5299390 -
aaatgcacattgtgctaacata

SEQ ID NO: 131048 - DNA, 22 bp, Artificial Sequence
  Synthetic oligonucleotide; TTG chr11 5299378 5299399 5299383 5299378 -
tgctaacatacaaactacattt

SEQ ID NO: 131049 - DNA, 22 bp, Artificial Sequence
  Synthetic oligonucleotide; CTA chr11 5299373 5299394 5299378 5299373 -
acatacaaactacatttaggaa

SEQ ID NO: 131050 - DNA, 22 bp, Artificial Sequence
  Synthetic oligonucleotide; CTA chr11 5299361 5299382 5299366 5299361 -
catttaggaaagctgcatctct

SEQ ID NO: 131051 - DNA, 22 bp, Artificial Sequence
  Synthetic oligonucleotide; TTT chr11 5299356 5299377 5299361 5299356 -
aggaaagctgcatctctattga

SEQ ID NO: 131052 - DNA, 22 bp, Artificial Sequence
  Synthetic oligonucleotide; TTA chr11 5299355 5299376 5299360 5299355 -
ggaaagctgcatctctattgac

SEQ ID NO: 131053 - DNA, 22 bp, Artificial Sequence
  Synthetic oligonucleotide; CTG chr11 5299346 5299367 5299351 5299346 -
catctctattgaccactgaaag

SEQ ID NO: 131054 - DNA, 22 bp, Artificial Sequence
  Synthetic oligonucleotide; CTC chr11 5299340 5299361 5299345 5299340 -
tattgaccactgaaaggatgtc

SEQ ID NO: 131055 - DNA, 22 bp, Artificial Sequence
  Synthetic oligonucleotide; CTA chr11 5299338 5299359 5299343 5299338 -
ttgaccactgaaaggatgtctg

SEQ ID NO: 131056 - DNA, 22 bp, Artificial Sequence
  Synthetic oligonucleotide; TTG chr11 5299335 5299356 5299340 5299335 -
accactgaaaggatgtctgtaa

SEQ ID NO: 131057 - DNA, 22 bp, Artificial Sequence
  Synthetic oligonucleotide; CTG chr11 5299328 5299349 5299333 5299328 -
aaaggatgtctgtaagagtaaa

SEQ ID NO: 131058 - DNA, 22 bp, Artificial Sequence
  Synthetic oligonucleotide; CTG chr11 5299316 5299337 5299321 5299316 -
taagagtaaaaaacatagcggt

SEQ ID NO: 131059 - DNA, 22 bp, Artificial Sequence
  Synthetic oligonucleotide; TTA chr11 5299290 5299311 5299295 5299290 -
aaattttcaggcgaataagggt

SEQ ID NO: 131060 - DNA, 22 bp, Artificial Sequence
  Synthetic oligonucleotide; TTT chr11 5299284 5299305 5299289 5299284 -
tcaggcgaataagggttttttg

SEQ ID NO: 131061 - DNA, 22 bp, Artificial Sequence
  Synthetic oligonucleotide; TTT chr11 5299283 5299304 5299288 5299283 -
caggcgaataagggttttttgt

SEQ ID NO: 131062 - DNA, 22 bp, Artificial Sequence
  Synthetic oligonucleotide; TTC chr11 5299282 5299303 5299287 5299282 -
aggcgaataagggttttttgta

SEQ ID NO: 131063 - DNA, 22 bp, Artificial Sequence
  Synthetic oligonucleotide; TTT chr11 5299266 5299287 5299271 5299266 -
tttgtaaaaatggcaaatgtat

SEQ ID NO: 131064 - DNA, 22 bp, Artificial Sequence
  Synthetic oligonucleotide; TTT chr11 5299265 5299286 5299270 5299265 -
ttgtaaaaatggcaaatgtatt

SEQ ID NO: 131065 - DNA, 22 bp, Artificial Sequence
  Synthetic oligonucleotide; TTT chr11 5299264 5299285 5299269 5299264 -
tgtaaaaatggcaaatgtattt

SEQ ID NO: 131066 - DNA, 22 bp, Artificial Sequence
  Synthetic oligonucleotide; TTT chr11 5299263 5299284 5299268 5299263 -
gtaaaaatggcaaatgtatttg

SEQ ID NO: 131067 - DNA, 22 bp, Artificial Sequence
  Synthetic oligonucleotide; TTG chr11 5299262 5299283 5299267 5299262 -
taaaaatggcaaatgtatttgt

SEQ ID NO: 131068 - DNA, 22 bp, Artificial Sequence
  Synthetic oligonucleotide; TTT chr11 5299242 5299263 5299247 5299242 -
gtcagtaggggattgcgatgct

SEQ ID NO: 131069 - DNA, 22 bp, Artificial Sequence
  Synthetic oligonucleotide; TTG chr11 5299241 5299262 5299246 5299241 -
tcagtaggggattgcgatgctg

SEQ ID NO: 131070 - DNA, 22 bp, Artificial Sequence
  Synthetic oligonucleotide; TTG chr11 5299227 5299248 5299232 5299227 -
cgatgctgttttcttgattgtt

SEQ ID NO: 131071 - DNA, 22 bp, Artificial Sequence
  Synthetic oligonucleotide; CTG chr11 5299219 5299240 5299224 5299219 -
ttttcttgattgttataagaag

SEQ ID NO: 131072 - DNA, 22 bp, Artificial Sequence
  Synthetic oligonucleotide; TTT chr11 5299216 5299237 5299221 5299216 -
tcttgattgttataagaagaca

SEQ ID NO: 131073 - DNA, 22 bp, Artificial Sequence
  Synthetic oligonucleotide; TTT chr11 5299215 5299236 5299220 5299215 -
cttgattgttataagaagacag

SEQ ID NO: 131074 - DNA, 22 bp, Artificial Sequence
  Synthetic oligonucleotide; TTC chr11 5299214 5299235 5299219 5299214 -
ttgattgttataagaagacagc

SEQ ID NO: 131075 - DNA, 22 bp, Artificial Sequence
  Synthetic oligonucleotide; CTT chr11 5299212 5299233 5299217 5299212 -
gattgttataagaagacagcct

SEQ ID NO: 131076 - DNA, 22 bp, Artificial Sequence
  Synthetic oligonucleotide; TTG chr11 5299211 5299232 5299216 5299211 -
attgttataagaagacagccta

SEQ ID NO: 131077 - DNA, 22 bp, Artificial Sequence
  Synthetic oligonucleotide; TTG chr11 5299207 5299228 5299212 5299207 -
ttataagaagacagcctacaac

SEQ ID NO: 131078 - DNA, 22 bp, Artificial Sequence
  Synthetic oligonucleotide; TTA chr11 5299204 5299225 5299209 5299204 -
taagaagacagcctacaacaat

SEQ ID NO: 131079 - DNA, 22 bp, Artificial Sequence
  Synthetic oligonucleotide; CTA chr11 5299189 5299210 5299194 5299189 -
caacaatgtgtaaatgtgtaat

SEQ ID NO: 131080 - DNA, 22 bp, Artificial Sequence
  Synthetic oligonucleotide; CTT chr11 5299159 5299180 5299164 5299159 -
aggggcgatgtgctgaaaataa

SEQ ID NO: 131081 - DNA, 22 bp, Artificial Sequence
  Synthetic oligonucleotide; TTA chr11 5299158 5299179 5299163 5299158 -
ggggcgatgtgctgaaaataag

SEQ ID NO: 131082 - DNA, 22 bp, Artificial Sequence
  Synthetic oligonucleotide; CTG chr11 5299144 5299165 5299149 5299144 -
aaaataaggtatgatagcgaag

SEQ ID NO: 131083 - DNA, 22 bp, Artificial Sequence
  Synthetic oligonucleotide; CTA chr11 5299118 5299139 5299123 5299118 -
agaaacagaggtatctaattat

SEQ ID NO: 131084 - DNA, 22 bp, Artificial Sequence
  Synthetic oligonucleotide; CTA chr11 5299101 5299122 5299106 5299101 -
attataaataagaagaagtggg

SEQ ID NO: 131085 - DNA, 22 bp, Artificial Sequence
  Synthetic oligonucleotide; TTA chr11 5299097 5299118 5299102 5299097 -
taaataagaagaagtgggaaga

SEQ ID NO: 131086 - DNA, 22 bp, Artificial Sequence
  Synthetic oligonucleotide; TTG chr11 5299067 5299088 5299072 5299067 -
agagctcaagtttactcatatg

SEQ ID NO: 131087 - DNA, 22 bp, Artificial Sequence
  Synthetic oligonucleotide; CTC chr11 5299060 5299081 5299065 5299060 -
aagtttactcatatgttagcaa

SEQ ID NO: 131088 - DNA, 22 bp, Artificial Sequence
  Synthetic oligonucleotide; TTT chr11 5299054 5299075 5299059 5299054 -
actcatatgttagcaagggatg

SEQ ID NO: 131089 - DNA, 22 bp, Artificial Sequence
  Synthetic oligonucleotide; TTA chr11 5299053 5299074 5299058 5299053 -
ctcatatgttagcaagggatga

SEQ ID NO: 131090 - DNA, 22 bp, Artificial Sequence
  Synthetic oligonucleotide; CTC chr11 5299050 5299071 5299055 5299050 -
atatgttagcaagggatgacat

SEQ ID NO: 131091 - DNA, 22 bp, Artificial Sequence
  Synthetic oligonucleotide; TTA chr11 5299042 5299063 5299047 5299042 -
gcaagggatgacataatatgat

SEQ ID NO: 131092 - DNA, 22 bp, Artificial Sequence
  Synthetic oligonucleotide; TTA chr11 5299016 5299037 5299021 5299016 -
tagcctattgatctttaaacag

SEQ ID NO: 131093 - DNA, 22 bp, Artificial Sequence
  Synthetic oligonucleotide; CTA chr11 5299009 5299030 5299014 5299009 -
ttgatctttaaacagcctgtat

SEQ ID NO: 131094 - DNA, 22 bp, Artificial Sequence
  Synthetic oligonucleotide; TTG chr11 5299006 5299027 5299011 5299006 -
atctttaaacagcctgtatcaa

SEQ ID NO: 131095 - DNA, 22 bp, Artificial Sequence
  Synthetic oligonucleotide; CTT chr11 5299001 5299022 5299006 5299001 -
taaacagcctgtatcaatagtc

SEQ ID NO: 131096 - DNA, 22 bp, Artificial Sequence
  Synthetic oligonucleotide; TTT chr11 5299000 5299021 5299005 5299000 -
aaacagcctgtatcaatagtca

SEQ ID NO: 131097 - DNA, 22 bp, Artificial Sequence
  Synthetic oligonucleotide; TTA chr11 5298999 5299020 5299004 5298999 -
aacagcctgtatcaatagtcaa

SEQ ID NO: 131098 - DNA, 22 bp, Artificial Sequence
  Synthetic oligonucleotide; CTG chr11 5298990 5299011 5298995 5298990 -
tatcaatagtcaaaaatcaatt

SEQ ID NO: 131099 - DNA, 22 bp, Artificial Sequence
  Synthetic oligonucleotide; TTA chr11 5298967 5298988 5298972 5298967 -
aaaaggataaattttaaaaatc

SEQ ID NO: 131100 - DNA, 22 bp, Artificial Sequence
  Synthetic oligonucleotide; TTT chr11 5298953 5298974 5298958 5298953 -
taaaaatcactcattttcttaa

SEQ ID NO: 131101 - DNA, 22 bp, Artificial Sequence
  Synthetic oligonucleotide; TTT chr11 5298952 5298973 5298957 5298952 -
aaaaatcactcattttcttaag

SEQ ID NO: 131102 - DNA, 22 bp, Artificial Sequence
  Synthetic oligonucleotide; TTA chr11 5298951 5298972 5298956 5298951 -
aaaatcactcattttcttaagt

SEQ ID NO: 131103 - DNA, 22 bp, Artificial Sequence
  Synthetic oligonucleotide; CTC chr11 5298941 5298962 5298946 5298941 -
attttcttaagtaaatgtatat

SEQ ID NO: 131104 - DNA, 22 bp, Artificial Sequence
  Synthetic oligonucleotide; TTT chr11 5298937 5298958 5298942 5298937 -
tcttaagtaaatgtatatttat

SEQ ID NO: 131105 - DNA, 22 bp, Artificial Sequence
  Synthetic oligonucleotide; TTT chr11 5298936 5298957 5298941 5298936 -
cttaagtaaatgtatatttatg

SEQ ID NO: 131106 - DNA, 22 bp, Artificial Sequence
  Synthetic oligonucleotide; TTC chr11 5298935 5298956 5298940 5298935 -
ttaagtaaatgtatatttatgc

SEQ ID NO: 131107 - DNA, 22 bp, Artificial Sequence
  Synthetic oligonucleotide; CTT chr11 5298933 5298954 5298938 5298933 -
aagtaaatgtatatttatgcgt

SEQ ID NO: 131108 - DNA, 22 bp, Artificial Sequence
  Synthetic oligonucleotide; TTA chr11 5298932 5298953 5298937 5298932 -
agtaaatgtatatttatgcgtt

SEQ ID NO: 131109 - DNA, 22 bp, Artificial Sequence
  Synthetic oligonucleotide; TTT chr11 5298917 5298938 5298922 5298917 -
atgcgttttaattttaattata

SEQ ID NO: 131110 - DNA, 22 bp, Artificial Sequence
  Synthetic oligonucleotide; TTA chr11 5298916 5298937 5298921 5298916 -
tgcgttttaattttaattatat

SEQ ID NO: 131111 - DNA, 22 bp, Artificial Sequence
  Synthetic oligonucleotide; TTT chr11 5298909 5298930 5298914 5298909 -
taattttaattatattcataac

SEQ ID NO: 131112 - DNA, 22 bp, Artificial Sequence
  Synthetic oligonucleotide; TTT chr11 5298908 5298929 5298913 5298908 -
aattttaattatattcataacc

SEQ ID NO: 131113 - DNA, 22 bp, Artificial Sequence
  Synthetic oligonucleotide; TTA chr11 5298907 5298928 5298912 5298907 -
attttaattatattcataacct

SEQ ID NO: 131114 - DNA, 22 bp, Artificial Sequence
  Synthetic oligonucleotide; TTT chr11 5298903 5298924 5298908 5298903 -
taattatattcataacctatat

SEQ ID NO: 131115 - DNA, 22 bp, Artificial Sequence
  Synthetic oligonucleotide; TTT chr11 5298902 5298923 5298907 5298902 -
aattatattcataacctatata

SEQ ID NO: 131116 - DNA, 22 bp, Artificial Sequence
  Synthetic oligonucleotide; TTA chr11 5298901 5298922 5298906 5298901 -
attatattcataacctatatat

SEQ ID NO: 131117 - DNA, 22 bp, Artificial Sequence
  Synthetic oligonucleotide; TTA chr11 5298897 5298918 5298902 5298897 -
tattcataacctatatattata

SEQ ID NO: 131118 - DNA, 22 bp, Artificial Sequence
  Synthetic oligonucleotide; TTC chr11 5298892 5298913 5298897 5298892 -
ataacctatatattatatttta

SEQ ID NO: 131119 - DNA, 22 bp, Artificial Sequence
  Synthetic oligonucleotide; CTA chr11 5298884 5298905 5298889 5298884 -
tatattatattttacaacttct

SEQ ID NO: 131120 - DNA, 22 bp, Artificial Sequence
  Synthetic oligonucleotide; TTA chr11 5298877 5298898 5298882 5298877 -
tattttacaacttcttagtttg

SEQ ID NO: 131121 - DNA, 22 bp, Artificial Sequence
  Synthetic oligonucleotide; TTT chr11 5298872 5298893 5298877 5298872 -
tacaacttcttagtttgaaaat

SEQ ID NO: 131122 - DNA, 22 bp, Artificial Sequence
  Synthetic oligonucleotide; TTT chr11 5298871 5298892 5298876 5298871 -
acaacttcttagtttgaaaatc

SEQ ID NO: 131123 - DNA, 22 bp, Artificial Sequence
  Synthetic oligonucleotide; TTA chr11 5298870 5298891 5298875 5298870 -
caacttcttagtttgaaaatcc

SEQ ID NO: 131124 - DNA, 22 bp, Artificial Sequence
  Synthetic oligonucleotide; CTT chr11 5298864 5298885 5298869 5298864 -
cttagtttgaaaatcctttcaa

SEQ ID NO: 131125 - DNA, 22 bp, Artificial Sequence
  Synthetic oligonucleotide; TTC chr11 5298863 5298884 5298868 5298863 -
ttagtttgaaaatcctttcaat

SEQ ID NO: 131126 - DNA, 22 bp, Artificial Sequence
  Synthetic oligonucleotide; CTT chr11 5298861 5298882 5298866 5298861 -
agtttgaaaatcctttcaatta

SEQ ID NO: 131127 - DNA, 22 bp, Artificial Sequence
  Synthetic oligonucleotide; TTA chr11 5298860 5298881 5298865 5298860 -
gtttgaaaatcctttcaattat

SEQ ID NO: 131128 - DNA, 22 bp, Artificial Sequence
  Synthetic oligonucleotide; TTT chr11 5298856 5298877 5298861 5298856 -
gaaaatcctttcaattattaag

SEQ ID NO: 131129 - DNA, 22 bp, Artificial Sequence
  Synthetic oligonucleotide; TTG chr11 5298855 5298876 5298860 5298855 -
aaaatcctttcaattattaagt

SEQ ID NO: 131130 - DNA, 22 bp, Artificial Sequence
  Synthetic oligonucleotide; CTT chr11 5298846 5298867 5298851 5298846 -
tcaattattaagtcagcatcca

SEQ ID NO: 131131 - DNA, 22 bp, Artificial Sequence
  Synthetic oligonucleotide; TTT chr11 5298845 5298866 5298850 5298845 -
caattattaagtcagcatccac

SEQ ID NO: 131132 - DNA, 22 bp, Artificial Sequence
  Synthetic oligonucleotide; TTC chr11 5298844 5298865 5298849 5298844 -
aattattaagtcagcatccacc

SEQ ID NO: 131133 - DNA, 22 bp, Artificial Sequence
  Synthetic oligonucleotide; TTA chr11 5298839 5298860 5298844 5298839 -
ttaagtcagcatccacctgctg

SEQ ID NO: 131134 - DNA, 22 bp, Artificial Sequence
  Synthetic oligonucleotide; TTA chr11 5298836 5298857 5298841 5298836 -
agtcagcatccacctgctgatc

SEQ ID NO: 131135 - DNA, 22 bp, Artificial Sequence
  Synthetic oligonucleotide; CTG chr11 5298820 5298841 5298825 5298820 -
ctgatccagtgatatataagga

SEQ ID NO: 131136 - DNA, 22 bp, Artificial Sequence
  Synthetic oligonucleotide; CTG chr11 5298817 5298838 5298822 5298817 -
atccagtgatatataaggacat

SEQ ID NO: 131137 - DNA, 22 bp, Artificial Sequence
  Synthetic oligonucleotide; TTT chr11 5298793 5298814 5298798 5298793 -
attgcaccactgaagtaaaatc

SEQ ID NO: 131138 - DNA, 22 bp, Artificial Sequence
  Synthetic oligonucleotide; TTA chr11 5298792 5298813 5298797 5298792 -
ttgcaccactgaagtaaaatca

SEQ ID NO: 131139 - DNA, 22 bp, Artificial Sequence
  Synthetic oligonucleotide; TTG chr11 5298789 5298810 5298794 5298789 -
caccactgaagtaaaatcagtg

SEQ ID NO: 131140 - DNA, 22 bp, Artificial Sequence
  Synthetic oligonucleotide; CTG chr11 5298781 5298802 5298786 5298781 -
aagtaaaatcagtgtcctttca

SEQ ID NO: 131141 - DNA, 22 bp, Artificial Sequence
  Synthetic oligonucleotide; CTT chr11 5298762 5298783 5298767 5298762 -
tcaaacaagtgcagcttccaga

SEQ ID NO: 131142 - DNA, 22 bp, Artificial Sequence
  Synthetic oligonucleotide; TTT chr11 5298761 5298782 5298766 5298761 -
caaacaagtgcagcttccagac

SEQ ID NO: 131143 - DNA, 22 bp, Artificial Sequence
  Synthetic oligonucleotide; TTC chr11 5298760 5298781 5298765 5298760 -
aaacaagtgcagcttccagaca

SEQ ID NO: 131144 - DNA, 22 bp, Artificial Sequence
  Synthetic oligonucleotide; CTT chr11 5298745 5298766 5298750 5298745 -
ccagacaagtctcttagacctc

SEQ ID NO: 131145 - DNA, 22 bp, Artificial Sequence
  Synthetic oligonucleotide; TTC chr11 5298744 5298765 5298749 5298744 -
cagacaagtctcttagacctca

SEQ ID NO: 131146 - DNA, 22 bp, Artificial Sequence
  Synthetic oligonucleotide; CTC chr11 5298732 5298753 5298737 5298732 -
ttagacctcatcctcagtctca

SEQ ID NO: 131147 - DNA, 22 bp, Artificial Sequence
  Synthetic oligonucleotide; CTT chr11 5298730 5298751 5298735 5298730 -
agacctcatcctcagtctcacc

SEQ ID NO: 131148 - DNA, 22 bp, Artificial Sequence
  Synthetic oligonucleotide; TTA chr11 5298729 5298750 5298734 5298729 -
gacctcatcctcagtctcaccc

SEQ ID NO: 131149 - DNA, 22 bp, Artificial Sequence
  Synthetic oligonucleotide; CTC chr11 5298723 5298744 5298728 5298723 -
atcctcagtctcaccctgactg

SEQ ID NO: 131150 - DNA, 22 bp, Artificial Sequence
  Synthetic oligonucleotide; CTC chr11 5298717 5298738 5298722 5298717 -
agtctcaccctgactgacaagt

SEQ ID NO: 131151 - DNA, 22 bp, Artificial Sequence
  Synthetic oligonucleotide; CTC chr11 5298711 5298732 5298716 5298711 -
accctgactgacaagtttgcca

SEQ ID NO: 131152 - DNA, 22 bp, Artificial Sequence
  Synthetic oligonucleotide; CTG chr11 5298705 5298726 5298710 5298705 -
actgacaagtttgccatacttg

SEQ ID NO: 131153 - DNA, 22 bp, Artificial Sequence
  Synthetic oligonucleotide; CTG chr11 5298701 5298722 5298706 5298701 -
acaagtttgccatacttgagaa

SEQ ID NO: 131154 - DNA, 22 bp, Artificial Sequence
  Synthetic oligonucleotide; TTT chr11 5298693 5298714 5298698 5298693 -
gccatacttgagaaccttgtga

SEQ ID NO: 131155 - DNA, 22 bp, Artificial Sequence
  Synthetic oligonucleotide; TTG chr11 5298692 5298713 5298697 5298692 -
ccatacttgagaaccttgtgaa

SEQ ID NO: 131156 - DNA, 22 bp, Artificial Sequence
  Synthetic oligonucleotide; CTT chr11 5298684 5298705 5298689 5298684 -
gagaaccttgtgaagcaggcgt

SEQ ID NO: 131157 - DNA, 22 bp, Artificial Sequence
  Synthetic oligonucleotide; TTG chr11 5298683 5298704 5298688 5298683 -
agaaccttgtgaagcaggcgtt

SEQ ID NO: 131158 - DNA, 22 bp, Artificial Sequence
  Synthetic oligonucleotide; CTT chr11 5298675 5298696 5298680 5298675 -
gtgaagcaggcgttgtgtctat

SEQ ID NO: 131159 - DNA, 22 bp, Artificial Sequence
  Synthetic oligonucleotide; TTG chr11 5298674 5298695 5298679 5298674 -
tgaagcaggcgttgtgtctata

SEQ ID NO: 131160 - DNA, 22 bp, Artificial Sequence
  Synthetic oligonucleotide; TTG chr11 5298660 5298681 5298665 5298660 -
tgtctataagctctcttagaga

SEQ ID NO: 131161 - DNA, 22 bp, Artificial Sequence
  Synthetic oligonucleotide; CTA chr11 5298654 5298675 5298659 5298654 -
taagctctcttagagatctgct

SEQ ID NO: 131162 - DNA, 22 bp, Artificial Sequence
  Synthetic oligonucleotide; CTC chr11 5298647 5298668 5298652 5298647 -
tcttagagatctgctctgagga

SEQ ID NO: 131163 - DNA, 22 bp, Artificial Sequence
  Synthetic oligonucleotide; CTC chr11 5298645 5298666 5298650 5298645 -
ttagagatctgctctgaggaat

SEQ ID NO: 131164 - DNA, 22 bp, Artificial Sequence
  Synthetic oligonucleotide; CTT chr11 5298643 5298664 5298648 5298643 -
agagatctgctctgaggaatta

SEQ ID NO: 131165 - DNA, 22 bp, Artificial Sequence
  Synthetic oligonucleotide; TTA chr11 5298642 5298663 5298647 5298642 -
gagatctgctctgaggaattat

SEQ ID NO: 131166 - DNA, 22 bp, Artificial Sequence
  Synthetic oligonucleotide; CTG chr11 5298634 5298655 5298639 5298634 -
ctctgaggaattatcaagtcag

SEQ ID NO: 131167 - DNA, 22 bp, Artificial Sequence
  Synthetic oligonucleotide; CTC chr11 5298631 5298652 5298636 5298631 -
tgaggaattatcaagtcagcac

SEQ ID NO: 131168 - DNA, 22 bp, Artificial Sequence
  Synthetic oligonucleotide; CTG chr11 5298629 5298650 5298634 5298629 -
aggaattatcaagtcagcacag

SEQ ID NO: 131169 - DNA, 22 bp, Artificial Sequence
  Synthetic oligonucleotide; TTA chr11 5298621 5298642 5298626 5298621 -
tcaagtcagcacagttaattct

SEQ ID NO: 131170 - DNA, 22 bp, Artificial Sequence
  Synthetic oligonucleotide; TTA chr11 5298604 5298625 5298609 5298604 -
attctctgtcatactgtgagtt

SEQ ID NO: 131171 - DNA, 22 bp, Artificial Sequence
  Synthetic oligonucleotide; TTC chr11 5298600 5298621 5298605 5298600 -
tctgtcatactgtgagtttagt

SEQ ID NO: 131172 - DNA, 22 bp, Artificial Sequence
  Synthetic oligonucleotide; CTC chr11 5298598 5298619 5298603 5298598 -
tgtcatactgtgagtttagtca

SEQ ID NO: 131173 - DNA, 22 bp, Artificial Sequence
  Synthetic oligonucleotide; CTG chr11 5298596 5298617 5298601 5298596 -
tcatactgtgagtttagtcagg

SEQ ID NO: 131174 - DNA, 22 bp, Artificial Sequence
  Synthetic oligonucleotide; CTG chr11 5298588 5298609 5298593 5298588 -
tgagtttagtcagggcagtaat

SEQ ID NO: 131175 - DNA, 22 bp, Artificial Sequence
  Synthetic oligonucleotide; TTT chr11 5298581 5298602 5298586 5298581 -
agtcagggcagtaattatattt

SEQ ID NO: 131176 - DNA, 22 bp, Artificial Sequence
  Synthetic oligonucleotide; TTA chr11 5298580 5298601 5298585 5298580 -
gtcagggcagtaattatatttc

SEQ ID NO: 131177 - DNA, 22 bp, Artificial Sequence
  Synthetic oligonucleotide; TTA chr11 5298564 5298585 5298569 5298564 -
tatttccccatcagcatattgt

SEQ ID NO: 131178 - DNA, 22 bp, Artificial Sequence
  Synthetic oligonucleotide; TTT chr11 5298559 5298580 5298564 5298559 -
ccccatcagcatattgtcttcc

SEQ ID NO: 131179 - DNA, 22 bp, Artificial Sequence
  Synthetic oligonucleotide; TTC chr11 5298558 5298579 5298563 5298558 -
cccatcagcatattgtcttccc

SEQ ID NO: 131180 - DNA, 22 bp, Artificial Sequence
  Synthetic oligonucleotide; TTG chr11 5298543 5298564 5298548 5298543 -
tcttcccaaggataactacctg

SEQ ID NO: 131181 - DNA, 22 bp, Artificial Sequence
  Synthetic oligonucleotide; CTT chr11 5298539 5298560 5298544 5298539 -
cccaaggataactacctgccat

SEQ ID NO: 131182 - DNA, 22 bp, Artificial Sequence
  Synthetic oligonucleotide; TTC chr11 5298538 5298559 5298543 5298538 -
ccaaggataactacctgccatt

SEQ ID NO: 131183 - DNA, 22 bp, Artificial Sequence
  Synthetic oligonucleotide; CTA chr11 5298525 5298546 5298530 5298525 -
cctgccattctgtaaaccccca

SEQ ID NO: 131184 - DNA, 22 bp, Artificial Sequence
  Synthetic oligonucleotide; CTG chr11 5298521 5298542 5298526 5298521 -
ccattctgtaaacccccaaatt

SEQ ID NO: 131185 - DNA, 22 bp, Artificial Sequence
  Synthetic oligonucleotide; TTC chr11 5298515 5298536 5298520 5298515 -
tgtaaacccccaaatttattaa

SEQ ID NO: 131186 - DNA, 22 bp, Artificial Sequence
  Synthetic oligonucleotide; CTG chr11 5298513 5298534 5298518 5298513 -
taaacccccaaatttattaatg

SEQ ID NO: 131187 - DNA, 22 bp, Artificial Sequence
  Synthetic oligonucleotide; TTT chr11 5298498 5298519 5298503 5298498 -
attaatgcagtcctttaaaaat

SEQ ID NO: 131188 - DNA, 22 bp, Artificial Sequence
  Synthetic oligonucleotide; TTA chr11 5298497 5298518 5298502 5298497 -
ttaatgcagtcctttaaaaata

SEQ ID NO: 131189 - DNA, 22 bp, Artificial Sequence
  Synthetic oligonucleotide; TTA chr11 5298494 5298515 5298499 5298494 -
atgcagtcctttaaaaatacac

SEQ ID NO: 131190 - DNA, 22 bp, Artificial Sequence
  Synthetic oligonucleotide; CTT chr11 5298483 5298504 5298488 5298483 -
taaaaatacacaatgttacttg

SEQ ID NO: 131191 - DNA, 22 bp, Artificial Sequence
  Synthetic oligonucleotide; TTT chr11 5298482 5298503 5298487 5298482 -
aaaaatacacaatgttacttgt

SEQ ID NO: 131192 - DNA, 22 bp, Artificial Sequence
  Synthetic oligonucleotide; TTA chr11 5298481 5298502 5298486 5298481 -
aaaatacacaatgttacttgtc

SEQ ID NO: 131193 - DNA, 22 bp, Artificial Sequence
  Synthetic oligonucleotide; TTA chr11 5298465 5298486 5298470 5298465 -
cttgtctggtgtggctaaagct

SEQ ID NO: 131194 - DNA, 22 bp, Artificial Sequence
  Synthetic oligonucleotide; CTT chr11 5298462 5298483 5298467 5298462 -
gtctggtgtggctaaagcttat

SEQ ID NO: 131195 - DNA, 22 bp, Artificial Sequence
  Synthetic oligonucleotide; TTG chr11 5298461 5298482 5298466 5298461 -
tctggtgtggctaaagcttatt

SEQ ID NO: 131196 - DNA, 22 bp, Artificial Sequence
  Synthetic oligonucleotide; CTG chr11 5298457 5298478 5298462 5298457 -
gtgtggctaaagcttatttatt

SEQ ID NO: 131197 - DNA, 22 bp, Artificial Sequence
  Synthetic oligonucleotide; CTA chr11 5298448 5298469 5298453 5298448 -
aagcttatttatttatttattt

SEQ ID NO: 131198 - DNA, 22 bp, Artificial Sequence
  Synthetic oligonucleotide; CTT chr11 5298442 5298463 5298447 5298442 -
atttatttatttatttatttat

SEQ ID NO: 131199 - DNA, 22 bp, Artificial Sequence
  Synthetic oligonucleotide; TTA chr11 5298441 5298462 5298446 5298441 -
tttatttatttatttatttatt

SEQ ID NO: 131200 - DNA, 22 bp, Artificial Sequence
  Synthetic oligonucleotide; TTT chr11 5298438 5298459 5298443 5298438 -
atttatttatttatttattttt

SEQ ID NO: 131201 - DNA, 22 bp, Artificial Sequence
  Synthetic oligonucleotide; TTA chr11 5298437 5298458 5298442 5298437 -
tttatttatttatttattttta

SEQ ID NO: 131202 - DNA, 22 bp, Artificial Sequence
  Synthetic oligonucleotide; TTT chr11 5298434 5298455 5298439 5298434 -
atttatttatttatttttatag

SEQ ID NO: 131203 - DNA, 22 bp, Artificial Sequence
  Synthetic oligonucleotide; TTA chr11 5298433 5298454 5298438 5298433 -
tttatttatttatttttataga

SEQ ID NO: 131204 - DNA, 22 bp, Artificial Sequence
  Synthetic oligonucleotide; TTT chr11 5298430 5298451 5298435 5298430 -
atttatttatttttatagacat

SEQ ID NO: 131205 - DNA, 22 bp, Artificial Sequence
  Synthetic oligonucleotide; TTA chr11 5298429 5298450 5298434 5298429 -
tttatttatttttatagacatg

SEQ ID NO: 131206 - DNA, 22 bp, Artificial Sequence
  Synthetic oligonucleotide; TTT chr11 5298426 5298447 5298431 5298426 -
atttatttttatagacatgatc

SEQ ID NO: 131207 - DNA, 22 bp, Artificial Sequence
  Synthetic oligonucleotide; TTA chr11 5298425 5298446 5298430 5298425 -
tttatttttatagacatgatct

SEQ ID NO: 131208 - DNA, 22 bp, Artificial Sequence
  Synthetic oligonucleotide; TTT chr11 5298422 5298443 5298427 5298422 -
atttttatagacatgatcttgc

SEQ ID NO: 131209 - DNA, 22 bp, Artificial Sequence
  Synthetic oligonucleotide; TTA chr11 5298421 5298442 5298426 5298421 -
tttttatagacatgatcttgct

SEQ ID NO: 131210 - DNA, 22 bp, Artificial Sequence
  Synthetic oligonucleotide; TTT chr11 5298418 5298439 5298423 5298418 -
ttatagacatgatcttgctctg

SEQ ID NO: 131211 - DNA, 22 bp, Artificial Sequence
  Synthetic oligonucleotide; TTT chr11 5298417 5298438 5298422 5298417 -
tatagacatgatcttgctctgt

SEQ ID NO: 131212 - DNA, 22 bp, Artificial Sequence
  Synthetic oligonucleotide; TTT chr11 5298416 5298437 5298421 5298416 -
atagacatgatcttgctctgtt

SEQ ID NO: 131213 - DNA, 22 bp, Artificial Sequence
  Synthetic oligonucleotide; TTA chr11 5298415 5298436 5298420 5298415 -
tagacatgatcttgctctgttg

SEQ ID NO: 131214 - DNA, 22 bp, Artificial Sequence
  Synthetic oligonucleotide; CTT chr11 5298402 5298423 5298407 5298402 -
gctctgttgcccaggctggagt

SEQ ID NO: 131215 - DNA, 22 bp, Artificial Sequence
  Synthetic oligonucleotide; TTG chr11 5298401 5298422 5298406 5298401 -
ctctgttgcccaggctggagtg

SEQ ID NO: 131216 - DNA, 22 bp, Artificial Sequence
  Synthetic oligonucleotide; CTC chr11 5298398 5298419 5298403 5298398 -
tgttgcccaggctggagtgcag

SEQ ID NO: 131217 - DNA, 22 bp, Artificial Sequence
  Synthetic oligonucleotide; CTG chr11 5298396 5298417 5298401 5298396 -
ttgcccaggctggagtgcagtg

SEQ ID NO: 131218 - DNA, 22 bp, Artificial Sequence
  Synthetic oligonucleotide; TTG chr11 5298393 5298414 5298398 5298393 -
cccaggctggagtgcagtggtg

SEQ ID NO: 131219 - DNA, 22 bp, Artificial Sequence
  Synthetic oligonucleotide; CTG chr11 5298384 5298405 5298389 5298384 -
gagtgcagtggtgccatcacag

SEQ ID NO: 131220 - DNA, 22 bp, Artificial Sequence
  Synthetic oligonucleotide; CTC chr11 5298359 5298380 5298364 5298359 -
actgcagccttgaaatcctggg

SEQ ID NO: 131221 - DNA, 22 bp, Artificial Sequence
  Synthetic oligonucleotide; CTG chr11 5298355 5298376 5298360 5298355 -
cagccttgaaatcctgggctca

SEQ ID NO: 131222 - DNA, 22 bp, Artificial Sequence
  Synthetic oligonucleotide; CTT chr11 5298348 5298369 5298353 5298348 -
gaaatcctgggctcaagcaatc

SEQ ID NO: 131223 - DNA, 22 bp, Artificial Sequence
  Synthetic oligonucleotide; TTG chr11 5298347 5298368 5298352 5298347 -
aaatcctgggctcaagcaatcc

SEQ ID NO: 131224 - DNA, 22 bp, Artificial Sequence
  Synthetic oligonucleotide; CTG chr11 5298339 5298360 5298344 5298339 -
ggctcaagcaatccttcttcct

SEQ ID NO: 131225 - DNA, 22 bp, Artificial Sequence
  Synthetic oligonucleotide; CTC chr11 5298334 5298355 5298339 5298334 -
aagcaatccttcttcctcagct

SEQ ID NO: 131226 - DNA, 22 bp, Artificial Sequence
  Synthetic oligonucleotide; CTT chr11 5298323 5298344 5298328 5298323 -
cttcctcagctttttgagtacc

SEQ ID NO: 131227 - DNA, 22 bp, Artificial Sequence
  Synthetic oligonucleotide; TTC chr11 5298322 5298343 5298327 5298322 -
ttcctcagctttttgagtacct

SEQ ID NO: 131228 - DNA, 22 bp, Artificial Sequence
  Synthetic oligonucleotide; CTT chr11 5298320 5298341 5298325 5298320 -
cctcagctttttgagtacctag

SEQ ID NO: 131229 - DNA, 22 bp, Artificial Sequence
  Synthetic oligonucleotide; TTC chr11 5298319 5298340 5298324 5298319 -
ctcagctttttgagtacctagg

SEQ ID NO: 131230 - DNA, 22 bp, Artificial Sequence
  Synthetic oligonucleotide; CTC chr11 5298316 5298337 5298321 5298316 -
agctttttgagtacctaggact

SEQ ID NO: 131231 - DNA, 22 bp, Artificial Sequence
  Synthetic oligonucleotide; CTT chr11 5298311 5298332 5298316 5298311 -
tttgagtacctaggactacagg

SEQ ID NO: 131232 - DNA, 22 bp, Artificial Sequence
  Synthetic oligonucleotide; TTT chr11 5298310 5298331 5298315 5298310 -
ttgagtacctaggactacaggt

SEQ ID NO: 131233 - DNA, 22 bp, Artificial Sequence
  Synthetic oligonucleotide; TTT chr11 5298309 5298330 5298314 5298309 -
tgagtacctaggactacaggtt

SEQ ID NO: 131234 - DNA, 22 bp, Artificial Sequence
  Synthetic oligonucleotide; TTT chr11 5298308 5298329 5298313 5298308 -
gagtacctaggactacaggttt

SEQ ID NO: 131235 - DNA, 22 bp, Artificial Sequence
  Synthetic oligonucleotide; TTG chr11 5298307 5298328 5298312 5298307 -
agtacctaggactacaggttta

SEQ ID NO: 131236 - DNA, 22 bp, Artificial Sequence
  Synthetic oligonucleotide; CTA chr11 5298299 5298320 5298304 5298299 -
ggactacaggtttatgccactg

SEQ ID NO: 131237 - DNA, 22 bp, Artificial Sequence
  Synthetic oligonucleotide; CTA chr11 5298293 5298314 5298298 5298293 -
caggtttatgccactgcaccta

SEQ ID NO: 131238 - DNA, 22 bp, Artificial Sequence
  Synthetic oligonucleotide; TTT chr11 5298286 5298307 5298291 5298286 -
atgccactgcacctagctaatg

SEQ ID NO: 131239 - DNA, 22 bp, Artificial Sequence
  Synthetic oligonucleotide; TTA chr11 5298285 5298306 5298290 5298285 -
tgccactgcacctagctaatgt

SEQ ID NO: 131240 - DNA, 22 bp, Artificial Sequence
  Synthetic oligonucleotide; CTG chr11 5298277 5298298 5298282 5298277 -
cacctagctaatgtttttattt

SEQ ID NO: 131241 - DNA, 22 bp, Artificial Sequence
  Synthetic oligonucleotide; CTA chr11 5298271 5298292 5298276 5298271 -
gctaatgtttttattttttgta

SEQ ID NO: 131242 - DNA, 22 bp, Artificial Sequence
  Synthetic oligonucleotide; CTA chr11 5298267 5298288 5298272 5298267 -
atgtttttattttttgtaaata

SEQ ID NO: 131243 - DNA, 22 bp, Artificial Sequence
  Synthetic oligonucleotide; TTT chr11 5298261 5298282 5298266 5298261 -
ttattttttgtaaatatgggat

SEQ ID NO: 131244 - DNA, 22 bp, Artificial Sequence
  Synthetic oligonucleotide; TTT chr11 5298260 5298281 5298265 5298260 -
tattttttgtaaatatgggatc

SEQ ID NO: 131245 - DNA, 22 bp, Artificial Sequence
  Synthetic oligonucleotide; TTT chr11 5298259 5298280 5298264 5298259 -
attttttgtaaatatgggatca

SEQ ID NO: 131246 - DNA, 22 bp, Artificial Sequence
  Synthetic oligonucleotide; TTA chr11 5298258 5298279 5298263 5298258 -
ttttttgtaaatatgggatcat

SEQ ID NO: 131247 - DNA, 22 bp, Artificial Sequence
  Synthetic oligonucleotide; TTT chr11 5298255 5298276 5298260 5298255 -
tttgtaaatatgggatcatgtt

SEQ ID NO: 131248 - DNA, 22 bp, Artificial Sequence
  Synthetic oligonucleotide; TTT chr11 5298254 5298275 5298259 5298254 -
ttgtaaatatgggatcatgtta

SEQ ID NO: 131249 - DNA, 22 bp, Artificial Sequence
  Synthetic oligonucleotide; TTT chr11 5298253 5298274 5298258 5298253 -
tgtaaatatgggatcatgttat

SEQ ID NO: 131250 - DNA, 22 bp, Artificial Sequence
  Synthetic oligonucleotide; TTT chr11 5298252 5298273 5298257 5298252 -
gtaaatatgggatcatgttatg

SEQ ID NO: 131251 - DNA, 22 bp, Artificial Sequence
  Synthetic oligonucleotide; TTG chr11 5298251 5298272 5298256 5298251 -
taaatatgggatcatgttatgt

SEQ ID NO: 131252 - DNA, 22 bp, Artificial Sequence
  Synthetic oligonucleotide; TTA chr11 5298232 5298253 5298237 5298232 -
tgttgccgaggctgctctccaa

SEQ ID NO: 131253 - DNA, 22 bp, Artificial Sequence
  Synthetic oligonucleotide; TTG chr11 5298227 5298248 5298232 5298227 -
ccgaggctgctctccaattcct

SEQ ID NO: 131254 - DNA, 22 bp, Artificial Sequence
  Synthetic oligonucleotide; CTG chr11 5298218 5298239 5298223 5298218 -
ctctccaattcctaacctcaag

SEQ ID NO: 131255 - DNA, 22 bp, Artificial Sequence
  Synthetic oligonucleotide; CTC chr11 5298215 5298236 5298220 5298215 -
tccaattcctaacctcaagcaa

SEQ ID NO: 131256 - DNA, 22 bp, Artificial Sequence
  Synthetic oligonucleotide; CTC chr11 5298213 5298234 5298218 5298213 -
caattcctaacctcaagcaatc

SEQ ID NO: 131257 - DNA, 22 bp, Artificial Sequence
  Synthetic oligonucleotide; TTC chr11 5298207 5298228 5298212 5298207 -
ctaacctcaagcaatcctccca

SEQ ID NO: 131258 - DNA, 22 bp, Artificial Sequence
  Synthetic oligonucleotide; CTA chr11 5298204 5298225 5298209 5298204 -
acctcaagcaatcctcccaccc

SEQ ID NO: 131259 - DNA, 22 bp, Artificial Sequence
  Synthetic oligonucleotide; CTC chr11 5298199 5298220 5298204 5298199 -
aagcaatcctcccaccctggcc

SEQ ID NO: 131260 - DNA, 22 bp, Artificial Sequence
  Synthetic oligonucleotide; CTC chr11 5298188 5298209 5298193 5298188 -
ccaccctggcctcctaatgata

SEQ ID NO: 131261 - DNA, 22 bp, Artificial Sequence
  Synthetic oligonucleotide; CTG chr11 5298180 5298201 5298185 5298180 -
gcctcctaatgatagggacagg

SEQ ID NO: 131262 - DNA, 22 bp, Artificial Sequence
  Synthetic oligonucleotide; CTC chr11 5298175 5298196 5298180 5298175 -
ctaatgatagggacaggaggca

SEQ ID NO: 131263 - DNA, 22 bp, Artificial Sequence
  Synthetic oligonucleotide; CTA chr11 5298172 5298193 5298177 5298172 -
atgatagggacaggaggcagag

SEQ ID NO: 131264 - DNA, 22 bp, Artificial Sequence
  Synthetic oligonucleotide; TTT chr11 5298144 5298165 5298149 5298144 -
taggcagaaaagggcggggtcc

SEQ ID NO: 131265 - DNA, 22 bp, Artificial Sequence
  Synthetic oligonucleotide; TTT chr11 5298143 5298164 5298148 5298143 -
aggcagaaaagggcggggtccc

SEQ ID NO: 131266 - DNA, 22 bp, Artificial Sequence
  Synthetic oligonucleotide; TTA chr11 5298142 5298163 5298147 5298142 -
ggcagaaaagggcggggtccct

SEQ ID NO: 131267 - DNA, 22 bp, Artificial Sequence
  Synthetic oligonucleotide; CTG chr11 5298119 5298140 5298124 5298119 -
gcatgggtcctaccctgaagcc

SEQ ID NO: 131268 - DNA, 22 bp, Artificial Sequence
  Synthetic oligonucleotide; CTA chr11 5298107 5298128 5298112 5298107 -
ccctgaagcctggaacatggcc

SEQ ID NO: 131269 - DNA, 22 bp, Artificial Sequence
  Synthetic oligonucleotide; CTG chr11 5298102 5298123 5298107 5298102 -
aagcctggaacatggccattcc

SEQ ID NO: 131270 - DNA, 22 bp, Artificial Sequence
  Synthetic oligonucleotide; CTG chr11 5298095 5298116 5298100 5298095 -
gaacatggccattcctgagata

SEQ ID NO: 131271 - DNA, 22 bp, Artificial Sequence
  Synthetic oligonucleotide; TTC chr11 5298081 5298102 5298086 5298081 -
ctgagatatttctctcagccag

SEQ ID NO: 131272 - DNA, 22 bp, Artificial Sequence
  Synthetic oligonucleotide; CTG chr11 5298078 5298099 5298083 5298078 -
agatatttctctcagccagaac

SEQ ID NO: 131273 - DNA, 22 bp, Artificial Sequence
  Synthetic oligonucleotide; TTT chr11 5298070 5298091 5298075 5298070 -
ctctcagccagaactgtttcac

SEQ ID NO: 131274 - DNA, 22 bp, Artificial Sequence
  Synthetic oligonucleotide; TTC chr11 5298069 5298090 5298074 5298069 -
tctcagccagaactgtttcaca

SEQ ID NO: 131275 - DNA, 22 bp, Artificial Sequence
  Synthetic oligonucleotide; CTC chr11 5298067 5298088 5298072 5298067 -
tcagccagaactgtttcacatt

SEQ ID NO: 131276 - DNA, 22 bp, Artificial Sequence
  Synthetic oligonucleotide; CTC chr11 5298065 5298086 5298070 5298065 -
agccagaactgtttcacattca

SEQ ID NO: 131277 - DNA, 22 bp, Artificial Sequence
  Synthetic oligonucleotide; CTG chr11 5298054 5298075 5298059 5298054 -
tttcacattcacattttaagtg

SEQ ID NO: 131278 - DNA, 22 bp, Artificial Sequence
  Synthetic oligonucleotide; TTT chr11 5298051 5298072 5298056 5298051 -
cacattcacattttaagtgcca

SEQ ID NO: 131279 - DNA, 22 bp, Artificial Sequence
  Synthetic oligonucleotide; TTC chr11 5298050 5298071 5298055 5298050 -
acattcacattttaagtgccag

SEQ ID NO: 131280 - DNA, 22 bp, Artificial Sequence
  Synthetic oligonucleotide; TTC chr11 5298044 5298065 5298049 5298044 -
acattttaagtgccaggtcttt

SEQ ID NO: 131281 - DNA, 22 bp, Artificial Sequence
  Synthetic oligonucleotide; TTT chr11 5298038 5298059 5298043 5298038 -
taagtgccaggtctttctatct

SEQ ID NO: 131282 - DNA, 22 bp, Artificial Sequence
  Synthetic oligonucleotide; TTT chr11 5298037 5298058 5298042 5298037 -
aagtgccaggtctttctatctt

SEQ ID NO: 131283 - DNA, 22 bp, Artificial Sequence
  Synthetic oligonucleotide; TTA chr11 5298036 5298057 5298041 5298036 -
agtgccaggtctttctatcttt

SEQ ID NO: 131284 - DNA, 22 bp, Artificial Sequence
  Synthetic oligonucleotide; CTT chr11 5298023 5298044 5298028 5298023 -
tctatctttctagctgtcttat

SEQ ID NO: 131285 - DNA, 22 bp, Artificial Sequence
  Synthetic oligonucleotide; TTT chr11 5298022 5298043 5298027 5298022 -
ctatctttctagctgtcttatt

SEQ ID NO: 131286 - DNA, 22 bp, Artificial Sequence
  Synthetic oligonucleotide; TTC chr11 5298021 5298042 5298026 5298021 -
tatctttctagctgtcttattc

SEQ ID NO: 131287 - DNA, 22 bp, Artificial Sequence
  Synthetic oligonucleotide; CTA chr11 5298019 5298040 5298024 5298019 -
tctttctagctgtcttattcat

SEQ ID NO: 131288 - DNA, 22 bp, Artificial Sequence
  Synthetic oligonucleotide; CTT chr11 5298015 5298036 5298020 5298015 -
tctagctgtcttattcatgcac

SEQ ID NO: 131289 - DNA, 22 bp, Artificial Sequence
  Synthetic oligonucleotide; TTT chr11 5298014 5298035 5298019 5298014 -
ctagctgtcttattcatgcact

SEQ ID NO: 131290 - DNA, 22 bp, Artificial Sequence
  Synthetic oligonucleotide; TTC chr11 5298013 5298034 5298018 5298013 -
tagctgtcttattcatgcactt

SEQ ID NO: 131291 - DNA, 22 bp, Artificial Sequence
  Synthetic oligonucleotide; CTA chr11 5298011 5298032 5298016 5298011 -
gctgtcttattcatgcactttc

SEQ ID NO: 131292 - DNA, 22 bp, Artificial Sequence
  Synthetic oligonucleotide; CTG chr11 5298007 5298028 5298012 5298007 -
tcttattcatgcactttctaga

SEQ ID NO: 131293 - DNA, 22 bp, Artificial Sequence
  Synthetic oligonucleotide; CTT chr11 5298003 5298024 5298008 5298003 -
attcatgcactttctagaaatc

SEQ ID NO: 131294 - DNA, 22 bp, Artificial Sequence
  Synthetic oligonucleotide; TTA chr11 5298002 5298023 5298007 5298002 -
ttcatgcactttctagaaatca

SEQ ID NO: 131295 - DNA, 22 bp, Artificial Sequence
  Synthetic oligonucleotide; TTC chr11 5297999 5298020 5298004 5297999 -
atgcactttctagaaatcactt

SEQ ID NO: 131296 - DNA, 22 bp, Artificial Sequence
  Synthetic oligonucleotide; CTT chr11 5297991 5298012 5297996 5297991 -
tctagaaatcacttgtatatta

SEQ ID NO: 131297 - DNA, 22 bp, Artificial Sequence
  Synthetic oligonucleotide; TTT chr11 5297990 5298011 5297995 5297990 -
ctagaaatcacttgtatattaa

SEQ ID NO: 131298 - DNA, 22 bp, Artificial Sequence
  Synthetic oligonucleotide; TTC chr11 5297989 5298010 5297994 5297989 -
tagaaatcacttgtatattaac

SEQ ID NO: 131299 - DNA, 22 bp, Artificial Sequence
  Synthetic oligonucleotide; CTA chr11 5297987 5298008 5297992 5297987 -
gaaatcacttgtatattaacat

SEQ ID NO: 131300 - DNA, 22 bp, Artificial Sequence
  Synthetic oligonucleotide; CTT chr11 5297977 5297998 5297982 5297977 -
gtatattaacatgcctatatta

SEQ ID NO: 131301 - DNA, 22 bp, Artificial Sequence
  Synthetic oligonucleotide; TTG chr11 5297976 5297997 5297981 5297976 -
tatattaacatgcctatattat

SEQ ID NO: 131302 - DNA, 22 bp, Artificial Sequence
  Synthetic oligonucleotide; TTA chr11 5297969 5297990 5297974 5297969 -
acatgcctatattatatttaca

SEQ ID NO: 131303 - DNA, 22 bp, Artificial Sequence
  Synthetic oligonucleotide; CTA chr11 5297960 5297981 5297965 5297960 -
tattatatttacattcccttca

SEQ ID NO: 131304 - DNA, 22 bp, Artificial Sequence
  Synthetic oligonucleotide; TTA chr11 5297955 5297976 5297960 5297955 -
tatttacattcccttcatttct

SEQ ID NO: 131305 - DNA, 22 bp, Artificial Sequence
  Synthetic oligonucleotide; TTT chr11 5297950 5297971 5297955 5297950 -
acattcccttcatttctttatt

SEQ ID NO: 131306 - DNA, 22 bp, Artificial Sequence
  Synthetic oligonucleotide; TTA chr11 5297949 5297970 5297954 5297949 -
cattcccttcatttctttattc

SEQ ID NO: 131307 - DNA, 22 bp, Artificial Sequence
  Synthetic oligonucleotide; TTC chr11 5297944 5297965 5297949 5297944 -
ccttcatttctttattctctgt

SEQ ID NO: 131308 - DNA, 22 bp, Artificial Sequence
  Synthetic oligonucleotide; CTT chr11 5297940 5297961 5297945 5297940 -
catttctttattctctgtttgt

SEQ ID NO: 131309 - DNA, 22 bp, Artificial Sequence
  Synthetic oligonucleotide; TTC chr11 5297939 5297960 5297944 5297939 -
atttctttattctctgtttgtc

SEQ ID NO: 131310 - DNA, 22 bp, Artificial Sequence
  Synthetic oligonucleotide; TTT chr11 5297935 5297956 5297940 5297935 -
ctttattctctgtttgtctcat

SEQ ID NO: 131311 - DNA, 22 bp, Artificial Sequence
  Synthetic oligonucleotide; TTC chr11 5297934 5297955 5297939 5297934 -
tttattctctgtttgtctcatg

SEQ ID NO: 131312 - DNA, 22 bp, Artificial Sequence
  Synthetic oligonucleotide; CTT chr11 5297932 5297953 5297937 5297932 -
tattctctgtttgtctcatgaa

SEQ ID NO: 131313 - DNA, 22 bp, Artificial Sequence
  Synthetic oligonucleotide; TTT chr11 5297931 5297952 5297936 5297931 -
attctctgtttgtctcatgaat

SEQ ID NO: 131314 - DNA, 22 bp, Artificial Sequence
  Synthetic oligonucleotide; TTA chr11 5297930 5297951 5297935 5297930 -
ttctctgtttgtctcatgaata

SEQ ID NO: 131315 - DNA, 22 bp, Artificial Sequence
  Synthetic oligonucleotide; TTC chr11 5297927 5297948 5297932 5297927 -
tctgtttgtctcatgaatattc

SEQ ID NO: 131316 - DNA, 22 bp, Artificial Sequence
  Synthetic oligonucleotide; CTC chr11 5297925 5297946 5297930 5297925 -
tgtttgtctcatgaatattccc

SEQ ID NO: 131317 - DNA, 22 bp, Artificial Sequence
  Synthetic oligonucleotide; CTG chr11 5297923 5297944 5297928 5297923 -
tttgtctcatgaatattccctc

SEQ ID NO: 131318 - DNA, 22 bp, Artificial Sequence
  Synthetic oligonucleotide; TTT chr11 5297920 5297941 5297925 5297920 -
gtctcatgaatattccctcagg

SEQ ID NO: 131319 - DNA, 22 bp, Artificial Sequence
  Synthetic oligonucleotide; TTG chr11 5297919 5297940 5297924 5297919 -
tctcatgaatattccctcagga

SEQ ID NO: 131320 - DNA, 22 bp, Artificial Sequence
  Synthetic oligonucleotide; CTC chr11 5297915 5297936 5297920 5297915 -
atgaatattccctcaggaaaca

SEQ ID NO: 131321 - DNA, 22 bp, Artificial Sequence
  Synthetic oligonucleotide; TTC chr11 5297905 5297926 5297910 5297905 -
cctcaggaaacaccctcccacg

SEQ ID NO: 131322 - DNA, 22 bp, Artificial Sequence
  Synthetic oligonucleotide; CTC chr11 5297901 5297922 5297906 5297901 -
aggaaacaccctcccacgccgt

SEQ ID NO: 131323 - DNA, 22 bp, Artificial Sequence
  Synthetic oligonucleotide; CTC chr11 5297888 5297909 5297893 5297888 -
ccacgccgttccctttatctag

SEQ ID NO: 131324 - DNA, 22 bp, Artificial Sequence
  Synthetic oligonucleotide; TTC chr11 5297877 5297898 5297882 5297877 -
cctttatctagcttcttattca

SEQ ID NO: 131325 - DNA, 22 bp, Artificial Sequence
  Synthetic oligonucleotide; CTT chr11 5297873 5297894 5297878 5297873 -
tatctagcttcttattcattcc

SEQ ID NO: 131326 - DNA, 22 bp, Artificial Sequence
  Synthetic oligonucleotide; TTT chr11 5297872 5297893 5297877 5297872 -
atctagcttcttattcattcct

SEQ ID NO: 131327 - DNA, 22 bp, Artificial Sequence
  Synthetic oligonucleotide; TTA chr11 5297871 5297892 5297876 5297871 -
tctagcttcttattcattcctc

SEQ ID NO: 131328 - DNA, 22 bp, Artificial Sequence
  Synthetic oligonucleotide; CTA chr11 5297867 5297888 5297872 5297867 -
gcttcttattcattcctcttgc

SEQ ID NO: 131329 - DNA, 22 bp, Artificial Sequence
  Synthetic oligonucleotide; CTT chr11 5297863 5297884 5297868 5297863 -
cttattcattcctcttgctgta

SEQ ID NO: 131330 - DNA, 22 bp, Artificial Sequence
  Synthetic oligonucleotide; TTC chr11 5297862 5297883 5297867 5297862 -
ttattcattcctcttgctgtac

SEQ ID NO: 131331 - DNA, 22 bp, Artificial Sequence
  Synthetic oligonucleotide; CTT chr11 5297860 5297881 5297865 5297860 -
attcattcctcttgctgtactg

SEQ ID NO: 131332 - DNA, 22 bp, Artificial Sequence
  Synthetic oligonucleotide; TTA chr11 5297859 5297880 5297864 5297859 -
ttcattcctcttgctgtactga

SEQ ID NO: 131333 - DNA, 22 bp, Artificial Sequence
  Synthetic oligonucleotide; TTC chr11 5297856 5297877 5297861 5297856 -
attcctcttgctgtactgatta

SEQ ID NO: 131334 - DNA, 22 bp, Artificial Sequence
  Synthetic oligonucleotide; TTC chr11 5297852 5297873 5297857 5297852 -
ctcttgctgtactgattagcct

SEQ ID NO: 131335 - DNA, 22 bp, Artificial Sequence
  Synthetic oligonucleotide; CTC chr11 5297849 5297870 5297854 5297849 -
ttgctgtactgattagccttga

SEQ ID NO: 131336 - DNA, 22 bp, Artificial Sequence
  Synthetic oligonucleotide; CTT chr11 5297847 5297868 5297852 5297847 -
gctgtactgattagccttgact

SEQ ID NO: 131337 - DNA, 22 bp, Artificial Sequence
  Synthetic oligonucleotide; TTG chr11 5297846 5297867 5297851 5297846 -
ctgtactgattagccttgactc

SEQ ID NO: 131338 - DNA, 22 bp, Artificial Sequence
  Synthetic oligonucleotide; CTG chr11 5297843 5297864 5297848 5297843 -
tactgattagccttgactcctc

SEQ ID NO: 131339 - DNA, 22 bp, Artificial Sequence
  Synthetic oligonucleotide; CTG chr11 5297838 5297859 5297843 5297838 -
attagccttgactcctcttata

SEQ ID NO: 131340 - DNA, 22 bp, Artificial Sequence
  Synthetic oligonucleotide; TTA chr11 5297834 5297855 5297839 5297834 -
gccttgactcctcttatagctc

SEQ ID NO: 131341 - DNA, 22 bp, Artificial Sequence
  Synthetic oligonucleotide; CTT chr11 5297829 5297850 5297834 5297829 -
gactcctcttatagctcacccc

SEQ ID NO: 131342 - DNA, 22 bp, Artificial Sequence
  Synthetic oligonucleotide; TTG chr11 5297828 5297849 5297833 5297828 -
actcctcttatagctcacccca

SEQ ID NO: 131343 - DNA, 22 bp, Artificial Sequence
  Synthetic oligonucleotide; CTC chr11 5297824 5297845 5297829 5297824 -
ctcttatagctcaccccagcct

SEQ ID NO: 131344 - DNA, 22 bp, Artificial Sequence
  Synthetic oligonucleotide; CTC chr11 5297821 5297842 5297826 5297821 -
ttatagctcaccccagcctctt

SEQ ID NO: 131345 - DNA, 22 bp, Artificial Sequence
  Synthetic oligonucleotide; CTT chr11 5297819 5297840 5297824 5297819 -
atagctcaccccagcctcttgg

SEQ ID NO: 131346 - DNA, 22 bp, Artificial Sequence
  Synthetic oligonucleotide; TTA chr11 5297818 5297839 5297823 5297818 -
tagctcaccccagcctcttggc

SEQ ID NO: 131347 - DNA, 22 bp, Artificial Sequence
  Synthetic oligonucleotide; CTC chr11 5297812 5297833 5297817 5297812 -
accccagcctcttggcattatt

SEQ ID NO: 131348 - DNA, 22 bp, Artificial Sequence
  Synthetic oligonucleotide; CTC chr11 5297801 5297822 5297806 5297801 -
ttggcattattatcaagtgtta

SEQ ID NO: 131349 - DNA, 22 bp, Artificial Sequence
  Synthetic oligonucleotide; CTT chr11 5297799 5297820 5297804 5297799 -
ggcattattatcaagtgttacc

SEQ ID NO: 131350 - DNA, 22 bp, Artificial Sequence
  Synthetic oligonucleotide; TTG chr11 5297798 5297819 5297803 5297798 -
gcattattatcaagtgttacca

SEQ ID NO: 131351 - DNA, 22 bp, Artificial Sequence
  Synthetic oligonucleotide; TTA chr11 5297792 5297813 5297797 5297792 -
ttatcaagtgttaccacagttg

SEQ ID NO: 131352 - DNA, 22 bp, Artificial Sequence
  Synthetic oligonucleotide; TTA chr11 5297789 5297810 5297794 5297789 -
tcaagtgttaccacagttgaac

SEQ ID NO: 131353 - DNA, 22 bp, Artificial Sequence
  Synthetic oligonucleotide; TTA chr11 5297779 5297800 5297784 5297779 -
ccacagttgaacagctggatcc

SEQ ID NO: 131354 - DNA, 22 bp, Artificial Sequence
  Synthetic oligonucleotide; TTG chr11 5297770 5297791 5297775 5297770 -
aacagctggatccaaaagtatt

SEQ ID NO: 131355 - DNA, 22 bp, Artificial Sequence
  Synthetic oligonucleotide; CTG chr11 5297762 5297783 5297767 5297762 -
gatccaaaagtattgaccaata

SEQ ID NO: 131356 - DNA, 22 bp, Artificial Sequence
  Synthetic oligonucleotide; TTG chr11 5297747 5297768 5297752 5297747 -
accaataaggaacagaaaataa

SEQ ID NO: 131357 - DNA, 22 bp, Artificial Sequence
  Synthetic oligonucleotide; CTT chr11 5297720 5297741 5297725 5297720 -
gcaatgtaaattataatatgga

SEQ ID NO: 131358 - DNA, 22 bp, Artificial Sequence
  Synthetic oligonucleotide; TTG chr11 5297719 5297740 5297724 5297719 -
caatgtaaattataatatggat

SEQ ID NO: 131359 - DNA, 22 bp, Artificial Sequence
  Synthetic oligonucleotide; TTA chr11 5297707 5297728 5297712 5297707 -
taatatggataagcattggtac

SEQ ID NO: 131360 - DNA, 22 bp, Artificial Sequence
  Synthetic oligonucleotide; TTG chr11 5297689 5297710 5297694 5297689 -
gtactaaacctgaagttagtat

SEQ ID NO: 131361 - DNA, 22 bp, Artificial Sequence
  Synthetic oligonucleotide; CTA chr11 5297683 5297704 5297688 5297683 -
aacctgaagttagtattttact

SEQ ID NO: 131362 - DNA, 22 bp, Artificial Sequence
  Synthetic oligonucleotide; CTG chr11 5297677 5297698 5297682 5297677 -
aagttagtattttactctatac

SEQ ID NO: 131363 - DNA, 22 bp, Artificial Sequence
  Synthetic oligonucleotide; TTA chr11 5297671 5297692 5297676 5297671 -
gtattttactctatacctacaa

SEQ ID NO: 131364 - DNA, 22 bp, Artificial Sequence
  Synthetic oligonucleotide; TTT chr11 5297665 5297686 5297670 5297665 -
tactctatacctacaaggaaga

SEQ ID NO: 131365 - DNA, 22 bp, Artificial Sequence
  Synthetic oligonucleotide; TTT chr11 5297664 5297685 5297669 5297664 -
actctatacctacaaggaagat

SEQ ID NO: 131366 - DNA, 22 bp, Artificial Sequence
  Synthetic oligonucleotide; TTA chr11 5297663 5297684 5297668 5297663 -
ctctatacctacaaggaagata

SEQ ID NO: 131367 - DNA, 22 bp, Artificial Sequence
  Synthetic oligonucleotide; CTC chr11 5297660 5297681 5297665 5297660 -
tatacctacaaggaagatatac

SEQ ID NO: 131368 - DNA, 22 bp, Artificial Sequence
  Synthetic oligonucleotide; CTA chr11 5297658 5297679 5297663 5297658 -
tacctacaaggaagatatacaa

SEQ ID NO: 131369 - DNA, 22 bp, Artificial Sequence
  Synthetic oligonucleotide; CTA chr11 5297652 5297673 5297657 5297652 -
caaggaagatatacaagtattt

SEQ ID NO: 131370 - DNA, 22 bp, Artificial Sequence
  Synthetic oligonucleotide; TTT chr11 5297630 5297651 5297635 5297630 -
ctctaaggtagtttgaaaagcc

SEQ ID NO: 131371 - DNA, 22 bp, Artificial Sequence
  Synthetic oligonucleotide; TTC chr11 5297629 5297650 5297634 5297629 -
tctaaggtagtttgaaaagcct

SEQ ID NO: 131372 - DNA, 22 bp, Artificial Sequence
  Synthetic oligonucleotide; CTC chr11 5297627 5297648 5297632 5297627 -
taaggtagtttgaaaagcctag

SEQ ID NO: 131373 - DNA, 22 bp, Artificial Sequence
  Synthetic oligonucleotide; CTA chr11 5297625 5297646 5297630 5297625 -
aggtagtttgaaaagcctagat

SEQ ID NO: 131374 - DNA, 22 bp, Artificial Sequence
  Synthetic oligonucleotide; TTT chr11 5297616 5297637 5297621 5297616 -
gaaaagcctagatatagaaact

SEQ ID NO: 131375 - DNA, 22 bp, Artificial Sequence
  Synthetic oligonucleotide; TTG chr11 5297615 5297636 5297620 5297615 -
aaaagcctagatatagaaactg

SEQ ID NO: 131376 - DNA, 22 bp, Artificial Sequence
  Synthetic oligonucleotide; CTA chr11 5297606 5297627 5297611 5297606 -
gatatagaaactggatcctcac

SEQ ID NO: 131377 - DNA, 22 bp, Artificial Sequence
  Synthetic oligonucleotide; CTG chr11 5297593 5297614 5297598 5297593 -
gatcctcacatgagttcagtat

SEQ ID NO: 131378 - DNA, 22 bp, Artificial Sequence
  Synthetic oligonucleotide; CTC chr11 5297586 5297607 5297591 5297586 -
acatgagttcagtatataattg

SEQ ID NO: 131379 - DNA, 22 bp, Artificial Sequence
  Synthetic oligonucleotide; TTC chr11 5297576 5297597 5297581 5297576 -
agtatataattgtaacagaata

SEQ ID NO: 131380 - DNA, 22 bp, Artificial Sequence
  Synthetic oligonucleotide; TTG chr11 5297564 5297585 5297569 5297564 -
taacagaataaaaaatcaatta

SEQ ID NO: 131381 - DNA, 22 bp, Artificial Sequence
  Synthetic oligonucleotide; TTA chr11 5297542 5297563 5297547 5297542 -
tgtattcaagttgctagtgtct

SEQ ID NO: 131382 - DNA, 22 bp, Artificial Sequence
  Synthetic oligonucleotide; TTC chr11 5297535 5297556 5297540 5297535 -
aagttgctagtgtcttaagagg

SEQ ID NO: 131383 - DNA, 22 bp, Artificial Sequence
  Synthetic oligonucleotide; TTG chr11 5297529 5297550 5297534 5297529 -
ctagtgtcttaagaggttcaca

SEQ ID NO: 131384 - DNA, 22 bp, Artificial Sequence
  Synthetic oligonucleotide; CTA chr11 5297526 5297547 5297531 5297526 -
gtgtcttaagaggttcacattt

SEQ ID NO: 131385 - DNA, 22 bp, Artificial Sequence
  Synthetic oligonucleotide; CTT chr11 5297519 5297540 5297524 5297519 -
aagaggttcacatttttatcta

SEQ ID NO: 131386 - DNA, 22 bp, Artificial Sequence
  Synthetic oligonucleotide; TTA chr11 5297518 5297539 5297523 5297518 -
agaggttcacatttttatctaa

SEQ ID NO: 131387 - DNA, 22 bp, Artificial Sequence
  Synthetic oligonucleotide; TTC chr11 5297510 5297531 5297515 5297510 -
acatttttatctaactgattat

SEQ ID NO: 131388 - DNA, 22 bp, Artificial Sequence
  Synthetic oligonucleotide; TTT chr11 5297504 5297525 5297509 5297504 -
ttatctaactgattatcacaaa

SEQ ID NO: 131389 - DNA, 22 bp, Artificial Sequence
  Synthetic oligonucleotide; TTT chr11 5297503 5297524 5297508 5297503 -
tatctaactgattatcacaaaa

SEQ ID NO: 131390 - DNA, 22 bp, Artificial Sequence
  Synthetic oligonucleotide; TTT chr11 5297502 5297523 5297507 5297502 -
atctaactgattatcacaaaaa

SEQ ID NO: 131391 - DNA, 22 bp, Artificial Sequence
  Synthetic oligonucleotide; TTA chr11 5297501 5297522 5297506 5297501 -
tctaactgattatcacaaaaat

SEQ ID NO: 131392 - DNA, 22 bp, Artificial Sequence
  Synthetic oligonucleotide; CTA chr11 5297497 5297518 5297502 5297497 -
actgattatcacaaaaatactt

SEQ ID NO: 131393 - DNA, 22 bp, Artificial Sequence
  Synthetic oligonucleotide; CTG chr11 5297493 5297514 5297498 5297493 -
attatcacaaaaatacttcgag

SEQ ID NO: 131394 - DNA, 22 bp, Artificial Sequence
  Synthetic oligonucleotide; TTA chr11 5297489 5297510 5297494 5297489 -
tcacaaaaatacttcgagttac

SEQ ID NO: 131395 - DNA, 22 bp, Artificial Sequence
  Synthetic oligonucleotide; CTT chr11 5297475 5297496 5297480 5297475 -
cgagttacttttcattataatt

SEQ ID NO: 131396 - DNA, 22 bp, Artificial Sequence
  Synthetic oligonucleotide; TTC chr11 5297474 5297495 5297479 5297474 -
gagttacttttcattataattc

SEQ ID NO: 131397 - DNA, 22 bp, Artificial Sequence
  Synthetic oligonucleotide; TTA chr11 5297468 5297489 5297473 5297468 -
cttttcattataattcctgact

SEQ ID NO: 131398 - DNA, 22 bp, Artificial Sequence
  Synthetic oligonucleotide; CTT chr11 5297465 5297486 5297470 5297465 -
ttcattataattcctgactaca

SEQ ID NO: 131399 - DNA, 22 bp, Artificial Sequence
  Synthetic oligonucleotide; TTT chr11 5297464 5297485 5297469 5297464 -
tcattataattcctgactacac

SEQ ID NO: 131400 - DNA, 22 bp, Artificial Sequence
  Synthetic oligonucleotide; TTT chr11 5297463 5297484 5297468 5297463 -
cattataattcctgactacaca

SEQ ID NO: 131401 - DNA, 22 bp, Artificial Sequence
  Synthetic oligonucleotide; TTC chr11 5297462 5297483 5297467 5297462 -
attataattcctgactacacat

SEQ ID NO: 131402 - DNA, 22 bp, Artificial Sequence
  Synthetic oligonucleotide; TTA chr11 5297458 5297479 5297463 5297458 -
taattcctgactacacatgaag

SEQ ID NO: 131403 - DNA, 22 bp, Artificial Sequence
  Synthetic oligonucleotide; TTC chr11 5297452 5297473 5297457 5297452 -
ctgactacacatgaagagactg

SEQ ID NO: 131404 - DNA, 22 bp, Artificial Sequence
  Synthetic oligonucleotide; CTG chr11 5297449 5297470 5297454 5297449 -
actacacatgaagagactgaca

SEQ ID NO: 131405 - DNA, 22 bp, Artificial Sequence
  Synthetic oligonucleotide; CTA chr11 5297445 5297466 5297450 5297445 -
cacatgaagagactgacacgta

SEQ ID NO: 131406 - DNA, 22 bp, Artificial Sequence
  Synthetic oligonucleotide; CTG chr11 5297430 5297451 5297435 5297430 -
acacgtaggtgccttacttagg

SEQ ID NO: 131407 - DNA, 22 bp, Artificial Sequence
  Synthetic oligonucleotide; CTT chr11 5297415 5297436 5297420 5297415 -
acttaggtaggttaagtaattt

SEQ ID NO: 131408 - DNA, 22 bp, Artificial Sequence
  Synthetic oligonucleotide; TTA chr11 5297414 5297435 5297419 5297414 -
cttaggtaggttaagtaattta

SEQ ID NO: 131409 - DNA, 22 bp, Artificial Sequence
  Synthetic oligonucleotide; CTT chr11 5297411 5297432 5297416 5297411 -
aggtaggttaagtaatttatcc

SEQ ID NO: 131410 - DNA, 22 bp, Artificial Sequence
  Synthetic oligonucleotide; TTA chr11 5297410 5297431 5297415 5297410 -
ggtaggttaagtaatttatcca

SEQ ID NO: 131411 - DNA, 22 bp, Artificial Sequence
  Synthetic oligonucleotide; TTA chr11 5297401 5297422 5297406 5297401 -
agtaatttatccaaaaccacac

SEQ ID NO: 131412 - DNA, 22 bp, Artificial Sequence
  Synthetic oligonucleotide; TTT chr11 5297393 5297414 5297398 5297393 -
atccaaaaccacacaatgtaga

SEQ ID NO: 131413 - DNA, 22 bp, Artificial Sequence
  Synthetic oligonucleotide; TTA chr11 5297392 5297413 5297397 5297392 -
tccaaaaccacacaatgtagaa

SEQ ID NO: 131414 - DNA, 22 bp, Artificial Sequence
  Synthetic oligonucleotide; CTA chr11 5297366 5297387 5297371 5297366 -
agctgattcggccatagaaaca

SEQ ID NO: 131415 - DNA, 22 bp, Artificial Sequence
  Synthetic oligonucleotide; CTG chr11 5297361 5297382 5297366 5297361 -
attcggccatagaaacacaata

SEQ ID NO: 131416 - DNA, 22 bp, Artificial Sequence
  Synthetic oligonucleotide; TTC chr11 5297357 5297378 5297362 5297357 -
ggccatagaaacacaatatgtg

SEQ ID NO: 131417 - DNA, 22 bp, Artificial Sequence
  Synthetic oligonucleotide; TTT chr11 5297312 5297333 5297317 5297312 -
ctctccttcctatgctgtcaga

SEQ ID NO: 131418 - DNA, 22 bp, Artificial Sequence
  Synthetic oligonucleotide; TTC chr11 5297311 5297332 5297316 5297311 -
tctccttcctatgctgtcagat

SEQ ID NO: 131419 - DNA, 22 bp, Artificial Sequence
  Synthetic oligonucleotide; CTC chr11 5297309 5297330 5297314 5297309 -
tccttcctatgctgtcagatga

SEQ ID NO: 131420 - DNA, 22 bp, Artificial Sequence
  Synthetic oligonucleotide; CTC chr11 5297307 5297328 5297312 5297307 -
cttcctatgctgtcagatgaat

SEQ ID NO: 131421 - DNA, 22 bp, Artificial Sequence
  Synthetic oligonucleotide; CTT chr11 5297304 5297325 5297309 5297304 -
cctatgctgtcagatgaatact

SEQ ID NO: 131422 - DNA, 22 bp, Artificial Sequence
  Synthetic oligonucleotide; TTC chr11 5297303 5297324 5297308 5297303 -
ctatgctgtcagatgaatactg

SEQ ID NO: 131423 - DNA, 22 bp, Artificial Sequence
  Synthetic oligonucleotide; CTA chr11 5297300 5297321 5297305 5297300 -
tgctgtcagatgaatactgaga

SEQ ID NO: 131424 - DNA, 22 bp, Artificial Sequence
  Synthetic oligonucleotide; CTG chr11 5297295 5297316 5297300 5297295 -
tcagatgaatactgagatagaa

SEQ ID NO: 131425 - DNA, 22 bp, Artificial Sequence
  Synthetic oligonucleotide; CTG chr11 5297281 5297302 5297286 5297281 -
agatagaatatttagttcatct

SEQ ID NO: 131426 - DNA, 22 bp, Artificial Sequence
  Synthetic oligonucleotide; TTT chr11 5297268 5297289 5297273 5297268 -
agttcatctatcacacattaaa

SEQ ID NO: 131427 - DNA, 22 bp, Artificial Sequence
  Synthetic oligonucleotide; TTA chr11 5297267 5297288 5297272 5297267 -
gttcatctatcacacattaaac

SEQ ID NO: 131428 - DNA, 22 bp, Artificial Sequence
  Synthetic oligonucleotide; TTC chr11 5297263 5297284 5297268 5297263 -
atctatcacacattaaacggga

SEQ ID NO: 131429 - DNA, 22 bp, Artificial Sequence
  Synthetic oligonucleotide; CTA chr11 5297258 5297279 5297263 5297258 -
tcacacattaaacgggacttta

SEQ ID NO: 131430 - DNA, 22 bp, Artificial Sequence
  Synthetic oligonucleotide; TTA chr11 5297248 5297269 5297253 5297248 -
aacgggactttacatttctgtc

SEQ ID NO: 131431 - DNA, 22 bp, Artificial Sequence
  Synthetic oligonucleotide; CTT chr11 5297238 5297259 5297243 5297238 -
tacatttctgtctgttgaagat

SEQ ID NO: 131432 - DNA, 22 bp, Artificial Sequence
  Synthetic oligonucleotide; TTT chr11 5297237 5297258 5297242 5297237 -
acatttctgtctgttgaagatt

SEQ ID NO: 131433 - DNA, 22 bp, Artificial Sequence
  Synthetic oligonucleotide; TTA chr11 5297236 5297257 5297241 5297236 -
catttctgtctgttgaagattt

SEQ ID NO: 131434 - DNA, 22 bp, Artificial Sequence
  Synthetic oligonucleotide; TTT chr11 5297231 5297252 5297236 5297231 -
ctgtctgttgaagatttgggtg

SEQ ID NO: 131435 - DNA, 22 bp, Artificial Sequence
  Synthetic oligonucleotide; TTC chr11 5297230 5297251 5297235 5297230 -
tgtctgttgaagatttgggtgt

SEQ ID NO: 131436 - DNA, 22 bp, Artificial Sequence
  Synthetic oligonucleotide; CTG chr11 5297228 5297249 5297233 5297228 -
tctgttgaagatttgggtgtgg

SEQ ID NO: 131437 - DNA, 22 bp, Artificial Sequence
  Synthetic oligonucleotide; CTG chr11 5297224 5297245 5297229 5297224 -
ttgaagatttgggtgtggggat

SEQ ID NO: 131438 - DNA, 22 bp, Artificial Sequence
  Synthetic oligonucleotide; TTG chr11 5297221 5297242 5297226 5297221 -
aagatttgggtgtggggataac

SEQ ID NO: 131439 - DNA, 22 bp, Artificial Sequence
  Synthetic oligonucleotide; TTT chr11 5297214 5297235 5297219 5297214 -
gggtgtggggataactcaaggt

SEQ ID NO: 131440 - DNA, 22 bp, Artificial Sequence
  Synthetic oligonucleotide; TTG chr11 5297213 5297234 5297218 5297213 -
ggtgtggggataactcaaggta

SEQ ID NO: 131441 - DNA, 22 bp, Artificial Sequence
  Synthetic oligonucleotide; CTC chr11 5297197 5297218 5297202 5297197 -
aaggtatcatatccaagggatg

SEQ ID NO: 131442 - DNA, 22 bp, Artificial Sequence
  Synthetic oligonucleotide; CTC chr11 5297157 5297178 5297162 5297157 -
taacagaaagggaaaggatgtt

SEQ ID NO: 131443 - DNA, 22 bp, Artificial Sequence
  Synthetic oligonucleotide; CTA chr11 5297155 5297176 5297160 5297155 -
acagaaagggaaaggatgttgg

SEQ ID NO: 131444 - DNA, 22 bp, Artificial Sequence
  Synthetic oligonucleotide; TTG chr11 5297134 5297155 5297139 5297134 -
gcaaggctatgttcatgaaagt

SEQ ID NO: 131445 - DNA, 22 bp, Artificial Sequence
  Synthetic oligonucleotide; CTA chr11 5297125 5297146 5297130 5297125 -
tgttcatgaaagtatatgtaaa

SEQ ID NO: 131446 - DNA, 22 bp, Artificial Sequence
  Synthetic oligonucleotide; TTC chr11 5297120 5297141 5297125 5297120 -
atgaaagtatatgtaaaatcca

SEQ ID NO: 131447 - DNA, 22 bp, Artificial Sequence
  Synthetic oligonucleotide; TTA chr11 5297093 5297114 5297098 5297093 -
agcttctttctgcatgcattgg

SEQ ID NO: 131448 - DNA, 22 bp, Artificial Sequence
  Synthetic oligonucleotide; CTT chr11 5297088 5297109 5297093 5297088 -
ctttctgcatgcattggcaatg

SEQ ID NO: 131449 - DNA, 22 bp, Artificial Sequence
  Synthetic oligonucleotide; TTC chr11 5297087 5297108 5297092 5297087 -
tttctgcatgcattggcaatgt

SEQ ID NO: 131450 - DNA, 22 bp, Artificial Sequence
  Synthetic oligonucleotide; CTT chr11 5297085 5297106 5297090 5297085 -
tctgcatgcattggcaatgttt

SEQ ID NO: 131451 - DNA, 22 bp, Artificial Sequence
  Synthetic oligonucleotide; TTT chr11 5297084 5297105 5297089 5297084 -
ctgcatgcattggcaatgttta

SEQ ID NO: 131452 - DNA, 22 bp, Artificial Sequence
  Synthetic oligonucleotide; TTC chr11 5297083 5297104 5297088 5297083 -
tgcatgcattggcaatgtttat

SEQ ID NO: 131453 - DNA, 22 bp, Artificial Sequence
  Synthetic oligonucleotide; CTG chr11 5297081 5297102 5297086 5297081 -
catgcattggcaatgtttatga

SEQ ID NO: 131454 - DNA, 22 bp, Artificial Sequence
  Synthetic oligonucleotide; TTG chr11 5297072 5297093 5297077 5297072 -
gcaatgtttatgaataatgtgt

SEQ ID NO: 131455 - DNA, 22 bp, Artificial Sequence
  Synthetic oligonucleotide; TTT chr11 5297063 5297084 5297068 5297063 -
atgaataatgtgtatgtaaaag

SEQ ID NO: 131456 - DNA, 22 bp, Artificial Sequence
  Synthetic oligonucleotide; TTA chr11 5297062 5297083 5297067 5297062 -
tgaataatgtgtatgtaaaagt

SEQ ID NO: 131457 - DNA, 22 bp, Artificial Sequence
  Synthetic oligonucleotide; CTG chr11 5297034 5297055 5297039 5297034 -
tatattcaaaagtgtttcatgt

SEQ ID NO: 131458 - DNA, 22 bp, Artificial Sequence
  Synthetic oligonucleotide; TTC chr11 5297027 5297048 5297032 5297027 -
aaaagtgtttcatgtgcctagg

SEQ ID NO: 131459 - DNA, 22 bp, Artificial Sequence
  Synthetic oligonucleotide; TTT chr11 5297017 5297038 5297022 5297017 -
catgtgcctaggggtgtcaaat

SEQ ID NO: 131460 - DNA, 22 bp, Artificial Sequence
  Synthetic oligonucleotide; TTC chr11 5297016 5297037 5297021 5297016 -
atgtgcctaggggtgtcaaata

SEQ ID NO: 131461 - DNA, 22 bp, Artificial Sequence
  Synthetic oligonucleotide; CTA chr11 5297007 5297028 5297012 5297007 -
ggggtgtcaaatactttgagtt

SEQ ID NO: 131462 - DNA, 22 bp, Artificial Sequence
  Synthetic oligonucleotide; CTT chr11 5296991 5297012 5296996 5296991 -
tgagtttgtaagtatatacttc

SEQ ID NO: 131463 - DNA, 22 bp, Artificial Sequence
  Synthetic oligonucleotide; TTT chr11 5296990 5297011 5296995 5296990 -
gagtttgtaagtatatacttct

SEQ ID NO: 131464 - DNA, 22 bp, Artificial Sequence
  Synthetic oligonucleotide; TTG chr11 5296989 5297010 5296994 5296989 -
agtttgtaagtatatacttctc

SEQ ID NO: 131465 - DNA, 22 bp, Artificial Sequence
  Synthetic oligonucleotide; TTT chr11 5296984 5297005 5296989 5296984 -
gtaagtatatacttctctgtaa

SEQ ID NO: 131466 - DNA, 22 bp, Artificial Sequence
  Synthetic oligonucleotide; TTG chr11 5296983 5297004 5296988 5296983 -
taagtatatacttctctgtaat

SEQ ID NO: 131467 - DNA, 22 bp, Artificial Sequence
  Synthetic oligonucleotide; CTT chr11 5296970 5296991 5296975 5296970 -
ctctgtaatgtgtctgaatatc

SEQ ID NO: 131468 - DNA, 22 bp, Artificial Sequence
  Synthetic oligonucleotide; TTC chr11 5296969 5296990 5296974 5296969 -
tctgtaatgtgtctgaatatct

SEQ ID NO: 131469 - DNA, 22 bp, Artificial Sequence
  Synthetic oligonucleotide; CTC chr11 5296967 5296988 5296972 5296967 -
tgtaatgtgtctgaatatctct

SEQ ID NO: 131470 - DNA, 22 bp, Artificial Sequence
  Synthetic oligonucleotide; CTG chr11 5296965 5296986 5296970 5296965 -
taatgtgtctgaatatctctat

SEQ ID NO: 131471 - DNA, 22 bp, Artificial Sequence
  Synthetic oligonucleotide; CTG chr11 5296954 5296975 5296959 5296954 -
aatatctctatttacttgattc

SEQ ID NO: 131472 - DNA, 22 bp, Artificial Sequence
  Synthetic oligonucleotide; CTC chr11 5296946 5296967 5296951 5296946 -
tatttacttgattctcaataag

SEQ ID NO: 131473 - DNA, 22 bp, Artificial Sequence
  Synthetic oligonucleotide; CTA chr11 5296944 5296965 5296949 5296944 -
tttacttgattctcaataagta

SEQ ID NO: 131474 - DNA, 22 bp, Artificial Sequence
  Synthetic oligonucleotide; TTT chr11 5296941 5296962 5296946 5296941 -
acttgattctcaataagtaggt

SEQ ID NO: 131475 - DNA, 22 bp, Artificial Sequence
  Synthetic oligonucleotide; TTA chr11 5296940 5296961 5296945 5296940 -
cttgattctcaataagtaggta

SEQ ID NO: 131476 - DNA, 22 bp, Artificial Sequence
  Synthetic oligonucleotide; CTT chr11 5296937 5296958 5296942 5296937 -
gattctcaataagtaggtatca

SEQ ID NO: 131477 - DNA, 22 bp, Artificial Sequence
  Synthetic oligonucleotide; TTG chr11 5296936 5296957 5296941 5296936 -
attctcaataagtaggtatcat

SEQ ID NO: 131478 - DNA, 22 bp, Artificial Sequence
  Synthetic oligonucleotide; TTC chr11 5296932 5296953 5296937 5296932 -
tcaataagtaggtatcatagtg

SEQ ID NO: 131479 - DNA, 22 bp, Artificial Sequence
  Synthetic oligonucleotide; CTC chr11 5296930 5296951 5296935 5296930 -
aataagtaggtatcatagtgaa

SEQ ID NO: 131480 - DNA, 22 bp, Artificial Sequence
  Synthetic oligonucleotide; CTG chr11 5296902 5296923 5296907 5296902 -
acaaatgtttgaggaacaattt

SEQ ID NO: 131481 - DNA, 22 bp, Artificial Sequence
  Synthetic oligonucleotide; TTT chr11 5296892 5296913 5296897 5296892 -
gaggaacaatttagtgtttacc

SEQ ID NO: 131482 - DNA, 22 bp, Artificial Sequence
  Synthetic oligonucleotide; TTG chr11 5296891 5296912 5296896 5296891 -
aggaacaatttagtgtttacct

SEQ ID NO: 131483 - DNA, 22 bp, Artificial Sequence
  Synthetic oligonucleotide; TTT chr11 5296880 5296901 5296885 5296880 -
agtgtttacctattcaccaaaa

SEQ ID NO: 131484 - DNA, 22 bp, Artificial Sequence
  Synthetic oligonucleotide; TTA chr11 5296879 5296900 5296884 5296879 -
gtgtttacctattcaccaaaat

SEQ ID NO: 131485 - DNA, 22 bp, Artificial Sequence
  Synthetic oligonucleotide; TTT chr11 5296873 5296894 5296878 5296873 -
acctattcaccaaaatttatta

SEQ ID NO: 131486 - DNA, 22 bp, Artificial Sequence
  Synthetic oligonucleotide; TTA chr11 5296872 5296893 5296877 5296872 -
cctattcaccaaaatttattaa

SEQ ID NO: 131487 - DNA, 22 bp, Artificial Sequence
  Synthetic oligonucleotide; CTA chr11 5296868 5296889 5296873 5296868 -
ttcaccaaaatttattaaatgc

SEQ ID NO: 131488 - DNA, 22 bp, Artificial Sequence
  Synthetic oligonucleotide; TTC chr11 5296865 5296886 5296870 5296865 -
accaaaatttattaaatgccta

SEQ ID NO: 131489 - DNA, 22 bp, Artificial Sequence
  Synthetic oligonucleotide; TTT chr11 5296855 5296876 5296860 5296855 -
attaaatgcctaatctgtatca

SEQ ID NO: 131490 - DNA, 22 bp, Artificial Sequence
  Synthetic oligonucleotide; TTA chr11 5296854 5296875 5296859 5296854 -
ttaaatgcctaatctgtatcag

SEQ ID NO: 131491 - DNA, 22 bp, Artificial Sequence
  Synthetic oligonucleotide; TTA chr11 5296851 5296872 5296856 5296851 -
aatgcctaatctgtatcagata

SEQ ID NO: 131492 - DNA, 22 bp, Artificial Sequence
  Synthetic oligonucleotide; CTA chr11 5296843 5296864 5296848 5296843 -
atctgtatcagatatacaatta

SEQ ID NO: 131493 - DNA, 22 bp, Artificial Sequence
  Synthetic oligonucleotide; CTG chr11 5296838 5296859 5296843 5296838 -
tatcagatatacaattatctgg

SEQ ID NO: 131494 - DNA, 22 bp, Artificial Sequence
  Synthetic oligonucleotide; TTA chr11 5296821 5296842 5296826 5296821 -
tctggcgaaatctgtaattcct

SEQ ID NO: 131495 - DNA, 22 bp, Artificial Sequence
  Synthetic oligonucleotide; CTG chr11 5296817 5296838 5296822 5296817 -
gcgaaatctgtaattcctaatt

SEQ ID NO: 131496 - DNA, 22 bp, Artificial Sequence
  Synthetic oligonucleotide; CTG chr11 5296807 5296828 5296812 5296807 -
taattcctaatttaaacagctg

SEQ ID NO: 131497 - DNA, 22 bp, Artificial Sequence
  Synthetic oligonucleotide; TTC chr11 5296801 5296822 5296806 5296801 -
ctaatttaaacagctgtgtagc

SEQ ID NO: 131498 - DNA, 22 bp, Artificial Sequence
  Synthetic oligonucleotide; CTA chr11 5296798 5296819 5296803 5296798 -
atttaaacagctgtgtagccta

SEQ ID NO: 131499 - DNA, 22 bp, Artificial Sequence
  Synthetic oligonucleotide; TTT chr11 5296794 5296815 5296799 5296794 -
aaacagctgtgtagcctaatta

SEQ ID NO: 131500 - DNA, 22 bp, Artificial Sequence
  Synthetic oligonucleotide; TTA chr11 5296793 5296814 5296798 5296793 -
aacagctgtgtagcctaattag

SEQ ID NO: 131501 - DNA, 22 bp, Artificial Sequence
  Synthetic oligonucleotide; CTG chr11 5296785 5296806 5296790 5296785 -
tgtagcctaattagggataaag

SEQ ID NO: 131502 - DNA, 22 bp, Artificial Sequence
  Synthetic oligonucleotide; CTA chr11 5296776 5296797 5296781 5296776 -
attagggataaaggcatgcaaa

SEQ ID NO: 131503 - DNA, 22 bp, Artificial Sequence
  Synthetic oligonucleotide; TTA chr11 5296772 5296793 5296777 5296772 -
gggataaaggcatgcaaaccca

SEQ ID NO: 131504 - DNA, 22 bp, Artificial Sequence
  Synthetic oligonucleotide; TTT chr11 5296744 5296765 5296749 5296744 -
gtgtaggttgaaatgagctata

SEQ ID NO: 131505 - DNA, 22 bp, Artificial Sequence
  Synthetic oligonucleotide; TTG chr11 5296743 5296764 5296748 5296743 -
tgtaggttgaaatgagctatag

SEQ ID NO: 131506 - DNA, 22 bp, Artificial Sequence
  Synthetic oligonucleotide; TTG chr11 5296734 5296755 5296739 5296734 -
aaatgagctatagaaaaatgca

SEQ ID NO: 131507 - DNA, 22 bp, Artificial Sequence
  Synthetic oligonucleotide; CTA chr11 5296724 5296745 5296729 5296724 -
tagaaaaatgcagtatatttat

SEQ ID NO: 131508 - DNA, 22 bp, Artificial Sequence
  Synthetic oligonucleotide; TTT chr11 5296704 5296725 5296709 5296704 -
atcagaagtctttagggtcatg

SEQ ID NO: 131509 - DNA, 22 bp, Artificial Sequence
  Synthetic oligonucleotide; TTA chr11 5296703 5296724 5296708 5296703 -
tcagaagtctttagggtcatga

SEQ ID NO: 131510 - DNA, 22 bp, Artificial Sequence
  Synthetic oligonucleotide; CTT chr11 5296692 5296713 5296697 5296692 -
tagggtcatgaaaaggaatggt

SEQ ID NO: 131511 - DNA, 22 bp, Artificial Sequence
  Synthetic oligonucleotide; TTT chr11 5296691 5296712 5296696 5296691 -
agggtcatgaaaaggaatggtc

SEQ ID NO: 131512 - DNA, 22 bp, Artificial Sequence
  Synthetic oligonucleotide; TTA chr11 5296690 5296711 5296695 5296690 -
gggtcatgaaaaggaatggtca

SEQ ID NO: 131513 - DNA, 22 bp, Artificial Sequence
  Synthetic oligonucleotide; CTG chr11 5296664 5296685 5296669 5296664 -
acactgccagggactcatatgt

SEQ ID NO: 131514 - DNA, 22 bp, Artificial Sequence
  Synthetic oligonucleotide; CTG chr11 5296658 5296679 5296663 5296658 -
ccagggactcatatgtaagaga

SEQ ID NO: 131515 - DNA, 22 bp, Artificial Sequence
  Synthetic oligonucleotide; CTC chr11 5296648 5296669 5296653 5296648 -
atatgtaagagataactaatgt

SEQ ID NO: 131516 - DNA, 22 bp, Artificial Sequence
  Synthetic oligonucleotide; CTA chr11 5296630 5296651 5296635 5296630 -
atgtgaagtgactttaaaggag

SEQ ID NO: 131517 - DNA, 22 bp, Artificial Sequence
  Synthetic oligonucleotide; CTT chr11 5296616 5296637 5296621 5296616 -
taaaggagaaattagcagaagt

SEQ ID NO: 131518 - DNA, 22 bp, Artificial Sequence
  Synthetic oligonucleotide; TTT chr11 5296615 5296636 5296620 5296615 -
aaaggagaaattagcagaagtt

SEQ ID NO: 131519 - DNA, 22 bp, Artificial Sequence
  Synthetic oligonucleotide; TTA chr11 5296614 5296635 5296619 5296614 -
aaggagaaattagcagaagttt

SEQ ID NO: 131520 - DNA, 22 bp, Artificial Sequence
  Synthetic oligonucleotide; TTA chr11 5296602 5296623 5296607 5296602 -
gcagaagttttctttccatgtc

SEQ ID NO: 131521 - DNA, 22 bp, Artificial Sequence
  Synthetic oligonucleotide; TTT chr11 5296592 5296613 5296597 5296592 -
tctttccatgtctcctcatcat

SEQ ID NO: 131522 - DNA, 22 bp, Artificial Sequence
  Synthetic oligonucleotide; TTT chr11 5296591 5296612 5296596 5296591 -
ctttccatgtctcctcatcatg

SEQ ID NO: 131523 - DNA, 22 bp, Artificial Sequence
  Synthetic oligonucleotide; TTC chr11 5296590 5296611 5296595 5296590 -
tttccatgtctcctcatcatgt

SEQ ID NO: 131524 - DNA, 22 bp, Artificial Sequence
  Synthetic oligonucleotide; CTT chr11 5296588 5296609 5296593 5296588 -
tccatgtctcctcatcatgtta

SEQ ID NO: 131525 - DNA, 22 bp, Artificial Sequence
  Synthetic oligonucleotide; TTT chr11 5296587 5296608 5296592 5296587 -
ccatgtctcctcatcatgttac

SEQ ID NO: 131526 - DNA, 22 bp, Artificial Sequence
  Synthetic oligonucleotide; TTC chr11 5296586 5296607 5296591 5296586 -
catgtctcctcatcatgttaca

SEQ ID NO: 131527 - DNA, 22 bp, Artificial Sequence
  Synthetic oligonucleotide; CTC chr11 5296578 5296599 5296583 5296578 -
ctcatcatgttacaataacgga

SEQ ID NO: 131528 - DNA, 22 bp, Artificial Sequence
  Synthetic oligonucleotide; CTC chr11 5296575 5296596 5296580 5296575 -
atcatgttacaataacggaaga

SEQ ID NO: 131529 - DNA, 22 bp, Artificial Sequence
  Synthetic oligonucleotide; TTA chr11 5296566 5296587 5296571 5296566 -
caataacggaagagattaaaac

SEQ ID NO: 131530 - DNA, 22 bp, Artificial Sequence
  Synthetic oligonucleotide; TTA chr11 5296548 5296569 5296553 5296548 -
aaacaacaaatacatttagaca

SEQ ID NO: 131531 - DNA, 22 bp, Artificial Sequence
  Synthetic oligonucleotide; TTT chr11 5296531 5296552 5296536 5296531 -
agacagcaatgtttatcctggt

SEQ ID NO: 131532 - DNA, 22 bp, Artificial Sequence
  Synthetic oligonucleotide; TTA chr11 5296530 5296551 5296535 5296530 -
gacagcaatgtttatcctggtt

SEQ ID NO: 131533 - DNA, 22 bp, Artificial Sequence
  Synthetic oligonucleotide; TTT chr11 5296517 5296538 5296522 5296517 -
atcctggttagatgttttaatc

SEQ ID NO: 131534 - DNA, 22 bp, Artificial Sequence
  Synthetic oligonucleotide; TTA chr11 5296516 5296537 5296521 5296516 -
tcctggttagatgttttaatct

SEQ ID NO: 131535 - DNA, 22 bp, Artificial Sequence
  Synthetic oligonucleotide; CTG chr11 5296511 5296532 5296516 5296511 -
gttagatgttttaatctaaatc

SEQ ID NO: 131536 - DNA, 22 bp, Artificial Sequence
  Synthetic oligonucleotide; TTA chr11 5296507 5296528 5296512 5296507 -
gatgttttaatctaaatctatc

SEQ ID NO: 131537 - DNA, 22 bp, Artificial Sequence
  Synthetic oligonucleotide; TTT chr11 5296500 5296521 5296505 5296500 -
taatctaaatctatcttggagt

SEQ ID NO: 131538 - DNA, 22 bp, Artificial Sequence
  Synthetic oligonucleotide; TTT chr11 5296499 5296520 5296504 5296499 -
aatctaaatctatcttggagtg

SEQ ID NO: 131539 - DNA, 22 bp, Artificial Sequence
  Synthetic oligonucleotide; TTA chr11 5296498 5296519 5296503 5296498 -
atctaaatctatcttggagtgt

SEQ ID NO: 131540 - DNA, 22 bp, Artificial Sequence
  Synthetic oligonucleotide; CTA chr11 5296493 5296514 5296498 5296493 -
aatctatcttggagtgttaaaa

SEQ ID NO: 131541 - DNA, 22 bp, Artificial Sequence
  Synthetic oligonucleotide; CTA chr11 5296487 5296508 5296492 5296487 -
tcttggagtgttaaaatgcatt

SEQ ID NO: 131542 - DNA, 22 bp, Artificial Sequence
  Synthetic oligonucleotide; CTT chr11 5296483 5296504 5296488 5296483 -
ggagtgttaaaatgcatttgct

SEQ ID NO: 131543 - DNA, 22 bp, Artificial Sequence
  Synthetic oligonucleotide; TTG chr11 5296482 5296503 5296487 5296482 -
gagtgttaaaatgcatttgctc

SEQ ID NO: 131544 - DNA, 22 bp, Artificial Sequence
  Synthetic oligonucleotide; TTA chr11 5296474 5296495 5296479 5296474 -
aaatgcatttgctcacctactt

SEQ ID NO: 131545 - DNA, 22 bp, Artificial Sequence
  Synthetic oligonucleotide; TTT chr11 5296464 5296485 5296469 5296464 -
gctcacctactttaaaatataa

SEQ ID NO: 131546 - DNA, 22 bp, Artificial Sequence
  Synthetic oligonucleotide; TTG chr11 5296463 5296484 5296468 5296463 -
ctcacctactttaaaatataaa

SEQ ID NO: 131547 - DNA, 22 bp, Artificial Sequence
  Synthetic oligonucleotide; CTC chr11 5296460 5296481 5296465 5296460 -
acctactttaaaatataaatga

SEQ ID NO: 131548 - DNA, 22 bp, Artificial Sequence
  Synthetic oligonucleotide; CTA chr11 5296455 5296476 5296460 5296455 -
ctttaaaatataaatgaaggta

SEQ ID NO: 131549 - DNA, 22 bp, Artificial Sequence
  Synthetic oligonucleotide; CTT chr11 5296452 5296473 5296457 5296452 -
taaaatataaatgaaggtagga

SEQ ID NO: 131550 - DNA, 22 bp, Artificial Sequence
  Synthetic oligonucleotide; TTT chr11 5296451 5296472 5296456 5296451 -
aaaatataaatgaaggtaggaa

SEQ ID NO: 131551 - DNA, 22 bp, Artificial Sequence
  Synthetic oligonucleotide; TTA chr11 5296450 5296471 5296455 5296450 -
aaatataaatgaaggtaggaac

SEQ ID NO: 131552 - DNA, 22 bp, Artificial Sequence
  Synthetic oligonucleotide; CTG chr11 5296425 5296446 5296430 5296425 -
tagatacaaaaagttggagaaa

SEQ ID NO: 131553 - DNA, 22 bp, Artificial Sequence
  Synthetic oligonucleotide; TTG chr11 5296409 5296430 5296414 5296409 -
gagaaaaaaagacaataaagat

SEQ ID NO: 131554 - DNA, 22 bp, Artificial Sequence
  Synthetic oligonucleotide; CTA chr11 5296375 5296396 5296380 5296375 -
ttaatccttgatagaaaatgag

SEQ ID NO: 131555 - DNA, 22 bp, Artificial Sequence
  Synthetic oligonucleotide; TTA chr11 5296372 5296393 5296377 5296372 -
atccttgatagaaaatgagaag

SEQ ID NO: 131556 - DNA, 22 bp, Artificial Sequence
  Synthetic oligonucleotide; CTT chr11 5296366 5296387 5296371 5296366 -
gatagaaaatgagaagagataa

SEQ ID NO: 131557 - DNA, 22 bp, Artificial Sequence
  Synthetic oligonucleotide; TTG chr11 5296365 5296386 5296370 5296365 -
atagaaaatgagaagagataaa

SEQ ID NO: 131558 - DNA, 22 bp, Artificial Sequence
  Synthetic oligonucleotide; CTG chr11 5296337 5296358 5296342 5296337 -
gtttacataaagaaaataagat

SEQ ID NO: 131559 - DNA, 22 bp, Artificial Sequence
  Synthetic oligonucleotide; TTT chr11 5296333 5296354 5296338 5296333 -
acataaagaaaataagatggat

SEQ ID NO: 131560 - DNA, 22 bp, Artificial Sequence
  Synthetic oligonucleotide; TTA chr11 5296332 5296353 5296337 5296332 -
cataaagaaaataagatggata

SEQ ID NO: 131561 - DNA, 22 bp, Artificial Sequence
  Synthetic oligonucleotide; CTT chr11 5296296 5296317 5296301 5296296 -
ataaaagtgataatttgagaaa

SEQ ID NO: 131562 - DNA, 22 bp, Artificial Sequence
  Synthetic oligonucleotide; TTA chr11 5296295 5296316 5296300 5296295 -
taaaagtgataatttgagaaaa

SEQ ID NO: 131563 - DNA, 22 bp, Artificial Sequence
  Synthetic oligonucleotide; TTT chr11 5296280 5296301 5296285 5296280 -
gagaaaaaaaatactccatatt

SEQ ID NO: 131564 - DNA, 22 bp, Artificial Sequence
  Synthetic oligonucleotide; TTG chr11 5296279 5296300 5296284 5296279 -
agaaaaaaaatactccatattc

SEQ ID NO: 131565 - DNA, 22 bp, Artificial Sequence
  Synthetic oligonucleotide; CTC chr11 5296264 5296285 5296269 5296264 -
catattctgagtttcttcacat

SEQ ID NO: 131566 - DNA, 22 bp, Artificial Sequence
  Synthetic oligonucleotide; TTC chr11 5296257 5296278 5296262 5296257 -
tgagtttcttcacataaaataa

SEQ ID NO: 131567 - DNA, 22 bp, Artificial Sequence
  Synthetic oligonucleotide; CTG chr11 5296255 5296276 5296260 5296255 -
agtttcttcacataaaataata

SEQ ID NO: 131568 - DNA, 22 bp, Artificial Sequence
  Synthetic oligonucleotide; TTT chr11 5296250 5296271 5296255 5296250 -
cttcacataaaataatacaaat

SEQ ID NO: 131569 - DNA, 22 bp, Artificial Sequence
  Synthetic oligonucleotide; TTC chr11 5296249 5296270 5296254 5296249 -
ttcacataaaataatacaaatc

SEQ ID NO: 131570 - DNA, 22 bp, Artificial Sequence
  Synthetic oligonucleotide; CTT chr11 5296247 5296268 5296252 5296247 -
cacataaaataatacaaatctg

SEQ ID NO: 131571 - DNA, 22 bp, Artificial Sequence
  Synthetic oligonucleotide; TTC chr11 5296246 5296267 5296251 5296246 -
acataaaataatacaaatctgc

SEQ ID NO: 131572 - DNA, 22 bp, Artificial Sequence
  Synthetic oligonucleotide; CTG chr11 5296225 5296246 5296230 5296225 -
ctgtggtaagttacaaagagat

SEQ ID NO: 131573 - DNA, 22 bp, Artificial Sequence
  Synthetic oligonucleotide; CTG chr11 5296222 5296243 5296227 5296222 -
tggtaagttacaaagagataga

SEQ ID NO: 131574 - DNA, 22 bp, Artificial Sequence
  Synthetic oligonucleotide; TTA chr11 5296212 5296233 5296217 5296212 -
caaagagatagattttttatca

SEQ ID NO: 131575 - DNA, 22 bp, Artificial Sequence
  Synthetic oligonucleotide; TTT chr11 5296197 5296218 5296202 5296197 -
tttatcattatataaaagatat

SEQ ID NO: 131576 - DNA, 22 bp, Artificial Sequence
  Synthetic oligonucleotide; TTT chr11 5296196 5296217 5296201 5296196 -
ttatcattatataaaagatatt

SEQ ID NO: 131577 - DNA, 22 bp, Artificial Sequence
  Synthetic oligonucleotide; TTT chr11 5296195 5296216 5296200 5296195 -
tatcattatataaaagatattt

SEQ ID NO: 131578 - DNA, 22 bp, Artificial Sequence
  Synthetic oligonucleotide; TTT chr11 5296194 5296215 5296199 5296194 -
atcattatataaaagatatttt

SEQ ID NO: 131579 - DNA, 22 bp, Artificial Sequence
  Synthetic oligonucleotide; TTA chr11 5296193 5296214 5296198 5296193 -
tcattatataaaagatatttta

SEQ ID NO: 131580 - DNA, 22 bp, Artificial Sequence
  Synthetic oligonucleotide; TTA chr11 5296187 5296208 5296192 5296187 -
tataaaagatattttaaacaga

SEQ ID NO: 131581 - DNA, 22 bp, Artificial Sequence
  Synthetic oligonucleotide; TTT chr11 5296173 5296194 5296178 5296173 -
taaacagagttatacaacaaag

SEQ ID NO: 131582 - DNA, 22 bp, Artificial Sequence
  Synthetic oligonucleotide; TTT chr11 5296172 5296193 5296177 5296172 -
aaacagagttatacaacaaagg

SEQ ID NO: 131583 - DNA, 22 bp, Artificial Sequence
  Synthetic oligonucleotide; TTA chr11 5296171 5296192 5296176 5296171 -
aacagagttatacaacaaagga

SEQ ID NO: 131584 - DNA, 22 bp, Artificial Sequence
  Synthetic oligonucleotide; TTA chr11 5296161 5296182 5296166 5296161 -
tacaacaaaggaacagactatg

SEQ ID NO: 131585 - DNA, 22 bp, Artificial Sequence
  Synthetic oligonucleotide; CTA chr11 5296141 5296162 5296146 5296141 -
tgtcatatattctcacttatca

SEQ ID NO: 131586 - DNA, 22 bp, Artificial Sequence
  Synthetic oligonucleotide; TTC chr11 5296129 5296150 5296134 5296129 -
tcacttatcactataaacatct

SEQ ID NO: 131587 - DNA, 22 bp, Artificial Sequence
  Synthetic oligonucleotide; CTC chr11 5296127 5296148 5296132 5296127 -
acttatcactataaacatctca

SEQ ID NO: 131588 - DNA, 22 bp, Artificial Sequence
  Synthetic oligonucleotide; CTT chr11 5296123 5296144 5296128 5296123 -
atcactataaacatctcagaaa

SEQ ID NO: 131589 - DNA, 22 bp, Artificial Sequence
  Synthetic oligonucleotide; TTA chr11 5296122 5296143 5296127 5296122 -
tcactataaacatctcagaaaa

SEQ ID NO: 131590 - DNA, 22 bp, Artificial Sequence
  Synthetic oligonucleotide; CTA chr11 5296116 5296137 5296121 5296116 -
taaacatctcagaaaaatctgc

SEQ ID NO: 131591 - DNA, 22 bp, Artificial Sequence
  Synthetic oligonucleotide; CTC chr11 5296106 5296127 5296111 5296106 -
agaaaaatctgcaaaatcattt

SEQ ID NO: 131592 - DNA, 22 bp, Artificial Sequence
  Synthetic oligonucleotide; CTG chr11 5296095 5296116 5296100 5296095 -
caaaatcatttcatagcatttt

SEQ ID NO: 131593 - DNA, 22 bp, Artificial Sequence
  Synthetic oligonucleotide; TTT chr11 5296084 5296105 5296089 5296084 -
catagcattttaaatagttagg

SEQ ID NO: 131594 - DNA, 22 bp, Artificial Sequence
  Synthetic oligonucleotide; TTC chr11 5296083 5296104 5296088 5296083 -
atagcattttaaatagttagga

SEQ ID NO: 131595 - DNA, 22 bp, Artificial Sequence
  Synthetic oligonucleotide; TTT chr11 5296074 5296095 5296079 5296074 -
taaatagttaggaataatgtag

SEQ ID NO: 131596 - DNA, 22 bp, Artificial Sequence
  Synthetic oligonucleotide; TTT chr11 5296073 5296094 5296078 5296073 -
aaatagttaggaataatgtaga

SEQ ID NO: 131597 - DNA, 22 bp, Artificial Sequence
  Synthetic oligonucleotide; TTA chr11 5296072 5296093 5296077 5296072 -
aatagttaggaataatgtagaa

SEQ ID NO: 131598 - DNA, 22 bp, Artificial Sequence
  Synthetic oligonucleotide; TTA chr11 5296064 5296085 5296069 5296064 -
ggaataatgtagaaaactgaaa

SEQ ID NO: 131599 - DNA, 22 bp, Artificial Sequence
  Synthetic oligonucleotide; CTG chr11 5296045 5296066 5296050 5296045 -
aaacagttctaagtttcccaca

SEQ ID NO: 131600 - DNA, 22 bp, Artificial Sequence
  Synthetic oligonucleotide; TTC chr11 5296036 5296057 5296041 5296036 -
taagtttcccacaaacttagag

SEQ ID NO: 131601 - DNA, 22 bp, Artificial Sequence
  Synthetic oligonucleotide; CTA chr11 5296034 5296055 5296039 5296034 -
agtttcccacaaacttagagtc

SEQ ID NO: 131602 - DNA, 22 bp, Artificial Sequence
  Synthetic oligonucleotide; TTT chr11 5296029 5296050 5296034 5296029 -
cccacaaacttagagtctcaaa

SEQ ID NO: 131603 - DNA, 22 bp, Artificial Sequence
  Synthetic oligonucleotide; TTC chr11 5296028 5296049 5296033 5296028 -
ccacaaacttagagtctcaaat

SEQ ID NO: 131604 - DNA, 22 bp, Artificial Sequence
  Synthetic oligonucleotide; CTT chr11 5296018 5296039 5296023 5296018 -
agagtctcaaatgttgcattac

SEQ ID NO: 131605 - DNA, 22 bp, Artificial Sequence
  Synthetic oligonucleotide; TTA chr11 5296017 5296038 5296022 5296017 -
gagtctcaaatgttgcattacc

SEQ ID NO: 131606 - DNA, 22 bp, Artificial Sequence
  Synthetic oligonucleotide; CTC chr11 5296010 5296031 5296015 5296010 -
aaatgttgcattacctaactta

SEQ ID NO: 131607 - DNA, 22 bp, Artificial Sequence
  Synthetic oligonucleotide; TTG chr11 5296002 5296023 5296007 5296002 -
cattacctaacttacctgcaaa

SEQ ID NO: 131608 - DNA, 22 bp, Artificial Sequence
  Synthetic oligonucleotide; TTA chr11 5295997 5296018 5296002 5295997 -
cctaacttacctgcaaatattt

SEQ ID NO: 131609 - DNA, 22 bp, Artificial Sequence
  Synthetic oligonucleotide; CTA chr11 5295993 5296014 5295998 5295993 -
acttacctgcaaatattttata

SEQ ID NO: 131610 - DNA, 22 bp, Artificial Sequence
  Synthetic oligonucleotide; CTT chr11 5295989 5296010 5295994 5295989 -
acctgcaaatattttatacaaa

SEQ ID NO: 131611 - DNA, 22 bp, Artificial Sequence
  Synthetic oligonucleotide; TTA chr11 5295988 5296009 5295993 5295988 -
cctgcaaatattttatacaaat

SEQ ID NO: 131612 - DNA, 22 bp, Artificial Sequence
  Synthetic oligonucleotide; CTG chr11 5295984 5296005 5295989 5295984 -
caaatattttatacaaatttgc

SEQ ID NO: 131613 - DNA, 22 bp, Artificial Sequence
  Synthetic oligonucleotide; TTT chr11 5295975 5295996 5295980 5295975 -
tatacaaatttgcacatgctac

SEQ ID NO: 131614 - DNA, 22 bp, Artificial Sequence
  Synthetic oligonucleotide; TTT chr11 5295974 5295995 5295979 5295974 -
atacaaatttgcacatgctact

SEQ ID NO: 131615 - DNA, 22 bp, Artificial Sequence
  Synthetic oligonucleotide; TTA chr11 5295973 5295994 5295978 5295973 -
tacaaatttgcacatgctactc

SEQ ID NO: 131616 - DNA, 22 bp, Artificial Sequence
  Synthetic oligonucleotide; TTT chr11 5295964 5295985 5295969 5295964 -
gcacatgctactctagtcaaaa

SEQ ID NO: 131617 - DNA, 22 bp, Artificial Sequence
  Synthetic oligonucleotide; TTG chr11 5295963 5295984 5295968 5295963 -
cacatgctactctagtcaaaaa

SEQ ID NO: 131618 - DNA, 22 bp, Artificial Sequence
  Synthetic oligonucleotide; CTA chr11 5295954 5295975 5295959 5295954 -
ctctagtcaaaaatatatgtac

SEQ ID NO: 131619 - DNA, 22 bp, Artificial Sequence
  Synthetic oligonucleotide; CTC chr11 5295951 5295972 5295956 5295951 -
tagtcaaaaatatatgtacatt

SEQ ID NO: 131620 - DNA, 22 bp, Artificial Sequence
  Synthetic oligonucleotide; CTA chr11 5295949 5295970 5295954 5295949 -
gtcaaaaatatatgtacattat

SEQ ID NO: 131621 - DNA, 22 bp, Artificial Sequence
  Synthetic oligonucleotide; TTA chr11 5295928 5295949 5295933 5295928 -
tgggtattttctgtgtgtaact

SEQ ID NO: 131622 - DNA, 22 bp, Artificial Sequence
  Synthetic oligonucleotide; TTT chr11 5295919 5295940 5295924 5295919 -
tctgtgtgtaacttggttctag

SEQ ID NO: 131623 - DNA, 22 bp, Artificial Sequence
  Synthetic oligonucleotide; TTT chr11 5295918 5295939 5295923 5295918 -
ctgtgtgtaacttggttctagt

SEQ ID NO: 131624 - DNA, 22 bp, Artificial Sequence
  Synthetic oligonucleotide; TTC chr11 5295917 5295938 5295922 5295917 -
tgtgtgtaacttggttctagtt

SEQ ID NO: 131625 - DNA, 22 bp, Artificial Sequence
  Synthetic oligonucleotide; CTG chr11 5295915 5295936 5295920 5295915 -
tgtgtaacttggttctagttgc

SEQ ID NO: 131626 - DNA, 22 bp, Artificial Sequence
  Synthetic oligonucleotide; CTT chr11 5295905 5295926 5295910 5295905 -
ggttctagttgcttctttcaga

SEQ ID NO: 131627 - DNA, 22 bp, Artificial Sequence
  Synthetic oligonucleotide; TTG chr11 5295904 5295925 5295909 5295904 -
gttctagttgcttctttcagaa

SEQ ID NO: 131628 - DNA, 22 bp, Artificial Sequence
  Synthetic oligonucleotide; TTC chr11 5295900 5295921 5295905 5295900 -
tagttgcttctttcagaaatag

SEQ ID NO: 131629 - DNA, 22 bp, Artificial Sequence
  Synthetic oligonucleotide; CTA chr11 5295898 5295919 5295903 5295898 -
gttgcttctttcagaaatagcc

SEQ ID NO: 131630 - DNA, 22 bp, Artificial Sequence
  Synthetic oligonucleotide; TTG chr11 5295894 5295915 5295899 5295894 -
cttctttcagaaatagcctcta

SEQ ID NO: 131631 - DNA, 22 bp, Artificial Sequence
  Synthetic oligonucleotide; CTT chr11 5295891 5295912 5295896 5295891 -
ctttcagaaatagcctctattt

SEQ ID NO: 131632 - DNA, 22 bp, Artificial Sequence
  Synthetic oligonucleotide; TTC chr11 5295890 5295911 5295895 5295890 -
tttcagaaatagcctctatttt

SEQ ID NO: 131633 - DNA, 22 bp, Artificial Sequence
  Synthetic oligonucleotide; CTT chr11 5295888 5295909 5295893 5295888 -
tcagaaatagcctctatttttg

SEQ ID NO: 131634 - DNA, 22 bp, Artificial Sequence
  Synthetic oligonucleotide; TTT chr11 5295887 5295908 5295892 5295887 -
cagaaatagcctctatttttga

SEQ ID NO: 131635 - DNA, 22 bp, Artificial Sequence
  Synthetic oligonucleotide; TTC chr11 5295886 5295907 5295891 5295886 -
agaaatagcctctatttttgat

SEQ ID NO: 131636 - DNA, 22 bp, Artificial Sequence
  Synthetic oligonucleotide; CTC chr11 5295874 5295895 5295879 5295874 -
tatttttgatttacctgataaa

SEQ ID NO: 131637 - DNA, 22 bp, Artificial Sequence
  Synthetic oligonucleotide; CTA chr11 5295872 5295893 5295877 5295872 -
tttttgatttacctgataaaat

SEQ ID NO: 131638 - DNA, 22 bp, Artificial Sequence
  Synthetic oligonucleotide; TTT chr11 5295869 5295890 5295874 5295869 -
ttgatttacctgataaaatcac

SEQ ID NO: 131639 - DNA, 22 bp, Artificial Sequence
  Synthetic oligonucleotide; TTT chr11 5295868 5295889 5295873 5295868 -
tgatttacctgataaaatcaca

SEQ ID NO: 131640 - DNA, 22 bp, Artificial Sequence
  Synthetic oligonucleotide; TTT chr11 5295867 5295888 5295872 5295867 -
gatttacctgataaaatcacat

SEQ ID NO: 131641 - DNA, 22 bp, Artificial Sequence
  Synthetic oligonucleotide; TTG chr11 5295866 5295887 5295871 5295866 -
atttacctgataaaatcacatt

SEQ ID NO: 131642 - DNA, 22 bp, Artificial Sequence
  Synthetic oligonucleotide; TTT chr11 5295862 5295883 5295867 5295862 -
acctgataaaatcacattcctc

SEQ ID NO: 131643 - DNA, 22 bp, Artificial Sequence
  Synthetic oligonucleotide; TTA chr11 5295861 5295882 5295866 5295861 -
cctgataaaatcacattcctct

SEQ ID NO: 131644 - DNA, 22 bp, Artificial Sequence
  Synthetic oligonucleotide; CTG chr11 5295857 5295878 5295862 5295857 -
ataaaatcacattcctctccaa

SEQ ID NO: 131645 - DNA, 22 bp, Artificial Sequence
  Synthetic oligonucleotide; TTC chr11 5295843 5295864 5295848 5295843 -
ctctccaaagccttctaaatac

SEQ ID NO: 131646 - DNA, 22 bp, Artificial Sequence
  Synthetic oligonucleotide; CTC chr11 5295840 5295861 5295845 5295840 -
tccaaagccttctaaatacttc

SEQ ID NO: 131647 - DNA, 22 bp, Artificial Sequence
  Synthetic oligonucleotide; CTC chr11 5295838 5295859 5295843 5295838 -
caaagccttctaaatacttcca

SEQ ID NO: 131648 - DNA, 22 bp, Artificial Sequence
  Synthetic oligonucleotide; CTT chr11 5295829 5295850 5295834 5295829 -
ctaaatacttccagactaacta

SEQ ID NO: 131649 - DNA, 22 bp, Artificial Sequence
  Synthetic oligonucleotide; TTC chr11 5295828 5295849 5295833 5295828 -
taaatacttccagactaactac

SEQ ID NO: 131650 - DNA, 22 bp, Artificial Sequence
  Synthetic oligonucleotide; CTA chr11 5295826 5295847 5295831 5295826 -
aatacttccagactaactactt

SEQ ID NO: 131651 - DNA, 22 bp, Artificial Sequence
  Synthetic oligonucleotide; CTT chr11 5295819 5295840 5295824 5295819 -
ccagactaactactttttagta

SEQ ID NO: 131652 - DNA, 22 bp, Artificial Sequence
  Synthetic oligonucleotide; TTC chr11 5295818 5295839 5295823 5295818 -
cagactaactactttttagtac

SEQ ID NO: 131653 - DNA, 22 bp, Artificial Sequence
  Synthetic oligonucleotide; CTA chr11 5295811 5295832 5295816 5295811 -
actactttttagtacatctaag

SEQ ID NO: 131654 - DNA, 22 bp, Artificial Sequence
  Synthetic oligonucleotide; CTA chr11 5295807 5295828 5295812 5295807 -
ctttttagtacatctaagaaga

SEQ ID NO: 131655 - DNA, 22 bp, Artificial Sequence
  Synthetic oligonucleotide; CTT chr11 5295804 5295825 5295809 5295804 -
tttagtacatctaagaagaaaa

SEQ ID NO: 131656 - DNA, 22 bp, Artificial Sequence
  Synthetic oligonucleotide; TTT chr11 5295803 5295824 5295808 5295803 -
ttagtacatctaagaagaaaag

SEQ ID NO: 131657 - DNA, 22 bp, Artificial Sequence
  Synthetic oligonucleotide; TTT chr11 5295802 5295823 5295807 5295802 -
tagtacatctaagaagaaaaga

SEQ ID NO: 131658 - DNA, 22 bp, Artificial Sequence
  Synthetic oligonucleotide; TTT chr11 5295801 5295822 5295806 5295801 -
agtacatctaagaagaaaagag

SEQ ID NO: 131659 - DNA, 22 bp, Artificial Sequence
  Synthetic oligonucleotide; TTA chr11 5295800 5295821 5295805 5295800 -
gtacatctaagaagaaaagagt

SEQ ID NO: 131660 - DNA, 22 bp, Artificial Sequence
  Synthetic oligonucleotide; CTA chr11 5295791 5295812 5295796 5295791 -
agaagaaaagagttttgtctct

SEQ ID NO: 131661 - DNA, 22 bp, Artificial Sequence
  Synthetic oligonucleotide; TTT chr11 5295776 5295797 5295781 5295776 -
tgtctcttatccacctctgagt

SEQ ID NO: 131662 - DNA, 22 bp, Artificial Sequence
  Synthetic oligonucleotide; TTT chr11 5295775 5295796 5295780 5295775 -
gtctcttatccacctctgagtc

SEQ ID NO: 131663 - DNA, 22 bp, Artificial Sequence
  Synthetic oligonucleotide; TTG chr11 5295774 5295795 5295779 5295774 -
tctcttatccacctctgagtca

SEQ ID NO: 131664 - DNA, 22 bp, Artificial Sequence
  Synthetic oligonucleotide; CTC chr11 5295770 5295791 5295775 5295770 -
ttatccacctctgagtcaaaaa

SEQ ID NO: 131665 - DNA, 22 bp, Artificial Sequence
  Synthetic oligonucleotide; CTT chr11 5295768 5295789 5295773 5295768 -
atccacctctgagtcaaaaagc

SEQ ID NO: 131666 - DNA, 22 bp, Artificial Sequence
  Synthetic oligonucleotide; TTA chr11 5295767 5295788 5295772 5295767 -
tccacctctgagtcaaaaagca

SEQ ID NO: 131667 - DNA, 22 bp, Artificial Sequence
  Synthetic oligonucleotide; CTC chr11 5295759 5295780 5295764 5295759 -
tgagtcaaaaagcagcatgtcc

SEQ ID NO: 131668 - DNA, 22 bp, Artificial Sequence
  Synthetic oligonucleotide; CTG chr11 5295757 5295778 5295762 5295757 -
agtcaaaaagcagcatgtccat

SEQ ID NO: 131669 - DNA, 22 bp, Artificial Sequence
  Synthetic oligonucleotide; TTG chr11 5295729 5295750 5295734 5295729 -
gtacatagttcccacagcccca

SEQ ID NO: 131670 - DNA, 22 bp, Artificial Sequence
  Synthetic oligonucleotide; TTC chr11 5295718 5295739 5295723 5295718 -
ccacagccccacttagctctgg

SEQ ID NO: 131671 - DNA, 22 bp, Artificial Sequence
  Synthetic oligonucleotide; CTT chr11 5295704 5295725 5295709 5295704 -
agctctggattggagttctact

SEQ ID NO: 131672 - DNA, 22 bp, Artificial Sequence
  Synthetic oligonucleotide; TTA chr11 5295703 5295724 5295708 5295703 -
gctctggattggagttctactt

SEQ ID NO: 131673 - DNA, 22 bp, Artificial Sequence
  Synthetic oligonucleotide; CTC chr11 5295699 5295720 5295704 5295699 -
tggattggagttctacttggca

SEQ ID NO: 131674 - DNA, 22 bp, Artificial Sequence
  Synthetic oligonucleotide; CTG chr11 5295697 5295718 5295702 5295697 -
gattggagttctacttggcatt

SEQ ID NO: 131675 - DNA, 22 bp, Artificial Sequence
  Synthetic oligonucleotide; TTG chr11 5295692 5295713 5295697 5295692 -
gagttctacttggcattgtttg

SEQ ID NO: 131676 - DNA, 22 bp, Artificial Sequence
  Synthetic oligonucleotide; TTC chr11 5295686 5295707 5295691 5295686 -
tacttggcattgtttgcaacta

SEQ ID NO: 131677 - DNA, 22 bp, Artificial Sequence
  Synthetic oligonucleotide; CTA chr11 5295684 5295705 5295689 5295684 -
cttggcattgtttgcaactaca

SEQ ID NO: 131678 - DNA, 22 bp, Artificial Sequence
  Synthetic oligonucleotide; CTT chr11 5295681 5295702 5295686 5295681 -
ggcattgtttgcaactacatgg

SEQ ID NO: 131679 - DNA, 22 bp, Artificial Sequence
  Synthetic oligonucleotide; TTG chr11 5295680 5295701 5295685 5295680 -
gcattgtttgcaactacatgga

SEQ ID NO: 131680 - DNA, 22 bp, Artificial Sequence
  Synthetic oligonucleotide; TTG chr11 5295674 5295695 5295679 5295674 -
tttgcaactacatggacgtaaa

SEQ ID NO: 131681 - DNA, 22 bp, Artificial Sequence
  Synthetic oligonucleotide; TTT chr11 5295671 5295692 5295676 5295671 -
gcaactacatggacgtaaaatg

SEQ ID NO: 131682 - DNA, 22 bp, Artificial Sequence
  Synthetic oligonucleotide; TTG chr11 5295670 5295691 5295675 5295670 -
caactacatggacgtaaaatgc

SEQ ID NO: 131683 - DNA, 22 bp, Artificial Sequence
  Synthetic oligonucleotide; CTA chr11 5295664 5295685 5295669 5295664 -
catggacgtaaaatgcatggat

SEQ ID NO: 131684 - DNA, 22 bp, Artificial Sequence
  Synthetic oligonucleotide; TTC chr11 5295640 5295661 5295645 5295640 -
tcttgaaaaaatgtttctgcca

SEQ ID NO: 131685 - DNA, 22 bp, Artificial Sequence
  Synthetic oligonucleotide; CTC chr11 5295638 5295659 5295643 5295638 -
ttgaaaaaatgtttctgccatg

SEQ ID NO: 131686 - DNA, 22 bp, Artificial Sequence
  Synthetic oligonucleotide; CTT chr11 5295636 5295657 5295641 5295636 -
gaaaaaatgtttctgccatgat

SEQ ID NO: 131687 - DNA, 22 bp, Artificial Sequence
  Synthetic oligonucleotide; TTG chr11 5295635 5295656 5295640 5295635 -
aaaaaatgtttctgccatgatg

SEQ ID NO: 131688 - DNA, 22 bp, Artificial Sequence
  Synthetic oligonucleotide; TTT chr11 5295624 5295645 5295629 5295624 -
ctgccatgatgttctctgaaag

SEQ ID NO: 131689 - DNA, 22 bp, Artificial Sequence
  Synthetic oligonucleotide; TTC chr11 5295623 5295644 5295628 5295623 -
tgccatgatgttctctgaaaga

SEQ ID NO: 131690 - DNA, 22 bp, Artificial Sequence
  Synthetic oligonucleotide; CTG chr11 5295621 5295642 5295626 5295621 -
ccatgatgttctctgaaagaga

SEQ ID NO: 131691 - DNA, 22 bp, Artificial Sequence
  Synthetic oligonucleotide; TTC chr11 5295610 5295631 5295615 5295610 -
tctgaaagagactaaccttccc

SEQ ID NO: 131692 - DNA, 22 bp, Artificial Sequence
  Synthetic oligonucleotide; CTC chr11 5295608 5295629 5295613 5295608 -
tgaaagagactaaccttccctc

SEQ ID NO: 131693 - DNA, 22 bp, Artificial Sequence
  Synthetic oligonucleotide; CTG chr11 5295606 5295627 5295611 5295606 -
aaagagactaaccttccctcgc

SEQ ID NO: 131694 - DNA, 22 bp, Artificial Sequence
  Synthetic oligonucleotide; CTA chr11 5295596 5295617 5295601 5295596 -
accttccctcgctttgcagaga

SEQ ID NO: 131695 - DNA, 22 bp, Artificial Sequence
  Synthetic oligonucleotide; CTT chr11 5295591 5295612 5295596 5295591 -
ccctcgctttgcagagaaagac

SEQ ID NO: 131696 - DNA, 22 bp, Artificial Sequence
  Synthetic oligonucleotide; TTC chr11 5295590 5295611 5295595 5295590 -
cctcgctttgcagagaaagact

SEQ ID NO: 131697 - DNA, 22 bp, Artificial Sequence
  Synthetic oligonucleotide; CTC chr11 5295586 5295607 5295591 5295586 -
gctttgcagagaaagactcgtg

SEQ ID NO: 131698 - DNA, 22 bp, Artificial Sequence
  Synthetic oligonucleotide; CTT chr11 5295582 5295603 5295587 5295582 -
tgcagagaaagactcgtgtaat

SEQ ID NO: 131699 - DNA, 22 bp, Artificial Sequence
  Synthetic oligonucleotide; TTT chr11 5295581 5295602 5295586 5295581 -
gcagagaaagactcgtgtaatc

SEQ ID NO: 131700 - DNA, 22 bp, Artificial Sequence
  Synthetic oligonucleotide; TTG chr11 5295580 5295601 5295585 5295580 -
cagagaaagactcgtgtaatcc

SEQ ID NO: 131701 - DNA, 22 bp, Artificial Sequence
  Synthetic oligonucleotide; CTC chr11 5295567 5295588 5295572 5295567 -
gtgtaatccttgacaatgtcat

SEQ ID NO: 131702 - DNA, 22 bp, Artificial Sequence
  Synthetic oligonucleotide; CTT chr11 5295556 5295577 5295561 5295556 -
gacaatgtcatctcatctattt

SEQ ID NO: 131703 - DNA, 22 bp, Artificial Sequence
  Synthetic oligonucleotide; TTG chr11 5295555 5295576 5295560 5295555 -
acaatgtcatctcatctattta

SEQ ID NO: 131704 - DNA, 22 bp, Artificial Sequence
  Synthetic oligonucleotide; CTC chr11 5295542 5295563 5295547 5295542 -
atctatttattcccatgtctac

SEQ ID NO: 131705 - DNA, 22 bp, Artificial Sequence
  Synthetic oligonucleotide; CTA chr11 5295537 5295558 5295542 5295537 -
tttattcccatgtctacccata

SEQ ID NO: 131706 - DNA, 22 bp, Artificial Sequence
  Synthetic oligonucleotide; TTT chr11 5295534 5295555 5295539 5295534 -
attcccatgtctacccatatgt

SEQ ID NO: 131707 - DNA, 22 bp, Artificial Sequence
  Synthetic oligonucleotide; TTA chr11 5295533 5295554 5295538 5295533 -
ttcccatgtctacccatatgtg

SEQ ID NO: 131708 - DNA, 22 bp, Artificial Sequence
  Synthetic oligonucleotide; TTC chr11 5295530 5295551 5295535 5295530 -
ccatgtctacccatatgtgacc

SEQ ID NO: 131709 - DNA, 22 bp, Artificial Sequence
  Synthetic oligonucleotide; CTA chr11 5295521 5295542 5295526 5295521 -
cccatatgtgaccttcatgtct

SEQ ID NO: 131710 - DNA, 22 bp, Artificial Sequence
  Synthetic oligonucleotide; CTT chr11 5295506 5295527 5295511 5295506 -
catgtctttgctctaagcccct

SEQ ID NO: 131711 - DNA, 22 bp, Artificial Sequence
  Synthetic oligonucleotide; TTC chr11 5295505 5295526 5295510 5295505 -
atgtctttgctctaagccccta

SEQ ID NO: 131712 - DNA, 22 bp, Artificial Sequence
  Synthetic oligonucleotide; CTT chr11 5295498 5295519 5295503 5295498 -
tgctctaagcccctacatcctc

SEQ ID NO: 131713 - DNA, 22 bp, Artificial Sequence
  Synthetic oligonucleotide; TTT chr11 5295497 5295518 5295502 5295497 -
gctctaagcccctacatcctca

SEQ ID NO: 131714 - DNA, 22 bp, Artificial Sequence
  Synthetic oligonucleotide; TTG chr11 5295496 5295517 5295501 5295496 -
ctctaagcccctacatcctcaa

SEQ ID NO: 131715 - DNA, 22 bp, Artificial Sequence
  Synthetic oligonucleotide; CTC chr11 5295493 5295514 5295498 5295493 -
taagcccctacatcctcaatct

SEQ ID NO: 131716 - DNA, 22 bp, Artificial Sequence
  Synthetic oligonucleotide; CTA chr11 5295491 5295512 5295496 5295491 -
agcccctacatcctcaatctac

SEQ ID NO: 131717 - DNA, 22 bp, Artificial Sequence
  Synthetic oligonucleotide; CTA chr11 5295483 5295504 5295488 5295483 -
catcctcaatctacacactagg

SEQ ID NO: 131718 - DNA, 22 bp, Artificial Sequence
  Synthetic oligonucleotide; CTC chr11 5295476 5295497 5295481 5295476 -
aatctacacactaggatagtat

SEQ ID NO: 131719 - DNA, 22 bp, Artificial Sequence
  Synthetic oligonucleotide; CTA chr11 5295470 5295491 5295475 5295470 -
cacactaggatagtataaaagt

SEQ ID NO: 131720 - DNA, 22 bp, Artificial Sequence
  Synthetic oligonucleotide; CTA chr11 5295463 5295484 5295468 5295463 -
ggatagtataaaagtaatagta

SEQ ID NO: 131721 - DNA, 22 bp, Artificial Sequence
  Synthetic oligonucleotide; TTA chr11 5295405 5295426 5295410 5295405 -
tggcttatactatacacaagac

SEQ ID NO: 131722 - DNA, 22 bp, Artificial Sequence
  Synthetic oligonucleotide; CTT chr11 5295399 5295420 5295404 5295399 -
atactatacacaagacactgtt

SEQ ID NO: 131723 - DNA, 22 bp, Artificial Sequence
  Synthetic oligonucleotide; TTA chr11 5295398 5295419 5295403 5295398 -
tactatacacaagacactgttg

SEQ ID NO: 131724 - DNA, 22 bp, Artificial Sequence
  Synthetic oligonucleotide; CTA chr11 5295393 5295414 5295398 5295393 -
tacacaagacactgttgatata

SEQ ID NO: 131725 - DNA, 22 bp, Artificial Sequence
  Synthetic oligonucleotide; CTG chr11 5295379 5295400 5295384 5295379 -
ttgatatattatttcatttagt

SEQ ID NO: 131726 - DNA, 22 bp, Artificial Sequence
  Synthetic oligonucleotide; TTG chr11 5295376 5295397 5295381 5295376 -
atatattatttcatttagtatt

SEQ ID NO: 131727 - DNA, 22 bp, Artificial Sequence
  Synthetic oligonucleotide; TTA chr11 5295368 5295389 5295373 5295368 -
tttcatttagtattcacagtaa

SEQ ID NO: 131728 - DNA, 22 bp, Artificial Sequence
  Synthetic oligonucleotide; TTT chr11 5295365 5295386 5295370 5295365 -
catttagtattcacagtaactc

SEQ ID NO: 131729 - DNA, 22 bp, Artificial Sequence
  Synthetic oligonucleotide; TTC chr11 5295364 5295385 5295369 5295364 -
atttagtattcacagtaactct

SEQ ID NO: 131730 - DNA, 22 bp, Artificial Sequence
  Synthetic oligonucleotide; TTT chr11 5295360 5295381 5295365 5295360 -
agtattcacagtaactctgtgc

SEQ ID NO: 131731 - DNA, 22 bp, Artificial Sequence
  Synthetic oligonucleotide; TTA chr11 5295359 5295380 5295364 5295359 -
gtattcacagtaactctgtgcc

SEQ ID NO: 131732 - DNA, 22 bp, Artificial Sequence
  Synthetic oligonucleotide; TTC chr11 5295353 5295374 5295358 5295353 -
acagtaactctgtgcctcaagt

SEQ ID NO: 131733 - DNA, 22 bp, Artificial Sequence
  Synthetic oligonucleotide; CTC chr11 5295343 5295364 5295348 5295343 -
tgtgcctcaagtactattgtaa

SEQ ID NO: 131734 - DNA, 22 bp, Artificial Sequence
  Synthetic oligonucleotide; CTG chr11 5295341 5295362 5295346 5295341 -
tgcctcaagtactattgtaata

SEQ ID NO: 131735 - DNA, 22 bp, Artificial Sequence
  Synthetic oligonucleotide; CTC chr11 5295335 5295356 5295340 5295335 -
aagtactattgtaatacccttt

SEQ ID NO: 131736 - DNA, 22 bp, Artificial Sequence
  Synthetic oligonucleotide; CTA chr11 5295327 5295348 5295332 5295327 -
ttgtaataccctttaagaggag

SEQ ID NO: 131737 - DNA, 22 bp, Artificial Sequence
  Synthetic oligonucleotide; TTG chr11 5295324 5295345 5295329 5295324 -
taataccctttaagaggaggaa

SEQ ID NO: 131738 - DNA, 22 bp, Artificial Sequence
  Synthetic oligonucleotide; CTT chr11 5295314 5295335 5295319 5295314 -
taagaggaggaaactgaggcac

SEQ ID NO: 131739 - DNA, 22 bp, Artificial Sequence
  Synthetic oligonucleotide; TTT chr11 5295313 5295334 5295318 5295313 -
aagaggaggaaactgaggcaca

SEQ ID NO: 131740 - DNA, 22 bp, Artificial Sequence
  Synthetic oligonucleotide; TTA chr11 5295312 5295333 5295317 5295312 -
agaggaggaaactgaggcacag

SEQ ID NO: 131741 - DNA, 22 bp, Artificial Sequence
  Synthetic oligonucleotide; CTG chr11 5295298 5295319 5295303 5295298 -
aggcacagggccctaaagtaat

SEQ ID NO: 131742 - DNA, 22 bp, Artificial Sequence
  Synthetic oligonucleotide; CTA chr11 5295283 5295304 5295288 5295283 -
aagtaatattccaagatgaagt

SEQ ID NO: 131743 - DNA, 22 bp, Artificial Sequence
  Synthetic oligonucleotide; TTC chr11 5295272 5295293 5295277 5295272 -
caagatgaagtggctactaact

SEQ ID NO: 131744 - DNA, 22 bp, Artificial Sequence
  Synthetic oligonucleotide; CTA chr11 5295256 5295277 5295261 5295256 -
ctaactgacagagggcataatt

SEQ ID NO: 131745 - DNA, 22 bp, Artificial Sequence
  Synthetic oligonucleotide; CTA chr11 5295253 5295274 5295258 5295253 -
actgacagagggcataattcaa

SEQ ID NO: 131746 - DNA, 22 bp, Artificial Sequence
  Synthetic oligonucleotide; CTG chr11 5295249 5295270 5295254 5295249 -
acagagggcataattcaactca

SEQ ID NO: 131747 - DNA, 22 bp, Artificial Sequence
  Synthetic oligonucleotide; TTC chr11 5295233 5295254 5295238 5295233 -
aactcatgatatttggctctag

SEQ ID NO: 131748 - DNA, 22 bp, Artificial Sequence
  Synthetic oligonucleotide; CTC chr11 5295228 5295249 5295233 5295228 -
atgatatttggctctagaatac

SEQ ID NO: 131749 - DNA, 22 bp, Artificial Sequence
  Synthetic oligonucleotide; TTT chr11 5295219 5295240 5295224 5295219 -
ggctctagaatacatgctctga

SEQ ID NO: 131750 - DNA, 22 bp, Artificial Sequence
  Synthetic oligonucleotide; TTG chr11 5295218 5295239 5295223 5295218 -
gctctagaatacatgctctgaa

SEQ ID NO: 131751 - DNA, 22 bp, Artificial Sequence
  Synthetic oligonucleotide; CTC chr11 5295214 5295235 5295219 5295214 -
tagaatacatgctctgaatcat

SEQ ID NO: 131752 - DNA, 22 bp, Artificial Sequence
  Synthetic oligonucleotide; CTA chr11 5295212 5295233 5295217 5295212 -
gaatacatgctctgaatcatta

SEQ ID NO: 131753 - DNA, 22 bp, Artificial Sequence
  Synthetic oligonucleotide; CTC chr11 5295200 5295221 5295205 5295200 -
tgaatcattatacaataataat

SEQ ID NO: 131754 - DNA, 22 bp, Artificial Sequence
  Synthetic oligonucleotide; CTG chr11 5295198 5295219 5295203 5295198 -
aatcattatacaataataattc

SEQ ID NO: 131755 - DNA, 22 bp, Artificial Sequence
  Synthetic oligonucleotide; TTA chr11 5295190 5295211 5295195 5295190 -
tacaataataattcatgaggaa

SEQ ID NO: 131756 - DNA, 22 bp, Artificial Sequence
  Synthetic oligonucleotide; TTC chr11 5295176 5295197 5295181 5295176 -
atgaggaaacattttttaaagc

SEQ ID NO: 131757 - DNA, 22 bp, Artificial Sequence
  Synthetic oligonucleotide; TTT chr11 5295162 5295183 5295167 5295162 -
tttaaagcctaagttatttgct

SEQ ID NO: 131758 - DNA, 22 bp, Artificial Sequence
  Synthetic oligonucleotide; TTT chr11 5295161 5295182 5295166 5295161 -
ttaaagcctaagttatttgctc

SEQ ID NO: 131759 - DNA, 22 bp, Artificial Sequence
  Synthetic oligonucleotide; TTT chr11 5295160 5295181 5295165 5295160 -
taaagcctaagttatttgctct

SEQ ID NO: 131760 - DNA, 22 bp, Artificial Sequence
  Synthetic oligonucleotide; TTT chr11 5295159 5295180 5295164 5295159 -
aaagcctaagttatttgctctg

SEQ ID NO: 131761 - DNA, 22 bp, Artificial Sequence
  Synthetic oligonucleotide; TTA chr11 5295158 5295179 5295163 5295158 -
aagcctaagttatttgctctga

SEQ ID NO: 131762 - DNA, 22 bp, Artificial Sequence
  Synthetic oligonucleotide; CTA chr11 5295151 5295172 5295156 5295151 -
agttatttgctctgaaataaga

SEQ ID NO: 131763 - DNA, 22 bp, Artificial Sequence
  Synthetic oligonucleotide; TTA chr11 5295146 5295167 5295151 5295146 -
tttgctctgaaataagacataa

SEQ ID NO: 131764 - DNA, 22 bp, Artificial Sequence
  Synthetic oligonucleotide; TTT chr11 5295143 5295164 5295148 5295143 -
gctctgaaataagacataattt

SEQ ID NO: 131765 - DNA, 22 bp, Artificial Sequence
  Synthetic oligonucleotide; TTG chr11 5295142 5295163 5295147 5295142 -
ctctgaaataagacataatttg

SEQ ID NO: 131766 - DNA, 22 bp, Artificial Sequence
  Synthetic oligonucleotide; CTC chr11 5295139 5295160 5295144 5295139 -
tgaaataagacataatttgggg

SEQ ID NO: 131767 - DNA, 22 bp, Artificial Sequence
  Synthetic oligonucleotide; CTG chr11 5295137 5295158 5295142 5295137 -
aaataagacataatttggggtg

SEQ ID NO: 131768 - DNA, 22 bp, Artificial Sequence
  Synthetic oligonucleotide; TTT chr11 5295121 5295142 5295126 5295121 -
ggggtgagaaagcttagattcc

SEQ ID NO: 131769 - DNA, 22 bp, Artificial Sequence
  Synthetic oligonucleotide; TTG chr11 5295120 5295141 5295125 5295120 -
gggtgagaaagcttagattcca

SEQ ID NO: 131770 - DNA, 22 bp, Artificial Sequence
  Synthetic oligonucleotide; CTT chr11 5295106 5295127 5295111 5295106 -
agattccatgaagtattacagc

SEQ ID NO: 131771 - DNA, 22 bp, Artificial Sequence
  Synthetic oligonucleotide; TTA chr11 5295105 5295126 5295110 5295105 -
gattccatgaagtattacagca

SEQ ID NO: 131772 - DNA, 22 bp, Artificial Sequence
  Synthetic oligonucleotide; TTC chr11 5295100 5295121 5295105 5295100 -
catgaagtattacagcatttgg

SEQ ID NO: 131773 - DNA, 22 bp, Artificial Sequence
  Synthetic oligonucleotide; TTA chr11 5295088 5295109 5295093 5295088 -
cagcatttggtagtctttttgc

SEQ ID NO: 131774 - DNA, 22 bp, Artificial Sequence
  Synthetic oligonucleotide; TTT chr11 5295080 5295101 5295085 5295080 -
ggtagtctttttgcactccagg

SEQ ID NO: 131775 - DNA, 22 bp, Artificial Sequence
  Synthetic oligonucleotide; TTG chr11 5295079 5295100 5295084 5295079 -
gtagtctttttgcactccaggt

SEQ ID NO: 131776 - DNA, 22 bp, Artificial Sequence
  Synthetic oligonucleotide; CTT chr11 5295071 5295092 5295076 5295071 -
tttgcactccaggtcttatttt

SEQ ID NO: 131777 - DNA, 22 bp, Artificial Sequence
  Synthetic oligonucleotide; TTT chr11 5295070 5295091 5295075 5295070 -
ttgcactccaggtcttattttt

SEQ ID NO: 131778 - DNA, 22 bp, Artificial Sequence
  Synthetic oligonucleotide; TTT chr11 5295069 5295090 5295074 5295069 -
tgcactccaggtcttattttta

SEQ ID NO: 131779 - DNA, 22 bp, Artificial Sequence
  Synthetic oligonucleotide; TTT chr11 5295068 5295089 5295073 5295068 -
gcactccaggtcttatttttac

SEQ ID NO: 131780 - DNA, 22 bp, Artificial Sequence
  Synthetic oligonucleotide; TTG chr11 5295067 5295088 5295072 5295067 -
cactccaggtcttatttttact

SEQ ID NO: 131781 - DNA, 22 bp, Artificial Sequence
  Synthetic oligonucleotide; CTC chr11 5295062 5295083 5295067 5295062 -
caggtcttatttttactgctta

SEQ ID NO: 131782 - DNA, 22 bp, Artificial Sequence
  Synthetic oligonucleotide; CTT chr11 5295054 5295075 5295059 5295054 -
atttttactgcttaaacataat

SEQ ID NO: 131783 - DNA, 22 bp, Artificial Sequence
  Synthetic oligonucleotide; TTA chr11 5295053 5295074 5295058 5295053 -
tttttactgcttaaacataata

SEQ ID NO: 131784 - DNA, 22 bp, Artificial Sequence
  Synthetic oligonucleotide; TTT chr11 5295050 5295071 5295055 5295050 -
ttactgcttaaacataataaaa

SEQ ID NO: 131785 - DNA, 22 bp, Artificial Sequence
  Synthetic oligonucleotide; TTT chr11 5295049 5295070 5295054 5295049 -
tactgcttaaacataataaaac

SEQ ID NO: 131786 - DNA, 22 bp, Artificial Sequence
  Synthetic oligonucleotide; TTT chr11 5295048 5295069 5295053 5295048 -
actgcttaaacataataaaaca

SEQ ID NO: 131787 - DNA, 22 bp, Artificial Sequence
  Synthetic oligonucleotide; TTA chr11 5295047 5295068 5295052 5295047 -
ctgcttaaacataataaaacat

SEQ ID NO: 131788 - DNA, 22 bp, Artificial Sequence
  Synthetic oligonucleotide; CTG chr11 5295044 5295065 5295049 5295044 -
cttaaacataataaaacatatg

SEQ ID NO: 131789 - DNA, 22 bp, Artificial Sequence
  Synthetic oligonucleotide; CTT chr11 5295041 5295062 5295046 5295041 -
aaacataataaaacatatggtt

SEQ ID NO: 131790 - DNA, 22 bp, Artificial Sequence
  Synthetic oligonucleotide; TTA chr11 5295040 5295061 5295045 5295040 -
aacataataaaacatatggttc

SEQ ID NO: 131791 - DNA, 22 bp, Artificial Sequence
  Synthetic oligonucleotide; TTC chr11 5295018 5295039 5295023 5295018 -
agtatgcctttgattttacaat

SEQ ID NO: 131792 - DNA, 22 bp, Artificial Sequence
  Synthetic oligonucleotide; CTT chr11 5295008 5295029 5295013 5295008 -
tgattttacaataatattcctg

SEQ ID NO: 131793 - DNA, 22 bp, Artificial Sequence
  Synthetic oligonucleotide; TTT chr11 5295007 5295028 5295012 5295007 -
gattttacaataatattcctgt

SEQ ID NO: 131794 - DNA, 22 bp, Artificial Sequence
  Synthetic oligonucleotide; TTG chr11 5295006 5295027 5295011 5295006 -
attttacaataatattcctgtt

SEQ ID NO: 131795 - DNA, 22 bp, Artificial Sequence
  Synthetic oligonucleotide; TTT chr11 5295002 5295023 5295007 5295002 -
tacaataatattcctgttattt

SEQ ID NO: 131796 - DNA, 22 bp, Artificial Sequence
  Synthetic oligonucleotide; TTT chr11 5295001 5295022 5295006 5295001 -
acaataatattcctgttatttt

SEQ ID NO: 131797 - DNA, 22 bp, Artificial Sequence
  Synthetic oligonucleotide; TTA chr11 5295000 5295021 5295005 5295000 -
caataatattcctgttattttt

SEQ ID NO: 131798 - DNA, 22 bp, Artificial Sequence
  Synthetic oligonucleotide; TTC chr11 5294989 5295010 5294994 5294989 -
ctgttatttttggaagcacagg

SEQ ID NO: 131799 - DNA, 22 bp, Artificial Sequence
  Synthetic oligonucleotide; CTG chr11 5294986 5295007 5294991 5294986 -
ttatttttggaagcacagggtg

SEQ ID NO: 131800 - DNA, 22 bp, Artificial Sequence
  Synthetic oligonucleotide; TTA chr11 5294983 5295004 5294988 5294983 -
tttttggaagcacagggtgtgg

SEQ ID NO: 131801 - DNA, 22 bp, Artificial Sequence
  Synthetic oligonucleotide; TTT chr11 5294980 5295001 5294985 5294980 -
ttggaagcacagggtgtgggat

SEQ ID NO: 131802 - DNA, 22 bp, Artificial Sequence
  Synthetic oligonucleotide; TTT chr11 5294979 5295000 5294984 5294979 -
tggaagcacagggtgtgggata

SEQ ID NO: 131803 - DNA, 22 bp, Artificial Sequence
  Synthetic oligonucleotide; TTT chr11 5294978 5294999 5294983 5294978 -
ggaagcacagggtgtgggataa

SEQ ID NO: 131804 - DNA, 22 bp, Artificial Sequence
  Synthetic oligonucleotide; TTG chr11 5294977 5294998 5294982 5294977 -
gaagcacagggtgtgggataat

SEQ ID NO: 131805 - DNA, 22 bp, Artificial Sequence
  Synthetic oligonucleotide; CTA chr11 5294951 5294972 5294956 5294951 -
attactagtgattagtattgag

SEQ ID NO: 131806 - DNA, 22 bp, Artificial Sequence
  Synthetic oligonucleotide; TTA chr11 5294947 5294968 5294952 5294947 -
ctagtgattagtattgagaggt

SEQ ID NO: 131807 - DNA, 22 bp, Artificial Sequence
  Synthetic oligonucleotide; CTA chr11 5294944 5294965 5294949 5294944 -
gtgattagtattgagaggtgac

SEQ ID NO: 131808 - DNA, 22 bp, Artificial Sequence
  Synthetic oligonucleotide; TTA chr11 5294937 5294958 5294942 5294937 -
gtattgagaggtgacagcgtgc

SEQ ID NO: 131809 - DNA, 22 bp, Artificial Sequence
  Synthetic oligonucleotide; TTG chr11 5294931 5294952 5294936 5294931 -
agaggtgacagcgtgctggcag

SEQ ID NO: 131810 - DNA, 22 bp, Artificial Sequence
  Synthetic oligonucleotide; CTG chr11 5294913 5294934 5294918 5294913 -
gcagtcctcacagccctcgctc

SEQ ID NO: 131811 - DNA, 22 bp, Artificial Sequence
  Synthetic oligonucleotide; CTC chr11 5294904 5294925 5294909 5294904 -
acagccctcgctcgctcttggc

SEQ ID NO: 131812 - DNA, 22 bp, Artificial Sequence
  Synthetic oligonucleotide; CTC chr11 5294895 5294916 5294900 5294895 -
gctcgctcttggcgcctcctct

SEQ ID NO: 131813 - DNA, 22 bp, Artificial Sequence
  Synthetic oligonucleotide; CTC chr11 5294891 5294912 5294896 5294891 -
gctcttggcgcctcctctgcct

SEQ ID NO: 131814 - DNA, 22 bp, Artificial Sequence
  Synthetic oligonucleotide; CTC chr11 5294887 5294908 5294892 5294887 -
ttggcgcctcctctgcctgggc

SEQ ID NO: 131815 - DNA, 22 bp, Artificial Sequence
  Synthetic oligonucleotide; CTT chr11 5294885 5294906 5294890 5294885 -
ggcgcctcctctgcctgggctc

SEQ ID NO: 131816 - DNA, 22 bp, Artificial Sequence
  Synthetic oligonucleotide; TTG chr11 5294884 5294905 5294889 5294884 -
gcgcctcctctgcctgggctcc

SEQ ID NO: 131817 - DNA, 22 bp, Artificial Sequence
  Synthetic oligonucleotide; CTC chr11 5294877 5294898 5294882 5294877 -
ctctgcctgggctcccacattg

SEQ ID NO: 131818 - DNA, 22 bp, Artificial Sequence
  Synthetic oligonucleotide; CTC chr11 5294874 5294895 5294879 5294874 -
tgcctgggctcccacattggtg

SEQ ID NO: 131819 - DNA, 22 bp, Artificial Sequence
  Synthetic oligonucleotide; CTG chr11 5294872 5294893 5294877 5294872 -
cctgggctcccacattggtggc

SEQ ID NO: 131820 - DNA, 22 bp, Artificial Sequence
  Synthetic oligonucleotide; CTG chr11 5294868 5294889 5294873 5294868 -
ggctcccacattggtggcactt

SEQ ID NO: 131821 - DNA, 22 bp, Artificial Sequence
  Synthetic oligonucleotide; CTC chr11 5294863 5294884 5294868 5294863 -
ccacattggtggcacttgagga

SEQ ID NO: 131822 - DNA, 22 bp, Artificial Sequence
  Synthetic oligonucleotide; TTG chr11 5294855 5294876 5294860 5294855 -
gtggcacttgaggagcccttca

SEQ ID NO: 131823 - DNA, 22 bp, Artificial Sequence
  Synthetic oligonucleotide; CTT chr11 5294846 5294867 5294851 5294846 -
gaggagcccttcagccggccgc

SEQ ID NO: 131824 - DNA, 22 bp, Artificial Sequence
  Synthetic oligonucleotide; TTG chr11 5294845 5294866 5294850 5294845 -
aggagcccttcagccggccgct

SEQ ID NO: 131825 - DNA, 22 bp, Artificial Sequence
  Synthetic oligonucleotide; CTT chr11 5294835 5294856 5294840 5294835 -
cagccggccgctgcactgtggg

SEQ ID NO: 131826 - DNA, 22 bp, Artificial Sequence
  Synthetic oligonucleotide; TTC chr11 5294834 5294855 5294839 5294834 -
agccggccgctgcactgtggga

SEQ ID NO: 131827 - DNA, 22 bp, Artificial Sequence
  Synthetic oligonucleotide; CTG chr11 5294822 5294843 5294827 5294822 -
cactgtgggagcccttttctgg

SEQ ID NO: 131828 - DNA, 22 bp, Artificial Sequence
  Synthetic oligonucleotide; CTG chr11 5294817 5294838 5294822 5294817 -
tgggagcccttttctgggctgg

SEQ ID NO: 131829 - DNA, 22 bp, Artificial Sequence
  Synthetic oligonucleotide; CTT chr11 5294806 5294827 5294811 5294806 -
ttctgggctggccaaggccaga

SEQ ID NO: 131830 - DNA, 22 bp, Artificial Sequence
  Synthetic oligonucleotide; TTT chr11 5294805 5294826 5294810 5294805 -
tctgggctggccaaggccagag

SEQ ID NO: 131831 - DNA, 22 bp, Artificial Sequence
  Synthetic oligonucleotide; TTT chr11 5294804 5294825 5294809 5294804 -
ctgggctggccaaggccagagc

SEQ ID NO: 131832 - DNA, 22 bp, Artificial Sequence
  Synthetic oligonucleotide; TTC chr11 5294803 5294824 5294808 5294803 -
tgggctggccaaggccagagcc

SEQ ID NO: 131833 - DNA, 22 bp, Artificial Sequence
  Synthetic oligonucleotide; CTG chr11 5294801 5294822 5294806 5294801 -
ggctggccaaggccagagccgg

SEQ ID NO: 131834 - DNA, 22 bp, Artificial Sequence
  Synthetic oligonucleotide; CTG chr11 5294796 5294817 5294801 5294796 -
gccaaggccagagccggctccc

SEQ ID NO: 131835 - DNA, 22 bp, Artificial Sequence
  Synthetic oligonucleotide; CTC chr11 5294776 5294797 5294781 5294776 -
cctcagcttgccaggaggtgtg

SEQ ID NO: 131836 - DNA, 22 bp, Artificial Sequence
  Synthetic oligonucleotide; CTC chr11 5294772 5294793 5294777 5294772 -
agcttgccaggaggtgtggagg

SEQ ID NO: 131837 - DNA, 22 bp, Artificial Sequence
  Synthetic oligonucleotide; CTT chr11 5294767 5294788 5294772 5294767 -
gccaggaggtgtggagggacag

SEQ ID NO: 131838 - DNA, 22 bp, Artificial Sequence
  Synthetic oligonucleotide; TTG chr11 5294766 5294787 5294771 5294766 -
ccaggaggtgtggagggacaga

SEQ ID NO: 131839 - DNA, 22 bp, Artificial Sequence
  Synthetic oligonucleotide; CTG chr11 5294724 5294745 5294729 5294724 -
tgcgccgtgcttgagggagttc

SEQ ID NO: 131840 - DNA, 22 bp, Artificial Sequence
  Synthetic oligonucleotide; CTT chr11 5294712 5294733 5294717 5294712 -
gagggagttccgggtgggcatg

SEQ ID NO: 131841 - DNA, 22 bp, Artificial Sequence
  Synthetic oligonucleotide; TTG chr11 5294711 5294732 5294716 5294711 -
agggagttccgggtgggcatgg

SEQ ID NO: 131842 - DNA, 22 bp, Artificial Sequence
  Synthetic oligonucleotide; TTC chr11 5294702 5294723 5294707 5294702 -
cgggtgggcatgggctccgagg

SEQ ID NO: 131843 - DNA, 22 bp, Artificial Sequence
  Synthetic oligonucleotide; CTC chr11 5294685 5294706 5294690 5294685 -
cgaggaccccgcactcggagcc

SEQ ID NO: 131844 - DNA, 22 bp, Artificial Sequence
  Synthetic oligonucleotide; CTC chr11 5294669 5294690 5294674 5294669 -
ggagccgccagccggccccacc

SEQ ID NO: 131845 - DNA, 22 bp, Artificial Sequence
  Synthetic oligonucleotide; CTT chr11 5294625 5294646 5294630 5294625 -
agcacctgggccagcagctgct

SEQ ID NO: 131846 - DNA, 22 bp, Artificial Sequence
  Synthetic oligonucleotide; TTA chr11 5294624 5294645 5294629 5294624 -
gcacctgggccagcagctgctg

SEQ ID NO: 131847 - DNA, 22 bp, Artificial Sequence
  Synthetic oligonucleotide; CTG chr11 5294617 5294638 5294622 5294617 -
ggccagcagctgctgtgctcaa

SEQ ID NO: 131848 - DNA, 22 bp, Artificial Sequence
  Synthetic oligonucleotide; CTG chr11 5294605 5294626 5294610 5294605 -
ctgtgctcaattcctcgccggg

SEQ ID NO: 131849 - DNA, 22 bp, Artificial Sequence
  Synthetic oligonucleotide; CTG chr11 5294602 5294623 5294607 5294602 -
tgctcaattcctcgccgggcct

SEQ ID NO: 131850 - DNA, 22 bp, Artificial Sequence
  Synthetic oligonucleotide; CTC chr11 5294597 5294618 5294602 5294597 -
aattcctcgccgggccttagct

SEQ ID NO: 131851 - DNA, 22 bp, Artificial Sequence
  Synthetic oligonucleotide; TTC chr11 5294592 5294613 5294597 5294592 -
ctcgccgggccttagctgcctt

SEQ ID NO: 131852 - DNA, 22 bp, Artificial Sequence
  Synthetic oligonucleotide; CTC chr11 5294589 5294610 5294594 5294589 -
gccgggccttagctgccttcct

SEQ ID NO: 131853 - DNA, 22 bp, Artificial Sequence
  Synthetic oligonucleotide; CTT chr11 5294579 5294600 5294584 5294579 -
agctgccttcctgcggggcagg

SEQ ID NO: 131854 - DNA, 22 bp, Artificial Sequence
  Synthetic oligonucleotide; TTA chr11 5294578 5294599 5294583 5294578 -
gctgccttcctgcggggcaggg

SEQ ID NO: 131855 - DNA, 22 bp, Artificial Sequence
  Synthetic oligonucleotide; CTG chr11 5294574 5294595 5294579 5294574 -
ccttcctgcggggcagggctcg

SEQ ID NO: 131856 - DNA, 22 bp, Artificial Sequence
  Synthetic oligonucleotide; CTT chr11 5294570 5294591 5294575 5294570 -
cctgcggggcagggctcgggac

SEQ ID NO: 131857 - DNA, 22 bp, Artificial Sequence
  Synthetic oligonucleotide; TTC chr11 5294569 5294590 5294574 5294569 -
ctgcggggcagggctcgggacc

SEQ ID NO: 131858 - DNA, 22 bp, Artificial Sequence
  Synthetic oligonucleotide; CTG chr11 5294566 5294587 5294571 5294566 -
cggggcagggctcgggacctgc

SEQ ID NO: 131859 - DNA, 22 bp, Artificial Sequence
  Synthetic oligonucleotide; CTC chr11 5294553 5294574 5294558 5294553 -
gggacctgcagcgcgccatgcc

SEQ ID NO: 131860 - DNA, 22 bp, Artificial Sequence
  Synthetic oligonucleotide; CTG chr11 5294545 5294566 5294550 5294545 -
cagcgcgccatgcctgagcctc

SEQ ID NO: 131861 - DNA, 22 bp, Artificial Sequence
  Synthetic oligonucleotide; CTG chr11 5294529 5294550 5294534 5294529 -
agcctccccaccttcatgggct

SEQ ID NO: 131862 - DNA, 22 bp, Artificial Sequence
  Synthetic oligonucleotide; CTC chr11 5294523 5294544 5294528 5294523 -
cccaccttcatgggctcctgtg

SEQ ID NO: 131863 - DNA, 22 bp, Artificial Sequence
  Synthetic oligonucleotide; CTT chr11 5294515 5294536 5294520 5294515 -
catgggctcctgtgcggcccga

SEQ ID NO: 131864 - DNA, 22 bp, Artificial Sequence
  Synthetic oligonucleotide; TTC chr11 5294514 5294535 5294519 5294514 -
atgggctcctgtgcggcccgag

SEQ ID NO: 131865 - DNA, 22 bp, Artificial Sequence
  Synthetic oligonucleotide; CTC chr11 5294506 5294527 5294511 5294506 -
ctgtgcggcccgagcctcgccg

SEQ ID NO: 131866 - DNA, 22 bp, Artificial Sequence
  Synthetic oligonucleotide; CTG chr11 5294503 5294524 5294508 5294503 -
tgcggcccgagcctcgccgacg

SEQ ID NO: 131867 - DNA, 22 bp, Artificial Sequence
  Synthetic oligonucleotide; CTC chr11 5294488 5294509 5294493 5294488 -
gccgacgagcgccgccccctgc

SEQ ID NO: 131868 - DNA, 22 bp, Artificial Sequence
  Synthetic oligonucleotide; CTG chr11 5294467 5294488 5294472 5294467 -
ctccagggcacccagtcccatc

SEQ ID NO: 131869 - DNA, 22 bp, Artificial Sequence
  Synthetic oligonucleotide; CTC chr11 5294464 5294485 5294469 5294464 -
cagggcacccagtcccatcgac

SEQ ID NO: 131870 - DNA, 22 bp, Artificial Sequence
  Synthetic oligonucleotide; CTG chr11 5294429 5294450 5294434 5294429 -
aagagtgcgggcgcacggcagg

SEQ ID NO: 131871 - DNA, 22 bp, Artificial Sequence
  Synthetic oligonucleotide; CTG chr11 5294401 5294422 5294406 5294401 -
gcaggcagctccccctgcagcc

SEQ ID NO: 131872 - DNA, 22 bp, Artificial Sequence
  Synthetic oligonucleotide; CTC chr11 5294390 5294411 5294395 5294390 -
cccctgcagcccaggtgcggga

SEQ ID NO: 131873 - DNA, 22 bp, Artificial Sequence
  Synthetic oligonucleotide; CTG chr11 5294384 5294405 5294389 5294384 -
cagcccaggtgcgggatccact

SEQ ID NO: 131874 - DNA, 22 bp, Artificial Sequence
  Synthetic oligonucleotide; CTG chr11 5294361 5294382 5294366 5294361 -
ggtgaagccggctaggctcctg

SEQ ID NO: 131875 - DNA, 22 bp, Artificial Sequence
  Synthetic oligonucleotide; CTA chr11 5294347 5294368 5294352 5294347 -
ggctcctgagtttgctggggat

SEQ ID NO: 131876 - DNA, 22 bp, Artificial Sequence
  Synthetic oligonucleotide; CTC chr11 5294342 5294363 5294347 5294342 -
ctgagtttgctggggatgcgaa

SEQ ID NO: 131877 - DNA, 22 bp, Artificial Sequence
  Synthetic oligonucleotide; CTG chr11 5294339 5294360 5294344 5294339 -
agtttgctggggatgcgaagaa

SEQ ID NO: 131878 - DNA, 22 bp, Artificial Sequence
  Synthetic oligonucleotide; TTT chr11 5294334 5294355 5294339 5294334 -
gctggggatgcgaagaaccctt

SEQ ID NO: 131879 - DNA, 22 bp, Artificial Sequence
  Synthetic oligonucleotide; TTG chr11 5294333 5294354 5294338 5294333 -
ctggggatgcgaagaaccctta

SEQ ID NO: 131880 - DNA, 22 bp, Artificial Sequence
  Synthetic oligonucleotide; CTG chr11 5294330 5294351 5294335 5294330 -
gggatgcgaagaacccttatgt

SEQ ID NO: 131881 - DNA, 22 bp, Artificial Sequence
  Synthetic oligonucleotide; CTT chr11 5294312 5294333 5294317 5294312 -
atgtctagataagggattgtaa

SEQ ID NO: 131882 - DNA, 22 bp, Artificial Sequence
  Synthetic oligonucleotide; TTA chr11 5294311 5294332 5294316 5294311 -
tgtctagataagggattgtaaa

SEQ ID NO: 131883 - DNA, 22 bp, Artificial Sequence
  Synthetic oligonucleotide; CTA chr11 5294305 5294326 5294310 5294305 -
gataagggattgtaaatacacc

SEQ ID NO: 131884 - DNA, 22 bp, Artificial Sequence
  Synthetic oligonucleotide; TTG chr11 5294293 5294314 5294298 5294293 -
taaatacaccaattggcactct

SEQ ID NO: 131885 - DNA, 22 bp, Artificial Sequence
  Synthetic oligonucleotide; TTG chr11 5294278 5294299 5294283 5294278 -
gcactctgtatctagctcaagg

SEQ ID NO: 131886 - DNA, 22 bp, Artificial Sequence
  Synthetic oligonucleotide; CTC chr11 5294272 5294293 5294277 5294272 -
tgtatctagctcaaggtttgta

SEQ ID NO: 131887 - DNA, 22 bp, Artificial Sequence
  Synthetic oligonucleotide; CTG chr11 5294270 5294291 5294275 5294270 -
tatctagctcaaggtttgtaaa

SEQ ID NO: 131888 - DNA, 22 bp, Artificial Sequence
  Synthetic oligonucleotide; CTA chr11 5294264 5294285 5294269 5294264 -
gctcaaggtttgtaaacacacc

SEQ ID NO: 131889 - DNA, 22 bp, Artificial Sequence
  Synthetic oligonucleotide; CTC chr11 5294260 5294281 5294265 5294260 -
aaggtttgtaaacacaccaatc

SEQ ID NO: 131890 - DNA, 22 bp, Artificial Sequence
  Synthetic oligonucleotide; TTT chr11 5294253 5294274 5294258 5294253 -
gtaaacacaccaatcagcaccc

SEQ ID NO: 131891 - DNA, 22 bp, Artificial Sequence
  Synthetic oligonucleotide; TTG chr11 5294252 5294273 5294257 5294252 -
taaacacaccaatcagcaccct

SEQ ID NO: 131892 - DNA, 22 bp, Artificial Sequence
  Synthetic oligonucleotide; CTG chr11 5294229 5294250 5294234 5294229 -
tgtctagctcagggtttgtgaa

SEQ ID NO: 131893 - DNA, 22 bp, Artificial Sequence
  Synthetic oligonucleotide; CTA chr11 5294223 5294244 5294228 5294223 -
gctcagggtttgtgaatgcacc

SEQ ID NO: 131894 - DNA, 22 bp, Artificial Sequence
  Synthetic oligonucleotide; CTC chr11 5294219 5294240 5294224 5294219 -
agggtttgtgaatgcaccaatc

SEQ ID NO: 131895 - DNA, 22 bp, Artificial Sequence
  Synthetic oligonucleotide; TTT chr11 5294212 5294233 5294217 5294212 -
gtgaatgcaccaatcaacactc

SEQ ID NO: 131896 - DNA, 22 bp, Artificial Sequence
  Synthetic oligonucleotide; TTG chr11 5294211 5294232 5294216 5294211 -
tgaatgcaccaatcaacactct

SEQ ID NO: 131897 - DNA, 22 bp, Artificial Sequence
  Synthetic oligonucleotide; CTC chr11 5294190 5294211 5294195 5294190 -
tatctagctactctggtggggc

SEQ ID NO: 131898 - DNA, 22 bp, Artificial Sequence
  Synthetic oligonucleotide; CTA chr11 5294188 5294209 5294193 5294188 -
tctagctactctggtggggcct

SEQ ID NO: 131899 - DNA, 22 bp, Artificial Sequence
  Synthetic oligonucleotide; CTA chr11 5294184 5294205 5294189 5294184 -
gctactctggtggggccttgga

SEQ ID NO: 131900 - DNA, 22 bp, Artificial Sequence
  Synthetic oligonucleotide; CTA chr11 5294180 5294201 5294185 5294180 -
ctctggtggggccttggagaac

SEQ ID NO: 131901 - DNA, 22 bp, Artificial Sequence
  Synthetic oligonucleotide; CTC chr11 5294177 5294198 5294182 5294177 -
tggtggggccttggagaacctt

SEQ ID NO: 131902 - DNA, 22 bp, Artificial Sequence
  Synthetic oligonucleotide; CTG chr11 5294175 5294196 5294180 5294175 -
gtggggccttggagaaccttta

SEQ ID NO: 131903 - DNA, 22 bp, Artificial Sequence
  Synthetic oligonucleotide; CTT chr11 5294165 5294186 5294170 5294165 -
ggagaacctttatgtctagctc

SEQ ID NO: 131904 - DNA, 22 bp, Artificial Sequence
  Synthetic oligonucleotide; TTG chr11 5294164 5294185 5294169 5294164 -
gagaacctttatgtctagctca

SEQ ID NO: 131905 - DNA, 22 bp, Artificial Sequence
  Synthetic oligonucleotide; CTT chr11 5294155 5294176 5294160 5294155 -
tatgtctagctcagggattgta

SEQ ID NO: 131906 - DNA, 22 bp, Artificial Sequence
  Synthetic oligonucleotide; TTT chr11 5294154 5294175 5294159 5294154 -
atgtctagctcagggattgtaa

SEQ ID NO: 131907 - DNA, 22 bp, Artificial Sequence
  Synthetic oligonucleotide; TTA chr11 5294153 5294174 5294158 5294153 -
tgtctagctcagggattgtaaa

SEQ ID NO: 131908 - DNA, 22 bp, Artificial Sequence
  Synthetic oligonucleotide; CTA chr11 5294147 5294168 5294152 5294147 -
gctcagggattgtaaatacacc

SEQ ID NO: 131909 - DNA, 22 bp, Artificial Sequence
  Synthetic oligonucleotide; CTC chr11 5294143 5294164 5294148 5294143 -
agggattgtaaatacaccaatc

SEQ ID NO: 131910 - DNA, 22 bp, Artificial Sequence
  Synthetic oligonucleotide; TTG chr11 5294135 5294156 5294140 5294135 -
taaatacaccaatcggcagtct

SEQ ID NO: 131911 - DNA, 22 bp, Artificial Sequence
  Synthetic oligonucleotide; CTG chr11 5294112 5294133 5294117 5294112 -
tatctagctcaaggtttgtaaa

SEQ ID NO: 131912 - DNA, 22 bp, Artificial Sequence
  Synthetic oligonucleotide; CTA chr11 5294106 5294127 5294111 5294106 -
gctcaaggtttgtaaacacacc

SEQ ID NO: 131913 - DNA, 22 bp, Artificial Sequence
  Synthetic oligonucleotide; CTC chr11 5294102 5294123 5294107 5294102 -
aaggtttgtaaacacaccaatc

SEQ ID NO: 131914 - DNA, 22 bp, Artificial Sequence
  Synthetic oligonucleotide; TTT chr11 5294095 5294116 5294100 5294095 -
gtaaacacaccaatcagcaccc

SEQ ID NO: 131915 - DNA, 22 bp, Artificial Sequence
  Synthetic oligonucleotide; TTG chr11 5294094 5294115 5294099 5294094 -
taaacacaccaatcagcaccct

SEQ ID NO: 131916 - DNA, 22 bp, Artificial Sequence
  Synthetic oligonucleotide; CTG chr11 5294071 5294092 5294076 5294071 -
tgtctagctcagggtttgtgaa

SEQ ID NO: 131917 - DNA, 22 bp, Artificial Sequence
  Synthetic oligonucleotide; CTA chr11 5294065 5294086 5294070 5294065 -
gctcagggtttgtgaatgcacc

SEQ ID NO: 131918 - DNA, 22 bp, Artificial Sequence
  Synthetic oligonucleotide; CTC chr11 5294061 5294082 5294066 5294061 -
agggtttgtgaatgcaccaatc

SEQ ID NO: 131919 - DNA, 22 bp, Artificial Sequence
  Synthetic oligonucleotide; TTT chr11 5294054 5294075 5294059 5294054 -
gtgaatgcaccaatcaacactc

SEQ ID NO: 131920 - DNA, 22 bp, Artificial Sequence
  Synthetic oligonucleotide; TTG chr11 5294053 5294074 5294058 5294053 -
tgaatgcaccaatcaacactct

SEQ ID NO: 131921 - DNA, 22 bp, Artificial Sequence
  Synthetic oligonucleotide; CTC chr11 5294032 5294053 5294037 5294032 -
tgtatctagctactctggtggg

SEQ ID NO: 131922 - DNA, 22 bp, Artificial Sequence
  Synthetic oligonucleotide; CTG chr11 5294030 5294051 5294035 5294030 -
tatctagctactctggtgggga

SEQ ID NO: 131923 - DNA, 22 bp, Artificial Sequence
  Synthetic oligonucleotide; CTA chr11 5294024 5294045 5294029 5294024 -
gctactctggtggggacgtgga

SEQ ID NO: 131924 - DNA, 22 bp, Artificial Sequence
  Synthetic oligonucleotide; CTA chr11 5294020 5294041 5294025 5294020 -
ctctggtggggacgtggagaac

SEQ ID NO: 131925 - DNA, 22 bp, Artificial Sequence
  Synthetic oligonucleotide; CTC chr11 5294017 5294038 5294022 5294017 -
tggtggggacgtggagaacctt

SEQ ID NO: 131926 - DNA, 22 bp, Artificial Sequence
  Synthetic oligonucleotide; CTG chr11 5294015 5294036 5294020 5294015 -
gtggggacgtggagaaccttta

SEQ ID NO: 131927 - DNA, 22 bp, Artificial Sequence
  Synthetic oligonucleotide; CTT chr11 5293995 5294016 5294000 5293995 -
tatgtctagctcagggattgta

SEQ ID NO: 131928 - DNA, 22 bp, Artificial Sequence
  Synthetic oligonucleotide; TTT chr11 5293994 5294015 5293999 5293994 -
atgtctagctcagggattgtaa

SEQ ID NO: 131929 - DNA, 22 bp, Artificial Sequence
  Synthetic oligonucleotide; TTA chr11 5293993 5294014 5293998 5293993 -
tgtctagctcagggattgtaaa

SEQ ID NO: 131930 - DNA, 22 bp, Artificial Sequence
  Synthetic oligonucleotide; CTA chr11 5293987 5294008 5293992 5293987 -
gctcagggattgtaaatacacc

SEQ ID NO: 131931 - DNA, 22 bp, Artificial Sequence
  Synthetic oligonucleotide; CTC chr11 5293983 5294004 5293988 5293983 -
agggattgtaaatacaccactc

SEQ ID NO: 131932 - DNA, 22 bp, Artificial Sequence
  Synthetic oligonucleotide; TTG chr11 5293975 5293996 5293980 5293975 -
taaatacaccactcggcagtct

SEQ ID NO: 131933 - DNA, 22 bp, Artificial Sequence
  Synthetic oligonucleotide; CTC chr11 5293961 5293982 5293966 5293961 -
ggcagtctgtatctagctcaag

SEQ ID NO: 131934 - DNA, 22 bp, Artificial Sequence
  Synthetic oligonucleotide; CTG chr11 5293952 5293973 5293957 5293952 -
tatctagctcaaggtttgtaaa

SEQ ID NO: 131935 - DNA, 22 bp, Artificial Sequence
  Synthetic oligonucleotide; CTA chr11 5293946 5293967 5293951 5293946 -
gctcaaggtttgtaaacacacc

SEQ ID NO: 131936 - DNA, 22 bp, Artificial Sequence
  Synthetic oligonucleotide; CTC chr11 5293942 5293963 5293947 5293942 -
aaggtttgtaaacacaccaatc

SEQ ID NO: 131937 - DNA, 22 bp, Artificial Sequence
  Synthetic oligonucleotide; TTT chr11 5293935 5293956 5293940 5293935 -
gtaaacacaccaatcagcaccc

SEQ ID NO: 131938 - DNA, 22 bp, Artificial Sequence
  Synthetic oligonucleotide; TTG chr11 5293934 5293955 5293939 5293934 -
taaacacaccaatcagcaccct

SEQ ID NO: 131939 - DNA, 22 bp, Artificial Sequence
  Synthetic oligonucleotide; CTG chr11 5293911 5293932 5293916 5293911 -
tgtctagctcagggtttgtgaa

SEQ ID NO: 131940 - DNA, 22 bp, Artificial Sequence
  Synthetic oligonucleotide; CTA chr11 5293905 5293926 5293910 5293905 -
gctcagggtttgtgaatgcacc

SEQ ID NO: 131941 - DNA, 22 bp, Artificial Sequence
  Synthetic oligonucleotide; CTC chr11 5293901 5293922 5293906 5293901 -
agggtttgtgaatgcaccaatc

SEQ ID NO: 131942 - DNA, 22 bp, Artificial Sequence
  Synthetic oligonucleotide; TTT chr11 5293894 5293915 5293899 5293894 -
gtgaatgcaccaatcaacactc

SEQ ID NO: 131943 - DNA, 22 bp, Artificial Sequence
  Synthetic oligonucleotide; TTG chr11 5293893 5293914 5293898 5293893 -
tgaatgcaccaatcaacactct

SEQ ID NO: 131944 - DNA, 22 bp, Artificial Sequence
  Synthetic oligonucleotide; CTC chr11 5293872 5293893 5293877 5293872 -
tgtatctagctactctggtggg

SEQ ID NO: 131945 - DNA, 22 bp, Artificial Sequence
  Synthetic oligonucleotide; CTG chr11 5293870 5293891 5293875 5293870 -
tatctagctactctggtgggga

SEQ ID NO: 131946 - DNA, 22 bp, Artificial Sequence
  Synthetic oligonucleotide; CTA chr11 5293864 5293885 5293869 5293864 -
gctactctggtggggacttgga

SEQ ID NO: 131947 - DNA, 22 bp, Artificial Sequence
  Synthetic oligonucleotide; CTA chr11 5293860 5293881 5293865 5293860 -
ctctggtggggacttggagaac

SEQ ID NO: 131948 - DNA, 22 bp, Artificial Sequence
  Synthetic oligonucleotide; CTC chr11 5293857 5293878 5293862 5293857 -
tggtggggacttggagaacctt

SEQ ID NO: 131949 - DNA, 22 bp, Artificial Sequence
  Synthetic oligonucleotide; CTG chr11 5293855 5293876 5293860 5293855 -
gtggggacttggagaacctttg

SEQ ID NO: 131950 - DNA, 22 bp, Artificial Sequence
  Synthetic oligonucleotide; CTT chr11 5293845 5293866 5293850 5293845 -
ggagaacctttgtgtggacact

SEQ ID NO: 131951 - DNA, 22 bp, Artificial Sequence
  Synthetic oligonucleotide; TTG chr11 5293844 5293865 5293849 5293844 -
gagaacctttgtgtggacactc

SEQ ID NO: 131952 - DNA, 22 bp, Artificial Sequence
  Synthetic oligonucleotide; CTT chr11 5293835 5293856 5293840 5293835 -
tgtgtggacactctgtatctag

SEQ ID NO: 131953 - DNA, 22 bp, Artificial Sequence
  Synthetic oligonucleotide; TTT chr11 5293834 5293855 5293839 5293834 -
gtgtggacactctgtatctagc

SEQ ID NO: 131954 - DNA, 22 bp, Artificial Sequence
  Synthetic oligonucleotide; TTG chr11 5293833 5293854 5293838 5293833 -
tgtggacactctgtatctagct

SEQ ID NO: 131955 - DNA, 22 bp, Artificial Sequence
  Synthetic oligonucleotide; CTC chr11 5293822 5293843 5293827 5293822 -
tgtatctagctaatctggtggg

SEQ ID NO: 131956 - DNA, 22 bp, Artificial Sequence
  Synthetic oligonucleotide; CTG chr11 5293820 5293841 5293825 5293820 -
tatctagctaatctggtgggga

SEQ ID NO: 131957 - DNA, 22 bp, Artificial Sequence
  Synthetic oligonucleotide; CTA chr11 5293814 5293835 5293819 5293814 -
gctaatctggtggggacgtgga

SEQ ID NO: 131958 - DNA, 22 bp, Artificial Sequence
  Synthetic oligonucleotide; CTA chr11 5293810 5293831 5293815 5293810 -
atctggtggggacgtggagaac

SEQ ID NO: 131959 - DNA, 22 bp, Artificial Sequence
  Synthetic oligonucleotide; CTG chr11 5293805 5293826 5293810 5293805 -
gtggggacgtggagaacctttg

SEQ ID NO: 131960 - DNA, 22 bp, Artificial Sequence
  Synthetic oligonucleotide; CTT chr11 5293785 5293806 5293790 5293785 -
tgtgtctagctcatggattgta

SEQ ID NO: 131961 - DNA, 22 bp, Artificial Sequence
  Synthetic oligonucleotide; TTT chr11 5293784 5293805 5293789 5293784 -
gtgtctagctcatggattgtaa

SEQ ID NO: 131962 - DNA, 22 bp, Artificial Sequence
  Synthetic oligonucleotide; TTG chr11 5293783 5293804 5293788 5293783 -
tgtctagctcatggattgtaaa

SEQ ID NO: 131963 - DNA, 22 bp, Artificial Sequence
  Synthetic oligonucleotide; CTA chr11 5293777 5293798 5293782 5293777 -
gctcatggattgtaaatgcacc

SEQ ID NO: 131964 - DNA, 22 bp, Artificial Sequence
  Synthetic oligonucleotide; CTC chr11 5293773 5293794 5293778 5293773 -
atggattgtaaatgcaccaatc

SEQ ID NO: 131965 - DNA, 22 bp, Artificial Sequence
  Synthetic oligonucleotide; TTG chr11 5293765 5293786 5293770 5293765 -
taaatgcaccaatcagtgccct

SEQ ID NO: 131966 - DNA, 22 bp, Artificial Sequence
  Synthetic oligonucleotide; CTG chr11 5293742 5293763 5293747 5293742 -
tcaaaacagaccactgggctct

SEQ ID NO: 131967 - DNA, 22 bp, Artificial Sequence
  Synthetic oligonucleotide; CTG chr11 5293726 5293747 5293731 5293726 -
ggctctaccaatcagcaggatg

SEQ ID NO: 131968 - DNA, 22 bp, Artificial Sequence
  Synthetic oligonucleotide; CTC chr11 5293721 5293742 5293726 5293721 -
taccaatcagcaggatgtgggt

SEQ ID NO: 131969 - DNA, 22 bp, Artificial Sequence
  Synthetic oligonucleotide; CTA chr11 5293719 5293740 5293724 5293719 -
ccaatcagcaggatgtgggtgg

SEQ ID NO: 131970 - DNA, 22 bp, Artificial Sequence
  Synthetic oligonucleotide; CTG chr11 5293669 5293690 5293674 5293669 -
cccgagccagcagtggcaaccc

SEQ ID NO: 131971 - DNA, 22 bp, Artificial Sequence
  Synthetic oligonucleotide; CTC chr11 5293643 5293664 5293648 5293643 -
gggtccccttccacactgtgga

SEQ ID NO: 131972 - DNA, 22 bp, Artificial Sequence
  Synthetic oligonucleotide; CTT chr11 5293633 5293654 5293638 5293633 -
ccacactgtggaagctttgttc

SEQ ID NO: 131973 - DNA, 22 bp, Artificial Sequence
  Synthetic oligonucleotide; TTC chr11 5293632 5293653 5293637 5293632 -
cacactgtggaagctttgttct

SEQ ID NO: 131974 - DNA, 22 bp, Artificial Sequence
  Synthetic oligonucleotide; CTG chr11 5293625 5293646 5293630 5293625 -
tggaagctttgttctttcgctc

SEQ ID NO: 131975 - DNA, 22 bp, Artificial Sequence
  Synthetic oligonucleotide; CTT chr11 5293616 5293637 5293621 5293616 -
tgttctttcgctctttgcaata

SEQ ID NO: 131976 - DNA, 22 bp, Artificial Sequence
  Synthetic oligonucleotide; TTT chr11 5293615 5293636 5293620 5293615 -
gttctttcgctctttgcaataa

SEQ ID NO: 131977 - DNA, 22 bp, Artificial Sequence
  Synthetic oligonucleotide; TTG chr11 5293614 5293635 5293619 5293614 -
ttctttcgctctttgcaataaa

SEQ ID NO: 131978 - DNA, 22 bp, Artificial Sequence
  Synthetic oligonucleotide; TTC chr11 5293611 5293632 5293616 5293611 -
tttcgctctttgcaataaatct

SEQ ID NO: 131979 - DNA, 22 bp, Artificial Sequence
  Synthetic oligonucleotide; CTT chr11 5293609 5293630 5293614 5293609 -
tcgctctttgcaataaatcttg

SEQ ID NO: 131980 - DNA, 22 bp, Artificial Sequence
  Synthetic oligonucleotide; TTT chr11 5293608 5293629 5293613 5293608 -
cgctctttgcaataaatcttgc

SEQ ID NO: 131981 - DNA, 22 bp, Artificial Sequence
  Synthetic oligonucleotide; TTC chr11 5293607 5293628 5293612 5293607 -
gctctttgcaataaatcttgct

SEQ ID NO: 131982 - DNA, 22 bp, Artificial Sequence
  Synthetic oligonucleotide; CTC chr11 5293603 5293624 5293608 5293603 -
tttgcaataaatcttgctgctg

SEQ ID NO: 131983 - DNA, 22 bp, Artificial Sequence
  Synthetic oligonucleotide; CTT chr11 5293601 5293622 5293606 5293601 -
tgcaataaatcttgctgctgct

SEQ ID NO: 131984 - DNA, 22 bp, Artificial Sequence
  Synthetic oligonucleotide; TTT chr11 5293600 5293621 5293605 5293600 -
gcaataaatcttgctgctgctc

SEQ ID NO: 131985 - DNA, 22 bp, Artificial Sequence
  Synthetic oligonucleotide; TTG chr11 5293599 5293620 5293604 5293599 -
caataaatcttgctgctgctca

SEQ ID NO: 131986 - DNA, 22 bp, Artificial Sequence
  Synthetic oligonucleotide; CTT chr11 5293588 5293609 5293593 5293588 -
gctgctgctcactgtttgggtc

SEQ ID NO: 131987 - DNA, 22 bp, Artificial Sequence
  Synthetic oligonucleotide; TTG chr11 5293587 5293608 5293592 5293587 -
ctgctgctcactgtttgggtct

SEQ ID NO: 131988 - DNA, 22 bp, Artificial Sequence
  Synthetic oligonucleotide; CTG chr11 5293584 5293605 5293589 5293584 -
ctgctcactgtttgggtctaca

SEQ ID NO: 131989 - DNA, 22 bp, Artificial Sequence
  Synthetic oligonucleotide; CTG chr11 5293581 5293602 5293586 5293581 -
ctcactgtttgggtctacactg

SEQ ID NO: 131990 - DNA, 22 bp, Artificial Sequence
  Synthetic oligonucleotide; CTC chr11 5293578 5293599 5293583 5293578 -
actgtttgggtctacactgcct

SEQ ID NO: 131991 - DNA, 22 bp, Artificial Sequence
  Synthetic oligonucleotide; CTG chr11 5293574 5293595 5293579 5293574 -
tttgggtctacactgcctttat

SEQ ID NO: 131992 - DNA, 22 bp, Artificial Sequence
  Synthetic oligonucleotide; TTT chr11 5293571 5293592 5293576 5293571 -
gggtctacactgcctttatgag

SEQ ID NO: 131993 - DNA, 22 bp, Artificial Sequence
  Synthetic oligonucleotide; TTG chr11 5293570 5293591 5293575 5293570 -
ggtctacactgcctttatgagc

SEQ ID NO: 131994 - DNA, 22 bp, Artificial Sequence
  Synthetic oligonucleotide; CTA chr11 5293564 5293585 5293569 5293564 -
cactgcctttatgagctgtaac

SEQ ID NO: 131995 - DNA, 22 bp, Artificial Sequence
  Synthetic oligonucleotide; CTG chr11 5293559 5293580 5293564 5293559 -
cctttatgagctgtaacgctca

SEQ ID NO: 131996 - DNA, 22 bp, Artificial Sequence
  Synthetic oligonucleotide; CTT chr11 5293555 5293576 5293560 5293555 -
tatgagctgtaacgctcaccgc

SEQ ID NO: 131997 - DNA, 22 bp, Artificial Sequence
  Synthetic oligonucleotide; TTT chr11 5293554 5293575 5293559 5293554 -
atgagctgtaacgctcaccgcg

SEQ ID NO: 131998 - DNA, 22 bp, Artificial Sequence
  Synthetic oligonucleotide; TTA chr11 5293553 5293574 5293558 5293553 -
tgagctgtaacgctcaccgcga

SEQ ID NO: 131999 - DNA, 22 bp, Artificial Sequence
  Synthetic oligonucleotide; CTG chr11 5293546 5293567 5293551 5293546 -
taacgctcaccgcgaaggtctg

SEQ ID NO: 132000 - DNA, 22 bp, Artificial Sequence
  Synthetic oligonucleotide; CTC chr11 5293538 5293559 5293543 5293538 -
accgcgaaggtctgcagcttca

SEQ ID NO: 132001 - DNA, 22 bp, Artificial Sequence
  Synthetic oligonucleotide; CTG chr11 5293524 5293545 5293529 5293524 -
cagcttcactcttgaagccagc

SEQ ID NO: 132002 - DNA, 22 bp, Artificial Sequence
  Synthetic oligonucleotide; CTT chr11 5293518 5293539 5293523 5293518 -
cactcttgaagccagcgagacc

SEQ ID NO: 132003 - DNA, 22 bp, Artificial Sequence
  Synthetic oligonucleotide; TTC chr11 5293517 5293538 5293522 5293517 -
actcttgaagccagcgagacca

SEQ ID NO: 132004 - DNA, 22 bp, Artificial Sequence
  Synthetic oligonucleotide; CTC chr11 5293513 5293534 5293518 5293513 -
ttgaagccagcgagaccacgaa

SEQ ID NO: 132005 - DNA, 22 bp, Artificial Sequence
  Synthetic oligonucleotide; CTT chr11 5293511 5293532 5293516 5293511 -
gaagccagcgagaccacgaacc

SEQ ID NO: 132006 - DNA, 22 bp, Artificial Sequence
  Synthetic oligonucleotide; TTG chr11 5293510 5293531 5293515 5293510 -
aagccagcgagaccacgaaccc

SEQ ID NO: 132007 - DNA, 22 bp, Artificial Sequence
  Synthetic oligonucleotide; CTC chr11 5293467 5293488 5293472 5293467 -
cagaggcgccgccttaagagct

SEQ ID NO: 132008 - DNA, 22 bp, Artificial Sequence
  Synthetic oligonucleotide; CTT chr11 5293452 5293473 5293457 5293452 -
aagagctggaacgttcactgtg

SEQ ID NO: 132009 - DNA, 22 bp, Artificial Sequence
  Synthetic oligonucleotide; TTA chr11 5293451 5293472 5293456 5293451 -
agagctggaacgttcactgtga

SEQ ID NO: 132010 - DNA, 22 bp, Artificial Sequence
  Synthetic oligonucleotide; CTG chr11 5293444 5293465 5293449 5293444 -
gaacgttcactgtgaaggtctg

SEQ ID NO: 132011 - DNA, 22 bp, Artificial Sequence
  Synthetic oligonucleotide; TTC chr11 5293436 5293457 5293441 5293436 -
actgtgaaggtctgcagcttca

SEQ ID NO: 132012 - DNA, 22 bp, Artificial Sequence
  Synthetic oligonucleotide; CTG chr11 5293432 5293453 5293437 5293432 -
tgaaggtctgcagcttcactcc

SEQ ID NO: 132013 - DNA, 22 bp, Artificial Sequence
  Synthetic oligonucleotide; CTG chr11 5293422 5293443 5293427 5293422 -
cagcttcactcctgagccagcg

SEQ ID NO: 132014 - DNA, 22 bp, Artificial Sequence
  Synthetic oligonucleotide; CTT chr11 5293416 5293437 5293421 5293416 -
cactcctgagccagcgagacca

SEQ ID NO: 132015 - DNA, 22 bp, Artificial Sequence
  Synthetic oligonucleotide; TTC chr11 5293415 5293436 5293420 5293415 -
actcctgagccagcgagaccac

SEQ ID NO: 132016 - DNA, 22 bp, Artificial Sequence
  Synthetic oligonucleotide; CTC chr11 5293411 5293432 5293416 5293411 -
ctgagccagcgagaccacgaac

SEQ ID NO: 132017 - DNA, 22 bp, Artificial Sequence
  Synthetic oligonucleotide; CTG chr11 5293408 5293429 5293413 5293408 -
agccagcgagaccacgaaccca

SEQ ID NO: 132018 - DNA, 22 bp, Artificial Sequence
  Synthetic oligonucleotide; CTC chr11 5293369 5293390 5293374 5293369 -
cgaacacatccaaacatcagaa

SEQ ID NO: 132019 - DNA, 22 bp, Artificial Sequence
  Synthetic oligonucleotide; CTC chr11 5293336 5293357 5293341 5293336 -
cacacacgcagcctttaagaac

SEQ ID NO: 132020 - DNA, 22 bp, Artificial Sequence
  Synthetic oligonucleotide; CTT chr11 5293321 5293342 5293326 5293321 -
taagaactgtaacactcaccac

SEQ ID NO: 132021 - DNA, 22 bp, Artificial Sequence
  Synthetic oligonucleotide; TTT chr11 5293320 5293341 5293325 5293320 -
aagaactgtaacactcaccacg

SEQ ID NO: 132022 - DNA, 22 bp, Artificial Sequence
  Synthetic oligonucleotide; TTA chr11 5293319 5293340 5293324 5293319 -
agaactgtaacactcaccacga

SEQ ID NO: 132023 - DNA, 22 bp, Artificial Sequence
  Synthetic oligonucleotide; CTG chr11 5293312 5293333 5293317 5293312 -
taacactcaccacgagggtccc

SEQ ID NO: 132024 - DNA, 22 bp, Artificial Sequence
  Synthetic oligonucleotide; CTC chr11 5293304 5293325 5293309 5293304 -
accacgagggtccccggcttca

SEQ ID NO: 132025 - DNA, 22 bp, Artificial Sequence
  Synthetic oligonucleotide; CTT chr11 5293284 5293305 5293289 5293284 -
cattcttgaagtcagtgaaacc

SEQ ID NO: 132026 - DNA, 22 bp, Artificial Sequence
  Synthetic oligonucleotide; TTC chr11 5293283 5293304 5293288 5293283 -
attcttgaagtcagtgaaacca

SEQ ID NO: 132027 - DNA, 22 bp, Artificial Sequence
  Synthetic oligonucleotide; TTC chr11 5293279 5293300 5293284 5293279 -
ttgaagtcagtgaaaccaagaa

SEQ ID NO: 132028 - DNA, 22 bp, Artificial Sequence
  Synthetic oligonucleotide; CTT chr11 5293277 5293298 5293282 5293277 -
gaagtcagtgaaaccaagaacc

SEQ ID NO: 132029 - DNA, 22 bp, Artificial Sequence
  Synthetic oligonucleotide; TTG chr11 5293276 5293297 5293281 5293276 -
aagtcagtgaaaccaagaaccc

SEQ ID NO: 132030 - DNA, 22 bp, Artificial Sequence
  Synthetic oligonucleotide; TTC chr11 5293246 5293267 5293251 5293246 -
cggacacagtatgtcagaaaca

SEQ ID NO: 132031 - DNA, 22 bp, Artificial Sequence
  Synthetic oligonucleotide; CTA chr11 5293211 5293232 5293216 5293211 -
aatcaatatacttctcaacaat

SEQ ID NO: 132032 - DNA, 22 bp, Artificial Sequence
  Synthetic oligonucleotide; CTT chr11 5293198 5293219 5293203 5293198 -
ctcaacaatttccaacagccct

SEQ ID NO: 132033 - DNA, 22 bp, Artificial Sequence
  Synthetic oligonucleotide; TTC chr11 5293197 5293218 5293202 5293197 -
tcaacaatttccaacagccctt

SEQ ID NO: 132034 - DNA, 22 bp, Artificial Sequence
  Synthetic oligonucleotide; CTC chr11 5293195 5293216 5293200 5293195 -
aacaatttccaacagcccttgc

SEQ ID NO: 132035 - DNA, 22 bp, Artificial Sequence
  Synthetic oligonucleotide; TTT chr11 5293187 5293208 5293192 5293187 -
ccaacagcccttgcaattaact

SEQ ID NO: 132036 - DNA, 22 bp, Artificial Sequence
  Synthetic oligonucleotide; TTC chr11 5293186 5293207 5293191 5293186 -
caacagcccttgcaattaactt

SEQ ID NO: 132037 - DNA, 22 bp, Artificial Sequence
  Synthetic oligonucleotide; CTT chr11 5293175 5293196 5293180 5293175 -
gcaattaacttggccatgtgac

SEQ ID NO: 132038 - DNA, 22 bp, Artificial Sequence
  Synthetic oligonucleotide; TTG chr11 5293174 5293195 5293179 5293174 -
caattaacttggccatgtgact

SEQ ID NO: 132039 - DNA, 22 bp, Artificial Sequence
  Synthetic oligonucleotide; TTA chr11 5293168 5293189 5293173 5293168 -
acttggccatgtgactggttgt

SEQ ID NO: 132040 - DNA, 22 bp, Artificial Sequence
  Synthetic oligonucleotide; CTT chr11 5293164 5293185 5293169 5293164 -
ggccatgtgactggttgtgact

SEQ ID NO: 132041 - DNA, 22 bp, Artificial Sequence
  Synthetic oligonucleotide; TTG chr11 5293163 5293184 5293168 5293163 -
gccatgtgactggttgtgacta

SEQ ID NO: 132042 - DNA, 22 bp, Artificial Sequence
  Synthetic oligonucleotide; CTG chr11 5293151 5293172 5293156 5293151 -
gttgtgactaaaataatgtgga

SEQ ID NO: 132043 - DNA, 22 bp, Artificial Sequence
  Synthetic oligonucleotide; TTG chr11 5293147 5293168 5293152 5293147 -
tgactaaaataatgtggagata

SEQ ID NO: 132044 - DNA, 22 bp, Artificial Sequence
  Synthetic oligonucleotide; CTA chr11 5293141 5293162 5293146 5293141 -
aaataatgtggagataataatg

SEQ ID NO: 132045 - DNA, 22 bp, Artificial Sequence
  Synthetic oligonucleotide; TTA chr11 5293114 5293135 5293119 5293114 -
ctccctaaggcagagtgccctt

SEQ ID NO: 132046 - DNA, 22 bp, Artificial Sequence
  Synthetic oligonucleotide; CTC chr11 5293111 5293132 5293116 5293111 -
cctaaggcagagtgcccttcta

SEQ ID NO: 132047 - DNA, 22 bp, Artificial Sequence
  Synthetic oligonucleotide; CTA chr11 5293107 5293128 5293112 5293107 -
aggcagagtgcccttctatcat

SEQ ID NO: 132048 - DNA, 22 bp, Artificial Sequence
  Synthetic oligonucleotide; CTT chr11 5293092 5293113 5293097 5293092 -
ctatcattctctttcccttcct

SEQ ID NO: 132049 - DNA, 22 bp, Artificial Sequence
  Synthetic oligonucleotide; TTC chr11 5293091 5293112 5293096 5293091 -
tatcattctctttcccttcctc

SEQ ID NO: 132050 - DNA, 22 bp, Artificial Sequence
  Synthetic oligonucleotide; CTA chr11 5293089 5293110 5293094 5293089 -
tcattctctttcccttcctcta

SEQ ID NO: 132051 - DNA, 22 bp, Artificial Sequence
  Synthetic oligonucleotide; TTC chr11 5293083 5293104 5293088 5293083 -
tctttcccttcctctatgtggc

SEQ ID NO: 132052 - DNA, 22 bp, Artificial Sequence
  Synthetic oligonucleotide; CTC chr11 5293081 5293102 5293086 5293081 -
tttcccttcctctatgtggcag

SEQ ID NO: 132053 - DNA, 22 bp, Artificial Sequence
  Synthetic oligonucleotide; CTT chr11 5293079 5293100 5293084 5293079 -
tcccttcctctatgtggcagaa

SEQ ID NO: 132054 - DNA, 22 bp, Artificial Sequence
  Synthetic oligonucleotide; TTT chr11 5293078 5293099 5293083 5293078 -
cccttcctctatgtggcagaaa

SEQ ID NO: 132055 - DNA, 22 bp, Artificial Sequence
  Synthetic oligonucleotide; TTC chr11 5293077 5293098 5293082 5293077 -
ccttcctctatgtggcagaaag

SEQ ID NO: 132056 - DNA, 22 bp, Artificial Sequence
  Synthetic oligonucleotide; CTT chr11 5293073 5293094 5293078 5293073 -
cctctatgtggcagaaagtaaa

SEQ ID NO: 132057 - DNA, 22 bp, Artificial Sequence
  Synthetic oligonucleotide; TTC chr11 5293072 5293093 5293077 5293072 -
ctctatgtggcagaaagtaaaa

SEQ ID NO: 132058 - DNA, 22 bp, Artificial Sequence
  Synthetic oligonucleotide; CTC chr11 5293069 5293090 5293074 5293069 -
tatgtggcagaaagtaaaagat

SEQ ID NO: 132059 - DNA, 22 bp, Artificial Sequence
  Synthetic oligonucleotide; CTA chr11 5293067 5293088 5293072 5293067 -
tgtggcagaaagtaaaagattc

SEQ ID NO: 132060 - DNA, 22 bp, Artificial Sequence
  Synthetic oligonucleotide; TTC chr11 5293045 5293066 5293050 5293045 -
tgaaatgataaagtcaatcaca

SEQ ID NO: 132061 - DNA, 22 bp, Artificial Sequence
  Synthetic oligonucleotide; CTG chr11 5293043 5293064 5293048 5293043 -
aaatgataaagtcaatcacagg

SEQ ID NO: 132062 - DNA, 22 bp, Artificial Sequence
  Synthetic oligonucleotide; CTG chr11 5293011 5293032 5293016 5293011 -
gactcctggcccactgcttgga

SEQ ID NO: 132063 - DNA, 22 bp, Artificial Sequence
  Synthetic oligonucleotide; CTC chr11 5293006 5293027 5293011 5293006 -
ctggcccactgcttggaggaga

SEQ ID NO: 132064 - DNA, 22 bp, Artificial Sequence
  Synthetic oligonucleotide; CTG chr11 5293003 5293024 5293008 5293003 -
gcccactgcttggaggagagca

SEQ ID NO: 132065 - DNA, 22 bp, Artificial Sequence
  Synthetic oligonucleotide; CTG chr11 5292995 5293016 5293000 5292995 -
cttggaggagagcactcaggac

SEQ ID NO: 132066 - DNA, 22 bp, Artificial Sequence
  Synthetic oligonucleotide; CTT chr11 5292992 5293013 5292997 5292992 -
ggaggagagcactcaggaccat

SEQ ID NO: 132067 - DNA, 22 bp, Artificial Sequence
  Synthetic oligonucleotide; TTG chr11 5292991 5293012 5292996 5292991 -
gaggagagcactcaggaccatg

SEQ ID NO: 132068 - DNA, 22 bp, Artificial Sequence
  Synthetic oligonucleotide; CTC chr11 5292978 5292999 5292983 5292978 -
aggaccatgaacatctgactgt

SEQ ID NO: 132069 - DNA, 22 bp, Artificial Sequence
  Synthetic oligonucleotide; CTG chr11 5292961 5292982 5292966 5292961 -
actgtgacgtagcaataaagaa

SEQ ID NO: 132070 - DNA, 22 bp, Artificial Sequence
  Synthetic oligonucleotide; CTG chr11 5292957 5292978 5292962 5292957 -
tgacgtagcaataaagaaaccc

SEQ ID NO: 132071 - DNA, 22 bp, Artificial Sequence
  Synthetic oligonucleotide; TTT chr11 5292929 5292950 5292934 5292929 -
catatgaaactgcttaaaatta

SEQ ID NO: 132072 - DNA, 22 bp, Artificial Sequence
  Synthetic oligonucleotide; TTC chr11 5292928 5292949 5292933 5292928 -
atatgaaactgcttaaaattaa

SEQ ID NO: 132073 - DNA, 22 bp, Artificial Sequence
  Synthetic oligonucleotide; CTG chr11 5292917 5292938 5292922 5292917 -
cttaaaattaatggcacaagtc

SEQ ID NO: 132074 - DNA, 22 bp, Artificial Sequence
  Synthetic oligonucleotide; CTT chr11 5292914 5292935 5292919 5292914 -
aaaattaatggcacaagtcatg

SEQ ID NO: 132075 - DNA, 22 bp, Artificial Sequence
  Synthetic oligonucleotide; TTA chr11 5292913 5292934 5292918 5292913 -
aaattaatggcacaagtcatgt

SEQ ID NO: 132076 - DNA, 22 bp, Artificial Sequence
  Synthetic oligonucleotide; TTA chr11 5292907 5292928 5292912 5292907 -
atggcacaagtcatgtttttga

SEQ ID NO: 132077 - DNA, 22 bp, Artificial Sequence
  Synthetic oligonucleotide; TTT chr11 5292889 5292910 5292894 5292889 -
ttgatgttgcacatttgtcttt

SEQ ID NO: 132078 - DNA, 22 bp, Artificial Sequence
  Synthetic oligonucleotide; TTT chr11 5292888 5292909 5292893 5292888 -
tgatgttgcacatttgtcttta

SEQ ID NO: 132079 - DNA, 22 bp, Artificial Sequence
  Synthetic oligonucleotide; TTT chr11 5292887 5292908 5292892 5292887 -
gatgttgcacatttgtctttat

SEQ ID NO: 132080 - DNA, 22 bp, Artificial Sequence
  Synthetic oligonucleotide; TTG chr11 5292886 5292907 5292891 5292886 -
atgttgcacatttgtctttatt

SEQ ID NO: 132081 - DNA, 22 bp, Artificial Sequence
  Synthetic oligonucleotide; TTG chr11 5292880 5292901 5292885 5292880 -
cacatttgtctttatttgtggc

SEQ ID NO: 132082 - DNA, 22 bp, Artificial Sequence
  Synthetic oligonucleotide; TTT chr11 5292873 5292894 5292878 5292873 -
gtctttatttgtggcttgtttt

SEQ ID NO: 132083 - DNA, 22 bp, Artificial Sequence
  Synthetic oligonucleotide; TTG chr11 5292872 5292893 5292877 5292872 -
tctttatttgtggcttgttttg

SEQ ID NO: 132084 - DNA, 22 bp, Artificial Sequence
  Synthetic oligonucleotide; CTT chr11 5292868 5292889 5292873 5292868 -
tatttgtggcttgttttgcttc

SEQ ID NO: 132085 - DNA, 22 bp, Artificial Sequence
  Synthetic oligonucleotide; TTT chr11 5292867 5292888 5292872 5292867 -
atttgtggcttgttttgcttcc

SEQ ID NO: 132086 - DNA, 22 bp, Artificial Sequence
  Synthetic oligonucleotide; TTA chr11 5292866 5292887 5292871 5292866 -
tttgtggcttgttttgcttcca

SEQ ID NO: 132087 - DNA, 22 bp, Artificial Sequence
  Synthetic oligonucleotide; TTT chr11 5292863 5292884 5292868 5292863 -
gtggcttgttttgcttccacat

SEQ ID NO: 132088 - DNA, 22 bp, Artificial Sequence
  Synthetic oligonucleotide; TTG chr11 5292862 5292883 5292867 5292862 -
tggcttgttttgcttccacatc

SEQ ID NO: 132089 - DNA, 22 bp, Artificial Sequence
  Synthetic oligonucleotide; CTT chr11 5292856 5292877 5292861 5292856 -
gttttgcttccacatcaatcca

SEQ ID NO: 132090 - DNA, 22 bp, Artificial Sequence
  Synthetic oligonucleotide; TTG chr11 5292855 5292876 5292860 5292855 -
ttttgcttccacatcaatccac

SEQ ID NO: 132091 - DNA, 22 bp, Artificial Sequence
  Synthetic oligonucleotide; TTT chr11 5292852 5292873 5292857 5292852 -
tgcttccacatcaatccactca

SEQ ID NO: 132092 - DNA, 22 bp, Artificial Sequence
  Synthetic oligonucleotide; TTT chr11 5292851 5292872 5292856 5292851 -
gcttccacatcaatccactcaa

SEQ ID NO: 132093 - DNA, 22 bp, Artificial Sequence
  Synthetic oligonucleotide; TTG chr11 5292850 5292871 5292855 5292850 -
cttccacatcaatccactcaag

SEQ ID NO: 132094 - DNA, 22 bp, Artificial Sequence
  Synthetic oligonucleotide; CTT chr11 5292847 5292868 5292852 5292847 -
ccacatcaatccactcaaggcc

SEQ ID NO: 132095 - DNA, 22 bp, Artificial Sequence
  Synthetic oligonucleotide; TTC chr11 5292846 5292867 5292851 5292846 -
cacatcaatccactcaaggcct

SEQ ID NO: 132096 - DNA, 22 bp, Artificial Sequence
  Synthetic oligonucleotide; CTC chr11 5292831 5292852 5292836 5292831 -
aaggcctacattctgctataat

SEQ ID NO: 132097 - DNA, 22 bp, Artificial Sequence
  Synthetic oligonucleotide; CTA chr11 5292823 5292844 5292828 5292823 -
cattctgctataatgcaatttc

SEQ ID NO: 132098 - DNA, 22 bp, Artificial Sequence
  Synthetic oligonucleotide; TTC chr11 5292818 5292839 5292823 5292818 -
tgctataatgcaatttcaagtt

SEQ ID NO: 132099 - DNA, 22 bp, Artificial Sequence
  Synthetic oligonucleotide; CTG chr11 5292816 5292837 5292821 5292816 -
ctataatgcaatttcaagttct

SEQ ID NO: 132100 - DNA, 22 bp, Artificial Sequence
  Synthetic oligonucleotide; CTA chr11 5292813 5292834 5292818 5292813 -
taatgcaatttcaagttcttta

SEQ ID NO: 132101 - DNA, 22 bp, Artificial Sequence
  Synthetic oligonucleotide; TTT chr11 5292802 5292823 5292807 5292802 -
caagttctttacaggccgagaa

SEQ ID NO: 132102 - DNA, 22 bp, Artificial Sequence
  Synthetic oligonucleotide; TTC chr11 5292801 5292822 5292806 5292801 -
aagttctttacaggccgagaaa

SEQ ID NO: 132103 - DNA, 22 bp, Artificial Sequence
  Synthetic oligonucleotide; TTC chr11 5292795 5292816 5292800 5292795 -
tttacaggccgagaaaaatgaa

SEQ ID NO: 132104 - DNA, 22 bp, Artificial Sequence
  Synthetic oligonucleotide; CTT chr11 5292793 5292814 5292798 5292793 -
tacaggccgagaaaaatgaatc

SEQ ID NO: 132105 - DNA, 22 bp, Artificial Sequence
  Synthetic oligonucleotide; TTT chr11 5292792 5292813 5292797 5292792 -
acaggccgagaaaaatgaatct

SEQ ID NO: 132106 - DNA, 22 bp, Artificial Sequence
  Synthetic oligonucleotide; TTA chr11 5292791 5292812 5292796 5292791 -
caggccgagaaaaatgaatctg

SEQ ID NO: 132107 - DNA, 22 bp, Artificial Sequence
  Synthetic oligonucleotide; CTG chr11 5292769 5292790 5292774 5292769 -
aattcctgacctccaaaagtga

SEQ ID NO: 132108 - DNA, 22 bp, Artificial Sequence
  Synthetic oligonucleotide; TTC chr11 5292764 5292785 5292769 5292764 -
ctgacctccaaaagtgatcaag

SEQ ID NO: 132109 - DNA, 22 bp, Artificial Sequence
  Synthetic oligonucleotide; CTG chr11 5292761 5292782 5292766 5292761 -
acctccaaaagtgatcaagata

SEQ ID NO: 132110 - DNA, 22 bp, Artificial Sequence
  Synthetic oligonucleotide; CTC chr11 5292756 5292777 5292761 5292756 -
caaaagtgatcaagatattttt

SEQ ID NO: 132111 - DNA, 22 bp, Artificial Sequence
  Synthetic oligonucleotide; TTT chr11 5292736 5292757 5292741 5292736 -
ttagttcaggctccaaaatttt

SEQ ID NO: 132112 - DNA, 22 bp, Artificial Sequence
  Synthetic oligonucleotide; TTT chr11 5292735 5292756 5292740 5292735 -
tagttcaggctccaaaattttc

SEQ ID NO: 132113 - DNA, 22 bp, Artificial Sequence
  Synthetic oligonucleotide; TTT chr11 5292734 5292755 5292739 5292734 -
agttcaggctccaaaattttct

SEQ ID NO: 132114 - DNA, 22 bp, Artificial Sequence
  Synthetic oligonucleotide; TTA chr11 5292733 5292754 5292738 5292733 -
gttcaggctccaaaattttctc

SEQ ID NO: 132115 - DNA, 22 bp, Artificial Sequence
  Synthetic oligonucleotide; TTC chr11 5292729 5292750 5292734 5292729 -
aggctccaaaattttctcattt

SEQ ID NO: 132116 - DNA, 22 bp, Artificial Sequence
  Synthetic oligonucleotide; CTC chr11 5292723 5292744 5292728 5292723 -
caaaattttctcattttcatag

SEQ ID NO: 132117 - DNA, 22 bp, Artificial Sequence
  Synthetic oligonucleotide; TTT chr11 5292715 5292736 5292720 5292715 -
tctcattttcataggttttcct

SEQ ID NO: 132118 - DNA, 22 bp, Artificial Sequence
  Synthetic oligonucleotide; TTT chr11 5292714 5292735 5292719 5292714 -
ctcattttcataggttttcctc

SEQ ID NO: 132119 - DNA, 22 bp, Artificial Sequence
  Synthetic oligonucleotide; TTC chr11 5292713 5292734 5292718 5292713 -
tcattttcataggttttcctcg

SEQ ID NO: 132120 - DNA, 22 bp, Artificial Sequence
  Synthetic oligonucleotide; CTC chr11 5292711 5292732 5292716 5292711 -
attttcataggttttcctcgat

SEQ ID NO: 132121 - DNA, 22 bp, Artificial Sequence
  Synthetic oligonucleotide; TTT chr11 5292707 5292728 5292712 5292707 -
tcataggttttcctcgattgat

SEQ ID NO: 132122 - DNA, 22 bp, Artificial Sequence
  Synthetic oligonucleotide; TTT chr11 5292706 5292727 5292711 5292706 -
cataggttttcctcgattgatc

SEQ ID NO: 132123 - DNA, 22 bp, Artificial Sequence
  Synthetic oligonucleotide; TTC chr11 5292705 5292726 5292710 5292705 -
ataggttttcctcgattgatca

SEQ ID NO: 132124 - DNA, 22 bp, Artificial Sequence
  Synthetic oligonucleotide; TTT chr11 5292697 5292718 5292702 5292697 -
tcctcgattgatcattattcat

SEQ ID NO: 132125 - DNA, 22 bp, Artificial Sequence
  Synthetic oligonucleotide; TTT chr11 5292696 5292717 5292701 5292696 -
cctcgattgatcattattcatg

SEQ ID NO: 132126 - DNA, 22 bp, Artificial Sequence
  Synthetic oligonucleotide; TTC chr11 5292695 5292716 5292700 5292695 -
ctcgattgatcattattcatga

SEQ ID NO: 132127 - DNA, 22 bp, Artificial Sequence
  Synthetic oligonucleotide; CTC chr11 5292692 5292713 5292697 5292692 -
gattgatcattattcatgattt

SEQ ID NO: 132128 - DNA, 22 bp, Artificial Sequence
  Synthetic oligonucleotide; TTG chr11 5292687 5292708 5292692 5292687 -
atcattattcatgatttgcaag

SEQ ID NO: 132129 - DNA, 22 bp, Artificial Sequence
  Synthetic oligonucleotide; TTA chr11 5292680 5292701 5292685 5292680 -
ttcatgatttgcaaggaatcat

SEQ ID NO: 132130 - DNA, 22 bp, Artificial Sequence
  Synthetic oligonucleotide; TTC chr11 5292677 5292698 5292682 5292677 -
atgatttgcaaggaatcattca

SEQ ID NO: 132131 - DNA, 22 bp, Artificial Sequence
  Synthetic oligonucleotide; TTT chr11 5292670 5292691 5292675 5292670 -
gcaaggaatcattcaatgtttt

SEQ ID NO: 132132 - DNA, 22 bp, Artificial Sequence
  Synthetic oligonucleotide; TTG chr11 5292669 5292690 5292674 5292669 -
caaggaatcattcaatgttttc

SEQ ID NO: 132133 - DNA, 22 bp, Artificial Sequence
  Synthetic oligonucleotide; TTC chr11 5292656 5292677 5292661 5292656 -
aatgttttctaaatctattact

SEQ ID NO: 132134 - DNA, 22 bp, Artificial Sequence
  Synthetic oligonucleotide; TTT chr11 5292649 5292670 5292654 5292649 -
tctaaatctattactgcatcct

SEQ ID NO: 132135 - DNA, 22 bp, Artificial Sequence
  Synthetic oligonucleotide; TTT chr11 5292648 5292669 5292653 5292648 -
ctaaatctattactgcatcctg

SEQ ID NO: 132136 - DNA, 22 bp, Artificial Sequence
  Synthetic oligonucleotide; TTC chr11 5292647 5292668 5292652 5292647 -
taaatctattactgcatcctga

SEQ ID NO: 132137 - DNA, 22 bp, Artificial Sequence
  Synthetic oligonucleotide; CTA chr11 5292645 5292666 5292650 5292645 -
aatctattactgcatcctgaca

SEQ ID NO: 132138 - DNA, 22 bp, Artificial Sequence
  Synthetic oligonucleotide; CTA chr11 5292639 5292660 5292644 5292639 -
ttactgcatcctgacacatatg

SEQ ID NO: 132139 - DNA, 22 bp, Artificial Sequence
  Synthetic oligonucleotide; TTA chr11 5292636 5292657 5292641 5292636 -
ctgcatcctgacacatatgaca

SEQ ID NO: 132140 - DNA, 22 bp, Artificial Sequence
  Synthetic oligonucleotide; CTG chr11 5292633 5292654 5292638 5292633 -
catcctgacacatatgacattt

SEQ ID NO: 132141 - DNA, 22 bp, Artificial Sequence
  Synthetic oligonucleotide; CTG chr11 5292626 5292647 5292631 5292626 -
acacatatgacattttaactat

SEQ ID NO: 132142 - DNA, 22 bp, Artificial Sequence
  Synthetic oligonucleotide; TTT chr11 5292611 5292632 5292616 5292611 -
taactatgttccagatttttga

SEQ ID NO: 132143 - DNA, 22 bp, Artificial Sequence
  Synthetic oligonucleotide; TTT chr11 5292610 5292631 5292615 5292610 -
aactatgttccagatttttgaa

SEQ ID NO: 132144 - DNA, 22 bp, Artificial Sequence
  Synthetic oligonucleotide; TTA chr11 5292609 5292630 5292614 5292609 -
actatgttccagatttttgaat

SEQ ID NO: 132145 - DNA, 22 bp, Artificial Sequence
  Synthetic oligonucleotide; CTA chr11 5292605 5292626 5292610 5292605 -
tgttccagatttttgaatgaag

SEQ ID NO: 132146 - DNA, 22 bp, Artificial Sequence
  Synthetic oligonucleotide; TTC chr11 5292600 5292621 5292605 5292600 -
cagatttttgaatgaagagtgt

SEQ ID NO: 132147 - DNA, 22 bp, Artificial Sequence
  Synthetic oligonucleotide; TTT chr11 5292593 5292614 5292598 5292593 -
ttgaatgaagagtgtaaatttt

SEQ ID NO: 132148 - DNA, 22 bp, Artificial Sequence
  Synthetic oligonucleotide; TTT chr11 5292592 5292613 5292597 5292592 -
tgaatgaagagtgtaaatttta

SEQ ID NO: 132149 - DNA, 22 bp, Artificial Sequence
  Synthetic oligonucleotide; TTT chr11 5292591 5292612 5292596 5292591 -
gaatgaagagtgtaaattttaa

SEQ ID NO: 132150 - DNA, 22 bp, Artificial Sequence
  Synthetic oligonucleotide; TTG chr11 5292590 5292611 5292595 5292590 -
aatgaagagtgtaaattttaaa

SEQ ID NO: 132151 - DNA, 22 bp, Artificial Sequence
  Synthetic oligonucleotide; TTT chr11 5292572 5292593 5292577 5292572 -
taaatgttttcaccacaaaaaa

SEQ ID NO: 132152 - DNA, 22 bp, Artificial Sequence
  Synthetic oligonucleotide; TTT chr11 5292571 5292592 5292576 5292571 -
aaatgttttcaccacaaaaaat

SEQ ID NO: 132153 - DNA, 22 bp, Artificial Sequence
  Synthetic oligonucleotide; TTA chr11 5292570 5292591 5292575 5292570 -
aatgttttcaccacaaaaaata

SEQ ID NO: 132154 - DNA, 22 bp, Artificial Sequence
  Synthetic oligonucleotide; TTT chr11 5292563 5292584 5292568 5292563 -
tcaccacaaaaaataagtatgt

SEQ ID NO: 132155 - DNA, 22 bp, Artificial Sequence
  Synthetic oligonucleotide; TTT chr11 5292562 5292583 5292567 5292562 -
caccacaaaaaataagtatgtg

SEQ ID NO: 132156 - DNA, 22 bp, Artificial Sequence
  Synthetic oligonucleotide; TTC chr11 5292561 5292582 5292566 5292561 -
accacaaaaaataagtatgtga

SEQ ID NO: 132157 - DNA, 22 bp, Artificial Sequence
  Synthetic oligonucleotide; TTT chr11 5292527 5292548 5292532 5292527 -
gttaattagccttatttaacca

SEQ ID NO: 132158 - DNA, 22 bp, Artificial Sequence
  Synthetic oligonucleotide; TTG chr11 5292526 5292547 5292531 5292526 -
ttaattagccttatttaaccat

SEQ ID NO: 132159 - DNA, 22 bp, Artificial Sequence
  Synthetic oligonucleotide; TTA chr11 5292523 5292544 5292528 5292523 -
attagccttatttaaccattta

SEQ ID NO: 132160 - DNA, 22 bp, Artificial Sequence
  Synthetic oligonucleotide; TTA chr11 5292519 5292540 5292524 5292519 -
gccttatttaaccatttaatat

SEQ ID NO: 132161 - DNA, 22 bp, Artificial Sequence
  Synthetic oligonucleotide; CTT chr11 5292514 5292535 5292519 5292514 -
atttaaccatttaatattgtac

SEQ ID NO: 132162 - DNA, 22 bp, Artificial Sequence
  Synthetic oligonucleotide; TTA chr11 5292513 5292534 5292518 5292513 -
tttaaccatttaatattgtaca

SEQ ID NO: 132163 - DNA, 22 bp, Artificial Sequence
  Synthetic oligonucleotide; TTT chr11 5292510 5292531 5292515 5292510 -
aaccatttaatattgtacacgt

SEQ ID NO: 132164 - DNA, 22 bp, Artificial Sequence
  Synthetic oligonucleotide; TTA chr11 5292509 5292530 5292514 5292509 -
accatttaatattgtacacgta

SEQ ID NO: 132165 - DNA, 22 bp, Artificial Sequence
  Synthetic oligonucleotide; TTT chr11 5292502 5292523 5292507 5292502 -
aatattgtacacgtacaccaaa

SEQ ID NO: 132166 - DNA, 22 bp, Artificial Sequence
  Synthetic oligonucleotide; TTA chr11 5292501 5292522 5292506 5292501 -
atattgtacacgtacaccaaag

SEQ ID NO: 132167 - DNA, 22 bp, Artificial Sequence
  Synthetic oligonucleotide; TTG chr11 5292495 5292516 5292500 5292495 -
tacacgtacaccaaagcatcat

SEQ ID NO: 132168 - DNA, 22 bp, Artificial Sequence
  Synthetic oligonucleotide; TTG chr11 5292469 5292490 5292474 5292469 -
taccccatgaatacacacaatt

SEQ ID NO: 132169 - DNA, 22 bp, Artificial Sequence
  Synthetic oligonucleotide; TTA chr11 5292446 5292467 5292451 5292446 -
ttatttgtcaatttaaaatgaa

SEQ ID NO: 132170 - DNA, 22 bp, Artificial Sequence
  Synthetic oligonucleotide; TTA chr11 5292443 5292464 5292448 5292443 -
tttgtcaatttaaaatgaaata

SEQ ID NO: 132171 - DNA, 22 bp, Artificial Sequence
  Synthetic oligonucleotide; TTT chr11 5292440 5292461 5292445 5292440 -
gtcaatttaaaatgaaataata

SEQ ID NO: 132172 - DNA, 22 bp, Artificial Sequence
  Synthetic oligonucleotide; TTG chr11 5292439 5292460 5292444 5292439 -
tcaatttaaaatgaaataataa

SEQ ID NO: 132173 - DNA, 22 bp, Artificial Sequence
  Synthetic oligonucleotide; TTT chr11 5292432 5292453 5292437 5292432 -
aaaatgaaataataaaaaataa

SEQ ID NO: 132174 - DNA, 22 bp, Artificial Sequence
  Synthetic oligonucleotide; TTA chr11 5292431 5292452 5292436 5292431 -
aaatgaaataataaaaaataac

SEQ ID NO: 132175 - DNA, 22 bp, Artificial Sequence
  Synthetic oligonucleotide; TTA chr11 5292399 5292420 5292404 5292399 -
gcctctgcattgcctttaccgg

SEQ ID NO: 132176 - DNA, 22 bp, Artificial Sequence
  Synthetic oligonucleotide; CTC chr11 5292394 5292415 5292399 5292394 -
tgcattgcctttaccggtcatc

SEQ ID NO: 132177 - DNA, 22 bp, Artificial Sequence
  Synthetic oligonucleotide; CTG chr11 5292392 5292413 5292397 5292392 -
cattgcctttaccggtcatcct

SEQ ID NO: 132178 - DNA, 22 bp, Artificial Sequence
  Synthetic oligonucleotide; TTG chr11 5292387 5292408 5292392 5292387 -
cctttaccggtcatcctcacgg

SEQ ID NO: 132179 - DNA, 22 bp, Artificial Sequence
  Synthetic oligonucleotide; CTT chr11 5292383 5292404 5292388 5292383 -
taccggtcatcctcacggtgac

SEQ ID NO: 132180 - DNA, 22 bp, Artificial Sequence
  Synthetic oligonucleotide; TTT chr11 5292382 5292403 5292387 5292382 -
accggtcatcctcacggtgact

SEQ ID NO: 132181 - DNA, 22 bp, Artificial Sequence
  Synthetic oligonucleotide; TTA chr11 5292381 5292402 5292386 5292381 -
ccggtcatcctcacggtgacta

SEQ ID NO: 132182 - DNA, 22 bp, Artificial Sequence
  Synthetic oligonucleotide; CTC chr11 5292369 5292390 5292374 5292369 -
acggtgactaacgcaaaaaacg

SEQ ID NO: 132183 - DNA, 22 bp, Artificial Sequence
  Synthetic oligonucleotide; CTA chr11 5292359 5292380 5292364 5292359 -
acgcaaaaaacgttctatttca

SEQ ID NO: 132184 - DNA, 22 bp, Artificial Sequence
  Synthetic oligonucleotide; TTC chr11 5292344 5292365 5292349 5292344 -
tatttcatccttacaaacatcc

SEQ ID NO: 132185 - DNA, 22 bp, Artificial Sequence
  Synthetic oligonucleotide; CTA chr11 5292342 5292363 5292347 5292342 -
tttcatccttacaaacatccct

SEQ ID NO: 132186 - DNA, 22 bp, Artificial Sequence
  Synthetic oligonucleotide; TTT chr11 5292339 5292360 5292344 5292339 -
catccttacaaacatccctatc

SEQ ID NO: 132187 - DNA, 22 bp, Artificial Sequence
  Synthetic oligonucleotide; TTC chr11 5292338 5292359 5292343 5292338 -
atccttacaaacatccctatct

SEQ ID NO: 132188 - DNA, 22 bp, Artificial Sequence
  Synthetic oligonucleotide; CTT chr11 5292332 5292353 5292337 5292332 -
acaaacatccctatctttgatg

SEQ ID NO: 132189 - DNA, 22 bp, Artificial Sequence
  Synthetic oligonucleotide; TTA chr11 5292331 5292352 5292336 5292331 -
caaacatccctatctttgatgc

SEQ ID NO: 132190 - DNA, 22 bp, Artificial Sequence
  Synthetic oligonucleotide; CTA chr11 5292319 5292340 5292324 5292319 -
tctttgatgcctctttgtctag

SEQ ID NO: 132191 - DNA, 22 bp, Artificial Sequence
  Synthetic oligonucleotide; CTT chr11 5292315 5292336 5292320 5292315 -
tgatgcctctttgtctagatct

SEQ ID NO: 132192 - DNA, 22 bp, Artificial Sequence
  Synthetic oligonucleotide; TTT chr11 5292314 5292335 5292319 5292314 -
gatgcctctttgtctagatctc

SEQ ID NO: 132193 - DNA, 22 bp, Artificial Sequence
  Synthetic oligonucleotide; TTG chr11 5292313 5292334 5292318 5292313 -
atgcctctttgtctagatctct

SEQ ID NO: 132194 - DNA, 22 bp, Artificial Sequence
  Synthetic oligonucleotide; CTC chr11 5292306 5292327 5292311 5292306 -
tttgtctagatctctatcccct

SEQ ID NO: 132195 - DNA, 22 bp, Artificial Sequence
  Synthetic oligonucleotide; CTT chr11 5292304 5292325 5292309 5292304 -
tgtctagatctctatcccctcc

SEQ ID NO: 132196 - DNA, 22 bp, Artificial Sequence
  Synthetic oligonucleotide; TTT chr11 5292303 5292324 5292308 5292303 -
gtctagatctctatcccctcct

SEQ ID NO: 132197 - DNA, 22 bp, Artificial Sequence
  Synthetic oligonucleotide; TTG chr11 5292302 5292323 5292307 5292302 -
tctagatctctatcccctcctg

SEQ ID NO: 132198 - DNA, 22 bp, Artificial Sequence
  Synthetic oligonucleotide; CTA chr11 5292298 5292319 5292303 5292298 -
gatctctatcccctcctgtttt

SEQ ID NO: 132199 - DNA, 22 bp, Artificial Sequence
  Synthetic oligonucleotide; CTC chr11 5292292 5292313 5292297 5292292 -
tatcccctcctgttttctctac

SEQ ID NO: 132200 - DNA, 22 bp, Artificial Sequence
  Synthetic oligonucleotide; CTA chr11 5292290 5292311 5292295 5292290 -
tcccctcctgttttctctacgt

SEQ ID NO: 132201 - DNA, 22 bp, Artificial Sequence
  Synthetic oligonucleotide; CTC chr11 5292283 5292304 5292288 5292283 -
ctgttttctctacgttatttat

SEQ ID NO: 132202 - DNA, 22 bp, Artificial Sequence
  Synthetic oligonucleotide; CTG chr11 5292280 5292301 5292285 5292280 -
ttttctctacgttatttatatg

SEQ ID NO: 132203 - DNA, 22 bp, Artificial Sequence
  Synthetic oligonucleotide; TTT chr11 5292277 5292298 5292282 5292277 -
tctctacgttatttatatgggt

SEQ ID NO: 132204 - DNA, 22 bp, Artificial Sequence
  Synthetic oligonucleotide; TTT chr11 5292276 5292297 5292281 5292276 -
ctctacgttatttatatgggta

SEQ ID NO: 132205 - DNA, 22 bp, Artificial Sequence
  Synthetic oligonucleotide; TTC chr11 5292275 5292296 5292280 5292275 -
tctacgttatttatatgggtat

SEQ ID NO: 132206 - DNA, 22 bp, Artificial Sequence
  Synthetic oligonucleotide; CTC chr11 5292273 5292294 5292278 5292273 -
tacgttatttatatgggtatca

SEQ ID NO: 132207 - DNA, 22 bp, Artificial Sequence
  Synthetic oligonucleotide; CTA chr11 5292271 5292292 5292276 5292271 -
cgttatttatatgggtatcatc

SEQ ID NO: 132208 - DNA, 22 bp, Artificial Sequence
  Synthetic oligonucleotide; TTA chr11 5292266 5292287 5292271 5292266 -
tttatatgggtatcatcaccat

SEQ ID NO: 132209 - DNA, 22 bp, Artificial Sequence
  Synthetic oligonucleotide; TTT chr11 5292263 5292284 5292268 5292263 -
atatgggtatcatcaccatcct

SEQ ID NO: 132210 - DNA, 22 bp, Artificial Sequence
  Synthetic oligonucleotide; TTA chr11 5292262 5292283 5292267 5292262 -
tatgggtatcatcaccatcctg

SEQ ID NO: 132211 - DNA, 22 bp, Artificial Sequence
  Synthetic oligonucleotide; CTG chr11 5292240 5292261 5292245 5292240 -
gacaacatcaggacagatatcc

SEQ ID NO: 132212 - DNA, 22 bp, Artificial Sequence
  Synthetic oligonucleotide; CTC chr11 5292215 5292236 5292220 5292215 -
accaagccaatgttcctctcta

SEQ ID NO: 132213 - DNA, 22 bp, Artificial Sequence
  Synthetic oligonucleotide; TTC chr11 5292200 5292221 5292205 5292200 -
ctctctatgttggctcaaatgt

SEQ ID NO: 132214 - DNA, 22 bp, Artificial Sequence
  Synthetic oligonucleotide; CTC chr11 5292197 5292218 5292202 5292197 -
tctatgttggctcaaatgtcct

SEQ ID NO: 132215 - DNA, 22 bp, Artificial Sequence
  Synthetic oligonucleotide; CTC chr11 5292195 5292216 5292200 5292195 -
tatgttggctcaaatgtccttg

SEQ ID NO: 132216 - DNA, 22 bp, Artificial Sequence
  Synthetic oligonucleotide; CTA chr11 5292193 5292214 5292198 5292193 -
tgttggctcaaatgtccttgaa

SEQ ID NO: 132217 - DNA, 22 bp, Artificial Sequence
  Synthetic oligonucleotide; TTG chr11 5292188 5292209 5292193 5292188 -
gctcaaatgtccttgaactttc

SEQ ID NO: 132218 - DNA, 22 bp, Artificial Sequence
  Synthetic oligonucleotide; CTC chr11 5292184 5292205 5292189 5292184 -
aaatgtccttgaactttccttt

SEQ ID NO: 132219 - DNA, 22 bp, Artificial Sequence
  Synthetic oligonucleotide; CTT chr11 5292174 5292195 5292179 5292174 -
gaactttcctttcaccaccctt

SEQ ID NO: 132220 - DNA, 22 bp, Artificial Sequence
  Synthetic oligonucleotide; TTG chr11 5292173 5292194 5292178 5292173 -
aactttcctttcaccacccttt

SEQ ID NO: 132221 - DNA, 22 bp, Artificial Sequence
  Synthetic oligonucleotide; CTT chr11 5292168 5292189 5292173 5292168 -
tcctttcaccaccctttccaca

SEQ ID NO: 132222 - DNA, 22 bp, Artificial Sequence
  Synthetic oligonucleotide; TTT chr11 5292167 5292188 5292172 5292167 -
cctttcaccaccctttccacag

SEQ ID NO: 132223 - DNA, 22 bp, Artificial Sequence
  Synthetic oligonucleotide; TTC chr11 5292166 5292187 5292171 5292166 -
ctttcaccaccctttccacagt

SEQ ID NO: 132224 - DNA, 22 bp, Artificial Sequence
  Synthetic oligonucleotide; CTT chr11 5292163 5292184 5292168 5292163 -
tcaccaccctttccacagtcaa

SEQ ID NO: 132225 - DNA, 22 bp, Artificial Sequence
  Synthetic oligonucleotide; TTT chr11 5292162 5292183 5292167 5292162 -
caccaccctttccacagtcaaa

SEQ ID NO: 132226 - DNA, 22 bp, Artificial Sequence
  Synthetic oligonucleotide; TTC chr11 5292161 5292182 5292166 5292161 -
accaccctttccacagtcaaaa

SEQ ID NO: 132227 - DNA, 22 bp, Artificial Sequence
  Synthetic oligonucleotide; CTT chr11 5292152 5292173 5292157 5292152 -
tccacagtcaaaaggatattgt

SEQ ID NO: 132228 - DNA, 22 bp, Artificial Sequence
  Synthetic oligonucleotide; TTT chr11 5292151 5292172 5292156 5292151 -
ccacagtcaaaaggatattgta

SEQ ID NO: 132229 - DNA, 22 bp, Artificial Sequence
  Synthetic oligonucleotide; TTC chr11 5292150 5292171 5292155 5292150 -
cacagtcaaaaggatattgtag

SEQ ID NO: 132230 - DNA, 22 bp, Artificial Sequence
  Synthetic oligonucleotide; TTG chr11 5292131 5292152 5292136 5292131 -
tagtttaatgcctcagagttca

SEQ ID NO: 132231 - DNA, 22 bp, Artificial Sequence
  Synthetic oligonucleotide; TTT chr11 5292125 5292146 5292130 5292125 -
aatgcctcagagttcagctttt

SEQ ID NO: 132232 - DNA, 22 bp, Artificial Sequence
  Synthetic oligonucleotide; TTA chr11 5292124 5292145 5292129 5292124 -
atgcctcagagttcagctttta

SEQ ID NO: 132233 - DNA, 22 bp, Artificial Sequence
  Synthetic oligonucleotide; CTC chr11 5292117 5292138 5292122 5292117 -
agagttcagcttttaagcttct

SEQ ID NO: 132234 - DNA, 22 bp, Artificial Sequence
  Synthetic oligonucleotide; TTC chr11 5292110 5292131 5292115 5292110 -
agcttttaagcttctgacaaat

SEQ ID NO: 132235 - DNA, 22 bp, Artificial Sequence
  Synthetic oligonucleotide; CTT chr11 5292105 5292126 5292110 5292105 -
ttaagcttctgacaaattattc

SEQ ID NO: 132236 - DNA, 22 bp, Artificial Sequence
  Synthetic oligonucleotide; TTT chr11 5292104 5292125 5292109 5292104 -
taagcttctgacaaattattct

SEQ ID NO: 132237 - DNA, 22 bp, Artificial Sequence
  Synthetic oligonucleotide; TTT chr11 5292103 5292124 5292108 5292103 -
aagcttctgacaaattattctt

SEQ ID NO: 132238 - DNA, 22 bp, Artificial Sequence
  Synthetic oligonucleotide; TTA chr11 5292102 5292123 5292107 5292102 -
agcttctgacaaattattcttc

SEQ ID NO: 132239 - DNA, 22 bp, Artificial Sequence
  Synthetic oligonucleotide; CTT chr11 5292097 5292118 5292102 5292097 -
ctgacaaattattcttcctctt

SEQ ID NO: 132240 - DNA, 22 bp, Artificial Sequence
  Synthetic oligonucleotide; TTC chr11 5292096 5292117 5292101 5292096 -
tgacaaattattcttcctcttt

SEQ ID NO: 132241 - DNA, 22 bp, Artificial Sequence
  Synthetic oligonucleotide; CTG chr11 5292094 5292115 5292099 5292094 -
acaaattattcttcctctttag

SEQ ID NO: 132242 - DNA, 22 bp, Artificial Sequence
  Synthetic oligonucleotide; TTA chr11 5292086 5292107 5292091 5292086 -
ttcttcctctttaggttctcct

SEQ ID NO: 132243 - DNA, 22 bp, Artificial Sequence
  Synthetic oligonucleotide; TTC chr11 5292083 5292104 5292088 5292083 -
ttcctctttaggttctccttta

SEQ ID NO: 132244 - DNA, 22 bp, Artificial Sequence
  Synthetic oligonucleotide; CTT chr11 5292081 5292102 5292086 5292081 -
cctctttaggttctcctttatg

SEQ ID NO: 132245 - DNA, 22 bp, Artificial Sequence
  Synthetic oligonucleotide; TTC chr11 5292080 5292101 5292085 5292080 -
ctctttaggttctcctttatgg

SEQ ID NO: 132246 - DNA, 22 bp, Artificial Sequence
  Synthetic oligonucleotide; CTC chr11 5292077 5292098 5292082 5292077 -
tttaggttctcctttatggaat

SEQ ID NO: 132247 - DNA, 22 bp, Artificial Sequence
  Synthetic oligonucleotide; CTT chr11 5292075 5292096 5292080 5292075 -
taggttctcctttatggaatct

SEQ ID NO: 132248 - DNA, 22 bp, Artificial Sequence
  Synthetic oligonucleotide; TTT chr11 5292074 5292095 5292079 5292074 -
aggttctcctttatggaatctt

SEQ ID NO: 132249 - DNA, 22 bp, Artificial Sequence
  Synthetic oligonucleotide; TTA chr11 5292073 5292094 5292078 5292073 -
ggttctcctttatggaatcttc

SEQ ID NO: 132250 - DNA, 22 bp, Artificial Sequence
  Synthetic oligonucleotide; TTC chr11 5292068 5292089 5292073 5292068 -
tcctttatggaatcttctgtac

SEQ ID NO: 132251 - DNA, 22 bp, Artificial Sequence
  Synthetic oligonucleotide; CTC chr11 5292066 5292087 5292071 5292066 -
ctttatggaatcttctgtactg

SEQ ID NO: 132252 - DNA, 22 bp, Artificial Sequence
  Synthetic oligonucleotide; CTT chr11 5292063 5292084 5292068 5292063 -
tatggaatcttctgtactgatg

SEQ ID NO: 132253 - DNA, 22 bp, Artificial Sequence
  Synthetic oligonucleotide; TTT chr11 5292062 5292083 5292067 5292062 -
atggaatcttctgtactgatgg

SEQ ID NO: 132254 - DNA, 22 bp, Artificial Sequence
  Synthetic oligonucleotide; TTA chr11 5292061 5292082 5292066 5292061 -
tggaatcttctgtactgatggc

SEQ ID NO: 132255 - DNA, 22 bp, Artificial Sequence
  Synthetic oligonucleotide; CTT chr11 5292052 5292073 5292057 5292052 -
ctgtactgatggccatgtcctt

SEQ ID NO: 132256 - DNA, 22 bp, Artificial Sequence
  Synthetic oligonucleotide; TTC chr11 5292051 5292072 5292056 5292051 -
tgtactgatggccatgtccttt

SEQ ID NO: 132257 - DNA, 22 bp, Artificial Sequence
  Synthetic oligonucleotide; CTG chr11 5292049 5292070 5292054 5292049 -
tactgatggccatgtcctttaa

SEQ ID NO: 132258 - DNA, 22 bp, Artificial Sequence
  Synthetic oligonucleotide; CTG chr11 5292044 5292065 5292049 5292044 -
atggccatgtcctttaactact

SEQ ID NO: 132259 - DNA, 22 bp, Artificial Sequence
  Synthetic oligonucleotide; CTT chr11 5292030 5292051 5292035 5292030 -
taactactatgtagatatctgc

SEQ ID NO: 132260 - DNA, 22 bp, Artificial Sequence
  Synthetic oligonucleotide; TTT chr11 5292029 5292050 5292034 5292029 -
aactactatgtagatatctgct

SEQ ID NO: 132261 - DNA, 22 bp, Artificial Sequence
  Synthetic oligonucleotide; TTA chr11 5292028 5292049 5292033 5292028 -
actactatgtagatatctgcta

SEQ ID NO: 132262 - DNA, 22 bp, Artificial Sequence
  Synthetic oligonucleotide; CTA chr11 5292024 5292045 5292029 5292024 -
ctatgtagatatctgctactac

SEQ ID NO: 132263 - DNA, 22 bp, Artificial Sequence
  Synthetic oligonucleotide; CTA chr11 5292021 5292042 5292026 5292021 -
tgtagatatctgctactacctg

SEQ ID NO: 132264 - DNA, 22 bp, Artificial Sequence
  Synthetic oligonucleotide; CTG chr11 5292009 5292030 5292014 5292009 -
ctactacctgtattatgcctct

SEQ ID NO: 132265 - DNA, 22 bp, Artificial Sequence
  Synthetic oligonucleotide; CTA chr11 5292006 5292027 5292011 5292006 -
ctacctgtattatgcctctacc

SEQ ID NO: 132266 - DNA, 22 bp, Artificial Sequence
  Synthetic oligonucleotide; CTA chr11 5292003 5292024 5292008 5292003 -
cctgtattatgcctctaccttt

SEQ ID NO: 132267 - DNA, 22 bp, Artificial Sequence
  Synthetic oligonucleotide; CTG chr11 5291999 5292020 5292004 5291999 -
tattatgcctctacctttatta

SEQ ID NO: 132268 - DNA, 22 bp, Artificial Sequence
  Synthetic oligonucleotide; TTA chr11 5291994 5292015 5291999 5291994 -
tgcctctacctttattagcaga

SEQ ID NO: 132269 - DNA, 22 bp, Artificial Sequence
  Synthetic oligonucleotide; CTC chr11 5291988 5292009 5291993 5291988 -
tacctttattagcagagttatc

SEQ ID NO: 132270 - DNA, 22 bp, Artificial Sequence
  Synthetic oligonucleotide; CTA chr11 5291986 5292007 5291991 5291986 -
cctttattagcagagttatctg

SEQ ID NO: 132271 - DNA, 22 bp, Artificial Sequence
  Synthetic oligonucleotide; CTT chr11 5291982 5292003 5291987 5291982 -
tattagcagagttatctgtact

SEQ ID NO: 132272 - DNA, 22 bp, Artificial Sequence
  Synthetic oligonucleotide; TTT chr11 5291981 5292002 5291986 5291981 -
attagcagagttatctgtactg

SEQ ID NO: 132273 - DNA, 22 bp, Artificial Sequence
  Synthetic oligonucleotide; TTA chr11 5291980 5292001 5291985 5291980 -
ttagcagagttatctgtactgt

SEQ ID NO: 132274 - DNA, 22 bp, Artificial Sequence
  Synthetic oligonucleotide; TTA chr11 5291977 5291998 5291982 5291977 -
gcagagttatctgtactgttgg

SEQ ID NO: 132275 - DNA, 22 bp, Artificial Sequence
  Synthetic oligonucleotide; TTA chr11 5291968 5291989 5291973 5291968 -
tctgtactgttggcatgacaat

SEQ ID NO: 132276 - DNA, 22 bp, Artificial Sequence
  Synthetic oligonucleotide; CTG chr11 5291964 5291985 5291969 5291964 -
tactgttggcatgacaatcatt

SEQ ID NO: 132277 - DNA, 22 bp, Artificial Sequence
  Synthetic oligonucleotide; CTG chr11 5291959 5291980 5291964 5291959 -
ttggcatgacaatcatttgtta

SEQ ID NO: 132278 - DNA, 22 bp, Artificial Sequence
  Synthetic oligonucleotide; TTG chr11 5291956 5291977 5291961 5291956 -
gcatgacaatcatttgttaata

SEQ ID NO: 132279 - DNA, 22 bp, Artificial Sequence
  Synthetic oligonucleotide; TTT chr11 5291941 5291962 5291946 5291941 -
gttaatatgacttgcctttcct

SEQ ID NO: 132280 - DNA, 22 bp, Artificial Sequence
  Synthetic oligonucleotide; TTG chr11 5291940 5291961 5291945 5291940 -
ttaatatgacttgcctttcctt

SEQ ID NO: 132281 - DNA, 22 bp, Artificial Sequence
  Synthetic oligonucleotide; TTA chr11 5291937 5291958 5291942 5291937 -
atatgacttgcctttccttttt

SEQ ID NO: 132282 - DNA, 22 bp, Artificial Sequence
  Synthetic oligonucleotide; CTT chr11 5291928 5291949 5291933 5291928 -
gcctttcctttttctgctattc

SEQ ID NO: 132283 - DNA, 22 bp, Artificial Sequence
  Synthetic oligonucleotide; TTG chr11 5291927 5291948 5291932 5291927 -
cctttcctttttctgctattct

SEQ ID NO: 132284 - DNA, 22 bp, Artificial Sequence
  Synthetic oligonucleotide; CTT chr11 5291923 5291944 5291928 5291923 -
tcctttttctgctattcttgat

SEQ ID NO: 132285 - DNA, 22 bp, Artificial Sequence
  Synthetic oligonucleotide; TTT chr11 5291922 5291943 5291927 5291922 -
cctttttctgctattcttgatc

SEQ ID NO: 132286 - DNA, 22 bp, Artificial Sequence
  Synthetic oligonucleotide; TTC chr11 5291921 5291942 5291926 5291921 -
ctttttctgctattcttgatca

SEQ ID NO: 132287 - DNA, 22 bp, Artificial Sequence
  Synthetic oligonucleotide; CTT chr11 5291918 5291939 5291923 5291918 -
tttctgctattcttgatcaaat

SEQ ID NO: 132288 - DNA, 22 bp, Artificial Sequence
  Synthetic oligonucleotide; TTT chr11 5291917 5291938 5291922 5291917 -
ttctgctattcttgatcaaatg

SEQ ID NO: 132289 - DNA, 22 bp, Artificial Sequence
  Synthetic oligonucleotide; TTT chr11 5291916 5291937 5291921 5291916 -
tctgctattcttgatcaaatgg

SEQ ID NO: 132290 - DNA, 22 bp, Artificial Sequence
  Synthetic oligonucleotide; TTT chr11 5291915 5291936 5291920 5291915 -
ctgctattcttgatcaaatggc

SEQ ID NO: 132291 - DNA, 22 bp, Artificial Sequence
  Synthetic oligonucleotide; TTC chr11 5291914 5291935 5291919 5291914 -
tgctattcttgatcaaatggct

SEQ ID NO: 132292 - DNA, 22 bp, Artificial Sequence
  Synthetic oligonucleotide; CTG chr11 5291912 5291933 5291917 5291912 -
ctattcttgatcaaatggctcc

SEQ ID NO: 132293 - DNA, 22 bp, Artificial Sequence
  Synthetic oligonucleotide; CTA chr11 5291909 5291930 5291914 5291909 -
ttcttgatcaaatggctcctct

SEQ ID NO: 132294 - DNA, 22 bp, Artificial Sequence
  Synthetic oligonucleotide; TTC chr11 5291906 5291927 5291911 5291906 -
ttgatcaaatggctcctctttc

SEQ ID NO: 132295 - DNA, 22 bp, Artificial Sequence
  Synthetic oligonucleotide; CTT chr11 5291904 5291925 5291909 5291904 -
gatcaaatggctcctctttctt

SEQ ID NO: 132296 - DNA, 22 bp, Artificial Sequence
  Synthetic oligonucleotide; TTG chr11 5291903 5291924 5291908 5291903 -
atcaaatggctcctctttcttg

SEQ ID NO: 132297 - DNA, 22 bp, Artificial Sequence
  Synthetic oligonucleotide; CTC chr11 5291891 5291912 5291896 5291891 -
ctctttcttgctcctctcattt

SEQ ID NO: 132298 - DNA, 22 bp, Artificial Sequence
  Synthetic oligonucleotide; CTC chr11 5291888 5291909 5291893 5291888 -
tttcttgctcctctcatttctc

SEQ ID NO: 132299 - DNA, 22 bp, Artificial Sequence
  Synthetic oligonucleotide; CTT chr11 5291886 5291907 5291891 5291886 -
tcttgctcctctcatttctcct

SEQ ID NO: 132300 - DNA, 22 bp, Artificial Sequence
  Synthetic oligonucleotide; TTT chr11 5291885 5291906 5291890 5291885 -
cttgctcctctcatttctcctg

SEQ ID NO: 132301 - DNA, 22 bp, Artificial Sequence
  Synthetic oligonucleotide; TTC chr11 5291884 5291905 5291889 5291884 -
ttgctcctctcatttctcctgc

SEQ ID NO: 132302 - DNA, 22 bp, Artificial Sequence
  Synthetic oligonucleotide; CTT chr11 5291882 5291903 5291887 5291882 -
gctcctctcatttctcctgcct

SEQ ID NO: 132303 - DNA, 22 bp, Artificial Sequence
  Synthetic oligonucleotide; TTG chr11 5291881 5291902 5291886 5291881 -
ctcctctcatttctcctgcctt

SEQ ID NO: 132304 - DNA, 22 bp, Artificial Sequence
  Synthetic oligonucleotide; CTC chr11 5291878 5291899 5291883 5291878 -
ctctcatttctcctgccttcac

SEQ ID NO: 132305 - DNA, 22 bp, Artificial Sequence
  Synthetic oligonucleotide; CTC chr11 5291875 5291896 5291880 5291875 -
tcatttctcctgccttcacttg

SEQ ID NO: 132306 - DNA, 22 bp, Artificial Sequence
  Synthetic oligonucleotide; CTC chr11 5291873 5291894 5291878 5291873 -
atttctcctgccttcacttgga

SEQ ID NO: 132307 - DNA, 22 bp, Artificial Sequence
  Synthetic oligonucleotide; TTT chr11 5291869 5291890 5291874 5291869 -
ctcctgccttcacttggacgtg

SEQ ID NO: 132308 - DNA, 22 bp, Artificial Sequence
  Synthetic oligonucleotide; TTC chr11 5291868 5291889 5291873 5291868 -
tcctgccttcacttggacgtgc

SEQ ID NO: 132309 - DNA, 22 bp, Artificial Sequence
  Synthetic oligonucleotide; CTC chr11 5291866 5291887 5291871 5291866 -
ctgccttcacttggacgtgctt

SEQ ID NO: 132310 - DNA, 22 bp, Artificial Sequence
  Synthetic oligonucleotide; CTG chr11 5291863 5291884 5291868 5291863 -
ccttcacttggacgtgcttcac

SEQ ID NO: 132311 - DNA, 22 bp, Artificial Sequence
  Synthetic oligonucleotide; CTT chr11 5291859 5291880 5291864 5291859 -
cacttggacgtgcttcacgtag

SEQ ID NO: 132312 - DNA, 22 bp, Artificial Sequence
  Synthetic oligonucleotide; TTC chr11 5291858 5291879 5291863 5291858 -
acttggacgtgcttcacgtagt

SEQ ID NO: 132313 - DNA, 22 bp, Artificial Sequence
  Synthetic oligonucleotide; CTT chr11 5291854 5291875 5291859 5291854 -
ggacgtgcttcacgtagtctgt

SEQ ID NO: 132314 - DNA, 22 bp, Artificial Sequence
  Synthetic oligonucleotide; TTG chr11 5291853 5291874 5291858 5291853 -
gacgtgcttcacgtagtctgtg

SEQ ID NO: 132315 - DNA, 22 bp, Artificial Sequence
  Synthetic oligonucleotide; CTT chr11 5291844 5291865 5291849 5291844 -
cacgtagtctgtgcttatgact

SEQ ID NO: 132316 - DNA, 22 bp, Artificial Sequence
  Synthetic oligonucleotide; TTC chr11 5291843 5291864 5291848 5291843 -
acgtagtctgtgcttatgactg

SEQ ID NO: 132317 - DNA, 22 bp, Artificial Sequence
  Synthetic oligonucleotide; CTG chr11 5291833 5291854 5291838 5291833 -
tgcttatgactggattaaaaat

SEQ ID NO: 132318 - DNA, 22 bp, Artificial Sequence
  Synthetic oligonucleotide; CTT chr11 5291828 5291849 5291833 5291828 -
atgactggattaaaaattgata

SEQ ID NO: 132319 - DNA, 22 bp, Artificial Sequence
  Synthetic oligonucleotide; TTA chr11 5291827 5291848 5291832 5291827 -
tgactggattaaaaattgatat

SEQ ID NO: 132320 - DNA, 22 bp, Artificial Sequence
  Synthetic oligonucleotide; CTG chr11 5291821 5291842 5291826 5291821 -
gattaaaaattgatatggactt

SEQ ID NO: 132321 - DNA, 22 bp, Artificial Sequence
  Synthetic oligonucleotide; TTA chr11 5291816 5291837 5291821 5291816 -
aaaattgatatggacttatcct

SEQ ID NO: 132322 - DNA, 22 bp, Artificial Sequence
  Synthetic oligonucleotide; TTG chr11 5291809 5291830 5291814 5291809 -
atatggacttatcctaatgttg

SEQ ID NO: 132323 - DNA, 22 bp, Artificial Sequence
  Synthetic oligonucleotide; CTT chr11 5291799 5291820 5291804 5291799 -
atcctaatgttgttcgtcataa

SEQ ID NO: 132324 - DNA, 22 bp, Artificial Sequence
  Synthetic oligonucleotide; TTA chr11 5291798 5291819 5291803 5291798 -
tcctaatgttgttcgtcataat

SEQ ID NO: 132325 - DNA, 22 bp, Artificial Sequence
  Synthetic oligonucleotide; CTA chr11 5291793 5291814 5291798 5291793 -
atgttgttcgtcataatatggg

SEQ ID NO: 132326 - DNA, 22 bp, Artificial Sequence
  Synthetic oligonucleotide; TTG chr11 5291787 5291808 5291792 5291787 -
ttcgtcataatatgggttttat

SEQ ID NO: 132327 - DNA, 22 bp, Artificial Sequence
  Synthetic oligonucleotide; TTC chr11 5291784 5291805 5291789 5291784 -
gtcataatatgggttttatggt

SEQ ID NO: 132328 - DNA, 22 bp, Artificial Sequence
  Synthetic oligonucleotide; TTT chr11 5291768 5291789 5291773 5291768 -
tatggtccattattatttccta

SEQ ID NO: 132329 - DNA, 22 bp, Artificial Sequence
  Synthetic oligonucleotide; TTT chr11 5291767 5291788 5291772 5291767 -
atggtccattattatttcctat

SEQ ID NO: 132330 - DNA, 22 bp, Artificial Sequence
  Synthetic oligonucleotide; TTA chr11 5291766 5291787 5291771 5291766 -
tggtccattattatttcctatg

SEQ ID NO: 132331 - DNA, 22 bp, Artificial Sequence
  Synthetic oligonucleotide; TTA chr11 5291756 5291777 5291761 5291756 -
ttatttcctatgcattgatctg

SEQ ID NO: 132332 - DNA, 22 bp, Artificial Sequence
  Synthetic oligonucleotide; TTA chr11 5291753 5291774 5291758 5291753 -
tttcctatgcattgatctggag

SEQ ID NO: 132333 - DNA, 22 bp, Artificial Sequence
  Synthetic oligonucleotide; TTT chr11 5291750 5291771 5291755 5291750 -
cctatgcattgatctggagaag

SEQ ID NO: 132334 - DNA, 22 bp, Artificial Sequence
  Synthetic oligonucleotide; TTC chr11 5291749 5291770 5291754 5291749 -
ctatgcattgatctggagaagg

SEQ ID NO: 132335 - DNA, 22 bp, Artificial Sequence
  Synthetic oligonucleotide; CTA chr11 5291746 5291767 5291751 5291746 -
tgcattgatctggagaaggctt

SEQ ID NO: 132336 - DNA, 22 bp, Artificial Sequence
  Synthetic oligonucleotide; TTG chr11 5291739 5291760 5291744 5291739 -
atctggagaaggcttcaatcct

SEQ ID NO: 132337 - DNA, 22 bp, Artificial Sequence
  Synthetic oligonucleotide; CTG chr11 5291734 5291755 5291739 5291734 -
gagaaggcttcaatccttttac

SEQ ID NO: 132338 - DNA, 22 bp, Artificial Sequence
  Synthetic oligonucleotide; CTT chr11 5291724 5291745 5291729 5291724 -
caatccttttactctttgtgga

SEQ ID NO: 132339 - DNA, 22 bp, Artificial Sequence
  Synthetic oligonucleotide; TTC chr11 5291723 5291744 5291728 5291723 -
aatccttttactctttgtggaa

SEQ ID NO: 132340 - DNA, 22 bp, Artificial Sequence
  Synthetic oligonucleotide; CTT chr11 5291716 5291737 5291721 5291716 -
ttactctttgtggaaaatatct

SEQ ID NO: 132341 - DNA, 22 bp, Artificial Sequence
  Synthetic oligonucleotide; TTT chr11 5291715 5291736 5291720 5291715 -
tactctttgtggaaaatatctg

SEQ ID NO: 132342 - DNA, 22 bp, Artificial Sequence
  Synthetic oligonucleotide; TTT chr11 5291714 5291735 5291719 5291714 -
actctttgtggaaaatatctgt

SEQ ID NO: 132343 - DNA, 22 bp, Artificial Sequence
  Synthetic oligonucleotide; TTA chr11 5291713 5291734 5291718 5291713 -
ctctttgtggaaaatatctgta

SEQ ID NO: 132344 - DNA, 22 bp, Artificial Sequence
  Synthetic oligonucleotide; CTC chr11 5291710 5291731 5291715 5291710 -
tttgtggaaaatatctgtaaac

SEQ ID NO: 132345 - DNA, 22 bp, Artificial Sequence
  Synthetic oligonucleotide; CTT chr11 5291708 5291729 5291713 5291708 -
tgtggaaaatatctgtaaacct

SEQ ID NO: 132346 - DNA, 22 bp, Artificial Sequence
  Synthetic oligonucleotide; TTT chr11 5291707 5291728 5291712 5291707 -
gtggaaaatatctgtaaacctt

SEQ ID NO: 132347 - DNA, 22 bp, Artificial Sequence
  Synthetic oligonucleotide; TTG chr11 5291706 5291727 5291711 5291706 -
tggaaaatatctgtaaaccttc

SEQ ID NO: 132348 - DNA, 22 bp, Artificial Sequence
  Synthetic oligonucleotide; CTG chr11 5291693 5291714 5291698 5291693 -
taaaccttctggttcactctgc

SEQ ID NO: 132349 - DNA, 22 bp, Artificial Sequence
  Synthetic oligonucleotide; CTT chr11 5291685 5291706 5291690 5291685 -
ctggttcactctgctatagcaa

SEQ ID NO: 132350 - DNA, 22 bp, Artificial Sequence
  Synthetic oligonucleotide; TTC chr11 5291684 5291705 5291689 5291684 -
tggttcactctgctatagcaat

SEQ ID NO: 132351 - DNA, 22 bp, Artificial Sequence
  Synthetic oligonucleotide; CTG chr11 5291682 5291703 5291687 5291682 -
gttcactctgctatagcaattt

SEQ ID NO: 132352 - DNA, 22 bp, Artificial Sequence
  Synthetic oligonucleotide; TTC chr11 5291678 5291699 5291683 5291678 -
actctgctatagcaatttcagt

SEQ ID NO: 132353 - DNA, 22 bp, Artificial Sequence
  Synthetic oligonucleotide; CTC chr11 5291674 5291695 5291679 5291674 -
tgctatagcaatttcagtttag

SEQ ID NO: 132354 - DNA, 22 bp, Artificial Sequence
  Synthetic oligonucleotide; CTG chr11 5291672 5291693 5291677 5291672 -
ctatagcaatttcagtttaggc

SEQ ID NO: 132355 - DNA, 22 bp, Artificial Sequence
  Synthetic oligonucleotide; CTA chr11 5291669 5291690 5291674 5291669 -
tagcaatttcagtttaggctag

SEQ ID NO: 132356 - DNA, 22 bp, Artificial Sequence
  Synthetic oligonucleotide; TTT chr11 5291660 5291681 5291665 5291660 -
cagtttaggctagtaagcatga

SEQ ID NO: 132357 - DNA, 22 bp, Artificial Sequence
  Synthetic oligonucleotide; TTC chr11 5291659 5291680 5291664 5291659 -
agtttaggctagtaagcatgag

SEQ ID NO: 132358 - DNA, 22 bp, Artificial Sequence
  Synthetic oligonucleotide; TTT chr11 5291654 5291675 5291659 5291654 -
aggctagtaagcatgaggatgc

SEQ ID NO: 132359 - DNA, 22 bp, Artificial Sequence
  Synthetic oligonucleotide; TTA chr11 5291653 5291674 5291658 5291653 -
ggctagtaagcatgaggatgcc

SEQ ID NO: 132360 - DNA, 22 bp, Artificial Sequence
  Synthetic oligonucleotide; CTA chr11 5291648 5291669 5291653 5291648 -
gtaagcatgaggatgcctcctt

SEQ ID NO: 132361 - DNA, 22 bp, Artificial Sequence
  Synthetic oligonucleotide; CTC chr11 5291629 5291650 5291634 5291629 -
cttctctgatttttcccacagt

SEQ ID NO: 132362 - DNA, 22 bp, Artificial Sequence
  Synthetic oligonucleotide; CTT chr11 5291626 5291647 5291631 5291626 -
ctctgatttttcccacagtctg

SEQ ID NO: 132363 - DNA, 22 bp, Artificial Sequence
  Synthetic oligonucleotide; TTC chr11 5291625 5291646 5291630 5291625 -
tctgatttttcccacagtctgt

SEQ ID NO: 132364 - DNA, 22 bp, Artificial Sequence
  Synthetic oligonucleotide; CTC chr11 5291623 5291644 5291628 5291623 -
tgatttttcccacagtctgttg

SEQ ID NO: 132365 - DNA, 22 bp, Artificial Sequence
  Synthetic oligonucleotide; CTG chr11 5291621 5291642 5291626 5291621 -
atttttcccacagtctgttggt

SEQ ID NO: 132366 - DNA, 22 bp, Artificial Sequence
  Synthetic oligonucleotide; TTT chr11 5291617 5291638 5291622 5291617 -
ttcccacagtctgttggtcaca

SEQ ID NO: 132367 - DNA, 22 bp, Artificial Sequence
  Synthetic oligonucleotide; TTT chr11 5291616 5291637 5291621 5291616 -
tcccacagtctgttggtcacag

SEQ ID NO: 132368 - DNA, 22 bp, Artificial Sequence
  Synthetic oligonucleotide; TTT chr11 5291615 5291636 5291620 5291615 -
cccacagtctgttggtcacaga

SEQ ID NO: 132369 - DNA, 22 bp, Artificial Sequence
  Synthetic oligonucleotide; TTC chr11 5291614 5291635 5291619 5291614 -
ccacagtctgttggtcacagaa

SEQ ID NO: 132370 - DNA, 22 bp, Artificial Sequence
  Synthetic oligonucleotide; CTG chr11 5291604 5291625 5291609 5291604 -
ttggtcacagaataacctgagt

SEQ ID NO: 132371 - DNA, 22 bp, Artificial Sequence
  Synthetic oligonucleotide; TTG chr11 5291601 5291622 5291606 5291601 -
gtcacagaataacctgagtgat

SEQ ID NO: 132372 - DNA, 22 bp, Artificial Sequence
  Synthetic oligonucleotide; CTG chr11 5291585 5291606 5291590 5291585 -
agtgattactgatgaaagagtg

SEQ ID NO: 132373 - DNA, 22 bp, Artificial Sequence
  Synthetic oligonucleotide; TTA chr11 5291577 5291598 5291582 5291577 -
ctgatgaaagagtgagaatgtt

SEQ ID NO: 132374 - DNA, 22 bp, Artificial Sequence
  Synthetic oligonucleotide; CTG chr11 5291574 5291595 5291579 5291574 -
atgaaagagtgagaatgttatt

SEQ ID NO: 132375 - DNA, 22 bp, Artificial Sequence
  Synthetic oligonucleotide; TTA chr11 5291554 5291575 5291559 5291554 -
ttgatagtcacaatgacaaaaa

SEQ ID NO: 132376 - DNA, 22 bp, Artificial Sequence
  Synthetic oligonucleotide; TTG chr11 5291551 5291572 5291556 5291551 -
atagtcacaatgacaaaaaaca

SEQ ID NO: 132377 - DNA, 22 bp, Artificial Sequence
  Synthetic oligonucleotide; CTA chr11 5291521 5291542 5291526 5291521 -
cagtcaaaatgtttctcttttt

SEQ ID NO: 132378 - DNA, 22 bp, Artificial Sequence
  Synthetic oligonucleotide; TTT chr11 5291507 5291528 5291512 5291507 -
ctctttttattagtggattata

SEQ ID NO: 132379 - DNA, 22 bp, Artificial Sequence
  Synthetic oligonucleotide; TTC chr11 5291506 5291527 5291511 5291506 -
tctttttattagtggattatat

SEQ ID NO: 132380 - DNA, 22 bp, Artificial Sequence
  Synthetic oligonucleotide; CTC chr11 5291504 5291525 5291509 5291504 -
tttttattagtggattatattt

SEQ ID NO: 132381 - DNA, 22 bp, Artificial Sequence
  Synthetic oligonucleotide; CTT chr11 5291502 5291523 5291507 5291502 -
tttattagtggattatatttcc

SEQ ID NO: 132382 - DNA, 22 bp, Artificial Sequence
  Synthetic oligonucleotide; TTT chr11 5291501 5291522 5291506 5291501 -
ttattagtggattatatttcct

SEQ ID NO: 132383 - DNA, 22 bp, Artificial Sequence
  Synthetic oligonucleotide; TTT chr11 5291500 5291521 5291505 5291500 -
tattagtggattatatttcctg

SEQ ID NO: 132384 - DNA, 22 bp, Artificial Sequence
  Synthetic oligonucleotide; TTT chr11 5291499 5291520 5291504 5291499 -
attagtggattatatttcctga

SEQ ID NO: 132385 - DNA, 22 bp, Artificial Sequence
  Synthetic oligonucleotide; TTA chr11 5291498 5291519 5291503 5291498 -
ttagtggattatatttcctgac

SEQ ID NO: 132386 - DNA, 22 bp, Artificial Sequence
  Synthetic oligonucleotide; TTA chr11 5291495 5291516 5291500 5291495 -
gtggattatatttcctgaccta

SEQ ID NO: 132387 - DNA, 22 bp, Artificial Sequence
  Synthetic oligonucleotide; TTA chr11 5291487 5291508 5291492 5291487 -
tatttcctgacctatatctggc

SEQ ID NO: 132388 - DNA, 22 bp, Artificial Sequence
  Synthetic oligonucleotide; TTT chr11 5291482 5291503 5291487 5291482 -
cctgacctatatctggcaggac

SEQ ID NO: 132389 - DNA, 22 bp, Artificial Sequence
  Synthetic oligonucleotide; TTC chr11 5291481 5291502 5291486 5291481 -
ctgacctatatctggcaggact

SEQ ID NO: 132390 - DNA, 22 bp, Artificial Sequence
  Synthetic oligonucleotide; CTG chr11 5291478 5291499 5291483 5291478 -
acctatatctggcaggactctt

SEQ ID NO: 132391 - DNA, 22 bp, Artificial Sequence
  Synthetic oligonucleotide; CTA chr11 5291473 5291494 5291478 5291473 -
tatctggcaggactctttagag

SEQ ID NO: 132392 - DNA, 22 bp, Artificial Sequence
  Synthetic oligonucleotide; CTG chr11 5291467 5291488 5291472 5291467 -
gcaggactctttagagaggtag

SEQ ID NO: 132393 - DNA, 22 bp, Artificial Sequence
  Synthetic oligonucleotide; CTC chr11 5291458 5291479 5291463 5291458 -
tttagagaggtagctgaagctg

SEQ ID NO: 132394 - DNA, 22 bp, Artificial Sequence
  Synthetic oligonucleotide; CTT chr11 5291456 5291477 5291461 5291456 -
tagagaggtagctgaagctgct

SEQ ID NO: 132395 - DNA, 22 bp, Artificial Sequence
  Synthetic oligonucleotide; TTT chr11 5291455 5291476 5291460 5291455 -
agagaggtagctgaagctgctg

SEQ ID NO: 132396 - DNA, 22 bp, Artificial Sequence
  Synthetic oligonucleotide; TTA chr11 5291454 5291475 5291459 5291454 -
gagaggtagctgaagctgctgt

SEQ ID NO: 132397 - DNA, 22 bp, Artificial Sequence
  Synthetic oligonucleotide; CTG chr11 5291442 5291463 5291447 5291442 -
aagctgctgttatgaccactag

SEQ ID NO: 132398 - DNA, 22 bp, Artificial Sequence
  Synthetic oligonucleotide; CTG chr11 5291436 5291457 5291441 5291436 -
ctgttatgaccactagagggaa

SEQ ID NO: 132399 - DNA, 22 bp, Artificial Sequence
  Synthetic oligonucleotide; CTG chr11 5291433 5291454 5291438 5291433 -
ttatgaccactagagggaagaa

SEQ ID NO: 132400 - DNA, 22 bp, Artificial Sequence
  Synthetic oligonucleotide; TTA chr11 5291430 5291451 5291435 5291430 -
tgaccactagagggaagaagat

SEQ ID NO: 132401 - DNA, 22 bp, Artificial Sequence
  Synthetic oligonucleotide; CTA chr11 5291421 5291442 5291426 5291421 -
gagggaagaagatacctgtgga

SEQ ID NO: 132402 - DNA, 22 bp, Artificial Sequence
  Synthetic oligonucleotide; CTG chr11 5291403 5291424 5291408 5291403 -
tggagctaatggtccaagatgg

SEQ ID NO: 132403 - DNA, 22 bp, Artificial Sequence
  Synthetic oligonucleotide; CTA chr11 5291395 5291416 5291400 5291395 -
atggtccaagatggtggagccc

SEQ ID NO: 132404 - DNA, 22 bp, Artificial Sequence
  Synthetic oligonucleotide; TTG chr11 5291358 5291379 5291363 5291358 -
ttaaggagcccttttgattgaa

SEQ ID NO: 132405 - DNA, 22 bp, Artificial Sequence
  Synthetic oligonucleotide; TTA chr11 5291355 5291376 5291360 5291355 -
aggagcccttttgattgaaggt

SEQ ID NO: 132406 - DNA, 22 bp, Artificial Sequence
  Synthetic oligonucleotide; CTT chr11 5291345 5291366 5291350 5291345 -
ttgattgaaggtgggtgccccc

SEQ ID NO: 132407 - DNA, 22 bp, Artificial Sequence
  Synthetic oligonucleotide; TTT chr11 5291344 5291365 5291349 5291344 -
tgattgaaggtgggtgccccca

SEQ ID NO: 132408 - DNA, 22 bp, Artificial Sequence
  Synthetic oligonucleotide; TTT chr11 5291343 5291364 5291348 5291343 -
gattgaaggtgggtgcccccac

SEQ ID NO: 132409 - DNA, 22 bp, Artificial Sequence
  Synthetic oligonucleotide; TTG chr11 5291342 5291363 5291347 5291342 -
attgaaggtgggtgcccccacc

SEQ ID NO: 132410 - DNA, 22 bp, Artificial Sequence
  Synthetic oligonucleotide; TTG chr11 5291338 5291359 5291343 5291338 -
aaggtgggtgcccccaccttac

SEQ ID NO: 132411 - DNA, 22 bp, Artificial Sequence
  Synthetic oligonucleotide; CTT chr11 5291318 5291339 5291323 5291318 -
acagggacaggacatctggata

SEQ ID NO: 132412 - DNA, 22 bp, Artificial Sequence
  Synthetic oligonucleotide; TTA chr11 5291317 5291338 5291322 5291317 -
cagggacaggacatctggatac

SEQ ID NO: 132413 - DNA, 22 bp, Artificial Sequence
  Synthetic oligonucleotide; CTG chr11 5291300 5291321 5291305 5291300 -
gatactcctcccagtttctcca

SEQ ID NO: 132414 - DNA, 22 bp, Artificial Sequence
  Synthetic oligonucleotide; CTC chr11 5291293 5291314 5291298 5291293 -
ctcccagtttctccagtttccc

SEQ ID NO: 132415 - DNA, 22 bp, Artificial Sequence
  Synthetic oligonucleotide; CTC chr11 5291290 5291311 5291295 5291290 -
ccagtttctccagtttcccttt

SEQ ID NO: 132416 - DNA, 22 bp, Artificial Sequence
  Synthetic oligonucleotide; TTT chr11 5291283 5291304 5291288 5291283 -
ctccagtttccctttttcctaa

SEQ ID NO: 132417 - DNA, 22 bp, Artificial Sequence
  Synthetic oligonucleotide; TTC chr11 5291282 5291303 5291287 5291282 -
tccagtttccctttttcctaat

SEQ ID NO: 132418 - DNA, 22 bp, Artificial Sequence
  Synthetic oligonucleotide; CTC chr11 5291280 5291301 5291285 5291280 -
cagtttccctttttcctaatat

SEQ ID NO: 132419 - DNA, 22 bp, Artificial Sequence
  Synthetic oligonucleotide; TTT chr11 5291274 5291295 5291279 5291274 -
ccctttttcctaatatatctcc

SEQ ID NO: 132420 - DNA, 22 bp, Artificial Sequence
  Synthetic oligonucleotide; TTC chr11 5291273 5291294 5291278 5291273 -
cctttttcctaatatatctcct

SEQ ID NO: 132421 - DNA, 22 bp, Artificial Sequence
  Synthetic oligonucleotide; CTT chr11 5291269 5291290 5291274 5291269 -
tttcctaatatatctcctgata

SEQ ID NO: 132422 - DNA, 22 bp, Artificial Sequence
  Synthetic oligonucleotide; TTT chr11 5291268 5291289 5291273 5291268 -
ttcctaatatatctcctgataa

SEQ ID NO: 132423 - DNA, 22 bp, Artificial Sequence
  Synthetic oligonucleotide; TTT chr11 5291267 5291288 5291272 5291267 -
tcctaatatatctcctgataaa

SEQ ID NO: 132424 - DNA, 22 bp, Artificial Sequence
  Synthetic oligonucleotide; TTT chr11 5291266 5291287 5291271 5291266 -
cctaatatatctcctgataaaa

SEQ ID NO: 132425 - DNA, 22 bp, Artificial Sequence
  Synthetic oligonucleotide; TTC chr11 5291265 5291286 5291270 5291265 -
ctaatatatctcctgataaaat

SEQ ID NO: 132426 - DNA, 22 bp, Artificial Sequence
  Synthetic oligonucleotide; CTA chr11 5291262 5291283 5291267 5291262 -
atatatctcctgataaaatgtc

SEQ ID NO: 132427 - DNA, 22 bp, Artificial Sequence
  Synthetic oligonucleotide; CTC chr11 5291253 5291274 5291258 5291253 -
ctgataaaatgtctatactcac

SEQ ID NO: 132428 - DNA, 22 bp, Artificial Sequence
  Synthetic oligonucleotide; CTG chr11 5291250 5291271 5291255 5291250 -
ataaaatgtctatactcacttc

SEQ ID NO: 132429 - DNA, 22 bp, Artificial Sequence
  Synthetic oligonucleotide; CTA chr11 5291238 5291259 5291243 5291238 -
tactcacttccccatttctaat

SEQ ID NO: 132430 - DNA, 22 bp, Artificial Sequence
  Synthetic oligonucleotide; CTC chr11 5291233 5291254 5291238 5291233 -
acttccccatttctaataataa

SEQ ID NO: 132431 - DNA, 22 bp, Artificial Sequence
  Synthetic oligonucleotide; CTT chr11 5291229 5291250 5291234 5291229 -
ccccatttctaataataaagca

SEQ ID NO: 132432 - DNA, 22 bp, Artificial Sequence
  Synthetic oligonucleotide; TTC chr11 5291228 5291249 5291233 5291228 -
cccatttctaataataaagcaa

SEQ ID NO: 132433 - DNA, 22 bp, Artificial Sequence
  Synthetic oligonucleotide; TTT chr11 5291221 5291242 5291226 5291221 -
ctaataataaagcaaaggctag

SEQ ID NO: 132434 - DNA, 22 bp, Artificial Sequence
  Synthetic oligonucleotide; TTC chr11 5291220 5291241 5291225 5291220 -
taataataaagcaaaggctagt

SEQ ID NO: 132435 - DNA, 22 bp, Artificial Sequence
  Synthetic oligonucleotide; CTA chr11 5291218 5291239 5291223 5291218 -
ataataaagcaaaggctagtta

SEQ ID NO: 132436 - DNA, 22 bp, Artificial Sequence
  Synthetic oligonucleotide; CTA chr11 5291200 5291221 5291205 5291200 -
gttagtaagacatcaccttgca

SEQ ID NO: 132437 - DNA, 22 bp, Artificial Sequence
  Synthetic oligonucleotide; TTA chr11 5291196 5291217 5291201 5291196 -
gtaagacatcaccttgcatttt

SEQ ID NO: 132438 - DNA, 22 bp, Artificial Sequence
  Synthetic oligonucleotide; CTT chr11 5291181 5291202 5291186 5291181 -
gcattttgaaaatgccatagac

SEQ ID NO: 132439 - DNA, 22 bp, Artificial Sequence
  Synthetic oligonucleotide; TTG chr11 5291180 5291201 5291185 5291180 -
cattttgaaaatgccatagact

SEQ ID NO: 132440 - DNA, 22 bp, Artificial Sequence
  Synthetic oligonucleotide; TTT chr11 5291175 5291196 5291180 5291175 -
tgaaaatgccatagactttcaa

SEQ ID NO: 132441 - DNA, 22 bp, Artificial Sequence
  Synthetic oligonucleotide; TTT chr11 5291174 5291195 5291179 5291174 -
gaaaatgccatagactttcaaa

SEQ ID NO: 132442 - DNA, 22 bp, Artificial Sequence
  Synthetic oligonucleotide; TTG chr11 5291173 5291194 5291178 5291173 -
aaaatgccatagactttcaaaa

SEQ ID NO: 132443 - DNA, 22 bp, Artificial Sequence
  Synthetic oligonucleotide; CTT chr11 5291157 5291178 5291162 5291157 -
tcaaaattatttcatacatcgg

SEQ ID NO: 132444 - DNA, 22 bp, Artificial Sequence
  Synthetic oligonucleotide; TTT chr11 5291156 5291177 5291161 5291156 -
caaaattatttcatacatcggt

SEQ ID NO: 132445 - DNA, 22 bp, Artificial Sequence
  Synthetic oligonucleotide; TTC chr11 5291155 5291176 5291160 5291155 -
aaaattatttcatacatcggtc

SEQ ID NO: 132446 - DNA, 22 bp, Artificial Sequence
  Synthetic oligonucleotide; TTA chr11 5291148 5291169 5291153 5291148 -
tttcatacatcggtctttcttt

SEQ ID NO: 132447 - DNA, 22 bp, Artificial Sequence
  Synthetic oligonucleotide; TTT chr11 5291145 5291166 5291150 5291145 -
catacatcggtctttctttatt

SEQ ID NO: 132448 - DNA, 22 bp, Artificial Sequence
  Synthetic oligonucleotide; TTC chr11 5291144 5291165 5291149 5291144 -
atacatcggtctttctttattt

SEQ ID NO: 132449 - DNA, 22 bp, Artificial Sequence
  Synthetic oligonucleotide; CTT chr11 5291131 5291152 5291136 5291131 -
tctttatttcaagagtccagaa

SEQ ID NO: 132450 - DNA, 22 bp, Artificial Sequence
  Synthetic oligonucleotide; TTT chr11 5291130 5291151 5291135 5291130 -
ctttatttcaagagtccagaaa

SEQ ID NO: 132451 - DNA, 22 bp, Artificial Sequence
  Synthetic oligonucleotide; TTC chr11 5291129 5291150 5291134 5291129 -
tttatttcaagagtccagaaat

SEQ ID NO: 132452 - DNA, 22 bp, Artificial Sequence
  Synthetic oligonucleotide; CTT chr11 5291127 5291148 5291132 5291127 -
tatttcaagagtccagaaatgg

SEQ ID NO: 132453 - DNA, 22 bp, Artificial Sequence
  Synthetic oligonucleotide; TTT chr11 5291126 5291147 5291131 5291126 -
atttcaagagtccagaaatggc

SEQ ID NO: 132454 - DNA, 22 bp, Artificial Sequence
  Synthetic oligonucleotide; TTA chr11 5291125 5291146 5291130 5291125 -
tttcaagagtccagaaatggca

SEQ ID NO: 132455 - DNA, 22 bp, Artificial Sequence
  Synthetic oligonucleotide; TTT chr11 5291122 5291143 5291127 5291122 -
caagagtccagaaatggcaaca

SEQ ID NO: 132456 - DNA, 22 bp, Artificial Sequence
  Synthetic oligonucleotide; TTC chr11 5291121 5291142 5291126 5291121 -
aagagtccagaaatggcaacat

SEQ ID NO: 132457 - DNA, 22 bp, Artificial Sequence
  Synthetic oligonucleotide; TTA chr11 5291097 5291118 5291102 5291097 -
cctttgattcaatgtaatggaa

SEQ ID NO: 132458 - DNA, 22 bp, Artificial Sequence
  Synthetic oligonucleotide; CTT chr11 5291093 5291114 5291098 5291093 -
tgattcaatgtaatggaaagag

SEQ ID NO: 132459 - DNA, 22 bp, Artificial Sequence
  Synthetic oligonucleotide; TTT chr11 5291092 5291113 5291097 5291092 -
gattcaatgtaatggaaagagc

SEQ ID NO: 132460 - DNA, 22 bp, Artificial Sequence
  Synthetic oligonucleotide; TTG chr11 5291091 5291112 5291096 5291091 -
attcaatgtaatggaaagagct

SEQ ID NO: 132461 - DNA, 22 bp, Artificial Sequence
  Synthetic oligonucleotide; TTC chr11 5291087 5291108 5291092 5291087 -
aatgtaatggaaagagctcttt

SEQ ID NO: 132462 - DNA, 22 bp, Artificial Sequence
  Synthetic oligonucleotide; CTC chr11 5291068 5291089 5291073 5291068 -
tttcaagagacagagaaaagaa

SEQ ID NO: 132463 - DNA, 22 bp, Artificial Sequence
  Synthetic oligonucleotide; CTT chr11 5291066 5291087 5291071 5291066 -
tcaagagacagagaaaagaata

SEQ ID NO: 132464 - DNA, 22 bp, Artificial Sequence
  Synthetic oligonucleotide; TTT chr11 5291065 5291086 5291070 5291065 -
caagagacagagaaaagaataa

SEQ ID NO: 132465 - DNA, 22 bp, Artificial Sequence
  Synthetic oligonucleotide; TTC chr11 5291064 5291085 5291069 5291064 -
aagagacagagaaaagaataat

SEQ ID NO: 132466 - DNA, 22 bp, Artificial Sequence
  Synthetic oligonucleotide; TTT chr11 5291040 5291061 5291045 5291040 -
aatttctttccccacacctcct

SEQ ID NO: 132467 - DNA, 22 bp, Artificial Sequence
  Synthetic oligonucleotide; TTA chr11 5291039 5291060 5291044 5291039 -
atttctttccccacacctcctt

SEQ ID NO: 132468 - DNA, 22 bp, Artificial Sequence
  Synthetic oligonucleotide; TTT chr11 5291035 5291056 5291040 5291035 -
ctttccccacacctccttccct

SEQ ID NO: 132469 - DNA, 22 bp, Artificial Sequence
  Synthetic oligonucleotide; TTC chr11 5291034 5291055 5291039 5291034 -
tttccccacacctccttccctg

SEQ ID NO: 132470 - DNA, 22 bp, Artificial Sequence
  Synthetic oligonucleotide; CTT chr11 5291032 5291053 5291037 5291032 -
tccccacacctccttccctgtc

SEQ ID NO: 132471 - DNA, 22 bp, Artificial Sequence
  Synthetic oligonucleotide; TTT chr11 5291031 5291052 5291036 5291031 -
ccccacacctccttccctgtct

SEQ ID NO: 132472 - DNA, 22 bp, Artificial Sequence
  Synthetic oligonucleotide; TTC chr11 5291030 5291051 5291035 5291030 -
cccacacctccttccctgtctc

SEQ ID NO: 132473 - DNA, 22 bp, Artificial Sequence
  Synthetic oligonucleotide; CTC chr11 5291020 5291041 5291025 5291020 -
cttccctgtctcttaccctatc

SEQ ID NO: 132474 - DNA, 22 bp, Artificial Sequence
  Synthetic oligonucleotide; CTT chr11 5291017 5291038 5291022 5291017 -
ccctgtctcttaccctatcttc

SEQ ID NO: 132475 - DNA, 22 bp, Artificial Sequence
  Synthetic oligonucleotide; TTC chr11 5291016 5291037 5291021 5291016 -
cctgtctcttaccctatcttcc

SEQ ID NO: 132476 - DNA, 22 bp, Artificial Sequence
  Synthetic oligonucleotide; CTG chr11 5291012 5291033 5291017 5291012 -
tctcttaccctatcttccttcc

SEQ ID NO: 132477 - DNA, 22 bp, Artificial Sequence
  Synthetic oligonucleotide; CTC chr11 5291008 5291029 5291013 5291008 -
ttaccctatcttccttccttct

SEQ ID NO: 132478 - DNA, 22 bp, Artificial Sequence
  Synthetic oligonucleotide; CTT chr11 5291006 5291027 5291011 5291006 -
accctatcttccttccttctac

SEQ ID NO: 132479 - DNA, 22 bp, Artificial Sequence
  Synthetic oligonucleotide; TTA chr11 5291005 5291026 5291010 5291005 -
ccctatcttccttccttctacc

SEQ ID NO: 132480 - DNA, 22 bp, Artificial Sequence
  Synthetic oligonucleotide; CTA chr11 5291000 5291021 5291005 5291000 -
tcttccttccttctaccctccc

SEQ ID NO: 132481 - DNA, 22 bp, Artificial Sequence
  Synthetic oligonucleotide; CTT chr11 5290996 5291017 5291001 5290996 -
ccttccttctaccctccccatt

SEQ ID NO: 132482 - DNA, 22 bp, Artificial Sequence
  Synthetic oligonucleotide; TTC chr11 5290995 5291016 5291000 5290995 -
cttccttctaccctccccattt

SEQ ID NO: 132483 - DNA, 22 bp, Artificial Sequence
  Synthetic oligonucleotide; CTT chr11 5290992 5291013 5290997 5290992 -
ccttctaccctccccatttctc

SEQ ID NO: 132484 - DNA, 22 bp, Artificial Sequence
  Synthetic oligonucleotide; TTC chr11 5290991 5291012 5290996 5290991 -
cttctaccctccccatttctct

SEQ ID NO: 132485 - DNA, 22 bp, Artificial Sequence
  Synthetic oligonucleotide; CTT chr11 5290988 5291009 5290993 5290988 -
ctaccctccccatttctctctc

SEQ ID NO: 132486 - DNA, 22 bp, Artificial Sequence
  Synthetic oligonucleotide; TTC chr11 5290987 5291008 5290992 5290987 -
taccctccccatttctctctct

SEQ ID NO: 132487 - DNA, 22 bp, Artificial Sequence
  Synthetic oligonucleotide; CTA chr11 5290985 5291006 5290990 5290985 -
ccctccccatttctctctctca

SEQ ID NO: 132488 - DNA, 22 bp, Artificial Sequence
  Synthetic oligonucleotide; CTC chr11 5290980 5291001 5290985 5290980 -
cccatttctctctctcatttct

SEQ ID NO: 132489 - DNA, 22 bp, Artificial Sequence
  Synthetic oligonucleotide; TTT chr11 5290973 5290994 5290978 5290973 -
ctctctctcatttctcagaagt

SEQ ID NO: 132490 - DNA, 22 bp, Artificial Sequence
  Synthetic oligonucleotide; TTC chr11 5290972 5290993 5290977 5290972 -
tctctctcatttctcagaagta

SEQ ID NO: 132491 - DNA, 22 bp, Artificial Sequence
  Synthetic oligonucleotide; CTC chr11 5290970 5290991 5290975 5290970 -
tctctcatttctcagaagtata

SEQ ID NO: 132492 - DNA, 22 bp, Artificial Sequence
  Synthetic oligonucleotide; CTC chr11 5290968 5290989 5290973 5290968 -
tctcatttctcagaagtatatt

SEQ ID NO: 132493 - DNA, 22 bp, Artificial Sequence
  Synthetic oligonucleotide; CTC chr11 5290966 5290987 5290971 5290966 -
tcatttctcagaagtatatttt

SEQ ID NO: 132494 - DNA, 22 bp, Artificial Sequence
  Synthetic oligonucleotide; CTC chr11 5290964 5290985 5290969 5290964 -
atttctcagaagtatattttga

SEQ ID NO: 132495 - DNA, 22 bp, Artificial Sequence
  Synthetic oligonucleotide; TTT chr11 5290960 5290981 5290965 5290960 -
ctcagaagtatattttgaaagg

SEQ ID NO: 132496 - DNA, 22 bp, Artificial Sequence
  Synthetic oligonucleotide; TTC chr11 5290959 5290980 5290964 5290959 -
tcagaagtatattttgaaagga

SEQ ID NO: 132497 - DNA, 22 bp, Artificial Sequence
  Synthetic oligonucleotide; CTC chr11 5290957 5290978 5290962 5290957 -
agaagtatattttgaaaggatt

SEQ ID NO: 132498 - DNA, 22 bp, Artificial Sequence
  Synthetic oligonucleotide; TTT chr11 5290945 5290966 5290950 5290945 -
tgaaaggattcatagcagacag

SEQ ID NO: 132499 - DNA, 22 bp, Artificial Sequence
  Synthetic oligonucleotide; TTT chr11 5290944 5290965 5290949 5290944 -
gaaaggattcatagcagacagc

SEQ ID NO: 132500 - DNA, 22 bp, Artificial Sequence
  Synthetic oligonucleotide; TTG chr11 5290943 5290964 5290948 5290943 -
aaaggattcatagcagacagct

SEQ ID NO: 132501 - DNA, 22 bp, Artificial Sequence
  Synthetic oligonucleotide; TTC chr11 5290934 5290955 5290939 5290934 -
atagcagacagctaaggctggt

SEQ ID NO: 132502 - DNA, 22 bp, Artificial Sequence
  Synthetic oligonucleotide; CTA chr11 5290920 5290941 5290925 5290920 -
aggctggttttttctaagtgaa

SEQ ID NO: 132503 - DNA, 22 bp, Artificial Sequence
  Synthetic oligonucleotide; CTG chr11 5290914 5290935 5290919 5290914 -
gttttttctaagtgaagaagtg

SEQ ID NO: 132504 - DNA, 22 bp, Artificial Sequence
  Synthetic oligonucleotide; TTT chr11 5290910 5290931 5290915 5290910 -
tttctaagtgaagaagtgatat

SEQ ID NO: 132505 - DNA, 22 bp, Artificial Sequence
  Synthetic oligonucleotide; TTT chr11 5290909 5290930 5290914 5290909 -
ttctaagtgaagaagtgatatt

SEQ ID NO: 132506 - DNA, 22 bp, Artificial Sequence
  Synthetic oligonucleotide; TTT chr11 5290908 5290929 5290913 5290908 -
tctaagtgaagaagtgatattg

SEQ ID NO: 132507 - DNA, 22 bp, Artificial Sequence
  Synthetic oligonucleotide; TTT chr11 5290907 5290928 5290912 5290907 -
ctaagtgaagaagtgatattga

SEQ ID NO: 132508 - DNA, 22 bp, Artificial Sequence
  Synthetic oligonucleotide; TTC chr11 5290906 5290927 5290911 5290906 -
taagtgaagaagtgatattgag

SEQ ID NO: 132509 - DNA, 22 bp, Artificial Sequence
  Synthetic oligonucleotide; CTA chr11 5290904 5290925 5290909 5290904 -
agtgaagaagtgatattgagaa

SEQ ID NO: 132510 - DNA, 22 bp, Artificial Sequence
  Synthetic oligonucleotide; TTG chr11 5290886 5290907 5290891 5290886 -
agaaggtagggttgcatgagcc

SEQ ID NO: 132511 - DNA, 22 bp, Artificial Sequence
  Synthetic oligonucleotide; TTG chr11 5290872 5290893 5290877 5290872 -
catgagccctttcagtttttta

SEQ ID NO: 132512 - DNA, 22 bp, Artificial Sequence
  Synthetic oligonucleotide; CTT chr11 5290861 5290882 5290866 5290861 -
tcagttttttagtttatataca

SEQ ID NO: 132513 - DNA, 22 bp, Artificial Sequence
  Synthetic oligonucleotide; TTT chr11 5290860 5290881 5290865 5290860 -
cagttttttagtttatatacat

SEQ ID NO: 132514 - DNA, 22 bp, Artificial Sequence
  Synthetic oligonucleotide; TTC chr11 5290859 5290880 5290864 5290859 -
agttttttagtttatatacatc

SEQ ID NO: 132515 - DNA, 22 bp, Artificial Sequence
  Synthetic oligonucleotide; TTT chr11 5290854 5290875 5290859 5290854 -
tttagtttatatacatctgtat

SEQ ID NO: 132516 - DNA, 22 bp, Artificial Sequence
  Synthetic oligonucleotide; TTT chr11 5290853 5290874 5290858 5290853 -
ttagtttatatacatctgtatt

SEQ ID NO: 132517 - DNA, 22 bp, Artificial Sequence
  Synthetic oligonucleotide; TTT chr11 5290852 5290873 5290857 5290852 -
tagtttatatacatctgtattg

SEQ ID NO: 132518 - DNA, 22 bp, Artificial Sequence
  Synthetic oligonucleotide; TTT chr11 5290851 5290872 5290856 5290851 -
agtttatatacatctgtattgt

SEQ ID NO: 132519 - DNA, 22 bp, Artificial Sequence
  Synthetic oligonucleotide; TTA chr11 5290850 5290871 5290855 5290850 -
gtttatatacatctgtattgtt

SEQ ID NO: 132520 - DNA, 22 bp, Artificial Sequence
  Synthetic oligonucleotide; TTT chr11 5290846 5290867 5290851 5290846 -
atatacatctgtattgttagaa

SEQ ID NO: 132521 - DNA, 22 bp, Artificial Sequence
  Synthetic oligonucleotide; TTA chr11 5290845 5290866 5290850 5290845 -
tatacatctgtattgttagaat

SEQ ID NO: 132522 - DNA, 22 bp, Artificial Sequence
  Synthetic oligonucleotide; CTG chr11 5290835 5290856 5290840 5290835 -
tattgttagaatgttttataat

SEQ ID NO: 132523 - DNA, 22 bp, Artificial Sequence
  Synthetic oligonucleotide; TTG chr11 5290830 5290851 5290835 5290830 -
ttagaatgttttataatataaa

SEQ ID NO: 132524 - DNA, 22 bp, Artificial Sequence
  Synthetic oligonucleotide; TTA chr11 5290827 5290848 5290832 5290827 -
gaatgttttataatataaataa

SEQ ID NO: 132525 - DNA, 22 bp, Artificial Sequence
  Synthetic oligonucleotide; TTT chr11 5290819 5290840 5290824 5290819 -
tataatataaataaaattattt

SEQ ID NO: 132526 - DNA, 22 bp, Artificial Sequence
  Synthetic oligonucleotide; TTT chr11 5290818 5290839 5290823 5290818 -
ataatataaataaaattatttc

SEQ ID NO: 132527 - DNA, 22 bp, Artificial Sequence
  Synthetic oligonucleotide; TTA chr11 5290817 5290838 5290822 5290817 -
taatataaataaaattatttct

SEQ ID NO: 132528 - DNA, 22 bp, Artificial Sequence
  Synthetic oligonucleotide; TTA chr11 5290800 5290821 5290805 5290800 -
tttctcagttatatactagcta

SEQ ID NO: 132529 - DNA, 22 bp, Artificial Sequence
  Synthetic oligonucleotide; TTT chr11 5290797 5290818 5290802 5290797 -
ctcagttatatactagctatgt

SEQ ID NO: 132530 - DNA, 22 bp, Artificial Sequence
  Synthetic oligonucleotide; TTC chr11 5290796 5290817 5290801 5290796 -
tcagttatatactagctatgta

SEQ ID NO: 132531 - DNA, 22 bp, Artificial Sequence
  Synthetic oligonucleotide; CTC chr11 5290794 5290815 5290799 5290794 -
agttatatactagctatgtaac

SEQ ID NO: 132532 - DNA, 22 bp, Artificial Sequence
  Synthetic oligonucleotide; TTA chr11 5290789 5290810 5290794 5290789 -
tatactagctatgtaacctgtg

SEQ ID NO: 132533 - DNA, 22 bp, Artificial Sequence
  Synthetic oligonucleotide; CTA chr11 5290782 5290803 5290787 5290782 -
gctatgtaacctgtggatattt

SEQ ID NO: 132534 - DNA, 22 bp, Artificial Sequence
  Synthetic oligonucleotide; CTA chr11 5290778 5290799 5290783 5290778 -
tgtaacctgtggatatttcctt

SEQ ID NO: 132535 - DNA, 22 bp, Artificial Sequence
  Synthetic oligonucleotide; CTG chr11 5290769 5290790 5290774 5290769 -
tggatatttccttaagtattac

SEQ ID NO: 132536 - DNA, 22 bp, Artificial Sequence
  Synthetic oligonucleotide; TTT chr11 5290760 5290781 5290765 5290760 -
ccttaagtattacaagctatac

SEQ ID NO: 132537 - DNA, 22 bp, Artificial Sequence
  Synthetic oligonucleotide; TTC chr11 5290759 5290780 5290764 5290759 -
cttaagtattacaagctatact

SEQ ID NO: 132538 - DNA, 22 bp, Artificial Sequence
  Synthetic oligonucleotide; CTT chr11 5290756 5290777 5290761 5290756 -
aagtattacaagctatacttaa

SEQ ID NO: 132539 - DNA, 22 bp, Artificial Sequence
  Synthetic oligonucleotide; TTA chr11 5290755 5290776 5290760 5290755 -
agtattacaagctatacttaac

SEQ ID NO: 132540 - DNA, 22 bp, Artificial Sequence
  Synthetic oligonucleotide; TTA chr11 5290748 5290769 5290753 5290748 -
caagctatacttaactcacttg

SEQ ID NO: 132541 - DNA, 22 bp, Artificial Sequence
  Synthetic oligonucleotide; CTA chr11 5290741 5290762 5290746 5290741 -
tacttaactcacttggaaaact

SEQ ID NO: 132542 - DNA, 22 bp, Artificial Sequence
  Synthetic oligonucleotide; CTT chr11 5290736 5290757 5290741 5290736 -
aactcacttggaaaactcaaat

SEQ ID NO: 132543 - DNA, 22 bp, Artificial Sequence
  Synthetic oligonucleotide; TTA chr11 5290735 5290756 5290740 5290735 -
actcacttggaaaactcaaata

SEQ ID NO: 132544 - DNA, 22 bp, Artificial Sequence
  Synthetic oligonucleotide; CTC chr11 5290731 5290752 5290736 5290731 -
acttggaaaactcaaataaata

SEQ ID NO: 132545 - DNA, 22 bp, Artificial Sequence
  Synthetic oligonucleotide; CTT chr11 5290727 5290748 5290732 5290727 -
ggaaaactcaaataaatacctg

SEQ ID NO: 132546 - DNA, 22 bp, Artificial Sequence
  Synthetic oligonucleotide; TTG chr11 5290726 5290747 5290731 5290726 -
gaaaactcaaataaatacctgc

SEQ ID NO: 132547 - DNA, 22 bp, Artificial Sequence
  Synthetic oligonucleotide; CTC chr11 5290718 5290739 5290723 5290718 -
aaataaatacctgcttcatagt

SEQ ID NO: 132548 - DNA, 22 bp, Artificial Sequence
  Synthetic oligonucleotide; CTG chr11 5290705 5290726 5290710 5290705 -
cttcatagttattaataaggat

SEQ ID NO: 132549 - DNA, 22 bp, Artificial Sequence
  Synthetic oligonucleotide; CTT chr11 5290702 5290723 5290707 5290702 -
catagttattaataaggattaa

SEQ ID NO: 132550 - DNA, 22 bp, Artificial Sequence
  Synthetic oligonucleotide; TTC chr11 5290701 5290722 5290706 5290701 -
atagttattaataaggattaag

SEQ ID NO: 132551 - DNA, 22 bp, Artificial Sequence
  Synthetic oligonucleotide; TTA chr11 5290694 5290715 5290699 5290694 -
ttaataaggattaagtgagata

SEQ ID NO: 132552 - DNA, 22 bp, Artificial Sequence
  Synthetic oligonucleotide; TTA chr11 5290691 5290712 5290696 5290691 -
ataaggattaagtgagataatg

SEQ ID NO: 132553 - DNA, 22 bp, Artificial Sequence
  Synthetic oligonucleotide; TTA chr11 5290681 5290702 5290686 5290681 -
agtgagataatgcccataagat

SEQ ID NO: 132554 - DNA, 22 bp, Artificial Sequence
  Synthetic oligonucleotide; TTC chr11 5290657 5290678 5290662 5290657 -
ctattaataacagataaataca

SEQ ID NO: 132555 - DNA, 22 bp, Artificial Sequence
  Synthetic oligonucleotide; CTA chr11 5290654 5290675 5290659 5290654 -
ttaataacagataaatacatac

SEQ ID NO: 132556 - DNA, 22 bp, Artificial Sequence
  Synthetic oligonucleotide; TTA chr11 5290651 5290672 5290656 5290651 -
ataacagataaatacatacaca

SEQ ID NO: 132557 - DNA, 22 bp, Artificial Sequence
  Synthetic oligonucleotide; TTG chr11 5290616 5290637 5290621 5290616 -
aaaggattcttactttgtgcta

SEQ ID NO: 132558 - DNA, 22 bp, Artificial Sequence
  Synthetic oligonucleotide; TTC chr11 5290607 5290628 5290612 5290607 -
ttactttgtgctaggaactata

SEQ ID NO: 132559 - DNA, 22 bp, Artificial Sequence
  Synthetic oligonucleotide; CTT chr11 5290605 5290626 5290610 5290605 -
actttgtgctaggaactataat

SEQ ID NO: 132560 - DNA, 22 bp, Artificial Sequence
  Synthetic oligonucleotide; TTA chr11 5290604 5290625 5290609 5290604 -
ctttgtgctaggaactataata

SEQ ID NO: 132561 - DNA, 22 bp, Artificial Sequence
  Synthetic oligonucleotide; CTT chr11 5290601 5290622 5290606 5290601 -
tgtgctaggaactataataagt

SEQ ID NO: 132562 - DNA, 22 bp, Artificial Sequence
  Synthetic oligonucleotide; TTT chr11 5290600 5290621 5290605 5290600 -
gtgctaggaactataataagtt

SEQ ID NO: 132563 - DNA, 22 bp, Artificial Sequence
  Synthetic oligonucleotide; TTG chr11 5290599 5290620 5290604 5290599 -
tgctaggaactataataagttc

SEQ ID NO: 132564 - DNA, 22 bp, Artificial Sequence
  Synthetic oligonucleotide; CTA chr11 5290594 5290615 5290599 5290594 -
ggaactataataagttcattga

SEQ ID NO: 132565 - DNA, 22 bp, Artificial Sequence
  Synthetic oligonucleotide; CTA chr11 5290587 5290608 5290592 5290587 -
taataagttcattgatgcatta

SEQ ID NO: 132566 - DNA, 22 bp, Artificial Sequence
  Synthetic oligonucleotide; TTC chr11 5290577 5290598 5290582 5290577 -
attgatgcattatatcattaag

SEQ ID NO: 132567 - DNA, 22 bp, Artificial Sequence
  Synthetic oligonucleotide; TTG chr11 5290573 5290594 5290578 5290573 -
atgcattatatcattaagttct

SEQ ID NO: 132568 - DNA, 22 bp, Artificial Sequence
  Synthetic oligonucleotide; TTA chr11 5290565 5290586 5290570 5290565 -
tatcattaagttctaatttcaa

SEQ ID NO: 132569 - DNA, 22 bp, Artificial Sequence
  Synthetic oligonucleotide; TTA chr11 5290557 5290578 5290562 5290557 -
agttctaatttcaacactagaa

SEQ ID NO: 132570 - DNA, 22 bp, Artificial Sequence
  Synthetic oligonucleotide; TTC chr11 5290552 5290573 5290557 5290552 -
taatttcaacactagaaggcag

SEQ ID NO: 132571 - DNA, 22 bp, Artificial Sequence
  Synthetic oligonucleotide; CTA chr11 5290550 5290571 5290555 5290550 -
atttcaacactagaaggcaggt

SEQ ID NO: 132572 - DNA, 22 bp, Artificial Sequence
  Synthetic oligonucleotide; TTT chr11 5290546 5290567 5290551 5290546 -
caacactagaaggcaggtatta

SEQ ID NO: 132573 - DNA, 22 bp, Artificial Sequence
  Synthetic oligonucleotide; TTC chr11 5290545 5290566 5290550 5290545 -
aacactagaaggcaggtattat

SEQ ID NO: 132574 - DNA, 22 bp, Artificial Sequence
  Synthetic oligonucleotide; CTA chr11 5290538 5290559 5290543 5290538 -
gaaggcaggtattatctaaatt

SEQ ID NO: 132575 - DNA, 22 bp, Artificial Sequence
  Synthetic oligonucleotide; TTA chr11 5290524 5290545 5290529 5290524 -
tctaaatttcatactggatacc

SEQ ID NO: 132576 - DNA, 22 bp, Artificial Sequence
  Synthetic oligonucleotide; CTA chr11 5290520 5290541 5290525 5290520 -
aatttcatactggatacctcca

SEQ ID NO: 132577 - DNA, 22 bp, Artificial Sequence
  Synthetic oligonucleotide; TTT chr11 5290515 5290536 5290520 5290515 -
catactggatacctccaaactc

SEQ ID NO: 132578 - DNA, 22 bp, Artificial Sequence
  Synthetic oligonucleotide; TTC chr11 5290514 5290535 5290519 5290514 -
atactggatacctccaaactca

SEQ ID NO: 132579 - DNA, 22 bp, Artificial Sequence
  Synthetic oligonucleotide; CTG chr11 5290508 5290529 5290513 5290508 -
gatacctccaaactcataaaga

SEQ ID NO: 132580 - DNA, 22 bp, Artificial Sequence
  Synthetic oligonucleotide; CTC chr11 5290500 5290521 5290505 5290500 -
caaactcataaagataattaaa

SEQ ID NO: 132581 - DNA, 22 bp, Artificial Sequence
  Synthetic oligonucleotide; CTC chr11 5290493 5290514 5290498 5290493 -
ataaagataattaaattgcctt

SEQ ID NO: 132582 - DNA, 22 bp, Artificial Sequence
  Synthetic oligonucleotide; TTA chr11 5290480 5290501 5290485 5290480 -
aattgccttttgtcatatattt

SEQ ID NO: 132583 - DNA, 22 bp, Artificial Sequence
  Synthetic oligonucleotide; TTG chr11 5290475 5290496 5290480 5290475 -
ccttttgtcatatatttattca

SEQ ID NO: 132584 - DNA, 22 bp, Artificial Sequence
  Synthetic oligonucleotide; CTT chr11 5290471 5290492 5290476 5290471 -
ttgtcatatatttattcaaaag

SEQ ID NO: 132585 - DNA, 22 bp, Artificial Sequence
  Synthetic oligonucleotide; TTT chr11 5290470 5290491 5290475 5290470 -
tgtcatatatttattcaaaagg

SEQ ID NO: 132586 - DNA, 22 bp, Artificial Sequence
  Synthetic oligonucleotide; TTT chr11 5290469 5290490 5290474 5290469 -
gtcatatatttattcaaaaggg

SEQ ID NO: 132587 - DNA, 22 bp, Artificial Sequence
  Synthetic oligonucleotide; TTG chr11 5290468 5290489 5290473 5290468 -
tcatatatttattcaaaagggt

SEQ ID NO: 132588 - DNA, 22 bp, Artificial Sequence
  Synthetic oligonucleotide; TTT chr11 5290458 5290479 5290463 5290458 -
attcaaaagggtaaactcaaac

SEQ ID NO: 132589 - DNA, 22 bp, Artificial Sequence
  Synthetic oligonucleotide; TTA chr11 5290457 5290478 5290462 5290457 -
ttcaaaagggtaaactcaaact

SEQ ID NO: 132590 - DNA, 22 bp, Artificial Sequence
  Synthetic oligonucleotide; TTC chr11 5290454 5290475 5290459 5290454 -
aaaagggtaaactcaaactatg

SEQ ID NO: 132591 - DNA, 22 bp, Artificial Sequence
  Synthetic oligonucleotide; CTC chr11 5290440 5290461 5290445 5290440 -
aaactatggcttgtctaatttt

SEQ ID NO: 132592 - DNA, 22 bp, Artificial Sequence
  Synthetic oligonucleotide; CTA chr11 5290434 5290455 5290439 5290434 -
tggcttgtctaattttatatat

SEQ ID NO: 132593 - DNA, 22 bp, Artificial Sequence
  Synthetic oligonucleotide; CTT chr11 5290428 5290449 5290433 5290428 -
gtctaattttatatatcaccct

SEQ ID NO: 132594 - DNA, 22 bp, Artificial Sequence
  Synthetic oligonucleotide; TTG chr11 5290427 5290448 5290432 5290427 -
tctaattttatatatcacccta

SEQ ID NO: 132595 - DNA, 22 bp, Artificial Sequence
  Synthetic oligonucleotide; CTA chr11 5290423 5290444 5290428 5290423 -
attttatatatcaccctactga

SEQ ID NO: 132596 - DNA, 22 bp, Artificial Sequence
  Synthetic oligonucleotide; TTT chr11 5290419 5290440 5290424 5290419 -
tatatatcaccctactgaacat

SEQ ID NO: 132597 - DNA, 22 bp, Artificial Sequence
  Synthetic oligonucleotide; TTT chr11 5290418 5290439 5290423 5290418 -
atatatcaccctactgaacatg

SEQ ID NO: 132598 - DNA, 22 bp, Artificial Sequence
  Synthetic oligonucleotide; TTA chr11 5290417 5290438 5290422 5290417 -
tatatcaccctactgaacatga

SEQ ID NO: 132599 - DNA, 22 bp, Artificial Sequence
  Synthetic oligonucleotide; CTA chr11 5290405 5290426 5290410 5290405 -
ctgaacatgaccctattgtgat

SEQ ID NO: 132600 - DNA, 22 bp, Artificial Sequence
  Synthetic oligonucleotide; CTG chr11 5290402 5290423 5290407 5290402 -
aacatgaccctattgtgatatt

SEQ ID NO: 132601 - DNA, 22 bp, Artificial Sequence
  Synthetic oligonucleotide; CTA chr11 5290390 5290411 5290395 5290390 -
ttgtgatattttataaaattat

SEQ ID NO: 132602 - DNA, 22 bp, Artificial Sequence
  Synthetic oligonucleotide; TTG chr11 5290387 5290408 5290392 5290387 -
tgatattttataaaattattct

SEQ ID NO: 132603 - DNA, 22 bp, Artificial Sequence
  Synthetic oligonucleotide; TTT chr11 5290379 5290400 5290384 5290379 -
tataaaattattctcaagttat

SEQ ID NO: 132604 - DNA, 22 bp, Artificial Sequence
  Synthetic oligonucleotide; TTT chr11 5290378 5290399 5290383 5290378 -
ataaaattattctcaagttatt

SEQ ID NO: 132605 - DNA, 22 bp, Artificial Sequence
  Synthetic oligonucleotide; TTA chr11 5290377 5290398 5290382 5290377 -
taaaattattctcaagttatta

SEQ ID NO: 132606 - DNA, 22 bp, Artificial Sequence
  Synthetic oligonucleotide; TTA chr11 5290369 5290390 5290374 5290369 -
ttctcaagttattatgaggatg

SEQ ID NO: 132607 - DNA, 22 bp, Artificial Sequence
  Synthetic oligonucleotide; TTC chr11 5290366 5290387 5290371 5290366 -
tcaagttattatgaggatgttg

SEQ ID NO: 132608 - DNA, 22 bp, Artificial Sequence
  Synthetic oligonucleotide; CTC chr11 5290364 5290385 5290369 5290364 -
aagttattatgaggatgttgaa

SEQ ID NO: 132609 - DNA, 22 bp, Artificial Sequence
  Synthetic oligonucleotide; TTA chr11 5290358 5290379 5290363 5290358 -
ttatgaggatgttgaaagacag

SEQ ID NO: 132610 - DNA, 22 bp, Artificial Sequence
  Synthetic oligonucleotide; TTA chr11 5290355 5290376 5290360 5290355 -
tgaggatgttgaaagacagaga

SEQ ID NO: 132611 - DNA, 22 bp, Artificial Sequence
  Synthetic oligonucleotide; TTG chr11 5290344 5290365 5290349 5290344 -
aaagacagagaggatggggtgc

SEQ ID NO: 132612 - DNA, 22 bp, Artificial Sequence
  Synthetic oligonucleotide; CTA chr11 5290320 5290341 5290325 5290320 -
tgccccaaatcagcctcacaat

SEQ ID NO: 132613 - DNA, 22 bp, Artificial Sequence
  Synthetic oligonucleotide; CTC chr11 5290303 5290324 5290308 5290303 -
acaattaagctaagcagctaag

SEQ ID NO: 132614 - DNA, 22 bp, Artificial Sequence
  Synthetic oligonucleotide; TTA chr11 5290296 5290317 5290301 5290296 -
agctaagcagctaagagtcttg

SEQ ID NO: 132615 - DNA, 22 bp, Artificial Sequence
  Synthetic oligonucleotide; CTA chr11 5290291 5290312 5290296 5290291 -
agcagctaagagtcttgcaggg

SEQ ID NO: 132616 - DNA, 22 bp, Artificial Sequence
  Synthetic oligonucleotide; CTA chr11 5290283 5290304 5290288 5290283 -
agagtcttgcagggtagtgtag

SEQ ID NO: 132617 - DNA, 22 bp, Artificial Sequence
  Synthetic oligonucleotide; CTT chr11 5290275 5290296 5290280 5290275 -
gcagggtagtgtagggaccaca

SEQ ID NO: 132618 - DNA, 22 bp, Artificial Sequence
  Synthetic oligonucleotide; TTG chr11 5290274 5290295 5290279 5290274 -
cagggtagtgtagggaccacag

SEQ ID NO: 132619 - DNA, 22 bp, Artificial Sequence
  Synthetic oligonucleotide; TTA chr11 5290247 5290268 5290252 5290247 -
agggggcagtagaattatactc

SEQ ID NO: 132620 - DNA, 22 bp, Artificial Sequence
  Synthetic oligonucleotide; TTA chr11 5290230 5290251 5290235 5290230 -
tactcccactttagtttcattt

SEQ ID NO: 132621 - DNA, 22 bp, Artificial Sequence
  Synthetic oligonucleotide; CTC chr11 5290225 5290246 5290230 5290225 -
ccactttagtttcatttcaaac

SEQ ID NO: 132622 - DNA, 22 bp, Artificial Sequence
  Synthetic oligonucleotide; CTT chr11 5290219 5290240 5290224 5290219 -
tagtttcatttcaaacaatcca

SEQ ID NO: 132623 - DNA, 22 bp, Artificial Sequence
  Synthetic oligonucleotide; TTT chr11 5290218 5290239 5290223 5290218 -
agtttcatttcaaacaatccat

SEQ ID NO: 132624 - DNA, 22 bp, Artificial Sequence
  Synthetic oligonucleotide; TTA chr11 5290217 5290238 5290222 5290217 -
gtttcatttcaaacaatccata

SEQ ID NO: 132625 - DNA, 22 bp, Artificial Sequence
  Synthetic oligonucleotide; TTT chr11 5290213 5290234 5290218 5290213 -
catttcaaacaatccatacaca

SEQ ID NO: 132626 - DNA, 22 bp, Artificial Sequence
  Synthetic oligonucleotide; TTC chr11 5290212 5290233 5290217 5290212 -
atttcaaacaatccatacacac

SEQ ID NO: 132627 - DNA, 22 bp, Artificial Sequence
  Synthetic oligonucleotide; TTT chr11 5290208 5290229 5290213 5290208 -
caaacaatccatacacacacag

SEQ ID NO: 132628 - DNA, 22 bp, Artificial Sequence
  Synthetic oligonucleotide; TTC chr11 5290207 5290228 5290212 5290207 -
aaacaatccatacacacacagc

SEQ ID NO: 132629 - DNA, 22 bp, Artificial Sequence
  Synthetic oligonucleotide; CTG chr11 5290181 5290202 5290186 5290181 -
agcacttacaaattatactacg

SEQ ID NO: 132630 - DNA, 22 bp, Artificial Sequence
  Synthetic oligonucleotide; CTT chr11 5290174 5290195 5290179 5290174 -
acaaattatactacgctctata

SEQ ID NO: 132631 - DNA, 22 bp, Artificial Sequence
  Synthetic oligonucleotide; TTA chr11 5290173 5290194 5290178 5290173 -
caaattatactacgctctatac

SEQ ID NO: 132632 - DNA, 22 bp, Artificial Sequence
  Synthetic oligonucleotide; TTA chr11 5290166 5290187 5290171 5290166 -
tactacgctctatactttttgt

SEQ ID NO: 132633 - DNA, 22 bp, Artificial Sequence
  Synthetic oligonucleotide; CTA chr11 5290161 5290182 5290166 5290161 -
cgctctatactttttgtttaaa

SEQ ID NO: 132634 - DNA, 22 bp, Artificial Sequence
  Synthetic oligonucleotide; CTC chr11 5290156 5290177 5290161 5290156 -
tatactttttgtttaaatgtat

SEQ ID NO: 132635 - DNA, 22 bp, Artificial Sequence
  Synthetic oligonucleotide; CTA chr11 5290154 5290175 5290159 5290154 -
tactttttgtttaaatgtataa

SEQ ID NO: 132636 - DNA, 22 bp, Artificial Sequence
  Synthetic oligonucleotide; CTT chr11 5290149 5290170 5290154 5290149 -
tttgtttaaatgtataaataag

SEQ ID NO: 132637 - DNA, 22 bp, Artificial Sequence
  Synthetic oligonucleotide; TTT chr11 5290148 5290169 5290153 5290148 -
ttgtttaaatgtataaataagt

SEQ ID NO: 132638 - DNA, 22 bp, Artificial Sequence
  Synthetic oligonucleotide; TTT chr11 5290147 5290168 5290152 5290147 -
tgtttaaatgtataaataagtg

SEQ ID NO: 132639 - DNA, 22 bp, Artificial Sequence
  Synthetic oligonucleotide; TTT chr11 5290146 5290167 5290151 5290146 -
gtttaaatgtataaataagtgg

SEQ ID NO: 132640 - DNA, 22 bp, Artificial Sequence
  Synthetic oligonucleotide; TTG chr11 5290145 5290166 5290150 5290145 -
tttaaatgtataaataagtgga

SEQ ID NO: 132641 - DNA, 22 bp, Artificial Sequence
  Synthetic oligonucleotide; TTT chr11 5290142 5290163 5290147 5290142 -
aaatgtataaataagtggatga

SEQ ID NO: 132642 - DNA, 22 bp, Artificial Sequence
  Synthetic oligonucleotide; TTA chr11 5290141 5290162 5290146 5290141 -
aatgtataaataagtggatgaa

SEQ ID NO: 132643 - DNA, 22 bp, Artificial Sequence
  Synthetic oligonucleotide; CTT chr11 5290070 5290091 5290075 5290070 -
gccttcatagctgtctccctac

SEQ ID NO: 132644 - DNA, 22 bp, Artificial Sequence
  Synthetic oligonucleotide; TTG chr11 5290069 5290090 5290074 5290069 -
ccttcatagctgtctccctacc

SEQ ID NO: 132645 - DNA, 22 bp, Artificial Sequence
  Synthetic oligonucleotide; CTT chr11 5290065 5290086 5290070 5290065 -
catagctgtctccctaccttgt

SEQ ID NO: 132646 - DNA, 22 bp, Artificial Sequence
  Synthetic oligonucleotide; TTC chr11 5290064 5290085 5290069 5290064 -
atagctgtctccctaccttgtt

SEQ ID NO: 132647 - DNA, 22 bp, Artificial Sequence
  Synthetic oligonucleotide; CTG chr11 5290057 5290078 5290062 5290057 -
tctccctaccttgttcaaaatg

SEQ ID NO: 132648 - DNA, 22 bp, Artificial Sequence
  Synthetic oligonucleotide; CTC chr11 5290053 5290074 5290058 5290053 -
cctaccttgttcaaaatgttcc

SEQ ID NO: 132649 - DNA, 22 bp, Artificial Sequence
  Synthetic oligonucleotide; CTA chr11 5290049 5290070 5290054 5290049 -
ccttgttcaaaatgttcctgtc

SEQ ID NO: 132650 - DNA, 22 bp, Artificial Sequence
  Synthetic oligonucleotide; CTT chr11 5290045 5290066 5290050 5290045 -
gttcaaaatgttcctgtccaga

SEQ ID NO: 132651 - DNA, 22 bp, Artificial Sequence
  Synthetic oligonucleotide; TTG chr11 5290044 5290065 5290049 5290044 -
ttcaaaatgttcctgtccagac

SEQ ID NO: 132652 - DNA, 22 bp, Artificial Sequence
  Synthetic oligonucleotide; TTC chr11 5290041 5290062 5290046 5290041 -
aaaatgttcctgtccagaccaa

SEQ ID NO: 132653 - DNA, 22 bp, Artificial Sequence
  Synthetic oligonucleotide; TTC chr11 5290032 5290053 5290037 5290032 -
ctgtccagaccaaagtaccttg

SEQ ID NO: 132654 - DNA, 22 bp, Artificial Sequence
  Synthetic oligonucleotide; CTG chr11 5290029 5290050 5290034 5290029 -
tccagaccaaagtaccttgcct

SEQ ID NO: 132655 - DNA, 22 bp, Artificial Sequence
  Synthetic oligonucleotide; CTT chr11 5290011 5290032 5290016 5290011 -
gccttcacttaagtaatcaatt

SEQ ID NO: 132656 - DNA, 22 bp, Artificial Sequence
  Synthetic oligonucleotide; TTG chr11 5290010 5290031 5290015 5290010 -
ccttcacttaagtaatcaattc

SEQ ID NO: 132657 - DNA, 22 bp, Artificial Sequence
  Synthetic oligonucleotide; CTT chr11 5290006 5290027 5290011 5290006 -
cacttaagtaatcaattcctag

SEQ ID NO: 132658 - DNA, 22 bp, Artificial Sequence
  Synthetic oligonucleotide; TTC chr11 5290005 5290026 5290010 5290005 -
acttaagtaatcaattcctagg

SEQ ID NO: 132659 - DNA, 22 bp, Artificial Sequence
  Synthetic oligonucleotide; CTT chr11 5290001 5290022 5290006 5290001 -
aagtaatcaattcctaggttat

SEQ ID NO: 132660 - DNA, 22 bp, Artificial Sequence
  Synthetic oligonucleotide; TTA chr11 5290000 5290021 5290005 5290000 -
agtaatcaattcctaggttata

SEQ ID NO: 132661 - DNA, 22 bp, Artificial Sequence
  Synthetic oligonucleotide; TTC chr11 5289988 5290009 5289993 5289988 -
ctaggttatattctgatgtcaa

SEQ ID NO: 132662 - DNA, 22 bp, Artificial Sequence
  Synthetic oligonucleotide; CTA chr11 5289985 5290006 5289990 5289985 -
ggttatattctgatgtcaaagg

SEQ ID NO: 132663 - DNA, 22 bp, Artificial Sequence
  Synthetic oligonucleotide; TTA chr11 5289980 5290001 5289985 5289980 -
tattctgatgtcaaaggaagtc

SEQ ID NO: 132664 - DNA, 22 bp, Artificial Sequence
  Synthetic oligonucleotide; TTC chr11 5289975 5289996 5289980 5289975 -
tgatgtcaaaggaagtcaaaag

SEQ ID NO: 132665 - DNA, 22 bp, Artificial Sequence
  Synthetic oligonucleotide; CTG chr11 5289973 5289994 5289978 5289973 -
atgtcaaaggaagtcaaaagat

SEQ ID NO: 132666 - DNA, 22 bp, Artificial Sequence
  Synthetic oligonucleotide; TTT chr11 5289937 5289958 5289942 5289937 -
ctgacccacaactcatgctttg

SEQ ID NO: 132667 - DNA, 22 bp, Artificial Sequence
  Synthetic oligonucleotide; TTC chr11 5289936 5289957 5289941 5289936 -
tgacccacaactcatgctttgt

SEQ ID NO: 132668 - DNA, 22 bp, Artificial Sequence
  Synthetic oligonucleotide; CTG chr11 5289934 5289955 5289939 5289934 -
acccacaactcatgctttgtag

SEQ ID NO: 132669 - DNA, 22 bp, Artificial Sequence
  Synthetic oligonucleotide; CTC chr11 5289923 5289944 5289928 5289923 -
atgctttgtagatgactagatc

SEQ ID NO: 132670 - DNA, 22 bp, Artificial Sequence
  Synthetic oligonucleotide; CTT chr11 5289917 5289938 5289922 5289917 -
tgtagatgactagatcaaaaaa

SEQ ID NO: 132671 - DNA, 22 bp, Artificial Sequence
  Synthetic oligonucleotide; TTT chr11 5289916 5289937 5289921 5289916 -
gtagatgactagatcaaaaaat

SEQ ID NO: 132672 - DNA, 22 bp, Artificial Sequence
  Synthetic oligonucleotide; TTG chr11 5289915 5289936 5289920 5289915 -
tagatgactagatcaaaaaatt

SEQ ID NO: 132673 - DNA, 22 bp, Artificial Sequence
  Synthetic oligonucleotide; CTA chr11 5289905 5289926 5289910 5289905 -
gatcaaaaaatttcagccatat

SEQ ID NO: 132674 - DNA, 22 bp, Artificial Sequence
  Synthetic oligonucleotide; TTT chr11 5289892 5289913 5289897 5289892 -
cagccatatcttaacagtgagt

SEQ ID NO: 132675 - DNA, 22 bp, Artificial Sequence
  Synthetic oligonucleotide; TTC chr11 5289891 5289912 5289896 5289891 -
agccatatcttaacagtgagtg

SEQ ID NO: 132676 - DNA, 22 bp, Artificial Sequence
  Synthetic oligonucleotide; CTT chr11 5289880 5289901 5289885 5289880 -
aacagtgagtgaacaggaaatc

SEQ ID NO: 132677 - DNA, 22 bp, Artificial Sequence
  Synthetic oligonucleotide; TTA chr11 5289879 5289900 5289884 5289879 -
acagtgagtgaacaggaaatct

SEQ ID NO: 132678 - DNA, 22 bp, Artificial Sequence
  Synthetic oligonucleotide; CTC chr11 5289856 5289877 5289861 5289856 -
ctcttttccctacatctgagat

SEQ ID NO: 132679 - DNA, 22 bp, Artificial Sequence
  Synthetic oligonucleotide; CTC chr11 5289853 5289874 5289858 5289853 -
ttttccctacatctgagatccc

SEQ ID NO: 132680 - DNA, 22 bp, Artificial Sequence
  Synthetic oligonucleotide; CTT chr11 5289851 5289872 5289856 5289851 -
ttccctacatctgagatcccag

SEQ ID NO: 132681 - DNA, 22 bp, Artificial Sequence
  Synthetic oligonucleotide; TTT chr11 5289850 5289871 5289855 5289850 -
tccctacatctgagatcccagc

SEQ ID NO: 132682 - DNA, 22 bp, Artificial Sequence
  Synthetic oligonucleotide; TTT chr11 5289849 5289870 5289854 5289849 -
ccctacatctgagatcccagct

SEQ ID NO: 132683 - DNA, 22 bp, Artificial Sequence
  Synthetic oligonucleotide; TTC chr11 5289848 5289869 5289853 5289848 -
cctacatctgagatcccagctt

SEQ ID NO: 132684 - DNA, 22 bp, Artificial Sequence
  Synthetic oligonucleotide; CTA chr11 5289844 5289865 5289849 5289844 -
catctgagatcccagcttctaa

SEQ ID NO: 132685 - DNA, 22 bp, Artificial Sequence
  Synthetic oligonucleotide; CTG chr11 5289838 5289859 5289843 5289838 -
agatcccagcttctaagacctt

SEQ ID NO: 132686 - DNA, 22 bp, Artificial Sequence
  Synthetic oligonucleotide; CTT chr11 5289826 5289847 5289831 5289826 -
ctaagaccttcaattctcactc

SEQ ID NO: 132687 - DNA, 22 bp, Artificial Sequence
  Synthetic oligonucleotide; TTC chr11 5289825 5289846 5289830 5289825 -
taagaccttcaattctcactct

SEQ ID NO: 132688 - DNA, 22 bp, Artificial Sequence
  Synthetic oligonucleotide; CTA chr11 5289823 5289844 5289828 5289823 -
agaccttcaattctcactcttg

SEQ ID NO: 132689 - DNA, 22 bp, Artificial Sequence
  Synthetic oligonucleotide; CTT chr11 5289816 5289837 5289821 5289816 -
caattctcactcttgatgcaac

SEQ ID NO: 132690 - DNA, 22 bp, Artificial Sequence
  Synthetic oligonucleotide; TTC chr11 5289815 5289836 5289820 5289815 -
aattctcactcttgatgcaaca

SEQ ID NO: 132691 - DNA, 22 bp, Artificial Sequence
  Synthetic oligonucleotide; TTC chr11 5289810 5289831 5289815 5289810 -
tcactcttgatgcaacagacct

SEQ ID NO: 132692 - DNA, 22 bp, Artificial Sequence
  Synthetic oligonucleotide; CTC chr11 5289808 5289829 5289813 5289808 -
actcttgatgcaacagaccttg

SEQ ID NO: 132693 - DNA, 22 bp, Artificial Sequence
  Synthetic oligonucleotide; CTC chr11 5289804 5289825 5289809 5289804 -
ttgatgcaacagaccttggaag

SEQ ID NO: 132694 - DNA, 22 bp, Artificial Sequence
  Synthetic oligonucleotide; CTT chr11 5289802 5289823 5289807 5289802 -
gatgcaacagaccttggaagca

SEQ ID NO: 132695 - DNA, 22 bp, Artificial Sequence
  Synthetic oligonucleotide; TTG chr11 5289801 5289822 5289806 5289801 -
atgcaacagaccttggaagcat

SEQ ID NO: 132696 - DNA, 22 bp, Artificial Sequence
  Synthetic oligonucleotide; CTT chr11 5289787 5289808 5289792 5289787 -
ggaagcatacaggagagctgaa

SEQ ID NO: 132697 - DNA, 22 bp, Artificial Sequence
  Synthetic oligonucleotide; TTG chr11 5289786 5289807 5289791 5289786 -
gaagcatacaggagagctgaac

SEQ ID NO: 132698 - DNA, 22 bp, Artificial Sequence
  Synthetic oligonucleotide; CTG chr11 5289767 5289788 5289772 5289767 -
aacttggtcaacaaaggagaaa

SEQ ID NO: 132699 - DNA, 22 bp, Artificial Sequence
  Synthetic oligonucleotide; CTT chr11 5289762 5289783 5289767 5289762 -
ggtcaacaaaggagaaaagttt

SEQ ID NO: 132700 - DNA, 22 bp, Artificial Sequence
  Synthetic oligonucleotide; TTG chr11 5289761 5289782 5289766 5289761 -
gtcaacaaaggagaaaagtttg

SEQ ID NO: 132701 - DNA, 22 bp, Artificial Sequence
  Synthetic oligonucleotide; TTT chr11 5289740 5289761 5289745 5289740 -
gttggcctccaaaggcacagct

SEQ ID NO: 132702 - DNA, 22 bp, Artificial Sequence
  Synthetic oligonucleotide; TTG chr11 5289739 5289760 5289744 5289739 -
ttggcctccaaaggcacagctc

SEQ ID NO: 132703 - DNA, 22 bp, Artificial Sequence
  Synthetic oligonucleotide; TTG chr11 5289736 5289757 5289741 5289736 -
gcctccaaaggcacagctcaaa

SEQ ID NO: 132704 - DNA, 22 bp, Artificial Sequence
  Synthetic oligonucleotide; CTC chr11 5289731 5289752 5289736 5289731 -
caaaggcacagctcaaactttt

SEQ ID NO: 132705 - DNA, 22 bp, Artificial Sequence
  Synthetic oligonucleotide; CTC chr11 5289717 5289738 5289722 5289717 -
aaacttttcaagccttctctaa

SEQ ID NO: 132706 - DNA, 22 bp, Artificial Sequence
  Synthetic oligonucleotide; CTT chr11 5289711 5289732 5289716 5289711 -
ttcaagccttctctaatcttaa

SEQ ID NO: 132707 - DNA, 22 bp, Artificial Sequence
  Synthetic oligonucleotide; TTT chr11 5289710 5289731 5289715 5289710 -
tcaagccttctctaatcttaaa

SEQ ID NO: 132708 - DNA, 22 bp, Artificial Sequence
  Synthetic oligonucleotide; TTT chr11 5289709 5289730 5289714 5289709 -
caagccttctctaatcttaaag

SEQ ID NO: 132709 - DNA, 22 bp, Artificial Sequence
  Synthetic oligonucleotide; TTC chr11 5289708 5289729 5289713 5289708 -
aagccttctctaatcttaaagg

SEQ ID NO: 132710 - DNA, 22 bp, Artificial Sequence
  Synthetic oligonucleotide; CTT chr11 5289701 5289722 5289706 5289701 -
ctctaatcttaaaggtaaacaa

SEQ ID NO: 132711 - DNA, 22 bp, Artificial Sequence
  Synthetic oligonucleotide; TTC chr11 5289700 5289721 5289705 5289700 -
tctaatcttaaaggtaaacaag

SEQ ID NO: 132712 - DNA, 22 bp, Artificial Sequence
  Synthetic oligonucleotide; CTC chr11 5289698 5289719 5289703 5289698 -
taatcttaaaggtaaacaaggg

SEQ ID NO: 132713 - DNA, 22 bp, Artificial Sequence
  Synthetic oligonucleotide; CTA chr11 5289696 5289717 5289701 5289696 -
atcttaaaggtaaacaagggtc

SEQ ID NO: 132714 - DNA, 22 bp, Artificial Sequence
  Synthetic oligonucleotide; CTT chr11 5289691 5289712 5289696 5289691 -
aaaggtaaacaagggtctcatt

SEQ ID NO: 132715 - DNA, 22 bp, Artificial Sequence
  Synthetic oligonucleotide; TTA chr11 5289690 5289711 5289695 5289690 -
aaggtaaacaagggtctcattt

SEQ ID NO: 132716 - DNA, 22 bp, Artificial Sequence
  Synthetic oligonucleotide; CTC chr11 5289672 5289693 5289677 5289672 -
atttctttgagaacttcaggga

SEQ ID NO: 132717 - DNA, 22 bp, Artificial Sequence
  Synthetic oligonucleotide; TTT chr11 5289668 5289689 5289673 5289668 -
ctttgagaacttcagggaaaat

SEQ ID NO: 132718 - DNA, 22 bp, Artificial Sequence
  Synthetic oligonucleotide; TTC chr11 5289667 5289688 5289672 5289667 -
tttgagaacttcagggaaaata

SEQ ID NO: 132719 - DNA, 22 bp, Artificial Sequence
  Synthetic oligonucleotide; CTT chr11 5289665 5289686 5289670 5289665 -
tgagaacttcagggaaaataga

SEQ ID NO: 132720 - DNA, 22 bp, Artificial Sequence
  Synthetic oligonucleotide; TTT chr11 5289664 5289685 5289669 5289664 -
gagaacttcagggaaaatagac

SEQ ID NO: 132721 - DNA, 22 bp, Artificial Sequence
  Synthetic oligonucleotide; TTG chr11 5289663 5289684 5289668 5289663 -
agaacttcagggaaaatagaca

SEQ ID NO: 132722 - DNA, 22 bp, Artificial Sequence
  Synthetic oligonucleotide; CTT chr11 5289656 5289677 5289661 5289656 -
cagggaaaatagacaaggactt

SEQ ID NO: 132723 - DNA, 22 bp, Artificial Sequence
  Synthetic oligonucleotide; TTC chr11 5289655 5289676 5289660 5289655 -
agggaaaatagacaaggacttg

SEQ ID NO: 132724 - DNA, 22 bp, Artificial Sequence
  Synthetic oligonucleotide; CTT chr11 5289634 5289655 5289639 5289634 -
gcctggtgcttttggtagggga

SEQ ID NO: 132725 - DNA, 22 bp, Artificial Sequence
  Synthetic oligonucleotide; TTG chr11 5289633 5289654 5289638 5289633 -
cctggtgcttttggtaggggag

SEQ ID NO: 132726 - DNA, 22 bp, Artificial Sequence
  Synthetic oligonucleotide; CTG chr11 5289629 5289650 5289634 5289629 -
gtgcttttggtaggggagcttg

SEQ ID NO: 132727 - DNA, 22 bp, Artificial Sequence
  Synthetic oligonucleotide; CTT chr11 5289623 5289644 5289628 5289623 -
ttggtaggggagcttgcacttt

SEQ ID NO: 132728 - DNA, 22 bp, Artificial Sequence
  Synthetic oligonucleotide; TTT chr11 5289622 5289643 5289627 5289622 -
tggtaggggagcttgcactttc

SEQ ID NO: 132729 - DNA, 22 bp, Artificial Sequence
  Synthetic oligonucleotide; TTT chr11 5289621 5289642 5289626 5289621 -
ggtaggggagcttgcactttcc

SEQ ID NO: 132730 - DNA, 22 bp, Artificial Sequence
  Synthetic oligonucleotide; TTG chr11 5289620 5289641 5289625 5289620 -
gtaggggagcttgcactttccc

SEQ ID NO: 132731 - DNA, 22 bp, Artificial Sequence
  Synthetic oligonucleotide; CTT chr11 5289608 5289629 5289613 5289608 -
gcactttccccctttctggagg

SEQ ID NO: 132732 - DNA, 22 bp, Artificial Sequence
  Synthetic oligonucleotide; TTG chr11 5289607 5289628 5289612 5289607 -
cactttccccctttctggagga

SEQ ID NO: 132733 - DNA, 22 bp, Artificial Sequence
  Synthetic oligonucleotide; CTT chr11 5289602 5289623 5289607 5289602 -
tccccctttctggaggaaatat

SEQ ID NO: 132734 - DNA, 22 bp, Artificial Sequence
  Synthetic oligonucleotide; TTT chr11 5289601 5289622 5289606 5289601 -
ccccctttctggaggaaatatt

SEQ ID NO: 132735 - DNA, 22 bp, Artificial Sequence
  Synthetic oligonucleotide; TTC chr11 5289600 5289621 5289605 5289600 -
cccctttctggaggaaatattt

SEQ ID NO: 132736 - DNA, 22 bp, Artificial Sequence
  Synthetic oligonucleotide; CTT chr11 5289594 5289615 5289599 5289594 -
tctggaggaaatatttatcccc

SEQ ID NO: 132737 - DNA, 22 bp, Artificial Sequence
  Synthetic oligonucleotide; TTT chr11 5289593 5289614 5289598 5289593 -
ctggaggaaatatttatcccca

SEQ ID NO: 132738 - DNA, 22 bp, Artificial Sequence
  Synthetic oligonucleotide; TTC chr11 5289592 5289613 5289597 5289592 -
tggaggaaatatttatccccag

SEQ ID NO: 132739 - DNA, 22 bp, Artificial Sequence
  Synthetic oligonucleotide; CTG chr11 5289590 5289611 5289595 5289590 -
gaggaaatatttatccccaggt

SEQ ID NO: 132740 - DNA, 22 bp, Artificial Sequence
  Synthetic oligonucleotide; TTT chr11 5289578 5289599 5289583 5289578 -
atccccaggtagttcccttttt

SEQ ID NO: 132741 - DNA, 22 bp, Artificial Sequence
  Synthetic oligonucleotide; TTA chr11 5289577 5289598 5289582 5289577 -
tccccaggtagttccctttttg

SEQ ID NO: 132742 - DNA, 22 bp, Artificial Sequence
  Synthetic oligonucleotide; TTC chr11 5289563 5289584 5289568 5289563 -
cctttttgcaccagtggttctt

SEQ ID NO: 132743 - DNA, 22 bp, Artificial Sequence
  Synthetic oligonucleotide; CTT chr11 5289559 5289580 5289564 5289559 -
tttgcaccagtggttctttgaa

SEQ ID NO: 132744 - DNA, 22 bp, Artificial Sequence
  Synthetic oligonucleotide; TTT chr11 5289558 5289579 5289563 5289558 -
ttgcaccagtggttctttgaag

SEQ ID NO: 132745 - DNA, 22 bp, Artificial Sequence
  Synthetic oligonucleotide; TTT chr11 5289557 5289578 5289562 5289557 -
tgcaccagtggttctttgaaga

SEQ ID NO: 132746 - DNA, 22 bp, Artificial Sequence
  Synthetic oligonucleotide; TTT chr11 5289556 5289577 5289561 5289556 -
gcaccagtggttctttgaagag

SEQ ID NO: 132747 - DNA, 22 bp, Artificial Sequence
  Synthetic oligonucleotide; TTG chr11 5289555 5289576 5289560 5289555 -
caccagtggttctttgaagaga

SEQ ID NO: 132748 - DNA, 22 bp, Artificial Sequence
  Synthetic oligonucleotide; TTC chr11 5289543 5289564 5289548 5289543 -
tttgaagagacttccacctggg

SEQ ID NO: 132749 - DNA, 22 bp, Artificial Sequence
  Synthetic oligonucleotide; CTT chr11 5289541 5289562 5289546 5289541 -
tgaagagacttccacctgggaa

SEQ ID NO: 132750 - DNA, 22 bp, Artificial Sequence
  Synthetic oligonucleotide; TTT chr11 5289540 5289561 5289545 5289540 -
gaagagacttccacctgggaac

SEQ ID NO: 132751 - DNA, 22 bp, Artificial Sequence
  Synthetic oligonucleotide; TTG chr11 5289539 5289560 5289544 5289539 -
aagagacttccacctgggaaca

SEQ ID NO: 132752 - DNA, 22 bp, Artificial Sequence
  Synthetic oligonucleotide; CTT chr11 5289530 5289551 5289535 5289530 -
ccacctgggaacagttaaacag

SEQ ID NO: 132753 - DNA, 22 bp, Artificial Sequence
  Synthetic oligonucleotide; TTC chr11 5289529 5289550 5289534 5289529 -
cacctgggaacagttaaacagc

SEQ ID NO: 132754 - DNA, 22 bp, Artificial Sequence
  Synthetic oligonucleotide; CTG chr11 5289523 5289544 5289528 5289523 -
ggaacagttaaacagcaactac

SEQ ID NO: 132755 - DNA, 22 bp, Artificial Sequence
  Synthetic oligonucleotide; TTA chr11 5289513 5289534 5289518 5289513 -
aacagcaactacagggccttga

SEQ ID NO: 132756 - DNA, 22 bp, Artificial Sequence
  Synthetic oligonucleotide; CTA chr11 5289502 5289523 5289507 5289502 -
cagggccttgaactgcacactt

SEQ ID NO: 132757 - DNA, 22 bp, Artificial Sequence
  Synthetic oligonucleotide; CTT chr11 5289493 5289514 5289498 5289493 -
gaactgcacactttcagtccgg

SEQ ID NO: 132758 - DNA, 22 bp, Artificial Sequence
  Synthetic oligonucleotide; TTG chr11 5289492 5289513 5289497 5289492 -
aactgcacactttcagtccggt

SEQ ID NO: 132759 - DNA, 22 bp, Artificial Sequence
  Synthetic oligonucleotide; CTG chr11 5289487 5289508 5289492 5289487 -
cacactttcagtccggtcctca

SEQ ID NO: 132760 - DNA, 22 bp, Artificial Sequence
  Synthetic oligonucleotide; CTT chr11 5289480 5289501 5289485 5289480 -
tcagtccggtcctcacagttga

SEQ ID NO: 132761 - DNA, 22 bp, Artificial Sequence
  Synthetic oligonucleotide; TTT chr11 5289479 5289500 5289484 5289479 -
cagtccggtcctcacagttgaa

SEQ ID NO: 132762 - DNA, 22 bp, Artificial Sequence
  Synthetic oligonucleotide; TTC chr11 5289478 5289499 5289483 5289478 -
agtccggtcctcacagttgaaa

SEQ ID NO: 132763 - DNA, 22 bp, Artificial Sequence
  Synthetic oligonucleotide; CTC chr11 5289466 5289487 5289471 5289466 -
acagttgaaaagacctaagctt

SEQ ID NO: 132764 - DNA, 22 bp, Artificial Sequence
  Synthetic oligonucleotide; TTG chr11 5289459 5289480 5289464 5289459 -
aaaagacctaagcttgtgcctg

SEQ ID NO: 132765 - DNA, 22 bp, Artificial Sequence
  Synthetic oligonucleotide; CTA chr11 5289449 5289470 5289454 5289449 -
agcttgtgcctgatttaagcct

SEQ ID NO: 132766 - DNA, 22 bp, Artificial Sequence
  Synthetic oligonucleotide; CTT chr11 5289444 5289465 5289449 5289444 -
gtgcctgatttaagcctttttg

SEQ ID NO: 132767 - DNA, 22 bp, Artificial Sequence
  Synthetic oligonucleotide; TTG chr11 5289443 5289464 5289448 5289443 -
tgcctgatttaagcctttttgg

SEQ ID NO: 132768 - DNA, 22 bp, Artificial Sequence
  Synthetic oligonucleotide; CTG chr11 5289437 5289458 5289442 5289437 -
atttaagcctttttggtcataa

SEQ ID NO: 132769 - DNA, 22 bp, Artificial Sequence
  Synthetic oligonucleotide; TTT chr11 5289433 5289454 5289438 5289433 -
aagcctttttggtcataaaaca

SEQ ID NO: 132770 - DNA, 22 bp, Artificial Sequence
  Synthetic oligonucleotide; TTA chr11 5289432 5289453 5289437 5289432 -
agcctttttggtcataaaacat

SEQ ID NO: 132771 - DNA, 22 bp, Artificial Sequence
  Synthetic oligonucleotide; CTT chr11 5289426 5289447 5289431 5289426 -
tttggtcataaaacattgaatt

SEQ ID NO: 132772 - DNA, 22 bp, Artificial Sequence
  Synthetic oligonucleotide; TTT chr11 5289425 5289446 5289430 5289425 -
ttggtcataaaacattgaattc

SEQ ID NO: 132773 - DNA, 22 bp, Artificial Sequence
  Synthetic oligonucleotide; TTT chr11 5289424 5289445 5289429 5289424 -
tggtcataaaacattgaattct

SEQ ID NO: 132774 - DNA, 22 bp, Artificial Sequence
  Synthetic oligonucleotide; TTT chr11 5289423 5289444 5289428 5289423 -
ggtcataaaacattgaattcta

SEQ ID NO: 132775 - DNA, 22 bp, Artificial Sequence
  Synthetic oligonucleotide; TTG chr11 5289422 5289443 5289427 5289422 -
gtcataaaacattgaattctaa

SEQ ID NO: 132776 - DNA, 22 bp, Artificial Sequence
  Synthetic oligonucleotide; TTG chr11 5289408 5289429 5289413 5289408 -
aattctaatctccctctcaacc

SEQ ID NO: 132777 - DNA, 22 bp, Artificial Sequence
  Synthetic oligonucleotide; TTC chr11 5289403 5289424 5289408 5289403 -
taatctccctctcaaccctaca

SEQ ID NO: 132778 - DNA, 22 bp, Artificial Sequence
  Synthetic oligonucleotide; CTA chr11 5289401 5289422 5289406 5289401 -
atctccctctcaaccctacagt

SEQ ID NO: 132779 - DNA, 22 bp, Artificial Sequence
  Synthetic oligonucleotide; CTC chr11 5289396 5289417 5289401 5289396 -
cctctcaaccctacagtcaccc

SEQ ID NO: 132780 - DNA, 22 bp, Artificial Sequence
  Synthetic oligonucleotide; CTC chr11 5289392 5289413 5289397 5289392 -
tcaaccctacagtcacccattt

SEQ ID NO: 132781 - DNA, 22 bp, Artificial Sequence
  Synthetic oligonucleotide; CTC chr11 5289390 5289411 5289395 5289390 -
aaccctacagtcacccatttgg

SEQ ID NO: 132782 - DNA, 22 bp, Artificial Sequence
  Synthetic oligonucleotide; CTA chr11 5289383 5289404 5289388 5289383 -
cagtcacccatttggtatatta

SEQ ID NO: 132783 - DNA, 22 bp, Artificial Sequence
  Synthetic oligonucleotide; TTT chr11 5289370 5289391 5289375 5289370 -
ggtatattaaagatgtgttgtc

SEQ ID NO: 132784 - DNA, 22 bp, Artificial Sequence
  Synthetic oligonucleotide; TTG chr11 5289369 5289390 5289374 5289369 -
gtatattaaagatgtgttgtct

SEQ ID NO: 132785 - DNA, 22 bp, Artificial Sequence
  Synthetic oligonucleotide; TTA chr11 5289361 5289382 5289366 5289361 -
aagatgtgttgtctactgtcta

SEQ ID NO: 132786 - DNA, 22 bp, Artificial Sequence
  Synthetic oligonucleotide; TTG chr11 5289350 5289371 5289355 5289350 -
tctactgtctagtatccctcaa

SEQ ID NO: 132787 - DNA, 22 bp, Artificial Sequence
  Synthetic oligonucleotide; CTA chr11 5289346 5289367 5289351 5289346 -
ctgtctagtatccctcaagtag

SEQ ID NO: 132788 - DNA, 22 bp, Artificial Sequence
  Synthetic oligonucleotide; CTG chr11 5289343 5289364 5289348 5289343 -
tctagtatccctcaagtagtgt

SEQ ID NO: 132789 - DNA, 22 bp, Artificial Sequence
  Synthetic oligonucleotide; CTA chr11 5289339 5289360 5289344 5289339 -
gtatccctcaagtagtgtcagg

SEQ ID NO: 132790 - DNA, 22 bp, Artificial Sequence
  Synthetic oligonucleotide; CTC chr11 5289330 5289351 5289335 5289330 -
aagtagtgtcaggaattagtca

SEQ ID NO: 132791 - DNA, 22 bp, Artificial Sequence
  Synthetic oligonucleotide; TTA chr11 5289312 5289333 5289317 5289312 -
gtcatttaaatagtctgcaagc

SEQ ID NO: 132792 - DNA, 22 bp, Artificial Sequence
  Synthetic oligonucleotide; TTT chr11 5289305 5289326 5289310 5289305 -
aaatagtctgcaagccaggagt

SEQ ID NO: 132793 - DNA, 22 bp, Artificial Sequence
  Synthetic oligonucleotide; TTA chr11 5289304 5289325 5289309 5289304 -
aatagtctgcaagccaggagtg

SEQ ID NO: 132794 - DNA, 22 bp, Artificial Sequence
  Synthetic oligonucleotide; CTG chr11 5289295 5289316 5289300 5289295 -
caagccaggagtggtggctcat

SEQ ID NO: 132795 - DNA, 22 bp, Artificial Sequence
  Synthetic oligonucleotide; CTC chr11 5289275 5289296 5289280 5289275 -
atgtctgtaattccagcacttg

SEQ ID NO: 132796 - DNA, 22 bp, Artificial Sequence
  Synthetic oligonucleotide; CTG chr11 5289268 5289289 5289273 5289268 -
taattccagcacttgagaggta

SEQ ID NO: 132797 - DNA, 22 bp, Artificial Sequence
  Synthetic oligonucleotide; TTC chr11 5289262 5289283 5289267 5289262 -
cagcacttgagaggtagaagtg

SEQ ID NO: 132798 - DNA, 22 bp, Artificial Sequence
  Synthetic oligonucleotide; CTT chr11 5289254 5289275 5289259 5289254 -
gagaggtagaagtgggaggact

SEQ ID NO: 132799 - DNA, 22 bp, Artificial Sequence
  Synthetic oligonucleotide; TTG chr11 5289253 5289274 5289258 5289253 -
agaggtagaagtgggaggactg

SEQ ID NO: 132800 - DNA, 22 bp, Artificial Sequence
  Synthetic oligonucleotide; CTG chr11 5289231 5289252 5289236 5289231 -
cttgagctcaagagtttgatat

SEQ ID NO: 132801 - DNA, 22 bp, Artificial Sequence
  Synthetic oligonucleotide; CTT chr11 5289228 5289249 5289233 5289228 -
gagctcaagagtttgatattat

SEQ ID NO: 132802 - DNA, 22 bp, Artificial Sequence
  Synthetic oligonucleotide; TTG chr11 5289227 5289248 5289232 5289227 -
agctcaagagtttgatattatc

SEQ ID NO: 132803 - DNA, 22 bp, Artificial Sequence
  Synthetic oligonucleotide; CTC chr11 5289222 5289243 5289227 5289222 -
aagagtttgatattatcctgga

SEQ ID NO: 132804 - DNA, 22 bp, Artificial Sequence
  Synthetic oligonucleotide; TTT chr11 5289214 5289235 5289219 5289214 -
gatattatcctggacaacatag

SEQ ID NO: 132805 - DNA, 22 bp, Artificial Sequence
  Synthetic oligonucleotide; TTG chr11 5289213 5289234 5289218 5289213 -
atattatcctggacaacatagc

SEQ ID NO: 132806 - DNA, 22 bp, Artificial Sequence
  Synthetic oligonucleotide; TTA chr11 5289207 5289228 5289212 5289207 -
tcctggacaacatagcaagacc

SEQ ID NO: 132807 - DNA, 22 bp, Artificial Sequence
  Synthetic oligonucleotide; CTG chr11 5289202 5289223 5289207 5289202 -
gacaacatagcaagacctcgtc

SEQ ID NO: 132808 - DNA, 22 bp, Artificial Sequence
  Synthetic oligonucleotide; CTC chr11 5289183 5289204 5289188 5289183 -
gtctctacttaaaaaaaaaaaa

SEQ ID NO: 132809 - DNA, 22 bp, Artificial Sequence
  Synthetic oligonucleotide; CTC chr11 5289178 5289199 5289183 5289178 -
tacttaaaaaaaaaaaaaaaat

SEQ ID NO: 132810 - DNA, 22 bp, Artificial Sequence
  Synthetic oligonucleotide; CTA chr11 5289176 5289197 5289181 5289176 -
cttaaaaaaaaaaaaaaaatta

SEQ ID NO: 132811 - DNA, 22 bp, Artificial Sequence
  Synthetic oligonucleotide; CTT chr11 5289173 5289194 5289178 5289173 -
aaaaaaaaaaaaaaaattagcc

SEQ ID NO: 132812 - DNA, 22 bp, Artificial Sequence
  Synthetic oligonucleotide; TTA chr11 5289172 5289193 5289177 5289172 -
aaaaaaaaaaaaaaattagcca

SEQ ID NO: 132813 - DNA, 22 bp, Artificial Sequence
  Synthetic oligonucleotide; TTA chr11 5289154 5289175 5289159 5289154 -
gccaggcatgtgatgtacacct

SEQ ID NO: 132814 - DNA, 22 bp, Artificial Sequence
  Synthetic oligonucleotide; CTG chr11 5289131 5289152 5289136 5289131 -
tagtcccagctactcaggaggc

SEQ ID NO: 132815 - DNA, 22 bp, Artificial Sequence
  Synthetic oligonucleotide; CTA chr11 5289119 5289140 5289124 5289119 -
ctcaggaggccgaaatgggagg

SEQ ID NO: 132816 - DNA, 22 bp, Artificial Sequence
  Synthetic oligonucleotide; CTC chr11 5289116 5289137 5289121 5289116 -
aggaggccgaaatgggaggatc

SEQ ID NO: 132817 - DNA, 22 bp, Artificial Sequence
  Synthetic oligonucleotide; CTT chr11 5289090 5289111 5289095 5289090 -
gagctcaggaggtcaaggctgc

SEQ ID NO: 132818 - DNA, 22 bp, Artificial Sequence
  Synthetic oligonucleotide; TTG chr11 5289089 5289110 5289094 5289089 -
agctcaggaggtcaaggctgca

SEQ ID NO: 132819 - DNA, 22 bp, Artificial Sequence
  Synthetic oligonucleotide; CTC chr11 5289084 5289105 5289089 5289084 -
aggaggtcaaggctgcagtgag

SEQ ID NO: 132820 - DNA, 22 bp, Artificial Sequence
  Synthetic oligonucleotide; CTG chr11 5289069 5289090 5289074 5289069 -
cagtgagacatgatcttgccac

SEQ ID NO: 132821 - DNA, 22 bp, Artificial Sequence
  Synthetic oligonucleotide; CTT chr11 5289052 5289073 5289057 5289052 -
gccactgcactccagcctggac

SEQ ID NO: 132822 - DNA, 22 bp, Artificial Sequence
  Synthetic oligonucleotide; TTG chr11 5289051 5289072 5289056 5289051 -
ccactgcactccagcctggaca

SEQ ID NO: 132823 - DNA, 22 bp, Artificial Sequence
  Synthetic oligonucleotide; CTG chr11 5289045 5289066 5289050 5289045 -
cactccagcctggacagcagag

SEQ ID NO: 132824 - DNA, 22 bp, Artificial Sequence
  Synthetic oligonucleotide; CTC chr11 5289040 5289061 5289045 5289040 -
cagcctggacagcagagtgaaa

SEQ ID NO: 132825 - DNA, 22 bp, Artificial Sequence
  Synthetic oligonucleotide; CTG chr11 5289033 5289054 5289038 5289033 -
gacagcagagtgaaaccttgcc

SEQ ID NO: 132826 - DNA, 22 bp, Artificial Sequence
  Synthetic oligonucleotide; CTT chr11 5289014 5289035 5289019 5289014 -
gcctcacgaaacagaatacaaa

SEQ ID NO: 132827 - DNA, 22 bp, Artificial Sequence
  Synthetic oligonucleotide; TTG chr11 5289013 5289034 5289018 5289013 -
cctcacgaaacagaatacaaaa

SEQ ID NO: 132828 - DNA, 22 bp, Artificial Sequence
  Synthetic oligonucleotide; CTC chr11 5289009 5289030 5289014 5289009 -
acgaaacagaatacaaaaacaa

SEQ ID NO: 132829 - DNA, 22 bp, Artificial Sequence
  Synthetic oligonucleotide; CTG chr11 5288972 5288993 5288977 5288972 -
ctccgcaatgcgcttccttgat

SEQ ID NO: 132830 - DNA, 22 bp, Artificial Sequence
  Synthetic oligonucleotide; CTC chr11 5288969 5288990 5288974 5288969 -
cgcaatgcgcttccttgatgct

SEQ ID NO: 132831 - DNA, 22 bp, Artificial Sequence
  Synthetic oligonucleotide; CTT chr11 5288957 5288978 5288962 5288957 -
ccttgatgctctaccacatagg

SEQ ID NO: 132832 - DNA, 22 bp, Artificial Sequence
  Synthetic oligonucleotide; TTC chr11 5288956 5288977 5288961 5288956 -
cttgatgctctaccacataggt

SEQ ID NO: 132833 - DNA, 22 bp, Artificial Sequence
  Synthetic oligonucleotide; CTT chr11 5288953 5288974 5288958 5288953 -
gatgctctaccacataggtctg

SEQ ID NO: 132834 - DNA, 22 bp, Artificial Sequence
  Synthetic oligonucleotide; TTG chr11 5288952 5288973 5288957 5288952 -
atgctctaccacataggtctgg

SEQ ID NO: 132835 - DNA, 22 bp, Artificial Sequence
  Synthetic oligonucleotide; CTC chr11 5288946 5288967 5288951 5288946 -
taccacataggtctgggtactt

SEQ ID NO: 132836 - DNA, 22 bp, Artificial Sequence
  Synthetic oligonucleotide; CTA chr11 5288944 5288965 5288949 5288944 -
ccacataggtctgggtactttg

SEQ ID NO: 132837 - DNA, 22 bp, Artificial Sequence
  Synthetic oligonucleotide; CTG chr11 5288931 5288952 5288936 5288931 -
ggtactttgtacacattatctc

SEQ ID NO: 132838 - DNA, 22 bp, Artificial Sequence
  Synthetic oligonucleotide; CTT chr11 5288924 5288945 5288929 5288924 -
tgtacacattatctcattgctg

SEQ ID NO: 132839 - DNA, 22 bp, Artificial Sequence
  Synthetic oligonucleotide; TTT chr11 5288923 5288944 5288928 5288923 -
gtacacattatctcattgctgt

SEQ ID NO: 132840 - DNA, 22 bp, Artificial Sequence
  Synthetic oligonucleotide; TTG chr11 5288922 5288943 5288927 5288922 -
tacacattatctcattgctgtt

SEQ ID NO: 132841 - DNA, 22 bp, Artificial Sequence
  Synthetic oligonucleotide; TTA chr11 5288913 5288934 5288918 5288913 -
tctcattgctgttcataattgt

SEQ ID NO: 132842 - DNA, 22 bp, Artificial Sequence
  Synthetic oligonucleotide; CTC chr11 5288909 5288930 5288914 5288909 -
attgctgttcataattgttaga

SEQ ID NO: 132843 - DNA, 22 bp, Artificial Sequence
  Synthetic oligonucleotide; TTG chr11 5288905 5288926 5288910 5288905 -
ctgttcataattgttagattaa

SEQ ID NO: 132844 - DNA, 22 bp, Artificial Sequence
  Synthetic oligonucleotide; CTG chr11 5288902 5288923 5288907 5288902 -
ttcataattgttagattaattt

SEQ ID NO: 132845 - DNA, 22 bp, Artificial Sequence
  Synthetic oligonucleotide; TTC chr11 5288899 5288920 5288904 5288899 -
ataattgttagattaattttgt

SEQ ID NO: 132846 - DNA, 22 bp, Artificial Sequence
  Synthetic oligonucleotide; TTG chr11 5288892 5288913 5288897 5288892 -
ttagattaattttgtaatattg

SEQ ID NO: 132847 - DNA, 22 bp, Artificial Sequence
  Synthetic oligonucleotide; TTA chr11 5288889 5288910 5288894 5288889 -
gattaattttgtaatattgata

SEQ ID NO: 132848 - DNA, 22 bp, Artificial Sequence
  Synthetic oligonucleotide; TTA chr11 5288884 5288905 5288889 5288884 -
attttgtaatattgatattatt

SEQ ID NO: 132849 - DNA, 22 bp, Artificial Sequence
  Synthetic oligonucleotide; TTT chr11 5288880 5288901 5288885 5288880 -
tgtaatattgatattattccta

SEQ ID NO: 132850 - DNA, 22 bp, Artificial Sequence
  Synthetic oligonucleotide; TTT chr11 5288879 5288900 5288884 5288879 -
gtaatattgatattattcctag

SEQ ID NO: 132851 - DNA, 22 bp, Artificial Sequence
  Synthetic oligonucleotide; TTG chr11 5288878 5288899 5288883 5288878 -
taatattgatattattcctaga

SEQ ID NO: 132852 - DNA, 22 bp, Artificial Sequence
  Synthetic oligonucleotide; TTG chr11 5288870 5288891 5288875 5288870 -
atattattcctagaaagctgag

SEQ ID NO: 132853 - DNA, 22 bp, Artificial Sequence
  Synthetic oligonucleotide; TTA chr11 5288864 5288885 5288869 5288864 -
ttcctagaaagctgaggcctca

SEQ ID NO: 132854 - DNA, 22 bp, Artificial Sequence
  Synthetic oligonucleotide; TTC chr11 5288861 5288882 5288866 5288861 -
ctagaaagctgaggcctcaaga

SEQ ID NO: 132855 - DNA, 22 bp, Artificial Sequence
  Synthetic oligonucleotide; CTA chr11 5288858 5288879 5288863 5288858 -
gaaagctgaggcctcaagatga

SEQ ID NO: 132856 - DNA, 22 bp, Artificial Sequence
  Synthetic oligonucleotide; CTG chr11 5288850 5288871 5288855 5288850 -
aggcctcaagatgataactttt

SEQ ID NO: 132857 - DNA, 22 bp, Artificial Sequence
  Synthetic oligonucleotide; CTC chr11 5288843 5288864 5288848 5288843 -
aagatgataacttttattttct

SEQ ID NO: 132858 - DNA, 22 bp, Artificial Sequence
  Synthetic oligonucleotide; CTT chr11 5288830 5288851 5288835 5288830 -
ttattttctggacttgtaatag

SEQ ID NO: 132859 - DNA, 22 bp, Artificial Sequence
  Synthetic oligonucleotide; TTT chr11 5288829 5288850 5288834 5288829 -
tattttctggacttgtaatagc

SEQ ID NO: 132860 - DNA, 22 bp, Artificial Sequence
  Synthetic oligonucleotide; TTT chr11 5288828 5288849 5288833 5288828 -
attttctggacttgtaatagct

SEQ ID NO: 132861 - DNA, 22 bp, Artificial Sequence
  Synthetic oligonucleotide; TTA chr11 5288827 5288848 5288832 5288827 -
ttttctggacttgtaatagctt

SEQ ID NO: 132862 - DNA, 22 bp, Artificial Sequence
  Synthetic oligonucleotide; TTT chr11 5288824 5288845 5288829 5288824 -
tctggacttgtaatagctttct

SEQ ID NO: 132863 - DNA, 22 bp, Artificial Sequence
  Synthetic oligonucleotide; TTT chr11 5288823 5288844 5288828 5288823 -
ctggacttgtaatagctttctc

SEQ ID NO: 132864 - DNA, 22 bp, Artificial Sequence
  Synthetic oligonucleotide; TTC chr11 5288822 5288843 5288827 5288822 -
tggacttgtaatagctttctct

SEQ ID NO: 132865 - DNA, 22 bp, Artificial Sequence
  Synthetic oligonucleotide; CTG chr11 5288820 5288841 5288825 5288820 -
gacttgtaatagctttctcttg

SEQ ID NO: 132866 - DNA, 22 bp, Artificial Sequence
  Synthetic oligonucleotide; CTT chr11 5288815 5288836 5288820 5288815 -
gtaatagctttctcttgtattc

SEQ ID NO: 132867 - DNA, 22 bp, Artificial Sequence
  Synthetic oligonucleotide; TTG chr11 5288814 5288835 5288819 5288814 -
taatagctttctcttgtattca

SEQ ID NO: 132868 - DNA, 22 bp, Artificial Sequence
  Synthetic oligonucleotide; CTT chr11 5288805 5288826 5288810 5288805 -
tctcttgtattcaccatgttgt

SEQ ID NO: 132869 - DNA, 22 bp, Artificial Sequence
  Synthetic oligonucleotide; TTT chr11 5288804 5288825 5288809 5288804 -
ctcttgtattcaccatgttgta

SEQ ID NO: 132870 - DNA, 22 bp, Artificial Sequence
  Synthetic oligonucleotide; TTC chr11 5288803 5288824 5288808 5288803 -
tcttgtattcaccatgttgtaa

SEQ ID NO: 132871 - DNA, 22 bp, Artificial Sequence
  Synthetic oligonucleotide; CTC chr11 5288801 5288822 5288806 5288801 -
ttgtattcaccatgttgtaact

SEQ ID NO: 132872 - DNA, 22 bp, Artificial Sequence
  Synthetic oligonucleotide; CTT chr11 5288799 5288820 5288804 5288799 -
gtattcaccatgttgtaacttt

SEQ ID NO: 132873 - DNA, 22 bp, Artificial Sequence
  Synthetic oligonucleotide; TTG chr11 5288798 5288819 5288803 5288798 -
tattcaccatgttgtaactttc

SEQ ID NO: 132874 - DNA, 22 bp, Artificial Sequence
  Synthetic oligonucleotide; TTC chr11 5288793 5288814 5288798 5288793 -
accatgttgtaactttcttaga

SEQ ID NO: 132875 - DNA, 22 bp, Artificial Sequence
  Synthetic oligonucleotide; TTG chr11 5288784 5288805 5288789 5288784 -
taactttcttagagtagtaaca

SEQ ID NO: 132876 - DNA, 22 bp, Artificial Sequence
  Synthetic oligonucleotide; CTT chr11 5288778 5288799 5288783 5288778 -
tcttagagtagtaacaatataa

SEQ ID NO: 132877 - DNA, 22 bp, Artificial Sequence
  Synthetic oligonucleotide; TTT chr11 5288777 5288798 5288782 5288777 -
cttagagtagtaacaatataaa

SEQ ID NO: 132878 - DNA, 22 bp, Artificial Sequence
  Synthetic oligonucleotide; TTC chr11 5288776 5288797 5288781 5288776 -
ttagagtagtaacaatataaag

SEQ ID NO: 132879 - DNA, 22 bp, Artificial Sequence
  Synthetic oligonucleotide; CTT chr11 5288774 5288795 5288779 5288774 -
agagtagtaacaatataaagtt

SEQ ID NO: 132880 - DNA, 22 bp, Artificial Sequence
  Synthetic oligonucleotide; TTA chr11 5288773 5288794 5288778 5288773 -
gagtagtaacaatataaagtta

SEQ ID NO: 132881 - DNA, 22 bp, Artificial Sequence
  Synthetic oligonucleotide; TTA chr11 5288751 5288772 5288756 5288751 -
ttgtgagtttttgcaaacacag

SEQ ID NO: 132882 - DNA, 22 bp, Artificial Sequence
  Synthetic oligonucleotide; TTG chr11 5288748 5288769 5288753 5288748 -
tgagtttttgcaaacacagcaa

SEQ ID NO: 132883 - DNA, 22 bp, Artificial Sequence
  Synthetic oligonucleotide; TTT chr11 5288741 5288762 5288746 5288741 -
ttgcaaacacagcaaacacaac

SEQ ID NO: 132884 - DNA, 22 bp, Artificial Sequence
  Synthetic oligonucleotide; TTT chr11 5288740 5288761 5288745 5288740 -
tgcaaacacagcaaacacaacg

SEQ ID NO: 132885 - DNA, 22 bp, Artificial Sequence
  Synthetic oligonucleotide; TTT chr11 5288739 5288760 5288744 5288739 -
gcaaacacagcaaacacaacga

SEQ ID NO: 132886 - DNA, 22 bp, Artificial Sequence
  Synthetic oligonucleotide; TTG chr11 5288738 5288759 5288743 5288738 -
caaacacagcaaacacaacgac

SEQ ID NO: 132887 - DNA, 22 bp, Artificial Sequence
  Synthetic oligonucleotide; TTG chr11 5288702 5288723 5288707 5288702 -
atgtgaaattgtctattgtcaa

SEQ ID NO: 132888 - DNA, 22 bp, Artificial Sequence
  Synthetic oligonucleotide; TTG chr11 5288691 5288712 5288696 5288691 -
tctattgtcaatttatgggaaa

SEQ ID NO: 132889 - DNA, 22 bp, Artificial Sequence
  Synthetic oligonucleotide; CTA chr11 5288687 5288708 5288692 5288687 -
ttgtcaatttatgggaaaacaa

SEQ ID NO: 132890 - DNA, 22 bp, Artificial Sequence
  Synthetic oligonucleotide; TTG chr11 5288684 5288705 5288689 5288684 -
tcaatttatgggaaaacaagta

SEQ ID NO: 132891 - DNA, 22 bp, Artificial Sequence
  Synthetic oligonucleotide; TTT chr11 5288677 5288698 5288682 5288677 -
atgggaaaacaagtatgtactt

SEQ ID NO: 132892 - DNA, 22 bp, Artificial Sequence
  Synthetic oligonucleotide; TTA chr11 5288676 5288697 5288681 5288676 -
tgggaaaacaagtatgtacttt

SEQ ID NO: 132893 - DNA, 22 bp, Artificial Sequence
  Synthetic oligonucleotide; CTT chr11 5288655 5288676 5288660 5288655 -
tttctactaagccattgaaaca

SEQ ID NO: 132894 - DNA, 22 bp, Artificial Sequence
  Synthetic oligonucleotide; TTT chr11 5288654 5288675 5288659 5288654 -
ttctactaagccattgaaacag

SEQ ID NO: 132895 - DNA, 22 bp, Artificial Sequence
  Synthetic oligonucleotide; TTT chr11 5288653 5288674 5288658 5288653 -
tctactaagccattgaaacagg

SEQ ID NO: 132896 - DNA, 22 bp, Artificial Sequence
  Synthetic oligonucleotide; TTT chr11 5288652 5288673 5288657 5288652 -
ctactaagccattgaaacagga

SEQ ID NO: 132897 - DNA, 22 bp, Artificial Sequence
  Synthetic oligonucleotide; TTC chr11 5288651 5288672 5288656 5288651 -
tactaagccattgaaacaggaa

SEQ ID NO: 132898 - DNA, 22 bp, Artificial Sequence
  Synthetic oligonucleotide; CTA chr11 5288649 5288670 5288654 5288649 -
ctaagccattgaaacaggaata

SEQ ID NO: 132899 - DNA, 22 bp, Artificial Sequence
  Synthetic oligonucleotide; CTA chr11 5288646 5288667 5288651 5288646 -
agccattgaaacaggaataaca

SEQ ID NO: 132900 - DNA, 22 bp, Artificial Sequence
  Synthetic oligonucleotide; TTG chr11 5288638 5288659 5288643 5288638 -
aaacaggaataacagaacaaga

SEQ ID NO: 132901 - DNA, 22 bp, Artificial Sequence
  Synthetic oligonucleotide; TTG chr11 5288613 5288634 5288618 5288613 -
aaagaatacattttccgaaatt

SEQ ID NO: 132902 - DNA, 22 bp, Artificial Sequence
  Synthetic oligonucleotide; TTT chr11 5288600 5288621 5288605 5288600 -
tccgaaattacttgagtattat

SEQ ID NO: 132903 - DNA, 22 bp, Artificial Sequence
  Synthetic oligonucleotide; TTT chr11 5288599 5288620 5288604 5288599 -
ccgaaattacttgagtattata

SEQ ID NO: 132904 - DNA, 22 bp, Artificial Sequence
  Synthetic oligonucleotide; TTC chr11 5288598 5288619 5288603 5288598 -
cgaaattacttgagtattatac

SEQ ID NO: 132905 - DNA, 22 bp, Artificial Sequence
  Synthetic oligonucleotide; TTA chr11 5288590 5288611 5288595 5288590 -
cttgagtattatacaaagacaa

SEQ ID NO: 132906 - DNA, 22 bp, Artificial Sequence
  Synthetic oligonucleotide; CTT chr11 5288587 5288608 5288592 5288587 -
gagtattatacaaagacaagca

SEQ ID NO: 132907 - DNA, 22 bp, Artificial Sequence
  Synthetic oligonucleotide; TTG chr11 5288586 5288607 5288591 5288586 -
agtattatacaaagacaagcac

SEQ ID NO: 132908 - DNA, 22 bp, Artificial Sequence
  Synthetic oligonucleotide; TTA chr11 5288579 5288600 5288584 5288579 -
tacaaagacaagcacgtggacc

SEQ ID NO: 132909 - DNA, 22 bp, Artificial Sequence
  Synthetic oligonucleotide; CTG chr11 5288555 5288576 5288560 5288555 -
ggaggagggttattgtccatga

SEQ ID NO: 132910 - DNA, 22 bp, Artificial Sequence
  Synthetic oligonucleotide; TTA chr11 5288543 5288564 5288548 5288543 -
ttgtccatgactggtgtgtgga

SEQ ID NO: 132911 - DNA, 22 bp, Artificial Sequence
  Synthetic oligonucleotide; TTG chr11 5288540 5288561 5288545 5288540 -
tccatgactggtgtgtggagac

SEQ ID NO: 132912 - DNA, 22 bp, Artificial Sequence
  Synthetic oligonucleotide; CTG chr11 5288530 5288551 5288535 5288530 -
gtgtgtggagacaaatgcaggt

SEQ ID NO: 132913 - DNA, 22 bp, Artificial Sequence
  Synthetic oligonucleotide; TTT chr11 5288506 5288527 5288511 5288506 -
ataatagatgggatggcatcta

SEQ ID NO: 132914 - DNA, 22 bp, Artificial Sequence
  Synthetic oligonucleotide; TTA chr11 5288505 5288526 5288510 5288505 -
taatagatgggatggcatctag

SEQ ID NO: 132915 - DNA, 22 bp, Artificial Sequence
  Synthetic oligonucleotide; CTA chr11 5288484 5288505 5288489 5288484 -
gcgcaatgactttgccatcact

SEQ ID NO: 132916 - DNA, 22 bp, Artificial Sequence
  Synthetic oligonucleotide; CTT chr11 5288472 5288493 5288477 5288472 -
tgccatcacttttagagagctc

SEQ ID NO: 132917 - DNA, 22 bp, Artificial Sequence
  Synthetic oligonucleotide; TTT chr11 5288471 5288492 5288476 5288471 -
gccatcacttttagagagctct

SEQ ID NO: 132918 - DNA, 22 bp, Artificial Sequence
  Synthetic oligonucleotide; TTG chr11 5288470 5288491 5288475 5288470 -
ccatcacttttagagagctctt

SEQ ID NO: 132919 - DNA, 22 bp, Artificial Sequence
  Synthetic oligonucleotide; CTT chr11 5288461 5288482 5288466 5288461 -
ttagagagctcttggggacccc

SEQ ID NO: 132920 - DNA, 22 bp, Artificial Sequence
  Synthetic oligonucleotide; TTT chr11 5288460 5288481 5288465 5288460 -
tagagagctcttggggacccca

SEQ ID NO: 132921 - DNA, 22 bp, Artificial Sequence
  Synthetic oligonucleotide; TTT chr11 5288459 5288480 5288464 5288459 -
agagagctcttggggaccccag

SEQ ID NO: 132922 - DNA, 22 bp, Artificial Sequence
  Synthetic oligonucleotide; TTA chr11 5288458 5288479 5288463 5288458 -
gagagctcttggggaccccagt

SEQ ID NO: 132923 - DNA, 22 bp, Artificial Sequence
  Synthetic oligonucleotide; CTC chr11 5288450 5288471 5288455 5288450 -
ttggggaccccagtacacaaga

SEQ ID NO: 132924 - DNA, 22 bp, Artificial Sequence
  Synthetic oligonucleotide; CTT chr11 5288448 5288469 5288453 5288448 -
ggggaccccagtacacaagagg

SEQ ID NO: 132925 - DNA, 22 bp, Artificial Sequence
  Synthetic oligonucleotide; TTG chr11 5288447 5288468 5288452 5288447 -
gggaccccagtacacaagaggg

SEQ ID NO: 132926 - DNA, 22 bp, Artificial Sequence
  Synthetic oligonucleotide; CTC chr11 5288400 5288421 5288405 5288400 -
attctttttcttagtgtgagaa

SEQ ID NO: 132927 - DNA, 22 bp, Artificial Sequence
  Synthetic oligonucleotide; TTC chr11 5288396 5288417 5288401 5288396 -
tttttcttagtgtgagaataag

SEQ ID NO: 132928 - DNA, 22 bp, Artificial Sequence
  Synthetic oligonucleotide; CTT chr11 5288394 5288415 5288399 5288394 -
tttcttagtgtgagaataagaa

SEQ ID NO: 132929 - DNA, 22 bp, Artificial Sequence
  Synthetic oligonucleotide; TTT chr11 5288393 5288414 5288398 5288393 -
ttcttagtgtgagaataagaat

SEQ ID NO: 132930 - DNA, 22 bp, Artificial Sequence
  Synthetic oligonucleotide; TTT chr11 5288392 5288413 5288397 5288392 -
tcttagtgtgagaataagaata

SEQ ID NO: 132931 - DNA, 22 bp, Artificial Sequence
  Synthetic oligonucleotide; TTT chr11 5288391 5288412 5288396 5288391 -
cttagtgtgagaataagaatag

SEQ ID NO: 132932 - DNA, 22 bp, Artificial Sequence
  Synthetic oligonucleotide; TTC chr11 5288390 5288411 5288395 5288390 -
ttagtgtgagaataagaatagc

SEQ ID NO: 132933 - DNA, 22 bp, Artificial Sequence
  Synthetic oligonucleotide; CTT chr11 5288388 5288409 5288393 5288388 -
agtgtgagaataagaatagcca

SEQ ID NO: 132934 - DNA, 22 bp, Artificial Sequence
  Synthetic oligonucleotide; TTA chr11 5288387 5288408 5288392 5288387 -
gtgtgagaataagaatagccat

SEQ ID NO: 132935 - DNA, 22 bp, Artificial Sequence
  Synthetic oligonucleotide; CTG chr11 5288359 5288380 5288364 5288359 -
agtttatagacaatgagccctt

SEQ ID NO: 132936 - DNA, 22 bp, Artificial Sequence
  Synthetic oligonucleotide; TTT chr11 5288354 5288375 5288359 5288354 -
atagacaatgagcccttttctc

SEQ ID NO: 132937 - DNA, 22 bp, Artificial Sequence
  Synthetic oligonucleotide; TTA chr11 5288353 5288374 5288358 5288353 -
tagacaatgagcccttttctct

SEQ ID NO: 132938 - DNA, 22 bp, Artificial Sequence
  Synthetic oligonucleotide; CTT chr11 5288337 5288358 5288342 5288337 -
ttctctctcccactcagcagct

SEQ ID NO: 132939 - DNA, 22 bp, Artificial Sequence
  Synthetic oligonucleotide; TTT chr11 5288336 5288357 5288341 5288336 -
tctctctcccactcagcagcta

SEQ ID NO: 132940 - DNA, 22 bp, Artificial Sequence
  Synthetic oligonucleotide; TTT chr11 5288335 5288356 5288340 5288335 -
ctctctcccactcagcagctat

SEQ ID NO: 132941 - DNA, 22 bp, Artificial Sequence
  Synthetic oligonucleotide; TTC chr11 5288334 5288355 5288339 5288334 -
tctctcccactcagcagctatg

SEQ ID NO: 132942 - DNA, 22 bp, Artificial Sequence
  Synthetic oligonucleotide; CTC chr11 5288332 5288353 5288337 5288332 -
tctcccactcagcagctatgag

SEQ ID NO: 132943 - DNA, 22 bp, Artificial Sequence
  Synthetic oligonucleotide; CTC chr11 5288330 5288351 5288335 5288330 -
tcccactcagcagctatgagat

SEQ ID NO: 132944 - DNA, 22 bp, Artificial Sequence
  Synthetic oligonucleotide; CTC chr11 5288328 5288349 5288333 5288328 -
ccactcagcagctatgagatgg

SEQ ID NO: 132945 - DNA, 22 bp, Artificial Sequence
  Synthetic oligonucleotide; CTC chr11 5288322 5288343 5288327 5288322 -
agcagctatgagatggcttgcc

SEQ ID NO: 132946 - DNA, 22 bp, Artificial Sequence
  Synthetic oligonucleotide; CTA chr11 5288314 5288335 5288319 5288314 -
tgagatggcttgccctgcctct

SEQ ID NO: 132947 - DNA, 22 bp, Artificial Sequence
  Synthetic oligonucleotide; CTT chr11 5288303 5288324 5288308 5288303 -
gccctgcctctctactaggctg

SEQ ID NO: 132948 - DNA, 22 bp, Artificial Sequence
  Synthetic oligonucleotide; TTG chr11 5288302 5288323 5288307 5288302 -
ccctgcctctctactaggctga

SEQ ID NO: 132949 - DNA, 22 bp, Artificial Sequence
  Synthetic oligonucleotide; CTG chr11 5288297 5288318 5288302 5288297 -
cctctctactaggctgactcac

SEQ ID NO: 132950 - DNA, 22 bp, Artificial Sequence
  Synthetic oligonucleotide; CTC chr11 5288293 5288314 5288298 5288293 -
tctactaggctgactcactcca

SEQ ID NO: 132951 - DNA, 22 bp, Artificial Sequence
  Synthetic oligonucleotide; CTC chr11 5288291 5288312 5288296 5288291 -
tactaggctgactcactccaag

SEQ ID NO: 132952 - DNA, 22 bp, Artificial Sequence
  Synthetic oligonucleotide; CTA chr11 5288289 5288310 5288294 5288289 -
ctaggctgactcactccaaggc

SEQ ID NO: 132953 - DNA, 22 bp, Artificial Sequence
  Synthetic oligonucleotide; CTA chr11 5288286 5288307 5288291 5288286 -
ggctgactcactccaaggccca

SEQ ID NO: 132954 - DNA, 22 bp, Artificial Sequence
  Synthetic oligonucleotide; CTG chr11 5288281 5288302 5288286 5288281 -
actcactccaaggcccagcaat

SEQ ID NO: 132955 - DNA, 22 bp, Artificial Sequence
  Synthetic oligonucleotide; CTC chr11 5288277 5288298 5288282 5288277 -
actccaaggcccagcaatgggc

SEQ ID NO: 132956 - DNA, 22 bp, Artificial Sequence
  Synthetic oligonucleotide; CTC chr11 5288273 5288294 5288278 5288273 -
caaggcccagcaatgggcaggg

SEQ ID NO: 132957 - DNA, 22 bp, Artificial Sequence
  Synthetic oligonucleotide; CTC chr11 5288248 5288269 5288253 5288248 -
tgtcagggctttgatagcacta

SEQ ID NO: 132958 - DNA, 22 bp, Artificial Sequence
  Synthetic oligonucleotide; CTG chr11 5288246 5288267 5288251 5288246 -
tcagggctttgatagcactatc

SEQ ID NO: 132959 - DNA, 22 bp, Artificial Sequence
  Synthetic oligonucleotide; CTT chr11 5288237 5288258 5288242 5288237 -
tgatagcactatctgcagagcc

SEQ ID NO: 132960 - DNA, 22 bp, Artificial Sequence
  Synthetic oligonucleotide; TTT chr11 5288236 5288257 5288241 5288236 -
gatagcactatctgcagagcca

SEQ ID NO: 132961 - DNA, 22 bp, Artificial Sequence
  Synthetic oligonucleotide; TTG chr11 5288235 5288256 5288240 5288235 -
atagcactatctgcagagccag

SEQ ID NO: 132962 - DNA, 22 bp, Artificial Sequence
  Synthetic oligonucleotide; CTA chr11 5288226 5288247 5288231 5288226 -
tctgcagagccagggccgagaa

SEQ ID NO: 132963 - DNA, 22 bp, Artificial Sequence
  Synthetic oligonucleotide; CTG chr11 5288222 5288243 5288227 5288222 -
cagagccagggccgagaagggg

SEQ ID NO: 132964 - DNA, 22 bp, Artificial Sequence
  Synthetic oligonucleotide; CTC chr11 5288193 5288214 5288198 5288193 -
cagagactctccctcccattcc

SEQ ID NO: 132965 - DNA, 22 bp, Artificial Sequence
  Synthetic oligonucleotide; CTC chr11 5288184 5288205 5288189 5288184 -
tccctcccattcccgagcaggg

SEQ ID NO: 132966 - DNA, 22 bp, Artificial Sequence
  Synthetic oligonucleotide; CTC chr11 5288182 5288203 5288187 5288182 -
cctcccattcccgagcagggtt

SEQ ID NO: 132967 - DNA, 22 bp, Artificial Sequence
  Synthetic oligonucleotide; CTC chr11 5288178 5288199 5288183 5288178 -
ccattcccgagcagggtttgct

SEQ ID NO: 132968 - DNA, 22 bp, Artificial Sequence
  Synthetic oligonucleotide; TTC chr11 5288172 5288193 5288177 5288172 -
ccgagcagggtttgcttattta

SEQ ID NO: 132969 - DNA, 22 bp, Artificial Sequence
  Synthetic oligonucleotide; TTT chr11 5288159 5288180 5288164 5288159 -
gcttatttatgcatttaaatga

SEQ ID NO: 132970 - DNA, 22 bp, Artificial Sequence
  Synthetic oligonucleotide; TTG chr11 5288158 5288179 5288163 5288158 -
cttatttatgcatttaaatgat

SEQ ID NO: 132971 - DNA, 22 bp, Artificial Sequence
  Synthetic oligonucleotide; CTT chr11 5288155 5288176 5288160 5288155 -
atttatgcatttaaatgatata

SEQ ID NO: 132972 - DNA, 22 bp, Artificial Sequence
  Synthetic oligonucleotide; TTA chr11 5288154 5288175 5288159 5288154 -
tttatgcatttaaatgatatat

SEQ ID NO: 132973 - DNA, 22 bp, Artificial Sequence
  Synthetic oligonucleotide; TTT chr11 5288151 5288172 5288156 5288151 -
atgcatttaaatgatatattta

SEQ ID NO: 132974 - DNA, 22 bp, Artificial Sequence
  Synthetic oligonucleotide; TTA chr11 5288150 5288171 5288155 5288150 -
tgcatttaaatgatatatttat

SEQ ID NO: 132975 - DNA, 22 bp, Artificial Sequence
  Synthetic oligonucleotide; TTT chr11 5288143 5288164 5288148 5288143 -
aaatgatatatttattttaaaa

SEQ ID NO: 132976 - DNA, 22 bp, Artificial Sequence
  Synthetic oligonucleotide; TTA chr11 5288142 5288163 5288147 5288142 -
aatgatatatttattttaaaag

SEQ ID NO: 132977 - DNA, 22 bp, Artificial Sequence
  Synthetic oligonucleotide; TTT chr11 5288130 5288151 5288135 5288130 -
attttaaaagaaataacaggag

SEQ ID NO: 132978 - DNA, 22 bp, Artificial Sequence
  Synthetic oligonucleotide; TTA chr11 5288129 5288150 5288134 5288129 -
ttttaaaagaaataacaggaga

SEQ ID NO: 132979 - DNA, 22 bp, Artificial Sequence
  Synthetic oligonucleotide; TTT chr11 5288126 5288147 5288131 5288126 -
taaaagaaataacaggagactg

SEQ ID NO: 132980 - DNA, 22 bp, Artificial Sequence
  Synthetic oligonucleotide; TTT chr11 5288125 5288146 5288130 5288125 -
aaaagaaataacaggagactgc

SEQ ID NO: 132981 - DNA, 22 bp, Artificial Sequence
  Synthetic oligonucleotide; TTA chr11 5288124 5288145 5288129 5288124 -
aaagaaataacaggagactgcc

SEQ ID NO: 132982 - DNA, 22 bp, Artificial Sequence
  Synthetic oligonucleotide; CTG chr11 5288104 5288125 5288109 5288104 -
cccagccctggctgtgacatgg

SEQ ID NO: 132983 - DNA, 22 bp, Artificial Sequence
  Synthetic oligonucleotide; CTG chr11 5288094 5288115 5288099 5288094 -
gctgtgacatggaaactatgta

SEQ ID NO: 132984 - DNA, 22 bp, Artificial Sequence
  Synthetic oligonucleotide; CTG chr11 5288090 5288111 5288095 5288090 -
tgacatggaaactatgtagaat

SEQ ID NO: 132985 - DNA, 22 bp, Artificial Sequence
  Synthetic oligonucleotide; CTA chr11 5288076 5288097 5288081 5288076 -
tgtagaatattttgggttccat

SEQ ID NO: 132986 - DNA, 22 bp, Artificial Sequence
  Synthetic oligonucleotide; TTT chr11 5288064 5288085 5288069 5288064 -
tgggttccatttttttttcctt

SEQ ID NO: 132987 - DNA, 22 bp, Artificial Sequence
  Synthetic oligonucleotide; TTT chr11 5288063 5288084 5288068 5288063 -
gggttccatttttttttccttc

SEQ ID NO: 132988 - DNA, 22 bp, Artificial Sequence
  Synthetic oligonucleotide; TTG chr11 5288062 5288083 5288067 5288062 -
ggttccatttttttttccttct

SEQ ID NO: 132989 - DNA, 22 bp, Artificial Sequence
  Synthetic oligonucleotide; TTC chr11 5288057 5288078 5288062 5288057 -
catttttttttccttctttcag

SEQ ID NO: 132990 - DNA, 22 bp, Artificial Sequence
  Synthetic oligonucleotide; TTT chr11 5288052 5288073 5288057 5288052 -
ttttttccttctttcagttaga

SEQ ID NO: 132991 - DNA, 22 bp, Artificial Sequence
  Synthetic oligonucleotide; TTT chr11 5288051 5288072 5288056 5288051 -
tttttccttctttcagttagag

SEQ ID NO: 132992 - DNA, 22 bp, Artificial Sequence
  Synthetic oligonucleotide; TTT chr11 5288050 5288071 5288055 5288050 -
ttttccttctttcagttagagg

SEQ ID NO: 132993 - DNA, 22 bp, Artificial Sequence
  Synthetic oligonucleotide; TTT chr11 5288049 5288070 5288054 5288049 -
tttccttctttcagttagagga

SEQ ID NO: 132994 - DNA, 22 bp, Artificial Sequence
  Synthetic oligonucleotide; TTT chr11 5288048 5288069 5288053 5288048 -
ttccttctttcagttagaggaa

SEQ ID NO: 132995 - DNA, 22 bp, Artificial Sequence
  Synthetic oligonucleotide; TTT chr11 5288047 5288068 5288052 5288047 -
tccttctttcagttagaggaaa

SEQ ID NO: 132996 - DNA, 22 bp, Artificial Sequence
  Synthetic oligonucleotide; TTT chr11 5288046 5288067 5288051 5288046 -
ccttctttcagttagaggaaaa

SEQ ID NO: 132997 - DNA, 22 bp, Artificial Sequence
  Synthetic oligonucleotide; TTC chr11 5288045 5288066 5288050 5288045 -
cttctttcagttagaggaaaag

SEQ ID NO: 132998 - DNA, 22 bp, Artificial Sequence
  Synthetic oligonucleotide; CTT chr11 5288042 5288063 5288047 5288042 -
ctttcagttagaggaaaagggg

SEQ ID NO: 132999 - DNA, 22 bp, Artificial Sequence
  Synthetic oligonucleotide; TTC chr11 5288041 5288062 5288046 5288041 -
tttcagttagaggaaaaggggc

SEQ ID NO: 133000 - DNA, 22 bp, Artificial Sequence
  Synthetic oligonucleotide; CTT chr11 5288039 5288060 5288044 5288039 -
tcagttagaggaaaaggggctc

SEQ ID NO: 133001 - DNA, 22 bp, Artificial Sequence
  Synthetic oligonucleotide; TTT chr11 5288038 5288059 5288043 5288038 -
cagttagaggaaaaggggctca

SEQ ID NO: 133002 - DNA, 22 bp, Artificial Sequence
  Synthetic oligonucleotide; TTC chr11 5288037 5288058 5288042 5288037 -
agttagaggaaaaggggctcac

SEQ ID NO: 133003 - DNA, 22 bp, Artificial Sequence
  Synthetic oligonucleotide; TTA chr11 5288032 5288053 5288037 5288032 -
gaggaaaaggggctcactgcac

SEQ ID NO: 133004 - DNA, 22 bp, Artificial Sequence
  Synthetic oligonucleotide; CTC chr11 5288017 5288038 5288022 5288017 -
actgcacatacactagacagaa

SEQ ID NO: 133005 - DNA, 22 bp, Artificial Sequence
  Synthetic oligonucleotide; CTG chr11 5288013 5288034 5288018 5288013 -
cacatacactagacagaaagtc

SEQ ID NO: 133006 - DNA, 22 bp, Artificial Sequence
  Synthetic oligonucleotide; CTA chr11 5288002 5288023 5288007 5288002 -
gacagaaagtcaggagctttga

SEQ ID NO: 133007 - DNA, 22 bp, Artificial Sequence
  Synthetic oligonucleotide; CTT chr11 5287983 5288004 5287988 5287983 -
tgaatccaagcctgatcatttc

SEQ ID NO: 133008 - DNA, 22 bp, Artificial Sequence
  Synthetic oligonucleotide; TTT chr11 5287982 5288003 5287987 5287982 -
gaatccaagcctgatcatttcc

SEQ ID NO: 133009 - DNA, 22 bp, Artificial Sequence
  Synthetic oligonucleotide; TTG chr11 5287981 5288002 5287986 5287981 -
aatccaagcctgatcatttcca

SEQ ID NO: 133010 - DNA, 22 bp, Artificial Sequence
  Synthetic oligonucleotide; CTG chr11 5287969 5287990 5287974 5287969 -
atcatttccatgtcatactgag

SEQ ID NO: 133011 - DNA, 22 bp, Artificial Sequence
  Synthetic oligonucleotide; TTT chr11 5287962 5287983 5287967 5287962 -
ccatgtcatactgagaaagtcc

SEQ ID NO: 133012 - DNA, 22 bp, Artificial Sequence
  Synthetic oligonucleotide; TTC chr11 5287961 5287982 5287966 5287961 -
catgtcatactgagaaagtccc

SEQ ID NO: 133013 - DNA, 22 bp, Artificial Sequence
  Synthetic oligonucleotide; CTG chr11 5287949 5287970 5287954 5287949 -
agaaagtccccacccttctctg

SEQ ID NO: 133014 - DNA, 22 bp, Artificial Sequence
  Synthetic oligonucleotide; CTT chr11 5287932 5287953 5287937 5287932 -
ctctgagcctcagtttctcttt

SEQ ID NO: 133015 - DNA, 22 bp, Artificial Sequence
  Synthetic oligonucleotide; TTC chr11 5287931 5287952 5287936 5287931 -
tctgagcctcagtttctctttt

SEQ ID NO: 133016 - DNA, 22 bp, Artificial Sequence
  Synthetic oligonucleotide; CTC chr11 5287929 5287950 5287934 5287929 -
tgagcctcagtttctcttttta

SEQ ID NO: 133017 - DNA, 22 bp, Artificial Sequence
  Synthetic oligonucleotide; CTG chr11 5287927 5287948 5287932 5287927 -
agcctcagtttctctttttata

SEQ ID NO: 133018 - DNA, 22 bp, Artificial Sequence
  Synthetic oligonucleotide; CTC chr11 5287921 5287942 5287926 5287921 -
agtttctctttttataagtagg

SEQ ID NO: 133019 - DNA, 22 bp, Artificial Sequence
  Synthetic oligonucleotide; TTT chr11 5287916 5287937 5287921 5287916 -
ctctttttataagtaggagtct

SEQ ID NO: 133020 - DNA, 22 bp, Artificial Sequence
  Synthetic oligonucleotide; TTC chr11 5287915 5287936 5287920 5287915 -
tctttttataagtaggagtctg

SEQ ID NO: 133021 - DNA, 22 bp, Artificial Sequence
  Synthetic oligonucleotide; CTC chr11 5287913 5287934 5287918 5287913 -
tttttataagtaggagtctgga

SEQ ID NO: 133022 - DNA, 22 bp, Artificial Sequence
  Synthetic oligonucleotide; CTT chr11 5287911 5287932 5287916 5287911 -
tttataagtaggagtctggagt

SEQ ID NO: 133023 - DNA, 22 bp, Artificial Sequence
  Synthetic oligonucleotide; TTT chr11 5287910 5287931 5287915 5287910 -
ttataagtaggagtctggagta

SEQ ID NO: 133024 - DNA, 22 bp, Artificial Sequence
  Synthetic oligonucleotide; TTT chr11 5287909 5287930 5287914 5287909 -
tataagtaggagtctggagtaa

SEQ ID NO: 133025 - DNA, 22 bp, Artificial Sequence
  Synthetic oligonucleotide; TTT chr11 5287908 5287929 5287913 5287908 -
ataagtaggagtctggagtaaa

SEQ ID NO: 133026 - DNA, 22 bp, Artificial Sequence
  Synthetic oligonucleotide; TTA chr11 5287907 5287928 5287912 5287907 -
taagtaggagtctggagtaaat

SEQ ID NO: 133027 - DNA, 22 bp, Artificial Sequence
  Synthetic oligonucleotide; CTG chr11 5287893 5287914 5287898 5287893 -
gagtaaatgatttccaatggct

SEQ ID NO: 133028 - DNA, 22 bp, Artificial Sequence
  Synthetic oligonucleotide; TTT chr11 5287880 5287901 5287885 5287880 -
ccaatggctctcatttcaatac

SEQ ID NO: 133029 - DNA, 22 bp, Artificial Sequence
  Synthetic oligonucleotide; TTC chr11 5287879 5287900 5287884 5287879 -
caatggctctcatttcaataca

SEQ ID NO: 133030 - DNA, 22 bp, Artificial Sequence
  Synthetic oligonucleotide; CTC chr11 5287870 5287891 5287875 5287870 -
tcatttcaatacaaaatttccg

SEQ ID NO: 133031 - DNA, 22 bp, Artificial Sequence
  Synthetic oligonucleotide; CTC chr11 5287868 5287889 5287873 5287868 -
atttcaatacaaaatttccgtt

SEQ ID NO: 133032 - DNA, 22 bp, Artificial Sequence
  Synthetic oligonucleotide; TTT chr11 5287864 5287885 5287869 5287864 -
caatacaaaatttccgtttatt

SEQ ID NO: 133033 - DNA, 22 bp, Artificial Sequence
  Synthetic oligonucleotide; TTC chr11 5287863 5287884 5287868 5287863 -
aatacaaaatttccgtttatta

SEQ ID NO: 133034 - DNA, 22 bp, Artificial Sequence
  Synthetic oligonucleotide; TTT chr11 5287851 5287872 5287856 5287851 -
ccgtttattaaatgcatgagct

SEQ ID NO: 133035 - DNA, 22 bp, Artificial Sequence
  Synthetic oligonucleotide; TTC chr11 5287850 5287871 5287855 5287850 -
cgtttattaaatgcatgagctt

SEQ ID NO: 133036 - DNA, 22 bp, Artificial Sequence
  Synthetic oligonucleotide; TTT chr11 5287845 5287866 5287850 5287845 -
attaaatgcatgagcttctgtt

SEQ ID NO: 133037 - DNA, 22 bp, Artificial Sequence
  Synthetic oligonucleotide; TTA chr11 5287844 5287865 5287849 5287844 -
ttaaatgcatgagcttctgtta

SEQ ID NO: 133038 - DNA, 22 bp, Artificial Sequence
  Synthetic oligonucleotide; TTA chr11 5287841 5287862 5287846 5287841 -
aatgcatgagcttctgttactc

SEQ ID NO: 133039 - DNA, 22 bp, Artificial Sequence
  Synthetic oligonucleotide; CTT chr11 5287828 5287849 5287833 5287828 -
ctgttactccaagactgagaag

SEQ ID NO: 133040 - DNA, 22 bp, Artificial Sequence
  Synthetic oligonucleotide; TTC chr11 5287827 5287848 5287832 5287827 -
tgttactccaagactgagaagg

SEQ ID NO: 133041 - DNA, 22 bp, Artificial Sequence
  Synthetic oligonucleotide; CTG chr11 5287825 5287846 5287830 5287825 -
ttactccaagactgagaaggaa

SEQ ID NO: 133042 - DNA, 22 bp, Artificial Sequence
  Synthetic oligonucleotide; TTA chr11 5287822 5287843 5287827 5287822 -
ctccaagactgagaaggaaatt

SEQ ID NO: 133043 - DNA, 22 bp, Artificial Sequence
  Synthetic oligonucleotide; CTC chr11 5287819 5287840 5287824 5287819 -
caagactgagaaggaaattgaa

SEQ ID NO: 133044 - DNA, 22 bp, Artificial Sequence
  Synthetic oligonucleotide; CTG chr11 5287811 5287832 5287816 5287811 -
agaaggaaattgaacctgagac

SEQ ID NO: 133045 - DNA, 22 bp, Artificial Sequence
  Synthetic oligonucleotide; TTG chr11 5287799 5287820 5287804 5287799 -
aacctgagactcattgactggc

SEQ ID NO: 133046 - DNA, 22 bp, Artificial Sequence
  Synthetic oligonucleotide; CTG chr11 5287793 5287814 5287798 5287793 -
agactcattgactggcaagatg

SEQ ID NO: 133047 - DNA, 22 bp, Artificial Sequence
  Synthetic oligonucleotide; CTC chr11 5287787 5287808 5287792 5287787 -
attgactggcaagatgtcccca

SEQ ID NO: 133048 - DNA, 22 bp, Artificial Sequence
  Synthetic oligonucleotide; TTG chr11 5287783 5287804 5287788 5287783 -
actggcaagatgtccccagagg

SEQ ID NO: 133049 - DNA, 22 bp, Artificial Sequence
  Synthetic oligonucleotide; CTG chr11 5287779 5287800 5287784 5287779 -
gcaagatgtccccagaggctct

SEQ ID NO: 133050 - DNA, 22 bp, Artificial Sequence
  Synthetic oligonucleotide; CTC chr11 5287758 5287779 5287763 5287758 -
tcattcagcaataaaattctca

SEQ ID NO: 133051 - DNA, 22 bp, Artificial Sequence
  Synthetic oligonucleotide; CTC chr11 5287756 5287777 5287761 5287756 -
attcagcaataaaattctcacc

SEQ ID NO: 133052 - DNA, 22 bp, Artificial Sequence
  Synthetic oligonucleotide; TTC chr11 5287752 5287773 5287757 5287752 -
agcaataaaattctcaccttca

SEQ ID NO: 133053 - DNA, 22 bp, Artificial Sequence
  Synthetic oligonucleotide; TTC chr11 5287739 5287760 5287744 5287739 -
tcaccttcacccaggcccactg

SEQ ID NO: 133054 - DNA, 22 bp, Artificial Sequence
  Synthetic oligonucleotide; CTC chr11 5287737 5287758 5287742 5287737 -
accttcacccaggcccactgag

SEQ ID NO: 133055 - DNA, 22 bp, Artificial Sequence
  Synthetic oligonucleotide; CTT chr11 5287732 5287753 5287737 5287732 -
cacccaggcccactgagtgtca

SEQ ID NO: 133056 - DNA, 22 bp, Artificial Sequence
  Synthetic oligonucleotide; TTC chr11 5287731 5287752 5287736 5287731 -
acccaggcccactgagtgtcag

SEQ ID NO: 133057 - DNA, 22 bp, Artificial Sequence
  Synthetic oligonucleotide; CTG chr11 5287717 5287738 5287722 5287717 -
agtgtcagatttgcatgcacta

SEQ ID NO: 133058 - DNA, 22 bp, Artificial Sequence
  Synthetic oligonucleotide; TTT chr11 5287705 5287726 5287710 5287705 -
gcatgcactagttcacgtgtgt

SEQ ID NO: 133059 - DNA, 22 bp, Artificial Sequence
  Synthetic oligonucleotide; TTG chr11 5287704 5287725 5287709 5287704 -
catgcactagttcacgtgtgta

SEQ ID NO: 133060 - DNA, 22 bp, Artificial Sequence
  Synthetic oligonucleotide; CTA chr11 5287695 5287716 5287700 5287695 -
gttcacgtgtgtaaaaaggagg

SEQ ID NO: 133061 - DNA, 22 bp, Artificial Sequence
  Synthetic oligonucleotide; TTC chr11 5287691 5287712 5287696 5287691 -
acgtgtgtaaaaaggaggatgc

SEQ ID NO: 133062 - DNA, 22 bp, Artificial Sequence
  Synthetic oligonucleotide; CTT chr11 5287667 5287688 5287672 5287667 -
ctttcctttgtattctcacata

SEQ ID NO: 133063 - DNA, 22 bp, Artificial Sequence
  Synthetic oligonucleotide; TTC chr11 5287666 5287687 5287671 5287666 -
tttcctttgtattctcacatac

SEQ ID NO: 133064 - DNA, 22 bp, Artificial Sequence
  Synthetic oligonucleotide; CTT chr11 5287664 5287685 5287669 5287664 -
tcctttgtattctcacatacct

SEQ ID NO: 133065 - DNA, 22 bp, Artificial Sequence
  Synthetic oligonucleotide; TTT chr11 5287663 5287684 5287668 5287663 -
cctttgtattctcacatacctt

SEQ ID NO: 133066 - DNA, 22 bp, Artificial Sequence
  Synthetic oligonucleotide; TTC chr11 5287662 5287683 5287667 5287662 -
ctttgtattctcacataccttt

SEQ ID NO: 133067 - DNA, 22 bp, Artificial Sequence
  Synthetic oligonucleotide; CTT chr11 5287659 5287680 5287664 5287659 -
tgtattctcacatacctttagg

SEQ ID NO: 133068 - DNA, 22 bp, Artificial Sequence
  Synthetic oligonucleotide; TTT chr11 5287658 5287679 5287663 5287658 -
gtattctcacatacctttagga

SEQ ID NO: 133069 - DNA, 22 bp, Artificial Sequence
  Synthetic oligonucleotide; TTG chr11 5287657 5287678 5287662 5287657 -
tattctcacatacctttaggaa

SEQ ID NO: 133070 - DNA, 22 bp, Artificial Sequence
  Synthetic oligonucleotide; TTC chr11 5287652 5287673 5287657 5287652 -
tcacatacctttaggaaagaac

SEQ ID NO: 133071 - DNA, 22 bp, Artificial Sequence
  Synthetic oligonucleotide; CTC chr11 5287650 5287671 5287655 5287650 -
acatacctttaggaaagaactt

SEQ ID NO: 133072 - DNA, 22 bp, Artificial Sequence
  Synthetic oligonucleotide; CTT chr11 5287641 5287662 5287646 5287641 -
taggaaagaacttagcaccctt

SEQ ID NO: 133073 - DNA, 22 bp, Artificial Sequence
  Synthetic oligonucleotide; TTT chr11 5287640 5287661 5287645 5287640 -
aggaaagaacttagcacccttc

SEQ ID NO: 133074 - DNA, 22 bp, Artificial Sequence
  Synthetic oligonucleotide; TTA chr11 5287639 5287660 5287644 5287639 -
ggaaagaacttagcacccttcc

SEQ ID NO: 133075 - DNA, 22 bp, Artificial Sequence
  Synthetic oligonucleotide; CTT chr11 5287628 5287649 5287633 5287628 -
agcacccttcccacacagccat

SEQ ID NO: 133076 - DNA, 22 bp, Artificial Sequence
  Synthetic oligonucleotide; TTA chr11 5287627 5287648 5287632 5287627 -
gcacccttcccacacagccatc

SEQ ID NO: 133077 - DNA, 22 bp, Artificial Sequence
  Synthetic oligonucleotide; CTT chr11 5287619 5287640 5287624 5287619 -
cccacacagccatcccaataac

SEQ ID NO: 133078 - DNA, 22 bp, Artificial Sequence
  Synthetic oligonucleotide; TTC chr11 5287618 5287639 5287623 5287618 -
ccacacagccatcccaataact

SEQ ID NO: 133079 - DNA, 22 bp, Artificial Sequence
  Synthetic oligonucleotide; CTC chr11 5287595 5287616 5287600 5287595 -
atttcagtgactcaacccttga

SEQ ID NO: 133080 - DNA, 22 bp, Artificial Sequence
  Synthetic oligonucleotide; TTT chr11 5287591 5287612 5287596 5287591 -
cagtgactcaacccttgacttt

SEQ ID NO: 133081 - DNA, 22 bp, Artificial Sequence
  Synthetic oligonucleotide; TTC chr11 5287590 5287611 5287595 5287590 -
agtgactcaacccttgacttta

SEQ ID NO: 133082 - DNA, 22 bp, Artificial Sequence
  Synthetic oligonucleotide; CTC chr11 5287582 5287603 5287587 5287582 -
aacccttgactttataaaagtc

SEQ ID NO: 133083 - DNA, 22 bp, Artificial Sequence
  Synthetic oligonucleotide; CTT chr11 5287575 5287596 5287580 5287575 -
gactttataaaagtcttgggca

SEQ ID NO: 133084 - DNA, 22 bp, Artificial Sequence
  Synthetic oligonucleotide; TTG chr11 5287574 5287595 5287579 5287574 -
actttataaaagtcttgggcag

SEQ ID NO: 133085 - DNA, 22 bp, Artificial Sequence
  Synthetic oligonucleotide; CTT chr11 5287570 5287591 5287575 5287570 -
tataaaagtcttgggcagtata

SEQ ID NO: 133086 - DNA, 22 bp, Artificial Sequence
  Synthetic oligonucleotide; TTT chr11 5287569 5287590 5287574 5287569 -
ataaaagtcttgggcagtatag

SEQ ID NO: 133087 - DNA, 22 bp, Artificial Sequence
  Synthetic oligonucleotide; TTA chr11 5287568 5287589 5287573 5287568 -
taaaagtcttgggcagtataga

SEQ ID NO: 133088 - DNA, 22 bp, Artificial Sequence
  Synthetic oligonucleotide; CTT chr11 5287558 5287579 5287563 5287558 -
gggcagtatagagcagagatta

SEQ ID NO: 133089 - DNA, 22 bp, Artificial Sequence
  Synthetic oligonucleotide; TTG chr11 5287557 5287578 5287562 5287557 -
ggcagtatagagcagagattaa

SEQ ID NO: 133090 - DNA, 22 bp, Artificial Sequence
  Synthetic oligonucleotide; TTA chr11 5287536 5287557 5287541 5287536 -
agagtacagatgctggagccag

SEQ ID NO: 133091 - DNA, 22 bp, Artificial Sequence
  Synthetic oligonucleotide; CTG chr11 5287521 5287542 5287526 5287521 -
gagccagaccacctgagtgatt

SEQ ID NO: 133092 - DNA, 22 bp, Artificial Sequence
  Synthetic oligonucleotide; CTG chr11 5287506 5287527 5287511 5287506 -
agtgattagtgactcagtttct

SEQ ID NO: 133093 - DNA, 22 bp, Artificial Sequence
  Synthetic oligonucleotide; TTA chr11 5287498 5287519 5287503 5287498 -
gtgactcagtttctcttagtag

SEQ ID NO: 133094 - DNA, 22 bp, Artificial Sequence
  Synthetic oligonucleotide; CTC chr11 5287491 5287512 5287496 5287491 -
agtttctcttagtagttgtatg

SEQ ID NO: 133095 - DNA, 22 bp, Artificial Sequence
  Synthetic oligonucleotide; TTT chr11 5287486 5287507 5287491 5287486 -
ctcttagtagttgtatgactca

SEQ ID NO: 133096 - DNA, 22 bp, Artificial Sequence
  Synthetic oligonucleotide; TTC chr11 5287485 5287506 5287490 5287485 -
tcttagtagttgtatgactcag

SEQ ID NO: 133097 - DNA, 22 bp, Artificial Sequence
  Synthetic oligonucleotide; CTC chr11 5287483 5287504 5287488 5287483 -
ttagtagttgtatgactcagtt

SEQ ID NO: 133098 - DNA, 22 bp, Artificial Sequence
  Synthetic oligonucleotide; CTT chr11 5287481 5287502 5287486 5287481 -
agtagttgtatgactcagtttc

SEQ ID NO: 133099 - DNA, 22 bp, Artificial Sequence
  Synthetic oligonucleotide; TTA chr11 5287480 5287501 5287485 5287480 -
gtagttgtatgactcagtttct

SEQ ID NO: 133100 - DNA, 22 bp, Artificial Sequence
  Synthetic oligonucleotide; TTG chr11 5287473 5287494 5287478 5287473 -
tatgactcagtttcttcatctg

SEQ ID NO: 133101 - DNA, 22 bp, Artificial Sequence
  Synthetic oligonucleotide; CTC chr11 5287465 5287486 5287470 5287465 -
agtttcttcatctgtaaaatgg

SEQ ID NO: 133102 - DNA, 22 bp, Artificial Sequence
  Synthetic oligonucleotide; TTT chr11 5287460 5287481 5287465 5287460 -
cttcatctgtaaaatggagggt

SEQ ID NO: 133103 - DNA, 22 bp, Artificial Sequence
  Synthetic oligonucleotide; TTC chr11 5287459 5287480 5287464 5287459 -
ttcatctgtaaaatggagggtt

SEQ ID NO: 133104 - DNA, 22 bp, Artificial Sequence
  Synthetic oligonucleotide; CTT chr11 5287457 5287478 5287462 5287457 -
catctgtaaaatggagggtttt

SEQ ID NO: 133105 - DNA, 22 bp, Artificial Sequence
  Synthetic oligonucleotide; TTC chr11 5287456 5287477 5287461 5287456 -
atctgtaaaatggagggttttt

SEQ ID NO: 133106 - DNA, 22 bp, Artificial Sequence
  Synthetic oligonucleotide; CTG chr11 5287451 5287472 5287456 5287451 -
taaaatggagggttttttaatt

SEQ ID NO: 133107 - DNA, 22 bp, Artificial Sequence
  Synthetic oligonucleotide; TTT chr11 5287436 5287457 5287441 5287436 -
tttaattagtttgtttttgaga

SEQ ID NO: 133108 - DNA, 22 bp, Artificial Sequence
  Synthetic oligonucleotide; TTT chr11 5287435 5287456 5287440 5287435 -
ttaattagtttgtttttgagaa

SEQ ID NO: 133109 - DNA, 22 bp, Artificial Sequence
  Synthetic oligonucleotide; TTT chr11 5287434 5287455 5287439 5287434 -
taattagtttgtttttgagaaa

SEQ ID NO: 133110 - DNA, 22 bp, Artificial Sequence
  Synthetic oligonucleotide; TTT chr11 5287433 5287454 5287438 5287433 -
aattagtttgtttttgagaaag

SEQ ID NO: 133111 - DNA, 22 bp, Artificial Sequence
  Synthetic oligonucleotide; TTA chr11 5287432 5287453 5287437 5287432 -
attagtttgtttttgagaaagg

SEQ ID NO: 133112 - DNA, 22 bp, Artificial Sequence
  Synthetic oligonucleotide; TTA chr11 5287428 5287449 5287433 5287428 -
gtttgtttttgagaaagggtct

SEQ ID NO: 133113 - DNA, 22 bp, Artificial Sequence
  Synthetic oligonucleotide; TTT chr11 5287424 5287445 5287429 5287424 -
gtttttgagaaagggtctcact

SEQ ID NO: 133114 - DNA, 22 bp, Artificial Sequence
  Synthetic oligonucleotide; TTG chr11 5287423 5287444 5287428 5287423 -
tttttgagaaagggtctcactc

SEQ ID NO: 133115 - DNA, 22 bp, Artificial Sequence
  Synthetic oligonucleotide; TTT chr11 5287420 5287441 5287425 5287420 -
ttgagaaagggtctcactctgt

SEQ ID NO: 133116 - DNA, 22 bp, Artificial Sequence
  Synthetic oligonucleotide; TTT chr11 5287419 5287440 5287424 5287419 -
tgagaaagggtctcactctgtc

SEQ ID NO: 133117 - DNA, 22 bp, Artificial Sequence
  Synthetic oligonucleotide; TTT chr11 5287418 5287439 5287423 5287418 -
gagaaagggtctcactctgtca

SEQ ID NO: 133118 - DNA, 22 bp, Artificial Sequence
  Synthetic oligonucleotide; TTG chr11 5287417 5287438 5287422 5287417 -
agaaagggtctcactctgtcac

SEQ ID NO: 133119 - DNA, 22 bp, Artificial Sequence
  Synthetic oligonucleotide; CTC chr11 5287405 5287426 5287410 5287405 -
actctgtcacccaaatgggagt

SEQ ID NO: 133120 - DNA, 22 bp, Artificial Sequence
  Synthetic oligonucleotide; CTC chr11 5287401 5287422 5287406 5287401 -
tgtcacccaaatgggagtgtag

SEQ ID NO: 133121 - DNA, 22 bp, Artificial Sequence
  Synthetic oligonucleotide; CTG chr11 5287399 5287420 5287404 5287399 -
tcacccaaatgggagtgtagtg

SEQ ID NO: 133122 - DNA, 22 bp, Artificial Sequence
  Synthetic oligonucleotide; CTC chr11 5287367 5287388 5287372 5287367 -
ggctcactgcaacttgcacttc

SEQ ID NO: 133123 - DNA, 22 bp, Artificial Sequence
  Synthetic oligonucleotide; CTC chr11 5287362 5287383 5287367 5287362 -
actgcaacttgcacttcccagg

SEQ ID NO: 133124 - DNA, 22 bp, Artificial Sequence
  Synthetic oligonucleotide; CTG chr11 5287358 5287379 5287363 5287358 -
caacttgcacttcccaggctca

SEQ ID NO: 133125 - DNA, 22 bp, Artificial Sequence
  Synthetic oligonucleotide; CTT chr11 5287352 5287373 5287357 5287352 -
gcacttcccaggctcaagcggt

SEQ ID NO: 133126 - DNA, 22 bp, Artificial Sequence
  Synthetic oligonucleotide; TTG chr11 5287351 5287372 5287356 5287351 -
cacttcccaggctcaagcggtc

SEQ ID NO: 133127 - DNA, 22 bp, Artificial Sequence
  Synthetic oligonucleotide; CTT chr11 5287346 5287367 5287351 5287346 -
cccaggctcaagcggtcctccc

SEQ ID NO: 133128 - DNA, 22 bp, Artificial Sequence
  Synthetic oligonucleotide; TTC chr11 5287345 5287366 5287350 5287345 -
ccaggctcaagcggtcctccca

SEQ ID NO: 133129 - DNA, 22 bp, Artificial Sequence
  Synthetic oligonucleotide; CTC chr11 5287337 5287358 5287342 5287337 -
aagcggtcctcccacctcaaca

SEQ ID NO: 133130 - DNA, 22 bp, Artificial Sequence
  Synthetic oligonucleotide; CTC chr11 5287326 5287347 5287331 5287326 -
ccacctcaacatcctgagtagc

SEQ ID NO: 133131 - DNA, 22 bp, Artificial Sequence
  Synthetic oligonucleotide; CTC chr11 5287319 5287340 5287324 5287319 -
aacatcctgagtagctggaacc

SEQ ID NO: 133132 - DNA, 22 bp, Artificial Sequence
  Synthetic oligonucleotide; CTG chr11 5287310 5287331 5287315 5287310 -
agtagctggaaccacaggtaca

SEQ ID NO: 133133 - DNA, 22 bp, Artificial Sequence
  Synthetic oligonucleotide; CTG chr11 5287302 5287323 5287307 5287302 -
gaaccacaggtacacaccacca

SEQ ID NO: 133134 - DNA, 22 bp, Artificial Sequence
  Synthetic oligonucleotide; CTC chr11 5287274 5287295 5287279 5287274 -
gctaattttttgtatttttggt

SEQ ID NO: 133135 - DNA, 22 bp, Artificial Sequence
  Synthetic oligonucleotide; CTA chr11 5287270 5287291 5287275 5287270 -
attttttgtatttttggtagag

SEQ ID NO: 133136 - DNA, 22 bp, Artificial Sequence
  Synthetic oligonucleotide; TTT chr11 5287266 5287287 5287271 5287266 -
tttgtatttttggtagagatgg

SEQ ID NO: 133137 - DNA, 22 bp, Artificial Sequence
  Synthetic oligonucleotide; TTT chr11 5287265 5287286 5287270 5287265 -
ttgtatttttggtagagatggg

SEQ ID NO: 133138 - DNA, 22 bp, Artificial Sequence
  Synthetic oligonucleotide; TTT chr11 5287264 5287285 5287269 5287264 -
tgtatttttggtagagatgggg

SEQ ID NO: 133139 - DNA, 22 bp, Artificial Sequence
  Synthetic oligonucleotide; TTT chr11 5287263 5287284 5287268 5287263 -
gtatttttggtagagatggggt

SEQ ID NO: 133140 - DNA, 22 bp, Artificial Sequence
  Synthetic oligonucleotide; TTG chr11 5287262 5287283 5287267 5287262 -
tatttttggtagagatggggtt

SEQ ID NO: 133141 - DNA, 22 bp, Artificial Sequence
  Synthetic oligonucleotide; TTT chr11 5287257 5287278 5287262 5287257 -
ttggtagagatggggtttcaca

SEQ ID NO: 133142 - DNA, 22 bp, Artificial Sequence
  Synthetic oligonucleotide; TTT chr11 5287256 5287277 5287261 5287256 -
tggtagagatggggtttcacat

SEQ ID NO: 133143 - DNA, 22 bp, Artificial Sequence
  Synthetic oligonucleotide; TTT chr11 5287255 5287276 5287260 5287255 -
ggtagagatggggtttcacatg

SEQ ID NO: 133144 - DNA, 22 bp, Artificial Sequence
  Synthetic oligonucleotide; TTG chr11 5287254 5287275 5287259 5287254 -
gtagagatggggtttcacatgt

SEQ ID NO: 133145 - DNA, 22 bp, Artificial Sequence
  Synthetic oligonucleotide; TTT chr11 5287239 5287260 5287244 5287239 -
cacatgttacacaggatggtct

SEQ ID NO: 133146 - DNA, 22 bp, Artificial Sequence
  Synthetic oligonucleotide; TTC chr11 5287238 5287259 5287243 5287238 -
acatgttacacaggatggtctc

SEQ ID NO: 133147 - DNA, 22 bp, Artificial Sequence
  Synthetic oligonucleotide; TTA chr11 5287230 5287251 5287235 5287230 -
cacaggatggtctcagactccg

SEQ ID NO: 133148 - DNA, 22 bp, Artificial Sequence
  Synthetic oligonucleotide; CTC chr11 5287216 5287237 5287221 5287216 -
agactccggagctcaagcaatc

SEQ ID NO: 133149 - DNA, 22 bp, Artificial Sequence
  Synthetic oligonucleotide; CTC chr11 5287210 5287231 5287215 5287210 -
cggagctcaagcaatctgccca

SEQ ID NO: 133150 - DNA, 22 bp, Artificial Sequence
  Synthetic oligonucleotide; CTC chr11 5287202 5287223 5287207 5287202 -
aagcaatctgcccacctcagcc

SEQ ID NO: 133151 - DNA, 22 bp, Artificial Sequence
  Synthetic oligonucleotide; CTG chr11 5287192 5287213 5287197 5287192 -
cccacctcagccttccaaagtg

SEQ ID NO: 133152 - DNA, 22 bp, Artificial Sequence
  Synthetic oligonucleotide; CTC chr11 5287184 5287205 5287189 5287184 -
agccttccaaagtgctgggatt

SEQ ID NO: 133153 - DNA, 22 bp, Artificial Sequence
  Synthetic oligonucleotide; CTT chr11 5287178 5287199 5287183 5287178 -
ccaaagtgctgggattataagc

SEQ ID NO: 133154 - DNA, 22 bp, Artificial Sequence
  Synthetic oligonucleotide; TTC chr11 5287177 5287198 5287182 5287177 -
caaagtgctgggattataagca

SEQ ID NO: 133155 - DNA, 22 bp, Artificial Sequence
  Synthetic oligonucleotide; CTG chr11 5287167 5287188 5287172 5287167 -
ggattataagcatgattacagg

SEQ ID NO: 133156 - DNA, 22 bp, Artificial Sequence
  Synthetic oligonucleotide; TTA chr11 5287161 5287182 5287166 5287161 -
taagcatgattacaggagtttt

SEQ ID NO: 133157 - DNA, 22 bp, Artificial Sequence
  Synthetic oligonucleotide; TTA chr11 5287149 5287170 5287154 5287149 -
caggagttttaacaggctcata

SEQ ID NO: 133158 - DNA, 22 bp, Artificial Sequence
  Synthetic oligonucleotide; TTT chr11 5287140 5287161 5287145 5287140 -
taacaggctcataagattgttc

SEQ ID NO: 133159 - DNA, 22 bp, Artificial Sequence
  Synthetic oligonucleotide; TTT chr11 5287139 5287160 5287144 5287139 -
aacaggctcataagattgttct

SEQ ID NO: 133160 - DNA, 22 bp, Artificial Sequence
  Synthetic oligonucleotide; TTA chr11 5287138 5287159 5287143 5287138 -
acaggctcataagattgttctg

SEQ ID NO: 133161 - DNA, 22 bp, Artificial Sequence
  Synthetic oligonucleotide; CTC chr11 5287130 5287151 5287135 5287130 -
ataagattgttctgcagcccga

SEQ ID NO: 133162 - DNA, 22 bp, Artificial Sequence
  Synthetic oligonucleotide; TTG chr11 5287121 5287142 5287126 5287121 -
ttctgcagcccgagtgagttaa

SEQ ID NO: 133163 - DNA, 22 bp, Artificial Sequence
  Synthetic oligonucleotide; TTC chr11 5287118 5287139 5287123 5287118 -
tgcagcccgagtgagttaatac

SEQ ID NO: 133164 - DNA, 22 bp, Artificial Sequence
  Synthetic oligonucleotide; CTG chr11 5287116 5287137 5287121 5287116 -
cagcccgagtgagttaatacat

SEQ ID NO: 133165 - DNA, 22 bp, Artificial Sequence
  Synthetic oligonucleotide; TTA chr11 5287100 5287121 5287105 5287100 -
atacatgcaaagagtttaaagc

SEQ ID NO: 133166 - DNA, 22 bp, Artificial Sequence
  Synthetic oligonucleotide; TTT chr11 5287083 5287104 5287088 5287083 -
aaagcagtgacttataaatgct

SEQ ID NO: 133167 - DNA, 22 bp, Artificial Sequence
  Synthetic oligonucleotide; TTA chr11 5287082 5287103 5287087 5287082 -
aagcagtgacttataaatgcta

SEQ ID NO: 133168 - DNA, 22 bp, Artificial Sequence
  Synthetic oligonucleotide; CTT chr11 5287070 5287091 5287075 5287070 -
ataaatgctaactactctagaa
